United States Patent 9,205,144 (IDENTIFICATION OF CONSERVED PEPTIDE BLOCKS IN HOMOLOGOUS POLYPEPTIDES) - sequence listing, part 3

SEQ ID NO: 54769 - protein, 8 aa, Dengue virus
ARYLEFEA

SEQ ID NO: 54770 - protein, 8 aa, Dengue virus
RYLEFEAL

SEQ ID NO: 54771 - protein, 8 aa, Dengue virus
YLEFEALG

SEQ ID NO: 54772 - protein, 8 aa, Dengue virus
LEFEALGF

SEQ ID NO: 54773 - protein, 8 aa, Dengue virus
EFEALGFL

SEQ ID NO: 54774 - protein, 8 aa, Dengue virus
FEALGFLN

SEQ ID NO: 54775 - protein, 8 aa, Dengue virus
EALGFLNE

SEQ ID NO: 54776 - protein, 8 aa, Dengue virus
ALGFLNED

SEQ ID NO: 54777 - protein, 8 aa, Dengue virus
LGFLNEDH

SEQ ID NO: 54778 - protein, 8 aa, Dengue virus
GFLNEDHW

SEQ ID NO: 54779 - protein, 8 aa, Dengue virus
FLNEDHWF

SEQ ID NO: 54780 - protein, 8 aa, Dengue virus
LNEDHWFS

SEQ ID NO: 54781 - protein, 8 aa, Dengue virus
NEDHWFSR

SEQ ID NO: 54782 - protein, 8 aa, Dengue virus
EDHWFSRE

SEQ ID NO: 54783 - protein, 8 aa, Dengue virus
DHWFSREN

SEQ ID NO: 54784 - protein, 8 aa, Dengue virus
HWFSRENS

SEQ ID NO: 54785 - protein, 8 aa, Dengue virus
WFSRENSY

SEQ ID NO: 54786 - protein, 8 aa, Dengue virus
FSRENSYS

SEQ ID NO: 54787 - protein, 8 aa, Dengue virus
SRENSYSG

SEQ ID NO: 54788 - protein, 8 aa, Dengue virus
RENSYSGV

SEQ ID NO: 54789 - protein, 8 aa, Dengue virus
ENSYSGVE

SEQ ID NO: 54790 - protein, 8 aa, Dengue virus
NSYSGVEG

SEQ ID NO: 54791 - protein, 8 aa, Dengue virus
SYSGVEGE

SEQ ID NO: 54792 - protein, 8 aa, Dengue virus
YSGVEGEG

SEQ ID NO: 54793 - protein, 8 aa, Dengue virus
SGVEGEGL

SEQ ID NO: 54794 - protein, 8 aa, Dengue virus
GVEGEGLH

SEQ ID NO: 54795 - protein, 8 aa, Dengue virus
VEGEGLHK

SEQ ID NO: 54796 - protein, 8 aa, Dengue virus
EGEGLHKL

SEQ ID NO: 54797 - protein, 8 aa, Dengue virus
GEGLHKLG

SEQ ID NO: 54798 - protein, 8 aa, Dengue virus
EGLHKLGY

SEQ ID NO: 54799 - protein, 8 aa, Dengue virus
GLHKLGYI

SEQ ID NO: 54800 - protein, 8 aa, Dengue virus
LHKLGYIL

SEQ ID NO: 54801 - protein, 8 aa, Dengue virus
HKLGYILR

SEQ ID NO: 54802 - protein, 8 aa, Dengue virus
KLGYILRD

SEQ ID NO: 54803 - protein, 8 aa, Dengue virus
LGYILRDI

SEQ ID NO: 54804 - protein, 8 aa, Dengue virus
GYILRDIS

SEQ ID NO: 54805 - protein, 8 aa, Dengue virus
YILRDISK

SEQ ID NO: 54806 - protein, 8 aa, Dengue virus
ILRDISKI

SEQ ID NO: 54807 - protein, 8 aa, Dengue virus
LRDISKIP

SEQ ID NO: 54808 - protein, 8 aa, Dengue virus
RDISKIPG

SEQ ID NO: 54809 - protein, 8 aa, Dengue virus
DISKIPGG

SEQ ID NO: 54810 - protein, 8 aa, Dengue virus
ISKIPGGA

SEQ ID NO: 54811 - protein, 8 aa, Dengue virus
SKIPGGAM

SEQ ID NO: 54812 - protein, 8 aa, Dengue virus
KIPGGAMY

SEQ ID NO: 54813 - protein, 8 aa, Dengue virus
IPGGAMYA

SEQ ID NO: 54814 - protein, 8 aa, Dengue virus
PGGAMYAD

SEQ ID NO: 54815 - protein, 8 aa, Dengue virus
GGAMYADD

SEQ ID NO: 54816 - protein, 8 aa, Dengue virus
GAMYADDT

SEQ ID NO: 54817 - protein, 8 aa, Dengue virus
AMYADDTA

SEQ ID NO: 54818 - protein, 8 aa, Dengue virus
MYADDTAG

SEQ ID NO: 54819 - protein, 8 aa, Dengue virus
YADDTAGW

SEQ ID NO: 54820 - protein, 8 aa, Dengue virus
ADDTAGWD

SEQ ID NO: 54821 - protein, 8 aa, Dengue virus
DDTAGWDT

SEQ ID NO: 54822 - protein, 8 aa, Dengue virus
DTAGWDTR

SEQ ID NO: 54823 - protein, 8 aa, Dengue virus
TAGWDTRI

SEQ ID NO: 54824 - protein, 8 aa, Dengue virus
AGWDTRIT

SEQ ID NO: 54825 - protein, 8 aa, Dengue virus
GWDTRITE

SEQ ID NO: 54826 - protein, 8 aa, Dengue virus
WDTRITED

SEQ ID NO: 54827 - protein, 8 aa, Dengue virus
DTRITEDD

SEQ ID NO: 54828 - protein, 8 aa, Dengue virus
TRITEDDL

SEQ ID NO: 54829 - protein, 8 aa, Dengue virus
RITEDDLH

SEQ ID NO: 54830 - protein, 8 aa, Dengue virus
ITEDDLHN

SEQ ID NO: 54831 - protein, 8 aa, Dengue virus
TEDDLHNE

SEQ ID NO: 54832 - protein, 8 aa, Dengue virus
EDDLHNEE

SEQ ID NO: 54833 - protein, 8 aa, Dengue virus
DDLHNEEK

SEQ ID NO: 54834 - protein, 8 aa, Dengue virus
DLHNEEKI

SEQ ID NO: 54835 - protein, 8 aa, Dengue virus
LHNEEKIT

SEQ ID NO: 54836 - protein, 8 aa, Dengue virus
HNEEKITQ

SEQ ID NO: 54837 - protein, 8 aa, Dengue virus
NEEKITQQ

SEQ ID NO: 54838 - protein, 8 aa, Dengue virus
EEKITQQM

SEQ ID NO: 54839 - protein, 8 aa, Dengue virus
EKITQQMD

SEQ ID NO: 54840 - protein, 8 aa, Dengue virus
KITQQMDP

SEQ ID NO: 54841 - protein, 8 aa, Dengue virus
ITQQMDPE

SEQ ID NO: 54842 - protein, 8 aa, Dengue virus
TQQMDPEH

SEQ ID NO: 54843 - protein, 8 aa, Dengue virus
QQMDPEHR

SEQ ID NO: 54844 - protein, 8 aa, Dengue virus
QMDPEHRQ

SEQ ID NO: 54845 - protein, 8 aa, Dengue virus
MDPEHRQL

SEQ ID NO: 54846 - protein, 8 aa, Dengue virus
DPEHRQLA

SEQ ID NO: 54847 - protein, 8 aa, Dengue virus
PEHRQLAN

SEQ ID NO: 54848 - protein, 8 aa, Dengue virus
EHRQLANA

SEQ ID NO: 54849 - protein, 8 aa, Dengue virus
HRQLANAI

SEQ ID NO: 54850 - protein, 8 aa, Dengue virus
RQLANAIF

SEQ ID NO: 54851 - protein, 8 aa, Dengue virus
QLANAIFK

SEQ ID NO: 54852 - protein, 8 aa, Dengue virus
LANAIFKL

SEQ ID NO: 54853 - protein, 8 aa, Dengue virus
ANAIFKLT

SEQ ID NO: 54854 - protein, 8 aa, Dengue virus
NAIFKLTY

SEQ ID NO: 54855 - protein, 8 aa, Dengue virus
AIFKLTYQ

SEQ ID NO: 54856 - protein, 8 aa, Dengue virus
IFKLTYQN

SEQ ID NO: 54857 - protein, 8 aa, Dengue virus
FKLTYQNK

SEQ ID NO: 54858 - protein, 8 aa, Dengue virus
KLTYQNKV

SEQ ID NO: 54859 - protein, 8 aa, Dengue virus
LTYQNKVV

SEQ ID NO: 54860 - protein, 8 aa, Dengue virus
TYQNKVVK

SEQ ID NO: 54861 - protein, 8 aa, Dengue virus
YQNKVVKV

SEQ ID NO: 54862 - protein, 8 aa, Dengue virus
QNKVVKVQ

SEQ ID NO: 54863 - protein, 8 aa, Dengue virus
NKVVKVQR

SEQ ID NO: 54864 - protein, 8 aa, Dengue virus
KVVKVQRP

SEQ ID NO: 54865 - protein, 8 aa, Dengue virus
VVKVQRPT

SEQ ID NO: 54866 - protein, 8 aa, Dengue virus
VKVQRPTP

SEQ ID NO: 54867 - protein, 8 aa, Dengue virus
KVQRPTPT

SEQ ID NO: 54868 - protein, 8 aa, Dengue virus
VQRPTPTG

SEQ ID NO: 54869 - protein, 8 aa, Dengue virus
QRPTPTGT

SEQ ID NO: 54870 - protein, 8 aa, Dengue virus
RPTPTGTV

SEQ ID NO: 54871 - protein, 8 aa, Dengue virus
PTPTGTVM

SEQ ID NO: 54872 - protein, 8 aa, Dengue virus
TPTGTVMD

SEQ ID NO: 54873 - protein, 8 aa, Dengue virus
PTGTVMDI

SEQ ID NO: 54874 - protein, 8 aa, Dengue virus
TGTVMDII

SEQ ID NO: 54875 - protein, 8 aa, Dengue virus
GTVMDIIS

SEQ ID NO: 54876 - protein, 8 aa, Dengue virus
TVMDIISR

SEQ ID NO: 54877 - protein, 8 aa, Dengue virus
VMDIISRK

SEQ ID NO: 54878 - protein, 8 aa, Dengue virus
MDIISRKD

SEQ ID NO: 54879 - protein, 8 aa, Dengue virus
DIISRKDQ

SEQ ID NO: 54880 - protein, 8 aa, Dengue virus
IISRKDQR

SEQ ID NO: 54881 - protein, 8 aa, Dengue virus
ISRKDQRG

SEQ ID NO: 54882 - protein, 8 aa, Dengue virus
SRKDQRGS

SEQ ID NO: 54883 - protein, 8 aa, Dengue virus
RKDQRGSG

SEQ ID NO: 54884 - protein, 8 aa, Dengue virus
KDQRGSGQ

SEQ ID NO: 54885 - protein, 8 aa, Dengue virus
DQRGSGQV

SEQ ID NO: 54886 - protein, 8 aa, Dengue virus
QRGSGQVG

SEQ ID NO: 54887 - protein, 8 aa, Dengue virus
RGSGQVGT

SEQ ID NO: 54888 - protein, 8 aa, Dengue virus
GSGQVGTY

SEQ ID NO: 54889 - protein, 8 aa, Dengue virus
SGQVGTYG

SEQ ID NO: 54890 - protein, 8 aa, Dengue virus
GQVGTYGL

SEQ ID NO: 54891 - protein, 8 aa, Dengue virus
QVGTYGLN

SEQ ID NO: 54892 - protein, 8 aa, Dengue virus
VGTYGLNT

SEQ ID NO: 54893 - protein, 8 aa, Dengue virus
FTNMEAQL

SEQ ID NO: 54894 - protein, 8 aa, Dengue virus
TNMEAQLI

SEQ ID NO: 54895 - protein, 8 aa, Dengue virus
NMEAQLIR

SEQ ID NO: 54896 - protein, 8 aa, Dengue virus
MEAQLIRQ

SEQ ID NO: 54897 - protein, 8 aa, Dengue virus
EAQLIRQM

SEQ ID NO: 54898 - protein, 8 aa, Dengue virus
AQLIRQME

SEQ ID NO: 54899 - protein, 8 aa, Dengue virus
QLIRQMEG

SEQ ID NO: 54900 - protein, 8 aa, Dengue virus
LIRQMEGE

SEQ ID NO: 54901 - protein, 8 aa, Dengue virus
IRQMEGEG

SEQ ID NO: 54902 - protein, 8 aa, Dengue virus
RQMEGEGV

SEQ ID NO: 54903 - protein, 8 aa, Dengue virus
QMEGEGVL

SEQ ID NO: 54904 - protein, 8 aa, Dengue virus
MEGEGVLS

SEQ ID NO: 54905 - protein, 8 aa, Dengue virus
EGEGVLSK

SEQ ID NO: 54906 - protein, 8 aa, Dengue virus
GEGVLSKA

SEQ ID NO: 54907 - protein, 8 aa, Dengue virus
VLSKADLE

SEQ ID NO: 54908 - protein, 8 aa, Dengue virus
EKKITQWL

SEQ ID NO: 54909 - protein, 8 aa, Dengue virus
KKITQWLE

SEQ ID NO: 54910 - protein, 8 aa, Dengue virus
TQWLETKG

SEQ ID NO: 54911 - protein, 8 aa, Dengue virus
QWLETKGV

SEQ ID NO: 54912 - protein, 8 aa, Dengue virus
WLETKGVE

SEQ ID NO: 54913 - protein, 8 aa, Dengue virus
LETKGVER

SEQ ID NO: 54914 - protein, 8 aa, Dengue virus
ETKGVERL

SEQ ID NO: 54915 - protein, 8 aa, Dengue virus
TKGVERLK

SEQ ID NO: 54916 - protein, 8 aa, Dengue virus
KGVERLKR

SEQ ID NO: 54917 - protein, 8 aa, Dengue virus
GVERLKRM

SEQ ID NO: 54918 - protein, 8 aa, Dengue virus
VERLKRMA

SEQ ID NO: 54919 - protein, 8 aa, Dengue virus
ERLKRMAI

SEQ ID NO: 54920 - protein, 8 aa, Dengue virus
RLKRMAIS

SEQ ID NO: 54921 - protein, 8 aa, Dengue virus
LKRMAISG

SEQ ID NO: 54922 - protein, 8 aa, Dengue virus
KRMAISGD

SEQ ID NO: 54923 - protein, 8 aa, Dengue virus
RMAISGDD

SEQ ID NO: 54924 - protein, 8 aa, Dengue virus
MAISGDDC

SEQ ID NO: 54925 - protein, 8 aa, Dengue virus
AISGDDCV

SEQ ID NO: 54926 - protein, 8 aa, Dengue virus
ISGDDCVV

SEQ ID NO: 54927 - protein, 8 aa, Dengue virus
SGDDCVVK

SEQ ID NO: 54928 - protein, 8 aa, Dengue virus
GDDCVVKP

SEQ ID NO: 54929 - protein, 8 aa, Dengue virus
DDCVVKPI

SEQ ID NO: 54930 - protein, 8 aa, Dengue virus
DCVVKPID

SEQ ID NO: 54931 - protein, 8 aa, Dengue virus
CVVKPIDD

SEQ ID NO: 54932 - protein, 8 aa, Dengue virus
VVKPIDDR

SEQ ID NO: 54933 - protein, 8 aa, Dengue virus
VKPIDDRF

SEQ ID NO: 54934 - protein, 8 aa, Dengue virus
KPIDDRFA

SEQ ID NO: 54935 - protein, 8 aa, Dengue virus
PIDDRFAN

SEQ ID NO: 54936 - protein, 8 aa, Dengue virus
IDDRFANA

SEQ ID NO: 54937 - protein, 8 aa, Dengue virus
DDRFANAL

SEQ ID NO: 54938 - protein, 8 aa, Dengue virus
DRFANALL

SEQ ID NO: 54939 - protein, 8 aa, Dengue virus
RFANALLA

SEQ ID NO: 54940 - protein, 8 aa, Dengue virus
FANALLAL

SEQ ID NO: 54941 - protein, 8 aa, Dengue virus
ANALLALN

SEQ ID NO: 54942 - protein, 8 aa, Dengue virus
NALLALND

SEQ ID NO: 54943 - protein, 8 aa, Dengue virus
ALLALNDM

SEQ ID NO: 54944 - protein, 8 aa, Dengue virus
LLALNDMG

SEQ ID NO: 54945 - protein, 8 aa, Dengue virus
LALNDMGK

SEQ ID NO: 54946 - protein, 8 aa, Dengue virus
ALNDMGKV

SEQ ID NO: 54947 - protein, 8 aa, Dengue virus
LNDMGKVR

SEQ ID NO: 54948 - protein, 8 aa, Dengue virus
NDMGKVRK

SEQ ID NO: 54949 - protein, 8 aa, Dengue virus
DMGKVRKD

SEQ ID NO: 54950 - protein, 8 aa, Dengue virus
MGKVRKDI

SEQ ID NO: 54951 - protein, 8 aa, Dengue virus
GKVRKDIP

SEQ ID NO: 54952 - protein, 8 aa, Dengue virus
KVRKDIPQ

SEQ ID NO: 54953 - protein, 8 aa, Dengue virus
VRKDIPQW

SEQ ID NO: 54954 - protein, 8 aa, Dengue virus
RKDIPQWQ

SEQ ID NO: 54955 - protein, 8 aa, Dengue virus
KDIPQWQP

SEQ ID NO: 54956 - protein, 8 aa, Dengue virus
DIPQWQPS

SEQ ID NO: 54957 - protein, 8 aa, Dengue virus
IPQWQPSK

SEQ ID NO: 54958 - protein, 8 aa, Dengue virus
PQWQPSKG

SEQ ID NO: 54959 - protein, 8 aa, Dengue virus
QWQPSKGW

SEQ ID NO: 54960 - protein, 8 aa, Dengue virus
WQPSKGWH

SEQ ID NO: 54961 - protein, 8 aa, Dengue virus
QPSKGWHD

SEQ ID NO: 54962 - protein, 8 aa, Dengue virus
PSKGWHDW

SEQ ID NO: 54963 - protein, 8 aa, Dengue virus
SKGWHDWQ

SEQ ID NO: 54964 - protein, 8 aa, Dengue virus
KGWHDWQQ

SEQ ID NO: 54965 - protein, 8 aa, Dengue virus
GWHDWQQV

SEQ ID NO: 54966 - protein, 8 aa, Dengue virus
WHDWQQVP

SEQ ID NO: 54967 - protein, 8 aa, Dengue virus
HDWQQVPF

SEQ ID NO: 54968 - protein, 8 aa, Dengue virus
DWQQVPFC

SEQ ID NO: 54969 - protein, 8 aa, Dengue virus
WQQVPFCS

SEQ ID NO: 54970 - protein, 8 aa, Dengue virus
QQVPFCSH

SEQ ID NO: 54971 - protein, 8 aa, Dengue virus
QVPFCSHH

SEQ ID NO: 54972 - protein, 8 aa, Dengue virus
VPFCSHHF

SEQ ID NO: 54973 - protein, 8 aa, Dengue virus
PFCSHHFH

SEQ ID NO: 54974 - protein, 8 aa, Dengue virus
FCSHHFHE

SEQ ID NO: 54975 - protein, 8 aa, Dengue virus
CSHHFHEL

SEQ ID NO: 54976 - protein, 8 aa, Dengue virus
SHHFHELI

SEQ ID NO: 54977 - protein, 8 aa, Dengue virus
HHFHELIM

SEQ ID NO: 54978 - protein, 8 aa, Dengue virus
HFHELIMK

SEQ ID NO: 54979 - protein, 8 aa, Dengue virus
FHELIMKD

SEQ ID NO: 54980 - protein, 8 aa, Dengue virus
HELIMKDG

SEQ ID NO: 54981 - protein, 8 aa, Dengue virus
ELIMKDGR

SEQ ID NO: 54982 - protein, 8 aa, Dengue virus
LIMKDGRK

SEQ ID NO: 54983 - protein, 8 aa, Dengue virus
IMKDGRKL

SEQ ID NO: 54984 - protein, 8 aa, Dengue virus
MKDGRKLV

SEQ ID NO: 54985 - protein, 8 aa, Dengue virus
KDGRKLVV

SEQ ID NO: 54986 - protein, 8 aa, Dengue virus
DGRKLVVP

SEQ ID NO: 54987 - protein, 8 aa, Dengue virus
GRKLVVPC

SEQ ID NO: 54988 - protein, 8 aa, Dengue virus
RKLVVPCR

SEQ ID NO: 54989 - protein, 8 aa, Dengue virus
KLVVPCRP

SEQ ID NO: 54990 - protein, 8 aa, Dengue virus
LVVPCRPQ

SEQ ID NO: 54991 - protein, 8 aa, Dengue virus
VVPCRPQD

SEQ ID NO: 54992 - protein, 8 aa, Dengue virus
VPCRPQDE

SEQ ID NO: 54993 - protein, 8 aa, Dengue virus
PCRPQDEL

SEQ ID NO: 54994 - protein, 8 aa, Dengue virus
CRPQDELI

SEQ ID NO: 54995 - protein, 8 aa, Dengue virus
RPQDELIG

SEQ ID NO: 54996 - protein, 8 aa, Dengue virus
PQDELIGR

SEQ ID NO: 54997 - protein, 8 aa, Dengue virus
QDELIGRA

SEQ ID NO: 54998 - protein, 8 aa, Dengue virus
DELIGRAR

SEQ ID NO: 54999 - protein, 8 aa, Dengue virus
ELIGRARI

SEQ ID NO: 55000 - protein, 8 aa, Dengue virus
LIGRARIS

SEQ ID NO: 55001 - protein, 8 aa, Dengue virus
IGRARISQ

SEQ ID NO: 55002 - protein, 8 aa, Dengue virus
GRARISQG

SEQ ID NO: 55003 - protein, 8 aa, Dengue virus
RARISQGA

SEQ ID NO: 55004 - protein, 8 aa, Dengue virus
ARISQGAG

SEQ ID NO: 55005 - protein, 8 aa, Dengue virus
RISQGAGW

SEQ ID NO: 55006 - protein, 8 aa, Dengue virus
ISQGAGWS

SEQ ID NO: 55007 - protein, 8 aa, Dengue virus
SQGAGWSL

SEQ ID NO: 55008 - protein, 8 aa, Dengue virus
QGAGWSLR

SEQ ID NO: 55009 - protein, 8 aa, Dengue virus
GAGWSLRE

SEQ ID NO: 55010 - protein, 8 aa, Dengue virus
AGWSLRET

SEQ ID NO: 55011 - protein, 8 aa, Dengue virus
GWSLRETA

SEQ ID NO: 55012 - protein, 8 aa, Dengue virus
WSLRETAC

SEQ ID NO: 55013 - protein, 8 aa, Dengue virus
SLRETACL

SEQ ID NO: 55014 - protein, 8 aa, Dengue virus
LRETACLG

SEQ ID NO: 55015 - protein, 8 aa, Dengue virus
RETACLGK

SEQ ID NO: 55016 - protein, 8 aa, Dengue virus
ETACLGKA

SEQ ID NO: 55017 - protein, 8 aa, Dengue virus
TACLGKAY

SEQ ID NO: 55018 - protein, 8 aa, Dengue virus
ACLGKAYA

SEQ ID NO: 55019 - protein, 8 aa, Dengue virus
CLGKAYAQ

SEQ ID NO: 55020 - protein, 8 aa, Dengue virus
LGKAYAQM

SEQ ID NO: 55021 - protein, 8 aa, Dengue virus
GKAYAQMW

SEQ ID NO: 55022 - protein, 8 aa, Dengue virus
KAYAQMWS

SEQ ID NO: 55023 - protein, 8 aa, Dengue virus
AYAQMWSL

SEQ ID NO: 55024 - protein, 8 aa, Dengue virus
YAQMWSLM

SEQ ID NO: 55025 - protein, 8 aa, Dengue virus
AQMWSLMY

SEQ ID NO: 55026 - protein, 8 aa, Dengue virus
QMWSLMYF

SEQ ID NO: 55027 - protein, 8 aa, Dengue virus
MWSLMYFH

SEQ ID NO: 55028 - protein, 8 aa, Dengue virus
WSLMYFHR

SEQ ID NO: 55029 - protein, 8 aa, Dengue virus
SLMYFHRR

SEQ ID NO: 55030 - protein, 8 aa, Dengue virus
LMYFHRRD

SEQ ID NO: 55031 - protein, 8 aa, Dengue virus
MYFHRRDL

SEQ ID NO: 55032 - protein, 8 aa, Dengue virus
YFHRRDLR

SEQ ID NO: 55033 - protein, 8 aa, Dengue virus
FHRRDLRL

SEQ ID NO: 55034 - protein, 8 aa, Dengue virus
HRRDLRLA

SEQ ID NO: 55035 - protein, 8 aa, Dengue virus
RRDLRLAS

SEQ ID NO: 55036 - protein, 8 aa, Dengue virus
RDLRLASN

SEQ ID NO: 55037 - protein, 8 aa, Dengue virus
DLRLASNA

SEQ ID NO: 55038 - protein, 8 aa, Dengue virus
LRLASNAI

SEQ ID NO: 55039 - protein, 8 aa, Dengue virus
RLASNAIC

SEQ ID NO: 55040 - protein, 8 aa, Dengue virus
LASNAICS

SEQ ID NO: 55041 - protein, 8 aa, Dengue virus
ASNAICSA

SEQ ID NO: 55042 - protein, 8 aa, Dengue virus
SNAICSAV

SEQ ID NO: 55043 - protein, 8 aa, Dengue virus
NAICSAVP

SEQ ID NO: 55044 - protein, 8 aa, Dengue virus
AICSAVPV

SEQ ID NO: 55045 - protein, 8 aa, Dengue virus
ICSAVPVH

SEQ ID NO: 55046 - protein, 8 aa, Dengue virus
CSAVPVHW

SEQ ID NO: 55047 - protein, 8 aa, Dengue virus
SAVPVHWV

SEQ ID NO: 55048 - protein, 8 aa, Dengue virus
AVPVHWVP

SEQ ID NO: 55049 - protein, 8 aa, Dengue virus
VPVHWVPT

SEQ ID NO: 55050 - protein, 8 aa, Dengue virus
PVHWVPTS

SEQ ID NO: 55051 - protein, 8 aa, Dengue virus
VHWVPTSR

SEQ ID NO: 55052 - protein, 8 aa, Dengue virus
HWVPTSRT

SEQ ID NO: 55053 - protein, 8 aa, Dengue virus
WVPTSRTT

SEQ ID NO: 55054 - protein, 8 aa, Dengue virus
VPTSRTTW

SEQ ID NO: 55055 - protein, 8 aa, Dengue virus
PTSRTTWS

SEQ ID NO: 55056 - protein, 8 aa, Dengue virus
TSRTTWSI

SEQ ID NO: 55057 - protein, 8 aa, Dengue virus
SRTTWSIH

SEQ ID NO: 55058 - protein, 8 aa, Dengue virus
RTTWSIHA

SEQ ID NO: 55059 - protein, 8 aa, Dengue virus
TTWSIHAH

SEQ ID NO: 55060 - protein, 8 aa, Dengue virus
TWSIHAHH

SEQ ID NO: 55061 - protein, 8 aa, Dengue virus
WSIHAHHQ

SEQ ID NO: 55062 - protein, 8 aa, Dengue virus
SIHAHHQW

SEQ ID NO: 55063 - protein, 8 aa, Dengue virus
IHAHHQWM

SEQ ID NO: 55064 - protein, 8 aa, Dengue virus
HAHHQWMT

SEQ ID NO: 55065 - protein, 8 aa, Dengue virus
AHHQWMTT

SEQ ID NO: 55066 - protein, 8 aa, Dengue virus
HHQWMTTE

SEQ ID NO: 55067 - protein, 8 aa, Dengue virus
HQWMTTED

SEQ ID NO: 55068 - protein, 8 aa, Dengue virus
QWMTTEDM

SEQ ID NO: 55069 - protein, 8 aa, Dengue virus
WMTTEDML

SEQ ID NO: 55070 - protein, 8 aa, Dengue virus
MTTEDMLT

SEQ ID NO: 55071 - protein, 8 aa, Dengue virus
TTEDMLTV

SEQ ID NO: 55072 - protein, 8 aa, Dengue virus
TEDMLTVW

SEQ ID NO: 55073 - protein, 8 aa, Dengue virus
EDMLTVWN

SEQ ID NO: 55074 - protein, 8 aa, Dengue virus
DMLTVWNR

SEQ ID NO: 55075 - protein, 8 aa, Dengue virus
MLTVWNRV

SEQ ID NO: 55076 - protein, 8 aa, Dengue virus
LTVWNRVW

SEQ ID NO: 55077 - protein, 8 aa, Dengue virus
TVWNRVWI

SEQ ID NO: 55078 - protein, 8 aa, Dengue virus
VWNRVWIE

SEQ ID NO: 55079 - protein, 8 aa, Dengue virus
WNRVWIED

SEQ ID NO: 55080 - protein, 8 aa, Dengue virus
NRVWIEDN

SEQ ID NO: 55081 - protein, 8 aa, Dengue virus
RVWIEDNP

SEQ ID NO: 55082 - protein, 8 aa, Dengue virus
VWIEDNPW

SEQ ID NO: 55083 - protein, 8 aa, Dengue virus
WIEDNPWM

SEQ ID NO: 55084 - protein, 8 aa, Dengue virus
IEDNPWME

SEQ ID NO: 55085 - protein, 8 aa, Dengue virus
EDNPWMED

SEQ ID NO: 55086 - protein, 8 aa, Dengue virus
DNPWMEDK

SEQ ID NO: 55087 - protein, 8 aa, Dengue virus
NPWMEDKT

SEQ ID NO: 55088 - protein, 8 aa, Dengue virus
PWMEDKTP

SEQ ID NO: 55089 - protein, 8 aa, Dengue virus
WMEDKTPV

SEQ ID NO: 55090 - protein, 8 aa, Dengue virus
MEDKTPVT

SEQ ID NO: 55091 - protein, 8 aa, Dengue virus
EDKTPVTT

SEQ ID NO: 55092 - protein, 8 aa, Dengue virus
DKTPVTTW

SEQ ID NO: 55093 - protein, 8 aa, Dengue virus
KTPVTTWE

SEQ ID NO: 55094 - protein, 8 aa, Dengue virus
TPVTTWEN

SEQ ID NO: 55095 - protein, 8 aa, Dengue virus
PVTTWENV

SEQ ID NO: 55096 - protein, 8 aa, Dengue virus
VTTWENVP

SEQ ID NO: 55097 - protein, 8 aa, Dengue virus
TTWENVPY

SEQ ID NO: 55098 - protein, 8 aa, Dengue virus
TWENVPYL

SEQ ID NO: 55099 - protein, 8 aa, Dengue virus
WENVPYLG

SEQ ID NO: 55100 - protein, 8 aa, Dengue virus
ENVPYLGK

SEQ ID NO: 55101 - protein, 8 aa, Dengue virus
NVPYLGKR

SEQ ID NO: 55102 - protein, 8 aa, Dengue virus
VPYLGKRE

SEQ ID NO: 55103 - protein, 8 aa, Dengue virus
PYLGKRED

SEQ ID NO: 55104 - protein, 8 aa, Dengue virus
YLGKREDQ

SEQ ID NO: 55105 - protein, 8 aa, Dengue virus
LGKREDQW

SEQ ID NO: 55106 - protein, 8 aa, Dengue virus
GKREDQWC

SEQ ID NO: 55107 - protein, 8 aa, Dengue virus
KREDQWCG

SEQ ID NO: 55108 - protein, 8 aa, Dengue virus
REDQWCGS

SEQ ID NO: 55109 - protein, 8 aa, Dengue virus
EDQWCGSL

SEQ ID NO: 55110 - protein, 8 aa, Dengue virus
DQWCGSLI

SEQ ID NO: 55111 - protein, 8 aa, Dengue virus
QWCGSLIG

SEQ ID NO: 55112 - protein, 8 aa, Dengue virus
WCGSLIGL

SEQ ID NO: 55113 - protein, 8 aa, Dengue virus
CGSLIGLT

SEQ ID NO: 55114 - protein, 8 aa, Dengue virus
GSLIGLTS

SEQ ID NO: 55115 - protein, 8 aa, Dengue virus
SLIGLTSR

SEQ ID NO: 55116 - protein, 8 aa, Dengue virus
LIGLTSRA

SEQ ID NO: 55117 - protein, 8 aa, Dengue virus
IGLTSRAT

SEQ ID NO: 55118 - protein, 8 aa, Dengue virus
GLTSRATW

SEQ ID NO: 55119 - protein, 8 aa, Dengue virus
LTSRATWA

SEQ ID NO: 55120 - protein, 8 aa, Dengue virus
TSRATWAQ

SEQ ID NO: 55121 - protein, 8 aa, Dengue virus
SRATWAQN

SEQ ID NO: 55122 - protein, 8 aa, Dengue virus
RATWAQNI

SEQ ID NO: 55123 - protein, 8 aa, Dengue virus
ATWAQNIP

SEQ ID NO: 55124 - protein, 8 aa, Dengue virus
TWAQNIPT

SEQ ID NO: 55125 - protein, 8 aa, Dengue virus
WAQNIPTA

SEQ ID NO: 55126 - protein, 8 aa, Dengue virus
AQNIPTAI

SEQ ID NO: 55127 - protein, 8 aa, Dengue virus
QNIPTAIQ

SEQ ID NO: 55128 - protein, 8 aa, Dengue virus
NIPTAIQQ

SEQ ID NO: 55129 - protein, 8 aa, Dengue virus
IPTAIQQV

SEQ ID NO: 55130 - protein, 8 aa, Dengue virus
PTAIQQVR

SEQ ID NO: 55131 - protein, 8 aa, Dengue virus
TAIQQVRS

SEQ ID NO: 55132 - protein, 8 aa, Dengue virus
AIQQVRSL

SEQ ID NO: 55133 - protein, 8 aa, Dengue virus
IQQVRSLI

SEQ ID NO: 55134 - protein, 8 aa, Dengue virus
QQVRSLIG

SEQ ID NO: 55135 - protein, 8 aa, Dengue virus
QVRSLIGN

SEQ ID NO: 55136 - protein, 8 aa, Dengue virus
VRSLIGNE

SEQ ID NO: 55137 - protein, 8 aa, Dengue virus
RSLIGNEE

SEQ ID NO: 55138 - protein, 8 aa, Dengue virus
SLIGNEEF

SEQ ID NO: 55139 - protein, 8 aa, Dengue virus
LIGNEEFL

SEQ ID NO: 55140 - protein, 8 aa, Dengue virus
IGNEEFLD

SEQ ID NO: 55141 - protein, 8 aa, Dengue virus
GNEEFLDY

SEQ ID NO: 55142 - protein, 8 aa, Dengue virus
NEEFLDYM

SEQ ID NO: 55143 - protein, 8 aa, Dengue virus
EEFLDYMP

SEQ ID NO: 55144 - protein, 8 aa, Dengue virus
EFLDYMPS

SEQ ID NO: 55145 - protein, 8 aa, Dengue virus
FLDYMPSM

SEQ ID NO: 55146 - protein, 8 aa, Dengue virus
LDYMPSMK

SEQ ID NO: 55147 - protein, 8 aa, Dengue virus
DYMPSMKR

SEQ ID NO: 55148 - protein, 8 aa, Dengue virus
YMPSMKRF

SEQ ID NO: 55149 - protein, 8 aa, Dengue virus
MPSMKRFR

SEQ ID NO: 55150 - protein, 8 aa, Dengue virus
PSMKRFRK

SEQ ID NO: 55151 - protein, 8 aa, Dengue virus
SMKRFRKE

SEQ ID NO: 55152 - protein, 8 aa, Dengue virus
MKRFRKEE

SEQ ID NO: 55153 - protein, 8 aa, Dengue virus
KRFRKEEE

SEQ ID NO: 55154 - protein, 8 aa, Dengue virus
RFRKEEES

SEQ ID NO: 55155 - protein, 8 aa, Dengue virus
FRKEEESE

SEQ ID NO: 55156 - protein, 8 aa, Dengue virus
RKEEESEG

SEQ ID NO: 55157 - protein, 8 aa, Dengue virus
KEEESEGA

SEQ ID NO: 55158 - protein, 8 aa, Dengue virus
EEESEGAI

SEQ ID NO: 55159 - protein, 8 aa, Dengue virus
EESEGAIW

SEQ ID NO: 55160 - protein, 8 aa, Dengue virus
MNNQRKKA

SEQ ID NO: 55161 - protein, 8 aa, Dengue virus
NNQRKKAG

SEQ ID NO: 55162 - protein, 8 aa, Dengue virus
NQRKKAGK

SEQ ID NO: 55163 - protein, 8 aa, Dengue virus
QRKKAGKP

SEQ ID NO: 55164 - protein, 8 aa, Dengue virus
RKKAGKPS

SEQ ID NO: 55165 - protein, 8 aa, Dengue virus
KKAGKPSI

SEQ ID NO: 55166 - protein, 8 aa, Dengue virus
KAGKPSIN

SEQ ID NO: 55167 - protein, 8 aa, Dengue virus
AGKPSINM

SEQ ID NO: 55168 - protein, 8 aa, Dengue virus
QLAKRFSR

SEQ ID NO: 55169 - protein, 8 aa, Dengue virus
LAKRFSRG

SEQ ID NO: 55170 - protein, 8 aa, Dengue virus
AKRFSRGL

SEQ ID NO: 55171 - protein, 8 aa, Dengue virus
KRFSRGLL

SEQ ID NO: 55172 - protein, 8 aa, Dengue virus
RFSRGLLN

SEQ ID NO: 55173 - protein, 8 aa, Dengue virus
FSRGLLNG

SEQ ID NO: 55174 - protein, 8 aa, Dengue virus
SRGLLNGQ

SEQ ID NO: 55175 - protein, 8 aa, Dengue virus
RGLLNGQG

SEQ ID NO: 55176 - protein, 8 aa, Dengue virus
ELLNGQGP

SEQ ID NO: 55177 - protein, 8 aa, Dengue virus
AIPPTAGI

SEQ ID NO: 55178 - protein, 8 aa, Dengue virus
IPPTAGIL

SEQ ID NO: 55179 - protein, 8 aa, Dengue virus
PPTAGILA

SEQ ID NO: 55180 - protein, 8 aa, Dengue virus
PTAGILAR

SEQ ID NO: 55181 - protein, 8 aa, Dengue virus
TAGILARW

SEQ ID NO: 55182 - protein, 8 aa, Dengue virus
AGILARWG

SEQ ID NO: 55183 - protein, 8 aa, Dengue virus
GILARWGT

SEQ ID NO: 55184 - protein, 8 aa, Dengue virus
ILARWGTF

SEQ ID NO: 55185 - protein, 8 aa, Dengue virus
KKLGAIKV

SEQ ID NO: 55186 - protein, 8 aa, Dengue virus
SGAIKVLR

SEQ ID NO: 55187 - protein, 8 aa, Dengue virus
GAIKVLRG

SEQ ID NO: 55188 - protein, 8 aa, Dengue virus
AIKVLRGF

SEQ ID NO: 55189 - protein, 8 aa, Dengue virus
IKVLRGFK

SEQ ID NO: 55190 - protein, 8 aa, Dengue virus
KVLRGFKK

SEQ ID NO: 55191 - protein, 8 aa, Dengue virus
VLRGFKKE

SEQ ID NO: 55192 - protein, 8 aa, Dengue virus
LRGFKKEI

SEQ ID NO: 55193 - protein, 8 aa, Dengue virus
RGFKKEIS

SEQ ID NO: 55194 - protein, 8 aa, Dengue virus
GFKREISN

SEQ ID NO: 55195 - protein, 8 aa, Dengue virus
FKREISNM

SEQ ID NO: 55196 - protein, 8 aa, Dengue virus
KREISNML

SEQ ID NO: 55197 - protein, 8 aa, Dengue virus
REISNMLS

SEQ ID NO: 55198 - protein, 8 aa, Dengue virus
NMLSIINR

SEQ ID NO: 55199 - protein, 8 aa, Dengue virus
MLSIINRR

SEQ ID NO: 55200 - protein, 8 aa, Dengue virus
LSIINRRK

SEQ ID NO: 55201 - protein, 8 aa, Dengue virus
SIINRRKK

SEQ ID NO: 55202 - protein, 8 aa, Dengue virus
IINRRKKT

SEQ ID NO: 55203 - protein, 8 aa, Dengue virus
INRRKKTS

SEQ ID NO: 55204 - protein, 8 aa, Dengue virus
NRRKKTSL

SEQ ID NO: 55205 - protein, 8 aa, Dengue virus
RRKKTSLC

SEQ ID NO: 55206 - protein, 8 aa, Dengue virus
RKKTSFCL

SEQ ID NO: 55207 - protein, 8 aa, Dengue virus
KKTSFCLM

SEQ ID NO: 55208 - protein, 8 aa, Dengue virus
KTSFCLMM

SEQ ID NO: 55209 - protein, 8 aa, Dengue virus
CLMMMLPA

SEQ ID NO: 55210 - protein, 8 aa, Dengue virus
MMLPATLA

SEQ ID NO: 55211 - protein, 8 aa, Dengue virus
MLPATLAF

SEQ ID NO: 55212 - protein, 8 aa, Dengue virus
LPATLAFH

SEQ ID NO: 55213 - protein, 8 aa, Dengue virus
PATLAFHL

SEQ ID NO: 55214 - protein, 8 aa, Dengue virus
ATLAFHLT

SEQ ID NO: 55215 - protein, 8 aa, Dengue virus
TLAFHLTS

SEQ ID NO: 55216 - protein, 8 aa, Dengue virus
GEPRMIVA

SEQ ID NO: 55217 - protein, 8 aa, Dengue virus
EPRMIVAK

SEQ ID NO: 55218 - protein, 8 aa, Dengue virus
PRMIVAKN

SEQ ID NO: 55219 - protein, 8 aa, Dengue virus
RMIVAKNE

SEQ ID NO: 55220 - protein, 8 aa, Dengue virus
MIVAKNER

SEQ ID NO: 55221 - protein, 8 aa, Dengue virus
IVAKNERG

SEQ ID NO: 55222 - protein, 8 aa, Dengue virus
VAKNERGK

SEQ ID NO: 55223 - protein, 8 aa, Dengue virus
AKNERGKS

SEQ ID NO: 55224 - protein, 8 aa, Dengue virus
SLLFKTAT

SEQ ID NO: 55225 - protein, 8 aa, Dengue virus
LLFKTATG

SEQ ID NO: 55226 - protein, 8 aa, Dengue virus
LFKTATGI

SEQ ID NO: 55227 - protein, 8 aa, Dengue virus
FKTATGIN

SEQ ID NO: 55228 - protein, 8 aa, Dengue virus
KTATGINM

SEQ ID NO: 55229 - protein, 8 aa, Dengue virus
TATGINMC

SEQ ID NO: 55230 - protein, 8 aa, Dengue virus
ATGINMCT

SEQ ID NO: 55231 - protein, 8 aa, Dengue virus
TGINMCTL

SEQ ID NO: 55232 - protein, 8 aa, Dengue virus
GEMCDDTI

SEQ ID NO: 55233 - protein, 8 aa, Dengue virus
EMCDDTIT

SEQ ID NO: 55234 - protein, 8 aa, Dengue virus
MCDDTITY

SEQ ID NO: 55235 - protein, 8 aa, Dengue virus
CDDTITYK

SEQ ID NO: 55236 - protein, 8 aa, Dengue virus
DDTITYKC

SEQ ID NO: 55237 - protein, 8 aa, Dengue virus
DTITYKCP

SEQ ID NO: 55238 - protein, 8 aa, Dengue virus
TVTYKCPL

SEQ ID NO: 55239 - protein, 8 aa, Dengue virus
VTYKCPLI

SEQ ID NO: 55240 - protein, 8 aa, Dengue virus
TYKCPLIA

SEQ ID NO: 55241 - protein, 8 aa, Dengue virus
YKCPLIAE

SEQ ID NO: 55242 - protein, 8 aa, Dengue virus
IAEVEPED

SEQ ID NO: 55243 - protein, 8 aa, Dengue virus
AEVEPEDI

SEQ ID NO: 55244 - protein, 8 aa, Dengue virus
TCNQAGER

SEQ ID NO: 55245 - protein, 8 aa, Dengue virus
CNQAGERR

SEQ ID NO: 55246 - protein, 8 aa, Dengue virus
NQAGERRR

SEQ ID NO: 55247 - protein, 8 aa, Dengue virus
QAGERRRD

SEQ ID NO: 55248 - protein, 8 aa, Dengue virus
AGERRRDK

SEQ ID NO: 55249 - protein, 8 aa, Dengue virus
GERRRDKR

SEQ ID NO: 55250 - protein, 8 aa, Dengue virus
ERRRDKRS

SEQ ID NO: 55251 - protein, 8 aa, Dengue virus
RRRDKRSV

SEQ ID NO: 55252 - protein, 8 aa, Dengue virus
GMGLDTRA

SEQ ID NO: 55253 - protein, 8 aa, Dengue virus
MGLDTRAQ

SEQ ID NO: 55254 - protein, 8 aa, Dengue virus
GLDTRAQT

SEQ ID NO: 55255 - protein, 8 aa, Dengue virus
LDTRAQTW

SEQ ID NO: 55256 - protein, 8 aa, Dengue virus
DTRAQTWM

SEQ ID NO: 55257 - protein, 8 aa, Dengue virus
TRAQTWMS

SEQ ID NO: 55258 - protein, 8 aa, Dengue virus
RAQTWMSA

SEQ ID NO: 55259 - protein, 8 aa, Dengue virus
AQTWMSAE

SEQ ID NO: 55260 - protein, 8 aa, Dengue virus
RQVERVET

SEQ ID NO: 55261 - protein, 8 aa, Dengue virus
QVERVETW

SEQ ID NO: 55262 - protein, 8 aa, Dengue virus
EKVETWAF

SEQ ID NO: 55263 - protein, 8 aa, Dengue virus
KVETWAFR

SEQ ID NO: 55264 - protein, 8 aa, Dengue virus
VETWAFRH

SEQ ID NO: 55265 - protein, 8 aa, Dengue virus
ETWAFRHP

SEQ ID NO: 55266 - protein, 8 aa, Dengue virus
TWAFRHPG

SEQ ID NO: 55267 - protein, 8 aa, Dengue virus
WAFRHPGF

SEQ ID NO: 55268 - protein, 8 aa, Dengue virus
AFRHPGFT

SEQ ID NO: 55269 - protein, 8 aa, Dengue virus
FRHPGFTI

SEQ ID NO: 55270 - protein, 8 aa, Dengue virus
ALFLAHYV

SEQ ID NO: 55271 - protein, 8 aa, Dengue virus
LFLAHYVG

SEQ ID NO: 55272 - protein, 8 aa, Dengue virus
FLAHYVGT

SEQ ID NO: 55273 - protein, 8 aa, Dengue virus
LAHYVGTS

SEQ ID NO: 55274 - protein, 8 aa, Dengue virus
AHYVGTSL

SEQ ID NO: 55275 - protein, 8 aa, Dengue virus
HYIGTSLI

SEQ ID NO: 55276 - protein, 8 aa, Dengue virus
YIGTSLIQ

SEQ ID NO: 55277 - protein, 8 aa, Dengue virus
IGTSLIQK

SEQ ID NO: 55278 - protein, 8 aa, Dengue virus
GTSLTQKA

SEQ ID NO: 55279 - protein, 8 aa, Dengue virus
TSLTQKAV

SEQ ID NO: 55280 - protein, 8 aa, Dengue virus
SLTQKAVI

SEQ ID NO: 55281 - protein, 8 aa, Dengue virus
LTQKAVIF

SEQ ID NO: 55282 - protein, 8 aa, Dengue virus
TQKVVIFV

SEQ ID NO: 55283 - protein, 8 aa, Dengue virus
QKVVIFVL

SEQ ID NO: 55284 - protein, 8 aa, Dengue virus
KVVIFVLL

SEQ ID NO: 55285 - protein, 8 aa, Dengue virus
VVIFVLLM

SEQ ID NO: 55286 - protein, 8 aa, Dengue virus
VIFVLLML

SEQ ID NO: 55287 - protein, 8 aa, Dengue virus
IFVLLMLV

SEQ ID NO: 55288 - protein, 8 aa, Dengue virus
FVLLMLVT

SEQ ID NO: 55289 - protein, 8 aa, Dengue virus
VLLMLVTP

SEQ ID NO: 55290 - protein, 8 aa, Dengue virus
MLVTPSMA

SEQ ID NO: 55291 - protein, 8 aa, Dengue virus
LVTPSMAM

SEQ ID NO: 55292 - protein, 8 aa, Dengue virus
VTPSMAMR

SEQ ID NO: 55293 - protein, 8 aa, Dengue virus
TPSMAMRC

SEQ ID NO: 55294 - protein, 8 aa, Dengue virus
PSMAMRCV

SEQ ID NO: 55295 - protein, 8 aa, Dengue virus
SMAMRCVG

SEQ ID NO: 55296 - protein, 8 aa, Dengue virus
MAMRCVGV

SEQ ID NO: 55297 - protein, 8 aa, Dengue virus
AMRCVGVG

SEQ ID NO: 55298 - protein, 8 aa, Dengue virus
CVTTMAKS

SEQ ID NO: 55299 - protein, 8 aa, Dengue virus
VTTMAKSK

SEQ ID NO: 55300 - protein, 8 aa, Dengue virus
TTMAKSKP

SEQ ID NO: 55301 - protein, 8 aa, Dengue virus
TMAKSKPT

SEQ ID NO: 55302 - protein, 8 aa, Dengue virus
MAKSKPTL

SEQ ID NO: 55303 - protein, 8 aa, Dengue virus
AKSKPTLD

SEQ ID NO: 55304 - protein, 8 aa, Dengue virus
KSKPTLDI

SEQ ID NO: 55305 - protein, 8 aa, Dengue virus
SKPTLDIE

SEQ ID NO: 55306 - protein, 8 aa, Dengue virus
IEGKITNV

SEQ ID NO: 55307 - protein, 8 aa, Dengue virus
EGKITNVT

SEQ ID NO: 55308 - protein, 8 aa, Dengue virus
GKITNVTT

SEQ ID NO: 55309 - protein, 8 aa, Dengue virus
KITNVTTD

SEQ ID NO: 55310 - protein, 8 aa, Dengue virus
ITNVTTDS

SEQ ID NO: 55311 - protein, 8 aa, Dengue virus
TNVTTDSR

SEQ ID NO: 55312 - protein, 8 aa, Dengue virus
NVTTDSRC

SEQ ID NO: 55313 - protein, 8 aa, Dengue virus
VTTDSRCP

SEQ ID NO: 55314 - protein, 8 aa, Dengue virus
CPTQGEAI

SEQ ID NO: 55315 - protein, 8 aa, Dengue virus
PTQGEAIL

SEQ ID NO: 55316 - protein, 8 aa, Dengue virus
TQGEAILP

SEQ ID NO: 55317 - protein, 8 aa, Dengue virus
QGEAILPE

SEQ ID NO: 55318 - protein, 8 aa, Dengue virus
GEAILPEE

SEQ ID NO: 55319 - protein, 8 aa, Dengue virus
EAILPEEQ

SEQ ID NO: 55320 - protein, 8 aa, Dengue virus
AILPEEQD

SEQ ID NO: 55321 - protein, 8 aa, Dengue virus
ILPEEQDQ

SEQ ID NO: 55322 - protein, 8 aa, Dengue virus
AKFQCLES

SEQ ID NO: 55323 - protein, 8 aa, Dengue virus
KFQCLESI

SEQ ID NO: 55324 - protein, 8 aa, Dengue virus
FQCLESIE

SEQ ID NO: 55325 - protein, 8 aa, Dengue virus
QCLESIEG

SEQ ID NO: 55326 - protein, 8 aa, Dengue virus
CLESIEGK

SEQ ID NO: 55327 - protein, 8 aa, Dengue virus
SIEGKVVQ

SEQ ID NO: 55328 - protein, 8 aa, Dengue virus
IEGKVVQH

SEQ ID NO: 55329 - protein, 8 aa, Dengue virus
EGKVVQHE

SEQ ID NO: 55330 - protein, 8 aa, Dengue virus
GKVVQHEN

SEQ ID NO: 55331 - protein, 8 aa, Dengue virus
KVVQHENL

SEQ ID NO: 55332 - protein, 8 aa, Dengue virus
VVQHENLK

SEQ ID NO: 55333 - protein, 8 aa, Dengue virus
VQHENLKY

SEQ ID NO: 55334 - protein, 8 aa, Dengue virus
QHENLKYT

SEQ ID NO: 55335 - protein, 8 aa, Dengue virus
HENLKYTV

SEQ ID NO: 55336 - protein, 8 aa, Dengue virus
ENLKYTVT

SEQ ID NO: 55337 - protein, 8 aa, Dengue virus
NLKYTVTI

SEQ ID NO: 55338 - protein, 8 aa, Dengue virus
LKYTVTIT

SEQ ID NO: 55339 - protein, 8 aa, Dengue virus
KYTVTITV

SEQ ID NO: 55340 - protein, 8 aa, Dengue virus
YTVTITVH

SEQ ID NO: 55341 - protein, 8 aa, Dengue virus
TVTITVHT

SEQ ID NO: 55342 - protein, 8 aa, Dengue virus
VTITVHTG

SEQ ID NO: 55343 - protein, 8 aa, Dengue virus
TITVHTGD

SEQ ID NO: 55344 - protein, 8 aa, Dengue virus
DQHQVGND

SEQ ID NO: 55345 - protein, 8 aa, Dengue virus
QHQVGNDT

SEQ ID NO: 55346 - protein, 8 aa, Dengue virus
HQVGNDTQ

SEQ ID NO: 55347 - protein, 8 aa, Dengue virus
QVGNDTQG

SEQ ID NO: 55348 - protein, 8 aa, Dengue virus
VGNDTQGV

SEQ ID NO: 55349 - protein, 8 aa, Dengue virus
GNDTQGVT

SEQ ID NO: 55350 - protein, 8 aa, Dengue virus
NDTQGVTV

SEQ ID NO: 55351 - protein, 8 aa, Dengue virus
DTQGVTVE

SEQ ID NO: 55352 - protein, 8 aa, Dengue virus
TQGVTVEI

SEQ ID NO: 55353 - protein, 8 aa, Dengue virus
QGVTVEIT

SEQ ID NO: 55354 - protein, 8 aa, Dengue virus
GVTVEITP

SEQ ID NO: 55355 - protein, 8 aa, Dengue virus
VTVEITPQ

SEQ ID NO: 55356 - protein, 8 aa, Dengue virus
TVEITPQA

SEQ ID NO: 55357 - protein, 8 aa, Dengue virus
VEITPQAS

SEQ ID NO: 55358 - protein, 8 aa, Dengue virus
EITPQASI

SEQ ID NO: 55359 - protein, 8 aa, Dengue virus
ITPQASTV

SEQ ID NO: 55360 - protein, 8 aa, Dengue virus
TPQASTVE

SEQ ID NO: 55361 - protein, 8 aa, Dengue virus
PQASTVEA

SEQ ID NO: 55362 - protein, 8 aa, Dengue virus
QASTVEAV

SEQ ID NO: 55363 - protein, 8 aa, Dengue virus
ASTVEAVL

SEQ ID NO: 55364 - protein, 8 aa, Dengue virus
VEAVLPEY

SEQ ID NO: 55365 - protein, 8 aa, Dengue virus
EAVLPEYG

SEQ ID NO: 55366 - protein, 8 aa, Dengue virus
AVLPEYGT

SEQ ID NO: 55367 - protein, 8 aa, Dengue virus
VLPEYGTL

SEQ ID NO: 55368 - protein, 8 aa, Dengue virus
FDLPLPWA

SEQ ID NO: 55369 - protein, 8 aa, Dengue virus
DLPLPWAS

SEQ ID NO: 55370 - protein, 8 aa, Dengue virus
LPLPWASG

SEQ ID NO: 55371 - protein, 8 aa, Dengue virus
PLPWASGA

SEQ ID NO: 55372 - protein, 8 aa, Dengue virus
LPWASGAT

SEQ ID NO: 55373 - protein, 8 aa, Dengue virus
PWASGATT

SEQ ID NO: 55374 - protein, 8 aa, Dengue virus
TAETPTWN

SEQ ID NO: 55375 - protein, 8 aa, Dengue virus
TETPTWNK

SEQ ID NO: 55376 - protein, 8 aa, Dengue virus
ETPTWNKK

SEQ ID NO: 55377 - protein, 8 aa, Dengue virus
TPTWNKKE

SEQ ID NO: 55378 - protein, 8 aa, Dengue virus
PTWNKKEL

SEQ ID NO: 55379 - protein, 8 aa, Dengue virus
TWNKKELL

SEQ ID NO: 55380 - protein, 8 aa, Dengue virus
WNKKELLV

SEQ ID NO: 55381 - protein, 8 aa, Dengue virus
NKKELLVT

SEQ ID NO: 55382 - protein, 8 aa, Dengue virus
KKELLVTF

SEQ ID NO: 55383 - protein, 8 aa, Dengue virus
TGATEIQT

SEQ ID NO: 55384 - protein, 8 aa, Dengue virus
GATEIQTS

SEQ ID NO: 55385 - protein, 8 aa, Dengue virus
ATEIQTSG

SEQ ID NO: 55386 - protein, 8 aa, Dengue virus
TEIQTSGG

SEQ ID NO: 55387 - protein, 8 aa, Dengue virus
EIQTSGGT

SEQ ID NO: 55388 - protein, 8 aa, Dengue virus
IQTSGGTS

SEQ ID NO: 55389 - protein, 8 aa, Dengue virus
QTSGGTSI

SEQ ID NO: 55390 - protein, 8 aa, Dengue virus
TSGGTSIF

SEQ ID NO: 55391 - protein, 8 aa, Dengue virus
SGGTNIFA

SEQ ID NO: 55392 - protein, 8 aa, Dengue virus
GGTNIFAG

SEQ ID NO: 55393 - protein, 8 aa, Dengue virus
GTNIFAGH

SEQ ID NO: 55394 - protein, 8 aa, Dengue virus
TNIFAGHL

SEQ ID NO: 55395 - protein, 8 aa, Dengue virus
NIFAGHLK

SEQ ID NO: 55396 - protein, 8 aa, Dengue virus
GMSYAMCL

SEQ ID NO: 55397 - protein, 8 aa, Dengue virus
MSYAMCLN

SEQ ID NO: 55398 - protein, 8 aa, Dengue virus
SYAMCLNT

SEQ ID NO: 55399 - protein, 8 aa, Dengue virus
YAMCLNTF

SEQ ID NO: 55400 - protein, 8 aa, Dengue virus
AMCLNTFV

SEQ ID NO: 55401 - protein, 8 aa, Dengue virus
MCLNTFVL

SEQ ID NO: 55402 - protein, 8 aa, Dengue virus
NAFVLKKE

SEQ ID NO: 55403 - protein, 8 aa, Dengue virus
AFVLKKEV

SEQ ID NO: 55404 - protein, 8 aa, Dengue virus
GTILVKVE

SEQ ID NO: 55405 - protein, 8 aa, Dengue virus
TILVKVEY

SEQ ID NO: 55406 - protein, 8 aa, Dengue virus
ILIKVEYR

SEQ ID NO: 55407 - protein, 8 aa, Dengue virus
LIKVEYRG

SEQ ID NO: 55408 - protein, 8 aa, Dengue virus
IKVEYRGE

SEQ ID NO: 55409 - protein, 8 aa, Dengue virus
KVEYRGED

SEQ ID NO: 55410 - protein, 8 aa, Dengue virus
VEYKGEDV

SEQ ID NO: 55411 - protein, 8 aa, Dengue virus
EYKGEDVP

SEQ ID NO: 55412 - protein, 8 aa, Dengue virus
YKGEDVPC

SEQ ID NO: 55413 - protein, 8 aa, Dengue virus
KGEDVPCK

SEQ ID NO: 55414 - protein, 8 aa, Dengue virus
GEDVPCKI

SEQ ID NO: 55415 - protein, 8 aa, Dengue virus
EDVPCKIP

SEQ ID NO: 55416 - protein, 8 aa, Dengue virus
DVPCKIPF

SEQ ID NO: 55417 - protein, 8 aa, Dengue virus
VPCKIPFS

SEQ ID NO: 55418 - protein, 8 aa, Dengue virus
PCKVPFST

SEQ ID NO: 55419 - protein, 8 aa, Dengue virus
CKVPFSTE

SEQ ID NO: 55420 - protein, 8 aa, Dengue virus
KVPFSTED

SEQ ID NO: 55421 - protein, 8 aa, Dengue virus
VPFSTEDG

SEQ ID NO: 55422 - protein, 8 aa, Dengue virus
PFSTEDEQ

SEQ ID NO: 55423 - protein, 8 aa, Dengue virus
FSTEDEQG

SEQ ID NO: 55424 - protein, 8 aa, Dengue virus
STEDEQGK

SEQ ID NO: 55425 - protein, 8 aa, Dengue virus
TEDEQGKA

SEQ ID NO: 55426 - protein, 8 aa, Dengue virus
EDEQGKAH

SEQ ID NO: 55427 - protein, 8 aa, Dengue virus
DGQGKAHS

SEQ ID NO: 55428 - protein, 8 aa, Dengue virus
GQGKAHSG

SEQ ID NO: 55429 - protein, 8 aa, Dengue virus
QGKAHSGR

SEQ ID NO: 55430 - protein, 8 aa, Dengue virus
GKAHSGRL

SEQ ID NO: 55431 - protein, 8 aa, Dengue virus
KAHSGRLI

SEQ ID NO: 55432 - protein, 8 aa, Dengue virus
AHSGRLIT

SEQ ID NO: 55433 - protein, 8 aa, Dengue virus
HSGRLITA

SEQ ID NO: 55434 - protein, 8 aa, Dengue virus
SGRLITAN

SEQ ID NO: 55435 - protein, 8 aa, Dengue virus
RLITANPI

SEQ ID NO: 55436 - protein, 8 aa, Dengue virus
LITANPIV

SEQ ID NO: 55437 - protein, 8 aa, Dengue virus
ITANPIVT

SEQ ID NO: 55438 - protein, 8 aa, Dengue virus
TANPIVTK

SEQ ID NO: 55439 - protein, 8 aa, Dengue virus
ANPIVTKK

SEQ ID NO: 55440 - protein, 8 aa, Dengue virus
NPIVTKKE

SEQ ID NO: 55441 - protein, 8 aa, Dengue virus
PIVTKKEE

SEQ ID NO: 55442 - protein, 8 aa, Dengue virus
IVTKKEEP

SEQ ID NO: 55443 - protein, 8 aa, Dengue virus
VTKKDEPV

SEQ ID NO: 55444 - protein, 8 aa, Dengue virus
TKKDEPVN

SEQ ID NO: 55445 - protein, 8 aa, Dengue virus
KKDEPVNI

SEQ ID NO: 55446 - protein, 8 aa, Dengue virus
KDEPVNIE

SEQ ID NO: 55447 - protein, 8 aa, Dengue virus
DEPVNIEA

SEQ ID NO: 55448 - protein, 8 aa, Dengue virus
EPINIEAE

SEQ ID NO: 55449 - protein, 8 aa, Dengue virus
PINIEAEP

SEQ ID NO: 55450 - protein, 8 aa, Dengue virus
INIEAEPP

SEQ ID NO: 55451 - protein, 8 aa, Dengue virus
PFGESNII

SEQ ID NO: 55452 - protein, 8 aa, Dengue virus
FGESNIII

SEQ ID NO: 55453 - protein, 8 aa, Dengue virus
GESNIIIG

SEQ ID NO: 55454 - protein, 8 aa, Dengue virus
ESNIIIGI

SEQ ID NO: 55455 - protein, 8 aa, Dengue virus
SNIIIGIG

SEQ ID NO: 55456 - protein, 8 aa, Dengue virus
NIIIGIGD

SEQ ID NO: 55457 - protein, 8 aa, Dengue virus
GDKALKIN

SEQ ID NO: 55458 - protein, 8 aa, Dengue virus
DKALKINW

SEQ ID NO: 55459 - protein, 8 aa, Dengue virus
KALKINWY

SEQ ID NO: 55460 - protein, 8 aa, Dengue virus
SLKINWYK

SEQ ID NO: 55461 - protein, 8 aa, Dengue virus
LKINWYRK

SEQ ID NO: 55462 - protein, 8 aa, Dengue virus
KINWYRKG

SEQ ID NO: 55463 - protein, 8 aa, Dengue virus
SAYTALFG

SEQ ID NO: 55464 - protein, 8 aa, Dengue virus
AYTALFGG

SEQ ID NO: 55465 - protein, 8 aa, Dengue virus
YTALFGGV

SEQ ID NO: 55466 - protein, 8 aa, Dengue virus
TALFGGVS

SEQ ID NO: 55467 - protein, 8 aa, Dengue virus
ALFGGVSW

SEQ ID NO: 55468 - protein, 8 aa, Dengue virus
LFSGVSWI

SEQ ID NO: 55469 - protein, 8 aa, Dengue virus
FSGVSWIM

SEQ ID NO: 55470 - protein, 8 aa, Dengue virus
SGVSWIMK

SEQ ID NO: 55471 - protein, 8 aa, Dengue virus
GVSWIMKI

SEQ ID NO: 55472 - protein, 8 aa, Dengue virus
VSWIMKIG

SEQ ID NO: 55473 - protein, 8 aa, Dengue virus
SWIMKIGI

SEQ ID NO: 55474 - protein, 8 aa, Dengue virus
WIMKIGIG

SEQ ID NO: 55475 - protein, 8 aa, Dengue virus
IMKIGIGV

SEQ ID NO: 55476 - protein, 8 aa, Dengue virus
MKIGIGIL

SEQ ID NO: 55477 - protein, 8 aa, Dengue virus
KIGIGILL

SEQ ID NO: 55478 - protein, 8 aa, Dengue virus
IGIGILLT

SEQ ID NO: 55479 - protein, 8 aa, Dengue virus
GIGILLTW

SEQ ID NO: 55480 - protein, 8 aa, Dengue virus
IGILLTWI

SEQ ID NO: 55481 - protein, 8 aa, Dengue virus
GILLTWIG

SEQ ID NO: 55482 - protein, 8 aa, Dengue virus
ILLTWIGL

SEQ ID NO: 55483 - protein, 8 aa, Dengue virus
SMSFSCIV

SEQ ID NO: 55484 - protein, 8 aa, Dengue virus
MSFSCIVI

SEQ ID NO: 55485 - protein, 8 aa, Dengue virus
SFSCIVIG

SEQ ID NO: 55486 - protein, 8 aa, Dengue virus
FSCIVIGI

SEQ ID NO: 55487 - protein, 8 aa, Dengue virus
SCIVIGII

SEQ ID NO: 55488 - protein, 8 aa, Dengue virus
CIVIGIIT

SEQ ID NO: 55489 - protein, 8 aa, Dengue virus
IVIGIITL

SEQ ID NO: 55490 - protein, 8 aa, Dengue virus
VIGIITLY

SEQ ID NO: 55491 - protein, 8 aa, Dengue virus
IGVITLYL

SEQ ID NO: 55492 - protein, 8 aa, Dengue virus
GVITLYLG

SEQ ID NO: 55493 - protein, 8 aa, Dengue virus
VITLYLGA

SEQ ID NO: 55494 - protein, 8 aa, Dengue virus
ITLYLGTV

SEQ ID NO: 55495 - protein, 8 aa, Dengue virus
TLYLGTVV

SEQ ID NO: 55496 - protein, 8 aa, Dengue virus
LYLGTVVQ

SEQ ID NO: 55497 - protein, 8 aa, Dengue virus
YLGTVVQA

SEQ ID NO: 55498 - protein, 8 aa, Dengue virus
LGTVVQAD

SEQ ID NO: 55499 - protein, 8 aa, Dengue virus
GAVVQADT

SEQ ID NO: 55500 - protein, 8 aa, Dengue virus
AVVQADTG

SEQ ID NO: 55501 - protein, 8 aa, Dengue virus
VVQADTGC

SEQ ID NO: 55502 - protein, 8 aa, Dengue virus
VQADTGCV

SEQ ID NO: 55503 - protein, 8 aa, Dengue virus
QADTGCVI

SEQ ID NO: 55504 - protein, 8 aa, Dengue virus
ADTGCVIN

SEQ ID NO: 55505 - protein, 8 aa, Dengue virus
DTGCVINW

SEQ ID NO: 55506 - protein, 8 aa, Dengue virus
TGCVINWK

SEQ ID NO: 55507 - protein, 8 aa, Dengue virus
GCAINWKG

SEQ ID NO: 55508 - protein, 8 aa, Dengue virus
CAINWKGK

SEQ ID NO: 55509 - protein, 8 aa, Dengue virus
AINWKGKE

SEQ ID NO: 55510 - protein, 8 aa, Dengue virus
VNWKGKEL

SEQ ID NO: 55511 - protein, 8 aa, Dengue virus
GKELKCGN

SEQ ID NO: 55512 - protein, 8 aa, Dengue virus
KELKCGNG

SEQ ID NO: 55513 - protein, 8 aa, Dengue virus
ELKCGNGI

SEQ ID NO: 55514 - protein, 8 aa, Dengue virus
LKCGNGIF

SEQ ID NO: 55515 - protein, 8 aa, Dengue virus
KCGNGIFV

SEQ ID NO: 55516 - protein, 8 aa, Dengue virus
CGNGIFVT

SEQ ID NO: 55517 - protein, 8 aa, Dengue virus
GNGIFVTN

SEQ ID NO: 55518 - protein, 8 aa, Dengue virus
NGIFVTNE

SEQ ID NO: 55519 - protein, 8 aa, Dengue virus
ENLLWKQV

SEQ ID NO: 55520 - protein, 8 aa, Dengue virus
NLLWKQVA

SEQ ID NO: 55521 - protein, 8 aa, Dengue virus
LLWKQVAN

SEQ ID NO: 55522 - protein, 8 aa, Dengue virus
LWKQVANE

SEQ ID NO: 55523 - protein, 8 aa, Dengue virus
WKQVANEL

SEQ ID NO: 55524 - protein, 8 aa, Dengue virus
KQVANELN

SEQ ID NO: 55525 - protein, 8 aa, Dengue virus
QVANELNY

SEQ ID NO: 55526 - protein, 8 aa, Dengue virus
VANELNYI

SEQ ID NO: 55527 - protein, 8 aa, Dengue virus
NHILWENN

SEQ ID NO: 55528 - protein, 8 aa, Dengue virus
YILWENNV

SEQ ID NO: 55529 - protein, 8 aa, Dengue virus
ILWENNVK

SEQ ID NO: 55530 - protein, 8 aa, Dengue virus
LWENNVKL

SEQ ID NO: 55531 - protein, 8 aa, Dengue virus
WENNVKLT

SEQ ID NO: 55532 - protein, 8 aa, Dengue virus
ENNIKLTI

SEQ ID NO: 55533 - protein, 8 aa, Dengue virus
NNIKLTIV

SEQ ID NO: 55534 - protein, 8 aa, Dengue virus
NIKLTIVV

SEQ ID NO: 55535 - protein, 8 aa, Dengue virus
IKLTIVVG

SEQ ID NO: 55536 - protein, 8 aa, Dengue virus
KLTIVVGD

SEQ ID NO: 55537 - protein, 8 aa, Dengue virus
LTVVVGDT

SEQ ID NO: 55538 - protein, 8 aa, Dengue virus
TVVVGDTI

SEQ ID NO: 55539 - protein, 8 aa, Dengue virus
VVVGDTIG

SEQ ID NO: 55540 - protein, 8 aa, Dengue virus
IGILEQGK

SEQ ID NO: 55541 - protein, 8 aa, Dengue virus
GILEQGKR

SEQ ID NO: 55542 - protein, 8 aa, Dengue virus
ILEQGKRT

SEQ ID NO: 55543 - protein, 8 aa, Dengue virus
LEQGKRAL

SEQ ID NO: 55544 - protein, 8 aa, Dengue virus
EQGKRALT

SEQ ID NO: 55545 - protein, 8 aa, Dengue virus
QGKRALTP

SEQ ID NO: 55546 - protein, 8 aa, Dengue virus
GKRALTPQ

SEQ ID NO: 55547 - protein, 8 aa, Dengue virus
KRALTPQP

SEQ ID NO: 55548 - protein, 8 aa, Dengue virus
RALTPQPM

SEQ ID NO: 55549 - protein, 8 aa, Dengue virus
ALTPQPME

SEQ ID NO: 55550 - protein, 8 aa, Dengue virus
LTLQPMEL

SEQ ID NO: 55551 - protein, 8 aa, Dengue virus
TLQPMELK

SEQ ID NO: 55552 - protein, 8 aa, Dengue virus
ELKYSWKA

SEQ ID NO: 55553 - protein, 8 aa, Dengue virus
LKYSWKAW

SEQ ID NO: 55554 - protein, 8 aa, Dengue virus
KYSWKAWG

SEQ ID NO: 55555 - protein, 8 aa, Dengue virus
YSWKAWGK

SEQ ID NO: 55556 - protein, 8 aa, Dengue virus
SWKAWGKA

SEQ ID NO: 55557 - protein, 8 aa, Dengue virus
WKTWGKAR

SEQ ID NO: 55558 - protein, 8 aa, Dengue virus
KTWGKARI

SEQ ID NO: 55559 - protein, 8 aa, Dengue virus
TWGKARIV

SEQ ID NO: 55560 - protein, 8 aa, Dengue virus
WGKARIVT

SEQ ID NO: 55561 - protein, 8 aa, Dengue virus
GKARIVTA

SEQ ID NO: 55562 - protein, 8 aa, Dengue virus
KARIVTAE

SEQ ID NO: 55563 - protein, 8 aa, Dengue virus
AEIQNSSF

SEQ ID NO: 55564 - protein, 8 aa, Dengue virus
EIQNSSFI

SEQ ID NO: 55565 - protein, 8 aa, Dengue virus
IQNSSFII

SEQ ID NO: 55566 - protein, 8 aa, Dengue virus
SFIIDGPS

SEQ ID NO: 55567 - protein, 8 aa, Dengue virus
FIIDGPST

SEQ ID NO: 55568 - protein, 8 aa, Dengue virus
IIDGPSTP

SEQ ID NO: 55569 - protein, 8 aa, Dengue virus
IDGPSTPE

SEQ ID NO: 55570 - protein, 8 aa, Dengue virus
DGPSTPEC

SEQ ID NO: 55571 - protein, 8 aa, Dengue virus
GPSTPECP

SEQ ID NO: 55572 - protein, 8 aa, Dengue virus
PNTPECPN

SEQ ID NO: 55573 - protein, 8 aa, Dengue virus
NTPECPNA

SEQ ID NO: 55574 - protein, 8 aa, Dengue virus
PNASRAWN

SEQ ID NO: 55575 - protein, 8 aa, Dengue virus
NASRAWNV

SEQ ID NO: 55576 - protein, 8 aa, Dengue virus
VSRAWNVW

SEQ ID NO: 55577 - protein, 8 aa, Dengue virus
IWLKLREM

SEQ ID NO: 55578 - protein, 8 aa, Dengue virus
WLKLREMY

SEQ ID NO: 55579 - protein, 8 aa, Dengue virus
LKLREMYT

SEQ ID NO: 55580 - protein, 8 aa, Dengue virus
KLREMYTQ

SEQ ID NO: 55581 - protein, 8 aa, Dengue virus
TQSCDHRL

SEQ ID NO: 55582 - protein, 8 aa, Dengue virus
QSCDHRLM

SEQ ID NO: 55583 - protein, 8 aa, Dengue virus
SCDHRLMS

SEQ ID NO: 55584 - protein, 8 aa, Dengue virus
HRLMSAAI

SEQ ID NO: 55585 - protein, 8 aa, Dengue virus
RLMSAAIK

SEQ ID NO: 55586 - protein, 8 aa, Dengue virus
LMSAAIKD

SEQ ID NO: 55587 - protein, 8 aa, Dengue virus
MSAAIKDE

SEQ ID NO: 55588 - protein, 8 aa, Dengue virus
SAAIKDER

SEQ ID NO: 55589 - protein, 8 aa, Dengue virus
AAIKDERA

SEQ ID NO: 55590 - protein, 8 aa, Dengue virus
AIKDERAV

SEQ ID NO: 55591 - protein, 8 aa, Dengue virus
IKDERAVH

SEQ ID NO: 55592 - protein, 8 aa, Dengue virus
WKLEKASF

SEQ ID NO: 55593 - protein, 8 aa, Dengue virus
KLEKASFI

SEQ ID NO: 55594 - protein, 8 aa, Dengue virus
LEKASFIE

SEQ ID NO: 55595 - protein, 8 aa, Dengue virus
EKASFIEV

SEQ ID NO: 55596 - protein, 8 aa, Dengue virus
KASFIEVK

SEQ ID NO: 55597 - protein, 8 aa, Dengue virus
ASFIEVKT

SEQ ID NO: 55598 - protein, 8 aa, Dengue virus
SFIEVKTC

SEQ ID NO: 55599 - protein, 8 aa, Dengue virus
FIEVKTCT

SEQ ID NO: 55600 - protein, 8 aa, Dengue virus
GPISQHNH

SEQ ID NO: 55601 - protein, 8 aa, Dengue virus
PISQHNHR

SEQ ID NO: 55602 - protein, 8 aa, Dengue virus
ISQHNHRP

SEQ ID NO: 55603 - protein, 8 aa, Dengue virus
SQHNHRPG

SEQ ID NO: 55604 - protein, 8 aa, Dengue virus
QHNHRPGY

SEQ ID NO: 55605 - protein, 8 aa, Dengue virus
HNHRPGYH

SEQ ID NO: 55606 - protein, 8 aa, Dengue virus
NHRPGYHT

SEQ ID NO: 55607 - protein, 8 aa, Dengue virus
HRPGYHTQ

SEQ ID NO: 55608 - protein, 8 aa, Dengue virus
YYTQTAGP

SEQ ID NO: 55609 - protein, 8 aa, Dengue virus
YTQTAGPW

SEQ ID NO: 55610 - protein, 8 aa, Dengue virus
EGTTVVIA

SEQ ID NO: 55611 - protein, 8 aa, Dengue virus
GTTVVIAE

SEQ ID NO: 55612 - protein, 8 aa, Dengue virus
TTVVITES

SEQ ID NO: 55613 - protein, 8 aa, Dengue virus
TVVITESC

SEQ ID NO: 55614 - protein, 8 aa, Dengue virus
VVITESCG

SEQ ID NO: 55615 - protein, 8 aa, Dengue virus
VITESCGT

SEQ ID NO: 55616 - protein, 8 aa, Dengue virus
CGTKGPSL

SEQ ID NO: 55617 - protein, 8 aa, Dengue virus
GTSGPSLT

SEQ ID NO: 55618 - protein, 8 aa, Dengue virus
TRGSSLRT

SEQ ID NO: 55619 - protein, 8 aa, Dengue virus
SGPSLTTT

SEQ ID NO: 55620 - protein, 8 aa, Dengue virus
YGMEIRPV

SEQ ID NO: 55621 - protein, 8 aa, Dengue virus
GMEIRPIN

SEQ ID NO: 55622 - protein, 8 aa, Dengue virus
MEIRPINE

SEQ ID NO: 55623 - protein, 8 aa, Dengue virus
EIRPINEK

SEQ ID NO: 55624 - protein, 8 aa, Dengue virus
IRPINEKE

SEQ ID NO: 55625 - protein, 8 aa, Dengue virus
RPINEKEE

SEQ ID NO: 55626 - protein, 8 aa, Dengue virus
PINEKEEN

SEQ ID NO: 55627 - protein, 8 aa, Dengue virus
INEKEENM

SEQ ID NO: 55628 - protein, 8 aa, Dengue virus
NEKEENMV

SEQ ID NO: 55629 - protein, 8 aa, Dengue virus
ENMVKSLA

SEQ ID NO: 55630 - protein, 8 aa, Dengue virus
NMVKSLAS

SEQ ID NO: 55631 - protein, 8 aa, Dengue virus
MVKSLASA

SEQ ID NO: 55632 - protein, 8 aa, Dengue virus
VKSLASAG

SEQ ID NO: 55633 - protein, 8 aa, Dengue virus
KSLASAGS

SEQ ID NO: 55634 - protein, 8 aa, Dengue virus
SLASAGSG

SEQ ID NO: 55635 - protein, 8 aa, Dengue virus
LVSAGSGE

SEQ ID NO: 55636 - protein, 8 aa, Dengue virus
VSAGSGEV

SEQ ID NO: 55637 - protein, 8 aa, Dengue virus
SAGSGEVD

SEQ ID NO: 55638 - protein, 8 aa, Dengue virus
AGSGEVDN

SEQ ID NO: 55639 - protein, 8 aa, Dengue virus
GSGEVDNF

SEQ ID NO: 55640 - protein, 8 aa, Dengue virus
SGEVDNFT

SEQ ID NO: 55641 - protein, 8 aa, Dengue virus
GEVDNFTM

SEQ ID NO: 55642 - protein, 8 aa, Dengue virus
EVDNFTMG

SEQ ID NO: 55643 - protein, 8 aa, Dengue virus
MDNFTMGI

SEQ ID NO: 55644 - protein, 8 aa, Dengue virus
DNFTMGIL

SEQ ID NO: 55645 - protein, 8 aa, Dengue virus
NFTMGILC

SEQ ID NO: 55646 - protein, 8 aa, Dengue virus
FTMGILCL

SEQ ID NO: 55647 - protein, 8 aa, Dengue virus
TMGILCLA

SEQ ID NO: 55648 - protein, 8 aa, Dengue virus
MGILCLAI

SEQ ID NO: 55649 - protein, 8 aa, Dengue virus
GILCLAIL

SEQ ID NO: 55650 - protein, 8 aa, Dengue virus
ILCLAILF

SEQ ID NO: 55651 - protein, 8 aa, Dengue virus
AILFEEVL

SEQ ID NO: 55652 - protein, 8 aa, Dengue virus
ILFEEVLR

SEQ ID NO: 55653 - protein, 8 aa, Dengue virus
LFEEVLRG

SEQ ID NO: 55654 - protein, 8 aa, Dengue virus
FEEVLRGK

SEQ ID NO: 55655 - protein, 8 aa, Dengue virus
EEVLRGKF

SEQ ID NO: 55656 - protein, 8 aa, Dengue virus
EVLRGKFG

SEQ ID NO: 55657 - protein, 8 aa, Dengue virus
VLRGKFGK

SEQ ID NO: 55658 - protein, 8 aa, Dengue virus
FGKKHMIV

SEQ ID NO: 55659 - protein, 8 aa, Dengue virus
GKKHMIVG

SEQ ID NO: 55660 - protein, 8 aa, Dengue virus
KKHMIVGV

SEQ ID NO: 55661 - protein, 8 aa, Dengue virus
FMFVLLLS

SEQ ID NO: 55662 - protein, 8 aa, Dengue virus
MFVLLLSG

SEQ ID NO: 55663 - protein, 8 aa, Dengue virus
GQITWRDL

SEQ ID NO: 55664 - protein, 8 aa, Dengue virus
QITWRDMT

SEQ ID NO: 55665 - protein, 8 aa, Dengue virus
DMARTLIM

SEQ ID NO: 55666 - protein, 8 aa, Dengue virus
ARTLIMIG

SEQ ID NO: 55667 - protein, 8 aa, Dengue virus
RTLIMIGS

SEQ ID NO: 55668 - protein, 8 aa, Dengue virus
TFIMIGSN

SEQ ID NO: 55669 - protein, 8 aa, Dengue virus
FIMIGSNA

SEQ ID NO: 55670 - protein, 8 aa, Dengue virus
IMIGSNAT

SEQ ID NO: 55671 - protein, 8 aa, Dengue virus
MIGSNATD

SEQ ID NO: 55672 - protein, 8 aa, Dengue virus
IGSNATDR

SEQ ID NO: 55673 - protein, 8 aa, Dengue virus
GSNATDRM

SEQ ID NO: 55674 - protein, 8 aa, Dengue virus
SNASDKMG

SEQ ID NO: 55675 - protein, 8 aa, Dengue virus
NASDKMGM

SEQ ID NO: 55676 - protein, 8 aa, Dengue virus
ATDRMGMG

SEQ ID NO: 55677 - protein, 8 aa, Dengue virus
SDKMGMGV

SEQ ID NO: 55678 - protein, 8 aa, Dengue virus
DKMGMGVT

SEQ ID NO: 55679 - protein, 8 aa, Dengue virus
KMGMGVTY

SEQ ID NO: 55680 - protein, 8 aa, Dengue virus
ATFKIQPL

SEQ ID NO: 55681 - protein, 8 aa, Dengue virus
TFKIQPLL

SEQ ID NO: 55682 - protein, 8 aa, Dengue virus
FKIQPLLA

SEQ ID NO: 55683 - protein, 8 aa, Dengue virus
KIQPLLAL

SEQ ID NO: 55684 - protein, 8 aa, Dengue virus
IQPLLALG

SEQ ID NO: 55685 - protein, 8 aa, Dengue virus
LLALGFFL

SEQ ID NO: 55686 - protein, 8 aa, Dengue virus
GVGLAMAA

SEQ ID NO: 55687 - protein, 8 aa, Dengue virus
VGLAMAAT

SEQ ID NO: 55688 - protein, 8 aa, Dengue virus
GLAMAATL

SEQ ID NO: 55689 - protein, 8 aa, Dengue virus
LAMAATLR

SEQ ID NO: 55690 - protein, 8 aa, Dengue virus
AMAATLRL

SEQ ID NO: 55691 - protein, 8 aa, Dengue virus
MAATLRLP

SEQ ID NO: 55692 - protein, 8 aa, Dengue virus
AATLRLPE

SEQ ID NO: 55693 - protein, 8 aa, Dengue virus
ATLRLPED

SEQ ID NO: 55694 - protein, 8 aa, Dengue virus
TLRLPEDI

SEQ ID NO: 55695 - protein, 8 aa, Dengue virus
LRLPEDIE

SEQ ID NO: 55696 - protein, 8 aa, Dengue virus
RLPEDIEQ

SEQ ID NO: 55697 - protein, 8 aa, Dengue virus
GIALGLMT

SEQ ID NO: 55698 - protein, 8 aa, Dengue virus
IALGLMTL

SEQ ID NO: 55699 - protein, 8 aa, Dengue virus
ALGLMTLK

SEQ ID NO: 55700 - protein, 8 aa, Dengue virus
LGLMTLKL

SEQ ID NO: 55701 - protein, 8 aa, Dengue virus
GLMTLKLI

SEQ ID NO: 55702 - protein, 8 aa, Dengue virus
LMTLKLIT

SEQ ID NO: 55703 - protein, 8 aa, Dengue virus
MTLKLITQ

SEQ ID NO: 55704 - protein, 8 aa, Dengue virus
TLKLITQF

SEQ ID NO: 55705 - protein, 8 aa, Dengue virus
LKLTTQFE

SEQ ID NO: 55706 - protein, 8 aa, Dengue virus
KLTTQFET

SEQ ID NO: 55707 - protein, 8 aa, Dengue virus
LTTQFETY

SEQ ID NO: 55708 - protein, 8 aa, Dengue virus
TTQFETYQ

SEQ ID NO: 55709 - protein, 8 aa, Dengue virus
FETYQLWA

SEQ ID NO: 55710 - protein, 8 aa, Dengue virus
ETYQLWAA

SEQ ID NO: 55711 - protein, 8 aa, Dengue virus
TYQLWAAL

SEQ ID NO: 55712 - protein, 8 aa, Dengue virus
YQLWTALV

SEQ ID NO: 55713 - protein, 8 aa, Dengue virus
QLWTALVS

SEQ ID NO: 55714 - protein, 8 aa, Dengue virus
LWTALVSL

SEQ ID NO: 55715 - protein, 8 aa, Dengue virus
WTALVSLT

SEQ ID NO: 55716 - protein, 8 aa, Dengue virus
TALVSLTC

SEQ ID NO: 55717 - protein, 8 aa, Dengue virus
ALVSLTCS

SEQ ID NO: 55718 - protein, 8 aa, Dengue virus
LVSLTCSN

SEQ ID NO: 55719 - protein, 8 aa, Dengue virus
VSLTCSNT

SEQ ID NO: 55720 - protein, 8 aa, Dengue virus
SLTCSNTM

SEQ ID NO: 55721 - protein, 8 aa, Dengue virus
LTCSNTMF

SEQ ID NO: 55722 - protein, 8 aa, Dengue virus
TCSNTMFT

SEQ ID NO: 55723 - protein, 8 aa, Dengue virus
CSNTMFTL

SEQ ID NO: 55724 - protein, 8 aa, Dengue virus
SNTMFTLT

SEQ ID NO: 55725 - protein, 8 aa, Dengue virus
NTMFTLTV

SEQ ID NO: 55726 - protein, 8 aa, Dengue virus
TMFTLTVA

SEQ ID NO: 55727 - protein, 8 aa, Dengue virus
MFTLTVAW

SEQ ID NO: 55728 - protein, 8 aa, Dengue virus
TATLILAV

SEQ ID NO: 55729 - protein, 8 aa, Dengue virus
ATLILAGI

SEQ ID NO: 55730 - protein, 8 aa, Dengue virus
TLILAGIS

SEQ ID NO: 55731 - protein, 8 aa, Dengue virus
LILAGISL

SEQ ID NO: 55732 - protein, 8 aa, Dengue virus
ILAGISLL

SEQ ID NO: 55733 - protein, 8 aa, Dengue virus
LAGISLLP

SEQ ID NO: 55734 - protein, 8 aa, Dengue virus
VSLLPLCQ

SEQ ID NO: 55735 - protein, 8 aa, Dengue virus
SLLPLCQS

SEQ ID NO: 55736 - protein, 8 aa, Dengue virus
LLPLCQSS

SEQ ID NO: 55737 - protein, 8 aa, Dengue virus
LPLCQSSS

SEQ ID NO: 55738 - protein, 8 aa, Dengue virus
PLCQSSSM

SEQ ID NO: 55739 - protein, 8 aa, Dengue virus
LCQSSSMR

SEQ ID NO: 55740 - protein, 8 aa, Dengue virus
QSSSMRKS

SEQ ID NO: 55741 - protein, 8 aa, Dengue virus
SSSMRKSD

SEQ ID NO: 55742 - protein, 8 aa, Dengue virus
SSMRKSDW

SEQ ID NO: 55743 - protein, 8 aa, Dengue virus
SMRKSDWL

SEQ ID NO: 55744 - protein, 8 aa, Dengue virus
MRKSDWLP

SEQ ID NO: 55745 - protein, 8 aa, Dengue virus
RKSDWLPM

SEQ ID NO: 55746 - protein, 8 aa, Dengue virus
KTDWLPMA

SEQ ID NO: 55747 - protein, 8 aa, Dengue virus
TDWLPMAV

SEQ ID NO: 55748 - protein, 8 aa, Dengue virus
DWLPMAVA

SEQ ID NO: 55749 - protein, 8 aa, Dengue virus
WLPMAVAA

SEQ ID NO: 55750 - protein, 8 aa, Dengue virus
LPMAVAAM

SEQ ID NO: 55751 - protein, 8 aa, Dengue virus
PMAVAAMG

SEQ ID NO: 55752 - protein, 8 aa, Dengue virus
MAVAAMGV

SEQ ID NO: 55753 - protein, 8 aa, Dengue virus
AVAAMGVP

SEQ ID NO: 55754 - protein, 8 aa, Dengue virus
VAAMGVPS

SEQ ID NO: 55755 - protein, 8 aa, Dengue virus
AAMGVPSL

SEQ ID NO: 55756 - protein, 8 aa, Dengue virus
AMGVPSLP

SEQ ID NO: 55757 - protein, 8 aa, Dengue virus
MGVPSLPL

SEQ ID NO: 55758 - protein, 8 aa, Dengue virus
GVPSLPLF

SEQ ID NO: 55759 - protein, 8 aa, Dengue virus
VPSLPLFI

SEQ ID NO: 55760 - protein, 8 aa, Dengue virus
PSLPLFIF

SEQ ID NO: 55761 - protein, 8 aa, Dengue virus
SLPLFIFS

SEQ ID NO: 55762 - protein, 8 aa, Dengue virus
LPLFIFNL

SEQ ID NO: 55763 - protein, 8 aa, Dengue virus
PLFIFNLK

SEQ ID NO: 55764 - protein, 8 aa, Dengue virus
LFIFNLKD

SEQ ID NO: 55765 - protein, 8 aa, Dengue virus
FIFNLKDT

SEQ ID NO: 55766 - protein, 8 aa, Dengue virus
LKDTPKRR

SEQ ID NO: 55767 - protein, 8 aa, Dengue virus
KDTPKRRS

SEQ ID NO: 55768 - protein, 8 aa, Dengue virus
DTPKRRSW

SEQ ID NO: 55769 - protein, 8 aa, Dengue virus
TPKRRSWP

SEQ ID NO: 55770 - protein, 8 aa, Dengue virus
PKRRSWPL

SEQ ID NO: 55771 - protein, 8 aa, Dengue virus
KRKSWPLN

SEQ ID NO: 55772 - protein, 8 aa, Dengue virus
RKSWPLNE

SEQ ID NO: 55773 - protein, 8 aa, Dengue virus
KSWPLNEG

SEQ ID NO: 55774 - protein, 8 aa, Dengue virus
VSILASSF

SEQ ID NO: 55775 - protein, 8 aa, Dengue virus
SILASSFL

SEQ ID NO: 55776 - protein, 8 aa, Dengue virus
ILASSFLR

SEQ ID NO: 55777 - protein, 8 aa, Dengue virus
LASSFLRN

SEQ ID NO: 55778 - protein, 8 aa, Dengue virus
ASSFLRND

SEQ ID NO: 55779 - protein, 8 aa, Dengue virus
SSFLRNDV

SEQ ID NO: 55780 - protein, 8 aa, Dengue virus
SFLRNDVP

SEQ ID NO: 55781 - protein, 8 aa, Dengue virus
FLRNDVPM

SEQ ID NO: 55782 - protein, 8 aa, Dengue virus
TGTSADLI

SEQ ID NO: 55783 - protein, 8 aa, Dengue virus
GTSADLIV

SEQ ID NO: 55784 - protein, 8 aa, Dengue virus
TSADLIVE

SEQ ID NO: 55785 - protein, 8 aa, Dengue virus
SADLIVEK

SEQ ID NO: 55786 - protein, 8 aa, Dengue virus
ADLIVEKA

SEQ ID NO: 55787 - protein, 8 aa, Dengue virus
DLIVEKAA

SEQ ID NO: 55788 - protein, 8 aa, Dengue virus
LIVEKAAD

SEQ ID NO: 55789 - protein, 8 aa, Dengue virus
ADITWEEE

SEQ ID NO: 55790 - protein, 8 aa, Dengue virus
DITWEEEA

SEQ ID NO: 55791 - protein, 8 aa, Dengue virus
ITWEEEAE

SEQ ID NO: 55792 - protein, 8 aa, Dengue virus
GVSHNLMV

SEQ ID NO: 55793 - protein, 8 aa, Dengue virus
VSHNLMVT

SEQ ID NO: 55794 - protein, 8 aa, Dengue virus
SHNLMVTV

SEQ ID NO: 55795 - protein, 8 aa, Dengue virus
HNLMVTVD

SEQ ID NO: 55796 - protein, 8 aa, Dengue virus
NLMVTVDD

SEQ ID NO: 55797 - protein, 8 aa, Dengue virus
LMVTVDDD

SEQ ID NO: 55798 - protein, 8 aa, Dengue virus
MVTVDDDG

SEQ ID NO: 55799 - protein, 8 aa, Dengue virus
VTVDDDGT

SEQ ID NO: 55800 - protein, 8 aa, Dengue virus
DGTMKIKD

SEQ ID NO: 55801 - protein, 8 aa, Dengue virus
GTMKIKDD

SEQ ID NO: 55802 - protein, 8 aa, Dengue virus
TMKIKDDE

SEQ ID NO: 55803 - protein, 8 aa, Dengue virus
MKIKDDET

SEQ ID NO: 55804 - protein, 8 aa, Dengue virus
KIKDDETE

SEQ ID NO: 55805 - protein, 8 aa, Dengue virus
ALLIVSGV

SEQ ID NO: 55806 - protein, 8 aa, Dengue virus
LLIVSGVF

SEQ ID NO: 55807 - protein, 8 aa, Dengue virus
LIVSGVFP

SEQ ID NO: 55808 - protein, 8 aa, Dengue virus
IVSGVFPY

SEQ ID NO: 55809 - protein, 8 aa, Dengue virus
VSGVFPYS

SEQ ID NO: 55810 - protein, 8 aa, Dengue virus
SGVFPYSI

SEQ ID NO: 55811 - protein, 8 aa, Dengue virus
GVFPYSIP

SEQ ID NO: 55812 - protein, 8 aa, Dengue virus
VFPYSIPA

SEQ ID NO: 55813 - protein, 8 aa, Dengue virus
VWHTWQKR

SEQ ID NO: 55814 - protein, 8 aa, Dengue virus
WHTWQKRT

SEQ ID NO: 55815 - protein, 8 aa, Dengue virus
HTWQKQTR

SEQ ID NO: 55816 - protein, 8 aa, Dengue virus
TWQKQTRR

SEQ ID NO: 55817 - protein, 8 aa, Dengue virus
WQKQTRRS

SEQ ID NO: 55818 - protein, 8 aa, Dengue virus
QKQTRRSG

SEQ ID NO: 55819 - protein, 8 aa, Dengue virus
KQTRRSGV

SEQ ID NO: 55820 - protein, 8 aa, Dengue virus
QTRRSGVL

SEQ ID NO: 55821 - protein, 8 aa, Dengue virus
TRRSGVLW

SEQ ID NO: 55822 - protein, 8 aa, Dengue virus
RRSGVLWD

SEQ ID NO: 55823 - protein, 8 aa, Dengue virus
RIKQQGIL

SEQ ID NO: 55824 - protein, 8 aa, Dengue virus
IKQQGILG

SEQ ID NO: 55825 - protein, 8 aa, Dengue virus
KQQGILGK

SEQ ID NO: 55826 - protein, 8 aa, Dengue virus
QQGILGKT

SEQ ID NO: 55827 - protein, 8 aa, Dengue virus
QGILGKTQ

SEQ ID NO: 55828 - protein, 8 aa, Dengue virus
GILGKTQV

SEQ ID NO: 55829 - protein, 8 aa, Dengue virus
ILGKTQVG

SEQ ID NO: 55830 - protein, 8 aa, Dengue virus
LGKTQVGV

SEQ ID NO: 55831 - protein, 8 aa, Dengue virus
TQVGVGIQ

SEQ ID NO: 55832 - protein, 8 aa, Dengue virus
QVGVGIQK

SEQ ID NO: 55833 - protein, 8 aa, Dengue virus
VGVGIQKE

SEQ ID NO: 55834 - protein, 8 aa, Dengue virus
GVGIQKEG

SEQ ID NO: 55835 - protein, 8 aa, Dengue virus
VGIQKEGV

SEQ ID NO: 55836 - protein, 8 aa, Dengue virus
GIQKEGVF

SEQ ID NO: 55837 - protein, 8 aa, Dengue virus
IQKEGVFH

SEQ ID NO: 55838 - protein, 8 aa, Dengue virus
TRGAVLTH

SEQ ID NO: 55839 - protein, 8 aa, Dengue virus
RGAVLTHN

SEQ ID NO: 55840 - protein, 8 aa, Dengue virus
GAVLTHNG

SEQ ID NO: 55841 - protein, 8 aa, Dengue virus
AVLTHNGK

SEQ ID NO: 55842 - protein, 8 aa, Dengue virus
VLTHNGKR

SEQ ID NO: 55843 - protein, 8 aa, Dengue virus
LTHNGKRL

SEQ ID NO: 55844 - protein, 8 aa, Dengue virus
THNGKRLE

SEQ ID NO: 55845 - protein, 8 aa, Dengue virus
HNGKRLEP

SEQ ID NO: 55846 - protein, 8 aa, Dengue virus
RLEPNWAN

SEQ ID NO: 55847 - protein, 8 aa, Dengue virus
LEPNWANV

SEQ ID NO: 55848 - protein, 8 aa, Dengue virus
EPNWANVK

SEQ ID NO: 55849 - protein, 8 aa, Dengue virus
PNWANVKK

SEQ ID NO: 55850 - protein, 8 aa, Dengue virus
NWANVKKD

SEQ ID NO: 55851 - protein, 8 aa, Dengue virus
WANVKKDL

SEQ ID NO: 55852 - protein, 8 aa, Dengue virus
ANVKKDLI

SEQ ID NO: 55853 - protein, 8 aa, Dengue virus
NVKKDLIS

SEQ ID NO: 55854 - protein, 8 aa, Dengue virus
ISYGGGWK

SEQ ID NO: 55855 - protein, 8 aa, Dengue virus
SYGGGWKL

SEQ ID NO: 55856 - protein, 8 aa, Dengue virus
YGGGWRLN

SEQ ID NO: 55857 - protein, 8 aa, Dengue virus
GGGWRLNA

SEQ ID NO: 55858 - protein, 8 aa, Dengue virus
GGWRLNAQ

SEQ ID NO: 55859 - protein, 8 aa, Dengue virus
GWRLNAQW

SEQ ID NO: 55860 - protein, 8 aa, Dengue virus
WRLNAQWQ

SEQ ID NO: 55861 - protein, 8 aa, Dengue virus
RLNAQWQK

SEQ ID NO: 55862 - protein, 8 aa, Dengue virus
LNAQWQKG

SEQ ID NO: 55863 - protein, 8 aa, Dengue virus
NAQWQKGE

SEQ ID NO: 55864 - protein, 8 aa, Dengue virus
TQWQKGEE

SEQ ID NO: 55865 - protein, 8 aa, Dengue virus
QWKKGEEV

SEQ ID NO: 55866 - protein, 8 aa, Dengue virus
WKKGEEVQ

SEQ ID NO: 55867 - protein, 8 aa, Dengue virus
KKGEEVQV

SEQ ID NO: 55868 - protein, 8 aa, Dengue virus
NPKNFQTT

SEQ ID NO: 55869 - protein, 8 aa, Dengue virus
PKNFQTTP

SEQ ID NO: 55870 - protein, 8 aa, Dengue virus
KNFQTTPG

SEQ ID NO: 55871 - protein, 8 aa, Dengue virus
NFQTMPGI

SEQ ID NO: 55872 - protein, 8 aa, Dengue virus
FQTMPGIF

SEQ ID NO: 55873 - protein, 8 aa, Dengue virus
QTMPGIFQ

SEQ ID NO: 55874 - protein, 8 aa, Dengue virus
TMPGIFQT

SEQ ID NO: 55875 - protein, 8 aa, Dengue virus
MPGIFQTT

SEQ ID NO: 55876 - protein, 8 aa, Dengue virus
PGIFQTTT

SEQ ID NO: 55877 - protein, 8 aa, Dengue virus
GIFQTTTG

SEQ ID NO: 55878 - protein, 8 aa, Dengue virus
IFQTTTGE

SEQ ID NO: 55879 - protein, 8 aa, Dengue virus
FQTTMGEI

SEQ ID NO: 55880 - protein, 8 aa, Dengue virus
QTTMGEIG

SEQ ID NO: 55881 - protein, 8 aa, Dengue virus
TTMGEIGA

SEQ ID NO: 55882 - protein, 8 aa, Dengue virus
TMGEIGAI

SEQ ID NO: 55883 - protein, 8 aa, Dengue virus
MGEIGAIA

SEQ ID NO: 55884 - protein, 8 aa, Dengue virus
IINREGKI

SEQ ID NO: 55885 - protein, 8 aa, Dengue virus
INREGKIV

SEQ ID NO: 55886 - protein, 8 aa, Dengue virus
NREGKIVG

SEQ ID NO: 55887 - protein, 8 aa, Dengue virus
REGKIVGL

SEQ ID NO: 55888 - protein, 8 aa, Dengue virus
EGKIVGLY

SEQ ID NO: 55889 - protein, 8 aa, Dengue virus
GKIVGLYG

SEQ ID NO: 55890 - protein, 8 aa, Dengue virus
KIVGLYGN

SEQ ID NO: 55891 - protein, 8 aa, Dengue virus
IVGLYGNG

SEQ ID NO: 55892 - protein, 8 aa, Dengue virus
GNGVVTKS

SEQ ID NO: 55893 - protein, 8 aa, Dengue virus
NGVVTKSG

SEQ ID NO: 55894 - protein, 8 aa, Dengue virus
GVVTKSGG

SEQ ID NO: 55895 - protein, 8 aa, Dengue virus
VVTKSGGY

SEQ ID NO: 55896 - protein, 8 aa, Dengue virus
VTKSGGYV

SEQ ID NO: 55897 - protein, 8 aa, Dengue virus
NAEPDGPA

SEQ ID NO: 55898 - protein, 8 aa, Dengue virus
ELEEEMFR

SEQ ID NO: 55899 - protein, 8 aa, Dengue virus
LEEEMFRK

SEQ ID NO: 55900 - protein, 8 aa, Dengue virus
EEEMFRKR

SEQ ID NO: 55901 - protein, 8 aa, Dengue virus
EEMFRKRN

SEQ ID NO: 55902 - protein, 8 aa, Dengue virus
EMFRKRNL

SEQ ID NO: 55903 - protein, 8 aa, Dengue virus
MFRKRNLT

SEQ ID NO: 55904 - protein, 8 aa, Dengue virus
FRKRNLTI

SEQ ID NO: 55905 - protein, 8 aa, Dengue virus
RKRNLTIM

SEQ ID NO: 55906 - protein, 8 aa, Dengue virus
RKYLPAII

SEQ ID NO: 55907 - protein, 8 aa, Dengue virus
KYLPAIIR

SEQ ID NO: 55908 - protein, 8 aa, Dengue virus
YLPAIIRE

SEQ ID NO: 55909 - protein, 8 aa, Dengue virus
LPAIIREA

SEQ ID NO: 55910 - protein, 8 aa, Dengue virus
PAIIREAI

SEQ ID NO: 55911 - protein, 8 aa, Dengue virus
AIIREAIK

SEQ ID NO: 55912 - protein, 8 aa, Dengue virus
IIREAIKR

SEQ ID NO: 55913 - protein, 8 aa, Dengue virus
IREAIKRR

SEQ ID NO: 55914 - protein, 8 aa, Dengue virus
IRYQTTAI

SEQ ID NO: 55915 - protein, 8 aa, Dengue virus
RYQTTAIK

SEQ ID NO: 55916 - protein, 8 aa, Dengue virus
YQTTAIKS

SEQ ID NO: 55917 - protein, 8 aa, Dengue virus
QTTAIKSE

SEQ ID NO: 55918 - protein, 8 aa, Dengue virus
TTAIKSEH

SEQ ID NO: 55919 - protein, 8 aa, Dengue virus
TAIKSEHT

SEQ ID NO: 55920 - protein, 8 aa, Dengue virus
AIKSEHTG

SEQ ID NO: 55921 - protein, 8 aa, Dengue virus
TKSEHTGK

SEQ ID NO: 55922 - protein, 8 aa, Dengue virus
KSEHTGKE

SEQ ID NO: 55923 - protein, 8 aa, Dengue virus
SEHTGKEI

SEQ ID NO: 55924 - protein, 8 aa, Dengue virus
EHTGKEIV

SEQ ID NO: 55925 - protein, 8 aa, Dengue virus
HTGKEIVD

SEQ ID NO: 55926 - protein, 8 aa, Dengue virus
TGKEIVDL

SEQ ID NO: 55927 - protein, 8 aa, Dengue virus
GKEIVDLM

SEQ ID NO: 55928 - protein, 8 aa, Dengue virus
KEIVDLMC

SEQ ID NO: 55929 - protein, 8 aa, Dengue virus
RVPNYNLV

SEQ ID NO: 55930 - protein, 8 aa, Dengue virus
VPNYNLVI

SEQ ID NO: 55931 - protein, 8 aa, Dengue virus
PNYNLVIM

SEQ ID NO: 55932 - protein, 8 aa, Dengue virus
NYNLVIMD

SEQ ID NO: 55933 - protein, 8 aa, Dengue virus
YNLVIMDE

SEQ ID NO: 55934 - protein, 8 aa, Dengue virus
NLVIMDEA

SEQ ID NO: 55935 - protein, 8 aa, Dengue virus
LVIMDEAH

SEQ ID NO: 55936 - protein, 8 aa, Dengue virus
VIMDEAHF

SEQ ID NO: 55937 - protein, 8 aa, Dengue virus
VMDEAHFT

SEQ ID NO: 55938 - protein, 8 aa, Dengue virus
TRVGMGET

SEQ ID NO: 55939 - protein, 8 aa, Dengue virus
RVGMGETA

SEQ ID NO: 55940 - protein, 8 aa, Dengue virus
VGMGETAA

SEQ ID NO: 55941 - protein, 8 aa, Dengue virus
GMGETAAI

SEQ ID NO: 55942 - protein, 8 aa, Dengue virus
MGETAAIF

SEQ ID NO: 55943 - protein, 8 aa, Dengue virus
GETAAIFM

SEQ ID NO: 55944 - protein, 8 aa, Dengue virus
ETAAIFMT

SEQ ID NO: 55945 - protein, 8 aa, Dengue virus
TAAIFMTA

SEQ ID NO: 55946 - protein, 8 aa, Dengue virus
ATPPGTAE

SEQ ID NO: 55947 - protein, 8 aa, Dengue virus
TPPGTAEA

SEQ ID NO: 55948 - protein, 8 aa, Dengue virus
PPGTAEAF

SEQ ID NO: 55949 - protein, 8 aa, Dengue virus
PGTAEAFP

SEQ ID NO: 55950 - protein, 8 aa, Dengue virus
GTAEAFPQ

SEQ ID NO: 55951 - protein, 8 aa, Dengue virus
TAEAFPQS

SEQ ID NO: 55952 - protein, 8 aa, Dengue virus
AEAFPQSN

SEQ ID NO: 55953 - protein, 8 aa, Dengue virus
EAFPQSNA

SEQ ID NO: 55954 - protein, 8 aa, Dengue virus
APIQDEEK

SEQ ID NO: 55955 - protein, 8 aa, Dengue virus
PIQDEEKD

SEQ ID NO: 55956 - protein, 8 aa, Dengue virus
IQDEEKDI

SEQ ID NO: 55957 - protein, 8 aa, Dengue virus
QDEEKDIP

SEQ ID NO: 55958 - protein, 8 aa, Dengue virus
DEEKDIPE

SEQ ID NO: 55959 - protein, 8 aa, Dengue virus
EEKDIPER

SEQ ID NO: 55960 - protein, 8 aa, Dengue virus
EKDIPERS

SEQ ID NO: 55961 - protein, 8 aa, Dengue virus
KDIPERSW

SEQ ID NO: 55962 - protein, 8 aa, Dengue virus
RSWNSGND

SEQ ID NO: 55963 - protein, 8 aa, Dengue virus
SWNSGNDW

SEQ ID NO: 55964 - protein, 8 aa, Dengue virus
WNSGNDWI

SEQ ID NO: 55965 - protein, 8 aa, Dengue virus
NSGNDWIT

SEQ ID NO: 55966 - protein, 8 aa, Dengue virus
SGNDWITD

SEQ ID NO: 55967 - protein, 8 aa, Dengue virus
GNDWITDF

SEQ ID NO: 55968 - protein, 8 aa, Dengue virus
NEWITDFV

SEQ ID NO: 55969 - protein, 8 aa, Dengue virus
EWITDFVG

SEQ ID NO: 55970 - protein, 8 aa, Dengue virus
WITDFVGK

SEQ ID NO: 55971 - protein, 8 aa, Dengue virus
ITDFVGKT

SEQ ID NO: 55972 - protein, 8 aa, Dengue virus
TDFVGKTV

SEQ ID NO: 55973 - protein, 8 aa, Dengue virus
DFVGKTVW

SEQ ID NO: 55974 - protein, 8 aa, Dengue virus
FVGKTVWF

SEQ ID NO: 55975 - protein, 8 aa, Dengue virus
VGKTVWFV

SEQ ID NO: 55976 - protein, 8 aa, Dengue virus
DTEYQKTR

SEQ ID NO: 55977 - protein, 8 aa, Dengue virus
TEYQKTRL

SEQ ID NO: 55978 - protein, 8 aa, Dengue virus
EYQKTRLN

SEQ ID NO: 55979 - protein, 8 aa, Dengue virus
YQKTRLND

SEQ ID NO: 55980 - protein, 8 aa, Dengue virus
QKTRLNDW

SEQ ID NO: 55981 - protein, 8 aa, Dengue virus
KTRLNDWD

SEQ ID NO: 55982 - protein, 8 aa, Dengue virus
TRLNDWDF

SEQ ID NO: 55983 - protein, 8 aa, Dengue virus
RLNDWDFV

SEQ ID NO: 55984 - protein, 8 aa, Dengue virus
EMGANFRA

SEQ ID NO: 55985 - protein, 8 aa, Dengue virus
MGANFRAD

SEQ ID NO: 55986 - protein, 8 aa, Dengue virus
GANFRADR

SEQ ID NO: 55987 - protein, 8 aa, Dengue virus
ANFRADRV

SEQ ID NO: 55988 - protein, 8 aa, Dengue virus
NFRADRVI

SEQ ID NO: 55989 - protein, 8 aa, Dengue virus
FRADRVID

SEQ ID NO: 55990 - protein, 8 aa, Dengue virus
RADRVIDP

SEQ ID NO: 55991 - protein, 8 aa, Dengue virus
AGPMPVTV

SEQ ID NO: 55992 - protein, 8 aa, Dengue virus
GPMPVTVA

SEQ ID NO: 55993 - protein, 8 aa, Dengue virus
PMPVTVAS

SEQ ID NO: 55994 - protein, 8 aa, Dengue virus
MPVTVASA

SEQ ID NO: 55995 - protein, 8 aa, Dengue virus
PVTVASAA

SEQ ID NO: 55996 - protein, 8 aa, Dengue virus
VTVASAAQ

SEQ ID NO: 55997 - protein, 8 aa, Dengue virus
TVASAAQR

SEQ ID NO: 55998 - protein, 8 aa, Dengue virus
VASAAQRR

SEQ ID NO: 55999 - protein, 8 aa, Dengue virus
GRVGRNPP

SEQ ID NO: 56000 - protein, 8 aa, Dengue virus
RVGRNPPK

SEQ ID NO: 56001 - protein, 8 aa, Dengue virus
VGRNPPKE

SEQ ID NO: 56002 - protein, 8 aa, Dengue virus
GRNPPKEN

SEQ ID NO: 56003 - protein, 8 aa, Dengue virus
RNPPKEND

SEQ ID NO: 56004 - protein, 8 aa, Dengue virus
NPPKENDQ

SEQ ID NO: 56005 - protein, 8 aa, Dengue virus
PPKENDQY

SEQ ID NO: 56006 - protein, 8 aa, Dengue virus
PKENDQYI

SEQ ID NO: 56007 - protein, 8 aa, Dengue virus
ENDQYIFM

SEQ ID NO: 56008 - protein, 8 aa, Dengue virus
NDQYIFMG

SEQ ID NO: 56009 - protein, 8 aa, Dengue virus
DQYIFMGQ

SEQ ID NO: 56010 - protein, 8 aa, Dengue virus
QYIFMGQP

SEQ ID NO: 56011 - protein, 8 aa, Dengue virus
YIFMGQPL

SEQ ID NO: 56012 - protein, 8 aa, Dengue virus
IFMGQPLN

SEQ ID NO: 56013 - protein, 8 aa, Dengue virus
FMGQPLNN

SEQ ID NO: 56014 - protein, 8 aa, Dengue virus
MGQPLNND

SEQ ID NO: 56015 - protein, 8 aa, Dengue virus
DLPVWLAY

SEQ ID NO: 56016 - protein, 8 aa, Dengue virus
LPVWLAYK

SEQ ID NO: 56017 - protein, 8 aa, Dengue virus
PVWLAYKV

SEQ ID NO: 56018 - protein, 8 aa, Dengue virus
VWLAYKVA

SEQ ID NO: 56019 - protein, 8 aa, Dengue virus
WLAYKVAS

SEQ ID NO: 56020 - protein, 8 aa, Dengue virus
LAYKVASE

SEQ ID NO: 56021 - protein, 8 aa, Dengue virus
AYKVASEG

SEQ ID NO: 56022 - protein, 8 aa, Dengue virus
YKVASEGI

SEQ ID NO: 56023 - protein, 8 aa, Dengue virus
RKWCFDGE

SEQ ID NO: 56024 - protein, 8 aa, Dengue virus
KWCFDGER

SEQ ID NO: 56025 - protein, 8 aa, Dengue virus
WCFDGERN

SEQ ID NO: 56026 - protein, 8 aa, Dengue virus
CFDGERNN

SEQ ID NO: 56027 - protein, 8 aa, Dengue virus
FDGERNNQ

SEQ ID NO: 56028 - protein, 8 aa, Dengue virus
DGERNNQI

SEQ ID NO: 56029 - protein, 8 aa, Dengue virus
GERNNQIL

SEQ ID NO: 56030 - protein, 8 aa, Dengue virus
ERNNQILE

SEQ ID NO: 56031 - protein, 8 aa, Dengue virus
IWTKEGER

SEQ ID NO: 56032 - protein, 8 aa, Dengue virus
WTKEGERK

SEQ ID NO: 56033 - protein, 8 aa, Dengue virus
TKEGERKK

SEQ ID NO: 56034 - protein, 8 aa, Dengue virus
KEGERKKL

SEQ ID NO: 56035 - protein, 8 aa, Dengue virus
EGERKKLR

SEQ ID NO: 56036 - protein, 8 aa, Dengue virus
GERKKLRP

SEQ ID NO: 56037 - protein, 8 aa, Dengue virus
ERKKLRPR

SEQ ID NO: 56038 - protein, 8 aa, Dengue virus
RKKLRPRW

SEQ ID NO: 56039 - protein, 8 aa, Dengue virus
LALKEFKE

SEQ ID NO: 56040 - protein, 8 aa, Dengue virus
ALKEFKEF

SEQ ID NO: 56041 - protein, 8 aa, Dengue virus
LKEFKEFA

SEQ ID NO: 56042 - protein, 8 aa, Dengue virus
KEFKEFAA

SEQ ID NO: 56043 - protein, 8 aa, Dengue virus
EFKEFAAG

SEQ ID NO: 56044 - protein, 8 aa, Dengue virus
FKEFAAGR

SEQ ID NO: 56045 - protein, 8 aa, Dengue virus
KEFAAGRK

SEQ ID NO: 56046 - protein, 8 aa, Dengue virus
EFAAGRKS

SEQ ID NO: 56047 - protein, 8 aa, Dengue virus
AGRKSIAF

SEQ ID NO: 56048 - protein, 8 aa, Dengue virus
GRKSIAFD

SEQ ID NO: 56049 - protein, 8 aa, Dengue virus
RKSIAFDL

SEQ ID NO: 56050 - protein, 8 aa, Dengue virus
KSIAFDLV

SEQ ID NO: 56051 - protein, 8 aa, Dengue virus
SIAFDLVT

SEQ ID NO: 56052 - protein, 8 aa, Dengue virus
IAFDLVTE

SEQ ID NO: 56053 - protein, 8 aa, Dengue virus
AFDLVTEI

SEQ ID NO: 56054 - protein, 8 aa, Dengue virus
FDLVTEIG

SEQ ID NO: 56055 - protein, 8 aa, Dengue virus
TEIGRVPT

SEQ ID NO: 56056 - protein, 8 aa, Dengue virus
EIGRVPTH

SEQ ID NO: 56057 - protein, 8 aa, Dengue virus
IGRVPTHL

SEQ ID NO: 56058 - protein, 8 aa, Dengue virus
GRVPTHLA

SEQ ID NO: 56059 - protein, 8 aa, Dengue virus
RVPTHLAH

SEQ ID NO: 56060 - protein, 8 aa, Dengue virus
VPTHLAHR

SEQ ID NO: 56061 - protein, 8 aa, Dengue virus
PTHLAHRT

SEQ ID NO: 56062 - protein, 8 aa, Dengue virus
THLAHRTR

SEQ ID NO: 56063 - protein, 8 aa, Dengue virus
HLAYRTRN

SEQ ID NO: 56064 - protein, 8 aa, Dengue virus
LAYRTRNA

SEQ ID NO: 56065 - protein, 8 aa, Dengue virus
AYRTRNAL

SEQ ID NO: 56066 - protein, 8 aa, Dengue virus
YRTRNALD

SEQ ID NO: 56067 - protein, 8 aa, Dengue virus
HTSEHGGK

SEQ ID NO: 56068 - protein, 8 aa, Dengue virus
TSEHGGKA

SEQ ID NO: 56069 - protein, 8 aa, Dengue virus
SEHGGKAY

SEQ ID NO: 56070 - protein, 8 aa, Dengue virus
EHGGKAYR

SEQ ID NO: 56071 - protein, 8 aa, Dengue virus
HGGKAYRH

SEQ ID NO: 56072 - protein, 8 aa, Dengue virus
GGKAYRHA

SEQ ID NO: 56073 - protein, 8 aa, Dengue virus
GKAYRHAV

SEQ ID NO: 56074 - protein, 8 aa, Dengue virus
KAYRHAVE

SEQ ID NO: 56075 - protein, 8 aa, Dengue virus
MILLTGGV

SEQ ID NO: 56076 - protein, 8 aa, Dengue virus
ILLTGGVM

SEQ ID NO: 56077 - protein, 8 aa, Dengue virus
LLTGGVML

SEQ ID NO: 56078 - protein, 8 aa, Dengue virus
LTGGVMLF

SEQ ID NO: 56079 - protein, 8 aa, Dengue virus
TGGVMLFL

SEQ ID NO: 56080 - protein, 8 aa, Dengue virus
GGVMLFLI

SEQ ID NO: 56081 - protein, 8 aa, Dengue virus
GVMLFLIS

SEQ ID NO: 56082 - protein, 8 aa, Dengue virus
VMLFLISG

SEQ ID NO: 56083 - protein, 8 aa, Dengue virus
MLFLISGR

SEQ ID NO: 56084 - protein, 8 aa, Dengue virus
LFLISGRG

SEQ ID NO: 56085 - protein, 8 aa, Dengue virus
FLISGKGV

SEQ ID NO: 56086 - protein, 8 aa, Dengue virus
LISGKGVG

SEQ ID NO: 56087 - protein, 8 aa, Dengue virus
ISGKGVGK

SEQ ID NO: 56088 - protein, 8 aa, Dengue virus
SGKGVGKT

SEQ ID NO: 56089 - protein, 8 aa, Dengue virus
GKGVGKTS

SEQ ID NO: 56090 - protein, 8 aa, Dengue virus
KGVGKTSI

SEQ ID NO: 56091 - protein, 8 aa, Dengue virus
GVGKTSIG

SEQ ID NO: 56092 - protein, 8 aa, Dengue virus
VGKTSIGL

SEQ ID NO: 56093 - protein, 8 aa, Dengue virus
GKTTIGLI

SEQ ID NO: 56094 - protein, 8 aa, Dengue virus
KTTIGLIC

SEQ ID NO: 56095 - protein, 8 aa, Dengue virus
TTIGLICV

SEQ ID NO: 56096 - protein, 8 aa, Dengue virus
SIGLICVV

SEQ ID NO: 56097 - protein, 8 aa, Dengue virus
IGLICVIV

SEQ ID NO: 56098 - protein, 8 aa, Dengue virus
GLICVIVS

SEQ ID NO: 56099 - protein, 8 aa, Dengue virus
LICVIVSS

SEQ ID NO: 56100 - protein, 8 aa, Dengue virus
ICVIVSSG

SEQ ID NO: 56101 - protein, 8 aa, Dengue virus
CVIVSSGM

SEQ ID NO: 56102 - protein, 8 aa, Dengue virus
VIVSSGML

SEQ ID NO: 56103 - protein, 8 aa, Dengue virus
IVSSGMLW

SEQ ID NO: 56104 - protein, 8 aa, Dengue virus
VSSGMLWM

SEQ ID NO: 56105 - protein, 8 aa, Dengue virus
SGMLWMAD

SEQ ID NO: 56106 - protein, 8 aa, Dengue virus
GMLWMADV

SEQ ID NO: 56107 - protein, 8 aa, Dengue virus
MLWMADVP

SEQ ID NO: 56108 - protein, 8 aa, Dengue virus
LWMADVPL

SEQ ID NO: 56109 - protein, 8 aa, Dengue virus
WMADVPLQ

SEQ ID NO: 56110 - protein, 8 aa, Dengue virus
MADVPLQW

SEQ ID NO: 56111 - protein, 8 aa, Dengue virus
ADVPLQWI

SEQ ID NO: 56112 - protein, 8 aa, Dengue virus
DVPLQWIA

SEQ ID NO: 56113 - protein, 8 aa, Dengue virus
VPLQWIAS

SEQ ID NO: 56114 - protein, 8 aa, Dengue virus
QWIASAII

SEQ ID NO: 56115 - protein, 8 aa, Dengue virus
WIASAIIL

SEQ ID NO: 56116 - protein, 8 aa, Dengue virus
IASAIILE

SEQ ID NO: 56117 - protein, 8 aa, Dengue virus
ASAIILEF

SEQ ID NO: 56118 - protein, 8 aa, Dengue virus
SAIILEFF

SEQ ID NO: 56119 - protein, 8 aa, Dengue virus
AIILEFFM

SEQ ID NO: 56120 - protein, 8 aa, Dengue virus
IILEFFMM

SEQ ID NO: 56121 - protein, 8 aa, Dengue virus
ILEFFMMV

SEQ ID NO: 56122 - protein, 8 aa, Dengue virus
GILTLAAT

SEQ ID NO: 56123 - protein, 8 aa, Dengue virus
ILTLAAIV

SEQ ID NO: 56124 - protein, 8 aa, Dengue virus
LTLAAIVA

SEQ ID NO: 56125 - protein, 8 aa, Dengue virus
TLAAIVAA

SEQ ID NO: 56126 - protein, 8 aa, Dengue virus
LAAIVAAN

SEQ ID NO: 56127 - protein, 8 aa, Dengue virus
AAIVAANE

SEQ ID NO: 56128 - protein, 8 aa, Dengue virus
AIVAANEM

SEQ ID NO: 56129 - protein, 8 aa, Dengue virus
IVAANEMG

SEQ ID NO: 56130 - protein, 8 aa, Dengue virus
VAANEMGL

SEQ ID NO: 56131 - protein, 8 aa, Dengue virus
TANEMGLL

SEQ ID NO: 56132 - protein, 8 aa, Dengue virus
GMLETTKR

SEQ ID NO: 56133 - protein, 8 aa, Dengue virus
MLETTKRD

SEQ ID NO: 56134 - protein, 8 aa, Dengue virus
KRDLGMSR

SEQ ID NO: 56135 - protein, 8 aa, Dengue virus
RDLGMSRE

SEQ ID NO: 56136 - protein, 8 aa, Dengue virus
DLGMSREP

SEQ ID NO: 56137 - protein, 8 aa, Dengue virus
LGMSREPG

SEQ ID NO: 56138 - protein, 8 aa, Dengue virus
GMSREPGV

SEQ ID NO: 56139 - protein, 8 aa, Dengue virus
MSKEPGVA

SEQ ID NO: 56140 - protein, 8 aa, Dengue virus
SKEPGVAS

SEQ ID NO: 56141 - protein, 8 aa, Dengue virus
KEPGVASP

SEQ ID NO: 56142 - protein, 8 aa, Dengue virus
EPGVASPT

SEQ ID NO: 56143 - protein, 8 aa, Dengue virus
PGVASPTS

SEQ ID NO: 56144 - protein, 8 aa, Dengue virus
GVASPTSY

SEQ ID NO: 56145 - protein, 8 aa, Dengue virus
VASPTSYL

SEQ ID NO: 56146 - protein, 8 aa, Dengue virus
ASPTSYLD

SEQ ID NO: 56147 - protein, 8 aa, Dengue virus
SSTSYLDV

SEQ ID NO: 56148 - protein, 8 aa, Dengue virus
STSYLDVD

SEQ ID NO: 56149 - protein, 8 aa, Dengue virus
NSYLDVDL

SEQ ID NO: 56150 - protein, 8 aa, Dengue virus
QVNPLTLI

SEQ ID NO: 56151 - protein, 8 aa, Dengue virus
VNPLTLIA

SEQ ID NO: 56152 - protein, 8 aa, Dengue virus
NPLTLTAV

SEQ ID NO: 56153 - protein, 8 aa, Dengue virus
PLTLTAVV

SEQ ID NO: 56154 - protein, 8 aa, Dengue virus
LTLTAVVL

SEQ ID NO: 56155 - protein, 8 aa, Dengue virus
TLTAVVLL

SEQ ID NO: 56156 - protein, 8 aa, Dengue virus
LTAVVLLL

SEQ ID NO: 56157 - protein, 8 aa, Dengue virus
TAAVLLLV

SEQ ID NO: 56158 - protein, 8 aa, Dengue virus
AAVLLLVT

SEQ ID NO: 56159 - protein, 8 aa, Dengue virus
AVLLLVTH

SEQ ID NO: 56160 - protein, 8 aa, Dengue virus
VLLLVTHY

SEQ ID NO: 56161 - protein, 8 aa, Dengue virus
LLLVTHYA

SEQ ID NO: 56162 - protein, 8 aa, Dengue virus
LLVTHYAI

SEQ ID NO: 56163 - protein, 8 aa, Dengue virus
LVTHYAII

SEQ ID NO: 56164 - protein, 8 aa, Dengue virus
VTHYAIIG

SEQ ID NO: 56165 - protein, 8 aa, Dengue virus
VMLLVLCV

SEQ ID NO: 56166 - protein, 8 aa, Dengue virus
MLLVLCAA

SEQ ID NO: 56167 - protein, 8 aa, Dengue virus
LLVLCAAQ

SEQ ID NO: 56168 - protein, 8 aa, Dengue virus
LVLCAAQL

SEQ ID NO: 56169 - protein, 8 aa, Dengue virus
VLCAAQLL

SEQ ID NO: 56170 - protein, 8 aa, Dengue virus
LCAAQLLL

SEQ ID NO: 56171 - protein, 8 aa, Dengue virus
CAAQLLLM

SEQ ID NO: 56172 - protein, 8 aa, Dengue virus
AAQLLLMR

SEQ ID NO: 56173 - protein, 8 aa, Dengue virus
LMRTSWAF

SEQ ID NO: 56174 - protein, 8 aa, Dengue virus
MRTSWAFC

SEQ ID NO: 56175 - protein, 8 aa, Dengue virus
RTSWAFCE

SEQ ID NO: 56176 - protein, 8 aa, Dengue virus
TSWAFCEA

SEQ ID NO: 56177 - protein, 8 aa, Dengue virus
SWAFCEAL

SEQ ID NO: 56178 - protein, 8 aa, Dengue virus
WAFCEALT

SEQ ID NO: 56179 - protein, 8 aa, Dengue virus
AFCEALTL

SEQ ID NO: 56180 - protein, 8 aa, Dengue virus
FCEALTLA

SEQ ID NO: 56181 - protein, 8 aa, Dengue virus
CEVLTLAT

SEQ ID NO: 56182 - protein, 8 aa, Dengue virus
EVLTLATG

SEQ ID NO: 56183 - protein, 8 aa, Dengue virus
VLTLATGP

SEQ ID NO: 56184 - protein, 8 aa, Dengue virus
RGNYLAGA

SEQ ID NO: 56185 - protein, 8 aa, Dengue virus
GNYLAGAG

SEQ ID NO: 56186 - protein, 8 aa, Dengue virus
SYIAGAGL

SEQ ID NO: 56187 - protein, 8 aa, Dengue virus
GAGLAFSV

SEQ ID NO: 56188 - protein, 8 aa, Dengue virus
AGLAFSVM

SEQ ID NO: 56189 - protein, 8 aa, Dengue virus
LAFSVMKS

SEQ ID NO: 56190 - protein, 8 aa, Dengue virus
AFSVMKSV

SEQ ID NO: 56191 - protein, 8 aa, Dengue virus
FSVMKSVG

SEQ ID NO: 56192 - protein, 8 aa, Dengue virus
SVMKSVGT

SEQ ID NO: 56193 - protein, 8 aa, Dengue virus
VMKSVGTG

SEQ ID NO: 56194 - protein, 8 aa, Dengue virus
MKSVGTGR

SEQ ID NO: 56195 - protein, 8 aa, Dengue virus
KSVGTGRR

SEQ ID NO: 56196 - protein, 8 aa, Dengue virus
SVGTGRRG

SEQ ID NO: 56197 - protein, 8 aa, Dengue virus
VGTGRRGT

SEQ ID NO: 56198 - protein, 8 aa, Dengue virus
GTGRRGTG

SEQ ID NO: 56199 - protein, 8 aa, Dengue virus
TGRRGTGS

SEQ ID NO: 56200 - protein, 8 aa, Dengue virus
GRRGTGSQ

SEQ ID NO: 56201 - protein, 8 aa, Dengue virus
RRGTGSQG

SEQ ID NO: 56202 - protein, 8 aa, Dengue virus
TLGEKWKR

SEQ ID NO: 56203 - protein, 8 aa, Dengue virus
LGEKWKKR

SEQ ID NO: 56204 - protein, 8 aa, Dengue virus
GEKWKKRL

SEQ ID NO: 56205 - protein, 8 aa, Dengue virus
EKWKKRLN

SEQ ID NO: 56206 - protein, 8 aa, Dengue virus
KWKKRLNQ

SEQ ID NO: 56207 - protein, 8 aa, Dengue virus
WKKRLNQL

SEQ ID NO: 56208 - protein, 8 aa, Dengue virus
KKRLNQLS

SEQ ID NO: 56209 - protein, 8 aa, Dengue virus
KRLNQLSR

SEQ ID NO: 56210 - protein, 8 aa, Dengue virus
RLNQLSRK

SEQ ID NO: 56211 - protein, 8 aa, Dengue virus
LNQLSRKD

SEQ ID NO: 56212 - protein, 8 aa, Dengue virus
NQLSRKDF

SEQ ID NO: 56213 - protein, 8 aa, Dengue virus
QLSRKDFD

SEQ ID NO: 56214 - protein, 8 aa, Dengue virus
LSRKDFDL

SEQ ID NO: 56215 - protein, 8 aa, Dengue virus
SRKDFDLY

SEQ ID NO: 56216 - protein, 8 aa, Dengue virus
RKDFDLYK

SEQ ID NO: 56217 - protein, 8 aa, Dengue virus
KDFDLYKK

SEQ ID NO: 56218 - protein, 8 aa, Dengue virus
DFDLYKKS

SEQ ID NO: 56219 - protein, 8 aa, Dengue virus
GITEVDRI

SEQ ID NO: 56220 - protein, 8 aa, Dengue virus
ITEVDRIE

SEQ ID NO: 56221 - protein, 8 aa, Dengue virus
TEVDRIEA

SEQ ID NO: 56222 - protein, 8 aa, Dengue virus
EVDRIEAK

SEQ ID NO: 56223 - protein, 8 aa, Dengue virus
VDRIEAKE

SEQ ID NO: 56224 - protein, 8 aa, Dengue virus
DRIEAKEG

SEQ ID NO: 56225 - protein, 8 aa, Dengue virus
RIEAKEGL

SEQ ID NO: 56226 - protein, 8 aa, Dengue virus
IEAKEGLK

SEQ ID NO: 56227 - protein, 8 aa, Dengue virus
EAKEGLKK

SEQ ID NO: 56228 - protein, 8 aa, Dengue virus
AKEGLRRG

SEQ ID NO: 56229 - protein, 8 aa, Dengue virus
KEGLRRGE

SEQ ID NO: 56230 - protein, 8 aa, Dengue virus
EGLKRGET

SEQ ID NO: 56231 - protein, 8 aa, Dengue virus
GLKRGETT

SEQ ID NO: 56232 - protein, 8 aa, Dengue virus
RGETTHHA

SEQ ID NO: 56233 - protein, 8 aa, Dengue virus
GETTHHAV

SEQ ID NO: 56234 - protein, 8 aa, Dengue virus
ETTHHAVS

SEQ ID NO: 56235 - protein, 8 aa, Dengue virus
TTHHAVSR

SEQ ID NO: 56236 - protein, 8 aa, Dengue virus
HHAVSRGT

SEQ ID NO: 56237 - protein, 8 aa, Dengue virus
HAVSRGTA

SEQ ID NO: 56238 - protein, 8 aa, Dengue virus
AVSRGTAK

SEQ ID NO: 56239 - protein, 8 aa, Dengue virus
VSRGTAKL

SEQ ID NO: 56240 - protein, 8 aa, Dengue virus
SRGTAKLQ

SEQ ID NO: 56241 - protein, 8 aa, Dengue virus
RGTAKLQW

SEQ ID NO: 56242 - protein, 8 aa, Dengue virus
GTAKLQWF

SEQ ID NO: 56243 - protein, 8 aa, Dengue virus
TAKLQWFV

SEQ ID NO: 56244 - protein, 8 aa, Dengue virus
FVERNMVV

SEQ ID NO: 56245 - protein, 8 aa, Dengue virus
VERNMVVP

SEQ ID NO: 56246 - protein, 8 aa, Dengue virus
ERNMVVPE

SEQ ID NO: 56247 - protein, 8 aa, Dengue virus
RNMVVPEG

SEQ ID NO: 56248 - protein, 8 aa, Dengue virus
NMVVPEGR

SEQ ID NO: 56249 - protein, 8 aa, Dengue virus
MVVPEGRV

SEQ ID NO: 56250 - protein, 8 aa, Dengue virus
VVPEGRVI

SEQ ID NO: 56251 - protein, 8 aa, Dengue virus
VPEGRVID

SEQ ID NO: 56252 - protein, 8 aa, Dengue virus
MSTYGWNL

SEQ ID NO: 56253 - protein, 8 aa, Dengue virus
STYGWNLV

SEQ ID NO: 56254 - protein, 8 aa, Dengue virus
TYGWNLVK

SEQ ID NO: 56255 - protein, 8 aa, Dengue virus
YGWNLVKL

SEQ ID NO: 56256 - protein, 8 aa, Dengue virus
GWNLVKLM

SEQ ID NO: 56257 - protein, 8 aa, Dengue virus
WNLVKLMS

SEQ ID NO: 56258 - protein, 8 aa, Dengue virus
NLVKLMSG

SEQ ID NO: 56259 - protein, 8 aa, Dengue virus
LVKLMSGK

SEQ ID NO: 56260 - protein, 8 aa, Dengue virus
VKLMTGKD

SEQ ID NO: 56261 - protein, 8 aa, Dengue virus
KLMTGKDV

SEQ ID NO: 56262 - protein, 8 aa, Dengue virus
LMTGKDVF

SEQ ID NO: 56263 - protein, 8 aa, Dengue virus
MTGKDVFY

SEQ ID NO: 56264 - protein, 8 aa, Dengue virus
PSPTVEEG

SEQ ID NO: 56265 - protein, 8 aa, Dengue virus
SPIVEESR

SEQ ID NO: 56266 - protein, 8 aa, Dengue virus
PTVEEGRT

SEQ ID NO: 56267 - protein, 8 aa, Dengue virus
IVEESRTI

SEQ ID NO: 56268 - protein, 8 aa, Dengue virus
GRTIRVLK

SEQ ID NO: 56269 - protein, 8 aa, Dengue virus
KMVEPWLR

SEQ ID NO: 56270 - protein, 8 aa, Dengue virus
MVEPWLRN

SEQ ID NO: 56271 - protein, 8 aa, Dengue virus
VEPWLRNN

SEQ ID NO: 56272 - protein, 8 aa, Dengue virus
EPWLRNNQ

SEQ ID NO: 56273 - protein, 8 aa, Dengue virus
PWLRNNQF

SEQ ID NO: 56274 - protein, 8 aa, Dengue virus
WLRNNQFC

SEQ ID NO: 56275 - protein, 8 aa, Dengue virus
LRNNQFCI

SEQ ID NO: 56276 - protein, 8 aa, Dengue virus
RNNQFCIK

SEQ ID NO: 56277 - protein, 8 aa, Dengue virus
NNQFCIKI

SEQ ID NO: 56278 - protein, 8 aa, Dengue virus
NQFCIKIL

SEQ ID NO: 56279 - protein, 8 aa, Dengue virus
QFCIKILN

SEQ ID NO: 56280 - protein, 8 aa, Dengue virus
FCIKILNP

SEQ ID NO: 56281 - protein, 8 aa, Dengue virus
CIKILNPY

SEQ ID NO: 56282 - protein, 8 aa, Dengue virus
IKILNPYM

SEQ ID NO: 56283 - protein, 8 aa, Dengue virus
KILNPYMP

SEQ ID NO: 56284 - protein, 8 aa, Dengue virus
VLNPYMPA

SEQ ID NO: 56285 - protein, 8 aa, Dengue virus
LNPYMPAV

SEQ ID NO: 56286 - protein, 8 aa, Dengue virus
NPYMPAVI

SEQ ID NO: 56287 - protein, 8 aa, Dengue virus
PYMPAVIE

SEQ ID NO: 56288 - protein, 8 aa, Dengue virus
YMPAVIEH

SEQ ID NO: 56289 - protein, 8 aa, Dengue virus
MPAVIEHL

SEQ ID NO: 56290 - protein, 8 aa, Dengue virus
PAVIEHLE

SEQ ID NO: 56291 - protein, 8 aa, Dengue virus
AVIEHLER

SEQ ID NO: 56292 - protein, 8 aa, Dengue virus
VVEHLERL

SEQ ID NO: 56293 - protein, 8 aa, Dengue virus
VEHLERLQ

SEQ ID NO: 56294 - protein, 8 aa, Dengue virus
LERLQRKY

SEQ ID NO: 56295 - protein, 8 aa, Dengue virus
ERLQRKYG

SEQ ID NO: 56296 - protein, 8 aa, Dengue virus
RLQRKYGG

SEQ ID NO: 56297 - protein, 8 aa, Dengue virus
LQRKYGGM

SEQ ID NO: 56298 - protein, 8 aa, Dengue virus
QRKYGGML

SEQ ID NO: 56299 - protein, 8 aa, Dengue virus
RKYGGMLV

SEQ ID NO: 56300 - protein, 8 aa, Dengue virus
KYGGMLVR

SEQ ID NO: 56301 - protein, 8 aa, Dengue virus
YGGMLVRN

SEQ ID NO: 56302 - protein, 8 aa, Dengue virus
NGTGNIVS

SEQ ID NO: 56303 - protein, 8 aa, Dengue virus
GTGNIVSS

SEQ ID NO: 56304 - protein, 8 aa, Dengue virus
TGNIVSSV

SEQ ID NO: 56305 - protein, 8 aa, Dengue virus
GNIVSSVN

SEQ ID NO: 56306 - protein, 8 aa, Dengue virus
NIVSSVNM

SEQ ID NO: 56307 - protein, 8 aa, Dengue virus
IVSSVNMV

SEQ ID NO: 56308 - protein, 8 aa, Dengue virus
VSSVNMVS

SEQ ID NO: 56309 - protein, 8 aa, Dengue virus
SSVNMVSR

SEQ ID NO: 56310 - protein, 8 aa, Dengue virus
LNRFTMTY

SEQ ID NO: 56311 - protein, 8 aa, Dengue virus
NRFTMTYR

SEQ ID NO: 56312 - protein, 8 aa, Dengue virus
RFTMTYRR

SEQ ID NO: 56313 - protein, 8 aa, Dengue virus
FTMTYRRP

SEQ ID NO: 56314 - protein, 8 aa, Dengue virus
TMTYRRPT

SEQ ID NO: 56315 - protein, 8 aa, Dengue virus
MTYRRPTI

SEQ ID NO: 56316 - protein, 8 aa, Dengue virus
TYRRPTIE

SEQ ID NO: 56317 - protein, 8 aa, Dengue virus
YRRPTIEK

SEQ ID NO: 56318 - protein, 8 aa, Dengue virus
RKPTIEKD

SEQ ID NO: 56319 - protein, 8 aa, Dengue virus
KPTIEKDV

SEQ ID NO: 56320 - protein, 8 aa, Dengue virus
PTIERDVD

SEQ ID NO: 56321 - protein, 8 aa, Dengue virus
TIERDVDL

SEQ ID NO: 56322 - protein, 8 aa, Dengue virus
IERDVDLG

SEQ ID NO: 56323 - protein, 8 aa, Dengue virus
ERDVDLGA

SEQ ID NO: 56324 - protein, 8 aa, Dengue virus
RDVDLGAG

SEQ ID NO: 56325 - protein, 8 aa, Dengue virus
HVNAEPEI

SEQ ID NO: 56326 - protein, 8 aa, Dengue virus
VNAEPEIP

SEQ ID NO: 56327 - protein, 8 aa, Dengue virus
NAEPEIPN

SEQ ID NO: 56328 - protein, 8 aa, Dengue virus
AEPEIPNM

SEQ ID NO: 56329 - protein, 8 aa, Dengue virus
EPEIPNMD

SEQ ID NO: 56330 - protein, 8 aa, Dengue virus
PEIPNMDV

SEQ ID NO: 56331 - protein, 8 aa, Dengue virus
EIPNMDVI

SEQ ID NO: 56332 - protein, 8 aa, Dengue virus
IPNMDVIG

SEQ ID NO: 56333 - protein, 8 aa, Dengue virus
DVIGERIR

SEQ ID NO: 56334 - protein, 8 aa, Dengue virus
VIGERIRR

SEQ ID NO: 56335 - protein, 8 aa, Dengue virus
IGERIRRI

SEQ ID NO: 56336 - protein, 8 aa, Dengue virus
GERIRRIK

SEQ ID NO: 56337 - protein, 8 aa, Dengue virus
ERIRRIKE

SEQ ID NO: 56338 - protein, 8 aa, Dengue virus
RIRRIKEE

SEQ ID NO: 56339 - protein, 8 aa, Dengue virus
IRRIKEEH

SEQ ID NO: 56340 - protein, 8 aa, Dengue virus
RIKEEHSS

SEQ ID NO: 56341 - protein, 8 aa, Dengue virus
IKEEHSST

SEQ ID NO: 56342 - protein, 8 aa, Dengue virus
KEEHSSTW

SEQ ID NO: 56343 - protein, 8 aa, Dengue virus
EEHSSTWH

SEQ ID NO: 56344 - protein, 8 aa, Dengue virus
EHSSTWHY

SEQ ID NO: 56345 - protein, 8 aa, Dengue virus
HSSTWHYD

SEQ ID NO: 56346 - protein, 8 aa, Dengue virus
SSTWHYDD

SEQ ID NO: 56347 - protein, 8 aa, Dengue virus
KTWHYDDE

SEQ ID NO: 56348 - protein, 8 aa, Dengue virus
KPWDVVPT

SEQ ID NO: 56349 - protein, 8 aa, Dengue virus
PWDVVPTV

SEQ ID NO: 56350 - protein, 8 aa, Dengue virus
WDVVPTVT

SEQ ID NO: 56351 - protein, 8 aa, Dengue virus
DVVPTVTQ

SEQ ID NO: 56352 - protein, 8 aa, Dengue virus
VVPTVTQM

SEQ ID NO: 56353 - protein, 8 aa, Dengue virus
VPTVTQMA

SEQ ID NO: 56354 - protein, 8 aa, Dengue virus
PTVTQMAM

SEQ ID NO: 56355 - protein, 8 aa, Dengue virus
TVTQMAMT

SEQ ID NO: 56356 - protein, 8 aa, Dengue virus
VIQMAMTD

SEQ ID NO: 56357 - protein, 8 aa, Dengue virus
IQMAMTDT

SEQ ID NO: 56358 - protein, 8 aa, Dengue virus
KVDTRTPK

SEQ ID NO: 56359 - protein, 8 aa, Dengue virus
VDTRTPRP

SEQ ID NO: 56360 - protein, 8 aa, Dengue virus
DTRTPRPM

SEQ ID NO: 56361 - protein, 8 aa, Dengue virus
TRTPRPMP

SEQ ID NO: 56362 - protein, 8 aa, Dengue virus
RTPRPMPG

SEQ ID NO: 56363 - protein, 8 aa, Dengue virus
TPRPMPGT

SEQ ID NO: 56364 - protein, 8 aa, Dengue virus
PRPMPGTR

SEQ ID NO: 56365 - protein, 8 aa, Dengue virus
MPGTRKVM

SEQ ID NO: 56366 - protein, 8 aa, Dengue virus
GTRRVMGI

SEQ ID NO: 56367 - protein, 8 aa, Dengue virus
TRRVMGIT

SEQ ID NO: 56368 - protein, 8 aa, Dengue virus
VMGITAEW

SEQ ID NO: 56369 - protein, 8 aa, Dengue virus
MGITAEWL

SEQ ID NO: 56370 - protein, 8 aa, Dengue virus
GITAEWLW

SEQ ID NO: 56371 - protein, 8 aa, Dengue virus
ITAGWLWR

SEQ ID NO: 56372 - protein, 8 aa, Dengue virus
TAGWLWRT

SEQ ID NO: 56373 - protein, 8 aa, Dengue virus
AGWLWRTL

SEQ ID NO: 56374 - protein, 8 aa, Dengue virus
GWLWRTLG

SEQ ID NO: 56375 - protein, 8 aa, Dengue virus
RTLGRNKR

SEQ ID NO: 56376 - protein, 8 aa, Dengue virus
TLGRNKRP

SEQ ID NO: 56377 - protein, 8 aa, Dengue virus
LGRNKRPR

SEQ ID NO: 56378 - protein, 8 aa, Dengue virus
GRNKRPRL

SEQ ID NO: 56379 - protein, 8 aa, Dengue virus
RNKRPRLC

SEQ ID NO: 56380 - protein, 8 aa, Dengue virus
NKRPRLCT

SEQ ID NO: 56381 - protein, 8 aa, Dengue virus
KRPRLCTR

SEQ ID NO: 56382 - protein, 8 aa, Dengue virus
RPRLCTRE

SEQ ID NO: 56383 - protein, 8 aa, Dengue virus
LCTREEFI

SEQ ID NO: 56384 - protein, 8 aa, Dengue virus
CTREEFIK

SEQ ID NO: 56385 - protein, 8 aa, Dengue virus
TREEFIKK

SEQ ID NO: 56386 - protein, 8 aa, Dengue virus
REEFIKKV

SEQ ID NO: 56387 - protein, 8 aa, Dengue virus
EEFIKKVR

SEQ ID NO: 56388 - protein, 8 aa, Dengue virus
EFIKKVRT

SEQ ID NO: 56389 - protein, 8 aa, Dengue virus
FIKKVRTN

SEQ ID NO: 56390 - protein, 8 aa, Dengue virus
IKKVRTNA

SEQ ID NO: 56391 - protein, 8 aa, Dengue virus
ENQWDSAR

SEQ ID NO: 56392 - protein, 8 aa, Dengue virus
NQWDSARA

SEQ ID NO: 56393 - protein, 8 aa, Dengue virus
QWDSARAA

SEQ ID NO: 56394 - protein, 8 aa, Dengue virus
WDSARAAV

SEQ ID NO: 56395 - protein, 8 aa, Dengue virus
DSARAAVE

SEQ ID NO: 56396 - protein, 8 aa, Dengue virus
SARAAVED

SEQ ID NO: 56397 - protein, 8 aa, Dengue virus
ARAAVEDE

SEQ ID NO: 56398 - protein, 8 aa, Dengue virus
RAAVEDEE

SEQ ID NO: 56399 - protein, 8 aa, Dengue virus
AAVEDEEF

SEQ ID NO: 56400 - protein, 8 aa, Dengue virus
AVEDEEFW

SEQ ID NO: 56401 - protein, 8 aa, Dengue virus
VEDEEFWK

SEQ ID NO: 56402 - protein, 8 aa, Dengue virus
EDEEFWKL

SEQ ID NO: 56403 - protein, 8 aa, Dengue virus
DEEFWKLV

SEQ ID NO: 56404 - protein, 8 aa, Dengue virus
EEFWKLVD

SEQ ID NO: 56405 - protein, 8 aa, Dengue virus
EFWKLVDR

SEQ ID NO: 56406 - protein, 8 aa, Dengue virus
FWKLVDKE

SEQ ID NO: 56407 - protein, 8 aa, Dengue virus
WKLVDKER

SEQ ID NO: 56408 - protein, 8 aa, Dengue virus
KLVDKERE

SEQ ID NO: 56409 - protein, 8 aa, Dengue virus
LVDKEREL

SEQ ID NO: 56410 - protein, 8 aa, Dengue virus
VDKERELH

SEQ ID NO: 56411 - protein, 8 aa, Dengue virus
DKERELHK

SEQ ID NO: 56412 - protein, 8 aa, Dengue virus
KERELHKL

SEQ ID NO: 56413 - protein, 8 aa, Dengue virus
ERELHKQG

SEQ ID NO: 56414 - protein, 8 aa, Dengue virus
RELHKQGK

SEQ ID NO: 56415 - protein, 8 aa, Dengue virus
ELHKQGKC

SEQ ID NO: 56416 - protein, 8 aa, Dengue virus
LHKQGKCG

SEQ ID NO: 56417 - protein, 8 aa, Dengue virus
HKQGKCGS

SEQ ID NO: 56418 - protein, 8 aa, Dengue virus
KQGKCGSC

SEQ ID NO: 56419 - protein, 8 aa, Dengue virus
QGKCGSCV

SEQ ID NO: 56420 - protein, 8 aa, Dengue virus
YMWLGARF

SEQ ID NO: 56421 - protein, 8 aa, Dengue virus
MWLGARFL

SEQ ID NO: 56422 - protein, 8 aa, Dengue virus
WLGARFLE

SEQ ID NO: 56423 - protein, 8 aa, Dengue virus
LGARFLEF

SEQ ID NO: 56424 - protein, 8 aa, Dengue virus
GARFLEFE

SEQ ID NO: 56425 - protein, 8 aa, Dengue virus
ARFLEFEA

SEQ ID NO: 56426 - protein, 8 aa, Dengue virus
RFLEFEAL

SEQ ID NO: 56427 - protein, 8 aa, Dengue virus
FLEFEALG

SEQ ID NO: 56428 - protein, 8 aa, Dengue virus
LHNEEKII

SEQ ID NO: 56429 - protein, 8 aa, Dengue virus
HNEEKIIQ

SEQ ID NO: 56430 - protein, 8 aa, Dengue virus
NEEKIIQQ

SEQ ID NO: 56431 - protein, 8 aa, Dengue virus
EEKIIQQM

SEQ ID NO: 56432 - protein, 8 aa, Dengue virus
EKIIQQMD

SEQ ID NO: 56433 - protein, 8 aa, Dengue virus
KIIQQMDP

SEQ ID NO: 56434 - protein, 8 aa, Dengue virus
IIQQMDPE

SEQ ID NO: 56435 - protein, 8 aa, Dengue virus
IQQMDPEH

SEQ ID NO: 56436 - protein, 8 aa, Dengue virus
HQMDPEHR

SEQ ID NO: 56437 - protein, 8 aa, Dengue virus
QMDPEHRR

SEQ ID NO: 56438 - protein, 8 aa, Dengue virus
MDPEHKQL

SEQ ID NO: 56439 - protein, 8 aa, Dengue virus
DPEHRKLA

SEQ ID NO: 56440 - protein, 8 aa, Dengue virus
PEHRQLAS

SEQ ID NO: 56441 - protein, 8 aa, Dengue virus
EHRQLASA

SEQ ID NO: 56442 - protein, 8 aa, Dengue virus
HRQLASAI

SEQ ID NO: 56443 - protein, 8 aa, Dengue virus
RQLASAIF

SEQ ID NO: 56444 - protein, 8 aa, Dengue virus
QLASAIFK

SEQ ID NO: 56445 - protein, 8 aa, Dengue virus
LASAIFKL

SEQ ID NO: 56446 - protein, 8 aa, Dengue virus
ASAIFKLT

SEQ ID NO: 56447 - protein, 8 aa, Dengue virus
SAIFKLTY

SEQ ID NO: 56448 - protein, 8 aa, Dengue virus
KVQRPTPK

SEQ ID NO: 56449 - protein, 8 aa, Dengue virus
VQRPTPKG

SEQ ID NO: 56450 - protein, 8 aa, Dengue virus
QRPTPKGT

SEQ ID NO: 56451 - protein, 8 aa, Dengue virus
RPTPKGTV

SEQ ID NO: 56452 - protein, 8 aa, Dengue virus
PTPKGTVM

SEQ ID NO: 56453 - protein, 8 aa, Dengue virus
TPKGTVMD

SEQ ID NO: 56454 - protein, 8 aa, Dengue virus
PKGTVMDI

SEQ ID NO: 56455 - protein, 8 aa, Dengue virus
KGTVMDII

SEQ ID NO: 56456 - protein, 8 aa, Dengue virus
FTNMEVQL

SEQ ID NO: 56457 - protein, 8 aa, Dengue virus
TNMEAQLV

SEQ ID NO: 56458 - protein, 8 aa, Dengue virus
NMEAQLVR

SEQ ID NO: 56459 - protein, 8 aa, Dengue virus
MEAQLVRQ

SEQ ID NO: 56460 - protein, 8 aa, Dengue virus
EAQLVRQM

SEQ ID NO: 56461 - protein, 8 aa, Dengue virus
AQLVRQME

SEQ ID NO: 56462 - protein, 8 aa, Dengue virus
QLVRQMEG

SEQ ID NO: 56463 - protein, 8 aa, Dengue virus
LVRQMEGE

SEQ ID NO: 56464 - protein, 8 aa, Dengue virus
VRQMEGEG

SEQ ID NO: 56465 - protein, 8 aa, Dengue virus
MEGEGVLT

SEQ ID NO: 56466 - protein, 8 aa, Dengue virus
EGEGVLTK

SEQ ID NO: 56467 - protein, 8 aa, Dengue virus
GEGVLTKA

SEQ ID NO: 56468 - protein, 8 aa, Dengue virus
VLTKADLE

SEQ ID NO: 56469 - protein, 8 aa, Dengue virus
EKKVTQWL

SEQ ID NO: 56470 - protein, 8 aa, Dengue virus
KKVTQWLE

SEQ ID NO: 56471 - protein, 8 aa, Dengue virus
TQWLETEG

SEQ ID NO: 56472 - protein, 8 aa, Dengue virus
QWLETEGV

SEQ ID NO: 56473 - protein, 8 aa, Dengue virus
WLETEGVE

SEQ ID NO: 56474 - protein, 8 aa, Dengue virus
LETEGVER

SEQ ID NO: 56475 - protein, 8 aa, Dengue virus
ETEGVERL

SEQ ID NO: 56476 - protein, 8 aa, Dengue virus
TKGVERLR

SEQ ID NO: 56477 - protein, 8 aa, Dengue virus
KGVERLRR

SEQ ID NO: 56478 - protein, 8 aa, Dengue virus
GVERLRRM

SEQ ID NO: 56479 - protein, 8 aa, Dengue virus
VERLRRMA

SEQ ID NO: 56480 - protein, 8 aa, Dengue virus
ERLRRMAI

SEQ ID NO: 56481 - protein, 8 aa, Dengue virus
RLRRMAIS

SEQ ID NO: 56482 - protein, 8 aa, Dengue virus
LRRMAISG

SEQ ID NO: 56483 - protein, 8 aa, Dengue virus
RRMAISGD

SEQ ID NO: 56484 - protein, 8 aa, Dengue virus
DRFANALF

SEQ ID NO: 56485 - protein, 8 aa, Dengue virus
RFANALFA

SEQ ID NO: 56486 - protein, 8 aa, Dengue virus
FANALFAL

SEQ ID NO: 56487 - protein, 8 aa, Dengue virus
ANALFALN

SEQ ID NO: 56488 - protein, 8 aa, Dengue virus
NALFALND

SEQ ID NO: 56489 - protein, 8 aa, Dengue virus
ALFALNDM

SEQ ID NO: 56490 - protein, 8 aa, Dengue virus
LFALNDMG

SEQ ID NO: 56491 - protein, 8 aa, Dengue virus
FALNDMGK

SEQ ID NO: 56492 - protein, 8 aa, Dengue virus
WQPSKGWQ

SEQ ID NO: 56493 - protein, 8 aa, Dengue virus
QPSKGWQD

SEQ ID NO: 56494 - protein, 8 aa, Dengue virus
PSKGWQDW

SEQ ID NO: 56495 - protein, 8 aa, Dengue virus
SKGWQDWQ

SEQ ID NO: 56496 - protein, 8 aa, Dengue virus
KGWQDWQQ

SEQ ID NO: 56497 - protein, 8 aa, Dengue virus
GWQDWQQV

SEQ ID NO: 56498 - protein, 8 aa, Dengue virus
WQDWQQVP

SEQ ID NO: 56499 - protein, 8 aa, Dengue virus
QDWQQVPF

SEQ ID NO: 56500 - protein, 8 aa, Dengue virus
QGAGWSLK

SEQ ID NO: 56501 - protein, 8 aa, Dengue virus
GAGWSLKE

SEQ ID NO: 56502 - protein, 8 aa, Dengue virus
AGWSLKET

SEQ ID NO: 56503 - protein, 8 aa, Dengue virus
GWSLKETA

SEQ ID NO: 56504 - protein, 8 aa, Dengue virus
WSLKETAC

SEQ ID NO: 56505 - protein, 8 aa, Dengue virus
SLKETACL

SEQ ID NO: 56506 - protein, 8 aa, Dengue virus
LKETACLG

SEQ ID NO: 56507 - protein, 8 aa, Dengue virus
KETACLGK

SEQ ID NO: 56508 - protein, 8 aa, Dengue virus
KAYAQMWA

SEQ ID NO: 56509 - protein, 8 aa, Dengue virus
AYAQMWAL

SEQ ID NO: 56510 - protein, 8 aa, Dengue virus
YAQMWALM

SEQ ID NO: 56511 - protein, 8 aa, Dengue virus
AQMWALMY

SEQ ID NO: 56512 - protein, 8 aa, Dengue virus
QMWALMYF

SEQ ID NO: 56513 - protein, 8 aa, Dengue virus
MWALMYFH

SEQ ID NO: 56514 - protein, 8 aa, Dengue virus
WALMYFHR

SEQ ID NO: 56515 - protein, 8 aa, Dengue virus
ALMYFHRR

SEQ ID NO: 56516 - protein, 8 aa, Dengue virus
AICSAVPA

SEQ ID NO: 56517 - protein, 8 aa, Dengue virus
ICSAVPAH

SEQ ID NO: 56518 - protein, 8 aa, Dengue virus
CSAVPAHW

SEQ ID NO: 56519 - protein, 8 aa, Dengue virus
SAVPVHWI

SEQ ID NO: 56520 - protein, 8 aa, Dengue virus
AVPVHWIP

SEQ ID NO: 56521 - protein, 8 aa, Dengue virus
VPVHWIPT

SEQ ID NO: 56522 - protein, 8 aa, Dengue virus
PVHWIPTS

SEQ ID NO: 56523 - protein, 8 aa, Dengue virus
VHWIPTSR

SEQ ID NO: 56524 - protein, 8 aa, Dengue virus
HWIPTSRT

SEQ ID NO: 56525 - protein, 8 aa, Dengue virus
WIPTSRTT

SEQ ID NO: 56526 - protein, 8 aa, Dengue virus
IPTSRTTW

SEQ ID NO: 56527 - protein, 8 aa, Dengue virus
MTTEDMLA

SEQ ID NO: 56528 - protein, 8 aa, Dengue virus
TTEDMLAV

SEQ ID NO: 56529 - protein, 8 aa, Dengue virus
TEDMLAVW

SEQ ID NO: 56530 - protein, 8 aa, Dengue virus
EDMLAVWN

SEQ ID NO: 56531 - protein, 8 aa, Dengue virus
DMLAVWNR

SEQ ID NO: 56532 - protein, 8 aa, Dengue virus
MLAVWNRV

SEQ ID NO: 56533 - protein, 8 aa, Dengue virus
LAVWNRVW

SEQ ID NO: 56534 - protein, 8 aa, Dengue virus
AVWNRVWI

SEQ ID NO: 56535 - protein, 8 aa, Dengue virus
WNRVWIEE

SEQ ID NO: 56536 - protein, 8 aa, Dengue virus
NRVWIEEN

SEQ ID NO: 56537 - protein, 8 aa, Dengue virus
RVWIEENP

SEQ ID NO: 56538 - protein, 8 aa, Dengue virus
VWIEENPW

SEQ ID NO: 56539 - protein, 8 aa, Dengue virus
WIEENPWM

SEQ ID NO: 56540 - protein, 8 aa, Dengue virus
IEENPWME

SEQ ID NO: 56541 - protein, 8 aa, Dengue virus
EENPWMED

SEQ ID NO: 56542 - protein, 8 aa, Dengue virus
ENPWMEDK

SEQ ID NO: 56543 - protein, 8 aa, Dengue virus
WMEDKTPI

SEQ ID NO: 56544 - protein, 8 aa, Dengue virus
MEDKTPIT

SEQ ID NO: 56545 - protein, 8 aa, Dengue virus
EDKTPITT

SEQ ID NO: 56546 - protein, 8 aa, Dengue virus
DKTPITTW

SEQ ID NO: 56547 - protein, 8 aa, Dengue virus
KTPITTWE

SEQ ID NO: 56548 - protein, 8 aa, Dengue virus
TPVTTWED

SEQ ID NO: 56549 - protein, 8 aa, Dengue virus
PVTTWEDV

SEQ ID NO: 56550 - protein, 8 aa, Dengue virus
VTTWEDVP

SEQ ID NO: 56551 - protein, 8 aa, Dengue virus
TTWEDVPY

SEQ ID NO: 56552 - protein, 8 aa, Dengue virus
TWEDVPYL

SEQ ID NO: 56553 - protein, 8 aa, Dengue virus
WEDVPYLG

SEQ ID NO: 56554 - protein, 8 aa, Dengue virus
EDVPYLGK

SEQ ID NO: 56555 - protein, 8 aa, Dengue virus
DVPYLGKR

SEQ ID NO: 56556 - protein, 8 aa, Dengue virus
ATWAQNIL

SEQ ID NO: 56557 - protein, 8 aa, Dengue virus
TWAQNILT

SEQ ID NO: 56558 - protein, 8 aa, Dengue virus
WAQNILTA

SEQ ID NO: 56559 - protein, 8 aa, Dengue virus
AQNILTAI

SEQ ID NO: 56560 - protein, 8 aa, Dengue virus
QNILTAIQ

SEQ ID NO: 56561 - protein, 8 aa, Dengue virus
NILTAIQQ

SEQ ID NO: 56562 - protein, 8 aa, Dengue virus
ILTAIQQV

SEQ ID NO: 56563 - protein, 8 aa, Dengue virus
LTAIQQVR

SEQ ID NO: 56564 - protein, 8 aa, Dengue virus
IAIQQVRS

SEQ ID NO: 56565 - protein, 8 aa, Dengue virus
QVRSLIGD

SEQ ID NO: 56566 - protein, 8 aa, Dengue virus
VRSLIGDE

SEQ ID NO: 56567 - protein, 8 aa, Dengue virus
RSLIGDEE

SEQ ID NO: 56568 - protein, 8 aa, Dengue virus
SLIGDEEF

SEQ ID NO: 56569 - protein, 8 aa, Dengue virus
LIGDEEFL

SEQ ID NO: 56570 - protein, 8 aa, Dengue virus
IGDEEFLD

SEQ ID NO: 56571 - protein, 8 aa, Dengue virus
GDEEFLDY

SEQ ID NO: 56572 - protein, 8 aa, Dengue virus
DEEFLDYM

SEQ ID NO: 56573 - protein, 8 aa, Dengue virus
RFRKEEEL

SEQ ID NO: 56574 - protein, 8 aa, Dengue virus
FRKEEELE

SEQ ID NO: 56575 - protein, 8 aa, Dengue virus
RKEEELEG

SEQ ID NO: 56576 - protein, 8 aa, Dengue virus
KEEELEGA

SEQ ID NO: 56577 - protein, 8 aa, Dengue virus
EEELEGAI

SEQ ID NO: 56578 - protein, 8 aa, Dengue virus
EELEGAIW

SEQ ID NO: 56579 - protein, 8 aa, Dengue virus
LAKRFSKE

SEQ ID NO: 56580 - protein, 8 aa, Dengue virus
AKRFSKEL

SEQ ID NO: 56581 - protein, 8 aa, Dengue virus
KRFSKELL

SEQ ID NO: 56582 - protein, 8 aa, Dengue virus
RFSKELLN

SEQ ID NO: 56583 - protein, 8 aa, Dengue virus
FSKELLNG

SEQ ID NO: 56584 - protein, 8 aa, Dengue virus
SKELLNGQ

SEQ ID NO: 56585 - protein, 8 aa, Dengue virus
KELLNGQG

SEQ ID NO: 56586 - protein, 8 aa, Dengue virus
GAIKVLKS

SEQ ID NO: 56587 - protein, 8 aa, Dengue virus
AIKVLKSF

SEQ ID NO: 56588 - protein, 8 aa, Dengue virus
IKVLKSFK

SEQ ID NO: 56589 - protein, 8 aa, Dengue virus
KVLKGFKR

SEQ ID NO: 56590 - protein, 8 aa, Dengue virus
VLKGFKRE

SEQ ID NO: 56591 - protein, 8 aa, Dengue virus
LKGFKREI

SEQ ID NO: 56592 - protein, 8 aa, Dengue virus
KGFKREIS

SEQ ID NO: 56593 - protein, 8 aa, Dengue virus
SFKKEISN

SEQ ID NO: 56594 - protein, 8 aa, Dengue virus
NMLSIINQ

SEQ ID NO: 56595 - protein, 8 aa, Dengue virus
SIINRRKR

SEQ ID NO: 56596 - protein, 8 aa, Dengue virus
IINRRKRT

SEQ ID NO: 56597 - protein, 8 aa, Dengue virus
INRRKRTS

SEQ ID NO: 56598 - protein, 8 aa, Dengue virus
NKRKKTSF

SEQ ID NO: 56599 - protein, 8 aa, Dengue virus
KRKKTSFC

SEQ ID NO: 56600 - protein, 8 aa, Dengue virus
RKRTSLCL

SEQ ID NO: 56601 - protein, 8 aa, Dengue virus
KKTSLCLV

SEQ ID NO: 56602 - protein, 8 aa, Dengue virus
KTSLCLVM

SEQ ID NO: 56603 - protein, 8 aa, Dengue virus
CLVMILPA

SEQ ID NO: 56604 - protein, 8 aa, Dengue virus
MILPATLA

SEQ ID NO: 56605 - protein, 8 aa, Dengue virus
ILPATLAF

SEQ ID NO: 56606 - protein, 8 aa, Dengue virus
TVTYKCPF

SEQ ID NO: 56607 - protein, 8 aa, Dengue virus
VTYKCPFI

SEQ ID NO: 56608 - protein, 8 aa, Dengue virus
TYKCPLIT

SEQ ID NO: 56609 - protein, 8 aa, Dengue virus
YKCPLITE

SEQ ID NO: 56610 - protein, 8 aa, Dengue virus
VAEVEPED

SEQ ID NO: 56611 - protein, 8 aa, Dengue virus
AHYISTSL

SEQ ID NO: 56612 - protein, 8 aa, Dengue virus
HYVGTSLT

SEQ ID NO: 56613 - protein, 8 aa, Dengue virus
YVGTSLTQ

SEQ ID NO: 56614 - protein, 8 aa, Dengue virus
VGTSLTQK

SEQ ID NO: 56615 - protein, 8 aa, Dengue virus
GTSLIQKV

SEQ ID NO: 56616 - protein, 8 aa, Dengue virus
TSLIQKVV

SEQ ID NO: 56617 - protein, 8 aa, Dengue virus
SLIQKVVI

SEQ ID NO: 56618 - protein, 8 aa, Dengue virus
LIQKVVIF

SEQ ID NO: 56619 - protein, 8 aa, Dengue virus
TQKAVIFI

SEQ ID NO: 56620 - protein, 8 aa, Dengue virus
QKAVIFIL

SEQ ID NO: 56621 - protein, 8 aa, Dengue virus
KAVIFILL

SEQ ID NO: 56622 - protein, 8 aa, Dengue virus
AVIFILLM

SEQ ID NO: 56623 - protein, 8 aa, Dengue virus
VIFTLLML

SEQ ID NO: 56624 - protein, 8 aa, Dengue virus
IFTLLMLV

SEQ ID NO: 56625 - protein, 8 aa, Dengue virus
FTLLMLVT

SEQ ID NO: 56626 - protein, 8 aa, Dengue virus
TLLMLVTP

SEQ ID NO: 56627 - protein, 8 aa, Dengue virus
CPTQGEAT

SEQ ID NO: 56628 - protein, 8 aa, Dengue virus
PTQGEATL

SEQ ID NO: 56629 - protein, 8 aa, Dengue virus
TQGEATLP

SEQ ID NO: 56630 - protein, 8 aa, Dengue virus
QGEATLPE

SEQ ID NO: 56631 - protein, 8 aa, Dengue virus
GEATLPEE

SEQ ID NO: 56632 - protein, 8 aa, Dengue virus
EATLPEEQ

SEQ ID NO: 56633 - protein, 8 aa, Dengue virus
ATLPEEQD

SEQ ID NO: 56634 - protein, 8 aa, Dengue virus
TLPEEQDQ

SEQ ID NO: 56635 - protein, 8 aa, Dengue virus
AKFQCLEL

SEQ ID NO: 56636 - protein, 8 aa, Dengue virus
KFQCLELI

SEQ ID NO: 56637 - protein, 8 aa, Dengue virus
FQCLELIE

SEQ ID NO: 56638 - protein, 8 aa, Dengue virus
QCLELIEG

SEQ ID NO: 56639 - protein, 8 aa, Dengue virus
CLELIEGK

SEQ ID NO: 56640 - protein, 8 aa, Dengue virus
LIEGKVVQ

SEQ ID NO: 56641 - protein, 8 aa, Dengue virus
IEGKAVQH

SEQ ID NO: 56642 - protein, 8 aa, Dengue virus
EGKAVQHE

SEQ ID NO: 56643 - protein, 8 aa, Dengue virus
GKAVQHEN

SEQ ID NO: 56644 - protein, 8 aa, Dengue virus
KAVQHENL

SEQ ID NO: 56645 - protein, 8 aa, Dengue virus
AVQHENLK

SEQ ID NO: 56646 - protein, 8 aa, Dengue virus
NDTQGVTA

SEQ ID NO: 56647 - protein, 8 aa, Dengue virus
DTQGVTAE

SEQ ID NO: 56648 - protein, 8 aa, Dengue virus
GVTAEITS

SEQ ID NO: 56649 - protein, 8 aa, Dengue virus
VTAEITSQ

SEQ ID NO: 56650 - protein, 8 aa, Dengue virus
ITPQASTA

SEQ ID NO: 56651 - protein, 8 aa, Dengue virus
TPQASTAE

SEQ ID NO: 56652 - protein, 8 aa, Dengue virus
PQASTAEA

SEQ ID NO: 56653 - protein, 8 aa, Dengue virus
QASTVEAI

SEQ ID NO: 56654 - protein, 8 aa, Dengue virus
ASTVEAIL

SEQ ID NO: 56655 - protein, 8 aa, Dengue virus
VEAILPEY

SEQ ID NO: 56656 - protein, 8 aa, Dengue virus
VILPEYGT

SEQ ID NO: 56657 - protein, 8 aa, Dengue virus
PLPWTSGV

SEQ ID NO: 56658 - protein, 8 aa, Dengue virus
LPWTSGVT

SEQ ID NO: 56659 - protein, 8 aa, Dengue virus
PWTSGATA

SEQ ID NO: 56660 - protein, 8 aa, Dengue virus
TTETPIWN

SEQ ID NO: 56661 - protein, 8 aa, Dengue virus
AETPTWNR

SEQ ID NO: 56662 - protein, 8 aa, Dengue virus
ETPIWNRK

SEQ ID NO: 56663 - protein, 8 aa, Dengue virus
IQNSGGTN

SEQ ID NO: 56664 - protein, 8 aa, Dengue virus
QNSGGTNI

SEQ ID NO: 56665 - protein, 8 aa, Dengue virus
NSGGTNIF

SEQ ID NO: 56666 - protein, 8 aa, Dengue virus
SGGTTIFA

SEQ ID NO: 56667 - protein, 8 aa, Dengue virus
GMSYAMCS

SEQ ID NO: 56668 - protein, 8 aa, Dengue virus
MSYAMCSN

SEQ ID NO: 56669 - protein, 8 aa, Dengue virus
SYAMCSNA

SEQ ID NO: 56670 - protein, 8 aa, Dengue virus
YAMCSNAF

SEQ ID NO: 56671 - protein, 8 aa, Dengue virus
AMCSNAFV

SEQ ID NO: 56672 - protein, 8 aa, Dengue virus
MCSNAFVL

SEQ ID NO: 56673 - protein, 8 aa, Dengue virus
GSFVLKKE

SEQ ID NO: 56674 - protein, 8 aa, Dengue virus
SFVLKKEV

SEQ ID NO: 56675 - protein, 8 aa, Dengue virus
ILVKVEYK

SEQ ID NO: 56676 - protein, 8 aa, Dengue virus
LVKVEYKG

SEQ ID NO: 56677 - protein, 8 aa, Dengue virus
IKVEYKGK

SEQ ID NO: 56678 - protein, 8 aa, Dengue virus
KVEYKGKD

SEQ ID NO: 56679 - protein, 8 aa, Dengue virus
VEYRGEDA

SEQ ID NO: 56680 - protein, 8 aa, Dengue virus
EYRGEDAP

SEQ ID NO: 56681 - protein, 8 aa, Dengue virus
YRGEDAPC

SEQ ID NO: 56682 - protein, 8 aa, Dengue virus
RGEDAPCK

SEQ ID NO: 56683 - protein, 8 aa, Dengue virus
GEDVPCKV

SEQ ID NO: 56684 - protein, 8 aa, Dengue virus
EDVPCKVP

SEQ ID NO: 56685 - protein, 8 aa, Dengue virus
DVPCKVPF

SEQ ID NO: 56686 - protein, 8 aa, Dengue virus
VPCKVPFS

SEQ ID NO: 56687 - protein, 8 aa, Dengue virus
TEDGQGKV

SEQ ID NO: 56688 - protein, 8 aa, Dengue virus
EDGQGKVH

SEQ ID NO: 56689 - protein, 8 aa, Dengue virus
DEQGKAHN

SEQ ID NO: 56690 - protein, 8 aa, Dengue virus
EQGKAHNG

SEQ ID NO: 56691 - protein, 8 aa, Dengue virus
QGKVHNGR

SEQ ID NO: 56692 - protein, 8 aa, Dengue virus
ANPVVIKK

SEQ ID NO: 56693 - protein, 8 aa, Dengue virus
NPVVTKKD

SEQ ID NO: 56694 - protein, 8 aa, Dengue virus
PVVTKKDE

SEQ ID NO: 56695 - protein, 8 aa, Dengue virus
VVTKKDEP

SEQ ID NO: 56696 - protein, 8 aa, Dengue virus
VTKKEEPI

SEQ ID NO: 56697 - protein, 8 aa, Dengue virus
TKKEEPIN

SEQ ID NO: 56698 - protein, 8 aa, Dengue virus
KKEEPINI

SEQ ID NO: 56699 - protein, 8 aa, Dengue virus
KEEPINIE

SEQ ID NO: 56700 - protein, 8 aa, Dengue virus
EEPINIEA

SEQ ID NO: 56701 - protein, 8 aa, Dengue virus
ESNIVIGT

SEQ ID NO: 56702 - protein, 8 aa, Dengue virus
SNIVIGTG

SEQ ID NO: 56703 - protein, 8 aa, Dengue virus
NIVIGTGD

SEQ ID NO: 56704 - protein, 8 aa, Dengue virus
GDNSLKIN

SEQ ID NO: 56705 - protein, 8 aa, Dengue virus
DNSLKINW

SEQ ID NO: 56706 - protein, 8 aa, Dengue virus
NSLKINWY

SEQ ID NO: 56707 - protein, 8 aa, Dengue virus
ALKINWYR

SEQ ID NO: 56708 - protein, 8 aa, Dengue virus
LFGGVSWI

SEQ ID NO: 56709 - protein, 8 aa, Dengue virus
FGGVSWIM

SEQ ID NO: 56710 - protein, 8 aa, Dengue virus
GGVSWIMK

SEQ ID NO: 56711 - protein, 8 aa, Dengue virus
GVSWMMKI

SEQ ID NO: 56712 - protein, 8 aa, Dengue virus
VSWMMKIG

SEQ ID NO: 56713 - protein, 8 aa, Dengue virus
SWMMKIGI

SEQ ID NO: 56714 - protein, 8 aa, Dengue virus
WMMKIGIG

SEQ ID NO: 56715 - protein, 8 aa, Dengue virus
VMKIGIGI

SEQ ID NO: 56716 - protein, 8 aa, Dengue virus
FSCIAIGV

SEQ ID NO: 56717 - protein, 8 aa, Dengue virus
SCIAIGVI

SEQ ID NO: 56718 - protein, 8 aa, Dengue virus
CIAIGVIT

SEQ ID NO: 56719 - protein, 8 aa, Dengue virus
IAIGVITL

SEQ ID NO: 56720 - protein, 8 aa, Dengue virus
AIGVITLY

SEQ ID NO: 56721 - protein, 8 aa, Dengue virus
IITLYLGT

SEQ ID NO: 56722 - protein, 8 aa, Dengue virus
ITLYLGVV

SEQ ID NO: 56723 - protein, 8 aa, Dengue virus
TLYLGVVV

SEQ ID NO: 56724 - protein, 8 aa, Dengue virus
LYLGVVVQ

SEQ ID NO: 56725 - protein, 8 aa, Dengue virus
YLGVVVQA

SEQ ID NO: 56726 - protein, 8 aa, Dengue virus
LGVVVQAD

SEQ ID NO: 56727 - protein, 8 aa, Dengue virus
GTVVQADM

SEQ ID NO: 56728 - protein, 8 aa, Dengue virus
TVVQADMG

SEQ ID NO: 56729 - protein, 8 aa, Dengue virus
VQADMGCA

SEQ ID NO: 56730 - protein, 8 aa, Dengue virus
QADMGCAI

SEQ ID NO: 56731 - protein, 8 aa, Dengue virus
ADMGCAIN

SEQ ID NO: 56732 - protein, 8 aa, Dengue virus
DMGCAINW

SEQ ID NO: 56733 - protein, 8 aa, Dengue virus
MGCAINWK

SEQ ID NO: 56734 - protein, 8 aa, Dengue virus
GCVVNWKG

SEQ ID NO: 56735 - protein, 8 aa, Dengue virus
CVVNWKGK

SEQ ID NO: 56736 - protein, 8 aa, Dengue virus
VVNWKGKE

SEQ ID NO: 56737 - protein, 8 aa, Dengue virus
YILWENSI

SEQ ID NO: 56738 - protein, 8 aa, Dengue virus
WENSIKLT

SEQ ID NO: 56739 - protein, 8 aa, Dengue virus
ENNVKLTV

SEQ ID NO: 56740 - protein, 8 aa, Dengue virus
NNVKLTVV

SEQ ID NO: 56741 - protein, 8 aa, Dengue virus
NVKLTVVV

SEQ ID NO: 56742 - protein, 8 aa, Dengue virus
LTIVVGDV

SEQ ID NO: 56743 - protein, 8 aa, Dengue virus
TVVVGDIT

SEQ ID NO: 56744 - protein, 8 aa, Dengue virus
VVVGDITG

SEQ ID NO: 56745 - protein, 8 aa, Dengue virus
TGVLEQGK

SEQ ID NO: 56746 - protein, 8 aa, Dengue virus
VLEQGKRA

SEQ ID NO: 56747 - protein, 8 aa, Dengue virus
QGKRTLTL

SEQ ID NO: 56748 - protein, 8 aa, Dengue virus
GKRTLTLQ

SEQ ID NO: 56749 - protein, 8 aa, Dengue virus
KRTLTLQP

SEQ ID NO: 56750 - protein, 8 aa, Dengue virus
RILTPQPM

SEQ ID NO: 56751 - protein, 8 aa, Dengue virus
TLTLQPME

SEQ ID NO: 56752 - protein, 8 aa, Dengue virus
IPQPMELK

SEQ ID NO: 56753 - protein, 8 aa, Dengue virus
WKAWGKAK

SEQ ID NO: 56754 - protein, 8 aa, Dengue virus
KAWGKAKI

SEQ ID NO: 56755 - protein, 8 aa, Dengue virus
TWGKAKVV

SEQ ID NO: 56756 - protein, 8 aa, Dengue virus
WGKAKIVI

SEQ ID NO: 56757 - protein, 8 aa, Dengue virus
GKAKIVIA

SEQ ID NO: 56758 - protein, 8 aa, Dengue virus
KAKIVIAE

SEQ ID NO: 56759 - protein, 8 aa, Dengue virus
AETQNFSF

SEQ ID NO: 56760 - protein, 8 aa, Dengue virus
ETQNFSFI

SEQ ID NO: 56761 - protein, 8 aa, Dengue virus
TQNFSFII

SEQ ID NO: 56762 - protein, 8 aa, Dengue virus
PSTPECPS

SEQ ID NO: 56763 - protein, 8 aa, Dengue virus
NTPECPSV

SEQ ID NO: 56764 - protein, 8 aa, Dengue virus
PSVSRAWN

SEQ ID NO: 56765 - protein, 8 aa, Dengue virus
SVSRAWNV

SEQ ID NO: 56766 - protein, 8 aa, Dengue virus
TSRAWNVW

SEQ ID NO: 56767 - protein, 8 aa, Dengue virus
IWLKLREA

SEQ ID NO: 56768 - protein, 8 aa, Dengue virus
WLKLREVH

SEQ ID NO: 56769 - protein, 8 aa, Dengue virus
LKLREVHT

SEQ ID NO: 56770 - protein, 8 aa, Dengue virus
KLREVHTQ

SEQ ID NO: 56771 - protein, 8 aa, Dengue virus
TQTCDHRL

SEQ ID NO: 56772 - protein, 8 aa, Dengue virus
QTCDHRLM

SEQ ID NO: 56773 - protein, 8 aa, Dengue virus
TCDHRLMS

SEQ ID NO: 56774 - protein, 8 aa, Dengue virus
EGTTVVIS

SEQ ID NO: 56775 - protein, 8 aa, Dengue virus
GTTVVISE

SEQ ID NO: 56776 - protein, 8 aa, Dengue virus
TTVVIAEN

SEQ ID NO: 56777 - protein, 8 aa, Dengue virus
TVVIAENC

SEQ ID NO: 56778 - protein, 8 aa, Dengue virus
VVIAENCG

SEQ ID NO: 56779 - protein, 8 aa, Dengue virus
VIAENCGT

SEQ ID NO: 56780 - protein, 8 aa, Dengue virus
CGTRGPAL

SEQ ID NO: 56781 - protein, 8 aa, Dengue virus
GMRGPSLR

SEQ ID NO: 56782 - protein, 8 aa, Dengue virus
TRRPSLRT

SEQ ID NO: 56783 - protein, 8 aa, Dengue virus
RGPSLRAT

SEQ ID NO: 56784 - protein, 8 aa, Dengue virus
GMEIRPVN

SEQ ID NO: 56785 - protein, 8 aa, Dengue virus
MEIRPVNE

SEQ ID NO: 56786 - protein, 8 aa, Dengue virus
EIRPVNEK

SEQ ID NO: 56787 - protein, 8 aa, Dengue virus
IRPVNEKE

SEQ ID NO: 56788 - protein, 8 aa, Dengue virus
RPVNEKEE

SEQ ID NO: 56789 - protein, 8 aa, Dengue virus
PVNEKEEN

SEQ ID NO: 56790 - protein, 8 aa, Dengue virus
VNEKEENM

SEQ ID NO: 56791 - protein, 8 aa, Dengue virus
LASAGSGK

SEQ ID NO: 56792 - protein, 8 aa, Dengue virus
VSAGSGKM

SEQ ID NO: 56793 - protein, 8 aa, Dengue virus
SAGSGKMD

SEQ ID NO: 56794 - protein, 8 aa, Dengue virus
AGSGKMDN

SEQ ID NO: 56795 - protein, 8 aa, Dengue virus
GSGKMDNF

SEQ ID NO: 56796 - protein, 8 aa, Dengue virus
SGKMDNFT

SEQ ID NO: 56797 - protein, 8 aa, Dengue virus
GKMDNFTM

SEQ ID NO: 56798 - protein, 8 aa, Dengue virus
KMDNFTMG

SEQ ID NO: 56799 - protein, 8 aa, Dengue virus
ADNFTMGV

SEQ ID NO: 56800 - protein, 8 aa, Dengue virus
ALCLAILF

SEQ ID NO: 56801 - protein, 8 aa, Dengue virus
KKHMIAGA

SEQ ID NO: 56802 - protein, 8 aa, Dengue virus
LTFVLLLS

SEQ ID NO: 56803 - protein, 8 aa, Dengue virus
IFVLLLSG

SEQ ID NO: 56804 - protein, 8 aa, Dengue virus
QITWRDLA

SEQ ID NO: 56805 - protein, 8 aa, Dengue virus
DMTHTLIM

SEQ ID NO: 56806 - protein, 8 aa, Dengue virus
THTLIMIG

SEQ ID NO: 56807 - protein, 8 aa, Dengue virus
HTFIMIGS

SEQ ID NO: 56808 - protein, 8 aa, Dengue virus
LIMIGSNT

SEQ ID NO: 56809 - protein, 8 aa, Dengue virus
IMIGSNTS

SEQ ID NO: 56810 - protein, 8 aa, Dengue virus
MIGSNTSD

SEQ ID NO: 56811 - protein, 8 aa, Dengue virus
IGSNASDK

SEQ ID NO: 56812 - protein, 8 aa, Dengue virus
GSNASDKM

SEQ ID NO: 56813 - protein, 8 aa, Dengue virus
SNATDRMG

SEQ ID NO: 56814 - protein, 8 aa, Dengue virus
NATDRMGM

SEQ ID NO: 56815 - protein, 8 aa, Dengue virus
ASDKMGMG

SEQ ID NO: 56816 - protein, 8 aa, Dengue virus
TDRMGMGV

SEQ ID NO: 56817 - protein, 8 aa, Dengue virus
TTTLQLPE

SEQ ID NO: 56818 - protein, 8 aa, Dengue virus
TLQLPADI

SEQ ID NO: 56819 - protein, 8 aa, Dengue virus
GLMALKLT

SEQ ID NO: 56820 - protein, 8 aa, Dengue virus
LMALKLTT

SEQ ID NO: 56821 - protein, 8 aa, Dengue virus
MALKLTTQ

SEQ ID NO: 56822 - protein, 8 aa, Dengue virus
ALKLTTQF

SEQ ID NO: 56823 - protein, 8 aa, Dengue virus
YQLWAALV

SEQ ID NO: 56824 - protein, 8 aa, Dengue virus
QLWAALVS

SEQ ID NO: 56825 - protein, 8 aa, Dengue virus
LWAALVSL

SEQ ID NO: 56826 - protein, 8 aa, Dengue virus
WTALVSLM

SEQ ID NO: 56827 - protein, 8 aa, Dengue virus
TALVSLMC

SEQ ID NO: 56828 - protein, 8 aa, Dengue virus
ALVSLMCS

SEQ ID NO: 56829 - protein, 8 aa, Dengue virus
LVSLMCSN

SEQ ID NO: 56830 - protein, 8 aa, Dengue virus
VSLMCSNT

SEQ ID NO: 56831 - protein, 8 aa, Dengue virus
SLMCSNTI

SEQ ID NO: 56832 - protein, 8 aa, Dengue virus
LMCSNTIF

SEQ ID NO: 56833 - protein, 8 aa, Dengue virus
MCSNTIFT

SEQ ID NO: 56834 - protein, 8 aa, Dengue virus
CANTIFTL

SEQ ID NO: 56835 - protein, 8 aa, Dengue virus
ANTIFTLT

SEQ ID NO: 56836 - protein, 8 aa, Dengue virus
ATLILAVI

SEQ ID NO: 56837 - protein, 8 aa, Dengue virus
TLILAVIS

SEQ ID NO: 56838 - protein, 8 aa, Dengue virus
LILAVISL

SEQ ID NO: 56839 - protein, 8 aa, Dengue virus
ILAVISLL

SEQ ID NO: 56840 - protein, 8 aa, Dengue virus
LAVISLLP

SEQ ID NO: 56841 - protein, 8 aa, Dengue virus
ISLLPVCQ

SEQ ID NO: 56842 - protein, 8 aa, Dengue virus
SLLPMCQS

SEQ ID NO: 56843 - protein, 8 aa, Dengue virus
LLPMCQSS

SEQ ID NO: 56844 - protein, 8 aa, Dengue virus
RKTDWLPV

SEQ ID NO: 56845 - protein, 8 aa, Dengue virus
KSDWLPMT

SEQ ID NO: 56846 - protein, 8 aa, Dengue virus
SDWLPMTV

SEQ ID NO: 56847 - protein, 8 aa, Dengue virus
DWLPVAVA

SEQ ID NO: 56848 - protein, 8 aa, Dengue virus
WLPVAVAA

SEQ ID NO: 56849 - protein, 8 aa, Dengue virus
LPVAVAAM

SEQ ID NO: 56850 - protein, 8 aa, Dengue virus
PVAVAAMG

SEQ ID NO: 56851 - protein, 8 aa, Dengue virus
VAVAAMGV

SEQ ID NO: 56852 - protein, 8 aa, Dengue virus
TVAAMGAQ

SEQ ID NO: 56853 - protein, 8 aa, Dengue virus
VAAMGAQP

SEQ ID NO: 56854 - protein, 8 aa, Dengue virus
AAMGAQPL

SEQ ID NO: 56855 - protein, 8 aa, Dengue virus
AMGAQPLP

SEQ ID NO: 56856 - protein, 8 aa, Dengue virus
MGAQPLPL

SEQ ID NO: 56857 - protein, 8 aa, Dengue virus
GAQPLPLF

SEQ ID NO: 56858 - protein, 8 aa, Dengue virus
AQPLPLFI

SEQ ID NO: 56859 - protein, 8 aa, Dengue virus
QPLPLFIF

SEQ ID NO: 56860 - protein, 8 aa, Dengue virus
PLPLFIFN

SEQ ID NO: 56861 - protein, 8 aa, Dengue virus
LPLFIFGL

SEQ ID NO: 56862 - protein, 8 aa, Dengue virus
PLFIFGLK

SEQ ID NO: 56863 - protein, 8 aa, Dengue virus
LFIFGLKD

SEQ ID NO: 56864 - protein, 8 aa, Dengue virus
FIFSLKDA

SEQ ID NO: 56865 - protein, 8 aa, Dengue virus
LKDTPKRK

SEQ ID NO: 56866 - protein, 8 aa, Dengue virus
KDTPKRKS

SEQ ID NO: 56867 - protein, 8 aa, Dengue virus
DTPKRKSW

SEQ ID NO: 56868 - protein, 8 aa, Dengue virus
TPKRKSWP

SEQ ID NO: 56869 - protein, 8 aa, Dengue virus
PKRKSWPL

SEQ ID NO: 56870 - protein, 8 aa, Dengue virus
ADLTVEKV

SEQ ID NO: 56871 - protein, 8 aa, Dengue virus
DLTVEKVA

SEQ ID NO: 56872 - protein, 8 aa, Dengue virus
LTVEKVAD

SEQ ID NO: 56873 - protein, 8 aa, Dengue virus
AEVTWEEE

SEQ ID NO: 56874 - protein, 8 aa, Dengue virus
EVTWEEEA

SEQ ID NO: 56875 - protein, 8 aa, Dengue virus
HTWQKRTQ

SEQ ID NO: 56876 - protein, 8 aa, Dengue virus
TWQKRTQR

SEQ ID NO: 56877 - protein, 8 aa, Dengue virus
YGGGWKLS

SEQ ID NO: 56878 - protein, 8 aa, Dengue virus
GGGWKLSA

SEQ ID NO: 56879 - protein, 8 aa, Dengue virus
GGWKLSAQ

SEQ ID NO: 56880 - protein, 8 aa, Dengue virus
GWKLSAQW

SEQ ID NO: 56881 - protein, 8 aa, Dengue virus
WKLSAQWQ

SEQ ID NO: 56882 - protein, 8 aa, Dengue virus
KLSAQWQK

SEQ ID NO: 56883 - protein, 8 aa, Dengue virus
LSTQWQKG

SEQ ID NO: 56884 - protein, 8 aa, Dengue virus
STQWQKGE

SEQ ID NO: 56885 - protein, 8 aa, Dengue virus
AQWKKGEE

SEQ ID NO: 56886 - protein, 8 aa, Dengue virus
NFQTTPGT

SEQ ID NO: 56887 - protein, 8 aa, Dengue virus
FQTTPGTF

SEQ ID NO: 56888 - protein, 8 aa, Dengue virus
QTTPGTFQ

SEQ ID NO: 56889 - protein, 8 aa, Dengue virus
TTPGTFQT

SEQ ID NO: 56890 - protein, 8 aa, Dengue virus
TPGTFQTT

SEQ ID NO: 56891 - protein, 8 aa, Dengue virus
PGIFQTTM

SEQ ID NO: 56892 - protein, 8 aa, Dengue virus
GIFQTTMG

SEQ ID NO: 56893 - protein, 8 aa, Dengue virus
IFQTTMGE

SEQ ID NO: 56894 - protein, 8 aa, Dengue virus
ITGEIGAI

SEQ ID NO: 56895 - protein, 8 aa, Dengue virus
IRYQTTVT

SEQ ID NO: 56896 - protein, 8 aa, Dengue virus
RYQTSATK

SEQ ID NO: 56897 - protein, 8 aa, Dengue virus
YQTTVTKS

SEQ ID NO: 56898 - protein, 8 aa, Dengue virus
QTTATRSE

SEQ ID NO: 56899 - protein, 8 aa, Dengue virus
TTVTKSEH

SEQ ID NO: 56900 - protein, 8 aa, Dengue virus
TATRSEHT

SEQ ID NO: 56901 - protein, 8 aa, Dengue virus
VTKSEHTG

SEQ ID NO: 56902 - protein, 8 aa, Dengue virus
IKSEHTGR

SEQ ID NO: 56903 - protein, 8 aa, Dengue virus
VPNYNLIV

SEQ ID NO: 56904 - protein, 8 aa, Dengue virus
PNYNLIVM

SEQ ID NO: 56905 - protein, 8 aa, Dengue virus
NYNLIVMD

SEQ ID NO: 56906 - protein, 8 aa, Dengue virus
YNLIVMDE

SEQ ID NO: 56907 - protein, 8 aa, Dengue virus
NLIVMDEA

SEQ ID NO: 56908 - protein, 8 aa, Dengue virus
LIVMDEAH

SEQ ID NO: 56909 - protein, 8 aa, Dengue virus
IVMDEAHF

SEQ ID NO: 56910 - protein, 8 aa, Dengue virus
NDWITDFA

SEQ ID NO: 56911 - protein, 8 aa, Dengue virus
DWITDFAG

SEQ ID NO: 56912 - protein, 8 aa, Dengue virus
WITDFTGK

SEQ ID NO: 56913 - protein, 8 aa, Dengue virus
ITDFTGKT

SEQ ID NO: 56914 - protein, 8 aa, Dengue virus
TDFTGKTV

SEQ ID NO: 56915 - protein, 8 aa, Dengue virus
DFTGKTVW

SEQ ID NO: 56916 - protein, 8 aa, Dengue virus
FTGKTVWF

SEQ ID NO: 56917 - protein, 8 aa, Dengue virus
TGKTVWFV

SEQ ID NO: 56918 - protein, 8 aa, Dengue virus
RNSQKEND

SEQ ID NO: 56919 - protein, 8 aa, Dengue virus
NSQKENDQ

SEQ ID NO: 56920 - protein, 8 aa, Dengue virus
SQKENDQY

SEQ ID NO: 56921 - protein, 8 aa, Dengue virus
RVPSHLAY

SEQ ID NO: 56922 - protein, 8 aa, Dengue virus
VPSHLAYR

SEQ ID NO: 56923 - protein, 8 aa, Dengue virus
PSHLAYRT

SEQ ID NO: 56924 - protein, 8 aa, Dengue virus
SHLAYRTR

SEQ ID NO: 56925 - protein, 8 aa, Dengue virus
HLPHRTRN

SEQ ID NO: 56926 - protein, 8 aa, Dengue virus
LAHRTKNA

SEQ ID NO: 56927 - protein, 8 aa, Dengue virus
AYRTRSAL

SEQ ID NO: 56928 - protein, 8 aa, Dengue virus
GGAMLFLV

SEQ ID NO: 56929 - protein, 8 aa, Dengue virus
FLISGRGI

SEQ ID NO: 56930 - protein, 8 aa, Dengue virus
LISGRGIG

SEQ ID NO: 56931 - protein, 8 aa, Dengue virus
ISGRGIGK

SEQ ID NO: 56932 - protein, 8 aa, Dengue virus
SGRGIGKA

SEQ ID NO: 56933 - protein, 8 aa, Dengue virus
GKGIGKTT

SEQ ID NO: 56934 - protein, 8 aa, Dengue virus
KGIGKTTI

SEQ ID NO: 56935 - protein, 8 aa, Dengue virus
GIGKTTIG

SEQ ID NO: 56936 - protein, 8 aa, Dengue virus
IGKTTIGL

SEQ ID NO: 56937 - protein, 8 aa, Dengue virus
GKASIGLI

SEQ ID NO: 56938 - protein, 8 aa, Dengue virus
KASIGLIC

SEQ ID NO: 56939 - protein, 8 aa, Dengue virus
ASIGLICV

SEQ ID NO: 56940 - protein, 8 aa, Dengue virus
TIGLICVI

SEQ ID NO: 56941 - protein, 8 aa, Dengue virus
IGLICVVA

SEQ ID NO: 56942 - protein, 8 aa, Dengue virus
GLICVVAS

SEQ ID NO: 56943 - protein, 8 aa, Dengue virus
LICVVASS

SEQ ID NO: 56944 - protein, 8 aa, Dengue virus
ICVVASSG

SEQ ID NO: 56945 - protein, 8 aa, Dengue virus
CVVASSGM

SEQ ID NO: 56946 - protein, 8 aa, Dengue virus
VVASSGML

SEQ ID NO: 56947 - protein, 8 aa, Dengue virus
VASSGMLW

SEQ ID NO: 56948 - protein, 8 aa, Dengue virus
SGMLWIAE

SEQ ID NO: 56949 - protein, 8 aa, Dengue virus
GMLWMAEV

SEQ ID NO: 56950 - protein, 8 aa, Dengue virus
MLWMAEVP

SEQ ID NO: 56951 - protein, 8 aa, Dengue virus
LWMAEVPL

SEQ ID NO: 56952 - protein, 8 aa, Dengue virus
WMAEVPLQ

SEQ ID NO: 56953 - protein, 8 aa, Dengue virus
MAEVPLQW

SEQ ID NO: 56954 - protein, 8 aa, Dengue virus
AEVPLQWI

SEQ ID NO: 56955 - protein, 8 aa, Dengue virus
EVPLQWIA

SEQ ID NO: 56956 - protein, 8 aa, Dengue virus
ILTLAATI

SEQ ID NO: 56957 - protein, 8 aa, Dengue virus
LTLAAIVT

SEQ ID NO: 56958 - protein, 8 aa, Dengue virus
TLAAIVTA

SEQ ID NO: 56959 - protein, 8 aa, Dengue virus
LAAIVTAN

SEQ ID NO: 56960 - protein, 8 aa, Dengue virus
AAIVTANE

SEQ ID NO: 56961 - protein, 8 aa, Dengue virus
AIVTANEM

SEQ ID NO: 56962 - protein, 8 aa, Dengue virus
IVTANEMG

SEQ ID NO: 56963 - protein, 8 aa, Dengue virus
VTANEMGL

SEQ ID NO: 56964 - protein, 8 aa, Dengue virus
MSREPGVV

SEQ ID NO: 56965 - protein, 8 aa, Dengue virus
SREPGVVS

SEQ ID NO: 56966 - protein, 8 aa, Dengue virus
KEPGVVSS

SEQ ID NO: 56967 - protein, 8 aa, Dengue virus
EPGVVSST

SEQ ID NO: 56968 - protein, 8 aa, Dengue virus
PGVVSSTS

SEQ ID NO: 56969 - protein, 8 aa, Dengue virus
GVVSSTSY

SEQ ID NO: 56970 - protein, 8 aa, Dengue virus
VVSSTSYL

SEQ ID NO: 56971 - protein, 8 aa, Dengue virus
VSSTSYLD

SEQ ID NO: 56972 - protein, 8 aa, Dengue virus
SPNSYLDV

SEQ ID NO: 56973 - protein, 8 aa, Dengue virus
PNSYLDVD

SEQ ID NO: 56974 - protein, 8 aa, Dengue virus
NPLTLIAA

SEQ ID NO: 56975 - protein, 8 aa, Dengue virus
PLTLIAAV

SEQ ID NO: 56976 - protein, 8 aa, Dengue virus
LTLIAAVL

SEQ ID NO: 56977 - protein, 8 aa, Dengue virus
TLIAAVLL

SEQ ID NO: 56978 - protein, 8 aa, Dengue virus
LIAAVLLL

SEQ ID NO: 56979 - protein, 8 aa, Dengue virus
TAVVLLLV

SEQ ID NO: 56980 - protein, 8 aa, Dengue virus
AVVLLLVT

SEQ ID NO: 56981 - protein, 8 aa, Dengue virus
VVLLLVTH

SEQ ID NO: 56982 - protein, 8 aa, Dengue virus
MLLVLCVV

SEQ ID NO: 56983 - protein, 8 aa, Dengue virus
LLVLCVVQ

SEQ ID NO: 56984 - protein, 8 aa, Dengue virus
LILCAVQL

SEQ ID NO: 56985 - protein, 8 aa, Dengue virus
ILCAVQLL

SEQ ID NO: 56986 - protein, 8 aa, Dengue virus
TSWALCEV

SEQ ID NO: 56987 - protein, 8 aa, Dengue virus
SWALCEVL

SEQ ID NO: 56988 - protein, 8 aa, Dengue virus
WALCEVLT

SEQ ID NO: 56989 - protein, 8 aa, Dengue virus
ALCEVLTL

SEQ ID NO: 56990 - protein, 8 aa, Dengue virus
LCEVLTLA

SEQ ID NO: 56991 - protein, 8 aa, Dengue virus
TGKRGTGL

SEQ ID NO: 56992 - protein, 8 aa, Dengue virus
LGEKWKRK

SEQ ID NO: 56993 - protein, 8 aa, Dengue virus
GEKWKRKL

SEQ ID NO: 56994 - protein, 8 aa, Dengue virus
EKWKRKLN

SEQ ID NO: 56995 - protein, 8 aa, Dengue virus
KWKRKLNQ

SEQ ID NO: 56996 - protein, 8 aa, Dengue virus
WKRKLNQL

SEQ ID NO: 56997 - protein, 8 aa, Dengue virus
KRKLNQLS

SEQ ID NO: 56998 - protein, 8 aa, Dengue virus
RKLNQLSR

SEQ ID NO: 56999 - protein, 8 aa, Dengue virus
KLNQLSRR

SEQ ID NO: 57000 - protein, 8 aa, Dengue virus
LNQLSWKE

SEQ ID NO: 57001 - protein, 8 aa, Dengue virus
NQLSRREF

SEQ ID NO: 57002 - protein, 8 aa, Dengue virus
QLSWKEFD

SEQ ID NO: 57003 - protein, 8 aa, Dengue virus
LSRREFDL

SEQ ID NO: 57004 - protein, 8 aa, Dengue virus
SWKEFDLY

SEQ ID NO: 57005 - protein, 8 aa, Dengue virus
RREFDLYK

SEQ ID NO: 57006 - protein, 8 aa, Dengue virus
GITEVDRS

SEQ ID NO: 57007 - protein, 8 aa, Dengue virus
ITEVDRSE

SEQ ID NO: 57008 - protein, 8 aa, Dengue virus
TEVDRSEA

SEQ ID NO: 57009 - protein, 8 aa, Dengue virus
EVDRSEAK

SEQ ID NO: 57010 - protein, 8 aa, Dengue virus
VDRSEAKE

SEQ ID NO: 57011 - protein, 8 aa, Dengue virus
DRSEAKEG

SEQ ID NO: 57012 - protein, 8 aa, Dengue virus
RSEAKEGL

SEQ ID NO: 57013 - protein, 8 aa, Dengue virus
SEAKEGLK

SEQ ID NO: 57014 - protein, 8 aa, Dengue virus
EGLKKGEI

SEQ ID NO: 57015 - protein, 8 aa, Dengue virus
GLKKGEIT

SEQ ID NO: 57016 - protein, 8 aa, Dengue virus
KGEITHHA

SEQ ID NO: 57017 - protein, 8 aa, Dengue virus
RETTHHAV

SEQ ID NO: 57018 - protein, 8 aa, Dengue virus
EVTHHAVS

SEQ ID NO: 57019 - protein, 8 aa, Dengue virus
VTHHAVSR

SEQ ID NO: 57020 - protein, 8 aa, Dengue virus
STYGWNII

SEQ ID NO: 57021 - protein, 8 aa, Dengue virus
GWNIIKLM

SEQ ID NO: 57022 - protein, 8 aa, Dengue virus
WNIIKLMS

SEQ ID NO: 57023 - protein, 8 aa, Dengue virus
NIVKLMTG

SEQ ID NO: 57024 - protein, 8 aa, Dengue virus
IIKLMSGK

SEQ ID NO: 57025 - protein, 8 aa, Dengue virus
IKLMSGKD

SEQ ID NO: 57026 - protein, 8 aa, Dengue virus
ILNPYMPT

SEQ ID NO: 57027 - protein, 8 aa, Dengue virus
LNPYMPNV

SEQ ID NO: 57028 - protein, 8 aa, Dengue virus
NPYMPTVV

SEQ ID NO: 57029 - protein, 8 aa, Dengue virus
PYMPTVVE

SEQ ID NO: 57030 - protein, 8 aa, Dengue virus
YMPTVVEH

SEQ ID NO: 57031 - protein, 8 aa, Dengue virus
MPTVVEHL

SEQ ID NO: 57032 - protein, 8 aa, Dengue virus
PTVVEHLE

SEQ ID NO: 57033 - protein, 8 aa, Dengue virus
TVVEHLER

SEQ ID NO: 57034 - protein, 8 aa, Dengue virus
RFTMTYRK

SEQ ID NO: 57035 - protein, 8 aa, Dengue virus
FTMTYRKP

SEQ ID NO: 57036 - protein, 8 aa, Dengue virus
TMTYRKPT

SEQ ID NO: 57037 - protein, 8 aa, Dengue virus
MTYRKPTI

SEQ ID NO: 57038 - protein, 8 aa, Dengue virus
TYRKPTIE

SEQ ID NO: 57039 - protein, 8 aa, Dengue virus
YRKPTIEK

SEQ ID NO: 57040 - protein, 8 aa, Dengue virus
RRPTIERD

SEQ ID NO: 57041 - protein, 8 aa, Dengue virus
RPTIERDV

SEQ ID NO: 57042 - protein, 8 aa, Dengue virus
ERIKRIKG

SEQ ID NO: 57043 - protein, 8 aa, Dengue virus
RIKRIKGE

SEQ ID NO: 57044 - protein, 8 aa, Dengue virus
IKRIKGEH

SEQ ID NO: 57045 - protein, 8 aa, Dengue virus
RIKGEHSK

SEQ ID NO: 57046 - protein, 8 aa, Dengue virus
IKGEHSKT

SEQ ID NO: 57047 - protein, 8 aa, Dengue virus
KGEHSKTW

SEQ ID NO: 57048 - protein, 8 aa, Dengue virus
GEHSKTWH

SEQ ID NO: 57049 - protein, 8 aa, Dengue virus
EHSKTWHY

SEQ ID NO: 57050 - protein, 8 aa, Dengue virus
HSKTWHYD

SEQ ID NO: 57051 - protein, 8 aa, Dengue virus
SKTWHYDD

SEQ ID NO: 57052 - protein, 8 aa, Dengue virus
WDVVPMVI

SEQ ID NO: 57053 - protein, 8 aa, Dengue virus
DVVPMVIQ

SEQ ID NO: 57054 - protein, 8 aa, Dengue virus
VVPMVIQM

SEQ ID NO: 57055 - protein, 8 aa, Dengue virus
VPMVIQMA

SEQ ID NO: 57056 - protein, 8 aa, Dengue virus
PMVIQMAM

SEQ ID NO: 57057 - protein, 8 aa, Dengue virus
MVIQMAMT

SEQ ID NO: 57058 - protein, 8 aa, Dengue virus
VDTRTPKP

SEQ ID NO: 57059 - protein, 8 aa, Dengue virus
DTRTPKPM

SEQ ID NO: 57060 - protein, 8 aa, Dengue virus
TRTPKPMP

SEQ ID NO: 57061 - protein, 8 aa, Dengue virus
RTPKPMPG

SEQ ID NO: 57062 - protein, 8 aa, Dengue virus
TPKPMPGT

SEQ ID NO: 57063 - protein, 8 aa, Dengue virus
PKPMPGTR

SEQ ID NO: 57064 - protein, 8 aa, Dengue virus
MPGTRKAM

SEQ ID NO: 57065 - protein, 8 aa, Dengue virus
GTRRVMEI

SEQ ID NO: 57066 - protein, 8 aa, Dengue virus
TRRVMEIT

SEQ ID NO: 57067 - protein, 8 aa, Dengue virus
AMGITAEW

SEQ ID NO: 57068 - protein, 8 aa, Dengue virus
KAAVEDEE

SEQ ID NO: 57069 - protein, 8 aa, Dengue virus
VEDEDFWI

SEQ ID NO: 57070 - protein, 8 aa, Dengue virus
EDEDFWIL

SEQ ID NO: 57071 - protein, 8 aa, Dengue virus
DEDFWILV

SEQ ID NO: 57072 - protein, 8 aa, Dengue virus
EDFWILVD

SEQ ID NO: 57073 - protein, 8 aa, Dengue virus
EFWKLVDK

SEQ ID NO: 57074 - protein, 8 aa, Dengue virus
FWILVDRE

SEQ ID NO: 57075 - protein, 8 aa, Dengue virus
WILVDRER

SEQ ID NO: 57076 - protein, 8 aa, Dengue virus
ILVDRERE

SEQ ID NO: 57077 - protein, 8 aa, Dengue virus
RERELHKQ

SEQ ID NO: 57078 - protein, 8 aa, Dengue virus
LHNEEKIM

SEQ ID NO: 57079 - protein, 8 aa, Dengue virus
HNEEKIMQ

SEQ ID NO: 57080 - protein, 8 aa, Dengue virus
NEEKIMQQ

SEQ ID NO: 57081 - protein, 8 aa, Dengue virus
EEKIMQQM

SEQ ID NO: 57082 - protein, 8 aa, Dengue virus
EKIMQQMD

SEQ ID NO: 57083 - protein, 8 aa, Dengue virus
KIMQQMDP

SEQ ID NO: 57084 - protein, 8 aa, Dengue virus
IMQQMDPE

SEQ ID NO: 57085 - protein, 8 aa, Dengue virus
MQQMDPEH

SEQ ID NO: 57086 - protein, 8 aa, Dengue virus
QQMDPEHK

SEQ ID NO: 57087 - protein, 8 aa, Dengue virus
QMDPEHKQ

SEQ ID NO: 57088 - protein, 8 aa, Dengue virus
MDPEHRKL

SEQ ID NO: 57089 - protein, 8 aa, Dengue virus
DPEHRRLA

SEQ ID NO: 57090 - protein, 8 aa, Dengue virus
PEHRLLAN

SEQ ID NO: 57091 - protein, 8 aa, Dengue virus
EHRLLANA

SEQ ID NO: 57092 - protein, 8 aa, Dengue virus
HRLLANAI

SEQ ID NO: 57093 - protein, 8 aa, Dengue virus
RLLANAIF

SEQ ID NO: 57094 - protein, 8 aa, Dengue virus
LLANAIFK

SEQ ID NO: 57095 - protein, 8 aa, Dengue virus
TNMEVQLI

SEQ ID NO: 57096 - protein, 8 aa, Dengue virus
NMEVQLIR

SEQ ID NO: 57097 - protein, 8 aa, Dengue virus
MEVQLIRQ

SEQ ID NO: 57098 - protein, 8 aa, Dengue virus
EVQLIRQM

SEQ ID NO: 57099 - protein, 8 aa, Dengue virus
VQLIRQME

SEQ ID NO: 57100 - protein, 8 aa, Dengue virus
EGEGVLSE

SEQ ID NO: 57101 - protein, 8 aa, Dengue virus
GEGVLSKT

SEQ ID NO: 57102 - protein, 8 aa, Dengue virus
VLSKTDLE

SEQ ID NO: 57103 - protein, 8 aa, Dengue virus
EKKIIQWL

SEQ ID NO: 57104 - protein, 8 aa, Dengue virus
KKIIQWLE

SEQ ID NO: 57105 - protein, 8 aa, Dengue virus
IQWLETKG

SEQ ID NO: 57106 - protein, 8 aa, Dengue virus
QWLENKGV

SEQ ID NO: 57107 - protein, 8 aa, Dengue virus
WLENKGVE

SEQ ID NO: 57108 - protein, 8 aa, Dengue virus
LENKGVER

SEQ ID NO: 57109 - protein, 8 aa, Dengue virus
ENKGVERL

SEQ ID NO: 57110 - protein, 8 aa, Dengue virus
TEGVERLK

SEQ ID NO: 57111 - protein, 8 aa, Dengue virus
EGVERLKR

SEQ ID NO: 57112 - protein, 8 aa, Dengue virus
KAYAQMWT

SEQ ID NO: 57113 - protein, 8 aa, Dengue virus
AYAQMWTL

SEQ ID NO: 57114 - protein, 8 aa, Dengue virus
YAQMWTLM

SEQ ID NO: 57115 - protein, 8 aa, Dengue virus
AQMWTLMY

SEQ ID NO: 57116 - protein, 8 aa, Dengue virus
QMWTLMYF

SEQ ID NO: 57117 - protein, 8 aa, Dengue virus
MWTLMYFH

SEQ ID NO: 57118 - protein, 8 aa, Dengue virus
WTLMYFHR

SEQ ID NO: 57119 - protein, 8 aa, Dengue virus
TLMYFHRR

SEQ ID NO: 57120 - protein, 8 aa, Dengue virus
SAVPAHWV

SEQ ID NO: 57121 - protein, 8 aa, Dengue virus
AVPAHWVP

SEQ ID NO: 57122 - protein, 8 aa, Dengue virus
VPAHWVPT

SEQ ID NO: 57123 - protein, 8 aa, Dengue virus
PAHWVPTS

SEQ ID NO: 57124 - protein, 8 aa, Dengue virus
AHWVPTSR

SEQ ID NO: 57125 - protein, 8 aa, Dengue virus
MTTEDMLS

SEQ ID NO: 57126 - protein, 8 aa, Dengue virus
TTEDMLSV

SEQ ID NO: 57127 - protein, 8 aa, Dengue virus
TEDMLSVW

SEQ ID NO: 57128 - protein, 8 aa, Dengue virus
EDMLSVWN

SEQ ID NO: 57129 - protein, 8 aa, Dengue virus
DMLSVWNR

SEQ ID NO: 57130 - protein, 8 aa, Dengue virus
MLSVWNRV

SEQ ID NO: 57131 - protein, 8 aa, Dengue virus
LSVWNRVW

SEQ ID NO: 57132 - protein, 8 aa, Dengue virus
SVWNRVWI

SEQ ID NO: 57133 - protein, 8 aa, Dengue virus
MGDKTPVT

SEQ ID NO: 57134 - protein, 8 aa, Dengue virus
GDKTPVTT

SEQ ID NO: 57135 - protein, 8 aa, Dengue virus
TPITTWEN

SEQ ID NO: 57136 - protein, 8 aa, Dengue virus
PITTWENV

SEQ ID NO: 57137 - protein, 8 aa, Dengue virus
ITTWENVP

SEQ ID NO: 57138 - protein, 8 aa, Dengue virus
TWAQNILI

SEQ ID NO: 57139 - protein, 8 aa, Dengue virus
WAQNILIA

SEQ ID NO: 57140 - protein, 8 aa, Dengue virus
AQNILIAI

SEQ ID NO: 57141 - protein, 8 aa, Dengue virus
QNILIAIQ

SEQ ID NO: 57142 - protein, 8 aa, Dengue virus
NILIAIQQ

SEQ ID NO: 57143 - protein, 8 aa, Dengue virus
ILIAIQQV

SEQ ID NO: 57144 - protein, 8 aa, Dengue virus
LIAIQQVR

SEQ ID NO: 57145 - protein, 8 aa, Dengue virus
RFRKEEET

SEQ ID NO: 57146 - protein, 8 aa, Dengue virus
FRKEEETE

SEQ ID NO: 57147 - protein, 8 aa, Dengue virus
RKEEETEG

SEQ ID NO: 57148 - protein, 8 aa, Dengue virus
KEEETEGA

SEQ ID NO: 57149 - protein, 8 aa, Dengue virus
EEETEGAI

SEQ ID NO: 57150 - protein, 8 aa, Dengue virus
EETEGAIW

SEQ ID NO: 57151 - protein, 8 aa, Dengue virus
KVLKSFKK

SEQ ID NO: 57152 - protein, 8 aa, Dengue virus
VLKSFKKE

SEQ ID NO: 57153 - protein, 8 aa, Dengue virus
NRRKKTSF

SEQ ID NO: 57154 - protein, 8 aa, Dengue virus
RRKKTSFC

SEQ ID NO: 57155 - protein, 8 aa, Dengue virus
KRTSLCLM

SEQ ID NO: 57156 - protein, 8 aa, Dengue virus
RTSLCLMM

SEQ ID NO: 57157 - protein, 8 aa, Dengue virus
CLMMVLPA

SEQ ID NO: 57158 - protein, 8 aa, Dengue virus
MMFPATLA

SEQ ID NO: 57159 - protein, 8 aa, Dengue virus
MFPATLAF

SEQ ID NO: 57160 - protein, 8 aa, Dengue virus
TITYKCPL

SEQ ID NO: 57161 - protein, 8 aa, Dengue virus
ITYKCPLI

SEQ ID NO: 57162 - protein, 8 aa, Dengue virus
TYKCPHIA

SEQ ID NO: 57163 - protein, 8 aa, Dengue virus
YKCPHIAE

SEQ ID NO: 57164 - protein, 8 aa, Dengue virus
HYISTSLT

SEQ ID NO: 57165 - protein, 8 aa, Dengue virus
TQKVVIFT

SEQ ID NO: 57166 - protein, 8 aa, Dengue virus
QKVVIFTL

SEQ ID NO: 57167 - protein, 8 aa, Dengue virus
KVVIFTLL

SEQ ID NO: 57168 - protein, 8 aa, Dengue virus
VVIFTLLM

SEQ ID NO: 57169 - protein, 8 aa, Dengue virus
CPTQGEAA

SEQ ID NO: 57170 - protein, 8 aa, Dengue virus
PTQGEAAL

SEQ ID NO: 57171 - protein, 8 aa, Dengue virus
TQGEAALP

SEQ ID NO: 57172 - protein, 8 aa, Dengue virus
QGEAALPE

SEQ ID NO: 57173 - protein, 8 aa, Dengue virus
GEAALPEE

SEQ ID NO: 57174 - protein, 8 aa, Dengue virus
EAALPEEQ

SEQ ID NO: 57175 - protein, 8 aa, Dengue virus
AALPEEQD

SEQ ID NO: 57176 - protein, 8 aa, Dengue virus
ALPEEQDQ

SEQ ID NO: 57177 - protein, 8 aa, Dengue virus
KFQCLEPV

SEQ ID NO: 57178 - protein, 8 aa, Dengue virus
FQCLEPVE

SEQ ID NO: 57179 - protein, 8 aa, Dengue virus
QCLEPVEG

SEQ ID NO: 57180 - protein, 8 aa, Dengue virus
CLEPVEGK

SEQ ID NO: 57181 - protein, 8 aa, Dengue virus
SIEGKAVQ

SEQ ID NO: 57182 - protein, 8 aa, Dengue virus
ITSQASTA

SEQ ID NO: 57183 - protein, 8 aa, Dengue virus
TPQASITE

SEQ ID NO: 57184 - protein, 8 aa, Dengue virus
SQASTAEA

SEQ ID NO: 57185 - protein, 8 aa, Dengue virus
QASTAEAI

SEQ ID NO: 57186 - protein, 8 aa, Dengue virus
ASTAEAIL

SEQ ID NO: 57187 - protein, 8 aa, Dengue virus
AEAILPEY

SEQ ID NO: 57188 - protein, 8 aa, Dengue virus
LPWTSGTT

SEQ ID NO: 57189 - protein, 8 aa, Dengue virus
PWTSGTTT

SEQ ID NO: 57190 - protein, 8 aa, Dengue virus
TTKTPTWN

SEQ ID NO: 57191 - protein, 8 aa, Dengue virus
TETPIWNR

SEQ ID NO: 57192 - protein, 8 aa, Dengue virus
SYAMCLNA

SEQ ID NO: 57193 - protein, 8 aa, Dengue virus
YAMCLNAF

SEQ ID NO: 57194 - protein, 8 aa, Dengue virus
AMCLNAFV

SEQ ID NO: 57195 - protein, 8 aa, Dengue virus
MCLNAFVL

SEQ ID NO: 57196 - protein, 8 aa, Dengue virus
NTFVLRKE

SEQ ID NO: 57197 - protein, 8 aa, Dengue virus
VKVEYKGE

SEQ ID NO: 57198 - protein, 8 aa, Dengue virus
VEYKGKDA

SEQ ID NO: 57199 - protein, 8 aa, Dengue virus
EYKGKDAP

SEQ ID NO: 57200 - protein, 8 aa, Dengue virus
KGKDAPCK

SEQ ID NO: 57201 - protein, 8 aa, Dengue virus
GKDAPCKI

SEQ ID NO: 57202 - protein, 8 aa, Dengue virus
KDAPCKIP

SEQ ID NO: 57203 - protein, 8 aa, Dengue virus
DGQGKVHN

SEQ ID NO: 57204 - protein, 8 aa, Dengue virus
GQGKVHNG

SEQ ID NO: 57205 - protein, 8 aa, Dengue virus
NPVVIKKE

SEQ ID NO: 57206 - protein, 8 aa, Dengue virus
PVVIKKEE

SEQ ID NO: 57207 - protein, 8 aa, Dengue virus
VVIKKEEP

SEQ ID NO: 57208 - protein, 8 aa, Dengue virus
VIKKEEPV

SEQ ID NO: 57209 - protein, 8 aa, Dengue virus
IKKEEPVN

SEQ ID NO: 57210 - protein, 8 aa, Dengue virus
ESNIIIGT

SEQ ID NO: 57211 - protein, 8 aa, Dengue virus
SNIIIGTG

SEQ ID NO: 57212 - protein, 8 aa, Dengue virus
NIIIGTGD

SEQ ID NO: 57213 - protein, 8 aa, Dengue virus
GNKALKIN

SEQ ID NO: 57214 - protein, 8 aa, Dengue virus
DNALRINW

SEQ ID NO: 57215 - protein, 8 aa, Dengue virus
MMKIGIGV

SEQ ID NO: 57216 - protein, 8 aa, Dengue virus
SCITIGII

SEQ ID NO: 57217 - protein, 8 aa, Dengue virus
CITIGIIT

SEQ ID NO: 57218 - protein, 8 aa, Dengue virus
ITIGIITL

SEQ ID NO: 57219 - protein, 8 aa, Dengue virus
TIGIITLY

SEQ ID NO: 57220 - protein, 8 aa, Dengue virus
IITLYLGV

SEQ ID NO: 57221 - protein, 8 aa, Dengue virus
GVVVQADM

SEQ ID NO: 57222 - protein, 8 aa, Dengue virus
VVVQADMG

SEQ ID NO: 57223 - protein, 8 aa, Dengue virus
QADMGCVV

SEQ ID NO: 57224 - protein, 8 aa, Dengue virus
ADMGCVVN

SEQ ID NO: 57225 - protein, 8 aa, Dengue virus
DMGCVVNW

SEQ ID NO: 57226 - protein, 8 aa, Dengue virus
MGCVVNWK

SEQ ID NO: 57227 - protein, 8 aa, Dengue virus
LTVVVGDV

SEQ ID NO: 57228 - protein, 8 aa, Dengue virus
TIVVGDVI

SEQ ID NO: 57229 - protein, 8 aa, Dengue virus
IVVGDVIG

SEQ ID NO: 57230 - protein, 8 aa, Dengue virus
RTLTLQPM

SEQ ID NO: 57231 - protein, 8 aa, Dengue virus
ILTPQPME

SEQ ID NO: 57232 - protein, 8 aa, Dengue virus
KTWGKAKV

SEQ ID NO: 57233 - protein, 8 aa, Dengue virus
AWGKAKIV

SEQ ID NO: 57234 - protein, 8 aa, Dengue virus
WGKAKVVT

SEQ ID NO: 57235 - protein, 8 aa, Dengue virus
GKAKVVTA

SEQ ID NO: 57236 - protein, 8 aa, Dengue virus
KAKVVTAE

SEQ ID NO: 57237 - protein, 8 aa, Dengue virus
AEKQNSSF

SEQ ID NO: 57238 - protein, 8 aa, Dengue virus
ENQNSSFI

SEQ ID NO: 57239 - protein, 8 aa, Dengue virus
NTPECPNT

SEQ ID NO: 57240 - protein, 8 aa, Dengue virus
PNTSRAWN

SEQ ID NO: 57241 - protein, 8 aa, Dengue virus
NTSRAWNV

SEQ ID NO: 57242 - protein, 8 aa, Dengue virus
WLKLRDVY

SEQ ID NO: 57243 - protein, 8 aa, Dengue virus
LKLREMYS

SEQ ID NO: 57244 - protein, 8 aa, Dengue virus
KLREMYSQ

SEQ ID NO: 57245 - protein, 8 aa, Dengue virus
SQLCDHRL

SEQ ID NO: 57246 - protein, 8 aa, Dengue virus
TTVVITED

SEQ ID NO: 57247 - protein, 8 aa, Dengue virus
TVVITEDC

SEQ ID NO: 57248 - protein, 8 aa, Dengue virus
VVITEDCG

SEQ ID NO: 57249 - protein, 8 aa, Dengue virus
VITEDCGT

SEQ ID NO: 57250 - protein, 8 aa, Dengue virus
CGTGGPSL

SEQ ID NO: 57251 - protein, 8 aa, Dengue virus
GTGGPSLR

SEQ ID NO: 57252 - protein, 8 aa, Dengue virus
TRGPALRT

SEQ ID NO: 57253 - protein, 8 aa, Dengue virus
GMEIRPVS

SEQ ID NO: 57254 - protein, 8 aa, Dengue virus
MEIRPVSE

SEQ ID NO: 57255 - protein, 8 aa, Dengue virus
EIRPVSEK

SEQ ID NO: 57256 - protein, 8 aa, Dengue virus
IRPVSEKE

SEQ ID NO: 57257 - protein, 8 aa, Dengue virus
RPVSEKEE

SEQ ID NO: 57258 - protein, 8 aa, Dengue virus
PVSEKEEN

SEQ ID NO: 57259 - protein, 8 aa, Dengue virus
VSEKEENM

SEQ ID NO: 57260 - protein, 8 aa, Dengue virus
ASAGSGKV

SEQ ID NO: 57261 - protein, 8 aa, Dengue virus
SAGSGKAD

SEQ ID NO: 57262 - protein, 8 aa, Dengue virus
AGSGKADN

SEQ ID NO: 57263 - protein, 8 aa, Dengue virus
GSGKADNF

SEQ ID NO: 57264 - protein, 8 aa, Dengue virus
SGKADNFT

SEQ ID NO: 57265 - protein, 8 aa, Dengue virus
GKADNFTM

SEQ ID NO: 57266 - protein, 8 aa, Dengue virus
KADNFTMG

SEQ ID NO: 57267 - protein, 8 aa, Dengue virus
MDNFTMGV

SEQ ID NO: 57268 - protein, 8 aa, Dengue virus
KKHMIAGI

SEQ ID NO: 57269 - protein, 8 aa, Dengue virus
FIFVLLLS

SEQ ID NO: 57270 - protein, 8 aa, Dengue virus
DMAHTFIM

SEQ ID NO: 57271 - protein, 8 aa, Dengue virus
AHTFIMIG

SEQ ID NO: 57272 - protein, 8 aa, Dengue virus
IGSNTSDR

SEQ ID NO: 57273 - protein, 8 aa, Dengue virus
WTALASLM

SEQ ID NO: 57274 - protein, 8 aa, Dengue virus
TALASLMC

SEQ ID NO: 57275 - protein, 8 aa, Dengue virus
ALASLMCS

SEQ ID NO: 57276 - protein, 8 aa, Dengue virus
LASLMCSN

SEQ ID NO: 57277 - protein, 8 aa, Dengue virus
ASLMCSNT

SEQ ID NO: 57278 - protein, 8 aa, Dengue virus
LMCANTIF

SEQ ID NO: 57279 - protein, 8 aa, Dengue virus
TCSNTILT

SEQ ID NO: 57280 - protein, 8 aa, Dengue virus
VLAGVSLL

SEQ ID NO: 57281 - protein, 8 aa, Dengue virus
VSLLPMCQ

SEQ ID NO: 57282 - protein, 8 aa, Dengue virus
KTDWLPVA

SEQ ID NO: 57283 - protein, 8 aa, Dengue virus
TDWLPVAV

SEQ ID NO: 57284 - protein, 8 aa, Dengue virus
MTVAAMGA

SEQ ID NO: 57285 - protein, 8 aa, Dengue virus
TVAAMGVQ

SEQ ID NO: 57286 - protein, 8 aa, Dengue virus
VAAMGVSP

SEQ ID NO: 57287 - protein, 8 aa, Dengue virus
AAMGVSPL

SEQ ID NO: 57288 - protein, 8 aa, Dengue virus
AMGVSPLP

SEQ ID NO: 57289 - protein, 8 aa, Dengue virus
MGVSPLPL

SEQ ID NO: 57290 - protein, 8 aa, Dengue virus
GVQPLPLF

SEQ ID NO: 57291 - protein, 8 aa, Dengue virus
VSPLPLFI

SEQ ID NO: 57292 - protein, 8 aa, Dengue virus
PLPLFIFG

SEQ ID NO: 57293 - protein, 8 aa, Dengue virus
FIFGLKDT

SEQ ID NO: 57294 - protein, 8 aa, Dengue virus
LKDALKRR

SEQ ID NO: 57295 - protein, 8 aa, Dengue virus
KDALKRRS

SEQ ID NO: 57296 - protein, 8 aa, Dengue virus
DALKRRSW

SEQ ID NO: 57297 - protein, 8 aa, Dengue virus
ALKRRSWP

SEQ ID NO: 57298 - protein, 8 aa, Dengue virus
LTVEKAAN

SEQ ID NO: 57299 - protein, 8 aa, Dengue virus
PDVTWEEE

SEQ ID NO: 57300 - protein, 8 aa, Dengue virus
NVTWEEEA

SEQ ID NO: 57301 - protein, 8 aa, Dengue virus
GGGWRLST

SEQ ID NO: 57302 - protein, 8 aa, Dengue virus
GGWRLSTQ

SEQ ID NO: 57303 - protein, 8 aa, Dengue virus
GWRLSTQW

SEQ ID NO: 57304 - protein, 8 aa, Dengue virus
WRLSTQWQ

SEQ ID NO: 57305 - protein, 8 aa, Dengue virus
RLSTQWQK

SEQ ID NO: 57306 - protein, 8 aa, Dengue virus
LSAQWKKG

SEQ ID NO: 57307 - protein, 8 aa, Dengue virus
SAQWKKGE

SEQ ID NO: 57308 - protein, 8 aa, Dengue virus
NFQTTPGI

SEQ ID NO: 57309 - protein, 8 aa, Dengue virus
FQTTPGIF

SEQ ID NO: 57310 - protein, 8 aa, Dengue virus
QTTPGIFQ

SEQ ID NO: 57311 - protein, 8 aa, Dengue virus
TTPGIFQT

SEQ ID NO: 57312 - protein, 8 aa, Dengue virus
TPGIFQTT

SEQ ID NO: 57313 - protein, 8 aa, Dengue virus
QTTVTKSE

SEQ ID NO: 57314 - protein, 8 aa, Dengue virus
TTATRSEH

SEQ ID NO: 57315 - protein, 8 aa, Dengue virus
TVTKSEHT

SEQ ID NO: 57316 - protein, 8 aa, Dengue virus
NEWITDFT

SEQ ID NO: 57317 - protein, 8 aa, Dengue virus
EWITDFTG

SEQ ID NO: 57318 - protein, 8 aa, Dengue virus
FLVSGKGI

SEQ ID NO: 57319 - protein, 8 aa, Dengue virus
LVSGKGIG

SEQ ID NO: 57320 - protein, 8 aa, Dengue virus
GRGIGKAS

SEQ ID NO: 57321 - protein, 8 aa, Dengue virus
RGIGKASI

SEQ ID NO: 57322 - protein, 8 aa, Dengue virus
GIGKASIG

SEQ ID NO: 57323 - protein, 8 aa, Dengue virus
IGKASIGL

SEQ ID NO: 57324 - protein, 8 aa, Dengue virus
VTVSSGML

SEQ ID NO: 57325 - protein, 8 aa, Dengue virus
TVSSGMLW

SEQ ID NO: 57326 - protein, 8 aa, Dengue virus
GMLWMADI

SEQ ID NO: 57327 - protein, 8 aa, Dengue virus
MLWMADIP

SEQ ID NO: 57328 - protein, 8 aa, Dengue virus
LWMADIPL

SEQ ID NO: 57329 - protein, 8 aa, Dengue virus
WMADIPLQ

SEQ ID NO: 57330 - protein, 8 aa, Dengue virus
MADIPLQW

SEQ ID NO: 57331 - protein, 8 aa, Dengue virus
ADIPLQWI

SEQ ID NO: 57332 - protein, 8 aa, Dengue virus
DIPLQWIA

SEQ ID NO: 57333 - protein, 8 aa, Dengue virus
LTLAATIA

SEQ ID NO: 57334 - protein, 8 aa, Dengue virus
TLAATIAA

SEQ ID NO: 57335 - protein, 8 aa, Dengue virus
LAATIAAN

SEQ ID NO: 57336 - protein, 8 aa, Dengue virus
AATIAANE

SEQ ID NO: 57337 - protein, 8 aa, Dengue virus
ATIAANEM

SEQ ID NO: 57338 - protein, 8 aa, Dengue virus
TIAANEMG

SEQ ID NO: 57339 - protein, 8 aa, Dengue virus
REPGVVSP

SEQ ID NO: 57340 - protein, 8 aa, Dengue virus
EPGVVSPN

SEQ ID NO: 57341 - protein, 8 aa, Dengue virus
PGVVSPNS

SEQ ID NO: 57342 - protein, 8 aa, Dengue virus
GVVSPNSY

SEQ ID NO: 57343 - protein, 8 aa, Dengue virus
VVSPNSYL

SEQ ID NO: 57344 - protein, 8 aa, Dengue virus
VSPNSYLD

SEQ ID NO: 57345 - protein, 8 aa, Dengue virus
IAAVLLLV

SEQ ID NO: 57346 - protein, 8 aa, Dengue virus
KKLNQLSW

SEQ ID NO: 57347 - protein, 8 aa, Dengue virus
KLNQLSWK

SEQ ID NO: 57348 - protein, 8 aa, Dengue virus
SRREFDLY

SEQ ID NO: 57349 - protein, 8 aa, Dengue virus
EGLKRRET

SEQ ID NO: 57350 - protein, 8 aa, Dengue virus
GLRRGEIT

SEQ ID NO: 57351 - protein, 8 aa, Dengue virus
RGEVTHHA

SEQ ID NO: 57352 - protein, 8 aa, Dengue virus
GEITRHAV

SEQ ID NO: 57353 - protein, 8 aa, Dengue virus
WNIVKLMT

SEQ ID NO: 57354 - protein, 8 aa, Dengue virus
NIIKLMSG

SEQ ID NO: 57355 - protein, 8 aa, Dengue virus
IVKLMTGK

SEQ ID NO: 57356 - protein, 8 aa, Dengue virus
VLNPYMPN

SEQ ID NO: 57357 - protein, 8 aa, Dengue virus
NPYMPNVI

SEQ ID NO: 57358 - protein, 8 aa, Dengue virus
PYMPNVIE

SEQ ID NO: 57359 - protein, 8 aa, Dengue virus
YMPNVIEH

SEQ ID NO: 57360 - protein, 8 aa, Dengue virus
MPNVIEHL

SEQ ID NO: 57361 - protein, 8 aa, Dengue virus
PNVIEHLE

SEQ ID NO: 57362 - protein, 8 aa, Dengue virus
NVIEHLER

SEQ ID NO: 57363 - protein, 8 aa, Dengue virus
HRRPTIER

SEQ ID NO: 57364 - protein, 8 aa, Dengue virus
ERVKRIKE

SEQ ID NO: 57365 - protein, 8 aa, Dengue virus
RLRRIKEE

SEQ ID NO: 57366 - protein, 8 aa, Dengue virus
LRRIKEEH

SEQ ID NO: 57367 - protein, 8 aa, Dengue virus
RVKEEHNS

SEQ ID NO: 57368 - protein, 8 aa, Dengue virus
IKEEHDST

SEQ ID NO: 57369 - protein, 8 aa, Dengue virus
SSTWHYDE

SEQ ID NO: 57370 - protein, 8 aa, Dengue virus
TRTPRPMA

SEQ ID NO: 57371 - protein, 8 aa, Dengue virus
RTPRPMAG

SEQ ID NO: 57372 - protein, 8 aa, Dengue virus
TPRPMAGT

SEQ ID NO: 57373 - protein, 8 aa, Dengue virus
PRPMAGTR

SEQ ID NO: 57374 - protein, 8 aa, Dengue virus
MPGTRRAM

SEQ ID NO: 57375 - protein, 8 aa, Dengue virus
GTRKVMGI

SEQ ID NO: 57376 - protein, 8 aa, Dengue virus
TRKVMGIT

SEQ ID NO: 57377 - protein, 8 aa, Dengue virus
AMEITAEW

SEQ ID NO: 57378 - protein, 8 aa, Dengue virus
ENFWKLVD

SEQ ID NO: 57379 - protein, 8 aa, Dengue virus
DFWILVDR

SEQ ID NO: 57380 - protein, 8 aa, Dengue virus
ITHQMDPE

SEQ ID NO: 57381 - protein, 8 aa, Dengue virus
TQQMNPEH

SEQ ID NO: 57382 - protein, 8 aa, Dengue virus
QMDPEHRL

SEQ ID NO: 57383 - protein, 8 aa, Dengue virus
MDPEHRLL

SEQ ID NO: 57384 - protein, 8 aa, Dengue virus
DPEHRLLA

SEQ ID NO: 57385 - protein, 8 aa, Dengue virus
PEHRRLAN

SEQ ID NO: 57386 - protein, 8 aa, Dengue virus
EHKQLANA

SEQ ID NO: 57387 - protein, 8 aa, Dengue virus
HRKLANAI

SEQ ID NO: 57388 - protein, 8 aa, Dengue virus
RRLANAIF

SEQ ID NO: 57389 - protein, 8 aa, Dengue virus
RLANAIFK

SEQ ID NO: 57390 - protein, 8 aa, Dengue virus
GEGVLSKV

SEQ ID NO: 57391 - protein, 8 aa, Dengue virus
VLSKVDLE

SEQ ID NO: 57392 - protein, 8 aa, Dengue virus
EKKIAQWL

SEQ ID NO: 57393 - protein, 8 aa, Dengue virus
KKIAQWLE

SEQ ID NO: 57394 - protein, 8 aa, Dengue virus
TQWLENKG

SEQ ID NO: 57395 - protein, 8 aa, Dengue virus
NKGVERLK

SEQ ID NO: 57396 - protein, 8 aa, Dengue virus
TPITTWED

SEQ ID NO: 57397 - protein, 8 aa, Dengue virus
PITTWEDV

SEQ ID NO: 57398 - protein, 8 aa, Dengue virus
ITTWEDVP

SEQ ID NO: 57399 - protein, 8 aa, Dengue virus
NRRKRTSL

SEQ ID NO: 57400 - protein, 8 aa, Dengue virus
RRKRTSLC

SEQ ID NO: 57401 - protein, 8 aa, Dengue virus
CLMMMFPA

SEQ ID NO: 57402 - protein, 8 aa, Dengue virus
MVLPAALA

SEQ ID NO: 57403 - protein, 8 aa, Dengue virus
VLPAALAF

SEQ ID NO: 57404 - protein, 8 aa, Dengue virus
TYKCPFIA

SEQ ID NO: 57405 - protein, 8 aa, Dengue virus
YKCPFIAE

SEQ ID NO: 57406 - protein, 8 aa, Dengue virus
IQKVVIFI

SEQ ID NO: 57407 - protein, 8 aa, Dengue virus
PQASTTEV

SEQ ID NO: 57408 - protein, 8 aa, Dengue virus
QASTTEVI

SEQ ID NO: 57409 - protein, 8 aa, Dengue virus
ASITEAIL

SEQ ID NO: 57410 - protein, 8 aa, Dengue virus
TEVILPEY

SEQ ID NO: 57411 - protein, 8 aa, Dengue virus
PWTSGVTT

SEQ ID NO: 57412 - protein, 8 aa, Dengue virus
ITETPTWN

SEQ ID NO: 57413 - protein, 8 aa, Dengue virus
TKTPTWNR

SEQ ID NO: 57414 - protein, 8 aa, Dengue virus
SYAMCLGS

SEQ ID NO: 57415 - protein, 8 aa, Dengue virus
YAMCLGSF

SEQ ID NO: 57416 - protein, 8 aa, Dengue virus
AMCLGSFV

SEQ ID NO: 57417 - protein, 8 aa, Dengue virus
MCLGSFVL

SEQ ID NO: 57418 - protein, 8 aa, Dengue virus
NIVIGVGD

SEQ ID NO: 57419 - protein, 8 aa, Dengue virus
TVVVGDVI

SEQ ID NO: 57420 - protein, 8 aa, Dengue virus
VVVGDVIG

SEQ ID NO: 57421 - protein, 8 aa, Dengue virus
KTWGKAKM

SEQ ID NO: 57422 - protein, 8 aa, Dengue virus
TWGKAKMV

SEQ ID NO: 57423 - protein, 8 aa, Dengue virus
WGKAKMVT

SEQ ID NO: 57424 - protein, 8 aa, Dengue virus
GKAKMVTA

SEQ ID NO: 57425 - protein, 8 aa, Dengue virus
KAKMVTAE

SEQ ID NO: 57426 - protein, 8 aa, Dengue virus
STPECPSA

SEQ ID NO: 57427 - protein, 8 aa, Dengue virus
PSAARAWN

SEQ ID NO: 57428 - protein, 8 aa, Dengue virus
SALRAWNV

SEQ ID NO: 57429 - protein, 8 aa, Dengue virus
LKLRDVYT

SEQ ID NO: 57430 - protein, 8 aa, Dengue virus
KLRDVYTQ

SEQ ID NO: 57431 - protein, 8 aa, Dengue virus
TTVVISEN

SEQ ID NO: 57432 - protein, 8 aa, Dengue virus
TVVISENC

SEQ ID NO: 57433 - protein, 8 aa, Dengue virus
VVISENCG

SEQ ID NO: 57434 - protein, 8 aa, Dengue virus
VISENCGT

SEQ ID NO: 57435 - protein, 8 aa, Dengue virus
IRGPSLRT

SEQ ID NO: 57436 - protein, 8 aa, Dengue virus
VSAGSGKA

SEQ ID NO: 57437 - protein, 8 aa, Dengue virus
VDNFTMGA

SEQ ID NO: 57438 - protein, 8 aa, Dengue virus
DLAHTLIM

SEQ ID NO: 57439 - protein, 8 aa, Dengue virus
WAALVSLT

SEQ ID NO: 57440 - protein, 8 aa, Dengue virus
AALVSLMC

SEQ ID NO: 57441 - protein, 8 aa, Dengue virus
ISLLPLCQ

SEQ ID NO: 57442 - protein, 8 aa, Dengue virus
TVAAMGVS

SEQ ID NO: 57443 - protein, 8 aa, Dengue virus
VAAMGVQP

SEQ ID NO: 57444 - protein, 8 aa, Dengue virus
AAMGVQPL

SEQ ID NO: 57445 - protein, 8 aa, Dengue virus
AMGVQPLP

SEQ ID NO: 57446 - protein, 8 aa, Dengue virus
MGVQPLPL

SEQ ID NO: 57447 - protein, 8 aa, Dengue virus
GVSPLPLF

SEQ ID NO: 57448 - protein, 8 aa, Dengue virus
VQPLPLFI

SEQ ID NO: 57449 - protein, 8 aa, Dengue virus
LKDAPKRR

SEQ ID NO: 57450 - protein, 8 aa, Dengue virus
KDAPKRRS

SEQ ID NO: 57451 - protein, 8 aa, Dengue virus
DAPKRRSW

SEQ ID NO: 57452 - protein, 8 aa, Dengue virus
APKRRSWP

SEQ ID NO: 57453 - protein, 8 aa, Dengue virus
LTVEKAAE

SEQ ID NO: 57454 - protein, 8 aa, Dengue virus
ANVTWEEE

SEQ ID NO: 57455 - protein, 8 aa, Dengue virus
WRLSAQWK

SEQ ID NO: 57456 - protein, 8 aa, Dengue virus
RLSAQWKK

SEQ ID NO: 57457 - protein, 8 aa, Dengue virus
GMLWIAEI

SEQ ID NO: 57458 - protein, 8 aa, Dengue virus
MLWIAEIP

SEQ ID NO: 57459 - protein, 8 aa, Dengue virus
EPGVVPPT

SEQ ID NO: 57460 - protein, 8 aa, Dengue virus
PGVVSPIS

SEQ ID NO: 57461 - protein, 8 aa, Dengue virus
GVVPPTSY

SEQ ID NO: 57462 - protein, 8 aa, Dengue virus
VVSPISYL

SEQ ID NO: 57463 - protein, 8 aa, Dengue virus
AAAVLLLV

SEQ ID NO: 57464 - protein, 8 aa, Dengue virus
RRETTHHA

SEQ ID NO: 57465 - protein, 8 aa, Dengue virus
RIKRVKEE

SEQ ID NO: 57466 - protein, 8 aa, Dengue virus
IKRIKEGV

SEQ ID NO: 57467 - protein, 8 aa, Dengue virus
RIKEEHDS

SEQ ID NO: 57468 - protein, 8 aa, Dengue virus
GTRKAMEI

SEQ ID NO: 57469 - protein, 8 aa, Dengue virus
TRKAMEIT

SEQ ID NO: 57470 - protein, 8 aa, Dengue virus
NFWKLVDR

SEQ ID NO: 57471 - protein, 8 aa, Dengue virus
QMDPEHRK

SEQ ID NO: 57472 - protein, 8 aa, Dengue virus
MDPEHRRL

SEQ ID NO: 57473 - protein, 8 aa, Dengue virus
DPEHKQLA

SEQ ID NO: 57474 - protein, 8 aa, Dengue virus
PEHRKLAN

SEQ ID NO: 57475 - protein, 8 aa, Dengue virus
EHRKLANA

SEQ ID NO: 57476 - protein, 8 aa, Dengue virus
HKQLANAI

SEQ ID NO: 57477 - protein, 8 aa, Dengue virus
KQLANAIF

SEQ ID NO: 57478 - protein, 8 aa, Dengue virus
GEGVLSEA

SEQ ID NO: 57479 - protein, 8 aa, Dengue virus
VLSEADLE

SEQ ID NO: 57480 - protein, 8 aa, Dengue virus
EKRITQWL

SEQ ID NO: 57481 - protein, 8 aa, Dengue virus
KRITQWLE

SEQ ID NO: 57482 - protein, 8 aa, Dengue virus
AQWLETKG

SEQ ID NO: 57483 - protein, 9 aa, Dengue virus
MNNQRKKTG

SEQ ID NO: 57484 - protein, 9 aa, Dengue virus
NNQRKKTGK

SEQ ID NO: 57485 - protein, 9 aa, Dengue virus
NQRKKTGKP

SEQ ID NO: 57486 - protein, 9 aa, Dengue virus
QRKKTGKPS

SEQ ID NO: 57487 - protein, 9 aa, Dengue virus
RKKTGKPSI

SEQ ID NO: 57488 - protein, 9 aa, Dengue virus
KKTGKPSIN

SEQ ID NO: 57489 - protein, 9 aa, Dengue virus
KTGKPSINM

SEQ ID NO: 57490 - protein, 9 aa, Dengue virus
TGKPSINML

SEQ ID NO: 57491 - protein, 9 aa, Dengue virus
GKPSINMLK

SEQ ID NO: 57492 - protein, 9 aa, Dengue virus
KPSINMLKR

SEQ ID NO: 57493 - protein, 9 aa, Dengue virus
PSINMLKRV

SEQ ID NO: 57494 - protein, 9 aa, Dengue virus
SINMLKRVR

SEQ ID NO: 57495 - protein, 9 aa, Dengue virus
INMLKRVRN

SEQ ID NO: 57496 - protein, 9 aa, Dengue virus
NMLKRVRNR

SEQ ID NO: 57497 - protein, 9 aa, Dengue virus
MLKRVRNRV

SEQ ID NO: 57498 - protein, 9 aa, Dengue virus
LKRVRNRVS

SEQ ID NO: 57499 - protein, 9 aa, Dengue virus
KRVRNRVST

SEQ ID NO: 57500 - protein, 9 aa, Dengue virus
RVRNRVSTG

SEQ ID NO: 57501 - protein, 9 aa, Dengue virus
VRNRVSTGS

SEQ ID NO: 57502 - protein, 9 aa, Dengue virus
RNRVSTGSQ

SEQ ID NO: 57503 - protein, 9 aa, Dengue virus
NRVSTGSQL

SEQ ID NO: 57504 - protein, 9 aa, Dengue virus
RVSTGSQLA

SEQ ID NO: 57505 - protein, 9 aa, Dengue virus
VSTGSQLAK

SEQ ID NO: 57506 - protein, 9 aa, Dengue virus
STGSQLAKR

SEQ ID NO: 57507 - protein, 9 aa, Dengue virus
TGSQLAKRF

SEQ ID NO: 57508 - protein, 9 aa, Dengue virus
GSQLAKRFS

SEQ ID NO: 57509 - protein, 9 aa, Dengue virus
SQLAKRFSK

SEQ ID NO: 57510 - protein, 9 aa, Dengue virus
QLAKRFSKG

SEQ ID NO: 57511 - protein, 9 aa, Dengue virus
LAKRFSKGL

SEQ ID NO: 57512 - protein, 9 aa, Dengue virus
AKRFSKGLL

SEQ ID NO: 57513 - protein, 9 aa, Dengue virus
KRFSKGLLN

SEQ ID NO: 57514 - protein, 9 aa, Dengue virus
RFSKGLLNG

SEQ ID NO: 57515 - protein, 9 aa, Dengue virus
FSKGLLNGQ

SEQ ID NO: 57516 - protein, 9 aa, Dengue virus
SKGLLNGQG

SEQ ID NO: 57517 - protein, 9 aa, Dengue virus
KGLLNGQGP

SEQ ID NO: 57518 - protein, 9 aa, Dengue virus
GLLNGQGPM

SEQ ID NO: 57519 - protein, 9 aa, Dengue virus
LLNGQGPMK

SEQ ID NO: 57520 - protein, 9 aa, Dengue virus
LNGQGPMKL

SEQ ID NO: 57521 - protein, 9 aa, Dengue virus
NGQGPMKLV

SEQ ID NO: 57522 - protein, 9 aa, Dengue virus
GQGPMKLVM

SEQ ID NO: 57523 - protein, 9 aa, Dengue virus
QGPMKLVMA

SEQ ID NO: 57524 - protein, 9 aa, Dengue virus
GPMKLVMAF

SEQ ID NO: 57525 - protein, 9 aa, Dengue virus
PMKLVMAFI

SEQ ID NO: 57526 - protein, 9 aa, Dengue virus
MKLVMAFIA

SEQ ID NO: 57527 - protein, 9 aa, Dengue virus
KLVMAFIAF

SEQ ID NO: 57528 - protein, 9 aa, Dengue virus
LVMAFIAFL

SEQ ID NO: 57529 - protein, 9 aa, Dengue virus
VMAFIAFLR

SEQ ID NO: 57530 - protein, 9 aa, Dengue virus
MAFIAFLRF

SEQ ID NO: 57531 - protein, 9 aa, Dengue virus
AFIAFLRFL

SEQ ID NO: 57532 - protein, 9 aa, Dengue virus
FIAFLRFLA

SEQ ID NO: 57533 - protein, 9 aa, Dengue virus
IAFLRFLAI

SEQ ID NO: 57534 - protein, 9 aa, Dengue virus
AFLRFLAIP

SEQ ID NO: 57535 - protein, 9 aa, Dengue virus
FLRFLAIPP

SEQ ID NO: 57536 - protein, 9 aa, Dengue virus
LRFLAIPPT

SEQ ID NO: 57537 - protein, 9 aa, Dengue virus
RFLAIPPTA

SEQ ID NO: 57538 - protein, 9 aa, Dengue virus
FLAIPPTAG

SEQ ID NO: 57539 - protein, 9 aa, Dengue virus
LAIPPTAGV

SEQ ID NO: 57540 - protein, 9 aa, Dengue virus
AIPPTAGVL

SEQ ID NO: 57541 - protein, 9 aa, Dengue virus
IPPTAGVLA

SEQ ID NO: 57542 - protein, 9 aa, Dengue virus
PPTAGVLAR

SEQ ID NO: 57543 - protein, 9 aa, Dengue virus
PTAGVLARW

SEQ ID NO: 57544 - protein, 9 aa, Dengue virus
TAGVLARWG

SEQ ID NO: 57545 - protein, 9 aa, Dengue virus
AGVLARWGT

SEQ ID NO: 57546 - protein, 9 aa, Dengue virus
GVLARWGTF

SEQ ID NO: 57547 - protein, 9 aa, Dengue virus
VLARWGTFK

SEQ ID NO: 57548 - protein, 9 aa, Dengue virus
LARWGTFKK

SEQ ID NO: 57549 - protein, 9 aa, Dengue virus
ARWGTFKKS

SEQ ID NO: 57550 - protein, 9 aa, Dengue virus
RWGTFKKSG

SEQ ID NO: 57551 - protein, 9 aa, Dengue virus
WGTFKKSGA

SEQ ID NO: 57552 - protein, 9 aa, Dengue virus
GTFKKSGAI

SEQ ID NO: 57553 - protein, 9 aa, Dengue virus
TFKKSGAIK

SEQ ID NO: 57554 - protein, 9 aa, Dengue virus
FKKSGAIKV

SEQ ID NO: 57555 - protein, 9 aa, Dengue virus
KKSGAIKVL

SEQ ID NO: 57556 - protein, 9 aa, Dengue virus
KSGAIKVLK

SEQ ID NO: 57557 - protein, 9 aa, Dengue virus
SGAIKVLKG

SEQ ID NO: 57558 - protein, 9 aa, Dengue virus
GAIKVLKGF

SEQ ID NO: 57559 - protein, 9 aa, Dengue virus
AIKVLKGFK

SEQ ID NO: 57560 - protein, 9 aa, Dengue virus
IKVLKGFKK

SEQ ID NO: 57561 - protein, 9 aa, Dengue virus
KVLKGFKKE

SEQ ID NO: 57562 - protein, 9 aa, Dengue virus
VLKGFKKEI

SEQ ID NO: 57563 - protein, 9 aa, Dengue virus
LKGFKKEIS

SEQ ID NO: 57564 - protein, 9 aa, Dengue virus
KGFKKEISN

SEQ ID NO: 57565 - protein, 9 aa, Dengue virus
GFKKEISNM

SEQ ID NO: 57566 - protein, 9 aa, Dengue virus
FKKEISNML

SEQ ID NO: 57567 - protein, 9 aa, Dengue virus
KKEISNMLS

SEQ ID NO: 57568 - protein, 9 aa, Dengue virus
KEISNMLSI

SEQ ID NO: 57569 - protein, 9 aa, Dengue virus
EISNMLSII

SEQ ID NO: 57570 - protein, 9 aa, Dengue virus
ISNMLSIIN

SEQ ID NO: 57571 - protein, 9 aa, Dengue virus
SNMLSIINK

SEQ ID NO: 57572 - protein, 9 aa, Dengue virus
NMLSIINKR

SEQ ID NO: 57573 - protein, 9 aa, Dengue virus
MLSIINKRK

SEQ ID NO: 57574 - protein, 9 aa, Dengue virus
LSIINKRKK

SEQ ID NO: 57575 - protein, 9 aa, Dengue virus
SIINKRKKT

SEQ ID NO: 57576 - protein, 9 aa, Dengue virus
IINKRKKTS

SEQ ID NO: 57577 - protein, 9 aa, Dengue virus
NKRKKTSLC

SEQ ID NO: 57578 - protein, 9 aa, Dengue virus
RKKTSLCLM

SEQ ID NO: 57579 - protein, 9 aa, Dengue virus
KKTSLCLMM

SEQ ID NO: 57580 - protein, 9 aa, Dengue virus
MILPAALAF

SEQ ID NO: 57581 - protein, 9 aa, Dengue virus
ILPAALAFH

SEQ ID NO: 57582 - protein, 9 aa, Dengue virus
LPAALAFHL

SEQ ID NO: 57583 - protein, 9 aa, Dengue virus
PAALAFHLT

SEQ ID NO: 57584 - protein, 9 aa, Dengue virus
AALAFHLTS

SEQ ID NO: 57585 - protein, 9 aa, Dengue virus
ALAFHLTSR

SEQ ID NO: 57586 - protein, 9 aa, Dengue virus
LAFHLTSRD

SEQ ID NO: 57587 - protein, 9 aa, Dengue virus
AFHLTSRDG

SEQ ID NO: 57588 - protein, 9 aa, Dengue virus
FHLTSRDGE

SEQ ID NO: 57589 - protein, 9 aa, Dengue virus
HLTSRDGEP

SEQ ID NO: 57590 - protein, 9 aa, Dengue virus
LTSRDGEPR

SEQ ID NO: 57591 - protein, 9 aa, Dengue virus
TSRDGEPRM

SEQ ID NO: 57592 - protein, 9 aa, Dengue virus
SRDGEPRMI

SEQ ID NO: 57593 - protein, 9 aa, Dengue virus
RDGEPRMIV

SEQ ID NO: 57594 - protein, 9 aa, Dengue virus
DGEPRMIVG

SEQ ID NO: 57595 - protein, 9 aa, Dengue virus
GEPRMIVGK

SEQ ID NO: 57596 - protein, 9 aa, Dengue virus
EPRMIVGKN

SEQ ID NO: 57597 - protein, 9 aa, Dengue virus
PRMIVGKNE

SEQ ID NO: 57598 - protein, 9 aa, Dengue virus
RMIVGKNER

SEQ ID NO: 57599 - protein, 9 aa, Dengue virus
MIVGKNERG

SEQ ID NO: 57600 - protein, 9 aa, Dengue virus
IVGKNERGK

SEQ ID NO: 57601 - protein, 9 aa, Dengue virus
VGKNERGKS

SEQ ID NO: 57602 - protein, 9 aa, Dengue virus
GKNERGKSL

SEQ ID NO: 57603 - protein, 9 aa, Dengue virus
KNERGKSLL

SEQ ID NO: 57604 - protein, 9 aa, Dengue virus
NERGKSLLF

SEQ ID NO: 57605 - protein, 9 aa, Dengue virus
ERGKSLLFK

SEQ ID NO: 57606 - protein, 9 aa, Dengue virus
RGKSLLFKT

SEQ ID NO: 57607 - protein, 9 aa, Dengue virus
GKSLLFKTA

SEQ ID NO: 57608 - protein, 9 aa, Dengue virus
KSLLFKTAS

SEQ ID NO: 57609 - protein, 9 aa, Dengue virus
SLLFKTASG

SEQ ID NO: 57610 - protein, 9 aa, Dengue virus
LLFKTASGI

SEQ ID NO: 57611 - protein, 9 aa, Dengue virus
LFKTASGIN

SEQ ID NO: 57612 - protein, 9 aa, Dengue virus
FKTASGINM

SEQ ID NO: 57613 - protein, 9 aa, Dengue virus
KTASGINMC

SEQ ID NO: 57614 - protein, 9 aa, Dengue virus
TASGINMCT

SEQ ID NO: 57615 - protein, 9 aa, Dengue virus
ASGINMCTL

SEQ ID NO: 57616 - protein, 9 aa, Dengue virus
SGINMCTLI

SEQ ID NO: 57617 - protein, 9 aa, Dengue virus
GINMCTLIA

SEQ ID NO: 57618 - protein, 9 aa, Dengue virus
INMCTLIAM

SEQ ID NO: 57619 - protein, 9 aa, Dengue virus
NMCTLIAMD

SEQ ID NO: 57620 - protein, 9 aa, Dengue virus
MCTLIAMDL

SEQ ID NO: 57621 - protein, 9 aa, Dengue virus
CTLIAMDLG

SEQ ID NO: 57622 - protein, 9 aa, Dengue virus
TLIAMDLGE

SEQ ID NO: 57623 - protein, 9 aa, Dengue virus
LIAMDLGEM

SEQ ID NO: 57624 - protein, 9 aa, Dengue virus
IAMDLGEMC

SEQ ID NO: 57625 - protein, 9 aa, Dengue virus
AMDLGEMCD

SEQ ID NO: 57626 - protein, 9 aa, Dengue virus
MDLGEMCDD

SEQ ID NO: 57627 - protein, 9 aa, Dengue virus
DLGEMCDDT

SEQ ID NO: 57628 - protein, 9 aa, Dengue virus
LGEMCDDTV

SEQ ID NO: 57629 - protein, 9 aa, Dengue virus
GEMCDDTVT

SEQ ID NO: 57630 - protein, 9 aa, Dengue virus
EMCDDTVTY

SEQ ID NO: 57631 - protein, 9 aa, Dengue virus
MCDDTVTYK

SEQ ID NO: 57632 - protein, 9 aa, Dengue virus
CDDTVTYKC

SEQ ID NO: 57633 - protein, 9 aa, Dengue virus
DDTVTYKCP

SEQ ID NO: 57634 - protein, 9 aa, Dengue virus
DTVTYKCPH

SEQ ID NO: 57635 - protein, 9 aa, Dengue virus
TVTYKCPHI

SEQ ID NO: 57636 - protein, 9 aa, Dengue virus
TYKCPHITE

SEQ ID NO: 57637 - protein, 9 aa, Dengue virus
ITEVEPEDI

SEQ ID NO: 57638 - protein, 9 aa, Dengue virus
TEVEPEDID

SEQ ID NO: 57639 - protein, 9 aa, Dengue virus
EVEPEDIDC

SEQ ID NO: 57640 - protein, 9 aa, Dengue virus
VEPEDIDCW

SEQ ID NO: 57641 - protein, 9 aa, Dengue virus
EPEDIDCWC

SEQ ID NO: 57642 - protein, 9 aa, Dengue virus
PEDIDCWCN

SEQ ID NO: 57643 - protein, 9 aa, Dengue virus
EDIDCWCNL

SEQ ID NO: 57644 - protein, 9 aa, Dengue virus
DIDCWCNLT

SEQ ID NO: 57645 - protein, 9 aa, Dengue virus
IDCWCNLTS

SEQ ID NO: 57646 - protein, 9 aa, Dengue virus
DCWCNLTST

SEQ ID NO: 57647 - protein, 9 aa, Dengue virus
CWCNLTSTW

SEQ ID NO: 57648 - protein, 9 aa, Dengue virus
WCNLTSTWV

SEQ ID NO: 57649 - protein, 9 aa, Dengue virus
CNLTSTWVT

SEQ ID NO: 57650 - protein, 9 aa, Dengue virus
NLTSTWVTY

SEQ ID NO: 57651 - protein, 9 aa, Dengue virus
LTSTWVTYG

SEQ ID NO: 57652 - protein, 9 aa, Dengue virus
TSTWVTYGT

SEQ ID NO: 57653 - protein, 9 aa, Dengue virus
STWVTYGTC

SEQ ID NO: 57654 - protein, 9 aa, Dengue virus
TWVTYGTCN

SEQ ID NO: 57655 - protein, 9 aa, Dengue virus
WVTYGTCNQ

SEQ ID NO: 57656 - protein, 9 aa, Dengue virus
VTYGTCNQA

SEQ ID NO: 57657 - protein, 9 aa, Dengue virus
TYGTCNQAG

SEQ ID NO: 57658 - protein, 9 aa, Dengue virus
YGTCNQAGE

SEQ ID NO: 57659 - protein, 9 aa, Dengue virus
GTCNQAGEH

SEQ ID NO: 57660 - protein, 9 aa, Dengue virus
TCNQAGEHR

SEQ ID NO: 57661 - protein, 9 aa, Dengue virus
CNQAGEHRR

SEQ ID NO: 57662 - protein, 9 aa, Dengue virus
NQAGEHRRD

SEQ ID NO: 57663 - protein, 9 aa, Dengue virus
QAGEHRRDK

SEQ ID NO: 57664 - protein, 9 aa, Dengue virus
AGEHRRDKR

SEQ ID NO: 57665 - protein, 9 aa, Dengue virus
GEHRRDKRS

SEQ ID NO: 57666 - protein, 9 aa, Dengue virus
EHRRDKRSV

SEQ ID NO: 57667 - protein, 9 aa, Dengue virus
HRRDKRSVA

SEQ ID NO: 57668 - protein, 9 aa, Dengue virus
RRDKRSVAL

SEQ ID NO: 57669 - protein, 9 aa, Dengue virus
RDKRSVALA

SEQ ID NO: 57670 - protein, 9 aa, Dengue virus
DKRSVALAP

SEQ ID NO: 57671 - protein, 9 aa, Dengue virus
KRSVALAPH

SEQ ID NO: 57672 - protein, 9 aa, Dengue virus
RSVALAPHV

SEQ ID NO: 57673 - protein, 9 aa, Dengue virus
SVALAPHVG

SEQ ID NO: 57674 - protein, 9 aa, Dengue virus
VALAPHVGM

SEQ ID NO: 57675 - protein, 9 aa, Dengue virus
ALAPHVGMG

SEQ ID NO: 57676 - protein, 9 aa, Dengue virus
LAPHVGMGL

SEQ ID NO: 57677 - protein, 9 aa, Dengue virus
APHVGMGLD

SEQ ID NO: 57678 - protein, 9 aa, Dengue virus
PHVGMGLDT

SEQ ID NO: 57679 - protein, 9 aa, Dengue virus
HVGMGLDTR

SEQ ID NO: 57680 - protein, 9 aa, Dengue virus
VGMGLDTRT

SEQ ID NO: 57681 - protein, 9 aa, Dengue virus
GMGLDTRTQ

SEQ ID NO: 57682 - protein, 9 aa, Dengue virus
MGLDTRTQT

SEQ ID NO: 57683 - protein, 9 aa, Dengue virus
GLDTRTQTW

SEQ ID NO: 57684 - protein, 9 aa, Dengue virus
LDTRTQTWM

SEQ ID NO: 57685 - protein, 9 aa, Dengue virus
DTRTQTWMS

SEQ ID NO: 57686 - protein, 9 aa, Dengue virus
TRTQTWMSA

SEQ ID NO: 57687 - protein, 9 aa, Dengue virus
RTQTWMSAE

SEQ ID NO: 57688 - protein, 9 aa, Dengue virus
TQTWMSAEG

SEQ ID NO: 57689 - protein, 9 aa, Dengue virus
QTWMSAEGA

SEQ ID NO: 57690 - protein, 9 aa, Dengue virus
TWMSAEGAW

SEQ ID NO: 57691 - protein, 9 aa, Dengue virus
WMSAEGAWR

SEQ ID NO: 57692 - protein, 9 aa, Dengue virus
MSAEGAWRQ

SEQ ID NO: 57693 - protein, 9 aa, Dengue virus
SAEGAWRQV

SEQ ID NO: 57694 - protein, 9 aa, Dengue virus
AEGAWRQVE

SEQ ID NO: 57695 - protein, 9 aa, Dengue virus
EGAWRQVEK

SEQ ID NO: 57696 - protein, 9 aa, Dengue virus
GAWRQVEKV

SEQ ID NO: 57697 - protein, 9 aa, Dengue virus
AWRQVEKVE

SEQ ID NO: 57698 - protein, 9 aa, Dengue virus
WRQVEKVET

SEQ ID NO: 57699 - protein, 9 aa, Dengue virus
RQVEKVETW

SEQ ID NO: 57700 - protein, 9 aa, Dengue virus
QVEKVETWA

SEQ ID NO: 57701 - protein, 9 aa, Dengue virus
VEKVETWAL

SEQ ID NO: 57702 - protein, 9 aa, Dengue virus
EKVETWALR

SEQ ID NO: 57703 - protein, 9 aa, Dengue virus
KVETWALRH

SEQ ID NO: 57704 - protein, 9 aa, Dengue virus
VETWALRHP

SEQ ID NO: 57705 - protein, 9 aa, Dengue virus
ETWALRHPG

SEQ ID NO: 57706 - protein, 9 aa, Dengue virus
TWALRHPGF

SEQ ID NO: 57707 - protein, 9 aa, Dengue virus
WALRHPGFT

SEQ ID NO: 57708 - protein, 9 aa, Dengue virus
ALRHPGFTI

SEQ ID NO: 57709 - protein, 9 aa, Dengue virus
LRHPGFTIL

SEQ ID NO: 57710 - protein, 9 aa, Dengue virus
RHPGFTILA

SEQ ID NO: 57711 - protein, 9 aa, Dengue virus
HPGFTILAL

SEQ ID NO: 57712 - protein, 9 aa, Dengue virus
PGFTILALF

SEQ ID NO: 57713 - protein, 9 aa, Dengue virus
GFTILALFL

SEQ ID NO: 57714 - protein, 9 aa, Dengue virus
FTILALFLA

SEQ ID NO: 57715 - protein, 9 aa, Dengue virus
TILALFLAH

SEQ ID NO: 57716 - protein, 9 aa, Dengue virus
ILALFLAHY

SEQ ID NO: 57717 - protein, 9 aa, Dengue virus
LALFLAHYI

SEQ ID NO: 57718 - protein, 9 aa, Dengue virus
ALFLAHYIG

SEQ ID NO: 57719 - protein, 9 aa, Dengue virus
LFLAHYIGT

SEQ ID NO: 57720 - protein, 9 aa, Dengue virus
FLAHYIGTS

SEQ ID NO: 57721 - protein, 9 aa, Dengue virus
LAHYIGTSL

SEQ ID NO: 57722 - protein, 9 aa, Dengue virus
AHYIGTSLT

SEQ ID NO: 57723 - protein, 9 aa, Dengue virus
HYIGTSLTQ

SEQ ID NO: 57724 - protein, 9 aa, Dengue virus
YIGTSLTQK

SEQ ID NO: 57725 - protein, 9 aa, Dengue virus
IGTSLTQKV

SEQ ID NO: 57726 - protein, 9 aa, Dengue virus
GTSLTQKVV

SEQ ID NO: 57727 - protein, 9 aa, Dengue virus
TSLTQKVVI

SEQ ID NO: 57728 - protein, 9 aa, Dengue virus
SLTQKVVIF

SEQ ID NO: 57729 - protein, 9 aa, Dengue virus
LTQKVVIFI

SEQ ID NO: 57730 - protein, 9 aa, Dengue virus
TQKVVIFIL

SEQ ID NO: 57731 - protein, 9 aa, Dengue virus
QKVVIFILL

SEQ ID NO: 57732 - protein, 9 aa, Dengue virus
KVVIFILLM

SEQ ID NO: 57733 - protein, 9 aa, Dengue virus
VVIFILLML

SEQ ID NO: 57734 - protein, 9 aa, Dengue virus
VIFILLMLV

SEQ ID NO: 57735 - protein, 9 aa, Dengue virus
IFILLMLVT

SEQ ID NO: 57736 - protein, 9 aa, Dengue virus
FILLMLVTP

SEQ ID NO: 57737 - protein, 9 aa, Dengue virus
ILLMLVTPS

SEQ ID NO: 57738 - protein, 9 aa, Dengue virus
LLMLVTPSM

SEQ ID NO: 57739 - protein, 9 aa, Dengue virus
LMLVTPSMT

SEQ ID NO: 57740 - protein, 9 aa, Dengue virus
MLVTPSMTM

SEQ ID NO: 57741 - protein, 9 aa, Dengue virus
LVTPSMTMR

SEQ ID NO: 57742 - protein, 9 aa, Dengue virus
VTPSMTMRC

SEQ ID NO: 57743 - protein, 9 aa, Dengue virus
TPSMTMRCV

SEQ ID NO: 57744 - protein, 9 aa, Dengue virus
PSMTMRCVG

SEQ ID NO: 57745 - protein, 9 aa, Dengue virus
SMTMRCVGV

SEQ ID NO: 57746 - protein, 9 aa, Dengue virus
MTMRCVGVG

SEQ ID NO: 57747 - protein, 9 aa, Dengue virus
TMRCVGVGN

SEQ ID NO: 57748 - protein, 9 aa, Dengue virus
MRCVGVGNR

SEQ ID NO: 57749 - protein, 9 aa, Dengue virus
RCVGVGNRD

SEQ ID NO: 57750 - protein, 9 aa, Dengue virus
CVGVGNRDF

SEQ ID NO: 57751 - protein, 9 aa, Dengue virus
VGVGNRDFV

SEQ ID NO: 57752 - protein, 9 aa, Dengue virus
GVGNRDFVE

SEQ ID NO: 57753 - protein, 9 aa, Dengue virus
VGNRDFVEG

SEQ ID NO: 57754 - protein, 9 aa, Dengue virus
GNRDFVEGL

SEQ ID NO: 57755 - protein, 9 aa, Dengue virus
NRDFVEGLS

SEQ ID NO: 57756 - protein, 9 aa, Dengue virus
RDFVEGLSG

SEQ ID NO: 57757 - protein, 9 aa, Dengue virus
DFVEGLSGA

SEQ ID NO: 57758 - protein, 9 aa, Dengue virus
FVEGLSGAT

SEQ ID NO: 57759 - protein, 9 aa, Dengue virus
VEGLSGATW

SEQ ID NO: 57760 - protein, 9 aa, Dengue virus
EGLSGATWV

SEQ ID NO: 57761 - protein, 9 aa, Dengue virus
GLSGATWVD

SEQ ID NO: 57762 - protein, 9 aa, Dengue virus
LSGATWVDV

SEQ ID NO: 57763 - protein, 9 aa, Dengue virus
SGATWVDVV

SEQ ID NO: 57764 - protein, 9 aa, Dengue virus
GATWVDVVL

SEQ ID NO: 57765 - protein, 9 aa, Dengue virus
ATWVDVVLE

SEQ ID NO: 57766 - protein, 9 aa, Dengue virus
TWVDVVLEH

SEQ ID NO: 57767 - protein, 9 aa, Dengue virus
WVDVVLEHG

SEQ ID NO: 57768 - protein, 9 aa, Dengue virus
VDVVLEHGG

SEQ ID NO: 57769 - protein, 9 aa, Dengue virus
DVVLEHGGC

SEQ ID NO: 57770 - protein, 9 aa, Dengue virus
VVLEHGGCV

SEQ ID NO: 57771 - protein, 9 aa, Dengue virus
VLEHGGCVT

SEQ ID NO: 57772 - protein, 9 aa, Dengue virus
LEHGGCVTT

SEQ ID NO: 57773 - protein, 9 aa, Dengue virus
EHGGCVTTM

SEQ ID NO: 57774 - protein, 9 aa, Dengue virus
HGGCVTTMA

SEQ ID NO: 57775 - protein, 9 aa, Dengue virus
GGCVTTMAK

SEQ ID NO: 57776 - protein, 9 aa, Dengue virus
GCVTTMAKN

SEQ ID NO: 57777 - protein, 9 aa, Dengue virus
CVTTMAKNK

SEQ ID NO: 57778 - protein, 9 aa, Dengue virus
VTTMAKNKP

SEQ ID NO: 57779 - protein, 9 aa, Dengue virus
TTMAKNKPT

SEQ ID NO: 57780 - protein, 9 aa, Dengue virus
TMAKNKPTL

SEQ ID NO: 57781 - protein, 9 aa, Dengue virus
MAKNKPTLD

SEQ ID NO: 57782 - protein, 9 aa, Dengue virus
AKNKPTLDI

SEQ ID NO: 57783 - protein, 9 aa, Dengue virus
KNKPTLDIE

SEQ ID NO: 57784 - protein, 9 aa, Dengue virus
NKPTLDIEL

SEQ ID NO: 57785 - protein, 9 aa, Dengue virus
KPTLDIELQ

SEQ ID NO: 57786 - protein, 9 aa, Dengue virus
PTLDIELQK

SEQ ID NO: 57787 - protein, 9 aa, Dengue virus
TLDIELQKT

SEQ ID NO: 57788 - protein, 9 aa, Dengue virus
LDIELQKTE

SEQ ID NO: 57789 - protein, 9 aa, Dengue virus
DIELQKTEA

SEQ ID NO: 57790 - protein, 9 aa, Dengue virus
IELQKTEAT

SEQ ID NO: 57791 - protein, 9 aa, Dengue virus
ELQKTEATQ

SEQ ID NO: 57792 - protein, 9 aa, Dengue virus
LQKTEATQL

SEQ ID NO: 57793 - protein, 9 aa, Dengue virus
QKTEATQLA

SEQ ID NO: 57794 - protein, 9 aa, Dengue virus
KTEATQLAT

SEQ ID NO: 57795 - protein, 9 aa, Dengue virus
TEATQLATL

SEQ ID NO: 57796 - protein, 9 aa, Dengue virus
EATQLATLR

SEQ ID NO: 57797 - protein, 9 aa, Dengue virus
ATQLATLRK

SEQ ID NO: 57798 - protein, 9 aa, Dengue virus
TQLATLRKL

SEQ ID NO: 57799 - protein, 9 aa, Dengue virus
QLATLRKLC

SEQ ID NO: 57800 - protein, 9 aa, Dengue virus
LATLRKLCI

SEQ ID NO: 57801 - protein, 9 aa, Dengue virus
ATLRKLCIE

SEQ ID NO: 57802 - protein, 9 aa, Dengue virus
TLRKLCIEG

SEQ ID NO: 57803 - protein, 9 aa, Dengue virus
LRKLCIEGK

SEQ ID NO: 57804 - protein, 9 aa, Dengue virus
RKLCIEGKI

SEQ ID NO: 57805 - protein, 9 aa, Dengue virus
KLCIEGKIT

SEQ ID NO: 57806 - protein, 9 aa, Dengue virus
LCIEGKITN

SEQ ID NO: 57807 - protein, 9 aa, Dengue virus
CIEGKITNI

SEQ ID NO: 57808 - protein, 9 aa, Dengue virus
IEGKITNIT

SEQ ID NO: 57809 - protein, 9 aa, Dengue virus
EGKITNITT

SEQ ID NO: 57810 - protein, 9 aa, Dengue virus
GKITNITTD

SEQ ID NO: 57811 - protein, 9 aa, Dengue virus
KITNITTDS

SEQ ID NO: 57812 - protein, 9 aa, Dengue virus
ITNITTDSR

SEQ ID NO: 57813 - protein, 9 aa, Dengue virus
TNITTDSRC

SEQ ID NO: 57814 - protein, 9 aa, Dengue virus
NITTDSRCP

SEQ ID NO: 57815 - protein, 9 aa, Dengue virus
ITTDSRCPT

SEQ ID NO: 57816 - protein, 9 aa, Dengue virus
TTDSRCPTQ

SEQ ID NO: 57817 - protein, 9 aa, Dengue virus
TDSRCPTQG

SEQ ID NO: 57818 - protein, 9 aa, Dengue virus
DSRCPTQGE

SEQ ID NO: 57819 - protein, 9 aa, Dengue virus
SRCPTQGEA

SEQ ID NO: 57820 - protein, 9 aa, Dengue virus
RCPTQGEAV

SEQ ID NO: 57821 - protein, 9 aa, Dengue virus
CPTQGEAVL

SEQ ID NO: 57822 - protein, 9 aa, Dengue virus
PTQGEAVLP

SEQ ID NO: 57823 - protein, 9 aa, Dengue virus
TQGEAVLPE

SEQ ID NO: 57824 - protein, 9 aa, Dengue virus
QGEAVLPEE

SEQ ID NO: 57825 - protein, 9 aa, Dengue virus
GEAVLPEEQ

SEQ ID NO: 57826 - protein, 9 aa, Dengue virus
EAVLPEEQD

SEQ ID NO: 57827 - protein, 9 aa, Dengue virus
AVLPEEQDQ

SEQ ID NO: 57828 - protein, 9 aa, Dengue virus
VLPEEQDQN

SEQ ID NO: 57829 - protein, 9 aa, Dengue virus
LPEEQDQNY

SEQ ID NO: 57830 - protein, 9 aa, Dengue virus
PEEQDQNYV

SEQ ID NO: 57831 - protein, 9 aa, Dengue virus
EEQDQNYVC

SEQ ID NO: 57832 - protein, 9 aa, Dengue virus
EQDQNYVCK

SEQ ID NO: 57833 - protein, 9 aa, Dengue virus
QDQNYVCKH

SEQ ID NO: 57834 - protein, 9 aa, Dengue virus
DQNYVCKHT

SEQ ID NO: 57835 - protein, 9 aa, Dengue virus
QNYVCKHTY

SEQ ID NO: 57836 - protein, 9 aa, Dengue virus
NYVCKHTYV

SEQ ID NO: 57837 - protein, 9 aa, Dengue virus
YVCKHTYVD

SEQ ID NO: 57838 - protein, 9 aa, Dengue virus
VCKHTYVDR

SEQ ID NO: 57839 - protein, 9 aa, Dengue virus
CKHTYVDRG

SEQ ID NO: 57840 - protein, 9 aa, Dengue virus
KHTYVDRGW

SEQ ID NO: 57841 - protein, 9 aa, Dengue virus
HTYVDRGWG

SEQ ID NO: 57842 - protein, 9 aa, Dengue virus
TYVDRGWGN

SEQ ID NO: 57843 - protein, 9 aa, Dengue virus
YVDRGWGNG

SEQ ID NO: 57844 - protein, 9 aa, Dengue virus
VDRGWGNGC

SEQ ID NO: 57845 - protein, 9 aa, Dengue virus
DRGWGNGCG

SEQ ID NO: 57846 - protein, 9 aa, Dengue virus
RGWGNGCGL

SEQ ID NO: 57847 - protein, 9 aa, Dengue virus
GWGNGCGLF

SEQ ID NO: 57848 - protein, 9 aa, Dengue virus
WGNGCGLFG

SEQ ID NO: 57849 - protein, 9 aa, Dengue virus
GNGCGLFGK

SEQ ID NO: 57850 - protein, 9 aa, Dengue virus
NGCGLFGKG

SEQ ID NO: 57851 - protein, 9 aa, Dengue virus
GCGLFGKGS

SEQ ID NO: 57852 - protein, 9 aa, Dengue virus
CGLFGKGSL

SEQ ID NO: 57853 - protein, 9 aa, Dengue virus
GLFGKGSLV

SEQ ID NO: 57854 - protein, 9 aa, Dengue virus
LFGKGSLVT

SEQ ID NO: 57855 - protein, 9 aa, Dengue virus
FGKGSLVTC

SEQ ID NO: 57856 - protein, 9 aa, Dengue virus
GKGSLVTCA

SEQ ID NO: 57857 - protein, 9 aa, Dengue virus
KGSLVTCAK

SEQ ID NO: 57858 - protein, 9 aa, Dengue virus
GSLVTCAKF

SEQ ID NO: 57859 - protein, 9 aa, Dengue virus
SLVTCAKFQ

SEQ ID NO: 57860 - protein, 9 aa, Dengue virus
LVTCAKFQC

SEQ ID NO: 57861 - protein, 9 aa, Dengue virus
VTCAKFQCL

SEQ ID NO: 57862 - protein, 9 aa, Dengue virus
TCAKFQCLE

SEQ ID NO: 57863 - protein, 9 aa, Dengue virus
CAKFQCLEP

SEQ ID NO: 57864 - protein, 9 aa, Dengue virus
AKFQCLEPI

SEQ ID NO: 57865 - protein, 9 aa, Dengue virus
KFQCLEPIE

SEQ ID NO: 57866 - protein, 9 aa, Dengue virus
FQCLEPIEG

SEQ ID NO: 57867 - protein, 9 aa, Dengue virus
QCLEPIEGK

SEQ ID NO: 57868 - protein, 9 aa, Dengue virus
IEGKVVQYE

SEQ ID NO: 57869 - protein, 9 aa, Dengue virus
EGKVVQYEN

SEQ ID NO: 57870 - protein, 9 aa, Dengue virus
GKVVQYENL

SEQ ID NO: 57871 - protein, 9 aa, Dengue virus
KVVQYENLK

SEQ ID NO: 57872 - protein, 9 aa, Dengue virus
VVQYENLKY

SEQ ID NO: 57873 - protein, 9 aa, Dengue virus
VQYENLKYT

SEQ ID NO: 57874 - protein, 9 aa, Dengue virus
QYENLKYTV

SEQ ID NO: 57875 - protein, 9 aa, Dengue virus
YENLKYTVI

SEQ ID NO: 57876 - protein, 9 aa, Dengue virus
ENLKYTVII

SEQ ID NO: 57877 - protein, 9 aa, Dengue virus
NLKYTVIIT

SEQ ID NO: 57878 - protein, 9 aa, Dengue virus
LKYTVIITV

SEQ ID NO: 57879 - protein, 9 aa, Dengue virus
KYTVIITVH

SEQ ID NO: 57880 - protein, 9 aa, Dengue virus
YTVIITVHT

SEQ ID NO: 57881 - protein, 9 aa, Dengue virus
TVIITVHTG

SEQ ID NO: 57882 - protein, 9 aa, Dengue virus
VIITVHTGD

SEQ ID NO: 57883 - protein, 9 aa, Dengue virus
IITVHTGDQ

SEQ ID NO: 57884 - protein, 9 aa, Dengue virus
ITVHTGDQH

SEQ ID NO: 57885 - protein, 9 aa, Dengue virus
TVHTGDQHQ

SEQ ID NO: 57886 - protein, 9 aa, Dengue virus
VHTGDQHQV

SEQ ID NO: 57887 - protein, 9 aa, Dengue virus
HTGDQHQVG

SEQ ID NO: 57888 - protein, 9 aa, Dengue virus
TGDQHQVGN

SEQ ID NO: 57889 - protein, 9 aa, Dengue virus
GDQHQVGNE

SEQ ID NO: 57890 - protein, 9 aa, Dengue virus
DQHQVGNET

SEQ ID NO: 57891 - protein, 9 aa, Dengue virus
QHQVGNETQ

SEQ ID NO: 57892 - protein, 9 aa, Dengue virus
HQVGNETQG

SEQ ID NO: 57893 - protein, 9 aa, Dengue virus
QVGNETQGV

SEQ ID NO: 57894 - protein, 9 aa, Dengue virus
VGNETQGVT

SEQ ID NO: 57895 - protein, 9 aa, Dengue virus
GNETQGVTA

SEQ ID NO: 57896 - protein, 9 aa, Dengue virus
NETQGVTAE

SEQ ID NO: 57897 - protein, 9 aa, Dengue virus
ETQGVTAEI

SEQ ID NO: 57898 - protein, 9 aa, Dengue virus
TQGVTAEIT

SEQ ID NO: 57899 - protein, 9 aa, Dengue virus
QGVTAEITP

SEQ ID NO: 57900 - protein, 9 aa, Dengue virus
GVTAEITPQ

SEQ ID NO: 57901 - protein, 9 aa, Dengue virus
VTAEITPQA

SEQ ID NO: 57902 - protein, 9 aa, Dengue virus
TAEITPQAS

SEQ ID NO: 57903 - protein, 9 aa, Dengue virus
AEITPQAST

SEQ ID NO: 57904 - protein, 9 aa, Dengue virus
EITPQASTT

SEQ ID NO: 57905 - protein, 9 aa, Dengue virus
ITPQASTTE

SEQ ID NO: 57906 - protein, 9 aa, Dengue virus
TPQASTTEA

SEQ ID NO: 57907 - protein, 9 aa, Dengue virus
QASTTEAIL

SEQ ID NO: 57908 - protein, 9 aa, Dengue virus
TEAILPEYG

SEQ ID NO: 57909 - protein, 9 aa, Dengue virus
EAILPEYGT

SEQ ID NO: 57910 - protein, 9 aa, Dengue virus
AILPEYGTL

SEQ ID NO: 57911 - protein, 9 aa, Dengue virus
ILPEYGTLG

SEQ ID NO: 57912 - protein, 9 aa, Dengue virus
LPEYGTLGL

SEQ ID NO: 57913 - protein, 9 aa, Dengue virus
PEYGTLGLE

SEQ ID NO: 57914 - protein, 9 aa, Dengue virus
EYGTLGLEC

SEQ ID NO: 57915 - protein, 9 aa, Dengue virus
YGTLGLECS

SEQ ID NO: 57916 - protein, 9 aa, Dengue virus
GTLGLECSP

SEQ ID NO: 57917 - protein, 9 aa, Dengue virus
TLGLECSPR

SEQ ID NO: 57918 - protein, 9 aa, Dengue virus
LGLECSPRT

SEQ ID NO: 57919 - protein, 9 aa, Dengue virus
GLECSPRTG

SEQ ID NO: 57920 - protein, 9 aa, Dengue virus
LECSPRTGL

SEQ ID NO: 57921 - protein, 9 aa, Dengue virus
ECSPRTGLD

SEQ ID NO: 57922 - protein, 9 aa, Dengue virus
CSPRTGLDF

SEQ ID NO: 57923 - protein, 9 aa, Dengue virus
SPRTGLDFN

SEQ ID NO: 57924 - protein, 9 aa, Dengue virus
PRTGLDFNE

SEQ ID NO: 57925 - protein, 9 aa, Dengue virus
RTGLDFNEM

SEQ ID NO: 57926 - protein, 9 aa, Dengue virus
TGLDFNEMI

SEQ ID NO: 57927 - protein, 9 aa, Dengue virus
GLDFNEMIL

SEQ ID NO: 57928 - protein, 9 aa, Dengue virus
LDFNEMILL

SEQ ID NO: 57929 - protein, 9 aa, Dengue virus
DFNEMILLT

SEQ ID NO: 57930 - protein, 9 aa, Dengue virus
FNEMILLTM

SEQ ID NO: 57931 - protein, 9 aa, Dengue virus
NEMILLTMK

SEQ ID NO: 57932 - protein, 9 aa, Dengue virus
EMILLTMKN

SEQ ID NO: 57933 - protein, 9 aa, Dengue virus
MILLTMKNK

SEQ ID NO: 57934 - protein, 9 aa, Dengue virus
ILLTMKNKA

SEQ ID NO: 57935 - protein, 9 aa, Dengue virus
LLTMKNKAW

SEQ ID NO: 57936 - protein, 9 aa, Dengue virus
LTMKNKAWM

SEQ ID NO: 57937 - protein, 9 aa, Dengue virus
TMKNKAWMV

SEQ ID NO: 57938 - protein, 9 aa, Dengue virus
MKNKAWMVH

SEQ ID NO: 57939 - protein, 9 aa, Dengue virus
KNKAWMVHR

SEQ ID NO: 57940 - protein, 9 aa, Dengue virus
NKAWMVHRQ

SEQ ID NO: 57941 - protein, 9 aa, Dengue virus
KAWMVHRQW

SEQ ID NO: 57942 - protein, 9 aa, Dengue virus
AWMVHRQWF

SEQ ID NO: 57943 - protein, 9 aa, Dengue virus
WMVHRQWFF

SEQ ID NO: 57944 - protein, 9 aa, Dengue virus
MVHRQWFFD

SEQ ID NO: 57945 - protein, 9 aa, Dengue virus
VHRQWFFDL

SEQ ID NO: 57946 - protein, 9 aa, Dengue virus
HRQWFFDLP

SEQ ID NO: 57947 - protein, 9 aa, Dengue virus
RQWFFDLPL

SEQ ID NO: 57948 - protein, 9 aa, Dengue virus
QWFFDLPLP

SEQ ID NO: 57949 - protein, 9 aa, Dengue virus
WFFDLPLPW

SEQ ID NO: 57950 - protein, 9 aa, Dengue virus
FFDLPLPWT

SEQ ID NO: 57951 - protein, 9 aa, Dengue virus
FDLPLPWTS

SEQ ID NO: 57952 - protein, 9 aa, Dengue virus
DLPLPWTSG

SEQ ID NO: 57953 - protein, 9 aa, Dengue virus
LPLPWTSGA

SEQ ID NO: 57954 - protein, 9 aa, Dengue virus
PLPWTSGAT

SEQ ID NO: 57955 - protein, 9 aa, Dengue virus
LPWTSGATT

SEQ ID NO: 57956 - protein, 9 aa, Dengue virus
TETPTWNRK

SEQ ID NO: 57957 - protein, 9 aa, Dengue virus
ETPTWNRKE

SEQ ID NO: 57958 - protein, 9 aa, Dengue virus
TPTWNRKEL

SEQ ID NO: 57959 - protein, 9 aa, Dengue virus
PTWNRKELL

SEQ ID NO: 57960 - protein, 9 aa, Dengue virus
TWNRKELLV

SEQ ID NO: 57961 - protein, 9 aa, Dengue virus
WNRKELLVT

SEQ ID NO: 57962 - protein, 9 aa, Dengue virus
NRKELLVTF

SEQ ID NO: 57963 - protein, 9 aa, Dengue virus
RKELLVTFK

SEQ ID NO: 57964 - protein, 9 aa, Dengue virus
KELLVTFKN

SEQ ID NO: 57965 - protein, 9 aa, Dengue virus
ELLVTFKNA

SEQ ID NO: 57966 - protein, 9 aa, Dengue virus
LLVTFKNAH

SEQ ID NO: 57967 - protein, 9 aa, Dengue virus
LVTFKNAHA

SEQ ID NO: 57968 - protein, 9 aa, Dengue virus
VTFKNAHAK

SEQ ID NO: 57969 - protein, 9 aa, Dengue virus
TFKNAHAKK

SEQ ID NO: 57970 - protein, 9 aa, Dengue virus
FKNAHAKKQ

SEQ ID NO: 57971 - protein, 9 aa, Dengue virus
KNAHAKKQE

SEQ ID NO: 57972 - protein, 9 aa, Dengue virus
NAHAKKQEV

SEQ ID NO: 57973 - protein, 9 aa, Dengue virus
AHAKKQEVV

SEQ ID NO: 57974 - protein, 9 aa, Dengue virus
HAKKQEVVV

SEQ ID NO: 57975 - protein, 9 aa, Dengue virus
AKKQEVVVL

SEQ ID NO: 57976 - protein, 9 aa, Dengue virus
KKQEVVVLG

SEQ ID NO: 57977 - protein, 9 aa, Dengue virus
KQEVVVLGS

SEQ ID NO: 57978 - protein, 9 aa, Dengue virus
QEVVVLGSQ

SEQ ID NO: 57979 - protein, 9 aa, Dengue virus
EVVVLGSQE

SEQ ID NO: 57980 - protein, 9 aa, Dengue virus
VVVLGSQEG

SEQ ID NO: 57981 - protein, 9 aa, Dengue virus
VVLGSQEGA

SEQ ID NO: 57982 - protein, 9 aa, Dengue virus
VLGSQEGAM

SEQ ID NO: 57983 - protein, 9 aa, Dengue virus
LGSQEGAMH

SEQ ID NO: 57984 - protein, 9 aa, Dengue virus
GSQEGAMHT

SEQ ID NO: 57985 - protein, 9 aa, Dengue virus
SQEGAMHTA

SEQ ID NO: 57986 - protein, 9 aa, Dengue virus
QEGAMHTAL

SEQ ID NO: 57987 - protein, 9 aa, Dengue virus
EGAMHTALT

SEQ ID NO: 57988 - protein, 9 aa, Dengue virus
GAMHTALTG

SEQ ID NO: 57989 - protein, 9 aa, Dengue virus
AMHTALTGA

SEQ ID NO: 57990 - protein, 9 aa, Dengue virus
MHTALTGAT

SEQ ID NO: 57991 - protein, 9 aa, Dengue virus
HTALTGATE

SEQ ID NO: 57992 - protein, 9 aa, Dengue virus
TALTGATEI

SEQ ID NO: 57993 - protein, 9 aa, Dengue virus
ALTGATEIQ

SEQ ID NO: 57994 - protein, 9 aa, Dengue virus
LTGATEIQN

SEQ ID NO: 57995 - protein, 9 aa, Dengue virus
TGATEIQNS

SEQ ID NO: 57996 - protein, 9 aa, Dengue virus
GATEIQNSG

SEQ ID NO: 57997 - protein, 9 aa, Dengue virus
ATEIQNSGG

SEQ ID NO: 57998 - protein, 9 aa, Dengue virus
TEIQNSGGT

SEQ ID NO: 57999 - protein, 9 aa, Dengue virus
EIQNSGGTS

SEQ ID NO: 58000 - protein, 9 aa, Dengue virus
IQNSGGTSI

SEQ ID NO: 58001 - protein, 9 aa, Dengue virus
QNSGGTSIF

SEQ ID NO: 58002 - protein, 9 aa, Dengue virus
NSGGTSIFA

SEQ ID NO: 58003 - protein, 9 aa, Dengue virus
SGGTSIFAG

SEQ ID NO: 58004 - protein, 9 aa, Dengue virus
GGTSIFAGH

SEQ ID NO: 58005 - protein, 9 aa, Dengue virus
GTSIFAGHL

SEQ ID NO: 58006 - protein, 9 aa, Dengue virus
TSIFAGHLK

SEQ ID NO: 58007 - protein, 9 aa, Dengue virus
SIFAGHLKC

SEQ ID NO: 58008 - protein, 9 aa, Dengue virus
IFAGHLKCR

SEQ ID NO: 58009 - protein, 9 aa, Dengue virus
FAGHLKCRL

SEQ ID NO: 58010 - protein, 9 aa, Dengue virus
AGHLKCRLK

SEQ ID NO: 58011 - protein, 9 aa, Dengue virus
GHLKCRLKM

SEQ ID NO: 58012 - protein, 9 aa, Dengue virus
HLKCRLKMD

SEQ ID NO: 58013 - protein, 9 aa, Dengue virus
LKCRLKMDK

SEQ ID NO: 58014 - protein, 9 aa, Dengue virus
KCRLKMDKL

SEQ ID NO: 58015 - protein, 9 aa, Dengue virus
CRLKMDKLE

SEQ ID NO: 58016 - protein, 9 aa, Dengue virus
RLKMDKLEL

SEQ ID NO: 58017 - protein, 9 aa, Dengue virus
LKMDKLELK

SEQ ID NO: 58018 - protein, 9 aa, Dengue virus
KMDKLELKG

SEQ ID NO: 58019 - protein, 9 aa, Dengue virus
MDKLELKGM

SEQ ID NO: 58020 - protein, 9 aa, Dengue virus
DKLELKGMS

SEQ ID NO: 58021 - protein, 9 aa, Dengue virus
KLELKGMSY

SEQ ID NO: 58022 - protein, 9 aa, Dengue virus
LELKGMSYA

SEQ ID NO: 58023 - protein, 9 aa, Dengue virus
ELKGMSYAM

SEQ ID NO: 58024 - protein, 9 aa, Dengue virus
LKGMSYAMC

SEQ ID NO: 58025 - protein, 9 aa, Dengue virus
KGMSYAMCT

SEQ ID NO: 58026 - protein, 9 aa, Dengue virus
GMSYAMCTN

SEQ ID NO: 58027 - protein, 9 aa, Dengue virus
MSYAMCTNT

SEQ ID NO: 58028 - protein, 9 aa, Dengue virus
SYAMCTNTF

SEQ ID NO: 58029 - protein, 9 aa, Dengue virus
YAMCTNTFV

SEQ ID NO: 58030 - protein, 9 aa, Dengue virus
AMCTNTFVL

SEQ ID NO: 58031 - protein, 9 aa, Dengue virus
NTFVLKKEV

SEQ ID NO: 58032 - protein, 9 aa, Dengue virus
TFVLKKEVS

SEQ ID NO: 58033 - protein, 9 aa, Dengue virus
FVLKKEVSE

SEQ ID NO: 58034 - protein, 9 aa, Dengue virus
VLKKEVSET

SEQ ID NO: 58035 - protein, 9 aa, Dengue virus
LKKEVSETQ

SEQ ID NO: 58036 - protein, 9 aa, Dengue virus
KKEVSETQH

SEQ ID NO: 58037 - protein, 9 aa, Dengue virus
KEVSETQHG

SEQ ID NO: 58038 - protein, 9 aa, Dengue virus
EVSETQHGT

SEQ ID NO: 58039 - protein, 9 aa, Dengue virus
VSETQHGTI

SEQ ID NO: 58040 - protein, 9 aa, Dengue virus
SETQHGTIL

SEQ ID NO: 58041 - protein, 9 aa, Dengue virus
ETQHGTILI

SEQ ID NO: 58042 - protein, 9 aa, Dengue virus
TQHGTILIK

SEQ ID NO: 58043 - protein, 9 aa, Dengue virus
QHGTILIKV

SEQ ID NO: 58044 - protein, 9 aa, Dengue virus
HGTILIKVE

SEQ ID NO: 58045 - protein, 9 aa, Dengue virus
GTILIKVEY

SEQ ID NO: 58046 - protein, 9 aa, Dengue virus
TILIKVEYK

SEQ ID NO: 58047 - protein, 9 aa, Dengue virus
ILIKVEYKG

SEQ ID NO: 58048 - protein, 9 aa, Dengue virus
LIKVEYKGE

SEQ ID NO: 58049 - protein, 9 aa, Dengue virus
IKVEYKGED

SEQ ID NO: 58050 - protein, 9 aa, Dengue virus
KVEYKGEDA

SEQ ID NO: 58051 - protein, 9 aa, Dengue virus
VEYKGEDAP

SEQ ID NO: 58052 - protein, 9 aa, Dengue virus
EYKGEDAPC

SEQ ID NO: 58053 - protein, 9 aa, Dengue virus
YKGEDAPCK

SEQ ID NO: 58054 - protein, 9 aa, Dengue virus
KGEDAPCKI

SEQ ID NO: 58055 - protein, 9 aa, Dengue virus
GEDAPCKIP

SEQ ID NO: 58056 - protein, 9 aa, Dengue virus
EDAPCKIPF

SEQ ID NO: 58057 - protein, 9 aa, Dengue virus
DAPCKIPFS

SEQ ID NO: 58058 - protein, 9 aa, Dengue virus
APCKIPFST

SEQ ID NO: 58059 - protein, 9 aa, Dengue virus
PCKIPFSTE

SEQ ID NO: 58060 - protein, 9 aa, Dengue virus
CKIPFSTED

SEQ ID NO: 58061 - protein, 9 aa, Dengue virus
KIPFSTEDG

SEQ ID NO: 58062 - protein, 9 aa, Dengue virus
IPFSTEDGQ

SEQ ID NO: 58063 - protein, 9 aa, Dengue virus
PFSTEDGQG

SEQ ID NO: 58064 - protein, 9 aa, Dengue virus
FSTEDGQGK

SEQ ID NO: 58065 - protein, 9 aa, Dengue virus
STEDGQGKA

SEQ ID NO: 58066 - protein, 9 aa, Dengue virus
TEDGQGKAH

SEQ ID NO: 58067 - protein, 9 aa, Dengue virus
EDGQGKAHN

SEQ ID NO: 58068 - protein, 9 aa, Dengue virus
DGQGKAHNG

SEQ ID NO: 58069 - protein, 9 aa, Dengue virus
GQGKAHNGR

SEQ ID NO: 58070 - protein, 9 aa, Dengue virus
QGKAHNGRL

SEQ ID NO: 58071 - protein, 9 aa, Dengue virus
GKAHNGRLI

SEQ ID NO: 58072 - protein, 9 aa, Dengue virus
KAHNGRLIT

SEQ ID NO: 58073 - protein, 9 aa, Dengue virus
AHNGRLITA

SEQ ID NO: 58074 - protein, 9 aa, Dengue virus
HNGRLITAN

SEQ ID NO: 58075 - protein, 9 aa, Dengue virus
NGRLITANP

SEQ ID NO: 58076 - protein, 9 aa, Dengue virus
GRLITANPV

SEQ ID NO: 58077 - protein, 9 aa, Dengue virus
RLITANPVV

SEQ ID NO: 58078 - protein, 9 aa, Dengue virus
LITANPVVT

SEQ ID NO: 58079 - protein, 9 aa, Dengue virus
ITANPVVTK

SEQ ID NO: 58080 - protein, 9 aa, Dengue virus
TANPVVTKK

SEQ ID NO: 58081 - protein, 9 aa, Dengue virus
ANPVVTKKE

SEQ ID NO: 58082 - protein, 9 aa, Dengue virus
NPVVTKKEE

SEQ ID NO: 58083 - protein, 9 aa, Dengue virus
PVVTKKEEP

SEQ ID NO: 58084 - protein, 9 aa, Dengue virus
VVTKKEEPV

SEQ ID NO: 58085 - protein, 9 aa, Dengue virus
VTKKEEPVN

SEQ ID NO: 58086 - protein, 9 aa, Dengue virus
TKKEEPVNI

SEQ ID NO: 58087 - protein, 9 aa, Dengue virus
KKEEPVNIE

SEQ ID NO: 58088 - protein, 9 aa, Dengue virus
KEEPVNIEA

SEQ ID NO: 58089 - protein, 9 aa, Dengue virus
EEPVNIEAE

SEQ ID NO: 58090 - protein, 9 aa, Dengue virus
EPVNIEAEP

SEQ ID NO: 58091 - protein, 9 aa, Dengue virus
PVNIEAEPP

SEQ ID NO: 58092 - protein, 9 aa, Dengue virus
VNIEAEPPF

SEQ ID NO: 58093 - protein, 9 aa, Dengue virus
NIEAEPPFG

SEQ ID NO: 58094 - protein, 9 aa, Dengue virus
IEAEPPFGE

SEQ ID NO: 58095 - protein, 9 aa, Dengue virus
EAEPPFGES

SEQ ID NO: 58096 - protein, 9 aa, Dengue virus
AEPPFGESN

SEQ ID NO: 58097 - protein, 9 aa, Dengue virus
EPPFGESNI

SEQ ID NO: 58098 - protein, 9 aa, Dengue virus
PPFGESNIV

SEQ ID NO: 58099 - protein, 9 aa, Dengue virus
PFGESNIVI

SEQ ID NO: 58100 - protein, 9 aa, Dengue virus
FGESNIVIG

SEQ ID NO: 58101 - protein, 9 aa, Dengue virus
GESNIVIGI

SEQ ID NO: 58102 - protein, 9 aa, Dengue virus
ESNIVIGIG

SEQ ID NO: 58103 - protein, 9 aa, Dengue virus
SNIVIGIGD

SEQ ID NO: 58104 - protein, 9 aa, Dengue virus
GDNALKINW

SEQ ID NO: 58105 - protein, 9 aa, Dengue virus
DNALKINWY

SEQ ID NO: 58106 - protein, 9 aa, Dengue virus
NALKINWYK

SEQ ID NO: 58107 - protein, 9 aa, Dengue virus
ALKINWYKK

SEQ ID NO: 58108 - protein, 9 aa, Dengue virus
LKINWYKKG

SEQ ID NO: 58109 - protein, 9 aa, Dengue virus
KINWYKKGS

SEQ ID NO: 58110 - protein, 9 aa, Dengue virus
INWYKKGSS

SEQ ID NO: 58111 - protein, 9 aa, Dengue virus
NWYKKGSSI

SEQ ID NO: 58112 - protein, 9 aa, Dengue virus
WYKKGSSIG

SEQ ID NO: 58113 - protein, 9 aa, Dengue virus
YKKGSSIGK

SEQ ID NO: 58114 - protein, 9 aa, Dengue virus
KKGSSIGKM

SEQ ID NO: 58115 - protein, 9 aa, Dengue virus
KGSSIGKMF

SEQ ID NO: 58116 - protein, 9 aa, Dengue virus
GSSIGKMFE

SEQ ID NO: 58117 - protein, 9 aa, Dengue virus
SSIGKMFEA

SEQ ID NO: 58118 - protein, 9 aa, Dengue virus
SIGKMFEAT

SEQ ID NO: 58119 - protein, 9 aa, Dengue virus
IGKMFEATA

SEQ ID NO: 58120 - protein, 9 aa, Dengue virus
GKMFEATAR

SEQ ID NO: 58121 - protein, 9 aa, Dengue virus
KMFEATARG

SEQ ID NO: 58122 - protein, 9 aa, Dengue virus
MFEATARGA

SEQ ID NO: 58123 - protein, 9 aa, Dengue virus
FEATARGAR

SEQ ID NO: 58124 - protein, 9 aa, Dengue virus
EATARGARR

SEQ ID NO: 58125 - protein, 9 aa, Dengue virus
ATARGARRM

SEQ ID NO: 58126 - protein, 9 aa, Dengue virus
TARGARRMA

SEQ ID NO: 58127 - protein, 9 aa, Dengue virus
ARGARRMAI

SEQ ID NO: 58128 - protein, 9 aa, Dengue virus
RGARRMAIL

SEQ ID NO: 58129 - protein, 9 aa, Dengue virus
GARRMAILG

SEQ ID NO: 58130 - protein, 9 aa, Dengue virus
ARRMAILGD

SEQ ID NO: 58131 - protein, 9 aa, Dengue virus
RRMAILGDT

SEQ ID NO: 58132 - protein, 9 aa, Dengue virus
RMAILGDTA

SEQ ID NO: 58133 - protein, 9 aa, Dengue virus
MAILGDTAW

SEQ ID NO: 58134 - protein, 9 aa, Dengue virus
AILGDTAWD

SEQ ID NO: 58135 - protein, 9 aa, Dengue virus
ILGDTAWDF

SEQ ID NO: 58136 - protein, 9 aa, Dengue virus
LGDTAWDFG

SEQ ID NO: 58137 - protein, 9 aa, Dengue virus
GDTAWDFGS

SEQ ID NO: 58138 - protein, 9 aa, Dengue virus
DTAWDFGSV

SEQ ID NO: 58139 - protein, 9 aa, Dengue virus
TAWDFGSVG

SEQ ID NO: 58140 - protein, 9 aa, Dengue virus
AWDFGSVGG

SEQ ID NO: 58141 - protein, 9 aa, Dengue virus
WDFGSVGGV

SEQ ID NO: 58142 - protein, 9 aa, Dengue virus
DFGSVGGVL

SEQ ID NO: 58143 - protein, 9 aa, Dengue virus
FGSVGGVLN

SEQ ID NO: 58144 - protein, 9 aa, Dengue virus
GSVGGVLNS

SEQ ID NO: 58145 - protein, 9 aa, Dengue virus
SVGGVLNSL

SEQ ID NO: 58146 - protein, 9 aa, Dengue virus
VGGVLNSLG

SEQ ID NO: 58147 - protein, 9 aa, Dengue virus
GGVLNSLGK

SEQ ID NO: 58148 - protein, 9 aa, Dengue virus
GVLNSLGKM

SEQ ID NO: 58149 - protein, 9 aa, Dengue virus
VLNSLGKMV

SEQ ID NO: 58150 - protein, 9 aa, Dengue virus
LNSLGKMVH

SEQ ID NO: 58151 - protein, 9 aa, Dengue virus
NSLGKMVHQ

SEQ ID NO: 58152 - protein, 9 aa, Dengue virus
SLGKMVHQI

SEQ ID NO: 58153 - protein, 9 aa, Dengue virus
LGKMVHQIF

SEQ ID NO: 58154 - protein, 9 aa, Dengue virus
GKMVHQIFG

SEQ ID NO: 58155 - protein, 9 aa, Dengue virus
KMVHQIFGS

SEQ ID NO: 58156 - protein, 9 aa, Dengue virus
MVHQIFGSA

SEQ ID NO: 58157 - protein, 9 aa, Dengue virus
VHQIFGSAY

SEQ ID NO: 58158 - protein, 9 aa, Dengue virus
HQIFGSAYT

SEQ ID NO: 58159 - protein, 9 aa, Dengue virus
QIFGSAYTA

SEQ ID NO: 58160 - protein, 9 aa, Dengue virus
IFGSAYTAL

SEQ ID NO: 58161 - protein, 9 aa, Dengue virus
FGSAYTALF

SEQ ID NO: 58162 - protein, 9 aa, Dengue virus
GSAYTALFS

SEQ ID NO: 58163 - protein, 9 aa, Dengue virus
SAYTALFSG

SEQ ID NO: 58164 - protein, 9 aa, Dengue virus
AYTALFSGV

SEQ ID NO: 58165 - protein, 9 aa, Dengue virus
YTALFSGVS

SEQ ID NO: 58166 - protein, 9 aa, Dengue virus
TALFSGVSW

SEQ ID NO: 58167 - protein, 9 aa, Dengue virus
ALFSGVSWV

SEQ ID NO: 58168 - protein, 9 aa, Dengue virus
LFSGVSWVM

SEQ ID NO: 58169 - protein, 9 aa, Dengue virus
FSGVSWVMK

SEQ ID NO: 58170 - protein, 9 aa, Dengue virus
SGVSWVMKI

SEQ ID NO: 58171 - protein, 9 aa, Dengue virus
GVSWVMKIG

SEQ ID NO: 58172 - protein, 9 aa, Dengue virus
VSWVMKIGI

SEQ ID NO: 58173 - protein, 9 aa, Dengue virus
SWVMKIGIG

SEQ ID NO: 58174 - protein, 9 aa, Dengue virus
WVMKIGIGV

SEQ ID NO: 58175 - protein, 9 aa, Dengue virus
VMKIGIGVL

SEQ ID NO: 58176 - protein, 9 aa, Dengue virus
MKIGIGVLL

SEQ ID NO: 58177 - protein, 9 aa, Dengue virus
KIGIGVLLT

SEQ ID NO: 58178 - protein, 9 aa, Dengue virus
IGIGVLLTW

SEQ ID NO: 58179 - protein, 9 aa, Dengue virus
GIGVLLTWI

SEQ ID NO: 58180 - protein, 9 aa, Dengue virus
IGVLLTWIG

SEQ ID NO: 58181 - protein, 9 aa, Dengue virus
GVLLTWIGL

SEQ ID NO: 58182 - protein, 9 aa, Dengue virus
VLLTWIGLN

SEQ ID NO: 58183 - protein, 9 aa, Dengue virus
LLTWIGLNS

SEQ ID NO: 58184 - protein, 9 aa, Dengue virus
LTWIGLNSK

SEQ ID NO: 58185 - protein, 9 aa, Dengue virus
TWIGLNSKN

SEQ ID NO: 58186 - protein, 9 aa, Dengue virus
WIGLNSKNT

SEQ ID NO: 58187 - protein, 9 aa, Dengue virus
IGLNSKNTS

SEQ ID NO: 58188 - protein, 9 aa, Dengue virus
GLNSKNTSM

SEQ ID NO: 58189 - protein, 9 aa, Dengue virus
LNSKNTSMS

SEQ ID NO: 58190 - protein, 9 aa, Dengue virus
NSKNTSMSF

SEQ ID NO: 58191 - protein, 9 aa, Dengue virus
SKNTSMSFS

SEQ ID NO: 58192 - protein, 9 aa, Dengue virus
KNTSMSFSC

SEQ ID NO: 58193 - protein, 9 aa, Dengue virus
NTSMSFSCI

SEQ ID NO: 58194 - protein, 9 aa, Dengue virus
TSMSFSCIA

SEQ ID NO: 58195 - protein, 9 aa, Dengue virus
SMSFSCIAI

SEQ ID NO: 58196 - protein, 9 aa, Dengue virus
MSFSCIAIG

SEQ ID NO: 58197 - protein, 9 aa, Dengue virus
SFSCIAIGI

SEQ ID NO: 58198 - protein, 9 aa, Dengue virus
FSCIAIGII

SEQ ID NO: 58199 - protein, 9 aa, Dengue virus
SCIAIGIIT

SEQ ID NO: 58200 - protein, 9 aa, Dengue virus
CIAIGIITL

SEQ ID NO: 58201 - protein, 9 aa, Dengue virus
IAIGIITLY

SEQ ID NO: 58202 - protein, 9 aa, Dengue virus
AIGIITLYL

SEQ ID NO: 58203 - protein, 9 aa, Dengue virus
IGIITLYLG

SEQ ID NO: 58204 - protein, 9 aa, Dengue virus
GIITLYLGA

SEQ ID NO: 58205 - protein, 9 aa, Dengue virus
IITLYLGAV

SEQ ID NO: 58206 - protein, 9 aa, Dengue virus
ITLYLGAVV

SEQ ID NO: 58207 - protein, 9 aa, Dengue virus
TLYLGAVVQ

SEQ ID NO: 58208 - protein, 9 aa, Dengue virus
LYLGAVVQA

SEQ ID NO: 58209 - protein, 9 aa, Dengue virus
YLGAVVQAD

SEQ ID NO: 58210 - protein, 9 aa, Dengue virus
LGAVVQADM

SEQ ID NO: 58211 - protein, 9 aa, Dengue virus
GAVVQADMG

SEQ ID NO: 58212 - protein, 9 aa, Dengue virus
AVVQADMGC

SEQ ID NO: 58213 - protein, 9 aa, Dengue virus
VVQADMGCV

SEQ ID NO: 58214 - protein, 9 aa, Dengue virus
VQADMGCVI

SEQ ID NO: 58215 - protein, 9 aa, Dengue virus
QADMGCVIN

SEQ ID NO: 58216 - protein, 9 aa, Dengue virus
ADMGCVINW

SEQ ID NO: 58217 - protein, 9 aa, Dengue virus
DMGCVINWK

SEQ ID NO: 58218 - protein, 9 aa, Dengue virus
MGCVINWKG

SEQ ID NO: 58219 - protein, 9 aa, Dengue virus
GCVINWKGK

SEQ ID NO: 58220 - protein, 9 aa, Dengue virus
CVINWKGKE

SEQ ID NO: 58221 - protein, 9 aa, Dengue virus
VINWKGKEL

SEQ ID NO: 58222 - protein, 9 aa, Dengue virus
INWKGKELK

SEQ ID NO: 58223 - protein, 9 aa, Dengue virus
NWKGKELKC

SEQ ID NO: 58224 - protein, 9 aa, Dengue virus
WKGKELKCG

SEQ ID NO: 58225 - protein, 9 aa, Dengue virus
KGKELKCGS

SEQ ID NO: 58226 - protein, 9 aa, Dengue virus
GKELKCGSG

SEQ ID NO: 58227 - protein, 9 aa, Dengue virus
KELKCGSGI

SEQ ID NO: 58228 - protein, 9 aa, Dengue virus
ELKCGSGIF

SEQ ID NO: 58229 - protein, 9 aa, Dengue virus
LKCGSGIFV

SEQ ID NO: 58230 - protein, 9 aa, Dengue virus
KCGSGIFVT

SEQ ID NO: 58231 - protein, 9 aa, Dengue virus
CGSGIFVTN

SEQ ID NO: 58232 - protein, 9 aa, Dengue virus
GSGIFVTNE

SEQ ID NO: 58233 - protein, 9 aa, Dengue virus
SGIFVTNEV

SEQ ID NO: 58234 - protein, 9 aa, Dengue virus
GIFVTNEVH

SEQ ID NO: 58235 - protein, 9 aa, Dengue virus
IFVTNEVHT

SEQ ID NO: 58236 - protein, 9 aa, Dengue virus
FVTNEVHTW

SEQ ID NO: 58237 - protein, 9 aa, Dengue virus
VTNEVHTWT

SEQ ID NO: 58238 - protein, 9 aa, Dengue virus
TNEVHTWTE

SEQ ID NO: 58239 - protein, 9 aa, Dengue virus
NEVHTWTEQ

SEQ ID NO: 58240 - protein, 9 aa, Dengue virus
EVHTWTEQY

SEQ ID NO: 58241 - protein, 9 aa, Dengue virus
VHTWTEQYK

SEQ ID NO: 58242 - protein, 9 aa, Dengue virus
HTWTEQYKF

SEQ ID NO: 58243 - protein, 9 aa, Dengue virus
TWTEQYKFQ

SEQ ID NO: 58244 - protein, 9 aa, Dengue virus
WTEQYKFQA

SEQ ID NO: 58245 - protein, 9 aa, Dengue virus
TEQYKFQAD

SEQ ID NO: 58246 - protein, 9 aa, Dengue virus
EQYKFQADS

SEQ ID NO: 58247 - protein, 9 aa, Dengue virus
QYKFQADSP

SEQ ID NO: 58248 - protein, 9 aa, Dengue virus
YKFQADSPK

SEQ ID NO: 58249 - protein, 9 aa, Dengue virus
KFQADSPKR

SEQ ID NO: 58250 - protein, 9 aa, Dengue virus
FQADSPKRL

SEQ ID NO: 58251 - protein, 9 aa, Dengue virus
QADSPKRLA

SEQ ID NO: 58252 - protein, 9 aa, Dengue virus
ADSPKRLAT

SEQ ID NO: 58253 - protein, 9 aa, Dengue virus
DSPKRLATA

SEQ ID NO: 58254 - protein, 9 aa, Dengue virus
SPKRLATAI

SEQ ID NO: 58255 - protein, 9 aa, Dengue virus
PKRLATAIA

SEQ ID NO: 58256 - protein, 9 aa, Dengue virus
KRLATAIAG

SEQ ID NO: 58257 - protein, 9 aa, Dengue virus
RLATAIAGA

SEQ ID NO: 58258 - protein, 9 aa, Dengue virus
LATAIAGAW

SEQ ID NO: 58259 - protein, 9 aa, Dengue virus
ATAIAGAWE

SEQ ID NO: 58260 - protein, 9 aa, Dengue virus
TAIAGAWEN

SEQ ID NO: 58261 - protein, 9 aa, Dengue virus
AIAGAWENG

SEQ ID NO: 58262 - protein, 9 aa, Dengue virus
IAGAWENGV

SEQ ID NO: 58263 - protein, 9 aa, Dengue virus
AGAWENGVC

SEQ ID NO: 58264 - protein, 9 aa, Dengue virus
GAWENGVCG

SEQ ID NO: 58265 - protein, 9 aa, Dengue virus
AWENGVCGI

SEQ ID NO: 58266 - protein, 9 aa, Dengue virus
WENGVCGIR

SEQ ID NO: 58267 - protein, 9 aa, Dengue virus
ENGVCGIRS

SEQ ID NO: 58268 - protein, 9 aa, Dengue virus
NGVCGIRST

SEQ ID NO: 58269 - protein, 9 aa, Dengue virus
GVCGIRSTT

SEQ ID NO: 58270 - protein, 9 aa, Dengue virus
VCGIRSTTR

SEQ ID NO: 58271 - protein, 9 aa, Dengue virus
CGIRSTTRM

SEQ ID NO: 58272 - protein, 9 aa, Dengue virus
GIRSTTRME

SEQ ID NO: 58273 - protein, 9 aa, Dengue virus
IRSTTRMEN

SEQ ID NO: 58274 - protein, 9 aa, Dengue virus
RSTTRMENL

SEQ ID NO: 58275 - protein, 9 aa, Dengue virus
STTRMENLL

SEQ ID NO: 58276 - protein, 9 aa, Dengue virus
TTRMENLLW

SEQ ID NO: 58277 - protein, 9 aa, Dengue virus
TRMENLLWK

SEQ ID NO: 58278 - protein, 9 aa, Dengue virus
RMENLLWKQ

SEQ ID NO: 58279 - protein, 9 aa, Dengue virus
MENLLWKQI

SEQ ID NO: 58280 - protein, 9 aa, Dengue virus
ENLLWKQIA

SEQ ID NO: 58281 - protein, 9 aa, Dengue virus
NLLWKQIAN

SEQ ID NO: 58282 - protein, 9 aa, Dengue virus
LLWKQIANE

SEQ ID NO: 58283 - protein, 9 aa, Dengue virus
LWKQIANEL

SEQ ID NO: 58284 - protein, 9 aa, Dengue virus
WKQIANELN

SEQ ID NO: 58285 - protein, 9 aa, Dengue virus
KQIANELNY

SEQ ID NO: 58286 - protein, 9 aa, Dengue virus
QIANELNYI

SEQ ID NO: 58287 - protein, 9 aa, Dengue virus
IANELNYIL

SEQ ID NO: 58288 - protein, 9 aa, Dengue virus
ANELNYILW

SEQ ID NO: 58289 - protein, 9 aa, Dengue virus
NELNYILWE

SEQ ID NO: 58290 - protein, 9 aa, Dengue virus
ELNYILWEN

SEQ ID NO: 58291 - protein, 9 aa, Dengue virus
LNYILWENN

SEQ ID NO: 58292 - protein, 9 aa, Dengue virus
NYILWENNI

SEQ ID NO: 58293 - protein, 9 aa, Dengue virus
YILWENNIK

SEQ ID NO: 58294 - protein, 9 aa, Dengue virus
ILWENNIKL

SEQ ID NO: 58295 - protein, 9 aa, Dengue virus
LWENNIKLT

SEQ ID NO: 58296 - protein, 9 aa, Dengue virus
WENNIKLTV

SEQ ID NO: 58297 - protein, 9 aa, Dengue virus
ENNIKLTVV

SEQ ID NO: 58298 - protein, 9 aa, Dengue virus
NNIKLTVVV

SEQ ID NO: 58299 - protein, 9 aa, Dengue virus
NIKLTVVVG

SEQ ID NO: 58300 - protein, 9 aa, Dengue virus
IKLTVVVGD

SEQ ID NO: 58301 - protein, 9 aa, Dengue virus
KLTVVVGDI

SEQ ID NO: 58302 - protein, 9 aa, Dengue virus
LTVVVGDII

SEQ ID NO: 58303 - protein, 9 aa, Dengue virus
TVVVGDIIG

SEQ ID NO: 58304 - protein, 9 aa, Dengue virus
IGVLEQGKR

SEQ ID NO: 58305 - protein, 9 aa, Dengue virus
GVLEQGKRT

SEQ ID NO: 58306 - protein, 9 aa, Dengue virus
VLEQGKRTL

SEQ ID NO: 58307 - protein, 9 aa, Dengue virus
LEQGKRTLT

SEQ ID NO: 58308 - protein, 9 aa, Dengue virus
EQGKRTLTP

SEQ ID NO: 58309 - protein, 9 aa, Dengue virus
QGKRTLTPQ

SEQ ID NO: 58310 - protein, 9 aa, Dengue virus
GKRTLTPQP

SEQ ID NO: 58311 - protein, 9 aa, Dengue virus
KRTLTPQPM

SEQ ID NO: 58312 - protein, 9 aa, Dengue virus
RTLTPQPME

SEQ ID NO: 58313 - protein, 9 aa, Dengue virus
TLTPQPMEL

SEQ ID NO: 58314 - protein, 9 aa, Dengue virus
LTPQPMELK

SEQ ID NO: 58315 - protein, 9 aa, Dengue virus
TPQPMELKY

SEQ ID NO: 58316 - protein, 9 aa, Dengue virus
PQPMELKYS

SEQ ID NO: 58317 - protein, 9 aa, Dengue virus
QPMELKYSW

SEQ ID NO: 58318 - protein, 9 aa, Dengue virus
PMELKYSWK

SEQ ID NO: 58319 - protein, 9 aa, Dengue virus
MELKYSWKT

SEQ ID NO: 58320 - protein, 9 aa, Dengue virus
ELKYSWKTW

SEQ ID NO: 58321 - protein, 9 aa, Dengue virus
LKYSWKTWG

SEQ ID NO: 58322 - protein, 9 aa, Dengue virus
KYSWKTWGK

SEQ ID NO: 58323 - protein, 9 aa, Dengue virus
YSWKTWGKA

SEQ ID NO: 58324 - protein, 9 aa, Dengue virus
SWKTWGKAK

SEQ ID NO: 58325 - protein, 9 aa, Dengue virus
WKTWGKAKI

SEQ ID NO: 58326 - protein, 9 aa, Dengue virus
KTWGKAKIV

SEQ ID NO: 58327 - protein, 9 aa, Dengue virus
WGKAKIVTA

SEQ ID NO: 58328 - protein, 9 aa, Dengue virus
GKAKIVTAE

SEQ ID NO: 58329 - protein, 9 aa, Dengue virus
AETQNSSFI

SEQ ID NO: 58330 - protein, 9 aa, Dengue virus
ETQNSSFII

SEQ ID NO: 58331 - protein, 9 aa, Dengue virus
TQNSSFIID

SEQ ID NO: 58332 - protein, 9 aa, Dengue virus
QNSSFIIDG

SEQ ID NO: 58333 - protein, 9 aa, Dengue virus
NSSFIIDGP

SEQ ID NO: 58334 - protein, 9 aa, Dengue virus
SSFIIDGPN

SEQ ID NO: 58335 - protein, 9 aa, Dengue virus
SFIIDGPNT

SEQ ID NO: 58336 - protein, 9 aa, Dengue virus
FIIDGPNTP

SEQ ID NO: 58337 - protein, 9 aa, Dengue virus
IIDGPNTPE

SEQ ID NO: 58338 - protein, 9 aa, Dengue virus
IDGPNTPEC

SEQ ID NO: 58339 - protein, 9 aa, Dengue virus
DGPNTPECP

SEQ ID NO: 58340 - protein, 9 aa, Dengue virus
GPNTPECPS

SEQ ID NO: 58341 - protein, 9 aa, Dengue virus
PNTPECPSA

SEQ ID NO: 58342 - protein, 9 aa, Dengue virus
PSASRAWNV

SEQ ID NO: 58343 - protein, 9 aa, Dengue virus
SASRAWNVW

SEQ ID NO: 58344 - protein, 9 aa, Dengue virus
ASRAWNVWE

SEQ ID NO: 58345 - protein, 9 aa, Dengue virus
SRAWNVWEV

SEQ ID NO: 58346 - protein, 9 aa, Dengue virus
RAWNVWEVE

SEQ ID NO: 58347 - protein, 9 aa, Dengue virus
AWNVWEVED

SEQ ID NO: 58348 - protein, 9 aa, Dengue virus
WNVWEVEDY

SEQ ID NO: 58349 - protein, 9 aa, Dengue virus
NVWEVEDYG

SEQ ID NO: 58350 - protein, 9 aa, Dengue virus
VWEVEDYGF

SEQ ID NO: 58351 - protein, 9 aa, Dengue virus
WEVEDYGFG

SEQ ID NO: 58352 - protein, 9 aa, Dengue virus
EVEDYGFGV

SEQ ID NO: 58353 - protein, 9 aa, Dengue virus
VEDYGFGVF

SEQ ID NO: 58354 - protein, 9 aa, Dengue virus
EDYGFGVFT

SEQ ID NO: 58355 - protein, 9 aa, Dengue virus
DYGFGVFTT

SEQ ID NO: 58356 - protein, 9 aa, Dengue virus
YGFGVFTTN

SEQ ID NO: 58357 - protein, 9 aa, Dengue virus
GFGVFTTNI

SEQ ID NO: 58358 - protein, 9 aa, Dengue virus
FGVFTTNIW

SEQ ID NO: 58359 - protein, 9 aa, Dengue virus
GVFTTNIWL

SEQ ID NO: 58360 - protein, 9 aa, Dengue virus
VFTTNIWLK

SEQ ID NO: 58361 - protein, 9 aa, Dengue virus
FTTNIWLKL

SEQ ID NO: 58362 - protein, 9 aa, Dengue virus
TTNIWLKLR

SEQ ID NO: 58363 - protein, 9 aa, Dengue virus
TNIWLKLRE

SEQ ID NO: 58364 - protein, 9 aa, Dengue virus
NIWLKLREV

SEQ ID NO: 58365 - protein, 9 aa, Dengue virus
IWLKLREVY

SEQ ID NO: 58366 - protein, 9 aa, Dengue virus
WLKLREVYT

SEQ ID NO: 58367 - protein, 9 aa, Dengue virus
LKLREVYTQ

SEQ ID NO: 58368 - protein, 9 aa, Dengue virus
TQLCDHRLM

SEQ ID NO: 58369 - protein, 9 aa, Dengue virus
QLCDHRLMS

SEQ ID NO: 58370 - protein, 9 aa, Dengue virus
LCDHRLMSA

SEQ ID NO: 58371 - protein, 9 aa, Dengue virus
CDHRLMSAA

SEQ ID NO: 58372 - protein, 9 aa, Dengue virus
DHRLMSAAV

SEQ ID NO: 58373 - protein, 9 aa, Dengue virus
HRLMSAAVK

SEQ ID NO: 58374 - protein, 9 aa, Dengue virus
RLMSAAVKD

SEQ ID NO: 58375 - protein, 9 aa, Dengue virus
LMSAAVKDE

SEQ ID NO: 58376 - protein, 9 aa, Dengue virus
MSAAVKDER

SEQ ID NO: 58377 - protein, 9 aa, Dengue virus
SAAVKDERA

SEQ ID NO: 58378 - protein, 9 aa, Dengue virus
AAVKDERAV

SEQ ID NO: 58379 - protein, 9 aa, Dengue virus
AVKDERAVH

SEQ ID NO: 58380 - protein, 9 aa, Dengue virus
VKDERAVHA

SEQ ID NO: 58381 - protein, 9 aa, Dengue virus
KDERAVHAD

SEQ ID NO: 58382 - protein, 9 aa, Dengue virus
DERAVHADM

SEQ ID NO: 58383 - protein, 9 aa, Dengue virus
ERAVHADMG

SEQ ID NO: 58384 - protein, 9 aa, Dengue virus
RAVHADMGY

SEQ ID NO: 58385 - protein, 9 aa, Dengue virus
AVHADMGYW

SEQ ID NO: 58386 - protein, 9 aa, Dengue virus
VHADMGYWI

SEQ ID NO: 58387 - protein, 9 aa, Dengue virus
HADMGYWIE

SEQ ID NO: 58388 - protein, 9 aa, Dengue virus
ADMGYWIES

SEQ ID NO: 58389 - protein, 9 aa, Dengue virus
DMGYWIESQ

SEQ ID NO: 58390 - protein, 9 aa, Dengue virus
MGYWIESQK

SEQ ID NO: 58391 - protein, 9 aa, Dengue virus
GYWIESQKN

SEQ ID NO: 58392 - protein, 9 aa, Dengue virus
YWIESQKNG

SEQ ID NO: 58393 - protein, 9 aa, Dengue virus
WIESQKNGS

SEQ ID NO: 58394 - protein, 9 aa, Dengue virus
IESQKNGSW

SEQ ID NO: 58395 - protein, 9 aa, Dengue virus
ESQKNGSWK

SEQ ID NO: 58396 - protein, 9 aa, Dengue virus
SQKNGSWKL

SEQ ID NO: 58397 - protein, 9 aa, Dengue virus
QKNGSWKLE

SEQ ID NO: 58398 - protein, 9 aa, Dengue virus
KNGSWKLEK

SEQ ID NO: 58399 - protein, 9 aa, Dengue virus
NGSWKLEKA

SEQ ID NO: 58400 - protein, 9 aa, Dengue virus
GSWKLEKAS

SEQ ID NO: 58401 - protein, 9 aa, Dengue virus
SWKLEKASL

SEQ ID NO: 58402 - protein, 9 aa, Dengue virus
WKLEKASLI

SEQ ID NO: 58403 - protein, 9 aa, Dengue virus
KLEKASLIE

SEQ ID NO: 58404 - protein, 9 aa, Dengue virus
LEKASLIEV

SEQ ID NO: 58405 - protein, 9 aa, Dengue virus
EKASLIEVK

SEQ ID NO: 58406 - protein, 9 aa, Dengue virus
KASLIEVKT

SEQ ID NO: 58407 - protein, 9 aa, Dengue virus
ASLIEVKTC

SEQ ID NO: 58408 - protein, 9 aa, Dengue virus
SLIEVKTCT

SEQ ID NO: 58409 - protein, 9 aa, Dengue virus
LIEVKTCTW

SEQ ID NO: 58410 - protein, 9 aa, Dengue virus
IEVKTCTWP

SEQ ID NO: 58411 - protein, 9 aa, Dengue virus
EVKTCTWPK

SEQ ID NO: 58412 - protein, 9 aa, Dengue virus
VKTCTWPKS

SEQ ID NO: 58413 - protein, 9 aa, Dengue virus
KTCTWPKSH

SEQ ID NO: 58414 - protein, 9 aa, Dengue virus
TCTWPKSHT

SEQ ID NO: 58415 - protein, 9 aa, Dengue virus
CTWPKSHTL

SEQ ID NO: 58416 - protein, 9 aa, Dengue virus
TWPKSHTLW

SEQ ID NO: 58417 - protein, 9 aa, Dengue virus
WPKSHTLWS

SEQ ID NO: 58418 - protein, 9 aa, Dengue virus
PKSHTLWSN

SEQ ID NO: 58419 - protein, 9 aa, Dengue virus
KSHTLWSNG

SEQ ID NO: 58420 - protein, 9 aa, Dengue virus
SHTLWSNGV

SEQ ID NO: 58421 - protein, 9 aa, Dengue virus
HTLWSNGVL

SEQ ID NO: 58422 - protein, 9 aa, Dengue virus
TLWSNGVLE

SEQ ID NO: 58423 - protein, 9 aa, Dengue virus
LWSNGVLES

SEQ ID NO: 58424 - protein, 9 aa, Dengue virus
WSNGVLESD

SEQ ID NO: 58425 - protein, 9 aa, Dengue virus
SNGVLESDM

SEQ ID NO: 58426 - protein, 9 aa, Dengue virus
NGVLESDMI

SEQ ID NO: 58427 - protein, 9 aa, Dengue virus
GVLESDMII

SEQ ID NO: 58428 - protein, 9 aa, Dengue virus
VLESDMIIP

SEQ ID NO: 58429 - protein, 9 aa, Dengue virus
LESDMIIPK

SEQ ID NO: 58430 - protein, 9 aa, Dengue virus
ESDMIIPKS

SEQ ID NO: 58431 - protein, 9 aa, Dengue virus
SDMIIPKSL

SEQ ID NO: 58432 - protein, 9 aa, Dengue virus
DMIIPKSLA

SEQ ID NO: 58433 - protein, 9 aa, Dengue virus
MIIPKSLAG

SEQ ID NO: 58434 - protein, 9 aa, Dengue virus
IIPKSLAGP

SEQ ID NO: 58435 - protein, 9 aa, Dengue virus
IPKSLAGPI

SEQ ID NO: 58436 - protein, 9 aa, Dengue virus
PKSLAGPIS

SEQ ID NO: 58437 - protein, 9 aa, Dengue virus
KSLAGPISQ

SEQ ID NO: 58438 - protein, 9 aa, Dengue virus
SLAGPISQH

SEQ ID NO: 58439 - protein, 9 aa, Dengue virus
LAGPISQHN

SEQ ID NO: 58440 - protein, 9 aa, Dengue virus
AGPISQHNY

SEQ ID NO: 58441 - protein, 9 aa, Dengue virus
GPISQHNYR

SEQ ID NO: 58442 - protein, 9 aa, Dengue virus
PISQHNYRP

SEQ ID NO: 58443 - protein, 9 aa, Dengue virus
ISQHNYRPG

SEQ ID NO: 58444 - protein, 9 aa, Dengue virus
SQHNYRPGY

SEQ ID NO: 58445 - protein, 9 aa, Dengue virus
QHNYRPGYH

SEQ ID NO: 58446 - protein, 9 aa, Dengue virus
HNYRPGYHT

SEQ ID NO: 58447 - protein, 9 aa, Dengue virus
NYRPGYHTQ

SEQ ID NO: 58448 - protein, 9 aa, Dengue virus
YRPGYHTQT

SEQ ID NO: 58449 - protein, 9 aa, Dengue virus
RPGYHTQTA

SEQ ID NO: 58450 - protein, 9 aa, Dengue virus
PGYHTQTAG

SEQ ID NO: 58451 - protein, 9 aa, Dengue virus
GYHTQTAGP

SEQ ID NO: 58452 - protein, 9 aa, Dengue virus
YHTQTAGPW

SEQ ID NO: 58453 - protein, 9 aa, Dengue virus
HTQTAGPWH

SEQ ID NO: 58454 - protein, 9 aa, Dengue virus
TQTAGPWHL

SEQ ID NO: 58455 - protein, 9 aa, Dengue virus
QTAGPWHLG

SEQ ID NO: 58456 - protein, 9 aa, Dengue virus
TAGPWHLGK

SEQ ID NO: 58457 - protein, 9 aa, Dengue virus
AGPWHLGKL

SEQ ID NO: 58458 - protein, 9 aa, Dengue virus
GPWHLGKLE

SEQ ID NO: 58459 - protein, 9 aa, Dengue virus
PWHLGKLEL

SEQ ID NO: 58460 - protein, 9 aa, Dengue virus
WHLGKLELD

SEQ ID NO: 58461 - protein, 9 aa, Dengue virus
HLGKLELDF

SEQ ID NO: 58462 - protein, 9 aa, Dengue virus
LGKLELDFN

SEQ ID NO: 58463 - protein, 9 aa, Dengue virus
GKLELDFNY

SEQ ID NO: 58464 - protein, 9 aa, Dengue virus
KLELDFNYC

SEQ ID NO: 58465 - protein, 9 aa, Dengue virus
LELDFNYCE

SEQ ID NO: 58466 - protein, 9 aa, Dengue virus
ELDFNYCEG

SEQ ID NO: 58467 - protein, 9 aa, Dengue virus
LDFNYCEGT

SEQ ID NO: 58468 - protein, 9 aa, Dengue virus
DFNYCEGTT

SEQ ID NO: 58469 - protein, 9 aa, Dengue virus
FNYCEGTTV

SEQ ID NO: 58470 - protein, 9 aa, Dengue virus
NYCEGTTVV

SEQ ID NO: 58471 - protein, 9 aa, Dengue virus
YCEGTTVVI

SEQ ID NO: 58472 - protein, 9 aa, Dengue virus
CEGTTVVIT

SEQ ID NO: 58473 - protein, 9 aa, Dengue virus
EGTTVVITE

SEQ ID NO: 58474 - protein, 9 aa, Dengue virus
GTTVVITEN

SEQ ID NO: 58475 - protein, 9 aa, Dengue virus
TTVVITENC

SEQ ID NO: 58476 - protein, 9 aa, Dengue virus
TVVITENCG

SEQ ID NO: 58477 - protein, 9 aa, Dengue virus
VVITENCGT

SEQ ID NO: 58478 - protein, 9 aa, Dengue virus
CGTRGPSLR

SEQ ID NO: 58479 - protein, 9 aa, Dengue virus
GTRGPSLRT

SEQ ID NO: 58480 - protein, 9 aa, Dengue virus
TRGPSLRTT

SEQ ID NO: 58481 - protein, 9 aa, Dengue virus
RGPSLRTTT

SEQ ID NO: 58482 - protein, 9 aa, Dengue virus
GPSLRTTTV

SEQ ID NO: 58483 - protein, 9 aa, Dengue virus
PSLRTTTVS

SEQ ID NO: 58484 - protein, 9 aa, Dengue virus
SLRTTTVSG

SEQ ID NO: 58485 - protein, 9 aa, Dengue virus
LRTTTVSGK

SEQ ID NO: 58486 - protein, 9 aa, Dengue virus
RTTTVSGKL

SEQ ID NO: 58487 - protein, 9 aa, Dengue virus
TTTVSGKLI

SEQ ID NO: 58488 - protein, 9 aa, Dengue virus
TTVSGKLIH

SEQ ID NO: 58489 - protein, 9 aa, Dengue virus
TVSGKLIHE

SEQ ID NO: 58490 - protein, 9 aa, Dengue virus
VSGKLIHEW

SEQ ID NO: 58491 - protein, 9 aa, Dengue virus
SGKLIHEWC

SEQ ID NO: 58492 - protein, 9 aa, Dengue virus
GKLIHEWCC

SEQ ID NO: 58493 - protein, 9 aa, Dengue virus
KLIHEWCCR

SEQ ID NO: 58494 - protein, 9 aa, Dengue virus
LIHEWCCRS

SEQ ID NO: 58495 - protein, 9 aa, Dengue virus
IHEWCCRSC

SEQ ID NO: 58496 - protein, 9 aa, Dengue virus
HEWCCRSCT

SEQ ID NO: 58497 - protein, 9 aa, Dengue virus
EWCCRSCTL

SEQ ID NO: 58498 - protein, 9 aa, Dengue virus
WCCRSCTLP

SEQ ID NO: 58499 - protein, 9 aa, Dengue virus
CCRSCTLPP

SEQ ID NO: 58500 - protein, 9 aa, Dengue virus
CRSCTLPPL

SEQ ID NO: 58501 - protein, 9 aa, Dengue virus
RSCTLPPLR

SEQ ID NO: 58502 - protein, 9 aa, Dengue virus
SCTLPPLRY

SEQ ID NO: 58503 - protein, 9 aa, Dengue virus
CTLPPLRYM

SEQ ID NO: 58504 - protein, 9 aa, Dengue virus
TLPPLRYMG

SEQ ID NO: 58505 - protein, 9 aa, Dengue virus
LPPLRYMGE

SEQ ID NO: 58506 - protein, 9 aa, Dengue virus
PPLRYMGED

SEQ ID NO: 58507 - protein, 9 aa, Dengue virus
PLRYMGEDG

SEQ ID NO: 58508 - protein, 9 aa, Dengue virus
LRYMGEDGC

SEQ ID NO: 58509 - protein, 9 aa, Dengue virus
RYMGEDGCW

SEQ ID NO: 58510 - protein, 9 aa, Dengue virus
YMGEDGCWY

SEQ ID NO: 58511 - protein, 9 aa, Dengue virus
MGEDGCWYG

SEQ ID NO: 58512 - protein, 9 aa, Dengue virus
GEDGCWYGM

SEQ ID NO: 58513 - protein, 9 aa, Dengue virus
EDGCWYGME

SEQ ID NO: 58514 - protein, 9 aa, Dengue virus
DGCWYGMEI

SEQ ID NO: 58515 - protein, 9 aa, Dengue virus
GCWYGMEIR

SEQ ID NO: 58516 - protein, 9 aa, Dengue virus
CWYGMEIRP

SEQ ID NO: 58517 - protein, 9 aa, Dengue virus
WYGMEIRPI

SEQ ID NO: 58518 - protein, 9 aa, Dengue virus
YGMEIRPIS

SEQ ID NO: 58519 - protein, 9 aa, Dengue virus
GMEIRPISE

SEQ ID NO: 58520 - protein, 9 aa, Dengue virus
MEIRPISEK

SEQ ID NO: 58521 - protein, 9 aa, Dengue virus
EIRPISEKE

SEQ ID NO: 58522 - protein, 9 aa, Dengue virus
IRPISEKEE

SEQ ID NO: 58523 - protein, 9 aa, Dengue virus
RPISEKEEN

SEQ ID NO: 58524 - protein, 9 aa, Dengue virus
PISEKEENM

SEQ ID NO: 58525 - protein, 9 aa, Dengue virus
ISEKEENMV

SEQ ID NO: 58526 - protein, 9 aa, Dengue virus
SEKEENMVK

SEQ ID NO: 58527 - protein, 9 aa, Dengue virus
EKEENMVKS

SEQ ID NO: 58528 - protein, 9 aa, Dengue virus
KEENMVKSL

SEQ ID NO: 58529 - protein, 9 aa, Dengue virus
EENMVKSLV

SEQ ID NO: 58530 - protein, 9 aa, Dengue virus
ENMVKSLVS

SEQ ID NO: 58531 - protein, 9 aa, Dengue virus
NMVKSLVSA

SEQ ID NO: 58532 - protein, 9 aa, Dengue virus
MVKSLVSAG

SEQ ID NO: 58533 - protein, 9 aa, Dengue virus
VKSLVSAGS

SEQ ID NO: 58534 - protein, 9 aa, Dengue virus
KSLVSAGSG

SEQ ID NO: 58535 - protein, 9 aa, Dengue virus
SLVSAGSGK

SEQ ID NO: 58536 - protein, 9 aa, Dengue virus
LVSAGSGKV

SEQ ID NO: 58537 - protein, 9 aa, Dengue virus
VSAGSGKVD

SEQ ID NO: 58538 - protein, 9 aa, Dengue virus
SAGSGKVDN

SEQ ID NO: 58539 - protein, 9 aa, Dengue virus
AGSGKVDNF

SEQ ID NO: 58540 - protein, 9 aa, Dengue virus
GSGKVDNFT

SEQ ID NO: 58541 - protein, 9 aa, Dengue virus
SGKVDNFTM

SEQ ID NO: 58542 - protein, 9 aa, Dengue virus
GKVDNFTMG

SEQ ID NO: 58543 - protein, 9 aa, Dengue virus
VDNFTMGVL

SEQ ID NO: 58544 - protein, 9 aa, Dengue virus
DNFTMGVLC

SEQ ID NO: 58545 - protein, 9 aa, Dengue virus
NFTMGVLCL

SEQ ID NO: 58546 - protein, 9 aa, Dengue virus
FTMGVLCLA

SEQ ID NO: 58547 - protein, 9 aa, Dengue virus
TMGVLCLAI

SEQ ID NO: 58548 - protein, 9 aa, Dengue virus
MGVLCLAIL

SEQ ID NO: 58549 - protein, 9 aa, Dengue virus
GVLCLAILF

SEQ ID NO: 58550 - protein, 9 aa, Dengue virus
VLCLAILFE

SEQ ID NO: 58551 - protein, 9 aa, Dengue virus
LCLAILFEE

SEQ ID NO: 58552 - protein, 9 aa, Dengue virus
CLAILFEEV

SEQ ID NO: 58553 - protein, 9 aa, Dengue virus
LAILFEEVM

SEQ ID NO: 58554 - protein, 9 aa, Dengue virus
AILFEEVMR

SEQ ID NO: 58555 - protein, 9 aa, Dengue virus
ILFEEVMRG

SEQ ID NO: 58556 - protein, 9 aa, Dengue virus
LFEEVMRGK

SEQ ID NO: 58557 - protein, 9 aa, Dengue virus
FEEVMRGKF

SEQ ID NO: 58558 - protein, 9 aa, Dengue virus
EEVMRGKFG

SEQ ID NO: 58559 - protein, 9 aa, Dengue virus
EVMRGKFGK

SEQ ID NO: 58560 - protein, 9 aa, Dengue virus
VMRGKFGKK

SEQ ID NO: 58561 - protein, 9 aa, Dengue virus
MRGKFGKKH

SEQ ID NO: 58562 - protein, 9 aa, Dengue virus
RGKFGKKHM

SEQ ID NO: 58563 - protein, 9 aa, Dengue virus
GKFGKKHMI

SEQ ID NO: 58564 - protein, 9 aa, Dengue virus
KFGKKHMIA

SEQ ID NO: 58565 - protein, 9 aa, Dengue virus
FGKKHMIAG

SEQ ID NO: 58566 - protein, 9 aa, Dengue virus
GKKHMIAGV

SEQ ID NO: 58567 - protein, 9 aa, Dengue virus
FTFVLLLSG

SEQ ID NO: 58568 - protein, 9 aa, Dengue virus
TFVLLLSGQ

SEQ ID NO: 58569 - protein, 9 aa, Dengue virus
FVLLLSGQI

SEQ ID NO: 58570 - protein, 9 aa, Dengue virus
VLLLSGQIT

SEQ ID NO: 58571 - protein, 9 aa, Dengue virus
LLLSGQITW

SEQ ID NO: 58572 - protein, 9 aa, Dengue virus
LLSGQITWR

SEQ ID NO: 58573 - protein, 9 aa, Dengue virus
LSGQITWRD

SEQ ID NO: 58574 - protein, 9 aa, Dengue virus
SGQITWRDM

SEQ ID NO: 58575 - protein, 9 aa, Dengue virus
GQITWRDMA

SEQ ID NO: 58576 - protein, 9 aa, Dengue virus
AHTLIMIGS

SEQ ID NO: 58577 - protein, 9 aa, Dengue virus
HTLIMIGSN

SEQ ID NO: 58578 - protein, 9 aa, Dengue virus
TLIMIGSNA

SEQ ID NO: 58579 - protein, 9 aa, Dengue virus
LIMIGSNAS

SEQ ID NO: 58580 - protein, 9 aa, Dengue virus
IMIGSNASD

SEQ ID NO: 58581 - protein, 9 aa, Dengue virus
MIGSNASDR

SEQ ID NO: 58582 - protein, 9 aa, Dengue virus
IGSNASDRM

SEQ ID NO: 58583 - protein, 9 aa, Dengue virus
GSNASDRMG

SEQ ID NO: 58584 - protein, 9 aa, Dengue virus
SNASDRMGM

SEQ ID NO: 58585 - protein, 9 aa, Dengue virus
NASDRMGMG

SEQ ID NO: 58586 - protein, 9 aa, Dengue virus
ASDRMGMGV

SEQ ID NO: 58587 - protein, 9 aa, Dengue virus
SDRMGMGVT

SEQ ID NO: 58588 - protein, 9 aa, Dengue virus
DRMGMGVTY

SEQ ID NO: 58589 - protein, 9 aa, Dengue virus
RMGMGVTYL

SEQ ID NO: 58590 - protein, 9 aa, Dengue virus
MGMGVTYLA

SEQ ID NO: 58591 - protein, 9 aa, Dengue virus
GMGVTYLAL

SEQ ID NO: 58592 - protein, 9 aa, Dengue virus
MGVTYLALI

SEQ ID NO: 58593 - protein, 9 aa, Dengue virus
GVTYLALIA

SEQ ID NO: 58594 - protein, 9 aa, Dengue virus
VTYLALIAT

SEQ ID NO: 58595 - protein, 9 aa, Dengue virus
TYLALIATF

SEQ ID NO: 58596 - protein, 9 aa, Dengue virus
YLALIATFK

SEQ ID NO: 58597 - protein, 9 aa, Dengue virus
LALIATFKI

SEQ ID NO: 58598 - protein, 9 aa, Dengue virus
ALIATFKIQ

SEQ ID NO: 58599 - protein, 9 aa, Dengue virus
LIATFKIQP

SEQ ID NO: 58600 - protein, 9 aa, Dengue virus
IATFKIQPF

SEQ ID NO: 58601 - protein, 9 aa, Dengue virus
ATFKIQPFL

SEQ ID NO: 58602 - protein, 9 aa, Dengue virus
TFKIQPFLA

SEQ ID NO: 58603 - protein, 9 aa, Dengue virus
FKIQPFLAL

SEQ ID NO: 58604 - protein, 9 aa, Dengue virus
KIQPFLALG

SEQ ID NO: 58605 - protein, 9 aa, Dengue virus
IQPFLALGF

SEQ ID NO: 58606 - protein, 9 aa, Dengue virus
QPFLALGFF

SEQ ID NO: 58607 - protein, 9 aa, Dengue virus
PFLALGFFL

SEQ ID NO: 58608 - protein, 9 aa, Dengue virus
FLALGFFLR

SEQ ID NO: 58609 - protein, 9 aa, Dengue virus
LALGFFLRK

SEQ ID NO: 58610 - protein, 9 aa, Dengue virus
ALGFFLRKL

SEQ ID NO: 58611 - protein, 9 aa, Dengue virus
LGFFLRKLT

SEQ ID NO: 58612 - protein, 9 aa, Dengue virus
GFFLRKLTS

SEQ ID NO: 58613 - protein, 9 aa, Dengue virus
FFLRKLTSR

SEQ ID NO: 58614 - protein, 9 aa, Dengue virus
FLRKLTSRE

SEQ ID NO: 58615 - protein, 9 aa, Dengue virus
LRKLTSREN

SEQ ID NO: 58616 - protein, 9 aa, Dengue virus
RKLTSRENL

SEQ ID NO: 58617 - protein, 9 aa, Dengue virus
KLTSRENLL

SEQ ID NO: 58618 - protein, 9 aa, Dengue virus
LTSRENLLL

SEQ ID NO: 58619 - protein, 9 aa, Dengue virus
TSRENLLLG

SEQ ID NO: 58620 - protein, 9 aa, Dengue virus
SRENLLLGV

SEQ ID NO: 58621 - protein, 9 aa, Dengue virus
RENLLLGVG

SEQ ID NO: 58622 - protein, 9 aa, Dengue virus
ENLLLGVGL

SEQ ID NO: 58623 - protein, 9 aa, Dengue virus
NLLLGVGLA

SEQ ID NO: 58624 - protein, 9 aa, Dengue virus
LLLGVGLAM

SEQ ID NO: 58625 - protein, 9 aa, Dengue virus
LLGVGLAMA

SEQ ID NO: 58626 - protein, 9 aa, Dengue virus
LGVGLAMAT

SEQ ID NO: 58627 - protein, 9 aa, Dengue virus
GVGLAMATT

SEQ ID NO: 58628 - protein, 9 aa, Dengue virus
VGLAMATTL

SEQ ID NO: 58629 - protein, 9 aa, Dengue virus
GLAMATTLQ

SEQ ID NO: 58630 - protein, 9 aa, Dengue virus
LAMATTLQL

SEQ ID NO: 58631 - protein, 9 aa, Dengue virus
AMATTLQLP

SEQ ID NO: 58632 - protein, 9 aa, Dengue virus
MATTLQLPE

SEQ ID NO: 58633 - protein, 9 aa, Dengue virus
ATTLQLPED

SEQ ID NO: 58634 - protein, 9 aa, Dengue virus
TTLQLPEDI

SEQ ID NO: 58635 - protein, 9 aa, Dengue virus
TLQLPEDIE

SEQ ID NO: 58636 - protein, 9 aa, Dengue virus
LQLPEDIEQ

SEQ ID NO: 58637 - protein, 9 aa, Dengue virus
QLPEDIEQM

SEQ ID NO: 58638 - protein, 9 aa, Dengue virus
LPEDIEQMA

SEQ ID NO: 58639 - protein, 9 aa, Dengue virus
PEDIEQMAN

SEQ ID NO: 58640 - protein, 9 aa, Dengue virus
EDIEQMANG

SEQ ID NO: 58641 - protein, 9 aa, Dengue virus
DIEQMANGI

SEQ ID NO: 58642 - protein, 9 aa, Dengue virus
IEQMANGIA

SEQ ID NO: 58643 - protein, 9 aa, Dengue virus
EQMANGIAL

SEQ ID NO: 58644 - protein, 9 aa, Dengue virus
QMANGIALG

SEQ ID NO: 58645 - protein, 9 aa, Dengue virus
MANGIALGL

SEQ ID NO: 58646 - protein, 9 aa, Dengue virus
ANGIALGLM

SEQ ID NO: 58647 - protein, 9 aa, Dengue virus
NGIALGLMA

SEQ ID NO: 58648 - protein, 9 aa, Dengue virus
GIALGLMAL

SEQ ID NO: 58649 - protein, 9 aa, Dengue virus
IALGLMALK

SEQ ID NO: 58650 - protein, 9 aa, Dengue virus
ALGLMALKL

SEQ ID NO: 58651 - protein, 9 aa, Dengue virus
LGLMALKLI

SEQ ID NO: 58652 - protein, 9 aa, Dengue virus
GLMALKLIT

SEQ ID NO: 58653 - protein, 9 aa, Dengue virus
LMALKLITQ

SEQ ID NO: 58654 - protein, 9 aa, Dengue virus
MALKLITQF

SEQ ID NO: 58655 - protein, 9 aa, Dengue virus
ALKLITQFE

SEQ ID NO: 58656 - protein, 9 aa, Dengue virus
LKLITQFET

SEQ ID NO: 58657 - protein, 9 aa, Dengue virus
KLITQFETY

SEQ ID NO: 58658 - protein, 9 aa, Dengue virus
LITQFETYQ

SEQ ID NO: 58659 - protein, 9 aa, Dengue virus
ITQFETYQL

SEQ ID NO: 58660 - protein, 9 aa, Dengue virus
TQFETYQLW

SEQ ID NO: 58661 - protein, 9 aa, Dengue virus
QFETYQLWT

SEQ ID NO: 58662 - protein, 9 aa, Dengue virus
FETYQLWTA

SEQ ID NO: 58663 - protein, 9 aa, Dengue virus
ETYQLWTAL

SEQ ID NO: 58664 - protein, 9 aa, Dengue virus
TYQLWTALI

SEQ ID NO: 58665 - protein, 9 aa, Dengue virus
YQLWTALIS

SEQ ID NO: 58666 - protein, 9 aa, Dengue virus
QLWTALISL

SEQ ID NO: 58667 - protein, 9 aa, Dengue virus
LWTALISLT

SEQ ID NO: 58668 - protein, 9 aa, Dengue virus
WTALISLTC

SEQ ID NO: 58669 - protein, 9 aa, Dengue virus
ALISLTCSN

SEQ ID NO: 58670 - protein, 9 aa, Dengue virus
LISLTCSNT

SEQ ID NO: 58671 - protein, 9 aa, Dengue virus
SLTCSNTIF

SEQ ID NO: 58672 - protein, 9 aa, Dengue virus
LTCSNTIFT

SEQ ID NO: 58673 - protein, 9 aa, Dengue virus
TCSNTIFTL

SEQ ID NO: 58674 - protein, 9 aa, Dengue virus
CSNTIFTLT

SEQ ID NO: 58675 - protein, 9 aa, Dengue virus
SNTIFTLTV

SEQ ID NO: 58676 - protein, 9 aa, Dengue virus
NTIFTLTVA

SEQ ID NO: 58677 - protein, 9 aa, Dengue virus
TIFTLTVAW

SEQ ID NO: 58678 - protein, 9 aa, Dengue virus
IFTLTVAWR

SEQ ID NO: 58679 - protein, 9 aa, Dengue virus
FTLTVAWRT

SEQ ID NO: 58680 - protein, 9 aa, Dengue virus
TLTVAWRTA

SEQ ID NO: 58681 - protein, 9 aa, Dengue virus
LTVAWRTAT

SEQ ID NO: 58682 - protein, 9 aa, Dengue virus
TVAWRTATL

SEQ ID NO: 58683 - protein, 9 aa, Dengue virus
VAWRTATLI

SEQ ID NO: 58684 - protein, 9 aa, Dengue virus
AWRTATLIL

SEQ ID NO: 58685 - protein, 9 aa, Dengue virus
WRTATLILA

SEQ ID NO: 58686 - protein, 9 aa, Dengue virus
RTATLILAG

SEQ ID NO: 58687 - protein, 9 aa, Dengue virus
TATLILAGV

SEQ ID NO: 58688 - protein, 9 aa, Dengue virus
ATLILAGVS

SEQ ID NO: 58689 - protein, 9 aa, Dengue virus
TLILAGVSL

SEQ ID NO: 58690 - protein, 9 aa, Dengue virus
LILAGVSLL

SEQ ID NO: 58691 - protein, 9 aa, Dengue virus
ILAGVSLLP

SEQ ID NO: 58692 - protein, 9 aa, Dengue virus
VSLLPVCQS

SEQ ID NO: 58693 - protein, 9 aa, Dengue virus
SLLPVCQSS

SEQ ID NO: 58694 - protein, 9 aa, Dengue virus
LLPVCQSSS

SEQ ID NO: 58695 - protein, 9 aa, Dengue virus
LPVCQSSSM

SEQ ID NO: 58696 - protein, 9 aa, Dengue virus
PVCQSSSMR

SEQ ID NO: 58697 - protein, 9 aa, Dengue virus
VCQSSSMRK

SEQ ID NO: 58698 - protein, 9 aa, Dengue virus
CQSSSMRKT

SEQ ID NO: 58699 - protein, 9 aa, Dengue virus
QSSSMRKTD

SEQ ID NO: 58700 - protein, 9 aa, Dengue virus
SSSMRKTDW

SEQ ID NO: 58701 - protein, 9 aa, Dengue virus
SSMRKTDWL

SEQ ID NO: 58702 - protein, 9 aa, Dengue virus
SMRKTDWLP

SEQ ID NO: 58703 - protein, 9 aa, Dengue virus
MRKTDWLPM

SEQ ID NO: 58704 - protein, 9 aa, Dengue virus
RKTDWLPMT

SEQ ID NO: 58705 - protein, 9 aa, Dengue virus
KTDWLPMTV

SEQ ID NO: 58706 - protein, 9 aa, Dengue virus
TDWLPMTVA

SEQ ID NO: 58707 - protein, 9 aa, Dengue virus
DWLPMTVAA

SEQ ID NO: 58708 - protein, 9 aa, Dengue virus
WLPMTVAAM

SEQ ID NO: 58709 - protein, 9 aa, Dengue virus
LPMTVAAMG

SEQ ID NO: 58710 - protein, 9 aa, Dengue virus
PMTVAAMGV

SEQ ID NO: 58711 - protein, 9 aa, Dengue virus
VAAMGVPPL

SEQ ID NO: 58712 - protein, 9 aa, Dengue virus
AAMGVPPLP

SEQ ID NO: 58713 - protein, 9 aa, Dengue virus
AMGVPPLPL

SEQ ID NO: 58714 - protein, 9 aa, Dengue virus
MGVPPLPLF

SEQ ID NO: 58715 - protein, 9 aa, Dengue virus
GVPPLPLFI

SEQ ID NO: 58716 - protein, 9 aa, Dengue virus
VPPLPLFIF

SEQ ID NO: 58717 - protein, 9 aa, Dengue virus
PLPLFIFSL

SEQ ID NO: 58718 - protein, 9 aa, Dengue virus
LPLFIFSLK

SEQ ID NO: 58719 - protein, 9 aa, Dengue virus
PLFIFSLKD

SEQ ID NO: 58720 - protein, 9 aa, Dengue virus
LFIFSLKDT

SEQ ID NO: 58721 - protein, 9 aa, Dengue virus
LKDTLKRRS

SEQ ID NO: 58722 - protein, 9 aa, Dengue virus
KDTLKRRSW

SEQ ID NO: 58723 - protein, 9 aa, Dengue virus
DTLKRRSWP

SEQ ID NO: 58724 - protein, 9 aa, Dengue virus
TLKRRSWPL

SEQ ID NO: 58725 - protein, 9 aa, Dengue virus
LKRRSWPLN

SEQ ID NO: 58726 - protein, 9 aa, Dengue virus
KRRSWPLNE

SEQ ID NO: 58727 - protein, 9 aa, Dengue virus
RRSWPLNEG

SEQ ID NO: 58728 - protein, 9 aa, Dengue virus
RSWPLNEGV

SEQ ID NO: 58729 - protein, 9 aa, Dengue virus
SWPLNEGVM

SEQ ID NO: 58730 - protein, 9 aa, Dengue virus
WPLNEGVMA

SEQ ID NO: 58731 - protein, 9 aa, Dengue virus
PLNEGVMAV

SEQ ID NO: 58732 - protein, 9 aa, Dengue virus
LNEGVMAVG

SEQ ID NO: 58733 - protein, 9 aa, Dengue virus
NEGVMAVGL

SEQ ID NO: 58734 - protein, 9 aa, Dengue virus
EGVMAVGLV

SEQ ID NO: 58735 - protein, 9 aa, Dengue virus
GVMAVGLVS

SEQ ID NO: 58736 - protein, 9 aa, Dengue virus
VMAVGLVSI

SEQ ID NO: 58737 - protein, 9 aa, Dengue virus
MAVGLVSIL

SEQ ID NO: 58738 - protein, 9 aa, Dengue virus
AVGLVSILA

SEQ ID NO: 58739 - protein, 9 aa, Dengue virus
VGLVSILAS

SEQ ID NO: 58740 - protein, 9 aa, Dengue virus
GLVSILASS

SEQ ID NO: 58741 - protein, 9 aa, Dengue virus
LVSILASSL

SEQ ID NO: 58742 - protein, 9 aa, Dengue virus
VSILASSLL

SEQ ID NO: 58743 - protein, 9 aa, Dengue virus
SILASSLLR

SEQ ID NO: 58744 - protein, 9 aa, Dengue virus
ILASSLLRN

SEQ ID NO: 58745 - protein, 9 aa, Dengue virus
LASSLLRND

SEQ ID NO: 58746 - protein, 9 aa, Dengue virus
ASSLLRNDV

SEQ ID NO: 58747 - protein, 9 aa, Dengue virus
SSLLRNDVP

SEQ ID NO: 58748 - protein, 9 aa, Dengue virus
SLLRNDVPM

SEQ ID NO: 58749 - protein, 9 aa, Dengue virus
LLRNDVPMA

SEQ ID NO: 58750 - protein, 9 aa, Dengue virus
LRNDVPMAG

SEQ ID NO: 58751 - protein, 9 aa, Dengue virus
RNDVPMAGP

SEQ ID NO: 58752 - protein, 9 aa, Dengue virus
NDVPMAGPL

SEQ ID NO: 58753 - protein, 9 aa, Dengue virus
DVPMAGPLV

SEQ ID NO: 58754 - protein, 9 aa, Dengue virus
VPMAGPLVA

SEQ ID NO: 58755 - protein, 9 aa, Dengue virus
PMAGPLVAG

SEQ ID NO: 58756 - protein, 9 aa, Dengue virus
MAGPLVAGG

SEQ ID NO: 58757 - protein, 9 aa, Dengue virus
AGPLVAGGL

SEQ ID NO: 58758 - protein, 9 aa, Dengue virus
GPLVAGGLL

SEQ ID NO: 58759 - protein, 9 aa, Dengue virus
PLVAGGLLI

SEQ ID NO: 58760 - protein, 9 aa, Dengue virus
LVAGGLLIA

SEQ ID NO: 58761 - protein, 9 aa, Dengue virus
VAGGLLIAC

SEQ ID NO: 58762 - protein, 9 aa, Dengue virus
AGGLLIACY

SEQ ID NO: 58763 - protein, 9 aa, Dengue virus
GGLLIACYV

SEQ ID NO: 58764 - protein, 9 aa, Dengue virus
GLLIACYVI

SEQ ID NO: 58765 - protein, 9 aa, Dengue virus
LLIACYVIT

SEQ ID NO: 58766 - protein, 9 aa, Dengue virus
LIACYVITG

SEQ ID NO: 58767 - protein, 9 aa, Dengue virus
IACYVITGT

SEQ ID NO: 58768 - protein, 9 aa, Dengue virus
ACYVITGTS

SEQ ID NO: 58769 - protein, 9 aa, Dengue virus
CYVITGTSA

SEQ ID NO: 58770 - protein, 9 aa, Dengue virus
YVITGTSAD

SEQ ID NO: 58771 - protein, 9 aa, Dengue virus
VITGTSADL

SEQ ID NO: 58772 - protein, 9 aa, Dengue virus
ITGTSADLT

SEQ ID NO: 58773 - protein, 9 aa, Dengue virus
TGTSADLTV

SEQ ID NO: 58774 - protein, 9 aa, Dengue virus
GTSADLTVE

SEQ ID NO: 58775 - protein, 9 aa, Dengue virus
TSADLTVEK

SEQ ID NO: 58776 - protein, 9 aa, Dengue virus
SADLTVEKA

SEQ ID NO: 58777 - protein, 9 aa, Dengue virus
ADLTVEKAA

SEQ ID NO: 58778 - protein, 9 aa, Dengue virus
DLTVEKAAD

SEQ ID NO: 58779 - protein, 9 aa, Dengue virus
ADVTWEEEA

SEQ ID NO: 58780 - protein, 9 aa, Dengue virus
DVTWEEEAE

SEQ ID NO: 58781 - protein, 9 aa, Dengue virus
VTWEEEAEQ

SEQ ID NO: 58782 - protein, 9 aa, Dengue virus
TWEEEAEQT

SEQ ID NO: 58783 - protein, 9 aa, Dengue virus
WEEEAEQTG

SEQ ID NO: 58784 - protein, 9 aa, Dengue virus
EEEAEQTGV

SEQ ID NO: 58785 - protein, 9 aa, Dengue virus
EEAEQTGVS

SEQ ID NO: 58786 - protein, 9 aa, Dengue virus
EAEQTGVSH

SEQ ID NO: 58787 - protein, 9 aa, Dengue virus
AEQTGVSHN

SEQ ID NO: 58788 - protein, 9 aa, Dengue virus
EQTGVSHNL

SEQ ID NO: 58789 - protein, 9 aa, Dengue virus
QTGVSHNLM

SEQ ID NO: 58790 - protein, 9 aa, Dengue virus
TGVSHNLMI

SEQ ID NO: 58791 - protein, 9 aa, Dengue virus
GVSHNLMIT

SEQ ID NO: 58792 - protein, 9 aa, Dengue virus
VSHNLMITV

SEQ ID NO: 58793 - protein, 9 aa, Dengue virus
SHNLMITVD

SEQ ID NO: 58794 - protein, 9 aa, Dengue virus
HNLMITVDD

SEQ ID NO: 58795 - protein, 9 aa, Dengue virus
NLMITVDDD

SEQ ID NO: 58796 - protein, 9 aa, Dengue virus
LMITVDDDG

SEQ ID NO: 58797 - protein, 9 aa, Dengue virus
MITVDDDGT

SEQ ID NO: 58798 - protein, 9 aa, Dengue virus
ITVDDDGTM

SEQ ID NO: 58799 - protein, 9 aa, Dengue virus
TVDDDGTMR

SEQ ID NO: 58800 - protein, 9 aa, Dengue virus
VDDDGTMRI

SEQ ID NO: 58801 - protein, 9 aa, Dengue virus
DDDGTMRIK

SEQ ID NO: 58802 - protein, 9 aa, Dengue virus
DDGTMRIKD

SEQ ID NO: 58803 - protein, 9 aa, Dengue virus
DGTMRIKDD

SEQ ID NO: 58804 - protein, 9 aa, Dengue virus
GTMRIKDDE

SEQ ID NO: 58805 - protein, 9 aa, Dengue virus
TMRIKDDET

SEQ ID NO: 58806 - protein, 9 aa, Dengue virus
MRIKDDETE

SEQ ID NO: 58807 - protein, 9 aa, Dengue virus
RIKDDETEN

SEQ ID NO: 58808 - protein, 9 aa, Dengue virus
IKDDETENI

SEQ ID NO: 58809 - protein, 9 aa, Dengue virus
KDDETENIL

SEQ ID NO: 58810 - protein, 9 aa, Dengue virus
DDETENILT

SEQ ID NO: 58811 - protein, 9 aa, Dengue virus
DETENILTV

SEQ ID NO: 58812 - protein, 9 aa, Dengue virus
ETENILTVL

SEQ ID NO: 58813 - protein, 9 aa, Dengue virus
TENILTVLL

SEQ ID NO: 58814 - protein, 9 aa, Dengue virus
ENILTVLLK

SEQ ID NO: 58815 - protein, 9 aa, Dengue virus
NILTVLLKT

SEQ ID NO: 58816 - protein, 9 aa, Dengue virus
ILTVLLKTA

SEQ ID NO: 58817 - protein, 9 aa, Dengue virus
LTVLLKTAL

SEQ ID NO: 58818 - protein, 9 aa, Dengue virus
TVLLKTALL

SEQ ID NO: 58819 - protein, 9 aa, Dengue virus
VLLKTALLI

SEQ ID NO: 58820 - protein, 9 aa, Dengue virus
LLKTALLIV

SEQ ID NO: 58821 - protein, 9 aa, Dengue virus
LKTALLIVS

SEQ ID NO: 58822 - protein, 9 aa, Dengue virus
KTALLIVSG

SEQ ID NO: 58823 - protein, 9 aa, Dengue virus
TALLIVSGI

SEQ ID NO: 58824 - protein, 9 aa, Dengue virus
ALLIVSGIF

SEQ ID NO: 58825 - protein, 9 aa, Dengue virus
LLIVSGIFP

SEQ ID NO: 58826 - protein, 9 aa, Dengue virus
LIVSGIFPY

SEQ ID NO: 58827 - protein, 9 aa, Dengue virus
IVSGIFPYS

SEQ ID NO: 58828 - protein, 9 aa, Dengue virus
VSGIFPYSI

SEQ ID NO: 58829 - protein, 9 aa, Dengue virus
SGIFPYSIP

SEQ ID NO: 58830 - protein, 9 aa, Dengue virus
GIFPYSIPA

SEQ ID NO: 58831 - protein, 9 aa, Dengue virus
IFPYSIPAT

SEQ ID NO: 58832 - protein, 9 aa, Dengue virus
FPYSIPATL

SEQ ID NO: 58833 - protein, 9 aa, Dengue virus
PYSIPATLL

SEQ ID NO: 58834 - protein, 9 aa, Dengue virus
YSIPATLLV

SEQ ID NO: 58835 - protein, 9 aa, Dengue virus
SIPATLLVW

SEQ ID NO: 58836 - protein, 9 aa, Dengue virus
IPATLLVWH

SEQ ID NO: 58837 - protein, 9 aa, Dengue virus
PATLLVWHT

SEQ ID NO: 58838 - protein, 9 aa, Dengue virus
ATLLVWHTW

SEQ ID NO: 58839 - protein, 9 aa, Dengue virus
TLLVWHTWQ

SEQ ID NO: 58840 - protein, 9 aa, Dengue virus
LLVWHTWQK

SEQ ID NO: 58841 - protein, 9 aa, Dengue virus
LVWHTWQKQ

SEQ ID NO: 58842 - protein, 9 aa, Dengue virus
VWHTWQKQT

SEQ ID NO: 58843 - protein, 9 aa, Dengue virus
WHTWQKQTQ

SEQ ID NO: 58844 - protein, 9 aa, Dengue virus
HTWQKQTQR

SEQ ID NO: 58845 - protein, 9 aa, Dengue virus
TWQKQTQRS

SEQ ID NO: 58846 - protein, 9 aa, Dengue virus
WQKQTQRSG

SEQ ID NO: 58847 - protein, 9 aa, Dengue virus
QKQTQRSGV

SEQ ID NO: 58848 - protein, 9 aa, Dengue virus
KQTQRSGVL

SEQ ID NO: 58849 - protein, 9 aa, Dengue virus
QTQRSGVLW

SEQ ID NO: 58850 - protein, 9 aa, Dengue virus
TQRSGVLWD

SEQ ID NO: 58851 - protein, 9 aa, Dengue virus
QRSGVLWDV

SEQ ID NO: 58852 - protein, 9 aa, Dengue virus
RSGVLWDVP

SEQ ID NO: 58853 - protein, 9 aa, Dengue virus
SGVLWDVPS

SEQ ID NO: 58854 - protein, 9 aa, Dengue virus
GVLWDVPSP

SEQ ID NO: 58855 - protein, 9 aa, Dengue virus
VLWDVPSPP

SEQ ID NO: 58856 - protein, 9 aa, Dengue virus
LWDVPSPPE

SEQ ID NO: 58857 - protein, 9 aa, Dengue virus
WDVPSPPET

SEQ ID NO: 58858 - protein, 9 aa, Dengue virus
DVPSPPETQ

SEQ ID NO: 58859 - protein, 9 aa, Dengue virus
VPSPPETQK

SEQ ID NO: 58860 - protein, 9 aa, Dengue virus
PSPPETQKA

SEQ ID NO: 58861 - protein, 9 aa, Dengue virus
SPPETQKAE

SEQ ID NO: 58862 - protein, 9 aa, Dengue virus
PPETQKAEL

SEQ ID NO: 58863 - protein, 9 aa, Dengue virus
PETQKAELE

SEQ ID NO: 58864 - protein, 9 aa, Dengue virus
ETQKAELEE

SEQ ID NO: 58865 - protein, 9 aa, Dengue virus
TQKAELEEG

SEQ ID NO: 58866 - protein, 9 aa, Dengue virus
QKAELEEGV

SEQ ID NO: 58867 - protein, 9 aa, Dengue virus
KAELEEGVY

SEQ ID NO: 58868 - protein, 9 aa, Dengue virus
AELEEGVYR

SEQ ID NO: 58869 - protein, 9 aa, Dengue virus
ELEEGVYRI

SEQ ID NO: 58870 - protein, 9 aa, Dengue virus
LEEGVYRIK

SEQ ID NO: 58871 - protein, 9 aa, Dengue virus
EEGVYRIKQ

SEQ ID NO: 58872 - protein, 9 aa, Dengue virus
EGVYRIKQQ

SEQ ID NO: 58873 - protein, 9 aa, Dengue virus
GVYRIKQQG

SEQ ID NO: 58874 - protein, 9 aa, Dengue virus
VYRIKQQGI

SEQ ID NO: 58875 - protein, 9 aa, Dengue virus
YRIKQQGIF

SEQ ID NO: 58876 - protein, 9 aa, Dengue virus
RIKQQGIFG

SEQ ID NO: 58877 - protein, 9 aa, Dengue virus
IKQQGIFGK

SEQ ID NO: 58878 - protein, 9 aa, Dengue virus
KQQGIFGKT

SEQ ID NO: 58879 - protein, 9 aa, Dengue virus
QQGIFGKTQ

SEQ ID NO: 58880 - protein, 9 aa, Dengue virus
QGIFGKTQV

SEQ ID NO: 58881 - protein, 9 aa, Dengue virus
GIFGKTQVG

SEQ ID NO: 58882 - protein, 9 aa, Dengue virus
IFGKTQVGV

SEQ ID NO: 58883 - protein, 9 aa, Dengue virus
FGKTQVGVG

SEQ ID NO: 58884 - protein, 9 aa, Dengue virus
GKTQVGVGV

SEQ ID NO: 58885 - protein, 9 aa, Dengue virus
KTQVGVGVQ

SEQ ID NO: 58886 - protein, 9 aa, Dengue virus
TQVGVGVQK

SEQ ID NO: 58887 - protein, 9 aa, Dengue virus
QVGVGVQKE

SEQ ID NO: 58888 - protein, 9 aa, Dengue virus
VGVGVQKEG

SEQ ID NO: 58889 - protein, 9 aa, Dengue virus
GVGVQKEGV

SEQ ID NO: 58890 - protein, 9 aa, Dengue virus
VGVQKEGVF

SEQ ID NO: 58891 - protein, 9 aa, Dengue virus
GVQKEGVFH

SEQ ID NO: 58892 - protein, 9 aa, Dengue virus
VQKEGVFHT

SEQ ID NO: 58893 - protein, 9 aa, Dengue virus
QKEGVFHTM

SEQ ID NO: 58894 - protein, 9 aa, Dengue virus
KEGVFHTMW

SEQ ID NO: 58895 - protein, 9 aa, Dengue virus
EGVFHTMWH

SEQ ID NO: 58896 - protein, 9 aa, Dengue virus
GVFHTMWHV

SEQ ID NO: 58897 - protein, 9 aa, Dengue virus
VFHTMWHVT

SEQ ID NO: 58898 - protein, 9 aa, Dengue virus
FHTMWHVTR

SEQ ID NO: 58899 - protein, 9 aa, Dengue virus
HTMWHVTRG

SEQ ID NO: 58900 - protein, 9 aa, Dengue virus
TMWHVTRGA

SEQ ID NO: 58901 - protein, 9 aa, Dengue virus
MWHVTRGAV

SEQ ID NO: 58902 - protein, 9 aa, Dengue virus
WHVTRGAVL

SEQ ID NO: 58903 - protein, 9 aa, Dengue virus
HVTRGAVLT

SEQ ID NO: 58904 - protein, 9 aa, Dengue virus
VTRGAVLTY

SEQ ID NO: 58905 - protein, 9 aa, Dengue virus
TRGAVLTYN

SEQ ID NO: 58906 - protein, 9 aa, Dengue virus
RGAVLTYNG

SEQ ID NO: 58907 - protein, 9 aa, Dengue virus
GAVLTYNGK

SEQ ID NO: 58908 - protein, 9 aa, Dengue virus
AVLTYNGKR

SEQ ID NO: 58909 - protein, 9 aa, Dengue virus
VLTYNGKRL

SEQ ID NO: 58910 - protein, 9 aa, Dengue virus
LTYNGKRLE

SEQ ID NO: 58911 - protein, 9 aa, Dengue virus
TYNGKRLEP

SEQ ID NO: 58912 - protein, 9 aa, Dengue virus
YNGKRLEPN

SEQ ID NO: 58913 - protein, 9 aa, Dengue virus
NGKRLEPNW

SEQ ID NO: 58914 - protein, 9 aa, Dengue virus
GKRLEPNWA

SEQ ID NO: 58915 - protein, 9 aa, Dengue virus
KRLEPNWAS

SEQ ID NO: 58916 - protein, 9 aa, Dengue virus
RLEPNWASV

SEQ ID NO: 58917 - protein, 9 aa, Dengue virus
LEPNWASVK

SEQ ID NO: 58918 - protein, 9 aa, Dengue virus
EPNWASVKK

SEQ ID NO: 58919 - protein, 9 aa, Dengue virus
PNWASVKKD

SEQ ID NO: 58920 - protein, 9 aa, Dengue virus
NWASVKKDL

SEQ ID NO: 58921 - protein, 9 aa, Dengue virus
WASVKKDLI

SEQ ID NO: 58922 - protein, 9 aa, Dengue virus
ASVKKDLIS

SEQ ID NO: 58923 - protein, 9 aa, Dengue virus
SVKKDLISY

SEQ ID NO: 58924 - protein, 9 aa, Dengue virus
VKKDLISYG

SEQ ID NO: 58925 - protein, 9 aa, Dengue virus
KKDLISYGG

SEQ ID NO: 58926 - protein, 9 aa, Dengue virus
KDLISYGGG

SEQ ID NO: 58927 - protein, 9 aa, Dengue virus
DLISYGGGW

SEQ ID NO: 58928 - protein, 9 aa, Dengue virus
LISYGGGWR

SEQ ID NO: 58929 - protein, 9 aa, Dengue virus
ISYGGGWRL

SEQ ID NO: 58930 - protein, 9 aa, Dengue virus
SYGGGWRLS

SEQ ID NO: 58931 - protein, 9 aa, Dengue virus
YGGGWRLSA

SEQ ID NO: 58932 - protein, 9 aa, Dengue virus
GGGWRLSAQ

SEQ ID NO: 58933 - protein, 9 aa, Dengue virus
GGWRLSAQW

SEQ ID NO: 58934 - protein, 9 aa, Dengue virus
GWRLSAQWQ

SEQ ID NO: 58935 - protein, 9 aa, Dengue virus
WRLSAQWQK

SEQ ID NO: 58936 - protein, 9 aa, Dengue virus
RLSAQWQKG

SEQ ID NO: 58937 - protein, 9 aa, Dengue virus
LSAQWQKGE

SEQ ID NO: 58938 - protein, 9 aa, Dengue virus
SAQWQKGEE

SEQ ID NO: 58939 - protein, 9 aa, Dengue virus
AQWQKGEEV

SEQ ID NO: 58940 - protein, 9 aa, Dengue virus
QWQKGEEVQ

SEQ ID NO: 58941 - protein, 9 aa, Dengue virus
WQKGEEVQV

SEQ ID NO: 58942 - protein, 9 aa, Dengue virus
QKGEEVQVI

SEQ ID NO: 58943 - protein, 9 aa, Dengue virus
KGEEVQVIA

SEQ ID NO: 58944 - protein, 9 aa, Dengue virus
GEEVQVIAV

SEQ ID NO: 58945 - protein, 9 aa, Dengue virus
EEVQVIAVE

SEQ ID NO: 58946 - protein, 9 aa, Dengue virus
EVQVIAVEP

SEQ ID NO: 58947 - protein, 9 aa, Dengue virus
VQVIAVEPG

SEQ ID NO: 58948 - protein, 9 aa, Dengue virus
QVIAVEPGK

SEQ ID NO: 58949 - protein, 9 aa, Dengue virus
VIAVEPGKN

SEQ ID NO: 58950 - protein, 9 aa, Dengue virus
IAVEPGKNP

SEQ ID NO: 58951 - protein, 9 aa, Dengue virus
AVEPGKNPK

SEQ ID NO: 58952 - protein, 9 aa, Dengue virus
VEPGKNPKN

SEQ ID NO: 58953 - protein, 9 aa, Dengue virus
EPGKNPKNF

SEQ ID NO: 58954 - protein, 9 aa, Dengue virus
PGKNPKNFQ

SEQ ID NO: 58955 - protein, 9 aa, Dengue virus
GKNPKNFQT

SEQ ID NO: 58956 - protein, 9 aa, Dengue virus
KNPKNFQTM

SEQ ID NO: 58957 - protein, 9 aa, Dengue virus
NPKNFQTMP

SEQ ID NO: 58958 - protein, 9 aa, Dengue virus
PKNFQTMPG

SEQ ID NO: 58959 - protein, 9 aa, Dengue virus
KNFQTMPGT

SEQ ID NO: 58960 - protein, 9 aa, Dengue virus
NFQTMPGTF

SEQ ID NO: 58961 - protein, 9 aa, Dengue virus
FQTMPGTFQ

SEQ ID NO: 58962 - protein, 9 aa, Dengue virus
QTMPGTFQT

SEQ ID NO: 58963 - protein, 9 aa, Dengue virus
TMPGTFQTT

SEQ ID NO: 58964 - protein, 9 aa, Dengue virus
PGTFQTTTG

SEQ ID NO: 58965 - protein, 9 aa, Dengue virus
GTFQTTTGE

SEQ ID NO: 58966 - protein, 9 aa, Dengue virus
TFQTTTGEI

SEQ ID NO: 58967 - protein, 9 aa, Dengue virus
FQTTTGEIG

SEQ ID NO: 58968 - protein, 9 aa, Dengue virus
QTTTGEIGA

SEQ ID NO: 58969 - protein, 9 aa, Dengue virus
TTTGEIGAI

SEQ ID NO: 58970 - protein, 9 aa, Dengue virus
TTGEIGAIA

SEQ ID NO: 58971 - protein, 9 aa, Dengue virus
TGEIGAIAL

SEQ ID NO: 58972 - protein, 9 aa, Dengue virus
GEIGAIALD

SEQ ID NO: 58973 - protein, 9 aa, Dengue virus
EIGAIALDF

SEQ ID NO: 58974 - protein, 9 aa, Dengue virus
IGAIALDFK

SEQ ID NO: 58975 - protein, 9 aa, Dengue virus
GAIALDFKP

SEQ ID NO: 58976 - protein, 9 aa, Dengue virus
AIALDFKPG

SEQ ID NO: 58977 - protein, 9 aa, Dengue virus
IALDFKPGT

SEQ ID NO: 58978 - protein, 9 aa, Dengue virus
ALDFKPGTS

SEQ ID NO: 58979 - protein, 9 aa, Dengue virus
LDFKPGTSG

SEQ ID NO: 58980 - protein, 9 aa, Dengue virus
DFKPGTSGS

SEQ ID NO: 58981 - protein, 9 aa, Dengue virus
FKPGTSGSP

SEQ ID NO: 58982 - protein, 9 aa, Dengue virus
KPGTSGSPI

SEQ ID NO: 58983 - protein, 9 aa, Dengue virus
PGTSGSPII

SEQ ID NO: 58984 - protein, 9 aa, Dengue virus
GTSGSPIIN

SEQ ID NO: 58985 - protein, 9 aa, Dengue virus
TSGSPIINR

SEQ ID NO: 58986 - protein, 9 aa, Dengue virus
SGSPIINRE

SEQ ID NO: 58987 - protein, 9 aa, Dengue virus
GSPIINREG

SEQ ID NO: 58988 - protein, 9 aa, Dengue virus
SPIINREGK

SEQ ID NO: 58989 - protein, 9 aa, Dengue virus
PIINREGKV

SEQ ID NO: 58990 - protein, 9 aa, Dengue virus
IINREGKVV

SEQ ID NO: 58991 - protein, 9 aa, Dengue virus
INREGKVVG

SEQ ID NO: 58992 - protein, 9 aa, Dengue virus
NREGKVVGL

SEQ ID NO: 58993 - protein, 9 aa, Dengue virus
REGKVVGLY

SEQ ID NO: 58994 - protein, 9 aa, Dengue virus
EGKVVGLYG

SEQ ID NO: 58995 - protein, 9 aa, Dengue virus
GKVVGLYGN

SEQ ID NO: 58996 - protein, 9 aa, Dengue virus
KVVGLYGNG

SEQ ID NO: 58997 - protein, 9 aa, Dengue virus
VVGLYGNGV

SEQ ID NO: 58998 - protein, 9 aa, Dengue virus
VGLYGNGVV

SEQ ID NO: 58999 - protein, 9 aa, Dengue virus
GLYGNGVVT

SEQ ID NO: 59000 - protein, 9 aa, Dengue virus
LYGNGVVTK

SEQ ID NO: 59001 - protein, 9 aa, Dengue virus
YGNGVVTKN

SEQ ID NO: 59002 - protein, 9 aa, Dengue virus
GNGVVTKNG

SEQ ID NO: 59003 - protein, 9 aa, Dengue virus
NGVVTKNGG

SEQ ID NO: 59004 - protein, 9 aa, Dengue virus
GVVTKNGGY

SEQ ID NO: 59005 - protein, 9 aa, Dengue virus
VVTKNGGYV

SEQ ID NO: 59006 - protein, 9 aa, Dengue virus
VTKNGGYVS

SEQ ID NO: 59007 - protein, 9 aa, Dengue virus
TKNGGYVSG

SEQ ID NO: 59008 - protein, 9 aa, Dengue virus
KNGGYVSGI

SEQ ID NO: 59009 - protein, 9 aa, Dengue virus
NGGYVSGIA

SEQ ID NO: 59010 - protein, 9 aa, Dengue virus
GGYVSGIAQ

SEQ ID NO: 59011 - protein, 9 aa, Dengue virus
GYVSGIAQT

SEQ ID NO: 59012 - protein, 9 aa, Dengue virus
YVSGIAQTN

SEQ ID NO: 59013 - protein, 9 aa, Dengue virus
VSGIAQTNA

SEQ ID NO: 59014 - protein, 9 aa, Dengue virus
SGIAQTNAE

SEQ ID NO: 59015 - protein, 9 aa, Dengue virus
GIAQTNAEP

SEQ ID NO: 59016 - protein, 9 aa, Dengue virus
IAQTNAEPD

SEQ ID NO: 59017 - protein, 9 aa, Dengue virus
AQTNAEPDG

SEQ ID NO: 59018 - protein, 9 aa, Dengue virus
QTNAEPDGP

SEQ ID NO: 59019 - protein, 9 aa, Dengue virus
TNAEPDGPT

SEQ ID NO: 59020 - protein, 9 aa, Dengue virus
NAEPDGPTP

SEQ ID NO: 59021 - protein, 9 aa, Dengue virus
AEPDGPTPE

SEQ ID NO: 59022 - protein, 9 aa, Dengue virus
EPDGPTPEL

SEQ ID NO: 59023 - protein, 9 aa, Dengue virus
PDGPTPELE

SEQ ID NO: 59024 - protein, 9 aa, Dengue virus
DGPTPELEE

SEQ ID NO: 59025 - protein, 9 aa, Dengue virus
GPTPELEEE

SEQ ID NO: 59026 - protein, 9 aa, Dengue virus
PTPELEEEM

SEQ ID NO: 59027 - protein, 9 aa, Dengue virus
TPELEEEMF

SEQ ID NO: 59028 - protein, 9 aa, Dengue virus
PELEEEMFK

SEQ ID NO: 59029 - protein, 9 aa, Dengue virus
ELEEEMFKK

SEQ ID NO: 59030 - protein, 9 aa, Dengue virus
LEEEMFKKR

SEQ ID NO: 59031 - protein, 9 aa, Dengue virus
EEEMFKKRN

SEQ ID NO: 59032 - protein, 9 aa, Dengue virus
EEMFKKRNL

SEQ ID NO: 59033 - protein, 9 aa, Dengue virus
EMFKKRNLT

SEQ ID NO: 59034 - protein, 9 aa, Dengue virus
MFKKRNLTI

SEQ ID NO: 59035 - protein, 9 aa, Dengue virus
FKKRNLTIM

SEQ ID NO: 59036 - protein, 9 aa, Dengue virus
KKRNLTIMD

SEQ ID NO: 59037 - protein, 9 aa, Dengue virus
KRNLTIMDL

SEQ ID NO: 59038 - protein, 9 aa, Dengue virus
RNLTIMDLH

SEQ ID NO: 59039 - protein, 9 aa, Dengue virus
NLTIMDLHP

SEQ ID NO: 59040 - protein, 9 aa, Dengue virus
LTIMDLHPG

SEQ ID NO: 59041 - protein, 9 aa, Dengue virus
TIMDLHPGS

SEQ ID NO: 59042 - protein, 9 aa, Dengue virus
IMDLHPGSG

SEQ ID NO: 59043 - protein, 9 aa, Dengue virus
MDLHPGSGK

SEQ ID NO: 59044 - protein, 9 aa, Dengue virus
DLHPGSGKT

SEQ ID NO: 59045 - protein, 9 aa, Dengue virus
LHPGSGKTR

SEQ ID NO: 59046 - protein, 9 aa, Dengue virus
HPGSGKTRK

SEQ ID NO: 59047 - protein, 9 aa, Dengue virus
PGSGKTRKY

SEQ ID NO: 59048 - protein, 9 aa, Dengue virus
GSGKTRKYL

SEQ ID NO: 59049 - protein, 9 aa, Dengue virus
SGKTRKYLP

SEQ ID NO: 59050 - protein, 9 aa, Dengue virus
GKTRKYLPA

SEQ ID NO: 59051 - protein, 9 aa, Dengue virus
KTRKYLPAI

SEQ ID NO: 59052 - protein, 9 aa, Dengue virus
TRKYLPAIV

SEQ ID NO: 59053 - protein, 9 aa, Dengue virus
RKYLPAIVR

SEQ ID NO: 59054 - protein, 9 aa, Dengue virus
KYLPAIVRE

SEQ ID NO: 59055 - protein, 9 aa, Dengue virus
YLPAIVREA

SEQ ID NO: 59056 - protein, 9 aa, Dengue virus
LPAIVREAI

SEQ ID NO: 59057 - protein, 9 aa, Dengue virus
PAIVREAIK

SEQ ID NO: 59058 - protein, 9 aa, Dengue virus
AIVREAIKR

SEQ ID NO: 59059 - protein, 9 aa, Dengue virus
IVREAIKRR

SEQ ID NO: 59060 - protein, 9 aa, Dengue virus
VREAIKRRL

SEQ ID NO: 59061 - protein, 9 aa, Dengue virus
REAIKRRLR

SEQ ID NO: 59062 - protein, 9 aa, Dengue virus
EAIKRRLRT

SEQ ID NO: 59063 - protein, 9 aa, Dengue virus
AIKRRLRTL

SEQ ID NO: 59064 - protein, 9 aa, Dengue virus
IKRRLRTLI

SEQ ID NO: 59065 - protein, 9 aa, Dengue virus
KRRLRTLIL

SEQ ID NO: 59066 - protein, 9 aa, Dengue virus
RRLRTLILA

SEQ ID NO: 59067 - protein, 9 aa, Dengue virus
RLRTLILAP

SEQ ID NO: 59068 - protein, 9 aa, Dengue virus
LRTLILAPT

SEQ ID NO: 59069 - protein, 9 aa, Dengue virus
RTLILAPTR

SEQ ID NO: 59070 - protein, 9 aa, Dengue virus
TLILAPTRV

SEQ ID NO: 59071 - protein, 9 aa, Dengue virus
LILAPTRVV

SEQ ID NO: 59072 - protein, 9 aa, Dengue virus
ILAPTRVVA

SEQ ID NO: 59073 - protein, 9 aa, Dengue virus
LAPTRVVAA

SEQ ID NO: 59074 - protein, 9 aa, Dengue virus
APTRVVAAE

SEQ ID NO: 59075 - protein, 9 aa, Dengue virus
PTRVVAAEM

SEQ ID NO: 59076 - protein, 9 aa, Dengue virus
TRVVAAEME

SEQ ID NO: 59077 - protein, 9 aa, Dengue virus
RVVAAEMEE

SEQ ID NO: 59078 - protein, 9 aa, Dengue virus
VVAAEMEEA

SEQ ID NO: 59079 - protein, 9 aa, Dengue virus
VAAEMEEAL

SEQ ID NO: 59080 - protein, 9 aa, Dengue virus
AAEMEEALK

SEQ ID NO: 59081 - protein, 9 aa, Dengue virus
AEMEEALKG

SEQ ID NO: 59082 - protein, 9 aa, Dengue virus
EMEEALKGL

SEQ ID NO: 59083 - protein, 9 aa, Dengue virus
MEEALKGLP

SEQ ID NO: 59084 - protein, 9 aa, Dengue virus
EEALKGLPI

SEQ ID NO: 59085 - protein, 9 aa, Dengue virus
EALKGLPIR

SEQ ID NO: 59086 - protein, 9 aa, Dengue virus
ALKGLPIRY

SEQ ID NO: 59087 - protein, 9 aa, Dengue virus
LKGLPIRYQ

SEQ ID NO: 59088 - protein, 9 aa, Dengue virus
KGLPIRYQT

SEQ ID NO: 59089 - protein, 9 aa, Dengue virus
GLPIRYQTT

SEQ ID NO: 59090 - protein, 9 aa, Dengue virus
LPIRYQTTA

SEQ ID NO: 59091 - protein, 9 aa, Dengue virus
PIRYQTTAT

SEQ ID NO: 59092 - protein, 9 aa, Dengue virus
IRYQTTATK

SEQ ID NO: 59093 - protein, 9 aa, Dengue virus
RYQTTATKS

SEQ ID NO: 59094 - protein, 9 aa, Dengue virus
YQTTATKSE

SEQ ID NO: 59095 - protein, 9 aa, Dengue virus
QTTATKSEH

SEQ ID NO: 59096 - protein, 9 aa, Dengue virus
TTATKSEHT

SEQ ID NO: 59097 - protein, 9 aa, Dengue virus
TATKSEHTG

SEQ ID NO: 59098 - protein, 9 aa, Dengue virus
ATKSEHTGR

SEQ ID NO: 59099 - protein, 9 aa, Dengue virus
TKSEHTGRE

SEQ ID NO: 59100 - protein, 9 aa, Dengue virus
KSEHTGREI

SEQ ID NO: 59101 - protein, 9 aa, Dengue virus
SEHTGREIV

SEQ ID NO: 59102 - protein, 9 aa, Dengue virus
EHTGREIVD

SEQ ID NO: 59103 - protein, 9 aa, Dengue virus
HTGREIVDL

SEQ ID NO: 59104 - protein, 9 aa, Dengue virus
TGREIVDLM

SEQ ID NO: 59105 - protein, 9 aa, Dengue virus
GREIVDLMC

SEQ ID NO: 59106 - protein, 9 aa, Dengue virus
REIVDLMCH

SEQ ID NO: 59107 - protein, 9 aa, Dengue virus
EIVDLMCHA

SEQ ID NO: 59108 - protein, 9 aa, Dengue virus
IVDLMCHAT

SEQ ID NO: 59109 - protein, 9 aa, Dengue virus
VDLMCHATF

SEQ ID NO: 59110 - protein, 9 aa, Dengue virus
DLMCHATFT

SEQ ID NO: 59111 - protein, 9 aa, Dengue virus
LMCHATFTM

SEQ ID NO: 59112 - protein, 9 aa, Dengue virus
MCHATFTMR

SEQ ID NO: 59113 - protein, 9 aa, Dengue virus
CHATFTMRL

SEQ ID NO: 59114 - protein, 9 aa, Dengue virus
HATFTMRLL

SEQ ID NO: 59115 - protein, 9 aa, Dengue virus
ATFTMRLLS

SEQ ID NO: 59116 - protein, 9 aa, Dengue virus
TFTMRLLSP

SEQ ID NO: 59117 - protein, 9 aa, Dengue virus
FTMRLLSPV

SEQ ID NO: 59118 - protein, 9 aa, Dengue virus
TMRLLSPVR

SEQ ID NO: 59119 - protein, 9 aa, Dengue virus
MRLLSPVRV

SEQ ID NO: 59120 - protein, 9 aa, Dengue virus
RLLSPVRVP

SEQ ID NO: 59121 - protein, 9 aa, Dengue virus
LLSPVRVPN

SEQ ID NO: 59122 - protein, 9 aa, Dengue virus
LSPVRVPNY

SEQ ID NO: 59123 - protein, 9 aa, Dengue virus
SPVRVPNYN

SEQ ID NO: 59124 - protein, 9 aa, Dengue virus
PVRVPNYNL

SEQ ID NO: 59125 - protein, 9 aa, Dengue virus
VRVPNYNLI

SEQ ID NO: 59126 - protein, 9 aa, Dengue virus
RVPNYNLII

SEQ ID NO: 59127 - protein, 9 aa, Dengue virus
VPNYNLIIM

SEQ ID NO: 59128 - protein, 9 aa, Dengue virus
PNYNLIIMD

SEQ ID NO: 59129 - protein, 9 aa, Dengue virus
NYNLIIMDE

SEQ ID NO: 59130 - protein, 9 aa, Dengue virus
YNLIIMDEA

SEQ ID NO: 59131 - protein, 9 aa, Dengue virus
NLIIMDEAH

SEQ ID NO: 59132 - protein, 9 aa, Dengue virus
LIIMDEAHF

SEQ ID NO: 59133 - protein, 9 aa, Dengue virus
IIMDEAHFT

SEQ ID NO: 59134 - protein, 9 aa, Dengue virus
IMDEAHFTD

SEQ ID NO: 59135 - protein, 9 aa, Dengue virus
MDEAHFTDP

SEQ ID NO: 59136 - protein, 9 aa, Dengue virus
DEAHFTDPA

SEQ ID NO: 59137 - protein, 9 aa, Dengue virus
EAHFTDPAS

SEQ ID NO: 59138 - protein, 9 aa, Dengue virus
AHFTDPASI

SEQ ID NO: 59139 - protein, 9 aa, Dengue virus
HFTDPASIA

SEQ ID NO: 59140 - protein, 9 aa, Dengue virus
FTDPASIAA

SEQ ID NO: 59141 - protein, 9 aa, Dengue virus
TDPASIAAR

SEQ ID NO: 59142 - protein, 9 aa, Dengue virus
DPASIAARG

SEQ ID NO: 59143 - protein, 9 aa, Dengue virus
PASIAARGY

SEQ ID NO: 59144 - protein, 9 aa, Dengue virus
ASIAARGYI

SEQ ID NO: 59145 - protein, 9 aa, Dengue virus
SIAARGYIS

SEQ ID NO: 59146 - protein, 9 aa, Dengue virus
IAARGYIST

SEQ ID NO: 59147 - protein, 9 aa, Dengue virus
AARGYISTR

SEQ ID NO: 59148 - protein, 9 aa, Dengue virus
ARGYISTRV

SEQ ID NO: 59149 - protein, 9 aa, Dengue virus
RGYISTRVG

SEQ ID NO: 59150 - protein, 9 aa, Dengue virus
GYISTRVGM

SEQ ID NO: 59151 - protein, 9 aa, Dengue virus
YISTRVGMG

SEQ ID NO: 59152 - protein, 9 aa, Dengue virus
ISTRVGMGE

SEQ ID NO: 59153 - protein, 9 aa, Dengue virus
STRVGMGEA

SEQ ID NO: 59154 - protein, 9 aa, Dengue virus
TRVGMGEAA

SEQ ID NO: 59155 - protein, 9 aa, Dengue virus
RVGMGEAAA

SEQ ID NO: 59156 - protein, 9 aa, Dengue virus
VGMGEAAAI

SEQ ID NO: 59157 - protein, 9 aa, Dengue virus
GMGEAAAIF

SEQ ID NO: 59158 - protein, 9 aa, Dengue virus
MGEAAAIFM

SEQ ID NO: 59159 - protein, 9 aa, Dengue virus
GEAAAIFMT

SEQ ID NO: 59160 - protein, 9 aa, Dengue virus
EAAAIFMTA

SEQ ID NO: 59161 - protein, 9 aa, Dengue virus
AAAIFMTAT

SEQ ID NO: 59162 - protein, 9 aa, Dengue virus
AAIFMTATP

SEQ ID NO: 59163 - protein, 9 aa, Dengue virus
AIFMTATPP

SEQ ID NO: 59164 - protein, 9 aa, Dengue virus
IFMTATPPG

SEQ ID NO: 59165 - protein, 9 aa, Dengue virus
FMTATPPGT

SEQ ID NO: 59166 - protein, 9 aa, Dengue virus
MTATPPGTA

SEQ ID NO: 59167 - protein, 9 aa, Dengue virus
TATPPGTAD

SEQ ID NO: 59168 - protein, 9 aa, Dengue virus
ATPPGTADA

SEQ ID NO: 59169 - protein, 9 aa, Dengue virus
TPPGTADAF

SEQ ID NO: 59170 - protein, 9 aa, Dengue virus
PPGTADAFP

SEQ ID NO: 59171 - protein, 9 aa, Dengue virus
PGTADAFPQ

SEQ ID NO: 59172 - protein, 9 aa, Dengue virus
GTADAFPQS

SEQ ID NO: 59173 - protein, 9 aa, Dengue virus
TADAFPQSN

SEQ ID NO: 59174 - protein, 9 aa, Dengue virus
ADAFPQSNA

SEQ ID NO: 59175 - protein, 9 aa, Dengue virus
DAFPQSNAP

SEQ ID NO: 59176 - protein, 9 aa, Dengue virus
AFPQSNAPI

SEQ ID NO: 59177 - protein, 9 aa, Dengue virus
FPQSNAPIQ

SEQ ID NO: 59178 - protein, 9 aa, Dengue virus
PQSNAPIQD

SEQ ID NO: 59179 - protein, 9 aa, Dengue virus
QSNAPIQDE

SEQ ID NO: 59180 - protein, 9 aa, Dengue virus
SNAPIQDEE

SEQ ID NO: 59181 - protein, 9 aa, Dengue virus
NAPIQDEER

SEQ ID NO: 59182 - protein, 9 aa, Dengue virus
APIQDEERD

SEQ ID NO: 59183 - protein, 9 aa, Dengue virus
PIQDEERDI

SEQ ID NO: 59184 - protein, 9 aa, Dengue virus
IQDEERDIP

SEQ ID NO: 59185 - protein, 9 aa, Dengue virus
QDEERDIPE

SEQ ID NO: 59186 - protein, 9 aa, Dengue virus
DEERDIPER

SEQ ID NO: 59187 - protein, 9 aa, Dengue virus
EERDIPERS

SEQ ID NO: 59188 - protein, 9 aa, Dengue virus
ERDIPERSW

SEQ ID NO: 59189 - protein, 9 aa, Dengue virus
RDIPERSWN

SEQ ID NO: 59190 - protein, 9 aa, Dengue virus
DIPERSWNS

SEQ ID NO: 59191 - protein, 9 aa, Dengue virus
IPERSWNSG

SEQ ID NO: 59192 - protein, 9 aa, Dengue virus
PERSWNSGN

SEQ ID NO: 59193 - protein, 9 aa, Dengue virus
ERSWNSGNE

SEQ ID NO: 59194 - protein, 9 aa, Dengue virus
RSWNSGNEW

SEQ ID NO: 59195 - protein, 9 aa, Dengue virus
SWNSGNEWI

SEQ ID NO: 59196 - protein, 9 aa, Dengue virus
WNSGNEWIT

SEQ ID NO: 59197 - protein, 9 aa, Dengue virus
NSGNEWITD

SEQ ID NO: 59198 - protein, 9 aa, Dengue virus
SGNEWITDF

SEQ ID NO: 59199 - protein, 9 aa, Dengue virus
GNEWITDFA

SEQ ID NO: 59200 - protein, 9 aa, Dengue virus
NEWITDFAG

SEQ ID NO: 59201 - protein, 9 aa, Dengue virus
EWITDFAGK

SEQ ID NO: 59202 - protein, 9 aa, Dengue virus
WITDFAGKT

SEQ ID NO: 59203 - protein, 9 aa, Dengue virus
ITDFAGKTV

SEQ ID NO: 59204 - protein, 9 aa, Dengue virus
TDFAGKTVW

SEQ ID NO: 59205 - protein, 9 aa, Dengue virus
DFAGKTVWF

SEQ ID NO: 59206 - protein, 9 aa, Dengue virus
FAGKTVWFV

SEQ ID NO: 59207 - protein, 9 aa, Dengue virus
AGKTVWFVP

SEQ ID NO: 59208 - protein, 9 aa, Dengue virus
GKTVWFVPS

SEQ ID NO: 59209 - protein, 9 aa, Dengue virus
KTVWFVPSI

SEQ ID NO: 59210 - protein, 9 aa, Dengue virus
TVWFVPSIK

SEQ ID NO: 59211 - protein, 9 aa, Dengue virus
VWFVPSIKA

SEQ ID NO: 59212 - protein, 9 aa, Dengue virus
WFVPSIKAG

SEQ ID NO: 59213 - protein, 9 aa, Dengue virus
FVPSIKAGN

SEQ ID NO: 59214 - protein, 9 aa, Dengue virus
VPSIKAGND

SEQ ID NO: 59215 - protein, 9 aa, Dengue virus
PSIKAGNDI

SEQ ID NO: 59216 - protein, 9 aa, Dengue virus
SIKAGNDIA

SEQ ID NO: 59217 - protein, 9 aa, Dengue virus
IKAGNDIAN

SEQ ID NO: 59218 - protein, 9 aa, Dengue virus
KAGNDIANC

SEQ ID NO: 59219 - protein, 9 aa, Dengue virus
AGNDIANCL

SEQ ID NO: 59220 - protein, 9 aa, Dengue virus
GNDIANCLR

SEQ ID NO: 59221 - protein, 9 aa, Dengue virus
NDIANCLRK

SEQ ID NO: 59222 - protein, 9 aa, Dengue virus
DIANCLRKN

SEQ ID NO: 59223 - protein, 9 aa, Dengue virus
IANCLRKNG

SEQ ID NO: 59224 - protein, 9 aa, Dengue virus
ANCLRKNGK

SEQ ID NO: 59225 - protein, 9 aa, Dengue virus
NCLRKNGKK

SEQ ID NO: 59226 - protein, 9 aa, Dengue virus
CLRKNGKKV

SEQ ID NO: 59227 - protein, 9 aa, Dengue virus
LRKNGKKVI

SEQ ID NO: 59228 - protein, 9 aa, Dengue virus
RKNGKKVIQ

SEQ ID NO: 59229 - protein, 9 aa, Dengue virus
KNGKKVIQL

SEQ ID NO: 59230 - protein, 9 aa, Dengue virus
NGKKVIQLS

SEQ ID NO: 59231 - protein, 9 aa, Dengue virus
GKKVIQLSR

SEQ ID NO: 59232 - protein, 9 aa, Dengue virus
KKVIQLSRK

SEQ ID NO: 59233 - protein, 9 aa, Dengue virus
KVIQLSRKT

SEQ ID NO: 59234 - protein, 9 aa, Dengue virus
VIQLSRKTF

SEQ ID NO: 59235 - protein, 9 aa, Dengue virus
IQLSRKTFD

SEQ ID NO: 59236 - protein, 9 aa, Dengue virus
QLSRKTFDT

SEQ ID NO: 59237 - protein, 9 aa, Dengue virus
LSRKTFDTE

SEQ ID NO: 59238 - protein, 9 aa, Dengue virus
SRKTFDTEY

SEQ ID NO: 59239 - protein, 9 aa, Dengue virus
RKTFDTEYQ

SEQ ID NO: 59240 - protein, 9 aa, Dengue virus
KTFDTEYQK

SEQ ID NO: 59241 - protein, 9 aa, Dengue virus
TFDTEYQKT

SEQ ID NO: 59242 - protein, 9 aa, Dengue virus
FDTEYQKTK

SEQ ID NO: 59243 - protein, 9 aa, Dengue virus
DTEYQKTKL

SEQ ID NO: 59244 - protein, 9 aa, Dengue virus
TEYQKTKLN

SEQ ID NO: 59245 - protein, 9 aa, Dengue virus
EYQKTKLND

SEQ ID NO: 59246 - protein, 9 aa, Dengue virus
YQKTKLNDW

SEQ ID NO: 59247 - protein, 9 aa, Dengue virus
QKTKLNDWD

SEQ ID NO: 59248 - protein, 9 aa, Dengue virus
KTKLNDWDF

SEQ ID NO: 59249 - protein, 9 aa, Dengue virus
TKLNDWDFV

SEQ ID NO: 59250 - protein, 9 aa, Dengue virus
KLNDWDFVV

SEQ ID NO: 59251 - protein, 9 aa, Dengue virus
LNDWDFVVT

SEQ ID NO: 59252 - protein, 9 aa, Dengue virus
NDWDFVVTT

SEQ ID NO: 59253 - protein, 9 aa, Dengue virus
DWDFVVTTD

SEQ ID NO: 59254 - protein, 9 aa, Dengue virus
WDFVVTTDI

SEQ ID NO: 59255 - protein, 9 aa, Dengue virus
DFVVTTDIS

SEQ ID NO: 59256 - protein, 9 aa, Dengue virus
FVVTTDISE

SEQ ID NO: 59257 - protein, 9 aa, Dengue virus
VVTTDISEM

SEQ ID NO: 59258 - protein, 9 aa, Dengue virus
VTTDISEMG

SEQ ID NO: 59259 - protein, 9 aa, Dengue virus
TTDISEMGA

SEQ ID NO: 59260 - protein, 9 aa, Dengue virus
TDISEMGAN

SEQ ID NO: 59261 - protein, 9 aa, Dengue virus
DISEMGANF

SEQ ID NO: 59262 - protein, 9 aa, Dengue virus
ISEMGANFK

SEQ ID NO: 59263 - protein, 9 aa, Dengue virus
SEMGANFKA

SEQ ID NO: 59264 - protein, 9 aa, Dengue virus
EMGANFKAD

SEQ ID NO: 59265 - protein, 9 aa, Dengue virus
MGANFKADR

SEQ ID NO: 59266 - protein, 9 aa, Dengue virus
GANFKADRV

SEQ ID NO: 59267 - protein, 9 aa, Dengue virus
ANFKADRVI

SEQ ID NO: 59268 - protein, 9 aa, Dengue virus
NFKADRVID

SEQ ID NO: 59269 - protein, 9 aa, Dengue virus
FKADRVIDP

SEQ ID NO: 59270 - protein, 9 aa, Dengue virus
KADRVIDPR

SEQ ID NO: 59271 - protein, 9 aa, Dengue virus
ADRVIDPRR

SEQ ID NO: 59272 - protein, 9 aa, Dengue virus
DRVIDPRRC

SEQ ID NO: 59273 - protein, 9 aa, Dengue virus
RVIDPRRCL

SEQ ID NO: 59274 - protein, 9 aa, Dengue virus
VIDPRRCLK

SEQ ID NO: 59275 - protein, 9 aa, Dengue virus
IDPRRCLKP

SEQ ID NO: 59276 - protein, 9 aa, Dengue virus
DPRRCLKPV

SEQ ID NO: 59277 - protein, 9 aa, Dengue virus
PRRCLKPVI

SEQ ID NO: 59278 - protein, 9 aa, Dengue virus
RRCLKPVIL

SEQ ID NO: 59279 - protein, 9 aa, Dengue virus
RCLKPVILT

SEQ ID NO: 59280 - protein, 9 aa, Dengue virus
CLKPVILTD

SEQ ID NO: 59281 - protein, 9 aa, Dengue virus
LKPVILTDG

SEQ ID NO: 59282 - protein, 9 aa, Dengue virus
KPVILTDGP

SEQ ID NO: 59283 - protein, 9 aa, Dengue virus
PVILTDGPE

SEQ ID NO: 59284 - protein, 9 aa, Dengue virus
VILTDGPER

SEQ ID NO: 59285 - protein, 9 aa, Dengue virus
ILTDGPERV

SEQ ID NO: 59286 - protein, 9 aa, Dengue virus
LTDGPERVI

SEQ ID NO: 59287 - protein, 9 aa, Dengue virus
TDGPERVIL

SEQ ID NO: 59288 - protein, 9 aa, Dengue virus
DGPERVILA

SEQ ID NO: 59289 - protein, 9 aa, Dengue virus
GPERVILAG

SEQ ID NO: 59290 - protein, 9 aa, Dengue virus
PERVILAGP

SEQ ID NO: 59291 - protein, 9 aa, Dengue virus
ERVILAGPM

SEQ ID NO: 59292 - protein, 9 aa, Dengue virus
RVILAGPMP

SEQ ID NO: 59293 - protein, 9 aa, Dengue virus
VILAGPMPV

SEQ ID NO: 59294 - protein, 9 aa, Dengue virus
ILAGPMPVT

SEQ ID NO: 59295 - protein, 9 aa, Dengue virus
LAGPMPVTA

SEQ ID NO: 59296 - protein, 9 aa, Dengue virus
AGPMPVTAA

SEQ ID NO: 59297 - protein, 9 aa, Dengue virus
GPMPVTAAS

SEQ ID NO: 59298 - protein, 9 aa, Dengue virus
PMPVTAASA

SEQ ID NO: 59299 - protein, 9 aa, Dengue virus
MPVTAASAA

SEQ ID NO: 59300 - protein, 9 aa, Dengue virus
PVTAASAAQ

SEQ ID NO: 59301 - protein, 9 aa, Dengue virus
VTAASAAQR

SEQ ID NO: 59302 - protein, 9 aa, Dengue virus
TAASAAQRR

SEQ ID NO: 59303 - protein, 9 aa, Dengue virus
AASAAQRRG

SEQ ID NO: 59304 - protein, 9 aa, Dengue virus
ASAAQRRGR

SEQ ID NO: 59305 - protein, 9 aa, Dengue virus
SAAQRRGRV

SEQ ID NO: 59306 - protein, 9 aa, Dengue virus
AAQRRGRVG

SEQ ID NO: 59307 - protein, 9 aa, Dengue virus
AQRRGRVGR

SEQ ID NO: 59308 - protein, 9 aa, Dengue virus
QRRGRVGRN

SEQ ID NO: 59309 - protein, 9 aa, Dengue virus
RRGRVGRNP

SEQ ID NO: 59310 - protein, 9 aa, Dengue virus
RGRVGRNPQ

SEQ ID NO: 59311 - protein, 9 aa, Dengue virus
GRVGRNPQK

SEQ ID NO: 59312 - protein, 9 aa, Dengue virus
RVGRNPQKE

SEQ ID NO: 59313 - protein, 9 aa, Dengue virus
VGRNPQKEN

SEQ ID NO: 59314 - protein, 9 aa, Dengue virus
GRNPQKEND

SEQ ID NO: 59315 - protein, 9 aa, Dengue virus
RNPQKENDQ

SEQ ID NO: 59316 - protein, 9 aa, Dengue virus
NPQKENDQY

SEQ ID NO: 59317 - protein, 9 aa, Dengue virus
PQKENDQYI

SEQ ID NO: 59318 - protein, 9 aa, Dengue virus
QKENDQYIF

SEQ ID NO: 59319 - protein, 9 aa, Dengue virus
KENDQYIFT

SEQ ID NO: 59320 - protein, 9 aa, Dengue virus
ENDQYIFTG

SEQ ID NO: 59321 - protein, 9 aa, Dengue virus
NDQYIFTGQ

SEQ ID NO: 59322 - protein, 9 aa, Dengue virus
DQYIFTGQP

SEQ ID NO: 59323 - protein, 9 aa, Dengue virus
QYIFTGQPL

SEQ ID NO: 59324 - protein, 9 aa, Dengue virus
YIFTGQPLN

SEQ ID NO: 59325 - protein, 9 aa, Dengue virus
IFTGQPLNN

SEQ ID NO: 59326 - protein, 9 aa, Dengue virus
FTGQPLNND

SEQ ID NO: 59327 - protein, 9 aa, Dengue virus
TGQPLNNDE

SEQ ID NO: 59328 - protein, 9 aa, Dengue virus
GQPLNNDED

SEQ ID NO: 59329 - protein, 9 aa, Dengue virus
QPLNNDEDH

SEQ ID NO: 59330 - protein, 9 aa, Dengue virus
PLNNDEDHA

SEQ ID NO: 59331 - protein, 9 aa, Dengue virus
LNNDEDHAH

SEQ ID NO: 59332 - protein, 9 aa, Dengue virus
NNDEDHAHW

SEQ ID NO: 59333 - protein, 9 aa, Dengue virus
NDEDHAHWT

SEQ ID NO: 59334 - protein, 9 aa, Dengue virus
DEDHAHWTE

SEQ ID NO: 59335 - protein, 9 aa, Dengue virus
EDHAHWTEA

SEQ ID NO: 59336 - protein, 9 aa, Dengue virus
DHAHWTEAK

SEQ ID NO: 59337 - protein, 9 aa, Dengue virus
HAHWTEAKM

SEQ ID NO: 59338 - protein, 9 aa, Dengue virus
AHWTEAKML

SEQ ID NO: 59339 - protein, 9 aa, Dengue virus
HWTEAKMLL

SEQ ID NO: 59340 - protein, 9 aa, Dengue virus
WTEAKMLLD

SEQ ID NO: 59341 - protein, 9 aa, Dengue virus
TEAKMLLDN

SEQ ID NO: 59342 - protein, 9 aa, Dengue virus
EAKMLLDNI

SEQ ID NO: 59343 - protein, 9 aa, Dengue virus
AKMLLDNIN

SEQ ID NO: 59344 - protein, 9 aa, Dengue virus
KMLLDNINT

SEQ ID NO: 59345 - protein, 9 aa, Dengue virus
MLLDNINTP

SEQ ID NO: 59346 - protein, 9 aa, Dengue virus
LLDNINTPE

SEQ ID NO: 59347 - protein, 9 aa, Dengue virus
LDNINTPEG

SEQ ID NO: 59348 - protein, 9 aa, Dengue virus
DNINTPEGI

SEQ ID NO: 59349 - protein, 9 aa, Dengue virus
NINTPEGII

SEQ ID NO: 59350 - protein, 9 aa, Dengue virus
INTPEGIIP

SEQ ID NO: 59351 - protein, 9 aa, Dengue virus
NTPEGIIPA

SEQ ID NO: 59352 - protein, 9 aa, Dengue virus
TPEGIIPAL

SEQ ID NO: 59353 - protein, 9 aa, Dengue virus
PEGIIPALF

SEQ ID NO: 59354 - protein, 9 aa, Dengue virus
EGIIPALFE

SEQ ID NO: 59355 - protein, 9 aa, Dengue virus
GIIPALFEP

SEQ ID NO: 59356 - protein, 9 aa, Dengue virus
IIPALFEPE

SEQ ID NO: 59357 - protein, 9 aa, Dengue virus
IPALFEPER

SEQ ID NO: 59358 - protein, 9 aa, Dengue virus
PALFEPERE

SEQ ID NO: 59359 - protein, 9 aa, Dengue virus
ALFEPEREK

SEQ ID NO: 59360 - protein, 9 aa, Dengue virus
LFEPEREKS

SEQ ID NO: 59361 - protein, 9 aa, Dengue virus
FEPEREKSA

SEQ ID NO: 59362 - protein, 9 aa, Dengue virus
EPEREKSAA

SEQ ID NO: 59363 - protein, 9 aa, Dengue virus
PEREKSAAI

SEQ ID NO: 59364 - protein, 9 aa, Dengue virus
EREKSAAID

SEQ ID NO: 59365 - protein, 9 aa, Dengue virus
REKSAAIDG

SEQ ID NO: 59366 - protein, 9 aa, Dengue virus
EKSAAIDGE

SEQ ID NO: 59367 - protein, 9 aa, Dengue virus
KSAAIDGEY

SEQ ID NO: 59368 - protein, 9 aa, Dengue virus
SAAIDGEYR

SEQ ID NO: 59369 - protein, 9 aa, Dengue virus
AAIDGEYRL

SEQ ID NO: 59370 - protein, 9 aa, Dengue virus
AIDGEYRLK

SEQ ID NO: 59371 - protein, 9 aa, Dengue virus
IDGEYRLKG

SEQ ID NO: 59372 - protein, 9 aa, Dengue virus
DGEYRLKGE

SEQ ID NO: 59373 - protein, 9 aa, Dengue virus
GEYRLKGES

SEQ ID NO: 59374 - protein, 9 aa, Dengue virus
EYRLKGESR

SEQ ID NO: 59375 - protein, 9 aa, Dengue virus
YRLKGESRK

SEQ ID NO: 59376 - protein, 9 aa, Dengue virus
RLKGESRKT

SEQ ID NO: 59377 - protein, 9 aa, Dengue virus
LKGESRKTF

SEQ ID NO: 59378 - protein, 9 aa, Dengue virus
KGESRKTFV

SEQ ID NO: 59379 - protein, 9 aa, Dengue virus
GESRKTFVE

SEQ ID NO: 59380 - protein, 9 aa, Dengue virus
ESRKTFVEL

SEQ ID NO: 59381 - protein, 9 aa, Dengue virus
SRKTFVELM

SEQ ID NO: 59382 - protein, 9 aa, Dengue virus
RKTFVELMR

SEQ ID NO: 59383 - protein, 9 aa, Dengue virus
KTFVELMRR

SEQ ID NO: 59384 - protein, 9 aa, Dengue virus
TFVELMRRG

SEQ ID NO: 59385 - protein, 9 aa, Dengue virus
FVELMRRGD

SEQ ID NO: 59386 - protein, 9 aa, Dengue virus
VELMRRGDL

SEQ ID NO: 59387 - protein, 9 aa, Dengue virus
ELMRRGDLP

SEQ ID NO: 59388 - protein, 9 aa, Dengue virus
LMRRGDLPV

SEQ ID NO: 59389 - protein, 9 aa, Dengue virus
MRRGDLPVW

SEQ ID NO: 59390 - protein, 9 aa, Dengue virus
RRGDLPVWL

SEQ ID NO: 59391 - protein, 9 aa, Dengue virus
RGDLPVWLA

SEQ ID NO: 59392 - protein, 9 aa, Dengue virus
GDLPVWLAH

SEQ ID NO: 59393 - protein, 9 aa, Dengue virus
DLPVWLAHK

SEQ ID NO: 59394 - protein, 9 aa, Dengue virus
LPVWLAHKV

SEQ ID NO: 59395 - protein, 9 aa, Dengue virus
PVWLAHKVA

SEQ ID NO: 59396 - protein, 9 aa, Dengue virus
VWLAHKVAS

SEQ ID NO: 59397 - protein, 9 aa, Dengue virus
WLAHKVASE

SEQ ID NO: 59398 - protein, 9 aa, Dengue virus
LAHKVASEG

SEQ ID NO: 59399 - protein, 9 aa, Dengue virus
AHKVASEGI

SEQ ID NO: 59400 - protein, 9 aa, Dengue virus
HKVASEGIK

SEQ ID NO: 59401 - protein, 9 aa, Dengue virus
KVASEGIKY

SEQ ID NO: 59402 - protein, 9 aa, Dengue virus
VASEGIKYT

SEQ ID NO: 59403 - protein, 9 aa, Dengue virus
ASEGIKYTD

SEQ ID NO: 59404 - protein, 9 aa, Dengue virus
SEGIKYTDR

SEQ ID NO: 59405 - protein, 9 aa, Dengue virus
EGIKYTDRK

SEQ ID NO: 59406 - protein, 9 aa, Dengue virus
GIKYTDRKW

SEQ ID NO: 59407 - protein, 9 aa, Dengue virus
IKYTDRKWC

SEQ ID NO: 59408 - protein, 9 aa, Dengue virus
KYTDRKWCF

SEQ ID NO: 59409 - protein, 9 aa, Dengue virus
YTDRKWCFD

SEQ ID NO: 59410 - protein, 9 aa, Dengue virus
TDRKWCFDG

SEQ ID NO: 59411 - protein, 9 aa, Dengue virus
DRKWCFDGQ

SEQ ID NO: 59412 - protein, 9 aa, Dengue virus
RKWCFDGQR

SEQ ID NO: 59413 - protein, 9 aa, Dengue virus
KWCFDGQRN

SEQ ID NO: 59414 - protein, 9 aa, Dengue virus
WCFDGQRNN

SEQ ID NO: 59415 - protein, 9 aa, Dengue virus
CFDGQRNNQ

SEQ ID NO: 59416 - protein, 9 aa, Dengue virus
FDGQRNNQI

SEQ ID NO: 59417 - protein, 9 aa, Dengue virus
DGQRNNQIL

SEQ ID NO: 59418 - protein, 9 aa, Dengue virus
GQRNNQILE

SEQ ID NO: 59419 - protein, 9 aa, Dengue virus
QRNNQILEE

SEQ ID NO: 59420 - protein, 9 aa, Dengue virus
RNNQILEEN

SEQ ID NO: 59421 - protein, 9 aa, Dengue virus
NNQILEENM

SEQ ID NO: 59422 - protein, 9 aa, Dengue virus
NQILEENMD

SEQ ID NO: 59423 - protein, 9 aa, Dengue virus
QILEENMDV

SEQ ID NO: 59424 - protein, 9 aa, Dengue virus
ILEENMDVE

SEQ ID NO: 59425 - protein, 9 aa, Dengue virus
LEENMDVEI

SEQ ID NO: 59426 - protein, 9 aa, Dengue virus
EENMDVEIW

SEQ ID NO: 59427 - protein, 9 aa, Dengue virus
ENMDVEIWT

SEQ ID NO: 59428 - protein, 9 aa, Dengue virus
NMDVEIWTK

SEQ ID NO: 59429 - protein, 9 aa, Dengue virus
MDVEIWTKE

SEQ ID NO: 59430 - protein, 9 aa, Dengue virus
DVEIWTKEG

SEQ ID NO: 59431 - protein, 9 aa, Dengue virus
VEIWTKEGE

SEQ ID NO: 59432 - protein, 9 aa, Dengue virus
EIWTKEGEK

SEQ ID NO: 59433 - protein, 9 aa, Dengue virus
IWTKEGEKK

SEQ ID NO: 59434 - protein, 9 aa, Dengue virus
WTKEGEKKK

SEQ ID NO: 59435 - protein, 9 aa, Dengue virus
TKEGEKKKL

SEQ ID NO: 59436 - protein, 9 aa, Dengue virus
KEGEKKKLR

SEQ ID NO: 59437 - protein, 9 aa, Dengue virus
EGEKKKLRP

SEQ ID NO: 59438 - protein, 9 aa, Dengue virus
GEKKKLRPR

SEQ ID NO: 59439 - protein, 9 aa, Dengue virus
EKKKLRPRW

SEQ ID NO: 59440 - protein, 9 aa, Dengue virus
KKKLRPRWL

SEQ ID NO: 59441 - protein, 9 aa, Dengue virus
KKLRPRWLD

SEQ ID NO: 59442 - protein, 9 aa, Dengue virus
KLRPRWLDA

SEQ ID NO: 59443 - protein, 9 aa, Dengue virus
LRPRWLDAR

SEQ ID NO: 59444 - protein, 9 aa, Dengue virus
RPRWLDART

SEQ ID NO: 59445 - protein, 9 aa, Dengue virus
PRWLDARTY

SEQ ID NO: 59446 - protein, 9 aa, Dengue virus
RWLDARTYS

SEQ ID NO: 59447 - protein, 9 aa, Dengue virus
WLDARTYSD

SEQ ID NO: 59448 - protein, 9 aa, Dengue virus
LDARTYSDP

SEQ ID NO: 59449 - protein, 9 aa, Dengue virus
DARTYSDPL

SEQ ID NO: 59450 - protein, 9 aa, Dengue virus
ARTYSDPLA

SEQ ID NO: 59451 - protein, 9 aa, Dengue virus
RTYSDPLAL

SEQ ID NO: 59452 - protein, 9 aa, Dengue virus
TYSDPLALK

SEQ ID NO: 59453 - protein, 9 aa, Dengue virus
YSDPLALKE

SEQ ID NO: 59454 - protein, 9 aa, Dengue virus
SDPLALKEF

SEQ ID NO: 59455 - protein, 9 aa, Dengue virus
DPLALKEFK

SEQ ID NO: 59456 - protein, 9 aa, Dengue virus
PLALKEFKD

SEQ ID NO: 59457 - protein, 9 aa, Dengue virus
LALKEFKDF

SEQ ID NO: 59458 - protein, 9 aa, Dengue virus
ALKEFKDFA

SEQ ID NO: 59459 - protein, 9 aa, Dengue virus
LKEFKDFAA

SEQ ID NO: 59460 - protein, 9 aa, Dengue virus
KEFKDFAAG

SEQ ID NO: 59461 - protein, 9 aa, Dengue virus
EFKDFAAGR

SEQ ID NO: 59462 - protein, 9 aa, Dengue virus
FKDFAAGRK

SEQ ID NO: 59463 - protein, 9 aa, Dengue virus
KDFAAGRKS

SEQ ID NO: 59464 - protein, 9 aa, Dengue virus
DFAAGRKSI

SEQ ID NO: 59465 - protein, 9 aa, Dengue virus
FAAGRKSIA

SEQ ID NO: 59466 - protein, 9 aa, Dengue virus
AAGRKSIAL

SEQ ID NO: 59467 - protein, 9 aa, Dengue virus
AGRKSIALD

SEQ ID NO: 59468 - protein, 9 aa, Dengue virus
GRKSIALDL

SEQ ID NO: 59469 - protein, 9 aa, Dengue virus
RKSIALDLV

SEQ ID NO: 59470 - protein, 9 aa, Dengue virus
KSIALDLVT

SEQ ID NO: 59471 - protein, 9 aa, Dengue virus
SIALDLVTE

SEQ ID NO: 59472 - protein, 9 aa, Dengue virus
IALDLVTEI

SEQ ID NO: 59473 - protein, 9 aa, Dengue virus
ALDLVTEIG

SEQ ID NO: 59474 - protein, 9 aa, Dengue virus
LDLVTEIGR

SEQ ID NO: 59475 - protein, 9 aa, Dengue virus
DLVTEIGRV

SEQ ID NO: 59476 - protein, 9 aa, Dengue virus
LVTEIGRVP

SEQ ID NO: 59477 - protein, 9 aa, Dengue virus
VTEIGRVPS

SEQ ID NO: 59478 - protein, 9 aa, Dengue virus
TEIGRVPSH

SEQ ID NO: 59479 - protein, 9 aa, Dengue virus
EIGRVPSHL

SEQ ID NO: 59480 - protein, 9 aa, Dengue virus
IGRVPSHLA

SEQ ID NO: 59481 - protein, 9 aa, Dengue virus
GRVPSHLAH

SEQ ID NO: 59482 - protein, 9 aa, Dengue virus
RVPSHLAHR

SEQ ID NO: 59483 - protein, 9 aa, Dengue virus
VPSHLAHRT

SEQ ID NO: 59484 - protein, 9 aa, Dengue virus
PSHLAHRTR

SEQ ID NO: 59485 - protein, 9 aa, Dengue virus
SHLAHRTRN

SEQ ID NO: 59486 - protein, 9 aa, Dengue virus
HLAHRTRNA

SEQ ID NO: 59487 - protein, 9 aa, Dengue virus
LAHRTRNAL

SEQ ID NO: 59488 - protein, 9 aa, Dengue virus
AHRTRNALD

SEQ ID NO: 59489 - protein, 9 aa, Dengue virus
HRTRNALDN

SEQ ID NO: 59490 - protein, 9 aa, Dengue virus
RTRNALDNL

SEQ ID NO: 59491 - protein, 9 aa, Dengue virus
TRNALDNLV

SEQ ID NO: 59492 - protein, 9 aa, Dengue virus
RNALDNLVM

SEQ ID NO: 59493 - protein, 9 aa, Dengue virus
NALDNLVML

SEQ ID NO: 59494 - protein, 9 aa, Dengue virus
ALDNLVMLH

SEQ ID NO: 59495 - protein, 9 aa, Dengue virus
LDNLVMLHT

SEQ ID NO: 59496 - protein, 9 aa, Dengue virus
DNLVMLHTS

SEQ ID NO: 59497 - protein, 9 aa, Dengue virus
NLVMLHTSE

SEQ ID NO: 59498 - protein, 9 aa, Dengue virus
LVMLHTSEH

SEQ ID NO: 59499 - protein, 9 aa, Dengue virus
VMLHTSEHG

SEQ ID NO: 59500 - protein, 9 aa, Dengue virus
MLHTSEHGG

SEQ ID NO: 59501 - protein, 9 aa, Dengue virus
LHTSEHGGR

SEQ ID NO: 59502 - protein, 9 aa, Dengue virus
HTSEHGGRA

SEQ ID NO: 59503 - protein, 9 aa, Dengue virus
TSEHGGRAY

SEQ ID NO: 59504 - protein, 9 aa, Dengue virus
SEHGGRAYR

SEQ ID NO: 59505 - protein, 9 aa, Dengue virus
EHGGRAYRH

SEQ ID NO: 59506 - protein, 9 aa, Dengue virus
HGGRAYRHA

SEQ ID NO: 59507 - protein, 9 aa, Dengue virus
GGRAYRHAV

SEQ ID NO: 59508 - protein, 9 aa, Dengue virus
GRAYRHAVE

SEQ ID NO: 59509 - protein, 9 aa, Dengue virus
RAYRHAVEE

SEQ ID NO: 59510 - protein, 9 aa, Dengue virus
AYRHAVEEL

SEQ ID NO: 59511 - protein, 9 aa, Dengue virus
YRHAVEELP

SEQ ID NO: 59512 - protein, 9 aa, Dengue virus
RHAVEELPE

SEQ ID NO: 59513 - protein, 9 aa, Dengue virus
HAVEELPET

SEQ ID NO: 59514 - protein, 9 aa, Dengue virus
AVEELPETM

SEQ ID NO: 59515 - protein, 9 aa, Dengue virus
VEELPETME

SEQ ID NO: 59516 - protein, 9 aa, Dengue virus
EELPETMET

SEQ ID NO: 59517 - protein, 9 aa, Dengue virus
ELPETMETL

SEQ ID NO: 59518 - protein, 9 aa, Dengue virus
LPETMETLL

SEQ ID NO: 59519 - protein, 9 aa, Dengue virus
PETMETLLL

SEQ ID NO: 59520 - protein, 9 aa, Dengue virus
ETMETLLLL

SEQ ID NO: 59521 - protein, 9 aa, Dengue virus
TMETLLLLG

SEQ ID NO: 59522 - protein, 9 aa, Dengue virus
METLLLLGL

SEQ ID NO: 59523 - protein, 9 aa, Dengue virus
ETLLLLGLM

SEQ ID NO: 59524 - protein, 9 aa, Dengue virus
TLLLLGLMI

SEQ ID NO: 59525 - protein, 9 aa, Dengue virus
LLLLGLMIL

SEQ ID NO: 59526 - protein, 9 aa, Dengue virus
LLLGLMILL

SEQ ID NO: 59527 - protein, 9 aa, Dengue virus
LLGLMILLT

SEQ ID NO: 59528 - protein, 9 aa, Dengue virus
LGLMILLTG

SEQ ID NO: 59529 - protein, 9 aa, Dengue virus
GLMILLTGG

SEQ ID NO: 59530 - protein, 9 aa, Dengue virus
LMILLTGGA

SEQ ID NO: 59531 - protein, 9 aa, Dengue virus
MILLTGGAM

SEQ ID NO: 59532 - protein, 9 aa, Dengue virus
ILLTGGAML

SEQ ID NO: 59533 - protein, 9 aa, Dengue virus
LLTGGAMLF

SEQ ID NO: 59534 - protein, 9 aa, Dengue virus
LTGGAMLFL

SEQ ID NO: 59535 - protein, 9 aa, Dengue virus
TGGAMLFLI

SEQ ID NO: 59536 - protein, 9 aa, Dengue virus
GGAMLFLIS

SEQ ID NO: 59537 - protein, 9 aa, Dengue virus
GAMLFLISG

SEQ ID NO: 59538 - protein, 9 aa, Dengue virus
AMLFLISGK

SEQ ID NO: 59539 - protein, 9 aa, Dengue virus
MLFLISGKG

SEQ ID NO: 59540 - protein, 9 aa, Dengue virus
LFLISGKGI

SEQ ID NO: 59541 - protein, 9 aa, Dengue virus
FLISGKGIG

SEQ ID NO: 59542 - protein, 9 aa, Dengue virus
LISGKGIGK

SEQ ID NO: 59543 - protein, 9 aa, Dengue virus
ISGKGIGKT

SEQ ID NO: 59544 - protein, 9 aa, Dengue virus
SGKGIGKTS

SEQ ID NO: 59545 - protein, 9 aa, Dengue virus
GKGIGKTSI

SEQ ID NO: 59546 - protein, 9 aa, Dengue virus
KGIGKTSIG

SEQ ID NO: 59547 - protein, 9 aa, Dengue virus
GIGKTSIGL

SEQ ID NO: 59548 - protein, 9 aa, Dengue virus
IGKTSIGLI

SEQ ID NO: 59549 - protein, 9 aa, Dengue virus
GKTSIGLIC

SEQ ID NO: 59550 - protein, 9 aa, Dengue virus
KTSIGLICV

SEQ ID NO: 59551 - protein, 9 aa, Dengue virus
TSIGLICVI

SEQ ID NO: 59552 - protein, 9 aa, Dengue virus
SIGLICVIA

SEQ ID NO: 59553 - protein, 9 aa, Dengue virus
IGLICVIAS

SEQ ID NO: 59554 - protein, 9 aa, Dengue virus
GLICVIASS

SEQ ID NO: 59555 - protein, 9 aa, Dengue virus
LICVIASSG

SEQ ID NO: 59556 - protein, 9 aa, Dengue virus
ICVIASSGM

SEQ ID NO: 59557 - protein, 9 aa, Dengue virus
CVIASSGML

SEQ ID NO: 59558 - protein, 9 aa, Dengue virus
VIASSGMLW

SEQ ID NO: 59559 - protein, 9 aa, Dengue virus
IASSGMLWM

SEQ ID NO: 59560 - protein, 9 aa, Dengue virus
ASSGMLWMA

SEQ ID NO: 59561 - protein, 9 aa, Dengue virus
SSGMLWMAE

SEQ ID NO: 59562 - protein, 9 aa, Dengue virus
SGMLWMAEI

SEQ ID NO: 59563 - protein, 9 aa, Dengue virus
GMLWMAEIP

SEQ ID NO: 59564 - protein, 9 aa, Dengue virus
MLWMAEIPL

SEQ ID NO: 59565 - protein, 9 aa, Dengue virus
LWMAEIPLQ

SEQ ID NO: 59566 - protein, 9 aa, Dengue virus
WMAEIPLQW

SEQ ID NO: 59567 - protein, 9 aa, Dengue virus
MAEIPLQWI

SEQ ID NO: 59568 - protein, 9 aa, Dengue virus
AEIPLQWIA

SEQ ID NO: 59569 - protein, 9 aa, Dengue virus
EIPLQWIAS

SEQ ID NO: 59570 - protein, 9 aa, Dengue virus
IPLQWIASA

SEQ ID NO: 59571 - protein, 9 aa, Dengue virus
PLQWIASAI

SEQ ID NO: 59572 - protein, 9 aa, Dengue virus
LQWIASAIV

SEQ ID NO: 59573 - protein, 9 aa, Dengue virus
QWIASAIVL

SEQ ID NO: 59574 - protein, 9 aa, Dengue virus
WIASAIVLE

SEQ ID NO: 59575 - protein, 9 aa, Dengue virus
IASAIVLEF

SEQ ID NO: 59576 - protein, 9 aa, Dengue virus
ASAIVLEFF

SEQ ID NO: 59577 - protein, 9 aa, Dengue virus
SAIVLEFFM

SEQ ID NO: 59578 - protein, 9 aa, Dengue virus
AIVLEFFMM

SEQ ID NO: 59579 - protein, 9 aa, Dengue virus
IVLEFFMMV

SEQ ID NO: 59580 - protein, 9 aa, Dengue virus
VLEFFMMVL

SEQ ID NO: 59581 - protein, 9 aa, Dengue virus
LEFFMMVLL

SEQ ID NO: 59582 - protein, 9 aa, Dengue virus
EFFMMVLLI

SEQ ID NO: 59583 - protein, 9 aa, Dengue virus
FFMMVLLIP

SEQ ID NO: 59584 - protein, 9 aa, Dengue virus
FMMVLLIPE

SEQ ID NO: 59585 - protein, 9 aa, Dengue virus
MMVLLIPEP

SEQ ID NO: 59586 - protein, 9 aa, Dengue virus
MVLLIPEPE

SEQ ID NO: 59587 - protein, 9 aa, Dengue virus
VLLIPEPEK

SEQ ID NO: 59588 - protein, 9 aa, Dengue virus
LLIPEPEKQ

SEQ ID NO: 59589 - protein, 9 aa, Dengue virus
LIPEPEKQR

SEQ ID NO: 59590 - protein, 9 aa, Dengue virus
IPEPEKQRT

SEQ ID NO: 59591 - protein, 9 aa, Dengue virus
PEPEKQRTP

SEQ ID NO: 59592 - protein, 9 aa, Dengue virus
EPEKQRTPQ

SEQ ID NO: 59593 - protein, 9 aa, Dengue virus
PEKQRTPQD

SEQ ID NO: 59594 - protein, 9 aa, Dengue virus
EKQRTPQDN

SEQ ID NO: 59595 - protein, 9 aa, Dengue virus
KQRTPQDNQ

SEQ ID NO: 59596 - protein, 9 aa, Dengue virus
QRTPQDNQL

SEQ ID NO: 59597 - protein, 9 aa, Dengue virus
RTPQDNQLA

SEQ ID NO: 59598 - protein, 9 aa, Dengue virus
TPQDNQLAY

SEQ ID NO: 59599 - protein, 9 aa, Dengue virus
PQDNQLAYV

SEQ ID NO: 59600 - protein, 9 aa, Dengue virus
QDNQLAYVV

SEQ ID NO: 59601 - protein, 9 aa, Dengue virus
DNQLAYVVI

SEQ ID NO: 59602 - protein, 9 aa, Dengue virus
NQLAYVVIG

SEQ ID NO: 59603 - protein, 9 aa, Dengue virus
QLAYVVIGI

SEQ ID NO: 59604 - protein, 9 aa, Dengue virus
LAYVVIGIL

SEQ ID NO: 59605 - protein, 9 aa, Dengue virus
AYVVIGILT

SEQ ID NO: 59606 - protein, 9 aa, Dengue virus
YVVIGILTL

SEQ ID NO: 59607 - protein, 9 aa, Dengue virus
VVIGILTLA

SEQ ID NO: 59608 - protein, 9 aa, Dengue virus
VIGILTLAA

SEQ ID NO: 59609 - protein, 9 aa, Dengue virus
IGILTLAAI

SEQ ID NO: 59610 - protein, 9 aa, Dengue virus
GILTLAAII

SEQ ID NO: 59611 - protein, 9 aa, Dengue virus
ILTLAAIIA

SEQ ID NO: 59612 - protein, 9 aa, Dengue virus
LTLAAIIAA

SEQ ID NO: 59613 - protein, 9 aa, Dengue virus
TLAAIIAAN

SEQ ID NO: 59614 - protein, 9 aa, Dengue virus
LAAIIAANE

SEQ ID NO: 59615 - protein, 9 aa, Dengue virus
AAIIAANEM

SEQ ID NO: 59616 - protein, 9 aa, Dengue virus
AIIAANEMG

SEQ ID NO: 59617 - protein, 9 aa, Dengue virus
IIAANEMGL

SEQ ID NO: 59618 - protein, 9 aa, Dengue virus
IAANEMGLL

SEQ ID NO: 59619 - protein, 9 aa, Dengue virus
AANEMGLLE

SEQ ID NO: 59620 - protein, 9 aa, Dengue virus
ANEMGLLET

SEQ ID NO: 59621 - protein, 9 aa, Dengue virus
NEMGLLETT

SEQ ID NO: 59622 - protein, 9 aa, Dengue virus
EMGLLETTK

SEQ ID NO: 59623 - protein, 9 aa, Dengue virus
MGLLETTKR

SEQ ID NO: 59624 - protein, 9 aa, Dengue virus
GLLETTKRD

SEQ ID NO: 59625 - protein, 9 aa, Dengue virus
LLETTKRDL

SEQ ID NO: 59626 - protein, 9 aa, Dengue virus
LETTKRDLG

SEQ ID NO: 59627 - protein, 9 aa, Dengue virus
ETTKRDLGM

SEQ ID NO: 59628 - protein, 9 aa, Dengue virus
TTKRDLGMS

SEQ ID NO: 59629 - protein, 9 aa, Dengue virus
TKRDLGMSK

SEQ ID NO: 59630 - protein, 9 aa, Dengue virus
KRDLGMSKE

SEQ ID NO: 59631 - protein, 9 aa, Dengue virus
RDLGMSKEP

SEQ ID NO: 59632 - protein, 9 aa, Dengue virus
DLGMSKEPG

SEQ ID NO: 59633 - protein, 9 aa, Dengue virus
LGMSKEPGV

SEQ ID NO: 59634 - protein, 9 aa, Dengue virus
GMSKEPGVV

SEQ ID NO: 59635 - protein, 9 aa, Dengue virus
MSKEPGVVS

SEQ ID NO: 59636 - protein, 9 aa, Dengue virus
SKEPGVVSP

SEQ ID NO: 59637 - protein, 9 aa, Dengue virus
EPGVVSPTS

SEQ ID NO: 59638 - protein, 9 aa, Dengue virus
PGVVSPTSY

SEQ ID NO: 59639 - protein, 9 aa, Dengue virus
GVVSPTSYL

SEQ ID NO: 59640 - protein, 9 aa, Dengue virus
VVSPTSYLD

SEQ ID NO: 59641 - protein, 9 aa, Dengue virus
VSPTSYLDV

SEQ ID NO: 59642 - protein, 9 aa, Dengue virus
SPTSYLDVD

SEQ ID NO: 59643 - protein, 9 aa, Dengue virus
PTSYLDVDL

SEQ ID NO: 59644 - protein, 9 aa, Dengue virus
TSYLDVDLH

SEQ ID NO: 59645 - protein, 9 aa, Dengue virus
SYLDVDLHP

SEQ ID NO: 59646 - protein, 9 aa, Dengue virus
YLDVDLHPA

SEQ ID NO: 59647 - protein, 9 aa, Dengue virus
LDVDLHPAS

SEQ ID NO: 59648 - protein, 9 aa, Dengue virus
DVDLHPASA

SEQ ID NO: 59649 - protein, 9 aa, Dengue virus
VDLHPASAW

SEQ ID NO: 59650 - protein, 9 aa, Dengue virus
DLHPASAWT

SEQ ID NO: 59651 - protein, 9 aa, Dengue virus
LHPASAWTL

SEQ ID NO: 59652 - protein, 9 aa, Dengue virus
HPASAWTLY

SEQ ID NO: 59653 - protein, 9 aa, Dengue virus
PASAWTLYA

SEQ ID NO: 59654 - protein, 9 aa, Dengue virus
ASAWTLYAV

SEQ ID NO: 59655 - protein, 9 aa, Dengue virus
SAWTLYAVA

SEQ ID NO: 59656 - protein, 9 aa, Dengue virus
AWTLYAVAT

SEQ ID NO: 59657 - protein, 9 aa, Dengue virus
WTLYAVATT

SEQ ID NO: 59658 - protein, 9 aa, Dengue virus
TLYAVATTV

SEQ ID NO: 59659 - protein, 9 aa, Dengue virus
LYAVATTVI

SEQ ID NO: 59660 - protein, 9 aa, Dengue virus
YAVATTVIT

SEQ ID NO: 59661 - protein, 9 aa, Dengue virus
AVATTVITP

SEQ ID NO: 59662 - protein, 9 aa, Dengue virus
VATTVITPM

SEQ ID NO: 59663 - protein, 9 aa, Dengue virus
ATTVITPML

SEQ ID NO: 59664 - protein, 9 aa, Dengue virus
TTVITPMLR

SEQ ID NO: 59665 - protein, 9 aa, Dengue virus
TVITPMLRH

SEQ ID NO: 59666 - protein, 9 aa, Dengue virus
VITPMLRHT

SEQ ID NO: 59667 - protein, 9 aa, Dengue virus
ITPMLRHTI

SEQ ID NO: 59668 - protein, 9 aa, Dengue virus
TPMLRHTIE

SEQ ID NO: 59669 - protein, 9 aa, Dengue virus
PMLRHTIEN

SEQ ID NO: 59670 - protein, 9 aa, Dengue virus
MLRHTIENS

SEQ ID NO: 59671 - protein, 9 aa, Dengue virus
LRHTIENST

SEQ ID NO: 59672 - protein, 9 aa, Dengue virus
RHTIENSTA

SEQ ID NO: 59673 - protein, 9 aa, Dengue virus
HTIENSTAN

SEQ ID NO: 59674 - protein, 9 aa, Dengue virus
TIENSTANV

SEQ ID NO: 59675 - protein, 9 aa, Dengue virus
IENSTANVS

SEQ ID NO: 59676 - protein, 9 aa, Dengue virus
ENSTANVSL

SEQ ID NO: 59677 - protein, 9 aa, Dengue virus
NSTANVSLA

SEQ ID NO: 59678 - protein, 9 aa, Dengue virus
STANVSLAA

SEQ ID NO: 59679 - protein, 9 aa, Dengue virus
TANVSLAAI

SEQ ID NO: 59680 - protein, 9 aa, Dengue virus
ANVSLAAIA

SEQ ID NO: 59681 - protein, 9 aa, Dengue virus
NVSLAAIAN

SEQ ID NO: 59682 - protein, 9 aa, Dengue virus
VSLAAIANQ

SEQ ID NO: 59683 - protein, 9 aa, Dengue virus
SLAAIANQA

SEQ ID NO: 59684 - protein, 9 aa, Dengue virus
LAAIANQAV

SEQ ID NO: 59685 - protein, 9 aa, Dengue virus
AAIANQAVV

SEQ ID NO: 59686 - protein, 9 aa, Dengue virus
AIANQAVVL

SEQ ID NO: 59687 - protein, 9 aa, Dengue virus
IANQAVVLM

SEQ ID NO: 59688 - protein, 9 aa, Dengue virus
ANQAVVLMG

SEQ ID NO: 59689 - protein, 9 aa, Dengue virus
NQAVVLMGL

SEQ ID NO: 59690 - protein, 9 aa, Dengue virus
QAVVLMGLD

SEQ ID NO: 59691 - protein, 9 aa, Dengue virus
AVVLMGLDK

SEQ ID NO: 59692 - protein, 9 aa, Dengue virus
VVLMGLDKG

SEQ ID NO: 59693 - protein, 9 aa, Dengue virus
VLMGLDKGW

SEQ ID NO: 59694 - protein, 9 aa, Dengue virus
LMGLDKGWP

SEQ ID NO: 59695 - protein, 9 aa, Dengue virus
MGLDKGWPI

SEQ ID NO: 59696 - protein, 9 aa, Dengue virus
GLDKGWPIS

SEQ ID NO: 59697 - protein, 9 aa, Dengue virus
LDKGWPISK

SEQ ID NO: 59698 - protein, 9 aa, Dengue virus
DKGWPISKM

SEQ ID NO: 59699 - protein, 9 aa, Dengue virus
KGWPISKMD

SEQ ID NO: 59700 - protein, 9 aa, Dengue virus
GWPISKMDL

SEQ ID NO: 59701 - protein, 9 aa, Dengue virus
WPISKMDLG

SEQ ID NO: 59702 - protein, 9 aa, Dengue virus
PISKMDLGV

SEQ ID NO: 59703 - protein, 9 aa, Dengue virus
ISKMDLGVP

SEQ ID NO: 59704 - protein, 9 aa, Dengue virus
SKMDLGVPL

SEQ ID NO: 59705 - protein, 9 aa, Dengue virus
KMDLGVPLL

SEQ ID NO: 59706 - protein, 9 aa, Dengue virus
MDLGVPLLA

SEQ ID NO: 59707 - protein, 9 aa, Dengue virus
DLGVPLLAL

SEQ ID NO: 59708 - protein, 9 aa, Dengue virus
LGVPLLALG

SEQ ID NO: 59709 - protein, 9 aa, Dengue virus
GVPLLALGC

SEQ ID NO: 59710 - protein, 9 aa, Dengue virus
VPLLALGCY

SEQ ID NO: 59711 - protein, 9 aa, Dengue virus
PLLALGCYS

SEQ ID NO: 59712 - protein, 9 aa, Dengue virus
LLALGCYSQ

SEQ ID NO: 59713 - protein, 9 aa, Dengue virus
LALGCYSQV

SEQ ID NO: 59714 - protein, 9 aa, Dengue virus
ALGCYSQVN

SEQ ID NO: 59715 - protein, 9 aa, Dengue virus
LGCYSQVNP

SEQ ID NO: 59716 - protein, 9 aa, Dengue virus
GCYSQVNPL

SEQ ID NO: 59717 - protein, 9 aa, Dengue virus
CYSQVNPLT

SEQ ID NO: 59718 - protein, 9 aa, Dengue virus
YSQVNPLTL

SEQ ID NO: 59719 - protein, 9 aa, Dengue virus
SQVNPLTLT

SEQ ID NO: 59720 - protein, 9 aa, Dengue virus
QVNPLTLTA

SEQ ID NO: 59721 - protein, 9 aa, Dengue virus
VNPLTLTAA

SEQ ID NO: 59722 - protein, 9 aa, Dengue virus
NPLTLTAAV

SEQ ID NO: 59723 - protein, 9 aa, Dengue virus
PLTLTAAVL

SEQ ID NO: 59724 - protein, 9 aa, Dengue virus
LTLTAAVLL

SEQ ID NO: 59725 - protein, 9 aa, Dengue virus
TLTAAVLLL

SEQ ID NO: 59726 - protein, 9 aa, Dengue virus
LTAAVLLLI

SEQ ID NO: 59727 - protein, 9 aa, Dengue virus
TAAVLLLIT

SEQ ID NO: 59728 - protein, 9 aa, Dengue virus
AAVLLLITH

SEQ ID NO: 59729 - protein, 9 aa, Dengue virus
AVLLLITHY

SEQ ID NO: 59730 - protein, 9 aa, Dengue virus
VLLLITHYA

SEQ ID NO: 59731 - protein, 9 aa, Dengue virus
LLLITHYAI

SEQ ID NO: 59732 - protein, 9 aa, Dengue virus
LLITHYAII

SEQ ID NO: 59733 - protein, 9 aa, Dengue virus
LITHYAIIG

SEQ ID NO: 59734 - protein, 9 aa, Dengue virus
ITHYAIIGP

SEQ ID NO: 59735 - protein, 9 aa, Dengue virus
THYAIIGPG

SEQ ID NO: 59736 - protein, 9 aa, Dengue virus
HYAIIGPGL

SEQ ID NO: 59737 - protein, 9 aa, Dengue virus
YAIIGPGLQ

SEQ ID NO: 59738 - protein, 9 aa, Dengue virus
AIIGPGLQA

SEQ ID NO: 59739 - protein, 9 aa, Dengue virus
IIGPGLQAK

SEQ ID NO: 59740 - protein, 9 aa, Dengue virus
IGPGLQAKA

SEQ ID NO: 59741 - protein, 9 aa, Dengue virus
GPGLQAKAT

SEQ ID NO: 59742 - protein, 9 aa, Dengue virus
PGLQAKATR

SEQ ID NO: 59743 - protein, 9 aa, Dengue virus
GLQAKATRE

SEQ ID NO: 59744 - protein, 9 aa, Dengue virus
LQAKATREA

SEQ ID NO: 59745 - protein, 9 aa, Dengue virus
QAKATREAQ

SEQ ID NO: 59746 - protein, 9 aa, Dengue virus
AKATREAQK

SEQ ID NO: 59747 - protein, 9 aa, Dengue virus
KATREAQKR

SEQ ID NO: 59748 - protein, 9 aa, Dengue virus
ATREAQKRT

SEQ ID NO: 59749 - protein, 9 aa, Dengue virus
TREAQKRTA

SEQ ID NO: 59750 - protein, 9 aa, Dengue virus
REAQKRTAA

SEQ ID NO: 59751 - protein, 9 aa, Dengue virus
EAQKRTAAG

SEQ ID NO: 59752 - protein, 9 aa, Dengue virus
AQKRTAAGI

SEQ ID NO: 59753 - protein, 9 aa, Dengue virus
QKRTAAGIM

SEQ ID NO: 59754 - protein, 9 aa, Dengue virus
KRTAAGIMK

SEQ ID NO: 59755 - protein, 9 aa, Dengue virus
RTAAGIMKN

SEQ ID NO: 59756 - protein, 9 aa, Dengue virus
TAAGIMKNP

SEQ ID NO: 59757 - protein, 9 aa, Dengue virus
AAGIMKNPT

SEQ ID NO: 59758 - protein, 9 aa, Dengue virus
AGIMKNPTV

SEQ ID NO: 59759 - protein, 9 aa, Dengue virus
GIMKNPTVD

SEQ ID NO: 59760 - protein, 9 aa, Dengue virus
IMKNPTVDG

SEQ ID NO: 59761 - protein, 9 aa, Dengue virus
MKNPTVDGI

SEQ ID NO: 59762 - protein, 9 aa, Dengue virus
KNPTVDGIM

SEQ ID NO: 59763 - protein, 9 aa, Dengue virus
NPTVDGIMT

SEQ ID NO: 59764 - protein, 9 aa, Dengue virus
PTVDGIMTI

SEQ ID NO: 59765 - protein, 9 aa, Dengue virus
TVDGIMTID

SEQ ID NO: 59766 - protein, 9 aa, Dengue virus
VDGIMTIDL

SEQ ID NO: 59767 - protein, 9 aa, Dengue virus
DGIMTIDLD

SEQ ID NO: 59768 - protein, 9 aa, Dengue virus
GIMTIDLDP

SEQ ID NO: 59769 - protein, 9 aa, Dengue virus
IMTIDLDPV

SEQ ID NO: 59770 - protein, 9 aa, Dengue virus
MTIDLDPVI

SEQ ID NO: 59771 - protein, 9 aa, Dengue virus
TIDLDPVIY

SEQ ID NO: 59772 - protein, 9 aa, Dengue virus
IDLDPVIYD

SEQ ID NO: 59773 - protein, 9 aa, Dengue virus
DLDPVIYDS

SEQ ID NO: 59774 - protein, 9 aa, Dengue virus
LDPVIYDSK

SEQ ID NO: 59775 - protein, 9 aa, Dengue virus
DPVIYDSKF

SEQ ID NO: 59776 - protein, 9 aa, Dengue virus
PVIYDSKFE

SEQ ID NO: 59777 - protein, 9 aa, Dengue virus
VIYDSKFEK

SEQ ID NO: 59778 - protein, 9 aa, Dengue virus
IYDSKFEKQ

SEQ ID NO: 59779 - protein, 9 aa, Dengue virus
YDSKFEKQL

SEQ ID NO: 59780 - protein, 9 aa, Dengue virus
DSKFEKQLG

SEQ ID NO: 59781 - protein, 9 aa, Dengue virus
SKFEKQLGQ

SEQ ID NO: 59782 - protein, 9 aa, Dengue virus
KFEKQLGQV

SEQ ID NO: 59783 - protein, 9 aa, Dengue virus
FEKQLGQVM

SEQ ID NO: 59784 - protein, 9 aa, Dengue virus
EKQLGQVML

SEQ ID NO: 59785 - protein, 9 aa, Dengue virus
KQLGQVMLL

SEQ ID NO: 59786 - protein, 9 aa, Dengue virus
QLGQVMLLV

SEQ ID NO: 59787 - protein, 9 aa, Dengue virus
LGQVMLLVL

SEQ ID NO: 59788 - protein, 9 aa, Dengue virus
GQVMLLVLC

SEQ ID NO: 59789 - protein, 9 aa, Dengue virus
QVMLLVLCA

SEQ ID NO: 59790 - protein, 9 aa, Dengue virus
VMLLVLCAV

SEQ ID NO: 59791 - protein, 9 aa, Dengue virus
MLLVLCAVQ

SEQ ID NO: 59792 - protein, 9 aa, Dengue virus
LLVLCAVQL

SEQ ID NO: 59793 - protein, 9 aa, Dengue virus
LVLCAVQLL

SEQ ID NO: 59794 - protein, 9 aa, Dengue virus
VLCAVQLLL

SEQ ID NO: 59795 - protein, 9 aa, Dengue virus
LCAVQLLLM

SEQ ID NO: 59796 - protein, 9 aa, Dengue virus
CAVQLLLMR

SEQ ID NO: 59797 - protein, 9 aa, Dengue virus
AVQLLLMRT

SEQ ID NO: 59798 - protein, 9 aa, Dengue virus
VQLLLMRTS

SEQ ID NO: 59799 - protein, 9 aa, Dengue virus
QLLLMRTSW

SEQ ID NO: 59800 - protein, 9 aa, Dengue virus
LLLMRTSWA

SEQ ID NO: 59801 - protein, 9 aa, Dengue virus
LLMRTSWAL

SEQ ID NO: 59802 - protein, 9 aa, Dengue virus
LMRTSWALC

SEQ ID NO: 59803 - protein, 9 aa, Dengue virus
MRTSWALCE

SEQ ID NO: 59804 - protein, 9 aa, Dengue virus
RTSWALCEA

SEQ ID NO: 59805 - protein, 9 aa, Dengue virus
TSWALCEAL

SEQ ID NO: 59806 - protein, 9 aa, Dengue virus
SWALCEALT

SEQ ID NO: 59807 - protein, 9 aa, Dengue virus
WALCEALTL

SEQ ID NO: 59808 - protein, 9 aa, Dengue virus
ALCEALTLA

SEQ ID NO: 59809 - protein, 9 aa, Dengue virus
LCEALTLAT

SEQ ID NO: 59810 - protein, 9 aa, Dengue virus
CEALTLATG

SEQ ID NO: 59811 - protein, 9 aa, Dengue virus
EALTLATGP

SEQ ID NO: 59812 - protein, 9 aa, Dengue virus
ALTLATGPI

SEQ ID NO: 59813 - protein, 9 aa, Dengue virus
LTLATGPIT

SEQ ID NO: 59814 - protein, 9 aa, Dengue virus
TLATGPITT

SEQ ID NO: 59815 - protein, 9 aa, Dengue virus
LATGPITTL

SEQ ID NO: 59816 - protein, 9 aa, Dengue virus
ATGPITTLW

SEQ ID NO: 59817 - protein, 9 aa, Dengue virus
TGPITTLWE

SEQ ID NO: 59818 - protein, 9 aa, Dengue virus
GPITTLWEG

SEQ ID NO: 59819 - protein, 9 aa, Dengue virus
PITTLWEGS

SEQ ID NO: 59820 - protein, 9 aa, Dengue virus
ITTLWEGSP

SEQ ID NO: 59821 - protein, 9 aa, Dengue virus
TTLWEGSPG

SEQ ID NO: 59822 - protein, 9 aa, Dengue virus
TLWEGSPGK

SEQ ID NO: 59823 - protein, 9 aa, Dengue virus
LWEGSPGKF

SEQ ID NO: 59824 - protein, 9 aa, Dengue virus
WEGSPGKFW

SEQ ID NO: 59825 - protein, 9 aa, Dengue virus
EGSPGKFWN

SEQ ID NO: 59826 - protein, 9 aa, Dengue virus
GSPGKFWNT

SEQ ID NO: 59827 - protein, 9 aa, Dengue virus
SPGKFWNTT

SEQ ID NO: 59828 - protein, 9 aa, Dengue virus
PGKFWNTTI

SEQ ID NO: 59829 - protein, 9 aa, Dengue virus
GKFWNTTIA

SEQ ID NO: 59830 - protein, 9 aa, Dengue virus
KFWNTTIAV

SEQ ID NO: 59831 - protein, 9 aa, Dengue virus
FWNTTIAVS

SEQ ID NO: 59832 - protein, 9 aa, Dengue virus
WNTTIAVSM

SEQ ID NO: 59833 - protein, 9 aa, Dengue virus
NTTIAVSMA

SEQ ID NO: 59834 - protein, 9 aa, Dengue virus
TTIAVSMAN

SEQ ID NO: 59835 - protein, 9 aa, Dengue virus
TIAVSMANI

SEQ ID NO: 59836 - protein, 9 aa, Dengue virus
IAVSMANIF

SEQ ID NO: 59837 - protein, 9 aa, Dengue virus
AVSMANIFR

SEQ ID NO: 59838 - protein, 9 aa, Dengue virus
VSMANIFRG

SEQ ID NO: 59839 - protein, 9 aa, Dengue virus
SMANIFRGS

SEQ ID NO: 59840 - protein, 9 aa, Dengue virus
MANIFRGSY

SEQ ID NO: 59841 - protein, 9 aa, Dengue virus
ANIFRGSYL

SEQ ID NO: 59842 - protein, 9 aa, Dengue virus
NIFRGSYLA

SEQ ID NO: 59843 - protein, 9 aa, Dengue virus
IFRGSYLAG

SEQ ID NO: 59844 - protein, 9 aa, Dengue virus
FRGSYLAGA

SEQ ID NO: 59845 - protein, 9 aa, Dengue virus
RGSYLAGAG

SEQ ID NO: 59846 - protein, 9 aa, Dengue virus
GSYLAGAGL

SEQ ID NO: 59847 - protein, 9 aa, Dengue virus
SYLAGAGLA

SEQ ID NO: 59848 - protein, 9 aa, Dengue virus
YLAGAGLAF

SEQ ID NO: 59849 - protein, 9 aa, Dengue virus
LAGAGLAFS

SEQ ID NO: 59850 - protein, 9 aa, Dengue virus
AGAGLAFSI

SEQ ID NO: 59851 - protein, 9 aa, Dengue virus
GAGLAFSIM

SEQ ID NO: 59852 - protein, 9 aa, Dengue virus
AGLAFSIMK

SEQ ID NO: 59853 - protein, 9 aa, Dengue virus
GLAFSIMKS

SEQ ID NO: 59854 - protein, 9 aa, Dengue virus
LAFSIMKSV

SEQ ID NO: 59855 - protein, 9 aa, Dengue virus
AFSIMKSVG

SEQ ID NO: 59856 - protein, 9 aa, Dengue virus
FSIMKSVGT

SEQ ID NO: 59857 - protein, 9 aa, Dengue virus
SIMKSVGTG

SEQ ID NO: 59858 - protein, 9 aa, Dengue virus
IMKSVGTGK

SEQ ID NO: 59859 - protein, 9 aa, Dengue virus
MKSVGTGKR

SEQ ID NO: 59860 - protein, 9 aa, Dengue virus
KSVGTGKRG

SEQ ID NO: 59861 - protein, 9 aa, Dengue virus
SVGTGKRGT

SEQ ID NO: 59862 - protein, 9 aa, Dengue virus
VGTGKRGTG

SEQ ID NO: 59863 - protein, 9 aa, Dengue virus
GTGKRGTGS

SEQ ID NO: 59864 - protein, 9 aa, Dengue virus
TGKRGTGSQ

SEQ ID NO: 59865 - protein, 9 aa, Dengue virus
GKRGTGSQG

SEQ ID NO: 59866 - protein, 9 aa, Dengue virus
KRGTGSQGE

SEQ ID NO: 59867 - protein, 9 aa, Dengue virus
RGTGSQGET

SEQ ID NO: 59868 - protein, 9 aa, Dengue virus
GTGSQGETL

SEQ ID NO: 59869 - protein, 9 aa, Dengue virus
TGSQGETLG

SEQ ID NO: 59870 - protein, 9 aa, Dengue virus
GSQGETLGE

SEQ ID NO: 59871 - protein, 9 aa, Dengue virus
SQGETLGEK

SEQ ID NO: 59872 - protein, 9 aa, Dengue virus
QGETLGEKW

SEQ ID NO: 59873 - protein, 9 aa, Dengue virus
GETLGEKWK

SEQ ID NO: 59874 - protein, 9 aa, Dengue virus
ETLGEKWKK

SEQ ID NO: 59875 - protein, 9 aa, Dengue virus
TLGEKWKKK

SEQ ID NO: 59876 - protein, 9 aa, Dengue virus
LGEKWKKKL

SEQ ID NO: 59877 - protein, 9 aa, Dengue virus
GEKWKKKLN

SEQ ID NO: 59878 - protein, 9 aa, Dengue virus
EKWKKKLNQ

SEQ ID NO: 59879 - protein, 9 aa, Dengue virus
KWKKKLNQL

SEQ ID NO: 59880 - protein, 9 aa, Dengue virus
WKKKLNQLS

SEQ ID NO: 59881 - protein, 9 aa, Dengue virus
KKKLNQLSR

SEQ ID NO: 59882 - protein, 9 aa, Dengue virus
KKLNQLSRK

SEQ ID NO: 59883 - protein, 9 aa, Dengue virus
KLNQLSRKE

SEQ ID NO: 59884 - protein, 9 aa, Dengue virus
LNQLSRKEF

SEQ ID NO: 59885 - protein, 9 aa, Dengue virus
NQLSRKEFD

SEQ ID NO: 59886 - protein, 9 aa, Dengue virus
QLSRKEFDL

SEQ ID NO: 59887 - protein, 9 aa, Dengue virus
LSRKEFDLY

SEQ ID NO: 59888 - protein, 9 aa, Dengue virus
SRKEFDLYK

SEQ ID NO: 59889 - protein, 9 aa, Dengue virus
RKEFDLYKK

SEQ ID NO: 59890 - protein, 9 aa, Dengue virus
KEFDLYKKS

SEQ ID NO: 59891 - protein, 9 aa, Dengue virus
EFDLYKKSG

SEQ ID NO: 59892 - protein, 9 aa, Dengue virus
FDLYKKSGI

SEQ ID NO: 59893 - protein, 9 aa, Dengue virus
DLYKKSGIT

SEQ ID NO: 59894 - protein, 9 aa, Dengue virus
LYKKSGITE

SEQ ID NO: 59895 - protein, 9 aa, Dengue virus
YKKSGITEV

SEQ ID NO: 59896 - protein, 9 aa, Dengue virus
KKSGITEVD

SEQ ID NO: 59897 - protein, 9 aa, Dengue virus
KSGITEVDR

SEQ ID NO: 59898 - protein, 9 aa, Dengue virus
SGITEVDRT

SEQ ID NO: 59899 - protein, 9 aa, Dengue virus
GITEVDRTE

SEQ ID NO: 59900 - protein, 9 aa, Dengue virus
ITEVDRTEA

SEQ ID NO: 59901 - protein, 9 aa, Dengue virus
TEVDRTEAK

SEQ ID NO: 59902 - protein, 9 aa, Dengue virus
EVDRTEAKE

SEQ ID NO: 59903 - protein, 9 aa, Dengue virus
VDRTEAKEG

SEQ ID NO: 59904 - protein, 9 aa, Dengue virus
DRTEAKEGL

SEQ ID NO: 59905 - protein, 9 aa, Dengue virus
RTEAKEGLK

SEQ ID NO: 59906 - protein, 9 aa, Dengue virus
TEAKEGLKR

SEQ ID NO: 59907 - protein, 9 aa, Dengue virus
EAKEGLKRG

SEQ ID NO: 59908 - protein, 9 aa, Dengue virus
AKEGLKRGE

SEQ ID NO: 59909 - protein, 9 aa, Dengue virus
KEGLKRGEI

SEQ ID NO: 59910 - protein, 9 aa, Dengue virus
EGLKRGEIT

SEQ ID NO: 59911 - protein, 9 aa, Dengue virus
RGEITHHAV

SEQ ID NO: 59912 - protein, 9 aa, Dengue virus
GEITHHAVS

SEQ ID NO: 59913 - protein, 9 aa, Dengue virus
EITHHAVSR

SEQ ID NO: 59914 - protein, 9 aa, Dengue virus
ITHHAVSRG

SEQ ID NO: 59915 - protein, 9 aa, Dengue virus
THHAVSRGS

SEQ ID NO: 59916 - protein, 9 aa, Dengue virus
HHAVSRGSA

SEQ ID NO: 59917 - protein, 9 aa, Dengue virus
HAVSRGSAK

SEQ ID NO: 59918 - protein, 9 aa, Dengue virus
AVSRGSAKL

SEQ ID NO: 59919 - protein, 9 aa, Dengue virus
VSRGSAKLQ

SEQ ID NO: 59920 - protein, 9 aa, Dengue virus
SRGSAKLQW

SEQ ID NO: 59921 - protein, 9 aa, Dengue virus
RGSAKLQWF

SEQ ID NO: 59922 - protein, 9 aa, Dengue virus
GSAKLQWFV

SEQ ID NO: 59923 - protein, 9 aa, Dengue virus
SAKLQWFVE

SEQ ID NO: 59924 - protein, 9 aa, Dengue virus
AKLQWFVER

SEQ ID NO: 59925 - protein, 9 aa, Dengue virus
KLQWFVERN

SEQ ID NO: 59926 - protein, 9 aa, Dengue virus
LQWFVERNM

SEQ ID NO: 59927 - protein, 9 aa, Dengue virus
QWFVERNMV

SEQ ID NO: 59928 - protein, 9 aa, Dengue virus
WFVERNMVI

SEQ ID NO: 59929 - protein, 9 aa, Dengue virus
FVERNMVIP

SEQ ID NO: 59930 - protein, 9 aa, Dengue virus
VERNMVIPE

SEQ ID NO: 59931 - protein, 9 aa, Dengue virus
ERNMVIPEG

SEQ ID NO: 59932 - protein, 9 aa, Dengue virus
RNMVIPEGR

SEQ ID NO: 59933 - protein, 9 aa, Dengue virus
NMVIPEGRV

SEQ ID NO: 59934 - protein, 9 aa, Dengue virus
MVIPEGRVI

SEQ ID NO: 59935 - protein, 9 aa, Dengue virus
VIPEGRVID

SEQ ID NO: 59936 - protein, 9 aa, Dengue virus
IPEGRVIDL

SEQ ID NO: 59937 - protein, 9 aa, Dengue virus
PEGRVIDLG

SEQ ID NO: 59938 - protein, 9 aa, Dengue virus
EGRVIDLGC

SEQ ID NO: 59939 - protein, 9 aa, Dengue virus
GRVIDLGCG

SEQ ID NO: 59940 - protein, 9 aa, Dengue virus
RVIDLGCGR

SEQ ID NO: 59941 - protein, 9 aa, Dengue virus
VIDLGCGRG

SEQ ID NO: 59942 - protein, 9 aa, Dengue virus
IDLGCGRGG

SEQ ID NO: 59943 - protein, 9 aa, Dengue virus
DLGCGRGGW

SEQ ID NO: 59944 - protein, 9 aa, Dengue virus
LGCGRGGWS

SEQ ID NO: 59945 - protein, 9 aa, Dengue virus
GCGRGGWSY

SEQ ID NO: 59946 - protein, 9 aa, Dengue virus
CGRGGWSYY

SEQ ID NO: 59947 - protein, 9 aa, Dengue virus
GRGGWSYYC

SEQ ID NO: 59948 - protein, 9 aa, Dengue virus
RGGWSYYCA

SEQ ID NO: 59949 - protein, 9 aa, Dengue virus
GGWSYYCAG

SEQ ID NO: 59950 - protein, 9 aa, Dengue virus
GWSYYCAGL

SEQ ID NO: 59951 - protein, 9 aa, Dengue virus
WSYYCAGLK

SEQ ID NO: 59952 - protein, 9 aa, Dengue virus
SYYCAGLKK

SEQ ID NO: 59953 - protein, 9 aa, Dengue virus
YYCAGLKKV

SEQ ID NO: 59954 - protein, 9 aa, Dengue virus
YCAGLKKVT

SEQ ID NO: 59955 - protein, 9 aa, Dengue virus
CAGLKKVTE

SEQ ID NO: 59956 - protein, 9 aa, Dengue virus
AGLKKVTEV

SEQ ID NO: 59957 - protein, 9 aa, Dengue virus
GLKKVTEVR

SEQ ID NO: 59958 - protein, 9 aa, Dengue virus
LKKVTEVRG

SEQ ID NO: 59959 - protein, 9 aa, Dengue virus
KKVTEVRGY

SEQ ID NO: 59960 - protein, 9 aa, Dengue virus
KVTEVRGYT

SEQ ID NO: 59961 - protein, 9 aa, Dengue virus
VTEVRGYTK

SEQ ID NO: 59962 - protein, 9 aa, Dengue virus
TEVRGYTKG

SEQ ID NO: 59963 - protein, 9 aa, Dengue virus
EVRGYTKGG

SEQ ID NO: 59964 - protein, 9 aa, Dengue virus
VRGYTKGGP

SEQ ID NO: 59965 - protein, 9 aa, Dengue virus
RGYTKGGPG

SEQ ID NO: 59966 - protein, 9 aa, Dengue virus
GYTKGGPGH

SEQ ID NO: 59967 - protein, 9 aa, Dengue virus
YTKGGPGHE

SEQ ID NO: 59968 - protein, 9 aa, Dengue virus
TKGGPGHEE

SEQ ID NO: 59969 - protein, 9 aa, Dengue virus
KGGPGHEEP

SEQ ID NO: 59970 - protein, 9 aa, Dengue virus
GGPGHEEPV

SEQ ID NO: 59971 - protein, 9 aa, Dengue virus
GPGHEEPVP

SEQ ID NO: 59972 - protein, 9 aa, Dengue virus
PGHEEPVPM

SEQ ID NO: 59973 - protein, 9 aa, Dengue virus
GHEEPVPMS

SEQ ID NO: 59974 - protein, 9 aa, Dengue virus
HEEPVPMST

SEQ ID NO: 59975 - protein, 9 aa, Dengue virus
EEPVPMSTY

SEQ ID NO: 59976 - protein, 9 aa, Dengue virus
EPVPMSTYG

SEQ ID NO: 59977 - protein, 9 aa, Dengue virus
PVPMSTYGW

SEQ ID NO: 59978 - protein, 9 aa, Dengue virus
VPMSTYGWN

SEQ ID NO: 59979 - protein, 9 aa, Dengue virus
PMSTYGWNI

SEQ ID NO: 59980 - protein, 9 aa, Dengue virus
MSTYGWNIV

SEQ ID NO: 59981 - protein, 9 aa, Dengue virus
STYGWNIVK

SEQ ID NO: 59982 - protein, 9 aa, Dengue virus
TYGWNIVKL

SEQ ID NO: 59983 - protein, 9 aa, Dengue virus
YGWNIVKLM

SEQ ID NO: 59984 - protein, 9 aa, Dengue virus
GWNIVKLMS

SEQ ID NO: 59985 - protein, 9 aa, Dengue virus
WNIVKLMSG

SEQ ID NO: 59986 - protein, 9 aa, Dengue virus
NIVKLMSGK

SEQ ID NO: 59987 - protein, 9 aa, Dengue virus
IVKLMSGKD

SEQ ID NO: 59988 - protein, 9 aa, Dengue virus
VKLMSGKDV

SEQ ID NO: 59989 - protein, 9 aa, Dengue virus
KLMSGKDVF

SEQ ID NO: 59990 - protein, 9 aa, Dengue virus
LMSGKDVFY

SEQ ID NO: 59991 - protein, 9 aa, Dengue virus
MSGKDVFYL

SEQ ID NO: 59992 - protein, 9 aa, Dengue virus
SGKDVFYLP

SEQ ID NO: 59993 - protein, 9 aa, Dengue virus
GKDVFYLPP

SEQ ID NO: 59994 - protein, 9 aa, Dengue virus
KDVFYLPPE

SEQ ID NO: 59995 - protein, 9 aa, Dengue virus
DVFYLPPEK

SEQ ID NO: 59996 - protein, 9 aa, Dengue virus
VFYLPPEKC

SEQ ID NO: 59997 - protein, 9 aa, Dengue virus
FYLPPEKCD

SEQ ID NO: 59998 - protein, 9 aa, Dengue virus
YLPPEKCDT

SEQ ID NO: 59999 - protein, 9 aa, Dengue virus
LPPEKCDTL

SEQ ID NO: 60000 - protein, 9 aa, Dengue virus
PPEKCDTLL

SEQ ID NO: 60001 - protein, 9 aa, Dengue virus
PEKCDTLLC

SEQ ID NO: 60002 - protein, 9 aa, Dengue virus
EKCDTLLCD

SEQ ID NO: 60003 - protein, 9 aa, Dengue virus
KCDTLLCDI

SEQ ID NO: 60004 - protein, 9 aa, Dengue virus
CDTLLCDIG

SEQ ID NO: 60005 - protein, 9 aa, Dengue virus
DTLLCDIGE

SEQ ID NO: 60006 - protein, 9 aa, Dengue virus
TLLCDIGES

SEQ ID NO: 60007 - protein, 9 aa, Dengue virus
LLCDIGESS

SEQ ID NO: 60008 - protein, 9 aa, Dengue virus
LCDIGESSP

SEQ ID NO: 60009 - protein, 9 aa, Dengue virus
CDIGESSPS

SEQ ID NO: 60010 - protein, 9 aa, Dengue virus
DIGESSPSP

SEQ ID NO: 60011 - protein, 9 aa, Dengue virus
IGESSPSPT

SEQ ID NO: 60012 - protein, 9 aa, Dengue virus
GESSPSPTV

SEQ ID NO: 60013 - protein, 9 aa, Dengue virus
ESSPSPTVE

SEQ ID NO: 60014 - protein, 9 aa, Dengue virus
SSPSPTVEE

SEQ ID NO: 60015 - protein, 9 aa, Dengue virus
SPSPTVEES

SEQ ID NO: 60016 - protein, 9 aa, Dengue virus
PSPTVEESR

SEQ ID NO: 60017 - protein, 9 aa, Dengue virus
SPTVEESRT

SEQ ID NO: 60018 - protein, 9 aa, Dengue virus
PTVEESRTI

SEQ ID NO: 60019 - protein, 9 aa, Dengue virus
TVEESRTIR

SEQ ID NO: 60020 - protein, 9 aa, Dengue virus
VEESRTIRV

SEQ ID NO: 60021 - protein, 9 aa, Dengue virus
EESRTIRVL

SEQ ID NO: 60022 - protein, 9 aa, Dengue virus
ESRTIRVLK

SEQ ID NO: 60023 - protein, 9 aa, Dengue virus
SRTIRVLKM

SEQ ID NO: 60024 - protein, 9 aa, Dengue virus
RTIRVLKMV

SEQ ID NO: 60025 - protein, 9 aa, Dengue virus
TIRVLKMVE

SEQ ID NO: 60026 - protein, 9 aa, Dengue virus
IRVLKMVEP

SEQ ID NO: 60027 - protein, 9 aa, Dengue virus
RVLKMVEPW

SEQ ID NO: 60028 - protein, 9 aa, Dengue virus
VLKMVEPWL

SEQ ID NO: 60029 - protein, 9 aa, Dengue virus
LKMVEPWLK

SEQ ID NO: 60030 - protein, 9 aa, Dengue virus
KMVEPWLKN

SEQ ID NO: 60031 - protein, 9 aa, Dengue virus
MVEPWLKNN

SEQ ID NO: 60032 - protein, 9 aa, Dengue virus
VEPWLKNNQ

SEQ ID NO: 60033 - protein, 9 aa, Dengue virus
EPWLKNNQF

SEQ ID NO: 60034 - protein, 9 aa, Dengue virus
PWLKNNQFC

SEQ ID NO: 60035 - protein, 9 aa, Dengue virus
WLKNNQFCI

SEQ ID NO: 60036 - protein, 9 aa, Dengue virus
LKNNQFCIK

SEQ ID NO: 60037 - protein, 9 aa, Dengue virus
KNNQFCIKV

SEQ ID NO: 60038 - protein, 9 aa, Dengue virus
NNQFCIKVL

SEQ ID NO: 60039 - protein, 9 aa, Dengue virus
NQFCIKVLN

SEQ ID NO: 60040 - protein, 9 aa, Dengue virus
QFCIKVLNP

SEQ ID NO: 60041 - protein, 9 aa, Dengue virus
FCIKVLNPY

SEQ ID NO: 60042 - protein, 9 aa, Dengue virus
CIKVLNPYM

SEQ ID NO: 60043 - protein, 9 aa, Dengue virus
IKVLNPYMP

SEQ ID NO: 60044 - protein, 9 aa, Dengue virus
KVLNPYMPT

SEQ ID NO: 60045 - protein, 9 aa, Dengue virus
VLNPYMPTV

SEQ ID NO: 60046 - protein, 9 aa, Dengue virus
LNPYMPTVI

SEQ ID NO: 60047 - protein, 9 aa, Dengue virus
NPYMPTVIE

SEQ ID NO: 60048 - protein, 9 aa, Dengue virus
PYMPTVIEH

SEQ ID NO: 60049 - protein, 9 aa, Dengue virus
YMPTVIEHL

SEQ ID NO: 60050 - protein, 9 aa, Dengue virus
MPTVIEHLE

SEQ ID NO: 60051 - protein, 9 aa, Dengue virus
PTVIEHLER

SEQ ID NO: 60052 - protein, 9 aa, Dengue virus
TVIEHLERL

SEQ ID NO: 60053 - protein, 9 aa, Dengue virus
VIEHLERLQ

SEQ ID NO: 60054 - protein, 9 aa, Dengue virus
IEHLERLQR

SEQ ID NO: 60055 - protein, 9 aa, Dengue virus
EHLERLQRK

SEQ ID NO: 60056 - protein, 9 aa, Dengue virus
HLERLQRKH

SEQ ID NO: 60057 - protein, 9 aa, Dengue virus
LERLQRKHG

SEQ ID NO: 60058 - protein, 9 aa, Dengue virus
ERLQRKHGG

SEQ ID NO: 60059 - protein, 9 aa, Dengue virus
RLQRKHGGM

SEQ ID NO: 60060 - protein, 9 aa, Dengue virus
LQRKHGGML

SEQ ID NO: 60061 - protein, 9 aa, Dengue virus
QRKHGGMLV

SEQ ID NO: 60062 - protein, 9 aa, Dengue virus
RKHGGMLVR

SEQ ID NO: 60063 - protein, 9 aa, Dengue virus
KHGGMLVRN

SEQ ID NO: 60064 - protein, 9 aa, Dengue virus
HGGMLVRNP

SEQ ID NO: 60065 - protein, 9 aa, Dengue virus
GGMLVRNPL

SEQ ID NO: 60066 - protein, 9 aa, Dengue virus
GMLVRNPLS

SEQ ID NO: 60067 - protein, 9 aa, Dengue virus
MLVRNPLSR

SEQ ID NO: 60068 - protein, 9 aa, Dengue virus
LVRNPLSRN

SEQ ID NO: 60069 - protein, 9 aa, Dengue virus
VRNPLSRNS

SEQ ID NO: 60070 - protein, 9 aa, Dengue virus
RNPLSRNST

SEQ ID NO: 60071 - protein, 9 aa, Dengue virus
NPLSRNSTH

SEQ ID NO: 60072 - protein, 9 aa, Dengue virus
PLSRNSTHE

SEQ ID NO: 60073 - protein, 9 aa, Dengue virus
LSRNSTHEM

SEQ ID NO: 60074 - protein, 9 aa, Dengue virus
SRNSTHEMY

SEQ ID NO: 60075 - protein, 9 aa, Dengue virus
RNSTHEMYW

SEQ ID NO: 60076 - protein, 9 aa, Dengue virus
NSTHEMYWI

SEQ ID NO: 60077 - protein, 9 aa, Dengue virus
STHEMYWIS

SEQ ID NO: 60078 - protein, 9 aa, Dengue virus
THEMYWISN

SEQ ID NO: 60079 - protein, 9 aa, Dengue virus
HEMYWISNG

SEQ ID NO: 60080 - protein, 9 aa, Dengue virus
EMYWISNGT

SEQ ID NO: 60081 - protein, 9 aa, Dengue virus
MYWISNGTG

SEQ ID NO: 60082 - protein, 9 aa, Dengue virus
YWISNGTGN

SEQ ID NO: 60083 - protein, 9 aa, Dengue virus
WISNGTGNI

SEQ ID NO: 60084 - protein, 9 aa, Dengue virus
ISNGTGNIV

SEQ ID NO: 60085 - protein, 9 aa, Dengue virus
SNGTGNIVA

SEQ ID NO: 60086 - protein, 9 aa, Dengue virus
NGTGNIVAS

SEQ ID NO: 60087 - protein, 9 aa, Dengue virus
GTGNIVASV

SEQ ID NO: 60088 - protein, 9 aa, Dengue virus
TGNIVASVN

SEQ ID NO: 60089 - protein, 9 aa, Dengue virus
GNIVASVNM

SEQ ID NO: 60090 - protein, 9 aa, Dengue virus
NIVASVNMV

SEQ ID NO: 60091 - protein, 9 aa, Dengue virus
IVASVNMVS

SEQ ID NO: 60092 - protein, 9 aa, Dengue virus
VASVNMVSR

SEQ ID NO: 60093 - protein, 9 aa, Dengue virus
ASVNMVSRL

SEQ ID NO: 60094 - protein, 9 aa, Dengue virus
SVNMVSRLL

SEQ ID NO: 60095 - protein, 9 aa, Dengue virus
VNMVSRLLL

SEQ ID NO: 60096 - protein, 9 aa, Dengue virus
NMVSRLLLN

SEQ ID NO: 60097 - protein, 9 aa, Dengue virus
MVSRLLLNR

SEQ ID NO: 60098 - protein, 9 aa, Dengue virus
VSRLLLNRF

SEQ ID NO: 60099 - protein, 9 aa, Dengue virus
SRLLLNRFT

SEQ ID NO: 60100 - protein, 9 aa, Dengue virus
RLLLNRFTM

SEQ ID NO: 60101 - protein, 9 aa, Dengue virus
LLLNRFTMT

SEQ ID NO: 60102 - protein, 9 aa, Dengue virus
LLNRFTMTH

SEQ ID NO: 60103 - protein, 9 aa, Dengue virus
LNRFTMTHR

SEQ ID NO: 60104 - protein, 9 aa, Dengue virus
NRFTMTHRR

SEQ ID NO: 60105 - protein, 9 aa, Dengue virus
RFTMTHRRP

SEQ ID NO: 60106 - protein, 9 aa, Dengue virus
FTMTHRRPT

SEQ ID NO: 60107 - protein, 9 aa, Dengue virus
TMTHRRPTI

SEQ ID NO: 60108 - protein, 9 aa, Dengue virus
MTHRRPTIE

SEQ ID NO: 60109 - protein, 9 aa, Dengue virus
THRRPTIEK

SEQ ID NO: 60110 - protein, 9 aa, Dengue virus
HRRPTIEKD

SEQ ID NO: 60111 - protein, 9 aa, Dengue virus
RRPTIEKDV

SEQ ID NO: 60112 - protein, 9 aa, Dengue virus
RPTIEKDVD

SEQ ID NO: 60113 - protein, 9 aa, Dengue virus
PTIEKDVDL

SEQ ID NO: 60114 - protein, 9 aa, Dengue virus
TIEKDVDLG

SEQ ID NO: 60115 - protein, 9 aa, Dengue virus
IEKDVDLGA

SEQ ID NO: 60116 - protein, 9 aa, Dengue virus
EKDVDLGAG

SEQ ID NO: 60117 - protein, 9 aa, Dengue virus
KDVDLGAGT

SEQ ID NO: 60118 - protein, 9 aa, Dengue virus
DVDLGAGTR

SEQ ID NO: 60119 - protein, 9 aa, Dengue virus
VDLGAGTRH

SEQ ID NO: 60120 - protein, 9 aa, Dengue virus
DLGAGTRHV

SEQ ID NO: 60121 - protein, 9 aa, Dengue virus
LGAGTRHVN

SEQ ID NO: 60122 - protein, 9 aa, Dengue virus
GAGTRHVNA

SEQ ID NO: 60123 - protein, 9 aa, Dengue virus
AGTRHVNAE

SEQ ID NO: 60124 - protein, 9 aa, Dengue virus
GTRHVNAEP

SEQ ID NO: 60125 - protein, 9 aa, Dengue virus
TRHVNAEPE

SEQ ID NO: 60126 - protein, 9 aa, Dengue virus
RHVNAEPET

SEQ ID NO: 60127 - protein, 9 aa, Dengue virus
HVNAEPETP

SEQ ID NO: 60128 - protein, 9 aa, Dengue virus
VNAEPETPN

SEQ ID NO: 60129 - protein, 9 aa, Dengue virus
NAEPETPNM

SEQ ID NO: 60130 - protein, 9 aa, Dengue virus
AEPETPNMD

SEQ ID NO: 60131 - protein, 9 aa, Dengue virus
EPETPNMDV

SEQ ID NO: 60132 - protein, 9 aa, Dengue virus
PETPNMDVI

SEQ ID NO: 60133 - protein, 9 aa, Dengue virus
ETPNMDVIG

SEQ ID NO: 60134 - protein, 9 aa, Dengue virus
TPNMDVIGE

SEQ ID NO: 60135 - protein, 9 aa, Dengue virus
PNMDVIGER

SEQ ID NO: 60136 - protein, 9 aa, Dengue virus
NMDVIGERI

SEQ ID NO: 60137 - protein, 9 aa, Dengue virus
MDVIGERIK

SEQ ID NO: 60138 - protein, 9 aa, Dengue virus
DVIGERIKR

SEQ ID NO: 60139 - protein, 9 aa, Dengue virus
VIGERIKRI

SEQ ID NO: 60140 - protein, 9 aa, Dengue virus
IGERIKRIK

SEQ ID NO: 60141 - protein, 9 aa, Dengue virus
GERIKRIKE

SEQ ID NO: 60142 - protein, 9 aa, Dengue virus
ERIKRIKEE

SEQ ID NO: 60143 - protein, 9 aa, Dengue virus
RIKRIKEEH

SEQ ID NO: 60144 - protein, 9 aa, Dengue virus
RIKEEHNST

SEQ ID NO: 60145 - protein, 9 aa, Dengue virus
IKEEHNSTW

SEQ ID NO: 60146 - protein, 9 aa, Dengue virus
KEEHNSTWH

SEQ ID NO: 60147 - protein, 9 aa, Dengue virus
EEHNSTWHY

SEQ ID NO: 60148 - protein, 9 aa, Dengue virus
EHNSTWHYD

SEQ ID NO: 60149 - protein, 9 aa, Dengue virus
HNSTWHYDD

SEQ ID NO: 60150 - protein, 9 aa, Dengue virus
NSTWHYDDE

SEQ ID NO: 60151 - protein, 9 aa, Dengue virus
STWHYDDEN

SEQ ID NO: 60152 - protein, 9 aa, Dengue virus
TWHYDDENP

SEQ ID NO: 60153 - protein, 9 aa, Dengue virus
WHYDDENPY

SEQ ID NO: 60154 - protein, 9 aa, Dengue virus
HYDDENPYK

SEQ ID NO: 60155 - protein, 9 aa, Dengue virus
YDDENPYKT

SEQ ID NO: 60156 - protein, 9 aa, Dengue virus
DDENPYKTW

SEQ ID NO: 60157 - protein, 9 aa, Dengue virus
DENPYKTWA

SEQ ID NO: 60158 - protein, 9 aa, Dengue virus
ENPYKTWAY

SEQ ID NO: 60159 - protein, 9 aa, Dengue virus
NPYKTWAYH

SEQ ID NO: 60160 - protein, 9 aa, Dengue virus
PYKTWAYHG

SEQ ID NO: 60161 - protein, 9 aa, Dengue virus
YKTWAYHGS

SEQ ID NO: 60162 - protein, 9 aa, Dengue virus
KTWAYHGSY

SEQ ID NO: 60163 - protein, 9 aa, Dengue virus
TWAYHGSYE

SEQ ID NO: 60164 - protein, 9 aa, Dengue virus
WAYHGSYEV

SEQ ID NO: 60165 - protein, 9 aa, Dengue virus
AYHGSYEVK

SEQ ID NO: 60166 - protein, 9 aa, Dengue virus
YHGSYEVKA

SEQ ID NO: 60167 - protein, 9 aa, Dengue virus
HGSYEVKAT

SEQ ID NO: 60168 - protein, 9 aa, Dengue virus
GSYEVKATG

SEQ ID NO: 60169 - protein, 9 aa, Dengue virus
SYEVKATGS

SEQ ID NO: 60170 - protein, 9 aa, Dengue virus
YEVKATGSA

SEQ ID NO: 60171 - protein, 9 aa, Dengue virus
EVKATGSAS

SEQ ID NO: 60172 - protein, 9 aa, Dengue virus
VKATGSASS

SEQ ID NO: 60173 - protein, 9 aa, Dengue virus
KATGSASSM

SEQ ID NO: 60174 - protein, 9 aa, Dengue virus
ATGSASSMI

SEQ ID NO: 60175 - protein, 9 aa, Dengue virus
TGSASSMIN

SEQ ID NO: 60176 - protein, 9 aa, Dengue virus
GSASSMING

SEQ ID NO: 60177 - protein, 9 aa, Dengue virus
SASSMINGV

SEQ ID NO: 60178 - protein, 9 aa, Dengue virus
ASSMINGVV

SEQ ID NO: 60179 - protein, 9 aa, Dengue virus
SSMINGVVK

SEQ ID NO: 60180 - protein, 9 aa, Dengue virus
SMINGVVKL

SEQ ID NO: 60181 - protein, 9 aa, Dengue virus
MINGVVKLL

SEQ ID NO: 60182 - protein, 9 aa, Dengue virus
INGVVKLLT

SEQ ID NO: 60183 - protein, 9 aa, Dengue virus
NGVVKLLTK

SEQ ID NO: 60184 - protein, 9 aa, Dengue virus
GVVKLLTKP

SEQ ID NO: 60185 - protein, 9 aa, Dengue virus
VVKLLTKPW

SEQ ID NO: 60186 - protein, 9 aa, Dengue virus
VKLLTKPWD

SEQ ID NO: 60187 - protein, 9 aa, Dengue virus
KLLTKPWDV

SEQ ID NO: 60188 - protein, 9 aa, Dengue virus
LLTKPWDVV

SEQ ID NO: 60189 - protein, 9 aa, Dengue virus
LTKPWDVVP

SEQ ID NO: 60190 - protein, 9 aa, Dengue virus
TKPWDVVPM

SEQ ID NO: 60191 - protein, 9 aa, Dengue virus
KPWDVVPMV

SEQ ID NO: 60192 - protein, 9 aa, Dengue virus
PWDVVPMVT

SEQ ID NO: 60193 - protein, 9 aa, Dengue virus
WDVVPMVTQ

SEQ ID NO: 60194 - protein, 9 aa, Dengue virus
DVVPMVTQM

SEQ ID NO: 60195 - protein, 9 aa, Dengue virus
VVPMVTQMA

SEQ ID NO: 60196 - protein, 9 aa, Dengue virus
VPMVTQMAM

SEQ ID NO: 60197 - protein, 9 aa, Dengue virus
PMVTQMAMT

SEQ ID NO: 60198 - protein, 9 aa, Dengue virus
MVTQMAMTD

SEQ ID NO: 60199 - protein, 9 aa, Dengue virus
VTQMAMTDT

SEQ ID NO: 60200 - protein, 9 aa, Dengue virus
TQMAMTDTT

SEQ ID NO: 60201 - protein, 9 aa, Dengue virus
QMAMTDTTP

SEQ ID NO: 60202 - protein, 9 aa, Dengue virus
MAMTDTTPF

SEQ ID NO: 60203 - protein, 9 aa, Dengue virus
AMTDTTPFG

SEQ ID NO: 60204 - protein, 9 aa, Dengue virus
MTDTTPFGQ

SEQ ID NO: 60205 - protein, 9 aa, Dengue virus
TDTTPFGQQ

SEQ ID NO: 60206 - protein, 9 aa, Dengue virus
DTTPFGQQR

SEQ ID NO: 60207 - protein, 9 aa, Dengue virus
TTPFGQQRV

SEQ ID NO: 60208 - protein, 9 aa, Dengue virus
TPFGQQRVF

SEQ ID NO: 60209 - protein, 9 aa, Dengue virus
PFGQQRVFK

SEQ ID NO: 60210 - protein, 9 aa, Dengue virus
FGQQRVFKE

SEQ ID NO: 60211 - protein, 9 aa, Dengue virus
GQQRVFKEK

SEQ ID NO: 60212 - protein, 9 aa, Dengue virus
QQRVFKEKV

SEQ ID NO: 60213 - protein, 9 aa, Dengue virus
QRVFKEKVD

SEQ ID NO: 60214 - protein, 9 aa, Dengue virus
RVFKEKVDT

SEQ ID NO: 60215 - protein, 9 aa, Dengue virus
VFKEKVDTR

SEQ ID NO: 60216 - protein, 9 aa, Dengue virus
FKEKVDTRT

SEQ ID NO: 60217 - protein, 9 aa, Dengue virus
KEKVDTRTP

SEQ ID NO: 60218 - protein, 9 aa, Dengue virus
EKVDTRTPR

SEQ ID NO: 60219 - protein, 9 aa, Dengue virus
KVDTRTPRS

SEQ ID NO: 60220 - protein, 9 aa, Dengue virus
VDTRTPRSM

SEQ ID NO: 60221 - protein, 9 aa, Dengue virus
DTRTPRSMP

SEQ ID NO: 60222 - protein, 9 aa, Dengue virus
TRTPRSMPG

SEQ ID NO: 60223 - protein, 9 aa, Dengue virus
RTPRSMPGT

SEQ ID NO: 60224 - protein, 9 aa, Dengue virus
TPRSMPGTR

SEQ ID NO: 60225 - protein, 9 aa, Dengue virus
GTRKVMEIT

SEQ ID NO: 60226 - protein, 9 aa, Dengue virus
VMEITAEWL

SEQ ID NO: 60227 - protein, 9 aa, Dengue virus
MEITAEWLW

SEQ ID NO: 60228 - protein, 9 aa, Dengue virus
EITAEWLWR

SEQ ID NO: 60229 - protein, 9 aa, Dengue virus
ITAEWLWRT

SEQ ID NO: 60230 - protein, 9 aa, Dengue virus
TAEWLWRTL

SEQ ID NO: 60231 - protein, 9 aa, Dengue virus
AEWLWRTLG

SEQ ID NO: 60232 - protein, 9 aa, Dengue virus
EWLWRTLGR

SEQ ID NO: 60233 - protein, 9 aa, Dengue virus
WLWRTLGRN

SEQ ID NO: 60234 - protein, 9 aa, Dengue virus
LWRTLGRNK

SEQ ID NO: 60235 - protein, 9 aa, Dengue virus
WRTLGRNKK

SEQ ID NO: 60236 - protein, 9 aa, Dengue virus
RTLGRNKKP

SEQ ID NO: 60237 - protein, 9 aa, Dengue virus
TLGRNKKPR

SEQ ID NO: 60238 - protein, 9 aa, Dengue virus
LGRNKKPRL

SEQ ID NO: 60239 - protein, 9 aa, Dengue virus
GRNKKPRLC

SEQ ID NO: 60240 - protein, 9 aa, Dengue virus
RNKKPRLCT

SEQ ID NO: 60241 - protein, 9 aa, Dengue virus
NKKPRLCTR

SEQ ID NO: 60242 - protein, 9 aa, Dengue virus
KKPRLCTRE

SEQ ID NO: 60243 - protein, 9 aa, Dengue virus
KPRLCTREE

SEQ ID NO: 60244 - protein, 9 aa, Dengue virus
PRLCTREEF

SEQ ID NO: 60245 - protein, 9 aa, Dengue virus
RLCTREEFT

SEQ ID NO: 60246 - protein, 9 aa, Dengue virus
LCTREEFTK

SEQ ID NO: 60247 - protein, 9 aa, Dengue virus
CTREEFTKK

SEQ ID NO: 60248 - protein, 9 aa, Dengue virus
TREEFTKKV

SEQ ID NO: 60249 - protein, 9 aa, Dengue virus
REEFTKKVR

SEQ ID NO: 60250 - protein, 9 aa, Dengue virus
EEFTKKVRT

SEQ ID NO: 60251 - protein, 9 aa, Dengue virus
EFTKKVRTN

SEQ ID NO: 60252 - protein, 9 aa, Dengue virus
FTKKVRTNA

SEQ ID NO: 60253 - protein, 9 aa, Dengue virus
TKKVRTNAA

SEQ ID NO: 60254 - protein, 9 aa, Dengue virus
KKVRTNAAM

SEQ ID NO: 60255 - protein, 9 aa, Dengue virus
KVRTNAAMG

SEQ ID NO: 60256 - protein, 9 aa, Dengue virus
VRTNAAMGA

SEQ ID NO: 60257 - protein, 9 aa, Dengue virus
RTNAAMGAV

SEQ ID NO: 60258 - protein, 9 aa, Dengue virus
TNAAMGAVF

SEQ ID NO: 60259 - protein, 9 aa, Dengue virus
NAAMGAVFT

SEQ ID NO: 60260 - protein, 9 aa, Dengue virus
AAMGAVFTE

SEQ ID NO: 60261 - protein, 9 aa, Dengue virus
AMGAVFTEE

SEQ ID NO: 60262 - protein, 9 aa, Dengue virus
MGAVFTEEN

SEQ ID NO: 60263 - protein, 9 aa, Dengue virus
GAVFTEENQ

SEQ ID NO: 60264 - protein, 9 aa, Dengue virus
AVFTEENQW

SEQ ID NO: 60265 - protein, 9 aa, Dengue virus
VFTEENQWD

SEQ ID NO: 60266 - protein, 9 aa, Dengue virus
FTEENQWDS

SEQ ID NO: 60267 - protein, 9 aa, Dengue virus
TEENQWDSA

SEQ ID NO: 60268 - protein, 9 aa, Dengue virus
EENQWDSAK

SEQ ID NO: 60269 - protein, 9 aa, Dengue virus
ENQWDSAKA

SEQ ID NO: 60270 - protein, 9 aa, Dengue virus
NQWDSAKAA

SEQ ID NO: 60271 - protein, 9 aa, Dengue virus
QWDSAKAAV

SEQ ID NO: 60272 - protein, 9 aa, Dengue virus
WDSAKAAVE

SEQ ID NO: 60273 - protein, 9 aa, Dengue virus
DSAKAAVED

SEQ ID NO: 60274 - protein, 9 aa, Dengue virus
SAKAAVEDE

SEQ ID NO: 60275 - protein, 9 aa, Dengue virus
AKAAVEDED

SEQ ID NO: 60276 - protein, 9 aa, Dengue virus
KAAVEDEDF

SEQ ID NO: 60277 - protein, 9 aa, Dengue virus
AAVEDEDFW

SEQ ID NO: 60278 - protein, 9 aa, Dengue virus
AVEDEDFWK

SEQ ID NO: 60279 - protein, 9 aa, Dengue virus
VEDEDFWKL

SEQ ID NO: 60280 - protein, 9 aa, Dengue virus
EDEDFWKLV

SEQ ID NO: 60281 - protein, 9 aa, Dengue virus
DEDFWKLVD

SEQ ID NO: 60282 - protein, 9 aa, Dengue virus
EDFWKLVDR

SEQ ID NO: 60283 - protein, 9 aa, Dengue virus
DFWKLVDRE

SEQ ID NO: 60284 - protein, 9 aa, Dengue virus
FWKLVDRER

SEQ ID NO: 60285 - protein, 9 aa, Dengue virus
WKLVDRERE

SEQ ID NO: 60286 - protein, 9 aa, Dengue virus
KLVDREREL

SEQ ID NO: 60287 - protein, 9 aa, Dengue virus
LVDRERELH

SEQ ID NO: 60288 - protein, 9 aa, Dengue virus
VDRERELHK

SEQ ID NO: 60289 - protein, 9 aa, Dengue virus
DRERELHKL

SEQ ID NO: 60290 - protein, 9 aa, Dengue virus
RERELHKLG

SEQ ID NO: 60291 - protein, 9 aa, Dengue virus
ERELHKLGK

SEQ ID NO: 60292 - protein, 9 aa, Dengue virus
RELHKLGKC

SEQ ID NO: 60293 - protein, 9 aa, Dengue virus
ELHKLGKCG

SEQ ID NO: 60294 - protein, 9 aa, Dengue virus
LHKLGKCGS

SEQ ID NO: 60295 - protein, 9 aa, Dengue virus
HKLGKCGSC

SEQ ID NO: 60296 - protein, 9 aa, Dengue virus
KLGKCGSCV

SEQ ID NO: 60297 - protein, 9 aa, Dengue virus
LGKCGSCVY

SEQ ID NO: 60298 - protein, 9 aa, Dengue virus
GKCGSCVYN

SEQ ID NO: 60299 - protein, 9 aa, Dengue virus
KCGSCVYNM

SEQ ID NO: 60300 - protein, 9 aa, Dengue virus
CGSCVYNMM

SEQ ID NO: 60301 - protein, 9 aa, Dengue virus
GSCVYNMMG

SEQ ID NO: 60302 - protein, 9 aa, Dengue virus
SCVYNMMGK

SEQ ID NO: 60303 - protein, 9 aa, Dengue virus
CVYNMMGKR

SEQ ID NO: 60304 - protein, 9 aa, Dengue virus
VYNMMGKRE

SEQ ID NO: 60305 - protein, 9 aa, Dengue virus
YNMMGKREK

SEQ ID NO: 60306 - protein, 9 aa, Dengue virus
NMMGKREKK

SEQ ID NO: 60307 - protein, 9 aa, Dengue virus
MMGKREKKL

SEQ ID NO: 60308 - protein, 9 aa, Dengue virus
MGKREKKLG

SEQ ID NO: 60309 - protein, 9 aa, Dengue virus
GKREKKLGE

SEQ ID NO: 60310 - protein, 9 aa, Dengue virus
KREKKLGEF

SEQ ID NO: 60311 - protein, 9 aa, Dengue virus
REKKLGEFG

SEQ ID NO: 60312 - protein, 9 aa, Dengue virus
EKKLGEFGK

SEQ ID NO: 60313 - protein, 9 aa, Dengue virus
KKLGEFGKA

SEQ ID NO: 60314 - protein, 9 aa, Dengue virus
KLGEFGKAK

SEQ ID NO: 60315 - protein, 9 aa, Dengue virus
LGEFGKAKG

SEQ ID NO: 60316 - protein, 9 aa, Dengue virus
GEFGKAKGS

SEQ ID NO: 60317 - protein, 9 aa, Dengue virus
EFGKAKGSR

SEQ ID NO: 60318 - protein, 9 aa, Dengue virus
FGKAKGSRA

SEQ ID NO: 60319 - protein, 9 aa, Dengue virus
GKAKGSRAI

SEQ ID NO: 60320 - protein, 9 aa, Dengue virus
KAKGSRAIW

SEQ ID NO: 60321 - protein, 9 aa, Dengue virus
AKGSRAIWY

SEQ ID NO: 60322 - protein, 9 aa, Dengue virus
KGSRAIWYM

SEQ ID NO: 60323 - protein, 9 aa, Dengue virus
GSRAIWYMW

SEQ ID NO: 60324 - protein, 9 aa, Dengue virus
SRAIWYMWL

SEQ ID NO: 60325 - protein, 9 aa, Dengue virus
RAIWYMWLG

SEQ ID NO: 60326 - protein, 9 aa, Dengue virus
AIWYMWLGA

SEQ ID NO: 60327 - protein, 9 aa, Dengue virus
IWYMWLGAR

SEQ ID NO: 60328 - protein, 9 aa, Dengue virus
WYMWLGARY

SEQ ID NO: 60329 - protein, 9 aa, Dengue virus
YMWLGARYL

SEQ ID NO: 60330 - protein, 9 aa, Dengue virus
MWLGARYLE

SEQ ID NO: 60331 - protein, 9 aa, Dengue virus
WLGARYLEF

SEQ ID NO: 60332 - protein, 9 aa, Dengue virus
LGARYLEFE

SEQ ID NO: 60333 - protein, 9 aa, Dengue virus
GARYLEFEA

SEQ ID NO: 60334 - protein, 9 aa, Dengue virus
ARYLEFEAL

SEQ ID NO: 60335 - protein, 9 aa, Dengue virus
RYLEFEALG

SEQ ID NO: 60336 - protein, 9 aa, Dengue virus
YLEFEALGF

SEQ ID NO: 60337 - protein, 9 aa, Dengue virus
LEFEALGFL

SEQ ID NO: 60338 - protein, 9 aa, Dengue virus
EFEALGFLN

SEQ ID NO: 60339 - protein, 9 aa, Dengue virus
FEALGFLNE

SEQ ID NO: 60340 - protein, 9 aa, Dengue virus
EALGFLNED

SEQ ID NO: 60341 - protein, 9 aa, Dengue virus
ALGFLNEDH

SEQ ID NO: 60342 - protein, 9 aa, Dengue virus
LGFLNEDHW

SEQ ID NO: 60343 - protein, 9 aa, Dengue virus
GFLNEDHWF

SEQ ID NO: 60344 - protein, 9 aa, Dengue virus
FLNEDHWFS

SEQ ID NO: 60345 - protein, 9 aa, Dengue virus
LNEDHWFSR

SEQ ID NO: 60346 - protein, 9 aa, Dengue virus
NEDHWFSRE

SEQ ID NO: 60347 - protein, 9 aa, Dengue virus
EDHWFSREN

SEQ ID NO: 60348 - protein, 9 aa, Dengue virus
DHWFSRENS

SEQ ID NO: 60349 - protein, 9 aa, Dengue virus
HWFSRENSY

SEQ ID NO: 60350 - protein, 9 aa, Dengue virus
WFSRENSYS

SEQ ID NO: 60351 - protein, 9 aa, Dengue virus
FSRENSYSG

SEQ ID NO: 60352 - protein, 9 aa, Dengue virus
SRENSYSGV

SEQ ID NO: 60353 - protein, 9 aa, Dengue virus
RENSYSGVE

SEQ ID NO: 60354 - protein, 9 aa, Dengue virus
ENSYSGVEG

SEQ ID NO: 60355 - protein, 9 aa, Dengue virus
NSYSGVEGE

SEQ ID NO: 60356 - protein, 9 aa, Dengue virus
SYSGVEGEG

SEQ ID NO: 60357 - protein, 9 aa, Dengue virus
YSGVEGEGL

SEQ ID NO: 60358 - protein, 9 aa, Dengue virus
SGVEGEGLH

SEQ ID NO: 60359 - protein, 9 aa, Dengue virus
GVEGEGLHK

SEQ ID NO: 60360 - protein, 9 aa, Dengue virus
VEGEGLHKL

SEQ ID NO: 60361 - protein, 9 aa, Dengue virus
EGEGLHKLG

SEQ ID NO: 60362 - protein, 9 aa, Dengue virus
GEGLHKLGY

SEQ ID NO: 60363 - protein, 9 aa, Dengue virus
EGLHKLGYI

SEQ ID NO: 60364 - protein, 9 aa, Dengue virus
GLHKLGYIL

SEQ ID NO: 60365 - protein, 9 aa, Dengue virus
LHKLGYILR

SEQ ID NO: 60366 - protein, 9 aa, Dengue virus
HKLGYILRD

SEQ ID NO: 60367 - protein, 9 aa, Dengue virus
KLGYILRDI

SEQ ID NO: 60368 - protein, 9 aa, Dengue virus
LGYILRDIS

SEQ ID NO: 60369 - protein, 9 aa, Dengue virus
GYILRDISK

SEQ ID NO: 60370 - protein, 9 aa, Dengue virus
YILRDISKI

SEQ ID NO: 60371 - protein, 9 aa, Dengue virus
ILRDISKIP

SEQ ID NO: 60372 - protein, 9 aa, Dengue virus
LRDISKIPG

SEQ ID NO: 60373 - protein, 9 aa, Dengue virus
RDISKIPGG

SEQ ID NO: 60374 - protein, 9 aa, Dengue virus
DISKIPGGA

SEQ ID NO: 60375 - protein, 9 aa, Dengue virus
ISKIPGGAM

SEQ ID NO: 60376 - protein, 9 aa, Dengue virus
SKIPGGAMY

SEQ ID NO: 60377 - protein, 9 aa, Dengue virus
KIPGGAMYA

SEQ ID NO: 60378 - protein, 9 aa, Dengue virus
IPGGAMYAD

SEQ ID NO: 60379 - protein, 9 aa, Dengue virus
PGGAMYADD

SEQ ID NO: 60380 - protein, 9 aa, Dengue virus
GGAMYADDT

SEQ ID NO: 60381 - protein, 9 aa, Dengue virus
GAMYADDTA

SEQ ID NO: 60382 - protein, 9 aa, Dengue virus
AMYADDTAG

SEQ ID NO: 60383 - protein, 9 aa, Dengue virus
MYADDTAGW

SEQ ID NO: 60384 - protein, 9 aa, Dengue virus
YADDTAGWD

SEQ ID NO: 60385 - protein, 9 aa, Dengue virus
ADDTAGWDT

SEQ ID NO: 60386 - protein, 9 aa, Dengue virus
DDTAGWDTR

SEQ ID NO: 60387 - protein, 9 aa, Dengue virus
DTAGWDTRI

SEQ ID NO: 60388 - protein, 9 aa, Dengue virus
TAGWDTRIT

SEQ ID NO: 60389 - protein, 9 aa, Dengue virus
AGWDTRITE

SEQ ID NO: 60390 - protein, 9 aa, Dengue virus
GWDTRITED

SEQ ID NO: 60391 - protein, 9 aa, Dengue virus
WDTRITEDD

SEQ ID NO: 60392 - protein, 9 aa, Dengue virus
DTRITEDDL

SEQ ID NO: 60393 - protein, 9 aa, Dengue virus
TRITEDDLH

SEQ ID NO: 60394 - protein, 9 aa, Dengue virus
RITEDDLHN

SEQ ID NO: 60395 - protein, 9 aa, Dengue virus
ITEDDLHNE

SEQ ID NO: 60396 - protein, 9 aa, Dengue virus
TEDDLHNEE

SEQ ID NO: 60397 - protein, 9 aa, Dengue virus
EDDLHNEEK

SEQ ID NO: 60398 - protein, 9 aa, Dengue virus
DDLHNEEKI

SEQ ID NO: 60399 - protein, 9 aa, Dengue virus
DLHNEEKIT

SEQ ID NO: 60400 - protein, 9 aa, Dengue virus
LHNEEKITQ

SEQ ID NO: 60401 - protein, 9 aa, Dengue virus
HNEEKITQQ

SEQ ID NO: 60402 - protein, 9 aa, Dengue virus
NEEKITQQM

SEQ ID NO: 60403 - protein, 9 aa, Dengue virus
EEKITQQMD

SEQ ID NO: 60404 - protein, 9 aa, Dengue virus
EKITQQMDP

SEQ ID NO: 60405 - protein, 9 aa, Dengue virus
KITQQMDPE

SEQ ID NO: 60406 - protein, 9 aa, Dengue virus
ITQQMDPEH

SEQ ID NO: 60407 - protein, 9 aa, Dengue virus
TQQMDPEHR

SEQ ID NO: 60408 - protein, 9 aa, Dengue virus
QMDPEHRQL

SEQ ID NO: 60409 - protein, 9 aa, Dengue virus
MDPEHRQLA

SEQ ID NO: 60410 - protein, 9 aa, Dengue virus
PEHRQLANA

SEQ ID NO: 60411 - protein, 9 aa, Dengue virus
EHRQLANAI

SEQ ID NO: 60412 - protein, 9 aa, Dengue virus
HRQLANAIF

SEQ ID NO: 60413 - protein, 9 aa, Dengue virus
RQLANAIFK

SEQ ID NO: 60414 - protein, 9 aa, Dengue virus
QLANAIFKL

SEQ ID NO: 60415 - protein, 9 aa, Dengue virus
LANAIFKLT

SEQ ID NO: 60416 - protein, 9 aa, Dengue virus
ANAIFKLTY

SEQ ID NO: 60417 - protein, 9 aa, Dengue virus
NAIFKLTYQ

SEQ ID NO: 60418 - protein, 9 aa, Dengue virus
AIFKLTYQN

SEQ ID NO: 60419 - protein, 9 aa, Dengue virus
IFKLTYQNK

SEQ ID NO: 60420 - protein, 9 aa, Dengue virus
FKLTYQNKV

SEQ ID NO: 60421 - protein, 9 aa, Dengue virus
KLTYQNKVV

SEQ ID NO: 60422 - protein, 9 aa, Dengue virus
LTYQNKVVK

SEQ ID NO: 60423 - protein, 9 aa, Dengue virus
TYQNKVVKV

SEQ ID NO: 60424 - protein, 9 aa, Dengue virus
YQNKVVKVQ

SEQ ID NO: 60425 - protein, 9 aa, Dengue virus
QNKVVKVQR

SEQ ID NO: 60426 - protein, 9 aa, Dengue virus
NKVVKVQRP

SEQ ID NO: 60427 - protein, 9 aa, Dengue virus
KVVKVQRPT

SEQ ID NO: 60428 - protein, 9 aa, Dengue virus
VVKVQRPTP

SEQ ID NO: 60429 - protein, 9 aa, Dengue virus
VKVQRPTPT

SEQ ID NO: 60430 - protein, 9 aa, Dengue virus
KVQRPTPTG

SEQ ID NO: 60431 - protein, 9 aa, Dengue virus
VQRPTPTGT

SEQ ID NO: 60432 - protein, 9 aa, Dengue virus
QRPTPTGTV

SEQ ID NO: 60433 - protein, 9 aa, Dengue virus
RPTPTGTVM

SEQ ID NO: 60434 - protein, 9 aa, Dengue virus
PTPTGTVMD

SEQ ID NO: 60435 - protein, 9 aa, Dengue virus
TPTGTVMDI

SEQ ID NO: 60436 - protein, 9 aa, Dengue virus
PTGTVMDII

SEQ ID NO: 60437 - protein, 9 aa, Dengue virus
TGTVMDIIS

SEQ ID NO: 60438 - protein, 9 aa, Dengue virus
GTVMDIISR

SEQ ID NO: 60439 - protein, 9 aa, Dengue virus
TVMDIISRK

SEQ ID NO: 60440 - protein, 9 aa, Dengue virus
VMDIISRKD

SEQ ID NO: 60441 - protein, 9 aa, Dengue virus
MDIISRKDQ

SEQ ID NO: 60442 - protein, 9 aa, Dengue virus
DIISRKDQR

SEQ ID NO: 60443 - protein, 9 aa, Dengue virus
IISRKDQRG

SEQ ID NO: 60444 - protein, 9 aa, Dengue virus
ISRKDQRGS

SEQ ID NO: 60445 - protein, 9 aa, Dengue virus
SRKDQRGSG

SEQ ID NO: 60446 - protein, 9 aa, Dengue virus
RKDQRGSGQ

SEQ ID NO: 60447 - protein, 9 aa, Dengue virus
KDQRGSGQV

SEQ ID NO: 60448 - protein, 9 aa, Dengue virus
DQRGSGQVG

SEQ ID NO: 60449 - protein, 9 aa, Dengue virus
QRGSGQVGT

SEQ ID NO: 60450 - protein, 9 aa, Dengue virus
RGSGQVGTY

SEQ ID NO: 60451 - protein, 9 aa, Dengue virus
GSGQVGTYG

SEQ ID NO: 60452 - protein, 9 aa, Dengue virus
SGQVGTYGL

SEQ ID NO: 60453 - protein, 9 aa, Dengue virus
GQVGTYGLN

SEQ ID NO: 60454 - protein, 9 aa, Dengue virus
QVGTYGLNT

SEQ ID NO: 60455 - protein, 9 aa, Dengue virus
FTNMEAQLI

SEQ ID NO: 60456 - protein, 9 aa, Dengue virus
TNMEAQLIR

SEQ ID NO: 60457 - protein, 9 aa, Dengue virus
NMEAQLIRQ

SEQ ID NO: 60458 - protein, 9 aa, Dengue virus
MEAQLIRQM

SEQ ID NO: 60459 - protein, 9 aa, Dengue virus
EAQLIRQME

SEQ ID NO: 60460 - protein, 9 aa, Dengue virus
AQLIRQMEG

SEQ ID NO: 60461 - protein, 9 aa, Dengue virus
QLIRQMEGE

SEQ ID NO: 60462 - protein, 9 aa, Dengue virus
LIRQMEGEG

SEQ ID NO: 60463 - protein, 9 aa, Dengue virus
IRQMEGEGV

SEQ ID NO: 60464 - protein, 9 aa, Dengue virus
RQMEGEGVL

SEQ ID NO: 60465 - protein, 9 aa, Dengue virus
QMEGEGVLS

SEQ ID NO: 60466 - protein, 9 aa, Dengue virus
MEGEGVLSK

SEQ ID NO: 60467 - protein, 9 aa, Dengue virus
EGEGVLSKA

SEQ ID NO: 60468 - protein, 9 aa, Dengue virus
EKKITQWLE

SEQ ID NO: 60469 - protein, 9 aa, Dengue virus
TQWLETKGV

SEQ ID NO: 60470 - protein, 9 aa, Dengue virus
QWLETKGVE

SEQ ID NO: 60471 - protein, 9 aa, Dengue virus
WLETKGVER

SEQ ID NO: 60472 - protein, 9 aa, Dengue virus
LETKGVERL

SEQ ID NO: 60473 - protein, 9 aa, Dengue virus
ETKGVERLK

SEQ ID NO: 60474 - protein, 9 aa, Dengue virus
TKGVERLKR

SEQ ID NO: 60475 - protein, 9 aa, Dengue virus
KGVERLKRM

SEQ ID NO: 60476 - protein, 9 aa, Dengue virus
GVERLKRMA

SEQ ID NO: 60477 - protein, 9 aa, Dengue virus
VERLKRMAI

SEQ ID NO: 60478 - protein, 9 aa, Dengue virus
ERLKRMAIS

SEQ ID NO: 60479 - protein, 9 aa, Dengue virus
RLKRMAISG

SEQ ID NO: 60480 - protein, 9 aa, Dengue virus
LKRMAISGD

SEQ ID NO: 60481 - protein, 9 aa, Dengue virus
KRMAISGDD

SEQ ID NO: 60482 - protein, 9 aa, Dengue virus
RMAISGDDC

SEQ ID NO: 60483 - protein, 9 aa, Dengue virus
MAISGDDCV

SEQ ID NO: 60484 - protein, 9 aa, Dengue virus
AISGDDCVV

SEQ ID NO: 60485 - protein, 9 aa, Dengue virus
ISGDDCVVK

SEQ ID NO: 60486 - protein, 9 aa, Dengue virus
SGDDCVVKP

SEQ ID NO: 60487 - protein, 9 aa, Dengue virus
GDDCVVKPI

SEQ ID NO: 60488 - protein, 9 aa, Dengue virus
DDCVVKPID

SEQ ID NO: 60489 - protein, 9 aa, Dengue virus
DCVVKPIDD

SEQ ID NO: 60490 - protein, 9 aa, Dengue virus
CVVKPIDDR

SEQ ID NO: 60491 - protein, 9 aa, Dengue virus
VVKPIDDRF

SEQ ID NO: 60492 - protein, 9 aa, Dengue virus
VKPIDDRFA

SEQ ID NO: 60493 - protein, 9 aa, Dengue virus
KPIDDRFAN

SEQ ID NO: 60494 - protein, 9 aa, Dengue virus
PIDDRFANA

SEQ ID NO: 60495 - protein, 9 aa, Dengue virus
IDDRFANAL

SEQ ID NO: 60496 - protein, 9 aa, Dengue virus
DDRFANALL

SEQ ID NO: 60497 - protein, 9 aa, Dengue virus
DRFANALLA

SEQ ID NO: 60498 - protein, 9 aa, Dengue virus
RFANALLAL

SEQ ID NO: 60499 - protein, 9 aa, Dengue virus
FANALLALN

SEQ ID NO: 60500 - protein, 9 aa, Dengue virus
ANALLALND

SEQ ID NO: 60501 - protein, 9 aa, Dengue virus
NALLALNDM

SEQ ID NO: 60502 - protein, 9 aa, Dengue virus
ALLALNDMG

SEQ ID NO: 60503 - protein, 9 aa, Dengue virus
LLALNDMGK

SEQ ID NO: 60504 - protein, 9 aa, Dengue virus
LALNDMGKV

SEQ ID NO: 60505 - protein, 9 aa, Dengue virus
ALNDMGKVR

SEQ ID NO: 60506 - protein, 9 aa, Dengue virus
LNDMGKVRK

SEQ ID NO: 60507 - protein, 9 aa, Dengue virus
NDMGKVRKD

SEQ ID NO: 60508 - protein, 9 aa, Dengue virus
DMGKVRKDI

SEQ ID NO: 60509 - protein, 9 aa, Dengue virus
MGKVRKDIP

SEQ ID NO: 60510 - protein, 9 aa, Dengue virus
GKVRKDIPQ

SEQ ID NO: 60511 - protein, 9 aa, Dengue virus
KVRKDIPQW

SEQ ID NO: 60512 - protein, 9 aa, Dengue virus
VRKDIPQWQ

SEQ ID NO: 60513 - protein, 9 aa, Dengue virus
RKDIPQWQP

SEQ ID NO: 60514 - protein, 9 aa, Dengue virus
KDIPQWQPS

SEQ ID NO: 60515 - protein, 9 aa, Dengue virus
DIPQWQPSK

SEQ ID NO: 60516 - protein, 9 aa, Dengue virus
IPQWQPSKG

SEQ ID NO: 60517 - protein, 9 aa, Dengue virus
PQWQPSKGW

SEQ ID NO: 60518 - protein, 9 aa, Dengue virus
QWQPSKGWH

SEQ ID NO: 60519 - protein, 9 aa, Dengue virus
WQPSKGWHD

SEQ ID NO: 60520 - protein, 9 aa, Dengue virus
QPSKGWHDW

SEQ ID NO: 60521 - protein, 9 aa, Dengue virus
PSKGWHDWQ

SEQ ID NO: 60522 - protein, 9 aa, Dengue virus
SKGWHDWQQ

SEQ ID NO: 60523 - protein, 9 aa, Dengue virus
KGWHDWQQV

SEQ ID NO: 60524 - protein, 9 aa, Dengue virus
GWHDWQQVP

SEQ ID NO: 60525 - protein, 9 aa, Dengue virus
WHDWQQVPF

SEQ ID NO: 60526 - protein, 9 aa, Dengue virus
HDWQQVPFC

SEQ ID NO: 60527 - protein, 9 aa, Dengue virus
DWQQVPFCS

SEQ ID NO: 60528 - protein, 9 aa, Dengue virus
WQQVPFCSH

SEQ ID NO: 60529 - protein, 9 aa, Dengue virus
QQVPFCSHH

SEQ ID NO: 60530 - protein, 9 aa, Dengue virus
QVPFCSHHF

SEQ ID NO: 60531 - protein, 9 aa, Dengue virus
VPFCSHHFH

SEQ ID NO: 60532 - protein, 9 aa, Dengue virus
PFCSHHFHE

SEQ ID NO: 60533 - protein, 9 aa, Dengue virus
FCSHHFHEL

SEQ ID NO: 60534 - protein, 9 aa, Dengue virus
CSHHFHELI

SEQ ID NO: 60535 - protein, 9 aa, Dengue virus
SHHFHELIM

SEQ ID NO: 60536 - protein, 9 aa, Dengue virus
HHFHELIMK

SEQ ID NO: 60537 - protein, 9 aa, Dengue virus
HFHELIMKD

SEQ ID NO: 60538 - protein, 9 aa, Dengue virus
FHELIMKDG

SEQ ID NO: 60539 - protein, 9 aa, Dengue virus
HELIMKDGR

SEQ ID NO: 60540 - protein, 9 aa, Dengue virus
ELIMKDGRK

SEQ ID NO: 60541 - protein, 9 aa, Dengue virus
LIMKDGRKL

SEQ ID NO: 60542 - protein, 9 aa, Dengue virus
IMKDGRKLV

SEQ ID NO: 60543 - protein, 9 aa, Dengue virus
MKDGRKLVV

SEQ ID NO: 60544 - protein, 9 aa, Dengue virus
KDGRKLVVP

SEQ ID NO: 60545 - protein, 9 aa, Dengue virus
DGRKLVVPC

SEQ ID NO: 60546 - protein, 9 aa, Dengue virus
GRKLVVPCR

SEQ ID NO: 60547 - protein, 9 aa, Dengue virus
RKLVVPCRP

SEQ ID NO: 60548 - protein, 9 aa, Dengue virus
KLVVPCRPQ

SEQ ID NO: 60549 - protein, 9 aa, Dengue virus
LVVPCRPQD

SEQ ID NO: 60550 - protein, 9 aa, Dengue virus
VVPCRPQDE

SEQ ID NO: 60551 - protein, 9 aa, Dengue virus
VPCRPQDEL

SEQ ID NO: 60552 - protein, 9 aa, Dengue virus
PCRPQDELI

SEQ ID NO: 60553 - protein, 9 aa, Dengue virus
CRPQDELIG

SEQ ID NO: 60554 - protein, 9 aa, Dengue virus
RPQDELIGR

SEQ ID NO: 60555 - protein, 9 aa, Dengue virus
PQDELIGRA

SEQ ID NO: 60556 - protein, 9 aa, Dengue virus
QDELIGRAR

SEQ ID NO: 60557 - protein, 9 aa, Dengue virus
DELIGRARI

SEQ ID NO: 60558 - protein, 9 aa, Dengue virus
ELIGRARIS

SEQ ID NO: 60559 - protein, 9 aa, Dengue virus
LIGRARISQ

SEQ ID NO: 60560 - protein, 9 aa, Dengue virus
IGRARISQG

SEQ ID NO: 60561 - protein, 9 aa, Dengue virus
GRARISQGA

SEQ ID NO: 60562 - protein, 9 aa, Dengue virus
RARISQGAG

SEQ ID NO: 60563 - protein, 9 aa, Dengue virus
ARISQGAGW

SEQ ID NO: 60564 - protein, 9 aa, Dengue virus
RISQGAGWS

SEQ ID NO: 60565 - protein, 9 aa, Dengue virus
ISQGAGWSL

SEQ ID NO: 60566 - protein, 9 aa, Dengue virus
SQGAGWSLR

SEQ ID NO: 60567 - protein, 9 aa, Dengue virus
QGAGWSLRE

SEQ ID NO: 60568 - protein, 9 aa, Dengue virus
GAGWSLRET

SEQ ID NO: 60569 - protein, 9 aa, Dengue virus
AGWSLRETA

SEQ ID NO: 60570 - protein, 9 aa, Dengue virus
GWSLRETAC

SEQ ID NO: 60571 - protein, 9 aa, Dengue virus
WSLRETACL

SEQ ID NO: 60572 - protein, 9 aa, Dengue virus
SLRETACLG

SEQ ID NO: 60573 - protein, 9 aa, Dengue virus
LRETACLGK

SEQ ID NO: 60574 - protein, 9 aa, Dengue virus
RETACLGKA

SEQ ID NO: 60575 - protein, 9 aa, Dengue virus
ETACLGKAY

SEQ ID NO: 60576 - protein, 9 aa, Dengue virus
TACLGKAYA

SEQ ID NO: 60577 - protein, 9 aa, Dengue virus
ACLGKAYAQ

SEQ ID NO: 60578 - protein, 9 aa, Dengue virus
CLGKAYAQM

SEQ ID NO: 60579 - protein, 9 aa, Dengue virus
LGKAYAQMW

SEQ ID NO: 60580 - protein, 9 aa, Dengue virus
GKAYAQMWS

SEQ ID NO: 60581 - protein, 9 aa, Dengue virus
KAYAQMWSL

SEQ ID NO: 60582 - protein, 9 aa, Dengue virus
AYAQMWSLM

SEQ ID NO: 60583 - protein, 9 aa, Dengue virus
YAQMWSLMY

SEQ ID NO: 60584 - protein, 9 aa, Dengue virus
AQMWSLMYF

SEQ ID NO: 60585 - protein, 9 aa, Dengue virus
QMWSLMYFH

SEQ ID NO: 60586 - protein, 9 aa, Dengue virus
MWSLMYFHR

SEQ ID NO: 60587 - protein, 9 aa, Dengue virus
WSLMYFHRR

SEQ ID NO: 60588 - protein, 9 aa, Dengue virus
SLMYFHRRD

SEQ ID NO: 60589 - protein, 9 aa, Dengue virus
LMYFHRRDL

SEQ ID NO: 60590 - protein, 9 aa, Dengue virus
MYFHRRDLR

SEQ ID NO: 60591 - protein, 9 aa, Dengue virus
YFHRRDLRL

SEQ ID NO: 60592 - protein, 9 aa, Dengue virus
FHRRDLRLA

SEQ ID NO: 60593 - protein, 9 aa, Dengue virus
HRRDLRLAS

SEQ ID NO: 60594 - protein, 9 aa, Dengue virus
RRDLRLASN

SEQ ID NO: 60595 - protein, 9 aa, Dengue virus
RDLRLASNA

SEQ ID NO: 60596 - protein, 9 aa, Dengue virus
DLRLASNAI

SEQ ID NO: 60597 - protein, 9 aa, Dengue virus
LRLASNAIC

SEQ ID NO: 60598 - protein, 9 aa, Dengue virus
RLASNAICS

SEQ ID NO: 60599 - protein, 9 aa, Dengue virus
LASNAICSA

SEQ ID NO: 60600 - protein, 9 aa, Dengue virus
ASNAICSAV

SEQ ID NO: 60601 - protein, 9 aa, Dengue virus
SNAICSAVP

SEQ ID NO: 60602 - protein, 9 aa, Dengue virus
NAICSAVPV

SEQ ID NO: 60603 - protein, 9 aa, Dengue virus
AICSAVPVH

SEQ ID NO: 60604 - protein, 9 aa, Dengue virus
ICSAVPVHW

SEQ ID NO: 60605 - protein, 9 aa, Dengue virus
CSAVPVHWV

SEQ ID NO: 60606 - protein, 9 aa, Dengue virus
SAVPVHWVP

SEQ ID NO: 60607 - protein, 9 aa, Dengue virus
AVPVHWVPT

SEQ ID NO: 60608 - protein, 9 aa, Dengue virus
VPVHWVPTS

SEQ ID NO: 60609 - protein, 9 aa, Dengue virus
PVHWVPTSR

SEQ ID NO: 60610 - protein, 9 aa, Dengue virus
VHWVPTSRT

SEQ ID NO: 60611 - protein, 9 aa, Dengue virus
HWVPTSRTT

SEQ ID NO: 60612 - protein, 9 aa, Dengue virus
WVPTSRTTW

SEQ ID NO: 60613 - protein, 9 aa, Dengue virus
VPTSRTTWS

SEQ ID NO: 60614 - protein, 9 aa, Dengue virus
PTSRTTWSI

SEQ ID NO: 60615 - protein, 9 aa, Dengue virus
TSRTTWSIH

SEQ ID NO: 60616 - protein, 9 aa, Dengue virus
SRTTWSIHA

SEQ ID NO: 60617 - protein, 9 aa, Dengue virus
RTTWSIHAH

SEQ ID NO: 60618 - protein, 9 aa, Dengue virus
TTWSIHAHH

SEQ ID NO: 60619 - protein, 9 aa, Dengue virus
TWSIHAHHQ

SEQ ID NO: 60620 - protein, 9 aa, Dengue virus
WSIHAHHQW

SEQ ID NO: 60621 - protein, 9 aa, Dengue virus
SIHAHHQWM

SEQ ID NO: 60622 - protein, 9 aa, Dengue virus
IHAHHQWMT

SEQ ID NO: 60623 - protein, 9 aa, Dengue virus
HAHHQWMTT

SEQ ID NO: 60624 - protein, 9 aa, Dengue virus
AHHQWMTTE

SEQ ID NO: 60625 - protein, 9 aa, Dengue virus
HHQWMTTED

SEQ ID NO: 60626 - protein, 9 aa, Dengue virus
HQWMTTEDM

SEQ ID NO: 60627 - protein, 9 aa, Dengue virus
QWMTTEDML

SEQ ID NO: 60628 - protein, 9 aa, Dengue virus
WMTTEDMLT

SEQ ID NO: 60629 - protein, 9 aa, Dengue virus
MTTEDMLTV

SEQ ID NO: 60630 - protein, 9 aa, Dengue virus
TTEDMLTVW

SEQ ID NO: 60631 - protein, 9 aa, Dengue virus
TEDMLTVWN

SEQ ID NO: 60632 - protein, 9 aa, Dengue virus
EDMLTVWNR

SEQ ID NO: 60633 - protein, 9 aa, Dengue virus
DMLTVWNRV

SEQ ID NO: 60634 - protein, 9 aa, Dengue virus
MLTVWNRVW

SEQ ID NO: 60635 - protein, 9 aa, Dengue virus
LTVWNRVWI

SEQ ID NO: 60636 - protein, 9 aa, Dengue virus
TVWNRVWIE

SEQ ID NO: 60637 - protein, 9 aa, Dengue virus
VWNRVWIED

SEQ ID NO: 60638 - protein, 9 aa, Dengue virus
WNRVWIEDN

SEQ ID NO: 60639 - protein, 9 aa, Dengue virus
NRVWIEDNP

SEQ ID NO: 60640 - protein, 9 aa, Dengue virus
RVWIEDNPW

SEQ ID NO: 60641 - protein, 9 aa, Dengue virus
VWIEDNPWM

SEQ ID NO: 60642 - protein, 9 aa, Dengue virus
WIEDNPWME

SEQ ID NO: 60643 - protein, 9 aa, Dengue virus
IEDNPWMED

SEQ ID NO: 60644 - protein, 9 aa, Dengue virus
EDNPWMEDK

SEQ ID NO: 60645 - protein, 9 aa, Dengue virus
DNPWMEDKT

SEQ ID NO: 60646 - protein, 9 aa, Dengue virus
NPWMEDKTP

SEQ ID NO: 60647 - protein, 9 aa, Dengue virus
PWMEDKTPV

SEQ ID NO: 60648 - protein, 9 aa, Dengue virus
WMEDKTPVT

SEQ ID NO: 60649 - protein, 9 aa, Dengue virus
MEDKTPVTT

SEQ ID NO: 60650 - protein, 9 aa, Dengue virus
EDKTPVTTW

SEQ ID NO: 60651 - protein, 9 aa, Dengue virus
DKTPVTTWE

SEQ ID NO: 60652 - protein, 9 aa, Dengue virus
KTPVTTWEN

SEQ ID NO: 60653 - protein, 9 aa, Dengue virus
TPVTTWENV

SEQ ID NO: 60654 - protein, 9 aa, Dengue virus
PVTTWENVP

SEQ ID NO: 60655 - protein, 9 aa, Dengue virus
VTTWENVPY

SEQ ID NO: 60656 - protein, 9 aa, Dengue virus
TTWENVPYL

SEQ ID NO: 60657 - protein, 9 aa, Dengue virus
TWENVPYLG

SEQ ID NO: 60658 - protein, 9 aa, Dengue virus
WENVPYLGK

SEQ ID NO: 60659 - protein, 9 aa, Dengue virus
ENVPYLGKR

SEQ ID NO: 60660 - protein, 9 aa, Dengue virus
NVPYLGKRE

SEQ ID NO: 60661 - protein, 9 aa, Dengue virus
VPYLGKRED

SEQ ID NO: 60662 - protein, 9 aa, Dengue virus
PYLGKREDQ

SEQ ID NO: 60663 - protein, 9 aa, Dengue virus
YLGKREDQW

SEQ ID NO: 60664 - protein, 9 aa, Dengue virus
LGKREDQWC

SEQ ID NO: 60665 - protein, 9 aa, Dengue virus
GKREDQWCG

SEQ ID NO: 60666 - protein, 9 aa, Dengue virus
KREDQWCGS

SEQ ID NO: 60667 - protein, 9 aa, Dengue virus
REDQWCGSL

SEQ ID NO: 60668 - protein, 9 aa, Dengue virus
EDQWCGSLI

SEQ ID NO: 60669 - protein, 9 aa, Dengue virus
DQWCGSLIG

SEQ ID NO: 60670 - protein, 9 aa, Dengue virus
QWCGSLIGL

SEQ ID NO: 60671 - protein, 9 aa, Dengue virus
WCGSLIGLT

SEQ ID NO: 60672 - protein, 9 aa, Dengue virus
CGSLIGLTS

SEQ ID NO: 60673 - protein, 9 aa, Dengue virus
GSLIGLTSR

SEQ ID NO: 60674 - protein, 9 aa, Dengue virus
SLIGLTSRA

SEQ ID NO: 60675 - protein, 9 aa, Dengue virus
LIGLTSRAT

SEQ ID NO: 60676 - protein, 9 aa, Dengue virus
IGLTSRATW

SEQ ID NO: 60677 - protein, 9 aa, Dengue virus
GLTSRATWA

SEQ ID NO: 60678 - protein, 9 aa, Dengue virus
LTSRATWAQ

SEQ ID NO: 60679 - protein, 9 aa, Dengue virus
TSRATWAQN

SEQ ID NO: 60680 - protein, 9 aa, Dengue virus
SRATWAQNI

SEQ ID NO: 60681 - protein, 9 aa, Dengue virus
RATWAQNIP

SEQ ID NO: 60682 - protein, 9 aa, Dengue virus
ATWAQNIPT

SEQ ID NO: 60683 - protein, 9 aa, Dengue virus
TWAQNIPTA

SEQ ID NO: 60684 - protein, 9 aa, Dengue virus
WAQNIPTAI

SEQ ID NO: 60685 - protein, 9 aa, Dengue virus
AQNIPTAIQ

SEQ ID NO: 60686 - protein, 9 aa, Dengue virus
QNIPTAIQQ

SEQ ID NO: 60687 - protein, 9 aa, Dengue virus
NIPTAIQQV

SEQ ID NO: 60688 - protein, 9 aa, Dengue virus
IPTAIQQVR

SEQ ID NO: 60689 - protein, 9 aa, Dengue virus
PTAIQQVRS

SEQ ID NO: 60690 - protein, 9 aa, Dengue virus
TAIQQVRSL

SEQ ID NO: 60691 - protein, 9 aa, Dengue virus
AIQQVRSLI

SEQ ID NO: 60692 - protein, 9 aa, Dengue virus
IQQVRSLIG

SEQ ID NO: 60693 - protein, 9 aa, Dengue virus
QQVRSLIGN

SEQ ID NO: 60694 - protein, 9 aa, Dengue virus
QVRSLIGNE

SEQ ID NO: 60695 - protein, 9 aa, Dengue virus
VRSLIGNEE

SEQ ID NO: 60696 - protein, 9 aa, Dengue virus
RSLIGNEEF

SEQ ID NO: 60697 - protein, 9 aa, Dengue virus
SLIGNEEFL

SEQ ID NO: 60698 - protein, 9 aa, Dengue virus
LIGNEEFLD

SEQ ID NO: 60699 - protein, 9 aa, Dengue virus
IGNEEFLDY

SEQ ID NO: 60700 - protein, 9 aa, Dengue virus
GNEEFLDYM

SEQ ID NO: 60701 - protein, 9 aa, Dengue virus
NEEFLDYMP

SEQ ID NO: 60702 - protein, 9 aa, Dengue virus
EEFLDYMPS

SEQ ID NO: 60703 - protein, 9 aa, Dengue virus
EFLDYMPSM

SEQ ID NO: 60704 - protein, 9 aa, Dengue virus
FLDYMPSMK

SEQ ID NO: 60705 - protein, 9 aa, Dengue virus
LDYMPSMKR

SEQ ID NO: 60706 - protein, 9 aa, Dengue virus
DYMPSMKRF

SEQ ID NO: 60707 - protein, 9 aa, Dengue virus
YMPSMKRFR

SEQ ID NO: 60708 - protein, 9 aa, Dengue virus
MPSMKRFRK

SEQ ID NO: 60709 - protein, 9 aa, Dengue virus
PSMKRFRKE

SEQ ID NO: 60710 - protein, 9 aa, Dengue virus
SMKRFRKEE

SEQ ID NO: 60711 - protein, 9 aa, Dengue virus
MKRFRKEEE

SEQ ID NO: 60712 - protein, 9 aa, Dengue virus
KRFRKEEES

SEQ ID NO: 60713 - protein, 9 aa, Dengue virus
RFRKEEESE

SEQ ID NO: 60714 - protein, 9 aa, Dengue virus
FRKEEESEG

SEQ ID NO: 60715 - protein, 9 aa, Dengue virus
RKEEESEGA

SEQ ID NO: 60716 - protein, 9 aa, Dengue virus
KEEESEGAI

SEQ ID NO: 60717 - protein, 9 aa, Dengue virus
EEESEGAIW

SEQ ID NO: 60718 - protein, 9 aa, Dengue virus
MNNQRKKAG

SEQ ID NO: 60719 - protein, 9 aa, Dengue virus
NNQRKKAGK

SEQ ID NO: 60720 - protein, 9 aa, Dengue virus
NQRKKAGKP

SEQ ID NO: 60721 - protein, 9 aa, Dengue virus
QRKKAGKPS

SEQ ID NO: 60722 - protein, 9 aa, Dengue virus
RKKAGKPSI

SEQ ID NO: 60723 - protein, 9 aa, Dengue virus
KKAGKPSIN

SEQ ID NO: 60724 - protein, 9 aa, Dengue virus
KAGKPSINM

SEQ ID NO: 60725 - protein, 9 aa, Dengue virus
AGKPSINML

SEQ ID NO: 60726 - protein, 9 aa, Dengue virus
VRNRVSTGT

SEQ ID NO: 60727 - protein, 9 aa, Dengue virus
SQLAKRFSR

SEQ ID NO: 60728 - protein, 9 aa, Dengue virus
QLAKRFSRG

SEQ ID NO: 60729 - protein, 9 aa, Dengue virus
LAKRFSRGL

SEQ ID NO: 60730 - protein, 9 aa, Dengue virus
AKRFSRGLL

SEQ ID NO: 60731 - protein, 9 aa, Dengue virus
KRFSRGLLN

SEQ ID NO: 60732 - protein, 9 aa, Dengue virus
RFSRGLLNG

SEQ ID NO: 60733 - protein, 9 aa, Dengue virus
FSRGLLNGQ

SEQ ID NO: 60734 - protein, 9 aa, Dengue virus
SRGLLNGQG

SEQ ID NO: 60735 - protein, 9 aa, Dengue virus
RGLLNGQGP

SEQ ID NO: 60736 - protein, 9 aa, Dengue virus
ELLNGQGPM

SEQ ID NO: 60737 - protein, 9 aa, Dengue virus
LAIPPTAGI

SEQ ID NO: 60738 - protein, 9 aa, Dengue virus
AIPPTAGIL

SEQ ID NO: 60739 - protein, 9 aa, Dengue virus
IPPTAGILA

SEQ ID NO: 60740 - protein, 9 aa, Dengue virus
PPTAGILAR

SEQ ID NO: 60741 - protein, 9 aa, Dengue virus
PTAGILARW

SEQ ID NO: 60742 - protein, 9 aa, Dengue virus
TAGILARWG

SEQ ID NO: 60743 - protein, 9 aa, Dengue virus
AGILARWGT

SEQ ID NO: 60744 - protein, 9 aa, Dengue virus
GILARWGTF

SEQ ID NO: 60745 - protein, 9 aa, Dengue virus
ILARWGTFK

SEQ ID NO: 60746 - protein, 9 aa, Dengue virus
FKKLGAIKV

SEQ ID NO: 60747 - protein, 9 aa, Dengue virus
KKLGAIKVL

SEQ ID NO: 60748 - protein, 9 aa, Dengue virus
KSGAIKVLR

SEQ ID NO: 60749 - protein, 9 aa, Dengue virus
SGAIKVLRG

SEQ ID NO: 60750 - protein, 9 aa, Dengue virus
GAIKVLRGF

SEQ ID NO: 60751 - protein, 9 aa, Dengue virus
AIKVLRGFK

SEQ ID NO: 60752 - protein, 9 aa, Dengue virus
IKVLRGFKK

SEQ ID NO: 60753 - protein, 9 aa, Dengue virus
KVLRGFKKE

SEQ ID NO: 60754 - protein, 9 aa, Dengue virus
VLRGFKKEI

SEQ ID NO: 60755 - protein, 9 aa, Dengue virus
LRGFKKEIS

SEQ ID NO: 60756 - protein, 9 aa, Dengue virus
RGFKKEISN

SEQ ID NO: 60757 - protein, 9 aa, Dengue virus
GFKREISNM

SEQ ID NO: 60758 - protein, 9 aa, Dengue virus
FKREISNML

SEQ ID NO: 60759 - protein, 9 aa, Dengue virus
KREISNMLS

SEQ ID NO: 60760 - protein, 9 aa, Dengue virus
REISNMLSI

SEQ ID NO: 60761 - protein, 9 aa, Dengue virus
SNMLSIINR

SEQ ID NO: 60762 - protein, 9 aa, Dengue virus
NMLSIINRR

SEQ ID NO: 60763 - protein, 9 aa, Dengue virus
MLSIINRRK

SEQ ID NO: 60764 - protein, 9 aa, Dengue virus
LSIINRRKK

SEQ ID NO: 60765 - protein, 9 aa, Dengue virus
SIINRRKKT

SEQ ID NO: 60766 - protein, 9 aa, Dengue virus
IINRRKKTS

SEQ ID NO: 60767 - protein, 9 aa, Dengue virus
NRRKKTSLC

SEQ ID NO: 60768 - protein, 9 aa, Dengue virus
RKKTSFCLM

SEQ ID NO: 60769 - protein, 9 aa, Dengue virus
KKTSFCLMM

SEQ ID NO: 60770 - protein, 9 aa, Dengue virus
MMLPATLAF

SEQ ID NO: 60771 - protein, 9 aa, Dengue virus
MLPATLAFH

SEQ ID NO: 60772 - protein, 9 aa, Dengue virus
LPATLAFHL

SEQ ID NO: 60773 - protein, 9 aa, Dengue virus
PATLAFHLT

SEQ ID NO: 60774 - protein, 9 aa, Dengue virus
ATLAFHLTS

SEQ ID NO: 60775 - protein, 9 aa, Dengue virus
TLAFHLTSR

SEQ ID NO: 60776 - protein, 9 aa, Dengue virus
DGEPRMIVA

SEQ ID NO: 60777 - protein, 9 aa, Dengue virus
GEPRMIVAK

SEQ ID NO: 60778 - protein, 9 aa, Dengue virus
EPRMIVAKN

SEQ ID NO: 60779 - protein, 9 aa, Dengue virus
PRMIVAKNE

SEQ ID NO: 60780 - protein, 9 aa, Dengue virus
RMIVAKNER

SEQ ID NO: 60781 - protein, 9 aa, Dengue virus
MIVAKNERG

SEQ ID NO: 60782 - protein, 9 aa, Dengue virus
IVAKNERGK

SEQ ID NO: 60783 - protein, 9 aa, Dengue virus
VAKNERGKS

SEQ ID NO: 60784 - protein, 9 aa, Dengue virus
AKNERGKSL

SEQ ID NO: 60785 - protein, 9 aa, Dengue virus
KSLLFKTAT

SEQ ID NO: 60786 - protein, 9 aa, Dengue virus
SLLFKTATG

SEQ ID NO: 60787 - protein, 9 aa, Dengue virus
LLFKTATGI

SEQ ID NO: 60788 - protein, 9 aa, Dengue virus
LFKTATGIN

SEQ ID NO: 60789 - protein, 9 aa, Dengue virus
FKTATGINM

SEQ ID NO: 60790 - protein, 9 aa, Dengue virus
KTATGINMC

SEQ ID NO: 60791 - protein, 9 aa, Dengue virus
TATGINMCT

SEQ ID NO: 60792 - protein, 9 aa, Dengue virus
ATGINMCTL

SEQ ID NO: 60793 - protein, 9 aa, Dengue virus
TGINMCTLI

SEQ ID NO: 60794 - protein, 9 aa, Dengue virus
LGEMCDDTI

SEQ ID NO: 60795 - protein, 9 aa, Dengue virus
GEMCDDTIT

SEQ ID NO: 60796 - protein, 9 aa, Dengue virus
EMCDDTITY

SEQ ID NO: 60797 - protein, 9 aa, Dengue virus
MCDDTITYK

SEQ ID NO: 60798 - protein, 9 aa, Dengue virus
CDDTITYKC

SEQ ID NO: 60799 - protein, 9 aa, Dengue virus
DDTITYKCP

SEQ ID NO: 60800 - protein, 9 aa, Dengue virus
DTVTYKCPL

SEQ ID NO: 60801 - protein, 9 aa, Dengue virus
TVTYKCPLI

SEQ ID NO: 60802 - protein, 9 aa, Dengue virus
TYKCPLIAE

SEQ ID NO: 60803 - protein, 9 aa, Dengue virus
IAEVEPEDI

SEQ ID NO: 60804 - protein, 9 aa, Dengue virus
AEVEPEDID

SEQ ID NO: 60805 - protein, 9 aa, Dengue virus
GTCNQAGER

SEQ ID NO: 60806 - protein, 9 aa, Dengue virus
TCNQAGERR

SEQ ID NO: 60807 - protein, 9 aa, Dengue virus
CNQAGERRR

SEQ ID NO: 60808 - protein, 9 aa, Dengue virus
NQAGERRRD

SEQ ID NO: 60809 - protein, 9 aa, Dengue virus
QAGERRRDK

SEQ ID NO: 60810 - protein, 9 aa, Dengue virus
AGERRRDKR

SEQ ID NO: 60811 - protein, 9 aa, Dengue virus
GERRRDKRS

SEQ ID NO: 60812 - protein, 9 aa, Dengue virus
ERRRDKRSV

SEQ ID NO: 60813 - protein, 9 aa, Dengue virus
RRRDKRSVA

SEQ ID NO: 60814 - protein, 9 aa, Dengue virus
VGMGLDTRA

SEQ ID NO: 60815 - protein, 9 aa, Dengue virus
GMGLDTRAQ

SEQ ID NO: 60816 - protein, 9 aa, Dengue virus
MGLDTRAQT

SEQ ID NO: 60817 - protein, 9 aa, Dengue virus
GLDTRAQTW

SEQ ID NO: 60818 - protein, 9 aa, Dengue virus
LDTRAQTWM

SEQ ID NO: 60819 - protein, 9 aa, Dengue virus
DTRAQTWMS

SEQ ID NO: 60820 - protein, 9 aa, Dengue virus
TRAQTWMSA

SEQ ID NO: 60821 - protein, 9 aa, Dengue virus
RAQTWMSAE

SEQ ID NO: 60822 - protein, 9 aa, Dengue virus
AQTWMSAEG

SEQ ID NO: 60823 - protein, 9 aa, Dengue virus
WRQVERVET

SEQ ID NO: 60824 - protein, 9 aa, Dengue virus
RQVERVETW

SEQ ID NO: 60825 - protein, 9 aa, Dengue virus
QVERVETWA

SEQ ID NO: 60826 - protein, 9 aa, Dengue virus
VEKVETWAF

SEQ ID NO: 60827 - protein, 9 aa, Dengue virus
EKVETWAFR

SEQ ID NO: 60828 - protein, 9 aa, Dengue virus
KVETWAFRH

SEQ ID NO: 60829 - protein, 9 aa, Dengue virus
VETWAFRHP

SEQ ID NO: 60830 - protein, 9 aa, Dengue virus
ETWAFRHPG

SEQ ID NO: 60831 - protein, 9 aa, Dengue virus
TWAFRHPGF

SEQ ID NO: 60832 - protein, 9 aa, Dengue virus
WAFRHPGFT

SEQ ID NO: 60833 - protein, 9 aa, Dengue virus
AFRHPGFTI

SEQ ID NO: 60834 - protein, 9 aa, Dengue virus
FRHPGFTIL

SEQ ID NO: 60835 - protein, 9 aa, Dengue virus
LALFLAHYV

SEQ ID NO: 60836 - protein, 9 aa, Dengue virus
ALFLAHYVG

SEQ ID NO: 60837 - protein, 9 aa, Dengue virus
LFLAHYVGT

SEQ ID NO: 60838 - protein, 9 aa, Dengue virus
FLAHYVGTS

SEQ ID NO: 60839 - protein, 9 aa, Dengue virus
LAHYVGTSL

SEQ ID NO: 60840 - protein, 9 aa, Dengue virus
AHYIGTSLI

SEQ ID NO: 60841 - protein, 9 aa, Dengue virus
HYIGTSLIQ

SEQ ID NO: 60842 - protein, 9 aa, Dengue virus
YIGTSLIQK

SEQ ID NO: 60843 - protein, 9 aa, Dengue virus
IGTSLTQKA

SEQ ID NO: 60844 - protein, 9 aa, Dengue virus
GTSLTQKAV

SEQ ID NO: 60845 - protein, 9 aa, Dengue virus
TSLTQKAVI

SEQ ID NO: 60846 - protein, 9 aa, Dengue virus
SLTQKAVIF

SEQ ID NO: 60847 - protein, 9 aa, Dengue virus
LTQKVVIFV

SEQ ID NO: 60848 - protein, 9 aa, Dengue virus
TQKVVIFVL

SEQ ID NO: 60849 - protein, 9 aa, Dengue virus
QKVVIFVLL

SEQ ID NO: 60850 - protein, 9 aa, Dengue virus
KVVIFVLLM

SEQ ID NO: 60851 - protein, 9 aa, Dengue virus
VVIFVLLML

SEQ ID NO: 60852 - protein, 9 aa, Dengue virus
VIFVLLMLV

SEQ ID NO: 60853 - protein, 9 aa, Dengue virus
IFVLLMLVT

SEQ ID NO: 60854 - protein, 9 aa, Dengue virus
FVLLMLVTP

SEQ ID NO: 60855 - protein, 9 aa, Dengue virus
VLLMLVTPS

SEQ ID NO: 60856 - protein, 9 aa, Dengue virus
LMLVTPSMA

SEQ ID NO: 60857 - protein, 9 aa, Dengue virus
MLVTPSMAM

SEQ ID NO: 60858 - protein, 9 aa, Dengue virus
LVTPSMAMR

SEQ ID NO: 60859 - protein, 9 aa, Dengue virus
VTPSMAMRC

SEQ ID NO: 60860 - protein, 9 aa, Dengue virus
TPSMAMRCV

SEQ ID NO: 60861 - protein, 9 aa, Dengue virus
PSMAMRCVG

SEQ ID NO: 60862 - protein, 9 aa, Dengue virus
SMAMRCVGV

SEQ ID NO: 60863 - protein, 9 aa, Dengue virus
MAMRCVGVG

SEQ ID NO: 60864 - protein, 9 aa, Dengue virus
AMRCVGVGN

SEQ ID NO: 60865 - protein, 9 aa, Dengue virus
GCVTTMAKS

SEQ ID NO: 60866 - protein, 9 aa, Dengue virus
CVTTMAKSK

SEQ ID NO: 60867 - protein, 9 aa, Dengue virus
VTTMAKSKP

SEQ ID NO: 60868 - protein, 9 aa, Dengue virus
TTMAKSKPT

SEQ ID NO: 60869 - protein, 9 aa, Dengue virus
TMAKSKPTL

SEQ ID NO: 60870 - protein, 9 aa, Dengue virus
MAKSKPTLD

SEQ ID NO: 60871 - protein, 9 aa, Dengue virus
AKSKPTLDI

SEQ ID NO: 60872 - protein, 9 aa, Dengue virus
KSKPTLDIE

SEQ ID NO: 60873 - protein, 9 aa, Dengue virus
SKPTLDIEL

SEQ ID NO: 60874 - protein, 9 aa, Dengue virus
CIEGKITNV

SEQ ID NO: 60875 - protein, 9 aa, Dengue virus
IEGKITNVT

SEQ ID NO: 60876 - protein, 9 aa, Dengue virus
EGKITNVTT

SEQ ID NO: 60877 - protein, 9 aa, Dengue virus
GKITNVTTD

SEQ ID NO: 60878 - protein, 9 aa, Dengue virus
KITNVTTDS

SEQ ID NO: 60879 - protein, 9 aa, Dengue virus
ITNVTTDSR

SEQ ID NO: 60880 - protein, 9 aa, Dengue virus
TNVTTDSRC

SEQ ID NO: 60881 - protein, 9 aa, Dengue virus
NVTTDSRCP

SEQ ID NO: 60882 - protein, 9 aa, Dengue virus
VTTDSRCPT

SEQ ID NO: 60883 - protein, 9 aa, Dengue virus
RCPTQGEAI

SEQ ID NO: 60884 - protein, 9 aa, Dengue virus
CPTQGEAIL

SEQ ID NO: 60885 - protein, 9 aa, Dengue virus
PTQGEAILP

SEQ ID NO: 60886 - protein, 9 aa, Dengue virus
TQGEAILPE

SEQ ID NO: 60887 - protein, 9 aa, Dengue virus
QGEAILPEE

SEQ ID NO: 60888 - protein, 9 aa, Dengue virus
GEAILPEEQ

SEQ ID NO: 60889 - protein, 9 aa, Dengue virus
EAILPEEQD

SEQ ID NO: 60890 - protein, 9 aa, Dengue virus
AILPEEQDQ

SEQ ID NO: 60891 - protein, 9 aa, Dengue virus
ILPEEQDQN

SEQ ID NO: 60892 - protein, 9 aa, Dengue virus
CAKFQCLES

SEQ ID NO: 60893 - protein, 9 aa, Dengue virus
AKFQCLESI

SEQ ID NO: 60894 - protein, 9 aa, Dengue virus
KFQCLESIE

SEQ ID NO: 60895 - protein, 9 aa, Dengue virus
FQCLESIEG

SEQ ID NO: 60896 - protein, 9 aa, Dengue virus
QCLESIEGK

SEQ ID NO: 60897 - protein, 9 aa, Dengue virus
IEGKVVQHE

SEQ ID NO: 60898 - protein, 9 aa, Dengue virus
EGKVVQHEN

SEQ ID NO: 60899 - protein, 9 aa, Dengue virus
GKVVQHENL

SEQ ID NO: 60900 - protein, 9 aa, Dengue virus
KVVQHENLK

SEQ ID NO: 60901 - protein, 9 aa, Dengue virus
VVQHENLKY

SEQ ID NO: 60902 - protein, 9 aa, Dengue virus
VQHENLKYT

SEQ ID NO: 60903 - protein, 9 aa, Dengue virus
QHENLKYTV

SEQ ID NO: 60904 - protein, 9 aa, Dengue virus
HENLKYTVI

SEQ ID NO: 60905 - protein, 9 aa, Dengue virus
ENLKYTVTI

SEQ ID NO: 60906 - protein, 9 aa, Dengue virus
NLKYTVTIT

SEQ ID NO: 60907 - protein, 9 aa, Dengue virus
LKYTVTITV

SEQ ID NO: 60908 - protein, 9 aa, Dengue virus
KYTVTITVH

SEQ ID NO: 60909 - protein, 9 aa, Dengue virus
YTVTITVHT

SEQ ID NO: 60910 - protein, 9 aa, Dengue virus
TVTITVHTG

SEQ ID NO: 60911 - protein, 9 aa, Dengue virus
VTITVHTGD

SEQ ID NO: 60912 - protein, 9 aa, Dengue virus
TITVHTGDQ

SEQ ID NO: 60913 - protein, 9 aa, Dengue virus
GDQHQVGND

SEQ ID NO: 60914 - protein, 9 aa, Dengue virus
DQHQVGNDT

SEQ ID NO: 60915 - protein, 9 aa, Dengue virus
QHQVGNDTQ

SEQ ID NO: 60916 - protein, 9 aa, Dengue virus
HQVGNDTQG

SEQ ID NO: 60917 - protein, 9 aa, Dengue virus
QVGNDTQGV

SEQ ID NO: 60918 - protein, 9 aa, Dengue virus
VGNDTQGVT

SEQ ID NO: 60919 - protein, 9 aa, Dengue virus
GNDTQGVTV

SEQ ID NO: 60920 - protein, 9 aa, Dengue virus
NDTQGVTVE

SEQ ID NO: 60921 - protein, 9 aa, Dengue virus
DTQGVTVEI

SEQ ID NO: 60922 - protein, 9 aa, Dengue virus
TQGVTVEIT

SEQ ID NO: 60923 - protein, 9 aa, Dengue virus
QGVTVEITP

SEQ ID NO: 60924 - protein, 9 aa, Dengue virus
GVTVEITPQ

SEQ ID NO: 60925 - protein, 9 aa, Dengue virus
VTVEITPQA

SEQ ID NO: 60926 - protein, 9 aa, Dengue virus
TVEITPQAS

SEQ ID NO: 60927 - protein, 9 aa, Dengue virus
VEITPQAST

SEQ ID NO: 60928 - protein, 9 aa, Dengue virus
EITPQASTV

SEQ ID NO: 60929 - protein, 9 aa, Dengue virus
ITPQASTVE

SEQ ID NO: 60930 - protein, 9 aa, Dengue virus
TPQASTVEA

SEQ ID NO: 60931 - protein, 9 aa, Dengue virus
QASTVEAVL

SEQ ID NO: 60932 - protein, 9 aa, Dengue virus
VEAVLPEYG

SEQ ID NO: 60933 - protein, 9 aa, Dengue virus
EAVLPEYGT

SEQ ID NO: 60934 - protein, 9 aa, Dengue virus
AVLPEYGTL

SEQ ID NO: 60935 - protein, 9 aa, Dengue virus
VLPEYGTLG

SEQ ID NO: 60936 - protein, 9 aa, Dengue virus
FFDLPLPWA

SEQ ID NO: 60937 - protein, 9 aa, Dengue virus
FDLPLPWAS

SEQ ID NO: 60938 - protein, 9 aa, Dengue virus
DLPLPWASG

SEQ ID NO: 60939 - protein, 9 aa, Dengue virus
LPLPWASGA

SEQ ID NO: 60940 - protein, 9 aa, Dengue virus
PLPWASGAT

SEQ ID NO: 60941 - protein, 9 aa, Dengue virus
LPWASGATT

SEQ ID NO: 60942 - protein, 9 aa, Dengue virus
TETPTWNKK

SEQ ID NO: 60943 - protein, 9 aa, Dengue virus
ETPTWNKKE

SEQ ID NO: 60944 - protein, 9 aa, Dengue virus
TPTWNKKEL

SEQ ID NO: 60945 - protein, 9 aa, Dengue virus
PTWNKKELL

SEQ ID NO: 60946 - protein, 9 aa, Dengue virus
TWNKKELLV

SEQ ID NO: 60947 - protein, 9 aa, Dengue virus
WNKKELLVT

SEQ ID NO: 60948 - protein, 9 aa, Dengue virus
NKKELLVTF

SEQ ID NO: 60949 - protein, 9 aa, Dengue virus
KKELLVTFK

SEQ ID NO: 60950 - protein, 9 aa, Dengue virus
LTGATEIQT

SEQ ID NO: 60951 - protein, 9 aa, Dengue virus
TGATEIQTS

SEQ ID NO: 60952 - protein, 9 aa, Dengue virus
GATEIQTSG

SEQ ID NO: 60953 - protein, 9 aa, Dengue virus
ATEIQTSGG

SEQ ID NO: 60954 - protein, 9 aa, Dengue virus
TEIQTSGGT

SEQ ID NO: 60955 - protein, 9 aa, Dengue virus
EIQTSGGTS

SEQ ID NO: 60956 - protein, 9 aa, Dengue virus
IQTSGGTSI

SEQ ID NO: 60957 - protein, 9 aa, Dengue virus
QTSGGTSIF

SEQ ID NO: 60958 - protein, 9 aa, Dengue virus
TSGGTSIFA

SEQ ID NO: 60959 - protein, 9 aa, Dengue virus
SGGTNIFAG

SEQ ID NO: 60960 - protein, 9 aa, Dengue virus
GGTNIFAGH

SEQ ID NO: 60961 - protein, 9 aa, Dengue virus
GTNIFAGHL

SEQ ID NO: 60962 - protein, 9 aa, Dengue virus
TNIFAGHLK

SEQ ID NO: 60963 - protein, 9 aa, Dengue virus
NIFAGHLKC

SEQ ID NO: 60964 - protein, 9 aa, Dengue virus
KGMSYAMCL

SEQ ID NO: 60965 - protein, 9 aa, Dengue virus
GMSYAMCLN

SEQ ID NO: 60966 - protein, 9 aa, Dengue virus
MSYAMCLNT

SEQ ID NO: 60967 - protein, 9 aa, Dengue virus
SYAMCLNTF

SEQ ID NO: 60968 - protein, 9 aa, Dengue virus
YAMCLNTFV

SEQ ID NO: 60969 - protein, 9 aa, Dengue virus
AMCLNTFVL

SEQ ID NO: 60970 - protein, 9 aa, Dengue virus
NAFVLKKEV

SEQ ID NO: 60971 - protein, 9 aa, Dengue virus
AFVLKKEVS

SEQ ID NO: 60972 - protein, 9 aa, Dengue virus
HGTILVKVE

SEQ ID NO: 60973 - protein, 9 aa, Dengue virus
GTILVKVEY

SEQ ID NO: 60974 - protein, 9 aa, Dengue virus
TILIKVEYR

SEQ ID NO: 60975 - protein, 9 aa, Dengue virus
ILIKVEYRG

SEQ ID NO: 60976 - protein, 9 aa, Dengue virus
LIKVEYRGE

SEQ ID NO: 60977 - protein, 9 aa, Dengue virus
IKVEYRGED

SEQ ID NO: 60978 - protein, 9 aa, Dengue virus
KVEYKGEDV

SEQ ID NO: 60979 - protein, 9 aa, Dengue virus
VEYKGEDVP

SEQ ID NO: 60980 - protein, 9 aa, Dengue virus
EYKGEDVPC

SEQ ID NO: 60981 - protein, 9 aa, Dengue virus
YKGEDVPCK

SEQ ID NO: 60982 - protein, 9 aa, Dengue virus
KGEDVPCKI

SEQ ID NO: 60983 - protein, 9 aa, Dengue virus
GEDVPCKIP

SEQ ID NO: 60984 - protein, 9 aa, Dengue virus
EDVPCKIPF

SEQ ID NO: 60985 - protein, 9 aa, Dengue virus
DVPCKIPFS

SEQ ID NO: 60986 - protein, 9 aa, Dengue virus
VPCKIPFST

SEQ ID NO: 60987 - protein, 9 aa, Dengue virus
PCKVPFSTE

SEQ ID NO: 60988 - protein, 9 aa, Dengue virus
CKVPFSTED

SEQ ID NO: 60989 - protein, 9 aa, Dengue virus
KVPFSTEDG

SEQ ID NO: 60990 - protein, 9 aa, Dengue virus
VPFSTEDGQ

SEQ ID NO: 60991 - protein, 9 aa, Dengue virus
PFSTEDEQG

SEQ ID NO: 60992 - protein, 9 aa, Dengue virus
FSTEDEQGK

SEQ ID NO: 60993 - protein, 9 aa, Dengue virus
STEDEQGKA

SEQ ID NO: 60994 - protein, 9 aa, Dengue virus
TEDEQGKAH

SEQ ID NO: 60995 - protein, 9 aa, Dengue virus
EDGQGKAHS

SEQ ID NO: 60996 - protein, 9 aa, Dengue virus
DGQGKAHSG

SEQ ID NO: 60997 - protein, 9 aa, Dengue virus
GQGKAHSGR

SEQ ID NO: 60998 - protein, 9 aa, Dengue virus
QGKAHSGRL

SEQ ID NO: 60999 - protein, 9 aa, Dengue virus
GKAHSGRLI

SEQ ID NO: 61000 - protein, 9 aa, Dengue virus
KAHSGRLIT

SEQ ID NO: 61001 - protein, 9 aa, Dengue virus
AHSGRLITA

SEQ ID NO: 61002 - protein, 9 aa, Dengue virus
HSGRLITAN

SEQ ID NO: 61003 - protein, 9 aa, Dengue virus
SGRLITANP

SEQ ID NO: 61004 - protein, 9 aa, Dengue virus
GRLITANPI

SEQ ID NO: 61005 - protein, 9 aa, Dengue virus
RLITANPIV

SEQ ID NO: 61006 - protein, 9 aa, Dengue virus
LITANPIVT

SEQ ID NO: 61007 - protein, 9 aa, Dengue virus
ITANPIVTK

SEQ ID NO: 61008 - protein, 9 aa, Dengue virus
TANPIVTKK

SEQ ID NO: 61009 - protein, 9 aa, Dengue virus
ANPIVTKKE

SEQ ID NO: 61010 - protein, 9 aa, Dengue virus
NPIVTKKEE

SEQ ID NO: 61011 - protein, 9 aa, Dengue virus
PIVTKKEEP

SEQ ID NO: 61012 - protein, 9 aa, Dengue virus
IVTKKEEPV

SEQ ID NO: 61013 - protein, 9 aa, Dengue virus
VTKKDEPVN

SEQ ID NO: 61014 - protein, 9 aa, Dengue virus
TKKDEPVNI

SEQ ID NO: 61015 - protein, 9 aa, Dengue virus
KKDEPVNIE

SEQ ID NO: 61016 - protein, 9 aa, Dengue virus
KDEPVNIEA

SEQ ID NO: 61017 - protein, 9 aa, Dengue virus
DEPVNIEAE

SEQ ID NO: 61018 - protein, 9 aa, Dengue virus
EPINIEAEP

SEQ ID NO: 61019 - protein, 9 aa, Dengue virus
PINIEAEPP

SEQ ID NO: 61020 - protein, 9 aa, Dengue virus
INIEAEPPF

SEQ ID NO: 61021 - protein, 9 aa, Dengue virus
PPFGESNII

SEQ ID NO: 61022 - protein, 9 aa, Dengue virus
PFGESNIII

SEQ ID NO: 61023 - protein, 9 aa, Dengue virus
FGESNIIIG

SEQ ID NO: 61024 - protein, 9 aa, Dengue virus
GESNIIIGI

SEQ ID NO: 61025 - protein, 9 aa, Dengue virus
ESNIIIGIG

SEQ ID NO: 61026 - protein, 9 aa, Dengue virus
SNIIIGIGD

SEQ ID NO: 61027 - protein, 9 aa, Dengue virus
GDKALKINW

SEQ ID NO: 61028 - protein, 9 aa, Dengue virus
DKALKINWY

SEQ ID NO: 61029 - protein, 9 aa, Dengue virus
KALKINWYK

SEQ ID NO: 61030 - protein, 9 aa, Dengue virus
SLKINWYKK

SEQ ID NO: 61031 - protein, 9 aa, Dengue virus
LKINWYRKG

SEQ ID NO: 61032 - protein, 9 aa, Dengue virus
KINWYRKGS

SEQ ID NO: 61033 - protein, 9 aa, Dengue virus
GSAYTALFG

SEQ ID NO: 61034 - protein, 9 aa, Dengue virus
SAYTALFGG

SEQ ID NO: 61035 - protein, 9 aa, Dengue virus
AYTALFGGV

SEQ ID NO: 61036 - protein, 9 aa, Dengue virus
YTALFGGVS

SEQ ID NO: 61037 - protein, 9 aa, Dengue virus
TALFGGVSW

SEQ ID NO: 61038 - protein, 9 aa, Dengue virus
ALFSGVSWI

SEQ ID NO: 61039 - protein, 9 aa, Dengue virus
LFSGVSWIM

SEQ ID NO: 61040 - protein, 9 aa, Dengue virus
FSGVSWIMK

SEQ ID NO: 61041 - protein, 9 aa, Dengue virus
SGVSWIMKI

SEQ ID NO: 61042 - protein, 9 aa, Dengue virus
GVSWIMKIG

SEQ ID NO: 61043 - protein, 9 aa, Dengue virus
VSWIMKIGI

SEQ ID NO: 61044 - protein, 9 aa, Dengue virus
SWIMKIGIG

SEQ ID NO: 61045 - protein, 9 aa, Dengue virus
WIMKIGIGV

SEQ ID NO: 61046 - protein, 9 aa, Dengue virus
IMKIGIGVL

SEQ ID NO: 61047 - protein, 9 aa, Dengue virus
MKIGIGILL

SEQ ID NO: 61048 - protein, 9 aa, Dengue virus
KIGIGILLT

SEQ ID NO: 61049 - protein, 9 aa, Dengue virus
IGIGILLTW

SEQ ID NO: 61050 - protein, 9 aa, Dengue virus
GIGILLTWI

SEQ ID NO: 61051 - protein, 9 aa, Dengue virus
IGILLTWIG

SEQ ID NO: 61052 - protein, 9 aa, Dengue virus
GILLTWIGL

SEQ ID NO: 61053 - protein, 9 aa, Dengue virus
ILLTWIGLN

SEQ ID NO: 61054 - protein, 9 aa, Dengue virus
TSMSFSCIV

SEQ ID NO: 61055 - protein, 9 aa, Dengue virus
SMSFSCIVI

SEQ ID NO: 61056 - protein, 9 aa, Dengue virus
MSFSCIVIG

SEQ ID NO: 61057 - protein, 9 aa, Dengue virus
SFSCIVIGI

SEQ ID NO: 61058 - protein, 9 aa, Dengue virus
FSCIVIGII

SEQ ID NO: 61059 - protein, 9 aa, Dengue virus
SCIVIGIIT

SEQ ID NO: 61060 - protein, 9 aa, Dengue virus
CIVIGIITL

SEQ ID NO: 61061 - protein, 9 aa, Dengue virus
IVIGIITLY

SEQ ID NO: 61062 - protein, 9 aa, Dengue virus
VIGIITLYL

SEQ ID NO: 61063 - protein, 9 aa, Dengue virus
IGVITLYLG

SEQ ID NO: 61064 - protein, 9 aa, Dengue virus
GVITLYLGA

SEQ ID NO: 61065 - protein, 9 aa, Dengue virus
VITLYLGAV

SEQ ID NO: 61066 - protein, 9 aa, Dengue virus
ITLYLGTVV

SEQ ID NO: 61067 - protein, 9 aa, Dengue virus
TLYLGTVVQ

SEQ ID NO: 61068 - protein, 9 aa, Dengue virus
LYLGTVVQA

SEQ ID NO: 61069 - protein, 9 aa, Dengue virus
YLGTVVQAD

SEQ ID NO: 61070 - protein, 9 aa, Dengue virus
LGAVVQADT

SEQ ID NO: 61071 - protein, 9 aa, Dengue virus
GAVVQADTG

SEQ ID NO: 61072 - protein, 9 aa, Dengue virus
AVVQADTGC

SEQ ID NO: 61073 - protein, 9 aa, Dengue virus
VVQADTGCV

SEQ ID NO: 61074 - protein, 9 aa, Dengue virus
VQADTGCVI

SEQ ID NO: 61075 - protein, 9 aa, Dengue virus
QADTGCVIN

SEQ ID NO: 61076 - protein, 9 aa, Dengue virus
ADTGCVINW

SEQ ID NO: 61077 - protein, 9 aa, Dengue virus
DTGCVINWK

SEQ ID NO: 61078 - protein, 9 aa, Dengue virus
TGCVINWKG

SEQ ID NO: 61079 - protein, 9 aa, Dengue virus
GCAINWKGK

SEQ ID NO: 61080 - protein, 9 aa, Dengue virus
CAINWKGKE

SEQ ID NO: 61081 - protein, 9 aa, Dengue virus
AINWKGKEL

SEQ ID NO: 61082 - protein, 9 aa, Dengue virus
VNWKGKELK

SEQ ID NO: 61083 - protein, 9 aa, Dengue virus
KGKELKCGN

SEQ ID NO: 61084 - protein, 9 aa, Dengue virus
GKELKCGNG

SEQ ID NO: 61085 - protein, 9 aa, Dengue virus
KELKCGNGI

SEQ ID NO: 61086 - protein, 9 aa, Dengue virus
ELKCGNGIF

SEQ ID NO: 61087 - protein, 9 aa, Dengue virus
LKCGNGIFV

SEQ ID NO: 61088 - protein, 9 aa, Dengue virus
KCGNGIFVT

SEQ ID NO: 61089 - protein, 9 aa, Dengue virus
CGNGIFVTN

SEQ ID NO: 61090 - protein, 9 aa, Dengue virus
GNGIFVTNE

SEQ ID NO: 61091 - protein, 9 aa, Dengue virus
NGIFVTNEV

SEQ ID NO: 61092 - protein, 9 aa, Dengue virus
MENLLWKQV

SEQ ID NO: 61093 - protein, 9 aa, Dengue virus
ENLLWKQVA

SEQ ID NO: 61094 - protein, 9 aa, Dengue virus
NLLWKQVAN

SEQ ID NO: 61095 - protein, 9 aa, Dengue virus
LLWKQVANE

SEQ ID NO: 61096 - protein, 9 aa, Dengue virus
LWKQVANEL

SEQ ID NO: 61097 - protein, 9 aa, Dengue virus
WKQVANELN

SEQ ID NO: 61098 - protein, 9 aa, Dengue virus
KQVANELNY

SEQ ID NO: 61099 - protein, 9 aa, Dengue virus
QVANELNYI

SEQ ID NO: 61100 - protein, 9 aa, Dengue virus
VANELNYIL

SEQ ID NO: 61101 - protein, 9 aa, Dengue virus
LNHILWENN

SEQ ID NO: 61102 - protein, 9 aa, Dengue virus
NYILWENNV

SEQ ID NO: 61103 - protein, 9 aa, Dengue virus
YILWENNVK

SEQ ID NO: 61104 - protein, 9 aa, Dengue virus
ILWENNVKL

SEQ ID NO: 61105 - protein, 9 aa, Dengue virus
LWENNVKLT

SEQ ID NO: 61106 - protein, 9 aa, Dengue virus
WENNIKLTI

SEQ ID NO: 61107 - protein, 9 aa, Dengue virus
ENNIKLTIV

SEQ ID NO: 61108 - protein, 9 aa, Dengue virus
NNIKLTIVV

SEQ ID NO: 61109 - protein, 9 aa, Dengue virus
NIKLTIVVG

SEQ ID NO: 61110 - protein, 9 aa, Dengue virus
IKLTIVVGD

SEQ ID NO: 61111 - protein, 9 aa, Dengue virus
KLTVVVGDT

SEQ ID NO: 61112 - protein, 9 aa, Dengue virus
LTVVVGDTI

SEQ ID NO: 61113 - protein, 9 aa, Dengue virus
TVVVGDTIG

SEQ ID NO: 61114 - protein, 9 aa, Dengue virus
IGILEQGKR

SEQ ID NO: 61115 - protein, 9 aa, Dengue virus
GILEQGKRT

SEQ ID NO: 61116 - protein, 9 aa, Dengue virus
ILEQGKRTL

SEQ ID NO: 61117 - protein, 9 aa, Dengue virus
LEQGKRALT

SEQ ID NO: 61118 - protein, 9 aa, Dengue virus
EQGKRALTP

SEQ ID NO: 61119 - protein, 9 aa, Dengue virus
QGKRALTPQ

SEQ ID NO: 61120 - protein, 9 aa, Dengue virus
GKRALTPQP

SEQ ID NO: 61121 - protein, 9 aa, Dengue virus
KRALTPQPM

SEQ ID NO: 61122 - protein, 9 aa, Dengue virus
RALTPQPME

SEQ ID NO: 61123 - protein, 9 aa, Dengue virus
ALTPQPMEL

SEQ ID NO: 61124 - protein, 9 aa, Dengue virus
LTLQPMELK

SEQ ID NO: 61125 - protein, 9 aa, Dengue virus
TLQPMELKY

SEQ ID NO: 61126 - protein, 9 aa, Dengue virus
MELKYSWKA

SEQ ID NO: 61127 - protein, 9 aa, Dengue virus
ELKYSWKAW

SEQ ID NO: 61128 - protein, 9 aa, Dengue virus
LKYSWKAWG

SEQ ID NO: 61129 - protein, 9 aa, Dengue virus
KYSWKAWGK

SEQ ID NO: 61130 - protein, 9 aa, Dengue virus
YSWKAWGKA

SEQ ID NO: 61131 - protein, 9 aa, Dengue virus
SWKTWGKAR

SEQ ID NO: 61132 - protein, 9 aa, Dengue virus
WKTWGKARI

SEQ ID NO: 61133 - protein, 9 aa, Dengue virus
KTWGKARIV

SEQ ID NO: 61134 - protein, 9 aa, Dengue virus
WGKARIVTA

SEQ ID NO: 61135 - protein, 9 aa, Dengue virus
GKARIVTAE

SEQ ID NO: 61136 - protein, 9 aa, Dengue virus
AEIQNSSFI

SEQ ID NO: 61137 - protein, 9 aa, Dengue virus
EIQNSSFII

SEQ ID NO: 61138 - protein, 9 aa, Dengue virus
IQNSSFIID

SEQ ID NO: 61139 - protein, 9 aa, Dengue virus
SSFIIDGPS

SEQ ID NO: 61140 - protein, 9 aa, Dengue virus
SFIIDGPST

SEQ ID NO: 61141 - protein, 9 aa, Dengue virus
FIIDGPSTP

SEQ ID NO: 61142 - protein, 9 aa, Dengue virus
IIDGPSTPE

SEQ ID NO: 61143 - protein, 9 aa, Dengue virus
IDGPSTPEC

SEQ ID NO: 61144 - protein, 9 aa, Dengue virus
DGPSTPECP

SEQ ID NO: 61145 - protein, 9 aa, Dengue virus
GPNTPECPN

SEQ ID NO: 61146 - protein, 9 aa, Dengue virus
PNTPECPNA

SEQ ID NO: 61147 - protein, 9 aa, Dengue virus
PNASRAWNV

SEQ ID NO: 61148 - protein, 9 aa, Dengue virus
NASRAWNVW

SEQ ID NO: 61149 - protein, 9 aa, Dengue virus
VSRAWNVWE

SEQ ID NO: 61150 - protein, 9 aa, Dengue virus
NIWLKLREM

SEQ ID NO: 61151 - protein, 9 aa, Dengue virus
IWLKLREMY

SEQ ID NO: 61152 - protein, 9 aa, Dengue virus
WLKLREMYT

SEQ ID NO: 61153 - protein, 9 aa, Dengue virus
LKLREMYTQ

SEQ ID NO: 61154 - protein, 9 aa, Dengue virus
TQSCDHRLM

SEQ ID NO: 61155 - protein, 9 aa, Dengue virus
QSCDHRLMS

SEQ ID NO: 61156 - protein, 9 aa, Dengue virus
SCDHRLMSA

SEQ ID NO: 61157 - protein, 9 aa, Dengue virus
DHRLMSAAI

SEQ ID NO: 61158 - protein, 9 aa, Dengue virus
HRLMSAAIK

SEQ ID NO: 61159 - protein, 9 aa, Dengue virus
RLMSAAIKD

SEQ ID NO: 61160 - protein, 9 aa, Dengue virus
LMSAAIKDE

SEQ ID NO: 61161 - protein, 9 aa, Dengue virus
MSAAIKDER

SEQ ID NO: 61162 - protein, 9 aa, Dengue virus
SAAIKDERA

SEQ ID NO: 61163 - protein, 9 aa, Dengue virus
AAIKDERAV

SEQ ID NO: 61164 - protein, 9 aa, Dengue virus
AIKDERAVH

SEQ ID NO: 61165 - protein, 9 aa, Dengue virus
IKDERAVHA

SEQ ID NO: 61166 - protein, 9 aa, Dengue virus
SWKLEKASF

SEQ ID NO: 61167 - protein, 9 aa, Dengue virus
WKLEKASFI

SEQ ID NO: 61168 - protein, 9 aa, Dengue virus
KLEKASFIE

SEQ ID NO: 61169 - protein, 9 aa, Dengue virus
LEKASFIEV

SEQ ID NO: 61170 - protein, 9 aa, Dengue virus
EKASFIEVK

SEQ ID NO: 61171 - protein, 9 aa, Dengue virus
KASFIEVKT

SEQ ID NO: 61172 - protein, 9 aa, Dengue virus
ASFIEVKTC

SEQ ID NO: 61173 - protein, 9 aa, Dengue virus
SFIEVKTCT

SEQ ID NO: 61174 - protein, 9 aa, Dengue virus
FIEVKTCTW

SEQ ID NO: 61175 - protein, 9 aa, Dengue virus
AGPISQHNH

SEQ ID NO: 61176 - protein, 9 aa, Dengue virus
GPISQHNHR

SEQ ID NO: 61177 - protein, 9 aa, Dengue virus
PISQHNHRP

SEQ ID NO: 61178 - protein, 9 aa, Dengue virus
ISQHNHRPG

SEQ ID NO: 61179 - protein, 9 aa, Dengue virus
SQHNHRPGY

SEQ ID NO: 61180 - protein, 9 aa, Dengue virus
QHNHRPGYH

SEQ ID NO: 61181 - protein, 9 aa, Dengue virus
HNHRPGYHT

SEQ ID NO: 61182 - protein, 9 aa, Dengue virus
NHRPGYHTQ

SEQ ID NO: 61183 - protein, 9 aa, Dengue virus
HRPGYHTQT

SEQ ID NO: 61184 - protein, 9 aa, Dengue virus
GYYTQTAGP

SEQ ID NO: 61185 - protein, 9 aa, Dengue virus
YYTQTAGPW

SEQ ID NO: 61186 - protein, 9 aa, Dengue virus
YTQTAGPWH

SEQ ID NO: 61187 - protein, 9 aa, Dengue virus
CEGTTVVIA

SEQ ID NO: 61188 - protein, 9 aa, Dengue virus
EGTTVVIAE

SEQ ID NO: 61189 - protein, 9 aa, Dengue virus
GTTVVITES

SEQ ID NO: 61190 - protein, 9 aa, Dengue virus
TTVVITESC

SEQ ID NO: 61191 - protein, 9 aa, Dengue virus
TVVITESCG

SEQ ID NO: 61192 - protein, 9 aa, Dengue virus
VVITESCGT

SEQ ID NO: 61193 - protein, 9 aa, Dengue virus
CGTRGSSLR

SEQ ID NO: 61194 - protein, 9 aa, Dengue virus
GTRGPALRT

SEQ ID NO: 61195 - protein, 9 aa, Dengue virus
TGGPSLRTT

SEQ ID NO: 61196 - protein, 9 aa, Dengue virus
RGSSLRTTT

SEQ ID NO: 61197 - protein, 9 aa, Dengue virus
WYGMEIRPV

SEQ ID NO: 61198 - protein, 9 aa, Dengue virus
YGMEIRPIN

SEQ ID NO: 61199 - protein, 9 aa, Dengue virus
GMEIRPINE

SEQ ID NO: 61200 - protein, 9 aa, Dengue virus
MEIRPINEK

SEQ ID NO: 61201 - protein, 9 aa, Dengue virus
EIRPINEKE

SEQ ID NO: 61202 - protein, 9 aa, Dengue virus
IRPINEKEE

SEQ ID NO: 61203 - protein, 9 aa, Dengue virus
RPINEKEEN

SEQ ID NO: 61204 - protein, 9 aa, Dengue virus
PINEKEENM

SEQ ID NO: 61205 - protein, 9 aa, Dengue virus
INEKEENMV

SEQ ID NO: 61206 - protein, 9 aa, Dengue virus
NEKEENMVK

SEQ ID NO: 61207 - protein, 9 aa, Dengue virus
EENMVKSLA

SEQ ID NO: 61208 - protein, 9 aa, Dengue virus
ENMVKSLAS

SEQ ID NO: 61209 - protein, 9 aa, Dengue virus
NMVKSLASA

SEQ ID NO: 61210 - protein, 9 aa, Dengue virus
MVKSLASAG

SEQ ID NO: 61211 - protein, 9 aa, Dengue virus
VKSLASAGS

SEQ ID NO: 61212 - protein, 9 aa, Dengue virus
KSLASAGSG

SEQ ID NO: 61213 - protein, 9 aa, Dengue virus
SLVSAGSGE

SEQ ID NO: 61214 - protein, 9 aa, Dengue virus
LVSAGSGEV

SEQ ID NO: 61215 - protein, 9 aa, Dengue virus
VSAGSGEVD

SEQ ID NO: 61216 - protein, 9 aa, Dengue virus
SAGSGEVDN

SEQ ID NO: 61217 - protein, 9 aa, Dengue virus
AGSGEVDNF

SEQ ID NO: 61218 - protein, 9 aa, Dengue virus
GSGEVDNFT

SEQ ID NO: 61219 - protein, 9 aa, Dengue virus
SGEVDNFTM

SEQ ID NO: 61220 - protein, 9 aa, Dengue virus
GEVDNFTMG

SEQ ID NO: 61221 - protein, 9 aa, Dengue virus
MDNFTMGIL

SEQ ID NO: 61222 - protein, 9 aa, Dengue virus
DNFTMGILC

SEQ ID NO: 61223 - protein, 9 aa, Dengue virus
NFTMGILCL

SEQ ID NO: 61224 - protein, 9 aa, Dengue virus
FTMGILCLA

SEQ ID NO: 61225 - protein, 9 aa, Dengue virus
TMGILCLAI

SEQ ID NO: 61226 - protein, 9 aa, Dengue virus
MGILCLAIL

SEQ ID NO: 61227 - protein, 9 aa, Dengue virus
GILCLAILF

SEQ ID NO: 61228 - protein, 9 aa, Dengue virus
ILCLAILFE

SEQ ID NO: 61229 - protein, 9 aa, Dengue virus
LAILFEEVL

SEQ ID NO: 61230 - protein, 9 aa, Dengue virus
AILFEEVLR

SEQ ID NO: 61231 - protein, 9 aa, Dengue virus
ILFEEVLRG

SEQ ID NO: 61232 - protein, 9 aa, Dengue virus
LFEEVLRGK

SEQ ID NO: 61233 - protein, 9 aa, Dengue virus
FEEVLRGKF

SEQ ID NO: 61234 - protein, 9 aa, Dengue virus
EEVLRGKFG

SEQ ID NO: 61235 - protein, 9 aa, Dengue virus
EVLRGKFGK

SEQ ID NO: 61236 - protein, 9 aa, Dengue virus
VLRGKFGKK

SEQ ID NO: 61237 - protein, 9 aa, Dengue virus
KFGKKHMIV

SEQ ID NO: 61238 - protein, 9 aa, Dengue virus
FGKKHMIVG

SEQ ID NO: 61239 - protein, 9 aa, Dengue virus
GKKHMIVGV

SEQ ID NO: 61240 - protein, 9 aa, Dengue virus
FMFVLLLSG

SEQ ID NO: 61241 - protein, 9 aa, Dengue virus
MFVLLLSGQ

SEQ ID NO: 61242 - protein, 9 aa, Dengue virus
VLLLSGQII

SEQ ID NO: 61243 - protein, 9 aa, Dengue virus
SGQITWRDL

SEQ ID NO: 61244 - protein, 9 aa, Dengue virus
GQITWRDMT

SEQ ID NO: 61245 - protein, 9 aa, Dengue virus
ARTLIMIGS

SEQ ID NO: 61246 - protein, 9 aa, Dengue virus
RTLIMIGSN

SEQ ID NO: 61247 - protein, 9 aa, Dengue virus
TFIMIGSNA

SEQ ID NO: 61248 - protein, 9 aa, Dengue virus
FIMIGSNAS

SEQ ID NO: 61249 - protein, 9 aa, Dengue virus
IMIGSNATD

SEQ ID NO: 61250 - protein, 9 aa, Dengue virus
MIGSNATDR

SEQ ID NO: 61251 - protein, 9 aa, Dengue virus
IGSNASDKM

SEQ ID NO: 61252 - protein, 9 aa, Dengue virus
GSNASDKMG

SEQ ID NO: 61253 - protein, 9 aa, Dengue virus
SNASDKMGM

SEQ ID NO: 61254 - protein, 9 aa, Dengue virus
NASDKMGMG

SEQ ID NO: 61255 - protein, 9 aa, Dengue virus
ATDRMGMGV

SEQ ID NO: 61256 - protein, 9 aa, Dengue virus
SDKMGMGVT

SEQ ID NO: 61257 - protein, 9 aa, Dengue virus
DKMGMGVTY

SEQ ID NO: 61258 - protein, 9 aa, Dengue virus
KMGMGVTYL

SEQ ID NO: 61259 - protein, 9 aa, Dengue virus
VTHLALIAT

SEQ ID NO: 61260 - protein, 9 aa, Dengue virus
HLALIATFK

SEQ ID NO: 61261 - protein, 9 aa, Dengue virus
IATFKIQPL

SEQ ID NO: 61262 - protein, 9 aa, Dengue virus
ATFKIQPLL

SEQ ID NO: 61263 - protein, 9 aa, Dengue virus
TFKIQPLLA

SEQ ID NO: 61264 - protein, 9 aa, Dengue virus
FKIQPLLAL

SEQ ID NO: 61265 - protein, 9 aa, Dengue virus
KIQPLLALG

SEQ ID NO: 61266 - protein, 9 aa, Dengue virus
IQPLLALGF

SEQ ID NO: 61267 - protein, 9 aa, Dengue virus
PLLALGFFL

SEQ ID NO: 61268 - protein, 9 aa, Dengue virus
LLALGFFLR

SEQ ID NO: 61269 - protein, 9 aa, Dengue virus
LGVGLAMAA

SEQ ID NO: 61270 - protein, 9 aa, Dengue virus
GVGLAMAAT

SEQ ID NO: 61271 - protein, 9 aa, Dengue virus
VGLAMAATL

SEQ ID NO: 61272 - protein, 9 aa, Dengue virus
GLAMAATLR

SEQ ID NO: 61273 - protein, 9 aa, Dengue virus
LAMAATLRL

SEQ ID NO: 61274 - protein, 9 aa, Dengue virus
AMAATLRLP

SEQ ID NO: 61275 - protein, 9 aa, Dengue virus
MAATLRLPE

SEQ ID NO: 61276 - protein, 9 aa, Dengue virus
AATLRLPED

SEQ ID NO: 61277 - protein, 9 aa, Dengue virus
ATLRLPEDI

SEQ ID NO: 61278 - protein, 9 aa, Dengue virus
TLRLPEDIE

SEQ ID NO: 61279 - protein, 9 aa, Dengue virus
LRLPEDIEQ

SEQ ID NO: 61280 - protein, 9 aa, Dengue virus
RLPEDIEQM

SEQ ID NO: 61281 - protein, 9 aa, Dengue virus
NGIALGLMT

SEQ ID NO: 61282 - protein, 9 aa, Dengue virus
GIALGLMTL

SEQ ID NO: 61283 - protein, 9 aa, Dengue virus
IALGLMTLK

SEQ ID NO: 61284 - protein, 9 aa, Dengue virus
ALGLMTLKL

SEQ ID NO: 61285 - protein, 9 aa, Dengue virus
LGLMTLKLI

SEQ ID NO: 61286 - protein, 9 aa, Dengue virus
GLMTLKLIT

SEQ ID NO: 61287 - protein, 9 aa, Dengue virus
LMTLKLITQ

SEQ ID NO: 61288 - protein, 9 aa, Dengue virus
MTLKLITQF

SEQ ID NO: 61289 - protein, 9 aa, Dengue virus
TLKLITQFE

SEQ ID NO: 61290 - protein, 9 aa, Dengue virus
LKLTTQFET

SEQ ID NO: 61291 - protein, 9 aa, Dengue virus
KLTTQFETY

SEQ ID NO: 61292 - protein, 9 aa, Dengue virus
LTTQFETYQ

SEQ ID NO: 61293 - protein, 9 aa, Dengue virus
TTQFETYQL

SEQ ID NO: 61294 - protein, 9 aa, Dengue virus
QFETYQLWA

SEQ ID NO: 61295 - protein, 9 aa, Dengue virus
FETYQLWAA

SEQ ID NO: 61296 - protein, 9 aa, Dengue virus
ETYQLWAAL

SEQ ID NO: 61297 - protein, 9 aa, Dengue virus
TYQLWTALV

SEQ ID NO: 61298 - protein, 9 aa, Dengue virus
YQLWTALVS

SEQ ID NO: 61299 - protein, 9 aa, Dengue virus
QLWTALVSL

SEQ ID NO: 61300 - protein, 9 aa, Dengue virus
LWTALVSLT

SEQ ID NO: 61301 - protein, 9 aa, Dengue virus
WTALVSLTC

SEQ ID NO: 61302 - protein, 9 aa, Dengue virus
ALVSLTCSN

SEQ ID NO: 61303 - protein, 9 aa, Dengue virus
LVSLTCSNT

SEQ ID NO: 61304 - protein, 9 aa, Dengue virus
SLTCSNTMF

SEQ ID NO: 61305 - protein, 9 aa, Dengue virus
LTCSNTMFT

SEQ ID NO: 61306 - protein, 9 aa, Dengue virus
TCSNTMFTL

SEQ ID NO: 61307 - protein, 9 aa, Dengue virus
CSNTMFTLT

SEQ ID NO: 61308 - protein, 9 aa, Dengue virus
SNTMFTLTV

SEQ ID NO: 61309 - protein, 9 aa, Dengue virus
NTMFTLTVA

SEQ ID NO: 61310 - protein, 9 aa, Dengue virus
TMFTLTVAW

SEQ ID NO: 61311 - protein, 9 aa, Dengue virus
MFTLTVAWR

SEQ ID NO: 61312 - protein, 9 aa, Dengue virus
RTATLILAV

SEQ ID NO: 61313 - protein, 9 aa, Dengue virus
TATLILAGI

SEQ ID NO: 61314 - protein, 9 aa, Dengue virus
ATLILAGIS

SEQ ID NO: 61315 - protein, 9 aa, Dengue virus
TLILAGISL

SEQ ID NO: 61316 - protein, 9 aa, Dengue virus
LILAGISLL

SEQ ID NO: 61317 - protein, 9 aa, Dengue virus
ILAGISLLP

SEQ ID NO: 61318 - protein, 9 aa, Dengue virus
VSLLPLCQS

SEQ ID NO: 61319 - protein, 9 aa, Dengue virus
SLLPLCQSS

SEQ ID NO: 61320 - protein, 9 aa, Dengue virus
LLPLCQSSS

SEQ ID NO: 61321 - protein, 9 aa, Dengue virus
LPLCQSSSM

SEQ ID NO: 61322 - protein, 9 aa, Dengue virus
PLCQSSSMR

SEQ ID NO: 61323 - protein, 9 aa, Dengue virus
LCQSSSMRK

SEQ ID NO: 61324 - protein, 9 aa, Dengue virus
CQSSSMRKS

SEQ ID NO: 61325 - protein, 9 aa, Dengue virus
QSSSMRKSD

SEQ ID NO: 61326 - protein, 9 aa, Dengue virus
SSSMRKSDW

SEQ ID NO: 61327 - protein, 9 aa, Dengue virus
SSMRKSDWL

SEQ ID NO: 61328 - protein, 9 aa, Dengue virus
SMRKSDWLP

SEQ ID NO: 61329 - protein, 9 aa, Dengue virus
MRKSDWLPM

SEQ ID NO: 61330 - protein, 9 aa, Dengue virus
RKTDWLPMA

SEQ ID NO: 61331 - protein, 9 aa, Dengue virus
KTDWLPMAV

SEQ ID NO: 61332 - protein, 9 aa, Dengue virus
TDWLPMAVA

SEQ ID NO: 61333 - protein, 9 aa, Dengue virus
DWLPMAVAA

SEQ ID NO: 61334 - protein, 9 aa, Dengue virus
WLPMAVAAM

SEQ ID NO: 61335 - protein, 9 aa, Dengue virus
LPMAVAAMG

SEQ ID NO: 61336 - protein, 9 aa, Dengue virus
PMAVAAMGV

SEQ ID NO: 61337 - protein, 9 aa, Dengue virus
VAAMGVPSL

SEQ ID NO: 61338 - protein, 9 aa, Dengue virus
AAMGVPSLP

SEQ ID NO: 61339 - protein, 9 aa, Dengue virus
AMGVPSLPL

SEQ ID NO: 61340 - protein, 9 aa, Dengue virus
MGVPSLPLF

SEQ ID NO: 61341 - protein, 9 aa, Dengue virus
GVPSLPLFI

SEQ ID NO: 61342 - protein, 9 aa, Dengue virus
VPSLPLFIF

SEQ ID NO: 61343 - protein, 9 aa, Dengue virus
SLPLFIFSL

SEQ ID NO: 61344 - protein, 9 aa, Dengue virus
LPLFIFNLK

SEQ ID NO: 61345 - protein, 9 aa, Dengue virus
PLFIFNLKD

SEQ ID NO: 61346 - protein, 9 aa, Dengue virus
LFIFNLKDT

SEQ ID NO: 61347 - protein, 9 aa, Dengue virus
LKDTPKRRS

SEQ ID NO: 61348 - protein, 9 aa, Dengue virus
KDTPKRRSW

SEQ ID NO: 61349 - protein, 9 aa, Dengue virus
DTPKRRSWP

SEQ ID NO: 61350 - protein, 9 aa, Dengue virus
TPKRRSWPL

SEQ ID NO: 61351 - protein, 9 aa, Dengue virus
PKRRSWPLN

SEQ ID NO: 61352 - protein, 9 aa, Dengue virus
KRKSWPLNE

SEQ ID NO: 61353 - protein, 9 aa, Dengue virus
RKSWPLNEG

SEQ ID NO: 61354 - protein, 9 aa, Dengue virus
KSWPLNEGV

SEQ ID NO: 61355 - protein, 9 aa, Dengue virus
LVSILASSF

SEQ ID NO: 61356 - protein, 9 aa, Dengue virus
VSILASSFL

SEQ ID NO: 61357 - protein, 9 aa, Dengue virus
SILASSFLR

SEQ ID NO: 61358 - protein, 9 aa, Dengue virus
ILASSFLRN

SEQ ID NO: 61359 - protein, 9 aa, Dengue virus
LASSFLRND

SEQ ID NO: 61360 - protein, 9 aa, Dengue virus
ASSFLRNDV

SEQ ID NO: 61361 - protein, 9 aa, Dengue virus
SSFLRNDVP

SEQ ID NO: 61362 - protein, 9 aa, Dengue virus
SFLRNDVPM

SEQ ID NO: 61363 - protein, 9 aa, Dengue virus
FLRNDVPMA

SEQ ID NO: 61364 - protein, 9 aa, Dengue virus
ITGTSADLI

SEQ ID NO: 61365 - protein, 9 aa, Dengue virus
TGTSADLIV

SEQ ID NO: 61366 - protein, 9 aa, Dengue virus
GTSADLIVE

SEQ ID NO: 61367 - protein, 9 aa, Dengue virus
TSADLIVEK

SEQ ID NO: 61368 - protein, 9 aa, Dengue virus
SADLIVEKA

SEQ ID NO: 61369 - protein, 9 aa, Dengue virus
ADLIVEKAA

SEQ ID NO: 61370 - protein, 9 aa, Dengue virus
DLIVEKAAD

SEQ ID NO: 61371 - protein, 9 aa, Dengue virus
ADITWEEEA

SEQ ID NO: 61372 - protein, 9 aa, Dengue virus
DITWEEEAE

SEQ ID NO: 61373 - protein, 9 aa, Dengue virus
ITWEEEAEQ

SEQ ID NO: 61374 - protein, 9 aa, Dengue virus
TGVSHNLMV

SEQ ID NO: 61375 - protein, 9 aa, Dengue virus
GVSHNLMVT

SEQ ID NO: 61376 - protein, 9 aa, Dengue virus
VSHNLMVTV

SEQ ID NO: 61377 - protein, 9 aa, Dengue virus
SHNLMVTVD

SEQ ID NO: 61378 - protein, 9 aa, Dengue virus
HNLMVTVDD

SEQ ID NO: 61379 - protein, 9 aa, Dengue virus
NLMVTVDDD

SEQ ID NO: 61380 - protein, 9 aa, Dengue virus
LMVTVDDDG

SEQ ID NO: 61381 - protein, 9 aa, Dengue virus
MVTVDDDGT

SEQ ID NO: 61382 - protein, 9 aa, Dengue virus
VTVDDDGTM

SEQ ID NO: 61383 - protein, 9 aa, Dengue virus
DDDGTMKIK

SEQ ID NO: 61384 - protein, 9 aa, Dengue virus
DDGTMKIKD

SEQ ID NO: 61385 - protein, 9 aa, Dengue virus
DGTMKIKDD

SEQ ID NO: 61386 - protein, 9 aa, Dengue virus
GTMKIKDDE

SEQ ID NO: 61387 - protein, 9 aa, Dengue virus
TMKIKDDET

SEQ ID NO: 61388 - protein, 9 aa, Dengue virus
MKIKDDETE

SEQ ID NO: 61389 - protein, 9 aa, Dengue virus
KIKDDETEN

SEQ ID NO: 61390 - protein, 9 aa, Dengue virus
TALLIVSGV

SEQ ID NO: 61391 - protein, 9 aa, Dengue virus
ALLIVSGVF

SEQ ID NO: 61392 - protein, 9 aa, Dengue virus
LLIVSGVFP

SEQ ID NO: 61393 - protein, 9 aa, Dengue virus
LIVSGVFPY

SEQ ID NO: 61394 - protein, 9 aa, Dengue virus
IVSGVFPYS

SEQ ID NO: 61395 - protein, 9 aa, Dengue virus
VSGVFPYSI

SEQ ID NO: 61396 - protein, 9 aa, Dengue virus
SGVFPYSIP

SEQ ID NO: 61397 - protein, 9 aa, Dengue virus
GVFPYSIPA

SEQ ID NO: 61398 - protein, 9 aa, Dengue virus
VFPYSIPAT

SEQ ID NO: 61399 - protein, 9 aa, Dengue virus
LVWHTWQKR

SEQ ID NO: 61400 - protein, 9 aa, Dengue virus
VWHTWQKRT

SEQ ID NO: 61401 - protein, 9 aa, Dengue virus
WHTWQKQTR

SEQ ID NO: 61402 - protein, 9 aa, Dengue virus
HTWQKQTRR

SEQ ID NO: 61403 - protein, 9 aa, Dengue virus
TWQKQTRRS

SEQ ID NO: 61404 - protein, 9 aa, Dengue virus
WQKQTRRSG

SEQ ID NO: 61405 - protein, 9 aa, Dengue virus
QKQTRRSGV

SEQ ID NO: 61406 - protein, 9 aa, Dengue virus
KQTRRSGVL

SEQ ID NO: 61407 - protein, 9 aa, Dengue virus
QTRRSGVLW

SEQ ID NO: 61408 - protein, 9 aa, Dengue virus
TRRSGVLWD

SEQ ID NO: 61409 - protein, 9 aa, Dengue virus
RRSGVLWDV

SEQ ID NO: 61410 - protein, 9 aa, Dengue virus
EGVYRINQQ

SEQ ID NO: 61411 - protein, 9 aa, Dengue virus
YRIKQQGIL

SEQ ID NO: 61412 - protein, 9 aa, Dengue virus
RIKQQGILG

SEQ ID NO: 61413 - protein, 9 aa, Dengue virus
IKQQGILGK

SEQ ID NO: 61414 - protein, 9 aa, Dengue virus
KQQGILGKT

SEQ ID NO: 61415 - protein, 9 aa, Dengue virus
QQGILGKTQ

SEQ ID NO: 61416 - protein, 9 aa, Dengue virus
QGILGKTQV

SEQ ID NO: 61417 - protein, 9 aa, Dengue virus
GILGKTQVG

SEQ ID NO: 61418 - protein, 9 aa, Dengue virus
ILGKTQVGV

SEQ ID NO: 61419 - protein, 9 aa, Dengue virus
LGKTQVGVG

SEQ ID NO: 61420 - protein, 9 aa, Dengue virus
KTQVGVGIQ

SEQ ID NO: 61421 - protein, 9 aa, Dengue virus
TQVGVGIQK

SEQ ID NO: 61422 - protein, 9 aa, Dengue virus
QVGVGIQKE

SEQ ID NO: 61423 - protein, 9 aa, Dengue virus
VGVGIQKEG

SEQ ID NO: 61424 - protein, 9 aa, Dengue virus
GVGIQKEGV

SEQ ID NO: 61425 - protein, 9 aa, Dengue virus
VGIQKEGVF

SEQ ID NO: 61426 - protein, 9 aa, Dengue virus
GIQKEGVFH

SEQ ID NO: 61427 - protein, 9 aa, Dengue virus
IQKEGVFHT

SEQ ID NO: 61428 - protein, 9 aa, Dengue virus
VTRGAVLTH

SEQ ID NO: 61429 - protein, 9 aa, Dengue virus
TRGAVLTHN

SEQ ID NO: 61430 - protein, 9 aa, Dengue virus
RGAVLTHNG

SEQ ID NO: 61431 - protein, 9 aa, Dengue virus
GAVLTHNGK

SEQ ID NO: 61432 - protein, 9 aa, Dengue virus
AVLTHNGKR

SEQ ID NO: 61433 - protein, 9 aa, Dengue virus
VLTHNGKRL

SEQ ID NO: 61434 - protein, 9 aa, Dengue virus
LTHNGKRLE

SEQ ID NO: 61435 - protein, 9 aa, Dengue virus
THNGKRLEP

SEQ ID NO: 61436 - protein, 9 aa, Dengue virus
HNGKRLEPN

SEQ ID NO: 61437 - protein, 9 aa, Dengue virus
KRLEPNWAN

SEQ ID NO: 61438 - protein, 9 aa, Dengue virus
RLEPNWANV

SEQ ID NO: 61439 - protein, 9 aa, Dengue virus
LEPNWANVK

SEQ ID NO: 61440 - protein, 9 aa, Dengue virus
EPNWANVKK

SEQ ID NO: 61441 - protein, 9 aa, Dengue virus
PNWANVKKD

SEQ ID NO: 61442 - protein, 9 aa, Dengue virus
NWANVKKDL

SEQ ID NO: 61443 - protein, 9 aa, Dengue virus
WANVKKDLI

SEQ ID NO: 61444 - protein, 9 aa, Dengue virus
ANVKKDLIS

SEQ ID NO: 61445 - protein, 9 aa, Dengue virus
NVKKDLISY

SEQ ID NO: 61446 - protein, 9 aa, Dengue virus
LISYGGGWK

SEQ ID NO: 61447 - protein, 9 aa, Dengue virus
ISYGGGWKL

SEQ ID NO: 61448 - protein, 9 aa, Dengue virus
SYGGGWRLN

SEQ ID NO: 61449 - protein, 9 aa, Dengue virus
YGGGWRLNA

SEQ ID NO: 61450 - protein, 9 aa, Dengue virus
GGGWRLNAQ

SEQ ID NO: 61451 - protein, 9 aa, Dengue virus
GGWRLNAQW

SEQ ID NO: 61452 - protein, 9 aa, Dengue virus
GWRLNAQWQ

SEQ ID NO: 61453 - protein, 9 aa, Dengue virus
WRLNAQWQK

SEQ ID NO: 61454 - protein, 9 aa, Dengue virus
RLNAQWQKG

SEQ ID NO: 61455 - protein, 9 aa, Dengue virus
LNAQWQKGE

SEQ ID NO: 61456 - protein, 9 aa, Dengue virus
NAQWQKGEE

SEQ ID NO: 61457 - protein, 9 aa, Dengue virus
TQWQKGEEV

SEQ ID NO: 61458 - protein, 9 aa, Dengue virus
QWKKGEEVQ

SEQ ID NO: 61459 - protein, 9 aa, Dengue virus
WKKGEEVQV

SEQ ID NO: 61460 - protein, 9 aa, Dengue virus
KKGEEVQVI

SEQ ID NO: 61461 - protein, 9 aa, Dengue virus
KNPKNFQTT

SEQ ID NO: 61462 - protein, 9 aa, Dengue virus
NPKNFQTTP

SEQ ID NO: 61463 - protein, 9 aa, Dengue virus
PKNFQTTPG

SEQ ID NO: 61464 - protein, 9 aa, Dengue virus
KNFQTMPGI

SEQ ID NO: 61465 - protein, 9 aa, Dengue virus
NFQTMPGIF

SEQ ID NO: 61466 - protein, 9 aa, Dengue virus
FQTMPGIFQ

SEQ ID NO: 61467 - protein, 9 aa, Dengue virus
QTMPGIFQT

SEQ ID NO: 61468 - protein, 9 aa, Dengue virus
TMPGIFQTT

SEQ ID NO: 61469 - protein, 9 aa, Dengue virus
PGIFQTTTG

SEQ ID NO: 61470 - protein, 9 aa, Dengue virus
GIFQTTTGE

SEQ ID NO: 61471 - protein, 9 aa, Dengue virus
IFQTTTGEI

SEQ ID NO: 61472 - protein, 9 aa, Dengue virus
FQTTMGEIG

SEQ ID NO: 61473 - protein, 9 aa, Dengue virus
QTTMGEIGA

SEQ ID NO: 61474 - protein, 9 aa, Dengue virus
TTMGEIGAI

SEQ ID NO: 61475 - protein, 9 aa, Dengue virus
TMGEIGAIA

SEQ ID NO: 61476 - protein, 9 aa, Dengue virus
MGEIGAIAL

SEQ ID NO: 61477 - protein, 9 aa, Dengue virus
PIINREGKI

SEQ ID NO: 61478 - protein, 9 aa, Dengue virus
IINREGKIV

SEQ ID NO: 61479 - protein, 9 aa, Dengue virus
INREGKIVG

SEQ ID NO: 61480 - protein, 9 aa, Dengue virus
NREGKIVGL

SEQ ID NO: 61481 - protein, 9 aa, Dengue virus
REGKIVGLY

SEQ ID NO: 61482 - protein, 9 aa, Dengue virus
EGKIVGLYG

SEQ ID NO: 61483 - protein, 9 aa, Dengue virus
GKIVGLYGN

SEQ ID NO: 61484 - protein, 9 aa, Dengue virus
KIVGLYGNG

SEQ ID NO: 61485 - protein, 9 aa, Dengue virus
IVGLYGNGV

SEQ ID NO: 61486 - protein, 9 aa, Dengue virus
YGNGVVTKS

SEQ ID NO: 61487 - protein, 9 aa, Dengue virus
GNGVVTKSG

SEQ ID NO: 61488 - protein, 9 aa, Dengue virus
NGVVTKSGG

SEQ ID NO: 61489 - protein, 9 aa, Dengue virus
GVVTKSGGY

SEQ ID NO: 61490 - protein, 9 aa, Dengue virus
VVTKSGGYV

SEQ ID NO: 61491 - protein, 9 aa, Dengue virus
VTKSGGYVS

SEQ ID NO: 61492 - protein, 9 aa, Dengue virus
TNAEPDGPA

SEQ ID NO: 61493 - protein, 9 aa, Dengue virus
NAEPDGPAP

SEQ ID NO: 61494 - protein, 9 aa, Dengue virus
PELEEEMFR

SEQ ID NO: 61495 - protein, 9 aa, Dengue virus
ELEEEMFRK

SEQ ID NO: 61496 - protein, 9 aa, Dengue virus
LEEEMFRKR

SEQ ID NO: 61497 - protein, 9 aa, Dengue virus
EEEMFRKRN

SEQ ID NO: 61498 - protein, 9 aa, Dengue virus
EEMFRKRNL

SEQ ID NO: 61499 - protein, 9 aa, Dengue virus
EMFRKRNLT

SEQ ID NO: 61500 - protein, 9 aa, Dengue virus
MFRKRNLTI

SEQ ID NO: 61501 - protein, 9 aa, Dengue virus
FRKRNLTIM

SEQ ID NO: 61502 - protein, 9 aa, Dengue virus
RKRNLTIMD

SEQ ID NO: 61503 - protein, 9 aa, Dengue virus
TRKYLPAII

SEQ ID NO: 61504 - protein, 9 aa, Dengue virus
RKYLPAIIR

SEQ ID NO: 61505 - protein, 9 aa, Dengue virus
KYLPAIIRE

SEQ ID NO: 61506 - protein, 9 aa, Dengue virus
YLPAIIREA

SEQ ID NO: 61507 - protein, 9 aa, Dengue virus
LPAIIREAI

SEQ ID NO: 61508 - protein, 9 aa, Dengue virus
PAIIREAIK

SEQ ID NO: 61509 - protein, 9 aa, Dengue virus
AIIREAIKR

SEQ ID NO: 61510 - protein, 9 aa, Dengue virus
IIREAIKRR

SEQ ID NO: 61511 - protein, 9 aa, Dengue virus
IREAIKRRL

SEQ ID NO: 61512 - protein, 9 aa, Dengue virus
PIRYQTTAI

SEQ ID NO: 61513 - protein, 9 aa, Dengue virus
IRYQTTAIK

SEQ ID NO: 61514 - protein, 9 aa, Dengue virus
RYQTTAIKS

SEQ ID NO: 61515 - protein, 9 aa, Dengue virus
YQTTAIKSE

SEQ ID NO: 61516 - protein, 9 aa, Dengue virus
QTTAIKSEH

SEQ ID NO: 61517 - protein, 9 aa, Dengue virus
TTAIKSEHT

SEQ ID NO: 61518 - protein, 9 aa, Dengue virus
TAIKSEHTG

SEQ ID NO: 61519 - protein, 9 aa, Dengue virus
ATKSEHTGK

SEQ ID NO: 61520 - protein, 9 aa, Dengue virus
TKSEHTGKE

SEQ ID NO: 61521 - protein, 9 aa, Dengue virus
KSEHTGKEI

SEQ ID NO: 61522 - protein, 9 aa, Dengue virus
SEHTGKEIV

SEQ ID NO: 61523 - protein, 9 aa, Dengue virus
EHTGKEIVD

SEQ ID NO: 61524 - protein, 9 aa, Dengue virus
HTGKEIVDL

SEQ ID NO: 61525 - protein, 9 aa, Dengue virus
TGKEIVDLM

SEQ ID NO: 61526 - protein, 9 aa, Dengue virus
GKEIVDLMC

SEQ ID NO: 61527 - protein, 9 aa, Dengue virus
KEIVDLMCH

SEQ ID NO: 61528 - protein, 9 aa, Dengue virus
VRVPNYNLV

SEQ ID NO: 61529 - protein, 9 aa, Dengue virus
RVPNYNLVI

SEQ ID NO: 61530 - protein, 9 aa, Dengue virus
VPNYNLVIM

SEQ ID NO: 61531 - protein, 9 aa, Dengue virus
PNYNLVIMD

SEQ ID NO: 61532 - protein, 9 aa, Dengue virus
NYNLVIMDE

SEQ ID NO: 61533 - protein, 9 aa, Dengue virus
YNLVIMDEA

SEQ ID NO: 61534 - protein, 9 aa, Dengue virus
NLVIMDEAH

SEQ ID NO: 61535 - protein, 9 aa, Dengue virus
LVIMDEAHF

SEQ ID NO: 61536 - protein, 9 aa, Dengue virus
VIMDEAHFT

SEQ ID NO: 61537 - protein, 9 aa, Dengue virus
VMDEAHFTD

SEQ ID NO: 61538 - protein, 9 aa, Dengue virus
STRVGMGET

SEQ ID NO: 61539 - protein, 9 aa, Dengue virus
TRVGMGETA

SEQ ID NO: 61540 - protein, 9 aa, Dengue virus
RVGMGETAA

SEQ ID NO: 61541 - protein, 9 aa, Dengue virus
VGMGETAAI

SEQ ID NO: 61542 - protein, 9 aa, Dengue virus
GMGETAAIF

SEQ ID NO: 61543 - protein, 9 aa, Dengue virus
MGETAAIFM

SEQ ID NO: 61544 - protein, 9 aa, Dengue virus
GETAAIFMT

SEQ ID NO: 61545 - protein, 9 aa, Dengue virus
ETAAIFMTA

SEQ ID NO: 61546 - protein, 9 aa, Dengue virus
TAAIFMTAT

SEQ ID NO: 61547 - protein, 9 aa, Dengue virus
TATPPGTAE

SEQ ID NO: 61548 - protein, 9 aa, Dengue virus
ATPPGTAEA

SEQ ID NO: 61549 - protein, 9 aa, Dengue virus
TPPGTAEAF

SEQ ID NO: 61550 - protein, 9 aa, Dengue virus
PPGTAEAFP

SEQ ID NO: 61551 - protein, 9 aa, Dengue virus
PGTAEAFPQ

SEQ ID NO: 61552 - protein, 9 aa, Dengue virus
GTAEAFPQS

SEQ ID NO: 61553 - protein, 9 aa, Dengue virus
TAEAFPQSN

SEQ ID NO: 61554 - protein, 9 aa, Dengue virus
AEAFPQSNA

SEQ ID NO: 61555 - protein, 9 aa, Dengue virus
EAFPQSNAP

SEQ ID NO: 61556 - protein, 9 aa, Dengue virus
NAPIQDEEK

SEQ ID NO: 61557 - protein, 9 aa, Dengue virus
APIQDEEKD

SEQ ID NO: 61558 - protein, 9 aa, Dengue virus
PIQDEEKDI

SEQ ID NO: 61559 - protein, 9 aa, Dengue virus
IQDEEKDIP

SEQ ID NO: 61560 - protein, 9 aa, Dengue virus
QDEEKDIPE

SEQ ID NO: 61561 - protein, 9 aa, Dengue virus
DEEKDIPER

SEQ ID NO: 61562 - protein, 9 aa, Dengue virus
EEKDIPERS

SEQ ID NO: 61563 - protein, 9 aa, Dengue virus
EKDIPERSW

SEQ ID NO: 61564 - protein, 9 aa, Dengue virus
KDIPERSWN

SEQ ID NO: 61565 - protein, 9 aa, Dengue virus
ERSWNSGND

SEQ ID NO: 61566 - protein, 9 aa, Dengue virus
RSWNSGNDW

SEQ ID NO: 61567 - protein, 9 aa, Dengue virus
SWNSGNDWI

SEQ ID NO: 61568 - protein, 9 aa, Dengue virus
WNSGNDWIT

SEQ ID NO: 61569 - protein, 9 aa, Dengue virus
NSGNDWITD

SEQ ID NO: 61570 - protein, 9 aa, Dengue virus
SGNDWITDF

SEQ ID NO: 61571 - protein, 9 aa, Dengue virus
GNEWITDFV

SEQ ID NO: 61572 - protein, 9 aa, Dengue virus
NEWITDFVG

SEQ ID NO: 61573 - protein, 9 aa, Dengue virus
EWITDFVGK

SEQ ID NO: 61574 - protein, 9 aa, Dengue virus
WITDFVGKT

SEQ ID NO: 61575 - protein, 9 aa, Dengue virus
ITDFVGKTV

SEQ ID NO: 61576 - protein, 9 aa, Dengue virus
TDFVGKTVW

SEQ ID NO: 61577 - protein, 9 aa, Dengue virus
DFVGKTVWF

SEQ ID NO: 61578 - protein, 9 aa, Dengue virus
FVGKTVWFV

SEQ ID NO: 61579 - protein, 9 aa, Dengue virus
VGKTVWFVP

SEQ ID NO: 61580 - protein, 9 aa, Dengue virus
FDTEYQKTR

SEQ ID NO: 61581 - protein, 9 aa, Dengue virus
DTEYQKTRL

SEQ ID NO: 61582 - protein, 9 aa, Dengue virus
TEYQKTRLN

SEQ ID NO: 61583 - protein, 9 aa, Dengue virus
EYQKTRLND

SEQ ID NO: 61584 - protein, 9 aa, Dengue virus
YQKTRLNDW

SEQ ID NO: 61585 - protein, 9 aa, Dengue virus
QKTRLNDWD

SEQ ID NO: 61586 - protein, 9 aa, Dengue virus
KTRLNDWDF

SEQ ID NO: 61587 - protein, 9 aa, Dengue virus
TRLNDWDFV

SEQ ID NO: 61588 - protein, 9 aa, Dengue virus
RLNDWDFVV

SEQ ID NO: 61589 - protein, 9 aa, Dengue virus
SEMGANFRA

SEQ ID NO: 61590 - protein, 9 aa, Dengue virus
EMGANFRAD

SEQ ID NO: 61591 - protein, 9 aa, Dengue virus
MGANFRADR

SEQ ID NO: 61592 - protein, 9 aa, Dengue virus
GANFRADRV

SEQ ID NO: 61593 - protein, 9 aa, Dengue virus
ANFRADRVI

SEQ ID NO: 61594 - protein, 9 aa, Dengue virus
NFRADRVID

SEQ ID NO: 61595 - protein, 9 aa, Dengue virus
FRADRVIDP

SEQ ID NO: 61596 - protein, 9 aa, Dengue virus
RADRVIDPR

SEQ ID NO: 61597 - protein, 9 aa, Dengue virus
LAGPMPVTV

SEQ ID NO: 61598 - protein, 9 aa, Dengue virus
AGPMPVTVA

SEQ ID NO: 61599 - protein, 9 aa, Dengue virus
GPMPVTVAS

SEQ ID NO: 61600 - protein, 9 aa, Dengue virus
PMPVTVASA

SEQ ID NO: 61601 - protein, 9 aa, Dengue virus
MPVTVASAA

SEQ ID NO: 61602 - protein, 9 aa, Dengue virus
PVTVASAAQ

SEQ ID NO: 61603 - protein, 9 aa, Dengue virus
VTVASAAQR

SEQ ID NO: 61604 - protein, 9 aa, Dengue virus
TVASAAQRR

SEQ ID NO: 61605 - protein, 9 aa, Dengue virus
VASAAQRRG

SEQ ID NO: 61606 - protein, 9 aa, Dengue virus
RGRVGRNPP

SEQ ID NO: 61607 - protein, 9 aa, Dengue virus
GRVGRNPPK

SEQ ID NO: 61608 - protein, 9 aa, Dengue virus
RVGRNPPKE

SEQ ID NO: 61609 - protein, 9 aa, Dengue virus
VGRNPPKEN

SEQ ID NO: 61610 - protein, 9 aa, Dengue virus
GRNPPKEND

SEQ ID NO: 61611 - protein, 9 aa, Dengue virus
RNPPKENDQ

SEQ ID NO: 61612 - protein, 9 aa, Dengue virus
NPPKENDQY

SEQ ID NO: 61613 - protein, 9 aa, Dengue virus
PPKENDQYI

SEQ ID NO: 61614 - protein, 9 aa, Dengue virus
PKENDQYIF

SEQ ID NO: 61615 - protein, 9 aa, Dengue virus
KENDQYIFM

SEQ ID NO: 61616 - protein, 9 aa, Dengue virus
ENDQYIFMG

SEQ ID NO: 61617 - protein, 9 aa, Dengue virus
NDQYIFMGQ

SEQ ID NO: 61618 - protein, 9 aa, Dengue virus
DQYIFMGQP

SEQ ID NO: 61619 - protein, 9 aa, Dengue virus
QYIFMGQPL

SEQ ID NO: 61620 - protein, 9 aa, Dengue virus
YIFMGQPLN

SEQ ID NO: 61621 - protein, 9 aa, Dengue virus
IFMGQPLNN

SEQ ID NO: 61622 - protein, 9 aa, Dengue virus
FMGQPLNND

SEQ ID NO: 61623 - protein, 9 aa, Dengue virus
MGQPLNNDE

SEQ ID NO: 61624 - protein, 9 aa, Dengue virus
GDLPVWLAY

SEQ ID NO: 61625 - protein, 9 aa, Dengue virus
DLPVWLAYK

SEQ ID NO: 61626 - protein, 9 aa, Dengue virus
LPVWLAYKV

SEQ ID NO: 61627 - protein, 9 aa, Dengue virus
PVWLAYKVA

SEQ ID NO: 61628 - protein, 9 aa, Dengue virus
VWLAYKVAS

SEQ ID NO: 61629 - protein, 9 aa, Dengue virus
WLAYKVASE

SEQ ID NO: 61630 - protein, 9 aa, Dengue virus
LAYKVASEG

SEQ ID NO: 61631 - protein, 9 aa, Dengue virus
AYKVASEGI

SEQ ID NO: 61632 - protein, 9 aa, Dengue virus
YKVASEGIK

SEQ ID NO: 61633 - protein, 9 aa, Dengue virus
DRKWCFDGE

SEQ ID NO: 61634 - protein, 9 aa, Dengue virus
RKWCFDGER

SEQ ID NO: 61635 - protein, 9 aa, Dengue virus
KWCFDGERN

SEQ ID NO: 61636 - protein, 9 aa, Dengue virus
WCFDGERNN

SEQ ID NO: 61637 - protein, 9 aa, Dengue virus
CFDGERNNQ

SEQ ID NO: 61638 - protein, 9 aa, Dengue virus
FDGERNNQI

SEQ ID NO: 61639 - protein, 9 aa, Dengue virus
DGERNNQIL

SEQ ID NO: 61640 - protein, 9 aa, Dengue virus
GERNNQILE

SEQ ID NO: 61641 - protein, 9 aa, Dengue virus
ERNNQILEE

SEQ ID NO: 61642 - protein, 9 aa, Dengue virus
EIWTKEGER

SEQ ID NO: 61643 - protein, 9 aa, Dengue virus
IWTKEGERK

SEQ ID NO: 61644 - protein, 9 aa, Dengue virus
WTKEGERKK

SEQ ID NO: 61645 - protein, 9 aa, Dengue virus
TKEGERKKL

SEQ ID NO: 61646 - protein, 9 aa, Dengue virus
KEGERKKLR

SEQ ID NO: 61647 - protein, 9 aa, Dengue virus
EGERKKLRP

SEQ ID NO: 61648 - protein, 9 aa, Dengue virus
GERKKLRPR

SEQ ID NO: 61649 - protein, 9 aa, Dengue virus
ERKKLRPRW

SEQ ID NO: 61650 - protein, 9 aa, Dengue virus
RKKLRPRWL

SEQ ID NO: 61651 - protein, 9 aa, Dengue virus
PLALKEFKE

SEQ ID NO: 61652 - protein, 9 aa, Dengue virus
LALKEFKEF

SEQ ID NO: 61653 - protein, 9 aa, Dengue virus
ALKEFKEFA

SEQ ID NO: 61654 - protein, 9 aa, Dengue virus
LKEFKEFAA

SEQ ID NO: 61655 - protein, 9 aa, Dengue virus
KEFKEFAAG

SEQ ID NO: 61656 - protein, 9 aa, Dengue virus
EFKEFAAGR

SEQ ID NO: 61657 - protein, 9 aa, Dengue virus
FKEFAAGRK

SEQ ID NO: 61658 - protein, 9 aa, Dengue virus
KEFAAGRKS

SEQ ID NO: 61659 - protein, 9 aa, Dengue virus
EFAAGRKSI

SEQ ID NO: 61660 - protein, 9 aa, Dengue virus
AAGRKSIAF

SEQ ID NO: 61661 - protein, 9 aa, Dengue virus
AGRKSIAFD

SEQ ID NO: 61662 - protein, 9 aa, Dengue virus
GRKSIAFDL

SEQ ID NO: 61663 - protein, 9 aa, Dengue virus
RKSIAFDLV

SEQ ID NO: 61664 - protein, 9 aa, Dengue virus
KSIAFDLVT

SEQ ID NO: 61665 - protein, 9 aa, Dengue virus
SIAFDLVTE

SEQ ID NO: 61666 - protein, 9 aa, Dengue virus
IAFDLVTEI

SEQ ID NO: 61667 - protein, 9 aa, Dengue virus
AFDLVTEIG

SEQ ID NO: 61668 - protein, 9 aa, Dengue virus
FDLVTEIGR

SEQ ID NO: 61669 - protein, 9 aa, Dengue virus
VTEIGRVPT

SEQ ID NO: 61670 - protein, 9 aa, Dengue virus
TEIGRVPTH

SEQ ID NO: 61671 - protein, 9 aa, Dengue virus
EIGRVPTHL

SEQ ID NO: 61672 - protein, 9 aa, Dengue virus
IGRVPTHLA

SEQ ID NO: 61673 - protein, 9 aa, Dengue virus
GRVPTHLAH

SEQ ID NO: 61674 - protein, 9 aa, Dengue virus
RVPTHLAHR

SEQ ID NO: 61675 - protein, 9 aa, Dengue virus
VPTHLAHRT

SEQ ID NO: 61676 - protein, 9 aa, Dengue virus
PTHLAHRTR

SEQ ID NO: 61677 - protein, 9 aa, Dengue virus
THLAHRTRN

SEQ ID NO: 61678 - protein, 9 aa, Dengue virus
HLAYRTRNA

SEQ ID NO: 61679 - protein, 9 aa, Dengue virus
LAYRTRNAL

SEQ ID NO: 61680 - protein, 9 aa, Dengue virus
AYRTRNALD

SEQ ID NO: 61681 - protein, 9 aa, Dengue virus
YRTRNALDN

SEQ ID NO: 61682 - protein, 9 aa, Dengue virus
LHTSEHGGK

SEQ ID NO: 61683 - protein, 9 aa, Dengue virus
HTSEHGGKA

SEQ ID NO: 61684 - protein, 9 aa, Dengue virus
TSEHGGKAY

SEQ ID NO: 61685 - protein, 9 aa, Dengue virus
SEHGGKAYR

SEQ ID NO: 61686 - protein, 9 aa, Dengue virus
EHGGKAYRH

SEQ ID NO: 61687 - protein, 9 aa, Dengue virus
HGGKAYRHA

SEQ ID NO: 61688 - protein, 9 aa, Dengue virus
GGKAYRHAV

SEQ ID NO: 61689 - protein, 9 aa, Dengue virus
GKAYRHAVE

SEQ ID NO: 61690 - protein, 9 aa, Dengue virus
KAYRHAVEE

SEQ ID NO: 61691 - protein, 9 aa, Dengue virus
LMILLTGGV

SEQ ID NO: 61692 - protein, 9 aa, Dengue virus
MILLTGGVM

SEQ ID NO: 61693 - protein, 9 aa, Dengue virus
ILLTGGVML

SEQ ID NO: 61694 - protein, 9 aa, Dengue virus
LLTGGVMLF

SEQ ID NO: 61695 - protein, 9 aa, Dengue virus
LTGGVMLFL

SEQ ID NO: 61696 - protein, 9 aa, Dengue virus
TGGVMLFLI

SEQ ID NO: 61697 - protein, 9 aa, Dengue virus
GGVMLFLIS

SEQ ID NO: 61698 - protein, 9 aa, Dengue virus
GVMLFLISG

SEQ ID NO: 61699 - protein, 9 aa, Dengue virus
VMLFLISGK

SEQ ID NO: 61700 - protein, 9 aa, Dengue virus
MLFLISGRG

SEQ ID NO: 61701 - protein, 9 aa, Dengue virus
LFLISGKGV

SEQ ID NO: 61702 - protein, 9 aa, Dengue virus
FLISGKGVG

SEQ ID NO: 61703 - protein, 9 aa, Dengue virus
LISGKGVGK

SEQ ID NO: 61704 - protein, 9 aa, Dengue virus
ISGKGVGKT

SEQ ID NO: 61705 - protein, 9 aa, Dengue virus
SGKGVGKTS

SEQ ID NO: 61706 - protein, 9 aa, Dengue virus
GKGVGKTSI

SEQ ID NO: 61707 - protein, 9 aa, Dengue virus
KGVGKTSIG

SEQ ID NO: 61708 - protein, 9 aa, Dengue virus
GVGKTSIGL

SEQ ID NO: 61709 - protein, 9 aa, Dengue virus
VGKTSIGLI

SEQ ID NO: 61710 - protein, 9 aa, Dengue virus
GKTTIGLIC

SEQ ID NO: 61711 - protein, 9 aa, Dengue virus
KTTIGLICV

SEQ ID NO: 61712 - protein, 9 aa, Dengue virus
TSIGLICVV

SEQ ID NO: 61713 - protein, 9 aa, Dengue virus
SIGLICVIV

SEQ ID NO: 61714 - protein, 9 aa, Dengue virus
IGLICVIVS

SEQ ID NO: 61715 - protein, 9 aa, Dengue virus
GLICVIVSS

SEQ ID NO: 61716 - protein, 9 aa, Dengue virus
LICVIVSSG

SEQ ID NO: 61717 - protein, 9 aa, Dengue virus
ICVIVSSGM

SEQ ID NO: 61718 - protein, 9 aa, Dengue virus
CVIVSSGML

SEQ ID NO: 61719 - protein, 9 aa, Dengue virus
VIVSSGMLW

SEQ ID NO: 61720 - protein, 9 aa, Dengue virus
IVSSGMLWM

SEQ ID NO: 61721 - protein, 9 aa, Dengue virus
VSSGMLWMA

SEQ ID NO: 61722 - protein, 9 aa, Dengue virus
SSGMLWMAD

SEQ ID NO: 61723 - protein, 9 aa, Dengue virus
SGMLWMADV

SEQ ID NO: 61724 - protein, 9 aa, Dengue virus
GMLWMADVP

SEQ ID NO: 61725 - protein, 9 aa, Dengue virus
MLWMADVPL

SEQ ID NO: 61726 - protein, 9 aa, Dengue virus
LWMADVPLQ

SEQ ID NO: 61727 - protein, 9 aa, Dengue virus
WMADVPLQW

SEQ ID NO: 61728 - protein, 9 aa, Dengue virus
MADVPLQWI

SEQ ID NO: 61729 - protein, 9 aa, Dengue virus
ADVPLQWIA

SEQ ID NO: 61730 - protein, 9 aa, Dengue virus
DVPLQWIAS

SEQ ID NO: 61731 - protein, 9 aa, Dengue virus
VPLQWIASA

SEQ ID NO: 61732 - protein, 9 aa, Dengue virus
LQWIASAII

SEQ ID NO: 61733 - protein, 9 aa, Dengue virus
QWIASAIIL

SEQ ID NO: 61734 - protein, 9 aa, Dengue virus
WIASAIILE

SEQ ID NO: 61735 - protein, 9 aa, Dengue virus
IASAIILEF

SEQ ID NO: 61736 - protein, 9 aa, Dengue virus
ASAIILEFF

SEQ ID NO: 61737 - protein, 9 aa, Dengue virus
SAIILEFFM

SEQ ID NO: 61738 - protein, 9 aa, Dengue virus
AIILEFFMM

SEQ ID NO: 61739 - protein, 9 aa, Dengue virus
IILEFFMMV

SEQ ID NO: 61740 - protein, 9 aa, Dengue virus
ILEFFMMVL

SEQ ID NO: 61741 - protein, 9 aa, Dengue virus
IGILTLAAT

SEQ ID NO: 61742 - protein, 9 aa, Dengue virus
GILTLAAIV

SEQ ID NO: 61743 - protein, 9 aa, Dengue virus
ILTLAAIVA

SEQ ID NO: 61744 - protein, 9 aa, Dengue virus
LTLAAIVAA

SEQ ID NO: 61745 - protein, 9 aa, Dengue virus
TLAAIVAAN

SEQ ID NO: 61746 - protein, 9 aa, Dengue virus
LAAIVAANE

SEQ ID NO: 61747 - protein, 9 aa, Dengue virus
AAIVAANEM

SEQ ID NO: 61748 - protein, 9 aa, Dengue virus
AIVAANEMG

SEQ ID NO: 61749 - protein, 9 aa, Dengue virus
IVAANEMGL

SEQ ID NO: 61750 - protein, 9 aa, Dengue virus
VAANEMGLL

SEQ ID NO: 61751 - protein, 9 aa, Dengue virus
TANEMGLLE

SEQ ID NO: 61752 - protein, 9 aa, Dengue virus
MGMLETTKR

SEQ ID NO: 61753 - protein, 9 aa, Dengue virus
GMLETTKRD

SEQ ID NO: 61754 - protein, 9 aa, Dengue virus
MLETTKRDL

SEQ ID NO: 61755 - protein, 9 aa, Dengue virus
TKRDLGMSR

SEQ ID NO: 61756 - protein, 9 aa, Dengue virus
KRDLGMSRE

SEQ ID NO: 61757 - protein, 9 aa, Dengue virus
RDLGMSREP

SEQ ID NO: 61758 - protein, 9 aa, Dengue virus
DLGMSREPG

SEQ ID NO: 61759 - protein, 9 aa, Dengue virus
LGMSREPGV

SEQ ID NO: 61760 - protein, 9 aa, Dengue virus
GMSKEPGVA

SEQ ID NO: 61761 - protein, 9 aa, Dengue virus
MSKEPGVAS

SEQ ID NO: 61762 - protein, 9 aa, Dengue virus
SKEPGVASP

SEQ ID NO: 61763 - protein, 9 aa, Dengue virus
EPGVASPTS

SEQ ID NO: 61764 - protein, 9 aa, Dengue virus
PGVASPTSY

SEQ ID NO: 61765 - protein, 9 aa, Dengue virus
GVASPTSYL

SEQ ID NO: 61766 - protein, 9 aa, Dengue virus
VASPTSYLD

SEQ ID NO: 61767 - protein, 9 aa, Dengue virus
ASPTSYLDV

SEQ ID NO: 61768 - protein, 9 aa, Dengue virus
SSTSYLDVD

SEQ ID NO: 61769 - protein, 9 aa, Dengue virus
STSYLDVDL

SEQ ID NO: 61770 - protein, 9 aa, Dengue virus
NSYLDVDLH

SEQ ID NO: 61771 - protein, 9 aa, Dengue virus
SQVNPLTLI

SEQ ID NO: 61772 - protein, 9 aa, Dengue virus
QVNPLTLIA

SEQ ID NO: 61773 - protein, 9 aa, Dengue virus
VNPLTLTAV

SEQ ID NO: 61774 - protein, 9 aa, Dengue virus
NPLTLTAVV

SEQ ID NO: 61775 - protein, 9 aa, Dengue virus
PLTLTAVVL

SEQ ID NO: 61776 - protein, 9 aa, Dengue virus
LTLTAVVLL

SEQ ID NO: 61777 - protein, 9 aa, Dengue virus
TLTAVVLLL

SEQ ID NO: 61778 - protein, 9 aa, Dengue virus
LTAAVLLLV

SEQ ID NO: 61779 - protein, 9 aa, Dengue virus
TAAVLLLVT

SEQ ID NO: 61780 - protein, 9 aa, Dengue virus
AAVLLLVTH

SEQ ID NO: 61781 - protein, 9 aa, Dengue virus
AVLLLVTHY

SEQ ID NO: 61782 - protein, 9 aa, Dengue virus
VLLLVTHYA

SEQ ID NO: 61783 - protein, 9 aa, Dengue virus
LLLVTHYAI

SEQ ID NO: 61784 - protein, 9 aa, Dengue virus
LLVTHYAII

SEQ ID NO: 61785 - protein, 9 aa, Dengue virus
LVTHYAIIG

SEQ ID NO: 61786 - protein, 9 aa, Dengue virus
VTHYAIIGP

SEQ ID NO: 61787 - protein, 9 aa, Dengue virus
QVMLLILCA

SEQ ID NO: 61788 - protein, 9 aa, Dengue virus
VMLLVLCAA

SEQ ID NO: 61789 - protein, 9 aa, Dengue virus
MLLVLCAAQ

SEQ ID NO: 61790 - protein, 9 aa, Dengue virus
LLVLCAAQL

SEQ ID NO: 61791 - protein, 9 aa, Dengue virus
LVLCAAQLL

SEQ ID NO: 61792 - protein, 9 aa, Dengue virus
VLCAAQLLL

SEQ ID NO: 61793 - protein, 9 aa, Dengue virus
LCAAQLLLM

SEQ ID NO: 61794 - protein, 9 aa, Dengue virus
CAAQLLLMR

SEQ ID NO: 61795 - protein, 9 aa, Dengue virus
AAQLLLMRT

SEQ ID NO: 61796 - protein, 9 aa, Dengue virus
LLMRTSWAF

SEQ ID NO: 61797 - protein, 9 aa, Dengue virus
LMRTSWAFC

SEQ ID NO: 61798 - protein, 9 aa, Dengue virus
MRTSWAFCE

SEQ ID NO: 61799 - protein, 9 aa, Dengue virus
RTSWAFCEA

SEQ ID NO: 61800 - protein, 9 aa, Dengue virus
TSWAFCEAL

SEQ ID NO: 61801 - protein, 9 aa, Dengue virus
SWAFCEALT

SEQ ID NO: 61802 - protein, 9 aa, Dengue virus
WAFCEALTL

SEQ ID NO: 61803 - protein, 9 aa, Dengue virus
AFCEALTLA

SEQ ID NO: 61804 - protein, 9 aa, Dengue virus
FCEALTLAT

SEQ ID NO: 61805 - protein, 9 aa, Dengue virus
CEVLTLATG

SEQ ID NO: 61806 - protein, 9 aa, Dengue virus
EVLTLATGP

SEQ ID NO: 61807 - protein, 9 aa, Dengue virus
VLTLATGPI

SEQ ID NO: 61808 - protein, 9 aa, Dengue virus
FRGNYLAGA

SEQ ID NO: 61809 - protein, 9 aa, Dengue virus
RGNYLAGAG

SEQ ID NO: 61810 - protein, 9 aa, Dengue virus
GNYLAGAGL

SEQ ID NO: 61811 - protein, 9 aa, Dengue virus
SYIAGAGLA

SEQ ID NO: 61812 - protein, 9 aa, Dengue virus
AGAGLAFSV

SEQ ID NO: 61813 - protein, 9 aa, Dengue virus
GAGLAFSVM

SEQ ID NO: 61814 - protein, 9 aa, Dengue virus
AGLAFSVMK

SEQ ID NO: 61815 - protein, 9 aa, Dengue virus
GLAFSVMKS

SEQ ID NO: 61816 - protein, 9 aa, Dengue virus
LAFSVMKSV

SEQ ID NO: 61817 - protein, 9 aa, Dengue virus
AFSVMKSVG

SEQ ID NO: 61818 - protein, 9 aa, Dengue virus
FSVMKSVGT

SEQ ID NO: 61819 - protein, 9 aa, Dengue virus
SVMKSVGTG

SEQ ID NO: 61820 - protein, 9 aa, Dengue virus
IMKSVGTGR

SEQ ID NO: 61821 - protein, 9 aa, Dengue virus
MKSVGTGRR

SEQ ID NO: 61822 - protein, 9 aa, Dengue virus
KSVGTGRRG

SEQ ID NO: 61823 - protein, 9 aa, Dengue virus
SVGTGRRGT

SEQ ID NO: 61824 - protein, 9 aa, Dengue virus
VGTGRRGTG

SEQ ID NO: 61825 - protein, 9 aa, Dengue virus
GTGRRGTGS

SEQ ID NO: 61826 - protein, 9 aa, Dengue virus
TGRRGTGSQ

SEQ ID NO: 61827 - protein, 9 aa, Dengue virus
GRRGTGSQG

SEQ ID NO: 61828 - protein, 9 aa, Dengue virus
RRGTGSQGE

SEQ ID NO: 61829 - protein, 9 aa, Dengue virus
ETLGEKWKR

SEQ ID NO: 61830 - protein, 9 aa, Dengue virus
TLGEKWKKR

SEQ ID NO: 61831 - protein, 9 aa, Dengue virus
LGEKWKKRL

SEQ ID NO: 61832 - protein, 9 aa, Dengue virus
GEKWKKRLN

SEQ ID NO: 61833 - protein, 9 aa, Dengue virus
EKWKKRLNQ

SEQ ID NO: 61834 - protein, 9 aa, Dengue virus
KWKKRLNQL

SEQ ID NO: 61835 - protein, 9 aa, Dengue virus
WKKRLNQLS

SEQ ID NO: 61836 - protein, 9 aa, Dengue virus
KKRLNQLSR

SEQ ID NO: 61837 - protein, 9 aa, Dengue virus
KRLNQLSRK

SEQ ID NO: 61838 - protein, 9 aa, Dengue virus
KLNQLSRKD

SEQ ID NO: 61839 - protein, 9 aa, Dengue virus
LNQLSRKDF

SEQ ID NO: 61840 - protein, 9 aa, Dengue virus
NQLSRKDFD

SEQ ID NO: 61841 - protein, 9 aa, Dengue virus
QLSRKDFDL

SEQ ID NO: 61842 - protein, 9 aa, Dengue virus
LSRKDFDLY

SEQ ID NO: 61843 - protein, 9 aa, Dengue virus
SRKDFDLYK

SEQ ID NO: 61844 - protein, 9 aa, Dengue virus
RKDFDLYKK

SEQ ID NO: 61845 - protein, 9 aa, Dengue virus
KDFDLYKKS

SEQ ID NO: 61846 - protein, 9 aa, Dengue virus
DFDLYKKSG

SEQ ID NO: 61847 - protein, 9 aa, Dengue virus
SGITEVDRI

SEQ ID NO: 61848 - protein, 9 aa, Dengue virus
GITEVDRIE

SEQ ID NO: 61849 - protein, 9 aa, Dengue virus
ITEVDRIEA

SEQ ID NO: 61850 - protein, 9 aa, Dengue virus
TEVDRIEAK

SEQ ID NO: 61851 - protein, 9 aa, Dengue virus
EVDRIEAKE

SEQ ID NO: 61852 - protein, 9 aa, Dengue virus
VDRIEAKEG

SEQ ID NO: 61853 - protein, 9 aa, Dengue virus
DRIEAKEGL

SEQ ID NO: 61854 - protein, 9 aa, Dengue virus
RIEAKEGLK

SEQ ID NO: 61855 - protein, 9 aa, Dengue virus
IEAKEGLKR

SEQ ID NO: 61856 - protein, 9 aa, Dengue virus
EAKEGLRRG

SEQ ID NO: 61857 - protein, 9 aa, Dengue virus
AKEGLRRGE

SEQ ID NO: 61858 - protein, 9 aa, Dengue virus
KEGLKRGET

SEQ ID NO: 61859 - protein, 9 aa, Dengue virus
EGLKRGETT

SEQ ID NO: 61860 - protein, 9 aa, Dengue virus
RGETTHHAV

SEQ ID NO: 61861 - protein, 9 aa, Dengue virus
GETTHHAVS

SEQ ID NO: 61862 - protein, 9 aa, Dengue virus
ETTHHAVSR

SEQ ID NO: 61863 - protein, 9 aa, Dengue virus
TTHHAVSRG

SEQ ID NO: 61864 - protein, 9 aa, Dengue virus
THHAVSRGT

SEQ ID NO: 61865 - protein, 9 aa, Dengue virus
HHAVSRGTA

SEQ ID NO: 61866 - protein, 9 aa, Dengue virus
HAVSRGTAK

SEQ ID NO: 61867 - protein, 9 aa, Dengue virus
AVSRGTAKL

SEQ ID NO: 61868 - protein, 9 aa, Dengue virus
VSRGTAKLQ

SEQ ID NO: 61869 - protein, 9 aa, Dengue virus
SRGTAKLQW

SEQ ID NO: 61870 - protein, 9 aa, Dengue virus
RGTAKLQWF

SEQ ID NO: 61871 - protein, 9 aa, Dengue virus
GTAKLQWFV

SEQ ID NO: 61872 - protein, 9 aa, Dengue virus
TAKLQWFVE

SEQ ID NO: 61873 - protein, 9 aa, Dengue virus
WFVERNMVV

SEQ ID NO: 61874 - protein, 9 aa, Dengue virus
FVERNMVVP

SEQ ID NO: 61875 - protein, 9 aa, Dengue virus
VERNMVVPE

SEQ ID NO: 61876 - protein, 9 aa, Dengue virus
ERNMVVPEG

SEQ ID NO: 61877 - protein, 9 aa, Dengue virus
RNMVVPEGR

SEQ ID NO: 61878 - protein, 9 aa, Dengue virus
NMVVPEGRV

SEQ ID NO: 61879 - protein, 9 aa, Dengue virus
MVVPEGRVI

SEQ ID NO: 61880 - protein, 9 aa, Dengue virus
VVPEGRVID

SEQ ID NO: 61881 - protein, 9 aa, Dengue virus
VPEGRVIDL

SEQ ID NO: 61882 - protein, 9 aa, Dengue virus
PMSTYGWNL

SEQ ID NO: 61883 - protein, 9 aa, Dengue virus
MSTYGWNLV

SEQ ID NO: 61884 - protein, 9 aa, Dengue virus
STYGWNLVK

SEQ ID NO: 61885 - protein, 9 aa, Dengue virus
TYGWNLVKL

SEQ ID NO: 61886 - protein, 9 aa, Dengue virus
YGWNLVKLM

SEQ ID NO: 61887 - protein, 9 aa, Dengue virus
GWNLVKLMS

SEQ ID NO: 61888 - protein, 9 aa, Dengue virus
WNLVKLMSG

SEQ ID NO: 61889 - protein, 9 aa, Dengue virus
NLVKLMSGK

SEQ ID NO: 61890 - protein, 9 aa, Dengue virus
LVKLMSGKD

SEQ ID NO: 61891 - protein, 9 aa, Dengue virus
VKLMTGKDV

SEQ ID NO: 61892 - protein, 9 aa, Dengue virus
KLMTGKDVF

SEQ ID NO: 61893 - protein, 9 aa, Dengue virus
LMTGKDVFY

SEQ ID NO: 61894 - protein, 9 aa, Dengue virus
MTGKDVFYL

SEQ ID NO: 61895 - protein, 9 aa, Dengue virus
SPSPTVEEG

SEQ ID NO: 61896 - protein, 9 aa, Dengue virus
PSPIVEESR

SEQ ID NO: 61897 - protein, 9 aa, Dengue virus
SPTVEEGRT

SEQ ID NO: 61898 - protein, 9 aa, Dengue virus
PIVEESRTI

SEQ ID NO: 61899 - protein, 9 aa, Dengue virus
TVEEGRTIR

SEQ ID NO: 61900 - protein, 9 aa, Dengue virus
ESRTIRVLR

SEQ ID NO: 61901 - protein, 9 aa, Dengue virus
GRTIRVLKM

SEQ ID NO: 61902 - protein, 9 aa, Dengue virus
LKMVEPWLR

SEQ ID NO: 61903 - protein, 9 aa, Dengue virus
KMVEPWLRN

SEQ ID NO: 61904 - protein, 9 aa, Dengue virus
MVEPWLRNN

SEQ ID NO: 61905 - protein, 9 aa, Dengue virus
VEPWLRNNQ

SEQ ID NO: 61906 - protein, 9 aa, Dengue virus
EPWLRNNQF

SEQ ID NO: 61907 - protein, 9 aa, Dengue virus
PWLRNNQFC

SEQ ID NO: 61908 - protein, 9 aa, Dengue virus
WLRNNQFCI

SEQ ID NO: 61909 - protein, 9 aa, Dengue virus
LRNNQFCIK

SEQ ID NO: 61910 - protein, 9 aa, Dengue virus
RNNQFCIKV

SEQ ID NO: 61911 - protein, 9 aa, Dengue virus
NNQFCIKIL

SEQ ID NO: 61912 - protein, 9 aa, Dengue virus
NQFCIKILN

SEQ ID NO: 61913 - protein, 9 aa, Dengue virus
QFCIKILNP

SEQ ID NO: 61914 - protein, 9 aa, Dengue virus
FCIKILNPY

SEQ ID NO: 61915 - protein, 9 aa, Dengue virus
CIKILNPYM

SEQ ID NO: 61916 - protein, 9 aa, Dengue virus
IKILNPYMP

SEQ ID NO: 61917 - protein, 9 aa, Dengue virus
KVLNPYMPA

SEQ ID NO: 61918 - protein, 9 aa, Dengue virus
VLNPYMPAV

SEQ ID NO: 61919 - protein, 9 aa, Dengue virus
LNPYMPAVI

SEQ ID NO: 61920 - protein, 9 aa, Dengue virus
NPYMPAVIE

SEQ ID NO: 61921 - protein, 9 aa, Dengue virus
PYMPAVIEH

SEQ ID NO: 61922 - protein, 9 aa, Dengue virus
YMPAVIEHL

SEQ ID NO: 61923 - protein, 9 aa, Dengue virus
MPAVIEHLE

SEQ ID NO: 61924 - protein, 9 aa, Dengue virus
PAVIEHLER

SEQ ID NO: 61925 - protein, 9 aa, Dengue virus
AVIEHLERL

SEQ ID NO: 61926 - protein, 9 aa, Dengue virus
VVEHLERLQ

SEQ ID NO: 61927 - protein, 9 aa, Dengue virus
VEHLERLQR

SEQ ID NO: 61928 - protein, 9 aa, Dengue virus
HLERLQRKY

SEQ ID NO: 61929 - protein, 9 aa, Dengue virus
LERLQRKYG

SEQ ID NO: 61930 - protein, 9 aa, Dengue virus
ERLQRKYGG

SEQ ID NO: 61931 - protein, 9 aa, Dengue virus
RLQRKYGGM

SEQ ID NO: 61932 - protein, 9 aa, Dengue virus
LQRKYGGML

SEQ ID NO: 61933 - protein, 9 aa, Dengue virus
QRKYGGMLV

SEQ ID NO: 61934 - protein, 9 aa, Dengue virus
RKYGGMLVR

SEQ ID NO: 61935 - protein, 9 aa, Dengue virus
KYGGMLVRN

SEQ ID NO: 61936 - protein, 9 aa, Dengue virus
YGGMLVRNP

SEQ ID NO: 61937 - protein, 9 aa, Dengue virus
SNGTGNIVS

SEQ ID NO: 61938 - protein, 9 aa, Dengue virus
NGTGNIVSS

SEQ ID NO: 61939 - protein, 9 aa, Dengue virus
GTGNIVSSV

SEQ ID NO: 61940 - protein, 9 aa, Dengue virus
TGNIVSSVN

SEQ ID NO: 61941 - protein, 9 aa, Dengue virus
GNIVSSVNM

SEQ ID NO: 61942 - protein, 9 aa, Dengue virus
NIVSSVNMV

SEQ ID NO: 61943 - protein, 9 aa, Dengue virus
IVSSVNMVS

SEQ ID NO: 61944 - protein, 9 aa, Dengue virus
VSSVNMVSR

SEQ ID NO: 61945 - protein, 9 aa, Dengue virus
SSVNMVSRL

SEQ ID NO: 61946 - protein, 9 aa, Dengue virus
LLNRFTMTY

SEQ ID NO: 61947 - protein, 9 aa, Dengue virus
LNRFTMTYR

SEQ ID NO: 61948 - protein, 9 aa, Dengue virus
NRFTMTYRR

SEQ ID NO: 61949 - protein, 9 aa, Dengue virus
RFTMTYRRP

SEQ ID NO: 61950 - protein, 9 aa, Dengue virus
FTMTYRRPT

SEQ ID NO: 61951 - protein, 9 aa, Dengue virus
TMTYRRPTI

SEQ ID NO: 61952 - protein, 9 aa, Dengue virus
MTYRRPTIE

SEQ ID NO: 61953 - protein, 9 aa, Dengue virus
TYRRPTIEK

SEQ ID NO: 61954 - protein, 9 aa, Dengue virus
YRRPTIEKD

SEQ ID NO: 61955 - protein, 9 aa, Dengue virus
RKPTIEKDV

SEQ ID NO: 61956 - protein, 9 aa, Dengue virus
KPTIEKDVD

SEQ ID NO: 61957 - protein, 9 aa, Dengue virus
PTIERDVDL

SEQ ID NO: 61958 - protein, 9 aa, Dengue virus
TIERDVDLG

SEQ ID NO: 61959 - protein, 9 aa, Dengue virus
IERDVDLGA

SEQ ID NO: 61960 - protein, 9 aa, Dengue virus
ERDVDLGAG

SEQ ID NO: 61961 - protein, 9 aa, Dengue virus
RDVDLGAGT

SEQ ID NO: 61962 - protein, 9 aa, Dengue virus
RHVNAEPEI

SEQ ID NO: 61963 - protein, 9 aa, Dengue virus
HVNAEPEIP

SEQ ID NO: 61964 - protein, 9 aa, Dengue virus
VNAEPEIPN

SEQ ID NO: 61965 - protein, 9 aa, Dengue virus
NAEPEIPNM

SEQ ID NO: 61966 - protein, 9 aa, Dengue virus
AEPEIPNMD

SEQ ID NO: 61967 - protein, 9 aa, Dengue virus
EPEIPNMDV

SEQ ID NO: 61968 - protein, 9 aa, Dengue virus
PEIPNMDVI

SEQ ID NO: 61969 - protein, 9 aa, Dengue virus
EIPNMDVIG

SEQ ID NO: 61970 - protein, 9 aa, Dengue virus
IPNMDVIGE

SEQ ID NO: 61971 - protein, 9 aa, Dengue virus
MDVIGERIR

SEQ ID NO: 61972 - protein, 9 aa, Dengue virus
DVIGERIRR

SEQ ID NO: 61973 - protein, 9 aa, Dengue virus
VIGERIRRI

SEQ ID NO: 61974 - protein, 9 aa, Dengue virus
IGERIRRIK

SEQ ID NO: 61975 - protein, 9 aa, Dengue virus
GERIRRIKE

SEQ ID NO: 61976 - protein, 9 aa, Dengue virus
ERIRRIKEE

SEQ ID NO: 61977 - protein, 9 aa, Dengue virus
RIRRIKEEH

SEQ ID NO: 61978 - protein, 9 aa, Dengue virus
RIKEEHSST

SEQ ID NO: 61979 - protein, 9 aa, Dengue virus
IKEEHSSTW

SEQ ID NO: 61980 - protein, 9 aa, Dengue virus
KEEHSSTWH

SEQ ID NO: 61981 - protein, 9 aa, Dengue virus
EEHSSTWHY

SEQ ID NO: 61982 - protein, 9 aa, Dengue virus
EHSSTWHYD

SEQ ID NO: 61983 - protein, 9 aa, Dengue virus
HSSTWHYDD

SEQ ID NO: 61984 - protein, 9 aa, Dengue virus
SSTWHYDDE

SEQ ID NO: 61985 - protein, 9 aa, Dengue virus
STWHYDEEN

SEQ ID NO: 61986 - protein, 9 aa, Dengue virus
TKPWDVVPT

SEQ ID NO: 61987 - protein, 9 aa, Dengue virus
KPWDVVPTV

SEQ ID NO: 61988 - protein, 9 aa, Dengue virus
PWDVVPTVT

SEQ ID NO: 61989 - protein, 9 aa, Dengue virus
WDVVPTVTQ

SEQ ID NO: 61990 - protein, 9 aa, Dengue virus
DVVPTVTQM

SEQ ID NO: 61991 - protein, 9 aa, Dengue virus
VVPTVTQMA

SEQ ID NO: 61992 - protein, 9 aa, Dengue virus
VPTVTQMAM

SEQ ID NO: 61993 - protein, 9 aa, Dengue virus
PTVTQMAMT

SEQ ID NO: 61994 - protein, 9 aa, Dengue virus
TVTQMAMTD

SEQ ID NO: 61995 - protein, 9 aa, Dengue virus
VIQMAMTDT

SEQ ID NO: 61996 - protein, 9 aa, Dengue virus
IQMAMTDTT

SEQ ID NO: 61997 - protein, 9 aa, Dengue virus
EKVDTRTPK

SEQ ID NO: 61998 - protein, 9 aa, Dengue virus
KVDTRTPRP

SEQ ID NO: 61999 - protein, 9 aa, Dengue virus
VDTRTPRPM

SEQ ID NO: 62000 - protein, 9 aa, Dengue virus
DTRTPRPMP

SEQ ID NO: 62001 - protein, 9 aa, Dengue virus
TRTPRPMPG

SEQ ID NO: 62002 - protein, 9 aa, Dengue virus
RTPRPMPGT

SEQ ID NO: 62003 - protein, 9 aa, Dengue virus
TPRPMPGTR

SEQ ID NO: 62004 - protein, 9 aa, Dengue virus
GTRRVMGIT

SEQ ID NO: 62005 - protein, 9 aa, Dengue virus
VMGITAEWL

SEQ ID NO: 62006 - protein, 9 aa, Dengue virus
MGITAEWLW

SEQ ID NO: 62007 - protein, 9 aa, Dengue virus
GITAEWLWR

SEQ ID NO: 62008 - protein, 9 aa, Dengue virus
ITAGWLWRT

SEQ ID NO: 62009 - protein, 9 aa, Dengue virus
TAGWLWRTL

SEQ ID NO: 62010 - protein, 9 aa, Dengue virus
AGWLWRTLG

SEQ ID NO: 62011 - protein, 9 aa, Dengue virus
GWLWRTLGR

SEQ ID NO: 62012 - protein, 9 aa, Dengue virus
WRTLGRNKR

SEQ ID NO: 62013 - protein, 9 aa, Dengue virus
RTLGRNKRP

SEQ ID NO: 62014 - protein, 9 aa, Dengue virus
TLGRNKRPR

SEQ ID NO: 62015 - protein, 9 aa, Dengue virus
LGRNKRPRL

SEQ ID NO: 62016 - protein, 9 aa, Dengue virus
GRNKRPRLC

SEQ ID NO: 62017 - protein, 9 aa, Dengue virus
RNKRPRLCT

SEQ ID NO: 62018 - protein, 9 aa, Dengue virus
NKRPRLCTR

SEQ ID NO: 62019 - protein, 9 aa, Dengue virus
KRPRLCTRE

SEQ ID NO: 62020 - protein, 9 aa, Dengue virus
RPRLCTREE

SEQ ID NO: 62021 - protein, 9 aa, Dengue virus
RLCTREEFI

SEQ ID NO: 62022 - protein, 9 aa, Dengue virus
LCTREEFIK

SEQ ID NO: 62023 - protein, 9 aa, Dengue virus
CTREEFIKK

SEQ ID NO: 62024 - protein, 9 aa, Dengue virus
TREEFIKKV

SEQ ID NO: 62025 - protein, 9 aa, Dengue virus
REEFIKKVR

SEQ ID NO: 62026 - protein, 9 aa, Dengue virus
EEFIKKVRT

SEQ ID NO: 62027 - protein, 9 aa, Dengue virus
EFIKKVRTN

SEQ ID NO: 62028 - protein, 9 aa, Dengue virus
FIKKVRTNA

SEQ ID NO: 62029 - protein, 9 aa, Dengue virus
IKKVRTNAA

SEQ ID NO: 62030 - protein, 9 aa, Dengue virus
EENQWDSAR

SEQ ID NO: 62031 - protein, 9 aa, Dengue virus
ENQWDSARA

SEQ ID NO: 62032 - protein, 9 aa, Dengue virus
NQWDSARAA

SEQ ID NO: 62033 - protein, 9 aa, Dengue virus
QWDSARAAV

SEQ ID NO: 62034 - protein, 9 aa, Dengue virus
WDSARAAVE

SEQ ID NO: 62035 - protein, 9 aa, Dengue virus
DSARAAVED

SEQ ID NO: 62036 - protein, 9 aa, Dengue virus
SARAAVEDE

SEQ ID NO: 62037 - protein, 9 aa, Dengue virus
ARAAVEDEE

SEQ ID NO: 62038 - protein, 9 aa, Dengue virus
RAAVEDEEF

SEQ ID NO: 62039 - protein, 9 aa, Dengue virus
AAVEDEEFW

SEQ ID NO: 62040 - protein, 9 aa, Dengue virus
AVEDEEFWK

SEQ ID NO: 62041 - protein, 9 aa, Dengue virus
VEDEEFWKL

SEQ ID NO: 62042 - protein, 9 aa, Dengue virus
EDEEFWKLV

SEQ ID NO: 62043 - protein, 9 aa, Dengue virus
DEEFWKLVD

SEQ ID NO: 62044 - protein, 9 aa, Dengue virus
EEFWKLVDR

SEQ ID NO: 62045 - protein, 9 aa, Dengue virus
EFWKLVDRE

SEQ ID NO: 62046 - protein, 9 aa, Dengue virus
FWKLVDKER

SEQ ID NO: 62047 - protein, 9 aa, Dengue virus
WKLVDKERE

SEQ ID NO: 62048 - protein, 9 aa, Dengue virus
KLVDKEREL

SEQ ID NO: 62049 - protein, 9 aa, Dengue virus
LVDKERELH

SEQ ID NO: 62050 - protein, 9 aa, Dengue virus
VDKERELHK

SEQ ID NO: 62051 - protein, 9 aa, Dengue virus
DKERELHKL

SEQ ID NO: 62052 - protein, 9 aa, Dengue virus
KERELHKLG

SEQ ID NO: 62053 - protein, 9 aa, Dengue virus
ERELHKQGK

SEQ ID NO: 62054 - protein, 9 aa, Dengue virus
RELHKQGKC

SEQ ID NO: 62055 - protein, 9 aa, Dengue virus
ELHKQGKCG

SEQ ID NO: 62056 - protein, 9 aa, Dengue virus
LHKQGKCGS

SEQ ID NO: 62057 - protein, 9 aa, Dengue virus
HKQGKCGSC

SEQ ID NO: 62058 - protein, 9 aa, Dengue virus
KQGKCGSCV

SEQ ID NO: 62059 - protein, 9 aa, Dengue virus
QGKCGSCVY

SEQ ID NO: 62060 - protein, 9 aa, Dengue virus
WYMWLGARF

SEQ ID NO: 62061 - protein, 9 aa, Dengue virus
YMWLGARFL

SEQ ID NO: 62062 - protein, 9 aa, Dengue virus
MWLGARFLE

SEQ ID NO: 62063 - protein, 9 aa, Dengue virus
WLGARFLEF

SEQ ID NO: 62064 - protein, 9 aa, Dengue virus
LGARFLEFE

SEQ ID NO: 62065 - protein, 9 aa, Dengue virus
GARFLEFEA

SEQ ID NO: 62066 - protein, 9 aa, Dengue virus
ARFLEFEAL

SEQ ID NO: 62067 - protein, 9 aa, Dengue virus
RFLEFEALG

SEQ ID NO: 62068 - protein, 9 aa, Dengue virus
FLEFEALGF

SEQ ID NO: 62069 - protein, 9 aa, Dengue virus
DLHNEEKII

SEQ ID NO: 62070 - protein, 9 aa, Dengue virus
LHNEEKIIQ

SEQ ID NO: 62071 - protein, 9 aa, Dengue virus
HNEEKIIQQ

SEQ ID NO: 62072 - protein, 9 aa, Dengue virus
NEEKIIQQM

SEQ ID NO: 62073 - protein, 9 aa, Dengue virus
EEKIIQQMD

SEQ ID NO: 62074 - protein, 9 aa, Dengue virus
EKIIQQMDP

SEQ ID NO: 62075 - protein, 9 aa, Dengue virus
KIIQQMDPE

SEQ ID NO: 62076 - protein, 9 aa, Dengue virus
IIQQMDPEH

SEQ ID NO: 62077 - protein, 9 aa, Dengue virus
IQQMDPEHR

SEQ ID NO: 62078 - protein, 9 aa, Dengue virus
QMDPEHKQL

SEQ ID NO: 62079 - protein, 9 aa, Dengue virus
MDPEHRKLA

SEQ ID NO: 62080 - protein, 9 aa, Dengue virus
PEHRQLASA

SEQ ID NO: 62081 - protein, 9 aa, Dengue virus
EHRQLASAI

SEQ ID NO: 62082 - protein, 9 aa, Dengue virus
HRQLASAIF

SEQ ID NO: 62083 - protein, 9 aa, Dengue virus
RQLASAIFK

SEQ ID NO: 62084 - protein, 9 aa, Dengue virus
QLASAIFKL

SEQ ID NO: 62085 - protein, 9 aa, Dengue virus
LASAIFKLT

SEQ ID NO: 62086 - protein, 9 aa, Dengue virus
ASAIFKLTY

SEQ ID NO: 62087 - protein, 9 aa, Dengue virus
SAIFKLTYQ

SEQ ID NO: 62088 - protein, 9 aa, Dengue virus
VKVQRPTPK

SEQ ID NO: 62089 - protein, 9 aa, Dengue virus
KVQRPTPKG

SEQ ID NO: 62090 - protein, 9 aa, Dengue virus
VQRPTPKGT

SEQ ID NO: 62091 - protein, 9 aa, Dengue virus
QRPTPKGTV

SEQ ID NO: 62092 - protein, 9 aa, Dengue virus
RPTPKGTVM

SEQ ID NO: 62093 - protein, 9 aa, Dengue virus
PTPKGTVMD

SEQ ID NO: 62094 - protein, 9 aa, Dengue virus
TPKGTVMDI

SEQ ID NO: 62095 - protein, 9 aa, Dengue virus
PKGTVMDII

SEQ ID NO: 62096 - protein, 9 aa, Dengue virus
KGTVMDIIS

SEQ ID NO: 62097 - protein, 9 aa, Dengue virus
FTNMEAQLV

SEQ ID NO: 62098 - protein, 9 aa, Dengue virus
TNMEAQLVR

SEQ ID NO: 62099 - protein, 9 aa, Dengue virus
NMEAQLVRQ

SEQ ID NO: 62100 - protein, 9 aa, Dengue virus
MEAQLVRQM

SEQ ID NO: 62101 - protein, 9 aa, Dengue virus
EAQLVRQME

SEQ ID NO: 62102 - protein, 9 aa, Dengue virus
AQLVRQMEG

SEQ ID NO: 62103 - protein, 9 aa, Dengue virus
QLVRQMEGE

SEQ ID NO: 62104 - protein, 9 aa, Dengue virus
LVRQMEGEG

SEQ ID NO: 62105 - protein, 9 aa, Dengue virus
VRQMEGEGV

SEQ ID NO: 62106 - protein, 9 aa, Dengue virus
QMEGEGVLT

SEQ ID NO: 62107 - protein, 9 aa, Dengue virus
MEGEGVLTK

SEQ ID NO: 62108 - protein, 9 aa, Dengue virus
EGEGVLTKA

SEQ ID NO: 62109 - protein, 9 aa, Dengue virus
EKKVTQWLE

SEQ ID NO: 62110 - protein, 9 aa, Dengue virus
TQWLETEGV

SEQ ID NO: 62111 - protein, 9 aa, Dengue virus
QWLETEGVE

SEQ ID NO: 62112 - protein, 9 aa, Dengue virus
WLETEGVER

SEQ ID NO: 62113 - protein, 9 aa, Dengue virus
LETEGVERL

SEQ ID NO: 62114 - protein, 9 aa, Dengue virus
ETKGVERLR

SEQ ID NO: 62115 - protein, 9 aa, Dengue virus
TKGVERLRR

SEQ ID NO: 62116 - protein, 9 aa, Dengue virus
KGVERLRRM

SEQ ID NO: 62117 - protein, 9 aa, Dengue virus
GVERLRRMA

SEQ ID NO: 62118 - protein, 9 aa, Dengue virus
VERLRRMAI

SEQ ID NO: 62119 - protein, 9 aa, Dengue virus
ERLRRMAIS

SEQ ID NO: 62120 - protein, 9 aa, Dengue virus
RLRRMAISG

SEQ ID NO: 62121 - protein, 9 aa, Dengue virus
LRRMAISGD

SEQ ID NO: 62122 - protein, 9 aa, Dengue virus
RRMAISGDD

SEQ ID NO: 62123 - protein, 9 aa, Dengue virus
DDRFANALF

SEQ ID NO: 62124 - protein, 9 aa, Dengue virus
DRFANALFA

SEQ ID NO: 62125 - protein, 9 aa, Dengue virus
RFANALFAL

SEQ ID NO: 62126 - protein, 9 aa, Dengue virus
FANALFALN

SEQ ID NO: 62127 - protein, 9 aa, Dengue virus
ANALFALND

SEQ ID NO: 62128 - protein, 9 aa, Dengue virus
NALFALNDM

SEQ ID NO: 62129 - protein, 9 aa, Dengue virus
ALFALNDMG

SEQ ID NO: 62130 - protein, 9 aa, Dengue virus
LFALNDMGK

SEQ ID NO: 62131 - protein, 9 aa, Dengue virus
FALNDMGKV

SEQ ID NO: 62132 - protein, 9 aa, Dengue virus
QWQPSKGWQ

SEQ ID NO: 62133 - protein, 9 aa, Dengue virus
WQPSKGWQD

SEQ ID NO: 62134 - protein, 9 aa, Dengue virus
QPSKGWQDW

SEQ ID NO: 62135 - protein, 9 aa, Dengue virus
PSKGWQDWQ

SEQ ID NO: 62136 - protein, 9 aa, Dengue virus
SKGWQDWQQ

SEQ ID NO: 62137 - protein, 9 aa, Dengue virus
KGWQDWQQV

SEQ ID NO: 62138 - protein, 9 aa, Dengue virus
GWQDWQQVP

SEQ ID NO: 62139 - protein, 9 aa, Dengue virus
WQDWQQVPF

SEQ ID NO: 62140 - protein, 9 aa, Dengue virus
QDWQQVPFC

SEQ ID NO: 62141 - protein, 9 aa, Dengue virus
SQGAGWSLK

SEQ ID NO: 62142 - protein, 9 aa, Dengue virus
QGAGWSLKE

SEQ ID NO: 62143 - protein, 9 aa, Dengue virus
GAGWSLKET

SEQ ID NO: 62144 - protein, 9 aa, Dengue virus
AGWSLKETA

SEQ ID NO: 62145 - protein, 9 aa, Dengue virus
GWSLKETAC

SEQ ID NO: 62146 - protein, 9 aa, Dengue virus
WSLKETACL

SEQ ID NO: 62147 - protein, 9 aa, Dengue virus
SLKETACLG

SEQ ID NO: 62148 - protein, 9 aa, Dengue virus
LKETACLGK

SEQ ID NO: 62149 - protein, 9 aa, Dengue virus
KETACLGKA

SEQ ID NO: 62150 - protein, 9 aa, Dengue virus
GKAYAQMWA

SEQ ID NO: 62151 - protein, 9 aa, Dengue virus
KAYAQMWAL

SEQ ID NO: 62152 - protein, 9 aa, Dengue virus
AYAQMWALM

SEQ ID NO: 62153 - protein, 9 aa, Dengue virus
YAQMWALMY

SEQ ID NO: 62154 - protein, 9 aa, Dengue virus
AQMWALMYF

SEQ ID NO: 62155 - protein, 9 aa, Dengue virus
QMWALMYFH

SEQ ID NO: 62156 - protein, 9 aa, Dengue virus
MWALMYFHR

SEQ ID NO: 62157 - protein, 9 aa, Dengue virus
WALMYFHRR

SEQ ID NO: 62158 - protein, 9 aa, Dengue virus
ALMYFHRRD

SEQ ID NO: 62159 - protein, 9 aa, Dengue virus
NAICSAVPA

SEQ ID NO: 62160 - protein, 9 aa, Dengue virus
AICSAVPAH

SEQ ID NO: 62161 - protein, 9 aa, Dengue virus
ICSAVPAHW

SEQ ID NO: 62162 - protein, 9 aa, Dengue virus
CSAVPVHWI

SEQ ID NO: 62163 - protein, 9 aa, Dengue virus
SAVPVHWIP

SEQ ID NO: 62164 - protein, 9 aa, Dengue virus
AVPVHWIPT

SEQ ID NO: 62165 - protein, 9 aa, Dengue virus
VPVHWIPTS

SEQ ID NO: 62166 - protein, 9 aa, Dengue virus
PVHWIPTSR

SEQ ID NO: 62167 - protein, 9 aa, Dengue virus
VHWIPTSRT

SEQ ID NO: 62168 - protein, 9 aa, Dengue virus
HWIPTSRTT

SEQ ID NO: 62169 - protein, 9 aa, Dengue virus
WIPTSRTTW

SEQ ID NO: 62170 - protein, 9 aa, Dengue virus
IPTSRTTWS

SEQ ID NO: 62171 - protein, 9 aa, Dengue virus
WMTTEDMLA

SEQ ID NO: 62172 - protein, 9 aa, Dengue virus
MTTEDMLAV

SEQ ID NO: 62173 - protein, 9 aa, Dengue virus
TTEDMLAVW

SEQ ID NO: 62174 - protein, 9 aa, Dengue virus
TEDMLAVWN

SEQ ID NO: 62175 - protein, 9 aa, Dengue virus
EDMLAVWNR

SEQ ID NO: 62176 - protein, 9 aa, Dengue virus
DMLAVWNRV

SEQ ID NO: 62177 - protein, 9 aa, Dengue virus
MLAVWNRVW

SEQ ID NO: 62178 - protein, 9 aa, Dengue virus
LAVWNRVWI

SEQ ID NO: 62179 - protein, 9 aa, Dengue virus
AVWNRVWIE

SEQ ID NO: 62180 - protein, 9 aa, Dengue virus
VWNRVWIEE

SEQ ID NO: 62181 - protein, 9 aa, Dengue virus
WNRVWIEEN

SEQ ID NO: 62182 - protein, 9 aa, Dengue virus
NRVWIEENP

SEQ ID NO: 62183 - protein, 9 aa, Dengue virus
RVWIEENPW

SEQ ID NO: 62184 - protein, 9 aa, Dengue virus
VWIEENPWM

SEQ ID NO: 62185 - protein, 9 aa, Dengue virus
WIEENPWME

SEQ ID NO: 62186 - protein, 9 aa, Dengue virus
IEENPWMED

SEQ ID NO: 62187 - protein, 9 aa, Dengue virus
EENPWMEDK

SEQ ID NO: 62188 - protein, 9 aa, Dengue virus
ENPWMEDKT

SEQ ID NO: 62189 - protein, 9 aa, Dengue virus
PWMEDKTPI

SEQ ID NO: 62190 - protein, 9 aa, Dengue virus
WMEDKTPIT

SEQ ID NO: 62191 - protein, 9 aa, Dengue virus
MEDKTPITT

SEQ ID NO: 62192 - protein, 9 aa, Dengue virus
EDKTPITTW

SEQ ID NO: 62193 - protein, 9 aa, Dengue virus
DKTPITTWE

SEQ ID NO: 62194 - protein, 9 aa, Dengue virus
KTPVTTWED

SEQ ID NO: 62195 - protein, 9 aa, Dengue virus
TPVTTWEDV

SEQ ID NO: 62196 - protein, 9 aa, Dengue virus
PVTTWEDVP

SEQ ID NO: 62197 - protein, 9 aa, Dengue virus
VTTWEDVPY

SEQ ID NO: 62198 - protein, 9 aa, Dengue virus
TTWEDVPYL

SEQ ID NO: 62199 - protein, 9 aa, Dengue virus
TWEDVPYLG

SEQ ID NO: 62200 - protein, 9 aa, Dengue virus
WEDVPYLGK

SEQ ID NO: 62201 - protein, 9 aa, Dengue virus
EDVPYLGKR

SEQ ID NO: 62202 - protein, 9 aa, Dengue virus
DVPYLGKRE

SEQ ID NO: 62203 - protein, 9 aa, Dengue virus
RATWAQNIL

SEQ ID NO: 62204 - protein, 9 aa, Dengue virus
ATWAQNILT

SEQ ID NO: 62205 - protein, 9 aa, Dengue virus
TWAQNILTA

SEQ ID NO: 62206 - protein, 9 aa, Dengue virus
WAQNILTAI

SEQ ID NO: 62207 - protein, 9 aa, Dengue virus
AQNILTAIQ

SEQ ID NO: 62208 - protein, 9 aa, Dengue virus
QNILTAIQQ

SEQ ID NO: 62209 - protein, 9 aa, Dengue virus
NILTAIQQV

SEQ ID NO: 62210 - protein, 9 aa, Dengue virus
ILTAIQQVR

SEQ ID NO: 62211 - protein, 9 aa, Dengue virus
LTAIQQVRS

SEQ ID NO: 62212 - protein, 9 aa, Dengue virus
IAIQQVRSL

SEQ ID NO: 62213 - protein, 9 aa, Dengue virus
QQVRSLIGD

SEQ ID NO: 62214 - protein, 9 aa, Dengue virus
QVRSLIGDE

SEQ ID NO: 62215 - protein, 9 aa, Dengue virus
VRSLIGDEE

SEQ ID NO: 62216 - protein, 9 aa, Dengue virus
RSLIGDEEF

SEQ ID NO: 62217 - protein, 9 aa, Dengue virus
SLIGDEEFL

SEQ ID NO: 62218 - protein, 9 aa, Dengue virus
LIGDEEFLD

SEQ ID NO: 62219 - protein, 9 aa, Dengue virus
IGDEEFLDY

SEQ ID NO: 62220 - protein, 9 aa, Dengue virus
GDEEFLDYM

SEQ ID NO: 62221 - protein, 9 aa, Dengue virus
DEEFLDYMP

SEQ ID NO: 62222 - protein, 9 aa, Dengue virus
KRFRKEEEL

SEQ ID NO: 62223 - protein, 9 aa, Dengue virus
RFRKEEELE

SEQ ID NO: 62224 - protein, 9 aa, Dengue virus
FRKEEELEG

SEQ ID NO: 62225 - protein, 9 aa, Dengue virus
RKEEELEGA

SEQ ID NO: 62226 - protein, 9 aa, Dengue virus
KEEELEGAI

SEQ ID NO: 62227 - protein, 9 aa, Dengue virus
EEELEGAIW

SEQ ID NO: 62228 - protein, 9 aa, Dengue virus
QLAKRFSKE

SEQ ID NO: 62229 - protein, 9 aa, Dengue virus
LAKRFSKEL

SEQ ID NO: 62230 - protein, 9 aa, Dengue virus
AKRFSKELL

SEQ ID NO: 62231 - protein, 9 aa, Dengue virus
KRFSKELLN

SEQ ID NO: 62232 - protein, 9 aa, Dengue virus
RFSKELLNG

SEQ ID NO: 62233 - protein, 9 aa, Dengue virus
FSKELLNGQ

SEQ ID NO: 62234 - protein, 9 aa, Dengue virus
SKELLNGQG

SEQ ID NO: 62235 - protein, 9 aa, Dengue virus
KELLNGQGP

SEQ ID NO: 62236 - protein, 9 aa, Dengue virus
SGAIKVLKS

SEQ ID NO: 62237 - protein, 9 aa, Dengue virus
GAIKVLKSF

SEQ ID NO: 62238 - protein, 9 aa, Dengue virus
AIKVLKSFK

SEQ ID NO: 62239 - protein, 9 aa, Dengue virus
IKVLKGFKR

SEQ ID NO: 62240 - protein, 9 aa, Dengue virus
KVLKGFKRE

SEQ ID NO: 62241 - protein, 9 aa, Dengue virus
VLKGFKREI

SEQ ID NO: 62242 - protein, 9 aa, Dengue virus
LKGFKREIS

SEQ ID NO: 62243 - protein, 9 aa, Dengue virus
KGFKREISN

SEQ ID NO: 62244 - protein, 9 aa, Dengue virus
GFKKEISSM

SEQ ID NO: 62245 - protein, 9 aa, Dengue virus
SNMLSIINQ

SEQ ID NO: 62246 - protein, 9 aa, Dengue virus
NMLSIINQR

SEQ ID NO: 62247 - protein, 9 aa, Dengue virus
LSIINRRKR

SEQ ID NO: 62248 - protein, 9 aa, Dengue virus
SIINRRKRT

SEQ ID NO: 62249 - protein, 9 aa, Dengue virus
IINRRKRTS

SEQ ID NO: 62250 - protein, 9 aa, Dengue virus
NKRKKTSFC

SEQ ID NO: 62251 - protein, 9 aa, Dengue virus
RKKTSLCLV

SEQ ID NO: 62252 - protein, 9 aa, Dengue virus
KKTSLCLVM

SEQ ID NO: 62253 - protein, 9 aa, Dengue virus
MILPATLAF

SEQ ID NO: 62254 - protein, 9 aa, Dengue virus
ILPATLAFH

SEQ ID NO: 62255 - protein, 9 aa, Dengue virus
DTVTYKCPF

SEQ ID NO: 62256 - protein, 9 aa, Dengue virus
TVTYKCPFI

SEQ ID NO: 62257 - protein, 9 aa, Dengue virus
TYKCPLITE

SEQ ID NO: 62258 - protein, 9 aa, Dengue virus
VAEVEPEDI

SEQ ID NO: 62259 - protein, 9 aa, Dengue virus
LAHYISTSL

SEQ ID NO: 62260 - protein, 9 aa, Dengue virus
AHYVGTSLT

SEQ ID NO: 62261 - protein, 9 aa, Dengue virus
HYVGTSLTQ

SEQ ID NO: 62262 - protein, 9 aa, Dengue virus
YVGTSLTQK

SEQ ID NO: 62263 - protein, 9 aa, Dengue virus
IGTSLIQKV

SEQ ID NO: 62264 - protein, 9 aa, Dengue virus
GTSLIQKVV

SEQ ID NO: 62265 - protein, 9 aa, Dengue virus
TSLIQKVVI

SEQ ID NO: 62266 - protein, 9 aa, Dengue virus
SLIQKVVIF

SEQ ID NO: 62267 - protein, 9 aa, Dengue virus
LTQKAVIFI

SEQ ID NO: 62268 - protein, 9 aa, Dengue virus
TQKAVIFIL

SEQ ID NO: 62269 - protein, 9 aa, Dengue virus
QKAVIFILL

SEQ ID NO: 62270 - protein, 9 aa, Dengue virus
KAVIFILLM

SEQ ID NO: 62271 - protein, 9 aa, Dengue virus
AVIFILLML

SEQ ID NO: 62272 - protein, 9 aa, Dengue virus
VIFTLLMLV

SEQ ID NO: 62273 - protein, 9 aa, Dengue virus
IFTLLMLVT

SEQ ID NO: 62274 - protein, 9 aa, Dengue virus
FTLLMLVTP

SEQ ID NO: 62275 - protein, 9 aa, Dengue virus
TLLMLVTPS

SEQ ID NO: 62276 - protein, 9 aa, Dengue virus
RCPTQGEAT

SEQ ID NO: 62277 - protein, 9 aa, Dengue virus
CPTQGEATL

SEQ ID NO: 62278 - protein, 9 aa, Dengue virus
PTQGEATLP

SEQ ID NO: 62279 - protein, 9 aa, Dengue virus
TQGEATLPE

SEQ ID NO: 62280 - protein, 9 aa, Dengue virus
QGEATLPEE

SEQ ID NO: 62281 - protein, 9 aa, Dengue virus
GEATLPEEQ

SEQ ID NO: 62282 - protein, 9 aa, Dengue virus
EATLPEEQD

SEQ ID NO: 62283 - protein, 9 aa, Dengue virus
ATLPEEQDQ

SEQ ID NO: 62284 - protein, 9 aa, Dengue virus
TLPEEQDQN

SEQ ID NO: 62285 - protein, 9 aa, Dengue virus
CAKFQCLEL

SEQ ID NO: 62286 - protein, 9 aa, Dengue virus
AKFQCLELI

SEQ ID NO: 62287 - protein, 9 aa, Dengue virus
KFQCLELIE

SEQ ID NO: 62288 - protein, 9 aa, Dengue virus
FQCLELIEG

SEQ ID NO: 62289 - protein, 9 aa, Dengue virus
QCLELIEGK

SEQ ID NO: 62290 - protein, 9 aa, Dengue virus
IEGKAVQHE

SEQ ID NO: 62291 - protein, 9 aa, Dengue virus
EGKAVQHEN

SEQ ID NO: 62292 - protein, 9 aa, Dengue virus
GKAVQHENL

SEQ ID NO: 62293 - protein, 9 aa, Dengue virus
KAVQHENLK

SEQ ID NO: 62294 - protein, 9 aa, Dengue virus
AVQHENLKY

SEQ ID NO: 62295 - protein, 9 aa, Dengue virus
HENLKYTVT

SEQ ID NO: 62296 - protein, 9 aa, Dengue virus
GNDTQGVTA

SEQ ID NO: 62297 - protein, 9 aa, Dengue virus
NDTQGVTAE

SEQ ID NO: 62298 - protein, 9 aa, Dengue virus
DTQGVTAEI

SEQ ID NO: 62299 - protein, 9 aa, Dengue virus
QGVTAEITS

SEQ ID NO: 62300 - protein, 9 aa, Dengue virus
GVTAEITSQ

SEQ ID NO: 62301 - protein, 9 aa, Dengue virus
VTAEITSQA

SEQ ID NO: 62302 - protein, 9 aa, Dengue virus
AEITSQAST

SEQ ID NO: 62303 - protein, 9 aa, Dengue virus
EITPQASTA

SEQ ID NO: 62304 - protein, 9 aa, Dengue virus
ITPQASTAE

SEQ ID NO: 62305 - protein, 9 aa, Dengue virus
TPQASTAEA

SEQ ID NO: 62306 - protein, 9 aa, Dengue virus
QASTVEAIL

SEQ ID NO: 62307 - protein, 9 aa, Dengue virus
VEAILPEYG

SEQ ID NO: 62308 - protein, 9 aa, Dengue virus
EVILPEYGT

SEQ ID NO: 62309 - protein, 9 aa, Dengue virus
VILPEYGTL

SEQ ID NO: 62310 - protein, 9 aa, Dengue virus
LPLPWTSGT

SEQ ID NO: 62311 - protein, 9 aa, Dengue virus
PLPWTSGTT

SEQ ID NO: 62312 - protein, 9 aa, Dengue virus
LPWTSGATA

SEQ ID NO: 62313 - protein, 9 aa, Dengue virus
AETPTWNRK

SEQ ID NO: 62314 - protein, 9 aa, Dengue virus
ETPIWNRKE

SEQ ID NO: 62315 - protein, 9 aa, Dengue virus
EIQNSGGTN

SEQ ID NO: 62316 - protein, 9 aa, Dengue virus
IQNSGGTNI

SEQ ID NO: 62317 - protein, 9 aa, Dengue virus
QNSGGTNIF

SEQ ID NO: 62318 - protein, 9 aa, Dengue virus
NSGGTNIFA

SEQ ID NO: 62319 - protein, 9 aa, Dengue virus
LGGTSIFAG

SEQ ID NO: 62320 - protein, 9 aa, Dengue virus
KGMSYAMCS

SEQ ID NO: 62321 - protein, 9 aa, Dengue virus
GMSYAMCSN

SEQ ID NO: 62322 - protein, 9 aa, Dengue virus
MSYAMCSNA

SEQ ID NO: 62323 - protein, 9 aa, Dengue virus
SYAMCSNAF

SEQ ID NO: 62324 - protein, 9 aa, Dengue virus
YAMCSNAFV

SEQ ID NO: 62325 - protein, 9 aa, Dengue virus
AMCSNAFVL

SEQ ID NO: 62326 - protein, 9 aa, Dengue virus
GSFVLKKEV

SEQ ID NO: 62327 - protein, 9 aa, Dengue virus
SFVLKKEVS

SEQ ID NO: 62328 - protein, 9 aa, Dengue virus
TILVKVEYK

SEQ ID NO: 62329 - protein, 9 aa, Dengue virus
ILVKVEYKG

SEQ ID NO: 62330 - protein, 9 aa, Dengue virus
LIKVEYKGK

SEQ ID NO: 62331 - protein, 9 aa, Dengue virus
IKVEYKGKD

SEQ ID NO: 62332 - protein, 9 aa, Dengue virus
KVEYRGEDA

SEQ ID NO: 62333 - protein, 9 aa, Dengue virus
VEYRGEDAP

SEQ ID NO: 62334 - protein, 9 aa, Dengue virus
EYRGEDAPC

SEQ ID NO: 62335 - protein, 9 aa, Dengue virus
YRGEDAPCK

SEQ ID NO: 62336 - protein, 9 aa, Dengue virus
RGEDAPCKI

SEQ ID NO: 62337 - protein, 9 aa, Dengue virus
GEDVPCKVP

SEQ ID NO: 62338 - protein, 9 aa, Dengue virus
EDVPCKVPF

SEQ ID NO: 62339 - protein, 9 aa, Dengue virus
DVPCKVPFS

SEQ ID NO: 62340 - protein, 9 aa, Dengue virus
VPCKVPFST

SEQ ID NO: 62341 - protein, 9 aa, Dengue virus
KIPFSTEDE

SEQ ID NO: 62342 - protein, 9 aa, Dengue virus
IPFSTEDEQ

SEQ ID NO: 62343 - protein, 9 aa, Dengue virus
STEDGQGKV

SEQ ID NO: 62344 - protein, 9 aa, Dengue virus
TEDGQGKVH

SEQ ID NO: 62345 - protein, 9 aa, Dengue virus
EDEQGKAHN

SEQ ID NO: 62346 - protein, 9 aa, Dengue virus
DEQGKAHNG

SEQ ID NO: 62347 - protein, 9 aa, Dengue virus
EQGKAHNGR

SEQ ID NO: 62348 - protein, 9 aa, Dengue virus
QGKVHNGRL

SEQ ID NO: 62349 - protein, 9 aa, Dengue virus
TANPVVIKK

SEQ ID NO: 62350 - protein, 9 aa, Dengue virus
ANPVVTKKD

SEQ ID NO: 62351 - protein, 9 aa, Dengue virus
NPVVTKKDE

SEQ ID NO: 62352 - protein, 9 aa, Dengue virus
PVVTKKDEP

SEQ ID NO: 62353 - protein, 9 aa, Dengue virus
VVTKKDEPV

SEQ ID NO: 62354 - protein, 9 aa, Dengue virus
VTKKEEPIN

SEQ ID NO: 62355 - protein, 9 aa, Dengue virus
TKKEEPINI

SEQ ID NO: 62356 - protein, 9 aa, Dengue virus
KKEEPINIE

SEQ ID NO: 62357 - protein, 9 aa, Dengue virus
KEEPINIEA

SEQ ID NO: 62358 - protein, 9 aa, Dengue virus
EEPINIEAE

SEQ ID NO: 62359 - protein, 9 aa, Dengue virus
GESNIVIGT

SEQ ID NO: 62360 - protein, 9 aa, Dengue virus
ESNIVIGTG

SEQ ID NO: 62361 - protein, 9 aa, Dengue virus
SNIVIGTGD

SEQ ID NO: 62362 - protein, 9 aa, Dengue virus
GDNSLKINW

SEQ ID NO: 62363 - protein, 9 aa, Dengue virus
DNSLKINWY

SEQ ID NO: 62364 - protein, 9 aa, Dengue virus
NSLKINWYK

SEQ ID NO: 62365 - protein, 9 aa, Dengue virus
ALKINWYRK

SEQ ID NO: 62366 - protein, 9 aa, Dengue virus
ALFGGVSWI

SEQ ID NO: 62367 - protein, 9 aa, Dengue virus
LFGGVSWIM

SEQ ID NO: 62368 - protein, 9 aa, Dengue virus
FGGVSWIMK

SEQ ID NO: 62369 - protein, 9 aa, Dengue virus
GGVSWIMKI

SEQ ID NO: 62370 - protein, 9 aa, Dengue virus
GVSWMMKIG

SEQ ID NO: 62371 - protein, 9 aa, Dengue virus
VSWMMKIGI

SEQ ID NO: 62372 - protein, 9 aa, Dengue virus
SWMMKIGIG

SEQ ID NO: 62373 - protein, 9 aa, Dengue virus
WVMKIGIGI

SEQ ID NO: 62374 - protein, 9 aa, Dengue virus
VMKIGIGIL

SEQ ID NO: 62375 - protein, 9 aa, Dengue virus
SFSCIAIGV

SEQ ID NO: 62376 - protein, 9 aa, Dengue virus
FSCIAIGVI

SEQ ID NO: 62377 - protein, 9 aa, Dengue virus
SCIAIGVIT

SEQ ID NO: 62378 - protein, 9 aa, Dengue virus
CIAIGVITL

SEQ ID NO: 62379 - protein, 9 aa, Dengue virus
IAIGVITLY

SEQ ID NO: 62380 - protein, 9 aa, Dengue virus
AIGVITLYL

SEQ ID NO: 62381 - protein, 9 aa, Dengue virus
GIITLYLGT

SEQ ID NO: 62382 - protein, 9 aa, Dengue virus
IITLYLGTV

SEQ ID NO: 62383 - protein, 9 aa, Dengue virus
ITLYLGVVV

SEQ ID NO: 62384 - protein, 9 aa, Dengue virus
TLYLGVVVQ

SEQ ID NO: 62385 - protein, 9 aa, Dengue virus
LYLGVVVQA

SEQ ID NO: 62386 - protein, 9 aa, Dengue virus
YLGVVVQAD

SEQ ID NO: 62387 - protein, 9 aa, Dengue virus
LGTVVQADM

SEQ ID NO: 62388 - protein, 9 aa, Dengue virus
GTVVQADMG

SEQ ID NO: 62389 - protein, 9 aa, Dengue virus
TVVQADMGC

SEQ ID NO: 62390 - protein, 9 aa, Dengue virus
VVQADMGCA

SEQ ID NO: 62391 - protein, 9 aa, Dengue virus
VQADMGCAI

SEQ ID NO: 62392 - protein, 9 aa, Dengue virus
QADMGCAIN

SEQ ID NO: 62393 - protein, 9 aa, Dengue virus
ADMGCAINW

SEQ ID NO: 62394 - protein, 9 aa, Dengue virus
DMGCAINWK

SEQ ID NO: 62395 - protein, 9 aa, Dengue virus
MGCAINWKG

SEQ ID NO: 62396 - protein, 9 aa, Dengue virus
GCVVNWKGK

SEQ ID NO: 62397 - protein, 9 aa, Dengue virus
CVVNWKGKE

SEQ ID NO: 62398 - protein, 9 aa, Dengue virus
VVNWKGKEL

SEQ ID NO: 62399 - protein, 9 aa, Dengue virus
NYILWENSI

SEQ ID NO: 62400 - protein, 9 aa, Dengue virus
HILWENNIK

SEQ ID NO: 62401 - protein, 9 aa, Dengue virus
LWENSIKLT

SEQ ID NO: 62402 - protein, 9 aa, Dengue virus
WENNVKLTV

SEQ ID NO: 62403 - protein, 9 aa, Dengue virus
ENNVKLTVV

SEQ ID NO: 62404 - protein, 9 aa, Dengue virus
NNVKLTVVV

SEQ ID NO: 62405 - protein, 9 aa, Dengue virus
NVKLTVVVG

SEQ ID NO: 62406 - protein, 9 aa, Dengue virus
KLTIVVGDV

SEQ ID NO: 62407 - protein, 9 aa, Dengue virus
LTVVVGDIT

SEQ ID NO: 62408 - protein, 9 aa, Dengue virus
TVVVGDITG

SEQ ID NO: 62409 - protein, 9 aa, Dengue virus
TGVLEQGKR

SEQ ID NO: 62410 - protein, 9 aa, Dengue virus
GVLEQGKRA

SEQ ID NO: 62411 - protein, 9 aa, Dengue virus
VLEQGKRAL

SEQ ID NO: 62412 - protein, 9 aa, Dengue virus
EQGKRTLTL

SEQ ID NO: 62413 - protein, 9 aa, Dengue virus
QGKRILTPQ

SEQ ID NO: 62414 - protein, 9 aa, Dengue virus
GKRILTPQP

SEQ ID NO: 62415 - protein, 9 aa, Dengue virus
KRTLTLQPM

SEQ ID NO: 62416 - protein, 9 aa, Dengue virus
RTLTLQPME

SEQ ID NO: 62417 - protein, 9 aa, Dengue virus
TLTLQPMEL

SEQ ID NO: 62418 - protein, 9 aa, Dengue virus
LTPQPMDLK

SEQ ID NO: 62419 - protein, 9 aa, Dengue virus
PPQPMELKY

SEQ ID NO: 62420 - protein, 9 aa, Dengue virus
SWKAWGKAK

SEQ ID NO: 62421 - protein, 9 aa, Dengue virus
WKTWGKAKV

SEQ ID NO: 62422 - protein, 9 aa, Dengue virus
KAWGKAKIV

SEQ ID NO: 62423 - protein, 9 aa, Dengue virus
WGKAKIVIA

SEQ ID NO: 62424 - protein, 9 aa, Dengue virus
GKAKIVIAE

SEQ ID NO: 62425 - protein, 9 aa, Dengue virus
AETQNFSFI

SEQ ID NO: 62426 - protein, 9 aa, Dengue virus
ETQNFSFII

SEQ ID NO: 62427 - protein, 9 aa, Dengue virus
TQNFSFIID

SEQ ID NO: 62428 - protein, 9 aa, Dengue virus
FSFIIDGPN

SEQ ID NO: 62429 - protein, 9 aa, Dengue virus
GPSTPECPS

SEQ ID NO: 62430 - protein, 9 aa, Dengue virus
PNTPECPSV

SEQ ID NO: 62431 - protein, 9 aa, Dengue virus
PSVSRAWNV

SEQ ID NO: 62432 - protein, 9 aa, Dengue virus
SVSRAWNVW

SEQ ID NO: 62433 - protein, 9 aa, Dengue virus
TSRAWNVWE

SEQ ID NO: 62434 - protein, 9 aa, Dengue virus
NIWLKLREA

SEQ ID NO: 62435 - protein, 9 aa, Dengue virus
IWLKLREVH

SEQ ID NO: 62436 - protein, 9 aa, Dengue virus
WLKLREVHT

SEQ ID NO: 62437 - protein, 9 aa, Dengue virus
LKLREVHTQ

SEQ ID NO: 62438 - protein, 9 aa, Dengue virus
TQTCDHRLM

SEQ ID NO: 62439 - protein, 9 aa, Dengue virus
QTCDHRLMS

SEQ ID NO: 62440 - protein, 9 aa, Dengue virus
TCDHRLMSA

SEQ ID NO: 62441 - protein, 9 aa, Dengue virus
CEGTTVVIS

SEQ ID NO: 62442 - protein, 9 aa, Dengue virus
EGTTVVISE

SEQ ID NO: 62443 - protein, 9 aa, Dengue virus
GTTVVIAEN

SEQ ID NO: 62444 - protein, 9 aa, Dengue virus
TTVVIAENC

SEQ ID NO: 62445 - protein, 9 aa, Dengue virus
TVVIAENCG

SEQ ID NO: 62446 - protein, 9 aa, Dengue virus
VVIAENCGT

SEQ ID NO: 62447 - protein, 9 aa, Dengue virus
CGTGGPSLR

SEQ ID NO: 62448 - protein, 9 aa, Dengue virus
GTSGPSLTT

SEQ ID NO: 62449 - protein, 9 aa, Dengue virus
TSGPSLTTT

SEQ ID NO: 62450 - protein, 9 aa, Dengue virus
KGPSLRTTT

SEQ ID NO: 62451 - protein, 9 aa, Dengue virus
YGMEIRPVN

SEQ ID NO: 62452 - protein, 9 aa, Dengue virus
GMEIRPVNE

SEQ ID NO: 62453 - protein, 9 aa, Dengue virus
MEIRPVNEK

SEQ ID NO: 62454 - protein, 9 aa, Dengue virus
EIRPVNEKE

SEQ ID NO: 62455 - protein, 9 aa, Dengue virus
IRPVNEKEE

SEQ ID NO: 62456 - protein, 9 aa, Dengue virus
RPVNEKEEN

SEQ ID NO: 62457 - protein, 9 aa, Dengue virus
PVNEKEENM

SEQ ID NO: 62458 - protein, 9 aa, Dengue virus
VNEKEENMV

SEQ ID NO: 62459 - protein, 9 aa, Dengue virus
SLASAGSGK

SEQ ID NO: 62460 - protein, 9 aa, Dengue virus
LVSAGSGKM

SEQ ID NO: 62461 - protein, 9 aa, Dengue virus
VSAGSGKMD

SEQ ID NO: 62462 - protein, 9 aa, Dengue virus
SAGSGKMDN

SEQ ID NO: 62463 - protein, 9 aa, Dengue virus
AGSGKMDNF

SEQ ID NO: 62464 - protein, 9 aa, Dengue virus
GSGKMDNFT

SEQ ID NO: 62465 - protein, 9 aa, Dengue virus
SGKMDNFTM

SEQ ID NO: 62466 - protein, 9 aa, Dengue virus
GKMDNFTMG

SEQ ID NO: 62467 - protein, 9 aa, Dengue virus
ADNFTMGVL

SEQ ID NO: 62468 - protein, 9 aa, Dengue virus
MGALCLAIL

SEQ ID NO: 62469 - protein, 9 aa, Dengue virus
GALCLAILF

SEQ ID NO: 62470 - protein, 9 aa, Dengue virus
ALCLAILFE

SEQ ID NO: 62471 - protein, 9 aa, Dengue virus
GKKHMIAGA

SEQ ID NO: 62472 - protein, 9 aa, Dengue virus
LTFVLLLSG

SEQ ID NO: 62473 - protein, 9 aa, Dengue virus
IFVLLLSGQ

SEQ ID NO: 62474 - protein, 9 aa, Dengue virus
SGQITWRGM

SEQ ID NO: 62475 - protein, 9 aa, Dengue virus
GQITWRDLA

SEQ ID NO: 62476 - protein, 9 aa, Dengue virus
THTLIMIGS

SEQ ID NO: 62477 - protein, 9 aa, Dengue virus
HTFIMIGSN

SEQ ID NO: 62478 - protein, 9 aa, Dengue virus
TLIMIGSNT

SEQ ID NO: 62479 - protein, 9 aa, Dengue virus
LIMIGSNAT

SEQ ID NO: 62480 - protein, 9 aa, Dengue virus
IMIGSNTSD

SEQ ID NO: 62481 - protein, 9 aa, Dengue virus
MIGSNASDK

SEQ ID NO: 62482 - protein, 9 aa, Dengue virus
IGSNATDRM

SEQ ID NO: 62483 - protein, 9 aa, Dengue virus
GSNATDRMG

SEQ ID NO: 62484 - protein, 9 aa, Dengue virus
SNATDRMGM

SEQ ID NO: 62485 - protein, 9 aa, Dengue virus
NATDRMGMG

SEQ ID NO: 62486 - protein, 9 aa, Dengue virus
ASDKMGMGV

SEQ ID NO: 62487 - protein, 9 aa, Dengue virus
TDRMGMGVT

SEQ ID NO: 62488 - protein, 9 aa, Dengue virus
MTTTLQLPE

SEQ ID NO: 62489 - protein, 9 aa, Dengue virus
TTTLQLPED

SEQ ID NO: 62490 - protein, 9 aa, Dengue virus
TTLQLPADI

SEQ ID NO: 62491 - protein, 9 aa, Dengue virus
TLQLPADIE

SEQ ID NO: 62492 - protein, 9 aa, Dengue virus
LGLMALKLT

SEQ ID NO: 62493 - protein, 9 aa, Dengue virus
GLMALKLTT

SEQ ID NO: 62494 - protein, 9 aa, Dengue virus
LMALKLTTQ

SEQ ID NO: 62495 - protein, 9 aa, Dengue virus
MALKLTTQF

SEQ ID NO: 62496 - protein, 9 aa, Dengue virus
ALKLTTQFE

SEQ ID NO: 62497 - protein, 9 aa, Dengue virus
TYQLWAALV

SEQ ID NO: 62498 - protein, 9 aa, Dengue virus
YQLWAALVS

SEQ ID NO: 62499 - protein, 9 aa, Dengue virus
QLWAALVSL

SEQ ID NO: 62500 - protein, 9 aa, Dengue virus
LWTALVSLM

SEQ ID NO: 62501 - protein, 9 aa, Dengue virus
WTALVSLMC

SEQ ID NO: 62502 - protein, 9 aa, Dengue virus
ALVSLMCSN

SEQ ID NO: 62503 - protein, 9 aa, Dengue virus
LVSLMCSNT

SEQ ID NO: 62504 - protein, 9 aa, Dengue virus
SLMCSNTIF

SEQ ID NO: 62505 - protein, 9 aa, Dengue virus
LMCSNTIFT

SEQ ID NO: 62506 - protein, 9 aa, Dengue virus
MCSNTIFTL

SEQ ID NO: 62507 - protein, 9 aa, Dengue virus
CSNTILTLT

SEQ ID NO: 62508 - protein, 9 aa, Dengue virus
ANTIFTLTV

SEQ ID NO: 62509 - protein, 9 aa, Dengue virus
TATLILAVI

SEQ ID NO: 62510 - protein, 9 aa, Dengue virus
ATLILAVIS

SEQ ID NO: 62511 - protein, 9 aa, Dengue virus
TLILAVISL

SEQ ID NO: 62512 - protein, 9 aa, Dengue virus
LILAVISLL

SEQ ID NO: 62513 - protein, 9 aa, Dengue virus
ILAVISLLP

SEQ ID NO: 62514 - protein, 9 aa, Dengue virus
ISLLPVCQS

SEQ ID NO: 62515 - protein, 9 aa, Dengue virus
SLLPMCQSS

SEQ ID NO: 62516 - protein, 9 aa, Dengue virus
LLPMCQSSS

SEQ ID NO: 62517 - protein, 9 aa, Dengue virus
MRKTDWLPV

SEQ ID NO: 62518 - protein, 9 aa, Dengue virus
RKSDWLPMT

SEQ ID NO: 62519 - protein, 9 aa, Dengue virus
KSDWLPMTV

SEQ ID NO: 62520 - protein, 9 aa, Dengue virus
SDWLPMTVA

SEQ ID NO: 62521 - protein, 9 aa, Dengue virus
DWLPVAVAA

SEQ ID NO: 62522 - protein, 9 aa, Dengue virus
WLPVAVAAM

SEQ ID NO: 62523 - protein, 9 aa, Dengue virus
LPVAVAAMG

SEQ ID NO: 62524 - protein, 9 aa, Dengue virus
PVAVAAMGV

SEQ ID NO: 62525 - protein, 9 aa, Dengue virus
VAAMGAQPL

SEQ ID NO: 62526 - protein, 9 aa, Dengue virus
AAMGAQPLP

SEQ ID NO: 62527 - protein, 9 aa, Dengue virus
AMGAQPLPL

SEQ ID NO: 62528 - protein, 9 aa, Dengue virus
MGAQPLPLF

SEQ ID NO: 62529 - protein, 9 aa, Dengue virus
GAQPLPLFI

SEQ ID NO: 62530 - protein, 9 aa, Dengue virus
AQPLPLFIF

SEQ ID NO: 62531 - protein, 9 aa, Dengue virus
PLPLFIFNL

SEQ ID NO: 62532 - protein, 9 aa, Dengue virus
LPLFIFGLK

SEQ ID NO: 62533 - protein, 9 aa, Dengue virus
PLFIFGLKD

SEQ ID NO: 62534 - protein, 9 aa, Dengue virus
LFIFSLKDA

SEQ ID NO: 62535 - protein, 9 aa, Dengue virus
LKDTPKRKS

SEQ ID NO: 62536 - protein, 9 aa, Dengue virus
KDTPKRKSW

SEQ ID NO: 62537 - protein, 9 aa, Dengue virus
DTPKRKSWP

SEQ ID NO: 62538 - protein, 9 aa, Dengue virus
TPKRKSWPL

SEQ ID NO: 62539 - protein, 9 aa, Dengue virus
PKRKSWPLN

SEQ ID NO: 62540 - protein, 9 aa, Dengue virus
SADLTVEKV

SEQ ID NO: 62541 - protein, 9 aa, Dengue virus
ADLTVEKVA

SEQ ID NO: 62542 - protein, 9 aa, Dengue virus
DLTVEKVAD

SEQ ID NO: 62543 - protein, 9 aa, Dengue virus
AEVTWEEEA

SEQ ID NO: 62544 - protein, 9 aa, Dengue virus
EVTWEEEAE

SEQ ID NO: 62545 - protein, 9 aa, Dengue virus
WHTWQKRTQ

SEQ ID NO: 62546 - protein, 9 aa, Dengue virus
HTWQKRTQR

SEQ ID NO: 62547 - protein, 9 aa, Dengue virus
TWQKRTQRS

SEQ ID NO: 62548 - protein, 9 aa, Dengue virus
SYGGGWKLS

SEQ ID NO: 62549 - protein, 9 aa, Dengue virus
YGGGWKLSA

SEQ ID NO: 62550 - protein, 9 aa, Dengue virus
GGGWKLSAQ

SEQ ID NO: 62551 - protein, 9 aa, Dengue virus
GGWKLSAQW

SEQ ID NO: 62552 - protein, 9 aa, Dengue virus
GWKLSAQWQ

SEQ ID NO: 62553 - protein, 9 aa, Dengue virus
WKLSAQWQK

SEQ ID NO: 62554 - protein, 9 aa, Dengue virus
KLSAQWQKG

SEQ ID NO: 62555 - protein, 9 aa, Dengue virus
LSTQWQKGE

SEQ ID NO: 62556 - protein, 9 aa, Dengue virus
STQWQKGEE

SEQ ID NO: 62557 - protein, 9 aa, Dengue virus
AQWKKGEEV

SEQ ID NO: 62558 - protein, 9 aa, Dengue virus
KNFQTTPGT

SEQ ID NO: 62559 - protein, 9 aa, Dengue virus
NFQTTPGTF

SEQ ID NO: 62560 - protein, 9 aa, Dengue virus
FQTTPGTFQ

SEQ ID NO: 62561 - protein, 9 aa, Dengue virus
QTTPGTFQT

SEQ ID NO: 62562 - protein, 9 aa, Dengue virus
TTPGTFQTT

SEQ ID NO: 62563 - protein, 9 aa, Dengue virus
PGIFQTTMG

SEQ ID NO: 62564 - protein, 9 aa, Dengue virus
GIFQTTMGE

SEQ ID NO: 62565 - protein, 9 aa, Dengue virus
IFQTTMGEI

SEQ ID NO: 62566 - protein, 9 aa, Dengue virus
TTAGEIGAI

SEQ ID NO: 62567 - protein, 9 aa, Dengue virus
TTGEIGAVA

SEQ ID NO: 62568 - protein, 9 aa, Dengue virus
PIRYQTSAT

SEQ ID NO: 62569 - protein, 9 aa, Dengue virus
IRYQTTVTK

SEQ ID NO: 62570 - protein, 9 aa, Dengue virus
RYQTSATKS

SEQ ID NO: 62571 - protein, 9 aa, Dengue virus
YQTTATRSE

SEQ ID NO: 62572 - protein, 9 aa, Dengue virus
QTTVTKSEH

SEQ ID NO: 62573 - protein, 9 aa, Dengue virus
TTVTKSEHT

SEQ ID NO: 62574 - protein, 9 aa, Dengue virus
SATKSEHTG

SEQ ID NO: 62575 - protein, 9 aa, Dengue virus
AIKSEHTGR

SEQ ID NO: 62576 - protein, 9 aa, Dengue virus
IKSEHTGRE

SEQ ID NO: 62577 - protein, 9 aa, Dengue virus
RVPNYNLIV

SEQ ID NO: 62578 - protein, 9 aa, Dengue virus
VPNYNLIVM

SEQ ID NO: 62579 - protein, 9 aa, Dengue virus
PNYNLIVMD

SEQ ID NO: 62580 - protein, 9 aa, Dengue virus
NYNLIVMDE

SEQ ID NO: 62581 - protein, 9 aa, Dengue virus
YNLIVMDEA

SEQ ID NO: 62582 - protein, 9 aa, Dengue virus
NLIVMDEAH

SEQ ID NO: 62583 - protein, 9 aa, Dengue virus
LIVMDEAHF

SEQ ID NO: 62584 - protein, 9 aa, Dengue virus
IVMDEAHFT

SEQ ID NO: 62585 - protein, 9 aa, Dengue virus
GNDWITDFA

SEQ ID NO: 62586 - protein, 9 aa, Dengue virus
NDWITDFAG

SEQ ID NO: 62587 - protein, 9 aa, Dengue virus
DWITDFAGK

SEQ ID NO: 62588 - protein, 9 aa, Dengue virus
WITDFTGKT

SEQ ID NO: 62589 - protein, 9 aa, Dengue virus
ITDFTGKTV

SEQ ID NO: 62590 - protein, 9 aa, Dengue virus
TDFTGKTVW

SEQ ID NO: 62591 - protein, 9 aa, Dengue virus
DFTGKTVWF

SEQ ID NO: 62592 - protein, 9 aa, Dengue virus
FTGKTVWFV

SEQ ID NO: 62593 - protein, 9 aa, Dengue virus
TGKTVWFVP

SEQ ID NO: 62594 - protein, 9 aa, Dengue virus
GRNSQKEND

SEQ ID NO: 62595 - protein, 9 aa, Dengue virus
RNSQKENDQ

SEQ ID NO: 62596 - protein, 9 aa, Dengue virus
NSQKENDQY

SEQ ID NO: 62597 - protein, 9 aa, Dengue virus
SQKENDQYI

SEQ ID NO: 62598 - protein, 9 aa, Dengue virus
GRVPSHLAY

SEQ ID NO: 62599 - protein, 9 aa, Dengue virus
RVPSHLAYR

SEQ ID NO: 62600 - protein, 9 aa, Dengue virus
VPSHLAYRT

SEQ ID NO: 62601 - protein, 9 aa, Dengue virus
PSHLAYRTR

SEQ ID NO: 62602 - protein, 9 aa, Dengue virus
SHLAYRTRN

SEQ ID NO: 62603 - protein, 9 aa, Dengue virus
HLAHRTRSA

SEQ ID NO: 62604 - protein, 9 aa, Dengue virus
LPHRTRNAL

SEQ ID NO: 62605 - protein, 9 aa, Dengue virus
AHKTRNALD

SEQ ID NO: 62606 - protein, 9 aa, Dengue virus
TGGAMLFLV

SEQ ID NO: 62607 - protein, 9 aa, Dengue virus
GGAMLFLVS

SEQ ID NO: 62608 - protein, 9 aa, Dengue virus
AMLFLISGR

SEQ ID NO: 62609 - protein, 9 aa, Dengue virus
LFLISGRGI

SEQ ID NO: 62610 - protein, 9 aa, Dengue virus
FLISGRGIG

SEQ ID NO: 62611 - protein, 9 aa, Dengue virus
LISGRGIGK

SEQ ID NO: 62612 - protein, 9 aa, Dengue virus
VSGKGIGKT

SEQ ID NO: 62613 - protein, 9 aa, Dengue virus
SGKGIGKTT

SEQ ID NO: 62614 - protein, 9 aa, Dengue virus
GKGIGKTTI

SEQ ID NO: 62615 - protein, 9 aa, Dengue virus
KGIGKTTIG

SEQ ID NO: 62616 - protein, 9 aa, Dengue virus
GIGKTTIGL

SEQ ID NO: 62617 - protein, 9 aa, Dengue virus
IGKTTIGLI

SEQ ID NO: 62618 - protein, 9 aa, Dengue virus
GKASIGLIC

SEQ ID NO: 62619 - protein, 9 aa, Dengue virus
KASIGLICV

SEQ ID NO: 62620 - protein, 9 aa, Dengue virus
TTIGLICVI

SEQ ID NO: 62621 - protein, 9 aa, Dengue virus
SIGLICVVA

SEQ ID NO: 62622 - protein, 9 aa, Dengue virus
IGLICVVAS

SEQ ID NO: 62623 - protein, 9 aa, Dengue virus
GLICVVASS

SEQ ID NO: 62624 - protein, 9 aa, Dengue virus
LICVVASSG

SEQ ID NO: 62625 - protein, 9 aa, Dengue virus
ICVVASSGM

SEQ ID NO: 62626 - protein, 9 aa, Dengue virus
CVVASSGML

SEQ ID NO: 62627 - protein, 9 aa, Dengue virus
VVASSGMLW

SEQ ID NO: 62628 - protein, 9 aa, Dengue virus
VASSGMLWM

SEQ ID NO: 62629 - protein, 9 aa, Dengue virus
SSGMLWIAE

SEQ ID NO: 62630 - protein, 9 aa, Dengue virus
SGMLWMAEV

SEQ ID NO: 62631 - protein, 9 aa, Dengue virus
GMLWMAEVP

SEQ ID NO: 62632 - protein, 9 aa, Dengue virus
MLWMAEVPL

SEQ ID NO: 62633 - protein, 9 aa, Dengue virus
LWMAEVPLQ

SEQ ID NO: 62634 - protein, 9 aa, Dengue virus
WMAEVPLQW

SEQ ID NO: 62635 - protein, 9 aa, Dengue virus
MAEVPLQWI

SEQ ID NO: 62636 - protein, 9 aa, Dengue virus
AEVPLQWIA

SEQ ID NO: 62637 - protein, 9 aa, Dengue virus
EVPLQWIAS

SEQ ID NO: 62638 - protein, 9 aa, Dengue virus
GILTLAATI

SEQ ID NO: 62639 - protein, 9 aa, Dengue virus
ILTLAAIVT

SEQ ID NO: 62640 - protein, 9 aa, Dengue virus
LTLAAIVTA

SEQ ID NO: 62641 - protein, 9 aa, Dengue virus
TLAAIVTAN

SEQ ID NO: 62642 - protein, 9 aa, Dengue virus
LAAIVTANE

SEQ ID NO: 62643 - protein, 9 aa, Dengue virus
AAIVTANEM

SEQ ID NO: 62644 - protein, 9 aa, Dengue virus
AIVTANEMG

SEQ ID NO: 62645 - protein, 9 aa, Dengue virus
IVTANEMGL

SEQ ID NO: 62646 - protein, 9 aa, Dengue virus
VTANEMGLL

SEQ ID NO: 62647 - protein, 9 aa, Dengue virus
GMSREPGVV

SEQ ID NO: 62648 - protein, 9 aa, Dengue virus
MSREPGVVS

SEQ ID NO: 62649 - protein, 9 aa, Dengue virus
SKEPGVVSS

SEQ ID NO: 62650 - protein, 9 aa, Dengue virus
EPGVVSSTS

SEQ ID NO: 62651 - protein, 9 aa, Dengue virus
PGVVSSTSY

SEQ ID NO: 62652 - protein, 9 aa, Dengue virus
GVVSSTSYL

SEQ ID NO: 62653 - protein, 9 aa, Dengue virus
VVSSTSYLD

SEQ ID NO: 62654 - protein, 9 aa, Dengue virus
VSSTSYLDV

SEQ ID NO: 62655 - protein, 9 aa, Dengue virus
SPNSYLDVD

SEQ ID NO: 62656 - protein, 9 aa, Dengue virus
PNSYLDVDL

SEQ ID NO: 62657 - protein, 9 aa, Dengue virus
VNPLTLIAA

SEQ ID NO: 62658 - protein, 9 aa, Dengue virus
NPLTLIAAV

SEQ ID NO: 62659 - protein, 9 aa, Dengue virus
PLTLIAAVL

SEQ ID NO: 62660 - protein, 9 aa, Dengue virus
LTLIAAVLL

SEQ ID NO: 62661 - protein, 9 aa, Dengue virus
TLIAAVLLL

SEQ ID NO: 62662 - protein, 9 aa, Dengue virus
LTAVVLLLV

SEQ ID NO: 62663 - protein, 9 aa, Dengue virus
TAVVLLLVT

SEQ ID NO: 62664 - protein, 9 aa, Dengue virus
AVVLLLVTH

SEQ ID NO: 62665 - protein, 9 aa, Dengue virus
VVLLLVTHY

SEQ ID NO: 62666 - protein, 9 aa, Dengue virus
VMLLVLCVV

SEQ ID NO: 62667 - protein, 9 aa, Dengue virus
MLLILCAVQ

SEQ ID NO: 62668 - protein, 9 aa, Dengue virus
LLVLCVVQL

SEQ ID NO: 62669 - protein, 9 aa, Dengue virus
LVLCVVQLL

SEQ ID NO: 62670 - protein, 9 aa, Dengue virus
ILCAVQLLL

SEQ ID NO: 62671 - protein, 9 aa, Dengue virus
RTSWALCEV

SEQ ID NO: 62672 - protein, 9 aa, Dengue virus
TSWALCEVL

SEQ ID NO: 62673 - protein, 9 aa, Dengue virus
SWALCEVLT

SEQ ID NO: 62674 - protein, 9 aa, Dengue virus
WALCEVLTL

SEQ ID NO: 62675 - protein, 9 aa, Dengue virus
ALCEVLTLA

SEQ ID NO: 62676 - protein, 9 aa, Dengue virus
LCEVLTLAT

SEQ ID NO: 62677 - protein, 9 aa, Dengue virus
VMKSVGTGK

SEQ ID NO: 62678 - protein, 9 aa, Dengue virus
GTGKRGTGL

SEQ ID NO: 62679 - protein, 9 aa, Dengue virus
TGKRGTGLQ

SEQ ID NO: 62680 - protein, 9 aa, Dengue virus
TLGEKWKRK

SEQ ID NO: 62681 - protein, 9 aa, Dengue virus
LGEKWKRKL

SEQ ID NO: 62682 - protein, 9 aa, Dengue virus
GEKWKRKLN

SEQ ID NO: 62683 - protein, 9 aa, Dengue virus
EKWKRKLNQ

SEQ ID NO: 62684 - protein, 9 aa, Dengue virus
KWKRKLNQL

SEQ ID NO: 62685 - protein, 9 aa, Dengue virus
WKRKLNQLS

SEQ ID NO: 62686 - protein, 9 aa, Dengue virus
KRKLNQLSR

SEQ ID NO: 62687 - protein, 9 aa, Dengue virus
RKLNQLSRK

SEQ ID NO: 62688 - protein, 9 aa, Dengue virus
RLNQLSRKE

SEQ ID NO: 62689 - protein, 9 aa, Dengue virus
LNQLSRREF

SEQ ID NO: 62690 - protein, 9 aa, Dengue virus
NQLSWKEFD

SEQ ID NO: 62691 - protein, 9 aa, Dengue virus
QLSWKEFDL

SEQ ID NO: 62692 - protein, 9 aa, Dengue virus
LSWKEFDLY

SEQ ID NO: 62693 - protein, 9 aa, Dengue virus
SRREFDLYK

SEQ ID NO: 62694 - protein, 9 aa, Dengue virus
WKEFDLYKK

SEQ ID NO: 62695 - protein, 9 aa, Dengue virus
SGITEVDRS

SEQ ID NO: 62696 - protein, 9 aa, Dengue virus
GITEVDRSE

SEQ ID NO: 62697 - protein, 9 aa, Dengue virus
ITEVDRSEA

SEQ ID NO: 62698 - protein, 9 aa, Dengue virus
TEVDRSEAK

SEQ ID NO: 62699 - protein, 9 aa, Dengue virus
EVDRSEAKE

SEQ ID NO: 62700 - protein, 9 aa, Dengue virus
VDRSEAKEG

SEQ ID NO: 62701 - protein, 9 aa, Dengue virus
DRSEAKEGL

SEQ ID NO: 62702 - protein, 9 aa, Dengue virus
RSEAKEGLK

SEQ ID NO: 62703 - protein, 9 aa, Dengue virus
SEAKEGLKR

SEQ ID NO: 62704 - protein, 9 aa, Dengue virus
EAKEGLKKG

SEQ ID NO: 62705 - protein, 9 aa, Dengue virus
KEGLKKGEI

SEQ ID NO: 62706 - protein, 9 aa, Dengue virus
EGLKKGEIT

SEQ ID NO: 62707 - protein, 9 aa, Dengue virus
KGEITHHAV

SEQ ID NO: 62708 - protein, 9 aa, Dengue virus
GEITRHAVS

SEQ ID NO: 62709 - protein, 9 aa, Dengue virus
EVTHHAVSR

SEQ ID NO: 62710 - protein, 9 aa, Dengue virus
VTHHAVSRG

SEQ ID NO: 62711 - protein, 9 aa, Dengue virus
MSTYGWNII

SEQ ID NO: 62712 - protein, 9 aa, Dengue virus
STYGWNIIK

SEQ ID NO: 62713 - protein, 9 aa, Dengue virus
YGWNIIKLM

SEQ ID NO: 62714 - protein, 9 aa, Dengue virus
GWNIIKLMS

SEQ ID NO: 62715 - protein, 9 aa, Dengue virus
WNIVKLMTG

SEQ ID NO: 62716 - protein, 9 aa, Dengue virus
NIVKLMTGK

SEQ ID NO: 62717 - protein, 9 aa, Dengue virus
IVKLMTGKD

SEQ ID NO: 62718 - protein, 9 aa, Dengue virus
IKLMSGKDV

SEQ ID NO: 62719 - protein, 9 aa, Dengue virus
KMVEPWLRS

SEQ ID NO: 62720 - protein, 9 aa, Dengue virus
KNNQFCIKI

SEQ ID NO: 62721 - protein, 9 aa, Dengue virus
KILNPYMPT

SEQ ID NO: 62722 - protein, 9 aa, Dengue virus
ILNPYMPTV

SEQ ID NO: 62723 - protein, 9 aa, Dengue virus
LNPYMPTVV

SEQ ID NO: 62724 - protein, 9 aa, Dengue virus
NPYMPTVVE

SEQ ID NO: 62725 - protein, 9 aa, Dengue virus
PYMPTVVEH

SEQ ID NO: 62726 - protein, 9 aa, Dengue virus
YMPTVVEHL

SEQ ID NO: 62727 - protein, 9 aa, Dengue virus
MPTVVEHLE

SEQ ID NO: 62728 - protein, 9 aa, Dengue virus
PTVVEHLER

SEQ ID NO: 62729 - protein, 9 aa, Dengue virus
TVVEHLERL

SEQ ID NO: 62730 - protein, 9 aa, Dengue virus
NRFTMTYRK

SEQ ID NO: 62731 - protein, 9 aa, Dengue virus
RFTMTYRKP

SEQ ID NO: 62732 - protein, 9 aa, Dengue virus
FTMTYRKPT

SEQ ID NO: 62733 - protein, 9 aa, Dengue virus
TMTYRKPTI

SEQ ID NO: 62734 - protein, 9 aa, Dengue virus
MTYRKPTIE

SEQ ID NO: 62735 - protein, 9 aa, Dengue virus
TYRKPTIEK

SEQ ID NO: 62736 - protein, 9 aa, Dengue virus
YRKPTIEKD

SEQ ID NO: 62737 - protein, 9 aa, Dengue virus
RRPTIERDV

SEQ ID NO: 62738 - protein, 9 aa, Dengue virus
RPTIERDVD

SEQ ID NO: 62739 - protein, 9 aa, Dengue virus
DVIGERIER

SEQ ID NO: 62740 - protein, 9 aa, Dengue virus
VIGERIKRV

SEQ ID NO: 62741 - protein, 9 aa, Dengue virus
GERIKRIKG

SEQ ID NO: 62742 - protein, 9 aa, Dengue virus
ERIKRIKGE

SEQ ID NO: 62743 - protein, 9 aa, Dengue virus
RIKRIKGEH

SEQ ID NO: 62744 - protein, 9 aa, Dengue virus
RIKGEHSKT

SEQ ID NO: 62745 - protein, 9 aa, Dengue virus
IKGEHSKTW

SEQ ID NO: 62746 - protein, 9 aa, Dengue virus
KGEHSKTWH

SEQ ID NO: 62747 - protein, 9 aa, Dengue virus
GEHSKTWHY

SEQ ID NO: 62748 - protein, 9 aa, Dengue virus
EHSKTWHYD

SEQ ID NO: 62749 - protein, 9 aa, Dengue virus
HSKTWHYDD

SEQ ID NO: 62750 - protein, 9 aa, Dengue virus
SKTWHYDDE

SEQ ID NO: 62751 - protein, 9 aa, Dengue virus
PWDVVPMVI

SEQ ID NO: 62752 - protein, 9 aa, Dengue virus
WDVVPMVIQ

SEQ ID NO: 62753 - protein, 9 aa, Dengue virus
DVVPMVIQM

SEQ ID NO: 62754 - protein, 9 aa, Dengue virus
VVPMVIQMA

SEQ ID NO: 62755 - protein, 9 aa, Dengue virus
VPMVIQMAM

SEQ ID NO: 62756 - protein, 9 aa, Dengue virus
PMVIQMAMT

SEQ ID NO: 62757 - protein, 9 aa, Dengue virus
MVIQMAMTD

SEQ ID NO: 62758 - protein, 9 aa, Dengue virus
KVDTRTPKP

SEQ ID NO: 62759 - protein, 9 aa, Dengue virus
VDTRTPKPM

SEQ ID NO: 62760 - protein, 9 aa, Dengue virus
DTRTPKPMP

SEQ ID NO: 62761 - protein, 9 aa, Dengue virus
TRTPKPMPG

SEQ ID NO: 62762 - protein, 9 aa, Dengue virus
RTPKPMPGT

SEQ ID NO: 62763 - protein, 9 aa, Dengue virus
TPKPMPGTR

SEQ ID NO: 62764 - protein, 9 aa, Dengue virus
GTRRVMEIT

SEQ ID NO: 62765 - protein, 9 aa, Dengue virus
AMGITAEWL

SEQ ID NO: 62766 - protein, 9 aa, Dengue virus
EITAGWLWR

SEQ ID NO: 62767 - protein, 9 aa, Dengue virus
TRKVRTNAA

SEQ ID NO: 62768 - protein, 9 aa, Dengue virus
AKAAVEDEE

SEQ ID NO: 62769 - protein, 9 aa, Dengue virus
KAAVEDEEF

SEQ ID NO: 62770 - protein, 9 aa, Dengue virus
AVEDEDFWI

SEQ ID NO: 62771 - protein, 9 aa, Dengue virus
VEDEDFWIL

SEQ ID NO: 62772 - protein, 9 aa, Dengue virus
EDEDFWILV

SEQ ID NO: 62773 - protein, 9 aa, Dengue virus
DEDFWILVD

SEQ ID NO: 62774 - protein, 9 aa, Dengue virus
EEFWKLVDK

SEQ ID NO: 62775 - protein, 9 aa, Dengue virus
EFWKLVDKE

SEQ ID NO: 62776 - protein, 9 aa, Dengue virus
FWILVDRER

SEQ ID NO: 62777 - protein, 9 aa, Dengue virus
WILVDRERE

SEQ ID NO: 62778 - protein, 9 aa, Dengue virus
ILVDREREL

SEQ ID NO: 62779 - protein, 9 aa, Dengue virus
DRERELHKQ

SEQ ID NO: 62780 - protein, 9 aa, Dengue virus
RERELHKQG

SEQ ID NO: 62781 - protein, 9 aa, Dengue virus
DLHNEEKIM

SEQ ID NO: 62782 - protein, 9 aa, Dengue virus
LHNEEKIMQ

SEQ ID NO: 62783 - protein, 9 aa, Dengue virus
HNEEKIMQQ

SEQ ID NO: 62784 - protein, 9 aa, Dengue virus
NEEKIMQQM

SEQ ID NO: 62785 - protein, 9 aa, Dengue virus
EEKIMQQMD

SEQ ID NO: 62786 - protein, 9 aa, Dengue virus
EKIMQQMDP

SEQ ID NO: 62787 - protein, 9 aa, Dengue virus
KIMQQMDPE

SEQ ID NO: 62788 - protein, 9 aa, Dengue virus
IMQQMDPEH

SEQ ID NO: 62789 - protein, 9 aa, Dengue virus
MQQMDPEHR

SEQ ID NO: 62790 - protein, 9 aa, Dengue virus
QMDPEHRRL

SEQ ID NO: 62791 - protein, 9 aa, Dengue virus
MDPEHKQLA

SEQ ID NO: 62792 - protein, 9 aa, Dengue virus
PEHRLLANA

SEQ ID NO: 62793 - protein, 9 aa, Dengue virus
EHRLLANAI

SEQ ID NO: 62794 - protein, 9 aa, Dengue virus
HRLLANAIF

SEQ ID NO: 62795 - protein, 9 aa, Dengue virus
RLLANAIFK

SEQ ID NO: 62796 - protein, 9 aa, Dengue virus
LLANAIFKL

SEQ ID NO: 62797 - protein, 9 aa, Dengue virus
FTNMEVQLI

SEQ ID NO: 62798 - protein, 9 aa, Dengue virus
TNMEVQLIR

SEQ ID NO: 62799 - protein, 9 aa, Dengue virus
NMEVQLIRQ

SEQ ID NO: 62800 - protein, 9 aa, Dengue virus
MEVQLIRQM

SEQ ID NO: 62801 - protein, 9 aa, Dengue virus
EVQLIRQME

SEQ ID NO: 62802 - protein, 9 aa, Dengue virus
VQLIRQMEG

SEQ ID NO: 62803 - protein, 9 aa, Dengue virus
MEGEGVLSE

SEQ ID NO: 62804 - protein, 9 aa, Dengue virus
EGEGVLSKT

SEQ ID NO: 62805 - protein, 9 aa, Dengue virus
EKKIIQWLE

SEQ ID NO: 62806 - protein, 9 aa, Dengue virus
TQWLENKGV

SEQ ID NO: 62807 - protein, 9 aa, Dengue virus
QWLENKGVE

SEQ ID NO: 62808 - protein, 9 aa, Dengue virus
WLENKGVER

SEQ ID NO: 62809 - protein, 9 aa, Dengue virus
LENKGVERL

SEQ ID NO: 62810 - protein, 9 aa, Dengue virus
ETEGVERLK

SEQ ID NO: 62811 - protein, 9 aa, Dengue virus
TEGVERLKR

SEQ ID NO: 62812 - protein, 9 aa, Dengue virus
EGVERLKRM

SEQ ID NO: 62813 - protein, 9 aa, Dengue virus
GKAYAQMWT

SEQ ID NO: 62814 - protein, 9 aa, Dengue virus
KAYAQMWTL

SEQ ID NO: 62815 - protein, 9 aa, Dengue virus
AYAQMWTLM

SEQ ID NO: 62816 - protein, 9 aa, Dengue virus
YAQMWTLMY

SEQ ID NO: 62817 - protein, 9 aa, Dengue virus
AQMWTLMYF

SEQ ID NO: 62818 - protein, 9 aa, Dengue virus
QMWTLMYFH

SEQ ID NO: 62819 - protein, 9 aa, Dengue virus
MWTLMYFHR

SEQ ID NO: 62820 - protein, 9 aa, Dengue virus
WTLMYFHRR

SEQ ID NO: 62821 - protein, 9 aa, Dengue virus
TLMYFHRRD

SEQ ID NO: 62822 - protein, 9 aa, Dengue virus
CSAVPAHWV

SEQ ID NO: 62823 - protein, 9 aa, Dengue virus
SAVPAHWVP

SEQ ID NO: 62824 - protein, 9 aa, Dengue virus
AVPAHWVPT

SEQ ID NO: 62825 - protein, 9 aa, Dengue virus
VPAHWVPTS

SEQ ID NO: 62826 - protein, 9 aa, Dengue virus
PAHWVPTSR

SEQ ID NO: 62827 - protein, 9 aa, Dengue virus
AHWVPTSRT

SEQ ID NO: 62828 - protein, 9 aa, Dengue virus
WMTTEDMLS

SEQ ID NO: 62829 - protein, 9 aa, Dengue virus
MTTEDMLSV

SEQ ID NO: 62830 - protein, 9 aa, Dengue virus
TTEDMLSVW

SEQ ID NO: 62831 - protein, 9 aa, Dengue virus
TEDMLSVWN

SEQ ID NO: 62832 - protein, 9 aa, Dengue virus
EDMLSVWNR

SEQ ID NO: 62833 - protein, 9 aa, Dengue virus
DMLSVWNRV

SEQ ID NO: 62834 - protein, 9 aa, Dengue virus
MLSVWNRVW

SEQ ID NO: 62835 - protein, 9 aa, Dengue virus
LSVWNRVWI

SEQ ID NO: 62836 - protein, 9 aa, Dengue virus
SVWNRVWIE

SEQ ID NO: 62837 - protein, 9 aa, Dengue virus
WMENKTPVT

SEQ ID NO: 62838 - protein, 9 aa, Dengue virus
MGDKTPVTT

SEQ ID NO: 62839 - protein, 9 aa, Dengue virus
ENKTPVTTW

SEQ ID NO: 62840 - protein, 9 aa, Dengue virus
KTPITTWEN

SEQ ID NO: 62841 - protein, 9 aa, Dengue virus
TPITTWENV

SEQ ID NO: 62842 - protein, 9 aa, Dengue virus
PITTWENVP

SEQ ID NO: 62843 - protein, 9 aa, Dengue virus
ITTWENVPY

SEQ ID NO: 62844 - protein, 9 aa, Dengue virus
ATWAQNILI

SEQ ID NO: 62845 - protein, 9 aa, Dengue virus
TWAQNILIA

SEQ ID NO: 62846 - protein, 9 aa, Dengue virus
WAQNILIAI

SEQ ID NO: 62847 - protein, 9 aa, Dengue virus
AQNILIAIQ

SEQ ID NO: 62848 - protein, 9 aa, Dengue virus
QNILIAIQQ

SEQ ID NO: 62849 - protein, 9 aa, Dengue virus
NILIAIQQV

SEQ ID NO: 62850 - protein, 9 aa, Dengue virus
ILIAIQQVR

SEQ ID NO: 62851 - protein, 9 aa, Dengue virus
LIAIQQVRS

SEQ ID NO: 62852 - protein, 9 aa, Dengue virus
KRFRKEEET

SEQ ID NO: 62853 - protein, 9 aa, Dengue virus
RFRKEEETE

SEQ ID NO: 62854 - protein, 9 aa, Dengue virus
FRKEEETEG

SEQ ID NO: 62855 - protein, 9 aa, Dengue virus
RKEEETEGA

SEQ ID NO: 62856 - protein, 9 aa, Dengue virus
KEEETEGAI

SEQ ID NO: 62857 - protein, 9 aa, Dengue virus
EEETEGAIW

SEQ ID NO: 62858 - protein, 9 aa, Dengue virus
IKVLKSFKK

SEQ ID NO: 62859 - protein, 9 aa, Dengue virus
KVLKSFKKE

SEQ ID NO: 62860 - protein, 9 aa, Dengue virus
VLKSFKKEI

SEQ ID NO: 62861 - protein, 9 aa, Dengue virus
KSFKKEISN

SEQ ID NO: 62862 - protein, 9 aa, Dengue virus
NRRKKTSFC

SEQ ID NO: 62863 - protein, 9 aa, Dengue virus
RKRTSLCLM

SEQ ID NO: 62864 - protein, 9 aa, Dengue virus
KRTSLCLMM

SEQ ID NO: 62865 - protein, 9 aa, Dengue virus
MMFPATLAF

SEQ ID NO: 62866 - protein, 9 aa, Dengue virus
VLPAALAFH

SEQ ID NO: 62867 - protein, 9 aa, Dengue virus
DTITYKCPL

SEQ ID NO: 62868 - protein, 9 aa, Dengue virus
TITYKCPLI

SEQ ID NO: 62869 - protein, 9 aa, Dengue virus
TYKCPHIAE

SEQ ID NO: 62870 - protein, 9 aa, Dengue virus
AHYISTSLT

SEQ ID NO: 62871 - protein, 9 aa, Dengue virus
HYISTSLTQ

SEQ ID NO: 62872 - protein, 9 aa, Dengue virus
VGTSLTQKV

SEQ ID NO: 62873 - protein, 9 aa, Dengue virus
LIQKVVIFI

SEQ ID NO: 62874 - protein, 9 aa, Dengue virus
IQKVVIFIL

SEQ ID NO: 62875 - protein, 9 aa, Dengue virus
QKVVIFTLL

SEQ ID NO: 62876 - protein, 9 aa, Dengue virus
KVVIFTLLM

SEQ ID NO: 62877 - protein, 9 aa, Dengue virus
VVIFTLLML

SEQ ID NO: 62878 - protein, 9 aa, Dengue virus
RCPTQGEAA

SEQ ID NO: 62879 - protein, 9 aa, Dengue virus
CPTQGEAAL

SEQ ID NO: 62880 - protein, 9 aa, Dengue virus
PTQGEAALP

SEQ ID NO: 62881 - protein, 9 aa, Dengue virus
TQGEAALPE

SEQ ID NO: 62882 - protein, 9 aa, Dengue virus
QGEAALPEE

SEQ ID NO: 62883 - protein, 9 aa, Dengue virus
GEAALPEEQ

SEQ ID NO: 62884 - protein, 9 aa, Dengue virus
EAALPEEQD

SEQ ID NO: 62885 - protein, 9 aa, Dengue virus
AALPEEQDQ

SEQ ID NO: 62886 - protein, 9 aa, Dengue virus
ALPEEQDQN

SEQ ID NO: 62887 - protein, 9 aa, Dengue virus
AKFQCLEPV

SEQ ID NO: 62888 - protein, 9 aa, Dengue virus
KFQCLEPVE

SEQ ID NO: 62889 - protein, 9 aa, Dengue virus
FQCLEPVEG

SEQ ID NO: 62890 - protein, 9 aa, Dengue virus
QCLEPVEGK

SEQ ID NO: 62891 - protein, 9 aa, Dengue virus
EITPQASIT

SEQ ID NO: 62892 - protein, 9 aa, Dengue virus
ITSQASTAE

SEQ ID NO: 62893 - protein, 9 aa, Dengue virus
TPQASITEA

SEQ ID NO: 62894 - protein, 9 aa, Dengue virus
QASTAEAIL

SEQ ID NO: 62895 - protein, 9 aa, Dengue virus
AEAILPEYG

SEQ ID NO: 62896 - protein, 9 aa, Dengue virus
PLPWTSGVT

SEQ ID NO: 62897 - protein, 9 aa, Dengue virus
LPWTSGVTT

SEQ ID NO: 62898 - protein, 9 aa, Dengue virus
TETPIWNRK

SEQ ID NO: 62899 - protein, 9 aa, Dengue virus
IQNSGGTTI

SEQ ID NO: 62900 - protein, 9 aa, Dengue virus
NSGGTTIFA

SEQ ID NO: 62901 - protein, 9 aa, Dengue virus
MSYAMCLNA

SEQ ID NO: 62902 - protein, 9 aa, Dengue virus
SYAMCLNAF

SEQ ID NO: 62903 - protein, 9 aa, Dengue virus
YAMCLNAFV

SEQ ID NO: 62904 - protein, 9 aa, Dengue virus
AMCLNAFVL

SEQ ID NO: 62905 - protein, 9 aa, Dengue virus
NTFVLRKEV

SEQ ID NO: 62906 - protein, 9 aa, Dengue virus
LVKVEYKGE

SEQ ID NO: 62907 - protein, 9 aa, Dengue virus
VKVEYKGED

SEQ ID NO: 62908 - protein, 9 aa, Dengue virus
KVEYKGKDA

SEQ ID NO: 62909 - protein, 9 aa, Dengue virus
VEYKGKDAP

SEQ ID NO: 62910 - protein, 9 aa, Dengue virus
EYKGKDAPC

SEQ ID NO: 62911 - protein, 9 aa, Dengue virus
YKGKDAPCK

SEQ ID NO: 62912 - protein, 9 aa, Dengue virus
KGEDVPCKV

SEQ ID NO: 62913 - protein, 9 aa, Dengue virus
GKDAPCKIP

SEQ ID NO: 62914 - protein, 9 aa, Dengue virus
KDAPCKIPF

SEQ ID NO: 62915 - protein, 9 aa, Dengue virus
EDGQGKVHN

SEQ ID NO: 62916 - protein, 9 aa, Dengue virus
DGQGKVHNG

SEQ ID NO: 62917 - protein, 9 aa, Dengue virus
GQGKVHNGR

SEQ ID NO: 62918 - protein, 9 aa, Dengue virus
ANPVVIKKE

SEQ ID NO: 62919 - protein, 9 aa, Dengue virus
NPVVIKKEE

SEQ ID NO: 62920 - protein, 9 aa, Dengue virus
PVVIKKEEP

SEQ ID NO: 62921 - protein, 9 aa, Dengue virus
VVTKKEEPI

SEQ ID NO: 62922 - protein, 9 aa, Dengue virus
VIKKEEPVN

SEQ ID NO: 62923 - protein, 9 aa, Dengue virus
IKKEEPVNI

SEQ ID NO: 62924 - protein, 9 aa, Dengue virus
GESNIIIGT

SEQ ID NO: 62925 - protein, 9 aa, Dengue virus
ESNIIIGTG

SEQ ID NO: 62926 - protein, 9 aa, Dengue virus
SNIIIGTGD

SEQ ID NO: 62927 - protein, 9 aa, Dengue virus
GDKALRINW

SEQ ID NO: 62928 - protein, 9 aa, Dengue virus
DSALKINWY

SEQ ID NO: 62929 - protein, 9 aa, Dengue virus
KALKINWYR

SEQ ID NO: 62930 - protein, 9 aa, Dengue virus
ALFGGVSWM

SEQ ID NO: 62931 - protein, 9 aa, Dengue virus
GGVSWMMKI

SEQ ID NO: 62932 - protein, 9 aa, Dengue virus
WMMKIGIGV

SEQ ID NO: 62933 - protein, 9 aa, Dengue virus
MMKIGIGVL

SEQ ID NO: 62934 - protein, 9 aa, Dengue virus
FSCITIGII

SEQ ID NO: 62935 - protein, 9 aa, Dengue virus
SCITIGIIT

SEQ ID NO: 62936 - protein, 9 aa, Dengue virus
CITIGIITL

SEQ ID NO: 62937 - protein, 9 aa, Dengue virus
ITIGIITLY

SEQ ID NO: 62938 - protein, 9 aa, Dengue virus
TIGIITLYL

SEQ ID NO: 62939 - protein, 9 aa, Dengue virus
GIITLYLGV

SEQ ID NO: 62940 - protein, 9 aa, Dengue virus
IITLYLGVV

SEQ ID NO: 62941 - protein, 9 aa, Dengue virus
LGVVVQADM

SEQ ID NO: 62942 - protein, 9 aa, Dengue virus
GVVVQADMG

SEQ ID NO: 62943 - protein, 9 aa, Dengue virus
VVVQADMGC

SEQ ID NO: 62944 - protein, 9 aa, Dengue virus
VQADMGCVV

SEQ ID NO: 62945 - protein, 9 aa, Dengue virus
QADMGCVVN

SEQ ID NO: 62946 - protein, 9 aa, Dengue virus
ADMGCVVNW

SEQ ID NO: 62947 - protein, 9 aa, Dengue virus
DMGCVVNWK

SEQ ID NO: 62948 - protein, 9 aa, Dengue virus
MGCVVNWKG

SEQ ID NO: 62949 - protein, 9 aa, Dengue virus
WENSIKLTV

SEQ ID NO: 62950 - protein, 9 aa, Dengue virus
KLTVVVGDV

SEQ ID NO: 62951 - protein, 9 aa, Dengue virus
LTIVVGDVI

SEQ ID NO: 62952 - protein, 9 aa, Dengue virus
TIVVGDVIG

SEQ ID NO: 62953 - protein, 9 aa, Dengue virus
KRILTPQPM

SEQ ID NO: 62954 - protein, 9 aa, Dengue virus
RILTPQPME

SEQ ID NO: 62955 - protein, 9 aa, Dengue virus
ILTPQPMEL

SEQ ID NO: 62956 - protein, 9 aa, Dengue virus
WKAWGKAKI

SEQ ID NO: 62957 - protein, 9 aa, Dengue virus
KTWGKAKVV

SEQ ID NO: 62958 - protein, 9 aa, Dengue virus
WGKAKVVTA

SEQ ID NO: 62959 - protein, 9 aa, Dengue virus
GKAKVVTAE

SEQ ID NO: 62960 - protein, 9 aa, Dengue virus
AENQNSSFI

SEQ ID NO: 62961 - protein, 9 aa, Dengue virus
EIQNFSFII

SEQ ID NO: 62962 - protein, 9 aa, Dengue virus
PNTPECPNT

SEQ ID NO: 62963 - protein, 9 aa, Dengue virus
PNTSRAWNV

SEQ ID NO: 62964 - protein, 9 aa, Dengue virus
NTSRAWNVW

SEQ ID NO: 62965 - protein, 9 aa, Dengue virus
IWLKLREAY

SEQ ID NO: 62966 - protein, 9 aa, Dengue virus
WLKLREMYS

SEQ ID NO: 62967 - protein, 9 aa, Dengue virus
LKLREMYSQ

SEQ ID NO: 62968 - protein, 9 aa, Dengue virus
SQLCDHRLM

SEQ ID NO: 62969 - protein, 9 aa, Dengue virus
GTTVVITED

SEQ ID NO: 62970 - protein, 9 aa, Dengue virus
TTVVITEDC

SEQ ID NO: 62971 - protein, 9 aa, Dengue virus
TVVITEDCG

SEQ ID NO: 62972 - protein, 9 aa, Dengue virus
VVITEDCGT

SEQ ID NO: 62973 - protein, 9 aa, Dengue virus
CGIRGPSLR

SEQ ID NO: 62974 - protein, 9 aa, Dengue virus
GTRGSSLRT

SEQ ID NO: 62975 - protein, 9 aa, Dengue virus
TRGPALRTT

SEQ ID NO: 62976 - protein, 9 aa, Dengue virus
YGMEIRPVS

SEQ ID NO: 62977 - protein, 9 aa, Dengue virus
GMEIRPVSE

SEQ ID NO: 62978 - protein, 9 aa, Dengue virus
MEIRPVSEK

SEQ ID NO: 62979 - protein, 9 aa, Dengue virus
EIRPVSEKE

SEQ ID NO: 62980 - protein, 9 aa, Dengue virus
IRPVSEKEE

SEQ ID NO: 62981 - protein, 9 aa, Dengue virus
RPVSEKEEN

SEQ ID NO: 62982 - protein, 9 aa, Dengue virus
PVSEKEENM

SEQ ID NO: 62983 - protein, 9 aa, Dengue virus
VSEKEENMV

SEQ ID NO: 62984 - protein, 9 aa, Dengue virus
LASAGSGKV

SEQ ID NO: 62985 - protein, 9 aa, Dengue virus
ASAGSGKVD

SEQ ID NO: 62986 - protein, 9 aa, Dengue virus
SAGSGKADN

SEQ ID NO: 62987 - protein, 9 aa, Dengue virus
AGSGKADNF

SEQ ID NO: 62988 - protein, 9 aa, Dengue virus
GSGKADNFT

SEQ ID NO: 62989 - protein, 9 aa, Dengue virus
SGKADNFTM

SEQ ID NO: 62990 - protein, 9 aa, Dengue virus
GKADNFTMG

SEQ ID NO: 62991 - protein, 9 aa, Dengue virus
MDNFTMGVL

SEQ ID NO: 62992 - protein, 9 aa, Dengue virus
GKKHMIAGI

SEQ ID NO: 62993 - protein, 9 aa, Dengue virus
FIFVLLLSG

SEQ ID NO: 62994 - protein, 9 aa, Dengue virus
AHTFIMIGS

SEQ ID NO: 62995 - protein, 9 aa, Dengue virus
HTLIMVGSN

SEQ ID NO: 62996 - protein, 9 aa, Dengue virus
LIMIGSNTS

SEQ ID NO: 62997 - protein, 9 aa, Dengue virus
MIGSNTSDR

SEQ ID NO: 62998 - protein, 9 aa, Dengue virus
IGSNTSDRM

SEQ ID NO: 62999 - protein, 9 aa, Dengue virus
TYQLWTALA

SEQ ID NO: 63000 - protein, 9 aa, Dengue virus
LWTALASLM

SEQ ID NO: 63001 - protein, 9 aa, Dengue virus
WTALASLMC

SEQ ID NO: 63002 - protein, 9 aa, Dengue virus
ALASLMCSN

SEQ ID NO: 63003 - protein, 9 aa, Dengue virus
LASLMCSNT

SEQ ID NO: 63004 - protein, 9 aa, Dengue virus
SLMCANTIF

SEQ ID NO: 63005 - protein, 9 aa, Dengue virus
LMCANTIFT

SEQ ID NO: 63006 - protein, 9 aa, Dengue virus
TCSNTILTL

SEQ ID NO: 63007 - protein, 9 aa, Dengue virus
LILAGVSIL

SEQ ID NO: 63008 - protein, 9 aa, Dengue virus
ILAGVSILP

SEQ ID NO: 63009 - protein, 9 aa, Dengue virus
VSLLPMCQS

SEQ ID NO: 63010 - protein, 9 aa, Dengue virus
RKTDWLPVA

SEQ ID NO: 63011 - protein, 9 aa, Dengue virus
KTDWLPVAV

SEQ ID NO: 63012 - protein, 9 aa, Dengue virus
TDWLPVAVA

SEQ ID NO: 63013 - protein, 9 aa, Dengue virus
PMTVAAMGA

SEQ ID NO: 63014 - protein, 9 aa, Dengue virus
VAAMGVQPL

SEQ ID NO: 63015 - protein, 9 aa, Dengue virus
AAMGVSPLP

SEQ ID NO: 63016 - protein, 9 aa, Dengue virus
AMGVQPLPL

SEQ ID NO: 63017 - protein, 9 aa, Dengue virus
MGVSPLPLF

SEQ ID NO: 63018 - protein, 9 aa, Dengue virus
GVQPLPLFI

SEQ ID NO: 63019 - protein, 9 aa, Dengue virus
VSPLPLFIF

SEQ ID NO: 63020 - protein, 9 aa, Dengue virus
PLPLFIFGL

SEQ ID NO: 63021 - protein, 9 aa, Dengue virus
LFIFGLKDT

SEQ ID NO: 63022 - protein, 9 aa, Dengue virus
LKDALKRRS

SEQ ID NO: 63023 - protein, 9 aa, Dengue virus
KDALKRRSW

SEQ ID NO: 63024 - protein, 9 aa, Dengue virus
DALKRRSWP

SEQ ID NO: 63025 - protein, 9 aa, Dengue virus
ALKRRSWPL

SEQ ID NO: 63026 - protein, 9 aa, Dengue virus
DLTVEKAAN

SEQ ID NO: 63027 - protein, 9 aa, Dengue virus
ANVTWEEEA

SEQ ID NO: 63028 - protein, 9 aa, Dengue virus
NVTWEEEAE

SEQ ID NO: 63029 - protein, 9 aa, Dengue virus
YGGGWRLST

SEQ ID NO: 63030 - protein, 9 aa, Dengue virus
GGGWRLSTQ

SEQ ID NO: 63031 - protein, 9 aa, Dengue virus
GGWRLSTQW

SEQ ID NO: 63032 - protein, 9 aa, Dengue virus
GWRLSTQWQ

SEQ ID NO: 63033 - protein, 9 aa, Dengue virus
WRLSTQWQK

SEQ ID NO: 63034 - protein, 9 aa, Dengue virus
RLSTQWQKG

SEQ ID NO: 63035 - protein, 9 aa, Dengue virus
LSAQWKKGE

SEQ ID NO: 63036 - protein, 9 aa, Dengue virus
SAQWKKGEE

SEQ ID NO: 63037 - protein, 9 aa, Dengue virus
KNFQTTPGI

SEQ ID NO: 63038 - protein, 9 aa, Dengue virus
NFQTTPGIF

SEQ ID NO: 63039 - protein, 9 aa, Dengue virus
FQTTPGIFQ

SEQ ID NO: 63040 - protein, 9 aa, Dengue virus
QTTPGIFQT

SEQ ID NO: 63041 - protein, 9 aa, Dengue virus
TTPGIFQTT

SEQ ID NO: 63042 - protein, 9 aa, Dengue virus
IRYQTSATK

SEQ ID NO: 63043 - protein, 9 aa, Dengue virus
YQTSATKSE

SEQ ID NO: 63044 - protein, 9 aa, Dengue virus
QTSATKSEH

SEQ ID NO: 63045 - protein, 9 aa, Dengue virus
TSATKSEHT

SEQ ID NO: 63046 - protein, 9 aa, Dengue virus
TVTKSEHTG

SEQ ID NO: 63047 - protein, 9 aa, Dengue virus
VTKSEHTGR

SEQ ID NO: 63048 - protein, 9 aa, Dengue virus
GNEWITDFT

SEQ ID NO: 63049 - protein, 9 aa, Dengue virus
NEWITDFTG

SEQ ID NO: 63050 - protein, 9 aa, Dengue virus
EWITDFTGK

SEQ ID NO: 63051 - protein, 9 aa, Dengue virus
SHLAYRTRS

SEQ ID NO: 63052 - protein, 9 aa, Dengue virus
LFLVSGKGI

SEQ ID NO: 63053 - protein, 9 aa, Dengue virus
FLVSGKGIG

SEQ ID NO: 63054 - protein, 9 aa, Dengue virus
LVSGKGIGK

SEQ ID NO: 63055 - protein, 9 aa, Dengue virus
ISGRGIGKA

SEQ ID NO: 63056 - protein, 9 aa, Dengue virus
SGRGIGKAS

SEQ ID NO: 63057 - protein, 9 aa, Dengue virus
GRGIGKASI

SEQ ID NO: 63058 - protein, 9 aa, Dengue virus
RGIGKASIG

SEQ ID NO: 63059 - protein, 9 aa, Dengue virus
GIGKASIGL

SEQ ID NO: 63060 - protein, 9 aa, Dengue virus
IGKASIGLI

SEQ ID NO: 63061 - protein, 9 aa, Dengue virus
ASIGLICVI

SEQ ID NO: 63062 - protein, 9 aa, Dengue virus
TIGLICVIV

SEQ ID NO: 63063 - protein, 9 aa, Dengue virus
CVTVSSGML

SEQ ID NO: 63064 - protein, 9 aa, Dengue virus
VTVSSGMLW

SEQ ID NO: 63065 - protein, 9 aa, Dengue virus
TVSSGMLWM

SEQ ID NO: 63066 - protein, 9 aa, Dengue virus
SGMLWMADI

SEQ ID NO: 63067 - protein, 9 aa, Dengue virus
GMLWMADIP

SEQ ID NO: 63068 - protein, 9 aa, Dengue virus
MLWMADIPL

SEQ ID NO: 63069 - protein, 9 aa, Dengue virus
LWMADIPLQ

SEQ ID NO: 63070 - protein, 9 aa, Dengue virus
WMADIPLQW

SEQ ID NO: 63071 - protein, 9 aa, Dengue virus
MADIPLQWI

SEQ ID NO: 63072 - protein, 9 aa, Dengue virus
ADIPLQWIA

SEQ ID NO: 63073 - protein, 9 aa, Dengue virus
DIPLQWIAS

SEQ ID NO: 63074 - protein, 9 aa, Dengue virus
ILTLAATIA

SEQ ID NO: 63075 - protein, 9 aa, Dengue virus
LTLAATIAA

SEQ ID NO: 63076 - protein, 9 aa, Dengue virus
TLAATIAAN

SEQ ID NO: 63077 - protein, 9 aa, Dengue virus
LAATIAANE

SEQ ID NO: 63078 - protein, 9 aa, Dengue virus
AATIAANEM

SEQ ID NO: 63079 - protein, 9 aa, Dengue virus
ATIAANEMG

SEQ ID NO: 63080 - protein, 9 aa, Dengue virus
TIAANEMGL

SEQ ID NO: 63081 - protein, 9 aa, Dengue virus
SREPGVVSP

SEQ ID NO: 63082 - protein, 9 aa, Dengue virus
EPGVVSPNS

SEQ ID NO: 63083 - protein, 9 aa, Dengue virus
PGVVSPNSY

SEQ ID NO: 63084 - protein, 9 aa, Dengue virus
GVVSPNSYL

SEQ ID NO: 63085 - protein, 9 aa, Dengue virus
VVSPNSYLD

SEQ ID NO: 63086 - protein, 9 aa, Dengue virus
VSPNSYLDV

SEQ ID NO: 63087 - protein, 9 aa, Dengue virus
LIAAVLLLV

SEQ ID NO: 63088 - protein, 9 aa, Dengue virus
IAAVLLLVT

SEQ ID NO: 63089 - protein, 9 aa, Dengue virus
KKKLNQLSW

SEQ ID NO: 63090 - protein, 9 aa, Dengue virus
KKLNQLSWK

SEQ ID NO: 63091 - protein, 9 aa, Dengue virus
KLNQLSRRE

SEQ ID NO: 63092 - protein, 9 aa, Dengue virus
LSRREFDLY

SEQ ID NO: 63093 - protein, 9 aa, Dengue virus
SWKEFDLYK

SEQ ID NO: 63094 - protein, 9 aa, Dengue virus
TEAKEGLRR

SEQ ID NO: 63095 - protein, 9 aa, Dengue virus
KEGLKRGEV

SEQ ID NO: 63096 - protein, 9 aa, Dengue virus
EGLKRRETT

SEQ ID NO: 63097 - protein, 9 aa, Dengue virus
RGEVTHHAV

SEQ ID NO: 63098 - protein, 9 aa, Dengue virus
RETTHHAVS

SEQ ID NO: 63099 - protein, 9 aa, Dengue virus
GWNIVKLMT

SEQ ID NO: 63100 - protein, 9 aa, Dengue virus
WNIIKLMSG

SEQ ID NO: 63101 - protein, 9 aa, Dengue virus
NIIKLMSGK

SEQ ID NO: 63102 - protein, 9 aa, Dengue virus
IIKLMSGKD

SEQ ID NO: 63103 - protein, 9 aa, Dengue virus
KVLNPYMPN

SEQ ID NO: 63104 - protein, 9 aa, Dengue virus
VLNPYMPNV

SEQ ID NO: 63105 - protein, 9 aa, Dengue virus
LNPYMPNVI

SEQ ID NO: 63106 - protein, 9 aa, Dengue virus
NPYMPNVIE

SEQ ID NO: 63107 - protein, 9 aa, Dengue virus
PYMPNVIEH

SEQ ID NO: 63108 - protein, 9 aa, Dengue virus
YMPNVIEHL

SEQ ID NO: 63109 - protein, 9 aa, Dengue virus
MPNVIEHLE

SEQ ID NO: 63110 - protein, 9 aa, Dengue virus
PNVIEHLER

SEQ ID NO: 63111 - protein, 9 aa, Dengue virus
NVIEHLERL

SEQ ID NO: 63112 - protein, 9 aa, Dengue virus
THRRPTIER

SEQ ID NO: 63113 - protein, 9 aa, Dengue virus
HRRPTIERD

SEQ ID NO: 63114 - protein, 9 aa, Dengue virus
GERLRRIKE

SEQ ID NO: 63115 - protein, 9 aa, Dengue virus
ERVKRIKEE

SEQ ID NO: 63116 - protein, 9 aa, Dengue virus
RIERIKEEH

SEQ ID NO: 63117 - protein, 9 aa, Dengue virus
RIKEEHDST

SEQ ID NO: 63118 - protein, 9 aa, Dengue virus
IKDEHNSTW

SEQ ID NO: 63119 - protein, 9 aa, Dengue virus
HSSTWHYDE

SEQ ID NO: 63120 - protein, 9 aa, Dengue virus
SSTWHYDEE

SEQ ID NO: 63121 - protein, 9 aa, Dengue virus
DTRTPRPMA

SEQ ID NO: 63122 - protein, 9 aa, Dengue virus
TRTPRPMAG

SEQ ID NO: 63123 - protein, 9 aa, Dengue virus
RTPRPMAGT

SEQ ID NO: 63124 - protein, 9 aa, Dengue virus
TPRPMAGTR

SEQ ID NO: 63125 - protein, 9 aa, Dengue virus
GTRKAMEIT

SEQ ID NO: 63126 - protein, 9 aa, Dengue virus
AMEITAEWL

SEQ ID NO: 63127 - protein, 9 aa, Dengue virus
AVEDENFWK

SEQ ID NO: 63128 - protein, 9 aa, Dengue virus
DENFWKLVD

SEQ ID NO: 63129 - protein, 9 aa, Dengue virus
EDFWILVDR

SEQ ID NO: 63130 - protein, 9 aa, Dengue virus
DFWILVDRE

SEQ ID NO: 63131 - protein, 9 aa, Dengue virus
KITQQMNPE

SEQ ID NO: 63132 - protein, 9 aa, Dengue virus
ITQQMNPEH

SEQ ID NO: 63133 - protein, 9 aa, Dengue virus
TQQMDPEHK

SEQ ID NO: 63134 - protein, 9 aa, Dengue virus
QMDPEHRLL

SEQ ID NO: 63135 - protein, 9 aa, Dengue virus
MDPEHRLLA

SEQ ID NO: 63136 - protein, 9 aa, Dengue virus
PEHRKLANA

SEQ ID NO: 63137 - protein, 9 aa, Dengue virus
EHRKLANAI

SEQ ID NO: 63138 - protein, 9 aa, Dengue virus
HKQLANAIF

SEQ ID NO: 63139 - protein, 9 aa, Dengue virus
KQLANAIFK

SEQ ID NO: 63140 - protein, 9 aa, Dengue virus
RLANAIFKL

SEQ ID NO: 63141 - protein, 9 aa, Dengue virus
EGEGVLSKV

SEQ ID NO: 63142 - protein, 9 aa, Dengue virus
EKKIAQWLE

SEQ ID NO: 63143 - protein, 9 aa, Dengue virus
AQWLETKGV

SEQ ID NO: 63144 - protein, 9 aa, Dengue virus
ENKGVERLK

SEQ ID NO: 63145 - protein, 9 aa, Dengue virus
NKGVERLKR

SEQ ID NO: 63146 - protein, 9 aa, Dengue virus
RMTTEDMLT

SEQ ID NO: 63147 - protein, 9 aa, Dengue virus
KTPITTWED

SEQ ID NO: 63148 - protein, 9 aa, Dengue virus
TPITTWEDV

SEQ ID NO: 63149 - protein, 9 aa, Dengue virus
PITTWEDVP

SEQ ID NO: 63150 - protein, 9 aa, Dengue virus
ITTWEDVPY

SEQ ID NO: 63151 - protein, 9 aa, Dengue virus
NRRKRTSLC

SEQ ID NO: 63152 - protein, 9 aa, Dengue virus
MVLPAALAF

SEQ ID NO: 63153 - protein, 9 aa, Dengue virus
MFPATLAFH

SEQ ID NO: 63154 - protein, 9 aa, Dengue virus
TYKCPFIAE

SEQ ID NO: 63155 - protein, 9 aa, Dengue virus
LTQKVVIFT

SEQ ID NO: 63156 - protein, 9 aa, Dengue virus
TQKVVIFTL

SEQ ID NO: 63157 - protein, 9 aa, Dengue virus
TSQASTAEA

SEQ ID NO: 63158 - protein, 9 aa, Dengue virus
QASITEAIL

SEQ ID NO: 63159 - protein, 9 aa, Dengue virus
TEVILPEYG

SEQ ID NO: 63160 - protein, 9 aa, Dengue virus
LPWTSGTTT

SEQ ID NO: 63161 - protein, 9 aa, Dengue virus
TKTPTWNRK

SEQ ID NO: 63162 - protein, 9 aa, Dengue virus
MSYAMCLGS

SEQ ID NO: 63163 - protein, 9 aa, Dengue virus
SYAMCLGSF

SEQ ID NO: 63164 - protein, 9 aa, Dengue virus
YAMCLGSFV

SEQ ID NO: 63165 - protein, 9 aa, Dengue virus
AMCLGSFVL

SEQ ID NO: 63166 - protein, 9 aa, Dengue virus
KGKDAPCKI

SEQ ID NO: 63167 - protein, 9 aa, Dengue virus
VVIKKEEPV

SEQ ID NO: 63168 - protein, 9 aa, Dengue virus
SNIVIGVGD

SEQ ID NO: 63169 - protein, 9 aa, Dengue virus
LTVVVGDVI

SEQ ID NO: 63170 - protein, 9 aa, Dengue virus
TVVVGDVIG

SEQ ID NO: 63171 - protein, 9 aa, Dengue virus
WKTWGKAKM

SEQ ID NO: 63172 - protein, 9 aa, Dengue virus
KTWGKAKMV

SEQ ID NO: 63173 - protein, 9 aa, Dengue virus
WGKAKMVTA

SEQ ID NO: 63174 - protein, 9 aa, Dengue virus
GKAKMVTAE

SEQ ID NO: 63175 - protein, 9 aa, Dengue virus
PSTPECPSA

SEQ ID NO: 63176 - protein, 9 aa, Dengue virus
PSALRAWNV

SEQ ID NO: 63177 - protein, 9 aa, Dengue virus
SAARAWNVW

SEQ ID NO: 63178 - protein, 9 aa, Dengue virus
WLKLRDVYT

SEQ ID NO: 63179 - protein, 9 aa, Dengue virus
LKLREAYTQ

SEQ ID NO: 63180 - protein, 9 aa, Dengue virus
GTTVVISEN

SEQ ID NO: 63181 - protein, 9 aa, Dengue virus
TTVVISENC

SEQ ID NO: 63182 - protein, 9 aa, Dengue virus
TVVISENCG

SEQ ID NO: 63183 - protein, 9 aa, Dengue virus
VVISENCGT

SEQ ID NO: 63184 - protein, 9 aa, Dengue virus
GTRGPSLRA

SEQ ID NO: 63185 - protein, 9 aa, Dengue virus
MRGPSLRTT

SEQ ID NO: 63186 - protein, 9 aa, Dengue virus
TSEKEENMV

SEQ ID NO: 63187 - protein, 9 aa, Dengue virus
LVSAGSGKA

SEQ ID NO: 63188 - protein, 9 aa, Dengue virus
VSAGSGKAD

SEQ ID NO: 63189 - protein, 9 aa, Dengue virus
VDNFTMGAL

SEQ ID NO: 63190 - protein, 9 aa, Dengue virus
LWAALVSLT

SEQ ID NO: 63191 - protein, 9 aa, Dengue virus
WAALVSLMC

SEQ ID NO: 63192 - protein, 9 aa, Dengue virus
ISLLPLCQS

SEQ ID NO: 63193 - protein, 9 aa, Dengue virus
VAAMGVSPL

SEQ ID NO: 63194 - protein, 9 aa, Dengue virus
AAMGVQPLP

SEQ ID NO: 63195 - protein, 9 aa, Dengue virus
AMGVSPLPL

SEQ ID NO: 63196 - protein, 9 aa, Dengue virus
MGVQPLPLF

SEQ ID NO: 63197 - protein, 9 aa, Dengue virus
GVSPLPLFI

SEQ ID NO: 63198 - protein, 9 aa, Dengue virus
VQPLPLFIF

SEQ ID NO: 63199 - protein, 9 aa, Dengue virus
LKDAPKRRS

SEQ ID NO: 63200 - protein, 9 aa, Dengue virus
KDAPKRRSW

SEQ ID NO: 63201 - protein, 9 aa, Dengue virus
DAPKRRSWP

SEQ ID NO: 63202 - protein, 9 aa, Dengue virus
APKRRSWPL

SEQ ID NO: 63203 - protein, 9 aa, Dengue virus
DLTVEKAAE

SEQ ID NO: 63204 - protein, 9 aa, Dengue virus
PDVTWEEEA

SEQ ID NO: 63205 - protein, 9 aa, Dengue virus
GWRLSAQWK

SEQ ID NO: 63206 - protein, 9 aa, Dengue virus
WRLSAQWKK

SEQ ID NO: 63207 - protein, 9 aa, Dengue virus
RLSAQWKKG

SEQ ID NO: 63208 - protein, 9 aa, Dengue virus
SHLAHRTKN

SEQ ID NO: 63209 - protein, 9 aa, Dengue virus
IASSGMLWI

SEQ ID NO: 63210 - protein, 9 aa, Dengue virus
SGMLWIAEI

SEQ ID NO: 63211 - protein, 9 aa, Dengue virus
GMLWIAEIP

SEQ ID NO: 63212 - protein, 9 aa, Dengue virus
MLWIAEIPL

SEQ ID NO: 63213 - protein, 9 aa, Dengue virus
IIAANEMGM

SEQ ID NO: 63214 - protein, 9 aa, Dengue virus
EPGVVPPTS

SEQ ID NO: 63215 - protein, 9 aa, Dengue virus
PGVVSPISY

SEQ ID NO: 63216 - protein, 9 aa, Dengue virus
GVVPPTSYL

SEQ ID NO: 63217 - protein, 9 aa, Dengue virus
VVPPTSYLD

SEQ ID NO: 63218 - protein, 9 aa, Dengue virus
LAAAVLLLV

SEQ ID NO: 63219 - protein, 9 aa, Dengue virus
AAAVLLLVT

SEQ ID NO: 63220 - protein, 9 aa, Dengue virus
KKLNQLSRR

SEQ ID NO: 63221 - protein, 9 aa, Dengue virus
KLNQLSWKE

SEQ ID NO: 63222 - protein, 9 aa, Dengue virus
RGEITRHAV

SEQ ID NO: 63223 - protein, 9 aa, Dengue virus
ERIKKIKEE

SEQ ID NO: 63224 - protein, 9 aa, Dengue virus
RIKRIKDEH

SEQ ID NO: 63225 - protein, 9 aa, Dengue virus
RIKEEHRST

SEQ ID NO: 63226 - protein, 9 aa, Dengue virus
GTRKVMGIT

SEQ ID NO: 63227 - protein, 9 aa, Dengue virus
ENFWKLVDR

SEQ ID NO: 63228 - protein, 9 aa, Dengue virus
NFWKLVDRE

SEQ ID NO: 63229 - protein, 9 aa, Dengue virus
THQMDPEHR

SEQ ID NO: 63230 - protein, 9 aa, Dengue virus
QMDPEHRKL

SEQ ID NO: 63231 - protein, 9 aa, Dengue virus
MDPEHRRLA

SEQ ID NO: 63232 - protein, 9 aa, Dengue virus
PEHKQLANA

SEQ ID NO: 63233 - protein, 9 aa, Dengue virus
EHRRLANAI

SEQ ID NO: 63234 - protein, 9 aa, Dengue virus
HRKLANAIF

SEQ ID NO: 63235 - protein, 9 aa, Dengue virus
RRLANAIFK

SEQ ID NO: 63236 - protein, 9 aa, Dengue virus
EGEGVLSEA

SEQ ID NO: 63237 - protein, 9 aa, Dengue virus
EKRITQWLE

SEQ ID NO: 63238 - protein, 9 aa, Dengue virus
IQWLETKGV

SEQ ID NO: 63239 - protein, 10 aa, Dengue virus
MNNQRKKTGK

SEQ ID NO: 63240 - protein, 10 aa, Dengue virus
NNQRKKTGKP

SEQ ID NO: 63241 - protein, 10 aa, Dengue virus
NQRKKTGKPS

SEQ ID NO: 63242 - protein, 10 aa, Dengue virus
QRKKTGKPSI

SEQ ID NO: 63243 - protein, 10 aa, Dengue virus
RKKTGKPSIN

SEQ ID NO: 63244 - protein, 10 aa, Dengue virus
KKTGKPSINM

SEQ ID NO: 63245 - protein, 10 aa, Dengue virus
KTGKPSINML

SEQ ID NO: 63246 - protein, 10 aa, Dengue virus
TGKPSINMLK

SEQ ID NO: 63247 - protein, 10 aa, Dengue virus
GKPSINMLKR

SEQ ID NO: 63248 - protein, 10 aa, Dengue virus
KPSINMLKRV

SEQ ID NO: 63249 - protein, 10 aa, Dengue virus
PSINMLKRVR

SEQ ID NO: 63250 - protein, 10 aa, Dengue virus
SINMLKRVRN

SEQ ID NO: 63251 - protein, 10 aa, Dengue virus
INMLKRVRNR

SEQ ID NO: 63252 - protein, 10 aa, Dengue virus
NMLKRVRNRV

SEQ ID NO: 63253 - protein, 10 aa, Dengue virus
MLKRVRNRVS

SEQ ID NO: 63254 - protein, 10 aa, Dengue virus
LKRVRNRVST

SEQ ID NO: 63255 - protein, 10 aa, Dengue virus
KRVRNRVSTG

SEQ ID NO: 63256 - protein, 10 aa, Dengue virus
RVRNRVSTGS

SEQ ID NO: 63257 - protein, 10 aa, Dengue virus
VRNRVSTGSQ

SEQ ID NO: 63258 - protein, 10 aa, Dengue virus
RNRVSTGSQL

SEQ ID NO: 63259 - protein, 10 aa, Dengue virus
NRVSTGSQLA

SEQ ID NO: 63260 - protein, 10 aa, Dengue virus
RVSTGSQLAK

SEQ ID NO: 63261 - protein, 10 aa, Dengue virus
VSTGSQLAKR

SEQ ID NO: 63262 - protein, 10 aa, Dengue virus
STGSQLAKRF

SEQ ID NO: 63263 - protein, 10 aa, Dengue virus
TGSQLAKRFS

SEQ ID NO: 63264 - protein, 10 aa, Dengue virus
GSQLAKRFSK

SEQ ID NO: 63265 - protein, 10 aa, Dengue virus
SQLAKRFSKG

SEQ ID NO: 63266 - protein, 10 aa, Dengue virus
QLAKRFSKGL

SEQ ID NO: 63267 - protein, 10 aa, Dengue virus
LAKRFSKGLL

SEQ ID NO: 63268 - protein, 10 aa, Dengue virus
AKRFSKGLLN

SEQ ID NO: 63269 - protein, 10 aa, Dengue virus
KRFSKGLLNG

SEQ ID NO: 63270 - protein, 10 aa, Dengue virus
RFSKGLLNGQ

SEQ ID NO: 63271 - protein, 10 aa, Dengue virus
FSKGLLNGQG

SEQ ID NO: 63272 - protein, 10 aa, Dengue virus
SKGLLNGQGP

SEQ ID NO: 63273 - protein, 10 aa, Dengue virus
KGLLNGQGPM

SEQ ID NO: 63274 - protein, 10 aa, Dengue virus
GLLNGQGPMK

SEQ ID NO: 63275 - protein, 10 aa, Dengue virus
LLNGQGPMKL

SEQ ID NO: 63276 - protein, 10 aa, Dengue virus
LNGQGPMKLV

SEQ ID NO: 63277 - protein, 10 aa, Dengue virus
NGQGPMKLVM

SEQ ID NO: 63278 - protein, 10 aa, Dengue virus
GQGPMKLVMA

SEQ ID NO: 63279 - protein, 10 aa, Dengue virus
QGPMKLVMAF

SEQ ID NO: 63280 - protein, 10 aa, Dengue virus
GPMKLVMAFI

SEQ ID NO: 63281 - protein, 10 aa, Dengue virus
PMKLVMAFIA

SEQ ID NO: 63282 - protein, 10 aa, Dengue virus
MKLVMAFIAF

SEQ ID NO: 63283 - protein, 10 aa, Dengue virus
KLVMAFIAFL

SEQ ID NO: 63284 - protein, 10 aa, Dengue virus
LVMAFIAFLR

SEQ ID NO: 63285 - protein, 10 aa, Dengue virus
VMAFIAFLRF

SEQ ID NO: 63286 - protein, 10 aa, Dengue virus
MAFIAFLRFL

SEQ ID NO: 63287 - protein, 10 aa, Dengue virus
AFIAFLRFLA

SEQ ID NO: 63288 - protein, 10 aa, Dengue virus
FIAFLRFLAI

SEQ ID NO: 63289 - protein, 10 aa, Dengue virus
IAFLRFLAIP

SEQ ID NO: 63290 - protein, 10 aa, Dengue virus
AFLRFLAIPP

SEQ ID NO: 63291 - protein, 10 aa, Dengue virus
FLRFLAIPPT

SEQ ID NO: 63292 - protein, 10 aa, Dengue virus
LRFLAIPPTA

SEQ ID NO: 63293 - protein, 10 aa, Dengue virus
RFLAIPPTAG

SEQ ID NO: 63294 - protein, 10 aa, Dengue virus
FLAIPPTAGV

SEQ ID NO: 63295 - protein, 10 aa, Dengue virus
LAIPPTAGVL

SEQ ID NO: 63296 - protein, 10 aa, Dengue virus
AIPPTAGVLA

SEQ ID NO: 63297 - protein, 10 aa, Dengue virus
IPPTAGVLAR

SEQ ID NO: 63298 - protein, 10 aa, Dengue virus
PPTAGVLARW

SEQ ID NO: 63299 - protein, 10 aa, Dengue virus
PTAGVLARWG

SEQ ID NO: 63300 - protein, 10 aa, Dengue virus
TAGVLARWGT

SEQ ID NO: 63301 - protein, 10 aa, Dengue virus
AGVLARWGTF

SEQ ID NO: 63302 - protein, 10 aa, Dengue virus
GVLARWGTFK

SEQ ID NO: 63303 - protein, 10 aa, Dengue virus
VLARWGTFKK

SEQ ID NO: 63304 - protein, 10 aa, Dengue virus
LARWGTFKKS

SEQ ID NO: 63305 - protein, 10 aa, Dengue virus
ARWGTFKKSG

SEQ ID NO: 63306 - protein, 10 aa, Dengue virus
RWGTFKKSGA

SEQ ID NO: 63307 - protein, 10 aa, Dengue virus
WGTFKKSGAI

SEQ ID NO: 63308 - protein, 10 aa, Dengue virus
GTFKKSGAIK

SEQ ID NO: 63309 - protein, 10 aa, Dengue virus
TFKKSGAIKV

SEQ ID NO: 63310 - protein, 10 aa, Dengue virus
FKKSGAIKVL

SEQ ID NO: 63311 - protein, 10 aa, Dengue virus
KKSGAIKVLK

SEQ ID NO: 63312 - protein, 10 aa, Dengue virus
KSGAIKVLKG

SEQ ID NO: 63313 - protein, 10 aa, Dengue virus
SGAIKVLKGF

SEQ ID NO: 63314 - protein, 10 aa, Dengue virus
GAIKVLKGFK

SEQ ID NO: 63315 - protein, 10 aa, Dengue virus
AIKVLKGFKK

SEQ ID NO: 63316 - protein, 10 aa, Dengue virus
IKVLKGFKKE

SEQ ID NO: 63317 - protein, 10 aa, Dengue virus
KVLKGFKKEI

SEQ ID NO: 63318 - protein, 10 aa, Dengue virus
VLKGFKKEIS

SEQ ID NO: 63319 - protein, 10 aa, Dengue virus
LKGFKKEISN

SEQ ID NO: 63320 - protein, 10 aa, Dengue virus
KGFKKEISNM

SEQ ID NO: 63321 - protein, 10 aa, Dengue virus
GFKKEISNML

SEQ ID NO: 63322 - protein, 10 aa, Dengue virus
FKKEISNMLS

SEQ ID NO: 63323 - protein, 10 aa, Dengue virus
KKEISNMLSI

SEQ ID NO: 63324 - protein, 10 aa, Dengue virus
KEISNMLSII

SEQ ID NO: 63325 - protein, 10 aa, Dengue virus
EISNMLSIIN

SEQ ID NO: 63326 - protein, 10 aa, Dengue virus
ISNMLSIINK

SEQ ID NO: 63327 - protein, 10 aa, Dengue virus
SNMLSIINKR

SEQ ID NO: 63328 - protein, 10 aa, Dengue virus
NMLSIINKRK

SEQ ID NO: 63329 - protein, 10 aa, Dengue virus
MLSIINKRKK

SEQ ID NO: 63330 - protein, 10 aa, Dengue virus
LSIINKRKKT

SEQ ID NO: 63331 - protein, 10 aa, Dengue virus
SIINKRKKTS

SEQ ID NO: 63332 - protein, 10 aa, Dengue virus
RKKTSLCLMM

SEQ ID NO: 63333 - protein, 10 aa, Dengue virus
MILPAALAFH

SEQ ID NO: 63334 - protein, 10 aa, Dengue virus
ILPAALAFHL

SEQ ID NO: 63335 - protein, 10 aa, Dengue virus
LPAALAFHLT

SEQ ID NO: 63336 - protein, 10 aa, Dengue virus
PAALAFHLTS

SEQ ID NO: 63337 - protein, 10 aa, Dengue virus
AALAFHLTSR

SEQ ID NO: 63338 - protein, 10 aa, Dengue virus
ALAFHLTSRD

SEQ ID NO: 63339 - protein, 10 aa, Dengue virus
LAFHLTSRDG

SEQ ID NO: 63340 - protein, 10 aa, Dengue virus
AFHLTSRDGE

SEQ ID NO: 63341 - protein, 10 aa, Dengue virus
FHLTSRDGEP

SEQ ID NO: 63342 - protein, 10 aa, Dengue virus
HLTSRDGEPR

SEQ ID NO: 63343 - protein, 10 aa, Dengue virus
LTSRDGEPRM

SEQ ID NO: 63344 - protein, 10 aa, Dengue virus
TSRDGEPRMI

SEQ ID NO: 63345 - protein, 10 aa, Dengue virus
SRDGEPRMIV

SEQ ID NO: 63346 - protein, 10 aa, Dengue virus
RDGEPRMIVG

SEQ ID NO: 63347 - protein, 10 aa, Dengue virus
DGEPRMIVGK

SEQ ID NO: 63348 - protein, 10 aa, Dengue virus
GEPRMIVGKN

SEQ ID NO: 63349 - protein, 10 aa, Dengue virus
EPRMIVGKNE

SEQ ID NO: 63350 - protein, 10 aa, Dengue virus
PRMIVGKNER

SEQ ID NO: 63351 - protein, 10 aa, Dengue virus
RMIVGKNERG

SEQ ID NO: 63352 - protein, 10 aa, Dengue virus
MIVGKNERGK

SEQ ID NO: 63353 - protein, 10 aa, Dengue virus
IVGKNERGKS

SEQ ID NO: 63354 - protein, 10 aa, Dengue virus
VGKNERGKSL

SEQ ID NO: 63355 - protein, 10 aa, Dengue virus
GKNERGKSLL

SEQ ID NO: 63356 - protein, 10 aa, Dengue virus
KNERGKSLLF

SEQ ID NO: 63357 - protein, 10 aa, Dengue virus
NERGKSLLFK

SEQ ID NO: 63358 - protein, 10 aa, Dengue virus
ERGKSLLFKT

SEQ ID NO: 63359 - protein, 10 aa, Dengue virus
RGKSLLFKTA

SEQ ID NO: 63360 - protein, 10 aa, Dengue virus
GKSLLFKTAS

SEQ ID NO: 63361 - protein, 10 aa, Dengue virus
KSLLFKTASG

SEQ ID NO: 63362 - protein, 10 aa, Dengue virus
SLLFKTASGI

SEQ ID NO: 63363 - protein, 10 aa, Dengue virus
LLFKTASGIN

SEQ ID NO: 63364 - protein, 10 aa, Dengue virus
LFKTASGINM

SEQ ID NO: 63365 - protein, 10 aa, Dengue virus
FKTASGINMC

SEQ ID NO: 63366 - protein, 10 aa, Dengue virus
KTASGINMCT

SEQ ID NO: 63367 - protein, 10 aa, Dengue virus
TASGINMCTL

SEQ ID NO: 63368 - protein, 10 aa, Dengue virus
ASGINMCTLI

SEQ ID NO: 63369 - protein, 10 aa, Dengue virus
SGINMCTLIA

SEQ ID NO: 63370 - protein, 10 aa, Dengue virus
GINMCTLIAM

SEQ ID NO: 63371 - protein, 10 aa, Dengue virus
INMCTLIAMD

SEQ ID NO: 63372 - protein, 10 aa, Dengue virus
NMCTLIAMDL

SEQ ID NO: 63373 - protein, 10 aa, Dengue virus
MCTLIAMDLG

SEQ ID NO: 63374 - protein, 10 aa, Dengue virus
CTLIAMDLGE

SEQ ID NO: 63375 - protein, 10 aa, Dengue virus
TLIAMDLGEM

SEQ ID NO: 63376 - protein, 10 aa, Dengue virus
LIAMDLGEMC

SEQ ID NO: 63377 - protein, 10 aa, Dengue virus
IAMDLGEMCD

SEQ ID NO: 63378 - protein, 10 aa, Dengue virus
AMDLGEMCDD

SEQ ID NO: 63379 - protein, 10 aa, Dengue virus
MDLGEMCDDT

SEQ ID NO: 63380 - protein, 10 aa, Dengue virus
DLGEMCDDTV

SEQ ID NO: 63381 - protein, 10 aa, Dengue virus
LGEMCDDTVT

SEQ ID NO: 63382 - protein, 10 aa, Dengue virus
GEMCDDTVTY

SEQ ID NO: 63383 - protein, 10 aa, Dengue virus
EMCDDTVTYK

SEQ ID NO: 63384 - protein, 10 aa, Dengue virus
MCDDTVTYKC

SEQ ID NO: 63385 - protein, 10 aa, Dengue virus
CDDTVTYKCP

SEQ ID NO: 63386 - protein, 10 aa, Dengue virus
DDTVTYKCPH

SEQ ID NO: 63387 - protein, 10 aa, Dengue virus
DTVTYKCPHI

SEQ ID NO: 63388 - protein, 10 aa, Dengue virus
ITEVEPEDID

SEQ ID NO: 63389 - protein, 10 aa, Dengue virus
TEVEPEDIDC

SEQ ID NO: 63390 - protein, 10 aa, Dengue virus
EVEPEDIDCW

SEQ ID NO: 63391 - protein, 10 aa, Dengue virus
VEPEDIDCWC

SEQ ID NO: 63392 - protein, 10 aa, Dengue virus
EPEDIDCWCN

SEQ ID NO: 63393 - protein, 10 aa, Dengue virus
PEDIDCWCNL

SEQ ID NO: 63394 - protein, 10 aa, Dengue virus
EDIDCWCNLT

SEQ ID NO: 63395 - protein, 10 aa, Dengue virus
DIDCWCNLTS

SEQ ID NO: 63396 - protein, 10 aa, Dengue virus
IDCWCNLTST

SEQ ID NO: 63397 - protein, 10 aa, Dengue virus
DCWCNLTSTW

SEQ ID NO: 63398 - protein, 10 aa, Dengue virus
CWCNLTSTWV

SEQ ID NO: 63399 - protein, 10 aa, Dengue virus
WCNLTSTWVT

SEQ ID NO: 63400 - protein, 10 aa, Dengue virus
CNLTSTWVTY

SEQ ID NO: 63401 - protein, 10 aa, Dengue virus
NLTSTWVTYG

SEQ ID NO: 63402 - protein, 10 aa, Dengue virus
LTSTWVTYGT

SEQ ID NO: 63403 - protein, 10 aa, Dengue virus
TSTWVTYGTC

SEQ ID NO: 63404 - protein, 10 aa, Dengue virus
STWVTYGTCN

SEQ ID NO: 63405 - protein, 10 aa, Dengue virus
TWVTYGTCNQ

SEQ ID NO: 63406 - protein, 10 aa, Dengue virus
WVTYGTCNQA

SEQ ID NO: 63407 - protein, 10 aa, Dengue virus
VTYGTCNQAG

SEQ ID NO: 63408 - protein, 10 aa, Dengue virus
TYGTCNQAGE

SEQ ID NO: 63409 - protein, 10 aa, Dengue virus
YGTCNQAGEH

SEQ ID NO: 63410 - protein, 10 aa, Dengue virus
GTCNQAGEHR

SEQ ID NO: 63411 - protein, 10 aa, Dengue virus
TCNQAGEHRR

SEQ ID NO: 63412 - protein, 10 aa, Dengue virus
CNQAGEHRRD

SEQ ID NO: 63413 - protein, 10 aa, Dengue virus
NQAGEHRRDK

SEQ ID NO: 63414 - protein, 10 aa, Dengue virus
QAGEHRRDKR

SEQ ID NO: 63415 - protein, 10 aa, Dengue virus
AGEHRRDKRS

SEQ ID NO: 63416 - protein, 10 aa, Dengue virus
GEHRRDKRSV

SEQ ID NO: 63417 - protein, 10 aa, Dengue virus
EHRRDKRSVA

SEQ ID NO: 63418 - protein, 10 aa, Dengue virus
HRRDKRSVAL

SEQ ID NO: 63419 - protein, 10 aa, Dengue virus
RRDKRSVALA

SEQ ID NO: 63420 - protein, 10 aa, Dengue virus
RDKRSVALAP

SEQ ID NO: 63421 - protein, 10 aa, Dengue virus
DKRSVALAPH

SEQ ID NO: 63422 - protein, 10 aa, Dengue virus
KRSVALAPHV

SEQ ID NO: 63423 - protein, 10 aa, Dengue virus
RSVALAPHVG

SEQ ID NO: 63424 - protein, 10 aa, Dengue virus
SVALAPHVGM

SEQ ID NO: 63425 - protein, 10 aa, Dengue virus
VALAPHVGMG

SEQ ID NO: 63426 - protein, 10 aa, Dengue virus
ALAPHVGMGL

SEQ ID NO: 63427 - protein, 10 aa, Dengue virus
LAPHVGMGLD

SEQ ID NO: 63428 - protein, 10 aa, Dengue virus
APHVGMGLDT

SEQ ID NO: 63429 - protein, 10 aa, Dengue virus
PHVGMGLDTR

SEQ ID NO: 63430 - protein, 10 aa, Dengue virus
HVGMGLDTRT

SEQ ID NO: 63431 - protein, 10 aa, Dengue virus
VGMGLDTRTQ

SEQ ID NO: 63432 - protein, 10 aa, Dengue virus
GMGLDTRTQT

SEQ ID NO: 63433 - protein, 10 aa, Dengue virus
MGLDTRTQTW

SEQ ID NO: 63434 - protein, 10 aa, Dengue virus
GLDTRTQTWM

SEQ ID NO: 63435 - protein, 10 aa, Dengue virus
LDTRTQTWMS

SEQ ID NO: 63436 - protein, 10 aa, Dengue virus
DTRTQTWMSA

SEQ ID NO: 63437 - protein, 10 aa, Dengue virus
TRTQTWMSAE

SEQ ID NO: 63438 - protein, 10 aa, Dengue virus
RTQTWMSAEG

SEQ ID NO: 63439 - protein, 10 aa, Dengue virus
TQTWMSAEGA

SEQ ID NO: 63440 - protein, 10 aa, Dengue virus
QTWMSAEGAW

SEQ ID NO: 63441 - protein, 10 aa, Dengue virus
TWMSAEGAWR

SEQ ID NO: 63442 - protein, 10 aa, Dengue virus
WMSAEGAWRQ

SEQ ID NO: 63443 - protein, 10 aa, Dengue virus
MSAEGAWRQV

SEQ ID NO: 63444 - protein, 10 aa, Dengue virus
SAEGAWRQVE

SEQ ID NO: 63445 - protein, 10 aa, Dengue virus
AEGAWRQVEK

SEQ ID NO: 63446 - protein, 10 aa, Dengue virus
EGAWRQVEKV

SEQ ID NO: 63447 - protein, 10 aa, Dengue virus
GAWRQVEKVE

SEQ ID NO: 63448 - protein, 10 aa, Dengue virus
AWRQVEKVET

SEQ ID NO: 63449 - protein, 10 aa, Dengue virus
WRQVEKVETW

SEQ ID NO: 63450 - protein, 10 aa, Dengue virus
RQVEKVETWA

SEQ ID NO: 63451 - protein, 10 aa, Dengue virus
QVEKVETWAL

SEQ ID NO: 63452 - protein, 10 aa, Dengue virus
VEKVETWALR

SEQ ID NO: 63453 - protein, 10 aa, Dengue virus
EKVETWALRH

SEQ ID NO: 63454 - protein, 10 aa, Dengue virus
KVETWALRHP

SEQ ID NO: 63455 - protein, 10 aa, Dengue virus
VETWALRHPG

SEQ ID NO: 63456 - protein, 10 aa, Dengue virus
ETWALRHPGF

SEQ ID NO: 63457 - protein, 10 aa, Dengue virus
TWALRHPGFT

SEQ ID NO: 63458 - protein, 10 aa, Dengue virus
WALRHPGFTI

SEQ ID NO: 63459 - protein, 10 aa, Dengue virus
ALRHPGFTIL

SEQ ID NO: 63460 - protein, 10 aa, Dengue virus
LRHPGFTILA

SEQ ID NO: 63461 - protein, 10 aa, Dengue virus
RHPGFTILAL

SEQ ID NO: 63462 - protein, 10 aa, Dengue virus
HPGFTILALF

SEQ ID NO: 63463 - protein, 10 aa, Dengue virus
PGFTILALFL

SEQ ID NO: 63464 - protein, 10 aa, Dengue virus
GFTILALFLA

SEQ ID NO: 63465 - protein, 10 aa, Dengue virus
FTILALFLAH

SEQ ID NO: 63466 - protein, 10 aa, Dengue virus
TILALFLAHY

SEQ ID NO: 63467 - protein, 10 aa, Dengue virus
ILALFLAHYI

SEQ ID NO: 63468 - protein, 10 aa, Dengue virus
LALFLAHYIG

SEQ ID NO: 63469 - protein, 10 aa, Dengue virus
ALFLAHYIGT

SEQ ID NO: 63470 - protein, 10 aa, Dengue virus
LFLAHYIGTS

SEQ ID NO: 63471 - protein, 10 aa, Dengue virus
FLAHYIGTSL

SEQ ID NO: 63472 - protein, 10 aa, Dengue virus
LAHYIGTSLT

SEQ ID NO: 63473 - protein, 10 aa, Dengue virus
AHYIGTSLTQ

SEQ ID NO: 63474 - protein, 10 aa, Dengue virus
HYIGTSLTQK

SEQ ID NO: 63475 - protein, 10 aa, Dengue virus
YIGTSLTQKV

SEQ ID NO: 63476 - protein, 10 aa, Dengue virus
IGTSLTQKVV

SEQ ID NO: 63477 - protein, 10 aa, Dengue virus
GTSLTQKVVI

SEQ ID NO: 63478 - protein, 10 aa, Dengue virus
TSLTQKVVIF

SEQ ID NO: 63479 - protein, 10 aa, Dengue virus
SLTQKVVIFI

SEQ ID NO: 63480 - protein, 10 aa, Dengue virus
LTQKVVIFIL

SEQ ID NO: 63481 - protein, 10 aa, Dengue virus
TQKVVIFILL

SEQ ID NO: 63482 - protein, 10 aa, Dengue virus
QKVVIFILLM

SEQ ID NO: 63483 - protein, 10 aa, Dengue virus
KVVIFILLML

SEQ ID NO: 63484 - protein, 10 aa, Dengue virus
VVIFILLMLV

SEQ ID NO: 63485 - protein, 10 aa, Dengue virus
VIFILLMLVT

SEQ ID NO: 63486 - protein, 10 aa, Dengue virus
IFILLMLVTP

SEQ ID NO: 63487 - protein, 10 aa, Dengue virus
FILLMLVTPS

SEQ ID NO: 63488 - protein, 10 aa, Dengue virus
ILLMLVTPSM

SEQ ID NO: 63489 - protein, 10 aa, Dengue virus
LLMLVTPSMT

SEQ ID NO: 63490 - protein, 10 aa, Dengue virus
LMLVTPSMTM

SEQ ID NO: 63491 - protein, 10 aa, Dengue virus
MLVTPSMTMR

SEQ ID NO: 63492 - protein, 10 aa, Dengue virus
LVTPSMTMRC

SEQ ID NO: 63493 - protein, 10 aa, Dengue virus
VTPSMTMRCV

SEQ ID NO: 63494 - protein, 10 aa, Dengue virus
TPSMTMRCVG

SEQ ID NO: 63495 - protein, 10 aa, Dengue virus
PSMTMRCVGV

SEQ ID NO: 63496 - protein, 10 aa, Dengue virus
SMTMRCVGVG

SEQ ID NO: 63497 - protein, 10 aa, Dengue virus
MTMRCVGVGN

SEQ ID NO: 63498 - protein, 10 aa, Dengue virus
TMRCVGVGNR

SEQ ID NO: 63499 - protein, 10 aa, Dengue virus
MRCVGVGNRD

SEQ ID NO: 63500 - protein, 10 aa, Dengue virus
RCVGVGNRDF

SEQ ID NO: 63501 - protein, 10 aa, Dengue virus
CVGVGNRDFV

SEQ ID NO: 63502 - protein, 10 aa, Dengue virus
VGVGNRDFVE

SEQ ID NO: 63503 - protein, 10 aa, Dengue virus
GVGNRDFVEG

SEQ ID NO: 63504 - protein, 10 aa, Dengue virus
VGNRDFVEGL

SEQ ID NO: 63505 - protein, 10 aa, Dengue virus
GNRDFVEGLS

SEQ ID NO: 63506 - protein, 10 aa, Dengue virus
NRDFVEGLSG

SEQ ID NO: 63507 - protein, 10 aa, Dengue virus
RDFVEGLSGA

SEQ ID NO: 63508 - protein, 10 aa, Dengue virus
DFVEGLSGAT

SEQ ID NO: 63509 - protein, 10 aa, Dengue virus
FVEGLSGATW

SEQ ID NO: 63510 - protein, 10 aa, Dengue virus
VEGLSGATWV

SEQ ID NO: 63511 - protein, 10 aa, Dengue virus
EGLSGATWVD

SEQ ID NO: 63512 - protein, 10 aa, Dengue virus
GLSGATWVDV

SEQ ID NO: 63513 - protein, 10 aa, Dengue virus
LSGATWVDVV

SEQ ID NO: 63514 - protein, 10 aa, Dengue virus
SGATWVDVVL

SEQ ID NO: 63515 - protein, 10 aa, Dengue virus
GATWVDVVLE

SEQ ID NO: 63516 - protein, 10 aa, Dengue virus
ATWVDVVLEH

SEQ ID NO: 63517 - protein, 10 aa, Dengue virus
TWVDVVLEHG

SEQ ID NO: 63518 - protein, 10 aa, Dengue virus
WVDVVLEHGG

SEQ ID NO: 63519 - protein, 10 aa, Dengue virus
VDVVLEHGGC

SEQ ID NO: 63520 - protein, 10 aa, Dengue virus
DVVLEHGGCV

SEQ ID NO: 63521 - protein, 10 aa, Dengue virus
VVLEHGGCVT

SEQ ID NO: 63522 - protein, 10 aa, Dengue virus
VLEHGGCVTT

SEQ ID NO: 63523 - protein, 10 aa, Dengue virus
LEHGGCVTTM

SEQ ID NO: 63524 - protein, 10 aa, Dengue virus
EHGGCVTTMA

SEQ ID NO: 63525 - protein, 10 aa, Dengue virus
HGGCVTTMAK

SEQ ID NO: 63526 - protein, 10 aa, Dengue virus
GGCVTTMAKN

SEQ ID NO: 63527 - protein, 10 aa, Dengue virus
GCVTTMAKNK

SEQ ID NO: 63528 - protein, 10 aa, Dengue virus
CVTTMAKNKP

SEQ ID NO: 63529 - protein, 10 aa, Dengue virus
VTTMAKNKPT

SEQ ID NO: 63530 - protein, 10 aa, Dengue virus
TTMAKNKPTL

SEQ ID NO: 63531 - protein, 10 aa, Dengue virus
TMAKNKPTLD

SEQ ID NO: 63532 - protein, 10 aa, Dengue virus
MAKNKPTLDI

SEQ ID NO: 63533 - protein, 10 aa, Dengue virus
AKNKPTLDIE

SEQ ID NO: 63534 - protein, 10 aa, Dengue virus
KNKPTLDIEL

SEQ ID NO: 63535 - protein, 10 aa, Dengue virus
NKPTLDIELQ

SEQ ID NO: 63536 - protein, 10 aa, Dengue virus
KPTLDIELQK

SEQ ID NO: 63537 - protein, 10 aa, Dengue virus
PTLDIELQKT

SEQ ID NO: 63538 - protein, 10 aa, Dengue virus
TLDIELQKTE

SEQ ID NO: 63539 - protein, 10 aa, Dengue virus
LDIELQKTEA

SEQ ID NO: 63540 - protein, 10 aa, Dengue virus
DIELQKTEAT

SEQ ID NO: 63541 - protein, 10 aa, Dengue virus
IELQKTEATQ

SEQ ID NO: 63542 - protein, 10 aa, Dengue virus
ELQKTEATQL

SEQ ID NO: 63543 - protein, 10 aa, Dengue virus
LQKTEATQLA

SEQ ID NO: 63544 - protein, 10 aa, Dengue virus
QKTEATQLAT

SEQ ID NO: 63545 - protein, 10 aa, Dengue virus
KTEATQLATL

SEQ ID NO: 63546 - protein, 10 aa, Dengue virus
TEATQLATLR

SEQ ID NO: 63547 - protein, 10 aa, Dengue virus
EATQLATLRK

SEQ ID NO: 63548 - protein, 10 aa, Dengue virus
ATQLATLRKL

SEQ ID NO: 63549 - protein, 10 aa, Dengue virus
TQLATLRKLC

SEQ ID NO: 63550 - protein, 10 aa, Dengue virus
QLATLRKLCI

SEQ ID NO: 63551 - protein, 10 aa, Dengue virus
LATLRKLCIE

SEQ ID NO: 63552 - protein, 10 aa, Dengue virus
ATLRKLCIEG

SEQ ID NO: 63553 - protein, 10 aa, Dengue virus
TLRKLCIEGK

SEQ ID NO: 63554 - protein, 10 aa, Dengue virus
LRKLCIEGKI

SEQ ID NO: 63555 - protein, 10 aa, Dengue virus
RKLCIEGKIT

SEQ ID NO: 63556 - protein, 10 aa, Dengue virus
KLCIEGKITN

SEQ ID NO: 63557 - protein, 10 aa, Dengue virus
LCIEGKITNI

SEQ ID NO: 63558 - protein, 10 aa, Dengue virus
CIEGKITNIT

SEQ ID NO: 63559 - protein, 10 aa, Dengue virus
IEGKITNITT

SEQ ID NO: 63560 - protein, 10 aa, Dengue virus
EGKITNITTD

SEQ ID NO: 63561 - protein, 10 aa, Dengue virus
GKITNITTDS

SEQ ID NO: 63562 - protein, 10 aa, Dengue virus
KITNITTDSR

SEQ ID NO: 63563 - protein, 10 aa, Dengue virus
ITNITTDSRC

SEQ ID NO: 63564 - protein, 10 aa, Dengue virus
TNITTDSRCP

SEQ ID NO: 63565 - protein, 10 aa, Dengue virus
NITTDSRCPT

SEQ ID NO: 63566 - protein, 10 aa, Dengue virus
ITTDSRCPTQ

SEQ ID NO: 63567 - protein, 10 aa, Dengue virus
TTDSRCPTQG

SEQ ID NO: 63568 - protein, 10 aa, Dengue virus
TDSRCPTQGE

SEQ ID NO: 63569 - protein, 10 aa, Dengue virus
DSRCPTQGEA

SEQ ID NO: 63570 - protein, 10 aa, Dengue virus
SRCPTQGEAV

SEQ ID NO: 63571 - protein, 10 aa, Dengue virus
RCPTQGEAVL

SEQ ID NO: 63572 - protein, 10 aa, Dengue virus
CPTQGEAVLP

SEQ ID NO: 63573 - protein, 10 aa, Dengue virus
PTQGEAVLPE

SEQ ID NO: 63574 - protein, 10 aa, Dengue virus
TQGEAVLPEE

SEQ ID NO: 63575 - protein, 10 aa, Dengue virus
QGEAVLPEEQ

SEQ ID NO: 63576 - protein, 10 aa, Dengue virus
GEAVLPEEQD

SEQ ID NO: 63577 - protein, 10 aa, Dengue virus
EAVLPEEQDQ

SEQ ID NO: 63578 - protein, 10 aa, Dengue virus
AVLPEEQDQN

SEQ ID NO: 63579 - protein, 10 aa, Dengue virus
VLPEEQDQNY

SEQ ID NO: 63580 - protein, 10 aa, Dengue virus
LPEEQDQNYV

SEQ ID NO: 63581 - protein, 10 aa, Dengue virus
PEEQDQNYVC

SEQ ID NO: 63582 - protein, 10 aa, Dengue virus
EEQDQNYVCK

SEQ ID NO: 63583 - protein, 10 aa, Dengue virus
EQDQNYVCKH

SEQ ID NO: 63584 - protein, 10 aa, Dengue virus
QDQNYVCKHT

SEQ ID NO: 63585 - protein, 10 aa, Dengue virus
DQNYVCKHTY

SEQ ID NO: 63586 - protein, 10 aa, Dengue virus
QNYVCKHTYV

SEQ ID NO: 63587 - protein, 10 aa, Dengue virus
NYVCKHTYVD

SEQ ID NO: 63588 - protein, 10 aa, Dengue virus
YVCKHTYVDR

SEQ ID NO: 63589 - protein, 10 aa, Dengue virus
VCKHTYVDRG

SEQ ID NO: 63590 - protein, 10 aa, Dengue virus
CKHTYVDRGW

SEQ ID NO: 63591 - protein, 10 aa, Dengue virus
KHTYVDRGWG

SEQ ID NO: 63592 - protein, 10 aa, Dengue virus
HTYVDRGWGN

SEQ ID NO: 63593 - protein, 10 aa, Dengue virus
TYVDRGWGNG

SEQ ID NO: 63594 - protein, 10 aa, Dengue virus
YVDRGWGNGC

SEQ ID NO: 63595 - protein, 10 aa, Dengue virus
VDRGWGNGCG

SEQ ID NO: 63596 - protein, 10 aa, Dengue virus
DRGWGNGCGL

SEQ ID NO: 63597 - protein, 10 aa, Dengue virus
RGWGNGCGLF

SEQ ID NO: 63598 - protein, 10 aa, Dengue virus
GWGNGCGLFG

SEQ ID NO: 63599 - protein, 10 aa, Dengue virus
WGNGCGLFGK

SEQ ID NO: 63600 - protein, 10 aa, Dengue virus
GNGCGLFGKG

SEQ ID NO: 63601 - protein, 10 aa, Dengue virus
NGCGLFGKGS

SEQ ID NO: 63602 - protein, 10 aa, Dengue virus
GCGLFGKGSL

SEQ ID NO: 63603 - protein, 10 aa, Dengue virus
CGLFGKGSLV

SEQ ID NO: 63604 - protein, 10 aa, Dengue virus
GLFGKGSLVT

SEQ ID NO: 63605 - protein, 10 aa, Dengue virus
LFGKGSLVTC

SEQ ID NO: 63606 - protein, 10 aa, Dengue virus
FGKGSLVTCA

SEQ ID NO: 63607 - protein, 10 aa, Dengue virus
GKGSLVTCAK

SEQ ID NO: 63608 - protein, 10 aa, Dengue virus
KGSLVTCAKF

SEQ ID NO: 63609 - protein, 10 aa, Dengue virus
GSLVTCAKFQ

SEQ ID NO: 63610 - protein, 10 aa, Dengue virus
SLVTCAKFQC

SEQ ID NO: 63611 - protein, 10 aa, Dengue virus
LVTCAKFQCL

SEQ ID NO: 63612 - protein, 10 aa, Dengue virus
VTCAKFQCLE

SEQ ID NO: 63613 - protein, 10 aa, Dengue virus
TCAKFQCLEP

SEQ ID NO: 63614 - protein, 10 aa, Dengue virus
CAKFQCLEPI

SEQ ID NO: 63615 - protein, 10 aa, Dengue virus
AKFQCLEPIE

SEQ ID NO: 63616 - protein, 10 aa, Dengue virus
KFQCLEPIEG

SEQ ID NO: 63617 - protein, 10 aa, Dengue virus
FQCLEPIEGK

SEQ ID NO: 63618 - protein, 10 aa, Dengue virus
IEGKVVQYEN

SEQ ID NO: 63619 - protein, 10 aa, Dengue virus
EGKVVQYENL

SEQ ID NO: 63620 - protein, 10 aa, Dengue virus
GKVVQYENLK

SEQ ID NO: 63621 - protein, 10 aa, Dengue virus
KVVQYENLKY

SEQ ID NO: 63622 - protein, 10 aa, Dengue virus
VVQYENLKYT

SEQ ID NO: 63623 - protein, 10 aa, Dengue virus
VQYENLKYTV

SEQ ID NO: 63624 - protein, 10 aa, Dengue virus
QYENLKYTVI

SEQ ID NO: 63625 - protein, 10 aa, Dengue virus
YENLKYTVII

SEQ ID NO: 63626 - protein, 10 aa, Dengue virus
ENLKYTVIIT

SEQ ID NO: 63627 - protein, 10 aa, Dengue virus
NLKYTVIITV

SEQ ID NO: 63628 - protein, 10 aa, Dengue virus
LKYTVIITVH

SEQ ID NO: 63629 - protein, 10 aa, Dengue virus
KYTVIITVHT

SEQ ID NO: 63630 - protein, 10 aa, Dengue virus
YTVIITVHTG

SEQ ID NO: 63631 - protein, 10 aa, Dengue virus
TVIITVHTGD

SEQ ID NO: 63632 - protein, 10 aa, Dengue virus
VIITVHTGDQ

SEQ ID NO: 63633 - protein, 10 aa, Dengue virus
IITVHTGDQH

SEQ ID NO: 63634 - protein, 10 aa, Dengue virus
ITVHTGDQHQ

SEQ ID NO: 63635 - protein, 10 aa, Dengue virus
TVHTGDQHQV

SEQ ID NO: 63636 - protein, 10 aa, Dengue virus
VHTGDQHQVG

SEQ ID NO: 63637 - protein, 10 aa, Dengue virus
HTGDQHQVGN

SEQ ID NO: 63638 - protein, 10 aa, Dengue virus
TGDQHQVGNE

SEQ ID NO: 63639 - protein, 10 aa, Dengue virus
GDQHQVGNET

SEQ ID NO: 63640 - protein, 10 aa, Dengue virus
DQHQVGNETQ

SEQ ID NO: 63641 - protein, 10 aa, Dengue virus
QHQVGNETQG

SEQ ID NO: 63642 - protein, 10 aa, Dengue virus
HQVGNETQGV

SEQ ID NO: 63643 - protein, 10 aa, Dengue virus
QVGNETQGVT

SEQ ID NO: 63644 - protein, 10 aa, Dengue virus
VGNETQGVTA

SEQ ID NO: 63645 - protein, 10 aa, Dengue virus
GNETQGVTAE

SEQ ID NO: 63646 - protein, 10 aa, Dengue virus
NETQGVTAEI

SEQ ID NO: 63647 - protein, 10 aa, Dengue virus
ETQGVTAEIT

SEQ ID NO: 63648 - protein, 10 aa, Dengue virus
TQGVTAEITP

SEQ ID NO: 63649 - protein, 10 aa, Dengue virus
QGVTAEITPQ

SEQ ID NO: 63650 - protein, 10 aa, Dengue virus
GVTAEITPQA

SEQ ID NO: 63651 - protein, 10 aa, Dengue virus
VTAEITPQAS

SEQ ID NO: 63652 - protein, 10 aa, Dengue virus
TAEITPQAST

SEQ ID NO: 63653 - protein, 10 aa, Dengue virus
EITPQASTTE

SEQ ID NO: 63654 - protein, 10 aa, Dengue virus
ITPQASTTEA

SEQ ID NO: 63655 - protein, 10 aa, Dengue virus
TEAILPEYGT

SEQ ID NO: 63656 - protein, 10 aa, Dengue virus
EAILPEYGTL

SEQ ID NO: 63657 - protein, 10 aa, Dengue virus
AILPEYGTLG

SEQ ID NO: 63658 - protein, 10 aa, Dengue virus
ILPEYGTLGL

SEQ ID NO: 63659 - protein, 10 aa, Dengue virus
LPEYGTLGLE

SEQ ID NO: 63660 - protein, 10 aa, Dengue virus
PEYGTLGLEC

SEQ ID NO: 63661 - protein, 10 aa, Dengue virus
EYGTLGLECS

SEQ ID NO: 63662 - protein, 10 aa, Dengue virus
YGTLGLECSP

SEQ ID NO: 63663 - protein, 10 aa, Dengue virus
GTLGLECSPR

SEQ ID NO: 63664 - protein, 10 aa, Dengue virus
TLGLECSPRT

SEQ ID NO: 63665 - protein, 10 aa, Dengue virus
LGLECSPRTG

SEQ ID NO: 63666 - protein, 10 aa, Dengue virus
GLECSPRTGL

SEQ ID NO: 63667 - protein, 10 aa, Dengue virus
LECSPRTGLD

SEQ ID NO: 63668 - protein, 10 aa, Dengue virus
ECSPRTGLDF

SEQ ID NO: 63669 - protein, 10 aa, Dengue virus
CSPRTGLDFN

SEQ ID NO: 63670 - protein, 10 aa, Dengue virus
SPRTGLDFNE

SEQ ID NO: 63671 - protein, 10 aa, Dengue virus
PRTGLDFNEM

SEQ ID NO: 63672 - protein, 10 aa, Dengue virus
RTGLDFNEMI

SEQ ID NO: 63673 - protein, 10 aa, Dengue virus
TGLDFNEMIL

SEQ ID NO: 63674 - protein, 10 aa, Dengue virus
GLDFNEMILL

SEQ ID NO: 63675 - protein, 10 aa, Dengue virus
LDFNEMILLT

SEQ ID NO: 63676 - protein, 10 aa, Dengue virus
DFNEMILLTM

SEQ ID NO: 63677 - protein, 10 aa, Dengue virus
FNEMILLTMK

SEQ ID NO: 63678 - protein, 10 aa, Dengue virus
NEMILLTMKN

SEQ ID NO: 63679 - protein, 10 aa, Dengue virus
EMILLTMKNK

SEQ ID NO: 63680 - protein, 10 aa, Dengue virus
MILLTMKNKA

SEQ ID NO: 63681 - protein, 10 aa, Dengue virus
ILLTMKNKAW

SEQ ID NO: 63682 - protein, 10 aa, Dengue virus
LLTMKNKAWM

SEQ ID NO: 63683 - protein, 10 aa, Dengue virus
LTMKNKAWMV

SEQ ID NO: 63684 - protein, 10 aa, Dengue virus
TMKNKAWMVH

SEQ ID NO: 63685 - protein, 10 aa, Dengue virus
MKNKAWMVHR

SEQ ID NO: 63686 - protein, 10 aa, Dengue virus
KNKAWMVHRQ

SEQ ID NO: 63687 - protein, 10 aa, Dengue virus
NKAWMVHRQW

SEQ ID NO: 63688 - protein, 10 aa, Dengue virus
KAWMVHRQWF

SEQ ID NO: 63689 - protein, 10 aa, Dengue virus
AWMVHRQWFF

SEQ ID NO: 63690 - protein, 10 aa, Dengue virus
WMVHRQWFFD

SEQ ID NO: 63691 - protein, 10 aa, Dengue virus
MVHRQWFFDL

SEQ ID NO: 63692 - protein, 10 aa, Dengue virus
VHRQWFFDLP

SEQ ID NO: 63693 - protein, 10 aa, Dengue virus
HRQWFFDLPL

SEQ ID NO: 63694 - protein, 10 aa, Dengue virus
RQWFFDLPLP

SEQ ID NO: 63695 - protein, 10 aa, Dengue virus
QWFFDLPLPW

SEQ ID NO: 63696 - protein, 10 aa, Dengue virus
WFFDLPLPWT

SEQ ID NO: 63697 - protein, 10 aa, Dengue virus
FFDLPLPWTS

SEQ ID NO: 63698 - protein, 10 aa, Dengue virus
FDLPLPWTSG

SEQ ID NO: 63699 - protein, 10 aa, Dengue virus
DLPLPWTSGA

SEQ ID NO: 63700 - protein, 10 aa, Dengue virus
LPLPWTSGAT

SEQ ID NO: 63701 - protein, 10 aa, Dengue virus
PLPWTSGATT

SEQ ID NO: 63702 - protein, 10 aa, Dengue virus
TETPTWNRKE

SEQ ID NO: 63703 - protein, 10 aa, Dengue virus
ETPTWNRKEL

SEQ ID NO: 63704 - protein, 10 aa, Dengue virus
TPTWNRKELL

SEQ ID NO: 63705 - protein, 10 aa, Dengue virus
PTWNRKELLV

SEQ ID NO: 63706 - protein, 10 aa, Dengue virus
TWNRKELLVT

SEQ ID NO: 63707 - protein, 10 aa, Dengue virus
WNRKELLVTF

SEQ ID NO: 63708 - protein, 10 aa, Dengue virus
NRKELLVTFK

SEQ ID NO: 63709 - protein, 10 aa, Dengue virus
RKELLVTFKN

SEQ ID NO: 63710 - protein, 10 aa, Dengue virus
KELLVTFKNA

SEQ ID NO: 63711 - protein, 10 aa, Dengue virus
ELLVTFKNAH

SEQ ID NO: 63712 - protein, 10 aa, Dengue virus
LLVTFKNAHA

SEQ ID NO: 63713 - protein, 10 aa, Dengue virus
LVTFKNAHAK

SEQ ID NO: 63714 - protein, 10 aa, Dengue virus
VTFKNAHAKK

SEQ ID NO: 63715 - protein, 10 aa, Dengue virus
TFKNAHAKKQ

SEQ ID NO: 63716 - protein, 10 aa, Dengue virus
FKNAHAKKQE

SEQ ID NO: 63717 - protein, 10 aa, Dengue virus
KNAHAKKQEV

SEQ ID NO: 63718 - protein, 10 aa, Dengue virus
NAHAKKQEVV

SEQ ID NO: 63719 - protein, 10 aa, Dengue virus
AHAKKQEVVV

SEQ ID NO: 63720 - protein, 10 aa, Dengue virus
HAKKQEVVVL

SEQ ID NO: 63721 - protein, 10 aa, Dengue virus
AKKQEVVVLG

SEQ ID NO: 63722 - protein, 10 aa, Dengue virus
KKQEVVVLGS

SEQ ID NO: 63723 - protein, 10 aa, Dengue virus
KQEVVVLGSQ

SEQ ID NO: 63724 - protein, 10 aa, Dengue virus
QEVVVLGSQE

SEQ ID NO: 63725 - protein, 10 aa, Dengue virus
EVVVLGSQEG

SEQ ID NO: 63726 - protein, 10 aa, Dengue virus
VVVLGSQEGA

SEQ ID NO: 63727 - protein, 10 aa, Dengue virus
VVLGSQEGAM

SEQ ID NO: 63728 - protein, 10 aa, Dengue virus
VLGSQEGAMH

SEQ ID NO: 63729 - protein, 10 aa, Dengue virus
LGSQEGAMHT

SEQ ID NO: 63730 - protein, 10 aa, Dengue virus
GSQEGAMHTA

SEQ ID NO: 63731 - protein, 10 aa, Dengue virus
SQEGAMHTAL

SEQ ID NO: 63732 - protein, 10 aa, Dengue virus
QEGAMHTALT

SEQ ID NO: 63733 - protein, 10 aa, Dengue virus
EGAMHTALTG

SEQ ID NO: 63734 - protein, 10 aa, Dengue virus
GAMHTALTGA

SEQ ID NO: 63735 - protein, 10 aa, Dengue virus
AMHTALTGAT

SEQ ID NO: 63736 - protein, 10 aa, Dengue virus
MHTALTGATE

SEQ ID NO: 63737 - protein, 10 aa, Dengue virus
HTALTGATEI

SEQ ID NO: 63738 - protein, 10 aa, Dengue virus
TALTGATEIQ

SEQ ID NO: 63739 - protein, 10 aa, Dengue virus
ALTGATEIQN

SEQ ID NO: 63740 - protein, 10 aa, Dengue virus
LTGATEIQNS

SEQ ID NO: 63741 - protein, 10 aa, Dengue virus
TGATEIQNSG

SEQ ID NO: 63742 - protein, 10 aa, Dengue virus
GATEIQNSGG

SEQ ID NO: 63743 - protein, 10 aa, Dengue virus
ATEIQNSGGT

SEQ ID NO: 63744 - protein, 10 aa, Dengue virus
TEIQNSGGTS

SEQ ID NO: 63745 - protein, 10 aa, Dengue virus
EIQNSGGTSI

SEQ ID NO: 63746 - protein, 10 aa, Dengue virus
IQNSGGTSIF

SEQ ID NO: 63747 - protein, 10 aa, Dengue virus
QNSGGTSIFA

SEQ ID NO: 63748 - protein, 10 aa, Dengue virus
NSGGTSIFAG

SEQ ID NO: 63749 - protein, 10 aa, Dengue virus
SGGTSIFAGH

SEQ ID NO: 63750 - protein, 10 aa, Dengue virus
GGTSIFAGHL

SEQ ID NO: 63751 - protein, 10 aa, Dengue virus
GTSIFAGHLK

SEQ ID NO: 63752 - protein, 10 aa, Dengue virus
TSIFAGHLKC

SEQ ID NO: 63753 - protein, 10 aa, Dengue virus
SIFAGHLKCR

SEQ ID NO: 63754 - protein, 10 aa, Dengue virus
IFAGHLKCRL

SEQ ID NO: 63755 - protein, 10 aa, Dengue virus
FAGHLKCRLK

SEQ ID NO: 63756 - protein, 10 aa, Dengue virus
AGHLKCRLKM

SEQ ID NO: 63757 - protein, 10 aa, Dengue virus
GHLKCRLKMD

SEQ ID NO: 63758 - protein, 10 aa, Dengue virus
HLKCRLKMDK

SEQ ID NO: 63759 - protein, 10 aa, Dengue virus
LKCRLKMDKL

SEQ ID NO: 63760 - protein, 10 aa, Dengue virus
KCRLKMDKLE

SEQ ID NO: 63761 - protein, 10 aa, Dengue virus
CRLKMDKLEL

SEQ ID NO: 63762 - protein, 10 aa, Dengue virus
RLKMDKLELK

SEQ ID NO: 63763 - protein, 10 aa, Dengue virus
LKMDKLELKG

SEQ ID NO: 63764 - protein, 10 aa, Dengue virus
KMDKLELKGM

SEQ ID NO: 63765 - protein, 10 aa, Dengue virus
MDKLELKGMS

SEQ ID NO: 63766 - protein, 10 aa, Dengue virus
DKLELKGMSY

SEQ ID NO: 63767 - protein, 10 aa, Dengue virus
KLELKGMSYA

SEQ ID NO: 63768 - protein, 10 aa, Dengue virus
LELKGMSYAM

SEQ ID NO: 63769 - protein, 10 aa, Dengue virus
ELKGMSYAMC

SEQ ID NO: 63770 - protein, 10 aa, Dengue virus
LKGMSYAMCT

SEQ ID NO: 63771 - protein, 10 aa, Dengue virus
KGMSYAMCTN

SEQ ID NO: 63772 - protein, 10 aa, Dengue virus
GMSYAMCTNT

SEQ ID NO: 63773 - protein, 10 aa, Dengue virus
MSYAMCTNTF

SEQ ID NO: 63774 - protein, 10 aa, Dengue virus
SYAMCTNTFV

SEQ ID NO: 63775 - protein, 10 aa, Dengue virus
YAMCTNTFVL

SEQ ID NO: 63776 - protein, 10 aa, Dengue virus
NTFVLKKEVS

SEQ ID NO: 63777 - protein, 10 aa, Dengue virus
TFVLKKEVSE

SEQ ID NO: 63778 - protein, 10 aa, Dengue virus
FVLKKEVSET

SEQ ID NO: 63779 - protein, 10 aa, Dengue virus
VLKKEVSETQ

SEQ ID NO: 63780 - protein, 10 aa, Dengue virus
LKKEVSETQH

SEQ ID NO: 63781 - protein, 10 aa, Dengue virus
KKEVSETQHG

SEQ ID NO: 63782 - protein, 10 aa, Dengue virus
KEVSETQHGT

SEQ ID NO: 63783 - protein, 10 aa, Dengue virus
EVSETQHGTI

SEQ ID NO: 63784 - protein, 10 aa, Dengue virus
VSETQHGTIL

SEQ ID NO: 63785 - protein, 10 aa, Dengue virus
SETQHGTILI

SEQ ID NO: 63786 - protein, 10 aa, Dengue virus
ETQHGTILIK

SEQ ID NO: 63787 - protein, 10 aa, Dengue virus
TQHGTILIKV

SEQ ID NO: 63788 - protein, 10 aa, Dengue virus
QHGTILIKVE

SEQ ID NO: 63789 - protein, 10 aa, Dengue virus
HGTILIKVEY

SEQ ID NO: 63790 - protein, 10 aa, Dengue virus
GTILIKVEYK

SEQ ID NO: 63791 - protein, 10 aa, Dengue virus
TILIKVEYKG

SEQ ID NO: 63792 - protein, 10 aa, Dengue virus
ILIKVEYKGE

SEQ ID NO: 63793 - protein, 10 aa, Dengue virus
LIKVEYKGED

SEQ ID NO: 63794 - protein, 10 aa, Dengue virus
IKVEYKGEDA

SEQ ID NO: 63795 - protein, 10 aa, Dengue virus
KVEYKGEDAP

SEQ ID NO: 63796 - protein, 10 aa, Dengue virus
VEYKGEDAPC

SEQ ID NO: 63797 - protein, 10 aa, Dengue virus
EYKGEDAPCK

SEQ ID NO: 63798 - protein, 10 aa, Dengue virus
YKGEDAPCKI

SEQ ID NO: 63799 - protein, 10 aa, Dengue virus
KGEDAPCKIP

SEQ ID NO: 63800 - protein, 10 aa, Dengue virus
GEDAPCKIPF

SEQ ID NO: 63801 - protein, 10 aa, Dengue virus
EDAPCKIPFS

SEQ ID NO: 63802 - protein, 10 aa, Dengue virus
DAPCKIPFST

SEQ ID NO: 63803 - protein, 10 aa, Dengue virus
APCKIPFSTE

SEQ ID NO: 63804 - protein, 10 aa, Dengue virus
PCKIPFSTED

SEQ ID NO: 63805 - protein, 10 aa, Dengue virus
CKIPFSTEDG

SEQ ID NO: 63806 - protein, 10 aa, Dengue virus
KIPFSTEDGQ

SEQ ID NO: 63807 - protein, 10 aa, Dengue virus
IPFSTEDGQG

SEQ ID NO: 63808 - protein, 10 aa, Dengue virus
PFSTEDGQGK

SEQ ID NO: 63809 - protein, 10 aa, Dengue virus
FSTEDGQGKA

SEQ ID NO: 63810 - protein, 10 aa, Dengue virus
STEDGQGKAH

SEQ ID NO: 63811 - protein, 10 aa, Dengue virus
TEDGQGKAHN

SEQ ID NO: 63812 - protein, 10 aa, Dengue virus
EDGQGKAHNG

SEQ ID NO: 63813 - protein, 10 aa, Dengue virus
DGQGKAHNGR

SEQ ID NO: 63814 - protein, 10 aa, Dengue virus
GQGKAHNGRL

SEQ ID NO: 63815 - protein, 10 aa, Dengue virus
QGKAHNGRLI

SEQ ID NO: 63816 - protein, 10 aa, Dengue virus
GKAHNGRLIT

SEQ ID NO: 63817 - protein, 10 aa, Dengue virus
KAHNGRLITA

SEQ ID NO: 63818 - protein, 10 aa, Dengue virus
AHNGRLITAN

SEQ ID NO: 63819 - protein, 10 aa, Dengue virus
HNGRLITANP

SEQ ID NO: 63820 - protein, 10 aa, Dengue virus
NGRLITANPV

SEQ ID NO: 63821 - protein, 10 aa, Dengue virus
GRLITANPVV

SEQ ID NO: 63822 - protein, 10 aa, Dengue virus
RLITANPVVT

SEQ ID NO: 63823 - protein, 10 aa, Dengue virus
LITANPVVTK

SEQ ID NO: 63824 - protein, 10 aa, Dengue virus
ITANPVVTKK

SEQ ID NO: 63825 - protein, 10 aa, Dengue virus
TANPVVTKKE

SEQ ID NO: 63826 - protein, 10 aa, Dengue virus
ANPVVTKKEE

SEQ ID NO: 63827 - protein, 10 aa, Dengue virus
NPVVTKKEEP

SEQ ID NO: 63828 - protein, 10 aa, Dengue virus
PVVTKKEEPV

SEQ ID NO: 63829 - protein, 10 aa, Dengue virus
VVTKKEEPVN

SEQ ID NO: 63830 - protein, 10 aa, Dengue virus
VTKKEEPVNI

SEQ ID NO: 63831 - protein, 10 aa, Dengue virus
TKKEEPVNIE

SEQ ID NO: 63832 - protein, 10 aa, Dengue virus
KKEEPVNIEA

SEQ ID NO: 63833 - protein, 10 aa, Dengue virus
KEEPVNIEAE

SEQ ID NO: 63834 - protein, 10 aa, Dengue virus
EEPVNIEAEP

SEQ ID NO: 63835 - protein, 10 aa, Dengue virus
EPVNIEAEPP

SEQ ID NO: 63836 - protein, 10 aa, Dengue virus
PVNIEAEPPF

SEQ ID NO: 63837 - protein, 10 aa, Dengue virus
VNIEAEPPFG

SEQ ID NO: 63838 - protein, 10 aa, Dengue virus
NIEAEPPFGE

SEQ ID NO: 63839 - protein, 10 aa, Dengue virus
IEAEPPFGES

SEQ ID NO: 63840 - protein, 10 aa, Dengue virus
EAEPPFGESN

SEQ ID NO: 63841 - protein, 10 aa, Dengue virus
AEPPFGESNI

SEQ ID NO: 63842 - protein, 10 aa, Dengue virus
EPPFGESNIV

SEQ ID NO: 63843 - protein, 10 aa, Dengue virus
PPFGESNIVI

SEQ ID NO: 63844 - protein, 10 aa, Dengue virus
PFGESNIVIG

SEQ ID NO: 63845 - protein, 10 aa, Dengue virus
FGESNIVIGI

SEQ ID NO: 63846 - protein, 10 aa, Dengue virus
GESNIVIGIG

SEQ ID NO: 63847 - protein, 10 aa, Dengue virus
ESNIVIGIGD

SEQ ID NO: 63848 - protein, 10 aa, Dengue virus
GDNALKINWY

SEQ ID NO: 63849 - protein, 10 aa, Dengue virus
DNALKINWYK

SEQ ID NO: 63850 - protein, 10 aa, Dengue virus
NALKINWYKK

SEQ ID NO: 63851 - protein, 10 aa, Dengue virus
ALKINWYKKG

SEQ ID NO: 63852 - protein, 10 aa, Dengue virus
LKINWYKKGS

SEQ ID NO: 63853 - protein, 10 aa, Dengue virus
KINWYKKGSS

SEQ ID NO: 63854 - protein, 10 aa, Dengue virus
INWYKKGSSI

SEQ ID NO: 63855 - protein, 10 aa, Dengue virus
NWYKKGSSIG

SEQ ID NO: 63856 - protein, 10 aa, Dengue virus
WYKKGSSIGK

SEQ ID NO: 63857 - protein, 10 aa, Dengue virus
YKKGSSIGKM

SEQ ID NO: 63858 - protein, 10 aa, Dengue virus
KKGSSIGKMF

SEQ ID NO: 63859 - protein, 10 aa, Dengue virus
KGSSIGKMFE

SEQ ID NO: 63860 - protein, 10 aa, Dengue virus
GSSIGKMFEA

SEQ ID NO: 63861 - protein, 10 aa, Dengue virus
SSIGKMFEAT

SEQ ID NO: 63862 - protein, 10 aa, Dengue virus
SIGKMFEATA

SEQ ID NO: 63863 - protein, 10 aa, Dengue virus
IGKMFEATAR

SEQ ID NO: 63864 - protein, 10 aa, Dengue virus
GKMFEATARG

SEQ ID NO: 63865 - protein, 10 aa, Dengue virus
KMFEATARGA

SEQ ID NO: 63866 - protein, 10 aa, Dengue virus
MFEATARGAR

SEQ ID NO: 63867 - protein, 10 aa, Dengue virus
FEATARGARR

SEQ ID NO: 63868 - protein, 10 aa, Dengue virus
EATARGARRM

SEQ ID NO: 63869 - protein, 10 aa, Dengue virus
ATARGARRMA

SEQ ID NO: 63870 - protein, 10 aa, Dengue virus
TARGARRMAI

SEQ ID NO: 63871 - protein, 10 aa, Dengue virus
ARGARRMAIL

SEQ ID NO: 63872 - protein, 10 aa, Dengue virus
RGARRMAILG

SEQ ID NO: 63873 - protein, 10 aa, Dengue virus
GARRMAILGD

SEQ ID NO: 63874 - protein, 10 aa, Dengue virus
ARRMAILGDT

SEQ ID NO: 63875 - protein, 10 aa, Dengue virus
RRMAILGDTA

SEQ ID NO: 63876 - protein, 10 aa, Dengue virus
RMAILGDTAW

SEQ ID NO: 63877 - protein, 10 aa, Dengue virus
MAILGDTAWD

SEQ ID NO: 63878 - protein, 10 aa, Dengue virus
AILGDTAWDF

SEQ ID NO: 63879 - protein, 10 aa, Dengue virus
ILGDTAWDFG

SEQ ID NO: 63880 - protein, 10 aa, Dengue virus
LGDTAWDFGS

SEQ ID NO: 63881 - protein, 10 aa, Dengue virus
GDTAWDFGSV

SEQ ID NO: 63882 - protein, 10 aa, Dengue virus
DTAWDFGSVG

SEQ ID NO: 63883 - protein, 10 aa, Dengue virus
TAWDFGSVGG

SEQ ID NO: 63884 - protein, 10 aa, Dengue virus
AWDFGSVGGV

SEQ ID NO: 63885 - protein, 10 aa, Dengue virus
WDFGSVGGVL

SEQ ID NO: 63886 - protein, 10 aa, Dengue virus
DFGSVGGVLN

SEQ ID NO: 63887 - protein, 10 aa, Dengue virus
FGSVGGVLNS

SEQ ID NO: 63888 - protein, 10 aa, Dengue virus
GSVGGVLNSL

SEQ ID NO: 63889 - protein, 10 aa, Dengue virus
SVGGVLNSLG

SEQ ID NO: 63890 - protein, 10 aa, Dengue virus
VGGVLNSLGK

SEQ ID NO: 63891 - protein, 10 aa, Dengue virus
GGVLNSLGKM

SEQ ID NO: 63892 - protein, 10 aa, Dengue virus
GVLNSLGKMV

SEQ ID NO: 63893 - protein, 10 aa, Dengue virus
VLNSLGKMVH

SEQ ID NO: 63894 - protein, 10 aa, Dengue virus
LNSLGKMVHQ

SEQ ID NO: 63895 - protein, 10 aa, Dengue virus
NSLGKMVHQI

SEQ ID NO: 63896 - protein, 10 aa, Dengue virus
SLGKMVHQIF

SEQ ID NO: 63897 - protein, 10 aa, Dengue virus
LGKMVHQIFG

SEQ ID NO: 63898 - protein, 10 aa, Dengue virus
GKMVHQIFGS

SEQ ID NO: 63899 - protein, 10 aa, Dengue virus
KMVHQIFGSA

SEQ ID NO: 63900 - protein, 10 aa, Dengue virus
MVHQIFGSAY

SEQ ID NO: 63901 - protein, 10 aa, Dengue virus
VHQIFGSAYT

SEQ ID NO: 63902 - protein, 10 aa, Dengue virus
HQIFGSAYTA

SEQ ID NO: 63903 - protein, 10 aa, Dengue virus
QIFGSAYTAL

SEQ ID NO: 63904 - protein, 10 aa, Dengue virus
IFGSAYTALF

SEQ ID NO: 63905 - protein, 10 aa, Dengue virus
FGSAYTALFS

SEQ ID NO: 63906 - protein, 10 aa, Dengue virus
GSAYTALFSG

SEQ ID NO: 63907 - protein, 10 aa, Dengue virus
SAYTALFSGV

SEQ ID NO: 63908 - protein, 10 aa, Dengue virus
AYTALFSGVS

SEQ ID NO: 63909 - protein, 10 aa, Dengue virus
YTALFSGVSW

SEQ ID NO: 63910 - protein, 10 aa, Dengue virus
TALFSGVSWV

SEQ ID NO: 63911 - protein, 10 aa, Dengue virus
ALFSGVSWVM

SEQ ID NO: 63912 - protein, 10 aa, Dengue virus
LFSGVSWVMK

SEQ ID NO: 63913 - protein, 10 aa, Dengue virus
FSGVSWVMKI

SEQ ID NO: 63914 - protein, 10 aa, Dengue virus
SGVSWVMKIG

SEQ ID NO: 63915 - protein, 10 aa, Dengue virus
GVSWVMKIGI

SEQ ID NO: 63916 - protein, 10 aa, Dengue virus
VSWVMKIGIG

SEQ ID NO: 63917 - protein, 10 aa, Dengue virus
SWVMKIGIGV

SEQ ID NO: 63918 - protein, 10 aa, Dengue virus
WVMKIGIGVL

SEQ ID NO: 63919 - protein, 10 aa, Dengue virus
VMKIGIGVLL

SEQ ID NO: 63920 - protein, 10 aa, Dengue virus
MKIGIGVLLT

SEQ ID NO: 63921 - protein, 10 aa, Dengue virus
KIGIGVLLTW

SEQ ID NO: 63922 - protein, 10 aa, Dengue virus
IGIGVLLTWI

SEQ ID NO: 63923 - protein, 10 aa, Dengue virus
GIGVLLTWIG

SEQ ID NO: 63924 - protein, 10 aa, Dengue virus
IGVLLTWIGL

SEQ ID NO: 63925 - protein, 10 aa, Dengue virus
GVLLTWIGLN

SEQ ID NO: 63926 - protein, 10 aa, Dengue virus
VLLTWIGLNS

SEQ ID NO: 63927 - protein, 10 aa, Dengue virus
LLTWIGLNSK

SEQ ID NO: 63928 - protein, 10 aa, Dengue virus
LTWIGLNSKN

SEQ ID NO: 63929 - protein, 10 aa, Dengue virus
TWIGLNSKNT

SEQ ID NO: 63930 - protein, 10 aa, Dengue virus
WIGLNSKNTS

SEQ ID NO: 63931 - protein, 10 aa, Dengue virus
IGLNSKNTSM

SEQ ID NO: 63932 - protein, 10 aa, Dengue virus
GLNSKNTSMS

SEQ ID NO: 63933 - protein, 10 aa, Dengue virus
LNSKNTSMSF

SEQ ID NO: 63934 - protein, 10 aa, Dengue virus
NSKNTSMSFS

SEQ ID NO: 63935 - protein, 10 aa, Dengue virus
SKNTSMSFSC

SEQ ID NO: 63936 - protein, 10 aa, Dengue virus
KNTSMSFSCI

SEQ ID NO: 63937 - protein, 10 aa, Dengue virus
NTSMSFSCIA

SEQ ID NO: 63938 - protein, 10 aa, Dengue virus
TSMSFSCIAI

SEQ ID NO: 63939 - protein, 10 aa, Dengue virus
SMSFSCIAIG

SEQ ID NO: 63940 - protein, 10 aa, Dengue virus
MSFSCIAIGI

SEQ ID NO: 63941 - protein, 10 aa, Dengue virus
SFSCIAIGII

SEQ ID NO: 63942 - protein, 10 aa, Dengue virus
FSCIAIGIIT

SEQ ID NO: 63943 - protein, 10 aa, Dengue virus
SCIAIGIITL

SEQ ID NO: 63944 - protein, 10 aa, Dengue virus
CIAIGIITLY

SEQ ID NO: 63945 - protein, 10 aa, Dengue virus
IAIGIITLYL

SEQ ID NO: 63946 - protein, 10 aa, Dengue virus
AIGIITLYLG

SEQ ID NO: 63947 - protein, 10 aa, Dengue virus
IGIITLYLGA

SEQ ID NO: 63948 - protein, 10 aa, Dengue virus
GIITLYLGAV

SEQ ID NO: 63949 - protein, 10 aa, Dengue virus
IITLYLGAVV

SEQ ID NO: 63950 - protein, 10 aa, Dengue virus
ITLYLGAVVQ

SEQ ID NO: 63951 - protein, 10 aa, Dengue virus
TLYLGAVVQA

SEQ ID NO: 63952 - protein, 10 aa, Dengue virus
LYLGAVVQAD

SEQ ID NO: 63953 - protein, 10 aa, Dengue virus
YLGAVVQADM

SEQ ID NO: 63954 - protein, 10 aa, Dengue virus
LGAVVQADMG

SEQ ID NO: 63955 - protein, 10 aa, Dengue virus
GAVVQADMGC

SEQ ID NO: 63956 - protein, 10 aa, Dengue virus
AVVQADMGCV

SEQ ID NO: 63957 - protein, 10 aa, Dengue virus
VVQADMGCVI

SEQ ID NO: 63958 - protein, 10 aa, Dengue virus
VQADMGCVIN

SEQ ID NO: 63959 - protein, 10 aa, Dengue virus
QADMGCVINW

SEQ ID NO: 63960 - protein, 10 aa, Dengue virus
ADMGCVINWK

SEQ ID NO: 63961 - protein, 10 aa, Dengue virus
DMGCVINWKG

SEQ ID NO: 63962 - protein, 10 aa, Dengue virus
MGCVINWKGK

SEQ ID NO: 63963 - protein, 10 aa, Dengue virus
GCVINWKGKE

SEQ ID NO: 63964 - protein, 10 aa, Dengue virus
CVINWKGKEL

SEQ ID NO: 63965 - protein, 10 aa, Dengue virus
VINWKGKELK

SEQ ID NO: 63966 - protein, 10 aa, Dengue virus
INWKGKELKC

SEQ ID NO: 63967 - protein, 10 aa, Dengue virus
NWKGKELKCG

SEQ ID NO: 63968 - protein, 10 aa, Dengue virus
WKGKELKCGS

SEQ ID NO: 63969 - protein, 10 aa, Dengue virus
KGKELKCGSG

SEQ ID NO: 63970 - protein, 10 aa, Dengue virus
GKELKCGSGI

SEQ ID NO: 63971 - protein, 10 aa, Dengue virus
KELKCGSGIF

SEQ ID NO: 63972 - protein, 10 aa, Dengue virus
ELKCGSGIFV

SEQ ID NO: 63973 - protein, 10 aa, Dengue virus
LKCGSGIFVT

SEQ ID NO: 63974 - protein, 10 aa, Dengue virus
KCGSGIFVTN

SEQ ID NO: 63975 - protein, 10 aa, Dengue virus
CGSGIFVTNE

SEQ ID NO: 63976 - protein, 10 aa, Dengue virus
GSGIFVTNEV

SEQ ID NO: 63977 - protein, 10 aa, Dengue virus
SGIFVTNEVH

SEQ ID NO: 63978 - protein, 10 aa, Dengue virus
GIFVTNEVHT

SEQ ID NO: 63979 - protein, 10 aa, Dengue virus
IFVTNEVHTW

SEQ ID NO: 63980 - protein, 10 aa, Dengue virus
FVTNEVHTWT

SEQ ID NO: 63981 - protein, 10 aa, Dengue virus
VTNEVHTWTE

SEQ ID NO: 63982 - protein, 10 aa, Dengue virus
TNEVHTWTEQ

SEQ ID NO: 63983 - protein, 10 aa, Dengue virus
NEVHTWTEQY

SEQ ID NO: 63984 - protein, 10 aa, Dengue virus
EVHTWTEQYK

SEQ ID NO: 63985 - protein, 10 aa, Dengue virus
VHTWTEQYKF

SEQ ID NO: 63986 - protein, 10 aa, Dengue virus
HTWTEQYKFQ

SEQ ID NO: 63987 - protein, 10 aa, Dengue virus
TWTEQYKFQA

SEQ ID NO: 63988 - protein, 10 aa, Dengue virus
WTEQYKFQAD

SEQ ID NO: 63989 - protein, 10 aa, Dengue virus
TEQYKFQADS

SEQ ID NO: 63990 - protein, 10 aa, Dengue virus
EQYKFQADSP

SEQ ID NO: 63991 - protein, 10 aa, Dengue virus
QYKFQADSPK

SEQ ID NO: 63992 - protein, 10 aa, Dengue virus
YKFQADSPKR

SEQ ID NO: 63993 - protein, 10 aa, Dengue virus
KFQADSPKRL

SEQ ID NO: 63994 - protein, 10 aa, Dengue virus
FQADSPKRLA

SEQ ID NO: 63995 - protein, 10 aa, Dengue virus
QADSPKRLAT

SEQ ID NO: 63996 - protein, 10 aa, Dengue virus
ADSPKRLATA

SEQ ID NO: 63997 - protein, 10 aa, Dengue virus
DSPKRLATAI

SEQ ID NO: 63998 - protein, 10 aa, Dengue virus
SPKRLATAIA

SEQ ID NO: 63999 - protein, 10 aa, Dengue virus
PKRLATAIAG

SEQ ID NO: 64000 - protein, 10 aa, Dengue virus
KRLATAIAGA

SEQ ID NO: 64001 - protein, 10 aa, Dengue virus
RLATAIAGAW

SEQ ID NO: 64002 - protein, 10 aa, Dengue virus
LATAIAGAWE

SEQ ID NO: 64003 - protein, 10 aa, Dengue virus
ATAIAGAWEN

SEQ ID NO: 64004 - protein, 10 aa, Dengue virus
TAIAGAWENG

SEQ ID NO: 64005 - protein, 10 aa, Dengue virus
AIAGAWENGV

SEQ ID NO: 64006 - protein, 10 aa, Dengue virus
IAGAWENGVC

SEQ ID NO: 64007 - protein, 10 aa, Dengue virus
AGAWENGVCG

SEQ ID NO: 64008 - protein, 10 aa, Dengue virus
GAWENGVCGI

SEQ ID NO: 64009 - protein, 10 aa, Dengue virus
AWENGVCGIR

SEQ ID NO: 64010 - protein, 10 aa, Dengue virus
WENGVCGIRS

SEQ ID NO: 64011 - protein, 10 aa, Dengue virus
ENGVCGIRST

SEQ ID NO: 64012 - protein, 10 aa, Dengue virus
NGVCGIRSTT

SEQ ID NO: 64013 - protein, 10 aa, Dengue virus
GVCGIRSTTR

SEQ ID NO: 64014 - protein, 10 aa, Dengue virus
VCGIRSTTRM

SEQ ID NO: 64015 - protein, 10 aa, Dengue virus
CGIRSTTRME

SEQ ID NO: 64016 - protein, 10 aa, Dengue virus
GIRSTTRMEN

SEQ ID NO: 64017 - protein, 10 aa, Dengue virus
IRSTTRMENL

SEQ ID NO: 64018 - protein, 10 aa, Dengue virus
RSTTRMENLL

SEQ ID NO: 64019 - protein, 10 aa, Dengue virus
STTRMENLLW

SEQ ID NO: 64020 - protein, 10 aa, Dengue virus
TTRMENLLWK

SEQ ID NO: 64021 - protein, 10 aa, Dengue virus
TRMENLLWKQ

SEQ ID NO: 64022 - protein, 10 aa, Dengue virus
RMENLLWKQI

SEQ ID NO: 64023 - protein, 10 aa, Dengue virus
MENLLWKQIA

SEQ ID NO: 64024 - protein, 10 aa, Dengue virus
ENLLWKQIAN

SEQ ID NO: 64025 - protein, 10 aa, Dengue virus
NLLWKQIANE

SEQ ID NO: 64026 - protein, 10 aa, Dengue virus
LLWKQIANEL

SEQ ID NO: 64027 - protein, 10 aa, Dengue virus
LWKQIANELN

SEQ ID NO: 64028 - protein, 10 aa, Dengue virus
WKQIANELNY

SEQ ID NO: 64029 - protein, 10 aa, Dengue virus
KQIANELNYI

SEQ ID NO: 64030 - protein, 10 aa, Dengue virus
QIANELNYIL

SEQ ID NO: 64031 - protein, 10 aa, Dengue virus
IANELNYILW

SEQ ID NO: 64032 - protein, 10 aa, Dengue virus
ANELNYILWE

SEQ ID NO: 64033 - protein, 10 aa, Dengue virus
NELNYILWEN

SEQ ID NO: 64034 - protein, 10 aa, Dengue virus
ELNYILWENN

SEQ ID NO: 64035 - protein, 10 aa, Dengue virus
LNYILWENNI

SEQ ID NO: 64036 - protein, 10 aa, Dengue virus
NYILWENNIK

SEQ ID NO: 64037 - protein, 10 aa, Dengue virus
YILWENNIKL

SEQ ID NO: 64038 - protein, 10 aa, Dengue virus
ILWENNIKLT

SEQ ID NO: 64039 - protein, 10 aa, Dengue virus
LWENNIKLTV

SEQ ID NO: 64040 - protein, 10 aa, Dengue virus
WENNIKLTVV

SEQ ID NO: 64041 - protein, 10 aa, Dengue virus
ENNIKLTVVV

SEQ ID NO: 64042 - protein, 10 aa, Dengue virus
NNIKLTVVVG

SEQ ID NO: 64043 - protein, 10 aa, Dengue virus
NIKLTVVVGD

SEQ ID NO: 64044 - protein, 10 aa, Dengue virus
IKLTVVVGDI

SEQ ID NO: 64045 - protein, 10 aa, Dengue virus
LTVVVGDIIG

SEQ ID NO: 64046 - protein, 10 aa, Dengue virus
IGVLEQGKRT

SEQ ID NO: 64047 - protein, 10 aa, Dengue virus
GVLEQGKRTL

SEQ ID NO: 64048 - protein, 10 aa, Dengue virus
VLEQGKRTLT

SEQ ID NO: 64049 - protein, 10 aa, Dengue virus
LEQGKRTLTP

SEQ ID NO: 64050 - protein, 10 aa, Dengue virus
EQGKRTLTPQ

SEQ ID NO: 64051 - protein, 10 aa, Dengue virus
QGKRTLTPQP

SEQ ID NO: 64052 - protein, 10 aa, Dengue virus
GKRTLTPQPM

SEQ ID NO: 64053 - protein, 10 aa, Dengue virus
KRTLTPQPME

SEQ ID NO: 64054 - protein, 10 aa, Dengue virus
RTLTPQPMEL

SEQ ID NO: 64055 - protein, 10 aa, Dengue virus
TLTPQPMELK

SEQ ID NO: 64056 - protein, 10 aa, Dengue virus
LTPQPMELKY

SEQ ID NO: 64057 - protein, 10 aa, Dengue virus
TPQPMELKYS

SEQ ID NO: 64058 - protein, 10 aa, Dengue virus
PQPMELKYSW

SEQ ID NO: 64059 - protein, 10 aa, Dengue virus
QPMELKYSWK

SEQ ID NO: 64060 - protein, 10 aa, Dengue virus
PMELKYSWKT

SEQ ID NO: 64061 - protein, 10 aa, Dengue virus
MELKYSWKTW

SEQ ID NO: 64062 - protein, 10 aa, Dengue virus
ELKYSWKTWG

SEQ ID NO: 64063 - protein, 10 aa, Dengue virus
LKYSWKTWGK

SEQ ID NO: 64064 - protein, 10 aa, Dengue virus
KYSWKTWGKA

SEQ ID NO: 64065 - protein, 10 aa, Dengue virus
YSWKTWGKAK

SEQ ID NO: 64066 - protein, 10 aa, Dengue virus
SWKTWGKAKI

SEQ ID NO: 64067 - protein, 10 aa, Dengue virus
WKTWGKAKIV

SEQ ID NO: 64068 - protein, 10 aa, Dengue virus
WGKAKIVTAE

SEQ ID NO: 64069 - protein, 10 aa, Dengue virus
AETQNSSFII

SEQ ID NO: 64070 - protein, 10 aa, Dengue virus
ETQNSSFIID

SEQ ID NO: 64071 - protein, 10 aa, Dengue virus
TQNSSFIIDG

SEQ ID NO: 64072 - protein, 10 aa, Dengue virus
QNSSFIIDGP

SEQ ID NO: 64073 - protein, 10 aa, Dengue virus
NSSFIIDGPN

SEQ ID NO: 64074 - protein, 10 aa, Dengue virus
SSFIIDGPNT

SEQ ID NO: 64075 - protein, 10 aa, Dengue virus
SFIIDGPNTP

SEQ ID NO: 64076 - protein, 10 aa, Dengue virus
FIIDGPNTPE

SEQ ID NO: 64077 - protein, 10 aa, Dengue virus
IIDGPNTPEC

SEQ ID NO: 64078 - protein, 10 aa, Dengue virus
IDGPNTPECP

SEQ ID NO: 64079 - protein, 10 aa, Dengue virus
DGPNTPECPS

SEQ ID NO: 64080 - protein, 10 aa, Dengue virus
GPNTPECPSA

SEQ ID NO: 64081 - protein, 10 aa, Dengue virus
PSASRAWNVW

SEQ ID NO: 64082 - protein, 10 aa, Dengue virus
SASRAWNVWE

SEQ ID NO: 64083 - protein, 10 aa, Dengue virus
ASRAWNVWEV

SEQ ID NO: 64084 - protein, 10 aa, Dengue virus
SRAWNVWEVE

SEQ ID NO: 64085 - protein, 10 aa, Dengue virus
RAWNVWEVED

SEQ ID NO: 64086 - protein, 10 aa, Dengue virus
AWNVWEVEDY

SEQ ID NO: 64087 - protein, 10 aa, Dengue virus
WNVWEVEDYG

SEQ ID NO: 64088 - protein, 10 aa, Dengue virus
NVWEVEDYGF

SEQ ID NO: 64089 - protein, 10 aa, Dengue virus
VWEVEDYGFG

SEQ ID NO: 64090 - protein, 10 aa, Dengue virus
WEVEDYGFGV

SEQ ID NO: 64091 - protein, 10 aa, Dengue virus
EVEDYGFGVF

SEQ ID NO: 64092 - protein, 10 aa, Dengue virus
VEDYGFGVFT

SEQ ID NO: 64093 - protein, 10 aa, Dengue virus
EDYGFGVFTT

SEQ ID NO: 64094 - protein, 10 aa, Dengue virus
DYGFGVFTTN

SEQ ID NO: 64095 - protein, 10 aa, Dengue virus
YGFGVFTTNI

SEQ ID NO: 64096 - protein, 10 aa, Dengue virus
GFGVFTTNIW

SEQ ID NO: 64097 - protein, 10 aa, Dengue virus
FGVFTTNIWL

SEQ ID NO: 64098 - protein, 10 aa, Dengue virus
GVFTTNIWLK

SEQ ID NO: 64099 - protein, 10 aa, Dengue virus
VFTTNIWLKL

SEQ ID NO: 64100 - protein, 10 aa, Dengue virus
FTTNIWLKLR

SEQ ID NO: 64101 - protein, 10 aa, Dengue virus
TTNIWLKLRE

SEQ ID NO: 64102 - protein, 10 aa, Dengue virus
TNIWLKLREV

SEQ ID NO: 64103 - protein, 10 aa, Dengue virus
NIWLKLREVY

SEQ ID NO: 64104 - protein, 10 aa, Dengue virus
IWLKLREVYT

SEQ ID NO: 64105 - protein, 10 aa, Dengue virus
WLKLREVYTQ

SEQ ID NO: 64106 - protein, 10 aa, Dengue virus
TQLCDHRLMS

SEQ ID NO: 64107 - protein, 10 aa, Dengue virus
QLCDHRLMSA

SEQ ID NO: 64108 - protein, 10 aa, Dengue virus
LCDHRLMSAA

SEQ ID NO: 64109 - protein, 10 aa, Dengue virus
CDHRLMSAAV

SEQ ID NO: 64110 - protein, 10 aa, Dengue virus
DHRLMSAAVK

SEQ ID NO: 64111 - protein, 10 aa, Dengue virus
HRLMSAAVKD

SEQ ID NO: 64112 - protein, 10 aa, Dengue virus
RLMSAAVKDE

SEQ ID NO: 64113 - protein, 10 aa, Dengue virus
LMSAAVKDER

SEQ ID NO: 64114 - protein, 10 aa, Dengue virus
MSAAVKDERA

SEQ ID NO: 64115 - protein, 10 aa, Dengue virus
SAAVKDERAV

SEQ ID NO: 64116 - protein, 10 aa, Dengue virus
AAVKDERAVH

SEQ ID NO: 64117 - protein, 10 aa, Dengue virus
AVKDERAVHA

SEQ ID NO: 64118 - protein, 10 aa, Dengue virus
VKDERAVHAD

SEQ ID NO: 64119 - protein, 10 aa, Dengue virus
KDERAVHADM

SEQ ID NO: 64120 - protein, 10 aa, Dengue virus
DERAVHADMG

SEQ ID NO: 64121 - protein, 10 aa, Dengue virus
ERAVHADMGY

SEQ ID NO: 64122 - protein, 10 aa, Dengue virus
RAVHADMGYW

SEQ ID NO: 64123 - protein, 10 aa, Dengue virus
AVHADMGYWI

SEQ ID NO: 64124 - protein, 10 aa, Dengue virus
VHADMGYWIE

SEQ ID NO: 64125 - protein, 10 aa, Dengue virus
HADMGYWIES

SEQ ID NO: 64126 - protein, 10 aa, Dengue virus
ADMGYWIESQ

SEQ ID NO: 64127 - protein, 10 aa, Dengue virus
DMGYWIESQK

SEQ ID NO: 64128 - protein, 10 aa, Dengue virus
MGYWIESQKN

SEQ ID NO: 64129 - protein, 10 aa, Dengue virus
GYWIESQKNG

SEQ ID NO: 64130 - protein, 10 aa, Dengue virus
YWIESQKNGS

SEQ ID NO: 64131 - protein, 10 aa, Dengue virus
WIESQKNGSW

SEQ ID NO: 64132 - protein, 10 aa, Dengue virus
IESQKNGSWK

SEQ ID NO: 64133 - protein, 10 aa, Dengue virus
ESQKNGSWKL

SEQ ID NO: 64134 - protein, 10 aa, Dengue virus
SQKNGSWKLE

SEQ ID NO: 64135 - protein, 10 aa, Dengue virus
QKNGSWKLEK

SEQ ID NO: 64136 - protein, 10 aa, Dengue virus
KNGSWKLEKA

SEQ ID NO: 64137 - protein, 10 aa, Dengue virus
NGSWKLEKAS

SEQ ID NO: 64138 - protein, 10 aa, Dengue virus
GSWKLEKASL

SEQ ID NO: 64139 - protein, 10 aa, Dengue virus
SWKLEKASLI

SEQ ID NO: 64140 - protein, 10 aa, Dengue virus
WKLEKASLIE

SEQ ID NO: 64141 - protein, 10 aa, Dengue virus
KLEKASLIEV

SEQ ID NO: 64142 - protein, 10 aa, Dengue virus
LEKASLIEVK

SEQ ID NO: 64143 - protein, 10 aa, Dengue virus
EKASLIEVKT

SEQ ID NO: 64144 - protein, 10 aa, Dengue virus
KASLIEVKTC

SEQ ID NO: 64145 - protein, 10 aa, Dengue virus
ASLIEVKTCT

SEQ ID NO: 64146 - protein, 10 aa, Dengue virus
SLIEVKTCTW

SEQ ID NO: 64147 - protein, 10 aa, Dengue virus
LIEVKTCTWP

SEQ ID NO: 64148 - protein, 10 aa, Dengue virus
IEVKTCTWPK

SEQ ID NO: 64149 - protein, 10 aa, Dengue virus
EVKTCTWPKS

SEQ ID NO: 64150 - protein, 10 aa, Dengue virus
VKTCTWPKSH

SEQ ID NO: 64151 - protein, 10 aa, Dengue virus
KTCTWPKSHT

SEQ ID NO: 64152 - protein, 10 aa, Dengue virus
TCTWPKSHTL

SEQ ID NO: 64153 - protein, 10 aa, Dengue virus
CTWPKSHTLW

SEQ ID NO: 64154 - protein, 10 aa, Dengue virus
TWPKSHTLWS

SEQ ID NO: 64155 - protein, 10 aa, Dengue virus
WPKSHTLWSN

SEQ ID NO: 64156 - protein, 10 aa, Dengue virus
PKSHTLWSNG

SEQ ID NO: 64157 - protein, 10 aa, Dengue virus
KSHTLWSNGV

SEQ ID NO: 64158 - protein, 10 aa, Dengue virus
SHTLWSNGVL

SEQ ID NO: 64159 - protein, 10 aa, Dengue virus
HTLWSNGVLE

SEQ ID NO: 64160 - protein, 10 aa, Dengue virus
TLWSNGVLES

SEQ ID NO: 64161 - protein, 10 aa, Dengue virus
LWSNGVLESD

SEQ ID NO: 64162 - protein, 10 aa, Dengue virus
WSNGVLESDM

SEQ ID NO: 64163 - protein, 10 aa, Dengue virus
SNGVLESDMI

SEQ ID NO: 64164 - protein, 10 aa, Dengue virus
NGVLESDMII

SEQ ID NO: 64165 - protein, 10 aa, Dengue virus
GVLESDMIIP

SEQ ID NO: 64166 - protein, 10 aa, Dengue virus
VLESDMIIPK

SEQ ID NO: 64167 - protein, 10 aa, Dengue virus
LESDMIIPKS

SEQ ID NO: 64168 - protein, 10 aa, Dengue virus
ESDMIIPKSL

SEQ ID NO: 64169 - protein, 10 aa, Dengue virus
SDMIIPKSLA

SEQ ID NO: 64170 - protein, 10 aa, Dengue virus
DMIIPKSLAG

SEQ ID NO: 64171 - protein, 10 aa, Dengue virus
MIIPKSLAGP

SEQ ID NO: 64172 - protein, 10 aa, Dengue virus
IIPKSLAGPI

SEQ ID NO: 64173 - protein, 10 aa, Dengue virus
IPKSLAGPIS

SEQ ID NO: 64174 - protein, 10 aa, Dengue virus
PKSLAGPISQ

SEQ ID NO: 64175 - protein, 10 aa, Dengue virus
KSLAGPISQH

SEQ ID NO: 64176 - protein, 10 aa, Dengue virus
SLAGPISQHN

SEQ ID NO: 64177 - protein, 10 aa, Dengue virus
LAGPISQHNY

SEQ ID NO: 64178 - protein, 10 aa, Dengue virus
AGPISQHNYR

SEQ ID NO: 64179 - protein, 10 aa, Dengue virus
GPISQHNYRP

SEQ ID NO: 64180 - protein, 10 aa, Dengue virus
PISQHNYRPG

SEQ ID NO: 64181 - protein, 10 aa, Dengue virus
ISQHNYRPGY

SEQ ID NO: 64182 - protein, 10 aa, Dengue virus
SQHNYRPGYH

SEQ ID NO: 64183 - protein, 10 aa, Dengue virus
QHNYRPGYHT

SEQ ID NO: 64184 - protein, 10 aa, Dengue virus
HNYRPGYHTQ

SEQ ID NO: 64185 - protein, 10 aa, Dengue virus
NYRPGYHTQT

SEQ ID NO: 64186 - protein, 10 aa, Dengue virus
YRPGYHTQTA

SEQ ID NO: 64187 - protein, 10 aa, Dengue virus
RPGYHTQTAG

SEQ ID NO: 64188 - protein, 10 aa, Dengue virus
PGYHTQTAGP

SEQ ID NO: 64189 - protein, 10 aa, Dengue virus
GYHTQTAGPW

SEQ ID NO: 64190 - protein, 10 aa, Dengue virus
YHTQTAGPWH

SEQ ID NO: 64191 - protein, 10 aa, Dengue virus
HTQTAGPWHL

SEQ ID NO: 64192 - protein, 10 aa, Dengue virus
TQTAGPWHLG

SEQ ID NO: 64193 - protein, 10 aa, Dengue virus
QTAGPWHLGK

SEQ ID NO: 64194 - protein, 10 aa, Dengue virus
TAGPWHLGKL

SEQ ID NO: 64195 - protein, 10 aa, Dengue virus
AGPWHLGKLE

SEQ ID NO: 64196 - protein, 10 aa, Dengue virus
GPWHLGKLEL

SEQ ID NO: 64197 - protein, 10 aa, Dengue virus
PWHLGKLELD

SEQ ID NO: 64198 - protein, 10 aa, Dengue virus
WHLGKLELDF

SEQ ID NO: 64199 - protein, 10 aa, Dengue virus
HLGKLELDFN

SEQ ID NO: 64200 - protein, 10 aa, Dengue virus
LGKLELDFNY

SEQ ID NO: 64201 - protein, 10 aa, Dengue virus
GKLELDFNYC

SEQ ID NO: 64202 - protein, 10 aa, Dengue virus
KLELDFNYCE

SEQ ID NO: 64203 - protein, 10 aa, Dengue virus
LELDFNYCEG

SEQ ID NO: 64204 - protein, 10 aa, Dengue virus
ELDFNYCEGT

SEQ ID NO: 64205 - protein, 10 aa, Dengue virus
LDFNYCEGTT

SEQ ID NO: 64206 - protein, 10 aa, Dengue virus
DFNYCEGTTV

SEQ ID NO: 64207 - protein, 10 aa, Dengue virus
FNYCEGTTVV

SEQ ID NO: 64208 - protein, 10 aa, Dengue virus
NYCEGTTVVI

SEQ ID NO: 64209 - protein, 10 aa, Dengue virus
YCEGTTVVIT

SEQ ID NO: 64210 - protein, 10 aa, Dengue virus
CEGTTVVITE

SEQ ID NO: 64211 - protein, 10 aa, Dengue virus
EGTTVVITEN

SEQ ID NO: 64212 - protein, 10 aa, Dengue virus
GTTVVITENC

SEQ ID NO: 64213 - protein, 10 aa, Dengue virus
TTVVITENCG

SEQ ID NO: 64214 - protein, 10 aa, Dengue virus
TVVITENCGT

SEQ ID NO: 64215 - protein, 10 aa, Dengue virus
CGTRGPSLRT

SEQ ID NO: 64216 - protein, 10 aa, Dengue virus
GTRGPSLRTT

SEQ ID NO: 64217 - protein, 10 aa, Dengue virus
TRGPSLRTTT

SEQ ID NO: 64218 - protein, 10 aa, Dengue virus
RGPSLRTTTV

SEQ ID NO: 64219 - protein, 10 aa, Dengue virus
GPSLRTTTVS

SEQ ID NO: 64220 - protein, 10 aa, Dengue virus
PSLRTTTVSG

SEQ ID NO: 64221 - protein, 10 aa, Dengue virus
SLRTTTVSGK

SEQ ID NO: 64222 - protein, 10 aa, Dengue virus
LRTTTVSGKL

SEQ ID NO: 64223 - protein, 10 aa, Dengue virus
RTTTVSGKLI

SEQ ID NO: 64224 - protein, 10 aa, Dengue virus
TTTVSGKLIH

SEQ ID NO: 64225 - protein, 10 aa, Dengue virus
TTVSGKLIHE

SEQ ID NO: 64226 - protein, 10 aa, Dengue virus
TVSGKLIHEW

SEQ ID NO: 64227 - protein, 10 aa, Dengue virus
VSGKLIHEWC

SEQ ID NO: 64228 - protein, 10 aa, Dengue virus
SGKLIHEWCC

SEQ ID NO: 64229 - protein, 10 aa, Dengue virus
GKLIHEWCCR

SEQ ID NO: 64230 - protein, 10 aa, Dengue virus
KLIHEWCCRS

SEQ ID NO: 64231 - protein, 10 aa, Dengue virus
LIHEWCCRSC

SEQ ID NO: 64232 - protein, 10 aa, Dengue virus
IHEWCCRSCT

SEQ ID NO: 64233 - protein, 10 aa, Dengue virus
HEWCCRSCTL

SEQ ID NO: 64234 - protein, 10 aa, Dengue virus
EWCCRSCTLP

SEQ ID NO: 64235 - protein, 10 aa, Dengue virus
WCCRSCTLPP

SEQ ID NO: 64236 - protein, 10 aa, Dengue virus
CCRSCTLPPL

SEQ ID NO: 64237 - protein, 10 aa, Dengue virus
CRSCTLPPLR

SEQ ID NO: 64238 - protein, 10 aa, Dengue virus
RSCTLPPLRY

SEQ ID NO: 64239 - protein, 10 aa, Dengue virus
SCTLPPLRYM

SEQ ID NO: 64240 - protein, 10 aa, Dengue virus
CTLPPLRYMG

SEQ ID NO: 64241 - protein, 10 aa, Dengue virus
TLPPLRYMGE

SEQ ID NO: 64242 - protein, 10 aa, Dengue virus
LPPLRYMGED

SEQ ID NO: 64243 - protein, 10 aa, Dengue virus
PPLRYMGEDG

SEQ ID NO: 64244 - protein, 10 aa, Dengue virus
PLRYMGEDGC

SEQ ID NO: 64245 - protein, 10 aa, Dengue virus
LRYMGEDGCW

SEQ ID NO: 64246 - protein, 10 aa, Dengue virus
RYMGEDGCWY

SEQ ID NO: 64247 - protein, 10 aa, Dengue virus
YMGEDGCWYG

SEQ ID NO: 64248 - protein, 10 aa, Dengue virus
MGEDGCWYGM

SEQ ID NO: 64249 - protein, 10 aa, Dengue virus
GEDGCWYGME

SEQ ID NO: 64250 - protein, 10 aa, Dengue virus
EDGCWYGMEI

SEQ ID NO: 64251 - protein, 10 aa, Dengue virus
DGCWYGMEIR

SEQ ID NO: 64252 - protein, 10 aa, Dengue virus
GCWYGMEIRP

SEQ ID NO: 64253 - protein, 10 aa, Dengue virus
CWYGMEIRPI

SEQ ID NO: 64254 - protein, 10 aa, Dengue virus
WYGMEIRPIS

SEQ ID NO: 64255 - protein, 10 aa, Dengue virus
YGMEIRPISE

SEQ ID NO: 64256 - protein, 10 aa, Dengue virus
GMEIRPISEK

SEQ ID NO: 64257 - protein, 10 aa, Dengue virus
MEIRPISEKE

SEQ ID NO: 64258 - protein, 10 aa, Dengue virus
EIRPISEKEE

SEQ ID NO: 64259 - protein, 10 aa, Dengue virus
IRPISEKEEN

SEQ ID NO: 64260 - protein, 10 aa, Dengue virus
RPISEKEENM

SEQ ID NO: 64261 - protein, 10 aa, Dengue virus
PISEKEENMV

SEQ ID NO: 64262 - protein, 10 aa, Dengue virus
ISEKEENMVK

SEQ ID NO: 64263 - protein, 10 aa, Dengue virus
SEKEENMVKS

SEQ ID NO: 64264 - protein, 10 aa, Dengue virus
EKEENMVKSL

SEQ ID NO: 64265 - protein, 10 aa, Dengue virus
KEENMVKSLV

SEQ ID NO: 64266 - protein, 10 aa, Dengue virus
EENMVKSLVS

SEQ ID NO: 64267 - protein, 10 aa, Dengue virus
ENMVKSLVSA

SEQ ID NO: 64268 - protein, 10 aa, Dengue virus
NMVKSLVSAG

SEQ ID NO: 64269 - protein, 10 aa, Dengue virus
MVKSLVSAGS

SEQ ID NO: 64270 - protein, 10 aa, Dengue virus
VKSLVSAGSG

SEQ ID NO: 64271 - protein, 10 aa, Dengue virus
KSLVSAGSGK

SEQ ID NO: 64272 - protein, 10 aa, Dengue virus
SLVSAGSGKV

SEQ ID NO: 64273 - protein, 10 aa, Dengue virus
LVSAGSGKVD

SEQ ID NO: 64274 - protein, 10 aa, Dengue virus
VSAGSGKVDN

SEQ ID NO: 64275 - protein, 10 aa, Dengue virus
SAGSGKVDNF

SEQ ID NO: 64276 - protein, 10 aa, Dengue virus
AGSGKVDNFT

SEQ ID NO: 64277 - protein, 10 aa, Dengue virus
GSGKVDNFTM

SEQ ID NO: 64278 - protein, 10 aa, Dengue virus
SGKVDNFTMG

SEQ ID NO: 64279 - protein, 10 aa, Dengue virus
VDNFTMGVLC

SEQ ID NO: 64280 - protein, 10 aa, Dengue virus
DNFTMGVLCL

SEQ ID NO: 64281 - protein, 10 aa, Dengue virus
NFTMGVLCLA

SEQ ID NO: 64282 - protein, 10 aa, Dengue virus
FTMGVLCLAI

SEQ ID NO: 64283 - protein, 10 aa, Dengue virus
TMGVLCLAIL

SEQ ID NO: 64284 - protein, 10 aa, Dengue virus
MGVLCLAILF

SEQ ID NO: 64285 - protein, 10 aa, Dengue virus
GVLCLAILFE

SEQ ID NO: 64286 - protein, 10 aa, Dengue virus
VLCLAILFEE

SEQ ID NO: 64287 - protein, 10 aa, Dengue virus
LCLAILFEEV

SEQ ID NO: 64288 - protein, 10 aa, Dengue virus
CLAILFEEVM

SEQ ID NO: 64289 - protein, 10 aa, Dengue virus
LAILFEEVMR

SEQ ID NO: 64290 - protein, 10 aa, Dengue virus
AILFEEVMRG

SEQ ID NO: 64291 - protein, 10 aa, Dengue virus
ILFEEVMRGK

SEQ ID NO: 64292 - protein, 10 aa, Dengue virus
LFEEVMRGKF

SEQ ID NO: 64293 - protein, 10 aa, Dengue virus
FEEVMRGKFG

SEQ ID NO: 64294 - protein, 10 aa, Dengue virus
EEVMRGKFGK

SEQ ID NO: 64295 - protein, 10 aa, Dengue virus
EVMRGKFGKK

SEQ ID NO: 64296 - protein, 10 aa, Dengue virus
VMRGKFGKKH

SEQ ID NO: 64297 - protein, 10 aa, Dengue virus
MRGKFGKKHM

SEQ ID NO: 64298 - protein, 10 aa, Dengue virus
RGKFGKKHMI

SEQ ID NO: 64299 - protein, 10 aa, Dengue virus
GKFGKKHMIA

SEQ ID NO: 64300 - protein, 10 aa, Dengue virus
KFGKKHMIAG

SEQ ID NO: 64301 - protein, 10 aa, Dengue virus
FGKKHMIAGV

SEQ ID NO: 64302 - protein, 10 aa, Dengue virus
FTFVLLLSGQ

SEQ ID NO: 64303 - protein, 10 aa, Dengue virus
TFVLLLSGQI

SEQ ID NO: 64304 - protein, 10 aa, Dengue virus
FVLLLSGQIT

SEQ ID NO: 64305 - protein, 10 aa, Dengue virus
VLLLSGQITW

SEQ ID NO: 64306 - protein, 10 aa, Dengue virus
LLLSGQITWR

SEQ ID NO: 64307 - protein, 10 aa, Dengue virus
LLSGQITWRD

SEQ ID NO: 64308 - protein, 10 aa, Dengue virus
LSGQITWRDM

SEQ ID NO: 64309 - protein, 10 aa, Dengue virus
SGQITWRDMA

SEQ ID NO: 64310 - protein, 10 aa, Dengue virus
AHTLIMIGSN

SEQ ID NO: 64311 - protein, 10 aa, Dengue virus
HTLIMIGSNA

SEQ ID NO: 64312 - protein, 10 aa, Dengue virus
TLIMIGSNAS

SEQ ID NO: 64313 - protein, 10 aa, Dengue virus
LIMIGSNASD

SEQ ID NO: 64314 - protein, 10 aa, Dengue virus
IMIGSNASDR

SEQ ID NO: 64315 - protein, 10 aa, Dengue virus
MIGSNASDRM

SEQ ID NO: 64316 - protein, 10 aa, Dengue virus
IGSNASDRMG

SEQ ID NO: 64317 - protein, 10 aa, Dengue virus
GSNASDRMGM

SEQ ID NO: 64318 - protein, 10 aa, Dengue virus
SNASDRMGMG

SEQ ID NO: 64319 - protein, 10 aa, Dengue virus
NASDRMGMGV

SEQ ID NO: 64320 - protein, 10 aa, Dengue virus
ASDRMGMGVT

SEQ ID NO: 64321 - protein, 10 aa, Dengue virus
SDRMGMGVTY

SEQ ID NO: 64322 - protein, 10 aa, Dengue virus
DRMGMGVTYL

SEQ ID NO: 64323 - protein, 10 aa, Dengue virus
RMGMGVTYLA

SEQ ID NO: 64324 - protein, 10 aa, Dengue virus
MGMGVTYLAL

SEQ ID NO: 64325 - protein, 10 aa, Dengue virus
GMGVTYLALI

SEQ ID NO: 64326 - protein, 10 aa, Dengue virus
MGVTYLALIA

SEQ ID NO: 64327 - protein, 10 aa, Dengue virus
GVTYLALIAT

SEQ ID NO: 64328 - protein, 10 aa, Dengue virus
VTYLALIATF

SEQ ID NO: 64329 - protein, 10 aa, Dengue virus
TYLALIATFK

SEQ ID NO: 64330 - protein, 10 aa, Dengue virus
YLALIATFKI

SEQ ID NO: 64331 - protein, 10 aa, Dengue virus
LALIATFKIQ

SEQ ID NO: 64332 - protein, 10 aa, Dengue virus
ALIATFKIQP

SEQ ID NO: 64333 - protein, 10 aa, Dengue virus
LIATFKIQPF

SEQ ID NO: 64334 - protein, 10 aa, Dengue virus
IATFKIQPFL

SEQ ID NO: 64335 - protein, 10 aa, Dengue virus
ATFKIQPFLA

SEQ ID NO: 64336 - protein, 10 aa, Dengue virus
TFKIQPFLAL

SEQ ID NO: 64337 - protein, 10 aa, Dengue virus
FKIQPFLALG

SEQ ID NO: 64338 - protein, 10 aa, Dengue virus
KIQPFLALGF

SEQ ID NO: 64339 - protein, 10 aa, Dengue virus
IQPFLALGFF

SEQ ID NO: 64340 - protein, 10 aa, Dengue virus
QPFLALGFFL

SEQ ID NO: 64341 - protein, 10 aa, Dengue virus
PFLALGFFLR

SEQ ID NO: 64342 - protein, 10 aa, Dengue virus
FLALGFFLRK

SEQ ID NO: 64343 - protein, 10 aa, Dengue virus
LALGFFLRKL

SEQ ID NO: 64344 - protein, 10 aa, Dengue virus
ALGFFLRKLT

SEQ ID NO: 64345 - protein, 10 aa, Dengue virus
LGFFLRKLTS

SEQ ID NO: 64346 - protein, 10 aa, Dengue virus
GFFLRKLTSR

SEQ ID NO: 64347 - protein, 10 aa, Dengue virus
FFLRKLTSRE

SEQ ID NO: 64348 - protein, 10 aa, Dengue virus
FLRKLTSREN

SEQ ID NO: 64349 - protein, 10 aa, Dengue virus
LRKLTSRENL

SEQ ID NO: 64350 - protein, 10 aa, Dengue virus
RKLTSRENLL

SEQ ID NO: 64351 - protein, 10 aa, Dengue virus
KLTSRENLLL

SEQ ID NO: 64352 - protein, 10 aa, Dengue virus
LTSRENLLLG

SEQ ID NO: 64353 - protein, 10 aa, Dengue virus
TSRENLLLGV

SEQ ID NO: 64354 - protein, 10 aa, Dengue virus
SRENLLLGVG

SEQ ID NO: 64355 - protein, 10 aa, Dengue virus
RENLLLGVGL

SEQ ID NO: 64356 - protein, 10 aa, Dengue virus
ENLLLGVGLA

SEQ ID NO: 64357 - protein, 10 aa, Dengue virus
NLLLGVGLAM

SEQ ID NO: 64358 - protein, 10 aa, Dengue virus
LLLGVGLAMA

SEQ ID NO: 64359 - protein, 10 aa, Dengue virus
LLGVGLAMAT

SEQ ID NO: 64360 - protein, 10 aa, Dengue virus
LGVGLAMATT

SEQ ID NO: 64361 - protein, 10 aa, Dengue virus
GVGLAMATTL

SEQ ID NO: 64362 - protein, 10 aa, Dengue virus
VGLAMATTLQ

SEQ ID NO: 64363 - protein, 10 aa, Dengue virus
GLAMATTLQL

SEQ ID NO: 64364 - protein, 10 aa, Dengue virus
LAMATTLQLP

SEQ ID NO: 64365 - protein, 10 aa, Dengue virus
AMATTLQLPE

SEQ ID NO: 64366 - protein, 10 aa, Dengue virus
MATTLQLPED

SEQ ID NO: 64367 - protein, 10 aa, Dengue virus
ATTLQLPEDI

SEQ ID NO: 64368 - protein, 10 aa, Dengue virus
TTLQLPEDIE

SEQ ID NO: 64369 - protein, 10 aa, Dengue virus
TLQLPEDIEQ

SEQ ID NO: 64370 - protein, 10 aa, Dengue virus
LQLPEDIEQM

SEQ ID NO: 64371 - protein, 10 aa, Dengue virus
QLPEDIEQMA

SEQ ID NO: 64372 - protein, 10 aa, Dengue virus
LPEDIEQMAN

SEQ ID NO: 64373 - protein, 10 aa, Dengue virus
PEDIEQMANG

SEQ ID NO: 64374 - protein, 10 aa, Dengue virus
EDIEQMANGI

SEQ ID NO: 64375 - protein, 10 aa, Dengue virus
DIEQMANGIA

SEQ ID NO: 64376 - protein, 10 aa, Dengue virus
IEQMANGIAL

SEQ ID NO: 64377 - protein, 10 aa, Dengue virus
EQMANGIALG

SEQ ID NO: 64378 - protein, 10 aa, Dengue virus
QMANGIALGL

SEQ ID NO: 64379 - protein, 10 aa, Dengue virus
MANGIALGLM

SEQ ID NO: 64380 - protein, 10 aa, Dengue virus
ANGIALGLMA

SEQ ID NO: 64381 - protein, 10 aa, Dengue virus
NGIALGLMAL

SEQ ID NO: 64382 - protein, 10 aa, Dengue virus
GIALGLMALK

SEQ ID NO: 64383 - protein, 10 aa, Dengue virus
IALGLMALKL

SEQ ID NO: 64384 - protein, 10 aa, Dengue virus
ALGLMALKLI

SEQ ID NO: 64385 - protein, 10 aa, Dengue virus
LGLMALKLIT

SEQ ID NO: 64386 - protein, 10 aa, Dengue virus
GLMALKLITQ

SEQ ID NO: 64387 - protein, 10 aa, Dengue virus
LMALKLITQF

SEQ ID NO: 64388 - protein, 10 aa, Dengue virus
MALKLITQFE

SEQ ID NO: 64389 - protein, 10 aa, Dengue virus
ALKLITQFET

SEQ ID NO: 64390 - protein, 10 aa, Dengue virus
LKLITQFETY

SEQ ID NO: 64391 - protein, 10 aa, Dengue virus
KLITQFETYQ

SEQ ID NO: 64392 - protein, 10 aa, Dengue virus
LITQFETYQL

SEQ ID NO: 64393 - protein, 10 aa, Dengue virus
ITQFETYQLW

SEQ ID NO: 64394 - protein, 10 aa, Dengue virus
TQFETYQLWT

SEQ ID NO: 64395 - protein, 10 aa, Dengue virus
QFETYQLWTA

SEQ ID NO: 64396 - protein, 10 aa, Dengue virus
FETYQLWTAL

SEQ ID NO: 64397 - protein, 10 aa, Dengue virus
ETYQLWTALI

SEQ ID NO: 64398 - protein, 10 aa, Dengue virus
TYQLWTALIS

SEQ ID NO: 64399 - protein, 10 aa, Dengue virus
YQLWTALISL

SEQ ID NO: 64400 - protein, 10 aa, Dengue virus
QLWTALISLT

SEQ ID NO: 64401 - protein, 10 aa, Dengue virus
LWTALISLTC

SEQ ID NO: 64402 - protein, 10 aa, Dengue virus
ALISLTCSNT

SEQ ID NO: 64403 - protein, 10 aa, Dengue virus
SLTCSNTIFT

SEQ ID NO: 64404 - protein, 10 aa, Dengue virus
LTCSNTIFTL

SEQ ID NO: 64405 - protein, 10 aa, Dengue virus
TCSNTIFTLT

SEQ ID NO: 64406 - protein, 10 aa, Dengue virus
CSNTIFTLTV

SEQ ID NO: 64407 - protein, 10 aa, Dengue virus
SNTIFTLTVA

SEQ ID NO: 64408 - protein, 10 aa, Dengue virus
NTIFTLTVAW

SEQ ID NO: 64409 - protein, 10 aa, Dengue virus
TIFTLTVAWR

SEQ ID NO: 64410 - protein, 10 aa, Dengue virus
IFTLTVAWRT

SEQ ID NO: 64411 - protein, 10 aa, Dengue virus
FTLTVAWRTA

SEQ ID NO: 64412 - protein, 10 aa, Dengue virus
TLTVAWRTAT

SEQ ID NO: 64413 - protein, 10 aa, Dengue virus
LTVAWRTATL

SEQ ID NO: 64414 - protein, 10 aa, Dengue virus
TVAWRTATLI

SEQ ID NO: 64415 - protein, 10 aa, Dengue virus
VAWRTATLIL

SEQ ID NO: 64416 - protein, 10 aa, Dengue virus
AWRTATLILA

SEQ ID NO: 64417 - protein, 10 aa, Dengue virus
WRTATLILAG

SEQ ID NO: 64418 - protein, 10 aa, Dengue virus
RTATLILAGV

SEQ ID NO: 64419 - protein, 10 aa, Dengue virus
TATLILAGVS

SEQ ID NO: 64420 - protein, 10 aa, Dengue virus
ATLILAGVSL

SEQ ID NO: 64421 - protein, 10 aa, Dengue virus
TLILAGVSLL

SEQ ID NO: 64422 - protein, 10 aa, Dengue virus
LILAGVSLLP

SEQ ID NO: 64423 - protein, 10 aa, Dengue virus
VSLLPVCQSS

SEQ ID NO: 64424 - protein, 10 aa, Dengue virus
SLLPVCQSSS

SEQ ID NO: 64425 - protein, 10 aa, Dengue virus
LLPVCQSSSM

SEQ ID NO: 64426 - protein, 10 aa, Dengue virus
LPVCQSSSMR

SEQ ID NO: 64427 - protein, 10 aa, Dengue virus
PVCQSSSMRK

SEQ ID NO: 64428 - protein, 10 aa, Dengue virus
VCQSSSMRKT

SEQ ID NO: 64429 - protein, 10 aa, Dengue virus
CQSSSMRKTD

SEQ ID NO: 64430 - protein, 10 aa, Dengue virus
QSSSMRKTDW

SEQ ID NO: 64431 - protein, 10 aa, Dengue virus
SSSMRKTDWL

SEQ ID NO: 64432 - protein, 10 aa, Dengue virus
SSMRKTDWLP

SEQ ID NO: 64433 - protein, 10 aa, Dengue virus
SMRKTDWLPM

SEQ ID NO: 64434 - protein, 10 aa, Dengue virus
MRKTDWLPMT

SEQ ID NO: 64435 - protein, 10 aa, Dengue virus
RKTDWLPMTV

SEQ ID NO: 64436 - protein, 10 aa, Dengue virus
KTDWLPMTVA

SEQ ID NO: 64437 - protein, 10 aa, Dengue virus
TDWLPMTVAA

SEQ ID NO: 64438 - protein, 10 aa, Dengue virus
DWLPMTVAAM

SEQ ID NO: 64439 - protein, 10 aa, Dengue virus
WLPMTVAAMG

SEQ ID NO: 64440 - protein, 10 aa, Dengue virus
LPMTVAAMGV

SEQ ID NO: 64441 - protein, 10 aa, Dengue virus
VAAMGVPPLP

SEQ ID NO: 64442 - protein, 10 aa, Dengue virus
AAMGVPPLPL

SEQ ID NO: 64443 - protein, 10 aa, Dengue virus
AMGVPPLPLF

SEQ ID NO: 64444 - protein, 10 aa, Dengue virus
MGVPPLPLFI

SEQ ID NO: 64445 - protein, 10 aa, Dengue virus
GVPPLPLFIF

SEQ ID NO: 64446 - protein, 10 aa, Dengue virus
PLPLFIFSLK

SEQ ID NO: 64447 - protein, 10 aa, Dengue virus
LPLFIFSLKD

SEQ ID NO: 64448 - protein, 10 aa, Dengue virus
PLFIFSLKDT

SEQ ID NO: 64449 - protein, 10 aa, Dengue virus
LKDTLKRRSW

SEQ ID NO: 64450 - protein, 10 aa, Dengue virus
KDTLKRRSWP

SEQ ID NO: 64451 - protein, 10 aa, Dengue virus
DTLKRRSWPL

SEQ ID NO: 64452 - protein, 10 aa, Dengue virus
TLKRRSWPLN

SEQ ID NO: 64453 - protein, 10 aa, Dengue virus
LKRRSWPLNE

SEQ ID NO: 64454 - protein, 10 aa, Dengue virus
KRRSWPLNEG

SEQ ID NO: 64455 - protein, 10 aa, Dengue virus
RRSWPLNEGV

SEQ ID NO: 64456 - protein, 10 aa, Dengue virus
RSWPLNEGVM

SEQ ID NO: 64457 - protein, 10 aa, Dengue virus
SWPLNEGVMA

SEQ ID NO: 64458 - protein, 10 aa, Dengue virus
WPLNEGVMAV

SEQ ID NO: 64459 - protein, 10 aa, Dengue virus
PLNEGVMAVG

SEQ ID NO: 64460 - protein, 10 aa, Dengue virus
LNEGVMAVGL

SEQ ID NO: 64461 - protein, 10 aa, Dengue virus
NEGVMAVGLV

SEQ ID NO: 64462 - protein, 10 aa, Dengue virus
EGVMAVGLVS

SEQ ID NO: 64463 - protein, 10 aa, Dengue virus
GVMAVGLVSI

SEQ ID NO: 64464 - protein, 10 aa, Dengue virus
VMAVGLVSIL

SEQ ID NO: 64465 - protein, 10 aa, Dengue virus
MAVGLVSILA

SEQ ID NO: 64466 - protein, 10 aa, Dengue virus
AVGLVSILAS

SEQ ID NO: 64467 - protein, 10 aa, Dengue virus
VGLVSILASS

SEQ ID NO: 64468 - protein, 10 aa, Dengue virus
GLVSILASSL

SEQ ID NO: 64469 - protein, 10 aa, Dengue virus
LVSILASSLL

SEQ ID NO: 64470 - protein, 10 aa, Dengue virus
VSILASSLLR

SEQ ID NO: 64471 - protein, 10 aa, Dengue virus
SILASSLLRN

SEQ ID NO: 64472 - protein, 10 aa, Dengue virus
ILASSLLRND

SEQ ID NO: 64473 - protein, 10 aa, Dengue virus
LASSLLRNDV

SEQ ID NO: 64474 - protein, 10 aa, Dengue virus
ASSLLRNDVP

SEQ ID NO: 64475 - protein, 10 aa, Dengue virus
SSLLRNDVPM

SEQ ID NO: 64476 - protein, 10 aa, Dengue virus
SLLRNDVPMA

SEQ ID NO: 64477 - protein, 10 aa, Dengue virus
LLRNDVPMAG

SEQ ID NO: 64478 - protein, 10 aa, Dengue virus
LRNDVPMAGP

SEQ ID NO: 64479 - protein, 10 aa, Dengue virus
RNDVPMAGPL

SEQ ID NO: 64480 - protein, 10 aa, Dengue virus
NDVPMAGPLV

SEQ ID NO: 64481 - protein, 10 aa, Dengue virus
DVPMAGPLVA

SEQ ID NO: 64482 - protein, 10 aa, Dengue virus
VPMAGPLVAG

SEQ ID NO: 64483 - protein, 10 aa, Dengue virus
PMAGPLVAGG

SEQ ID NO: 64484 - protein, 10 aa, Dengue virus
MAGPLVAGGL

SEQ ID NO: 64485 - protein, 10 aa, Dengue virus
AGPLVAGGLL

SEQ ID NO: 64486 - protein, 10 aa, Dengue virus
GPLVAGGLLI

SEQ ID NO: 64487 - protein, 10 aa, Dengue virus
PLVAGGLLIA

SEQ ID NO: 64488 - protein, 10 aa, Dengue virus
LVAGGLLIAC

SEQ ID NO: 64489 - protein, 10 aa, Dengue virus
VAGGLLIACY

SEQ ID NO: 64490 - protein, 10 aa, Dengue virus
AGGLLIACYV

SEQ ID NO: 64491 - protein, 10 aa, Dengue virus
GGLLIACYVI

SEQ ID NO: 64492 - protein, 10 aa, Dengue virus
GLLIACYVIT

SEQ ID NO: 64493 - protein, 10 aa, Dengue virus
LLIACYVITG

SEQ ID NO: 64494 - protein, 10 aa, Dengue virus
LIACYVITGT

SEQ ID NO: 64495 - protein, 10 aa, Dengue virus
IACYVITGTS

SEQ ID NO: 64496 - protein, 10 aa, Dengue virus
ACYVITGTSA

SEQ ID NO: 64497 - protein, 10 aa, Dengue virus
CYVITGTSAD

SEQ ID NO: 64498 - protein, 10 aa, Dengue virus
YVITGTSADL

SEQ ID NO: 64499 - protein, 10 aa, Dengue virus
VITGTSADLT

SEQ ID NO: 64500 - protein, 10 aa, Dengue virus
ITGTSADLTV

SEQ ID NO: 64501 - protein, 10 aa, Dengue virus
TGTSADLTVE

SEQ ID NO: 64502 - protein, 10 aa, Dengue virus
GTSADLTVEK

SEQ ID NO: 64503 - protein, 10 aa, Dengue virus
TSADLTVEKA

SEQ ID NO: 64504 - protein, 10 aa, Dengue virus
SADLTVEKAA

SEQ ID NO: 64505 - protein, 10 aa, Dengue virus
ADLTVEKAAD

SEQ ID NO: 64506 - protein, 10 aa, Dengue virus
ADVTWEEEAE

SEQ ID NO: 64507 - protein, 10 aa, Dengue virus
DVTWEEEAEQ

SEQ ID NO: 64508 - protein, 10 aa, Dengue virus
VTWEEEAEQT

SEQ ID NO: 64509 - protein, 10 aa, Dengue virus
TWEEEAEQTG

SEQ ID NO: 64510 - protein, 10 aa, Dengue virus
WEEEAEQTGV

SEQ ID NO: 64511 - protein, 10 aa, Dengue virus
EEEAEQTGVS

SEQ ID NO: 64512 - protein, 10 aa, Dengue virus
EEAEQTGVSH

SEQ ID NO: 64513 - protein, 10 aa, Dengue virus
EAEQTGVSHN

SEQ ID NO: 64514 - protein, 10 aa, Dengue virus
AEQTGVSHNL

SEQ ID NO: 64515 - protein, 10 aa, Dengue virus
EQTGVSHNLM

SEQ ID NO: 64516 - protein, 10 aa, Dengue virus
QTGVSHNLMI

SEQ ID NO: 64517 - protein, 10 aa, Dengue virus
TGVSHNLMIT

SEQ ID NO: 64518 - protein, 10 aa, Dengue virus
GVSHNLMITV

SEQ ID NO: 64519 - protein, 10 aa, Dengue virus
VSHNLMITVD

SEQ ID NO: 64520 - protein, 10 aa, Dengue virus
SHNLMITVDD

SEQ ID NO: 64521 - protein, 10 aa, Dengue virus
HNLMITVDDD

SEQ ID NO: 64522 - protein, 10 aa, Dengue virus
NLMITVDDDG

SEQ ID NO: 64523 - protein, 10 aa, Dengue virus
LMITVDDDGT

SEQ ID NO: 64524 - protein, 10 aa, Dengue virus
MITVDDDGTM

SEQ ID NO: 64525 - protein, 10 aa, Dengue virus
ITVDDDGTMR

SEQ ID NO: 64526 - protein, 10 aa, Dengue virus
TVDDDGTMRI

SEQ ID NO: 64527 - protein, 10 aa, Dengue virus
VDDDGTMRIK

SEQ ID NO: 64528 - protein, 10 aa, Dengue virus
DDDGTMRIKD

SEQ ID NO: 64529 - protein, 10 aa, Dengue virus
DDGTMRIKDD

SEQ ID NO: 64530 - protein, 10 aa, Dengue virus
DGTMRIKDDE

SEQ ID NO: 64531 - protein, 10 aa, Dengue virus
GTMRIKDDET

SEQ ID NO: 64532 - protein, 10 aa, Dengue virus
TMRIKDDETE

SEQ ID NO: 64533 - protein, 10 aa, Dengue virus
MRIKDDETEN

SEQ ID NO: 64534 - protein, 10 aa, Dengue virus
RIKDDETENI

SEQ ID NO: 64535 - protein, 10 aa, Dengue virus
IKDDETENIL

SEQ ID NO: 64536 - protein, 10 aa, Dengue virus
KDDETENILT

SEQ ID NO: 64537 - protein, 10 aa, Dengue virus
DDETENILTV

SEQ ID NO: 64538 - protein, 10 aa, Dengue virus
DETENILTVL

SEQ ID NO: 64539 - protein, 10 aa, Dengue virus
ETENILTVLL

SEQ ID NO: 64540 - protein, 10 aa, Dengue virus
TENILTVLLK

SEQ ID NO: 64541 - protein, 10 aa, Dengue virus
ENILTVLLKT

SEQ ID NO: 64542 - protein, 10 aa, Dengue virus
NILTVLLKTA

SEQ ID NO: 64543 - protein, 10 aa, Dengue virus
ILTVLLKTAL

SEQ ID NO: 64544 - protein, 10 aa, Dengue virus
LTVLLKTALL

SEQ ID NO: 64545 - protein, 10 aa, Dengue virus
TVLLKTALLI

SEQ ID NO: 64546 - protein, 10 aa, Dengue virus
VLLKTALLIV

SEQ ID NO: 64547 - protein, 10 aa, Dengue virus
LLKTALLIVS

SEQ ID NO: 64548 - protein, 10 aa, Dengue virus
LKTALLIVSG

SEQ ID NO: 64549 - protein, 10 aa, Dengue virus
KTALLIVSGI

SEQ ID NO: 64550 - protein, 10 aa, Dengue virus
TALLIVSGIF

SEQ ID NO: 64551 - protein, 10 aa, Dengue virus
ALLIVSGIFP

SEQ ID NO: 64552 - protein, 10 aa, Dengue virus
LLIVSGIFPY

SEQ ID NO: 64553 - protein, 10 aa, Dengue virus
LIVSGIFPYS

SEQ ID NO: 64554 - protein, 10 aa, Dengue virus
IVSGIFPYSI

SEQ ID NO: 64555 - protein, 10 aa, Dengue virus
VSGIFPYSIP

SEQ ID NO: 64556 - protein, 10 aa, Dengue virus
SGIFPYSIPA

SEQ ID NO: 64557 - protein, 10 aa, Dengue virus
GIFPYSIPAT

SEQ ID NO: 64558 - protein, 10 aa, Dengue virus
IFPYSIPATL

SEQ ID NO: 64559 - protein, 10 aa, Dengue virus
FPYSIPATLL

SEQ ID NO: 64560 - protein, 10 aa, Dengue virus
PYSIPATLLV

SEQ ID NO: 64561 - protein, 10 aa, Dengue virus
YSIPATLLVW

SEQ ID NO: 64562 - protein, 10 aa, Dengue virus
SIPATLLVWH

SEQ ID NO: 64563 - protein, 10 aa, Dengue virus
IPATLLVWHT

SEQ ID NO: 64564 - protein, 10 aa, Dengue virus
PATLLVWHTW

SEQ ID NO: 64565 - protein, 10 aa, Dengue virus
ATLLVWHTWQ

SEQ ID NO: 64566 - protein, 10 aa, Dengue virus
TLLVWHTWQK

SEQ ID NO: 64567 - protein, 10 aa, Dengue virus
LLVWHTWQKQ

SEQ ID NO: 64568 - protein, 10 aa, Dengue virus
LVWHTWQKQT

SEQ ID NO: 64569 - protein, 10 aa, Dengue virus
VWHTWQKQTQ

SEQ ID NO: 64570 - protein, 10 aa, Dengue virus
WHTWQKQTQR

SEQ ID NO: 64571 - protein, 10 aa, Dengue virus
HTWQKQTQRS

SEQ ID NO: 64572 - protein, 10 aa, Dengue virus
TWQKQTQRSG

SEQ ID NO: 64573 - protein, 10 aa, Dengue virus
WQKQTQRSGV

SEQ ID NO: 64574 - protein, 10 aa, Dengue virus
QKQTQRSGVL

SEQ ID NO: 64575 - protein, 10 aa, Dengue virus
KQTQRSGVLW

SEQ ID NO: 64576 - protein, 10 aa, Dengue virus
QTQRSGVLWD

SEQ ID NO: 64577 - protein, 10 aa, Dengue virus
TQRSGVLWDV

SEQ ID NO: 64578 - protein, 10 aa, Dengue virus
QRSGVLWDVP

SEQ ID NO: 64579 - protein, 10 aa, Dengue virus
RSGVLWDVPS

SEQ ID NO: 64580 - protein, 10 aa, Dengue virus
SGVLWDVPSP

SEQ ID NO: 64581 - protein, 10 aa, Dengue virus
GVLWDVPSPP

SEQ ID NO: 64582 - protein, 10 aa, Dengue virus
VLWDVPSPPE

SEQ ID NO: 64583 - protein, 10 aa, Dengue virus
LWDVPSPPET

SEQ ID NO: 64584 - protein, 10 aa, Dengue virus
WDVPSPPETQ

SEQ ID NO: 64585 - protein, 10 aa, Dengue virus
DVPSPPETQK

SEQ ID NO: 64586 - protein, 10 aa, Dengue virus
VPSPPETQKA

SEQ ID NO: 64587 - protein, 10 aa, Dengue virus
PSPPETQKAE

SEQ ID NO: 64588 - protein, 10 aa, Dengue virus
SPPETQKAEL

SEQ ID NO: 64589 - protein, 10 aa, Dengue virus
PPETQKAELE

SEQ ID NO: 64590 - protein, 10 aa, Dengue virus
PETQKAELEE

SEQ ID NO: 64591 - protein, 10 aa, Dengue virus
ETQKAELEEG

SEQ ID NO: 64592 - protein, 10 aa, Dengue virus
TQKAELEEGV

SEQ ID NO: 64593 - protein, 10 aa, Dengue virus
QKAELEEGVY

SEQ ID NO: 64594 - protein, 10 aa, Dengue virus
KAELEEGVYR

SEQ ID NO: 64595 - protein, 10 aa, Dengue virus
AELEEGVYRI

SEQ ID NO: 64596 - protein, 10 aa, Dengue virus
ELEEGVYRIK

SEQ ID NO: 64597 - protein, 10 aa, Dengue virus
LEEGVYRIKQ

SEQ ID NO: 64598 - protein, 10 aa, Dengue virus
EEGVYRIKQQ

SEQ ID NO: 64599 - protein, 10 aa, Dengue virus
EGVYRIKQQG

SEQ ID NO: 64600 - protein, 10 aa, Dengue virus
GVYRIKQQGI

SEQ ID NO: 64601 - protein, 10 aa, Dengue virus
VYRIKQQGIF

SEQ ID NO: 64602 - protein, 10 aa, Dengue virus
YRIKQQGIFG

SEQ ID NO: 64603 - protein, 10 aa, Dengue virus
RIKQQGIFGK

SEQ ID NO: 64604 - protein, 10 aa, Dengue virus
IKQQGIFGKT

SEQ ID NO: 64605 - protein, 10 aa, Dengue virus
KQQGIFGKTQ

SEQ ID NO: 64606 - protein, 10 aa, Dengue virus
QQGIFGKTQV

SEQ ID NO: 64607 - protein, 10 aa, Dengue virus
QGIFGKTQVG

SEQ ID NO: 64608 - protein, 10 aa, Dengue virus
GIFGKTQVGV

SEQ ID NO: 64609 - protein, 10 aa, Dengue virus
IFGKTQVGVG

SEQ ID NO: 64610 - protein, 10 aa, Dengue virus
FGKTQVGVGV

SEQ ID NO: 64611 - protein, 10 aa, Dengue virus
GKTQVGVGVQ

SEQ ID NO: 64612 - protein, 10 aa, Dengue virus
KTQVGVGVQK

SEQ ID NO: 64613 - protein, 10 aa, Dengue virus
TQVGVGVQKE

SEQ ID NO: 64614 - protein, 10 aa, Dengue virus
QVGVGVQKEG

SEQ ID NO: 64615 - protein, 10 aa, Dengue virus
VGVGVQKEGV

SEQ ID NO: 64616 - protein, 10 aa, Dengue virus
GVGVQKEGVF

SEQ ID NO: 64617 - protein, 10 aa, Dengue virus
VGVQKEGVFH

SEQ ID NO: 64618 - protein, 10 aa, Dengue virus
GVQKEGVFHT

SEQ ID NO: 64619 - protein, 10 aa, Dengue virus
VQKEGVFHTM

SEQ ID NO: 64620 - protein, 10 aa, Dengue virus
QKEGVFHTMW

SEQ ID NO: 64621 - protein, 10 aa, Dengue virus
KEGVFHTMWH

SEQ ID NO: 64622 - protein, 10 aa, Dengue virus
EGVFHTMWHV

SEQ ID NO: 64623 - protein, 10 aa, Dengue virus
GVFHTMWHVT

SEQ ID NO: 64624 - protein, 10 aa, Dengue virus
VFHTMWHVTR

SEQ ID NO: 64625 - protein, 10 aa, Dengue virus
FHTMWHVTRG

SEQ ID NO: 64626 - protein, 10 aa, Dengue virus
HTMWHVTRGA

SEQ ID NO: 64627 - protein, 10 aa, Dengue virus
TMWHVTRGAV

SEQ ID NO: 64628 - protein, 10 aa, Dengue virus
MWHVTRGAVL

SEQ ID NO: 64629 - protein, 10 aa, Dengue virus
WHVTRGAVLT

SEQ ID NO: 64630 - protein, 10 aa, Dengue virus
HVTRGAVLTY

SEQ ID NO: 64631 - protein, 10 aa, Dengue virus
VTRGAVLTYN

SEQ ID NO: 64632 - protein, 10 aa, Dengue virus
TRGAVLTYNG

SEQ ID NO: 64633 - protein, 10 aa, Dengue virus
RGAVLTYNGK

SEQ ID NO: 64634 - protein, 10 aa, Dengue virus
GAVLTYNGKR

SEQ ID NO: 64635 - protein, 10 aa, Dengue virus
AVLTYNGKRL

SEQ ID NO: 64636 - protein, 10 aa, Dengue virus
VLTYNGKRLE

SEQ ID NO: 64637 - protein, 10 aa, Dengue virus
LTYNGKRLEP

SEQ ID NO: 64638 - protein, 10 aa, Dengue virus
TYNGKRLEPN

SEQ ID NO: 64639 - protein, 10 aa, Dengue virus
YNGKRLEPNW

SEQ ID NO: 64640 - protein, 10 aa, Dengue virus
NGKRLEPNWA

SEQ ID NO: 64641 - protein, 10 aa, Dengue virus
GKRLEPNWAS

SEQ ID NO: 64642 - protein, 10 aa, Dengue virus
KRLEPNWASV

SEQ ID NO: 64643 - protein, 10 aa, Dengue virus
RLEPNWASVK

SEQ ID NO: 64644 - protein, 10 aa, Dengue virus
LEPNWASVKK

SEQ ID NO: 64645 - protein, 10 aa, Dengue virus
EPNWASVKKD

SEQ ID NO: 64646 - protein, 10 aa, Dengue virus
PNWASVKKDL

SEQ ID NO: 64647 - protein, 10 aa, Dengue virus
NWASVKKDLI

SEQ ID NO: 64648 - protein, 10 aa, Dengue virus
WASVKKDLIS

SEQ ID NO: 64649 - protein, 10 aa, Dengue virus
ASVKKDLISY

SEQ ID NO: 64650 - protein, 10 aa, Dengue virus
SVKKDLISYG

SEQ ID NO: 64651 - protein, 10 aa, Dengue virus
VKKDLISYGG

SEQ ID NO: 64652 - protein, 10 aa, Dengue virus
KKDLISYGGG

SEQ ID NO: 64653 - protein, 10 aa, Dengue virus
KDLISYGGGW

SEQ ID NO: 64654 - protein, 10 aa, Dengue virus
DLISYGGGWR

SEQ ID NO: 64655 - protein, 10 aa, Dengue virus
LISYGGGWRL

SEQ ID NO: 64656 - protein, 10 aa, Dengue virus
ISYGGGWRLS

SEQ ID NO: 64657 - protein, 10 aa, Dengue virus
SYGGGWRLSA

SEQ ID NO: 64658 - protein, 10 aa, Dengue virus
YGGGWRLSAQ

SEQ ID NO: 64659 - protein, 10 aa, Dengue virus
GGGWRLSAQW

SEQ ID NO: 64660 - protein, 10 aa, Dengue virus
GGWRLSAQWQ

SEQ ID NO: 64661 - protein, 10 aa, Dengue virus
GWRLSAQWQK

SEQ ID NO: 64662 - protein, 10 aa, Dengue virus
WRLSAQWQKG

SEQ ID NO: 64663 - protein, 10 aa, Dengue virus
RLSAQWQKGE

SEQ ID NO: 64664 - protein, 10 aa, Dengue virus
LSAQWQKGEE

SEQ ID NO: 64665 - protein, 10 aa, Dengue virus
SAQWQKGEEV

SEQ ID NO: 64666 - protein, 10 aa, Dengue virus
AQWQKGEEVQ

SEQ ID NO: 64667 - protein, 10 aa, Dengue virus
QWQKGEEVQV

SEQ ID NO: 64668 - protein, 10 aa, Dengue virus
WQKGEEVQVI

SEQ ID NO: 64669 - protein, 10 aa, Dengue virus
QKGEEVQVIA

SEQ ID NO: 64670 - protein, 10 aa, Dengue virus
KGEEVQVIAV

SEQ ID NO: 64671 - protein, 10 aa, Dengue virus
GEEVQVIAVE

SEQ ID NO: 64672 - protein, 10 aa, Dengue virus
EEVQVIAVEP

SEQ ID NO: 64673 - protein, 10 aa, Dengue virus
EVQVIAVEPG

SEQ ID NO: 64674 - protein, 10 aa, Dengue virus
VQVIAVEPGK

SEQ ID NO: 64675 - protein, 10 aa, Dengue virus
QVIAVEPGKN

SEQ ID NO: 64676 - protein, 10 aa, Dengue virus
VIAVEPGKNP

SEQ ID NO: 64677 - protein, 10 aa, Dengue virus
IAVEPGKNPK

SEQ ID NO: 64678 - protein, 10 aa, Dengue virus
AVEPGKNPKN

SEQ ID NO: 64679 - protein, 10 aa, Dengue virus
VEPGKNPKNF

SEQ ID NO: 64680 - protein, 10 aa, Dengue virus
EPGKNPKNFQ

SEQ ID NO: 64681 - protein, 10 aa, Dengue virus
PGKNPKNFQT

SEQ ID NO: 64682 - protein, 10 aa, Dengue virus
GKNPKNFQTM

SEQ ID NO: 64683 - protein, 10 aa, Dengue virus
KNPKNFQTMP

SEQ ID NO: 64684 - protein, 10 aa, Dengue virus
NPKNFQTMPG

SEQ ID NO: 64685 - protein, 10 aa, Dengue virus
PKNFQTMPGT

SEQ ID NO: 64686 - protein, 10 aa, Dengue virus
KNFQTMPGTF

SEQ ID NO: 64687 - protein, 10 aa, Dengue virus
NFQTMPGTFQ

SEQ ID NO: 64688 - protein, 10 aa, Dengue virus
FQTMPGTFQT

SEQ ID NO: 64689 - protein, 10 aa, Dengue virus
QTMPGTFQTT

SEQ ID NO: 64690 - protein, 10 aa, Dengue virus
PGTFQTTTGE

SEQ ID NO: 64691 - protein, 10 aa, Dengue virus
GTFQTTTGEI

SEQ ID NO: 64692 - protein, 10 aa, Dengue virus
TFQTTTGEIG

SEQ ID NO: 64693 - protein, 10 aa, Dengue virus
FQTTTGEIGA

SEQ ID NO: 64694 - protein, 10 aa, Dengue virus
QTTTGEIGAI

SEQ ID NO: 64695 - protein, 10 aa, Dengue virus
TTTGEIGAIA

SEQ ID NO: 64696 - protein, 10 aa, Dengue virus
TTGEIGAIAL

SEQ ID NO: 64697 - protein, 10 aa, Dengue virus
TGEIGAIALD

SEQ ID NO: 64698 - protein, 10 aa, Dengue virus
GEIGAIALDF

SEQ ID NO: 64699 - protein, 10 aa, Dengue virus
EIGAIALDFK

SEQ ID NO: 64700 - protein, 10 aa, Dengue virus
IGAIALDFKP

SEQ ID NO: 64701 - protein, 10 aa, Dengue virus
GAIALDFKPG

SEQ ID NO: 64702 - protein, 10 aa, Dengue virus
AIALDFKPGT

SEQ ID NO: 64703 - protein, 10 aa, Dengue virus
IALDFKPGTS

SEQ ID NO: 64704 - protein, 10 aa, Dengue virus
ALDFKPGTSG

SEQ ID NO: 64705 - protein, 10 aa, Dengue virus
LDFKPGTSGS

SEQ ID NO: 64706 - protein, 10 aa, Dengue virus
DFKPGTSGSP

SEQ ID NO: 64707 - protein, 10 aa, Dengue virus
FKPGTSGSPI

SEQ ID NO: 64708 - protein, 10 aa, Dengue virus
KPGTSGSPII

SEQ ID NO: 64709 - protein, 10 aa, Dengue virus
PGTSGSPIIN

SEQ ID NO: 64710 - protein, 10 aa, Dengue virus
GTSGSPIINR

SEQ ID NO: 64711 - protein, 10 aa, Dengue virus
TSGSPIINRE

SEQ ID NO: 64712 - protein, 10 aa, Dengue virus
SGSPIINREG

SEQ ID NO: 64713 - protein, 10 aa, Dengue virus
GSPIINREGK

SEQ ID NO: 64714 - protein, 10 aa, Dengue virus
SPIINREGKV

SEQ ID NO: 64715 - protein, 10 aa, Dengue virus
PIINREGKVV

SEQ ID NO: 64716 - protein, 10 aa, Dengue virus
IINREGKVVG

SEQ ID NO: 64717 - protein, 10 aa, Dengue virus
INREGKVVGL

SEQ ID NO: 64718 - protein, 10 aa, Dengue virus
NREGKVVGLY

SEQ ID NO: 64719 - protein, 10 aa, Dengue virus
REGKVVGLYG

SEQ ID NO: 64720 - protein, 10 aa, Dengue virus
EGKVVGLYGN

SEQ ID NO: 64721 - protein, 10 aa, Dengue virus
GKVVGLYGNG

SEQ ID NO: 64722 - protein, 10 aa, Dengue virus
KVVGLYGNGV

SEQ ID NO: 64723 - protein, 10 aa, Dengue virus
VVGLYGNGVV

SEQ ID NO: 64724 - protein, 10 aa, Dengue virus
VGLYGNGVVT

SEQ ID NO: 64725 - protein, 10 aa, Dengue virus
GLYGNGVVTK

SEQ ID NO: 64726 - protein, 10 aa, Dengue virus
LYGNGVVTKN

SEQ ID NO: 64727 - protein, 10 aa, Dengue virus
YGNGVVTKNG

SEQ ID NO: 64728 - protein, 10 aa, Dengue virus
GNGVVTKNGG

SEQ ID NO: 64729 - protein, 10 aa, Dengue virus
NGVVTKNGGY

SEQ ID NO: 64730 - protein, 10 aa, Dengue virus
GVVTKNGGYV

SEQ ID NO: 64731 - protein, 10 aa, Dengue virus
VVTKNGGYVS

SEQ ID NO: 64732 - protein, 10 aa, Dengue virus
VTKNGGYVSG

SEQ ID NO: 64733 - protein, 10 aa, Dengue virus
TKNGGYVSGI

SEQ ID NO: 64734 - protein, 10 aa, Dengue virus
KNGGYVSGIA

SEQ ID NO: 64735 - protein, 10 aa, Dengue virus
NGGYVSGIAQ

SEQ ID NO: 64736 - protein, 10 aa, Dengue virus
GGYVSGIAQT

SEQ ID NO: 64737 - protein, 10 aa, Dengue virus
GYVSGIAQTN

SEQ ID NO: 64738 - protein, 10 aa, Dengue virus
YVSGIAQTNA

SEQ ID NO: 64739 - protein, 10 aa, Dengue virus
VSGIAQTNAE

SEQ ID NO: 64740 - protein, 10 aa, Dengue virus
SGIAQTNAEP

SEQ ID NO: 64741 - protein, 10 aa, Dengue virus
GIAQTNAEPD

SEQ ID NO: 64742 - protein, 10 aa, Dengue virus
IAQTNAEPDG

SEQ ID NO: 64743 - protein, 10 aa, Dengue virus
AQTNAEPDGP

SEQ ID NO: 64744 - protein, 10 aa, Dengue virus
QTNAEPDGPT

SEQ ID NO: 64745 - protein, 10 aa, Dengue virus
TNAEPDGPTP

SEQ ID NO: 64746 - protein, 10 aa, Dengue virus
NAEPDGPTPE

SEQ ID NO: 64747 - protein, 10 aa, Dengue virus
AEPDGPTPEL

SEQ ID NO: 64748 - protein, 10 aa, Dengue virus
EPDGPTPELE

SEQ ID NO: 64749 - protein, 10 aa, Dengue virus
PDGPTPELEE

SEQ ID NO: 64750 - protein, 10 aa, Dengue virus
DGPTPELEEE

SEQ ID NO: 64751 - protein, 10 aa, Dengue virus
GPTPELEEEM

SEQ ID NO: 64752 - protein, 10 aa, Dengue virus
PTPELEEEMF

SEQ ID NO: 64753 - protein, 10 aa, Dengue virus
TPELEEEMFK

SEQ ID NO: 64754 - protein, 10 aa, Dengue virus
PELEEEMFKK

SEQ ID NO: 64755 - protein, 10 aa, Dengue virus
ELEEEMFKKR

SEQ ID NO: 64756 - protein, 10 aa, Dengue virus
LEEEMFKKRN

SEQ ID NO: 64757 - protein, 10 aa, Dengue virus
EEEMFKKRNL

SEQ ID NO: 64758 - protein, 10 aa, Dengue virus
EEMFKKRNLT

SEQ ID NO: 64759 - protein, 10 aa, Dengue virus
EMFKKRNLTI

SEQ ID NO: 64760 - protein, 10 aa, Dengue virus
MFKKRNLTIM

SEQ ID NO: 64761 - protein, 10 aa, Dengue virus
FKKRNLTIMD

SEQ ID NO: 64762 - protein, 10 aa, Dengue virus
KKRNLTIMDL

SEQ ID NO: 64763 - protein, 10 aa, Dengue virus
KRNLTIMDLH

SEQ ID NO: 64764 - protein, 10 aa, Dengue virus
RNLTIMDLHP

SEQ ID NO: 64765 - protein, 10 aa, Dengue virus
NLTIMDLHPG

SEQ ID NO: 64766 - protein, 10 aa, Dengue virus
LTIMDLHPGS

SEQ ID NO: 64767 - protein, 10 aa, Dengue virus
TIMDLHPGSG

SEQ ID NO: 64768 - protein, 10 aa, Dengue virus
IMDLHPGSGK

SEQ ID NO: 64769 - protein, 10 aa, Dengue virus
MDLHPGSGKT

SEQ ID NO: 64770 - protein, 10 aa, Dengue virus
DLHPGSGKTR

SEQ ID NO: 64771 - protein, 10 aa, Dengue virus
LHPGSGKTRK

SEQ ID NO: 64772 - protein, 10 aa, Dengue virus
HPGSGKTRKY

SEQ ID NO: 64773 - protein, 10 aa, Dengue virus
PGSGKTRKYL

SEQ ID NO: 64774 - protein, 10 aa, Dengue virus
GSGKTRKYLP

SEQ ID NO: 64775 - protein, 10 aa, Dengue virus
SGKTRKYLPA

SEQ ID NO: 64776 - protein, 10 aa, Dengue virus
GKTRKYLPAI

SEQ ID NO: 64777 - protein, 10 aa, Dengue virus
KTRKYLPAIV

SEQ ID NO: 64778 - protein, 10 aa, Dengue virus
TRKYLPAIVR

SEQ ID NO: 64779 - protein, 10 aa, Dengue virus
RKYLPAIVRE

SEQ ID NO: 64780 - protein, 10 aa, Dengue virus
KYLPAIVREA

SEQ ID NO: 64781 - protein, 10 aa, Dengue virus
YLPAIVREAI

SEQ ID NO: 64782 - protein, 10 aa, Dengue virus
LPAIVREAIK

SEQ ID NO: 64783 - protein, 10 aa, Dengue virus
PAIVREAIKR

SEQ ID NO: 64784 - protein, 10 aa, Dengue virus
AIVREAIKRR

SEQ ID NO: 64785 - protein, 10 aa, Dengue virus
IVREAIKRRL

SEQ ID NO: 64786 - protein, 10 aa, Dengue virus
VREAIKRRLR

SEQ ID NO: 64787 - protein, 10 aa, Dengue virus
REAIKRRLRT

SEQ ID NO: 64788 - protein, 10 aa, Dengue virus
EAIKRRLRTL

SEQ ID NO: 64789 - protein, 10 aa, Dengue virus
AIKRRLRTLI

SEQ ID NO: 64790 - protein, 10 aa, Dengue virus
IKRRLRTLIL

SEQ ID NO: 64791 - protein, 10 aa, Dengue virus
KRRLRTLILA

SEQ ID NO: 64792 - protein, 10 aa, Dengue virus
RRLRTLILAP

SEQ ID NO: 64793 - protein, 10 aa, Dengue virus
RLRTLILAPT

SEQ ID NO: 64794 - protein, 10 aa, Dengue virus
LRTLILAPTR

SEQ ID NO: 64795 - protein, 10 aa, Dengue virus
RTLILAPTRV

SEQ ID NO: 64796 - protein, 10 aa, Dengue virus
TLILAPTRVV

SEQ ID NO: 64797 - protein, 10 aa, Dengue virus
LILAPTRVVA

SEQ ID NO: 64798 - protein, 10 aa, Dengue virus
ILAPTRVVAA

SEQ ID NO: 64799 - protein, 10 aa, Dengue virus
LAPTRVVAAE

SEQ ID NO: 64800 - protein, 10 aa, Dengue virus
APTRVVAAEM

SEQ ID NO: 64801 - protein, 10 aa, Dengue virus
PTRVVAAEME

SEQ ID NO: 64802 - protein, 10 aa, Dengue virus
TRVVAAEMEE

SEQ ID NO: 64803 - protein, 10 aa, Dengue virus
RVVAAEMEEA

SEQ ID NO: 64804 - protein, 10 aa, Dengue virus
VVAAEMEEAL

SEQ ID NO: 64805 - protein, 10 aa, Dengue virus
VAAEMEEALK

SEQ ID NO: 64806 - protein, 10 aa, Dengue virus
AAEMEEALKG

SEQ ID NO: 64807 - protein, 10 aa, Dengue virus
AEMEEALKGL

SEQ ID NO: 64808 - protein, 10 aa, Dengue virus
EMEEALKGLP

SEQ ID NO: 64809 - protein, 10 aa, Dengue virus
MEEALKGLPI

SEQ ID NO: 64810 - protein, 10 aa, Dengue virus
EEALKGLPIR

SEQ ID NO: 64811 - protein, 10 aa, Dengue virus
EALKGLPIRY

SEQ ID NO: 64812 - protein, 10 aa, Dengue virus
ALKGLPIRYQ

SEQ ID NO: 64813 - protein, 10 aa, Dengue virus
LKGLPIRYQT

SEQ ID NO: 64814 - protein, 10 aa, Dengue virus
KGLPIRYQTT

SEQ ID NO: 64815 - protein, 10 aa, Dengue virus
GLPIRYQTTA

SEQ ID NO: 64816 - protein, 10 aa, Dengue virus
LPIRYQTTAT

SEQ ID NO: 64817 - protein, 10 aa, Dengue virus
PIRYQTTATK

SEQ ID NO: 64818 - protein, 10 aa, Dengue virus
IRYQTTATKS

SEQ ID NO: 64819 - protein, 10 aa, Dengue virus
RYQTTATKSE

SEQ ID NO: 64820 - protein, 10 aa, Dengue virus
YQTTATKSEH

SEQ ID NO: 64821 - protein, 10 aa, Dengue virus
QTTATKSEHT

SEQ ID NO: 64822 - protein, 10 aa, Dengue virus
TTATKSEHTG

SEQ ID NO: 64823 - protein, 10 aa, Dengue virus
TATKSEHTGR

SEQ ID NO: 64824 - protein, 10 aa, Dengue virus
ATKSEHTGRE

SEQ ID NO: 64825 - protein, 10 aa, Dengue virus
TKSEHTGREI

SEQ ID NO: 64826 - protein, 10 aa, Dengue virus
KSEHTGREIV

SEQ ID NO: 64827 - protein, 10 aa, Dengue virus
SEHTGREIVD

SEQ ID NO: 64828 - protein, 10 aa, Dengue virus
EHTGREIVDL

SEQ ID NO: 64829 - protein, 10 aa, Dengue virus
HTGREIVDLM

SEQ ID NO: 64830 - protein, 10 aa, Dengue virus
TGREIVDLMC

SEQ ID NO: 64831 - protein, 10 aa, Dengue virus
GREIVDLMCH

SEQ ID NO: 64832 - protein, 10 aa, Dengue virus
REIVDLMCHA

SEQ ID NO: 64833 - protein, 10 aa, Dengue virus
EIVDLMCHAT

SEQ ID NO: 64834 - protein, 10 aa, Dengue virus
IVDLMCHATF

SEQ ID NO: 64835 - protein, 10 aa, Dengue virus
VDLMCHATFT

SEQ ID NO: 64836 - protein, 10 aa, Dengue virus
DLMCHATFTM

SEQ ID NO: 64837 - protein, 10 aa, Dengue virus
LMCHATFTMR

SEQ ID NO: 64838 - protein, 10 aa, Dengue virus
MCHATFTMRL

SEQ ID NO: 64839 - protein, 10 aa, Dengue virus
CHATFTMRLL

SEQ ID NO: 64840 - protein, 10 aa, Dengue virus
HATFTMRLLS

SEQ ID NO: 64841 - protein, 10 aa, Dengue virus
ATFTMRLLSP

SEQ ID NO: 64842 - protein, 10 aa, Dengue virus
TFTMRLLSPV

SEQ ID NO: 64843 - protein, 10 aa, Dengue virus
FTMRLLSPVR

SEQ ID NO: 64844 - protein, 10 aa, Dengue virus
TMRLLSPVRV

SEQ ID NO: 64845 - protein, 10 aa, Dengue virus
MRLLSPVRVP

SEQ ID NO: 64846 - protein, 10 aa, Dengue virus
RLLSPVRVPN

SEQ ID NO: 64847 - protein, 10 aa, Dengue virus
LLSPVRVPNY

SEQ ID NO: 64848 - protein, 10 aa, Dengue virus
LSPVRVPNYN

SEQ ID NO: 64849 - protein, 10 aa, Dengue virus
SPVRVPNYNL

SEQ ID NO: 64850 - protein, 10 aa, Dengue virus
PVRVPNYNLI

SEQ ID NO: 64851 - protein, 10 aa, Dengue virus
VRVPNYNLII

SEQ ID NO: 64852 - protein, 10 aa, Dengue virus
RVPNYNLIIM

SEQ ID NO: 64853 - protein, 10 aa, Dengue virus
VPNYNLIIMD

SEQ ID NO: 64854 - protein, 10 aa, Dengue virus
PNYNLIIMDE

SEQ ID NO: 64855 - protein, 10 aa, Dengue virus
NYNLIIMDEA

SEQ ID NO: 64856 - protein, 10 aa, Dengue virus
YNLIIMDEAH

SEQ ID NO: 64857 - protein, 10 aa, Dengue virus
NLIIMDEAHF

SEQ ID NO: 64858 - protein, 10 aa, Dengue virus
LIIMDEAHFT

SEQ ID NO: 64859 - protein, 10 aa, Dengue virus
IIMDEAHFTD

SEQ ID NO: 64860 - protein, 10 aa, Dengue virus
IMDEAHFTDP

SEQ ID NO: 64861 - protein, 10 aa, Dengue virus
MDEAHFTDPA

SEQ ID NO: 64862 - protein, 10 aa, Dengue virus
DEAHFTDPAS

SEQ ID NO: 64863 - protein, 10 aa, Dengue virus
EAHFTDPASI

SEQ ID NO: 64864 - protein, 10 aa, Dengue virus
AHFTDPASIA

SEQ ID NO: 64865 - protein, 10 aa, Dengue virus
HFTDPASIAA

SEQ ID NO: 64866 - protein, 10 aa, Dengue virus
FTDPASIAAR

SEQ ID NO: 64867 - protein, 10 aa, Dengue virus
TDPASIAARG

SEQ ID NO: 64868 - protein, 10 aa, Dengue virus
DPASIAARGY

SEQ ID NO: 64869 - protein, 10 aa, Dengue virus
PASIAARGYI

SEQ ID NO: 64870 - protein, 10 aa, Dengue virus
ASIAARGYIS

SEQ ID NO: 64871 - protein, 10 aa, Dengue virus
SIAARGYIST

SEQ ID NO: 64872 - protein, 10 aa, Dengue virus
IAARGYISTR

SEQ ID NO: 64873 - protein, 10 aa, Dengue virus
AARGYISTRV

SEQ ID NO: 64874 - protein, 10 aa, Dengue virus
ARGYISTRVG

SEQ ID NO: 64875 - protein, 10 aa, Dengue virus
RGYISTRVGM

SEQ ID NO: 64876 - protein, 10 aa, Dengue virus
GYISTRVGMG

SEQ ID NO: 64877 - protein, 10 aa, Dengue virus
YISTRVGMGE

SEQ ID NO: 64878 - protein, 10 aa, Dengue virus
ISTRVGMGEA

SEQ ID NO: 64879 - protein, 10 aa, Dengue virus
STRVGMGEAA

SEQ ID NO: 64880 - protein, 10 aa, Dengue virus
TRVGMGEAAA

SEQ ID NO: 64881 - protein, 10 aa, Dengue virus
RVGMGEAAAI

SEQ ID NO: 64882 - protein, 10 aa, Dengue virus
VGMGEAAAIF

SEQ ID NO: 64883 - protein, 10 aa, Dengue virus
GMGEAAAIFM

SEQ ID NO: 64884 - protein, 10 aa, Dengue virus
MGEAAAIFMT

SEQ ID NO: 64885 - protein, 10 aa, Dengue virus
GEAAAIFMTA

SEQ ID NO: 64886 - protein, 10 aa, Dengue virus
EAAAIFMTAT

SEQ ID NO: 64887 - protein, 10 aa, Dengue virus
AAAIFMTATP

SEQ ID NO: 64888 - protein, 10 aa, Dengue virus
AAIFMTATPP

SEQ ID NO: 64889 - protein, 10 aa, Dengue virus
AIFMTATPPG

SEQ ID NO: 64890 - protein, 10 aa, Dengue virus
IFMTATPPGT

SEQ ID NO: 64891 - protein, 10 aa, Dengue virus
FMTATPPGTA

SEQ ID NO: 64892 - protein, 10 aa, Dengue virus
MTATPPGTAD

SEQ ID NO: 64893 - protein, 10 aa, Dengue virus
TATPPGTADA

SEQ ID NO: 64894 - protein, 10 aa, Dengue virus
ATPPGTADAF

SEQ ID NO: 64895 - protein, 10 aa, Dengue virus
TPPGTADAFP

SEQ ID NO: 64896 - protein, 10 aa, Dengue virus
PPGTADAFPQ

SEQ ID NO: 64897 - protein, 10 aa, Dengue virus
PGTADAFPQS

SEQ ID NO: 64898 - protein, 10 aa, Dengue virus
GTADAFPQSN

SEQ ID NO: 64899 - protein, 10 aa, Dengue virus
TADAFPQSNA

SEQ ID NO: 64900 - protein, 10 aa, Dengue virus
ADAFPQSNAP

SEQ ID NO: 64901 - protein, 10 aa, Dengue virus
DAFPQSNAPI

SEQ ID NO: 64902 - protein, 10 aa, Dengue virus
AFPQSNAPIQ

SEQ ID NO: 64903 - protein, 10 aa, Dengue virus
FPQSNAPIQD

SEQ ID NO: 64904 - protein, 10 aa, Dengue virus
PQSNAPIQDE

SEQ ID NO: 64905 - protein, 10 aa, Dengue virus
QSNAPIQDEE

SEQ ID NO: 64906 - protein, 10 aa, Dengue virus
SNAPIQDEER

SEQ ID NO: 64907 - protein, 10 aa, Dengue virus
NAPIQDEERD

SEQ ID NO: 64908 - protein, 10 aa, Dengue virus
APIQDEERDI

SEQ ID NO: 64909 - protein, 10 aa, Dengue virus
PIQDEERDIP

SEQ ID NO: 64910 - protein, 10 aa, Dengue virus
IQDEERDIPE

SEQ ID NO: 64911 - protein, 10 aa, Dengue virus
QDEERDIPER

SEQ ID NO: 64912 - protein, 10 aa, Dengue virus
DEERDIPERS

SEQ ID NO: 64913 - protein, 10 aa, Dengue virus
EERDIPERSW

SEQ ID NO: 64914 - protein, 10 aa, Dengue virus
ERDIPERSWN

SEQ ID NO: 64915 - protein, 10 aa, Dengue virus
RDIPERSWNS

SEQ ID NO: 64916 - protein, 10 aa, Dengue virus
DIPERSWNSG

SEQ ID NO: 64917 - protein, 10 aa, Dengue virus
IPERSWNSGN

SEQ ID NO: 64918 - protein, 10 aa, Dengue virus
PERSWNSGNE

SEQ ID NO: 64919 - protein, 10 aa, Dengue virus
ERSWNSGNEW

SEQ ID NO: 64920 - protein, 10 aa, Dengue virus
RSWNSGNEWI

SEQ ID NO: 64921 - protein, 10 aa, Dengue virus
SWNSGNEWIT

SEQ ID NO: 64922 - protein, 10 aa, Dengue virus
WNSGNEWITD

SEQ ID NO: 64923 - protein, 10 aa, Dengue virus
NSGNEWITDF

SEQ ID NO: 64924 - protein, 10 aa, Dengue virus
SGNEWITDFA

SEQ ID NO: 64925 - protein, 10 aa, Dengue virus
GNEWITDFAG

SEQ ID NO: 64926 - protein, 10 aa, Dengue virus
NEWITDFAGK

SEQ ID NO: 64927 - protein, 10 aa, Dengue virus
EWITDFAGKT

SEQ ID NO: 64928 - protein, 10 aa, Dengue virus
WITDFAGKTV

SEQ ID NO: 64929 - protein, 10 aa, Dengue virus
ITDFAGKTVW

SEQ ID NO: 64930 - protein, 10 aa, Dengue virus
TDFAGKTVWF

SEQ ID NO: 64931 - protein, 10 aa, Dengue virus
DFAGKTVWFV

SEQ ID NO: 64932 - protein, 10 aa, Dengue virus
FAGKTVWFVP

SEQ ID NO: 64933 - protein, 10 aa, Dengue virus
AGKTVWFVPS

SEQ ID NO: 64934 - protein, 10 aa, Dengue virus
GKTVWFVPSI

SEQ ID NO: 64935 - protein, 10 aa, Dengue virus
KTVWFVPSIK

SEQ ID NO: 64936 - protein, 10 aa, Dengue virus
TVWFVPSIKA

SEQ ID NO: 64937 - protein, 10 aa, Dengue virus
VWFVPSIKAG

SEQ ID NO: 64938 - protein, 10 aa, Dengue virus
WFVPSIKAGN

SEQ ID NO: 64939 - protein, 10 aa, Dengue virus
FVPSIKAGND

SEQ ID NO: 64940 - protein, 10 aa, Dengue virus
VPSIKAGNDI

SEQ ID NO: 64941 - protein, 10 aa, Dengue virus
PSIKAGNDIA

SEQ ID NO: 64942 - protein, 10 aa, Dengue virus
SIKAGNDIAN

SEQ ID NO: 64943 - protein, 10 aa, Dengue virus
IKAGNDIANC

SEQ ID NO: 64944 - protein, 10 aa, Dengue virus
KAGNDIANCL

SEQ ID NO: 64945 - protein, 10 aa, Dengue virus
AGNDIANCLR

SEQ ID NO: 64946 - protein, 10 aa, Dengue virus
GNDIANCLRK

SEQ ID NO: 64947 - protein, 10 aa, Dengue virus
NDIANCLRKN

SEQ ID NO: 64948 - protein, 10 aa, Dengue virus
DIANCLRKNG

SEQ ID NO: 64949 - protein, 10 aa, Dengue virus
IANCLRKNGK

SEQ ID NO: 64950 - protein, 10 aa, Dengue virus
ANCLRKNGKK

SEQ ID NO: 64951 - protein, 10 aa, Dengue virus
NCLRKNGKKV

SEQ ID NO: 64952 - protein, 10 aa, Dengue virus
CLRKNGKKVI

SEQ ID NO: 64953 - protein, 10 aa, Dengue virus
LRKNGKKVIQ

SEQ ID NO: 64954 - protein, 10 aa, Dengue virus
RKNGKKVIQL

SEQ ID NO: 64955 - protein, 10 aa, Dengue virus
KNGKKVIQLS

SEQ ID NO: 64956 - protein, 10 aa, Dengue virus
NGKKVIQLSR

SEQ ID NO: 64957 - protein, 10 aa, Dengue virus
GKKVIQLSRK

SEQ ID NO: 64958 - protein, 10 aa, Dengue virus
KKVIQLSRKT

SEQ ID NO: 64959 - protein, 10 aa, Dengue virus
KVIQLSRKTF

SEQ ID NO: 64960 - protein, 10 aa, Dengue virus
VIQLSRKTFD

SEQ ID NO: 64961 - protein, 10 aa, Dengue virus
IQLSRKTFDT

SEQ ID NO: 64962 - protein, 10 aa, Dengue virus
QLSRKTFDTE

SEQ ID NO: 64963 - protein, 10 aa, Dengue virus
LSRKTFDTEY

SEQ ID NO: 64964 - protein, 10 aa, Dengue virus
SRKTFDTEYQ

SEQ ID NO: 64965 - protein, 10 aa, Dengue virus
RKTFDTEYQK

SEQ ID NO: 64966 - protein, 10 aa, Dengue virus
KTFDTEYQKT

SEQ ID NO: 64967 - protein, 10 aa, Dengue virus
TFDTEYQKTK

SEQ ID NO: 64968 - protein, 10 aa, Dengue virus
FDTEYQKTKL

SEQ ID NO: 64969 - protein, 10 aa, Dengue virus
DTEYQKTKLN

SEQ ID NO: 64970 - protein, 10 aa, Dengue virus
TEYQKTKLND

SEQ ID NO: 64971 - protein, 10 aa, Dengue virus
EYQKTKLNDW

SEQ ID NO: 64972 - protein, 10 aa, Dengue virus
YQKTKLNDWD

SEQ ID NO: 64973 - protein, 10 aa, Dengue virus
QKTKLNDWDF

SEQ ID NO: 64974 - protein, 10 aa, Dengue virus
KTKLNDWDFV

SEQ ID NO: 64975 - protein, 10 aa, Dengue virus
TKLNDWDFVV

SEQ ID NO: 64976 - protein, 10 aa, Dengue virus
KLNDWDFVVT

SEQ ID NO: 64977 - protein, 10 aa, Dengue virus
LNDWDFVVTT

SEQ ID NO: 64978 - protein, 10 aa, Dengue virus
NDWDFVVTTD

SEQ ID NO: 64979 - protein, 10 aa, Dengue virus
DWDFVVTTDI

SEQ ID NO: 64980 - protein, 10 aa, Dengue virus
WDFVVTTDIS

SEQ ID NO: 64981 - protein, 10 aa, Dengue virus
DFVVTTDISE

SEQ ID NO: 64982 - protein, 10 aa, Dengue virus
FVVTTDISEM

SEQ ID NO: 64983 - protein, 10 aa, Dengue virus
VVTTDISEMG

SEQ ID NO: 64984 - protein, 10 aa, Dengue virus
VTTDISEMGA

SEQ ID NO: 64985 - protein, 10 aa, Dengue virus
TTDISEMGAN

SEQ ID NO: 64986 - protein, 10 aa, Dengue virus
TDISEMGANF

SEQ ID NO: 64987 - protein, 10 aa, Dengue virus
DISEMGANFK

SEQ ID NO: 64988 - protein, 10 aa, Dengue virus
ISEMGANFKA

SEQ ID NO: 64989 - protein, 10 aa, Dengue virus
SEMGANFKAD

SEQ ID NO: 64990 - protein, 10 aa, Dengue virus
EMGANFKADR

SEQ ID NO: 64991 - protein, 10 aa, Dengue virus
MGANFKADRV

SEQ ID NO: 64992 - protein, 10 aa, Dengue virus
GANFKADRVI

SEQ ID NO: 64993 - protein, 10 aa, Dengue virus
ANFKADRVID

SEQ ID NO: 64994 - protein, 10 aa, Dengue virus
NFKADRVIDP

SEQ ID NO: 64995 - protein, 10 aa, Dengue virus
FKADRVIDPR

SEQ ID NO: 64996 - protein, 10 aa, Dengue virus
KADRVIDPRR

SEQ ID NO: 64997 - protein, 10 aa, Dengue virus
ADRVIDPRRC

SEQ ID NO: 64998 - protein, 10 aa, Dengue virus
DRVIDPRRCL

SEQ ID NO: 64999 - protein, 10 aa, Dengue virus
RVIDPRRCLK

SEQ ID NO: 65000 - protein, 10 aa, Dengue virus
VIDPRRCLKP

SEQ ID NO: 65001 - protein, 10 aa, Dengue virus
IDPRRCLKPV

SEQ ID NO: 65002 - protein, 10 aa, Dengue virus
DPRRCLKPVI

SEQ ID NO: 65003 - protein, 10 aa, Dengue virus
PRRCLKPVIL

SEQ ID NO: 65004 - protein, 10 aa, Dengue virus
RRCLKPVILT

SEQ ID NO: 65005 - protein, 10 aa, Dengue virus
RCLKPVILTD

SEQ ID NO: 65006 - protein, 10 aa, Dengue virus
CLKPVILTDG

SEQ ID NO: 65007 - protein, 10 aa, Dengue virus
LKPVILTDGP

SEQ ID NO: 65008 - protein, 10 aa, Dengue virus
KPVILTDGPE

SEQ ID NO: 65009 - protein, 10 aa, Dengue virus
PVILTDGPER

SEQ ID NO: 65010 - protein, 10 aa, Dengue virus
VILTDGPERV

SEQ ID NO: 65011 - protein, 10 aa, Dengue virus
ILTDGPERVI

SEQ ID NO: 65012 - protein, 10 aa, Dengue virus
LTDGPERVIL

SEQ ID NO: 65013 - protein, 10 aa, Dengue virus
TDGPERVILA

SEQ ID NO: 65014 - protein, 10 aa, Dengue virus
DGPERVILAG

SEQ ID NO: 65015 - protein, 10 aa, Dengue virus
GPERVILAGP

SEQ ID NO: 65016 - protein, 10 aa, Dengue virus
PERVILAGPM

SEQ ID NO: 65017 - protein, 10 aa, Dengue virus
ERVILAGPMP

SEQ ID NO: 65018 - protein, 10 aa, Dengue virus
RVILAGPMPV

SEQ ID NO: 65019 - protein, 10 aa, Dengue virus
VILAGPMPVT

SEQ ID NO: 65020 - protein, 10 aa, Dengue virus
ILAGPMPVTA

SEQ ID NO: 65021 - protein, 10 aa, Dengue virus
LAGPMPVTAA

SEQ ID NO: 65022 - protein, 10 aa, Dengue virus
AGPMPVTAAS

SEQ ID NO: 65023 - protein, 10 aa, Dengue virus
GPMPVTAASA

SEQ ID NO: 65024 - protein, 10 aa, Dengue virus
PMPVTAASAA

SEQ ID NO: 65025 - protein, 10 aa, Dengue virus
MPVTAASAAQ

SEQ ID NO: 65026 - protein, 10 aa, Dengue virus
PVTAASAAQR

SEQ ID NO: 65027 - protein, 10 aa, Dengue virus
VTAASAAQRR

SEQ ID NO: 65028 - protein, 10 aa, Dengue virus
TAASAAQRRG

SEQ ID NO: 65029 - protein, 10 aa, Dengue virus
AASAAQRRGR

SEQ ID NO: 65030 - protein, 10 aa, Dengue virus
ASAAQRRGRV

SEQ ID NO: 65031 - protein, 10 aa, Dengue virus
SAAQRRGRVG

SEQ ID NO: 65032 - protein, 10 aa, Dengue virus
AAQRRGRVGR

SEQ ID NO: 65033 - protein, 10 aa, Dengue virus
AQRRGRVGRN

SEQ ID NO: 65034 - protein, 10 aa, Dengue virus
QRRGRVGRNP

SEQ ID NO: 65035 - protein, 10 aa, Dengue virus
RRGRVGRNPQ

SEQ ID NO: 65036 - protein, 10 aa, Dengue virus
RGRVGRNPQK

SEQ ID NO: 65037 - protein, 10 aa, Dengue virus
GRVGRNPQKE

SEQ ID NO: 65038 - protein, 10 aa, Dengue virus
RVGRNPQKEN

SEQ ID NO: 65039 - protein, 10 aa, Dengue virus
VGRNPQKEND

SEQ ID NO: 65040 - protein, 10 aa, Dengue virus
GRNPQKENDQ

SEQ ID NO: 65041 - protein, 10 aa, Dengue virus
RNPQKENDQY

SEQ ID NO: 65042 - protein, 10 aa, Dengue virus
NPQKENDQYI

SEQ ID NO: 65043 - protein, 10 aa, Dengue virus
PQKENDQYIF

SEQ ID NO: 65044 - protein, 10 aa, Dengue virus
QKENDQYIFT

SEQ ID NO: 65045 - protein, 10 aa, Dengue virus
KENDQYIFTG

SEQ ID NO: 65046 - protein, 10 aa, Dengue virus
ENDQYIFTGQ

SEQ ID NO: 65047 - protein, 10 aa, Dengue virus
NDQYIFTGQP

SEQ ID NO: 65048 - protein, 10 aa, Dengue virus
DQYIFTGQPL

SEQ ID NO: 65049 - protein, 10 aa, Dengue virus
QYIFTGQPLN

SEQ ID NO: 65050 - protein, 10 aa, Dengue virus
YIFTGQPLNN

SEQ ID NO: 65051 - protein, 10 aa, Dengue virus
IFTGQPLNND

SEQ ID NO: 65052 - protein, 10 aa, Dengue virus
FTGQPLNNDE

SEQ ID NO: 65053 - protein, 10 aa, Dengue virus
TGQPLNNDED

SEQ ID NO: 65054 - protein, 10 aa, Dengue virus
GQPLNNDEDH

SEQ ID NO: 65055 - protein, 10 aa, Dengue virus
QPLNNDEDHA

SEQ ID NO: 65056 - protein, 10 aa, Dengue virus
PLNNDEDHAH

SEQ ID NO: 65057 - protein, 10 aa, Dengue virus
LNNDEDHAHW

SEQ ID NO: 65058 - protein, 10 aa, Dengue virus
NNDEDHAHWT

SEQ ID NO: 65059 - protein, 10 aa, Dengue virus
NDEDHAHWTE

SEQ ID NO: 65060 - protein, 10 aa, Dengue virus
DEDHAHWTEA

SEQ ID NO: 65061 - protein, 10 aa, Dengue virus
EDHAHWTEAK

SEQ ID NO: 65062 - protein, 10 aa, Dengue virus
DHAHWTEAKM

SEQ ID NO: 65063 - protein, 10 aa, Dengue virus
HAHWTEAKML

SEQ ID NO: 65064 - protein, 10 aa, Dengue virus
AHWTEAKMLL

SEQ ID NO: 65065 - protein, 10 aa, Dengue virus
HWTEAKMLLD

SEQ ID NO: 65066 - protein, 10 aa, Dengue virus
WTEAKMLLDN

SEQ ID NO: 65067 - protein, 10 aa, Dengue virus
TEAKMLLDNI

SEQ ID NO: 65068 - protein, 10 aa, Dengue virus
EAKMLLDNIN

SEQ ID NO: 65069 - protein, 10 aa, Dengue virus
AKMLLDNINT

SEQ ID NO: 65070 - protein, 10 aa, Dengue virus
KMLLDNINTP

SEQ ID NO: 65071 - protein, 10 aa, Dengue virus
MLLDNINTPE

SEQ ID NO: 65072 - protein, 10 aa, Dengue virus
LLDNINTPEG

SEQ ID NO: 65073 - protein, 10 aa, Dengue virus
LDNINTPEGI

SEQ ID NO: 65074 - protein, 10 aa, Dengue virus
DNINTPEGII

SEQ ID NO: 65075 - protein, 10 aa, Dengue virus
NINTPEGIIP

SEQ ID NO: 65076 - protein, 10 aa, Dengue virus
INTPEGIIPA

SEQ ID NO: 65077 - protein, 10 aa, Dengue virus
NTPEGIIPAL

SEQ ID NO: 65078 - protein, 10 aa, Dengue virus
TPEGIIPALF

SEQ ID NO: 65079 - protein, 10 aa, Dengue virus
PEGIIPALFE

SEQ ID NO: 65080 - protein, 10 aa, Dengue virus
EGIIPALFEP

SEQ ID NO: 65081 - protein, 10 aa, Dengue virus
GIIPALFEPE

SEQ ID NO: 65082 - protein, 10 aa, Dengue virus
IIPALFEPER

SEQ ID NO: 65083 - protein, 10 aa, Dengue virus
IPALFEPERE

SEQ ID NO: 65084 - protein, 10 aa, Dengue virus
PALFEPEREK

SEQ ID NO: 65085 - protein, 10 aa, Dengue virus
ALFEPEREKS

SEQ ID NO: 65086 - protein, 10 aa, Dengue virus
LFEPEREKSA

SEQ ID NO: 65087 - protein, 10 aa, Dengue virus
FEPEREKSAA

SEQ ID NO: 65088 - protein, 10 aa, Dengue virus
EPEREKSAAI

SEQ ID NO: 65089 - protein, 10 aa, Dengue virus
PEREKSAAID

SEQ ID NO: 65090 - protein, 10 aa, Dengue virus
EREKSAAIDG

SEQ ID NO: 65091 - protein, 10 aa, Dengue virus
REKSAAIDGE

SEQ ID NO: 65092 - protein, 10 aa, Dengue virus
EKSAAIDGEY

SEQ ID NO: 65093 - protein, 10 aa, Dengue virus
KSAAIDGEYR

SEQ ID NO: 65094 - protein, 10 aa, Dengue virus
SAAIDGEYRL

SEQ ID NO: 65095 - protein, 10 aa, Dengue virus
AAIDGEYRLK

SEQ ID NO: 65096 - protein, 10 aa, Dengue virus
AIDGEYRLKG

SEQ ID NO: 65097 - protein, 10 aa, Dengue virus
IDGEYRLKGE

SEQ ID NO: 65098 - protein, 10 aa, Dengue virus
DGEYRLKGES

SEQ ID NO: 65099 - protein, 10 aa, Dengue virus
GEYRLKGESR

SEQ ID NO: 65100 - protein, 10 aa, Dengue virus
EYRLKGESRK

SEQ ID NO: 65101 - protein, 10 aa, Dengue virus
YRLKGESRKT

SEQ ID NO: 65102 - protein, 10 aa, Dengue virus
RLKGESRKTF

SEQ ID NO: 65103 - protein, 10 aa, Dengue virus
LKGESRKTFV

SEQ ID NO: 65104 - protein, 10 aa, Dengue virus
KGESRKTFVE

SEQ ID NO: 65105 - protein, 10 aa, Dengue virus
GESRKTFVEL

SEQ ID NO: 65106 - protein, 10 aa, Dengue virus
ESRKTFVELM

SEQ ID NO: 65107 - protein, 10 aa, Dengue virus
SRKTFVELMR

SEQ ID NO: 65108 - protein, 10 aa, Dengue virus
RKTFVELMRR

SEQ ID NO: 65109 - protein, 10 aa, Dengue virus
KTFVELMRRG

SEQ ID NO: 65110 - protein, 10 aa, Dengue virus
TFVELMRRGD

SEQ ID NO: 65111 - protein, 10 aa, Dengue virus
FVELMRRGDL

SEQ ID NO: 65112 - protein, 10 aa, Dengue virus
VELMRRGDLP

SEQ ID NO: 65113 - protein, 10 aa, Dengue virus
ELMRRGDLPV

SEQ ID NO: 65114 - protein, 10 aa, Dengue virus
LMRRGDLPVW

SEQ ID NO: 65115 - protein, 10 aa, Dengue virus
MRRGDLPVWL

SEQ ID NO: 65116 - protein, 10 aa, Dengue virus
RRGDLPVWLA

SEQ ID NO: 65117 - protein, 10 aa, Dengue virus
RGDLPVWLAH

SEQ ID NO: 65118 - protein, 10 aa, Dengue virus
GDLPVWLAHK

SEQ ID NO: 65119 - protein, 10 aa, Dengue virus
DLPVWLAHKV

SEQ ID NO: 65120 - protein, 10 aa, Dengue virus
LPVWLAHKVA

SEQ ID NO: 65121 - protein, 10 aa, Dengue virus
PVWLAHKVAS

SEQ ID NO: 65122 - protein, 10 aa, Dengue virus
VWLAHKVASE

SEQ ID NO: 65123 - protein, 10 aa, Dengue virus
WLAHKVASEG

SEQ ID NO: 65124 - protein, 10 aa, Dengue virus
LAHKVASEGI

SEQ ID NO: 65125 - protein, 10 aa, Dengue virus
AHKVASEGIK

SEQ ID NO: 65126 - protein, 10 aa, Dengue virus
HKVASEGIKY

SEQ ID NO: 65127 - protein, 10 aa, Dengue virus
KVASEGIKYT

SEQ ID NO: 65128 - protein, 10 aa, Dengue virus
VASEGIKYTD

SEQ ID NO: 65129 - protein, 10 aa, Dengue virus
ASEGIKYTDR

SEQ ID NO: 65130 - protein, 10 aa, Dengue virus
SEGIKYTDRK

SEQ ID NO: 65131 - protein, 10 aa, Dengue virus
EGIKYTDRKW

SEQ ID NO: 65132 - protein, 10 aa, Dengue virus
GIKYTDRKWC

SEQ ID NO: 65133 - protein, 10 aa, Dengue virus
IKYTDRKWCF

SEQ ID NO: 65134 - protein, 10 aa, Dengue virus
KYTDRKWCFD

SEQ ID NO: 65135 - protein, 10 aa, Dengue virus
YTDRKWCFDG

SEQ ID NO: 65136 - protein, 10 aa, Dengue virus
TDRKWCFDGQ

SEQ ID NO: 65137 - protein, 10 aa, Dengue virus
DRKWCFDGQR

SEQ ID NO: 65138 - protein, 10 aa, Dengue virus
RKWCFDGQRN

SEQ ID NO: 65139 - protein, 10 aa, Dengue virus
KWCFDGQRNN

SEQ ID NO: 65140 - protein, 10 aa, Dengue virus
WCFDGQRNNQ

SEQ ID NO: 65141 - protein, 10 aa, Dengue virus
CFDGQRNNQI

SEQ ID NO: 65142 - protein, 10 aa, Dengue virus
FDGQRNNQIL

SEQ ID NO: 65143 - protein, 10 aa, Dengue virus
DGQRNNQILE

SEQ ID NO: 65144 - protein, 10 aa, Dengue virus
GQRNNQILEE

SEQ ID NO: 65145 - protein, 10 aa, Dengue virus
QRNNQILEEN

SEQ ID NO: 65146 - protein, 10 aa, Dengue virus
RNNQILEENM

SEQ ID NO: 65147 - protein, 10 aa, Dengue virus
NNQILEENMD

SEQ ID NO: 65148 - protein, 10 aa, Dengue virus
NQILEENMDV

SEQ ID NO: 65149 - protein, 10 aa, Dengue virus
QILEENMDVE

SEQ ID NO: 65150 - protein, 10 aa, Dengue virus
ILEENMDVEI

SEQ ID NO: 65151 - protein, 10 aa, Dengue virus
LEENMDVEIW

SEQ ID NO: 65152 - protein, 10 aa, Dengue virus
EENMDVEIWT

SEQ ID NO: 65153 - protein, 10 aa, Dengue virus
ENMDVEIWTK

SEQ ID NO: 65154 - protein, 10 aa, Dengue virus
NMDVEIWTKE

SEQ ID NO: 65155 - protein, 10 aa, Dengue virus
MDVEIWTKEG

SEQ ID NO: 65156 - protein, 10 aa, Dengue virus
DVEIWTKEGE

SEQ ID NO: 65157 - protein, 10 aa, Dengue virus
VEIWTKEGEK

SEQ ID NO: 65158 - protein, 10 aa, Dengue virus
EIWTKEGEKK

SEQ ID NO: 65159 - protein, 10 aa, Dengue virus
IWTKEGEKKK

SEQ ID NO: 65160 - protein, 10 aa, Dengue virus
WTKEGEKKKL

SEQ ID NO: 65161 - protein, 10 aa, Dengue virus
TKEGEKKKLR

SEQ ID NO: 65162 - protein, 10 aa, Dengue virus
KEGEKKKLRP

SEQ ID NO: 65163 - protein, 10 aa, Dengue virus
EGEKKKLRPR

SEQ ID NO: 65164 - protein, 10 aa, Dengue virus
GEKKKLRPRW

SEQ ID NO: 65165 - protein, 10 aa, Dengue virus
EKKKLRPRWL

SEQ ID NO: 65166 - protein, 10 aa, Dengue virus
KKKLRPRWLD

SEQ ID NO: 65167 - protein, 10 aa, Dengue virus
KKLRPRWLDA

SEQ ID NO: 65168 - protein, 10 aa, Dengue virus
KLRPRWLDAR

SEQ ID NO: 65169 - protein, 10 aa, Dengue virus
LRPRWLDART

SEQ ID NO: 65170 - protein, 10 aa, Dengue virus
RPRWLDARTY

SEQ ID NO: 65171 - protein, 10 aa, Dengue virus
PRWLDARTYS

SEQ ID NO: 65172 - protein, 10 aa, Dengue virus
RWLDARTYSD

SEQ ID NO: 65173 - protein, 10 aa, Dengue virus
WLDARTYSDP

SEQ ID NO: 65174 - protein, 10 aa, Dengue virus
LDARTYSDPL

SEQ ID NO: 65175 - protein, 10 aa, Dengue virus
DARTYSDPLA

SEQ ID NO: 65176 - protein, 10 aa, Dengue virus
ARTYSDPLAL

SEQ ID NO: 65177 - protein, 10 aa, Dengue virus
RTYSDPLALK

SEQ ID NO: 65178 - protein, 10 aa, Dengue virus
TYSDPLALKE

SEQ ID NO: 65179 - protein, 10 aa, Dengue virus
YSDPLALKEF

SEQ ID NO: 65180 - protein, 10 aa, Dengue virus
SDPLALKEFK

SEQ ID NO: 65181 - protein, 10 aa, Dengue virus
DPLALKEFKD

SEQ ID NO: 65182 - protein, 10 aa, Dengue virus
PLALKEFKDF

SEQ ID NO: 65183 - protein, 10 aa, Dengue virus
LALKEFKDFA

SEQ ID NO: 65184 - protein, 10 aa, Dengue virus
ALKEFKDFAA

SEQ ID NO: 65185 - protein, 10 aa, Dengue virus
LKEFKDFAAG

SEQ ID NO: 65186 - protein, 10 aa, Dengue virus
KEFKDFAAGR

SEQ ID NO: 65187 - protein, 10 aa, Dengue virus
EFKDFAAGRK

SEQ ID NO: 65188 - protein, 10 aa, Dengue virus
FKDFAAGRKS

SEQ ID NO: 65189 - protein, 10 aa, Dengue virus
KDFAAGRKSI

SEQ ID NO: 65190 - protein, 10 aa, Dengue virus
DFAAGRKSIA

SEQ ID NO: 65191 - protein, 10 aa, Dengue virus
FAAGRKSIAL

SEQ ID NO: 65192 - protein, 10 aa, Dengue virus
AAGRKSIALD

SEQ ID NO: 65193 - protein, 10 aa, Dengue virus
AGRKSIALDL

SEQ ID NO: 65194 - protein, 10 aa, Dengue virus
GRKSIALDLV

SEQ ID NO: 65195 - protein, 10 aa, Dengue virus
RKSIALDLVT

SEQ ID NO: 65196 - protein, 10 aa, Dengue virus
KSIALDLVTE

SEQ ID NO: 65197 - protein, 10 aa, Dengue virus
SIALDLVTEI

SEQ ID NO: 65198 - protein, 10 aa, Dengue virus
IALDLVTEIG

SEQ ID NO: 65199 - protein, 10 aa, Dengue virus
ALDLVTEIGR

SEQ ID NO: 65200 - protein, 10 aa, Dengue virus
LDLVTEIGRV

SEQ ID NO: 65201 - protein, 10 aa, Dengue virus
DLVTEIGRVP

SEQ ID NO: 65202 - protein, 10 aa, Dengue virus
LVTEIGRVPS

SEQ ID NO: 65203 - protein, 10 aa, Dengue virus
VTEIGRVPSH

SEQ ID NO: 65204 - protein, 10 aa, Dengue virus
TEIGRVPSHL

SEQ ID NO: 65205 - protein, 10 aa, Dengue virus
EIGRVPSHLA

SEQ ID NO: 65206 - protein, 10 aa, Dengue virus
IGRVPSHLAH

SEQ ID NO: 65207 - protein, 10 aa, Dengue virus
GRVPSHLAHR

SEQ ID NO: 65208 - protein, 10 aa, Dengue virus
RVPSHLAHRT

SEQ ID NO: 65209 - protein, 10 aa, Dengue virus
VPSHLAHRTR

SEQ ID NO: 65210 - protein, 10 aa, Dengue virus
PSHLAHRTRN

SEQ ID NO: 65211 - protein, 10 aa, Dengue virus
SHLAHRTRNA

SEQ ID NO: 65212 - protein, 10 aa, Dengue virus
HLAHRTRNAL

SEQ ID NO: 65213 - protein, 10 aa, Dengue virus
LAHRTRNALD

SEQ ID NO: 65214 - protein, 10 aa, Dengue virus
AHRTRNALDN

SEQ ID NO: 65215 - protein, 10 aa, Dengue virus
HRTRNALDNL

SEQ ID NO: 65216 - protein, 10 aa, Dengue virus
RTRNALDNLV

SEQ ID NO: 65217 - protein, 10 aa, Dengue virus
TRNALDNLVM

SEQ ID NO: 65218 - protein, 10 aa, Dengue virus
RNALDNLVML

SEQ ID NO: 65219 - protein, 10 aa, Dengue virus
NALDNLVMLH

SEQ ID NO: 65220 - protein, 10 aa, Dengue virus
ALDNLVMLHT

SEQ ID NO: 65221 - protein, 10 aa, Dengue virus
LDNLVMLHTS

SEQ ID NO: 65222 - protein, 10 aa, Dengue virus
DNLVMLHTSE

SEQ ID NO: 65223 - protein, 10 aa, Dengue virus
NLVMLHTSEH

SEQ ID NO: 65224 - protein, 10 aa, Dengue virus
LVMLHTSEHG

SEQ ID NO: 65225 - protein, 10 aa, Dengue virus
VMLHTSEHGG

SEQ ID NO: 65226 - protein, 10 aa, Dengue virus
MLHTSEHGGR

SEQ ID NO: 65227 - protein, 10 aa, Dengue virus
LHTSEHGGRA

SEQ ID NO: 65228 - protein, 10 aa, Dengue virus
HTSEHGGRAY

SEQ ID NO: 65229 - protein, 10 aa, Dengue virus
TSEHGGRAYR

SEQ ID NO: 65230 - protein, 10 aa, Dengue virus
SEHGGRAYRH

SEQ ID NO: 65231 - protein, 10 aa, Dengue virus
EHGGRAYRHA

SEQ ID NO: 65232 - protein, 10 aa, Dengue virus
HGGRAYRHAV

SEQ ID NO: 65233 - protein, 10 aa, Dengue virus
GGRAYRHAVE

SEQ ID NO: 65234 - protein, 10 aa, Dengue virus
GRAYRHAVEE

SEQ ID NO: 65235 - protein, 10 aa, Dengue virus
RAYRHAVEEL

SEQ ID NO: 65236 - protein, 10 aa, Dengue virus
AYRHAVEELP

SEQ ID NO: 65237 - protein, 10 aa, Dengue virus
YRHAVEELPE

SEQ ID NO: 65238 - protein, 10 aa, Dengue virus
RHAVEELPET

SEQ ID NO: 65239 - protein, 10 aa, Dengue virus
HAVEELPETM

SEQ ID NO: 65240 - protein, 10 aa, Dengue virus
AVEELPETME

SEQ ID NO: 65241 - protein, 10 aa, Dengue virus
VEELPETMET

SEQ ID NO: 65242 - protein, 10 aa, Dengue virus
EELPETMETL

SEQ ID NO: 65243 - protein, 10 aa, Dengue virus
ELPETMETLL

SEQ ID NO: 65244 - protein, 10 aa, Dengue virus
LPETMETLLL

SEQ ID NO: 65245 - protein, 10 aa, Dengue virus
PETMETLLLL

SEQ ID NO: 65246 - protein, 10 aa, Dengue virus
ETMETLLLLG

SEQ ID NO: 65247 - protein, 10 aa, Dengue virus
TMETLLLLGL

SEQ ID NO: 65248 - protein, 10 aa, Dengue virus
METLLLLGLM

SEQ ID NO: 65249 - protein, 10 aa, Dengue virus
ETLLLLGLMI

SEQ ID NO: 65250 - protein, 10 aa, Dengue virus
TLLLLGLMIL

SEQ ID NO: 65251 - protein, 10 aa, Dengue virus
LLLLGLMILL

SEQ ID NO: 65252 - protein, 10 aa, Dengue virus
LLLGLMILLT

SEQ ID NO: 65253 - protein, 10 aa, Dengue virus
LLGLMILLTG

SEQ ID NO: 65254 - protein, 10 aa, Dengue virus
LGLMILLTGG

SEQ ID NO: 65255 - protein, 10 aa, Dengue virus
GLMILLTGGA

SEQ ID NO: 65256 - protein, 10 aa, Dengue virus
LMILLTGGAM

SEQ ID NO: 65257 - protein, 10 aa, Dengue virus
MILLTGGAML

SEQ ID NO: 65258 - protein, 10 aa, Dengue virus
ILLTGGAMLF

SEQ ID NO: 65259 - protein, 10 aa, Dengue virus
LLTGGAMLFL

SEQ ID NO: 65260 - protein, 10 aa, Dengue virus
LTGGAMLFLI

SEQ ID NO: 65261 - protein, 10 aa, Dengue virus
TGGAMLFLIS

SEQ ID NO: 65262 - protein, 10 aa, Dengue virus
GGAMLFLISG

SEQ ID NO: 65263 - protein, 10 aa, Dengue virus
GAMLFLISGK

SEQ ID NO: 65264 - protein, 10 aa, Dengue virus
AMLFLISGKG

SEQ ID NO: 65265 - protein, 10 aa, Dengue virus
MLFLISGKGI

SEQ ID NO: 65266 - protein, 10 aa, Dengue virus
LFLISGKGIG

SEQ ID NO: 65267 - protein, 10 aa, Dengue virus
FLISGKGIGK

SEQ ID NO: 65268 - protein, 10 aa, Dengue virus
LISGKGIGKT

SEQ ID NO: 65269 - protein, 10 aa, Dengue virus
ISGKGIGKTS

SEQ ID NO: 65270 - protein, 10 aa, Dengue virus
SGKGIGKTSI

SEQ ID NO: 65271 - protein, 10 aa, Dengue virus
GKGIGKTSIG

SEQ ID NO: 65272 - protein, 10 aa, Dengue virus
KGIGKTSIGL

SEQ ID NO: 65273 - protein, 10 aa, Dengue virus
GIGKTSIGLI

SEQ ID NO: 65274 - protein, 10 aa, Dengue virus
IGKTSIGLIC

SEQ ID NO: 65275 - protein, 10 aa, Dengue virus
GKTSIGLICV

SEQ ID NO: 65276 - protein, 10 aa, Dengue virus
KTSIGLICVI

SEQ ID NO: 65277 - protein, 10 aa, Dengue virus
TSIGLICVIA

SEQ ID NO: 65278 - protein, 10 aa, Dengue virus
SIGLICVIAS

SEQ ID NO: 65279 - protein, 10 aa, Dengue virus
IGLICVIASS

SEQ ID NO: 65280 - protein, 10 aa, Dengue virus
GLICVIASSG

SEQ ID NO: 65281 - protein, 10 aa, Dengue virus
LICVIASSGM

SEQ ID NO: 65282 - protein, 10 aa, Dengue virus
ICVIASSGML

SEQ ID NO: 65283 - protein, 10 aa, Dengue virus
CVIASSGMLW

SEQ ID NO: 65284 - protein, 10 aa, Dengue virus
VIASSGMLWM

SEQ ID NO: 65285 - protein, 10 aa, Dengue virus
IASSGMLWMA

SEQ ID NO: 65286 - protein, 10 aa, Dengue virus
ASSGMLWMAE

SEQ ID NO: 65287 - protein, 10 aa, Dengue virus
SSGMLWMAEI

SEQ ID NO: 65288 - protein, 10 aa, Dengue virus
SGMLWMAEIP

SEQ ID NO: 65289 - protein, 10 aa, Dengue virus
GMLWMAEIPL

SEQ ID NO: 65290 - protein, 10 aa, Dengue virus
MLWMAEIPLQ

SEQ ID NO: 65291 - protein, 10 aa, Dengue virus
LWMAEIPLQW

SEQ ID NO: 65292 - protein, 10 aa, Dengue virus
WMAEIPLQWI

SEQ ID NO: 65293 - protein, 10 aa, Dengue virus
MAEIPLQWIA

SEQ ID NO: 65294 - protein, 10 aa, Dengue virus
AEIPLQWIAS

SEQ ID NO: 65295 - protein, 10 aa, Dengue virus
EIPLQWIASA

SEQ ID NO: 65296 - protein, 10 aa, Dengue virus
IPLQWIASAI

SEQ ID NO: 65297 - protein, 10 aa, Dengue virus
PLQWIASAIV

SEQ ID NO: 65298 - protein, 10 aa, Dengue virus
LQWIASAIVL

SEQ ID NO: 65299 - protein, 10 aa, Dengue virus
QWIASAIVLE

SEQ ID NO: 65300 - protein, 10 aa, Dengue virus
WIASAIVLEF

SEQ ID NO: 65301 - protein, 10 aa, Dengue virus
IASAIVLEFF

SEQ ID NO: 65302 - protein, 10 aa, Dengue virus
ASAIVLEFFM

SEQ ID NO: 65303 - protein, 10 aa, Dengue virus
SAIVLEFFMM

SEQ ID NO: 65304 - protein, 10 aa, Dengue virus
AIVLEFFMMV

SEQ ID NO: 65305 - protein, 10 aa, Dengue virus
IVLEFFMMVL

SEQ ID NO: 65306 - protein, 10 aa, Dengue virus
VLEFFMMVLL

SEQ ID NO: 65307 - protein, 10 aa, Dengue virus
LEFFMMVLLI

SEQ ID NO: 65308 - protein, 10 aa, Dengue virus
EFFMMVLLIP

SEQ ID NO: 65309 - protein, 10 aa, Dengue virus
FFMMVLLIPE

SEQ ID NO: 65310 - protein, 10 aa, Dengue virus
FMMVLLIPEP

SEQ ID NO: 65311 - protein, 10 aa, Dengue virus
MMVLLIPEPE

SEQ ID NO: 65312 - protein, 10 aa, Dengue virus
MVLLIPEPEK

SEQ ID NO: 65313 - protein, 10 aa, Dengue virus
VLLIPEPEKQ

SEQ ID NO: 65314 - protein, 10 aa, Dengue virus
LLIPEPEKQR

SEQ ID NO: 65315 - protein, 10 aa, Dengue virus
LIPEPEKQRT

SEQ ID NO: 65316 - protein, 10 aa, Dengue virus
IPEPEKQRTP

SEQ ID NO: 65317 - protein, 10 aa, Dengue virus
PEPEKQRTPQ

SEQ ID NO: 65318 - protein, 10 aa, Dengue virus
EPEKQRTPQD

SEQ ID NO: 65319 - protein, 10 aa, Dengue virus
PEKQRTPQDN

SEQ ID NO: 65320 - protein, 10 aa, Dengue virus
EKQRTPQDNQ

SEQ ID NO: 65321 - protein, 10 aa, Dengue virus
KQRTPQDNQL

SEQ ID NO: 65322 - protein, 10 aa, Dengue virus
QRTPQDNQLA

SEQ ID NO: 65323 - protein, 10 aa, Dengue virus
RTPQDNQLAY

SEQ ID NO: 65324 - protein, 10 aa, Dengue virus
TPQDNQLAYV

SEQ ID NO: 65325 - protein, 10 aa, Dengue virus
PQDNQLAYVV

SEQ ID NO: 65326 - protein, 10 aa, Dengue virus
QDNQLAYVVI

SEQ ID NO: 65327 - protein, 10 aa, Dengue virus
DNQLAYVVIG

SEQ ID NO: 65328 - protein, 10 aa, Dengue virus
NQLAYVVIGI

SEQ ID NO: 65329 - protein, 10 aa, Dengue virus
QLAYVVIGIL

SEQ ID NO: 65330 - protein, 10 aa, Dengue virus
LAYVVIGILT

SEQ ID NO: 65331 - protein, 10 aa, Dengue virus
AYVVIGILTL

SEQ ID NO: 65332 - protein, 10 aa, Dengue virus
YVVIGILTLA

SEQ ID NO: 65333 - protein, 10 aa, Dengue virus
VVIGILTLAA

SEQ ID NO: 65334 - protein, 10 aa, Dengue virus
VIGILTLAAI

SEQ ID NO: 65335 - protein, 10 aa, Dengue virus
IGILTLAAII

SEQ ID NO: 65336 - protein, 10 aa, Dengue virus
GILTLAAIIA

SEQ ID NO: 65337 - protein, 10 aa, Dengue virus
ILTLAAIIAA

SEQ ID NO: 65338 - protein, 10 aa, Dengue virus
LTLAAIIAAN

SEQ ID NO: 65339 - protein, 10 aa, Dengue virus
TLAAIIAANE

SEQ ID NO: 65340 - protein, 10 aa, Dengue virus
LAAIIAANEM

SEQ ID NO: 65341 - protein, 10 aa, Dengue virus
AAIIAANEMG

SEQ ID NO: 65342 - protein, 10 aa, Dengue virus
AIIAANEMGL

SEQ ID NO: 65343 - protein, 10 aa, Dengue virus
IIAANEMGLL

SEQ ID NO: 65344 - protein, 10 aa, Dengue virus
IAANEMGLLE

SEQ ID NO: 65345 - protein, 10 aa, Dengue virus
AANEMGLLET

SEQ ID NO: 65346 - protein, 10 aa, Dengue virus
ANEMGLLETT

SEQ ID NO: 65347 - protein, 10 aa, Dengue virus
NEMGLLETTK

SEQ ID NO: 65348 - protein, 10 aa, Dengue virus
EMGLLETTKR

SEQ ID NO: 65349 - protein, 10 aa, Dengue virus
MGLLETTKRD

SEQ ID NO: 65350 - protein, 10 aa, Dengue virus
GLLETTKRDL

SEQ ID NO: 65351 - protein, 10 aa, Dengue virus
LLETTKRDLG

SEQ ID NO: 65352 - protein, 10 aa, Dengue virus
LETTKRDLGM

SEQ ID NO: 65353 - protein, 10 aa, Dengue virus
ETTKRDLGMS

SEQ ID NO: 65354 - protein, 10 aa, Dengue virus
TTKRDLGMSK

SEQ ID NO: 65355 - protein, 10 aa, Dengue virus
TKRDLGMSKE

SEQ ID NO: 65356 - protein, 10 aa, Dengue virus
KRDLGMSKEP

SEQ ID NO: 65357 - protein, 10 aa, Dengue virus
RDLGMSKEPG

SEQ ID NO: 65358 - protein, 10 aa, Dengue virus
DLGMSKEPGV

SEQ ID NO: 65359 - protein, 10 aa, Dengue virus
LGMSKEPGVV

SEQ ID NO: 65360 - protein, 10 aa, Dengue virus
GMSKEPGVVS

SEQ ID NO: 65361 - protein, 10 aa, Dengue virus
MSKEPGVVSP

SEQ ID NO: 65362 - protein, 10 aa, Dengue virus
EPGVVSPTSY

SEQ ID NO: 65363 - protein, 10 aa, Dengue virus
PGVVSPTSYL

SEQ ID NO: 65364 - protein, 10 aa, Dengue virus
GVVSPTSYLD

SEQ ID NO: 65365 - protein, 10 aa, Dengue virus
VVSPTSYLDV

SEQ ID NO: 65366 - protein, 10 aa, Dengue virus
VSPTSYLDVD

SEQ ID NO: 65367 - protein, 10 aa, Dengue virus
SPTSYLDVDL

SEQ ID NO: 65368 - protein, 10 aa, Dengue virus
PTSYLDVDLH

SEQ ID NO: 65369 - protein, 10 aa, Dengue virus
TSYLDVDLHP

SEQ ID NO: 65370 - protein, 10 aa, Dengue virus
SYLDVDLHPA

SEQ ID NO: 65371 - protein, 10 aa, Dengue virus
YLDVDLHPAS

SEQ ID NO: 65372 - protein, 10 aa, Dengue virus
LDVDLHPASA

SEQ ID NO: 65373 - protein, 10 aa, Dengue virus
DVDLHPASAW

SEQ ID NO: 65374 - protein, 10 aa, Dengue virus
VDLHPASAWT

SEQ ID NO: 65375 - protein, 10 aa, Dengue virus
DLHPASAWTL

SEQ ID NO: 65376 - protein, 10 aa, Dengue virus
LHPASAWTLY

SEQ ID NO: 65377 - protein, 10 aa, Dengue virus
HPASAWTLYA

SEQ ID NO: 65378 - protein, 10 aa, Dengue virus
PASAWTLYAV

SEQ ID NO: 65379 - protein, 10 aa, Dengue virus
ASAWTLYAVA

SEQ ID NO: 65380 - protein, 10 aa, Dengue virus
SAWTLYAVAT

SEQ ID NO: 65381 - protein, 10 aa, Dengue virus
AWTLYAVATT

SEQ ID NO: 65382 - protein, 10 aa, Dengue virus
WTLYAVATTV

SEQ ID NO: 65383 - protein, 10 aa, Dengue virus
TLYAVATTVI

SEQ ID NO: 65384 - protein, 10 aa, Dengue virus
LYAVATTVIT

SEQ ID NO: 65385 - protein, 10 aa, Dengue virus
YAVATTVITP

SEQ ID NO: 65386 - protein, 10 aa, Dengue virus
AVATTVITPM

SEQ ID NO: 65387 - protein, 10 aa, Dengue virus
VATTVITPML

SEQ ID NO: 65388 - protein, 10 aa, Dengue virus
ATTVITPMLR

SEQ ID NO: 65389 - protein, 10 aa, Dengue virus
TTVITPMLRH

SEQ ID NO: 65390 - protein, 10 aa, Dengue virus
TVITPMLRHT

SEQ ID NO: 65391 - protein, 10 aa, Dengue virus
VITPMLRHTI

SEQ ID NO: 65392 - protein, 10 aa, Dengue virus
ITPMLRHTIE

SEQ ID NO: 65393 - protein, 10 aa, Dengue virus
TPMLRHTIEN

SEQ ID NO: 65394 - protein, 10 aa, Dengue virus
PMLRHTIENS

SEQ ID NO: 65395 - protein, 10 aa, Dengue virus
MLRHTIENST

SEQ ID NO: 65396 - protein, 10 aa, Dengue virus
LRHTIENSTA

SEQ ID NO: 65397 - protein, 10 aa, Dengue virus
RHTIENSTAN

SEQ ID NO: 65398 - protein, 10 aa, Dengue virus
HTIENSTANV

SEQ ID NO: 65399 - protein, 10 aa, Dengue virus
TIENSTANVS

SEQ ID NO: 65400 - protein, 10 aa, Dengue virus
IENSTANVSL

SEQ ID NO: 65401 - protein, 10 aa, Dengue virus
ENSTANVSLA

SEQ ID NO: 65402 - protein, 10 aa, Dengue virus
NSTANVSLAA

SEQ ID NO: 65403 - protein, 10 aa, Dengue virus
STANVSLAAI

SEQ ID NO: 65404 - protein, 10 aa, Dengue virus
TANVSLAAIA

SEQ ID NO: 65405 - protein, 10 aa, Dengue virus
ANVSLAAIAN

SEQ ID NO: 65406 - protein, 10 aa, Dengue virus
NVSLAAIANQ

SEQ ID NO: 65407 - protein, 10 aa, Dengue virus
VSLAAIANQA

SEQ ID NO: 65408 - protein, 10 aa, Dengue virus
SLAAIANQAV

SEQ ID NO: 65409 - protein, 10 aa, Dengue virus
LAAIANQAVV

SEQ ID NO: 65410 - protein, 10 aa, Dengue virus
AAIANQAVVL

SEQ ID NO: 65411 - protein, 10 aa, Dengue virus
AIANQAVVLM

SEQ ID NO: 65412 - protein, 10 aa, Dengue virus
IANQAVVLMG

SEQ ID NO: 65413 - protein, 10 aa, Dengue virus
ANQAVVLMGL

SEQ ID NO: 65414 - protein, 10 aa, Dengue virus
NQAVVLMGLD

SEQ ID NO: 65415 - protein, 10 aa, Dengue virus
QAVVLMGLDK

SEQ ID NO: 65416 - protein, 10 aa, Dengue virus
AVVLMGLDKG

SEQ ID NO: 65417 - protein, 10 aa, Dengue virus
VVLMGLDKGW

SEQ ID NO: 65418 - protein, 10 aa, Dengue virus
VLMGLDKGWP

SEQ ID NO: 65419 - protein, 10 aa, Dengue virus
LMGLDKGWPI

SEQ ID NO: 65420 - protein, 10 aa, Dengue virus
MGLDKGWPIS

SEQ ID NO: 65421 - protein, 10 aa, Dengue virus
GLDKGWPISK

SEQ ID NO: 65422 - protein, 10 aa, Dengue virus
LDKGWPISKM

SEQ ID NO: 65423 - protein, 10 aa, Dengue virus
DKGWPISKMD

SEQ ID NO: 65424 - protein, 10 aa, Dengue virus
KGWPISKMDL

SEQ ID NO: 65425 - protein, 10 aa, Dengue virus
GWPISKMDLG

SEQ ID NO: 65426 - protein, 10 aa, Dengue virus
WPISKMDLGV

SEQ ID NO: 65427 - protein, 10 aa, Dengue virus
PISKMDLGVP

SEQ ID NO: 65428 - protein, 10 aa, Dengue virus
ISKMDLGVPL

SEQ ID NO: 65429 - protein, 10 aa, Dengue virus
SKMDLGVPLL

SEQ ID NO: 65430 - protein, 10 aa, Dengue virus
KMDLGVPLLA

SEQ ID NO: 65431 - protein, 10 aa, Dengue virus
MDLGVPLLAL

SEQ ID NO: 65432 - protein, 10 aa, Dengue virus
DLGVPLLALG

SEQ ID NO: 65433 - protein, 10 aa, Dengue virus
LGVPLLALGC

SEQ ID NO: 65434 - protein, 10 aa, Dengue virus
GVPLLALGCY

SEQ ID NO: 65435 - protein, 10 aa, Dengue virus
VPLLALGCYS

SEQ ID NO: 65436 - protein, 10 aa, Dengue virus
PLLALGCYSQ

SEQ ID NO: 65437 - protein, 10 aa, Dengue virus
LLALGCYSQV

SEQ ID NO: 65438 - protein, 10 aa, Dengue virus
LALGCYSQVN

SEQ ID NO: 65439 - protein, 10 aa, Dengue virus
ALGCYSQVNP

SEQ ID NO: 65440 - protein, 10 aa, Dengue virus
LGCYSQVNPL

SEQ ID NO: 65441 - protein, 10 aa, Dengue virus
GCYSQVNPLT

SEQ ID NO: 65442 - protein, 10 aa, Dengue virus
CYSQVNPLTL

SEQ ID NO: 65443 - protein, 10 aa, Dengue virus
YSQVNPLTLT

SEQ ID NO: 65444 - protein, 10 aa, Dengue virus
SQVNPLTLTA

SEQ ID NO: 65445 - protein, 10 aa, Dengue virus
QVNPLTLTAA

SEQ ID NO: 65446 - protein, 10 aa, Dengue virus
VNPLTLTAAV

SEQ ID NO: 65447 - protein, 10 aa, Dengue virus
NPLTLTAAVL

SEQ ID NO: 65448 - protein, 10 aa, Dengue virus
PLTLTAAVLL

SEQ ID NO: 65449 - protein, 10 aa, Dengue virus
LTLTAAVLLL

SEQ ID NO: 65450 - protein, 10 aa, Dengue virus
TLTAAVLLLI

SEQ ID NO: 65451 - protein, 10 aa, Dengue virus
LTAAVLLLIT

SEQ ID NO: 65452 - protein, 10 aa, Dengue virus
TAAVLLLITH

SEQ ID NO: 65453 - protein, 10 aa, Dengue virus
AAVLLLITHY

SEQ ID NO: 65454 - protein, 10 aa, Dengue virus
AVLLLITHYA

SEQ ID NO: 65455 - protein, 10 aa, Dengue virus
VLLLITHYAI

SEQ ID NO: 65456 - protein, 10 aa, Dengue virus
LLLITHYAII

SEQ ID NO: 65457 - protein, 10 aa, Dengue virus
LLITHYAIIG

SEQ ID NO: 65458 - protein, 10 aa, Dengue virus
LITHYAIIGP

SEQ ID NO: 65459 - protein, 10 aa, Dengue virus
ITHYAIIGPG

SEQ ID NO: 65460 - protein, 10 aa, Dengue virus
THYAIIGPGL

SEQ ID NO: 65461 - protein, 10 aa, Dengue virus
HYAIIGPGLQ

SEQ ID NO: 65462 - protein, 10 aa, Dengue virus
YAIIGPGLQA

SEQ ID NO: 65463 - protein, 10 aa, Dengue virus
AIIGPGLQAK

SEQ ID NO: 65464 - protein, 10 aa, Dengue virus
IIGPGLQAKA

SEQ ID NO: 65465 - protein, 10 aa, Dengue virus
IGPGLQAKAT

SEQ ID NO: 65466 - protein, 10 aa, Dengue virus
GPGLQAKATR

SEQ ID NO: 65467 - protein, 10 aa, Dengue virus
PGLQAKATRE

SEQ ID NO: 65468 - protein, 10 aa, Dengue virus
GLQAKATREA

SEQ ID NO: 65469 - protein, 10 aa, Dengue virus
LQAKATREAQ

SEQ ID NO: 65470 - protein, 10 aa, Dengue virus
QAKATREAQK

SEQ ID NO: 65471 - protein, 10 aa, Dengue virus
AKATREAQKR

SEQ ID NO: 65472 - protein, 10 aa, Dengue virus
KATREAQKRT

SEQ ID NO: 65473 - protein, 10 aa, Dengue virus
ATREAQKRTA

SEQ ID NO: 65474 - protein, 10 aa, Dengue virus
TREAQKRTAA

SEQ ID NO: 65475 - protein, 10 aa, Dengue virus
REAQKRTAAG

SEQ ID NO: 65476 - protein, 10 aa, Dengue virus
EAQKRTAAGI

SEQ ID NO: 65477 - protein, 10 aa, Dengue virus
AQKRTAAGIM

SEQ ID NO: 65478 - protein, 10 aa, Dengue virus
QKRTAAGIMK

SEQ ID NO: 65479 - protein, 10 aa, Dengue virus
KRTAAGIMKN

SEQ ID NO: 65480 - protein, 10 aa, Dengue virus
RTAAGIMKNP

SEQ ID NO: 65481 - protein, 10 aa, Dengue virus
TAAGIMKNPT

SEQ ID NO: 65482 - protein, 10 aa, Dengue virus
AAGIMKNPTV

SEQ ID NO: 65483 - protein, 10 aa, Dengue virus
AGIMKNPTVD

SEQ ID NO: 65484 - protein, 10 aa, Dengue virus
GIMKNPTVDG

SEQ ID NO: 65485 - protein, 10 aa, Dengue virus
IMKNPTVDGI

SEQ ID NO: 65486 - protein, 10 aa, Dengue virus
MKNPTVDGIM

SEQ ID NO: 65487 - protein, 10 aa, Dengue virus
KNPTVDGIMT

SEQ ID NO: 65488 - protein, 10 aa, Dengue virus
NPTVDGIMTI

SEQ ID NO: 65489 - protein, 10 aa, Dengue virus
PTVDGIMTID

SEQ ID NO: 65490 - protein, 10 aa, Dengue virus
TVDGIMTIDL

SEQ ID NO: 65491 - protein, 10 aa, Dengue virus
VDGIMTIDLD

SEQ ID NO: 65492 - protein, 10 aa, Dengue virus
DGIMTIDLDP

SEQ ID NO: 65493 - protein, 10 aa, Dengue virus
GIMTIDLDPV

SEQ ID NO: 65494 - protein, 10 aa, Dengue virus
IMTIDLDPVI

SEQ ID NO: 65495 - protein, 10 aa, Dengue virus
MTIDLDPVIY

SEQ ID NO: 65496 - protein, 10 aa, Dengue virus
TIDLDPVIYD

SEQ ID NO: 65497 - protein, 10 aa, Dengue virus
IDLDPVIYDS

SEQ ID NO: 65498 - protein, 10 aa, Dengue virus
DLDPVIYDSK

SEQ ID NO: 65499 - protein, 10 aa, Dengue virus
LDPVIYDSKF

SEQ ID NO: 65500 - protein, 10 aa, Dengue virus
DPVIYDSKFE

SEQ ID NO: 65501 - protein, 10 aa, Dengue virus
PVIYDSKFEK

SEQ ID NO: 65502 - protein, 10 aa, Dengue virus
VIYDSKFEKQ

SEQ ID NO: 65503 - protein, 10 aa, Dengue virus
IYDSKFEKQL

SEQ ID NO: 65504 - protein, 10 aa, Dengue virus
YDSKFEKQLG

SEQ ID NO: 65505 - protein, 10 aa, Dengue virus
DSKFEKQLGQ

SEQ ID NO: 65506 - protein, 10 aa, Dengue virus
SKFEKQLGQV

SEQ ID NO: 65507 - protein, 10 aa, Dengue virus
KFEKQLGQVM

SEQ ID NO: 65508 - protein, 10 aa, Dengue virus
FEKQLGQVML

SEQ ID NO: 65509 - protein, 10 aa, Dengue virus
EKQLGQVMLL

SEQ ID NO: 65510 - protein, 10 aa, Dengue virus
KQLGQVMLLV

SEQ ID NO: 65511 - protein, 10 aa, Dengue virus
QLGQVMLLVL

SEQ ID NO: 65512 - protein, 10 aa, Dengue virus
LGQVMLLVLC

SEQ ID NO: 65513 - protein, 10 aa, Dengue virus
GQVMLLVLCA

SEQ ID NO: 65514 - protein, 10 aa, Dengue virus
QVMLLVLCAV

SEQ ID NO: 65515 - protein, 10 aa, Dengue virus
VMLLVLCAVQ

SEQ ID NO: 65516 - protein, 10 aa, Dengue virus
MLLVLCAVQL

SEQ ID NO: 65517 - protein, 10 aa, Dengue virus
LLVLCAVQLL

SEQ ID NO: 65518 - protein, 10 aa, Dengue virus
LVLCAVQLLL

SEQ ID NO: 65519 - protein, 10 aa, Dengue virus
VLCAVQLLLM

SEQ ID NO: 65520 - protein, 10 aa, Dengue virus
LCAVQLLLMR

SEQ ID NO: 65521 - protein, 10 aa, Dengue virus
CAVQLLLMRT

SEQ ID NO: 65522 - protein, 10 aa, Dengue virus
AVQLLLMRTS

SEQ ID NO: 65523 - protein, 10 aa, Dengue virus
VQLLLMRTSW

SEQ ID NO: 65524 - protein, 10 aa, Dengue virus
QLLLMRTSWA

SEQ ID NO: 65525 - protein, 10 aa, Dengue virus
LLLMRTSWAL

SEQ ID NO: 65526 - protein, 10 aa, Dengue virus
LLMRTSWALC

SEQ ID NO: 65527 - protein, 10 aa, Dengue virus
LMRTSWALCE

SEQ ID NO: 65528 - protein, 10 aa, Dengue virus
MRTSWALCEA

SEQ ID NO: 65529 - protein, 10 aa, Dengue virus
RTSWALCEAL

SEQ ID NO: 65530 - protein, 10 aa, Dengue virus
TSWALCEALT

SEQ ID NO: 65531 - protein, 10 aa, Dengue virus
SWALCEALTL

SEQ ID NO: 65532 - protein, 10 aa, Dengue virus
WALCEALTLA

SEQ ID NO: 65533 - protein, 10 aa, Dengue virus
ALCEALTLAT

SEQ ID NO: 65534 - protein, 10 aa, Dengue virus
LCEALTLATG

SEQ ID NO: 65535 - protein, 10 aa, Dengue virus
CEALTLATGP

SEQ ID NO: 65536 - protein, 10 aa, Dengue virus
EALTLATGPI

SEQ ID NO: 65537 - protein, 10 aa, Dengue virus
ALTLATGPIT

SEQ ID NO: 65538 - protein, 10 aa, Dengue virus
LTLATGPITT

SEQ ID NO: 65539 - protein, 10 aa, Dengue virus
TLATGPITTL

SEQ ID NO: 65540 - protein, 10 aa, Dengue virus
LATGPITTLW

SEQ ID NO: 65541 - protein, 10 aa, Dengue virus
ATGPITTLWE

SEQ ID NO: 65542 - protein, 10 aa, Dengue virus
TGPITTLWEG

SEQ ID NO: 65543 - protein, 10 aa, Dengue virus
GPITTLWEGS

SEQ ID NO: 65544 - protein, 10 aa, Dengue virus
PITTLWEGSP

SEQ ID NO: 65545 - protein, 10 aa, Dengue virus
ITTLWEGSPG

SEQ ID NO: 65546 - protein, 10 aa, Dengue virus
TTLWEGSPGK

SEQ ID NO: 65547 - protein, 10 aa, Dengue virus
TLWEGSPGKF

SEQ ID NO: 65548 - protein, 10 aa, Dengue virus
LWEGSPGKFW

SEQ ID NO: 65549 - protein, 10 aa, Dengue virus
WEGSPGKFWN

SEQ ID NO: 65550 - protein, 10 aa, Dengue virus
EGSPGKFWNT

SEQ ID NO: 65551 - protein, 10 aa, Dengue virus
GSPGKFWNTT

SEQ ID NO: 65552 - protein, 10 aa, Dengue virus
SPGKFWNTTI

SEQ ID NO: 65553 - protein, 10 aa, Dengue virus
PGKFWNTTIA

SEQ ID NO: 65554 - protein, 10 aa, Dengue virus
GKFWNTTIAV

SEQ ID NO: 65555 - protein, 10 aa, Dengue virus
KFWNTTIAVS

SEQ ID NO: 65556 - protein, 10 aa, Dengue virus
FWNTTIAVSM

SEQ ID NO: 65557 - protein, 10 aa, Dengue virus
WNTTIAVSMA

SEQ ID NO: 65558 - protein, 10 aa, Dengue virus
NTTIAVSMAN

SEQ ID NO: 65559 - protein, 10 aa, Dengue virus
TTIAVSMANI

SEQ ID NO: 65560 - protein, 10 aa, Dengue virus
TIAVSMANIF

SEQ ID NO: 65561 - protein, 10 aa, Dengue virus
IAVSMANIFR

SEQ ID NO: 65562 - protein, 10 aa, Dengue virus
AVSMANIFRG

SEQ ID NO: 65563 - protein, 10 aa, Dengue virus
VSMANIFRGS

SEQ ID NO: 65564 - protein, 10 aa, Dengue virus
SMANIFRGSY

SEQ ID NO: 65565 - protein, 10 aa, Dengue virus
MANIFRGSYL

SEQ ID NO: 65566 - protein, 10 aa, Dengue virus
ANIFRGSYLA

SEQ ID NO: 65567 - protein, 10 aa, Dengue virus
NIFRGSYLAG

SEQ ID NO: 65568 - protein, 10 aa, Dengue virus
IFRGSYLAGA

SEQ ID NO: 65569 - protein, 10 aa, Dengue virus
FRGSYLAGAG

SEQ ID NO: 65570 - protein, 10 aa, Dengue virus
RGSYLAGAGL

SEQ ID NO: 65571 - protein, 10 aa, Dengue virus
GSYLAGAGLA

SEQ ID NO: 65572 - protein, 10 aa, Dengue virus
SYLAGAGLAF

SEQ ID NO: 65573 - protein, 10 aa, Dengue virus
YLAGAGLAFS

SEQ ID NO: 65574 - protein, 10 aa, Dengue virus
LAGAGLAFSI

SEQ ID NO: 65575 - protein, 10 aa, Dengue virus
AGAGLAFSIM

SEQ ID NO: 65576 - protein, 10 aa, Dengue virus
GAGLAFSIMK

SEQ ID NO: 65577 - protein, 10 aa, Dengue virus
AGLAFSIMKS

SEQ ID NO: 65578 - protein, 10 aa, Dengue virus
GLAFSIMKSV

SEQ ID NO: 65579 - protein, 10 aa, Dengue virus
LAFSIMKSVG

SEQ ID NO: 65580 - protein, 10 aa, Dengue virus
AFSIMKSVGT

SEQ ID NO: 65581 - protein, 10 aa, Dengue virus
FSIMKSVGTG

SEQ ID NO: 65582 - protein, 10 aa, Dengue virus
SIMKSVGTGK

SEQ ID NO: 65583 - protein, 10 aa, Dengue virus
IMKSVGTGKR

SEQ ID NO: 65584 - protein, 10 aa, Dengue virus
MKSVGTGKRG

SEQ ID NO: 65585 - protein, 10 aa, Dengue virus
KSVGTGKRGT

SEQ ID NO: 65586 - protein, 10 aa, Dengue virus
SVGTGKRGTG

SEQ ID NO: 65587 - protein, 10 aa, Dengue virus
VGTGKRGTGS

SEQ ID NO: 65588 - protein, 10 aa, Dengue virus
GTGKRGTGSQ

SEQ ID NO: 65589 - protein, 10 aa, Dengue virus
TGKRGTGSQG

SEQ ID NO: 65590 - protein, 10 aa, Dengue virus
GKRGTGSQGE

SEQ ID NO: 65591 - protein, 10 aa, Dengue virus
KRGTGSQGET

SEQ ID NO: 65592 - protein, 10 aa, Dengue virus
RGTGSQGETL

SEQ ID NO: 65593 - protein, 10 aa, Dengue virus
GTGSQGETLG

SEQ ID NO: 65594 - protein, 10 aa, Dengue virus
TGSQGETLGE

SEQ ID NO: 65595 - protein, 10 aa, Dengue virus
GSQGETLGEK

SEQ ID NO: 65596 - protein, 10 aa, Dengue virus
SQGETLGEKW

SEQ ID NO: 65597 - protein, 10 aa, Dengue virus
QGETLGEKWK

SEQ ID NO: 65598 - protein, 10 aa, Dengue virus
GETLGEKWKK

SEQ ID NO: 65599 - protein, 10 aa, Dengue virus
ETLGEKWKKK

SEQ ID NO: 65600 - protein, 10 aa, Dengue virus
TLGEKWKKKL

SEQ ID NO: 65601 - protein, 10 aa, Dengue virus
LGEKWKKKLN

SEQ ID NO: 65602 - protein, 10 aa, Dengue virus
GEKWKKKLNQ

SEQ ID NO: 65603 - protein, 10 aa, Dengue virus
EKWKKKLNQL

SEQ ID NO: 65604 - protein, 10 aa, Dengue virus
KWKKKLNQLS

SEQ ID NO: 65605 - protein, 10 aa, Dengue virus
WKKKLNQLSR

SEQ ID NO: 65606 - protein, 10 aa, Dengue virus
KKKLNQLSRK

SEQ ID NO: 65607 - protein, 10 aa, Dengue virus
KLNQLSRKEF

SEQ ID NO: 65608 - protein, 10 aa, Dengue virus
LNQLSRKEFD

SEQ ID NO: 65609 - protein, 10 aa, Dengue virus
NQLSRKEFDL

SEQ ID NO: 65610 - protein, 10 aa, Dengue virus
QLSRKEFDLY

SEQ ID NO: 65611 - protein, 10 aa, Dengue virus
LSRKEFDLYK

SEQ ID NO: 65612 - protein, 10 aa, Dengue virus
SRKEFDLYKK

SEQ ID NO: 65613 - protein, 10 aa, Dengue virus
RKEFDLYKKS

SEQ ID NO: 65614 - protein, 10 aa, Dengue virus
KEFDLYKKSG

SEQ ID NO: 65615 - protein, 10 aa, Dengue virus
EFDLYKKSGI

SEQ ID NO: 65616 - protein, 10 aa, Dengue virus
FDLYKKSGIT

SEQ ID NO: 65617 - protein, 10 aa, Dengue virus
DLYKKSGITE

SEQ ID NO: 65618 - protein, 10 aa, Dengue virus
LYKKSGITEV

SEQ ID NO: 65619 - protein, 10 aa, Dengue virus
YKKSGITEVD

SEQ ID NO: 65620 - protein, 10 aa, Dengue virus
KKSGITEVDR

SEQ ID NO: 65621 - protein, 10 aa, Dengue virus
KSGITEVDRT

SEQ ID NO: 65622 - protein, 10 aa, Dengue virus
SGITEVDRTE

SEQ ID NO: 65623 - protein, 10 aa, Dengue virus
GITEVDRTEA

SEQ ID NO: 65624 - protein, 10 aa, Dengue virus
ITEVDRTEAK

SEQ ID NO: 65625 - protein, 10 aa, Dengue virus
TEVDRTEAKE

SEQ ID NO: 65626 - protein, 10 aa, Dengue virus
EVDRTEAKEG

SEQ ID NO: 65627 - protein, 10 aa, Dengue virus
VDRTEAKEGL

SEQ ID NO: 65628 - protein, 10 aa, Dengue virus
DRTEAKEGLK

SEQ ID NO: 65629 - protein, 10 aa, Dengue virus
RTEAKEGLKR

SEQ ID NO: 65630 - protein, 10 aa, Dengue virus
TEAKEGLKRG

SEQ ID NO: 65631 - protein, 10 aa, Dengue virus
EAKEGLKRGE

SEQ ID NO: 65632 - protein, 10 aa, Dengue virus
AKEGLKRGEI

SEQ ID NO: 65633 - protein, 10 aa, Dengue virus
KEGLKRGEIT

SEQ ID NO: 65634 - protein, 10 aa, Dengue virus
RGEITHHAVS

SEQ ID NO: 65635 - protein, 10 aa, Dengue virus
GEITHHAVSR

SEQ ID NO: 65636 - protein, 10 aa, Dengue virus
EITHHAVSRG

SEQ ID NO: 65637 - protein, 10 aa, Dengue virus
ITHHAVSRGS

SEQ ID NO: 65638 - protein, 10 aa, Dengue virus
THHAVSRGSA

SEQ ID NO: 65639 - protein, 10 aa, Dengue virus
HHAVSRGSAK

SEQ ID NO: 65640 - protein, 10 aa, Dengue virus
HAVSRGSAKL

SEQ ID NO: 65641 - protein, 10 aa, Dengue virus
AVSRGSAKLQ

SEQ ID NO: 65642 - protein, 10 aa, Dengue virus
VSRGSAKLQW

SEQ ID NO: 65643 - protein, 10 aa, Dengue virus
SRGSAKLQWF

SEQ ID NO: 65644 - protein, 10 aa, Dengue virus
RGSAKLQWFV

SEQ ID NO: 65645 - protein, 10 aa, Dengue virus
GSAKLQWFVE

SEQ ID NO: 65646 - protein, 10 aa, Dengue virus
SAKLQWFVER

SEQ ID NO: 65647 - protein, 10 aa, Dengue virus
AKLQWFVERN

SEQ ID NO: 65648 - protein, 10 aa, Dengue virus
KLQWFVERNM

SEQ ID NO: 65649 - protein, 10 aa, Dengue virus
LQWFVERNMV

SEQ ID NO: 65650 - protein, 10 aa, Dengue virus
QWFVERNMVI

SEQ ID NO: 65651 - protein, 10 aa, Dengue virus
WFVERNMVIP

SEQ ID NO: 65652 - protein, 10 aa, Dengue virus
FVERNMVIPE

SEQ ID NO: 65653 - protein, 10 aa, Dengue virus
VERNMVIPEG

SEQ ID NO: 65654 - protein, 10 aa, Dengue virus
ERNMVIPEGR

SEQ ID NO: 65655 - protein, 10 aa, Dengue virus
RNMVIPEGRV

SEQ ID NO: 65656 - protein, 10 aa, Dengue virus
NMVIPEGRVI

SEQ ID NO: 65657 - protein, 10 aa, Dengue virus
MVIPEGRVID

SEQ ID NO: 65658 - protein, 10 aa, Dengue virus
VIPEGRVIDL

SEQ ID NO: 65659 - protein, 10 aa, Dengue virus
IPEGRVIDLG

SEQ ID NO: 65660 - protein, 10 aa, Dengue virus
PEGRVIDLGC

SEQ ID NO: 65661 - protein, 10 aa, Dengue virus
EGRVIDLGCG

SEQ ID NO: 65662 - protein, 10 aa, Dengue virus
GRVIDLGCGR

SEQ ID NO: 65663 - protein, 10 aa, Dengue virus
RVIDLGCGRG

SEQ ID NO: 65664 - protein, 10 aa, Dengue virus
VIDLGCGRGG

SEQ ID NO: 65665 - protein, 10 aa, Dengue virus
IDLGCGRGGW

SEQ ID NO: 65666 - protein, 10 aa, Dengue virus
DLGCGRGGWS

SEQ ID NO: 65667 - protein, 10 aa, Dengue virus
LGCGRGGWSY

SEQ ID NO: 65668 - protein, 10 aa, Dengue virus
GCGRGGWSYY

SEQ ID NO: 65669 - protein, 10 aa, Dengue virus
CGRGGWSYYC

SEQ ID NO: 65670 - protein, 10 aa, Dengue virus
GRGGWSYYCA

SEQ ID NO: 65671 - protein, 10 aa, Dengue virus
RGGWSYYCAG

SEQ ID NO: 65672 - protein, 10 aa, Dengue virus
GGWSYYCAGL

SEQ ID NO: 65673 - protein, 10 aa, Dengue virus
GWSYYCAGLK

SEQ ID NO: 65674 - protein, 10 aa, Dengue virus
WSYYCAGLKK

SEQ ID NO: 65675 - protein, 10 aa, Dengue virus
SYYCAGLKKV

SEQ ID NO: 65676 - protein, 10 aa, Dengue virus
YYCAGLKKVT

SEQ ID NO: 65677 - protein, 10 aa, Dengue virus
YCAGLKKVTE

SEQ ID NO: 65678 - protein, 10 aa, Dengue virus
CAGLKKVTEV

SEQ ID NO: 65679 - protein, 10 aa, Dengue virus
AGLKKVTEVR

SEQ ID NO: 65680 - protein, 10 aa, Dengue virus
GLKKVTEVRG

SEQ ID NO: 65681 - protein, 10 aa, Dengue virus
LKKVTEVRGY

SEQ ID NO: 65682 - protein, 10 aa, Dengue virus
KKVTEVRGYT

SEQ ID NO: 65683 - protein, 10 aa, Dengue virus
KVTEVRGYTK

SEQ ID NO: 65684 - protein, 10 aa, Dengue virus
VTEVRGYTKG

SEQ ID NO: 65685 - protein, 10 aa, Dengue virus
TEVRGYTKGG

SEQ ID NO: 65686 - protein, 10 aa, Dengue virus
EVRGYTKGGP

SEQ ID NO: 65687 - protein, 10 aa, Dengue virus
VRGYTKGGPG

SEQ ID NO: 65688 - protein, 10 aa, Dengue virus
RGYTKGGPGH

SEQ ID NO: 65689 - protein, 10 aa, Dengue virus
GYTKGGPGHE

SEQ ID NO: 65690 - protein, 10 aa, Dengue virus
YTKGGPGHEE

SEQ ID NO: 65691 - protein, 10 aa, Dengue virus
TKGGPGHEEP

SEQ ID NO: 65692 - protein, 10 aa, Dengue virus
KGGPGHEEPV

SEQ ID NO: 65693 - protein, 10 aa, Dengue virus
GGPGHEEPVP

SEQ ID NO: 65694 - protein, 10 aa, Dengue virus
GPGHEEPVPM

SEQ ID NO: 65695 - protein, 10 aa, Dengue virus
PGHEEPVPMS

SEQ ID NO: 65696 - protein, 10 aa, Dengue virus
GHEEPVPMST

SEQ ID NO: 65697 - protein, 10 aa, Dengue virus
HEEPVPMSTY

SEQ ID NO: 65698 - protein, 10 aa, Dengue virus
EEPVPMSTYG

SEQ ID NO: 65699 - protein, 10 aa, Dengue virus
EPVPMSTYGW

SEQ ID NO: 65700 - protein, 10 aa, Dengue virus
PVPMSTYGWN

SEQ ID NO: 65701 - protein, 10 aa, Dengue virus
VPMSTYGWNI

SEQ ID NO: 65702 - protein, 10 aa, Dengue virus
PMSTYGWNIV

SEQ ID NO: 65703 - protein, 10 aa, Dengue virus
MSTYGWNIVK

SEQ ID NO: 65704 - protein, 10 aa, Dengue virus
STYGWNIVKL

SEQ ID NO: 65705 - protein, 10 aa, Dengue virus
TYGWNIVKLM

SEQ ID NO: 65706 - protein, 10 aa, Dengue virus
YGWNIVKLMS

SEQ ID NO: 65707 - protein, 10 aa, Dengue virus
GWNIVKLMSG

SEQ ID NO: 65708 - protein, 10 aa, Dengue virus
WNIVKLMSGK

SEQ ID NO: 65709 - protein, 10 aa, Dengue virus
NIVKLMSGKD

SEQ ID NO: 65710 - protein, 10 aa, Dengue virus
IVKLMSGKDV

SEQ ID NO: 65711 - protein, 10 aa, Dengue virus
VKLMSGKDVF

SEQ ID NO: 65712 - protein, 10 aa, Dengue virus
KLMSGKDVFY

SEQ ID NO: 65713 - protein, 10 aa, Dengue virus
LMSGKDVFYL

SEQ ID NO: 65714 - protein, 10 aa, Dengue virus
MSGKDVFYLP

SEQ ID NO: 65715 - protein, 10 aa, Dengue virus
SGKDVFYLPP

SEQ ID NO: 65716 - protein, 10 aa, Dengue virus
GKDVFYLPPE

SEQ ID NO: 65717 - protein, 10 aa, Dengue virus
KDVFYLPPEK

SEQ ID NO: 65718 - protein, 10 aa, Dengue virus
DVFYLPPEKC

SEQ ID NO: 65719 - protein, 10 aa, Dengue virus
VFYLPPEKCD

SEQ ID NO: 65720 - protein, 10 aa, Dengue virus
FYLPPEKCDT

SEQ ID NO: 65721 - protein, 10 aa, Dengue virus
YLPPEKCDTL

SEQ ID NO: 65722 - protein, 10 aa, Dengue virus
LPPEKCDTLL

SEQ ID NO: 65723 - protein, 10 aa, Dengue virus
PPEKCDTLLC

SEQ ID NO: 65724 - protein, 10 aa, Dengue virus
PEKCDTLLCD

SEQ ID NO: 65725 - protein, 10 aa, Dengue virus
EKCDTLLCDI

SEQ ID NO: 65726 - protein, 10 aa, Dengue virus
KCDTLLCDIG

SEQ ID NO: 65727 - protein, 10 aa, Dengue virus
CDTLLCDIGE

SEQ ID NO: 65728 - protein, 10 aa, Dengue virus
DTLLCDIGES

SEQ ID NO: 65729 - protein, 10 aa, Dengue virus
TLLCDIGESS

SEQ ID NO: 65730 - protein, 10 aa, Dengue virus
LLCDIGESSP

SEQ ID NO: 65731 - protein, 10 aa, Dengue virus
LCDIGESSPS

SEQ ID NO: 65732 - protein, 10 aa, Dengue virus
CDIGESSPSP

SEQ ID NO: 65733 - protein, 10 aa, Dengue virus
DIGESSPSPT

SEQ ID NO: 65734 - protein, 10 aa, Dengue virus
IGESSPSPTV

SEQ ID NO: 65735 - protein, 10 aa, Dengue virus
GESSPSPTVE

SEQ ID NO: 65736 - protein, 10 aa, Dengue virus
ESSPSPTVEE

SEQ ID NO: 65737 - protein, 10 aa, Dengue virus
SSPSPTVEES

SEQ ID NO: 65738 - protein, 10 aa, Dengue virus
SPSPTVEESR

SEQ ID NO: 65739 - protein, 10 aa, Dengue virus
PSPTVEESRT

SEQ ID NO: 65740 - protein, 10 aa, Dengue virus
SPTVEESRTI

SEQ ID NO: 65741 - protein, 10 aa, Dengue virus
PTVEESRTIR

SEQ ID NO: 65742 - protein, 10 aa, Dengue virus
TVEESRTIRV

SEQ ID NO: 65743 - protein, 10 aa, Dengue virus
VEESRTIRVL

SEQ ID NO: 65744 - protein, 10 aa, Dengue virus
EESRTIRVLK

SEQ ID NO: 65745 - protein, 10 aa, Dengue virus
ESRTIRVLKM

SEQ ID NO: 65746 - protein, 10 aa, Dengue virus
SRTIRVLKMV

SEQ ID NO: 65747 - protein, 10 aa, Dengue virus
RTIRVLKMVE

SEQ ID NO: 65748 - protein, 10 aa, Dengue virus
TIRVLKMVEP

SEQ ID NO: 65749 - protein, 10 aa, Dengue virus
IRVLKMVEPW

SEQ ID NO: 65750 - protein, 10 aa, Dengue virus
RVLKMVEPWL

SEQ ID NO: 65751 - protein, 10 aa, Dengue virus
VLKMVEPWLK

SEQ ID NO: 65752 - protein, 10 aa, Dengue virus
LKMVEPWLKN

SEQ ID NO: 65753 - protein, 10 aa, Dengue virus
KMVEPWLKNN

SEQ ID NO: 65754 - protein, 10 aa, Dengue virus
MVEPWLKNNQ

SEQ ID NO: 65755 - protein, 10 aa, Dengue virus
VEPWLKNNQF

SEQ ID NO: 65756 - protein, 10 aa, Dengue virus
EPWLKNNQFC

SEQ ID NO: 65757 - protein, 10 aa, Dengue virus
PWLKNNQFCI

SEQ ID NO: 65758 - protein, 10 aa, Dengue virus
WLKNNQFCIK

SEQ ID NO: 65759 - protein, 10 aa, Dengue virus
LKNNQFCIKV

SEQ ID NO: 65760 - protein, 10 aa, Dengue virus
KNNQFCIKVL

SEQ ID NO: 65761 - protein, 10 aa, Dengue virus
NNQFCIKVLN

SEQ ID NO: 65762 - protein, 10 aa, Dengue virus
NQFCIKVLNP

SEQ ID NO: 65763 - protein, 10 aa, Dengue virus
QFCIKVLNPY

SEQ ID NO: 65764 - protein, 10 aa, Dengue virus
FCIKVLNPYM

SEQ ID NO: 65765 - protein, 10 aa, Dengue virus
CIKVLNPYMP

SEQ ID NO: 65766 - protein, 10 aa, Dengue virus
IKVLNPYMPT

SEQ ID NO: 65767 - protein, 10 aa, Dengue virus
KVLNPYMPTV

SEQ ID NO: 65768 - protein, 10 aa, Dengue virus
VLNPYMPTVI

SEQ ID NO: 65769 - protein, 10 aa, Dengue virus
LNPYMPTVIE

SEQ ID NO: 65770 - protein, 10 aa, Dengue virus
NPYMPTVIEH

SEQ ID NO: 65771 - protein, 10 aa, Dengue virus
PYMPTVIEHL

SEQ ID NO: 65772 - protein, 10 aa, Dengue virus
YMPTVIEHLE

SEQ ID NO: 65773 - protein, 10 aa, Dengue virus
MPTVIEHLER

SEQ ID NO: 65774 - protein, 10 aa, Dengue virus
PTVIEHLERL

SEQ ID NO: 65775 - protein, 10 aa, Dengue virus
TVIEHLERLQ

SEQ ID NO: 65776 - protein, 10 aa, Dengue virus
VIEHLERLQR

SEQ ID NO: 65777 - protein, 10 aa, Dengue virus
IEHLERLQRK

SEQ ID NO: 65778 - protein, 10 aa, Dengue virus
EHLERLQRKH

SEQ ID NO: 65779 - protein, 10 aa, Dengue virus
HLERLQRKHG

SEQ ID NO: 65780 - protein, 10 aa, Dengue virus
LERLQRKHGG

SEQ ID NO: 65781 - protein, 10 aa, Dengue virus
ERLQRKHGGM

SEQ ID NO: 65782 - protein, 10 aa, Dengue virus
RLQRKHGGML

SEQ ID NO: 65783 - protein, 10 aa, Dengue virus
LQRKHGGMLV

SEQ ID NO: 65784 - protein, 10 aa, Dengue virus
QRKHGGMLVR

SEQ ID NO: 65785 - protein, 10 aa, Dengue virus
RKHGGMLVRN

SEQ ID NO: 65786 - protein, 10 aa, Dengue virus
KHGGMLVRNP

SEQ ID NO: 65787 - protein, 10 aa, Dengue virus
HGGMLVRNPL

SEQ ID NO: 65788 - protein, 10 aa, Dengue virus
GGMLVRNPLS

SEQ ID NO: 65789 - protein, 10 aa, Dengue virus
GMLVRNPLSR

SEQ ID NO: 65790 - protein, 10 aa, Dengue virus
MLVRNPLSRN

SEQ ID NO: 65791 - protein, 10 aa, Dengue virus
LVRNPLSRNS

SEQ ID NO: 65792 - protein, 10 aa, Dengue virus
VRNPLSRNST

SEQ ID NO: 65793 - protein, 10 aa, Dengue virus
RNPLSRNSTH

SEQ ID NO: 65794 - protein, 10 aa, Dengue virus
NPLSRNSTHE

SEQ ID NO: 65795 - protein, 10 aa, Dengue virus
PLSRNSTHEM

SEQ ID NO: 65796 - protein, 10 aa, Dengue virus
LSRNSTHEMY

SEQ ID NO: 65797 - protein, 10 aa, Dengue virus
SRNSTHEMYW

SEQ ID NO: 65798 - protein, 10 aa, Dengue virus
RNSTHEMYWI

SEQ ID NO: 65799 - protein, 10 aa, Dengue virus
NSTHEMYWIS

SEQ ID NO: 65800 - protein, 10 aa, Dengue virus
STHEMYWISN

SEQ ID NO: 65801 - protein, 10 aa, Dengue virus
THEMYWISNG

SEQ ID NO: 65802 - protein, 10 aa, Dengue virus
HEMYWISNGT

SEQ ID NO: 65803 - protein, 10 aa, Dengue virus
EMYWISNGTG

SEQ ID NO: 65804 - protein, 10 aa, Dengue virus
MYWISNGTGN

SEQ ID NO: 65805 - protein, 10 aa, Dengue virus
YWISNGTGNI

SEQ ID NO: 65806 - protein, 10 aa, Dengue virus
WISNGTGNIV

SEQ ID NO: 65807 - protein, 10 aa, Dengue virus
ISNGTGNIVA

SEQ ID NO: 65808 - protein, 10 aa, Dengue virus
SNGTGNIVAS

SEQ ID NO: 65809 - protein, 10 aa, Dengue virus
NGTGNIVASV

SEQ ID NO: 65810 - protein, 10 aa, Dengue virus
GTGNIVASVN

SEQ ID NO: 65811 - protein, 10 aa, Dengue virus
TGNIVASVNM

SEQ ID NO: 65812 - protein, 10 aa, Dengue virus
GNIVASVNMV

SEQ ID NO: 65813 - protein, 10 aa, Dengue virus
NIVASVNMVS

SEQ ID NO: 65814 - protein, 10 aa, Dengue virus
IVASVNMVSR

SEQ ID NO: 65815 - protein, 10 aa, Dengue virus
VASVNMVSRL

SEQ ID NO: 65816 - protein, 10 aa, Dengue virus
ASVNMVSRLL

SEQ ID NO: 65817 - protein, 10 aa, Dengue virus
SVNMVSRLLL

SEQ ID NO: 65818 - protein, 10 aa, Dengue virus
VNMVSRLLLN

SEQ ID NO: 65819 - protein, 10 aa, Dengue virus
NMVSRLLLNR

SEQ ID NO: 65820 - protein, 10 aa, Dengue virus
MVSRLLLNRF

SEQ ID NO: 65821 - protein, 10 aa, Dengue virus
VSRLLLNRFT

SEQ ID NO: 65822 - protein, 10 aa, Dengue virus
SRLLLNRFTM

SEQ ID NO: 65823 - protein, 10 aa, Dengue virus
RLLLNRFTMT

SEQ ID NO: 65824 - protein, 10 aa, Dengue virus
LLLNRFTMTH

SEQ ID NO: 65825 - protein, 10 aa, Dengue virus
LLNRFTMTHR

SEQ ID NO: 65826 - protein, 10 aa, Dengue virus
LNRFTMTHRR

SEQ ID NO: 65827 - protein, 10 aa, Dengue virus
NRFTMTHRRP

SEQ ID NO: 65828 - protein, 10 aa, Dengue virus
RFTMTHRRPT

SEQ ID NO: 65829 - protein, 10 aa, Dengue virus
FTMTHRRPTI

SEQ ID NO: 65830 - protein, 10 aa, Dengue virus
TMTHRRPTIE

SEQ ID NO: 65831 - protein, 10 aa, Dengue virus
MTHRRPTIEK

SEQ ID NO: 65832 - protein, 10 aa, Dengue virus
THRRPTIEKD

SEQ ID NO: 65833 - protein, 10 aa, Dengue virus
HRRPTIEKDV

SEQ ID NO: 65834 - protein, 10 aa, Dengue virus
RRPTIEKDVD

SEQ ID NO: 65835 - protein, 10 aa, Dengue virus
RPTIEKDVDL

SEQ ID NO: 65836 - protein, 10 aa, Dengue virus
PTIEKDVDLG

SEQ ID NO: 65837 - protein, 10 aa, Dengue virus
TIEKDVDLGA

SEQ ID NO: 65838 - protein, 10 aa, Dengue virus
IEKDVDLGAG

SEQ ID NO: 65839 - protein, 10 aa, Dengue virus
EKDVDLGAGT

SEQ ID NO: 65840 - protein, 10 aa, Dengue virus
KDVDLGAGTR

SEQ ID NO: 65841 - protein, 10 aa, Dengue virus
DVDLGAGTRH

SEQ ID NO: 65842 - protein, 10 aa, Dengue virus
VDLGAGTRHV

SEQ ID NO: 65843 - protein, 10 aa, Dengue virus
DLGAGTRHVN

SEQ ID NO: 65844 - protein, 10 aa, Dengue virus
LGAGTRHVNA

SEQ ID NO: 65845 - protein, 10 aa, Dengue virus
GAGTRHVNAE

SEQ ID NO: 65846 - protein, 10 aa, Dengue virus
AGTRHVNAEP

SEQ ID NO: 65847 - protein, 10 aa, Dengue virus
GTRHVNAEPE

SEQ ID NO: 65848 - protein, 10 aa, Dengue virus
TRHVNAEPET

SEQ ID NO: 65849 - protein, 10 aa, Dengue virus
RHVNAEPETP

SEQ ID NO: 65850 - protein, 10 aa, Dengue virus
HVNAEPETPN

SEQ ID NO: 65851 - protein, 10 aa, Dengue virus
VNAEPETPNM

SEQ ID NO: 65852 - protein, 10 aa, Dengue virus
NAEPETPNMD

SEQ ID NO: 65853 - protein, 10 aa, Dengue virus
AEPETPNMDV

SEQ ID NO: 65854 - protein, 10 aa, Dengue virus
EPETPNMDVI

SEQ ID NO: 65855 - protein, 10 aa, Dengue virus
PETPNMDVIG

SEQ ID NO: 65856 - protein, 10 aa, Dengue virus
ETPNMDVIGE

SEQ ID NO: 65857 - protein, 10 aa, Dengue virus
TPNMDVIGER

SEQ ID NO: 65858 - protein, 10 aa, Dengue virus
PNMDVIGERI

SEQ ID NO: 65859 - protein, 10 aa, Dengue virus
NMDVIGERIK

SEQ ID NO: 65860 - protein, 10 aa, Dengue virus
MDVIGERIKR

SEQ ID NO: 65861 - protein, 10 aa, Dengue virus
DVIGERIKRI

SEQ ID NO: 65862 - protein, 10 aa, Dengue virus
VIGERIKRIK

SEQ ID NO: 65863 - protein, 10 aa, Dengue virus
IGERIKRIKE

SEQ ID NO: 65864 - protein, 10 aa, Dengue virus
GERIKRIKEE

SEQ ID NO: 65865 - protein, 10 aa, Dengue virus
ERIKRIKEEH

SEQ ID NO: 65866 - protein, 10 aa, Dengue virus
RIKEEHNSTW

SEQ ID NO: 65867 - protein, 10 aa, Dengue virus
IKEEHNSTWH

SEQ ID NO: 65868 - protein, 10 aa, Dengue virus
KEEHNSTWHY

SEQ ID NO: 65869 - protein, 10 aa, Dengue virus
EEHNSTWHYD

SEQ ID NO: 65870 - protein, 10 aa, Dengue virus
EHNSTWHYDD

SEQ ID NO: 65871 - protein, 10 aa, Dengue virus
HNSTWHYDDE

SEQ ID NO: 65872 - protein, 10 aa, Dengue virus
NSTWHYDDEN

SEQ ID NO: 65873 - protein, 10 aa, Dengue virus
STWHYDDENP

SEQ ID NO: 65874 - protein, 10 aa, Dengue virus
TWHYDDENPY

SEQ ID NO: 65875 - protein, 10 aa, Dengue virus
WHYDDENPYK

SEQ ID NO: 65876 - protein, 10 aa, Dengue virus
HYDDENPYKT

SEQ ID NO: 65877 - protein, 10 aa, Dengue virus
YDDENPYKTW

SEQ ID NO: 65878 - protein, 10 aa, Dengue virus
DDENPYKTWA

SEQ ID NO: 65879 - protein, 10 aa, Dengue virus
DENPYKTWAY

SEQ ID NO: 65880 - protein, 10 aa, Dengue virus
ENPYKTWAYH

SEQ ID NO: 65881 - protein, 10 aa, Dengue virus
NPYKTWAYHG

SEQ ID NO: 65882 - protein, 10 aa, Dengue virus
PYKTWAYHGS

SEQ ID NO: 65883 - protein, 10 aa, Dengue virus
YKTWAYHGSY

SEQ ID NO: 65884 - protein, 10 aa, Dengue virus
KTWAYHGSYE

SEQ ID NO: 65885 - protein, 10 aa, Dengue virus
TWAYHGSYEV

SEQ ID NO: 65886 - protein, 10 aa, Dengue virus
WAYHGSYEVK

SEQ ID NO: 65887 - protein, 10 aa, Dengue virus
AYHGSYEVKA

SEQ ID NO: 65888 - protein, 10 aa, Dengue virus
YHGSYEVKAT

SEQ ID NO: 65889 - protein, 10 aa, Dengue virus
HGSYEVKATG

SEQ ID NO: 65890 - protein, 10 aa, Dengue virus
GSYEVKATGS

SEQ ID NO: 65891 - protein, 10 aa, Dengue virus
SYEVKATGSA

SEQ ID NO: 65892 - protein, 10 aa, Dengue virus
YEVKATGSAS

SEQ ID NO: 65893 - protein, 10 aa, Dengue virus
EVKATGSASS

SEQ ID NO: 65894 - protein, 10 aa, Dengue virus
VKATGSASSM

SEQ ID NO: 65895 - protein, 10 aa, Dengue virus
KATGSASSMI

SEQ ID NO: 65896 - protein, 10 aa, Dengue virus
ATGSASSMIN

SEQ ID NO: 65897 - protein, 10 aa, Dengue virus
TGSASSMING

SEQ ID NO: 65898 - protein, 10 aa, Dengue virus
GSASSMINGV

SEQ ID NO: 65899 - protein, 10 aa, Dengue virus
SASSMINGVV

SEQ ID NO: 65900 - protein, 10 aa, Dengue virus
ASSMINGVVK

SEQ ID NO: 65901 - protein, 10 aa, Dengue virus
SSMINGVVKL

SEQ ID NO: 65902 - protein, 10 aa, Dengue virus
SMINGVVKLL

SEQ ID NO: 65903 - protein, 10 aa, Dengue virus
MINGVVKLLT

SEQ ID NO: 65904 - protein, 10 aa, Dengue virus
INGVVKLLTK

SEQ ID NO: 65905 - protein, 10 aa, Dengue virus
NGVVKLLTKP

SEQ ID NO: 65906 - protein, 10 aa, Dengue virus
GVVKLLTKPW

SEQ ID NO: 65907 - protein, 10 aa, Dengue virus
VVKLLTKPWD

SEQ ID NO: 65908 - protein, 10 aa, Dengue virus
VKLLTKPWDV

SEQ ID NO: 65909 - protein, 10 aa, Dengue virus
KLLTKPWDVV

SEQ ID NO: 65910 - protein, 10 aa, Dengue virus
LLTKPWDVVP

SEQ ID NO: 65911 - protein, 10 aa, Dengue virus
LTKPWDVVPM

SEQ ID NO: 65912 - protein, 10 aa, Dengue virus
TKPWDVVPMV

SEQ ID NO: 65913 - protein, 10 aa, Dengue virus
KPWDVVPMVT

SEQ ID NO: 65914 - protein, 10 aa, Dengue virus
PWDVVPMVTQ

SEQ ID NO: 65915 - protein, 10 aa, Dengue virus
WDVVPMVTQM

SEQ ID NO: 65916 - protein, 10 aa, Dengue virus
DVVPMVTQMA

SEQ ID NO: 65917 - protein, 10 aa, Dengue virus
VVPMVTQMAM

SEQ ID NO: 65918 - protein, 10 aa, Dengue virus
VPMVTQMAMT

SEQ ID NO: 65919 - protein, 10 aa, Dengue virus
PMVTQMAMTD

SEQ ID NO: 65920 - protein, 10 aa, Dengue virus
MVTQMAMTDT

SEQ ID NO: 65921 - protein, 10 aa, Dengue virus
VTQMAMTDTT

SEQ ID NO: 65922 - protein, 10 aa, Dengue virus
TQMAMTDTTP

SEQ ID NO: 65923 - protein, 10 aa, Dengue virus
QMAMTDTTPF

SEQ ID NO: 65924 - protein, 10 aa, Dengue virus
MAMTDTTPFG

SEQ ID NO: 65925 - protein, 10 aa, Dengue virus
AMTDTTPFGQ

SEQ ID NO: 65926 - protein, 10 aa, Dengue virus
MTDTTPFGQQ

SEQ ID NO: 65927 - protein, 10 aa, Dengue virus
TDTTPFGQQR

SEQ ID NO: 65928 - protein, 10 aa, Dengue virus
DTTPFGQQRV

SEQ ID NO: 65929 - protein, 10 aa, Dengue virus
TTPFGQQRVF

SEQ ID NO: 65930 - protein, 10 aa, Dengue virus
TPFGQQRVFK

SEQ ID NO: 65931 - protein, 10 aa, Dengue virus
PFGQQRVFKE

SEQ ID NO: 65932 - protein, 10 aa, Dengue virus
FGQQRVFKEK

SEQ ID NO: 65933 - protein, 10 aa, Dengue virus
GQQRVFKEKV

SEQ ID NO: 65934 - protein, 10 aa, Dengue virus
QQRVFKEKVD

SEQ ID NO: 65935 - protein, 10 aa, Dengue virus
QRVFKEKVDT

SEQ ID NO: 65936 - protein, 10 aa, Dengue virus
RVFKEKVDTR

SEQ ID NO: 65937 - protein, 10 aa, Dengue virus
VFKEKVDTRT

SEQ ID NO: 65938 - protein, 10 aa, Dengue virus
FKEKVDTRTP

SEQ ID NO: 65939 - protein, 10 aa, Dengue virus
KEKVDTRTPR

SEQ ID NO: 65940 - protein, 10 aa, Dengue virus
EKVDTRTPRS

SEQ ID NO: 65941 - protein, 10 aa, Dengue virus
KVDTRTPRSM

SEQ ID NO: 65942 - protein, 10 aa, Dengue virus
VDTRTPRSMP

SEQ ID NO: 65943 - protein, 10 aa, Dengue virus
DTRTPRSMPG

SEQ ID NO: 65944 - protein, 10 aa, Dengue virus
TRTPRSMPGT

SEQ ID NO: 65945 - protein, 10 aa, Dengue virus
RTPRSMPGTR

SEQ ID NO: 65946 - protein, 10 aa, Dengue virus
VMEITAEWLW

SEQ ID NO: 65947 - protein, 10 aa, Dengue virus
MEITAEWLWR

SEQ ID NO: 65948 - protein, 10 aa, Dengue virus
EITAEWLWRT

SEQ ID NO: 65949 - protein, 10 aa, Dengue virus
ITAEWLWRTL

SEQ ID NO: 65950 - protein, 10 aa, Dengue virus
TAEWLWRTLG

SEQ ID NO: 65951 - protein, 10 aa, Dengue virus
AEWLWRTLGR

SEQ ID NO: 65952 - protein, 10 aa, Dengue virus
EWLWRTLGRN

SEQ ID NO: 65953 - protein, 10 aa, Dengue virus
WLWRTLGRNK

SEQ ID NO: 65954 - protein, 10 aa, Dengue virus
LWRTLGRNKK

SEQ ID NO: 65955 - protein, 10 aa, Dengue virus
WRTLGRNKKP

SEQ ID NO: 65956 - protein, 10 aa, Dengue virus
RTLGRNKKPR

SEQ ID NO: 65957 - protein, 10 aa, Dengue virus
TLGRNKKPRL

SEQ ID NO: 65958 - protein, 10 aa, Dengue virus
LGRNKKPRLC

SEQ ID NO: 65959 - protein, 10 aa, Dengue virus
GRNKKPRLCT

SEQ ID NO: 65960 - protein, 10 aa, Dengue virus
RNKKPRLCTR

SEQ ID NO: 65961 - protein, 10 aa, Dengue virus
NKKPRLCTRE

SEQ ID NO: 65962 - protein, 10 aa, Dengue virus
KKPRLCTREE

SEQ ID NO: 65963 - protein, 10 aa, Dengue virus
KPRLCTREEF

SEQ ID NO: 65964 - protein, 10 aa, Dengue virus
PRLCTREEFT

SEQ ID NO: 65965 - protein, 10 aa, Dengue virus
RLCTREEFTK

SEQ ID NO: 65966 - protein, 10 aa, Dengue virus
LCTREEFTKK

SEQ ID NO: 65967 - protein, 10 aa, Dengue virus
CTREEFTKKV

SEQ ID NO: 65968 - protein, 10 aa, Dengue virus
TREEFTKKVR

SEQ ID NO: 65969 - protein, 10 aa, Dengue virus
REEFTKKVRT

SEQ ID NO: 65970 - protein, 10 aa, Dengue virus
EEFTKKVRTN

SEQ ID NO: 65971 - protein, 10 aa, Dengue virus
EFTKKVRTNA

SEQ ID NO: 65972 - protein, 10 aa, Dengue virus
FTKKVRTNAA

SEQ ID NO: 65973 - protein, 10 aa, Dengue virus
TKKVRTNAAM

SEQ ID NO: 65974 - protein, 10 aa, Dengue virus
KKVRTNAAMG

SEQ ID NO: 65975 - protein, 10 aa, Dengue virus
KVRTNAAMGA

SEQ ID NO: 65976 - protein, 10 aa, Dengue virus
VRTNAAMGAV

SEQ ID NO: 65977 - protein, 10 aa, Dengue virus
RTNAAMGAVF

SEQ ID NO: 65978 - protein, 10 aa, Dengue virus
TNAAMGAVFT

SEQ ID NO: 65979 - protein, 10 aa, Dengue virus
NAAMGAVFTE

SEQ ID NO: 65980 - protein, 10 aa, Dengue virus
AAMGAVFTEE

SEQ ID NO: 65981 - protein, 10 aa, Dengue virus
AMGAVFTEEN

SEQ ID NO: 65982 - protein, 10 aa, Dengue virus
MGAVFTEENQ

SEQ ID NO: 65983 - protein, 10 aa, Dengue virus
GAVFTEENQW

SEQ ID NO: 65984 - protein, 10 aa, Dengue virus
AVFTEENQWD

SEQ ID NO: 65985 - protein, 10 aa, Dengue virus
VFTEENQWDS

SEQ ID NO: 65986 - protein, 10 aa, Dengue virus
FTEENQWDSA

SEQ ID NO: 65987 - protein, 10 aa, Dengue virus
TEENQWDSAK

SEQ ID NO: 65988 - protein, 10 aa, Dengue virus
EENQWDSAKA

SEQ ID NO: 65989 - protein, 10 aa, Dengue virus
ENQWDSAKAA

SEQ ID NO: 65990 - protein, 10 aa, Dengue virus
NQWDSAKAAV

SEQ ID NO: 65991 - protein, 10 aa, Dengue virus
QWDSAKAAVE

SEQ ID NO: 65992 - protein, 10 aa, Dengue virus
WDSAKAAVED

SEQ ID NO: 65993 - protein, 10 aa, Dengue virus
DSAKAAVEDE

SEQ ID NO: 65994 - protein, 10 aa, Dengue virus
SAKAAVEDED

SEQ ID NO: 65995 - protein, 10 aa, Dengue virus
AKAAVEDEDF

SEQ ID NO: 65996 - protein, 10 aa, Dengue virus
KAAVEDEDFW

SEQ ID NO: 65997 - protein, 10 aa, Dengue virus
AAVEDEDFWK

SEQ ID NO: 65998 - protein, 10 aa, Dengue virus
AVEDEDFWKL

SEQ ID NO: 65999 - protein, 10 aa, Dengue virus
VEDEDFWKLV

SEQ ID NO: 66000 - protein, 10 aa, Dengue virus
EDEDFWKLVD

SEQ ID NO: 66001 - protein, 10 aa, Dengue virus
DEDFWKLVDR

SEQ ID NO: 66002 - protein, 10 aa, Dengue virus
EDFWKLVDRE

SEQ ID NO: 66003 - protein, 10 aa, Dengue virus
DFWKLVDRER

SEQ ID NO: 66004 - protein, 10 aa, Dengue virus
FWKLVDRERE

SEQ ID NO: 66005 - protein, 10 aa, Dengue virus
WKLVDREREL

SEQ ID NO: 66006 - protein, 10 aa, Dengue virus
KLVDRERELH

SEQ ID NO: 66007 - protein, 10 aa, Dengue virus
LVDRERELHK

SEQ ID NO: 66008 - protein, 10 aa, Dengue virus
VDRERELHKL

SEQ ID NO: 66009 - protein, 10 aa, Dengue virus
DRERELHKLG

SEQ ID NO: 66010 - protein, 10 aa, Dengue virus
RERELHKLGK

SEQ ID NO: 66011 - protein, 10 aa, Dengue virus
ERELHKLGKC

SEQ ID NO: 66012 - protein, 10 aa, Dengue virus
RELHKLGKCG

SEQ ID NO: 66013 - protein, 10 aa, Dengue virus
ELHKLGKCGS

SEQ ID NO: 66014 - protein, 10 aa, Dengue virus
LHKLGKCGSC

SEQ ID NO: 66015 - protein, 10 aa, Dengue virus
HKLGKCGSCV

SEQ ID NO: 66016 - protein, 10 aa, Dengue virus
KLGKCGSCVY

SEQ ID NO: 66017 - protein, 10 aa, Dengue virus
LGKCGSCVYN

SEQ ID NO: 66018 - protein, 10 aa, Dengue virus
GKCGSCVYNM

SEQ ID NO: 66019 - protein, 10 aa, Dengue virus
KCGSCVYNMM

SEQ ID NO: 66020 - protein, 10 aa, Dengue virus
CGSCVYNMMG

SEQ ID NO: 66021 - protein, 10 aa, Dengue virus
GSCVYNMMGK

SEQ ID NO: 66022 - protein, 10 aa, Dengue virus
SCVYNMMGKR

SEQ ID NO: 66023 - protein, 10 aa, Dengue virus
CVYNMMGKRE

SEQ ID NO: 66024 - protein, 10 aa, Dengue virus
VYNMMGKREK

SEQ ID NO: 66025 - protein, 10 aa, Dengue virus
YNMMGKREKK

SEQ ID NO: 66026 - protein, 10 aa, Dengue virus
NMMGKREKKL

SEQ ID NO: 66027 - protein, 10 aa, Dengue virus
MMGKREKKLG

SEQ ID NO: 66028 - protein, 10 aa, Dengue virus
MGKREKKLGE

SEQ ID NO: 66029 - protein, 10 aa, Dengue virus
GKREKKLGEF

SEQ ID NO: 66030 - protein, 10 aa, Dengue virus
KREKKLGEFG

SEQ ID NO: 66031 - protein, 10 aa, Dengue virus
REKKLGEFGK

SEQ ID NO: 66032 - protein, 10 aa, Dengue virus
EKKLGEFGKA

SEQ ID NO: 66033 - protein, 10 aa, Dengue virus
KKLGEFGKAK

SEQ ID NO: 66034 - protein, 10 aa, Dengue virus
KLGEFGKAKG

SEQ ID NO: 66035 - protein, 10 aa, Dengue virus
LGEFGKAKGS

SEQ ID NO: 66036 - protein, 10 aa, Dengue virus
GEFGKAKGSR

SEQ ID NO: 66037 - protein, 10 aa, Dengue virus
EFGKAKGSRA

SEQ ID NO: 66038 - protein, 10 aa, Dengue virus
FGKAKGSRAI

SEQ ID NO: 66039 - protein, 10 aa, Dengue virus
GKAKGSRAIW

SEQ ID NO: 66040 - protein, 10 aa, Dengue virus
KAKGSRAIWY

SEQ ID NO: 66041 - protein, 10 aa, Dengue virus
AKGSRAIWYM

SEQ ID NO: 66042 - protein, 10 aa, Dengue virus
KGSRAIWYMW

SEQ ID NO: 66043 - protein, 10 aa, Dengue virus
GSRAIWYMWL

SEQ ID NO: 66044 - protein, 10 aa, Dengue virus
SRAIWYMWLG

SEQ ID NO: 66045 - protein, 10 aa, Dengue virus
RAIWYMWLGA

SEQ ID NO: 66046 - protein, 10 aa, Dengue virus
AIWYMWLGAR

SEQ ID NO: 66047 - protein, 10 aa, Dengue virus
IWYMWLGARY

SEQ ID NO: 66048 - protein, 10 aa, Dengue virus
WYMWLGARYL

SEQ ID NO: 66049 - protein, 10 aa, Dengue virus
YMWLGARYLE

SEQ ID NO: 66050 - protein, 10 aa, Dengue virus
MWLGARYLEF

SEQ ID NO: 66051 - protein, 10 aa, Dengue virus
WLGARYLEFE

SEQ ID NO: 66052 - protein, 10 aa, Dengue virus
LGARYLEFEA

SEQ ID NO: 66053 - protein, 10 aa, Dengue virus
GARYLEFEAL

SEQ ID NO: 66054 - protein, 10 aa, Dengue virus
ARYLEFEALG

SEQ ID NO: 66055 - protein, 10 aa, Dengue virus
RYLEFEALGF

SEQ ID NO: 66056 - protein, 10 aa, Dengue virus
YLEFEALGFL

SEQ ID NO: 66057 - protein, 10 aa, Dengue virus
LEFEALGFLN

SEQ ID NO: 66058 - protein, 10 aa, Dengue virus
EFEALGFLNE

SEQ ID NO: 66059 - protein, 10 aa, Dengue virus
FEALGFLNED

SEQ ID NO: 66060 - protein, 10 aa, Dengue virus
EALGFLNEDH

SEQ ID NO: 66061 - protein, 10 aa, Dengue virus
ALGFLNEDHW

SEQ ID NO: 66062 - protein, 10 aa, Dengue virus
LGFLNEDHWF

SEQ ID NO: 66063 - protein, 10 aa, Dengue virus
GFLNEDHWFS

SEQ ID NO: 66064 - protein, 10 aa, Dengue virus
FLNEDHWFSR

SEQ ID NO: 66065 - protein, 10 aa, Dengue virus
LNEDHWFSRE

SEQ ID NO: 66066 - protein, 10 aa, Dengue virus
NEDHWFSREN

SEQ ID NO: 66067 - protein, 10 aa, Dengue virus
EDHWFSRENS

SEQ ID NO: 66068 - protein, 10 aa, Dengue virus
DHWFSRENSY

SEQ ID NO: 66069 - protein, 10 aa, Dengue virus
HWFSRENSYS

SEQ ID NO: 66070 - protein, 10 aa, Dengue virus
WFSRENSYSG

SEQ ID NO: 66071 - protein, 10 aa, Dengue virus
FSRENSYSGV

SEQ ID NO: 66072 - protein, 10 aa, Dengue virus
SRENSYSGVE

SEQ ID NO: 66073 - protein, 10 aa, Dengue virus
RENSYSGVEG

SEQ ID NO: 66074 - protein, 10 aa, Dengue virus
ENSYSGVEGE

SEQ ID NO: 66075 - protein, 10 aa, Dengue virus
NSYSGVEGEG

SEQ ID NO: 66076 - protein, 10 aa, Dengue virus
SYSGVEGEGL

SEQ ID NO: 66077 - protein, 10 aa, Dengue virus
YSGVEGEGLH

SEQ ID NO: 66078 - protein, 10 aa, Dengue virus
SGVEGEGLHK

SEQ ID NO: 66079 - protein, 10 aa, Dengue virus
GVEGEGLHKL

SEQ ID NO: 66080 - protein, 10 aa, Dengue virus
VEGEGLHKLG

SEQ ID NO: 66081 - protein, 10 aa, Dengue virus
EGEGLHKLGY

SEQ ID NO: 66082 - protein, 10 aa, Dengue virus
GEGLHKLGYI

SEQ ID NO: 66083 - protein, 10 aa, Dengue virus
EGLHKLGYIL

SEQ ID NO: 66084 - protein, 10 aa, Dengue virus
GLHKLGYILR

SEQ ID NO: 66085 - protein, 10 aa, Dengue virus
LHKLGYILRD

SEQ ID NO: 66086 - protein, 10 aa, Dengue virus
HKLGYILRDI

SEQ ID NO: 66087 - protein, 10 aa, Dengue virus
KLGYILRDIS

SEQ ID NO: 66088 - protein, 10 aa, Dengue virus
LGYILRDISK

SEQ ID NO: 66089 - protein, 10 aa, Dengue virus
GYILRDISKI

SEQ ID NO: 66090 - protein, 10 aa, Dengue virus
YILRDISKIP

SEQ ID NO: 66091 - protein, 10 aa, Dengue virus
ILRDISKIPG

SEQ ID NO: 66092 - protein, 10 aa, Dengue virus
LRDISKIPGG

SEQ ID NO: 66093 - protein, 10 aa, Dengue virus
RDISKIPGGA

SEQ ID NO: 66094 - protein, 10 aa, Dengue virus
DISKIPGGAM

SEQ ID NO: 66095 - protein, 10 aa, Dengue virus
ISKIPGGAMY

SEQ ID NO: 66096 - protein, 10 aa, Dengue virus
SKIPGGAMYA

SEQ ID NO: 66097 - protein, 10 aa, Dengue virus
KIPGGAMYAD

SEQ ID NO: 66098 - protein, 10 aa, Dengue virus
IPGGAMYADD

SEQ ID NO: 66099 - protein, 10 aa, Dengue virus
PGGAMYADDT

SEQ ID NO: 66100 - protein, 10 aa, Dengue virus
GGAMYADDTA

SEQ ID NO: 66101 - protein, 10 aa, Dengue virus
GAMYADDTAG

SEQ ID NO: 66102 - protein, 10 aa, Dengue virus
AMYADDTAGW

SEQ ID NO: 66103 - protein, 10 aa, Dengue virus
MYADDTAGWD

SEQ ID NO: 66104 - protein, 10 aa, Dengue virus
YADDTAGWDT

SEQ ID NO: 66105 - protein, 10 aa, Dengue virus
ADDTAGWDTR

SEQ ID NO: 66106 - protein, 10 aa, Dengue virus
DDTAGWDTRI

SEQ ID NO: 66107 - protein, 10 aa, Dengue virus
DTAGWDTRIT

SEQ ID NO: 66108 - protein, 10 aa, Dengue virus
TAGWDTRITE

SEQ ID NO: 66109 - protein, 10 aa, Dengue virus
AGWDTRITED

SEQ ID NO: 66110 - protein, 10 aa, Dengue virus
GWDTRITEDD

SEQ ID NO: 66111 - protein, 10 aa, Dengue virus
WDTRITEDDL

SEQ ID NO: 66112 - protein, 10 aa, Dengue virus
DTRITEDDLH

SEQ ID NO: 66113 - protein, 10 aa, Dengue virus
TRITEDDLHN

SEQ ID NO: 66114 - protein, 10 aa, Dengue virus
RITEDDLHNE

SEQ ID NO: 66115 - protein, 10 aa, Dengue virus
ITEDDLHNEE

SEQ ID NO: 66116 - protein, 10 aa, Dengue virus
TEDDLHNEEK

SEQ ID NO: 66117 - protein, 10 aa, Dengue virus
EDDLHNEEKI

SEQ ID NO: 66118 - protein, 10 aa, Dengue virus
DDLHNEEKIT

SEQ ID NO: 66119 - protein, 10 aa, Dengue virus
DLHNEEKITQ

SEQ ID NO: 66120 - protein, 10 aa, Dengue virus
LHNEEKITQQ

SEQ ID NO: 66121 - protein, 10 aa, Dengue virus
HNEEKITQQM

SEQ ID NO: 66122 - protein, 10 aa, Dengue virus
NEEKITQQMD

SEQ ID NO: 66123 - protein, 10 aa, Dengue virus
EEKITQQMDP

SEQ ID NO: 66124 - protein, 10 aa, Dengue virus
EKITQQMDPE

SEQ ID NO: 66125 - protein, 10 aa, Dengue virus
KITQQMDPEH

SEQ ID NO: 66126 - protein, 10 aa, Dengue virus
ITQQMDPEHR

SEQ ID NO: 66127 - protein, 10 aa, Dengue virus
QMDPEHRQLA

SEQ ID NO: 66128 - protein, 10 aa, Dengue virus
PEHRQLANAI

SEQ ID NO: 66129 - protein, 10 aa, Dengue virus
EHRQLANAIF

SEQ ID NO: 66130 - protein, 10 aa, Dengue virus
HRQLANAIFK

SEQ ID NO: 66131 - protein, 10 aa, Dengue virus
RQLANAIFKL

SEQ ID NO: 66132 - protein, 10 aa, Dengue virus
QLANAIFKLT

SEQ ID NO: 66133 - protein, 10 aa, Dengue virus
LANAIFKLTY

SEQ ID NO: 66134 - protein, 10 aa, Dengue virus
ANAIFKLTYQ

SEQ ID NO: 66135 - protein, 10 aa, Dengue virus
NAIFKLTYQN

SEQ ID NO: 66136 - protein, 10 aa, Dengue virus
AIFKLTYQNK

SEQ ID NO: 66137 - protein, 10 aa, Dengue virus
IFKLTYQNKV

SEQ ID NO: 66138 - protein, 10 aa, Dengue virus
FKLTYQNKVV

SEQ ID NO: 66139 - protein, 10 aa, Dengue virus
KLTYQNKVVK

SEQ ID NO: 66140 - protein, 10 aa, Dengue virus
LTYQNKVVKV

SEQ ID NO: 66141 - protein, 10 aa, Dengue virus
TYQNKVVKVQ

SEQ ID NO: 66142 - protein, 10 aa, Dengue virus
YQNKVVKVQR

SEQ ID NO: 66143 - protein, 10 aa, Dengue virus
QNKVVKVQRP

SEQ ID NO: 66144 - protein, 10 aa, Dengue virus
NKVVKVQRPT

SEQ ID NO: 66145 - protein, 10 aa, Dengue virus
KVVKVQRPTP

SEQ ID NO: 66146 - protein, 10 aa, Dengue virus
VVKVQRPTPT

SEQ ID NO: 66147 - protein, 10 aa, Dengue virus
VKVQRPTPTG

SEQ ID NO: 66148 - protein, 10 aa, Dengue virus
KVQRPTPTGT

SEQ ID NO: 66149 - protein, 10 aa, Dengue virus
VQRPTPTGTV

SEQ ID NO: 66150 - protein, 10 aa, Dengue virus
QRPTPTGTVM

SEQ ID NO: 66151 - protein, 10 aa, Dengue virus
RPTPTGTVMD

SEQ ID NO: 66152 - protein, 10 aa, Dengue virus
PTPTGTVMDI

SEQ ID NO: 66153 - protein, 10 aa, Dengue virus
TPTGTVMDII

SEQ ID NO: 66154 - protein, 10 aa, Dengue virus
PTGTVMDIIS

SEQ ID NO: 66155 - protein, 10 aa, Dengue virus
TGTVMDIISR

SEQ ID NO: 66156 - protein, 10 aa, Dengue virus
GTVMDIISRK

SEQ ID NO: 66157 - protein, 10 aa, Dengue virus
TVMDIISRKD

SEQ ID NO: 66158 - protein, 10 aa, Dengue virus
VMDIISRKDQ

SEQ ID NO: 66159 - protein, 10 aa, Dengue virus
MDIISRKDQR

SEQ ID NO: 66160 - protein, 10 aa, Dengue virus
DIISRKDQRG

SEQ ID NO: 66161 - protein, 10 aa, Dengue virus
IISRKDQRGS

SEQ ID NO: 66162 - protein, 10 aa, Dengue virus
ISRKDQRGSG

SEQ ID NO: 66163 - protein, 10 aa, Dengue virus
SRKDQRGSGQ

SEQ ID NO: 66164 - protein, 10 aa, Dengue virus
RKDQRGSGQV

SEQ ID NO: 66165 - protein, 10 aa, Dengue virus
KDQRGSGQVG

SEQ ID NO: 66166 - protein, 10 aa, Dengue virus
DQRGSGQVGT

SEQ ID NO: 66167 - protein, 10 aa, Dengue virus
QRGSGQVGTY

SEQ ID NO: 66168 - protein, 10 aa, Dengue virus
RGSGQVGTYG

SEQ ID NO: 66169 - protein, 10 aa, Dengue virus
GSGQVGTYGL

SEQ ID NO: 66170 - protein, 10 aa, Dengue virus
SGQVGTYGLN

SEQ ID NO: 66171 - protein, 10 aa, Dengue virus
GQVGTYGLNT

SEQ ID NO: 66172 - protein, 10 aa, Dengue virus
FTNMEAQLIR

SEQ ID NO: 66173 - protein, 10 aa, Dengue virus
TNMEAQLIRQ

SEQ ID NO: 66174 - protein, 10 aa, Dengue virus
NMEAQLIRQM

SEQ ID NO: 66175 - protein, 10 aa, Dengue virus
MEAQLIRQME

SEQ ID NO: 66176 - protein, 10 aa, Dengue virus
EAQLIRQMEG

SEQ ID NO: 66177 - protein, 10 aa, Dengue virus
AQLIRQMEGE

SEQ ID NO: 66178 - protein, 10 aa, Dengue virus
QLIRQMEGEG

SEQ ID NO: 66179 - protein, 10 aa, Dengue virus
LIRQMEGEGV

SEQ ID NO: 66180 - protein, 10 aa, Dengue virus
IRQMEGEGVL

SEQ ID NO: 66181 - protein, 10 aa, Dengue virus
RQMEGEGVLS

SEQ ID NO: 66182 - protein, 10 aa, Dengue virus
QMEGEGVLSK

SEQ ID NO: 66183 - protein, 10 aa, Dengue virus
MEGEGVLSKA

SEQ ID NO: 66184 - protein, 10 aa, Dengue virus
TQWLETKGVE

SEQ ID NO: 66185 - protein, 10 aa, Dengue virus
QWLETKGVER

SEQ ID NO: 66186 - protein, 10 aa, Dengue virus
WLETKGVERL

SEQ ID NO: 66187 - protein, 10 aa, Dengue virus
LETKGVERLK

SEQ ID NO: 66188 - protein, 10 aa, Dengue virus
ETKGVERLKR

SEQ ID NO: 66189 - protein, 10 aa, Dengue virus
TKGVERLKRM

SEQ ID NO: 66190 - protein, 10 aa, Dengue virus
KGVERLKRMA

SEQ ID NO: 66191 - protein, 10 aa, Dengue virus
GVERLKRMAI

SEQ ID NO: 66192 - protein, 10 aa, Dengue virus
VERLKRMAIS

SEQ ID NO: 66193 - protein, 10 aa, Dengue virus
ERLKRMAISG

SEQ ID NO: 66194 - protein, 10 aa, Dengue virus
RLKRMAISGD

SEQ ID NO: 66195 - protein, 10 aa, Dengue virus
LKRMAISGDD

SEQ ID NO: 66196 - protein, 10 aa, Dengue virus
KRMAISGDDC

SEQ ID NO: 66197 - protein, 10 aa, Dengue virus
RMAISGDDCV

SEQ ID NO: 66198 - protein, 10 aa, Dengue virus
MAISGDDCVV

SEQ ID NO: 66199 - protein, 10 aa, Dengue virus
AISGDDCVVK

SEQ ID NO: 66200 - protein, 10 aa, Dengue virus
ISGDDCVVKP

SEQ ID NO: 66201 - protein, 10 aa, Dengue virus
SGDDCVVKPI

SEQ ID NO: 66202 - protein, 10 aa, Dengue virus
GDDCVVKPID

SEQ ID NO: 66203 - protein, 10 aa, Dengue virus
DDCVVKPIDD

SEQ ID NO: 66204 - protein, 10 aa, Dengue virus
DCVVKPIDDR

SEQ ID NO: 66205 - protein, 10 aa, Dengue virus
CVVKPIDDRF

SEQ ID NO: 66206 - protein, 10 aa, Dengue virus
VVKPIDDRFA

SEQ ID NO: 66207 - protein, 10 aa, Dengue virus
VKPIDDRFAN

SEQ ID NO: 66208 - protein, 10 aa, Dengue virus
KPIDDRFANA

SEQ ID NO: 66209 - protein, 10 aa, Dengue virus
PIDDRFANAL

SEQ ID NO: 66210 - protein, 10 aa, Dengue virus
IDDRFANALL

SEQ ID NO: 66211 - protein, 10 aa, Dengue virus
DDRFANALLA

SEQ ID NO: 66212 - protein, 10 aa, Dengue virus
DRFANALLAL

SEQ ID NO: 66213 - protein, 10 aa, Dengue virus
RFANALLALN

SEQ ID NO: 66214 - protein, 10 aa, Dengue virus
FANALLALND

SEQ ID NO: 66215 - protein, 10 aa, Dengue virus
ANALLALNDM

SEQ ID NO: 66216 - protein, 10 aa, Dengue virus
NALLALNDMG

SEQ ID NO: 66217 - protein, 10 aa, Dengue virus
ALLALNDMGK

SEQ ID NO: 66218 - protein, 10 aa, Dengue virus
LLALNDMGKV

SEQ ID NO: 66219 - protein, 10 aa, Dengue virus
LALNDMGKVR

SEQ ID NO: 66220 - protein, 10 aa, Dengue virus
ALNDMGKVRK

SEQ ID NO: 66221 - protein, 10 aa, Dengue virus
LNDMGKVRKD

SEQ ID NO: 66222 - protein, 10 aa, Dengue virus
NDMGKVRKDI

SEQ ID NO: 66223 - protein, 10 aa, Dengue virus
DMGKVRKDIP

SEQ ID NO: 66224 - protein, 10 aa, Dengue virus
MGKVRKDIPQ

SEQ ID NO: 66225 - protein, 10 aa, Dengue virus
GKVRKDIPQW

SEQ ID NO: 66226 - protein, 10 aa, Dengue virus
KVRKDIPQWQ

SEQ ID NO: 66227 - protein, 10 aa, Dengue virus
VRKDIPQWQP

SEQ ID NO: 66228 - protein, 10 aa, Dengue virus
RKDIPQWQPS

SEQ ID NO: 66229 - protein, 10 aa, Dengue virus
KDIPQWQPSK

SEQ ID NO: 66230 - protein, 10 aa, Dengue virus
DIPQWQPSKG

SEQ ID NO: 66231 - protein, 10 aa, Dengue virus
IPQWQPSKGW

SEQ ID NO: 66232 - protein, 10 aa, Dengue virus
PQWQPSKGWH

SEQ ID NO: 66233 - protein, 10 aa, Dengue virus
QWQPSKGWHD

SEQ ID NO: 66234 - protein, 10 aa, Dengue virus
WQPSKGWHDW

SEQ ID NO: 66235 - protein, 10 aa, Dengue virus
QPSKGWHDWQ

SEQ ID NO: 66236 - protein, 10 aa, Dengue virus
PSKGWHDWQQ

SEQ ID NO: 66237 - protein, 10 aa, Dengue virus
SKGWHDWQQV

SEQ ID NO: 66238 - protein, 10 aa, Dengue virus
KGWHDWQQVP

SEQ ID NO: 66239 - protein, 10 aa, Dengue virus
GWHDWQQVPF

SEQ ID NO: 66240 - protein, 10 aa, Dengue virus
WHDWQQVPFC

SEQ ID NO: 66241 - protein, 10 aa, Dengue virus
HDWQQVPFCS

SEQ ID NO: 66242 - protein, 10 aa, Dengue virus
DWQQVPFCSH

SEQ ID NO: 66243 - protein, 10 aa, Dengue virus
WQQVPFCSHH

SEQ ID NO: 66244 - protein, 10 aa, Dengue virus
QQVPFCSHHF

SEQ ID NO: 66245 - protein, 10 aa, Dengue virus
QVPFCSHHFH

SEQ ID NO: 66246 - protein, 10 aa, Dengue virus
VPFCSHHFHE

SEQ ID NO: 66247 - protein, 10 aa, Dengue virus
PFCSHHFHEL

SEQ ID NO: 66248 - protein, 10 aa, Dengue virus
FCSHHFHELI

SEQ ID NO: 66249 - protein, 10 aa, Dengue virus
CSHHFHELIM

SEQ ID NO: 66250 - protein, 10 aa, Dengue virus
SHHFHELIMK

SEQ ID NO: 66251 - protein, 10 aa, Dengue virus
HHFHELIMKD

SEQ ID NO: 66252 - protein, 10 aa, Dengue virus
HFHELIMKDG

SEQ ID NO: 66253 - protein, 10 aa, Dengue virus
FHELIMKDGR

SEQ ID NO: 66254 - protein, 10 aa, Dengue virus
HELIMKDGRK

SEQ ID NO: 66255 - protein, 10 aa, Dengue virus
ELIMKDGRKL

SEQ ID NO: 66256 - protein, 10 aa, Dengue virus
LIMKDGRKLV

SEQ ID NO: 66257 - protein, 10 aa, Dengue virus
IMKDGRKLVV

SEQ ID NO: 66258 - protein, 10 aa, Dengue virus
MKDGRKLVVP

SEQ ID NO: 66259 - protein, 10 aa, Dengue virus
KDGRKLVVPC

SEQ ID NO: 66260 - protein, 10 aa, Dengue virus
DGRKLVVPCR

SEQ ID NO: 66261 - protein, 10 aa, Dengue virus
GRKLVVPCRP

SEQ ID NO: 66262 - protein, 10 aa, Dengue virus
RKLVVPCRPQ

SEQ ID NO: 66263 - protein, 10 aa, Dengue virus
KLVVPCRPQD

SEQ ID NO: 66264 - protein, 10 aa, Dengue virus
LVVPCRPQDE

SEQ ID NO: 66265 - protein, 10 aa, Dengue virus
VVPCRPQDEL

SEQ ID NO: 66266 - protein, 10 aa, Dengue virus
VPCRPQDELI

SEQ ID NO: 66267 - protein, 10 aa, Dengue virus
PCRPQDELIG

SEQ ID NO: 66268 - protein, 10 aa, Dengue virus
CRPQDELIGR

SEQ ID NO: 66269 - protein, 10 aa, Dengue virus
RPQDELIGRA

SEQ ID NO: 66270 - protein, 10 aa, Dengue virus
PQDELIGRAR

SEQ ID NO: 66271 - protein, 10 aa, Dengue virus
QDELIGRARI

SEQ ID NO: 66272 - protein, 10 aa, Dengue virus
DELIGRARIS

SEQ ID NO: 66273 - protein, 10 aa, Dengue virus
ELIGRARISQ

SEQ ID NO: 66274 - protein, 10 aa, Dengue virus
LIGRARISQG

SEQ ID NO: 66275 - protein, 10 aa, Dengue virus
IGRARISQGA

SEQ ID NO: 66276 - protein, 10 aa, Dengue virus
GRARISQGAG

SEQ ID NO: 66277 - protein, 10 aa, Dengue virus
RARISQGAGW

SEQ ID NO: 66278 - protein, 10 aa, Dengue virus
ARISQGAGWS

SEQ ID NO: 66279 - protein, 10 aa, Dengue virus
RISQGAGWSL

SEQ ID NO: 66280 - protein, 10 aa, Dengue virus
ISQGAGWSLR

SEQ ID NO: 66281 - protein, 10 aa, Dengue virus
SQGAGWSLRE

SEQ ID NO: 66282 - protein, 10 aa, Dengue virus
QGAGWSLRET

SEQ ID NO: 66283 - protein, 10 aa, Dengue virus
GAGWSLRETA

SEQ ID NO: 66284 - protein, 10 aa, Dengue virus
AGWSLRETAC

SEQ ID NO: 66285 - protein, 10 aa, Dengue virus
GWSLRETACL

SEQ ID NO: 66286 - protein, 10 aa, Dengue virus
WSLRETACLG

SEQ ID NO: 66287 - protein, 10 aa, Dengue virus
SLRETACLGK

SEQ ID NO: 66288 - protein, 10 aa, Dengue virus
LRETACLGKA

SEQ ID NO: 66289 - protein, 10 aa, Dengue virus
RETACLGKAY

SEQ ID NO: 66290 - protein, 10 aa, Dengue virus
ETACLGKAYA

SEQ ID NO: 66291 - protein, 10 aa, Dengue virus
TACLGKAYAQ

SEQ ID NO: 66292 - protein, 10 aa, Dengue virus
ACLGKAYAQM

SEQ ID NO: 66293 - protein, 10 aa, Dengue virus
CLGKAYAQMW

SEQ ID NO: 66294 - protein, 10 aa, Dengue virus
LGKAYAQMWS

SEQ ID NO: 66295 - protein, 10 aa, Dengue virus
GKAYAQMWSL

SEQ ID NO: 66296 - protein, 10 aa, Dengue virus
KAYAQMWSLM

SEQ ID NO: 66297 - protein, 10 aa, Dengue virus
AYAQMWSLMY

SEQ ID NO: 66298 - protein, 10 aa, Dengue virus
YAQMWSLMYF

SEQ ID NO: 66299 - protein, 10 aa, Dengue virus
AQMWSLMYFH

SEQ ID NO: 66300 - protein, 10 aa, Dengue virus
QMWSLMYFHR

SEQ ID NO: 66301 - protein, 10 aa, Dengue virus
MWSLMYFHRR

SEQ ID NO: 66302 - protein, 10 aa, Dengue virus
WSLMYFHRRD

SEQ ID NO: 66303 - protein, 10 aa, Dengue virus
SLMYFHRRDL

SEQ ID NO: 66304 - protein, 10 aa, Dengue virus
LMYFHRRDLR

SEQ ID NO: 66305 - protein, 10 aa, Dengue virus
MYFHRRDLRL

SEQ ID NO: 66306 - protein, 10 aa, Dengue virus
YFHRRDLRLA

SEQ ID NO: 66307 - protein, 10 aa, Dengue virus
FHRRDLRLAS

SEQ ID NO: 66308 - protein, 10 aa, Dengue virus
HRRDLRLASN

SEQ ID NO: 66309 - protein, 10 aa, Dengue virus
RRDLRLASNA

SEQ ID NO: 66310 - protein, 10 aa, Dengue virus
RDLRLASNAI

SEQ ID NO: 66311 - protein, 10 aa, Dengue virus
DLRLASNAIC

SEQ ID NO: 66312 - protein, 10 aa, Dengue virus
LRLASNAICS

SEQ ID NO: 66313 - protein, 10 aa, Dengue virus
RLASNAICSA

SEQ ID NO: 66314 - protein, 10 aa, Dengue virus
LASNAICSAV

SEQ ID NO: 66315 - protein, 10 aa, Dengue virus
ASNAICSAVP

SEQ ID NO: 66316 - protein, 10 aa, Dengue virus
SNAICSAVPV

SEQ ID NO: 66317 - protein, 10 aa, Dengue virus
NAICSAVPVH

SEQ ID NO: 66318 - protein, 10 aa, Dengue virus
AICSAVPVHW

SEQ ID NO: 66319 - protein, 10 aa, Dengue virus
ICSAVPVHWV

SEQ ID NO: 66320 - protein, 10 aa, Dengue virus
CSAVPVHWVP

SEQ ID NO: 66321 - protein, 10 aa, Dengue virus
SAVPVHWVPT

SEQ ID NO: 66322 - protein, 10 aa, Dengue virus
AVPVHWVPTS

SEQ ID NO: 66323 - protein, 10 aa, Dengue virus
VPVHWVPTSR

SEQ ID NO: 66324 - protein, 10 aa, Dengue virus
PVHWVPTSRT

SEQ ID NO: 66325 - protein, 10 aa, Dengue virus
VHWVPTSRTT

SEQ ID NO: 66326 - protein, 10 aa, Dengue virus
HWVPTSRTTW

SEQ ID NO: 66327 - protein, 10 aa, Dengue virus
WVPTSRTTWS

SEQ ID NO: 66328 - protein, 10 aa, Dengue virus
VPTSRTTWSI

SEQ ID NO: 66329 - protein, 10 aa, Dengue virus
PTSRTTWSIH

SEQ ID NO: 66330 - protein, 10 aa, Dengue virus
TSRTTWSIHA

SEQ ID NO: 66331 - protein, 10 aa, Dengue virus
SRTTWSIHAH

SEQ ID NO: 66332 - protein, 10 aa, Dengue virus
RTTWSIHAHH

SEQ ID NO: 66333 - protein, 10 aa, Dengue virus
TTWSIHAHHQ

SEQ ID NO: 66334 - protein, 10 aa, Dengue virus
TWSIHAHHQW

SEQ ID NO: 66335 - protein, 10 aa, Dengue virus
WSIHAHHQWM

SEQ ID NO: 66336 - protein, 10 aa, Dengue virus
SIHAHHQWMT

SEQ ID NO: 66337 - protein, 10 aa, Dengue virus
IHAHHQWMTT

SEQ ID NO: 66338 - protein, 10 aa, Dengue virus
HAHHQWMTTE

SEQ ID NO: 66339 - protein, 10 aa, Dengue virus
AHHQWMTTED

SEQ ID NO: 66340 - protein, 10 aa, Dengue virus
HHQWMTTEDM

SEQ ID NO: 66341 - protein, 10 aa, Dengue virus
HQWMTTEDML

SEQ ID NO: 66342 - protein, 10 aa, Dengue virus
QWMTTEDMLT

SEQ ID NO: 66343 - protein, 10 aa, Dengue virus
WMTTEDMLTV

SEQ ID NO: 66344 - protein, 10 aa, Dengue virus
MTTEDMLTVW

SEQ ID NO: 66345 - protein, 10 aa, Dengue virus
TTEDMLTVWN

SEQ ID NO: 66346 - protein, 10 aa, Dengue virus
TEDMLTVWNR

SEQ ID NO: 66347 - protein, 10 aa, Dengue virus
EDMLTVWNRV

SEQ ID NO: 66348 - protein, 10 aa, Dengue virus
DMLTVWNRVW

SEQ ID NO: 66349 - protein, 10 aa, Dengue virus
MLTVWNRVWI

SEQ ID NO: 66350 - protein, 10 aa, Dengue virus
LTVWNRVWIE

SEQ ID NO: 66351 - protein, 10 aa, Dengue virus
TVWNRVWIED

SEQ ID NO: 66352 - protein, 10 aa, Dengue virus
VWNRVWIEDN

SEQ ID NO: 66353 - protein, 10 aa, Dengue virus
WNRVWIEDNP

SEQ ID NO: 66354 - protein, 10 aa, Dengue virus
NRVWIEDNPW

SEQ ID NO: 66355 - protein, 10 aa, Dengue virus
RVWIEDNPWM

SEQ ID NO: 66356 - protein, 10 aa, Dengue virus
VWIEDNPWME

SEQ ID NO: 66357 - protein, 10 aa, Dengue virus
WIEDNPWMED

SEQ ID NO: 66358 - protein, 10 aa, Dengue virus
IEDNPWMEDK

SEQ ID NO: 66359 - protein, 10 aa, Dengue virus
EDNPWMEDKT

SEQ ID NO: 66360 - protein, 10 aa, Dengue virus
DNPWMEDKTP

SEQ ID NO: 66361 - protein, 10 aa, Dengue virus
NPWMEDKTPV

SEQ ID NO: 66362 - protein, 10 aa, Dengue virus
PWMEDKTPVT

SEQ ID NO: 66363 - protein, 10 aa, Dengue virus
WMEDKTPVTT

SEQ ID NO: 66364 - protein, 10 aa, Dengue virus
MEDKTPVTTW

SEQ ID NO: 66365 - protein, 10 aa, Dengue virus
EDKTPVTTWE

SEQ ID NO: 66366 - protein, 10 aa, Dengue virus
DKTPVTTWEN

SEQ ID NO: 66367 - protein, 10 aa, Dengue virus
KTPVTTWENV

SEQ ID NO: 66368 - protein, 10 aa, Dengue virus
TPVTTWENVP

SEQ ID NO: 66369 - protein, 10 aa, Dengue virus
PVTTWENVPY

SEQ ID NO: 66370 - protein, 10 aa, Dengue virus
VTTWENVPYL

SEQ ID NO: 66371 - protein, 10 aa, Dengue virus
TTWENVPYLG

SEQ ID NO: 66372 - protein, 10 aa, Dengue virus
TWENVPYLGK

SEQ ID NO: 66373 - protein, 10 aa, Dengue virus
WENVPYLGKR

SEQ ID NO: 66374 - protein, 10 aa, Dengue virus
ENVPYLGKRE

SEQ ID NO: 66375 - protein, 10 aa, Dengue virus
NVPYLGKRED

SEQ ID NO: 66376 - protein, 10 aa, Dengue virus
VPYLGKREDQ

SEQ ID NO: 66377 - protein, 10 aa, Dengue virus
PYLGKREDQW

SEQ ID NO: 66378 - protein, 10 aa, Dengue virus
YLGKREDQWC

SEQ ID NO: 66379 - protein, 10 aa, Dengue virus
LGKREDQWCG

SEQ ID NO: 66380 - protein, 10 aa, Dengue virus
GKREDQWCGS

SEQ ID NO: 66381 - protein, 10 aa, Dengue virus
KREDQWCGSL

SEQ ID NO: 66382 - protein, 10 aa, Dengue virus
REDQWCGSLI

SEQ ID NO: 66383 - protein, 10 aa, Dengue virus
EDQWCGSLIG

SEQ ID NO: 66384 - protein, 10 aa, Dengue virus
DQWCGSLIGL

SEQ ID NO: 66385 - protein, 10 aa, Dengue virus
QWCGSLIGLT

SEQ ID NO: 66386 - protein, 10 aa, Dengue virus
WCGSLIGLTS

SEQ ID NO: 66387 - protein, 10 aa, Dengue virus
CGSLIGLTSR

SEQ ID NO: 66388 - protein, 10 aa, Dengue virus
GSLIGLTSRA

SEQ ID NO: 66389 - protein, 10 aa, Dengue virus
SLIGLTSRAT

SEQ ID NO: 66390 - protein, 10 aa, Dengue virus
LIGLTSRATW

SEQ ID NO: 66391 - protein, 10 aa, Dengue virus
IGLTSRATWA

SEQ ID NO: 66392 - protein, 10 aa, Dengue virus
GLTSRATWAQ

SEQ ID NO: 66393 - protein, 10 aa, Dengue virus
LTSRATWAQN

SEQ ID NO: 66394 - protein, 10 aa, Dengue virus
TSRATWAQNI

SEQ ID NO: 66395 - protein, 10 aa, Dengue virus
SRATWAQNIP

SEQ ID NO: 66396 - protein, 10 aa, Dengue virus
RATWAQNIPT

SEQ ID NO: 66397 - protein, 10 aa, Dengue virus
ATWAQNIPTA

SEQ ID NO: 66398 - protein, 10 aa, Dengue virus
TWAQNIPTAI

SEQ ID NO: 66399 - protein, 10 aa, Dengue virus
WAQNIPTAIQ

SEQ ID NO: 66400 - protein, 10 aa, Dengue virus
AQNIPTAIQQ

SEQ ID NO: 66401 - protein, 10 aa, Dengue virus
QNIPTAIQQV

SEQ ID NO: 66402 - protein, 10 aa, Dengue virus
NIPTAIQQVR

SEQ ID NO: 66403 - protein, 10 aa, Dengue virus
IPTAIQQVRS

SEQ ID NO: 66404 - protein, 10 aa, Dengue virus
PTAIQQVRSL

SEQ ID NO: 66405 - protein, 10 aa, Dengue virus
TAIQQVRSLI

SEQ ID NO: 66406 - protein, 10 aa, Dengue virus
AIQQVRSLIG

SEQ ID NO: 66407 - protein, 10 aa, Dengue virus
IQQVRSLIGN

SEQ ID NO: 66408 - protein, 10 aa, Dengue virus
QQVRSLIGNE

SEQ ID NO: 66409 - protein, 10 aa, Dengue virus
QVRSLIGNEE

SEQ ID NO: 66410 - protein, 10 aa, Dengue virus
VRSLIGNEEF

SEQ ID NO: 66411 - protein, 10 aa, Dengue virus
RSLIGNEEFL

SEQ ID NO: 66412 - protein, 10 aa, Dengue virus
SLIGNEEFLD

SEQ ID NO: 66413 - protein, 10 aa, Dengue virus
LIGNEEFLDY

SEQ ID NO: 66414 - protein, 10 aa, Dengue virus
IGNEEFLDYM

SEQ ID NO: 66415 - protein, 10 aa, Dengue virus
GNEEFLDYMP

SEQ ID NO: 66416 - protein, 10 aa, Dengue virus
NEEFLDYMPS

SEQ ID NO: 66417 - protein, 10 aa, Dengue virus
EEFLDYMPSM

SEQ ID NO: 66418 - protein, 10 aa, Dengue virus
EFLDYMPSMK

SEQ ID NO: 66419 - protein, 10 aa, Dengue virus
FLDYMPSMKR

SEQ ID NO: 66420 - protein, 10 aa, Dengue virus
LDYMPSMKRF

SEQ ID NO: 66421 - protein, 10 aa, Dengue virus
DYMPSMKRFR

SEQ ID NO: 66422 - protein, 10 aa, Dengue virus
YMPSMKRFRK

SEQ ID NO: 66423 - protein, 10 aa, Dengue virus
MPSMKRFRKE

SEQ ID NO: 66424 - protein, 10 aa, Dengue virus
PSMKRFRKEE

SEQ ID NO: 66425 - protein, 10 aa, Dengue virus
SMKRFRKEEE

SEQ ID NO: 66426 - protein, 10 aa, Dengue virus
MKRFRKEEES

SEQ ID NO: 66427 - protein, 10 aa, Dengue virus
KRFRKEEESE

SEQ ID NO: 66428 - protein, 10 aa, Dengue virus
RFRKEEESEG

SEQ ID NO: 66429 - protein, 10 aa, Dengue virus
FRKEEESEGA

SEQ ID NO: 66430 - protein, 10 aa, Dengue virus
RKEEESEGAI

SEQ ID NO: 66431 - protein, 10 aa, Dengue virus
KEEESEGAIW

SEQ ID NO: 66432 - protein, 10 aa, Dengue virus
MNNQRKKAGK

SEQ ID NO: 66433 - protein, 10 aa, Dengue virus
NNQRKKAGKP

SEQ ID NO: 66434 - protein, 10 aa, Dengue virus
NQRKKAGKPS

SEQ ID NO: 66435 - protein, 10 aa, Dengue virus
QRKKAGKPSI

SEQ ID NO: 66436 - protein, 10 aa, Dengue virus
RKKAGKPSIN

SEQ ID NO: 66437 - protein, 10 aa, Dengue virus
KKAGKPSINM

SEQ ID NO: 66438 - protein, 10 aa, Dengue virus
KAGKPSINML

SEQ ID NO: 66439 - protein, 10 aa, Dengue virus
AGKPSINMLK

SEQ ID NO: 66440 - protein, 10 aa, Dengue virus
RVRNRVSTGT

SEQ ID NO: 66441 - protein, 10 aa, Dengue virus
VRNRVSTGTQ

SEQ ID NO: 66442 - protein, 10 aa, Dengue virus
GSQLAKRFSR

SEQ ID NO: 66443 - protein, 10 aa, Dengue virus
SQLAKRFSRG

SEQ ID NO: 66444 - protein, 10 aa, Dengue virus
QLAKRFSRGL

SEQ ID NO: 66445 - protein, 10 aa, Dengue virus
LAKRFSRGLL

SEQ ID NO: 66446 - protein, 10 aa, Dengue virus
AKRFSRGLLN

SEQ ID NO: 66447 - protein, 10 aa, Dengue virus
KRFSRGLLNG

SEQ ID NO: 66448 - protein, 10 aa, Dengue virus
RFSRGLLNGQ

SEQ ID NO: 66449 - protein, 10 aa, Dengue virus
FSRGLLNGQG

SEQ ID NO: 66450 - protein, 10 aa, Dengue virus
SRGLLNGQGP

SEQ ID NO: 66451 - protein, 10 aa, Dengue virus
RGLLNGQGPM

SEQ ID NO: 66452 - protein, 10 aa, Dengue virus
ELLNGQGPMK

SEQ ID NO: 66453 - protein, 10 aa, Dengue virus
FLAIPPTAGI

SEQ ID NO: 66454 - protein, 10 aa, Dengue virus
LAIPPTAGIL

SEQ ID NO: 66455 - protein, 10 aa, Dengue virus
AIPPTAGILA

SEQ ID NO: 66456 - protein, 10 aa, Dengue virus
IPPTAGILAR

SEQ ID NO: 66457 - protein, 10 aa, Dengue virus
PPTAGILARW

SEQ ID NO: 66458 - protein, 10 aa, Dengue virus
PTAGILARWG

SEQ ID NO: 66459 - protein, 10 aa, Dengue virus
TAGILARWGT

SEQ ID NO: 66460 - protein, 10 aa, Dengue virus
AGILARWGTF

SEQ ID NO: 66461 - protein, 10 aa, Dengue virus
GILARWGTFK

SEQ ID NO: 66462 - protein, 10 aa, Dengue virus
ILARWGTFKK

SEQ ID NO: 66463 - protein, 10 aa, Dengue virus
TFKKLGAIKV

SEQ ID NO: 66464 - protein, 10 aa, Dengue virus
FKKLGAIKVL

SEQ ID NO: 66465 - protein, 10 aa, Dengue virus
KKSGAIKVLR

SEQ ID NO: 66466 - protein, 10 aa, Dengue virus
KSGAIKVLRG

SEQ ID NO: 66467 - protein, 10 aa, Dengue virus
SGAIKVLRGF

SEQ ID NO: 66468 - protein, 10 aa, Dengue virus
GAIKVLRGFK

SEQ ID NO: 66469 - protein, 10 aa, Dengue virus
AIKVLRGFKK

SEQ ID NO: 66470 - protein, 10 aa, Dengue virus
IKVLRGFKKE

SEQ ID NO: 66471 - protein, 10 aa, Dengue virus
KVLRGFKKEI

SEQ ID NO: 66472 - protein, 10 aa, Dengue virus
VLRGFKKEIS

SEQ ID NO: 66473 - protein, 10 aa, Dengue virus
LRGFKKEISN

SEQ ID NO: 66474 - protein, 10 aa, Dengue virus
RGFKKEISNM

SEQ ID NO: 66475 - protein, 10 aa, Dengue virus
GFKREISNML

SEQ ID NO: 66476 - protein, 10 aa, Dengue virus
FKREISNMLS

SEQ ID NO: 66477 - protein, 10 aa, Dengue virus
KREISNMLSI

SEQ ID NO: 66478 - protein, 10 aa, Dengue virus
REISNMLSII

SEQ ID NO: 66479 - protein, 10 aa, Dengue virus
ISNMLSIINR

SEQ ID NO: 66480 - protein, 10 aa, Dengue virus
SNMLSIINRR

SEQ ID NO: 66481 - protein, 10 aa, Dengue virus
NMLSIINRRK

SEQ ID NO: 66482 - protein, 10 aa, Dengue virus
MLSIINRRKK

SEQ ID NO: 66483 - protein, 10 aa, Dengue virus
LSIINRRKKT

SEQ ID NO: 66484 - protein, 10 aa, Dengue virus
SIINRRKKTS

SEQ ID NO: 66485 - protein, 10 aa, Dengue virus
RKKTSFCLMM

SEQ ID NO: 66486 - protein, 10 aa, Dengue virus
MMLPATLAFH

SEQ ID NO: 66487 - protein, 10 aa, Dengue virus
MLPATLAFHL

SEQ ID NO: 66488 - protein, 10 aa, Dengue virus
LPATLAFHLT

SEQ ID NO: 66489 - protein, 10 aa, Dengue virus
PATLAFHLTS

SEQ ID NO: 66490 - protein, 10 aa, Dengue virus
ATLAFHLTSR

SEQ ID NO: 66491 - protein, 10 aa, Dengue virus
TLAFHLTSRD

SEQ ID NO: 66492 - protein, 10 aa, Dengue virus
RDGEPRMIVA

SEQ ID NO: 66493 - protein, 10 aa, Dengue virus
DGEPRMIVAK

SEQ ID NO: 66494 - protein, 10 aa, Dengue virus
GEPRMIVAKN

SEQ ID NO: 66495 - protein, 10 aa, Dengue virus
EPRMIVAKNE

SEQ ID NO: 66496 - protein, 10 aa, Dengue virus
PRMIVAKNER

SEQ ID NO: 66497 - protein, 10 aa, Dengue virus
RMIVAKNERG

SEQ ID NO: 66498 - protein, 10 aa, Dengue virus
MIVAKNERGK

SEQ ID NO: 66499 - protein, 10 aa, Dengue virus
IVAKNERGKS

SEQ ID NO: 66500 - protein, 10 aa, Dengue virus
VAKNERGKSL

SEQ ID NO: 66501 - protein, 10 aa, Dengue virus
AKNERGKSLL

SEQ ID NO: 66502 - protein, 10 aa, Dengue virus
GKSLLFKTAT

SEQ ID NO: 66503 - protein, 10 aa, Dengue virus
KSLLFKTATG

SEQ ID NO: 66504 - protein, 10 aa, Dengue virus
SLLFKTATGI

SEQ ID NO: 66505 - protein, 10 aa, Dengue virus
LLFKTATGIN

SEQ ID NO: 66506 - protein, 10 aa, Dengue virus
LFKTATGINM

SEQ ID NO: 66507 - protein, 10 aa, Dengue virus
FKTATGINMC

SEQ ID NO: 66508 - protein, 10 aa, Dengue virus
KTATGINMCT

SEQ ID NO: 66509 - protein, 10 aa, Dengue virus
TATGINMCTL

SEQ ID NO: 66510 - protein, 10 aa, Dengue virus
ATGINMCTLI

SEQ ID NO: 66511 - protein, 10 aa, Dengue virus
TGINMCTLIA

SEQ ID NO: 66512 - protein, 10 aa, Dengue virus
DLGEMCDDTI

SEQ ID NO: 66513 - protein, 10 aa, Dengue virus
LGEMCDDTIT

SEQ ID NO: 66514 - protein, 10 aa, Dengue virus
GEMCDDTITY

SEQ ID NO: 66515 - protein, 10 aa, Dengue virus
EMCDDTITYK

SEQ ID NO: 66516 - protein, 10 aa, Dengue virus
MCDDTITYKC

SEQ ID NO: 66517 - protein, 10 aa, Dengue virus
CDDTITYKCP

SEQ ID NO: 66518 - protein, 10 aa, Dengue virus
DDTVTYKCPL

SEQ ID NO: 66519 - protein, 10 aa, Dengue virus
DTVTYKCPLI

SEQ ID NO: 66520 - protein, 10 aa, Dengue virus
IAEVEPEDID

SEQ ID NO: 66521 - protein, 10 aa, Dengue virus
AEVEPEDIDC

SEQ ID NO: 66522 - protein, 10 aa, Dengue virus
YGTCNQAGER

SEQ ID NO: 66523 - protein, 10 aa, Dengue virus
GTCNQAGERR

SEQ ID NO: 66524 - protein, 10 aa, Dengue virus
TCNQAGERRR

SEQ ID NO: 66525 - protein, 10 aa, Dengue virus
CNQAGERRRD

SEQ ID NO: 66526 - protein, 10 aa, Dengue virus
NQAGERRRDK

SEQ ID NO: 66527 - protein, 10 aa, Dengue virus
QAGERRRDKR

SEQ ID NO: 66528 - protein, 10 aa, Dengue virus
AGERRRDKRS

SEQ ID NO: 66529 - protein, 10 aa, Dengue virus
GERRRDKRSV

SEQ ID NO: 66530 - protein, 10 aa, Dengue virus
ERRRDKRSVA

SEQ ID NO: 66531 - protein, 10 aa, Dengue virus
RRRDKRSVAL

SEQ ID NO: 66532 - protein, 10 aa, Dengue virus
HVGMGLDTRA

SEQ ID NO: 66533 - protein, 10 aa, Dengue virus
VGMGLDTRAQ

SEQ ID NO: 66534 - protein, 10 aa, Dengue virus
GMGLDTRAQT

SEQ ID NO: 66535 - protein, 10 aa, Dengue virus
MGLDTRAQTW

SEQ ID NO: 66536 - protein, 10 aa, Dengue virus
GLDTRAQTWM

SEQ ID NO: 66537 - protein, 10 aa, Dengue virus
LDTRAQTWMS

SEQ ID NO: 66538 - protein, 10 aa, Dengue virus
DTRAQTWMSA

SEQ ID NO: 66539 - protein, 10 aa, Dengue virus
TRAQTWMSAE

SEQ ID NO: 66540 - protein, 10 aa, Dengue virus
RAQTWMSAEG

SEQ ID NO: 66541 - protein, 10 aa, Dengue virus
AQTWMSAEGA

SEQ ID NO: 66542 - protein, 10 aa, Dengue virus
AEGAWRQVER

SEQ ID NO: 66543 - protein, 10 aa, Dengue virus
AWRQVERVET

SEQ ID NO: 66544 - protein, 10 aa, Dengue virus
WRQVERVETW

SEQ ID NO: 66545 - protein, 10 aa, Dengue virus
RQVERVETWA

SEQ ID NO: 66546 - protein, 10 aa, Dengue virus
QVEKVETWAF

SEQ ID NO: 66547 - protein, 10 aa, Dengue virus
VEKVETWAFR

SEQ ID NO: 66548 - protein, 10 aa, Dengue virus
EKVETWAFRH

SEQ ID NO: 66549 - protein, 10 aa, Dengue virus
KVETWAFRHP

SEQ ID NO: 66550 - protein, 10 aa, Dengue virus
VETWAFRHPG

SEQ ID NO: 66551 - protein, 10 aa, Dengue virus
ETWAFRHPGF

SEQ ID NO: 66552 - protein, 10 aa, Dengue virus
TWAFRHPGFT

SEQ ID NO: 66553 - protein, 10 aa, Dengue virus
WAFRHPGFTI

SEQ ID NO: 66554 - protein, 10 aa, Dengue virus
AFRHPGFTIL

SEQ ID NO: 66555 - protein, 10 aa, Dengue virus
FRHPGFTILA

SEQ ID NO: 66556 - protein, 10 aa, Dengue virus
ILALFLAHYV

SEQ ID NO: 66557 - protein, 10 aa, Dengue virus
LALFLAHYVG

SEQ ID NO: 66558 - protein, 10 aa, Dengue virus
ALFLAHYVGT

SEQ ID NO: 66559 - protein, 10 aa, Dengue virus
LFLAHYVGTS

SEQ ID NO: 66560 - protein, 10 aa, Dengue virus
FLAHYVGTSL

SEQ ID NO: 66561 - protein, 10 aa, Dengue virus
LAHYIGTSLI

SEQ ID NO: 66562 - protein, 10 aa, Dengue virus
AHYIGTSLIQ

SEQ ID NO: 66563 - protein, 10 aa, Dengue virus
HYIGTSLIQK

SEQ ID NO: 66564 - protein, 10 aa, Dengue virus
YIGTSLTQKA

SEQ ID NO: 66565 - protein, 10 aa, Dengue virus
IGTSLTQKAV

SEQ ID NO: 66566 - protein, 10 aa, Dengue virus
GTSLTQKAVI

SEQ ID NO: 66567 - protein, 10 aa, Dengue virus
TSLTQKAVIF

SEQ ID NO: 66568 - protein, 10 aa, Dengue virus
SLTQKVVIFV

SEQ ID NO: 66569 - protein, 10 aa, Dengue virus
LTQKVVIFVL

SEQ ID NO: 66570 - protein, 10 aa, Dengue virus
TQKVVIFVLL

SEQ ID NO: 66571 - protein, 10 aa, Dengue virus
QKVVIFVLLM

SEQ ID NO: 66572 - protein, 10 aa, Dengue virus
KVVIFVLLML

SEQ ID NO: 66573 - protein, 10 aa, Dengue virus
VVIFVLLMLV

SEQ ID NO: 66574 - protein, 10 aa, Dengue virus
VIFVLLMLVT

SEQ ID NO: 66575 - protein, 10 aa, Dengue virus
IFVLLMLVTP

SEQ ID NO: 66576 - protein, 10 aa, Dengue virus
FVLLMLVTPS

SEQ ID NO: 66577 - protein, 10 aa, Dengue virus
VLLMLVTPSM

SEQ ID NO: 66578 - protein, 10 aa, Dengue virus
LLMLVTPSMA

SEQ ID NO: 66579 - protein, 10 aa, Dengue virus
LMLVTPSMAM

SEQ ID NO: 66580 - protein, 10 aa, Dengue virus
MLVTPSMAMR

SEQ ID NO: 66581 - protein, 10 aa, Dengue virus
LVTPSMAMRC

SEQ ID NO: 66582 - protein, 10 aa, Dengue virus
VTPSMAMRCV

SEQ ID NO: 66583 - protein, 10 aa, Dengue virus
TPSMAMRCVG

SEQ ID NO: 66584 - protein, 10 aa, Dengue virus
PSMAMRCVGV

SEQ ID NO: 66585 - protein, 10 aa, Dengue virus
SMAMRCVGVG

SEQ ID NO: 66586 - protein, 10 aa, Dengue virus
MAMRCVGVGN

SEQ ID NO: 66587 - protein, 10 aa, Dengue virus
AMRCVGVGNR

SEQ ID NO: 66588 - protein, 10 aa, Dengue virus
GGCVTTMAKS

SEQ ID NO: 66589 - protein, 10 aa, Dengue virus
GCVTTMAKSK

SEQ ID NO: 66590 - protein, 10 aa, Dengue virus
CVTTMAKSKP

SEQ ID NO: 66591 - protein, 10 aa, Dengue virus
VTTMAKSKPT

SEQ ID NO: 66592 - protein, 10 aa, Dengue virus
TTMAKSKPTL

SEQ ID NO: 66593 - protein, 10 aa, Dengue virus
TMAKSKPTLD

SEQ ID NO: 66594 - protein, 10 aa, Dengue virus
MAKSKPTLDI

SEQ ID NO: 66595 - protein, 10 aa, Dengue virus
AKSKPTLDIE

SEQ ID NO: 66596 - protein, 10 aa, Dengue virus
KSKPTLDIEL

SEQ ID NO: 66597 - protein, 10 aa, Dengue virus
SKPTLDIELQ

SEQ ID NO: 66598 - protein, 10 aa, Dengue virus
LCIEGKITNV

SEQ ID NO: 66599 - protein, 10 aa, Dengue virus
CIEGKITNVT

SEQ ID NO: 66600 - protein, 10 aa, Dengue virus
IEGKITNVTT

SEQ ID NO: 66601 - protein, 10 aa, Dengue virus
EGKITNVTTD

SEQ ID NO: 66602 - protein, 10 aa, Dengue virus
GKITNVTTDS

SEQ ID NO: 66603 - protein, 10 aa, Dengue virus
KITNVTTDSR

SEQ ID NO: 66604 - protein, 10 aa, Dengue virus
ITNVTTDSRC

SEQ ID NO: 66605 - protein, 10 aa, Dengue virus
TNVTTDSRCP

SEQ ID NO: 66606 - protein, 10 aa, Dengue virus
NVTTDSRCPT

SEQ ID NO: 66607 - protein, 10 aa, Dengue virus
VTTDSRCPTQ

SEQ ID NO: 66608 - protein, 10 aa, Dengue virus
SRCPTQGEAI

SEQ ID NO: 66609 - protein, 10 aa, Dengue virus
RCPTQGEAIL

SEQ ID NO: 66610 - protein, 10 aa, Dengue virus
CPTQGEAILP

SEQ ID NO: 66611 - protein, 10 aa, Dengue virus
PTQGEAILPE

SEQ ID NO: 66612 - protein, 10 aa, Dengue virus
TQGEAILPEE

SEQ ID NO: 66613 - protein, 10 aa, Dengue virus
QGEAILPEEQ

SEQ ID NO: 66614 - protein, 10 aa, Dengue virus
GEAILPEEQD

SEQ ID NO: 66615 - protein, 10 aa, Dengue virus
EAILPEEQDQ

SEQ ID NO: 66616 - protein, 10 aa, Dengue virus
AILPEEQDQN

SEQ ID NO: 66617 - protein, 10 aa, Dengue virus
ILPEEQDQNY

SEQ ID NO: 66618 - protein, 10 aa, Dengue virus
TCAKFQCLES

SEQ ID NO: 66619 - protein, 10 aa, Dengue virus
CAKFQCLESI

SEQ ID NO: 66620 - protein, 10 aa, Dengue virus
AKFQCLESIE

SEQ ID NO: 66621 - protein, 10 aa, Dengue virus
KFQCLESIEG

SEQ ID NO: 66622 - protein, 10 aa, Dengue virus
FQCLESIEGK

SEQ ID NO: 66623 - protein, 10 aa, Dengue virus
IEGKVVQHEN

SEQ ID NO: 66624 - protein, 10 aa, Dengue virus
EGKVVQHENL

SEQ ID NO: 66625 - protein, 10 aa, Dengue virus
GKVVQHENLK

SEQ ID NO: 66626 - protein, 10 aa, Dengue virus
KVVQHENLKY

SEQ ID NO: 66627 - protein, 10 aa, Dengue virus
VVQHENLKYT

SEQ ID NO: 66628 - protein, 10 aa, Dengue virus
VQHENLKYTV

SEQ ID NO: 66629 - protein, 10 aa, Dengue virus
QHENLKYTVI

SEQ ID NO: 66630 - protein, 10 aa, Dengue virus
HENLKYTVII

SEQ ID NO: 66631 - protein, 10 aa, Dengue virus
ENLKYTVTIT

SEQ ID NO: 66632 - protein, 10 aa, Dengue virus
NLKYTVTITV

SEQ ID NO: 66633 - protein, 10 aa, Dengue virus
LKYTVTITVH

SEQ ID NO: 66634 - protein, 10 aa, Dengue virus
KYTVTITVHT

SEQ ID NO: 66635 - protein, 10 aa, Dengue virus
YTVTITVHTG

SEQ ID NO: 66636 - protein, 10 aa, Dengue virus
TVTITVHTGD

SEQ ID NO: 66637 - protein, 10 aa, Dengue virus
VTITVHTGDQ

SEQ ID NO: 66638 - protein, 10 aa, Dengue virus
TITVHTGDQH

SEQ ID NO: 66639 - protein, 10 aa, Dengue virus
TGDQHQVGND

SEQ ID NO: 66640 - protein, 10 aa, Dengue virus
GDQHQVGNDT

SEQ ID NO: 66641 - protein, 10 aa, Dengue virus
DQHQVGNDTQ

SEQ ID NO: 66642 - protein, 10 aa, Dengue virus
QHQVGNDTQG

SEQ ID NO: 66643 - protein, 10 aa, Dengue virus
HQVGNDTQGV

SEQ ID NO: 66644 - protein, 10 aa, Dengue virus
QVGNDTQGVT

SEQ ID NO: 66645 - protein, 10 aa, Dengue virus
VGNDTQGVTV

SEQ ID NO: 66646 - protein, 10 aa, Dengue virus
GNDTQGVTVE

SEQ ID NO: 66647 - protein, 10 aa, Dengue virus
NDTQGVTVEI

SEQ ID NO: 66648 - protein, 10 aa, Dengue virus
DTQGVTVEIT

SEQ ID NO: 66649 - protein, 10 aa, Dengue virus
TQGVTVEITP

SEQ ID NO: 66650 - protein, 10 aa, Dengue virus
QGVTVEITPQ

SEQ ID NO: 66651 - protein, 10 aa, Dengue virus
GVTVEITPQA

SEQ ID NO: 66652 - protein, 10 aa, Dengue virus
VTVEITPQAS

SEQ ID NO: 66653 - protein, 10 aa, Dengue virus
TVEITPQAST

SEQ ID NO: 66654 - protein, 10 aa, Dengue virus
EITPQASTVE

SEQ ID NO: 66655 - protein, 10 aa, Dengue virus
ITPQASTVEA

SEQ ID NO: 66656 - protein, 10 aa, Dengue virus
VEAVLPEYGT

SEQ ID NO: 66657 - protein, 10 aa, Dengue virus
EAVLPEYGTL

SEQ ID NO: 66658 - protein, 10 aa, Dengue virus
AVLPEYGTLG

SEQ ID NO: 66659 - protein, 10 aa, Dengue virus
VLPEYGTLGL

SEQ ID NO: 66660 - protein, 10 aa, Dengue virus
WFFDLPLPWA

SEQ ID NO: 66661 - protein, 10 aa, Dengue virus
FFDLPLPWAS

SEQ ID NO: 66662 - protein, 10 aa, Dengue virus
FDLPLPWASG

SEQ ID NO: 66663 - protein, 10 aa, Dengue virus
DLPLPWASGA

SEQ ID NO: 66664 - protein, 10 aa, Dengue virus
LPLPWASGAT

SEQ ID NO: 66665 - protein, 10 aa, Dengue virus
PLPWASGATT

SEQ ID NO: 66666 - protein, 10 aa, Dengue virus
TETPTWNKKE

SEQ ID NO: 66667 - protein, 10 aa, Dengue virus
ETPTWNKKEL

SEQ ID NO: 66668 - protein, 10 aa, Dengue virus
TPTWNKKELL

SEQ ID NO: 66669 - protein, 10 aa, Dengue virus
PTWNKKELLV

SEQ ID NO: 66670 - protein, 10 aa, Dengue virus
TWNKKELLVT

SEQ ID NO: 66671 - protein, 10 aa, Dengue virus
WNKKELLVTF

SEQ ID NO: 66672 - protein, 10 aa, Dengue virus
NKKELLVTFK

SEQ ID NO: 66673 - protein, 10 aa, Dengue virus
KKELLVTFKN

SEQ ID NO: 66674 - protein, 10 aa, Dengue virus
ALTGATEIQT

SEQ ID NO: 66675 - protein, 10 aa, Dengue virus
LTGATEIQTS

SEQ ID NO: 66676 - protein, 10 aa, Dengue virus
TGATEIQTSG

SEQ ID NO: 66677 - protein, 10 aa, Dengue virus
GATEIQTSGG

SEQ ID NO: 66678 - protein, 10 aa, Dengue virus
ATEIQTSGGT

SEQ ID NO: 66679 - protein, 10 aa, Dengue virus
TEIQTSGGTS

SEQ ID NO: 66680 - protein, 10 aa, Dengue virus
EIQTSGGTSI

SEQ ID NO: 66681 - protein, 10 aa, Dengue virus
IQTSGGTSIF

SEQ ID NO: 66682 - protein, 10 aa, Dengue virus
QTSGGTSIFA

SEQ ID NO: 66683 - protein, 10 aa, Dengue virus
TSGGTSIFAG

SEQ ID NO: 66684 - protein, 10 aa, Dengue virus
SGGTNIFAGH

SEQ ID NO: 66685 - protein, 10 aa, Dengue virus
GGTNIFAGHL

SEQ ID NO: 66686 - protein, 10 aa, Dengue virus
GTNIFAGHLK

SEQ ID NO: 66687 - protein, 10 aa, Dengue virus
TNIFAGHLKC

SEQ ID NO: 66688 - protein, 10 aa, Dengue virus
NIFAGHLKCR

SEQ ID NO: 66689 - protein, 10 aa, Dengue virus
LKGMSYAMCL

SEQ ID NO: 66690 - protein, 10 aa, Dengue virus
KGMSYAMCLN

SEQ ID NO: 66691 - protein, 10 aa, Dengue virus
GMSYAMCLNT

SEQ ID NO: 66692 - protein, 10 aa, Dengue virus
MSYAMCLNTF

SEQ ID NO: 66693 - protein, 10 aa, Dengue virus
SYAMCLNTFV

SEQ ID NO: 66694 - protein, 10 aa, Dengue virus
YAMCLNTFVL

SEQ ID NO: 66695 - protein, 10 aa, Dengue virus
NAFVLKKEVS

SEQ ID NO: 66696 - protein, 10 aa, Dengue virus
AFVLKKEVSE

SEQ ID NO: 66697 - protein, 10 aa, Dengue virus
QHGTILVKVE

SEQ ID NO: 66698 - protein, 10 aa, Dengue virus
HGTILVKVEY

SEQ ID NO: 66699 - protein, 10 aa, Dengue virus
GTILIKVEYR

SEQ ID NO: 66700 - protein, 10 aa, Dengue virus
TILIKVEYRG

SEQ ID NO: 66701 - protein, 10 aa, Dengue virus
ILIKVEYRGE

SEQ ID NO: 66702 - protein, 10 aa, Dengue virus
LIKVEYRGED

SEQ ID NO: 66703 - protein, 10 aa, Dengue virus
IKVEYKGEDV

SEQ ID NO: 66704 - protein, 10 aa, Dengue virus
KVEYKGEDVP

SEQ ID NO: 66705 - protein, 10 aa, Dengue virus
VEYKGEDVPC

SEQ ID NO: 66706 - protein, 10 aa, Dengue virus
EYKGEDVPCK

SEQ ID NO: 66707 - protein, 10 aa, Dengue virus
YKGEDVPCKI

SEQ ID NO: 66708 - protein, 10 aa, Dengue virus
KGEDVPCKIP

SEQ ID NO: 66709 - protein, 10 aa, Dengue virus
GEDVPCKIPF

SEQ ID NO: 66710 - protein, 10 aa, Dengue virus
EDVPCKIPFS

SEQ ID NO: 66711 - protein, 10 aa, Dengue virus
DVPCKIPFST

SEQ ID NO: 66712 - protein, 10 aa, Dengue virus
VPCKIPFSTE

SEQ ID NO: 66713 - protein, 10 aa, Dengue virus
PCKVPFSTED

SEQ ID NO: 66714 - protein, 10 aa, Dengue virus
CKVPFSTEDG

SEQ ID NO: 66715 - protein, 10 aa, Dengue virus
KVPFSTEDGQ

SEQ ID NO: 66716 - protein, 10 aa, Dengue virus
VPFSTEDGQG

SEQ ID NO: 66717 - protein, 10 aa, Dengue virus
PFSTEDEQGK

SEQ ID NO: 66718 - protein, 10 aa, Dengue virus
FSTEDEQGKA

SEQ ID NO: 66719 - protein, 10 aa, Dengue virus
STEDEQGKAH

SEQ ID NO: 66720 - protein, 10 aa, Dengue virus
TEDGQGKAHS

SEQ ID NO: 66721 - protein, 10 aa, Dengue virus
EDGQGKAHSG

SEQ ID NO: 66722 - protein, 10 aa, Dengue virus
DGQGKAHSGR

SEQ ID NO: 66723 - protein, 10 aa, Dengue virus
GQGKAHSGRL

SEQ ID NO: 66724 - protein, 10 aa, Dengue virus
QGKAHSGRLI

SEQ ID NO: 66725 - protein, 10 aa, Dengue virus
GKAHSGRLIT

SEQ ID NO: 66726 - protein, 10 aa, Dengue virus
KAHSGRLITA

SEQ ID NO: 66727 - protein, 10 aa, Dengue virus
AHSGRLITAN

SEQ ID NO: 66728 - protein, 10 aa, Dengue virus
HSGRLITANP

SEQ ID NO: 66729 - protein, 10 aa, Dengue virus
NGRLITANPI

SEQ ID NO: 66730 - protein, 10 aa, Dengue virus
GRLITANPIV

SEQ ID NO: 66731 - protein, 10 aa, Dengue virus
RLITANPIVT

SEQ ID NO: 66732 - protein, 10 aa, Dengue virus
LITANPIVTK

SEQ ID NO: 66733 - protein, 10 aa, Dengue virus
ITANPIVTKK

SEQ ID NO: 66734 - protein, 10 aa, Dengue virus
TANPIVTKKE

SEQ ID NO: 66735 - protein, 10 aa, Dengue virus
ANPIVTKKEE

SEQ ID NO: 66736 - protein, 10 aa, Dengue virus
NPIVTKKEEP

SEQ ID NO: 66737 - protein, 10 aa, Dengue virus
PIVTKKEEPV

SEQ ID NO: 66738 - protein, 10 aa, Dengue virus
IVTKKEEPVN

SEQ ID NO: 66739 - protein, 10 aa, Dengue virus
VTKKDEPVNI

SEQ ID NO: 66740 - protein, 10 aa, Dengue virus
TKKDEPVNIE

SEQ ID NO: 66741 - protein, 10 aa, Dengue virus
KKDEPVNIEA

SEQ ID NO: 66742 - protein, 10 aa, Dengue virus
KDEPVNIEAE

SEQ ID NO: 66743 - protein, 10 aa, Dengue virus
DEPVNIEAEP

SEQ ID NO: 66744 - protein, 10 aa, Dengue virus
EPINIEAEPP

SEQ ID NO: 66745 - protein, 10 aa, Dengue virus
PINIEAEPPF

SEQ ID NO: 66746 - protein, 10 aa, Dengue virus
INIEAEPPFG

SEQ ID NO: 66747 - protein, 10 aa, Dengue virus
EPPFGESNII

SEQ ID NO: 66748 - protein, 10 aa, Dengue virus
PPFGESNIII

SEQ ID NO: 66749 - protein, 10 aa, Dengue virus
PFGESNIIIG

SEQ ID NO: 66750 - protein, 10 aa, Dengue virus
FGESNIIIGI

SEQ ID NO: 66751 - protein, 10 aa, Dengue virus
GESNIIIGIG

SEQ ID NO: 66752 - protein, 10 aa, Dengue virus
ESNIIIGIGD

SEQ ID NO: 66753 - protein, 10 aa, Dengue virus
GDKALKINWY

SEQ ID NO: 66754 - protein, 10 aa, Dengue virus
DKALKINWYK

SEQ ID NO: 66755 - protein, 10 aa, Dengue virus
KALKINWYKK

SEQ ID NO: 66756 - protein, 10 aa, Dengue virus
SLKINWYKKG

SEQ ID NO: 66757 - protein, 10 aa, Dengue virus
LKINWYRKGS

SEQ ID NO: 66758 - protein, 10 aa, Dengue virus
KINWYRKGSS

SEQ ID NO: 66759 - protein, 10 aa, Dengue virus
FGSAYTALFG

SEQ ID NO: 66760 - protein, 10 aa, Dengue virus
GSAYTALFGG

SEQ ID NO: 66761 - protein, 10 aa, Dengue virus
SAYTALFGGV

SEQ ID NO: 66762 - protein, 10 aa, Dengue virus
AYTALFGGVS

SEQ ID NO: 66763 - protein, 10 aa, Dengue virus
YTALFGGVSW

SEQ ID NO: 66764 - protein, 10 aa, Dengue virus
TALFSGVSWI

SEQ ID NO: 66765 - protein, 10 aa, Dengue virus
ALFSGVSWIM

SEQ ID NO: 66766 - protein, 10 aa, Dengue virus
LFSGVSWIMK

SEQ ID NO: 66767 - protein, 10 aa, Dengue virus
FSGVSWIMKI

SEQ ID NO: 66768 - protein, 10 aa, Dengue virus
SGVSWIMKIG

SEQ ID NO: 66769 - protein, 10 aa, Dengue virus
GVSWIMKIGI

SEQ ID NO: 66770 - protein, 10 aa, Dengue virus
VSWIMKIGIG

SEQ ID NO: 66771 - protein, 10 aa, Dengue virus
SWIMKIGIGV

SEQ ID NO: 66772 - protein, 10 aa, Dengue virus
WIMKIGIGVL

SEQ ID NO: 66773 - protein, 10 aa, Dengue virus
IMKIGIGVLL

SEQ ID NO: 66774 - protein, 10 aa, Dengue virus
MKIGIGILLT

SEQ ID NO: 66775 - protein, 10 aa, Dengue virus
KIGIGILLTW

SEQ ID NO: 66776 - protein, 10 aa, Dengue virus
IGIGILLTWI

SEQ ID NO: 66777 - protein, 10 aa, Dengue virus
GIGILLTWIG

SEQ ID NO: 66778 - protein, 10 aa, Dengue virus
IGILLTWIGL

SEQ ID NO: 66779 - protein, 10 aa, Dengue virus
GILLTWIGLN

SEQ ID NO: 66780 - protein, 10 aa, Dengue virus
ILLTWIGLNS

SEQ ID NO: 66781 - protein, 10 aa, Dengue virus
NTSMSFSCIV

SEQ ID NO: 66782 - protein, 10 aa, Dengue virus
TSMSFSCIVI

SEQ ID NO: 66783 - protein, 10 aa, Dengue virus
SMSFSCIVIG

SEQ ID NO: 66784 - protein, 10 aa, Dengue virus
MSFSCIVIGI

SEQ ID NO: 66785 - protein, 10 aa, Dengue virus
SFSCIVIGII

SEQ ID NO: 66786 - protein, 10 aa, Dengue virus
FSCIVIGIIT

SEQ ID NO: 66787 - protein, 10 aa, Dengue virus
SCIVIGIITL

SEQ ID NO: 66788 - protein, 10 aa, Dengue virus
CIVIGIITLY

SEQ ID NO: 66789 - protein, 10 aa, Dengue virus
IVIGIITLYL

SEQ ID NO: 66790 - protein, 10 aa, Dengue virus
VIGIITLYLG

SEQ ID NO: 66791 - protein, 10 aa, Dengue virus
IGVITLYLGA

SEQ ID NO: 66792 - protein, 10 aa, Dengue virus
GVITLYLGAV

SEQ ID NO: 66793 - protein, 10 aa, Dengue virus
VITLYLGAVV

SEQ ID NO: 66794 - protein, 10 aa, Dengue virus
ITLYLGTVVQ

SEQ ID NO: 66795 - protein, 10 aa, Dengue virus
TLYLGTVVQA

SEQ ID NO: 66796 - protein, 10 aa, Dengue virus
LYLGTVVQAD

SEQ ID NO: 66797 - protein, 10 aa, Dengue virus
YLGAVVQADT

SEQ ID NO: 66798 - protein, 10 aa, Dengue virus
LGAVVQADTG

SEQ ID NO: 66799 - protein, 10 aa, Dengue virus
GAVVQADTGC

SEQ ID NO: 66800 - protein, 10 aa, Dengue virus
AVVQADTGCV

SEQ ID NO: 66801 - protein, 10 aa, Dengue virus
VVQADTGCVI

SEQ ID NO: 66802 - protein, 10 aa, Dengue virus
VQADTGCVIN

SEQ ID NO: 66803 - protein, 10 aa, Dengue virus
QADTGCVINW

SEQ ID NO: 66804 - protein, 10 aa, Dengue virus
ADTGCVINWK

SEQ ID NO: 66805 - protein, 10 aa, Dengue virus
DTGCVINWKG

SEQ ID NO: 66806 - protein, 10 aa, Dengue virus
TGCVINWKGK

SEQ ID NO: 66807 - protein, 10 aa, Dengue virus
GCAINWKGKE

SEQ ID NO: 66808 - protein, 10 aa, Dengue virus
CAINWKGKEL

SEQ ID NO: 66809 - protein, 10 aa, Dengue virus
AINWKGKELK

SEQ ID NO: 66810 - protein, 10 aa, Dengue virus
VNWKGKELKC

SEQ ID NO: 66811 - protein, 10 aa, Dengue virus
WKGKELKCGN

SEQ ID NO: 66812 - protein, 10 aa, Dengue virus
KGKELKCGNG

SEQ ID NO: 66813 - protein, 10 aa, Dengue virus
GKELKCGNGI

SEQ ID NO: 66814 - protein, 10 aa, Dengue virus
KELKCGNGIF

SEQ ID NO: 66815 - protein, 10 aa, Dengue virus
ELKCGNGIFV

SEQ ID NO: 66816 - protein, 10 aa, Dengue virus
LKCGNGIFVT

SEQ ID NO: 66817 - protein, 10 aa, Dengue virus
KCGNGIFVTN

SEQ ID NO: 66818 - protein, 10 aa, Dengue virus
CGNGIFVTNE

SEQ ID NO: 66819 - protein, 10 aa, Dengue virus
GNGIFVTNEV

SEQ ID NO: 66820 - protein, 10 aa, Dengue virus
NGIFVTNEVH

SEQ ID NO: 66821 - protein, 10 aa, Dengue virus
RMENLLWKQV

SEQ ID NO: 66822 - protein, 10 aa, Dengue virus
MENLLWKQVA

SEQ ID NO: 66823 - protein, 10 aa, Dengue virus
ENLLWKQVAN

SEQ ID NO: 66824 - protein, 10 aa, Dengue virus
NLLWKQVANE

SEQ ID NO: 66825 - protein, 10 aa, Dengue virus
LLWKQVANEL

SEQ ID NO: 66826 - protein, 10 aa, Dengue virus
LWKQVANELN

SEQ ID NO: 66827 - protein, 10 aa, Dengue virus
WKQVANELNY

SEQ ID NO: 66828 - protein, 10 aa, Dengue virus
KQVANELNYI

SEQ ID NO: 66829 - protein, 10 aa, Dengue virus
QVANELNYIL

SEQ ID NO: 66830 - protein, 10 aa, Dengue virus
VANELNYILW

SEQ ID NO: 66831 - protein, 10 aa, Dengue virus
ELNHILWENN

SEQ ID NO: 66832 - protein, 10 aa, Dengue virus
LNYILWENNV

SEQ ID NO: 66833 - protein, 10 aa, Dengue virus
NYILWENNVK

SEQ ID NO: 66834 - protein, 10 aa, Dengue virus
YILWENNVKL

SEQ ID NO: 66835 - protein, 10 aa, Dengue virus
ILWENNVKLT

SEQ ID NO: 66836 - protein, 10 aa, Dengue virus
LWENNIKLTI

SEQ ID NO: 66837 - protein, 10 aa, Dengue virus
WENNIKLTIV

SEQ ID NO: 66838 - protein, 10 aa, Dengue virus
ENNIKLTIVV

SEQ ID NO: 66839 - protein, 10 aa, Dengue virus
NNIKLTIVVG

SEQ ID NO: 66840 - protein, 10 aa, Dengue virus
NIKLTIVVGD

SEQ ID NO: 66841 - protein, 10 aa, Dengue virus
IKLTVVVGDT

SEQ ID NO: 66842 - protein, 10 aa, Dengue virus
LTVVVGDTIG

SEQ ID NO: 66843 - protein, 10 aa, Dengue virus
IGILEQGKRT

SEQ ID NO: 66844 - protein, 10 aa, Dengue virus
GILEQGKRTL

SEQ ID NO: 66845 - protein, 10 aa, Dengue virus
ILEQGKRTLT

SEQ ID NO: 66846 - protein, 10 aa, Dengue virus
LEQGKRALTP

SEQ ID NO: 66847 - protein, 10 aa, Dengue virus
EQGKRALTPQ

SEQ ID NO: 66848 - protein, 10 aa, Dengue virus
QGKRALTPQP

SEQ ID NO: 66849 - protein, 10 aa, Dengue virus
GKRALTPQPM

SEQ ID NO: 66850 - protein, 10 aa, Dengue virus
KRALTPQPME

SEQ ID NO: 66851 - protein, 10 aa, Dengue virus
RALTPQPMEL

SEQ ID NO: 66852 - protein, 10 aa, Dengue virus
ALTPQPMELK

SEQ ID NO: 66853 - protein, 10 aa, Dengue virus
LTLQPMELKY

SEQ ID NO: 66854 - protein, 10 aa, Dengue virus
TLQPMELKYS

SEQ ID NO: 66855 - protein, 10 aa, Dengue virus
PMELKYSWKA

SEQ ID NO: 66856 - protein, 10 aa, Dengue virus
MELKYSWKAW

SEQ ID NO: 66857 - protein, 10 aa, Dengue virus
ELKYSWKAWG

SEQ ID NO: 66858 - protein, 10 aa, Dengue virus
LKYSWKAWGK

SEQ ID NO: 66859 - protein, 10 aa, Dengue virus
KYSWKAWGKA

SEQ ID NO: 66860 - protein, 10 aa, Dengue virus
YSWKTWGKAR

SEQ ID NO: 66861 - protein, 10 aa, Dengue virus
SWKTWGKARI

SEQ ID NO: 66862 - protein, 10 aa, Dengue virus
WKTWGKARIV

SEQ ID NO: 66863 - protein, 10 aa, Dengue virus
WGKARIVTAE

SEQ ID NO: 66864 - protein, 10 aa, Dengue virus
AEIQNSSFII

SEQ ID NO: 66865 - protein, 10 aa, Dengue virus
EIQNSSFIID

SEQ ID NO: 66866 - protein, 10 aa, Dengue virus
IQNSSFIIDG

SEQ ID NO: 66867 - protein, 10 aa, Dengue virus
QNFSFIIDGP

SEQ ID NO: 66868 - protein, 10 aa, Dengue virus
NSSFIIDGPS

SEQ ID NO: 66869 - protein, 10 aa, Dengue virus
SSFIIDGPST

SEQ ID NO: 66870 - protein, 10 aa, Dengue virus
SFIIDGPSTP

SEQ ID NO: 66871 - protein, 10 aa, Dengue virus
FIIDGPSTPE

SEQ ID NO: 66872 - protein, 10 aa, Dengue virus
IIDGPSTPEC

SEQ ID NO: 66873 - protein, 10 aa, Dengue virus
IDGPSTPECP

SEQ ID NO: 66874 - protein, 10 aa, Dengue virus
DGPNTPECPN

SEQ ID NO: 66875 - protein, 10 aa, Dengue virus
GPNTPECPNA

SEQ ID NO: 66876 - protein, 10 aa, Dengue virus
PNASRAWNVW

SEQ ID NO: 66877 - protein, 10 aa, Dengue virus
NASRAWNVWE

SEQ ID NO: 66878 - protein, 10 aa, Dengue virus
VSRAWNVWEV

SEQ ID NO: 66879 - protein, 10 aa, Dengue virus
TNIWLKLREM

SEQ ID NO: 66880 - protein, 10 aa, Dengue virus
NIWLKLREMY

SEQ ID NO: 66881 - protein, 10 aa, Dengue virus
IWLKLREMYT

SEQ ID NO: 66882 - protein, 10 aa, Dengue virus
WLKLREMYTQ

SEQ ID NO: 66883 - protein, 10 aa, Dengue virus
TQSCDHRLMS

SEQ ID NO: 66884 - protein, 10 aa, Dengue virus
QSCDHRLMSA

SEQ ID NO: 66885 - protein, 10 aa, Dengue virus
SCDHRLMSAA

SEQ ID NO: 66886 - protein, 10 aa, Dengue virus
CDHRLMSAAI

SEQ ID NO: 66887 - protein, 10 aa, Dengue virus
DHRLMSAAIK

SEQ ID NO: 66888 - protein, 10 aa, Dengue virus
HRLMSAAIKD

SEQ ID NO: 66889 - protein, 10 aa, Dengue virus
RLMSAAIKDE

SEQ ID NO: 66890 - protein, 10 aa, Dengue virus
LMSAAIKDER

SEQ ID NO: 66891 - protein, 10 aa, Dengue virus
MSAAIKDERA

SEQ ID NO: 66892 - protein, 10 aa, Dengue virus
SAAIKDERAV

SEQ ID NO: 66893 - protein, 10 aa, Dengue virus
AAIKDERAVH

SEQ ID NO: 66894 - protein, 10 aa, Dengue virus
AIKDERAVHA

SEQ ID NO: 66895 - protein, 10 aa, Dengue virus
IKDERAVHAD

SEQ ID NO: 66896 - protein, 10 aa, Dengue virus
GSWKLEKASF

SEQ ID NO: 66897 - protein, 10 aa, Dengue virus
SWKLEKASFI

SEQ ID NO: 66898 - protein, 10 aa, Dengue virus
WKLEKASFIE

SEQ ID NO: 66899 - protein, 10 aa, Dengue virus
KLEKASFIEV

SEQ ID NO: 66900 - protein, 10 aa, Dengue virus
LEKASFIEVK

SEQ ID NO: 66901 - protein, 10 aa, Dengue virus
EKASFIEVKT

SEQ ID NO: 66902 - protein, 10 aa, Dengue virus
KASFIEVKTC

SEQ ID NO: 66903 - protein, 10 aa, Dengue virus
ASFIEVKTCT

SEQ ID NO: 66904 - protein, 10 aa, Dengue virus
SFIEVKTCTW

SEQ ID NO: 66905 - protein, 10 aa, Dengue virus
FIEVKTCTWP

SEQ ID NO: 66906 - protein, 10 aa, Dengue virus
LAGPISQHNH

SEQ ID NO: 66907 - protein, 10 aa, Dengue virus
AGPISQHNHR

SEQ ID NO: 66908 - protein, 10 aa, Dengue virus
GPISQHNHRP

SEQ ID NO: 66909 - protein, 10 aa, Dengue virus
PISQHNHRPG

SEQ ID NO: 66910 - protein, 10 aa, Dengue virus
ISQHNHRPGY

SEQ ID NO: 66911 - protein, 10 aa, Dengue virus
SQHNHRPGYH

SEQ ID NO: 66912 - protein, 10 aa, Dengue virus
QHNHRPGYHT

SEQ ID NO: 66913 - protein, 10 aa, Dengue virus
HNHRPGYHTQ

SEQ ID NO: 66914 - protein, 10 aa, Dengue virus
NHRPGYHTQT

SEQ ID NO: 66915 - protein, 10 aa, Dengue virus
HRPGYHTQTA

SEQ ID NO: 66916 - protein, 10 aa, Dengue virus
PGYYTQTAGP

SEQ ID NO: 66917 - protein, 10 aa, Dengue virus
GYYTQTAGPW

SEQ ID NO: 66918 - protein, 10 aa, Dengue virus
YYTQTAGPWH

SEQ ID NO: 66919 - protein, 10 aa, Dengue virus
YTQTAGPWHL

SEQ ID NO: 66920 - protein, 10 aa, Dengue virus
AGPWHLGKLD

SEQ ID NO: 66921 - protein, 10 aa, Dengue virus
YCEGTTVVIA

SEQ ID NO: 66922 - protein, 10 aa, Dengue virus
CEGTTVVIAE

SEQ ID NO: 66923 - protein, 10 aa, Dengue virus
EGTTVVITES

SEQ ID NO: 66924 - protein, 10 aa, Dengue virus
GTTVVITESC

SEQ ID NO: 66925 - protein, 10 aa, Dengue virus
TTVVITESCG

SEQ ID NO: 66926 - protein, 10 aa, Dengue virus
TVVITESCGT

SEQ ID NO: 66927 - protein, 10 aa, Dengue virus
CGMRGPSLRT

SEQ ID NO: 66928 - protein, 10 aa, Dengue virus
GTRGPSLRAT

SEQ ID NO: 66929 - protein, 10 aa, Dengue virus
IRGPSLRTTT

SEQ ID NO: 66930 - protein, 10 aa, Dengue virus
KGPSLRTTTV

SEQ ID NO: 66931 - protein, 10 aa, Dengue virus
CWYGMEIRPV

SEQ ID NO: 66932 - protein, 10 aa, Dengue virus
WYGMEIRPIN

SEQ ID NO: 66933 - protein, 10 aa, Dengue virus
YGMEIRPINE

SEQ ID NO: 66934 - protein, 10 aa, Dengue virus
GMEIRPINEK

SEQ ID NO: 66935 - protein, 10 aa, Dengue virus
MEIRPINEKE

SEQ ID NO: 66936 - protein, 10 aa, Dengue virus
EIRPINEKEE

SEQ ID NO: 66937 - protein, 10 aa, Dengue virus
IRPINEKEEN

SEQ ID NO: 66938 - protein, 10 aa, Dengue virus
RPINEKEENM

SEQ ID NO: 66939 - protein, 10 aa, Dengue virus
PINEKEENMV

SEQ ID NO: 66940 - protein, 10 aa, Dengue virus
INEKEENMVK

SEQ ID NO: 66941 - protein, 10 aa, Dengue virus
NEKEENMVKS

SEQ ID NO: 66942 - protein, 10 aa, Dengue virus
KEENMVKSLA

SEQ ID NO: 66943 - protein, 10 aa, Dengue virus
EENMVKSLAS

SEQ ID NO: 66944 - protein, 10 aa, Dengue virus
ENMVKSLASA

SEQ ID NO: 66945 - protein, 10 aa, Dengue virus
NMVKSLASAG

SEQ ID NO: 66946 - protein, 10 aa, Dengue virus
MVKSLASAGS

SEQ ID NO: 66947 - protein, 10 aa, Dengue virus
VKSLASAGSG

SEQ ID NO: 66948 - protein, 10 aa, Dengue virus
KSLVSAGSGE

SEQ ID NO: 66949 - protein, 10 aa, Dengue virus
SLVSAGSGEV

SEQ ID NO: 66950 - protein, 10 aa, Dengue virus
LVSAGSGEVD

SEQ ID NO: 66951 - protein, 10 aa, Dengue virus
VSAGSGEVDN

SEQ ID NO: 66952 - protein, 10 aa, Dengue virus
SAGSGEVDNF

SEQ ID NO: 66953 - protein, 10 aa, Dengue virus
AGSGEVDNFT

SEQ ID NO: 66954 - protein, 10 aa, Dengue virus
GSGEVDNFTM

SEQ ID NO: 66955 - protein, 10 aa, Dengue virus
SGEVDNFTMG

SEQ ID NO: 66956 - protein, 10 aa, Dengue virus
MDNFTMGILC

SEQ ID NO: 66957 - protein, 10 aa, Dengue virus
DNFTMGILCL

SEQ ID NO: 66958 - protein, 10 aa, Dengue virus
NFTMGILCLA

SEQ ID NO: 66959 - protein, 10 aa, Dengue virus
FTMGILCLAI

SEQ ID NO: 66960 - protein, 10 aa, Dengue virus
TMGILCLAIL

SEQ ID NO: 66961 - protein, 10 aa, Dengue virus
MGILCLAILF

SEQ ID NO: 66962 - protein, 10 aa, Dengue virus
GILCLAILFE

SEQ ID NO: 66963 - protein, 10 aa, Dengue virus
ILCLAILFEE

SEQ ID NO: 66964 - protein, 10 aa, Dengue virus
CLAILFEEVL

SEQ ID NO: 66965 - protein, 10 aa, Dengue virus
LAILFEEVLR

SEQ ID NO: 66966 - protein, 10 aa, Dengue virus
AILFEEVLRG

SEQ ID NO: 66967 - protein, 10 aa, Dengue virus
ILFEEVLRGK

SEQ ID NO: 66968 - protein, 10 aa, Dengue virus
LFEEVLRGKF

SEQ ID NO: 66969 - protein, 10 aa, Dengue virus
FEEVLRGKFG

SEQ ID NO: 66970 - protein, 10 aa, Dengue virus
EEVLRGKFGK

SEQ ID NO: 66971 - protein, 10 aa, Dengue virus
EVLRGKFGKK

SEQ ID NO: 66972 - protein, 10 aa, Dengue virus
VLRGKFGKKH

SEQ ID NO: 66973 - protein, 10 aa, Dengue virus
GKFGKKHMIV

SEQ ID NO: 66974 - protein, 10 aa, Dengue virus
KFGKKHMIVG

SEQ ID NO: 66975 - protein, 10 aa, Dengue virus
FGKKHMIVGV

SEQ ID NO: 66976 - protein, 10 aa, Dengue virus
FMFVLLLSGQ

SEQ ID NO: 66977 - protein, 10 aa, Dengue virus
MFVLLLSGQI

SEQ ID NO: 66978 - protein, 10 aa, Dengue virus
FVLLLSGQIK

SEQ ID NO: 66979 - protein, 10 aa, Dengue virus
ALLLSGQITW

SEQ ID NO: 66980 - protein, 10 aa, Dengue virus
LSGQITWRDL

SEQ ID NO: 66981 - protein, 10 aa, Dengue virus
SGQITWRDMT

SEQ ID NO: 66982 - protein, 10 aa, Dengue virus
ARTLIMIGSN

SEQ ID NO: 66983 - protein, 10 aa, Dengue virus
RTLIMIGSNA

SEQ ID NO: 66984 - protein, 10 aa, Dengue virus
TFIMIGSNAS

SEQ ID NO: 66985 - protein, 10 aa, Dengue virus
FIMIGSNASD

SEQ ID NO: 66986 - protein, 10 aa, Dengue virus
IMIGSNASDK

SEQ ID NO: 66987 - protein, 10 aa, Dengue virus
MIGSNATDRM

SEQ ID NO: 66988 - protein, 10 aa, Dengue virus
IGSNATDRMG

SEQ ID NO: 66989 - protein, 10 aa, Dengue virus
GSNATDRMGM

SEQ ID NO: 66990 - protein, 10 aa, Dengue virus
SNATDRMGMG

SEQ ID NO: 66991 - protein, 10 aa, Dengue virus
NASDKMGMGV

SEQ ID NO: 66992 - protein, 10 aa, Dengue virus
ATDRMGMGVT

SEQ ID NO: 66993 - protein, 10 aa, Dengue virus
TDRMGMGVTY

SEQ ID NO: 66994 - protein, 10 aa, Dengue virus
DKMGMGVTYL

SEQ ID NO: 66995 - protein, 10 aa, Dengue virus
KMGMGVTYLA

SEQ ID NO: 66996 - protein, 10 aa, Dengue virus
GVTHLALIAT

SEQ ID NO: 66997 - protein, 10 aa, Dengue virus
VTHLALIATF

SEQ ID NO: 66998 - protein, 10 aa, Dengue virus
THLALIATFK

SEQ ID NO: 66999 - protein, 10 aa, Dengue virus
HLALIATFKI

SEQ ID NO: 67000 - protein, 10 aa, Dengue virus
LIATFKIQPL

SEQ ID NO: 67001 - protein, 10 aa, Dengue virus
IATFKIQPLL

SEQ ID NO: 67002 - protein, 10 aa, Dengue virus
ATFKIQPLLA

SEQ ID NO: 67003 - protein, 10 aa, Dengue virus
TFKIQPLLAL

SEQ ID NO: 67004 - protein, 10 aa, Dengue virus
FKIQPLLALG

SEQ ID NO: 67005 - protein, 10 aa, Dengue virus
KIQPLLALGF

SEQ ID NO: 67006 - protein, 10 aa, Dengue virus
IQPLLALGFF

SEQ ID NO: 67007 - protein, 10 aa, Dengue virus
QPLLALGFFL

SEQ ID NO: 67008 - protein, 10 aa, Dengue virus
PLLALGFFLR

SEQ ID NO: 67009 - protein, 10 aa, Dengue virus
LLALGFFLRK

SEQ ID NO: 67010 - protein, 10 aa, Dengue virus
LLGVGLAMAA

SEQ ID NO: 67011 - protein, 10 aa, Dengue virus
LGVGLAMAAT

SEQ ID NO: 67012 - protein, 10 aa, Dengue virus
GVGLAMAATL

SEQ ID NO: 67013 - protein, 10 aa, Dengue virus
VGLAMAATLR

SEQ ID NO: 67014 - protein, 10 aa, Dengue virus
GLAMAATLRL

SEQ ID NO: 67015 - protein, 10 aa, Dengue virus
LAMAATLRLP

SEQ ID NO: 67016 - protein, 10 aa, Dengue virus
AMAATLRLPE

SEQ ID NO: 67017 - protein, 10 aa, Dengue virus
MAATLRLPED

SEQ ID NO: 67018 - protein, 10 aa, Dengue virus
AATLRLPEDI

SEQ ID NO: 67019 - protein, 10 aa, Dengue virus
ATLRLPEDIE

SEQ ID NO: 67020 - protein, 10 aa, Dengue virus
TLRLPEDIEQ

SEQ ID NO: 67021 - protein, 10 aa, Dengue virus
LRLPEDIEQM

SEQ ID NO: 67022 - protein, 10 aa, Dengue virus
RLPEDIEQMA

SEQ ID NO: 67023 - protein, 10 aa, Dengue virus
EDIEQMANGV

SEQ ID NO: 67024 - protein, 10 aa, Dengue virus
ANGIALGLMT

SEQ ID NO: 67025 - protein, 10 aa, Dengue virus
NGIALGLMTL

SEQ ID NO: 67026 - protein, 10 aa, Dengue virus
GIALGLMTLK

SEQ ID NO: 67027 - protein, 10 aa, Dengue virus
IALGLMTLKL

SEQ ID NO: 67028 - protein, 10 aa, Dengue virus
ALGLMTLKLI

SEQ ID NO: 67029 - protein, 10 aa, Dengue virus
LGLMTLKLIT

SEQ ID NO: 67030 - protein, 10 aa, Dengue virus
GLMTLKLITQ

SEQ ID NO: 67031 - protein, 10 aa, Dengue virus
LMTLKLITQF

SEQ ID NO: 67032 - protein, 10 aa, Dengue virus
MTLKLITQFE

SEQ ID NO: 67033 - protein, 10 aa, Dengue virus
TLKLITQFET

SEQ ID NO: 67034 - protein, 10 aa, Dengue virus
LKLTTQFETY

SEQ ID NO: 67035 - protein, 10 aa, Dengue virus
KLTTQFETYQ

SEQ ID NO: 67036 - protein, 10 aa, Dengue virus
LTTQFETYQL

SEQ ID NO: 67037 - protein, 10 aa, Dengue virus
TTQFETYQLW

SEQ ID NO: 67038 - protein, 10 aa, Dengue virus
TQFETYQLWA

SEQ ID NO: 67039 - protein, 10 aa, Dengue virus
QFETYQLWAA

SEQ ID NO: 67040 - protein, 10 aa, Dengue virus
FETYQLWAAL

SEQ ID NO: 67041 - protein, 10 aa, Dengue virus
ETYQLWTALV

SEQ ID NO: 67042 - protein, 10 aa, Dengue virus
TYQLWTALVS

SEQ ID NO: 67043 - protein, 10 aa, Dengue virus
YQLWTALVSL

SEQ ID NO: 67044 - protein, 10 aa, Dengue virus
QLWTALVSLT

SEQ ID NO: 67045 - protein, 10 aa, Dengue virus
LWTALVSLTC

SEQ ID NO: 67046 - protein, 10 aa, Dengue virus
ALVSLTCSNT

SEQ ID NO: 67047 - protein, 10 aa, Dengue virus
SLTCSNTMFT

SEQ ID NO: 67048 - protein, 10 aa, Dengue virus
LTCSNTMFTL

SEQ ID NO: 67049 - protein, 10 aa, Dengue virus
TCSNTMFTLT

SEQ ID NO: 67050 - protein, 10 aa, Dengue virus
CSNTMFTLTV

SEQ ID NO: 67051 - protein, 10 aa, Dengue virus
SNTMFTLTVA

SEQ ID NO: 67052 - protein, 10 aa, Dengue virus
NTMFTLTVAW

SEQ ID NO: 67053 - protein, 10 aa, Dengue virus
TMFTLTVAWR

SEQ ID NO: 67054 - protein, 10 aa, Dengue virus
MFTLTVAWRT

SEQ ID NO: 67055 - protein, 10 aa, Dengue virus
WRTATLILAV

SEQ ID NO: 67056 - protein, 10 aa, Dengue virus
RTATLILAGI

SEQ ID NO: 67057 - protein, 10 aa, Dengue virus
TATLILAGIS

SEQ ID NO: 67058 - protein, 10 aa, Dengue virus
ATLILAGISL

SEQ ID NO: 67059 - protein, 10 aa, Dengue virus
TLILAGISLL

SEQ ID NO: 67060 - protein, 10 aa, Dengue virus
LILAGISLLP

SEQ ID NO: 67061 - protein, 10 aa, Dengue virus
VSLLPLCQSS

SEQ ID NO: 67062 - protein, 10 aa, Dengue virus
SLLPLCQSSS

SEQ ID NO: 67063 - protein, 10 aa, Dengue virus
LLPLCQSSSM

SEQ ID NO: 67064 - protein, 10 aa, Dengue virus
LPLCQSSSMR

SEQ ID NO: 67065 - protein, 10 aa, Dengue virus
PLCQSSSMRK

SEQ ID NO: 67066 - protein, 10 aa, Dengue virus
LCQSSSMRKT

SEQ ID NO: 67067 - protein, 10 aa, Dengue virus
CQSSSMRKSD

SEQ ID NO: 67068 - protein, 10 aa, Dengue virus
QSSSMRKSDW

SEQ ID NO: 67069 - protein, 10 aa, Dengue virus
SSSMRKSDWL

SEQ ID NO: 67070 - protein, 10 aa, Dengue virus
SSMRKSDWLP

SEQ ID NO: 67071 - protein, 10 aa, Dengue virus
SMRKSDWLPM

SEQ ID NO: 67072 - protein, 10 aa, Dengue virus
MRKTDWLPMA

SEQ ID NO: 67073 - protein, 10 aa, Dengue virus
RKTDWLPMAV

SEQ ID NO: 67074 - protein, 10 aa, Dengue virus
KTDWLPMAVA

SEQ ID NO: 67075 - protein, 10 aa, Dengue virus
TDWLPMAVAA

SEQ ID NO: 67076 - protein, 10 aa, Dengue virus
DWLPMAVAAM

SEQ ID NO: 67077 - protein, 10 aa, Dengue virus
WLPMAVAAMG

SEQ ID NO: 67078 - protein, 10 aa, Dengue virus
LPMAVAAMGV

SEQ ID NO: 67079 - protein, 10 aa, Dengue virus
VAAMGVPSLP

SEQ ID NO: 67080 - protein, 10 aa, Dengue virus
AAMGVPSLPL

SEQ ID NO: 67081 - protein, 10 aa, Dengue virus
AMGVPSLPLF

SEQ ID NO: 67082 - protein, 10 aa, Dengue virus
MGVPSLPLFI

SEQ ID NO: 67083 - protein, 10 aa, Dengue virus
GVPSLPLFIF

SEQ ID NO: 67084 - protein, 10 aa, Dengue virus
SLPLFIFSLK

SEQ ID NO: 67085 - protein, 10 aa, Dengue virus
LPLFIFNLKD

SEQ ID NO: 67086 - protein, 10 aa, Dengue virus
PLFIFNLKDT

SEQ ID NO: 67087 - protein, 10 aa, Dengue virus
LKDTPKRRSW

SEQ ID NO: 67088 - protein, 10 aa, Dengue virus
KDTPKRRSWP

SEQ ID NO: 67089 - protein, 10 aa, Dengue virus
DTPKRRSWPL

SEQ ID NO: 67090 - protein, 10 aa, Dengue virus
TPKRRSWPLN

SEQ ID NO: 67091 - protein, 10 aa, Dengue virus
PKRRSWPLNE

SEQ ID NO: 67092 - protein, 10 aa, Dengue virus
KRKSWPLNEG

SEQ ID NO: 67093 - protein, 10 aa, Dengue virus
RKSWPLNEGV

SEQ ID NO: 67094 - protein, 10 aa, Dengue virus
KSWPLNEGVM

SEQ ID NO: 67095 - protein, 10 aa, Dengue virus
GLVSILASSF

SEQ ID NO: 67096 - protein, 10 aa, Dengue virus
LVSILASSFL

SEQ ID NO: 67097 - protein, 10 aa, Dengue virus
VSILASSFLR

SEQ ID NO: 67098 - protein, 10 aa, Dengue virus
SILASSFLRN

SEQ ID NO: 67099 - protein, 10 aa, Dengue virus
ILASSFLRND

SEQ ID NO: 67100 - protein, 10 aa, Dengue virus
LASSFLRNDV

SEQ ID NO: 67101 - protein, 10 aa, Dengue virus
ASSFLRNDVP

SEQ ID NO: 67102 - protein, 10 aa, Dengue virus
SSFLRNDVPM

SEQ ID NO: 67103 - protein, 10 aa, Dengue virus
SFLRNDVPMA

SEQ ID NO: 67104 - protein, 10 aa, Dengue virus
FLRNDVPMAG

SEQ ID NO: 67105 - protein, 10 aa, Dengue virus
VITGTSADLI

SEQ ID NO: 67106 - protein, 10 aa, Dengue virus
ITGTSADLIV

SEQ ID NO: 67107 - protein, 10 aa, Dengue virus
TGTSADLIVE

SEQ ID NO: 67108 - protein, 10 aa, Dengue virus
GTSADLIVEK

SEQ ID NO: 67109 - protein, 10 aa, Dengue virus
TSADLIVEKA

SEQ ID NO: 67110 - protein, 10 aa, Dengue virus
SADLIVEKAA

SEQ ID NO: 67111 - protein, 10 aa, Dengue virus
ADLIVEKAAD

SEQ ID NO: 67112 - protein, 10 aa, Dengue virus
ADITWEEEAE

SEQ ID NO: 67113 - protein, 10 aa, Dengue virus
DITWEEEAEQ

SEQ ID NO: 67114 - protein, 10 aa, Dengue virus
ITWEEEAEQT

SEQ ID NO: 67115 - protein, 10 aa, Dengue virus
QTGVSHNLMV

SEQ ID NO: 67116 - protein, 10 aa, Dengue virus
TGVSHNLMVT

SEQ ID NO: 67117 - protein, 10 aa, Dengue virus
GVSHNLMVTV

SEQ ID NO: 67118 - protein, 10 aa, Dengue virus
VSHNLMVTVD

SEQ ID NO: 67119 - protein, 10 aa, Dengue virus
SHNLMVTVDD

SEQ ID NO: 67120 - protein, 10 aa, Dengue virus
HNLMVTVDDD

SEQ ID NO: 67121 - protein, 10 aa, Dengue virus
NLMVTVDDDG

SEQ ID NO: 67122 - protein, 10 aa, Dengue virus
LMVTVDDDGT

SEQ ID NO: 67123 - protein, 10 aa, Dengue virus
MVTVDDDGTM

SEQ ID NO: 67124 - protein, 10 aa, Dengue virus
VTVDDDGTMR

SEQ ID NO: 67125 - protein, 10 aa, Dengue virus
VDDDGTMKIK

SEQ ID NO: 67126 - protein, 10 aa, Dengue virus
DDDGTMKIKD

SEQ ID NO: 67127 - protein, 10 aa, Dengue virus
DDGTMKIKDD

SEQ ID NO: 67128 - protein, 10 aa, Dengue virus
DGTMKIKDDE

SEQ ID NO: 67129 - protein, 10 aa, Dengue virus
GTMKIKDDET

SEQ ID NO: 67130 - protein, 10 aa, Dengue virus
TMKIKDDETE

SEQ ID NO: 67131 - protein, 10 aa, Dengue virus
MKIKDDETEN

SEQ ID NO: 67132 - protein, 10 aa, Dengue virus
KIKDDETENI

SEQ ID NO: 67133 - protein, 10 aa, Dengue virus
KTALLIVSGV

SEQ ID NO: 67134 - protein, 10 aa, Dengue virus
TALLIVSGVF

SEQ ID NO: 67135 - protein, 10 aa, Dengue virus
ALLIVSGVFP

SEQ ID NO: 67136 - protein, 10 aa, Dengue virus
LLIVSGVFPY

SEQ ID NO: 67137 - protein, 10 aa, Dengue virus
LIVSGVFPYS

SEQ ID NO: 67138 - protein, 10 aa, Dengue virus
IVSGVFPYSI

SEQ ID NO: 67139 - protein, 10 aa, Dengue virus
VSGVFPYSIP

SEQ ID NO: 67140 - protein, 10 aa, Dengue virus
SGVFPYSIPA

SEQ ID NO: 67141 - protein, 10 aa, Dengue virus
GVFPYSIPAT

SEQ ID NO: 67142 - protein, 10 aa, Dengue virus
VFPYSIPATL

SEQ ID NO: 67143 - protein, 10 aa, Dengue virus
LLVWHTWQKR

SEQ ID NO: 67144 - protein, 10 aa, Dengue virus
LVWHTWQKRT

SEQ ID NO: 67145 - protein, 10 aa, Dengue virus
VWHTWQKQTR

SEQ ID NO: 67146 - protein, 10 aa, Dengue virus
WHTWQKQTRR

SEQ ID NO: 67147 - protein, 10 aa, Dengue virus
HTWQKQTRRS

SEQ ID NO: 67148 - protein, 10 aa, Dengue virus
TWQKQTRRSG

SEQ ID NO: 67149 - protein, 10 aa, Dengue virus
WQKQTRRSGV

SEQ ID NO: 67150 - protein, 10 aa, Dengue virus
QKQTRRSGVL

SEQ ID NO: 67151 - protein, 10 aa, Dengue virus
KQTRRSGVLW

SEQ ID NO: 67152 - protein, 10 aa, Dengue virus
QTRRSGVLWD

SEQ ID NO: 67153 - protein, 10 aa, Dengue virus
TRRSGVLWDV

SEQ ID NO: 67154 - protein, 10 aa, Dengue virus
RRSGVLWDVP

SEQ ID NO: 67155 - protein, 10 aa, Dengue virus
EEGVYRINQQ

SEQ ID NO: 67156 - protein, 10 aa, Dengue virus
EGVYRINQQG

SEQ ID NO: 67157 - protein, 10 aa, Dengue virus
VYRIKQQGIL

SEQ ID NO: 67158 - protein, 10 aa, Dengue virus
YRIKQQGILG

SEQ ID NO: 67159 - protein, 10 aa, Dengue virus
RIKQQGILGK

SEQ ID NO: 67160 - protein, 10 aa, Dengue virus
IKQQGILGKT

SEQ ID NO: 67161 - protein, 10 aa, Dengue virus
KQQGILGKTQ

SEQ ID NO: 67162 - protein, 10 aa, Dengue virus
QQGILGKTQV

SEQ ID NO: 67163 - protein, 10 aa, Dengue virus
QGILGKTQVG

SEQ ID NO: 67164 - protein, 10 aa, Dengue virus
GILGKTQVGV

SEQ ID NO: 67165 - protein, 10 aa, Dengue virus
ILGKTQVGVG

SEQ ID NO: 67166 - protein, 10 aa, Dengue virus
LGKTQVGVGV

SEQ ID NO: 67167 - protein, 10 aa, Dengue virus
GKTQVGVGIQ

SEQ ID NO: 67168 - protein, 10 aa, Dengue virus
KTQVGVGIQK

SEQ ID NO: 67169 - protein, 10 aa, Dengue virus
TQVGVGIQKE

SEQ ID NO: 67170 - protein, 10 aa, Dengue virus
QVGVGIQKEG

SEQ ID NO: 67171 - protein, 10 aa, Dengue virus
VGVGIQKEGV

SEQ ID NO: 67172 - protein, 10 aa, Dengue virus
GVGIQKEGVF

SEQ ID NO: 67173 - protein, 10 aa, Dengue virus
VGIQKEGVFH

SEQ ID NO: 67174 - protein, 10 aa, Dengue virus
GIQKEGVFHT

SEQ ID NO: 67175 - protein, 10 aa, Dengue virus
IQKEGVFHTM

SEQ ID NO: 67176 - protein, 10 aa, Dengue virus
HVTRGAVLTH

SEQ ID NO: 67177 - protein, 10 aa, Dengue virus
VTRGAVLTHN

SEQ ID NO: 67178 - protein, 10 aa, Dengue virus
TRGAVLTHNG

SEQ ID NO: 67179 - protein, 10 aa, Dengue virus
RGAVLTHNGK

SEQ ID NO: 67180 - protein, 10 aa, Dengue virus
GAVLTHNGKR

SEQ ID NO: 67181 - protein, 10 aa, Dengue virus
AVLTHNGKRL

SEQ ID NO: 67182 - protein, 10 aa, Dengue virus
VLTHNGKRLE

SEQ ID NO: 67183 - protein, 10 aa, Dengue virus
LTHNGKRLEP

SEQ ID NO: 67184 - protein, 10 aa, Dengue virus
THNGKRLEPN

SEQ ID NO: 67185 - protein, 10 aa, Dengue virus
HNGKRLEPNW

SEQ ID NO: 67186 - protein, 10 aa, Dengue virus
GKRLEPNWAN

SEQ ID NO: 67187 - protein, 10 aa, Dengue virus
KRLEPNWANV

SEQ ID NO: 67188 - protein, 10 aa, Dengue virus
RLEPNWANVK

SEQ ID NO: 67189 - protein, 10 aa, Dengue virus
LEPNWANVKK

SEQ ID NO: 67190 - protein, 10 aa, Dengue virus
EPNWANVKKD

SEQ ID NO: 67191 - protein, 10 aa, Dengue virus
PNWANVKKDL

SEQ ID NO: 67192 - protein, 10 aa, Dengue virus
NWANVKKDLI

SEQ ID NO: 67193 - protein, 10 aa, Dengue virus
WANVKKDLIS

SEQ ID NO: 67194 - protein, 10 aa, Dengue virus
ANVKKDLISY

SEQ ID NO: 67195 - protein, 10 aa, Dengue virus
NVKKDLISYG

SEQ ID NO: 67196 - protein, 10 aa, Dengue virus
DLISYGGGWK

SEQ ID NO: 67197 - protein, 10 aa, Dengue virus
LISYGGGWKL

SEQ ID NO: 67198 - protein, 10 aa, Dengue virus
ISYGGGWRLN

SEQ ID NO: 67199 - protein, 10 aa, Dengue virus
SYGGGWRLNA

SEQ ID NO: 67200 - protein, 10 aa, Dengue virus
YGGGWRLNAQ

SEQ ID NO: 67201 - protein, 10 aa, Dengue virus
GGGWRLNAQW

SEQ ID NO: 67202 - protein, 10 aa, Dengue virus
GGWRLNAQWQ

SEQ ID NO: 67203 - protein, 10 aa, Dengue virus
GWRLNAQWQK

SEQ ID NO: 67204 - protein, 10 aa, Dengue virus
WRLNAQWQKG

SEQ ID NO: 67205 - protein, 10 aa, Dengue virus
RLNAQWQKGE

SEQ ID NO: 67206 - protein, 10 aa, Dengue virus
LNAQWQKGEE

SEQ ID NO: 67207 - protein, 10 aa, Dengue virus
NAQWQKGEEV

SEQ ID NO: 67208 - protein, 10 aa, Dengue virus
TQWQKGEEVQ

SEQ ID NO: 67209 - protein, 10 aa, Dengue virus
QWKKGEEVQV

SEQ ID NO: 67210 - protein, 10 aa, Dengue virus
WKKGEEVQVI

SEQ ID NO: 67211 - protein, 10 aa, Dengue virus
KKGEEVQVIA

SEQ ID NO: 67212 - protein, 10 aa, Dengue virus
GKNPKNFQTT

SEQ ID NO: 67213 - protein, 10 aa, Dengue virus
KNPKNFQTTP

SEQ ID NO: 67214 - protein, 10 aa, Dengue virus
NPKNFQTTPG

SEQ ID NO: 67215 - protein, 10 aa, Dengue virus
PKNFQTMPGI

SEQ ID NO: 67216 - protein, 10 aa, Dengue virus
KNFQTMPGIF

SEQ ID NO: 67217 - protein, 10 aa, Dengue virus
NFQTMPGIFQ

SEQ ID NO: 67218 - protein, 10 aa, Dengue virus
FQTMPGIFQT

SEQ ID NO: 67219 - protein, 10 aa, Dengue virus
QTMPGIFQTT

SEQ ID NO: 67220 - protein, 10 aa, Dengue virus
PGIFQTTTGE

SEQ ID NO: 67221 - protein, 10 aa, Dengue virus
GIFQTTTGEI

SEQ ID NO: 67222 - protein, 10 aa, Dengue virus
IFQTTTGEIG

SEQ ID NO: 67223 - protein, 10 aa, Dengue virus
FQTTMGEIGA

SEQ ID NO: 67224 - protein, 10 aa, Dengue virus
QTTMGEIGAI

SEQ ID NO: 67225 - protein, 10 aa, Dengue virus
TTMGEIGAIA

SEQ ID NO: 67226 - protein, 10 aa, Dengue virus
TMGEIGAIAL

SEQ ID NO: 67227 - protein, 10 aa, Dengue virus
MGEIGAIALD

SEQ ID NO: 67228 - protein, 10 aa, Dengue virus
SPIINREGKI

SEQ ID NO: 67229 - protein, 10 aa, Dengue virus
PIINREGKIV

SEQ ID NO: 67230 - protein, 10 aa, Dengue virus
IINREGKIVG

SEQ ID NO: 67231 - protein, 10 aa, Dengue virus
INREGKIVGL

SEQ ID NO: 67232 - protein, 10 aa, Dengue virus
NREGKIVGLY

SEQ ID NO: 67233 - protein, 10 aa, Dengue virus
REGKIVGLYG

SEQ ID NO: 67234 - protein, 10 aa, Dengue virus
EGKIVGLYGN

SEQ ID NO: 67235 - protein, 10 aa, Dengue virus
GKIVGLYGNG

SEQ ID NO: 67236 - protein, 10 aa, Dengue virus
KIVGLYGNGV

SEQ ID NO: 67237 - protein, 10 aa, Dengue virus
IVGLYGNGVV

SEQ ID NO: 67238 - protein, 10 aa, Dengue virus
LYGNGVVTKS

SEQ ID NO: 67239 - protein, 10 aa, Dengue virus
YGNGVVTKSG

SEQ ID NO: 67240 - protein, 10 aa, Dengue virus
GNGVVTKSGG

SEQ ID NO: 67241 - protein, 10 aa, Dengue virus
NGVVTKSGGY

SEQ ID NO: 67242 - protein, 10 aa, Dengue virus
GVVTKSGGYV

SEQ ID NO: 67243 - protein, 10 aa, Dengue virus
VVTKSGGYVS

SEQ ID NO: 67244 - protein, 10 aa, Dengue virus
VTKSGGYVSG

SEQ ID NO: 67245 - protein, 10 aa, Dengue virus
QTNAEPDGPA

SEQ ID NO: 67246 - protein, 10 aa, Dengue virus
TNAEPDGPAP

SEQ ID NO: 67247 - protein, 10 aa, Dengue virus
NAEPDGPAPE

SEQ ID NO: 67248 - protein, 10 aa, Dengue virus
TPELEEEMFR

SEQ ID NO: 67249 - protein, 10 aa, Dengue virus
PELEEEMFRK

SEQ ID NO: 67250 - protein, 10 aa, Dengue virus
ELEEEMFRKR

SEQ ID NO: 67251 - protein, 10 aa, Dengue virus
LEEEMFRKRN

SEQ ID NO: 67252 - protein, 10 aa, Dengue virus
EEEMFRKRNL

SEQ ID NO: 67253 - protein, 10 aa, Dengue virus
EEMFRKRNLT

SEQ ID NO: 67254 - protein, 10 aa, Dengue virus
EMFRKRNLTI

SEQ ID NO: 67255 - protein, 10 aa, Dengue virus
MFRKRNLTIM

SEQ ID NO: 67256 - protein, 10 aa, Dengue virus
FRKRNLTIMD

SEQ ID NO: 67257 - protein, 10 aa, Dengue virus
RKRNLTIMDL

SEQ ID NO: 67258 - protein, 10 aa, Dengue virus
KTRKYLPAII

SEQ ID NO: 67259 - protein, 10 aa, Dengue virus
TRKYLPAIIR

SEQ ID NO: 67260 - protein, 10 aa, Dengue virus
RKYLPAIIRE

SEQ ID NO: 67261 - protein, 10 aa, Dengue virus
KYLPAIIREA

SEQ ID NO: 67262 - protein, 10 aa, Dengue virus
YLPAIIREAI

SEQ ID NO: 67263 - protein, 10 aa, Dengue virus
LPAIIREAIK

SEQ ID NO: 67264 - protein, 10 aa, Dengue virus
PAIIREAIKR

SEQ ID NO: 67265 - protein, 10 aa, Dengue virus
AIIREAIKRR

SEQ ID NO: 67266 - protein, 10 aa, Dengue virus
IIREAIKRRL

SEQ ID NO: 67267 - protein, 10 aa, Dengue virus
IREAIKRRLR

SEQ ID NO: 67268 - protein, 10 aa, Dengue virus
LPIRYQTTAI

SEQ ID NO: 67269 - protein, 10 aa, Dengue virus
PIRYQTTAIK

SEQ ID NO: 67270 - protein, 10 aa, Dengue virus
IRYQTTAIKS

SEQ ID NO: 67271 - protein, 10 aa, Dengue virus
RYQTTAIKSE

SEQ ID NO: 67272 - protein, 10 aa, Dengue virus
YQTTAIKSEH

SEQ ID NO: 67273 - protein, 10 aa, Dengue virus
QTTAIKSEHT

SEQ ID NO: 67274 - protein, 10 aa, Dengue virus
TTAIKSEHTG

SEQ ID NO: 67275 - protein, 10 aa, Dengue virus
TATKSEHTGK

SEQ ID NO: 67276 - protein, 10 aa, Dengue virus
ATKSEHTGKE

SEQ ID NO: 67277 - protein, 10 aa, Dengue virus
TKSEHTGKEI

SEQ ID NO: 67278 - protein, 10 aa, Dengue virus
KSEHTGKEIV

SEQ ID NO: 67279 - protein, 10 aa, Dengue virus
SEHTGKEIVD

SEQ ID NO: 67280 - protein, 10 aa, Dengue virus
EHTGKEIVDL

SEQ ID NO: 67281 - protein, 10 aa, Dengue virus
HTGKEIVDLM

SEQ ID NO: 67282 - protein, 10 aa, Dengue virus
TGKEIVDLMC

SEQ ID NO: 67283 - protein, 10 aa, Dengue virus
GKEIVDLMCH

SEQ ID NO: 67284 - protein, 10 aa, Dengue virus
KEIVDLMCHA

SEQ ID NO: 67285 - protein, 10 aa, Dengue virus
PVRVPNYNLV

SEQ ID NO: 67286 - protein, 10 aa, Dengue virus
VRVPNYNLVI

SEQ ID NO: 67287 - protein, 10 aa, Dengue virus
RVPNYNLVIM

SEQ ID NO: 67288 - protein, 10 aa, Dengue virus
VPNYNLVIMD

SEQ ID NO: 67289 - protein, 10 aa, Dengue virus
PNYNLVIMDE

SEQ ID NO: 67290 - protein, 10 aa, Dengue virus
NYNLVIMDEA

SEQ ID NO: 67291 - protein, 10 aa, Dengue virus
YNLVIMDEAH

SEQ ID NO: 67292 - protein, 10 aa, Dengue virus
NLVIMDEAHF

SEQ ID NO: 67293 - protein, 10 aa, Dengue virus
LVIMDEAHFT

SEQ ID NO: 67294 - protein, 10 aa, Dengue virus
VIMDEAHFTD

SEQ ID NO: 67295 - protein, 10 aa, Dengue virus
VMDEAHFTDP

SEQ ID NO: 67296 - protein, 10 aa, Dengue virus
ISTRVGMGET

SEQ ID NO: 67297 - protein, 10 aa, Dengue virus
STRVGMGETA

SEQ ID NO: 67298 - protein, 10 aa, Dengue virus
TRVGMGETAA

SEQ ID NO: 67299 - protein, 10 aa, Dengue virus
RVGMGETAAI

SEQ ID NO: 67300 - protein, 10 aa, Dengue virus
VGMGETAAIF

SEQ ID NO: 67301 - protein, 10 aa, Dengue virus
GMGETAAIFM

SEQ ID NO: 67302 - protein, 10 aa, Dengue virus
MGETAAIFMT

SEQ ID NO: 67303 - protein, 10 aa, Dengue virus
GETAAIFMTA

SEQ ID NO: 67304 - protein, 10 aa, Dengue virus
ETAAIFMTAT

SEQ ID NO: 67305 - protein, 10 aa, Dengue virus
TAAIFMTATP

SEQ ID NO: 67306 - protein, 10 aa, Dengue virus
MTATPPGTAE

SEQ ID NO: 67307 - protein, 10 aa, Dengue virus
TATPPGTAEA

SEQ ID NO: 67308 - protein, 10 aa, Dengue virus
ATPPGTAEAF

SEQ ID NO: 67309 - protein, 10 aa, Dengue virus
TPPGTAEAFP

SEQ ID NO: 67310 - protein, 10 aa, Dengue virus
PPGTAEAFPQ

SEQ ID NO: 67311 - protein, 10 aa, Dengue virus
PGTAEAFPQS

SEQ ID NO: 67312 - protein, 10 aa, Dengue virus
GTAEAFPQSN

SEQ ID NO: 67313 - protein, 10 aa, Dengue virus
TAEAFPQSNA

SEQ ID NO: 67314 - protein, 10 aa, Dengue virus
AEAFPQSNAP

SEQ ID NO: 67315 - protein, 10 aa, Dengue virus
EAFPQSNAPI

SEQ ID NO: 67316 - protein, 10 aa, Dengue virus
SNAPIQDEEK

SEQ ID NO: 67317 - protein, 10 aa, Dengue virus
NAPIQDEEKD

SEQ ID NO: 67318 - protein, 10 aa, Dengue virus
APIQDEEKDI

SEQ ID NO: 67319 - protein, 10 aa, Dengue virus
PIQDEEKDIP

SEQ ID NO: 67320 - protein, 10 aa, Dengue virus
IQDEEKDIPE

SEQ ID NO: 67321 - protein, 10 aa, Dengue virus
QDEEKDIPER

SEQ ID NO: 67322 - protein, 10 aa, Dengue virus
DEEKDIPERS

SEQ ID NO: 67323 - protein, 10 aa, Dengue virus
EEKDIPERSW

SEQ ID NO: 67324 - protein, 10 aa, Dengue virus
EKDIPERSWN

SEQ ID NO: 67325 - protein, 10 aa, Dengue virus
KDIPERSWNS

SEQ ID NO: 67326 - protein, 10 aa, Dengue virus
PERSWNSGND

SEQ ID NO: 67327 - protein, 10 aa, Dengue virus
ERSWNSGNDW

SEQ ID NO: 67328 - protein, 10 aa, Dengue virus
RSWNSGNDWI

SEQ ID NO: 67329 - protein, 10 aa, Dengue virus
SWNSGNDWIT

SEQ ID NO: 67330 - protein, 10 aa, Dengue virus
WNSGNDWITD

SEQ ID NO: 67331 - protein, 10 aa, Dengue virus
NSGNDWITDF

SEQ ID NO: 67332 - protein, 10 aa, Dengue virus
SGNEWITDFV

SEQ ID NO: 67333 - protein, 10 aa, Dengue virus
GNEWITDFVG

SEQ ID NO: 67334 - protein, 10 aa, Dengue virus
NEWITDFVGK

SEQ ID NO: 67335 - protein, 10 aa, Dengue virus
EWITDFVGKT

SEQ ID NO: 67336 - protein, 10 aa, Dengue virus
WITDFVGKTV

SEQ ID NO: 67337 - protein, 10 aa, Dengue virus
ITDFVGKTVW

SEQ ID NO: 67338 - protein, 10 aa, Dengue virus
TDFVGKTVWF

SEQ ID NO: 67339 - protein, 10 aa, Dengue virus
DFVGKTVWFV

SEQ ID NO: 67340 - protein, 10 aa, Dengue virus
FVGKTVWFVP

SEQ ID NO: 67341 - protein, 10 aa, Dengue virus
VGKTVWFVPS

SEQ ID NO: 67342 - protein, 10 aa, Dengue virus
TFDTEYQKTR

SEQ ID NO: 67343 - protein, 10 aa, Dengue virus
FDTEYQKTRL

SEQ ID NO: 67344 - protein, 10 aa, Dengue virus
DTEYQKTRLN

SEQ ID NO: 67345 - protein, 10 aa, Dengue virus
TEYQKTRLND

SEQ ID NO: 67346 - protein, 10 aa, Dengue virus
EYQKTRLNDW

SEQ ID NO: 67347 - protein, 10 aa, Dengue virus
YQKTRLNDWD

SEQ ID NO: 67348 - protein, 10 aa, Dengue virus
QKTRLNDWDF

SEQ ID NO: 67349 - protein, 10 aa, Dengue virus
KTRLNDWDFV

SEQ ID NO: 67350 - protein, 10 aa, Dengue virus
TRLNDWDFVV

SEQ ID NO: 67351 - protein, 10 aa, Dengue virus
RLNDWDFVVT

SEQ ID NO: 67352 - protein, 10 aa, Dengue virus
ISEMGANFRA

SEQ ID NO: 67353 - protein, 10 aa, Dengue virus
SEMGANFRAD

SEQ ID NO: 67354 - protein, 10 aa, Dengue virus
EMGANFRADR

SEQ ID NO: 67355 - protein, 10 aa, Dengue virus
MGANFRADRV

SEQ ID NO: 67356 - protein, 10 aa, Dengue virus
GANFRADRVI

SEQ ID NO: 67357 - protein, 10 aa, Dengue virus
ANFRADRVID

SEQ ID NO: 67358 - protein, 10 aa, Dengue virus
NFRADRVIDP

SEQ ID NO: 67359 - protein, 10 aa, Dengue virus
FRADRVIDPR

SEQ ID NO: 67360 - protein, 10 aa, Dengue virus
RADRVIDPRR

SEQ ID NO: 67361 - protein, 10 aa, Dengue virus
ILAGPMPVTV

SEQ ID NO: 67362 - protein, 10 aa, Dengue virus
LAGPMPVTVA

SEQ ID NO: 67363 - protein, 10 aa, Dengue virus
AGPMPVTVAS

SEQ ID NO: 67364 - protein, 10 aa, Dengue virus
GPMPVTVASA

SEQ ID NO: 67365 - protein, 10 aa, Dengue virus
PMPVTVASAA

SEQ ID NO: 67366 - protein, 10 aa, Dengue virus
MPVTVASAAQ

SEQ ID NO: 67367 - protein, 10 aa, Dengue virus
PVTVASAAQR

SEQ ID NO: 67368 - protein, 10 aa, Dengue virus
VTVASAAQRR

SEQ ID NO: 67369 - protein, 10 aa, Dengue virus
TVASAAQRRG

SEQ ID NO: 67370 - protein, 10 aa, Dengue virus
VASAAQRRGR

SEQ ID NO: 67371 - protein, 10 aa, Dengue virus
RRGRVGRNPP

SEQ ID NO: 67372 - protein, 10 aa, Dengue virus
RGRVGRNPPK

SEQ ID NO: 67373 - protein, 10 aa, Dengue virus
GRVGRNPPKE

SEQ ID NO: 67374 - protein, 10 aa, Dengue virus
RVGRNPPKEN

SEQ ID NO: 67375 - protein, 10 aa, Dengue virus
VGRNPPKEND

SEQ ID NO: 67376 - protein, 10 aa, Dengue virus
GRNPPKENDQ

SEQ ID NO: 67377 - protein, 10 aa, Dengue virus
RNPPKENDQY

SEQ ID NO: 67378 - protein, 10 aa, Dengue virus
NPPKENDQYI

SEQ ID NO: 67379 - protein, 10 aa, Dengue virus
PPKENDQYIF

SEQ ID NO: 67380 - protein, 10 aa, Dengue virus
QKENDQYIFM

SEQ ID NO: 67381 - protein, 10 aa, Dengue virus
KENDQYIFMG

SEQ ID NO: 67382 - protein, 10 aa, Dengue virus
ENDQYIFMGQ

SEQ ID NO: 67383 - protein, 10 aa, Dengue virus
NDQYIFMGQP

SEQ ID NO: 67384 - protein, 10 aa, Dengue virus
DQYIFMGQPL

SEQ ID NO: 67385 - protein, 10 aa, Dengue virus
QYIFMGQPLN

SEQ ID NO: 67386 - protein, 10 aa, Dengue virus
YIFMGQPLNN

SEQ ID NO: 67387 - protein, 10 aa, Dengue virus
IFMGQPLNND

SEQ ID NO: 67388 - protein, 10 aa, Dengue virus
FMGQPLNNDE

SEQ ID NO: 67389 - protein, 10 aa, Dengue virus
MGQPLNNDED

SEQ ID NO: 67390 - protein, 10 aa, Dengue virus
RGDLPVWLAY

SEQ ID NO: 67391 - protein, 10 aa, Dengue virus
GDLPVWLAYK

SEQ ID NO: 67392 - protein, 10 aa, Dengue virus
DLPVWLAYKV

SEQ ID NO: 67393 - protein, 10 aa, Dengue virus
LPVWLAYKVA

SEQ ID NO: 67394 - protein, 10 aa, Dengue virus
PVWLAYKVAS

SEQ ID NO: 67395 - protein, 10 aa, Dengue virus
VWLAYKVASE

SEQ ID NO: 67396 - protein, 10 aa, Dengue virus
WLAYKVASEG

SEQ ID NO: 67397 - protein, 10 aa, Dengue virus
LAYKVASEGI

SEQ ID NO: 67398 - protein, 10 aa, Dengue virus
AYKVASEGIK

SEQ ID NO: 67399 - protein, 10 aa, Dengue virus
YKVASEGIKY

SEQ ID NO: 67400 - protein, 10 aa, Dengue virus
TDRKWCFDGE

SEQ ID NO: 67401 - protein, 10 aa, Dengue virus
DRKWCFDGER

SEQ ID NO: 67402 - protein, 10 aa, Dengue virus
RKWCFDGERN

SEQ ID NO: 67403 - protein, 10 aa, Dengue virus
KWCFDGERNN

SEQ ID NO: 67404 - protein, 10 aa, Dengue virus
WCFDGERNNQ

SEQ ID NO: 67405 - protein, 10 aa, Dengue virus
CFDGERNNQI

SEQ ID NO: 67406 - protein, 10 aa, Dengue virus
FDGERNNQIL

SEQ ID NO: 67407 - protein, 10 aa, Dengue virus
DGERNNQILE

SEQ ID NO: 67408 - protein, 10 aa, Dengue virus
GERNNQILEE

SEQ ID NO: 67409 - protein, 10 aa, Dengue virus
ERNNQILEEN

SEQ ID NO: 67410 - protein, 10 aa, Dengue virus
VEIWTKEGER

SEQ ID NO: 67411 - protein, 10 aa, Dengue virus
EIWTKEGERK

SEQ ID NO: 67412 - protein, 10 aa, Dengue virus
IWTKEGERKK

SEQ ID NO: 67413 - protein, 10 aa, Dengue virus
WTKEGERKKL

SEQ ID NO: 67414 - protein, 10 aa, Dengue virus
TKEGERKKLR

SEQ ID NO: 67415 - protein, 10 aa, Dengue virus
KEGERKKLRP

SEQ ID NO: 67416 - protein, 10 aa, Dengue virus
EGERKKLRPR

SEQ ID NO: 67417 - protein, 10 aa, Dengue virus
GERKKLRPRW

SEQ ID NO: 67418 - protein, 10 aa, Dengue virus
ERKKLRPRWL

SEQ ID NO: 67419 - protein, 10 aa, Dengue virus
RKKLRPRWLD

SEQ ID NO: 67420 - protein, 10 aa, Dengue virus
DPLALKEFKE

SEQ ID NO: 67421 - protein, 10 aa, Dengue virus
PLALKEFKEF

SEQ ID NO: 67422 - protein, 10 aa, Dengue virus
LALKEFKEFA

SEQ ID NO: 67423 - protein, 10 aa, Dengue virus
ALKEFKEFAA

SEQ ID NO: 67424 - protein, 10 aa, Dengue virus
LKEFKEFAAG

SEQ ID NO: 67425 - protein, 10 aa, Dengue virus
KEFKEFAAGR

SEQ ID NO: 67426 - protein, 10 aa, Dengue virus
EFKEFAAGRK

SEQ ID NO: 67427 - protein, 10 aa, Dengue virus
FKEFAAGRKS

SEQ ID NO: 67428 - protein, 10 aa, Dengue virus
KEFAAGRKSI

SEQ ID NO: 67429 - protein, 10 aa, Dengue virus
EFAAGRKSIA

SEQ ID NO: 67430 - protein, 10 aa, Dengue virus
FAAGRKSIAF

SEQ ID NO: 67431 - protein, 10 aa, Dengue virus
AAGRKSIAFD

SEQ ID NO: 67432 - protein, 10 aa, Dengue virus
AGRKSIAFDL

SEQ ID NO: 67433 - protein, 10 aa, Dengue virus
GRKSIAFDLV

SEQ ID NO: 67434 - protein, 10 aa, Dengue virus
RKSIAFDLVT

SEQ ID NO: 67435 - protein, 10 aa, Dengue virus
KSIAFDLVTE

SEQ ID NO: 67436 - protein, 10 aa, Dengue virus
SIAFDLVTEI

SEQ ID NO: 67437 - protein, 10 aa, Dengue virus
IAFDLVTEIG

SEQ ID NO: 67438 - protein, 10 aa, Dengue virus
AFDLVTEIGR

SEQ ID NO: 67439 - protein, 10 aa, Dengue virus
FDLVTEIGRV

SEQ ID NO: 67440 - protein, 10 aa, Dengue virus
LVTEIGRVPT

SEQ ID NO: 67441 - protein, 10 aa, Dengue virus
VTEIGRVPTH

SEQ ID NO: 67442 - protein, 10 aa, Dengue virus
TEIGRVPTHL

SEQ ID NO: 67443 - protein, 10 aa, Dengue virus
EIGRVPTHLA

SEQ ID NO: 67444 - protein, 10 aa, Dengue virus
IGRVPTHLAH

SEQ ID NO: 67445 - protein, 10 aa, Dengue virus
GRVPTHLAHR

SEQ ID NO: 67446 - protein, 10 aa, Dengue virus
RVPTHLAHRT

SEQ ID NO: 67447 - protein, 10 aa, Dengue virus
VPTHLAHRTR

SEQ ID NO: 67448 - protein, 10 aa, Dengue virus
PTHLAHRTRN

SEQ ID NO: 67449 - protein, 10 aa, Dengue virus
THLAHRTRNA

SEQ ID NO: 67450 - protein, 10 aa, Dengue virus
HLAYRTRNAL

SEQ ID NO: 67451 - protein, 10 aa, Dengue virus
LAYRTRNALD

SEQ ID NO: 67452 - protein, 10 aa, Dengue virus
AYRTRNALDN

SEQ ID NO: 67453 - protein, 10 aa, Dengue virus
YRTRNALDNL

SEQ ID NO: 67454 - protein, 10 aa, Dengue virus
MLHTSEHGGK

SEQ ID NO: 67455 - protein, 10 aa, Dengue virus
LHTSEHGGKA

SEQ ID NO: 67456 - protein, 10 aa, Dengue virus
HTSEHGGKAY

SEQ ID NO: 67457 - protein, 10 aa, Dengue virus
TSEHGGKAYR

SEQ ID NO: 67458 - protein, 10 aa, Dengue virus
SEHGGKAYRH

SEQ ID NO: 67459 - protein, 10 aa, Dengue virus
EHGGKAYRHA

SEQ ID NO: 67460 - protein, 10 aa, Dengue virus
HGGKAYRHAV

SEQ ID NO: 67461 - protein, 10 aa, Dengue virus
GGKAYRHAVE

SEQ ID NO: 67462 - protein, 10 aa, Dengue virus
GKAYRHAVEE

SEQ ID NO: 67463 - protein, 10 aa, Dengue virus
KAYRHAVEEL

SEQ ID NO: 67464 - protein, 10 aa, Dengue virus
GLMILLTGGV

SEQ ID NO: 67465 - protein, 10 aa, Dengue virus
LMILLTGGVM

SEQ ID NO: 67466 - protein, 10 aa, Dengue virus
MILLTGGVML

SEQ ID NO: 67467 - protein, 10 aa, Dengue virus
ILLTGGVMLF

SEQ ID NO: 67468 - protein, 10 aa, Dengue virus
LLTGGVMLFL

SEQ ID NO: 67469 - protein, 10 aa, Dengue virus
LTGGVMLFLI

SEQ ID NO: 67470 - protein, 10 aa, Dengue virus
TGGVMLFLIS

SEQ ID NO: 67471 - protein, 10 aa, Dengue virus
GGVMLFLISG

SEQ ID NO: 67472 - protein, 10 aa, Dengue virus
GVMLFLISGK

SEQ ID NO: 67473 - protein, 10 aa, Dengue virus
VMLFLISGKG

SEQ ID NO: 67474 - protein, 10 aa, Dengue virus
MLFLISGKGV

SEQ ID NO: 67475 - protein, 10 aa, Dengue virus
LFLISGKGVG

SEQ ID NO: 67476 - protein, 10 aa, Dengue virus
FLISGKGVGK

SEQ ID NO: 67477 - protein, 10 aa, Dengue virus
LISGKGVGKT

SEQ ID NO: 67478 - protein, 10 aa, Dengue virus
ISGKGVGKTS

SEQ ID NO: 67479 - protein, 10 aa, Dengue virus
SGKGVGKTSI

SEQ ID NO: 67480 - protein, 10 aa, Dengue virus
GKGVGKTSIG

SEQ ID NO: 67481 - protein, 10 aa, Dengue virus
KGVGKTSIGL

SEQ ID NO: 67482 - protein, 10 aa, Dengue virus
GVGKTSIGLI

SEQ ID NO: 67483 - protein, 10 aa, Dengue virus
VGKTSIGLIC

SEQ ID NO: 67484 - protein, 10 aa, Dengue virus
GKTTIGLICV

SEQ ID NO: 67485 - protein, 10 aa, Dengue virus
KTSIGLICVV

SEQ ID NO: 67486 - protein, 10 aa, Dengue virus
TSIGLICVIV

SEQ ID NO: 67487 - protein, 10 aa, Dengue virus
SIGLICVIVS

SEQ ID NO: 67488 - protein, 10 aa, Dengue virus
IGLICVIVSS

SEQ ID NO: 67489 - protein, 10 aa, Dengue virus
GLICVIVSSG

SEQ ID NO: 67490 - protein, 10 aa, Dengue virus
LICVIVSSGM

SEQ ID NO: 67491 - protein, 10 aa, Dengue virus
ICVIVSSGML

SEQ ID NO: 67492 - protein, 10 aa, Dengue virus
CVIVSSGMLW

SEQ ID NO: 67493 - protein, 10 aa, Dengue virus
VIVSSGMLWM

SEQ ID NO: 67494 - protein, 10 aa, Dengue virus
IVSSGMLWMA

SEQ ID NO: 67495 - protein, 10 aa, Dengue virus
VSSGMLWMAD

SEQ ID NO: 67496 - protein, 10 aa, Dengue virus
SSGMLWMADV

SEQ ID NO: 67497 - protein, 10 aa, Dengue virus
SGMLWMADVP

SEQ ID NO: 67498 - protein, 10 aa, Dengue virus
GMLWMADVPL

SEQ ID NO: 67499 - protein, 10 aa, Dengue virus
MLWMADVPLQ

SEQ ID NO: 67500 - protein, 10 aa, Dengue virus
LWMADVPLQW

SEQ ID NO: 67501 - protein, 10 aa, Dengue virus
WMADVPLQWI

SEQ ID NO: 67502 - protein, 10 aa, Dengue virus
MADVPLQWIA

SEQ ID NO: 67503 - protein, 10 aa, Dengue virus
ADVPLQWIAS

SEQ ID NO: 67504 - protein, 10 aa, Dengue virus
DVPLQWIASA

SEQ ID NO: 67505 - protein, 10 aa, Dengue virus
VPLQWIASAI

SEQ ID NO: 67506 - protein, 10 aa, Dengue virus
PLQWIASAII

SEQ ID NO: 67507 - protein, 10 aa, Dengue virus
LQWIASAIIL

SEQ ID NO: 67508 - protein, 10 aa, Dengue virus
QWIASAIILE

SEQ ID NO: 67509 - protein, 10 aa, Dengue virus
WIASAIILEF

SEQ ID NO: 67510 - protein, 10 aa, Dengue virus
IASAIILEFF

SEQ ID NO: 67511 - protein, 10 aa, Dengue virus
ASAIILEFFM

SEQ ID NO: 67512 - protein, 10 aa, Dengue virus
SAIILEFFMM

SEQ ID NO: 67513 - protein, 10 aa, Dengue virus
AIILEFFMMV

SEQ ID NO: 67514 - protein, 10 aa, Dengue virus
IILEFFMMVL

SEQ ID NO: 67515 - protein, 10 aa, Dengue virus
ILEFFMMVLL

SEQ ID NO: 67516 - protein, 10 aa, Dengue virus
VIGILTLAAT

SEQ ID NO: 67517 - protein, 10 aa, Dengue virus
IGILTLAAIV

SEQ ID NO: 67518 - protein, 10 aa, Dengue virus
GILTLAAIVA

SEQ ID NO: 67519 - protein, 10 aa, Dengue virus
ILTLAAIVAA

SEQ ID NO: 67520 - protein, 10 aa, Dengue virus
LTLAAIVAAN

SEQ ID NO: 67521 - protein, 10 aa, Dengue virus
TLAAIVAANE

SEQ ID NO: 67522 - protein, 10 aa, Dengue virus
LAAIVAANEM

SEQ ID NO: 67523 - protein, 10 aa, Dengue virus
AAIVAANEMG

SEQ ID NO: 67524 - protein, 10 aa, Dengue virus
AIVAANEMGL

SEQ ID NO: 67525 - protein, 10 aa, Dengue virus
IVAANEMGLL

SEQ ID NO: 67526 - protein, 10 aa, Dengue virus
VAANEMGLLE

SEQ ID NO: 67527 - protein, 10 aa, Dengue virus
TANEMGLLET

SEQ ID NO: 67528 - protein, 10 aa, Dengue virus
EMGMLETTKR

SEQ ID NO: 67529 - protein, 10 aa, Dengue virus
MGMLETTKRD

SEQ ID NO: 67530 - protein, 10 aa, Dengue virus
GMLETTKRDL

SEQ ID NO: 67531 - protein, 10 aa, Dengue virus
MLETTKRDLG

SEQ ID NO: 67532 - protein, 10 aa, Dengue virus
TTKRDLGMSR

SEQ ID NO: 67533 - protein, 10 aa, Dengue virus
TKRDLGMSRE

SEQ ID NO: 67534 - protein, 10 aa, Dengue virus
KRDLGMSREP

SEQ ID NO: 67535 - protein, 10 aa, Dengue virus
RDLGMSREPG

SEQ ID NO: 67536 - protein, 10 aa, Dengue virus
DLGMSREPGV

SEQ ID NO: 67537 - protein, 10 aa, Dengue virus
LGMSKEPGVA

SEQ ID NO: 67538 - protein, 10 aa, Dengue virus
GMSKEPGVAS

SEQ ID NO: 67539 - protein, 10 aa, Dengue virus
MSKEPGVASP

SEQ ID NO: 67540 - protein, 10 aa, Dengue virus
EPGVASPTSY

SEQ ID NO: 67541 - protein, 10 aa, Dengue virus
PGVASPTSYL

SEQ ID NO: 67542 - protein, 10 aa, Dengue virus
GVASPTSYLD

SEQ ID NO: 67543 - protein, 10 aa, Dengue virus
VASPTSYLDV

SEQ ID NO: 67544 - protein, 10 aa, Dengue virus
ASPTSYLDVD

SEQ ID NO: 67545 - protein, 10 aa, Dengue virus
SSTSYLDVDL

SEQ ID NO: 67546 - protein, 10 aa, Dengue virus
STSYLDVDLH

SEQ ID NO: 67547 - protein, 10 aa, Dengue virus
NSYLDVDLHP

SEQ ID NO: 67548 - protein, 10 aa, Dengue virus
YSQVNPLTLI

SEQ ID NO: 67549 - protein, 10 aa, Dengue virus
SQVNPLTLIA

SEQ ID NO: 67550 - protein, 10 aa, Dengue virus
QVNPLTLTAV

SEQ ID NO: 67551 - protein, 10 aa, Dengue virus
VNPLTLTAVV

SEQ ID NO: 67552 - protein, 10 aa, Dengue virus
NPLTLTAVVL

SEQ ID NO: 67553 - protein, 10 aa, Dengue virus
PLTLTAVVLL

SEQ ID NO: 67554 - protein, 10 aa, Dengue virus
LTLTAVVLLL

SEQ ID NO: 67555 - protein, 10 aa, Dengue virus
TLTAAVLLLV

SEQ ID NO: 67556 - protein, 10 aa, Dengue virus
LTAAVLLLVT

SEQ ID NO: 67557 - protein, 10 aa, Dengue virus
TAAVLLLVTH

SEQ ID NO: 67558 - protein, 10 aa, Dengue virus
AAVLLLVTHY

SEQ ID NO: 67559 - protein, 10 aa, Dengue virus
AVLLLVTHYA

SEQ ID NO: 67560 - protein, 10 aa, Dengue virus
VLLLVTHYAI

SEQ ID NO: 67561 - protein, 10 aa, Dengue virus
LLLVTHYAII

SEQ ID NO: 67562 - protein, 10 aa, Dengue virus
LLVTHYAIIG

SEQ ID NO: 67563 - protein, 10 aa, Dengue virus
LVTHYAIIGP

SEQ ID NO: 67564 - protein, 10 aa, Dengue virus
VTHYAIIGPG

SEQ ID NO: 67565 - protein, 10 aa, Dengue virus
GQVMLLILCA

SEQ ID NO: 67566 - protein, 10 aa, Dengue virus
QVMLLVLCAA

SEQ ID NO: 67567 - protein, 10 aa, Dengue virus
VMLLVLCAAQ

SEQ ID NO: 67568 - protein, 10 aa, Dengue virus
MLLVLCAAQL

SEQ ID NO: 67569 - protein, 10 aa, Dengue virus
LLVLCAAQLL

SEQ ID NO: 67570 - protein, 10 aa, Dengue virus
LVLCAAQLLL

SEQ ID NO: 67571 - protein, 10 aa, Dengue virus
VLCAAQLLLM

SEQ ID NO: 67572 - protein, 10 aa, Dengue virus
LCAAQLLLMR

SEQ ID NO: 67573 - protein, 10 aa, Dengue virus
CAAQLLLMRT

SEQ ID NO: 67574 - protein, 10 aa, Dengue virus
AAQLLLMRTS

SEQ ID NO: 67575 - protein, 10 aa, Dengue virus
LLLMRTSWAF

SEQ ID NO: 67576 - protein, 10 aa, Dengue virus
LLMRTSWAFC

SEQ ID NO: 67577 - protein, 10 aa, Dengue virus
LMRTSWAFCE

SEQ ID NO: 67578 - protein, 10 aa, Dengue virus
MRTSWAFCEA

SEQ ID NO: 67579 - protein, 10 aa, Dengue virus
RTSWAFCEAL

SEQ ID NO: 67580 - protein, 10 aa, Dengue virus
TSWAFCEALT

SEQ ID NO: 67581 - protein, 10 aa, Dengue virus
SWAFCEALTL

SEQ ID NO: 67582 - protein, 10 aa, Dengue virus
WAFCEALTLA

SEQ ID NO: 67583 - protein, 10 aa, Dengue virus
AFCEALTLAT

SEQ ID NO: 67584 - protein, 10 aa, Dengue virus
FCEALTLATG

SEQ ID NO: 67585 - protein, 10 aa, Dengue virus
CEVLTLATGP

SEQ ID NO: 67586 - protein, 10 aa, Dengue virus
EVLTLATGPI

SEQ ID NO: 67587 - protein, 10 aa, Dengue virus
VLTLATGPIT

SEQ ID NO: 67588 - protein, 10 aa, Dengue virus
IFRGSYIAGA

SEQ ID NO: 67589 - protein, 10 aa, Dengue virus
FRGSYIAGAG

SEQ ID NO: 67590 - protein, 10 aa, Dengue virus
RGNYLAGAGL

SEQ ID NO: 67591 - protein, 10 aa, Dengue virus
GSYIAGAGLA

SEQ ID NO: 67592 - protein, 10 aa, Dengue virus
NYLAGAGLAF

SEQ ID NO: 67593 - protein, 10 aa, Dengue virus
LAGAGLAFSV

SEQ ID NO: 67594 - protein, 10 aa, Dengue virus
AGAGLAFSVM

SEQ ID NO: 67595 - protein, 10 aa, Dengue virus
GAGLAFSVMK

SEQ ID NO: 67596 - protein, 10 aa, Dengue virus
AGLAFSVMKS

SEQ ID NO: 67597 - protein, 10 aa, Dengue virus
GLAFSVMKSV

SEQ ID NO: 67598 - protein, 10 aa, Dengue virus
LAFSVMKSVG

SEQ ID NO: 67599 - protein, 10 aa, Dengue virus
AFSVMKSVGT

SEQ ID NO: 67600 - protein, 10 aa, Dengue virus
FSVMKSVGTG

SEQ ID NO: 67601 - protein, 10 aa, Dengue virus
SIMKSVGTGR

SEQ ID NO: 67602 - protein, 10 aa, Dengue virus
IMKSVGTGRR

SEQ ID NO: 67603 - protein, 10 aa, Dengue virus
MKSVGTGRRG

SEQ ID NO: 67604 - protein, 10 aa, Dengue virus
KSVGTGRRGT

SEQ ID NO: 67605 - protein, 10 aa, Dengue virus
SVGTGRRGTG

SEQ ID NO: 67606 - protein, 10 aa, Dengue virus
VGTGRRGTGS

SEQ ID NO: 67607 - protein, 10 aa, Dengue virus
GTGRRGTGSQ

SEQ ID NO: 67608 - protein, 10 aa, Dengue virus
TGRRGTGSQG

SEQ ID NO: 67609 - protein, 10 aa, Dengue virus
GRRGTGSQGE

SEQ ID NO: 67610 - protein, 10 aa, Dengue virus
RRGTGSQGET

SEQ ID NO: 67611 - protein, 10 aa, Dengue virus
GETLGEKWKR

SEQ ID NO: 67612 - protein, 10 aa, Dengue virus
ETLGEKWKKR

SEQ ID NO: 67613 - protein, 10 aa, Dengue virus
TLGEKWKKRL

SEQ ID NO: 67614 - protein, 10 aa, Dengue virus
LGEKWKKRLN

SEQ ID NO: 67615 - protein, 10 aa, Dengue virus
GEKWKKRLNQ

SEQ ID NO: 67616 - protein, 10 aa, Dengue virus
EKWKKRLNQL

SEQ ID NO: 67617 - protein, 10 aa, Dengue virus
KWKKRLNQLS

SEQ ID NO: 67618 - protein, 10 aa, Dengue virus
WKKRLNQLSR

SEQ ID NO: 67619 - protein, 10 aa, Dengue virus
KKRLNQLSRK

SEQ ID NO: 67620 - protein, 10 aa, Dengue virus
KLNQLSRKDF

SEQ ID NO: 67621 - protein, 10 aa, Dengue virus
LNQLSRKDFD

SEQ ID NO: 67622 - protein, 10 aa, Dengue virus
NQLSRKDFDL

SEQ ID NO: 67623 - protein, 10 aa, Dengue virus
QLSRKDFDLY

SEQ ID NO: 67624 - protein, 10 aa, Dengue virus
LSRKDFDLYK

SEQ ID NO: 67625 - protein, 10 aa, Dengue virus
SRKDFDLYKK

SEQ ID NO: 67626 - protein, 10 aa, Dengue virus
RKDFDLYKKS

SEQ ID NO: 67627 - protein, 10 aa, Dengue virus
KDFDLYKKSG

SEQ ID NO: 67628 - protein, 10 aa, Dengue virus
DFDLYKKSGI

SEQ ID NO: 67629 - protein, 10 aa, Dengue virus
KSGITEVDRI

SEQ ID NO: 67630 - protein, 10 aa, Dengue virus
SGITEVDRIE

SEQ ID NO: 67631 - protein, 10 aa, Dengue virus
GITEVDRIEA

SEQ ID NO: 67632 - protein, 10 aa, Dengue virus
ITEVDRIEAK

SEQ ID NO: 67633 - protein, 10 aa, Dengue virus
TEVDRIEAKE

SEQ ID NO: 67634 - protein, 10 aa, Dengue virus
EVDRIEAKEG

SEQ ID NO: 67635 - protein, 10 aa, Dengue virus
VDRIEAKEGL

SEQ ID NO: 67636 - protein, 10 aa, Dengue virus
DRIEAKEGLK

SEQ ID NO: 67637 - protein, 10 aa, Dengue virus
RIEAKEGLKR

SEQ ID NO: 67638 - protein, 10 aa, Dengue virus
IEAKEGLKRG

SEQ ID NO: 67639 - protein, 10 aa, Dengue virus
EAKEGLRRGE

SEQ ID NO: 67640 - protein, 10 aa, Dengue virus
AKEGLKRGET

SEQ ID NO: 67641 - protein, 10 aa, Dengue virus
KEGLKRGETT

SEQ ID NO: 67642 - protein, 10 aa, Dengue virus
RGETTHHAVS

SEQ ID NO: 67643 - protein, 10 aa, Dengue virus
GETTHHAVSR

SEQ ID NO: 67644 - protein, 10 aa, Dengue virus
ETTHHAVSRG

SEQ ID NO: 67645 - protein, 10 aa, Dengue virus
TTHHAVSRGS

SEQ ID NO: 67646 - protein, 10 aa, Dengue virus
THHAVSRGTA

SEQ ID NO: 67647 - protein, 10 aa, Dengue virus
HHAVSRGTAK

SEQ ID NO: 67648 - protein, 10 aa, Dengue virus
HAVSRGTAKL

SEQ ID NO: 67649 - protein, 10 aa, Dengue virus
AVSRGTAKLQ

SEQ ID NO: 67650 - protein, 10 aa, Dengue virus
VSRGTAKLQW

SEQ ID NO: 67651 - protein, 10 aa, Dengue virus
SRGTAKLQWF

SEQ ID NO: 67652 - protein, 10 aa, Dengue virus
RGTAKLQWFV

SEQ ID NO: 67653 - protein, 10 aa, Dengue virus
GTAKLQWFVE

SEQ ID NO: 67654 - protein, 10 aa, Dengue virus
TAKLQWFVER

SEQ ID NO: 67655 - protein, 10 aa, Dengue virus
QWFVERNMVV

SEQ ID NO: 67656 - protein, 10 aa, Dengue virus
WFVERNMVVP

SEQ ID NO: 67657 - protein, 10 aa, Dengue virus
FVERNMVVPE

SEQ ID NO: 67658 - protein, 10 aa, Dengue virus
VERNMVVPEG

SEQ ID NO: 67659 - protein, 10 aa, Dengue virus
ERNMVVPEGR

SEQ ID NO: 67660 - protein, 10 aa, Dengue virus
RNMVVPEGRV

SEQ ID NO: 67661 - protein, 10 aa, Dengue virus
NMVVPEGRVI

SEQ ID NO: 67662 - protein, 10 aa, Dengue virus
MVVPEGRVID

SEQ ID NO: 67663 - protein, 10 aa, Dengue virus
VVPEGRVIDL

SEQ ID NO: 67664 - protein, 10 aa, Dengue virus
VPEGRVIDLG

SEQ ID NO: 67665 - protein, 10 aa, Dengue virus
VPMSTYGWNL

SEQ ID NO: 67666 - protein, 10 aa, Dengue virus
PMSTYGWNLV

SEQ ID NO: 67667 - protein, 10 aa, Dengue virus
MSTYGWNLVK

SEQ ID NO: 67668 - protein, 10 aa, Dengue virus
STYGWNLVKL

SEQ ID NO: 67669 - protein, 10 aa, Dengue virus
TYGWNLVKLM

SEQ ID NO: 67670 - protein, 10 aa, Dengue virus
YGWNLVKLMS

SEQ ID NO: 67671 - protein, 10 aa, Dengue virus
GWNLVKLMSG

SEQ ID NO: 67672 - protein, 10 aa, Dengue virus
WNLVKLMSGK

SEQ ID NO: 67673 - protein, 10 aa, Dengue virus
NLVKLMSGKD

SEQ ID NO: 67674 - protein, 10 aa, Dengue virus
LVKLMSGKDV

SEQ ID NO: 67675 - protein, 10 aa, Dengue virus
IKLMSGKDVF

SEQ ID NO: 67676 - protein, 10 aa, Dengue virus
KLMTGKDVFY

SEQ ID NO: 67677 - protein, 10 aa, Dengue virus
LMTGKDVFYL

SEQ ID NO: 67678 - protein, 10 aa, Dengue virus
MTGKDVFYLP

SEQ ID NO: 67679 - protein, 10 aa, Dengue virus
SSPSPIVEES

SEQ ID NO: 67680 - protein, 10 aa, Dengue virus
SPSPIVEESR

SEQ ID NO: 67681 - protein, 10 aa, Dengue virus
PSPIVEESRT

SEQ ID NO: 67682 - protein, 10 aa, Dengue virus
SPIVEESRTI

SEQ ID NO: 67683 - protein, 10 aa, Dengue virus
PIVEESRTIR

SEQ ID NO: 67684 - protein, 10 aa, Dengue virus
TVEEGRTIRV

SEQ ID NO: 67685 - protein, 10 aa, Dengue virus
EESRTIRVLR

SEQ ID NO: 67686 - protein, 10 aa, Dengue virus
EGRTIRVLKM

SEQ ID NO: 67687 - protein, 10 aa, Dengue virus
SRTIRVLRMV

SEQ ID NO: 67688 - protein, 10 aa, Dengue virus
VLKMVEPWLR

SEQ ID NO: 67689 - protein, 10 aa, Dengue virus
LKMVEPWLRN

SEQ ID NO: 67690 - protein, 10 aa, Dengue virus
KMVEPWLRNN

SEQ ID NO: 67691 - protein, 10 aa, Dengue virus
MVEPWLRNNQ

SEQ ID NO: 67692 - protein, 10 aa, Dengue virus
VEPWLRNNQF

SEQ ID NO: 67693 - protein, 10 aa, Dengue virus
EPWLRNNQFC

SEQ ID NO: 67694 - protein, 10 aa, Dengue virus
PWLRNNQFCI

SEQ ID NO: 67695 - protein, 10 aa, Dengue virus
WLRNNQFCIK

SEQ ID NO: 67696 - protein, 10 aa, Dengue virus
LRNNQFCIKV

SEQ ID NO: 67697 - protein, 10 aa, Dengue virus
RNNQFCIKVL

SEQ ID NO: 67698 - protein, 10 aa, Dengue virus
NNQFCIKILN

SEQ ID NO: 67699 - protein, 10 aa, Dengue virus
NQFCIKILNP

SEQ ID NO: 67700 - protein, 10 aa, Dengue virus
QFCIKILNPY

SEQ ID NO: 67701 - protein, 10 aa, Dengue virus
FCIKILNPYM

SEQ ID NO: 67702 - protein, 10 aa, Dengue virus
CIKILNPYMP

SEQ ID NO: 67703 - protein, 10 aa, Dengue virus
IKVLNPYMPA

SEQ ID NO: 67704 - protein, 10 aa, Dengue virus
KVLNPYMPAV

SEQ ID NO: 67705 - protein, 10 aa, Dengue virus
VLNPYMPAVI

SEQ ID NO: 67706 - protein, 10 aa, Dengue virus
LNPYMPAVIE

SEQ ID NO: 67707 - protein, 10 aa, Dengue virus
NPYMPAVIEH

SEQ ID NO: 67708 - protein, 10 aa, Dengue virus
PYMPAVIEHL

SEQ ID NO: 67709 - protein, 10 aa, Dengue virus
YMPAVIEHLE

SEQ ID NO: 67710 - protein, 10 aa, Dengue virus
MPAVIEHLER

SEQ ID NO: 67711 - protein, 10 aa, Dengue virus
PAVIEHLERL

SEQ ID NO: 67712 - protein, 10 aa, Dengue virus
AVIEHLERLQ

SEQ ID NO: 67713 - protein, 10 aa, Dengue virus
VVEHLERLQR

SEQ ID NO: 67714 - protein, 10 aa, Dengue virus
VEHLERLQRK

SEQ ID NO: 67715 - protein, 10 aa, Dengue virus
EHLERLQRKY

SEQ ID NO: 67716 - protein, 10 aa, Dengue virus
HLERLQRKYG

SEQ ID NO: 67717 - protein, 10 aa, Dengue virus
LERLQRKYGG

SEQ ID NO: 67718 - protein, 10 aa, Dengue virus
ERLQRKYGGM

SEQ ID NO: 67719 - protein, 10 aa, Dengue virus
RLQRKYGGML

SEQ ID NO: 67720 - protein, 10 aa, Dengue virus
LQRKYGGMLV

SEQ ID NO: 67721 - protein, 10 aa, Dengue virus
QRKYGGMLVR

SEQ ID NO: 67722 - protein, 10 aa, Dengue virus
RKYGGMLVRN

SEQ ID NO: 67723 - protein, 10 aa, Dengue virus
KYGGMLVRNP

SEQ ID NO: 67724 - protein, 10 aa, Dengue virus
YGGMLVRNPL

SEQ ID NO: 67725 - protein, 10 aa, Dengue virus
ISNGTGNIVS

SEQ ID NO: 67726 - protein, 10 aa, Dengue virus
SNGTGNIVSS

SEQ ID NO: 67727 - protein, 10 aa, Dengue virus
NGTGNIVSSV

SEQ ID NO: 67728 - protein, 10 aa, Dengue virus
GTGNIVSSVN

SEQ ID NO: 67729 - protein, 10 aa, Dengue virus
TGNIVSSVNM

SEQ ID NO: 67730 - protein, 10 aa, Dengue virus
GNIVSSVNMV

SEQ ID NO: 67731 - protein, 10 aa, Dengue virus
NIVSSVNMVS

SEQ ID NO: 67732 - protein, 10 aa, Dengue virus
IVSSVNMVSR

SEQ ID NO: 67733 - protein, 10 aa, Dengue virus
VSSVNMVSRL

SEQ ID NO: 67734 - protein, 10 aa, Dengue virus
SSVNMVSRLL

SEQ ID NO: 67735 - protein, 10 aa, Dengue virus
LLLNRFTMTY

SEQ ID NO: 67736 - protein, 10 aa, Dengue virus
LLNRFTMTYR

SEQ ID NO: 67737 - protein, 10 aa, Dengue virus
LNRFTMTYRR

SEQ ID NO: 67738 - protein, 10 aa, Dengue virus
NRFTMTYRRP

SEQ ID NO: 67739 - protein, 10 aa, Dengue virus
RFTMTYRRPT

SEQ ID NO: 67740 - protein, 10 aa, Dengue virus
FTMTYRRPTI

SEQ ID NO: 67741 - protein, 10 aa, Dengue virus
TMTYRRPTIE

SEQ ID NO: 67742 - protein, 10 aa, Dengue virus
MTYRRPTIEK

SEQ ID NO: 67743 - protein, 10 aa, Dengue virus
TYRRPTIEKD

SEQ ID NO: 67744 - protein, 10 aa, Dengue virus
YRRPTIEKDV

SEQ ID NO: 67745 - protein, 10 aa, Dengue virus
RKPTIEKDVD

SEQ ID NO: 67746 - protein, 10 aa, Dengue virus
KPTIEKDVDL

SEQ ID NO: 67747 - protein, 10 aa, Dengue virus
PTIERDVDLG

SEQ ID NO: 67748 - protein, 10 aa, Dengue virus
TIERDVDLGA

SEQ ID NO: 67749 - protein, 10 aa, Dengue virus
IERDVDLGAG

SEQ ID NO: 67750 - protein, 10 aa, Dengue virus
ERDVDLGAGT

SEQ ID NO: 67751 - protein, 10 aa, Dengue virus
RDVDLGAGTR

SEQ ID NO: 67752 - protein, 10 aa, Dengue virus
TRHVNAEPEI

SEQ ID NO: 67753 - protein, 10 aa, Dengue virus
RHVNAEPEIP

SEQ ID NO: 67754 - protein, 10 aa, Dengue virus
HVNAEPEIPN

SEQ ID NO: 67755 - protein, 10 aa, Dengue virus
VNAEPEIPNM

SEQ ID NO: 67756 - protein, 10 aa, Dengue virus
NAEPEIPNMD

SEQ ID NO: 67757 - protein, 10 aa, Dengue virus
AEPEIPNMDV

SEQ ID NO: 67758 - protein, 10 aa, Dengue virus
EPEIPNMDVI

SEQ ID NO: 67759 - protein, 10 aa, Dengue virus
PEIPNMDVIG

SEQ ID NO: 67760 - protein, 10 aa, Dengue virus
EIPNMDVIGE

SEQ ID NO: 67761 - protein, 10 aa, Dengue virus
IPNMDVIGER

SEQ ID NO: 67762 - protein, 10 aa, Dengue virus
NMDVIGERIR

SEQ ID NO: 67763 - protein, 10 aa, Dengue virus
MDVIGERIRR

SEQ ID NO: 67764 - protein, 10 aa, Dengue virus
DVIGERIRRI

SEQ ID NO: 67765 - protein, 10 aa, Dengue virus
VIGERIRRIK

SEQ ID NO: 67766 - protein, 10 aa, Dengue virus
IGERIRRIKE

SEQ ID NO: 67767 - protein, 10 aa, Dengue virus
GERIRRIKEE

SEQ ID NO: 67768 - protein, 10 aa, Dengue virus
ERIRRIKEEH

SEQ ID NO: 67769 - protein, 10 aa, Dengue virus
RIKEEHSSTW

SEQ ID NO: 67770 - protein, 10 aa, Dengue virus
IKEEHSSTWH

SEQ ID NO: 67771 - protein, 10 aa, Dengue virus
KEEHSSTWHY

SEQ ID NO: 67772 - protein, 10 aa, Dengue virus
EEHSSTWHYD

SEQ ID NO: 67773 - protein, 10 aa, Dengue virus
EHSSTWHYDD

SEQ ID NO: 67774 - protein, 10 aa, Dengue virus
HSSTWHYDDE

SEQ ID NO: 67775 - protein, 10 aa, Dengue virus
SSTWHYDDEN

SEQ ID NO: 67776 - protein, 10 aa, Dengue virus
KTWHYDDENP

SEQ ID NO: 67777 - protein, 10 aa, Dengue virus
LTKPWDVVPT

SEQ ID NO: 67778 - protein, 10 aa, Dengue virus
TKPWDVVPTV

SEQ ID NO: 67779 - protein, 10 aa, Dengue virus
KPWDVVPTVT

SEQ ID NO: 67780 - protein, 10 aa, Dengue virus
PWDVVPTVTQ

SEQ ID NO: 67781 - protein, 10 aa, Dengue virus
WDVVPTVTQM

SEQ ID NO: 67782 - protein, 10 aa, Dengue virus
DVVPTVTQMA

SEQ ID NO: 67783 - protein, 10 aa, Dengue virus
VVPTVTQMAM

SEQ ID NO: 67784 - protein, 10 aa, Dengue virus
VPTVTQMAMT

SEQ ID NO: 67785 - protein, 10 aa, Dengue virus
PTVTQMAMTD

SEQ ID NO: 67786 - protein, 10 aa, Dengue virus
TVTQMAMTDT

SEQ ID NO: 67787 - protein, 10 aa, Dengue virus
VIQMAMTDTT

SEQ ID NO: 67788 - protein, 10 aa, Dengue virus
IQMAMTDTTP

SEQ ID NO: 67789 - protein, 10 aa, Dengue virus
KEKVDTRTPK

SEQ ID NO: 67790 - protein, 10 aa, Dengue virus
EKVDTRTPRP

SEQ ID NO: 67791 - protein, 10 aa, Dengue virus
KVDTRTPRPM

SEQ ID NO: 67792 - protein, 10 aa, Dengue virus
VDTRTPRPMP

SEQ ID NO: 67793 - protein, 10 aa, Dengue virus
DTRTPRPMPG

SEQ ID NO: 67794 - protein, 10 aa, Dengue virus
TRTPRPMPGT

SEQ ID NO: 67795 - protein, 10 aa, Dengue virus
RTPRPMPGTR

SEQ ID NO: 67796 - protein, 10 aa, Dengue virus
VMGITAEWLW

SEQ ID NO: 67797 - protein, 10 aa, Dengue virus
MGITAEWLWR

SEQ ID NO: 67798 - protein, 10 aa, Dengue virus
GITAEWLWRT

SEQ ID NO: 67799 - protein, 10 aa, Dengue virus
ITAGWLWRTL

SEQ ID NO: 67800 - protein, 10 aa, Dengue virus
TAGWLWRTLG

SEQ ID NO: 67801 - protein, 10 aa, Dengue virus
AGWLWRTLGR

SEQ ID NO: 67802 - protein, 10 aa, Dengue virus
GWLWRTLGRN

SEQ ID NO: 67803 - protein, 10 aa, Dengue virus
LWRTLGRNKR

SEQ ID NO: 67804 - protein, 10 aa, Dengue virus
WRTLGRNKRP

SEQ ID NO: 67805 - protein, 10 aa, Dengue virus
RTLGRNKRPR

SEQ ID NO: 67806 - protein, 10 aa, Dengue virus
TLGRNKRPRL

SEQ ID NO: 67807 - protein, 10 aa, Dengue virus
LGRNKRPRLC

SEQ ID NO: 67808 - protein, 10 aa, Dengue virus
GRNKRPRLCT

SEQ ID NO: 67809 - protein, 10 aa, Dengue virus
RNKRPRLCTR

SEQ ID NO: 67810 - protein, 10 aa, Dengue virus
NKRPRLCTRE

SEQ ID NO: 67811 - protein, 10 aa, Dengue virus
KRPRLCTREE

SEQ ID NO: 67812 - protein, 10 aa, Dengue virus
RPRLCTREEF

SEQ ID NO: 67813 - protein, 10 aa, Dengue virus
PRLCTREEFI

SEQ ID NO: 67814 - protein, 10 aa, Dengue virus
RLCTREEFIK

SEQ ID NO: 67815 - protein, 10 aa, Dengue virus
LCTREEFIKK

SEQ ID NO: 67816 - protein, 10 aa, Dengue virus
CTREEFIKKV

SEQ ID NO: 67817 - protein, 10 aa, Dengue virus
TREEFIKKVR

SEQ ID NO: 67818 - protein, 10 aa, Dengue virus
REEFIKKVRT

SEQ ID NO: 67819 - protein, 10 aa, Dengue virus
EEFIKKVRTN

SEQ ID NO: 67820 - protein, 10 aa, Dengue virus
EFIKKVRTNA

SEQ ID NO: 67821 - protein, 10 aa, Dengue virus
FIKKVRTNAA

SEQ ID NO: 67822 - protein, 10 aa, Dengue virus
IKKVRTNAAM

SEQ ID NO: 67823 - protein, 10 aa, Dengue virus
TEENQWDSAR

SEQ ID NO: 67824 - protein, 10 aa, Dengue virus
EENQWDSARA

SEQ ID NO: 67825 - protein, 10 aa, Dengue virus
ENQWDSARAA

SEQ ID NO: 67826 - protein, 10 aa, Dengue virus
NQWDSARAAV

SEQ ID NO: 67827 - protein, 10 aa, Dengue virus
QWDSARAAVE

SEQ ID NO: 67828 - protein, 10 aa, Dengue virus
WDSARAAVED

SEQ ID NO: 67829 - protein, 10 aa, Dengue virus
DSARAAVEDE

SEQ ID NO: 67830 - protein, 10 aa, Dengue virus
SARAAVEDEE

SEQ ID NO: 67831 - protein, 10 aa, Dengue virus
ARAAVEDEEF

SEQ ID NO: 67832 - protein, 10 aa, Dengue virus
RAAVEDEEFW

SEQ ID NO: 67833 - protein, 10 aa, Dengue virus
AAVEDEEFWK

SEQ ID NO: 67834 - protein, 10 aa, Dengue virus
AVEDEEFWKL

SEQ ID NO: 67835 - protein, 10 aa, Dengue virus
VEDEEFWKLV

SEQ ID NO: 67836 - protein, 10 aa, Dengue virus
EDEEFWKLVD

SEQ ID NO: 67837 - protein, 10 aa, Dengue virus
DEEFWKLVDR

SEQ ID NO: 67838 - protein, 10 aa, Dengue virus
EEFWKLVDRE

SEQ ID NO: 67839 - protein, 10 aa, Dengue virus
EFWKLVDRER

SEQ ID NO: 67840 - protein, 10 aa, Dengue virus
FWKLVDKERE

SEQ ID NO: 67841 - protein, 10 aa, Dengue virus
WKLVDKEREL

SEQ ID NO: 67842 - protein, 10 aa, Dengue virus
KLVDKERELH

SEQ ID NO: 67843 - protein, 10 aa, Dengue virus
LVDKERELHK

SEQ ID NO: 67844 - protein, 10 aa, Dengue virus
VDKERELHKL

SEQ ID NO: 67845 - protein, 10 aa, Dengue virus
DKERELHKLG

SEQ ID NO: 67846 - protein, 10 aa, Dengue virus
KERELHKLGK

SEQ ID NO: 67847 - protein, 10 aa, Dengue virus
ERELHKQGKC

SEQ ID NO: 67848 - protein, 10 aa, Dengue virus
RELHKQGKCG

SEQ ID NO: 67849 - protein, 10 aa, Dengue virus
ELHKQGKCGS

SEQ ID NO: 67850 - protein, 10 aa, Dengue virus
LHKQGKCGSC

SEQ ID NO: 67851 - protein, 10 aa, Dengue virus
HKQGKCGSCV

SEQ ID NO: 67852 - protein, 10 aa, Dengue virus
KQGKCGSCVY

SEQ ID NO: 67853 - protein, 10 aa, Dengue virus
QGKCGSCVYN

SEQ ID NO: 67854 - protein, 10 aa, Dengue virus
IWYMWLGARF

SEQ ID NO: 67855 - protein, 10 aa, Dengue virus
WYMWLGARFL

SEQ ID NO: 67856 - protein, 10 aa, Dengue virus
YMWLGARFLE

SEQ ID NO: 67857 - protein, 10 aa, Dengue virus
MWLGARFLEF

SEQ ID NO: 67858 - protein, 10 aa, Dengue virus
WLGARFLEFE

SEQ ID NO: 67859 - protein, 10 aa, Dengue virus
LGARFLEFEA

SEQ ID NO: 67860 - protein, 10 aa, Dengue virus
GARFLEFEAL

SEQ ID NO: 67861 - protein, 10 aa, Dengue virus
ARFLEFEALG

SEQ ID NO: 67862 - protein, 10 aa, Dengue virus
RFLEFEALGF

SEQ ID NO: 67863 - protein, 10 aa, Dengue virus
FLEFEALGFL

SEQ ID NO: 67864 - protein, 10 aa, Dengue virus
DDLHNEEKII

SEQ ID NO: 67865 - protein, 10 aa, Dengue virus
DLHNEEKIIQ

SEQ ID NO: 67866 - protein, 10 aa, Dengue virus
LHNEEKIIQQ

SEQ ID NO: 67867 - protein, 10 aa, Dengue virus
HNEEKIIQQM

SEQ ID NO: 67868 - protein, 10 aa, Dengue virus
NEEKIIQQMD

SEQ ID NO: 67869 - protein, 10 aa, Dengue virus
EEKIIQQMDP

SEQ ID NO: 67870 - protein, 10 aa, Dengue virus
EKIIQQMDPE

SEQ ID NO: 67871 - protein, 10 aa, Dengue virus
KIIQQMDPEH

SEQ ID NO: 67872 - protein, 10 aa, Dengue virus
IIQQMDPEHR

SEQ ID NO: 67873 - protein, 10 aa, Dengue virus
QMDPEHRLLA

SEQ ID NO: 67874 - protein, 10 aa, Dengue virus
PEHRQLASAI

SEQ ID NO: 67875 - protein, 10 aa, Dengue virus
EHRQLASAIF

SEQ ID NO: 67876 - protein, 10 aa, Dengue virus
HRQLASAIFK

SEQ ID NO: 67877 - protein, 10 aa, Dengue virus
RQLASAIFKL

SEQ ID NO: 67878 - protein, 10 aa, Dengue virus
QLASAIFKLT

SEQ ID NO: 67879 - protein, 10 aa, Dengue virus
LASAIFKLTY

SEQ ID NO: 67880 - protein, 10 aa, Dengue virus
ASAIFKLTYQ

SEQ ID NO: 67881 - protein, 10 aa, Dengue virus
SAIFKLTYQN

SEQ ID NO: 67882 - protein, 10 aa, Dengue virus
VVKVQRPTPK

SEQ ID NO: 67883 - protein, 10 aa, Dengue virus
VKVQRPTPKG

SEQ ID NO: 67884 - protein, 10 aa, Dengue virus
KVQRPTPKGT

SEQ ID NO: 67885 - protein, 10 aa, Dengue virus
VQRPTPKGTV

SEQ ID NO: 67886 - protein, 10 aa, Dengue virus
QRPTPKGTVM

SEQ ID NO: 67887 - protein, 10 aa, Dengue virus
RPTPKGTVMD

SEQ ID NO: 67888 - protein, 10 aa, Dengue virus
PTPKGTVMDI

SEQ ID NO: 67889 - protein, 10 aa, Dengue virus
TPKGTVMDII

SEQ ID NO: 67890 - protein, 10 aa, Dengue virus
PKGTVMDIIS

SEQ ID NO: 67891 - protein, 10 aa, Dengue virus
KGTVMDIISR

SEQ ID NO: 67892 - protein, 10 aa, Dengue virus
FTNMEAQLVR

SEQ ID NO: 67893 - protein, 10 aa, Dengue virus
TNMEAQLVRQ

SEQ ID NO: 67894 - protein, 10 aa, Dengue virus
NMEAQLVRQM

SEQ ID NO: 67895 - protein, 10 aa, Dengue virus
MEAQLVRQME

SEQ ID NO: 67896 - protein, 10 aa, Dengue virus
EAQLVRQMEG

SEQ ID NO: 67897 - protein, 10 aa, Dengue virus
AQLVRQMEGE

SEQ ID NO: 67898 - protein, 10 aa, Dengue virus
QLVRQMEGEG

SEQ ID NO: 67899 - protein, 10 aa, Dengue virus
LVRQMEGEGV

SEQ ID NO: 67900 - protein, 10 aa, Dengue virus
VRQMEGEGVL

SEQ ID NO: 67901 - protein, 10 aa, Dengue virus
RQMEGEGVLT

SEQ ID NO: 67902 - protein, 10 aa, Dengue virus
QMEGEGVLTK

SEQ ID NO: 67903 - protein, 10 aa, Dengue virus
MEGEGVLTKA

SEQ ID NO: 67904 - protein, 10 aa, Dengue virus
TQWLETEGVE

SEQ ID NO: 67905 - protein, 10 aa, Dengue virus
QWLETEGVER

SEQ ID NO: 67906 - protein, 10 aa, Dengue virus
WLETEGVERL

SEQ ID NO: 67907 - protein, 10 aa, Dengue virus
LETKGVERLR

SEQ ID NO: 67908 - protein, 10 aa, Dengue virus
ETKGVERLRR

SEQ ID NO: 67909 - protein, 10 aa, Dengue virus
TKGVERLRRM

SEQ ID NO: 67910 - protein, 10 aa, Dengue virus
KGVERLRRMA

SEQ ID NO: 67911 - protein, 10 aa, Dengue virus
GVERLRRMAI

SEQ ID NO: 67912 - protein, 10 aa, Dengue virus
VERLRRMAIS

SEQ ID NO: 67913 - protein, 10 aa, Dengue virus
ERLRRMAISG

SEQ ID NO: 67914 - protein, 10 aa, Dengue virus
RLRRMAISGD

SEQ ID NO: 67915 - protein, 10 aa, Dengue virus
LRRMAISGDD

SEQ ID NO: 67916 - protein, 10 aa, Dengue virus
RRMAISGDDC

SEQ ID NO: 67917 - protein, 10 aa, Dengue virus
IDDRFANALF

SEQ ID NO: 67918 - protein, 10 aa, Dengue virus
DDRFANALFA

SEQ ID NO: 67919 - protein, 10 aa, Dengue virus
DRFANALFAL

SEQ ID NO: 67920 - protein, 10 aa, Dengue virus
RFANALFALN

SEQ ID NO: 67921 - protein, 10 aa, Dengue virus
FANALFALND

SEQ ID NO: 67922 - protein, 10 aa, Dengue virus
ANALFALNDM

SEQ ID NO: 67923 - protein, 10 aa, Dengue virus
NALFALNDMG

SEQ ID NO: 67924 - protein, 10 aa, Dengue virus
ALFALNDMGK

SEQ ID NO: 67925 - protein, 10 aa, Dengue virus
LFALNDMGKV

SEQ ID NO: 67926 - protein, 10 aa, Dengue virus
FALNDMGKVR

SEQ ID NO: 67927 - protein, 10 aa, Dengue virus
PQWQPSKGWQ

SEQ ID NO: 67928 - protein, 10 aa, Dengue virus
QWQPSKGWQD

SEQ ID NO: 67929 - protein, 10 aa, Dengue virus
WQPSKGWQDW

SEQ ID NO: 67930 - protein, 10 aa, Dengue virus
QPSKGWQDWQ

SEQ ID NO: 67931 - protein, 10 aa, Dengue virus
PSKGWQDWQQ

SEQ ID NO: 67932 - protein, 10 aa, Dengue virus
SKGWQDWQQV

SEQ ID NO: 67933 - protein, 10 aa, Dengue virus
KGWQDWQQVP

SEQ ID NO: 67934 - protein, 10 aa, Dengue virus
GWQDWQQVPF

SEQ ID NO: 67935 - protein, 10 aa, Dengue virus
WQDWQQVPFC

SEQ ID NO: 67936 - protein, 10 aa, Dengue virus
QDWQQVPFCS

SEQ ID NO: 67937 - protein, 10 aa, Dengue virus
ISQGAGWSLK

SEQ ID NO: 67938 - protein, 10 aa, Dengue virus
SQGAGWSLKE

SEQ ID NO: 67939 - protein, 10 aa, Dengue virus
QGAGWSLKET

SEQ ID NO: 67940 - protein, 10 aa, Dengue virus
GAGWSLKETA

SEQ ID NO: 67941 - protein, 10 aa, Dengue virus
AGWSLKETAC

SEQ ID NO: 67942 - protein, 10 aa, Dengue virus
GWSLKETACL

SEQ ID NO: 67943 - protein, 10 aa, Dengue virus
WSLKETACLG

SEQ ID NO: 67944 - protein, 10 aa, Dengue virus
SLKETACLGK

SEQ ID NO: 67945 - protein, 10 aa, Dengue virus
LKETACLGKA

SEQ ID NO: 67946 - protein, 10 aa, Dengue virus
KETACLGKAY

SEQ ID NO: 67947 - protein, 10 aa, Dengue virus
LGKAYAQMWA

SEQ ID NO: 67948 - protein, 10 aa, Dengue virus
GKAYAQMWAL

SEQ ID NO: 67949 - protein, 10 aa, Dengue virus
KAYAQMWALM

SEQ ID NO: 67950 - protein, 10 aa, Dengue virus
AYAQMWALMY

SEQ ID NO: 67951 - protein, 10 aa, Dengue virus
YAQMWALMYF

SEQ ID NO: 67952 - protein, 10 aa, Dengue virus
AQMWALMYFH

SEQ ID NO: 67953 - protein, 10 aa, Dengue virus
QMWALMYFHR

SEQ ID NO: 67954 - protein, 10 aa, Dengue virus
MWALMYFHRR

SEQ ID NO: 67955 - protein, 10 aa, Dengue virus
WALMYFHRRD

SEQ ID NO: 67956 - protein, 10 aa, Dengue virus
ALMYFHRRDL

SEQ ID NO: 67957 - protein, 10 aa, Dengue virus
SNAICSAVPA

SEQ ID NO: 67958 - protein, 10 aa, Dengue virus
NAICSAVPAH

SEQ ID NO: 67959 - protein, 10 aa, Dengue virus
AICSAVPAHW

SEQ ID NO: 67960 - protein, 10 aa, Dengue virus
ICSAVPVHWI

SEQ ID NO: 67961 - protein, 10 aa, Dengue virus
CSAVPVHWIP

SEQ ID NO: 67962 - protein, 10 aa, Dengue virus
SAVPVHWIPT

SEQ ID NO: 67963 - protein, 10 aa, Dengue virus
AVPVHWIPTS

SEQ ID NO: 67964 - protein, 10 aa, Dengue virus
VPVHWIPTSR

SEQ ID NO: 67965 - protein, 10 aa, Dengue virus
PVHWIPTSRT

SEQ ID NO: 67966 - protein, 10 aa, Dengue virus
VHWIPTSRTT

SEQ ID NO: 67967 - protein, 10 aa, Dengue virus
HWIPTSRTTW

SEQ ID NO: 67968 - protein, 10 aa, Dengue virus
WIPTSRTTWS

SEQ ID NO: 67969 - protein, 10 aa, Dengue virus
IPTSRTTWSI

SEQ ID NO: 67970 - protein, 10 aa, Dengue virus
QWMTTEDMLA

SEQ ID NO: 67971 - protein, 10 aa, Dengue virus
WMTTEDMLAV

SEQ ID NO: 67972 - protein, 10 aa, Dengue virus
MTTEDMLAVW

SEQ ID NO: 67973 - protein, 10 aa, Dengue virus
TTEDMLAVWN

SEQ ID NO: 67974 - protein, 10 aa, Dengue virus
TEDMLAVWNR

SEQ ID NO: 67975 - protein, 10 aa, Dengue virus
EDMLAVWNRV

SEQ ID NO: 67976 - protein, 10 aa, Dengue virus
DMLAVWNRVW

SEQ ID NO: 67977 - protein, 10 aa, Dengue virus
MLAVWNRVWI

SEQ ID NO: 67978 - protein, 10 aa, Dengue virus
LAVWNRVWIE

SEQ ID NO: 67979 - protein, 10 aa, Dengue virus
TVWNRVWIEE

SEQ ID NO: 67980 - protein, 10 aa, Dengue virus
VWNRVWIEEN

SEQ ID NO: 67981 - protein, 10 aa, Dengue virus
WNRVWIEENP

SEQ ID NO: 67982 - protein, 10 aa, Dengue virus
NRVWIEENPW

SEQ ID NO: 67983 - protein, 10 aa, Dengue virus
RVWIEENPWM

SEQ ID NO: 67984 - protein, 10 aa, Dengue virus
VWIEENPWME

SEQ ID NO: 67985 - protein, 10 aa, Dengue virus
WIEENPWMED

SEQ ID NO: 67986 - protein, 10 aa, Dengue virus
IEENPWMEDK

SEQ ID NO: 67987 - protein, 10 aa, Dengue virus
EENPWMEDKT

SEQ ID NO: 67988 - protein, 10 aa, Dengue virus
ENPWMEDKTP

SEQ ID NO: 67989 - protein, 10 aa, Dengue virus
NPWMEDKTPI

SEQ ID NO: 67990 - protein, 10 aa, Dengue virus
PWMEDKTPIT

SEQ ID NO: 67991 - protein, 10 aa, Dengue virus
WMEDKTPITT

SEQ ID NO: 67992 - protein, 10 aa, Dengue virus
MEDKTPITTW

SEQ ID NO: 67993 - protein, 10 aa, Dengue virus
EDKTPITTWE

SEQ ID NO: 67994 - protein, 10 aa, Dengue virus
DKTPVTTWED

SEQ ID NO: 67995 - protein, 10 aa, Dengue virus
KTPVTTWEDV

SEQ ID NO: 67996 - protein, 10 aa, Dengue virus
TPVTTWEDVP

SEQ ID NO: 67997 - protein, 10 aa, Dengue virus
PVTTWEDVPY

SEQ ID NO: 67998 - protein, 10 aa, Dengue virus
VTTWEDVPYL

SEQ ID NO: 67999 - protein, 10 aa, Dengue virus
TTWEDVPYLG

SEQ ID NO: 68000 - protein, 10 aa, Dengue virus
TWEDVPYLGK

SEQ ID NO: 68001 - protein, 10 aa, Dengue virus
WEDVPYLGKR

SEQ ID NO: 68002 - protein, 10 aa, Dengue virus
EDVPYLGKRE

SEQ ID NO: 68003 - protein, 10 aa, Dengue virus
DVPYLGKRED

SEQ ID NO: 68004 - protein, 10 aa, Dengue virus
SRATWAQNIL

SEQ ID NO: 68005 - protein, 10 aa, Dengue virus
RATWAQNILT

SEQ ID NO: 68006 - protein, 10 aa, Dengue virus
ATWAQNILTA

SEQ ID NO: 68007 - protein, 10 aa, Dengue virus
TWAQNILTAI

SEQ ID NO: 68008 - protein, 10 aa, Dengue virus
WAQNILTAIQ

SEQ ID NO: 68009 - protein, 10 aa, Dengue virus
AQNILTAIQQ

SEQ ID NO: 68010 - protein, 10 aa, Dengue virus
QNILTAIQQV

SEQ ID NO: 68011 - protein, 10 aa, Dengue virus
NILTAIQQVR

SEQ ID NO: 68012 - protein, 10 aa, Dengue virus
ILTAIQQVRS

SEQ ID NO: 68013 - protein, 10 aa, Dengue virus
LTAIQQVRSL

SEQ ID NO: 68014 - protein, 10 aa, Dengue virus
IAIQQVRSLI

SEQ ID NO: 68015 - protein, 10 aa, Dengue virus
IQQVRSLIGD

SEQ ID NO: 68016 - protein, 10 aa, Dengue virus
QQVRSLIGDE

SEQ ID NO: 68017 - protein, 10 aa, Dengue virus
QVRSLIGDEE

SEQ ID NO: 68018 - protein, 10 aa, Dengue virus
VRSLIGDEEF

SEQ ID NO: 68019 - protein, 10 aa, Dengue virus
RSLIGDEEFL

SEQ ID NO: 68020 - protein, 10 aa, Dengue virus
SLIGDEEFLD

SEQ ID NO: 68021 - protein, 10 aa, Dengue virus
LIGDEEFLDY

SEQ ID NO: 68022 - protein, 10 aa, Dengue virus
IGDEEFLDYM

SEQ ID NO: 68023 - protein, 10 aa, Dengue virus
GDEEFLDYMP

SEQ ID NO: 68024 - protein, 10 aa, Dengue virus
DEEFLDYMPS

SEQ ID NO: 68025 - protein, 10 aa, Dengue virus
MKRFRKEEEL

SEQ ID NO: 68026 - protein, 10 aa, Dengue virus
KRFRKEEELE

SEQ ID NO: 68027 - protein, 10 aa, Dengue virus
RFRKEEELEG

SEQ ID NO: 68028 - protein, 10 aa, Dengue virus
FRKEEELEGA

SEQ ID NO: 68029 - protein, 10 aa, Dengue virus
RKEEELEGAI

SEQ ID NO: 68030 - protein, 10 aa, Dengue virus
KEEELEGAIW

SEQ ID NO: 68031 - protein, 10 aa, Dengue virus
SQLAKRFSKE

SEQ ID NO: 68032 - protein, 10 aa, Dengue virus
QLAKRFSKEL

SEQ ID NO: 68033 - protein, 10 aa, Dengue virus
LAKRFSKELL

SEQ ID NO: 68034 - protein, 10 aa, Dengue virus
AKRFSKELLN

SEQ ID NO: 68035 - protein, 10 aa, Dengue virus
KRFSKELLNG

SEQ ID NO: 68036 - protein, 10 aa, Dengue virus
RFSKELLNGQ

SEQ ID NO: 68037 - protein, 10 aa, Dengue virus
FSKELLNGQG

SEQ ID NO: 68038 - protein, 10 aa, Dengue virus
SKELLNGQGP

SEQ ID NO: 68039 - protein, 10 aa, Dengue virus
KELLNGQGPM

SEQ ID NO: 68040 - protein, 10 aa, Dengue virus
KKLGAIKVLR

SEQ ID NO: 68041 - protein, 10 aa, Dengue virus
KSGAIKVLKS

SEQ ID NO: 68042 - protein, 10 aa, Dengue virus
SGAIKVLKSF

SEQ ID NO: 68043 - protein, 10 aa, Dengue virus
GAIKVLKSFK

SEQ ID NO: 68044 - protein, 10 aa, Dengue virus
AIKVLKGFKR

SEQ ID NO: 68045 - protein, 10 aa, Dengue virus
IKVLKGFKRE

SEQ ID NO: 68046 - protein, 10 aa, Dengue virus
KVLKGFKREI

SEQ ID NO: 68047 - protein, 10 aa, Dengue virus
VLKGFKREIS

SEQ ID NO: 68048 - protein, 10 aa, Dengue virus
LKGFKREISN

SEQ ID NO: 68049 - protein, 10 aa, Dengue virus
KGFKREISNM

SEQ ID NO: 68050 - protein, 10 aa, Dengue virus
SFKKEISNML

SEQ ID NO: 68051 - protein, 10 aa, Dengue virus
ISNMLSIINQ

SEQ ID NO: 68052 - protein, 10 aa, Dengue virus
SSMLSIINRR

SEQ ID NO: 68053 - protein, 10 aa, Dengue virus
NMLSIINQRK

SEQ ID NO: 68054 - protein, 10 aa, Dengue virus
MLSIINRRKR

SEQ ID NO: 68055 - protein, 10 aa, Dengue virus
LSIINRRKRT

SEQ ID NO: 68056 - protein, 10 aa, Dengue virus
SIINRRKRTS

SEQ ID NO: 68057 - protein, 10 aa, Dengue virus
RKKTSLCLVM

SEQ ID NO: 68058 - protein, 10 aa, Dengue virus
MILPATLAFH

SEQ ID NO: 68059 - protein, 10 aa, Dengue virus
ILPATLAFHL

SEQ ID NO: 68060 - protein, 10 aa, Dengue virus
DDTVTYKCPF

SEQ ID NO: 68061 - protein, 10 aa, Dengue virus
DTVTYKCPFI

SEQ ID NO: 68062 - protein, 10 aa, Dengue virus
VAEVEPEDID

SEQ ID NO: 68063 - protein, 10 aa, Dengue virus
QVERVETWAL

SEQ ID NO: 68064 - protein, 10 aa, Dengue virus
FLAHYISTSL

SEQ ID NO: 68065 - protein, 10 aa, Dengue virus
LAHYVGTSLT

SEQ ID NO: 68066 - protein, 10 aa, Dengue virus
AHYVGTSLTQ

SEQ ID NO: 68067 - protein, 10 aa, Dengue virus
HYVGTSLTQK

SEQ ID NO: 68068 - protein, 10 aa, Dengue virus
YIGTSLIQKV

SEQ ID NO: 68069 - protein, 10 aa, Dengue virus
IGTSLIQKVV

SEQ ID NO: 68070 - protein, 10 aa, Dengue virus
GTSLIQKVVI

SEQ ID NO: 68071 - protein, 10 aa, Dengue virus
TSLIQKVVIF

SEQ ID NO: 68072 - protein, 10 aa, Dengue virus
SLTQKAVIFI

SEQ ID NO: 68073 - protein, 10 aa, Dengue virus
LTQKAVIFIL

SEQ ID NO: 68074 - protein, 10 aa, Dengue virus
TQKAVIFILL

SEQ ID NO: 68075 - protein, 10 aa, Dengue virus
QKAVIFILLM

SEQ ID NO: 68076 - protein, 10 aa, Dengue virus
KAVIFILLML

SEQ ID NO: 68077 - protein, 10 aa, Dengue virus
AVIFILLMLV

SEQ ID NO: 68078 - protein, 10 aa, Dengue virus
VIFTLLMLVT

SEQ ID NO: 68079 - protein, 10 aa, Dengue virus
IFTLLMLVTP

SEQ ID NO: 68080 - protein, 10 aa, Dengue virus
FTLLMLVTPS

SEQ ID NO: 68081 - protein, 10 aa, Dengue virus
TLLMLVTPSM

SEQ ID NO: 68082 - protein, 10 aa, Dengue virus
SRCPTQGEAT

SEQ ID NO: 68083 - protein, 10 aa, Dengue virus
RCPTQGEATL

SEQ ID NO: 68084 - protein, 10 aa, Dengue virus
CPTQGEATLP

SEQ ID NO: 68085 - protein, 10 aa, Dengue virus
PTQGEATLPE

SEQ ID NO: 68086 - protein, 10 aa, Dengue virus
TQGEATLPEE

SEQ ID NO: 68087 - protein, 10 aa, Dengue virus
QGEATLPEEQ

SEQ ID NO: 68088 - protein, 10 aa, Dengue virus
GEATLPEEQD

SEQ ID NO: 68089 - protein, 10 aa, Dengue virus
EATLPEEQDQ

SEQ ID NO: 68090 - protein, 10 aa, Dengue virus
ATLPEEQDQN

SEQ ID NO: 68091 - protein, 10 aa, Dengue virus
TLPEEQDQNY

SEQ ID NO: 68092 - protein, 10 aa, Dengue virus
TCAKFQCLEL

SEQ ID NO: 68093 - protein, 10 aa, Dengue virus
CAKFQCLELI

SEQ ID NO: 68094 - protein, 10 aa, Dengue virus
AKFQCLELIE

SEQ ID NO: 68095 - protein, 10 aa, Dengue virus
KFQCLELIEG

SEQ ID NO: 68096 - protein, 10 aa, Dengue virus
FQCLELIEGK

SEQ ID NO: 68097 - protein, 10 aa, Dengue virus
IEGKAVQHEN

SEQ ID NO: 68098 - protein, 10 aa, Dengue virus
EGKAVQHENL

SEQ ID NO: 68099 - protein, 10 aa, Dengue virus
GKAVQHENLK

SEQ ID NO: 68100 - protein, 10 aa, Dengue virus
KAVQHENLKY

SEQ ID NO: 68101 - protein, 10 aa, Dengue virus
AVQHENLKYT

SEQ ID NO: 68102 - protein, 10 aa, Dengue virus
QHENLKYTVT

SEQ ID NO: 68103 - protein, 10 aa, Dengue virus
HENLKYTVTI

SEQ ID NO: 68104 - protein, 10 aa, Dengue virus
VGNDTQGVTA

SEQ ID NO: 68105 - protein, 10 aa, Dengue virus
GNDTQGVTAE

SEQ ID NO: 68106 - protein, 10 aa, Dengue virus
NDTQGVTAEI

SEQ ID NO: 68107 - protein, 10 aa, Dengue virus
DTQGVTAEIT

SEQ ID NO: 68108 - protein, 10 aa, Dengue virus
TQGVTAEITS

SEQ ID NO: 68109 - protein, 10 aa, Dengue virus
QGVTAEITSQ

SEQ ID NO: 68110 - protein, 10 aa, Dengue virus
GVTAEITSQA

SEQ ID NO: 68111 - protein, 10 aa, Dengue virus
VTAEITSQAS

SEQ ID NO: 68112 - protein, 10 aa, Dengue virus
TAEITSQAST

SEQ ID NO: 68113 - protein, 10 aa, Dengue virus
EITPQASTAE

SEQ ID NO: 68114 - protein, 10 aa, Dengue virus
ITPQASTAEA

SEQ ID NO: 68115 - protein, 10 aa, Dengue virus
VEAILPEYGT

SEQ ID NO: 68116 - protein, 10 aa, Dengue virus
EVILPEYGTL

SEQ ID NO: 68117 - protein, 10 aa, Dengue virus
VILPEYGTLG

SEQ ID NO: 68118 - protein, 10 aa, Dengue virus
DLPLPWTSGT

SEQ ID NO: 68119 - protein, 10 aa, Dengue virus
LPLPWTSGTT

SEQ ID NO: 68120 - protein, 10 aa, Dengue virus
PLPWTSGATA

SEQ ID NO: 68121 - protein, 10 aa, Dengue virus
AETPTWNRKE

SEQ ID NO: 68122 - protein, 10 aa, Dengue virus
ETPIWNRKEL

SEQ ID NO: 68123 - protein, 10 aa, Dengue virus
TEIQNSGGTN

SEQ ID NO: 68124 - protein, 10 aa, Dengue virus
EIQNSGGTNI

SEQ ID NO: 68125 - protein, 10 aa, Dengue virus
IQNSGGTNIF

SEQ ID NO: 68126 - protein, 10 aa, Dengue virus
QNSGGTNIFA

SEQ ID NO: 68127 - protein, 10 aa, Dengue virus
NSGGTNIFAG

SEQ ID NO: 68128 - protein, 10 aa, Dengue virus
SGGTSIFSGH

SEQ ID NO: 68129 - protein, 10 aa, Dengue virus
LKGMSYAMCS

SEQ ID NO: 68130 - protein, 10 aa, Dengue virus
KGMSYAMCSN

SEQ ID NO: 68131 - protein, 10 aa, Dengue virus
GMSYAMCSNA

SEQ ID NO: 68132 - protein, 10 aa, Dengue virus
MSYAMCSNAF

SEQ ID NO: 68133 - protein, 10 aa, Dengue virus
SYAMCSNAFV

SEQ ID NO: 68134 - protein, 10 aa, Dengue virus
YAMCSNAFVL

SEQ ID NO: 68135 - protein, 10 aa, Dengue virus
NTFVLRKEVS

SEQ ID NO: 68136 - protein, 10 aa, Dengue virus
SFVLKKEVSE

SEQ ID NO: 68137 - protein, 10 aa, Dengue virus
GTILVKVEYK

SEQ ID NO: 68138 - protein, 10 aa, Dengue virus
TILVKVEYKG

SEQ ID NO: 68139 - protein, 10 aa, Dengue virus
ILIKVEYKGK

SEQ ID NO: 68140 - protein, 10 aa, Dengue virus
LIKVEYKGKD

SEQ ID NO: 68141 - protein, 10 aa, Dengue virus
IKVEYRGEDA

SEQ ID NO: 68142 - protein, 10 aa, Dengue virus
KVEYRGEDAP

SEQ ID NO: 68143 - protein, 10 aa, Dengue virus
VEYRGEDAPC

SEQ ID NO: 68144 - protein, 10 aa, Dengue virus
EYRGEDAPCK

SEQ ID NO: 68145 - protein, 10 aa, Dengue virus
YRGEDAPCKI

SEQ ID NO: 68146 - protein, 10 aa, Dengue virus
RGEDAPCKIP

SEQ ID NO: 68147 - protein, 10 aa, Dengue virus
GEDVPCKVPF

SEQ ID NO: 68148 - protein, 10 aa, Dengue virus
EDVPCKVPFS

SEQ ID NO: 68149 - protein, 10 aa, Dengue virus
DVPCKVPFST

SEQ ID NO: 68150 - protein, 10 aa, Dengue virus
VPCKVPFSTE

SEQ ID NO: 68151 - protein, 10 aa, Dengue virus
CKIPFSTEDE

SEQ ID NO: 68152 - protein, 10 aa, Dengue virus
KIPFSTEDEQ

SEQ ID NO: 68153 - protein, 10 aa, Dengue virus
IPFSTEDEQG

SEQ ID NO: 68154 - protein, 10 aa, Dengue virus
FSTEDGQGKV

SEQ ID NO: 68155 - protein, 10 aa, Dengue virus
STEDGQGKVH

SEQ ID NO: 68156 - protein, 10 aa, Dengue virus
TEDEQGKAHN

SEQ ID NO: 68157 - protein, 10 aa, Dengue virus
EDEQGKAHNG

SEQ ID NO: 68158 - protein, 10 aa, Dengue virus
DEQGKAHNGR

SEQ ID NO: 68159 - protein, 10 aa, Dengue virus
EQGKAHNGRL

SEQ ID NO: 68160 - protein, 10 aa, Dengue virus
QGKVHNGRLI

SEQ ID NO: 68161 - protein, 10 aa, Dengue virus
SGRLITANPV

SEQ ID NO: 68162 - protein, 10 aa, Dengue virus
ITANPVVIKK

SEQ ID NO: 68163 - protein, 10 aa, Dengue virus
TANPVVTKKD

SEQ ID NO: 68164 - protein, 10 aa, Dengue virus
ANPVVTKKDE

SEQ ID NO: 68165 - protein, 10 aa, Dengue virus
NPVVTKKDEP

SEQ ID NO: 68166 - protein, 10 aa, Dengue virus
PVVTKKDEPV

SEQ ID NO: 68167 - protein, 10 aa, Dengue virus
VVTKKDEPVN

SEQ ID NO: 68168 - protein, 10 aa, Dengue virus
VTKKEEPINI

SEQ ID NO: 68169 - protein, 10 aa, Dengue virus
TKKEEPINIE

SEQ ID NO: 68170 - protein, 10 aa, Dengue virus
KKEEPINIEA

SEQ ID NO: 68171 - protein, 10 aa, Dengue virus
KEEPINIEAE

SEQ ID NO: 68172 - protein, 10 aa, Dengue virus
EEPINIEAEP

SEQ ID NO: 68173 - protein, 10 aa, Dengue virus
FGESNIVIGT

SEQ ID NO: 68174 - protein, 10 aa, Dengue virus
GESNIVIGTG

SEQ ID NO: 68175 - protein, 10 aa, Dengue virus
ESNIVIGTGD

SEQ ID NO: 68176 - protein, 10 aa, Dengue virus
GDNSLKINWY

SEQ ID NO: 68177 - protein, 10 aa, Dengue virus
DNSLKINWYK

SEQ ID NO: 68178 - protein, 10 aa, Dengue virus
NSLKINWYKK

SEQ ID NO: 68179 - protein, 10 aa, Dengue virus
ALKINWYRKG

SEQ ID NO: 68180 - protein, 10 aa, Dengue virus
TALFGGVSWI

SEQ ID NO: 68181 - protein, 10 aa, Dengue virus
ALFGGVSWIM

SEQ ID NO: 68182 - protein, 10 aa, Dengue virus
LFGGVSWIMK

SEQ ID NO: 68183 - protein, 10 aa, Dengue virus
FGGVSWIMKI

SEQ ID NO: 68184 - protein, 10 aa, Dengue virus
GGVSWIMKIG

SEQ ID NO: 68185 - protein, 10 aa, Dengue virus
GVSWMMKIGI

SEQ ID NO: 68186 - protein, 10 aa, Dengue virus
VSWMMKIGIG

SEQ ID NO: 68187 - protein, 10 aa, Dengue virus
SWVMKIGIGI

SEQ ID NO: 68188 - protein, 10 aa, Dengue virus
WVMKIGIGIL

SEQ ID NO: 68189 - protein, 10 aa, Dengue virus
VMKIGIGILL

SEQ ID NO: 68190 - protein, 10 aa, Dengue virus
TSMSFSCITI

SEQ ID NO: 68191 - protein, 10 aa, Dengue virus
MSFSCIAIGV

SEQ ID NO: 68192 - protein, 10 aa, Dengue virus
SFSCIAIGVI

SEQ ID NO: 68193 - protein, 10 aa, Dengue virus
FSCIAIGVIT

SEQ ID NO: 68194 - protein, 10 aa, Dengue virus
SCIAIGVITL

SEQ ID NO: 68195 - protein, 10 aa, Dengue virus
CIAIGVITLY

SEQ ID NO: 68196 - protein, 10 aa, Dengue virus
IAIGVITLYL

SEQ ID NO: 68197 - protein, 10 aa, Dengue virus
AIGVITLYLG

SEQ ID NO: 68198 - protein, 10 aa, Dengue virus
IGIITLYLGT

SEQ ID NO: 68199 - protein, 10 aa, Dengue virus
GIITLYLGTV

SEQ ID NO: 68200 - protein, 10 aa, Dengue virus
IITLYLGTVV

SEQ ID NO: 68201 - protein, 10 aa, Dengue virus
ITLYLGVVVQ

SEQ ID NO: 68202 - protein, 10 aa, Dengue virus
TLYLGVVVQA

SEQ ID NO: 68203 - protein, 10 aa, Dengue virus
LYLGVVVQAD

SEQ ID NO: 68204 - protein, 10 aa, Dengue virus
YLGTVVQADM

SEQ ID NO: 68205 - protein, 10 aa, Dengue virus
LGTVVQADMG

SEQ ID NO: 68206 - protein, 10 aa, Dengue virus
GTVVQADMGC

SEQ ID NO: 68207 - protein, 10 aa, Dengue virus
AVVQADMGCA

SEQ ID NO: 68208 - protein, 10 aa, Dengue virus
VVQADMGCAI

SEQ ID NO: 68209 - protein, 10 aa, Dengue virus
VQADMGCAIN

SEQ ID NO: 68210 - protein, 10 aa, Dengue virus
QADMGCAINW

SEQ ID NO: 68211 - protein, 10 aa, Dengue virus
ADMGCAINWK

SEQ ID NO: 68212 - protein, 10 aa, Dengue virus
DMGCAINWKG

SEQ ID NO: 68213 - protein, 10 aa, Dengue virus
MGCAINWKGK

SEQ ID NO: 68214 - protein, 10 aa, Dengue virus
GCVVNWKGKE

SEQ ID NO: 68215 - protein, 10 aa, Dengue virus
CVVNWKGKEL

SEQ ID NO: 68216 - protein, 10 aa, Dengue virus
VVNWKGKELK

SEQ ID NO: 68217 - protein, 10 aa, Dengue virus
LNHILWENNI

SEQ ID NO: 68218 - protein, 10 aa, Dengue virus
NHILWENNIK

SEQ ID NO: 68219 - protein, 10 aa, Dengue virus
YILWENSIKL

SEQ ID NO: 68220 - protein, 10 aa, Dengue virus
ILWENSIKLT

SEQ ID NO: 68221 - protein, 10 aa, Dengue virus
LWENNVKLTV

SEQ ID NO: 68222 - protein, 10 aa, Dengue virus
WENNVKLTVV

SEQ ID NO: 68223 - protein, 10 aa, Dengue virus
ENNVKLTVVV

SEQ ID NO: 68224 - protein, 10 aa, Dengue virus
NNVKLTVVVG

SEQ ID NO: 68225 - protein, 10 aa, Dengue virus
NVKLTVVVGD

SEQ ID NO: 68226 - protein, 10 aa, Dengue virus
IKLTIVVGDV

SEQ ID NO: 68227 - protein, 10 aa, Dengue virus
LTVVVGDITG

SEQ ID NO: 68228 - protein, 10 aa, Dengue virus
TGVLEQGKRT

SEQ ID NO: 68229 - protein, 10 aa, Dengue virus
GVLEQGKRAL

SEQ ID NO: 68230 - protein, 10 aa, Dengue virus
VLEQGKRALT

SEQ ID NO: 68231 - protein, 10 aa, Dengue virus
LEQGKRILTP

SEQ ID NO: 68232 - protein, 10 aa, Dengue virus
EQGKRILTPQ

SEQ ID NO: 68233 - protein, 10 aa, Dengue virus
QGKRTLTLQP

SEQ ID NO: 68234 - protein, 10 aa, Dengue virus
GKRTLTLQPM

SEQ ID NO: 68235 - protein, 10 aa, Dengue virus
KRILTPQPME

SEQ ID NO: 68236 - protein, 10 aa, Dengue virus
RILTPQPMEL

SEQ ID NO: 68237 - protein, 10 aa, Dengue virus
ILTPQPMELK

SEQ ID NO: 68238 - protein, 10 aa, Dengue virus
LIPQPMELKY

SEQ ID NO: 68239 - protein, 10 aa, Dengue virus
PPQPMELKYS

SEQ ID NO: 68240 - protein, 10 aa, Dengue virus
YSWKAWGKAK

SEQ ID NO: 68241 - protein, 10 aa, Dengue virus
SWKTWGKAKV

SEQ ID NO: 68242 - protein, 10 aa, Dengue virus
WKTWGKAKVV

SEQ ID NO: 68243 - protein, 10 aa, Dengue virus
WGKAKIVIAE

SEQ ID NO: 68244 - protein, 10 aa, Dengue virus
AETQNFSFII

SEQ ID NO: 68245 - protein, 10 aa, Dengue virus
ETQNFSFIID

SEQ ID NO: 68246 - protein, 10 aa, Dengue virus
TQNFSFIIDG

SEQ ID NO: 68247 - protein, 10 aa, Dengue virus
NFSFIIDGPN

SEQ ID NO: 68248 - protein, 10 aa, Dengue virus
FSFIIDGPNT

SEQ ID NO: 68249 - protein, 10 aa, Dengue virus
DGPSTPECPS

SEQ ID NO: 68250 - protein, 10 aa, Dengue virus
GPNTPECPSV

SEQ ID NO: 68251 - protein, 10 aa, Dengue virus
PSVSRAWNVW

SEQ ID NO: 68252 - protein, 10 aa, Dengue virus
SVSRAWNVWE

SEQ ID NO: 68253 - protein, 10 aa, Dengue virus
TSRAWNVWEV

SEQ ID NO: 68254 - protein, 10 aa, Dengue virus
TNIWLKLREA

SEQ ID NO: 68255 - protein, 10 aa, Dengue virus
NIWLKLREVH

SEQ ID NO: 68256 - protein, 10 aa, Dengue virus
IWLKLREVHT

SEQ ID NO: 68257 - protein, 10 aa, Dengue virus
WLKLREVHTQ

SEQ ID NO: 68258 - protein, 10 aa, Dengue virus
TQTCDHRLMS

SEQ ID NO: 68259 - protein, 10 aa, Dengue virus
QTCDHRLMSA

SEQ ID NO: 68260 - protein, 10 aa, Dengue virus
TCDHRLMSAA

SEQ ID NO: 68261 - protein, 10 aa, Dengue virus
YCEGTTVVIS

SEQ ID NO: 68262 - protein, 10 aa, Dengue virus
CEGTTVVISE

SEQ ID NO: 68263 - protein, 10 aa, Dengue virus
EGTTVVIAEN

SEQ ID NO: 68264 - protein, 10 aa, Dengue virus
GTTVVIAENC

SEQ ID NO: 68265 - protein, 10 aa, Dengue virus
TTVVIAENCG

SEQ ID NO: 68266 - protein, 10 aa, Dengue virus
TVVIAENCGT

SEQ ID NO: 68267 - protein, 10 aa, Dengue virus
CGTRGPSLRA

SEQ ID NO: 68268 - protein, 10 aa, Dengue virus
GIRGPSLRTT

SEQ ID NO: 68269 - protein, 10 aa, Dengue virus
TRGPSLRATT

SEQ ID NO: 68270 - protein, 10 aa, Dengue virus
GGPSLRTTTV

SEQ ID NO: 68271 - protein, 10 aa, Dengue virus
WYGMEIRPVN

SEQ ID NO: 68272 - protein, 10 aa, Dengue virus
YGMEIRPVNE

SEQ ID NO: 68273 - protein, 10 aa, Dengue virus
GMEIRPVNEK

SEQ ID NO: 68274 - protein, 10 aa, Dengue virus
MEIRPVNEKE

SEQ ID NO: 68275 - protein, 10 aa, Dengue virus
EIRPVNEKEE

SEQ ID NO: 68276 - protein, 10 aa, Dengue virus
IRPVNEKEEN

SEQ ID NO: 68277 - protein, 10 aa, Dengue virus
RPVNEKEENM

SEQ ID NO: 68278 - protein, 10 aa, Dengue virus
PVNEKEENMV

SEQ ID NO: 68279 - protein, 10 aa, Dengue virus
VNEKEENMVK

SEQ ID NO: 68280 - protein, 10 aa, Dengue virus
KSLASAGSGK

SEQ ID NO: 68281 - protein, 10 aa, Dengue virus
SLVSAGSGKM

SEQ ID NO: 68282 - protein, 10 aa, Dengue virus
LVSAGSGKMD

SEQ ID NO: 68283 - protein, 10 aa, Dengue virus
VSAGSGKMDN

SEQ ID NO: 68284 - protein, 10 aa, Dengue virus
SAGSGKMDNF

SEQ ID NO: 68285 - protein, 10 aa, Dengue virus
AGSGKMDNFT

SEQ ID NO: 68286 - protein, 10 aa, Dengue virus
GSGKMDNFTM

SEQ ID NO: 68287 - protein, 10 aa, Dengue virus
SGKMDNFTMG

SEQ ID NO: 68288 - protein, 10 aa, Dengue virus
ADNFTMGVLC

SEQ ID NO: 68289 - protein, 10 aa, Dengue virus
TMGALCLAIL

SEQ ID NO: 68290 - protein, 10 aa, Dengue virus
MGALCLAILF

SEQ ID NO: 68291 - protein, 10 aa, Dengue virus
GALCLAILFE

SEQ ID NO: 68292 - protein, 10 aa, Dengue virus
ALCLAILFEE

SEQ ID NO: 68293 - protein, 10 aa, Dengue virus
FGKKHMIAGA

SEQ ID NO: 68294 - protein, 10 aa, Dengue virus
LTFVLLLSGQ

SEQ ID NO: 68295 - protein, 10 aa, Dengue virus
IFVLLLSGQI

SEQ ID NO: 68296 - protein, 10 aa, Dengue virus
LSGQIKWRDM

SEQ ID NO: 68297 - protein, 10 aa, Dengue virus
SGQITWRDLA

SEQ ID NO: 68298 - protein, 10 aa, Dengue virus
THTLIMIGSN

SEQ ID NO: 68299 - protein, 10 aa, Dengue virus
HTFIMIGSNA

SEQ ID NO: 68300 - protein, 10 aa, Dengue virus
TLIMIGSNAT

SEQ ID NO: 68301 - protein, 10 aa, Dengue virus
LIMIGSNATD

SEQ ID NO: 68302 - protein, 10 aa, Dengue virus
IMIGSNATDR

SEQ ID NO: 68303 - protein, 10 aa, Dengue virus
MIGSNASDKM

SEQ ID NO: 68304 - protein, 10 aa, Dengue virus
IGSNASDKMG

SEQ ID NO: 68305 - protein, 10 aa, Dengue virus
GSNASDKMGM

SEQ ID NO: 68306 - protein, 10 aa, Dengue virus
SNASDKMGMG

SEQ ID NO: 68307 - protein, 10 aa, Dengue virus
NATDRMGMGV

SEQ ID NO: 68308 - protein, 10 aa, Dengue virus
ASDKMGMGVT

SEQ ID NO: 68309 - protein, 10 aa, Dengue virus
SDKMGMGVTY

SEQ ID NO: 68310 - protein, 10 aa, Dengue virus
YLALIATFKV

SEQ ID NO: 68311 - protein, 10 aa, Dengue virus
AMTTTLQLPE

SEQ ID NO: 68312 - protein, 10 aa, Dengue virus
MTTTLQLPED

SEQ ID NO: 68313 - protein, 10 aa, Dengue virus
ATTLQLPADI

SEQ ID NO: 68314 - protein, 10 aa, Dengue virus
TTLQLPADIE

SEQ ID NO: 68315 - protein, 10 aa, Dengue virus
TLQLPADIEQ

SEQ ID NO: 68316 - protein, 10 aa, Dengue virus
ALGLMALKLT

SEQ ID NO: 68317 - protein, 10 aa, Dengue virus
LGLMALKLTT

SEQ ID NO: 68318 - protein, 10 aa, Dengue virus
GLMALKLTTQ

SEQ ID NO: 68319 - protein, 10 aa, Dengue virus
LMALKLTTQF

SEQ ID NO: 68320 - protein, 10 aa, Dengue virus
MALKLTTQFE

SEQ ID NO: 68321 - protein, 10 aa, Dengue virus
ALKLTTQFET

SEQ ID NO: 68322 - protein, 10 aa, Dengue virus
ETYQLWAALV

SEQ ID NO: 68323 - protein, 10 aa, Dengue virus
TYQLWAALVS

SEQ ID NO: 68324 - protein, 10 aa, Dengue virus
YQLWAALVSL

SEQ ID NO: 68325 - protein, 10 aa, Dengue virus
QLWTALVSLM

SEQ ID NO: 68326 - protein, 10 aa, Dengue virus
LWTALVSLMC

SEQ ID NO: 68327 - protein, 10 aa, Dengue virus
ALVSLMCSNT

SEQ ID NO: 68328 - protein, 10 aa, Dengue virus
SLMCSNTIFT

SEQ ID NO: 68329 - protein, 10 aa, Dengue virus
LMCSNTIFTL

SEQ ID NO: 68330 - protein, 10 aa, Dengue virus
MCSNTIFTLT

SEQ ID NO: 68331 - protein, 10 aa, Dengue virus
CANTIFTLTV

SEQ ID NO: 68332 - protein, 10 aa, Dengue virus
ANTIFTLTVA

SEQ ID NO: 68333 - protein, 10 aa, Dengue virus
RTATLILAVI

SEQ ID NO: 68334 - protein, 10 aa, Dengue virus
TATLILAVIS

SEQ ID NO: 68335 - protein, 10 aa, Dengue virus
ATLILAVISL

SEQ ID NO: 68336 - protein, 10 aa, Dengue virus
TLILAVISLL

SEQ ID NO: 68337 - protein, 10 aa, Dengue virus
LILAVISLLP

SEQ ID NO: 68338 - protein, 10 aa, Dengue virus
ISLLPVCQSS

SEQ ID NO: 68339 - protein, 10 aa, Dengue virus
SLLPMCQSSS

SEQ ID NO: 68340 - protein, 10 aa, Dengue virus
LLPMCQSSSM

SEQ ID NO: 68341 - protein, 10 aa, Dengue virus
VCQSSSMRKS

SEQ ID NO: 68342 - protein, 10 aa, Dengue virus
SMRKTDWLPV

SEQ ID NO: 68343 - protein, 10 aa, Dengue virus
MRKSDWLPMT

SEQ ID NO: 68344 - protein, 10 aa, Dengue virus
RKSDWLPMTV

SEQ ID NO: 68345 - protein, 10 aa, Dengue virus
KSDWLPMTVA

SEQ ID NO: 68346 - protein, 10 aa, Dengue virus
SDWLPMTVAA

SEQ ID NO: 68347 - protein, 10 aa, Dengue virus
DWLPVAVAAM

SEQ ID NO: 68348 - protein, 10 aa, Dengue virus
WLPVAVAAMG

SEQ ID NO: 68349 - protein, 10 aa, Dengue virus
LPVAVAAMGV

SEQ ID NO: 68350 - protein, 10 aa, Dengue virus
VAAMGAQPLP

SEQ ID NO: 68351 - protein, 10 aa, Dengue virus
AAMGAQPLPL

SEQ ID NO: 68352 - protein, 10 aa, Dengue virus
AMGAQPLPLF

SEQ ID NO: 68353 - protein, 10 aa, Dengue virus
MGAQPLPLFI

SEQ ID NO: 68354 - protein, 10 aa, Dengue virus
GAQPLPLFIF

SEQ ID NO: 68355 - protein, 10 aa, Dengue virus
PLPLFIFNLK

SEQ ID NO: 68356 - protein, 10 aa, Dengue virus
LPLFIFGLKD

SEQ ID NO: 68357 - protein, 10 aa, Dengue virus
PLFIFSLKDA

SEQ ID NO: 68358 - protein, 10 aa, Dengue virus
LKDTPKRKSW

SEQ ID NO: 68359 - protein, 10 aa, Dengue virus
KDTPKRKSWP

SEQ ID NO: 68360 - protein, 10 aa, Dengue virus
DTPKRKSWPL

SEQ ID NO: 68361 - protein, 10 aa, Dengue virus
TPKRKSWPLN

SEQ ID NO: 68362 - protein, 10 aa, Dengue virus
PKRKSWPLNE

SEQ ID NO: 68363 - protein, 10 aa, Dengue virus
TSADLTVEKV

SEQ ID NO: 68364 - protein, 10 aa, Dengue virus
SADLTVEKVA

SEQ ID NO: 68365 - protein, 10 aa, Dengue virus
ADLTVEKVAD

SEQ ID NO: 68366 - protein, 10 aa, Dengue virus
AEVTWEEEAE

SEQ ID NO: 68367 - protein, 10 aa, Dengue virus
EVTWEEEAEQ

SEQ ID NO: 68368 - protein, 10 aa, Dengue virus
ITVDDDGTMK

SEQ ID NO: 68369 - protein, 10 aa, Dengue virus
VWHTWQKRTQ

SEQ ID NO: 68370 - protein, 10 aa, Dengue virus
WHTWQKRTQR

SEQ ID NO: 68371 - protein, 10 aa, Dengue virus
HTWQKRTQRS

SEQ ID NO: 68372 - protein, 10 aa, Dengue virus
TWQKRTQRSG

SEQ ID NO: 68373 - protein, 10 aa, Dengue virus
AYNGKRLEPN

SEQ ID NO: 68374 - protein, 10 aa, Dengue virus
ISYGGGWKLS

SEQ ID NO: 68375 - protein, 10 aa, Dengue virus
SYGGGWKLSA

SEQ ID NO: 68376 - protein, 10 aa, Dengue virus
YGGGWKLSAQ

SEQ ID NO: 68377 - protein, 10 aa, Dengue virus
GGGWKLSAQW

SEQ ID NO: 68378 - protein, 10 aa, Dengue virus
GGWKLSAQWQ

SEQ ID NO: 68379 - protein, 10 aa, Dengue virus
GWKLSAQWQK

SEQ ID NO: 68380 - protein, 10 aa, Dengue virus
WKLSAQWQKG

SEQ ID NO: 68381 - protein, 10 aa, Dengue virus
KLSAQWQKGE

SEQ ID NO: 68382 - protein, 10 aa, Dengue virus
LSTQWQKGEE

SEQ ID NO: 68383 - protein, 10 aa, Dengue virus
STQWQKGEEV

SEQ ID NO: 68384 - protein, 10 aa, Dengue virus
AQWKKGEEVQ

SEQ ID NO: 68385 - protein, 10 aa, Dengue virus
QWQRGEEVQV

SEQ ID NO: 68386 - protein, 10 aa, Dengue virus
PKNFQTTPGT

SEQ ID NO: 68387 - protein, 10 aa, Dengue virus
KNFQTTPGTF

SEQ ID NO: 68388 - protein, 10 aa, Dengue virus
NFQTTPGTFQ

SEQ ID NO: 68389 - protein, 10 aa, Dengue virus
FQTTPGTFQT

SEQ ID NO: 68390 - protein, 10 aa, Dengue virus
QTTPGTFQTT

SEQ ID NO: 68391 - protein, 10 aa, Dengue virus
PGIFQTTMGE

SEQ ID NO: 68392 - protein, 10 aa, Dengue virus
GIFQTTMGEI

SEQ ID NO: 68393 - protein, 10 aa, Dengue virus
IFQTTMGEIG

SEQ ID NO: 68394 - protein, 10 aa, Dengue virus
QTITGEIGAI

SEQ ID NO: 68395 - protein, 10 aa, Dengue virus
TITGEIGAIA

SEQ ID NO: 68396 - protein, 10 aa, Dengue virus
TTGEIGAVAL

SEQ ID NO: 68397 - protein, 10 aa, Dengue virus
LPIRYQTTVT

SEQ ID NO: 68398 - protein, 10 aa, Dengue virus
PIRYQTSATK

SEQ ID NO: 68399 - protein, 10 aa, Dengue virus
IRYQTTVTKS

SEQ ID NO: 68400 - protein, 10 aa, Dengue virus
RYQTTATRSE

SEQ ID NO: 68401 - protein, 10 aa, Dengue virus
YQTTATRSEH

SEQ ID NO: 68402 - protein, 10 aa, Dengue virus
QTTVTKSEHT

SEQ ID NO: 68403 - protein, 10 aa, Dengue virus
TTATRSEHTG

SEQ ID NO: 68404 - protein, 10 aa, Dengue virus
TAIKSEHTGR

SEQ ID NO: 68405 - protein, 10 aa, Dengue virus
AIKSEHTGRE

SEQ ID NO: 68406 - protein, 10 aa, Dengue virus
IKSEHTGREI

SEQ ID NO: 68407 - protein, 10 aa, Dengue virus
VRVPNYNLIV

SEQ ID NO: 68408 - protein, 10 aa, Dengue virus
RVPNYNLIVM

SEQ ID NO: 68409 - protein, 10 aa, Dengue virus
VPNYNLIVMD

SEQ ID NO: 68410 - protein, 10 aa, Dengue virus
PNYNLIVMDE

SEQ ID NO: 68411 - protein, 10 aa, Dengue virus
NYNLIVMDEA

SEQ ID NO: 68412 - protein, 10 aa, Dengue virus
YNLIVMDEAH

SEQ ID NO: 68413 - protein, 10 aa, Dengue virus
NLIVMDEAHF

SEQ ID NO: 68414 - protein, 10 aa, Dengue virus
LIVMDEAHFT

SEQ ID NO: 68415 - protein, 10 aa, Dengue virus
IVMDEAHFTD

SEQ ID NO: 68416 - protein, 10 aa, Dengue virus
SGNDWITDFA

SEQ ID NO: 68417 - protein, 10 aa, Dengue virus
GNDWITDFAG

SEQ ID NO: 68418 - protein, 10 aa, Dengue virus
NDWITDFAGK

SEQ ID NO: 68419 - protein, 10 aa, Dengue virus
DWITDFAGKT

SEQ ID NO: 68420 - protein, 10 aa, Dengue virus
WITDFTGKTV

SEQ ID NO: 68421 - protein, 10 aa, Dengue virus
ITDFTGKTVW

SEQ ID NO: 68422 - protein, 10 aa, Dengue virus
TDFTGKTVWF

SEQ ID NO: 68423 - protein, 10 aa, Dengue virus
DFTGKTVWFV

SEQ ID NO: 68424 - protein, 10 aa, Dengue virus
FTGKTVWFVP

SEQ ID NO: 68425 - protein, 10 aa, Dengue virus
TGKTVWFVPS

SEQ ID NO: 68426 - protein, 10 aa, Dengue virus
VGRNSQKEND

SEQ ID NO: 68427 - protein, 10 aa, Dengue virus
GRNSQKENDQ

SEQ ID NO: 68428 - protein, 10 aa, Dengue virus
RNSQKENDQY

SEQ ID NO: 68429 - protein, 10 aa, Dengue virus
NSQKENDQYI

SEQ ID NO: 68430 - protein, 10 aa, Dengue virus
SQKENDQYIF

SEQ ID NO: 68431 - protein, 10 aa, Dengue virus
PKENDQYIFT

SEQ ID NO: 68432 - protein, 10 aa, Dengue virus
IGRVPSHLAY

SEQ ID NO: 68433 - protein, 10 aa, Dengue virus
GRVPSHLAYR

SEQ ID NO: 68434 - protein, 10 aa, Dengue virus
RVPSHLAYRT

SEQ ID NO: 68435 - protein, 10 aa, Dengue virus
VPSHLAYRTR

SEQ ID NO: 68436 - protein, 10 aa, Dengue virus
PSHLAYRTRN

SEQ ID NO: 68437 - protein, 10 aa, Dengue virus
SHLAYRTRNA

SEQ ID NO: 68438 - protein, 10 aa, Dengue virus
HLAHRTKNAL

SEQ ID NO: 68439 - protein, 10 aa, Dengue virus
LAHKTRNALD

SEQ ID NO: 68440 - protein, 10 aa, Dengue virus
AYRTRSALDN

SEQ ID NO: 68441 - protein, 10 aa, Dengue virus
LTGGAMLFLV

SEQ ID NO: 68442 - protein, 10 aa, Dengue virus
TGGAMLFLVS

SEQ ID NO: 68443 - protein, 10 aa, Dengue virus
GGAMLFLVSG

SEQ ID NO: 68444 - protein, 10 aa, Dengue virus
GAMLFLISGR

SEQ ID NO: 68445 - protein, 10 aa, Dengue virus
AMLFLISGRG

SEQ ID NO: 68446 - protein, 10 aa, Dengue virus
MLFLISGRGI

SEQ ID NO: 68447 - protein, 10 aa, Dengue virus
LFLISGRGIG

SEQ ID NO: 68448 - protein, 10 aa, Dengue virus
FLISGRGIGK

SEQ ID NO: 68449 - protein, 10 aa, Dengue virus
LVSGKGIGKT

SEQ ID NO: 68450 - protein, 10 aa, Dengue virus
ISGRGIGKAS

SEQ ID NO: 68451 - protein, 10 aa, Dengue virus
SGKGIGKTTI

SEQ ID NO: 68452 - protein, 10 aa, Dengue virus
GKGIGKTTIG

SEQ ID NO: 68453 - protein, 10 aa, Dengue virus
KGIGKTTIGL

SEQ ID NO: 68454 - protein, 10 aa, Dengue virus
GIGKTTIGLI

SEQ ID NO: 68455 - protein, 10 aa, Dengue virus
IGKTTIGLIC

SEQ ID NO: 68456 - protein, 10 aa, Dengue virus
GKASIGLICV

SEQ ID NO: 68457 - protein, 10 aa, Dengue virus
KTTIGLICVI

SEQ ID NO: 68458 - protein, 10 aa, Dengue virus
TSIGLICVVA

SEQ ID NO: 68459 - protein, 10 aa, Dengue virus
SIGLICVVAS

SEQ ID NO: 68460 - protein, 10 aa, Dengue virus
IGLICVVASS

SEQ ID NO: 68461 - protein, 10 aa, Dengue virus
GLICVVASSG

SEQ ID NO: 68462 - protein, 10 aa, Dengue virus
LICVVASSGM

SEQ ID NO: 68463 - protein, 10 aa, Dengue virus
ICVVASSGML

SEQ ID NO: 68464 - protein, 10 aa, Dengue virus
CVVASSGMLW

SEQ ID NO: 68465 - protein, 10 aa, Dengue virus
VVASSGMLWM

SEQ ID NO: 68466 - protein, 10 aa, Dengue virus
VASSGMLWMA

SEQ ID NO: 68467 - protein, 10 aa, Dengue virus
ASSGMLWMAD

SEQ ID NO: 68468 - protein, 10 aa, Dengue virus
SSGMLWMAEV

SEQ ID NO: 68469 - protein, 10 aa, Dengue virus
SGMLWMAEVP

SEQ ID NO: 68470 - protein, 10 aa, Dengue virus
GMLWMAEVPL

SEQ ID NO: 68471 - protein, 10 aa, Dengue virus
MLWMAEVPLQ

SEQ ID NO: 68472 - protein, 10 aa, Dengue virus
LWMAEVPLQW

SEQ ID NO: 68473 - protein, 10 aa, Dengue virus
WMAEVPLQWI

SEQ ID NO: 68474 - protein, 10 aa, Dengue virus
MAEVPLQWIA

SEQ ID NO: 68475 - protein, 10 aa, Dengue virus
AEVPLQWIAS

SEQ ID NO: 68476 - protein, 10 aa, Dengue virus
EVPLQWIASA

SEQ ID NO: 68477 - protein, 10 aa, Dengue virus
IGILTLAATI

SEQ ID NO: 68478 - protein, 10 aa, Dengue virus
GILTLAAIVT

SEQ ID NO: 68479 - protein, 10 aa, Dengue virus
ILTLAAIVTA

SEQ ID NO: 68480 - protein, 10 aa, Dengue virus
LTLAAIVTAN

SEQ ID NO: 68481 - protein, 10 aa, Dengue virus
TLAAIVTANE

SEQ ID NO: 68482 - protein, 10 aa, Dengue virus
LAAIVTANEM

SEQ ID NO: 68483 - protein, 10 aa, Dengue virus
AAIVTANEMG

SEQ ID NO: 68484 - protein, 10 aa, Dengue virus
AIVTANEMGL

SEQ ID NO: 68485 - protein, 10 aa, Dengue virus
IVTANEMGLL

SEQ ID NO: 68486 - protein, 10 aa, Dengue virus
VTANEMGLLE

SEQ ID NO: 68487 - protein, 10 aa, Dengue virus
KDLGMSKEPG

SEQ ID NO: 68488 - protein, 10 aa, Dengue virus
LGMSREPGVV

SEQ ID NO: 68489 - protein, 10 aa, Dengue virus
GMSREPGVVS

SEQ ID NO: 68490 - protein, 10 aa, Dengue virus
MSKEPGVVSS

SEQ ID NO: 68491 - protein, 10 aa, Dengue virus
EPGVVSSTSY

SEQ ID NO: 68492 - protein, 10 aa, Dengue virus
PGVVSSTSYL

SEQ ID NO: 68493 - protein, 10 aa, Dengue virus
GVVSSTSYLD

SEQ ID NO: 68494 - protein, 10 aa, Dengue virus
VVSSTSYLDV

SEQ ID NO: 68495 - protein, 10 aa, Dengue virus
VSSTSYLDVD

SEQ ID NO: 68496 - protein, 10 aa, Dengue virus
SPNSYLDVDL

SEQ ID NO: 68497 - protein, 10 aa, Dengue virus
PNSYLDVDLH

SEQ ID NO: 68498 - protein, 10 aa, Dengue virus
QVNPLTLIAA

SEQ ID NO: 68499 - protein, 10 aa, Dengue virus
VNPLTLIAAV

SEQ ID NO: 68500 - protein, 10 aa, Dengue virus
NPLTLIAAVL

SEQ ID NO: 68501 - protein, 10 aa, Dengue virus
PLTLIAAVLL

SEQ ID NO: 68502 - protein, 10 aa, Dengue virus
LTLIAAVLLL

SEQ ID NO: 68503 - protein, 10 aa, Dengue virus
TLTAVVLLLV

SEQ ID NO: 68504 - protein, 10 aa, Dengue virus
LTAVVLLLVT

SEQ ID NO: 68505 - protein, 10 aa, Dengue virus
TAVVLLLVTH

SEQ ID NO: 68506 - protein, 10 aa, Dengue virus
AVVLLLVTHY

SEQ ID NO: 68507 - protein, 10 aa, Dengue virus
VVLLLVTHYA

SEQ ID NO: 68508 - protein, 10 aa, Dengue virus
QVMLLILCAV

SEQ ID NO: 68509 - protein, 10 aa, Dengue virus
VMLLVLCVVQ

SEQ ID NO: 68510 - protein, 10 aa, Dengue virus
MLLILCAVQL

SEQ ID NO: 68511 - protein, 10 aa, Dengue virus
LLVLCVVQLL

SEQ ID NO: 68512 - protein, 10 aa, Dengue virus
LVLCVVQLLL

SEQ ID NO: 68513 - protein, 10 aa, Dengue virus
ILCAVQLLLM

SEQ ID NO: 68514 - protein, 10 aa, Dengue virus
MRTSWALCEV

SEQ ID NO: 68515 - protein, 10 aa, Dengue virus
RTSWALCEVL

SEQ ID NO: 68516 - protein, 10 aa, Dengue virus
TSWALCEVLT

SEQ ID NO: 68517 - protein, 10 aa, Dengue virus
SWALCEVLTL

SEQ ID NO: 68518 - protein, 10 aa, Dengue virus
WALCEVLTLA

SEQ ID NO: 68519 - protein, 10 aa, Dengue virus
ALCEVLTLAT

SEQ ID NO: 68520 - protein, 10 aa, Dengue virus
LCEVLTLATG

SEQ ID NO: 68521 - protein, 10 aa, Dengue virus
SVMKSVGTGK

SEQ ID NO: 68522 - protein, 10 aa, Dengue virus
VMKSVGTGKR

SEQ ID NO: 68523 - protein, 10 aa, Dengue virus
VGTGKRGTGL

SEQ ID NO: 68524 - protein, 10 aa, Dengue virus
GTGKRGTGLQ

SEQ ID NO: 68525 - protein, 10 aa, Dengue virus
TGKRGTGTQG

SEQ ID NO: 68526 - protein, 10 aa, Dengue virus
ETLGEKWKRK

SEQ ID NO: 68527 - protein, 10 aa, Dengue virus
TLGEKWKRKL

SEQ ID NO: 68528 - protein, 10 aa, Dengue virus
LGEKWKRKLN

SEQ ID NO: 68529 - protein, 10 aa, Dengue virus
GEKWKRKLNQ

SEQ ID NO: 68530 - protein, 10 aa, Dengue virus
EKWKRKLNQL

SEQ ID NO: 68531 - protein, 10 aa, Dengue virus
KWKRKLNQLS

SEQ ID NO: 68532 - protein, 10 aa, Dengue virus
WKRKLNQLSR

SEQ ID NO: 68533 - protein, 10 aa, Dengue virus
KRKLNQLSRK

SEQ ID NO: 68534 - protein, 10 aa, Dengue virus
RLNQLSRKEF

SEQ ID NO: 68535 - protein, 10 aa, Dengue virus
LNQLSRREFD

SEQ ID NO: 68536 - protein, 10 aa, Dengue virus
NQLSRREFDL

SEQ ID NO: 68537 - protein, 10 aa, Dengue virus
QLSRREFDLY

SEQ ID NO: 68538 - protein, 10 aa, Dengue virus
LSWKEFDLYK

SEQ ID NO: 68539 - protein, 10 aa, Dengue virus
SRREFDLYKK

SEQ ID NO: 68540 - protein, 10 aa, Dengue virus
WKEFDLYKKS

SEQ ID NO: 68541 - protein, 10 aa, Dengue virus
KSGITEVDRS

SEQ ID NO: 68542 - protein, 10 aa, Dengue virus
SGITEVDRSE

SEQ ID NO: 68543 - protein, 10 aa, Dengue virus
GITEVDRSEA

SEQ ID NO: 68544 - protein, 10 aa, Dengue virus
ITEVDRSEAK

SEQ ID NO: 68545 - protein, 10 aa, Dengue virus
TEVDRSEAKE

SEQ ID NO: 68546 - protein, 10 aa, Dengue virus
EVDRSEAKEG

SEQ ID NO: 68547 - protein, 10 aa, Dengue virus
VDRSEAKEGL

SEQ ID NO: 68548 - protein, 10 aa, Dengue virus
DRSEAKEGLK

SEQ ID NO: 68549 - protein, 10 aa, Dengue virus
RSEAKEGLKR

SEQ ID NO: 68550 - protein, 10 aa, Dengue virus
SEAKEGLKRG

SEQ ID NO: 68551 - protein, 10 aa, Dengue virus
EAKEGLKKGE

SEQ ID NO: 68552 - protein, 10 aa, Dengue virus
AKEGLKKGEI

SEQ ID NO: 68553 - protein, 10 aa, Dengue virus
KEGLKKGEIT

SEQ ID NO: 68554 - protein, 10 aa, Dengue virus
KGEITHHAVS

SEQ ID NO: 68555 - protein, 10 aa, Dengue virus
GEITRHAVSR

SEQ ID NO: 68556 - protein, 10 aa, Dengue virus
EITRHAVSRG

SEQ ID NO: 68557 - protein, 10 aa, Dengue virus
TTHHAVSRGT

SEQ ID NO: 68558 - protein, 10 aa, Dengue virus
PMSTYGWNII

SEQ ID NO: 68559 - protein, 10 aa, Dengue virus
MSTYGWNIIK

SEQ ID NO: 68560 - protein, 10 aa, Dengue virus
STYGWNIIKL

SEQ ID NO: 68561 - protein, 10 aa, Dengue virus
TYGWNIIKLM

SEQ ID NO: 68562 - protein, 10 aa, Dengue virus
YGWNIIKLMS

SEQ ID NO: 68563 - protein, 10 aa, Dengue virus
GWNIIKLMSG

SEQ ID NO: 68564 - protein, 10 aa, Dengue virus
WNIIKLMSGK

SEQ ID NO: 68565 - protein, 10 aa, Dengue virus
NIIKLMSGKD

SEQ ID NO: 68566 - protein, 10 aa, Dengue virus
IIKLMSGKDV

SEQ ID NO: 68567 - protein, 10 aa, Dengue virus
VKLMTGKDVF

SEQ ID NO: 68568 - protein, 10 aa, Dengue virus
LKMVEPWLRS

SEQ ID NO: 68569 - protein, 10 aa, Dengue virus
KMVEPWLRSN

SEQ ID NO: 68570 - protein, 10 aa, Dengue virus
LKNNQFCIKI

SEQ ID NO: 68571 - protein, 10 aa, Dengue virus
KNNQFCIKIL

SEQ ID NO: 68572 - protein, 10 aa, Dengue virus
IKILNPYMPT

SEQ ID NO: 68573 - protein, 10 aa, Dengue virus
KILNPYMPTV

SEQ ID NO: 68574 - protein, 10 aa, Dengue virus
VLNPYMPTVV

SEQ ID NO: 68575 - protein, 10 aa, Dengue virus
LNPYMPTVVE

SEQ ID NO: 68576 - protein, 10 aa, Dengue virus
NPYMPTVVEH

SEQ ID NO: 68577 - protein, 10 aa, Dengue virus
PYMPTVVEHL

SEQ ID NO: 68578 - protein, 10 aa, Dengue virus
YMPTVVEHLE

SEQ ID NO: 68579 - protein, 10 aa, Dengue virus
MPTVVEHLER

SEQ ID NO: 68580 - protein, 10 aa, Dengue virus
PTVVEHLERL

SEQ ID NO: 68581 - protein, 10 aa, Dengue virus
TVVEHLERLQ

SEQ ID NO: 68582 - protein, 10 aa, Dengue virus
LNRFTMTYRK

SEQ ID NO: 68583 - protein, 10 aa, Dengue virus
NRFTMTYRKP

SEQ ID NO: 68584 - protein, 10 aa, Dengue virus
RFTMTYRKPT

SEQ ID NO: 68585 - protein, 10 aa, Dengue virus
FTMTYRKPTI

SEQ ID NO: 68586 - protein, 10 aa, Dengue virus
TMTYRKPTIE

SEQ ID NO: 68587 - protein, 10 aa, Dengue virus
MTYRKPTIEK

SEQ ID NO: 68588 - protein, 10 aa, Dengue virus
TYRKPTIEKD

SEQ ID NO: 68589 - protein, 10 aa, Dengue virus
YRKPTIEKDV

SEQ ID NO: 68590 - protein, 10 aa, Dengue virus
RRPTIERDVD

SEQ ID NO: 68591 - protein, 10 aa, Dengue virus
RPTIERDVDL

SEQ ID NO: 68592 - protein, 10 aa, Dengue virus
MDIIGERIRR

SEQ ID NO: 68593 - protein, 10 aa, Dengue virus
DVIGERVKRI

SEQ ID NO: 68594 - protein, 10 aa, Dengue virus
IIGERIRRIK

SEQ ID NO: 68595 - protein, 10 aa, Dengue virus
IGERIKRIKG

SEQ ID NO: 68596 - protein, 10 aa, Dengue virus
GERIKRIKGE

SEQ ID NO: 68597 - protein, 10 aa, Dengue virus
ERIKRIKGEH

SEQ ID NO: 68598 - protein, 10 aa, Dengue virus
RIKGEHSKTW

SEQ ID NO: 68599 - protein, 10 aa, Dengue virus
IKGEHSKTWH

SEQ ID NO: 68600 - protein, 10 aa, Dengue virus
KGEHSKTWHY

SEQ ID NO: 68601 - protein, 10 aa, Dengue virus
GEHSKTWHYD

SEQ ID NO: 68602 - protein, 10 aa, Dengue virus
EHSSTWHYDE

SEQ ID NO: 68603 - protein, 10 aa, Dengue virus
HSSTWHYDEE

SEQ ID NO: 68604 - protein, 10 aa, Dengue virus
SKTWHYDDEN

SEQ ID NO: 68605 - protein, 10 aa, Dengue virus
KPWDVVPMVI

SEQ ID NO: 68606 - protein, 10 aa, Dengue virus
PWDVVPMVIQ

SEQ ID NO: 68607 - protein, 10 aa, Dengue virus
WDVVPMVIQM

SEQ ID NO: 68608 - protein, 10 aa, Dengue virus
DVVPMVIQMA

SEQ ID NO: 68609 - protein, 10 aa, Dengue virus
VVPMVIQMAM

SEQ ID NO: 68610 - protein, 10 aa, Dengue virus
VPMVIQMAMT

SEQ ID NO: 68611 - protein, 10 aa, Dengue virus
PMVIQMAMTD

SEQ ID NO: 68612 - protein, 10 aa, Dengue virus
MVIQMAMTDT

SEQ ID NO: 68613 - protein, 10 aa, Dengue virus
EKVDTRTPKP

SEQ ID NO: 68614 - protein, 10 aa, Dengue virus
KVDTRTPKPM

SEQ ID NO: 68615 - protein, 10 aa, Dengue virus
VDTRTPKPMP

SEQ ID NO: 68616 - protein, 10 aa, Dengue virus
DTRTPKPMPG

SEQ ID NO: 68617 - protein, 10 aa, Dengue virus
TRTPKPMPGT

SEQ ID NO: 68618 - protein, 10 aa, Dengue virus
RTPKPMPGTR

SEQ ID NO: 68619 - protein, 10 aa, Dengue virus
AMEITAEWLW

SEQ ID NO: 68620 - protein, 10 aa, Dengue virus
MEITAGWLWR

SEQ ID NO: 68621 - protein, 10 aa, Dengue virus
EITAGWLWRT

SEQ ID NO: 68622 - protein, 10 aa, Dengue virus
FTRKVRTNAA

SEQ ID NO: 68623 - protein, 10 aa, Dengue virus
TRKVRTNAAM

SEQ ID NO: 68624 - protein, 10 aa, Dengue virus
SAKAAVEDEE

SEQ ID NO: 68625 - protein, 10 aa, Dengue virus
AKAAVEDEEF

SEQ ID NO: 68626 - protein, 10 aa, Dengue virus
KAAVEDEEFW

SEQ ID NO: 68627 - protein, 10 aa, Dengue virus
AAVEDEDFWI

SEQ ID NO: 68628 - protein, 10 aa, Dengue virus
AVEDEDFWIL

SEQ ID NO: 68629 - protein, 10 aa, Dengue virus
VEDEDFWILV

SEQ ID NO: 68630 - protein, 10 aa, Dengue virus
EDEDFWILVD

SEQ ID NO: 68631 - protein, 10 aa, Dengue virus
DEEFWKLVDK

SEQ ID NO: 68632 - protein, 10 aa, Dengue virus
EEFWKLVDKE

SEQ ID NO: 68633 - protein, 10 aa, Dengue virus
EFWKLVDKER

SEQ ID NO: 68634 - protein, 10 aa, Dengue virus
FWILVDRERE

SEQ ID NO: 68635 - protein, 10 aa, Dengue virus
WILVDREREL

SEQ ID NO: 68636 - protein, 10 aa, Dengue virus
ILVDRERELH

SEQ ID NO: 68637 - protein, 10 aa, Dengue virus
VDRERELHKQ

SEQ ID NO: 68638 - protein, 10 aa, Dengue virus
DRERELHKQG

SEQ ID NO: 68639 - protein, 10 aa, Dengue virus
RERELHKQGK

SEQ ID NO: 68640 - protein, 10 aa, Dengue virus
DDLHNEEKIM

SEQ ID NO: 68641 - protein, 10 aa, Dengue virus
DLHNEEKIMQ

SEQ ID NO: 68642 - protein, 10 aa, Dengue virus
LHNEEKIMQQ

SEQ ID NO: 68643 - protein, 10 aa, Dengue virus
HNEEKIMQQM

SEQ ID NO: 68644 - protein, 10 aa, Dengue virus
NEEKIMQQMD

SEQ ID NO: 68645 - protein, 10 aa, Dengue virus
EEKIMQQMDP

SEQ ID NO: 68646 - protein, 10 aa, Dengue virus
EKIMQQMDPE

SEQ ID NO: 68647 - protein, 10 aa, Dengue virus
KIMQQMDPEH

SEQ ID NO: 68648 - protein, 10 aa, Dengue virus
IMQQMDPEHR

SEQ ID NO: 68649 - protein, 10 aa, Dengue virus
QMDPEHRKLA

SEQ ID NO: 68650 - protein, 10 aa, Dengue virus
PEHRLLANAI

SEQ ID NO: 68651 - protein, 10 aa, Dengue virus
EHRLLANAIF

SEQ ID NO: 68652 - protein, 10 aa, Dengue virus
HRLLANAIFK

SEQ ID NO: 68653 - protein, 10 aa, Dengue virus
RLLANAIFKL

SEQ ID NO: 68654 - protein, 10 aa, Dengue virus
LLANAIFKLT

SEQ ID NO: 68655 - protein, 10 aa, Dengue virus
FTNMEVQLIR

SEQ ID NO: 68656 - protein, 10 aa, Dengue virus
TNMEVQLIRQ

SEQ ID NO: 68657 - protein, 10 aa, Dengue virus
NMEVQLIRQM

SEQ ID NO: 68658 - protein, 10 aa, Dengue virus
MEVQLIRQME

SEQ ID NO: 68659 - protein, 10 aa, Dengue virus
EVQLIRQMEG

SEQ ID NO: 68660 - protein, 10 aa, Dengue virus
VQLIRQMEGE

SEQ ID NO: 68661 - protein, 10 aa, Dengue virus
QMEGEGVLSE

SEQ ID NO: 68662 - protein, 10 aa, Dengue virus
MEGEGVLSKT

SEQ ID NO: 68663 - protein, 10 aa, Dengue virus
AQWLETKGVE

SEQ ID NO: 68664 - protein, 10 aa, Dengue virus
QWLENKGVER

SEQ ID NO: 68665 - protein, 10 aa, Dengue virus
WLENKGVERL

SEQ ID NO: 68666 - protein, 10 aa, Dengue virus
LETEGVERLK

SEQ ID NO: 68667 - protein, 10 aa, Dengue virus
ETEGVERLKR

SEQ ID NO: 68668 - protein, 10 aa, Dengue virus
TEGVERLKRM

SEQ ID NO: 68669 - protein, 10 aa, Dengue virus
EGVERLKRMA

SEQ ID NO: 68670 - protein, 10 aa, Dengue virus
LGKAYAQMWT

SEQ ID NO: 68671 - protein, 10 aa, Dengue virus
GKAYAQMWTL

SEQ ID NO: 68672 - protein, 10 aa, Dengue virus
KAYAQMWTLM

SEQ ID NO: 68673 - protein, 10 aa, Dengue virus
AYAQMWTLMY

SEQ ID NO: 68674 - protein, 10 aa, Dengue virus
YAQMWTLMYF

SEQ ID NO: 68675 - protein, 10 aa, Dengue virus
AQMWTLMYFH

SEQ ID NO: 68676 - protein, 10 aa, Dengue virus
QMWTLMYFHR

SEQ ID NO: 68677 - protein, 10 aa, Dengue virus
MWTLMYFHRR

SEQ ID NO: 68678 - protein, 10 aa, Dengue virus
WTLMYFHRRD

SEQ ID NO: 68679 - protein, 10 aa, Dengue virus
TLMYFHRRDL

SEQ ID NO: 68680 - protein, 10 aa, Dengue virus
ICSAVPAHWV

SEQ ID NO: 68681 - protein, 10 aa, Dengue virus
CSAVPAHWVP

SEQ ID NO: 68682 - protein, 10 aa, Dengue virus
SAVPAHWVPT

SEQ ID NO: 68683 - protein, 10 aa, Dengue virus
AVPAHWVPTS

SEQ ID NO: 68684 - protein, 10 aa, Dengue virus
VPAHWVPTSR

SEQ ID NO: 68685 - protein, 10 aa, Dengue virus
PAHWVPTSRT

SEQ ID NO: 68686 - protein, 10 aa, Dengue virus
AHWVPTSRTT

SEQ ID NO: 68687 - protein, 10 aa, Dengue virus
QWMTTEDMLS

SEQ ID NO: 68688 - protein, 10 aa, Dengue virus
WMTTEDMLSV

SEQ ID NO: 68689 - protein, 10 aa, Dengue virus
MTTEDMLSVW

SEQ ID NO: 68690 - protein, 10 aa, Dengue virus
TTEDMLSVWN

SEQ ID NO: 68691 - protein, 10 aa, Dengue virus
TEDMLSVWNR

SEQ ID NO: 68692 - protein, 10 aa, Dengue virus
EDMLSVWNRV

SEQ ID NO: 68693 - protein, 10 aa, Dengue virus
DMLSVWNRVW

SEQ ID NO: 68694 - protein, 10 aa, Dengue virus
MLSVWNRVWI

SEQ ID NO: 68695 - protein, 10 aa, Dengue virus
LSVWNRVWIE

SEQ ID NO: 68696 - protein, 10 aa, Dengue virus
AVWNRVWIED

SEQ ID NO: 68697 - protein, 10 aa, Dengue virus
PWMENKTPVT

SEQ ID NO: 68698 - protein, 10 aa, Dengue virus
WMENKTPVTT

SEQ ID NO: 68699 - protein, 10 aa, Dengue virus
MGDKTPVTTW

SEQ ID NO: 68700 - protein, 10 aa, Dengue virus
ENKTPVTTWE

SEQ ID NO: 68701 - protein, 10 aa, Dengue virus
DKTPITTWEN

SEQ ID NO: 68702 - protein, 10 aa, Dengue virus
KTPITTWENV

SEQ ID NO: 68703 - protein, 10 aa, Dengue virus
TPITTWENVP

SEQ ID NO: 68704 - protein, 10 aa, Dengue virus
PITTWENVPY

SEQ ID NO: 68705 - protein, 10 aa, Dengue virus
ITTWENVPYL

SEQ ID NO: 68706 - protein, 10 aa, Dengue virus
RATWAQNILI

SEQ ID NO: 68707 - protein, 10 aa, Dengue virus
ATWAQNILIA

SEQ ID NO: 68708 - protein, 10 aa, Dengue virus
TWAQNILIAI

SEQ ID NO: 68709 - protein, 10 aa, Dengue virus
WAQNILIAIQ

SEQ ID NO: 68710 - protein, 10 aa, Dengue virus
AQNILIAIQQ

SEQ ID NO: 68711 - protein, 10 aa, Dengue virus
QNILIAIQQV

SEQ ID NO: 68712 - protein, 10 aa, Dengue virus
NILIAIQQVR

SEQ ID NO: 68713 - protein, 10 aa, Dengue virus
ILIAIQQVRS

SEQ ID NO: 68714 - protein, 10 aa, Dengue virus
LIAIQQVRSL

SEQ ID NO: 68715 - protein, 10 aa, Dengue virus
MKRFRKEEET

SEQ ID NO: 68716 - protein, 10 aa, Dengue virus
KRFRKEEETE

SEQ ID NO: 68717 - protein, 10 aa, Dengue virus
RFRKEEETEG

SEQ ID NO: 68718 - protein, 10 aa, Dengue virus
FRKEEETEGA

SEQ ID NO: 68719 - protein, 10 aa, Dengue virus
RKEEETEGAI

SEQ ID NO: 68720 - protein, 10 aa, Dengue virus
KEEETEGAIW

SEQ ID NO: 68721 - protein, 10 aa, Dengue virus
AIKVLKSFKK

SEQ ID NO: 68722 - protein, 10 aa, Dengue virus
IKVLKSFKKE

SEQ ID NO: 68723 - protein, 10 aa, Dengue virus
KVLKSFKKEI

SEQ ID NO: 68724 - protein, 10 aa, Dengue virus
VLKSFKKEIS

SEQ ID NO: 68725 - protein, 10 aa, Dengue virus
LKSFKKEISN

SEQ ID NO: 68726 - protein, 10 aa, Dengue virus
KSFKKEISNM

SEQ ID NO: 68727 - protein, 10 aa, Dengue virus
SMLSIINRRK

SEQ ID NO: 68728 - protein, 10 aa, Dengue virus
RKRTSLCLMM

SEQ ID NO: 68729 - protein, 10 aa, Dengue virus
MMFPATLAFH

SEQ ID NO: 68730 - protein, 10 aa, Dengue virus
MFPATLAFHL

SEQ ID NO: 68731 - protein, 10 aa, Dengue virus
DDTITYKCPL

SEQ ID NO: 68732 - protein, 10 aa, Dengue virus
DTITYKCPLI

SEQ ID NO: 68733 - protein, 10 aa, Dengue virus
LAHYISTSLT

SEQ ID NO: 68734 - protein, 10 aa, Dengue virus
AHYISTSLTQ

SEQ ID NO: 68735 - protein, 10 aa, Dengue virus
HYISTSLTQK

SEQ ID NO: 68736 - protein, 10 aa, Dengue virus
YVGTSLTQKV

SEQ ID NO: 68737 - protein, 10 aa, Dengue virus
VGTSLTQKVV

SEQ ID NO: 68738 - protein, 10 aa, Dengue virus
SLTQKVVIFT

SEQ ID NO: 68739 - protein, 10 aa, Dengue virus
LIQKVVIFIL

SEQ ID NO: 68740 - protein, 10 aa, Dengue virus
IQKVVIFILL

SEQ ID NO: 68741 - protein, 10 aa, Dengue virus
QKVVIFTLLM

SEQ ID NO: 68742 - protein, 10 aa, Dengue virus
KVVIFTLLML

SEQ ID NO: 68743 - protein, 10 aa, Dengue virus
VVIFTLLMLV

SEQ ID NO: 68744 - protein, 10 aa, Dengue virus
SRCPTQGEAA

SEQ ID NO: 68745 - protein, 10 aa, Dengue virus
RCPTQGEAAL

SEQ ID NO: 68746 - protein, 10 aa, Dengue virus
CPTQGEAALP

SEQ ID NO: 68747 - protein, 10 aa, Dengue virus
PTQGEAALPE

SEQ ID NO: 68748 - protein, 10 aa, Dengue virus
TQGEAALPEE

SEQ ID NO: 68749 - protein, 10 aa, Dengue virus
QGEAALPEEQ

SEQ ID NO: 68750 - protein, 10 aa, Dengue virus
GEAALPEEQD

SEQ ID NO: 68751 - protein, 10 aa, Dengue virus
EAALPEEQDQ

SEQ ID NO: 68752 - protein, 10 aa, Dengue virus
AALPEEQDQN

SEQ ID NO: 68753 - protein, 10 aa, Dengue virus
ALPEEQDQNY

SEQ ID NO: 68754 - protein, 10 aa, Dengue virus
CAKFQCLEPV

SEQ ID NO: 68755 - protein, 10 aa, Dengue virus
AKFQCLEPVE

SEQ ID NO: 68756 - protein, 10 aa, Dengue virus
KFQCLEPVEG

SEQ ID NO: 68757 - protein, 10 aa, Dengue virus
FQCLEPVEGK

SEQ ID NO: 68758 - protein, 10 aa, Dengue virus
EITPQASITE

SEQ ID NO: 68759 - protein, 10 aa, Dengue virus
ITPQASITEA

SEQ ID NO: 68760 - protein, 10 aa, Dengue virus
AEAILPEYGT

SEQ ID NO: 68761 - protein, 10 aa, Dengue virus
LPLPWTSGVT

SEQ ID NO: 68762 - protein, 10 aa, Dengue virus
PLPWTSGTTT

SEQ ID NO: 68763 - protein, 10 aa, Dengue virus
TETPIWNRKE

SEQ ID NO: 68764 - protein, 10 aa, Dengue virus
EIQNSGGTTI

SEQ ID NO: 68765 - protein, 10 aa, Dengue virus
IQNSGGTTIF

SEQ ID NO: 68766 - protein, 10 aa, Dengue virus
QNSGGTTIFA

SEQ ID NO: 68767 - protein, 10 aa, Dengue virus
NSGGTSIFSG

SEQ ID NO: 68768 - protein, 10 aa, Dengue virus
GMSYAMCLNA

SEQ ID NO: 68769 - protein, 10 aa, Dengue virus
MSYAMCLNAF

SEQ ID NO: 68770 - protein, 10 aa, Dengue virus
SYAMCLNAFV

SEQ ID NO: 68771 - protein, 10 aa, Dengue virus
YAMCLNAFVL

SEQ ID NO: 68772 - protein, 10 aa, Dengue virus
GSFVLKKEVS

SEQ ID NO: 68773 - protein, 10 aa, Dengue virus
ILVKVEYKGE

SEQ ID NO: 68774 - protein, 10 aa, Dengue virus
LVKVEYKGED

SEQ ID NO: 68775 - protein, 10 aa, Dengue virus
IKVEYKGKDA

SEQ ID NO: 68776 - protein, 10 aa, Dengue virus
KVEYKGKDAP

SEQ ID NO: 68777 - protein, 10 aa, Dengue virus
VEYKGKDAPC

SEQ ID NO: 68778 - protein, 10 aa, Dengue virus
EYKGKDAPCK

SEQ ID NO: 68779 - protein, 10 aa, Dengue virus
YKGEDVPCKV

SEQ ID NO: 68780 - protein, 10 aa, Dengue virus
KGEDVPCKVP

SEQ ID NO: 68781 - protein, 10 aa, Dengue virus
GKDAPCKIPF

SEQ ID NO: 68782 - protein, 10 aa, Dengue virus
KDAPCKIPFS

SEQ ID NO: 68783 - protein, 10 aa, Dengue virus
TEDGQGKVHN

SEQ ID NO: 68784 - protein, 10 aa, Dengue virus
EDGQGKVHNG

SEQ ID NO: 68785 - protein, 10 aa, Dengue virus
DGQGKVHNGR

SEQ ID NO: 68786 - protein, 10 aa, Dengue virus
GQGKVHNGRL

SEQ ID NO: 68787 - protein, 10 aa, Dengue virus
TANPVVIKKE

SEQ ID NO: 68788 - protein, 10 aa, Dengue virus
ANPVVIKKEE

SEQ ID NO: 68789 - protein, 10 aa, Dengue virus
NPVVIKKEEP

SEQ ID NO: 68790 - protein, 10 aa, Dengue virus
PVVTKKEEPI

SEQ ID NO: 68791 - protein, 10 aa, Dengue virus
VVTKKEEPIN

SEQ ID NO: 68792 - protein, 10 aa, Dengue virus
VIKKEEPVNI

SEQ ID NO: 68793 - protein, 10 aa, Dengue virus
IKKEEPVNIE

SEQ ID NO: 68794 - protein, 10 aa, Dengue virus
FGESNIIIGT

SEQ ID NO: 68795 - protein, 10 aa, Dengue virus
GESNIIIGTG

SEQ ID NO: 68796 - protein, 10 aa, Dengue virus
ESNIIIGTGD

SEQ ID NO: 68797 - protein, 10 aa, Dengue virus
GDKALRINWY

SEQ ID NO: 68798 - protein, 10 aa, Dengue virus
DKALKINWYR

SEQ ID NO: 68799 - protein, 10 aa, Dengue virus
KALKINWYRK

SEQ ID NO: 68800 - protein, 10 aa, Dengue virus
TALFGGVSWM

SEQ ID NO: 68801 - protein, 10 aa, Dengue virus
ALFGGVSWMM

SEQ ID NO: 68802 - protein, 10 aa, Dengue virus
FGGVSWMMKI

SEQ ID NO: 68803 - protein, 10 aa, Dengue virus
GGVSWMMKIG

SEQ ID NO: 68804 - protein, 10 aa, Dengue virus
SWMMKIGIGV

SEQ ID NO: 68805 - protein, 10 aa, Dengue virus
WMMKIGIGVL

SEQ ID NO: 68806 - protein, 10 aa, Dengue virus
MMKIGIGVLL

SEQ ID NO: 68807 - protein, 10 aa, Dengue virus
SFSCITIGII

SEQ ID NO: 68808 - protein, 10 aa, Dengue virus
FSCITIGIIT

SEQ ID NO: 68809 - protein, 10 aa, Dengue virus
SCITIGIITL

SEQ ID NO: 68810 - protein, 10 aa, Dengue virus
CITIGIITLY

SEQ ID NO: 68811 - protein, 10 aa, Dengue virus
ITIGIITLYL

SEQ ID NO: 68812 - protein, 10 aa, Dengue virus
TIGIITLYLG

SEQ ID NO: 68813 - protein, 10 aa, Dengue virus
IGIITLYLGV

SEQ ID NO: 68814 - protein, 10 aa, Dengue virus
GIITLYLGVV

SEQ ID NO: 68815 - protein, 10 aa, Dengue virus
IITLYLGVVV

SEQ ID NO: 68816 - protein, 10 aa, Dengue virus
YLGVVVQADM

SEQ ID NO: 68817 - protein, 10 aa, Dengue virus
LGVVVQADMG

SEQ ID NO: 68818 - protein, 10 aa, Dengue virus
GVVVQADMGC

SEQ ID NO: 68819 - protein, 10 aa, Dengue virus
TVVQADMGCV

SEQ ID NO: 68820 - protein, 10 aa, Dengue virus
VVQADMGCVV

SEQ ID NO: 68821 - protein, 10 aa, Dengue virus
VQADMGCVVN

SEQ ID NO: 68822 - protein, 10 aa, Dengue virus
QADMGCVVNW

SEQ ID NO: 68823 - protein, 10 aa, Dengue virus
ADMGCVVNWK

SEQ ID NO: 68824 - protein, 10 aa, Dengue virus
DMGCVVNWKG

SEQ ID NO: 68825 - protein, 10 aa, Dengue virus
MGCVVNWKGK

SEQ ID NO: 68826 - protein, 10 aa, Dengue virus
LWENSIKLTV

SEQ ID NO: 68827 - protein, 10 aa, Dengue virus
WENSIKLTVV

SEQ ID NO: 68828 - protein, 10 aa, Dengue virus
IKLTVVVGDV

SEQ ID NO: 68829 - protein, 10 aa, Dengue virus
LTIVVGDVIG

SEQ ID NO: 68830 - protein, 10 aa, Dengue virus
IGVLEQGKRA

SEQ ID NO: 68831 - protein, 10 aa, Dengue virus
GKRILTPQPM

SEQ ID NO: 68832 - protein, 10 aa, Dengue virus
KRTLTLQPME

SEQ ID NO: 68833 - protein, 10 aa, Dengue virus
RTLTLQPMEL

SEQ ID NO: 68834 - protein, 10 aa, Dengue virus
TLTLQPMELK

SEQ ID NO: 68835 - protein, 10 aa, Dengue virus
SWKAWGKAKI

SEQ ID NO: 68836 - protein, 10 aa, Dengue virus
WKAWGKAKIV

SEQ ID NO: 68837 - protein, 10 aa, Dengue virus
WGKAKVVTAE

SEQ ID NO: 68838 - protein, 10 aa, Dengue virus
AEIQNFSFII

SEQ ID NO: 68839 - protein, 10 aa, Dengue virus
ENQNSSFIID

SEQ ID NO: 68840 - protein, 10 aa, Dengue virus
GPNTPECPNT

SEQ ID NO: 68841 - protein, 10 aa, Dengue virus
PNTSRAWNVW

SEQ ID NO: 68842 - protein, 10 aa, Dengue virus
NTSRAWNVWE

SEQ ID NO: 68843 - protein, 10 aa, Dengue virus
NIWLKLRDVY

SEQ ID NO: 68844 - protein, 10 aa, Dengue virus
IWLKLREMYS

SEQ ID NO: 68845 - protein, 10 aa, Dengue virus
WLKLREMYSQ

SEQ ID NO: 68846 - protein, 10 aa, Dengue virus
SQLCDHRLMS

SEQ ID NO: 68847 - protein, 10 aa, Dengue virus
EGTTVVITED

SEQ ID NO: 68848 - protein, 10 aa, Dengue virus
GTTVVITEDC

SEQ ID NO: 68849 - protein, 10 aa, Dengue virus
TTVVITEDCG

SEQ ID NO: 68850 - protein, 10 aa, Dengue virus
TVVITEDCGT

SEQ ID NO: 68851 - protein, 10 aa, Dengue virus
CGTRGPALRT

SEQ ID NO: 68852 - protein, 10 aa, Dengue virus
GTRRPSLRTT

SEQ ID NO: 68853 - protein, 10 aa, Dengue virus
TSGPSLTTTT

SEQ ID NO: 68854 - protein, 10 aa, Dengue virus
WYGMEIRPVS

SEQ ID NO: 68855 - protein, 10 aa, Dengue virus
YGMEIRPVSE

SEQ ID NO: 68856 - protein, 10 aa, Dengue virus
GMEIRPVSEK

SEQ ID NO: 68857 - protein, 10 aa, Dengue virus
MEIRPVSEKE

SEQ ID NO: 68858 - protein, 10 aa, Dengue virus
EIRPVSEKEE

SEQ ID NO: 68859 - protein, 10 aa, Dengue virus
IRPVSEKEEN

SEQ ID NO: 68860 - protein, 10 aa, Dengue virus
RPVSEKEENM

SEQ ID NO: 68861 - protein, 10 aa, Dengue virus
PVSEKEENMV

SEQ ID NO: 68862 - protein, 10 aa, Dengue virus
VSEKEENMVK

SEQ ID NO: 68863 - protein, 10 aa, Dengue virus
SLASAGSGKV

SEQ ID NO: 68864 - protein, 10 aa, Dengue virus
LASAGSGKVD

SEQ ID NO: 68865 - protein, 10 aa, Dengue virus
ASAGSGKVDN

SEQ ID NO: 68866 - protein, 10 aa, Dengue virus
SAGSGKADNF

SEQ ID NO: 68867 - protein, 10 aa, Dengue virus
AGSGKADNFT

SEQ ID NO: 68868 - protein, 10 aa, Dengue virus
GSGKADNFTM

SEQ ID NO: 68869 - protein, 10 aa, Dengue virus
SGKADNFTMG

SEQ ID NO: 68870 - protein, 10 aa, Dengue virus
MDNFTMGVLC

SEQ ID NO: 68871 - protein, 10 aa, Dengue virus
FGKKHMIAGI

SEQ ID NO: 68872 - protein, 10 aa, Dengue virus
FIFVLLLSGQ

SEQ ID NO: 68873 - protein, 10 aa, Dengue virus
SGQITWRGMA

SEQ ID NO: 68874 - protein, 10 aa, Dengue virus
AHTFIMIGSN

SEQ ID NO: 68875 - protein, 10 aa, Dengue virus
HTLIMIGSNT

SEQ ID NO: 68876 - protein, 10 aa, Dengue virus
TLIMIGSNTS

SEQ ID NO: 68877 - protein, 10 aa, Dengue virus
LIMIGSNTSD

SEQ ID NO: 68878 - protein, 10 aa, Dengue virus
IMIGSNTSDR

SEQ ID NO: 68879 - protein, 10 aa, Dengue virus
MIGSNTSDRM

SEQ ID NO: 68880 - protein, 10 aa, Dengue virus
IGSNTSDRMG

SEQ ID NO: 68881 - protein, 10 aa, Dengue virus
NTSDRMGMGV

SEQ ID NO: 68882 - protein, 10 aa, Dengue virus
TTTLQLPEDI

SEQ ID NO: 68883 - protein, 10 aa, Dengue virus
ETYQLWTALA

SEQ ID NO: 68884 - protein, 10 aa, Dengue virus
TYQLWTALAS

SEQ ID NO: 68885 - protein, 10 aa, Dengue virus
QLWTALASLM

SEQ ID NO: 68886 - protein, 10 aa, Dengue virus
LWTALASLMC

SEQ ID NO: 68887 - protein, 10 aa, Dengue virus
ALASLMCSNT

SEQ ID NO: 68888 - protein, 10 aa, Dengue virus
SLMCANTIFT

SEQ ID NO: 68889 - protein, 10 aa, Dengue virus
LMCANTIFTL

SEQ ID NO: 68890 - protein, 10 aa, Dengue virus
MCANTIFTLT

SEQ ID NO: 68891 - protein, 10 aa, Dengue virus
TLVLAGVSLL

SEQ ID NO: 68892 - protein, 10 aa, Dengue virus
LILAGVSILP

SEQ ID NO: 68893 - protein, 10 aa, Dengue virus
ISLLPLCQSS

SEQ ID NO: 68894 - protein, 10 aa, Dengue virus
MRKTDWLPVA

SEQ ID NO: 68895 - protein, 10 aa, Dengue virus
RKTDWLPVAV

SEQ ID NO: 68896 - protein, 10 aa, Dengue virus
KTDWLPVAVA

SEQ ID NO: 68897 - protein, 10 aa, Dengue virus
TDWLPVAVAA

SEQ ID NO: 68898 - protein, 10 aa, Dengue virus
LPMTVAAMGA

SEQ ID NO: 68899 - protein, 10 aa, Dengue virus
VAAMGVSPLP

SEQ ID NO: 68900 - protein, 10 aa, Dengue virus
AAMGVQPLPL

SEQ ID NO: 68901 - protein, 10 aa, Dengue virus
AMGVQPLPLF

SEQ ID NO: 68902 - protein, 10 aa, Dengue virus
MGVSPLPLFI

SEQ ID NO: 68903 - protein, 10 aa, Dengue virus
GVSPLPLFIF

SEQ ID NO: 68904 - protein, 10 aa, Dengue virus
PLPLFIFGLK

SEQ ID NO: 68905 - protein, 10 aa, Dengue virus
PLFIFGLKDT

SEQ ID NO: 68906 - protein, 10 aa, Dengue virus
LKDALKRRSW

SEQ ID NO: 68907 - protein, 10 aa, Dengue virus
KDALKRRSWP

SEQ ID NO: 68908 - protein, 10 aa, Dengue virus
DALKRRSWPL

SEQ ID NO: 68909 - protein, 10 aa, Dengue virus
ALKRRSWPLN

SEQ ID NO: 68910 - protein, 10 aa, Dengue virus
ADLTVEKAAE

SEQ ID NO: 68911 - protein, 10 aa, Dengue virus
PDVTWEEEAE

SEQ ID NO: 68912 - protein, 10 aa, Dengue virus
NVTWEEEAEQ

SEQ ID NO: 68913 - protein, 10 aa, Dengue virus
SYGGGWRLST

SEQ ID NO: 68914 - protein, 10 aa, Dengue virus
YGGGWRLSTQ

SEQ ID NO: 68915 - protein, 10 aa, Dengue virus
GGGWRLSTQW

SEQ ID NO: 68916 - protein, 10 aa, Dengue virus
GGWRLSTQWQ

SEQ ID NO: 68917 - protein, 10 aa, Dengue virus
GWRLSTQWQK

SEQ ID NO: 68918 - protein, 10 aa, Dengue virus
WRLSTQWQKG

SEQ ID NO: 68919 - protein, 10 aa, Dengue virus
RLSTQWQKGE

SEQ ID NO: 68920 - protein, 10 aa, Dengue virus
LSAQWKKGEE

SEQ ID NO: 68921 - protein, 10 aa, Dengue virus
SAQWKKGEEV

SEQ ID NO: 68922 - protein, 10 aa, Dengue virus
PKNFQTTPGI

SEQ ID NO: 68923 - protein, 10 aa, Dengue virus
KNFQTTPGIF

SEQ ID NO: 68924 - protein, 10 aa, Dengue virus
NFQTTPGIFQ

SEQ ID NO: 68925 - protein, 10 aa, Dengue virus
FQTTPGIFQT

SEQ ID NO: 68926 - protein, 10 aa, Dengue virus
QTTPGIFQTT

SEQ ID NO: 68927 - protein, 10 aa, Dengue virus
PIRYQTTATR

SEQ ID NO: 68928 - protein, 10 aa, Dengue virus
IRYQTTATRS

SEQ ID NO: 68929 - protein, 10 aa, Dengue virus
RYQTSATKSE

SEQ ID NO: 68930 - protein, 10 aa, Dengue virus
YQTSATKSEH

SEQ ID NO: 68931 - protein, 10 aa, Dengue virus
QTSATKSEHT

SEQ ID NO: 68932 - protein, 10 aa, Dengue virus
TTVTKSEHTG

SEQ ID NO: 68933 - protein, 10 aa, Dengue virus
TATRSEHTGR

SEQ ID NO: 68934 - protein, 10 aa, Dengue virus
VTKSEHTGRE

SEQ ID NO: 68935 - protein, 10 aa, Dengue virus
SGNEWITDFT

SEQ ID NO: 68936 - protein, 10 aa, Dengue virus
GNEWITDFTG

SEQ ID NO: 68937 - protein, 10 aa, Dengue virus
NEWITDFTGK

SEQ ID NO: 68938 - protein, 10 aa, Dengue virus
EWITDFTGKT

SEQ ID NO: 68939 - protein, 10 aa, Dengue virus
PSHLAHKTRN

SEQ ID NO: 68940 - protein, 10 aa, Dengue virus
SHLAYRTRSA

SEQ ID NO: 68941 - protein, 10 aa, Dengue virus
MLFLVSGKGI

SEQ ID NO: 68942 - protein, 10 aa, Dengue virus
LFLVSGKGIG

SEQ ID NO: 68943 - protein, 10 aa, Dengue virus
FLVSGKGIGK

SEQ ID NO: 68944 - protein, 10 aa, Dengue virus
LISGRGIGKA

SEQ ID NO: 68945 - protein, 10 aa, Dengue virus
VSGKGIGKTT

SEQ ID NO: 68946 - protein, 10 aa, Dengue virus
SGRGIGKASI

SEQ ID NO: 68947 - protein, 10 aa, Dengue virus
GRGIGKASIG

SEQ ID NO: 68948 - protein, 10 aa, Dengue virus
RGIGKASIGL

SEQ ID NO: 68949 - protein, 10 aa, Dengue virus
GIGKASIGLI

SEQ ID NO: 68950 - protein, 10 aa, Dengue virus
IGKASIGLIC

SEQ ID NO: 68951 - protein, 10 aa, Dengue virus
KASIGLICVI

SEQ ID NO: 68952 - protein, 10 aa, Dengue virus
TTIGLICVIV

SEQ ID NO: 68953 - protein, 10 aa, Dengue virus
TIGLICVIVS

SEQ ID NO: 68954 - protein, 10 aa, Dengue virus
ICVTVSSGML

SEQ ID NO: 68955 - protein, 10 aa, Dengue virus
CVTVSSGMLW

SEQ ID NO: 68956 - protein, 10 aa, Dengue virus
VTVSSGMLWM

SEQ ID NO: 68957 - protein, 10 aa, Dengue virus
TVSSGMLWMA

SEQ ID NO: 68958 - protein, 10 aa, Dengue virus
VSSGMLWMAE

SEQ ID NO: 68959 - protein, 10 aa, Dengue virus
SSGMLWMADI

SEQ ID NO: 68960 - protein, 10 aa, Dengue virus
SGMLWMADIP

SEQ ID NO: 68961 - protein, 10 aa, Dengue virus
GMLWMADIPL

SEQ ID NO: 68962 - protein, 10 aa, Dengue virus
MLWMADIPLQ

SEQ ID NO: 68963 - protein, 10 aa, Dengue virus
LWMADIPLQW

SEQ ID NO: 68964 - protein, 10 aa, Dengue virus
WMADIPLQWI

SEQ ID NO: 68965 - protein, 10 aa, Dengue virus
MADIPLQWIA

SEQ ID NO: 68966 - protein, 10 aa, Dengue virus
ADIPLQWIAS

SEQ ID NO: 68967 - protein, 10 aa, Dengue virus
DIPLQWIASA

SEQ ID NO: 68968 - protein, 10 aa, Dengue virus
GILTLAATIA

SEQ ID NO: 68969 - protein, 10 aa, Dengue virus
ILTLAATIAA

SEQ ID NO: 68970 - protein, 10 aa, Dengue virus
LTLAATIAAN

SEQ ID NO: 68971 - protein, 10 aa, Dengue virus
TLAATIAANE

SEQ ID NO: 68972 - protein, 10 aa, Dengue virus
LAATIAANEM

SEQ ID NO: 68973 - protein, 10 aa, Dengue virus
AATIAANEMG

SEQ ID NO: 68974 - protein, 10 aa, Dengue virus
ATIAANEMGL

SEQ ID NO: 68975 - protein, 10 aa, Dengue virus
TIAANEMGLL

SEQ ID NO: 68976 - protein, 10 aa, Dengue virus
MSREPGVVSP

SEQ ID NO: 68977 - protein, 10 aa, Dengue virus
EPGVVSPNSY

SEQ ID NO: 68978 - protein, 10 aa, Dengue virus
PGVVSPNSYL

SEQ ID NO: 68979 - protein, 10 aa, Dengue virus
GVVSPNSYLD

SEQ ID NO: 68980 - protein, 10 aa, Dengue virus
VVSPNSYLDV

SEQ ID NO: 68981 - protein, 10 aa, Dengue virus
VSPNSYLDVD

SEQ ID NO: 68982 - protein, 10 aa, Dengue virus
TLIAAVLLLV

SEQ ID NO: 68983 - protein, 10 aa, Dengue virus
LIAAVLLLVT

SEQ ID NO: 68984 - protein, 10 aa, Dengue virus
IAAVLLLVTH

SEQ ID NO: 68985 - protein, 10 aa, Dengue virus
WKKKLNQLSW

SEQ ID NO: 68986 - protein, 10 aa, Dengue virus
KKKLNQLSWK

SEQ ID NO: 68987 - protein, 10 aa, Dengue virus
KLNQLSWKEF

SEQ ID NO: 68988 - protein, 10 aa, Dengue virus
QLSWKEFDLY

SEQ ID NO: 68989 - protein, 10 aa, Dengue virus
LSRREFDLYK

SEQ ID NO: 68990 - protein, 10 aa, Dengue virus
SWKEFDLYKK

SEQ ID NO: 68991 - protein, 10 aa, Dengue virus
RTEAKEGLRR

SEQ ID NO: 68992 - protein, 10 aa, Dengue virus
TEAKEGLKKG

SEQ ID NO: 68993 - protein, 10 aa, Dengue virus
AKEGLKRRET

SEQ ID NO: 68994 - protein, 10 aa, Dengue virus
KEGLKRGEVT

SEQ ID NO: 68995 - protein, 10 aa, Dengue virus
RRETTHHAVS

SEQ ID NO: 68996 - protein, 10 aa, Dengue virus
GEVTHHAVSR

SEQ ID NO: 68997 - protein, 10 aa, Dengue virus
ITRHAVSRGS

SEQ ID NO: 68998 - protein, 10 aa, Dengue virus
YGWNIVKLMT

SEQ ID NO: 68999 - protein, 10 aa, Dengue virus
GWNIVKLMTG

SEQ ID NO: 69000 - protein, 10 aa, Dengue virus
WNIVKLMTGK

SEQ ID NO: 69001 - protein, 10 aa, Dengue virus
NIVKLMTGKD

SEQ ID NO: 69002 - protein, 10 aa, Dengue virus
IVKLMTGKDV

SEQ ID NO: 69003 - protein, 10 aa, Dengue virus
IKVLNPYMPN

SEQ ID NO: 69004 - protein, 10 aa, Dengue virus
KVLNPYMPNV

SEQ ID NO: 69005 - protein, 10 aa, Dengue virus
ILNPYMPTVI

SEQ ID NO: 69006 - protein, 10 aa, Dengue virus
LNPYMPNVIE

SEQ ID NO: 69007 - protein, 10 aa, Dengue virus
NPYMPNVIEH

SEQ ID NO: 69008 - protein, 10 aa, Dengue virus
PYMPNVIEHL

SEQ ID NO: 69009 - protein, 10 aa, Dengue virus
YMPNVIEHLE

SEQ ID NO: 69010 - protein, 10 aa, Dengue virus
MPNVIEHLER

SEQ ID NO: 69011 - protein, 10 aa, Dengue virus
PNVIEHLERL

SEQ ID NO: 69012 - protein, 10 aa, Dengue virus
NVIEHLERLQ

SEQ ID NO: 69013 - protein, 10 aa, Dengue virus
MTHRRPTIER

SEQ ID NO: 69014 - protein, 10 aa, Dengue virus
THRRPTIERD

SEQ ID NO: 69015 - protein, 10 aa, Dengue virus
HRRPTIERDV

SEQ ID NO: 69016 - protein, 10 aa, Dengue virus
DVIGERLRRI

SEQ ID NO: 69017 - protein, 10 aa, Dengue virus
IGERLRRIKE

SEQ ID NO: 69018 - protein, 10 aa, Dengue virus
GERIKRVKEE

SEQ ID NO: 69019 - protein, 10 aa, Dengue virus
ERIKRIKDEH

SEQ ID NO: 69020 - protein, 10 aa, Dengue virus
RIKEEHISTW

SEQ ID NO: 69021 - protein, 10 aa, Dengue virus
IKEEHDSTWH

SEQ ID NO: 69022 - protein, 10 aa, Dengue virus
EHSKTWHYDD

SEQ ID NO: 69023 - protein, 10 aa, Dengue virus
HSKTWHYDDE

SEQ ID NO: 69024 - protein, 10 aa, Dengue virus
SSTWHYDEEN

SEQ ID NO: 69025 - protein, 10 aa, Dengue virus
VDTRTPRPMA

SEQ ID NO: 69026 - protein, 10 aa, Dengue virus
DTRTPRPMAG

SEQ ID NO: 69027 - protein, 10 aa, Dengue virus
TRTPRPMAGT

SEQ ID NO: 69028 - protein, 10 aa, Dengue virus
RTPRPMAGTR

SEQ ID NO: 69029 - protein, 10 aa, Dengue virus
AMGITAEWLW

SEQ ID NO: 69030 - protein, 10 aa, Dengue virus
SAKAAVEDEN

SEQ ID NO: 69031 - protein, 10 aa, Dengue virus
AAVEDENFWK

SEQ ID NO: 69032 - protein, 10 aa, Dengue virus
AVEDENFWKL

SEQ ID NO: 69033 - protein, 10 aa, Dengue virus
EDENFWKLVD

SEQ ID NO: 69034 - protein, 10 aa, Dengue virus
DEDFWILVDR

SEQ ID NO: 69035 - protein, 10 aa, Dengue virus
EDFWILVDRE

SEQ ID NO: 69036 - protein, 10 aa, Dengue virus
DFWILVDRER

SEQ ID NO: 69037 - protein, 10 aa, Dengue virus
VDRERKLHKL

SEQ ID NO: 69038 - protein, 10 aa, Dengue virus
NEEKITQQMN

SEQ ID NO: 69039 - protein, 10 aa, Dengue virus
EKITQQMNPE

SEQ ID NO: 69040 - protein, 10 aa, Dengue virus
KITHQMDPEH

SEQ ID NO: 69041 - protein, 10 aa, Dengue virus
ITHQMDPEHR

SEQ ID NO: 69042 - protein, 10 aa, Dengue virus
QMDPEHRRLA

SEQ ID NO: 69043 - protein, 10 aa, Dengue virus
PEHKQLANAI

SEQ ID NO: 69044 - protein, 10 aa, Dengue virus
EHRRLANAIF

SEQ ID NO: 69045 - protein, 10 aa, Dengue virus
HKQLANAIFK

SEQ ID NO: 69046 - protein, 10 aa, Dengue virus
KQLANAIFKL

SEQ ID NO: 69047 - protein, 10 aa, Dengue virus
RLANAIFKLT

SEQ ID NO: 69048 - protein, 10 aa, Dengue virus
MEGEGVLSKV

SEQ ID NO: 69049 - protein, 10 aa, Dengue virus
TQWLENKGVE

SEQ ID NO: 69050 - protein, 10 aa, Dengue virus
LENKGVERLK

SEQ ID NO: 69051 - protein, 10 aa, Dengue virus
ENKGVERLKR

SEQ ID NO: 69052 - protein, 10 aa, Dengue virus
NKGVERLKRM

SEQ ID NO: 69053 - protein, 10 aa, Dengue virus
QRMTTEDMLT

SEQ ID NO: 69054 - protein, 10 aa, Dengue virus
RMTTEDMLTV

SEQ ID NO: 69055 - protein, 10 aa, Dengue virus
SVWNRVWIED

SEQ ID NO: 69056 - protein, 10 aa, Dengue virus
DKTPITTWED

SEQ ID NO: 69057 - protein, 10 aa, Dengue virus
KTPITTWEDV

SEQ ID NO: 69058 - protein, 10 aa, Dengue virus
TPITTWEDVP

SEQ ID NO: 69059 - protein, 10 aa, Dengue virus
PITTWEDVPY

SEQ ID NO: 69060 - protein, 10 aa, Dengue virus
ITTWEDVPYL

SEQ ID NO: 69061 - protein, 10 aa, Dengue virus
MVLPAALAFH

SEQ ID NO: 69062 - protein, 10 aa, Dengue virus
VLPAALAFHL

SEQ ID NO: 69063 - protein, 10 aa, Dengue virus
SLIQKVVIFI

SEQ ID NO: 69064 - protein, 10 aa, Dengue virus
LTQKVVIFTL

SEQ ID NO: 69065 - protein, 10 aa, Dengue virus
TQKVVIFTLL

SEQ ID NO: 69066 - protein, 10 aa, Dengue virus
ITSQASTAEA

SEQ ID NO: 69067 - protein, 10 aa, Dengue virus
TEVILPEYGT

SEQ ID NO: 69068 - protein, 10 aa, Dengue virus
PLPWTSGVTT

SEQ ID NO: 69069 - protein, 10 aa, Dengue virus
TKTPTWNRKE

SEQ ID NO: 69070 - protein, 10 aa, Dengue virus
GMSYAMCLGS

SEQ ID NO: 69071 - protein, 10 aa, Dengue virus
MSYAMCLGSF

SEQ ID NO: 69072 - protein, 10 aa, Dengue virus
SYAMCLGSFV

SEQ ID NO: 69073 - protein, 10 aa, Dengue virus
YAMCLGSFVL

SEQ ID NO: 69074 - protein, 10 aa, Dengue virus
VKVEYKGEDA

SEQ ID NO: 69075 - protein, 10 aa, Dengue virus
YKGKDAPCKI

SEQ ID NO: 69076 - protein, 10 aa, Dengue virus
KGKDAPCKIP

SEQ ID NO: 69077 - protein, 10 aa, Dengue virus
PVVIKKEEPV

SEQ ID NO: 69078 - protein, 10 aa, Dengue virus
VVIKKEEPVN

SEQ ID NO: 69079 - protein, 10 aa, Dengue virus
ESNIVIGVGD

SEQ ID NO: 69080 - protein, 10 aa, Dengue virus
DKALRINWYK

SEQ ID NO: 69081 - protein, 10 aa, Dengue virus
VVVQADMGCV

SEQ ID NO: 69082 - protein, 10 aa, Dengue virus
IGCVINWKGK

SEQ ID NO: 69083 - protein, 10 aa, Dengue virus
LTVVVGDVIG

SEQ ID NO: 69084 - protein, 10 aa, Dengue virus
LGVLEQGKRT

SEQ ID NO: 69085 - protein, 10 aa, Dengue virus
TLTPQPTELK

SEQ ID NO: 69086 - protein, 10 aa, Dengue virus
SWKTWGKAKM

SEQ ID NO: 69087 - protein, 10 aa, Dengue virus
WKTWGKAKMV

SEQ ID NO: 69088 - protein, 10 aa, Dengue virus
WGKAKMVTAE

SEQ ID NO: 69089 - protein, 10 aa, Dengue virus
GPSTPECPSA

SEQ ID NO: 69090 - protein, 10 aa, Dengue virus
PSAARAWNVW

SEQ ID NO: 69091 - protein, 10 aa, Dengue virus
SALRAWNVWE

SEQ ID NO: 69092 - protein, 10 aa, Dengue virus
IWLKLREAYT

SEQ ID NO: 69093 - protein, 10 aa, Dengue virus
WLKLRDVYTQ

SEQ ID NO: 69094 - protein, 10 aa, Dengue virus
EGTTVVISEN

SEQ ID NO: 69095 - protein, 10 aa, Dengue virus
GTTVVISENC

SEQ ID NO: 69096 - protein, 10 aa, Dengue virus
TTVVISENCG

SEQ ID NO: 69097 - protein, 10 aa, Dengue virus
TVVISENCGT

SEQ ID NO: 69098 - protein, 10 aa, Dengue virus
CGTRRPSLRT

SEQ ID NO: 69099 - protein, 10 aa, Dengue virus
GTGGPSLRTT

SEQ ID NO: 69100 - protein, 10 aa, Dengue virus
TRGSSLRTTT

SEQ ID NO: 69101 - protein, 10 aa, Dengue virus
PTNEKEENMV

SEQ ID NO: 69102 - protein, 10 aa, Dengue virus
TSEKEENMVK

SEQ ID NO: 69103 - protein, 10 aa, Dengue virus
SLVSAGSGKA

SEQ ID NO: 69104 - protein, 10 aa, Dengue virus
LVSAGSGKAD

SEQ ID NO: 69105 - protein, 10 aa, Dengue virus
VSAGSGKADN

SEQ ID NO: 69106 - protein, 10 aa, Dengue virus
VDNFTMGALC

SEQ ID NO: 69107 - protein, 10 aa, Dengue virus
AHTLIMVGSN

SEQ ID NO: 69108 - protein, 10 aa, Dengue virus
HTLIMVGSNA

SEQ ID NO: 69109 - protein, 10 aa, Dengue virus
QLWAALVSLT

SEQ ID NO: 69110 - protein, 10 aa, Dengue virus
LWAALVSLTC

SEQ ID NO: 69111 - protein, 10 aa, Dengue virus
VSLLPMCQSS

SEQ ID NO: 69112 - protein, 10 aa, Dengue virus
VAAMGVQPLP

SEQ ID NO: 69113 - protein, 10 aa, Dengue virus
AAMGVSPLPL

SEQ ID NO: 69114 - protein, 10 aa, Dengue virus
AMGVSPLPLF

SEQ ID NO: 69115 - protein, 10 aa, Dengue virus
MGVQPLPLFI

SEQ ID NO: 69116 - protein, 10 aa, Dengue virus
GVQPLPLFIF

SEQ ID NO: 69117 - protein, 10 aa, Dengue virus
LKDAPKRRSW

SEQ ID NO: 69118 - protein, 10 aa, Dengue virus
KDAPKRRSWP

SEQ ID NO: 69119 - protein, 10 aa, Dengue virus
DAPKRRSWPL

SEQ ID NO: 69120 - protein, 10 aa, Dengue virus
APKRRSWPLN

SEQ ID NO: 69121 - protein, 10 aa, Dengue virus
ADLTVEKAAN

SEQ ID NO: 69122 - protein, 10 aa, Dengue virus
ANVTWEEEAE

SEQ ID NO: 69123 - protein, 10 aa, Dengue virus
GGWRLSAQWK

SEQ ID NO: 69124 - protein, 10 aa, Dengue virus
GWRLSAQWKK

SEQ ID NO: 69125 - protein, 10 aa, Dengue virus
WRLSAQWKKG

SEQ ID NO: 69126 - protein, 10 aa, Dengue virus
RLSAQWKKGE

SEQ ID NO: 69127 - protein, 10 aa, Dengue virus
TVTKSEHTGR

SEQ ID NO: 69128 - protein, 10 aa, Dengue virus
PSHLAYRTRS

SEQ ID NO: 69129 - protein, 10 aa, Dengue virus
SHLAHRTKNA

SEQ ID NO: 69130 - protein, 10 aa, Dengue virus
ISGKGIGKTT

SEQ ID NO: 69131 - protein, 10 aa, Dengue virus
ASIGLICVIV

SEQ ID NO: 69132 - protein, 10 aa, Dengue virus
VIASSGMLWI

SEQ ID NO: 69133 - protein, 10 aa, Dengue virus
IASSGMLWIA

SEQ ID NO: 69134 - protein, 10 aa, Dengue virus
ASSGMLWIAE

SEQ ID NO: 69135 - protein, 10 aa, Dengue virus
SSGMLWIAEI

SEQ ID NO: 69136 - protein, 10 aa, Dengue virus
SGMLWIAEIP

SEQ ID NO: 69137 - protein, 10 aa, Dengue virus
GMLWIAEIPL

SEQ ID NO: 69138 - protein, 10 aa, Dengue virus
MLWIAEIPLQ

SEQ ID NO: 69139 - protein, 10 aa, Dengue virus
AIIAANEMGM

SEQ ID NO: 69140 - protein, 10 aa, Dengue virus
IIAANEMGML

SEQ ID NO: 69141 - protein, 10 aa, Dengue virus
EPGVVPPTSY

SEQ ID NO: 69142 - protein, 10 aa, Dengue virus
PGVVSPISYL

SEQ ID NO: 69143 - protein, 10 aa, Dengue virus
GVVPPTSYLD

SEQ ID NO: 69144 - protein, 10 aa, Dengue virus
VVSPISYLDV

SEQ ID NO: 69145 - protein, 10 aa, Dengue virus
TLAAAVLLLV

SEQ ID NO: 69146 - protein, 10 aa, Dengue virus
LAAAVLLLVT

SEQ ID NO: 69147 - protein, 10 aa, Dengue virus
AAAVLLLVTH

SEQ ID NO: 69148 - protein, 10 aa, Dengue virus
KKKLNQLSRR

SEQ ID NO: 69149 - protein, 10 aa, Dengue virus
KLNQLSRREF

SEQ ID NO: 69150 - protein, 10 aa, Dengue virus
TEAKEGLRRG

SEQ ID NO: 69151 - protein, 10 aa, Dengue virus
RGEVTHHAVS

SEQ ID NO: 69152 - protein, 10 aa, Dengue virus
VTHHAVSRGS

SEQ ID NO: 69153 - protein, 10 aa, Dengue virus
VLNPYMPNVI

SEQ ID NO: 69154 - protein, 10 aa, Dengue virus
GERIKRIKDE

SEQ ID NO: 69155 - protein, 10 aa, Dengue virus
ERVKRIKEEH

SEQ ID NO: 69156 - protein, 10 aa, Dengue virus
RVKEEHNSTW

SEQ ID NO: 69157 - protein, 10 aa, Dengue virus
DENFWKLVDR

SEQ ID NO: 69158 - protein, 10 aa, Dengue virus
ENFWKLVDRE

SEQ ID NO: 69159 - protein, 10 aa, Dengue virus
NFWKLVDRER

SEQ ID NO: 69160 - protein, 10 aa, Dengue virus
ITQQMNPEHR

SEQ ID NO: 69161 - protein, 10 aa, Dengue virus
QMDPEHKQLA

SEQ ID NO: 69162 - protein, 10 aa, Dengue virus
PEHRRLANAI

SEQ ID NO: 69163 - protein, 10 aa, Dengue virus
EHRKLANAIF

SEQ ID NO: 69164 - protein, 10 aa, Dengue virus
HRRLANAIFK

SEQ ID NO: 69165 - protein, 10 aa, Dengue virus
RRLANAIFKL

SEQ ID NO: 69166 - protein, 10 aa, Dengue virus
MEGEGVLSEA

SEQ ID NO: 69167 - protein, 10 aa, Dengue virus
IQWLETKGVE

SEQ ID NO: 69168 - protein, 11 aa, Dengue virus
MNNQRKKTGKP

SEQ ID NO: 69169 - protein, 11 aa, Dengue virus
NNQRKKTGKPS

SEQ ID NO: 69170 - protein, 11 aa, Dengue virus
NQRKKTGKPSI

SEQ ID NO: 69171 - protein, 11 aa, Dengue virus
QRKKTGKPSIN

SEQ ID NO: 69172 - protein, 11 aa, Dengue virus
RKKTGKPSINM

SEQ ID NO: 69173 - protein, 11 aa, Dengue virus
KKTGKPSINML

SEQ ID NO: 69174 - protein, 11 aa, Dengue virus
KTGKPSINMLK

SEQ ID NO: 69175 - protein, 11 aa, Dengue virus
TGKPSINMLKR

SEQ ID NO: 69176 - protein, 11 aa, Dengue virus
GKPSINMLKRV

SEQ ID NO: 69177 - protein, 11 aa, Dengue virus
KPSINMLKRVR

SEQ ID NO: 69178 - protein, 11 aa, Dengue virus
PSINMLKRVRN

SEQ ID NO: 69179 - protein, 11 aa, Dengue virus
SINMLKRVRNR

SEQ ID NO: 69180 - protein, 11 aa, Dengue virus
INMLKRVRNRV

SEQ ID NO: 69181 - protein, 11 aa, Dengue virus
NMLKRVRNRVS

SEQ ID NO: 69182 - protein, 11 aa, Dengue virus
MLKRVRNRVST

SEQ ID NO: 69183 - protein, 11 aa, Dengue virus
LKRVRNRVSTG

SEQ ID NO: 69184 - protein, 11 aa, Dengue virus
KRVRNRVSTGS

SEQ ID NO: 69185 - protein, 11 aa, Dengue virus
RVRNRVSTGSQ

SEQ ID NO: 69186 - protein, 11 aa, Dengue virus
VRNRVSTGSQL

SEQ ID NO: 69187 - protein, 11 aa, Dengue virus
RNRVSTGSQLA

SEQ ID NO: 69188 - protein, 11 aa, Dengue virus
NRVSTGSQLAK

SEQ ID NO: 69189 - protein, 11 aa, Dengue virus
RVSTGSQLAKR

SEQ ID NO: 69190 - protein, 11 aa, Dengue virus
VSTGSQLAKRF

SEQ ID NO: 69191 - protein, 11 aa, Dengue virus
STGSQLAKRFS

SEQ ID NO: 69192 - protein, 11 aa, Dengue virus
TGSQLAKRFSK

SEQ ID NO: 69193 - protein, 11 aa, Dengue virus
GSQLAKRFSKG

SEQ ID NO: 69194 - protein, 11 aa, Dengue virus
SQLAKRFSKGL

SEQ ID NO: 69195 - protein, 11 aa, Dengue virus
QLAKRFSKGLL

SEQ ID NO: 69196 - protein, 11 aa, Dengue virus
LAKRFSKGLLN

SEQ ID NO: 69197 - protein, 11 aa, Dengue virus
AKRFSKGLLNG

SEQ ID NO: 69198 - protein, 11 aa, Dengue virus
KRFSKGLLNGQ

SEQ ID NO: 69199 - protein, 11 aa, Dengue virus
RFSKGLLNGQG

SEQ ID NO: 69200 - protein, 11 aa, Dengue virus
FSKGLLNGQGP

SEQ ID NO: 69201 - protein, 11 aa, Dengue virus
SKGLLNGQGPM

SEQ ID NO: 69202 - protein, 11 aa, Dengue virus
KGLLNGQGPMK

SEQ ID NO: 69203 - protein, 11 aa, Dengue virus
GLLNGQGPMKL

SEQ ID NO: 69204 - protein, 11 aa, Dengue virus
LLNGQGPMKLV

SEQ ID NO: 69205 - protein, 11 aa, Dengue virus
LNGQGPMKLVM

SEQ ID NO: 69206 - protein, 11 aa, Dengue virus
NGQGPMKLVMA

SEQ ID NO: 69207 - protein, 11 aa, Dengue virus
GQGPMKLVMAF

SEQ ID NO: 69208 - protein, 11 aa, Dengue virus
QGPMKLVMAFI

SEQ ID NO: 69209 - protein, 11 aa, Dengue virus
GPMKLVMAFIA

SEQ ID NO: 69210 - protein, 11 aa, Dengue virus
PMKLVMAFIAF

SEQ ID NO: 69211 - protein, 11 aa, Dengue virus
MKLVMAFIAFL

SEQ ID NO: 69212 - protein, 11 aa, Dengue virus
KLVMAFIAFLR

SEQ ID NO: 69213 - protein, 11 aa, Dengue virus
LVMAFIAFLRF

SEQ ID NO: 69214 - protein, 11 aa, Dengue virus
VMAFIAFLRFL

SEQ ID NO: 69215 - protein, 11 aa, Dengue virus
MAFIAFLRFLA

SEQ ID NO: 69216 - protein, 11 aa, Dengue virus
AFIAFLRFLAI

SEQ ID NO: 69217 - protein, 11 aa, Dengue virus
FIAFLRFLAIP

SEQ ID NO: 69218 - protein, 11 aa, Dengue virus
IAFLRFLAIPP

SEQ ID NO: 69219 - protein, 11 aa, Dengue virus
AFLRFLAIPPT

SEQ ID NO: 69220 - protein, 11 aa, Dengue virus
FLRFLAIPPTA

SEQ ID NO: 69221 - protein, 11 aa, Dengue virus
LRFLAIPPTAG

SEQ ID NO: 69222 - protein, 11 aa, Dengue virus
RFLAIPPTAGV

SEQ ID NO: 69223 - protein, 11 aa, Dengue virus
FLAIPPTAGVL

SEQ ID NO: 69224 - protein, 11 aa, Dengue virus
LAIPPTAGVLA

SEQ ID NO: 69225 - protein, 11 aa, Dengue virus
AIPPTAGVLAR

SEQ ID NO: 69226 - protein, 11 aa, Dengue virus
IPPTAGVLARW

SEQ ID NO: 69227 - protein, 11 aa, Dengue virus
PPTAGVLARWG

SEQ ID NO: 69228 - protein, 11 aa, Dengue virus
PTAGVLARWGT

SEQ ID NO: 69229 - protein, 11 aa, Dengue virus
TAGVLARWGTF

SEQ ID NO: 69230 - protein, 11 aa, Dengue virus
AGVLARWGTFK

SEQ ID NO: 69231 - protein, 11 aa, Dengue virus
GVLARWGTFKK

SEQ ID NO: 69232 - protein, 11 aa, Dengue virus
VLARWGTFKKS

SEQ ID NO: 69233 - protein, 11 aa, Dengue virus
LARWGTFKKSG

SEQ ID NO: 69234 - protein, 11 aa, Dengue virus
ARWGTFKKSGA

SEQ ID NO: 69235 - protein, 11 aa, Dengue virus
RWGTFKKSGAI

SEQ ID NO: 69236 - protein, 11 aa, Dengue virus
WGTFKKSGAIK

SEQ ID NO: 69237 - protein, 11 aa, Dengue virus
GTFKKSGAIKV

SEQ ID NO: 69238 - protein, 11 aa, Dengue virus
TFKKSGAIKVL

SEQ ID NO: 69239 - protein, 11 aa, Dengue virus
FKKSGAIKVLK

SEQ ID NO: 69240 - protein, 11 aa, Dengue virus
KKSGAIKVLKG

SEQ ID NO: 69241 - protein, 11 aa, Dengue virus
KSGAIKVLKGF

SEQ ID NO: 69242 - protein, 11 aa, Dengue virus
SGAIKVLKGFK

SEQ ID NO: 69243 - protein, 11 aa, Dengue virus
GAIKVLKGFKK

SEQ ID NO: 69244 - protein, 11 aa, Dengue virus
AIKVLKGFKKE

SEQ ID NO: 69245 - protein, 11 aa, Dengue virus
IKVLKGFKKEI

SEQ ID NO: 69246 - protein, 11 aa, Dengue virus
KVLKGFKKEIS

SEQ ID NO: 69247 - protein, 11 aa, Dengue virus
VLKGFKKEISN

SEQ ID NO: 69248 - protein, 11 aa, Dengue virus
LKGFKKEISNM

SEQ ID NO: 69249 - protein, 11 aa, Dengue virus
KGFKKEISNML

SEQ ID NO: 69250 - protein, 11 aa, Dengue virus
GFKKEISNMLS

SEQ ID NO: 69251 - protein, 11 aa, Dengue virus
FKKEISNMLSI

SEQ ID NO: 69252 - protein, 11 aa, Dengue virus
KKEISNMLSII

SEQ ID NO: 69253 - protein, 11 aa, Dengue virus
KEISNMLSIIN

SEQ ID NO: 69254 - protein, 11 aa, Dengue virus
EISNMLSIINK

SEQ ID NO: 69255 - protein, 11 aa, Dengue virus
ISNMLSIINKR

SEQ ID NO: 69256 - protein, 11 aa, Dengue virus
SNMLSIINKRK

SEQ ID NO: 69257 - protein, 11 aa, Dengue virus
NMLSIINKRKK

SEQ ID NO: 69258 - protein, 11 aa, Dengue virus
MLSIINKRKKT

SEQ ID NO: 69259 - protein, 11 aa, Dengue virus
LSIINKRKKTS

SEQ ID NO: 69260 - protein, 11 aa, Dengue virus
MILPAALAFHL

SEQ ID NO: 69261 - protein, 11 aa, Dengue virus
ILPAALAFHLT

SEQ ID NO: 69262 - protein, 11 aa, Dengue virus
LPAALAFHLTS

SEQ ID NO: 69263 - protein, 11 aa, Dengue virus
PAALAFHLTSR

SEQ ID NO: 69264 - protein, 11 aa, Dengue virus
AALAFHLTSRD

SEQ ID NO: 69265 - protein, 11 aa, Dengue virus
ALAFHLTSRDG

SEQ ID NO: 69266 - protein, 11 aa, Dengue virus
LAFHLTSRDGE

SEQ ID NO: 69267 - protein, 11 aa, Dengue virus
AFHLTSRDGEP

SEQ ID NO: 69268 - protein, 11 aa, Dengue virus
FHLTSRDGEPR

SEQ ID NO: 69269 - protein, 11 aa, Dengue virus
HLTSRDGEPRM

SEQ ID NO: 69270 - protein, 11 aa, Dengue virus
LTSRDGEPRMI

SEQ ID NO: 69271 - protein, 11 aa, Dengue virus
TSRDGEPRMIV

SEQ ID NO: 69272 - protein, 11 aa, Dengue virus
SRDGEPRMIVG

SEQ ID NO: 69273 - protein, 11 aa, Dengue virus
RDGEPRMIVGK

SEQ ID NO: 69274 - protein, 11 aa, Dengue virus
DGEPRMIVGKN

SEQ ID NO: 69275 - protein, 11 aa, Dengue virus
GEPRMIVGKNE

SEQ ID NO: 69276 - protein, 11 aa, Dengue virus
EPRMIVGKNER

SEQ ID NO: 69277 - protein, 11 aa, Dengue virus
PRMIVGKNERG

SEQ ID NO: 69278 - protein, 11 aa, Dengue virus
RMIVGKNERGK

SEQ ID NO: 69279 - protein, 11 aa, Dengue virus
MIVGKNERGKS

SEQ ID NO: 69280 - protein, 11 aa, Dengue virus
IVGKNERGKSL

SEQ ID NO: 69281 - protein, 11 aa, Dengue virus
VGKNERGKSLL

SEQ ID NO: 69282 - protein, 11 aa, Dengue virus
GKNERGKSLLF

SEQ ID NO: 69283 - protein, 11 aa, Dengue virus
KNERGKSLLFK

SEQ ID NO: 69284 - protein, 11 aa, Dengue virus
NERGKSLLFKT

SEQ ID NO: 69285 - protein, 11 aa, Dengue virus
ERGKSLLFKTA

SEQ ID NO: 69286 - protein, 11 aa, Dengue virus
RGKSLLFKTAS

SEQ ID NO: 69287 - protein, 11 aa, Dengue virus
GKSLLFKTASG

SEQ ID NO: 69288 - protein, 11 aa, Dengue virus
KSLLFKTASGI

SEQ ID NO: 69289 - protein, 11 aa, Dengue virus
SLLFKTASGIN

SEQ ID NO: 69290 - protein, 11 aa, Dengue virus
LLFKTASGINM

SEQ ID NO: 69291 - protein, 11 aa, Dengue virus
LFKTASGINMC

SEQ ID NO: 69292 - protein, 11 aa, Dengue virus
FKTASGINMCT

SEQ ID NO: 69293 - protein, 11 aa, Dengue virus
KTASGINMCTL

SEQ ID NO: 69294 - protein, 11 aa, Dengue virus
TASGINMCTLI

SEQ ID NO: 69295 - protein, 11 aa, Dengue virus
ASGINMCTLIA

SEQ ID NO: 69296 - protein, 11 aa, Dengue virus
SGINMCTLIAM

SEQ ID NO: 69297 - protein, 11 aa, Dengue virus
GINMCTLIAMD

SEQ ID NO: 69298 - protein, 11 aa, Dengue virus
INMCTLIAMDL

SEQ ID NO: 69299 - protein, 11 aa, Dengue virus
NMCTLIAMDLG

SEQ ID NO: 69300 - protein, 11 aa, Dengue virus
MCTLIAMDLGE

SEQ ID NO: 69301 - protein, 11 aa, Dengue virus
CTLIAMDLGEM

SEQ ID NO: 69302 - protein, 11 aa, Dengue virus
TLIAMDLGEMC

SEQ ID NO: 69303 - protein, 11 aa, Dengue virus
LIAMDLGEMCD

SEQ ID NO: 69304 - protein, 11 aa, Dengue virus
IAMDLGEMCDD

SEQ ID NO: 69305 - protein, 11 aa, Dengue virus
AMDLGEMCDDT

SEQ ID NO: 69306 - protein, 11 aa, Dengue virus
MDLGEMCDDTV

SEQ ID NO: 69307 - protein, 11 aa, Dengue virus
DLGEMCDDTVT

SEQ ID NO: 69308 - protein, 11 aa, Dengue virus
LGEMCDDTVTY

SEQ ID NO: 69309 - protein, 11 aa, Dengue virus
GEMCDDTVTYK

SEQ ID NO: 69310 - protein, 11 aa, Dengue virus
EMCDDTVTYKC

SEQ ID NO: 69311 - protein, 11 aa, Dengue virus
MCDDTVTYKCP

SEQ ID NO: 69312 - protein, 11 aa, Dengue virus
CDDTVTYKCPH

SEQ ID NO: 69313 - protein, 11 aa, Dengue virus
DDTVTYKCPHI

SEQ ID NO: 69314 - protein, 11 aa, Dengue virus
ITEVEPEDIDC

SEQ ID NO: 69315 - protein, 11 aa, Dengue virus
TEVEPEDIDCW

SEQ ID NO: 69316 - protein, 11 aa, Dengue virus
EVEPEDIDCWC

SEQ ID NO: 69317 - protein, 11 aa, Dengue virus
VEPEDIDCWCN

SEQ ID NO: 69318 - protein, 11 aa, Dengue virus
EPEDIDCWCNL

SEQ ID NO: 69319 - protein, 11 aa, Dengue virus
PEDIDCWCNLT

SEQ ID NO: 69320 - protein, 11 aa, Dengue virus
EDIDCWCNLTS

SEQ ID NO: 69321 - protein, 11 aa, Dengue virus
DIDCWCNLTST

SEQ ID NO: 69322 - protein, 11 aa, Dengue virus
IDCWCNLTSTW

SEQ ID NO: 69323 - protein, 11 aa, Dengue virus
DCWCNLTSTWV

SEQ ID NO: 69324 - protein, 11 aa, Dengue virus
CWCNLTSTWVT

SEQ ID NO: 69325 - protein, 11 aa, Dengue virus
WCNLTSTWVTY

SEQ ID NO: 69326 - protein, 11 aa, Dengue virus
CNLTSTWVTYG

SEQ ID NO: 69327 - protein, 11 aa, Dengue virus
NLTSTWVTYGT

SEQ ID NO: 69328 - protein, 11 aa, Dengue virus
LTSTWVTYGTC

SEQ ID NO: 69329 - protein, 11 aa, Dengue virus
TSTWVTYGTCN

SEQ ID NO: 69330 - protein, 11 aa, Dengue virus
STWVTYGTCNQ

SEQ ID NO: 69331 - protein, 11 aa, Dengue virus
TWVTYGTCNQA

SEQ ID NO: 69332 - protein, 11 aa, Dengue virus
WVTYGTCNQAG

SEQ ID NO: 69333 - protein, 11 aa, Dengue virus
VTYGTCNQAGE

SEQ ID NO: 69334 - protein, 11 aa, Dengue virus
TYGTCNQAGEH

SEQ ID NO: 69335 - protein, 11 aa, Dengue virus
YGTCNQAGEHR

SEQ ID NO: 69336 - protein, 11 aa, Dengue virus
GTCNQAGEHRR

SEQ ID NO: 69337 - protein, 11 aa, Dengue virus
TCNQAGEHRRD

SEQ ID NO: 69338 - protein, 11 aa, Dengue virus
CNQAGEHRRDK

SEQ ID NO: 69339 - protein, 11 aa, Dengue virus
NQAGEHRRDKR

SEQ ID NO: 69340 - protein, 11 aa, Dengue virus
QAGEHRRDKRS

SEQ ID NO: 69341 - protein, 11 aa, Dengue virus
AGEHRRDKRSV

SEQ ID NO: 69342 - protein, 11 aa, Dengue virus
GEHRRDKRSVA

SEQ ID NO: 69343 - protein, 11 aa, Dengue virus
EHRRDKRSVAL

SEQ ID NO: 69344 - protein, 11 aa, Dengue virus
HRRDKRSVALA

SEQ ID NO: 69345 - protein, 11 aa, Dengue virus
RRDKRSVALAP

SEQ ID NO: 69346 - protein, 11 aa, Dengue virus
RDKRSVALAPH

SEQ ID NO: 69347 - protein, 11 aa, Dengue virus
DKRSVALAPHV

SEQ ID NO: 69348 - protein, 11 aa, Dengue virus
KRSVALAPHVG

SEQ ID NO: 69349 - protein, 11 aa, Dengue virus
RSVALAPHVGM

SEQ ID NO: 69350 - protein, 11 aa, Dengue virus
SVALAPHVGMG

SEQ ID NO: 69351 - protein, 11 aa, Dengue virus
VALAPHVGMGL

SEQ ID NO: 69352 - protein, 11 aa, Dengue virus
ALAPHVGMGLD

SEQ ID NO: 69353 - protein, 11 aa, Dengue virus
LAPHVGMGLDT

SEQ ID NO: 69354 - protein, 11 aa, Dengue virus
APHVGMGLDTR

SEQ ID NO: 69355 - protein, 11 aa, Dengue virus
PHVGMGLDTRT

SEQ ID NO: 69356 - protein, 11 aa, Dengue virus
HVGMGLDTRTQ

SEQ ID NO: 69357 - protein, 11 aa, Dengue virus
VGMGLDTRTQT

SEQ ID NO: 69358 - protein, 11 aa, Dengue virus
GMGLDTRTQTW

SEQ ID NO: 69359 - protein, 11 aa, Dengue virus
MGLDTRTQTWM

SEQ ID NO: 69360 - protein, 11 aa, Dengue virus
GLDTRTQTWMS

SEQ ID NO: 69361 - protein, 11 aa, Dengue virus
LDTRTQTWMSA

SEQ ID NO: 69362 - protein, 11 aa, Dengue virus
DTRTQTWMSAE

SEQ ID NO: 69363 - protein, 11 aa, Dengue virus
TRTQTWMSAEG

SEQ ID NO: 69364 - protein, 11 aa, Dengue virus
RTQTWMSAEGA

SEQ ID NO: 69365 - protein, 11 aa, Dengue virus
TQTWMSAEGAW

SEQ ID NO: 69366 - protein, 11 aa, Dengue virus
QTWMSAEGAWR

SEQ ID NO: 69367 - protein, 11 aa, Dengue virus
TWMSAEGAWRQ

SEQ ID NO: 69368 - protein, 11 aa, Dengue virus
WMSAEGAWRQV

SEQ ID NO: 69369 - protein, 11 aa, Dengue virus
MSAEGAWRQVE

SEQ ID NO: 69370 - protein, 11 aa, Dengue virus
SAEGAWRQVEK

SEQ ID NO: 69371 - protein, 11 aa, Dengue virus
AEGAWRQVEKV

SEQ ID NO: 69372 - protein, 11 aa, Dengue virus
EGAWRQVEKVE

SEQ ID NO: 69373 - protein, 11 aa, Dengue virus
GAWRQVEKVET

SEQ ID NO: 69374 - protein, 11 aa, Dengue virus
AWRQVEKVETW

SEQ ID NO: 69375 - protein, 11 aa, Dengue virus
WRQVEKVETWA

SEQ ID NO: 69376 - protein, 11 aa, Dengue virus
RQVEKVETWAL

SEQ ID NO: 69377 - protein, 11 aa, Dengue virus
QVEKVETWALR

SEQ ID NO: 69378 - protein, 11 aa, Dengue virus
VEKVETWALRH

SEQ ID NO: 69379 - protein, 11 aa, Dengue virus
EKVETWALRHP

SEQ ID NO: 69380 - protein, 11 aa, Dengue virus
KVETWALRHPG

SEQ ID NO: 69381 - protein, 11 aa, Dengue virus
VETWALRHPGF

SEQ ID NO: 69382 - protein, 11 aa, Dengue virus
ETWALRHPGFT

SEQ ID NO: 69383 - protein, 11 aa, Dengue virus
TWALRHPGFTI

SEQ ID NO: 69384 - protein, 11 aa, Dengue virus
WALRHPGFTIL

SEQ ID NO: 69385 - protein, 11 aa, Dengue virus
ALRHPGFTILA

SEQ ID NO: 69386 - protein, 11 aa, Dengue virus
LRHPGFTILAL

SEQ ID NO: 69387 - protein, 11 aa, Dengue virus
RHPGFTILALF

SEQ ID NO: 69388 - protein, 11 aa, Dengue virus
HPGFTILALFL

SEQ ID NO: 69389 - protein, 11 aa, Dengue virus
PGFTILALFLA

SEQ ID NO: 69390 - protein, 11 aa, Dengue virus
GFTILALFLAH

SEQ ID NO: 69391 - protein, 11 aa, Dengue virus
FTILALFLAHY

SEQ ID NO: 69392 - protein, 11 aa, Dengue virus
TILALFLAHYI

SEQ ID NO: 69393 - protein, 11 aa, Dengue virus
ILALFLAHYIG

SEQ ID NO: 69394 - protein, 11 aa, Dengue virus
LALFLAHYIGT

SEQ ID NO: 69395 - protein, 11 aa, Dengue virus
ALFLAHYIGTS

SEQ ID NO: 69396 - protein, 11 aa, Dengue virus
LFLAHYIGTSL

SEQ ID NO: 69397 - protein, 11 aa, Dengue virus
FLAHYIGTSLT

SEQ ID NO: 69398 - protein, 11 aa, Dengue virus
LAHYIGTSLTQ

SEQ ID NO: 69399 - protein, 11 aa, Dengue virus
AHYIGTSLTQK

SEQ ID NO: 69400 - protein, 11 aa, Dengue virus
HYIGTSLTQKV

SEQ ID NO: 69401 - protein, 11 aa, Dengue virus
YIGTSLTQKVV

SEQ ID NO: 69402 - protein, 11 aa, Dengue virus
IGTSLTQKVVI

SEQ ID NO: 69403 - protein, 11 aa, Dengue virus
GTSLTQKVVIF

SEQ ID NO: 69404 - protein, 11 aa, Dengue virus
TSLTQKVVIFI

SEQ ID NO: 69405 - protein, 11 aa, Dengue virus
SLTQKVVIFIL

SEQ ID NO: 69406 - protein, 11 aa, Dengue virus
LTQKVVIFILL

SEQ ID NO: 69407 - protein, 11 aa, Dengue virus
TQKVVIFILLM

SEQ ID NO: 69408 - protein, 11 aa, Dengue virus
QKVVIFILLML

SEQ ID NO: 69409 - protein, 11 aa, Dengue virus
KVVIFILLMLV

SEQ ID NO: 69410 - protein, 11 aa, Dengue virus
VVIFILLMLVT

SEQ ID NO: 69411 - protein, 11 aa, Dengue virus
VIFILLMLVTP

SEQ ID NO: 69412 - protein, 11 aa, Dengue virus
IFILLMLVTPS

SEQ ID NO: 69413 - protein, 11 aa, Dengue virus
FILLMLVTPSM

SEQ ID NO: 69414 - protein, 11 aa, Dengue virus
ILLMLVTPSMT

SEQ ID NO: 69415 - protein, 11 aa, Dengue virus
LLMLVTPSMTM

SEQ ID NO: 69416 - protein, 11 aa, Dengue virus
LMLVTPSMTMR

SEQ ID NO: 69417 - protein, 11 aa, Dengue virus
MLVTPSMTMRC

SEQ ID NO: 69418 - protein, 11 aa, Dengue virus
LVTPSMTMRCV

SEQ ID NO: 69419 - protein, 11 aa, Dengue virus
VTPSMTMRCVG

SEQ ID NO: 69420 - protein, 11 aa, Dengue virus
TPSMTMRCVGV

SEQ ID NO: 69421 - protein, 11 aa, Dengue virus
PSMTMRCVGVG

SEQ ID NO: 69422 - protein, 11 aa, Dengue virus
SMTMRCVGVGN

SEQ ID NO: 69423 - protein, 11 aa, Dengue virus
MTMRCVGVGNR

SEQ ID NO: 69424 - protein, 11 aa, Dengue virus
TMRCVGVGNRD

SEQ ID NO: 69425 - protein, 11 aa, Dengue virus
MRCVGVGNRDF

SEQ ID NO: 69426 - protein, 11 aa, Dengue virus
RCVGVGNRDFV

SEQ ID NO: 69427 - protein, 11 aa, Dengue virus
CVGVGNRDFVE

SEQ ID NO: 69428 - protein, 11 aa, Dengue virus
VGVGNRDFVEG

SEQ ID NO: 69429 - protein, 11 aa, Dengue virus
GVGNRDFVEGL

SEQ ID NO: 69430 - protein, 11 aa, Dengue virus
VGNRDFVEGLS

SEQ ID NO: 69431 - protein, 11 aa, Dengue virus
GNRDFVEGLSG

SEQ ID NO: 69432 - protein, 11 aa, Dengue virus
NRDFVEGLSGA

SEQ ID NO: 69433 - protein, 11 aa, Dengue virus
RDFVEGLSGAT

SEQ ID NO: 69434 - protein, 11 aa, Dengue virus
DFVEGLSGATW

SEQ ID NO: 69435 - protein, 11 aa, Dengue virus
FVEGLSGATWV

SEQ ID NO: 69436 - protein, 11 aa, Dengue virus
VEGLSGATWVD

SEQ ID NO: 69437 - protein, 11 aa, Dengue virus
EGLSGATWVDV

SEQ ID NO: 69438 - protein, 11 aa, Dengue virus
GLSGATWVDVV

SEQ ID NO: 69439 - protein, 11 aa, Dengue virus
LSGATWVDVVL

SEQ ID NO: 69440 - protein, 11 aa, Dengue virus
SGATWVDVVLE

SEQ ID NO: 69441 - protein, 11 aa, Dengue virus
GATWVDVVLEH

SEQ ID NO: 69442 - protein, 11 aa, Dengue virus
ATWVDVVLEHG

SEQ ID NO: 69443 - protein, 11 aa, Dengue virus
TWVDVVLEHGG

SEQ ID NO: 69444 - protein, 11 aa, Dengue virus
WVDVVLEHGGC

SEQ ID NO: 69445 - protein, 11 aa, Dengue virus
VDVVLEHGGCV

SEQ ID NO: 69446 - protein, 11 aa, Dengue virus
DVVLEHGGCVT

SEQ ID NO: 69447 - protein, 11 aa, Dengue virus
VVLEHGGCVTT

SEQ ID NO: 69448 - protein, 11 aa, Dengue virus
VLEHGGCVTTM

SEQ ID NO: 69449 - protein, 11 aa, Dengue virus
LEHGGCVTTMA

SEQ ID NO: 69450 - protein, 11 aa, Dengue virus
EHGGCVTTMAK

SEQ ID NO: 69451 - protein, 11 aa, Dengue virus
HGGCVTTMAKN

SEQ ID NO: 69452 - protein, 11 aa, Dengue virus
GGCVTTMAKNK

SEQ ID NO: 69453 - protein, 11 aa, Dengue virus
GCVTTMAKNKP

SEQ ID NO: 69454 - protein, 11 aa, Dengue virus
CVTTMAKNKPT

SEQ ID NO: 69455 - protein, 11 aa, Dengue virus
VTTMAKNKPTL

SEQ ID NO: 69456 - protein, 11 aa, Dengue virus
TTMAKNKPTLD

SEQ ID NO: 69457 - protein, 11 aa, Dengue virus
TMAKNKPTLDI

SEQ ID NO: 69458 - protein, 11 aa, Dengue virus
MAKNKPTLDIE

SEQ ID NO: 69459 - protein, 11 aa, Dengue virus
AKNKPTLDIEL

SEQ ID NO: 69460 - protein, 11 aa, Dengue virus
KNKPTLDIELQ

SEQ ID NO: 69461 - protein, 11 aa, Dengue virus
NKPTLDIELQK

SEQ ID NO: 69462 - protein, 11 aa, Dengue virus
KPTLDIELQKT

SEQ ID NO: 69463 - protein, 11 aa, Dengue virus
PTLDIELQKTE

SEQ ID NO: 69464 - protein, 11 aa, Dengue virus
TLDIELQKTEA

SEQ ID NO: 69465 - protein, 11 aa, Dengue virus
LDIELQKTEAT

SEQ ID NO: 69466 - protein, 11 aa, Dengue virus
DIELQKTEATQ

SEQ ID NO: 69467 - protein, 11 aa, Dengue virus
IELQKTEATQL

SEQ ID NO: 69468 - protein, 11 aa, Dengue virus
ELQKTEATQLA

SEQ ID NO: 69469 - protein, 11 aa, Dengue virus
LQKTEATQLAT

SEQ ID NO: 69470 - protein, 11 aa, Dengue virus
QKTEATQLATL

SEQ ID NO: 69471 - protein, 11 aa, Dengue virus
KTEATQLATLR

SEQ ID NO: 69472 - protein, 11 aa, Dengue virus
TEATQLATLRK

SEQ ID NO: 69473 - protein, 11 aa, Dengue virus
EATQLATLRKL

SEQ ID NO: 69474 - protein, 11 aa, Dengue virus
ATQLATLRKLC

SEQ ID NO: 69475 - protein, 11 aa, Dengue virus
TQLATLRKLCI

SEQ ID NO: 69476 - protein, 11 aa, Dengue virus
QLATLRKLCIE

SEQ ID NO: 69477 - protein, 11 aa, Dengue virus
LATLRKLCIEG

SEQ ID NO: 69478 - protein, 11 aa, Dengue virus
ATLRKLCIEGK

SEQ ID NO: 69479 - protein, 11 aa, Dengue virus
TLRKLCIEGKI

SEQ ID NO: 69480 - protein, 11 aa, Dengue virus
LRKLCIEGKIT

SEQ ID NO: 69481 - protein, 11 aa, Dengue virus
RKLCIEGKITN

SEQ ID NO: 69482 - protein, 11 aa, Dengue virus
KLCIEGKITNI

SEQ ID NO: 69483 - protein, 11 aa, Dengue virus
LCIEGKITNIT

SEQ ID NO: 69484 - protein, 11 aa, Dengue virus
CIEGKITNITT

SEQ ID NO: 69485 - protein, 11 aa, Dengue virus
IEGKITNITTD

SEQ ID NO: 69486 - protein, 11 aa, Dengue virus
EGKITNITTDS

SEQ ID NO: 69487 - protein, 11 aa, Dengue virus
GKITNITTDSR

SEQ ID NO: 69488 - protein, 11 aa, Dengue virus
KITNITTDSRC

SEQ ID NO: 69489 - protein, 11 aa, Dengue virus
ITNITTDSRCP

SEQ ID NO: 69490 - protein, 11 aa, Dengue virus
TNITTDSRCPT

SEQ ID NO: 69491 - protein, 11 aa, Dengue virus
NITTDSRCPTQ

SEQ ID NO: 69492 - protein, 11 aa, Dengue virus
ITTDSRCPTQG

SEQ ID NO: 69493 - protein, 11 aa, Dengue virus
TTDSRCPTQGE

SEQ ID NO: 69494 - protein, 11 aa, Dengue virus
TDSRCPTQGEA

SEQ ID NO: 69495 - protein, 11 aa, Dengue virus
DSRCPTQGEAV

SEQ ID NO: 69496 - protein, 11 aa, Dengue virus
SRCPTQGEAVL

SEQ ID NO: 69497 - protein, 11 aa, Dengue virus
RCPTQGEAVLP

SEQ ID NO: 69498 - protein, 11 aa, Dengue virus
CPTQGEAVLPE

SEQ ID NO: 69499 - protein, 11 aa, Dengue virus
PTQGEAVLPEE

SEQ ID NO: 69500 - protein, 11 aa, Dengue virus
TQGEAVLPEEQ

SEQ ID NO: 69501 - protein, 11 aa, Dengue virus
QGEAVLPEEQD

SEQ ID NO: 69502 - protein, 11 aa, Dengue virus
GEAVLPEEQDQ

SEQ ID NO: 69503 - protein, 11 aa, Dengue virus
EAVLPEEQDQN

SEQ ID NO: 69504 - protein, 11 aa, Dengue virus
AVLPEEQDQNY

SEQ ID NO: 69505 - protein, 11 aa, Dengue virus
VLPEEQDQNYV

SEQ ID NO: 69506 - protein, 11 aa, Dengue virus
LPEEQDQNYVC

SEQ ID NO: 69507 - protein, 11 aa, Dengue virus
PEEQDQNYVCK

SEQ ID NO: 69508 - protein, 11 aa, Dengue virus
EEQDQNYVCKH

SEQ ID NO: 69509 - protein, 11 aa, Dengue virus
EQDQNYVCKHT

SEQ ID NO: 69510 - protein, 11 aa, Dengue virus
QDQNYVCKHTY

SEQ ID NO: 69511 - protein, 11 aa, Dengue virus
DQNYVCKHTYV

SEQ ID NO: 69512 - protein, 11 aa, Dengue virus
QNYVCKHTYVD

SEQ ID NO: 69513 - protein, 11 aa, Dengue virus
NYVCKHTYVDR

SEQ ID NO: 69514 - protein, 11 aa, Dengue virus
YVCKHTYVDRG

SEQ ID NO: 69515 - protein, 11 aa, Dengue virus
VCKHTYVDRGW

SEQ ID NO: 69516 - protein, 11 aa, Dengue virus
CKHTYVDRGWG

SEQ ID NO: 69517 - protein, 11 aa, Dengue virus
KHTYVDRGWGN

SEQ ID NO: 69518 - protein, 11 aa, Dengue virus
HTYVDRGWGNG

SEQ ID NO: 69519 - protein, 11 aa, Dengue virus
TYVDRGWGNGC

SEQ ID NO: 69520 - protein, 11 aa, Dengue virus
YVDRGWGNGCG

SEQ ID NO: 69521 - protein, 11 aa, Dengue virus
VDRGWGNGCGL

SEQ ID NO: 69522 - protein, 11 aa, Dengue virus
DRGWGNGCGLF

SEQ ID NO: 69523 - protein, 11 aa, Dengue virus
RGWGNGCGLFG

SEQ ID NO: 69524 - protein, 11 aa, Dengue virus
GWGNGCGLFGK

SEQ ID NO: 69525 - protein, 11 aa, Dengue virus
WGNGCGLFGKG

SEQ ID NO: 69526 - protein, 11 aa, Dengue virus
GNGCGLFGKGS

SEQ ID NO: 69527 - protein, 11 aa, Dengue virus
NGCGLFGKGSL

SEQ ID NO: 69528 - protein, 11 aa, Dengue virus
GCGLFGKGSLV

SEQ ID NO: 69529 - protein, 11 aa, Dengue virus
CGLFGKGSLVT

SEQ ID NO: 69530 - protein, 11 aa, Dengue virus
GLFGKGSLVTC

SEQ ID NO: 69531 - protein, 11 aa, Dengue virus
LFGKGSLVTCA

SEQ ID NO: 69532 - protein, 11 aa, Dengue virus
FGKGSLVTCAK

SEQ ID NO: 69533 - protein, 11 aa, Dengue virus
GKGSLVTCAKF

SEQ ID NO: 69534 - protein, 11 aa, Dengue virus
KGSLVTCAKFQ

SEQ ID NO: 69535 - protein, 11 aa, Dengue virus
GSLVTCAKFQC

SEQ ID NO: 69536 - protein, 11 aa, Dengue virus
SLVTCAKFQCL

SEQ ID NO: 69537 - protein, 11 aa, Dengue virus
LVTCAKFQCLE

SEQ ID NO: 69538 - protein, 11 aa, Dengue virus
VTCAKFQCLEP

SEQ ID NO: 69539 - protein, 11 aa, Dengue virus
TCAKFQCLEPI

SEQ ID NO: 69540 - protein, 11 aa, Dengue virus
CAKFQCLEPIE

SEQ ID NO: 69541 - protein, 11 aa, Dengue virus
AKFQCLEPIEG

SEQ ID NO: 69542 - protein, 11 aa, Dengue virus
KFQCLEPIEGK

SEQ ID NO: 69543 - protein, 11 aa, Dengue virus
IEGKVVQYENL

SEQ ID NO: 69544 - protein, 11 aa, Dengue virus
EGKVVQYENLK

SEQ ID NO: 69545 - protein, 11 aa, Dengue virus
GKVVQYENLKY

SEQ ID NO: 69546 - protein, 11 aa, Dengue virus
KVVQYENLKYT

SEQ ID NO: 69547 - protein, 11 aa, Dengue virus
VVQYENLKYTV

SEQ ID NO: 69548 - protein, 11 aa, Dengue virus
VQYENLKYTVI

SEQ ID NO: 69549 - protein, 11 aa, Dengue virus
QYENLKYTVII

SEQ ID NO: 69550 - protein, 11 aa, Dengue virus
YENLKYTVIIT

SEQ ID NO: 69551 - protein, 11 aa, Dengue virus
ENLKYTVIITV

SEQ ID NO: 69552 - protein, 11 aa, Dengue virus
NLKYTVIITVH

SEQ ID NO: 69553 - protein, 11 aa, Dengue virus
LKYTVIITVHT

SEQ ID NO: 69554 - protein, 11 aa, Dengue virus
KYTVIITVHTG

SEQ ID NO: 69555 - protein, 11 aa, Dengue virus
YTVIITVHTGD

SEQ ID NO: 69556 - protein, 11 aa, Dengue virus
TVIITVHTGDQ

SEQ ID NO: 69557 - protein, 11 aa, Dengue virus
VIITVHTGDQH

SEQ ID NO: 69558 - protein, 11 aa, Dengue virus
IITVHTGDQHQ

SEQ ID NO: 69559 - protein, 11 aa, Dengue virus
ITVHTGDQHQV

SEQ ID NO: 69560 - protein, 11 aa, Dengue virus
TVHTGDQHQVG

SEQ ID NO: 69561 - protein, 11 aa, Dengue virus
VHTGDQHQVGN

SEQ ID NO: 69562 - protein, 11 aa, Dengue virus
HTGDQHQVGNE

SEQ ID NO: 69563 - protein, 11 aa, Dengue virus
TGDQHQVGNET

SEQ ID NO: 69564 - protein, 11 aa, Dengue virus
GDQHQVGNETQ

SEQ ID NO: 69565 - protein, 11 aa, Dengue virus
DQHQVGNETQG

SEQ ID NO: 69566 - protein, 11 aa, Dengue virus
QHQVGNETQGV

SEQ ID NO: 69567 - protein, 11 aa, Dengue virus
HQVGNETQGVT

SEQ ID NO: 69568 - protein, 11 aa, Dengue virus
QVGNETQGVTA

SEQ ID NO: 69569 - protein, 11 aa, Dengue virus
VGNETQGVTAE

SEQ ID NO: 69570 - protein, 11 aa, Dengue virus
GNETQGVTAEI

SEQ ID NO: 69571 - protein, 11 aa, Dengue virus
NETQGVTAEIT

SEQ ID NO: 69572 - protein, 11 aa, Dengue virus
ETQGVTAEITP

SEQ ID NO: 69573 - protein, 11 aa, Dengue virus
TQGVTAEITPQ

SEQ ID NO: 69574 - protein, 11 aa, Dengue virus
QGVTAEITPQA

SEQ ID NO: 69575 - protein, 11 aa, Dengue virus
GVTAEITPQAS

SEQ ID NO: 69576 - protein, 11 aa, Dengue virus
VTAEITPQAST

SEQ ID NO: 69577 - protein, 11 aa, Dengue virus
EITPQASTTEA

SEQ ID NO: 69578 - protein, 11 aa, Dengue virus
TEAILPEYGTL

SEQ ID NO: 69579 - protein, 11 aa, Dengue virus
EAILPEYGTLG

SEQ ID NO: 69580 - protein, 11 aa, Dengue virus
AILPEYGTLGL

SEQ ID NO: 69581 - protein, 11 aa, Dengue virus
ILPEYGTLGLE

SEQ ID NO: 69582 - protein, 11 aa, Dengue virus
LPEYGTLGLEC

SEQ ID NO: 69583 - protein, 11 aa, Dengue virus
PEYGTLGLECS

SEQ ID NO: 69584 - protein, 11 aa, Dengue virus
EYGTLGLECSP

SEQ ID NO: 69585 - protein, 11 aa, Dengue virus
YGTLGLECSPR

SEQ ID NO: 69586 - protein, 11 aa, Dengue virus
GTLGLECSPRT

SEQ ID NO: 69587 - protein, 11 aa, Dengue virus
TLGLECSPRTG

SEQ ID NO: 69588 - protein, 11 aa, Dengue virus
LGLECSPRTGL

SEQ ID NO: 69589 - protein, 11 aa, Dengue virus
GLECSPRTGLD

SEQ ID NO: 69590 - protein, 11 aa, Dengue virus
LECSPRTGLDF

SEQ ID NO: 69591 - protein, 11 aa, Dengue virus
ECSPRTGLDFN

SEQ ID NO: 69592 - protein, 11 aa, Dengue virus
CSPRTGLDFNE

SEQ ID NO: 69593 - protein, 11 aa, Dengue virus
SPRTGLDFNEM

SEQ ID NO: 69594 - protein, 11 aa, Dengue virus
PRTGLDFNEMI

SEQ ID NO: 69595 - protein, 11 aa, Dengue virus
RTGLDFNEMIL

SEQ ID NO: 69596 - protein, 11 aa, Dengue virus
TGLDFNEMILL

SEQ ID NO: 69597 - protein, 11 aa, Dengue virus
GLDFNEMILLT

SEQ ID NO: 69598 - protein, 11 aa, Dengue virus
LDFNEMILLTM

SEQ ID NO: 69599 - protein, 11 aa, Dengue virus
DFNEMILLTMK

SEQ ID NO: 69600 - protein, 11 aa, Dengue virus
FNEMILLTMKN

SEQ ID NO: 69601 - protein, 11 aa, Dengue virus
NEMILLTMKNK

SEQ ID NO: 69602 - protein, 11 aa, Dengue virus
EMILLTMKNKA

SEQ ID NO: 69603 - protein, 11 aa, Dengue virus
MILLTMKNKAW

SEQ ID NO: 69604 - protein, 11 aa, Dengue virus
ILLTMKNKAWM

SEQ ID NO: 69605 - protein, 11 aa, Dengue virus
LLTMKNKAWMV

SEQ ID NO: 69606 - protein, 11 aa, Dengue virus
LTMKNKAWMVH

SEQ ID NO: 69607 - protein, 11 aa, Dengue virus
TMKNKAWMVHR

SEQ ID NO: 69608 - protein, 11 aa, Dengue virus
MKNKAWMVHRQ

SEQ ID NO: 69609 - protein, 11 aa, Dengue virus
KNKAWMVHRQW

SEQ ID NO: 69610 - protein, 11 aa, Dengue virus
NKAWMVHRQWF

SEQ ID NO: 69611 - protein, 11 aa, Dengue virus
KAWMVHRQWFF

SEQ ID NO: 69612 - protein, 11 aa, Dengue virus
AWMVHRQWFFD

SEQ ID NO: 69613 - protein, 11 aa, Dengue virus
WMVHRQWFFDL

SEQ ID NO: 69614 - protein, 11 aa, Dengue virus
MVHRQWFFDLP

SEQ ID NO: 69615 - protein, 11 aa, Dengue virus
VHRQWFFDLPL

SEQ ID NO: 69616 - protein, 11 aa, Dengue virus
HRQWFFDLPLP

SEQ ID NO: 69617 - protein, 11 aa, Dengue virus
RQWFFDLPLPW

SEQ ID NO: 69618 - protein, 11 aa, Dengue virus
QWFFDLPLPWT

SEQ ID NO: 69619 - protein, 11 aa, Dengue virus
WFFDLPLPWTS

SEQ ID NO: 69620 - protein, 11 aa, Dengue virus
FFDLPLPWTSG

SEQ ID NO: 69621 - protein, 11 aa, Dengue virus
FDLPLPWTSGA

SEQ ID NO: 69622 - protein, 11 aa, Dengue virus
DLPLPWTSGAT

SEQ ID NO: 69623 - protein, 11 aa, Dengue virus
LPLPWTSGATT

SEQ ID NO: 69624 - protein, 11 aa, Dengue virus
TETPTWNRKEL

SEQ ID NO: 69625 - protein, 11 aa, Dengue virus
ETPTWNRKELL

SEQ ID NO: 69626 - protein, 11 aa, Dengue virus
TPTWNRKELLV

SEQ ID NO: 69627 - protein, 11 aa, Dengue virus
PTWNRKELLVT

SEQ ID NO: 69628 - protein, 11 aa, Dengue virus
TWNRKELLVTF

SEQ ID NO: 69629 - protein, 11 aa, Dengue virus
WNRKELLVTFK

SEQ ID NO: 69630 - protein, 11 aa, Dengue virus
NRKELLVTFKN

SEQ ID NO: 69631 - protein, 11 aa, Dengue virus
RKELLVTFKNA

SEQ ID NO: 69632 - protein, 11 aa, Dengue virus
KELLVTFKNAH

SEQ ID NO: 69633 - protein, 11 aa, Dengue virus
ELLVTFKNAHA

SEQ ID NO: 69634 - protein, 11 aa, Dengue virus
LLVTFKNAHAK

SEQ ID NO: 69635 - protein, 11 aa, Dengue virus
LVTFKNAHAKK

SEQ ID NO: 69636 - protein, 11 aa, Dengue virus
VTFKNAHAKKQ

SEQ ID NO: 69637 - protein, 11 aa, Dengue virus
TFKNAHAKKQE

SEQ ID NO: 69638 - protein, 11 aa, Dengue virus
FKNAHAKKQEV

SEQ ID NO: 69639 - protein, 11 aa, Dengue virus
KNAHAKKQEVV

SEQ ID NO: 69640 - protein, 11 aa, Dengue virus
NAHAKKQEVVV

SEQ ID NO: 69641 - protein, 11 aa, Dengue virus
AHAKKQEVVVL

SEQ ID NO: 69642 - protein, 11 aa, Dengue virus
HAKKQEVVVLG

SEQ ID NO: 69643 - protein, 11 aa, Dengue virus
AKKQEVVVLGS

SEQ ID NO: 69644 - protein, 11 aa, Dengue virus
KKQEVVVLGSQ

SEQ ID NO: 69645 - protein, 11 aa, Dengue virus
KQEVVVLGSQE

SEQ ID NO: 69646 - protein, 11 aa, Dengue virus
QEVVVLGSQEG

SEQ ID NO: 69647 - protein, 11 aa, Dengue virus
EVVVLGSQEGA

SEQ ID NO: 69648 - protein, 11 aa, Dengue virus
VVVLGSQEGAM

SEQ ID NO: 69649 - protein, 11 aa, Dengue virus
VVLGSQEGAMH

SEQ ID NO: 69650 - protein, 11 aa, Dengue virus
VLGSQEGAMHT

SEQ ID NO: 69651 - protein, 11 aa, Dengue virus
LGSQEGAMHTA

SEQ ID NO: 69652 - protein, 11 aa, Dengue virus
GSQEGAMHTAL

SEQ ID NO: 69653 - protein, 11 aa, Dengue virus
SQEGAMHTALT

SEQ ID NO: 69654 - protein, 11 aa, Dengue virus
QEGAMHTALTG

SEQ ID NO: 69655 - protein, 11 aa, Dengue virus
EGAMHTALTGA

SEQ ID NO: 69656 - protein, 11 aa, Dengue virus
GAMHTALTGAT

SEQ ID NO: 69657 - protein, 11 aa, Dengue virus
AMHTALTGATE

SEQ ID NO: 69658 - protein, 11 aa, Dengue virus
MHTALTGATEI

SEQ ID NO: 69659 - protein, 11 aa, Dengue virus
HTALTGATEIQ

SEQ ID NO: 69660 - protein, 11 aa, Dengue virus
TALTGATEIQN

SEQ ID NO: 69661 - protein, 11 aa, Dengue virus
ALTGATEIQNS

SEQ ID NO: 69662 - protein, 11 aa, Dengue virus
LTGATEIQNSG

SEQ ID NO: 69663 - protein, 11 aa, Dengue virus
TGATEIQNSGG

SEQ ID NO: 69664 - protein, 11 aa, Dengue virus
GATEIQNSGGT

SEQ ID NO: 69665 - protein, 11 aa, Dengue virus
ATEIQNSGGTS

SEQ ID NO: 69666 - protein, 11 aa, Dengue virus
TEIQNSGGTSI

SEQ ID NO: 69667 - protein, 11 aa, Dengue virus
EIQNSGGTSIF

SEQ ID NO: 69668 - protein, 11 aa, Dengue virus
IQNSGGTSIFA

SEQ ID NO: 69669 - protein, 11 aa, Dengue virus
QNSGGTSIFAG

SEQ ID NO: 69670 - protein, 11 aa, Dengue virus
NSGGTSIFAGH

SEQ ID NO: 69671 - protein, 11 aa, Dengue virus
SGGTSIFAGHL

SEQ ID NO: 69672 - protein, 11 aa, Dengue virus
GGTSIFAGHLK

SEQ ID NO: 69673 - protein, 11 aa, Dengue virus
GTSIFAGHLKC

SEQ ID NO: 69674 - protein, 11 aa, Dengue virus
TSIFAGHLKCR

SEQ ID NO: 69675 - protein, 11 aa, Dengue virus
SIFAGHLKCRL

SEQ ID NO: 69676 - protein, 11 aa, Dengue virus
IFAGHLKCRLK

SEQ ID NO: 69677 - protein, 11 aa, Dengue virus
FAGHLKCRLKM

SEQ ID NO: 69678 - protein, 11 aa, Dengue virus
AGHLKCRLKMD

SEQ ID NO: 69679 - protein, 11 aa, Dengue virus
GHLKCRLKMDK

SEQ ID NO: 69680 - protein, 11 aa, Dengue virus
HLKCRLKMDKL

SEQ ID NO: 69681 - protein, 11 aa, Dengue virus
LKCRLKMDKLE

SEQ ID NO: 69682 - protein, 11 aa, Dengue virus
KCRLKMDKLEL

SEQ ID NO: 69683 - protein, 11 aa, Dengue virus
CRLKMDKLELK

SEQ ID NO: 69684 - protein, 11 aa, Dengue virus
RLKMDKLELKG

SEQ ID NO: 69685 - protein, 11 aa, Dengue virus
LKMDKLELKGM

SEQ ID NO: 69686 - protein, 11 aa, Dengue virus
KMDKLELKGMS

SEQ ID NO: 69687 - protein, 11 aa, Dengue virus
MDKLELKGMSY

SEQ ID NO: 69688 - protein, 11 aa, Dengue virus
DKLELKGMSYA

SEQ ID NO: 69689 - protein, 11 aa, Dengue virus
KLELKGMSYAM

SEQ ID NO: 69690 - protein, 11 aa, Dengue virus
LELKGMSYAMC

SEQ ID NO: 69691 - protein, 11 aa, Dengue virus
ELKGMSYAMCT

SEQ ID NO: 69692 - protein, 11 aa, Dengue virus
LKGMSYAMCTN

SEQ ID NO: 69693 - protein, 11 aa, Dengue virus
KGMSYAMCTNT

SEQ ID NO: 69694 - protein, 11 aa, Dengue virus
GMSYAMCTNTF

SEQ ID NO: 69695 - protein, 11 aa, Dengue virus
MSYAMCTNTFV

SEQ ID NO: 69696 - protein, 11 aa, Dengue virus
SYAMCTNTFVL

SEQ ID NO: 69697 - protein, 11 aa, Dengue virus
NTFVLKKEVSE

SEQ ID NO: 69698 - protein, 11 aa, Dengue virus
TFVLKKEVSET

SEQ ID NO: 69699 - protein, 11 aa, Dengue virus
FVLKKEVSETQ

SEQ ID NO: 69700 - protein, 11 aa, Dengue virus
VLKKEVSETQH

SEQ ID NO: 69701 - protein, 11 aa, Dengue virus
LKKEVSETQHG

SEQ ID NO: 69702 - protein, 11 aa, Dengue virus
KKEVSETQHGT

SEQ ID NO: 69703 - protein, 11 aa, Dengue virus
KEVSETQHGTI

SEQ ID NO: 69704 - protein, 11 aa, Dengue virus
EVSETQHGTIL

SEQ ID NO: 69705 - protein, 11 aa, Dengue virus
VSETQHGTILI

SEQ ID NO: 69706 - protein, 11 aa, Dengue virus
SETQHGTILIK

SEQ ID NO: 69707 - protein, 11 aa, Dengue virus
ETQHGTILIKV

SEQ ID NO: 69708 - protein, 11 aa, Dengue virus
TQHGTILIKVE

SEQ ID NO: 69709 - protein, 11 aa, Dengue virus
QHGTILIKVEY

SEQ ID NO: 69710 - protein, 11 aa, Dengue virus
HGTILIKVEYK

SEQ ID NO: 69711 - protein, 11 aa, Dengue virus
GTILIKVEYKG

SEQ ID NO: 69712 - protein, 11 aa, Dengue virus
TILIKVEYKGE

SEQ ID NO: 69713 - protein, 11 aa, Dengue virus
ILIKVEYKGED

SEQ ID NO: 69714 - protein, 11 aa, Dengue virus
LIKVEYKGEDA

SEQ ID NO: 69715 - protein, 11 aa, Dengue virus
IKVEYKGEDAP

SEQ ID NO: 69716 - protein, 11 aa, Dengue virus
KVEYKGEDAPC

SEQ ID NO: 69717 - protein, 11 aa, Dengue virus
VEYKGEDAPCK

SEQ ID NO: 69718 - protein, 11 aa, Dengue virus
EYKGEDAPCKI

SEQ ID NO: 69719 - protein, 11 aa, Dengue virus
YKGEDAPCKIP

SEQ ID NO: 69720 - protein, 11 aa, Dengue virus
KGEDAPCKIPF

SEQ ID NO: 69721 - protein, 11 aa, Dengue virus
GEDAPCKIPFS

SEQ ID NO: 69722 - protein, 11 aa, Dengue virus
EDAPCKIPFST

SEQ ID NO: 69723 - protein, 11 aa, Dengue virus
DAPCKIPFSTE

SEQ ID NO: 69724 - protein, 11 aa, Dengue virus
APCKIPFSTED

SEQ ID NO: 69725 - protein, 11 aa, Dengue virus
PCKIPFSTEDG

SEQ ID NO: 69726 - protein, 11 aa, Dengue virus
CKIPFSTEDGQ

SEQ ID NO: 69727 - protein, 11 aa, Dengue virus
KIPFSTEDGQG

SEQ ID NO: 69728 - protein, 11 aa, Dengue virus
IPFSTEDGQGK

SEQ ID NO: 69729 - protein, 11 aa, Dengue virus
PFSTEDGQGKA

SEQ ID NO: 69730 - protein, 11 aa, Dengue virus
FSTEDGQGKAH

SEQ ID NO: 69731 - protein, 11 aa, Dengue virus
STEDGQGKAHN

SEQ ID NO: 69732 - protein, 11 aa, Dengue virus
TEDGQGKAHNG

SEQ ID NO: 69733 - protein, 11 aa, Dengue virus
EDGQGKAHNGR

SEQ ID NO: 69734 - protein, 11 aa, Dengue virus
DGQGKAHNGRL

SEQ ID NO: 69735 - protein, 11 aa, Dengue virus
GQGKAHNGRLI

SEQ ID NO: 69736 - protein, 11 aa, Dengue virus
QGKAHNGRLIT

SEQ ID NO: 69737 - protein, 11 aa, Dengue virus
GKAHNGRLITA

SEQ ID NO: 69738 - protein, 11 aa, Dengue virus
KAHNGRLITAN

SEQ ID NO: 69739 - protein, 11 aa, Dengue virus
AHNGRLITANP

SEQ ID NO: 69740 - protein, 11 aa, Dengue virus
HNGRLITANPV

SEQ ID NO: 69741 - protein, 11 aa, Dengue virus
NGRLITANPVV

SEQ ID NO: 69742 - protein, 11 aa, Dengue virus
GRLITANPVVT

SEQ ID NO: 69743 - protein, 11 aa, Dengue virus
RLITANPVVTK

SEQ ID NO: 69744 - protein, 11 aa, Dengue virus
LITANPVVTKK

SEQ ID NO: 69745 - protein, 11 aa, Dengue virus
ITANPVVTKKE

SEQ ID NO: 69746 - protein, 11 aa, Dengue virus
TANPVVTKKEE

SEQ ID NO: 69747 - protein, 11 aa, Dengue virus
ANPVVTKKEEP

SEQ ID NO: 69748 - protein, 11 aa, Dengue virus
NPVVTKKEEPV

SEQ ID NO: 69749 - protein, 11 aa, Dengue virus
PVVTKKEEPVN

SEQ ID NO: 69750 - protein, 11 aa, Dengue virus
VVTKKEEPVNI

SEQ ID NO: 69751 - protein, 11 aa, Dengue virus
VTKKEEPVNIE

SEQ ID NO: 69752 - protein, 11 aa, Dengue virus
TKKEEPVNIEA

SEQ ID NO: 69753 - protein, 11 aa, Dengue virus
KKEEPVNIEAE

SEQ ID NO: 69754 - protein, 11 aa, Dengue virus
KEEPVNIEAEP

SEQ ID NO: 69755 - protein, 11 aa, Dengue virus
EEPVNIEAEPP

SEQ ID NO: 69756 - protein, 11 aa, Dengue virus
EPVNIEAEPPF

SEQ ID NO: 69757 - protein, 11 aa, Dengue virus
PVNIEAEPPFG

SEQ ID NO: 69758 - protein, 11 aa, Dengue virus
VNIEAEPPFGE

SEQ ID NO: 69759 - protein, 11 aa, Dengue virus
NIEAEPPFGES

SEQ ID NO: 69760 - protein, 11 aa, Dengue virus
IEAEPPFGESN

SEQ ID NO: 69761 - protein, 11 aa, Dengue virus
EAEPPFGESNI

SEQ ID NO: 69762 - protein, 11 aa, Dengue virus
AEPPFGESNIV

SEQ ID NO: 69763 - protein, 11 aa, Dengue virus
EPPFGESNIVI

SEQ ID NO: 69764 - protein, 11 aa, Dengue virus
PPFGESNIVIG

SEQ ID NO: 69765 - protein, 11 aa, Dengue virus
PFGESNIVIGI

SEQ ID NO: 69766 - protein, 11 aa, Dengue virus
FGESNIVIGIG

SEQ ID NO: 69767 - protein, 11 aa, Dengue virus
GESNIVIGIGD

SEQ ID NO: 69768 - protein, 11 aa, Dengue virus
GDNALKINWYK

SEQ ID NO: 69769 - protein, 11 aa, Dengue virus
NALKINWYKKG

SEQ ID NO: 69770 - protein, 11 aa, Dengue virus
ALKINWYKKGS

SEQ ID NO: 69771 - protein, 11 aa, Dengue virus
LKINWYKKGSS

SEQ ID NO: 69772 - protein, 11 aa, Dengue virus
KINWYKKGSSI

SEQ ID NO: 69773 - protein, 11 aa, Dengue virus
INWYKKGSSIG

SEQ ID NO: 69774 - protein, 11 aa, Dengue virus
NWYKKGSSIGK

SEQ ID NO: 69775 - protein, 11 aa, Dengue virus
WYKKGSSIGKM

SEQ ID NO: 69776 - protein, 11 aa, Dengue virus
YKKGSSIGKMF

SEQ ID NO: 69777 - protein, 11 aa, Dengue virus
KKGSSIGKMFE

SEQ ID NO: 69778 - protein, 11 aa, Dengue virus
KGSSIGKMFEA

SEQ ID NO: 69779 - protein, 11 aa, Dengue virus
GSSIGKMFEAT

SEQ ID NO: 69780 - protein, 11 aa, Dengue virus
SSIGKMFEATA

SEQ ID NO: 69781 - protein, 11 aa, Dengue virus
SIGKMFEATAR

SEQ ID NO: 69782 - protein, 11 aa, Dengue virus
IGKMFEATARG

SEQ ID NO: 69783 - protein, 11 aa, Dengue virus
GKMFEATARGA

SEQ ID NO: 69784 - protein, 11 aa, Dengue virus
KMFEATARGAR

SEQ ID NO: 69785 - protein, 11 aa, Dengue virus
MFEATARGARR

SEQ ID NO: 69786 - protein, 11 aa, Dengue virus
FEATARGARRM

SEQ ID NO: 69787 - protein, 11 aa, Dengue virus
EATARGARRMA

SEQ ID NO: 69788 - protein, 11 aa, Dengue virus
ATARGARRMAI

SEQ ID NO: 69789 - protein, 11 aa, Dengue virus
TARGARRMAIL

SEQ ID NO: 69790 - protein, 11 aa, Dengue virus
ARGARRMAILG

SEQ ID NO: 69791 - protein, 11 aa, Dengue virus
RGARRMAILGD

SEQ ID NO: 69792 - protein, 11 aa, Dengue virus
GARRMAILGDT

SEQ ID NO: 69793 - protein, 11 aa, Dengue virus
ARRMAILGDTA

SEQ ID NO: 69794 - protein, 11 aa, Dengue virus
RRMAILGDTAW

SEQ ID NO: 69795 - protein, 11 aa, Dengue virus
RMAILGDTAWD

SEQ ID NO: 69796 - protein, 11 aa, Dengue virus
MAILGDTAWDF

SEQ ID NO: 69797 - protein, 11 aa, Dengue virus
AILGDTAWDFG

SEQ ID NO: 69798 - protein, 11 aa, Dengue virus
ILGDTAWDFGS

SEQ ID NO: 69799 - protein, 11 aa, Dengue virus
LGDTAWDFGSV

SEQ ID NO: 69800 - protein, 11 aa, Dengue virus
GDTAWDFGSVG

SEQ ID NO: 69801 - protein, 11 aa, Dengue virus
DTAWDFGSVGG

SEQ ID NO: 69802 - protein, 11 aa, Dengue virus
TAWDFGSVGGV

SEQ ID NO: 69803 - protein, 11 aa, Dengue virus
AWDFGSVGGVL

SEQ ID NO: 69804 - protein, 11 aa, Dengue virus
WDFGSVGGVLN

SEQ ID NO: 69805 - protein, 11 aa, Dengue virus
DFGSVGGVLNS

SEQ ID NO: 69806 - protein, 11 aa, Dengue virus
FGSVGGVLNSL

SEQ ID NO: 69807 - protein, 11 aa, Dengue virus
GSVGGVLNSLG

SEQ ID NO: 69808 - protein, 11 aa, Dengue virus
SVGGVLNSLGK

SEQ ID NO: 69809 - protein, 11 aa, Dengue virus
VGGVLNSLGKM

SEQ ID NO: 69810 - protein, 11 aa, Dengue virus
GGVLNSLGKMV

SEQ ID NO: 69811 - protein, 11 aa, Dengue virus
GVLNSLGKMVH

SEQ ID NO: 69812 - protein, 11 aa, Dengue virus
VLNSLGKMVHQ

SEQ ID NO: 69813 - protein, 11 aa, Dengue virus
LNSLGKMVHQI

SEQ ID NO: 69814 - protein, 11 aa, Dengue virus
NSLGKMVHQIF

SEQ ID NO: 69815 - protein, 11 aa, Dengue virus
SLGKMVHQIFG

SEQ ID NO: 69816 - protein, 11 aa, Dengue virus
LGKMVHQIFGS

SEQ ID NO: 69817 - protein, 11 aa, Dengue virus
GKMVHQIFGSA

SEQ ID NO: 69818 - protein, 11 aa, Dengue virus
KMVHQIFGSAY

SEQ ID NO: 69819 - protein, 11 aa, Dengue virus
MVHQIFGSAYT

SEQ ID NO: 69820 - protein, 11 aa, Dengue virus
VHQIFGSAYTA

SEQ ID NO: 69821 - protein, 11 aa, Dengue virus
HQIFGSAYTAL

SEQ ID NO: 69822 - protein, 11 aa, Dengue virus
QIFGSAYTALF

SEQ ID NO: 69823 - protein, 11 aa, Dengue virus
IFGSAYTALFS

SEQ ID NO: 69824 - protein, 11 aa, Dengue virus
FGSAYTALFSG

SEQ ID NO: 69825 - protein, 11 aa, Dengue virus
GSAYTALFSGV

SEQ ID NO: 69826 - protein, 11 aa, Dengue virus
SAYTALFSGVS

SEQ ID NO: 69827 - protein, 11 aa, Dengue virus
AYTALFSGVSW

SEQ ID NO: 69828 - protein, 11 aa, Dengue virus
YTALFSGVSWV

SEQ ID NO: 69829 - protein, 11 aa, Dengue virus
TALFSGVSWVM

SEQ ID NO: 69830 - protein, 11 aa, Dengue virus
ALFSGVSWVMK

SEQ ID NO: 69831 - protein, 11 aa, Dengue virus
LFSGVSWVMKI

SEQ ID NO: 69832 - protein, 11 aa, Dengue virus
FSGVSWVMKIG

SEQ ID NO: 69833 - protein, 11 aa, Dengue virus
SGVSWVMKIGI

SEQ ID NO: 69834 - protein, 11 aa, Dengue virus
GVSWVMKIGIG

SEQ ID NO: 69835 - protein, 11 aa, Dengue virus
VSWVMKIGIGV

SEQ ID NO: 69836 - protein, 11 aa, Dengue virus
SWVMKIGIGVL

SEQ ID NO: 69837 - protein, 11 aa, Dengue virus
WVMKIGIGVLL

SEQ ID NO: 69838 - protein, 11 aa, Dengue virus
VMKIGIGVLLT

SEQ ID NO: 69839 - protein, 11 aa, Dengue virus
MKIGIGVLLTW

SEQ ID NO: 69840 - protein, 11 aa, Dengue virus
KIGIGVLLTWI

SEQ ID NO: 69841 - protein, 11 aa, Dengue virus
IGIGVLLTWIG

SEQ ID NO: 69842 - protein, 11 aa, Dengue virus
GIGVLLTWIGL

SEQ ID NO: 69843 - protein, 11 aa, Dengue virus
IGVLLTWIGLN

SEQ ID NO: 69844 - protein, 11 aa, Dengue virus
GVLLTWIGLNS

SEQ ID NO: 69845 - protein, 11 aa, Dengue virus
VLLTWIGLNSK

SEQ ID NO: 69846 - protein, 11 aa, Dengue virus
LLTWIGLNSKN

SEQ ID NO: 69847 - protein, 11 aa, Dengue virus
LTWIGLNSKNT

SEQ ID NO: 69848 - protein, 11 aa, Dengue virus
TWIGLNSKNTS

SEQ ID NO: 69849 - protein, 11 aa, Dengue virus
WIGLNSKNTSM

SEQ ID NO: 69850 - protein, 11 aa, Dengue virus
IGLNSKNTSMS

SEQ ID NO: 69851 - protein, 11 aa, Dengue virus
GLNSKNTSMSF

SEQ ID NO: 69852 - protein, 11 aa, Dengue virus
LNSKNTSMSFS

SEQ ID NO: 69853 - protein, 11 aa, Dengue virus
NSKNTSMSFSC

SEQ ID NO: 69854 - protein, 11 aa, Dengue virus
SKNTSMSFSCI

SEQ ID NO: 69855 - protein, 11 aa, Dengue virus
KNTSMSFSCIA

SEQ ID NO: 69856 - protein, 11 aa, Dengue virus
NTSMSFSCIAI

SEQ ID NO: 69857 - protein, 11 aa, Dengue virus
TSMSFSCIAIG

SEQ ID NO: 69858 - protein, 11 aa, Dengue virus
SMSFSCIAIGI

SEQ ID NO: 69859 - protein, 11 aa, Dengue virus
MSFSCIAIGII

SEQ ID NO: 69860 - protein, 11 aa, Dengue virus
SFSCIAIGIIT

SEQ ID NO: 69861 - protein, 11 aa, Dengue virus
FSCIAIGIITL

SEQ ID NO: 69862 - protein, 11 aa, Dengue virus
SCIAIGIITLY

SEQ ID NO: 69863 - protein, 11 aa, Dengue virus
CIAIGIITLYL

SEQ ID NO: 69864 - protein, 11 aa, Dengue virus
IAIGIITLYLG

SEQ ID NO: 69865 - protein, 11 aa, Dengue virus
IGIITLYLGAV

SEQ ID NO: 69866 - protein, 11 aa, Dengue virus
GIITLYLGAVV

SEQ ID NO: 69867 - protein, 11 aa, Dengue virus
IITLYLGAVVQ

SEQ ID NO: 69868 - protein, 11 aa, Dengue virus
ITLYLGAVVQA

SEQ ID NO: 69869 - protein, 11 aa, Dengue virus
TLYLGAVVQAD

SEQ ID NO: 69870 - protein, 11 aa, Dengue virus
LYLGAVVQADM

SEQ ID NO: 69871 - protein, 11 aa, Dengue virus
YLGAVVQADMG

SEQ ID NO: 69872 - protein, 11 aa, Dengue virus
LGAVVQADMGC

SEQ ID NO: 69873 - protein, 11 aa, Dengue virus
GAVVQADMGCV

SEQ ID NO: 69874 - protein, 11 aa, Dengue virus
VVQADMGCVIN

SEQ ID NO: 69875 - protein, 11 aa, Dengue virus
VQADMGCVINW

SEQ ID NO: 69876 - protein, 11 aa, Dengue virus
QADMGCVINWK

SEQ ID NO: 69877 - protein, 11 aa, Dengue virus
ADMGCVINWKG

SEQ ID NO: 69878 - protein, 11 aa, Dengue virus
DMGCVINWKGK

SEQ ID NO: 69879 - protein, 11 aa, Dengue virus
MGCVINWKGKE

SEQ ID NO: 69880 - protein, 11 aa, Dengue virus
GCVINWKGKEL

SEQ ID NO: 69881 - protein, 11 aa, Dengue virus
CVINWKGKELK

SEQ ID NO: 69882 - protein, 11 aa, Dengue virus
VINWKGKELKC

SEQ ID NO: 69883 - protein, 11 aa, Dengue virus
INWKGKELKCG

SEQ ID NO: 69884 - protein, 11 aa, Dengue virus
NWKGKELKCGS

SEQ ID NO: 69885 - protein, 11 aa, Dengue virus
WKGKELKCGSG

SEQ ID NO: 69886 - protein, 11 aa, Dengue virus
KGKELKCGSGI

SEQ ID NO: 69887 - protein, 11 aa, Dengue virus
GKELKCGSGIF

SEQ ID NO: 69888 - protein, 11 aa, Dengue virus
KELKCGSGIFV

SEQ ID NO: 69889 - protein, 11 aa, Dengue virus
ELKCGSGIFVT

SEQ ID NO: 69890 - protein, 11 aa, Dengue virus
LKCGSGIFVTN

SEQ ID NO: 69891 - protein, 11 aa, Dengue virus
KCGSGIFVTNE

SEQ ID NO: 69892 - protein, 11 aa, Dengue virus
CGSGIFVTNEV

SEQ ID NO: 69893 - protein, 11 aa, Dengue virus
GSGIFVTNEVH

SEQ ID NO: 69894 - protein, 11 aa, Dengue virus
SGIFVTNEVHT

SEQ ID NO: 69895 - protein, 11 aa, Dengue virus
GIFVTNEVHTW

SEQ ID NO: 69896 - protein, 11 aa, Dengue virus
IFVTNEVHTWT

SEQ ID NO: 69897 - protein, 11 aa, Dengue virus
FVTNEVHTWTE

SEQ ID NO: 69898 - protein, 11 aa, Dengue virus
VTNEVHTWTEQ

SEQ ID NO: 69899 - protein, 11 aa, Dengue virus
TNEVHTWTEQY

SEQ ID NO: 69900 - protein, 11 aa, Dengue virus
NEVHTWTEQYK

SEQ ID NO: 69901 - protein, 11 aa, Dengue virus
EVHTWTEQYKF

SEQ ID NO: 69902 - protein, 11 aa, Dengue virus
VHTWTEQYKFQ

SEQ ID NO: 69903 - protein, 11 aa, Dengue virus
HTWTEQYKFQA

SEQ ID NO: 69904 - protein, 11 aa, Dengue virus
TWTEQYKFQAD

SEQ ID NO: 69905 - protein, 11 aa, Dengue virus
WTEQYKFQADS

SEQ ID NO: 69906 - protein, 11 aa, Dengue virus
TEQYKFQADSP

SEQ ID NO: 69907 - protein, 11 aa, Dengue virus
EQYKFQADSPK

SEQ ID NO: 69908 - protein, 11 aa, Dengue virus
QYKFQADSPKR

SEQ ID NO: 69909 - protein, 11 aa, Dengue virus
YKFQADSPKRL

SEQ ID NO: 69910 - protein, 11 aa, Dengue virus
KFQADSPKRLA

SEQ ID NO: 69911 - protein, 11 aa, Dengue virus
FQADSPKRLAT

SEQ ID NO: 69912 - protein, 11 aa, Dengue virus
QADSPKRLATA

SEQ ID NO: 69913 - protein, 11 aa, Dengue virus
ADSPKRLATAI

SEQ ID NO: 69914 - protein, 11 aa, Dengue virus
DSPKRLATAIA

SEQ ID NO: 69915 - protein, 11 aa, Dengue virus
SPKRLATAIAG

SEQ ID NO: 69916 - protein, 11 aa, Dengue virus
PKRLATAIAGA

SEQ ID NO: 69917 - protein, 11 aa, Dengue virus
KRLATAIAGAW

SEQ ID NO: 69918 - protein, 11 aa, Dengue virus
RLATAIAGAWE

SEQ ID NO: 69919 - protein, 11 aa, Dengue virus
LATAIAGAWEN

SEQ ID NO: 69920 - protein, 11 aa, Dengue virus
ATAIAGAWENG

SEQ ID NO: 69921 - protein, 11 aa, Dengue virus
TAIAGAWENGV

SEQ ID NO: 69922 - protein, 11 aa, Dengue virus
AIAGAWENGVC

SEQ ID NO: 69923 - protein, 11 aa, Dengue virus
IAGAWENGVCG

SEQ ID NO: 69924 - protein, 11 aa, Dengue virus
AGAWENGVCGI

SEQ ID NO: 69925 - protein, 11 aa, Dengue virus
GAWENGVCGIR

SEQ ID NO: 69926 - protein, 11 aa, Dengue virus
AWENGVCGIRS

SEQ ID NO: 69927 - protein, 11 aa, Dengue virus
WENGVCGIRST

SEQ ID NO: 69928 - protein, 11 aa, Dengue virus
ENGVCGIRSTT

SEQ ID NO: 69929 - protein, 11 aa, Dengue virus
NGVCGIRSTTR

SEQ ID NO: 69930 - protein, 11 aa, Dengue virus
GVCGIRSTTRM

SEQ ID NO: 69931 - protein, 11 aa, Dengue virus
VCGIRSTTRME

SEQ ID NO: 69932 - protein, 11 aa, Dengue virus
CGIRSTTRMEN

SEQ ID NO: 69933 - protein, 11 aa, Dengue virus
GIRSTTRMENL

SEQ ID NO: 69934 - protein, 11 aa, Dengue virus
IRSTTRMENLL

SEQ ID NO: 69935 - protein, 11 aa, Dengue virus
RSTTRMENLLW

SEQ ID NO: 69936 - protein, 11 aa, Dengue virus
STTRMENLLWK

SEQ ID NO: 69937 - protein, 11 aa, Dengue virus
TTRMENLLWKQ

SEQ ID NO: 69938 - protein, 11 aa, Dengue virus
TRMENLLWKQI

SEQ ID NO: 69939 - protein, 11 aa, Dengue virus
RMENLLWKQIA

SEQ ID NO: 69940 - protein, 11 aa, Dengue virus
MENLLWKQIAN

SEQ ID NO: 69941 - protein, 11 aa, Dengue virus
ENLLWKQIANE

SEQ ID NO: 69942 - protein, 11 aa, Dengue virus
NLLWKQIANEL

SEQ ID NO: 69943 - protein, 11 aa, Dengue virus
LLWKQIANELN

SEQ ID NO: 69944 - protein, 11 aa, Dengue virus
LWKQIANELNY

SEQ ID NO: 69945 - protein, 11 aa, Dengue virus
WKQIANELNYI

SEQ ID NO: 69946 - protein, 11 aa, Dengue virus
KQIANELNYIL

SEQ ID NO: 69947 - protein, 11 aa, Dengue virus
QIANELNYILW

SEQ ID NO: 69948 - protein, 11 aa, Dengue virus
IANELNYILWE

SEQ ID NO: 69949 - protein, 11 aa, Dengue virus
ANELNYILWEN

SEQ ID NO: 69950 - protein, 11 aa, Dengue virus
NELNYILWENN

SEQ ID NO: 69951 - protein, 11 aa, Dengue virus
ELNYILWENNI

SEQ ID NO: 69952 - protein, 11 aa, Dengue virus
LNYILWENNIK

SEQ ID NO: 69953 - protein, 11 aa, Dengue virus
NYILWENNIKL

SEQ ID NO: 69954 - protein, 11 aa, Dengue virus
YILWENNIKLT

SEQ ID NO: 69955 - protein, 11 aa, Dengue virus
ILWENNIKLTV

SEQ ID NO: 69956 - protein, 11 aa, Dengue virus
LWENNIKLTVV

SEQ ID NO: 69957 - protein, 11 aa, Dengue virus
WENNIKLTVVV

SEQ ID NO: 69958 - protein, 11 aa, Dengue virus
ENNIKLTVVVG

SEQ ID NO: 69959 - protein, 11 aa, Dengue virus
NNIKLTVVVGD

SEQ ID NO: 69960 - protein, 11 aa, Dengue virus
NIKLTVVVGDI

SEQ ID NO: 69961 - protein, 11 aa, Dengue virus
IGVLEQGKRTL

SEQ ID NO: 69962 - protein, 11 aa, Dengue virus
GVLEQGKRTLT

SEQ ID NO: 69963 - protein, 11 aa, Dengue virus
VLEQGKRTLTP

SEQ ID NO: 69964 - protein, 11 aa, Dengue virus
LEQGKRTLTPQ

SEQ ID NO: 69965 - protein, 11 aa, Dengue virus
EQGKRTLTPQP

SEQ ID NO: 69966 - protein, 11 aa, Dengue virus
QGKRTLTPQPM

SEQ ID NO: 69967 - protein, 11 aa, Dengue virus
GKRTLTPQPME

SEQ ID NO: 69968 - protein, 11 aa, Dengue virus
KRTLTPQPMEL

SEQ ID NO: 69969 - protein, 11 aa, Dengue virus
RTLTPQPMELK

SEQ ID NO: 69970 - protein, 11 aa, Dengue virus
TLTPQPMELKY

SEQ ID NO: 69971 - protein, 11 aa, Dengue virus
LTPQPMELKYS

SEQ ID NO: 69972 - protein, 11 aa, Dengue virus
TPQPMELKYSW

SEQ ID NO: 69973 - protein, 11 aa, Dengue virus
PQPMELKYSWK

SEQ ID NO: 69974 - protein, 11 aa, Dengue virus
QPMELKYSWKT

SEQ ID NO: 69975 - protein, 11 aa, Dengue virus
PMELKYSWKTW

SEQ ID NO: 69976 - protein, 11 aa, Dengue virus
MELKYSWKTWG

SEQ ID NO: 69977 - protein, 11 aa, Dengue virus
ELKYSWKTWGK

SEQ ID NO: 69978 - protein, 11 aa, Dengue virus
LKYSWKTWGKA

SEQ ID NO: 69979 - protein, 11 aa, Dengue virus
KYSWKTWGKAK

SEQ ID NO: 69980 - protein, 11 aa, Dengue virus
YSWKTWGKAKI

SEQ ID NO: 69981 - protein, 11 aa, Dengue virus
SWKTWGKAKIV

SEQ ID NO: 69982 - protein, 11 aa, Dengue virus
AETQNSSFIID

SEQ ID NO: 69983 - protein, 11 aa, Dengue virus
ETQNSSFIIDG

SEQ ID NO: 69984 - protein, 11 aa, Dengue virus
TQNSSFIIDGP

SEQ ID NO: 69985 - protein, 11 aa, Dengue virus
QNSSFIIDGPN

SEQ ID NO: 69986 - protein, 11 aa, Dengue virus
NSSFIIDGPNT

SEQ ID NO: 69987 - protein, 11 aa, Dengue virus
SSFIIDGPNTP

SEQ ID NO: 69988 - protein, 11 aa, Dengue virus
SFIIDGPNTPE

SEQ ID NO: 69989 - protein, 11 aa, Dengue virus
FIIDGPNTPEC

SEQ ID NO: 69990 - protein, 11 aa, Dengue virus
IIDGPNTPECP

SEQ ID NO: 69991 - protein, 11 aa, Dengue virus
IDGPNTPECPS

SEQ ID NO: 69992 - protein, 11 aa, Dengue virus
DGPNTPECPSA

SEQ ID NO: 69993 - protein, 11 aa, Dengue virus
PSASRAWNVWE

SEQ ID NO: 69994 - protein, 11 aa, Dengue virus
SASRAWNVWEV

SEQ ID NO: 69995 - protein, 11 aa, Dengue virus
ASRAWNVWEVE

SEQ ID NO: 69996 - protein, 11 aa, Dengue virus
SRAWNVWEVED

SEQ ID NO: 69997 - protein, 11 aa, Dengue virus
RAWNVWEVEDY

SEQ ID NO: 69998 - protein, 11 aa, Dengue virus
AWNVWEVEDYG

SEQ ID NO: 69999 - protein, 11 aa, Dengue virus
WNVWEVEDYGF

SEQ ID NO: 70000 - protein, 11 aa, Dengue virus
NVWEVEDYGFG

SEQ ID NO: 70001 - protein, 11 aa, Dengue virus
VWEVEDYGFGV

SEQ ID NO: 70002 - protein, 11 aa, Dengue virus
WEVEDYGFGVF

SEQ ID NO: 70003 - protein, 11 aa, Dengue virus
EVEDYGFGVFT

SEQ ID NO: 70004 - protein, 11 aa, Dengue virus
VEDYGFGVFTT

SEQ ID NO: 70005 - protein, 11 aa, Dengue virus
EDYGFGVFTTN

SEQ ID NO: 70006 - protein, 11 aa, Dengue virus
DYGFGVFTTNI

SEQ ID NO: 70007 - protein, 11 aa, Dengue virus
YGFGVFTTNIW

SEQ ID NO: 70008 - protein, 11 aa, Dengue virus
GFGVFTTNIWL

SEQ ID NO: 70009 - protein, 11 aa, Dengue virus
FGVFTTNIWLK

SEQ ID NO: 70010 - protein, 11 aa, Dengue virus
GVFTTNIWLKL

SEQ ID NO: 70011 - protein, 11 aa, Dengue virus
VFTTNIWLKLR

SEQ ID NO: 70012 - protein, 11 aa, Dengue virus
FTTNIWLKLRE

SEQ ID NO: 70013 - protein, 11 aa, Dengue virus
TTNIWLKLREV

SEQ ID NO: 70014 - protein, 11 aa, Dengue virus
TNIWLKLREVY

SEQ ID NO: 70015 - protein, 11 aa, Dengue virus
NIWLKLREVYT

SEQ ID NO: 70016 - protein, 11 aa, Dengue virus
IWLKLREVYTQ

SEQ ID NO: 70017 - protein, 11 aa, Dengue virus
TQLCDHRLMSA

SEQ ID NO: 70018 - protein, 11 aa, Dengue virus
QLCDHRLMSAA

SEQ ID NO: 70019 - protein, 11 aa, Dengue virus
LCDHRLMSAAV

SEQ ID NO: 70020 - protein, 11 aa, Dengue virus
CDHRLMSAAVK

SEQ ID NO: 70021 - protein, 11 aa, Dengue virus
DHRLMSAAVKD

SEQ ID NO: 70022 - protein, 11 aa, Dengue virus
HRLMSAAVKDE

SEQ ID NO: 70023 - protein, 11 aa, Dengue virus
RLMSAAVKDER

SEQ ID NO: 70024 - protein, 11 aa, Dengue virus
LMSAAVKDERA

SEQ ID NO: 70025 - protein, 11 aa, Dengue virus
MSAAVKDERAV

SEQ ID NO: 70026 - protein, 11 aa, Dengue virus
SAAVKDERAVH

SEQ ID NO: 70027 - protein, 11 aa, Dengue virus
AAVKDERAVHA

SEQ ID NO: 70028 - protein, 11 aa, Dengue virus
AVKDERAVHAD

SEQ ID NO: 70029 - protein, 11 aa, Dengue virus
VKDERAVHADM

SEQ ID NO: 70030 - protein, 11 aa, Dengue virus
KDERAVHADMG

SEQ ID NO: 70031 - protein, 11 aa, Dengue virus
DERAVHADMGY

SEQ ID NO: 70032 - protein, 11 aa, Dengue virus
ERAVHADMGYW

SEQ ID NO: 70033 - protein, 11 aa, Dengue virus
RAVHADMGYWI

SEQ ID NO: 70034 - protein, 11 aa, Dengue virus
AVHADMGYWIE

SEQ ID NO: 70035 - protein, 11 aa, Dengue virus
VHADMGYWIES

SEQ ID NO: 70036 - protein, 11 aa, Dengue virus
HADMGYWIESQ

SEQ ID NO: 70037 - protein, 11 aa, Dengue virus
ADMGYWIESQK

SEQ ID NO: 70038 - protein, 11 aa, Dengue virus
DMGYWIESQKN

SEQ ID NO: 70039 - protein, 11 aa, Dengue virus
MGYWIESQKNG

SEQ ID NO: 70040 - protein, 11 aa, Dengue virus
GYWIESQKNGS

SEQ ID NO: 70041 - protein, 11 aa, Dengue virus
YWIESQKNGSW

SEQ ID NO: 70042 - protein, 11 aa, Dengue virus
WIESQKNGSWK

SEQ ID NO: 70043 - protein, 11 aa, Dengue virus
IESQKNGSWKL

SEQ ID NO: 70044 - protein, 11 aa, Dengue virus
ESQKNGSWKLE

SEQ ID NO: 70045 - protein, 11 aa, Dengue virus
SQKNGSWKLEK

SEQ ID NO: 70046 - protein, 11 aa, Dengue virus
QKNGSWKLEKA

SEQ ID NO: 70047 - protein, 11 aa, Dengue virus
KNGSWKLEKAS

SEQ ID NO: 70048 - protein, 11 aa, Dengue virus
NGSWKLEKASL

SEQ ID NO: 70049 - protein, 11 aa, Dengue virus
GSWKLEKASLI

SEQ ID NO: 70050 - protein, 11 aa, Dengue virus
SWKLEKASLIE

SEQ ID NO: 70051 - protein, 11 aa, Dengue virus
WKLEKASLIEV

SEQ ID NO: 70052 - protein, 11 aa, Dengue virus
KLEKASLIEVK

SEQ ID NO: 70053 - protein, 11 aa, Dengue virus
LEKASLIEVKT

SEQ ID NO: 70054 - protein, 11 aa, Dengue virus
EKASLIEVKTC

SEQ ID NO: 70055 - protein, 11 aa, Dengue virus
KASLIEVKTCT

SEQ ID NO: 70056 - protein, 11 aa, Dengue virus
ASLIEVKTCTW

SEQ ID NO: 70057 - protein, 11 aa, Dengue virus
SLIEVKTCTWP

SEQ ID NO: 70058 - protein, 11 aa, Dengue virus
LIEVKTCTWPK

SEQ ID NO: 70059 - protein, 11 aa, Dengue virus
IEVKTCTWPKS

SEQ ID NO: 70060 - protein, 11 aa, Dengue virus
EVKTCTWPKSH

SEQ ID NO: 70061 - protein, 11 aa, Dengue virus
VKTCTWPKSHT

SEQ ID NO: 70062 - protein, 11 aa, Dengue virus
KTCTWPKSHTL

SEQ ID NO: 70063 - protein, 11 aa, Dengue virus
TCTWPKSHTLW

SEQ ID NO: 70064 - protein, 11 aa, Dengue virus
CTWPKSHTLWS

SEQ ID NO: 70065 - protein, 11 aa, Dengue virus
TWPKSHTLWSN

SEQ ID NO: 70066 - protein, 11 aa, Dengue virus
WPKSHTLWSNG

SEQ ID NO: 70067 - protein, 11 aa, Dengue virus
PKSHTLWSNGV

SEQ ID NO: 70068 - protein, 11 aa, Dengue virus
KSHTLWSNGVL

SEQ ID NO: 70069 - protein, 11 aa, Dengue virus
SHTLWSNGVLE

SEQ ID NO: 70070 - protein, 11 aa, Dengue virus
HTLWSNGVLES

SEQ ID NO: 70071 - protein, 11 aa, Dengue virus
TLWSNGVLESD

SEQ ID NO: 70072 - protein, 11 aa, Dengue virus
LWSNGVLESDM

SEQ ID NO: 70073 - protein, 11 aa, Dengue virus
WSNGVLESDMI

SEQ ID NO: 70074 - protein, 11 aa, Dengue virus
SNGVLESDMII

SEQ ID NO: 70075 - protein, 11 aa, Dengue virus
NGVLESDMIIP

SEQ ID NO: 70076 - protein, 11 aa, Dengue virus
GVLESDMIIPK

SEQ ID NO: 70077 - protein, 11 aa, Dengue virus
VLESDMIIPKS

SEQ ID NO: 70078 - protein, 11 aa, Dengue virus
LESDMIIPKSL

SEQ ID NO: 70079 - protein, 11 aa, Dengue virus
ESDMIIPKSLA

SEQ ID NO: 70080 - protein, 11 aa, Dengue virus
SDMIIPKSLAG

SEQ ID NO: 70081 - protein, 11 aa, Dengue virus
DMIIPKSLAGP

SEQ ID NO: 70082 - protein, 11 aa, Dengue virus
MIIPKSLAGPI

SEQ ID NO: 70083 - protein, 11 aa, Dengue virus
IIPKSLAGPIS

SEQ ID NO: 70084 - protein, 11 aa, Dengue virus
IPKSLAGPISQ

SEQ ID NO: 70085 - protein, 11 aa, Dengue virus
PKSLAGPISQH

SEQ ID NO: 70086 - protein, 11 aa, Dengue virus
KSLAGPISQHN

SEQ ID NO: 70087 - protein, 11 aa, Dengue virus
SLAGPISQHNY

SEQ ID NO: 70088 - protein, 11 aa, Dengue virus
LAGPISQHNYR

SEQ ID NO: 70089 - protein, 11 aa, Dengue virus
AGPISQHNYRP

SEQ ID NO: 70090 - protein, 11 aa, Dengue virus
GPISQHNYRPG

SEQ ID NO: 70091 - protein, 11 aa, Dengue virus
PISQHNYRPGY

SEQ ID NO: 70092 - protein, 11 aa, Dengue virus
ISQHNYRPGYH

SEQ ID NO: 70093 - protein, 11 aa, Dengue virus
SQHNYRPGYHT

SEQ ID NO: 70094 - protein, 11 aa, Dengue virus
QHNYRPGYHTQ

SEQ ID NO: 70095 - protein, 11 aa, Dengue virus
HNYRPGYHTQT

SEQ ID NO: 70096 - protein, 11 aa, Dengue virus
NYRPGYHTQTA

SEQ ID NO: 70097 - protein, 11 aa, Dengue virus
YRPGYHTQTAG

SEQ ID NO: 70098 - protein, 11 aa, Dengue virus
RPGYHTQTAGP

SEQ ID NO: 70099 - protein, 11 aa, Dengue virus
PGYHTQTAGPW

SEQ ID NO: 70100 - protein, 11 aa, Dengue virus
GYHTQTAGPWH

SEQ ID NO: 70101 - protein, 11 aa, Dengue virus
YHTQTAGPWHL

SEQ ID NO: 70102 - protein, 11 aa, Dengue virus
HTQTAGPWHLG

SEQ ID NO: 70103 - protein, 11 aa, Dengue virus
TQTAGPWHLGK

SEQ ID NO: 70104 - protein, 11 aa, Dengue virus
QTAGPWHLGKL

SEQ ID NO: 70105 - protein, 11 aa, Dengue virus
TAGPWHLGKLE

SEQ ID NO: 70106 - protein, 11 aa, Dengue virus
AGPWHLGKLEL

SEQ ID NO: 70107 - protein, 11 aa, Dengue virus
GPWHLGKLELD

SEQ ID NO: 70108 - protein, 11 aa, Dengue virus
PWHLGKLELDF

SEQ ID NO: 70109 - protein, 11 aa, Dengue virus
WHLGKLELDFN

SEQ ID NO: 70110 - protein, 11 aa, Dengue virus
HLGKLELDFNY

SEQ ID NO: 70111 - protein, 11 aa, Dengue virus
LGKLELDFNYC

SEQ ID NO: 70112 - protein, 11 aa, Dengue virus
GKLELDFNYCE

SEQ ID NO: 70113 - protein, 11 aa, Dengue virus
KLELDFNYCEG

SEQ ID NO: 70114 - protein, 11 aa, Dengue virus
LELDFNYCEGT

SEQ ID NO: 70115 - protein, 11 aa, Dengue virus
ELDFNYCEGTT

SEQ ID NO: 70116 - protein, 11 aa, Dengue virus
LDFNYCEGTTV

SEQ ID NO: 70117 - protein, 11 aa, Dengue virus
DFNYCEGTTVV

SEQ ID NO: 70118 - protein, 11 aa, Dengue virus
FNYCEGTTVVI

SEQ ID NO: 70119 - protein, 11 aa, Dengue virus
NYCEGTTVVIT

SEQ ID NO: 70120 - protein, 11 aa, Dengue virus
YCEGTTVVITE

SEQ ID NO: 70121 - protein, 11 aa, Dengue virus
CEGTTVVITEN

SEQ ID NO: 70122 - protein, 11 aa, Dengue virus
EGTTVVITENC

SEQ ID NO: 70123 - protein, 11 aa, Dengue virus
GTTVVITENCG

SEQ ID NO: 70124 - protein, 11 aa, Dengue virus
TTVVITENCGT

SEQ ID NO: 70125 - protein, 11 aa, Dengue virus
CGTRGPSLRTT

SEQ ID NO: 70126 - protein, 11 aa, Dengue virus
GTRGPSLRTTT

SEQ ID NO: 70127 - protein, 11 aa, Dengue virus
TRGPSLRTTTV

SEQ ID NO: 70128 - protein, 11 aa, Dengue virus
RGPSLRTTTVS

SEQ ID NO: 70129 - protein, 11 aa, Dengue virus
GPSLRTTTVSG

SEQ ID NO: 70130 - protein, 11 aa, Dengue virus
PSLRTTTVSGK

SEQ ID NO: 70131 - protein, 11 aa, Dengue virus
SLRTTTVSGKL

SEQ ID NO: 70132 - protein, 11 aa, Dengue virus
LRTTTVSGKLI

SEQ ID NO: 70133 - protein, 11 aa, Dengue virus
RTTTVSGKLIH

SEQ ID NO: 70134 - protein, 11 aa, Dengue virus
TTTVSGKLIHE

SEQ ID NO: 70135 - protein, 11 aa, Dengue virus
TTVSGKLIHEW

SEQ ID NO: 70136 - protein, 11 aa, Dengue virus
TVSGKLIHEWC

SEQ ID NO: 70137 - protein, 11 aa, Dengue virus
VSGKLIHEWCC

SEQ ID NO: 70138 - protein, 11 aa, Dengue virus
SGKLIHEWCCR

SEQ ID NO: 70139 - protein, 11 aa, Dengue virus
GKLIHEWCCRS

SEQ ID NO: 70140 - protein, 11 aa, Dengue virus
KLIHEWCCRSC

SEQ ID NO: 70141 - protein, 11 aa, Dengue virus
LIHEWCCRSCT

SEQ ID NO: 70142 - protein, 11 aa, Dengue virus
IHEWCCRSCTL

SEQ ID NO: 70143 - protein, 11 aa, Dengue virus
HEWCCRSCTLP

SEQ ID NO: 70144 - protein, 11 aa, Dengue virus
EWCCRSCTLPP

SEQ ID NO: 70145 - protein, 11 aa, Dengue virus
WCCRSCTLPPL

SEQ ID NO: 70146 - protein, 11 aa, Dengue virus
CCRSCTLPPLR

SEQ ID NO: 70147 - protein, 11 aa, Dengue virus
CRSCTLPPLRY

SEQ ID NO: 70148 - protein, 11 aa, Dengue virus
RSCTLPPLRYM

SEQ ID NO: 70149 - protein, 11 aa, Dengue virus
SCTLPPLRYMG

SEQ ID NO: 70150 - protein, 11 aa, Dengue virus
CTLPPLRYMGE

SEQ ID NO: 70151 - protein, 11 aa, Dengue virus
TLPPLRYMGED

SEQ ID NO: 70152 - protein, 11 aa, Dengue virus
LPPLRYMGEDG

SEQ ID NO: 70153 - protein, 11 aa, Dengue virus
PPLRYMGEDGC

SEQ ID NO: 70154 - protein, 11 aa, Dengue virus
PLRYMGEDGCW

SEQ ID NO: 70155 - protein, 11 aa, Dengue virus
LRYMGEDGCWY

SEQ ID NO: 70156 - protein, 11 aa, Dengue virus
RYMGEDGCWYG

SEQ ID NO: 70157 - protein, 11 aa, Dengue virus
YMGEDGCWYGM

SEQ ID NO: 70158 - protein, 11 aa, Dengue virus
MGEDGCWYGME

SEQ ID NO: 70159 - protein, 11 aa, Dengue virus
GEDGCWYGMEI

SEQ ID NO: 70160 - protein, 11 aa, Dengue virus
EDGCWYGMEIR

SEQ ID NO: 70161 - protein, 11 aa, Dengue virus
DGCWYGMEIRP

SEQ ID NO: 70162 - protein, 11 aa, Dengue virus
GCWYGMEIRPI

SEQ ID NO: 70163 - protein, 11 aa, Dengue virus
CWYGMEIRPIS

SEQ ID NO: 70164 - protein, 11 aa, Dengue virus
WYGMEIRPISE

SEQ ID NO: 70165 - protein, 11 aa, Dengue virus
YGMEIRPISEK

SEQ ID NO: 70166 - protein, 11 aa, Dengue virus
GMEIRPISEKE

SEQ ID NO: 70167 - protein, 11 aa, Dengue virus
MEIRPISEKEE

SEQ ID NO: 70168 - protein, 11 aa, Dengue virus
EIRPISEKEEN

SEQ ID NO: 70169 - protein, 11 aa, Dengue virus
IRPISEKEENM

SEQ ID NO: 70170 - protein, 11 aa, Dengue virus
RPISEKEENMV

SEQ ID NO: 70171 - protein, 11 aa, Dengue virus
PISEKEENMVK

SEQ ID NO: 70172 - protein, 11 aa, Dengue virus
ISEKEENMVKS

SEQ ID NO: 70173 - protein, 11 aa, Dengue virus
SEKEENMVKSL

SEQ ID NO: 70174 - protein, 11 aa, Dengue virus
EKEENMVKSLV

SEQ ID NO: 70175 - protein, 11 aa, Dengue virus
KEENMVKSLVS

SEQ ID NO: 70176 - protein, 11 aa, Dengue virus
EENMVKSLVSA

SEQ ID NO: 70177 - protein, 11 aa, Dengue virus
ENMVKSLVSAG

SEQ ID NO: 70178 - protein, 11 aa, Dengue virus
NMVKSLVSAGS

SEQ ID NO: 70179 - protein, 11 aa, Dengue virus
MVKSLVSAGSG

SEQ ID NO: 70180 - protein, 11 aa, Dengue virus
VKSLVSAGSGK

SEQ ID NO: 70181 - protein, 11 aa, Dengue virus
KSLVSAGSGKV

SEQ ID NO: 70182 - protein, 11 aa, Dengue virus
SLVSAGSGKVD

SEQ ID NO: 70183 - protein, 11 aa, Dengue virus
LVSAGSGKVDN

SEQ ID NO: 70184 - protein, 11 aa, Dengue virus
VSAGSGKVDNF

SEQ ID NO: 70185 - protein, 11 aa, Dengue virus
SAGSGKVDNFT

SEQ ID NO: 70186 - protein, 11 aa, Dengue virus
AGSGKVDNFTM

SEQ ID NO: 70187 - protein, 11 aa, Dengue virus
GSGKVDNFTMG

SEQ ID NO: 70188 - protein, 11 aa, Dengue virus
VDNFTMGVLCL

SEQ ID NO: 70189 - protein, 11 aa, Dengue virus
DNFTMGVLCLA

SEQ ID NO: 70190 - protein, 11 aa, Dengue virus
NFTMGVLCLAI

SEQ ID NO: 70191 - protein, 11 aa, Dengue virus
FTMGVLCLAIL

SEQ ID NO: 70192 - protein, 11 aa, Dengue virus
TMGVLCLAILF

SEQ ID NO: 70193 - protein, 11 aa, Dengue virus
MGVLCLAILFE

SEQ ID NO: 70194 - protein, 11 aa, Dengue virus
GVLCLAILFEE

SEQ ID NO: 70195 - protein, 11 aa, Dengue virus
VLCLAILFEEV

SEQ ID NO: 70196 - protein, 11 aa, Dengue virus
LCLAILFEEVM

SEQ ID NO: 70197 - protein, 11 aa, Dengue virus
CLAILFEEVMR

SEQ ID NO: 70198 - protein, 11 aa, Dengue virus
LAILFEEVMRG

SEQ ID NO: 70199 - protein, 11 aa, Dengue virus
AILFEEVMRGK

SEQ ID NO: 70200 - protein, 11 aa, Dengue virus
ILFEEVMRGKF

SEQ ID NO: 70201 - protein, 11 aa, Dengue virus
LFEEVMRGKFG

SEQ ID NO: 70202 - protein, 11 aa, Dengue virus
FEEVMRGKFGK

SEQ ID NO: 70203 - protein, 11 aa, Dengue virus
EEVMRGKFGKK

SEQ ID NO: 70204 - protein, 11 aa, Dengue virus
EVMRGKFGKKH

SEQ ID NO: 70205 - protein, 11 aa, Dengue virus
VMRGKFGKKHM

SEQ ID NO: 70206 - protein, 11 aa, Dengue virus
MRGKFGKKHMI

SEQ ID NO: 70207 - protein, 11 aa, Dengue virus
RGKFGKKHMIA

SEQ ID NO: 70208 - protein, 11 aa, Dengue virus
GKFGKKHMIAG

SEQ ID NO: 70209 - protein, 11 aa, Dengue virus
KFGKKHMIAGV

SEQ ID NO: 70210 - protein, 11 aa, Dengue virus
FTFVLLLSGQI

SEQ ID NO: 70211 - protein, 11 aa, Dengue virus
TFVLLLSGQIT

SEQ ID NO: 70212 - protein, 11 aa, Dengue virus
FVLLLSGQITW

SEQ ID NO: 70213 - protein, 11 aa, Dengue virus
VLLLSGQITWR

SEQ ID NO: 70214 - protein, 11 aa, Dengue virus
LLLSGQITWRD

SEQ ID NO: 70215 - protein, 11 aa, Dengue virus
LLSGQITWRDM

SEQ ID NO: 70216 - protein, 11 aa, Dengue virus
LSGQITWRDMA

SEQ ID NO: 70217 - protein, 11 aa, Dengue virus
TLIMIGSNASD

SEQ ID NO: 70218 - protein, 11 aa, Dengue virus
LIMIGSNASDR

SEQ ID NO: 70219 - protein, 11 aa, Dengue virus
IMIGSNASDRM

SEQ ID NO: 70220 - protein, 11 aa, Dengue virus
MIGSNASDRMG

SEQ ID NO: 70221 - protein, 11 aa, Dengue virus
IGSNASDRMGM

SEQ ID NO: 70222 - protein, 11 aa, Dengue virus
GSNASDRMGMG

SEQ ID NO: 70223 - protein, 11 aa, Dengue virus
SNASDRMGMGV

SEQ ID NO: 70224 - protein, 11 aa, Dengue virus
NASDRMGMGVT

SEQ ID NO: 70225 - protein, 11 aa, Dengue virus
ASDRMGMGVTY

SEQ ID NO: 70226 - protein, 11 aa, Dengue virus
SDRMGMGVTYL

SEQ ID NO: 70227 - protein, 11 aa, Dengue virus
DRMGMGVTYLA

SEQ ID NO: 70228 - protein, 11 aa, Dengue virus
RMGMGVTYLAL

SEQ ID NO: 70229 - protein, 11 aa, Dengue virus
MGMGVTYLALI

SEQ ID NO: 70230 - protein, 11 aa, Dengue virus
GMGVTYLALIA

SEQ ID NO: 70231 - protein, 11 aa, Dengue virus
MGVTYLALIAT

SEQ ID NO: 70232 - protein, 11 aa, Dengue virus
GVTYLALIATF

SEQ ID NO: 70233 - protein, 11 aa, Dengue virus
VTYLALIATFK

SEQ ID NO: 70234 - protein, 11 aa, Dengue virus
TYLALIATFKI

SEQ ID NO: 70235 - protein, 11 aa, Dengue virus
YLALIATFKIQ

SEQ ID NO: 70236 - protein, 11 aa, Dengue virus
LALIATFKIQP

SEQ ID NO: 70237 - protein, 11 aa, Dengue virus
ALIATFKIQPF

SEQ ID NO: 70238 - protein, 11 aa, Dengue virus
LIATFKIQPFL

SEQ ID NO: 70239 - protein, 11 aa, Dengue virus
IATFKIQPFLA

SEQ ID NO: 70240 - protein, 11 aa, Dengue virus
ATFKIQPFLAL

SEQ ID NO: 70241 - protein, 11 aa, Dengue virus
TFKIQPFLALG

SEQ ID NO: 70242 - protein, 11 aa, Dengue virus
FKIQPFLALGF

SEQ ID NO: 70243 - protein, 11 aa, Dengue virus
KIQPFLALGFF

SEQ ID NO: 70244 - protein, 11 aa, Dengue virus
IQPFLALGFFL

SEQ ID NO: 70245 - protein, 11 aa, Dengue virus
QPFLALGFFLR

SEQ ID NO: 70246 - protein, 11 aa, Dengue virus
PFLALGFFLRK

SEQ ID NO: 70247 - protein, 11 aa, Dengue virus
FLALGFFLRKL

SEQ ID NO: 70248 - protein, 11 aa, Dengue virus
LALGFFLRKLT

SEQ ID NO: 70249 - protein, 11 aa, Dengue virus
ALGFFLRKLTS

SEQ ID NO: 70250 - protein, 11 aa, Dengue virus
LGFFLRKLTSR

SEQ ID NO: 70251 - protein, 11 aa, Dengue virus
GFFLRKLTSRE

SEQ ID NO: 70252 - protein, 11 aa, Dengue virus
FFLRKLTSREN

SEQ ID NO: 70253 - protein, 11 aa, Dengue virus
FLRKLTSRENL

SEQ ID NO: 70254 - protein, 11 aa, Dengue virus
LRKLTSRENLL

SEQ ID NO: 70255 - protein, 11 aa, Dengue virus
RKLTSRENLLL

SEQ ID NO: 70256 - protein, 11 aa, Dengue virus
KLTSRENLLLG

SEQ ID NO: 70257 - protein, 11 aa, Dengue virus
LTSRENLLLGV

SEQ ID NO: 70258 - protein, 11 aa, Dengue virus
TSRENLLLGVG

SEQ ID NO: 70259 - protein, 11 aa, Dengue virus
SRENLLLGVGL

SEQ ID NO: 70260 - protein, 11 aa, Dengue virus
RENLLLGVGLA

SEQ ID NO: 70261 - protein, 11 aa, Dengue virus
ENLLLGVGLAM

SEQ ID NO: 70262 - protein, 11 aa, Dengue virus
NLLLGVGLAMA

SEQ ID NO: 70263 - protein, 11 aa, Dengue virus
LLLGVGLAMAT

SEQ ID NO: 70264 - protein, 11 aa, Dengue virus
LLGVGLAMATT

SEQ ID NO: 70265 - protein, 11 aa, Dengue virus
LGVGLAMATTL

SEQ ID NO: 70266 - protein, 11 aa, Dengue virus
GVGLAMATTLQ

SEQ ID NO: 70267 - protein, 11 aa, Dengue virus
VGLAMATTLQL

SEQ ID NO: 70268 - protein, 11 aa, Dengue virus
GLAMATTLQLP

SEQ ID NO: 70269 - protein, 11 aa, Dengue virus
LAMATTLQLPE

SEQ ID NO: 70270 - protein, 11 aa, Dengue virus
AMATTLQLPED

SEQ ID NO: 70271 - protein, 11 aa, Dengue virus
MATTLQLPEDI

SEQ ID NO: 70272 - protein, 11 aa, Dengue virus
ATTLQLPEDIE

SEQ ID NO: 70273 - protein, 11 aa, Dengue virus
TTLQLPEDIEQ

SEQ ID NO: 70274 - protein, 11 aa, Dengue virus
TLQLPEDIEQM

SEQ ID NO: 70275 - protein, 11 aa, Dengue virus
LQLPEDIEQMA

SEQ ID NO: 70276 - protein, 11 aa, Dengue virus
QLPEDIEQMAN

SEQ ID NO: 70277 - protein, 11 aa, Dengue virus
LPEDIEQMANG

SEQ ID NO: 70278 - protein, 11 aa, Dengue virus
PEDIEQMANGI

SEQ ID NO: 70279 - protein, 11 aa, Dengue virus
EDIEQMANGIA

SEQ ID NO: 70280 - protein, 11 aa, Dengue virus
DIEQMANGIAL

SEQ ID NO: 70281 - protein, 11 aa, Dengue virus
IEQMANGIALG

SEQ ID NO: 70282 - protein, 11 aa, Dengue virus
EQMANGIALGL

SEQ ID NO: 70283 - protein, 11 aa, Dengue virus
QMANGIALGLM

SEQ ID NO: 70284 - protein, 11 aa, Dengue virus
MANGIALGLMA

SEQ ID NO: 70285 - protein, 11 aa, Dengue virus
ANGIALGLMAL

SEQ ID NO: 70286 - protein, 11 aa, Dengue virus
NGIALGLMALK

SEQ ID NO: 70287 - protein, 11 aa, Dengue virus
GIALGLMALKL

SEQ ID NO: 70288 - protein, 11 aa, Dengue virus
IALGLMALKLI

SEQ ID NO: 70289 - protein, 11 aa, Dengue virus
ALGLMALKLIT

SEQ ID NO: 70290 - protein, 11 aa, Dengue virus
LGLMALKLITQ

SEQ ID NO: 70291 - protein, 11 aa, Dengue virus
GLMALKLITQF

SEQ ID NO: 70292 - protein, 11 aa, Dengue virus
LMALKLITQFE

SEQ ID NO: 70293 - protein, 11 aa, Dengue virus
MALKLITQFET

SEQ ID NO: 70294 - protein, 11 aa, Dengue virus
ALKLITQFETY

SEQ ID NO: 70295 - protein, 11 aa, Dengue virus
LKLITQFETYQ

SEQ ID NO: 70296 - protein, 11 aa, Dengue virus
KLITQFETYQL

SEQ ID NO: 70297 - protein, 11 aa, Dengue virus
LITQFETYQLW

SEQ ID NO: 70298 - protein, 11 aa, Dengue virus
ITQFETYQLWT

SEQ ID NO: 70299 - protein, 11 aa, Dengue virus
TQFETYQLWTA

SEQ ID NO: 70300 - protein, 11 aa, Dengue virus
QFETYQLWTAL

SEQ ID NO: 70301 - protein, 11 aa, Dengue virus
FETYQLWTALI

SEQ ID NO: 70302 - protein, 11 aa, Dengue virus
ETYQLWTALIS

SEQ ID NO: 70303 - protein, 11 aa, Dengue virus
TYQLWTALISL

SEQ ID NO: 70304 - protein, 11 aa, Dengue virus
YQLWTALISLT

SEQ ID NO: 70305 - protein, 11 aa, Dengue virus
QLWTALISLTC

SEQ ID NO: 70306 - protein, 11 aa, Dengue virus
SLTCSNTIFTL

SEQ ID NO: 70307 - protein, 11 aa, Dengue virus
LTCSNTIFTLT

SEQ ID NO: 70308 - protein, 11 aa, Dengue virus
TCSNTIFTLTV

SEQ ID NO: 70309 - protein, 11 aa, Dengue virus
CSNTIFTLTVA

SEQ ID NO: 70310 - protein, 11 aa, Dengue virus
SNTIFTLTVAW

SEQ ID NO: 70311 - protein, 11 aa, Dengue virus
NTIFTLTVAWR

SEQ ID NO: 70312 - protein, 11 aa, Dengue virus
TIFTLTVAWRT

SEQ ID NO: 70313 - protein, 11 aa, Dengue virus
IFTLTVAWRTA

SEQ ID NO: 70314 - protein, 11 aa, Dengue virus
FTLTVAWRTAT

SEQ ID NO: 70315 - protein, 11 aa, Dengue virus
TLTVAWRTATL

SEQ ID NO: 70316 - protein, 11 aa, Dengue virus
LTVAWRTATLI

SEQ ID NO: 70317 - protein, 11 aa, Dengue virus
TVAWRTATLIL

SEQ ID NO: 70318 - protein, 11 aa, Dengue virus
VAWRTATLILA

SEQ ID NO: 70319 - protein, 11 aa, Dengue virus
AWRTATLILAG

SEQ ID NO: 70320 - protein, 11 aa, Dengue virus
WRTATLILAGV

SEQ ID NO: 70321 - protein, 11 aa, Dengue virus
RTATLILAGVS

SEQ ID NO: 70322 - protein, 11 aa, Dengue virus
TATLILAGVSL

SEQ ID NO: 70323 - protein, 11 aa, Dengue virus
ATLILAGVSLL

SEQ ID NO: 70324 - protein, 11 aa, Dengue virus
TLILAGVSLLP

SEQ ID NO: 70325 - protein, 11 aa, Dengue virus
VSLLPVCQSSS

SEQ ID NO: 70326 - protein, 11 aa, Dengue virus
SLLPVCQSSSM

SEQ ID NO: 70327 - protein, 11 aa, Dengue virus
LLPVCQSSSMR

SEQ ID NO: 70328 - protein, 11 aa, Dengue virus
LPVCQSSSMRK

SEQ ID NO: 70329 - protein, 11 aa, Dengue virus
PVCQSSSMRKT

SEQ ID NO: 70330 - protein, 11 aa, Dengue virus
VCQSSSMRKTD

SEQ ID NO: 70331 - protein, 11 aa, Dengue virus
CQSSSMRKTDW

SEQ ID NO: 70332 - protein, 11 aa, Dengue virus
QSSSMRKTDWL

SEQ ID NO: 70333 - protein, 11 aa, Dengue virus
SSSMRKTDWLP

SEQ ID NO: 70334 - protein, 11 aa, Dengue virus
SSMRKTDWLPM

SEQ ID NO: 70335 - protein, 11 aa, Dengue virus
SMRKTDWLPMT

SEQ ID NO: 70336 - protein, 11 aa, Dengue virus
MRKTDWLPMTV

SEQ ID NO: 70337 - protein, 11 aa, Dengue virus
RKTDWLPMTVA

SEQ ID NO: 70338 - protein, 11 aa, Dengue virus
KTDWLPMTVAA

SEQ ID NO: 70339 - protein, 11 aa, Dengue virus
TDWLPMTVAAM

SEQ ID NO: 70340 - protein, 11 aa, Dengue virus
DWLPMTVAAMG

SEQ ID NO: 70341 - protein, 11 aa, Dengue virus
WLPMTVAAMGV

SEQ ID NO: 70342 - protein, 11 aa, Dengue virus
VAAMGVPPLPL

SEQ ID NO: 70343 - protein, 11 aa, Dengue virus
AAMGVPPLPLF

SEQ ID NO: 70344 - protein, 11 aa, Dengue virus
AMGVPPLPLFI

SEQ ID NO: 70345 - protein, 11 aa, Dengue virus
MGVPPLPLFIF

SEQ ID NO: 70346 - protein, 11 aa, Dengue virus
PLPLFIFSLKD

SEQ ID NO: 70347 - protein, 11 aa, Dengue virus
LPLFIFSLKDT

SEQ ID NO: 70348 - protein, 11 aa, Dengue virus
LKDTLKRRSWP

SEQ ID NO: 70349 - protein, 11 aa, Dengue virus
KDTLKRRSWPL

SEQ ID NO: 70350 - protein, 11 aa, Dengue virus
DTLKRRSWPLN

SEQ ID NO: 70351 - protein, 11 aa, Dengue virus
TLKRRSWPLNE

SEQ ID NO: 70352 - protein, 11 aa, Dengue virus
LKRRSWPLNEG

SEQ ID NO: 70353 - protein, 11 aa, Dengue virus
KRRSWPLNEGV

SEQ ID NO: 70354 - protein, 11 aa, Dengue virus
RRSWPLNEGVM

SEQ ID NO: 70355 - protein, 11 aa, Dengue virus
RSWPLNEGVMA

SEQ ID NO: 70356 - protein, 11 aa, Dengue virus
SWPLNEGVMAV

SEQ ID NO: 70357 - protein, 11 aa, Dengue virus
WPLNEGVMAVG

SEQ ID NO: 70358 - protein, 11 aa, Dengue virus
PLNEGVMAVGL

SEQ ID NO: 70359 - protein, 11 aa, Dengue virus
LNEGVMAVGLV

SEQ ID NO: 70360 - protein, 11 aa, Dengue virus
NEGVMAVGLVS

SEQ ID NO: 70361 - protein, 11 aa, Dengue virus
EGVMAVGLVSI

SEQ ID NO: 70362 - protein, 11 aa, Dengue virus
GVMAVGLVSIL

SEQ ID NO: 70363 - protein, 11 aa, Dengue virus
VMAVGLVSILA

SEQ ID NO: 70364 - protein, 11 aa, Dengue virus
MAVGLVSILAS

SEQ ID NO: 70365 - protein, 11 aa, Dengue virus
AVGLVSILASS

SEQ ID NO: 70366 - protein, 11 aa, Dengue virus
VGLVSILASSL

SEQ ID NO: 70367 - protein, 11 aa, Dengue virus
GLVSILASSLL

SEQ ID NO: 70368 - protein, 11 aa, Dengue virus
LVSILASSLLR

SEQ ID NO: 70369 - protein, 11 aa, Dengue virus
VSILASSLLRN

SEQ ID NO: 70370 - protein, 11 aa, Dengue virus
SILASSLLRND

SEQ ID NO: 70371 - protein, 11 aa, Dengue virus
ILASSLLRNDV

SEQ ID NO: 70372 - protein, 11 aa, Dengue virus
LASSLLRNDVP

SEQ ID NO: 70373 - protein, 11 aa, Dengue virus
ASSLLRNDVPM

SEQ ID NO: 70374 - protein, 11 aa, Dengue virus
SSLLRNDVPMA

SEQ ID NO: 70375 - protein, 11 aa, Dengue virus
SLLRNDVPMAG

SEQ ID NO: 70376 - protein, 11 aa, Dengue virus
LLRNDVPMAGP

SEQ ID NO: 70377 - protein, 11 aa, Dengue virus
LRNDVPMAGPL

SEQ ID NO: 70378 - protein, 11 aa, Dengue virus
RNDVPMAGPLV

SEQ ID NO: 70379 - protein, 11 aa, Dengue virus
NDVPMAGPLVA

SEQ ID NO: 70380 - protein, 11 aa, Dengue virus
DVPMAGPLVAG

SEQ ID NO: 70381 - protein, 11 aa, Dengue virus
VPMAGPLVAGG

SEQ ID NO: 70382 - protein, 11 aa, Dengue virus
PMAGPLVAGGL

SEQ ID NO: 70383 - protein, 11 aa, Dengue virus
MAGPLVAGGLL

SEQ ID NO: 70384 - protein, 11 aa, Dengue virus
AGPLVAGGLLI

SEQ ID NO: 70385 - protein, 11 aa, Dengue virus
GPLVAGGLLIA

SEQ ID NO: 70386 - protein, 11 aa, Dengue virus
PLVAGGLLIAC

SEQ ID NO: 70387 - protein, 11 aa, Dengue virus
LVAGGLLIACY

SEQ ID NO: 70388 - protein, 11 aa, Dengue virus
VAGGLLIACYV

SEQ ID NO: 70389 - protein, 11 aa, Dengue virus
AGGLLIACYVI

SEQ ID NO: 70390 - protein, 11 aa, Dengue virus
GGLLIACYVIT

SEQ ID NO: 70391 - protein, 11 aa, Dengue virus
GLLIACYVITG

SEQ ID NO: 70392 - protein, 11 aa, Dengue virus
LLIACYVITGT

SEQ ID NO: 70393 - protein, 11 aa, Dengue virus
LIACYVITGTS

SEQ ID NO: 70394 - protein, 11 aa, Dengue virus
IACYVITGTSA

SEQ ID NO: 70395 - protein, 11 aa, Dengue virus
ACYVITGTSAD

SEQ ID NO: 70396 - protein, 11 aa, Dengue virus
CYVITGTSADL

SEQ ID NO: 70397 - protein, 11 aa, Dengue virus
YVITGTSADLT

SEQ ID NO: 70398 - protein, 11 aa, Dengue virus
VITGTSADLTV

SEQ ID NO: 70399 - protein, 11 aa, Dengue virus
ITGTSADLTVE

SEQ ID NO: 70400 - protein, 11 aa, Dengue virus
TGTSADLTVEK

SEQ ID NO: 70401 - protein, 11 aa, Dengue virus
GTSADLTVEKA

SEQ ID NO: 70402 - protein, 11 aa, Dengue virus
TSADLTVEKAA

SEQ ID NO: 70403 - protein, 11 aa, Dengue virus
SADLTVEKAAD

SEQ ID NO: 70404 - protein, 11 aa, Dengue virus
ADVTWEEEAEQ

SEQ ID NO: 70405 - protein, 11 aa, Dengue virus
DVTWEEEAEQT

SEQ ID NO: 70406 - protein, 11 aa, Dengue virus
VTWEEEAEQTG

SEQ ID NO: 70407 - protein, 11 aa, Dengue virus
TWEEEAEQTGV

SEQ ID NO: 70408 - protein, 11 aa, Dengue virus
WEEEAEQTGVS

SEQ ID NO: 70409 - protein, 11 aa, Dengue virus
EEEAEQTGVSH

SEQ ID NO: 70410 - protein, 11 aa, Dengue virus
EEAEQTGVSHN

SEQ ID NO: 70411 - protein, 11 aa, Dengue virus
EAEQTGVSHNL

SEQ ID NO: 70412 - protein, 11 aa, Dengue virus
AEQTGVSHNLM

SEQ ID NO: 70413 - protein, 11 aa, Dengue virus
EQTGVSHNLMI

SEQ ID NO: 70414 - protein, 11 aa, Dengue virus
QTGVSHNLMIT

SEQ ID NO: 70415 - protein, 11 aa, Dengue virus
TGVSHNLMITV

SEQ ID NO: 70416 - protein, 11 aa, Dengue virus
GVSHNLMITVD

SEQ ID NO: 70417 - protein, 11 aa, Dengue virus
VSHNLMITVDD

SEQ ID NO: 70418 - protein, 11 aa, Dengue virus
SHNLMITVDDD

SEQ ID NO: 70419 - protein, 11 aa, Dengue virus
HNLMITVDDDG

SEQ ID NO: 70420 - protein, 11 aa, Dengue virus
NLMITVDDDGT

SEQ ID NO: 70421 - protein, 11 aa, Dengue virus
LMITVDDDGTM

SEQ ID NO: 70422 - protein, 11 aa, Dengue virus
MITVDDDGTMR

SEQ ID NO: 70423 - protein, 11 aa, Dengue virus
ITVDDDGTMRI

SEQ ID NO: 70424 - protein, 11 aa, Dengue virus
TVDDDGTMRIK

SEQ ID NO: 70425 - protein, 11 aa, Dengue virus
VDDDGTMRIKD

SEQ ID NO: 70426 - protein, 11 aa, Dengue virus
DDDGTMRIKDD

SEQ ID NO: 70427 - protein, 11 aa, Dengue virus
DDGTMRIKDDE

SEQ ID NO: 70428 - protein, 11 aa, Dengue virus
DGTMRIKDDET

SEQ ID NO: 70429 - protein, 11 aa, Dengue virus
GTMRIKDDETE

SEQ ID NO: 70430 - protein, 11 aa, Dengue virus
TMRIKDDETEN

SEQ ID NO: 70431 - protein, 11 aa, Dengue virus
MRIKDDETENI

SEQ ID NO: 70432 - protein, 11 aa, Dengue virus
RIKDDETENIL

SEQ ID NO: 70433 - protein, 11 aa, Dengue virus
IKDDETENILT

SEQ ID NO: 70434 - protein, 11 aa, Dengue virus
KDDETENILTV

SEQ ID NO: 70435 - protein, 11 aa, Dengue virus
DDETENILTVL

SEQ ID NO: 70436 - protein, 11 aa, Dengue virus
DETENILTVLL

SEQ ID NO: 70437 - protein, 11 aa, Dengue virus
ETENILTVLLK

SEQ ID NO: 70438 - protein, 11 aa, Dengue virus
TENILTVLLKT

SEQ ID NO: 70439 - protein, 11 aa, Dengue virus
ENILTVLLKTA

SEQ ID NO: 70440 - protein, 11 aa, Dengue virus
NILTVLLKTAL

SEQ ID NO: 70441 - protein, 11 aa, Dengue virus
ILTVLLKTALL

SEQ ID NO: 70442 - protein, 11 aa, Dengue virus
LTVLLKTALLI

SEQ ID NO: 70443 - protein, 11 aa, Dengue virus
TVLLKTALLIV

SEQ ID NO: 70444 - protein, 11 aa, Dengue virus
VLLKTALLIVS

SEQ ID NO: 70445 - protein, 11 aa, Dengue virus
LLKTALLIVSG

SEQ ID NO: 70446 - protein, 11 aa, Dengue virus
LKTALLIVSGI

SEQ ID NO: 70447 - protein, 11 aa, Dengue virus
KTALLIVSGIF

SEQ ID NO: 70448 - protein, 11 aa, Dengue virus
TALLIVSGIFP

SEQ ID NO: 70449 - protein, 11 aa, Dengue virus
ALLIVSGIFPY

SEQ ID NO: 70450 - protein, 11 aa, Dengue virus
LLIVSGIFPYS

SEQ ID NO: 70451 - protein, 11 aa, Dengue virus
LIVSGIFPYSI

SEQ ID NO: 70452 - protein, 11 aa, Dengue virus
IVSGIFPYSIP

SEQ ID NO: 70453 - protein, 11 aa, Dengue virus
VSGIFPYSIPA

SEQ ID NO: 70454 - protein, 11 aa, Dengue virus
SGIFPYSIPAT

SEQ ID NO: 70455 - protein, 11 aa, Dengue virus
GIFPYSIPATL

SEQ ID NO: 70456 - protein, 11 aa, Dengue virus
IFPYSIPATLL

SEQ ID NO: 70457 - protein, 11 aa, Dengue virus
FPYSIPATLLV

SEQ ID NO: 70458 - protein, 11 aa, Dengue virus
PYSIPATLLVW

SEQ ID NO: 70459 - protein, 11 aa, Dengue virus
YSIPATLLVWH

SEQ ID NO: 70460 - protein, 11 aa, Dengue virus
SIPATLLVWHT

SEQ ID NO: 70461 - protein, 11 aa, Dengue virus
IPATLLVWHTW

SEQ ID NO: 70462 - protein, 11 aa, Dengue virus
PATLLVWHTWQ

SEQ ID NO: 70463 - protein, 11 aa, Dengue virus
ATLLVWHTWQK

SEQ ID NO: 70464 - protein, 11 aa, Dengue virus
TLLVWHTWQKQ

SEQ ID NO: 70465 - protein, 11 aa, Dengue virus
LLVWHTWQKQT

SEQ ID NO: 70466 - protein, 11 aa, Dengue virus
LVWHTWQKQTQ

SEQ ID NO: 70467 - protein, 11 aa, Dengue virus
VWHTWQKQTQR

SEQ ID NO: 70468 - protein, 11 aa, Dengue virus
WHTWQKQTQRS

SEQ ID NO: 70469 - protein, 11 aa, Dengue virus
HTWQKQTQRSG

SEQ ID NO: 70470 - protein, 11 aa, Dengue virus
TWQKQTQRSGV

SEQ ID NO: 70471 - protein, 11 aa, Dengue virus
WQKQTQRSGVL

SEQ ID NO: 70472 - protein, 11 aa, Dengue virus
QKQTQRSGVLW

SEQ ID NO: 70473 - protein, 11 aa, Dengue virus
KQTQRSGVLWD

SEQ ID NO: 70474 - protein, 11 aa, Dengue virus
QTQRSGVLWDV

SEQ ID NO: 70475 - protein, 11 aa, Dengue virus
TQRSGVLWDVP

SEQ ID NO: 70476 - protein, 11 aa, Dengue virus
QRSGVLWDVPS

SEQ ID NO: 70477 - protein, 11 aa, Dengue virus
RSGVLWDVPSP

SEQ ID NO: 70478 - protein, 11 aa, Dengue virus
SGVLWDVPSPP

SEQ ID NO: 70479 - protein, 11 aa, Dengue virus
GVLWDVPSPPE

SEQ ID NO: 70480 - protein, 11 aa, Dengue virus
VLWDVPSPPET

SEQ ID NO: 70481 - protein, 11 aa, Dengue virus
LWDVPSPPETQ

SEQ ID NO: 70482 - protein, 11 aa, Dengue virus
WDVPSPPETQK

SEQ ID NO: 70483 - protein, 11 aa, Dengue virus
DVPSPPETQKA

SEQ ID NO: 70484 - protein, 11 aa, Dengue virus
VPSPPETQKAE

SEQ ID NO: 70485 - protein, 11 aa, Dengue virus
PSPPETQKAEL

SEQ ID NO: 70486 - protein, 11 aa, Dengue virus
SPPETQKAELE

SEQ ID NO: 70487 - protein, 11 aa, Dengue virus
PPETQKAELEE

SEQ ID NO: 70488 - protein, 11 aa, Dengue virus
PETQKAELEEG

SEQ ID NO: 70489 - protein, 11 aa, Dengue virus
ETQKAELEEGV

SEQ ID NO: 70490 - protein, 11 aa, Dengue virus
TQKAELEEGVY

SEQ ID NO: 70491 - protein, 11 aa, Dengue virus
QKAELEEGVYR

SEQ ID NO: 70492 - protein, 11 aa, Dengue virus
KAELEEGVYRI

SEQ ID NO: 70493 - protein, 11 aa, Dengue virus
AELEEGVYRIK

SEQ ID NO: 70494 - protein, 11 aa, Dengue virus
ELEEGVYRIKQ

SEQ ID NO: 70495 - protein, 11 aa, Dengue virus
LEEGVYRIKQQ

SEQ ID NO: 70496 - protein, 11 aa, Dengue virus
EEGVYRIKQQG

SEQ ID NO: 70497 - protein, 11 aa, Dengue virus
EGVYRIKQQGI

SEQ ID NO: 70498 - protein, 11 aa, Dengue virus
GVYRIKQQGIF

SEQ ID NO: 70499 - protein, 11 aa, Dengue virus
VYRIKQQGIFG

SEQ ID NO: 70500 - protein, 11 aa, Dengue virus
YRIKQQGIFGK

SEQ ID NO: 70501 - protein, 11 aa, Dengue virus
RIKQQGIFGKT

SEQ ID NO: 70502 - protein, 11 aa, Dengue virus
IKQQGIFGKTQ

SEQ ID NO: 70503 - protein, 11 aa, Dengue virus
KQQGIFGKTQV

SEQ ID NO: 70504 - protein, 11 aa, Dengue virus
QQGIFGKTQVG

SEQ ID NO: 70505 - protein, 11 aa, Dengue virus
QGIFGKTQVGV

SEQ ID NO: 70506 - protein, 11 aa, Dengue virus
GIFGKTQVGVG

SEQ ID NO: 70507 - protein, 11 aa, Dengue virus
IFGKTQVGVGV

SEQ ID NO: 70508 - protein, 11 aa, Dengue virus
FGKTQVGVGVQ

SEQ ID NO: 70509 - protein, 11 aa, Dengue virus
GKTQVGVGVQK

SEQ ID NO: 70510 - protein, 11 aa, Dengue virus
KTQVGVGVQKE

SEQ ID NO: 70511 - protein, 11 aa, Dengue virus
TQVGVGVQKEG

SEQ ID NO: 70512 - protein, 11 aa, Dengue virus
QVGVGVQKEGV

SEQ ID NO: 70513 - protein, 11 aa, Dengue virus
VGVGVQKEGVF

SEQ ID NO: 70514 - protein, 11 aa, Dengue virus
GVGVQKEGVFH

SEQ ID NO: 70515 - protein, 11 aa, Dengue virus
VGVQKEGVFHT

SEQ ID NO: 70516 - protein, 11 aa, Dengue virus
GVQKEGVFHTM

SEQ ID NO: 70517 - protein, 11 aa, Dengue virus
VQKEGVFHTMW

SEQ ID NO: 70518 - protein, 11 aa, Dengue virus
QKEGVFHTMWH

SEQ ID NO: 70519 - protein, 11 aa, Dengue virus
KEGVFHTMWHV

SEQ ID NO: 70520 - protein, 11 aa, Dengue virus
EGVFHTMWHVT

SEQ ID NO: 70521 - protein, 11 aa, Dengue virus
GVFHTMWHVTR

SEQ ID NO: 70522 - protein, 11 aa, Dengue virus
VFHTMWHVTRG

SEQ ID NO: 70523 - protein, 11 aa, Dengue virus
FHTMWHVTRGA

SEQ ID NO: 70524 - protein, 11 aa, Dengue virus
HTMWHVTRGAV

SEQ ID NO: 70525 - protein, 11 aa, Dengue virus
TMWHVTRGAVL

SEQ ID NO: 70526 - protein, 11 aa, Dengue virus
MWHVTRGAVLT

SEQ ID NO: 70527 - protein, 11 aa, Dengue virus
WHVTRGAVLTY

SEQ ID NO: 70528 - protein, 11 aa, Dengue virus
HVTRGAVLTYN

SEQ ID NO: 70529 - protein, 11 aa, Dengue virus
VTRGAVLTYNG

SEQ ID NO: 70530 - protein, 11 aa, Dengue virus
TRGAVLTYNGK

SEQ ID NO: 70531 - protein, 11 aa, Dengue virus
RGAVLTYNGKR

SEQ ID NO: 70532 - protein, 11 aa, Dengue virus
GAVLTYNGKRL

SEQ ID NO: 70533 - protein, 11 aa, Dengue virus
AVLTYNGKRLE

SEQ ID NO: 70534 - protein, 11 aa, Dengue virus
VLTYNGKRLEP

SEQ ID NO: 70535 - protein, 11 aa, Dengue virus
LTYNGKRLEPN

SEQ ID NO: 70536 - protein, 11 aa, Dengue virus
TYNGKRLEPNW

SEQ ID NO: 70537 - protein, 11 aa, Dengue virus
YNGKRLEPNWA

SEQ ID NO: 70538 - protein, 11 aa, Dengue virus
NGKRLEPNWAS

SEQ ID NO: 70539 - protein, 11 aa, Dengue virus
GKRLEPNWASV

SEQ ID NO: 70540 - protein, 11 aa, Dengue virus
KRLEPNWASVK

SEQ ID NO: 70541 - protein, 11 aa, Dengue virus
RLEPNWASVKK

SEQ ID NO: 70542 - protein, 11 aa, Dengue virus
LEPNWASVKKD

SEQ ID NO: 70543 - protein, 11 aa, Dengue virus
EPNWASVKKDL

SEQ ID NO: 70544 - protein, 11 aa, Dengue virus
PNWASVKKDLI

SEQ ID NO: 70545 - protein, 11 aa, Dengue virus
NWASVKKDLIS

SEQ ID NO: 70546 - protein, 11 aa, Dengue virus
WASVKKDLISY

SEQ ID NO: 70547 - protein, 11 aa, Dengue virus
ASVKKDLISYG

SEQ ID NO: 70548 - protein, 11 aa, Dengue virus
SVKKDLISYGG

SEQ ID NO: 70549 - protein, 11 aa, Dengue virus
VKKDLISYGGG

SEQ ID NO: 70550 - protein, 11 aa, Dengue virus
KKDLISYGGGW

SEQ ID NO: 70551 - protein, 11 aa, Dengue virus
KDLISYGGGWR

SEQ ID NO: 70552 - protein, 11 aa, Dengue virus
DLISYGGGWRL

SEQ ID NO: 70553 - protein, 11 aa, Dengue virus
LISYGGGWRLS

SEQ ID NO: 70554 - protein, 11 aa, Dengue virus
ISYGGGWRLSA

SEQ ID NO: 70555 - protein, 11 aa, Dengue virus
SYGGGWRLSAQ

SEQ ID NO: 70556 - protein, 11 aa, Dengue virus
YGGGWRLSAQW

SEQ ID NO: 70557 - protein, 11 aa, Dengue virus
GGGWRLSAQWQ

SEQ ID NO: 70558 - protein, 11 aa, Dengue virus
GGWRLSAQWQK

SEQ ID NO: 70559 - protein, 11 aa, Dengue virus
GWRLSAQWQKG

SEQ ID NO: 70560 - protein, 11 aa, Dengue virus
WRLSAQWQKGE

SEQ ID NO: 70561 - protein, 11 aa, Dengue virus
RLSAQWQKGEE

SEQ ID NO: 70562 - protein, 11 aa, Dengue virus
LSAQWQKGEEV

SEQ ID NO: 70563 - protein, 11 aa, Dengue virus
SAQWQKGEEVQ

SEQ ID NO: 70564 - protein, 11 aa, Dengue virus
AQWQKGEEVQV

SEQ ID NO: 70565 - protein, 11 aa, Dengue virus
QWQKGEEVQVI

SEQ ID NO: 70566 - protein, 11 aa, Dengue virus
WQKGEEVQVIA

SEQ ID NO: 70567 - protein, 11 aa, Dengue virus
QKGEEVQVIAV

SEQ ID NO: 70568 - protein, 11 aa, Dengue virus
KGEEVQVIAVE

SEQ ID NO: 70569 - protein, 11 aa, Dengue virus
GEEVQVIAVEP

SEQ ID NO: 70570 - protein, 11 aa, Dengue virus
EEVQVIAVEPG

SEQ ID NO: 70571 - protein, 11 aa, Dengue virus
EVQVIAVEPGK

SEQ ID NO: 70572 - protein, 11 aa, Dengue virus
VQVIAVEPGKN

SEQ ID NO: 70573 - protein, 11 aa, Dengue virus
QVIAVEPGKNP

SEQ ID NO: 70574 - protein, 11 aa, Dengue virus
VIAVEPGKNPK

SEQ ID NO: 70575 - protein, 11 aa, Dengue virus
IAVEPGKNPKN

SEQ ID NO: 70576 - protein, 11 aa, Dengue virus
AVEPGKNPKNF

SEQ ID NO: 70577 - protein, 11 aa, Dengue virus
VEPGKNPKNFQ

SEQ ID NO: 70578 - protein, 11 aa, Dengue virus
EPGKNPKNFQT

SEQ ID NO: 70579 - protein, 11 aa, Dengue virus
PGKNPKNFQTM

SEQ ID NO: 70580 - protein, 11 aa, Dengue virus
GKNPKNFQTMP

SEQ ID NO: 70581 - protein, 11 aa, Dengue virus
KNPKNFQTMPG

SEQ ID NO: 70582 - protein, 11 aa, Dengue virus
NPKNFQTMPGT

SEQ ID NO: 70583 - protein, 11 aa, Dengue virus
PKNFQTMPGTF

SEQ ID NO: 70584 - protein, 11 aa, Dengue virus
KNFQTMPGTFQ

SEQ ID NO: 70585 - protein, 11 aa, Dengue virus
NFQTMPGTFQT

SEQ ID NO: 70586 - protein, 11 aa, Dengue virus
FQTMPGTFQTT

SEQ ID NO: 70587 - protein, 11 aa, Dengue virus
PGTFQTTTGEI

SEQ ID NO: 70588 - protein, 11 aa, Dengue virus
GTFQTTTGEIG

SEQ ID NO: 70589 - protein, 11 aa, Dengue virus
TFQTTTGEIGA

SEQ ID NO: 70590 - protein, 11 aa, Dengue virus
FQTTTGEIGAI

SEQ ID NO: 70591 - protein, 11 aa, Dengue virus
QTTTGEIGAIA

SEQ ID NO: 70592 - protein, 11 aa, Dengue virus
TTTGEIGAIAL

SEQ ID NO: 70593 - protein, 11 aa, Dengue virus
TTGEIGAIALD

SEQ ID NO: 70594 - protein, 11 aa, Dengue virus
TGEIGAIALDF

SEQ ID NO: 70595 - protein, 11 aa, Dengue virus
GEIGAIALDFK

SEQ ID NO: 70596 - protein, 11 aa, Dengue virus
EIGAIALDFKP

SEQ ID NO: 70597 - protein, 11 aa, Dengue virus
IGAIALDFKPG

SEQ ID NO: 70598 - protein, 11 aa, Dengue virus
GAIALDFKPGT

SEQ ID NO: 70599 - protein, 11 aa, Dengue virus
AIALDFKPGTS

SEQ ID NO: 70600 - protein, 11 aa, Dengue virus
IALDFKPGTSG

SEQ ID NO: 70601 - protein, 11 aa, Dengue virus
ALDFKPGTSGS

SEQ ID NO: 70602 - protein, 11 aa, Dengue virus
LDFKPGTSGSP

SEQ ID NO: 70603 - protein, 11 aa, Dengue virus
DFKPGTSGSPI

SEQ ID NO: 70604 - protein, 11 aa, Dengue virus
FKPGTSGSPII

SEQ ID NO: 70605 - protein, 11 aa, Dengue virus
KPGTSGSPIIN

SEQ ID NO: 70606 - protein, 11 aa, Dengue virus
PGTSGSPIINR

SEQ ID NO: 70607 - protein, 11 aa, Dengue virus
GTSGSPIINRE

SEQ ID NO: 70608 - protein, 11 aa, Dengue virus
TSGSPIINREG

SEQ ID NO: 70609 - protein, 11 aa, Dengue virus
SGSPIINREGK

SEQ ID NO: 70610 - protein, 11 aa, Dengue virus
GSPIINREGKV

SEQ ID NO: 70611 - protein, 11 aa, Dengue virus
SPIINREGKVV

SEQ ID NO: 70612 - protein, 11 aa, Dengue virus
PIINREGKVVG

SEQ ID NO: 70613 - protein, 11 aa, Dengue virus
IINREGKVVGL

SEQ ID NO: 70614 - protein, 11 aa, Dengue virus
INREGKVVGLY

SEQ ID NO: 70615 - protein, 11 aa, Dengue virus
NREGKVVGLYG

SEQ ID NO: 70616 - protein, 11 aa, Dengue virus
REGKVVGLYGN

SEQ ID NO: 70617 - protein, 11 aa, Dengue virus
EGKVVGLYGNG

SEQ ID NO: 70618 - protein, 11 aa, Dengue virus
GKVVGLYGNGV

SEQ ID NO: 70619 - protein, 11 aa, Dengue virus
KVVGLYGNGVV

SEQ ID NO: 70620 - protein, 11 aa, Dengue virus
VVGLYGNGVVT

SEQ ID NO: 70621 - protein, 11 aa, Dengue virus
VGLYGNGVVTK

SEQ ID NO: 70622 - protein, 11 aa, Dengue virus
GLYGNGVVTKN

SEQ ID NO: 70623 - protein, 11 aa, Dengue virus
LYGNGVVTKNG

SEQ ID NO: 70624 - protein, 11 aa, Dengue virus
YGNGVVTKNGG

SEQ ID NO: 70625 - protein, 11 aa, Dengue virus
GNGVVTKNGGY

SEQ ID NO: 70626 - protein, 11 aa, Dengue virus
NGVVTKNGGYV

SEQ ID NO: 70627 - protein, 11 aa, Dengue virus
GVVTKNGGYVS

SEQ ID NO: 70628 - protein, 11 aa, Dengue virus
VVTKNGGYVSG

SEQ ID NO: 70629 - protein, 11 aa, Dengue virus
VTKNGGYVSGI

SEQ ID NO: 70630 - protein, 11 aa, Dengue virus
TKNGGYVSGIA

SEQ ID NO: 70631 - protein, 11 aa, Dengue virus
KNGGYVSGIAQ

SEQ ID NO: 70632 - protein, 11 aa, Dengue virus
NGGYVSGIAQT

SEQ ID NO: 70633 - protein, 11 aa, Dengue virus
GGYVSGIAQTN

SEQ ID NO: 70634 - protein, 11 aa, Dengue virus
GYVSGIAQTNA

SEQ ID NO: 70635 - protein, 11 aa, Dengue virus
YVSGIAQTNAE

SEQ ID NO: 70636 - protein, 11 aa, Dengue virus
VSGIAQTNAEP

SEQ ID NO: 70637 - protein, 11 aa, Dengue virus
SGIAQTNAEPD

SEQ ID NO: 70638 - protein, 11 aa, Dengue virus
GIAQTNAEPDG

SEQ ID NO: 70639 - protein, 11 aa, Dengue virus
IAQTNAEPDGP

SEQ ID NO: 70640 - protein, 11 aa, Dengue virus
AQTNAEPDGPT

SEQ ID NO: 70641 - protein, 11 aa, Dengue virus
QTNAEPDGPTP

SEQ ID NO: 70642 - protein, 11 aa, Dengue virus
TNAEPDGPTPE

SEQ ID NO: 70643 - protein, 11 aa, Dengue virus
NAEPDGPTPEL

SEQ ID NO: 70644 - protein, 11 aa, Dengue virus
AEPDGPTPELE

SEQ ID NO: 70645 - protein, 11 aa, Dengue virus
EPDGPTPELEE

SEQ ID NO: 70646 - protein, 11 aa, Dengue virus
PDGPTPELEEE

SEQ ID NO: 70647 - protein, 11 aa, Dengue virus
DGPTPELEEEM

SEQ ID NO: 70648 - protein, 11 aa, Dengue virus
GPTPELEEEMF

SEQ ID NO: 70649 - protein, 11 aa, Dengue virus
PTPELEEEMFK

SEQ ID NO: 70650 - protein, 11 aa, Dengue virus
TPELEEEMFKK

SEQ ID NO: 70651 - protein, 11 aa, Dengue virus
PELEEEMFKKR

SEQ ID NO: 70652 - protein, 11 aa, Dengue virus
ELEEEMFKKRN

SEQ ID NO: 70653 - protein, 11 aa, Dengue virus
LEEEMFKKRNL

SEQ ID NO: 70654 - protein, 11 aa, Dengue virus
EEEMFKKRNLT

SEQ ID NO: 70655 - protein, 11 aa, Dengue virus
EEMFKKRNLTI

SEQ ID NO: 70656 - protein, 11 aa, Dengue virus
EMFKKRNLTIM

SEQ ID NO: 70657 - protein, 11 aa, Dengue virus
MFKKRNLTIMD

SEQ ID NO: 70658 - protein, 11 aa, Dengue virus
FKKRNLTIMDL

SEQ ID NO: 70659 - protein, 11 aa, Dengue virus
KKRNLTIMDLH

SEQ ID NO: 70660 - protein, 11 aa, Dengue virus
KRNLTIMDLHP

SEQ ID NO: 70661 - protein, 11 aa, Dengue virus
RNLTIMDLHPG

SEQ ID NO: 70662 - protein, 11 aa, Dengue virus
NLTIMDLHPGS

SEQ ID NO: 70663 - protein, 11 aa, Dengue virus
LTIMDLHPGSG

SEQ ID NO: 70664 - protein, 11 aa, Dengue virus
TIMDLHPGSGK

SEQ ID NO: 70665 - protein, 11 aa, Dengue virus
IMDLHPGSGKT

SEQ ID NO: 70666 - protein, 11 aa, Dengue virus
MDLHPGSGKTR

SEQ ID NO: 70667 - protein, 11 aa, Dengue virus
DLHPGSGKTRK

SEQ ID NO: 70668 - protein, 11 aa, Dengue virus
LHPGSGKTRKY

SEQ ID NO: 70669 - protein, 11 aa, Dengue virus
HPGSGKTRKYL

SEQ ID NO: 70670 - protein, 11 aa, Dengue virus
PGSGKTRKYLP

SEQ ID NO: 70671 - protein, 11 aa, Dengue virus
GSGKTRKYLPA

SEQ ID NO: 70672 - protein, 11 aa, Dengue virus
SGKTRKYLPAI

SEQ ID NO: 70673 - protein, 11 aa, Dengue virus
GKTRKYLPAIV

SEQ ID NO: 70674 - protein, 11 aa, Dengue virus
KTRKYLPAIVR

SEQ ID NO: 70675 - protein, 11 aa, Dengue virus
TRKYLPAIVRE

SEQ ID NO: 70676 - protein, 11 aa, Dengue virus
RKYLPAIVREA

SEQ ID NO: 70677 - protein, 11 aa, Dengue virus
KYLPAIVREAI

SEQ ID NO: 70678 - protein, 11 aa, Dengue virus
YLPAIVREAIK

SEQ ID NO: 70679 - protein, 11 aa, Dengue virus
LPAIVREAIKR

SEQ ID NO: 70680 - protein, 11 aa, Dengue virus
PAIVREAIKRR

SEQ ID NO: 70681 - protein, 11 aa, Dengue virus
AIVREAIKRRL

SEQ ID NO: 70682 - protein, 11 aa, Dengue virus
IVREAIKRRLR

SEQ ID NO: 70683 - protein, 11 aa, Dengue virus
VREAIKRRLRT

SEQ ID NO: 70684 - protein, 11 aa, Dengue virus
REAIKRRLRTL

SEQ ID NO: 70685 - protein, 11 aa, Dengue virus
EAIKRRLRTLI

SEQ ID NO: 70686 - protein, 11 aa, Dengue virus
AIKRRLRTLIL

SEQ ID NO: 70687 - protein, 11 aa, Dengue virus
IKRRLRTLILA

SEQ ID NO: 70688 - protein, 11 aa, Dengue virus
KRRLRTLILAP

SEQ ID NO: 70689 - protein, 11 aa, Dengue virus
RRLRTLILAPT

SEQ ID NO: 70690 - protein, 11 aa, Dengue virus
RLRTLILAPTR

SEQ ID NO: 70691 - protein, 11 aa, Dengue virus
LRTLILAPTRV

SEQ ID NO: 70692 - protein, 11 aa, Dengue virus
RTLILAPTRVV

SEQ ID NO: 70693 - protein, 11 aa, Dengue virus
TLILAPTRVVA

SEQ ID NO: 70694 - protein, 11 aa, Dengue virus
LILAPTRVVAA

SEQ ID NO: 70695 - protein, 11 aa, Dengue virus
ILAPTRVVAAE

SEQ ID NO: 70696 - protein, 11 aa, Dengue virus
LAPTRVVAAEM

SEQ ID NO: 70697 - protein, 11 aa, Dengue virus
APTRVVAAEME

SEQ ID NO: 70698 - protein, 11 aa, Dengue virus
PTRVVAAEMEE

SEQ ID NO: 70699 - protein, 11 aa, Dengue virus
TRVVAAEMEEA

SEQ ID NO: 70700 - protein, 11 aa, Dengue virus
RVVAAEMEEAL

SEQ ID NO: 70701 - protein, 11 aa, Dengue virus
VVAAEMEEALK

SEQ ID NO: 70702 - protein, 11 aa, Dengue virus
VAAEMEEALKG

SEQ ID NO: 70703 - protein, 11 aa, Dengue virus
AAEMEEALKGL

SEQ ID NO: 70704 - protein, 11 aa, Dengue virus
AEMEEALKGLP

SEQ ID NO: 70705 - protein, 11 aa, Dengue virus
EMEEALKGLPI

SEQ ID NO: 70706 - protein, 11 aa, Dengue virus
MEEALKGLPIR

SEQ ID NO: 70707 - protein, 11 aa, Dengue virus
EEALKGLPIRY

SEQ ID NO: 70708 - protein, 11 aa, Dengue virus
EALKGLPIRYQ

SEQ ID NO: 70709 - protein, 11 aa, Dengue virus
ALKGLPIRYQT

SEQ ID NO: 70710 - protein, 11 aa, Dengue virus
LKGLPIRYQTT

SEQ ID NO: 70711 - protein, 11 aa, Dengue virus
KGLPIRYQTTA

SEQ ID NO: 70712 - protein, 11 aa, Dengue virus
GLPIRYQTTAT

SEQ ID NO: 70713 - protein, 11 aa, Dengue virus
LPIRYQTTATK

SEQ ID NO: 70714 - protein, 11 aa, Dengue virus
PIRYQTTATKS

SEQ ID NO: 70715 - protein, 11 aa, Dengue virus
IRYQTTATKSE

SEQ ID NO: 70716 - protein, 11 aa, Dengue virus
RYQTTATKSEH

SEQ ID NO: 70717 - protein, 11 aa, Dengue virus
YQTTATKSEHT

SEQ ID NO: 70718 - protein, 11 aa, Dengue virus
QTTATKSEHTG

SEQ ID NO: 70719 - protein, 11 aa, Dengue virus
TTATKSEHTGR

SEQ ID NO: 70720 - protein, 11 aa, Dengue virus
TATKSEHTGRE

SEQ ID NO: 70721 - protein, 11 aa, Dengue virus
ATKSEHTGREI

SEQ ID NO: 70722 - protein, 11 aa, Dengue virus
TKSEHTGREIV

SEQ ID NO: 70723 - protein, 11 aa, Dengue virus
KSEHTGREIVD

SEQ ID NO: 70724 - protein, 11 aa, Dengue virus
SEHTGREIVDL

SEQ ID NO: 70725 - protein, 11 aa, Dengue virus
EHTGREIVDLM

SEQ ID NO: 70726 - protein, 11 aa, Dengue virus
HTGREIVDLMC

SEQ ID NO: 70727 - protein, 11 aa, Dengue virus
TGREIVDLMCH

SEQ ID NO: 70728 - protein, 11 aa, Dengue virus
GREIVDLMCHA

SEQ ID NO: 70729 - protein, 11 aa, Dengue virus
REIVDLMCHAT

SEQ ID NO: 70730 - protein, 11 aa, Dengue virus
EIVDLMCHATF

SEQ ID NO: 70731 - protein, 11 aa, Dengue virus
IVDLMCHATFT

SEQ ID NO: 70732 - protein, 11 aa, Dengue virus
VDLMCHATFTM

SEQ ID NO: 70733 - protein, 11 aa, Dengue virus
DLMCHATFTMR

SEQ ID NO: 70734 - protein, 11 aa, Dengue virus
LMCHATFTMRL

SEQ ID NO: 70735 - protein, 11 aa, Dengue virus
MCHATFTMRLL

SEQ ID NO: 70736 - protein, 11 aa, Dengue virus
CHATFTMRLLS

SEQ ID NO: 70737 - protein, 11 aa, Dengue virus
HATFTMRLLSP

SEQ ID NO: 70738 - protein, 11 aa, Dengue virus
ATFTMRLLSPV

SEQ ID NO: 70739 - protein, 11 aa, Dengue virus
TFTMRLLSPVR

SEQ ID NO: 70740 - protein, 11 aa, Dengue virus
FTMRLLSPVRV

SEQ ID NO: 70741 - protein, 11 aa, Dengue virus
TMRLLSPVRVP

SEQ ID NO: 70742 - protein, 11 aa, Dengue virus
MRLLSPVRVPN

SEQ ID NO: 70743 - protein, 11 aa, Dengue virus
RLLSPVRVPNY

SEQ ID NO: 70744 - protein, 11 aa, Dengue virus
LLSPVRVPNYN

SEQ ID NO: 70745 - protein, 11 aa, Dengue virus
LSPVRVPNYNL

SEQ ID NO: 70746 - protein, 11 aa, Dengue virus
SPVRVPNYNLI

SEQ ID NO: 70747 - protein, 11 aa, Dengue virus
PVRVPNYNLII

SEQ ID NO: 70748 - protein, 11 aa, Dengue virus
VRVPNYNLIIM

SEQ ID NO: 70749 - protein, 11 aa, Dengue virus
RVPNYNLIIMD

SEQ ID NO: 70750 - protein, 11 aa, Dengue virus
VPNYNLIIMDE

SEQ ID NO: 70751 - protein, 11 aa, Dengue virus
PNYNLIIMDEA

SEQ ID NO: 70752 - protein, 11 aa, Dengue virus
NYNLIIMDEAH

SEQ ID NO: 70753 - protein, 11 aa, Dengue virus
YNLIIMDEAHF

SEQ ID NO: 70754 - protein, 11 aa, Dengue virus
NLIIMDEAHFT

SEQ ID NO: 70755 - protein, 11 aa, Dengue virus
LIIMDEAHFTD

SEQ ID NO: 70756 - protein, 11 aa, Dengue virus
IIMDEAHFTDP

SEQ ID NO: 70757 - protein, 11 aa, Dengue virus
IMDEAHFTDPA

SEQ ID NO: 70758 - protein, 11 aa, Dengue virus
MDEAHFTDPAS

SEQ ID NO: 70759 - protein, 11 aa, Dengue virus
DEAHFTDPASI

SEQ ID NO: 70760 - protein, 11 aa, Dengue virus
EAHFTDPASIA

SEQ ID NO: 70761 - protein, 11 aa, Dengue virus
AHFTDPASIAA

SEQ ID NO: 70762 - protein, 11 aa, Dengue virus
HFTDPASIAAR

SEQ ID NO: 70763 - protein, 11 aa, Dengue virus
FTDPASIAARG

SEQ ID NO: 70764 - protein, 11 aa, Dengue virus
TDPASIAARGY

SEQ ID NO: 70765 - protein, 11 aa, Dengue virus
DPASIAARGYI

SEQ ID NO: 70766 - protein, 11 aa, Dengue virus
PASIAARGYIS

SEQ ID NO: 70767 - protein, 11 aa, Dengue virus
ASIAARGYIST

SEQ ID NO: 70768 - protein, 11 aa, Dengue virus
SIAARGYISTR

SEQ ID NO: 70769 - protein, 11 aa, Dengue virus
IAARGYISTRV

SEQ ID NO: 70770 - protein, 11 aa, Dengue virus
AARGYISTRVG

SEQ ID NO: 70771 - protein, 11 aa, Dengue virus
ARGYISTRVGM

SEQ ID NO: 70772 - protein, 11 aa, Dengue virus
RGYISTRVGMG

SEQ ID NO: 70773 - protein, 11 aa, Dengue virus
GYISTRVGMGE

SEQ ID NO: 70774 - protein, 11 aa, Dengue virus
YISTRVGMGEA

SEQ ID NO: 70775 - protein, 11 aa, Dengue virus
ISTRVGMGEAA

SEQ ID NO: 70776 - protein, 11 aa, Dengue virus
STRVGMGEAAA

SEQ ID NO: 70777 - protein, 11 aa, Dengue virus
TRVGMGEAAAI

SEQ ID NO: 70778 - protein, 11 aa, Dengue virus
RVGMGEAAAIF

SEQ ID NO: 70779 - protein, 11 aa, Dengue virus
VGMGEAAAIFM

SEQ ID NO: 70780 - protein, 11 aa, Dengue virus
GMGEAAAIFMT

SEQ ID NO: 70781 - protein, 11 aa, Dengue virus
MGEAAAIFMTA

SEQ ID NO: 70782 - protein, 11 aa, Dengue virus
GEAAAIFMTAT

SEQ ID NO: 70783 - protein, 11 aa, Dengue virus
EAAAIFMTATP

SEQ ID NO: 70784 - protein, 11 aa, Dengue virus
AAAIFMTATPP

SEQ ID NO: 70785 - protein, 11 aa, Dengue virus
AAIFMTATPPG

SEQ ID NO: 70786 - protein, 11 aa, Dengue virus
AIFMTATPPGT

SEQ ID NO: 70787 - protein, 11 aa, Dengue virus
IFMTATPPGTA

SEQ ID NO: 70788 - protein, 11 aa, Dengue virus
FMTATPPGTAD

SEQ ID NO: 70789 - protein, 11 aa, Dengue virus
MTATPPGTADA

SEQ ID NO: 70790 - protein, 11 aa, Dengue virus
TATPPGTADAF

SEQ ID NO: 70791 - protein, 11 aa, Dengue virus
ATPPGTADAFP

SEQ ID NO: 70792 - protein, 11 aa, Dengue virus
TPPGTADAFPQ

SEQ ID NO: 70793 - protein, 11 aa, Dengue virus
PPGTADAFPQS

SEQ ID NO: 70794 - protein, 11 aa, Dengue virus
PGTADAFPQSN

SEQ ID NO: 70795 - protein, 11 aa, Dengue virus
GTADAFPQSNA

SEQ ID NO: 70796 - protein, 11 aa, Dengue virus
TADAFPQSNAP

SEQ ID NO: 70797 - protein, 11 aa, Dengue virus
ADAFPQSNAPI

SEQ ID NO: 70798 - protein, 11 aa, Dengue virus
DAFPQSNAPIQ

SEQ ID NO: 70799 - protein, 11 aa, Dengue virus
AFPQSNAPIQD

SEQ ID NO: 70800 - protein, 11 aa, Dengue virus
FPQSNAPIQDE

SEQ ID NO: 70801 - protein, 11 aa, Dengue virus
PQSNAPIQDEE

SEQ ID NO: 70802 - protein, 11 aa, Dengue virus
QSNAPIQDEER

SEQ ID NO: 70803 - protein, 11 aa, Dengue virus
SNAPIQDEERD

SEQ ID NO: 70804 - protein, 11 aa, Dengue virus
NAPIQDEERDI

SEQ ID NO: 70805 - protein, 11 aa, Dengue virus
APIQDEERDIP

SEQ ID NO: 70806 - protein, 11 aa, Dengue virus
PIQDEERDIPE

SEQ ID NO: 70807 - protein, 11 aa, Dengue virus
IQDEERDIPER

SEQ ID NO: 70808 - protein, 11 aa, Dengue virus
QDEERDIPERS

SEQ ID NO: 70809 - protein, 11 aa, Dengue virus
DEERDIPERSW

SEQ ID NO: 70810 - protein, 11 aa, Dengue virus
EERDIPERSWN

SEQ ID NO: 70811 - protein, 11 aa, Dengue virus
ERDIPERSWNS

SEQ ID NO: 70812 - protein, 11 aa, Dengue virus
RDIPERSWNSG

SEQ ID NO: 70813 - protein, 11 aa, Dengue virus
DIPERSWNSGN

SEQ ID NO: 70814 - protein, 11 aa, Dengue virus
IPERSWNSGNE

SEQ ID NO: 70815 - protein, 11 aa, Dengue virus
PERSWNSGNEW

SEQ ID NO: 70816 - protein, 11 aa, Dengue virus
ERSWNSGNEWI

SEQ ID NO: 70817 - protein, 11 aa, Dengue virus
RSWNSGNEWIT

SEQ ID NO: 70818 - protein, 11 aa, Dengue virus
SWNSGNEWITD

SEQ ID NO: 70819 - protein, 11 aa, Dengue virus
WNSGNEWITDF

SEQ ID NO: 70820 - protein, 11 aa, Dengue virus
NSGNEWITDFA

SEQ ID NO: 70821 - protein, 11 aa, Dengue virus
SGNEWITDFAG

SEQ ID NO: 70822 - protein, 11 aa, Dengue virus
GNEWITDFAGK

SEQ ID NO: 70823 - protein, 11 aa, Dengue virus
NEWITDFAGKT

SEQ ID NO: 70824 - protein, 11 aa, Dengue virus
EWITDFAGKTV

SEQ ID NO: 70825 - protein, 11 aa, Dengue virus
WITDFAGKTVW

SEQ ID NO: 70826 - protein, 11 aa, Dengue virus
ITDFAGKTVWF

SEQ ID NO: 70827 - protein, 11 aa, Dengue virus
TDFAGKTVWFV

SEQ ID NO: 70828 - protein, 11 aa, Dengue virus
DFAGKTVWFVP

SEQ ID NO: 70829 - protein, 11 aa, Dengue virus
FAGKTVWFVPS

SEQ ID NO: 70830 - protein, 11 aa, Dengue virus
AGKTVWFVPSI

SEQ ID NO: 70831 - protein, 11 aa, Dengue virus
GKTVWFVPSIK

SEQ ID NO: 70832 - protein, 11 aa, Dengue virus
KTVWFVPSIKA

SEQ ID NO: 70833 - protein, 11 aa, Dengue virus
TVWFVPSIKAG

SEQ ID NO: 70834 - protein, 11 aa, Dengue virus
VWFVPSIKAGN

SEQ ID NO: 70835 - protein, 11 aa, Dengue virus
WFVPSIKAGND

SEQ ID NO: 70836 - protein, 11 aa, Dengue virus
FVPSIKAGNDI

SEQ ID NO: 70837 - protein, 11 aa, Dengue virus
VPSIKAGNDIA

SEQ ID NO: 70838 - protein, 11 aa, Dengue virus
PSIKAGNDIAN

SEQ ID NO: 70839 - protein, 11 aa, Dengue virus
SIKAGNDIANC

SEQ ID NO: 70840 - protein, 11 aa, Dengue virus
IKAGNDIANCL

SEQ ID NO: 70841 - protein, 11 aa, Dengue virus
KAGNDIANCLR

SEQ ID NO: 70842 - protein, 11 aa, Dengue virus
AGNDIANCLRK

SEQ ID NO: 70843 - protein, 11 aa, Dengue virus
GNDIANCLRKN

SEQ ID NO: 70844 - protein, 11 aa, Dengue virus
NDIANCLRKNG

SEQ ID NO: 70845 - protein, 11 aa, Dengue virus
DIANCLRKNGK

SEQ ID NO: 70846 - protein, 11 aa, Dengue virus
IANCLRKNGKK

SEQ ID NO: 70847 - protein, 11 aa, Dengue virus
ANCLRKNGKKV

SEQ ID NO: 70848 - protein, 11 aa, Dengue virus
NCLRKNGKKVI

SEQ ID NO: 70849 - protein, 11 aa, Dengue virus
CLRKNGKKVIQ

SEQ ID NO: 70850 - protein, 11 aa, Dengue virus
LRKNGKKVIQL

SEQ ID NO: 70851 - protein, 11 aa, Dengue virus
RKNGKKVIQLS

SEQ ID NO: 70852 - protein, 11 aa, Dengue virus
KNGKKVIQLSR

SEQ ID NO: 70853 - protein, 11 aa, Dengue virus
NGKKVIQLSRK

SEQ ID NO: 70854 - protein, 11 aa, Dengue virus
GKKVIQLSRKT

SEQ ID NO: 70855 - protein, 11 aa, Dengue virus
KKVIQLSRKTF

SEQ ID NO: 70856 - protein, 11 aa, Dengue virus
KVIQLSRKTFD

SEQ ID NO: 70857 - protein, 11 aa, Dengue virus
VIQLSRKTFDT

SEQ ID NO: 70858 - protein, 11 aa, Dengue virus
IQLSRKTFDTE

SEQ ID NO: 70859 - protein, 11 aa, Dengue virus
QLSRKTFDTEY

SEQ ID NO: 70860 - protein, 11 aa, Dengue virus
LSRKTFDTEYQ

SEQ ID NO: 70861 - protein, 11 aa, Dengue virus
SRKTFDTEYQK

SEQ ID NO: 70862 - protein, 11 aa, Dengue virus
RKTFDTEYQKT

SEQ ID NO: 70863 - protein, 11 aa, Dengue virus
KTFDTEYQKTK

SEQ ID NO: 70864 - protein, 11 aa, Dengue virus
TFDTEYQKTKL

SEQ ID NO: 70865 - protein, 11 aa, Dengue virus
FDTEYQKTKLN

SEQ ID NO: 70866 - protein, 11 aa, Dengue virus
DTEYQKTKLND

SEQ ID NO: 70867 - protein, 11 aa, Dengue virus
TEYQKTKLNDW

SEQ ID NO: 70868 - protein, 11 aa, Dengue virus
EYQKTKLNDWD

SEQ ID NO: 70869 - protein, 11 aa, Dengue virus
YQKTKLNDWDF

SEQ ID NO: 70870 - protein, 11 aa, Dengue virus
QKTKLNDWDFV

SEQ ID NO: 70871 - protein, 11 aa, Dengue virus
KTKLNDWDFVV

SEQ ID NO: 70872 - protein, 11 aa, Dengue virus
TKLNDWDFVVT

SEQ ID NO: 70873 - protein, 11 aa, Dengue virus
KLNDWDFVVTT

SEQ ID NO: 70874 - protein, 11 aa, Dengue virus
LNDWDFVVTTD

SEQ ID NO: 70875 - protein, 11 aa, Dengue virus
NDWDFVVTTDI

SEQ ID NO: 70876 - protein, 11 aa, Dengue virus
DWDFVVTTDIS

SEQ ID NO: 70877 - protein, 11 aa, Dengue virus
WDFVVTTDISE

SEQ ID NO: 70878 - protein, 11 aa, Dengue virus
DFVVTTDISEM

SEQ ID NO: 70879 - protein, 11 aa, Dengue virus
FVVTTDISEMG

SEQ ID NO: 70880 - protein, 11 aa, Dengue virus
VVTTDISEMGA

SEQ ID NO: 70881 - protein, 11 aa, Dengue virus
VTTDISEMGAN

SEQ ID NO: 70882 - protein, 11 aa, Dengue virus
TTDISEMGANF

SEQ ID NO: 70883 - protein, 11 aa, Dengue virus
TDISEMGANFK

SEQ ID NO: 70884 - protein, 11 aa, Dengue virus
DISEMGANFKA

SEQ ID NO: 70885 - protein, 11 aa, Dengue virus
ISEMGANFKAD

SEQ ID NO: 70886 - protein, 11 aa, Dengue virus
SEMGANFKADR

SEQ ID NO: 70887 - protein, 11 aa, Dengue virus
EMGANFKADRV

SEQ ID NO: 70888 - protein, 11 aa, Dengue virus
MGANFKADRVI

SEQ ID NO: 70889 - protein, 11 aa, Dengue virus
GANFKADRVID

SEQ ID NO: 70890 - protein, 11 aa, Dengue virus
ANFKADRVIDP

SEQ ID NO: 70891 - protein, 11 aa, Dengue virus
NFKADRVIDPR

SEQ ID NO: 70892 - protein, 11 aa, Dengue virus
FKADRVIDPRR

SEQ ID NO: 70893 - protein, 11 aa, Dengue virus
KADRVIDPRRC

SEQ ID NO: 70894 - protein, 11 aa, Dengue virus
ADRVIDPRRCL

SEQ ID NO: 70895 - protein, 11 aa, Dengue virus
DRVIDPRRCLK

SEQ ID NO: 70896 - protein, 11 aa, Dengue virus
RVIDPRRCLKP

SEQ ID NO: 70897 - protein, 11 aa, Dengue virus
VIDPRRCLKPV

SEQ ID NO: 70898 - protein, 11 aa, Dengue virus
IDPRRCLKPVI

SEQ ID NO: 70899 - protein, 11 aa, Dengue virus
DPRRCLKPVIL

SEQ ID NO: 70900 - protein, 11 aa, Dengue virus
PRRCLKPVILT

SEQ ID NO: 70901 - protein, 11 aa, Dengue virus
RRCLKPVILTD

SEQ ID NO: 70902 - protein, 11 aa, Dengue virus
RCLKPVILTDG

SEQ ID NO: 70903 - protein, 11 aa, Dengue virus
CLKPVILTDGP

SEQ ID NO: 70904 - protein, 11 aa, Dengue virus
LKPVILTDGPE

SEQ ID NO: 70905 - protein, 11 aa, Dengue virus
KPVILTDGPER

SEQ ID NO: 70906 - protein, 11 aa, Dengue virus
PVILTDGPERV

SEQ ID NO: 70907 - protein, 11 aa, Dengue virus
VILTDGPERVI

SEQ ID NO: 70908 - protein, 11 aa, Dengue virus
ILTDGPERVIL

SEQ ID NO: 70909 - protein, 11 aa, Dengue virus
LTDGPERVILA

SEQ ID NO: 70910 - protein, 11 aa, Dengue virus
TDGPERVILAG

SEQ ID NO: 70911 - protein, 11 aa, Dengue virus
DGPERVILAGP

SEQ ID NO: 70912 - protein, 11 aa, Dengue virus
GPERVILAGPM

SEQ ID NO: 70913 - protein, 11 aa, Dengue virus
PERVILAGPMP

SEQ ID NO: 70914 - protein, 11 aa, Dengue virus
ERVILAGPMPV

SEQ ID NO: 70915 - protein, 11 aa, Dengue virus
RVILAGPMPVT

SEQ ID NO: 70916 - protein, 11 aa, Dengue virus
VILAGPMPVTA

SEQ ID NO: 70917 - protein, 11 aa, Dengue virus
ILAGPMPVTAA

SEQ ID NO: 70918 - protein, 11 aa, Dengue virus
LAGPMPVTAAS

SEQ ID NO: 70919 - protein, 11 aa, Dengue virus
AGPMPVTAASA

SEQ ID NO: 70920 - protein, 11 aa, Dengue virus
GPMPVTAASAA

SEQ ID NO: 70921 - protein, 11 aa, Dengue virus
PMPVTAASAAQ

SEQ ID NO: 70922 - protein, 11 aa, Dengue virus
MPVTAASAAQR

SEQ ID NO: 70923 - protein, 11 aa, Dengue virus
PVTAASAAQRR

SEQ ID NO: 70924 - protein, 11 aa, Dengue virus
VTAASAAQRRG

SEQ ID NO: 70925 - protein, 11 aa, Dengue virus
TAASAAQRRGR

SEQ ID NO: 70926 - protein, 11 aa, Dengue virus
AASAAQRRGRV

SEQ ID NO: 70927 - protein, 11 aa, Dengue virus
ASAAQRRGRVG

SEQ ID NO: 70928 - protein, 11 aa, Dengue virus
SAAQRRGRVGR

SEQ ID NO: 70929 - protein, 11 aa, Dengue virus
AAQRRGRVGRN

SEQ ID NO: 70930 - protein, 11 aa, Dengue virus
AQRRGRVGRNP

SEQ ID NO: 70931 - protein, 11 aa, Dengue virus
QRRGRVGRNPQ

SEQ ID NO: 70932 - protein, 11 aa, Dengue virus
RRGRVGRNPQK

SEQ ID NO: 70933 - protein, 11 aa, Dengue virus
RGRVGRNPQKE

SEQ ID NO: 70934 - protein, 11 aa, Dengue virus
GRVGRNPQKEN

SEQ ID NO: 70935 - protein, 11 aa, Dengue virus
RVGRNPQKEND

SEQ ID NO: 70936 - protein, 11 aa, Dengue virus
VGRNPQKENDQ

SEQ ID NO: 70937 - protein, 11 aa, Dengue virus
GRNPQKENDQY

SEQ ID NO: 70938 - protein, 11 aa, Dengue virus
RNPQKENDQYI

SEQ ID NO: 70939 - protein, 11 aa, Dengue virus
NPQKENDQYIF

SEQ ID NO: 70940 - protein, 11 aa, Dengue virus
PQKENDQYIFT

SEQ ID NO: 70941 - protein, 11 aa, Dengue virus
QKENDQYIFTG

SEQ ID NO: 70942 - protein, 11 aa, Dengue virus
KENDQYIFTGQ

SEQ ID NO: 70943 - protein, 11 aa, Dengue virus
ENDQYIFTGQP

SEQ ID NO: 70944 - protein, 11 aa, Dengue virus
NDQYIFTGQPL

SEQ ID NO: 70945 - protein, 11 aa, Dengue virus
DQYIFTGQPLN

SEQ ID NO: 70946 - protein, 11 aa, Dengue virus
QYIFTGQPLNN

SEQ ID NO: 70947 - protein, 11 aa, Dengue virus
YIFTGQPLNND

SEQ ID NO: 70948 - protein, 11 aa, Dengue virus
IFTGQPLNNDE

SEQ ID NO: 70949 - protein, 11 aa, Dengue virus
FTGQPLNNDED

SEQ ID NO: 70950 - protein, 11 aa, Dengue virus
TGQPLNNDEDH

SEQ ID NO: 70951 - protein, 11 aa, Dengue virus
GQPLNNDEDHA

SEQ ID NO: 70952 - protein, 11 aa, Dengue virus
QPLNNDEDHAH

SEQ ID NO: 70953 - protein, 11 aa, Dengue virus
PLNNDEDHAHW

SEQ ID NO: 70954 - protein, 11 aa, Dengue virus
LNNDEDHAHWT

SEQ ID NO: 70955 - protein, 11 aa, Dengue virus
NNDEDHAHWTE

SEQ ID NO: 70956 - protein, 11 aa, Dengue virus
NDEDHAHWTEA

SEQ ID NO: 70957 - protein, 11 aa, Dengue virus
DEDHAHWTEAK

SEQ ID NO: 70958 - protein, 11 aa, Dengue virus
EDHAHWTEAKM

SEQ ID NO: 70959 - protein, 11 aa, Dengue virus
DHAHWTEAKML

SEQ ID NO: 70960 - protein, 11 aa, Dengue virus
HAHWTEAKMLL

SEQ ID NO: 70961 - protein, 11 aa, Dengue virus
AHWTEAKMLLD

SEQ ID NO: 70962 - protein, 11 aa, Dengue virus
HWTEAKMLLDN

SEQ ID NO: 70963 - protein, 11 aa, Dengue virus
WTEAKMLLDNI

SEQ ID NO: 70964 - protein, 11 aa, Dengue virus
TEAKMLLDNIN

SEQ ID NO: 70965 - protein, 11 aa, Dengue virus
EAKMLLDNINT

SEQ ID NO: 70966 - protein, 11 aa, Dengue virus
AKMLLDNINTP

SEQ ID NO: 70967 - protein, 11 aa, Dengue virus
KMLLDNINTPE

SEQ ID NO: 70968 - protein, 11 aa, Dengue virus
MLLDNINTPEG

SEQ ID NO: 70969 - protein, 11 aa, Dengue virus
LLDNINTPEGI

SEQ ID NO: 70970 - protein, 11 aa, Dengue virus
LDNINTPEGII

SEQ ID NO: 70971 - protein, 11 aa, Dengue virus
DNINTPEGIIP

SEQ ID NO: 70972 - protein, 11 aa, Dengue virus
NINTPEGIIPA

SEQ ID NO: 70973 - protein, 11 aa, Dengue virus
INTPEGIIPAL

SEQ ID NO: 70974 - protein, 11 aa, Dengue virus
NTPEGIIPALF

SEQ ID NO: 70975 - protein, 11 aa, Dengue virus
TPEGIIPALFE

SEQ ID NO: 70976 - protein, 11 aa, Dengue virus
PEGIIPALFEP

SEQ ID NO: 70977 - protein, 11 aa, Dengue virus
EGIIPALFEPE

SEQ ID NO: 70978 - protein, 11 aa, Dengue virus
GIIPALFEPER

SEQ ID NO: 70979 - protein, 11 aa, Dengue virus
IIPALFEPERE

SEQ ID NO: 70980 - protein, 11 aa, Dengue virus
IPALFEPEREK

SEQ ID NO: 70981 - protein, 11 aa, Dengue virus
PALFEPEREKS

SEQ ID NO: 70982 - protein, 11 aa, Dengue virus
ALFEPEREKSA

SEQ ID NO: 70983 - protein, 11 aa, Dengue virus
LFEPEREKSAA

SEQ ID NO: 70984 - protein, 11 aa, Dengue virus
FEPEREKSAAI

SEQ ID NO: 70985 - protein, 11 aa, Dengue virus
EPEREKSAAID

SEQ ID NO: 70986 - protein, 11 aa, Dengue virus
PEREKSAAIDG

SEQ ID NO: 70987 - protein, 11 aa, Dengue virus
EREKSAAIDGE

SEQ ID NO: 70988 - protein, 11 aa, Dengue virus
REKSAAIDGEY

SEQ ID NO: 70989 - protein, 11 aa, Dengue virus
EKSAAIDGEYR

SEQ ID NO: 70990 - protein, 11 aa, Dengue virus
KSAAIDGEYRL

SEQ ID NO: 70991 - protein, 11 aa, Dengue virus
SAAIDGEYRLK

SEQ ID NO: 70992 - protein, 11 aa, Dengue virus
AAIDGEYRLKG

SEQ ID NO: 70993 - protein, 11 aa, Dengue virus
AIDGEYRLKGE

SEQ ID NO: 70994 - protein, 11 aa, Dengue virus
IDGEYRLKGES

SEQ ID NO: 70995 - protein, 11 aa, Dengue virus
DGEYRLKGESR

SEQ ID NO: 70996 - protein, 11 aa, Dengue virus
GEYRLKGESRK

SEQ ID NO: 70997 - protein, 11 aa, Dengue virus
EYRLKGESRKT

SEQ ID NO: 70998 - protein, 11 aa, Dengue virus
YRLKGESRKTF

SEQ ID NO: 70999 - protein, 11 aa, Dengue virus
RLKGESRKTFV

SEQ ID NO: 71000 - protein, 11 aa, Dengue virus
LKGESRKTFVE

SEQ ID NO: 71001 - protein, 11 aa, Dengue virus
KGESRKTFVEL

SEQ ID NO: 71002 - protein, 11 aa, Dengue virus
GESRKTFVELM

SEQ ID NO: 71003 - protein, 11 aa, Dengue virus
ESRKTFVELMR

SEQ ID NO: 71004 - protein, 11 aa, Dengue virus
SRKTFVELMRR

SEQ ID NO: 71005 - protein, 11 aa, Dengue virus
RKTFVELMRRG

SEQ ID NO: 71006 - protein, 11 aa, Dengue virus
KTFVELMRRGD

SEQ ID NO: 71007 - protein, 11 aa, Dengue virus
TFVELMRRGDL

SEQ ID NO: 71008 - protein, 11 aa, Dengue virus
FVELMRRGDLP

SEQ ID NO: 71009 - protein, 11 aa, Dengue virus
VELMRRGDLPV

SEQ ID NO: 71010 - protein, 11 aa, Dengue virus
ELMRRGDLPVW

SEQ ID NO: 71011 - protein, 11 aa, Dengue virus
LMRRGDLPVWL

SEQ ID NO: 71012 - protein, 11 aa, Dengue virus
MRRGDLPVWLA

SEQ ID NO: 71013 - protein, 11 aa, Dengue virus
RRGDLPVWLAH

SEQ ID NO: 71014 - protein, 11 aa, Dengue virus
RGDLPVWLAHK

SEQ ID NO: 71015 - protein, 11 aa, Dengue virus
GDLPVWLAHKV

SEQ ID NO: 71016 - protein, 11 aa, Dengue virus
DLPVWLAHKVA

SEQ ID NO: 71017 - protein, 11 aa, Dengue virus
LPVWLAHKVAS

SEQ ID NO: 71018 - protein, 11 aa, Dengue virus
PVWLAHKVASE

SEQ ID NO: 71019 - protein, 11 aa, Dengue virus
VWLAHKVASEG

SEQ ID NO: 71020 - protein, 11 aa, Dengue virus
WLAHKVASEGI

SEQ ID NO: 71021 - protein, 11 aa, Dengue virus
LAHKVASEGIK

SEQ ID NO: 71022 - protein, 11 aa, Dengue virus
AHKVASEGIKY

SEQ ID NO: 71023 - protein, 11 aa, Dengue virus
HKVASEGIKYT

SEQ ID NO: 71024 - protein, 11 aa, Dengue virus
KVASEGIKYTD

SEQ ID NO: 71025 - protein, 11 aa, Dengue virus
VASEGIKYTDR

SEQ ID NO: 71026 - protein, 11 aa, Dengue virus
ASEGIKYTDRK

SEQ ID NO: 71027 - protein, 11 aa, Dengue virus
SEGIKYTDRKW

SEQ ID NO: 71028 - protein, 11 aa, Dengue virus
EGIKYTDRKWC

SEQ ID NO: 71029 - protein, 11 aa, Dengue virus
GIKYTDRKWCF

SEQ ID NO: 71030 - protein, 11 aa, Dengue virus
IKYTDRKWCFD

SEQ ID NO: 71031 - protein, 11 aa, Dengue virus
KYTDRKWCFDG

SEQ ID NO: 71032 - protein, 11 aa, Dengue virus
YTDRKWCFDGQ

SEQ ID NO: 71033 - protein, 11 aa, Dengue virus
TDRKWCFDGQR

SEQ ID NO: 71034 - protein, 11 aa, Dengue virus
DRKWCFDGQRN

SEQ ID NO: 71035 - protein, 11 aa, Dengue virus
RKWCFDGQRNN

SEQ ID NO: 71036 - protein, 11 aa, Dengue virus
KWCFDGQRNNQ

SEQ ID NO: 71037 - protein, 11 aa, Dengue virus
WCFDGQRNNQI

SEQ ID NO: 71038 - protein, 11 aa, Dengue virus
CFDGQRNNQIL

SEQ ID NO: 71039 - protein, 11 aa, Dengue virus
FDGQRNNQILE

SEQ ID NO: 71040 - protein, 11 aa, Dengue virus
DGQRNNQILEE

SEQ ID NO: 71041 - protein, 11 aa, Dengue virus
GQRNNQILEEN

SEQ ID NO: 71042 - protein, 11 aa, Dengue virus
QRNNQILEENM

SEQ ID NO: 71043 - protein, 11 aa, Dengue virus
RNNQILEENMD

SEQ ID NO: 71044 - protein, 11 aa, Dengue virus
NNQILEENMDV

SEQ ID NO: 71045 - protein, 11 aa, Dengue virus
NQILEENMDVE

SEQ ID NO: 71046 - protein, 11 aa, Dengue virus
QILEENMDVEI

SEQ ID NO: 71047 - protein, 11 aa, Dengue virus
ILEENMDVEIW

SEQ ID NO: 71048 - protein, 11 aa, Dengue virus
LEENMDVEIWT

SEQ ID NO: 71049 - protein, 11 aa, Dengue virus
EENMDVEIWTK

SEQ ID NO: 71050 - protein, 11 aa, Dengue virus
ENMDVEIWTKE

SEQ ID NO: 71051 - protein, 11 aa, Dengue virus
NMDVEIWTKEG

SEQ ID NO: 71052 - protein, 11 aa, Dengue virus
MDVEIWTKEGE

SEQ ID NO: 71053 - protein, 11 aa, Dengue virus
DVEIWTKEGEK

SEQ ID NO: 71054 - protein, 11 aa, Dengue virus
VEIWTKEGEKK

SEQ ID NO: 71055 - protein, 11 aa, Dengue virus
EIWTKEGEKKK

SEQ ID NO: 71056 - protein, 11 aa, Dengue virus
IWTKEGEKKKL

SEQ ID NO: 71057 - protein, 11 aa, Dengue virus
WTKEGEKKKLR

SEQ ID NO: 71058 - protein, 11 aa, Dengue virus
TKEGEKKKLRP

SEQ ID NO: 71059 - protein, 11 aa, Dengue virus
KEGEKKKLRPR

SEQ ID NO: 71060 - protein, 11 aa, Dengue virus
EGEKKKLRPRW

SEQ ID NO: 71061 - protein, 11 aa, Dengue virus
GEKKKLRPRWL

SEQ ID NO: 71062 - protein, 11 aa, Dengue virus
EKKKLRPRWLD

SEQ ID NO: 71063 - protein, 11 aa, Dengue virus
KKKLRPRWLDA

SEQ ID NO: 71064 - protein, 11 aa, Dengue virus
KKLRPRWLDAR

SEQ ID NO: 71065 - protein, 11 aa, Dengue virus
KLRPRWLDART

SEQ ID NO: 71066 - protein, 11 aa, Dengue virus
LRPRWLDARTY

SEQ ID NO: 71067 - protein, 11 aa, Dengue virus
RPRWLDARTYS

SEQ ID NO: 71068 - protein, 11 aa, Dengue virus
PRWLDARTYSD

SEQ ID NO: 71069 - protein, 11 aa, Dengue virus
RWLDARTYSDP

SEQ ID NO: 71070 - protein, 11 aa, Dengue virus
WLDARTYSDPL

SEQ ID NO: 71071 - protein, 11 aa, Dengue virus
LDARTYSDPLA

SEQ ID NO: 71072 - protein, 11 aa, Dengue virus
DARTYSDPLAL

SEQ ID NO: 71073 - protein, 11 aa, Dengue virus
ARTYSDPLALK

SEQ ID NO: 71074 - protein, 11 aa, Dengue virus
RTYSDPLALKE

SEQ ID NO: 71075 - protein, 11 aa, Dengue virus
TYSDPLALKEF

SEQ ID NO: 71076 - protein, 11 aa, Dengue virus
YSDPLALKEFK

SEQ ID NO: 71077 - protein, 11 aa, Dengue virus
SDPLALKEFKD

SEQ ID NO: 71078 - protein, 11 aa, Dengue virus
DPLALKEFKDF

SEQ ID NO: 71079 - protein, 11 aa, Dengue virus
PLALKEFKDFA

SEQ ID NO: 71080 - protein, 11 aa, Dengue virus
LALKEFKDFAA

SEQ ID NO: 71081 - protein, 11 aa, Dengue virus
ALKEFKDFAAG

SEQ ID NO: 71082 - protein, 11 aa, Dengue virus
LKEFKDFAAGR

SEQ ID NO: 71083 - protein, 11 aa, Dengue virus
KEFKDFAAGRK

SEQ ID NO: 71084 - protein, 11 aa, Dengue virus
EFKDFAAGRKS

SEQ ID NO: 71085 - protein, 11 aa, Dengue virus
FKDFAAGRKSI

SEQ ID NO: 71086 - protein, 11 aa, Dengue virus
KDFAAGRKSIA

SEQ ID NO: 71087 - protein, 11 aa, Dengue virus
DFAAGRKSIAL

SEQ ID NO: 71088 - protein, 11 aa, Dengue virus
FAAGRKSIALD

SEQ ID NO: 71089 - protein, 11 aa, Dengue virus
AAGRKSIALDL

SEQ ID NO: 71090 - protein, 11 aa, Dengue virus
AGRKSIALDLV

SEQ ID NO: 71091 - protein, 11 aa, Dengue virus
GRKSIALDLVT

SEQ ID NO: 71092 - protein, 11 aa, Dengue virus
RKSIALDLVTE

SEQ ID NO: 71093 - protein, 11 aa, Dengue virus
KSIALDLVTEI

SEQ ID NO: 71094 - protein, 11 aa, Dengue virus
SIALDLVTEIG

SEQ ID NO: 71095 - protein, 11 aa, Dengue virus
IALDLVTEIGR

SEQ ID NO: 71096 - protein, 11 aa, Dengue virus
ALDLVTEIGRV

SEQ ID NO: 71097 - protein, 11 aa, Dengue virus
LDLVTEIGRVP

SEQ ID NO: 71098 - protein, 11 aa, Dengue virus
DLVTEIGRVPS

SEQ ID NO: 71099 - protein, 11 aa, Dengue virus
LVTEIGRVPSH

SEQ ID NO: 71100 - protein, 11 aa, Dengue virus
VTEIGRVPSHL

SEQ ID NO: 71101 - protein, 11 aa, Dengue virus
TEIGRVPSHLA

SEQ ID NO: 71102 - protein, 11 aa, Dengue virus
EIGRVPSHLAH

SEQ ID NO: 71103 - protein, 11 aa, Dengue virus
IGRVPSHLAHR

SEQ ID NO: 71104 - protein, 11 aa, Dengue virus
GRVPSHLAHRT

SEQ ID NO: 71105 - protein, 11 aa, Dengue virus
RVPSHLAHRTR

SEQ ID NO: 71106 - protein, 11 aa, Dengue virus
VPSHLAHRTRN

SEQ ID NO: 71107 - protein, 11 aa, Dengue virus
PSHLAHRTRNA

SEQ ID NO: 71108 - protein, 11 aa, Dengue virus
SHLAHRTRNAL

SEQ ID NO: 71109 - protein, 11 aa, Dengue virus
HLAHRTRNALD

SEQ ID NO: 71110 - protein, 11 aa, Dengue virus
LAHRTRNALDN

SEQ ID NO: 71111 - protein, 11 aa, Dengue virus
AHRTRNALDNL

SEQ ID NO: 71112 - protein, 11 aa, Dengue virus
HRTRNALDNLV

SEQ ID NO: 71113 - protein, 11 aa, Dengue virus
RTRNALDNLVM

SEQ ID NO: 71114 - protein, 11 aa, Dengue virus
TRNALDNLVML

SEQ ID NO: 71115 - protein, 11 aa, Dengue virus
RNALDNLVMLH

SEQ ID NO: 71116 - protein, 11 aa, Dengue virus
NALDNLVMLHT

SEQ ID NO: 71117 - protein, 11 aa, Dengue virus
ALDNLVMLHTS

SEQ ID NO: 71118 - protein, 11 aa, Dengue virus
LDNLVMLHTSE

SEQ ID NO: 71119 - protein, 11 aa, Dengue virus
DNLVMLHTSEH

SEQ ID NO: 71120 - protein, 11 aa, Dengue virus
NLVMLHTSEHG

SEQ ID NO: 71121 - protein, 11 aa, Dengue virus
LVMLHTSEHGG

SEQ ID NO: 71122 - protein, 11 aa, Dengue virus
VMLHTSEHGGR

SEQ ID NO: 71123 - protein, 11 aa, Dengue virus
MLHTSEHGGRA

SEQ ID NO: 71124 - protein, 11 aa, Dengue virus
LHTSEHGGRAY

SEQ ID NO: 71125 - protein, 11 aa, Dengue virus
HTSEHGGRAYR

SEQ ID NO: 71126 - protein, 11 aa, Dengue virus
TSEHGGRAYRH

SEQ ID NO: 71127 - protein, 11 aa, Dengue virus
SEHGGRAYRHA

SEQ ID NO: 71128 - protein, 11 aa, Dengue virus
EHGGRAYRHAV

SEQ ID NO: 71129 - protein, 11 aa, Dengue virus
HGGRAYRHAVE

SEQ ID NO: 71130 - protein, 11 aa, Dengue virus
GGRAYRHAVEE

SEQ ID NO: 71131 - protein, 11 aa, Dengue virus
GRAYRHAVEEL

SEQ ID NO: 71132 - protein, 11 aa, Dengue virus
RAYRHAVEELP

SEQ ID NO: 71133 - protein, 11 aa, Dengue virus
AYRHAVEELPE

SEQ ID NO: 71134 - protein, 11 aa, Dengue virus
YRHAVEELPET

SEQ ID NO: 71135 - protein, 11 aa, Dengue virus
RHAVEELPETM

SEQ ID NO: 71136 - protein, 11 aa, Dengue virus
HAVEELPETME

SEQ ID NO: 71137 - protein, 11 aa, Dengue virus
AVEELPETMET

SEQ ID NO: 71138 - protein, 11 aa, Dengue virus
VEELPETMETL

SEQ ID NO: 71139 - protein, 11 aa, Dengue virus
EELPETMETLL

SEQ ID NO: 71140 - protein, 11 aa, Dengue virus
ELPETMETLLL

SEQ ID NO: 71141 - protein, 11 aa, Dengue virus
LPETMETLLLL

SEQ ID NO: 71142 - protein, 11 aa, Dengue virus
PETMETLLLLG

SEQ ID NO: 71143 - protein, 11 aa, Dengue virus
ETMETLLLLGL

SEQ ID NO: 71144 - protein, 11 aa, Dengue virus
TMETLLLLGLM

SEQ ID NO: 71145 - protein, 11 aa, Dengue virus
METLLLLGLMI

SEQ ID NO: 71146 - protein, 11 aa, Dengue virus
ETLLLLGLMIL

SEQ ID NO: 71147 - protein, 11 aa, Dengue virus
TLLLLGLMILL

SEQ ID NO: 71148 - protein, 11 aa, Dengue virus
LLLLGLMILLT

SEQ ID NO: 71149 - protein, 11 aa, Dengue virus
LLLGLMILLTG

SEQ ID NO: 71150 - protein, 11 aa, Dengue virus
LLGLMILLTGG

SEQ ID NO: 71151 - protein, 11 aa, Dengue virus
LGLMILLTGGA

SEQ ID NO: 71152 - protein, 11 aa, Dengue virus
GLMILLTGGAM

SEQ ID NO: 71153 - protein, 11 aa, Dengue virus
LMILLTGGAML

SEQ ID NO: 71154 - protein, 11 aa, Dengue virus
MILLTGGAMLF

SEQ ID NO: 71155 - protein, 11 aa, Dengue virus
ILLTGGAMLFL

SEQ ID NO: 71156 - protein, 11 aa, Dengue virus
LLTGGAMLFLI

SEQ ID NO: 71157 - protein, 11 aa, Dengue virus
LTGGAMLFLIS

SEQ ID NO: 71158 - protein, 11 aa, Dengue virus
TGGAMLFLISG

SEQ ID NO: 71159 - protein, 11 aa, Dengue virus
GGAMLFLISGK

SEQ ID NO: 71160 - protein, 11 aa, Dengue virus
GAMLFLISGKG

SEQ ID NO: 71161 - protein, 11 aa, Dengue virus
MLFLISGKGIG

SEQ ID NO: 71162 - protein, 11 aa, Dengue virus
LFLISGKGIGK

SEQ ID NO: 71163 - protein, 11 aa, Dengue virus
FLISGKGIGKT

SEQ ID NO: 71164 - protein, 11 aa, Dengue virus
LISGKGIGKTS

SEQ ID NO: 71165 - protein, 11 aa, Dengue virus
ISGKGIGKTSI

SEQ ID NO: 71166 - protein, 11 aa, Dengue virus
SGKGIGKTSIG

SEQ ID NO: 71167 - protein, 11 aa, Dengue virus
GKGIGKTSIGL

SEQ ID NO: 71168 - protein, 11 aa, Dengue virus
KGIGKTSIGLI

SEQ ID NO: 71169 - protein, 11 aa, Dengue virus
GIGKTSIGLIC

SEQ ID NO: 71170 - protein, 11 aa, Dengue virus
IGKTSIGLICV

SEQ ID NO: 71171 - protein, 11 aa, Dengue virus
GKTSIGLICVI

SEQ ID NO: 71172 - protein, 11 aa, Dengue virus
KTSIGLICVIA

SEQ ID NO: 71173 - protein, 11 aa, Dengue virus
TSIGLICVIAS

SEQ ID NO: 71174 - protein, 11 aa, Dengue virus
SIGLICVIASS

SEQ ID NO: 71175 - protein, 11 aa, Dengue virus
IGLICVIASSG

SEQ ID NO: 71176 - protein, 11 aa, Dengue virus
GLICVIASSGM

SEQ ID NO: 71177 - protein, 11 aa, Dengue virus
LICVIASSGML

SEQ ID NO: 71178 - protein, 11 aa, Dengue virus
ICVIASSGMLW

SEQ ID NO: 71179 - protein, 11 aa, Dengue virus
CVIASSGMLWM

SEQ ID NO: 71180 - protein, 11 aa, Dengue virus
VIASSGMLWMA

SEQ ID NO: 71181 - protein, 11 aa, Dengue virus
SSGMLWMAEIP

SEQ ID NO: 71182 - protein, 11 aa, Dengue virus
SGMLWMAEIPL

SEQ ID NO: 71183 - protein, 11 aa, Dengue virus
GMLWMAEIPLQ

SEQ ID NO: 71184 - protein, 11 aa, Dengue virus
MLWMAEIPLQW

SEQ ID NO: 71185 - protein, 11 aa, Dengue virus
LWMAEIPLQWI

SEQ ID NO: 71186 - protein, 11 aa, Dengue virus
WMAEIPLQWIA

SEQ ID NO: 71187 - protein, 11 aa, Dengue virus
MAEIPLQWIAS

SEQ ID NO: 71188 - protein, 11 aa, Dengue virus
AEIPLQWIASA

SEQ ID NO: 71189 - protein, 11 aa, Dengue virus
EIPLQWIASAI

SEQ ID NO: 71190 - protein, 11 aa, Dengue virus
IPLQWIASAIV

SEQ ID NO: 71191 - protein, 11 aa, Dengue virus
PLQWIASAIVL

SEQ ID NO: 71192 - protein, 11 aa, Dengue virus
LQWIASAIVLE

SEQ ID NO: 71193 - protein, 11 aa, Dengue virus
QWIASAIVLEF

SEQ ID NO: 71194 - protein, 11 aa, Dengue virus
WIASAIVLEFF

SEQ ID NO: 71195 - protein, 11 aa, Dengue virus
IASAIVLEFFM

SEQ ID NO: 71196 - protein, 11 aa, Dengue virus
ASAIVLEFFMM

SEQ ID NO: 71197 - protein, 11 aa, Dengue virus
SAIVLEFFMMV

SEQ ID NO: 71198 - protein, 11 aa, Dengue virus
AIVLEFFMMVL

SEQ ID NO: 71199 - protein, 11 aa, Dengue virus
IVLEFFMMVLL

SEQ ID NO: 71200 - protein, 11 aa, Dengue virus
VLEFFMMVLLI

SEQ ID NO: 71201 - protein, 11 aa, Dengue virus
LEFFMMVLLIP

SEQ ID NO: 71202 - protein, 11 aa, Dengue virus
EFFMMVLLIPE

SEQ ID NO: 71203 - protein, 11 aa, Dengue virus
FFMMVLLIPEP

SEQ ID NO: 71204 - protein, 11 aa, Dengue virus
FMMVLLIPEPE

SEQ ID NO: 71205 - protein, 11 aa, Dengue virus
MMVLLIPEPEK

SEQ ID NO: 71206 - protein, 11 aa, Dengue virus
MVLLIPEPEKQ

SEQ ID NO: 71207 - protein, 11 aa, Dengue virus
VLLIPEPEKQR

SEQ ID NO: 71208 - protein, 11 aa, Dengue virus
LLIPEPEKQRT

SEQ ID NO: 71209 - protein, 11 aa, Dengue virus
LIPEPEKQRTP

SEQ ID NO: 71210 - protein, 11 aa, Dengue virus
IPEPEKQRTPQ

SEQ ID NO: 71211 - protein, 11 aa, Dengue virus
PEPEKQRTPQD

SEQ ID NO: 71212 - protein, 11 aa, Dengue virus
EPEKQRTPQDN

SEQ ID NO: 71213 - protein, 11 aa, Dengue virus
PEKQRTPQDNQ

SEQ ID NO: 71214 - protein, 11 aa, Dengue virus
EKQRTPQDNQL

SEQ ID NO: 71215 - protein, 11 aa, Dengue virus
KQRTPQDNQLA

SEQ ID NO: 71216 - protein, 11 aa, Dengue virus
QRTPQDNQLAY

SEQ ID NO: 71217 - protein, 11 aa, Dengue virus
RTPQDNQLAYV

SEQ ID NO: 71218 - protein, 11 aa, Dengue virus
TPQDNQLAYVV

SEQ ID NO: 71219 - protein, 11 aa, Dengue virus
PQDNQLAYVVI

SEQ ID NO: 71220 - protein, 11 aa, Dengue virus
QDNQLAYVVIG

SEQ ID NO: 71221 - protein, 11 aa, Dengue virus
DNQLAYVVIGI

SEQ ID NO: 71222 - protein, 11 aa, Dengue virus
NQLAYVVIGIL

SEQ ID NO: 71223 - protein, 11 aa, Dengue virus
QLAYVVIGILT

SEQ ID NO: 71224 - protein, 11 aa, Dengue virus
LAYVVIGILTL

SEQ ID NO: 71225 - protein, 11 aa, Dengue virus
AYVVIGILTLA

SEQ ID NO: 71226 - protein, 11 aa, Dengue virus
YVVIGILTLAA

SEQ ID NO: 71227 - protein, 11 aa, Dengue virus
VVIGILTLAAI

SEQ ID NO: 71228 - protein, 11 aa, Dengue virus
VIGILTLAAII

SEQ ID NO: 71229 - protein, 11 aa, Dengue virus
IGILTLAAIIA

SEQ ID NO: 71230 - protein, 11 aa, Dengue virus
GILTLAAIIAA

SEQ ID NO: 71231 - protein, 11 aa, Dengue virus
ILTLAAIIAAN

SEQ ID NO: 71232 - protein, 11 aa, Dengue virus
LTLAAIIAANE

SEQ ID NO: 71233 - protein, 11 aa, Dengue virus
TLAAIIAANEM

SEQ ID NO: 71234 - protein, 11 aa, Dengue virus
LAAIIAANEMG

SEQ ID NO: 71235 - protein, 11 aa, Dengue virus
AAIIAANEMGL

SEQ ID NO: 71236 - protein, 11 aa, Dengue virus
AIIAANEMGLL

SEQ ID NO: 71237 - protein, 11 aa, Dengue virus
IIAANEMGLLE

SEQ ID NO: 71238 - protein, 11 aa, Dengue virus
IAANEMGLLET

SEQ ID NO: 71239 - protein, 11 aa, Dengue virus
AANEMGLLETT

SEQ ID NO: 71240 - protein, 11 aa, Dengue virus
ANEMGLLETTK

SEQ ID NO: 71241 - protein, 11 aa, Dengue virus
NEMGLLETTKR

SEQ ID NO: 71242 - protein, 11 aa, Dengue virus
EMGLLETTKRD

SEQ ID NO: 71243 - protein, 11 aa, Dengue virus
MGLLETTKRDL

SEQ ID NO: 71244 - protein, 11 aa, Dengue virus
GLLETTKRDLG

SEQ ID NO: 71245 - protein, 11 aa, Dengue virus
LLETTKRDLGM

SEQ ID NO: 71246 - protein, 11 aa, Dengue virus
LETTKRDLGMS

SEQ ID NO: 71247 - protein, 11 aa, Dengue virus
ETTKRDLGMSK

SEQ ID NO: 71248 - protein, 11 aa, Dengue virus
TTKRDLGMSKE

SEQ ID NO: 71249 - protein, 11 aa, Dengue virus
TKRDLGMSKEP

SEQ ID NO: 71250 - protein, 11 aa, Dengue virus
KRDLGMSKEPG

SEQ ID NO: 71251 - protein, 11 aa, Dengue virus
RDLGMSKEPGV

SEQ ID NO: 71252 - protein, 11 aa, Dengue virus
DLGMSKEPGVV

SEQ ID NO: 71253 - protein, 11 aa, Dengue virus
LGMSKEPGVVS

SEQ ID NO: 71254 - protein, 11 aa, Dengue virus
GMSKEPGVVSP

SEQ ID NO: 71255 - protein, 11 aa, Dengue virus
EPGVVSPTSYL

SEQ ID NO: 71256 - protein, 11 aa, Dengue virus
PGVVSPTSYLD

SEQ ID NO: 71257 - protein, 11 aa, Dengue virus
GVVSPTSYLDV

SEQ ID NO: 71258 - protein, 11 aa, Dengue virus
VVSPTSYLDVD

SEQ ID NO: 71259 - protein, 11 aa, Dengue virus
VSPTSYLDVDL

SEQ ID NO: 71260 - protein, 11 aa, Dengue virus
SPTSYLDVDLH

SEQ ID NO: 71261 - protein, 11 aa, Dengue virus
PTSYLDVDLHP

SEQ ID NO: 71262 - protein, 11 aa, Dengue virus
TSYLDVDLHPA

SEQ ID NO: 71263 - protein, 11 aa, Dengue virus
SYLDVDLHPAS

SEQ ID NO: 71264 - protein, 11 aa, Dengue virus
YLDVDLHPASA

SEQ ID NO: 71265 - protein, 11 aa, Dengue virus
LDVDLHPASAW

SEQ ID NO: 71266 - protein, 11 aa, Dengue virus
DVDLHPASAWT

SEQ ID NO: 71267 - protein, 11 aa, Dengue virus
VDLHPASAWTL

SEQ ID NO: 71268 - protein, 11 aa, Dengue virus
DLHPASAWTLY

SEQ ID NO: 71269 - protein, 11 aa, Dengue virus
LHPASAWTLYA

SEQ ID NO: 71270 - protein, 11 aa, Dengue virus
HPASAWTLYAV

SEQ ID NO: 71271 - protein, 11 aa, Dengue virus
PASAWTLYAVA

SEQ ID NO: 71272 - protein, 11 aa, Dengue virus
ASAWTLYAVAT

SEQ ID NO: 71273 - protein, 11 aa, Dengue virus
SAWTLYAVATT

SEQ ID NO: 71274 - protein, 11 aa, Dengue virus
AWTLYAVATTV

SEQ ID NO: 71275 - protein, 11 aa, Dengue virus
WTLYAVATTVI

SEQ ID NO: 71276 - protein, 11 aa, Dengue virus
TLYAVATTVIT

SEQ ID NO: 71277 - protein, 11 aa, Dengue virus
LYAVATTVITP

SEQ ID NO: 71278 - protein, 11 aa, Dengue virus
YAVATTVITPM

SEQ ID NO: 71279 - protein, 11 aa, Dengue virus
AVATTVITPML

SEQ ID NO: 71280 - protein, 11 aa, Dengue virus
VATTVITPMLR

SEQ ID NO: 71281 - protein, 11 aa, Dengue virus
ATTVITPMLRH

SEQ ID NO: 71282 - protein, 11 aa, Dengue virus
TTVITPMLRHT

SEQ ID NO: 71283 - protein, 11 aa, Dengue virus
TVITPMLRHTI

SEQ ID NO: 71284 - protein, 11 aa, Dengue virus
VITPMLRHTIE

SEQ ID NO: 71285 - protein, 11 aa, Dengue virus
ITPMLRHTIEN

SEQ ID NO: 71286 - protein, 11 aa, Dengue virus
TPMLRHTIENS

SEQ ID NO: 71287 - protein, 11 aa, Dengue virus
PMLRHTIENST

SEQ ID NO: 71288 - protein, 11 aa, Dengue virus
MLRHTIENSTA

SEQ ID NO: 71289 - protein, 11 aa, Dengue virus
LRHTIENSTAN

SEQ ID NO: 71290 - protein, 11 aa, Dengue virus
RHTIENSTANV

SEQ ID NO: 71291 - protein, 11 aa, Dengue virus
HTIENSTANVS

SEQ ID NO: 71292 - protein, 11 aa, Dengue virus
TIENSTANVSL

SEQ ID NO: 71293 - protein, 11 aa, Dengue virus
IENSTANVSLA

SEQ ID NO: 71294 - protein, 11 aa, Dengue virus
ENSTANVSLAA

SEQ ID NO: 71295 - protein, 11 aa, Dengue virus
NSTANVSLAAI

SEQ ID NO: 71296 - protein, 11 aa, Dengue virus
STANVSLAAIA

SEQ ID NO: 71297 - protein, 11 aa, Dengue virus
TANVSLAAIAN

SEQ ID NO: 71298 - protein, 11 aa, Dengue virus
ANVSLAAIANQ

SEQ ID NO: 71299 - protein, 11 aa, Dengue virus
NVSLAAIANQA

SEQ ID NO: 71300 - protein, 11 aa, Dengue virus
VSLAAIANQAV

SEQ ID NO: 71301 - protein, 11 aa, Dengue virus
SLAAIANQAVV

SEQ ID NO: 71302 - protein, 11 aa, Dengue virus
LAAIANQAVVL

SEQ ID NO: 71303 - protein, 11 aa, Dengue virus
AAIANQAVVLM

SEQ ID NO: 71304 - protein, 11 aa, Dengue virus
AIANQAVVLMG

SEQ ID NO: 71305 - protein, 11 aa, Dengue virus
IANQAVVLMGL

SEQ ID NO: 71306 - protein, 11 aa, Dengue virus
ANQAVVLMGLD

SEQ ID NO: 71307 - protein, 11 aa, Dengue virus
NQAVVLMGLDK

SEQ ID NO: 71308 - protein, 11 aa, Dengue virus
QAVVLMGLDKG

SEQ ID NO: 71309 - protein, 11 aa, Dengue virus
AVVLMGLDKGW

SEQ ID NO: 71310 - protein, 11 aa, Dengue virus
VVLMGLDKGWP

SEQ ID NO: 71311 - protein, 11 aa, Dengue virus
VLMGLDKGWPI

SEQ ID NO: 71312 - protein, 11 aa, Dengue virus
LMGLDKGWPIS

SEQ ID NO: 71313 - protein, 11 aa, Dengue virus
MGLDKGWPISK

SEQ ID NO: 71314 - protein, 11 aa, Dengue virus
GLDKGWPISKM

SEQ ID NO: 71315 - protein, 11 aa, Dengue virus
LDKGWPISKMD

SEQ ID NO: 71316 - protein, 11 aa, Dengue virus
DKGWPISKMDL

SEQ ID NO: 71317 - protein, 11 aa, Dengue virus
KGWPISKMDLG

SEQ ID NO: 71318 - protein, 11 aa, Dengue virus
GWPISKMDLGV

SEQ ID NO: 71319 - protein, 11 aa, Dengue virus
WPISKMDLGVP

SEQ ID NO: 71320 - protein, 11 aa, Dengue virus
PISKMDLGVPL

SEQ ID NO: 71321 - protein, 11 aa, Dengue virus
ISKMDLGVPLL

SEQ ID NO: 71322 - protein, 11 aa, Dengue virus
SKMDLGVPLLA

SEQ ID NO: 71323 - protein, 11 aa, Dengue virus
KMDLGVPLLAL

SEQ ID NO: 71324 - protein, 11 aa, Dengue virus
MDLGVPLLALG

SEQ ID NO: 71325 - protein, 11 aa, Dengue virus
DLGVPLLALGC

SEQ ID NO: 71326 - protein, 11 aa, Dengue virus
LGVPLLALGCY

SEQ ID NO: 71327 - protein, 11 aa, Dengue virus
GVPLLALGCYS

SEQ ID NO: 71328 - protein, 11 aa, Dengue virus
VPLLALGCYSQ

SEQ ID NO: 71329 - protein, 11 aa, Dengue virus
PLLALGCYSQV

SEQ ID NO: 71330 - protein, 11 aa, Dengue virus
LLALGCYSQVN

SEQ ID NO: 71331 - protein, 11 aa, Dengue virus
LALGCYSQVNP

SEQ ID NO: 71332 - protein, 11 aa, Dengue virus
ALGCYSQVNPL

SEQ ID NO: 71333 - protein, 11 aa, Dengue virus
LGCYSQVNPLT

SEQ ID NO: 71334 - protein, 11 aa, Dengue virus
GCYSQVNPLTL

SEQ ID NO: 71335 - protein, 11 aa, Dengue virus
CYSQVNPLTLT

SEQ ID NO: 71336 - protein, 11 aa, Dengue virus
YSQVNPLTLTA

SEQ ID NO: 71337 - protein, 11 aa, Dengue virus
SQVNPLTLTAA

SEQ ID NO: 71338 - protein, 11 aa, Dengue virus
QVNPLTLTAAV

SEQ ID NO: 71339 - protein, 11 aa, Dengue virus
VNPLTLTAAVL

SEQ ID NO: 71340 - protein, 11 aa, Dengue virus
NPLTLTAAVLL

SEQ ID NO: 71341 - protein, 11 aa, Dengue virus
PLTLTAAVLLL

SEQ ID NO: 71342 - protein, 11 aa, Dengue virus
LTLTAAVLLLI

SEQ ID NO: 71343 - protein, 11 aa, Dengue virus
TLTAAVLLLIT

SEQ ID NO: 71344 - protein, 11 aa, Dengue virus
LTAAVLLLITH

SEQ ID NO: 71345 - protein, 11 aa, Dengue virus
TAAVLLLITHY

SEQ ID NO: 71346 - protein, 11 aa, Dengue virus
AAVLLLITHYA

SEQ ID NO: 71347 - protein, 11 aa, Dengue virus
AVLLLITHYAI

SEQ ID NO: 71348 - protein, 11 aa, Dengue virus
VLLLITHYAII

SEQ ID NO: 71349 - protein, 11 aa, Dengue virus
LLLITHYAIIG

SEQ ID NO: 71350 - protein, 11 aa, Dengue virus
LLITHYAIIGP

SEQ ID NO: 71351 - protein, 11 aa, Dengue virus
LITHYAIIGPG

SEQ ID NO: 71352 - protein, 11 aa, Dengue virus
ITHYAIIGPGL

SEQ ID NO: 71353 - protein, 11 aa, Dengue virus
THYAIIGPGLQ

SEQ ID NO: 71354 - protein, 11 aa, Dengue virus
HYAIIGPGLQA

SEQ ID NO: 71355 - protein, 11 aa, Dengue virus
YAIIGPGLQAK

SEQ ID NO: 71356 - protein, 11 aa, Dengue virus
AIIGPGLQAKA

SEQ ID NO: 71357 - protein, 11 aa, Dengue virus
IIGPGLQAKAT

SEQ ID NO: 71358 - protein, 11 aa, Dengue virus
IGPGLQAKATR

SEQ ID NO: 71359 - protein, 11 aa, Dengue virus
GPGLQAKATRE

SEQ ID NO: 71360 - protein, 11 aa, Dengue virus
PGLQAKATREA

SEQ ID NO: 71361 - protein, 11 aa, Dengue virus
GLQAKATREAQ

SEQ ID NO: 71362 - protein, 11 aa, Dengue virus
LQAKATREAQK

SEQ ID NO: 71363 - protein, 11 aa, Dengue virus
QAKATREAQKR

SEQ ID NO: 71364 - protein, 11 aa, Dengue virus
AKATREAQKRT

SEQ ID NO: 71365 - protein, 11 aa, Dengue virus
KATREAQKRTA

SEQ ID NO: 71366 - protein, 11 aa, Dengue virus
ATREAQKRTAA

SEQ ID NO: 71367 - protein, 11 aa, Dengue virus
TREAQKRTAAG

SEQ ID NO: 71368 - protein, 11 aa, Dengue virus
REAQKRTAAGI

SEQ ID NO: 71369 - protein, 11 aa, Dengue virus
EAQKRTAAGIM

SEQ ID NO: 71370 - protein, 11 aa, Dengue virus
AQKRTAAGIMK

SEQ ID NO: 71371 - protein, 11 aa, Dengue virus
QKRTAAGIMKN

SEQ ID NO: 71372 - protein, 11 aa, Dengue virus
KRTAAGIMKNP

SEQ ID NO: 71373 - protein, 11 aa, Dengue virus
RTAAGIMKNPT

SEQ ID NO: 71374 - protein, 11 aa, Dengue virus
TAAGIMKNPTV

SEQ ID NO: 71375 - protein, 11 aa, Dengue virus
AAGIMKNPTVD

SEQ ID NO: 71376 - protein, 11 aa, Dengue virus
AGIMKNPTVDG

SEQ ID NO: 71377 - protein, 11 aa, Dengue virus
GIMKNPTVDGI

SEQ ID NO: 71378 - protein, 11 aa, Dengue virus
IMKNPTVDGIM

SEQ ID NO: 71379 - protein, 11 aa, Dengue virus
MKNPTVDGIMT

SEQ ID NO: 71380 - protein, 11 aa, Dengue virus
KNPTVDGIMTI

SEQ ID NO: 71381 - protein, 11 aa, Dengue virus
NPTVDGIMTID

SEQ ID NO: 71382 - protein, 11 aa, Dengue virus
PTVDGIMTIDL

SEQ ID NO: 71383 - protein, 11 aa, Dengue virus
TVDGIMTIDLD

SEQ ID NO: 71384 - protein, 11 aa, Dengue virus
VDGIMTIDLDP

SEQ ID NO: 71385 - protein, 11 aa, Dengue virus
DGIMTIDLDPV

SEQ ID NO: 71386 - protein, 11 aa, Dengue virus
GIMTIDLDPVI

SEQ ID NO: 71387 - protein, 11 aa, Dengue virus
IMTIDLDPVIY

SEQ ID NO: 71388 - protein, 11 aa, Dengue virus
MTIDLDPVIYD

SEQ ID NO: 71389 - protein, 11 aa, Dengue virus
TIDLDPVIYDS

SEQ ID NO: 71390 - protein, 11 aa, Dengue virus
IDLDPVIYDSK

SEQ ID NO: 71391 - protein, 11 aa, Dengue virus
DLDPVIYDSKF

SEQ ID NO: 71392 - protein, 11 aa, Dengue virus
LDPVIYDSKFE

SEQ ID NO: 71393 - protein, 11 aa, Dengue virus
DPVIYDSKFEK

SEQ ID NO: 71394 - protein, 11 aa, Dengue virus
PVIYDSKFEKQ

SEQ ID NO: 71395 - protein, 11 aa, Dengue virus
VIYDSKFEKQL

SEQ ID NO: 71396 - protein, 11 aa, Dengue virus
IYDSKFEKQLG

SEQ ID NO: 71397 - protein, 11 aa, Dengue virus
YDSKFEKQLGQ

SEQ ID NO: 71398 - protein, 11 aa, Dengue virus
DSKFEKQLGQV

SEQ ID NO: 71399 - protein, 11 aa, Dengue virus
SKFEKQLGQVM

SEQ ID NO: 71400 - protein, 11 aa, Dengue virus
KFEKQLGQVML

SEQ ID NO: 71401 - protein, 11 aa, Dengue virus
FEKQLGQVMLL

SEQ ID NO: 71402 - protein, 11 aa, Dengue virus
EKQLGQVMLLV

SEQ ID NO: 71403 - protein, 11 aa, Dengue virus
KQLGQVMLLVL

SEQ ID NO: 71404 - protein, 11 aa, Dengue virus
QLGQVMLLVLC

SEQ ID NO: 71405 - protein, 11 aa, Dengue virus
LGQVMLLVLCA

SEQ ID NO: 71406 - protein, 11 aa, Dengue virus
GQVMLLVLCAV

SEQ ID NO: 71407 - protein, 11 aa, Dengue virus
QVMLLVLCAVQ

SEQ ID NO: 71408 - protein, 11 aa, Dengue virus
VMLLVLCAVQL

SEQ ID NO: 71409 - protein, 11 aa, Dengue virus
MLLVLCAVQLL

SEQ ID NO: 71410 - protein, 11 aa, Dengue virus
LLVLCAVQLLL

SEQ ID NO: 71411 - protein, 11 aa, Dengue virus
LVLCAVQLLLM

SEQ ID NO: 71412 - protein, 11 aa, Dengue virus
VLCAVQLLLMR

SEQ ID NO: 71413 - protein, 11 aa, Dengue virus
LCAVQLLLMRT

SEQ ID NO: 71414 - protein, 11 aa, Dengue virus
CAVQLLLMRTS

SEQ ID NO: 71415 - protein, 11 aa, Dengue virus
AVQLLLMRTSW

SEQ ID NO: 71416 - protein, 11 aa, Dengue virus
VQLLLMRTSWA

SEQ ID NO: 71417 - protein, 11 aa, Dengue virus
QLLLMRTSWAL

SEQ ID NO: 71418 - protein, 11 aa, Dengue virus
LLLMRTSWALC

SEQ ID NO: 71419 - protein, 11 aa, Dengue virus
LLMRTSWALCE

SEQ ID NO: 71420 - protein, 11 aa, Dengue virus
LMRTSWALCEA

SEQ ID NO: 71421 - protein, 11 aa, Dengue virus
MRTSWALCEAL

SEQ ID NO: 71422 - protein, 11 aa, Dengue virus
RTSWALCEALT

SEQ ID NO: 71423 - protein, 11 aa, Dengue virus
TSWALCEALTL

SEQ ID NO: 71424 - protein, 11 aa, Dengue virus
SWALCEALTLA

SEQ ID NO: 71425 - protein, 11 aa, Dengue virus
WALCEALTLAT

SEQ ID NO: 71426 - protein, 11 aa, Dengue virus
ALCEALTLATG

SEQ ID NO: 71427 - protein, 11 aa, Dengue virus
LCEALTLATGP

SEQ ID NO: 71428 - protein, 11 aa, Dengue virus
CEALTLATGPI

SEQ ID NO: 71429 - protein, 11 aa, Dengue virus
EALTLATGPIT

SEQ ID NO: 71430 - protein, 11 aa, Dengue virus
ALTLATGPITT

SEQ ID NO: 71431 - protein, 11 aa, Dengue virus
LTLATGPITTL

SEQ ID NO: 71432 - protein, 11 aa, Dengue virus
TLATGPITTLW

SEQ ID NO: 71433 - protein, 11 aa, Dengue virus
LATGPITTLWE

SEQ ID NO: 71434 - protein, 11 aa, Dengue virus
ATGPITTLWEG

SEQ ID NO: 71435 - protein, 11 aa, Dengue virus
TGPITTLWEGS

SEQ ID NO: 71436 - protein, 11 aa, Dengue virus
GPITTLWEGSP

SEQ ID NO: 71437 - protein, 11 aa, Dengue virus
PITTLWEGSPG

SEQ ID NO: 71438 - protein, 11 aa, Dengue virus
ITTLWEGSPGK

SEQ ID NO: 71439 - protein, 11 aa, Dengue virus
TTLWEGSPGKF

SEQ ID NO: 71440 - protein, 11 aa, Dengue virus
TLWEGSPGKFW

SEQ ID NO: 71441 - protein, 11 aa, Dengue virus
LWEGSPGKFWN

SEQ ID NO: 71442 - protein, 11 aa, Dengue virus
WEGSPGKFWNT

SEQ ID NO: 71443 - protein, 11 aa, Dengue virus
EGSPGKFWNTT

SEQ ID NO: 71444 - protein, 11 aa, Dengue virus
GSPGKFWNTTI

SEQ ID NO: 71445 - protein, 11 aa, Dengue virus
SPGKFWNTTIA

SEQ ID NO: 71446 - protein, 11 aa, Dengue virus
PGKFWNTTIAV

SEQ ID NO: 71447 - protein, 11 aa, Dengue virus
GKFWNTTIAVS

SEQ ID NO: 71448 - protein, 11 aa, Dengue virus
KFWNTTIAVSM

SEQ ID NO: 71449 - protein, 11 aa, Dengue virus
FWNTTIAVSMA

SEQ ID NO: 71450 - protein, 11 aa, Dengue virus
WNTTIAVSMAN

SEQ ID NO: 71451 - protein, 11 aa, Dengue virus
NTTIAVSMANI

SEQ ID NO: 71452 - protein, 11 aa, Dengue virus
TTIAVSMANIF

SEQ ID NO: 71453 - protein, 11 aa, Dengue virus
TIAVSMANIFR

SEQ ID NO: 71454 - protein, 11 aa, Dengue virus
IAVSMANIFRG

SEQ ID NO: 71455 - protein, 11 aa, Dengue virus
AVSMANIFRGS

SEQ ID NO: 71456 - protein, 11 aa, Dengue virus
VSMANIFRGSY

SEQ ID NO: 71457 - protein, 11 aa, Dengue virus
SMANIFRGSYL

SEQ ID NO: 71458 - protein, 11 aa, Dengue virus
MANIFRGSYLA

SEQ ID NO: 71459 - protein, 11 aa, Dengue virus
ANIFRGSYLAG

SEQ ID NO: 71460 - protein, 11 aa, Dengue virus
NIFRGSYLAGA

SEQ ID NO: 71461 - protein, 11 aa, Dengue virus
IFRGSYLAGAG

SEQ ID NO: 71462 - protein, 11 aa, Dengue virus
FRGSYLAGAGL

SEQ ID NO: 71463 - protein, 11 aa, Dengue virus
RGSYLAGAGLA

SEQ ID NO: 71464 - protein, 11 aa, Dengue virus
GSYLAGAGLAF

SEQ ID NO: 71465 - protein, 11 aa, Dengue virus
SYLAGAGLAFS

SEQ ID NO: 71466 - protein, 11 aa, Dengue virus
YLAGAGLAFSI

SEQ ID NO: 71467 - protein, 11 aa, Dengue virus
LAGAGLAFSIM

SEQ ID NO: 71468 - protein, 11 aa, Dengue virus
AGAGLAFSIMK

SEQ ID NO: 71469 - protein, 11 aa, Dengue virus
GAGLAFSIMKS

SEQ ID NO: 71470 - protein, 11 aa, Dengue virus
AGLAFSIMKSV

SEQ ID NO: 71471 - protein, 11 aa, Dengue virus
GLAFSIMKSVG

SEQ ID NO: 71472 - protein, 11 aa, Dengue virus
LAFSIMKSVGT

SEQ ID NO: 71473 - protein, 11 aa, Dengue virus
AFSIMKSVGTG

SEQ ID NO: 71474 - protein, 11 aa, Dengue virus
FSIMKSVGTGK

SEQ ID NO: 71475 - protein, 11 aa, Dengue virus
SIMKSVGTGKR

SEQ ID NO: 71476 - protein, 11 aa, Dengue virus
IMKSVGTGKRG

SEQ ID NO: 71477 - protein, 11 aa, Dengue virus
MKSVGTGKRGT

SEQ ID NO: 71478 - protein, 11 aa, Dengue virus
KSVGTGKRGTG

SEQ ID NO: 71479 - protein, 11 aa, Dengue virus
SVGTGKRGTGS

SEQ ID NO: 71480 - protein, 11 aa, Dengue virus
VGTGKRGTGSQ

SEQ ID NO: 71481 - protein, 11 aa, Dengue virus
GTGKRGTGSQG

SEQ ID NO: 71482 - protein, 11 aa, Dengue virus
TGKRGTGSQGE

SEQ ID NO: 71483 - protein, 11 aa, Dengue virus
GKRGTGSQGET

SEQ ID NO: 71484 - protein, 11 aa, Dengue virus
KRGTGSQGETL

SEQ ID NO: 71485 - protein, 11 aa, Dengue virus
RGTGSQGETLG

SEQ ID NO: 71486 - protein, 11 aa, Dengue virus
GTGSQGETLGE

SEQ ID NO: 71487 - protein, 11 aa, Dengue virus
TGSQGETLGEK

SEQ ID NO: 71488 - protein, 11 aa, Dengue virus
GSQGETLGEKW

SEQ ID NO: 71489 - protein, 11 aa, Dengue virus
SQGETLGEKWK

SEQ ID NO: 71490 - protein, 11 aa, Dengue virus
QGETLGEKWKK

SEQ ID NO: 71491 - protein, 11 aa, Dengue virus
GETLGEKWKKK

SEQ ID NO: 71492 - protein, 11 aa, Dengue virus
ETLGEKWKKKL

SEQ ID NO: 71493 - protein, 11 aa, Dengue virus
TLGEKWKKKLN

SEQ ID NO: 71494 - protein, 11 aa, Dengue virus
LGEKWKKKLNQ

SEQ ID NO: 71495 - protein, 11 aa, Dengue virus
GEKWKKKLNQL

SEQ ID NO: 71496 - protein, 11 aa, Dengue virus
EKWKKKLNQLS

SEQ ID NO: 71497 - protein, 11 aa, Dengue virus
KWKKKLNQLSR

SEQ ID NO: 71498 - protein, 11 aa, Dengue virus
WKKKLNQLSRK

SEQ ID NO: 71499 - protein, 11 aa, Dengue virus
KLNQLSRKEFD

SEQ ID NO: 71500 - protein, 11 aa, Dengue virus
LNQLSRKEFDL

SEQ ID NO: 71501 - protein, 11 aa, Dengue virus
NQLSRKEFDLY

SEQ ID NO: 71502 - protein, 11 aa, Dengue virus
QLSRKEFDLYK

SEQ ID NO: 71503 - protein, 11 aa, Dengue virus
LSRKEFDLYKK

SEQ ID NO: 71504 - protein, 11 aa, Dengue virus
SRKEFDLYKKS

SEQ ID NO: 71505 - protein, 11 aa, Dengue virus
RKEFDLYKKSG

SEQ ID NO: 71506 - protein, 11 aa, Dengue virus
KEFDLYKKSGI

SEQ ID NO: 71507 - protein, 11 aa, Dengue virus
EFDLYKKSGIT

SEQ ID NO: 71508 - protein, 11 aa, Dengue virus
FDLYKKSGITE

SEQ ID NO: 71509 - protein, 11 aa, Dengue virus
DLYKKSGITEV

SEQ ID NO: 71510 - protein, 11 aa, Dengue virus
LYKKSGITEVD

SEQ ID NO: 71511 - protein, 11 aa, Dengue virus
YKKSGITEVDR

SEQ ID NO: 71512 - protein, 11 aa, Dengue virus
KKSGITEVDRT

SEQ ID NO: 71513 - protein, 11 aa, Dengue virus
KSGITEVDRTE

SEQ ID NO: 71514 - protein, 11 aa, Dengue virus
SGITEVDRTEA

SEQ ID NO: 71515 - protein, 11 aa, Dengue virus
GITEVDRTEAK

SEQ ID NO: 71516 - protein, 11 aa, Dengue virus
ITEVDRTEAKE

SEQ ID NO: 71517 - protein, 11 aa, Dengue virus
TEVDRTEAKEG

SEQ ID NO: 71518 - protein, 11 aa, Dengue virus
EVDRTEAKEGL

SEQ ID NO: 71519 - protein, 11 aa, Dengue virus
VDRTEAKEGLK

SEQ ID NO: 71520 - protein, 11 aa, Dengue virus
DRTEAKEGLKR

SEQ ID NO: 71521 - protein, 11 aa, Dengue virus
RTEAKEGLKRG

SEQ ID NO: 71522 - protein, 11 aa, Dengue virus
TEAKEGLKRGE

SEQ ID NO: 71523 - protein, 11 aa, Dengue virus
EAKEGLKRGEI

SEQ ID NO: 71524 - protein, 11 aa, Dengue virus
AKEGLKRGEIT

SEQ ID NO: 71525 - protein, 11 aa, Dengue virus
RGEITHHAVSR

SEQ ID NO: 71526 - protein, 11 aa, Dengue virus
GEITHHAVSRG

SEQ ID NO: 71527 - protein, 11 aa, Dengue virus
EITHHAVSRGS

SEQ ID NO: 71528 - protein, 11 aa, Dengue virus
ITHHAVSRGSA

SEQ ID NO: 71529 - protein, 11 aa, Dengue virus
THHAVSRGSAK

SEQ ID NO: 71530 - protein, 11 aa, Dengue virus
HHAVSRGSAKL

SEQ ID NO: 71531 - protein, 11 aa, Dengue virus
HAVSRGSAKLQ

SEQ ID NO: 71532 - protein, 11 aa, Dengue virus
AVSRGSAKLQW

SEQ ID NO: 71533 - protein, 11 aa, Dengue virus
VSRGSAKLQWF

SEQ ID NO: 71534 - protein, 11 aa, Dengue virus
SRGSAKLQWFV

SEQ ID NO: 71535 - protein, 11 aa, Dengue virus
RGSAKLQWFVE

SEQ ID NO: 71536 - protein, 11 aa, Dengue virus
GSAKLQWFVER

SEQ ID NO: 71537 - protein, 11 aa, Dengue virus
SAKLQWFVERN

SEQ ID NO: 71538 - protein, 11 aa, Dengue virus
AKLQWFVERNM

SEQ ID NO: 71539 - protein, 11 aa, Dengue virus
KLQWFVERNMV

SEQ ID NO: 71540 - protein, 11 aa, Dengue virus
LQWFVERNMVI

SEQ ID NO: 71541 - protein, 11 aa, Dengue virus
QWFVERNMVIP

SEQ ID NO: 71542 - protein, 11 aa, Dengue virus
WFVERNMVIPE

SEQ ID NO: 71543 - protein, 11 aa, Dengue virus
FVERNMVIPEG

SEQ ID NO: 71544 - protein, 11 aa, Dengue virus
VERNMVIPEGR

SEQ ID NO: 71545 - protein, 11 aa, Dengue virus
ERNMVIPEGRV

SEQ ID NO: 71546 - protein, 11 aa, Dengue virus
RNMVIPEGRVI

SEQ ID NO: 71547 - protein, 11 aa, Dengue virus
NMVIPEGRVID

SEQ ID NO: 71548 - protein, 11 aa, Dengue virus
MVIPEGRVIDL

SEQ ID NO: 71549 - protein, 11 aa, Dengue virus
VIPEGRVIDLG

SEQ ID NO: 71550 - protein, 11 aa, Dengue virus
IPEGRVIDLGC

SEQ ID NO: 71551 - protein, 11 aa, Dengue virus
PEGRVIDLGCG

SEQ ID NO: 71552 - protein, 11 aa, Dengue virus
EGRVIDLGCGR

SEQ ID NO: 71553 - protein, 11 aa, Dengue virus
GRVIDLGCGRG

SEQ ID NO: 71554 - protein, 11 aa, Dengue virus
RVIDLGCGRGG

SEQ ID NO: 71555 - protein, 11 aa, Dengue virus
VIDLGCGRGGW

SEQ ID NO: 71556 - protein, 11 aa, Dengue virus
IDLGCGRGGWS

SEQ ID NO: 71557 - protein, 11 aa, Dengue virus
DLGCGRGGWSY

SEQ ID NO: 71558 - protein, 11 aa, Dengue virus
LGCGRGGWSYY

SEQ ID NO: 71559 - protein, 11 aa, Dengue virus
GCGRGGWSYYC

SEQ ID NO: 71560 - protein, 11 aa, Dengue virus
CGRGGWSYYCA

SEQ ID NO: 71561 - protein, 11 aa, Dengue virus
GRGGWSYYCAG

SEQ ID NO: 71562 - protein, 11 aa, Dengue virus
RGGWSYYCAGL

SEQ ID NO: 71563 - protein, 11 aa, Dengue virus
GGWSYYCAGLK

SEQ ID NO: 71564 - protein, 11 aa, Dengue virus
GWSYYCAGLKK

SEQ ID NO: 71565 - protein, 11 aa, Dengue virus
WSYYCAGLKKV

SEQ ID NO: 71566 - protein, 11 aa, Dengue virus
SYYCAGLKKVT

SEQ ID NO: 71567 - protein, 11 aa, Dengue virus
YYCAGLKKVTE

SEQ ID NO: 71568 - protein, 11 aa, Dengue virus
YCAGLKKVTEV

SEQ ID NO: 71569 - protein, 11 aa, Dengue virus
CAGLKKVTEVR

SEQ ID NO: 71570 - protein, 11 aa, Dengue virus
AGLKKVTEVRG

SEQ ID NO: 71571 - protein, 11 aa, Dengue virus
GLKKVTEVRGY

SEQ ID NO: 71572 - protein, 11 aa, Dengue virus
LKKVTEVRGYT

SEQ ID NO: 71573 - protein, 11 aa, Dengue virus
KKVTEVRGYTK

SEQ ID NO: 71574 - protein, 11 aa, Dengue virus
KVTEVRGYTKG

SEQ ID NO: 71575 - protein, 11 aa, Dengue virus
VTEVRGYTKGG

SEQ ID NO: 71576 - protein, 11 aa, Dengue virus
TEVRGYTKGGP

SEQ ID NO: 71577 - protein, 11 aa, Dengue virus
EVRGYTKGGPG

SEQ ID NO: 71578 - protein, 11 aa, Dengue virus
VRGYTKGGPGH

SEQ ID NO: 71579 - protein, 11 aa, Dengue virus
RGYTKGGPGHE

SEQ ID NO: 71580 - protein, 11 aa, Dengue virus
GYTKGGPGHEE

SEQ ID NO: 71581 - protein, 11 aa, Dengue virus
YTKGGPGHEEP

SEQ ID NO: 71582 - protein, 11 aa, Dengue virus
TKGGPGHEEPV

SEQ ID NO: 71583 - protein, 11 aa, Dengue virus
KGGPGHEEPVP

SEQ ID NO: 71584 - protein, 11 aa, Dengue virus
GGPGHEEPVPM

SEQ ID NO: 71585 - protein, 11 aa, Dengue virus
GPGHEEPVPMS

SEQ ID NO: 71586 - protein, 11 aa, Dengue virus
PGHEEPVPMST

SEQ ID NO: 71587 - protein, 11 aa, Dengue virus
GHEEPVPMSTY

SEQ ID NO: 71588 - protein, 11 aa, Dengue virus
HEEPVPMSTYG

SEQ ID NO: 71589 - protein, 11 aa, Dengue virus
EEPVPMSTYGW

SEQ ID NO: 71590 - protein, 11 aa, Dengue virus
EPVPMSTYGWN

SEQ ID NO: 71591 - protein, 11 aa, Dengue virus
PVPMSTYGWNI

SEQ ID NO: 71592 - protein, 11 aa, Dengue virus
VPMSTYGWNIV

SEQ ID NO: 71593 - protein, 11 aa, Dengue virus
PMSTYGWNIVK

SEQ ID NO: 71594 - protein, 11 aa, Dengue virus
MSTYGWNIVKL

SEQ ID NO: 71595 - protein, 11 aa, Dengue virus
STYGWNIVKLM

SEQ ID NO: 71596 - protein, 11 aa, Dengue virus
TYGWNIVKLMS

SEQ ID NO: 71597 - protein, 11 aa, Dengue virus
YGWNIVKLMSG

SEQ ID NO: 71598 - protein, 11 aa, Dengue virus
GWNIVKLMSGK

SEQ ID NO: 71599 - protein, 11 aa, Dengue virus
WNIVKLMSGKD

SEQ ID NO: 71600 - protein, 11 aa, Dengue virus
NIVKLMSGKDV

SEQ ID NO: 71601 - protein, 11 aa, Dengue virus
IVKLMSGKDVF

SEQ ID NO: 71602 - protein, 11 aa, Dengue virus
VKLMSGKDVFY

SEQ ID NO: 71603 - protein, 11 aa, Dengue virus
KLMSGKDVFYL

SEQ ID NO: 71604 - protein, 11 aa, Dengue virus
LMSGKDVFYLP

SEQ ID NO: 71605 - protein, 11 aa, Dengue virus
MSGKDVFYLPP

SEQ ID NO: 71606 - protein, 11 aa, Dengue virus
SGKDVFYLPPE

SEQ ID NO: 71607 - protein, 11 aa, Dengue virus
GKDVFYLPPEK

SEQ ID NO: 71608 - protein, 11 aa, Dengue virus
KDVFYLPPEKC

SEQ ID NO: 71609 - protein, 11 aa, Dengue virus
DVFYLPPEKCD

SEQ ID NO: 71610 - protein, 11 aa, Dengue virus
VFYLPPEKCDT

SEQ ID NO: 71611 - protein, 11 aa, Dengue virus
FYLPPEKCDTL

SEQ ID NO: 71612 - protein, 11 aa, Dengue virus
YLPPEKCDTLL

SEQ ID NO: 71613 - protein, 11 aa, Dengue virus
LPPEKCDTLLC

SEQ ID NO: 71614 - protein, 11 aa, Dengue virus
PPEKCDTLLCD

SEQ ID NO: 71615 - protein, 11 aa, Dengue virus
PEKCDTLLCDI

SEQ ID NO: 71616 - protein, 11 aa, Dengue virus
EKCDTLLCDIG

SEQ ID NO: 71617 - protein, 11 aa, Dengue virus
KCDTLLCDIGE

SEQ ID NO: 71618 - protein, 11 aa, Dengue virus
CDTLLCDIGES

SEQ ID NO: 71619 - protein, 11 aa, Dengue virus
DTLLCDIGESS

SEQ ID NO: 71620 - protein, 11 aa, Dengue virus
TLLCDIGESSP

SEQ ID NO: 71621 - protein, 11 aa, Dengue virus
LLCDIGESSPS

SEQ ID NO: 71622 - protein, 11 aa, Dengue virus
LCDIGESSPSP

SEQ ID NO: 71623 - protein, 11 aa, Dengue virus
CDIGESSPSPT

SEQ ID NO: 71624 - protein, 11 aa, Dengue virus
DIGESSPSPTV

SEQ ID NO: 71625 - protein, 11 aa, Dengue virus
IGESSPSPTVE

SEQ ID NO: 71626 - protein, 11 aa, Dengue virus
GESSPSPTVEE

SEQ ID NO: 71627 - protein, 11 aa, Dengue virus
ESSPSPTVEES

SEQ ID NO: 71628 - protein, 11 aa, Dengue virus
SSPSPTVEESR

SEQ ID NO: 71629 - protein, 11 aa, Dengue virus
SPSPTVEESRT

SEQ ID NO: 71630 - protein, 11 aa, Dengue virus
PSPTVEESRTI

SEQ ID NO: 71631 - protein, 11 aa, Dengue virus
SPTVEESRTIR

SEQ ID NO: 71632 - protein, 11 aa, Dengue virus
PTVEESRTIRV

SEQ ID NO: 71633 - protein, 11 aa, Dengue virus
TVEESRTIRVL

SEQ ID NO: 71634 - protein, 11 aa, Dengue virus
VEESRTIRVLK

SEQ ID NO: 71635 - protein, 11 aa, Dengue virus
EESRTIRVLKM

SEQ ID NO: 71636 - protein, 11 aa, Dengue virus
ESRTIRVLKMV

SEQ ID NO: 71637 - protein, 11 aa, Dengue virus
SRTIRVLKMVE

SEQ ID NO: 71638 - protein, 11 aa, Dengue virus
RTIRVLKMVEP

SEQ ID NO: 71639 - protein, 11 aa, Dengue virus
TIRVLKMVEPW

SEQ ID NO: 71640 - protein, 11 aa, Dengue virus
IRVLKMVEPWL

SEQ ID NO: 71641 - protein, 11 aa, Dengue virus
RVLKMVEPWLK

SEQ ID NO: 71642 - protein, 11 aa, Dengue virus
VLKMVEPWLKN

SEQ ID NO: 71643 - protein, 11 aa, Dengue virus
LKMVEPWLKNN

SEQ ID NO: 71644 - protein, 11 aa, Dengue virus
KMVEPWLKNNQ

SEQ ID NO: 71645 - protein, 11 aa, Dengue virus
MVEPWLKNNQF

SEQ ID NO: 71646 - protein, 11 aa, Dengue virus
VEPWLKNNQFC

SEQ ID NO: 71647 - protein, 11 aa, Dengue virus
EPWLKNNQFCI

SEQ ID NO: 71648 - protein, 11 aa, Dengue virus
PWLKNNQFCIK

SEQ ID NO: 71649 - protein, 11 aa, Dengue virus
WLKNNQFCIKV

SEQ ID NO: 71650 - protein, 11 aa, Dengue virus
LKNNQFCIKVL

SEQ ID NO: 71651 - protein, 11 aa, Dengue virus
KNNQFCIKVLN

SEQ ID NO: 71652 - protein, 11 aa, Dengue virus
NNQFCIKVLNP

SEQ ID NO: 71653 - protein, 11 aa, Dengue virus
NQFCIKVLNPY

SEQ ID NO: 71654 - protein, 11 aa, Dengue virus
QFCIKVLNPYM

SEQ ID NO: 71655 - protein, 11 aa, Dengue virus
FCIKVLNPYMP

SEQ ID NO: 71656 - protein, 11 aa, Dengue virus
CIKVLNPYMPT

SEQ ID NO: 71657 - protein, 11 aa, Dengue virus
IKVLNPYMPTV

SEQ ID NO: 71658 - protein, 11 aa, Dengue virus
KVLNPYMPTVI

SEQ ID NO: 71659 - protein, 11 aa, Dengue virus
VLNPYMPTVIE

SEQ ID NO: 71660 - protein, 11 aa, Dengue virus
LNPYMPTVIEH

SEQ ID NO: 71661 - protein, 11 aa, Dengue virus
NPYMPTVIEHL

SEQ ID NO: 71662 - protein, 11 aa, Dengue virus
PYMPTVIEHLE

SEQ ID NO: 71663 - protein, 11 aa, Dengue virus
YMPTVIEHLER

SEQ ID NO: 71664 - protein, 11 aa, Dengue virus
MPTVIEHLERL

SEQ ID NO: 71665 - protein, 11 aa, Dengue virus
PTVIEHLERLQ

SEQ ID NO: 71666 - protein, 11 aa, Dengue virus
TVIEHLERLQR

SEQ ID NO: 71667 - protein, 11 aa, Dengue virus
VIEHLERLQRK

SEQ ID NO: 71668 - protein, 11 aa, Dengue virus
IEHLERLQRKH

SEQ ID NO: 71669 - protein, 11 aa, Dengue virus
EHLERLQRKHG

SEQ ID NO: 71670 - protein, 11 aa, Dengue virus
HLERLQRKHGG

SEQ ID NO: 71671 - protein, 11 aa, Dengue virus
LERLQRKHGGM

SEQ ID NO: 71672 - protein, 11 aa, Dengue virus
ERLQRKHGGML

SEQ ID NO: 71673 - protein, 11 aa, Dengue virus
RLQRKHGGMLV

SEQ ID NO: 71674 - protein, 11 aa, Dengue virus
LQRKHGGMLVR

SEQ ID NO: 71675 - protein, 11 aa, Dengue virus
QRKHGGMLVRN

SEQ ID NO: 71676 - protein, 11 aa, Dengue virus
RKHGGMLVRNP

SEQ ID NO: 71677 - protein, 11 aa, Dengue virus
KHGGMLVRNPL

SEQ ID NO: 71678 - protein, 11 aa, Dengue virus
HGGMLVRNPLS

SEQ ID NO: 71679 - protein, 11 aa, Dengue virus
GGMLVRNPLSR

SEQ ID NO: 71680 - protein, 11 aa, Dengue virus
GMLVRNPLSRN

SEQ ID NO: 71681 - protein, 11 aa, Dengue virus
MLVRNPLSRNS

SEQ ID NO: 71682 - protein, 11 aa, Dengue virus
LVRNPLSRNST

SEQ ID NO: 71683 - protein, 11 aa, Dengue virus
VRNPLSRNSTH

SEQ ID NO: 71684 - protein, 11 aa, Dengue virus
RNPLSRNSTHE

SEQ ID NO: 71685 - protein, 11 aa, Dengue virus
NPLSRNSTHEM

SEQ ID NO: 71686 - protein, 11 aa, Dengue virus
PLSRNSTHEMY

SEQ ID NO: 71687 - protein, 11 aa, Dengue virus
LSRNSTHEMYW

SEQ ID NO: 71688 - protein, 11 aa, Dengue virus
SRNSTHEMYWI

SEQ ID NO: 71689 - protein, 11 aa, Dengue virus
RNSTHEMYWIS

SEQ ID NO: 71690 - protein, 11 aa, Dengue virus
NSTHEMYWISN

SEQ ID NO: 71691 - protein, 11 aa, Dengue virus
STHEMYWISNG

SEQ ID NO: 71692 - protein, 11 aa, Dengue virus
THEMYWISNGT

SEQ ID NO: 71693 - protein, 11 aa, Dengue virus
HEMYWISNGTG

SEQ ID NO: 71694 - protein, 11 aa, Dengue virus
EMYWISNGTGN

SEQ ID NO: 71695 - protein, 11 aa, Dengue virus
MYWISNGTGNI

SEQ ID NO: 71696 - protein, 11 aa, Dengue virus
YWISNGTGNIV

SEQ ID NO: 71697 - protein, 11 aa, Dengue virus
WISNGTGNIVA

SEQ ID NO: 71698 - protein, 11 aa, Dengue virus
ISNGTGNIVAS

SEQ ID NO: 71699 - protein, 11 aa, Dengue virus
SNGTGNIVASV

SEQ ID NO: 71700 - protein, 11 aa, Dengue virus
NGTGNIVASVN

SEQ ID NO: 71701 - protein, 11 aa, Dengue virus
GTGNIVASVNM

SEQ ID NO: 71702 - protein, 11 aa, Dengue virus
TGNIVASVNMV

SEQ ID NO: 71703 - protein, 11 aa, Dengue virus
GNIVASVNMVS

SEQ ID NO: 71704 - protein, 11 aa, Dengue virus
NIVASVNMVSR

SEQ ID NO: 71705 - protein, 11 aa, Dengue virus
IVASVNMVSRL

SEQ ID NO: 71706 - protein, 11 aa, Dengue virus
VASVNMVSRLL

SEQ ID NO: 71707 - protein, 11 aa, Dengue virus
ASVNMVSRLLL

SEQ ID NO: 71708 - protein, 11 aa, Dengue virus
SVNMVSRLLLN

SEQ ID NO: 71709 - protein, 11 aa, Dengue virus
VNMVSRLLLNR

SEQ ID NO: 71710 - protein, 11 aa, Dengue virus
NMVSRLLLNRF

SEQ ID NO: 71711 - protein, 11 aa, Dengue virus
MVSRLLLNRFT

SEQ ID NO: 71712 - protein, 11 aa, Dengue virus
VSRLLLNRFTM

SEQ ID NO: 71713 - protein, 11 aa, Dengue virus
SRLLLNRFTMT

SEQ ID NO: 71714 - protein, 11 aa, Dengue virus
RLLLNRFTMTH

SEQ ID NO: 71715 - protein, 11 aa, Dengue virus
LLLNRFTMTHR

SEQ ID NO: 71716 - protein, 11 aa, Dengue virus
LLNRFTMTHRR

SEQ ID NO: 71717 - protein, 11 aa, Dengue virus
LNRFTMTHRRP

SEQ ID NO: 71718 - protein, 11 aa, Dengue virus
NRFTMTHRRPT

SEQ ID NO: 71719 - protein, 11 aa, Dengue virus
RFTMTHRRPTI

SEQ ID NO: 71720 - protein, 11 aa, Dengue virus
FTMTHRRPTIE

SEQ ID NO: 71721 - protein, 11 aa, Dengue virus
TMTHRRPTIEK

SEQ ID NO: 71722 - protein, 11 aa, Dengue virus
MTHRRPTIEKD

SEQ ID NO: 71723 - protein, 11 aa, Dengue virus
THRRPTIEKDV

SEQ ID NO: 71724 - protein, 11 aa, Dengue virus
HRRPTIEKDVD

SEQ ID NO: 71725 - protein, 11 aa, Dengue virus
RRPTIEKDVDL

SEQ ID NO: 71726 - protein, 11 aa, Dengue virus
RPTIEKDVDLG

SEQ ID NO: 71727 - protein, 11 aa, Dengue virus
PTIEKDVDLGA

SEQ ID NO: 71728 - protein, 11 aa, Dengue virus
TIEKDVDLGAG

SEQ ID NO: 71729 - protein, 11 aa, Dengue virus
IEKDVDLGAGT

SEQ ID NO: 71730 - protein, 11 aa, Dengue virus
EKDVDLGAGTR

SEQ ID NO: 71731 - protein, 11 aa, Dengue virus
KDVDLGAGTRH

SEQ ID NO: 71732 - protein, 11 aa, Dengue virus
DVDLGAGTRHV

SEQ ID NO: 71733 - protein, 11 aa, Dengue virus
VDLGAGTRHVN

SEQ ID NO: 71734 - protein, 11 aa, Dengue virus
DLGAGTRHVNA

SEQ ID NO: 71735 - protein, 11 aa, Dengue virus
LGAGTRHVNAE

SEQ ID NO: 71736 - protein, 11 aa, Dengue virus
GAGTRHVNAEP

SEQ ID NO: 71737 - protein, 11 aa, Dengue virus
AGTRHVNAEPE

SEQ ID NO: 71738 - protein, 11 aa, Dengue virus
GTRHVNAEPET

SEQ ID NO: 71739 - protein, 11 aa, Dengue virus
TRHVNAEPETP

SEQ ID NO: 71740 - protein, 11 aa, Dengue virus
RHVNAEPETPN

SEQ ID NO: 71741 - protein, 11 aa, Dengue virus
HVNAEPETPNM

SEQ ID NO: 71742 - protein, 11 aa, Dengue virus
VNAEPETPNMD

SEQ ID NO: 71743 - protein, 11 aa, Dengue virus
NAEPETPNMDV

SEQ ID NO: 71744 - protein, 11 aa, Dengue virus
AEPETPNMDVI

SEQ ID NO: 71745 - protein, 11 aa, Dengue virus
EPETPNMDVIG

SEQ ID NO: 71746 - protein, 11 aa, Dengue virus
PETPNMDVIGE

SEQ ID NO: 71747 - protein, 11 aa, Dengue virus
ETPNMDVIGER

SEQ ID NO: 71748 - protein, 11 aa, Dengue virus
TPNMDVIGERI

SEQ ID NO: 71749 - protein, 11 aa, Dengue virus
PNMDVIGERIK

SEQ ID NO: 71750 - protein, 11 aa, Dengue virus
NMDVIGERIKR

SEQ ID NO: 71751 - protein, 11 aa, Dengue virus
MDVIGERIKRI

SEQ ID NO: 71752 - protein, 11 aa, Dengue virus
DVIGERIKRIK

SEQ ID NO: 71753 - protein, 11 aa, Dengue virus
VIGERIKRIKE

SEQ ID NO: 71754 - protein, 11 aa, Dengue virus
IGERIKRIKEE

SEQ ID NO: 71755 - protein, 11 aa, Dengue virus
GERIKRIKEEH

SEQ ID NO: 71756 - protein, 11 aa, Dengue virus
RIKEEHNSTWH

SEQ ID NO: 71757 - protein, 11 aa, Dengue virus
IKEEHNSTWHY

SEQ ID NO: 71758 - protein, 11 aa, Dengue virus
KEEHNSTWHYD

SEQ ID NO: 71759 - protein, 11 aa, Dengue virus
EEHNSTWHYDD

SEQ ID NO: 71760 - protein, 11 aa, Dengue virus
EHNSTWHYDDE

SEQ ID NO: 71761 - protein, 11 aa, Dengue virus
HNSTWHYDDEN

SEQ ID NO: 71762 - protein, 11 aa, Dengue virus
NSTWHYDDENP

SEQ ID NO: 71763 - protein, 11 aa, Dengue virus
STWHYDDENPY

SEQ ID NO: 71764 - protein, 11 aa, Dengue virus
TWHYDDENPYK

SEQ ID NO: 71765 - protein, 11 aa, Dengue virus
WHYDDENPYKT

SEQ ID NO: 71766 - protein, 11 aa, Dengue virus
HYDDENPYKTW

SEQ ID NO: 71767 - protein, 11 aa, Dengue virus
YDDENPYKTWA

SEQ ID NO: 71768 - protein, 11 aa, Dengue virus
DDENPYKTWAY

SEQ ID NO: 71769 - protein, 11 aa, Dengue virus
DENPYKTWAYH

SEQ ID NO: 71770 - protein, 11 aa, Dengue virus
ENPYKTWAYHG

SEQ ID NO: 71771 - protein, 11 aa, Dengue virus
NPYKTWAYHGS

SEQ ID NO: 71772 - protein, 11 aa, Dengue virus
PYKTWAYHGSY

SEQ ID NO: 71773 - protein, 11 aa, Dengue virus
YKTWAYHGSYE

SEQ ID NO: 71774 - protein, 11 aa, Dengue virus
KTWAYHGSYEV

SEQ ID NO: 71775 - protein, 11 aa, Dengue virus
TWAYHGSYEVK

SEQ ID NO: 71776 - protein, 11 aa, Dengue virus
WAYHGSYEVKA

SEQ ID NO: 71777 - protein, 11 aa, Dengue virus
AYHGSYEVKAT

SEQ ID NO: 71778 - protein, 11 aa, Dengue virus
YHGSYEVKATG

SEQ ID NO: 71779 - protein, 11 aa, Dengue virus
HGSYEVKATGS

SEQ ID NO: 71780 - protein, 11 aa, Dengue virus
GSYEVKATGSA

SEQ ID NO: 71781 - protein, 11 aa, Dengue virus
SYEVKATGSAS

SEQ ID NO: 71782 - protein, 11 aa, Dengue virus
YEVKATGSASS

SEQ ID NO: 71783 - protein, 11 aa, Dengue virus
EVKATGSASSM

SEQ ID NO: 71784 - protein, 11 aa, Dengue virus
VKATGSASSMI

SEQ ID NO: 71785 - protein, 11 aa, Dengue virus
KATGSASSMIN

SEQ ID NO: 71786 - protein, 11 aa, Dengue virus
ATGSASSMING

SEQ ID NO: 71787 - protein, 11 aa, Dengue virus
TGSASSMINGV

SEQ ID NO: 71788 - protein, 11 aa, Dengue virus
GSASSMINGVV

SEQ ID NO: 71789 - protein, 11 aa, Dengue virus
SASSMINGVVK

SEQ ID NO: 71790 - protein, 11 aa, Dengue virus
ASSMINGVVKL

SEQ ID NO: 71791 - protein, 11 aa, Dengue virus
SSMINGVVKLL

SEQ ID NO: 71792 - protein, 11 aa, Dengue virus
SMINGVVKLLT

SEQ ID NO: 71793 - protein, 11 aa, Dengue virus
MINGVVKLLTK

SEQ ID NO: 71794 - protein, 11 aa, Dengue virus
INGVVKLLTKP

SEQ ID NO: 71795 - protein, 11 aa, Dengue virus
NGVVKLLTKPW

SEQ ID NO: 71796 - protein, 11 aa, Dengue virus
GVVKLLTKPWD

SEQ ID NO: 71797 - protein, 11 aa, Dengue virus
VVKLLTKPWDV

SEQ ID NO: 71798 - protein, 11 aa, Dengue virus
VKLLTKPWDVV

SEQ ID NO: 71799 - protein, 11 aa, Dengue virus
KLLTKPWDVVP

SEQ ID NO: 71800 - protein, 11 aa, Dengue virus
LLTKPWDVVPM

SEQ ID NO: 71801 - protein, 11 aa, Dengue virus
LTKPWDVVPMV

SEQ ID NO: 71802 - protein, 11 aa, Dengue virus
TKPWDVVPMVT

SEQ ID NO: 71803 - protein, 11 aa, Dengue virus
KPWDVVPMVTQ

SEQ ID NO: 71804 - protein, 11 aa, Dengue virus
PWDVVPMVTQM

SEQ ID NO: 71805 - protein, 11 aa, Dengue virus
WDVVPMVTQMA

SEQ ID NO: 71806 - protein, 11 aa, Dengue virus
DVVPMVTQMAM

SEQ ID NO: 71807 - protein, 11 aa, Dengue virus
VVPMVTQMAMT

SEQ ID NO: 71808 - protein, 11 aa, Dengue virus
VPMVTQMAMTD

SEQ ID NO: 71809 - protein, 11 aa, Dengue virus
PMVTQMAMTDT

SEQ ID NO: 71810 - protein, 11 aa, Dengue virus
MVTQMAMTDTT

SEQ ID NO: 71811 - protein, 11 aa, Dengue virus
VTQMAMTDTTP

SEQ ID NO: 71812 - protein, 11 aa, Dengue virus
TQMAMTDTTPF

SEQ ID NO: 71813 - protein, 11 aa, Dengue virus
QMAMTDTTPFG

SEQ ID NO: 71814 - protein, 11 aa, Dengue virus
MAMTDTTPFGQ

SEQ ID NO: 71815 - protein, 11 aa, Dengue virus
AMTDTTPFGQQ

SEQ ID NO: 71816 - protein, 11 aa, Dengue virus
MTDTTPFGQQR

SEQ ID NO: 71817 - protein, 11 aa, Dengue virus
TDTTPFGQQRV

SEQ ID NO: 71818 - protein, 11 aa, Dengue virus
DTTPFGQQRVF

SEQ ID NO: 71819 - protein, 11 aa, Dengue virus
TTPFGQQRVFK

SEQ ID NO: 71820 - protein, 11 aa, Dengue virus
TPFGQQRVFKE

SEQ ID NO: 71821 - protein, 11 aa, Dengue virus
PFGQQRVFKEK

SEQ ID NO: 71822 - protein, 11 aa, Dengue virus
FGQQRVFKEKV

SEQ ID NO: 71823 - protein, 11 aa, Dengue virus
GQQRVFKEKVD

SEQ ID NO: 71824 - protein, 11 aa, Dengue virus
QQRVFKEKVDT

SEQ ID NO: 71825 - protein, 11 aa, Dengue virus
QRVFKEKVDTR

SEQ ID NO: 71826 - protein, 11 aa, Dengue virus
RVFKEKVDTRT

SEQ ID NO: 71827 - protein, 11 aa, Dengue virus
VFKEKVDTRTP

SEQ ID NO: 71828 - protein, 11 aa, Dengue virus
FKEKVDTRTPR

SEQ ID NO: 71829 - protein, 11 aa, Dengue virus
KEKVDTRTPRS

SEQ ID NO: 71830 - protein, 11 aa, Dengue virus
EKVDTRTPRSM

SEQ ID NO: 71831 - protein, 11 aa, Dengue virus
KVDTRTPRSMP

SEQ ID NO: 71832 - protein, 11 aa, Dengue virus
VDTRTPRSMPG

SEQ ID NO: 71833 - protein, 11 aa, Dengue virus
DTRTPRSMPGT

SEQ ID NO: 71834 - protein, 11 aa, Dengue virus
TRTPRSMPGTR

SEQ ID NO: 71835 - protein, 11 aa, Dengue virus
VMEITAEWLWR

SEQ ID NO: 71836 - protein, 11 aa, Dengue virus
MEITAEWLWRT

SEQ ID NO: 71837 - protein, 11 aa, Dengue virus
EITAEWLWRTL

SEQ ID NO: 71838 - protein, 11 aa, Dengue virus
ITAEWLWRTLG

SEQ ID NO: 71839 - protein, 11 aa, Dengue virus
TAEWLWRTLGR

SEQ ID NO: 71840 - protein, 11 aa, Dengue virus
AEWLWRTLGRN

SEQ ID NO: 71841 - protein, 11 aa, Dengue virus
EWLWRTLGRNK

SEQ ID NO: 71842 - protein, 11 aa, Dengue virus
WLWRTLGRNKK

SEQ ID NO: 71843 - protein, 11 aa, Dengue virus
LWRTLGRNKKP

SEQ ID NO: 71844 - protein, 11 aa, Dengue virus
WRTLGRNKKPR

SEQ ID NO: 71845 - protein, 11 aa, Dengue virus
RTLGRNKKPRL

SEQ ID NO: 71846 - protein, 11 aa, Dengue virus
TLGRNKKPRLC

SEQ ID NO: 71847 - protein, 11 aa, Dengue virus
LGRNKKPRLCT

SEQ ID NO: 71848 - protein, 11 aa, Dengue virus
GRNKKPRLCTR

SEQ ID NO: 71849 - protein, 11 aa, Dengue virus
RNKKPRLCTRE

SEQ ID NO: 71850 - protein, 11 aa, Dengue virus
NKKPRLCTREE

SEQ ID NO: 71851 - protein, 11 aa, Dengue virus
KKPRLCTREEF

SEQ ID NO: 71852 - protein, 11 aa, Dengue virus
KPRLCTREEFT

SEQ ID NO: 71853 - protein, 11 aa, Dengue virus
PRLCTREEFTK

SEQ ID NO: 71854 - protein, 11 aa, Dengue virus
RLCTREEFTKK

SEQ ID NO: 71855 - protein, 11 aa, Dengue virus
LCTREEFTKKV

SEQ ID NO: 71856 - protein, 11 aa, Dengue virus
CTREEFTKKVR

SEQ ID NO: 71857 - protein, 11 aa, Dengue virus
TREEFTKKVRT

SEQ ID NO: 71858 - protein, 11 aa, Dengue virus
REEFTKKVRTN

SEQ ID NO: 71859 - protein, 11 aa, Dengue virus
EEFTKKVRTNA

SEQ ID NO: 71860 - protein, 11 aa, Dengue virus
EFTKKVRTNAA

SEQ ID NO: 71861 - protein, 11 aa, Dengue virus
FTKKVRTNAAM

SEQ ID NO: 71862 - protein, 11 aa, Dengue virus
TKKVRTNAAMG

SEQ ID NO: 71863 - protein, 11 aa, Dengue virus
KKVRTNAAMGA

SEQ ID NO: 71864 - protein, 11 aa, Dengue virus
KVRTNAAMGAV

SEQ ID NO: 71865 - protein, 11 aa, Dengue virus
VRTNAAMGAVF

SEQ ID NO: 71866 - protein, 11 aa, Dengue virus
RTNAAMGAVFT

SEQ ID NO: 71867 - protein, 11 aa, Dengue virus
TNAAMGAVFTE

SEQ ID NO: 71868 - protein, 11 aa, Dengue virus
NAAMGAVFTEE

SEQ ID NO: 71869 - protein, 11 aa, Dengue virus
AAMGAVFTEEN

SEQ ID NO: 71870 - protein, 11 aa, Dengue virus
AMGAVFTEENQ

SEQ ID NO: 71871 - protein, 11 aa, Dengue virus
MGAVFTEENQW

SEQ ID NO: 71872 - protein, 11 aa, Dengue virus
GAVFTEENQWD

SEQ ID NO: 71873 - protein, 11 aa, Dengue virus
AVFTEENQWDS

SEQ ID NO: 71874 - protein, 11 aa, Dengue virus
VFTEENQWDSA

SEQ ID NO: 71875 - protein, 11 aa, Dengue virus
FTEENQWDSAK

SEQ ID NO: 71876 - protein, 11 aa, Dengue virus
TEENQWDSAKA

SEQ ID NO: 71877 - protein, 11 aa, Dengue virus
EENQWDSAKAA

SEQ ID NO: 71878 - protein, 11 aa, Dengue virus
ENQWDSAKAAV

SEQ ID NO: 71879 - protein, 11 aa, Dengue virus
NQWDSAKAAVE

SEQ ID NO: 71880 - protein, 11 aa, Dengue virus
QWDSAKAAVED

SEQ ID NO: 71881 - protein, 11 aa, Dengue virus
WDSAKAAVEDE

SEQ ID NO: 71882 - protein, 11 aa, Dengue virus
DSAKAAVEDED

SEQ ID NO: 71883 - protein, 11 aa, Dengue virus
SAKAAVEDEDF

SEQ ID NO: 71884 - protein, 11 aa, Dengue virus
AKAAVEDEDFW

SEQ ID NO: 71885 - protein, 11 aa, Dengue virus
KAAVEDEDFWK

SEQ ID NO: 71886 - protein, 11 aa, Dengue virus
AAVEDEDFWKL

SEQ ID NO: 71887 - protein, 11 aa, Dengue virus
AVEDEDFWKLV

SEQ ID NO: 71888 - protein, 11 aa, Dengue virus
VEDEDFWKLVD

SEQ ID NO: 71889 - protein, 11 aa, Dengue virus
EDEDFWKLVDR

SEQ ID NO: 71890 - protein, 11 aa, Dengue virus
DEDFWKLVDRE

SEQ ID NO: 71891 - protein, 11 aa, Dengue virus
EDFWKLVDRER

SEQ ID NO: 71892 - protein, 11 aa, Dengue virus
FWKLVDREREL

SEQ ID NO: 71893 - protein, 11 aa, Dengue virus
WKLVDRERELH

SEQ ID NO: 71894 - protein, 11 aa, Dengue virus
KLVDRERELHK

SEQ ID NO: 71895 - protein, 11 aa, Dengue virus
LVDRERELHKL

SEQ ID NO: 71896 - protein, 11 aa, Dengue virus
VDRERELHKLG

SEQ ID NO: 71897 - protein, 11 aa, Dengue virus
DRERELHKLGK

SEQ ID NO: 71898 - protein, 11 aa, Dengue virus
RERELHKLGKC

SEQ ID NO: 71899 - protein, 11 aa, Dengue virus
ERELHKLGKCG

SEQ ID NO: 71900 - protein, 11 aa, Dengue virus
RELHKLGKCGS

SEQ ID NO: 71901 - protein, 11 aa, Dengue virus
ELHKLGKCGSC

SEQ ID NO: 71902 - protein, 11 aa, Dengue virus
LHKLGKCGSCV

SEQ ID NO: 71903 - protein, 11 aa, Dengue virus
HKLGKCGSCVY

SEQ ID NO: 71904 - protein, 11 aa, Dengue virus
KLGKCGSCVYN

SEQ ID NO: 71905 - protein, 11 aa, Dengue virus
LGKCGSCVYNM

SEQ ID NO: 71906 - protein, 11 aa, Dengue virus
GKCGSCVYNMM

SEQ ID NO: 71907 - protein, 11 aa, Dengue virus
KCGSCVYNMMG

SEQ ID NO: 71908 - protein, 11 aa, Dengue virus
CGSCVYNMMGK

SEQ ID NO: 71909 - protein, 11 aa, Dengue virus
GSCVYNMMGKR

SEQ ID NO: 71910 - protein, 11 aa, Dengue virus
SCVYNMMGKRE

SEQ ID NO: 71911 - protein, 11 aa, Dengue virus
CVYNMMGKREK

SEQ ID NO: 71912 - protein, 11 aa, Dengue virus
VYNMMGKREKK

SEQ ID NO: 71913 - protein, 11 aa, Dengue virus
YNMMGKREKKL

SEQ ID NO: 71914 - protein, 11 aa, Dengue virus
NMMGKREKKLG

SEQ ID NO: 71915 - protein, 11 aa, Dengue virus
MMGKREKKLGE

SEQ ID NO: 71916 - protein, 11 aa, Dengue virus
MGKREKKLGEF

SEQ ID NO: 71917 - protein, 11 aa, Dengue virus
GKREKKLGEFG

SEQ ID NO: 71918 - protein, 11 aa, Dengue virus
KREKKLGEFGK

SEQ ID NO: 71919 - protein, 11 aa, Dengue virus
REKKLGEFGKA

SEQ ID NO: 71920 - protein, 11 aa, Dengue virus
EKKLGEFGKAK

SEQ ID NO: 71921 - protein, 11 aa, Dengue virus
KKLGEFGKAKG

SEQ ID NO: 71922 - protein, 11 aa, Dengue virus
KLGEFGKAKGS

SEQ ID NO: 71923 - protein, 11 aa, Dengue virus
LGEFGKAKGSR

SEQ ID NO: 71924 - protein, 11 aa, Dengue virus
GEFGKAKGSRA

SEQ ID NO: 71925 - protein, 11 aa, Dengue virus
EFGKAKGSRAI

SEQ ID NO: 71926 - protein, 11 aa, Dengue virus
FGKAKGSRAIW

SEQ ID NO: 71927 - protein, 11 aa, Dengue virus
GKAKGSRAIWY

SEQ ID NO: 71928 - protein, 11 aa, Dengue virus
KAKGSRAIWYM

SEQ ID NO: 71929 - protein, 11 aa, Dengue virus
AKGSRAIWYMW

SEQ ID NO: 71930 - protein, 11 aa, Dengue virus
KGSRAIWYMWL

SEQ ID NO: 71931 - protein, 11 aa, Dengue virus
GSRAIWYMWLG

SEQ ID NO: 71932 - protein, 11 aa, Dengue virus
SRAIWYMWLGA

SEQ ID NO: 71933 - protein, 11 aa, Dengue virus
RAIWYMWLGAR

SEQ ID NO: 71934 - protein, 11 aa, Dengue virus
AIWYMWLGARY

SEQ ID NO: 71935 - protein, 11 aa, Dengue virus
IWYMWLGARYL

SEQ ID NO: 71936 - protein, 11 aa, Dengue virus
WYMWLGARYLE

SEQ ID NO: 71937 - protein, 11 aa, Dengue virus
YMWLGARYLEF

SEQ ID NO: 71938 - protein, 11 aa, Dengue virus
MWLGARYLEFE

SEQ ID NO: 71939 - protein, 11 aa, Dengue virus
WLGARYLEFEA

SEQ ID NO: 71940 - protein, 11 aa, Dengue virus
LGARYLEFEAL

SEQ ID NO: 71941 - protein, 11 aa, Dengue virus
GARYLEFEALG

SEQ ID NO: 71942 - protein, 11 aa, Dengue virus
ARYLEFEALGF

SEQ ID NO: 71943 - protein, 11 aa, Dengue virus
RYLEFEALGFL

SEQ ID NO: 71944 - protein, 11 aa, Dengue virus
YLEFEALGFLN

SEQ ID NO: 71945 - protein, 11 aa, Dengue virus
LEFEALGFLNE

SEQ ID NO: 71946 - protein, 11 aa, Dengue virus
EFEALGFLNED

SEQ ID NO: 71947 - protein, 11 aa, Dengue virus
FEALGFLNEDH

SEQ ID NO: 71948 - protein, 11 aa, Dengue virus
EALGFLNEDHW

SEQ ID NO: 71949 - protein, 11 aa, Dengue virus
ALGFLNEDHWF

SEQ ID NO: 71950 - protein, 11 aa, Dengue virus
LGFLNEDHWFS

SEQ ID NO: 71951 - protein, 11 aa, Dengue virus
GFLNEDHWFSR

SEQ ID NO: 71952 - protein, 11 aa, Dengue virus
FLNEDHWFSRE

SEQ ID NO: 71953 - protein, 11 aa, Dengue virus
LNEDHWFSREN

SEQ ID NO: 71954 - protein, 11 aa, Dengue virus
NEDHWFSRENS

SEQ ID NO: 71955 - protein, 11 aa, Dengue virus
EDHWFSRENSY

SEQ ID NO: 71956 - protein, 11 aa, Dengue virus
DHWFSRENSYS

SEQ ID NO: 71957 - protein, 11 aa, Dengue virus
HWFSRENSYSG

SEQ ID NO: 71958 - protein, 11 aa, Dengue virus
WFSRENSYSGV

SEQ ID NO: 71959 - protein, 11 aa, Dengue virus
FSRENSYSGVE

SEQ ID NO: 71960 - protein, 11 aa, Dengue virus
SRENSYSGVEG

SEQ ID NO: 71961 - protein, 11 aa, Dengue virus
RENSYSGVEGE

SEQ ID NO: 71962 - protein, 11 aa, Dengue virus
ENSYSGVEGEG

SEQ ID NO: 71963 - protein, 11 aa, Dengue virus
NSYSGVEGEGL

SEQ ID NO: 71964 - protein, 11 aa, Dengue virus
SYSGVEGEGLH

SEQ ID NO: 71965 - protein, 11 aa, Dengue virus
YSGVEGEGLHK

SEQ ID NO: 71966 - protein, 11 aa, Dengue virus
SGVEGEGLHKL

SEQ ID NO: 71967 - protein, 11 aa, Dengue virus
GVEGEGLHKLG

SEQ ID NO: 71968 - protein, 11 aa, Dengue virus
VEGEGLHKLGY

SEQ ID NO: 71969 - protein, 11 aa, Dengue virus
EGEGLHKLGYI

SEQ ID NO: 71970 - protein, 11 aa, Dengue virus
GEGLHKLGYIL

SEQ ID NO: 71971 - protein, 11 aa, Dengue virus
EGLHKLGYILR

SEQ ID NO: 71972 - protein, 11 aa, Dengue virus
GLHKLGYILRD

SEQ ID NO: 71973 - protein, 11 aa, Dengue virus
LHKLGYILRDI

SEQ ID NO: 71974 - protein, 11 aa, Dengue virus
HKLGYILRDIS

SEQ ID NO: 71975 - protein, 11 aa, Dengue virus
KLGYILRDISK

SEQ ID NO: 71976 - protein, 11 aa, Dengue virus
LGYILRDISKI

SEQ ID NO: 71977 - protein, 11 aa, Dengue virus
GYILRDISKIP

SEQ ID NO: 71978 - protein, 11 aa, Dengue virus
YILRDISKIPG

SEQ ID NO: 71979 - protein, 11 aa, Dengue virus
ILRDISKIPGG

SEQ ID NO: 71980 - protein, 11 aa, Dengue virus
LRDISKIPGGA

SEQ ID NO: 71981 - protein, 11 aa, Dengue virus
RDISKIPGGAM

SEQ ID NO: 71982 - protein, 11 aa, Dengue virus
DISKIPGGAMY

SEQ ID NO: 71983 - protein, 11 aa, Dengue virus
ISKIPGGAMYA

SEQ ID NO: 71984 - protein, 11 aa, Dengue virus
SKIPGGAMYAD

SEQ ID NO: 71985 - protein, 11 aa, Dengue virus
KIPGGAMYADD

SEQ ID NO: 71986 - protein, 11 aa, Dengue virus
IPGGAMYADDT

SEQ ID NO: 71987 - protein, 11 aa, Dengue virus
PGGAMYADDTA

SEQ ID NO: 71988 - protein, 11 aa, Dengue virus
GGAMYADDTAG

SEQ ID NO: 71989 - protein, 11 aa, Dengue virus
GAMYADDTAGW

SEQ ID NO: 71990 - protein, 11 aa, Dengue virus
AMYADDTAGWD

SEQ ID NO: 71991 - protein, 11 aa, Dengue virus
MYADDTAGWDT

SEQ ID NO: 71992 - protein, 11 aa, Dengue virus
YADDTAGWDTR

SEQ ID NO: 71993 - protein, 11 aa, Dengue virus
ADDTAGWDTRI

SEQ ID NO: 71994 - protein, 11 aa, Dengue virus
DDTAGWDTRIT

SEQ ID NO: 71995 - protein, 11 aa, Dengue virus
DTAGWDTRITE

SEQ ID NO: 71996 - protein, 11 aa, Dengue virus
TAGWDTRITED

SEQ ID NO: 71997 - protein, 11 aa, Dengue virus
AGWDTRITEDD

SEQ ID NO: 71998 - protein, 11 aa, Dengue virus
GWDTRITEDDL

SEQ ID NO: 71999 - protein, 11 aa, Dengue virus
WDTRITEDDLH

SEQ ID NO: 72000 - protein, 11 aa, Dengue virus
DTRITEDDLHN

SEQ ID NO: 72001 - protein, 11 aa, Dengue virus
TRITEDDLHNE

SEQ ID NO: 72002 - protein, 11 aa, Dengue virus
RITEDDLHNEE

SEQ ID NO: 72003 - protein, 11 aa, Dengue virus
ITEDDLHNEEK

SEQ ID NO: 72004 - protein, 11 aa, Dengue virus
TEDDLHNEEKI

SEQ ID NO: 72005 - protein, 11 aa, Dengue virus
EDDLHNEEKIT

SEQ ID NO: 72006 - protein, 11 aa, Dengue virus
DDLHNEEKITQ

SEQ ID NO: 72007 - protein, 11 aa, Dengue virus
DLHNEEKITQQ

SEQ ID NO: 72008 - protein, 11 aa, Dengue virus
LHNEEKITQQM

SEQ ID NO: 72009 - protein, 11 aa, Dengue virus
HNEEKITQQMD

SEQ ID NO: 72010 - protein, 11 aa, Dengue virus
NEEKITQQMDP

SEQ ID NO: 72011 - protein, 11 aa, Dengue virus
EEKITQQMDPE

SEQ ID NO: 72012 - protein, 11 aa, Dengue virus
EKITQQMDPEH

SEQ ID NO: 72013 - protein, 11 aa, Dengue virus
KITQQMDPEHR

SEQ ID NO: 72014 - protein, 11 aa, Dengue virus
PEHRQLANAIF

SEQ ID NO: 72015 - protein, 11 aa, Dengue virus
EHRQLANAIFK

SEQ ID NO: 72016 - protein, 11 aa, Dengue virus
HRQLANAIFKL

SEQ ID NO: 72017 - protein, 11 aa, Dengue virus
RQLANAIFKLT

SEQ ID NO: 72018 - protein, 11 aa, Dengue virus
QLANAIFKLTY

SEQ ID NO: 72019 - protein, 11 aa, Dengue virus
LANAIFKLTYQ

SEQ ID NO: 72020 - protein, 11 aa, Dengue virus
ANAIFKLTYQN

SEQ ID NO: 72021 - protein, 11 aa, Dengue virus
NAIFKLTYQNK

SEQ ID NO: 72022 - protein, 11 aa, Dengue virus
AIFKLTYQNKV

SEQ ID NO: 72023 - protein, 11 aa, Dengue virus
IFKLTYQNKVV

SEQ ID NO: 72024 - protein, 11 aa, Dengue virus
FKLTYQNKVVK

SEQ ID NO: 72025 - protein, 11 aa, Dengue virus
KLTYQNKVVKV

SEQ ID NO: 72026 - protein, 11 aa, Dengue virus
LTYQNKVVKVQ

SEQ ID NO: 72027 - protein, 11 aa, Dengue virus
TYQNKVVKVQR

SEQ ID NO: 72028 - protein, 11 aa, Dengue virus
YQNKVVKVQRP

SEQ ID NO: 72029 - protein, 11 aa, Dengue virus
QNKVVKVQRPT

SEQ ID NO: 72030 - protein, 11 aa, Dengue virus
NKVVKVQRPTP

SEQ ID NO: 72031 - protein, 11 aa, Dengue virus
KVVKVQRPTPT

SEQ ID NO: 72032 - protein, 11 aa, Dengue virus
VVKVQRPTPTG

SEQ ID NO: 72033 - protein, 11 aa, Dengue virus
VKVQRPTPTGT

SEQ ID NO: 72034 - protein, 11 aa, Dengue virus
KVQRPTPTGTV

SEQ ID NO: 72035 - protein, 11 aa, Dengue virus
VQRPTPTGTVM

SEQ ID NO: 72036 - protein, 11 aa, Dengue virus
QRPTPTGTVMD

SEQ ID NO: 72037 - protein, 11 aa, Dengue virus
RPTPTGTVMDI

SEQ ID NO: 72038 - protein, 11 aa, Dengue virus
PTPTGTVMDII

SEQ ID NO: 72039 - protein, 11 aa, Dengue virus
TPTGTVMDIIS

SEQ ID NO: 72040 - protein, 11 aa, Dengue virus
PTGTVMDIISR

SEQ ID NO: 72041 - protein, 11 aa, Dengue virus
TGTVMDIISRK

SEQ ID NO: 72042 - protein, 11 aa, Dengue virus
GTVMDIISRKD

SEQ ID NO: 72043 - protein, 11 aa, Dengue virus
TVMDIISRKDQ

SEQ ID NO: 72044 - protein, 11 aa, Dengue virus
VMDIISRKDQR

SEQ ID NO: 72045 - protein, 11 aa, Dengue virus
MDIISRKDQRG

SEQ ID NO: 72046 - protein, 11 aa, Dengue virus
DIISRKDQRGS

SEQ ID NO: 72047 - protein, 11 aa, Dengue virus
IISRKDQRGSG

SEQ ID NO: 72048 - protein, 11 aa, Dengue virus
ISRKDQRGSGQ

SEQ ID NO: 72049 - protein, 11 aa, Dengue virus
SRKDQRGSGQV

SEQ ID NO: 72050 - protein, 11 aa, Dengue virus
RKDQRGSGQVG

SEQ ID NO: 72051 - protein, 11 aa, Dengue virus
KDQRGSGQVGT

SEQ ID NO: 72052 - protein, 11 aa, Dengue virus
DQRGSGQVGTY

SEQ ID NO: 72053 - protein, 11 aa, Dengue virus
QRGSGQVGTYG

SEQ ID NO: 72054 - protein, 11 aa, Dengue virus
RGSGQVGTYGL

SEQ ID NO: 72055 - protein, 11 aa, Dengue virus
GSGQVGTYGLN

SEQ ID NO: 72056 - protein, 11 aa, Dengue virus
SGQVGTYGLNT

SEQ ID NO: 72057 - protein, 11 aa, Dengue virus
FTNMEAQLIRQ

SEQ ID NO: 72058 - protein, 11 aa, Dengue virus
TNMEAQLIRQM

SEQ ID NO: 72059 - protein, 11 aa, Dengue virus
NMEAQLIRQME

SEQ ID NO: 72060 - protein, 11 aa, Dengue virus
MEAQLIRQMEG

SEQ ID NO: 72061 - protein, 11 aa, Dengue virus
EAQLIRQMEGE

SEQ ID NO: 72062 - protein, 11 aa, Dengue virus
AQLIRQMEGEG

SEQ ID NO: 72063 - protein, 11 aa, Dengue virus
QLIRQMEGEGV

SEQ ID NO: 72064 - protein, 11 aa, Dengue virus
LIRQMEGEGVL

SEQ ID NO: 72065 - protein, 11 aa, Dengue virus
IRQMEGEGVLS

SEQ ID NO: 72066 - protein, 11 aa, Dengue virus
RQMEGEGVLSK

SEQ ID NO: 72067 - protein, 11 aa, Dengue virus
QMEGEGVLSKA

SEQ ID NO: 72068 - protein, 11 aa, Dengue virus
TQWLETKGVER

SEQ ID NO: 72069 - protein, 11 aa, Dengue virus
QWLETKGVERL

SEQ ID NO: 72070 - protein, 11 aa, Dengue virus
WLETKGVERLK

SEQ ID NO: 72071 - protein, 11 aa, Dengue virus
LETKGVERLKR

SEQ ID NO: 72072 - protein, 11 aa, Dengue virus
ETKGVERLKRM

SEQ ID NO: 72073 - protein, 11 aa, Dengue virus
TKGVERLKRMA

SEQ ID NO: 72074 - protein, 11 aa, Dengue virus
KGVERLKRMAI

SEQ ID NO: 72075 - protein, 11 aa, Dengue virus
GVERLKRMAIS

SEQ ID NO: 72076 - protein, 11 aa, Dengue virus
VERLKRMAISG

SEQ ID NO: 72077 - protein, 11 aa, Dengue virus
ERLKRMAISGD

SEQ ID NO: 72078 - protein, 11 aa, Dengue virus
RLKRMAISGDD

SEQ ID NO: 72079 - protein, 11 aa, Dengue virus
LKRMAISGDDC

SEQ ID NO: 72080 - protein, 11 aa, Dengue virus
KRMAISGDDCV

SEQ ID NO: 72081 - protein, 11 aa, Dengue virus
RMAISGDDCVV

SEQ ID NO: 72082 - protein, 11 aa, Dengue virus
MAISGDDCVVK

SEQ ID NO: 72083 - protein, 11 aa, Dengue virus
AISGDDCVVKP

SEQ ID NO: 72084 - protein, 11 aa, Dengue virus
ISGDDCVVKPI

SEQ ID NO: 72085 - protein, 11 aa, Dengue virus
SGDDCVVKPID

SEQ ID NO: 72086 - protein, 11 aa, Dengue virus
GDDCVVKPIDD

SEQ ID NO: 72087 - protein, 11 aa, Dengue virus
DDCVVKPIDDR

SEQ ID NO: 72088 - protein, 11 aa, Dengue virus
DCVVKPIDDRF

SEQ ID NO: 72089 - protein, 11 aa, Dengue virus
CVVKPIDDRFA

SEQ ID NO: 72090 - protein, 11 aa, Dengue virus
VVKPIDDRFAN

SEQ ID NO: 72091 - protein, 11 aa, Dengue virus
VKPIDDRFANA

SEQ ID NO: 72092 - protein, 11 aa, Dengue virus
KPIDDRFANAL

SEQ ID NO: 72093 - protein, 11 aa, Dengue virus
PIDDRFANALL

SEQ ID NO: 72094 - protein, 11 aa, Dengue virus
IDDRFANALLA

SEQ ID NO: 72095 - protein, 11 aa, Dengue virus
DDRFANALLAL

SEQ ID NO: 72096 - protein, 11 aa, Dengue virus
DRFANALLALN

SEQ ID NO: 72097 - protein, 11 aa, Dengue virus
RFANALLALND

SEQ ID NO: 72098 - protein, 11 aa, Dengue virus
FANALLALNDM

SEQ ID NO: 72099 - protein, 11 aa, Dengue virus
ANALLALNDMG

SEQ ID NO: 72100 - protein, 11 aa, Dengue virus
NALLALNDMGK

SEQ ID NO: 72101 - protein, 11 aa, Dengue virus
ALLALNDMGKV

SEQ ID NO: 72102 - protein, 11 aa, Dengue virus
LLALNDMGKVR

SEQ ID NO: 72103 - protein, 11 aa, Dengue virus
LALNDMGKVRK

SEQ ID NO: 72104 - protein, 11 aa, Dengue virus
ALNDMGKVRKD

SEQ ID NO: 72105 - protein, 11 aa, Dengue virus
LNDMGKVRKDI

SEQ ID NO: 72106 - protein, 11 aa, Dengue virus
NDMGKVRKDIP

SEQ ID NO: 72107 - protein, 11 aa, Dengue virus
DMGKVRKDIPQ

SEQ ID NO: 72108 - protein, 11 aa, Dengue virus
MGKVRKDIPQW

SEQ ID NO: 72109 - protein, 11 aa, Dengue virus
GKVRKDIPQWQ

SEQ ID NO: 72110 - protein, 11 aa, Dengue virus
KVRKDIPQWQP

SEQ ID NO: 72111 - protein, 11 aa, Dengue virus
VRKDIPQWQPS

SEQ ID NO: 72112 - protein, 11 aa, Dengue virus
RKDIPQWQPSK

SEQ ID NO: 72113 - protein, 11 aa, Dengue virus
KDIPQWQPSKG

SEQ ID NO: 72114 - protein, 11 aa, Dengue virus
DIPQWQPSKGW

SEQ ID NO: 72115 - protein, 11 aa, Dengue virus
IPQWQPSKGWH

SEQ ID NO: 72116 - protein, 11 aa, Dengue virus
PQWQPSKGWHD

SEQ ID NO: 72117 - protein, 11 aa, Dengue virus
QWQPSKGWHDW

SEQ ID NO: 72118 - protein, 11 aa, Dengue virus
WQPSKGWHDWQ

SEQ ID NO: 72119 - protein, 11 aa, Dengue virus
QPSKGWHDWQQ

SEQ ID NO: 72120 - protein, 11 aa, Dengue virus
PSKGWHDWQQV

SEQ ID NO: 72121 - protein, 11 aa, Dengue virus
SKGWHDWQQVP

SEQ ID NO: 72122 - protein, 11 aa, Dengue virus
KGWHDWQQVPF

SEQ ID NO: 72123 - protein, 11 aa, Dengue virus
GWHDWQQVPFC

SEQ ID NO: 72124 - protein, 11 aa, Dengue virus
WHDWQQVPFCS

SEQ ID NO: 72125 - protein, 11 aa, Dengue virus
HDWQQVPFCSH

SEQ ID NO: 72126 - protein, 11 aa, Dengue virus
DWQQVPFCSHH

SEQ ID NO: 72127 - protein, 11 aa, Dengue virus
WQQVPFCSHHF

SEQ ID NO: 72128 - protein, 11 aa, Dengue virus
QQVPFCSHHFH

SEQ ID NO: 72129 - protein, 11 aa, Dengue virus
QVPFCSHHFHE

SEQ ID NO: 72130 - protein, 11 aa, Dengue virus
VPFCSHHFHEL

SEQ ID NO: 72131 - protein, 11 aa, Dengue virus
PFCSHHFHELI

SEQ ID NO: 72132 - protein, 11 aa, Dengue virus
FCSHHFHELIM

SEQ ID NO: 72133 - protein, 11 aa, Dengue virus
CSHHFHELIMK

SEQ ID NO: 72134 - protein, 11 aa, Dengue virus
SHHFHELIMKD

SEQ ID NO: 72135 - protein, 11 aa, Dengue virus
HHFHELIMKDG

SEQ ID NO: 72136 - protein, 11 aa, Dengue virus
HFHELIMKDGR

SEQ ID NO: 72137 - protein, 11 aa, Dengue virus
FHELIMKDGRK

SEQ ID NO: 72138 - protein, 11 aa, Dengue virus
HELIMKDGRKL

SEQ ID NO: 72139 - protein, 11 aa, Dengue virus
ELIMKDGRKLV

SEQ ID NO: 72140 - protein, 11 aa, Dengue virus
LIMKDGRKLVV

SEQ ID NO: 72141 - protein, 11 aa, Dengue virus
IMKDGRKLVVP

SEQ ID NO: 72142 - protein, 11 aa, Dengue virus
MKDGRKLVVPC

SEQ ID NO: 72143 - protein, 11 aa, Dengue virus
KDGRKLVVPCR

SEQ ID NO: 72144 - protein, 11 aa, Dengue virus
DGRKLVVPCRP

SEQ ID NO: 72145 - protein, 11 aa, Dengue virus
GRKLVVPCRPQ

SEQ ID NO: 72146 - protein, 11 aa, Dengue virus
RKLVVPCRPQD

SEQ ID NO: 72147 - protein, 11 aa, Dengue virus
KLVVPCRPQDE

SEQ ID NO: 72148 - protein, 11 aa, Dengue virus
LVVPCRPQDEL

SEQ ID NO: 72149 - protein, 11 aa, Dengue virus
VVPCRPQDELI

SEQ ID NO: 72150 - protein, 11 aa, Dengue virus
VPCRPQDELIG

SEQ ID NO: 72151 - protein, 11 aa, Dengue virus
PCRPQDELIGR

SEQ ID NO: 72152 - protein, 11 aa, Dengue virus
CRPQDELIGRA

SEQ ID NO: 72153 - protein, 11 aa, Dengue virus
RPQDELIGRAR

SEQ ID NO: 72154 - protein, 11 aa, Dengue virus
PQDELIGRARI

SEQ ID NO: 72155 - protein, 11 aa, Dengue virus
QDELIGRARIS

SEQ ID NO: 72156 - protein, 11 aa, Dengue virus
DELIGRARISQ

SEQ ID NO: 72157 - protein, 11 aa, Dengue virus
ELIGRARISQG

SEQ ID NO: 72158 - protein, 11 aa, Dengue virus
LIGRARISQGA

SEQ ID NO: 72159 - protein, 11 aa, Dengue virus
IGRARISQGAG

SEQ ID NO: 72160 - protein, 11 aa, Dengue virus
GRARISQGAGW

SEQ ID NO: 72161 - protein, 11 aa, Dengue virus
RARISQGAGWS

SEQ ID NO: 72162 - protein, 11 aa, Dengue virus
ARISQGAGWSL

SEQ ID NO: 72163 - protein, 11 aa, Dengue virus
RISQGAGWSLR

SEQ ID NO: 72164 - protein, 11 aa, Dengue virus
ISQGAGWSLRE

SEQ ID NO: 72165 - protein, 11 aa, Dengue virus
SQGAGWSLRET

SEQ ID NO: 72166 - protein, 11 aa, Dengue virus
QGAGWSLRETA

SEQ ID NO: 72167 - protein, 11 aa, Dengue virus
GAGWSLRETAC

SEQ ID NO: 72168 - protein, 11 aa, Dengue virus
AGWSLRETACL

SEQ ID NO: 72169 - protein, 11 aa, Dengue virus
GWSLRETACLG

SEQ ID NO: 72170 - protein, 11 aa, Dengue virus
WSLRETACLGK

SEQ ID NO: 72171 - protein, 11 aa, Dengue virus
SLRETACLGKA

SEQ ID NO: 72172 - protein, 11 aa, Dengue virus
LRETACLGKAY

SEQ ID NO: 72173 - protein, 11 aa, Dengue virus
RETACLGKAYA

SEQ ID NO: 72174 - protein, 11 aa, Dengue virus
ETACLGKAYAQ

SEQ ID NO: 72175 - protein, 11 aa, Dengue virus
TACLGKAYAQM

SEQ ID NO: 72176 - protein, 11 aa, Dengue virus
ACLGKAYAQMW

SEQ ID NO: 72177 - protein, 11 aa, Dengue virus
CLGKAYAQMWS

SEQ ID NO: 72178 - protein, 11 aa, Dengue virus
LGKAYAQMWSL

SEQ ID NO: 72179 - protein, 11 aa, Dengue virus
GKAYAQMWSLM

SEQ ID NO: 72180 - protein, 11 aa, Dengue virus
KAYAQMWSLMY

SEQ ID NO: 72181 - protein, 11 aa, Dengue virus
AYAQMWSLMYF

SEQ ID NO: 72182 - protein, 11 aa, Dengue virus
YAQMWSLMYFH

SEQ ID NO: 72183 - protein, 11 aa, Dengue virus
AQMWSLMYFHR

SEQ ID NO: 72184 - protein, 11 aa, Dengue virus
QMWSLMYFHRR

SEQ ID NO: 72185 - protein, 11 aa, Dengue virus
MWSLMYFHRRD

SEQ ID NO: 72186 - protein, 11 aa, Dengue virus
WSLMYFHRRDL

SEQ ID NO: 72187 - protein, 11 aa, Dengue virus
SLMYFHRRDLR

SEQ ID NO: 72188 - protein, 11 aa, Dengue virus
LMYFHRRDLRL

SEQ ID NO: 72189 - protein, 11 aa, Dengue virus
MYFHRRDLRLA

SEQ ID NO: 72190 - protein, 11 aa, Dengue virus
YFHRRDLRLAS

SEQ ID NO: 72191 - protein, 11 aa, Dengue virus
FHRRDLRLASN

SEQ ID NO: 72192 - protein, 11 aa, Dengue virus
HRRDLRLASNA

SEQ ID NO: 72193 - protein, 11 aa, Dengue virus
RRDLRLASNAI

SEQ ID NO: 72194 - protein, 11 aa, Dengue virus
RDLRLASNAIC

SEQ ID NO: 72195 - protein, 11 aa, Dengue virus
DLRLASNAICS

SEQ ID NO: 72196 - protein, 11 aa, Dengue virus
LRLASNAICSA

SEQ ID NO: 72197 - protein, 11 aa, Dengue virus
RLASNAICSAV

SEQ ID NO: 72198 - protein, 11 aa, Dengue virus
LASNAICSAVP

SEQ ID NO: 72199 - protein, 11 aa, Dengue virus
ASNAICSAVPV

SEQ ID NO: 72200 - protein, 11 aa, Dengue virus
SNAICSAVPVH

SEQ ID NO: 72201 - protein, 11 aa, Dengue virus
NAICSAVPVHW

SEQ ID NO: 72202 - protein, 11 aa, Dengue virus
AICSAVPVHWV

SEQ ID NO: 72203 - protein, 11 aa, Dengue virus
ICSAVPVHWVP

SEQ ID NO: 72204 - protein, 11 aa, Dengue virus
CSAVPVHWVPT

SEQ ID NO: 72205 - protein, 11 aa, Dengue virus
SAVPVHWVPTS

SEQ ID NO: 72206 - protein, 11 aa, Dengue virus
AVPVHWVPTSR

SEQ ID NO: 72207 - protein, 11 aa, Dengue virus
VPVHWVPTSRT

SEQ ID NO: 72208 - protein, 11 aa, Dengue virus
PVHWVPTSRTT

SEQ ID NO: 72209 - protein, 11 aa, Dengue virus
VHWVPTSRTTW

SEQ ID NO: 72210 - protein, 11 aa, Dengue virus
HWVPTSRTTWS

SEQ ID NO: 72211 - protein, 11 aa, Dengue virus
WVPTSRTTWSI

SEQ ID NO: 72212 - protein, 11 aa, Dengue virus
VPTSRTTWSIH

SEQ ID NO: 72213 - protein, 11 aa, Dengue virus
PTSRTTWSIHA

SEQ ID NO: 72214 - protein, 11 aa, Dengue virus
TSRTTWSIHAH

SEQ ID NO: 72215 - protein, 11 aa, Dengue virus
SRTTWSIHAHH

SEQ ID NO: 72216 - protein, 11 aa, Dengue virus
RTTWSIHAHHQ

SEQ ID NO: 72217 - protein, 11 aa, Dengue virus
TTWSIHAHHQW

SEQ ID NO: 72218 - protein, 11 aa, Dengue virus
TWSIHAHHQWM

SEQ ID NO: 72219 - protein, 11 aa, Dengue virus
WSIHAHHQWMT

SEQ ID NO: 72220 - protein, 11 aa, Dengue virus
SIHAHHQWMTT

SEQ ID NO: 72221 - protein, 11 aa, Dengue virus
IHAHHQWMTTE

SEQ ID NO: 72222 - protein, 11 aa, Dengue virus
HAHHQWMTTED

SEQ ID NO: 72223 - protein, 11 aa, Dengue virus
AHHQWMTTEDM

SEQ ID NO: 72224 - protein, 11 aa, Dengue virus
HHQWMTTEDML

SEQ ID NO: 72225 - protein, 11 aa, Dengue virus
HQWMTTEDMLT

SEQ ID NO: 72226 - protein, 11 aa, Dengue virus
QWMTTEDMLTV

SEQ ID NO: 72227 - protein, 11 aa, Dengue virus
WMTTEDMLTVW

SEQ ID NO: 72228 - protein, 11 aa, Dengue virus
MTTEDMLTVWN

SEQ ID NO: 72229 - protein, 11 aa, Dengue virus
TTEDMLTVWNR

SEQ ID NO: 72230 - protein, 11 aa, Dengue virus
TEDMLTVWNRV

SEQ ID NO: 72231 - protein, 11 aa, Dengue virus
EDMLTVWNRVW

SEQ ID NO: 72232 - protein, 11 aa, Dengue virus
DMLTVWNRVWI

SEQ ID NO: 72233 - protein, 11 aa, Dengue virus
MLTVWNRVWIE

SEQ ID NO: 72234 - protein, 11 aa, Dengue virus
LTVWNRVWIED

SEQ ID NO: 72235 - protein, 11 aa, Dengue virus
TVWNRVWIEDN

SEQ ID NO: 72236 - protein, 11 aa, Dengue virus
VWNRVWIEDNP

SEQ ID NO: 72237 - protein, 11 aa, Dengue virus
WNRVWIEDNPW

SEQ ID NO: 72238 - protein, 11 aa, Dengue virus
NRVWIEDNPWM

SEQ ID NO: 72239 - protein, 11 aa, Dengue virus
RVWIEDNPWME

SEQ ID NO: 72240 - protein, 11 aa, Dengue virus
VWIEDNPWMED

SEQ ID NO: 72241 - protein, 11 aa, Dengue virus
WIEDNPWMEDK

SEQ ID NO: 72242 - protein, 11 aa, Dengue virus
IEDNPWMEDKT

SEQ ID NO: 72243 - protein, 11 aa, Dengue virus
EDNPWMEDKTP

SEQ ID NO: 72244 - protein, 11 aa, Dengue virus
DNPWMEDKTPV

SEQ ID NO: 72245 - protein, 11 aa, Dengue virus
NPWMEDKTPVT

SEQ ID NO: 72246 - protein, 11 aa, Dengue virus
PWMEDKTPVTT

SEQ ID NO: 72247 - protein, 11 aa, Dengue virus
WMEDKTPVTTW

SEQ ID NO: 72248 - protein, 11 aa, Dengue virus
MEDKTPVTTWE

SEQ ID NO: 72249 - protein, 11 aa, Dengue virus
EDKTPVTTWEN

SEQ ID NO: 72250 - protein, 11 aa, Dengue virus
DKTPVTTWENV

SEQ ID NO: 72251 - protein, 11 aa, Dengue virus
KTPVTTWENVP

SEQ ID NO: 72252 - protein, 11 aa, Dengue virus
TPVTTWENVPY

SEQ ID NO: 72253 - protein, 11 aa, Dengue virus
PVTTWENVPYL

SEQ ID NO: 72254 - protein, 11 aa, Dengue virus
VTTWENVPYLG

SEQ ID NO: 72255 - protein, 11 aa, Dengue virus
TTWENVPYLGK

SEQ ID NO: 72256 - protein, 11 aa, Dengue virus
TWENVPYLGKR

SEQ ID NO: 72257 - protein, 11 aa, Dengue virus
WENVPYLGKRE

SEQ ID NO: 72258 - protein, 11 aa, Dengue virus
ENVPYLGKRED

SEQ ID NO: 72259 - protein, 11 aa, Dengue virus
NVPYLGKREDQ

SEQ ID NO: 72260 - protein, 11 aa, Dengue virus
VPYLGKREDQW

SEQ ID NO: 72261 - protein, 11 aa, Dengue virus
PYLGKREDQWC

SEQ ID NO: 72262 - protein, 11 aa, Dengue virus
YLGKREDQWCG

SEQ ID NO: 72263 - protein, 11 aa, Dengue virus
LGKREDQWCGS

SEQ ID NO: 72264 - protein, 11 aa, Dengue virus
GKREDQWCGSL

SEQ ID NO: 72265 - protein, 11 aa, Dengue virus
KREDQWCGSLI

SEQ ID NO: 72266 - protein, 11 aa, Dengue virus
REDQWCGSLIG

SEQ ID NO: 72267 - protein, 11 aa, Dengue virus
EDQWCGSLIGL

SEQ ID NO: 72268 - protein, 11 aa, Dengue virus
DQWCGSLIGLT

SEQ ID NO: 72269 - protein, 11 aa, Dengue virus
QWCGSLIGLTS

SEQ ID NO: 72270 - protein, 11 aa, Dengue virus
WCGSLIGLTSR

SEQ ID NO: 72271 - protein, 11 aa, Dengue virus
CGSLIGLTSRA

SEQ ID NO: 72272 - protein, 11 aa, Dengue virus
GSLIGLTSRAT

SEQ ID NO: 72273 - protein, 11 aa, Dengue virus
SLIGLTSRATW

SEQ ID NO: 72274 - protein, 11 aa, Dengue virus
LIGLTSRATWA

SEQ ID NO: 72275 - protein, 11 aa, Dengue virus
IGLTSRATWAQ

SEQ ID NO: 72276 - protein, 11 aa, Dengue virus
GLTSRATWAQN

SEQ ID NO: 72277 - protein, 11 aa, Dengue virus
LTSRATWAQNI

SEQ ID NO: 72278 - protein, 11 aa, Dengue virus
TSRATWAQNIP

SEQ ID NO: 72279 - protein, 11 aa, Dengue virus
SRATWAQNIPT

SEQ ID NO: 72280 - protein, 11 aa, Dengue virus
RATWAQNIPTA

SEQ ID NO: 72281 - protein, 11 aa, Dengue virus
ATWAQNIPTAI

SEQ ID NO: 72282 - protein, 11 aa, Dengue virus
TWAQNIPTAIQ

SEQ ID NO: 72283 - protein, 11 aa, Dengue virus
WAQNIPTAIQQ

SEQ ID NO: 72284 - protein, 11 aa, Dengue virus
AQNIPTAIQQV

SEQ ID NO: 72285 - protein, 11 aa, Dengue virus
QNIPTAIQQVR

SEQ ID NO: 72286 - protein, 11 aa, Dengue virus
NIPTAIQQVRS

SEQ ID NO: 72287 - protein, 11 aa, Dengue virus
IPTAIQQVRSL

SEQ ID NO: 72288 - protein, 11 aa, Dengue virus
PTAIQQVRSLI

SEQ ID NO: 72289 - protein, 11 aa, Dengue virus
TAIQQVRSLIG

SEQ ID NO: 72290 - protein, 11 aa, Dengue virus
AIQQVRSLIGN

SEQ ID NO: 72291 - protein, 11 aa, Dengue virus
IQQVRSLIGNE

SEQ ID NO: 72292 - protein, 11 aa, Dengue virus
QQVRSLIGNEE

SEQ ID NO: 72293 - protein, 11 aa, Dengue virus
QVRSLIGNEEF

SEQ ID NO: 72294 - protein, 11 aa, Dengue virus
VRSLIGNEEFL

SEQ ID NO: 72295 - protein, 11 aa, Dengue virus
RSLIGNEEFLD

SEQ ID NO: 72296 - protein, 11 aa, Dengue virus
SLIGNEEFLDY

SEQ ID NO: 72297 - protein, 11 aa, Dengue virus
LIGNEEFLDYM

SEQ ID NO: 72298 - protein, 11 aa, Dengue virus
IGNEEFLDYMP

SEQ ID NO: 72299 - protein, 11 aa, Dengue virus
GNEEFLDYMPS

SEQ ID NO: 72300 - protein, 11 aa, Dengue virus
NEEFLDYMPSM

SEQ ID NO: 72301 - protein, 11 aa, Dengue virus
EEFLDYMPSMK

SEQ ID NO: 72302 - protein, 11 aa, Dengue virus
EFLDYMPSMKR

SEQ ID NO: 72303 - protein, 11 aa, Dengue virus
FLDYMPSMKRF

SEQ ID NO: 72304 - protein, 11 aa, Dengue virus
LDYMPSMKRFR

SEQ ID NO: 72305 - protein, 11 aa, Dengue virus
DYMPSMKRFRK

SEQ ID NO: 72306 - protein, 11 aa, Dengue virus
YMPSMKRFRKE

SEQ ID NO: 72307 - protein, 11 aa, Dengue virus
MPSMKRFRKEE

SEQ ID NO: 72308 - protein, 11 aa, Dengue virus
PSMKRFRKEEE

SEQ ID NO: 72309 - protein, 11 aa, Dengue virus
SMKRFRKEEES

SEQ ID NO: 72310 - protein, 11 aa, Dengue virus
MKRFRKEEESE

SEQ ID NO: 72311 - protein, 11 aa, Dengue virus
KRFRKEEESEG

SEQ ID NO: 72312 - protein, 11 aa, Dengue virus
RFRKEEESEGA

SEQ ID NO: 72313 - protein, 11 aa, Dengue virus
FRKEEESEGAI

SEQ ID NO: 72314 - protein, 11 aa, Dengue virus
RKEEESEGAIW

SEQ ID NO: 72315 - protein, 11 aa, Dengue virus
MNNQRKKAGKP

SEQ ID NO: 72316 - protein, 11 aa, Dengue virus
NNQRKKAGKPS

SEQ ID NO: 72317 - protein, 11 aa, Dengue virus
NQRKKAGKPSI

SEQ ID NO: 72318 - protein, 11 aa, Dengue virus
QRKKAGKPSIN

SEQ ID NO: 72319 - protein, 11 aa, Dengue virus
RKKAGKPSINM

SEQ ID NO: 72320 - protein, 11 aa, Dengue virus
KKAGKPSINML

SEQ ID NO: 72321 - protein, 11 aa, Dengue virus
KAGKPSINMLK

SEQ ID NO: 72322 - protein, 11 aa, Dengue virus
AGKPSINMLKR

SEQ ID NO: 72323 - protein, 11 aa, Dengue virus
KRVRNRVSTGT

SEQ ID NO: 72324 - protein, 11 aa, Dengue virus
RVRNRVSTGTQ

SEQ ID NO: 72325 - protein, 11 aa, Dengue virus
VRNRVSTGTQL

SEQ ID NO: 72326 - protein, 11 aa, Dengue virus
TGSQLAKRFSR

SEQ ID NO: 72327 - protein, 11 aa, Dengue virus
GSQLAKRFSRG

SEQ ID NO: 72328 - protein, 11 aa, Dengue virus
SQLAKRFSRGL

SEQ ID NO: 72329 - protein, 11 aa, Dengue virus
QLAKRFSRGLL

SEQ ID NO: 72330 - protein, 11 aa, Dengue virus
LAKRFSRGLLN

SEQ ID NO: 72331 - protein, 11 aa, Dengue virus
AKRFSRGLLNG

SEQ ID NO: 72332 - protein, 11 aa, Dengue virus
KRFSRGLLNGQ

SEQ ID NO: 72333 - protein, 11 aa, Dengue virus
RFSRGLLNGQG

SEQ ID NO: 72334 - protein, 11 aa, Dengue virus
FSRGLLNGQGP

SEQ ID NO: 72335 - protein, 11 aa, Dengue virus
SRGLLNGQGPM

SEQ ID NO: 72336 - protein, 11 aa, Dengue virus
RGLLNGQGPMK

SEQ ID NO: 72337 - protein, 11 aa, Dengue virus
ELLNGQGPMKL

SEQ ID NO: 72338 - protein, 11 aa, Dengue virus
RFLAIPPTAGI

SEQ ID NO: 72339 - protein, 11 aa, Dengue virus
FLAIPPTAGIL

SEQ ID NO: 72340 - protein, 11 aa, Dengue virus
LAIPPTAGILA

SEQ ID NO: 72341 - protein, 11 aa, Dengue virus
AIPPTAGILAR

SEQ ID NO: 72342 - protein, 11 aa, Dengue virus
IPPTAGILARW

SEQ ID NO: 72343 - protein, 11 aa, Dengue virus
PPTAGILARWG

SEQ ID NO: 72344 - protein, 11 aa, Dengue virus
PTAGILARWGT

SEQ ID NO: 72345 - protein, 11 aa, Dengue virus
TAGILARWGTF

SEQ ID NO: 72346 - protein, 11 aa, Dengue virus
AGILARWGTFK

SEQ ID NO: 72347 - protein, 11 aa, Dengue virus
GILARWGTFKK

SEQ ID NO: 72348 - protein, 11 aa, Dengue virus
ILARWGTFKKS

SEQ ID NO: 72349 - protein, 11 aa, Dengue virus
GTFKKLGAIKV

SEQ ID NO: 72350 - protein, 11 aa, Dengue virus
TFKKLGAIKVL

SEQ ID NO: 72351 - protein, 11 aa, Dengue virus
FKKSGAIKVLR

SEQ ID NO: 72352 - protein, 11 aa, Dengue virus
KKSGAIKVLRG

SEQ ID NO: 72353 - protein, 11 aa, Dengue virus
KSGAIKVLRGF

SEQ ID NO: 72354 - protein, 11 aa, Dengue virus
SGAIKVLRGFK

SEQ ID NO: 72355 - protein, 11 aa, Dengue virus
GAIKVLRGFKK

SEQ ID NO: 72356 - protein, 11 aa, Dengue virus
AIKVLRGFKKE

SEQ ID NO: 72357 - protein, 11 aa, Dengue virus
IKVLRGFKKEI

SEQ ID NO: 72358 - protein, 11 aa, Dengue virus
KVLRGFKKEIS

SEQ ID NO: 72359 - protein, 11 aa, Dengue virus
VLRGFKKEISN

SEQ ID NO: 72360 - protein, 11 aa, Dengue virus
LRGFKKEISNM

SEQ ID NO: 72361 - protein, 11 aa, Dengue virus
RGFKKEISNML

SEQ ID NO: 72362 - protein, 11 aa, Dengue virus
GFKREISNMLS

SEQ ID NO: 72363 - protein, 11 aa, Dengue virus
FKREISNMLSI

SEQ ID NO: 72364 - protein, 11 aa, Dengue virus
KREISNMLSII

SEQ ID NO: 72365 - protein, 11 aa, Dengue virus
REISNMLSIIN

SEQ ID NO: 72366 - protein, 11 aa, Dengue virus
EISNMLSIINR

SEQ ID NO: 72367 - protein, 11 aa, Dengue virus
ISNMLSIINRR

SEQ ID NO: 72368 - protein, 11 aa, Dengue virus
SNMLSIINRRK

SEQ ID NO: 72369 - protein, 11 aa, Dengue virus
NMLSIINRRKK

SEQ ID NO: 72370 - protein, 11 aa, Dengue virus
MLSIINRRKKT

SEQ ID NO: 72371 - protein, 11 aa, Dengue virus
LSIINRRKKTS

SEQ ID NO: 72372 - protein, 11 aa, Dengue virus
MMLPATLAFHL

SEQ ID NO: 72373 - protein, 11 aa, Dengue virus
MLPATLAFHLT

SEQ ID NO: 72374 - protein, 11 aa, Dengue virus
LPATLAFHLTS

SEQ ID NO: 72375 - protein, 11 aa, Dengue virus
PATLAFHLTSR

SEQ ID NO: 72376 - protein, 11 aa, Dengue virus
ATLAFHLTSRD

SEQ ID NO: 72377 - protein, 11 aa, Dengue virus
TLAFHLTSRDG

SEQ ID NO: 72378 - protein, 11 aa, Dengue virus
SRDGEPRMIVA

SEQ ID NO: 72379 - protein, 11 aa, Dengue virus
RDGEPRMIVAK

SEQ ID NO: 72380 - protein, 11 aa, Dengue virus
DGEPRMIVAKN

SEQ ID NO: 72381 - protein, 11 aa, Dengue virus
GEPRMIVAKNE

SEQ ID NO: 72382 - protein, 11 aa, Dengue virus
EPRMIVAKNER

SEQ ID NO: 72383 - protein, 11 aa, Dengue virus
PRMIVAKNERG

SEQ ID NO: 72384 - protein, 11 aa, Dengue virus
RMIVAKNERGK

SEQ ID NO: 72385 - protein, 11 aa, Dengue virus
MIVAKNERGKS

SEQ ID NO: 72386 - protein, 11 aa, Dengue virus
IVAKNERGKSL

SEQ ID NO: 72387 - protein, 11 aa, Dengue virus
VAKNERGKSLL

SEQ ID NO: 72388 - protein, 11 aa, Dengue virus
AKNERGKSLLF

SEQ ID NO: 72389 - protein, 11 aa, Dengue virus
RGKSLLFKTAT

SEQ ID NO: 72390 - protein, 11 aa, Dengue virus
GKSLLFKTATG

SEQ ID NO: 72391 - protein, 11 aa, Dengue virus
KSLLFKTATGI

SEQ ID NO: 72392 - protein, 11 aa, Dengue virus
SLLFKTATGIN

SEQ ID NO: 72393 - protein, 11 aa, Dengue virus
LLFKTATGINM

SEQ ID NO: 72394 - protein, 11 aa, Dengue virus
LFKTATGINMC

SEQ ID NO: 72395 - protein, 11 aa, Dengue virus
FKTATGINMCT

SEQ ID NO: 72396 - protein, 11 aa, Dengue virus
KTATGINMCTL

SEQ ID NO: 72397 - protein, 11 aa, Dengue virus
TATGINMCTLI

SEQ ID NO: 72398 - protein, 11 aa, Dengue virus
ATGINMCTLIA

SEQ ID NO: 72399 - protein, 11 aa, Dengue virus
TGINMCTLIAM

SEQ ID NO: 72400 - protein, 11 aa, Dengue virus
MDLGEMCDDTI

SEQ ID NO: 72401 - protein, 11 aa, Dengue virus
DLGEMCDDTIT

SEQ ID NO: 72402 - protein, 11 aa, Dengue virus
LGEMCDDTITY

SEQ ID NO: 72403 - protein, 11 aa, Dengue virus
GEMCDDTITYK

SEQ ID NO: 72404 - protein, 11 aa, Dengue virus
EMCDDTITYKC

SEQ ID NO: 72405 - protein, 11 aa, Dengue virus
MCDDTITYKCP

SEQ ID NO: 72406 - protein, 11 aa, Dengue virus
CDDTVTYKCPL

SEQ ID NO: 72407 - protein, 11 aa, Dengue virus
DDTVTYKCPLI

SEQ ID NO: 72408 - protein, 11 aa, Dengue virus
IAEVEPEDIDC

SEQ ID NO: 72409 - protein, 11 aa, Dengue virus
AEVEPEDIDCW

SEQ ID NO: 72410 - protein, 11 aa, Dengue virus
TWVTYGTCTQA

SEQ ID NO: 72411 - protein, 11 aa, Dengue virus
TYGTCNQAGER

SEQ ID NO: 72412 - protein, 11 aa, Dengue virus
YGTCNQAGERR

SEQ ID NO: 72413 - protein, 11 aa, Dengue virus
GTCNQAGERRR

SEQ ID NO: 72414 - protein, 11 aa, Dengue virus
TCNQAGERRRD

SEQ ID NO: 72415 - protein, 11 aa, Dengue virus
CNQAGERRRDK

SEQ ID NO: 72416 - protein, 11 aa, Dengue virus
NQAGERRRDKR

SEQ ID NO: 72417 - protein, 11 aa, Dengue virus
QAGERRRDKRS

SEQ ID NO: 72418 - protein, 11 aa, Dengue virus
AGERRRDKRSV

SEQ ID NO: 72419 - protein, 11 aa, Dengue virus
GERRRDKRSVA

SEQ ID NO: 72420 - protein, 11 aa, Dengue virus
ERRRDKRSVAL

SEQ ID NO: 72421 - protein, 11 aa, Dengue virus
RRRDKRSVALA

SEQ ID NO: 72422 - protein, 11 aa, Dengue virus
PHVGMGLDTRA

SEQ ID NO: 72423 - protein, 11 aa, Dengue virus
HVGMGLDTRAQ

SEQ ID NO: 72424 - protein, 11 aa, Dengue virus
VGMGLDTRAQT

SEQ ID NO: 72425 - protein, 11 aa, Dengue virus
GMGLDTRAQTW

SEQ ID NO: 72426 - protein, 11 aa, Dengue virus
MGLDTRAQTWM

SEQ ID NO: 72427 - protein, 11 aa, Dengue virus
GLDTRAQTWMS

SEQ ID NO: 72428 - protein, 11 aa, Dengue virus
LDTRAQTWMSA

SEQ ID NO: 72429 - protein, 11 aa, Dengue virus
DTRAQTWMSAE

SEQ ID NO: 72430 - protein, 11 aa, Dengue virus
TRAQTWMSAEG

SEQ ID NO: 72431 - protein, 11 aa, Dengue virus
RAQTWMSAEGA

SEQ ID NO: 72432 - protein, 11 aa, Dengue virus
AQTWMSAEGAW

SEQ ID NO: 72433 - protein, 11 aa, Dengue virus
SAEGAWRQVER

SEQ ID NO: 72434 - protein, 11 aa, Dengue virus
AEGAWRQVERV

SEQ ID NO: 72435 - protein, 11 aa, Dengue virus
GAWRQVERVET

SEQ ID NO: 72436 - protein, 11 aa, Dengue virus
AWRQVERVETW

SEQ ID NO: 72437 - protein, 11 aa, Dengue virus
WRQVERVETWA

SEQ ID NO: 72438 - protein, 11 aa, Dengue virus
RQVEKVETWAF

SEQ ID NO: 72439 - protein, 11 aa, Dengue virus
QVEKVETWAFR

SEQ ID NO: 72440 - protein, 11 aa, Dengue virus
VEKVETWAFRH

SEQ ID NO: 72441 - protein, 11 aa, Dengue virus
EKVETWAFRHP

SEQ ID NO: 72442 - protein, 11 aa, Dengue virus
KVETWAFRHPG

SEQ ID NO: 72443 - protein, 11 aa, Dengue virus
VETWAFRHPGF

SEQ ID NO: 72444 - protein, 11 aa, Dengue virus
ETWAFRHPGFT

SEQ ID NO: 72445 - protein, 11 aa, Dengue virus
TWAFRHPGFTI

SEQ ID NO: 72446 - protein, 11 aa, Dengue virus
WAFRHPGFTIL

SEQ ID NO: 72447 - protein, 11 aa, Dengue virus
AFRHPGFTILA

SEQ ID NO: 72448 - protein, 11 aa, Dengue virus
FRHPGFTILAL

SEQ ID NO: 72449 - protein, 11 aa, Dengue virus
TILALFLAHYV

SEQ ID NO: 72450 - protein, 11 aa, Dengue virus
ILALFLAHYVG

SEQ ID NO: 72451 - protein, 11 aa, Dengue virus
LALFLAHYVGT

SEQ ID NO: 72452 - protein, 11 aa, Dengue virus
ALFLAHYVGTS

SEQ ID NO: 72453 - protein, 11 aa, Dengue virus
LFLAHYVGTSL

SEQ ID NO: 72454 - protein, 11 aa, Dengue virus
FLAHYIGTSLI

SEQ ID NO: 72455 - protein, 11 aa, Dengue virus
LAHYIGTSLIQ

SEQ ID NO: 72456 - protein, 11 aa, Dengue virus
AHYIGTSLIQK

SEQ ID NO: 72457 - protein, 11 aa, Dengue virus
HYIGTSLTQKA

SEQ ID NO: 72458 - protein, 11 aa, Dengue virus
YIGTSLTQKAV

SEQ ID NO: 72459 - protein, 11 aa, Dengue virus
IGTSLTQKAVI

SEQ ID NO: 72460 - protein, 11 aa, Dengue virus
GTSLTQKAVIF

SEQ ID NO: 72461 - protein, 11 aa, Dengue virus
TSLTQKVVIFV

SEQ ID NO: 72462 - protein, 11 aa, Dengue virus
SLTQKVVIFVL

SEQ ID NO: 72463 - protein, 11 aa, Dengue virus
LTQKVVIFVLL

SEQ ID NO: 72464 - protein, 11 aa, Dengue virus
TQKVVIFVLLM

SEQ ID NO: 72465 - protein, 11 aa, Dengue virus
QKVVIFVLLML

SEQ ID NO: 72466 - protein, 11 aa, Dengue virus
KVVIFVLLMLV

SEQ ID NO: 72467 - protein, 11 aa, Dengue virus
VVIFVLLMLVT

SEQ ID NO: 72468 - protein, 11 aa, Dengue virus
VIFVLLMLVTP

SEQ ID NO: 72469 - protein, 11 aa, Dengue virus
IFVLLMLVTPS

SEQ ID NO: 72470 - protein, 11 aa, Dengue virus
FVLLMLVTPSM

SEQ ID NO: 72471 - protein, 11 aa, Dengue virus
VLLMLVTPSMT

SEQ ID NO: 72472 - protein, 11 aa, Dengue virus
LLMLVTPSMAM

SEQ ID NO: 72473 - protein, 11 aa, Dengue virus
LMLVTPSMAMR

SEQ ID NO: 72474 - protein, 11 aa, Dengue virus
MLVTPSMAMRC

SEQ ID NO: 72475 - protein, 11 aa, Dengue virus
LVTPSMAMRCV

SEQ ID NO: 72476 - protein, 11 aa, Dengue virus
VTPSMAMRCVG

SEQ ID NO: 72477 - protein, 11 aa, Dengue virus
TPSMAMRCVGV

SEQ ID NO: 72478 - protein, 11 aa, Dengue virus
PSMAMRCVGVG

SEQ ID NO: 72479 - protein, 11 aa, Dengue virus
SMAMRCVGVGN

SEQ ID NO: 72480 - protein, 11 aa, Dengue virus
MAMRCVGVGNR

SEQ ID NO: 72481 - protein, 11 aa, Dengue virus
AMRCVGVGNRD

SEQ ID NO: 72482 - protein, 11 aa, Dengue virus
HGGCVTTMAKS

SEQ ID NO: 72483 - protein, 11 aa, Dengue virus
GGCVTTMAKSK

SEQ ID NO: 72484 - protein, 11 aa, Dengue virus
GCVTTMAKSKP

SEQ ID NO: 72485 - protein, 11 aa, Dengue virus
CVTTMAKSKPT

SEQ ID NO: 72486 - protein, 11 aa, Dengue virus
VTTMAKSKPTL

SEQ ID NO: 72487 - protein, 11 aa, Dengue virus
TTMAKSKPTLD

SEQ ID NO: 72488 - protein, 11 aa, Dengue virus
TMAKSKPTLDI

SEQ ID NO: 72489 - protein, 11 aa, Dengue virus
MAKSKPTLDIE

SEQ ID NO: 72490 - protein, 11 aa, Dengue virus
AKSKPTLDIEL

SEQ ID NO: 72491 - protein, 11 aa, Dengue virus
KSKPTLDIELQ

SEQ ID NO: 72492 - protein, 11 aa, Dengue virus
SKPTLDIELQK

SEQ ID NO: 72493 - protein, 11 aa, Dengue virus
KLCIEGKITNV

SEQ ID NO: 72494 - protein, 11 aa, Dengue virus
LCIEGKITNVT

SEQ ID NO: 72495 - protein, 11 aa, Dengue virus
CIEGKITNVTT

SEQ ID NO: 72496 - protein, 11 aa, Dengue virus
IEGKITNVTTD

SEQ ID NO: 72497 - protein, 11 aa, Dengue virus
EGKITNVTTDS

SEQ ID NO: 72498 - protein, 11 aa, Dengue virus
GKITNVTTDSR

SEQ ID NO: 72499 - protein, 11 aa, Dengue virus
KITNVTTDSRC

SEQ ID NO: 72500 - protein, 11 aa, Dengue virus
ITNVTTDSRCP

SEQ ID NO: 72501 - protein, 11 aa, Dengue virus
TNVTTDSRCPT

SEQ ID NO: 72502 - protein, 11 aa, Dengue virus
NVTTDSRCPTQ

SEQ ID NO: 72503 - protein, 11 aa, Dengue virus
VTTDSRCPTQG

SEQ ID NO: 72504 - protein, 11 aa, Dengue virus
DSRCPTQGEAI

SEQ ID NO: 72505 - protein, 11 aa, Dengue virus
SRCPTQGEAIL

SEQ ID NO: 72506 - protein, 11 aa, Dengue virus
RCPTQGEAILP

SEQ ID NO: 72507 - protein, 11 aa, Dengue virus
CPTQGEAILPE

SEQ ID NO: 72508 - protein, 11 aa, Dengue virus
PTQGEAILPEE

SEQ ID NO: 72509 - protein, 11 aa, Dengue virus
TQGEAILPEEQ

SEQ ID NO: 72510 - protein, 11 aa, Dengue virus
QGEAILPEEQD

SEQ ID NO: 72511 - protein, 11 aa, Dengue virus
GEAILPEEQDQ

SEQ ID NO: 72512 - protein, 11 aa, Dengue virus
EAILPEEQDQN

SEQ ID NO: 72513 - protein, 11 aa, Dengue virus
AILPEEQDQNY

SEQ ID NO: 72514 - protein, 11 aa, Dengue virus
ILPEEQDQNYV

SEQ ID NO: 72515 - protein, 11 aa, Dengue virus
VTCAKFQCLES

SEQ ID NO: 72516 - protein, 11 aa, Dengue virus
TCAKFQCLESI

SEQ ID NO: 72517 - protein, 11 aa, Dengue virus
CAKFQCLESIE

SEQ ID NO: 72518 - protein, 11 aa, Dengue virus
AKFQCLESIEG

SEQ ID NO: 72519 - protein, 11 aa, Dengue virus
KFQCLESIEGK

SEQ ID NO: 72520 - protein, 11 aa, Dengue virus
IEGKVVQHENL

SEQ ID NO: 72521 - protein, 11 aa, Dengue virus
EGKVVQHENLK

SEQ ID NO: 72522 - protein, 11 aa, Dengue virus
GKVVQHENLKY

SEQ ID NO: 72523 - protein, 11 aa, Dengue virus
KVVQHENLKYT

SEQ ID NO: 72524 - protein, 11 aa, Dengue virus
VVQHENLKYTV

SEQ ID NO: 72525 - protein, 11 aa, Dengue virus
VQHENLKYTVI

SEQ ID NO: 72526 - protein, 11 aa, Dengue virus
QHENLKYTVII

SEQ ID NO: 72527 - protein, 11 aa, Dengue virus
HENLKYTVIIT

SEQ ID NO: 72528 - protein, 11 aa, Dengue virus
ENLKYTVTITV

SEQ ID NO: 72529 - protein, 11 aa, Dengue virus
NLKYTVTITVH

SEQ ID NO: 72530 - protein, 11 aa, Dengue virus
LKYTVTITVHT

SEQ ID NO: 72531 - protein, 11 aa, Dengue virus
KYTVTITVHTG

SEQ ID NO: 72532 - protein, 11 aa, Dengue virus
YTVTITVHTGD

SEQ ID NO: 72533 - protein, 11 aa, Dengue virus
TVTITVHTGDQ

SEQ ID NO: 72534 - protein, 11 aa, Dengue virus
VTITVHTGDQH

SEQ ID NO: 72535 - protein, 11 aa, Dengue virus
TITVHTGDQHQ

SEQ ID NO: 72536 - protein, 11 aa, Dengue virus
HTGDQHQVGND

SEQ ID NO: 72537 - protein, 11 aa, Dengue virus
TGDQHQVGNDT

SEQ ID NO: 72538 - protein, 11 aa, Dengue virus
GDQHQVGNDTQ

SEQ ID NO: 72539 - protein, 11 aa, Dengue virus
DQHQVGNDTQG

SEQ ID NO: 72540 - protein, 11 aa, Dengue virus
QHQVGNDTQGV

SEQ ID NO: 72541 - protein, 11 aa, Dengue virus
HQVGNDTQGVT

SEQ ID NO: 72542 - protein, 11 aa, Dengue virus
QVGNDTQGVTV

SEQ ID NO: 72543 - protein, 11 aa, Dengue virus
VGNDTQGVTVE

SEQ ID NO: 72544 - protein, 11 aa, Dengue virus
GNDTQGVTVEI

SEQ ID NO: 72545 - protein, 11 aa, Dengue virus
NDTQGVTVEIT

SEQ ID NO: 72546 - protein, 11 aa, Dengue virus
DTQGVTVEITP

SEQ ID NO: 72547 - protein, 11 aa, Dengue virus
TQGVTVEITPQ

SEQ ID NO: 72548 - protein, 11 aa, Dengue virus
QGVTVEITPQA

SEQ ID NO: 72549 - protein, 11 aa, Dengue virus
GVTVEITPQAS

SEQ ID NO: 72550 - protein, 11 aa, Dengue virus
VTVEITPQAST

SEQ ID NO: 72551 - protein, 11 aa, Dengue virus
EITPQASTVEA

SEQ ID NO: 72552 - protein, 11 aa, Dengue virus
VEAVLPEYGTL

SEQ ID NO: 72553 - protein, 11 aa, Dengue virus
EAVLPEYGTLG

SEQ ID NO: 72554 - protein, 11 aa, Dengue virus
AVLPEYGTLGL

SEQ ID NO: 72555 - protein, 11 aa, Dengue virus
VLPEYGTLGLE

SEQ ID NO: 72556 - protein, 11 aa, Dengue virus
QWFFDLPLPWA

SEQ ID NO: 72557 - protein, 11 aa, Dengue virus
WFFDLPLPWAS

SEQ ID NO: 72558 - protein, 11 aa, Dengue virus
FFDLPLPWASG

SEQ ID NO: 72559 - protein, 11 aa, Dengue virus
FDLPLPWASGA

SEQ ID NO: 72560 - protein, 11 aa, Dengue virus
DLPLPWASGAT

SEQ ID NO: 72561 - protein, 11 aa, Dengue virus
LPLPWASGATT

SEQ ID NO: 72562 - protein, 11 aa, Dengue virus
TETPTWNKKEL

SEQ ID NO: 72563 - protein, 11 aa, Dengue virus
ETPTWNKKELL

SEQ ID NO: 72564 - protein, 11 aa, Dengue virus
TPTWNKKELLV

SEQ ID NO: 72565 - protein, 11 aa, Dengue virus
PTWNKKELLVT

SEQ ID NO: 72566 - protein, 11 aa, Dengue virus
TWNKKELLVTF

SEQ ID NO: 72567 - protein, 11 aa, Dengue virus
WNKKELLVTFK

SEQ ID NO: 72568 - protein, 11 aa, Dengue virus
NKKELLVTFKN

SEQ ID NO: 72569 - protein, 11 aa, Dengue virus
KKELLVTFKNA

SEQ ID NO: 72570 - protein, 11 aa, Dengue virus
TALTGATEIQT

SEQ ID NO: 72571 - protein, 11 aa, Dengue virus
ALTGATEIQTS

SEQ ID NO: 72572 - protein, 11 aa, Dengue virus
LTGATEIQTSG

SEQ ID NO: 72573 - protein, 11 aa, Dengue virus
TGATEIQTSGG

SEQ ID NO: 72574 - protein, 11 aa, Dengue virus
GATEIQTSGGT

SEQ ID NO: 72575 - protein, 11 aa, Dengue virus
ATEIQTSGGTS

SEQ ID NO: 72576 - protein, 11 aa, Dengue virus
TEIQTSGGTSI

SEQ ID NO: 72577 - protein, 11 aa, Dengue virus
EIQTSGGTSIF

SEQ ID NO: 72578 - protein, 11 aa, Dengue virus
IQTSGGTSIFA

SEQ ID NO: 72579 - protein, 11 aa, Dengue virus
QTSGGTSIFAG

SEQ ID NO: 72580 - protein, 11 aa, Dengue virus
TSGGTSIFAGH

SEQ ID NO: 72581 - protein, 11 aa, Dengue virus
SGGTNIFAGHL

SEQ ID NO: 72582 - protein, 11 aa, Dengue virus
GGTNIFAGHLK

SEQ ID NO: 72583 - protein, 11 aa, Dengue virus
GTNIFAGHLKC

SEQ ID NO: 72584 - protein, 11 aa, Dengue virus
TNIFAGHLKCR

SEQ ID NO: 72585 - protein, 11 aa, Dengue virus
NIFAGHLKCRL

SEQ ID NO: 72586 - protein, 11 aa, Dengue virus
ELKGMSYAMCL

SEQ ID NO: 72587 - protein, 11 aa, Dengue virus
LKGMSYAMCLN

SEQ ID NO: 72588 - protein, 11 aa, Dengue virus
KGMSYAMCLNT

SEQ ID NO: 72589 - protein, 11 aa, Dengue virus
GMSYAMCLNTF

SEQ ID NO: 72590 - protein, 11 aa, Dengue virus
MSYAMCLNTFV

SEQ ID NO: 72591 - protein, 11 aa, Dengue virus
SYAMCLNTFVL

SEQ ID NO: 72592 - protein, 11 aa, Dengue virus
NAFVLKKEVSE

SEQ ID NO: 72593 - protein, 11 aa, Dengue virus
AFVLKKEVSET

SEQ ID NO: 72594 - protein, 11 aa, Dengue virus
TQHGTILVKVE

SEQ ID NO: 72595 - protein, 11 aa, Dengue virus
QHGTILVKVEY

SEQ ID NO: 72596 - protein, 11 aa, Dengue virus
HGTILIKVEYR

SEQ ID NO: 72597 - protein, 11 aa, Dengue virus
GTILIKVEYRG

SEQ ID NO: 72598 - protein, 11 aa, Dengue virus
TILIKVEYRGE

SEQ ID NO: 72599 - protein, 11 aa, Dengue virus
ILIKVEYRGED

SEQ ID NO: 72600 - protein, 11 aa, Dengue virus
LIKVEYKGEDV

SEQ ID NO: 72601 - protein, 11 aa, Dengue virus
IKVEYKGEDVP

SEQ ID NO: 72602 - protein, 11 aa, Dengue virus
KVEYKGEDVPC

SEQ ID NO: 72603 - protein, 11 aa, Dengue virus
VEYKGEDVPCK

SEQ ID NO: 72604 - protein, 11 aa, Dengue virus
EYKGEDVPCKI

SEQ ID NO: 72605 - protein, 11 aa, Dengue virus
YKGEDVPCKIP

SEQ ID NO: 72606 - protein, 11 aa, Dengue virus
KGEDVPCKIPF

SEQ ID NO: 72607 - protein, 11 aa, Dengue virus
GEDVPCKIPFS

SEQ ID NO: 72608 - protein, 11 aa, Dengue virus
EDVPCKIPFST

SEQ ID NO: 72609 - protein, 11 aa, Dengue virus
DVPCKIPFSTE

SEQ ID NO: 72610 - protein, 11 aa, Dengue virus
VPCKIPFSTED

SEQ ID NO: 72611 - protein, 11 aa, Dengue virus
PCKVPFSTEDG

SEQ ID NO: 72612 - protein, 11 aa, Dengue virus
CKVPFSTEDGQ

SEQ ID NO: 72613 - protein, 11 aa, Dengue virus
KVPFSTEDGQG

SEQ ID NO: 72614 - protein, 11 aa, Dengue virus
VPFSTEDGQGK

SEQ ID NO: 72615 - protein, 11 aa, Dengue virus
PFSTEDEQGKA

SEQ ID NO: 72616 - protein, 11 aa, Dengue virus
FSTEDEQGKAH

SEQ ID NO: 72617 - protein, 11 aa, Dengue virus
STEDGQGKAHS

SEQ ID NO: 72618 - protein, 11 aa, Dengue virus
TEDGQGKAHSG

SEQ ID NO: 72619 - protein, 11 aa, Dengue virus
EDGQGKAHSGR

SEQ ID NO: 72620 - protein, 11 aa, Dengue virus
DGQGKAHSGRL

SEQ ID NO: 72621 - protein, 11 aa, Dengue virus
GQGKAHSGRLI

SEQ ID NO: 72622 - protein, 11 aa, Dengue virus
QGKAHSGRLIT

SEQ ID NO: 72623 - protein, 11 aa, Dengue virus
GKAHSGRLITA

SEQ ID NO: 72624 - protein, 11 aa, Dengue virus
KAHSGRLITAN

SEQ ID NO: 72625 - protein, 11 aa, Dengue virus
AHSGRLITANP

SEQ ID NO: 72626 - protein, 11 aa, Dengue virus
HNGRLITANPI

SEQ ID NO: 72627 - protein, 11 aa, Dengue virus
NGRLITANPIV

SEQ ID NO: 72628 - protein, 11 aa, Dengue virus
GRLITANPIVT

SEQ ID NO: 72629 - protein, 11 aa, Dengue virus
RLITANPIVTK

SEQ ID NO: 72630 - protein, 11 aa, Dengue virus
LITANPIVTKK

SEQ ID NO: 72631 - protein, 11 aa, Dengue virus
ITANPIVTKKE

SEQ ID NO: 72632 - protein, 11 aa, Dengue virus
TANPIVTKKEE

SEQ ID NO: 72633 - protein, 11 aa, Dengue virus
ANPIVTKKEEP

SEQ ID NO: 72634 - protein, 11 aa, Dengue virus
NPIVTKKEEPV

SEQ ID NO: 72635 - protein, 11 aa, Dengue virus
PIVTKKEEPVN

SEQ ID NO: 72636 - protein, 11 aa, Dengue virus
IVTKKEEPVNI

SEQ ID NO: 72637 - protein, 11 aa, Dengue virus
VTKKDEPVNIE

SEQ ID NO: 72638 - protein, 11 aa, Dengue virus
TKKDEPVNIEA

SEQ ID NO: 72639 - protein, 11 aa, Dengue virus
KKDEPVNIEAE

SEQ ID NO: 72640 - protein, 11 aa, Dengue virus
KDEPVNIEAEP

SEQ ID NO: 72641 - protein, 11 aa, Dengue virus
DEPVNIEAEPP

SEQ ID NO: 72642 - protein, 11 aa, Dengue virus
EPINIEAEPPF

SEQ ID NO: 72643 - protein, 11 aa, Dengue virus
PINIEAEPPFG

SEQ ID NO: 72644 - protein, 11 aa, Dengue virus
INIEAEPPFGE

SEQ ID NO: 72645 - protein, 11 aa, Dengue virus
AEPPFGESNII

SEQ ID NO: 72646 - protein, 11 aa, Dengue virus
EPPFGESNIII

SEQ ID NO: 72647 - protein, 11 aa, Dengue virus
PPFGESNIIIG

SEQ ID NO: 72648 - protein, 11 aa, Dengue virus
PFGESNIIIGI

SEQ ID NO: 72649 - protein, 11 aa, Dengue virus
FGESNIIIGIG

SEQ ID NO: 72650 - protein, 11 aa, Dengue virus
GESNIIIGIGD

SEQ ID NO: 72651 - protein, 11 aa, Dengue virus
GDKALKINWYK

SEQ ID NO: 72652 - protein, 11 aa, Dengue virus
KALKINWYKKG

SEQ ID NO: 72653 - protein, 11 aa, Dengue virus
SLKINWYKKGS

SEQ ID NO: 72654 - protein, 11 aa, Dengue virus
LKINWYRKGSS

SEQ ID NO: 72655 - protein, 11 aa, Dengue virus
KINWYRKGSSI

SEQ ID NO: 72656 - protein, 11 aa, Dengue virus
IFGSAYTALFG

SEQ ID NO: 72657 - protein, 11 aa, Dengue virus
FGSAYTALFGG

SEQ ID NO: 72658 - protein, 11 aa, Dengue virus
GSAYTALFGGV

SEQ ID NO: 72659 - protein, 11 aa, Dengue virus
SAYTALFGGVS

SEQ ID NO: 72660 - protein, 11 aa, Dengue virus
AYTALFGGVSW

SEQ ID NO: 72661 - protein, 11 aa, Dengue virus
YTALFSGVSWI

SEQ ID NO: 72662 - protein, 11 aa, Dengue virus
TALFSGVSWIM

SEQ ID NO: 72663 - protein, 11 aa, Dengue virus
ALFSGVSWIMK

SEQ ID NO: 72664 - protein, 11 aa, Dengue virus
LFSGVSWIMKI

SEQ ID NO: 72665 - protein, 11 aa, Dengue virus
FSGVSWIMKIG

SEQ ID NO: 72666 - protein, 11 aa, Dengue virus
SGVSWIMKIGI

SEQ ID NO: 72667 - protein, 11 aa, Dengue virus
GVSWIMKIGIG

SEQ ID NO: 72668 - protein, 11 aa, Dengue virus
VSWIMKIGIGV

SEQ ID NO: 72669 - protein, 11 aa, Dengue virus
SWIMKIGIGVL

SEQ ID NO: 72670 - protein, 11 aa, Dengue virus
WIMKIGIGVLL

SEQ ID NO: 72671 - protein, 11 aa, Dengue virus
IMKIGIGVLLT

SEQ ID NO: 72672 - protein, 11 aa, Dengue virus
MKIGIGILLTW

SEQ ID NO: 72673 - protein, 11 aa, Dengue virus
KIGIGILLTWI

SEQ ID NO: 72674 - protein, 11 aa, Dengue virus
IGIGILLTWIG

SEQ ID NO: 72675 - protein, 11 aa, Dengue virus
GIGILLTWIGL

SEQ ID NO: 72676 - protein, 11 aa, Dengue virus
IGILLTWIGLN

SEQ ID NO: 72677 - protein, 11 aa, Dengue virus
GILLTWIGLNS

SEQ ID NO: 72678 - protein, 11 aa, Dengue virus
ILLTWIGLNSK

SEQ ID NO: 72679 - protein, 11 aa, Dengue virus
KNTSMSFSCIV

SEQ ID NO: 72680 - protein, 11 aa, Dengue virus
NTSMSFSCIVI

SEQ ID NO: 72681 - protein, 11 aa, Dengue virus
TSMSFSCIVIG

SEQ ID NO: 72682 - protein, 11 aa, Dengue virus
SMSFSCIVIGI

SEQ ID NO: 72683 - protein, 11 aa, Dengue virus
MSFSCIVIGII

SEQ ID NO: 72684 - protein, 11 aa, Dengue virus
SFSCIVIGIIT

SEQ ID NO: 72685 - protein, 11 aa, Dengue virus
FSCIVIGIITL

SEQ ID NO: 72686 - protein, 11 aa, Dengue virus
SCIVIGIITLY

SEQ ID NO: 72687 - protein, 11 aa, Dengue virus
CIVIGIITLYL

SEQ ID NO: 72688 - protein, 11 aa, Dengue virus
IVIGIITLYLG

SEQ ID NO: 72689 - protein, 11 aa, Dengue virus
IGVITLYLGAV

SEQ ID NO: 72690 - protein, 11 aa, Dengue virus
GVITLYLGAVV

SEQ ID NO: 72691 - protein, 11 aa, Dengue virus
VITLYLGAVVQ

SEQ ID NO: 72692 - protein, 11 aa, Dengue virus
ITLYLGTVVQA

SEQ ID NO: 72693 - protein, 11 aa, Dengue virus
TLYLGTVVQAD

SEQ ID NO: 72694 - protein, 11 aa, Dengue virus
LYLGAVVQADT

SEQ ID NO: 72695 - protein, 11 aa, Dengue virus
YLGAVVQADTG

SEQ ID NO: 72696 - protein, 11 aa, Dengue virus
LGAVVQADTGC

SEQ ID NO: 72697 - protein, 11 aa, Dengue virus
GAVVQADTGCV

SEQ ID NO: 72698 - protein, 11 aa, Dengue virus
VVQADTGCVIN

SEQ ID NO: 72699 - protein, 11 aa, Dengue virus
VQADTGCVINW

SEQ ID NO: 72700 - protein, 11 aa, Dengue virus
QADTGCVINWK

SEQ ID NO: 72701 - protein, 11 aa, Dengue virus
ADTGCVINWKG

SEQ ID NO: 72702 - protein, 11 aa, Dengue virus
DTGCVINWKGK

SEQ ID NO: 72703 - protein, 11 aa, Dengue virus
TGCVINWKGKE

SEQ ID NO: 72704 - protein, 11 aa, Dengue virus
GCAINWKGKEL

SEQ ID NO: 72705 - protein, 11 aa, Dengue virus
CAINWKGKELK

SEQ ID NO: 72706 - protein, 11 aa, Dengue virus
AINWKGKELKC

SEQ ID NO: 72707 - protein, 11 aa, Dengue virus
VNWKGKELKCG

SEQ ID NO: 72708 - protein, 11 aa, Dengue virus
NWKGKELKCGN

SEQ ID NO: 72709 - protein, 11 aa, Dengue virus
WKGKELKCGNG

SEQ ID NO: 72710 - protein, 11 aa, Dengue virus
KGKELKCGNGI

SEQ ID NO: 72711 - protein, 11 aa, Dengue virus
GKELKCGNGIF

SEQ ID NO: 72712 - protein, 11 aa, Dengue virus
KELKCGNGIFV

SEQ ID NO: 72713 - protein, 11 aa, Dengue virus
ELKCGNGIFVT

SEQ ID NO: 72714 - protein, 11 aa, Dengue virus
LKCGNGIFVTN

SEQ ID NO: 72715 - protein, 11 aa, Dengue virus
KCGNGIFVTNE

SEQ ID NO: 72716 - protein, 11 aa, Dengue virus
CGNGIFVTNEV

SEQ ID NO: 72717 - protein, 11 aa, Dengue virus
GNGIFVTNEVH

SEQ ID NO: 72718 - protein, 11 aa, Dengue virus
NGIFVTNEVHT

SEQ ID NO: 72719 - protein, 11 aa, Dengue virus
TRMENLLWKQV

SEQ ID NO: 72720 - protein, 11 aa, Dengue virus
RMENLLWKQVA

SEQ ID NO: 72721 - protein, 11 aa, Dengue virus
MENLLWKQVAN

SEQ ID NO: 72722 - protein, 11 aa, Dengue virus
ENLLWKQVANE

SEQ ID NO: 72723 - protein, 11 aa, Dengue virus
NLLWKQVANEL

SEQ ID NO: 72724 - protein, 11 aa, Dengue virus
LLWKQVANELN

SEQ ID NO: 72725 - protein, 11 aa, Dengue virus
LWKQVANELNY

SEQ ID NO: 72726 - protein, 11 aa, Dengue virus
WKQVANELNYI

SEQ ID NO: 72727 - protein, 11 aa, Dengue virus
KQVANELNYIL

SEQ ID NO: 72728 - protein, 11 aa, Dengue virus
QVANELNYILW

SEQ ID NO: 72729 - protein, 11 aa, Dengue virus
VANELNYILWE

SEQ ID NO: 72730 - protein, 11 aa, Dengue virus
NELNYILWENS

SEQ ID NO: 72731 - protein, 11 aa, Dengue virus
ELNYILWENNV

SEQ ID NO: 72732 - protein, 11 aa, Dengue virus
LNYILWENNVK

SEQ ID NO: 72733 - protein, 11 aa, Dengue virus
NYILWENNVKL

SEQ ID NO: 72734 - protein, 11 aa, Dengue virus
YILWENNVKLT

SEQ ID NO: 72735 - protein, 11 aa, Dengue virus
ILWENNIKLTI

SEQ ID NO: 72736 - protein, 11 aa, Dengue virus
LWENNIKLTIV

SEQ ID NO: 72737 - protein, 11 aa, Dengue virus
WENNIKLTIVV

SEQ ID NO: 72738 - protein, 11 aa, Dengue virus
ENNIKLTIVVG

SEQ ID NO: 72739 - protein, 11 aa, Dengue virus
NNIKLTIVVGD

SEQ ID NO: 72740 - protein, 11 aa, Dengue virus
NIKLTVVVGDT

SEQ ID NO: 72741 - protein, 11 aa, Dengue virus
IGILEQGKRTL

SEQ ID NO: 72742 - protein, 11 aa, Dengue virus
GILEQGKRTLT

SEQ ID NO: 72743 - protein, 11 aa, Dengue virus
ILEQGKRTLTP

SEQ ID NO: 72744 - protein, 11 aa, Dengue virus
LEQGKRALTPQ

SEQ ID NO: 72745 - protein, 11 aa, Dengue virus
EQGKRALTPQP

SEQ ID NO: 72746 - protein, 11 aa, Dengue virus
QGKRALTPQPM

SEQ ID NO: 72747 - protein, 11 aa, Dengue virus
GKRALTPQPME

SEQ ID NO: 72748 - protein, 11 aa, Dengue virus
KRALTPQPMEL

SEQ ID NO: 72749 - protein, 11 aa, Dengue virus
RALTPQPMELK

SEQ ID NO: 72750 - protein, 11 aa, Dengue virus
ALTPQPMELKY

SEQ ID NO: 72751 - protein, 11 aa, Dengue virus
LTLQPMELKYS

SEQ ID NO: 72752 - protein, 11 aa, Dengue virus
TLQPMELKYSW

SEQ ID NO: 72753 - protein, 11 aa, Dengue virus
QPMELKYSWKA

SEQ ID NO: 72754 - protein, 11 aa, Dengue virus
PMELKYSWKAW

SEQ ID NO: 72755 - protein, 11 aa, Dengue virus
MELKYSWKAWG

SEQ ID NO: 72756 - protein, 11 aa, Dengue virus
ELKYSWKAWGK

SEQ ID NO: 72757 - protein, 11 aa, Dengue virus
LKYSWKAWGKA

SEQ ID NO: 72758 - protein, 11 aa, Dengue virus
KYSWKTWGKAR

SEQ ID NO: 72759 - protein, 11 aa, Dengue virus
YSWKTWGKARI

SEQ ID NO: 72760 - protein, 11 aa, Dengue virus
SWKTWGKARIV

SEQ ID NO: 72761 - protein, 11 aa, Dengue virus
AEIQNSSFIID

SEQ ID NO: 72762 - protein, 11 aa, Dengue virus
EIQNSSFIIDG

SEQ ID NO: 72763 - protein, 11 aa, Dengue virus
IQNSSFIIDGP

SEQ ID NO: 72764 - protein, 11 aa, Dengue virus
QNSSFIIDGPS

SEQ ID NO: 72765 - protein, 11 aa, Dengue virus
NSSFIIDGPST

SEQ ID NO: 72766 - protein, 11 aa, Dengue virus
SSFIIDGPSTP

SEQ ID NO: 72767 - protein, 11 aa, Dengue virus
SFIIDGPSTPE

SEQ ID NO: 72768 - protein, 11 aa, Dengue virus
FIIDGPSTPEC

SEQ ID NO: 72769 - protein, 11 aa, Dengue virus
IIDGPSTPECP

SEQ ID NO: 72770 - protein, 11 aa, Dengue virus
IDGPNTPECPN

SEQ ID NO: 72771 - protein, 11 aa, Dengue virus
DGPNTPECPNA

SEQ ID NO: 72772 - protein, 11 aa, Dengue virus
PNASRAWNVWE

SEQ ID NO: 72773 - protein, 11 aa, Dengue virus
NASRAWNVWEV

SEQ ID NO: 72774 - protein, 11 aa, Dengue virus
VSRAWNVWEVE

SEQ ID NO: 72775 - protein, 11 aa, Dengue virus
LRAWNVWEVED

SEQ ID NO: 72776 - protein, 11 aa, Dengue virus
TTNIWLKLREM

SEQ ID NO: 72777 - protein, 11 aa, Dengue virus
TNIWLKLREMY

SEQ ID NO: 72778 - protein, 11 aa, Dengue virus
NIWLKLREMYT

SEQ ID NO: 72779 - protein, 11 aa, Dengue virus
IWLKLREMYTQ

SEQ ID NO: 72780 - protein, 11 aa, Dengue virus
TQSCDHRLMSA

SEQ ID NO: 72781 - protein, 11 aa, Dengue virus
QSCDHRLMSAA

SEQ ID NO: 72782 - protein, 11 aa, Dengue virus
SCDHRLMSAAI

SEQ ID NO: 72783 - protein, 11 aa, Dengue virus
CDHRLMSAAIK

SEQ ID NO: 72784 - protein, 11 aa, Dengue virus
DHRLMSAAIKD

SEQ ID NO: 72785 - protein, 11 aa, Dengue virus
HRLMSAAIKDE

SEQ ID NO: 72786 - protein, 11 aa, Dengue virus
RLMSAAIKDER

SEQ ID NO: 72787 - protein, 11 aa, Dengue virus
LMSAAIKDERA

SEQ ID NO: 72788 - protein, 11 aa, Dengue virus
MSAAIKDERAV

SEQ ID NO: 72789 - protein, 11 aa, Dengue virus
SAAIKDERAVH

SEQ ID NO: 72790 - protein, 11 aa, Dengue virus
AAIKDERAVHA

SEQ ID NO: 72791 - protein, 11 aa, Dengue virus
AIKDERAVHAD

SEQ ID NO: 72792 - protein, 11 aa, Dengue virus
IKDERAVHADM

SEQ ID NO: 72793 - protein, 11 aa, Dengue virus
NGSWKLEKASF

SEQ ID NO: 72794 - protein, 11 aa, Dengue virus
GSWKLEKASFI

SEQ ID NO: 72795 - protein, 11 aa, Dengue virus
SWKLEKASFIE

SEQ ID NO: 72796 - protein, 11 aa, Dengue virus
WKLEKASFIEV

SEQ ID NO: 72797 - protein, 11 aa, Dengue virus
KLEKASFIEVK

SEQ ID NO: 72798 - protein, 11 aa, Dengue virus
LEKASFIEVKT

SEQ ID NO: 72799 - protein, 11 aa, Dengue virus
EKASFIEVKTC

SEQ ID NO: 72800 - protein, 11 aa, Dengue virus
KASFIEVKTCT

SEQ ID NO: 72801 - protein, 11 aa, Dengue virus
ASFIEVKTCTW

SEQ ID NO: 72802 - protein, 11 aa, Dengue virus
SFIEVKTCTWP

SEQ ID NO: 72803 - protein, 11 aa, Dengue virus
FIEVKTCTWPK

SEQ ID NO: 72804 - protein, 11 aa, Dengue virus
TNGVLESDMII

SEQ ID NO: 72805 - protein, 11 aa, Dengue virus
SLAGPISQHNH

SEQ ID NO: 72806 - protein, 11 aa, Dengue virus
LAGPISQHNHR

SEQ ID NO: 72807 - protein, 11 aa, Dengue virus
AGPISQHNHRP

SEQ ID NO: 72808 - protein, 11 aa, Dengue virus
GPISQHNHRPG

SEQ ID NO: 72809 - protein, 11 aa, Dengue virus
PISQHNHRPGY

SEQ ID NO: 72810 - protein, 11 aa, Dengue virus
ISQHNHRPGYH

SEQ ID NO: 72811 - protein, 11 aa, Dengue virus
SQHNHRPGYHT

SEQ ID NO: 72812 - protein, 11 aa, Dengue virus
QHNHRPGYHTQ

SEQ ID NO: 72813 - protein, 11 aa, Dengue virus
HNHRPGYHTQT

SEQ ID NO: 72814 - protein, 11 aa, Dengue virus
NHRPGYHTQTA

SEQ ID NO: 72815 - protein, 11 aa, Dengue virus
HRPGYHTQTAG

SEQ ID NO: 72816 - protein, 11 aa, Dengue virus
RPGYYTQTAGP

SEQ ID NO: 72817 - protein, 11 aa, Dengue virus
PGYYTQTAGPW

SEQ ID NO: 72818 - protein, 11 aa, Dengue virus
GYYTQTAGPWH

SEQ ID NO: 72819 - protein, 11 aa, Dengue virus
YYTQTAGPWHL

SEQ ID NO: 72820 - protein, 11 aa, Dengue virus
YTQTAGPWHLG

SEQ ID NO: 72821 - protein, 11 aa, Dengue virus
TAGPWHLGKLD

SEQ ID NO: 72822 - protein, 11 aa, Dengue virus
AGPWHLGKLDL

SEQ ID NO: 72823 - protein, 11 aa, Dengue virus
NYCEGTTVVIA

SEQ ID NO: 72824 - protein, 11 aa, Dengue virus
YCEGTTVVIAE

SEQ ID NO: 72825 - protein, 11 aa, Dengue virus
CEGTTVVITES

SEQ ID NO: 72826 - protein, 11 aa, Dengue virus
EGTTVVITESC

SEQ ID NO: 72827 - protein, 11 aa, Dengue virus
GTTVVITESCG

SEQ ID NO: 72828 - protein, 11 aa, Dengue virus
TTVVITESCGT

SEQ ID NO: 72829 - protein, 11 aa, Dengue virus
CGTRGPSLRAT

SEQ ID NO: 72830 - protein, 11 aa, Dengue virus
GTRRPSLRTTT

SEQ ID NO: 72831 - protein, 11 aa, Dengue virus
TGGPSLRTTTV

SEQ ID NO: 72832 - protein, 11 aa, Dengue virus
RGPALRTTTVS

SEQ ID NO: 72833 - protein, 11 aa, Dengue virus
GCWYGMEIRPV

SEQ ID NO: 72834 - protein, 11 aa, Dengue virus
CWYGMEIRPIN

SEQ ID NO: 72835 - protein, 11 aa, Dengue virus
WYGMEIRPINE

SEQ ID NO: 72836 - protein, 11 aa, Dengue virus
YGMEIRPINEK

SEQ ID NO: 72837 - protein, 11 aa, Dengue virus
GMEIRPINEKE

SEQ ID NO: 72838 - protein, 11 aa, Dengue virus
MEIRPINEKEE

SEQ ID NO: 72839 - protein, 11 aa, Dengue virus
EIRPINEKEEN

SEQ ID NO: 72840 - protein, 11 aa, Dengue virus
IRPINEKEENM

SEQ ID NO: 72841 - protein, 11 aa, Dengue virus
RPINEKEENMV

SEQ ID NO: 72842 - protein, 11 aa, Dengue virus
PINEKEENMVK

SEQ ID NO: 72843 - protein, 11 aa, Dengue virus
INEKEENMVKS

SEQ ID NO: 72844 - protein, 11 aa, Dengue virus
NEKEENMVKSL

SEQ ID NO: 72845 - protein, 11 aa, Dengue virus
EKEENMVKSLA

SEQ ID NO: 72846 - protein, 11 aa, Dengue virus
KEENMVKSLAS

SEQ ID NO: 72847 - protein, 11 aa, Dengue virus
EENMVKSLASA

SEQ ID NO: 72848 - protein, 11 aa, Dengue virus
ENMVKSLASAG

SEQ ID NO: 72849 - protein, 11 aa, Dengue virus
NMVKSLASAGS

SEQ ID NO: 72850 - protein, 11 aa, Dengue virus
MVKSLASAGSG

SEQ ID NO: 72851 - protein, 11 aa, Dengue virus
VKSLVSAGSGE

SEQ ID NO: 72852 - protein, 11 aa, Dengue virus
KSLVSAGSGEV

SEQ ID NO: 72853 - protein, 11 aa, Dengue virus
SLVSAGSGEVD

SEQ ID NO: 72854 - protein, 11 aa, Dengue virus
LVSAGSGEVDN

SEQ ID NO: 72855 - protein, 11 aa, Dengue virus
VSAGSGEVDNF

SEQ ID NO: 72856 - protein, 11 aa, Dengue virus
SAGSGEVDNFT

SEQ ID NO: 72857 - protein, 11 aa, Dengue virus
AGSGEVDNFTM

SEQ ID NO: 72858 - protein, 11 aa, Dengue virus
GSGEVDNFTMG

SEQ ID NO: 72859 - protein, 11 aa, Dengue virus
MDNFTMGILCL

SEQ ID NO: 72860 - protein, 11 aa, Dengue virus
DNFTMGILCLA

SEQ ID NO: 72861 - protein, 11 aa, Dengue virus
NFTMGILCLAI

SEQ ID NO: 72862 - protein, 11 aa, Dengue virus
FTMGILCLAIL

SEQ ID NO: 72863 - protein, 11 aa, Dengue virus
TMGILCLAILF

SEQ ID NO: 72864 - protein, 11 aa, Dengue virus
MGILCLAILFE

SEQ ID NO: 72865 - protein, 11 aa, Dengue virus
GILCLAILFEE

SEQ ID NO: 72866 - protein, 11 aa, Dengue virus
ILCLAILFEEV

SEQ ID NO: 72867 - protein, 11 aa, Dengue virus
LCLAILFEEVL

SEQ ID NO: 72868 - protein, 11 aa, Dengue virus
CLAILFEEVLR

SEQ ID NO: 72869 - protein, 11 aa, Dengue virus
LAILFEEVLRG

SEQ ID NO: 72870 - protein, 11 aa, Dengue virus
AILFEEVLRGK

SEQ ID NO: 72871 - protein, 11 aa, Dengue virus
ILFEEVLRGKF

SEQ ID NO: 72872 - protein, 11 aa, Dengue virus
LFEEVLRGKFG

SEQ ID NO: 72873 - protein, 11 aa, Dengue virus
FEEVLRGKFGK

SEQ ID NO: 72874 - protein, 11 aa, Dengue virus
EEVLRGKFGKK

SEQ ID NO: 72875 - protein, 11 aa, Dengue virus
EVLRGKFGKKH

SEQ ID NO: 72876 - protein, 11 aa, Dengue virus
VLRGKFGKKHM

SEQ ID NO: 72877 - protein, 11 aa, Dengue virus
RGKFGKKHMIV

SEQ ID NO: 72878 - protein, 11 aa, Dengue virus
GKFGKKHMIVG

SEQ ID NO: 72879 - protein, 11 aa, Dengue virus
KFGKKHMIVGV

SEQ ID NO: 72880 - protein, 11 aa, Dengue virus
FMFVLLLSGQI

SEQ ID NO: 72881 - protein, 11 aa, Dengue virus
MFVLLLSGQIT

SEQ ID NO: 72882 - protein, 11 aa, Dengue virus
FVLLLSGQIIW

SEQ ID NO: 72883 - protein, 11 aa, Dengue virus
ALLLSGQITWR

SEQ ID NO: 72884 - protein, 11 aa, Dengue virus
LLSGQITWRDL

SEQ ID NO: 72885 - protein, 11 aa, Dengue virus
LSGQITWRDMT

SEQ ID NO: 72886 - protein, 11 aa, Dengue virus
TFIMIGSNASD

SEQ ID NO: 72887 - protein, 11 aa, Dengue virus
FIMIGSNASDR

SEQ ID NO: 72888 - protein, 11 aa, Dengue virus
IMIGSNASDKM

SEQ ID NO: 72889 - protein, 11 aa, Dengue virus
MIGSNASDKMG

SEQ ID NO: 72890 - protein, 11 aa, Dengue virus
IGSNATDRMGM

SEQ ID NO: 72891 - protein, 11 aa, Dengue virus
GSNASDKMGMG

SEQ ID NO: 72892 - protein, 11 aa, Dengue virus
SNASDKMGMGV

SEQ ID NO: 72893 - protein, 11 aa, Dengue virus
NASDKMGMGVT

SEQ ID NO: 72894 - protein, 11 aa, Dengue virus
ASDKMGMGVTY

SEQ ID NO: 72895 - protein, 11 aa, Dengue virus
TDRMGMGVTYL

SEQ ID NO: 72896 - protein, 11 aa, Dengue virus
DKMGMGVTYLA

SEQ ID NO: 72897 - protein, 11 aa, Dengue virus
KMGMGVTYLAL

SEQ ID NO: 72898 - protein, 11 aa, Dengue virus
MGMGVTHLALI

SEQ ID NO: 72899 - protein, 11 aa, Dengue virus
MGVTHLALIAT

SEQ ID NO: 72900 - protein, 11 aa, Dengue virus
GVTHLALIATF

SEQ ID NO: 72901 - protein, 11 aa, Dengue virus
VTHLALIATFK

SEQ ID NO: 72902 - protein, 11 aa, Dengue virus
THLALIATFKI

SEQ ID NO: 72903 - protein, 11 aa, Dengue virus
HLALIATFKIQ

SEQ ID NO: 72904 - protein, 11 aa, Dengue virus
ALIATFKIQPL

SEQ ID NO: 72905 - protein, 11 aa, Dengue virus
LIATFKIQPLL

SEQ ID NO: 72906 - protein, 11 aa, Dengue virus
IATFKIQPLLA

SEQ ID NO: 72907 - protein, 11 aa, Dengue virus
ATFKIQPLLAL

SEQ ID NO: 72908 - protein, 11 aa, Dengue virus
TFKIQPLLALG

SEQ ID NO: 72909 - protein, 11 aa, Dengue virus
FKIQPLLALGF

SEQ ID NO: 72910 - protein, 11 aa, Dengue virus
KIQPLLALGFF

SEQ ID NO: 72911 - protein, 11 aa, Dengue virus
IQPLLALGFFL

SEQ ID NO: 72912 - protein, 11 aa, Dengue virus
QPLLALGFFLR

SEQ ID NO: 72913 - protein, 11 aa, Dengue virus
PLLALGFFLRK

SEQ ID NO: 72914 - protein, 11 aa, Dengue virus
LLALGFFLRKL

SEQ ID NO: 72915 - protein, 11 aa, Dengue virus
LLLGVGLAMAA

SEQ ID NO: 72916 - protein, 11 aa, Dengue virus
LLGVGLAMAAT

SEQ ID NO: 72917 - protein, 11 aa, Dengue virus
LGVGLAMAATL

SEQ ID NO: 72918 - protein, 11 aa, Dengue virus
GVGLAMAATLR

SEQ ID NO: 72919 - protein, 11 aa, Dengue virus
VGLAMAATLRL

SEQ ID NO: 72920 - protein, 11 aa, Dengue virus
GLAMAATLRLP

SEQ ID NO: 72921 - protein, 11 aa, Dengue virus
LAMAATLRLPE

SEQ ID NO: 72922 - protein, 11 aa, Dengue virus
AMAATLRLPED

SEQ ID NO: 72923 - protein, 11 aa, Dengue virus
MAATLRLPEDI

SEQ ID NO: 72924 - protein, 11 aa, Dengue virus
AATLRLPEDIE

SEQ ID NO: 72925 - protein, 11 aa, Dengue virus
ATLRLPEDIEQ

SEQ ID NO: 72926 - protein, 11 aa, Dengue virus
TLRLPEDIEQM

SEQ ID NO: 72927 - protein, 11 aa, Dengue virus
LRLPEDIEQMA

SEQ ID NO: 72928 - protein, 11 aa, Dengue virus
RLPEDIEQMAN

SEQ ID NO: 72929 - protein, 11 aa, Dengue virus
PEDIEQMANGV

SEQ ID NO: 72930 - protein, 11 aa, Dengue virus
EDIEQMANGVA

SEQ ID NO: 72931 - protein, 11 aa, Dengue virus
MANGIALGLMT

SEQ ID NO: 72932 - protein, 11 aa, Dengue virus
ANGIALGLMTL

SEQ ID NO: 72933 - protein, 11 aa, Dengue virus
NGIALGLMTLK

SEQ ID NO: 72934 - protein, 11 aa, Dengue virus
GIALGLMTLKL

SEQ ID NO: 72935 - protein, 11 aa, Dengue virus
IALGLMTLKLI

SEQ ID NO: 72936 - protein, 11 aa, Dengue virus
ALGLMTLKLIT

SEQ ID NO: 72937 - protein, 11 aa, Dengue virus
LGLMTLKLITQ

SEQ ID NO: 72938 - protein, 11 aa, Dengue virus
GLMTLKLITQF

SEQ ID NO: 72939 - protein, 11 aa, Dengue virus
LMTLKLITQFE

SEQ ID NO: 72940 - protein, 11 aa, Dengue virus
MTLKLITQFET

SEQ ID NO: 72941 - protein, 11 aa, Dengue virus
TLKLITQFETY

SEQ ID NO: 72942 - protein, 11 aa, Dengue virus
LKLTTQFETYQ

SEQ ID NO: 72943 - protein, 11 aa, Dengue virus
KLTTQFETYQL

SEQ ID NO: 72944 - protein, 11 aa, Dengue virus
LTTQFETYQLW

SEQ ID NO: 72945 - protein, 11 aa, Dengue virus
TTQFETYQLWT

SEQ ID NO: 72946 - protein, 11 aa, Dengue virus
TQFETYQLWAA

SEQ ID NO: 72947 - protein, 11 aa, Dengue virus
QFETYQLWAAL

SEQ ID NO: 72948 - protein, 11 aa, Dengue virus
FETYQLWTALV

SEQ ID NO: 72949 - protein, 11 aa, Dengue virus
ETYQLWTALVS

SEQ ID NO: 72950 - protein, 11 aa, Dengue virus
TYQLWTALVSL

SEQ ID NO: 72951 - protein, 11 aa, Dengue virus
YQLWTALVSLT

SEQ ID NO: 72952 - protein, 11 aa, Dengue virus
QLWTALVSLTC

SEQ ID NO: 72953 - protein, 11 aa, Dengue virus
SLTCSNTMFTL

SEQ ID NO: 72954 - protein, 11 aa, Dengue virus
LTCSNTMFTLT

SEQ ID NO: 72955 - protein, 11 aa, Dengue virus
TCSNTMFTLTV

SEQ ID NO: 72956 - protein, 11 aa, Dengue virus
CSNTMFTLTVA

SEQ ID NO: 72957 - protein, 11 aa, Dengue virus
SNTMFTLTVAW

SEQ ID NO: 72958 - protein, 11 aa, Dengue virus
NTMFTLTVAWR

SEQ ID NO: 72959 - protein, 11 aa, Dengue virus
TMFTLTVAWRT

SEQ ID NO: 72960 - protein, 11 aa, Dengue virus
MFTLTVAWRTA

SEQ ID NO: 72961 - protein, 11 aa, Dengue virus
AWRTATLILAV

SEQ ID NO: 72962 - protein, 11 aa, Dengue virus
WRTATLILAGI

SEQ ID NO: 72963 - protein, 11 aa, Dengue virus
RTATLILAGIS

SEQ ID NO: 72964 - protein, 11 aa, Dengue virus
TATLILAGISL

SEQ ID NO: 72965 - protein, 11 aa, Dengue virus
ATLILAGISLL

SEQ ID NO: 72966 - protein, 11 aa, Dengue virus
TLILAGISLLP

SEQ ID NO: 72967 - protein, 11 aa, Dengue virus
VSLLPLCQSSS

SEQ ID NO: 72968 - protein, 11 aa, Dengue virus
SLLPLCQSSSM

SEQ ID NO: 72969 - protein, 11 aa, Dengue virus
LLPLCQSSSMR

SEQ ID NO: 72970 - protein, 11 aa, Dengue virus
LPLCQSSSMRK

SEQ ID NO: 72971 - protein, 11 aa, Dengue virus
PLCQSSSMRKT

SEQ ID NO: 72972 - protein, 11 aa, Dengue virus
LCQSSSMRKTD

SEQ ID NO: 72973 - protein, 11 aa, Dengue virus
CQSSSMRKSDW

SEQ ID NO: 72974 - protein, 11 aa, Dengue virus
QSSSMRKSDWL

SEQ ID NO: 72975 - protein, 11 aa, Dengue virus
SSSMRKSDWLP

SEQ ID NO: 72976 - protein, 11 aa, Dengue virus
SSMRKSDWLPM

SEQ ID NO: 72977 - protein, 11 aa, Dengue virus
SMRKTDWLPMA

SEQ ID NO: 72978 - protein, 11 aa, Dengue virus
MRKTDWLPMAV

SEQ ID NO: 72979 - protein, 11 aa, Dengue virus
RKTDWLPMAVA

SEQ ID NO: 72980 - protein, 11 aa, Dengue virus
KTDWLPMAVAA

SEQ ID NO: 72981 - protein, 11 aa, Dengue virus
TDWLPMAVAAM

SEQ ID NO: 72982 - protein, 11 aa, Dengue virus
DWLPMAVAAMG

SEQ ID NO: 72983 - protein, 11 aa, Dengue virus
WLPMAVAAMGV

SEQ ID NO: 72984 - protein, 11 aa, Dengue virus
VAAMGVPSLPL

SEQ ID NO: 72985 - protein, 11 aa, Dengue virus
AAMGVPSLPLF

SEQ ID NO: 72986 - protein, 11 aa, Dengue virus
AMGVPSLPLFI

SEQ ID NO: 72987 - protein, 11 aa, Dengue virus
MGVPSLPLFIF

SEQ ID NO: 72988 - protein, 11 aa, Dengue virus
SLPLFIFSLKD

SEQ ID NO: 72989 - protein, 11 aa, Dengue virus
LPLFIFNLKDT

SEQ ID NO: 72990 - protein, 11 aa, Dengue virus
LKDTPKRRSWP

SEQ ID NO: 72991 - protein, 11 aa, Dengue virus
KDTPKRRSWPL

SEQ ID NO: 72992 - protein, 11 aa, Dengue virus
DTPKRRSWPLN

SEQ ID NO: 72993 - protein, 11 aa, Dengue virus
TPKRRSWPLNE

SEQ ID NO: 72994 - protein, 11 aa, Dengue virus
PKRRSWPLNEG

SEQ ID NO: 72995 - protein, 11 aa, Dengue virus
KRKSWPLNEGV

SEQ ID NO: 72996 - protein, 11 aa, Dengue virus
RKSWPLNEGVM

SEQ ID NO: 72997 - protein, 11 aa, Dengue virus
KSWPLNEGVMA

SEQ ID NO: 72998 - protein, 11 aa, Dengue virus
VGLVSILASSF

SEQ ID NO: 72999 - protein, 11 aa, Dengue virus
GLVSILASSFL

SEQ ID NO: 73000 - protein, 11 aa, Dengue virus
LVSILASSFLR

SEQ ID NO: 73001 - protein, 11 aa, Dengue virus
VSILASSFLRN

SEQ ID NO: 73002 - protein, 11 aa, Dengue virus
SILASSFLRND

SEQ ID NO: 73003 - protein, 11 aa, Dengue virus
ILASSFLRNDV

SEQ ID NO: 73004 - protein, 11 aa, Dengue virus
LASSFLRNDVP

SEQ ID NO: 73005 - protein, 11 aa, Dengue virus
ASSFLRNDVPM

SEQ ID NO: 73006 - protein, 11 aa, Dengue virus
SSFLRNDVPMA

SEQ ID NO: 73007 - protein, 11 aa, Dengue virus
SFLRNDVPMAG

SEQ ID NO: 73008 - protein, 11 aa, Dengue virus
FLRNDVPMAGP

SEQ ID NO: 73009 - protein, 11 aa, Dengue virus
YVITGTSADLI

SEQ ID NO: 73010 - protein, 11 aa, Dengue virus
VITGTSADLIV

SEQ ID NO: 73011 - protein, 11 aa, Dengue virus
ITGTSADLIVE

SEQ ID NO: 73012 - protein, 11 aa, Dengue virus
TGTSADLIVEK

SEQ ID NO: 73013 - protein, 11 aa, Dengue virus
GTSADLIVEKA

SEQ ID NO: 73014 - protein, 11 aa, Dengue virus
TSADLIVEKAA

SEQ ID NO: 73015 - protein, 11 aa, Dengue virus
SADLIVEKAAD

SEQ ID NO: 73016 - protein, 11 aa, Dengue virus
ADITWEEEAEQ

SEQ ID NO: 73017 - protein, 11 aa, Dengue virus
DITWEEEAEQT

SEQ ID NO: 73018 - protein, 11 aa, Dengue virus
ITWEEEAEQTG

SEQ ID NO: 73019 - protein, 11 aa, Dengue virus
EQTGVSHNLMV

SEQ ID NO: 73020 - protein, 11 aa, Dengue virus
QTGVSHNLMVT

SEQ ID NO: 73021 - protein, 11 aa, Dengue virus
TGVSHNLMVTV

SEQ ID NO: 73022 - protein, 11 aa, Dengue virus
GVSHNLMVTVD

SEQ ID NO: 73023 - protein, 11 aa, Dengue virus
VSHNLMVTVDD

SEQ ID NO: 73024 - protein, 11 aa, Dengue virus
SHNLMVTVDDD

SEQ ID NO: 73025 - protein, 11 aa, Dengue virus
HNLMVTVDDDG

SEQ ID NO: 73026 - protein, 11 aa, Dengue virus
NLMVTVDDDGT

SEQ ID NO: 73027 - protein, 11 aa, Dengue virus
LMVTVDDDGTM

SEQ ID NO: 73028 - protein, 11 aa, Dengue virus
MVTVDDDGTMR

SEQ ID NO: 73029 - protein, 11 aa, Dengue virus
VTVDDDGTMRI

SEQ ID NO: 73030 - protein, 11 aa, Dengue virus
TVDDDGTMKIK

SEQ ID NO: 73031 - protein, 11 aa, Dengue virus
VDDDGTMKIKD

SEQ ID NO: 73032 - protein, 11 aa, Dengue virus
DDDGTMKIKDD

SEQ ID NO: 73033 - protein, 11 aa, Dengue virus
DDGTMKIKDDE

SEQ ID NO: 73034 - protein, 11 aa, Dengue virus
DGTMKIKDDET

SEQ ID NO: 73035 - protein, 11 aa, Dengue virus
GTMKIKDDETE

SEQ ID NO: 73036 - protein, 11 aa, Dengue virus
TMKIKDDETEN

SEQ ID NO: 73037 - protein, 11 aa, Dengue virus
MKIKDDETENI

SEQ ID NO: 73038 - protein, 11 aa, Dengue virus
KIKDDETENIL

SEQ ID NO: 73039 - protein, 11 aa, Dengue virus
LKTALLIVSGV

SEQ ID NO: 73040 - protein, 11 aa, Dengue virus
KTALLIVSGVF

SEQ ID NO: 73041 - protein, 11 aa, Dengue virus
TALLIVSGVFP

SEQ ID NO: 73042 - protein, 11 aa, Dengue virus
ALLIVSGVFPY

SEQ ID NO: 73043 - protein, 11 aa, Dengue virus
LLIVSGVFPYS

SEQ ID NO: 73044 - protein, 11 aa, Dengue virus
LIVSGVFPYSI

SEQ ID NO: 73045 - protein, 11 aa, Dengue virus
IVSGVFPYSIP

SEQ ID NO: 73046 - protein, 11 aa, Dengue virus
VSGVFPYSIPA

SEQ ID NO: 73047 - protein, 11 aa, Dengue virus
SGVFPYSIPAT

SEQ ID NO: 73048 - protein, 11 aa, Dengue virus
GVFPYSIPATL

SEQ ID NO: 73049 - protein, 11 aa, Dengue virus
VFPYSIPATLL

SEQ ID NO: 73050 - protein, 11 aa, Dengue virus
TLLVWHTWQKR

SEQ ID NO: 73051 - protein, 11 aa, Dengue virus
LLVWHTWQKRT

SEQ ID NO: 73052 - protein, 11 aa, Dengue virus
LVWHTWQKQTR

SEQ ID NO: 73053 - protein, 11 aa, Dengue virus
VWHTWQKQTRR

SEQ ID NO: 73054 - protein, 11 aa, Dengue virus
WHTWQKQTRRS

SEQ ID NO: 73055 - protein, 11 aa, Dengue virus
HTWQKQTRRSG

SEQ ID NO: 73056 - protein, 11 aa, Dengue virus
TWQKQTRRSGV

SEQ ID NO: 73057 - protein, 11 aa, Dengue virus
WQKQTRRSGVL

SEQ ID NO: 73058 - protein, 11 aa, Dengue virus
QKQTRRSGVLW

SEQ ID NO: 73059 - protein, 11 aa, Dengue virus
KQTRRSGVLWD

SEQ ID NO: 73060 - protein, 11 aa, Dengue virus
QTRRSGVLWDV

SEQ ID NO: 73061 - protein, 11 aa, Dengue virus
TRRSGVLWDVP

SEQ ID NO: 73062 - protein, 11 aa, Dengue virus
RRSGVLWDVPS

SEQ ID NO: 73063 - protein, 11 aa, Dengue virus
LEEGVYRINQQ

SEQ ID NO: 73064 - protein, 11 aa, Dengue virus
EEGVYRINQQG

SEQ ID NO: 73065 - protein, 11 aa, Dengue virus
EGVYRINQQGI

SEQ ID NO: 73066 - protein, 11 aa, Dengue virus
GVYRIKQQGIL

SEQ ID NO: 73067 - protein, 11 aa, Dengue virus
VYRIKQQGILG

SEQ ID NO: 73068 - protein, 11 aa, Dengue virus
YRIKQQGILGK

SEQ ID NO: 73069 - protein, 11 aa, Dengue virus
RIKQQGILGKT

SEQ ID NO: 73070 - protein, 11 aa, Dengue virus
IKQQGILGKTQ

SEQ ID NO: 73071 - protein, 11 aa, Dengue virus
KQQGILGKTQV

SEQ ID NO: 73072 - protein, 11 aa, Dengue virus
QQGILGKTQVG

SEQ ID NO: 73073 - protein, 11 aa, Dengue virus
QGILGKTQVGV

SEQ ID NO: 73074 - protein, 11 aa, Dengue virus
GILGKTQVGVG

SEQ ID NO: 73075 - protein, 11 aa, Dengue virus
ILGKTQVGVGV

SEQ ID NO: 73076 - protein, 11 aa, Dengue virus
LGKTQVGVGVQ

SEQ ID NO: 73077 - protein, 11 aa, Dengue virus
GKTQVGVGIQK

SEQ ID NO: 73078 - protein, 11 aa, Dengue virus
KTQVGVGIQKE

SEQ ID NO: 73079 - protein, 11 aa, Dengue virus
TQVGVGIQKEG

SEQ ID NO: 73080 - protein, 11 aa, Dengue virus
QVGVGIQKEGV

SEQ ID NO: 73081 - protein, 11 aa, Dengue virus
VGVGIQKEGVF

SEQ ID NO: 73082 - protein, 11 aa, Dengue virus
GVGIQKEGVFH

SEQ ID NO: 73083 - protein, 11 aa, Dengue virus
VGIQKEGVFHT

SEQ ID NO: 73084 - protein, 11 aa, Dengue virus
GIQKEGVFHTM

SEQ ID NO: 73085 - protein, 11 aa, Dengue virus
IQKEGVFHTMW

SEQ ID NO: 73086 - protein, 11 aa, Dengue virus
WHVTRGAVLTH

SEQ ID NO: 73087 - protein, 11 aa, Dengue virus
HVTRGAVLTHN

SEQ ID NO: 73088 - protein, 11 aa, Dengue virus
VTRGAVLTHNG

SEQ ID NO: 73089 - protein, 11 aa, Dengue virus
TRGAVLTHNGK

SEQ ID NO: 73090 - protein, 11 aa, Dengue virus
RGAVLTHNGKR

SEQ ID NO: 73091 - protein, 11 aa, Dengue virus
GAVLTHNGKRL

SEQ ID NO: 73092 - protein, 11 aa, Dengue virus
AVLTHNGKRLE

SEQ ID NO: 73093 - protein, 11 aa, Dengue virus
VLTHNGKRLEP

SEQ ID NO: 73094 - protein, 11 aa, Dengue virus
LTHNGKRLEPN

SEQ ID NO: 73095 - protein, 11 aa, Dengue virus
THNGKRLEPNW

SEQ ID NO: 73096 - protein, 11 aa, Dengue virus
HNGKRLEPNWA

SEQ ID NO: 73097 - protein, 11 aa, Dengue virus
NGKRLEPNWAN

SEQ ID NO: 73098 - protein, 11 aa, Dengue virus
GKRLEPNWANV

SEQ ID NO: 73099 - protein, 11 aa, Dengue virus
KRLEPNWANVK

SEQ ID NO: 73100 - protein, 11 aa, Dengue virus
RLEPNWANVKK

SEQ ID NO: 73101 - protein, 11 aa, Dengue virus
LEPNWANVKKD

SEQ ID NO: 73102 - protein, 11 aa, Dengue virus
EPNWANVKKDL

SEQ ID NO: 73103 - protein, 11 aa, Dengue virus
PNWANVKKDLI

SEQ ID NO: 73104 - protein, 11 aa, Dengue virus
NWANVKKDLIS

SEQ ID NO: 73105 - protein, 11 aa, Dengue virus
WANVKKDLISY

SEQ ID NO: 73106 - protein, 11 aa, Dengue virus
ANVKKDLISYG

SEQ ID NO: 73107 - protein, 11 aa, Dengue virus
NVKKDLISYGG

SEQ ID NO: 73108 - protein, 11 aa, Dengue virus
KDLISYGGGWK

SEQ ID NO: 73109 - protein, 11 aa, Dengue virus
DLISYGGGWKL

SEQ ID NO: 73110 - protein, 11 aa, Dengue virus
LISYGGGWRLN

SEQ ID NO: 73111 - protein, 11 aa, Dengue virus
ISYGGGWRLNA

SEQ ID NO: 73112 - protein, 11 aa, Dengue virus
SYGGGWRLNAQ

SEQ ID NO: 73113 - protein, 11 aa, Dengue virus
YGGGWRLNAQW

SEQ ID NO: 73114 - protein, 11 aa, Dengue virus
GGGWRLNAQWQ

SEQ ID NO: 73115 - protein, 11 aa, Dengue virus
GGWRLNAQWQK

SEQ ID NO: 73116 - protein, 11 aa, Dengue virus
GWRLNAQWQKG

SEQ ID NO: 73117 - protein, 11 aa, Dengue virus
WRLNAQWQKGE

SEQ ID NO: 73118 - protein, 11 aa, Dengue virus
RLNAQWQKGEE

SEQ ID NO: 73119 - protein, 11 aa, Dengue virus
LNAQWQKGEEV

SEQ ID NO: 73120 - protein, 11 aa, Dengue virus
NAQWQKGEEVQ

SEQ ID NO: 73121 - protein, 11 aa, Dengue virus
TQWQKGEEVQV

SEQ ID NO: 73122 - protein, 11 aa, Dengue virus
QWKKGEEVQVI

SEQ ID NO: 73123 - protein, 11 aa, Dengue virus
WKKGEEVQVIA

SEQ ID NO: 73124 - protein, 11 aa, Dengue virus
KKGEEVQVIAV

SEQ ID NO: 73125 - protein, 11 aa, Dengue virus
PGKNPKNFQTT

SEQ ID NO: 73126 - protein, 11 aa, Dengue virus
GKNPKNFQTTP

SEQ ID NO: 73127 - protein, 11 aa, Dengue virus
KNPKNFQTTPG

SEQ ID NO: 73128 - protein, 11 aa, Dengue virus
NPKNFQTMPGI

SEQ ID NO: 73129 - protein, 11 aa, Dengue virus
PKNFQTMPGIF

SEQ ID NO: 73130 - protein, 11 aa, Dengue virus
KNFQTMPGIFQ

SEQ ID NO: 73131 - protein, 11 aa, Dengue virus
NFQTMPGIFQT

SEQ ID NO: 73132 - protein, 11 aa, Dengue virus
FQTMPGIFQTT

SEQ ID NO: 73133 - protein, 11 aa, Dengue virus
PGIFQTTTGEI

SEQ ID NO: 73134 - protein, 11 aa, Dengue virus
GIFQTTTGEIG

SEQ ID NO: 73135 - protein, 11 aa, Dengue virus
IFQTTTGEIGA

SEQ ID NO: 73136 - protein, 11 aa, Dengue virus
FQTTMGEIGAI

SEQ ID NO: 73137 - protein, 11 aa, Dengue virus
QTTMGEIGAIA

SEQ ID NO: 73138 - protein, 11 aa, Dengue virus
TTMGEIGAIAL

SEQ ID NO: 73139 - protein, 11 aa, Dengue virus
TMGEIGAIALD

SEQ ID NO: 73140 - protein, 11 aa, Dengue virus
MGEIGAIALDF

SEQ ID NO: 73141 - protein, 11 aa, Dengue virus
GSPIINREGKI

SEQ ID NO: 73142 - protein, 11 aa, Dengue virus
SPIINREGKIV

SEQ ID NO: 73143 - protein, 11 aa, Dengue virus
PIINREGKIVG

SEQ ID NO: 73144 - protein, 11 aa, Dengue virus
IINREGKIVGL

SEQ ID NO: 73145 - protein, 11 aa, Dengue virus
INREGKIVGLY

SEQ ID NO: 73146 - protein, 11 aa, Dengue virus
NREGKIVGLYG

SEQ ID NO: 73147 - protein, 11 aa, Dengue virus
REGKIVGLYGN

SEQ ID NO: 73148 - protein, 11 aa, Dengue virus
EGKIVGLYGNG

SEQ ID NO: 73149 - protein, 11 aa, Dengue virus
GKIVGLYGNGV

SEQ ID NO: 73150 - protein, 11 aa, Dengue virus
KIVGLYGNGVV

SEQ ID NO: 73151 - protein, 11 aa, Dengue virus
IVGLYGNGVVT

SEQ ID NO: 73152 - protein, 11 aa, Dengue virus
GLYGNGVVTKS

SEQ ID NO: 73153 - protein, 11 aa, Dengue virus
LYGNGVVTKSG

SEQ ID NO: 73154 - protein, 11 aa, Dengue virus
YGNGVVTKSGG

SEQ ID NO: 73155 - protein, 11 aa, Dengue virus
GNGVVTKSGGY

SEQ ID NO: 73156 - protein, 11 aa, Dengue virus
NGVVTKSGGYV

SEQ ID NO: 73157 - protein, 11 aa, Dengue virus
GVVTKSGGYVS

SEQ ID NO: 73158 - protein, 11 aa, Dengue virus
VVTKSGGYVSG

SEQ ID NO: 73159 - protein, 11 aa, Dengue virus
VTKSGGYVSGI

SEQ ID NO: 73160 - protein, 11 aa, Dengue virus
AQTNAEPDGPA

SEQ ID NO: 73161 - protein, 11 aa, Dengue virus
QTNAEPDGPAP

SEQ ID NO: 73162 - protein, 11 aa, Dengue virus
TNAEPDGPAPE

SEQ ID NO: 73163 - protein, 11 aa, Dengue virus
NAEPDGPAPEL

SEQ ID NO: 73164 - protein, 11 aa, Dengue virus
PTPELEEEMFR

SEQ ID NO: 73165 - protein, 11 aa, Dengue virus
TPELEEEMFRK

SEQ ID NO: 73166 - protein, 11 aa, Dengue virus
PELEEEMFRKR

SEQ ID NO: 73167 - protein, 11 aa, Dengue virus
ELEEEMFRKRN

SEQ ID NO: 73168 - protein, 11 aa, Dengue virus
LEEEMFRKRNL

SEQ ID NO: 73169 - protein, 11 aa, Dengue virus
EEEMFRKRNLT

SEQ ID NO: 73170 - protein, 11 aa, Dengue virus
EEMFRKRNLTI

SEQ ID NO: 73171 - protein, 11 aa, Dengue virus
EMFRKRNLTIM

SEQ ID NO: 73172 - protein, 11 aa, Dengue virus
MFRKRNLTIMD

SEQ ID NO: 73173 - protein, 11 aa, Dengue virus
FRKRNLTIMDL

SEQ ID NO: 73174 - protein, 11 aa, Dengue virus
RKRNLTIMDLH

SEQ ID NO: 73175 - protein, 11 aa, Dengue virus
GKTRKYLPAII

SEQ ID NO: 73176 - protein, 11 aa, Dengue virus
KTRKYLPAIIR

SEQ ID NO: 73177 - protein, 11 aa, Dengue virus
TRKYLPAIIRE

SEQ ID NO: 73178 - protein, 11 aa, Dengue virus
RKYLPAIIREA

SEQ ID NO: 73179 - protein, 11 aa, Dengue virus
KYLPAIIREAI

SEQ ID NO: 73180 - protein, 11 aa, Dengue virus
YLPAIIREAIK

SEQ ID NO: 73181 - protein, 11 aa, Dengue virus
LPAIIREAIKR

SEQ ID NO: 73182 - protein, 11 aa, Dengue virus
PAIIREAIKRR

SEQ ID NO: 73183 - protein, 11 aa, Dengue virus
AIIREAIKRRL

SEQ ID NO: 73184 - protein, 11 aa, Dengue virus
IIREAIKRRLR

SEQ ID NO: 73185 - protein, 11 aa, Dengue virus
IREAIKRRLRT

SEQ ID NO: 73186 - protein, 11 aa, Dengue virus
LKGLPIRYQTS

SEQ ID NO: 73187 - protein, 11 aa, Dengue virus
KGLPIRYQTSA

SEQ ID NO: 73188 - protein, 11 aa, Dengue virus
GLPIRYQTTAI

SEQ ID NO: 73189 - protein, 11 aa, Dengue virus
LPIRYQTTAIK

SEQ ID NO: 73190 - protein, 11 aa, Dengue virus
PIRYQTTAIKS

SEQ ID NO: 73191 - protein, 11 aa, Dengue virus
IRYQTTAIKSE

SEQ ID NO: 73192 - protein, 11 aa, Dengue virus
RYQTTAIKSEH

SEQ ID NO: 73193 - protein, 11 aa, Dengue virus
YQTTAIKSEHT

SEQ ID NO: 73194 - protein, 11 aa, Dengue virus
QTTAIKSEHTG

SEQ ID NO: 73195 - protein, 11 aa, Dengue virus
TTATKSEHTGK

SEQ ID NO: 73196 - protein, 11 aa, Dengue virus
TATKSEHTGKE

SEQ ID NO: 73197 - protein, 11 aa, Dengue virus
ATKSEHTGKEI

SEQ ID NO: 73198 - protein, 11 aa, Dengue virus
TKSEHTGKEIV

SEQ ID NO: 73199 - protein, 11 aa, Dengue virus
KSEHTGKEIVD

SEQ ID NO: 73200 - protein, 11 aa, Dengue virus
SEHTGKEIVDL

SEQ ID NO: 73201 - protein, 11 aa, Dengue virus
EHTGKEIVDLM

SEQ ID NO: 73202 - protein, 11 aa, Dengue virus
HTGKEIVDLMC

SEQ ID NO: 73203 - protein, 11 aa, Dengue virus
TGKEIVDLMCH

SEQ ID NO: 73204 - protein, 11 aa, Dengue virus
GKEIVDLMCHA

SEQ ID NO: 73205 - protein, 11 aa, Dengue virus
KEIVDLMCHAT

SEQ ID NO: 73206 - protein, 11 aa, Dengue virus
SPVRVPNYNLV

SEQ ID NO: 73207 - protein, 11 aa, Dengue virus
PVRVPNYNLVI

SEQ ID NO: 73208 - protein, 11 aa, Dengue virus
VRVPNYNLVIM

SEQ ID NO: 73209 - protein, 11 aa, Dengue virus
RVPNYNLVIMD

SEQ ID NO: 73210 - protein, 11 aa, Dengue virus
VPNYNLVIMDE

SEQ ID NO: 73211 - protein, 11 aa, Dengue virus
PNYNLVIMDEA

SEQ ID NO: 73212 - protein, 11 aa, Dengue virus
NYNLVIMDEAH

SEQ ID NO: 73213 - protein, 11 aa, Dengue virus
YNLVIMDEAHF

SEQ ID NO: 73214 - protein, 11 aa, Dengue virus
NLVIMDEAHFT

SEQ ID NO: 73215 - protein, 11 aa, Dengue virus
LVIMDEAHFTD

SEQ ID NO: 73216 - protein, 11 aa, Dengue virus
VIMDEAHFTDP

SEQ ID NO: 73217 - protein, 11 aa, Dengue virus
VMDEAHFTDPA

SEQ ID NO: 73218 - protein, 11 aa, Dengue virus
YISTRVGMGET

SEQ ID NO: 73219 - protein, 11 aa, Dengue virus
ISTRVGMGETA

SEQ ID NO: 73220 - protein, 11 aa, Dengue virus
STRVGMGETAA

SEQ ID NO: 73221 - protein, 11 aa, Dengue virus
TRVGMGETAAI

SEQ ID NO: 73222 - protein, 11 aa, Dengue virus
RVGMGETAAIF

SEQ ID NO: 73223 - protein, 11 aa, Dengue virus
VGMGETAAIFM

SEQ ID NO: 73224 - protein, 11 aa, Dengue virus
GMGETAAIFMT

SEQ ID NO: 73225 - protein, 11 aa, Dengue virus
MGETAAIFMTA

SEQ ID NO: 73226 - protein, 11 aa, Dengue virus
GETAAIFMTAT

SEQ ID NO: 73227 - protein, 11 aa, Dengue virus
ETAAIFMTATP

SEQ ID NO: 73228 - protein, 11 aa, Dengue virus
TAAIFMTATPP

SEQ ID NO: 73229 - protein, 11 aa, Dengue virus
FMTATPPGTAE

SEQ ID NO: 73230 - protein, 11 aa, Dengue virus
MTATPPGTAEA

SEQ ID NO: 73231 - protein, 11 aa, Dengue virus
TATPPGTAEAF

SEQ ID NO: 73232 - protein, 11 aa, Dengue virus
ATPPGTAEAFP

SEQ ID NO: 73233 - protein, 11 aa, Dengue virus
TPPGTAEAFPQ

SEQ ID NO: 73234 - protein, 11 aa, Dengue virus
PPGTAEAFPQS

SEQ ID NO: 73235 - protein, 11 aa, Dengue virus
PGTAEAFPQSN

SEQ ID NO: 73236 - protein, 11 aa, Dengue virus
GTAEAFPQSNA

SEQ ID NO: 73237 - protein, 11 aa, Dengue virus
TAEAFPQSNAP

SEQ ID NO: 73238 - protein, 11 aa, Dengue virus
AEAFPQSNAPI

SEQ ID NO: 73239 - protein, 11 aa, Dengue virus
EAFPQSNAPIQ

SEQ ID NO: 73240 - protein, 11 aa, Dengue virus
QSNAPIQDEEK

SEQ ID NO: 73241 - protein, 11 aa, Dengue virus
SNAPIQDEEKD

SEQ ID NO: 73242 - protein, 11 aa, Dengue virus
NAPIQDEEKDI

SEQ ID NO: 73243 - protein, 11 aa, Dengue virus
APIQDEEKDIP

SEQ ID NO: 73244 - protein, 11 aa, Dengue virus
PIQDEEKDIPE

SEQ ID NO: 73245 - protein, 11 aa, Dengue virus
IQDEEKDIPER

SEQ ID NO: 73246 - protein, 11 aa, Dengue virus
QDEEKDIPERS

SEQ ID NO: 73247 - protein, 11 aa, Dengue virus
DEEKDIPERSW

SEQ ID NO: 73248 - protein, 11 aa, Dengue virus
EEKDIPERSWN

SEQ ID NO: 73249 - protein, 11 aa, Dengue virus
EKDIPERSWNS

SEQ ID NO: 73250 - protein, 11 aa, Dengue virus
KDIPERSWNSG

SEQ ID NO: 73251 - protein, 11 aa, Dengue virus
IPERSWNSGND

SEQ ID NO: 73252 - protein, 11 aa, Dengue virus
PERSWNSGNDW

SEQ ID NO: 73253 - protein, 11 aa, Dengue virus
ERSWNSGNDWI

SEQ ID NO: 73254 - protein, 11 aa, Dengue virus
RSWNSGNDWIT

SEQ ID NO: 73255 - protein, 11 aa, Dengue virus
SWNSGNDWITD

SEQ ID NO: 73256 - protein, 11 aa, Dengue virus
WNSGNDWITDF

SEQ ID NO: 73257 - protein, 11 aa, Dengue virus
NSGNEWITDFV

SEQ ID NO: 73258 - protein, 11 aa, Dengue virus
SGNEWITDFVG

SEQ ID NO: 73259 - protein, 11 aa, Dengue virus
GNEWITDFVGK

SEQ ID NO: 73260 - protein, 11 aa, Dengue virus
NEWITDFVGKT

SEQ ID NO: 73261 - protein, 11 aa, Dengue virus
EWITDFVGKTV

SEQ ID NO: 73262 - protein, 11 aa, Dengue virus
WITDFVGKTVW

SEQ ID NO: 73263 - protein, 11 aa, Dengue virus
ITDFVGKTVWF

SEQ ID NO: 73264 - protein, 11 aa, Dengue virus
TDFVGKTVWFV

SEQ ID NO: 73265 - protein, 11 aa, Dengue virus
DFVGKTVWFVP

SEQ ID NO: 73266 - protein, 11 aa, Dengue virus
FVGKTVWFVPS

SEQ ID NO: 73267 - protein, 11 aa, Dengue virus
VGKTVWFVPSI

SEQ ID NO: 73268 - protein, 11 aa, Dengue virus
KTFDTEYQKTR

SEQ ID NO: 73269 - protein, 11 aa, Dengue virus
TFDTEYQKTRL

SEQ ID NO: 73270 - protein, 11 aa, Dengue virus
FDTEYQKTRLN

SEQ ID NO: 73271 - protein, 11 aa, Dengue virus
DTEYQKTRLND

SEQ ID NO: 73272 - protein, 11 aa, Dengue virus
TEYQKTRLNDW

SEQ ID NO: 73273 - protein, 11 aa, Dengue virus
EYQKTRLNDWD

SEQ ID NO: 73274 - protein, 11 aa, Dengue virus
YQKTRLNDWDF

SEQ ID NO: 73275 - protein, 11 aa, Dengue virus
QKTRLNDWDFV

SEQ ID NO: 73276 - protein, 11 aa, Dengue virus
KTRLNDWDFVV

SEQ ID NO: 73277 - protein, 11 aa, Dengue virus
TRLNDWDFVVT

SEQ ID NO: 73278 - protein, 11 aa, Dengue virus
RLNDWDFVVTT

SEQ ID NO: 73279 - protein, 11 aa, Dengue virus
DISEMGANFRA

SEQ ID NO: 73280 - protein, 11 aa, Dengue virus
ISEMGANFRAD

SEQ ID NO: 73281 - protein, 11 aa, Dengue virus
SEMGANFRADR

SEQ ID NO: 73282 - protein, 11 aa, Dengue virus
EMGANFRADRV

SEQ ID NO: 73283 - protein, 11 aa, Dengue virus
MGANFRADRVI

SEQ ID NO: 73284 - protein, 11 aa, Dengue virus
GANFRADRVID

SEQ ID NO: 73285 - protein, 11 aa, Dengue virus
ANFRADRVIDP

SEQ ID NO: 73286 - protein, 11 aa, Dengue virus
NFRADRVIDPR

SEQ ID NO: 73287 - protein, 11 aa, Dengue virus
FRADRVIDPRR

SEQ ID NO: 73288 - protein, 11 aa, Dengue virus
RADRVIDPRRC

SEQ ID NO: 73289 - protein, 11 aa, Dengue virus
VILAGPMPVTV

SEQ ID NO: 73290 - protein, 11 aa, Dengue virus
ILAGPMPVTVA

SEQ ID NO: 73291 - protein, 11 aa, Dengue virus
LAGPMPVTVAS

SEQ ID NO: 73292 - protein, 11 aa, Dengue virus
AGPMPVTVASA

SEQ ID NO: 73293 - protein, 11 aa, Dengue virus
GPMPVTVASAA

SEQ ID NO: 73294 - protein, 11 aa, Dengue virus
PMPVTVASAAQ

SEQ ID NO: 73295 - protein, 11 aa, Dengue virus
MPVTVASAAQR

SEQ ID NO: 73296 - protein, 11 aa, Dengue virus
PVTVASAAQRR

SEQ ID NO: 73297 - protein, 11 aa, Dengue virus
VTVASAAQRRG

SEQ ID NO: 73298 - protein, 11 aa, Dengue virus
TVASAAQRRGR

SEQ ID NO: 73299 - protein, 11 aa, Dengue virus
VASAAQRRGRV

SEQ ID NO: 73300 - protein, 11 aa, Dengue virus
QRRGRVGRNPP

SEQ ID NO: 73301 - protein, 11 aa, Dengue virus
RRGRVGRNPPK

SEQ ID NO: 73302 - protein, 11 aa, Dengue virus
RGRVGRNPPKE

SEQ ID NO: 73303 - protein, 11 aa, Dengue virus
GRVGRNPPKEN

SEQ ID NO: 73304 - protein, 11 aa, Dengue virus
RVGRNPPKEND

SEQ ID NO: 73305 - protein, 11 aa, Dengue virus
VGRNPPKENDQ

SEQ ID NO: 73306 - protein, 11 aa, Dengue virus
GRNPPKENDQY

SEQ ID NO: 73307 - protein, 11 aa, Dengue virus
RNPPKENDQYI

SEQ ID NO: 73308 - protein, 11 aa, Dengue virus
NPPKENDQYIF

SEQ ID NO: 73309 - protein, 11 aa, Dengue virus
PQKENDQYIFM

SEQ ID NO: 73310 - protein, 11 aa, Dengue virus
QKENDQYIFMG

SEQ ID NO: 73311 - protein, 11 aa, Dengue virus
KENDQYIFMGQ

SEQ ID NO: 73312 - protein, 11 aa, Dengue virus
ENDQYIFMGQP

SEQ ID NO: 73313 - protein, 11 aa, Dengue virus
NDQYIFMGQPL

SEQ ID NO: 73314 - protein, 11 aa, Dengue virus
DQYIFMGQPLN

SEQ ID NO: 73315 - protein, 11 aa, Dengue virus
QYIFMGQPLNN

SEQ ID NO: 73316 - protein, 11 aa, Dengue virus
YIFMGQPLNND

SEQ ID NO: 73317 - protein, 11 aa, Dengue virus
IFMGQPLNNDE

SEQ ID NO: 73318 - protein, 11 aa, Dengue virus
FMGQPLNNDED

SEQ ID NO: 73319 - protein, 11 aa, Dengue virus
MGQPLNNDEDH

SEQ ID NO: 73320 - protein, 11 aa, Dengue virus
RRGDLPVWLAY

SEQ ID NO: 73321 - protein, 11 aa, Dengue virus
RGDLPVWLAYK

SEQ ID NO: 73322 - protein, 11 aa, Dengue virus
GDLPVWLAYKV

SEQ ID NO: 73323 - protein, 11 aa, Dengue virus
DLPVWLAYKVA

SEQ ID NO: 73324 - protein, 11 aa, Dengue virus
LPVWLAYKVAS

SEQ ID NO: 73325 - protein, 11 aa, Dengue virus
PVWLAYKVASE

SEQ ID NO: 73326 - protein, 11 aa, Dengue virus
VWLAYKVASEG

SEQ ID NO: 73327 - protein, 11 aa, Dengue virus
WLAYKVASEGI

SEQ ID NO: 73328 - protein, 11 aa, Dengue virus
LAYKVASEGIK

SEQ ID NO: 73329 - protein, 11 aa, Dengue virus
AYKVASEGIKY

SEQ ID NO: 73330 - protein, 11 aa, Dengue virus
YKVASEGIKYT

SEQ ID NO: 73331 - protein, 11 aa, Dengue virus
YTDRKWCFDGE

SEQ ID NO: 73332 - protein, 11 aa, Dengue virus
TDRKWCFDGER

SEQ ID NO: 73333 - protein, 11 aa, Dengue virus
DRKWCFDGERN

SEQ ID NO: 73334 - protein, 11 aa, Dengue virus
RKWCFDGERNN

SEQ ID NO: 73335 - protein, 11 aa, Dengue virus
KWCFDGERNNQ

SEQ ID NO: 73336 - protein, 11 aa, Dengue virus
WCFDGERNNQI

SEQ ID NO: 73337 - protein, 11 aa, Dengue virus
CFDGERNNQIL

SEQ ID NO: 73338 - protein, 11 aa, Dengue virus
FDGERNNQILE

SEQ ID NO: 73339 - protein, 11 aa, Dengue virus
DGERNNQILEE

SEQ ID NO: 73340 - protein, 11 aa, Dengue virus
GERNNQILEEN

SEQ ID NO: 73341 - protein, 11 aa, Dengue virus
ERNNQILEENM

SEQ ID NO: 73342 - protein, 11 aa, Dengue virus
DVEIWTKEGER

SEQ ID NO: 73343 - protein, 11 aa, Dengue virus
VEIWTKEGERK

SEQ ID NO: 73344 - protein, 11 aa, Dengue virus
EIWTKEGERKK

SEQ ID NO: 73345 - protein, 11 aa, Dengue virus
IWTKEGERKKL

SEQ ID NO: 73346 - protein, 11 aa, Dengue virus
WTKEGERKKLR

SEQ ID NO: 73347 - protein, 11 aa, Dengue virus
TKEGERKKLRP

SEQ ID NO: 73348 - protein, 11 aa, Dengue virus
KEGERKKLRPR

SEQ ID NO: 73349 - protein, 11 aa, Dengue virus
EGERKKLRPRW

SEQ ID NO: 73350 - protein, 11 aa, Dengue virus
GERKKLRPRWL

SEQ ID NO: 73351 - protein, 11 aa, Dengue virus
ERKKLRPRWLD

SEQ ID NO: 73352 - protein, 11 aa, Dengue virus
RKKLRPRWLDA

SEQ ID NO: 73353 - protein, 11 aa, Dengue virus
SDPLALKEFKE

SEQ ID NO: 73354 - protein, 11 aa, Dengue virus
DPLALKEFKEF

SEQ ID NO: 73355 - protein, 11 aa, Dengue virus
PLALKEFKEFA

SEQ ID NO: 73356 - protein, 11 aa, Dengue virus
LALKEFKEFAA

SEQ ID NO: 73357 - protein, 11 aa, Dengue virus
ALKEFKEFAAG

SEQ ID NO: 73358 - protein, 11 aa, Dengue virus
LKEFKEFAAGR

SEQ ID NO: 73359 - protein, 11 aa, Dengue virus
KEFKEFAAGRK

SEQ ID NO: 73360 - protein, 11 aa, Dengue virus
EFKEFAAGRKS

SEQ ID NO: 73361 - protein, 11 aa, Dengue virus
FKEFAAGRKSI

SEQ ID NO: 73362 - protein, 11 aa, Dengue virus
KEFAAGRKSIA

SEQ ID NO: 73363 - protein, 11 aa, Dengue virus
EFAAGRKSIAL

SEQ ID NO: 73364 - protein, 11 aa, Dengue virus
FAAGRKSIAFD

SEQ ID NO: 73365 - protein, 11 aa, Dengue virus
AAGRKSIAFDL

SEQ ID NO: 73366 - protein, 11 aa, Dengue virus
AGRKSIAFDLV

SEQ ID NO: 73367 - protein, 11 aa, Dengue virus
GRKSIAFDLVT

SEQ ID NO: 73368 - protein, 11 aa, Dengue virus
RKSIAFDLVTE

SEQ ID NO: 73369 - protein, 11 aa, Dengue virus
KSIAFDLVTEI

SEQ ID NO: 73370 - protein, 11 aa, Dengue virus
SIAFDLVTEIG

SEQ ID NO: 73371 - protein, 11 aa, Dengue virus
IAFDLVTEIGR

SEQ ID NO: 73372 - protein, 11 aa, Dengue virus
AFDLVTEIGRV

SEQ ID NO: 73373 - protein, 11 aa, Dengue virus
FDLVTEIGRVP

SEQ ID NO: 73374 - protein, 11 aa, Dengue virus
DLVTEIGRVPT

SEQ ID NO: 73375 - protein, 11 aa, Dengue virus
LVTEIGRVPTH

SEQ ID NO: 73376 - protein, 11 aa, Dengue virus
VTEIGRVPTHL

SEQ ID NO: 73377 - protein, 11 aa, Dengue virus
TEIGRVPTHLA

SEQ ID NO: 73378 - protein, 11 aa, Dengue virus
EIGRVPTHLAH

SEQ ID NO: 73379 - protein, 11 aa, Dengue virus
IGRVPTHLAHR

SEQ ID NO: 73380 - protein, 11 aa, Dengue virus
GRVPTHLAHRT

SEQ ID NO: 73381 - protein, 11 aa, Dengue virus
RVPTHLAHRTR

SEQ ID NO: 73382 - protein, 11 aa, Dengue virus
VPTHLAHRTRN

SEQ ID NO: 73383 - protein, 11 aa, Dengue virus
PTHLAHRTRNA

SEQ ID NO: 73384 - protein, 11 aa, Dengue virus
THLAHRTRNAL

SEQ ID NO: 73385 - protein, 11 aa, Dengue virus
HLAYRTRNALD

SEQ ID NO: 73386 - protein, 11 aa, Dengue virus
LAYRTRNALDN

SEQ ID NO: 73387 - protein, 11 aa, Dengue virus
AYRTRNALDNL

SEQ ID NO: 73388 - protein, 11 aa, Dengue virus
YRTRNALDNLV

SEQ ID NO: 73389 - protein, 11 aa, Dengue virus
VMLHTSEHGGK

SEQ ID NO: 73390 - protein, 11 aa, Dengue virus
MLHTSEHGGKA

SEQ ID NO: 73391 - protein, 11 aa, Dengue virus
LHTSEHGGKAY

SEQ ID NO: 73392 - protein, 11 aa, Dengue virus
HTSEHGGKAYR

SEQ ID NO: 73393 - protein, 11 aa, Dengue virus
TSEHGGKAYRH

SEQ ID NO: 73394 - protein, 11 aa, Dengue virus
SEHGGKAYRHA

SEQ ID NO: 73395 - protein, 11 aa, Dengue virus
EHGGKAYRHAV

SEQ ID NO: 73396 - protein, 11 aa, Dengue virus
HGGKAYRHAVE

SEQ ID NO: 73397 - protein, 11 aa, Dengue virus
GGKAYRHAVEE

SEQ ID NO: 73398 - protein, 11 aa, Dengue virus
GKAYRHAVEEL

SEQ ID NO: 73399 - protein, 11 aa, Dengue virus
KAYRHAVEELP

SEQ ID NO: 73400 - protein, 11 aa, Dengue virus
LGLMILLTGGV

SEQ ID NO: 73401 - protein, 11 aa, Dengue virus
GLMILLTGGVM

SEQ ID NO: 73402 - protein, 11 aa, Dengue virus
LMILLTGGVML

SEQ ID NO: 73403 - protein, 11 aa, Dengue virus
MILLTGGVMLF

SEQ ID NO: 73404 - protein, 11 aa, Dengue virus
ILLTGGVMLFL

SEQ ID NO: 73405 - protein, 11 aa, Dengue virus
LLTGGVMLFLI

SEQ ID NO: 73406 - protein, 11 aa, Dengue virus
LTGGVMLFLIS

SEQ ID NO: 73407 - protein, 11 aa, Dengue virus
TGGVMLFLISG

SEQ ID NO: 73408 - protein, 11 aa, Dengue virus
GGVMLFLISGK

SEQ ID NO: 73409 - protein, 11 aa, Dengue virus
GVMLFLISGKG

SEQ ID NO: 73410 - protein, 11 aa, Dengue virus
MLFLISGKGVG

SEQ ID NO: 73411 - protein, 11 aa, Dengue virus
LFLISGKGVGK

SEQ ID NO: 73412 - protein, 11 aa, Dengue virus
FLISGKGVGKT

SEQ ID NO: 73413 - protein, 11 aa, Dengue virus
LISGKGVGKTS

SEQ ID NO: 73414 - protein, 11 aa, Dengue virus
ISGKGVGKTSI

SEQ ID NO: 73415 - protein, 11 aa, Dengue virus
SGKGVGKTSIG

SEQ ID NO: 73416 - protein, 11 aa, Dengue virus
GKGVGKTSIGL

SEQ ID NO: 73417 - protein, 11 aa, Dengue virus
KGVGKTSIGLI

SEQ ID NO: 73418 - protein, 11 aa, Dengue virus
GVGKTSIGLIC

SEQ ID NO: 73419 - protein, 11 aa, Dengue virus
VGKTSIGLICV

SEQ ID NO: 73420 - protein, 11 aa, Dengue virus
GKTSIGLICVV

SEQ ID NO: 73421 - protein, 11 aa, Dengue virus
KTSIGLICVIV

SEQ ID NO: 73422 - protein, 11 aa, Dengue virus
TSIGLICVIVS

SEQ ID NO: 73423 - protein, 11 aa, Dengue virus
SIGLICVIVSS

SEQ ID NO: 73424 - protein, 11 aa, Dengue virus
IGLICVIVSSG

SEQ ID NO: 73425 - protein, 11 aa, Dengue virus
GLICVIVSSGM

SEQ ID NO: 73426 - protein, 11 aa, Dengue virus
LICVIVSSGML

SEQ ID NO: 73427 - protein, 11 aa, Dengue virus
ICVIVSSGMLW

SEQ ID NO: 73428 - protein, 11 aa, Dengue virus
CVIVSSGMLWM

SEQ ID NO: 73429 - protein, 11 aa, Dengue virus
VIVSSGMLWMA

SEQ ID NO: 73430 - protein, 11 aa, Dengue virus
SSGMLWMADVP

SEQ ID NO: 73431 - protein, 11 aa, Dengue virus
SGMLWMADVPL

SEQ ID NO: 73432 - protein, 11 aa, Dengue virus
GMLWMADVPLQ

SEQ ID NO: 73433 - protein, 11 aa, Dengue virus
MLWMADVPLQW

SEQ ID NO: 73434 - protein, 11 aa, Dengue virus
LWMADVPLQWI

SEQ ID NO: 73435 - protein, 11 aa, Dengue virus
WMADVPLQWIA

SEQ ID NO: 73436 - protein, 11 aa, Dengue virus
MADVPLQWIAS

SEQ ID NO: 73437 - protein, 11 aa, Dengue virus
ADVPLQWIASA

SEQ ID NO: 73438 - protein, 11 aa, Dengue virus
DVPLQWIASAI

SEQ ID NO: 73439 - protein, 11 aa, Dengue virus
VPLQWIASAIV

SEQ ID NO: 73440 - protein, 11 aa, Dengue virus
PLQWIASAIIL

SEQ ID NO: 73441 - protein, 11 aa, Dengue virus
LQWIASAIILE

SEQ ID NO: 73442 - protein, 11 aa, Dengue virus
QWIASAIILEF

SEQ ID NO: 73443 - protein, 11 aa, Dengue virus
WIASAIILEFF

SEQ ID NO: 73444 - protein, 11 aa, Dengue virus
IASAIILEFFM

SEQ ID NO: 73445 - protein, 11 aa, Dengue virus
ASAIILEFFMM

SEQ ID NO: 73446 - protein, 11 aa, Dengue virus
SAIILEFFMMV

SEQ ID NO: 73447 - protein, 11 aa, Dengue virus
AIILEFFMMVL

SEQ ID NO: 73448 - protein, 11 aa, Dengue virus
IILEFFMMVLL

SEQ ID NO: 73449 - protein, 11 aa, Dengue virus
ILEFFMMVLLI

SEQ ID NO: 73450 - protein, 11 aa, Dengue virus
VVIGILTLAAT

SEQ ID NO: 73451 - protein, 11 aa, Dengue virus
VIGILTLAAIV

SEQ ID NO: 73452 - protein, 11 aa, Dengue virus
IGILTLAAIVA

SEQ ID NO: 73453 - protein, 11 aa, Dengue virus
GILTLAAIVAA

SEQ ID NO: 73454 - protein, 11 aa, Dengue virus
ILTLAAIVAAN

SEQ ID NO: 73455 - protein, 11 aa, Dengue virus
LTLAAIVAANE

SEQ ID NO: 73456 - protein, 11 aa, Dengue virus
TLAAIVAANEM

SEQ ID NO: 73457 - protein, 11 aa, Dengue virus
LAAIVAANEMG

SEQ ID NO: 73458 - protein, 11 aa, Dengue virus
AAIVAANEMGL

SEQ ID NO: 73459 - protein, 11 aa, Dengue virus
AIVAANEMGLL

SEQ ID NO: 73460 - protein, 11 aa, Dengue virus
IVAANEMGLLE

SEQ ID NO: 73461 - protein, 11 aa, Dengue virus
VAANEMGLLET

SEQ ID NO: 73462 - protein, 11 aa, Dengue virus
TANEMGLLETT

SEQ ID NO: 73463 - protein, 11 aa, Dengue virus
NEMGMLETTKR

SEQ ID NO: 73464 - protein, 11 aa, Dengue virus
EMGMLETTKRD

SEQ ID NO: 73465 - protein, 11 aa, Dengue virus
MGMLETTKRDL

SEQ ID NO: 73466 - protein, 11 aa, Dengue virus
GMLETTKRDLG

SEQ ID NO: 73467 - protein, 11 aa, Dengue virus
MLETTKRDLGM

SEQ ID NO: 73468 - protein, 11 aa, Dengue virus
ETTKRDLGMSR

SEQ ID NO: 73469 - protein, 11 aa, Dengue virus
TTKRDLGMSRE

SEQ ID NO: 73470 - protein, 11 aa, Dengue virus
TKRDLGMSREP

SEQ ID NO: 73471 - protein, 11 aa, Dengue virus
KRDLGMSREPG

SEQ ID NO: 73472 - protein, 11 aa, Dengue virus
RDLGMSREPGV

SEQ ID NO: 73473 - protein, 11 aa, Dengue virus
DLGMSKEPGVA

SEQ ID NO: 73474 - protein, 11 aa, Dengue virus
LGMSKEPGVAS

SEQ ID NO: 73475 - protein, 11 aa, Dengue virus
GMSKEPGVASP

SEQ ID NO: 73476 - protein, 11 aa, Dengue virus
EPGVASPTSYL

SEQ ID NO: 73477 - protein, 11 aa, Dengue virus
PGVASPTSYLD

SEQ ID NO: 73478 - protein, 11 aa, Dengue virus
GVASPTSYLDV

SEQ ID NO: 73479 - protein, 11 aa, Dengue virus
VASPTSYLDVD

SEQ ID NO: 73480 - protein, 11 aa, Dengue virus
ASPTSYLDVDL

SEQ ID NO: 73481 - protein, 11 aa, Dengue virus
SSTSYLDVDLH

SEQ ID NO: 73482 - protein, 11 aa, Dengue virus
STSYLDVDLHP

SEQ ID NO: 73483 - protein, 11 aa, Dengue virus
NSYLDVDLHPA

SEQ ID NO: 73484 - protein, 11 aa, Dengue virus
CYSQVNPLTLI

SEQ ID NO: 73485 - protein, 11 aa, Dengue virus
YSQVNPLTLIA

SEQ ID NO: 73486 - protein, 11 aa, Dengue virus
SQVNPLTLTAV

SEQ ID NO: 73487 - protein, 11 aa, Dengue virus
QVNPLTLTAVV

SEQ ID NO: 73488 - protein, 11 aa, Dengue virus
VNPLTLTAVVL

SEQ ID NO: 73489 - protein, 11 aa, Dengue virus
NPLTLTAVVLL

SEQ ID NO: 73490 - protein, 11 aa, Dengue virus
PLTLTAVVLLL

SEQ ID NO: 73491 - protein, 11 aa, Dengue virus
LTLTAAVLLLV

SEQ ID NO: 73492 - protein, 11 aa, Dengue virus
TLTAAVLLLVT

SEQ ID NO: 73493 - protein, 11 aa, Dengue virus
LTAAVLLLVTH

SEQ ID NO: 73494 - protein, 11 aa, Dengue virus
TAAVLLLVTHY

SEQ ID NO: 73495 - protein, 11 aa, Dengue virus
AAVLLLVTHYA

SEQ ID NO: 73496 - protein, 11 aa, Dengue virus
AVLLLVTHYAI

SEQ ID NO: 73497 - protein, 11 aa, Dengue virus
VLLLVTHYAII

SEQ ID NO: 73498 - protein, 11 aa, Dengue virus
LLLVTHYAIIG

SEQ ID NO: 73499 - protein, 11 aa, Dengue virus
LLVTHYAIIGP

SEQ ID NO: 73500 - protein, 11 aa, Dengue virus
LVTHYAIIGPG

SEQ ID NO: 73501 - protein, 11 aa, Dengue virus
VTHYAIIGPGL

SEQ ID NO: 73502 - protein, 11 aa, Dengue virus
LGQVMLLVLCV

SEQ ID NO: 73503 - protein, 11 aa, Dengue virus
GQVMLLVLCAA

SEQ ID NO: 73504 - protein, 11 aa, Dengue virus
QVMLLVLCAAQ

SEQ ID NO: 73505 - protein, 11 aa, Dengue virus
VMLLVLCAAQL

SEQ ID NO: 73506 - protein, 11 aa, Dengue virus
MLLVLCAAQLL

SEQ ID NO: 73507 - protein, 11 aa, Dengue virus
LLVLCAAQLLL

SEQ ID NO: 73508 - protein, 11 aa, Dengue virus
LVLCAAQLLLM

SEQ ID NO: 73509 - protein, 11 aa, Dengue virus
VLCAAQLLLMR

SEQ ID NO: 73510 - protein, 11 aa, Dengue virus
LCAAQLLLMRT

SEQ ID NO: 73511 - protein, 11 aa, Dengue virus
CAAQLLLMRTS

SEQ ID NO: 73512 - protein, 11 aa, Dengue virus
AAQLLLMRTSW

SEQ ID NO: 73513 - protein, 11 aa, Dengue virus
QLLLMRTSWAF

SEQ ID NO: 73514 - protein, 11 aa, Dengue virus
LLLMRTSWAFC

SEQ ID NO: 73515 - protein, 11 aa, Dengue virus
LLMRTSWAFCE

SEQ ID NO: 73516 - protein, 11 aa, Dengue virus
LMRTSWAFCEA

SEQ ID NO: 73517 - protein, 11 aa, Dengue virus
MRTSWAFCEAL

SEQ ID NO: 73518 - protein, 11 aa, Dengue virus
RTSWAFCEALT

SEQ ID NO: 73519 - protein, 11 aa, Dengue virus
TSWAFCEALTL

SEQ ID NO: 73520 - protein, 11 aa, Dengue virus
SWAFCEALTLA

SEQ ID NO: 73521 - protein, 11 aa, Dengue virus
WAFCEALTLAT

SEQ ID NO: 73522 - protein, 11 aa, Dengue virus
AFCEALTLATG

SEQ ID NO: 73523 - protein, 11 aa, Dengue virus
FCEALTLATGP

SEQ ID NO: 73524 - protein, 11 aa, Dengue virus
CEVLTLATGPI

SEQ ID NO: 73525 - protein, 11 aa, Dengue virus
EVLTLATGPIT

SEQ ID NO: 73526 - protein, 11 aa, Dengue virus
VLTLATGPITT

SEQ ID NO: 73527 - protein, 11 aa, Dengue virus
NIFRGSYIAGA

SEQ ID NO: 73528 - protein, 11 aa, Dengue virus
IFRGSYIAGAG

SEQ ID NO: 73529 - protein, 11 aa, Dengue virus
FRGNYLAGAGL

SEQ ID NO: 73530 - protein, 11 aa, Dengue virus
RGSYIAGAGLA

SEQ ID NO: 73531 - protein, 11 aa, Dengue virus
GNYLAGAGLAF

SEQ ID NO: 73532 - protein, 11 aa, Dengue virus
NYLAGAGLAFS

SEQ ID NO: 73533 - protein, 11 aa, Dengue virus
YLAGAGLAFSV

SEQ ID NO: 73534 - protein, 11 aa, Dengue virus
LAGAGLAFSVM

SEQ ID NO: 73535 - protein, 11 aa, Dengue virus
AGAGLAFSVMK

SEQ ID NO: 73536 - protein, 11 aa, Dengue virus
GAGLAFSVMKS

SEQ ID NO: 73537 - protein, 11 aa, Dengue virus
AGLAFSVMKSV

SEQ ID NO: 73538 - protein, 11 aa, Dengue virus
GLAFSVMKSVG

SEQ ID NO: 73539 - protein, 11 aa, Dengue virus
LAFSVMKSVGT

SEQ ID NO: 73540 - protein, 11 aa, Dengue virus
AFSVMKSVGTG

SEQ ID NO: 73541 - protein, 11 aa, Dengue virus
FSIMKSVGTGR

SEQ ID NO: 73542 - protein, 11 aa, Dengue virus
SIMKSVGTGRR

SEQ ID NO: 73543 - protein, 11 aa, Dengue virus
IMKSVGTGRRG

SEQ ID NO: 73544 - protein, 11 aa, Dengue virus
MKSVGTGRRGT

SEQ ID NO: 73545 - protein, 11 aa, Dengue virus
KSVGTGRRGTG

SEQ ID NO: 73546 - protein, 11 aa, Dengue virus
SVGTGRRGTGS

SEQ ID NO: 73547 - protein, 11 aa, Dengue virus
VGTGRRGTGSQ

SEQ ID NO: 73548 - protein, 11 aa, Dengue virus
GTGRRGTGSQG

SEQ ID NO: 73549 - protein, 11 aa, Dengue virus
TGRRGTGSQGE

SEQ ID NO: 73550 - protein, 11 aa, Dengue virus
GRRGTGSQGET

SEQ ID NO: 73551 - protein, 11 aa, Dengue virus
RRGTGSQGETL

SEQ ID NO: 73552 - protein, 11 aa, Dengue virus
QGETLGEKWKR

SEQ ID NO: 73553 - protein, 11 aa, Dengue virus
GETLGEKWKKR

SEQ ID NO: 73554 - protein, 11 aa, Dengue virus
ETLGEKWKKRL

SEQ ID NO: 73555 - protein, 11 aa, Dengue virus
TLGEKWKKRLN

SEQ ID NO: 73556 - protein, 11 aa, Dengue virus
LGEKWKKRLNQ

SEQ ID NO: 73557 - protein, 11 aa, Dengue virus
GEKWKKRLNQL

SEQ ID NO: 73558 - protein, 11 aa, Dengue virus
EKWKKRLNQLS

SEQ ID NO: 73559 - protein, 11 aa, Dengue virus
KWKKRLNQLSR

SEQ ID NO: 73560 - protein, 11 aa, Dengue virus
WKKRLNQLSRK

SEQ ID NO: 73561 - protein, 11 aa, Dengue virus
KLNQLSRKDFD

SEQ ID NO: 73562 - protein, 11 aa, Dengue virus
LNQLSRKDFDL

SEQ ID NO: 73563 - protein, 11 aa, Dengue virus
NQLSRKDFDLY

SEQ ID NO: 73564 - protein, 11 aa, Dengue virus
QLSRKDFDLYK

SEQ ID NO: 73565 - protein, 11 aa, Dengue virus
LSRKDFDLYKK

SEQ ID NO: 73566 - protein, 11 aa, Dengue virus
SRKDFDLYKKS

SEQ ID NO: 73567 - protein, 11 aa, Dengue virus
RKDFDLYKKSG

SEQ ID NO: 73568 - protein, 11 aa, Dengue virus
KDFDLYKKSGI

SEQ ID NO: 73569 - protein, 11 aa, Dengue virus
DFDLYKKSGIT

SEQ ID NO: 73570 - protein, 11 aa, Dengue virus
KKSGITEVDRI

SEQ ID NO: 73571 - protein, 11 aa, Dengue virus
KSGITEVDRIE

SEQ ID NO: 73572 - protein, 11 aa, Dengue virus
SGITEVDRIEA

SEQ ID NO: 73573 - protein, 11 aa, Dengue virus
GITEVDRIEAK

SEQ ID NO: 73574 - protein, 11 aa, Dengue virus
ITEVDRIEAKE

SEQ ID NO: 73575 - protein, 11 aa, Dengue virus
TEVDRIEAKEG

SEQ ID NO: 73576 - protein, 11 aa, Dengue virus
EVDRIEAKEGL

SEQ ID NO: 73577 - protein, 11 aa, Dengue virus
VDRIEAKEGLK

SEQ ID NO: 73578 - protein, 11 aa, Dengue virus
DRIEAKEGLKR

SEQ ID NO: 73579 - protein, 11 aa, Dengue virus
RIEAKEGLKRG

SEQ ID NO: 73580 - protein, 11 aa, Dengue virus
IEAKEGLKRGE

SEQ ID NO: 73581 - protein, 11 aa, Dengue virus
EAKEGLKRGET

SEQ ID NO: 73582 - protein, 11 aa, Dengue virus
AKEGLKRGETT

SEQ ID NO: 73583 - protein, 11 aa, Dengue virus
RGETTHHAVSR

SEQ ID NO: 73584 - protein, 11 aa, Dengue virus
GETTHHAVSRG

SEQ ID NO: 73585 - protein, 11 aa, Dengue virus
ETTHHAVSRGS

SEQ ID NO: 73586 - protein, 11 aa, Dengue virus
TTHHAVSRGSA

SEQ ID NO: 73587 - protein, 11 aa, Dengue virus
THHAVSRGTAK

SEQ ID NO: 73588 - protein, 11 aa, Dengue virus
HHAVSRGTAKL

SEQ ID NO: 73589 - protein, 11 aa, Dengue virus
HAVSRGTAKLQ

SEQ ID NO: 73590 - protein, 11 aa, Dengue virus
AVSRGTAKLQW

SEQ ID NO: 73591 - protein, 11 aa, Dengue virus
VSRGTAKLQWF

SEQ ID NO: 73592 - protein, 11 aa, Dengue virus
SRGTAKLQWFV

SEQ ID NO: 73593 - protein, 11 aa, Dengue virus
RGTAKLQWFVE

SEQ ID NO: 73594 - protein, 11 aa, Dengue virus
GTAKLQWFVER

SEQ ID NO: 73595 - protein, 11 aa, Dengue virus
TAKLQWFVERN

SEQ ID NO: 73596 - protein, 11 aa, Dengue virus
LQWFVERNMVV

SEQ ID NO: 73597 - protein, 11 aa, Dengue virus
QWFVERNMVVP

SEQ ID NO: 73598 - protein, 11 aa, Dengue virus
WFVERNMVVPE

SEQ ID NO: 73599 - protein, 11 aa, Dengue virus
FVERNMVVPEG

SEQ ID NO: 73600 - protein, 11 aa, Dengue virus
VERNMVVPEGR

SEQ ID NO: 73601 - protein, 11 aa, Dengue virus
ERNMVVPEGRV

SEQ ID NO: 73602 - protein, 11 aa, Dengue virus
RNMVVPEGRVI

SEQ ID NO: 73603 - protein, 11 aa, Dengue virus
NMVVPEGRVID

SEQ ID NO: 73604 - protein, 11 aa, Dengue virus
MVVPEGRVIDL

SEQ ID NO: 73605 - protein, 11 aa, Dengue virus
VVPEGRVIDLG

SEQ ID NO: 73606 - protein, 11 aa, Dengue virus
VPEGRVIDLGC

SEQ ID NO: 73607 - protein, 11 aa, Dengue virus
PVPMSTYGWNL

SEQ ID NO: 73608 - protein, 11 aa, Dengue virus
VPMSTYGWNLV

SEQ ID NO: 73609 - protein, 11 aa, Dengue virus
PMSTYGWNLVK

SEQ ID NO: 73610 - protein, 11 aa, Dengue virus
MSTYGWNLVKL

SEQ ID NO: 73611 - protein, 11 aa, Dengue virus
STYGWNLVKLM

SEQ ID NO: 73612 - protein, 11 aa, Dengue virus
TYGWNLVKLMS

SEQ ID NO: 73613 - protein, 11 aa, Dengue virus
YGWNLVKLMSG

SEQ ID NO: 73614 - protein, 11 aa, Dengue virus
GWNLVKLMSGK

SEQ ID NO: 73615 - protein, 11 aa, Dengue virus
WNLVKLMSGKD

SEQ ID NO: 73616 - protein, 11 aa, Dengue virus
NLVKLMSGKDV

SEQ ID NO: 73617 - protein, 11 aa, Dengue virus
LVKLMSGKDVF

SEQ ID NO: 73618 - protein, 11 aa, Dengue virus
VKLMTGKDVFY

SEQ ID NO: 73619 - protein, 11 aa, Dengue virus
KLMTGKDVFYL

SEQ ID NO: 73620 - protein, 11 aa, Dengue virus
LMTGKDVFYLP

SEQ ID NO: 73621 - protein, 11 aa, Dengue virus
MTGKDVFYLPP

SEQ ID NO: 73622 - protein, 11 aa, Dengue virus
ESSPSPIVEES

SEQ ID NO: 73623 - protein, 11 aa, Dengue virus
SSPSPIVEESR

SEQ ID NO: 73624 - protein, 11 aa, Dengue virus
SPSPIVEESRT

SEQ ID NO: 73625 - protein, 11 aa, Dengue virus
PSPTVEEGRTI

SEQ ID NO: 73626 - protein, 11 aa, Dengue virus
SPTVEEGRTIR

SEQ ID NO: 73627 - protein, 11 aa, Dengue virus
PIVEESRTIRV

SEQ ID NO: 73628 - protein, 11 aa, Dengue virus
IVEESRTIRVL

SEQ ID NO: 73629 - protein, 11 aa, Dengue virus
VEESRTIRVLR

SEQ ID NO: 73630 - protein, 11 aa, Dengue virus
EESRTIRVLRM

SEQ ID NO: 73631 - protein, 11 aa, Dengue virus
ESRTIRVLRMV

SEQ ID NO: 73632 - protein, 11 aa, Dengue virus
GRTIRVLKMVE

SEQ ID NO: 73633 - protein, 11 aa, Dengue virus
RVLKMVEPWLR

SEQ ID NO: 73634 - protein, 11 aa, Dengue virus
VLKMVEPWLRN

SEQ ID NO: 73635 - protein, 11 aa, Dengue virus
LKMVEPWLRNN

SEQ ID NO: 73636 - protein, 11 aa, Dengue virus
KMVEPWLRNNQ

SEQ ID NO: 73637 - protein, 11 aa, Dengue virus
MVEPWLRNNQF

SEQ ID NO: 73638 - protein, 11 aa, Dengue virus
VEPWLRNNQFC

SEQ ID NO: 73639 - protein, 11 aa, Dengue virus
EPWLRNNQFCI

SEQ ID NO: 73640 - protein, 11 aa, Dengue virus
PWLRNNQFCIK

SEQ ID NO: 73641 - protein, 11 aa, Dengue virus
WLRNNQFCIKV

SEQ ID NO: 73642 - protein, 11 aa, Dengue virus
LRNNQFCIKVL

SEQ ID NO: 73643 - protein, 11 aa, Dengue virus
RNNQFCIKVLN

SEQ ID NO: 73644 - protein, 11 aa, Dengue virus
NNQFCIKILNP

SEQ ID NO: 73645 - protein, 11 aa, Dengue virus
NQFCIKILNPY

SEQ ID NO: 73646 - protein, 11 aa, Dengue virus
QFCIKILNPYM

SEQ ID NO: 73647 - protein, 11 aa, Dengue virus
FCIKILNPYMP

SEQ ID NO: 73648 - protein, 11 aa, Dengue virus
CIKVLNPYMPA

SEQ ID NO: 73649 - protein, 11 aa, Dengue virus
IKVLNPYMPAV

SEQ ID NO: 73650 - protein, 11 aa, Dengue virus
KVLNPYMPAVI

SEQ ID NO: 73651 - protein, 11 aa, Dengue virus
VLNPYMPAVIE

SEQ ID NO: 73652 - protein, 11 aa, Dengue virus
LNPYMPAVIEH

SEQ ID NO: 73653 - protein, 11 aa, Dengue virus
NPYMPAVIEHL

SEQ ID NO: 73654 - protein, 11 aa, Dengue virus
PYMPAVIEHLE

SEQ ID NO: 73655 - protein, 11 aa, Dengue virus
YMPAVIEHLER

SEQ ID NO: 73656 - protein, 11 aa, Dengue virus
MPAVIEHLERL

SEQ ID NO: 73657 - protein, 11 aa, Dengue virus
PAVIEHLERLQ

SEQ ID NO: 73658 - protein, 11 aa, Dengue virus
AVIEHLERLQR

SEQ ID NO: 73659 - protein, 11 aa, Dengue virus
VVEHLERLQRK

SEQ ID NO: 73660 - protein, 11 aa, Dengue virus
IEHLERLQRKY

SEQ ID NO: 73661 - protein, 11 aa, Dengue virus
EHLERLQRKYG

SEQ ID NO: 73662 - protein, 11 aa, Dengue virus
HLERLQRKYGG

SEQ ID NO: 73663 - protein, 11 aa, Dengue virus
LERLQRKYGGM

SEQ ID NO: 73664 - protein, 11 aa, Dengue virus
ERLQRKYGGML

SEQ ID NO: 73665 - protein, 11 aa, Dengue virus
RLQRKYGGMLV

SEQ ID NO: 73666 - protein, 11 aa, Dengue virus
LQRKYGGMLVR

SEQ ID NO: 73667 - protein, 11 aa, Dengue virus
QRKYGGMLVRN

SEQ ID NO: 73668 - protein, 11 aa, Dengue virus
RKYGGMLVRNP

SEQ ID NO: 73669 - protein, 11 aa, Dengue virus
KYGGMLVRNPL

SEQ ID NO: 73670 - protein, 11 aa, Dengue virus
YGGMLVRNPLS

SEQ ID NO: 73671 - protein, 11 aa, Dengue virus
WISNGTGNIVS

SEQ ID NO: 73672 - protein, 11 aa, Dengue virus
ISNGTGNIVSS

SEQ ID NO: 73673 - protein, 11 aa, Dengue virus
SNGTGNIVSSV

SEQ ID NO: 73674 - protein, 11 aa, Dengue virus
NGTGNIVSSVN

SEQ ID NO: 73675 - protein, 11 aa, Dengue virus
GTGNIVSSVNM

SEQ ID NO: 73676 - protein, 11 aa, Dengue virus
TGNIVSSVNMV

SEQ ID NO: 73677 - protein, 11 aa, Dengue virus
GNIVSSVNMVS

SEQ ID NO: 73678 - protein, 11 aa, Dengue virus
NIVSSVNMVSR

SEQ ID NO: 73679 - protein, 11 aa, Dengue virus
IVSSVNMVSRL

SEQ ID NO: 73680 - protein, 11 aa, Dengue virus
VSSVNMVSRLL

SEQ ID NO: 73681 - protein, 11 aa, Dengue virus
SSVNMVSRLLL

SEQ ID NO: 73682 - protein, 11 aa, Dengue virus
RLLLNRFTMTY

SEQ ID NO: 73683 - protein, 11 aa, Dengue virus
LLLNRFTMTYR

SEQ ID NO: 73684 - protein, 11 aa, Dengue virus
LLNRFTMTYRR

SEQ ID NO: 73685 - protein, 11 aa, Dengue virus
LNRFTMTYRRP

SEQ ID NO: 73686 - protein, 11 aa, Dengue virus
NRFTMTYRRPT

SEQ ID NO: 73687 - protein, 11 aa, Dengue virus
RFTMTYRRPTI

SEQ ID NO: 73688 - protein, 11 aa, Dengue virus
FTMTYRRPTIE

SEQ ID NO: 73689 - protein, 11 aa, Dengue virus
TMTYRRPTIEK

SEQ ID NO: 73690 - protein, 11 aa, Dengue virus
MTYRRPTIEKD

SEQ ID NO: 73691 - protein, 11 aa, Dengue virus
TYRRPTIEKDV

SEQ ID NO: 73692 - protein, 11 aa, Dengue virus
YRRPTIEKDVD

SEQ ID NO: 73693 - protein, 11 aa, Dengue virus
RKPTIEKDVDL

SEQ ID NO: 73694 - protein, 11 aa, Dengue virus
KPTIEKDVDLG

SEQ ID NO: 73695 - protein, 11 aa, Dengue virus
PTIERDVDLGA

SEQ ID NO: 73696 - protein, 11 aa, Dengue virus
TIERDVDLGAG

SEQ ID NO: 73697 - protein, 11 aa, Dengue virus
IERDVDLGAGT

SEQ ID NO: 73698 - protein, 11 aa, Dengue virus
ERDVDLGAGTR

SEQ ID NO: 73699 - protein, 11 aa, Dengue virus
RDVDLGAGTRH

SEQ ID NO: 73700 - protein, 11 aa, Dengue virus
GTRHVNAEPEI

SEQ ID NO: 73701 - protein, 11 aa, Dengue virus
TRHVNAEPEIP

SEQ ID NO: 73702 - protein, 11 aa, Dengue virus
RHVNAEPEIPN

SEQ ID NO: 73703 - protein, 11 aa, Dengue virus
HVNAEPEIPNM

SEQ ID NO: 73704 - protein, 11 aa, Dengue virus
VNAEPEIPNMD

SEQ ID NO: 73705 - protein, 11 aa, Dengue virus
NAEPEIPNMDV

SEQ ID NO: 73706 - protein, 11 aa, Dengue virus
AEPEIPNMDVI

SEQ ID NO: 73707 - protein, 11 aa, Dengue virus
EPEIPNMDVIG

SEQ ID NO: 73708 - protein, 11 aa, Dengue virus
PEIPNMDVIGE

SEQ ID NO: 73709 - protein, 11 aa, Dengue virus
EIPNMDVIGER

SEQ ID NO: 73710 - protein, 11 aa, Dengue virus
IPNMDVIGERI

SEQ ID NO: 73711 - protein, 11 aa, Dengue virus
PNMDVIGERIR

SEQ ID NO: 73712 - protein, 11 aa, Dengue virus
NMDVIGERIRR

SEQ ID NO: 73713 - protein, 11 aa, Dengue virus
MDVIGERIRRI

SEQ ID NO: 73714 - protein, 11 aa, Dengue virus
DVIGERIRRIK

SEQ ID NO: 73715 - protein, 11 aa, Dengue virus
VIGERIRRIKE

SEQ ID NO: 73716 - protein, 11 aa, Dengue virus
IGERIRRIKEE

SEQ ID NO: 73717 - protein, 11 aa, Dengue virus
GERIRRIKEEH

SEQ ID NO: 73718 - protein, 11 aa, Dengue virus
RIKEEHSSTWH

SEQ ID NO: 73719 - protein, 11 aa, Dengue virus
IKEEHSSTWHY

SEQ ID NO: 73720 - protein, 11 aa, Dengue virus
KEEHSSTWHYD

SEQ ID NO: 73721 - protein, 11 aa, Dengue virus
EEHSSTWHYDD

SEQ ID NO: 73722 - protein, 11 aa, Dengue virus
EHSSTWHYDDE

SEQ ID NO: 73723 - protein, 11 aa, Dengue virus
HSSTWHYDDEN

SEQ ID NO: 73724 - protein, 11 aa, Dengue virus
SSTWHYDDENP

SEQ ID NO: 73725 - protein, 11 aa, Dengue virus
STWHYDEENPY

SEQ ID NO: 73726 - protein, 11 aa, Dengue virus
LLTKPWDVVPT

SEQ ID NO: 73727 - protein, 11 aa, Dengue virus
LTKPWDVVPTV

SEQ ID NO: 73728 - protein, 11 aa, Dengue virus
TKPWDVVPTVT

SEQ ID NO: 73729 - protein, 11 aa, Dengue virus
KPWDVVPTVTQ

SEQ ID NO: 73730 - protein, 11 aa, Dengue virus
PWDVVPTVTQM

SEQ ID NO: 73731 - protein, 11 aa, Dengue virus
WDVVPTVTQMA

SEQ ID NO: 73732 - protein, 11 aa, Dengue virus
DVVPTVTQMAM

SEQ ID NO: 73733 - protein, 11 aa, Dengue virus
VVPTVTQMAMT

SEQ ID NO: 73734 - protein, 11 aa, Dengue virus
VPTVTQMAMTD

SEQ ID NO: 73735 - protein, 11 aa, Dengue virus
PTVTQMAMTDT

SEQ ID NO: 73736 - protein, 11 aa, Dengue virus
TVTQMAMTDTT

SEQ ID NO: 73737 - protein, 11 aa, Dengue virus
VIQMAMTDTTP

SEQ ID NO: 73738 - protein, 11 aa, Dengue virus
IQMAMTDTTPF

SEQ ID NO: 73739 - protein, 11 aa, Dengue virus
FKEKVDTRTPK

SEQ ID NO: 73740 - protein, 11 aa, Dengue virus
KEKVDTRTPRP

SEQ ID NO: 73741 - protein, 11 aa, Dengue virus
EKVDTRTPRPM

SEQ ID NO: 73742 - protein, 11 aa, Dengue virus
KVDTRTPRPMP

SEQ ID NO: 73743 - protein, 11 aa, Dengue virus
VDTRTPRPMPG

SEQ ID NO: 73744 - protein, 11 aa, Dengue virus
DTRTPRPMPGT

SEQ ID NO: 73745 - protein, 11 aa, Dengue virus
TRTPRPMPGTR

SEQ ID NO: 73746 - protein, 11 aa, Dengue virus
VMGITAEWLWR

SEQ ID NO: 73747 - protein, 11 aa, Dengue virus
MGITAEWLWRT

SEQ ID NO: 73748 - protein, 11 aa, Dengue virus
GITAEWLWRTL

SEQ ID NO: 73749 - protein, 11 aa, Dengue virus
ITAGWLWRTLG

SEQ ID NO: 73750 - protein, 11 aa, Dengue virus
TAGWLWRTLGR

SEQ ID NO: 73751 - protein, 11 aa, Dengue virus
AGWLWRTLGRN

SEQ ID NO: 73752 - protein, 11 aa, Dengue virus
GWLWRTLGRNK

SEQ ID NO: 73753 - protein, 11 aa, Dengue virus
WLWRTLGRNKR

SEQ ID NO: 73754 - protein, 11 aa, Dengue virus
LWRTLGRNKRP

SEQ ID NO: 73755 - protein, 11 aa, Dengue virus
WRTLGRNKRPR

SEQ ID NO: 73756 - protein, 11 aa, Dengue virus
RTLGRNKRPRL

SEQ ID NO: 73757 - protein, 11 aa, Dengue virus
TLGRNKRPRLC

SEQ ID NO: 73758 - protein, 11 aa, Dengue virus
LGRNKRPRLCT

SEQ ID NO: 73759 - protein, 11 aa, Dengue virus
GRNKRPRLCTR

SEQ ID NO: 73760 - protein, 11 aa, Dengue virus
RNKRPRLCTRE

SEQ ID NO: 73761 - protein, 11 aa, Dengue virus
NKRPRLCTREE

SEQ ID NO: 73762 - protein, 11 aa, Dengue virus
KRPRLCTREEF

SEQ ID NO: 73763 - protein, 11 aa, Dengue virus
RPRLCTREEFT

SEQ ID NO: 73764 - protein, 11 aa, Dengue virus
PRLCTREEFIK

SEQ ID NO: 73765 - protein, 11 aa, Dengue virus
RLCTREEFIKK

SEQ ID NO: 73766 - protein, 11 aa, Dengue virus
LCTREEFIKKV

SEQ ID NO: 73767 - protein, 11 aa, Dengue virus
CTREEFIKKVR

SEQ ID NO: 73768 - protein, 11 aa, Dengue virus
TREEFIKKVRT

SEQ ID NO: 73769 - protein, 11 aa, Dengue virus
REEFIKKVRTN

SEQ ID NO: 73770 - protein, 11 aa, Dengue virus
EEFIKKVRTNA

SEQ ID NO: 73771 - protein, 11 aa, Dengue virus
EFIKKVRTNAA

SEQ ID NO: 73772 - protein, 11 aa, Dengue virus
FIKKVRTNAAM

SEQ ID NO: 73773 - protein, 11 aa, Dengue virus
IKKVRTNAAMG

SEQ ID NO: 73774 - protein, 11 aa, Dengue virus
FTEENQWDSAR

SEQ ID NO: 73775 - protein, 11 aa, Dengue virus
TEENQWDSARA

SEQ ID NO: 73776 - protein, 11 aa, Dengue virus
EENQWDSARAA

SEQ ID NO: 73777 - protein, 11 aa, Dengue virus
ENQWDSARAAV

SEQ ID NO: 73778 - protein, 11 aa, Dengue virus
NQWDSARAAVE

SEQ ID NO: 73779 - protein, 11 aa, Dengue virus
QWDSARAAVED

SEQ ID NO: 73780 - protein, 11 aa, Dengue virus
WDSARAAVEDE

SEQ ID NO: 73781 - protein, 11 aa, Dengue virus
DSARAAVEDEE

SEQ ID NO: 73782 - protein, 11 aa, Dengue virus
SARAAVEDEEF

SEQ ID NO: 73783 - protein, 11 aa, Dengue virus
ARAAVEDEEFW

SEQ ID NO: 73784 - protein, 11 aa, Dengue virus
RAAVEDEEFWK

SEQ ID NO: 73785 - protein, 11 aa, Dengue virus
AAVEDEEFWKL

SEQ ID NO: 73786 - protein, 11 aa, Dengue virus
AVEDEEFWKLV

SEQ ID NO: 73787 - protein, 11 aa, Dengue virus
VEDEEFWKLVD

SEQ ID NO: 73788 - protein, 11 aa, Dengue virus
EDEEFWKLVDR

SEQ ID NO: 73789 - protein, 11 aa, Dengue virus
DEEFWKLVDRE

SEQ ID NO: 73790 - protein, 11 aa, Dengue virus
EEFWKLVDRER

SEQ ID NO: 73791 - protein, 11 aa, Dengue virus
FWKLVDKEREL

SEQ ID NO: 73792 - protein, 11 aa, Dengue virus
WKLVDKERELH

SEQ ID NO: 73793 - protein, 11 aa, Dengue virus
KLVDKERELHK

SEQ ID NO: 73794 - protein, 11 aa, Dengue virus
LVDKERELHKL

SEQ ID NO: 73795 - protein, 11 aa, Dengue virus
VDKERELHKLG

SEQ ID NO: 73796 - protein, 11 aa, Dengue virus
DKERELHKLGK

SEQ ID NO: 73797 - protein, 11 aa, Dengue virus
KERELHKLGKC

SEQ ID NO: 73798 - protein, 11 aa, Dengue virus
ERELHKQGKCG

SEQ ID NO: 73799 - protein, 11 aa, Dengue virus
RELHKQGKCGS

SEQ ID NO: 73800 - protein, 11 aa, Dengue virus
ELHKQGKCGSC

SEQ ID NO: 73801 - protein, 11 aa, Dengue virus
LHKQGKCGSCV

SEQ ID NO: 73802 - protein, 11 aa, Dengue virus
HKQGKCGSCVY

SEQ ID NO: 73803 - protein, 11 aa, Dengue virus
KQGKCGSCVYN

SEQ ID NO: 73804 - protein, 11 aa, Dengue virus
QGKCGSCVYNM

SEQ ID NO: 73805 - protein, 11 aa, Dengue virus
AIWYMWLGARF

SEQ ID NO: 73806 - protein, 11 aa, Dengue virus
IWYMWLGARFL

SEQ ID NO: 73807 - protein, 11 aa, Dengue virus
WYMWLGARFLE

SEQ ID NO: 73808 - protein, 11 aa, Dengue virus
YMWLGARFLEF

SEQ ID NO: 73809 - protein, 11 aa, Dengue virus
MWLGARFLEFE

SEQ ID NO: 73810 - protein, 11 aa, Dengue virus
WLGARFLEFEA

SEQ ID NO: 73811 - protein, 11 aa, Dengue virus
LGARFLEFEAL

SEQ ID NO: 73812 - protein, 11 aa, Dengue virus
GARFLEFEALG

SEQ ID NO: 73813 - protein, 11 aa, Dengue virus
ARFLEFEALGF

SEQ ID NO: 73814 - protein, 11 aa, Dengue virus
RFLEFEALGFL

SEQ ID NO: 73815 - protein, 11 aa, Dengue virus
FLEFEALGFLN

SEQ ID NO: 73816 - protein, 11 aa, Dengue virus
EDDLHNEEKII

SEQ ID NO: 73817 - protein, 11 aa, Dengue virus
DDLHNEEKIIQ

SEQ ID NO: 73818 - protein, 11 aa, Dengue virus
DLHNEEKIIQQ

SEQ ID NO: 73819 - protein, 11 aa, Dengue virus
LHNEEKIIQQM

SEQ ID NO: 73820 - protein, 11 aa, Dengue virus
HNEEKIIQQMD

SEQ ID NO: 73821 - protein, 11 aa, Dengue virus
NEEKIIQQMDP

SEQ ID NO: 73822 - protein, 11 aa, Dengue virus
EEKIIQQMDPE

SEQ ID NO: 73823 - protein, 11 aa, Dengue virus
EKIIQQMDPEH

SEQ ID NO: 73824 - protein, 11 aa, Dengue virus
KIIQQMDPEHR

SEQ ID NO: 73825 - protein, 11 aa, Dengue virus
PEHRQLASAIF

SEQ ID NO: 73826 - protein, 11 aa, Dengue virus
EHRQLASAIFK

SEQ ID NO: 73827 - protein, 11 aa, Dengue virus
HRQLASAIFKL

SEQ ID NO: 73828 - protein, 11 aa, Dengue virus
RQLASAIFKLT

SEQ ID NO: 73829 - protein, 11 aa, Dengue virus
QLASAIFKLTY

SEQ ID NO: 73830 - protein, 11 aa, Dengue virus
LASAIFKLTYQ

SEQ ID NO: 73831 - protein, 11 aa, Dengue virus
ASAIFKLTYQN

SEQ ID NO: 73832 - protein, 11 aa, Dengue virus
SAIFKLTYQNK

SEQ ID NO: 73833 - protein, 11 aa, Dengue virus
KVVKVQRPTPK

SEQ ID NO: 73834 - protein, 11 aa, Dengue virus
VVKVQRPTPKG

SEQ ID NO: 73835 - protein, 11 aa, Dengue virus
VKVQRPTPKGT

SEQ ID NO: 73836 - protein, 11 aa, Dengue virus
KVQRPTPKGTV

SEQ ID NO: 73837 - protein, 11 aa, Dengue virus
VQRPTPKGTVM

SEQ ID NO: 73838 - protein, 11 aa, Dengue virus
QRPTPKGTVMD

SEQ ID NO: 73839 - protein, 11 aa, Dengue virus
RPTPKGTVMDI

SEQ ID NO: 73840 - protein, 11 aa, Dengue virus
PTPKGTVMDII

SEQ ID NO: 73841 - protein, 11 aa, Dengue virus
TPKGTVMDIIS

SEQ ID NO: 73842 - protein, 11 aa, Dengue virus
PKGTVMDIISR

SEQ ID NO: 73843 - protein, 11 aa, Dengue virus
KGTVMDIISRK

SEQ ID NO: 73844 - protein, 11 aa, Dengue virus
FTNMEAQLVRQ

SEQ ID NO: 73845 - protein, 11 aa, Dengue virus
TNMEAQLVRQM

SEQ ID NO: 73846 - protein, 11 aa, Dengue virus
NMEAQLVRQME

SEQ ID NO: 73847 - protein, 11 aa, Dengue virus
MEAQLVRQMEG

SEQ ID NO: 73848 - protein, 11 aa, Dengue virus
EAQLVRQMEGE

SEQ ID NO: 73849 - protein, 11 aa, Dengue virus
AQLVRQMEGEG

SEQ ID NO: 73850 - protein, 11 aa, Dengue virus
QLVRQMEGEGV

SEQ ID NO: 73851 - protein, 11 aa, Dengue virus
LVRQMEGEGVL

SEQ ID NO: 73852 - protein, 11 aa, Dengue virus
VRQMEGEGVLS

SEQ ID NO: 73853 - protein, 11 aa, Dengue virus
RQMEGEGVLTK

SEQ ID NO: 73854 - protein, 11 aa, Dengue virus
QMEGEGVLTKA

SEQ ID NO: 73855 - protein, 11 aa, Dengue virus
TQWLETEGVER

SEQ ID NO: 73856 - protein, 11 aa, Dengue virus
QWLETEGVERL

SEQ ID NO: 73857 - protein, 11 aa, Dengue virus
WLETKGVERLR

SEQ ID NO: 73858 - protein, 11 aa, Dengue virus
LETKGVERLRR

SEQ ID NO: 73859 - protein, 11 aa, Dengue virus
ETKGVERLRRM

SEQ ID NO: 73860 - protein, 11 aa, Dengue virus
TKGVERLRRMA

SEQ ID NO: 73861 - protein, 11 aa, Dengue virus
KGVERLRRMAI

SEQ ID NO: 73862 - protein, 11 aa, Dengue virus
GVERLRRMAIS

SEQ ID NO: 73863 - protein, 11 aa, Dengue virus
VERLRRMAISG

SEQ ID NO: 73864 - protein, 11 aa, Dengue virus
ERLRRMAISGD

SEQ ID NO: 73865 - protein, 11 aa, Dengue virus
RLRRMAISGDD

SEQ ID NO: 73866 - protein, 11 aa, Dengue virus
LRRMAISGDDC

SEQ ID NO: 73867 - protein, 11 aa, Dengue virus
RRMAISGDDCV

SEQ ID NO: 73868 - protein, 11 aa, Dengue virus
PIDDRFANALF

SEQ ID NO: 73869 - protein, 11 aa, Dengue virus
IDDRFANALFA

SEQ ID NO: 73870 - protein, 11 aa, Dengue virus
DDRFANALFAL

SEQ ID NO: 73871 - protein, 11 aa, Dengue virus
DRFANALFALN

SEQ ID NO: 73872 - protein, 11 aa, Dengue virus
RFANALFALND

SEQ ID NO: 73873 - protein, 11 aa, Dengue virus
FANALFALNDM

SEQ ID NO: 73874 - protein, 11 aa, Dengue virus
ANALFALNDMG

SEQ ID NO: 73875 - protein, 11 aa, Dengue virus
NALFALNDMGK

SEQ ID NO: 73876 - protein, 11 aa, Dengue virus
ALFALNDMGKV

SEQ ID NO: 73877 - protein, 11 aa, Dengue virus
LFALNDMGKVR

SEQ ID NO: 73878 - protein, 11 aa, Dengue virus
FALNDMGKVRK

SEQ ID NO: 73879 - protein, 11 aa, Dengue virus
IPQWQPSKGWQ

SEQ ID NO: 73880 - protein, 11 aa, Dengue virus
PQWQPSKGWQD

SEQ ID NO: 73881 - protein, 11 aa, Dengue virus
QWQPSKGWQDW

SEQ ID NO: 73882 - protein, 11 aa, Dengue virus
WQPSKGWQDWQ

SEQ ID NO: 73883 - protein, 11 aa, Dengue virus
QPSKGWQDWQQ

SEQ ID NO: 73884 - protein, 11 aa, Dengue virus
PSKGWQDWQQV

SEQ ID NO: 73885 - protein, 11 aa, Dengue virus
SKGWQDWQQVP

SEQ ID NO: 73886 - protein, 11 aa, Dengue virus
KGWQDWQQVPF

SEQ ID NO: 73887 - protein, 11 aa, Dengue virus
GWQDWQQVPFC

SEQ ID NO: 73888 - protein, 11 aa, Dengue virus
WQDWQQVPFCS

SEQ ID NO: 73889 - protein, 11 aa, Dengue virus
QDWQQVPFCSH

SEQ ID NO: 73890 - protein, 11 aa, Dengue virus
RISQGAGWSLK

SEQ ID NO: 73891 - protein, 11 aa, Dengue virus
ISQGAGWSLKE

SEQ ID NO: 73892 - protein, 11 aa, Dengue virus
SQGAGWSLKET

SEQ ID NO: 73893 - protein, 11 aa, Dengue virus
QGAGWSLKETA

SEQ ID NO: 73894 - protein, 11 aa, Dengue virus
GAGWSLKETAC

SEQ ID NO: 73895 - protein, 11 aa, Dengue virus
AGWSLKETACL

SEQ ID NO: 73896 - protein, 11 aa, Dengue virus
GWSLKETACLG

SEQ ID NO: 73897 - protein, 11 aa, Dengue virus
WSLKETACLGK

SEQ ID NO: 73898 - protein, 11 aa, Dengue virus
SLKETACLGKA

SEQ ID NO: 73899 - protein, 11 aa, Dengue virus
LKETACLGKAY

SEQ ID NO: 73900 - protein, 11 aa, Dengue virus
KETACLGKAYA

SEQ ID NO: 73901 - protein, 11 aa, Dengue virus
CLGKAYAQMWA

SEQ ID NO: 73902 - protein, 11 aa, Dengue virus
LGKAYAQMWAL

SEQ ID NO: 73903 - protein, 11 aa, Dengue virus
GKAYAQMWALM

SEQ ID NO: 73904 - protein, 11 aa, Dengue virus
KAYAQMWALMY

SEQ ID NO: 73905 - protein, 11 aa, Dengue virus
AYAQMWALMYF

SEQ ID NO: 73906 - protein, 11 aa, Dengue virus
YAQMWALMYFH

SEQ ID NO: 73907 - protein, 11 aa, Dengue virus
AQMWALMYFHR

SEQ ID NO: 73908 - protein, 11 aa, Dengue virus
QMWALMYFHRR

SEQ ID NO: 73909 - protein, 11 aa, Dengue virus
MWALMYFHRRD

SEQ ID NO: 73910 - protein, 11 aa, Dengue virus
WALMYFHRRDL

SEQ ID NO: 73911 - protein, 11 aa, Dengue virus
ALMYFHRRDLR

SEQ ID NO: 73912 - protein, 11 aa, Dengue virus
ASNAICSAVPA

SEQ ID NO: 73913 - protein, 11 aa, Dengue virus
SNAICSAVPAH

SEQ ID NO: 73914 - protein, 11 aa, Dengue virus
NAICSAVPAHW

SEQ ID NO: 73915 - protein, 11 aa, Dengue virus
AICSAVPVHWI

SEQ ID NO: 73916 - protein, 11 aa, Dengue virus
ICSAVPVHWIP

SEQ ID NO: 73917 - protein, 11 aa, Dengue virus
CSAVPVHWIPT

SEQ ID NO: 73918 - protein, 11 aa, Dengue virus
SAVPVHWIPTS

SEQ ID NO: 73919 - protein, 11 aa, Dengue virus
AVPVHWIPTSR

SEQ ID NO: 73920 - protein, 11 aa, Dengue virus
VPVHWIPTSRT

SEQ ID NO: 73921 - protein, 11 aa, Dengue virus
PVHWIPTSRTT

SEQ ID NO: 73922 - protein, 11 aa, Dengue virus
VHWIPTSRTTW

SEQ ID NO: 73923 - protein, 11 aa, Dengue virus
HWIPTSRTTWS

SEQ ID NO: 73924 - protein, 11 aa, Dengue virus
WIPTSRTTWSI

SEQ ID NO: 73925 - protein, 11 aa, Dengue virus
IPTSRTTWSIH

SEQ ID NO: 73926 - protein, 11 aa, Dengue virus
HQWMTTEDMLA

SEQ ID NO: 73927 - protein, 11 aa, Dengue virus
QWMTTEDMLAV

SEQ ID NO: 73928 - protein, 11 aa, Dengue virus
WMTTEDMLAVW

SEQ ID NO: 73929 - protein, 11 aa, Dengue virus
MTTEDMLAVWN

SEQ ID NO: 73930 - protein, 11 aa, Dengue virus
TTEDMLAVWNR

SEQ ID NO: 73931 - protein, 11 aa, Dengue virus
TEDMLAVWNRV

SEQ ID NO: 73932 - protein, 11 aa, Dengue virus
EDMLAVWNRVW

SEQ ID NO: 73933 - protein, 11 aa, Dengue virus
DMLAVWNRVWI

SEQ ID NO: 73934 - protein, 11 aa, Dengue virus
MLAVWNRVWIE

SEQ ID NO: 73935 - protein, 11 aa, Dengue virus
LTVWNRVWIEE

SEQ ID NO: 73936 - protein, 11 aa, Dengue virus
TVWNRVWIEEN

SEQ ID NO: 73937 - protein, 11 aa, Dengue virus
VWNRVWIEENP

SEQ ID NO: 73938 - protein, 11 aa, Dengue virus
WNRVWIEENPW

SEQ ID NO: 73939 - protein, 11 aa, Dengue virus
NRVWIEENPWM

SEQ ID NO: 73940 - protein, 11 aa, Dengue virus
RVWIEENPWME

SEQ ID NO: 73941 - protein, 11 aa, Dengue virus
VWIEENPWMED

SEQ ID NO: 73942 - protein, 11 aa, Dengue virus
WIEENPWMEDK

SEQ ID NO: 73943 - protein, 11 aa, Dengue virus
IEENPWMEDKT

SEQ ID NO: 73944 - protein, 11 aa, Dengue virus
EENPWMEDKTP

SEQ ID NO: 73945 - protein, 11 aa, Dengue virus
ENPWMEDKTPV

SEQ ID NO: 73946 - protein, 11 aa, Dengue virus
NPWMEDKTPIT

SEQ ID NO: 73947 - protein, 11 aa, Dengue virus
PWMEDKTPITT

SEQ ID NO: 73948 - protein, 11 aa, Dengue virus
WMEDKTPITTW

SEQ ID NO: 73949 - protein, 11 aa, Dengue virus
MEDKTPITTWE

SEQ ID NO: 73950 - protein, 11 aa, Dengue virus
EDKTPVTTWED

SEQ ID NO: 73951 - protein, 11 aa, Dengue virus
DKTPVTTWEDV

SEQ ID NO: 73952 - protein, 11 aa, Dengue virus
KTPVTTWEDVP

SEQ ID NO: 73953 - protein, 11 aa, Dengue virus
TPVTTWEDVPY

SEQ ID NO: 73954 - protein, 11 aa, Dengue virus
PVTTWEDVPYL

SEQ ID NO: 73955 - protein, 11 aa, Dengue virus
VTTWEDVPYLG

SEQ ID NO: 73956 - protein, 11 aa, Dengue virus
TTWEDVPYLGK

SEQ ID NO: 73957 - protein, 11 aa, Dengue virus
TWEDVPYLGKR

SEQ ID NO: 73958 - protein, 11 aa, Dengue virus
WEDVPYLGKRE

SEQ ID NO: 73959 - protein, 11 aa, Dengue virus
EDVPYLGKRED

SEQ ID NO: 73960 - protein, 11 aa, Dengue virus
DVPYLGKREDQ

SEQ ID NO: 73961 - protein, 11 aa, Dengue virus
TSRATWAQNIL

SEQ ID NO: 73962 - protein, 11 aa, Dengue virus
SRATWAQNILT

SEQ ID NO: 73963 - protein, 11 aa, Dengue virus
RATWAQNILTA

SEQ ID NO: 73964 - protein, 11 aa, Dengue virus
ATWAQNILTAI

SEQ ID NO: 73965 - protein, 11 aa, Dengue virus
TWAQNILTAIQ

SEQ ID NO: 73966 - protein, 11 aa, Dengue virus
WAQNILTAIQQ

SEQ ID NO: 73967 - protein, 11 aa, Dengue virus
AQNILTAIQQV

SEQ ID NO: 73968 - protein, 11 aa, Dengue virus
QNILTAIQQVR

SEQ ID NO: 73969 - protein, 11 aa, Dengue virus
NILTAIQQVRS

SEQ ID NO: 73970 - protein, 11 aa, Dengue virus
ILTAIQQVRSL

SEQ ID NO: 73971 - protein, 11 aa, Dengue virus
LTAIQQVRSLI

SEQ ID NO: 73972 - protein, 11 aa, Dengue virus
IAIQQVRSLIG

SEQ ID NO: 73973 - protein, 11 aa, Dengue virus
AIQQVRSLIGD

SEQ ID NO: 73974 - protein, 11 aa, Dengue virus
IQQVRSLIGDE

SEQ ID NO: 73975 - protein, 11 aa, Dengue virus
QQVRSLIGDEE

SEQ ID NO: 73976 - protein, 11 aa, Dengue virus
QVRSLIGDEEF

SEQ ID NO: 73977 - protein, 11 aa, Dengue virus
VRSLIGDEEFL

SEQ ID NO: 73978 - protein, 11 aa, Dengue virus
RSLIGDEEFLD

SEQ ID NO: 73979 - protein, 11 aa, Dengue virus
SLIGDEEFLDY

SEQ ID NO: 73980 - protein, 11 aa, Dengue virus
LIGDEEFLDYM

SEQ ID NO: 73981 - protein, 11 aa, Dengue virus
IGDEEFLDYMP

SEQ ID NO: 73982 - protein, 11 aa, Dengue virus
GDEEFLDYMPS

SEQ ID NO: 73983 - protein, 11 aa, Dengue virus
DEEFLDYMPSM

SEQ ID NO: 73984 - protein, 11 aa, Dengue virus
SMKRFRKEEEL

SEQ ID NO: 73985 - protein, 11 aa, Dengue virus
MKRFRKEEELE

SEQ ID NO: 73986 - protein, 11 aa, Dengue virus
KRFRKEEELEG

SEQ ID NO: 73987 - protein, 11 aa, Dengue virus
RFRKEEELEGA

SEQ ID NO: 73988 - protein, 11 aa, Dengue virus
FRKEEELEGAI

SEQ ID NO: 73989 - protein, 11 aa, Dengue virus
RKEEELEGAIW

SEQ ID NO: 73990 - protein, 11 aa, Dengue virus
GSQLAKRFSKE

SEQ ID NO: 73991 - protein, 11 aa, Dengue virus
SQLAKRFSKEL

SEQ ID NO: 73992 - protein, 11 aa, Dengue virus
QLAKRFSKELL

SEQ ID NO: 73993 - protein, 11 aa, Dengue virus
LAKRFSKELLN

SEQ ID NO: 73994 - protein, 11 aa, Dengue virus
AKRFSKELLNG

SEQ ID NO: 73995 - protein, 11 aa, Dengue virus
KRFSKELLNGQ

SEQ ID NO: 73996 - protein, 11 aa, Dengue virus
RFSKELLNGQG

SEQ ID NO: 73997 - protein, 11 aa, Dengue virus
FSKELLNGQGP

SEQ ID NO: 73998 - protein, 11 aa, Dengue virus
SKELLNGQGPM

SEQ ID NO: 73999 - protein, 11 aa, Dengue virus
KELLNGQGPMK

SEQ ID NO: 74000 - protein, 11 aa, Dengue virus
FEKSGAIKVLK

SEQ ID NO: 74001 - protein, 11 aa, Dengue virus
KKSGAIKVLKS

SEQ ID NO: 74002 - protein, 11 aa, Dengue virus
KSGAIKVLKSF

SEQ ID NO: 74003 - protein, 11 aa, Dengue virus
SGAIKVLKSFK

SEQ ID NO: 74004 - protein, 11 aa, Dengue virus
GAIKVLKGFKR

SEQ ID NO: 74005 - protein, 11 aa, Dengue virus
AIKVLKGFKRE

SEQ ID NO: 74006 - protein, 11 aa, Dengue virus
IKVLKGFKREI

SEQ ID NO: 74007 - protein, 11 aa, Dengue virus
KVLKGFKREIS

SEQ ID NO: 74008 - protein, 11 aa, Dengue virus
VLKGFKREISN

SEQ ID NO: 74009 - protein, 11 aa, Dengue virus
LKGFKREISNM

SEQ ID NO: 74010 - protein, 11 aa, Dengue virus
KGFKREISNML

SEQ ID NO: 74011 - protein, 11 aa, Dengue virus
SFKKEISNMLS

SEQ ID NO: 74012 - protein, 11 aa, Dengue virus
EISNMLSIINQ

SEQ ID NO: 74013 - protein, 11 aa, Dengue virus
ISNMLSIINQR

SEQ ID NO: 74014 - protein, 11 aa, Dengue virus
SNMLSIINKRR

SEQ ID NO: 74015 - protein, 11 aa, Dengue virus
NMLSIINRRKR

SEQ ID NO: 74016 - protein, 11 aa, Dengue virus
MLSIINRRKRT

SEQ ID NO: 74017 - protein, 11 aa, Dengue virus
LSIINRRKRTS

SEQ ID NO: 74018 - protein, 11 aa, Dengue virus
MILPATLAFHL

SEQ ID NO: 74019 - protein, 11 aa, Dengue virus
ILPATLAFHLT

SEQ ID NO: 74020 - protein, 11 aa, Dengue virus
KSIFFKTASGI

SEQ ID NO: 74021 - protein, 11 aa, Dengue virus
CDDTVTYKCPF

SEQ ID NO: 74022 - protein, 11 aa, Dengue virus
DDTVTYKCPFI

SEQ ID NO: 74023 - protein, 11 aa, Dengue virus
VAEVEPEDIDC

SEQ ID NO: 74024 - protein, 11 aa, Dengue virus
RQVERVETWAL

SEQ ID NO: 74025 - protein, 11 aa, Dengue virus
QVERVETWALR

SEQ ID NO: 74026 - protein, 11 aa, Dengue virus
ILALFLAHYIS

SEQ ID NO: 74027 - protein, 11 aa, Dengue virus
LFLAHYISTSL

SEQ ID NO: 74028 - protein, 11 aa, Dengue virus
FLAHYVGTSLT

SEQ ID NO: 74029 - protein, 11 aa, Dengue virus
LAHYVGTSLTQ

SEQ ID NO: 74030 - protein, 11 aa, Dengue virus
AHYVGTSLTQK

SEQ ID NO: 74031 - protein, 11 aa, Dengue virus
HYIGTSLIQKV

SEQ ID NO: 74032 - protein, 11 aa, Dengue virus
YIGTSLIQKVV

SEQ ID NO: 74033 - protein, 11 aa, Dengue virus
IGTSLIQKVVI

SEQ ID NO: 74034 - protein, 11 aa, Dengue virus
GTSLIQKVVIF

SEQ ID NO: 74035 - protein, 11 aa, Dengue virus
TSLTQKAVIFI

SEQ ID NO: 74036 - protein, 11 aa, Dengue virus
SLTQKAVIFIL

SEQ ID NO: 74037 - protein, 11 aa, Dengue virus
LTQKAVIFILL

SEQ ID NO: 74038 - protein, 11 aa, Dengue virus
TQKAVIFILLM

SEQ ID NO: 74039 - protein, 11 aa, Dengue virus
QKAVIFILLML

SEQ ID NO: 74040 - protein, 11 aa, Dengue virus
KAVIFILLMLV

SEQ ID NO: 74041 - protein, 11 aa, Dengue virus
AVIFILLMLVT

SEQ ID NO: 74042 - protein, 11 aa, Dengue virus
VIFTLLMLVTP

SEQ ID NO: 74043 - protein, 11 aa, Dengue virus
IFTLLMLVTPS

SEQ ID NO: 74044 - protein, 11 aa, Dengue virus
FTLLMLVTPSM

SEQ ID NO: 74045 - protein, 11 aa, Dengue virus
VLLMLVTPSMA

SEQ ID NO: 74046 - protein, 11 aa, Dengue virus
DSRCPTQGEAT

SEQ ID NO: 74047 - protein, 11 aa, Dengue virus
SRCPTQGEATL

SEQ ID NO: 74048 - protein, 11 aa, Dengue virus
RCPTQGEATLP

SEQ ID NO: 74049 - protein, 11 aa, Dengue virus
CPTQGEATLPE

SEQ ID NO: 74050 - protein, 11 aa, Dengue virus
PTQGEATLPEE

SEQ ID NO: 74051 - protein, 11 aa, Dengue virus
TQGEATLPEEQ

SEQ ID NO: 74052 - protein, 11 aa, Dengue virus
QGEATLPEEQD

SEQ ID NO: 74053 - protein, 11 aa, Dengue virus
GEATLPEEQDQ

SEQ ID NO: 74054 - protein, 11 aa, Dengue virus
EATLPEEQDQN

SEQ ID NO: 74055 - protein, 11 aa, Dengue virus
ATLPEEQDQNY

SEQ ID NO: 74056 - protein, 11 aa, Dengue virus
TLPEEQDQNYV

SEQ ID NO: 74057 - protein, 11 aa, Dengue virus
VTCAKFQCLEL

SEQ ID NO: 74058 - protein, 11 aa, Dengue virus
TCAKFQCLELI

SEQ ID NO: 74059 - protein, 11 aa, Dengue virus
CAKFQCLELIE

SEQ ID NO: 74060 - protein, 11 aa, Dengue virus
AKFQCLELIEG

SEQ ID NO: 74061 - protein, 11 aa, Dengue virus
KFQCLELIEGK

SEQ ID NO: 74062 - protein, 11 aa, Dengue virus
IEGKAVQHENL

SEQ ID NO: 74063 - protein, 11 aa, Dengue virus
EGKAVQHENLK

SEQ ID NO: 74064 - protein, 11 aa, Dengue virus
GKAVQHENLKY

SEQ ID NO: 74065 - protein, 11 aa, Dengue virus
KAVQHENLKYT

SEQ ID NO: 74066 - protein, 11 aa, Dengue virus
AVQHENLKYTV

SEQ ID NO: 74067 - protein, 11 aa, Dengue virus
VQHENLKYTVT

SEQ ID NO: 74068 - protein, 11 aa, Dengue virus
QHENLKYTVTI

SEQ ID NO: 74069 - protein, 11 aa, Dengue virus
HENLKYTVTIT

SEQ ID NO: 74070 - protein, 11 aa, Dengue virus
QPQVGNDTQGV

SEQ ID NO: 74071 - protein, 11 aa, Dengue virus
PQVGNDTQGVT

SEQ ID NO: 74072 - protein, 11 aa, Dengue virus
QVGNDTQGVTA

SEQ ID NO: 74073 - protein, 11 aa, Dengue virus
VGNDTQGVTAE

SEQ ID NO: 74074 - protein, 11 aa, Dengue virus
GNDTQGVTAEI

SEQ ID NO: 74075 - protein, 11 aa, Dengue virus
NDTQGVTAEIT

SEQ ID NO: 74076 - protein, 11 aa, Dengue virus
ETQGVTAEITS

SEQ ID NO: 74077 - protein, 11 aa, Dengue virus
TQGVTAEITSQ

SEQ ID NO: 74078 - protein, 11 aa, Dengue virus
QGVTAEITSQA

SEQ ID NO: 74079 - protein, 11 aa, Dengue virus
GVTAEITSQAS

SEQ ID NO: 74080 - protein, 11 aa, Dengue virus
VTAEITSQAST

SEQ ID NO: 74081 - protein, 11 aa, Dengue virus
EITPQASTAEA

SEQ ID NO: 74082 - protein, 11 aa, Dengue virus
VEAILPEYGTL

SEQ ID NO: 74083 - protein, 11 aa, Dengue virus
EVILPEYGTLG

SEQ ID NO: 74084 - protein, 11 aa, Dengue virus
VILPEYGTLGL

SEQ ID NO: 74085 - protein, 11 aa, Dengue virus
FDLPLPWTSGT

SEQ ID NO: 74086 - protein, 11 aa, Dengue virus
DLPLPWTSGTT

SEQ ID NO: 74087 - protein, 11 aa, Dengue virus
LPLPWTSGATA

SEQ ID NO: 74088 - protein, 11 aa, Dengue virus
AETPTWNRKEL

SEQ ID NO: 74089 - protein, 11 aa, Dengue virus
ETPIWNRKELL

SEQ ID NO: 74090 - protein, 11 aa, Dengue virus
TPIWNRKELLV

SEQ ID NO: 74091 - protein, 11 aa, Dengue virus
ATEIQNSGGTN

SEQ ID NO: 74092 - protein, 11 aa, Dengue virus
TEIQNSGGTNI

SEQ ID NO: 74093 - protein, 11 aa, Dengue virus
EIQNSGGTNIF

SEQ ID NO: 74094 - protein, 11 aa, Dengue virus
IQNSGGTNIFA

SEQ ID NO: 74095 - protein, 11 aa, Dengue virus
QNSGGTNIFAG

SEQ ID NO: 74096 - protein, 11 aa, Dengue virus
NSGGTNIFAGH

SEQ ID NO: 74097 - protein, 11 aa, Dengue virus
LGGTSIFAGHL

SEQ ID NO: 74098 - protein, 11 aa, Dengue virus
ELKGMSYAMCS

SEQ ID NO: 74099 - protein, 11 aa, Dengue virus
LKGMSYAMCSN

SEQ ID NO: 74100 - protein, 11 aa, Dengue virus
KGMSYAMCSNA

SEQ ID NO: 74101 - protein, 11 aa, Dengue virus
GMSYAMCSNAF

SEQ ID NO: 74102 - protein, 11 aa, Dengue virus
MSYAMCSNAFV

SEQ ID NO: 74103 - protein, 11 aa, Dengue virus
SYAMCSNAFVL

SEQ ID NO: 74104 - protein, 11 aa, Dengue virus
GSFVLKKEVSE

SEQ ID NO: 74105 - protein, 11 aa, Dengue virus
TFVLRKEVSET

SEQ ID NO: 74106 - protein, 11 aa, Dengue virus
HGTILVKVEYK

SEQ ID NO: 74107 - protein, 11 aa, Dengue virus
GTILVKVEYKG

SEQ ID NO: 74108 - protein, 11 aa, Dengue virus
TILIKVEYKGK

SEQ ID NO: 74109 - protein, 11 aa, Dengue virus
ILIKVEYKGKD

SEQ ID NO: 74110 - protein, 11 aa, Dengue virus
LIKVEYRGEDA

SEQ ID NO: 74111 - protein, 11 aa, Dengue virus
IKVEYRGEDAP

SEQ ID NO: 74112 - protein, 11 aa, Dengue virus
KVEYRGEDAPC

SEQ ID NO: 74113 - protein, 11 aa, Dengue virus
VEYRGEDAPCK

SEQ ID NO: 74114 - protein, 11 aa, Dengue virus
EYRGEDAPCKI

SEQ ID NO: 74115 - protein, 11 aa, Dengue virus
YRGEDAPCKIP

SEQ ID NO: 74116 - protein, 11 aa, Dengue virus
RGEDAPCKIPF

SEQ ID NO: 74117 - protein, 11 aa, Dengue virus
GEDVPCKVPFS

SEQ ID NO: 74118 - protein, 11 aa, Dengue virus
EDVPCKVPFST

SEQ ID NO: 74119 - protein, 11 aa, Dengue virus
DVPCKVPFSTE

SEQ ID NO: 74120 - protein, 11 aa, Dengue virus
VPCKVPFSTED

SEQ ID NO: 74121 - protein, 11 aa, Dengue virus
PCKIPFSTEDE

SEQ ID NO: 74122 - protein, 11 aa, Dengue virus
CKIPFSTEDEQ

SEQ ID NO: 74123 - protein, 11 aa, Dengue virus
KIPFSTEDEQG

SEQ ID NO: 74124 - protein, 11 aa, Dengue virus
IPFSTEDEQGK

SEQ ID NO: 74125 - protein, 11 aa, Dengue virus
PFSTEDGQGKV

SEQ ID NO: 74126 - protein, 11 aa, Dengue virus
FSTEDGQGKVH

SEQ ID NO: 74127 - protein, 11 aa, Dengue virus
STEDEQGKAHN

SEQ ID NO: 74128 - protein, 11 aa, Dengue virus
TEDEQGKAHNG

SEQ ID NO: 74129 - protein, 11 aa, Dengue virus
EDEQGKAHNGR

SEQ ID NO: 74130 - protein, 11 aa, Dengue virus
DEQGKAHNGRL

SEQ ID NO: 74131 - protein, 11 aa, Dengue virus
EQGKAHNGRLI

SEQ ID NO: 74132 - protein, 11 aa, Dengue virus
QGKVHNGRLIT

SEQ ID NO: 74133 - protein, 11 aa, Dengue virus
HSGRLITANPV

SEQ ID NO: 74134 - protein, 11 aa, Dengue virus
SGRLITANPVV

SEQ ID NO: 74135 - protein, 11 aa, Dengue virus
LITANPVVIKK

SEQ ID NO: 74136 - protein, 11 aa, Dengue virus
ITANPVVTKKD

SEQ ID NO: 74137 - protein, 11 aa, Dengue virus
TANPVVTKKDE

SEQ ID NO: 74138 - protein, 11 aa, Dengue virus
ANPVVTKKDEP

SEQ ID NO: 74139 - protein, 11 aa, Dengue virus
NPVVTKKDEPV

SEQ ID NO: 74140 - protein, 11 aa, Dengue virus
PVVTKKDEPVN

SEQ ID NO: 74141 - protein, 11 aa, Dengue virus
VVTKKDEPVNI

SEQ ID NO: 74142 - protein, 11 aa, Dengue virus
VTKKEEPINIE

SEQ ID NO: 74143 - protein, 11 aa, Dengue virus
TKKEEPINIEA

SEQ ID NO: 74144 - protein, 11 aa, Dengue virus
KKEEPINIEAE

SEQ ID NO: 74145 - protein, 11 aa, Dengue virus
KEEPINIEAEP

SEQ ID NO: 74146 - protein, 11 aa, Dengue virus
EEPINIEAEPP

SEQ ID NO: 74147 - protein, 11 aa, Dengue virus
PFGESNIVIGT

SEQ ID NO: 74148 - protein, 11 aa, Dengue virus
FGESNIVIGTG

SEQ ID NO: 74149 - protein, 11 aa, Dengue virus
GESNIVIGTGD

SEQ ID NO: 74150 - protein, 11 aa, Dengue virus
GDNSLKINWYK

SEQ ID NO: 74151 - protein, 11 aa, Dengue virus
NSLKINWYKKG

SEQ ID NO: 74152 - protein, 11 aa, Dengue virus
ALKINWYRKGS

SEQ ID NO: 74153 - protein, 11 aa, Dengue virus
YTALFGGVSWI

SEQ ID NO: 74154 - protein, 11 aa, Dengue virus
TALFGGVSWIM

SEQ ID NO: 74155 - protein, 11 aa, Dengue virus
ALFGGVSWIMK

SEQ ID NO: 74156 - protein, 11 aa, Dengue virus
LFGGVSWIMKI

SEQ ID NO: 74157 - protein, 11 aa, Dengue virus
FGGVSWIMKIG

SEQ ID NO: 74158 - protein, 11 aa, Dengue virus
GGVSWIMKIGI

SEQ ID NO: 74159 - protein, 11 aa, Dengue virus
GVSWMMKIGIG

SEQ ID NO: 74160 - protein, 11 aa, Dengue virus
VSWVMKIGIGI

SEQ ID NO: 74161 - protein, 11 aa, Dengue virus
SWVMKIGIGIL

SEQ ID NO: 74162 - protein, 11 aa, Dengue virus
WVMKIGIGILL

SEQ ID NO: 74163 - protein, 11 aa, Dengue virus
VMKIGIGILLT

SEQ ID NO: 74164 - protein, 11 aa, Dengue virus
KNTSMSFSCIT

SEQ ID NO: 74165 - protein, 11 aa, Dengue virus
NTSMSFSCITI

SEQ ID NO: 74166 - protein, 11 aa, Dengue virus
TSMSFSCITIG

SEQ ID NO: 74167 - protein, 11 aa, Dengue virus
SMSFSCIAIGV

SEQ ID NO: 74168 - protein, 11 aa, Dengue virus
MSFSCIAIGVI

SEQ ID NO: 74169 - protein, 11 aa, Dengue virus
SFSCIAIGVIT

SEQ ID NO: 74170 - protein, 11 aa, Dengue virus
FSCIAIGVITL

SEQ ID NO: 74171 - protein, 11 aa, Dengue virus
SCIAIGVITLY

SEQ ID NO: 74172 - protein, 11 aa, Dengue virus
CIAIGVITLYL

SEQ ID NO: 74173 - protein, 11 aa, Dengue virus
IAIGVITLYLG

SEQ ID NO: 74174 - protein, 11 aa, Dengue virus
IGIITLYLGTV

SEQ ID NO: 74175 - protein, 11 aa, Dengue virus
GIITLYLGTVV

SEQ ID NO: 74176 - protein, 11 aa, Dengue virus
IITLYLGTVVQ

SEQ ID NO: 74177 - protein, 11 aa, Dengue virus
ITLYLGVVVQA

SEQ ID NO: 74178 - protein, 11 aa, Dengue virus
TLYLGVVVQAD

SEQ ID NO: 74179 - protein, 11 aa, Dengue virus
LYLGTVVQADM

SEQ ID NO: 74180 - protein, 11 aa, Dengue virus
YLGTVVQADMG

SEQ ID NO: 74181 - protein, 11 aa, Dengue virus
LGTVVQADMGC

SEQ ID NO: 74182 - protein, 11 aa, Dengue virus
GAVVQADMGCA

SEQ ID NO: 74183 - protein, 11 aa, Dengue virus
VVQADMGCAIN

SEQ ID NO: 74184 - protein, 11 aa, Dengue virus
VQADMGCAINW

SEQ ID NO: 74185 - protein, 11 aa, Dengue virus
QADMGCAINWK

SEQ ID NO: 74186 - protein, 11 aa, Dengue virus
ADMGCAINWKG

SEQ ID NO: 74187 - protein, 11 aa, Dengue virus
DMGCAINWKGK

SEQ ID NO: 74188 - protein, 11 aa, Dengue virus
MGCAINWKGKE

SEQ ID NO: 74189 - protein, 11 aa, Dengue virus
GCVVNWKGKEL

SEQ ID NO: 74190 - protein, 11 aa, Dengue virus
CVVNWKGKELK

SEQ ID NO: 74191 - protein, 11 aa, Dengue virus
VVNWKGKELKC

SEQ ID NO: 74192 - protein, 11 aa, Dengue virus
ELNHILWENNI

SEQ ID NO: 74193 - protein, 11 aa, Dengue virus
LNHILWENNIK

SEQ ID NO: 74194 - protein, 11 aa, Dengue virus
NHILWENNIKL

SEQ ID NO: 74195 - protein, 11 aa, Dengue virus
YILWENSIKLT

SEQ ID NO: 74196 - protein, 11 aa, Dengue virus
ILWENNVKLTV

SEQ ID NO: 74197 - protein, 11 aa, Dengue virus
LWENNVKLTVV

SEQ ID NO: 74198 - protein, 11 aa, Dengue virus
WENNVKLTVVV

SEQ ID NO: 74199 - protein, 11 aa, Dengue virus
ENNVKLTVVVG

SEQ ID NO: 74200 - protein, 11 aa, Dengue virus
NNVKLTVVVGD

SEQ ID NO: 74201 - protein, 11 aa, Dengue virus
NIKLTIVVGDV

SEQ ID NO: 74202 - protein, 11 aa, Dengue virus
TGVLEQGKRTL

SEQ ID NO: 74203 - protein, 11 aa, Dengue virus
GVLEQGKRALT

SEQ ID NO: 74204 - protein, 11 aa, Dengue virus
VLEQGKRALTP

SEQ ID NO: 74205 - protein, 11 aa, Dengue virus
LEQGKRTLTLQ

SEQ ID NO: 74206 - protein, 11 aa, Dengue virus
EQGKRILTPQP

SEQ ID NO: 74207 - protein, 11 aa, Dengue virus
QGKRILTPQPM

SEQ ID NO: 74208 - protein, 11 aa, Dengue virus
GKRILTPQPME

SEQ ID NO: 74209 - protein, 11 aa, Dengue virus
KRTLTLQPMEL

SEQ ID NO: 74210 - protein, 11 aa, Dengue virus
RILTPQPMELK

SEQ ID NO: 74211 - protein, 11 aa, Dengue virus
ILTPQPMELKY

SEQ ID NO: 74212 - protein, 11 aa, Dengue virus
LTPQPTELKYS

SEQ ID NO: 74213 - protein, 11 aa, Dengue virus
TPQPMDLKYSW

SEQ ID NO: 74214 - protein, 11 aa, Dengue virus
KYSWKAWGKAK

SEQ ID NO: 74215 - protein, 11 aa, Dengue virus
YSWKAWGKAKI

SEQ ID NO: 74216 - protein, 11 aa, Dengue virus
SWKTWGKAKVV

SEQ ID NO: 74217 - protein, 11 aa, Dengue virus
AETQNFSFIID

SEQ ID NO: 74218 - protein, 11 aa, Dengue virus
ETQNFSFIIDG

SEQ ID NO: 74219 - protein, 11 aa, Dengue virus
TQNFSFIIDGP

SEQ ID NO: 74220 - protein, 11 aa, Dengue virus
QNFSFIIDGPN

SEQ ID NO: 74221 - protein, 11 aa, Dengue virus
NFSFIIDGPNT

SEQ ID NO: 74222 - protein, 11 aa, Dengue virus
FSFIIDGPNTP

SEQ ID NO: 74223 - protein, 11 aa, Dengue virus
IDGPSTPECPS

SEQ ID NO: 74224 - protein, 11 aa, Dengue virus
DGPNTPECPSV

SEQ ID NO: 74225 - protein, 11 aa, Dengue virus
PSVSRAWNVWE

SEQ ID NO: 74226 - protein, 11 aa, Dengue virus
SVSRAWNVWEV

SEQ ID NO: 74227 - protein, 11 aa, Dengue virus
TSRAWNVWEVE

SEQ ID NO: 74228 - protein, 11 aa, Dengue virus
STNIWLKLREV

SEQ ID NO: 74229 - protein, 11 aa, Dengue virus
TNIWLKLREVH

SEQ ID NO: 74230 - protein, 11 aa, Dengue virus
NIWLKLREVHT

SEQ ID NO: 74231 - protein, 11 aa, Dengue virus
IWLKLREVHTQ

SEQ ID NO: 74232 - protein, 11 aa, Dengue virus
TQTCDHRLMSA

SEQ ID NO: 74233 - protein, 11 aa, Dengue virus
QTCDHRLMSAA

SEQ ID NO: 74234 - protein, 11 aa, Dengue virus
TCDHRLMSAAI

SEQ ID NO: 74235 - protein, 11 aa, Dengue virus
NYCEGTTVVIS

SEQ ID NO: 74236 - protein, 11 aa, Dengue virus
YCEGTTVVISE

SEQ ID NO: 74237 - protein, 11 aa, Dengue virus
CEGTTVVIAEN

SEQ ID NO: 74238 - protein, 11 aa, Dengue virus
EGTTVVIAENC

SEQ ID NO: 74239 - protein, 11 aa, Dengue virus
GTTVVIAENCG

SEQ ID NO: 74240 - protein, 11 aa, Dengue virus
TTVVIAENCGT

SEQ ID NO: 74241 - protein, 11 aa, Dengue virus
CGTRGPALRTT

SEQ ID NO: 74242 - protein, 11 aa, Dengue virus
GTKGPSLRTTT

SEQ ID NO: 74243 - protein, 11 aa, Dengue virus
TSGPSLTTTTV

SEQ ID NO: 74244 - protein, 11 aa, Dengue virus
GGPSLRTTTVS

SEQ ID NO: 74245 - protein, 11 aa, Dengue virus
CWYGMEIRPVN

SEQ ID NO: 74246 - protein, 11 aa, Dengue virus
WYGMEIRPVNE

SEQ ID NO: 74247 - protein, 11 aa, Dengue virus
YGMEIRPVNEK

SEQ ID NO: 74248 - protein, 11 aa, Dengue virus
GMEIRPVNEKE

SEQ ID NO: 74249 - protein, 11 aa, Dengue virus
MEIRPVNEKEE

SEQ ID NO: 74250 - protein, 11 aa, Dengue virus
EIRPVNEKEEN

SEQ ID NO: 74251 - protein, 11 aa, Dengue virus
IRPVNEKEENM

SEQ ID NO: 74252 - protein, 11 aa, Dengue virus
RPVNEKEENMV

SEQ ID NO: 74253 - protein, 11 aa, Dengue virus
PVNEKEENMVK

SEQ ID NO: 74254 - protein, 11 aa, Dengue virus
VNEKEENMVKS

SEQ ID NO: 74255 - protein, 11 aa, Dengue virus
VKSLASAGSGK

SEQ ID NO: 74256 - protein, 11 aa, Dengue virus
KSLVSAGSGKM

SEQ ID NO: 74257 - protein, 11 aa, Dengue virus
SLVSAGSGKMD

SEQ ID NO: 74258 - protein, 11 aa, Dengue virus
LVSAGSGKMDN

SEQ ID NO: 74259 - protein, 11 aa, Dengue virus
VSAGSGKMDNF

SEQ ID NO: 74260 - protein, 11 aa, Dengue virus
SAGSGKMDNFT

SEQ ID NO: 74261 - protein, 11 aa, Dengue virus
AGSGKMDNFTM

SEQ ID NO: 74262 - protein, 11 aa, Dengue virus
GSGKMDNFTMG

SEQ ID NO: 74263 - protein, 11 aa, Dengue virus
ADNFTMGVLCL

SEQ ID NO: 74264 - protein, 11 aa, Dengue virus
FTMGALCLAIL

SEQ ID NO: 74265 - protein, 11 aa, Dengue virus
TMGALCLAILF

SEQ ID NO: 74266 - protein, 11 aa, Dengue virus
MGALCLAILFE

SEQ ID NO: 74267 - protein, 11 aa, Dengue virus
GALCLAILFEE

SEQ ID NO: 74268 - protein, 11 aa, Dengue virus
ALCLAILFEEV

SEQ ID NO: 74269 - protein, 11 aa, Dengue virus
KFGKKHMIAGA

SEQ ID NO: 74270 - protein, 11 aa, Dengue virus
LTFVLLLSGQI

SEQ ID NO: 74271 - protein, 11 aa, Dengue virus
IFVLLLSGQIT

SEQ ID NO: 74272 - protein, 11 aa, Dengue virus
MLLLSGQITWR

SEQ ID NO: 74273 - protein, 11 aa, Dengue virus
LLSGQITWRDV

SEQ ID NO: 74274 - protein, 11 aa, Dengue virus
LSGQITWRDLA

SEQ ID NO: 74275 - protein, 11 aa, Dengue virus
TLIMIGSNATD

SEQ ID NO: 74276 - protein, 11 aa, Dengue virus
LIMIGSNATDR

SEQ ID NO: 74277 - protein, 11 aa, Dengue virus
IMIGSNATDRM

SEQ ID NO: 74278 - protein, 11 aa, Dengue virus
MIGSNATDRMG

SEQ ID NO: 74279 - protein, 11 aa, Dengue virus
IGSNASDKMGM

SEQ ID NO: 74280 - protein, 11 aa, Dengue virus
GSNATDRMGMG

SEQ ID NO: 74281 - protein, 11 aa, Dengue virus
SNATDRMGMGV

SEQ ID NO: 74282 - protein, 11 aa, Dengue virus
NATDRMGMGVT

SEQ ID NO: 74283 - protein, 11 aa, Dengue virus
ATDRMGMGVTY

SEQ ID NO: 74284 - protein, 11 aa, Dengue virus
SDKMGMGVTYL

SEQ ID NO: 74285 - protein, 11 aa, Dengue virus
TYLALIATFKV

SEQ ID NO: 74286 - protein, 11 aa, Dengue virus
YLALIATFKVQ

SEQ ID NO: 74287 - protein, 11 aa, Dengue virus
IATFKVQPFLA

SEQ ID NO: 74288 - protein, 11 aa, Dengue virus
LAMATTLQLPA

SEQ ID NO: 74289 - protein, 11 aa, Dengue virus
AMTTTLQLPED

SEQ ID NO: 74290 - protein, 11 aa, Dengue virus
MTTTLQLPEDI

SEQ ID NO: 74291 - protein, 11 aa, Dengue virus
ATTLQLPADIE

SEQ ID NO: 74292 - protein, 11 aa, Dengue virus
TTLQLPADIEQ

SEQ ID NO: 74293 - protein, 11 aa, Dengue virus
TLQLPADIEQM

SEQ ID NO: 74294 - protein, 11 aa, Dengue virus
IALGLMALKLT

SEQ ID NO: 74295 - protein, 11 aa, Dengue virus
ALGLMALKLTT

SEQ ID NO: 74296 - protein, 11 aa, Dengue virus
LGLMALKLTTQ

SEQ ID NO: 74297 - protein, 11 aa, Dengue virus
GLMALKLTTQF

SEQ ID NO: 74298 - protein, 11 aa, Dengue virus
LMALKLTTQFE

SEQ ID NO: 74299 - protein, 11 aa, Dengue virus
MALKLTTQFET

SEQ ID NO: 74300 - protein, 11 aa, Dengue virus
ALKLTTQFETY

SEQ ID NO: 74301 - protein, 11 aa, Dengue virus
ITQFETYQLWA

SEQ ID NO: 74302 - protein, 11 aa, Dengue virus
FETYQLWAALV

SEQ ID NO: 74303 - protein, 11 aa, Dengue virus
ETYQLWAALVS

SEQ ID NO: 74304 - protein, 11 aa, Dengue virus
TYQLWAALVSL

SEQ ID NO: 74305 - protein, 11 aa, Dengue virus
YQLWTALVSLM

SEQ ID NO: 74306 - protein, 11 aa, Dengue virus
QLWTALVSLMC

SEQ ID NO: 74307 - protein, 11 aa, Dengue virus
SLMCSNTIFTL

SEQ ID NO: 74308 - protein, 11 aa, Dengue virus
LMCSNTIFTLT

SEQ ID NO: 74309 - protein, 11 aa, Dengue virus
MCSNTIFTLTV

SEQ ID NO: 74310 - protein, 11 aa, Dengue virus
CANTIFTLTVA

SEQ ID NO: 74311 - protein, 11 aa, Dengue virus
ANTIFTLTVAW

SEQ ID NO: 74312 - protein, 11 aa, Dengue virus
WRTATLILAVI

SEQ ID NO: 74313 - protein, 11 aa, Dengue virus
RTATLILAVIS

SEQ ID NO: 74314 - protein, 11 aa, Dengue virus
TATLILAVISL

SEQ ID NO: 74315 - protein, 11 aa, Dengue virus
ATLILAVISLL

SEQ ID NO: 74316 - protein, 11 aa, Dengue virus
TLILAVISLLP

SEQ ID NO: 74317 - protein, 11 aa, Dengue virus
ISLLPVCQSSS

SEQ ID NO: 74318 - protein, 11 aa, Dengue virus
SLLPMCQSSSM

SEQ ID NO: 74319 - protein, 11 aa, Dengue virus
LLPMCQSSSMR

SEQ ID NO: 74320 - protein, 11 aa, Dengue virus
PVCQSSSMRKS

SEQ ID NO: 74321 - protein, 11 aa, Dengue virus
VCQSSSMRKSD

SEQ ID NO: 74322 - protein, 11 aa, Dengue virus
SSMRKTDWLPV

SEQ ID NO: 74323 - protein, 11 aa, Dengue virus
SMRKSDWLPMT

SEQ ID NO: 74324 - protein, 11 aa, Dengue virus
MRKSDWLPMTV

SEQ ID NO: 74325 - protein, 11 aa, Dengue virus
RKSDWLPMTVA

SEQ ID NO: 74326 - protein, 11 aa, Dengue virus
KSDWLPMTVAA

SEQ ID NO: 74327 - protein, 11 aa, Dengue virus
SDWLPMTVAAM

SEQ ID NO: 74328 - protein, 11 aa, Dengue virus
DWLPVAVAAMG

SEQ ID NO: 74329 - protein, 11 aa, Dengue virus
WLPVAVAAMGV

SEQ ID NO: 74330 - protein, 11 aa, Dengue virus
VAAMGAQPLPL

SEQ ID NO: 74331 - protein, 11 aa, Dengue virus
AAMGAQPLPLF

SEQ ID NO: 74332 - protein, 11 aa, Dengue virus
AMGAQPLPLFI

SEQ ID NO: 74333 - protein, 11 aa, Dengue virus
MGAQPLPLFIF

SEQ ID NO: 74334 - protein, 11 aa, Dengue virus
PLPLFIFNLKD

SEQ ID NO: 74335 - protein, 11 aa, Dengue virus
LPLFIFSLKDA

SEQ ID NO: 74336 - protein, 11 aa, Dengue virus
LKDTPKRKSWP

SEQ ID NO: 74337 - protein, 11 aa, Dengue virus
KDTPKRKSWPL

SEQ ID NO: 74338 - protein, 11 aa, Dengue virus
DTPKRKSWPLN

SEQ ID NO: 74339 - protein, 11 aa, Dengue virus
TPKRKSWPLNE

SEQ ID NO: 74340 - protein, 11 aa, Dengue virus
PKRKSWPLNEG

SEQ ID NO: 74341 - protein, 11 aa, Dengue virus
GTSADLTVEKV

SEQ ID NO: 74342 - protein, 11 aa, Dengue virus
TSADLTVEKVA

SEQ ID NO: 74343 - protein, 11 aa, Dengue virus
SADLTVEKVAD

SEQ ID NO: 74344 - protein, 11 aa, Dengue virus
AEVTWEEEAEQ

SEQ ID NO: 74345 - protein, 11 aa, Dengue virus
EVTWEEEAEQT

SEQ ID NO: 74346 - protein, 11 aa, Dengue virus
MITVDDDGTMK

SEQ ID NO: 74347 - protein, 11 aa, Dengue virus
ITVDDDGTMKI

SEQ ID NO: 74348 - protein, 11 aa, Dengue virus
LVWHTWQKRTQ

SEQ ID NO: 74349 - protein, 11 aa, Dengue virus
VWHTWQKRTQR

SEQ ID NO: 74350 - protein, 11 aa, Dengue virus
WHTWQKRTQRS

SEQ ID NO: 74351 - protein, 11 aa, Dengue virus
HTWQKRTQRSG

SEQ ID NO: 74352 - protein, 11 aa, Dengue virus
TWQKRTQRSGV

SEQ ID NO: 74353 - protein, 11 aa, Dengue virus
RINQQGIFGKT

SEQ ID NO: 74354 - protein, 11 aa, Dengue virus
FGKTQVGVGIQ

SEQ ID NO: 74355 - protein, 11 aa, Dengue virus
LAYNGKRLEPN

SEQ ID NO: 74356 - protein, 11 aa, Dengue virus
AYNGKRLEPNW

SEQ ID NO: 74357 - protein, 11 aa, Dengue virus
LISYGGGWKLS

SEQ ID NO: 74358 - protein, 11 aa, Dengue virus
ISYGGGWKLSA

SEQ ID NO: 74359 - protein, 11 aa, Dengue virus
SYGGGWKLSAQ

SEQ ID NO: 74360 - protein, 11 aa, Dengue virus
YGGGWKLSAQW

SEQ ID NO: 74361 - protein, 11 aa, Dengue virus
GGGWKLSAQWQ

SEQ ID NO: 74362 - protein, 11 aa, Dengue virus
GGWKLSAQWQK

SEQ ID NO: 74363 - protein, 11 aa, Dengue virus
GWKLSAQWQKG

SEQ ID NO: 74364 - protein, 11 aa, Dengue virus
WKLSAQWQKGE

SEQ ID NO: 74365 - protein, 11 aa, Dengue virus
KLSAQWQKGEE

SEQ ID NO: 74366 - protein, 11 aa, Dengue virus
LSTQWQKGEEV

SEQ ID NO: 74367 - protein, 11 aa, Dengue virus
STQWQKGEEVQ

SEQ ID NO: 74368 - protein, 11 aa, Dengue virus
AQWKKGEEVQV

SEQ ID NO: 74369 - protein, 11 aa, Dengue virus
QWQRGEEVQVI

SEQ ID NO: 74370 - protein, 11 aa, Dengue virus
NPKNFQTTPGT

SEQ ID NO: 74371 - protein, 11 aa, Dengue virus
PKNFQTTPGTF

SEQ ID NO: 74372 - protein, 11 aa, Dengue virus
KNFQTTPGTFQ

SEQ ID NO: 74373 - protein, 11 aa, Dengue virus
NFQTTPGTFQT

SEQ ID NO: 74374 - protein, 11 aa, Dengue virus
FQTTPGTFQTT

SEQ ID NO: 74375 - protein, 11 aa, Dengue virus
PGIFQTTMGEI

SEQ ID NO: 74376 - protein, 11 aa, Dengue virus
GIFQTTMGEIG

SEQ ID NO: 74377 - protein, 11 aa, Dengue virus
IFQTTMGEIGA

SEQ ID NO: 74378 - protein, 11 aa, Dengue virus
FQTITGEIGAI

SEQ ID NO: 74379 - protein, 11 aa, Dengue virus
QTTAGEIGAIA

SEQ ID NO: 74380 - protein, 11 aa, Dengue virus
TTAGEIGAIAL

SEQ ID NO: 74381 - protein, 11 aa, Dengue virus
ITGEIGAIALD

SEQ ID NO: 74382 - protein, 11 aa, Dengue virus
GLPIRYQTSAT

SEQ ID NO: 74383 - protein, 11 aa, Dengue virus
LPIRYQTTVTK

SEQ ID NO: 74384 - protein, 11 aa, Dengue virus
PIRYQTTATRS

SEQ ID NO: 74385 - protein, 11 aa, Dengue virus
IRYQTSATKSE

SEQ ID NO: 74386 - protein, 11 aa, Dengue virus
RYQTTATRSEH

SEQ ID NO: 74387 - protein, 11 aa, Dengue virus
YQTSATKSEHT

SEQ ID NO: 74388 - protein, 11 aa, Dengue virus
QTSATKSEHTG

SEQ ID NO: 74389 - protein, 11 aa, Dengue virus
TTAIKSEHTGR

SEQ ID NO: 74390 - protein, 11 aa, Dengue virus
TAIKSEHTGRE

SEQ ID NO: 74391 - protein, 11 aa, Dengue virus
AIKSEHTGREI

SEQ ID NO: 74392 - protein, 11 aa, Dengue virus
IKSEHTGREIV

SEQ ID NO: 74393 - protein, 11 aa, Dengue virus
PVRVPNYNLIV

SEQ ID NO: 74394 - protein, 11 aa, Dengue virus
VRVPNYNLIVM

SEQ ID NO: 74395 - protein, 11 aa, Dengue virus
RVPNYNLIVMD

SEQ ID NO: 74396 - protein, 11 aa, Dengue virus
VPNYNLIVMDE

SEQ ID NO: 74397 - protein, 11 aa, Dengue virus
PNYNLIVMDEA

SEQ ID NO: 74398 - protein, 11 aa, Dengue virus
NYNLIVMDEAH

SEQ ID NO: 74399 - protein, 11 aa, Dengue virus
YNLIVMDEAHF

SEQ ID NO: 74400 - protein, 11 aa, Dengue virus
NLIVMDEAHFT

SEQ ID NO: 74401 - protein, 11 aa, Dengue virus
LIVMDEAHFTD

SEQ ID NO: 74402 - protein, 11 aa, Dengue virus
IVMDEAHFTDP

SEQ ID NO: 74403 - protein, 11 aa, Dengue virus
NSGNDWITDFA

SEQ ID NO: 74404 - protein, 11 aa, Dengue virus
SGNDWITDFAG

SEQ ID NO: 74405 - protein, 11 aa, Dengue virus
GNDWITDFAGK

SEQ ID NO: 74406 - protein, 11 aa, Dengue virus
NDWITDFAGKT

SEQ ID NO: 74407 - protein, 11 aa, Dengue virus
DWITDFAGKTV

SEQ ID NO: 74408 - protein, 11 aa, Dengue virus
WITDFTGKTVW

SEQ ID NO: 74409 - protein, 11 aa, Dengue virus
ITDFTGKTVWF

SEQ ID NO: 74410 - protein, 11 aa, Dengue virus
TDFTGKTVWFV

SEQ ID NO: 74411 - protein, 11 aa, Dengue virus
DFTGKTVWFVP

SEQ ID NO: 74412 - protein, 11 aa, Dengue virus
FTGKTVWFVPS

SEQ ID NO: 74413 - protein, 11 aa, Dengue virus
TGKTVWFVPSI

SEQ ID NO: 74414 - protein, 11 aa, Dengue virus
NTEYQKTKLND

SEQ ID NO: 74415 - protein, 11 aa, Dengue virus
RVGRNSQKEND

SEQ ID NO: 74416 - protein, 11 aa, Dengue virus
VGRNSQKENDQ

SEQ ID NO: 74417 - protein, 11 aa, Dengue virus
GRNSQKENDQY

SEQ ID NO: 74418 - protein, 11 aa, Dengue virus
RNSQKENDQYI

SEQ ID NO: 74419 - protein, 11 aa, Dengue virus
NSQKENDQYIF

SEQ ID NO: 74420 - protein, 11 aa, Dengue virus
PPKENDQYIFT

SEQ ID NO: 74421 - protein, 11 aa, Dengue virus
PKENDQYIFTG

SEQ ID NO: 74422 - protein, 11 aa, Dengue virus
DFAAGRKSIAF

SEQ ID NO: 74423 - protein, 11 aa, Dengue virus
EIGRVPSHLAY

SEQ ID NO: 74424 - protein, 11 aa, Dengue virus
IGRVPSHLAYR

SEQ ID NO: 74425 - protein, 11 aa, Dengue virus
GRVPSHLAYRT

SEQ ID NO: 74426 - protein, 11 aa, Dengue virus
RVPSHLAYRTR

SEQ ID NO: 74427 - protein, 11 aa, Dengue virus
VPSHLAYRTRN

SEQ ID NO: 74428 - protein, 11 aa, Dengue virus
PSHLAYRTRNA

SEQ ID NO: 74429 - protein, 11 aa, Dengue virus
SHLAYRTRNAL

SEQ ID NO: 74430 - protein, 11 aa, Dengue virus
HLAYRTRSALD

SEQ ID NO: 74431 - protein, 11 aa, Dengue virus
LAHRTRSALDN

SEQ ID NO: 74432 - protein, 11 aa, Dengue virus
PHRTRNALDNL

SEQ ID NO: 74433 - protein, 11 aa, Dengue virus
TSEDGGRAYRH

SEQ ID NO: 74434 - protein, 11 aa, Dengue virus
LLTGGAMLFLV

SEQ ID NO: 74435 - protein, 11 aa, Dengue virus
LTGGAMLFLVS

SEQ ID NO: 74436 - protein, 11 aa, Dengue virus
TGGAMLFLVSG

SEQ ID NO: 74437 - protein, 11 aa, Dengue virus
GGAMLFLISGR

SEQ ID NO: 74438 - protein, 11 aa, Dengue virus
GAMLFLISGRG

SEQ ID NO: 74439 - protein, 11 aa, Dengue virus
MLFLISGRGIG

SEQ ID NO: 74440 - protein, 11 aa, Dengue virus
LFLISGRGIGK

SEQ ID NO: 74441 - protein, 11 aa, Dengue virus
FLISGRGIGKA

SEQ ID NO: 74442 - protein, 11 aa, Dengue virus
LISGRGIGKAS

SEQ ID NO: 74443 - protein, 11 aa, Dengue virus
ISGRGIGKASI

SEQ ID NO: 74444 - protein, 11 aa, Dengue virus
SGKGIGKTTIG

SEQ ID NO: 74445 - protein, 11 aa, Dengue virus
GKGIGKTTIGL

SEQ ID NO: 74446 - protein, 11 aa, Dengue virus
KGIGKTTIGLI

SEQ ID NO: 74447 - protein, 11 aa, Dengue virus
GIGKTTIGLIC

SEQ ID NO: 74448 - protein, 11 aa, Dengue virus
IGKTTIGLICV

SEQ ID NO: 74449 - protein, 11 aa, Dengue virus
GKTTIGLICVI

SEQ ID NO: 74450 - protein, 11 aa, Dengue virus
KTSIGLICVVA

SEQ ID NO: 74451 - protein, 11 aa, Dengue virus
TSIGLICVVAS

SEQ ID NO: 74452 - protein, 11 aa, Dengue virus
SIGLICVVASS

SEQ ID NO: 74453 - protein, 11 aa, Dengue virus
IGLICVVASSG

SEQ ID NO: 74454 - protein, 11 aa, Dengue virus
GLICVVASSGM

SEQ ID NO: 74455 - protein, 11 aa, Dengue virus
LICVVASSGML

SEQ ID NO: 74456 - protein, 11 aa, Dengue virus
ICVVASSGMLW

SEQ ID NO: 74457 - protein, 11 aa, Dengue virus
CVVASSGMLWM

SEQ ID NO: 74458 - protein, 11 aa, Dengue virus
VVASSGMLWMA

SEQ ID NO: 74459 - protein, 11 aa, Dengue virus
SSGMLWMAEVP

SEQ ID NO: 74460 - protein, 11 aa, Dengue virus
SGMLWMAEVPL

SEQ ID NO: 74461 - protein, 11 aa, Dengue virus
GMLWMAEVPLQ

SEQ ID NO: 74462 - protein, 11 aa, Dengue virus
MLWMAEVPLQW

SEQ ID NO: 74463 - protein, 11 aa, Dengue virus
LWMAEVPLQWI

SEQ ID NO: 74464 - protein, 11 aa, Dengue virus
WMAEVPLQWIA

SEQ ID NO: 74465 - protein, 11 aa, Dengue virus
MAEVPLQWIAS

SEQ ID NO: 74466 - protein, 11 aa, Dengue virus
AEVPLQWIASA

SEQ ID NO: 74467 - protein, 11 aa, Dengue virus
EVPLQWIASAI

SEQ ID NO: 74468 - protein, 11 aa, Dengue virus
VPLQWIASAII

SEQ ID NO: 74469 - protein, 11 aa, Dengue virus
VIGILTLAATI

SEQ ID NO: 74470 - protein, 11 aa, Dengue virus
IGILTLAAIVT

SEQ ID NO: 74471 - protein, 11 aa, Dengue virus
GILTLAAIVTA

SEQ ID NO: 74472 - protein, 11 aa, Dengue virus
ILTLAAIVTAN

SEQ ID NO: 74473 - protein, 11 aa, Dengue virus
LTLAAIVTANE

SEQ ID NO: 74474 - protein, 11 aa, Dengue virus
TLAAIVTANEM

SEQ ID NO: 74475 - protein, 11 aa, Dengue virus
LAAIVTANEMG

SEQ ID NO: 74476 - protein, 11 aa, Dengue virus
AAIVTANEMGL

SEQ ID NO: 74477 - protein, 11 aa, Dengue virus
AIVTANEMGLL

SEQ ID NO: 74478 - protein, 11 aa, Dengue virus
IVTANEMGLLE

SEQ ID NO: 74479 - protein, 11 aa, Dengue virus
VTANEMGLLET

SEQ ID NO: 74480 - protein, 11 aa, Dengue virus
KKDLGMSKEPG

SEQ ID NO: 74481 - protein, 11 aa, Dengue virus
KDLGMSKEPGV

SEQ ID NO: 74482 - protein, 11 aa, Dengue virus
DLGMSREPGVV

SEQ ID NO: 74483 - protein, 11 aa, Dengue virus
LGMSREPGVVS

SEQ ID NO: 74484 - protein, 11 aa, Dengue virus
GMSKEPGVVSS

SEQ ID NO: 74485 - protein, 11 aa, Dengue virus
EPGVVSSTSYL

SEQ ID NO: 74486 - protein, 11 aa, Dengue virus
PGVVSSTSYLD

SEQ ID NO: 74487 - protein, 11 aa, Dengue virus
GVVSSTSYLDV

SEQ ID NO: 74488 - protein, 11 aa, Dengue virus
VVSSTSYLDVD

SEQ ID NO: 74489 - protein, 11 aa, Dengue virus
VSSTSYLDVDL

SEQ ID NO: 74490 - protein, 11 aa, Dengue virus
SPNSYLDVDLH

SEQ ID NO: 74491 - protein, 11 aa, Dengue virus
PNSYLDVDLHP

SEQ ID NO: 74492 - protein, 11 aa, Dengue virus
SQVNPLTLIAA

SEQ ID NO: 74493 - protein, 11 aa, Dengue virus
QVNPLTLIAAV

SEQ ID NO: 74494 - protein, 11 aa, Dengue virus
VNPLTLIAAVL

SEQ ID NO: 74495 - protein, 11 aa, Dengue virus
NPLTLIAAVLL

SEQ ID NO: 74496 - protein, 11 aa, Dengue virus
PLTLIAAVLLL

SEQ ID NO: 74497 - protein, 11 aa, Dengue virus
LTLTAVVLLLV

SEQ ID NO: 74498 - protein, 11 aa, Dengue virus
TLTAVVLLLVT

SEQ ID NO: 74499 - protein, 11 aa, Dengue virus
LTAVVLLLVTH

SEQ ID NO: 74500 - protein, 11 aa, Dengue virus
TAVVLLLVTHY

SEQ ID NO: 74501 - protein, 11 aa, Dengue virus
AVVLLLVTHYA

SEQ ID NO: 74502 - protein, 11 aa, Dengue virus
VVLLLVTHYAI

SEQ ID NO: 74503 - protein, 11 aa, Dengue virus
GQVMLLILCAV

SEQ ID NO: 74504 - protein, 11 aa, Dengue virus
QVMLLVLCVVQ

SEQ ID NO: 74505 - protein, 11 aa, Dengue virus
VMLLVLCVVQL

SEQ ID NO: 74506 - protein, 11 aa, Dengue virus
MLLILCAVQLL

SEQ ID NO: 74507 - protein, 11 aa, Dengue virus
LLVLCVVQLLL

SEQ ID NO: 74508 - protein, 11 aa, Dengue virus
LVLCVVQLLLM

SEQ ID NO: 74509 - protein, 11 aa, Dengue virus
ILCAVQLLLMR

SEQ ID NO: 74510 - protein, 11 aa, Dengue virus
LMRTSWALCEV

SEQ ID NO: 74511 - protein, 11 aa, Dengue virus
MRTSWALCEVL

SEQ ID NO: 74512 - protein, 11 aa, Dengue virus
RTSWALCEVLT

SEQ ID NO: 74513 - protein, 11 aa, Dengue virus
TSWALCEVLTL

SEQ ID NO: 74514 - protein, 11 aa, Dengue virus
SWALCEVLTLA

SEQ ID NO: 74515 - protein, 11 aa, Dengue virus
WALCEVLTLAT

SEQ ID NO: 74516 - protein, 11 aa, Dengue virus
ALCEVLTLATG

SEQ ID NO: 74517 - protein, 11 aa, Dengue virus
LCEVLTLATGP

SEQ ID NO: 74518 - protein, 11 aa, Dengue virus
FSVMKSVGTGK

SEQ ID NO: 74519 - protein, 11 aa, Dengue virus
SVMKSVGTGKR

SEQ ID NO: 74520 - protein, 11 aa, Dengue virus
VMKSVGTGKRG

SEQ ID NO: 74521 - protein, 11 aa, Dengue virus
SVGTGKRGTGT

SEQ ID NO: 74522 - protein, 11 aa, Dengue virus
VGTGKRGTGTQ

SEQ ID NO: 74523 - protein, 11 aa, Dengue virus
GTGKRGTGTQG

SEQ ID NO: 74524 - protein, 11 aa, Dengue virus
TGKRGTGTQGE

SEQ ID NO: 74525 - protein, 11 aa, Dengue virus
GETLGEKWKRK

SEQ ID NO: 74526 - protein, 11 aa, Dengue virus
ETLGEKWKRKL

SEQ ID NO: 74527 - protein, 11 aa, Dengue virus
TLGEKWKRKLN

SEQ ID NO: 74528 - protein, 11 aa, Dengue virus
LGEKWKRKLNQ

SEQ ID NO: 74529 - protein, 11 aa, Dengue virus
GEKWKRKLNQL

SEQ ID NO: 74530 - protein, 11 aa, Dengue virus
EKWKRKLNQLS

SEQ ID NO: 74531 - protein, 11 aa, Dengue virus
KWKRKLNQLSR

SEQ ID NO: 74532 - protein, 11 aa, Dengue virus
WKRKLNQLSRK

SEQ ID NO: 74533 - protein, 11 aa, Dengue virus
RLNQLSRKEFD

SEQ ID NO: 74534 - protein, 11 aa, Dengue virus
LNQLSRREFDL

SEQ ID NO: 74535 - protein, 11 aa, Dengue virus
NQLSRREFDLY

SEQ ID NO: 74536 - protein, 11 aa, Dengue virus
QLSWKEFDLYK

SEQ ID NO: 74537 - protein, 11 aa, Dengue virus
LSWKEFDLYKK

SEQ ID NO: 74538 - protein, 11 aa, Dengue virus
SWKEFDLYKKS

SEQ ID NO: 74539 - protein, 11 aa, Dengue virus
RREFDLYKKSG

SEQ ID NO: 74540 - protein, 11 aa, Dengue virus
KKSGITEVDRS

SEQ ID NO: 74541 - protein, 11 aa, Dengue virus
KSGITEVDRSE

SEQ ID NO: 74542 - protein, 11 aa, Dengue virus
SGITEVDRSEA

SEQ ID NO: 74543 - protein, 11 aa, Dengue virus
GITEVDRSEAK

SEQ ID NO: 74544 - protein, 11 aa, Dengue virus
ITEVDRSEAKE

SEQ ID NO: 74545 - protein, 11 aa, Dengue virus
TEVDRSEAKEG

SEQ ID NO: 74546 - protein, 11 aa, Dengue virus
EVDRSEAKEGL

SEQ ID NO: 74547 - protein, 11 aa, Dengue virus
VDRSEAKEGLK

SEQ ID NO: 74548 - protein, 11 aa, Dengue virus
DRSEAKEGLKR

SEQ ID NO: 74549 - protein, 11 aa, Dengue virus
RSEAKEGLKRG

SEQ ID NO: 74550 - protein, 11 aa, Dengue virus
SEAKEGLKRGE

SEQ ID NO: 74551 - protein, 11 aa, Dengue virus
EAKEGLKKGEI

SEQ ID NO: 74552 - protein, 11 aa, Dengue virus
AKEGLKKGEIT

SEQ ID NO: 74553 - protein, 11 aa, Dengue virus
KGEITHHAVSR

SEQ ID NO: 74554 - protein, 11 aa, Dengue virus
GEITRHAVSRG

SEQ ID NO: 74555 - protein, 11 aa, Dengue virus
ETTHHAVSRGT

SEQ ID NO: 74556 - protein, 11 aa, Dengue virus
TTHHAVSRGTA

SEQ ID NO: 74557 - protein, 11 aa, Dengue virus
VPMSTYGWNII

SEQ ID NO: 74558 - protein, 11 aa, Dengue virus
PMSTYGWNIIK

SEQ ID NO: 74559 - protein, 11 aa, Dengue virus
MSTYGWNIIKL

SEQ ID NO: 74560 - protein, 11 aa, Dengue virus
STYGWNIIKLM

SEQ ID NO: 74561 - protein, 11 aa, Dengue virus
TYGWNIVKLMT

SEQ ID NO: 74562 - protein, 11 aa, Dengue virus
YGWNIIKLMSG

SEQ ID NO: 74563 - protein, 11 aa, Dengue virus
GWNIIKLMSGK

SEQ ID NO: 74564 - protein, 11 aa, Dengue virus
WNIIKLMSGKD

SEQ ID NO: 74565 - protein, 11 aa, Dengue virus
NIVKLMTGKDV

SEQ ID NO: 74566 - protein, 11 aa, Dengue virus
IVKLMTGKDVF

SEQ ID NO: 74567 - protein, 11 aa, Dengue virus
IKLMSGKDVFY

SEQ ID NO: 74568 - protein, 11 aa, Dengue virus
VLKMVEPWLRS

SEQ ID NO: 74569 - protein, 11 aa, Dengue virus
LKMVEPWLRSN

SEQ ID NO: 74570 - protein, 11 aa, Dengue virus
KMVEPWLRSNQ

SEQ ID NO: 74571 - protein, 11 aa, Dengue virus
WLKNNQFCIKI

SEQ ID NO: 74572 - protein, 11 aa, Dengue virus
LKNNQFCIKIL

SEQ ID NO: 74573 - protein, 11 aa, Dengue virus
KNNQFCIKILN

SEQ ID NO: 74574 - protein, 11 aa, Dengue virus
CIKILNPYMPT

SEQ ID NO: 74575 - protein, 11 aa, Dengue virus
IKILNPYMPTV

SEQ ID NO: 74576 - protein, 11 aa, Dengue virus
KVLNPYMPTVV

SEQ ID NO: 74577 - protein, 11 aa, Dengue virus
VLNPYMPTVVE

SEQ ID NO: 74578 - protein, 11 aa, Dengue virus
LNPYMPTVVEH

SEQ ID NO: 74579 - protein, 11 aa, Dengue virus
NPYMPTVVEHL

SEQ ID NO: 74580 - protein, 11 aa, Dengue virus
PYMPTVVEHLE

SEQ ID NO: 74581 - protein, 11 aa, Dengue virus
YMPTVVEHLER

SEQ ID NO: 74582 - protein, 11 aa, Dengue virus
MPTVVEHLERL

SEQ ID NO: 74583 - protein, 11 aa, Dengue virus
PTVVEHLERLQ

SEQ ID NO: 74584 - protein, 11 aa, Dengue virus
TVVEHLERLQR

SEQ ID NO: 74585 - protein, 11 aa, Dengue virus
VEHLERLQRKH

SEQ ID NO: 74586 - protein, 11 aa, Dengue virus
SGNIVASVNMV

SEQ ID NO: 74587 - protein, 11 aa, Dengue virus
LLNRFTMTYRK

SEQ ID NO: 74588 - protein, 11 aa, Dengue virus
LNRFTMTYRKP

SEQ ID NO: 74589 - protein, 11 aa, Dengue virus
NRFTMTYRKPT

SEQ ID NO: 74590 - protein, 11 aa, Dengue virus
RFTMTYRKPTI

SEQ ID NO: 74591 - protein, 11 aa, Dengue virus
FTMTYRKPTIE

SEQ ID NO: 74592 - protein, 11 aa, Dengue virus
TMTYRKPTIEK

SEQ ID NO: 74593 - protein, 11 aa, Dengue virus
MTYRKPTIEKD

SEQ ID NO: 74594 - protein, 11 aa, Dengue virus
TYRKPTIEKDV

SEQ ID NO: 74595 - protein, 11 aa, Dengue virus
YRKPTIEKDVD

SEQ ID NO: 74596 - protein, 11 aa, Dengue virus
RRPTIERDVDL

SEQ ID NO: 74597 - protein, 11 aa, Dengue virus
RPTIERDVDLG

SEQ ID NO: 74598 - protein, 11 aa, Dengue virus
NMDVIGERLRR

SEQ ID NO: 74599 - protein, 11 aa, Dengue virus
MDVIGERVKRI

SEQ ID NO: 74600 - protein, 11 aa, Dengue virus
DVIGERIKRVK

SEQ ID NO: 74601 - protein, 11 aa, Dengue virus
VIGERIKRIKG

SEQ ID NO: 74602 - protein, 11 aa, Dengue virus
IGERIKRIKGE

SEQ ID NO: 74603 - protein, 11 aa, Dengue virus
GERIKRIKGEH

SEQ ID NO: 74604 - protein, 11 aa, Dengue virus
RIKGEHSKTWH

SEQ ID NO: 74605 - protein, 11 aa, Dengue virus
IKGEHSKTWHY

SEQ ID NO: 74606 - protein, 11 aa, Dengue virus
KGEHSKTWHYD

SEQ ID NO: 74607 - protein, 11 aa, Dengue virus
GEHSKTWHYDD

SEQ ID NO: 74608 - protein, 11 aa, Dengue virus
EHSSTWHYDEE

SEQ ID NO: 74609 - protein, 11 aa, Dengue virus
HSKTWHYDDEN

SEQ ID NO: 74610 - protein, 11 aa, Dengue virus
SKTWHYDDENP

SEQ ID NO: 74611 - protein, 11 aa, Dengue virus
TKPWDVVPMVI

SEQ ID NO: 74612 - protein, 11 aa, Dengue virus
KPWDVVPMVIQ

SEQ ID NO: 74613 - protein, 11 aa, Dengue virus
PWDVVPMVIQM

SEQ ID NO: 74614 - protein, 11 aa, Dengue virus
WDVVPMVIQMA

SEQ ID NO: 74615 - protein, 11 aa, Dengue virus
DVVPMVIQMAM

SEQ ID NO: 74616 - protein, 11 aa, Dengue virus
VVPMVIQMAMT

SEQ ID NO: 74617 - protein, 11 aa, Dengue virus
VPMVIQMAMTD

SEQ ID NO: 74618 - protein, 11 aa, Dengue virus
PMVIQMAMTDT

SEQ ID NO: 74619 - protein, 11 aa, Dengue virus
MVIQMAMTDTT

SEQ ID NO: 74620 - protein, 11 aa, Dengue virus
KEKVDTRTPKP

SEQ ID NO: 74621 - protein, 11 aa, Dengue virus
EKVDTRTPKPM

SEQ ID NO: 74622 - protein, 11 aa, Dengue virus
KVDTRTPKPMP

SEQ ID NO: 74623 - protein, 11 aa, Dengue virus
VDTRTPKPMPG

SEQ ID NO: 74624 - protein, 11 aa, Dengue virus
DTRTPKPMPGT

SEQ ID NO: 74625 - protein, 11 aa, Dengue virus
TRTPKPMPGTR

SEQ ID NO: 74626 - protein, 11 aa, Dengue virus
AMGITAEWLWR

SEQ ID NO: 74627 - protein, 11 aa, Dengue virus
MEITAGWLWRT

SEQ ID NO: 74628 - protein, 11 aa, Dengue virus
EITAGWLWRTL

SEQ ID NO: 74629 - protein, 11 aa, Dengue virus
RPRLCTREEFI

SEQ ID NO: 74630 - protein, 11 aa, Dengue virus
EFTRKVRTNAA

SEQ ID NO: 74631 - protein, 11 aa, Dengue virus
FTRKVRTNAAM

SEQ ID NO: 74632 - protein, 11 aa, Dengue virus
TRKVRTNAAMG

SEQ ID NO: 74633 - protein, 11 aa, Dengue virus
DSAKAAVEDEE

SEQ ID NO: 74634 - protein, 11 aa, Dengue virus
SAKAAVEDEEF

SEQ ID NO: 74635 - protein, 11 aa, Dengue virus
AKAAVEDEEFW

SEQ ID NO: 74636 - protein, 11 aa, Dengue virus
KAAVEDEEFWK

SEQ ID NO: 74637 - protein, 11 aa, Dengue virus
AAVEDEDFWIL

SEQ ID NO: 74638 - protein, 11 aa, Dengue virus
AVEDEDFWILV

SEQ ID NO: 74639 - protein, 11 aa, Dengue virus
VEDEDFWILVD

SEQ ID NO: 74640 - protein, 11 aa, Dengue virus
EDEEFWKLVDK

SEQ ID NO: 74641 - protein, 11 aa, Dengue virus
DEEFWKLVDKE

SEQ ID NO: 74642 - protein, 11 aa, Dengue virus
EEFWKLVDKER

SEQ ID NO: 74643 - protein, 11 aa, Dengue virus
FWILVDREREL

SEQ ID NO: 74644 - protein, 11 aa, Dengue virus
WILVDRERELH

SEQ ID NO: 74645 - protein, 11 aa, Dengue virus
ILVDRERELHK

SEQ ID NO: 74646 - protein, 11 aa, Dengue virus
LVDRERELHKQ

SEQ ID NO: 74647 - protein, 11 aa, Dengue virus
VDRERELHKQG

SEQ ID NO: 74648 - protein, 11 aa, Dengue virus
DRERELHKQGK

SEQ ID NO: 74649 - protein, 11 aa, Dengue virus
RERELHKQGKC

SEQ ID NO: 74650 - protein, 11 aa, Dengue virus
EDDLHNEEKIM

SEQ ID NO: 74651 - protein, 11 aa, Dengue virus
DDLHNEEKIMQ

SEQ ID NO: 74652 - protein, 11 aa, Dengue virus
DLHNEEKIMQQ

SEQ ID NO: 74653 - protein, 11 aa, Dengue virus
LHNEEKIMQQM

SEQ ID NO: 74654 - protein, 11 aa, Dengue virus
HNEEKIMQQMD

SEQ ID NO: 74655 - protein, 11 aa, Dengue virus
NEEKIMQQMDP

SEQ ID NO: 74656 - protein, 11 aa, Dengue virus
EEKIMQQMDPE

SEQ ID NO: 74657 - protein, 11 aa, Dengue virus
EKIMQQMDPEH

SEQ ID NO: 74658 - protein, 11 aa, Dengue virus
KIMQQMDPEHR

SEQ ID NO: 74659 - protein, 11 aa, Dengue virus
PEHRLLANAIF

SEQ ID NO: 74660 - protein, 11 aa, Dengue virus
EHRLLANAIFK

SEQ ID NO: 74661 - protein, 11 aa, Dengue virus
HRLLANAIFKL

SEQ ID NO: 74662 - protein, 11 aa, Dengue virus
RLLANAIFKLT

SEQ ID NO: 74663 - protein, 11 aa, Dengue virus
LLANAIFKLTY

SEQ ID NO: 74664 - protein, 11 aa, Dengue virus
FTNMEVQLIRQ

SEQ ID NO: 74665 - protein, 11 aa, Dengue virus
TNMEVQLIRQM

SEQ ID NO: 74666 - protein, 11 aa, Dengue virus
NMEVQLIRQME

SEQ ID NO: 74667 - protein, 11 aa, Dengue virus
MEVQLIRQMEG

SEQ ID NO: 74668 - protein, 11 aa, Dengue virus
EVQLIRQMEGE

SEQ ID NO: 74669 - protein, 11 aa, Dengue virus
VQLIRQMEGEG

SEQ ID NO: 74670 - protein, 11 aa, Dengue virus
VRQMEGEGVLT

SEQ ID NO: 74671 - protein, 11 aa, Dengue virus
RQMEGEGVLSE

SEQ ID NO: 74672 - protein, 11 aa, Dengue virus
QMEGEGVLSKT

SEQ ID NO: 74673 - protein, 11 aa, Dengue virus
IQWLETKGVER

SEQ ID NO: 74674 - protein, 11 aa, Dengue virus
QWLENKGVERL

SEQ ID NO: 74675 - protein, 11 aa, Dengue virus
WLETEGVERLK

SEQ ID NO: 74676 - protein, 11 aa, Dengue virus
LETEGVERLKR

SEQ ID NO: 74677 - protein, 11 aa, Dengue virus
ETEGVERLKRM

SEQ ID NO: 74678 - protein, 11 aa, Dengue virus
TEGVERLKRMA

SEQ ID NO: 74679 - protein, 11 aa, Dengue virus
EGVERLKRMAI

SEQ ID NO: 74680 - protein, 11 aa, Dengue virus
CLGKAYAQMWT

SEQ ID NO: 74681 - protein, 11 aa, Dengue virus
LGKAYAQMWTL

SEQ ID NO: 74682 - protein, 11 aa, Dengue virus
GKAYAQMWTLM

SEQ ID NO: 74683 - protein, 11 aa, Dengue virus
KAYAQMWTLMY

SEQ ID NO: 74684 - protein, 11 aa, Dengue virus
AYAQMWTLMYF

SEQ ID NO: 74685 - protein, 11 aa, Dengue virus
YAQMWTLMYFH

SEQ ID NO: 74686 - protein, 11 aa, Dengue virus
AQMWTLMYFHR

SEQ ID NO: 74687 - protein, 11 aa, Dengue virus
QMWTLMYFHRR

SEQ ID NO: 74688 - protein, 11 aa, Dengue virus
MWTLMYFHRRD

SEQ ID NO: 74689 - protein, 11 aa, Dengue virus
WTLMYFHRRDL

SEQ ID NO: 74690 - protein, 11 aa, Dengue virus
TLMYFHRRDLR

SEQ ID NO: 74691 - protein, 11 aa, Dengue virus
AICSAVPAHWV

SEQ ID NO: 74692 - protein, 11 aa, Dengue virus
ICSAVPAHWVP

SEQ ID NO: 74693 - protein, 11 aa, Dengue virus
CSAVPAHWVPT

SEQ ID NO: 74694 - protein, 11 aa, Dengue virus
SAVPAHWVPTS

SEQ ID NO: 74695 - protein, 11 aa, Dengue virus
AVPAHWVPTSR

SEQ ID NO: 74696 - protein, 11 aa, Dengue virus
VPAHWVPTSRT

SEQ ID NO: 74697 - protein, 11 aa, Dengue virus
PAHWVPTSRTT

SEQ ID NO: 74698 - protein, 11 aa, Dengue virus
AHWVPTSRTTW

SEQ ID NO: 74699 - protein, 11 aa, Dengue virus
HQWMTTEDMLS

SEQ ID NO: 74700 - protein, 11 aa, Dengue virus
QWMTTEDMLSV

SEQ ID NO: 74701 - protein, 11 aa, Dengue virus
WMTTEDMLSVW

SEQ ID NO: 74702 - protein, 11 aa, Dengue virus
MTTEDMLSVWN

SEQ ID NO: 74703 - protein, 11 aa, Dengue virus
TTEDMLSVWNR

SEQ ID NO: 74704 - protein, 11 aa, Dengue virus
TEDMLSVWNRV

SEQ ID NO: 74705 - protein, 11 aa, Dengue virus
EDMLSVWNRVW

SEQ ID NO: 74706 - protein, 11 aa, Dengue virus
DMLSVWNRVWI

SEQ ID NO: 74707 - protein, 11 aa, Dengue virus
MLSVWNRVWIE

SEQ ID NO: 74708 - protein, 11 aa, Dengue virus
LAVWNRVWIED

SEQ ID NO: 74709 - protein, 11 aa, Dengue virus
AVWNRVWIEDN

SEQ ID NO: 74710 - protein, 11 aa, Dengue virus
DNPWMEDKTPI

SEQ ID NO: 74711 - protein, 11 aa, Dengue virus
NPWMENKTPVT

SEQ ID NO: 74712 - protein, 11 aa, Dengue virus
PWMENKTPVTT

SEQ ID NO: 74713 - protein, 11 aa, Dengue virus
WMENKTPVTTW

SEQ ID NO: 74714 - protein, 11 aa, Dengue virus
MGDKTPVTTWE

SEQ ID NO: 74715 - protein, 11 aa, Dengue virus
EDKTPITTWEN

SEQ ID NO: 74716 - protein, 11 aa, Dengue virus
DKTPITTWENV

SEQ ID NO: 74717 - protein, 11 aa, Dengue virus
KTPITTWENVP

SEQ ID NO: 74718 - protein, 11 aa, Dengue virus
TPITTWENVPY

SEQ ID NO: 74719 - protein, 11 aa, Dengue virus
PITTWENVPYL

SEQ ID NO: 74720 - protein, 11 aa, Dengue virus
ITTWENVPYLG

SEQ ID NO: 74721 - protein, 11 aa, Dengue virus
SRATWAQNILI

SEQ ID NO: 74722 - protein, 11 aa, Dengue virus
RATWAQNILIA

SEQ ID NO: 74723 - protein, 11 aa, Dengue virus
ATWAQNILIAI

SEQ ID NO: 74724 - protein, 11 aa, Dengue virus
TWAQNILIAIQ

SEQ ID NO: 74725 - protein, 11 aa, Dengue virus
WAQNILIAIQQ

SEQ ID NO: 74726 - protein, 11 aa, Dengue virus
AQNILIAIQQV

SEQ ID NO: 74727 - protein, 11 aa, Dengue virus
QNILIAIQQVR

SEQ ID NO: 74728 - protein, 11 aa, Dengue virus
NILIAIQQVRS

SEQ ID NO: 74729 - protein, 11 aa, Dengue virus
ILIAIQQVRSL

SEQ ID NO: 74730 - protein, 11 aa, Dengue virus
LIAIQQVRSLI

SEQ ID NO: 74731 - protein, 11 aa, Dengue virus
SMKRFRKEEET

SEQ ID NO: 74732 - protein, 11 aa, Dengue virus
MKRFRKEEETE

SEQ ID NO: 74733 - protein, 11 aa, Dengue virus
KRFRKEEETEG

SEQ ID NO: 74734 - protein, 11 aa, Dengue virus
RFRKEEETEGA

SEQ ID NO: 74735 - protein, 11 aa, Dengue virus
FRKEEETEGAI

SEQ ID NO: 74736 - protein, 11 aa, Dengue virus
RKEEETEGAIW

SEQ ID NO: 74737 - protein, 11 aa, Dengue virus
KKSGAIRVLRG

SEQ ID NO: 74738 - protein, 11 aa, Dengue virus
GAIKVLKSFKK

SEQ ID NO: 74739 - protein, 11 aa, Dengue virus
AIKVLKSFKKE

SEQ ID NO: 74740 - protein, 11 aa, Dengue virus
IKVLKSFKKEI

SEQ ID NO: 74741 - protein, 11 aa, Dengue virus
KVLKSFKKEIS

SEQ ID NO: 74742 - protein, 11 aa, Dengue virus
VLKSFKKEISN

SEQ ID NO: 74743 - protein, 11 aa, Dengue virus
LKSFKKEISNM

SEQ ID NO: 74744 - protein, 11 aa, Dengue virus
KSFKKEISNML

SEQ ID NO: 74745 - protein, 11 aa, Dengue virus
SNMLSIINQRK

SEQ ID NO: 74746 - protein, 11 aa, Dengue virus
NMLSIINQRKK

SEQ ID NO: 74747 - protein, 11 aa, Dengue virus
MVLPAALAFHL

SEQ ID NO: 74748 - protein, 11 aa, Dengue virus
MFPATLAFHLT

SEQ ID NO: 74749 - protein, 11 aa, Dengue virus
CDDTITYKCPL

SEQ ID NO: 74750 - protein, 11 aa, Dengue virus
DDTITYKCPLI

SEQ ID NO: 74751 - protein, 11 aa, Dengue virus
FLAHYISTSLT

SEQ ID NO: 74752 - protein, 11 aa, Dengue virus
LAHYISTSLTQ

SEQ ID NO: 74753 - protein, 11 aa, Dengue virus
AHYISTSLTQK

SEQ ID NO: 74754 - protein, 11 aa, Dengue virus
HYVGTSLTQKV

SEQ ID NO: 74755 - protein, 11 aa, Dengue virus
YVGTSLTQKVV

SEQ ID NO: 74756 - protein, 11 aa, Dengue virus
VGTSLTQKVVI

SEQ ID NO: 74757 - protein, 11 aa, Dengue virus
TSLIQKVVIFI

SEQ ID NO: 74758 - protein, 11 aa, Dengue virus
SLIQKVVIFIL

SEQ ID NO: 74759 - protein, 11 aa, Dengue virus
LTQKVVIFTLL

SEQ ID NO: 74760 - protein, 11 aa, Dengue virus
TQKVVIFTLLM

SEQ ID NO: 74761 - protein, 11 aa, Dengue virus
QKVVIFTLLML

SEQ ID NO: 74762 - protein, 11 aa, Dengue virus
KVVIFTLLMLV

SEQ ID NO: 74763 - protein, 11 aa, Dengue virus
VVIFTLLMLVT

SEQ ID NO: 74764 - protein, 11 aa, Dengue virus
TLLMLVTPSMT

SEQ ID NO: 74765 - protein, 11 aa, Dengue virus
DSRCPTQGEAA

SEQ ID NO: 74766 - protein, 11 aa, Dengue virus
SRCPTQGEAAL

SEQ ID NO: 74767 - protein, 11 aa, Dengue virus
RCPTQGEAALP

SEQ ID NO: 74768 - protein, 11 aa, Dengue virus
CPTQGEAALPE

SEQ ID NO: 74769 - protein, 11 aa, Dengue virus
PTQGEAALPEE

SEQ ID NO: 74770 - protein, 11 aa, Dengue virus
TQGEAALPEEQ

SEQ ID NO: 74771 - protein, 11 aa, Dengue virus
QGEAALPEEQD

SEQ ID NO: 74772 - protein, 11 aa, Dengue virus
GEAALPEEQDQ

SEQ ID NO: 74773 - protein, 11 aa, Dengue virus
EAALPEEQDQN

SEQ ID NO: 74774 - protein, 11 aa, Dengue virus
AALPEEQDQNY

SEQ ID NO: 74775 - protein, 11 aa, Dengue virus
ALPEEQDQNYV

SEQ ID NO: 74776 - protein, 11 aa, Dengue virus
TCAKFQCLEPV

SEQ ID NO: 74777 - protein, 11 aa, Dengue virus
CAKFQCLEPVE

SEQ ID NO: 74778 - protein, 11 aa, Dengue virus
AKFQCLEPVEG

SEQ ID NO: 74779 - protein, 11 aa, Dengue virus
KFQCLEPVEGK

SEQ ID NO: 74780 - protein, 11 aa, Dengue virus
DTQGVTAEITP

SEQ ID NO: 74781 - protein, 11 aa, Dengue virus
VTAEITPQASI

SEQ ID NO: 74782 - protein, 11 aa, Dengue virus
EITPQASITEA

SEQ ID NO: 74783 - protein, 11 aa, Dengue virus
AEAILPEYGTL

SEQ ID NO: 74784 - protein, 11 aa, Dengue virus
DLPLPWTSGVT

SEQ ID NO: 74785 - protein, 11 aa, Dengue virus
LPLPWTSGVTT

SEQ ID NO: 74786 - protein, 11 aa, Dengue virus
TETPIWNRKEL

SEQ ID NO: 74787 - protein, 11 aa, Dengue virus
ATEIQNSGGTT

SEQ ID NO: 74788 - protein, 11 aa, Dengue virus
TEIQNSGGTTI

SEQ ID NO: 74789 - protein, 11 aa, Dengue virus
EIQNSGGTTIF

SEQ ID NO: 74790 - protein, 11 aa, Dengue virus
IQNSGGTTIFA

SEQ ID NO: 74791 - protein, 11 aa, Dengue virus
QNSGGTSIFSG

SEQ ID NO: 74792 - protein, 11 aa, Dengue virus
NSGGTTIFAGH

SEQ ID NO: 74793 - protein, 11 aa, Dengue virus
KGMSYAMCLNA

SEQ ID NO: 74794 - protein, 11 aa, Dengue virus
GMSYAMCLNAF

SEQ ID NO: 74795 - protein, 11 aa, Dengue virus
MSYAMCLNAFV

SEQ ID NO: 74796 - protein, 11 aa, Dengue virus
SYAMCLNAFVL

SEQ ID NO: 74797 - protein, 11 aa, Dengue virus
NTFVLRKEVSE

SEQ ID NO: 74798 - protein, 11 aa, Dengue virus
TILVKVEYKGE

SEQ ID NO: 74799 - protein, 11 aa, Dengue virus
ILVKVEYKGED

SEQ ID NO: 74800 - protein, 11 aa, Dengue virus
LIKVEYKGKDA

SEQ ID NO: 74801 - protein, 11 aa, Dengue virus
IKVEYKGKDAP

SEQ ID NO: 74802 - protein, 11 aa, Dengue virus
KVEYKGKDAPC

SEQ ID NO: 74803 - protein, 11 aa, Dengue virus
VEYKGKDAPCK

SEQ ID NO: 74804 - protein, 11 aa, Dengue virus
EYKGEDVPCKV

SEQ ID NO: 74805 - protein, 11 aa, Dengue virus
YKGEDVPCKVP

SEQ ID NO: 74806 - protein, 11 aa, Dengue virus
KGEDVPCKVPF

SEQ ID NO: 74807 - protein, 11 aa, Dengue virus
GKDAPCKIPFS

SEQ ID NO: 74808 - protein, 11 aa, Dengue virus
KDAPCKIPFST

SEQ ID NO: 74809 - protein, 11 aa, Dengue virus
STEDGQGKVHN

SEQ ID NO: 74810 - protein, 11 aa, Dengue virus
TEDGQGKVHNG

SEQ ID NO: 74811 - protein, 11 aa, Dengue virus
EDGQGKVHNGR

SEQ ID NO: 74812 - protein, 11 aa, Dengue virus
DGQGKVHNGRL

SEQ ID NO: 74813 - protein, 11 aa, Dengue virus
GQGKVHNGRLI

SEQ ID NO: 74814 - protein, 11 aa, Dengue virus
ITANPVVIKKE

SEQ ID NO: 74815 - protein, 11 aa, Dengue virus
TANPVVIKKEE

SEQ ID NO: 74816 - protein, 11 aa, Dengue virus
ANPVVIKKEEP

SEQ ID NO: 74817 - protein, 11 aa, Dengue virus
NPVVTKKEEPI

SEQ ID NO: 74818 - protein, 11 aa, Dengue virus
PVVTKKEEPIN

SEQ ID NO: 74819 - protein, 11 aa, Dengue virus
VVTKKEEPINI

SEQ ID NO: 74820 - protein, 11 aa, Dengue virus
VIKKEEPVNIE

SEQ ID NO: 74821 - protein, 11 aa, Dengue virus
IKKEEPVNIEA

SEQ ID NO: 74822 - protein, 11 aa, Dengue virus
PFGESNIIIGT

SEQ ID NO: 74823 - protein, 11 aa, Dengue virus
FGESNIIIGTG

SEQ ID NO: 74824 - protein, 11 aa, Dengue virus
GESNIIIGTGD

SEQ ID NO: 74825 - protein, 11 aa, Dengue virus
GDKALKINWYR

SEQ ID NO: 74826 - protein, 11 aa, Dengue virus
KALKINWYRKG

SEQ ID NO: 74827 - protein, 11 aa, Dengue virus
YTALFGGVSWM

SEQ ID NO: 74828 - protein, 11 aa, Dengue virus
TALFGGVSWMM

SEQ ID NO: 74829 - protein, 11 aa, Dengue virus
ALFGGVSWMMK

SEQ ID NO: 74830 - protein, 11 aa, Dengue virus
LFGGVSWMMKI

SEQ ID NO: 74831 - protein, 11 aa, Dengue virus
FGGVSWMMKIG

SEQ ID NO: 74832 - protein, 11 aa, Dengue virus
GGVSWMMKIGI

SEQ ID NO: 74833 - protein, 11 aa, Dengue virus
VSWMMKIGIGV

SEQ ID NO: 74834 - protein, 11 aa, Dengue virus
SWMMKIGIGVL

SEQ ID NO: 74835 - protein, 11 aa, Dengue virus
WMMKIGIGVLL

SEQ ID NO: 74836 - protein, 11 aa, Dengue virus
MMKIGIGVLLT

SEQ ID NO: 74837 - protein, 11 aa, Dengue virus
SMSFSCITIGI

SEQ ID NO: 74838 - protein, 11 aa, Dengue virus
MSFSCITIGII

SEQ ID NO: 74839 - protein, 11 aa, Dengue virus
SFSCITIGIIT

SEQ ID NO: 74840 - protein, 11 aa, Dengue virus
FSCITIGIITL

SEQ ID NO: 74841 - protein, 11 aa, Dengue virus
SCITIGIITLY

SEQ ID NO: 74842 - protein, 11 aa, Dengue virus
CITIGIITLYL

SEQ ID NO: 74843 - protein, 11 aa, Dengue virus
ITIGIITLYLG

SEQ ID NO: 74844 - protein, 11 aa, Dengue virus
IGIITLYLGVV

SEQ ID NO: 74845 - protein, 11 aa, Dengue virus
GIITLYLGVVV

SEQ ID NO: 74846 - protein, 11 aa, Dengue virus
IITLYLGVVVQ

SEQ ID NO: 74847 - protein, 11 aa, Dengue virus
LYLGVVVQADM

SEQ ID NO: 74848 - protein, 11 aa, Dengue virus
YLGVVVQADMG

SEQ ID NO: 74849 - protein, 11 aa, Dengue virus
LGVVVQADMGC

SEQ ID NO: 74850 - protein, 11 aa, Dengue virus
GTVVQADMGCV

SEQ ID NO: 74851 - protein, 11 aa, Dengue virus
VVQADMGCVVN

SEQ ID NO: 74852 - protein, 11 aa, Dengue virus
VQADMGCVVNW

SEQ ID NO: 74853 - protein, 11 aa, Dengue virus
QADMGCVVNWK

SEQ ID NO: 74854 - protein, 11 aa, Dengue virus
ADMGCVVNWKG

SEQ ID NO: 74855 - protein, 11 aa, Dengue virus
DMGCVVNWKGK

SEQ ID NO: 74856 - protein, 11 aa, Dengue virus
MGCVVNWKGKE

SEQ ID NO: 74857 - protein, 11 aa, Dengue virus
HILWENNIKLT

SEQ ID NO: 74858 - protein, 11 aa, Dengue virus
ILWENSIKLTV

SEQ ID NO: 74859 - protein, 11 aa, Dengue virus
LWENSIKLTVV

SEQ ID NO: 74860 - protein, 11 aa, Dengue virus
WENSIKLTVVV

SEQ ID NO: 74861 - protein, 11 aa, Dengue virus
NIKLTVVVGDV

SEQ ID NO: 74862 - protein, 11 aa, Dengue virus
IGVLEQGKRAL

SEQ ID NO: 74863 - protein, 11 aa, Dengue virus
VLEQGKRTLTL

SEQ ID NO: 74864 - protein, 11 aa, Dengue virus
QGKRTLTLQPM

SEQ ID NO: 74865 - protein, 11 aa, Dengue virus
GKRTLTLQPME

SEQ ID NO: 74866 - protein, 11 aa, Dengue virus
KRILTPQPMEL

SEQ ID NO: 74867 - protein, 11 aa, Dengue virus
RTLTLQPMELK

SEQ ID NO: 74868 - protein, 11 aa, Dengue virus
TLTLQPMELKY

SEQ ID NO: 74869 - protein, 11 aa, Dengue virus
YSWKTWGKAKV

SEQ ID NO: 74870 - protein, 11 aa, Dengue virus
SWKAWGKAKIV

SEQ ID NO: 74871 - protein, 11 aa, Dengue virus
AETRNSSFIID

SEQ ID NO: 74872 - protein, 11 aa, Dengue virus
ENQNSSFIIDG

SEQ ID NO: 74873 - protein, 11 aa, Dengue virus
KQNSSFIIDGP

SEQ ID NO: 74874 - protein, 11 aa, Dengue virus
DGPNTPECPNT

SEQ ID NO: 74875 - protein, 11 aa, Dengue virus
PNTSRAWNVWE

SEQ ID NO: 74876 - protein, 11 aa, Dengue virus
NTSRAWNVWEV

SEQ ID NO: 74877 - protein, 11 aa, Dengue virus
TTNIWLKLRDV

SEQ ID NO: 74878 - protein, 11 aa, Dengue virus
TNIWLKLRDVY

SEQ ID NO: 74879 - protein, 11 aa, Dengue virus
NIWLKLREMYS

SEQ ID NO: 74880 - protein, 11 aa, Dengue virus
IWLKLREMYSQ

SEQ ID NO: 74881 - protein, 11 aa, Dengue virus
SQLCDHRLMSA

SEQ ID NO: 74882 - protein, 11 aa, Dengue virus
LCDHRLMSAAI

SEQ ID NO: 74883 - protein, 11 aa, Dengue virus
CEGTTVVITED

SEQ ID NO: 74884 - protein, 11 aa, Dengue virus
EGTTVVITEDC

SEQ ID NO: 74885 - protein, 11 aa, Dengue virus
GTTVVITEDCG

SEQ ID NO: 74886 - protein, 11 aa, Dengue virus
TTVVITEDCGT

SEQ ID NO: 74887 - protein, 11 aa, Dengue virus
CGTKGPSLRTT

SEQ ID NO: 74888 - protein, 11 aa, Dengue virus
GTSGPSLTTTT

SEQ ID NO: 74889 - protein, 11 aa, Dengue virus
TRGPALRTTTV

SEQ ID NO: 74890 - protein, 11 aa, Dengue virus
CWYGMEIRPVS

SEQ ID NO: 74891 - protein, 11 aa, Dengue virus
WYGMEIRPVSE

SEQ ID NO: 74892 - protein, 11 aa, Dengue virus
YGMEIRPVSEK

SEQ ID NO: 74893 - protein, 11 aa, Dengue virus
GMEIRPVSEKE

SEQ ID NO: 74894 - protein, 11 aa, Dengue virus
MEIRPVSEKEE

SEQ ID NO: 74895 - protein, 11 aa, Dengue virus
EIRPVSEKEEN

SEQ ID NO: 74896 - protein, 11 aa, Dengue virus
IRPVSEKEENM

SEQ ID NO: 74897 - protein, 11 aa, Dengue virus
RPVSEKEENMV

SEQ ID NO: 74898 - protein, 11 aa, Dengue virus
PVSEKEENMVK

SEQ ID NO: 74899 - protein, 11 aa, Dengue virus
VSEKEENMVKS

SEQ ID NO: 74900 - protein, 11 aa, Dengue virus
KSLASAGSGKV

SEQ ID NO: 74901 - protein, 11 aa, Dengue virus
SLASAGSGKVD

SEQ ID NO: 74902 - protein, 11 aa, Dengue virus
LASAGSGKVDN

SEQ ID NO: 74903 - protein, 11 aa, Dengue virus
ASAGSGKVDNF

SEQ ID NO: 74904 - protein, 11 aa, Dengue virus
SAGSGKADNFT

SEQ ID NO: 74905 - protein, 11 aa, Dengue virus
AGSGKADNFTM

SEQ ID NO: 74906 - protein, 11 aa, Dengue virus
GSGKADNFTMG

SEQ ID NO: 74907 - protein, 11 aa, Dengue virus
MDNFTMGVLCL

SEQ ID NO: 74908 - protein, 11 aa, Dengue virus
VLCLVILFEEV

SEQ ID NO: 74909 - protein, 11 aa, Dengue virus
KFGKKHMIAGI

SEQ ID NO: 74910 - protein, 11 aa, Dengue virus
FIFVLLLSGQI

SEQ ID NO: 74911 - protein, 11 aa, Dengue virus
TFVLLLSGQII

SEQ ID NO: 74912 - protein, 11 aa, Dengue virus
LSGQIKWRDMA

SEQ ID NO: 74913 - protein, 11 aa, Dengue virus
TLIMIGSNTSD

SEQ ID NO: 74914 - protein, 11 aa, Dengue virus
LIMIGSNASDK

SEQ ID NO: 74915 - protein, 11 aa, Dengue virus
IMIGSNTSDRM

SEQ ID NO: 74916 - protein, 11 aa, Dengue virus
MIGSNTSDRMG

SEQ ID NO: 74917 - protein, 11 aa, Dengue virus
IGSNTSDRMGM

SEQ ID NO: 74918 - protein, 11 aa, Dengue virus
SNTSDRMGMGV

SEQ ID NO: 74919 - protein, 11 aa, Dengue virus
NTSDRMGMGVT

SEQ ID NO: 74920 - protein, 11 aa, Dengue virus
TSDRMGMGVTY

SEQ ID NO: 74921 - protein, 11 aa, Dengue virus
MATTLQLPADI

SEQ ID NO: 74922 - protein, 11 aa, Dengue virus
TTTLQLPEDIE

SEQ ID NO: 74923 - protein, 11 aa, Dengue virus
FETYQLWTALA

SEQ ID NO: 74924 - protein, 11 aa, Dengue virus
ETYQLWTALAS

SEQ ID NO: 74925 - protein, 11 aa, Dengue virus
TYQLWTALASL

SEQ ID NO: 74926 - protein, 11 aa, Dengue virus
YQLWTALASLM

SEQ ID NO: 74927 - protein, 11 aa, Dengue virus
QLWTALASLMC

SEQ ID NO: 74928 - protein, 11 aa, Dengue virus
SLMCANTIFTL

SEQ ID NO: 74929 - protein, 11 aa, Dengue virus
LTCSNTILTLT

SEQ ID NO: 74930 - protein, 11 aa, Dengue virus
MCANTIFTLTV

SEQ ID NO: 74931 - protein, 11 aa, Dengue virus
ATLVLAGVSLL

SEQ ID NO: 74932 - protein, 11 aa, Dengue virus
TLILAGVSILP

SEQ ID NO: 74933 - protein, 11 aa, Dengue virus
ISLLPLCQSSS

SEQ ID NO: 74934 - protein, 11 aa, Dengue virus
SMRKTDWLPVA

SEQ ID NO: 74935 - protein, 11 aa, Dengue virus
MRKTDWLPVAV

SEQ ID NO: 74936 - protein, 11 aa, Dengue virus
RKTDWLPVAVA

SEQ ID NO: 74937 - protein, 11 aa, Dengue virus
KTDWLPVAVAA

SEQ ID NO: 74938 - protein, 11 aa, Dengue virus
TDWLPVAVAAM

SEQ ID NO: 74939 - protein, 11 aa, Dengue virus
WLPMTVAAMGA

SEQ ID NO: 74940 - protein, 11 aa, Dengue virus
VAAMGVSPLPL

SEQ ID NO: 74941 - protein, 11 aa, Dengue virus
AAMGVSPLPLF

SEQ ID NO: 74942 - protein, 11 aa, Dengue virus
AMGVQPLPLFI

SEQ ID NO: 74943 - protein, 11 aa, Dengue virus
MGVQPLPLFIF

SEQ ID NO: 74944 - protein, 11 aa, Dengue virus
PLPLFIFGLKD

SEQ ID NO: 74945 - protein, 11 aa, Dengue virus
LPLFIFGLKDT

SEQ ID NO: 74946 - protein, 11 aa, Dengue virus
LKDALKRRSWP

SEQ ID NO: 74947 - protein, 11 aa, Dengue virus
KDALKRRSWPL

SEQ ID NO: 74948 - protein, 11 aa, Dengue virus
DALKRRSWPLN

SEQ ID NO: 74949 - protein, 11 aa, Dengue virus
ALKRRSWPLNE

SEQ ID NO: 74950 - protein, 11 aa, Dengue virus
SADLTVEKAAN

SEQ ID NO: 74951 - protein, 11 aa, Dengue virus
ANVTWEEEAEQ

SEQ ID NO: 74952 - protein, 11 aa, Dengue virus
NVTWEEEAEQT

SEQ ID NO: 74953 - protein, 11 aa, Dengue virus
ISYGGGWRLST

SEQ ID NO: 74954 - protein, 11 aa, Dengue virus
SYGGGWRLSTQ

SEQ ID NO: 74955 - protein, 11 aa, Dengue virus
YGGGWRLSTQW

SEQ ID NO: 74956 - protein, 11 aa, Dengue virus
GGGWRLSTQWQ

SEQ ID NO: 74957 - protein, 11 aa, Dengue virus
GGWRLSTQWQK

SEQ ID NO: 74958 - protein, 11 aa, Dengue virus
GWRLSTQWQKG

SEQ ID NO: 74959 - protein, 11 aa, Dengue virus
WRLSTQWQKGE

SEQ ID NO: 74960 - protein, 11 aa, Dengue virus
RLSTQWQKGEE

SEQ ID NO: 74961 - protein, 11 aa, Dengue virus
LSAQWKKGEEV

SEQ ID NO: 74962 - protein, 11 aa, Dengue virus
SAQWKKGEEVQ

SEQ ID NO: 74963 - protein, 11 aa, Dengue virus
AQWQRGEEVQV

SEQ ID NO: 74964 - protein, 11 aa, Dengue virus
NPKNFQTTPGI

SEQ ID NO: 74965 - protein, 11 aa, Dengue virus
PKNFQTTPGIF

SEQ ID NO: 74966 - protein, 11 aa, Dengue virus
KNFQTTPGIFQ

SEQ ID NO: 74967 - protein, 11 aa, Dengue virus
NFQTTPGIFQT

SEQ ID NO: 74968 - protein, 11 aa, Dengue virus
FQTTPGIFQTT

SEQ ID NO: 74969 - protein, 11 aa, Dengue virus
LPIRYQTTATR

SEQ ID NO: 74970 - protein, 11 aa, Dengue virus
PIRYQTTVTKS

SEQ ID NO: 74971 - protein, 11 aa, Dengue virus
IRYQTTVTKSE

SEQ ID NO: 74972 - protein, 11 aa, Dengue virus
RYQTSATKSEH

SEQ ID NO: 74973 - protein, 11 aa, Dengue virus
YQTTVTKSEHT

SEQ ID NO: 74974 - protein, 11 aa, Dengue virus
QTTATRSEHTG

SEQ ID NO: 74975 - protein, 11 aa, Dengue virus
TSATKSEHTGR

SEQ ID NO: 74976 - protein, 11 aa, Dengue virus
TATRSEHTGRE

SEQ ID NO: 74977 - protein, 11 aa, Dengue virus
ATRSEHTGREI

SEQ ID NO: 74978 - protein, 11 aa, Dengue virus
NSGNEWITDFT

SEQ ID NO: 74979 - protein, 11 aa, Dengue virus
SGNEWITDFTG

SEQ ID NO: 74980 - protein, 11 aa, Dengue virus
GNEWITDFTGK

SEQ ID NO: 74981 - protein, 11 aa, Dengue virus
NEWITDFTGKT

SEQ ID NO: 74982 - protein, 11 aa, Dengue virus
EWITDFTGKTV

SEQ ID NO: 74983 - protein, 11 aa, Dengue virus
SQKENDQYIFT

SEQ ID NO: 74984 - protein, 11 aa, Dengue virus
VPSHLAYRTRS

SEQ ID NO: 74985 - protein, 11 aa, Dengue virus
PTHLAHRTRTA

SEQ ID NO: 74986 - protein, 11 aa, Dengue virus
SHLAHRTKNAL

SEQ ID NO: 74987 - protein, 11 aa, Dengue virus
GGAMLFLVSGK

SEQ ID NO: 74988 - protein, 11 aa, Dengue virus
MLFLVSGKGIG

SEQ ID NO: 74989 - protein, 11 aa, Dengue virus
LFLVSGKGIGK

SEQ ID NO: 74990 - protein, 11 aa, Dengue virus
FLVSGKGIGKT

SEQ ID NO: 74991 - protein, 11 aa, Dengue virus
LVSGKGIGKTT

SEQ ID NO: 74992 - protein, 11 aa, Dengue virus
VSGKGIGKTTI

SEQ ID NO: 74993 - protein, 11 aa, Dengue virus
SGRGIGKASIG

SEQ ID NO: 74994 - protein, 11 aa, Dengue virus
GRGIGKASIGL

SEQ ID NO: 74995 - protein, 11 aa, Dengue virus
RGIGKASIGLI

SEQ ID NO: 74996 - protein, 11 aa, Dengue virus
GIGKASIGLIC

SEQ ID NO: 74997 - protein, 11 aa, Dengue virus
IGKASIGLICV

SEQ ID NO: 74998 - protein, 11 aa, Dengue virus
GKASIGLICVI

SEQ ID NO: 74999 - protein, 11 aa, Dengue virus
KTTIGLICVIV

SEQ ID NO: 75000 - protein, 11 aa, Dengue virus
TTIGLICVIVS

SEQ ID NO: 75001 - protein, 11 aa, Dengue virus
TIGLICVIVSS

SEQ ID NO: 75002 - protein, 11 aa, Dengue virus
LICVTVSSGML

SEQ ID NO: 75003 - protein, 11 aa, Dengue virus
ICVTVSSGMLW

SEQ ID NO: 75004 - protein, 11 aa, Dengue virus
CVIASSGMLWI

SEQ ID NO: 75005 - protein, 11 aa, Dengue virus
VTVSSGMLWMA

SEQ ID NO: 75006 - protein, 11 aa, Dengue virus
SSGMLWMADIP

SEQ ID NO: 75007 - protein, 11 aa, Dengue virus
SGMLWMADIPL

SEQ ID NO: 75008 - protein, 11 aa, Dengue virus
GMLWMADIPLQ

SEQ ID NO: 75009 - protein, 11 aa, Dengue virus
MLWMADIPLQW

SEQ ID NO: 75010 - protein, 11 aa, Dengue virus
LWMADIPLQWI

SEQ ID NO: 75011 - protein, 11 aa, Dengue virus
WMADIPLQWIA

SEQ ID NO: 75012 - protein, 11 aa, Dengue virus
MADIPLQWIAS

SEQ ID NO: 75013 - protein, 11 aa, Dengue virus
ADIPLQWIASA

SEQ ID NO: 75014 - protein, 11 aa, Dengue virus
DIPLQWIASAI

SEQ ID NO: 75015 - protein, 11 aa, Dengue virus
IGILTLAATIA

SEQ ID NO: 75016 - protein, 11 aa, Dengue virus
GILTLAATIAA

SEQ ID NO: 75017 - protein, 11 aa, Dengue virus
ILTLAATIAAN

SEQ ID NO: 75018 - protein, 11 aa, Dengue virus
LTLAATIAANE

SEQ ID NO: 75019 - protein, 11 aa, Dengue virus
TLAATIAANEM

SEQ ID NO: 75020 - protein, 11 aa, Dengue virus
LAATIAANEMG

SEQ ID NO: 75021 - protein, 11 aa, Dengue virus
AATIAANEMGL

SEQ ID NO: 75022 - protein, 11 aa, Dengue virus
ATIAANEMGLL

SEQ ID NO: 75023 - protein, 11 aa, Dengue virus
TIAANEMGLLE

SEQ ID NO: 75024 - protein, 11 aa, Dengue virus
GMSREPGVVSP

SEQ ID NO: 75025 - protein, 11 aa, Dengue virus
EPGVVSPNSYL

SEQ ID NO: 75026 - protein, 11 aa, Dengue virus
PGVVSPNSYLD

SEQ ID NO: 75027 - protein, 11 aa, Dengue virus
GVVSPNSYLDV

SEQ ID NO: 75028 - protein, 11 aa, Dengue virus
VVSPNSYLDVD

SEQ ID NO: 75029 - protein, 11 aa, Dengue virus
VSPNSYLDVDL

SEQ ID NO: 75030 - protein, 11 aa, Dengue virus
LTLIAAVLLLV

SEQ ID NO: 75031 - protein, 11 aa, Dengue virus
TLIAAVLLLVT

SEQ ID NO: 75032 - protein, 11 aa, Dengue virus
LIAAVLLLVTH

SEQ ID NO: 75033 - protein, 11 aa, Dengue virus
IAAVLLLVTHY

SEQ ID NO: 75034 - protein, 11 aa, Dengue virus
KWKKKLNQLSW

SEQ ID NO: 75035 - protein, 11 aa, Dengue virus
WKKKLNQLSRR

SEQ ID NO: 75036 - protein, 11 aa, Dengue virus
KLNQLSWKEFD

SEQ ID NO: 75037 - protein, 11 aa, Dengue virus
NQLSWKEFDLY

SEQ ID NO: 75038 - protein, 11 aa, Dengue virus
QLSRREFDLYK

SEQ ID NO: 75039 - protein, 11 aa, Dengue virus
LSRREFDLYKK

SEQ ID NO: 75040 - protein, 11 aa, Dengue virus
SRREFDLYKKS

SEQ ID NO: 75041 - protein, 11 aa, Dengue virus
DRTEAKEGLKK

SEQ ID NO: 75042 - protein, 11 aa, Dengue virus
RTEAKEGLKKG

SEQ ID NO: 75043 - protein, 11 aa, Dengue virus
TEAKEGLKKGE

SEQ ID NO: 75044 - protein, 11 aa, Dengue virus
EAKEGLKRGEV

SEQ ID NO: 75045 - protein, 11 aa, Dengue virus
AKEGLKRRETT

SEQ ID NO: 75046 - protein, 11 aa, Dengue virus
RRETTHHAVSR

SEQ ID NO: 75047 - protein, 11 aa, Dengue virus
RETTHHAVSRG

SEQ ID NO: 75048 - protein, 11 aa, Dengue virus
EITRHAVSRGS

SEQ ID NO: 75049 - protein, 11 aa, Dengue virus
VTHHAVSRGSA

SEQ ID NO: 75050 - protein, 11 aa, Dengue virus
TYGWNIIKLMS

SEQ ID NO: 75051 - protein, 11 aa, Dengue virus
YGWNIVKLMTG

SEQ ID NO: 75052 - protein, 11 aa, Dengue virus
GWNIVKLMTGK

SEQ ID NO: 75053 - protein, 11 aa, Dengue virus
WNIVKLMTGKD

SEQ ID NO: 75054 - protein, 11 aa, Dengue virus
NIIKLMSGKDV

SEQ ID NO: 75055 - protein, 11 aa, Dengue virus
IIKLMSGKDVF

SEQ ID NO: 75056 - protein, 11 aa, Dengue virus
CIKVLNPYMPN

SEQ ID NO: 75057 - protein, 11 aa, Dengue virus
IKVLNPYMPNV

SEQ ID NO: 75058 - protein, 11 aa, Dengue virus
KILNPYMPTVI

SEQ ID NO: 75059 - protein, 11 aa, Dengue virus
ILNPYMPTVIE

SEQ ID NO: 75060 - protein, 11 aa, Dengue virus
LNPYMPNVIEH

SEQ ID NO: 75061 - protein, 11 aa, Dengue virus
NPYMPNVIEHL

SEQ ID NO: 75062 - protein, 11 aa, Dengue virus
PYMPNVIEHLE

SEQ ID NO: 75063 - protein, 11 aa, Dengue virus
YMPNVIEHLER

SEQ ID NO: 75064 - protein, 11 aa, Dengue virus
MPNVIEHLERL

SEQ ID NO: 75065 - protein, 11 aa, Dengue virus
PNVIEHLERLQ

SEQ ID NO: 75066 - protein, 11 aa, Dengue virus
NVIEHLERLQR

SEQ ID NO: 75067 - protein, 11 aa, Dengue virus
TMTHRRPTIER

SEQ ID NO: 75068 - protein, 11 aa, Dengue virus
MTHRRPTIERD

SEQ ID NO: 75069 - protein, 11 aa, Dengue virus
THRRPTIERDV

SEQ ID NO: 75070 - protein, 11 aa, Dengue virus
HRRPTIERDVD

SEQ ID NO: 75071 - protein, 11 aa, Dengue virus
MDIIGERIRRI

SEQ ID NO: 75072 - protein, 11 aa, Dengue virus
DVIGERIKKIK

SEQ ID NO: 75073 - protein, 11 aa, Dengue virus
VIGERIERIKE

SEQ ID NO: 75074 - protein, 11 aa, Dengue virus
IGERIKKIKEE

SEQ ID NO: 75075 - protein, 11 aa, Dengue virus
GERLRRIKEEH

SEQ ID NO: 75076 - protein, 11 aa, Dengue virus
RIKEEHDSTWH

SEQ ID NO: 75077 - protein, 11 aa, Dengue virus
IKDEHNSTWHY

SEQ ID NO: 75078 - protein, 11 aa, Dengue virus
EEHSSTWHYDE

SEQ ID NO: 75079 - protein, 11 aa, Dengue virus
EHSKTWHYDDE

SEQ ID NO: 75080 - protein, 11 aa, Dengue virus
HSSTWHYDEEN

SEQ ID NO: 75081 - protein, 11 aa, Dengue virus
SSTWHYDEENP

SEQ ID NO: 75082 - protein, 11 aa, Dengue virus
KVDTRTPRPMA

SEQ ID NO: 75083 - protein, 11 aa, Dengue virus
VDTRTPRPMAG

SEQ ID NO: 75084 - protein, 11 aa, Dengue virus
DTRTPRPMAGT

SEQ ID NO: 75085 - protein, 11 aa, Dengue virus
TRTPRPMAGTR

SEQ ID NO: 75086 - protein, 11 aa, Dengue virus
AMEITAEWLWR

SEQ ID NO: 75087 - protein, 11 aa, Dengue virus
DSAKAAVEDEN

SEQ ID NO: 75088 - protein, 11 aa, Dengue virus
NARAAVEDEEF

SEQ ID NO: 75089 - protein, 11 aa, Dengue virus
KAAVEDEDFWI

SEQ ID NO: 75090 - protein, 11 aa, Dengue virus
AAVEDENFWKL

SEQ ID NO: 75091 - protein, 11 aa, Dengue virus
AVEDENFWKLV

SEQ ID NO: 75092 - protein, 11 aa, Dengue virus
VEDENFWKLVD

SEQ ID NO: 75093 - protein, 11 aa, Dengue virus
EDEDFWILVDR

SEQ ID NO: 75094 - protein, 11 aa, Dengue virus
DEDFWILVDRE

SEQ ID NO: 75095 - protein, 11 aa, Dengue virus
EDFWILVDRER

SEQ ID NO: 75096 - protein, 11 aa, Dengue virus
KLVDRERELHR

SEQ ID NO: 75097 - protein, 11 aa, Dengue virus
LVDRERKLHKL

SEQ ID NO: 75098 - protein, 11 aa, Dengue virus
VDRERELHKVG

SEQ ID NO: 75099 - protein, 11 aa, Dengue virus
ERERELHKLGK

SEQ ID NO: 75100 - protein, 11 aa, Dengue virus
HNEEKITHQMD

SEQ ID NO: 75101 - protein, 11 aa, Dengue virus
NEEKITHQMDP

SEQ ID NO: 75102 - protein, 11 aa, Dengue virus
EEKITQQMNPE

SEQ ID NO: 75103 - protein, 11 aa, Dengue virus
EKITQQMNPEH

SEQ ID NO: 75104 - protein, 11 aa, Dengue virus
KITHQMDPEHR

SEQ ID NO: 75105 - protein, 11 aa, Dengue virus
PEHKQLANAIF

SEQ ID NO: 75106 - protein, 11 aa, Dengue virus
EHKQLANAIFK

SEQ ID NO: 75107 - protein, 11 aa, Dengue virus
HRKLANAIFKL

SEQ ID NO: 75108 - protein, 11 aa, Dengue virus
RKLANAIFKLT

SEQ ID NO: 75109 - protein, 11 aa, Dengue virus
RLANAIFKLTY

SEQ ID NO: 75110 - protein, 11 aa, Dengue virus
AQLVRQMEGED

SEQ ID NO: 75111 - protein, 11 aa, Dengue virus
IRQMEGEGVLT

SEQ ID NO: 75112 - protein, 11 aa, Dengue virus
QMEGEGVLSKV

SEQ ID NO: 75113 - protein, 11 aa, Dengue virus
AQWLETKGVER

SEQ ID NO: 75114 - protein, 11 aa, Dengue virus
WLENKGVERLK

SEQ ID NO: 75115 - protein, 11 aa, Dengue virus
LENKGVERLKR

SEQ ID NO: 75116 - protein, 11 aa, Dengue virus
ENKGVERLKRM

SEQ ID NO: 75117 - protein, 11 aa, Dengue virus
NKGVERLKRMA

SEQ ID NO: 75118 - protein, 11 aa, Dengue virus
HQRMTTEDMLT

SEQ ID NO: 75119 - protein, 11 aa, Dengue virus
QRMTTEDMLTV

SEQ ID NO: 75120 - protein, 11 aa, Dengue virus
RMTTEDMLTVW

SEQ ID NO: 75121 - protein, 11 aa, Dengue virus
LSVWNRVWIED

SEQ ID NO: 75122 - protein, 11 aa, Dengue virus
SVWNRVWIEDN

SEQ ID NO: 75123 - protein, 11 aa, Dengue virus
EDKTPITTWED

SEQ ID NO: 75124 - protein, 11 aa, Dengue virus
DKTPITTWEDV

SEQ ID NO: 75125 - protein, 11 aa, Dengue virus
KTPITTWEDVP

SEQ ID NO: 75126 - protein, 11 aa, Dengue virus
TPITTWEDVPY

SEQ ID NO: 75127 - protein, 11 aa, Dengue virus
PITTWEDVPYL

SEQ ID NO: 75128 - protein, 11 aa, Dengue virus
ITTWEDVPYLG

SEQ ID NO: 75129 - protein, 11 aa, Dengue virus
STAIQQVRSLI

SEQ ID NO: 75130 - protein, 11 aa, Dengue virus
VLRGFKKEISS

SEQ ID NO: 75131 - protein, 11 aa, Dengue virus
SMLSIINRRKK

SEQ ID NO: 75132 - protein, 11 aa, Dengue virus
MMFPATLAFHL

SEQ ID NO: 75133 - protein, 11 aa, Dengue virus
VLPAALAFHLT

SEQ ID NO: 75134 - protein, 11 aa, Dengue virus
HYISTSLTQKV

SEQ ID NO: 75135 - protein, 11 aa, Dengue virus
TSLTQKVVIFT

SEQ ID NO: 75136 - protein, 11 aa, Dengue virus
SLTQKVVIFTL

SEQ ID NO: 75137 - protein, 11 aa, Dengue virus
LIQKVVIFILL

SEQ ID NO: 75138 - protein, 11 aa, Dengue virus
IQKVVIFILLM

SEQ ID NO: 75139 - protein, 11 aa, Dengue virus
EITSQASTAEA

SEQ ID NO: 75140 - protein, 11 aa, Dengue virus
TEVILPEYGTL

SEQ ID NO: 75141 - protein, 11 aa, Dengue virus
LPLPWTSGTTT

SEQ ID NO: 75142 - protein, 11 aa, Dengue virus
TKTPTWNRKEL

SEQ ID NO: 75143 - protein, 11 aa, Dengue virus
IQNSGGTSIFS

SEQ ID NO: 75144 - protein, 11 aa, Dengue virus
KGMSYAMCLGS

SEQ ID NO: 75145 - protein, 11 aa, Dengue virus
GMSYAMCLGSF

SEQ ID NO: 75146 - protein, 11 aa, Dengue virus
MSYAMCLGSFV

SEQ ID NO: 75147 - protein, 11 aa, Dengue virus
SYAMCLGSFVL

SEQ ID NO: 75148 - protein, 11 aa, Dengue virus
LVKVEYKGEDA

SEQ ID NO: 75149 - protein, 11 aa, Dengue virus
VKVEYKGEDAP

SEQ ID NO: 75150 - protein, 11 aa, Dengue virus
EYKGKDAPCKI

SEQ ID NO: 75151 - protein, 11 aa, Dengue virus
YKGKDAPCKIP

SEQ ID NO: 75152 - protein, 11 aa, Dengue virus
KGKDAPCKIPF

SEQ ID NO: 75153 - protein, 11 aa, Dengue virus
NPVVIKKEEPV

SEQ ID NO: 75154 - protein, 11 aa, Dengue virus
PVVIKKEEPVN

SEQ ID NO: 75155 - protein, 11 aa, Dengue virus
VVIKKEEPVNI

SEQ ID NO: 75156 - protein, 11 aa, Dengue virus
GESNIVIGVGD

SEQ ID NO: 75157 - protein, 11 aa, Dengue virus
GEKALKINWYK

SEQ ID NO: 75158 - protein, 11 aa, Dengue virus
GVVVQADMGCV

SEQ ID NO: 75159 - protein, 11 aa, Dengue virus
DIGCVINWKGK

SEQ ID NO: 75160 - protein, 11 aa, Dengue virus
IGCVINWKGKE

SEQ ID NO: 75161 - protein, 11 aa, Dengue virus
NVKLTVVVGDI

SEQ ID NO: 75162 - protein, 11 aa, Dengue virus
LGVLEQGKRTL

SEQ ID NO: 75163 - protein, 11 aa, Dengue virus
RTLTPQPMELQ

SEQ ID NO: 75164 - protein, 11 aa, Dengue virus
TLPPQPMELKY

SEQ ID NO: 75165 - protein, 11 aa, Dengue virus
YSWKTWGKAKM

SEQ ID NO: 75166 - protein, 11 aa, Dengue virus
SWKTWGKAKMV

SEQ ID NO: 75167 - protein, 11 aa, Dengue virus
DGPSTPECPSA

SEQ ID NO: 75168 - protein, 11 aa, Dengue virus
PSAARAWNVWE

SEQ ID NO: 75169 - protein, 11 aa, Dengue virus
SAARAWNVWEV

SEQ ID NO: 75170 - protein, 11 aa, Dengue virus
NIWLKLREAYT

SEQ ID NO: 75171 - protein, 11 aa, Dengue virus
IWLKLREAYTQ

SEQ ID NO: 75172 - protein, 11 aa, Dengue virus
CEGTTVVISEN

SEQ ID NO: 75173 - protein, 11 aa, Dengue virus
EGTTVVISENC

SEQ ID NO: 75174 - protein, 11 aa, Dengue virus
GTTVVISENCG

SEQ ID NO: 75175 - protein, 11 aa, Dengue virus
TTVVISENCGT

SEQ ID NO: 75176 - protein, 11 aa, Dengue virus
CGTSGPSLTTT

SEQ ID NO: 75177 - protein, 11 aa, Dengue virus
GTRGPALRTTT

SEQ ID NO: 75178 - protein, 11 aa, Dengue virus
TRGSSLRTTTV

SEQ ID NO: 75179 - protein, 11 aa, Dengue virus
RPTSEKEENMV

SEQ ID NO: 75180 - protein, 11 aa, Dengue virus
PTSEKEENMVK

SEQ ID NO: 75181 - protein, 11 aa, Dengue virus
TSEKEENMVKS

SEQ ID NO: 75182 - protein, 11 aa, Dengue virus
KSLVSAGSGKA

SEQ ID NO: 75183 - protein, 11 aa, Dengue virus
SLVSAGSGKAD

SEQ ID NO: 75184 - protein, 11 aa, Dengue virus
LVSAGSGKADN

SEQ ID NO: 75185 - protein, 11 aa, Dengue virus
VSAGSGKADNF

SEQ ID NO: 75186 - protein, 11 aa, Dengue virus
VDNFTMGALCL

SEQ ID NO: 75187 - protein, 11 aa, Dengue virus
LIMIGSNTSDR

SEQ ID NO: 75188 - protein, 11 aa, Dengue virus
YQLWAALVSLT

SEQ ID NO: 75189 - protein, 11 aa, Dengue virus
QLWAALVSLMC

SEQ ID NO: 75190 - protein, 11 aa, Dengue virus
VSLLPMCQSSS

SEQ ID NO: 75191 - protein, 11 aa, Dengue virus
VAAMGVQPLPL

SEQ ID NO: 75192 - protein, 11 aa, Dengue virus
AAMGVQPLPLF

SEQ ID NO: 75193 - protein, 11 aa, Dengue virus
AMGVSPLPLFI

SEQ ID NO: 75194 - protein, 11 aa, Dengue virus
MGVSPLPLFIF

SEQ ID NO: 75195 - protein, 11 aa, Dengue virus
LKDAPKRRSWP

SEQ ID NO: 75196 - protein, 11 aa, Dengue virus
KDAPKRRSWPL

SEQ ID NO: 75197 - protein, 11 aa, Dengue virus
DAPKRRSWPLN

SEQ ID NO: 75198 - protein, 11 aa, Dengue virus
APKRRSWPLNE

SEQ ID NO: 75199 - protein, 11 aa, Dengue virus
SADLTVEKAAE

SEQ ID NO: 75200 - protein, 11 aa, Dengue virus
PDVTWEEEAEQ

SEQ ID NO: 75201 - protein, 11 aa, Dengue virus
GGGWRLSAQWK

SEQ ID NO: 75202 - protein, 11 aa, Dengue virus
GGWRLSAQWKK

SEQ ID NO: 75203 - protein, 11 aa, Dengue virus
GWRLSAQWKKG

SEQ ID NO: 75204 - protein, 11 aa, Dengue virus
WRLSAQWKKGE

SEQ ID NO: 75205 - protein, 11 aa, Dengue virus
RLSAQWKKGEE

SEQ ID NO: 75206 - protein, 11 aa, Dengue virus
TTVTKSEHTGR

SEQ ID NO: 75207 - protein, 11 aa, Dengue virus
SATKSEHTGRE

SEQ ID NO: 75208 - protein, 11 aa, Dengue virus
VPTHLAHRTRT

SEQ ID NO: 75209 - protein, 11 aa, Dengue virus
PSHLAHKTRNA

SEQ ID NO: 75210 - protein, 11 aa, Dengue virus
SHLAYRTRSAL

SEQ ID NO: 75211 - protein, 11 aa, Dengue virus
LISGKGIGKTT

SEQ ID NO: 75212 - protein, 11 aa, Dengue virus
ISGKGIGKTTI

SEQ ID NO: 75213 - protein, 11 aa, Dengue virus
KASIGLICVIV

SEQ ID NO: 75214 - protein, 11 aa, Dengue virus
ASIGLICVIVS

SEQ ID NO: 75215 - protein, 11 aa, Dengue virus
CVTVSSGMLWM

SEQ ID NO: 75216 - protein, 11 aa, Dengue virus
VIASSGMLWIA

SEQ ID NO: 75217 - protein, 11 aa, Dengue virus
SSGMLWIAEIP

SEQ ID NO: 75218 - protein, 11 aa, Dengue virus
SGMLWIAEIPL

SEQ ID NO: 75219 - protein, 11 aa, Dengue virus
GMLWIAEIPLQ

SEQ ID NO: 75220 - protein, 11 aa, Dengue virus
MLWIAEIPLQW

SEQ ID NO: 75221 - protein, 11 aa, Dengue virus
AAIIAANEMGM

SEQ ID NO: 75222 - protein, 11 aa, Dengue virus
AIIAANEMGML

SEQ ID NO: 75223 - protein, 11 aa, Dengue virus
IIAANEMGMLE

SEQ ID NO: 75224 - protein, 11 aa, Dengue virus
EPGVVPPTSYL

SEQ ID NO: 75225 - protein, 11 aa, Dengue virus
PGVVSPISYLD

SEQ ID NO: 75226 - protein, 11 aa, Dengue virus
GVVPPTSYLDV

SEQ ID NO: 75227 - protein, 11 aa, Dengue virus
VVSPISYLDVD

SEQ ID NO: 75228 - protein, 11 aa, Dengue virus
LTLAAAVLLLV

SEQ ID NO: 75229 - protein, 11 aa, Dengue virus
TLAAAVLLLVT

SEQ ID NO: 75230 - protein, 11 aa, Dengue virus
LAAAVLLLVTH

SEQ ID NO: 75231 - protein, 11 aa, Dengue virus
AAAVLLLVTHY

SEQ ID NO: 75232 - protein, 11 aa, Dengue virus
WKKKLNQLSWK

SEQ ID NO: 75233 - protein, 11 aa, Dengue virus
KLNQLSRREFD

SEQ ID NO: 75234 - protein, 11 aa, Dengue virus
RTEAKEGLRRG

SEQ ID NO: 75235 - protein, 11 aa, Dengue virus
TEAKEGLRRGE

SEQ ID NO: 75236 - protein, 11 aa, Dengue virus
EAKEGLKRRET

SEQ ID NO: 75237 - protein, 11 aa, Dengue virus
RGEITRHAVSR

SEQ ID NO: 75238 - protein, 11 aa, Dengue virus
EVTHHAVSRGS

SEQ ID NO: 75239 - protein, 11 aa, Dengue virus
ITRHAVSRGSA

SEQ ID NO: 75240 - protein, 11 aa, Dengue virus
KVLNPYMPNVI

SEQ ID NO: 75241 - protein, 11 aa, Dengue virus
VLNPYMPNVIE

SEQ ID NO: 75242 - protein, 11 aa, Dengue virus
VIGERIKKIKE

SEQ ID NO: 75243 - protein, 11 aa, Dengue virus
IGERVKRIKEE

SEQ ID NO: 75244 - protein, 11 aa, Dengue virus
GERVKRIKEEH

SEQ ID NO: 75245 - protein, 11 aa, Dengue virus
KIKEEHNSTWH

SEQ ID NO: 75246 - protein, 11 aa, Dengue virus
DEHNSTWHYDD

SEQ ID NO: 75247 - protein, 11 aa, Dengue virus
VMGITAEWLWK

SEQ ID NO: 75248 - protein, 11 aa, Dengue virus
DNARAAVEDEE

SEQ ID NO: 75249 - protein, 11 aa, Dengue virus
KAAVEDENFWK

SEQ ID NO: 75250 - protein, 11 aa, Dengue virus
EDENFWKLVDR

SEQ ID NO: 75251 - protein, 11 aa, Dengue virus
DENFWKLVDRE

SEQ ID NO: 75252 - protein, 11 aa, Dengue virus
ENFWKLVDRER

SEQ ID NO: 75253 - protein, 11 aa, Dengue virus
KITQQMNPEHR

SEQ ID NO: 75254 - protein, 11 aa, Dengue virus
PEHRKLANAIF

SEQ ID NO: 75255 - protein, 11 aa, Dengue virus
EHRKLANAIFK

SEQ ID NO: 75256 - protein, 11 aa, Dengue virus
HKQLANAIFKL

SEQ ID NO: 75257 - protein, 11 aa, Dengue virus
KQLANAIFKLT

SEQ ID NO: 75258 - protein, 11 aa, Dengue virus
QMEGEGVLSEA

SEQ ID NO: 75259 - protein, 11 aa, Dengue virus
TQWLENKGVER

SEQ ID NO: 75260 - protein, 11 aa, Dengue virus
GDKTPVTTWED

SEQ ID NO: 75261 - protein, 11 aa, Dengue virus
NKTPVTTWENV

SEQ ID NO: 75262 - protein, 8 aa, Dengue virus
MNQRKKVV

SEQ ID NO: 75263 - protein, 8 aa, Dengue virus
NQRKKVVR

SEQ ID NO: 75264 - protein, 8 aa, Dengue virus
QRKKVVRP

SEQ ID NO: 75265 - protein, 8 aa, Dengue virus
RKKVVRPP

SEQ ID NO: 75266 - protein, 8 aa, Dengue virus
KKVVRPPF

SEQ ID NO: 75267 - protein, 8 aa, Dengue virus
KVVRPPFN

SEQ ID NO: 75268 - protein, 8 aa, Dengue virus
VVRPPFNM

SEQ ID NO: 75269 - protein, 8 aa, Dengue virus
VRPPFNML

SEQ ID NO: 75270 - protein, 8 aa, Dengue virus
RPPFNMLK

SEQ ID NO: 75271 - protein, 8 aa, Dengue virus
PPFNMLKR

SEQ ID NO: 75272 - protein, 8 aa, Dengue virus
PFNMLKRE

SEQ ID NO: 75273 - protein, 8 aa, Dengue virus
FNMLKRER

SEQ ID NO: 75274 - protein, 8 aa, Dengue virus
NMLKRERN

SEQ ID NO: 75275 - protein, 8 aa, Dengue virus
MLKRERNR

SEQ ID NO: 75276 - protein, 8 aa, Dengue virus
LKRERNRV

SEQ ID NO: 75277 - protein, 8 aa, Dengue virus
KRERNRVS

SEQ ID NO: 75278 - protein, 8 aa, Dengue virus
RERNRVST

SEQ ID NO: 75279 - protein, 8 aa, Dengue virus
ERNRVSTP

SEQ ID NO: 75280 - protein, 8 aa, Dengue virus
RNRVSTPQ

SEQ ID NO: 75281 - protein, 8 aa, Dengue virus
NRVSTPQG

SEQ ID NO: 75282 - protein, 8 aa, Dengue virus
RVSTPQGL

SEQ ID NO: 75283 - protein, 8 aa, Dengue virus
VSTPQGLV

SEQ ID NO: 75284 - protein, 8 aa, Dengue virus
STPQGLVK

SEQ ID NO: 75285 - protein, 8 aa, Dengue virus
TPQGLVKR

SEQ ID NO: 75286 - protein, 8 aa, Dengue virus
PQGLVKRF

SEQ ID NO: 75287 - protein, 8 aa, Dengue virus
QGLVKRFS

SEQ ID NO: 75288 - protein, 8 aa, Dengue virus
GLVKRFST

SEQ ID NO: 75289 - protein, 8 aa, Dengue virus
LVKRFSTG

SEQ ID NO: 75290 - protein, 8 aa, Dengue virus
VKRFSTGL

SEQ ID NO: 75291 - protein, 8 aa, Dengue virus
KRFSTGLF

SEQ ID NO: 75292 - protein, 8 aa, Dengue virus
RFSTGLFS

SEQ ID NO: 75293 - protein, 8 aa, Dengue virus
FSTGLFSG

SEQ ID NO: 75294 - protein, 8 aa, Dengue virus
STGLFSGK

SEQ ID NO: 75295 - protein, 8 aa, Dengue virus
TGLFSGKG

SEQ ID NO: 75296 - protein, 8 aa, Dengue virus
GLFSGKGP

SEQ ID NO: 75297 - protein, 8 aa, Dengue virus
LFSGKGPL

SEQ ID NO: 75298 - protein, 8 aa, Dengue virus
FSGKGPLR

SEQ ID NO: 75299 - protein, 8 aa, Dengue virus
SGKGPLRM

SEQ ID NO: 75300 - protein, 8 aa, Dengue virus
GKGPLRMV

SEQ ID NO: 75301 - protein, 8 aa, Dengue virus
KGPLRMVL

SEQ ID NO: 75302 - protein, 8 aa, Dengue virus
GPLRMVLA

SEQ ID NO: 75303 - protein, 8 aa, Dengue virus
PLRMVLAF

SEQ ID NO: 75304 - protein, 8 aa, Dengue virus
LRMVLAFI

SEQ ID NO: 75305 - protein, 8 aa, Dengue virus
RMVLAFIT

SEQ ID NO: 75306 - protein, 8 aa, Dengue virus
MVLAFITF

SEQ ID NO: 75307 - protein, 8 aa, Dengue virus
VLAFITFL

SEQ ID NO: 75308 - protein, 8 aa, Dengue virus
LAFITFLR

SEQ ID NO: 75309 - protein, 8 aa, Dengue virus
AFITFLRV

SEQ ID NO: 75310 - protein, 8 aa, Dengue virus
FITFLRVL

SEQ ID NO: 75311 - protein, 8 aa, Dengue virus
ITFLRVLS

SEQ ID NO: 75312 - protein, 8 aa, Dengue virus
TFLRVLSI

SEQ ID NO: 75313 - protein, 8 aa, Dengue virus
FLRVLSIP

SEQ ID NO: 75314 - protein, 8 aa, Dengue virus
LRVLSIPP

SEQ ID NO: 75315 - protein, 8 aa, Dengue virus
RVLSIPPT

SEQ ID NO: 75316 - protein, 8 aa, Dengue virus
VLSIPPTA

SEQ ID NO: 75317 - protein, 8 aa, Dengue virus
LSIPPTAG

SEQ ID NO: 75318 - protein, 8 aa, Dengue virus
SIPPTAGI

SEQ ID NO: 75319 - protein, 8 aa, Dengue virus
IPPTAGIL

SEQ ID NO: 75320 - protein, 8 aa, Dengue virus
PPTAGILK

SEQ ID NO: 75321 - protein, 8 aa, Dengue virus
PTAGILKR

SEQ ID NO: 75322 - protein, 8 aa, Dengue virus
TAGILKRW

SEQ ID NO: 75323 - protein, 8 aa, Dengue virus
AGILKRWG

SEQ ID NO: 75324 - protein, 8 aa, Dengue virus
GILKRWGQ

SEQ ID NO: 75325 - protein, 8 aa, Dengue virus
ILKRWGQL

SEQ ID NO: 75326 - protein, 8 aa, Dengue virus
LKRWGQLK

SEQ ID NO: 75327 - protein, 8 aa, Dengue virus
KRWGQLKK

SEQ ID NO: 75328 - protein, 8 aa, Dengue virus
RWGQLKKN

SEQ ID NO: 75329 - protein, 8 aa, Dengue virus
WGQLKKNK

SEQ ID NO: 75330 - protein, 8 aa, Dengue virus
GQLKKNKA

SEQ ID NO: 75331 - protein, 8 aa, Dengue virus
QLKKNKAI

SEQ ID NO: 75332 - protein, 8 aa, Dengue virus
LKKNKAIK

SEQ ID NO: 75333 - protein, 8 aa, Dengue virus
KKNKAIKI

SEQ ID NO: 75334 - protein, 8 aa, Dengue virus
KNKAIKIL

SEQ ID NO: 75335 - protein, 8 aa, Dengue virus
NKAIKILI

SEQ ID NO: 75336 - protein, 8 aa, Dengue virus
KAIKILIG

SEQ ID NO: 75337 - protein, 8 aa, Dengue virus
AIKILIGF

SEQ ID NO: 75338 - protein, 8 aa, Dengue virus
IKILIGFR

SEQ ID NO: 75339 - protein, 8 aa, Dengue virus
KILIGFRK

SEQ ID NO: 75340 - protein, 8 aa, Dengue virus
ILIGFRKE

SEQ ID NO: 75341 - protein, 8 aa, Dengue virus
LIGFRKEI

SEQ ID NO: 75342 - protein, 8 aa, Dengue virus
IGFRKEIG

SEQ ID NO: 75343 - protein, 8 aa, Dengue virus
GFRKEIGR

SEQ ID NO: 75344 - protein, 8 aa, Dengue virus
FRKEIGRM

SEQ ID NO: 75345 - protein, 8 aa, Dengue virus
RKEIGRML

SEQ ID NO: 75346 - protein, 8 aa, Dengue virus
KEIGRMLN

SEQ ID NO: 75347 - protein, 8 aa, Dengue virus
EIGRMLNI

SEQ ID NO: 75348 - protein, 8 aa, Dengue virus
IGRMLNIL

SEQ ID NO: 75349 - protein, 8 aa, Dengue virus
GRMLNILN

SEQ ID NO: 75350 - protein, 8 aa, Dengue virus
RMLNILNG

SEQ ID NO: 75351 - protein, 8 aa, Dengue virus
MLNILNGR

SEQ ID NO: 75352 - protein, 8 aa, Dengue virus
LNILNGRK

SEQ ID NO: 75353 - protein, 8 aa, Dengue virus
NILNGRKR

SEQ ID NO: 75354 - protein, 8 aa, Dengue virus
ILNGRKRS

SEQ ID NO: 75355 - protein, 8 aa, Dengue virus
LNGRKRST

SEQ ID NO: 75356 - protein, 8 aa, Dengue virus
RKRSTITL

SEQ ID NO: 75357 - protein, 8 aa, Dengue virus
KRSTITLL

SEQ ID NO: 75358 - protein, 8 aa, Dengue virus
RSTITLLC

SEQ ID NO: 75359 - protein, 8 aa, Dengue virus
STITLLCL

SEQ ID NO: 75360 - protein, 8 aa, Dengue virus
TITLLCLI

SEQ ID NO: 75361 - protein, 8 aa, Dengue virus
ITLLCLIP

SEQ ID NO: 75362 - protein, 8 aa, Dengue virus
TLLCLIPT

SEQ ID NO: 75363 - protein, 8 aa, Dengue virus
LLCLIPTV

SEQ ID NO: 75364 - protein, 8 aa, Dengue virus
LCLIPTVM

SEQ ID NO: 75365 - protein, 8 aa, Dengue virus
CLIPTVMA

SEQ ID NO: 75366 - protein, 8 aa, Dengue virus
LIPTVMAF

SEQ ID NO: 75367 - protein, 8 aa, Dengue virus
IPTVMAFH

SEQ ID NO: 75368 - protein, 8 aa, Dengue virus
PTVMAFHL

SEQ ID NO: 75369 - protein, 8 aa, Dengue virus
TVMAFHLS

SEQ ID NO: 75370 - protein, 8 aa, Dengue virus
VMAFHLST

SEQ ID NO: 75371 - protein, 8 aa, Dengue virus
MAFHLSTR

SEQ ID NO: 75372 - protein, 8 aa, Dengue virus
AFHLSTRD

SEQ ID NO: 75373 - protein, 8 aa, Dengue virus
FHLSTRDG

SEQ ID NO: 75374 - protein, 8 aa, Dengue virus
HLSTRDGE

SEQ ID NO: 75375 - protein, 8 aa, Dengue virus
LSTRDGEP

SEQ ID NO: 75376 - protein, 8 aa, Dengue virus
STRDGEPL

SEQ ID NO: 75377 - protein, 8 aa, Dengue virus
TRDGEPLM

SEQ ID NO: 75378 - protein, 8 aa, Dengue virus
RDGEPLMI

SEQ ID NO: 75379 - protein, 8 aa, Dengue virus
DGEPLMIV

SEQ ID NO: 75380 - protein, 8 aa, Dengue virus
GEPLMIVA

SEQ ID NO: 75381 - protein, 8 aa, Dengue virus
EPLMIVAK

SEQ ID NO: 75382 - protein, 8 aa, Dengue virus
PLMIVAKH

SEQ ID NO: 75383 - protein, 8 aa, Dengue virus
LMIVAKHE

SEQ ID NO: 75384 - protein, 8 aa, Dengue virus
MIVAKHER

SEQ ID NO: 75385 - protein, 8 aa, Dengue virus
IVAKHERG

SEQ ID NO: 75386 - protein, 8 aa, Dengue virus
VAKHERGR

SEQ ID NO: 75387 - protein, 8 aa, Dengue virus
AKHERGRP

SEQ ID NO: 75388 - protein, 8 aa, Dengue virus
KHERGRPL

SEQ ID NO: 75389 - protein, 8 aa, Dengue virus
HERGRPLL

SEQ ID NO: 75390 - protein, 8 aa, Dengue virus
ERGRPLLF

SEQ ID NO: 75391 - protein, 8 aa, Dengue virus
RGRPLLFK

SEQ ID NO: 75392 - protein, 8 aa, Dengue virus
GRPLLFKT

SEQ ID NO: 75393 - protein, 8 aa, Dengue virus
RPLLFKTT

SEQ ID NO: 75394 - protein, 8 aa, Dengue virus
PLLFKTTE

SEQ ID NO: 75395 - protein, 8 aa, Dengue virus
LLFKTTEG

SEQ ID NO: 75396 - protein, 8 aa, Dengue virus
LFKTTEGI

SEQ ID NO: 75397 - protein, 8 aa, Dengue virus
FKTTEGIN

SEQ ID NO: 75398 - protein, 8 aa, Dengue virus
KTTEGINK

SEQ ID NO: 75399 - protein, 8 aa, Dengue virus
TTEGINKC

SEQ ID NO: 75400 - protein, 8 aa, Dengue virus
TEGINKCT

SEQ ID NO: 75401 - protein, 8 aa, Dengue virus
EGINKCTL

SEQ ID NO: 75402 - protein, 8 aa, Dengue virus
GINKCTLI

SEQ ID NO: 75403 - protein, 8 aa, Dengue virus
INKCTLIA

SEQ ID NO: 75404 - protein, 8 aa, Dengue virus
NKCTLIAM

SEQ ID NO: 75405 - protein, 8 aa, Dengue virus
KCTLIAMD

SEQ ID NO: 75406 - protein, 8 aa, Dengue virus
CTLIAMDL

SEQ ID NO: 75407 - protein, 8 aa, Dengue virus
TLIAMDLG

SEQ ID NO: 75408 - protein, 8 aa, Dengue virus
LIAMDLGE

SEQ ID NO: 75409 - protein, 8 aa, Dengue virus
IAMDLGEM

SEQ ID NO: 75410 - protein, 8 aa, Dengue virus
AMDLGEMC

SEQ ID NO: 75411 - protein, 8 aa, Dengue virus
MDLGEMCE

SEQ ID NO: 75412 - protein, 8 aa, Dengue virus
DLGEMCED

SEQ ID NO: 75413 - protein, 8 aa, Dengue virus
LGEMCEDT

SEQ ID NO: 75414 - protein, 8 aa, Dengue virus
GEMCEDTV

SEQ ID NO: 75415 - protein, 8 aa, Dengue virus
EMCEDTVT

SEQ ID NO: 75416 - protein, 8 aa, Dengue virus
MCEDTVTY

SEQ ID NO: 75417 - protein, 8 aa, Dengue virus
CEDTVTYK

SEQ ID NO: 75418 - protein, 8 aa, Dengue virus
EDTVTYKC

SEQ ID NO: 75419 - protein, 8 aa, Dengue virus
DTVTYKCP

SEQ ID NO: 75420 - protein, 8 aa, Dengue virus
TVTYKCPL

SEQ ID NO: 75421 - protein, 8 aa, Dengue virus
VTYKCPLL

SEQ ID NO: 75422 - protein, 8 aa, Dengue virus
TYKCPLLV

SEQ ID NO: 75423 - protein, 8 aa, Dengue virus
YKCPLLVN

SEQ ID NO: 75424 - protein, 8 aa, Dengue virus
KCPLLVNT

SEQ ID NO: 75425 - protein, 8 aa, Dengue virus
CPLLVNTE

SEQ ID NO: 75426 - protein, 8 aa, Dengue virus
PLLVNTEP

SEQ ID NO: 75427 - protein, 8 aa, Dengue virus
LLVNTEPE

SEQ ID NO: 75428 - protein, 8 aa, Dengue virus
LVNTEPED

SEQ ID NO: 75429 - protein, 8 aa, Dengue virus
VNTEPEDI

SEQ ID NO: 75430 - protein, 8 aa, Dengue virus
NTEPEDID

SEQ ID NO: 75431 - protein, 8 aa, Dengue virus
TEPEDIDC

SEQ ID NO: 75432 - protein, 8 aa, Dengue virus
EPEDIDCW

SEQ ID NO: 75433 - protein, 8 aa, Dengue virus
PEDIDCWC

SEQ ID NO: 75434 - protein, 8 aa, Dengue virus
EDIDCWCN

SEQ ID NO: 75435 - protein, 8 aa, Dengue virus
DIDCWCNL

SEQ ID NO: 75436 - protein, 8 aa, Dengue virus
IDCWCNLT

SEQ ID NO: 75437 - protein, 8 aa, Dengue virus
DCWCNLTS

SEQ ID NO: 75438 - protein, 8 aa, Dengue virus
CWCNLTST

SEQ ID NO: 75439 - protein, 8 aa, Dengue virus
WCNLTSTW

SEQ ID NO: 75440 - protein, 8 aa, Dengue virus
CNLTSTWV

SEQ ID NO: 75441 - protein, 8 aa, Dengue virus
NLTSTWVM

SEQ ID NO: 75442 - protein, 8 aa, Dengue virus
LTSTWVMY

SEQ ID NO: 75443 - protein, 8 aa, Dengue virus
TSTWVMYG

SEQ ID NO: 75444 - protein, 8 aa, Dengue virus
STWVMYGT

SEQ ID NO: 75445 - protein, 8 aa, Dengue virus
TWVMYGTC

SEQ ID NO: 75446 - protein, 8 aa, Dengue virus
WVMYGTCT

SEQ ID NO: 75447 - protein, 8 aa, Dengue virus
VMYGTCTQ

SEQ ID NO: 75448 - protein, 8 aa, Dengue virus
MYGTCTQS

SEQ ID NO: 75449 - protein, 8 aa, Dengue virus
YGTCTQSG

SEQ ID NO: 75450 - protein, 8 aa, Dengue virus
GTCTQSGE

SEQ ID NO: 75451 - protein, 8 aa, Dengue virus
TCTQSGER

SEQ ID NO: 75452 - protein, 8 aa, Dengue virus
CTQSGERR

SEQ ID NO: 75453 - protein, 8 aa, Dengue virus
TQSGERRR

SEQ ID NO: 75454 - protein, 8 aa, Dengue virus
QSGERRRE

SEQ ID NO: 75455 - protein, 8 aa, Dengue virus
SGERRREK

SEQ ID NO: 75456 - protein, 8 aa, Dengue virus
GERRREKR

SEQ ID NO: 75457 - protein, 8 aa, Dengue virus
ERRREKRS

SEQ ID NO: 75458 - protein, 8 aa, Dengue virus
RRREKRSV

SEQ ID NO: 75459 - protein, 8 aa, Dengue virus
RREKRSVA

SEQ ID NO: 75460 - protein, 8 aa, Dengue virus
REKRSVAL

SEQ ID NO: 75461 - protein, 8 aa, Dengue virus
EKRSVALT

SEQ ID NO: 75462 - protein, 8 aa, Dengue virus
KRSVALTP

SEQ ID NO: 75463 - protein, 8 aa, Dengue virus
RSVALTPH

SEQ ID NO: 75464 - protein, 8 aa, Dengue virus
SVALTPHS

SEQ ID NO: 75465 - protein, 8 aa, Dengue virus
VALTPHSG

SEQ ID NO: 75466 - protein, 8 aa, Dengue virus
ALTPHSGM

SEQ ID NO: 75467 - protein, 8 aa, Dengue virus
LTPHSGMG

SEQ ID NO: 75468 - protein, 8 aa, Dengue virus
TPHSGMGL

SEQ ID NO: 75469 - protein, 8 aa, Dengue virus
PHSGMGLE

SEQ ID NO: 75470 - protein, 8 aa, Dengue virus
HSGMGLET

SEQ ID NO: 75471 - protein, 8 aa, Dengue virus
SGMGLETR

SEQ ID NO: 75472 - protein, 8 aa, Dengue virus
GMGLETRA

SEQ ID NO: 75473 - protein, 8 aa, Dengue virus
MGLETRAE

SEQ ID NO: 75474 - protein, 8 aa, Dengue virus
GLETRAET

SEQ ID NO: 75475 - protein, 8 aa, Dengue virus
LETRAETW

SEQ ID NO: 75476 - protein, 8 aa, Dengue virus
ETRAETWM

SEQ ID NO: 75477 - protein, 8 aa, Dengue virus
TRAETWMS

SEQ ID NO: 75478 - protein, 8 aa, Dengue virus
RAETWMSS

SEQ ID NO: 75479 - protein, 8 aa, Dengue virus
AETWMSSE

SEQ ID NO: 75480 - protein, 8 aa, Dengue virus
ETWMSSEG

SEQ ID NO: 75481 - protein, 8 aa, Dengue virus
TWMSSEGA

SEQ ID NO: 75482 - protein, 8 aa, Dengue virus
WMSSEGAW

SEQ ID NO: 75483 - protein, 8 aa, Dengue virus
MSSEGAWK

SEQ ID NO: 75484 - protein, 8 aa, Dengue virus
SSEGAWKH

SEQ ID NO: 75485 - protein, 8 aa, Dengue virus
SEGAWKHA

SEQ ID NO: 75486 - protein, 8 aa, Dengue virus
EGAWKHAQ

SEQ ID NO: 75487 - protein, 8 aa, Dengue virus
GAWKHAQR

SEQ ID NO: 75488 - protein, 8 aa, Dengue virus
AWKHAQRV

SEQ ID NO: 75489 - protein, 8 aa, Dengue virus
WKHAQRVE

SEQ ID NO: 75490 - protein, 8 aa, Dengue virus
KHAQRVES

SEQ ID NO: 75491 - protein, 8 aa, Dengue virus
HAQRVESW

SEQ ID NO: 75492 - protein, 8 aa, Dengue virus
AQRVESWI

SEQ ID NO: 75493 - protein, 8 aa, Dengue virus
QRVESWIL

SEQ ID NO: 75494 - protein, 8 aa, Dengue virus
RVESWILR

SEQ ID NO: 75495 - protein, 8 aa, Dengue virus
VESWILRN

SEQ ID NO: 75496 - protein, 8 aa, Dengue virus
ESWILRNP

SEQ ID NO: 75497 - protein, 8 aa, Dengue virus
SWILRNPG

SEQ ID NO: 75498 - protein, 8 aa, Dengue virus
WILRNPGF

SEQ ID NO: 75499 - protein, 8 aa, Dengue virus
ILRNPGFA

SEQ ID NO: 75500 - protein, 8 aa, Dengue virus
LRNPGFAL

SEQ ID NO: 75501 - protein, 8 aa, Dengue virus
RNPGFALL

SEQ ID NO: 75502 - protein, 8 aa, Dengue virus
NPGFALLA

SEQ ID NO: 75503 - protein, 8 aa, Dengue virus
PGFALLAG

SEQ ID NO: 75504 - protein, 8 aa, Dengue virus
GFALLAGF

SEQ ID NO: 75505 - protein, 8 aa, Dengue virus
FALLAGFM

SEQ ID NO: 75506 - protein, 8 aa, Dengue virus
ALLAGFMA

SEQ ID NO: 75507 - protein, 8 aa, Dengue virus
LLAGFMAY

SEQ ID NO: 75508 - protein, 8 aa, Dengue virus
LAGFMAYM

SEQ ID NO: 75509 - protein, 8 aa, Dengue virus
AGFMAYMI

SEQ ID NO: 75510 - protein, 8 aa, Dengue virus
GFMAYMIG

SEQ ID NO: 75511 - protein, 8 aa, Dengue virus
FMAYMIGQ

SEQ ID NO: 75512 - protein, 8 aa, Dengue virus
MAYMIGQT

SEQ ID NO: 75513 - protein, 8 aa, Dengue virus
AYMIGQTG

SEQ ID NO: 75514 - protein, 8 aa, Dengue virus
YMIGQTGI

SEQ ID NO: 75515 - protein, 8 aa, Dengue virus
MIGQTGIQ

SEQ ID NO: 75516 - protein, 8 aa, Dengue virus
IGQTGIQR

SEQ ID NO: 75517 - protein, 8 aa, Dengue virus
GQTGIQRT

SEQ ID NO: 75518 - protein, 8 aa, Dengue virus
QTGIQRTV

SEQ ID NO: 75519 - protein, 8 aa, Dengue virus
TGIQRTVF

SEQ ID NO: 75520 - protein, 8 aa, Dengue virus
GIQRTVFF

SEQ ID NO: 75521 - protein, 8 aa, Dengue virus
IQRTVFFV

SEQ ID NO: 75522 - protein, 8 aa, Dengue virus
QRTVFFVL

SEQ ID NO: 75523 - protein, 8 aa, Dengue virus
RTVFFVLM

SEQ ID NO: 75524 - protein, 8 aa, Dengue virus
TVFFVLMM

SEQ ID NO: 75525 - protein, 8 aa, Dengue virus
VFFVLMML

SEQ ID NO: 75526 - protein, 8 aa, Dengue virus
FFVLMMLV

SEQ ID NO: 75527 - protein, 8 aa, Dengue virus
FVLMMLVA

SEQ ID NO: 75528 - protein, 8 aa, Dengue virus
VLMMLVAP

SEQ ID NO: 75529 - protein, 8 aa, Dengue virus
LMMLVAPS

SEQ ID NO: 75530 - protein, 8 aa, Dengue virus
MMLVAPSY

SEQ ID NO: 75531 - protein, 8 aa, Dengue virus
MLVAPSYG

SEQ ID NO: 75532 - protein, 8 aa, Dengue virus
LVAPSYGM

SEQ ID NO: 75533 - protein, 8 aa, Dengue virus
VAPSYGMR

SEQ ID NO: 75534 - protein, 8 aa, Dengue virus
APSYGMRC

SEQ ID NO: 75535 - protein, 8 aa, Dengue virus
PSYGMRCV

SEQ ID NO: 75536 - protein, 8 aa, Dengue virus
SYGMRCVG

SEQ ID NO: 75537 - protein, 8 aa, Dengue virus
YGMRCVGV

SEQ ID NO: 75538 - protein, 8 aa, Dengue virus
GMRCVGVG

SEQ ID NO: 75539 - protein, 8 aa, Dengue virus
MRCVGVGN

SEQ ID NO: 75540 - protein, 8 aa, Dengue virus
RCVGVGNR

SEQ ID NO: 75541 - protein, 8 aa, Dengue virus
CVGVGNRD

SEQ ID NO: 75542 - protein, 8 aa, Dengue virus
VGVGNRDF

SEQ ID NO: 75543 - protein, 8 aa, Dengue virus
GVGNRDFV

SEQ ID NO: 75544 - protein, 8 aa, Dengue virus
VGNRDFVE

SEQ ID NO: 75545 - protein, 8 aa, Dengue virus
GNRDFVEG

SEQ ID NO: 75546 - protein, 8 aa, Dengue virus
NRDFVEGV

SEQ ID NO: 75547 - protein, 8 aa, Dengue virus
RDFVEGVS

SEQ ID NO: 75548 - protein, 8 aa, Dengue virus
DFVEGVSG

SEQ ID NO: 75549 - protein, 8 aa, Dengue virus
FVEGVSGG

SEQ ID NO: 75550 - protein, 8 aa, Dengue virus
VEGVSGGA

SEQ ID NO: 75551 - protein, 8 aa, Dengue virus
EGVSGGAW

SEQ ID NO: 75552 - protein, 8 aa, Dengue virus
GVSGGAWV

SEQ ID NO: 75553 - protein, 8 aa, Dengue virus
VSGGAWVD

SEQ ID NO: 75554 - protein, 8 aa, Dengue virus
SGGAWVDL

SEQ ID NO: 75555 - protein, 8 aa, Dengue virus
GGAWVDLV

SEQ ID NO: 75556 - protein, 8 aa, Dengue virus
GAWVDLVL

SEQ ID NO: 75557 - protein, 8 aa, Dengue virus
AWVDLVLE

SEQ ID NO: 75558 - protein, 8 aa, Dengue virus
WVDLVLEH

SEQ ID NO: 75559 - protein, 8 aa, Dengue virus
VDLVLEHG

SEQ ID NO: 75560 - protein, 8 aa, Dengue virus
DLVLEHGG

SEQ ID NO: 75561 - protein, 8 aa, Dengue virus
LVLEHGGC

SEQ ID NO: 75562 - protein, 8 aa, Dengue virus
VLEHGGCV

SEQ ID NO: 75563 - protein, 8 aa, Dengue virus
LEHGGCVT

SEQ ID NO: 75564 - protein, 8 aa, Dengue virus
EHGGCVTT

SEQ ID NO: 75565 - protein, 8 aa, Dengue virus
HGGCVTTM

SEQ ID NO: 75566 - protein, 8 aa, Dengue virus
GGCVTTMA

SEQ ID NO: 75567 - protein, 8 aa, Dengue virus
GCVTTMAQ

SEQ ID NO: 75568 - protein, 8 aa, Dengue virus
CVTTMAQG

SEQ ID NO: 75569 - protein, 8 aa, Dengue virus
VTTMAQGK

SEQ ID NO: 75570 - protein, 8 aa, Dengue virus
TTMAQGKP

SEQ ID NO: 75571 - protein, 8 aa, Dengue virus
TMAQGKPT

SEQ ID NO: 75572 - protein, 8 aa, Dengue virus
MAQGKPTL

SEQ ID NO: 75573 - protein, 8 aa, Dengue virus
AQGKPTLD

SEQ ID NO: 75574 - protein, 8 aa, Dengue virus
QGKPTLDF

SEQ ID NO: 75575 - protein, 8 aa, Dengue virus
GKPTLDFE

SEQ ID NO: 75576 - protein, 8 aa, Dengue virus
KPTLDFEL

SEQ ID NO: 75577 - protein, 8 aa, Dengue virus
PTLDFELT

SEQ ID NO: 75578 - protein, 8 aa, Dengue virus
TLDFELTK

SEQ ID NO: 75579 - protein, 8 aa, Dengue virus
LDFELTKT

SEQ ID NO: 75580 - protein, 8 aa, Dengue virus
DFELTKTT

SEQ ID NO: 75581 - protein, 8 aa, Dengue virus
FELTKTTA

SEQ ID NO: 75582 - protein, 8 aa, Dengue virus
ELTKTTAK

SEQ ID NO: 75583 - protein, 8 aa, Dengue virus
LTKTTAKE

SEQ ID NO: 75584 - protein, 8 aa, Dengue virus
TKTTAKEV

SEQ ID NO: 75585 - protein, 8 aa, Dengue virus
KTTAKEVA

SEQ ID NO: 75586 - protein, 8 aa, Dengue virus
TTAKEVAL

SEQ ID NO: 75587 - protein, 8 aa, Dengue virus
TAKEVALL

SEQ ID NO: 75588 - protein, 8 aa, Dengue virus
AKEVALLR

SEQ ID NO: 75589 - protein, 8 aa, Dengue virus
KEVALLRT

SEQ ID NO: 75590 - protein, 8 aa, Dengue virus
EVALLRTY

SEQ ID NO: 75591 - protein, 8 aa, Dengue virus
VALLRTYC

SEQ ID NO: 75592 - protein, 8 aa, Dengue virus
ALLRTYCI

SEQ ID NO: 75593 - protein, 8 aa, Dengue virus
LLRTYCIE

SEQ ID NO: 75594 - protein, 8 aa, Dengue virus
LRTYCIEA

SEQ ID NO: 75595 - protein, 8 aa, Dengue virus
RTYCIEAS

SEQ ID NO: 75596 - protein, 8 aa, Dengue virus
TYCIEASI

SEQ ID NO: 75597 - protein, 8 aa, Dengue virus
YCIEASIS

SEQ ID NO: 75598 - protein, 8 aa, Dengue virus
CIEASISN

SEQ ID NO: 75599 - protein, 8 aa, Dengue virus
IEASISNI

SEQ ID NO: 75600 - protein, 8 aa, Dengue virus
EASISNIT

SEQ ID NO: 75601 - protein, 8 aa, Dengue virus
ASISNITT

SEQ ID NO: 75602 - protein, 8 aa, Dengue virus
SISNITTA

SEQ ID NO: 75603 - protein, 8 aa, Dengue virus
ISNITTAT

SEQ ID NO: 75604 - protein, 8 aa, Dengue virus
SNITTATR

SEQ ID NO: 75605 - protein, 8 aa, Dengue virus
NITTATRC

SEQ ID NO: 75606 - protein, 8 aa, Dengue virus
ITTATRCP

SEQ ID NO: 75607 - protein, 8 aa, Dengue virus
TTATRCPT

SEQ ID NO: 75608 - protein, 8 aa, Dengue virus
TATRCPTQ

SEQ ID NO: 75609 - protein, 8 aa, Dengue virus
ATRCPTQG

SEQ ID NO: 75610 - protein, 8 aa, Dengue virus
TRCPTQGE

SEQ ID NO: 75611 - protein, 8 aa, Dengue virus
RCPTQGEP

SEQ ID NO: 75612 - protein, 8 aa, Dengue virus
CPTQGEPY

SEQ ID NO: 75613 - protein, 8 aa, Dengue virus
PTQGEPYL

SEQ ID NO: 75614 - protein, 8 aa, Dengue virus
TQGEPYLK

SEQ ID NO: 75615 - protein, 8 aa, Dengue virus
QGEPYLKE

SEQ ID NO: 75616 - protein, 8 aa, Dengue virus
GEPYLKEE

SEQ ID NO: 75617 - protein, 8 aa, Dengue virus
EPYLKEEQ

SEQ ID NO: 75618 - protein, 8 aa, Dengue virus
PYLKEEQD

SEQ ID NO: 75619 - protein, 8 aa, Dengue virus
YLKEEQDQ

SEQ ID NO: 75620 - protein, 8 aa, Dengue virus
LKEEQDQQ

SEQ ID NO: 75621 - protein, 8 aa, Dengue virus
KEEQDQQY

SEQ ID NO: 75622 - protein, 8 aa, Dengue virus
EEQDQQYI

SEQ ID NO: 75623 - protein, 8 aa, Dengue virus
EQDQQYIC

SEQ ID NO: 75624 - protein, 8 aa, Dengue virus
QDQQYICR

SEQ ID NO: 75625 - protein, 8 aa, Dengue virus
DQQYICRR

SEQ ID NO: 75626 - protein, 8 aa, Dengue virus
QQYICRRD

SEQ ID NO: 75627 - protein, 8 aa, Dengue virus
QYICRRDV

SEQ ID NO: 75628 - protein, 8 aa, Dengue virus
YICRRDVV

SEQ ID NO: 75629 - protein, 8 aa, Dengue virus
ICRRDVVD

SEQ ID NO: 75630 - protein, 8 aa, Dengue virus
CRRDVVDR

SEQ ID NO: 75631 - protein, 8 aa, Dengue virus
RRDVVDRG

SEQ ID NO: 75632 - protein, 8 aa, Dengue virus
RDVVDRGW

SEQ ID NO: 75633 - protein, 8 aa, Dengue virus
DVVDRGWG

SEQ ID NO: 75634 - protein, 8 aa, Dengue virus
VVDRGWGN

SEQ ID NO: 75635 - protein, 8 aa, Dengue virus
VDRGWGNG

SEQ ID NO: 75636 - protein, 8 aa, Dengue virus
DRGWGNGC

SEQ ID NO: 75637 - protein, 8 aa, Dengue virus
RGWGNGCG

SEQ ID NO: 75638 - protein, 8 aa, Dengue virus
GWGNGCGL

SEQ ID NO: 75639 - protein, 8 aa, Dengue virus
WGNGCGLF

SEQ ID NO: 75640 - protein, 8 aa, Dengue virus
GNGCGLFG

SEQ ID NO: 75641 - protein, 8 aa, Dengue virus
NGCGLFGK

SEQ ID NO: 75642 - protein, 8 aa, Dengue virus
GCGLFGKG

SEQ ID NO: 75643 - protein, 8 aa, Dengue virus
CGLFGKGG

SEQ ID NO: 75644 - protein, 8 aa, Dengue virus
GLFGKGGV

SEQ ID NO: 75645 - protein, 8 aa, Dengue virus
LFGKGGVV

SEQ ID NO: 75646 - protein, 8 aa, Dengue virus
FGKGGVVT

SEQ ID NO: 75647 - protein, 8 aa, Dengue virus
GKGGVVTC

SEQ ID NO: 75648 - protein, 8 aa, Dengue virus
KGGVVTCA

SEQ ID NO: 75649 - protein, 8 aa, Dengue virus
GGVVTCAK

SEQ ID NO: 75650 - protein, 8 aa, Dengue virus
GVVTCAKF

SEQ ID NO: 75651 - protein, 8 aa, Dengue virus
VVTCAKFS

SEQ ID NO: 75652 - protein, 8 aa, Dengue virus
VTCAKFSC

SEQ ID NO: 75653 - protein, 8 aa, Dengue virus
TCAKFSCS

SEQ ID NO: 75654 - protein, 8 aa, Dengue virus
CAKFSCSG

SEQ ID NO: 75655 - protein, 8 aa, Dengue virus
AKFSCSGK

SEQ ID NO: 75656 - protein, 8 aa, Dengue virus
KFSCSGKI

SEQ ID NO: 75657 - protein, 8 aa, Dengue virus
FSCSGKIT

SEQ ID NO: 75658 - protein, 8 aa, Dengue virus
SCSGKITG

SEQ ID NO: 75659 - protein, 8 aa, Dengue virus
CSGKITGN

SEQ ID NO: 75660 - protein, 8 aa, Dengue virus
SGKITGNL

SEQ ID NO: 75661 - protein, 8 aa, Dengue virus
GKITGNLV

SEQ ID NO: 75662 - protein, 8 aa, Dengue virus
KITGNLVQ

SEQ ID NO: 75663 - protein, 8 aa, Dengue virus
ITGNLVQI

SEQ ID NO: 75664 - protein, 8 aa, Dengue virus
TGNLVQIE

SEQ ID NO: 75665 - protein, 8 aa, Dengue virus
GNLVQIEN

SEQ ID NO: 75666 - protein, 8 aa, Dengue virus
NLVQIENL

SEQ ID NO: 75667 - protein, 8 aa, Dengue virus
LVQIENLE

SEQ ID NO: 75668 - protein, 8 aa, Dengue virus
VQIENLEY

SEQ ID NO: 75669 - protein, 8 aa, Dengue virus
QIENLEYT

SEQ ID NO: 75670 - protein, 8 aa, Dengue virus
IENLEYTV

SEQ ID NO: 75671 - protein, 8 aa, Dengue virus
ENLEYTVV

SEQ ID NO: 75672 - protein, 8 aa, Dengue virus
NLEYTVVV

SEQ ID NO: 75673 - protein, 8 aa, Dengue virus
LEYTVVVT

SEQ ID NO: 75674 - protein, 8 aa, Dengue virus
EYTVVVTV

SEQ ID NO: 75675 - protein, 8 aa, Dengue virus
YTVVVTVH

SEQ ID NO: 75676 - protein, 8 aa, Dengue virus
TVVVTVHN

SEQ ID NO: 75677 - protein, 8 aa, Dengue virus
VVVTVHNG

SEQ ID NO: 75678 - protein, 8 aa, Dengue virus
VVTVHNGD

SEQ ID NO: 75679 - protein, 8 aa, Dengue virus
VTVHNGDT

SEQ ID NO: 75680 - protein, 8 aa, Dengue virus
TVHNGDTH

SEQ ID NO: 75681 - protein, 8 aa, Dengue virus
VHNGDTHA

SEQ ID NO: 75682 - protein, 8 aa, Dengue virus
HNGDTHAV

SEQ ID NO: 75683 - protein, 8 aa, Dengue virus
NGDTHAVG

SEQ ID NO: 75684 - protein, 8 aa, Dengue virus
GDTHAVGN

SEQ ID NO: 75685 - protein, 8 aa, Dengue virus
DTHAVGND

SEQ ID NO: 75686 - protein, 8 aa, Dengue virus
THAVGNDT

SEQ ID NO: 75687 - protein, 8 aa, Dengue virus
HAVGNDTS

SEQ ID NO: 75688 - protein, 8 aa, Dengue virus
AVGNDTSN

SEQ ID NO: 75689 - protein, 8 aa, Dengue virus
VGNDTSNH

SEQ ID NO: 75690 - protein, 8 aa, Dengue virus
GNDTSNHG

SEQ ID NO: 75691 - protein, 8 aa, Dengue virus
NDTSNHGV

SEQ ID NO: 75692 - protein, 8 aa, Dengue virus
DTSNHGVT

SEQ ID NO: 75693 - protein, 8 aa, Dengue virus
TSNHGVTA

SEQ ID NO: 75694 - protein, 8 aa, Dengue virus
SNHGVTAT

SEQ ID NO: 75695 - protein, 8 aa, Dengue virus
NHGVTATI

SEQ ID NO: 75696 - protein, 8 aa, Dengue virus
HGVTATIT

SEQ ID NO: 75697 - protein, 8 aa, Dengue virus
GVTATITP

SEQ ID NO: 75698 - protein, 8 aa, Dengue virus
VTATITPR

SEQ ID NO: 75699 - protein, 8 aa, Dengue virus
TATITPRS

SEQ ID NO: 75700 - protein, 8 aa, Dengue virus
ATITPRSP

SEQ ID NO: 75701 - protein, 8 aa, Dengue virus
TITPRSPS

SEQ ID NO: 75702 - protein, 8 aa, Dengue virus
ITPRSPSV

SEQ ID NO: 75703 - protein, 8 aa, Dengue virus
TPRSPSVE

SEQ ID NO: 75704 - protein, 8 aa, Dengue virus
PRSPSVEV

SEQ ID NO: 75705 - protein, 8 aa, Dengue virus
RSPSVEVK

SEQ ID NO: 75706 - protein, 8 aa, Dengue virus
SPSVEVKL

SEQ ID NO: 75707 - protein, 8 aa, Dengue virus
PSVEVKLP

SEQ ID NO: 75708 - protein, 8 aa, Dengue virus
SVEVKLPD

SEQ ID NO: 75709 - protein, 8 aa, Dengue virus
VEVKLPDY

SEQ ID NO: 75710 - protein, 8 aa, Dengue virus
EVKLPDYG

SEQ ID NO: 75711 - protein, 8 aa, Dengue virus
VKLPDYGE

SEQ ID NO: 75712 - protein, 8 aa, Dengue virus
KLPDYGEL

SEQ ID NO: 75713 - protein, 8 aa, Dengue virus
LPDYGELT

SEQ ID NO: 75714 - protein, 8 aa, Dengue virus
PDYGELTL

SEQ ID NO: 75715 - protein, 8 aa, Dengue virus
DYGELTLD

SEQ ID NO: 75716 - protein, 8 aa, Dengue virus
YGELTLDC

SEQ ID NO: 75717 - protein, 8 aa, Dengue virus
GELTLDCE

SEQ ID NO: 75718 - protein, 8 aa, Dengue virus
ELTLDCEP

SEQ ID NO: 75719 - protein, 8 aa, Dengue virus
LTLDCEPR

SEQ ID NO: 75720 - protein, 8 aa, Dengue virus
TLDCEPRS

SEQ ID NO: 75721 - protein, 8 aa, Dengue virus
LDCEPRSG

SEQ ID NO: 75722 - protein, 8 aa, Dengue virus
DCEPRSGI

SEQ ID NO: 75723 - protein, 8 aa, Dengue virus
CEPRSGID

SEQ ID NO: 75724 - protein, 8 aa, Dengue virus
EPRSGIDF

SEQ ID NO: 75725 - protein, 8 aa, Dengue virus
PRSGIDFN

SEQ ID NO: 75726 - protein, 8 aa, Dengue virus
RSGIDFNE

SEQ ID NO: 75727 - protein, 8 aa, Dengue virus
SGIDFNEM

SEQ ID NO: 75728 - protein, 8 aa, Dengue virus
GIDFNEMI

SEQ ID NO: 75729 - protein, 8 aa, Dengue virus
IDFNEMIL

SEQ ID NO: 75730 - protein, 8 aa, Dengue virus
DFNEMILM

SEQ ID NO: 75731 - protein, 8 aa, Dengue virus
FNEMILMK

SEQ ID NO: 75732 - protein, 8 aa, Dengue virus
NEMILMKM

SEQ ID NO: 75733 - protein, 8 aa, Dengue virus
EMILMKMK

SEQ ID NO: 75734 - protein, 8 aa, Dengue virus
MKKKTWLV

SEQ ID NO: 75735 - protein, 8 aa, Dengue virus
KKKTWLVH

SEQ ID NO: 75736 - protein, 8 aa, Dengue virus
KKTWLVHK

SEQ ID NO: 75737 - protein, 8 aa, Dengue virus
KTWLVHKQ

SEQ ID NO: 75738 - protein, 8 aa, Dengue virus
TWLVHKQW

SEQ ID NO: 75739 - protein, 8 aa, Dengue virus
WLVHKQWF

SEQ ID NO: 75740 - protein, 8 aa, Dengue virus
LVHKQWFL

SEQ ID NO: 75741 - protein, 8 aa, Dengue virus
VHKQWFLD

SEQ ID NO: 75742 - protein, 8 aa, Dengue virus
HKQWFLDL

SEQ ID NO: 75743 - protein, 8 aa, Dengue virus
KQWFLDLP

SEQ ID NO: 75744 - protein, 8 aa, Dengue virus
QWFLDLPL

SEQ ID NO: 75745 - protein, 8 aa, Dengue virus
WFLDLPLP

SEQ ID NO: 75746 - protein, 8 aa, Dengue virus
FLDLPLPW

SEQ ID NO: 75747 - protein, 8 aa, Dengue virus
LDLPLPWT

SEQ ID NO: 75748 - protein, 8 aa, Dengue virus
DLPLPWTA

SEQ ID NO: 75749 - protein, 8 aa, Dengue virus
LPLPWTAG

SEQ ID NO: 75750 - protein, 8 aa, Dengue virus
PLPWTAGA

SEQ ID NO: 75751 - protein, 8 aa, Dengue virus
LPWTAGAD

SEQ ID NO: 75752 - protein, 8 aa, Dengue virus
PWTAGADT

SEQ ID NO: 75753 - protein, 8 aa, Dengue virus
WTAGADTS

SEQ ID NO: 75754 - protein, 8 aa, Dengue virus
TAGADTSE

SEQ ID NO: 75755 - protein, 8 aa, Dengue virus
AGADTSEV

SEQ ID NO: 75756 - protein, 8 aa, Dengue virus
GADTSEVH

SEQ ID NO: 75757 - protein, 8 aa, Dengue virus
ADTSEVHW

SEQ ID NO: 75758 - protein, 8 aa, Dengue virus
DTSEVHWN

SEQ ID NO: 75759 - protein, 8 aa, Dengue virus
TSEVHWNY

SEQ ID NO: 75760 - protein, 8 aa, Dengue virus
SEVHWNYK

SEQ ID NO: 75761 - protein, 8 aa, Dengue virus
EVHWNYKE

SEQ ID NO: 75762 - protein, 8 aa, Dengue virus
VHWNYKER

SEQ ID NO: 75763 - protein, 8 aa, Dengue virus
HWNYKERM

SEQ ID NO: 75764 - protein, 8 aa, Dengue virus
WNYKERMV

SEQ ID NO: 75765 - protein, 8 aa, Dengue virus
NYKERMVT

SEQ ID NO: 75766 - protein, 8 aa, Dengue virus
YKERMVTF

SEQ ID NO: 75767 - protein, 8 aa, Dengue virus
KERMVTFK

SEQ ID NO: 75768 - protein, 8 aa, Dengue virus
ERMVTFKV

SEQ ID NO: 75769 - protein, 8 aa, Dengue virus
RMVTFKVP

SEQ ID NO: 75770 - protein, 8 aa, Dengue virus
MVTFKVPH

SEQ ID NO: 75771 - protein, 8 aa, Dengue virus
VTFKVPHA

SEQ ID NO: 75772 - protein, 8 aa, Dengue virus
TFKVPHAK

SEQ ID NO: 75773 - protein, 8 aa, Dengue virus
FKVPHAKR

SEQ ID NO: 75774 - protein, 8 aa, Dengue virus
KVPHAKRQ

SEQ ID NO: 75775 - protein, 8 aa, Dengue virus
VPHAKRQD

SEQ ID NO: 75776 - protein, 8 aa, Dengue virus
PHAKRQDV

SEQ ID NO: 75777 - protein, 8 aa, Dengue virus
HAKRQDVT

SEQ ID NO: 75778 - protein, 8 aa, Dengue virus
AKRQDVTV

SEQ ID NO: 75779 - protein, 8 aa, Dengue virus
KRQDVTVL

SEQ ID NO: 75780 - protein, 8 aa, Dengue virus
RQDVTVLG

SEQ ID NO: 75781 - protein, 8 aa, Dengue virus
QDVTVLGS

SEQ ID NO: 75782 - protein, 8 aa, Dengue virus
DVTVLGSQ

SEQ ID NO: 75783 - protein, 8 aa, Dengue virus
VTVLGSQE

SEQ ID NO: 75784 - protein, 8 aa, Dengue virus
TVLGSQEG

SEQ ID NO: 75785 - protein, 8 aa, Dengue virus
VLGSQEGA

SEQ ID NO: 75786 - protein, 8 aa, Dengue virus
LGSQEGAM

SEQ ID NO: 75787 - protein, 8 aa, Dengue virus
GSQEGAMH

SEQ ID NO: 75788 - protein, 8 aa, Dengue virus
SQEGAMHS

SEQ ID NO: 75789 - protein, 8 aa, Dengue virus
QEGAMHSA

SEQ ID NO: 75790 - protein, 8 aa, Dengue virus
EGAMHSAL

SEQ ID NO: 75791 - protein, 8 aa, Dengue virus
GAMHSALA

SEQ ID NO: 75792 - protein, 8 aa, Dengue virus
AMHSALAG

SEQ ID NO: 75793 - protein, 8 aa, Dengue virus
MHSALAGA

SEQ ID NO: 75794 - protein, 8 aa, Dengue virus
HSALAGAT

SEQ ID NO: 75795 - protein, 8 aa, Dengue virus
SALAGATE

SEQ ID NO: 75796 - protein, 8 aa, Dengue virus
ALAGATEV

SEQ ID NO: 75797 - protein, 8 aa, Dengue virus
LAGATEVD

SEQ ID NO: 75798 - protein, 8 aa, Dengue virus
AGATEVDS

SEQ ID NO: 75799 - protein, 8 aa, Dengue virus
GATEVDSG

SEQ ID NO: 75800 - protein, 8 aa, Dengue virus
ATEVDSGD

SEQ ID NO: 75801 - protein, 8 aa, Dengue virus
TEVDSGDG

SEQ ID NO: 75802 - protein, 8 aa, Dengue virus
EVDSGDGN

SEQ ID NO: 75803 - protein, 8 aa, Dengue virus
VDSGDGNH

SEQ ID NO: 75804 - protein, 8 aa, Dengue virus
DSGDGNHM

SEQ ID NO: 75805 - protein, 8 aa, Dengue virus
SGDGNHMF

SEQ ID NO: 75806 - protein, 8 aa, Dengue virus
GDGNHMFA

SEQ ID NO: 75807 - protein, 8 aa, Dengue virus
DGNHMFAG

SEQ ID NO: 75808 - protein, 8 aa, Dengue virus
GNHMFAGH

SEQ ID NO: 75809 - protein, 8 aa, Dengue virus
NHMFAGHL

SEQ ID NO: 75810 - protein, 8 aa, Dengue virus
HMFAGHLK

SEQ ID NO: 75811 - protein, 8 aa, Dengue virus
MFAGHLKC

SEQ ID NO: 75812 - protein, 8 aa, Dengue virus
FAGHLKCK

SEQ ID NO: 75813 - protein, 8 aa, Dengue virus
AGHLKCKV

SEQ ID NO: 75814 - protein, 8 aa, Dengue virus
GHLKCKVR

SEQ ID NO: 75815 - protein, 8 aa, Dengue virus
HLKCKVRM

SEQ ID NO: 75816 - protein, 8 aa, Dengue virus
LKCKVRME

SEQ ID NO: 75817 - protein, 8 aa, Dengue virus
KCKVRMEK

SEQ ID NO: 75818 - protein, 8 aa, Dengue virus
CKVRMEKL

SEQ ID NO: 75819 - protein, 8 aa, Dengue virus
KVRMEKLR

SEQ ID NO: 75820 - protein, 8 aa, Dengue virus
VRMEKLRI

SEQ ID NO: 75821 - protein, 8 aa, Dengue virus
RMEKLRIK

SEQ ID NO: 75822 - protein, 8 aa, Dengue virus
MEKLRIKG

SEQ ID NO: 75823 - protein, 8 aa, Dengue virus
EKLRIKGM

SEQ ID NO: 75824 - protein, 8 aa, Dengue virus
KLRIKGMS

SEQ ID NO: 75825 - protein, 8 aa, Dengue virus
LRIKGMSY

SEQ ID NO: 75826 - protein, 8 aa, Dengue virus
RIKGMSYT

SEQ ID NO: 75827 - protein, 8 aa, Dengue virus
IKGMSYTM

SEQ ID NO: 75828 - protein, 8 aa, Dengue virus
KGMSYTMC

SEQ ID NO: 75829 - protein, 8 aa, Dengue virus
GMSYTMCS

SEQ ID NO: 75830 - protein, 8 aa, Dengue virus
MSYTMCSG

SEQ ID NO: 75831 - protein, 8 aa, Dengue virus
SYTMCSGK

SEQ ID NO: 75832 - protein, 8 aa, Dengue virus
YTMCSGKF

SEQ ID NO: 75833 - protein, 8 aa, Dengue virus
TMCSGKFS

SEQ ID NO: 75834 - protein, 8 aa, Dengue virus
MCSGKFSI

SEQ ID NO: 75835 - protein, 8 aa, Dengue virus
CSGKFSID

SEQ ID NO: 75836 - protein, 8 aa, Dengue virus
SGKFSIDK

SEQ ID NO: 75837 - protein, 8 aa, Dengue virus
GKFSIDKE

SEQ ID NO: 75838 - protein, 8 aa, Dengue virus
KFSIDKEM

SEQ ID NO: 75839 - protein, 8 aa, Dengue virus
FSIDKEMA

SEQ ID NO: 75840 - protein, 8 aa, Dengue virus
SIDKEMAE

SEQ ID NO: 75841 - protein, 8 aa, Dengue virus
IDKEMAET

SEQ ID NO: 75842 - protein, 8 aa, Dengue virus
DKEMAETQ

SEQ ID NO: 75843 - protein, 8 aa, Dengue virus
KEMAETQH

SEQ ID NO: 75844 - protein, 8 aa, Dengue virus
EMAETQHG

SEQ ID NO: 75845 - protein, 8 aa, Dengue virus
MAETQHGT

SEQ ID NO: 75846 - protein, 8 aa, Dengue virus
AETQHGTT

SEQ ID NO: 75847 - protein, 8 aa, Dengue virus
ETQHGTTV

SEQ ID NO: 75848 - protein, 8 aa, Dengue virus
TQHGTTVV

SEQ ID NO: 75849 - protein, 8 aa, Dengue virus
QHGTTVVK

SEQ ID NO: 75850 - protein, 8 aa, Dengue virus
HGTTVVKV

SEQ ID NO: 75851 - protein, 8 aa, Dengue virus
GTTVVKVK

SEQ ID NO: 75852 - protein, 8 aa, Dengue virus
TTVVKVKY

SEQ ID NO: 75853 - protein, 8 aa, Dengue virus
TVVKVKYE

SEQ ID NO: 75854 - protein, 8 aa, Dengue virus
VVKVKYEG

SEQ ID NO: 75855 - protein, 8 aa, Dengue virus
VKVKYEGA

SEQ ID NO: 75856 - protein, 8 aa, Dengue virus
KVKYEGAG

SEQ ID NO: 75857 - protein, 8 aa, Dengue virus
VKYEGAGA

SEQ ID NO: 75858 - protein, 8 aa, Dengue virus
KYEGAGAP

SEQ ID NO: 75859 - protein, 8 aa, Dengue virus
YEGAGAPC

SEQ ID NO: 75860 - protein, 8 aa, Dengue virus
EGAGAPCK

SEQ ID NO: 75861 - protein, 8 aa, Dengue virus
GAGAPCKV

SEQ ID NO: 75862 - protein, 8 aa, Dengue virus
AGAPCKVP

SEQ ID NO: 75863 - protein, 8 aa, Dengue virus
GAPCKVPI

SEQ ID NO: 75864 - protein, 8 aa, Dengue virus
APCKVPIE

SEQ ID NO: 75865 - protein, 8 aa, Dengue virus
PCKVPIEI

SEQ ID NO: 75866 - protein, 8 aa, Dengue virus
CKVPIEIR

SEQ ID NO: 75867 - protein, 8 aa, Dengue virus
KVPIEIRD

SEQ ID NO: 75868 - protein, 8 aa, Dengue virus
VPIEIRDV

SEQ ID NO: 75869 - protein, 8 aa, Dengue virus
PIEIRDVN

SEQ ID NO: 75870 - protein, 8 aa, Dengue virus
IEIRDVNK

SEQ ID NO: 75871 - protein, 8 aa, Dengue virus
EIRDVNKE

SEQ ID NO: 75872 - protein, 8 aa, Dengue virus
IRDVNKEK

SEQ ID NO: 75873 - protein, 8 aa, Dengue virus
RDVNKEKV

SEQ ID NO: 75874 - protein, 8 aa, Dengue virus
DVNKEKVV

SEQ ID NO: 75875 - protein, 8 aa, Dengue virus
VNKEKVVG

SEQ ID NO: 75876 - protein, 8 aa, Dengue virus
NKEKVVGR

SEQ ID NO: 75877 - protein, 8 aa, Dengue virus
KVVGRVIS

SEQ ID NO: 75878 - protein, 8 aa, Dengue virus
VVGRVISS

SEQ ID NO: 75879 - protein, 8 aa, Dengue virus
GRVISSTP

SEQ ID NO: 75880 - protein, 8 aa, Dengue virus
ISSTPLAE

SEQ ID NO: 75881 - protein, 8 aa, Dengue virus
PLAENTNS

SEQ ID NO: 75882 - protein, 8 aa, Dengue virus
AENTNSVT

SEQ ID NO: 75883 - protein, 8 aa, Dengue virus
ENTNSVTN

SEQ ID NO: 75884 - protein, 8 aa, Dengue virus
NTNSVTNI

SEQ ID NO: 75885 - protein, 8 aa, Dengue virus
TNSVTNIE

SEQ ID NO: 75886 - protein, 8 aa, Dengue virus
NSVTNIEL

SEQ ID NO: 75887 - protein, 8 aa, Dengue virus
SVTNIELE

SEQ ID NO: 75888 - protein, 8 aa, Dengue virus
VTNIELEP

SEQ ID NO: 75889 - protein, 8 aa, Dengue virus
TNIELEPP

SEQ ID NO: 75890 - protein, 8 aa, Dengue virus
NIELEPPF

SEQ ID NO: 75891 - protein, 8 aa, Dengue virus
IELEPPFG

SEQ ID NO: 75892 - protein, 8 aa, Dengue virus
ELEPPFGD

SEQ ID NO: 75893 - protein, 8 aa, Dengue virus
LEPPFGDS

SEQ ID NO: 75894 - protein, 8 aa, Dengue virus
EPPFGDSY

SEQ ID NO: 75895 - protein, 8 aa, Dengue virus
PPFGDSYI

SEQ ID NO: 75896 - protein, 8 aa, Dengue virus
PFGDSYIV

SEQ ID NO: 75897 - protein, 8 aa, Dengue virus
FGDSYIVI

SEQ ID NO: 75898 - protein, 8 aa, Dengue virus
GDSYIVIG

SEQ ID NO: 75899 - protein, 8 aa, Dengue virus
DSYIVIGV

SEQ ID NO: 75900 - protein, 8 aa, Dengue virus
SYIVIGVG

SEQ ID NO: 75901 - protein, 8 aa, Dengue virus
YIVIGVGN

SEQ ID NO: 75902 - protein, 8 aa, Dengue virus
IVIGVGNS

SEQ ID NO: 75903 - protein, 8 aa, Dengue virus
VIGVGNSA

SEQ ID NO: 75904 - protein, 8 aa, Dengue virus
IGVGNSAL

SEQ ID NO: 75905 - protein, 8 aa, Dengue virus
GVGNSALT

SEQ ID NO: 75906 - protein, 8 aa, Dengue virus
VGNSALTL

SEQ ID NO: 75907 - protein, 8 aa, Dengue virus
GNSALTLH

SEQ ID NO: 75908 - protein, 8 aa, Dengue virus
NSALTLHW

SEQ ID NO: 75909 - protein, 8 aa, Dengue virus
SALTLHWF

SEQ ID NO: 75910 - protein, 8 aa, Dengue virus
ALTLHWFR

SEQ ID NO: 75911 - protein, 8 aa, Dengue virus
LTLHWFRK

SEQ ID NO: 75912 - protein, 8 aa, Dengue virus
TLHWFRKG

SEQ ID NO: 75913 - protein, 8 aa, Dengue virus
LHWFRKGS

SEQ ID NO: 75914 - protein, 8 aa, Dengue virus
HWFRKGSS

SEQ ID NO: 75915 - protein, 8 aa, Dengue virus
WFRKGSSI

SEQ ID NO: 75916 - protein, 8 aa, Dengue virus
FRKGSSIG

SEQ ID NO: 75917 - protein, 8 aa, Dengue virus
RKGSSIGK

SEQ ID NO: 75918 - protein, 8 aa, Dengue virus
KGSSIGKM

SEQ ID NO: 75919 - protein, 8 aa, Dengue virus
GSSIGKMF

SEQ ID NO: 75920 - protein, 8 aa, Dengue virus
SSIGKMFE

SEQ ID NO: 75921 - protein, 8 aa, Dengue virus
SIGKMFES

SEQ ID NO: 75922 - protein, 8 aa, Dengue virus
IGKMFEST

SEQ ID NO: 75923 - protein, 8 aa, Dengue virus
GKMFESTY

SEQ ID NO: 75924 - protein, 8 aa, Dengue virus
KMFESTYR

SEQ ID NO: 75925 - protein, 8 aa, Dengue virus
MFESTYRG

SEQ ID NO: 75926 - protein, 8 aa, Dengue virus
FESTYRGA

SEQ ID NO: 75927 - protein, 8 aa, Dengue virus
ESTYRGAK

SEQ ID NO: 75928 - protein, 8 aa, Dengue virus
STYRGAKR

SEQ ID NO: 75929 - protein, 8 aa, Dengue virus
TYRGAKRM

SEQ ID NO: 75930 - protein, 8 aa, Dengue virus
YRGAKRMA

SEQ ID NO: 75931 - protein, 8 aa, Dengue virus
RGAKRMAI

SEQ ID NO: 75932 - protein, 8 aa, Dengue virus
GAKRMAIL

SEQ ID NO: 75933 - protein, 8 aa, Dengue virus
AKRMAILG

SEQ ID NO: 75934 - protein, 8 aa, Dengue virus
KRMAILGE

SEQ ID NO: 75935 - protein, 8 aa, Dengue virus
RMAILGET

SEQ ID NO: 75936 - protein, 8 aa, Dengue virus
MAILGETA

SEQ ID NO: 75937 - protein, 8 aa, Dengue virus
AILGETAW

SEQ ID NO: 75938 - protein, 8 aa, Dengue virus
ILGETAWD

SEQ ID NO: 75939 - protein, 8 aa, Dengue virus
LGETAWDF

SEQ ID NO: 75940 - protein, 8 aa, Dengue virus
GETAWDFG

SEQ ID NO: 75941 - protein, 8 aa, Dengue virus
ETAWDFGS

SEQ ID NO: 75942 - protein, 8 aa, Dengue virus
TAWDFGSV

SEQ ID NO: 75943 - protein, 8 aa, Dengue virus
AWDFGSVG

SEQ ID NO: 75944 - protein, 8 aa, Dengue virus
WDFGSVGG

SEQ ID NO: 75945 - protein, 8 aa, Dengue virus
DFGSVGGL

SEQ ID NO: 75946 - protein, 8 aa, Dengue virus
FGSVGGLF

SEQ ID NO: 75947 - protein, 8 aa, Dengue virus
GSVGGLFT

SEQ ID NO: 75948 - protein, 8 aa, Dengue virus
SVGGLFTS

SEQ ID NO: 75949 - protein, 8 aa, Dengue virus
VGGLFTSL

SEQ ID NO: 75950 - protein, 8 aa, Dengue virus
GGLFTSLG

SEQ ID NO: 75951 - protein, 8 aa, Dengue virus
GLFTSLGK

SEQ ID NO: 75952 - protein, 8 aa, Dengue virus
LFTSLGKA

SEQ ID NO: 75953 - protein, 8 aa, Dengue virus
FTSLGKAV

SEQ ID NO: 75954 - protein, 8 aa, Dengue virus
TSLGKAVH

SEQ ID NO: 75955 - protein, 8 aa, Dengue virus
SLGKAVHQ

SEQ ID NO: 75956 - protein, 8 aa, Dengue virus
LGKAVHQV

SEQ ID NO: 75957 - protein, 8 aa, Dengue virus
GKAVHQVF

SEQ ID NO: 75958 - protein, 8 aa, Dengue virus
KAVHQVFG

SEQ ID NO: 75959 - protein, 8 aa, Dengue virus
AVHQVFGS

SEQ ID NO: 75960 - protein, 8 aa, Dengue virus
VHQVFGSV

SEQ ID NO: 75961 - protein, 8 aa, Dengue virus
HQVFGSVY

SEQ ID NO: 75962 - protein, 8 aa, Dengue virus
QVFGSVYT

SEQ ID NO: 75963 - protein, 8 aa, Dengue virus
VFGSVYTT

SEQ ID NO: 75964 - protein, 8 aa, Dengue virus
FGSVYTTM

SEQ ID NO: 75965 - protein, 8 aa, Dengue virus
GSVYTTMF

SEQ ID NO: 75966 - protein, 8 aa, Dengue virus
SVYTTMFG

SEQ ID NO: 75967 - protein, 8 aa, Dengue virus
VYTTMFGG

SEQ ID NO: 75968 - protein, 8 aa, Dengue virus
YTTMFGGV

SEQ ID NO: 75969 - protein, 8 aa, Dengue virus
TTMFGGVS

SEQ ID NO: 75970 - protein, 8 aa, Dengue virus
TMFGGVSW

SEQ ID NO: 75971 - protein, 8 aa, Dengue virus
MFGGVSWM

SEQ ID NO: 75972 - protein, 8 aa, Dengue virus
FGGVSWMI

SEQ ID NO: 75973 - protein, 8 aa, Dengue virus
GGVSWMIR

SEQ ID NO: 75974 - protein, 8 aa, Dengue virus
GVSWMIRI

SEQ ID NO: 75975 - protein, 8 aa, Dengue virus
VSWMIRIL

SEQ ID NO: 75976 - protein, 8 aa, Dengue virus
SWMIRILI

SEQ ID NO: 75977 - protein, 8 aa, Dengue virus
WMIRILIG

SEQ ID NO: 75978 - protein, 8 aa, Dengue virus
IRILIGFL

SEQ ID NO: 75979 - protein, 8 aa, Dengue virus
RILIGFLV

SEQ ID NO: 75980 - protein, 8 aa, Dengue virus
ILIGFLVL

SEQ ID NO: 75981 - protein, 8 aa, Dengue virus
LIGFLVLW

SEQ ID NO: 75982 - protein, 8 aa, Dengue virus
IGFLVLWI

SEQ ID NO: 75983 - protein, 8 aa, Dengue virus
GFLVLWIG

SEQ ID NO: 75984 - protein, 8 aa, Dengue virus
FLVLWIGT

SEQ ID NO: 75985 - protein, 8 aa, Dengue virus
LVLWIGTN

SEQ ID NO: 75986 - protein, 8 aa, Dengue virus
VLWIGTNS

SEQ ID NO: 75987 - protein, 8 aa, Dengue virus
LWIGTNSR

SEQ ID NO: 75988 - protein, 8 aa, Dengue virus
WIGTNSRN

SEQ ID NO: 75989 - protein, 8 aa, Dengue virus
IGTNSRNT

SEQ ID NO: 75990 - protein, 8 aa, Dengue virus
GTNSRNTS

SEQ ID NO: 75991 - protein, 8 aa, Dengue virus
TNSRNTSM

SEQ ID NO: 75992 - protein, 8 aa, Dengue virus
NSRNTSMA

SEQ ID NO: 75993 - protein, 8 aa, Dengue virus
SRNTSMAM

SEQ ID NO: 75994 - protein, 8 aa, Dengue virus
RNTSMAMT

SEQ ID NO: 75995 - protein, 8 aa, Dengue virus
NTSMAMTC

SEQ ID NO: 75996 - protein, 8 aa, Dengue virus
TSMAMTCI

SEQ ID NO: 75997 - protein, 8 aa, Dengue virus
SMAMTCIA

SEQ ID NO: 75998 - protein, 8 aa, Dengue virus
MAMTCIAV

SEQ ID NO: 75999 - protein, 8 aa, Dengue virus
AMTCIAVG

SEQ ID NO: 76000 - protein, 8 aa, Dengue virus
MTCIAVGG

SEQ ID NO: 76001 - protein, 8 aa, Dengue virus
TCIAVGGI

SEQ ID NO: 76002 - protein, 8 aa, Dengue virus
CIAVGGIT

SEQ ID NO: 76003 - protein, 8 aa, Dengue virus
IAVGGITL

SEQ ID NO: 76004 - protein, 8 aa, Dengue virus
AVGGITLF

SEQ ID NO: 76005 - protein, 8 aa, Dengue virus
VGGITLFL

SEQ ID NO: 76006 - protein, 8 aa, Dengue virus
GGITLFLG

SEQ ID NO: 76007 - protein, 8 aa, Dengue virus
GITLFLGF

SEQ ID NO: 76008 - protein, 8 aa, Dengue virus
ITLFLGFT

SEQ ID NO: 76009 - protein, 8 aa, Dengue virus
TLFLGFTV

SEQ ID NO: 76010 - protein, 8 aa, Dengue virus
LFLGFTVQ

SEQ ID NO: 76011 - protein, 8 aa, Dengue virus
FLGFTVQA

SEQ ID NO: 76012 - protein, 8 aa, Dengue virus
LGFTVQAD

SEQ ID NO: 76013 - protein, 8 aa, Dengue virus
GFTVQADM

SEQ ID NO: 76014 - protein, 8 aa, Dengue virus
FTVQADMG

SEQ ID NO: 76015 - protein, 8 aa, Dengue virus
TVQADMGC

SEQ ID NO: 76016 - protein, 8 aa, Dengue virus
ADMGCVVS

SEQ ID NO: 76017 - protein, 8 aa, Dengue virus
DMGCVVSW

SEQ ID NO: 76018 - protein, 8 aa, Dengue virus
GCVVSWSG

SEQ ID NO: 76019 - protein, 8 aa, Dengue virus
SWSGRELK

SEQ ID NO: 76020 - protein, 8 aa, Dengue virus
WSGRELKC

SEQ ID NO: 76021 - protein, 8 aa, Dengue virus
SGRELKCG

SEQ ID NO: 76022 - protein, 8 aa, Dengue virus
GRELKCGS

SEQ ID NO: 76023 - protein, 8 aa, Dengue virus
RELKCGSG

SEQ ID NO: 76024 - protein, 8 aa, Dengue virus
ELKCGSGI

SEQ ID NO: 76025 - protein, 8 aa, Dengue virus
LKCGSGIF

SEQ ID NO: 76026 - protein, 8 aa, Dengue virus
KCGSGIFV

SEQ ID NO: 76027 - protein, 8 aa, Dengue virus
CGSGIFVV

SEQ ID NO: 76028 - protein, 8 aa, Dengue virus
GSGIFVVD

SEQ ID NO: 76029 - protein, 8 aa, Dengue virus
SGIFVVDN

SEQ ID NO: 76030 - protein, 8 aa, Dengue virus
GIFVVDNV

SEQ ID NO: 76031 - protein, 8 aa, Dengue virus
IFVVDNVH

SEQ ID NO: 76032 - protein, 8 aa, Dengue virus
FVVDNVHT

SEQ ID NO: 76033 - protein, 8 aa, Dengue virus
VVDNVHTW

SEQ ID NO: 76034 - protein, 8 aa, Dengue virus
VDNVHTWT

SEQ ID NO: 76035 - protein, 8 aa, Dengue virus
DNVHTWTE

SEQ ID NO: 76036 - protein, 8 aa, Dengue virus
NVHTWTEQ

SEQ ID NO: 76037 - protein, 8 aa, Dengue virus
VHTWTEQY

SEQ ID NO: 76038 - protein, 8 aa, Dengue virus
HTWTEQYK

SEQ ID NO: 76039 - protein, 8 aa, Dengue virus
TWTEQYKF

SEQ ID NO: 76040 - protein, 8 aa, Dengue virus
WTEQYKFQ

SEQ ID NO: 76041 - protein, 8 aa, Dengue virus
TEQYKFQP

SEQ ID NO: 76042 - protein, 8 aa, Dengue virus
EQYKFQPE

SEQ ID NO: 76043 - protein, 8 aa, Dengue virus
QYKFQPES

SEQ ID NO: 76044 - protein, 8 aa, Dengue virus
YKFQPESP

SEQ ID NO: 76045 - protein, 8 aa, Dengue virus
KFQPESPA

SEQ ID NO: 76046 - protein, 8 aa, Dengue virus
FQPESPAR

SEQ ID NO: 76047 - protein, 8 aa, Dengue virus
QPESPARL

SEQ ID NO: 76048 - protein, 8 aa, Dengue virus
PESPARLA

SEQ ID NO: 76049 - protein, 8 aa, Dengue virus
ESPARLAS

SEQ ID NO: 76050 - protein, 8 aa, Dengue virus
SPARLASA

SEQ ID NO: 76051 - protein, 8 aa, Dengue virus
PARLASAI

SEQ ID NO: 76052 - protein, 8 aa, Dengue virus
ARLASAIL

SEQ ID NO: 76053 - protein, 8 aa, Dengue virus
RLASAILN

SEQ ID NO: 76054 - protein, 8 aa, Dengue virus
LASAILNA

SEQ ID NO: 76055 - protein, 8 aa, Dengue virus
ASAILNAH

SEQ ID NO: 76056 - protein, 8 aa, Dengue virus
SAILNAHK

SEQ ID NO: 76057 - protein, 8 aa, Dengue virus
AILNAHKD

SEQ ID NO: 76058 - protein, 8 aa, Dengue virus
ILNAHKDG

SEQ ID NO: 76059 - protein, 8 aa, Dengue virus
LNAHKDGV

SEQ ID NO: 76060 - protein, 8 aa, Dengue virus
NAHKDGVC

SEQ ID NO: 76061 - protein, 8 aa, Dengue virus
AHKDGVCG

SEQ ID NO: 76062 - protein, 8 aa, Dengue virus
HKDGVCGI

SEQ ID NO: 76063 - protein, 8 aa, Dengue virus
KDGVCGIR

SEQ ID NO: 76064 - protein, 8 aa, Dengue virus
DGVCGIRS

SEQ ID NO: 76065 - protein, 8 aa, Dengue virus
GVCGIRST

SEQ ID NO: 76066 - protein, 8 aa, Dengue virus
VCGIRSTT

SEQ ID NO: 76067 - protein, 8 aa, Dengue virus
CGIRSTTR

SEQ ID NO: 76068 - protein, 8 aa, Dengue virus
GIRSTTRL

SEQ ID NO: 76069 - protein, 8 aa, Dengue virus
IRSTTRLE

SEQ ID NO: 76070 - protein, 8 aa, Dengue virus
RSTTRLEN

SEQ ID NO: 76071 - protein, 8 aa, Dengue virus
STTRLENV

SEQ ID NO: 76072 - protein, 8 aa, Dengue virus
TTRLENVM

SEQ ID NO: 76073 - protein, 8 aa, Dengue virus
TRLENVMW

SEQ ID NO: 76074 - protein, 8 aa, Dengue virus
RLENVMWK

SEQ ID NO: 76075 - protein, 8 aa, Dengue virus
LENVMWKQ

SEQ ID NO: 76076 - protein, 8 aa, Dengue virus
ENVMWKQI

SEQ ID NO: 76077 - protein, 8 aa, Dengue virus
NVMWKQIT

SEQ ID NO: 76078 - protein, 8 aa, Dengue virus
VMWKQITN

SEQ ID NO: 76079 - protein, 8 aa, Dengue virus
MWKQITNE

SEQ ID NO: 76080 - protein, 8 aa, Dengue virus
WKQITNEL

SEQ ID NO: 76081 - protein, 8 aa, Dengue virus
KQITNELN

SEQ ID NO: 76082 - protein, 8 aa, Dengue virus
QITNELNY

SEQ ID NO: 76083 - protein, 8 aa, Dengue virus
ITNELNYV

SEQ ID NO: 76084 - protein, 8 aa, Dengue virus
TNELNYVL

SEQ ID NO: 76085 - protein, 8 aa, Dengue virus
NELNYVLW

SEQ ID NO: 76086 - protein, 8 aa, Dengue virus
ELNYVLWE

SEQ ID NO: 76087 - protein, 8 aa, Dengue virus
LNYVLWEG

SEQ ID NO: 76088 - protein, 8 aa, Dengue virus
NYVLWEGG

SEQ ID NO: 76089 - protein, 8 aa, Dengue virus
YVLWEGGH

SEQ ID NO: 76090 - protein, 8 aa, Dengue virus
VLWEGGHD

SEQ ID NO: 76091 - protein, 8 aa, Dengue virus
LWEGGHDL

SEQ ID NO: 76092 - protein, 8 aa, Dengue virus
WEGGHDLT

SEQ ID NO: 76093 - protein, 8 aa, Dengue virus
EGGHDLTV

SEQ ID NO: 76094 - protein, 8 aa, Dengue virus
GGHDLTVV

SEQ ID NO: 76095 - protein, 8 aa, Dengue virus
GHDLTVVA

SEQ ID NO: 76096 - protein, 8 aa, Dengue virus
HDLTVVAG

SEQ ID NO: 76097 - protein, 8 aa, Dengue virus
DLTVVAGD

SEQ ID NO: 76098 - protein, 8 aa, Dengue virus
LTVVAGDV

SEQ ID NO: 76099 - protein, 8 aa, Dengue virus
TVVAGDVK

SEQ ID NO: 76100 - protein, 8 aa, Dengue virus
VVAGDVKG

SEQ ID NO: 76101 - protein, 8 aa, Dengue virus
VAGDVKGV

SEQ ID NO: 76102 - protein, 8 aa, Dengue virus
AGDVKGVL

SEQ ID NO: 76103 - protein, 8 aa, Dengue virus
GDVKGVLT

SEQ ID NO: 76104 - protein, 8 aa, Dengue virus
DVKGVLTK

SEQ ID NO: 76105 - protein, 8 aa, Dengue virus
VKGVLTKG

SEQ ID NO: 76106 - protein, 8 aa, Dengue virus
KGVLTKGK

SEQ ID NO: 76107 - protein, 8 aa, Dengue virus
GVLTKGKR

SEQ ID NO: 76108 - protein, 8 aa, Dengue virus
VLTKGKRA

SEQ ID NO: 76109 - protein, 8 aa, Dengue virus
LTKGKRAL

SEQ ID NO: 76110 - protein, 8 aa, Dengue virus
TKGKRALT

SEQ ID NO: 76111 - protein, 8 aa, Dengue virus
KGKRALTP

SEQ ID NO: 76112 - protein, 8 aa, Dengue virus
GKRALTPP

SEQ ID NO: 76113 - protein, 8 aa, Dengue virus
KRALTPPV

SEQ ID NO: 76114 - protein, 8 aa, Dengue virus
LTPPVSDL

SEQ ID NO: 76115 - protein, 8 aa, Dengue virus
TPPVSDLK

SEQ ID NO: 76116 - protein, 8 aa, Dengue virus
PPVSDLKY

SEQ ID NO: 76117 - protein, 8 aa, Dengue virus
PVSDLKYS

SEQ ID NO: 76118 - protein, 8 aa, Dengue virus
VSDLKYSW

SEQ ID NO: 76119 - protein, 8 aa, Dengue virus
SDLKYSWK

SEQ ID NO: 76120 - protein, 8 aa, Dengue virus
DLKYSWKT

SEQ ID NO: 76121 - protein, 8 aa, Dengue virus
LKYSWKTW

SEQ ID NO: 76122 - protein, 8 aa, Dengue virus
KYSWKTWG

SEQ ID NO: 76123 - protein, 8 aa, Dengue virus
YSWKTWGK

SEQ ID NO: 76124 - protein, 8 aa, Dengue virus
SWKTWGKA

SEQ ID NO: 76125 - protein, 8 aa, Dengue virus
WKTWGKAK

SEQ ID NO: 76126 - protein, 8 aa, Dengue virus
KTWGKAKI

SEQ ID NO: 76127 - protein, 8 aa, Dengue virus
TWGKAKIF

SEQ ID NO: 76128 - protein, 8 aa, Dengue virus
WGKAKIFT

SEQ ID NO: 76129 - protein, 8 aa, Dengue virus
GKAKIFTP

SEQ ID NO: 76130 - protein, 8 aa, Dengue virus
KAKIFTPE

SEQ ID NO: 76131 - protein, 8 aa, Dengue virus
AKIFTPEA

SEQ ID NO: 76132 - protein, 8 aa, Dengue virus
IFTPEARN

SEQ ID NO: 76133 - protein, 8 aa, Dengue virus
PEARNSTF

SEQ ID NO: 76134 - protein, 8 aa, Dengue virus
EARNSTFL

SEQ ID NO: 76135 - protein, 8 aa, Dengue virus
RNSTFLID

SEQ ID NO: 76136 - protein, 8 aa, Dengue virus
NSTFLIDG

SEQ ID NO: 76137 - protein, 8 aa, Dengue virus
STFLIDGP

SEQ ID NO: 76138 - protein, 8 aa, Dengue virus
TFLIDGPD

SEQ ID NO: 76139 - protein, 8 aa, Dengue virus
FLIDGPDT

SEQ ID NO: 76140 - protein, 8 aa, Dengue virus
LIDGPDTS

SEQ ID NO: 76141 - protein, 8 aa, Dengue virus
IDGPDTSE

SEQ ID NO: 76142 - protein, 8 aa, Dengue virus
DGPDTSEC

SEQ ID NO: 76143 - protein, 8 aa, Dengue virus
GPDTSECP

SEQ ID NO: 76144 - protein, 8 aa, Dengue virus
PDTSECPN

SEQ ID NO: 76145 - protein, 8 aa, Dengue virus
DTSECPNE

SEQ ID NO: 76146 - protein, 8 aa, Dengue virus
TSECPNER

SEQ ID NO: 76147 - protein, 8 aa, Dengue virus
SECPNERR

SEQ ID NO: 76148 - protein, 8 aa, Dengue virus
ECPNERRA

SEQ ID NO: 76149 - protein, 8 aa, Dengue virus
CPNERRAW

SEQ ID NO: 76150 - protein, 8 aa, Dengue virus
PNERRAWN

SEQ ID NO: 76151 - protein, 8 aa, Dengue virus
NERRAWNS

SEQ ID NO: 76152 - protein, 8 aa, Dengue virus
ERRAWNSL

SEQ ID NO: 76153 - protein, 8 aa, Dengue virus
RRAWNSLE

SEQ ID NO: 76154 - protein, 8 aa, Dengue virus
RAWNSLEV

SEQ ID NO: 76155 - protein, 8 aa, Dengue virus
AWNSLEVE

SEQ ID NO: 76156 - protein, 8 aa, Dengue virus
WNSLEVED

SEQ ID NO: 76157 - protein, 8 aa, Dengue virus
NSLEVEDY

SEQ ID NO: 76158 - protein, 8 aa, Dengue virus
SLEVEDYG

SEQ ID NO: 76159 - protein, 8 aa, Dengue virus
LEVEDYGF

SEQ ID NO: 76160 - protein, 8 aa, Dengue virus
EVEDYGFG

SEQ ID NO: 76161 - protein, 8 aa, Dengue virus
VEDYGFGM

SEQ ID NO: 76162 - protein, 8 aa, Dengue virus
EDYGFGMF

SEQ ID NO: 76163 - protein, 8 aa, Dengue virus
DYGFGMFT

SEQ ID NO: 76164 - protein, 8 aa, Dengue virus
YGFGMFTT

SEQ ID NO: 76165 - protein, 8 aa, Dengue virus
GFGMFTTN

SEQ ID NO: 76166 - protein, 8 aa, Dengue virus
FGMFTTNI

SEQ ID NO: 76167 - protein, 8 aa, Dengue virus
GMFTTNIW

SEQ ID NO: 76168 - protein, 8 aa, Dengue virus
MFTTNIWM

SEQ ID NO: 76169 - protein, 8 aa, Dengue virus
FTTNIWMK

SEQ ID NO: 76170 - protein, 8 aa, Dengue virus
TTNIWMKF

SEQ ID NO: 76171 - protein, 8 aa, Dengue virus
TNIWMKFR

SEQ ID NO: 76172 - protein, 8 aa, Dengue virus
NIWMKFRE

SEQ ID NO: 76173 - protein, 8 aa, Dengue virus
IWMKFREG

SEQ ID NO: 76174 - protein, 8 aa, Dengue virus
WMKFREGS

SEQ ID NO: 76175 - protein, 8 aa, Dengue virus
MKFREGSS

SEQ ID NO: 76176 - protein, 8 aa, Dengue virus
KFREGSSE

SEQ ID NO: 76177 - protein, 8 aa, Dengue virus
FREGSSEV

SEQ ID NO: 76178 - protein, 8 aa, Dengue virus
REGSSEVC

SEQ ID NO: 76179 - protein, 8 aa, Dengue virus
EGSSEVCD

SEQ ID NO: 76180 - protein, 8 aa, Dengue virus
GSSEVCDH

SEQ ID NO: 76181 - protein, 8 aa, Dengue virus
SSEVCDHR

SEQ ID NO: 76182 - protein, 8 aa, Dengue virus
SEVCDHRL

SEQ ID NO: 76183 - protein, 8 aa, Dengue virus
EVCDHRLM

SEQ ID NO: 76184 - protein, 8 aa, Dengue virus
VCDHRLMS

SEQ ID NO: 76185 - protein, 8 aa, Dengue virus
CDHRLMSA

SEQ ID NO: 76186 - protein, 8 aa, Dengue virus
DHRLMSAA

SEQ ID NO: 76187 - protein, 8 aa, Dengue virus
HRLMSAAI

SEQ ID NO: 76188 - protein, 8 aa, Dengue virus
RLMSAAIK

SEQ ID NO: 76189 - protein, 8 aa, Dengue virus
LMSAAIKD

SEQ ID NO: 76190 - protein, 8 aa, Dengue virus
MSAAIKDQ

SEQ ID NO: 76191 - protein, 8 aa, Dengue virus
SAAIKDQK

SEQ ID NO: 76192 - protein, 8 aa, Dengue virus
AAIKDQKA

SEQ ID NO: 76193 - protein, 8 aa, Dengue virus
AIKDQKAV

SEQ ID NO: 76194 - protein, 8 aa, Dengue virus
IKDQKAVH

SEQ ID NO: 76195 - protein, 8 aa, Dengue virus
KDQKAVHA

SEQ ID NO: 76196 - protein, 8 aa, Dengue virus
DQKAVHAD

SEQ ID NO: 76197 - protein, 8 aa, Dengue virus
QKAVHADM

SEQ ID NO: 76198 - protein, 8 aa, Dengue virus
KAVHADMG

SEQ ID NO: 76199 - protein, 8 aa, Dengue virus
AVHADMGY

SEQ ID NO: 76200 - protein, 8 aa, Dengue virus
VHADMGYW

SEQ ID NO: 76201 - protein, 8 aa, Dengue virus
HADMGYWI

SEQ ID NO: 76202 - protein, 8 aa, Dengue virus
ADMGYWIE

SEQ ID NO: 76203 - protein, 8 aa, Dengue virus
DMGYWIES

SEQ ID NO: 76204 - protein, 8 aa, Dengue virus
MGYWIESS

SEQ ID NO: 76205 - protein, 8 aa, Dengue virus
GYWIESSK

SEQ ID NO: 76206 - protein, 8 aa, Dengue virus
YWIESSKN

SEQ ID NO: 76207 - protein, 8 aa, Dengue virus
WIESSKNQ

SEQ ID NO: 76208 - protein, 8 aa, Dengue virus
IESSKNQT

SEQ ID NO: 76209 - protein, 8 aa, Dengue virus
ESSKNQTW

SEQ ID NO: 76210 - protein, 8 aa, Dengue virus
SSKNQTWQ

SEQ ID NO: 76211 - protein, 8 aa, Dengue virus
SKNQTWQI

SEQ ID NO: 76212 - protein, 8 aa, Dengue virus
KNQTWQIE

SEQ ID NO: 76213 - protein, 8 aa, Dengue virus
NQTWQIEK

SEQ ID NO: 76214 - protein, 8 aa, Dengue virus
QTWQIEKA

SEQ ID NO: 76215 - protein, 8 aa, Dengue virus
TWQIEKAS

SEQ ID NO: 76216 - protein, 8 aa, Dengue virus
WQIEKASL

SEQ ID NO: 76217 - protein, 8 aa, Dengue virus
QIEKASLI

SEQ ID NO: 76218 - protein, 8 aa, Dengue virus
IEKASLIE

SEQ ID NO: 76219 - protein, 8 aa, Dengue virus
EKASLIEV

SEQ ID NO: 76220 - protein, 8 aa, Dengue virus
KASLIEVK

SEQ ID NO: 76221 - protein, 8 aa, Dengue virus
ASLIEVKT

SEQ ID NO: 76222 - protein, 8 aa, Dengue virus
SLIEVKTC

SEQ ID NO: 76223 - protein, 8 aa, Dengue virus
LIEVKTCL

SEQ ID NO: 76224 - protein, 8 aa, Dengue virus
IEVKTCLW

SEQ ID NO: 76225 - protein, 8 aa, Dengue virus
EVKTCLWP

SEQ ID NO: 76226 - protein, 8 aa, Dengue virus
VKTCLWPK

SEQ ID NO: 76227 - protein, 8 aa, Dengue virus
KTCLWPKT

SEQ ID NO: 76228 - protein, 8 aa, Dengue virus
TCLWPKTH

SEQ ID NO: 76229 - protein, 8 aa, Dengue virus
CLWPKTHT

SEQ ID NO: 76230 - protein, 8 aa, Dengue virus
LWPKTHTL

SEQ ID NO: 76231 - protein, 8 aa, Dengue virus
WPKTHTLW

SEQ ID NO: 76232 - protein, 8 aa, Dengue virus
PKTHTLWS

SEQ ID NO: 76233 - protein, 8 aa, Dengue virus
KTHTLWSN

SEQ ID NO: 76234 - protein, 8 aa, Dengue virus
THTLWSNG

SEQ ID NO: 76235 - protein, 8 aa, Dengue virus
HTLWSNGV

SEQ ID NO: 76236 - protein, 8 aa, Dengue virus
TLWSNGVL

SEQ ID NO: 76237 - protein, 8 aa, Dengue virus
LWSNGVLE

SEQ ID NO: 76238 - protein, 8 aa, Dengue virus
WSNGVLES

SEQ ID NO: 76239 - protein, 8 aa, Dengue virus
SNGVLESQ

SEQ ID NO: 76240 - protein, 8 aa, Dengue virus
NGVLESQM

SEQ ID NO: 76241 - protein, 8 aa, Dengue virus
GVLESQML

SEQ ID NO: 76242 - protein, 8 aa, Dengue virus
VLESQMLI

SEQ ID NO: 76243 - protein, 8 aa, Dengue virus
LESQMLIP

SEQ ID NO: 76244 - protein, 8 aa, Dengue virus
ESQMLIPK

SEQ ID NO: 76245 - protein, 8 aa, Dengue virus
SQMLIPKS

SEQ ID NO: 76246 - protein, 8 aa, Dengue virus
QMLIPKSY

SEQ ID NO: 76247 - protein, 8 aa, Dengue virus
MLIPKSYA

SEQ ID NO: 76248 - protein, 8 aa, Dengue virus
LIPKSYAG

SEQ ID NO: 76249 - protein, 8 aa, Dengue virus
IPKSYAGP

SEQ ID NO: 76250 - protein, 8 aa, Dengue virus
PKSYAGPF

SEQ ID NO: 76251 - protein, 8 aa, Dengue virus
KSYAGPFS

SEQ ID NO: 76252 - protein, 8 aa, Dengue virus
SYAGPFSQ

SEQ ID NO: 76253 - protein, 8 aa, Dengue virus
YAGPFSQH

SEQ ID NO: 76254 - protein, 8 aa, Dengue virus
AGPFSQHN

SEQ ID NO: 76255 - protein, 8 aa, Dengue virus
GPFSQHNY

SEQ ID NO: 76256 - protein, 8 aa, Dengue virus
PFSQHNYR

SEQ ID NO: 76257 - protein, 8 aa, Dengue virus
FSQHNYRQ

SEQ ID NO: 76258 - protein, 8 aa, Dengue virus
SQHNYRQG

SEQ ID NO: 76259 - protein, 8 aa, Dengue virus
QHNYRQGY

SEQ ID NO: 76260 - protein, 8 aa, Dengue virus
HNYRQGYA

SEQ ID NO: 76261 - protein, 8 aa, Dengue virus
NYRQGYAT

SEQ ID NO: 76262 - protein, 8 aa, Dengue virus
YRQGYATQ

SEQ ID NO: 76263 - protein, 8 aa, Dengue virus
RQGYATQT

SEQ ID NO: 76264 - protein, 8 aa, Dengue virus
QGYATQTV

SEQ ID NO: 76265 - protein, 8 aa, Dengue virus
GYATQTVG

SEQ ID NO: 76266 - protein, 8 aa, Dengue virus
YATQTVGP

SEQ ID NO: 76267 - protein, 8 aa, Dengue virus
ATQTVGPW

SEQ ID NO: 76268 - protein, 8 aa, Dengue virus
TQTVGPWH

SEQ ID NO: 76269 - protein, 8 aa, Dengue virus
QTVGPWHL

SEQ ID NO: 76270 - protein, 8 aa, Dengue virus
TVGPWHLG

SEQ ID NO: 76271 - protein, 8 aa, Dengue virus
VGPWHLGK

SEQ ID NO: 76272 - protein, 8 aa, Dengue virus
GPWHLGKL

SEQ ID NO: 76273 - protein, 8 aa, Dengue virus
PWHLGKLE

SEQ ID NO: 76274 - protein, 8 aa, Dengue virus
WHLGKLEI

SEQ ID NO: 76275 - protein, 8 aa, Dengue virus
HLGKLEID

SEQ ID NO: 76276 - protein, 8 aa, Dengue virus
LGKLEIDF

SEQ ID NO: 76277 - protein, 8 aa, Dengue virus
GKLEIDFG

SEQ ID NO: 76278 - protein, 8 aa, Dengue virus
KLEIDFGE

SEQ ID NO: 76279 - protein, 8 aa, Dengue virus
LEIDFGEC

SEQ ID NO: 76280 - protein, 8 aa, Dengue virus
EIDFGECP

SEQ ID NO: 76281 - protein, 8 aa, Dengue virus
IDFGECPG

SEQ ID NO: 76282 - protein, 8 aa, Dengue virus
DFGECPGT

SEQ ID NO: 76283 - protein, 8 aa, Dengue virus
FGECPGTT

SEQ ID NO: 76284 - protein, 8 aa, Dengue virus
GECPGTTV

SEQ ID NO: 76285 - protein, 8 aa, Dengue virus
ECPGTTVT

SEQ ID NO: 76286 - protein, 8 aa, Dengue virus
CPGTTVTI

SEQ ID NO: 76287 - protein, 8 aa, Dengue virus
PGTTVTIQ

SEQ ID NO: 76288 - protein, 8 aa, Dengue virus
GTTVTIQE

SEQ ID NO: 76289 - protein, 8 aa, Dengue virus
TTVTIQED

SEQ ID NO: 76290 - protein, 8 aa, Dengue virus
TVTIQEDC

SEQ ID NO: 76291 - protein, 8 aa, Dengue virus
QEDCDHRG

SEQ ID NO: 76292 - protein, 8 aa, Dengue virus
EDCDHRGP

SEQ ID NO: 76293 - protein, 8 aa, Dengue virus
DCDHRGPS

SEQ ID NO: 76294 - protein, 8 aa, Dengue virus
CDHRGPSL

SEQ ID NO: 76295 - protein, 8 aa, Dengue virus
DHRGPSLR

SEQ ID NO: 76296 - protein, 8 aa, Dengue virus
HRGPSLRT

SEQ ID NO: 76297 - protein, 8 aa, Dengue virus
RGPSLRTT

SEQ ID NO: 76298 - protein, 8 aa, Dengue virus
GPSLRTTT

SEQ ID NO: 76299 - protein, 8 aa, Dengue virus
PSLRTTTA

SEQ ID NO: 76300 - protein, 8 aa, Dengue virus
SLRTTTAS

SEQ ID NO: 76301 - protein, 8 aa, Dengue virus
LRTTTASG

SEQ ID NO: 76302 - protein, 8 aa, Dengue virus
RTTTASGK

SEQ ID NO: 76303 - protein, 8 aa, Dengue virus
TTTASGKL

SEQ ID NO: 76304 - protein, 8 aa, Dengue virus
TTASGKLV

SEQ ID NO: 76305 - protein, 8 aa, Dengue virus
TASGKLVT

SEQ ID NO: 76306 - protein, 8 aa, Dengue virus
ASGKLVTQ

SEQ ID NO: 76307 - protein, 8 aa, Dengue virus
SGKLVTQW

SEQ ID NO: 76308 - protein, 8 aa, Dengue virus
GKLVTQWC

SEQ ID NO: 76309 - protein, 8 aa, Dengue virus
KLVTQWCC

SEQ ID NO: 76310 - protein, 8 aa, Dengue virus
LVTQWCCR

SEQ ID NO: 76311 - protein, 8 aa, Dengue virus
VTQWCCRS

SEQ ID NO: 76312 - protein, 8 aa, Dengue virus
TQWCCRSC

SEQ ID NO: 76313 - protein, 8 aa, Dengue virus
QWCCRSCT

SEQ ID NO: 76314 - protein, 8 aa, Dengue virus
WCCRSCTM

SEQ ID NO: 76315 - protein, 8 aa, Dengue virus
CCRSCTMP

SEQ ID NO: 76316 - protein, 8 aa, Dengue virus
CRSCTMPP

SEQ ID NO: 76317 - protein, 8 aa, Dengue virus
RSCTMPPL

SEQ ID NO: 76318 - protein, 8 aa, Dengue virus
SCTMPPLR

SEQ ID NO: 76319 - protein, 8 aa, Dengue virus
CTMPPLRF

SEQ ID NO: 76320 - protein, 8 aa, Dengue virus
TMPPLRFL

SEQ ID NO: 76321 - protein, 8 aa, Dengue virus
MPPLRFLG

SEQ ID NO: 76322 - protein, 8 aa, Dengue virus
PPLRFLGE

SEQ ID NO: 76323 - protein, 8 aa, Dengue virus
PLRFLGED

SEQ ID NO: 76324 - protein, 8 aa, Dengue virus
LRFLGEDG

SEQ ID NO: 76325 - protein, 8 aa, Dengue virus
RFLGEDGC

SEQ ID NO: 76326 - protein, 8 aa, Dengue virus
FLGEDGCW

SEQ ID NO: 76327 - protein, 8 aa, Dengue virus
LGEDGCWY

SEQ ID NO: 76328 - protein, 8 aa, Dengue virus
GEDGCWYG

SEQ ID NO: 76329 - protein, 8 aa, Dengue virus
EDGCWYGM

SEQ ID NO: 76330 - protein, 8 aa, Dengue virus
DGCWYGME

SEQ ID NO: 76331 - protein, 8 aa, Dengue virus
GCWYGMEI

SEQ ID NO: 76332 - protein, 8 aa, Dengue virus
CWYGMEIR

SEQ ID NO: 76333 - protein, 8 aa, Dengue virus
WYGMEIRP

SEQ ID NO: 76334 - protein, 8 aa, Dengue virus
YGMEIRPL

SEQ ID NO: 76335 - protein, 8 aa, Dengue virus
GMEIRPLS

SEQ ID NO: 76336 - protein, 8 aa, Dengue virus
MEIRPLSE

SEQ ID NO: 76337 - protein, 8 aa, Dengue virus
EIRPLSEK

SEQ ID NO: 76338 - protein, 8 aa, Dengue virus
IRPLSEKE

SEQ ID NO: 76339 - protein, 8 aa, Dengue virus
RPLSEKEE

SEQ ID NO: 76340 - protein, 8 aa, Dengue virus
PLSEKEEN

SEQ ID NO: 76341 - protein, 8 aa, Dengue virus
LSEKEENM

SEQ ID NO: 76342 - protein, 8 aa, Dengue virus
SEKEENMV

SEQ ID NO: 76343 - protein, 8 aa, Dengue virus
EKEENMVK

SEQ ID NO: 76344 - protein, 8 aa, Dengue virus
KEENMVKS

SEQ ID NO: 76345 - protein, 8 aa, Dengue virus
EENMVKSQ

SEQ ID NO: 76346 - protein, 8 aa, Dengue virus
ENMVKSQV

SEQ ID NO: 76347 - protein, 8 aa, Dengue virus
NMVKSQVT

SEQ ID NO: 76348 - protein, 8 aa, Dengue virus
MVKSQVTA

SEQ ID NO: 76349 - protein, 8 aa, Dengue virus
VKSQVTAG

SEQ ID NO: 76350 - protein, 8 aa, Dengue virus
AGQGTSET

SEQ ID NO: 76351 - protein, 8 aa, Dengue virus
GQGTSETF

SEQ ID NO: 76352 - protein, 8 aa, Dengue virus
GTSETFSM

SEQ ID NO: 76353 - protein, 8 aa, Dengue virus
TSETFSMG

SEQ ID NO: 76354 - protein, 8 aa, Dengue virus
SETFSMGL

SEQ ID NO: 76355 - protein, 8 aa, Dengue virus
ETFSMGLL

SEQ ID NO: 76356 - protein, 8 aa, Dengue virus
TFSMGLLC

SEQ ID NO: 76357 - protein, 8 aa, Dengue virus
FSMGLLCL

SEQ ID NO: 76358 - protein, 8 aa, Dengue virus
SMGLLCLT

SEQ ID NO: 76359 - protein, 8 aa, Dengue virus
MGLLCLTL

SEQ ID NO: 76360 - protein, 8 aa, Dengue virus
GLLCLTLF

SEQ ID NO: 76361 - protein, 8 aa, Dengue virus
LLCLTLFV

SEQ ID NO: 76362 - protein, 8 aa, Dengue virus
LCLTLFVE

SEQ ID NO: 76363 - protein, 8 aa, Dengue virus
CLTLFVEE

SEQ ID NO: 76364 - protein, 8 aa, Dengue virus
LTLFVEEC

SEQ ID NO: 76365 - protein, 8 aa, Dengue virus
TLFVEECL

SEQ ID NO: 76366 - protein, 8 aa, Dengue virus
LFVEECLR

SEQ ID NO: 76367 - protein, 8 aa, Dengue virus
FVEECLRR

SEQ ID NO: 76368 - protein, 8 aa, Dengue virus
VEECLRRR

SEQ ID NO: 76369 - protein, 8 aa, Dengue virus
EECLRRRV

SEQ ID NO: 76370 - protein, 8 aa, Dengue virus
ECLRRRVT

SEQ ID NO: 76371 - protein, 8 aa, Dengue virus
CLRRRVTR

SEQ ID NO: 76372 - protein, 8 aa, Dengue virus
LRRRVTRK

SEQ ID NO: 76373 - protein, 8 aa, Dengue virus
RRRVTRKH

SEQ ID NO: 76374 - protein, 8 aa, Dengue virus
RRVTRKHM

SEQ ID NO: 76375 - protein, 8 aa, Dengue virus
RVTRKHMI

SEQ ID NO: 76376 - protein, 8 aa, Dengue virus
VTRKHMIL

SEQ ID NO: 76377 - protein, 8 aa, Dengue virus
TRKHMILA

SEQ ID NO: 76378 - protein, 8 aa, Dengue virus
RKHMILAV

SEQ ID NO: 76379 - protein, 8 aa, Dengue virus
KHMILAVV

SEQ ID NO: 76380 - protein, 8 aa, Dengue virus
HMILAVVI

SEQ ID NO: 76381 - protein, 8 aa, Dengue virus
MILAVVIT

SEQ ID NO: 76382 - protein, 8 aa, Dengue virus
ITLCAIIL

SEQ ID NO: 76383 - protein, 8 aa, Dengue virus
TLCAIILG

SEQ ID NO: 76384 - protein, 8 aa, Dengue virus
LCAIILGG

SEQ ID NO: 76385 - protein, 8 aa, Dengue virus
CAIILGGL

SEQ ID NO: 76386 - protein, 8 aa, Dengue virus
AIILGGLT

SEQ ID NO: 76387 - protein, 8 aa, Dengue virus
IILGGLTW

SEQ ID NO: 76388 - protein, 8 aa, Dengue virus
ILGGLTWM

SEQ ID NO: 76389 - protein, 8 aa, Dengue virus
LGGLTWMD

SEQ ID NO: 76390 - protein, 8 aa, Dengue virus
GGLTWMDL

SEQ ID NO: 76391 - protein, 8 aa, Dengue virus
GLTWMDLL

SEQ ID NO: 76392 - protein, 8 aa, Dengue virus
LTWMDLLR

SEQ ID NO: 76393 - protein, 8 aa, Dengue virus
TWMDLLRA

SEQ ID NO: 76394 - protein, 8 aa, Dengue virus
WMDLLRAL

SEQ ID NO: 76395 - protein, 8 aa, Dengue virus
MDLLRALI

SEQ ID NO: 76396 - protein, 8 aa, Dengue virus
DLLRALIM

SEQ ID NO: 76397 - protein, 8 aa, Dengue virus
LLRALIML

SEQ ID NO: 76398 - protein, 8 aa, Dengue virus
LRALIMLG

SEQ ID NO: 76399 - protein, 8 aa, Dengue virus
RALIMLGD

SEQ ID NO: 76400 - protein, 8 aa, Dengue virus
ALIMLGDT

SEQ ID NO: 76401 - protein, 8 aa, Dengue virus
LIMLGDTM

SEQ ID NO: 76402 - protein, 8 aa, Dengue virus
IMLGDTMS

SEQ ID NO: 76403 - protein, 8 aa, Dengue virus
MLGDTMSG

SEQ ID NO: 76404 - protein, 8 aa, Dengue virus
LGDTMSGR

SEQ ID NO: 76405 - protein, 8 aa, Dengue virus
GDTMSGRI

SEQ ID NO: 76406 - protein, 8 aa, Dengue virus
DTMSGRIG

SEQ ID NO: 76407 - protein, 8 aa, Dengue virus
TMSGRIGG

SEQ ID NO: 76408 - protein, 8 aa, Dengue virus
MSGRIGGQ

SEQ ID NO: 76409 - protein, 8 aa, Dengue virus
RIGGQTHL

SEQ ID NO: 76410 - protein, 8 aa, Dengue virus
IGGQTHLA

SEQ ID NO: 76411 - protein, 8 aa, Dengue virus
GGQTHLAI

SEQ ID NO: 76412 - protein, 8 aa, Dengue virus
GQTHLAIM

SEQ ID NO: 76413 - protein, 8 aa, Dengue virus
QTHLAIMA

SEQ ID NO: 76414 - protein, 8 aa, Dengue virus
THLAIMAV

SEQ ID NO: 76415 - protein, 8 aa, Dengue virus
HLAIMAVF

SEQ ID NO: 76416 - protein, 8 aa, Dengue virus
LAIMAVFK

SEQ ID NO: 76417 - protein, 8 aa, Dengue virus
AIMAVFKM

SEQ ID NO: 76418 - protein, 8 aa, Dengue virus
IMAVFKMS

SEQ ID NO: 76419 - protein, 8 aa, Dengue virus
MAVFKMSP

SEQ ID NO: 76420 - protein, 8 aa, Dengue virus
AVFKMSPG

SEQ ID NO: 76421 - protein, 8 aa, Dengue virus
VFKMSPGY

SEQ ID NO: 76422 - protein, 8 aa, Dengue virus
FKMSPGYV

SEQ ID NO: 76423 - protein, 8 aa, Dengue virus
KMSPGYVL

SEQ ID NO: 76424 - protein, 8 aa, Dengue virus
MSPGYVLG

SEQ ID NO: 76425 - protein, 8 aa, Dengue virus
SPGYVLGV

SEQ ID NO: 76426 - protein, 8 aa, Dengue virus
PGYVLGVF

SEQ ID NO: 76427 - protein, 8 aa, Dengue virus
GYVLGVFL

SEQ ID NO: 76428 - protein, 8 aa, Dengue virus
YVLGVFLR

SEQ ID NO: 76429 - protein, 8 aa, Dengue virus
VLGVFLRK

SEQ ID NO: 76430 - protein, 8 aa, Dengue virus
LGVFLRKL

SEQ ID NO: 76431 - protein, 8 aa, Dengue virus
GVFLRKLT

SEQ ID NO: 76432 - protein, 8 aa, Dengue virus
VFLRKLTS

SEQ ID NO: 76433 - protein, 8 aa, Dengue virus
FLRKLTSR

SEQ ID NO: 76434 - protein, 8 aa, Dengue virus
LRKLTSRE

SEQ ID NO: 76435 - protein, 8 aa, Dengue virus
RKLTSRET

SEQ ID NO: 76436 - protein, 8 aa, Dengue virus
KLTSRETA

SEQ ID NO: 76437 - protein, 8 aa, Dengue virus
LTSRETAL

SEQ ID NO: 76438 - protein, 8 aa, Dengue virus
TSRETALM

SEQ ID NO: 76439 - protein, 8 aa, Dengue virus
SRETALMV

SEQ ID NO: 76440 - protein, 8 aa, Dengue virus
RETALMVI

SEQ ID NO: 76441 - protein, 8 aa, Dengue virus
ETALMVIG

SEQ ID NO: 76442 - protein, 8 aa, Dengue virus
TALMVIGM

SEQ ID NO: 76443 - protein, 8 aa, Dengue virus
ALMVIGMA

SEQ ID NO: 76444 - protein, 8 aa, Dengue virus
LMVIGMAM

SEQ ID NO: 76445 - protein, 8 aa, Dengue virus
MVIGMAMT

SEQ ID NO: 76446 - protein, 8 aa, Dengue virus
VIGMAMTT

SEQ ID NO: 76447 - protein, 8 aa, Dengue virus
IGMAMTTT

SEQ ID NO: 76448 - protein, 8 aa, Dengue virus
GMAMTTTL

SEQ ID NO: 76449 - protein, 8 aa, Dengue virus
MAMTTTLS

SEQ ID NO: 76450 - protein, 8 aa, Dengue virus
AMTTTLSI

SEQ ID NO: 76451 - protein, 8 aa, Dengue virus
MTTTLSIP

SEQ ID NO: 76452 - protein, 8 aa, Dengue virus
TTTLSIPH

SEQ ID NO: 76453 - protein, 8 aa, Dengue virus
TTLSIPHD

SEQ ID NO: 76454 - protein, 8 aa, Dengue virus
TLSIPHDL

SEQ ID NO: 76455 - protein, 8 aa, Dengue virus
LSIPHDLM

SEQ ID NO: 76456 - protein, 8 aa, Dengue virus
SIPHDLME

SEQ ID NO: 76457 - protein, 8 aa, Dengue virus
IPHDLMEL

SEQ ID NO: 76458 - protein, 8 aa, Dengue virus
PHDLMELI

SEQ ID NO: 76459 - protein, 8 aa, Dengue virus
HDLMELID

SEQ ID NO: 76460 - protein, 8 aa, Dengue virus
DLMELIDG

SEQ ID NO: 76461 - protein, 8 aa, Dengue virus
LMELIDGI

SEQ ID NO: 76462 - protein, 8 aa, Dengue virus
MELIDGIS

SEQ ID NO: 76463 - protein, 8 aa, Dengue virus
ELIDGISL

SEQ ID NO: 76464 - protein, 8 aa, Dengue virus
LIDGISLG

SEQ ID NO: 76465 - protein, 8 aa, Dengue virus
IDGISLGL

SEQ ID NO: 76466 - protein, 8 aa, Dengue virus
DGISLGLI

SEQ ID NO: 76467 - protein, 8 aa, Dengue virus
GISLGLIL

SEQ ID NO: 76468 - protein, 8 aa, Dengue virus
ISLGLILL

SEQ ID NO: 76469 - protein, 8 aa, Dengue virus
SLGLILLK

SEQ ID NO: 76470 - protein, 8 aa, Dengue virus
LGLILLKI

SEQ ID NO: 76471 - protein, 8 aa, Dengue virus
GLILLKIV

SEQ ID NO: 76472 - protein, 8 aa, Dengue virus
LILLKIVT

SEQ ID NO: 76473 - protein, 8 aa, Dengue virus
ILLKIVTQ

SEQ ID NO: 76474 - protein, 8 aa, Dengue virus
LLKIVTQF

SEQ ID NO: 76475 - protein, 8 aa, Dengue virus
LKIVTQFD

SEQ ID NO: 76476 - protein, 8 aa, Dengue virus
VTQFDNTQ

SEQ ID NO: 76477 - protein, 8 aa, Dengue virus
TQFDNTQV

SEQ ID NO: 76478 - protein, 8 aa, Dengue virus
QFDNTQVG

SEQ ID NO: 76479 - protein, 8 aa, Dengue virus
FDNTQVGT

SEQ ID NO: 76480 - protein, 8 aa, Dengue virus
DNTQVGTL

SEQ ID NO: 76481 - protein, 8 aa, Dengue virus
NTQVGTLA

SEQ ID NO: 76482 - protein, 8 aa, Dengue virus
TQVGTLAL

SEQ ID NO: 76483 - protein, 8 aa, Dengue virus
QVGTLALS

SEQ ID NO: 76484 - protein, 8 aa, Dengue virus
VGTLALSL

SEQ ID NO: 76485 - protein, 8 aa, Dengue virus
GTLALSLT

SEQ ID NO: 76486 - protein, 8 aa, Dengue virus
TLALSLTF

SEQ ID NO: 76487 - protein, 8 aa, Dengue virus
LALSLTFI

SEQ ID NO: 76488 - protein, 8 aa, Dengue virus
ALSLTFIR

SEQ ID NO: 76489 - protein, 8 aa, Dengue virus
LSLTFIRS

SEQ ID NO: 76490 - protein, 8 aa, Dengue virus
SLTFIRST

SEQ ID NO: 76491 - protein, 8 aa, Dengue virus
LTFIRSTM

SEQ ID NO: 76492 - protein, 8 aa, Dengue virus
SLVMAWRT

SEQ ID NO: 76493 - protein, 8 aa, Dengue virus
LVMAWRTI

SEQ ID NO: 76494 - protein, 8 aa, Dengue virus
VMAWRTIM

SEQ ID NO: 76495 - protein, 8 aa, Dengue virus
MAWRTIMA

SEQ ID NO: 76496 - protein, 8 aa, Dengue virus
AWRTIMAV

SEQ ID NO: 76497 - protein, 8 aa, Dengue virus
WRTIMAVL

SEQ ID NO: 76498 - protein, 8 aa, Dengue virus
RTIMAVLF

SEQ ID NO: 76499 - protein, 8 aa, Dengue virus
TIMAVLFV

SEQ ID NO: 76500 - protein, 8 aa, Dengue virus
IMAVLFVV

SEQ ID NO: 76501 - protein, 8 aa, Dengue virus
MAVLFVVT

SEQ ID NO: 76502 - protein, 8 aa, Dengue virus
AVLFVVTL

SEQ ID NO: 76503 - protein, 8 aa, Dengue virus
VLFVVTLI

SEQ ID NO: 76504 - protein, 8 aa, Dengue virus
LFVVTLIP

SEQ ID NO: 76505 - protein, 8 aa, Dengue virus
FVVTLIPL

SEQ ID NO: 76506 - protein, 8 aa, Dengue virus
VVTLIPLC

SEQ ID NO: 76507 - protein, 8 aa, Dengue virus
VTLIPLCR

SEQ ID NO: 76508 - protein, 8 aa, Dengue virus
TLIPLCRT

SEQ ID NO: 76509 - protein, 8 aa, Dengue virus
LIPLCRTS

SEQ ID NO: 76510 - protein, 8 aa, Dengue virus
IPLCRTSC

SEQ ID NO: 76511 - protein, 8 aa, Dengue virus
PLCRTSCL

SEQ ID NO: 76512 - protein, 8 aa, Dengue virus
LCRTSCLQ

SEQ ID NO: 76513 - protein, 8 aa, Dengue virus
CRTSCLQK

SEQ ID NO: 76514 - protein, 8 aa, Dengue virus
RTSCLQKQ

SEQ ID NO: 76515 - protein, 8 aa, Dengue virus
TSCLQKQS

SEQ ID NO: 76516 - protein, 8 aa, Dengue virus
SCLQKQSH

SEQ ID NO: 76517 - protein, 8 aa, Dengue virus
CLQKQSHW

SEQ ID NO: 76518 - protein, 8 aa, Dengue virus
LQKQSHWV

SEQ ID NO: 76519 - protein, 8 aa, Dengue virus
QKQSHWVE

SEQ ID NO: 76520 - protein, 8 aa, Dengue virus
KQSHWVEI

SEQ ID NO: 76521 - protein, 8 aa, Dengue virus
QSHWVEIT

SEQ ID NO: 76522 - protein, 8 aa, Dengue virus
SHWVEITA

SEQ ID NO: 76523 - protein, 8 aa, Dengue virus
HWVEITAL

SEQ ID NO: 76524 - protein, 8 aa, Dengue virus
WVEITALI

SEQ ID NO: 76525 - protein, 8 aa, Dengue virus
VEITALIL

SEQ ID NO: 76526 - protein, 8 aa, Dengue virus
EITALILG

SEQ ID NO: 76527 - protein, 8 aa, Dengue virus
ITALILGA

SEQ ID NO: 76528 - protein, 8 aa, Dengue virus
TALILGAQ

SEQ ID NO: 76529 - protein, 8 aa, Dengue virus
ALILGAQA

SEQ ID NO: 76530 - protein, 8 aa, Dengue virus
LILGAQAL

SEQ ID NO: 76531 - protein, 8 aa, Dengue virus
ILGAQALP

SEQ ID NO: 76532 - protein, 8 aa, Dengue virus
LGAQALPV

SEQ ID NO: 76533 - protein, 8 aa, Dengue virus
GAQALPVY

SEQ ID NO: 76534 - protein, 8 aa, Dengue virus
AQALPVYL

SEQ ID NO: 76535 - protein, 8 aa, Dengue virus
QALPVYLM

SEQ ID NO: 76536 - protein, 8 aa, Dengue virus
ALPVYLMT

SEQ ID NO: 76537 - protein, 8 aa, Dengue virus
LPVYLMTL

SEQ ID NO: 76538 - protein, 8 aa, Dengue virus
PVYLMTLM

SEQ ID NO: 76539 - protein, 8 aa, Dengue virus
VYLMTLMK

SEQ ID NO: 76540 - protein, 8 aa, Dengue virus
YLMTLMKG

SEQ ID NO: 76541 - protein, 8 aa, Dengue virus
LMTLMKGA

SEQ ID NO: 76542 - protein, 8 aa, Dengue virus
MTLMKGAS

SEQ ID NO: 76543 - protein, 8 aa, Dengue virus
TLMKGASR

SEQ ID NO: 76544 - protein, 8 aa, Dengue virus
LMKGASRR

SEQ ID NO: 76545 - protein, 8 aa, Dengue virus
MKGASRRS

SEQ ID NO: 76546 - protein, 8 aa, Dengue virus
KGASRRSW

SEQ ID NO: 76547 - protein, 8 aa, Dengue virus
GASRRSWP

SEQ ID NO: 76548 - protein, 8 aa, Dengue virus
ASRRSWPL

SEQ ID NO: 76549 - protein, 8 aa, Dengue virus
SRRSWPLN

SEQ ID NO: 76550 - protein, 8 aa, Dengue virus
RRSWPLNE

SEQ ID NO: 76551 - protein, 8 aa, Dengue virus
RSWPLNEG

SEQ ID NO: 76552 - protein, 8 aa, Dengue virus
SWPLNEGI

SEQ ID NO: 76553 - protein, 8 aa, Dengue virus
WPLNEGIM

SEQ ID NO: 76554 - protein, 8 aa, Dengue virus
PLNEGIMA

SEQ ID NO: 76555 - protein, 8 aa, Dengue virus
LNEGIMAV

SEQ ID NO: 76556 - protein, 8 aa, Dengue virus
NEGIMAVG

SEQ ID NO: 76557 - protein, 8 aa, Dengue virus
EGIMAVGL

SEQ ID NO: 76558 - protein, 8 aa, Dengue virus
GIMAVGLV

SEQ ID NO: 76559 - protein, 8 aa, Dengue virus
IMAVGLVS

SEQ ID NO: 76560 - protein, 8 aa, Dengue virus
MAVGLVSL

SEQ ID NO: 76561 - protein, 8 aa, Dengue virus
AVGLVSLL

SEQ ID NO: 76562 - protein, 8 aa, Dengue virus
VGLVSLLG

SEQ ID NO: 76563 - protein, 8 aa, Dengue virus
GLVSLLGS

SEQ ID NO: 76564 - protein, 8 aa, Dengue virus
LVSLLGSA

SEQ ID NO: 76565 - protein, 8 aa, Dengue virus
VSLLGSAL

SEQ ID NO: 76566 - protein, 8 aa, Dengue virus
SLLGSALL

SEQ ID NO: 76567 - protein, 8 aa, Dengue virus
LLGSALLK

SEQ ID NO: 76568 - protein, 8 aa, Dengue virus
LGSALLKN

SEQ ID NO: 76569 - protein, 8 aa, Dengue virus
GSALLKND

SEQ ID NO: 76570 - protein, 8 aa, Dengue virus
SALLKNDV

SEQ ID NO: 76571 - protein, 8 aa, Dengue virus
ALLKNDVP

SEQ ID NO: 76572 - protein, 8 aa, Dengue virus
LLKNDVPL

SEQ ID NO: 76573 - protein, 8 aa, Dengue virus
LKNDVPLA

SEQ ID NO: 76574 - protein, 8 aa, Dengue virus
KNDVPLAG

SEQ ID NO: 76575 - protein, 8 aa, Dengue virus
NDVPLAGP

SEQ ID NO: 76576 - protein, 8 aa, Dengue virus
DVPLAGPM

SEQ ID NO: 76577 - protein, 8 aa, Dengue virus
VPLAGPMV

SEQ ID NO: 76578 - protein, 8 aa, Dengue virus
PLAGPMVA

SEQ ID NO: 76579 - protein, 8 aa, Dengue virus
LAGPMVAG

SEQ ID NO: 76580 - protein, 8 aa, Dengue virus
AGPMVAGG

SEQ ID NO: 76581 - protein, 8 aa, Dengue virus
GPMVAGGL

SEQ ID NO: 76582 - protein, 8 aa, Dengue virus
PMVAGGLL

SEQ ID NO: 76583 - protein, 8 aa, Dengue virus
MVAGGLLL

SEQ ID NO: 76584 - protein, 8 aa, Dengue virus
VAGGLLLA

SEQ ID NO: 76585 - protein, 8 aa, Dengue virus
AGGLLLAA

SEQ ID NO: 76586 - protein, 8 aa, Dengue virus
GGLLLAAY

SEQ ID NO: 76587 - protein, 8 aa, Dengue virus
GLLLAAYV

SEQ ID NO: 76588 - protein, 8 aa, Dengue virus
LLLAAYVM

SEQ ID NO: 76589 - protein, 8 aa, Dengue virus
LLAAYVMS

SEQ ID NO: 76590 - protein, 8 aa, Dengue virus
LAAYVMSG

SEQ ID NO: 76591 - protein, 8 aa, Dengue virus
AAYVMSGS

SEQ ID NO: 76592 - protein, 8 aa, Dengue virus
AYVMSGSS

SEQ ID NO: 76593 - protein, 8 aa, Dengue virus
YVMSGSSA

SEQ ID NO: 76594 - protein, 8 aa, Dengue virus
VMSGSSAD

SEQ ID NO: 76595 - protein, 8 aa, Dengue virus
MSGSSADL

SEQ ID NO: 76596 - protein, 8 aa, Dengue virus
SGSSADLS

SEQ ID NO: 76597 - protein, 8 aa, Dengue virus
GSSADLSL

SEQ ID NO: 76598 - protein, 8 aa, Dengue virus
SSADLSLE

SEQ ID NO: 76599 - protein, 8 aa, Dengue virus
SADLSLEK

SEQ ID NO: 76600 - protein, 8 aa, Dengue virus
ADLSLEKA

SEQ ID NO: 76601 - protein, 8 aa, Dengue virus
DLSLEKAA

SEQ ID NO: 76602 - protein, 8 aa, Dengue virus
LSLEKAAN

SEQ ID NO: 76603 - protein, 8 aa, Dengue virus
SLEKAANV

SEQ ID NO: 76604 - protein, 8 aa, Dengue virus
LEKAANVQ

SEQ ID NO: 76605 - protein, 8 aa, Dengue virus
EKAANVQW

SEQ ID NO: 76606 - protein, 8 aa, Dengue virus
KAANVQWD

SEQ ID NO: 76607 - protein, 8 aa, Dengue virus
AANVQWDE

SEQ ID NO: 76608 - protein, 8 aa, Dengue virus
ANVQWDEM

SEQ ID NO: 76609 - protein, 8 aa, Dengue virus
NVQWDEMA

SEQ ID NO: 76610 - protein, 8 aa, Dengue virus
VQWDEMAD

SEQ ID NO: 76611 - protein, 8 aa, Dengue virus
QWDEMADI

SEQ ID NO: 76612 - protein, 8 aa, Dengue virus
WDEMADIT

SEQ ID NO: 76613 - protein, 8 aa, Dengue virus
DEMADITG

SEQ ID NO: 76614 - protein, 8 aa, Dengue virus
EMADITGS

SEQ ID NO: 76615 - protein, 8 aa, Dengue virus
MADITGSS

SEQ ID NO: 76616 - protein, 8 aa, Dengue virus
ADITGSSP

SEQ ID NO: 76617 - protein, 8 aa, Dengue virus
DITGSSPI

SEQ ID NO: 76618 - protein, 8 aa, Dengue virus
ITGSSPII

SEQ ID NO: 76619 - protein, 8 aa, Dengue virus
TGSSPIIE

SEQ ID NO: 76620 - protein, 8 aa, Dengue virus
GSSPIIEV

SEQ ID NO: 76621 - protein, 8 aa, Dengue virus
SSPIIEVK

SEQ ID NO: 76622 - protein, 8 aa, Dengue virus
SPIIEVKQ

SEQ ID NO: 76623 - protein, 8 aa, Dengue virus
PIIEVKQD

SEQ ID NO: 76624 - protein, 8 aa, Dengue virus
IIEVKQDE

SEQ ID NO: 76625 - protein, 8 aa, Dengue virus
IEVKQDED

SEQ ID NO: 76626 - protein, 8 aa, Dengue virus
EVKQDEDG

SEQ ID NO: 76627 - protein, 8 aa, Dengue virus
VKQDEDGS

SEQ ID NO: 76628 - protein, 8 aa, Dengue virus
KQDEDGSF

SEQ ID NO: 76629 - protein, 8 aa, Dengue virus
QDEDGSFS

SEQ ID NO: 76630 - protein, 8 aa, Dengue virus
DEDGSFSI

SEQ ID NO: 76631 - protein, 8 aa, Dengue virus
EDGSFSIR

SEQ ID NO: 76632 - protein, 8 aa, Dengue virus
DGSFSIRD

SEQ ID NO: 76633 - protein, 8 aa, Dengue virus
GSFSIRDV

SEQ ID NO: 76634 - protein, 8 aa, Dengue virus
SFSIRDVE

SEQ ID NO: 76635 - protein, 8 aa, Dengue virus
FSIRDVEE

SEQ ID NO: 76636 - protein, 8 aa, Dengue virus
SIRDVEET

SEQ ID NO: 76637 - protein, 8 aa, Dengue virus
IRDVEETN

SEQ ID NO: 76638 - protein, 8 aa, Dengue virus
RDVEETNM

SEQ ID NO: 76639 - protein, 8 aa, Dengue virus
DVEETNMI

SEQ ID NO: 76640 - protein, 8 aa, Dengue virus
VEETNMIT

SEQ ID NO: 76641 - protein, 8 aa, Dengue virus
EETNMITL

SEQ ID NO: 76642 - protein, 8 aa, Dengue virus
ETNMITLL

SEQ ID NO: 76643 - protein, 8 aa, Dengue virus
TNMITLLV

SEQ ID NO: 76644 - protein, 8 aa, Dengue virus
NMITLLVK

SEQ ID NO: 76645 - protein, 8 aa, Dengue virus
MITLLVKL

SEQ ID NO: 76646 - protein, 8 aa, Dengue virus
ITLLVKLA

SEQ ID NO: 76647 - protein, 8 aa, Dengue virus
TLLVKLAL

SEQ ID NO: 76648 - protein, 8 aa, Dengue virus
LLVKLALI

SEQ ID NO: 76649 - protein, 8 aa, Dengue virus
LVKLALIT

SEQ ID NO: 76650 - protein, 8 aa, Dengue virus
VKLALITV

SEQ ID NO: 76651 - protein, 8 aa, Dengue virus
KLALITVS

SEQ ID NO: 76652 - protein, 8 aa, Dengue virus
LALITVSG

SEQ ID NO: 76653 - protein, 8 aa, Dengue virus
ALITVSGL

SEQ ID NO: 76654 - protein, 8 aa, Dengue virus
LITVSGLY

SEQ ID NO: 76655 - protein, 8 aa, Dengue virus
ITVSGLYP

SEQ ID NO: 76656 - protein, 8 aa, Dengue virus
TVSGLYPL

SEQ ID NO: 76657 - protein, 8 aa, Dengue virus
VSGLYPLA

SEQ ID NO: 76658 - protein, 8 aa, Dengue virus
SGLYPLAI

SEQ ID NO: 76659 - protein, 8 aa, Dengue virus
GLYPLAIP

SEQ ID NO: 76660 - protein, 8 aa, Dengue virus
LYPLAIPV

SEQ ID NO: 76661 - protein, 8 aa, Dengue virus
YPLAIPVT

SEQ ID NO: 76662 - protein, 8 aa, Dengue virus
PLAIPVTM

SEQ ID NO: 76663 - protein, 8 aa, Dengue virus
LAIPVTMT

SEQ ID NO: 76664 - protein, 8 aa, Dengue virus
AIPVTMTL

SEQ ID NO: 76665 - protein, 8 aa, Dengue virus
IPVTMTLW

SEQ ID NO: 76666 - protein, 8 aa, Dengue virus
PVTMTLWY

SEQ ID NO: 76667 - protein, 8 aa, Dengue virus
VTMTLWYM

SEQ ID NO: 76668 - protein, 8 aa, Dengue virus
TMTLWYMW

SEQ ID NO: 76669 - protein, 8 aa, Dengue virus
MTLWYMWQ

SEQ ID NO: 76670 - protein, 8 aa, Dengue virus
TLWYMWQV

SEQ ID NO: 76671 - protein, 8 aa, Dengue virus
LWYMWQVK

SEQ ID NO: 76672 - protein, 8 aa, Dengue virus
WYMWQVKT

SEQ ID NO: 76673 - protein, 8 aa, Dengue virus
YMWQVKTQ

SEQ ID NO: 76674 - protein, 8 aa, Dengue virus
MWQVKTQR

SEQ ID NO: 76675 - protein, 8 aa, Dengue virus
WQVKTQRS

SEQ ID NO: 76676 - protein, 8 aa, Dengue virus
QVKTQRSG

SEQ ID NO: 76677 - protein, 8 aa, Dengue virus
VKTQRSGA

SEQ ID NO: 76678 - protein, 8 aa, Dengue virus
KTQRSGAL

SEQ ID NO: 76679 - protein, 8 aa, Dengue virus
TQRSGALW

SEQ ID NO: 76680 - protein, 8 aa, Dengue virus
QRSGALWD

SEQ ID NO: 76681 - protein, 8 aa, Dengue virus
RSGALWDV

SEQ ID NO: 76682 - protein, 8 aa, Dengue virus
SGALWDVP

SEQ ID NO: 76683 - protein, 8 aa, Dengue virus
GALWDVPS

SEQ ID NO: 76684 - protein, 8 aa, Dengue virus
ALWDVPSP

SEQ ID NO: 76685 - protein, 8 aa, Dengue virus
LWDVPSPA

SEQ ID NO: 76686 - protein, 8 aa, Dengue virus
WDVPSPAA

SEQ ID NO: 76687 - protein, 8 aa, Dengue virus
DVPSPAAT

SEQ ID NO: 76688 - protein, 8 aa, Dengue virus
VPSPAATQ

SEQ ID NO: 76689 - protein, 8 aa, Dengue virus
PSPAATQK

SEQ ID NO: 76690 - protein, 8 aa, Dengue virus
SPAATQKA

SEQ ID NO: 76691 - protein, 8 aa, Dengue virus
TQKAALSE

SEQ ID NO: 76692 - protein, 8 aa, Dengue virus
QKAALSEG

SEQ ID NO: 76693 - protein, 8 aa, Dengue virus
KAALSEGV

SEQ ID NO: 76694 - protein, 8 aa, Dengue virus
AALSEGVY

SEQ ID NO: 76695 - protein, 8 aa, Dengue virus
ALSEGVYR

SEQ ID NO: 76696 - protein, 8 aa, Dengue virus
LSEGVYRI

SEQ ID NO: 76697 - protein, 8 aa, Dengue virus
SEGVYRIM

SEQ ID NO: 76698 - protein, 8 aa, Dengue virus
EGVYRIMQ

SEQ ID NO: 76699 - protein, 8 aa, Dengue virus
GVYRIMQR

SEQ ID NO: 76700 - protein, 8 aa, Dengue virus
VYRIMQRG

SEQ ID NO: 76701 - protein, 8 aa, Dengue virus
YRIMQRGL

SEQ ID NO: 76702 - protein, 8 aa, Dengue virus
RIMQRGLF

SEQ ID NO: 76703 - protein, 8 aa, Dengue virus
IMQRGLFG

SEQ ID NO: 76704 - protein, 8 aa, Dengue virus
MQRGLFGK

SEQ ID NO: 76705 - protein, 8 aa, Dengue virus
QRGLFGKT

SEQ ID NO: 76706 - protein, 8 aa, Dengue virus
RGLFGKTQ

SEQ ID NO: 76707 - protein, 8 aa, Dengue virus
GLFGKTQV

SEQ ID NO: 76708 - protein, 8 aa, Dengue virus
LFGKTQVG

SEQ ID NO: 76709 - protein, 8 aa, Dengue virus
FGKTQVGV

SEQ ID NO: 76710 - protein, 8 aa, Dengue virus
GKTQVGVG

SEQ ID NO: 76711 - protein, 8 aa, Dengue virus
KTQVGVGI

SEQ ID NO: 76712 - protein, 8 aa, Dengue virus
TQVGVGIH

SEQ ID NO: 76713 - protein, 8 aa, Dengue virus
QVGVGIHM

SEQ ID NO: 76714 - protein, 8 aa, Dengue virus
VGVGIHME

SEQ ID NO: 76715 - protein, 8 aa, Dengue virus
GVGIHMEG

SEQ ID NO: 76716 - protein, 8 aa, Dengue virus
VGIHMEGV

SEQ ID NO: 76717 - protein, 8 aa, Dengue virus
GIHMEGVF

SEQ ID NO: 76718 - protein, 8 aa, Dengue virus
IHMEGVFH

SEQ ID NO: 76719 - protein, 8 aa, Dengue virus
HMEGVFHT

SEQ ID NO: 76720 - protein, 8 aa, Dengue virus
MEGVFHTM

SEQ ID NO: 76721 - protein, 8 aa, Dengue virus
EGVFHTMW

SEQ ID NO: 76722 - protein, 8 aa, Dengue virus
GVFHTMWH

SEQ ID NO: 76723 - protein, 8 aa, Dengue virus
VFHTMWHV

SEQ ID NO: 76724 - protein, 8 aa, Dengue virus
FHTMWHVT

SEQ ID NO: 76725 - protein, 8 aa, Dengue virus
HTMWHVTR

SEQ ID NO: 76726 - protein, 8 aa, Dengue virus
TMWHVTRG

SEQ ID NO: 76727 - protein, 8 aa, Dengue virus
MWHVTRGS

SEQ ID NO: 76728 - protein, 8 aa, Dengue virus
WHVTRGSV

SEQ ID NO: 76729 - protein, 8 aa, Dengue virus
HVTRGSVI

SEQ ID NO: 76730 - protein, 8 aa, Dengue virus
VTRGSVIC

SEQ ID NO: 76731 - protein, 8 aa, Dengue virus
TRGSVICH

SEQ ID NO: 76732 - protein, 8 aa, Dengue virus
RGSVICHE

SEQ ID NO: 76733 - protein, 8 aa, Dengue virus
GSVICHET

SEQ ID NO: 76734 - protein, 8 aa, Dengue virus
SVICHETG

SEQ ID NO: 76735 - protein, 8 aa, Dengue virus
VICHETGR

SEQ ID NO: 76736 - protein, 8 aa, Dengue virus
ICHETGRL

SEQ ID NO: 76737 - protein, 8 aa, Dengue virus
CHETGRLE

SEQ ID NO: 76738 - protein, 8 aa, Dengue virus
HETGRLEP

SEQ ID NO: 76739 - protein, 8 aa, Dengue virus
ETGRLEPS

SEQ ID NO: 76740 - protein, 8 aa, Dengue virus
TGRLEPSW

SEQ ID NO: 76741 - protein, 8 aa, Dengue virus
GRLEPSWA

SEQ ID NO: 76742 - protein, 8 aa, Dengue virus
RLEPSWAD

SEQ ID NO: 76743 - protein, 8 aa, Dengue virus
LEPSWADV

SEQ ID NO: 76744 - protein, 8 aa, Dengue virus
EPSWADVR

SEQ ID NO: 76745 - protein, 8 aa, Dengue virus
PSWADVRN

SEQ ID NO: 76746 - protein, 8 aa, Dengue virus
SWADVRND

SEQ ID NO: 76747 - protein, 8 aa, Dengue virus
WADVRNDM

SEQ ID NO: 76748 - protein, 8 aa, Dengue virus
ADVRNDMI

SEQ ID NO: 76749 - protein, 8 aa, Dengue virus
DVRNDMIS

SEQ ID NO: 76750 - protein, 8 aa, Dengue virus
VRNDMISY

SEQ ID NO: 76751 - protein, 8 aa, Dengue virus
RNDMISYG

SEQ ID NO: 76752 - protein, 8 aa, Dengue virus
NDMISYGG

SEQ ID NO: 76753 - protein, 8 aa, Dengue virus
DMISYGGG

SEQ ID NO: 76754 - protein, 8 aa, Dengue virus
MISYGGGW

SEQ ID NO: 76755 - protein, 8 aa, Dengue virus
ISYGGGWR

SEQ ID NO: 76756 - protein, 8 aa, Dengue virus
SYGGGWRL

SEQ ID NO: 76757 - protein, 8 aa, Dengue virus
YGGGWRLG

SEQ ID NO: 76758 - protein, 8 aa, Dengue virus
GGGWRLGD

SEQ ID NO: 76759 - protein, 8 aa, Dengue virus
GGWRLGDK

SEQ ID NO: 76760 - protein, 8 aa, Dengue virus
GWRLGDKW

SEQ ID NO: 76761 - protein, 8 aa, Dengue virus
WRLGDKWD

SEQ ID NO: 76762 - protein, 8 aa, Dengue virus
RLGDKWDK

SEQ ID NO: 76763 - protein, 8 aa, Dengue virus
LGDKWDKE

SEQ ID NO: 76764 - protein, 8 aa, Dengue virus
GDKWDKEE

SEQ ID NO: 76765 - protein, 8 aa, Dengue virus
DKWDKEED

SEQ ID NO: 76766 - protein, 8 aa, Dengue virus
KWDKEEDV

SEQ ID NO: 76767 - protein, 8 aa, Dengue virus
WDKEEDVQ

SEQ ID NO: 76768 - protein, 8 aa, Dengue virus
DKEEDVQV

SEQ ID NO: 76769 - protein, 8 aa, Dengue virus
KEEDVQVL

SEQ ID NO: 76770 - protein, 8 aa, Dengue virus
EEDVQVLA

SEQ ID NO: 76771 - protein, 8 aa, Dengue virus
EDVQVLAI

SEQ ID NO: 76772 - protein, 8 aa, Dengue virus
DVQVLAIE

SEQ ID NO: 76773 - protein, 8 aa, Dengue virus
VQVLAIEP

SEQ ID NO: 76774 - protein, 8 aa, Dengue virus
QVLAIEPG

SEQ ID NO: 76775 - protein, 8 aa, Dengue virus
VLAIEPGK

SEQ ID NO: 76776 - protein, 8 aa, Dengue virus
LAIEPGKN

SEQ ID NO: 76777 - protein, 8 aa, Dengue virus
AIEPGKNP

SEQ ID NO: 76778 - protein, 8 aa, Dengue virus
IEPGKNPK

SEQ ID NO: 76779 - protein, 8 aa, Dengue virus
EPGKNPKH

SEQ ID NO: 76780 - protein, 8 aa, Dengue virus
PGKNPKHV

SEQ ID NO: 76781 - protein, 8 aa, Dengue virus
GKNPKHVQ

SEQ ID NO: 76782 - protein, 8 aa, Dengue virus
KNPKHVQT

SEQ ID NO: 76783 - protein, 8 aa, Dengue virus
NPKHVQTK

SEQ ID NO: 76784 - protein, 8 aa, Dengue virus
PKHVQTKP

SEQ ID NO: 76785 - protein, 8 aa, Dengue virus
KHVQTKPG

SEQ ID NO: 76786 - protein, 8 aa, Dengue virus
HVQTKPGL

SEQ ID NO: 76787 - protein, 8 aa, Dengue virus
VQTKPGLF

SEQ ID NO: 76788 - protein, 8 aa, Dengue virus
QTKPGLFK

SEQ ID NO: 76789 - protein, 8 aa, Dengue virus
TKPGLFKT

SEQ ID NO: 76790 - protein, 8 aa, Dengue virus
KPGLFKTL

SEQ ID NO: 76791 - protein, 8 aa, Dengue virus
PGLFKTLT

SEQ ID NO: 76792 - protein, 8 aa, Dengue virus
GLFKTLTG

SEQ ID NO: 76793 - protein, 8 aa, Dengue virus
LFKTLTGE

SEQ ID NO: 76794 - protein, 8 aa, Dengue virus
FKTLTGEI

SEQ ID NO: 76795 - protein, 8 aa, Dengue virus
KTLTGEIG

SEQ ID NO: 76796 - protein, 8 aa, Dengue virus
TLTGEIGA

SEQ ID NO: 76797 - protein, 8 aa, Dengue virus
LTGEIGAV

SEQ ID NO: 76798 - protein, 8 aa, Dengue virus
TGEIGAVT

SEQ ID NO: 76799 - protein, 8 aa, Dengue virus
GEIGAVTL

SEQ ID NO: 76800 - protein, 8 aa, Dengue virus
EIGAVTLD

SEQ ID NO: 76801 - protein, 8 aa, Dengue virus
IGAVTLDF

SEQ ID NO: 76802 - protein, 8 aa, Dengue virus
GAVTLDFK

SEQ ID NO: 76803 - protein, 8 aa, Dengue virus
AVTLDFKP

SEQ ID NO: 76804 - protein, 8 aa, Dengue virus
VTLDFKPG

SEQ ID NO: 76805 - protein, 8 aa, Dengue virus
TLDFKPGT

SEQ ID NO: 76806 - protein, 8 aa, Dengue virus
LDFKPGTS

SEQ ID NO: 76807 - protein, 8 aa, Dengue virus
DFKPGTSG

SEQ ID NO: 76808 - protein, 8 aa, Dengue virus
FKPGTSGS

SEQ ID NO: 76809 - protein, 8 aa, Dengue virus
KPGTSGSP

SEQ ID NO: 76810 - protein, 8 aa, Dengue virus
PGTSGSPI

SEQ ID NO: 76811 - protein, 8 aa, Dengue virus
GTSGSPII

SEQ ID NO: 76812 - protein, 8 aa, Dengue virus
TSGSPIIN

SEQ ID NO: 76813 - protein, 8 aa, Dengue virus
SGSPIINR

SEQ ID NO: 76814 - protein, 8 aa, Dengue virus
GSPIINRK

SEQ ID NO: 76815 - protein, 8 aa, Dengue virus
SPIINRKG

SEQ ID NO: 76816 - protein, 8 aa, Dengue virus
PIINRKGK

SEQ ID NO: 76817 - protein, 8 aa, Dengue virus
IINRKGKV

SEQ ID NO: 76818 - protein, 8 aa, Dengue virus
INRKGKVI

SEQ ID NO: 76819 - protein, 8 aa, Dengue virus
NRKGKVIG

SEQ ID NO: 76820 - protein, 8 aa, Dengue virus
RKGKVIGL

SEQ ID NO: 76821 - protein, 8 aa, Dengue virus
KGKVIGLY

SEQ ID NO: 76822 - protein, 8 aa, Dengue virus
GKVIGLYG

SEQ ID NO: 76823 - protein, 8 aa, Dengue virus
KVIGLYGN

SEQ ID NO: 76824 - protein, 8 aa, Dengue virus
VIGLYGNG

SEQ ID NO: 76825 - protein, 8 aa, Dengue virus
IGLYGNGV

SEQ ID NO: 76826 - protein, 8 aa, Dengue virus
GLYGNGVV

SEQ ID NO: 76827 - protein, 8 aa, Dengue virus
LYGNGVVT

SEQ ID NO: 76828 - protein, 8 aa, Dengue virus
YGNGVVTK

SEQ ID NO: 76829 - protein, 8 aa, Dengue virus
GNGVVTKS

SEQ ID NO: 76830 - protein, 8 aa, Dengue virus
NGVVTKSG

SEQ ID NO: 76831 - protein, 8 aa, Dengue virus
GVVTKSGD

SEQ ID NO: 76832 - protein, 8 aa, Dengue virus
VVTKSGDY

SEQ ID NO: 76833 - protein, 8 aa, Dengue virus
VTKSGDYV

SEQ ID NO: 76834 - protein, 8 aa, Dengue virus
TKSGDYVS

SEQ ID NO: 76835 - protein, 8 aa, Dengue virus
KSGDYVSA

SEQ ID NO: 76836 - protein, 8 aa, Dengue virus
SGDYVSAI

SEQ ID NO: 76837 - protein, 8 aa, Dengue virus
GDYVSAIT

SEQ ID NO: 76838 - protein, 8 aa, Dengue virus
DYVSAITQ

SEQ ID NO: 76839 - protein, 8 aa, Dengue virus
YVSAITQA

SEQ ID NO: 76840 - protein, 8 aa, Dengue virus
VSAITQAE

SEQ ID NO: 76841 - protein, 8 aa, Dengue virus
SAITQAER

SEQ ID NO: 76842 - protein, 8 aa, Dengue virus
AITQAERI

SEQ ID NO: 76843 - protein, 8 aa, Dengue virus
ITQAERIG

SEQ ID NO: 76844 - protein, 8 aa, Dengue virus
TQAERIGE

SEQ ID NO: 76845 - protein, 8 aa, Dengue virus
QAERIGEP

SEQ ID NO: 76846 - protein, 8 aa, Dengue virus
AERIGEPD

SEQ ID NO: 76847 - protein, 8 aa, Dengue virus
ERIGEPDY

SEQ ID NO: 76848 - protein, 8 aa, Dengue virus
RIGEPDYE

SEQ ID NO: 76849 - protein, 8 aa, Dengue virus
IGEPDYEV

SEQ ID NO: 76850 - protein, 8 aa, Dengue virus
GEPDYEVD

SEQ ID NO: 76851 - protein, 8 aa, Dengue virus
EPDYEVDE

SEQ ID NO: 76852 - protein, 8 aa, Dengue virus
PDYEVDED

SEQ ID NO: 76853 - protein, 8 aa, Dengue virus
DYEVDEDI

SEQ ID NO: 76854 - protein, 8 aa, Dengue virus
YEVDEDIF

SEQ ID NO: 76855 - protein, 8 aa, Dengue virus
EVDEDIFR

SEQ ID NO: 76856 - protein, 8 aa, Dengue virus
VDEDIFRK

SEQ ID NO: 76857 - protein, 8 aa, Dengue virus
DEDIFRKK

SEQ ID NO: 76858 - protein, 8 aa, Dengue virus
EDIFRKKR

SEQ ID NO: 76859 - protein, 8 aa, Dengue virus
DIFRKKRL

SEQ ID NO: 76860 - protein, 8 aa, Dengue virus
IFRKKRLT

SEQ ID NO: 76861 - protein, 8 aa, Dengue virus
FRKKRLTI

SEQ ID NO: 76862 - protein, 8 aa, Dengue virus
RKKRLTIM

SEQ ID NO: 76863 - protein, 8 aa, Dengue virus
KKRLTIMD

SEQ ID NO: 76864 - protein, 8 aa, Dengue virus
KRLTIMDL

SEQ ID NO: 76865 - protein, 8 aa, Dengue virus
RLTIMDLH

SEQ ID NO: 76866 - protein, 8 aa, Dengue virus
LTIMDLHP

SEQ ID NO: 76867 - protein, 8 aa, Dengue virus
TIMDLHPG

SEQ ID NO: 76868 - protein, 8 aa, Dengue virus
IMDLHPGA

SEQ ID NO: 76869 - protein, 8 aa, Dengue virus
MDLHPGAG

SEQ ID NO: 76870 - protein, 8 aa, Dengue virus
DLHPGAGK

SEQ ID NO: 76871 - protein, 8 aa, Dengue virus
LHPGAGKT

SEQ ID NO: 76872 - protein, 8 aa, Dengue virus
HPGAGKTK

SEQ ID NO: 76873 - protein, 8 aa, Dengue virus
PGAGKTKR

SEQ ID NO: 76874 - protein, 8 aa, Dengue virus
GAGKTKRI

SEQ ID NO: 76875 - protein, 8 aa, Dengue virus
AGKTKRIL

SEQ ID NO: 76876 - protein, 8 aa, Dengue virus
GKTKRILP

SEQ ID NO: 76877 - protein, 8 aa, Dengue virus
KTKRILPS

SEQ ID NO: 76878 - protein, 8 aa, Dengue virus
TKRILPSI

SEQ ID NO: 76879 - protein, 8 aa, Dengue virus
KRILPSIV

SEQ ID NO: 76880 - protein, 8 aa, Dengue virus
RILPSIVR

SEQ ID NO: 76881 - protein, 8 aa, Dengue virus
ILPSIVRE

SEQ ID NO: 76882 - protein, 8 aa, Dengue virus
LPSIVREA

SEQ ID NO: 76883 - protein, 8 aa, Dengue virus
PSIVREAL

SEQ ID NO: 76884 - protein, 8 aa, Dengue virus
SIVREALK

SEQ ID NO: 76885 - protein, 8 aa, Dengue virus
IVREALKR

SEQ ID NO: 76886 - protein, 8 aa, Dengue virus
VREALKRR

SEQ ID NO: 76887 - protein, 8 aa, Dengue virus
REALKRRL

SEQ ID NO: 76888 - protein, 8 aa, Dengue virus
EALKRRLR

SEQ ID NO: 76889 - protein, 8 aa, Dengue virus
ALKRRLRT

SEQ ID NO: 76890 - protein, 8 aa, Dengue virus
LKRRLRTL

SEQ ID NO: 76891 - protein, 8 aa, Dengue virus
KRRLRTLI

SEQ ID NO: 76892 - protein, 8 aa, Dengue virus
RRLRTLIL

SEQ ID NO: 76893 - protein, 8 aa, Dengue virus
RLRTLILA

SEQ ID NO: 76894 - protein, 8 aa, Dengue virus
LRTLILAP

SEQ ID NO: 76895 - protein, 8 aa, Dengue virus
RTLILAPT

SEQ ID NO: 76896 - protein, 8 aa, Dengue virus
TLILAPTR

SEQ ID NO: 76897 - protein, 8 aa, Dengue virus
LILAPTRV

SEQ ID NO: 76898 - protein, 8 aa, Dengue virus
ILAPTRVV

SEQ ID NO: 76899 - protein, 8 aa, Dengue virus
LAPTRVVA

SEQ ID NO: 76900 - protein, 8 aa, Dengue virus
APTRVVAA

SEQ ID NO: 76901 - protein, 8 aa, Dengue virus
PTRVVAAE

SEQ ID NO: 76902 - protein, 8 aa, Dengue virus
TRVVAAEM

SEQ ID NO: 76903 - protein, 8 aa, Dengue virus
RVVAAEME

SEQ ID NO: 76904 - protein, 8 aa, Dengue virus
VVAAEMEE

SEQ ID NO: 76905 - protein, 8 aa, Dengue virus
VAAEMEEA

SEQ ID NO: 76906 - protein, 8 aa, Dengue virus
AAEMEEAL

SEQ ID NO: 76907 - protein, 8 aa, Dengue virus
AEMEEALR

SEQ ID NO: 76908 - protein, 8 aa, Dengue virus
EMEEALRG

SEQ ID NO: 76909 - protein, 8 aa, Dengue virus
MEEALRGL

SEQ ID NO: 76910 - protein, 8 aa, Dengue virus
EEALRGLP

SEQ ID NO: 76911 - protein, 8 aa, Dengue virus
EALRGLPI

SEQ ID NO: 76912 - protein, 8 aa, Dengue virus
ALRGLPIR

SEQ ID NO: 76913 - protein, 8 aa, Dengue virus
LRGLPIRY

SEQ ID NO: 76914 - protein, 8 aa, Dengue virus
RGLPIRYQ

SEQ ID NO: 76915 - protein, 8 aa, Dengue virus
GLPIRYQT

SEQ ID NO: 76916 - protein, 8 aa, Dengue virus
LPIRYQTP

SEQ ID NO: 76917 - protein, 8 aa, Dengue virus
PIRYQTPA

SEQ ID NO: 76918 - protein, 8 aa, Dengue virus
IRYQTPAV

SEQ ID NO: 76919 - protein, 8 aa, Dengue virus
RYQTPAVK

SEQ ID NO: 76920 - protein, 8 aa, Dengue virus
YQTPAVKS

SEQ ID NO: 76921 - protein, 8 aa, Dengue virus
QTPAVKSE

SEQ ID NO: 76922 - protein, 8 aa, Dengue virus
TPAVKSEH

SEQ ID NO: 76923 - protein, 8 aa, Dengue virus
PAVKSEHT

SEQ ID NO: 76924 - protein, 8 aa, Dengue virus
AVKSEHTG

SEQ ID NO: 76925 - protein, 8 aa, Dengue virus
VKSEHTGR

SEQ ID NO: 76926 - protein, 8 aa, Dengue virus
KSEHTGRE

SEQ ID NO: 76927 - protein, 8 aa, Dengue virus
SEHTGREI

SEQ ID NO: 76928 - protein, 8 aa, Dengue virus
EHTGREIV

SEQ ID NO: 76929 - protein, 8 aa, Dengue virus
HTGREIVD

SEQ ID NO: 76930 - protein, 8 aa, Dengue virus
TGREIVDL

SEQ ID NO: 76931 - protein, 8 aa, Dengue virus
GREIVDLM

SEQ ID NO: 76932 - protein, 8 aa, Dengue virus
REIVDLMC

SEQ ID NO: 76933 - protein, 8 aa, Dengue virus
EIVDLMCH

SEQ ID NO: 76934 - protein, 8 aa, Dengue virus
IVDLMCHA

SEQ ID NO: 76935 - protein, 8 aa, Dengue virus
VDLMCHAT

SEQ ID NO: 76936 - protein, 8 aa, Dengue virus
DLMCHATF

SEQ ID NO: 76937 - protein, 8 aa, Dengue virus
LMCHATFT

SEQ ID NO: 76938 - protein, 8 aa, Dengue virus
MCHATFTT

SEQ ID NO: 76939 - protein, 8 aa, Dengue virus
CHATFTTR

SEQ ID NO: 76940 - protein, 8 aa, Dengue virus
HATFTTRL

SEQ ID NO: 76941 - protein, 8 aa, Dengue virus
ATFTTRLL

SEQ ID NO: 76942 - protein, 8 aa, Dengue virus
TFTTRLLS

SEQ ID NO: 76943 - protein, 8 aa, Dengue virus
FTTRLLSS

SEQ ID NO: 76944 - protein, 8 aa, Dengue virus
TTRLLSST

SEQ ID NO: 76945 - protein, 8 aa, Dengue virus
TRLLSSTR

SEQ ID NO: 76946 - protein, 8 aa, Dengue virus
RLLSSTRV

SEQ ID NO: 76947 - protein, 8 aa, Dengue virus
LLSSTRVP

SEQ ID NO: 76948 - protein, 8 aa, Dengue virus
LSSTRVPN

SEQ ID NO: 76949 - protein, 8 aa, Dengue virus
SSTRVPNY

SEQ ID NO: 76950 - protein, 8 aa, Dengue virus
STRVPNYN

SEQ ID NO: 76951 - protein, 8 aa, Dengue virus
TRVPNYNL

SEQ ID NO: 76952 - protein, 8 aa, Dengue virus
RVPNYNLI

SEQ ID NO: 76953 - protein, 8 aa, Dengue virus
VPNYNLIV

SEQ ID NO: 76954 - protein, 8 aa, Dengue virus
PNYNLIVM

SEQ ID NO: 76955 - protein, 8 aa, Dengue virus
NYNLIVMD

SEQ ID NO: 76956 - protein, 8 aa, Dengue virus
YNLIVMDE

SEQ ID NO: 76957 - protein, 8 aa, Dengue virus
NLIVMDEA

SEQ ID NO: 76958 - protein, 8 aa, Dengue virus
LIVMDEAH

SEQ ID NO: 76959 - protein, 8 aa, Dengue virus
IVMDEAHF

SEQ ID NO: 76960 - protein, 8 aa, Dengue virus
VMDEAHFT

SEQ ID NO: 76961 - protein, 8 aa, Dengue virus
MDEAHFTD

SEQ ID NO: 76962 - protein, 8 aa, Dengue virus
DEAHFTDP

SEQ ID NO: 76963 - protein, 8 aa, Dengue virus
EAHFTDPS

SEQ ID NO: 76964 - protein, 8 aa, Dengue virus
AHFTDPSS

SEQ ID NO: 76965 - protein, 8 aa, Dengue virus
HFTDPSSV

SEQ ID NO: 76966 - protein, 8 aa, Dengue virus
FTDPSSVA

SEQ ID NO: 76967 - protein, 8 aa, Dengue virus
TDPSSVAA

SEQ ID NO: 76968 - protein, 8 aa, Dengue virus
DPSSVAAR

SEQ ID NO: 76969 - protein, 8 aa, Dengue virus
PSSVAARG

SEQ ID NO: 76970 - protein, 8 aa, Dengue virus
SSVAARGY

SEQ ID NO: 76971 - protein, 8 aa, Dengue virus
SVAARGYI

SEQ ID NO: 76972 - protein, 8 aa, Dengue virus
VAARGYIS

SEQ ID NO: 76973 - protein, 8 aa, Dengue virus
AARGYIST

SEQ ID NO: 76974 - protein, 8 aa, Dengue virus
ARGYISTR

SEQ ID NO: 76975 - protein, 8 aa, Dengue virus
RGYISTRV

SEQ ID NO: 76976 - protein, 8 aa, Dengue virus
GYISTRVE

SEQ ID NO: 76977 - protein, 8 aa, Dengue virus
YISTRVEM

SEQ ID NO: 76978 - protein, 8 aa, Dengue virus
ISTRVEMG

SEQ ID NO: 76979 - protein, 8 aa, Dengue virus
STRVEMGE

SEQ ID NO: 76980 - protein, 8 aa, Dengue virus
TRVEMGEA

SEQ ID NO: 76981 - protein, 8 aa, Dengue virus
RVEMGEAA

SEQ ID NO: 76982 - protein, 8 aa, Dengue virus
VEMGEAAA

SEQ ID NO: 76983 - protein, 8 aa, Dengue virus
EMGEAAAI

SEQ ID NO: 76984 - protein, 8 aa, Dengue virus
MGEAAAIF

SEQ ID NO: 76985 - protein, 8 aa, Dengue virus
GEAAAIFM

SEQ ID NO: 76986 - protein, 8 aa, Dengue virus
EAAAIFMT

SEQ ID NO: 76987 - protein, 8 aa, Dengue virus
AAAIFMTA

SEQ ID NO: 76988 - protein, 8 aa, Dengue virus
AAIFMTAT

SEQ ID NO: 76989 - protein, 8 aa, Dengue virus
AIFMTATP

SEQ ID NO: 76990 - protein, 8 aa, Dengue virus
IFMTATPP

SEQ ID NO: 76991 - protein, 8 aa, Dengue virus
FMTATPPG

SEQ ID NO: 76992 - protein, 8 aa, Dengue virus
MTATPPGA

SEQ ID NO: 76993 - protein, 8 aa, Dengue virus
TATPPGAT

SEQ ID NO: 76994 - protein, 8 aa, Dengue virus
ATPPGATD

SEQ ID NO: 76995 - protein, 8 aa, Dengue virus
TPPGATDP

SEQ ID NO: 76996 - protein, 8 aa, Dengue virus
PPGATDPF

SEQ ID NO: 76997 - protein, 8 aa, Dengue virus
PGATDPFP

SEQ ID NO: 76998 - protein, 8 aa, Dengue virus
GATDPFPQ

SEQ ID NO: 76999 - protein, 8 aa, Dengue virus
ATDPFPQS

SEQ ID NO: 77000 - protein, 8 aa, Dengue virus
TDPFPQSN

SEQ ID NO: 77001 - protein, 8 aa, Dengue virus
DPFPQSNS

SEQ ID NO: 77002 - protein, 8 aa, Dengue virus
PFPQSNSP

SEQ ID NO: 77003 - protein, 8 aa, Dengue virus
FPQSNSPI

SEQ ID NO: 77004 - protein, 8 aa, Dengue virus
PQSNSPIE

SEQ ID NO: 77005 - protein, 8 aa, Dengue virus
QSNSPIED

SEQ ID NO: 77006 - protein, 8 aa, Dengue virus
SNSPIEDI

SEQ ID NO: 77007 - protein, 8 aa, Dengue virus
NSPIEDIE

SEQ ID NO: 77008 - protein, 8 aa, Dengue virus
SPIEDIER

SEQ ID NO: 77009 - protein, 8 aa, Dengue virus
PIEDIERE

SEQ ID NO: 77010 - protein, 8 aa, Dengue virus
IEDIEREI

SEQ ID NO: 77011 - protein, 8 aa, Dengue virus
EDIEREIP

SEQ ID NO: 77012 - protein, 8 aa, Dengue virus
DIEREIPE

SEQ ID NO: 77013 - protein, 8 aa, Dengue virus
IEREIPER

SEQ ID NO: 77014 - protein, 8 aa, Dengue virus
EREIPERS

SEQ ID NO: 77015 - protein, 8 aa, Dengue virus
REIPERSW

SEQ ID NO: 77016 - protein, 8 aa, Dengue virus
EIPERSWN

SEQ ID NO: 77017 - protein, 8 aa, Dengue virus
IPERSWNT

SEQ ID NO: 77018 - protein, 8 aa, Dengue virus
PERSWNTG

SEQ ID NO: 77019 - protein, 8 aa, Dengue virus
ERSWNTGF

SEQ ID NO: 77020 - protein, 8 aa, Dengue virus
RSWNTGFD

SEQ ID NO: 77021 - protein, 8 aa, Dengue virus
SWNTGFDW

SEQ ID NO: 77022 - protein, 8 aa, Dengue virus
WNTGFDWI

SEQ ID NO: 77023 - protein, 8 aa, Dengue virus
NTGFDWIT

SEQ ID NO: 77024 - protein, 8 aa, Dengue virus
TGFDWITD

SEQ ID NO: 77025 - protein, 8 aa, Dengue virus
GFDWITDY

SEQ ID NO: 77026 - protein, 8 aa, Dengue virus
FDWITDYQ

SEQ ID NO: 77027 - protein, 8 aa, Dengue virus
DWITDYQG

SEQ ID NO: 77028 - protein, 8 aa, Dengue virus
WITDYQGK

SEQ ID NO: 77029 - protein, 8 aa, Dengue virus
ITDYQGKT

SEQ ID NO: 77030 - protein, 8 aa, Dengue virus
TDYQGKTV

SEQ ID NO: 77031 - protein, 8 aa, Dengue virus
DYQGKTVW

SEQ ID NO: 77032 - protein, 8 aa, Dengue virus
YQGKTVWF

SEQ ID NO: 77033 - protein, 8 aa, Dengue virus
QGKTVWFV

SEQ ID NO: 77034 - protein, 8 aa, Dengue virus
GKTVWFVP

SEQ ID NO: 77035 - protein, 8 aa, Dengue virus
KTVWFVPS

SEQ ID NO: 77036 - protein, 8 aa, Dengue virus
TVWFVPSI

SEQ ID NO: 77037 - protein, 8 aa, Dengue virus
VWFVPSIK

SEQ ID NO: 77038 - protein, 8 aa, Dengue virus
WFVPSIKA

SEQ ID NO: 77039 - protein, 8 aa, Dengue virus
FVPSIKAG

SEQ ID NO: 77040 - protein, 8 aa, Dengue virus
VPSIKAGN

SEQ ID NO: 77041 - protein, 8 aa, Dengue virus
PSIKAGND

SEQ ID NO: 77042 - protein, 8 aa, Dengue virus
SIKAGNDI

SEQ ID NO: 77043 - protein, 8 aa, Dengue virus
IKAGNDIA

SEQ ID NO: 77044 - protein, 8 aa, Dengue virus
KAGNDIAN

SEQ ID NO: 77045 - protein, 8 aa, Dengue virus
AGNDIANC

SEQ ID NO: 77046 - protein, 8 aa, Dengue virus
GNDIANCL

SEQ ID NO: 77047 - protein, 8 aa, Dengue virus
NDIANCLR

SEQ ID NO: 77048 - protein, 8 aa, Dengue virus
DIANCLRK

SEQ ID NO: 77049 - protein, 8 aa, Dengue virus
IANCLRKS

SEQ ID NO: 77050 - protein, 8 aa, Dengue virus
ANCLRKSG

SEQ ID NO: 77051 - protein, 8 aa, Dengue virus
NCLRKSGK

SEQ ID NO: 77052 - protein, 8 aa, Dengue virus
CLRKSGKK

SEQ ID NO: 77053 - protein, 8 aa, Dengue virus
LRKSGKKV

SEQ ID NO: 77054 - protein, 8 aa, Dengue virus
RKSGKKVI

SEQ ID NO: 77055 - protein, 8 aa, Dengue virus
KSGKKVIQ

SEQ ID NO: 77056 - protein, 8 aa, Dengue virus
SGKKVIQL

SEQ ID NO: 77057 - protein, 8 aa, Dengue virus
GKKVIQLS

SEQ ID NO: 77058 - protein, 8 aa, Dengue virus
KKVIQLSR

SEQ ID NO: 77059 - protein, 8 aa, Dengue virus
KVIQLSRK

SEQ ID NO: 77060 - protein, 8 aa, Dengue virus
VIQLSRKT

SEQ ID NO: 77061 - protein, 8 aa, Dengue virus
IQLSRKTF

SEQ ID NO: 77062 - protein, 8 aa, Dengue virus
QLSRKTFD

SEQ ID NO: 77063 - protein, 8 aa, Dengue virus
LSRKTFDT

SEQ ID NO: 77064 - protein, 8 aa, Dengue virus
SRKTFDTE

SEQ ID NO: 77065 - protein, 8 aa, Dengue virus
RKTFDTEY

SEQ ID NO: 77066 - protein, 8 aa, Dengue virus
KTFDTEYP

SEQ ID NO: 77067 - protein, 8 aa, Dengue virus
TFDTEYPK

SEQ ID NO: 77068 - protein, 8 aa, Dengue virus
FDTEYPKT

SEQ ID NO: 77069 - protein, 8 aa, Dengue virus
DTEYPKTK

SEQ ID NO: 77070 - protein, 8 aa, Dengue virus
TEYPKTKL

SEQ ID NO: 77071 - protein, 8 aa, Dengue virus
EYPKTKLT

SEQ ID NO: 77072 - protein, 8 aa, Dengue virus
YPKTKLTD

SEQ ID NO: 77073 - protein, 8 aa, Dengue virus
PKTKLTDW

SEQ ID NO: 77074 - protein, 8 aa, Dengue virus
KTKLTDWD

SEQ ID NO: 77075 - protein, 8 aa, Dengue virus
TKLTDWDF

SEQ ID NO: 77076 - protein, 8 aa, Dengue virus
KLTDWDFV

SEQ ID NO: 77077 - protein, 8 aa, Dengue virus
LTDWDFVV

SEQ ID NO: 77078 - protein, 8 aa, Dengue virus
TDWDFVVT

SEQ ID NO: 77079 - protein, 8 aa, Dengue virus
DWDFVVTT

SEQ ID NO: 77080 - protein, 8 aa, Dengue virus
WDFVVTTD

SEQ ID NO: 77081 - protein, 8 aa, Dengue virus
DFVVTTDI

SEQ ID NO: 77082 - protein, 8 aa, Dengue virus
FVVTTDIS

SEQ ID NO: 77083 - protein, 8 aa, Dengue virus
VVTTDISE

SEQ ID NO: 77084 - protein, 8 aa, Dengue virus
VTTDISEM

SEQ ID NO: 77085 - protein, 8 aa, Dengue virus
TTDISEMG

SEQ ID NO: 77086 - protein, 8 aa, Dengue virus
TDISEMGA

SEQ ID NO: 77087 - protein, 8 aa, Dengue virus
DISEMGAN

SEQ ID NO: 77088 - protein, 8 aa, Dengue virus
ISEMGANF

SEQ ID NO: 77089 - protein, 8 aa, Dengue virus
SEMGANFR

SEQ ID NO: 77090 - protein, 8 aa, Dengue virus
EMGANFRA

SEQ ID NO: 77091 - protein, 8 aa, Dengue virus
MGANFRAG

SEQ ID NO: 77092 - protein, 8 aa, Dengue virus
GANFRAGR

SEQ ID NO: 77093 - protein, 8 aa, Dengue virus
ANFRAGRV

SEQ ID NO: 77094 - protein, 8 aa, Dengue virus
NFRAGRVI

SEQ ID NO: 77095 - protein, 8 aa, Dengue virus
FRAGRVID

SEQ ID NO: 77096 - protein, 8 aa, Dengue virus
RAGRVIDP

SEQ ID NO: 77097 - protein, 8 aa, Dengue virus
AGRVIDPR

SEQ ID NO: 77098 - protein, 8 aa, Dengue virus
GRVIDPRR

SEQ ID NO: 77099 - protein, 8 aa, Dengue virus
RVIDPRRC

SEQ ID NO: 77100 - protein, 8 aa, Dengue virus
VIDPRRCL

SEQ ID NO: 77101 - protein, 8 aa, Dengue virus
IDPRRCLK

SEQ ID NO: 77102 - protein, 8 aa, Dengue virus
DPRRCLKP

SEQ ID NO: 77103 - protein, 8 aa, Dengue virus
PRRCLKPV

SEQ ID NO: 77104 - protein, 8 aa, Dengue virus
RRCLKPVI

SEQ ID NO: 77105 - protein, 8 aa, Dengue virus
RCLKPVIL

SEQ ID NO: 77106 - protein, 8 aa, Dengue virus
CLKPVILT

SEQ ID NO: 77107 - protein, 8 aa, Dengue virus
LKPVILTD

SEQ ID NO: 77108 - protein, 8 aa, Dengue virus
KPVILTDG

SEQ ID NO: 77109 - protein, 8 aa, Dengue virus
PVILTDGP

SEQ ID NO: 77110 - protein, 8 aa, Dengue virus
VILTDGPE

SEQ ID NO: 77111 - protein, 8 aa, Dengue virus
ILTDGPER

SEQ ID NO: 77112 - protein, 8 aa, Dengue virus
LTDGPERV

SEQ ID NO: 77113 - protein, 8 aa, Dengue virus
TDGPERVI

SEQ ID NO: 77114 - protein, 8 aa, Dengue virus
DGPERVIL

SEQ ID NO: 77115 - protein, 8 aa, Dengue virus
GPERVILA

SEQ ID NO: 77116 - protein, 8 aa, Dengue virus
PERVILAG

SEQ ID NO: 77117 - protein, 8 aa, Dengue virus
ERVILAGP

SEQ ID NO: 77118 - protein, 8 aa, Dengue virus
RVILAGPI

SEQ ID NO: 77119 - protein, 8 aa, Dengue virus
VILAGPIP

SEQ ID NO: 77120 - protein, 8 aa, Dengue virus
ILAGPIPV

SEQ ID NO: 77121 - protein, 8 aa, Dengue virus
LAGPIPVT

SEQ ID NO: 77122 - protein, 8 aa, Dengue virus
AGPIPVTP

SEQ ID NO: 77123 - protein, 8 aa, Dengue virus
GPIPVTPA

SEQ ID NO: 77124 - protein, 8 aa, Dengue virus
PIPVTPAS

SEQ ID NO: 77125 - protein, 8 aa, Dengue virus
IPVTPASA

SEQ ID NO: 77126 - protein, 8 aa, Dengue virus
PVTPASAA

SEQ ID NO: 77127 - protein, 8 aa, Dengue virus
VTPASAAQ

SEQ ID NO: 77128 - protein, 8 aa, Dengue virus
TPASAAQR

SEQ ID NO: 77129 - protein, 8 aa, Dengue virus
PASAAQRR

SEQ ID NO: 77130 - protein, 8 aa, Dengue virus
ASAAQRRG

SEQ ID NO: 77131 - protein, 8 aa, Dengue virus
SAAQRRGR

SEQ ID NO: 77132 - protein, 8 aa, Dengue virus
AAQRRGRI

SEQ ID NO: 77133 - protein, 8 aa, Dengue virus
AQRRGRIG

SEQ ID NO: 77134 - protein, 8 aa, Dengue virus
QRRGRIGR

SEQ ID NO: 77135 - protein, 8 aa, Dengue virus
RRGRIGRN

SEQ ID NO: 77136 - protein, 8 aa, Dengue virus
RGRIGRNP

SEQ ID NO: 77137 - protein, 8 aa, Dengue virus
GRIGRNPA

SEQ ID NO: 77138 - protein, 8 aa, Dengue virus
RIGRNPAQ

SEQ ID NO: 77139 - protein, 8 aa, Dengue virus
IGRNPAQE

SEQ ID NO: 77140 - protein, 8 aa, Dengue virus
GRNPAQED

SEQ ID NO: 77141 - protein, 8 aa, Dengue virus
RNPAQEDD

SEQ ID NO: 77142 - protein, 8 aa, Dengue virus
NPAQEDDQ

SEQ ID NO: 77143 - protein, 8 aa, Dengue virus
PAQEDDQY

SEQ ID NO: 77144 - protein, 8 aa, Dengue virus
AQEDDQYV

SEQ ID NO: 77145 - protein, 8 aa, Dengue virus
QEDDQYVF

SEQ ID NO: 77146 - protein, 8 aa, Dengue virus
EDDQYVFS

SEQ ID NO: 77147 - protein, 8 aa, Dengue virus
DDQYVFSG

SEQ ID NO: 77148 - protein, 8 aa, Dengue virus
DQYVFSGD

SEQ ID NO: 77149 - protein, 8 aa, Dengue virus
QYVFSGDP

SEQ ID NO: 77150 - protein, 8 aa, Dengue virus
YVFSGDPL

SEQ ID NO: 77151 - protein, 8 aa, Dengue virus
VFSGDPLK

SEQ ID NO: 77152 - protein, 8 aa, Dengue virus
FSGDPLKN

SEQ ID NO: 77153 - protein, 8 aa, Dengue virus
SGDPLKND

SEQ ID NO: 77154 - protein, 8 aa, Dengue virus
GDPLKNDE

SEQ ID NO: 77155 - protein, 8 aa, Dengue virus
DPLKNDED

SEQ ID NO: 77156 - protein, 8 aa, Dengue virus
PLKNDEDH

SEQ ID NO: 77157 - protein, 8 aa, Dengue virus
LKNDEDHA

SEQ ID NO: 77158 - protein, 8 aa, Dengue virus
KNDEDHAH

SEQ ID NO: 77159 - protein, 8 aa, Dengue virus
NDEDHAHW

SEQ ID NO: 77160 - protein, 8 aa, Dengue virus
DEDHAHWT

SEQ ID NO: 77161 - protein, 8 aa, Dengue virus
EDHAHWTE

SEQ ID NO: 77162 - protein, 8 aa, Dengue virus
DHAHWTEA

SEQ ID NO: 77163 - protein, 8 aa, Dengue virus
HAHWTEAK

SEQ ID NO: 77164 - protein, 8 aa, Dengue virus
AHWTEAKM

SEQ ID NO: 77165 - protein, 8 aa, Dengue virus
HWTEAKML

SEQ ID NO: 77166 - protein, 8 aa, Dengue virus
WTEAKMLL

SEQ ID NO: 77167 - protein, 8 aa, Dengue virus
TEAKMLLD

SEQ ID NO: 77168 - protein, 8 aa, Dengue virus
EAKMLLDN

SEQ ID NO: 77169 - protein, 8 aa, Dengue virus
AKMLLDNI

SEQ ID NO: 77170 - protein, 8 aa, Dengue virus
KMLLDNIY

SEQ ID NO: 77171 - protein, 8 aa, Dengue virus
MLLDNIYT

SEQ ID NO: 77172 - protein, 8 aa, Dengue virus
LLDNIYTP

SEQ ID NO: 77173 - protein, 8 aa, Dengue virus
LDNIYTPE

SEQ ID NO: 77174 - protein, 8 aa, Dengue virus
DNIYTPEG

SEQ ID NO: 77175 - protein, 8 aa, Dengue virus
NIYTPEGI

SEQ ID NO: 77176 - protein, 8 aa, Dengue virus
IYTPEGII

SEQ ID NO: 77177 - protein, 8 aa, Dengue virus
YTPEGIIP

SEQ ID NO: 77178 - protein, 8 aa, Dengue virus
TPEGIIPT

SEQ ID NO: 77179 - protein, 8 aa, Dengue virus
PEGIIPTL

SEQ ID NO: 77180 - protein, 8 aa, Dengue virus
EGIIPTLF

SEQ ID NO: 77181 - protein, 8 aa, Dengue virus
GIIPTLFG

SEQ ID NO: 77182 - protein, 8 aa, Dengue virus
IIPTLFGP

SEQ ID NO: 77183 - protein, 8 aa, Dengue virus
IPTLFGPE

SEQ ID NO: 77184 - protein, 8 aa, Dengue virus
PTLFGPER

SEQ ID NO: 77185 - protein, 8 aa, Dengue virus
TLFGPERE

SEQ ID NO: 77186 - protein, 8 aa, Dengue virus
LFGPEREK

SEQ ID NO: 77187 - protein, 8 aa, Dengue virus
FGPEREKT

SEQ ID NO: 77188 - protein, 8 aa, Dengue virus
GPEREKTQ

SEQ ID NO: 77189 - protein, 8 aa, Dengue virus
PEREKTQA

SEQ ID NO: 77190 - protein, 8 aa, Dengue virus
EREKTQAI

SEQ ID NO: 77191 - protein, 8 aa, Dengue virus
REKTQAID

SEQ ID NO: 77192 - protein, 8 aa, Dengue virus
EKTQAIDG

SEQ ID NO: 77193 - protein, 8 aa, Dengue virus
KTQAIDGE

SEQ ID NO: 77194 - protein, 8 aa, Dengue virus
TQAIDGEF

SEQ ID NO: 77195 - protein, 8 aa, Dengue virus
QAIDGEFR

SEQ ID NO: 77196 - protein, 8 aa, Dengue virus
AIDGEFRL

SEQ ID NO: 77197 - protein, 8 aa, Dengue virus
IDGEFRLR

SEQ ID NO: 77198 - protein, 8 aa, Dengue virus
DGEFRLRG

SEQ ID NO: 77199 - protein, 8 aa, Dengue virus
GEFRLRGE

SEQ ID NO: 77200 - protein, 8 aa, Dengue virus
EFRLRGEQ

SEQ ID NO: 77201 - protein, 8 aa, Dengue virus
FRLRGEQR

SEQ ID NO: 77202 - protein, 8 aa, Dengue virus
RLRGEQRK

SEQ ID NO: 77203 - protein, 8 aa, Dengue virus
LRGEQRKT

SEQ ID NO: 77204 - protein, 8 aa, Dengue virus
RGEQRKTF

SEQ ID NO: 77205 - protein, 8 aa, Dengue virus
GEQRKTFV

SEQ ID NO: 77206 - protein, 8 aa, Dengue virus
EQRKTFVE

SEQ ID NO: 77207 - protein, 8 aa, Dengue virus
QRKTFVEL

SEQ ID NO: 77208 - protein, 8 aa, Dengue virus
RKTFVELM

SEQ ID NO: 77209 - protein, 8 aa, Dengue virus
KTFVELMR

SEQ ID NO: 77210 - protein, 8 aa, Dengue virus
TFVELMRR

SEQ ID NO: 77211 - protein, 8 aa, Dengue virus
FVELMRRG

SEQ ID NO: 77212 - protein, 8 aa, Dengue virus
VELMRRGD

SEQ ID NO: 77213 - protein, 8 aa, Dengue virus
ELMRRGDL

SEQ ID NO: 77214 - protein, 8 aa, Dengue virus
LMRRGDLP

SEQ ID NO: 77215 - protein, 8 aa, Dengue virus
MRRGDLPV

SEQ ID NO: 77216 - protein, 8 aa, Dengue virus
RRGDLPVW

SEQ ID NO: 77217 - protein, 8 aa, Dengue virus
RGDLPVWL

SEQ ID NO: 77218 - protein, 8 aa, Dengue virus
GDLPVWLS

SEQ ID NO: 77219 - protein, 8 aa, Dengue virus
DLPVWLSY

SEQ ID NO: 77220 - protein, 8 aa, Dengue virus
LPVWLSYK

SEQ ID NO: 77221 - protein, 8 aa, Dengue virus
PVWLSYKV

SEQ ID NO: 77222 - protein, 8 aa, Dengue virus
VWLSYKVA

SEQ ID NO: 77223 - protein, 8 aa, Dengue virus
WLSYKVAS

SEQ ID NO: 77224 - protein, 8 aa, Dengue virus
LSYKVASA

SEQ ID NO: 77225 - protein, 8 aa, Dengue virus
SYKVASAG

SEQ ID NO: 77226 - protein, 8 aa, Dengue virus
YKVASAGI

SEQ ID NO: 77227 - protein, 8 aa, Dengue virus
KVASAGIS

SEQ ID NO: 77228 - protein, 8 aa, Dengue virus
VASAGISY

SEQ ID NO: 77229 - protein, 8 aa, Dengue virus
ASAGISYK

SEQ ID NO: 77230 - protein, 8 aa, Dengue virus
SAGISYKD

SEQ ID NO: 77231 - protein, 8 aa, Dengue virus
AGISYKDR

SEQ ID NO: 77232 - protein, 8 aa, Dengue virus
GISYKDRE

SEQ ID NO: 77233 - protein, 8 aa, Dengue virus
ISYKDREW

SEQ ID NO: 77234 - protein, 8 aa, Dengue virus
SYKDREWC

SEQ ID NO: 77235 - protein, 8 aa, Dengue virus
YKDREWCF

SEQ ID NO: 77236 - protein, 8 aa, Dengue virus
KDREWCFT

SEQ ID NO: 77237 - protein, 8 aa, Dengue virus
DREWCFTG

SEQ ID NO: 77238 - protein, 8 aa, Dengue virus
REWCFTGE

SEQ ID NO: 77239 - protein, 8 aa, Dengue virus
EWCFTGER

SEQ ID NO: 77240 - protein, 8 aa, Dengue virus
WCFTGERN

SEQ ID NO: 77241 - protein, 8 aa, Dengue virus
CFTGERNN

SEQ ID NO: 77242 - protein, 8 aa, Dengue virus
FTGERNNQ

SEQ ID NO: 77243 - protein, 8 aa, Dengue virus
TGERNNQI

SEQ ID NO: 77244 - protein, 8 aa, Dengue virus
GERNNQIL

SEQ ID NO: 77245 - protein, 8 aa, Dengue virus
ERNNQILE

SEQ ID NO: 77246 - protein, 8 aa, Dengue virus
RNNQILEE

SEQ ID NO: 77247 - protein, 8 aa, Dengue virus
NNQILEEN

SEQ ID NO: 77248 - protein, 8 aa, Dengue virus
NQILEENM

SEQ ID NO: 77249 - protein, 8 aa, Dengue virus
QILEENME

SEQ ID NO: 77250 - protein, 8 aa, Dengue virus
ILEENMEV

SEQ ID NO: 77251 - protein, 8 aa, Dengue virus
LEENMEVE

SEQ ID NO: 77252 - protein, 8 aa, Dengue virus
EENMEVEI

SEQ ID NO: 77253 - protein, 8 aa, Dengue virus
ENMEVEIW

SEQ ID NO: 77254 - protein, 8 aa, Dengue virus
NMEVEIWT

SEQ ID NO: 77255 - protein, 8 aa, Dengue virus
MEVEIWTR

SEQ ID NO: 77256 - protein, 8 aa, Dengue virus
EVEIWTRE

SEQ ID NO: 77257 - protein, 8 aa, Dengue virus
VEIWTREG

SEQ ID NO: 77258 - protein, 8 aa, Dengue virus
EIWTREGE

SEQ ID NO: 77259 - protein, 8 aa, Dengue virus
IWTREGEK

SEQ ID NO: 77260 - protein, 8 aa, Dengue virus
WTREGEKK

SEQ ID NO: 77261 - protein, 8 aa, Dengue virus
TREGEKKK

SEQ ID NO: 77262 - protein, 8 aa, Dengue virus
REGEKKKL

SEQ ID NO: 77263 - protein, 8 aa, Dengue virus
EGEKKKLR

SEQ ID NO: 77264 - protein, 8 aa, Dengue virus
GEKKKLRP

SEQ ID NO: 77265 - protein, 8 aa, Dengue virus
EKKKLRPR

SEQ ID NO: 77266 - protein, 8 aa, Dengue virus
KKKLRPRW

SEQ ID NO: 77267 - protein, 8 aa, Dengue virus
KKLRPRWL

SEQ ID NO: 77268 - protein, 8 aa, Dengue virus
KLRPRWLD

SEQ ID NO: 77269 - protein, 8 aa, Dengue virus
LRPRWLDA

SEQ ID NO: 77270 - protein, 8 aa, Dengue virus
RPRWLDAR

SEQ ID NO: 77271 - protein, 8 aa, Dengue virus
PRWLDARV

SEQ ID NO: 77272 - protein, 8 aa, Dengue virus
RWLDARVY

SEQ ID NO: 77273 - protein, 8 aa, Dengue virus
WLDARVYA

SEQ ID NO: 77274 - protein, 8 aa, Dengue virus
LDARVYAD

SEQ ID NO: 77275 - protein, 8 aa, Dengue virus
DARVYADP

SEQ ID NO: 77276 - protein, 8 aa, Dengue virus
ARVYADPM

SEQ ID NO: 77277 - protein, 8 aa, Dengue virus
RVYADPMA

SEQ ID NO: 77278 - protein, 8 aa, Dengue virus
VYADPMAL

SEQ ID NO: 77279 - protein, 8 aa, Dengue virus
YADPMALK

SEQ ID NO: 77280 - protein, 8 aa, Dengue virus
ADPMALKD

SEQ ID NO: 77281 - protein, 8 aa, Dengue virus
DPMALKDF

SEQ ID NO: 77282 - protein, 8 aa, Dengue virus
PMALKDFK

SEQ ID NO: 77283 - protein, 8 aa, Dengue virus
MALKDFKE

SEQ ID NO: 77284 - protein, 8 aa, Dengue virus
ALKDFKEF

SEQ ID NO: 77285 - protein, 8 aa, Dengue virus
LKDFKEFA

SEQ ID NO: 77286 - protein, 8 aa, Dengue virus
KDFKEFAS

SEQ ID NO: 77287 - protein, 8 aa, Dengue virus
DFKEFASG

SEQ ID NO: 77288 - protein, 8 aa, Dengue virus
FKEFASGR

SEQ ID NO: 77289 - protein, 8 aa, Dengue virus
KEFASGRK

SEQ ID NO: 77290 - protein, 8 aa, Dengue virus
EFASGRKS

SEQ ID NO: 77291 - protein, 8 aa, Dengue virus
FASGRKSI

SEQ ID NO: 77292 - protein, 8 aa, Dengue virus
ASGRKSIT

SEQ ID NO: 77293 - protein, 8 aa, Dengue virus
SGRKSITL

SEQ ID NO: 77294 - protein, 8 aa, Dengue virus
GRKSITLD

SEQ ID NO: 77295 - protein, 8 aa, Dengue virus
RKSITLDI

SEQ ID NO: 77296 - protein, 8 aa, Dengue virus
KSITLDIL

SEQ ID NO: 77297 - protein, 8 aa, Dengue virus
SITLDILT

SEQ ID NO: 77298 - protein, 8 aa, Dengue virus
ITLDILTE

SEQ ID NO: 77299 - protein, 8 aa, Dengue virus
TLDILTEI

SEQ ID NO: 77300 - protein, 8 aa, Dengue virus
LDILTEIA

SEQ ID NO: 77301 - protein, 8 aa, Dengue virus
DILTEIAS

SEQ ID NO: 77302 - protein, 8 aa, Dengue virus
ILTEIASL

SEQ ID NO: 77303 - protein, 8 aa, Dengue virus
LTEIASLP

SEQ ID NO: 77304 - protein, 8 aa, Dengue virus
TEIASLPT

SEQ ID NO: 77305 - protein, 8 aa, Dengue virus
EIASLPTY

SEQ ID NO: 77306 - protein, 8 aa, Dengue virus
IASLPTYL

SEQ ID NO: 77307 - protein, 8 aa, Dengue virus
ASLPTYLS

SEQ ID NO: 77308 - protein, 8 aa, Dengue virus
SLPTYLSS

SEQ ID NO: 77309 - protein, 8 aa, Dengue virus
LPTYLSSR

SEQ ID NO: 77310 - protein, 8 aa, Dengue virus
PTYLSSRA

SEQ ID NO: 77311 - protein, 8 aa, Dengue virus
TYLSSRAK

SEQ ID NO: 77312 - protein, 8 aa, Dengue virus
YLSSRAKL

SEQ ID NO: 77313 - protein, 8 aa, Dengue virus
LSSRAKLA

SEQ ID NO: 77314 - protein, 8 aa, Dengue virus
SSRAKLAL

SEQ ID NO: 77315 - protein, 8 aa, Dengue virus
SRAKLALD

SEQ ID NO: 77316 - protein, 8 aa, Dengue virus
RAKLALDN

SEQ ID NO: 77317 - protein, 8 aa, Dengue virus
AKLALDNI

SEQ ID NO: 77318 - protein, 8 aa, Dengue virus
KLALDNIV

SEQ ID NO: 77319 - protein, 8 aa, Dengue virus
LALDNIVM

SEQ ID NO: 77320 - protein, 8 aa, Dengue virus
ALDNIVML

SEQ ID NO: 77321 - protein, 8 aa, Dengue virus
LDNIVMLH

SEQ ID NO: 77322 - protein, 8 aa, Dengue virus
DNIVMLHT

SEQ ID NO: 77323 - protein, 8 aa, Dengue virus
NIVMLHTT

SEQ ID NO: 77324 - protein, 8 aa, Dengue virus
IVMLHTTE

SEQ ID NO: 77325 - protein, 8 aa, Dengue virus
VMLHTTER

SEQ ID NO: 77326 - protein, 8 aa, Dengue virus
MLHTTERG

SEQ ID NO: 77327 - protein, 8 aa, Dengue virus
LHTTERGG

SEQ ID NO: 77328 - protein, 8 aa, Dengue virus
HTTERGGR

SEQ ID NO: 77329 - protein, 8 aa, Dengue virus
TTERGGRA

SEQ ID NO: 77330 - protein, 8 aa, Dengue virus
TERGGRAY

SEQ ID NO: 77331 - protein, 8 aa, Dengue virus
ERGGRAYQ

SEQ ID NO: 77332 - protein, 8 aa, Dengue virus
RGGRAYQH

SEQ ID NO: 77333 - protein, 8 aa, Dengue virus
GGRAYQHA

SEQ ID NO: 77334 - protein, 8 aa, Dengue virus
GRAYQHAL

SEQ ID NO: 77335 - protein, 8 aa, Dengue virus
RAYQHALN

SEQ ID NO: 77336 - protein, 8 aa, Dengue virus
AYQHALNE

SEQ ID NO: 77337 - protein, 8 aa, Dengue virus
YQHALNEL

SEQ ID NO: 77338 - protein, 8 aa, Dengue virus
QHALNELP

SEQ ID NO: 77339 - protein, 8 aa, Dengue virus
HALNELPE

SEQ ID NO: 77340 - protein, 8 aa, Dengue virus
ALNELPES

SEQ ID NO: 77341 - protein, 8 aa, Dengue virus
LNELPESL

SEQ ID NO: 77342 - protein, 8 aa, Dengue virus
NELPESLE

SEQ ID NO: 77343 - protein, 8 aa, Dengue virus
ELPESLET

SEQ ID NO: 77344 - protein, 8 aa, Dengue virus
LPESLETL

SEQ ID NO: 77345 - protein, 8 aa, Dengue virus
PESLETLM

SEQ ID NO: 77346 - protein, 8 aa, Dengue virus
ESLETLML

SEQ ID NO: 77347 - protein, 8 aa, Dengue virus
SLETLMLV

SEQ ID NO: 77348 - protein, 8 aa, Dengue virus
LETLMLVA

SEQ ID NO: 77349 - protein, 8 aa, Dengue virus
ETLMLVAL

SEQ ID NO: 77350 - protein, 8 aa, Dengue virus
TLMLVALL

SEQ ID NO: 77351 - protein, 8 aa, Dengue virus
LMLVALLG

SEQ ID NO: 77352 - protein, 8 aa, Dengue virus
MLVALLGA

SEQ ID NO: 77353 - protein, 8 aa, Dengue virus
LVALLGAM

SEQ ID NO: 77354 - protein, 8 aa, Dengue virus
VALLGAMT

SEQ ID NO: 77355 - protein, 8 aa, Dengue virus
ALLGAMTA

SEQ ID NO: 77356 - protein, 8 aa, Dengue virus
LLGAMTAG

SEQ ID NO: 77357 - protein, 8 aa, Dengue virus
LGAMTAGI

SEQ ID NO: 77358 - protein, 8 aa, Dengue virus
GAMTAGIF

SEQ ID NO: 77359 - protein, 8 aa, Dengue virus
AMTAGIFL

SEQ ID NO: 77360 - protein, 8 aa, Dengue virus
MTAGIFLF

SEQ ID NO: 77361 - protein, 8 aa, Dengue virus
TAGIFLFF

SEQ ID NO: 77362 - protein, 8 aa, Dengue virus
AGIFLFFM

SEQ ID NO: 77363 - protein, 8 aa, Dengue virus
GIFLFFMQ

SEQ ID NO: 77364 - protein, 8 aa, Dengue virus
IFLFFMQG

SEQ ID NO: 77365 - protein, 8 aa, Dengue virus
FLFFMQGK

SEQ ID NO: 77366 - protein, 8 aa, Dengue virus
LFFMQGKG

SEQ ID NO: 77367 - protein, 8 aa, Dengue virus
FFMQGKGI

SEQ ID NO: 77368 - protein, 8 aa, Dengue virus
FMQGKGIG

SEQ ID NO: 77369 - protein, 8 aa, Dengue virus
MQGKGIGK

SEQ ID NO: 77370 - protein, 8 aa, Dengue virus
QGKGIGKL

SEQ ID NO: 77371 - protein, 8 aa, Dengue virus
GKGIGKLS

SEQ ID NO: 77372 - protein, 8 aa, Dengue virus
KGIGKLSM

SEQ ID NO: 77373 - protein, 8 aa, Dengue virus
GIGKLSMG

SEQ ID NO: 77374 - protein, 8 aa, Dengue virus
IGKLSMGL

SEQ ID NO: 77375 - protein, 8 aa, Dengue virus
GKLSMGLI

SEQ ID NO: 77376 - protein, 8 aa, Dengue virus
KLSMGLIT

SEQ ID NO: 77377 - protein, 8 aa, Dengue virus
LSMGLITI

SEQ ID NO: 77378 - protein, 8 aa, Dengue virus
SMGLITIA

SEQ ID NO: 77379 - protein, 8 aa, Dengue virus
MGLITIAV

SEQ ID NO: 77380 - protein, 8 aa, Dengue virus
GLITIAVA

SEQ ID NO: 77381 - protein, 8 aa, Dengue virus
LITIAVAS

SEQ ID NO: 77382 - protein, 8 aa, Dengue virus
ITIAVASG

SEQ ID NO: 77383 - protein, 8 aa, Dengue virus
TIAVASGL

SEQ ID NO: 77384 - protein, 8 aa, Dengue virus
IAVASGLL

SEQ ID NO: 77385 - protein, 8 aa, Dengue virus
AVASGLLW

SEQ ID NO: 77386 - protein, 8 aa, Dengue virus
VASGLLWV

SEQ ID NO: 77387 - protein, 8 aa, Dengue virus
ASGLLWVA

SEQ ID NO: 77388 - protein, 8 aa, Dengue virus
SGLLWVAE

SEQ ID NO: 77389 - protein, 8 aa, Dengue virus
GLLWVAEI

SEQ ID NO: 77390 - protein, 8 aa, Dengue virus
LLWVAEIQ

SEQ ID NO: 77391 - protein, 8 aa, Dengue virus
LWVAEIQP

SEQ ID NO: 77392 - protein, 8 aa, Dengue virus
WVAEIQPQ

SEQ ID NO: 77393 - protein, 8 aa, Dengue virus
VAEIQPQW

SEQ ID NO: 77394 - protein, 8 aa, Dengue virus
AEIQPQWI

SEQ ID NO: 77395 - protein, 8 aa, Dengue virus
EIQPQWIA

SEQ ID NO: 77396 - protein, 8 aa, Dengue virus
IQPQWIAA

SEQ ID NO: 77397 - protein, 8 aa, Dengue virus
QPQWIAAS

SEQ ID NO: 77398 - protein, 8 aa, Dengue virus
PQWIAASI

SEQ ID NO: 77399 - protein, 8 aa, Dengue virus
QWIAASII

SEQ ID NO: 77400 - protein, 8 aa, Dengue virus
WIAASIIL

SEQ ID NO: 77401 - protein, 8 aa, Dengue virus
IAASIILE

SEQ ID NO: 77402 - protein, 8 aa, Dengue virus
AASIILEF

SEQ ID NO: 77403 - protein, 8 aa, Dengue virus
ASIILEFF

SEQ ID NO: 77404 - protein, 8 aa, Dengue virus
SIILEFFL

SEQ ID NO: 77405 - protein, 8 aa, Dengue virus
IILEFFLM

SEQ ID NO: 77406 - protein, 8 aa, Dengue virus
ILEFFLMV

SEQ ID NO: 77407 - protein, 8 aa, Dengue virus
LEFFLMVL

SEQ ID NO: 77408 - protein, 8 aa, Dengue virus
EFFLMVLL

SEQ ID NO: 77409 - protein, 8 aa, Dengue virus
FFLMVLLI

SEQ ID NO: 77410 - protein, 8 aa, Dengue virus
FLMVLLIP

SEQ ID NO: 77411 - protein, 8 aa, Dengue virus
LMVLLIPE

SEQ ID NO: 77412 - protein, 8 aa, Dengue virus
MVLLIPEP

SEQ ID NO: 77413 - protein, 8 aa, Dengue virus
VLLIPEPE

SEQ ID NO: 77414 - protein, 8 aa, Dengue virus
LLIPEPEK

SEQ ID NO: 77415 - protein, 8 aa, Dengue virus
LIPEPEKQ

SEQ ID NO: 77416 - protein, 8 aa, Dengue virus
IPEPEKQR

SEQ ID NO: 77417 - protein, 8 aa, Dengue virus
PEPEKQRT

SEQ ID NO: 77418 - protein, 8 aa, Dengue virus
EPEKQRTP

SEQ ID NO: 77419 - protein, 8 aa, Dengue virus
PEKQRTPQ

SEQ ID NO: 77420 - protein, 8 aa, Dengue virus
EKQRTPQD

SEQ ID NO: 77421 - protein, 8 aa, Dengue virus
KQRTPQDN

SEQ ID NO: 77422 - protein, 8 aa, Dengue virus
QRTPQDNQ

SEQ ID NO: 77423 - protein, 8 aa, Dengue virus
RTPQDNQL

SEQ ID NO: 77424 - protein, 8 aa, Dengue virus
TPQDNQLI

SEQ ID NO: 77425 - protein, 8 aa, Dengue virus
PQDNQLIY

SEQ ID NO: 77426 - protein, 8 aa, Dengue virus
QDNQLIYV

SEQ ID NO: 77427 - protein, 8 aa, Dengue virus
DNQLIYVI

SEQ ID NO: 77428 - protein, 8 aa, Dengue virus
NQLIYVIL

SEQ ID NO: 77429 - protein, 8 aa, Dengue virus
QLIYVILT

SEQ ID NO: 77430 - protein, 8 aa, Dengue virus
LIYVILTI

SEQ ID NO: 77431 - protein, 8 aa, Dengue virus
IYVILTIL

SEQ ID NO: 77432 - protein, 8 aa, Dengue virus
YVILTILT

SEQ ID NO: 77433 - protein, 8 aa, Dengue virus
VILTILTI

SEQ ID NO: 77434 - protein, 8 aa, Dengue virus
ILTILTII

SEQ ID NO: 77435 - protein, 8 aa, Dengue virus
LTILTIIG

SEQ ID NO: 77436 - protein, 8 aa, Dengue virus
TILTIIGL

SEQ ID NO: 77437 - protein, 8 aa, Dengue virus
ILTIIGLI

SEQ ID NO: 77438 - protein, 8 aa, Dengue virus
LTIIGLIA

SEQ ID NO: 77439 - protein, 8 aa, Dengue virus
TIIGLIAA

SEQ ID NO: 77440 - protein, 8 aa, Dengue virus
IIGLIAAN

SEQ ID NO: 77441 - protein, 8 aa, Dengue virus
IGLIAANE

SEQ ID NO: 77442 - protein, 8 aa, Dengue virus
GLIAANEM

SEQ ID NO: 77443 - protein, 8 aa, Dengue virus
LIAANEMG

SEQ ID NO: 77444 - protein, 8 aa, Dengue virus
IAANEMGL

SEQ ID NO: 77445 - protein, 8 aa, Dengue virus
AANEMGLI

SEQ ID NO: 77446 - protein, 8 aa, Dengue virus
ANEMGLIE

SEQ ID NO: 77447 - protein, 8 aa, Dengue virus
NEMGLIEK

SEQ ID NO: 77448 - protein, 8 aa, Dengue virus
EMGLIEKT

SEQ ID NO: 77449 - protein, 8 aa, Dengue virus
MGLIEKTK

SEQ ID NO: 77450 - protein, 8 aa, Dengue virus
GLIEKTKT

SEQ ID NO: 77451 - protein, 8 aa, Dengue virus
LIEKTKTD

SEQ ID NO: 77452 - protein, 8 aa, Dengue virus
IEKTKTDF

SEQ ID NO: 77453 - protein, 8 aa, Dengue virus
EKTKTDFG

SEQ ID NO: 77454 - protein, 8 aa, Dengue virus
KTKTDFGF

SEQ ID NO: 77455 - protein, 8 aa, Dengue virus
TKTDFGFY

SEQ ID NO: 77456 - protein, 8 aa, Dengue virus
KTDFGFYQ

SEQ ID NO: 77457 - protein, 8 aa, Dengue virus
TDFGFYQV

SEQ ID NO: 77458 - protein, 8 aa, Dengue virus
DFGFYQVK

SEQ ID NO: 77459 - protein, 8 aa, Dengue virus
FGFYQVKT

SEQ ID NO: 77460 - protein, 8 aa, Dengue virus
GFYQVKTE

SEQ ID NO: 77461 - protein, 8 aa, Dengue virus
FYQVKTET

SEQ ID NO: 77462 - protein, 8 aa, Dengue virus
YQVKTETT

SEQ ID NO: 77463 - protein, 8 aa, Dengue virus
QVKTETTI

SEQ ID NO: 77464 - protein, 8 aa, Dengue virus
VKTETTIL

SEQ ID NO: 77465 - protein, 8 aa, Dengue virus
KTETTILD

SEQ ID NO: 77466 - protein, 8 aa, Dengue virus
TETTILDV

SEQ ID NO: 77467 - protein, 8 aa, Dengue virus
ETTILDVD

SEQ ID NO: 77468 - protein, 8 aa, Dengue virus
TTILDVDL

SEQ ID NO: 77469 - protein, 8 aa, Dengue virus
TILDVDLR

SEQ ID NO: 77470 - protein, 8 aa, Dengue virus
ILDVDLRP

SEQ ID NO: 77471 - protein, 8 aa, Dengue virus
LDVDLRPA

SEQ ID NO: 77472 - protein, 8 aa, Dengue virus
DVDLRPAS

SEQ ID NO: 77473 - protein, 8 aa, Dengue virus
VDLRPASA

SEQ ID NO: 77474 - protein, 8 aa, Dengue virus
DLRPASAW

SEQ ID NO: 77475 - protein, 8 aa, Dengue virus
LRPASAWT

SEQ ID NO: 77476 - protein, 8 aa, Dengue virus
RPASAWTL

SEQ ID NO: 77477 - protein, 8 aa, Dengue virus
PASAWTLY

SEQ ID NO: 77478 - protein, 8 aa, Dengue virus
ASAWTLYA

SEQ ID NO: 77479 - protein, 8 aa, Dengue virus
SAWTLYAV

SEQ ID NO: 77480 - protein, 8 aa, Dengue virus
AWTLYAVA

SEQ ID NO: 77481 - protein, 8 aa, Dengue virus
WTLYAVAT

SEQ ID NO: 77482 - protein, 8 aa, Dengue virus
TLYAVATT

SEQ ID NO: 77483 - protein, 8 aa, Dengue virus
LYAVATTI

SEQ ID NO: 77484 - protein, 8 aa, Dengue virus
YAVATTIL

SEQ ID NO: 77485 - protein, 8 aa, Dengue virus
AVATTILT

SEQ ID NO: 77486 - protein, 8 aa, Dengue virus
VATTILTP

SEQ ID NO: 77487 - protein, 8 aa, Dengue virus
ATTILTPM

SEQ ID NO: 77488 - protein, 8 aa, Dengue virus
TTILTPML

SEQ ID NO: 77489 - protein, 8 aa, Dengue virus
TILTPMLR

SEQ ID NO: 77490 - protein, 8 aa, Dengue virus
ILTPMLRH

SEQ ID NO: 77491 - protein, 8 aa, Dengue virus
LTPMLRHT

SEQ ID NO: 77492 - protein, 8 aa, Dengue virus
TPMLRHTI

SEQ ID NO: 77493 - protein, 8 aa, Dengue virus
PMLRHTIE

SEQ ID NO: 77494 - protein, 8 aa, Dengue virus
MLRHTIEN

SEQ ID NO: 77495 - protein, 8 aa, Dengue virus
LRHTIENT

SEQ ID NO: 77496 - protein, 8 aa, Dengue virus
RHTIENTS

SEQ ID NO: 77497 - protein, 8 aa, Dengue virus
HTIENTSA

SEQ ID NO: 77498 - protein, 8 aa, Dengue virus
TIENTSAN

SEQ ID NO: 77499 - protein, 8 aa, Dengue virus
IENTSANL

SEQ ID NO: 77500 - protein, 8 aa, Dengue virus
ENTSANLS

SEQ ID NO: 77501 - protein, 8 aa, Dengue virus
NTSANLSL

SEQ ID NO: 77502 - protein, 8 aa, Dengue virus
TSANLSLA

SEQ ID NO: 77503 - protein, 8 aa, Dengue virus
SANLSLAA

SEQ ID NO: 77504 - protein, 8 aa, Dengue virus
ANLSLAAI

SEQ ID NO: 77505 - protein, 8 aa, Dengue virus
NLSLAAIA

SEQ ID NO: 77506 - protein, 8 aa, Dengue virus
LSLAAIAN

SEQ ID NO: 77507 - protein, 8 aa, Dengue virus
SLAAIANQ

SEQ ID NO: 77508 - protein, 8 aa, Dengue virus
LAAIANQA

SEQ ID NO: 77509 - protein, 8 aa, Dengue virus
AAIANQAA

SEQ ID NO: 77510 - protein, 8 aa, Dengue virus
AIANQAAV

SEQ ID NO: 77511 - protein, 8 aa, Dengue virus
IANQAAVL

SEQ ID NO: 77512 - protein, 8 aa, Dengue virus
ANQAAVLM

SEQ ID NO: 77513 - protein, 8 aa, Dengue virus
NQAAVLMG

SEQ ID NO: 77514 - protein, 8 aa, Dengue virus
QAAVLMGL

SEQ ID NO: 77515 - protein, 8 aa, Dengue virus
AAVLMGLG

SEQ ID NO: 77516 - protein, 8 aa, Dengue virus
AVLMGLGK

SEQ ID NO: 77517 - protein, 8 aa, Dengue virus
VLMGLGKG

SEQ ID NO: 77518 - protein, 8 aa, Dengue virus
LMGLGKGW

SEQ ID NO: 77519 - protein, 8 aa, Dengue virus
MGLGKGWP

SEQ ID NO: 77520 - protein, 8 aa, Dengue virus
GLGKGWPL

SEQ ID NO: 77521 - protein, 8 aa, Dengue virus
LGKGWPLH

SEQ ID NO: 77522 - protein, 8 aa, Dengue virus
GKGWPLHR

SEQ ID NO: 77523 - protein, 8 aa, Dengue virus
KGWPLHRM

SEQ ID NO: 77524 - protein, 8 aa, Dengue virus
GWPLHRMD

SEQ ID NO: 77525 - protein, 8 aa, Dengue virus
WPLHRMDL

SEQ ID NO: 77526 - protein, 8 aa, Dengue virus
PLHRMDLG

SEQ ID NO: 77527 - protein, 8 aa, Dengue virus
LHRMDLGV

SEQ ID NO: 77528 - protein, 8 aa, Dengue virus
HRMDLGVP

SEQ ID NO: 77529 - protein, 8 aa, Dengue virus
RMDLGVPL

SEQ ID NO: 77530 - protein, 8 aa, Dengue virus
MDLGVPLL

SEQ ID NO: 77531 - protein, 8 aa, Dengue virus
DLGVPLLA

SEQ ID NO: 77532 - protein, 8 aa, Dengue virus
LGVPLLAM

SEQ ID NO: 77533 - protein, 8 aa, Dengue virus
GVPLLAMG

SEQ ID NO: 77534 - protein, 8 aa, Dengue virus
VPLLAMGC

SEQ ID NO: 77535 - protein, 8 aa, Dengue virus
PLLAMGCY

SEQ ID NO: 77536 - protein, 8 aa, Dengue virus
LLAMGCYS

SEQ ID NO: 77537 - protein, 8 aa, Dengue virus
LAMGCYSQ

SEQ ID NO: 77538 - protein, 8 aa, Dengue virus
AMGCYSQV

SEQ ID NO: 77539 - protein, 8 aa, Dengue virus
MGCYSQVN

SEQ ID NO: 77540 - protein, 8 aa, Dengue virus
GCYSQVNP

SEQ ID NO: 77541 - protein, 8 aa, Dengue virus
CYSQVNPT

SEQ ID NO: 77542 - protein, 8 aa, Dengue virus
YSQVNPTT

SEQ ID NO: 77543 - protein, 8 aa, Dengue virus
SQVNPTTL

SEQ ID NO: 77544 - protein, 8 aa, Dengue virus
QVNPTTLT

SEQ ID NO: 77545 - protein, 8 aa, Dengue virus
VNPTTLTA

SEQ ID NO: 77546 - protein, 8 aa, Dengue virus
NPTTLTAS

SEQ ID NO: 77547 - protein, 8 aa, Dengue virus
PTTLTASL

SEQ ID NO: 77548 - protein, 8 aa, Dengue virus
TTLTASLV

SEQ ID NO: 77549 - protein, 8 aa, Dengue virus
TLTASLVM

SEQ ID NO: 77550 - protein, 8 aa, Dengue virus
LTASLVML

SEQ ID NO: 77551 - protein, 8 aa, Dengue virus
TASLVMLL

SEQ ID NO: 77552 - protein, 8 aa, Dengue virus
ASLVMLLV

SEQ ID NO: 77553 - protein, 8 aa, Dengue virus
SLVMLLVH

SEQ ID NO: 77554 - protein, 8 aa, Dengue virus
LVMLLVHY

SEQ ID NO: 77555 - protein, 8 aa, Dengue virus
VMLLVHYA

SEQ ID NO: 77556 - protein, 8 aa, Dengue virus
MLLVHYAI

SEQ ID NO: 77557 - protein, 8 aa, Dengue virus
LLVHYAII

SEQ ID NO: 77558 - protein, 8 aa, Dengue virus
LVHYAIIG

SEQ ID NO: 77559 - protein, 8 aa, Dengue virus
VHYAIIGP

SEQ ID NO: 77560 - protein, 8 aa, Dengue virus
HYAIIGPG

SEQ ID NO: 77561 - protein, 8 aa, Dengue virus
YAIIGPGL

SEQ ID NO: 77562 - protein, 8 aa, Dengue virus
AIIGPGLQ

SEQ ID NO: 77563 - protein, 8 aa, Dengue virus
IIGPGLQA

SEQ ID NO: 77564 - protein, 8 aa, Dengue virus
IGPGLQAK

SEQ ID NO: 77565 - protein, 8 aa, Dengue virus
GPGLQAKA

SEQ ID NO: 77566 - protein, 8 aa, Dengue virus
PGLQAKAT

SEQ ID NO: 77567 - protein, 8 aa, Dengue virus
GLQAKATR

SEQ ID NO: 77568 - protein, 8 aa, Dengue virus
LQAKATRE

SEQ ID NO: 77569 - protein, 8 aa, Dengue virus
QAKATREA

SEQ ID NO: 77570 - protein, 8 aa, Dengue virus
AKATREAQ

SEQ ID NO: 77571 - protein, 8 aa, Dengue virus
KATREAQK

SEQ ID NO: 77572 - protein, 8 aa, Dengue virus
ATREAQKR

SEQ ID NO: 77573 - protein, 8 aa, Dengue virus
TREAQKRT

SEQ ID NO: 77574 - protein, 8 aa, Dengue virus
REAQKRTA

SEQ ID NO: 77575 - protein, 8 aa, Dengue virus
EAQKRTAA

SEQ ID NO: 77576 - protein, 8 aa, Dengue virus
AQKRTAAG

SEQ ID NO: 77577 - protein, 8 aa, Dengue virus
QKRTAAGI

SEQ ID NO: 77578 - protein, 8 aa, Dengue virus
KRTAAGIM

SEQ ID NO: 77579 - protein, 8 aa, Dengue virus
RTAAGIMK

SEQ ID NO: 77580 - protein, 8 aa, Dengue virus
TAAGIMKN

SEQ ID NO: 77581 - protein, 8 aa, Dengue virus
AAGIMKNP

SEQ ID NO: 77582 - protein, 8 aa, Dengue virus
AGIMKNPT

SEQ ID NO: 77583 - protein, 8 aa, Dengue virus
GIMKNPTV

SEQ ID NO: 77584 - protein, 8 aa, Dengue virus
IMKNPTVD

SEQ ID NO: 77585 - protein, 8 aa, Dengue virus
MKNPTVDG

SEQ ID NO: 77586 - protein, 8 aa, Dengue virus
KNPTVDGI

SEQ ID NO: 77587 - protein, 8 aa, Dengue virus
NPTVDGIT

SEQ ID NO: 77588 - protein, 8 aa, Dengue virus
PTVDGITV

SEQ ID NO: 77589 - protein, 8 aa, Dengue virus
TVDGITVI

SEQ ID NO: 77590 - protein, 8 aa, Dengue virus
VDGITVID

SEQ ID NO: 77591 - protein, 8 aa, Dengue virus
DGITVIDL

SEQ ID NO: 77592 - protein, 8 aa, Dengue virus
GITVIDLE

SEQ ID NO: 77593 - protein, 8 aa, Dengue virus
ITVIDLEP

SEQ ID NO: 77594 - protein, 8 aa, Dengue virus
TVIDLEPI

SEQ ID NO: 77595 - protein, 8 aa, Dengue virus
VIDLEPIS

SEQ ID NO: 77596 - protein, 8 aa, Dengue virus
IDLEPISY

SEQ ID NO: 77597 - protein, 8 aa, Dengue virus
DLEPISYD

SEQ ID NO: 77598 - protein, 8 aa, Dengue virus
LEPISYDP

SEQ ID NO: 77599 - protein, 8 aa, Dengue virus
EPISYDPK

SEQ ID NO: 77600 - protein, 8 aa, Dengue virus
PISYDPKF

SEQ ID NO: 77601 - protein, 8 aa, Dengue virus
ISYDPKFE

SEQ ID NO: 77602 - protein, 8 aa, Dengue virus
SYDPKFEK

SEQ ID NO: 77603 - protein, 8 aa, Dengue virus
YDPKFEKQ

SEQ ID NO: 77604 - protein, 8 aa, Dengue virus
DPKFEKQL

SEQ ID NO: 77605 - protein, 8 aa, Dengue virus
PKFEKQLG

SEQ ID NO: 77606 - protein, 8 aa, Dengue virus
KFEKQLGQ

SEQ ID NO: 77607 - protein, 8 aa, Dengue virus
FEKQLGQV

SEQ ID NO: 77608 - protein, 8 aa, Dengue virus
EKQLGQVM

SEQ ID NO: 77609 - protein, 8 aa, Dengue virus
KQLGQVML

SEQ ID NO: 77610 - protein, 8 aa, Dengue virus
QLGQVMLL

SEQ ID NO: 77611 - protein, 8 aa, Dengue virus
LGQVMLLV

SEQ ID NO: 77612 - protein, 8 aa, Dengue virus
GQVMLLVL

SEQ ID NO: 77613 - protein, 8 aa, Dengue virus
QVMLLVLC

SEQ ID NO: 77614 - protein, 8 aa, Dengue virus
VMLLVLCA

SEQ ID NO: 77615 - protein, 8 aa, Dengue virus
MLLVLCAG

SEQ ID NO: 77616 - protein, 8 aa, Dengue virus
LLVLCAGQ

SEQ ID NO: 77617 - protein, 8 aa, Dengue virus
LVLCAGQL

SEQ ID NO: 77618 - protein, 8 aa, Dengue virus
VLCAGQLL

SEQ ID NO: 77619 - protein, 8 aa, Dengue virus
LCAGQLLL

SEQ ID NO: 77620 - protein, 8 aa, Dengue virus
CAGQLLLM

SEQ ID NO: 77621 - protein, 8 aa, Dengue virus
AGQLLLMR

SEQ ID NO: 77622 - protein, 8 aa, Dengue virus
GQLLLMRT

SEQ ID NO: 77623 - protein, 8 aa, Dengue virus
QLLLMRTT

SEQ ID NO: 77624 - protein, 8 aa, Dengue virus
LLLMRTTW

SEQ ID NO: 77625 - protein, 8 aa, Dengue virus
LLMRTTWA

SEQ ID NO: 77626 - protein, 8 aa, Dengue virus
LMRTTWAF

SEQ ID NO: 77627 - protein, 8 aa, Dengue virus
MRTTWAFC

SEQ ID NO: 77628 - protein, 8 aa, Dengue virus
RTTWAFCE

SEQ ID NO: 77629 - protein, 8 aa, Dengue virus
TTWAFCEV

SEQ ID NO: 77630 - protein, 8 aa, Dengue virus
TWAFCEVL

SEQ ID NO: 77631 - protein, 8 aa, Dengue virus
WAFCEVLT

SEQ ID NO: 77632 - protein, 8 aa, Dengue virus
AFCEVLTL

SEQ ID NO: 77633 - protein, 8 aa, Dengue virus
FCEVLTLA

SEQ ID NO: 77634 - protein, 8 aa, Dengue virus
CEVLTLAT

SEQ ID NO: 77635 - protein, 8 aa, Dengue virus
EVLTLATG

SEQ ID NO: 77636 - protein, 8 aa, Dengue virus
VLTLATGP

SEQ ID NO: 77637 - protein, 8 aa, Dengue virus
LTLATGPI

SEQ ID NO: 77638 - protein, 8 aa, Dengue virus
TLATGPIL

SEQ ID NO: 77639 - protein, 8 aa, Dengue virus
LATGPILT

SEQ ID NO: 77640 - protein, 8 aa, Dengue virus
ATGPILTL

SEQ ID NO: 77641 - protein, 8 aa, Dengue virus
TGPILTLW

SEQ ID NO: 77642 - protein, 8 aa, Dengue virus
GPILTLWE

SEQ ID NO: 77643 - protein, 8 aa, Dengue virus
PILTLWEG

SEQ ID NO: 77644 - protein, 8 aa, Dengue virus
ILTLWEGN

SEQ ID NO: 77645 - protein, 8 aa, Dengue virus
LTLWEGNP

SEQ ID NO: 77646 - protein, 8 aa, Dengue virus
TLWEGNPG

SEQ ID NO: 77647 - protein, 8 aa, Dengue virus
LWEGNPGR

SEQ ID NO: 77648 - protein, 8 aa, Dengue virus
WEGNPGRF

SEQ ID NO: 77649 - protein, 8 aa, Dengue virus
EGNPGRFW

SEQ ID NO: 77650 - protein, 8 aa, Dengue virus
GNPGRFWN

SEQ ID NO: 77651 - protein, 8 aa, Dengue virus
NPGRFWNT

SEQ ID NO: 77652 - protein, 8 aa, Dengue virus
PGRFWNTT

SEQ ID NO: 77653 - protein, 8 aa, Dengue virus
GRFWNTTI

SEQ ID NO: 77654 - protein, 8 aa, Dengue virus
RFWNTTIA

SEQ ID NO: 77655 - protein, 8 aa, Dengue virus
FWNTTIAV

SEQ ID NO: 77656 - protein, 8 aa, Dengue virus
WNTTIAVS

SEQ ID NO: 77657 - protein, 8 aa, Dengue virus
NTTIAVST

SEQ ID NO: 77658 - protein, 8 aa, Dengue virus
TTIAVSTA

SEQ ID NO: 77659 - protein, 8 aa, Dengue virus
TIAVSTAN

SEQ ID NO: 77660 - protein, 8 aa, Dengue virus
IAVSTANI

SEQ ID NO: 77661 - protein, 8 aa, Dengue virus
AVSTANIF

SEQ ID NO: 77662 - protein, 8 aa, Dengue virus
VSTANIFR

SEQ ID NO: 77663 - protein, 8 aa, Dengue virus
STANIFRG

SEQ ID NO: 77664 - protein, 8 aa, Dengue virus
TANIFRGS

SEQ ID NO: 77665 - protein, 8 aa, Dengue virus
ANIFRGSY

SEQ ID NO: 77666 - protein, 8 aa, Dengue virus
NIFRGSYL

SEQ ID NO: 77667 - protein, 8 aa, Dengue virus
IFRGSYLA

SEQ ID NO: 77668 - protein, 8 aa, Dengue virus
FRGSYLAG

SEQ ID NO: 77669 - protein, 8 aa, Dengue virus
RGSYLAGA

SEQ ID NO: 77670 - protein, 8 aa, Dengue virus
GSYLAGAG

SEQ ID NO: 77671 - protein, 8 aa, Dengue virus
SYLAGAGL

SEQ ID NO: 77672 - protein, 8 aa, Dengue virus
YLAGAGLA

SEQ ID NO: 77673 - protein, 8 aa, Dengue virus
LAGAGLAF

SEQ ID NO: 77674 - protein, 8 aa, Dengue virus
AGAGLAFS

SEQ ID NO: 77675 - protein, 8 aa, Dengue virus
GAGLAFSL

SEQ ID NO: 77676 - protein, 8 aa, Dengue virus
AGLAFSLI

SEQ ID NO: 77677 - protein, 8 aa, Dengue virus
GLAFSLIK

SEQ ID NO: 77678 - protein, 8 aa, Dengue virus
LAFSLIKN

SEQ ID NO: 77679 - protein, 8 aa, Dengue virus
AFSLIKNA

SEQ ID NO: 77680 - protein, 8 aa, Dengue virus
FSLIKNAQ

SEQ ID NO: 77681 - protein, 8 aa, Dengue virus
SLIKNAQT

SEQ ID NO: 77682 - protein, 8 aa, Dengue virus
LIKNAQTP

SEQ ID NO: 77683 - protein, 8 aa, Dengue virus
IKNAQTPR

SEQ ID NO: 77684 - protein, 8 aa, Dengue virus
KNAQTPRR

SEQ ID NO: 77685 - protein, 8 aa, Dengue virus
NAQTPRRG

SEQ ID NO: 77686 - protein, 8 aa, Dengue virus
AQTPRRGT

SEQ ID NO: 77687 - protein, 8 aa, Dengue virus
QTPRRGTG

SEQ ID NO: 77688 - protein, 8 aa, Dengue virus
TPRRGTGT

SEQ ID NO: 77689 - protein, 8 aa, Dengue virus
PRRGTGTT

SEQ ID NO: 77690 - protein, 8 aa, Dengue virus
RRGTGTTG

SEQ ID NO: 77691 - protein, 8 aa, Dengue virus
RGTGTTGE

SEQ ID NO: 77692 - protein, 8 aa, Dengue virus
GTGTTGET

SEQ ID NO: 77693 - protein, 8 aa, Dengue virus
TGTTGETL

SEQ ID NO: 77694 - protein, 8 aa, Dengue virus
GTTGETLG

SEQ ID NO: 77695 - protein, 8 aa, Dengue virus
TTGETLGE

SEQ ID NO: 77696 - protein, 8 aa, Dengue virus
TGETLGEK

SEQ ID NO: 77697 - protein, 8 aa, Dengue virus
GETLGEKW

SEQ ID NO: 77698 - protein, 8 aa, Dengue virus
ETLGEKWK

SEQ ID NO: 77699 - protein, 8 aa, Dengue virus
TLGEKWKR

SEQ ID NO: 77700 - protein, 8 aa, Dengue virus
LGEKWKRQ

SEQ ID NO: 77701 - protein, 8 aa, Dengue virus
GEKWKRQL

SEQ ID NO: 77702 - protein, 8 aa, Dengue virus
EKWKRQLN

SEQ ID NO: 77703 - protein, 8 aa, Dengue virus
KWKRQLNS

SEQ ID NO: 77704 - protein, 8 aa, Dengue virus
WKRQLNSL

SEQ ID NO: 77705 - protein, 8 aa, Dengue virus
KRQLNSLD

SEQ ID NO: 77706 - protein, 8 aa, Dengue virus
RQLNSLDR

SEQ ID NO: 77707 - protein, 8 aa, Dengue virus
QLNSLDRK

SEQ ID NO: 77708 - protein, 8 aa, Dengue virus
LNSLDRKE

SEQ ID NO: 77709 - protein, 8 aa, Dengue virus
NSLDRKEF

SEQ ID NO: 77710 - protein, 8 aa, Dengue virus
SLDRKEFE

SEQ ID NO: 77711 - protein, 8 aa, Dengue virus
LDRKEFEE

SEQ ID NO: 77712 - protein, 8 aa, Dengue virus
DRKEFEEY

SEQ ID NO: 77713 - protein, 8 aa, Dengue virus
RKEFEEYK

SEQ ID NO: 77714 - protein, 8 aa, Dengue virus
KEFEEYKR

SEQ ID NO: 77715 - protein, 8 aa, Dengue virus
EFEEYKRS

SEQ ID NO: 77716 - protein, 8 aa, Dengue virus
FEEYKRSG

SEQ ID NO: 77717 - protein, 8 aa, Dengue virus
EEYKRSGI

SEQ ID NO: 77718 - protein, 8 aa, Dengue virus
EYKRSGIL

SEQ ID NO: 77719 - protein, 8 aa, Dengue virus
YKRSGILE

SEQ ID NO: 77720 - protein, 8 aa, Dengue virus
KRSGILEV

SEQ ID NO: 77721 - protein, 8 aa, Dengue virus
RSGILEVD

SEQ ID NO: 77722 - protein, 8 aa, Dengue virus
SGILEVDR

SEQ ID NO: 77723 - protein, 8 aa, Dengue virus
GILEVDRT

SEQ ID NO: 77724 - protein, 8 aa, Dengue virus
ILEVDRTE

SEQ ID NO: 77725 - protein, 8 aa, Dengue virus
LEVDRTEA

SEQ ID NO: 77726 - protein, 8 aa, Dengue virus
EVDRTEAK

SEQ ID NO: 77727 - protein, 8 aa, Dengue virus
VDRTEAKS

SEQ ID NO: 77728 - protein, 8 aa, Dengue virus
DRTEAKSA

SEQ ID NO: 77729 - protein, 8 aa, Dengue virus
RTEAKSAL

SEQ ID NO: 77730 - protein, 8 aa, Dengue virus
TEAKSALK

SEQ ID NO: 77731 - protein, 8 aa, Dengue virus
EAKSALKD

SEQ ID NO: 77732 - protein, 8 aa, Dengue virus
AKSALKDG

SEQ ID NO: 77733 - protein, 8 aa, Dengue virus
KSALKDGS

SEQ ID NO: 77734 - protein, 8 aa, Dengue virus
SALKDGSK

SEQ ID NO: 77735 - protein, 8 aa, Dengue virus
ALKDGSKI

SEQ ID NO: 77736 - protein, 8 aa, Dengue virus
LKDGSKIK

SEQ ID NO: 77737 - protein, 8 aa, Dengue virus
KDGSKIKH

SEQ ID NO: 77738 - protein, 8 aa, Dengue virus
DGSKIKHA

SEQ ID NO: 77739 - protein, 8 aa, Dengue virus
GSKIKHAV

SEQ ID NO: 77740 - protein, 8 aa, Dengue virus
SKIKHAVS

SEQ ID NO: 77741 - protein, 8 aa, Dengue virus
KIKHAVSR

SEQ ID NO: 77742 - protein, 8 aa, Dengue virus
IKHAVSRG

SEQ ID NO: 77743 - protein, 8 aa, Dengue virus
KHAVSRGS

SEQ ID NO: 77744 - protein, 8 aa, Dengue virus
HAVSRGSS

SEQ ID NO: 77745 - protein, 8 aa, Dengue virus
AVSRGSSK

SEQ ID NO: 77746 - protein, 8 aa, Dengue virus
VSRGSSKI

SEQ ID NO: 77747 - protein, 8 aa, Dengue virus
SRGSSKIR

SEQ ID NO: 77748 - protein, 8 aa, Dengue virus
RGSSKIRW

SEQ ID NO: 77749 - protein, 8 aa, Dengue virus
GSSKIRWI

SEQ ID NO: 77750 - protein, 8 aa, Dengue virus
SSKIRWIV

SEQ ID NO: 77751 - protein, 8 aa, Dengue virus
SKIRWIVE

SEQ ID NO: 77752 - protein, 8 aa, Dengue virus
KIRWIVER

SEQ ID NO: 77753 - protein, 8 aa, Dengue virus
IRWIVERG

SEQ ID NO: 77754 - protein, 8 aa, Dengue virus
RWIVERGM

SEQ ID NO: 77755 - protein, 8 aa, Dengue virus
WIVERGMV

SEQ ID NO: 77756 - protein, 8 aa, Dengue virus
IVERGMVK

SEQ ID NO: 77757 - protein, 8 aa, Dengue virus
VERGMVKP

SEQ ID NO: 77758 - protein, 8 aa, Dengue virus
ERGMVKPK

SEQ ID NO: 77759 - protein, 8 aa, Dengue virus
RGMVKPKG

SEQ ID NO: 77760 - protein, 8 aa, Dengue virus
GMVKPKGK

SEQ ID NO: 77761 - protein, 8 aa, Dengue virus
MVKPKGKV

SEQ ID NO: 77762 - protein, 8 aa, Dengue virus
VKPKGKVV

SEQ ID NO: 77763 - protein, 8 aa, Dengue virus
KPKGKVVD

SEQ ID NO: 77764 - protein, 8 aa, Dengue virus
PKGKVVDL

SEQ ID NO: 77765 - protein, 8 aa, Dengue virus
KGKVVDLG

SEQ ID NO: 77766 - protein, 8 aa, Dengue virus
GKVVDLGC

SEQ ID NO: 77767 - protein, 8 aa, Dengue virus
KVVDLGCG

SEQ ID NO: 77768 - protein, 8 aa, Dengue virus
VVDLGCGR

SEQ ID NO: 77769 - protein, 8 aa, Dengue virus
VDLGCGRG

SEQ ID NO: 77770 - protein, 8 aa, Dengue virus
DLGCGRGG

SEQ ID NO: 77771 - protein, 8 aa, Dengue virus
LGCGRGGW

SEQ ID NO: 77772 - protein, 8 aa, Dengue virus
GCGRGGWS

SEQ ID NO: 77773 - protein, 8 aa, Dengue virus
CGRGGWSY

SEQ ID NO: 77774 - protein, 8 aa, Dengue virus
GRGGWSYY

SEQ ID NO: 77775 - protein, 8 aa, Dengue virus
RGGWSYYM

SEQ ID NO: 77776 - protein, 8 aa, Dengue virus
GGWSYYMA

SEQ ID NO: 77777 - protein, 8 aa, Dengue virus
GWSYYMAT

SEQ ID NO: 77778 - protein, 8 aa, Dengue virus
WSYYMATL

SEQ ID NO: 77779 - protein, 8 aa, Dengue virus
SYYMATLK

SEQ ID NO: 77780 - protein, 8 aa, Dengue virus
YYMATLKN

SEQ ID NO: 77781 - protein, 8 aa, Dengue virus
YMATLKNV

SEQ ID NO: 77782 - protein, 8 aa, Dengue virus
MATLKNVT

SEQ ID NO: 77783 - protein, 8 aa, Dengue virus
ATLKNVTE

SEQ ID NO: 77784 - protein, 8 aa, Dengue virus
TLKNVTEV

SEQ ID NO: 77785 - protein, 8 aa, Dengue virus
LKNVTEVK

SEQ ID NO: 77786 - protein, 8 aa, Dengue virus
KNVTEVKG

SEQ ID NO: 77787 - protein, 8 aa, Dengue virus
NVTEVKGY

SEQ ID NO: 77788 - protein, 8 aa, Dengue virus
VTEVKGYT

SEQ ID NO: 77789 - protein, 8 aa, Dengue virus
TEVKGYTK

SEQ ID NO: 77790 - protein, 8 aa, Dengue virus
EVKGYTKG

SEQ ID NO: 77791 - protein, 8 aa, Dengue virus
VKGYTKGG

SEQ ID NO: 77792 - protein, 8 aa, Dengue virus
KGYTKGGP

SEQ ID NO: 77793 - protein, 8 aa, Dengue virus
GYTKGGPG

SEQ ID NO: 77794 - protein, 8 aa, Dengue virus
YTKGGPGH

SEQ ID NO: 77795 - protein, 8 aa, Dengue virus
TKGGPGHE

SEQ ID NO: 77796 - protein, 8 aa, Dengue virus
KGGPGHEE

SEQ ID NO: 77797 - protein, 8 aa, Dengue virus
GGPGHEEP

SEQ ID NO: 77798 - protein, 8 aa, Dengue virus
GPGHEEPI

SEQ ID NO: 77799 - protein, 8 aa, Dengue virus
PGHEEPIP

SEQ ID NO: 77800 - protein, 8 aa, Dengue virus
GHEEPIPM

SEQ ID NO: 77801 - protein, 8 aa, Dengue virus
HEEPIPMA

SEQ ID NO: 77802 - protein, 8 aa, Dengue virus
EEPIPMAT

SEQ ID NO: 77803 - protein, 8 aa, Dengue virus
EPIPMATY

SEQ ID NO: 77804 - protein, 8 aa, Dengue virus
PIPMATYG

SEQ ID NO: 77805 - protein, 8 aa, Dengue virus
IPMATYGW

SEQ ID NO: 77806 - protein, 8 aa, Dengue virus
PMATYGWN

SEQ ID NO: 77807 - protein, 8 aa, Dengue virus
MATYGWNL

SEQ ID NO: 77808 - protein, 8 aa, Dengue virus
ATYGWNLV

SEQ ID NO: 77809 - protein, 8 aa, Dengue virus
TYGWNLVK

SEQ ID NO: 77810 - protein, 8 aa, Dengue virus
YGWNLVKL

SEQ ID NO: 77811 - protein, 8 aa, Dengue virus
GWNLVKLH

SEQ ID NO: 77812 - protein, 8 aa, Dengue virus
WNLVKLHS

SEQ ID NO: 77813 - protein, 8 aa, Dengue virus
NLVKLHSG

SEQ ID NO: 77814 - protein, 8 aa, Dengue virus
LVKLHSGV

SEQ ID NO: 77815 - protein, 8 aa, Dengue virus
VKLHSGVD

SEQ ID NO: 77816 - protein, 8 aa, Dengue virus
KLHSGVDV

SEQ ID NO: 77817 - protein, 8 aa, Dengue virus
LHSGVDVF

SEQ ID NO: 77818 - protein, 8 aa, Dengue virus
HSGVDVFY

SEQ ID NO: 77819 - protein, 8 aa, Dengue virus
SGVDVFYK

SEQ ID NO: 77820 - protein, 8 aa, Dengue virus
GVDVFYKP

SEQ ID NO: 77821 - protein, 8 aa, Dengue virus
VDVFYKPT

SEQ ID NO: 77822 - protein, 8 aa, Dengue virus
DVFYKPTE

SEQ ID NO: 77823 - protein, 8 aa, Dengue virus
VFYKPTEQ

SEQ ID NO: 77824 - protein, 8 aa, Dengue virus
FYKPTEQV

SEQ ID NO: 77825 - protein, 8 aa, Dengue virus
YKPTEQVD

SEQ ID NO: 77826 - protein, 8 aa, Dengue virus
KPTEQVDT

SEQ ID NO: 77827 - protein, 8 aa, Dengue virus
PTEQVDTL

SEQ ID NO: 77828 - protein, 8 aa, Dengue virus
TEQVDTLL

SEQ ID NO: 77829 - protein, 8 aa, Dengue virus
EQVDTLLC

SEQ ID NO: 77830 - protein, 8 aa, Dengue virus
QVDTLLCD

SEQ ID NO: 77831 - protein, 8 aa, Dengue virus
VDTLLCDI

SEQ ID NO: 77832 - protein, 8 aa, Dengue virus
DTLLCDIG

SEQ ID NO: 77833 - protein, 8 aa, Dengue virus
TLLCDIGE

SEQ ID NO: 77834 - protein, 8 aa, Dengue virus
LLCDIGES

SEQ ID NO: 77835 - protein, 8 aa, Dengue virus
LCDIGESS

SEQ ID NO: 77836 - protein, 8 aa, Dengue virus
CDIGESSS

SEQ ID NO: 77837 - protein, 8 aa, Dengue virus
DIGESSSN

SEQ ID NO: 77838 - protein, 8 aa, Dengue virus
IGESSSNP

SEQ ID NO: 77839 - protein, 8 aa, Dengue virus
GESSSNPT

SEQ ID NO: 77840 - protein, 8 aa, Dengue virus
ESSSNPTI

SEQ ID NO: 77841 - protein, 8 aa, Dengue virus
SSSNPTIE

SEQ ID NO: 77842 - protein, 8 aa, Dengue virus
SSNPTIEE

SEQ ID NO: 77843 - protein, 8 aa, Dengue virus
SNPTIEEG

SEQ ID NO: 77844 - protein, 8 aa, Dengue virus
NPTIEEGR

SEQ ID NO: 77845 - protein, 8 aa, Dengue virus
PTIEEGRT

SEQ ID NO: 77846 - protein, 8 aa, Dengue virus
TIEEGRTL

SEQ ID NO: 77847 - protein, 8 aa, Dengue virus
IEEGRTLR

SEQ ID NO: 77848 - protein, 8 aa, Dengue virus
EEGRTLRV

SEQ ID NO: 77849 - protein, 8 aa, Dengue virus
EGRTLRVL

SEQ ID NO: 77850 - protein, 8 aa, Dengue virus
GRTLRVLK

SEQ ID NO: 77851 - protein, 8 aa, Dengue virus
RTLRVLKM

SEQ ID NO: 77852 - protein, 8 aa, Dengue virus
TLRVLKMV

SEQ ID NO: 77853 - protein, 8 aa, Dengue virus
LRVLKMVE

SEQ ID NO: 77854 - protein, 8 aa, Dengue virus
RVLKMVEP

SEQ ID NO: 77855 - protein, 8 aa, Dengue virus
VLKMVEPW

SEQ ID NO: 77856 - protein, 8 aa, Dengue virus
LKMVEPWL

SEQ ID NO: 77857 - protein, 8 aa, Dengue virus
KMVEPWLS

SEQ ID NO: 77858 - protein, 8 aa, Dengue virus
MVEPWLSS

SEQ ID NO: 77859 - protein, 8 aa, Dengue virus
VEPWLSSK

SEQ ID NO: 77860 - protein, 8 aa, Dengue virus
EPWLSSKP

SEQ ID NO: 77861 - protein, 8 aa, Dengue virus
PWLSSKPE

SEQ ID NO: 77862 - protein, 8 aa, Dengue virus
WLSSKPEF

SEQ ID NO: 77863 - protein, 8 aa, Dengue virus
LSSKPEFC

SEQ ID NO: 77864 - protein, 8 aa, Dengue virus
SSKPEFCI

SEQ ID NO: 77865 - protein, 8 aa, Dengue virus
SKPEFCIK

SEQ ID NO: 77866 - protein, 8 aa, Dengue virus
KPEFCIKV

SEQ ID NO: 77867 - protein, 8 aa, Dengue virus
PEFCIKVL

SEQ ID NO: 77868 - protein, 8 aa, Dengue virus
EFCIKVLN

SEQ ID NO: 77869 - protein, 8 aa, Dengue virus
FCIKVLNP

SEQ ID NO: 77870 - protein, 8 aa, Dengue virus
CIKVLNPY

SEQ ID NO: 77871 - protein, 8 aa, Dengue virus
IKVLNPYM

SEQ ID NO: 77872 - protein, 8 aa, Dengue virus
KVLNPYMP

SEQ ID NO: 77873 - protein, 8 aa, Dengue virus
VLNPYMPT

SEQ ID NO: 77874 - protein, 8 aa, Dengue virus
LNPYMPTV

SEQ ID NO: 77875 - protein, 8 aa, Dengue virus
NPYMPTVI

SEQ ID NO: 77876 - protein, 8 aa, Dengue virus
PYMPTVIE

SEQ ID NO: 77877 - protein, 8 aa, Dengue virus
YMPTVIEE

SEQ ID NO: 77878 - protein, 8 aa, Dengue virus
MPTVIEEL

SEQ ID NO: 77879 - protein, 8 aa, Dengue virus
PTVIEELE

SEQ ID NO: 77880 - protein, 8 aa, Dengue virus
TVIEELEK

SEQ ID NO: 77881 - protein, 8 aa, Dengue virus
VIEELEKL

SEQ ID NO: 77882 - protein, 8 aa, Dengue virus
IEELEKLQ

SEQ ID NO: 77883 - protein, 8 aa, Dengue virus
EELEKLQR

SEQ ID NO: 77884 - protein, 8 aa, Dengue virus
ELEKLQRK

SEQ ID NO: 77885 - protein, 8 aa, Dengue virus
LEKLQRKH

SEQ ID NO: 77886 - protein, 8 aa, Dengue virus
EKLQRKHG

SEQ ID NO: 77887 - protein, 8 aa, Dengue virus
KLQRKHGG

SEQ ID NO: 77888 - protein, 8 aa, Dengue virus
LQRKHGGN

SEQ ID NO: 77889 - protein, 8 aa, Dengue virus
QRKHGGNL

SEQ ID NO: 77890 - protein, 8 aa, Dengue virus
RKHGGNLV

SEQ ID NO: 77891 - protein, 8 aa, Dengue virus
KHGGNLVR

SEQ ID NO: 77892 - protein, 8 aa, Dengue virus
HGGNLVRC

SEQ ID NO: 77893 - protein, 8 aa, Dengue virus
GGNLVRCP

SEQ ID NO: 77894 - protein, 8 aa, Dengue virus
GNLVRCPL

SEQ ID NO: 77895 - protein, 8 aa, Dengue virus
NLVRCPLS

SEQ ID NO: 77896 - protein, 8 aa, Dengue virus
LVRCPLSR

SEQ ID NO: 77897 - protein, 8 aa, Dengue virus
VRCPLSRN

SEQ ID NO: 77898 - protein, 8 aa, Dengue virus
RCPLSRNS

SEQ ID NO: 77899 - protein, 8 aa, Dengue virus
CPLSRNST

SEQ ID NO: 77900 - protein, 8 aa, Dengue virus
PLSRNSTH

SEQ ID NO: 77901 - protein, 8 aa, Dengue virus
LSRNSTHE

SEQ ID NO: 77902 - protein, 8 aa, Dengue virus
SRNSTHEM

SEQ ID NO: 77903 - protein, 8 aa, Dengue virus
RNSTHEMY

SEQ ID NO: 77904 - protein, 8 aa, Dengue virus
NSTHEMYW

SEQ ID NO: 77905 - protein, 8 aa, Dengue virus
STHEMYWV

SEQ ID NO: 77906 - protein, 8 aa, Dengue virus
THEMYWVS

SEQ ID NO: 77907 - protein, 8 aa, Dengue virus
HEMYWVSG

SEQ ID NO: 77908 - protein, 8 aa, Dengue virus
EMYWVSGA

SEQ ID NO: 77909 - protein, 8 aa, Dengue virus
MYWVSGAS

SEQ ID NO: 77910 - protein, 8 aa, Dengue virus
YWVSGASG

SEQ ID NO: 77911 - protein, 8 aa, Dengue virus
WVSGASGN

SEQ ID NO: 77912 - protein, 8 aa, Dengue virus
VSGASGNI

SEQ ID NO: 77913 - protein, 8 aa, Dengue virus
SGASGNIV

SEQ ID NO: 77914 - protein, 8 aa, Dengue virus
GASGNIVS

SEQ ID NO: 77915 - protein, 8 aa, Dengue virus
ASGNIVSS

SEQ ID NO: 77916 - protein, 8 aa, Dengue virus
SGNIVSSV

SEQ ID NO: 77917 - protein, 8 aa, Dengue virus
GNIVSSVN

SEQ ID NO: 77918 - protein, 8 aa, Dengue virus
NIVSSVNT

SEQ ID NO: 77919 - protein, 8 aa, Dengue virus
IVSSVNTT

SEQ ID NO: 77920 - protein, 8 aa, Dengue virus
VSSVNTTS

SEQ ID NO: 77921 - protein, 8 aa, Dengue virus
SSVNTTSK

SEQ ID NO: 77922 - protein, 8 aa, Dengue virus
SVNTTSKM

SEQ ID NO: 77923 - protein, 8 aa, Dengue virus
VNTTSKML

SEQ ID NO: 77924 - protein, 8 aa, Dengue virus
NTTSKMLL

SEQ ID NO: 77925 - protein, 8 aa, Dengue virus
TTSKMLLN

SEQ ID NO: 77926 - protein, 8 aa, Dengue virus
TSKMLLNR

SEQ ID NO: 77927 - protein, 8 aa, Dengue virus
SKMLLNRF

SEQ ID NO: 77928 - protein, 8 aa, Dengue virus
KMLLNRFT

SEQ ID NO: 77929 - protein, 8 aa, Dengue virus
MLLNRFTT

SEQ ID NO: 77930 - protein, 8 aa, Dengue virus
LLNRFTTR

SEQ ID NO: 77931 - protein, 8 aa, Dengue virus
LNRFTTRH

SEQ ID NO: 77932 - protein, 8 aa, Dengue virus
NRFTTRHR

SEQ ID NO: 77933 - protein, 8 aa, Dengue virus
RFTTRHRK

SEQ ID NO: 77934 - protein, 8 aa, Dengue virus
FTTRHRKP

SEQ ID NO: 77935 - protein, 8 aa, Dengue virus
TTRHRKPT

SEQ ID NO: 77936 - protein, 8 aa, Dengue virus
TRHRKPTY

SEQ ID NO: 77937 - protein, 8 aa, Dengue virus
RHRKPTYE

SEQ ID NO: 77938 - protein, 8 aa, Dengue virus
HRKPTYEK

SEQ ID NO: 77939 - protein, 8 aa, Dengue virus
RKPTYEKD

SEQ ID NO: 77940 - protein, 8 aa, Dengue virus
KPTYEKDV

SEQ ID NO: 77941 - protein, 8 aa, Dengue virus
PTYEKDVD

SEQ ID NO: 77942 - protein, 8 aa, Dengue virus
TYEKDVDL

SEQ ID NO: 77943 - protein, 8 aa, Dengue virus
YEKDVDLG

SEQ ID NO: 77944 - protein, 8 aa, Dengue virus
EKDVDLGA

SEQ ID NO: 77945 - protein, 8 aa, Dengue virus
KDVDLGAG

SEQ ID NO: 77946 - protein, 8 aa, Dengue virus
DVDLGAGT

SEQ ID NO: 77947 - protein, 8 aa, Dengue virus
VDLGAGTR

SEQ ID NO: 77948 - protein, 8 aa, Dengue virus
DLGAGTRS

SEQ ID NO: 77949 - protein, 8 aa, Dengue virus
LGAGTRSV

SEQ ID NO: 77950 - protein, 8 aa, Dengue virus
GAGTRSVS

SEQ ID NO: 77951 - protein, 8 aa, Dengue virus
AGTRSVST

SEQ ID NO: 77952 - protein, 8 aa, Dengue virus
GTRSVSTE

SEQ ID NO: 77953 - protein, 8 aa, Dengue virus
TRSVSTET

SEQ ID NO: 77954 - protein, 8 aa, Dengue virus
RSVSTETE

SEQ ID NO: 77955 - protein, 8 aa, Dengue virus
SVSTETEK

SEQ ID NO: 77956 - protein, 8 aa, Dengue virus
VSTETEKP

SEQ ID NO: 77957 - protein, 8 aa, Dengue virus
STETEKPD

SEQ ID NO: 77958 - protein, 8 aa, Dengue virus
TETEKPDM

SEQ ID NO: 77959 - protein, 8 aa, Dengue virus
ETEKPDMT

SEQ ID NO: 77960 - protein, 8 aa, Dengue virus
TEKPDMTI

SEQ ID NO: 77961 - protein, 8 aa, Dengue virus
EKPDMTII

SEQ ID NO: 77962 - protein, 8 aa, Dengue virus
KPDMTIIG

SEQ ID NO: 77963 - protein, 8 aa, Dengue virus
PDMTIIGR

SEQ ID NO: 77964 - protein, 8 aa, Dengue virus
DMTIIGRR

SEQ ID NO: 77965 - protein, 8 aa, Dengue virus
MTIIGRRL

SEQ ID NO: 77966 - protein, 8 aa, Dengue virus
TIIGRRLQ

SEQ ID NO: 77967 - protein, 8 aa, Dengue virus
IIGRRLQR

SEQ ID NO: 77968 - protein, 8 aa, Dengue virus
IGRRLQRL

SEQ ID NO: 77969 - protein, 8 aa, Dengue virus
GRRLQRLQ

SEQ ID NO: 77970 - protein, 8 aa, Dengue virus
RRLQRLQE

SEQ ID NO: 77971 - protein, 8 aa, Dengue virus
RLQRLQEE

SEQ ID NO: 77972 - protein, 8 aa, Dengue virus
LQRLQEEH

SEQ ID NO: 77973 - protein, 8 aa, Dengue virus
QRLQEEHK

SEQ ID NO: 77974 - protein, 8 aa, Dengue virus
RLQEEHKE

SEQ ID NO: 77975 - protein, 8 aa, Dengue virus
LQEEHKET

SEQ ID NO: 77976 - protein, 8 aa, Dengue virus
QEEHKETW

SEQ ID NO: 77977 - protein, 8 aa, Dengue virus
EEHKETWH

SEQ ID NO: 77978 - protein, 8 aa, Dengue virus
EHKETWHY

SEQ ID NO: 77979 - protein, 8 aa, Dengue virus
HKETWHYD

SEQ ID NO: 77980 - protein, 8 aa, Dengue virus
KETWHYDQ

SEQ ID NO: 77981 - protein, 8 aa, Dengue virus
ETWHYDQE

SEQ ID NO: 77982 - protein, 8 aa, Dengue virus
TWHYDQEN

SEQ ID NO: 77983 - protein, 8 aa, Dengue virus
WHYDQENP

SEQ ID NO: 77984 - protein, 8 aa, Dengue virus
HYDQENPY

SEQ ID NO: 77985 - protein, 8 aa, Dengue virus
YDQENPYR

SEQ ID NO: 77986 - protein, 8 aa, Dengue virus
DQENPYRT

SEQ ID NO: 77987 - protein, 8 aa, Dengue virus
QENPYRTW

SEQ ID NO: 77988 - protein, 8 aa, Dengue virus
ENPYRTWA

SEQ ID NO: 77989 - protein, 8 aa, Dengue virus
NPYRTWAY

SEQ ID NO: 77990 - protein, 8 aa, Dengue virus
PYRTWAYH

SEQ ID NO: 77991 - protein, 8 aa, Dengue virus
YRTWAYHG

SEQ ID NO: 77992 - protein, 8 aa, Dengue virus
RTWAYHGS

SEQ ID NO: 77993 - protein, 8 aa, Dengue virus
TWAYHGSY

SEQ ID NO: 77994 - protein, 8 aa, Dengue virus
WAYHGSYE

SEQ ID NO: 77995 - protein, 8 aa, Dengue virus
AYHGSYEA

SEQ ID NO: 77996 - protein, 8 aa, Dengue virus
YHGSYEAP

SEQ ID NO: 77997 - protein, 8 aa, Dengue virus
HGSYEAPS

SEQ ID NO: 77998 - protein, 8 aa, Dengue virus
GSYEAPST

SEQ ID NO: 77999 - protein, 8 aa, Dengue virus
SYEAPSTG

SEQ ID NO: 78000 - protein, 8 aa, Dengue virus
YEAPSTGS

SEQ ID NO: 78001 - protein, 8 aa, Dengue virus
EAPSTGSA

SEQ ID NO: 78002 - protein, 8 aa, Dengue virus
APSTGSAS

SEQ ID NO: 78003 - protein, 8 aa, Dengue virus
PSTGSASS

SEQ ID NO: 78004 - protein, 8 aa, Dengue virus
STGSASSM

SEQ ID NO: 78005 - protein, 8 aa, Dengue virus
TGSASSMV

SEQ ID NO: 78006 - protein, 8 aa, Dengue virus
GSASSMVN

SEQ ID NO: 78007 - protein, 8 aa, Dengue virus
SASSMVNG

SEQ ID NO: 78008 - protein, 8 aa, Dengue virus
ASSMVNGV

SEQ ID NO: 78009 - protein, 8 aa, Dengue virus
SSMVNGVV

SEQ ID NO: 78010 - protein, 8 aa, Dengue virus
SMVNGVVK

SEQ ID NO: 78011 - protein, 8 aa, Dengue virus
MVNGVVKL

SEQ ID NO: 78012 - protein, 8 aa, Dengue virus
VNGVVKLL

SEQ ID NO: 78013 - protein, 8 aa, Dengue virus
NGVVKLLT

SEQ ID NO: 78014 - protein, 8 aa, Dengue virus
GVVKLLTK

SEQ ID NO: 78015 - protein, 8 aa, Dengue virus
VVKLLTKP

SEQ ID NO: 78016 - protein, 8 aa, Dengue virus
VKLLTKPW

SEQ ID NO: 78017 - protein, 8 aa, Dengue virus
KLLTKPWD

SEQ ID NO: 78018 - protein, 8 aa, Dengue virus
LLTKPWDV

SEQ ID NO: 78019 - protein, 8 aa, Dengue virus
LTKPWDVI

SEQ ID NO: 78020 - protein, 8 aa, Dengue virus
TKPWDVIP

SEQ ID NO: 78021 - protein, 8 aa, Dengue virus
KPWDVIPM

SEQ ID NO: 78022 - protein, 8 aa, Dengue virus
PWDVIPMV

SEQ ID NO: 78023 - protein, 8 aa, Dengue virus
WDVIPMVT

SEQ ID NO: 78024 - protein, 8 aa, Dengue virus
DVIPMVTQ

SEQ ID NO: 78025 - protein, 8 aa, Dengue virus
VIPMVTQL

SEQ ID NO: 78026 - protein, 8 aa, Dengue virus
IPMVTQLA

SEQ ID NO: 78027 - protein, 8 aa, Dengue virus
PMVTQLAM

SEQ ID NO: 78028 - protein, 8 aa, Dengue virus
MVTQLAMT

SEQ ID NO: 78029 - protein, 8 aa, Dengue virus
VTQLAMTD

SEQ ID NO: 78030 - protein, 8 aa, Dengue virus
TQLAMTDT

SEQ ID NO: 78031 - protein, 8 aa, Dengue virus
QLAMTDTT

SEQ ID NO: 78032 - protein, 8 aa, Dengue virus
LAMTDTTP

SEQ ID NO: 78033 - protein, 8 aa, Dengue virus
AMTDTTPF

SEQ ID NO: 78034 - protein, 8 aa, Dengue virus
MTDTTPFG

SEQ ID NO: 78035 - protein, 8 aa, Dengue virus
TDTTPFGQ

SEQ ID NO: 78036 - protein, 8 aa, Dengue virus
DTTPFGQQ

SEQ ID NO: 78037 - protein, 8 aa, Dengue virus
TTPFGQQR

SEQ ID NO: 78038 - protein, 8 aa, Dengue virus
TPFGQQRV

SEQ ID NO: 78039 - protein, 8 aa, Dengue virus
PFGQQRVF

SEQ ID NO: 78040 - protein, 8 aa, Dengue virus
FGQQRVFK

SEQ ID NO: 78041 - protein, 8 aa, Dengue virus
GQQRVFKE

SEQ ID NO: 78042 - protein, 8 aa, Dengue virus
QQRVFKEK

SEQ ID NO: 78043 - protein, 8 aa, Dengue virus
QRVFKEKV

SEQ ID NO: 78044 - protein, 8 aa, Dengue virus
RVFKEKVD

SEQ ID NO: 78045 - protein, 8 aa, Dengue virus
VFKEKVDT

SEQ ID NO: 78046 - protein, 8 aa, Dengue virus
FKEKVDTR

SEQ ID NO: 78047 - protein, 8 aa, Dengue virus
KEKVDTRT

SEQ ID NO: 78048 - protein, 8 aa, Dengue virus
EKVDTRTP

SEQ ID NO: 78049 - protein, 8 aa, Dengue virus
KVDTRTPQ

SEQ ID NO: 78050 - protein, 8 aa, Dengue virus
VDTRTPQP

SEQ ID NO: 78051 - protein, 8 aa, Dengue virus
DTRTPQPK

SEQ ID NO: 78052 - protein, 8 aa, Dengue virus
TRTPQPKP

SEQ ID NO: 78053 - protein, 8 aa, Dengue virus
RTPQPKPG

SEQ ID NO: 78054 - protein, 8 aa, Dengue virus
TPQPKPGT

SEQ ID NO: 78055 - protein, 8 aa, Dengue virus
PQPKPGTR

SEQ ID NO: 78056 - protein, 8 aa, Dengue virus
QPKPGTRM

SEQ ID NO: 78057 - protein, 8 aa, Dengue virus
PKPGTRMV

SEQ ID NO: 78058 - protein, 8 aa, Dengue virus
KPGTRMVM

SEQ ID NO: 78059 - protein, 8 aa, Dengue virus
PGTRMVMT

SEQ ID NO: 78060 - protein, 8 aa, Dengue virus
GTRMVMTT

SEQ ID NO: 78061 - protein, 8 aa, Dengue virus
TRMVMTTT

SEQ ID NO: 78062 - protein, 8 aa, Dengue virus
RMVMTTTA

SEQ ID NO: 78063 - protein, 8 aa, Dengue virus
MVMTTTAN

SEQ ID NO: 78064 - protein, 8 aa, Dengue virus
VMTTTANW

SEQ ID NO: 78065 - protein, 8 aa, Dengue virus
MTTTANWL

SEQ ID NO: 78066 - protein, 8 aa, Dengue virus
TTTANWLW

SEQ ID NO: 78067 - protein, 8 aa, Dengue virus
TTANWLWA

SEQ ID NO: 78068 - protein, 8 aa, Dengue virus
TANWLWAL

SEQ ID NO: 78069 - protein, 8 aa, Dengue virus
ANWLWALL

SEQ ID NO: 78070 - protein, 8 aa, Dengue virus
NWLWALLG

SEQ ID NO: 78071 - protein, 8 aa, Dengue virus
WLWALLGK

SEQ ID NO: 78072 - protein, 8 aa, Dengue virus
LWALLGKK

SEQ ID NO: 78073 - protein, 8 aa, Dengue virus
WALLGKKK

SEQ ID NO: 78074 - protein, 8 aa, Dengue virus
LLGKKKNP

SEQ ID NO: 78075 - protein, 8 aa, Dengue virus
LGKKKNPR

SEQ ID NO: 78076 - protein, 8 aa, Dengue virus
GKKKNPRL

SEQ ID NO: 78077 - protein, 8 aa, Dengue virus
KKKNPRLC

SEQ ID NO: 78078 - protein, 8 aa, Dengue virus
KKNPRLCT

SEQ ID NO: 78079 - protein, 8 aa, Dengue virus
KNPRLCTR

SEQ ID NO: 78080 - protein, 8 aa, Dengue virus
NPRLCTRE

SEQ ID NO: 78081 - protein, 8 aa, Dengue virus
PRLCTREE

SEQ ID NO: 78082 - protein, 8 aa, Dengue virus
RLCTREEF

SEQ ID NO: 78083 - protein, 8 aa, Dengue virus
LCTREEFI

SEQ ID NO: 78084 - protein, 8 aa, Dengue virus
CTREEFIS

SEQ ID NO: 78085 - protein, 8 aa, Dengue virus
TREEFISK

SEQ ID NO: 78086 - protein, 8 aa, Dengue virus
REEFISKV

SEQ ID NO: 78087 - protein, 8 aa, Dengue virus
EEFISKVR

SEQ ID NO: 78088 - protein, 8 aa, Dengue virus
EFISKVRS

SEQ ID NO: 78089 - protein, 8 aa, Dengue virus
FISKVRSN

SEQ ID NO: 78090 - protein, 8 aa, Dengue virus
ISKVRSNA

SEQ ID NO: 78091 - protein, 8 aa, Dengue virus
SKVRSNAA

SEQ ID NO: 78092 - protein, 8 aa, Dengue virus
KVRSNAAI

SEQ ID NO: 78093 - protein, 8 aa, Dengue virus
VRSNAAIG

SEQ ID NO: 78094 - protein, 8 aa, Dengue virus
RSNAAIGA

SEQ ID NO: 78095 - protein, 8 aa, Dengue virus
SNAAIGAV

SEQ ID NO: 78096 - protein, 8 aa, Dengue virus
NAAIGAVF

SEQ ID NO: 78097 - protein, 8 aa, Dengue virus
AAIGAVFQ

SEQ ID NO: 78098 - protein, 8 aa, Dengue virus
AIGAVFQE

SEQ ID NO: 78099 - protein, 8 aa, Dengue virus
IGAVFQEE

SEQ ID NO: 78100 - protein, 8 aa, Dengue virus
GAVFQEEQ

SEQ ID NO: 78101 - protein, 8 aa, Dengue virus
AVFQEEQG

SEQ ID NO: 78102 - protein, 8 aa, Dengue virus
VFQEEQGW

SEQ ID NO: 78103 - protein, 8 aa, Dengue virus
FQEEQGWT

SEQ ID NO: 78104 - protein, 8 aa, Dengue virus
QEEQGWTS

SEQ ID NO: 78105 - protein, 8 aa, Dengue virus
EEQGWTSA

SEQ ID NO: 78106 - protein, 8 aa, Dengue virus
EQGWTSAS

SEQ ID NO: 78107 - protein, 8 aa, Dengue virus
QGWTSASE

SEQ ID NO: 78108 - protein, 8 aa, Dengue virus
GWTSASEA

SEQ ID NO: 78109 - protein, 8 aa, Dengue virus
WTSASEAV

SEQ ID NO: 78110 - protein, 8 aa, Dengue virus
TSASEAVN

SEQ ID NO: 78111 - protein, 8 aa, Dengue virus
SASEAVND

SEQ ID NO: 78112 - protein, 8 aa, Dengue virus
ASEAVNDS

SEQ ID NO: 78113 - protein, 8 aa, Dengue virus
SEAVNDSR

SEQ ID NO: 78114 - protein, 8 aa, Dengue virus
EAVNDSRF

SEQ ID NO: 78115 - protein, 8 aa, Dengue virus
AVNDSRFW

SEQ ID NO: 78116 - protein, 8 aa, Dengue virus
VNDSRFWE

SEQ ID NO: 78117 - protein, 8 aa, Dengue virus
NDSRFWEL

SEQ ID NO: 78118 - protein, 8 aa, Dengue virus
DSRFWELV

SEQ ID NO: 78119 - protein, 8 aa, Dengue virus
SRFWELVD

SEQ ID NO: 78120 - protein, 8 aa, Dengue virus
RFWELVDK

SEQ ID NO: 78121 - protein, 8 aa, Dengue virus
FWELVDKE

SEQ ID NO: 78122 - protein, 8 aa, Dengue virus
WELVDKER

SEQ ID NO: 78123 - protein, 8 aa, Dengue virus
ELVDKERA

SEQ ID NO: 78124 - protein, 8 aa, Dengue virus
LVDKERAL

SEQ ID NO: 78125 - protein, 8 aa, Dengue virus
VDKERALH

SEQ ID NO: 78126 - protein, 8 aa, Dengue virus
DKERALHQ

SEQ ID NO: 78127 - protein, 8 aa, Dengue virus
KERALHQE

SEQ ID NO: 78128 - protein, 8 aa, Dengue virus
ERALHQEG

SEQ ID NO: 78129 - protein, 8 aa, Dengue virus
RALHQEGK

SEQ ID NO: 78130 - protein, 8 aa, Dengue virus
ALHQEGKC

SEQ ID NO: 78131 - protein, 8 aa, Dengue virus
LHQEGKCE

SEQ ID NO: 78132 - protein, 8 aa, Dengue virus
HQEGKCES

SEQ ID NO: 78133 - protein, 8 aa, Dengue virus
QEGKCESC

SEQ ID NO: 78134 - protein, 8 aa, Dengue virus
EGKCESCV

SEQ ID NO: 78135 - protein, 8 aa, Dengue virus
GKCESCVY

SEQ ID NO: 78136 - protein, 8 aa, Dengue virus
KCESCVYN

SEQ ID NO: 78137 - protein, 8 aa, Dengue virus
CESCVYNM

SEQ ID NO: 78138 - protein, 8 aa, Dengue virus
ESCVYNMM

SEQ ID NO: 78139 - protein, 8 aa, Dengue virus
SCVYNMMG

SEQ ID NO: 78140 - protein, 8 aa, Dengue virus
CVYNMMGK

SEQ ID NO: 78141 - protein, 8 aa, Dengue virus
VYNMMGKR

SEQ ID NO: 78142 - protein, 8 aa, Dengue virus
YNMMGKRE

SEQ ID NO: 78143 - protein, 8 aa, Dengue virus
NMMGKREK

SEQ ID NO: 78144 - protein, 8 aa, Dengue virus
MMGKREKK

SEQ ID NO: 78145 - protein, 8 aa, Dengue virus
MGKREKKL

SEQ ID NO: 78146 - protein, 8 aa, Dengue virus
GKREKKLG

SEQ ID NO: 78147 - protein, 8 aa, Dengue virus
KREKKLGE

SEQ ID NO: 78148 - protein, 8 aa, Dengue virus
REKKLGEF

SEQ ID NO: 78149 - protein, 8 aa, Dengue virus
EKKLGEFG

SEQ ID NO: 78150 - protein, 8 aa, Dengue virus
KKLGEFGR

SEQ ID NO: 78151 - protein, 8 aa, Dengue virus
KLGEFGRA

SEQ ID NO: 78152 - protein, 8 aa, Dengue virus
LGEFGRAK

SEQ ID NO: 78153 - protein, 8 aa, Dengue virus
GEFGRAKG

SEQ ID NO: 78154 - protein, 8 aa, Dengue virus
EFGRAKGS

SEQ ID NO: 78155 - protein, 8 aa, Dengue virus
FGRAKGSR

SEQ ID NO: 78156 - protein, 8 aa, Dengue virus
GRAKGSRA

SEQ ID NO: 78157 - protein, 8 aa, Dengue virus
RAKGSRAI

SEQ ID NO: 78158 - protein, 8 aa, Dengue virus
AKGSRAIW

SEQ ID NO: 78159 - protein, 8 aa, Dengue virus
KGSRAIWY

SEQ ID NO: 78160 - protein, 8 aa, Dengue virus
GSRAIWYM

SEQ ID NO: 78161 - protein, 8 aa, Dengue virus
SRAIWYMW

SEQ ID NO: 78162 - protein, 8 aa, Dengue virus
RAIWYMWL

SEQ ID NO: 78163 - protein, 8 aa, Dengue virus
AIWYMWLG

SEQ ID NO: 78164 - protein, 8 aa, Dengue virus
IWYMWLGA

SEQ ID NO: 78165 - protein, 8 aa, Dengue virus
WYMWLGAR

SEQ ID NO: 78166 - protein, 8 aa, Dengue virus
YMWLGARF

SEQ ID NO: 78167 - protein, 8 aa, Dengue virus
MWLGARFL

SEQ ID NO: 78168 - protein, 8 aa, Dengue virus
WLGARFLE

SEQ ID NO: 78169 - protein, 8 aa, Dengue virus
LGARFLEF

SEQ ID NO: 78170 - protein, 8 aa, Dengue virus
GARFLEFE

SEQ ID NO: 78171 - protein, 8 aa, Dengue virus
ARFLEFEA

SEQ ID NO: 78172 - protein, 8 aa, Dengue virus
RFLEFEAL

SEQ ID NO: 78173 - protein, 8 aa, Dengue virus
FLEFEALG

SEQ ID NO: 78174 - protein, 8 aa, Dengue virus
LEFEALGF

SEQ ID NO: 78175 - protein, 8 aa, Dengue virus
EFEALGFL

SEQ ID NO: 78176 - protein, 8 aa, Dengue virus
FEALGFLN

SEQ ID NO: 78177 - protein, 8 aa, Dengue virus
EALGFLNE

SEQ ID NO: 78178 - protein, 8 aa, Dengue virus
ALGFLNED

SEQ ID NO: 78179 - protein, 8 aa, Dengue virus
LGFLNEDH

SEQ ID NO: 78180 - protein, 8 aa, Dengue virus
GFLNEDHW

SEQ ID NO: 78181 - protein, 8 aa, Dengue virus
FLNEDHWF

SEQ ID NO: 78182 - protein, 8 aa, Dengue virus
LNEDHWFG

SEQ ID NO: 78183 - protein, 8 aa, Dengue virus
NEDHWFGR

SEQ ID NO: 78184 - protein, 8 aa, Dengue virus
EDHWFGRE

SEQ ID NO: 78185 - protein, 8 aa, Dengue virus
DHWFGREN

SEQ ID NO: 78186 - protein, 8 aa, Dengue virus
HWFGRENS

SEQ ID NO: 78187 - protein, 8 aa, Dengue virus
WFGRENSW

SEQ ID NO: 78188 - protein, 8 aa, Dengue virus
FGRENSWS

SEQ ID NO: 78189 - protein, 8 aa, Dengue virus
GRENSWSG

SEQ ID NO: 78190 - protein, 8 aa, Dengue virus
RENSWSGV

SEQ ID NO: 78191 - protein, 8 aa, Dengue virus
ENSWSGVE

SEQ ID NO: 78192 - protein, 8 aa, Dengue virus
NSWSGVEG

SEQ ID NO: 78193 - protein, 8 aa, Dengue virus
SWSGVEGE

SEQ ID NO: 78194 - protein, 8 aa, Dengue virus
WSGVEGEG

SEQ ID NO: 78195 - protein, 8 aa, Dengue virus
SGVEGEGL

SEQ ID NO: 78196 - protein, 8 aa, Dengue virus
GVEGEGLH

SEQ ID NO: 78197 - protein, 8 aa, Dengue virus
VEGEGLHR

SEQ ID NO: 78198 - protein, 8 aa, Dengue virus
EGEGLHRL

SEQ ID NO: 78199 - protein, 8 aa, Dengue virus
GEGLHRLG

SEQ ID NO: 78200 - protein, 8 aa, Dengue virus
EGLHRLGY

SEQ ID NO: 78201 - protein, 8 aa, Dengue virus
GLHRLGYI

SEQ ID NO: 78202 - protein, 8 aa, Dengue virus
LHRLGYIL

SEQ ID NO: 78203 - protein, 8 aa, Dengue virus
HRLGYILE

SEQ ID NO: 78204 - protein, 8 aa, Dengue virus
RLGYILEE

SEQ ID NO: 78205 - protein, 8 aa, Dengue virus
LGYILEEI

SEQ ID NO: 78206 - protein, 8 aa, Dengue virus
GYILEEID

SEQ ID NO: 78207 - protein, 8 aa, Dengue virus
YILEEIDK

SEQ ID NO: 78208 - protein, 8 aa, Dengue virus
ILEEIDKK

SEQ ID NO: 78209 - protein, 8 aa, Dengue virus
LEEIDKKD

SEQ ID NO: 78210 - protein, 8 aa, Dengue virus
EEIDKKDG

SEQ ID NO: 78211 - protein, 8 aa, Dengue virus
EIDKKDGD

SEQ ID NO: 78212 - protein, 8 aa, Dengue virus
IDKKDGDL

SEQ ID NO: 78213 - protein, 8 aa, Dengue virus
DKKDGDLM

SEQ ID NO: 78214 - protein, 8 aa, Dengue virus
KKDGDLMY

SEQ ID NO: 78215 - protein, 8 aa, Dengue virus
KDGDLMYA

SEQ ID NO: 78216 - protein, 8 aa, Dengue virus
DGDLMYAD

SEQ ID NO: 78217 - protein, 8 aa, Dengue virus
GDLMYADD

SEQ ID NO: 78218 - protein, 8 aa, Dengue virus
DLMYADDT

SEQ ID NO: 78219 - protein, 8 aa, Dengue virus
LMYADDTA

SEQ ID NO: 78220 - protein, 8 aa, Dengue virus
MYADDTAG

SEQ ID NO: 78221 - protein, 8 aa, Dengue virus
YADDTAGW

SEQ ID NO: 78222 - protein, 8 aa, Dengue virus
ADDTAGWD

SEQ ID NO: 78223 - protein, 8 aa, Dengue virus
DDTAGWDT

SEQ ID NO: 78224 - protein, 8 aa, Dengue virus
DTAGWDTR

SEQ ID NO: 78225 - protein, 8 aa, Dengue virus
TAGWDTRI

SEQ ID NO: 78226 - protein, 8 aa, Dengue virus
AGWDTRIT

SEQ ID NO: 78227 - protein, 8 aa, Dengue virus
GWDTRITE

SEQ ID NO: 78228 - protein, 8 aa, Dengue virus
WDTRITED

SEQ ID NO: 78229 - protein, 8 aa, Dengue virus
DTRITEDD

SEQ ID NO: 78230 - protein, 8 aa, Dengue virus
TRITEDDL

SEQ ID NO: 78231 - protein, 8 aa, Dengue virus
RITEDDLQ

SEQ ID NO: 78232 - protein, 8 aa, Dengue virus
ITEDDLQN

SEQ ID NO: 78233 - protein, 8 aa, Dengue virus
TEDDLQNE

SEQ ID NO: 78234 - protein, 8 aa, Dengue virus
EDDLQNEE

SEQ ID NO: 78235 - protein, 8 aa, Dengue virus
DDLQNEEL

SEQ ID NO: 78236 - protein, 8 aa, Dengue virus
DLQNEELI

SEQ ID NO: 78237 - protein, 8 aa, Dengue virus
LQNEELIT

SEQ ID NO: 78238 - protein, 8 aa, Dengue virus
QNEELITE

SEQ ID NO: 78239 - protein, 8 aa, Dengue virus
NEELITEQ

SEQ ID NO: 78240 - protein, 8 aa, Dengue virus
EELITEQM

SEQ ID NO: 78241 - protein, 8 aa, Dengue virus
ELITEQMA

SEQ ID NO: 78242 - protein, 8 aa, Dengue virus
LITEQMAP

SEQ ID NO: 78243 - protein, 8 aa, Dengue virus
ITEQMAPH

SEQ ID NO: 78244 - protein, 8 aa, Dengue virus
TEQMAPHH

SEQ ID NO: 78245 - protein, 8 aa, Dengue virus
EQMAPHHK

SEQ ID NO: 78246 - protein, 8 aa, Dengue virus
QMAPHHKI

SEQ ID NO: 78247 - protein, 8 aa, Dengue virus
MAPHHKIL

SEQ ID NO: 78248 - protein, 8 aa, Dengue virus
APHHKILA

SEQ ID NO: 78249 - protein, 8 aa, Dengue virus
PHHKILAK

SEQ ID NO: 78250 - protein, 8 aa, Dengue virus
HHKILAKA

SEQ ID NO: 78251 - protein, 8 aa, Dengue virus
HKILAKAI

SEQ ID NO: 78252 - protein, 8 aa, Dengue virus
KILAKAIF

SEQ ID NO: 78253 - protein, 8 aa, Dengue virus
ILAKAIFK

SEQ ID NO: 78254 - protein, 8 aa, Dengue virus
LAKAIFKL

SEQ ID NO: 78255 - protein, 8 aa, Dengue virus
AKAIFKLT

SEQ ID NO: 78256 - protein, 8 aa, Dengue virus
KAIFKLTY

SEQ ID NO: 78257 - protein, 8 aa, Dengue virus
AIFKLTYQ

SEQ ID NO: 78258 - protein, 8 aa, Dengue virus
IFKLTYQN

SEQ ID NO: 78259 - protein, 8 aa, Dengue virus
FKLTYQNK

SEQ ID NO: 78260 - protein, 8 aa, Dengue virus
KLTYQNKV

SEQ ID NO: 78261 - protein, 8 aa, Dengue virus
LTYQNKVV

SEQ ID NO: 78262 - protein, 8 aa, Dengue virus
TYQNKVVK

SEQ ID NO: 78263 - protein, 8 aa, Dengue virus
YQNKVVKV

SEQ ID NO: 78264 - protein, 8 aa, Dengue virus
QNKVVKVL

SEQ ID NO: 78265 - protein, 8 aa, Dengue virus
NKVVKVLR

SEQ ID NO: 78266 - protein, 8 aa, Dengue virus
KVVKVLRP

SEQ ID NO: 78267 - protein, 8 aa, Dengue virus
VVKVLRPT

SEQ ID NO: 78268 - protein, 8 aa, Dengue virus
VKVLRPTP

SEQ ID NO: 78269 - protein, 8 aa, Dengue virus
KVLRPTPR

SEQ ID NO: 78270 - protein, 8 aa, Dengue virus
VLRPTPRG

SEQ ID NO: 78271 - protein, 8 aa, Dengue virus
LRPTPRGA

SEQ ID NO: 78272 - protein, 8 aa, Dengue virus
RPTPRGAV

SEQ ID NO: 78273 - protein, 8 aa, Dengue virus
PTPRGAVM

SEQ ID NO: 78274 - protein, 8 aa, Dengue virus
TPRGAVMD

SEQ ID NO: 78275 - protein, 8 aa, Dengue virus
PRGAVMDI

SEQ ID NO: 78276 - protein, 8 aa, Dengue virus
RGAVMDII

SEQ ID NO: 78277 - protein, 8 aa, Dengue virus
GAVMDIIS

SEQ ID NO: 78278 - protein, 8 aa, Dengue virus
AVMDIISR

SEQ ID NO: 78279 - protein, 8 aa, Dengue virus
VMDIISRK

SEQ ID NO: 78280 - protein, 8 aa, Dengue virus
MDIISRKD

SEQ ID NO: 78281 - protein, 8 aa, Dengue virus
DIISRKDQ

SEQ ID NO: 78282 - protein, 8 aa, Dengue virus
IISRKDQR

SEQ ID NO: 78283 - protein, 8 aa, Dengue virus
ISRKDQRG

SEQ ID NO: 78284 - protein, 8 aa, Dengue virus
SRKDQRGS

SEQ ID NO: 78285 - protein, 8 aa, Dengue virus
RKDQRGSG

SEQ ID NO: 78286 - protein, 8 aa, Dengue virus
KDQRGSGQ

SEQ ID NO: 78287 - protein, 8 aa, Dengue virus
DQRGSGQV

SEQ ID NO: 78288 - protein, 8 aa, Dengue virus
QRGSGQVG

SEQ ID NO: 78289 - protein, 8 aa, Dengue virus
RGSGQVGT

SEQ ID NO: 78290 - protein, 8 aa, Dengue virus
GSGQVGTY

SEQ ID NO: 78291 - protein, 8 aa, Dengue virus
SGQVGTYG

SEQ ID NO: 78292 - protein, 8 aa, Dengue virus
GQVGTYGL

SEQ ID NO: 78293 - protein, 8 aa, Dengue virus
QVGTYGLN

SEQ ID NO: 78294 - protein, 8 aa, Dengue virus
VGTYGLNT

SEQ ID NO: 78295 - protein, 8 aa, Dengue virus
GTYGLNTF

SEQ ID NO: 78296 - protein, 8 aa, Dengue virus
TYGLNTFT

SEQ ID NO: 78297 - protein, 8 aa, Dengue virus
YGLNTFTN

SEQ ID NO: 78298 - protein, 8 aa, Dengue virus
GLNTFTNM

SEQ ID NO: 78299 - protein, 8 aa, Dengue virus
LNTFTNME

SEQ ID NO: 78300 - protein, 8 aa, Dengue virus
NTFTNMEV

SEQ ID NO: 78301 - protein, 8 aa, Dengue virus
TFTNMEVQ

SEQ ID NO: 78302 - protein, 8 aa, Dengue virus
FTNMEVQL

SEQ ID NO: 78303 - protein, 8 aa, Dengue virus
TNMEVQLI

SEQ ID NO: 78304 - protein, 8 aa, Dengue virus
NMEVQLIR

SEQ ID NO: 78305 - protein, 8 aa, Dengue virus
MEVQLIRQ

SEQ ID NO: 78306 - protein, 8 aa, Dengue virus
EVQLIRQM

SEQ ID NO: 78307 - protein, 8 aa, Dengue virus
VQLIRQME

SEQ ID NO: 78308 - protein, 8 aa, Dengue virus
QLIRQMEA

SEQ ID NO: 78309 - protein, 8 aa, Dengue virus
LIRQMEAE

SEQ ID NO: 78310 - protein, 8 aa, Dengue virus
IRQMEAEG

SEQ ID NO: 78311 - protein, 8 aa, Dengue virus
RQMEAEGV

SEQ ID NO: 78312 - protein, 8 aa, Dengue virus
QMEAEGVI

SEQ ID NO: 78313 - protein, 8 aa, Dengue virus
MEAEGVIT

SEQ ID NO: 78314 - protein, 8 aa, Dengue virus
EAEGVITQ

SEQ ID NO: 78315 - protein, 8 aa, Dengue virus
AEGVITQD

SEQ ID NO: 78316 - protein, 8 aa, Dengue virus
EGVITQDD

SEQ ID NO: 78317 - protein, 8 aa, Dengue virus
GVITQDDM

SEQ ID NO: 78318 - protein, 8 aa, Dengue virus
VITQDDMQ

SEQ ID NO: 78319 - protein, 8 aa, Dengue virus
ITQDDMQN

SEQ ID NO: 78320 - protein, 8 aa, Dengue virus
TQDDMQNP

SEQ ID NO: 78321 - protein, 8 aa, Dengue virus
QDDMQNPK

SEQ ID NO: 78322 - protein, 8 aa, Dengue virus
DDMQNPKG

SEQ ID NO: 78323 - protein, 8 aa, Dengue virus
DMQNPKGL

SEQ ID NO: 78324 - protein, 8 aa, Dengue virus
MQNPKGLK

SEQ ID NO: 78325 - protein, 8 aa, Dengue virus
QNPKGLKE

SEQ ID NO: 78326 - protein, 8 aa, Dengue virus
NPKGLKER

SEQ ID NO: 78327 - protein, 8 aa, Dengue virus
PKGLKERV

SEQ ID NO: 78328 - protein, 8 aa, Dengue virus
KGLKERVE

SEQ ID NO: 78329 - protein, 8 aa, Dengue virus
GLKERVEK

SEQ ID NO: 78330 - protein, 8 aa, Dengue virus
LKERVEKW

SEQ ID NO: 78331 - protein, 8 aa, Dengue virus
KERVEKWL

SEQ ID NO: 78332 - protein, 8 aa, Dengue virus
ERVEKWLR

SEQ ID NO: 78333 - protein, 8 aa, Dengue virus
RVEKWLRE

SEQ ID NO: 78334 - protein, 8 aa, Dengue virus
VEKWLREC

SEQ ID NO: 78335 - protein, 8 aa, Dengue virus
EKWLRECG

SEQ ID NO: 78336 - protein, 8 aa, Dengue virus
KWLRECGV

SEQ ID NO: 78337 - protein, 8 aa, Dengue virus
WLRECGVD

SEQ ID NO: 78338 - protein, 8 aa, Dengue virus
LRECGVDR

SEQ ID NO: 78339 - protein, 8 aa, Dengue virus
RECGVDRL

SEQ ID NO: 78340 - protein, 8 aa, Dengue virus
ECGVDRLK

SEQ ID NO: 78341 - protein, 8 aa, Dengue virus
CGVDRLKR

SEQ ID NO: 78342 - protein, 8 aa, Dengue virus
GVDRLKRM

SEQ ID NO: 78343 - protein, 8 aa, Dengue virus
VDRLKRMA

SEQ ID NO: 78344 - protein, 8 aa, Dengue virus
DRLKRMAI

SEQ ID NO: 78345 - protein, 8 aa, Dengue virus
RLKRMAIS

SEQ ID NO: 78346 - protein, 8 aa, Dengue virus
LKRMAISG

SEQ ID NO: 78347 - protein, 8 aa, Dengue virus
KRMAISGD

SEQ ID NO: 78348 - protein, 8 aa, Dengue virus
RMAISGDD

SEQ ID NO: 78349 - protein, 8 aa, Dengue virus
MAISGDDC

SEQ ID NO: 78350 - protein, 8 aa, Dengue virus
AISGDDCV

SEQ ID NO: 78351 - protein, 8 aa, Dengue virus
ISGDDCVV

SEQ ID NO: 78352 - protein, 8 aa, Dengue virus
SGDDCVVK

SEQ ID NO: 78353 - protein, 8 aa, Dengue virus
GDDCVVKP

SEQ ID NO: 78354 - protein, 8 aa, Dengue virus
DDCVVKPL

SEQ ID NO: 78355 - protein, 8 aa, Dengue virus
DCVVKPLD

SEQ ID NO: 78356 - protein, 8 aa, Dengue virus
CVVKPLDE

SEQ ID NO: 78357 - protein, 8 aa, Dengue virus
VVKPLDER

SEQ ID NO: 78358 - protein, 8 aa, Dengue virus
VKPLDERF

SEQ ID NO: 78359 - protein, 8 aa, Dengue virus
KPLDERFG

SEQ ID NO: 78360 - protein, 8 aa, Dengue virus
PLDERFGT

SEQ ID NO: 78361 - protein, 8 aa, Dengue virus
LDERFGTS

SEQ ID NO: 78362 - protein, 8 aa, Dengue virus
DERFGTSL

SEQ ID NO: 78363 - protein, 8 aa, Dengue virus
ERFGTSLL

SEQ ID NO: 78364 - protein, 8 aa, Dengue virus
RFGTSLLF

SEQ ID NO: 78365 - protein, 8 aa, Dengue virus
FGTSLLFL

SEQ ID NO: 78366 - protein, 8 aa, Dengue virus
GTSLLFLN

SEQ ID NO: 78367 - protein, 8 aa, Dengue virus
TSLLFLND

SEQ ID NO: 78368 - protein, 8 aa, Dengue virus
SLLFLNDM

SEQ ID NO: 78369 - protein, 8 aa, Dengue virus
LLFLNDMG

SEQ ID NO: 78370 - protein, 8 aa, Dengue virus
LFLNDMGK

SEQ ID NO: 78371 - protein, 8 aa, Dengue virus
FLNDMGKV

SEQ ID NO: 78372 - protein, 8 aa, Dengue virus
LNDMGKVR

SEQ ID NO: 78373 - protein, 8 aa, Dengue virus
NDMGKVRK

SEQ ID NO: 78374 - protein, 8 aa, Dengue virus
DMGKVRKD

SEQ ID NO: 78375 - protein, 8 aa, Dengue virus
MGKVRKDI

SEQ ID NO: 78376 - protein, 8 aa, Dengue virus
GKVRKDIP

SEQ ID NO: 78377 - protein, 8 aa, Dengue virus
KVRKDIPQ

SEQ ID NO: 78378 - protein, 8 aa, Dengue virus
VRKDIPQW

SEQ ID NO: 78379 - protein, 8 aa, Dengue virus
RKDIPQWE

SEQ ID NO: 78380 - protein, 8 aa, Dengue virus
KDIPQWEP

SEQ ID NO: 78381 - protein, 8 aa, Dengue virus
DIPQWEPS

SEQ ID NO: 78382 - protein, 8 aa, Dengue virus
IPQWEPSK

SEQ ID NO: 78383 - protein, 8 aa, Dengue virus
PQWEPSKG

SEQ ID NO: 78384 - protein, 8 aa, Dengue virus
QWEPSKGW

SEQ ID NO: 78385 - protein, 8 aa, Dengue virus
WEPSKGWK

SEQ ID NO: 78386 - protein, 8 aa, Dengue virus
EPSKGWKN

SEQ ID NO: 78387 - protein, 8 aa, Dengue virus
PSKGWKNW

SEQ ID NO: 78388 - protein, 8 aa, Dengue virus
SKGWKNWQ

SEQ ID NO: 78389 - protein, 8 aa, Dengue virus
KGWKNWQE

SEQ ID NO: 78390 - protein, 8 aa, Dengue virus
GWKNWQEV

SEQ ID NO: 78391 - protein, 8 aa, Dengue virus
WKNWQEVP

SEQ ID NO: 78392 - protein, 8 aa, Dengue virus
KNWQEVPF

SEQ ID NO: 78393 - protein, 8 aa, Dengue virus
NWQEVPFC

SEQ ID NO: 78394 - protein, 8 aa, Dengue virus
WQEVPFCS

SEQ ID NO: 78395 - protein, 8 aa, Dengue virus
QEVPFCSH

SEQ ID NO: 78396 - protein, 8 aa, Dengue virus
EVPFCSHH

SEQ ID NO: 78397 - protein, 8 aa, Dengue virus
VPFCSHHF

SEQ ID NO: 78398 - protein, 8 aa, Dengue virus
PFCSHHFH

SEQ ID NO: 78399 - protein, 8 aa, Dengue virus
FCSHHFHK

SEQ ID NO: 78400 - protein, 8 aa, Dengue virus
CSHHFHKI

SEQ ID NO: 78401 - protein, 8 aa, Dengue virus
SHHFHKIF

SEQ ID NO: 78402 - protein, 8 aa, Dengue virus
HHFHKIFM

SEQ ID NO: 78403 - protein, 8 aa, Dengue virus
HFHKIFMK

SEQ ID NO: 78404 - protein, 8 aa, Dengue virus
FHKIFMKD

SEQ ID NO: 78405 - protein, 8 aa, Dengue virus
HKIFMKDG

SEQ ID NO: 78406 - protein, 8 aa, Dengue virus
KIFMKDGR

SEQ ID NO: 78407 - protein, 8 aa, Dengue virus
IFMKDGRS

SEQ ID NO: 78408 - protein, 8 aa, Dengue virus
FMKDGRSL

SEQ ID NO: 78409 - protein, 8 aa, Dengue virus
MKDGRSLV

SEQ ID NO: 78410 - protein, 8 aa, Dengue virus
KDGRSLVV

SEQ ID NO: 78411 - protein, 8 aa, Dengue virus
DGRSLVVP

SEQ ID NO: 78412 - protein, 8 aa, Dengue virus
GRSLVVPC

SEQ ID NO: 78413 - protein, 8 aa, Dengue virus
RSLVVPCR

SEQ ID NO: 78414 - protein, 8 aa, Dengue virus
SLVVPCRN

SEQ ID NO: 78415 - protein, 8 aa, Dengue virus
LVVPCRNQ

SEQ ID NO: 78416 - protein, 8 aa, Dengue virus
VVPCRNQD

SEQ ID NO: 78417 - protein, 8 aa, Dengue virus
VPCRNQDE

SEQ ID NO: 78418 - protein, 8 aa, Dengue virus
PCRNQDEL

SEQ ID NO: 78419 - protein, 8 aa, Dengue virus
CRNQDELI

SEQ ID NO: 78420 - protein, 8 aa, Dengue virus
RNQDELIG

SEQ ID NO: 78421 - protein, 8 aa, Dengue virus
NQDELIGR

SEQ ID NO: 78422 - protein, 8 aa, Dengue virus
QDELIGRA

SEQ ID NO: 78423 - protein, 8 aa, Dengue virus
DELIGRAR

SEQ ID NO: 78424 - protein, 8 aa, Dengue virus
ELIGRARI

SEQ ID NO: 78425 - protein, 8 aa, Dengue virus
LIGRARIS

SEQ ID NO: 78426 - protein, 8 aa, Dengue virus
IGRARISQ

SEQ ID NO: 78427 - protein, 8 aa, Dengue virus
GRARISQG

SEQ ID NO: 78428 - protein, 8 aa, Dengue virus
RARISQGA

SEQ ID NO: 78429 - protein, 8 aa, Dengue virus
ARISQGAG

SEQ ID NO: 78430 - protein, 8 aa, Dengue virus
RISQGAGW

SEQ ID NO: 78431 - protein, 8 aa, Dengue virus
ISQGAGWS

SEQ ID NO: 78432 - protein, 8 aa, Dengue virus
SQGAGWSL

SEQ ID NO: 78433 - protein, 8 aa, Dengue virus
QGAGWSLR

SEQ ID NO: 78434 - protein, 8 aa, Dengue virus
GAGWSLRE

SEQ ID NO: 78435 - protein, 8 aa, Dengue virus
AGWSLRET

SEQ ID NO: 78436 - protein, 8 aa, Dengue virus
GWSLRETA

SEQ ID NO: 78437 - protein, 8 aa, Dengue virus
WSLRETAC

SEQ ID NO: 78438 - protein, 8 aa, Dengue virus
SLRETACL

SEQ ID NO: 78439 - protein, 8 aa, Dengue virus
LRETACLG

SEQ ID NO: 78440 - protein, 8 aa, Dengue virus
RETACLGK

SEQ ID NO: 78441 - protein, 8 aa, Dengue virus
ETACLGKA

SEQ ID NO: 78442 - protein, 8 aa, Dengue virus
TACLGKAY

SEQ ID NO: 78443 - protein, 8 aa, Dengue virus
ACLGKAYA

SEQ ID NO: 78444 - protein, 8 aa, Dengue virus
CLGKAYAQ

SEQ ID NO: 78445 - protein, 8 aa, Dengue virus
LGKAYAQM

SEQ ID NO: 78446 - protein, 8 aa, Dengue virus
GKAYAQMW

SEQ ID NO: 78447 - protein, 8 aa, Dengue virus
KAYAQMWS

SEQ ID NO: 78448 - protein, 8 aa, Dengue virus
AYAQMWSL

SEQ ID NO: 78449 - protein, 8 aa, Dengue virus
YAQMWSLM

SEQ ID NO: 78450 - protein, 8 aa, Dengue virus
AQMWSLMY

SEQ ID NO: 78451 - protein, 8 aa, Dengue virus
QMWSLMYF

SEQ ID NO: 78452 - protein, 8 aa, Dengue virus
MWSLMYFH

SEQ ID NO: 78453 - protein, 8 aa, Dengue virus
WSLMYFHR

SEQ ID NO: 78454 - protein, 8 aa, Dengue virus
SLMYFHRR

SEQ ID NO: 78455 - protein, 8 aa, Dengue virus
LMYFHRRD

SEQ ID NO: 78456 - protein, 8 aa, Dengue virus
MYFHRRDL

SEQ ID NO: 78457 - protein, 8 aa, Dengue virus
YFHRRDLR

SEQ ID NO: 78458 - protein, 8 aa, Dengue virus
FHRRDLRL

SEQ ID NO: 78459 - protein, 8 aa, Dengue virus
HRRDLRLA

SEQ ID NO: 78460 - protein, 8 aa, Dengue virus
RRDLRLAS

SEQ ID NO: 78461 - protein, 8 aa, Dengue virus
RDLRLASM

SEQ ID NO: 78462 - protein, 8 aa, Dengue virus
DLRLASMA

SEQ ID NO: 78463 - protein, 8 aa, Dengue virus
LRLASMAI

SEQ ID NO: 78464 - protein, 8 aa, Dengue virus
RLASMAIC

SEQ ID NO: 78465 - protein, 8 aa, Dengue virus
LASMAICS

SEQ ID NO: 78466 - protein, 8 aa, Dengue virus
ASMAICSA

SEQ ID NO: 78467 - protein, 8 aa, Dengue virus
SMAICSAV

SEQ ID NO: 78468 - protein, 8 aa, Dengue virus
MAICSAVP

SEQ ID NO: 78469 - protein, 8 aa, Dengue virus
AICSAVPT

SEQ ID NO: 78470 - protein, 8 aa, Dengue virus
ICSAVPTE

SEQ ID NO: 78471 - protein, 8 aa, Dengue virus
CSAVPTEW

SEQ ID NO: 78472 - protein, 8 aa, Dengue virus
SAVPTEWF

SEQ ID NO: 78473 - protein, 8 aa, Dengue virus
AVPTEWFP

SEQ ID NO: 78474 - protein, 8 aa, Dengue virus
VPTEWFPT

SEQ ID NO: 78475 - protein, 8 aa, Dengue virus
PTEWFPTS

SEQ ID NO: 78476 - protein, 8 aa, Dengue virus
TEWFPTSR

SEQ ID NO: 78477 - protein, 8 aa, Dengue virus
EWFPTSRT

SEQ ID NO: 78478 - protein, 8 aa, Dengue virus
WFPTSRTT

SEQ ID NO: 78479 - protein, 8 aa, Dengue virus
FPTSRTTW

SEQ ID NO: 78480 - protein, 8 aa, Dengue virus
PTSRTTWS

SEQ ID NO: 78481 - protein, 8 aa, Dengue virus
TSRTTWSI

SEQ ID NO: 78482 - protein, 8 aa, Dengue virus
SRTTWSIH

SEQ ID NO: 78483 - protein, 8 aa, Dengue virus
RTTWSIHA

SEQ ID NO: 78484 - protein, 8 aa, Dengue virus
TTWSIHAH

SEQ ID NO: 78485 - protein, 8 aa, Dengue virus
TWSIHAHH

SEQ ID NO: 78486 - protein, 8 aa, Dengue virus
WSIHAHHQ

SEQ ID NO: 78487 - protein, 8 aa, Dengue virus
SIHAHHQW

SEQ ID NO: 78488 - protein, 8 aa, Dengue virus
IHAHHQWM

SEQ ID NO: 78489 - protein, 8 aa, Dengue virus
HAHHQWMT

SEQ ID NO: 78490 - protein, 8 aa, Dengue virus
AHHQWMTT

SEQ ID NO: 78491 - protein, 8 aa, Dengue virus
HHQWMTTE

SEQ ID NO: 78492 - protein, 8 aa, Dengue virus
HQWMTTED

SEQ ID NO: 78493 - protein, 8 aa, Dengue virus
QWMTTEDM

SEQ ID NO: 78494 - protein, 8 aa, Dengue virus
WMTTEDML

SEQ ID NO: 78495 - protein, 8 aa, Dengue virus
MTTEDMLK

SEQ ID NO: 78496 - protein, 8 aa, Dengue virus
TTEDMLKV

SEQ ID NO: 78497 - protein, 8 aa, Dengue virus
TEDMLKVW

SEQ ID NO: 78498 - protein, 8 aa, Dengue virus
EDMLKVWN

SEQ ID NO: 78499 - protein, 8 aa, Dengue virus
DMLKVWNR

SEQ ID NO: 78500 - protein, 8 aa, Dengue virus
MLKVWNRV

SEQ ID NO: 78501 - protein, 8 aa, Dengue virus
LKVWNRVW

SEQ ID NO: 78502 - protein, 8 aa, Dengue virus
KVWNRVWI

SEQ ID NO: 78503 - protein, 8 aa, Dengue virus
VWNRVWIE

SEQ ID NO: 78504 - protein, 8 aa, Dengue virus
WNRVWIED

SEQ ID NO: 78505 - protein, 8 aa, Dengue virus
NRVWIEDN

SEQ ID NO: 78506 - protein, 8 aa, Dengue virus
RVWIEDNP

SEQ ID NO: 78507 - protein, 8 aa, Dengue virus
VWIEDNPN

SEQ ID NO: 78508 - protein, 8 aa, Dengue virus
WIEDNPNM

SEQ ID NO: 78509 - protein, 8 aa, Dengue virus
IEDNPNMI

SEQ ID NO: 78510 - protein, 8 aa, Dengue virus
EDNPNMID

SEQ ID NO: 78511 - protein, 8 aa, Dengue virus
DNPNMIDK

SEQ ID NO: 78512 - protein, 8 aa, Dengue virus
NPNMIDKT

SEQ ID NO: 78513 - protein, 8 aa, Dengue virus
PNMIDKTP

SEQ ID NO: 78514 - protein, 8 aa, Dengue virus
NMIDKTPV

SEQ ID NO: 78515 - protein, 8 aa, Dengue virus
MIDKTPVH

SEQ ID NO: 78516 - protein, 8 aa, Dengue virus
IDKTPVHS

SEQ ID NO: 78517 - protein, 8 aa, Dengue virus
DKTPVHSW

SEQ ID NO: 78518 - protein, 8 aa, Dengue virus
KTPVHSWE

SEQ ID NO: 78519 - protein, 8 aa, Dengue virus
TPVHSWED

SEQ ID NO: 78520 - protein, 8 aa, Dengue virus
PVHSWEDI

SEQ ID NO: 78521 - protein, 8 aa, Dengue virus
VHSWEDIP

SEQ ID NO: 78522 - protein, 8 aa, Dengue virus
HSWEDIPY

SEQ ID NO: 78523 - protein, 8 aa, Dengue virus
SWEDIPYL

SEQ ID NO: 78524 - protein, 8 aa, Dengue virus
WEDIPYLG

SEQ ID NO: 78525 - protein, 8 aa, Dengue virus
EDIPYLGK

SEQ ID NO: 78526 - protein, 8 aa, Dengue virus
DIPYLGKR

SEQ ID NO: 78527 - protein, 8 aa, Dengue virus
IPYLGKRE

SEQ ID NO: 78528 - protein, 8 aa, Dengue virus
PYLGKRED

SEQ ID NO: 78529 - protein, 8 aa, Dengue virus
YLGKREDL

SEQ ID NO: 78530 - protein, 8 aa, Dengue virus
LGKREDLW

SEQ ID NO: 78531 - protein, 8 aa, Dengue virus
GKREDLWC

SEQ ID NO: 78532 - protein, 8 aa, Dengue virus
KREDLWCG

SEQ ID NO: 78533 - protein, 8 aa, Dengue virus
REDLWCGS

SEQ ID NO: 78534 - protein, 8 aa, Dengue virus
EDLWCGSL

SEQ ID NO: 78535 - protein, 8 aa, Dengue virus
DLWCGSLI

SEQ ID NO: 78536 - protein, 8 aa, Dengue virus
LWCGSLIG

SEQ ID NO: 78537 - protein, 8 aa, Dengue virus
WCGSLIGL

SEQ ID NO: 78538 - protein, 8 aa, Dengue virus
CGSLIGLS

SEQ ID NO: 78539 - protein, 8 aa, Dengue virus
GSLIGLSS

SEQ ID NO: 78540 - protein, 8 aa, Dengue virus
SLIGLSSR

SEQ ID NO: 78541 - protein, 8 aa, Dengue virus
LIGLSSRA

SEQ ID NO: 78542 - protein, 8 aa, Dengue virus
IGLSSRAT

SEQ ID NO: 78543 - protein, 8 aa, Dengue virus
GLSSRATW

SEQ ID NO: 78544 - protein, 8 aa, Dengue virus
LSSRATWA

SEQ ID NO: 78545 - protein, 8 aa, Dengue virus
SSRATWAK

SEQ ID NO: 78546 - protein, 8 aa, Dengue virus
SRATWAKN

SEQ ID NO: 78547 - protein, 8 aa, Dengue virus
RATWAKNI

SEQ ID NO: 78548 - protein, 8 aa, Dengue virus
ATWAKNIH

SEQ ID NO: 78549 - protein, 8 aa, Dengue virus
TWAKNIHT

SEQ ID NO: 78550 - protein, 8 aa, Dengue virus
WAKNIHTA

SEQ ID NO: 78551 - protein, 8 aa, Dengue virus
AKNIHTAI

SEQ ID NO: 78552 - protein, 8 aa, Dengue virus
KNIHTAIT

SEQ ID NO: 78553 - protein, 8 aa, Dengue virus
NIHTAITQ

SEQ ID NO: 78554 - protein, 8 aa, Dengue virus
IHTAITQV

SEQ ID NO: 78555 - protein, 8 aa, Dengue virus
HTAITQVR

SEQ ID NO: 78556 - protein, 8 aa, Dengue virus
TAITQVRN

SEQ ID NO: 78557 - protein, 8 aa, Dengue virus
AITQVRNL

SEQ ID NO: 78558 - protein, 8 aa, Dengue virus
ITQVRNLI

SEQ ID NO: 78559 - protein, 8 aa, Dengue virus
TQVRNLIG

SEQ ID NO: 78560 - protein, 8 aa, Dengue virus
QVRNLIGK

SEQ ID NO: 78561 - protein, 8 aa, Dengue virus
VRNLIGKE

SEQ ID NO: 78562 - protein, 8 aa, Dengue virus
RNLIGKEE

SEQ ID NO: 78563 - protein, 8 aa, Dengue virus
NLIGKEEY

SEQ ID NO: 78564 - protein, 8 aa, Dengue virus
LIGKEEYV

SEQ ID NO: 78565 - protein, 8 aa, Dengue virus
IGKEEYVD

SEQ ID NO: 78566 - protein, 8 aa, Dengue virus
GKEEYVDY

SEQ ID NO: 78567 - protein, 8 aa, Dengue virus
KEEYVDYM

SEQ ID NO: 78568 - protein, 8 aa, Dengue virus
EEYVDYMP

SEQ ID NO: 78569 - protein, 8 aa, Dengue virus
EYVDYMPV

SEQ ID NO: 78570 - protein, 8 aa, Dengue virus
YVDYMPVM

SEQ ID NO: 78571 - protein, 8 aa, Dengue virus
VDYMPVMK

SEQ ID NO: 78572 - protein, 8 aa, Dengue virus
DYMPVMKR

SEQ ID NO: 78573 - protein, 8 aa, Dengue virus
YMPVMKRY

SEQ ID NO: 78574 - protein, 8 aa, Dengue virus
MPVMKRYS

SEQ ID NO: 78575 - protein, 8 aa, Dengue virus
PVMKRYSA

SEQ ID NO: 78576 - protein, 8 aa, Dengue virus
VMKRYSAP

SEQ ID NO: 78577 - protein, 8 aa, Dengue virus
MKRYSAPS

SEQ ID NO: 78578 - protein, 8 aa, Dengue virus
KRYSAPSE

SEQ ID NO: 78579 - protein, 8 aa, Dengue virus
RYSAPSES

SEQ ID NO: 78580 - protein, 8 aa, Dengue virus
YSAPSESE

SEQ ID NO: 78581 - protein, 8 aa, Dengue virus
SAPSESEG

SEQ ID NO: 78582 - protein, 8 aa, Dengue virus
APSESEGV

SEQ ID NO: 78583 - protein, 8 aa, Dengue virus
PSESEGVL

SEQ ID NO: 78584 - protein, 8 aa, Dengue virus
MNQRKKVA

SEQ ID NO: 78585 - protein, 8 aa, Dengue virus
NQRKKVAR

SEQ ID NO: 78586 - protein, 8 aa, Dengue virus
QRKKVARP

SEQ ID NO: 78587 - protein, 8 aa, Dengue virus
RKKVARPP

SEQ ID NO: 78588 - protein, 8 aa, Dengue virus
KKVARPPF

SEQ ID NO: 78589 - protein, 8 aa, Dengue virus
KVARPPFN

SEQ ID NO: 78590 - protein, 8 aa, Dengue virus
VARPPFNM

SEQ ID NO: 78591 - protein, 8 aa, Dengue virus
ARPPFNML

SEQ ID NO: 78592 - protein, 8 aa, Dengue virus
NTPFNMLK

SEQ ID NO: 78593 - protein, 8 aa, Dengue virus
TPFNMLKR

SEQ ID NO: 78594 - protein, 8 aa, Dengue virus
ERNRVSTV

SEQ ID NO: 78595 - protein, 8 aa, Dengue virus
RNRVSTVQ

SEQ ID NO: 78596 - protein, 8 aa, Dengue virus
NRVSTVQQ

SEQ ID NO: 78597 - protein, 8 aa, Dengue virus
RVSTVQQL

SEQ ID NO: 78598 - protein, 8 aa, Dengue virus
VSTVQQLT

SEQ ID NO: 78599 - protein, 8 aa, Dengue virus
STVQQLTK

SEQ ID NO: 78600 - protein, 8 aa, Dengue virus
TVQQLTKR

SEQ ID NO: 78601 - protein, 8 aa, Dengue virus
VQQLTKRF

SEQ ID NO: 78602 - protein, 8 aa, Dengue virus
QQLTKRFS

SEQ ID NO: 78603 - protein, 8 aa, Dengue virus
GLVKRFSS

SEQ ID NO: 78604 - protein, 8 aa, Dengue virus
LVKRFSSG

SEQ ID NO: 78605 - protein, 8 aa, Dengue virus
VKRFSSGL

SEQ ID NO: 78606 - protein, 8 aa, Dengue virus
KRFSSGLF

SEQ ID NO: 78607 - protein, 8 aa, Dengue virus
RFSSGLFS

SEQ ID NO: 78608 - protein, 8 aa, Dengue virus
FSSGLFSG

SEQ ID NO: 78609 - protein, 8 aa, Dengue virus
SSGLFSGK

SEQ ID NO: 78610 - protein, 8 aa, Dengue virus
SGLFSGKG

SEQ ID NO: 78611 - protein, 8 aa, Dengue virus
GMLQGRGP

SEQ ID NO: 78612 - protein, 8 aa, Dengue virus
MLQGRGPL

SEQ ID NO: 78613 - protein, 8 aa, Dengue virus
LQGRGPLK

SEQ ID NO: 78614 - protein, 8 aa, Dengue virus
QGRGPLKL

SEQ ID NO: 78615 - protein, 8 aa, Dengue virus
GRGPLKLF

SEQ ID NO: 78616 - protein, 8 aa, Dengue virus
RGPLKLFM

SEQ ID NO: 78617 - protein, 8 aa, Dengue virus
GPLKLFMA

SEQ ID NO: 78618 - protein, 8 aa, Dengue virus
PLKLFMAL

SEQ ID NO: 78619 - protein, 8 aa, Dengue virus
LKLFMALV

SEQ ID NO: 78620 - protein, 8 aa, Dengue virus
KLFMALVA

SEQ ID NO: 78621 - protein, 8 aa, Dengue virus
LFMALVAF

SEQ ID NO: 78622 - protein, 8 aa, Dengue virus
FMALVAFL

SEQ ID NO: 78623 - protein, 8 aa, Dengue virus
MALVAFLR

SEQ ID NO: 78624 - protein, 8 aa, Dengue virus
ALVAFLRF

SEQ ID NO: 78625 - protein, 8 aa, Dengue virus
LVAFLRFL

SEQ ID NO: 78626 - protein, 8 aa, Dengue virus
VAFLRFLT

SEQ ID NO: 78627 - protein, 8 aa, Dengue virus
AFLRFLTI

SEQ ID NO: 78628 - protein, 8 aa, Dengue virus
FLRFLTIP

SEQ ID NO: 78629 - protein, 8 aa, Dengue virus
LRFLTIPP

SEQ ID NO: 78630 - protein, 8 aa, Dengue virus
RFLTIPPT

SEQ ID NO: 78631 - protein, 8 aa, Dengue virus
FLTIPPTA

SEQ ID NO: 78632 - protein, 8 aa, Dengue virus
LTIPPTAG

SEQ ID NO: 78633 - protein, 8 aa, Dengue virus
TIPPTAGI

SEQ ID NO: 78634 - protein, 8 aa, Dengue virus
GILKRWGT

SEQ ID NO: 78635 - protein, 8 aa, Dengue virus
ILKRWGTI

SEQ ID NO: 78636 - protein, 8 aa, Dengue virus
LKRWGTIK

SEQ ID NO: 78637 - protein, 8 aa, Dengue virus
KRWGTIKK

SEQ ID NO: 78638 - protein, 8 aa, Dengue virus
RWGTIKKS

SEQ ID NO: 78639 - protein, 8 aa, Dengue virus
WGTIKKSK

SEQ ID NO: 78640 - protein, 8 aa, Dengue virus
GTIKKSKA

SEQ ID NO: 78641 - protein, 8 aa, Dengue virus
QLKKTKAI

SEQ ID NO: 78642 - protein, 8 aa, Dengue virus
LKKNKAIR

SEQ ID NO: 78643 - protein, 8 aa, Dengue virus
KKNKAIRI

SEQ ID NO: 78644 - protein, 8 aa, Dengue virus
KNKAIRIL

SEQ ID NO: 78645 - protein, 8 aa, Dengue virus
NKAIKILT

SEQ ID NO: 78646 - protein, 8 aa, Dengue virus
KAIKILTG

SEQ ID NO: 78647 - protein, 8 aa, Dengue virus
AIKILTGF

SEQ ID NO: 78648 - protein, 8 aa, Dengue virus
IKILTGFR

SEQ ID NO: 78649 - protein, 8 aa, Dengue virus
KILTGFRK

SEQ ID NO: 78650 - protein, 8 aa, Dengue virus
ILTGFRKE

SEQ ID NO: 78651 - protein, 8 aa, Dengue virus
LTGFRKEI

SEQ ID NO: 78652 - protein, 8 aa, Dengue virus
TGFRKEIG

SEQ ID NO: 78653 - protein, 8 aa, Dengue virus
RMLNILNR

SEQ ID NO: 78654 - protein, 8 aa, Dengue virus
MLNILNRR

SEQ ID NO: 78655 - protein, 8 aa, Dengue virus
LNILNRRR

SEQ ID NO: 78656 - protein, 8 aa, Dengue virus
NILNRRRR

SEQ ID NO: 78657 - protein, 8 aa, Dengue virus
ILNRRRRS

SEQ ID NO: 78658 - protein, 8 aa, Dengue virus
LNRRRRST

SEQ ID NO: 78659 - protein, 8 aa, Dengue virus
RKRSTMTL

SEQ ID NO: 78660 - protein, 8 aa, Dengue virus
KRSTMTLL

SEQ ID NO: 78661 - protein, 8 aa, Dengue virus
RSTMTLLC

SEQ ID NO: 78662 - protein, 8 aa, Dengue virus
STMTLLCL

SEQ ID NO: 78663 - protein, 8 aa, Dengue virus
TMTLLCLI

SEQ ID NO: 78664 - protein, 8 aa, Dengue virus
MTLLCLIP

SEQ ID NO: 78665 - protein, 8 aa, Dengue virus
MIIMLIPT

SEQ ID NO: 78666 - protein, 8 aa, Dengue virus
LLCLIPTA

SEQ ID NO: 78667 - protein, 8 aa, Dengue virus
LCLIPTAM

SEQ ID NO: 78668 - protein, 8 aa, Dengue virus
CLIPTAMA

SEQ ID NO: 78669 - protein, 8 aa, Dengue virus
LIPTAMAF

SEQ ID NO: 78670 - protein, 8 aa, Dengue virus
IPTAMAFH

SEQ ID NO: 78671 - protein, 8 aa, Dengue virus
PTAMAFHL

SEQ ID NO: 78672 - protein, 8 aa, Dengue virus
TAMAFHLS

SEQ ID NO: 78673 - protein, 8 aa, Dengue virus
AMAFHLST

SEQ ID NO: 78674 - protein, 8 aa, Dengue virus
MAFSLSTR

SEQ ID NO: 78675 - protein, 8 aa, Dengue virus
AFSLSTRD

SEQ ID NO: 78676 - protein, 8 aa, Dengue virus
FSLSTRDG

SEQ ID NO: 78677 - protein, 8 aa, Dengue virus
SLSTRDGE

SEQ ID NO: 78678 - protein, 8 aa, Dengue virus
LTTRNGEP

SEQ ID NO: 78679 - protein, 8 aa, Dengue virus
TTRNGEPH

SEQ ID NO: 78680 - protein, 8 aa, Dengue virus
TRNGEPHM

SEQ ID NO: 78681 - protein, 8 aa, Dengue virus
RNGEPHMI

SEQ ID NO: 78682 - protein, 8 aa, Dengue virus
NGEPHMIV

SEQ ID NO: 78683 - protein, 8 aa, Dengue virus
GEPHMIVS

SEQ ID NO: 78684 - protein, 8 aa, Dengue virus
EPHMIVSR

SEQ ID NO: 78685 - protein, 8 aa, Dengue virus
PHMIVSRQ

SEQ ID NO: 78686 - protein, 8 aa, Dengue virus
HMIVSRQE

SEQ ID NO: 78687 - protein, 8 aa, Dengue virus
MIVSRQEK

SEQ ID NO: 78688 - protein, 8 aa, Dengue virus
IVSRQEKG

SEQ ID NO: 78689 - protein, 8 aa, Dengue virus
VSRQEKGK

SEQ ID NO: 78690 - protein, 8 aa, Dengue virus
SRQEKGKS

SEQ ID NO: 78691 - protein, 8 aa, Dengue virus
RQEKGKSL

SEQ ID NO: 78692 - protein, 8 aa, Dengue virus
QEKGKSLL

SEQ ID NO: 78693 - protein, 8 aa, Dengue virus
EKGKSLLF

SEQ ID NO: 78694 - protein, 8 aa, Dengue virus
KGKSLLFK

SEQ ID NO: 78695 - protein, 8 aa, Dengue virus
GKSLLFKT

SEQ ID NO: 78696 - protein, 8 aa, Dengue virus
KSLLFKTE

SEQ ID NO: 78697 - protein, 8 aa, Dengue virus
SLLFKTED

SEQ ID NO: 78698 - protein, 8 aa, Dengue virus
LLFKTEDG

SEQ ID NO: 78699 - protein, 8 aa, Dengue virus
LFKTEDGV

SEQ ID NO: 78700 - protein, 8 aa, Dengue virus
FKTEDGVN

SEQ ID NO: 78701 - protein, 8 aa, Dengue virus
KTEDGVNM

SEQ ID NO: 78702 - protein, 8 aa, Dengue virus
TEDGVNMC

SEQ ID NO: 78703 - protein, 8 aa, Dengue virus
EDGVNMCT

SEQ ID NO: 78704 - protein, 8 aa, Dengue virus
DGVNMCTL

SEQ ID NO: 78705 - protein, 8 aa, Dengue virus
GVNMCTLM

SEQ ID NO: 78706 - protein, 8 aa, Dengue virus
VNMCTLMA

SEQ ID NO: 78707 - protein, 8 aa, Dengue virus
NMCTLMAM

SEQ ID NO: 78708 - protein, 8 aa, Dengue virus
MCTLMAMD

SEQ ID NO: 78709 - protein, 8 aa, Dengue virus
CTLMAMDL

SEQ ID NO: 78710 - protein, 8 aa, Dengue virus
TLMAMDLG

SEQ ID NO: 78711 - protein, 8 aa, Dengue virus
LMAMDLGE

SEQ ID NO: 78712 - protein, 8 aa, Dengue virus
MAMDLGEL

SEQ ID NO: 78713 - protein, 8 aa, Dengue virus
AMDLGELC

SEQ ID NO: 78714 - protein, 8 aa, Dengue virus
MDLGELCE

SEQ ID NO: 78715 - protein, 8 aa, Dengue virus
DLGELCED

SEQ ID NO: 78716 - protein, 8 aa, Dengue virus
LGELCEDT

SEQ ID NO: 78717 - protein, 8 aa, Dengue virus
GELCEDTI

SEQ ID NO: 78718 - protein, 8 aa, Dengue virus
ELCEDTIT

SEQ ID NO: 78719 - protein, 8 aa, Dengue virus
LCEDTITY

SEQ ID NO: 78720 - protein, 8 aa, Dengue virus
CEDTVTYE

SEQ ID NO: 78721 - protein, 8 aa, Dengue virus
EDTITYKC

SEQ ID NO: 78722 - protein, 8 aa, Dengue virus
DTITYKCP

SEQ ID NO: 78723 - protein, 8 aa, Dengue virus
TVTYECPL

SEQ ID NO: 78724 - protein, 8 aa, Dengue virus
ITYKCPLL

SEQ ID NO: 78725 - protein, 8 aa, Dengue virus
TYKCPLLI

SEQ ID NO: 78726 - protein, 8 aa, Dengue virus
YKCPLLIN

SEQ ID NO: 78727 - protein, 8 aa, Dengue virus
KCPLLINT

SEQ ID NO: 78728 - protein, 8 aa, Dengue virus
CPLLINTE

SEQ ID NO: 78729 - protein, 8 aa, Dengue virus
PLLINTEP

SEQ ID NO: 78730 - protein, 8 aa, Dengue virus
LLINTEPE

SEQ ID NO: 78731 - protein, 8 aa, Dengue virus
LINTEPED

SEQ ID NO: 78732 - protein, 8 aa, Dengue virus
INTEPEDI

SEQ ID NO: 78733 - protein, 8 aa, Dengue virus
QNEPEDID

SEQ ID NO: 78734 - protein, 8 aa, Dengue virus
NEPEDIDC

SEQ ID NO: 78735 - protein, 8 aa, Dengue virus
DIDCWCNS

SEQ ID NO: 78736 - protein, 8 aa, Dengue virus
IDCWCNST

SEQ ID NO: 78737 - protein, 8 aa, Dengue virus
DCWCNSTS

SEQ ID NO: 78738 - protein, 8 aa, Dengue virus
CWCNLTSA

SEQ ID NO: 78739 - protein, 8 aa, Dengue virus
WCNLTSAW

SEQ ID NO: 78740 - protein, 8 aa, Dengue virus
CNLTSAWV

SEQ ID NO: 78741 - protein, 8 aa, Dengue virus
NLTSAWVM

SEQ ID NO: 78742 - protein, 8 aa, Dengue virus
LTSAWVMY

SEQ ID NO: 78743 - protein, 8 aa, Dengue virus
TSAWVMYG

SEQ ID NO: 78744 - protein, 8 aa, Dengue virus
SAWVMYGT

SEQ ID NO: 78745 - protein, 8 aa, Dengue virus
AWVMYGTC

SEQ ID NO: 78746 - protein, 8 aa, Dengue virus
WVTYGTCT

SEQ ID NO: 78747 - protein, 8 aa, Dengue virus
VTYGTCTT

SEQ ID NO: 78748 - protein, 8 aa, Dengue virus
MYGTCTQN

SEQ ID NO: 78749 - protein, 8 aa, Dengue virus
YGTCTQNG

SEQ ID NO: 78750 - protein, 8 aa, Dengue virus
GTCTQNGE

SEQ ID NO: 78751 - protein, 8 aa, Dengue virus
TCTQNGER

SEQ ID NO: 78752 - protein, 8 aa, Dengue virus
CTQNGERR

SEQ ID NO: 78753 - protein, 8 aa, Dengue virus
TQNGERRR

SEQ ID NO: 78754 - protein, 8 aa, Dengue virus
QNGERRRE

SEQ ID NO: 78755 - protein, 8 aa, Dengue virus
NGERRREK

SEQ ID NO: 78756 - protein, 8 aa, Dengue virus
GEHRREKR

SEQ ID NO: 78757 - protein, 8 aa, Dengue virus
EHRREKRS

SEQ ID NO: 78758 - protein, 8 aa, Dengue virus
HRREKRSV

SEQ ID NO: 78759 - protein, 8 aa, Dengue virus
EKRSVALV

SEQ ID NO: 78760 - protein, 8 aa, Dengue virus
KRSVALVP

SEQ ID NO: 78761 - protein, 8 aa, Dengue virus
RSVALVPH

SEQ ID NO: 78762 - protein, 8 aa, Dengue virus
SVALVPHV

SEQ ID NO: 78763 - protein, 8 aa, Dengue virus
VALVPHVG

SEQ ID NO: 78764 - protein, 8 aa, Dengue virus
ALVPHVGM

SEQ ID NO: 78765 - protein, 8 aa, Dengue virus
LVPHVGMG

SEQ ID NO: 78766 - protein, 8 aa, Dengue virus
VPHVGMGL

SEQ ID NO: 78767 - protein, 8 aa, Dengue virus
PHVGMGLE

SEQ ID NO: 78768 - protein, 8 aa, Dengue virus
HVGMGLET

SEQ ID NO: 78769 - protein, 8 aa, Dengue virus
VGMGLETR

SEQ ID NO: 78770 - protein, 8 aa, Dengue virus
GMGLETRT

SEQ ID NO: 78771 - protein, 8 aa, Dengue virus
MGLETRTE

SEQ ID NO: 78772 - protein, 8 aa, Dengue virus
GLETRTET

SEQ ID NO: 78773 - protein, 8 aa, Dengue virus
LETRTETW

SEQ ID NO: 78774 - protein, 8 aa, Dengue virus
ETRTETWM

SEQ ID NO: 78775 - protein, 8 aa, Dengue virus
TRTETWMS

SEQ ID NO: 78776 - protein, 8 aa, Dengue virus
RTETWMSS

SEQ ID NO: 78777 - protein, 8 aa, Dengue virus
TETWMSSE

SEQ ID NO: 78778 - protein, 8 aa, Dengue virus
AWKHAQRI

SEQ ID NO: 78779 - protein, 8 aa, Dengue virus
WKHAQRIE

SEQ ID NO: 78780 - protein, 8 aa, Dengue virus
KHAQRIET

SEQ ID NO: 78781 - protein, 8 aa, Dengue virus
HAQRIETW

SEQ ID NO: 78782 - protein, 8 aa, Dengue virus
AQRIETWI

SEQ ID NO: 78783 - protein, 8 aa, Dengue virus
QRIETWIL

SEQ ID NO: 78784 - protein, 8 aa, Dengue virus
RIETWILR

SEQ ID NO: 78785 - protein, 8 aa, Dengue virus
IETWILRH

SEQ ID NO: 78786 - protein, 8 aa, Dengue virus
ETWILRHP

SEQ ID NO: 78787 - protein, 8 aa, Dengue virus
TWILRHPG

SEQ ID NO: 78788 - protein, 8 aa, Dengue virus
WILRHPGF

SEQ ID NO: 78789 - protein, 8 aa, Dengue virus
ILRHPGFT

SEQ ID NO: 78790 - protein, 8 aa, Dengue virus
LRHPGFTI

SEQ ID NO: 78791 - protein, 8 aa, Dengue virus
RHPGFTIM

SEQ ID NO: 78792 - protein, 8 aa, Dengue virus
HPGFTIMA

SEQ ID NO: 78793 - protein, 8 aa, Dengue virus
PGFTIMAA

SEQ ID NO: 78794 - protein, 8 aa, Dengue virus
GFTIMAAI

SEQ ID NO: 78795 - protein, 8 aa, Dengue virus
FTIMAAIL

SEQ ID NO: 78796 - protein, 8 aa, Dengue virus
TIMAAILA

SEQ ID NO: 78797 - protein, 8 aa, Dengue virus
IMAAILAY

SEQ ID NO: 78798 - protein, 8 aa, Dengue virus
MAAILAYT

SEQ ID NO: 78799 - protein, 8 aa, Dengue virus
AGFMAYMV

SEQ ID NO: 78800 - protein, 8 aa, Dengue virus
AILAYTIG

SEQ ID NO: 78801 - protein, 8 aa, Dengue virus
FMAYMVGQ

SEQ ID NO: 78802 - protein, 8 aa, Dengue virus
MAYMVGQT

SEQ ID NO: 78803 - protein, 8 aa, Dengue virus
AYMVGQTG

SEQ ID NO: 78804 - protein, 8 aa, Dengue virus
YMVGQTGI

SEQ ID NO: 78805 - protein, 8 aa, Dengue virus
TIGTTHFQ

SEQ ID NO: 78806 - protein, 8 aa, Dengue virus
IGTTHFQR

SEQ ID NO: 78807 - protein, 8 aa, Dengue virus
GTTHFQRA

SEQ ID NO: 78808 - protein, 8 aa, Dengue virus
TTHFQRAL

SEQ ID NO: 78809 - protein, 8 aa, Dengue virus
THFQRALI

SEQ ID NO: 78810 - protein, 8 aa, Dengue virus
HFQRALIF

SEQ ID NO: 78811 - protein, 8 aa, Dengue virus
IQRTVFFI

SEQ ID NO: 78812 - protein, 8 aa, Dengue virus
QRTVFFIL

SEQ ID NO: 78813 - protein, 8 aa, Dengue virus
RTVFFILM

SEQ ID NO: 78814 - protein, 8 aa, Dengue virus
TVFFILMM

SEQ ID NO: 78815 - protein, 8 aa, Dengue virus
VFFILMML

SEQ ID NO: 78816 - protein, 8 aa, Dengue virus
FFILMMLV

SEQ ID NO: 78817 - protein, 8 aa, Dengue virus
FILMMLVA

SEQ ID NO: 78818 - protein, 8 aa, Dengue virus
ILMMLVAP

SEQ ID NO: 78819 - protein, 8 aa, Dengue virus
LLTAVAPS

SEQ ID NO: 78820 - protein, 8 aa, Dengue virus
LTAVAPSM

SEQ ID NO: 78821 - protein, 8 aa, Dengue virus
TAVAPSMT

SEQ ID NO: 78822 - protein, 8 aa, Dengue virus
AVAPSMTM

SEQ ID NO: 78823 - protein, 8 aa, Dengue virus
VAPSMTMR

SEQ ID NO: 78824 - protein, 8 aa, Dengue virus
APSMTMRC

SEQ ID NO: 78825 - protein, 8 aa, Dengue virus
PSYGMRCI

SEQ ID NO: 78826 - protein, 8 aa, Dengue virus
SYGMRCIG

SEQ ID NO: 78827 - protein, 8 aa, Dengue virus
YGMRCIGV

SEQ ID NO: 78828 - protein, 8 aa, Dengue virus
TMRCIGIS

SEQ ID NO: 78829 - protein, 8 aa, Dengue virus
MRCIGISN

SEQ ID NO: 78830 - protein, 8 aa, Dengue virus
RCIGISNR

SEQ ID NO: 78831 - protein, 8 aa, Dengue virus
CIGVGNRD

SEQ ID NO: 78832 - protein, 8 aa, Dengue virus
IGISNRDF

SEQ ID NO: 78833 - protein, 8 aa, Dengue virus
GISNRDFV

SEQ ID NO: 78834 - protein, 8 aa, Dengue virus
ISNRDFVE

SEQ ID NO: 78835 - protein, 8 aa, Dengue virus
SNRDFVEG

SEQ ID NO: 78836 - protein, 8 aa, Dengue virus
VEGVSGGS

SEQ ID NO: 78837 - protein, 8 aa, Dengue virus
EGVSGGSW

SEQ ID NO: 78838 - protein, 8 aa, Dengue virus
GVSGGSWV

SEQ ID NO: 78839 - protein, 8 aa, Dengue virus
VSGGSWVD

SEQ ID NO: 78840 - protein, 8 aa, Dengue virus
SGGSWVDI

SEQ ID NO: 78841 - protein, 8 aa, Dengue virus
GGSWVDIV

SEQ ID NO: 78842 - protein, 8 aa, Dengue virus
GSWVDIVL

SEQ ID NO: 78843 - protein, 8 aa, Dengue virus
SWVDIVLE

SEQ ID NO: 78844 - protein, 8 aa, Dengue virus
WVDIVLEH

SEQ ID NO: 78845 - protein, 8 aa, Dengue virus
VDIVLEHG

SEQ ID NO: 78846 - protein, 8 aa, Dengue virus
DIVLEHGS

SEQ ID NO: 78847 - protein, 8 aa, Dengue virus
IVLEHGSC

SEQ ID NO: 78848 - protein, 8 aa, Dengue virus
VLEHGSCV

SEQ ID NO: 78849 - protein, 8 aa, Dengue virus
LEHGSCVT

SEQ ID NO: 78850 - protein, 8 aa, Dengue virus
EHGSCVTT

SEQ ID NO: 78851 - protein, 8 aa, Dengue virus
HGSCVTTM

SEQ ID NO: 78852 - protein, 8 aa, Dengue virus
GSCVTTMA

SEQ ID NO: 78853 - protein, 8 aa, Dengue virus
SCVTTMAK

SEQ ID NO: 78854 - protein, 8 aa, Dengue virus
CVTTMAKN

SEQ ID NO: 78855 - protein, 8 aa, Dengue virus
VTTMAKNK

SEQ ID NO: 78856 - protein, 8 aa, Dengue virus
TTMAKNKP

SEQ ID NO: 78857 - protein, 8 aa, Dengue virus
TMAKNKPT

SEQ ID NO: 78858 - protein, 8 aa, Dengue virus
MAKNKPTL

SEQ ID NO: 78859 - protein, 8 aa, Dengue virus
AKNKPTLD

SEQ ID NO: 78860 - protein, 8 aa, Dengue virus
KNKPTLDF

SEQ ID NO: 78861 - protein, 8 aa, Dengue virus
NKPTLDFE

SEQ ID NO: 78862 - protein, 8 aa, Dengue virus
PTLDFELI

SEQ ID NO: 78863 - protein, 8 aa, Dengue virus
TLDFELIK

SEQ ID NO: 78864 - protein, 8 aa, Dengue virus
LDFELIKT

SEQ ID NO: 78865 - protein, 8 aa, Dengue virus
DFELIKTT

SEQ ID NO: 78866 - protein, 8 aa, Dengue virus
FELIKTTA

SEQ ID NO: 78867 - protein, 8 aa, Dengue virus
ELIKTTAK

SEQ ID NO: 78868 - protein, 8 aa, Dengue virus
LIKTTAKE

SEQ ID NO: 78869 - protein, 8 aa, Dengue virus
IKTTAKEV

SEQ ID NO: 78870 - protein, 8 aa, Dengue virus
KTEAKQPA

SEQ ID NO: 78871 - protein, 8 aa, Dengue virus
TEAKQPAT

SEQ ID NO: 78872 - protein, 8 aa, Dengue virus
EAKQPATL

SEQ ID NO: 78873 - protein, 8 aa, Dengue virus
AKQPATLR

SEQ ID NO: 78874 - protein, 8 aa, Dengue virus
KQPATLRK

SEQ ID NO: 78875 - protein, 8 aa, Dengue virus
QPATLRKY

SEQ ID NO: 78876 - protein, 8 aa, Dengue virus
PATLRKYC

SEQ ID NO: 78877 - protein, 8 aa, Dengue virus
ATLRKYCI

SEQ ID NO: 78878 - protein, 8 aa, Dengue virus
TLRKYCIE

SEQ ID NO: 78879 - protein, 8 aa, Dengue virus
LRKYCIEA

SEQ ID NO: 78880 - protein, 8 aa, Dengue virus
RTYCIEAL

SEQ ID NO: 78881 - protein, 8 aa, Dengue virus
TYCIEALI

SEQ ID NO: 78882 - protein, 8 aa, Dengue virus
YCIEALIS

SEQ ID NO: 78883 - protein, 8 aa, Dengue virus
CIEALISN

SEQ ID NO: 78884 - protein, 8 aa, Dengue virus
IEALISNI

SEQ ID NO: 78885 - protein, 8 aa, Dengue virus
EALISNIT

SEQ ID NO: 78886 - protein, 8 aa, Dengue virus
ALISNITT

SEQ ID NO: 78887 - protein, 8 aa, Dengue virus
LISNITTA

SEQ ID NO: 78888 - protein, 8 aa, Dengue virus
LTNTTTES

SEQ ID NO: 78889 - protein, 8 aa, Dengue virus
TNTTTESR

SEQ ID NO: 78890 - protein, 8 aa, Dengue virus
NTTTESRC

SEQ ID NO: 78891 - protein, 8 aa, Dengue virus
TTTESRCP

SEQ ID NO: 78892 - protein, 8 aa, Dengue virus
TTESRCPT

SEQ ID NO: 78893 - protein, 8 aa, Dengue virus
TESRCPTQ

SEQ ID NO: 78894 - protein, 8 aa, Dengue virus
ESRCPTQG

SEQ ID NO: 78895 - protein, 8 aa, Dengue virus
SRCPTQGE

SEQ ID NO: 78896 - protein, 8 aa, Dengue virus
CPTQGEPS

SEQ ID NO: 78897 - protein, 8 aa, Dengue virus
PTQGEPSL

SEQ ID NO: 78898 - protein, 8 aa, Dengue virus
TQGEPSLN

SEQ ID NO: 78899 - protein, 8 aa, Dengue virus
QGEPSLNE

SEQ ID NO: 78900 - protein, 8 aa, Dengue virus
GEPSLNEE

SEQ ID NO: 78901 - protein, 8 aa, Dengue virus
EPSLNEEQ

SEQ ID NO: 78902 - protein, 8 aa, Dengue virus
PSLNEEQD

SEQ ID NO: 78903 - protein, 8 aa, Dengue virus
SLNEEQDK

SEQ ID NO: 78904 - protein, 8 aa, Dengue virus
LNEEQDKR

SEQ ID NO: 78905 - protein, 8 aa, Dengue virus
NEEQDKRF

SEQ ID NO: 78906 - protein, 8 aa, Dengue virus
EEQDKRFV

SEQ ID NO: 78907 - protein, 8 aa, Dengue virus
EQDKRFVC

SEQ ID NO: 78908 - protein, 8 aa, Dengue virus
QDKRFVCK

SEQ ID NO: 78909 - protein, 8 aa, Dengue virus
DKRFVCKH

SEQ ID NO: 78910 - protein, 8 aa, Dengue virus
KRFVCKHS

SEQ ID NO: 78911 - protein, 8 aa, Dengue virus
RFVCKHSM

SEQ ID NO: 78912 - protein, 8 aa, Dengue virus
YICRRDMV

SEQ ID NO: 78913 - protein, 8 aa, Dengue virus
VCKHSMVD

SEQ ID NO: 78914 - protein, 8 aa, Dengue virus
CRRDMVDR

SEQ ID NO: 78915 - protein, 8 aa, Dengue virus
KHSMVDRG

SEQ ID NO: 78916 - protein, 8 aa, Dengue virus
RDMVDRGW

SEQ ID NO: 78917 - protein, 8 aa, Dengue virus
SMVDRGWG

SEQ ID NO: 78918 - protein, 8 aa, Dengue virus
MVDRGWGN

SEQ ID NO: 78919 - protein, 8 aa, Dengue virus
GLFGKGGI

SEQ ID NO: 78920 - protein, 8 aa, Dengue virus
LFGKGGIV

SEQ ID NO: 78921 - protein, 8 aa, Dengue virus
FGKGGIVT

SEQ ID NO: 78922 - protein, 8 aa, Dengue virus
GKGGIVTC

SEQ ID NO: 78923 - protein, 8 aa, Dengue virus
KGGIVTCA

SEQ ID NO: 78924 - protein, 8 aa, Dengue virus
GGIVTCAM

SEQ ID NO: 78925 - protein, 8 aa, Dengue virus
GIVTCAMF

SEQ ID NO: 78926 - protein, 8 aa, Dengue virus
VVTCAKFL

SEQ ID NO: 78927 - protein, 8 aa, Dengue virus
VTCAKFLC

SEQ ID NO: 78928 - protein, 8 aa, Dengue virus
TCAKFLCS

SEQ ID NO: 78929 - protein, 8 aa, Dengue virus
CAKFLCSG

SEQ ID NO: 78930 - protein, 8 aa, Dengue virus
AKFLCSGK

SEQ ID NO: 78931 - protein, 8 aa, Dengue virus
KFLCSGKI

SEQ ID NO: 78932 - protein, 8 aa, Dengue virus
FLCSGKIT

SEQ ID NO: 78933 - protein, 8 aa, Dengue virus
LCSGKITG

SEQ ID NO: 78934 - protein, 8 aa, Dengue virus
CKKNMEGK

SEQ ID NO: 78935 - protein, 8 aa, Dengue virus
KKNMEGKV

SEQ ID NO: 78936 - protein, 8 aa, Dengue virus
KNMEGKVV

SEQ ID NO: 78937 - protein, 8 aa, Dengue virus
NMEGKVVQ

SEQ ID NO: 78938 - protein, 8 aa, Dengue virus
MEGKVVQP

SEQ ID NO: 78939 - protein, 8 aa, Dengue virus
EGKVVQPE

SEQ ID NO: 78940 - protein, 8 aa, Dengue virus
GKVVQPEN

SEQ ID NO: 78941 - protein, 8 aa, Dengue virus
KVVQPENL

SEQ ID NO: 78942 - protein, 8 aa, Dengue virus
VVQPENLE

SEQ ID NO: 78943 - protein, 8 aa, Dengue virus
VQPENLEY

SEQ ID NO: 78944 - protein, 8 aa, Dengue virus
QPENLEYT

SEQ ID NO: 78945 - protein, 8 aa, Dengue virus
PENLEYTI

SEQ ID NO: 78946 - protein, 8 aa, Dengue virus
ENLEYTIV

SEQ ID NO: 78947 - protein, 8 aa, Dengue virus
NLEYTIVI

SEQ ID NO: 78948 - protein, 8 aa, Dengue virus
LEYTIVIT

SEQ ID NO: 78949 - protein, 8 aa, Dengue virus
EYTIVITP

SEQ ID NO: 78950 - protein, 8 aa, Dengue virus
YTIVITPH

SEQ ID NO: 78951 - protein, 8 aa, Dengue virus
TIVITPHS

SEQ ID NO: 78952 - protein, 8 aa, Dengue virus
IVITPHSG

SEQ ID NO: 78953 - protein, 8 aa, Dengue virus
VITPHSGE

SEQ ID NO: 78954 - protein, 8 aa, Dengue virus
ITPHSGEE

SEQ ID NO: 78955 - protein, 8 aa, Dengue virus
TPHSGEEH

SEQ ID NO: 78956 - protein, 8 aa, Dengue virus
PHSGEEHA

SEQ ID NO: 78957 - protein, 8 aa, Dengue virus
HSGEEHAV

SEQ ID NO: 78958 - protein, 8 aa, Dengue virus
SGEEHAVG

SEQ ID NO: 78959 - protein, 8 aa, Dengue virus
GEEHAVGN

SEQ ID NO: 78960 - protein, 8 aa, Dengue virus
EEHAVGND

SEQ ID NO: 78961 - protein, 8 aa, Dengue virus
EHAVGNDT

SEQ ID NO: 78962 - protein, 8 aa, Dengue virus
HAVGNDTG

SEQ ID NO: 78963 - protein, 8 aa, Dengue virus
AVGNDIPN

SEQ ID NO: 78964 - protein, 8 aa, Dengue virus
VGNDTGKH

SEQ ID NO: 78965 - protein, 8 aa, Dengue virus
GNDIPNHG

SEQ ID NO: 78966 - protein, 8 aa, Dengue virus
NDIPNHGV

SEQ ID NO: 78967 - protein, 8 aa, Dengue virus
DTGKHGKE

SEQ ID NO: 78968 - protein, 8 aa, Dengue virus
TSNHGVTT

SEQ ID NO: 78969 - protein, 8 aa, Dengue virus
SNHGVTAM

SEQ ID NO: 78970 - protein, 8 aa, Dengue virus
NHGVTAMI

SEQ ID NO: 78971 - protein, 8 aa, Dengue virus
HGVTAMIT

SEQ ID NO: 78972 - protein, 8 aa, Dengue virus
GVTAMITP

SEQ ID NO: 78973 - protein, 8 aa, Dengue virus
VTAMITPR

SEQ ID NO: 78974 - protein, 8 aa, Dengue virus
TAMITPRS

SEQ ID NO: 78975 - protein, 8 aa, Dengue virus
AMITPRSP

SEQ ID NO: 78976 - protein, 8 aa, Dengue virus
MITPRSPS

SEQ ID NO: 78977 - protein, 8 aa, Dengue virus
ITPRTPSV

SEQ ID NO: 78978 - protein, 8 aa, Dengue virus
TPRTPSVE

SEQ ID NO: 78979 - protein, 8 aa, Dengue virus
PQSSITEA

SEQ ID NO: 78980 - protein, 8 aa, Dengue virus
RSPSVEVE

SEQ ID NO: 78981 - protein, 8 aa, Dengue virus
TPSVEVKL

SEQ ID NO: 78982 - protein, 8 aa, Dengue virus
PSVEVELP

SEQ ID NO: 78983 - protein, 8 aa, Dengue virus
ITEAELTG

SEQ ID NO: 78984 - protein, 8 aa, Dengue virus
VEVELPDY

SEQ ID NO: 78985 - protein, 8 aa, Dengue virus
EVELPDYG

SEQ ID NO: 78986 - protein, 8 aa, Dengue virus
AELTGYGT

SEQ ID NO: 78987 - protein, 8 aa, Dengue virus
ELTGYGTV

SEQ ID NO: 78988 - protein, 8 aa, Dengue virus
LTGYGTVT

SEQ ID NO: 78989 - protein, 8 aa, Dengue virus
TGYGTVTM

SEQ ID NO: 78990 - protein, 8 aa, Dengue virus
GYGTVTME

SEQ ID NO: 78991 - protein, 8 aa, Dengue virus
YGTVTMEC

SEQ ID NO: 78992 - protein, 8 aa, Dengue virus
GELSLDCE

SEQ ID NO: 78993 - protein, 8 aa, Dengue virus
TVTMECSP

SEQ ID NO: 78994 - protein, 8 aa, Dengue virus
LSLDCEPR

SEQ ID NO: 78995 - protein, 8 aa, Dengue virus
TMECSPRT

SEQ ID NO: 78996 - protein, 8 aa, Dengue virus
MECSPRTG

SEQ ID NO: 78997 - protein, 8 aa, Dengue virus
ECSPRTGL

SEQ ID NO: 78998 - protein, 8 aa, Dengue virus
CSPRTGLD

SEQ ID NO: 78999 - protein, 8 aa, Dengue virus
SPRTGLDF

SEQ ID NO: 79000 - protein, 8 aa, Dengue virus
PRTGLDFN

SEQ ID NO: 79001 - protein, 8 aa, Dengue virus
RTGLDFNE

SEQ ID NO: 79002 - protein, 8 aa, Dengue virus
TGLDFNEM

SEQ ID NO: 79003 - protein, 8 aa, Dengue virus
GLDFNEMV

SEQ ID NO: 79004 - protein, 8 aa, Dengue virus
LDFNEMVL

SEQ ID NO: 79005 - protein, 8 aa, Dengue virus
DFNEMVLL

SEQ ID NO: 79006 - protein, 8 aa, Dengue virus
FNEMILME

SEQ ID NO: 79007 - protein, 8 aa, Dengue virus
NEMILMRM

SEQ ID NO: 79008 - protein, 8 aa, Dengue virus
EMILMKME

SEQ ID NO: 79009 - protein, 8 aa, Dengue virus
MKTKTWLV

SEQ ID NO: 79010 - protein, 8 aa, Dengue virus
ENKAWLVH

SEQ ID NO: 79011 - protein, 8 aa, Dengue virus
TKTWLVHK

SEQ ID NO: 79012 - protein, 8 aa, Dengue virus
KAWLVHRQ

SEQ ID NO: 79013 - protein, 8 aa, Dengue virus
AWLVHRQW

SEQ ID NO: 79014 - protein, 8 aa, Dengue virus
WLVHRQWF

SEQ ID NO: 79015 - protein, 8 aa, Dengue virus
LVHRQWFL

SEQ ID NO: 79016 - protein, 8 aa, Dengue virus
VHRQWFLD

SEQ ID NO: 79017 - protein, 8 aa, Dengue virus
HRQWFLDL

SEQ ID NO: 79018 - protein, 8 aa, Dengue virus
RQWFLDLP

SEQ ID NO: 79019 - protein, 8 aa, Dengue virus
LDLPLPWA

SEQ ID NO: 79020 - protein, 8 aa, Dengue virus
DLPLPWTT

SEQ ID NO: 79021 - protein, 8 aa, Dengue virus
LPLPWTTG

SEQ ID NO: 79022 - protein, 8 aa, Dengue virus
PLPWTTGA

SEQ ID NO: 79023 - protein, 8 aa, Dengue virus
LPWTTGAD

SEQ ID NO: 79024 - protein, 8 aa, Dengue virus
PWTTGADT

SEQ ID NO: 79025 - protein, 8 aa, Dengue virus
WTTGADTS

SEQ ID NO: 79026 - protein, 8 aa, Dengue virus
TTGADTSE

SEQ ID NO: 79027 - protein, 8 aa, Dengue virus
TGADTSEV

SEQ ID NO: 79028 - protein, 8 aa, Dengue virus
GADTQGSN

SEQ ID NO: 79029 - protein, 8 aa, Dengue virus
ADTLEVHW

SEQ ID NO: 79030 - protein, 8 aa, Dengue virus
DTLEVHWN

SEQ ID NO: 79031 - protein, 8 aa, Dengue virus
TSEVHWNH

SEQ ID NO: 79032 - protein, 8 aa, Dengue virus
SEVHWNHK

SEQ ID NO: 79033 - protein, 8 aa, Dengue virus
EVHWNHKE

SEQ ID NO: 79034 - protein, 8 aa, Dengue virus
VHWNHKER

SEQ ID NO: 79035 - protein, 8 aa, Dengue virus
HWNHKERM

SEQ ID NO: 79036 - protein, 8 aa, Dengue virus
WNHKERMV

SEQ ID NO: 79037 - protein, 8 aa, Dengue virus
NHKERMVT

SEQ ID NO: 79038 - protein, 8 aa, Dengue virus
HKERMVTF

SEQ ID NO: 79039 - protein, 8 aa, Dengue virus
KETLVTFK

SEQ ID NO: 79040 - protein, 8 aa, Dengue virus
ETLVTFKN

SEQ ID NO: 79041 - protein, 8 aa, Dengue virus
TLVTFKNP

SEQ ID NO: 79042 - protein, 8 aa, Dengue virus
LVTFKNPH

SEQ ID NO: 79043 - protein, 8 aa, Dengue virus
VTFKNPHA

SEQ ID NO: 79044 - protein, 8 aa, Dengue virus
TFKNPHAK

SEQ ID NO: 79045 - protein, 8 aa, Dengue virus
FKNPHAKK

SEQ ID NO: 79046 - protein, 8 aa, Dengue virus
KNPHAKKQ

SEQ ID NO: 79047 - protein, 8 aa, Dengue virus
NPHAKKQD

SEQ ID NO: 79048 - protein, 8 aa, Dengue virus
PHAKKQDV

SEQ ID NO: 79049 - protein, 8 aa, Dengue virus
HAKKQDVV

SEQ ID NO: 79050 - protein, 8 aa, Dengue virus
AKKQDVVV

SEQ ID NO: 79051 - protein, 8 aa, Dengue virus
KKQDVVVL

SEQ ID NO: 79052 - protein, 8 aa, Dengue virus
KQDVVVLG

SEQ ID NO: 79053 - protein, 8 aa, Dengue virus
QDVVVLGS

SEQ ID NO: 79054 - protein, 8 aa, Dengue virus
DVVVLGSQ

SEQ ID NO: 79055 - protein, 8 aa, Dengue virus
VVVLGSQE

SEQ ID NO: 79056 - protein, 8 aa, Dengue virus
VVLGSQEG

SEQ ID NO: 79057 - protein, 8 aa, Dengue virus
SQEGAMHT

SEQ ID NO: 79058 - protein, 8 aa, Dengue virus
QEGAMHTA

SEQ ID NO: 79059 - protein, 8 aa, Dengue virus
EGAMHTAL

SEQ ID NO: 79060 - protein, 8 aa, Dengue virus
GAMHSALT

SEQ ID NO: 79061 - protein, 8 aa, Dengue virus
AMHSALTG

SEQ ID NO: 79062 - protein, 8 aa, Dengue virus
MHSALTGA

SEQ ID NO: 79063 - protein, 8 aa, Dengue virus
HSALTGAT

SEQ ID NO: 79064 - protein, 8 aa, Dengue virus
SALTGATE

SEQ ID NO: 79065 - protein, 8 aa, Dengue virus
ALTGATEV

SEQ ID NO: 79066 - protein, 8 aa, Dengue virus
LTGATEVD

SEQ ID NO: 79067 - protein, 8 aa, Dengue virus
TGATEVDS

SEQ ID NO: 79068 - protein, 8 aa, Dengue virus
GATEIQMS

SEQ ID NO: 79069 - protein, 8 aa, Dengue virus
ATEIQMSS

SEQ ID NO: 79070 - protein, 8 aa, Dengue virus
TEIQMSSG

SEQ ID NO: 79071 - protein, 8 aa, Dengue virus
EIQMSSGN

SEQ ID NO: 79072 - protein, 8 aa, Dengue virus
IQMSSGNL

SEQ ID NO: 79073 - protein, 8 aa, Dengue virus
QMSSGNLL

SEQ ID NO: 79074 - protein, 8 aa, Dengue virus
MSSGNLLF

SEQ ID NO: 79075 - protein, 8 aa, Dengue virus
SSGNLLFT

SEQ ID NO: 79076 - protein, 8 aa, Dengue virus
SGNLLFTG

SEQ ID NO: 79077 - protein, 8 aa, Dengue virus
GNLLFTGH

SEQ ID NO: 79078 - protein, 8 aa, Dengue virus
NLLFTGHL

SEQ ID NO: 79079 - protein, 8 aa, Dengue virus
LLFTGHLK

SEQ ID NO: 79080 - protein, 8 aa, Dengue virus
LFTGHLKC

SEQ ID NO: 79081 - protein, 8 aa, Dengue virus
FTGHLKCR

SEQ ID NO: 79082 - protein, 8 aa, Dengue virus
TGHLKCRL

SEQ ID NO: 79083 - protein, 8 aa, Dengue virus
GHLKCRLR

SEQ ID NO: 79084 - protein, 8 aa, Dengue virus
HLKCRLRM

SEQ ID NO: 79085 - protein, 8 aa, Dengue virus
LKCRLRMD

SEQ ID NO: 79086 - protein, 8 aa, Dengue virus
KCRLRMDK

SEQ ID NO: 79087 - protein, 8 aa, Dengue virus
CRLRMDKL

SEQ ID NO: 79088 - protein, 8 aa, Dengue virus
RLRMDKLQ

SEQ ID NO: 79089 - protein, 8 aa, Dengue virus
LRMDKLQL

SEQ ID NO: 79090 - protein, 8 aa, Dengue virus
RMDKLQLK

SEQ ID NO: 79091 - protein, 8 aa, Dengue virus
MDKLQLKG

SEQ ID NO: 79092 - protein, 8 aa, Dengue virus
DKLQLKGM

SEQ ID NO: 79093 - protein, 8 aa, Dengue virus
KLQLKGMS

SEQ ID NO: 79094 - protein, 8 aa, Dengue virus
LQLKGMSY

SEQ ID NO: 79095 - protein, 8 aa, Dengue virus
QLKGMSYS

SEQ ID NO: 79096 - protein, 8 aa, Dengue virus
LKGMSYSM

SEQ ID NO: 79097 - protein, 8 aa, Dengue virus
KGMSYSMC

SEQ ID NO: 79098 - protein, 8 aa, Dengue virus
GMSYSMCT

SEQ ID NO: 79099 - protein, 8 aa, Dengue virus
MSYSMCTG

SEQ ID NO: 79100 - protein, 8 aa, Dengue virus
SYSMCTGK

SEQ ID NO: 79101 - protein, 8 aa, Dengue virus
YSMCTGKF

SEQ ID NO: 79102 - protein, 8 aa, Dengue virus
SMCTGKFK

SEQ ID NO: 79103 - protein, 8 aa, Dengue virus
MCTGKFKV

SEQ ID NO: 79104 - protein, 8 aa, Dengue virus
CTGKFKVV

SEQ ID NO: 79105 - protein, 8 aa, Dengue virus
SGKFSIDR

SEQ ID NO: 79106 - protein, 8 aa, Dengue virus
GKFSIDRE

SEQ ID NO: 79107 - protein, 8 aa, Dengue virus
KFKVVKEI

SEQ ID NO: 79108 - protein, 8 aa, Dengue virus
FKVVKEIA

SEQ ID NO: 79109 - protein, 8 aa, Dengue virus
KVVKEIAE

SEQ ID NO: 79110 - protein, 8 aa, Dengue virus
VVKEIAET

SEQ ID NO: 79111 - protein, 8 aa, Dengue virus
VKEIAETQ

SEQ ID NO: 79112 - protein, 8 aa, Dengue virus
KEIAETQH

SEQ ID NO: 79113 - protein, 8 aa, Dengue virus
EIAETQHG

SEQ ID NO: 79114 - protein, 8 aa, Dengue virus
IAETQHGT

SEQ ID NO: 79115 - protein, 8 aa, Dengue virus
AETQHGTI

SEQ ID NO: 79116 - protein, 8 aa, Dengue virus
ETQHGTIV

SEQ ID NO: 79117 - protein, 8 aa, Dengue virus
TQHGTIVI

SEQ ID NO: 79118 - protein, 8 aa, Dengue virus
QHGTIVIR

SEQ ID NO: 79119 - protein, 8 aa, Dengue virus
HGTIVIRV

SEQ ID NO: 79120 - protein, 8 aa, Dengue virus
GTIVIRVQ

SEQ ID NO: 79121 - protein, 8 aa, Dengue virus
TIVIRVQY

SEQ ID NO: 79122 - protein, 8 aa, Dengue virus
IVIRVQYE

SEQ ID NO: 79123 - protein, 8 aa, Dengue virus
VIRVQYEG

SEQ ID NO: 79124 - protein, 8 aa, Dengue virus
VKVKYEGT

SEQ ID NO: 79125 - protein, 8 aa, Dengue virus
KVKYEGTG

SEQ ID NO: 79126 - protein, 8 aa, Dengue virus
VKYEGTGA

SEQ ID NO: 79127 - protein, 8 aa, Dengue virus
KYEGTGAP

SEQ ID NO: 79128 - protein, 8 aa, Dengue virus
YEGTGAPC

SEQ ID NO: 79129 - protein, 8 aa, Dengue virus
EGTGAPCK

SEQ ID NO: 79130 - protein, 8 aa, Dengue virus
GTGAPCKV

SEQ ID NO: 79131 - protein, 8 aa, Dengue virus
TGAPCKVP

SEQ ID NO: 79132 - protein, 8 aa, Dengue virus
GAPCKIPI

SEQ ID NO: 79133 - protein, 8 aa, Dengue virus
APCKIPIE

SEQ ID NO: 79134 - protein, 8 aa, Dengue virus
PCKIPIEI

SEQ ID NO: 79135 - protein, 8 aa, Dengue virus
CKIPIEIR

SEQ ID NO: 79136 - protein, 8 aa, Dengue virus
KIPFEIMD

SEQ ID NO: 79137 - protein, 8 aa, Dengue virus
IPIEIRDV

SEQ ID NO: 79138 - protein, 8 aa, Dengue virus
PFEIMDLE

SEQ ID NO: 79139 - protein, 8 aa, Dengue virus
FEIMDLEK

SEQ ID NO: 79140 - protein, 8 aa, Dengue virus
EIRDVNKK

SEQ ID NO: 79141 - protein, 8 aa, Dengue virus
IRDVNKKK

SEQ ID NO: 79142 - protein, 8 aa, Dengue virus
RDVNKKKV

SEQ ID NO: 79143 - protein, 8 aa, Dengue virus
DVNKKKVV

SEQ ID NO: 79144 - protein, 8 aa, Dengue virus
VNKKKVVG

SEQ ID NO: 79145 - protein, 8 aa, Dengue virus
NKKKVVGR

SEQ ID NO: 79146 - protein, 8 aa, Dengue virus
KVVGRIIS

SEQ ID NO: 79147 - protein, 8 aa, Dengue virus
VVGRIISS

SEQ ID NO: 79148 - protein, 8 aa, Dengue virus
GRIISSTP

SEQ ID NO: 79149 - protein, 8 aa, Dengue virus
ISATPLAE

SEQ ID NO: 79150 - protein, 8 aa, Dengue virus
PFAENTNS

SEQ ID NO: 79151 - protein, 8 aa, Dengue virus
AENTNSAT

SEQ ID NO: 79152 - protein, 8 aa, Dengue virus
ENTNSATN

SEQ ID NO: 79153 - protein, 8 aa, Dengue virus
STNSVTNI

SEQ ID NO: 79154 - protein, 8 aa, Dengue virus
TNSATNIE

SEQ ID NO: 79155 - protein, 8 aa, Dengue virus
NSATNIEL

SEQ ID NO: 79156 - protein, 8 aa, Dengue virus
SATNIELE

SEQ ID NO: 79157 - protein, 8 aa, Dengue virus
ATNIELEP

SEQ ID NO: 79158 - protein, 8 aa, Dengue virus
VNIEAEPP

SEQ ID NO: 79159 - protein, 8 aa, Dengue virus
NIEAEPPF

SEQ ID NO: 79160 - protein, 8 aa, Dengue virus
IEAEPPFG

SEQ ID NO: 79161 - protein, 8 aa, Dengue virus
EAEPPFGD

SEQ ID NO: 79162 - protein, 8 aa, Dengue virus
AEPPFGDS

SEQ ID NO: 79163 - protein, 8 aa, Dengue virus
PFGDSYII

SEQ ID NO: 79164 - protein, 8 aa, Dengue virus
FGDSYIII

SEQ ID NO: 79165 - protein, 8 aa, Dengue virus
GDSYIIIG

SEQ ID NO: 79166 - protein, 8 aa, Dengue virus
DSYIIIGV

SEQ ID NO: 79167 - protein, 8 aa, Dengue virus
SYIIIGVE

SEQ ID NO: 79168 - protein, 8 aa, Dengue virus
YIVIGVGD

SEQ ID NO: 79169 - protein, 8 aa, Dengue virus
IVIGVGDS

SEQ ID NO: 79170 - protein, 8 aa, Dengue virus
VIGVGDSA

SEQ ID NO: 79171 - protein, 8 aa, Dengue virus
IGVGDSAL

SEQ ID NO: 79172 - protein, 8 aa, Dengue virus
GVGDSALT

SEQ ID NO: 79173 - protein, 8 aa, Dengue virus
VGDSALTL

SEQ ID NO: 79174 - protein, 8 aa, Dengue virus
GDSALTLH

SEQ ID NO: 79175 - protein, 8 aa, Dengue virus
DSALTLHW

SEQ ID NO: 79176 - protein, 8 aa, Dengue virus
GQLKLNWF

SEQ ID NO: 79177 - protein, 8 aa, Dengue virus
QLKLNWFK

SEQ ID NO: 79178 - protein, 8 aa, Dengue virus
LKLNWFKK

SEQ ID NO: 79179 - protein, 8 aa, Dengue virus
KLNWFKKG

SEQ ID NO: 79180 - protein, 8 aa, Dengue virus
LNWFKKGS

SEQ ID NO: 79181 - protein, 8 aa, Dengue virus
NWFKKGSS

SEQ ID NO: 79182 - protein, 8 aa, Dengue virus
WFKKGSSI

SEQ ID NO: 79183 - protein, 8 aa, Dengue virus
FKKGSSIG

SEQ ID NO: 79184 - protein, 8 aa, Dengue virus
KKGSSIGQ

SEQ ID NO: 79185 - protein, 8 aa, Dengue virus
KGSSIGQM

SEQ ID NO: 79186 - protein, 8 aa, Dengue virus
GSSIGKML

SEQ ID NO: 79187 - protein, 8 aa, Dengue virus
SSIGKMLE

SEQ ID NO: 79188 - protein, 8 aa, Dengue virus
SIGQMFET

SEQ ID NO: 79189 - protein, 8 aa, Dengue virus
IGQMFETT

SEQ ID NO: 79190 - protein, 8 aa, Dengue virus
GKMLESTY

SEQ ID NO: 79191 - protein, 8 aa, Dengue virus
KMLESTYR

SEQ ID NO: 79192 - protein, 8 aa, Dengue virus
MFETTMRG

SEQ ID NO: 79193 - protein, 8 aa, Dengue virus
FETTMRGA

SEQ ID NO: 79194 - protein, 8 aa, Dengue virus
ETTMRGAK

SEQ ID NO: 79195 - protein, 8 aa, Dengue virus
TTMRGAKR

SEQ ID NO: 79196 - protein, 8 aa, Dengue virus
TMRGAKRM

SEQ ID NO: 79197 - protein, 8 aa, Dengue virus
MRGAKRMA

SEQ ID NO: 79198 - protein, 8 aa, Dengue virus
KRMAILGD

SEQ ID NO: 79199 - protein, 8 aa, Dengue virus
RMAILGDT

SEQ ID NO: 79200 - protein, 8 aa, Dengue virus
MAILGDTA

SEQ ID NO: 79201 - protein, 8 aa, Dengue virus
AILGDTAW

SEQ ID NO: 79202 - protein, 8 aa, Dengue virus
ILGDTAWD

SEQ ID NO: 79203 - protein, 8 aa, Dengue virus
LGDTAWDF

SEQ ID NO: 79204 - protein, 8 aa, Dengue virus
GDTAWDFG

SEQ ID NO: 79205 - protein, 8 aa, Dengue virus
DTAWDFGS

SEQ ID NO: 79206 - protein, 8 aa, Dengue virus
TAWDFGSL

SEQ ID NO: 79207 - protein, 8 aa, Dengue virus
AWDFGSLG

SEQ ID NO: 79208 - protein, 8 aa, Dengue virus
WDFGSLGG

SEQ ID NO: 79209 - protein, 8 aa, Dengue virus
DFGSLGGV

SEQ ID NO: 79210 - protein, 8 aa, Dengue virus
FGSVGGLL

SEQ ID NO: 79211 - protein, 8 aa, Dengue virus
GSVGGLLT

SEQ ID NO: 79212 - protein, 8 aa, Dengue virus
SVGGLLTS

SEQ ID NO: 79213 - protein, 8 aa, Dengue virus
VGGLLTSL

SEQ ID NO: 79214 - protein, 8 aa, Dengue virus
GGLLTSLG

SEQ ID NO: 79215 - protein, 8 aa, Dengue virus
GLLTSLGK

SEQ ID NO: 79216 - protein, 8 aa, Dengue virus
LLTSLGKA

SEQ ID NO: 79217 - protein, 8 aa, Dengue virus
LTSLGKAV

SEQ ID NO: 79218 - protein, 8 aa, Dengue virus
TSIGKALH

SEQ ID NO: 79219 - protein, 8 aa, Dengue virus
SIGKALHQ

SEQ ID NO: 79220 - protein, 8 aa, Dengue virus
IGKALHQV

SEQ ID NO: 79221 - protein, 8 aa, Dengue virus
GKALHQVF

SEQ ID NO: 79222 - protein, 8 aa, Dengue virus
KALHQVFG

SEQ ID NO: 79223 - protein, 8 aa, Dengue virus
ALHQVFGA

SEQ ID NO: 79224 - protein, 8 aa, Dengue virus
LHQVFGAI

SEQ ID NO: 79225 - protein, 8 aa, Dengue virus
HQIFGSVY

SEQ ID NO: 79226 - protein, 8 aa, Dengue virus
QVFGAIYG

SEQ ID NO: 79227 - protein, 8 aa, Dengue virus
VFGAIYGA

SEQ ID NO: 79228 - protein, 8 aa, Dengue virus
FGAIYGAA

SEQ ID NO: 79229 - protein, 8 aa, Dengue virus
GAIYGAAF

SEQ ID NO: 79230 - protein, 8 aa, Dengue virus
AIYGAAFS

SEQ ID NO: 79231 - protein, 8 aa, Dengue virus
IYGAAFSG

SEQ ID NO: 79232 - protein, 8 aa, Dengue virus
YGAAFSGV

SEQ ID NO: 79233 - protein, 8 aa, Dengue virus
GAAFSGVS

SEQ ID NO: 79234 - protein, 8 aa, Dengue virus
AAFSGVSW

SEQ ID NO: 79235 - protein, 8 aa, Dengue virus
AFSGVSWT

SEQ ID NO: 79236 - protein, 8 aa, Dengue virus
FGGVSWMV

SEQ ID NO: 79237 - protein, 8 aa, Dengue virus
GGVSWMVR

SEQ ID NO: 79238 - protein, 8 aa, Dengue virus
GVSWMVRI

SEQ ID NO: 79239 - protein, 8 aa, Dengue virus
VSWMVRIL

SEQ ID NO: 79240 - protein, 8 aa, Dengue virus
SWMVRILI

SEQ ID NO: 79241 - protein, 8 aa, Dengue virus
WMVRILIG

SEQ ID NO: 79242 - protein, 8 aa, Dengue virus
VRILIGFL

SEQ ID NO: 79243 - protein, 8 aa, Dengue virus
RILIGLLV

SEQ ID NO: 79244 - protein, 8 aa, Dengue virus
ILIGLLVL

SEQ ID NO: 79245 - protein, 8 aa, Dengue virus
LIGLLVLW

SEQ ID NO: 79246 - protein, 8 aa, Dengue virus
IGLLVLWI

SEQ ID NO: 79247 - protein, 8 aa, Dengue virus
GLLVLWIG

SEQ ID NO: 79248 - protein, 8 aa, Dengue virus
LLVLWIGT

SEQ ID NO: 79249 - protein, 8 aa, Dengue virus
IITWIGMN

SEQ ID NO: 79250 - protein, 8 aa, Dengue virus
ITWIGMNS

SEQ ID NO: 79251 - protein, 8 aa, Dengue virus
TWIGMNSR

SEQ ID NO: 79252 - protein, 8 aa, Dengue virus
WIGMNSRN

SEQ ID NO: 79253 - protein, 8 aa, Dengue virus
IGMNSRNT

SEQ ID NO: 79254 - protein, 8 aa, Dengue virus
GTNSRNTP

SEQ ID NO: 79255 - protein, 8 aa, Dengue virus
MNSRNTSM

SEQ ID NO: 79256 - protein, 8 aa, Dengue virus
NSRNTPMA

SEQ ID NO: 79257 - protein, 8 aa, Dengue virus
SRNTPMAM

SEQ ID NO: 79258 - protein, 8 aa, Dengue virus
RNTSMAMS

SEQ ID NO: 79259 - protein, 8 aa, Dengue virus
NTSMAMSC

SEQ ID NO: 79260 - protein, 8 aa, Dengue virus
TSMAMSCI

SEQ ID NO: 79261 - protein, 8 aa, Dengue virus
SMAMSCIA

SEQ ID NO: 79262 - protein, 8 aa, Dengue virus
MAMSCIAV

SEQ ID NO: 79263 - protein, 8 aa, Dengue virus
AMSCIAVG

SEQ ID NO: 79264 - protein, 8 aa, Dengue virus
MSCIAVGG

SEQ ID NO: 79265 - protein, 8 aa, Dengue virus
SCIAVGGI

SEQ ID NO: 79266 - protein, 8 aa, Dengue virus
LFLGFTVH

SEQ ID NO: 79267 - protein, 8 aa, Dengue virus
FLGFTVHA

SEQ ID NO: 79268 - protein, 8 aa, Dengue virus
LGFTVHAD

SEQ ID NO: 79269 - protein, 8 aa, Dengue virus
GFTVHADM

SEQ ID NO: 79270 - protein, 8 aa, Dengue virus
FTVHADMG

SEQ ID NO: 79271 - protein, 8 aa, Dengue virus
TVHADMGC

SEQ ID NO: 79272 - protein, 8 aa, Dengue virus
ADMGCVAS

SEQ ID NO: 79273 - protein, 8 aa, Dengue virus
DMGCVASW

SEQ ID NO: 79274 - protein, 8 aa, Dengue virus
GCVVSWNG

SEQ ID NO: 79275 - protein, 8 aa, Dengue virus
SWSGKELK

SEQ ID NO: 79276 - protein, 8 aa, Dengue virus
WSGKELKC

SEQ ID NO: 79277 - protein, 8 aa, Dengue virus
SGKELKCG

SEQ ID NO: 79278 - protein, 8 aa, Dengue virus
GKELKCGS

SEQ ID NO: 79279 - protein, 8 aa, Dengue virus
KELKCGSG

SEQ ID NO: 79280 - protein, 8 aa, Dengue virus
CGSGIFVI

SEQ ID NO: 79281 - protein, 8 aa, Dengue virus
GSGIFVID

SEQ ID NO: 79282 - protein, 8 aa, Dengue virus
SGIFVIDN

SEQ ID NO: 79283 - protein, 8 aa, Dengue virus
GIFVIDNV

SEQ ID NO: 79284 - protein, 8 aa, Dengue virus
IFVIDNVH

SEQ ID NO: 79285 - protein, 8 aa, Dengue virus
FVIDNVHT

SEQ ID NO: 79286 - protein, 8 aa, Dengue virus
VIDNVHTW

SEQ ID NO: 79287 - protein, 8 aa, Dengue virus
IDNVHTWT

SEQ ID NO: 79288 - protein, 8 aa, Dengue virus
VHTWTEQH

SEQ ID NO: 79289 - protein, 8 aa, Dengue virus
HTWTEQYQ

SEQ ID NO: 79290 - protein, 8 aa, Dengue virus
TWTEQYQF

SEQ ID NO: 79291 - protein, 8 aa, Dengue virus
WTEQYQFQ

SEQ ID NO: 79292 - protein, 8 aa, Dengue virus
TEQYQFQP

SEQ ID NO: 79293 - protein, 8 aa, Dengue virus
EQYQFQPE

SEQ ID NO: 79294 - protein, 8 aa, Dengue virus
QYQFQPES

SEQ ID NO: 79295 - protein, 8 aa, Dengue virus
YQFQPESP

SEQ ID NO: 79296 - protein, 8 aa, Dengue virus
QFQPESPA

SEQ ID NO: 79297 - protein, 8 aa, Dengue virus
QPESPARV

SEQ ID NO: 79298 - protein, 8 aa, Dengue virus
PESPARVA

SEQ ID NO: 79299 - protein, 8 aa, Dengue virus
ESPARVAS

SEQ ID NO: 79300 - protein, 8 aa, Dengue virus
SPARVASA

SEQ ID NO: 79301 - protein, 8 aa, Dengue virus
PARVASAI

SEQ ID NO: 79302 - protein, 8 aa, Dengue virus
ARVASAIL

SEQ ID NO: 79303 - protein, 8 aa, Dengue virus
RVASAILN

SEQ ID NO: 79304 - protein, 8 aa, Dengue virus
VASAILNA

SEQ ID NO: 79305 - protein, 8 aa, Dengue virus
SAILNAHE

SEQ ID NO: 79306 - protein, 8 aa, Dengue virus
AILNAHED

SEQ ID NO: 79307 - protein, 8 aa, Dengue virus
ILNAHKEG

SEQ ID NO: 79308 - protein, 8 aa, Dengue virus
LNAHEDGV

SEQ ID NO: 79309 - protein, 8 aa, Dengue virus
NAHKEGVC

SEQ ID NO: 79310 - protein, 8 aa, Dengue virus
AHKEGVCG

SEQ ID NO: 79311 - protein, 8 aa, Dengue virus
HKDGVCGV

SEQ ID NO: 79312 - protein, 8 aa, Dengue virus
KEGVCGIR

SEQ ID NO: 79313 - protein, 8 aa, Dengue virus
DGVCGVRS

SEQ ID NO: 79314 - protein, 8 aa, Dengue virus
STTRLENI

SEQ ID NO: 79315 - protein, 8 aa, Dengue virus
TTRLENIM

SEQ ID NO: 79316 - protein, 8 aa, Dengue virus
TRLENIMW

SEQ ID NO: 79317 - protein, 8 aa, Dengue virus
RLENIMWK

SEQ ID NO: 79318 - protein, 8 aa, Dengue virus
LENIMWKQ

SEQ ID NO: 79319 - protein, 8 aa, Dengue virus
ENIMWKQI

SEQ ID NO: 79320 - protein, 8 aa, Dengue virus
NIMWKQIT

SEQ ID NO: 79321 - protein, 8 aa, Dengue virus
IMWKQITN

SEQ ID NO: 79322 - protein, 8 aa, Dengue virus
GHDLTVVT

SEQ ID NO: 79323 - protein, 8 aa, Dengue virus
HDLTIVAG

SEQ ID NO: 79324 - protein, 8 aa, Dengue virus
DLTIVAGD

SEQ ID NO: 79325 - protein, 8 aa, Dengue virus
LTVVAGDA

SEQ ID NO: 79326 - protein, 8 aa, Dengue virus
TVVAGDAK

SEQ ID NO: 79327 - protein, 8 aa, Dengue virus
VVAGDAKG

SEQ ID NO: 79328 - protein, 8 aa, Dengue virus
VAGDAKGV

SEQ ID NO: 79329 - protein, 8 aa, Dengue virus
AGDAKGVL

SEQ ID NO: 79330 - protein, 8 aa, Dengue virus
GDVKGVLS

SEQ ID NO: 79331 - protein, 8 aa, Dengue virus
DVKGVLSK

SEQ ID NO: 79332 - protein, 8 aa, Dengue virus
VKGVLSKG

SEQ ID NO: 79333 - protein, 8 aa, Dengue virus
KGVLSKGK

SEQ ID NO: 79334 - protein, 8 aa, Dengue virus
GVLSKGKR

SEQ ID NO: 79335 - protein, 8 aa, Dengue virus
VLSKGKRA

SEQ ID NO: 79336 - protein, 8 aa, Dengue virus
LSKGKRAL

SEQ ID NO: 79337 - protein, 8 aa, Dengue virus
SKGKRALA

SEQ ID NO: 79338 - protein, 8 aa, Dengue virus
KGKRALAP

SEQ ID NO: 79339 - protein, 8 aa, Dengue virus
GKRALAPP

SEQ ID NO: 79340 - protein, 8 aa, Dengue virus
KRALTPPA

SEQ ID NO: 79341 - protein, 8 aa, Dengue virus
LTPPASDL

SEQ ID NO: 79342 - protein, 8 aa, Dengue virus
TPPASDLK

SEQ ID NO: 79343 - protein, 8 aa, Dengue virus
PPASDLKY

SEQ ID NO: 79344 - protein, 8 aa, Dengue virus
PASDLKYS

SEQ ID NO: 79345 - protein, 8 aa, Dengue virus
ASDLKYSW

SEQ ID NO: 79346 - protein, 8 aa, Dengue virus
NDLKYSWK

SEQ ID NO: 79347 - protein, 8 aa, Dengue virus
WGKARIFT

SEQ ID NO: 79348 - protein, 8 aa, Dengue virus
GKAKIFAP

SEQ ID NO: 79349 - protein, 8 aa, Dengue virus
KARIFTPE

SEQ ID NO: 79350 - protein, 8 aa, Dengue virus
AKIFTPET

SEQ ID NO: 79351 - protein, 8 aa, Dengue virus
IFTPETRN

SEQ ID NO: 79352 - protein, 8 aa, Dengue virus
PETRNSTF

SEQ ID NO: 79353 - protein, 8 aa, Dengue virus
ETRNSTFL

SEQ ID NO: 79354 - protein, 8 aa, Dengue virus
KNSTFLID

SEQ ID NO: 79355 - protein, 8 aa, Dengue virus
NSTFLVDG

SEQ ID NO: 79356 - protein, 8 aa, Dengue virus
STFLVDGP

SEQ ID NO: 79357 - protein, 8 aa, Dengue virus
TFLVDGPD

SEQ ID NO: 79358 - protein, 8 aa, Dengue virus
FLVDGPDT

SEQ ID NO: 79359 - protein, 8 aa, Dengue virus
LVDGPDTS

SEQ ID NO: 79360 - protein, 8 aa, Dengue virus
VDGPDTSE

SEQ ID NO: 79361 - protein, 8 aa, Dengue virus
NERRAWNF

SEQ ID NO: 79362 - protein, 8 aa, Dengue virus
ERRAWNSF

SEQ ID NO: 79363 - protein, 8 aa, Dengue virus
RRAWNSFE

SEQ ID NO: 79364 - protein, 8 aa, Dengue virus
RAWNSFEV

SEQ ID NO: 79365 - protein, 8 aa, Dengue virus
AWNSFEVE

SEQ ID NO: 79366 - protein, 8 aa, Dengue virus
WNSFEVED

SEQ ID NO: 79367 - protein, 8 aa, Dengue virus
NSFEVEDY

SEQ ID NO: 79368 - protein, 8 aa, Dengue virus
SFEVEDYG

SEQ ID NO: 79369 - protein, 8 aa, Dengue virus
FEVEDYGF

SEQ ID NO: 79370 - protein, 8 aa, Dengue virus
GFGMFTTS

SEQ ID NO: 79371 - protein, 8 aa, Dengue virus
FGMFTTSI

SEQ ID NO: 79372 - protein, 8 aa, Dengue virus
GMFTTSIW

SEQ ID NO: 79373 - protein, 8 aa, Dengue virus
MFTTSIWM

SEQ ID NO: 79374 - protein, 8 aa, Dengue virus
FTTSIWMK

SEQ ID NO: 79375 - protein, 8 aa, Dengue virus
TTSIWMKF

SEQ ID NO: 79376 - protein, 8 aa, Dengue virus
TSIWMKFR

SEQ ID NO: 79377 - protein, 8 aa, Dengue virus
SIWMKFRE

SEQ ID NO: 79378 - protein, 8 aa, Dengue virus
FREGSSEL

SEQ ID NO: 79379 - protein, 8 aa, Dengue virus
NQTWQIER

SEQ ID NO: 79380 - protein, 8 aa, Dengue virus
QTWQIERA

SEQ ID NO: 79381 - protein, 8 aa, Dengue virus
TWQIERAS

SEQ ID NO: 79382 - protein, 8 aa, Dengue virus
WQIERASL

SEQ ID NO: 79383 - protein, 8 aa, Dengue virus
QIERASLI

SEQ ID NO: 79384 - protein, 8 aa, Dengue virus
IERASLIE

SEQ ID NO: 79385 - protein, 8 aa, Dengue virus
ERASLIEV

SEQ ID NO: 79386 - protein, 8 aa, Dengue virus
RASLIEVK

SEQ ID NO: 79387 - protein, 8 aa, Dengue virus
ESQMLIPR

SEQ ID NO: 79388 - protein, 8 aa, Dengue virus
SQMLIPRS

SEQ ID NO: 79389 - protein, 8 aa, Dengue virus
QMLIPRSY

SEQ ID NO: 79390 - protein, 8 aa, Dengue virus
MLIPRSYA

SEQ ID NO: 79391 - protein, 8 aa, Dengue virus
LIPRSYAG

SEQ ID NO: 79392 - protein, 8 aa, Dengue virus
IPRSYAGP

SEQ ID NO: 79393 - protein, 8 aa, Dengue virus
PRSYAGPF

SEQ ID NO: 79394 - protein, 8 aa, Dengue virus
RSYAGPFS

SEQ ID NO: 79395 - protein, 8 aa, Dengue virus
AYAGPFSQ

SEQ ID NO: 79396 - protein, 8 aa, Dengue virus
YAGPFSHH

SEQ ID NO: 79397 - protein, 8 aa, Dengue virus
AGPFSHHN

SEQ ID NO: 79398 - protein, 8 aa, Dengue virus
GPFSHHNY

SEQ ID NO: 79399 - protein, 8 aa, Dengue virus
PFSHHNYR

SEQ ID NO: 79400 - protein, 8 aa, Dengue virus
FSHHNYRQ

SEQ ID NO: 79401 - protein, 8 aa, Dengue virus
SHHNYRQG

SEQ ID NO: 79402 - protein, 8 aa, Dengue virus
HHNYRQGY

SEQ ID NO: 79403 - protein, 8 aa, Dengue virus
RQGYATQI

SEQ ID NO: 79404 - protein, 8 aa, Dengue virus
QGYATQTM

SEQ ID NO: 79405 - protein, 8 aa, Dengue virus
GYATQTMG

SEQ ID NO: 79406 - protein, 8 aa, Dengue virus
YATQTMGP

SEQ ID NO: 79407 - protein, 8 aa, Dengue virus
ATQTMGPW

SEQ ID NO: 79408 - protein, 8 aa, Dengue virus
TQTMGPWH

SEQ ID NO: 79409 - protein, 8 aa, Dengue virus
QTMGPWHL

SEQ ID NO: 79410 - protein, 8 aa, Dengue virus
TMGPWHLG

SEQ ID NO: 79411 - protein, 8 aa, Dengue virus
AGPWHLGK

SEQ ID NO: 79412 - protein, 8 aa, Dengue virus
HLGKLEMD

SEQ ID NO: 79413 - protein, 8 aa, Dengue virus
LGKLEIGF

SEQ ID NO: 79414 - protein, 8 aa, Dengue virus
GKLEIGFG

SEQ ID NO: 79415 - protein, 8 aa, Dengue virus
KLEMDFGE

SEQ ID NO: 79416 - protein, 8 aa, Dengue virus
LEMDFGEC

SEQ ID NO: 79417 - protein, 8 aa, Dengue virus
EIGFGECP

SEQ ID NO: 79418 - protein, 8 aa, Dengue virus
MDFGECPG

SEQ ID NO: 79419 - protein, 8 aa, Dengue virus
ECPGTTVA

SEQ ID NO: 79420 - protein, 8 aa, Dengue virus
CPGTTVAI

SEQ ID NO: 79421 - protein, 8 aa, Dengue virus
PGTTVAIQ

SEQ ID NO: 79422 - protein, 8 aa, Dengue virus
GTTVAIQE

SEQ ID NO: 79423 - protein, 8 aa, Dengue virus
TTVTIQEN

SEQ ID NO: 79424 - protein, 8 aa, Dengue virus
TVTIQENC

SEQ ID NO: 79425 - protein, 8 aa, Dengue virus
QENCDHRG

SEQ ID NO: 79426 - protein, 8 aa, Dengue virus
ENCDHRGP

SEQ ID NO: 79427 - protein, 8 aa, Dengue virus
NCDHRGPS

SEQ ID NO: 79428 - protein, 8 aa, Dengue virus
CGHRGSSL

SEQ ID NO: 79429 - protein, 8 aa, Dengue virus
GHRGSSLR

SEQ ID NO: 79430 - protein, 8 aa, Dengue virus
HRGSSLRT

SEQ ID NO: 79431 - protein, 8 aa, Dengue virus
RGSSLRTT

SEQ ID NO: 79432 - protein, 8 aa, Dengue virus
GSSLRTTT

SEQ ID NO: 79433 - protein, 8 aa, Dengue virus
SSLRTTTA

SEQ ID NO: 79434 - protein, 8 aa, Dengue virus
GMEIRPLN

SEQ ID NO: 79435 - protein, 8 aa, Dengue virus
MEIRPLNE

SEQ ID NO: 79436 - protein, 8 aa, Dengue virus
EIRPLNEK

SEQ ID NO: 79437 - protein, 8 aa, Dengue virus
IRPLNEKE

SEQ ID NO: 79438 - protein, 8 aa, Dengue virus
RPLNEKEE

SEQ ID NO: 79439 - protein, 8 aa, Dengue virus
PLNEKEEN

SEQ ID NO: 79440 - protein, 8 aa, Dengue virus
LNEKEENM

SEQ ID NO: 79441 - protein, 8 aa, Dengue virus
NEKEENMV

SEQ ID NO: 79442 - protein, 8 aa, Dengue virus
EREENMVK

SEQ ID NO: 79443 - protein, 8 aa, Dengue virus
REENMVKS

SEQ ID NO: 79444 - protein, 8 aa, Dengue virus
EENMVRSQ

SEQ ID NO: 79445 - protein, 8 aa, Dengue virus
ENMVRSQV

SEQ ID NO: 79446 - protein, 8 aa, Dengue virus
NMVKSQVA

SEQ ID NO: 79447 - protein, 8 aa, Dengue virus
MVKSQVAA

SEQ ID NO: 79448 - protein, 8 aa, Dengue virus
VKSQVAAG

SEQ ID NO: 79449 - protein, 8 aa, Dengue virus
AGQSTSET

SEQ ID NO: 79450 - protein, 8 aa, Dengue virus
GQSTSETF

SEQ ID NO: 79451 - protein, 8 aa, Dengue virus
STSETFSM

SEQ ID NO: 79452 - protein, 8 aa, Dengue virus
SSETFSMG

SEQ ID NO: 79453 - protein, 8 aa, Dengue virus
SETFFMGL

SEQ ID NO: 79454 - protein, 8 aa, Dengue virus
LLCLTLFM

SEQ ID NO: 79455 - protein, 8 aa, Dengue virus
LCLTLFME

SEQ ID NO: 79456 - protein, 8 aa, Dengue virus
CLTLFMEE

SEQ ID NO: 79457 - protein, 8 aa, Dengue virus
LTLFMEEC

SEQ ID NO: 79458 - protein, 8 aa, Dengue virus
TLFMEECL

SEQ ID NO: 79459 - protein, 8 aa, Dengue virus
LFMEECLR

SEQ ID NO: 79460 - protein, 8 aa, Dengue virus
FMEECLRR

SEQ ID NO: 79461 - protein, 8 aa, Dengue virus
MEECLRRR

SEQ ID NO: 79462 - protein, 8 aa, Dengue virus
EECLRRKV

SEQ ID NO: 79463 - protein, 8 aa, Dengue virus
ECLRRKVT

SEQ ID NO: 79464 - protein, 8 aa, Dengue virus
CLRRKVTR

SEQ ID NO: 79465 - protein, 8 aa, Dengue virus
LRRKVTRK

SEQ ID NO: 79466 - protein, 8 aa, Dengue virus
RRKVTRKH

SEQ ID NO: 79467 - protein, 8 aa, Dengue virus
RKVTRKHM

SEQ ID NO: 79468 - protein, 8 aa, Dengue virus
KVTRKHMI

SEQ ID NO: 79469 - protein, 8 aa, Dengue virus
TRKHMILV

SEQ ID NO: 79470 - protein, 8 aa, Dengue virus
RKHMILVV

SEQ ID NO: 79471 - protein, 8 aa, Dengue virus
KHMILVVV

SEQ ID NO: 79472 - protein, 8 aa, Dengue virus
HMILVVVI

SEQ ID NO: 79473 - protein, 8 aa, Dengue virus
MILVVVIT

SEQ ID NO: 79474 - protein, 8 aa, Dengue virus
ITFCAIIL

SEQ ID NO: 79475 - protein, 8 aa, Dengue virus
TFCAIILG

SEQ ID NO: 79476 - protein, 8 aa, Dengue virus
FCAIILGG

SEQ ID NO: 79477 - protein, 8 aa, Dengue virus
WMDLLRAI

SEQ ID NO: 79478 - protein, 8 aa, Dengue virus
MDLLRAII

SEQ ID NO: 79479 - protein, 8 aa, Dengue virus
DLLRAIIM

SEQ ID NO: 79480 - protein, 8 aa, Dengue virus
LLRAIIML

SEQ ID NO: 79481 - protein, 8 aa, Dengue virus
LRAIIMLG

SEQ ID NO: 79482 - protein, 8 aa, Dengue virus
RAIIMLGD

SEQ ID NO: 79483 - protein, 8 aa, Dengue virus
AIIMLGDT

SEQ ID NO: 79484 - protein, 8 aa, Dengue virus
IIMLGDTM

SEQ ID NO: 79485 - protein, 8 aa, Dengue virus
IMLGDTML

SEQ ID NO: 79486 - protein, 8 aa, Dengue virus
MLGDTMLS

SEQ ID NO: 79487 - protein, 8 aa, Dengue virus
LGDTMLSR

SEQ ID NO: 79488 - protein, 8 aa, Dengue virus
GDTMSGRM

SEQ ID NO: 79489 - protein, 8 aa, Dengue virus
DTMSGRMG

SEQ ID NO: 79490 - protein, 8 aa, Dengue virus
TMSGRMGG

SEQ ID NO: 79491 - protein, 8 aa, Dengue virus
MSGRMGGQ

SEQ ID NO: 79492 - protein, 8 aa, Dengue virus
RIGGQIHL

SEQ ID NO: 79493 - protein, 8 aa, Dengue virus
IGGQIHLA

SEQ ID NO: 79494 - protein, 8 aa, Dengue virus
GGQIHLAI

SEQ ID NO: 79495 - protein, 8 aa, Dengue virus
GQIHLAIM

SEQ ID NO: 79496 - protein, 8 aa, Dengue virus
QIHLAIMA

SEQ ID NO: 79497 - protein, 8 aa, Dengue virus
IHLAIMAV

SEQ ID NO: 79498 - protein, 8 aa, Dengue virus
HLAIMIVF

SEQ ID NO: 79499 - protein, 8 aa, Dengue virus
LAIMIVFK

SEQ ID NO: 79500 - protein, 8 aa, Dengue virus
AIMIVFKM

SEQ ID NO: 79501 - protein, 8 aa, Dengue virus
IMIVFKMS

SEQ ID NO: 79502 - protein, 8 aa, Dengue virus
MIVFKMSP

SEQ ID NO: 79503 - protein, 8 aa, Dengue virus
IVFKMSPG

SEQ ID NO: 79504 - protein, 8 aa, Dengue virus
SPGYVLGI

SEQ ID NO: 79505 - protein, 8 aa, Dengue virus
PGYVLGIF

SEQ ID NO: 79506 - protein, 8 aa, Dengue virus
GYVLGIFL

SEQ ID NO: 79507 - protein, 8 aa, Dengue virus
YVLGIFLR

SEQ ID NO: 79508 - protein, 8 aa, Dengue virus
VLGIFLRK

SEQ ID NO: 79509 - protein, 8 aa, Dengue virus
LGIFLRKL

SEQ ID NO: 79510 - protein, 8 aa, Dengue virus
GIFLRKLT

SEQ ID NO: 79511 - protein, 8 aa, Dengue virus
IFLRKLTS

SEQ ID NO: 79512 - protein, 8 aa, Dengue virus
FLRRLTSR

SEQ ID NO: 79513 - protein, 8 aa, Dengue virus
LRRLTSRE

SEQ ID NO: 79514 - protein, 8 aa, Dengue virus
RRLTSRET

SEQ ID NO: 79515 - protein, 8 aa, Dengue virus
RLTSRETA

SEQ ID NO: 79516 - protein, 8 aa, Dengue virus
IGMAMTTV

SEQ ID NO: 79517 - protein, 8 aa, Dengue virus
GMAMTTVL

SEQ ID NO: 79518 - protein, 8 aa, Dengue virus
MAMTTVLS

SEQ ID NO: 79519 - protein, 8 aa, Dengue virus
AMTTVLSI

SEQ ID NO: 79520 - protein, 8 aa, Dengue virus
MTTVLSIP

SEQ ID NO: 79521 - protein, 8 aa, Dengue virus
TTVLSIPH

SEQ ID NO: 79522 - protein, 8 aa, Dengue virus
TVLSIPHD

SEQ ID NO: 79523 - protein, 8 aa, Dengue virus
VLSIPHDL

SEQ ID NO: 79524 - protein, 8 aa, Dengue virus
FSIPHDLM

SEQ ID NO: 79525 - protein, 8 aa, Dengue virus
IPHDLMEF

SEQ ID NO: 79526 - protein, 8 aa, Dengue virus
PHDLMEFI

SEQ ID NO: 79527 - protein, 8 aa, Dengue virus
HDLMEFID

SEQ ID NO: 79528 - protein, 8 aa, Dengue virus
DLMEFIDG

SEQ ID NO: 79529 - protein, 8 aa, Dengue virus
LMEFIDGI

SEQ ID NO: 79530 - protein, 8 aa, Dengue virus
MEFIDGIS

SEQ ID NO: 79531 - protein, 8 aa, Dengue virus
EFIDGISL

SEQ ID NO: 79532 - protein, 8 aa, Dengue virus
FIDGISLG

SEQ ID NO: 79533 - protein, 8 aa, Dengue virus
IDGIALGL

SEQ ID NO: 79534 - protein, 8 aa, Dengue virus
DGIALGLI

SEQ ID NO: 79535 - protein, 8 aa, Dengue virus
GIALGLIL

SEQ ID NO: 79536 - protein, 8 aa, Dengue virus
IALGLILL

SEQ ID NO: 79537 - protein, 8 aa, Dengue virus
LGLILLKM

SEQ ID NO: 79538 - protein, 8 aa, Dengue virus
GLILLKMV

SEQ ID NO: 79539 - protein, 8 aa, Dengue virus
LILLKMVT

SEQ ID NO: 79540 - protein, 8 aa, Dengue virus
ILLKIVTH

SEQ ID NO: 79541 - protein, 8 aa, Dengue virus
LLKIVTHF

SEQ ID NO: 79542 - protein, 8 aa, Dengue virus
LKIVTHFD

SEQ ID NO: 79543 - protein, 8 aa, Dengue virus
VTHFDNTQ

SEQ ID NO: 79544 - protein, 8 aa, Dengue virus
THFDNTQV

SEQ ID NO: 79545 - protein, 8 aa, Dengue virus
HFDNTQVG

SEQ ID NO: 79546 - protein, 8 aa, Dengue virus
FDDTQVGT

SEQ ID NO: 79547 - protein, 8 aa, Dengue virus
DDTQVGTL

SEQ ID NO: 79548 - protein, 8 aa, Dengue virus
DTQVGTLA

SEQ ID NO: 79549 - protein, 8 aa, Dengue virus
QLGTLALS

SEQ ID NO: 79550 - protein, 8 aa, Dengue virus
LGTLALSL

SEQ ID NO: 79551 - protein, 8 aa, Dengue virus
ALSLTFIK

SEQ ID NO: 79552 - protein, 8 aa, Dengue virus
LSLTFIKS

SEQ ID NO: 79553 - protein, 8 aa, Dengue virus
SLTFIKST

SEQ ID NO: 79554 - protein, 8 aa, Dengue virus
LTFIRSTT

SEQ ID NO: 79555 - protein, 8 aa, Dengue virus
PLVMAWRT

SEQ ID NO: 79556 - protein, 8 aa, Dengue virus
LIMAWRTI

SEQ ID NO: 79557 - protein, 8 aa, Dengue virus
IMAWRTIM

SEQ ID NO: 79558 - protein, 8 aa, Dengue virus
WRTIMAVF

SEQ ID NO: 79559 - protein, 8 aa, Dengue virus
RTIMAVFF

SEQ ID NO: 79560 - protein, 8 aa, Dengue virus
TIMAVFFV

SEQ ID NO: 79561 - protein, 8 aa, Dengue virus
IMAVFFVV

SEQ ID NO: 79562 - protein, 8 aa, Dengue virus
MAVFFVVT

SEQ ID NO: 79563 - protein, 8 aa, Dengue virus
AVFFVVTL

SEQ ID NO: 79564 - protein, 8 aa, Dengue virus
VFFVVTLI

SEQ ID NO: 79565 - protein, 8 aa, Dengue virus
FFVVTLIP

SEQ ID NO: 79566 - protein, 8 aa, Dengue virus
FAVTLIPL

SEQ ID NO: 79567 - protein, 8 aa, Dengue virus
AVTLIPLC

SEQ ID NO: 79568 - protein, 8 aa, Dengue virus
LQNQSHWV

SEQ ID NO: 79569 - protein, 8 aa, Dengue virus
QKQSHWIE

SEQ ID NO: 79570 - protein, 8 aa, Dengue virus
KQSHWIEI

SEQ ID NO: 79571 - protein, 8 aa, Dengue virus
HWVEITAI

SEQ ID NO: 79572 - protein, 8 aa, Dengue virus
WVEITAII

SEQ ID NO: 79573 - protein, 8 aa, Dengue virus
VEITAIIL

SEQ ID NO: 79574 - protein, 8 aa, Dengue virus
EITAIILG

SEQ ID NO: 79575 - protein, 8 aa, Dengue virus
ITAIILGA

SEQ ID NO: 79576 - protein, 8 aa, Dengue virus
TAIILGAQ

SEQ ID NO: 79577 - protein, 8 aa, Dengue virus
AIILGAQA

SEQ ID NO: 79578 - protein, 8 aa, Dengue virus
IILGAQAL

SEQ ID NO: 79579 - protein, 8 aa, Dengue virus
TLGAQALP

SEQ ID NO: 79580 - protein, 8 aa, Dengue virus
TLMKGASK

SEQ ID NO: 79581 - protein, 8 aa, Dengue virus
LMKGASKR

SEQ ID NO: 79582 - protein, 8 aa, Dengue virus
MKGASKRS

SEQ ID NO: 79583 - protein, 8 aa, Dengue virus
KGASKRSW

SEQ ID NO: 79584 - protein, 8 aa, Dengue virus
GASKRSWP

SEQ ID NO: 79585 - protein, 8 aa, Dengue virus
ASKRSWPL

SEQ ID NO: 79586 - protein, 8 aa, Dengue virus
SKRSWPLN

SEQ ID NO: 79587 - protein, 8 aa, Dengue virus
KRSWPLNE

SEQ ID NO: 79588 - protein, 8 aa, Dengue virus
SADLSLER

SEQ ID NO: 79589 - protein, 8 aa, Dengue virus
ADLSLERA

SEQ ID NO: 79590 - protein, 8 aa, Dengue virus
DLSLERAA

SEQ ID NO: 79591 - protein, 8 aa, Dengue virus
LSLEKAAS

SEQ ID NO: 79592 - protein, 8 aa, Dengue virus
SLEKAASV

SEQ ID NO: 79593 - protein, 8 aa, Dengue virus
LEKAASVQ

SEQ ID NO: 79594 - protein, 8 aa, Dengue virus
EKAASVQW

SEQ ID NO: 79595 - protein, 8 aa, Dengue virus
KAASVQWD

SEQ ID NO: 79596 - protein, 8 aa, Dengue virus
AASVQWDE

SEQ ID NO: 79597 - protein, 8 aa, Dengue virus
ASVQWDEM

SEQ ID NO: 79598 - protein, 8 aa, Dengue virus
SVQWDEMA

SEQ ID NO: 79599 - protein, 8 aa, Dengue virus
DITGSSPV

SEQ ID NO: 79600 - protein, 8 aa, Dengue virus
ITGSSPIV

SEQ ID NO: 79601 - protein, 8 aa, Dengue virus
TGSSPIVE

SEQ ID NO: 79602 - protein, 8 aa, Dengue virus
GSSPIVEV

SEQ ID NO: 79603 - protein, 8 aa, Dengue virus
SSPIVEVK

SEQ ID NO: 79604 - protein, 8 aa, Dengue virus
SPIVEVKQ

SEQ ID NO: 79605 - protein, 8 aa, Dengue virus
PIVEVKQD

SEQ ID NO: 79606 - protein, 8 aa, Dengue virus
IVEVKQDE

SEQ ID NO: 79607 - protein, 8 aa, Dengue virus
VEVKQDED

SEQ ID NO: 79608 - protein, 8 aa, Dengue virus
GSFSIRDI

SEQ ID NO: 79609 - protein, 8 aa, Dengue virus
SFSIRDIE

SEQ ID NO: 79610 - protein, 8 aa, Dengue virus
FSIRDIEE

SEQ ID NO: 79611 - protein, 8 aa, Dengue virus
SIRDIEET

SEQ ID NO: 79612 - protein, 8 aa, Dengue virus
IRDIEETN

SEQ ID NO: 79613 - protein, 8 aa, Dengue virus
RDIEETNM

SEQ ID NO: 79614 - protein, 8 aa, Dengue virus
DIEETNMI

SEQ ID NO: 79615 - protein, 8 aa, Dengue virus
IEETNMIT

SEQ ID NO: 79616 - protein, 8 aa, Dengue virus
LYPLAIPI

SEQ ID NO: 79617 - protein, 8 aa, Dengue virus
YPLAIPIT

SEQ ID NO: 79618 - protein, 8 aa, Dengue virus
PLAIPITM

SEQ ID NO: 79619 - protein, 8 aa, Dengue virus
LAIPITMT

SEQ ID NO: 79620 - protein, 8 aa, Dengue virus
AIPITMTL

SEQ ID NO: 79621 - protein, 8 aa, Dengue virus
IPITMTLW

SEQ ID NO: 79622 - protein, 8 aa, Dengue virus
PITMTLWY

SEQ ID NO: 79623 - protein, 8 aa, Dengue virus
ITMTLWYM

SEQ ID NO: 79624 - protein, 8 aa, Dengue virus
TMALWYIW

SEQ ID NO: 79625 - protein, 8 aa, Dengue virus
MALWYIWQ

SEQ ID NO: 79626 - protein, 8 aa, Dengue virus
ALWYIWQV

SEQ ID NO: 79627 - protein, 8 aa, Dengue virus
LWYIWQVK

SEQ ID NO: 79628 - protein, 8 aa, Dengue virus
WYIWQVKT

SEQ ID NO: 79629 - protein, 8 aa, Dengue virus
YIWQVKTQ

SEQ ID NO: 79630 - protein, 8 aa, Dengue virus
IWQVKTQR

SEQ ID NO: 79631 - protein, 8 aa, Dengue virus
WQVRTQRS

SEQ ID NO: 79632 - protein, 8 aa, Dengue virus
QVRTQRSG

SEQ ID NO: 79633 - protein, 8 aa, Dengue virus
VRTQRSGA

SEQ ID NO: 79634 - protein, 8 aa, Dengue virus
RTQRSGAL

SEQ ID NO: 79635 - protein, 8 aa, Dengue virus
WDVPSPAT

SEQ ID NO: 79636 - protein, 8 aa, Dengue virus
DVPSPAAA

SEQ ID NO: 79637 - protein, 8 aa, Dengue virus
VPSPAATK

SEQ ID NO: 79638 - protein, 8 aa, Dengue virus
PSPAATKK

SEQ ID NO: 79639 - protein, 8 aa, Dengue virus
SPAATKKA

SEQ ID NO: 79640 - protein, 8 aa, Dengue virus
TKKAALSE

SEQ ID NO: 79641 - protein, 8 aa, Dengue virus
KKAALSEG

SEQ ID NO: 79642 - protein, 8 aa, Dengue virus
KATLSEGV

SEQ ID NO: 79643 - protein, 8 aa, Dengue virus
ATLSEGVY

SEQ ID NO: 79644 - protein, 8 aa, Dengue virus
TLSEGVYR

SEQ ID NO: 79645 - protein, 8 aa, Dengue virus
LTEGVYRI

SEQ ID NO: 79646 - protein, 8 aa, Dengue virus
TEGVYRIM

SEQ ID NO: 79647 - protein, 8 aa, Dengue virus
RIMQRGLL

SEQ ID NO: 79648 - protein, 8 aa, Dengue virus
IMQRGLLG

SEQ ID NO: 79649 - protein, 8 aa, Dengue virus
MQRGLLGK

SEQ ID NO: 79650 - protein, 8 aa, Dengue virus
QRGLLGKT

SEQ ID NO: 79651 - protein, 8 aa, Dengue virus
RGLLGKTQ

SEQ ID NO: 79652 - protein, 8 aa, Dengue virus
GLLGKTQV

SEQ ID NO: 79653 - protein, 8 aa, Dengue virus
LLGKTQVG

SEQ ID NO: 79654 - protein, 8 aa, Dengue virus
LGKTQVGV

SEQ ID NO: 79655 - protein, 8 aa, Dengue virus
KTQVGVGV

SEQ ID NO: 79656 - protein, 8 aa, Dengue virus
QVGVGIHI

SEQ ID NO: 79657 - protein, 8 aa, Dengue virus
VGVGIHIE

SEQ ID NO: 79658 - protein, 8 aa, Dengue virus
GVGIHIEG

SEQ ID NO: 79659 - protein, 8 aa, Dengue virus
VGIHIEGV

SEQ ID NO: 79660 - protein, 8 aa, Dengue virus
GIHIEGVF

SEQ ID NO: 79661 - protein, 8 aa, Dengue virus
IHIEGVFH

SEQ ID NO: 79662 - protein, 8 aa, Dengue virus
HIEGVFHT

SEQ ID NO: 79663 - protein, 8 aa, Dengue virus
IEGVFHTM

SEQ ID NO: 79664 - protein, 8 aa, Dengue virus
GSVICHES

SEQ ID NO: 79665 - protein, 8 aa, Dengue virus
SVICHESG

SEQ ID NO: 79666 - protein, 8 aa, Dengue virus
VICHESGR

SEQ ID NO: 79667 - protein, 8 aa, Dengue virus
ICHESGRL

SEQ ID NO: 79668 - protein, 8 aa, Dengue virus
CHESGRLE

SEQ ID NO: 79669 - protein, 8 aa, Dengue virus
HESGRLEP

SEQ ID NO: 79670 - protein, 8 aa, Dengue virus
ESGRLEPS

SEQ ID NO: 79671 - protein, 8 aa, Dengue virus
SGRLEPSW

SEQ ID NO: 79672 - protein, 8 aa, Dengue virus
RLGDKWDR

SEQ ID NO: 79673 - protein, 8 aa, Dengue virus
LGDKWDRE

SEQ ID NO: 79674 - protein, 8 aa, Dengue virus
GDKWDREE

SEQ ID NO: 79675 - protein, 8 aa, Dengue virus
DKWDREED

SEQ ID NO: 79676 - protein, 8 aa, Dengue virus
KWDREEDV

SEQ ID NO: 79677 - protein, 8 aa, Dengue virus
WDREEDVQ

SEQ ID NO: 79678 - protein, 8 aa, Dengue virus
DREEDVQV

SEQ ID NO: 79679 - protein, 8 aa, Dengue virus
REEDVQVL

SEQ ID NO: 79680 - protein, 8 aa, Dengue virus
EDVQVLAV

SEQ ID NO: 79681 - protein, 8 aa, Dengue virus
DVQVLAVE

SEQ ID NO: 79682 - protein, 8 aa, Dengue virus
VQVLAVEP

SEQ ID NO: 79683 - protein, 8 aa, Dengue virus
QVLAVEPG

SEQ ID NO: 79684 - protein, 8 aa, Dengue virus
VLAVEPGK

SEQ ID NO: 79685 - protein, 8 aa, Dengue virus
LAVEPGKN

SEQ ID NO: 79686 - protein, 8 aa, Dengue virus
AVEPGKNP

SEQ ID NO: 79687 - protein, 8 aa, Dengue virus
VEPGKNPK

SEQ ID NO: 79688 - protein, 8 aa, Dengue virus
KPGLFKTI

SEQ ID NO: 79689 - protein, 8 aa, Dengue virus
PGLFKTIT

SEQ ID NO: 79690 - protein, 8 aa, Dengue virus
GLFKTITG

SEQ ID NO: 79691 - protein, 8 aa, Dengue virus
LFKTITGE

SEQ ID NO: 79692 - protein, 8 aa, Dengue virus
FKTITGEI

SEQ ID NO: 79693 - protein, 8 aa, Dengue virus
KTITGEIG

SEQ ID NO: 79694 - protein, 8 aa, Dengue virus
TITGEIGA

SEQ ID NO: 79695 - protein, 8 aa, Dengue virus
ITGEIGAV

SEQ ID NO: 79696 - protein, 8 aa, Dengue virus
GTSGSPIV

SEQ ID NO: 79697 - protein, 8 aa, Dengue virus
SSGSPIIN

SEQ ID NO: 79698 - protein, 8 aa, Dengue virus
SGSPIINK

SEQ ID NO: 79699 - protein, 8 aa, Dengue virus
GSPIINKK

SEQ ID NO: 79700 - protein, 8 aa, Dengue virus
SPIINKKG

SEQ ID NO: 79701 - protein, 8 aa, Dengue virus
PIINKKGK

SEQ ID NO: 79702 - protein, 8 aa, Dengue virus
IINKKGKV

SEQ ID NO: 79703 - protein, 8 aa, Dengue virus
INKKGKVI

SEQ ID NO: 79704 - protein, 8 aa, Dengue virus
NKKGKVIG

SEQ ID NO: 79705 - protein, 8 aa, Dengue virus
KKGKVIGL

SEQ ID NO: 79706 - protein, 8 aa, Dengue virus
AITQAERT

SEQ ID NO: 79707 - protein, 8 aa, Dengue virus
ITQAERTG

SEQ ID NO: 79708 - protein, 8 aa, Dengue virus
TQAERTGE

SEQ ID NO: 79709 - protein, 8 aa, Dengue virus
QAERTGEP

SEQ ID NO: 79710 - protein, 8 aa, Dengue virus
AERTGEPD

SEQ ID NO: 79711 - protein, 8 aa, Dengue virus
ERTGEPDY

SEQ ID NO: 79712 - protein, 8 aa, Dengue virus
RTGEPDYE

SEQ ID NO: 79713 - protein, 8 aa, Dengue virus
TGEPDYEV

SEQ ID NO: 79714 - protein, 8 aa, Dengue virus
QTPAVKSD

SEQ ID NO: 79715 - protein, 8 aa, Dengue virus
TPAVKAEH

SEQ ID NO: 79716 - protein, 8 aa, Dengue virus
PAVKAEHT

SEQ ID NO: 79717 - protein, 8 aa, Dengue virus
AVKAEHTG

SEQ ID NO: 79718 - protein, 8 aa, Dengue virus
VKSDHTGR

SEQ ID NO: 79719 - protein, 8 aa, Dengue virus
KSDHTGRE

SEQ ID NO: 79720 - protein, 8 aa, Dengue virus
SDHTGREI

SEQ ID NO: 79721 - protein, 8 aa, Dengue virus
CHATFTTK

SEQ ID NO: 79722 - protein, 8 aa, Dengue virus
HATFTTKL

SEQ ID NO: 79723 - protein, 8 aa, Dengue virus
ATFTTKLL

SEQ ID NO: 79724 - protein, 8 aa, Dengue virus
TFTTKLLS

SEQ ID NO: 79725 - protein, 8 aa, Dengue virus
FTTKLLSS

SEQ ID NO: 79726 - protein, 8 aa, Dengue virus
TTKLLSST

SEQ ID NO: 79727 - protein, 8 aa, Dengue virus
TKLLSSTR

SEQ ID NO: 79728 - protein, 8 aa, Dengue virus
KLLSSTRV

SEQ ID NO: 79729 - protein, 8 aa, Dengue virus
EAHFTDPC

SEQ ID NO: 79730 - protein, 8 aa, Dengue virus
AHFTDPCS

SEQ ID NO: 79731 - protein, 8 aa, Dengue virus
HFTDPCSV

SEQ ID NO: 79732 - protein, 8 aa, Dengue virus
FTDPCSVA

SEQ ID NO: 79733 - protein, 8 aa, Dengue virus
TDPCSVAA

SEQ ID NO: 79734 - protein, 8 aa, Dengue virus
DPCSVAAR

SEQ ID NO: 79735 - protein, 8 aa, Dengue virus
PCSVAARG

SEQ ID NO: 79736 - protein, 8 aa, Dengue virus
CSVAARGY

SEQ ID NO: 79737 - protein, 8 aa, Dengue virus
MTATPPGS

SEQ ID NO: 79738 - protein, 8 aa, Dengue virus
TATPPGSI

SEQ ID NO: 79739 - protein, 8 aa, Dengue virus
ATPPGSID

SEQ ID NO: 79740 - protein, 8 aa, Dengue virus
TPPGSIDP

SEQ ID NO: 79741 - protein, 8 aa, Dengue virus
PPGSIDPF

SEQ ID NO: 79742 - protein, 8 aa, Dengue virus
PGSIDPFP

SEQ ID NO: 79743 - protein, 8 aa, Dengue virus
GSIDPFPQ

SEQ ID NO: 79744 - protein, 8 aa, Dengue virus
SIDPFPQS

SEQ ID NO: 79745 - protein, 8 aa, Dengue virus
IDPFPQSN

SEQ ID NO: 79746 - protein, 8 aa, Dengue virus
CLRKSGKR

SEQ ID NO: 79747 - protein, 8 aa, Dengue virus
LRKSGKRV

SEQ ID NO: 79748 - protein, 8 aa, Dengue virus
RKSGKRVI

SEQ ID NO: 79749 - protein, 8 aa, Dengue virus
KSGKRVIQ

SEQ ID NO: 79750 - protein, 8 aa, Dengue virus
SGKRVIQL

SEQ ID NO: 79751 - protein, 8 aa, Dengue virus
GKRVIQLS

SEQ ID NO: 79752 - protein, 8 aa, Dengue virus
KRVIQLSR

SEQ ID NO: 79753 - protein, 8 aa, Dengue virus
RVIQLSRK

SEQ ID NO: 79754 - protein, 8 aa, Dengue virus
RCLKPVIS

SEQ ID NO: 79755 - protein, 8 aa, Dengue virus
CLKPVILP

SEQ ID NO: 79756 - protein, 8 aa, Dengue virus
LKPVILPD

SEQ ID NO: 79757 - protein, 8 aa, Dengue virus
KPVILPDG

SEQ ID NO: 79758 - protein, 8 aa, Dengue virus
PVILPDGP

SEQ ID NO: 79759 - protein, 8 aa, Dengue virus
VILPDGPE

SEQ ID NO: 79760 - protein, 8 aa, Dengue virus
ILPDGPER

SEQ ID NO: 79761 - protein, 8 aa, Dengue virus
LPDGPERV

SEQ ID NO: 79762 - protein, 8 aa, Dengue virus
PDGPERVI

SEQ ID NO: 79763 - protein, 8 aa, Dengue virus
RGRIGRNL

SEQ ID NO: 79764 - protein, 8 aa, Dengue virus
GRIGRNLA

SEQ ID NO: 79765 - protein, 8 aa, Dengue virus
RIGRNLAQ

SEQ ID NO: 79766 - protein, 8 aa, Dengue virus
IGRNLAQE

SEQ ID NO: 79767 - protein, 8 aa, Dengue virus
GRNLAQED

SEQ ID NO: 79768 - protein, 8 aa, Dengue virus
RNLAQEDD

SEQ ID NO: 79769 - protein, 8 aa, Dengue virus
NLAQEDDQ

SEQ ID NO: 79770 - protein, 8 aa, Dengue virus
LAQEDDQY

SEQ ID NO: 79771 - protein, 8 aa, Dengue virus
TQEDDQYV

SEQ ID NO: 79772 - protein, 8 aa, Dengue virus
VFSGDPLR

SEQ ID NO: 79773 - protein, 8 aa, Dengue virus
FSGDPLRN

SEQ ID NO: 79774 - protein, 8 aa, Dengue virus
SGDPLRND

SEQ ID NO: 79775 - protein, 8 aa, Dengue virus
GDPLRNDE

SEQ ID NO: 79776 - protein, 8 aa, Dengue virus
DPLRNDED

SEQ ID NO: 79777 - protein, 8 aa, Dengue virus
PLRNDEDH

SEQ ID NO: 79778 - protein, 8 aa, Dengue virus
LRNDEDHA

SEQ ID NO: 79779 - protein, 8 aa, Dengue virus
RNDEDHAH

SEQ ID NO: 79780 - protein, 8 aa, Dengue virus
FGPEREKN

SEQ ID NO: 79781 - protein, 8 aa, Dengue virus
GPEREKNQ

SEQ ID NO: 79782 - protein, 8 aa, Dengue virus
PEREKNQA

SEQ ID NO: 79783 - protein, 8 aa, Dengue virus
EREKNQAI

SEQ ID NO: 79784 - protein, 8 aa, Dengue virus
REKNQAID

SEQ ID NO: 79785 - protein, 8 aa, Dengue virus
EKNQAIDG

SEQ ID NO: 79786 - protein, 8 aa, Dengue virus
KNQAIDGE

SEQ ID NO: 79787 - protein, 8 aa, Dengue virus
NQAIDGEF

SEQ ID NO: 79788 - protein, 8 aa, Dengue virus
KTFVELMK

SEQ ID NO: 79789 - protein, 8 aa, Dengue virus
TFVELMKR

SEQ ID NO: 79790 - protein, 8 aa, Dengue virus
FVELMKRG

SEQ ID NO: 79791 - protein, 8 aa, Dengue virus
VELMKRGD

SEQ ID NO: 79792 - protein, 8 aa, Dengue virus
ELMKRGDL

SEQ ID NO: 79793 - protein, 8 aa, Dengue virus
LMKRGDLP

SEQ ID NO: 79794 - protein, 8 aa, Dengue virus
MKRGDLPV

SEQ ID NO: 79795 - protein, 8 aa, Dengue virus
KRGDLPVW

SEQ ID NO: 79796 - protein, 8 aa, Dengue virus
ASAGISYE

SEQ ID NO: 79797 - protein, 8 aa, Dengue virus
SAGISYED

SEQ ID NO: 79798 - protein, 8 aa, Dengue virus
AGISYEDR

SEQ ID NO: 79799 - protein, 8 aa, Dengue virus
GISYEDRE

SEQ ID NO: 79800 - protein, 8 aa, Dengue virus
ISYEDREW

SEQ ID NO: 79801 - protein, 8 aa, Dengue virus
SYEDREWC

SEQ ID NO: 79802 - protein, 8 aa, Dengue virus
YEDREWCF

SEQ ID NO: 79803 - protein, 8 aa, Dengue virus
EDREWCFT

SEQ ID NO: 79804 - protein, 8 aa, Dengue virus
EKKKLRPK

SEQ ID NO: 79805 - protein, 8 aa, Dengue virus
KKKLRPKW

SEQ ID NO: 79806 - protein, 8 aa, Dengue virus
KKLRPKWL

SEQ ID NO: 79807 - protein, 8 aa, Dengue virus
KLRPKWLD

SEQ ID NO: 79808 - protein, 8 aa, Dengue virus
LRPKWLDA

SEQ ID NO: 79809 - protein, 8 aa, Dengue virus
RPKWLDAR

SEQ ID NO: 79810 - protein, 8 aa, Dengue virus
PKWLDARV

SEQ ID NO: 79811 - protein, 8 aa, Dengue virus
KWLDARVY

SEQ ID NO: 79812 - protein, 8 aa, Dengue virus
DILTEIAT

SEQ ID NO: 79813 - protein, 8 aa, Dengue virus
ILTEIATL

SEQ ID NO: 79814 - protein, 8 aa, Dengue virus
LTEIATLP

SEQ ID NO: 79815 - protein, 8 aa, Dengue virus
TEIATLPT

SEQ ID NO: 79816 - protein, 8 aa, Dengue virus
EIATLPTY

SEQ ID NO: 79817 - protein, 8 aa, Dengue virus
IATLPTYL

SEQ ID NO: 79818 - protein, 8 aa, Dengue virus
ATLPTYLS

SEQ ID NO: 79819 - protein, 8 aa, Dengue virus
TLPTYLSS

SEQ ID NO: 79820 - protein, 8 aa, Dengue virus
LPTYLSSK

SEQ ID NO: 79821 - protein, 8 aa, Dengue virus
PTYLSSKA

SEQ ID NO: 79822 - protein, 8 aa, Dengue virus
TYLSSKAK

SEQ ID NO: 79823 - protein, 8 aa, Dengue virus
YLSSKAKL

SEQ ID NO: 79824 - protein, 8 aa, Dengue virus
LSSKAKLA

SEQ ID NO: 79825 - protein, 8 aa, Dengue virus
SSKAKLAL

SEQ ID NO: 79826 - protein, 8 aa, Dengue virus
SKAKLALD

SEQ ID NO: 79827 - protein, 8 aa, Dengue virus
KAKLALDN

SEQ ID NO: 79828 - protein, 8 aa, Dengue virus
VMLHTTEK

SEQ ID NO: 79829 - protein, 8 aa, Dengue virus
MLHTTEKG

SEQ ID NO: 79830 - protein, 8 aa, Dengue virus
LHTTEKGG

SEQ ID NO: 79831 - protein, 8 aa, Dengue virus
HTTEKGGR

SEQ ID NO: 79832 - protein, 8 aa, Dengue virus
TTEKGGRA

SEQ ID NO: 79833 - protein, 8 aa, Dengue virus
TEKGGRAY

SEQ ID NO: 79834 - protein, 8 aa, Dengue virus
EKGGRAYQ

SEQ ID NO: 79835 - protein, 8 aa, Dengue virus
KGGRAYQH

SEQ ID NO: 79836 - protein, 8 aa, Dengue virus
GGKAYQHA

SEQ ID NO: 79837 - protein, 8 aa, Dengue virus
GKAYQHAL

SEQ ID NO: 79838 - protein, 8 aa, Dengue virus
KAYQHALN

SEQ ID NO: 79839 - protein, 8 aa, Dengue virus
SLETLMLI

SEQ ID NO: 79840 - protein, 8 aa, Dengue virus
LETLMLIA

SEQ ID NO: 79841 - protein, 8 aa, Dengue virus
ETLMLIAL

SEQ ID NO: 79842 - protein, 8 aa, Dengue virus
TLMLIALL

SEQ ID NO: 79843 - protein, 8 aa, Dengue virus
LMLIALLG

SEQ ID NO: 79844 - protein, 8 aa, Dengue virus
MLIALLGA

SEQ ID NO: 79845 - protein, 8 aa, Dengue virus
LIALLGAM

SEQ ID NO: 79846 - protein, 8 aa, Dengue virus
IALLGAMT

SEQ ID NO: 79847 - protein, 8 aa, Dengue virus
LGAMTAGT

SEQ ID NO: 79848 - protein, 8 aa, Dengue virus
GAMTAGTF

SEQ ID NO: 79849 - protein, 8 aa, Dengue virus
AMTAGTFL

SEQ ID NO: 79850 - protein, 8 aa, Dengue virus
MTAGTFLF

SEQ ID NO: 79851 - protein, 8 aa, Dengue virus
TAGTFLFF

SEQ ID NO: 79852 - protein, 8 aa, Dengue virus
AGTFLFFM

SEQ ID NO: 79853 - protein, 8 aa, Dengue virus
GTFLFFMQ

SEQ ID NO: 79854 - protein, 8 aa, Dengue virus
TFLFFMQG

SEQ ID NO: 79855 - protein, 8 aa, Dengue virus
FFMQGKGM

SEQ ID NO: 79856 - protein, 8 aa, Dengue virus
FMQGKGMG

SEQ ID NO: 79857 - protein, 8 aa, Dengue virus
MQGKGMGK

SEQ ID NO: 79858 - protein, 8 aa, Dengue virus
QGKGMGKL

SEQ ID NO: 79859 - protein, 8 aa, Dengue virus
GKGMGKLS

SEQ ID NO: 79860 - protein, 8 aa, Dengue virus
KGIGKLSV

SEQ ID NO: 79861 - protein, 8 aa, Dengue virus
GMGKLSMG

SEQ ID NO: 79862 - protein, 8 aa, Dengue virus
MGKLSMGL

SEQ ID NO: 79863 - protein, 8 aa, Dengue virus
GKLSVGLI

SEQ ID NO: 79864 - protein, 8 aa, Dengue virus
KLSMGLIA

SEQ ID NO: 79865 - protein, 8 aa, Dengue virus
LSMGLIAI

SEQ ID NO: 79866 - protein, 8 aa, Dengue virus
SMGLIAIA

SEQ ID NO: 79867 - protein, 8 aa, Dengue virus
MGLIAIAV

SEQ ID NO: 79868 - protein, 8 aa, Dengue virus
GLIAIAVA

SEQ ID NO: 79869 - protein, 8 aa, Dengue virus
LIAIAVAS

SEQ ID NO: 79870 - protein, 8 aa, Dengue virus
IAIAVASG

SEQ ID NO: 79871 - protein, 8 aa, Dengue virus
AIAVASGL

SEQ ID NO: 79872 - protein, 8 aa, Dengue virus
IAMASGLL

SEQ ID NO: 79873 - protein, 8 aa, Dengue virus
AMASGLLW

SEQ ID NO: 79874 - protein, 8 aa, Dengue virus
MASGLLWI

SEQ ID NO: 79875 - protein, 8 aa, Dengue virus
ASGLLWIA

SEQ ID NO: 79876 - protein, 8 aa, Dengue virus
SGLLWIAE

SEQ ID NO: 79877 - protein, 8 aa, Dengue virus
GLLWIAEI

SEQ ID NO: 79878 - protein, 8 aa, Dengue virus
LLWIAEIQ

SEQ ID NO: 79879 - protein, 8 aa, Dengue virus
LWIAEIQP

SEQ ID NO: 79880 - protein, 8 aa, Dengue virus
WIAEIQPQ

SEQ ID NO: 79881 - protein, 8 aa, Dengue virus
IAEIQPQW

SEQ ID NO: 79882 - protein, 8 aa, Dengue virus
AELQPQWI

SEQ ID NO: 79883 - protein, 8 aa, Dengue virus
ELQPQWIA

SEQ ID NO: 79884 - protein, 8 aa, Dengue virus
LQPQWIAA

SEQ ID NO: 79885 - protein, 8 aa, Dengue virus
FFLMVLLV

SEQ ID NO: 79886 - protein, 8 aa, Dengue virus
FLMVLLVP

SEQ ID NO: 79887 - protein, 8 aa, Dengue virus
LMVLLVPE

SEQ ID NO: 79888 - protein, 8 aa, Dengue virus
MVLLVPEP

SEQ ID NO: 79889 - protein, 8 aa, Dengue virus
VLLVPEPE

SEQ ID NO: 79890 - protein, 8 aa, Dengue virus
LLVPEPEK

SEQ ID NO: 79891 - protein, 8 aa, Dengue virus
LVPEPEKQ

SEQ ID NO: 79892 - protein, 8 aa, Dengue virus
VPEPEKQR

SEQ ID NO: 79893 - protein, 8 aa, Dengue virus
QLIYVILA

SEQ ID NO: 79894 - protein, 8 aa, Dengue virus
LIYVILAI

SEQ ID NO: 79895 - protein, 8 aa, Dengue virus
IYVILAIL

SEQ ID NO: 79896 - protein, 8 aa, Dengue virus
YVILAILT

SEQ ID NO: 79897 - protein, 8 aa, Dengue virus
VILAILTI

SEQ ID NO: 79898 - protein, 8 aa, Dengue virus
ILAILTII

SEQ ID NO: 79899 - protein, 8 aa, Dengue virus
LAILTIIG

SEQ ID NO: 79900 - protein, 8 aa, Dengue virus
AILTIIGL

SEQ ID NO: 79901 - protein, 8 aa, Dengue virus
ILTIIGLV

SEQ ID NO: 79902 - protein, 8 aa, Dengue virus
LTIIGLVA

SEQ ID NO: 79903 - protein, 8 aa, Dengue virus
TIIGLVAA

SEQ ID NO: 79904 - protein, 8 aa, Dengue virus
IIGLVAAN

SEQ ID NO: 79905 - protein, 8 aa, Dengue virus
IGLVAANE

SEQ ID NO: 79906 - protein, 8 aa, Dengue virus
GLVAANEM

SEQ ID NO: 79907 - protein, 8 aa, Dengue virus
LVAANEMG

SEQ ID NO: 79908 - protein, 8 aa, Dengue virus
VAANEMGL

SEQ ID NO: 79909 - protein, 8 aa, Dengue virus
GLIEKTKA

SEQ ID NO: 79910 - protein, 8 aa, Dengue virus
LIEKTKAD

SEQ ID NO: 79911 - protein, 8 aa, Dengue virus
IEKTKADF

SEQ ID NO: 79912 - protein, 8 aa, Dengue virus
EKTKADFG

SEQ ID NO: 79913 - protein, 8 aa, Dengue virus
KTKADFGF

SEQ ID NO: 79914 - protein, 8 aa, Dengue virus
TKADFGFY

SEQ ID NO: 79915 - protein, 8 aa, Dengue virus
KADFGFYQ

SEQ ID NO: 79916 - protein, 8 aa, Dengue virus
TDFGFYQA

SEQ ID NO: 79917 - protein, 8 aa, Dengue virus
DFGFYQAK

SEQ ID NO: 79918 - protein, 8 aa, Dengue virus
FGFYQAKT

SEQ ID NO: 79919 - protein, 8 aa, Dengue virus
GFYQAKTE

SEQ ID NO: 79920 - protein, 8 aa, Dengue virus
FYQAKTET

SEQ ID NO: 79921 - protein, 8 aa, Dengue virus
YQAKTETT

SEQ ID NO: 79922 - protein, 8 aa, Dengue virus
QAKTETTI

SEQ ID NO: 79923 - protein, 8 aa, Dengue virus
AKTETTIL

SEQ ID NO: 79924 - protein, 8 aa, Dengue virus
KAETTILD

SEQ ID NO: 79925 - protein, 8 aa, Dengue virus
AETTILDV

SEQ ID NO: 79926 - protein, 8 aa, Dengue virus
LYAVVTTI

SEQ ID NO: 79927 - protein, 8 aa, Dengue virus
YAVVTTIL

SEQ ID NO: 79928 - protein, 8 aa, Dengue virus
AVVTTILT

SEQ ID NO: 79929 - protein, 8 aa, Dengue virus
VVTTILTP

SEQ ID NO: 79930 - protein, 8 aa, Dengue virus
VTTILTPM

SEQ ID NO: 79931 - protein, 8 aa, Dengue virus
SLAAIANH

SEQ ID NO: 79932 - protein, 8 aa, Dengue virus
LTAIANQA

SEQ ID NO: 79933 - protein, 8 aa, Dengue virus
TAIANQAA

SEQ ID NO: 79934 - protein, 8 aa, Dengue virus
KGWPLHRV

SEQ ID NO: 79935 - protein, 8 aa, Dengue virus
GWPLHRVD

SEQ ID NO: 79936 - protein, 8 aa, Dengue virus
WPLHRVDL

SEQ ID NO: 79937 - protein, 8 aa, Dengue virus
PLHRVDLG

SEQ ID NO: 79938 - protein, 8 aa, Dengue virus
LHRVDLGV

SEQ ID NO: 79939 - protein, 8 aa, Dengue virus
HRVDLGVP

SEQ ID NO: 79940 - protein, 8 aa, Dengue virus
RVDLGVPL

SEQ ID NO: 79941 - protein, 8 aa, Dengue virus
VDLGVPLL

SEQ ID NO: 79942 - protein, 8 aa, Dengue virus
QVNPTTLI

SEQ ID NO: 79943 - protein, 8 aa, Dengue virus
VNPTTLIA

SEQ ID NO: 79944 - protein, 8 aa, Dengue virus
NPTTLIAS

SEQ ID NO: 79945 - protein, 8 aa, Dengue virus
PTTLIASL

SEQ ID NO: 79946 - protein, 8 aa, Dengue virus
TTLIASLV

SEQ ID NO: 79947 - protein, 8 aa, Dengue virus
TLIASLVM

SEQ ID NO: 79948 - protein, 8 aa, Dengue virus
LIASLVML

SEQ ID NO: 79949 - protein, 8 aa, Dengue virus
TASLVMLS

SEQ ID NO: 79950 - protein, 8 aa, Dengue virus
ASLVMLSV

SEQ ID NO: 79951 - protein, 8 aa, Dengue virus
SLVMLSVH

SEQ ID NO: 79952 - protein, 8 aa, Dengue virus
LVMLSVHY

SEQ ID NO: 79953 - protein, 8 aa, Dengue virus
VMLSVHYA

SEQ ID NO: 79954 - protein, 8 aa, Dengue virus
MLSVHYAI

SEQ ID NO: 79955 - protein, 8 aa, Dengue virus
LSVHYAII

SEQ ID NO: 79956 - protein, 8 aa, Dengue virus
SVHYAIIG

SEQ ID NO: 79957 - protein, 8 aa, Dengue virus
VMLLVLCV

SEQ ID NO: 79958 - protein, 8 aa, Dengue virus
MLLVLCVG

SEQ ID NO: 79959 - protein, 8 aa, Dengue virus
LLVLCVGQ

SEQ ID NO: 79960 - protein, 8 aa, Dengue virus
LVLCVGQL

SEQ ID NO: 79961 - protein, 8 aa, Dengue virus
VLCVGQLL

SEQ ID NO: 79962 - protein, 8 aa, Dengue virus
LCVGQLLL

SEQ ID NO: 79963 - protein, 8 aa, Dengue virus
CVGQLLLM

SEQ ID NO: 79964 - protein, 8 aa, Dengue virus
VGQLLLMR

SEQ ID NO: 79965 - protein, 8 aa, Dengue virus
GQLFLMRT

SEQ ID NO: 79966 - protein, 8 aa, Dengue virus
QLFLMRTT

SEQ ID NO: 79967 - protein, 8 aa, Dengue virus
LFLMRTTW

SEQ ID NO: 79968 - protein, 8 aa, Dengue virus
FLMRTTWA

SEQ ID NO: 79969 - protein, 8 aa, Dengue virus
LMRTTWAL

SEQ ID NO: 79970 - protein, 8 aa, Dengue virus
MRTTWALC

SEQ ID NO: 79971 - protein, 8 aa, Dengue virus
RTTWALCE

SEQ ID NO: 79972 - protein, 8 aa, Dengue virus
TTWALCEV

SEQ ID NO: 79973 - protein, 8 aa, Dengue virus
TWALCEVL

SEQ ID NO: 79974 - protein, 8 aa, Dengue virus
WALCEVLT

SEQ ID NO: 79975 - protein, 8 aa, Dengue virus
ALCEVLTL

SEQ ID NO: 79976 - protein, 8 aa, Dengue virus
LCEVLTLA

SEQ ID NO: 79977 - protein, 8 aa, Dengue virus
LTLATGPV

SEQ ID NO: 79978 - protein, 8 aa, Dengue virus
TLATGPIM

SEQ ID NO: 79979 - protein, 8 aa, Dengue virus
LATGPIMT

SEQ ID NO: 79980 - protein, 8 aa, Dengue virus
ATGPIMTL

SEQ ID NO: 79981 - protein, 8 aa, Dengue virus
TGPIMTLW

SEQ ID NO: 79982 - protein, 8 aa, Dengue virus
GPIMTLWE

SEQ ID NO: 79983 - protein, 8 aa, Dengue virus
PIMTLWEG

SEQ ID NO: 79984 - protein, 8 aa, Dengue virus
IMTLWEGN

SEQ ID NO: 79985 - protein, 8 aa, Dengue virus
MTLWEGNP

SEQ ID NO: 79986 - protein, 8 aa, Dengue virus
AFSLIKNV

SEQ ID NO: 79987 - protein, 8 aa, Dengue virus
FSLIKNVQ

SEQ ID NO: 79988 - protein, 8 aa, Dengue virus
SLIKNVQT

SEQ ID NO: 79989 - protein, 8 aa, Dengue virus
LIKNVQTP

SEQ ID NO: 79990 - protein, 8 aa, Dengue virus
IKNVQTPR

SEQ ID NO: 79991 - protein, 8 aa, Dengue virus
KNVQTPRR

SEQ ID NO: 79992 - protein, 8 aa, Dengue virus
NVQTPRRG

SEQ ID NO: 79993 - protein, 8 aa, Dengue virus
VQTPRRGT

SEQ ID NO: 79994 - protein, 8 aa, Dengue virus
TPRRGTGI

SEQ ID NO: 79995 - protein, 8 aa, Dengue virus
PRRGTGTI

SEQ ID NO: 79996 - protein, 8 aa, Dengue virus
RRGTGITG

SEQ ID NO: 79997 - protein, 8 aa, Dengue virus
RGTGTIGE

SEQ ID NO: 79998 - protein, 8 aa, Dengue virus
GTGITGET

SEQ ID NO: 79999 - protein, 8 aa, Dengue virus
TGTIGETL

SEQ ID NO: 80000 - protein, 8 aa, Dengue virus
GITGETLG

SEQ ID NO: 80001 - protein, 8 aa, Dengue virus
ITGETLGE

SEQ ID NO: 80002 - protein, 8 aa, Dengue virus
QLNSLDRR

SEQ ID NO: 80003 - protein, 8 aa, Dengue virus
LNSLDRRE

SEQ ID NO: 80004 - protein, 8 aa, Dengue virus
NSLDRREF

SEQ ID NO: 80005 - protein, 8 aa, Dengue virus
SLDRREFE

SEQ ID NO: 80006 - protein, 8 aa, Dengue virus
LDRREFEE

SEQ ID NO: 80007 - protein, 8 aa, Dengue virus
DRREFEEY

SEQ ID NO: 80008 - protein, 8 aa, Dengue virus
EYKRSGII

SEQ ID NO: 80009 - protein, 8 aa, Dengue virus
YKRSGIIE

SEQ ID NO: 80010 - protein, 8 aa, Dengue virus
KRSGIIEV

SEQ ID NO: 80011 - protein, 8 aa, Dengue virus
RSGIIEVD

SEQ ID NO: 80012 - protein, 8 aa, Dengue virus
SGIIEVDR

SEQ ID NO: 80013 - protein, 8 aa, Dengue virus
GIIEVDRT

SEQ ID NO: 80014 - protein, 8 aa, Dengue virus
IIEVDRTE

SEQ ID NO: 80015 - protein, 8 aa, Dengue virus
IEVDRTEA

SEQ ID NO: 80016 - protein, 8 aa, Dengue virus
TEAKSALR

SEQ ID NO: 80017 - protein, 8 aa, Dengue virus
EAKSALRD

SEQ ID NO: 80018 - protein, 8 aa, Dengue virus
AKSALRDG

SEQ ID NO: 80019 - protein, 8 aa, Dengue virus
KSALRDGS

SEQ ID NO: 80020 - protein, 8 aa, Dengue virus
SALRDGSK

SEQ ID NO: 80021 - protein, 8 aa, Dengue virus
ALRDGSKI

SEQ ID NO: 80022 - protein, 8 aa, Dengue virus
LRDGSKIK

SEQ ID NO: 80023 - protein, 8 aa, Dengue virus
RDGSKIKH

SEQ ID NO: 80024 - protein, 8 aa, Dengue virus
DGSKTKHA

SEQ ID NO: 80025 - protein, 8 aa, Dengue virus
GSKTKHAV

SEQ ID NO: 80026 - protein, 8 aa, Dengue virus
SKTKHAVS

SEQ ID NO: 80027 - protein, 8 aa, Dengue virus
KTKHAVSR

SEQ ID NO: 80028 - protein, 8 aa, Dengue virus
TKHAVSRG

SEQ ID NO: 80029 - protein, 8 aa, Dengue virus
KYAVSRGT

SEQ ID NO: 80030 - protein, 8 aa, Dengue virus
YAVSRGTS

SEQ ID NO: 80031 - protein, 8 aa, Dengue virus
AVSRGTSK

SEQ ID NO: 80032 - protein, 8 aa, Dengue virus
VSRGTSKI

SEQ ID NO: 80033 - protein, 8 aa, Dengue virus
SRGTSKIR

SEQ ID NO: 80034 - protein, 8 aa, Dengue virus
RGTSKIRW

SEQ ID NO: 80035 - protein, 8 aa, Dengue virus
GTSKIRWI

SEQ ID NO: 80036 - protein, 8 aa, Dengue virus
TSKIRWIV

SEQ ID NO: 80037 - protein, 8 aa, Dengue virus
WIVERGMI

SEQ ID NO: 80038 - protein, 8 aa, Dengue virus
IVERGMIK

SEQ ID NO: 80039 - protein, 8 aa, Dengue virus
VERGMIKP

SEQ ID NO: 80040 - protein, 8 aa, Dengue virus
ERGMIKPK

SEQ ID NO: 80041 - protein, 8 aa, Dengue virus
RGMIKPKG

SEQ ID NO: 80042 - protein, 8 aa, Dengue virus
GMIKPKGK

SEQ ID NO: 80043 - protein, 8 aa, Dengue virus
MIKPKGKV

SEQ ID NO: 80044 - protein, 8 aa, Dengue virus
IKPKGKVV

SEQ ID NO: 80045 - protein, 8 aa, Dengue virus
KPKGKVID

SEQ ID NO: 80046 - protein, 8 aa, Dengue virus
PKGKIVDL

SEQ ID NO: 80047 - protein, 8 aa, Dengue virus
KGKVIDLG

SEQ ID NO: 80048 - protein, 8 aa, Dengue virus
GKVIDLGC

SEQ ID NO: 80049 - protein, 8 aa, Dengue virus
KVIDLGCG

SEQ ID NO: 80050 - protein, 8 aa, Dengue virus
IVDLGCGR

SEQ ID NO: 80051 - protein, 8 aa, Dengue virus
LKNVTEVR

SEQ ID NO: 80052 - protein, 8 aa, Dengue virus
KNVTEVRG

SEQ ID NO: 80053 - protein, 8 aa, Dengue virus
NVTEVRGF

SEQ ID NO: 80054 - protein, 8 aa, Dengue virus
VTEVRGFT

SEQ ID NO: 80055 - protein, 8 aa, Dengue virus
TEVRGFTK

SEQ ID NO: 80056 - protein, 8 aa, Dengue virus
EVRGFTKG

SEQ ID NO: 80057 - protein, 8 aa, Dengue virus
VRGFTKGG

SEQ ID NO: 80058 - protein, 8 aa, Dengue virus
RGFTKGGP

SEQ ID NO: 80059 - protein, 8 aa, Dengue virus
GFTKGGPG

SEQ ID NO: 80060 - protein, 8 aa, Dengue virus
FTKGGPGH

SEQ ID NO: 80061 - protein, 8 aa, Dengue virus
SGVDVFYR

SEQ ID NO: 80062 - protein, 8 aa, Dengue virus
GVDVFYRP

SEQ ID NO: 80063 - protein, 8 aa, Dengue virus
VDVFYRPT

SEQ ID NO: 80064 - protein, 8 aa, Dengue virus
DVFYRPTE

SEQ ID NO: 80065 - protein, 8 aa, Dengue virus
VFYRPTEQ

SEQ ID NO: 80066 - protein, 8 aa, Dengue virus
FYRPTEQV

SEQ ID NO: 80067 - protein, 8 aa, Dengue virus
YRPTEQVD

SEQ ID NO: 80068 - protein, 8 aa, Dengue virus
RPTEQVDT

SEQ ID NO: 80069 - protein, 8 aa, Dengue virus
ELEKLQRR

SEQ ID NO: 80070 - protein, 8 aa, Dengue virus
LEKLQRRH

SEQ ID NO: 80071 - protein, 8 aa, Dengue virus
EKLQRRHG

SEQ ID NO: 80072 - protein, 8 aa, Dengue virus
KLQRRHGG

SEQ ID NO: 80073 - protein, 8 aa, Dengue virus
LQRRHGGS

SEQ ID NO: 80074 - protein, 8 aa, Dengue virus
QRRHGGSL

SEQ ID NO: 80075 - protein, 8 aa, Dengue virus
RRHGGSLV

SEQ ID NO: 80076 - protein, 8 aa, Dengue virus
RHGGSLVR

SEQ ID NO: 80077 - protein, 8 aa, Dengue virus
HGGSLVRC

SEQ ID NO: 80078 - protein, 8 aa, Dengue virus
GGSLVRCP

SEQ ID NO: 80079 - protein, 8 aa, Dengue virus
GSLVRCPL

SEQ ID NO: 80080 - protein, 8 aa, Dengue virus
SLVRCPLS

SEQ ID NO: 80081 - protein, 8 aa, Dengue virus
LIRCPLSR

SEQ ID NO: 80082 - protein, 8 aa, Dengue virus
IRCPLSRN

SEQ ID NO: 80083 - protein, 8 aa, Dengue virus
EMYWVSGV

SEQ ID NO: 80084 - protein, 8 aa, Dengue virus
MYWVSGVS

SEQ ID NO: 80085 - protein, 8 aa, Dengue virus
YWVSGVSG

SEQ ID NO: 80086 - protein, 8 aa, Dengue virus
WVSGVSGN

SEQ ID NO: 80087 - protein, 8 aa, Dengue virus
VSGVSGNI

SEQ ID NO: 80088 - protein, 8 aa, Dengue virus
SGVSGNIV

SEQ ID NO: 80089 - protein, 8 aa, Dengue virus
GVSGNIVS

SEQ ID NO: 80090 - protein, 8 aa, Dengue virus
VSGNIVSS

SEQ ID NO: 80091 - protein, 8 aa, Dengue virus
IVSSVNTI

SEQ ID NO: 80092 - protein, 8 aa, Dengue virus
VSSVNTIS

SEQ ID NO: 80093 - protein, 8 aa, Dengue virus
SSVNTISK

SEQ ID NO: 80094 - protein, 8 aa, Dengue virus
SVNTISKM

SEQ ID NO: 80095 - protein, 8 aa, Dengue virus
VNTISKML

SEQ ID NO: 80096 - protein, 8 aa, Dengue virus
NTISKMLL

SEQ ID NO: 80097 - protein, 8 aa, Dengue virus
TISKMLLN

SEQ ID NO: 80098 - protein, 8 aa, Dengue virus
ISKMLLNR

SEQ ID NO: 80099 - protein, 8 aa, Dengue virus
LLNWFTTR

SEQ ID NO: 80100 - protein, 8 aa, Dengue virus
LNRFTTKH

SEQ ID NO: 80101 - protein, 8 aa, Dengue virus
NWFTTRHR

SEQ ID NO: 80102 - protein, 8 aa, Dengue virus
RFTTRHRR

SEQ ID NO: 80103 - protein, 8 aa, Dengue virus
FTTRHRRP

SEQ ID NO: 80104 - protein, 8 aa, Dengue virus
TTKHRKPT

SEQ ID NO: 80105 - protein, 8 aa, Dengue virus
TRHRRPTY

SEQ ID NO: 80106 - protein, 8 aa, Dengue virus
RHRRPTYE

SEQ ID NO: 80107 - protein, 8 aa, Dengue virus
KPTYEKDA

SEQ ID NO: 80108 - protein, 8 aa, Dengue virus
PTYEKDAD

SEQ ID NO: 80109 - protein, 8 aa, Dengue virus
TYEKDADL

SEQ ID NO: 80110 - protein, 8 aa, Dengue virus
YEKDADLG

SEQ ID NO: 80111 - protein, 8 aa, Dengue virus
EKDADLGA

SEQ ID NO: 80112 - protein, 8 aa, Dengue virus
KDADLGAG

SEQ ID NO: 80113 - protein, 8 aa, Dengue virus
DADLGAGT

SEQ ID NO: 80114 - protein, 8 aa, Dengue virus
ADLGAGTR

SEQ ID NO: 80115 - protein, 8 aa, Dengue virus
PENPDMTI

SEQ ID NO: 80116 - protein, 8 aa, Dengue virus
ENPDMTII

SEQ ID NO: 80117 - protein, 8 aa, Dengue virus
KPDMTVIG

SEQ ID NO: 80118 - protein, 8 aa, Dengue virus
GRRLQRLR

SEQ ID NO: 80119 - protein, 8 aa, Dengue virus
RRLQRLRE

SEQ ID NO: 80120 - protein, 8 aa, Dengue virus
RLQRLREE

SEQ ID NO: 80121 - protein, 8 aa, Dengue virus
LQRLREEH

SEQ ID NO: 80122 - protein, 8 aa, Dengue virus
QRLREEHK

SEQ ID NO: 80123 - protein, 8 aa, Dengue virus
RLREEHKE

SEQ ID NO: 80124 - protein, 8 aa, Dengue virus
LREEHKET

SEQ ID NO: 80125 - protein, 8 aa, Dengue virus
REEHKETW

SEQ ID NO: 80126 - protein, 8 aa, Dengue virus
KETWHYDH

SEQ ID NO: 80127 - protein, 8 aa, Dengue virus
ETWHYDHE

SEQ ID NO: 80128 - protein, 8 aa, Dengue virus
TWHYDHEN

SEQ ID NO: 80129 - protein, 8 aa, Dengue virus
WHYDHENP

SEQ ID NO: 80130 - protein, 8 aa, Dengue virus
HYDHENPY

SEQ ID NO: 80131 - protein, 8 aa, Dengue virus
YDHENPYR

SEQ ID NO: 80132 - protein, 8 aa, Dengue virus
DHENPYRT

SEQ ID NO: 80133 - protein, 8 aa, Dengue virus
HENPYRTW

SEQ ID NO: 80134 - protein, 8 aa, Dengue virus
EAPSTGST

SEQ ID NO: 80135 - protein, 8 aa, Dengue virus
ASSTGSAS

SEQ ID NO: 80136 - protein, 8 aa, Dengue virus
SSTGSASS

SEQ ID NO: 80137 - protein, 8 aa, Dengue virus
TGSTSSMV

SEQ ID NO: 80138 - protein, 8 aa, Dengue virus
GSTSSMVN

SEQ ID NO: 80139 - protein, 8 aa, Dengue virus
STSSMVNG

SEQ ID NO: 80140 - protein, 8 aa, Dengue virus
ASSMINGV

SEQ ID NO: 80141 - protein, 8 aa, Dengue virus
LLTKPWDM

SEQ ID NO: 80142 - protein, 8 aa, Dengue virus
LTKPWDVV

SEQ ID NO: 80143 - protein, 8 aa, Dengue virus
TKPWDVVP

SEQ ID NO: 80144 - protein, 8 aa, Dengue virus
KPWDVVPM

SEQ ID NO: 80145 - protein, 8 aa, Dengue virus
PWDVVPMV

SEQ ID NO: 80146 - protein, 8 aa, Dengue virus
WDVVPMVT

SEQ ID NO: 80147 - protein, 8 aa, Dengue virus
DVVPMVTQ

SEQ ID NO: 80148 - protein, 8 aa, Dengue virus
VVPMVTQL

SEQ ID NO: 80149 - protein, 8 aa, Dengue virus
VPMVTQLA

SEQ ID NO: 80150 - protein, 8 aa, Dengue virus
TRTPQPKL

SEQ ID NO: 80151 - protein, 8 aa, Dengue virus
RTPQPKLG

SEQ ID NO: 80152 - protein, 8 aa, Dengue virus
TPQPKLGT

SEQ ID NO: 80153 - protein, 8 aa, Dengue virus
PQPKLGTR

SEQ ID NO: 80154 - protein, 8 aa, Dengue virus
QPKPGTRV

SEQ ID NO: 80155 - protein, 8 aa, Dengue virus
PKPGTRMI

SEQ ID NO: 80156 - protein, 8 aa, Dengue virus
KPGTRMIM

SEQ ID NO: 80157 - protein, 8 aa, Dengue virus
PGTRMIMT

SEQ ID NO: 80158 - protein, 8 aa, Dengue virus
GTRMIMTT

SEQ ID NO: 80159 - protein, 8 aa, Dengue virus
TRMIMTTT

SEQ ID NO: 80160 - protein, 8 aa, Dengue virus
RMIMTTTA

SEQ ID NO: 80161 - protein, 8 aa, Dengue virus
MIMTTTAN

SEQ ID NO: 80162 - protein, 8 aa, Dengue virus
IMTTTANW

SEQ ID NO: 80163 - protein, 8 aa, Dengue virus
TTANWLWT

SEQ ID NO: 80164 - protein, 8 aa, Dengue virus
TANWLWTL

SEQ ID NO: 80165 - protein, 8 aa, Dengue virus
ANWLWTLL

SEQ ID NO: 80166 - protein, 8 aa, Dengue virus
NWLWTLLG

SEQ ID NO: 80167 - protein, 8 aa, Dengue virus
WLWALLGR

SEQ ID NO: 80168 - protein, 8 aa, Dengue virus
LWALLGRK

SEQ ID NO: 80169 - protein, 8 aa, Dengue virus
WALLGRKK

SEQ ID NO: 80170 - protein, 8 aa, Dengue virus
LLGKKKSP

SEQ ID NO: 80171 - protein, 8 aa, Dengue virus
LGKKKSPR

SEQ ID NO: 80172 - protein, 8 aa, Dengue virus
GKKKSPRL

SEQ ID NO: 80173 - protein, 8 aa, Dengue virus
KKKSPRLC

SEQ ID NO: 80174 - protein, 8 aa, Dengue virus
KKSPRLCT

SEQ ID NO: 80175 - protein, 8 aa, Dengue virus
KSPRLCTR

SEQ ID NO: 80176 - protein, 8 aa, Dengue virus
SPRLCTRE

SEQ ID NO: 80177 - protein, 8 aa, Dengue virus
PRLCTKEE

SEQ ID NO: 80178 - protein, 8 aa, Dengue virus
RLCTKEEF

SEQ ID NO: 80179 - protein, 8 aa, Dengue virus
LCTKEEFI

SEQ ID NO: 80180 - protein, 8 aa, Dengue virus
CTKEEFIS

SEQ ID NO: 80181 - protein, 8 aa, Dengue virus
TKEEFISK

SEQ ID NO: 80182 - protein, 8 aa, Dengue virus
KEEFISKV

SEQ ID NO: 80183 - protein, 8 aa, Dengue virus
TSASEAVS

SEQ ID NO: 80184 - protein, 8 aa, Dengue virus
SASEAVSD

SEQ ID NO: 80185 - protein, 8 aa, Dengue virus
ASEAVSDS

SEQ ID NO: 80186 - protein, 8 aa, Dengue virus
SEAVSDSR

SEQ ID NO: 80187 - protein, 8 aa, Dengue virus
EAVSDSRF

SEQ ID NO: 80188 - protein, 8 aa, Dengue virus
AVSDSRFW

SEQ ID NO: 80189 - protein, 8 aa, Dengue virus
VSDSRFWE

SEQ ID NO: 80190 - protein, 8 aa, Dengue virus
SDSRFWEL

SEQ ID NO: 80191 - protein, 8 aa, Dengue virus
ELVDKERT

SEQ ID NO: 80192 - protein, 8 aa, Dengue virus
RTLHQEGK

SEQ ID NO: 80193 - protein, 8 aa, Dengue virus
ALHQEGRC

SEQ ID NO: 80194 - protein, 8 aa, Dengue virus
LNEDHWFS

SEQ ID NO: 80195 - protein, 8 aa, Dengue virus
NEDHWFSR

SEQ ID NO: 80196 - protein, 8 aa, Dengue virus
EDHWFSRE

SEQ ID NO: 80197 - protein, 8 aa, Dengue virus
DHWFSREN

SEQ ID NO: 80198 - protein, 8 aa, Dengue virus
HWFSRENS

SEQ ID NO: 80199 - protein, 8 aa, Dengue virus
WFSRENSW

SEQ ID NO: 80200 - protein, 8 aa, Dengue virus
FSRENSWS

SEQ ID NO: 80201 - protein, 8 aa, Dengue virus
SRENSWSG

SEQ ID NO: 80202 - protein, 8 aa, Dengue virus
RLGYILED

SEQ ID NO: 80203 - protein, 8 aa, Dengue virus
LGYILEDI

SEQ ID NO: 80204 - protein, 8 aa, Dengue virus
GYILEDID

SEQ ID NO: 80205 - protein, 8 aa, Dengue virus
YILEDIDK

SEQ ID NO: 80206 - protein, 8 aa, Dengue virus
ILEDIDKK

SEQ ID NO: 80207 - protein, 8 aa, Dengue virus
LEDIDKKD

SEQ ID NO: 80208 - protein, 8 aa, Dengue virus
EDIDKKDG

SEQ ID NO: 80209 - protein, 8 aa, Dengue virus
DIDKKDGD

SEQ ID NO: 80210 - protein, 8 aa, Dengue virus
IDRKDGDL

SEQ ID NO: 80211 - protein, 8 aa, Dengue virus
DKKDGDLI

SEQ ID NO: 80212 - protein, 8 aa, Dengue virus
KKDGDLIY

SEQ ID NO: 80213 - protein, 8 aa, Dengue virus
KDGDLIYA

SEQ ID NO: 80214 - protein, 8 aa, Dengue virus
DGDLIYAD

SEQ ID NO: 80215 - protein, 8 aa, Dengue virus
GDLIYADD

SEQ ID NO: 80216 - protein, 8 aa, Dengue virus
DLIYADDT

SEQ ID NO: 80217 - protein, 8 aa, Dengue virus
LIYADDTA

SEQ ID NO: 80218 - protein, 8 aa, Dengue virus
IYADDTAG

SEQ ID NO: 80219 - protein, 8 aa, Dengue virus
RITEDDLL

SEQ ID NO: 80220 - protein, 8 aa, Dengue virus
ITEDDLLN

SEQ ID NO: 80221 - protein, 8 aa, Dengue virus
TEDDLLNE

SEQ ID NO: 80222 - protein, 8 aa, Dengue virus
EDDLLNEE

SEQ ID NO: 80223 - protein, 8 aa, Dengue virus
DDLLNEEL

SEQ ID NO: 80224 - protein, 8 aa, Dengue virus
DLLNEELI

SEQ ID NO: 80225 - protein, 8 aa, Dengue virus
LLNEELIT

SEQ ID NO: 80226 - protein, 8 aa, Dengue virus
LNEELITE

SEQ ID NO: 80227 - protein, 8 aa, Dengue virus
VTEQMAPH

SEQ ID NO: 80228 - protein, 8 aa, Dengue virus
EQMAPHHR

SEQ ID NO: 80229 - protein, 8 aa, Dengue virus
QMAPHHKT

SEQ ID NO: 80230 - protein, 8 aa, Dengue virus
MAPHHKTL

SEQ ID NO: 80231 - protein, 8 aa, Dengue virus
APHHKTLA

SEQ ID NO: 80232 - protein, 8 aa, Dengue virus
PHHKTLAK

SEQ ID NO: 80233 - protein, 8 aa, Dengue virus
HHKTLAKA

SEQ ID NO: 80234 - protein, 8 aa, Dengue virus
HKTLAKAI

SEQ ID NO: 80235 - protein, 8 aa, Dengue virus
KTLAKAIF

SEQ ID NO: 80236 - protein, 8 aa, Dengue virus
TLAKAIFK

SEQ ID NO: 80237 - protein, 8 aa, Dengue virus
KVLRPTPK

SEQ ID NO: 80238 - protein, 8 aa, Dengue virus
VLRPTPKG

SEQ ID NO: 80239 - protein, 8 aa, Dengue virus
LRPTPKGA

SEQ ID NO: 80240 - protein, 8 aa, Dengue virus
RPTPKGAV

SEQ ID NO: 80241 - protein, 8 aa, Dengue virus
PTPKGAVM

SEQ ID NO: 80242 - protein, 8 aa, Dengue virus
TPKGAVMD

SEQ ID NO: 80243 - protein, 8 aa, Dengue virus
PKGAVMDI

SEQ ID NO: 80244 - protein, 8 aa, Dengue virus
KGAVMDII

SEQ ID NO: 80245 - protein, 8 aa, Dengue virus
SGQVGTYS

SEQ ID NO: 80246 - protein, 8 aa, Dengue virus
GQVGTYSL

SEQ ID NO: 80247 - protein, 8 aa, Dengue virus
QVGTYSLN

SEQ ID NO: 80248 - protein, 8 aa, Dengue virus
VGTYSLNT

SEQ ID NO: 80249 - protein, 8 aa, Dengue virus
GTYSLNTF

SEQ ID NO: 80250 - protein, 8 aa, Dengue virus
TYSLNTFT

SEQ ID NO: 80251 - protein, 8 aa, Dengue virus
YSLNTFTN

SEQ ID NO: 80252 - protein, 8 aa, Dengue virus
SLNTFTNM

SEQ ID NO: 80253 - protein, 8 aa, Dengue virus
EAEGVITR

SEQ ID NO: 80254 - protein, 8 aa, Dengue virus
AEGVITRD

SEQ ID NO: 80255 - protein, 8 aa, Dengue virus
EGVITRDD

SEQ ID NO: 80256 - protein, 8 aa, Dengue virus
GVITRDDM

SEQ ID NO: 80257 - protein, 8 aa, Dengue virus
VITRDDMH

SEQ ID NO: 80258 - protein, 8 aa, Dengue virus
ITQDDMHN

SEQ ID NO: 80259 - protein, 8 aa, Dengue virus
TRDDMHNP

SEQ ID NO: 80260 - protein, 8 aa, Dengue virus
RDDMHNPK

SEQ ID NO: 80261 - protein, 8 aa, Dengue virus
DDMHNPKG

SEQ ID NO: 80262 - protein, 8 aa, Dengue virus
DMHNPKGL

SEQ ID NO: 80263 - protein, 8 aa, Dengue virus
MHNPKGLK

SEQ ID NO: 80264 - protein, 8 aa, Dengue virus
HNPKGLKE

SEQ ID NO: 80265 - protein, 8 aa, Dengue virus
NPKGLKEK

SEQ ID NO: 80266 - protein, 8 aa, Dengue virus
PKGLRERV

SEQ ID NO: 80267 - protein, 8 aa, Dengue virus
KGLRERVE

SEQ ID NO: 80268 - protein, 8 aa, Dengue virus
GLKERVEN

SEQ ID NO: 80269 - protein, 8 aa, Dengue virus
LKERVENW

SEQ ID NO: 80270 - protein, 8 aa, Dengue virus
KERVENWL

SEQ ID NO: 80271 - protein, 8 aa, Dengue virus
ERVEKWLK

SEQ ID NO: 80272 - protein, 8 aa, Dengue virus
RVEKWLKE

SEQ ID NO: 80273 - protein, 8 aa, Dengue virus
VEKWLKEC

SEQ ID NO: 80274 - protein, 8 aa, Dengue virus
EKWLKECG

SEQ ID NO: 80275 - protein, 8 aa, Dengue virus
KWLKECGV

SEQ ID NO: 80276 - protein, 8 aa, Dengue virus
WLKECGVD

SEQ ID NO: 80277 - protein, 8 aa, Dengue virus
LKECGVDR

SEQ ID NO: 80278 - protein, 8 aa, Dengue virus
KECGVDRL

SEQ ID NO: 80279 - protein, 8 aa, Dengue virus
KPLDERFS

SEQ ID NO: 80280 - protein, 8 aa, Dengue virus
PLDERFST

SEQ ID NO: 80281 - protein, 8 aa, Dengue virus
LDERFSTS

SEQ ID NO: 80282 - protein, 8 aa, Dengue virus
DERFSTSL

SEQ ID NO: 80283 - protein, 8 aa, Dengue virus
ERFSTSLL

SEQ ID NO: 80284 - protein, 8 aa, Dengue virus
RFSTSLLF

SEQ ID NO: 80285 - protein, 8 aa, Dengue virus
FSTSLLFL

SEQ ID NO: 80286 - protein, 8 aa, Dengue virus
STSLLFLN

SEQ ID NO: 80287 - protein, 8 aa, Dengue virus
SHHFHKIL

SEQ ID NO: 80288 - protein, 8 aa, Dengue virus
HHFHRIFM

SEQ ID NO: 80289 - protein, 8 aa, Dengue virus
HFHKILMK

SEQ ID NO: 80290 - protein, 8 aa, Dengue virus
FHKILMKD

SEQ ID NO: 80291 - protein, 8 aa, Dengue virus
HRIFMKDG

SEQ ID NO: 80292 - protein, 8 aa, Dengue virus
KILMKDGR

SEQ ID NO: 80293 - protein, 8 aa, Dengue virus
QGAGWSLK

SEQ ID NO: 80294 - protein, 8 aa, Dengue virus
GAGWSLKE

SEQ ID NO: 80295 - protein, 8 aa, Dengue virus
AGWSLKET

SEQ ID NO: 80296 - protein, 8 aa, Dengue virus
GWSLKETA

SEQ ID NO: 80297 - protein, 8 aa, Dengue virus
WSLKETAC

SEQ ID NO: 80298 - protein, 8 aa, Dengue virus
SLKETACL

SEQ ID NO: 80299 - protein, 8 aa, Dengue virus
LKETACLG

SEQ ID NO: 80300 - protein, 8 aa, Dengue virus
KETACLGK

SEQ ID NO: 80301 - protein, 8 aa, Dengue virus
SAVPTEWL

SEQ ID NO: 80302 - protein, 8 aa, Dengue virus
AVPVEWVP

SEQ ID NO: 80303 - protein, 8 aa, Dengue virus
VPVEWVPT

SEQ ID NO: 80304 - protein, 8 aa, Dengue virus
PTEWLPTS

SEQ ID NO: 80305 - protein, 8 aa, Dengue virus
VEWVPTSR

SEQ ID NO: 80306 - protein, 8 aa, Dengue virus
EWVPTSRT

SEQ ID NO: 80307 - protein, 8 aa, Dengue virus
WVPTSRTT

SEQ ID NO: 80308 - protein, 8 aa, Dengue virus
VPTSRTTW

SEQ ID NO: 80309 - protein, 8 aa, Dengue virus
IEDNPNMT

SEQ ID NO: 80310 - protein, 8 aa, Dengue virus
EDNPNMTD

SEQ ID NO: 80311 - protein, 8 aa, Dengue virus
DNPNMTDK

SEQ ID NO: 80312 - protein, 8 aa, Dengue virus
NPNMTDKT

SEQ ID NO: 80313 - protein, 8 aa, Dengue virus
PNMTDKTP

SEQ ID NO: 80314 - protein, 8 aa, Dengue virus
NMTDKTPV

SEQ ID NO: 80315 - protein, 8 aa, Dengue virus
MTDKTPVH

SEQ ID NO: 80316 - protein, 8 aa, Dengue virus
TDKTPVHS

SEQ ID NO: 80317 - protein, 8 aa, Dengue virus
DKTPIHSW

SEQ ID NO: 80318 - protein, 8 aa, Dengue virus
KTPIHSWE

SEQ ID NO: 80319 - protein, 8 aa, Dengue virus
TPIHSWED

SEQ ID NO: 80320 - protein, 8 aa, Dengue virus
PIHSWEDI

SEQ ID NO: 80321 - protein, 8 aa, Dengue virus
IHSWEDIP

SEQ ID NO: 80322 - protein, 8 aa, Dengue virus
HSWEDVPY

SEQ ID NO: 80323 - protein, 8 aa, Dengue virus
SWEDVPYL

SEQ ID NO: 80324 - protein, 8 aa, Dengue virus
WEDVPYLG

SEQ ID NO: 80325 - protein, 8 aa, Dengue virus
EDVPYLGK

SEQ ID NO: 80326 - protein, 8 aa, Dengue virus
DVPYLGKR

SEQ ID NO: 80327 - protein, 8 aa, Dengue virus
VPYLGKRE

SEQ ID NO: 80328 - protein, 8 aa, Dengue virus
ATWAKNIQ

SEQ ID NO: 80329 - protein, 8 aa, Dengue virus
TWAKNIQT

SEQ ID NO: 80330 - protein, 8 aa, Dengue virus
WAKNIQTA

SEQ ID NO: 80331 - protein, 8 aa, Dengue virus
AKNIQTAI

SEQ ID NO: 80332 - protein, 8 aa, Dengue virus
KNIHTAIA

SEQ ID NO: 80333 - protein, 8 aa, Dengue virus
NIHTAIAQ

SEQ ID NO: 80334 - protein, 8 aa, Dengue virus
IQTAITQV

SEQ ID NO: 80335 - protein, 8 aa, Dengue virus
QTAITQVR

SEQ ID NO: 80336 - protein, 8 aa, Dengue virus
TAIAQVRN

SEQ ID NO: 80337 - protein, 8 aa, Dengue virus
AIAQVRNL

SEQ ID NO: 80338 - protein, 8 aa, Dengue virus
IAQVRNLI

SEQ ID NO: 80339 - protein, 8 aa, Dengue virus
AQVRNLIG

SEQ ID NO: 80340 - protein, 8 aa, Dengue virus
LIGKEEYM

SEQ ID NO: 80341 - protein, 8 aa, Dengue virus
IGKEEYMD

SEQ ID NO: 80342 - protein, 8 aa, Dengue virus
GKEEYADY

SEQ ID NO: 80343 - protein, 8 aa, Dengue virus
KEEYADYM

SEQ ID NO: 80344 - protein, 8 aa, Dengue virus
EEYMDYMP

SEQ ID NO: 80345 - protein, 8 aa, Dengue virus
EYVDYMPA

SEQ ID NO: 80346 - protein, 8 aa, Dengue virus
YVDYMPAM

SEQ ID NO: 80347 - protein, 8 aa, Dengue virus
VDYMPAMK

SEQ ID NO: 80348 - protein, 8 aa, Dengue virus
DYMPAMKR

SEQ ID NO: 80349 - protein, 8 aa, Dengue virus
YMPAMKRY

SEQ ID NO: 80350 - protein, 8 aa, Dengue virus
MPAMKRYS

SEQ ID NO: 80351 - protein, 8 aa, Dengue virus
PAMKRYSA

SEQ ID NO: 80352 - protein, 8 aa, Dengue virus
AMKRYSAP

SEQ ID NO: 80353 - protein, 8 aa, Dengue virus
MKRYSAPF

SEQ ID NO: 80354 - protein, 8 aa, Dengue virus
KRYSAPFE

SEQ ID NO: 80355 - protein, 8 aa, Dengue virus
RYSAPFES

SEQ ID NO: 80356 - protein, 8 aa, Dengue virus
YSAPFESE

SEQ ID NO: 80357 - protein, 8 aa, Dengue virus
SAPFESEG

SEQ ID NO: 80358 - protein, 8 aa, Dengue virus
APFESEGV

SEQ ID NO: 80359 - protein, 8 aa, Dengue virus
PFESEGVL

SEQ ID NO: 80360 - protein, 8 aa, Dengue virus
NNQRKKAR

SEQ ID NO: 80361 - protein, 8 aa, Dengue virus
NQRKKARN

SEQ ID NO: 80362 - protein, 8 aa, Dengue virus
QRKKARNT

SEQ ID NO: 80363 - protein, 8 aa, Dengue virus
RKKARNTP

SEQ ID NO: 80364 - protein, 8 aa, Dengue virus
KKARNTPF

SEQ ID NO: 80365 - protein, 8 aa, Dengue virus
KARNTPFN

SEQ ID NO: 80366 - protein, 8 aa, Dengue virus
ARNTPFNM

SEQ ID NO: 80367 - protein, 8 aa, Dengue virus
RNTPFNML

SEQ ID NO: 80368 - protein, 8 aa, Dengue virus
QLTKRFSL

SEQ ID NO: 80369 - protein, 8 aa, Dengue virus
LTKRFSLG

SEQ ID NO: 80370 - protein, 8 aa, Dengue virus
VKRFSIGL

SEQ ID NO: 80371 - protein, 8 aa, Dengue virus
KRFSLGML

SEQ ID NO: 80372 - protein, 8 aa, Dengue virus
RFSIGLFS

SEQ ID NO: 80373 - protein, 8 aa, Dengue virus
FSIGLFSG

SEQ ID NO: 80374 - protein, 8 aa, Dengue virus
SLGMLQGR

SEQ ID NO: 80375 - protein, 8 aa, Dengue virus
LGMLQGRG

SEQ ID NO: 80376 - protein, 8 aa, Dengue virus
RWGQLKKT

SEQ ID NO: 80377 - protein, 8 aa, Dengue virus
WGQLKKTK

SEQ ID NO: 80378 - protein, 8 aa, Dengue virus
GQLKKTKA

SEQ ID NO: 80379 - protein, 8 aa, Dengue virus
TIKKSKAI

SEQ ID NO: 80380 - protein, 8 aa, Dengue virus
LKKTKAIK

SEQ ID NO: 80381 - protein, 8 aa, Dengue virus
KKTKAIKI

SEQ ID NO: 80382 - protein, 8 aa, Dengue virus
KTKAIKIL

SEQ ID NO: 80383 - protein, 8 aa, Dengue virus
NKAIRILI

SEQ ID NO: 80384 - protein, 8 aa, Dengue virus
KAIRILIG

SEQ ID NO: 80385 - protein, 8 aa, Dengue virus
AIRILIGF

SEQ ID NO: 80386 - protein, 8 aa, Dengue virus
IRILIGFR

SEQ ID NO: 80387 - protein, 8 aa, Dengue virus
RILIGFRK

SEQ ID NO: 80388 - protein, 8 aa, Dengue virus
VLRGFRKE

SEQ ID NO: 80389 - protein, 8 aa, Dengue virus
LRGFRKEI

SEQ ID NO: 80390 - protein, 8 aa, Dengue virus
RGFRKEIG

SEQ ID NO: 80391 - protein, 8 aa, Dengue virus
LNILNRRK

SEQ ID NO: 80392 - protein, 8 aa, Dengue virus
NILNRRKR

SEQ ID NO: 80393 - protein, 8 aa, Dengue virus
ILNGRRRS

SEQ ID NO: 80394 - protein, 8 aa, Dengue virus
LNRRKRST

SEQ ID NO: 80395 - protein, 8 aa, Dengue virus
RRRSTMTL

SEQ ID NO: 80396 - protein, 8 aa, Dengue virus
RRSTMTLL

SEQ ID NO: 80397 - protein, 8 aa, Dengue virus
RSTVTLLC

SEQ ID NO: 80398 - protein, 8 aa, Dengue virus
STVTLLCL

SEQ ID NO: 80399 - protein, 8 aa, Dengue virus
TVTLLCLI

SEQ ID NO: 80400 - protein, 8 aa, Dengue virus
VTLLCLIP

SEQ ID NO: 80401 - protein, 8 aa, Dengue virus
LLCLIPTI

SEQ ID NO: 80402 - protein, 8 aa, Dengue virus
LCLIPTIM

SEQ ID NO: 80403 - protein, 8 aa, Dengue virus
CLIPTIMA

SEQ ID NO: 80404 - protein, 8 aa, Dengue virus
LIPTIMAF

SEQ ID NO: 80405 - protein, 8 aa, Dengue virus
IPTVMAFS

SEQ ID NO: 80406 - protein, 8 aa, Dengue virus
PTVMAFSL

SEQ ID NO: 80407 - protein, 8 aa, Dengue virus
TVMAFSLS

SEQ ID NO: 80408 - protein, 8 aa, Dengue virus
VMAFSLST

SEQ ID NO: 80409 - protein, 8 aa, Dengue virus
MAFHLTTR

SEQ ID NO: 80410 - protein, 8 aa, Dengue virus
AFHLTTRN

SEQ ID NO: 80411 - protein, 8 aa, Dengue virus
FHLTTRNG

SEQ ID NO: 80412 - protein, 8 aa, Dengue virus
HLTTRNGE

SEQ ID NO: 80413 - protein, 8 aa, Dengue virus
EPLMIVGK

SEQ ID NO: 80414 - protein, 8 aa, Dengue virus
PLMIVARH

SEQ ID NO: 80415 - protein, 8 aa, Dengue virus
LMIVARHE

SEQ ID NO: 80416 - protein, 8 aa, Dengue virus
MIVARHER

SEQ ID NO: 80417 - protein, 8 aa, Dengue virus
IVGKHERG

SEQ ID NO: 80418 - protein, 8 aa, Dengue virus
VGKHERGR

SEQ ID NO: 80419 - protein, 8 aa, Dengue virus
GKHERGRP

SEQ ID NO: 80420 - protein, 8 aa, Dengue virus
KTTEGTNK

SEQ ID NO: 80421 - protein, 8 aa, Dengue virus
TTEGTNKC

SEQ ID NO: 80422 - protein, 8 aa, Dengue virus
TEGTNKCT

SEQ ID NO: 80423 - protein, 8 aa, Dengue virus
EGINRCTL

SEQ ID NO: 80424 - protein, 8 aa, Dengue virus
GINRCTLI

SEQ ID NO: 80425 - protein, 8 aa, Dengue virus
TNKCTLIA

SEQ ID NO: 80426 - protein, 8 aa, Dengue virus
CEDTITYK

SEQ ID NO: 80427 - protein, 8 aa, Dengue virus
EDTVTYEC

SEQ ID NO: 80428 - protein, 8 aa, Dengue virus
DTVTYECP

SEQ ID NO: 80429 - protein, 8 aa, Dengue virus
TITYKCPL

SEQ ID NO: 80430 - protein, 8 aa, Dengue virus
VTYECPLL

SEQ ID NO: 80431 - protein, 8 aa, Dengue virus
TYECPLLV

SEQ ID NO: 80432 - protein, 8 aa, Dengue virus
YECPLLVN

SEQ ID NO: 80433 - protein, 8 aa, Dengue virus
KCPLLRQN

SEQ ID NO: 80434 - protein, 8 aa, Dengue virus
CPLLRQNE

SEQ ID NO: 80435 - protein, 8 aa, Dengue virus
PLLRQNEP

SEQ ID NO: 80436 - protein, 8 aa, Dengue virus
LLRQNEPE

SEQ ID NO: 80437 - protein, 8 aa, Dengue virus
LRQNEPED

SEQ ID NO: 80438 - protein, 8 aa, Dengue virus
RQNEPEDI

SEQ ID NO: 80439 - protein, 8 aa, Dengue virus
CWCNSTST

SEQ ID NO: 80440 - protein, 8 aa, Dengue virus
WCNSTSTW

SEQ ID NO: 80441 - protein, 8 aa, Dengue virus
CNSTSTWV

SEQ ID NO: 80442 - protein, 8 aa, Dengue virus
NSTSTWVT

SEQ ID NO: 80443 - protein, 8 aa, Dengue virus
STSTWVTY

SEQ ID NO: 80444 - protein, 8 aa, Dengue virus
TSTWVTYG

SEQ ID NO: 80445 - protein, 8 aa, Dengue virus
STWVTYGT

SEQ ID NO: 80446 - protein, 8 aa, Dengue virus
TWVTYGTC

SEQ ID NO: 80447 - protein, 8 aa, Dengue virus
TYGTCTTT

SEQ ID NO: 80448 - protein, 8 aa, Dengue virus
YGTCTTTG

SEQ ID NO: 80449 - protein, 8 aa, Dengue virus
GTCTTTGE

SEQ ID NO: 80450 - protein, 8 aa, Dengue virus
TCTTTGEH

SEQ ID NO: 80451 - protein, 8 aa, Dengue virus
CTTTGEHR

SEQ ID NO: 80452 - protein, 8 aa, Dengue virus
TTTGEHRR

SEQ ID NO: 80453 - protein, 8 aa, Dengue virus
TTGEHRRE

SEQ ID NO: 80454 - protein, 8 aa, Dengue virus
TGEHRREK

SEQ ID NO: 80455 - protein, 8 aa, Dengue virus
AAILAYTI

SEQ ID NO: 80456 - protein, 8 aa, Dengue virus
GFMAYMVG

SEQ ID NO: 80457 - protein, 8 aa, Dengue virus
ILAYTIGT

SEQ ID NO: 80458 - protein, 8 aa, Dengue virus
LAYTIGTT

SEQ ID NO: 80459 - protein, 8 aa, Dengue virus
AYTIGTTH

SEQ ID NO: 80460 - protein, 8 aa, Dengue virus
YTIGTTHF

SEQ ID NO: 80461 - protein, 8 aa, Dengue virus
MVGQTGIQ

SEQ ID NO: 80462 - protein, 8 aa, Dengue virus
VGQTGIQR

SEQ ID NO: 80463 - protein, 8 aa, Dengue virus
GQTRIQRT

SEQ ID NO: 80464 - protein, 8 aa, Dengue virus
QTGIQRAV

SEQ ID NO: 80465 - protein, 8 aa, Dengue virus
TGIQRAVF

SEQ ID NO: 80466 - protein, 8 aa, Dengue virus
RIQRTVFF

SEQ ID NO: 80467 - protein, 8 aa, Dengue virus
FQRALIFI

SEQ ID NO: 80468 - protein, 8 aa, Dengue virus
QRALIFIL

SEQ ID NO: 80469 - protein, 8 aa, Dengue virus
RALIFILL

SEQ ID NO: 80470 - protein, 8 aa, Dengue virus
ALIFILLT

SEQ ID NO: 80471 - protein, 8 aa, Dengue virus
LIFILLTA

SEQ ID NO: 80472 - protein, 8 aa, Dengue virus
IFILLTAV

SEQ ID NO: 80473 - protein, 8 aa, Dengue virus
FILLTAVA

SEQ ID NO: 80474 - protein, 8 aa, Dengue virus
ILLTAVAP

SEQ ID NO: 80475 - protein, 8 aa, Dengue virus
PSMTMRCI

SEQ ID NO: 80476 - protein, 8 aa, Dengue virus
SMTMRCIG

SEQ ID NO: 80477 - protein, 8 aa, Dengue virus
MTMRCIGI

SEQ ID NO: 80478 - protein, 8 aa, Dengue virus
GMRCIGVG

SEQ ID NO: 80479 - protein, 8 aa, Dengue virus
MRCIGVGN

SEQ ID NO: 80480 - protein, 8 aa, Dengue virus
RCIGVGNR

SEQ ID NO: 80481 - protein, 8 aa, Dengue virus
CIGISNRD

SEQ ID NO: 80482 - protein, 8 aa, Dengue virus
IGVGNRDF

SEQ ID NO: 80483 - protein, 8 aa, Dengue virus
VEGVSGGV

SEQ ID NO: 80484 - protein, 8 aa, Dengue virus
EGVSGGTW

SEQ ID NO: 80485 - protein, 8 aa, Dengue virus
GVSGGTWV

SEQ ID NO: 80486 - protein, 8 aa, Dengue virus
VSGGVWVD

SEQ ID NO: 80487 - protein, 8 aa, Dengue virus
SGGTWVDL

SEQ ID NO: 80488 - protein, 8 aa, Dengue virus
GGTWVDLV

SEQ ID NO: 80489 - protein, 8 aa, Dengue virus
GVWVDLVL

SEQ ID NO: 80490 - protein, 8 aa, Dengue virus
TWVDLVLE

SEQ ID NO: 80491 - protein, 8 aa, Dengue virus
DFELIKTE

SEQ ID NO: 80492 - protein, 8 aa, Dengue virus
FELIKTEA

SEQ ID NO: 80493 - protein, 8 aa, Dengue virus
ELIKTEAK

SEQ ID NO: 80494 - protein, 8 aa, Dengue virus
LIKTEAKQ

SEQ ID NO: 80495 - protein, 8 aa, Dengue virus
IKTEAKQP

SEQ ID NO: 80496 - protein, 8 aa, Dengue virus
RKYCIEAK

SEQ ID NO: 80497 - protein, 8 aa, Dengue virus
KYCIEAKL

SEQ ID NO: 80498 - protein, 8 aa, Dengue virus
YCIEAKLT

SEQ ID NO: 80499 - protein, 8 aa, Dengue virus
CIEAKLTN

SEQ ID NO: 80500 - protein, 8 aa, Dengue virus
IEAKLTNT

SEQ ID NO: 80501 - protein, 8 aa, Dengue virus
EAKLTNTT

SEQ ID NO: 80502 - protein, 8 aa, Dengue virus
AKLTNTTT

SEQ ID NO: 80503 - protein, 8 aa, Dengue virus
KLTNTTTE

SEQ ID NO: 80504 - protein, 8 aa, Dengue virus
RQYICRRD

SEQ ID NO: 80505 - protein, 8 aa, Dengue virus
QYICRRDM

SEQ ID NO: 80506 - protein, 8 aa, Dengue virus
FVCKHSMV

SEQ ID NO: 80507 - protein, 8 aa, Dengue virus
ICRRDMVD

SEQ ID NO: 80508 - protein, 8 aa, Dengue virus
CKHSMVDR

SEQ ID NO: 80509 - protein, 8 aa, Dengue virus
RRDMVDRG

SEQ ID NO: 80510 - protein, 8 aa, Dengue virus
HSMVDRGW

SEQ ID NO: 80511 - protein, 8 aa, Dengue virus
DMVDRGWG

SEQ ID NO: 80512 - protein, 8 aa, Dengue virus
IVTCAMFT

SEQ ID NO: 80513 - protein, 8 aa, Dengue virus
VTCAMFTC

SEQ ID NO: 80514 - protein, 8 aa, Dengue virus
TCAMFTCK

SEQ ID NO: 80515 - protein, 8 aa, Dengue virus
CAMFTCKK

SEQ ID NO: 80516 - protein, 8 aa, Dengue virus
AMFTCKKN

SEQ ID NO: 80517 - protein, 8 aa, Dengue virus
MFTCKKNM

SEQ ID NO: 80518 - protein, 8 aa, Dengue virus
FTCKKNME

SEQ ID NO: 80519 - protein, 8 aa, Dengue virus
TCKKNMEG

SEQ ID NO: 80520 - protein, 8 aa, Dengue virus
THAVGNDI

SEQ ID NO: 80521 - protein, 8 aa, Dengue virus
HAVGNDIP

SEQ ID NO: 80522 - protein, 8 aa, Dengue virus
AVGNDTGK

SEQ ID NO: 80523 - protein, 8 aa, Dengue virus
VGNDIPNH

SEQ ID NO: 80524 - protein, 8 aa, Dengue virus
GNDTGKHG

SEQ ID NO: 80525 - protein, 8 aa, Dengue virus
NDTGKHGK

SEQ ID NO: 80526 - protein, 8 aa, Dengue virus
DIPNHGVT

SEQ ID NO: 80527 - protein, 8 aa, Dengue virus
IPNHGVTA

SEQ ID NO: 80528 - protein, 8 aa, Dengue virus
SNHGVTTT

SEQ ID NO: 80529 - protein, 8 aa, Dengue virus
NHGVTTTI

SEQ ID NO: 80530 - protein, 8 aa, Dengue virus
HGVTTTIT

SEQ ID NO: 80531 - protein, 8 aa, Dengue virus
GVTTTITP

SEQ ID NO: 80532 - protein, 8 aa, Dengue virus
VTTTITPR

SEQ ID NO: 80533 - protein, 8 aa, Dengue virus
TTTITPRS

SEQ ID NO: 80534 - protein, 8 aa, Dengue virus
TTITPRSP

SEQ ID NO: 80535 - protein, 8 aa, Dengue virus
TITPRTPS

SEQ ID NO: 80536 - protein, 8 aa, Dengue virus
ITPQSSIT

SEQ ID NO: 80537 - protein, 8 aa, Dengue virus
TPQSSITE

SEQ ID NO: 80538 - protein, 8 aa, Dengue virus
PRTPSVEV

SEQ ID NO: 80539 - protein, 8 aa, Dengue virus
QSSITEAE

SEQ ID NO: 80540 - protein, 8 aa, Dengue virus
SSITEAEL

SEQ ID NO: 80541 - protein, 8 aa, Dengue virus
SITEAELT

SEQ ID NO: 80542 - protein, 8 aa, Dengue virus
SVEVELPD

SEQ ID NO: 80543 - protein, 8 aa, Dengue virus
TEAELTGY

SEQ ID NO: 80544 - protein, 8 aa, Dengue virus
EAELTGYG

SEQ ID NO: 80545 - protein, 8 aa, Dengue virus
VELPDYGE

SEQ ID NO: 80546 - protein, 8 aa, Dengue virus
ELPDYGEL

SEQ ID NO: 80547 - protein, 8 aa, Dengue virus
LPDYGELS

SEQ ID NO: 80548 - protein, 8 aa, Dengue virus
PDYGELSL

SEQ ID NO: 80549 - protein, 8 aa, Dengue virus
DYGELSLD

SEQ ID NO: 80550 - protein, 8 aa, Dengue virus
YGELSLDC

SEQ ID NO: 80551 - protein, 8 aa, Dengue virus
GTVTMECS

SEQ ID NO: 80552 - protein, 8 aa, Dengue virus
ELSLDCEP

SEQ ID NO: 80553 - protein, 8 aa, Dengue virus
VTMECSPR

SEQ ID NO: 80554 - protein, 8 aa, Dengue virus
SLDCEPRS

SEQ ID NO: 80555 - protein, 8 aa, Dengue virus
FNEMILMR

SEQ ID NO: 80556 - protein, 8 aa, Dengue virus
NEMVLLQM

SEQ ID NO: 80557 - protein, 8 aa, Dengue virus
EMILMEMK

SEQ ID NO: 80558 - protein, 8 aa, Dengue virus
MEKKTWLV

SEQ ID NO: 80559 - protein, 8 aa, Dengue virus
KTKTWLVH

SEQ ID NO: 80560 - protein, 8 aa, Dengue virus
NKAWLVHR

SEQ ID NO: 80561 - protein, 8 aa, Dengue virus
LDLPLPWL

SEQ ID NO: 80562 - protein, 8 aa, Dengue virus
DLPLPWAA

SEQ ID NO: 80563 - protein, 8 aa, Dengue virus
LPLPWAAG

SEQ ID NO: 80564 - protein, 8 aa, Dengue virus
PLPWAAGA

SEQ ID NO: 80565 - protein, 8 aa, Dengue virus
LPWAAGAD

SEQ ID NO: 80566 - protein, 8 aa, Dengue virus
PWAAGADT

SEQ ID NO: 80567 - protein, 8 aa, Dengue virus
WAAGADTS

SEQ ID NO: 80568 - protein, 8 aa, Dengue virus
AAGADTSE

SEQ ID NO: 80569 - protein, 8 aa, Dengue virus
AGADTLEV

SEQ ID NO: 80570 - protein, 8 aa, Dengue virus
GADTLEVH

SEQ ID NO: 80571 - protein, 8 aa, Dengue virus
ADTQGSNW

SEQ ID NO: 80572 - protein, 8 aa, Dengue virus
DTQGSNWI

SEQ ID NO: 80573 - protein, 8 aa, Dengue virus
TQGSNWIQ

SEQ ID NO: 80574 - protein, 8 aa, Dengue virus
LEVHWNHK

SEQ ID NO: 80575 - protein, 8 aa, Dengue virus
GSNWIQKE

SEQ ID NO: 80576 - protein, 8 aa, Dengue virus
SNWIQKET

SEQ ID NO: 80577 - protein, 8 aa, Dengue virus
NWIQKETL

SEQ ID NO: 80578 - protein, 8 aa, Dengue virus
WIQKETLV

SEQ ID NO: 80579 - protein, 8 aa, Dengue virus
IQKETLVT

SEQ ID NO: 80580 - protein, 8 aa, Dengue virus
QKETLVTF

SEQ ID NO: 80581 - protein, 8 aa, Dengue virus
GAMHTALT

SEQ ID NO: 80582 - protein, 8 aa, Dengue virus
AMHTALTG

SEQ ID NO: 80583 - protein, 8 aa, Dengue virus
MHTALTGA

SEQ ID NO: 80584 - protein, 8 aa, Dengue virus
HTALTGAT

SEQ ID NO: 80585 - protein, 8 aa, Dengue virus
TALTGATE

SEQ ID NO: 80586 - protein, 8 aa, Dengue virus
ALTGATEI

SEQ ID NO: 80587 - protein, 8 aa, Dengue virus
LTGATEIQ

SEQ ID NO: 80588 - protein, 8 aa, Dengue virus
TGATEIQM

SEQ ID NO: 80589 - protein, 8 aa, Dengue virus
KCKVRMER

SEQ ID NO: 80590 - protein, 8 aa, Dengue virus
CKVRMERL

SEQ ID NO: 80591 - protein, 8 aa, Dengue virus
KIRMEKLR

SEQ ID NO: 80592 - protein, 8 aa, Dengue virus
IRMEKLRI

SEQ ID NO: 80593 - protein, 8 aa, Dengue virus
EKLRIKGI

SEQ ID NO: 80594 - protein, 8 aa, Dengue virus
RLRIKGMS

SEQ ID NO: 80595 - protein, 8 aa, Dengue virus
TGKFKVVK

SEQ ID NO: 80596 - protein, 8 aa, Dengue virus
GKFKVVKE

SEQ ID NO: 80597 - protein, 8 aa, Dengue virus
KFSIDREM

SEQ ID NO: 80598 - protein, 8 aa, Dengue virus
FSIDREMA

SEQ ID NO: 80599 - protein, 8 aa, Dengue virus
SIDREMAE

SEQ ID NO: 80600 - protein, 8 aa, Dengue virus
IDREMAET

SEQ ID NO: 80601 - protein, 8 aa, Dengue virus
DREMAETQ

SEQ ID NO: 80602 - protein, 8 aa, Dengue virus
REMAETQH

SEQ ID NO: 80603 - protein, 8 aa, Dengue virus
TQHGTAVV

SEQ ID NO: 80604 - protein, 8 aa, Dengue virus
QHGTAVVK

SEQ ID NO: 80605 - protein, 8 aa, Dengue virus
HGTTVIKV

SEQ ID NO: 80606 - protein, 8 aa, Dengue virus
GTAVVKVK

SEQ ID NO: 80607 - protein, 8 aa, Dengue virus
TTVIKVKY

SEQ ID NO: 80608 - protein, 8 aa, Dengue virus
TVIKVKYE

SEQ ID NO: 80609 - protein, 8 aa, Dengue virus
IRVQYEGD

SEQ ID NO: 80610 - protein, 8 aa, Dengue virus
RVQYEGDG

SEQ ID NO: 80611 - protein, 8 aa, Dengue virus
VQYEGDGS

SEQ ID NO: 80612 - protein, 8 aa, Dengue virus
QYEGDGSP

SEQ ID NO: 80613 - protein, 8 aa, Dengue virus
YEGDGSPC

SEQ ID NO: 80614 - protein, 8 aa, Dengue virus
EGDGSPCK

SEQ ID NO: 80615 - protein, 8 aa, Dengue virus
GDGSPCKI

SEQ ID NO: 80616 - protein, 8 aa, Dengue virus
AGAPCKIP

SEQ ID NO: 80617 - protein, 8 aa, Dengue virus
GSPCKIPF

SEQ ID NO: 80618 - protein, 8 aa, Dengue virus
SPCKIPFE

SEQ ID NO: 80619 - protein, 8 aa, Dengue virus
PCKIPFEI

SEQ ID NO: 80620 - protein, 8 aa, Dengue virus
CKIPFEIM

SEQ ID NO: 80621 - protein, 8 aa, Dengue virus
KIPIEIRD

SEQ ID NO: 80622 - protein, 8 aa, Dengue virus
IPFEIMDL

SEQ ID NO: 80623 - protein, 8 aa, Dengue virus
EIMDLEKR

SEQ ID NO: 80624 - protein, 8 aa, Dengue virus
IMDLEKRH

SEQ ID NO: 80625 - protein, 8 aa, Dengue virus
MDLEKRHV

SEQ ID NO: 80626 - protein, 8 aa, Dengue virus
DLEKRHVL

SEQ ID NO: 80627 - protein, 8 aa, Dengue virus
LEKRHVLG

SEQ ID NO: 80628 - protein, 8 aa, Dengue virus
NKEKVIGR

SEQ ID NO: 80629 - protein, 8 aa, Dengue virus
HVLGRLIT

SEQ ID NO: 80630 - protein, 8 aa, Dengue virus
VVGRVISA

SEQ ID NO: 80631 - protein, 8 aa, Dengue virus
GRVISATP

SEQ ID NO: 80632 - protein, 8 aa, Dengue virus
ISSTPFAE

SEQ ID NO: 80633 - protein, 8 aa, Dengue virus
PFAESTNS

SEQ ID NO: 80634 - protein, 8 aa, Dengue virus
AESTNSVT

SEQ ID NO: 80635 - protein, 8 aa, Dengue virus
ESTNSVTN

SEQ ID NO: 80636 - protein, 8 aa, Dengue virus
NTNSATNI

SEQ ID NO: 80637 - protein, 8 aa, Dengue virus
KDSPVNIE

SEQ ID NO: 80638 - protein, 8 aa, Dengue virus
DSPVNIEA

SEQ ID NO: 80639 - protein, 8 aa, Dengue virus
SPVNIEAE

SEQ ID NO: 80640 - protein, 8 aa, Dengue virus
PVNIEAEP

SEQ ID NO: 80641 - protein, 8 aa, Dengue virus
PFGDSYIM

SEQ ID NO: 80642 - protein, 8 aa, Dengue virus
FGDSYIMI

SEQ ID NO: 80643 - protein, 8 aa, Dengue virus
GDSYIMIG

SEQ ID NO: 80644 - protein, 8 aa, Dengue virus
DSYIMIGV

SEQ ID NO: 80645 - protein, 8 aa, Dengue virus
SYIMIGVG

SEQ ID NO: 80646 - protein, 8 aa, Dengue virus
YIIIGVEP

SEQ ID NO: 80647 - protein, 8 aa, Dengue virus
IIIGVEPG

SEQ ID NO: 80648 - protein, 8 aa, Dengue virus
IIGVEPGQ

SEQ ID NO: 80649 - protein, 8 aa, Dengue virus
IGVEPGQL

SEQ ID NO: 80650 - protein, 8 aa, Dengue virus
GVEPGQLK

SEQ ID NO: 80651 - protein, 8 aa, Dengue virus
VEPGQLKL

SEQ ID NO: 80652 - protein, 8 aa, Dengue virus
EPGQLKLN

SEQ ID NO: 80653 - protein, 8 aa, Dengue virus
PGQLKLNW

SEQ ID NO: 80654 - protein, 8 aa, Dengue virus
GSSIGQMF

SEQ ID NO: 80655 - protein, 8 aa, Dengue virus
SSIGQMFE

SEQ ID NO: 80656 - protein, 8 aa, Dengue virus
SIGKMLES

SEQ ID NO: 80657 - protein, 8 aa, Dengue virus
IGKMLEST

SEQ ID NO: 80658 - protein, 8 aa, Dengue virus
GQMFETTM

SEQ ID NO: 80659 - protein, 8 aa, Dengue virus
QMFETTMR

SEQ ID NO: 80660 - protein, 8 aa, Dengue virus
MLESTYRG

SEQ ID NO: 80661 - protein, 8 aa, Dengue virus
LESTYRGA

SEQ ID NO: 80662 - protein, 8 aa, Dengue virus
FGSLGGVF

SEQ ID NO: 80663 - protein, 8 aa, Dengue virus
GSLGGVFT

SEQ ID NO: 80664 - protein, 8 aa, Dengue virus
SLGGVFTS

SEQ ID NO: 80665 - protein, 8 aa, Dengue virus
LGGVFTSI

SEQ ID NO: 80666 - protein, 8 aa, Dengue virus
GGVFTSIG

SEQ ID NO: 80667 - protein, 8 aa, Dengue virus
GVFTSIGK

SEQ ID NO: 80668 - protein, 8 aa, Dengue virus
VFTSIGKA

SEQ ID NO: 80669 - protein, 8 aa, Dengue virus
FTSIGKAL

SEQ ID NO: 80670 - protein, 8 aa, Dengue virus
LGKAVHQI

SEQ ID NO: 80671 - protein, 8 aa, Dengue virus
GKAVHQIF

SEQ ID NO: 80672 - protein, 8 aa, Dengue virus
KAVHQIFG

SEQ ID NO: 80673 - protein, 8 aa, Dengue virus
AVHQIFGS

SEQ ID NO: 80674 - protein, 8 aa, Dengue virus
VHQIFGSV

SEQ ID NO: 80675 - protein, 8 aa, Dengue virus
HQVFGAIY

SEQ ID NO: 80676 - protein, 8 aa, Dengue virus
QIFGSVYT

SEQ ID NO: 80677 - protein, 8 aa, Dengue virus
IFGSVYTT

SEQ ID NO: 80678 - protein, 8 aa, Dengue virus
FSGVSWTM

SEQ ID NO: 80679 - protein, 8 aa, Dengue virus
SGVSWTMK

SEQ ID NO: 80680 - protein, 8 aa, Dengue virus
GVSWTMKI

SEQ ID NO: 80681 - protein, 8 aa, Dengue virus
VSWTMKIL

SEQ ID NO: 80682 - protein, 8 aa, Dengue virus
SWTMKILI

SEQ ID NO: 80683 - protein, 8 aa, Dengue virus
WTMKILIG

SEQ ID NO: 80684 - protein, 8 aa, Dengue virus
VRILIGLL

SEQ ID NO: 80685 - protein, 8 aa, Dengue virus
KILIGVII

SEQ ID NO: 80686 - protein, 8 aa, Dengue virus
ILIGVIIT

SEQ ID NO: 80687 - protein, 8 aa, Dengue virus
LIGVIITW

SEQ ID NO: 80688 - protein, 8 aa, Dengue virus
IGVIITWI

SEQ ID NO: 80689 - protein, 8 aa, Dengue virus
GVIITWIG

SEQ ID NO: 80690 - protein, 8 aa, Dengue virus
VIITWIGM

SEQ ID NO: 80691 - protein, 8 aa, Dengue virus
GMNSRNTS

SEQ ID NO: 80692 - protein, 8 aa, Dengue virus
TNSRNTPM

SEQ ID NO: 80693 - protein, 8 aa, Dengue virus
RNTPMAMT

SEQ ID NO: 80694 - protein, 8 aa, Dengue virus
NTPMAMTC

SEQ ID NO: 80695 - protein, 8 aa, Dengue virus
TPMAMTCI

SEQ ID NO: 80696 - protein, 8 aa, Dengue virus
PMAMTCIA

SEQ ID NO: 80697 - protein, 8 aa, Dengue virus
GFTVHADT

SEQ ID NO: 80698 - protein, 8 aa, Dengue virus
FTVHADTG

SEQ ID NO: 80699 - protein, 8 aa, Dengue virus
TVHADTGC

SEQ ID NO: 80700 - protein, 8 aa, Dengue virus
ADTGCAVS

SEQ ID NO: 80701 - protein, 8 aa, Dengue virus
DTGCAVSW

SEQ ID NO: 80702 - protein, 8 aa, Dengue virus
GCVASWSG

SEQ ID NO: 80703 - protein, 8 aa, Dengue virus
SWNGKELK

SEQ ID NO: 80704 - protein, 8 aa, Dengue virus
WNGKELKC

SEQ ID NO: 80705 - protein, 8 aa, Dengue virus
NGKELKCG

SEQ ID NO: 80706 - protein, 8 aa, Dengue virus
CGSGIFVT

SEQ ID NO: 80707 - protein, 8 aa, Dengue virus
GSGIFVTD

SEQ ID NO: 80708 - protein, 8 aa, Dengue virus
SGIFVTDN

SEQ ID NO: 80709 - protein, 8 aa, Dengue virus
GIFVADNV

SEQ ID NO: 80710 - protein, 8 aa, Dengue virus
IFVTDNVH

SEQ ID NO: 80711 - protein, 8 aa, Dengue virus
FVADNVHT

SEQ ID NO: 80712 - protein, 8 aa, Dengue virus
VTDNVHTW

SEQ ID NO: 80713 - protein, 8 aa, Dengue virus
ADNVHTWT

SEQ ID NO: 80714 - protein, 8 aa, Dengue virus
HTWTEQHK

SEQ ID NO: 80715 - protein, 8 aa, Dengue virus
TWTEQHKF

SEQ ID NO: 80716 - protein, 8 aa, Dengue virus
WIEQYKFQ

SEQ ID NO: 80717 - protein, 8 aa, Dengue virus
TEQHKFQP

SEQ ID NO: 80718 - protein, 8 aa, Dengue virus
AILNAHKE

SEQ ID NO: 80719 - protein, 8 aa, Dengue virus
ILNAHEDG

SEQ ID NO: 80720 - protein, 8 aa, Dengue virus
LIAHKDGV

SEQ ID NO: 80721 - protein, 8 aa, Dengue virus
IAHKDGVC

SEQ ID NO: 80722 - protein, 8 aa, Dengue virus
HEDGVCGI

SEQ ID NO: 80723 - protein, 8 aa, Dengue virus
KDGVCGVR

SEQ ID NO: 80724 - protein, 8 aa, Dengue virus
LTVVTGDV

SEQ ID NO: 80725 - protein, 8 aa, Dengue virus
TVVAGDVR

SEQ ID NO: 80726 - protein, 8 aa, Dengue virus
VVAGDVRG

SEQ ID NO: 80727 - protein, 8 aa, Dengue virus
VAGDVRGV

SEQ ID NO: 80728 - protein, 8 aa, Dengue virus
AGDVRGVL

SEQ ID NO: 80729 - protein, 8 aa, Dengue virus
GDAKGVLT

SEQ ID NO: 80730 - protein, 8 aa, Dengue virus
DVKGVLVK

SEQ ID NO: 80731 - protein, 8 aa, Dengue virus
VKGVLVKG

SEQ ID NO: 80732 - protein, 8 aa, Dengue virus
KGVLVKGK

SEQ ID NO: 80733 - protein, 8 aa, Dengue virus
GVLVKGKR

SEQ ID NO: 80734 - protein, 8 aa, Dengue virus
VLVKGKRA

SEQ ID NO: 80735 - protein, 8 aa, Dengue virus
LVKGKRAL

SEQ ID NO: 80736 - protein, 8 aa, Dengue virus
VKGKRALT

SEQ ID NO: 80737 - protein, 8 aa, Dengue virus
KGKRVIAP

SEQ ID NO: 80738 - protein, 8 aa, Dengue virus
GKRVIAPP

SEQ ID NO: 80739 - protein, 8 aa, Dengue virus
KRALAPPV

SEQ ID NO: 80740 - protein, 8 aa, Dengue virus
LTPPVNDL

SEQ ID NO: 80741 - protein, 8 aa, Dengue virus
TPPVNDLK

SEQ ID NO: 80742 - protein, 8 aa, Dengue virus
PPVNDLKY

SEQ ID NO: 80743 - protein, 8 aa, Dengue virus
PVNDLKYS

SEQ ID NO: 80744 - protein, 8 aa, Dengue virus
VNDLKYSW

SEQ ID NO: 80745 - protein, 8 aa, Dengue virus
AKIFAPEA

SEQ ID NO: 80746 - protein, 8 aa, Dengue virus
IFTPEAKN

SEQ ID NO: 80747 - protein, 8 aa, Dengue virus
PEAKNSTF

SEQ ID NO: 80748 - protein, 8 aa, Dengue virus
EAKNSTFL

SEQ ID NO: 80749 - protein, 8 aa, Dengue virus
RNSTFLVD

SEQ ID NO: 80750 - protein, 8 aa, Dengue virus
ERRAWNFL

SEQ ID NO: 80751 - protein, 8 aa, Dengue virus
RRAWNFLE

SEQ ID NO: 80752 - protein, 8 aa, Dengue virus
RAWNFLEV

SEQ ID NO: 80753 - protein, 8 aa, Dengue virus
AWNFLEVE

SEQ ID NO: 80754 - protein, 8 aa, Dengue virus
WNFLEVED

SEQ ID NO: 80755 - protein, 8 aa, Dengue virus
NFLEVEDY

SEQ ID NO: 80756 - protein, 8 aa, Dengue virus
FLEVEDYG

SEQ ID NO: 80757 - protein, 8 aa, Dengue virus
SQMLIPKA

SEQ ID NO: 80758 - protein, 8 aa, Dengue virus
QMLIPKAY

SEQ ID NO: 80759 - protein, 8 aa, Dengue virus
MLIPKAYA

SEQ ID NO: 80760 - protein, 8 aa, Dengue virus
LIPKAYAG

SEQ ID NO: 80761 - protein, 8 aa, Dengue virus
IPKAYAGP

SEQ ID NO: 80762 - protein, 8 aa, Dengue virus
PKAYAGPF

SEQ ID NO: 80763 - protein, 8 aa, Dengue virus
KAYAGPFS

SEQ ID NO: 80764 - protein, 8 aa, Dengue virus
SYAGPFSH

SEQ ID NO: 80765 - protein, 8 aa, Dengue virus
YAGPISQH

SEQ ID NO: 80766 - protein, 8 aa, Dengue virus
AGPISQHN

SEQ ID NO: 80767 - protein, 8 aa, Dengue virus
GPISQHNY

SEQ ID NO: 80768 - protein, 8 aa, Dengue virus
PISQHNYR

SEQ ID NO: 80769 - protein, 8 aa, Dengue virus
ISQHNYRQ

SEQ ID NO: 80770 - protein, 8 aa, Dengue virus
QGYATQTA

SEQ ID NO: 80771 - protein, 8 aa, Dengue virus
GYATQTAG

SEQ ID NO: 80772 - protein, 8 aa, Dengue virus
YATQTAGP

SEQ ID NO: 80773 - protein, 8 aa, Dengue virus
ATQTAGPW

SEQ ID NO: 80774 - protein, 8 aa, Dengue virus
TQTAGPWH

SEQ ID NO: 80775 - protein, 8 aa, Dengue virus
QTAGPWHL

SEQ ID NO: 80776 - protein, 8 aa, Dengue virus
TAGPWHLG

SEQ ID NO: 80777 - protein, 8 aa, Dengue virus
MGPWHLGK

SEQ ID NO: 80778 - protein, 8 aa, Dengue virus
CPGTTVTV

SEQ ID NO: 80779 - protein, 8 aa, Dengue virus
PGTTVTVQ

SEQ ID NO: 80780 - protein, 8 aa, Dengue virus
GTTVTIQD

SEQ ID NO: 80781 - protein, 8 aa, Dengue virus
TTVAIQED

SEQ ID NO: 80782 - protein, 8 aa, Dengue virus
TVAIQEDC

SEQ ID NO: 80783 - protein, 8 aa, Dengue virus
QDDCDHRG

SEQ ID NO: 80784 - protein, 8 aa, Dengue virus
DDCDHRGP

SEQ ID NO: 80785 - protein, 8 aa, Dengue virus
DCGHRGSS

SEQ ID NO: 80786 - protein, 8 aa, Dengue virus
EIRPLSER

SEQ ID NO: 80787 - protein, 8 aa, Dengue virus
IRPLSERE

SEQ ID NO: 80788 - protein, 8 aa, Dengue virus
RPLSEREE

SEQ ID NO: 80789 - protein, 8 aa, Dengue virus
PLSEREEN

SEQ ID NO: 80790 - protein, 8 aa, Dengue virus
LSEREENM

SEQ ID NO: 80791 - protein, 8 aa, Dengue virus
SEREENMV

SEQ ID NO: 80792 - protein, 8 aa, Dengue virus
EKEENMVR

SEQ ID NO: 80793 - protein, 8 aa, Dengue virus
KEENMVRS

SEQ ID NO: 80794 - protein, 8 aa, Dengue virus
ENMVKSQA

SEQ ID NO: 80795 - protein, 8 aa, Dengue virus
NMVKSQVS

SEQ ID NO: 80796 - protein, 8 aa, Dengue virus
MVKSQVSA

SEQ ID NO: 80797 - protein, 8 aa, Dengue virus
VKSQVSAG

SEQ ID NO: 80798 - protein, 8 aa, Dengue virus
AGPGTSET

SEQ ID NO: 80799 - protein, 8 aa, Dengue virus
GPGTSETF

SEQ ID NO: 80800 - protein, 8 aa, Dengue virus
GSSETFSM

SEQ ID NO: 80801 - protein, 8 aa, Dengue virus
PSETFSMG

SEQ ID NO: 80802 - protein, 8 aa, Dengue virus
LLCLTLFI

SEQ ID NO: 80803 - protein, 8 aa, Dengue virus
LCLTLFIE

SEQ ID NO: 80804 - protein, 8 aa, Dengue virus
CLTLFIEE

SEQ ID NO: 80805 - protein, 8 aa, Dengue virus
LTLFIEEC

SEQ ID NO: 80806 - protein, 8 aa, Dengue virus
TLFIEECL

SEQ ID NO: 80807 - protein, 8 aa, Dengue virus
LFIEECLR

SEQ ID NO: 80808 - protein, 8 aa, Dengue virus
FIEECLRR

SEQ ID NO: 80809 - protein, 8 aa, Dengue virus
IEECLRRK

SEQ ID NO: 80810 - protein, 8 aa, Dengue virus
KHMILVVA

SEQ ID NO: 80811 - protein, 8 aa, Dengue virus
HMILVVVT

SEQ ID NO: 80812 - protein, 8 aa, Dengue virus
MILVVVTT

SEQ ID NO: 80813 - protein, 8 aa, Dengue virus
TTLCAIIL

SEQ ID NO: 80814 - protein, 8 aa, Dengue virus
MLGDTMSS

SEQ ID NO: 80815 - protein, 8 aa, Dengue virus
LGDTMFGR

SEQ ID NO: 80816 - protein, 8 aa, Dengue virus
GDTMLSRV

SEQ ID NO: 80817 - protein, 8 aa, Dengue virus
DTMLSRVG

SEQ ID NO: 80818 - protein, 8 aa, Dengue virus
TMLSRVGG

SEQ ID NO: 80819 - protein, 8 aa, Dengue virus
MLSRVGGQ

SEQ ID NO: 80820 - protein, 8 aa, Dengue virus
RMGGQIHL

SEQ ID NO: 80821 - protein, 8 aa, Dengue virus
MGGQIHLA

SEQ ID NO: 80822 - protein, 8 aa, Dengue virus
GGQVHLAI

SEQ ID NO: 80823 - protein, 8 aa, Dengue virus
GQVHLAIM

SEQ ID NO: 80824 - protein, 8 aa, Dengue virus
QVHLAIMA

SEQ ID NO: 80825 - protein, 8 aa, Dengue virus
VHLAIMAV

SEQ ID NO: 80826 - protein, 8 aa, Dengue virus
VLGVFLRR

SEQ ID NO: 80827 - protein, 8 aa, Dengue virus
LGVFLRRL

SEQ ID NO: 80828 - protein, 8 aa, Dengue virus
GVFLRRLT

SEQ ID NO: 80829 - protein, 8 aa, Dengue virus
VFLRRLTS

SEQ ID NO: 80830 - protein, 8 aa, Dengue virus
GMAMTTVF

SEQ ID NO: 80831 - protein, 8 aa, Dengue virus
MAMTTVFS

SEQ ID NO: 80832 - protein, 8 aa, Dengue virus
AMTTVFSI

SEQ ID NO: 80833 - protein, 8 aa, Dengue virus
MTTVFSIP

SEQ ID NO: 80834 - protein, 8 aa, Dengue virus
TTVFSIPH

SEQ ID NO: 80835 - protein, 8 aa, Dengue virus
TVFSIPHD

SEQ ID NO: 80836 - protein, 8 aa, Dengue virus
VFSIPHDL

SEQ ID NO: 80837 - protein, 8 aa, Dengue virus
MELIDGIA

SEQ ID NO: 80838 - protein, 8 aa, Dengue virus
EFIDGLSL

SEQ ID NO: 80839 - protein, 8 aa, Dengue virus
FIDGLSLG

SEQ ID NO: 80840 - protein, 8 aa, Dengue virus
LILLKTVT

SEQ ID NO: 80841 - protein, 8 aa, Dengue virus
ILLKMVTH

SEQ ID NO: 80842 - protein, 8 aa, Dengue virus
LLKMVTHF

SEQ ID NO: 80843 - protein, 8 aa, Dengue virus
LKMVTHFD

SEQ ID NO: 80844 - protein, 8 aa, Dengue virus
VTHFDDTQ

SEQ ID NO: 80845 - protein, 8 aa, Dengue virus
THFDDTQV

SEQ ID NO: 80846 - protein, 8 aa, Dengue virus
HFDDTQVG

SEQ ID NO: 80847 - protein, 8 aa, Dengue virus
FDSTQVGT

SEQ ID NO: 80848 - protein, 8 aa, Dengue virus
DNAQLGTL

SEQ ID NO: 80849 - protein, 8 aa, Dengue virus
NAQLGTLA

SEQ ID NO: 80850 - protein, 8 aa, Dengue virus
ALALTFIK

SEQ ID NO: 80851 - protein, 8 aa, Dengue virus
LALTFIKS

SEQ ID NO: 80852 - protein, 8 aa, Dengue virus
SLTFISST

SEQ ID NO: 80853 - protein, 8 aa, Dengue virus
LTFIKSTM

SEQ ID NO: 80854 - protein, 8 aa, Dengue virus
PLIMAWRT

SEQ ID NO: 80855 - protein, 8 aa, Dengue virus
LTMAWRTI

SEQ ID NO: 80856 - protein, 8 aa, Dengue virus
TMAWRTIM

SEQ ID NO: 80857 - protein, 8 aa, Dengue virus
TIMAVLFA

SEQ ID NO: 80858 - protein, 8 aa, Dengue virus
IMAVLFAV

SEQ ID NO: 80859 - protein, 8 aa, Dengue virus
MAVLFAVT

SEQ ID NO: 80860 - protein, 8 aa, Dengue virus
AVLFAVTL

SEQ ID NO: 80861 - protein, 8 aa, Dengue virus
VLFAVTLI

SEQ ID NO: 80862 - protein, 8 aa, Dengue virus
LFAVTLIP

SEQ ID NO: 80863 - protein, 8 aa, Dengue virus
WVEITALT

SEQ ID NO: 80864 - protein, 8 aa, Dengue virus
VEITALTL

SEQ ID NO: 80865 - protein, 8 aa, Dengue virus
EITALTLG

SEQ ID NO: 80866 - protein, 8 aa, Dengue virus
ITALTLGA

SEQ ID NO: 80867 - protein, 8 aa, Dengue virus
TALTLGAQ

SEQ ID NO: 80868 - protein, 8 aa, Dengue virus
ALTLGAQA

SEQ ID NO: 80869 - protein, 8 aa, Dengue virus
LTLGAQAL

SEQ ID NO: 80870 - protein, 8 aa, Dengue virus
LSLERAAN

SEQ ID NO: 80871 - protein, 8 aa, Dengue virus
SLERAANV

SEQ ID NO: 80872 - protein, 8 aa, Dengue virus
LERAANVQ

SEQ ID NO: 80873 - protein, 8 aa, Dengue virus
ERAANVQW

SEQ ID NO: 80874 - protein, 8 aa, Dengue virus
RAANVQWD

SEQ ID NO: 80875 - protein, 8 aa, Dengue virus
IIEVKQDD

SEQ ID NO: 80876 - protein, 8 aa, Dengue virus
LAIPVTMA

SEQ ID NO: 80877 - protein, 8 aa, Dengue virus
AIPVTMAL

SEQ ID NO: 80878 - protein, 8 aa, Dengue virus
IPVTMALW

SEQ ID NO: 80879 - protein, 8 aa, Dengue virus
PVTMALWY

SEQ ID NO: 80880 - protein, 8 aa, Dengue virus
VTMALWYI

SEQ ID NO: 80881 - protein, 8 aa, Dengue virus
TMALWYMW

SEQ ID NO: 80882 - protein, 8 aa, Dengue virus
MALWYMWQ

SEQ ID NO: 80883 - protein, 8 aa, Dengue virus
ALWYMWQV

SEQ ID NO: 80884 - protein, 8 aa, Dengue virus
LWYMWQVR

SEQ ID NO: 80885 - protein, 8 aa, Dengue virus
WYMWQVRT

SEQ ID NO: 80886 - protein, 8 aa, Dengue virus
YMWQVRTQ

SEQ ID NO: 80887 - protein, 8 aa, Dengue virus
MWQVRTQR

SEQ ID NO: 80888 - protein, 8 aa, Dengue virus
DVPSPATA

SEQ ID NO: 80889 - protein, 8 aa, Dengue virus
VPSPAAAQ

SEQ ID NO: 80890 - protein, 8 aa, Dengue virus
PSPAAAQK

SEQ ID NO: 80891 - protein, 8 aa, Dengue virus
SPAAAQKA

SEQ ID NO: 80892 - protein, 8 aa, Dengue virus
TQKATLSE

SEQ ID NO: 80893 - protein, 8 aa, Dengue virus
QKATLSEG

SEQ ID NO: 80894 - protein, 8 aa, Dengue virus
KATLTEGV

SEQ ID NO: 80895 - protein, 8 aa, Dengue virus
ATLTEGVY

SEQ ID NO: 80896 - protein, 8 aa, Dengue virus
TLTEGVYR

SEQ ID NO: 80897 - protein, 8 aa, Dengue virus
QVGVGIHT

SEQ ID NO: 80898 - protein, 8 aa, Dengue virus
VGVGIHTE

SEQ ID NO: 80899 - protein, 8 aa, Dengue virus
GVGVHVEG

SEQ ID NO: 80900 - protein, 8 aa, Dengue virus
VGVHVEGV

SEQ ID NO: 80901 - protein, 8 aa, Dengue virus
GVHVEGVF

SEQ ID NO: 80902 - protein, 8 aa, Dengue virus
IHTEGVFH

SEQ ID NO: 80903 - protein, 8 aa, Dengue virus
HVEGVFHT

SEQ ID NO: 80904 - protein, 8 aa, Dengue virus
VEGVFHTM

SEQ ID NO: 80905 - protein, 8 aa, Dengue virus
MTATPPGT

SEQ ID NO: 80906 - protein, 8 aa, Dengue virus
TATPPGTT

SEQ ID NO: 80907 - protein, 8 aa, Dengue virus
ATPPGTTD

SEQ ID NO: 80908 - protein, 8 aa, Dengue virus
TPPGTTDP

SEQ ID NO: 80909 - protein, 8 aa, Dengue virus
PPGTTDPF

SEQ ID NO: 80910 - protein, 8 aa, Dengue virus
PGTTDPFP

SEQ ID NO: 80911 - protein, 8 aa, Dengue virus
GTTDPFPQ

SEQ ID NO: 80912 - protein, 8 aa, Dengue virus
TTDPFPQS

SEQ ID NO: 80913 - protein, 8 aa, Dengue virus
CLKPVIST

SEQ ID NO: 80914 - protein, 8 aa, Dengue virus
LKPVISTD

SEQ ID NO: 80915 - protein, 8 aa, Dengue virus
KPVISTDG

SEQ ID NO: 80916 - protein, 8 aa, Dengue virus
PVISTDGP

SEQ ID NO: 80917 - protein, 8 aa, Dengue virus
VISTDGPE

SEQ ID NO: 80918 - protein, 8 aa, Dengue virus
ISTDGPER

SEQ ID NO: 80919 - protein, 8 aa, Dengue virus
STDGPERV

SEQ ID NO: 80920 - protein, 8 aa, Dengue virus
GRIGRNPT

SEQ ID NO: 80921 - protein, 8 aa, Dengue virus
RIGRNPTQ

SEQ ID NO: 80922 - protein, 8 aa, Dengue virus
IGRNPTQE

SEQ ID NO: 80923 - protein, 8 aa, Dengue virus
GRNPTQED

SEQ ID NO: 80924 - protein, 8 aa, Dengue virus
RNPTQEDD

SEQ ID NO: 80925 - protein, 8 aa, Dengue virus
NPTQEDDQ

SEQ ID NO: 80926 - protein, 8 aa, Dengue virus
PTQEDDQY

SEQ ID NO: 80927 - protein, 8 aa, Dengue virus
TEIATLPA

SEQ ID NO: 80928 - protein, 8 aa, Dengue virus
EIATLPAY

SEQ ID NO: 80929 - protein, 8 aa, Dengue virus
IATLPAYL

SEQ ID NO: 80930 - protein, 8 aa, Dengue virus
ATLPAYLS

SEQ ID NO: 80931 - protein, 8 aa, Dengue virus
TLPAYLSS

SEQ ID NO: 80932 - protein, 8 aa, Dengue virus
LPAYLSSK

SEQ ID NO: 80933 - protein, 8 aa, Dengue virus
PAYLSSKA

SEQ ID NO: 80934 - protein, 8 aa, Dengue virus
AYLSSKAK

SEQ ID NO: 80935 - protein, 8 aa, Dengue virus
HTTERGGK

SEQ ID NO: 80936 - protein, 8 aa, Dengue virus
TTERGGKA

SEQ ID NO: 80937 - protein, 8 aa, Dengue virus
TERGGKAY

SEQ ID NO: 80938 - protein, 8 aa, Dengue virus
ERGGKAYQ

SEQ ID NO: 80939 - protein, 8 aa, Dengue virus
RGGKAYQH

SEQ ID NO: 80940 - protein, 8 aa, Dengue virus
KGMGKLSM

SEQ ID NO: 80941 - protein, 8 aa, Dengue virus
GIGKLSVG

SEQ ID NO: 80942 - protein, 8 aa, Dengue virus
IGKLSVGL

SEQ ID NO: 80943 - protein, 8 aa, Dengue virus
KLSVGLIA

SEQ ID NO: 80944 - protein, 8 aa, Dengue virus
LSVGLIAI

SEQ ID NO: 80945 - protein, 8 aa, Dengue virus
SVGLIAIA

SEQ ID NO: 80946 - protein, 8 aa, Dengue virus
MGLITIAM

SEQ ID NO: 80947 - protein, 8 aa, Dengue virus
GLITIAMA

SEQ ID NO: 80948 - protein, 8 aa, Dengue virus
LITIAMAS

SEQ ID NO: 80949 - protein, 8 aa, Dengue virus
ITIAMASG

SEQ ID NO: 80950 - protein, 8 aa, Dengue virus
TIAMASGL

SEQ ID NO: 80951 - protein, 8 aa, Dengue virus
IAVASGLF

SEQ ID NO: 80952 - protein, 8 aa, Dengue virus
AVASGLFW

SEQ ID NO: 80953 - protein, 8 aa, Dengue virus
VASGLFWV

SEQ ID NO: 80954 - protein, 8 aa, Dengue virus
ASGLFWVA

SEQ ID NO: 80955 - protein, 8 aa, Dengue virus
SGLFWVAE

SEQ ID NO: 80956 - protein, 8 aa, Dengue virus
GLFWVAEI

SEQ ID NO: 80957 - protein, 8 aa, Dengue virus
LFWVAEIQ

SEQ ID NO: 80958 - protein, 8 aa, Dengue virus
FWVAEIQP

SEQ ID NO: 80959 - protein, 8 aa, Dengue virus
WVAELQPQ

SEQ ID NO: 80960 - protein, 8 aa, Dengue virus
VAELQPQW

SEQ ID NO: 80961 - protein, 8 aa, Dengue virus
YVILTILA

SEQ ID NO: 80962 - protein, 8 aa, Dengue virus
VILTILAI

SEQ ID NO: 80963 - protein, 8 aa, Dengue virus
ILTILAII

SEQ ID NO: 80964 - protein, 8 aa, Dengue virus
LTILTIIA

SEQ ID NO: 80965 - protein, 8 aa, Dengue virus
TILTIIAL

SEQ ID NO: 80966 - protein, 8 aa, Dengue virus
ILTIIALV

SEQ ID NO: 80967 - protein, 8 aa, Dengue virus
LTIIALVA

SEQ ID NO: 80968 - protein, 8 aa, Dengue virus
TIIALVAA

SEQ ID NO: 80969 - protein, 8 aa, Dengue virus
IIALVAAN

SEQ ID NO: 80970 - protein, 8 aa, Dengue virus
IALVAANE

SEQ ID NO: 80971 - protein, 8 aa, Dengue virus
ALVAANEM

SEQ ID NO: 80972 - protein, 8 aa, Dengue virus
TDFGFYQE

SEQ ID NO: 80973 - protein, 8 aa, Dengue virus
DFGFYQEK

SEQ ID NO: 80974 - protein, 8 aa, Dengue virus
FGFYQEKT

SEQ ID NO: 80975 - protein, 8 aa, Dengue virus
GFYQEKTE

SEQ ID NO: 80976 - protein, 8 aa, Dengue virus
FYQEKTET

SEQ ID NO: 80977 - protein, 8 aa, Dengue virus
YQEKTETT

SEQ ID NO: 80978 - protein, 8 aa, Dengue virus
QEKTETTI

SEQ ID NO: 80979 - protein, 8 aa, Dengue virus
EKTETTIL

SEQ ID NO: 80980 - protein, 8 aa, Dengue virus
KPETTILD

SEQ ID NO: 80981 - protein, 8 aa, Dengue virus
PETTILDV

SEQ ID NO: 80982 - protein, 8 aa, Dengue virus
IASLVMLL

SEQ ID NO: 80983 - protein, 8 aa, Dengue virus
ASLVMLFV

SEQ ID NO: 80984 - protein, 8 aa, Dengue virus
SLVMLFVH

SEQ ID NO: 80985 - protein, 8 aa, Dengue virus
LVMLFVHY

SEQ ID NO: 80986 - protein, 8 aa, Dengue virus
VMLFVHYA

SEQ ID NO: 80987 - protein, 8 aa, Dengue virus
VLCAGQLF

SEQ ID NO: 80988 - protein, 8 aa, Dengue virus
LCAGQLFL

SEQ ID NO: 80989 - protein, 8 aa, Dengue virus
CAGQLFLM

SEQ ID NO: 80990 - protein, 8 aa, Dengue virus
AGQLFLMR

SEQ ID NO: 80991 - protein, 8 aa, Dengue virus
LTLATGPT

SEQ ID NO: 80992 - protein, 8 aa, Dengue virus
TLATGPVL

SEQ ID NO: 80993 - protein, 8 aa, Dengue virus
LATGPVLT

SEQ ID NO: 80994 - protein, 8 aa, Dengue virus
ATGPVLTL

SEQ ID NO: 80995 - protein, 8 aa, Dengue virus
TGPVLTLW

SEQ ID NO: 80996 - protein, 8 aa, Dengue virus
GPVLTLWE

SEQ ID NO: 80997 - protein, 8 aa, Dengue virus
PVLTLWEG

SEQ ID NO: 80998 - protein, 8 aa, Dengue virus
VLTLWEGN

SEQ ID NO: 80999 - protein, 8 aa, Dengue virus
AFSLIKNT

SEQ ID NO: 81000 - protein, 8 aa, Dengue virus
FSLIKNTQ

SEQ ID NO: 81001 - protein, 8 aa, Dengue virus
SLIKNAQA

SEQ ID NO: 81002 - protein, 8 aa, Dengue virus
LIKNTQTP

SEQ ID NO: 81003 - protein, 8 aa, Dengue virus
IKNTQTPR

SEQ ID NO: 81004 - protein, 8 aa, Dengue virus
KNAQAPRR

SEQ ID NO: 81005 - protein, 8 aa, Dengue virus
NAQAPRRG

SEQ ID NO: 81006 - protein, 8 aa, Dengue virus
AQAPRRGT

SEQ ID NO: 81007 - protein, 8 aa, Dengue virus
ALKDGSKT

SEQ ID NO: 81008 - protein, 8 aa, Dengue virus
LKDGSKTK

SEQ ID NO: 81009 - protein, 8 aa, Dengue virus
KDGSKTKH

SEQ ID NO: 81010 - protein, 8 aa, Dengue virus
DGSKIKYA

SEQ ID NO: 81011 - protein, 8 aa, Dengue virus
GSKIKYAV

SEQ ID NO: 81012 - protein, 8 aa, Dengue virus
SKIKYAVS

SEQ ID NO: 81013 - protein, 8 aa, Dengue virus
KIKYAVSR

SEQ ID NO: 81014 - protein, 8 aa, Dengue virus
IKYAVSRG

SEQ ID NO: 81015 - protein, 8 aa, Dengue virus
VKPKGKVI

SEQ ID NO: 81016 - protein, 8 aa, Dengue virus
LEKLQRKY

SEQ ID NO: 81017 - protein, 8 aa, Dengue virus
EKLQRKYG

SEQ ID NO: 81018 - protein, 8 aa, Dengue virus
KLQRKYGG

SEQ ID NO: 81019 - protein, 8 aa, Dengue virus
LQRKHGGS

SEQ ID NO: 81020 - protein, 8 aa, Dengue virus
QRKHGGSL

SEQ ID NO: 81021 - protein, 8 aa, Dengue virus
RKHGGSLV

SEQ ID NO: 81022 - protein, 8 aa, Dengue virus
KHGGSLVR

SEQ ID NO: 81023 - protein, 8 aa, Dengue virus
HGGSLIRC

SEQ ID NO: 81024 - protein, 8 aa, Dengue virus
GGSLIRCP

SEQ ID NO: 81025 - protein, 8 aa, Dengue virus
GSLIRCPL

SEQ ID NO: 81026 - protein, 8 aa, Dengue virus
SLIRCPLS

SEQ ID NO: 81027 - protein, 8 aa, Dengue virus
VSKMLLNR

SEQ ID NO: 81028 - protein, 8 aa, Dengue virus
RFTTKHRK

SEQ ID NO: 81029 - protein, 8 aa, Dengue virus
LTKPWDMI

SEQ ID NO: 81030 - protein, 8 aa, Dengue virus
TKPWDMIP

SEQ ID NO: 81031 - protein, 8 aa, Dengue virus
KPWDMIPM

SEQ ID NO: 81032 - protein, 8 aa, Dengue virus
PWDMIPMV

SEQ ID NO: 81033 - protein, 8 aa, Dengue virus
WDMIPMVT

SEQ ID NO: 81034 - protein, 8 aa, Dengue virus
DMIPMVTQ

SEQ ID NO: 81035 - protein, 8 aa, Dengue virus
MIPMVTQL

SEQ ID NO: 81036 - protein, 8 aa, Dengue virus
PQPKPGTQ

SEQ ID NO: 81037 - protein, 8 aa, Dengue virus
QPKPGTQM

SEQ ID NO: 81038 - protein, 8 aa, Dengue virus
PKPGTRVV

SEQ ID NO: 81039 - protein, 8 aa, Dengue virus
KPGTRVVM

SEQ ID NO: 81040 - protein, 8 aa, Dengue virus
PGTRVVMT

SEQ ID NO: 81041 - protein, 8 aa, Dengue virus
GTRVVMTT

SEQ ID NO: 81042 - protein, 8 aa, Dengue virus
TRVVMTTT

SEQ ID NO: 81043 - protein, 8 aa, Dengue virus
RVVMTTTA

SEQ ID NO: 81044 - protein, 8 aa, Dengue virus
VVMTTTAN

SEQ ID NO: 81045 - protein, 8 aa, Dengue virus
WLWTLLGK

SEQ ID NO: 81046 - protein, 8 aa, Dengue virus
LWTLLGKK

SEQ ID NO: 81047 - protein, 8 aa, Dengue virus
WTLLGKKK

SEQ ID NO: 81048 - protein, 8 aa, Dengue virus
LLGRKKNP

SEQ ID NO: 81049 - protein, 8 aa, Dengue virus
LGRKKNPR

SEQ ID NO: 81050 - protein, 8 aa, Dengue virus
GRKKNPRL

SEQ ID NO: 81051 - protein, 8 aa, Dengue virus
RKKNPRLC

SEQ ID NO: 81052 - protein, 8 aa, Dengue virus
KKTPRLCT

SEQ ID NO: 81053 - protein, 8 aa, Dengue virus
KSPRLCTK

SEQ ID NO: 81054 - protein, 8 aa, Dengue virus
SPRLCTKE

SEQ ID NO: 81055 - protein, 8 aa, Dengue virus
YILEDIDR

SEQ ID NO: 81056 - protein, 8 aa, Dengue virus
ILEDIDRK

SEQ ID NO: 81057 - protein, 8 aa, Dengue virus
LEDIDRKD

SEQ ID NO: 81058 - protein, 8 aa, Dengue virus
EDIDRKDG

SEQ ID NO: 81059 - protein, 8 aa, Dengue virus
DIDRKDGD

SEQ ID NO: 81060 - protein, 8 aa, Dengue virus
DRKDGDLM

SEQ ID NO: 81061 - protein, 8 aa, Dengue virus
RKDGDLMY

SEQ ID NO: 81062 - protein, 8 aa, Dengue virus
QMAPHHRI

SEQ ID NO: 81063 - protein, 8 aa, Dengue virus
MAPHHRIL

SEQ ID NO: 81064 - protein, 8 aa, Dengue virus
APHHRILA

SEQ ID NO: 81065 - protein, 8 aa, Dengue virus
PHHRILAK

SEQ ID NO: 81066 - protein, 8 aa, Dengue virus
HHRILAKA

SEQ ID NO: 81067 - protein, 8 aa, Dengue virus
HRILAKAI

SEQ ID NO: 81068 - protein, 8 aa, Dengue virus
RILAKAIF

SEQ ID NO: 81069 - protein, 8 aa, Dengue virus
VITQDDMH

SEQ ID NO: 81070 - protein, 8 aa, Dengue virus
ITRDDMHN

SEQ ID NO: 81071 - protein, 8 aa, Dengue virus
TQDDMHNP

SEQ ID NO: 81072 - protein, 8 aa, Dengue virus
QDDMHNPK

SEQ ID NO: 81073 - protein, 8 aa, Dengue virus
GLKEKVEK

SEQ ID NO: 81074 - protein, 8 aa, Dengue virus
LKEKVEKW

SEQ ID NO: 81075 - protein, 8 aa, Dengue virus
KEKVEKWL

SEQ ID NO: 81076 - protein, 8 aa, Dengue virus
ERVENWLR

SEQ ID NO: 81077 - protein, 8 aa, Dengue virus
RVENWLRE

SEQ ID NO: 81078 - protein, 8 aa, Dengue virus
VENWLREC

SEQ ID NO: 81079 - protein, 8 aa, Dengue virus
ENWLRECG

SEQ ID NO: 81080 - protein, 8 aa, Dengue virus
NWLRECGV

SEQ ID NO: 81081 - protein, 8 aa, Dengue virus
KPLDERFA

SEQ ID NO: 81082 - protein, 8 aa, Dengue virus
PLDERFAT

SEQ ID NO: 81083 - protein, 8 aa, Dengue virus
LDERFATS

SEQ ID NO: 81084 - protein, 8 aa, Dengue virus
DERFATSL

SEQ ID NO: 81085 - protein, 8 aa, Dengue virus
ERFATSLL

SEQ ID NO: 81086 - protein, 8 aa, Dengue virus
RFATSLLF

SEQ ID NO: 81087 - protein, 8 aa, Dengue virus
FATSLLFL

SEQ ID NO: 81088 - protein, 8 aa, Dengue virus
ATSLLFLN

SEQ ID NO: 81089 - protein, 8 aa, Dengue virus
NMTDKTPI

SEQ ID NO: 81090 - protein, 8 aa, Dengue virus
MTDKTPIH

SEQ ID NO: 81091 - protein, 8 aa, Dengue virus
TDKTPIHS

SEQ ID NO: 81092 - protein, 8 aa, Dengue virus
PVHSWEDV

SEQ ID NO: 81093 - protein, 8 aa, Dengue virus
VHSWEDVP

SEQ ID NO: 81094 - protein, 8 aa, Dengue virus
KNIQTAIT

SEQ ID NO: 81095 - protein, 8 aa, Dengue virus
NIQTAITQ

SEQ ID NO: 81096 - protein, 8 aa, Dengue virus
IHTAIAQV

SEQ ID NO: 81097 - protein, 8 aa, Dengue virus
HTAIAQVR

SEQ ID NO: 81098 - protein, 8 aa, Dengue virus
EYADYMPV

SEQ ID NO: 81099 - protein, 8 aa, Dengue virus
YADYMPVM

SEQ ID NO: 81100 - protein, 8 aa, Dengue virus
VDYMPVMR

SEQ ID NO: 81101 - protein, 8 aa, Dengue virus
DYMPVMRR

SEQ ID NO: 81102 - protein, 8 aa, Dengue virus
YMPVMRRY

SEQ ID NO: 81103 - protein, 8 aa, Dengue virus
MPVMRRYS

SEQ ID NO: 81104 - protein, 8 aa, Dengue virus
PVMRRYSA

SEQ ID NO: 81105 - protein, 8 aa, Dengue virus
VMRRYSAL

SEQ ID NO: 81106 - protein, 8 aa, Dengue virus
MRRYSALS

SEQ ID NO: 81107 - protein, 8 aa, Dengue virus
KRYSAHFE

SEQ ID NO: 81108 - protein, 8 aa, Dengue virus
RYSALSES

SEQ ID NO: 81109 - protein, 8 aa, Dengue virus
YSALSESE

SEQ ID NO: 81110 - protein, 8 aa, Dengue virus
SALSESEG

SEQ ID NO: 81111 - protein, 8 aa, Dengue virus
ALSESEGV

SEQ ID NO: 81112 - protein, 8 aa, Dengue virus
LSESEGVL

SEQ ID NO: 81113 - protein, 8 aa, Dengue virus
KRVVRPPF

SEQ ID NO: 81114 - protein, 8 aa, Dengue virus
KVVRPSFN

SEQ ID NO: 81115 - protein, 8 aa, Dengue virus
GLVKRFSI

SEQ ID NO: 81116 - protein, 8 aa, Dengue virus
LVKRFSIG

SEQ ID NO: 81117 - protein, 8 aa, Dengue virus
TKRFSLGM

SEQ ID NO: 81118 - protein, 8 aa, Dengue virus
KRFSIGLF

SEQ ID NO: 81119 - protein, 8 aa, Dengue virus
RFSLGMLQ

SEQ ID NO: 81120 - protein, 8 aa, Dengue virus
FSLGMLQG

SEQ ID NO: 81121 - protein, 8 aa, Dengue virus
SIGLFSGK

SEQ ID NO: 81122 - protein, 8 aa, Dengue virus
IGLFSGKG

SEQ ID NO: 81123 - protein, 8 aa, Dengue virus
IKKSKAIN

SEQ ID NO: 81124 - protein, 8 aa, Dengue virus
KKSKAINV

SEQ ID NO: 81125 - protein, 8 aa, Dengue virus
KSKAINVL

SEQ ID NO: 81126 - protein, 8 aa, Dengue virus
TKAIKILT

SEQ ID NO: 81127 - protein, 8 aa, Dengue virus
KAINVLRG

SEQ ID NO: 81128 - protein, 8 aa, Dengue virus
AINVLRGF

SEQ ID NO: 81129 - protein, 8 aa, Dengue virus
INVLRGFR

SEQ ID NO: 81130 - protein, 8 aa, Dengue virus
NVLRGFRK

SEQ ID NO: 81131 - protein, 8 aa, Dengue virus
LNILNGRR

SEQ ID NO: 81132 - protein, 8 aa, Dengue virus
NILNGRRR

SEQ ID NO: 81133 - protein, 8 aa, Dengue virus
ILNRRKRS

SEQ ID NO: 81134 - protein, 8 aa, Dengue virus
LNRRRRTA

SEQ ID NO: 81135 - protein, 8 aa, Dengue virus
RKRSTVTL

SEQ ID NO: 81136 - protein, 8 aa, Dengue virus
KRSTVTLL

SEQ ID NO: 81137 - protein, 8 aa, Dengue virus
RTAGMIIM

SEQ ID NO: 81138 - protein, 8 aa, Dengue virus
TAGMIIML

SEQ ID NO: 81139 - protein, 8 aa, Dengue virus
AGMIIMLI

SEQ ID NO: 81140 - protein, 8 aa, Dengue virus
GMIIMLIP

SEQ ID NO: 81141 - protein, 8 aa, Dengue virus
IIMLIPTV

SEQ ID NO: 81142 - protein, 8 aa, Dengue virus
IMLIPTVM

SEQ ID NO: 81143 - protein, 8 aa, Dengue virus
MLIPTVMA

SEQ ID NO: 81144 - protein, 8 aa, Dengue virus
IPTIMAFH

SEQ ID NO: 81145 - protein, 8 aa, Dengue virus
PTIMAFHL

SEQ ID NO: 81146 - protein, 8 aa, Dengue virus
TIMAFHLS

SEQ ID NO: 81147 - protein, 8 aa, Dengue virus
IMAFHLST

SEQ ID NO: 81148 - protein, 8 aa, Dengue virus
TYKCPLLR

SEQ ID NO: 81149 - protein, 8 aa, Dengue virus
YKCPLLRQ

SEQ ID NO: 81150 - protein, 8 aa, Dengue virus
ECPLLVNT

SEQ ID NO: 81151 - protein, 8 aa, Dengue virus
QTRIQRTV

SEQ ID NO: 81152 - protein, 8 aa, Dengue virus
TGIQRTIF

SEQ ID NO: 81153 - protein, 8 aa, Dengue virus
GIQRAVFF

SEQ ID NO: 81154 - protein, 8 aa, Dengue virus
IQRAVFFV

SEQ ID NO: 81155 - protein, 8 aa, Dengue virus
QRTIFFVL

SEQ ID NO: 81156 - protein, 8 aa, Dengue virus
RTIFFVLM

SEQ ID NO: 81157 - protein, 8 aa, Dengue virus
TIFFVLMM

SEQ ID NO: 81158 - protein, 8 aa, Dengue virus
TGKHGKEI

SEQ ID NO: 81159 - protein, 8 aa, Dengue virus
PNHGVTAT

SEQ ID NO: 81160 - protein, 8 aa, Dengue virus
KHGKEIKI

SEQ ID NO: 81161 - protein, 8 aa, Dengue virus
HGKEIKIT

SEQ ID NO: 81162 - protein, 8 aa, Dengue virus
GKEIKITP

SEQ ID NO: 81163 - protein, 8 aa, Dengue virus
KEIKITPQ

SEQ ID NO: 81164 - protein, 8 aa, Dengue virus
EIKITPQS

SEQ ID NO: 81165 - protein, 8 aa, Dengue virus
ATITPRTP

SEQ ID NO: 81166 - protein, 8 aa, Dengue virus
KITPQSSI

SEQ ID NO: 81167 - protein, 8 aa, Dengue virus
RTPSVEVK

SEQ ID NO: 81168 - protein, 8 aa, Dengue virus
SPSVEVEL

SEQ ID NO: 81169 - protein, 8 aa, Dengue virus
PSVEVQLP

SEQ ID NO: 81170 - protein, 8 aa, Dengue virus
SVEVQLPD

SEQ ID NO: 81171 - protein, 8 aa, Dengue virus
AEVKLPDY

SEQ ID NO: 81172 - protein, 8 aa, Dengue virus
FNEMVLLQ

SEQ ID NO: 81173 - protein, 8 aa, Dengue virus
NEMILMEM

SEQ ID NO: 81174 - protein, 8 aa, Dengue virus
EMVLLQME

SEQ ID NO: 81175 - protein, 8 aa, Dengue virus
MENKAWLV

SEQ ID NO: 81176 - protein, 8 aa, Dengue virus
EKKTWLVH

SEQ ID NO: 81177 - protein, 8 aa, Dengue virus
DLPLPWLP

SEQ ID NO: 81178 - protein, 8 aa, Dengue virus
LPLPWLPG

SEQ ID NO: 81179 - protein, 8 aa, Dengue virus
PLPWLPGA

SEQ ID NO: 81180 - protein, 8 aa, Dengue virus
LPWLPGAD

SEQ ID NO: 81181 - protein, 8 aa, Dengue virus
PWLPGADT

SEQ ID NO: 81182 - protein, 8 aa, Dengue virus
WLPGADTQ

SEQ ID NO: 81183 - protein, 8 aa, Dengue virus
LPGADTQG

SEQ ID NO: 81184 - protein, 8 aa, Dengue virus
PGADTQGS

SEQ ID NO: 81185 - protein, 8 aa, Dengue virus
TLEVHWNH

SEQ ID NO: 81186 - protein, 8 aa, Dengue virus
QGSNWIQK

SEQ ID NO: 81187 - protein, 8 aa, Dengue virus
GAGAPCKI

SEQ ID NO: 81188 - protein, 8 aa, Dengue virus
DGSPCKIP

SEQ ID NO: 81189 - protein, 8 aa, Dengue virus
IKDMNKEK

SEQ ID NO: 81190 - protein, 8 aa, Dengue virus
RDVNKERV

SEQ ID NO: 81191 - protein, 8 aa, Dengue virus
DVNKEKVI

SEQ ID NO: 81192 - protein, 8 aa, Dengue virus
VNKEKVIG

SEQ ID NO: 81193 - protein, 8 aa, Dengue virus
EKRHVLGR

SEQ ID NO: 81194 - protein, 8 aa, Dengue virus
RVVGRVIS

SEQ ID NO: 81195 - protein, 8 aa, Dengue virus
VLGRLITV

SEQ ID NO: 81196 - protein, 8 aa, Dengue virus
GRLITVNP

SEQ ID NO: 81197 - protein, 8 aa, Dengue virus
ITVNPIVT

SEQ ID NO: 81198 - protein, 8 aa, Dengue virus
PFAEYTNS

SEQ ID NO: 81199 - protein, 8 aa, Dengue virus
VTEKDSPV

SEQ ID NO: 81200 - protein, 8 aa, Dengue virus
EYTNSVTN

SEQ ID NO: 81201 - protein, 8 aa, Dengue virus
YTNSVTNI

SEQ ID NO: 81202 - protein, 8 aa, Dengue virus
SYIIIGVG

SEQ ID NO: 81203 - protein, 8 aa, Dengue virus
YIMIGVGN

SEQ ID NO: 81204 - protein, 8 aa, Dengue virus
IMIGVGNS

SEQ ID NO: 81205 - protein, 8 aa, Dengue virus
MIGVGNSA

SEQ ID NO: 81206 - protein, 8 aa, Dengue virus
IRILIGLL

SEQ ID NO: 81207 - protein, 8 aa, Dengue virus
GFTVQADV

SEQ ID NO: 81208 - protein, 8 aa, Dengue virus
FTVRADMG

SEQ ID NO: 81209 - protein, 8 aa, Dengue virus
TVRADMGC

SEQ ID NO: 81210 - protein, 8 aa, Dengue virus
ADMGCAVS

SEQ ID NO: 81211 - protein, 8 aa, Dengue virus
DMGCAVSW

SEQ ID NO: 81212 - protein, 8 aa, Dengue virus
GCAVSWSG

SEQ ID NO: 81213 - protein, 8 aa, Dengue virus
SWNGRELK

SEQ ID NO: 81214 - protein, 8 aa, Dengue virus
WNGRELKC

SEQ ID NO: 81215 - protein, 8 aa, Dengue virus
NGRELKCG

SEQ ID NO: 81216 - protein, 8 aa, Dengue virus
CGSGIFVA

SEQ ID NO: 81217 - protein, 8 aa, Dengue virus
GSGIFVAD

SEQ ID NO: 81218 - protein, 8 aa, Dengue virus
SGIFVADN

SEQ ID NO: 81219 - protein, 8 aa, Dengue virus
GIFVTDNV

SEQ ID NO: 81220 - protein, 8 aa, Dengue virus
IFVADNVH

SEQ ID NO: 81221 - protein, 8 aa, Dengue virus
FVTDNVHT

SEQ ID NO: 81222 - protein, 8 aa, Dengue virus
VADNVHTW

SEQ ID NO: 81223 - protein, 8 aa, Dengue virus
TDNVHTWT

SEQ ID NO: 81224 - protein, 8 aa, Dengue virus
TIVAGDVK

SEQ ID NO: 81225 - protein, 8 aa, Dengue virus
IVAGDVKG

SEQ ID NO: 81226 - protein, 8 aa, Dengue virus
GDVKGVLV

SEQ ID NO: 81227 - protein, 8 aa, Dengue virus
DAKGVLTK

SEQ ID NO: 81228 - protein, 8 aa, Dengue virus
AKGVLTKG

SEQ ID NO: 81229 - protein, 8 aa, Dengue virus
VLTKGKRV

SEQ ID NO: 81230 - protein, 8 aa, Dengue virus
LTKGKRVI

SEQ ID NO: 81231 - protein, 8 aa, Dengue virus
TKGKRALA

SEQ ID NO: 81232 - protein, 8 aa, Dengue virus
KRALAPPA

SEQ ID NO: 81233 - protein, 8 aa, Dengue virus
LAPPVNDL

SEQ ID NO: 81234 - protein, 8 aa, Dengue virus
APPVNDLK

SEQ ID NO: 81235 - protein, 8 aa, Dengue virus
AKIFTPEV

SEQ ID NO: 81236 - protein, 8 aa, Dengue virus
IFTPETKN

SEQ ID NO: 81237 - protein, 8 aa, Dengue virus
PETKNSTF

SEQ ID NO: 81238 - protein, 8 aa, Dengue virus
EVRNSTFL

SEQ ID NO: 81239 - protein, 8 aa, Dengue virus
ERRAWNFF

SEQ ID NO: 81240 - protein, 8 aa, Dengue virus
RRAWNFFE

SEQ ID NO: 81241 - protein, 8 aa, Dengue virus
RAWNFFEV

SEQ ID NO: 81242 - protein, 8 aa, Dengue virus
AWNFFEVE

SEQ ID NO: 81243 - protein, 8 aa, Dengue virus
WNFFEVED

SEQ ID NO: 81244 - protein, 8 aa, Dengue virus
NFFEVEDY

SEQ ID NO: 81245 - protein, 8 aa, Dengue virus
FFEVEDYG

SEQ ID NO: 81246 - protein, 8 aa, Dengue virus
PKAYAGPI

SEQ ID NO: 81247 - protein, 8 aa, Dengue virus
KAYAGPIS

SEQ ID NO: 81248 - protein, 8 aa, Dengue virus
AYAGPISQ

SEQ ID NO: 81249 - protein, 8 aa, Dengue virus
QGYATQIA

SEQ ID NO: 81250 - protein, 8 aa, Dengue virus
GYATQIAG

SEQ ID NO: 81251 - protein, 8 aa, Dengue virus
YATQIAGP

SEQ ID NO: 81252 - protein, 8 aa, Dengue virus
ATQIAGPW

SEQ ID NO: 81253 - protein, 8 aa, Dengue virus
TQIAGPWH

SEQ ID NO: 81254 - protein, 8 aa, Dengue virus
QIAGPWHL

SEQ ID NO: 81255 - protein, 8 aa, Dengue virus
IAGPWHLG

SEQ ID NO: 81256 - protein, 8 aa, Dengue virus
GTTVTVQE

SEQ ID NO: 81257 - protein, 8 aa, Dengue virus
TTVTIQDD

SEQ ID NO: 81258 - protein, 8 aa, Dengue virus
TVTIQDDC

SEQ ID NO: 81259 - protein, 8 aa, Dengue virus
QEDCGHRG

SEQ ID NO: 81260 - protein, 8 aa, Dengue virus
EDCGHRGS

SEQ ID NO: 81261 - protein, 8 aa, Dengue virus
NMVKSQAT

SEQ ID NO: 81262 - protein, 8 aa, Dengue virus
MVKSQATA

SEQ ID NO: 81263 - protein, 8 aa, Dengue virus
VKSQATAG

SEQ ID NO: 81264 - protein, 8 aa, Dengue virus
AGQGSSET

SEQ ID NO: 81265 - protein, 8 aa, Dengue virus
GQGSSETF

SEQ ID NO: 81266 - protein, 8 aa, Dengue virus
GTSETFFM

SEQ ID NO: 81267 - protein, 8 aa, Dengue virus
TSETFFMG

SEQ ID NO: 81268 - protein, 8 aa, Dengue virus
HMILVVAI

SEQ ID NO: 81269 - protein, 8 aa, Dengue virus
MILVVAIT

SEQ ID NO: 81270 - protein, 8 aa, Dengue virus
ATLCAIIL

SEQ ID NO: 81271 - protein, 8 aa, Dengue virus
GDTMSSRM

SEQ ID NO: 81272 - protein, 8 aa, Dengue virus
DTMSSRMG

SEQ ID NO: 81273 - protein, 8 aa, Dengue virus
TMSSRMGG

SEQ ID NO: 81274 - protein, 8 aa, Dengue virus
MFGRMGGQ

SEQ ID NO: 81275 - protein, 8 aa, Dengue virus
RVGGQTHL

SEQ ID NO: 81276 - protein, 8 aa, Dengue virus
IGGQVHLA

SEQ ID NO: 81277 - protein, 8 aa, Dengue virus
QTHLAIMI

SEQ ID NO: 81278 - protein, 8 aa, Dengue virus
THLAIMIV

SEQ ID NO: 81279 - protein, 8 aa, Dengue virus
GMAMTTTF

SEQ ID NO: 81280 - protein, 8 aa, Dengue virus
MAMTTTFS

SEQ ID NO: 81281 - protein, 8 aa, Dengue virus
AMTTTFSI

SEQ ID NO: 81282 - protein, 8 aa, Dengue virus
MTTTFSIP

SEQ ID NO: 81283 - protein, 8 aa, Dengue virus
TTTFSIPH

SEQ ID NO: 81284 - protein, 8 aa, Dengue virus
TTFSIPHD

SEQ ID NO: 81285 - protein, 8 aa, Dengue virus
TFSIPHDL

SEQ ID NO: 81286 - protein, 8 aa, Dengue virus
ILLKMVVH

SEQ ID NO: 81287 - protein, 8 aa, Dengue virus
LLKMVVHF

SEQ ID NO: 81288 - protein, 8 aa, Dengue virus
LKMVVHFD

SEQ ID NO: 81289 - protein, 8 aa, Dengue virus
VTHFDSTQ

SEQ ID NO: 81290 - protein, 8 aa, Dengue virus
THFDSTQV

SEQ ID NO: 81291 - protein, 8 aa, Dengue virus
HFDSTQVG

SEQ ID NO: 81292 - protein, 8 aa, Dengue virus
LSLTFISS

SEQ ID NO: 81293 - protein, 8 aa, Dengue virus
SLTFIKTT

SEQ ID NO: 81294 - protein, 8 aa, Dengue virus
LTFIRSTI

SEQ ID NO: 81295 - protein, 8 aa, Dengue virus
PLTMAWRT

SEQ ID NO: 81296 - protein, 8 aa, Dengue virus
VTMALWYM

SEQ ID NO: 81297 - protein, 8 aa, Dengue virus
VPSPATAQ

SEQ ID NO: 81298 - protein, 8 aa, Dengue virus
PSPATAQK

SEQ ID NO: 81299 - protein, 8 aa, Dengue virus
SPATAQKA

SEQ ID NO: 81300 - protein, 8 aa, Dengue virus
AQKATLTE

SEQ ID NO: 81301 - protein, 8 aa, Dengue virus
QKATLTEG

SEQ ID NO: 81302 - protein, 8 aa, Dengue virus
TATPPGST

SEQ ID NO: 81303 - protein, 8 aa, Dengue virus
ATPPGSTD

SEQ ID NO: 81304 - protein, 8 aa, Dengue virus
TPPGSTDP

SEQ ID NO: 81305 - protein, 8 aa, Dengue virus
PPGSTDPF

SEQ ID NO: 81306 - protein, 8 aa, Dengue virus
PGSTDPFP

SEQ ID NO: 81307 - protein, 8 aa, Dengue virus
GSTDPFPQ

SEQ ID NO: 81308 - protein, 8 aa, Dengue virus
STDPFPQS

SEQ ID NO: 81309 - protein, 8 aa, Dengue virus
VGLIAIAV

SEQ ID NO: 81310 - protein, 8 aa, Dengue virus
VASSLLWV

SEQ ID NO: 81311 - protein, 8 aa, Dengue virus
GLLWVAEL

SEQ ID NO: 81312 - protein, 8 aa, Dengue virus
LLWVAELQ

SEQ ID NO: 81313 - protein, 8 aa, Dengue virus
LWVAELQP

SEQ ID NO: 81314 - protein, 8 aa, Dengue virus
LALLTIIS

SEQ ID NO: 81315 - protein, 8 aa, Dengue virus
TILAIIGL

SEQ ID NO: 81316 - protein, 8 aa, Dengue virus
LLTIISLI

SEQ ID NO: 81317 - protein, 8 aa, Dengue virus
LAIIGLIA

SEQ ID NO: 81318 - protein, 8 aa, Dengue virus
TIISLIAA

SEQ ID NO: 81319 - protein, 8 aa, Dengue virus
ADFGFYQV

SEQ ID NO: 81320 - protein, 8 aa, Dengue virus
FGFYQVKA

SEQ ID NO: 81321 - protein, 8 aa, Dengue virus
GFYQVKAE

SEQ ID NO: 81322 - protein, 8 aa, Dengue virus
FYQVKTEI

SEQ ID NO: 81323 - protein, 8 aa, Dengue virus
YQVKAETT

SEQ ID NO: 81324 - protein, 8 aa, Dengue virus
QVKTEITI

SEQ ID NO: 81325 - protein, 8 aa, Dengue virus
VKAETTIL

SEQ ID NO: 81326 - protein, 8 aa, Dengue virus
TASLAMLL

SEQ ID NO: 81327 - protein, 8 aa, Dengue virus
TLSTGPAL

SEQ ID NO: 81328 - protein, 8 aa, Dengue virus
LATGPTLT

SEQ ID NO: 81329 - protein, 8 aa, Dengue virus
STGPALTL

SEQ ID NO: 81330 - protein, 8 aa, Dengue virus
TGPALTLW

SEQ ID NO: 81331 - protein, 8 aa, Dengue virus
GPALTLWE

SEQ ID NO: 81332 - protein, 8 aa, Dengue virus
PALTLWEG

SEQ ID NO: 81333 - protein, 8 aa, Dengue virus
ALTLWEGG

SEQ ID NO: 81334 - protein, 8 aa, Dengue virus
SLIKNTQT

SEQ ID NO: 81335 - protein, 8 aa, Dengue virus
LIKNAQAP

SEQ ID NO: 81336 - protein, 8 aa, Dengue virus
IKNAQAPR

SEQ ID NO: 81337 - protein, 8 aa, Dengue virus
KNTQTPRR

SEQ ID NO: 81338 - protein, 8 aa, Dengue virus
NTQTPRRG

SEQ ID NO: 81339 - protein, 8 aa, Dengue virus
TQTPRRGT

SEQ ID NO: 81340 - protein, 8 aa, Dengue virus
ALRDGSKT

SEQ ID NO: 81341 - protein, 8 aa, Dengue virus
LRDGSKTK

SEQ ID NO: 81342 - protein, 8 aa, Dengue virus
KDGSKIKY

SEQ ID NO: 81343 - protein, 8 aa, Dengue virus
LQRKYGGN

SEQ ID NO: 81344 - protein, 8 aa, Dengue virus
QRKYGGNL

SEQ ID NO: 81345 - protein, 8 aa, Dengue virus
RKHGGSLI

SEQ ID NO: 81346 - protein, 8 aa, Dengue virus
KHGGSLIR

SEQ ID NO: 81347 - protein, 8 aa, Dengue virus
YGGSLVRC

SEQ ID NO: 81348 - protein, 8 aa, Dengue virus
QPKLGTRV

SEQ ID NO: 81349 - protein, 8 aa, Dengue virus
PKPGTQMI

SEQ ID NO: 81350 - protein, 8 aa, Dengue virus
KLGTRVVM

SEQ ID NO: 81351 - protein, 8 aa, Dengue virus
LGTRVVMT

SEQ ID NO: 81352 - protein, 8 aa, Dengue virus
GTQMIMTT

SEQ ID NO: 81353 - protein, 8 aa, Dengue virus
TQMIMTTT

SEQ ID NO: 81354 - protein, 8 aa, Dengue virus
QMIMTTTA

SEQ ID NO: 81355 - protein, 8 aa, Dengue virus
LLGKKKTP

SEQ ID NO: 81356 - protein, 8 aa, Dengue virus
LGKKKTPR

SEQ ID NO: 81357 - protein, 8 aa, Dengue virus
GKKKTPRL

SEQ ID NO: 81358 - protein, 8 aa, Dengue virus
KKKTPRLC

SEQ ID NO: 81359 - protein, 8 aa, Dengue virus
KTPRLCTR

SEQ ID NO: 81360 - protein, 8 aa, Dengue virus
TPRLCTRE

SEQ ID NO: 81361 - protein, 8 aa, Dengue virus
MDYMPVMK

SEQ ID NO: 81362 - protein, 8 aa, Dengue virus
AMKRYSAH

SEQ ID NO: 81363 - protein, 8 aa, Dengue virus
MKRYSAHF

SEQ ID NO: 81364 - protein, 8 aa, Dengue virus
RRYSALSE

SEQ ID NO: 81365 - protein, 8 aa, Dengue virus
RYSAHFES

SEQ ID NO: 81366 - protein, 8 aa, Dengue virus
YSAHFESE

SEQ ID NO: 81367 - protein, 8 aa, Dengue virus
SAHFESEG

SEQ ID NO: 81368 - protein, 8 aa, Dengue virus
AHFESEGV

SEQ ID NO: 81369 - protein, 8 aa, Dengue virus
HFESEGVL

SEQ ID NO: 81370 - protein, 8 aa, Dengue virus
SKAINVLR

SEQ ID NO: 81371 - protein, 8 aa, Dengue virus
ILNRRRRT

SEQ ID NO: 81372 - protein, 8 aa, Dengue virus
LNGRRRST

SEQ ID NO: 81373 - protein, 8 aa, Dengue virus
RRRTAGMI

SEQ ID NO: 81374 - protein, 8 aa, Dengue virus
RRTAGMII

SEQ ID NO: 81375 - protein, 8 aa, Dengue virus
TVMAFHLT

SEQ ID NO: 81376 - protein, 8 aa, Dengue virus
VMAFHLTT

SEQ ID NO: 81377 - protein, 8 aa, Dengue virus
GKHGKEIK

SEQ ID NO: 81378 - protein, 8 aa, Dengue virus
TATITPRT

SEQ ID NO: 81379 - protein, 8 aa, Dengue virus
IKITPQSS

SEQ ID NO: 81380 - protein, 8 aa, Dengue virus
RSPSVEVQ

SEQ ID NO: 81381 - protein, 8 aa, Dengue virus
SPSAEVKL

SEQ ID NO: 81382 - protein, 8 aa, Dengue virus
EMILMRMK

SEQ ID NO: 81383 - protein, 8 aa, Dengue virus
WTAGADTL

SEQ ID NO: 81384 - protein, 8 aa, Dengue virus
TAGADTLE

SEQ ID NO: 81385 - protein, 8 aa, Dengue virus
DVNKERVV

SEQ ID NO: 81386 - protein, 8 aa, Dengue virus
MNKEKVVG

SEQ ID NO: 81387 - protein, 8 aa, Dengue virus
KVIGRVIS

SEQ ID NO: 81388 - protein, 8 aa, Dengue virus
VIGRIISS

SEQ ID NO: 81389 - protein, 8 aa, Dengue virus
GRIISSIP

SEQ ID NO: 81390 - protein, 8 aa, Dengue virus
ISSIPLAE

SEQ ID NO: 81391 - protein, 8 aa, Dengue virus
PIVTEKDS

SEQ ID NO: 81392 - protein, 8 aa, Dengue virus
AEYTNSVT

SEQ ID NO: 81393 - protein, 8 aa, Dengue virus
TEKDSPVN

SEQ ID NO: 81394 - protein, 8 aa, Dengue virus
EKDSPVNI

SEQ ID NO: 81395 - protein, 8 aa, Dengue virus
YIIIGVGD

SEQ ID NO: 81396 - protein, 8 aa, Dengue virus
IVIGAGDS

SEQ ID NO: 81397 - protein, 8 aa, Dengue virus
IIGVGDSA

SEQ ID NO: 81398 - protein, 8 aa, Dengue virus
MKILIGVI

SEQ ID NO: 81399 - protein, 8 aa, Dengue virus
GFTVRADM

SEQ ID NO: 81400 - protein, 8 aa, Dengue virus
FTVQADVG

SEQ ID NO: 81401 - protein, 8 aa, Dengue virus
TVQADVGC

SEQ ID NO: 81402 - protein, 8 aa, Dengue virus
GCVVSWTG

SEQ ID NO: 81403 - protein, 8 aa, Dengue virus
SWTGKELK

SEQ ID NO: 81404 - protein, 8 aa, Dengue virus
WTGKELKC

SEQ ID NO: 81405 - protein, 8 aa, Dengue virus
TGKELKCG

SEQ ID NO: 81406 - protein, 8 aa, Dengue virus
TKGKRTLT

SEQ ID NO: 81407 - protein, 8 aa, Dengue virus
KRTLTPPV

SEQ ID NO: 81408 - protein, 8 aa, Dengue virus
LAPPASDL

SEQ ID NO: 81409 - protein, 8 aa, Dengue virus
APPASDLK

SEQ ID NO: 81410 - protein, 8 aa, Dengue virus
IFAPEARN

SEQ ID NO: 81411 - protein, 8 aa, Dengue virus
PEVRNSTF

SEQ ID NO: 81412 - protein, 8 aa, Dengue virus
EARNNTFL

SEQ ID NO: 81413 - protein, 8 aa, Dengue virus
TTVTVQED

SEQ ID NO: 81414 - protein, 8 aa, Dengue virus
TVTVQEDC

SEQ ID NO: 81415 - protein, 8 aa, Dengue virus
REDCDHRG

SEQ ID NO: 81416 - protein, 8 aa, Dengue virus
NMVRSQVT

SEQ ID NO: 81417 - protein, 8 aa, Dengue virus
MVRSQVTA

SEQ ID NO: 81418 - protein, 8 aa, Dengue virus
VRSQVTAG

SEQ ID NO: 81419 - protein, 8 aa, Dengue virus
AGQGTPET

SEQ ID NO: 81420 - protein, 8 aa, Dengue virus
GQGPSETF

SEQ ID NO: 81421 - protein, 8 aa, Dengue virus
GTPETFSM

SEQ ID NO: 81422 - protein, 8 aa, Dengue virus
HMILVVVA

SEQ ID NO: 81423 - protein, 8 aa, Dengue virus
MILVVVAT

SEQ ID NO: 81424 - protein, 8 aa, Dengue virus
TTFCAIIL

SEQ ID NO: 81425 - protein, 8 aa, Dengue virus
RIGGQVHL

SEQ ID NO: 81426 - protein, 8 aa, Dengue virus
VGGQTHLA

SEQ ID NO: 81427 - protein, 8 aa, Dengue virus
VTQFDDTQ

SEQ ID NO: 81428 - protein, 8 aa, Dengue virus
VHFDNAQL

SEQ ID NO: 81429 - protein, 8 aa, Dengue virus
HFDNAQLG

SEQ ID NO: 81430 - protein, 8 aa, Dengue virus
LTFIKTTM

SEQ ID NO: 81431 - protein, 8 aa, Dengue virus
FYQEKPET

SEQ ID NO: 81432 - protein, 8 aa, Dengue virus
YQEKPETT

SEQ ID NO: 81433 - protein, 8 aa, Dengue virus
QVKAETTI

SEQ ID NO: 81434 - protein, 8 aa, Dengue virus
VKTEITIL

SEQ ID NO: 81435 - protein, 8 aa, Dengue virus
RDGSKTKH

SEQ ID NO: 81436 - protein, 8 aa, Dengue virus
RKYGGSLV

SEQ ID NO: 81437 - protein, 8 aa, Dengue virus
KYGGSLVR

SEQ ID NO: 81438 - protein, 8 aa, Dengue virus
PKLGTRVV

SEQ ID NO: 81439 - protein, 8 aa, Dengue virus
KPGTQMIM

SEQ ID NO: 81440 - protein, 8 aa, Dengue virus
PGTQMIMT

SEQ ID NO: 81441 - protein, 8 aa, Dengue virus
KKPRLCTR

SEQ ID NO: 81442 - protein, 8 aa, Dengue virus
NPRLCTKE

SEQ ID NO: 81443 - protein, 8 aa, Dengue virus
VMKRYSAH

SEQ ID NO: 81444 - protein, 8 aa, Dengue virus
MKRYSALS

SEQ ID NO: 81445 - protein, 8 aa, Dengue virus
KRYSALSE

SEQ ID NO: 81446 - protein, 8 aa, Dengue virus
RYSAPSEN

SEQ ID NO: 81447 - protein, 8 aa, Dengue virus
YSAPSENE

SEQ ID NO: 81448 - protein, 8 aa, Dengue virus
SAPSENEG

SEQ ID NO: 81449 - protein, 8 aa, Dengue virus
APSENEGV

SEQ ID NO: 81450 - protein, 8 aa, Dengue virus
PSENEGVL

SEQ ID NO: 81451 - protein, 9 aa, Dengue virus
MNQRKKVVR

SEQ ID NO: 81452 - protein, 9 aa, Dengue virus
NQRKKVVRP

SEQ ID NO: 81453 - protein, 9 aa, Dengue virus
QRKKVVRPP

SEQ ID NO: 81454 - protein, 9 aa, Dengue virus
RKKVVRPPF

SEQ ID NO: 81455 - protein, 9 aa, Dengue virus
KKVVRPPFN

SEQ ID NO: 81456 - protein, 9 aa, Dengue virus
KVVRPPFNM

SEQ ID NO: 81457 - protein, 9 aa, Dengue virus
VVRPPFNML

SEQ ID NO: 81458 - protein, 9 aa, Dengue virus
VRPPFNMLK

SEQ ID NO: 81459 - protein, 9 aa, Dengue virus
RPPFNMLKR

SEQ ID NO: 81460 - protein, 9 aa, Dengue virus
PPFNMLKRE

SEQ ID NO: 81461 - protein, 9 aa, Dengue virus
PFNMLKRER

SEQ ID NO: 81462 - protein, 9 aa, Dengue virus
FNMLKRERN

SEQ ID NO: 81463 - protein, 9 aa, Dengue virus
NMLKRERNR

SEQ ID NO: 81464 - protein, 9 aa, Dengue virus
MLKRERNRV

SEQ ID NO: 81465 - protein, 9 aa, Dengue virus
LKRERNRVS

SEQ ID NO: 81466 - protein, 9 aa, Dengue virus
KRERNRVST

SEQ ID NO: 81467 - protein, 9 aa, Dengue virus
RERNRVSTP

SEQ ID NO: 81468 - protein, 9 aa, Dengue virus
ERNRVSTPQ

SEQ ID NO: 81469 - protein, 9 aa, Dengue virus
RNRVSTPQG

SEQ ID NO: 81470 - protein, 9 aa, Dengue virus
NRVSTPQGL

SEQ ID NO: 81471 - protein, 9 aa, Dengue virus
RVSTPQGLV

SEQ ID NO: 81472 - protein, 9 aa, Dengue virus
VSTPQGLVK

SEQ ID NO: 81473 - protein, 9 aa, Dengue virus
STPQGLVKR

SEQ ID NO: 81474 - protein, 9 aa, Dengue virus
TPQGLVKRF

SEQ ID NO: 81475 - protein, 9 aa, Dengue virus
PQGLVKRFS

SEQ ID NO: 81476 - protein, 9 aa, Dengue virus
QGLVKRFST

SEQ ID NO: 81477 - protein, 9 aa, Dengue virus
GLVKRFSTG

SEQ ID NO: 81478 - protein, 9 aa, Dengue virus
LVKRFSTGL

SEQ ID NO: 81479 - protein, 9 aa, Dengue virus
VKRFSTGLF

SEQ ID NO: 81480 - protein, 9 aa, Dengue virus
KRFSTGLFS

SEQ ID NO: 81481 - protein, 9 aa, Dengue virus
RFSTGLFSG

SEQ ID NO: 81482 - protein, 9 aa, Dengue virus
FSTGLFSGK

SEQ ID NO: 81483 - protein, 9 aa, Dengue virus
STGLFSGKG

SEQ ID NO: 81484 - protein, 9 aa, Dengue virus
TGLFSGKGP

SEQ ID NO: 81485 - protein, 9 aa, Dengue virus
GLFSGKGPL

SEQ ID NO: 81486 - protein, 9 aa, Dengue virus
LFSGKGPLR

SEQ ID NO: 81487 - protein, 9 aa, Dengue virus
FSGKGPLRM

SEQ ID NO: 81488 - protein, 9 aa, Dengue virus
SGKGPLRMV

SEQ ID NO: 81489 - protein, 9 aa, Dengue virus
GKGPLRMVL

SEQ ID NO: 81490 - protein, 9 aa, Dengue virus
KGPLRMVLA

SEQ ID NO: 81491 - protein, 9 aa, Dengue virus
GPLRMVLAF

SEQ ID NO: 81492 - protein, 9 aa, Dengue virus
PLRMVLAFI

SEQ ID NO: 81493 - protein, 9 aa, Dengue virus
LRMVLAFIT

SEQ ID NO: 81494 - protein, 9 aa, Dengue virus
RMVLAFITF

SEQ ID NO: 81495 - protein, 9 aa, Dengue virus
MVLAFITFL

SEQ ID NO: 81496 - protein, 9 aa, Dengue virus
VLAFITFLR

SEQ ID NO: 81497 - protein, 9 aa, Dengue virus
LAFITFLRV

SEQ ID NO: 81498 - protein, 9 aa, Dengue virus
AFITFLRVL

SEQ ID NO: 81499 - protein, 9 aa, Dengue virus
FITFLRVLS

SEQ ID NO: 81500 - protein, 9 aa, Dengue virus
ITFLRVLSI

SEQ ID NO: 81501 - protein, 9 aa, Dengue virus
TFLRVLSIP

SEQ ID NO: 81502 - protein, 9 aa, Dengue virus
FLRVLSIPP

SEQ ID NO: 81503 - protein, 9 aa, Dengue virus
LRVLSIPPT

SEQ ID NO: 81504 - protein, 9 aa, Dengue virus
RVLSIPPTA

SEQ ID NO: 81505 - protein, 9 aa, Dengue virus
VLSIPPTAG

SEQ ID NO: 81506 - protein, 9 aa, Dengue virus
LSIPPTAGI

SEQ ID NO: 81507 - protein, 9 aa, Dengue virus
SIPPTAGIL

SEQ ID NO: 81508 - protein, 9 aa, Dengue virus
IPPTAGILK

SEQ ID NO: 81509 - protein, 9 aa, Dengue virus
PPTAGILKR

SEQ ID NO: 81510 - protein, 9 aa, Dengue virus
PTAGILKRW

SEQ ID NO: 81511 - protein, 9 aa, Dengue virus
TAGILKRWG

SEQ ID NO: 81512 - protein, 9 aa, Dengue virus
AGILKRWGQ

SEQ ID NO: 81513 - protein, 9 aa, Dengue virus
GILKRWGQL

SEQ ID NO: 81514 - protein, 9 aa, Dengue virus
ILKRWGQLK

SEQ ID NO: 81515 - protein, 9 aa, Dengue virus
LKRWGQLKK

SEQ ID NO: 81516 - protein, 9 aa, Dengue virus
KRWGQLKKN

SEQ ID NO: 81517 - protein, 9 aa, Dengue virus
RWGQLKKNK

SEQ ID NO: 81518 - protein, 9 aa, Dengue virus
WGQLKKNKA

SEQ ID NO: 81519 - protein, 9 aa, Dengue virus
GQLKKNKAI

SEQ ID NO: 81520 - protein, 9 aa, Dengue virus
QLKKNKAIK

SEQ ID NO: 81521 - protein, 9 aa, Dengue virus
LKKNKAIKI

SEQ ID NO: 81522 - protein, 9 aa, Dengue virus
KKNKAIKIL

SEQ ID NO: 81523 - protein, 9 aa, Dengue virus
KNKAIKILI

SEQ ID NO: 81524 - protein, 9 aa, Dengue virus
NKAIKILIG

SEQ ID NO: 81525 - protein, 9 aa, Dengue virus
KAIKILIGF

SEQ ID NO: 81526 - protein, 9 aa, Dengue virus
AIKILIGFR

SEQ ID NO: 81527 - protein, 9 aa, Dengue virus
IKILIGFRK

SEQ ID NO: 81528 - protein, 9 aa, Dengue virus
KILIGFRKE

SEQ ID NO: 81529 - protein, 9 aa, Dengue virus
ILIGFRKEI

SEQ ID NO: 81530 - protein, 9 aa, Dengue virus
LIGFRKEIG

SEQ ID NO: 81531 - protein, 9 aa, Dengue virus
IGFRKEIGR

SEQ ID NO: 81532 - protein, 9 aa, Dengue virus
GFRKEIGRM

SEQ ID NO: 81533 - protein, 9 aa, Dengue virus
FRKEIGRML

SEQ ID NO: 81534 - protein, 9 aa, Dengue virus
RKEIGRMLN

SEQ ID NO: 81535 - protein, 9 aa, Dengue virus
KEIGRMLNI

SEQ ID NO: 81536 - protein, 9 aa, Dengue virus
EIGRMLNIL

SEQ ID NO: 81537 - protein, 9 aa, Dengue virus
IGRMLNILN

SEQ ID NO: 81538 - protein, 9 aa, Dengue virus
GRMLNILNG

SEQ ID NO: 81539 - protein, 9 aa, Dengue virus
RMLNILNGR

SEQ ID NO: 81540 - protein, 9 aa, Dengue virus
MLNILNGRK

SEQ ID NO: 81541 - protein, 9 aa, Dengue virus
LNILNGRKR

SEQ ID NO: 81542 - protein, 9 aa, Dengue virus
NILNGRKRS

SEQ ID NO: 81543 - protein, 9 aa, Dengue virus
ILNGRKRST

SEQ ID NO: 81544 - protein, 9 aa, Dengue virus
RKRSTITLL

SEQ ID NO: 81545 - protein, 9 aa, Dengue virus
KRSTITLLC

SEQ ID NO: 81546 - protein, 9 aa, Dengue virus
RSTITLLCL

SEQ ID NO: 81547 - protein, 9 aa, Dengue virus
STITLLCLI

SEQ ID NO: 81548 - protein, 9 aa, Dengue virus
TITLLCLIP

SEQ ID NO: 81549 - protein, 9 aa, Dengue virus
ITLLCLIPT

SEQ ID NO: 81550 - protein, 9 aa, Dengue virus
TLLCLIPTV

SEQ ID NO: 81551 - protein, 9 aa, Dengue virus
LLCLIPTVM

SEQ ID NO: 81552 - protein, 9 aa, Dengue virus
LCLIPTVMA

SEQ ID NO: 81553 - protein, 9 aa, Dengue virus
CLIPTVMAF

SEQ ID NO: 81554 - protein, 9 aa, Dengue virus
LIPTVMAFH

SEQ ID NO: 81555 - protein, 9 aa, Dengue virus
IPTVMAFHL

SEQ ID NO: 81556 - protein, 9 aa, Dengue virus
PTVMAFHLS

SEQ ID NO: 81557 - protein, 9 aa, Dengue virus
TVMAFHLST

SEQ ID NO: 81558 - protein, 9 aa, Dengue virus
VMAFHLSTR

SEQ ID NO: 81559 - protein, 9 aa, Dengue virus
MAFHLSTRD

SEQ ID NO: 81560 - protein, 9 aa, Dengue virus
AFHLSTRDG

SEQ ID NO: 81561 - protein, 9 aa, Dengue virus
FHLSTRDGE

SEQ ID NO: 81562 - protein, 9 aa, Dengue virus
HLSTRDGEP

SEQ ID NO: 81563 - protein, 9 aa, Dengue virus
LSTRDGEPL

SEQ ID NO: 81564 - protein, 9 aa, Dengue virus
STRDGEPLM

SEQ ID NO: 81565 - protein, 9 aa, Dengue virus
TRDGEPLMI

SEQ ID NO: 81566 - protein, 9 aa, Dengue virus
RDGEPLMIV

SEQ ID NO: 81567 - protein, 9 aa, Dengue virus
DGEPLMIVA

SEQ ID NO: 81568 - protein, 9 aa, Dengue virus
GEPLMIVAK

SEQ ID NO: 81569 - protein, 9 aa, Dengue virus
EPLMIVAKH

SEQ ID NO: 81570 - protein, 9 aa, Dengue virus
PLMIVAKHE

SEQ ID NO: 81571 - protein, 9 aa, Dengue virus
LMIVAKHER

SEQ ID NO: 81572 - protein, 9 aa, Dengue virus
MIVAKHERG

SEQ ID NO: 81573 - protein, 9 aa, Dengue virus
IVAKHERGR

SEQ ID NO: 81574 - protein, 9 aa, Dengue virus
VAKHERGRP

SEQ ID NO: 81575 - protein, 9 aa, Dengue virus
AKHERGRPL

SEQ ID NO: 81576 - protein, 9 aa, Dengue virus
KHERGRPLL

SEQ ID NO: 81577 - protein, 9 aa, Dengue virus
HERGRPLLF

SEQ ID NO: 81578 - protein, 9 aa, Dengue virus
ERGRPLLFK

SEQ ID NO: 81579 - protein, 9 aa, Dengue virus
RGRPLLFKT

SEQ ID NO: 81580 - protein, 9 aa, Dengue virus
GRPLLFKTT

SEQ ID NO: 81581 - protein, 9 aa, Dengue virus
RPLLFKTTE

SEQ ID NO: 81582 - protein, 9 aa, Dengue virus
PLLFKTTEG

SEQ ID NO: 81583 - protein, 9 aa, Dengue virus
LLFKTTEGI

SEQ ID NO: 81584 - protein, 9 aa, Dengue virus
LFKTTEGIN

SEQ ID NO: 81585 - protein, 9 aa, Dengue virus
FKTTEGINK

SEQ ID NO: 81586 - protein, 9 aa, Dengue virus
KTTEGINKC

SEQ ID NO: 81587 - protein, 9 aa, Dengue virus
TTEGINKCT

SEQ ID NO: 81588 - protein, 9 aa, Dengue virus
TEGINKCTL

SEQ ID NO: 81589 - protein, 9 aa, Dengue virus
EGINKCTLI

SEQ ID NO: 81590 - protein, 9 aa, Dengue virus
GINKCTLIA

SEQ ID NO: 81591 - protein, 9 aa, Dengue virus
INKCTLIAM

SEQ ID NO: 81592 - protein, 9 aa, Dengue virus
NKCTLIAMD

SEQ ID NO: 81593 - protein, 9 aa, Dengue virus
KCTLIAMDL

SEQ ID NO: 81594 - protein, 9 aa, Dengue virus
CTLIAMDLG

SEQ ID NO: 81595 - protein, 9 aa, Dengue virus
TLIAMDLGE

SEQ ID NO: 81596 - protein, 9 aa, Dengue virus
LIAMDLGEM

SEQ ID NO: 81597 - protein, 9 aa, Dengue virus
IAMDLGEMC

SEQ ID NO: 81598 - protein, 9 aa, Dengue virus
AMDLGEMCE

SEQ ID NO: 81599 - protein, 9 aa, Dengue virus
MDLGEMCED

SEQ ID NO: 81600 - protein, 9 aa, Dengue virus
DLGEMCEDT

SEQ ID NO: 81601 - protein, 9 aa, Dengue virus
LGEMCEDTV

SEQ ID NO: 81602 - protein, 9 aa, Dengue virus
GEMCEDTVT

SEQ ID NO: 81603 - protein, 9 aa, Dengue virus
EMCEDTVTY

SEQ ID NO: 81604 - protein, 9 aa, Dengue virus
MCEDTVTYK

SEQ ID NO: 81605 - protein, 9 aa, Dengue virus
CEDTVTYKC

SEQ ID NO: 81606 - protein, 9 aa, Dengue virus
EDTVTYKCP

SEQ ID NO: 81607 - protein, 9 aa, Dengue virus
DTVTYKCPL

SEQ ID NO: 81608 - protein, 9 aa, Dengue virus
TVTYKCPLL

SEQ ID NO: 81609 - protein, 9 aa, Dengue virus
VTYKCPLLV

SEQ ID NO: 81610 - protein, 9 aa, Dengue virus
TYKCPLLVN

SEQ ID NO: 81611 - protein, 9 aa, Dengue virus
YKCPLLVNT

SEQ ID NO: 81612 - protein, 9 aa, Dengue virus
KCPLLVNTE

SEQ ID NO: 81613 - protein, 9 aa, Dengue virus
CPLLVNTEP

SEQ ID NO: 81614 - protein, 9 aa, Dengue virus
PLLVNTEPE

SEQ ID NO: 81615 - protein, 9 aa, Dengue virus
LLVNTEPED

SEQ ID NO: 81616 - protein, 9 aa, Dengue virus
LVNTEPEDI

SEQ ID NO: 81617 - protein, 9 aa, Dengue virus
VNTEPEDID

SEQ ID NO: 81618 - protein, 9 aa, Dengue virus
NTEPEDIDC

SEQ ID NO: 81619 - protein, 9 aa, Dengue virus
TEPEDIDCW

SEQ ID NO: 81620 - protein, 9 aa, Dengue virus
EPEDIDCWC

SEQ ID NO: 81621 - protein, 9 aa, Dengue virus
PEDIDCWCN

SEQ ID NO: 81622 - protein, 9 aa, Dengue virus
EDIDCWCNL

SEQ ID NO: 81623 - protein, 9 aa, Dengue virus
DIDCWCNLT

SEQ ID NO: 81624 - protein, 9 aa, Dengue virus
IDCWCNLTS

SEQ ID NO: 81625 - protein, 9 aa, Dengue virus
DCWCNLTST

SEQ ID NO: 81626 - protein, 9 aa, Dengue virus
CWCNLTSTW

SEQ ID NO: 81627 - protein, 9 aa, Dengue virus
WCNLTSTWV

SEQ ID NO: 81628 - protein, 9 aa, Dengue virus
CNLTSTWVM

SEQ ID NO: 81629 - protein, 9 aa, Dengue virus
NLTSTWVMY

SEQ ID NO: 81630 - protein, 9 aa, Dengue virus
LTSTWVMYG

SEQ ID NO: 81631 - protein, 9 aa, Dengue virus
TSTWVMYGT

SEQ ID NO: 81632 - protein, 9 aa, Dengue virus
STWVMYGTC

SEQ ID NO: 81633 - protein, 9 aa, Dengue virus
TWVMYGTCT

SEQ ID NO: 81634 - protein, 9 aa, Dengue virus
WVMYGTCTQ

SEQ ID NO: 81635 - protein, 9 aa, Dengue virus
VMYGTCTQS

SEQ ID NO: 81636 - protein, 9 aa, Dengue virus
MYGTCTQSG

SEQ ID NO: 81637 - protein, 9 aa, Dengue virus
YGTCTQSGE

SEQ ID NO: 81638 - protein, 9 aa, Dengue virus
GTCTQSGER

SEQ ID NO: 81639 - protein, 9 aa, Dengue virus
TCTQSGERR

SEQ ID NO: 81640 - protein, 9 aa, Dengue virus
CTQSGERRR

SEQ ID NO: 81641 - protein, 9 aa, Dengue virus
TQSGERRRE

SEQ ID NO: 81642 - protein, 9 aa, Dengue virus
QSGERRREK

SEQ ID NO: 81643 - protein, 9 aa, Dengue virus
SGERRREKR

SEQ ID NO: 81644 - protein, 9 aa, Dengue virus
GERRREKRS

SEQ ID NO: 81645 - protein, 9 aa, Dengue virus
ERRREKRSV

SEQ ID NO: 81646 - protein, 9 aa, Dengue virus
RRREKRSVA

SEQ ID NO: 81647 - protein, 9 aa, Dengue virus
RREKRSVAL

SEQ ID NO: 81648 - protein, 9 aa, Dengue virus
REKRSVALT

SEQ ID NO: 81649 - protein, 9 aa, Dengue virus
EKRSVALTP

SEQ ID NO: 81650 - protein, 9 aa, Dengue virus
KRSVALTPH

SEQ ID NO: 81651 - protein, 9 aa, Dengue virus
RSVALTPHS

SEQ ID NO: 81652 - protein, 9 aa, Dengue virus
SVALTPHSG

SEQ ID NO: 81653 - protein, 9 aa, Dengue virus
VALTPHSGM

SEQ ID NO: 81654 - protein, 9 aa, Dengue virus
ALTPHSGMG

SEQ ID NO: 81655 - protein, 9 aa, Dengue virus
LTPHSGMGL

SEQ ID NO: 81656 - protein, 9 aa, Dengue virus
TPHSGMGLE

SEQ ID NO: 81657 - protein, 9 aa, Dengue virus
PHSGMGLET

SEQ ID NO: 81658 - protein, 9 aa, Dengue virus
HSGMGLETR

SEQ ID NO: 81659 - protein, 9 aa, Dengue virus
SGMGLETRA

SEQ ID NO: 81660 - protein, 9 aa, Dengue virus
GMGLETRAE

SEQ ID NO: 81661 - protein, 9 aa, Dengue virus
MGLETRAET

SEQ ID NO: 81662 - protein, 9 aa, Dengue virus
GLETRAETW

SEQ ID NO: 81663 - protein, 9 aa, Dengue virus
LETRAETWM

SEQ ID NO: 81664 - protein, 9 aa, Dengue virus
ETRAETWMS

SEQ ID NO: 81665 - protein, 9 aa, Dengue virus
TRAETWMSS

SEQ ID NO: 81666 - protein, 9 aa, Dengue virus
RAETWMSSE

SEQ ID NO: 81667 - protein, 9 aa, Dengue virus
AETWMSSEG

SEQ ID NO: 81668 - protein, 9 aa, Dengue virus
ETWMSSEGA

SEQ ID NO: 81669 - protein, 9 aa, Dengue virus
TWMSSEGAW

SEQ ID NO: 81670 - protein, 9 aa, Dengue virus
WMSSEGAWK

SEQ ID NO: 81671 - protein, 9 aa, Dengue virus
MSSEGAWKH

SEQ ID NO: 81672 - protein, 9 aa, Dengue virus
SSEGAWKHA

SEQ ID NO: 81673 - protein, 9 aa, Dengue virus
SEGAWKHAQ

SEQ ID NO: 81674 - protein, 9 aa, Dengue virus
EGAWKHAQR

SEQ ID NO: 81675 - protein, 9 aa, Dengue virus
GAWKHAQRV

SEQ ID NO: 81676 - protein, 9 aa, Dengue virus
AWKHAQRVE

SEQ ID NO: 81677 - protein, 9 aa, Dengue virus
WKHAQRVES

SEQ ID NO: 81678 - protein, 9 aa, Dengue virus
KHAQRVESW

SEQ ID NO: 81679 - protein, 9 aa, Dengue virus
HAQRVESWI

SEQ ID NO: 81680 - protein, 9 aa, Dengue virus
AQRVESWIL

SEQ ID NO: 81681 - protein, 9 aa, Dengue virus
QRVESWILR

SEQ ID NO: 81682 - protein, 9 aa, Dengue virus
RVESWILRN

SEQ ID NO: 81683 - protein, 9 aa, Dengue virus
VESWILRNP

SEQ ID NO: 81684 - protein, 9 aa, Dengue virus
ESWILRNPG

SEQ ID NO: 81685 - protein, 9 aa, Dengue virus
SWILRNPGF

SEQ ID NO: 81686 - protein, 9 aa, Dengue virus
WILRNPGFA

SEQ ID NO: 81687 - protein, 9 aa, Dengue virus
ILRNPGFAL

SEQ ID NO: 81688 - protein, 9 aa, Dengue virus
LRNPGFALL

SEQ ID NO: 81689 - protein, 9 aa, Dengue virus
RNPGFALLA

SEQ ID NO: 81690 - protein, 9 aa, Dengue virus
NPGFALLAG

SEQ ID NO: 81691 - protein, 9 aa, Dengue virus
PGFALLAGF

SEQ ID NO: 81692 - protein, 9 aa, Dengue virus
GFALLAGFM

SEQ ID NO: 81693 - protein, 9 aa, Dengue virus
FALLAGFMA

SEQ ID NO: 81694 - protein, 9 aa, Dengue virus
ALLAGFMAY

SEQ ID NO: 81695 - protein, 9 aa, Dengue virus
LLAGFMAYM

SEQ ID NO: 81696 - protein, 9 aa, Dengue virus
LAGFMAYMI

SEQ ID NO: 81697 - protein, 9 aa, Dengue virus
AGFMAYMIG

SEQ ID NO: 81698 - protein, 9 aa, Dengue virus
GFMAYMIGQ

SEQ ID NO: 81699 - protein, 9 aa, Dengue virus
FMAYMIGQT

SEQ ID NO: 81700 - protein, 9 aa, Dengue virus
MAYMIGQTG

SEQ ID NO: 81701 - protein, 9 aa, Dengue virus
AYMIGQTGI

SEQ ID NO: 81702 - protein, 9 aa, Dengue virus
YMIGQTGIQ

SEQ ID NO: 81703 - protein, 9 aa, Dengue virus
MIGQTGIQR

SEQ ID NO: 81704 - protein, 9 aa, Dengue virus
IGQTGIQRT

SEQ ID NO: 81705 - protein, 9 aa, Dengue virus
GQTGIQRTV

SEQ ID NO: 81706 - protein, 9 aa, Dengue virus
QTGIQRTVF

SEQ ID NO: 81707 - protein, 9 aa, Dengue virus
TGIQRTVFF

SEQ ID NO: 81708 - protein, 9 aa, Dengue virus
GIQRTVFFV

SEQ ID NO: 81709 - protein, 9 aa, Dengue virus
IQRTVFFVL

SEQ ID NO: 81710 - protein, 9 aa, Dengue virus
QRTVFFVLM

SEQ ID NO: 81711 - protein, 9 aa, Dengue virus
RTVFFVLMM

SEQ ID NO: 81712 - protein, 9 aa, Dengue virus
TVFFVLMML

SEQ ID NO: 81713 - protein, 9 aa, Dengue virus
VFFVLMMLV

SEQ ID NO: 81714 - protein, 9 aa, Dengue virus
FFVLMMLVA

SEQ ID NO: 81715 - protein, 9 aa, Dengue virus
FVLMMLVAP

SEQ ID NO: 81716 - protein, 9 aa, Dengue virus
VLMMLVAPS

SEQ ID NO: 81717 - protein, 9 aa, Dengue virus
LMMLVAPSY

SEQ ID NO: 81718 - protein, 9 aa, Dengue virus
MMLVAPSYG

SEQ ID NO: 81719 - protein, 9 aa, Dengue virus
MLVAPSYGM

SEQ ID NO: 81720 - protein, 9 aa, Dengue virus
LVAPSYGMR

SEQ ID NO: 81721 - protein, 9 aa, Dengue virus
VAPSYGMRC

SEQ ID NO: 81722 - protein, 9 aa, Dengue virus
APSYGMRCV

SEQ ID NO: 81723 - protein, 9 aa, Dengue virus
PSYGMRCVG

SEQ ID NO: 81724 - protein, 9 aa, Dengue virus
SYGMRCVGV

SEQ ID NO: 81725 - protein, 9 aa, Dengue virus
YGMRCVGVG

SEQ ID NO: 81726 - protein, 9 aa, Dengue virus
GMRCVGVGN

SEQ ID NO: 81727 - protein, 9 aa, Dengue virus
MRCVGVGNR

SEQ ID NO: 81728 - protein, 9 aa, Dengue virus
RCVGVGNRD

SEQ ID NO: 81729 - protein, 9 aa, Dengue virus
CVGVGNRDF

SEQ ID NO: 81730 - protein, 9 aa, Dengue virus
VGVGNRDFV

SEQ ID NO: 81731 - protein, 9 aa, Dengue virus
GVGNRDFVE

SEQ ID NO: 81732 - protein, 9 aa, Dengue virus
VGNRDFVEG

SEQ ID NO: 81733 - protein, 9 aa, Dengue virus
GNRDFVEGV

SEQ ID NO: 81734 - protein, 9 aa, Dengue virus
NRDFVEGVS

SEQ ID NO: 81735 - protein, 9 aa, Dengue virus
RDFVEGVSG

SEQ ID NO: 81736 - protein, 9 aa, Dengue virus
DFVEGVSGG

SEQ ID NO: 81737 - protein, 9 aa, Dengue virus
FVEGVSGGA

SEQ ID NO: 81738 - protein, 9 aa, Dengue virus
VEGVSGGAW

SEQ ID NO: 81739 - protein, 9 aa, Dengue virus
EGVSGGAWV

SEQ ID NO: 81740 - protein, 9 aa, Dengue virus
GVSGGAWVD

SEQ ID NO: 81741 - protein, 9 aa, Dengue virus
VSGGAWVDL

SEQ ID NO: 81742 - protein, 9 aa, Dengue virus
SGGAWVDLV

SEQ ID NO: 81743 - protein, 9 aa, Dengue virus
GGAWVDLVL

SEQ ID NO: 81744 - protein, 9 aa, Dengue virus
GAWVDLVLE

SEQ ID NO: 81745 - protein, 9 aa, Dengue virus
AWVDLVLEH

SEQ ID NO: 81746 - protein, 9 aa, Dengue virus
WVDLVLEHG

SEQ ID NO: 81747 - protein, 9 aa, Dengue virus
VDLVLEHGG

SEQ ID NO: 81748 - protein, 9 aa, Dengue virus
DLVLEHGGC

SEQ ID NO: 81749 - protein, 9 aa, Dengue virus
LVLEHGGCV

SEQ ID NO: 81750 - protein, 9 aa, Dengue virus
VLEHGGCVT

SEQ ID NO: 81751 - protein, 9 aa, Dengue virus
LEHGGCVTT

SEQ ID NO: 81752 - protein, 9 aa, Dengue virus
EHGGCVTTM

SEQ ID NO: 81753 - protein, 9 aa, Dengue virus
HGGCVTTMA

SEQ ID NO: 81754 - protein, 9 aa, Dengue virus
GGCVTTMAQ

SEQ ID NO: 81755 - protein, 9 aa, Dengue virus
GCVTTMAQG

SEQ ID NO: 81756 - protein, 9 aa, Dengue virus
CVTTMAQGK

SEQ ID NO: 81757 - protein, 9 aa, Dengue virus
VTTMAQGKP

SEQ ID NO: 81758 - protein, 9 aa, Dengue virus
TTMAQGKPT

SEQ ID NO: 81759 - protein, 9 aa, Dengue virus
TMAQGKPTL

SEQ ID NO: 81760 - protein, 9 aa, Dengue virus
MAQGKPTLD

SEQ ID NO: 81761 - protein, 9 aa, Dengue virus
AQGKPTLDF

SEQ ID NO: 81762 - protein, 9 aa, Dengue virus
QGKPTLDFE

SEQ ID NO: 81763 - protein, 9 aa, Dengue virus
GKPTLDFEL

SEQ ID NO: 81764 - protein, 9 aa, Dengue virus
KPTLDFELT

SEQ ID NO: 81765 - protein, 9 aa, Dengue virus
PTLDFELTK

SEQ ID NO: 81766 - protein, 9 aa, Dengue virus
TLDFELTKT

SEQ ID NO: 81767 - protein, 9 aa, Dengue virus
LDFELTKTT

SEQ ID NO: 81768 - protein, 9 aa, Dengue virus
DFELTKTTA

SEQ ID NO: 81769 - protein, 9 aa, Dengue virus
FELTKTTAK

SEQ ID NO: 81770 - protein, 9 aa, Dengue virus
ELTKTTAKE

SEQ ID NO: 81771 - protein, 9 aa, Dengue virus
LTKTTAKEV

SEQ ID NO: 81772 - protein, 9 aa, Dengue virus
TKTTAKEVA

SEQ ID NO: 81773 - protein, 9 aa, Dengue virus
KTTAKEVAL

SEQ ID NO: 81774 - protein, 9 aa, Dengue virus
TTAKEVALL

SEQ ID NO: 81775 - protein, 9 aa, Dengue virus
TAKEVALLR

SEQ ID NO: 81776 - protein, 9 aa, Dengue virus
AKEVALLRT

SEQ ID NO: 81777 - protein, 9 aa, Dengue virus
KEVALLRTY

SEQ ID NO: 81778 - protein, 9 aa, Dengue virus
EVALLRTYC

SEQ ID NO: 81779 - protein, 9 aa, Dengue virus
VALLRTYCI

SEQ ID NO: 81780 - protein, 9 aa, Dengue virus
ALLRTYCIE

SEQ ID NO: 81781 - protein, 9 aa, Dengue virus
LLRTYCIEA

SEQ ID NO: 81782 - protein, 9 aa, Dengue virus
LRTYCIEAS

SEQ ID NO: 81783 - protein, 9 aa, Dengue virus
RTYCIEASI

SEQ ID NO: 81784 - protein, 9 aa, Dengue virus
TYCIEASIS

SEQ ID NO: 81785 - protein, 9 aa, Dengue virus
YCIEASISN

SEQ ID NO: 81786 - protein, 9 aa, Dengue virus
CIEASISNI

SEQ ID NO: 81787 - protein, 9 aa, Dengue virus
IEASISNIT

SEQ ID NO: 81788 - protein, 9 aa, Dengue virus
EASISNITT

SEQ ID NO: 81789 - protein, 9 aa, Dengue virus
ASISNITTA

SEQ ID NO: 81790 - protein, 9 aa, Dengue virus
SISNITTAT

SEQ ID NO: 81791 - protein, 9 aa, Dengue virus
ISNITTATR

SEQ ID NO: 81792 - protein, 9 aa, Dengue virus
SNITTATRC

SEQ ID NO: 81793 - protein, 9 aa, Dengue virus
NITTATRCP

SEQ ID NO: 81794 - protein, 9 aa, Dengue virus
ITTATRCPT

SEQ ID NO: 81795 - protein, 9 aa, Dengue virus
TTATRCPTQ

SEQ ID NO: 81796 - protein, 9 aa, Dengue virus
TATRCPTQG

SEQ ID NO: 81797 - protein, 9 aa, Dengue virus
ATRCPTQGE

SEQ ID NO: 81798 - protein, 9 aa, Dengue virus
TRCPTQGEP

SEQ ID NO: 81799 - protein, 9 aa, Dengue virus
RCPTQGEPY

SEQ ID NO: 81800 - protein, 9 aa, Dengue virus
CPTQGEPYL

SEQ ID NO: 81801 - protein, 9 aa, Dengue virus
PTQGEPYLK

SEQ ID NO: 81802 - protein, 9 aa, Dengue virus
TQGEPYLKE

SEQ ID NO: 81803 - protein, 9 aa, Dengue virus
QGEPYLKEE

SEQ ID NO: 81804 - protein, 9 aa, Dengue virus
GEPYLKEEQ

SEQ ID NO: 81805 - protein, 9 aa, Dengue virus
EPYLKEEQD

SEQ ID NO: 81806 - protein, 9 aa, Dengue virus
PYLKEEQDQ

SEQ ID NO: 81807 - protein, 9 aa, Dengue virus
YLKEEQDQQ

SEQ ID NO: 81808 - protein, 9 aa, Dengue virus
LKEEQDQQY

SEQ ID NO: 81809 - protein, 9 aa, Dengue virus
KEEQDQQYI

SEQ ID NO: 81810 - protein, 9 aa, Dengue virus
EEQDQQYIC

SEQ ID NO: 81811 - protein, 9 aa, Dengue virus
EQDQQYICR

SEQ ID NO: 81812 - protein, 9 aa, Dengue virus
QDQQYICRR

SEQ ID NO: 81813 - protein, 9 aa, Dengue virus
DQQYICRRD

SEQ ID NO: 81814 - protein, 9 aa, Dengue virus
QQYICRRDV

SEQ ID NO: 81815 - protein, 9 aa, Dengue virus
QYICRRDVV

SEQ ID NO: 81816 - protein, 9 aa, Dengue virus
YICRRDVVD

SEQ ID NO: 81817 - protein, 9 aa, Dengue virus
ICRRDVVDR

SEQ ID NO: 81818 - protein, 9 aa, Dengue virus
CRRDVVDRG

SEQ ID NO: 81819 - protein, 9 aa, Dengue virus
RRDVVDRGW

SEQ ID NO: 81820 - protein, 9 aa, Dengue virus
RDVVDRGWG

SEQ ID NO: 81821 - protein, 9 aa, Dengue virus
DVVDRGWGN

SEQ ID NO: 81822 - protein, 9 aa, Dengue virus
VVDRGWGNG

SEQ ID NO: 81823 - protein, 9 aa, Dengue virus
VDRGWGNGC

SEQ ID NO: 81824 - protein, 9 aa, Dengue virus
DRGWGNGCG

SEQ ID NO: 81825 - protein, 9 aa, Dengue virus
RGWGNGCGL

SEQ ID NO: 81826 - protein, 9 aa, Dengue virus
GWGNGCGLF

SEQ ID NO: 81827 - protein, 9 aa, Dengue virus
WGNGCGLFG

SEQ ID NO: 81828 - protein, 9 aa, Dengue virus
GNGCGLFGK

SEQ ID NO: 81829 - protein, 9 aa, Dengue virus
NGCGLFGKG

SEQ ID NO: 81830 - protein, 9 aa, Dengue virus
GCGLFGKGG

SEQ ID NO: 81831 - protein, 9 aa, Dengue virus
CGLFGKGGV

SEQ ID NO: 81832 - protein, 9 aa, Dengue virus
GLFGKGGVV

SEQ ID NO: 81833 - protein, 9 aa, Dengue virus
LFGKGGVVT

SEQ ID NO: 81834 - protein, 9 aa, Dengue virus
FGKGGVVTC

SEQ ID NO: 81835 - protein, 9 aa, Dengue virus
GKGGVVTCA

SEQ ID NO: 81836 - protein, 9 aa, Dengue virus
KGGVVTCAK

SEQ ID NO: 81837 - protein, 9 aa, Dengue virus
GGVVTCAKF

SEQ ID NO: 81838 - protein, 9 aa, Dengue virus
GVVTCAKFS

SEQ ID NO: 81839 - protein, 9 aa, Dengue virus
VVTCAKFSC

SEQ ID NO: 81840 - protein, 9 aa, Dengue virus
VTCAKFSCS

SEQ ID NO: 81841 - protein, 9 aa, Dengue virus
TCAKFSCSG

SEQ ID NO: 81842 - protein, 9 aa, Dengue virus
CAKFSCSGK

SEQ ID NO: 81843 - protein, 9 aa, Dengue virus
AKFSCSGKI

SEQ ID NO: 81844 - protein, 9 aa, Dengue virus
KFSCSGKIT

SEQ ID NO: 81845 - protein, 9 aa, Dengue virus
FSCSGKITG

SEQ ID NO: 81846 - protein, 9 aa, Dengue virus
SCSGKITGN

SEQ ID NO: 81847 - protein, 9 aa, Dengue virus
CSGKITGNL

SEQ ID NO: 81848 - protein, 9 aa, Dengue virus
SGKITGNLV

SEQ ID NO: 81849 - protein, 9 aa, Dengue virus
GKITGNLVQ

SEQ ID NO: 81850 - protein, 9 aa, Dengue virus
KITGNLVQI

SEQ ID NO: 81851 - protein, 9 aa, Dengue virus
ITGNLVQIE

SEQ ID NO: 81852 - protein, 9 aa, Dengue virus
TGNLVQIEN

SEQ ID NO: 81853 - protein, 9 aa, Dengue virus
GNLVQIENL

SEQ ID NO: 81854 - protein, 9 aa, Dengue virus
NLVQIENLE

SEQ ID NO: 81855 - protein, 9 aa, Dengue virus
LVQIENLEY

SEQ ID NO: 81856 - protein, 9 aa, Dengue virus
VQIENLEYT

SEQ ID NO: 81857 - protein, 9 aa, Dengue virus
QIENLEYTV

SEQ ID NO: 81858 - protein, 9 aa, Dengue virus
IENLEYTVV

SEQ ID NO: 81859 - protein, 9 aa, Dengue virus
ENLEYTVVV

SEQ ID NO: 81860 - protein, 9 aa, Dengue virus
NLEYTVVVT

SEQ ID NO: 81861 - protein, 9 aa, Dengue virus
LEYTVVVTV

SEQ ID NO: 81862 - protein, 9 aa, Dengue virus
EYTVVVTVH

SEQ ID NO: 81863 - protein, 9 aa, Dengue virus
YTVVVTVHN

SEQ ID NO: 81864 - protein, 9 aa, Dengue virus
TVVVTVHNG

SEQ ID NO: 81865 - protein, 9 aa, Dengue virus
VVVTVHNGD

SEQ ID NO: 81866 - protein, 9 aa, Dengue virus
VVTVHNGDT

SEQ ID NO: 81867 - protein, 9 aa, Dengue virus
VTVHNGDTH

SEQ ID NO: 81868 - protein, 9 aa, Dengue virus
TVHNGDTHA

SEQ ID NO: 81869 - protein, 9 aa, Dengue virus
VHNGDTHAV

SEQ ID NO: 81870 - protein, 9 aa, Dengue virus
HNGDTHAVG

SEQ ID NO: 81871 - protein, 9 aa, Dengue virus
NGDTHAVGN

SEQ ID NO: 81872 - protein, 9 aa, Dengue virus
GDTHAVGND

SEQ ID NO: 81873 - protein, 9 aa, Dengue virus
DTHAVGNDT

SEQ ID NO: 81874 - protein, 9 aa, Dengue virus
THAVGNDTS

SEQ ID NO: 81875 - protein, 9 aa, Dengue virus
HAVGNDTSN

SEQ ID NO: 81876 - protein, 9 aa, Dengue virus
AVGNDTSNH

SEQ ID NO: 81877 - protein, 9 aa, Dengue virus
VGNDTSNHG

SEQ ID NO: 81878 - protein, 9 aa, Dengue virus
GNDTSNHGV

SEQ ID NO: 81879 - protein, 9 aa, Dengue virus
NDTSNHGVT

SEQ ID NO: 81880 - protein, 9 aa, Dengue virus
DTSNHGVTA

SEQ ID NO: 81881 - protein, 9 aa, Dengue virus
TSNHGVTAT

SEQ ID NO: 81882 - protein, 9 aa, Dengue virus
SNHGVTATI

SEQ ID NO: 81883 - protein, 9 aa, Dengue virus
NHGVTATIT

SEQ ID NO: 81884 - protein, 9 aa, Dengue virus
HGVTATITP

SEQ ID NO: 81885 - protein, 9 aa, Dengue virus
GVTATITPR

SEQ ID NO: 81886 - protein, 9 aa, Dengue virus
VTATITPRS

SEQ ID NO: 81887 - protein, 9 aa, Dengue virus
TATITPRSP

SEQ ID NO: 81888 - protein, 9 aa, Dengue virus
ATITPRSPS

SEQ ID NO: 81889 - protein, 9 aa, Dengue virus
TITPRSPSV

SEQ ID NO: 81890 - protein, 9 aa, Dengue virus
ITPRSPSVE

SEQ ID NO: 81891 - protein, 9 aa, Dengue virus
TPRSPSVEV

SEQ ID NO: 81892 - protein, 9 aa, Dengue virus
PRSPSVEVK

SEQ ID NO: 81893 - protein, 9 aa, Dengue virus
RSPSVEVKL

SEQ ID NO: 81894 - protein, 9 aa, Dengue virus
SPSVEVKLP

SEQ ID NO: 81895 - protein, 9 aa, Dengue virus
PSVEVKLPD

SEQ ID NO: 81896 - protein, 9 aa, Dengue virus
SVEVKLPDY

SEQ ID NO: 81897 - protein, 9 aa, Dengue virus
VEVKLPDYG

SEQ ID NO: 81898 - protein, 9 aa, Dengue virus
EVKLPDYGE

SEQ ID NO: 81899 - protein, 9 aa, Dengue virus
VKLPDYGEL

SEQ ID NO: 81900 - protein, 9 aa, Dengue virus
KLPDYGELT

SEQ ID NO: 81901 - protein, 9 aa, Dengue virus
LPDYGELTL

SEQ ID NO: 81902 - protein, 9 aa, Dengue virus
PDYGELTLD

SEQ ID NO: 81903 - protein, 9 aa, Dengue virus
DYGELTLDC

SEQ ID NO: 81904 - protein, 9 aa, Dengue virus
YGELTLDCE

SEQ ID NO: 81905 - protein, 9 aa, Dengue virus
GELTLDCEP

SEQ ID NO: 81906 - protein, 9 aa, Dengue virus
ELTLDCEPR

SEQ ID NO: 81907 - protein, 9 aa, Dengue virus
LTLDCEPRS

SEQ ID NO: 81908 - protein, 9 aa, Dengue virus
TLDCEPRSG

SEQ ID NO: 81909 - protein, 9 aa, Dengue virus
LDCEPRSGI

SEQ ID NO: 81910 - protein, 9 aa, Dengue virus
DCEPRSGID

SEQ ID NO: 81911 - protein, 9 aa, Dengue virus
CEPRSGIDF

SEQ ID NO: 81912 - protein, 9 aa, Dengue virus
EPRSGIDFN

SEQ ID NO: 81913 - protein, 9 aa, Dengue virus
PRSGIDFNE

SEQ ID NO: 81914 - protein, 9 aa, Dengue virus
RSGIDFNEM

SEQ ID NO: 81915 - protein, 9 aa, Dengue virus
SGIDFNEMI

SEQ ID NO: 81916 - protein, 9 aa, Dengue virus
GIDFNEMIL

SEQ ID NO: 81917 - protein, 9 aa, Dengue virus
IDFNEMILM

SEQ ID NO: 81918 - protein, 9 aa, Dengue virus
DFNEMILMK

SEQ ID NO: 81919 - protein, 9 aa, Dengue virus
FNEMILMKM

SEQ ID NO: 81920 - protein, 9 aa, Dengue virus
NEMILMKMK

SEQ ID NO: 81921 - protein, 9 aa, Dengue virus
MKKKTWLVH

SEQ ID NO: 81922 - protein, 9 aa, Dengue virus
KKKTWLVHK

SEQ ID NO: 81923 - protein, 9 aa, Dengue virus
KKTWLVHKQ

SEQ ID NO: 81924 - protein, 9 aa, Dengue virus
KTWLVHKQW

SEQ ID NO: 81925 - protein, 9 aa, Dengue virus
TWLVHKQWF

SEQ ID NO: 81926 - protein, 9 aa, Dengue virus
WLVHKQWFL

SEQ ID NO: 81927 - protein, 9 aa, Dengue virus
LVHKQWFLD

SEQ ID NO: 81928 - protein, 9 aa, Dengue virus
VHKQWFLDL

SEQ ID NO: 81929 - protein, 9 aa, Dengue virus
HKQWFLDLP

SEQ ID NO: 81930 - protein, 9 aa, Dengue virus
KQWFLDLPL

SEQ ID NO: 81931 - protein, 9 aa, Dengue virus
QWFLDLPLP

SEQ ID NO: 81932 - protein, 9 aa, Dengue virus
WFLDLPLPW

SEQ ID NO: 81933 - protein, 9 aa, Dengue virus
FLDLPLPWT

SEQ ID NO: 81934 - protein, 9 aa, Dengue virus
LDLPLPWTA

SEQ ID NO: 81935 - protein, 9 aa, Dengue virus
DLPLPWTAG

SEQ ID NO: 81936 - protein, 9 aa, Dengue virus
LPLPWTAGA

SEQ ID NO: 81937 - protein, 9 aa, Dengue virus
PLPWTAGAD

SEQ ID NO: 81938 - protein, 9 aa, Dengue virus
LPWTAGADT

SEQ ID NO: 81939 - protein, 9 aa, Dengue virus
PWTAGADTS

SEQ ID NO: 81940 - protein, 9 aa, Dengue virus
WTAGADTSE

SEQ ID NO: 81941 - protein, 9 aa, Dengue virus
TAGADTSEV

SEQ ID NO: 81942 - protein, 9 aa, Dengue virus
AGADTSEVH

SEQ ID NO: 81943 - protein, 9 aa, Dengue virus
GADTSEVHW

SEQ ID NO: 81944 - protein, 9 aa, Dengue virus
ADTSEVHWN

SEQ ID NO: 81945 - protein, 9 aa, Dengue virus
DTSEVHWNY

SEQ ID NO: 81946 - protein, 9 aa, Dengue virus
TSEVHWNYK

SEQ ID NO: 81947 - protein, 9 aa, Dengue virus
SEVHWNYKE

SEQ ID NO: 81948 - protein, 9 aa, Dengue virus
EVHWNYKER

SEQ ID NO: 81949 - protein, 9 aa, Dengue virus
VHWNYKERM

SEQ ID NO: 81950 - protein, 9 aa, Dengue virus
HWNYKERMV

SEQ ID NO: 81951 - protein, 9 aa, Dengue virus
WNYKERMVT

SEQ ID NO: 81952 - protein, 9 aa, Dengue virus
NYKERMVTF

SEQ ID NO: 81953 - protein, 9 aa, Dengue virus
YKERMVTFK

SEQ ID NO: 81954 - protein, 9 aa, Dengue virus
KERMVTFKV

SEQ ID NO: 81955 - protein, 9 aa, Dengue virus
ERMVTFKVP

SEQ ID NO: 81956 - protein, 9 aa, Dengue virus
RMVTFKVPH

SEQ ID NO: 81957 - protein, 9 aa, Dengue virus
MVTFKVPHA

SEQ ID NO: 81958 - protein, 9 aa, Dengue virus
VTFKVPHAK

SEQ ID NO: 81959 - protein, 9 aa, Dengue virus
TFKVPHAKR

SEQ ID NO: 81960 - protein, 9 aa, Dengue virus
FKVPHAKRQ

SEQ ID NO: 81961 - protein, 9 aa, Dengue virus
KVPHAKRQD

SEQ ID NO: 81962 - protein, 9 aa, Dengue virus
VPHAKRQDV

SEQ ID NO: 81963 - protein, 9 aa, Dengue virus
PHAKRQDVT

SEQ ID NO: 81964 - protein, 9 aa, Dengue virus
HAKRQDVTV

SEQ ID NO: 81965 - protein, 9 aa, Dengue virus
AKRQDVTVL

SEQ ID NO: 81966 - protein, 9 aa, Dengue virus
KRQDVTVLG

SEQ ID NO: 81967 - protein, 9 aa, Dengue virus
RQDVTVLGS

SEQ ID NO: 81968 - protein, 9 aa, Dengue virus
QDVTVLGSQ

SEQ ID NO: 81969 - protein, 9 aa, Dengue virus
DVTVLGSQE

SEQ ID NO: 81970 - protein, 9 aa, Dengue virus
VTVLGSQEG

SEQ ID NO: 81971 - protein, 9 aa, Dengue virus
TVLGSQEGA

SEQ ID NO: 81972 - protein, 9 aa, Dengue virus
VLGSQEGAM

SEQ ID NO: 81973 - protein, 9 aa, Dengue virus
LGSQEGAMH

SEQ ID NO: 81974 - protein, 9 aa, Dengue virus
GSQEGAMHS

SEQ ID NO: 81975 - protein, 9 aa, Dengue virus
SQEGAMHSA

SEQ ID NO: 81976 - protein, 9 aa, Dengue virus
QEGAMHSAL

SEQ ID NO: 81977 - protein, 9 aa, Dengue virus
EGAMHSALA

SEQ ID NO: 81978 - protein, 9 aa, Dengue virus
GAMHSALAG

SEQ ID NO: 81979 - protein, 9 aa, Dengue virus
AMHSALAGA

SEQ ID NO: 81980 - protein, 9 aa, Dengue virus
MHSALAGAT

SEQ ID NO: 81981 - protein, 9 aa, Dengue virus
HSALAGATE

SEQ ID NO: 81982 - protein, 9 aa, Dengue virus
SALAGATEV

SEQ ID NO: 81983 - protein, 9 aa, Dengue virus
ALAGATEVD

SEQ ID NO: 81984 - protein, 9 aa, Dengue virus
LAGATEVDS

SEQ ID NO: 81985 - protein, 9 aa, Dengue virus
AGATEVDSG

SEQ ID NO: 81986 - protein, 9 aa, Dengue virus
GATEVDSGD

SEQ ID NO: 81987 - protein, 9 aa, Dengue virus
ATEVDSGDG

SEQ ID NO: 81988 - protein, 9 aa, Dengue virus
TEVDSGDGN

SEQ ID NO: 81989 - protein, 9 aa, Dengue virus
EVDSGDGNH

SEQ ID NO: 81990 - protein, 9 aa, Dengue virus
VDSGDGNHM

SEQ ID NO: 81991 - protein, 9 aa, Dengue virus
DSGDGNHMF

SEQ ID NO: 81992 - protein, 9 aa, Dengue virus
SGDGNHMFA

SEQ ID NO: 81993 - protein, 9 aa, Dengue virus
GDGNHMFAG

SEQ ID NO: 81994 - protein, 9 aa, Dengue virus
DGNHMFAGH

SEQ ID NO: 81995 - protein, 9 aa, Dengue virus
GNHMFAGHL

SEQ ID NO: 81996 - protein, 9 aa, Dengue virus
NHMFAGHLK

SEQ ID NO: 81997 - protein, 9 aa, Dengue virus
HMFAGHLKC

SEQ ID NO: 81998 - protein, 9 aa, Dengue virus
MFAGHLKCK

SEQ ID NO: 81999 - protein, 9 aa, Dengue virus
FAGHLKCKV

SEQ ID NO: 82000 - protein, 9 aa, Dengue virus
AGHLKCKVR

SEQ ID NO: 82001 - protein, 9 aa, Dengue virus
GHLKCKVRM

SEQ ID NO: 82002 - protein, 9 aa, Dengue virus
HLKCKVRME

SEQ ID NO: 82003 - protein, 9 aa, Dengue virus
LKCKVRMEK

SEQ ID NO: 82004 - protein, 9 aa, Dengue virus
KCKVRMEKL

SEQ ID NO: 82005 - protein, 9 aa, Dengue virus
CKVRMEKLR

SEQ ID NO: 82006 - protein, 9 aa, Dengue virus
KVRMEKLRI

SEQ ID NO: 82007 - protein, 9 aa, Dengue virus
VRMEKLRIK

SEQ ID NO: 82008 - protein, 9 aa, Dengue virus
RMEKLRIKG

SEQ ID NO: 82009 - protein, 9 aa, Dengue virus
MEKLRIKGM

SEQ ID NO: 82010 - protein, 9 aa, Dengue virus
EKLRIKGMS

SEQ ID NO: 82011 - protein, 9 aa, Dengue virus
KLRIKGMSY

SEQ ID NO: 82012 - protein, 9 aa, Dengue virus
LRIKGMSYT

SEQ ID NO: 82013 - protein, 9 aa, Dengue virus
RIKGMSYTM

SEQ ID NO: 82014 - protein, 9 aa, Dengue virus
IKGMSYTMC

SEQ ID NO: 82015 - protein, 9 aa, Dengue virus
KGMSYTMCS

SEQ ID NO: 82016 - protein, 9 aa, Dengue virus
GMSYTMCSG

SEQ ID NO: 82017 - protein, 9 aa, Dengue virus
MSYTMCSGK

SEQ ID NO: 82018 - protein, 9 aa, Dengue virus
SYTMCSGKF

SEQ ID NO: 82019 - protein, 9 aa, Dengue virus
YTMCSGKFS

SEQ ID NO: 82020 - protein, 9 aa, Dengue virus
TMCSGKFSI

SEQ ID NO: 82021 - protein, 9 aa, Dengue virus
MCSGKFSID

SEQ ID NO: 82022 - protein, 9 aa, Dengue virus
CSGKFSIDK

SEQ ID NO: 82023 - protein, 9 aa, Dengue virus
SGKFSIDKE

SEQ ID NO: 82024 - protein, 9 aa, Dengue virus
GKFSIDKEM

SEQ ID NO: 82025 - protein, 9 aa, Dengue virus
KFSIDKEMA

SEQ ID NO: 82026 - protein, 9 aa, Dengue virus
FSIDKEMAE

SEQ ID NO: 82027 - protein, 9 aa, Dengue virus
SIDKEMAET

SEQ ID NO: 82028 - protein, 9 aa, Dengue virus
IDKEMAETQ

SEQ ID NO: 82029 - protein, 9 aa, Dengue virus
DKEMAETQH

SEQ ID NO: 82030 - protein, 9 aa, Dengue virus
KEMAETQHG

SEQ ID NO: 82031 - protein, 9 aa, Dengue virus
EMAETQHGT

SEQ ID NO: 82032 - protein, 9 aa, Dengue virus
MAETQHGTT

SEQ ID NO: 82033 - protein, 9 aa, Dengue virus
AETQHGTTV

SEQ ID NO: 82034 - protein, 9 aa, Dengue virus
ETQHGTTVV

SEQ ID NO: 82035 - protein, 9 aa, Dengue virus
TQHGTTVVK

SEQ ID NO: 82036 - protein, 9 aa, Dengue virus
QHGTTVVKV

SEQ ID NO: 82037 - protein, 9 aa, Dengue virus
HGTTVVKVK

SEQ ID NO: 82038 - protein, 9 aa, Dengue virus
GTTVVKVKY

SEQ ID NO: 82039 - protein, 9 aa, Dengue virus
TTVVKVKYE

SEQ ID NO: 82040 - protein, 9 aa, Dengue virus
TVVKVKYEG

SEQ ID NO: 82041 - protein, 9 aa, Dengue virus
VVKVKYEGA

SEQ ID NO: 82042 - protein, 9 aa, Dengue virus
VKVKYEGAG

SEQ ID NO: 82043 - protein, 9 aa, Dengue virus
KVKYEGAGA

SEQ ID NO: 82044 - protein, 9 aa, Dengue virus
VKYEGAGAP

SEQ ID NO: 82045 - protein, 9 aa, Dengue virus
KYEGAGAPC

SEQ ID NO: 82046 - protein, 9 aa, Dengue virus
YEGAGAPCK

SEQ ID NO: 82047 - protein, 9 aa, Dengue virus
EGAGAPCKV

SEQ ID NO: 82048 - protein, 9 aa, Dengue virus
GAGAPCKVP

SEQ ID NO: 82049 - protein, 9 aa, Dengue virus
AGAPCKVPI

SEQ ID NO: 82050 - protein, 9 aa, Dengue virus
GAPCKVPIE

SEQ ID NO: 82051 - protein, 9 aa, Dengue virus
APCKVPIEI

SEQ ID NO: 82052 - protein, 9 aa, Dengue virus
PCKVPIEIR

SEQ ID NO: 82053 - protein, 9 aa, Dengue virus
CKVPIEIRD

SEQ ID NO: 82054 - protein, 9 aa, Dengue virus
KVPIEIRDV

SEQ ID NO: 82055 - protein, 9 aa, Dengue virus
VPIEIRDVN

SEQ ID NO: 82056 - protein, 9 aa, Dengue virus
PIEIRDVNK

SEQ ID NO: 82057 - protein, 9 aa, Dengue virus
IEIRDVNKE

SEQ ID NO: 82058 - protein, 9 aa, Dengue virus
EIRDVNKEK

SEQ ID NO: 82059 - protein, 9 aa, Dengue virus
IRDVNKEKV

SEQ ID NO: 82060 - protein, 9 aa, Dengue virus
RDVNKEKVV

SEQ ID NO: 82061 - protein, 9 aa, Dengue virus
DVNKEKVVG

SEQ ID NO: 82062 - protein, 9 aa, Dengue virus
VNKEKVVGR

SEQ ID NO: 82063 - protein, 9 aa, Dengue virus
AENTNSVTN

SEQ ID NO: 82064 - protein, 9 aa, Dengue virus
ENTNSVTNI

SEQ ID NO: 82065 - protein, 9 aa, Dengue virus
NTNSVTNIE

SEQ ID NO: 82066 - protein, 9 aa, Dengue virus
TNSVTNIEL

SEQ ID NO: 82067 - protein, 9 aa, Dengue virus
NSVTNIELE

SEQ ID NO: 82068 - protein, 9 aa, Dengue virus
SVTNIELEP

SEQ ID NO: 82069 - protein, 9 aa, Dengue virus
VTNIELEPP

SEQ ID NO: 82070 - protein, 9 aa, Dengue virus
TNIELEPPF

SEQ ID NO: 82071 - protein, 9 aa, Dengue virus
NIELEPPFG

SEQ ID NO: 82072 - protein, 9 aa, Dengue virus
IELEPPFGD

SEQ ID NO: 82073 - protein, 9 aa, Dengue virus
ELEPPFGDS

SEQ ID NO: 82074 - protein, 9 aa, Dengue virus
LEPPFGDSY

SEQ ID NO: 82075 - protein, 9 aa, Dengue virus
EPPFGDSYI

SEQ ID NO: 82076 - protein, 9 aa, Dengue virus
PPFGDSYIV

SEQ ID NO: 82077 - protein, 9 aa, Dengue virus
PFGDSYIVI

SEQ ID NO: 82078 - protein, 9 aa, Dengue virus
FGDSYIVIG

SEQ ID NO: 82079 - protein, 9 aa, Dengue virus
GDSYIVIGV

SEQ ID NO: 82080 - protein, 9 aa, Dengue virus
DSYIVIGVG

SEQ ID NO: 82081 - protein, 9 aa, Dengue virus
SYIVIGVGN

SEQ ID NO: 82082 - protein, 9 aa, Dengue virus
YIVIGVGNS

SEQ ID NO: 82083 - protein, 9 aa, Dengue virus
IVIGVGNSA

SEQ ID NO: 82084 - protein, 9 aa, Dengue virus
VIGVGNSAL

SEQ ID NO: 82085 - protein, 9 aa, Dengue virus
IGVGNSALT

SEQ ID NO: 82086 - protein, 9 aa, Dengue virus
GVGNSALTL

SEQ ID NO: 82087 - protein, 9 aa, Dengue virus
VGNSALTLH

SEQ ID NO: 82088 - protein, 9 aa, Dengue virus
GNSALTLHW

SEQ ID NO: 82089 - protein, 9 aa, Dengue virus
NSALTLHWF

SEQ ID NO: 82090 - protein, 9 aa, Dengue virus
SALTLHWFR

SEQ ID NO: 82091 - protein, 9 aa, Dengue virus
ALTLHWFRK

SEQ ID NO: 82092 - protein, 9 aa, Dengue virus
LTLHWFRKG

SEQ ID NO: 82093 - protein, 9 aa, Dengue virus
TLHWFRKGS

SEQ ID NO: 82094 - protein, 9 aa, Dengue virus
LHWFRKGSS

SEQ ID NO: 82095 - protein, 9 aa, Dengue virus
HWFRKGSSI

SEQ ID NO: 82096 - protein, 9 aa, Dengue virus
WFRKGSSIG

SEQ ID NO: 82097 - protein, 9 aa, Dengue virus
FRKGSSIGK

SEQ ID NO: 82098 - protein, 9 aa, Dengue virus
RKGSSIGKM

SEQ ID NO: 82099 - protein, 9 aa, Dengue virus
KGSSIGKMF

SEQ ID NO: 82100 - protein, 9 aa, Dengue virus
GSSIGKMFE

SEQ ID NO: 82101 - protein, 9 aa, Dengue virus
SSIGKMFES

SEQ ID NO: 82102 - protein, 9 aa, Dengue virus
SIGKMFEST

SEQ ID NO: 82103 - protein, 9 aa, Dengue virus
IGKMFESTY

SEQ ID NO: 82104 - protein, 9 aa, Dengue virus
GKMFESTYR

SEQ ID NO: 82105 - protein, 9 aa, Dengue virus
KMFESTYRG

SEQ ID NO: 82106 - protein, 9 aa, Dengue virus
MFESTYRGA

SEQ ID NO: 82107 - protein, 9 aa, Dengue virus
FESTYRGAK

SEQ ID NO: 82108 - protein, 9 aa, Dengue virus
ESTYRGAKR

SEQ ID NO: 82109 - protein, 9 aa, Dengue virus
STYRGAKRM

SEQ ID NO: 82110 - protein, 9 aa, Dengue virus
TYRGAKRMA

SEQ ID NO: 82111 - protein, 9 aa, Dengue virus
YRGAKRMAI

SEQ ID NO: 82112 - protein, 9 aa, Dengue virus
RGAKRMAIL

SEQ ID NO: 82113 - protein, 9 aa, Dengue virus
GAKRMAILG

SEQ ID NO: 82114 - protein, 9 aa, Dengue virus
AKRMAILGE

SEQ ID NO: 82115 - protein, 9 aa, Dengue virus
KRMAILGET

SEQ ID NO: 82116 - protein, 9 aa, Dengue virus
RMAILGETA

SEQ ID NO: 82117 - protein, 9 aa, Dengue virus
MAILGETAW

SEQ ID NO: 82118 - protein, 9 aa, Dengue virus
AILGETAWD

SEQ ID NO: 82119 - protein, 9 aa, Dengue virus
ILGETAWDF

SEQ ID NO: 82120 - protein, 9 aa, Dengue virus
LGETAWDFG

SEQ ID NO: 82121 - protein, 9 aa, Dengue virus
GETAWDFGS

SEQ ID NO: 82122 - protein, 9 aa, Dengue virus
ETAWDFGSV

SEQ ID NO: 82123 - protein, 9 aa, Dengue virus
TAWDFGSVG

SEQ ID NO: 82124 - protein, 9 aa, Dengue virus
AWDFGSVGG

SEQ ID NO: 82125 - protein, 9 aa, Dengue virus
WDFGSVGGL

SEQ ID NO: 82126 - protein, 9 aa, Dengue virus
DFGSVGGLF

SEQ ID NO: 82127 - protein, 9 aa, Dengue virus
FGSVGGLFT

SEQ ID NO: 82128 - protein, 9 aa, Dengue virus
GSVGGLFTS

SEQ ID NO: 82129 - protein, 9 aa, Dengue virus
SVGGLFTSL

SEQ ID NO: 82130 - protein, 9 aa, Dengue virus
VGGLFTSLG

SEQ ID NO: 82131 - protein, 9 aa, Dengue virus
GGLFTSLGK

SEQ ID NO: 82132 - protein, 9 aa, Dengue virus
GLFTSLGKA

SEQ ID NO: 82133 - protein, 9 aa, Dengue virus
LFTSLGKAV

SEQ ID NO: 82134 - protein, 9 aa, Dengue virus
FTSLGKAVH

SEQ ID NO: 82135 - protein, 9 aa, Dengue virus
TSLGKAVHQ

SEQ ID NO: 82136 - protein, 9 aa, Dengue virus
SLGKAVHQV

SEQ ID NO: 82137 - protein, 9 aa, Dengue virus
LGKAVHQVF

SEQ ID NO: 82138 - protein, 9 aa, Dengue virus
GKAVHQVFG

SEQ ID NO: 82139 - protein, 9 aa, Dengue virus
KAVHQVFGS

SEQ ID NO: 82140 - protein, 9 aa, Dengue virus
AVHQVFGSV

SEQ ID NO: 82141 - protein, 9 aa, Dengue virus
VHQVFGSVY

SEQ ID NO: 82142 - protein, 9 aa, Dengue virus
HQVFGSVYT

SEQ ID NO: 82143 - protein, 9 aa, Dengue virus
QVFGSVYTT

SEQ ID NO: 82144 - protein, 9 aa, Dengue virus
VFGSVYTTM

SEQ ID NO: 82145 - protein, 9 aa, Dengue virus
FGSVYTTMF

SEQ ID NO: 82146 - protein, 9 aa, Dengue virus
GSVYTTMFG

SEQ ID NO: 82147 - protein, 9 aa, Dengue virus
SVYTTMFGG

SEQ ID NO: 82148 - protein, 9 aa, Dengue virus
VYTTMFGGV

SEQ ID NO: 82149 - protein, 9 aa, Dengue virus
YTTMFGGVS

SEQ ID NO: 82150 - protein, 9 aa, Dengue virus
TTMFGGVSW

SEQ ID NO: 82151 - protein, 9 aa, Dengue virus
TMFGGVSWM

SEQ ID NO: 82152 - protein, 9 aa, Dengue virus
MFGGVSWMI

SEQ ID NO: 82153 - protein, 9 aa, Dengue virus
FGGVSWMIR

SEQ ID NO: 82154 - protein, 9 aa, Dengue virus
GGVSWMIRI

SEQ ID NO: 82155 - protein, 9 aa, Dengue virus
GVSWMIRIL

SEQ ID NO: 82156 - protein, 9 aa, Dengue virus
VSWMIRILI

SEQ ID NO: 82157 - protein, 9 aa, Dengue virus
SWMIRILIG

SEQ ID NO: 82158 - protein, 9 aa, Dengue virus
IRILIGFLV

SEQ ID NO: 82159 - protein, 9 aa, Dengue virus
RILIGFLVL

SEQ ID NO: 82160 - protein, 9 aa, Dengue virus
ILIGFLVLW

SEQ ID NO: 82161 - protein, 9 aa, Dengue virus
LIGFLVLWI

SEQ ID NO: 82162 - protein, 9 aa, Dengue virus
IGFLVLWIG

SEQ ID NO: 82163 - protein, 9 aa, Dengue virus
GFLVLWIGT

SEQ ID NO: 82164 - protein, 9 aa, Dengue virus
FLVLWIGTN

SEQ ID NO: 82165 - protein, 9 aa, Dengue virus
LVLWIGTNS

SEQ ID NO: 82166 - protein, 9 aa, Dengue virus
VLWIGTNSR

SEQ ID NO: 82167 - protein, 9 aa, Dengue virus
LWIGTNSRN

SEQ ID NO: 82168 - protein, 9 aa, Dengue virus
WIGTNSRNT

SEQ ID NO: 82169 - protein, 9 aa, Dengue virus
IGTNSRNTS

SEQ ID NO: 82170 - protein, 9 aa, Dengue virus
GTNSRNTSM

SEQ ID NO: 82171 - protein, 9 aa, Dengue virus
TNSRNTSMA

SEQ ID NO: 82172 - protein, 9 aa, Dengue virus
NSRNTSMAM

SEQ ID NO: 82173 - protein, 9 aa, Dengue virus
SRNTSMAMT

SEQ ID NO: 82174 - protein, 9 aa, Dengue virus
RNTSMAMTC

SEQ ID NO: 82175 - protein, 9 aa, Dengue virus
NTSMAMTCI

SEQ ID NO: 82176 - protein, 9 aa, Dengue virus
TSMAMTCIA

SEQ ID NO: 82177 - protein, 9 aa, Dengue virus
SMAMTCIAV

SEQ ID NO: 82178 - protein, 9 aa, Dengue virus
MAMTCIAVG

SEQ ID NO: 82179 - protein, 9 aa, Dengue virus
AMTCIAVGG

SEQ ID NO: 82180 - protein, 9 aa, Dengue virus
MTCIAVGGI

SEQ ID NO: 82181 - protein, 9 aa, Dengue virus
TCIAVGGIT

SEQ ID NO: 82182 - protein, 9 aa, Dengue virus
CIAVGGITL

SEQ ID NO: 82183 - protein, 9 aa, Dengue virus
IAVGGITLF

SEQ ID NO: 82184 - protein, 9 aa, Dengue virus
AVGGITLFL

SEQ ID NO: 82185 - protein, 9 aa, Dengue virus
VGGITLFLG

SEQ ID NO: 82186 - protein, 9 aa, Dengue virus
GGITLFLGF

SEQ ID NO: 82187 - protein, 9 aa, Dengue virus
GITLFLGFT

SEQ ID NO: 82188 - protein, 9 aa, Dengue virus
ITLFLGFTV

SEQ ID NO: 82189 - protein, 9 aa, Dengue virus
TLFLGFTVQ

SEQ ID NO: 82190 - protein, 9 aa, Dengue virus
LFLGFTVQA

SEQ ID NO: 82191 - protein, 9 aa, Dengue virus
FLGFTVQAD

SEQ ID NO: 82192 - protein, 9 aa, Dengue virus
LGFTVQADM

SEQ ID NO: 82193 - protein, 9 aa, Dengue virus
GFTVQADMG

SEQ ID NO: 82194 - protein, 9 aa, Dengue virus
FTVQADMGC

SEQ ID NO: 82195 - protein, 9 aa, Dengue virus
ADMGCVVSW

SEQ ID NO: 82196 - protein, 9 aa, Dengue virus
SWSGRELKC

SEQ ID NO: 82197 - protein, 9 aa, Dengue virus
WSGRELKCG

SEQ ID NO: 82198 - protein, 9 aa, Dengue virus
SGRELKCGS

SEQ ID NO: 82199 - protein, 9 aa, Dengue virus
GRELKCGSG

SEQ ID NO: 82200 - protein, 9 aa, Dengue virus
RELKCGSGI

SEQ ID NO: 82201 - protein, 9 aa, Dengue virus
ELKCGSGIF

SEQ ID NO: 82202 - protein, 9 aa, Dengue virus
LKCGSGIFV

SEQ ID NO: 82203 - protein, 9 aa, Dengue virus
KCGSGIFVV

SEQ ID NO: 82204 - protein, 9 aa, Dengue virus
CGSGIFVVD

SEQ ID NO: 82205 - protein, 9 aa, Dengue virus
GSGIFVVDN

SEQ ID NO: 82206 - protein, 9 aa, Dengue virus
SGIFVVDNV

SEQ ID NO: 82207 - protein, 9 aa, Dengue virus
GIFVVDNVH

SEQ ID NO: 82208 - protein, 9 aa, Dengue virus
IFVVDNVHT

SEQ ID NO: 82209 - protein, 9 aa, Dengue virus
FVVDNVHTW

SEQ ID NO: 82210 - protein, 9 aa, Dengue virus
VVDNVHTWT

SEQ ID NO: 82211 - protein, 9 aa, Dengue virus
VDNVHTWTE

SEQ ID NO: 82212 - protein, 9 aa, Dengue virus
DNVHTWTEQ

SEQ ID NO: 82213 - protein, 9 aa, Dengue virus
NVHTWTEQY

SEQ ID NO: 82214 - protein, 9 aa, Dengue virus
VHTWTEQYK

SEQ ID NO: 82215 - protein, 9 aa, Dengue virus
HTWTEQYKF

SEQ ID NO: 82216 - protein, 9 aa, Dengue virus
TWTEQYKFQ

SEQ ID NO: 82217 - protein, 9 aa, Dengue virus
WTEQYKFQP

SEQ ID NO: 82218 - protein, 9 aa, Dengue virus
TEQYKFQPE

SEQ ID NO: 82219 - protein, 9 aa, Dengue virus
EQYKFQPES

SEQ ID NO: 82220 - protein, 9 aa, Dengue virus
QYKFQPESP

SEQ ID NO: 82221 - protein, 9 aa, Dengue virus
YKFQPESPA

SEQ ID NO: 82222 - protein, 9 aa, Dengue virus
KFQPESPAR

SEQ ID NO: 82223 - protein, 9 aa, Dengue virus
FQPESPARL

SEQ ID NO: 82224 - protein, 9 aa, Dengue virus
QPESPARLA

SEQ ID NO: 82225 - protein, 9 aa, Dengue virus
PESPARLAS

SEQ ID NO: 82226 - protein, 9 aa, Dengue virus
ESPARLASA

SEQ ID NO: 82227 - protein, 9 aa, Dengue virus
SPARLASAI

SEQ ID NO: 82228 - protein, 9 aa, Dengue virus
PARLASAIL

SEQ ID NO: 82229 - protein, 9 aa, Dengue virus
ARLASAILN

SEQ ID NO: 82230 - protein, 9 aa, Dengue virus
RLASAILNA

SEQ ID NO: 82231 - protein, 9 aa, Dengue virus
LASAILNAH

SEQ ID NO: 82232 - protein, 9 aa, Dengue virus
ASAILNAHK

SEQ ID NO: 82233 - protein, 9 aa, Dengue virus
SAILNAHKD

SEQ ID NO: 82234 - protein, 9 aa, Dengue virus
AILNAHKDG

SEQ ID NO: 82235 - protein, 9 aa, Dengue virus
ILNAHKDGV

SEQ ID NO: 82236 - protein, 9 aa, Dengue virus
LNAHKDGVC

SEQ ID NO: 82237 - protein, 9 aa, Dengue virus
NAHKDGVCG

SEQ ID NO: 82238 - protein, 9 aa, Dengue virus
AHKDGVCGI

SEQ ID NO: 82239 - protein, 9 aa, Dengue virus
HKDGVCGIR

SEQ ID NO: 82240 - protein, 9 aa, Dengue virus
KDGVCGIRS

SEQ ID NO: 82241 - protein, 9 aa, Dengue virus
DGVCGIRST

SEQ ID NO: 82242 - protein, 9 aa, Dengue virus
GVCGIRSTT

SEQ ID NO: 82243 - protein, 9 aa, Dengue virus
VCGIRSTTR

SEQ ID NO: 82244 - protein, 9 aa, Dengue virus
CGIRSTTRL

SEQ ID NO: 82245 - protein, 9 aa, Dengue virus
GIRSTTRLE

SEQ ID NO: 82246 - protein, 9 aa, Dengue virus
IRSTTRLEN

SEQ ID NO: 82247 - protein, 9 aa, Dengue virus
RSTTRLENV

SEQ ID NO: 82248 - protein, 9 aa, Dengue virus
STTRLENVM

SEQ ID NO: 82249 - protein, 9 aa, Dengue virus
TTRLENVMW

SEQ ID NO: 82250 - protein, 9 aa, Dengue virus
TRLENVMWK

SEQ ID NO: 82251 - protein, 9 aa, Dengue virus
RLENVMWKQ

SEQ ID NO: 82252 - protein, 9 aa, Dengue virus
LENVMWKQI

SEQ ID NO: 82253 - protein, 9 aa, Dengue virus
ENVMWKQIT

SEQ ID NO: 82254 - protein, 9 aa, Dengue virus
NVMWKQITN

SEQ ID NO: 82255 - protein, 9 aa, Dengue virus
VMWKQITNE

SEQ ID NO: 82256 - protein, 9 aa, Dengue virus
MWKQITNEL

SEQ ID NO: 82257 - protein, 9 aa, Dengue virus
WKQITNELN

SEQ ID NO: 82258 - protein, 9 aa, Dengue virus
KQITNELNY

SEQ ID NO: 82259 - protein, 9 aa, Dengue virus
QITNELNYV

SEQ ID NO: 82260 - protein, 9 aa, Dengue virus
ITNELNYVL

SEQ ID NO: 82261 - protein, 9 aa, Dengue virus
TNELNYVLW

SEQ ID NO: 82262 - protein, 9 aa, Dengue virus
NELNYVLWE

SEQ ID NO: 82263 - protein, 9 aa, Dengue virus
ELNYVLWEG

SEQ ID NO: 82264 - protein, 9 aa, Dengue virus
LNYVLWEGG

SEQ ID NO: 82265 - protein, 9 aa, Dengue virus
NYVLWEGGH

SEQ ID NO: 82266 - protein, 9 aa, Dengue virus
YVLWEGGHD

SEQ ID NO: 82267 - protein, 9 aa, Dengue virus
VLWEGGHDL

SEQ ID NO: 82268 - protein, 9 aa, Dengue virus
LWEGGHDLT

SEQ ID NO: 82269 - protein, 9 aa, Dengue virus
WEGGHDLTV

SEQ ID NO: 82270 - protein, 9 aa, Dengue virus
EGGHDLTVV

SEQ ID NO: 82271 - protein, 9 aa, Dengue virus
GGHDLTVVA

SEQ ID NO: 82272 - protein, 9 aa, Dengue virus
GHDLTVVAG

SEQ ID NO: 82273 - protein, 9 aa, Dengue virus
HDLTVVAGD

SEQ ID NO: 82274 - protein, 9 aa, Dengue virus
DLTVVAGDV

SEQ ID NO: 82275 - protein, 9 aa, Dengue virus
LTVVAGDVK

SEQ ID NO: 82276 - protein, 9 aa, Dengue virus
TVVAGDVKG

SEQ ID NO: 82277 - protein, 9 aa, Dengue virus
VVAGDVKGV

SEQ ID NO: 82278 - protein, 9 aa, Dengue virus
VAGDVKGVL

SEQ ID NO: 82279 - protein, 9 aa, Dengue virus
AGDVKGVLT

SEQ ID NO: 82280 - protein, 9 aa, Dengue virus
GDVKGVLTK

SEQ ID NO: 82281 - protein, 9 aa, Dengue virus
DVKGVLTKG

SEQ ID NO: 82282 - protein, 9 aa, Dengue virus
VKGVLTKGK

SEQ ID NO: 82283 - protein, 9 aa, Dengue virus
KGVLTKGKR

SEQ ID NO: 82284 - protein, 9 aa, Dengue virus
GVLTKGKRA

SEQ ID NO: 82285 - protein, 9 aa, Dengue virus
VLTKGKRAL

SEQ ID NO: 82286 - protein, 9 aa, Dengue virus
LTKGKRALT

SEQ ID NO: 82287 - protein, 9 aa, Dengue virus
TKGKRALTP

SEQ ID NO: 82288 - protein, 9 aa, Dengue virus
KGKRALTPP

SEQ ID NO: 82289 - protein, 9 aa, Dengue virus
GKRALTPPV

SEQ ID NO: 82290 - protein, 9 aa, Dengue virus
LTPPVSDLK

SEQ ID NO: 82291 - protein, 9 aa, Dengue virus
TPPVSDLKY

SEQ ID NO: 82292 - protein, 9 aa, Dengue virus
PPVSDLKYS

SEQ ID NO: 82293 - protein, 9 aa, Dengue virus
PVSDLKYSW

SEQ ID NO: 82294 - protein, 9 aa, Dengue virus
VSDLKYSWK

SEQ ID NO: 82295 - protein, 9 aa, Dengue virus
SDLKYSWKT

SEQ ID NO: 82296 - protein, 9 aa, Dengue virus
DLKYSWKTW

SEQ ID NO: 82297 - protein, 9 aa, Dengue virus
LKYSWKTWG

SEQ ID NO: 82298 - protein, 9 aa, Dengue virus
KYSWKTWGK

SEQ ID NO: 82299 - protein, 9 aa, Dengue virus
YSWKTWGKA

SEQ ID NO: 82300 - protein, 9 aa, Dengue virus
SWKTWGKAK

SEQ ID NO: 82301 - protein, 9 aa, Dengue virus
WKTWGKAKI

SEQ ID NO: 82302 - protein, 9 aa, Dengue virus
KTWGKAKIF

SEQ ID NO: 82303 - protein, 9 aa, Dengue virus
TWGKAKIFT

SEQ ID NO: 82304 - protein, 9 aa, Dengue virus
WGKAKIFTP

SEQ ID NO: 82305 - protein, 9 aa, Dengue virus
GKAKIFTPE

SEQ ID NO: 82306 - protein, 9 aa, Dengue virus
KAKIFTPEA

SEQ ID NO: 82307 - protein, 9 aa, Dengue virus
PEARNSTFL

SEQ ID NO: 82308 - protein, 9 aa, Dengue virus
RNSTFLIDG

SEQ ID NO: 82309 - protein, 9 aa, Dengue virus
NSTFLIDGP

SEQ ID NO: 82310 - protein, 9 aa, Dengue virus
STFLIDGPD

SEQ ID NO: 82311 - protein, 9 aa, Dengue virus
TFLIDGPDT

SEQ ID NO: 82312 - protein, 9 aa, Dengue virus
FLIDGPDTS

SEQ ID NO: 82313 - protein, 9 aa, Dengue virus
LIDGPDTSE

SEQ ID NO: 82314 - protein, 9 aa, Dengue virus
IDGPDTSEC

SEQ ID NO: 82315 - protein, 9 aa, Dengue virus
DGPDTSECP

SEQ ID NO: 82316 - protein, 9 aa, Dengue virus
GPDTSECPN

SEQ ID NO: 82317 - protein, 9 aa, Dengue virus
PDTSECPNE

SEQ ID NO: 82318 - protein, 9 aa, Dengue virus
DTSECPNER

SEQ ID NO: 82319 - protein, 9 aa, Dengue virus
TSECPNERR

SEQ ID NO: 82320 - protein, 9 aa, Dengue virus
SECPNERRA

SEQ ID NO: 82321 - protein, 9 aa, Dengue virus
ECPNERRAW

SEQ ID NO: 82322 - protein, 9 aa, Dengue virus
CPNERRAWN

SEQ ID NO: 82323 - protein, 9 aa, Dengue virus
PNERRAWNS

SEQ ID NO: 82324 - protein, 9 aa, Dengue virus
NERRAWNSL

SEQ ID NO: 82325 - protein, 9 aa, Dengue virus
ERRAWNSLE

SEQ ID NO: 82326 - protein, 9 aa, Dengue virus
RRAWNSLEV

SEQ ID NO: 82327 - protein, 9 aa, Dengue virus
RAWNSLEVE

SEQ ID NO: 82328 - protein, 9 aa, Dengue virus
AWNSLEVED

SEQ ID NO: 82329 - protein, 9 aa, Dengue virus
WNSLEVEDY

SEQ ID NO: 82330 - protein, 9 aa, Dengue virus
NSLEVEDYG

SEQ ID NO: 82331 - protein, 9 aa, Dengue virus
SLEVEDYGF

SEQ ID NO: 82332 - protein, 9 aa, Dengue virus
LEVEDYGFG

SEQ ID NO: 82333 - protein, 9 aa, Dengue virus
EVEDYGFGM

SEQ ID NO: 82334 - protein, 9 aa, Dengue virus
VEDYGFGMF

SEQ ID NO: 82335 - protein, 9 aa, Dengue virus
EDYGFGMFT

SEQ ID NO: 82336 - protein, 9 aa, Dengue virus
DYGFGMFTT

SEQ ID NO: 82337 - protein, 9 aa, Dengue virus
YGFGMFTTN

SEQ ID NO: 82338 - protein, 9 aa, Dengue virus
GFGMFTTNI

SEQ ID NO: 82339 - protein, 9 aa, Dengue virus
FGMFTTNIW

SEQ ID NO: 82340 - protein, 9 aa, Dengue virus
GMFTTNIWM

SEQ ID NO: 82341 - protein, 9 aa, Dengue virus
MFTTNIWMK

SEQ ID NO: 82342 - protein, 9 aa, Dengue virus
FTTNIWMKF

SEQ ID NO: 82343 - protein, 9 aa, Dengue virus
TTNIWMKFR

SEQ ID NO: 82344 - protein, 9 aa, Dengue virus
TNIWMKFRE

SEQ ID NO: 82345 - protein, 9 aa, Dengue virus
NIWMKFREG

SEQ ID NO: 82346 - protein, 9 aa, Dengue virus
IWMKFREGS

SEQ ID NO: 82347 - protein, 9 aa, Dengue virus
WMKFREGSS

SEQ ID NO: 82348 - protein, 9 aa, Dengue virus
MKFREGSSE

SEQ ID NO: 82349 - protein, 9 aa, Dengue virus
KFREGSSEV

SEQ ID NO: 82350 - protein, 9 aa, Dengue virus
FREGSSEVC

SEQ ID NO: 82351 - protein, 9 aa, Dengue virus
REGSSEVCD

SEQ ID NO: 82352 - protein, 9 aa, Dengue virus
EGSSEVCDH

SEQ ID NO: 82353 - protein, 9 aa, Dengue virus
GSSEVCDHR

SEQ ID NO: 82354 - protein, 9 aa, Dengue virus
SSEVCDHRL

SEQ ID NO: 82355 - protein, 9 aa, Dengue virus
SEVCDHRLM

SEQ ID NO: 82356 - protein, 9 aa, Dengue virus
EVCDHRLMS

SEQ ID NO: 82357 - protein, 9 aa, Dengue virus
VCDHRLMSA

SEQ ID NO: 82358 - protein, 9 aa, Dengue virus
CDHRLMSAA

SEQ ID NO: 82359 - protein, 9 aa, Dengue virus
DHRLMSAAI

SEQ ID NO: 82360 - protein, 9 aa, Dengue virus
HRLMSAAIK

SEQ ID NO: 82361 - protein, 9 aa, Dengue virus
RLMSAAIKD

SEQ ID NO: 82362 - protein, 9 aa, Dengue virus
LMSAAIKDQ

SEQ ID NO: 82363 - protein, 9 aa, Dengue virus
MSAAIKDQK

SEQ ID NO: 82364 - protein, 9 aa, Dengue virus
SAAIKDQKA

SEQ ID NO: 82365 - protein, 9 aa, Dengue virus
AAIKDQKAV

SEQ ID NO: 82366 - protein, 9 aa, Dengue virus
AIKDQKAVH

SEQ ID NO: 82367 - protein, 9 aa, Dengue virus
IKDQKAVHA

SEQ ID NO: 82368 - protein, 9 aa, Dengue virus
KDQKAVHAD

SEQ ID NO: 82369 - protein, 9 aa, Dengue virus
DQKAVHADM

SEQ ID NO: 82370 - protein, 9 aa, Dengue virus
QKAVHADMG

SEQ ID NO: 82371 - protein, 9 aa, Dengue virus
KAVHADMGY

SEQ ID NO: 82372 - protein, 9 aa, Dengue virus
AVHADMGYW

SEQ ID NO: 82373 - protein, 9 aa, Dengue virus
VHADMGYWI

SEQ ID NO: 82374 - protein, 9 aa, Dengue virus
HADMGYWIE

SEQ ID NO: 82375 - protein, 9 aa, Dengue virus
ADMGYWIES

SEQ ID NO: 82376 - protein, 9 aa, Dengue virus
DMGYWIESS

SEQ ID NO: 82377 - protein, 9 aa, Dengue virus
MGYWIESSK

SEQ ID NO: 82378 - protein, 9 aa, Dengue virus
GYWIESSKN

SEQ ID NO: 82379 - protein, 9 aa, Dengue virus
YWIESSKNQ

SEQ ID NO: 82380 - protein, 9 aa, Dengue virus
WIESSKNQT

SEQ ID NO: 82381 - protein, 9 aa, Dengue virus
IESSKNQTW

SEQ ID NO: 82382 - protein, 9 aa, Dengue virus
ESSKNQTWQ

SEQ ID NO: 82383 - protein, 9 aa, Dengue virus
SSKNQTWQI

SEQ ID NO: 82384 - protein, 9 aa, Dengue virus
SKNQTWQIE

SEQ ID NO: 82385 - protein, 9 aa, Dengue virus
KNQTWQIEK

SEQ ID NO: 82386 - protein, 9 aa, Dengue virus
NQTWQIEKA

SEQ ID NO: 82387 - protein, 9 aa, Dengue virus
QTWQIEKAS

SEQ ID NO: 82388 - protein, 9 aa, Dengue virus
TWQIEKASL

SEQ ID NO: 82389 - protein, 9 aa, Dengue virus
WQIEKASLI

SEQ ID NO: 82390 - protein, 9 aa, Dengue virus
QIEKASLIE

SEQ ID NO: 82391 - protein, 9 aa, Dengue virus
IEKASLIEV

SEQ ID NO: 82392 - protein, 9 aa, Dengue virus
EKASLIEVK

SEQ ID NO: 82393 - protein, 9 aa, Dengue virus
KASLIEVKT

SEQ ID NO: 82394 - protein, 9 aa, Dengue virus
ASLIEVKTC

SEQ ID NO: 82395 - protein, 9 aa, Dengue virus
SLIEVKTCL

SEQ ID NO: 82396 - protein, 9 aa, Dengue virus
LIEVKTCLW

SEQ ID NO: 82397 - protein, 9 aa, Dengue virus
IEVKTCLWP

SEQ ID NO: 82398 - protein, 9 aa, Dengue virus
EVKTCLWPK

SEQ ID NO: 82399 - protein, 9 aa, Dengue virus
VKTCLWPKT

SEQ ID NO: 82400 - protein, 9 aa, Dengue virus
KTCLWPKTH

SEQ ID NO: 82401 - protein, 9 aa, Dengue virus
TCLWPKTHT

SEQ ID NO: 82402 - protein, 9 aa, Dengue virus
CLWPKTHTL

SEQ ID NO: 82403 - protein, 9 aa, Dengue virus
LWPKTHTLW

SEQ ID NO: 82404 - protein, 9 aa, Dengue virus
WPKTHTLWS

SEQ ID NO: 82405 - protein, 9 aa, Dengue virus
PKTHTLWSN

SEQ ID NO: 82406 - protein, 9 aa, Dengue virus
KTHTLWSNG

SEQ ID NO: 82407 - protein, 9 aa, Dengue virus
THTLWSNGV

SEQ ID NO: 82408 - protein, 9 aa, Dengue virus
HTLWSNGVL

SEQ ID NO: 82409 - protein, 9 aa, Dengue virus
TLWSNGVLE

SEQ ID NO: 82410 - protein, 9 aa, Dengue virus
LWSNGVLES

SEQ ID NO: 82411 - protein, 9 aa, Dengue virus
WSNGVLESQ

SEQ ID NO: 82412 - protein, 9 aa, Dengue virus
SNGVLESQM

SEQ ID NO: 82413 - protein, 9 aa, Dengue virus
NGVLESQML

SEQ ID NO: 82414 - protein, 9 aa, Dengue virus
GVLESQMLI

SEQ ID NO: 82415 - protein, 9 aa, Dengue virus
VLESQMLIP

SEQ ID NO: 82416 - protein, 9 aa, Dengue virus
LESQMLIPK

SEQ ID NO: 82417 - protein, 9 aa, Dengue virus
ESQMLIPKS

SEQ ID NO: 82418 - protein, 9 aa, Dengue virus
SQMLIPKSY

SEQ ID NO: 82419 - protein, 9 aa, Dengue virus
QMLIPKSYA

SEQ ID NO: 82420 - protein, 9 aa, Dengue virus
MLIPKSYAG

SEQ ID NO: 82421 - protein, 9 aa, Dengue virus
LIPKSYAGP

SEQ ID NO: 82422 - protein, 9 aa, Dengue virus
IPKSYAGPF

SEQ ID NO: 82423 - protein, 9 aa, Dengue virus
PKSYAGPFS

SEQ ID NO: 82424 - protein, 9 aa, Dengue virus
KSYAGPFSQ

SEQ ID NO: 82425 - protein, 9 aa, Dengue virus
SYAGPFSQH

SEQ ID NO: 82426 - protein, 9 aa, Dengue virus
YAGPFSQHN

SEQ ID NO: 82427 - protein, 9 aa, Dengue virus
AGPFSQHNY

SEQ ID NO: 82428 - protein, 9 aa, Dengue virus
GPFSQHNYR

SEQ ID NO: 82429 - protein, 9 aa, Dengue virus
PFSQHNYRQ

SEQ ID NO: 82430 - protein, 9 aa, Dengue virus
FSQHNYRQG

SEQ ID NO: 82431 - protein, 9 aa, Dengue virus
SQHNYRQGY

SEQ ID NO: 82432 - protein, 9 aa, Dengue virus
QHNYRQGYA

SEQ ID NO: 82433 - protein, 9 aa, Dengue virus
HNYRQGYAT

SEQ ID NO: 82434 - protein, 9 aa, Dengue virus
NYRQGYATQ

SEQ ID NO: 82435 - protein, 9 aa, Dengue virus
YRQGYATQT

SEQ ID NO: 82436 - protein, 9 aa, Dengue virus
RQGYATQTV

SEQ ID NO: 82437 - protein, 9 aa, Dengue virus
QGYATQTVG

SEQ ID NO: 82438 - protein, 9 aa, Dengue virus
GYATQTVGP

SEQ ID NO: 82439 - protein, 9 aa, Dengue virus
YATQTVGPW

SEQ ID NO: 82440 - protein, 9 aa, Dengue virus
ATQTVGPWH

SEQ ID NO: 82441 - protein, 9 aa, Dengue virus
TQTVGPWHL

SEQ ID NO: 82442 - protein, 9 aa, Dengue virus
QTVGPWHLG

SEQ ID NO: 82443 - protein, 9 aa, Dengue virus
TVGPWHLGK

SEQ ID NO: 82444 - protein, 9 aa, Dengue virus
VGPWHLGKL

SEQ ID NO: 82445 - protein, 9 aa, Dengue virus
GPWHLGKLE

SEQ ID NO: 82446 - protein, 9 aa, Dengue virus
PWHLGKLEI

SEQ ID NO: 82447 - protein, 9 aa, Dengue virus
WHLGKLEID

SEQ ID NO: 82448 - protein, 9 aa, Dengue virus
HLGKLEIDF

SEQ ID NO: 82449 - protein, 9 aa, Dengue virus
LGKLEIDFG

SEQ ID NO: 82450 - protein, 9 aa, Dengue virus
GKLEIDFGE

SEQ ID NO: 82451 - protein, 9 aa, Dengue virus
KLEIDFGEC

SEQ ID NO: 82452 - protein, 9 aa, Dengue virus
LEIDFGECP

SEQ ID NO: 82453 - protein, 9 aa, Dengue virus
EIDFGECPG

SEQ ID NO: 82454 - protein, 9 aa, Dengue virus
IDFGECPGT

SEQ ID NO: 82455 - protein, 9 aa, Dengue virus
DFGECPGTT

SEQ ID NO: 82456 - protein, 9 aa, Dengue virus
FGECPGTTV

SEQ ID NO: 82457 - protein, 9 aa, Dengue virus
GECPGTTVT

SEQ ID NO: 82458 - protein, 9 aa, Dengue virus
ECPGTTVTI

SEQ ID NO: 82459 - protein, 9 aa, Dengue virus
CPGTTVTIQ

SEQ ID NO: 82460 - protein, 9 aa, Dengue virus
PGTTVTIQE

SEQ ID NO: 82461 - protein, 9 aa, Dengue virus
GTTVTIQED

SEQ ID NO: 82462 - protein, 9 aa, Dengue virus
TTVTIQEDC

SEQ ID NO: 82463 - protein, 9 aa, Dengue virus
QEDCDHRGP

SEQ ID NO: 82464 - protein, 9 aa, Dengue virus
EDCDHRGPS

SEQ ID NO: 82465 - protein, 9 aa, Dengue virus
DCDHRGPSL

SEQ ID NO: 82466 - protein, 9 aa, Dengue virus
CDHRGPSLR

SEQ ID NO: 82467 - protein, 9 aa, Dengue virus
DHRGPSLRT

SEQ ID NO: 82468 - protein, 9 aa, Dengue virus
HRGPSLRTT

SEQ ID NO: 82469 - protein, 9 aa, Dengue virus
RGPSLRTTT

SEQ ID NO: 82470 - protein, 9 aa, Dengue virus
GPSLRTTTA

SEQ ID NO: 82471 - protein, 9 aa, Dengue virus
PSLRTTTAS

SEQ ID NO: 82472 - protein, 9 aa, Dengue virus
SLRTTTASG

SEQ ID NO: 82473 - protein, 9 aa, Dengue virus
LRTTTASGK

SEQ ID NO: 82474 - protein, 9 aa, Dengue virus
RTTTASGKL

SEQ ID NO: 82475 - protein, 9 aa, Dengue virus
TTTASGKLV

SEQ ID NO: 82476 - protein, 9 aa, Dengue virus
TTASGKLVT

SEQ ID NO: 82477 - protein, 9 aa, Dengue virus
TASGKLVTQ

SEQ ID NO: 82478 - protein, 9 aa, Dengue virus
ASGKLVTQW

SEQ ID NO: 82479 - protein, 9 aa, Dengue virus
SGKLVTQWC

SEQ ID NO: 82480 - protein, 9 aa, Dengue virus
GKLVTQWCC

SEQ ID NO: 82481 - protein, 9 aa, Dengue virus
KLVTQWCCR

SEQ ID NO: 82482 - protein, 9 aa, Dengue virus
LVTQWCCRS

SEQ ID NO: 82483 - protein, 9 aa, Dengue virus
VTQWCCRSC

SEQ ID NO: 82484 - protein, 9 aa, Dengue virus
TQWCCRSCT

SEQ ID NO: 82485 - protein, 9 aa, Dengue virus
QWCCRSCTM

SEQ ID NO: 82486 - protein, 9 aa, Dengue virus
WCCRSCTMP

SEQ ID NO: 82487 - protein, 9 aa, Dengue virus
CCRSCTMPP

SEQ ID NO: 82488 - protein, 9 aa, Dengue virus
CRSCTMPPL

SEQ ID NO: 82489 - protein, 9 aa, Dengue virus
RSCTMPPLR

SEQ ID NO: 82490 - protein, 9 aa, Dengue virus
SCTMPPLRF

SEQ ID NO: 82491 - protein, 9 aa, Dengue virus
CTMPPLRFL

SEQ ID NO: 82492 - protein, 9 aa, Dengue virus
TMPPLRFLG

SEQ ID NO: 82493 - protein, 9 aa, Dengue virus
MPPLRFLGE

SEQ ID NO: 82494 - protein, 9 aa, Dengue virus
PPLRFLGED

SEQ ID NO: 82495 - protein, 9 aa, Dengue virus
PLRFLGEDG

SEQ ID NO: 82496 - protein, 9 aa, Dengue virus
LRFLGEDGC

SEQ ID NO: 82497 - protein, 9 aa, Dengue virus
RFLGEDGCW

SEQ ID NO: 82498 - protein, 9 aa, Dengue virus
FLGEDGCWY

SEQ ID NO: 82499 - protein, 9 aa, Dengue virus
LGEDGCWYG

SEQ ID NO: 82500 - protein, 9 aa, Dengue virus
GEDGCWYGM

SEQ ID NO: 82501 - protein, 9 aa, Dengue virus
EDGCWYGME

SEQ ID NO: 82502 - protein, 9 aa, Dengue virus
DGCWYGMEI

SEQ ID NO: 82503 - protein, 9 aa, Dengue virus
GCWYGMEIR

SEQ ID NO: 82504 - protein, 9 aa, Dengue virus
CWYGMEIRP

SEQ ID NO: 82505 - protein, 9 aa, Dengue virus
WYGMEIRPL

SEQ ID NO: 82506 - protein, 9 aa, Dengue virus
YGMEIRPLS

SEQ ID NO: 82507 - protein, 9 aa, Dengue virus
GMEIRPLSE

SEQ ID NO: 82508 - protein, 9 aa, Dengue virus
MEIRPLSEK

SEQ ID NO: 82509 - protein, 9 aa, Dengue virus
EIRPLSEKE

SEQ ID NO: 82510 - protein, 9 aa, Dengue virus
IRPLSEKEE

SEQ ID NO: 82511 - protein, 9 aa, Dengue virus
RPLSEKEEN

SEQ ID NO: 82512 - protein, 9 aa, Dengue virus
PLSEKEENM

SEQ ID NO: 82513 - protein, 9 aa, Dengue virus
LSEKEENMV

SEQ ID NO: 82514 - protein, 9 aa, Dengue virus
SEKEENMVK

SEQ ID NO: 82515 - protein, 9 aa, Dengue virus
EKEENMVKS

SEQ ID NO: 82516 - protein, 9 aa, Dengue virus
KEENMVKSQ

SEQ ID NO: 82517 - protein, 9 aa, Dengue virus
EENMVKSQV

SEQ ID NO: 82518 - protein, 9 aa, Dengue virus
ENMVKSQVT

SEQ ID NO: 82519 - protein, 9 aa, Dengue virus
NMVKSQVTA

SEQ ID NO: 82520 - protein, 9 aa, Dengue virus
MVKSQVTAG

SEQ ID NO: 82521 - protein, 9 aa, Dengue virus
AGQGTSETF

SEQ ID NO: 82522 - protein, 9 aa, Dengue virus
GTSETFSMG

SEQ ID NO: 82523 - protein, 9 aa, Dengue virus
TSETFSMGL

SEQ ID NO: 82524 - protein, 9 aa, Dengue virus
SETFSMGLL

SEQ ID NO: 82525 - protein, 9 aa, Dengue virus
ETFSMGLLC

SEQ ID NO: 82526 - protein, 9 aa, Dengue virus
TFSMGLLCL

SEQ ID NO: 82527 - protein, 9 aa, Dengue virus
FSMGLLCLT

SEQ ID NO: 82528 - protein, 9 aa, Dengue virus
SMGLLCLTL

SEQ ID NO: 82529 - protein, 9 aa, Dengue virus
MGLLCLTLF

SEQ ID NO: 82530 - protein, 9 aa, Dengue virus
GLLCLTLFV

SEQ ID NO: 82531 - protein, 9 aa, Dengue virus
LLCLTLFVE

SEQ ID NO: 82532 - protein, 9 aa, Dengue virus
LCLTLFVEE

SEQ ID NO: 82533 - protein, 9 aa, Dengue virus
CLTLFVEEC

SEQ ID NO: 82534 - protein, 9 aa, Dengue virus
LTLFVEECL

SEQ ID NO: 82535 - protein, 9 aa, Dengue virus
TLFVEECLR

SEQ ID NO: 82536 - protein, 9 aa, Dengue virus
LFVEECLRR

SEQ ID NO: 82537 - protein, 9 aa, Dengue virus
FVEECLRRR

SEQ ID NO: 82538 - protein, 9 aa, Dengue virus
VEECLRRRV

SEQ ID NO: 82539 - protein, 9 aa, Dengue virus
EECLRRRVT

SEQ ID NO: 82540 - protein, 9 aa, Dengue virus
ECLRRRVTR

SEQ ID NO: 82541 - protein, 9 aa, Dengue virus
CLRRRVTRK

SEQ ID NO: 82542 - protein, 9 aa, Dengue virus
LRRRVTRKH

SEQ ID NO: 82543 - protein, 9 aa, Dengue virus
RRRVTRKHM

SEQ ID NO: 82544 - protein, 9 aa, Dengue virus
RRVTRKHMI

SEQ ID NO: 82545 - protein, 9 aa, Dengue virus
RVTRKHMIL

SEQ ID NO: 82546 - protein, 9 aa, Dengue virus
VTRKHMILA

SEQ ID NO: 82547 - protein, 9 aa, Dengue virus
TRKHMILAV

SEQ ID NO: 82548 - protein, 9 aa, Dengue virus
RKHMILAVV

SEQ ID NO: 82549 - protein, 9 aa, Dengue virus
KHMILAVVI

SEQ ID NO: 82550 - protein, 9 aa, Dengue virus
HMILAVVIT

SEQ ID NO: 82551 - protein, 9 aa, Dengue virus
ITLCAIILG

SEQ ID NO: 82552 - protein, 9 aa, Dengue virus
TLCAIILGG

SEQ ID NO: 82553 - protein, 9 aa, Dengue virus
LCAIILGGL

SEQ ID NO: 82554 - protein, 9 aa, Dengue virus
CAIILGGLT

SEQ ID NO: 82555 - protein, 9 aa, Dengue virus
AIILGGLTW

SEQ ID NO: 82556 - protein, 9 aa, Dengue virus
IILGGLTWM

SEQ ID NO: 82557 - protein, 9 aa, Dengue virus
ILGGLTWMD

SEQ ID NO: 82558 - protein, 9 aa, Dengue virus
LGGLTWMDL

SEQ ID NO: 82559 - protein, 9 aa, Dengue virus
GGLTWMDLL

SEQ ID NO: 82560 - protein, 9 aa, Dengue virus
GLTWMDLLR

SEQ ID NO: 82561 - protein, 9 aa, Dengue virus
LTWMDLLRA

SEQ ID NO: 82562 - protein, 9 aa, Dengue virus
TWMDLLRAL

SEQ ID NO: 82563 - protein, 9 aa, Dengue virus
WMDLLRALI

SEQ ID NO: 82564 - protein, 9 aa, Dengue virus
MDLLRALIM

SEQ ID NO: 82565 - protein, 9 aa, Dengue virus
DLLRALIML

SEQ ID NO: 82566 - protein, 9 aa, Dengue virus
LLRALIMLG

SEQ ID NO: 82567 - protein, 9 aa, Dengue virus
LRALIMLGD

SEQ ID NO: 82568 - protein, 9 aa, Dengue virus
RALIMLGDT

SEQ ID NO: 82569 - protein, 9 aa, Dengue virus
ALIMLGDTM

SEQ ID NO: 82570 - protein, 9 aa, Dengue virus
LIMLGDTMS

SEQ ID NO: 82571 - protein, 9 aa, Dengue virus
IMLGDTMSG

SEQ ID NO: 82572 - protein, 9 aa, Dengue virus
MLGDTMSGR

SEQ ID NO: 82573 - protein, 9 aa, Dengue virus
LGDTMSGRI

SEQ ID NO: 82574 - protein, 9 aa, Dengue virus
GDTMSGRIG

SEQ ID NO: 82575 - protein, 9 aa, Dengue virus
DTMSGRIGG

SEQ ID NO: 82576 - protein, 9 aa, Dengue virus
TMSGRIGGQ

SEQ ID NO: 82577 - protein, 9 aa, Dengue virus
RIGGQTHLA

SEQ ID NO: 82578 - protein, 9 aa, Dengue virus
IGGQTHLAI

SEQ ID NO: 82579 - protein, 9 aa, Dengue virus
GGQTHLAIM

SEQ ID NO: 82580 - protein, 9 aa, Dengue virus
GQTHLAIMA

SEQ ID NO: 82581 - protein, 9 aa, Dengue virus
QTHLAIMAV

SEQ ID NO: 82582 - protein, 9 aa, Dengue virus
THLAIMAVF

SEQ ID NO: 82583 - protein, 9 aa, Dengue virus
HLAIMAVFK

SEQ ID NO: 82584 - protein, 9 aa, Dengue virus
LAIMAVFKM

SEQ ID NO: 82585 - protein, 9 aa, Dengue virus
AIMAVFKMS

SEQ ID NO: 82586 - protein, 9 aa, Dengue virus
IMAVFKMSP

SEQ ID NO: 82587 - protein, 9 aa, Dengue virus
MAVFKMSPG

SEQ ID NO: 82588 - protein, 9 aa, Dengue virus
AVFKMSPGY

SEQ ID NO: 82589 - protein, 9 aa, Dengue virus
VFKMSPGYV

SEQ ID NO: 82590 - protein, 9 aa, Dengue virus
FKMSPGYVL

SEQ ID NO: 82591 - protein, 9 aa, Dengue virus
KMSPGYVLG

SEQ ID NO: 82592 - protein, 9 aa, Dengue virus
MSPGYVLGV

SEQ ID NO: 82593 - protein, 9 aa, Dengue virus
SPGYVLGVF

SEQ ID NO: 82594 - protein, 9 aa, Dengue virus
PGYVLGVFL

SEQ ID NO: 82595 - protein, 9 aa, Dengue virus
GYVLGVFLR

SEQ ID NO: 82596 - protein, 9 aa, Dengue virus
YVLGVFLRK

SEQ ID NO: 82597 - protein, 9 aa, Dengue virus
VLGVFLRKL

SEQ ID NO: 82598 - protein, 9 aa, Dengue virus
LGVFLRKLT

SEQ ID NO: 82599 - protein, 9 aa, Dengue virus
GVFLRKLTS

SEQ ID NO: 82600 - protein, 9 aa, Dengue virus
VFLRKLTSR

SEQ ID NO: 82601 - protein, 9 aa, Dengue virus
FLRKLTSRE

SEQ ID NO: 82602 - protein, 9 aa, Dengue virus
LRKLTSRET

SEQ ID NO: 82603 - protein, 9 aa, Dengue virus
RKLTSRETA

SEQ ID NO: 82604 - protein, 9 aa, Dengue virus
KLTSRETAL

SEQ ID NO: 82605 - protein, 9 aa, Dengue virus
LTSRETALM

SEQ ID NO: 82606 - protein, 9 aa, Dengue virus
TSRETALMV

SEQ ID NO: 82607 - protein, 9 aa, Dengue virus
SRETALMVI

SEQ ID NO: 82608 - protein, 9 aa, Dengue virus
RETALMVIG

SEQ ID NO: 82609 - protein, 9 aa, Dengue virus
ETALMVIGM

SEQ ID NO: 82610 - protein, 9 aa, Dengue virus
TALMVIGMA

SEQ ID NO: 82611 - protein, 9 aa, Dengue virus
ALMVIGMAM

SEQ ID NO: 82612 - protein, 9 aa, Dengue virus
LMVIGMAMT

SEQ ID NO: 82613 - protein, 9 aa, Dengue virus
MVIGMAMTT

SEQ ID NO: 82614 - protein, 9 aa, Dengue virus
VIGMAMTTT

SEQ ID NO: 82615 - protein, 9 aa, Dengue virus
IGMAMTTTL

SEQ ID NO: 82616 - protein, 9 aa, Dengue virus
GMAMTTTLS

SEQ ID NO: 82617 - protein, 9 aa, Dengue virus
MAMTTTLSI

SEQ ID NO: 82618 - protein, 9 aa, Dengue virus
AMTTTLSIP

SEQ ID NO: 82619 - protein, 9 aa, Dengue virus
MTTTLSIPH

SEQ ID NO: 82620 - protein, 9 aa, Dengue virus
TTTLSIPHD

SEQ ID NO: 82621 - protein, 9 aa, Dengue virus
TTLSIPHDL

SEQ ID NO: 82622 - protein, 9 aa, Dengue virus
TLSIPHDLM

SEQ ID NO: 82623 - protein, 9 aa, Dengue virus
LSIPHDLME

SEQ ID NO: 82624 - protein, 9 aa, Dengue virus
SIPHDLMEL

SEQ ID NO: 82625 - protein, 9 aa, Dengue virus
IPHDLMELI

SEQ ID NO: 82626 - protein, 9 aa, Dengue virus
PHDLMELID

SEQ ID NO: 82627 - protein, 9 aa, Dengue virus
HDLMELIDG

SEQ ID NO: 82628 - protein, 9 aa, Dengue virus
DLMELIDGI

SEQ ID NO: 82629 - protein, 9 aa, Dengue virus
LMELIDGIS

SEQ ID NO: 82630 - protein, 9 aa, Dengue virus
MELIDGISL

SEQ ID NO: 82631 - protein, 9 aa, Dengue virus
ELIDGISLG

SEQ ID NO: 82632 - protein, 9 aa, Dengue virus
LIDGISLGL

SEQ ID NO: 82633 - protein, 9 aa, Dengue virus
IDGISLGLI

SEQ ID NO: 82634 - protein, 9 aa, Dengue virus
DGISLGLIL

SEQ ID NO: 82635 - protein, 9 aa, Dengue virus
GISLGLILL

SEQ ID NO: 82636 - protein, 9 aa, Dengue virus
ISLGLILLK

SEQ ID NO: 82637 - protein, 9 aa, Dengue virus
SLGLILLKI

SEQ ID NO: 82638 - protein, 9 aa, Dengue virus
LGLILLKIV

SEQ ID NO: 82639 - protein, 9 aa, Dengue virus
GLILLKIVT

SEQ ID NO: 82640 - protein, 9 aa, Dengue virus
LILLKIVTQ

SEQ ID NO: 82641 - protein, 9 aa, Dengue virus
ILLKIVTQF

SEQ ID NO: 82642 - protein, 9 aa, Dengue virus
LLKIVTQFD

SEQ ID NO: 82643 - protein, 9 aa, Dengue virus
VTQFDNTQV

SEQ ID NO: 82644 - protein, 9 aa, Dengue virus
TQFDNTQVG

SEQ ID NO: 82645 - protein, 9 aa, Dengue virus
QFDNTQVGT

SEQ ID NO: 82646 - protein, 9 aa, Dengue virus
FDNTQVGTL

SEQ ID NO: 82647 - protein, 9 aa, Dengue virus
DNTQVGTLA

SEQ ID NO: 82648 - protein, 9 aa, Dengue virus
NTQVGTLAL

SEQ ID NO: 82649 - protein, 9 aa, Dengue virus
TQVGTLALS

SEQ ID NO: 82650 - protein, 9 aa, Dengue virus
QVGTLALSL

SEQ ID NO: 82651 - protein, 9 aa, Dengue virus
VGTLALSLT

SEQ ID NO: 82652 - protein, 9 aa, Dengue virus
GTLALSLTF

SEQ ID NO: 82653 - protein, 9 aa, Dengue virus
TLALSLTFI

SEQ ID NO: 82654 - protein, 9 aa, Dengue virus
LALSLTFIR

SEQ ID NO: 82655 - protein, 9 aa, Dengue virus
ALSLTFIRS

SEQ ID NO: 82656 - protein, 9 aa, Dengue virus
LSLTFIRST

SEQ ID NO: 82657 - protein, 9 aa, Dengue virus
SLVMAWRTI

SEQ ID NO: 82658 - protein, 9 aa, Dengue virus
LVMAWRTIM

SEQ ID NO: 82659 - protein, 9 aa, Dengue virus
VMAWRTIMA

SEQ ID NO: 82660 - protein, 9 aa, Dengue virus
MAWRTIMAV

SEQ ID NO: 82661 - protein, 9 aa, Dengue virus
AWRTIMAVL

SEQ ID NO: 82662 - protein, 9 aa, Dengue virus
WRTIMAVLF

SEQ ID NO: 82663 - protein, 9 aa, Dengue virus
RTIMAVLFV

SEQ ID NO: 82664 - protein, 9 aa, Dengue virus
TIMAVLFVV

SEQ ID NO: 82665 - protein, 9 aa, Dengue virus
IMAVLFVVT

SEQ ID NO: 82666 - protein, 9 aa, Dengue virus
MAVLFVVTL

SEQ ID NO: 82667 - protein, 9 aa, Dengue virus
AVLFVVTLI

SEQ ID NO: 82668 - protein, 9 aa, Dengue virus
VLFVVTLIP

SEQ ID NO: 82669 - protein, 9 aa, Dengue virus
LFVVTLIPL

SEQ ID NO: 82670 - protein, 9 aa, Dengue virus
FVVTLIPLC

SEQ ID NO: 82671 - protein, 9 aa, Dengue virus
VVTLIPLCR

SEQ ID NO: 82672 - protein, 9 aa, Dengue virus
VTLIPLCRT

SEQ ID NO: 82673 - protein, 9 aa, Dengue virus
TLIPLCRTS

SEQ ID NO: 82674 - protein, 9 aa, Dengue virus
LIPLCRTSC

SEQ ID NO: 82675 - protein, 9 aa, Dengue virus
IPLCRTSCL

SEQ ID NO: 82676 - protein, 9 aa, Dengue virus
PLCRTSCLQ

SEQ ID NO: 82677 - protein, 9 aa, Dengue virus
LCRTSCLQK

SEQ ID NO: 82678 - protein, 9 aa, Dengue virus
CRTSCLQKQ

SEQ ID NO: 82679 - protein, 9 aa, Dengue virus
RTSCLQKQS

SEQ ID NO: 82680 - protein, 9 aa, Dengue virus
TSCLQKQSH

SEQ ID NO: 82681 - protein, 9 aa, Dengue virus
SCLQKQSHW

SEQ ID NO: 82682 - protein, 9 aa, Dengue virus
CLQKQSHWV

SEQ ID NO: 82683 - protein, 9 aa, Dengue virus
LQKQSHWVE

SEQ ID NO: 82684 - protein, 9 aa, Dengue virus
QKQSHWVEI

SEQ ID NO: 82685 - protein, 9 aa, Dengue virus
KQSHWVEIT

SEQ ID NO: 82686 - protein, 9 aa, Dengue virus
QSHWVEITA

SEQ ID NO: 82687 - protein, 9 aa, Dengue virus
SHWVEITAL

SEQ ID NO: 82688 - protein, 9 aa, Dengue virus
HWVEITALI

SEQ ID NO: 82689 - protein, 9 aa, Dengue virus
WVEITALIL

SEQ ID NO: 82690 - protein, 9 aa, Dengue virus
VEITALILG

SEQ ID NO: 82691 - protein, 9 aa, Dengue virus
EITALILGA

SEQ ID NO: 82692 - protein, 9 aa, Dengue virus
ITALILGAQ

SEQ ID NO: 82693 - protein, 9 aa, Dengue virus
TALILGAQA

SEQ ID NO: 82694 - protein, 9 aa, Dengue virus
ALILGAQAL

SEQ ID NO: 82695 - protein, 9 aa, Dengue virus
LILGAQALP

SEQ ID NO: 82696 - protein, 9 aa, Dengue virus
ILGAQALPV

SEQ ID NO: 82697 - protein, 9 aa, Dengue virus
LGAQALPVY

SEQ ID NO: 82698 - protein, 9 aa, Dengue virus
GAQALPVYL

SEQ ID NO: 82699 - protein, 9 aa, Dengue virus
AQALPVYLM

SEQ ID NO: 82700 - protein, 9 aa, Dengue virus
QALPVYLMT

SEQ ID NO: 82701 - protein, 9 aa, Dengue virus
ALPVYLMTL

SEQ ID NO: 82702 - protein, 9 aa, Dengue virus
LPVYLMTLM

SEQ ID NO: 82703 - protein, 9 aa, Dengue virus
PVYLMTLMK

SEQ ID NO: 82704 - protein, 9 aa, Dengue virus
VYLMTLMKG

SEQ ID NO: 82705 - protein, 9 aa, Dengue virus
YLMTLMKGA

SEQ ID NO: 82706 - protein, 9 aa, Dengue virus
LMTLMKGAS

SEQ ID NO: 82707 - protein, 9 aa, Dengue virus
MTLMKGASR

SEQ ID NO: 82708 - protein, 9 aa, Dengue virus
TLMKGASRR

SEQ ID NO: 82709 - protein, 9 aa, Dengue virus
LMKGASRRS

SEQ ID NO: 82710 - protein, 9 aa, Dengue virus
MKGASRRSW

SEQ ID NO: 82711 - protein, 9 aa, Dengue virus
KGASRRSWP

SEQ ID NO: 82712 - protein, 9 aa, Dengue virus
GASRRSWPL

SEQ ID NO: 82713 - protein, 9 aa, Dengue virus
ASRRSWPLN

SEQ ID NO: 82714 - protein, 9 aa, Dengue virus
SRRSWPLNE

SEQ ID NO: 82715 - protein, 9 aa, Dengue virus
RRSWPLNEG

SEQ ID NO: 82716 - protein, 9 aa, Dengue virus
RSWPLNEGI

SEQ ID NO: 82717 - protein, 9 aa, Dengue virus
SWPLNEGIM

SEQ ID NO: 82718 - protein, 9 aa, Dengue virus
WPLNEGIMA

SEQ ID NO: 82719 - protein, 9 aa, Dengue virus
PLNEGIMAV

SEQ ID NO: 82720 - protein, 9 aa, Dengue virus
LNEGIMAVG

SEQ ID NO: 82721 - protein, 9 aa, Dengue virus
NEGIMAVGL

SEQ ID NO: 82722 - protein, 9 aa, Dengue virus
EGIMAVGLV

SEQ ID NO: 82723 - protein, 9 aa, Dengue virus
GIMAVGLVS

SEQ ID NO: 82724 - protein, 9 aa, Dengue virus
IMAVGLVSL

SEQ ID NO: 82725 - protein, 9 aa, Dengue virus
MAVGLVSLL

SEQ ID NO: 82726 - protein, 9 aa, Dengue virus
AVGLVSLLG

SEQ ID NO: 82727 - protein, 9 aa, Dengue virus
VGLVSLLGS

SEQ ID NO: 82728 - protein, 9 aa, Dengue virus
GLVSLLGSA

SEQ ID NO: 82729 - protein, 9 aa, Dengue virus
LVSLLGSAL

SEQ ID NO: 82730 - protein, 9 aa, Dengue virus
VSLLGSALL

SEQ ID NO: 82731 - protein, 9 aa, Dengue virus
SLLGSALLK

SEQ ID NO: 82732 - protein, 9 aa, Dengue virus
LLGSALLKN

SEQ ID NO: 82733 - protein, 9 aa, Dengue virus
LGSALLKND

SEQ ID NO: 82734 - protein, 9 aa, Dengue virus
GSALLKNDV

SEQ ID NO: 82735 - protein, 9 aa, Dengue virus
SALLKNDVP

SEQ ID NO: 82736 - protein, 9 aa, Dengue virus
ALLKNDVPL

SEQ ID NO: 82737 - protein, 9 aa, Dengue virus
LLKNDVPLA

SEQ ID NO: 82738 - protein, 9 aa, Dengue virus
LKNDVPLAG

SEQ ID NO: 82739 - protein, 9 aa, Dengue virus
KNDVPLAGP

SEQ ID NO: 82740 - protein, 9 aa, Dengue virus
NDVPLAGPM

SEQ ID NO: 82741 - protein, 9 aa, Dengue virus
DVPLAGPMV

SEQ ID NO: 82742 - protein, 9 aa, Dengue virus
VPLAGPMVA

SEQ ID NO: 82743 - protein, 9 aa, Dengue virus
PLAGPMVAG

SEQ ID NO: 82744 - protein, 9 aa, Dengue virus
LAGPMVAGG

SEQ ID NO: 82745 - protein, 9 aa, Dengue virus
AGPMVAGGL

SEQ ID NO: 82746 - protein, 9 aa, Dengue virus
GPMVAGGLL

SEQ ID NO: 82747 - protein, 9 aa, Dengue virus
PMVAGGLLL

SEQ ID NO: 82748 - protein, 9 aa, Dengue virus
MVAGGLLLA

SEQ ID NO: 82749 - protein, 9 aa, Dengue virus
VAGGLLLAA

SEQ ID NO: 82750 - protein, 9 aa, Dengue virus
AGGLLLAAY

SEQ ID NO: 82751 - protein, 9 aa, Dengue virus
GGLLLAAYV

SEQ ID NO: 82752 - protein, 9 aa, Dengue virus
GLLLAAYVM

SEQ ID NO: 82753 - protein, 9 aa, Dengue virus
LLLAAYVMS

SEQ ID NO: 82754 - protein, 9 aa, Dengue virus
LLAAYVMSG

SEQ ID NO: 82755 - protein, 9 aa, Dengue virus
LAAYVMSGS

SEQ ID NO: 82756 - protein, 9 aa, Dengue virus
AAYVMSGSS

SEQ ID NO: 82757 - protein, 9 aa, Dengue virus
AYVMSGSSA

SEQ ID NO: 82758 - protein, 9 aa, Dengue virus
YVMSGSSAD

SEQ ID NO: 82759 - protein, 9 aa, Dengue virus
VMSGSSADL

SEQ ID NO: 82760 - protein, 9 aa, Dengue virus
MSGSSADLS

SEQ ID NO: 82761 - protein, 9 aa, Dengue virus
SGSSADLSL

SEQ ID NO: 82762 - protein, 9 aa, Dengue virus
GSSADLSLE

SEQ ID NO: 82763 - protein, 9 aa, Dengue virus
SSADLSLEK

SEQ ID NO: 82764 - protein, 9 aa, Dengue virus
SADLSLEKA

SEQ ID NO: 82765 - protein, 9 aa, Dengue virus
ADLSLEKAA

SEQ ID NO: 82766 - protein, 9 aa, Dengue virus
DLSLEKAAN

SEQ ID NO: 82767 - protein, 9 aa, Dengue virus
LSLEKAANV

SEQ ID NO: 82768 - protein, 9 aa, Dengue virus
SLEKAANVQ

SEQ ID NO: 82769 - protein, 9 aa, Dengue virus
LEKAANVQW

SEQ ID NO: 82770 - protein, 9 aa, Dengue virus
EKAANVQWD

SEQ ID NO: 82771 - protein, 9 aa, Dengue virus
KAANVQWDE

SEQ ID NO: 82772 - protein, 9 aa, Dengue virus
AANVQWDEM

SEQ ID NO: 82773 - protein, 9 aa, Dengue virus
ANVQWDEMA

SEQ ID NO: 82774 - protein, 9 aa, Dengue virus
NVQWDEMAD

SEQ ID NO: 82775 - protein, 9 aa, Dengue virus
VQWDEMADI

SEQ ID NO: 82776 - protein, 9 aa, Dengue virus
QWDEMADIT

SEQ ID NO: 82777 - protein, 9 aa, Dengue virus
WDEMADITG

SEQ ID NO: 82778 - protein, 9 aa, Dengue virus
DEMADITGS

SEQ ID NO: 82779 - protein, 9 aa, Dengue virus
EMADITGSS

SEQ ID NO: 82780 - protein, 9 aa, Dengue virus
MADITGSSP

SEQ ID NO: 82781 - protein, 9 aa, Dengue virus
ADITGSSPI

SEQ ID NO: 82782 - protein, 9 aa, Dengue virus
DITGSSPII

SEQ ID NO: 82783 - protein, 9 aa, Dengue virus
ITGSSPIIE

SEQ ID NO: 82784 - protein, 9 aa, Dengue virus
TGSSPIIEV

SEQ ID NO: 82785 - protein, 9 aa, Dengue virus
GSSPIIEVK

SEQ ID NO: 82786 - protein, 9 aa, Dengue virus
SSPIIEVKQ

SEQ ID NO: 82787 - protein, 9 aa, Dengue virus
SPIIEVKQD

SEQ ID NO: 82788 - protein, 9 aa, Dengue virus
PIIEVKQDE

SEQ ID NO: 82789 - protein, 9 aa, Dengue virus
IIEVKQDED

SEQ ID NO: 82790 - protein, 9 aa, Dengue virus
IEVKQDEDG

SEQ ID NO: 82791 - protein, 9 aa, Dengue virus
EVKQDEDGS

SEQ ID NO: 82792 - protein, 9 aa, Dengue virus
VKQDEDGSF

SEQ ID NO: 82793 - protein, 9 aa, Dengue virus
KQDEDGSFS

SEQ ID NO: 82794 - protein, 9 aa, Dengue virus
QDEDGSFSI

SEQ ID NO: 82795 - protein, 9 aa, Dengue virus
DEDGSFSIR

SEQ ID NO: 82796 - protein, 9 aa, Dengue virus
EDGSFSIRD

SEQ ID NO: 82797 - protein, 9 aa, Dengue virus
DGSFSIRDV

SEQ ID NO: 82798 - protein, 9 aa, Dengue virus
GSFSIRDVE

SEQ ID NO: 82799 - protein, 9 aa, Dengue virus
SFSIRDVEE

SEQ ID NO: 82800 - protein, 9 aa, Dengue virus
FSIRDVEET

SEQ ID NO: 82801 - protein, 9 aa, Dengue virus
SIRDVEETN

SEQ ID NO: 82802 - protein, 9 aa, Dengue virus
IRDVEETNM

SEQ ID NO: 82803 - protein, 9 aa, Dengue virus
RDVEETNMI

SEQ ID NO: 82804 - protein, 9 aa, Dengue virus
DVEETNMIT

SEQ ID NO: 82805 - protein, 9 aa, Dengue virus
VEETNMITL

SEQ ID NO: 82806 - protein, 9 aa, Dengue virus
EETNMITLL

SEQ ID NO: 82807 - protein, 9 aa, Dengue virus
ETNMITLLV

SEQ ID NO: 82808 - protein, 9 aa, Dengue virus
TNMITLLVK

SEQ ID NO: 82809 - protein, 9 aa, Dengue virus
NMITLLVKL

SEQ ID NO: 82810 - protein, 9 aa, Dengue virus
MITLLVKLA

SEQ ID NO: 82811 - protein, 9 aa, Dengue virus
ITLLVKLAL

SEQ ID NO: 82812 - protein, 9 aa, Dengue virus
TLLVKLALI

SEQ ID NO: 82813 - protein, 9 aa, Dengue virus
LLVKLALIT

SEQ ID NO: 82814 - protein, 9 aa, Dengue virus
LVKLALITV

SEQ ID NO: 82815 - protein, 9 aa, Dengue virus
VKLALITVS

SEQ ID NO: 82816 - protein, 9 aa, Dengue virus
KLALITVSG

SEQ ID NO: 82817 - protein, 9 aa, Dengue virus
LALITVSGL

SEQ ID NO: 82818 - protein, 9 aa, Dengue virus
ALITVSGLY

SEQ ID NO: 82819 - protein, 9 aa, Dengue virus
LITVSGLYP

SEQ ID NO: 82820 - protein, 9 aa, Dengue virus
ITVSGLYPL

SEQ ID NO: 82821 - protein, 9 aa, Dengue virus
TVSGLYPLA

SEQ ID NO: 82822 - protein, 9 aa, Dengue virus
VSGLYPLAI

SEQ ID NO: 82823 - protein, 9 aa, Dengue virus
SGLYPLAIP

SEQ ID NO: 82824 - protein, 9 aa, Dengue virus
GLYPLAIPV

SEQ ID NO: 82825 - protein, 9 aa, Dengue virus
LYPLAIPVT

SEQ ID NO: 82826 - protein, 9 aa, Dengue virus
YPLAIPVTM

SEQ ID NO: 82827 - protein, 9 aa, Dengue virus
PLAIPVTMT

SEQ ID NO: 82828 - protein, 9 aa, Dengue virus
LAIPVTMTL

SEQ ID NO: 82829 - protein, 9 aa, Dengue virus
AIPVTMTLW

SEQ ID NO: 82830 - protein, 9 aa, Dengue virus
IPVTMTLWY

SEQ ID NO: 82831 - protein, 9 aa, Dengue virus
PVTMTLWYM

SEQ ID NO: 82832 - protein, 9 aa, Dengue virus
VTMTLWYMW

SEQ ID NO: 82833 - protein, 9 aa, Dengue virus
TMTLWYMWQ

SEQ ID NO: 82834 - protein, 9 aa, Dengue virus
MTLWYMWQV

SEQ ID NO: 82835 - protein, 9 aa, Dengue virus
TLWYMWQVK

SEQ ID NO: 82836 - protein, 9 aa, Dengue virus
LWYMWQVKT

SEQ ID NO: 82837 - protein, 9 aa, Dengue virus
WYMWQVKTQ

SEQ ID NO: 82838 - protein, 9 aa, Dengue virus
YMWQVKTQR

SEQ ID NO: 82839 - protein, 9 aa, Dengue virus
MWQVKTQRS

SEQ ID NO: 82840 - protein, 9 aa, Dengue virus
WQVKTQRSG

SEQ ID NO: 82841 - protein, 9 aa, Dengue virus
QVKTQRSGA

SEQ ID NO: 82842 - protein, 9 aa, Dengue virus
VKTQRSGAL

SEQ ID NO: 82843 - protein, 9 aa, Dengue virus
KTQRSGALW

SEQ ID NO: 82844 - protein, 9 aa, Dengue virus
TQRSGALWD

SEQ ID NO: 82845 - protein, 9 aa, Dengue virus
QRSGALWDV

SEQ ID NO: 82846 - protein, 9 aa, Dengue virus
RSGALWDVP

SEQ ID NO: 82847 - protein, 9 aa, Dengue virus
SGALWDVPS

SEQ ID NO: 82848 - protein, 9 aa, Dengue virus
GALWDVPSP

SEQ ID NO: 82849 - protein, 9 aa, Dengue virus
ALWDVPSPA

SEQ ID NO: 82850 - protein, 9 aa, Dengue virus
LWDVPSPAA

SEQ ID NO: 82851 - protein, 9 aa, Dengue virus
WDVPSPAAT

SEQ ID NO: 82852 - protein, 9 aa, Dengue virus
DVPSPAATQ

SEQ ID NO: 82853 - protein, 9 aa, Dengue virus
VPSPAATQK

SEQ ID NO: 82854 - protein, 9 aa, Dengue virus
PSPAATQKA

SEQ ID NO: 82855 - protein, 9 aa, Dengue virus
TQKAALSEG

SEQ ID NO: 82856 - protein, 9 aa, Dengue virus
QKAALSEGV

SEQ ID NO: 82857 - protein, 9 aa, Dengue virus
KAALSEGVY

SEQ ID NO: 82858 - protein, 9 aa, Dengue virus
AALSEGVYR

SEQ ID NO: 82859 - protein, 9 aa, Dengue virus
ALSEGVYRI

SEQ ID NO: 82860 - protein, 9 aa, Dengue virus
LSEGVYRIM

SEQ ID NO: 82861 - protein, 9 aa, Dengue virus
SEGVYRIMQ

SEQ ID NO: 82862 - protein, 9 aa, Dengue virus
EGVYRIMQR

SEQ ID NO: 82863 - protein, 9 aa, Dengue virus
GVYRIMQRG

SEQ ID NO: 82864 - protein, 9 aa, Dengue virus
VYRIMQRGL

SEQ ID NO: 82865 - protein, 9 aa, Dengue virus
YRIMQRGLF

SEQ ID NO: 82866 - protein, 9 aa, Dengue virus
RIMQRGLFG

SEQ ID NO: 82867 - protein, 9 aa, Dengue virus
IMQRGLFGK

SEQ ID NO: 82868 - protein, 9 aa, Dengue virus
MQRGLFGKT

SEQ ID NO: 82869 - protein, 9 aa, Dengue virus
QRGLFGKTQ

SEQ ID NO: 82870 - protein, 9 aa, Dengue virus
RGLFGKTQV

SEQ ID NO: 82871 - protein, 9 aa, Dengue virus
GLFGKTQVG

SEQ ID NO: 82872 - protein, 9 aa, Dengue virus
LFGKTQVGV

SEQ ID NO: 82873 - protein, 9 aa, Dengue virus
FGKTQVGVG

SEQ ID NO: 82874 - protein, 9 aa, Dengue virus
GKTQVGVGI

SEQ ID NO: 82875 - protein, 9 aa, Dengue virus
KTQVGVGIH

SEQ ID NO: 82876 - protein, 9 aa, Dengue virus
TQVGVGIHM

SEQ ID NO: 82877 - protein, 9 aa, Dengue virus
QVGVGIHME

SEQ ID NO: 82878 - protein, 9 aa, Dengue virus
VGVGIHMEG

SEQ ID NO: 82879 - protein, 9 aa, Dengue virus
GVGIHMEGV

SEQ ID NO: 82880 - protein, 9 aa, Dengue virus
VGIHMEGVF

SEQ ID NO: 82881 - protein, 9 aa, Dengue virus
GIHMEGVFH

SEQ ID NO: 82882 - protein, 9 aa, Dengue virus
IHMEGVFHT

SEQ ID NO: 82883 - protein, 9 aa, Dengue virus
HMEGVFHTM

SEQ ID NO: 82884 - protein, 9 aa, Dengue virus
MEGVFHTMW

SEQ ID NO: 82885 - protein, 9 aa, Dengue virus
EGVFHTMWH

SEQ ID NO: 82886 - protein, 9 aa, Dengue virus
GVFHTMWHV

SEQ ID NO: 82887 - protein, 9 aa, Dengue virus
VFHTMWHVT

SEQ ID NO: 82888 - protein, 9 aa, Dengue virus
FHTMWHVTR

SEQ ID NO: 82889 - protein, 9 aa, Dengue virus
HTMWHVTRG

SEQ ID NO: 82890 - protein, 9 aa, Dengue virus
TMWHVTRGS

SEQ ID NO: 82891 - protein, 9 aa, Dengue virus
MWHVTRGSV

SEQ ID NO: 82892 - protein, 9 aa, Dengue virus
WHVTRGSVI

SEQ ID NO: 82893 - protein, 9 aa, Dengue virus
HVTRGSVIC

SEQ ID NO: 82894 - protein, 9 aa, Dengue virus
VTRGSVICH

SEQ ID NO: 82895 - protein, 9 aa, Dengue virus
TRGSVICHE

SEQ ID NO: 82896 - protein, 9 aa, Dengue virus
RGSVICHET

SEQ ID NO: 82897 - protein, 9 aa, Dengue virus
GSVICHETG

SEQ ID NO: 82898 - protein, 9 aa, Dengue virus
SVICHETGR

SEQ ID NO: 82899 - protein, 9 aa, Dengue virus
VICHETGRL

SEQ ID NO: 82900 - protein, 9 aa, Dengue virus
ICHETGRLE

SEQ ID NO: 82901 - protein, 9 aa, Dengue virus
CHETGRLEP

SEQ ID NO: 82902 - protein, 9 aa, Dengue virus
HETGRLEPS

SEQ ID NO: 82903 - protein, 9 aa, Dengue virus
ETGRLEPSW

SEQ ID NO: 82904 - protein, 9 aa, Dengue virus
TGRLEPSWA

SEQ ID NO: 82905 - protein, 9 aa, Dengue virus
GRLEPSWAD

SEQ ID NO: 82906 - protein, 9 aa, Dengue virus
RLEPSWADV

SEQ ID NO: 82907 - protein, 9 aa, Dengue virus
LEPSWADVR

SEQ ID NO: 82908 - protein, 9 aa, Dengue virus
EPSWADVRN

SEQ ID NO: 82909 - protein, 9 aa, Dengue virus
PSWADVRND

SEQ ID NO: 82910 - protein, 9 aa, Dengue virus
SWADVRNDM

SEQ ID NO: 82911 - protein, 9 aa, Dengue virus
WADVRNDMI

SEQ ID NO: 82912 - protein, 9 aa, Dengue virus
ADVRNDMIS

SEQ ID NO: 82913 - protein, 9 aa, Dengue virus
DVRNDMISY

SEQ ID NO: 82914 - protein, 9 aa, Dengue virus
VRNDMISYG

SEQ ID NO: 82915 - protein, 9 aa, Dengue virus
RNDMISYGG

SEQ ID NO: 82916 - protein, 9 aa, Dengue virus
NDMISYGGG

SEQ ID NO: 82917 - protein, 9 aa, Dengue virus
DMISYGGGW

SEQ ID NO: 82918 - protein, 9 aa, Dengue virus
MISYGGGWR

SEQ ID NO: 82919 - protein, 9 aa, Dengue virus
ISYGGGWRL

SEQ ID NO: 82920 - protein, 9 aa, Dengue virus
SYGGGWRLG

SEQ ID NO: 82921 - protein, 9 aa, Dengue virus
YGGGWRLGD

SEQ ID NO: 82922 - protein, 9 aa, Dengue virus
GGGWRLGDK

SEQ ID NO: 82923 - protein, 9 aa, Dengue virus
GGWRLGDKW

SEQ ID NO: 82924 - protein, 9 aa, Dengue virus
GWRLGDKWD

SEQ ID NO: 82925 - protein, 9 aa, Dengue virus
WRLGDKWDK

SEQ ID NO: 82926 - protein, 9 aa, Dengue virus
RLGDKWDKE

SEQ ID NO: 82927 - protein, 9 aa, Dengue virus
LGDKWDKEE

SEQ ID NO: 82928 - protein, 9 aa, Dengue virus
GDKWDKEED

SEQ ID NO: 82929 - protein, 9 aa, Dengue virus
DKWDKEEDV

SEQ ID NO: 82930 - protein, 9 aa, Dengue virus
KWDKEEDVQ

SEQ ID NO: 82931 - protein, 9 aa, Dengue virus
WDKEEDVQV

SEQ ID NO: 82932 - protein, 9 aa, Dengue virus
DKEEDVQVL

SEQ ID NO: 82933 - protein, 9 aa, Dengue virus
KEEDVQVLA

SEQ ID NO: 82934 - protein, 9 aa, Dengue virus
EEDVQVLAI

SEQ ID NO: 82935 - protein, 9 aa, Dengue virus
EDVQVLAIE

SEQ ID NO: 82936 - protein, 9 aa, Dengue virus
DVQVLAIEP

SEQ ID NO: 82937 - protein, 9 aa, Dengue virus
VQVLAIEPG

SEQ ID NO: 82938 - protein, 9 aa, Dengue virus
QVLAIEPGK

SEQ ID NO: 82939 - protein, 9 aa, Dengue virus
VLAIEPGKN

SEQ ID NO: 82940 - protein, 9 aa, Dengue virus
LAIEPGKNP

SEQ ID NO: 82941 - protein, 9 aa, Dengue virus
AIEPGKNPK

SEQ ID NO: 82942 - protein, 9 aa, Dengue virus
IEPGKNPKH

SEQ ID NO: 82943 - protein, 9 aa, Dengue virus
EPGKNPKHV

SEQ ID NO: 82944 - protein, 9 aa, Dengue virus
PGKNPKHVQ

SEQ ID NO: 82945 - protein, 9 aa, Dengue virus
GKNPKHVQT

SEQ ID NO: 82946 - protein, 9 aa, Dengue virus
KNPKHVQTK

SEQ ID NO: 82947 - protein, 9 aa, Dengue virus
NPKHVQTKP

SEQ ID NO: 82948 - protein, 9 aa, Dengue virus
PKHVQTKPG

SEQ ID NO: 82949 - protein, 9 aa, Dengue virus
KHVQTKPGL

SEQ ID NO: 82950 - protein, 9 aa, Dengue virus
HVQTKPGLF

SEQ ID NO: 82951 - protein, 9 aa, Dengue virus
VQTKPGLFK

SEQ ID NO: 82952 - protein, 9 aa, Dengue virus
QTKPGLFKT

SEQ ID NO: 82953 - protein, 9 aa, Dengue virus
TKPGLFKTL

SEQ ID NO: 82954 - protein, 9 aa, Dengue virus
KPGLFKTLT

SEQ ID NO: 82955 - protein, 9 aa, Dengue virus
PGLFKTLTG

SEQ ID NO: 82956 - protein, 9 aa, Dengue virus
GLFKTLTGE

SEQ ID NO: 82957 - protein, 9 aa, Dengue virus
LFKTLTGEI

SEQ ID NO: 82958 - protein, 9 aa, Dengue virus
FKTLTGEIG

SEQ ID NO: 82959 - protein, 9 aa, Dengue virus
KTLTGEIGA

SEQ ID NO: 82960 - protein, 9 aa, Dengue virus
TLTGEIGAV

SEQ ID NO: 82961 - protein, 9 aa, Dengue virus
LTGEIGAVT

SEQ ID NO: 82962 - protein, 9 aa, Dengue virus
TGEIGAVTL

SEQ ID NO: 82963 - protein, 9 aa, Dengue virus
GEIGAVTLD

SEQ ID NO: 82964 - protein, 9 aa, Dengue virus
EIGAVTLDF

SEQ ID NO: 82965 - protein, 9 aa, Dengue virus
IGAVTLDFK

SEQ ID NO: 82966 - protein, 9 aa, Dengue virus
GAVTLDFKP

SEQ ID NO: 82967 - protein, 9 aa, Dengue virus
AVTLDFKPG

SEQ ID NO: 82968 - protein, 9 aa, Dengue virus
VTLDFKPGT

SEQ ID NO: 82969 - protein, 9 aa, Dengue virus
TLDFKPGTS

SEQ ID NO: 82970 - protein, 9 aa, Dengue virus
LDFKPGTSG

SEQ ID NO: 82971 - protein, 9 aa, Dengue virus
DFKPGTSGS

SEQ ID NO: 82972 - protein, 9 aa, Dengue virus
FKPGTSGSP

SEQ ID NO: 82973 - protein, 9 aa, Dengue virus
KPGTSGSPI

SEQ ID NO: 82974 - protein, 9 aa, Dengue virus
PGTSGSPII

SEQ ID NO: 82975 - protein, 9 aa, Dengue virus
GTSGSPIIN

SEQ ID NO: 82976 - protein, 9 aa, Dengue virus
TSGSPIINR

SEQ ID NO: 82977 - protein, 9 aa, Dengue virus
SGSPIINRK

SEQ ID NO: 82978 - protein, 9 aa, Dengue virus
GSPIINRKG

SEQ ID NO: 82979 - protein, 9 aa, Dengue virus
SPIINRKGK

SEQ ID NO: 82980 - protein, 9 aa, Dengue virus
PIINRKGKV

SEQ ID NO: 82981 - protein, 9 aa, Dengue virus
IINRKGKVI

SEQ ID NO: 82982 - protein, 9 aa, Dengue virus
INRKGKVIG

SEQ ID NO: 82983 - protein, 9 aa, Dengue virus
NRKGKVIGL

SEQ ID NO: 82984 - protein, 9 aa, Dengue virus
RKGKVIGLY

SEQ ID NO: 82985 - protein, 9 aa, Dengue virus
KGKVIGLYG

SEQ ID NO: 82986 - protein, 9 aa, Dengue virus
GKVIGLYGN

SEQ ID NO: 82987 - protein, 9 aa, Dengue virus
KVIGLYGNG

SEQ ID NO: 82988 - protein, 9 aa, Dengue virus
VIGLYGNGV

SEQ ID NO: 82989 - protein, 9 aa, Dengue virus
IGLYGNGVV

SEQ ID NO: 82990 - protein, 9 aa, Dengue virus
GLYGNGVVT

SEQ ID NO: 82991 - protein, 9 aa, Dengue virus
LYGNGVVTK

SEQ ID NO: 82992 - protein, 9 aa, Dengue virus
YGNGVVTKS

SEQ ID NO: 82993 - protein, 9 aa, Dengue virus
GNGVVTKSG

SEQ ID NO: 82994 - protein, 9 aa, Dengue virus
NGVVTKSGD

SEQ ID NO: 82995 - protein, 9 aa, Dengue virus
GVVTKSGDY

SEQ ID NO: 82996 - protein, 9 aa, Dengue virus
VVTKSGDYV

SEQ ID NO: 82997 - protein, 9 aa, Dengue virus
VTKSGDYVS

SEQ ID NO: 82998 - protein, 9 aa, Dengue virus
TKSGDYVSA

SEQ ID NO: 82999 - protein, 9 aa, Dengue virus
KSGDYVSAI

SEQ ID NO: 83000 - protein, 9 aa, Dengue virus
SGDYVSAIT

SEQ ID NO: 83001 - protein, 9 aa, Dengue virus
GDYVSAITQ

SEQ ID NO: 83002 - protein, 9 aa, Dengue virus
DYVSAITQA

SEQ ID NO: 83003 - protein, 9 aa, Dengue virus
YVSAITQAE

SEQ ID NO: 83004 - protein, 9 aa, Dengue virus
VSAITQAER

SEQ ID NO: 83005 - protein, 9 aa, Dengue virus
SAITQAERI

SEQ ID NO: 83006 - protein, 9 aa, Dengue virus
AITQAERIG

SEQ ID NO: 83007 - protein, 9 aa, Dengue virus
ITQAERIGE

SEQ ID NO: 83008 - protein, 9 aa, Dengue virus
TQAERIGEP

SEQ ID NO: 83009 - protein, 9 aa, Dengue virus
QAERIGEPD

SEQ ID NO: 83010 - protein, 9 aa, Dengue virus
AERIGEPDY

SEQ ID NO: 83011 - protein, 9 aa, Dengue virus
ERIGEPDYE

SEQ ID NO: 83012 - protein, 9 aa, Dengue virus
RIGEPDYEV

SEQ ID NO: 83013 - protein, 9 aa, Dengue virus
IGEPDYEVD

SEQ ID NO: 83014 - protein, 9 aa, Dengue virus
GEPDYEVDE

SEQ ID NO: 83015 - protein, 9 aa, Dengue virus
EPDYEVDED

SEQ ID NO: 83016 - protein, 9 aa, Dengue virus
PDYEVDEDI

SEQ ID NO: 83017 - protein, 9 aa, Dengue virus
DYEVDEDIF

SEQ ID NO: 83018 - protein, 9 aa, Dengue virus
YEVDEDIFR

SEQ ID NO: 83019 - protein, 9 aa, Dengue virus
EVDEDIFRK

SEQ ID NO: 83020 - protein, 9 aa, Dengue virus
VDEDIFRKK

SEQ ID NO: 83021 - protein, 9 aa, Dengue virus
DEDIFRKKR

SEQ ID NO: 83022 - protein, 9 aa, Dengue virus
EDIFRKKRL

SEQ ID NO: 83023 - protein, 9 aa, Dengue virus
DIFRKKRLT

SEQ ID NO: 83024 - protein, 9 aa, Dengue virus
IFRKKRLTI

SEQ ID NO: 83025 - protein, 9 aa, Dengue virus
FRKKRLTIM

SEQ ID NO: 83026 - protein, 9 aa, Dengue virus
RKKRLTIMD

SEQ ID NO: 83027 - protein, 9 aa, Dengue virus
KKRLTIMDL

SEQ ID NO: 83028 - protein, 9 aa, Dengue virus
KRLTIMDLH

SEQ ID NO: 83029 - protein, 9 aa, Dengue virus
RLTIMDLHP

SEQ ID NO: 83030 - protein, 9 aa, Dengue virus
LTIMDLHPG

SEQ ID NO: 83031 - protein, 9 aa, Dengue virus
TIMDLHPGA

SEQ ID NO: 83032 - protein, 9 aa, Dengue virus
IMDLHPGAG

SEQ ID NO: 83033 - protein, 9 aa, Dengue virus
MDLHPGAGK

SEQ ID NO: 83034 - protein, 9 aa, Dengue virus
DLHPGAGKT

SEQ ID NO: 83035 - protein, 9 aa, Dengue virus
LHPGAGKTK

SEQ ID NO: 83036 - protein, 9 aa, Dengue virus
HPGAGKTKR

SEQ ID NO: 83037 - protein, 9 aa, Dengue virus
PGAGKTKRI

SEQ ID NO: 83038 - protein, 9 aa, Dengue virus
GAGKTKRIL

SEQ ID NO: 83039 - protein, 9 aa, Dengue virus
AGKTKRILP

SEQ ID NO: 83040 - protein, 9 aa, Dengue virus
GKTKRILPS

SEQ ID NO: 83041 - protein, 9 aa, Dengue virus
KTKRILPSI

SEQ ID NO: 83042 - protein, 9 aa, Dengue virus
TKRILPSIV

SEQ ID NO: 83043 - protein, 9 aa, Dengue virus
KRILPSIVR

SEQ ID NO: 83044 - protein, 9 aa, Dengue virus
RILPSIVRE

SEQ ID NO: 83045 - protein, 9 aa, Dengue virus
ILPSIVREA

SEQ ID NO: 83046 - protein, 9 aa, Dengue virus
LPSIVREAL

SEQ ID NO: 83047 - protein, 9 aa, Dengue virus
PSIVREALK

SEQ ID NO: 83048 - protein, 9 aa, Dengue virus
SIVREALKR

SEQ ID NO: 83049 - protein, 9 aa, Dengue virus
IVREALKRR

SEQ ID NO: 83050 - protein, 9 aa, Dengue virus
VREALKRRL

SEQ ID NO: 83051 - protein, 9 aa, Dengue virus
REALKRRLR

SEQ ID NO: 83052 - protein, 9 aa, Dengue virus
EALKRRLRT

SEQ ID NO: 83053 - protein, 9 aa, Dengue virus
ALKRRLRTL

SEQ ID NO: 83054 - protein, 9 aa, Dengue virus
LKRRLRTLI

SEQ ID NO: 83055 - protein, 9 aa, Dengue virus
KRRLRTLIL

SEQ ID NO: 83056 - protein, 9 aa, Dengue virus
RRLRTLILA

SEQ ID NO: 83057 - protein, 9 aa, Dengue virus
RLRTLILAP

SEQ ID NO: 83058 - protein, 9 aa, Dengue virus
LRTLILAPT

SEQ ID NO: 83059 - protein, 9 aa, Dengue virus
RTLILAPTR

SEQ ID NO: 83060 - protein, 9 aa, Dengue virus
TLILAPTRV

SEQ ID NO: 83061 - protein, 9 aa, Dengue virus
LILAPTRVV

SEQ ID NO: 83062 - protein, 9 aa, Dengue virus
ILAPTRVVA

SEQ ID NO: 83063 - protein, 9 aa, Dengue virus
LAPTRVVAA

SEQ ID NO: 83064 - protein, 9 aa, Dengue virus
APTRVVAAE

SEQ ID NO: 83065 - protein, 9 aa, Dengue virus
PTRVVAAEM

SEQ ID NO: 83066 - protein, 9 aa, Dengue virus
TRVVAAEME

SEQ ID NO: 83067 - protein, 9 aa, Dengue virus
RVVAAEMEE

SEQ ID NO: 83068 - protein, 9 aa, Dengue virus
VVAAEMEEA

SEQ ID NO: 83069 - protein, 9 aa, Dengue virus
VAAEMEEAL

SEQ ID NO: 83070 - protein, 9 aa, Dengue virus
AAEMEEALR

SEQ ID NO: 83071 - protein, 9 aa, Dengue virus
AEMEEALRG

SEQ ID NO: 83072 - protein, 9 aa, Dengue virus
EMEEALRGL

SEQ ID NO: 83073 - protein, 9 aa, Dengue virus
MEEALRGLP

SEQ ID NO: 83074 - protein, 9 aa, Dengue virus
EEALRGLPI

SEQ ID NO: 83075 - protein, 9 aa, Dengue virus
EALRGLPIR

SEQ ID NO: 83076 - protein, 9 aa, Dengue virus
ALRGLPIRY

SEQ ID NO: 83077 - protein, 9 aa, Dengue virus
LRGLPIRYQ

SEQ ID NO: 83078 - protein, 9 aa, Dengue virus
RGLPIRYQT

SEQ ID NO: 83079 - protein, 9 aa, Dengue virus
GLPIRYQTP

SEQ ID NO: 83080 - protein, 9 aa, Dengue virus
LPIRYQTPA

SEQ ID NO: 83081 - protein, 9 aa, Dengue virus
PIRYQTPAV

SEQ ID NO: 83082 - protein, 9 aa, Dengue virus
IRYQTPAVK

SEQ ID NO: 83083 - protein, 9 aa, Dengue virus
RYQTPAVKS

SEQ ID NO: 83084 - protein, 9 aa, Dengue virus
YQTPAVKSE

SEQ ID NO: 83085 - protein, 9 aa, Dengue virus
QTPAVKSEH

SEQ ID NO: 83086 - protein, 9 aa, Dengue virus
TPAVKSEHT

SEQ ID NO: 83087 - protein, 9 aa, Dengue virus
PAVKSEHTG

SEQ ID NO: 83088 - protein, 9 aa, Dengue virus
AVKSEHTGR

SEQ ID NO: 83089 - protein, 9 aa, Dengue virus
VKSEHTGRE

SEQ ID NO: 83090 - protein, 9 aa, Dengue virus
KSEHTGREI

SEQ ID NO: 83091 - protein, 9 aa, Dengue virus
SEHTGREIV

SEQ ID NO: 83092 - protein, 9 aa, Dengue virus
EHTGREIVD

SEQ ID NO: 83093 - protein, 9 aa, Dengue virus
HTGREIVDL

SEQ ID NO: 83094 - protein, 9 aa, Dengue virus
TGREIVDLM

SEQ ID NO: 83095 - protein, 9 aa, Dengue virus
GREIVDLMC

SEQ ID NO: 83096 - protein, 9 aa, Dengue virus
REIVDLMCH

SEQ ID NO: 83097 - protein, 9 aa, Dengue virus
EIVDLMCHA

SEQ ID NO: 83098 - protein, 9 aa, Dengue virus
IVDLMCHAT

SEQ ID NO: 83099 - protein, 9 aa, Dengue virus
VDLMCHATF

SEQ ID NO: 83100 - protein, 9 aa, Dengue virus
DLMCHATFT

SEQ ID NO: 83101 - protein, 9 aa, Dengue virus
LMCHATFTT

SEQ ID NO: 83102 - protein, 9 aa, Dengue virus
MCHATFTTR

SEQ ID NO: 83103 - protein, 9 aa, Dengue virus
CHATFTTRL

SEQ ID NO: 83104 - protein, 9 aa, Dengue virus
HATFTTRLL

SEQ ID NO: 83105 - protein, 9 aa, Dengue virus
ATFTTRLLS

SEQ ID NO: 83106 - protein, 9 aa, Dengue virus
TFTTRLLSS

SEQ ID NO: 83107 - protein, 9 aa, Dengue virus
FTTRLLSST

SEQ ID NO: 83108 - protein, 9 aa, Dengue virus
TTRLLSSTR

SEQ ID NO: 83109 - protein, 9 aa, Dengue virus
TRLLSSTRV

SEQ ID NO: 83110 - protein, 9 aa, Dengue virus
RLLSSTRVP

SEQ ID NO: 83111 - protein, 9 aa, Dengue virus
LLSSTRVPN

SEQ ID NO: 83112 - protein, 9 aa, Dengue virus
LSSTRVPNY

SEQ ID NO: 83113 - protein, 9 aa, Dengue virus
SSTRVPNYN

SEQ ID NO: 83114 - protein, 9 aa, Dengue virus
STRVPNYNL

SEQ ID NO: 83115 - protein, 9 aa, Dengue virus
TRVPNYNLI

SEQ ID NO: 83116 - protein, 9 aa, Dengue virus
RVPNYNLIV

SEQ ID NO: 83117 - protein, 9 aa, Dengue virus
VPNYNLIVM

SEQ ID NO: 83118 - protein, 9 aa, Dengue virus
PNYNLIVMD

SEQ ID NO: 83119 - protein, 9 aa, Dengue virus
NYNLIVMDE

SEQ ID NO: 83120 - protein, 9 aa, Dengue virus
YNLIVMDEA

SEQ ID NO: 83121 - protein, 9 aa, Dengue virus
NLIVMDEAH

SEQ ID NO: 83122 - protein, 9 aa, Dengue virus
LIVMDEAHF

SEQ ID NO: 83123 - protein, 9 aa, Dengue virus
IVMDEAHFT

SEQ ID NO: 83124 - protein, 9 aa, Dengue virus
VMDEAHFTD

SEQ ID NO: 83125 - protein, 9 aa, Dengue virus
MDEAHFTDP

SEQ ID NO: 83126 - protein, 9 aa, Dengue virus
DEAHFTDPS

SEQ ID NO: 83127 - protein, 9 aa, Dengue virus
EAHFTDPSS

SEQ ID NO: 83128 - protein, 9 aa, Dengue virus
AHFTDPSSV

SEQ ID NO: 83129 - protein, 9 aa, Dengue virus
HFTDPSSVA

SEQ ID NO: 83130 - protein, 9 aa, Dengue virus
FTDPSSVAA

SEQ ID NO: 83131 - protein, 9 aa, Dengue virus
TDPSSVAAR

SEQ ID NO: 83132 - protein, 9 aa, Dengue virus
DPSSVAARG

SEQ ID NO: 83133 - protein, 9 aa, Dengue virus
PSSVAARGY

SEQ ID NO: 83134 - protein, 9 aa, Dengue virus
SSVAARGYI

SEQ ID NO: 83135 - protein, 9 aa, Dengue virus
SVAARGYIS

SEQ ID NO: 83136 - protein, 9 aa, Dengue virus
VAARGYIST

SEQ ID NO: 83137 - protein, 9 aa, Dengue virus
AARGYISTR

SEQ ID NO: 83138 - protein, 9 aa, Dengue virus
ARGYISTRV

SEQ ID NO: 83139 - protein, 9 aa, Dengue virus
RGYISTRVE

SEQ ID NO: 83140 - protein, 9 aa, Dengue virus
GYISTRVEM

SEQ ID NO: 83141 - protein, 9 aa, Dengue virus
YISTRVEMG

SEQ ID NO: 83142 - protein, 9 aa, Dengue virus
ISTRVEMGE

SEQ ID NO: 83143 - protein, 9 aa, Dengue virus
STRVEMGEA

SEQ ID NO: 83144 - protein, 9 aa, Dengue virus
TRVEMGEAA

SEQ ID NO: 83145 - protein, 9 aa, Dengue virus
RVEMGEAAA

SEQ ID NO: 83146 - protein, 9 aa, Dengue virus
VEMGEAAAI

SEQ ID NO: 83147 - protein, 9 aa, Dengue virus
EMGEAAAIF

SEQ ID NO: 83148 - protein, 9 aa, Dengue virus
MGEAAAIFM

SEQ ID NO: 83149 - protein, 9 aa, Dengue virus
GEAAAIFMT

SEQ ID NO: 83150 - protein, 9 aa, Dengue virus
EAAAIFMTA

SEQ ID NO: 83151 - protein, 9 aa, Dengue virus
AAAIFMTAT

SEQ ID NO: 83152 - protein, 9 aa, Dengue virus
AAIFMTATP

SEQ ID NO: 83153 - protein, 9 aa, Dengue virus
AIFMTATPP

SEQ ID NO: 83154 - protein, 9 aa, Dengue virus
IFMTATPPG

SEQ ID NO: 83155 - protein, 9 aa, Dengue virus
FMTATPPGA

SEQ ID NO: 83156 - protein, 9 aa, Dengue virus
MTATPPGAT

SEQ ID NO: 83157 - protein, 9 aa, Dengue virus
TATPPGATD

SEQ ID NO: 83158 - protein, 9 aa, Dengue virus
ATPPGATDP

SEQ ID NO: 83159 - protein, 9 aa, Dengue virus
TPPGATDPF

SEQ ID NO: 83160 - protein, 9 aa, Dengue virus
PPGATDPFP

SEQ ID NO: 83161 - protein, 9 aa, Dengue virus
PGATDPFPQ

SEQ ID NO: 83162 - protein, 9 aa, Dengue virus
GATDPFPQS

SEQ ID NO: 83163 - protein, 9 aa, Dengue virus
ATDPFPQSN

SEQ ID NO: 83164 - protein, 9 aa, Dengue virus
TDPFPQSNS

SEQ ID NO: 83165 - protein, 9 aa, Dengue virus
DPFPQSNSP

SEQ ID NO: 83166 - protein, 9 aa, Dengue virus
PFPQSNSPI

SEQ ID NO: 83167 - protein, 9 aa, Dengue virus
FPQSNSPIE

SEQ ID NO: 83168 - protein, 9 aa, Dengue virus
PQSNSPIED

SEQ ID NO: 83169 - protein, 9 aa, Dengue virus
QSNSPIEDI

SEQ ID NO: 83170 - protein, 9 aa, Dengue virus
SNSPIEDIE

SEQ ID NO: 83171 - protein, 9 aa, Dengue virus
NSPIEDIER

SEQ ID NO: 83172 - protein, 9 aa, Dengue virus
SPIEDIERE

SEQ ID NO: 83173 - protein, 9 aa, Dengue virus
PIEDIEREI

SEQ ID NO: 83174 - protein, 9 aa, Dengue virus
IEDIEREIP

SEQ ID NO: 83175 - protein, 9 aa, Dengue virus
EDIEREIPE

SEQ ID NO: 83176 - protein, 9 aa, Dengue virus
DIEREIPER

SEQ ID NO: 83177 - protein, 9 aa, Dengue virus
IEREIPERS

SEQ ID NO: 83178 - protein, 9 aa, Dengue virus
EREIPERSW

SEQ ID NO: 83179 - protein, 9 aa, Dengue virus
REIPERSWN

SEQ ID NO: 83180 - protein, 9 aa, Dengue virus
EIPERSWNT

SEQ ID NO: 83181 - protein, 9 aa, Dengue virus
IPERSWNTG

SEQ ID NO: 83182 - protein, 9 aa, Dengue virus
PERSWNTGF

SEQ ID NO: 83183 - protein, 9 aa, Dengue virus
ERSWNTGFD

SEQ ID NO: 83184 - protein, 9 aa, Dengue virus
RSWNTGFDW

SEQ ID NO: 83185 - protein, 9 aa, Dengue virus
SWNTGFDWI

SEQ ID NO: 83186 - protein, 9 aa, Dengue virus
WNTGFDWIT

SEQ ID NO: 83187 - protein, 9 aa, Dengue virus
NTGFDWITD

SEQ ID NO: 83188 - protein, 9 aa, Dengue virus
TGFDWITDY

SEQ ID NO: 83189 - protein, 9 aa, Dengue virus
GFDWITDYQ

SEQ ID NO: 83190 - protein, 9 aa, Dengue virus
FDWITDYQG

SEQ ID NO: 83191 - protein, 9 aa, Dengue virus
DWITDYQGK

SEQ ID NO: 83192 - protein, 9 aa, Dengue virus
WITDYQGKT

SEQ ID NO: 83193 - protein, 9 aa, Dengue virus
ITDYQGKTV

SEQ ID NO: 83194 - protein, 9 aa, Dengue virus
TDYQGKTVW

SEQ ID NO: 83195 - protein, 9 aa, Dengue virus
DYQGKTVWF

SEQ ID NO: 83196 - protein, 9 aa, Dengue virus
YQGKTVWFV

SEQ ID NO: 83197 - protein, 9 aa, Dengue virus
QGKTVWFVP

SEQ ID NO: 83198 - protein, 9 aa, Dengue virus
GKTVWFVPS

SEQ ID NO: 83199 - protein, 9 aa, Dengue virus
KTVWFVPSI

SEQ ID NO: 83200 - protein, 9 aa, Dengue virus
TVWFVPSIK

SEQ ID NO: 83201 - protein, 9 aa, Dengue virus
VWFVPSIKA

SEQ ID NO: 83202 - protein, 9 aa, Dengue virus
WFVPSIKAG

SEQ ID NO: 83203 - protein, 9 aa, Dengue virus
FVPSIKAGN

SEQ ID NO: 83204 - protein, 9 aa, Dengue virus
VPSIKAGND

SEQ ID NO: 83205 - protein, 9 aa, Dengue virus
PSIKAGNDI

SEQ ID NO: 83206 - protein, 9 aa, Dengue virus
SIKAGNDIA

SEQ ID NO: 83207 - protein, 9 aa, Dengue virus
IKAGNDIAN

SEQ ID NO: 83208 - protein, 9 aa, Dengue virus
KAGNDIANC

SEQ ID NO: 83209 - protein, 9 aa, Dengue virus
AGNDIANCL

SEQ ID NO: 83210 - protein, 9 aa, Dengue virus
GNDIANCLR

SEQ ID NO: 83211 - protein, 9 aa, Dengue virus
NDIANCLRK

SEQ ID NO: 83212 - protein, 9 aa, Dengue virus
DIANCLRKS

SEQ ID NO: 83213 - protein, 9 aa, Dengue virus
IANCLRKSG

SEQ ID NO: 83214 - protein, 9 aa, Dengue virus
ANCLRKSGK

SEQ ID NO: 83215 - protein, 9 aa, Dengue virus
NCLRKSGKK

SEQ ID NO: 83216 - protein, 9 aa, Dengue virus
CLRKSGKKV

SEQ ID NO: 83217 - protein, 9 aa, Dengue virus
LRKSGKKVI

SEQ ID NO: 83218 - protein, 9 aa, Dengue virus
RKSGKKVIQ

SEQ ID NO: 83219 - protein, 9 aa, Dengue virus
KSGKKVIQL

SEQ ID NO: 83220 - protein, 9 aa, Dengue virus
SGKKVIQLS

SEQ ID NO: 83221 - protein, 9 aa, Dengue virus
GKKVIQLSR

SEQ ID NO: 83222 - protein, 9 aa, Dengue virus
KKVIQLSRK

SEQ ID NO: 83223 - protein, 9 aa, Dengue virus
KVIQLSRKT

SEQ ID NO: 83224 - protein, 9 aa, Dengue virus
VIQLSRKTF

SEQ ID NO: 83225 - protein, 9 aa, Dengue virus
IQLSRKTFD

SEQ ID NO: 83226 - protein, 9 aa, Dengue virus
QLSRKTFDT

SEQ ID NO: 83227 - protein, 9 aa, Dengue virus
LSRKTFDTE

SEQ ID NO: 83228 - protein, 9 aa, Dengue virus
SRKTFDTEY

SEQ ID NO: 83229 - protein, 9 aa, Dengue virus
RKTFDTEYP

SEQ ID NO: 83230 - protein, 9 aa, Dengue virus
KTFDTEYPK

SEQ ID NO: 83231 - protein, 9 aa, Dengue virus
TFDTEYPKT

SEQ ID NO: 83232 - protein, 9 aa, Dengue virus
FDTEYPKTK

SEQ ID NO: 83233 - protein, 9 aa, Dengue virus
DTEYPKTKL

SEQ ID NO: 83234 - protein, 9 aa, Dengue virus
TEYPKTKLT

SEQ ID NO: 83235 - protein, 9 aa, Dengue virus
EYPKTKLTD

SEQ ID NO: 83236 - protein, 9 aa, Dengue virus
YPKTKLTDW

SEQ ID NO: 83237 - protein, 9 aa, Dengue virus
PKTKLTDWD

SEQ ID NO: 83238 - protein, 9 aa, Dengue virus
KTKLTDWDF

SEQ ID NO: 83239 - protein, 9 aa, Dengue virus
TKLTDWDFV

SEQ ID NO: 83240 - protein, 9 aa, Dengue virus
KLTDWDFVV

SEQ ID NO: 83241 - protein, 9 aa, Dengue virus
LTDWDFVVT

SEQ ID NO: 83242 - protein, 9 aa, Dengue virus
TDWDFVVTT

SEQ ID NO: 83243 - protein, 9 aa, Dengue virus
DWDFVVTTD

SEQ ID NO: 83244 - protein, 9 aa, Dengue virus
WDFVVTTDI

SEQ ID NO: 83245 - protein, 9 aa, Dengue virus
DFVVTTDIS

SEQ ID NO: 83246 - protein, 9 aa, Dengue virus
FVVTTDISE

SEQ ID NO: 83247 - protein, 9 aa, Dengue virus
VVTTDISEM

SEQ ID NO: 83248 - protein, 9 aa, Dengue virus
VTTDISEMG

SEQ ID NO: 83249 - protein, 9 aa, Dengue virus
TTDISEMGA

SEQ ID NO: 83250 - protein, 9 aa, Dengue virus
TDISEMGAN

SEQ ID NO: 83251 - protein, 9 aa, Dengue virus
DISEMGANF

SEQ ID NO: 83252 - protein, 9 aa, Dengue virus
ISEMGANFR

SEQ ID NO: 83253 - protein, 9 aa, Dengue virus
SEMGANFRA

SEQ ID NO: 83254 - protein, 9 aa, Dengue virus
EMGANFRAG

SEQ ID NO: 83255 - protein, 9 aa, Dengue virus
MGANFRAGR

SEQ ID NO: 83256 - protein, 9 aa, Dengue virus
GANFRAGRV

SEQ ID NO: 83257 - protein, 9 aa, Dengue virus
ANFRAGRVI

SEQ ID NO: 83258 - protein, 9 aa, Dengue virus
NFRAGRVID

SEQ ID NO: 83259 - protein, 9 aa, Dengue virus
FRAGRVIDP

SEQ ID NO: 83260 - protein, 9 aa, Dengue virus
RAGRVIDPR

SEQ ID NO: 83261 - protein, 9 aa, Dengue virus
AGRVIDPRR

SEQ ID NO: 83262 - protein, 9 aa, Dengue virus
GRVIDPRRC

SEQ ID NO: 83263 - protein, 9 aa, Dengue virus
RVIDPRRCL

SEQ ID NO: 83264 - protein, 9 aa, Dengue virus
VIDPRRCLK

SEQ ID NO: 83265 - protein, 9 aa, Dengue virus
IDPRRCLKP

SEQ ID NO: 83266 - protein, 9 aa, Dengue virus
DPRRCLKPV

SEQ ID NO: 83267 - protein, 9 aa, Dengue virus
PRRCLKPVI

SEQ ID NO: 83268 - protein, 9 aa, Dengue virus
RRCLKPVIL

SEQ ID NO: 83269 - protein, 9 aa, Dengue virus
RCLKPVILT

SEQ ID NO: 83270 - protein, 9 aa, Dengue virus
CLKPVILTD

SEQ ID NO: 83271 - protein, 9 aa, Dengue virus
LKPVILTDG

SEQ ID NO: 83272 - protein, 9 aa, Dengue virus
KPVILTDGP

SEQ ID NO: 83273 - protein, 9 aa, Dengue virus
PVILTDGPE

SEQ ID NO: 83274 - protein, 9 aa, Dengue virus
VILTDGPER

SEQ ID NO: 83275 - protein, 9 aa, Dengue virus
ILTDGPERV

SEQ ID NO: 83276 - protein, 9 aa, Dengue virus
LTDGPERVI

SEQ ID NO: 83277 - protein, 9 aa, Dengue virus
TDGPERVIL

SEQ ID NO: 83278 - protein, 9 aa, Dengue virus
DGPERVILA

SEQ ID NO: 83279 - protein, 9 aa, Dengue virus
GPERVILAG

SEQ ID NO: 83280 - protein, 9 aa, Dengue virus
PERVILAGP

SEQ ID NO: 83281 - protein, 9 aa, Dengue virus
ERVILAGPI

SEQ ID NO: 83282 - protein, 9 aa, Dengue virus
RVILAGPIP

SEQ ID NO: 83283 - protein, 9 aa, Dengue virus
VILAGPIPV

SEQ ID NO: 83284 - protein, 9 aa, Dengue virus
ILAGPIPVT

SEQ ID NO: 83285 - protein, 9 aa, Dengue virus
LAGPIPVTP

SEQ ID NO: 83286 - protein, 9 aa, Dengue virus
AGPIPVTPA

SEQ ID NO: 83287 - protein, 9 aa, Dengue virus
GPIPVTPAS

SEQ ID NO: 83288 - protein, 9 aa, Dengue virus
PIPVTPASA

SEQ ID NO: 83289 - protein, 9 aa, Dengue virus
IPVTPASAA

SEQ ID NO: 83290 - protein, 9 aa, Dengue virus
PVTPASAAQ

SEQ ID NO: 83291 - protein, 9 aa, Dengue virus
VTPASAAQR

SEQ ID NO: 83292 - protein, 9 aa, Dengue virus
TPASAAQRR

SEQ ID NO: 83293 - protein, 9 aa, Dengue virus
PASAAQRRG

SEQ ID NO: 83294 - protein, 9 aa, Dengue virus
ASAAQRRGR

SEQ ID NO: 83295 - protein, 9 aa, Dengue virus
SAAQRRGRI

SEQ ID NO: 83296 - protein, 9 aa, Dengue virus
AAQRRGRIG

SEQ ID NO: 83297 - protein, 9 aa, Dengue virus
AQRRGRIGR

SEQ ID NO: 83298 - protein, 9 aa, Dengue virus
QRRGRIGRN

SEQ ID NO: 83299 - protein, 9 aa, Dengue virus
RRGRIGRNP

SEQ ID NO: 83300 - protein, 9 aa, Dengue virus
RGRIGRNPA

SEQ ID NO: 83301 - protein, 9 aa, Dengue virus
GRIGRNPAQ

SEQ ID NO: 83302 - protein, 9 aa, Dengue virus
RIGRNPAQE

SEQ ID NO: 83303 - protein, 9 aa, Dengue virus
IGRNPAQED

SEQ ID NO: 83304 - protein, 9 aa, Dengue virus
GRNPAQEDD

SEQ ID NO: 83305 - protein, 9 aa, Dengue virus
RNPAQEDDQ

SEQ ID NO: 83306 - protein, 9 aa, Dengue virus
NPAQEDDQY

SEQ ID NO: 83307 - protein, 9 aa, Dengue virus
PAQEDDQYV

SEQ ID NO: 83308 - protein, 9 aa, Dengue virus
AQEDDQYVF

SEQ ID NO: 83309 - protein, 9 aa, Dengue virus
QEDDQYVFS

SEQ ID NO: 83310 - protein, 9 aa, Dengue virus
EDDQYVFSG

SEQ ID NO: 83311 - protein, 9 aa, Dengue virus
DDQYVFSGD

SEQ ID NO: 83312 - protein, 9 aa, Dengue virus
DQYVFSGDP

SEQ ID NO: 83313 - protein, 9 aa, Dengue virus
QYVFSGDPL

SEQ ID NO: 83314 - protein, 9 aa, Dengue virus
YVFSGDPLK

SEQ ID NO: 83315 - protein, 9 aa, Dengue virus
VFSGDPLKN

SEQ ID NO: 83316 - protein, 9 aa, Dengue virus
FSGDPLKND

SEQ ID NO: 83317 - protein, 9 aa, Dengue virus
SGDPLKNDE

SEQ ID NO: 83318 - protein, 9 aa, Dengue virus
GDPLKNDED

SEQ ID NO: 83319 - protein, 9 aa, Dengue virus
DPLKNDEDH

SEQ ID NO: 83320 - protein, 9 aa, Dengue virus
PLKNDEDHA

SEQ ID NO: 83321 - protein, 9 aa, Dengue virus
LKNDEDHAH

SEQ ID NO: 83322 - protein, 9 aa, Dengue virus
KNDEDHAHW

SEQ ID NO: 83323 - protein, 9 aa, Dengue virus
NDEDHAHWT

SEQ ID NO: 83324 - protein, 9 aa, Dengue virus
DEDHAHWTE

SEQ ID NO: 83325 - protein, 9 aa, Dengue virus
EDHAHWTEA

SEQ ID NO: 83326 - protein, 9 aa, Dengue virus
DHAHWTEAK

SEQ ID NO: 83327 - protein, 9 aa, Dengue virus
HAHWTEAKM

SEQ ID NO: 83328 - protein, 9 aa, Dengue virus
AHWTEAKML

SEQ ID NO: 83329 - protein, 9 aa, Dengue virus
HWTEAKMLL

SEQ ID NO: 83330 - protein, 9 aa, Dengue virus
WTEAKMLLD

SEQ ID NO: 83331 - protein, 9 aa, Dengue virus
TEAKMLLDN

SEQ ID NO: 83332 - protein, 9 aa, Dengue virus
EAKMLLDNI

SEQ ID NO: 83333 - protein, 9 aa, Dengue virus
AKMLLDNIY

SEQ ID NO: 83334 - protein, 9 aa, Dengue virus
KMLLDNIYT

SEQ ID NO: 83335 - protein, 9 aa, Dengue virus
MLLDNIYTP

SEQ ID NO: 83336 - protein, 9 aa, Dengue virus
LLDNIYTPE

SEQ ID NO: 83337 - protein, 9 aa, Dengue virus
LDNIYTPEG

SEQ ID NO: 83338 - protein, 9 aa, Dengue virus
DNIYTPEGI

SEQ ID NO: 83339 - protein, 9 aa, Dengue virus
NIYTPEGII

SEQ ID NO: 83340 - protein, 9 aa, Dengue virus
IYTPEGIIP

SEQ ID NO: 83341 - protein, 9 aa, Dengue virus
YTPEGIIPT

SEQ ID NO: 83342 - protein, 9 aa, Dengue virus
TPEGIIPTL

SEQ ID NO: 83343 - protein, 9 aa, Dengue virus
PEGIIPTLF

SEQ ID NO: 83344 - protein, 9 aa, Dengue virus
EGIIPTLFG

SEQ ID NO: 83345 - protein, 9 aa, Dengue virus
GIIPTLFGP

SEQ ID NO: 83346 - protein, 9 aa, Dengue virus
IIPTLFGPE

SEQ ID NO: 83347 - protein, 9 aa, Dengue virus
IPTLFGPER

SEQ ID NO: 83348 - protein, 9 aa, Dengue virus
PTLFGPERE

SEQ ID NO: 83349 - protein, 9 aa, Dengue virus
TLFGPEREK

SEQ ID NO: 83350 - protein, 9 aa, Dengue virus
LFGPEREKT

SEQ ID NO: 83351 - protein, 9 aa, Dengue virus
FGPEREKTQ

SEQ ID NO: 83352 - protein, 9 aa, Dengue virus
GPEREKTQA

SEQ ID NO: 83353 - protein, 9 aa, Dengue virus
PEREKTQAI

SEQ ID NO: 83354 - protein, 9 aa, Dengue virus
EREKTQAID

SEQ ID NO: 83355 - protein, 9 aa, Dengue virus
REKTQAIDG

SEQ ID NO: 83356 - protein, 9 aa, Dengue virus
EKTQAIDGE

SEQ ID NO: 83357 - protein, 9 aa, Dengue virus
KTQAIDGEF

SEQ ID NO: 83358 - protein, 9 aa, Dengue virus
TQAIDGEFR

SEQ ID NO: 83359 - protein, 9 aa, Dengue virus
QAIDGEFRL

SEQ ID NO: 83360 - protein, 9 aa, Dengue virus
AIDGEFRLR

SEQ ID NO: 83361 - protein, 9 aa, Dengue virus
IDGEFRLRG

SEQ ID NO: 83362 - protein, 9 aa, Dengue virus
DGEFRLRGE

SEQ ID NO: 83363 - protein, 9 aa, Dengue virus
GEFRLRGEQ

SEQ ID NO: 83364 - protein, 9 aa, Dengue virus
EFRLRGEQR

SEQ ID NO: 83365 - protein, 9 aa, Dengue virus
FRLRGEQRK

SEQ ID NO: 83366 - protein, 9 aa, Dengue virus
RLRGEQRKT

SEQ ID NO: 83367 - protein, 9 aa, Dengue virus
LRGEQRKTF

SEQ ID NO: 83368 - protein, 9 aa, Dengue virus
RGEQRKTFV

SEQ ID NO: 83369 - protein, 9 aa, Dengue virus
GEQRKTFVE

SEQ ID NO: 83370 - protein, 9 aa, Dengue virus
EQRKTFVEL

SEQ ID NO: 83371 - protein, 9 aa, Dengue virus
QRKTFVELM

SEQ ID NO: 83372 - protein, 9 aa, Dengue virus
RKTFVELMR

SEQ ID NO: 83373 - protein, 9 aa, Dengue virus
KTFVELMRR

SEQ ID NO: 83374 - protein, 9 aa, Dengue virus
TFVELMRRG

SEQ ID NO: 83375 - protein, 9 aa, Dengue virus
FVELMRRGD

SEQ ID NO: 83376 - protein, 9 aa, Dengue virus
VELMRRGDL

SEQ ID NO: 83377 - protein, 9 aa, Dengue virus
ELMRRGDLP

SEQ ID NO: 83378 - protein, 9 aa, Dengue virus
LMRRGDLPV

SEQ ID NO: 83379 - protein, 9 aa, Dengue virus
MRRGDLPVW

SEQ ID NO: 83380 - protein, 9 aa, Dengue virus
RRGDLPVWL

SEQ ID NO: 83381 - protein, 9 aa, Dengue virus
RGDLPVWLS

SEQ ID NO: 83382 - protein, 9 aa, Dengue virus
GDLPVWLSY

SEQ ID NO: 83383 - protein, 9 aa, Dengue virus
DLPVWLSYK

SEQ ID NO: 83384 - protein, 9 aa, Dengue virus
LPVWLSYKV

SEQ ID NO: 83385 - protein, 9 aa, Dengue virus
PVWLSYKVA

SEQ ID NO: 83386 - protein, 9 aa, Dengue virus
VWLSYKVAS

SEQ ID NO: 83387 - protein, 9 aa, Dengue virus
WLSYKVASA

SEQ ID NO: 83388 - protein, 9 aa, Dengue virus
LSYKVASAG

SEQ ID NO: 83389 - protein, 9 aa, Dengue virus
SYKVASAGI

SEQ ID NO: 83390 - protein, 9 aa, Dengue virus
YKVASAGIS

SEQ ID NO: 83391 - protein, 9 aa, Dengue virus
KVASAGISY

SEQ ID NO: 83392 - protein, 9 aa, Dengue virus
VASAGISYK

SEQ ID NO: 83393 - protein, 9 aa, Dengue virus
ASAGISYKD

SEQ ID NO: 83394 - protein, 9 aa, Dengue virus
SAGISYKDR

SEQ ID NO: 83395 - protein, 9 aa, Dengue virus
AGISYKDRE

SEQ ID NO: 83396 - protein, 9 aa, Dengue virus
GISYKDREW

SEQ ID NO: 83397 - protein, 9 aa, Dengue virus
ISYKDREWC

SEQ ID NO: 83398 - protein, 9 aa, Dengue virus
SYKDREWCF

SEQ ID NO: 83399 - protein, 9 aa, Dengue virus
YKDREWCFT

SEQ ID NO: 83400 - protein, 9 aa, Dengue virus
KDREWCFTG

SEQ ID NO: 83401 - protein, 9 aa, Dengue virus
DREWCFTGE

SEQ ID NO: 83402 - protein, 9 aa, Dengue virus
REWCFTGER

SEQ ID NO: 83403 - protein, 9 aa, Dengue virus
EWCFTGERN

SEQ ID NO: 83404 - protein, 9 aa, Dengue virus
WCFTGERNN

SEQ ID NO: 83405 - protein, 9 aa, Dengue virus
CFTGERNNQ

SEQ ID NO: 83406 - protein, 9 aa, Dengue virus
FTGERNNQI

SEQ ID NO: 83407 - protein, 9 aa, Dengue virus
TGERNNQIL

SEQ ID NO: 83408 - protein, 9 aa, Dengue virus
GERNNQILE

SEQ ID NO: 83409 - protein, 9 aa, Dengue virus
ERNNQILEE

SEQ ID NO: 83410 - protein, 9 aa, Dengue virus
RNNQILEEN

SEQ ID NO: 83411 - protein, 9 aa, Dengue virus
NNQILEENM

SEQ ID NO: 83412 - protein, 9 aa, Dengue virus
NQILEENME

SEQ ID NO: 83413 - protein, 9 aa, Dengue virus
QILEENMEV

SEQ ID NO: 83414 - protein, 9 aa, Dengue virus
ILEENMEVE

SEQ ID NO: 83415 - protein, 9 aa, Dengue virus
LEENMEVEI

SEQ ID NO: 83416 - protein, 9 aa, Dengue virus
EENMEVEIW

SEQ ID NO: 83417 - protein, 9 aa, Dengue virus
ENMEVEIWT

SEQ ID NO: 83418 - protein, 9 aa, Dengue virus
NMEVEIWTR

SEQ ID NO: 83419 - protein, 9 aa, Dengue virus
MEVEIWTRE

SEQ ID NO: 83420 - protein, 9 aa, Dengue virus
EVEIWTREG

SEQ ID NO: 83421 - protein, 9 aa, Dengue virus
VEIWTREGE

SEQ ID NO: 83422 - protein, 9 aa, Dengue virus
EIWTREGEK

SEQ ID NO: 83423 - protein, 9 aa, Dengue virus
IWTREGEKK

SEQ ID NO: 83424 - protein, 9 aa, Dengue virus
WTREGEKKK

SEQ ID NO: 83425 - protein, 9 aa, Dengue virus
TREGEKKKL

SEQ ID NO: 83426 - protein, 9 aa, Dengue virus
REGEKKKLR

SEQ ID NO: 83427 - protein, 9 aa, Dengue virus
EGEKKKLRP

SEQ ID NO: 83428 - protein, 9 aa, Dengue virus
GEKKKLRPR

SEQ ID NO: 83429 - protein, 9 aa, Dengue virus
EKKKLRPRW

SEQ ID NO: 83430 - protein, 9 aa, Dengue virus
KKKLRPRWL

SEQ ID NO: 83431 - protein, 9 aa, Dengue virus
KKLRPRWLD

SEQ ID NO: 83432 - protein, 9 aa, Dengue virus
KLRPRWLDA

SEQ ID NO: 83433 - protein, 9 aa, Dengue virus
LRPRWLDAR

SEQ ID NO: 83434 - protein, 9 aa, Dengue virus
RPRWLDARV

SEQ ID NO: 83435 - protein, 9 aa, Dengue virus
PRWLDARVY

SEQ ID NO: 83436 - protein, 9 aa, Dengue virus
RWLDARVYA

SEQ ID NO: 83437 - protein, 9 aa, Dengue virus
WLDARVYAD

SEQ ID NO: 83438 - protein, 9 aa, Dengue virus
LDARVYADP

SEQ ID NO: 83439 - protein, 9 aa, Dengue virus
DARVYADPM

SEQ ID NO: 83440 - protein, 9 aa, Dengue virus
ARVYADPMA

SEQ ID NO: 83441 - protein, 9 aa, Dengue virus
RVYADPMAL

SEQ ID NO: 83442 - protein, 9 aa, Dengue virus
VYADPMALK

SEQ ID NO: 83443 - protein, 9 aa, Dengue virus
YADPMALKD

SEQ ID NO: 83444 - protein, 9 aa, Dengue virus
ADPMALKDF

SEQ ID NO: 83445 - protein, 9 aa, Dengue virus
DPMALKDFK

SEQ ID NO: 83446 - protein, 9 aa, Dengue virus
PMALKDFKE

SEQ ID NO: 83447 - protein, 9 aa, Dengue virus
MALKDFKEF

SEQ ID NO: 83448 - protein, 9 aa, Dengue virus
ALKDFKEFA

SEQ ID NO: 83449 - protein, 9 aa, Dengue virus
LKDFKEFAS

SEQ ID NO: 83450 - protein, 9 aa, Dengue virus
KDFKEFASG

SEQ ID NO: 83451 - protein, 9 aa, Dengue virus
DFKEFASGR

SEQ ID NO: 83452 - protein, 9 aa, Dengue virus
FKEFASGRK

SEQ ID NO: 83453 - protein, 9 aa, Dengue virus
KEFASGRKS

SEQ ID NO: 83454 - protein, 9 aa, Dengue virus
EFASGRKSI

SEQ ID NO: 83455 - protein, 9 aa, Dengue virus
FASGRKSIT

SEQ ID NO: 83456 - protein, 9 aa, Dengue virus
ASGRKSITL

SEQ ID NO: 83457 - protein, 9 aa, Dengue virus
SGRKSITLD

SEQ ID NO: 83458 - protein, 9 aa, Dengue virus
GRKSITLDI

SEQ ID NO: 83459 - protein, 9 aa, Dengue virus
RKSITLDIL

SEQ ID NO: 83460 - protein, 9 aa, Dengue virus
KSITLDILT

SEQ ID NO: 83461 - protein, 9 aa, Dengue virus
SITLDILTE

SEQ ID NO: 83462 - protein, 9 aa, Dengue virus
ITLDILTEI

SEQ ID NO: 83463 - protein, 9 aa, Dengue virus
TLDILTEIA

SEQ ID NO: 83464 - protein, 9 aa, Dengue virus
LDILTEIAS

SEQ ID NO: 83465 - protein, 9 aa, Dengue virus
DILTEIASL

SEQ ID NO: 83466 - protein, 9 aa, Dengue virus
ILTEIASLP

SEQ ID NO: 83467 - protein, 9 aa, Dengue virus
LTEIASLPT

SEQ ID NO: 83468 - protein, 9 aa, Dengue virus
TEIASLPTY

SEQ ID NO: 83469 - protein, 9 aa, Dengue virus
EIASLPTYL

SEQ ID NO: 83470 - protein, 9 aa, Dengue virus
IASLPTYLS

SEQ ID NO: 83471 - protein, 9 aa, Dengue virus
ASLPTYLSS

SEQ ID NO: 83472 - protein, 9 aa, Dengue virus
SLPTYLSSR

SEQ ID NO: 83473 - protein, 9 aa, Dengue virus
LPTYLSSRA

SEQ ID NO: 83474 - protein, 9 aa, Dengue virus
PTYLSSRAK

SEQ ID NO: 83475 - protein, 9 aa, Dengue virus
TYLSSRAKL

SEQ ID NO: 83476 - protein, 9 aa, Dengue virus
YLSSRAKLA

SEQ ID NO: 83477 - protein, 9 aa, Dengue virus
LSSRAKLAL

SEQ ID NO: 83478 - protein, 9 aa, Dengue virus
SSRAKLALD

SEQ ID NO: 83479 - protein, 9 aa, Dengue virus
SRAKLALDN

SEQ ID NO: 83480 - protein, 9 aa, Dengue virus
RAKLALDNI

SEQ ID NO: 83481 - protein, 9 aa, Dengue virus
AKLALDNIV

SEQ ID NO: 83482 - protein, 9 aa, Dengue virus
KLALDNIVM

SEQ ID NO: 83483 - protein, 9 aa, Dengue virus
LALDNIVML

SEQ ID NO: 83484 - protein, 9 aa, Dengue virus
ALDNIVMLH

SEQ ID NO: 83485 - protein, 9 aa, Dengue virus
LDNIVMLHT

SEQ ID NO: 83486 - protein, 9 aa, Dengue virus
DNIVMLHTT

SEQ ID NO: 83487 - protein, 9 aa, Dengue virus
NIVMLHTTE

SEQ ID NO: 83488 - protein, 9 aa, Dengue virus
IVMLHTTER

SEQ ID NO: 83489 - protein, 9 aa, Dengue virus
VMLHTTERG

SEQ ID NO: 83490 - protein, 9 aa, Dengue virus
MLHTTERGG

SEQ ID NO: 83491 - protein, 9 aa, Dengue virus
LHTTERGGR

SEQ ID NO: 83492 - protein, 9 aa, Dengue virus
HTTERGGRA

SEQ ID NO: 83493 - protein, 9 aa, Dengue virus
TTERGGRAY

SEQ ID NO: 83494 - protein, 9 aa, Dengue virus
TERGGRAYQ

SEQ ID NO: 83495 - protein, 9 aa, Dengue virus
ERGGRAYQH

SEQ ID NO: 83496 - protein, 9 aa, Dengue virus
RGGRAYQHA

SEQ ID NO: 83497 - protein, 9 aa, Dengue virus
GGRAYQHAL

SEQ ID NO: 83498 - protein, 9 aa, Dengue virus
GRAYQHALN

SEQ ID NO: 83499 - protein, 9 aa, Dengue virus
RAYQHALNE

SEQ ID NO: 83500 - protein, 9 aa, Dengue virus
AYQHALNEL

SEQ ID NO: 83501 - protein, 9 aa, Dengue virus
YQHALNELP

SEQ ID NO: 83502 - protein, 9 aa, Dengue virus
QHALNELPE

SEQ ID NO: 83503 - protein, 9 aa, Dengue virus
HALNELPES

SEQ ID NO: 83504 - protein, 9 aa, Dengue virus
ALNELPESL

SEQ ID NO: 83505 - protein, 9 aa, Dengue virus
LNELPESLE

SEQ ID NO: 83506 - protein, 9 aa, Dengue virus
NELPESLET

SEQ ID NO: 83507 - protein, 9 aa, Dengue virus
ELPESLETL

SEQ ID NO: 83508 - protein, 9 aa, Dengue virus
LPESLETLM

SEQ ID NO: 83509 - protein, 9 aa, Dengue virus
PESLETLML

SEQ ID NO: 83510 - protein, 9 aa, Dengue virus
ESLETLMLV

SEQ ID NO: 83511 - protein, 9 aa, Dengue virus
SLETLMLVA

SEQ ID NO: 83512 - protein, 9 aa, Dengue virus
LETLMLVAL

SEQ ID NO: 83513 - protein, 9 aa, Dengue virus
ETLMLVALL

SEQ ID NO: 83514 - protein, 9 aa, Dengue virus
TLMLVALLG

SEQ ID NO: 83515 - protein, 9 aa, Dengue virus
LMLVALLGA

SEQ ID NO: 83516 - protein, 9 aa, Dengue virus
MLVALLGAM

SEQ ID NO: 83517 - protein, 9 aa, Dengue virus
LVALLGAMT

SEQ ID NO: 83518 - protein, 9 aa, Dengue virus
VALLGAMTA

SEQ ID NO: 83519 - protein, 9 aa, Dengue virus
ALLGAMTAG

SEQ ID NO: 83520 - protein, 9 aa, Dengue virus
LLGAMTAGI

SEQ ID NO: 83521 - protein, 9 aa, Dengue virus
LGAMTAGIF

SEQ ID NO: 83522 - protein, 9 aa, Dengue virus
GAMTAGIFL

SEQ ID NO: 83523 - protein, 9 aa, Dengue virus
AMTAGIFLF

SEQ ID NO: 83524 - protein, 9 aa, Dengue virus
MTAGIFLFF

SEQ ID NO: 83525 - protein, 9 aa, Dengue virus
TAGIFLFFM

SEQ ID NO: 83526 - protein, 9 aa, Dengue virus
AGIFLFFMQ

SEQ ID NO: 83527 - protein, 9 aa, Dengue virus
GIFLFFMQG

SEQ ID NO: 83528 - protein, 9 aa, Dengue virus
IFLFFMQGK

SEQ ID NO: 83529 - protein, 9 aa, Dengue virus
FLFFMQGKG

SEQ ID NO: 83530 - protein, 9 aa, Dengue virus
LFFMQGKGI

SEQ ID NO: 83531 - protein, 9 aa, Dengue virus
FFMQGKGIG

SEQ ID NO: 83532 - protein, 9 aa, Dengue virus
FMQGKGIGK

SEQ ID NO: 83533 - protein, 9 aa, Dengue virus
MQGKGIGKL

SEQ ID NO: 83534 - protein, 9 aa, Dengue virus
QGKGIGKLS

SEQ ID NO: 83535 - protein, 9 aa, Dengue virus
GKGIGKLSM

SEQ ID NO: 83536 - protein, 9 aa, Dengue virus
KGIGKLSMG

SEQ ID NO: 83537 - protein, 9 aa, Dengue virus
GIGKLSMGL

SEQ ID NO: 83538 - protein, 9 aa, Dengue virus
IGKLSMGLI

SEQ ID NO: 83539 - protein, 9 aa, Dengue virus
GKLSMGLIT

SEQ ID NO: 83540 - protein, 9 aa, Dengue virus
KLSMGLITI

SEQ ID NO: 83541 - protein, 9 aa, Dengue virus
LSMGLITIA

SEQ ID NO: 83542 - protein, 9 aa, Dengue virus
SMGLITIAV

SEQ ID NO: 83543 - protein, 9 aa, Dengue virus
MGLITIAVA

SEQ ID NO: 83544 - protein, 9 aa, Dengue virus
GLITIAVAS

SEQ ID NO: 83545 - protein, 9 aa, Dengue virus
LITIAVASG

SEQ ID NO: 83546 - protein, 9 aa, Dengue virus
ITIAVASGL

SEQ ID NO: 83547 - protein, 9 aa, Dengue virus
TIAVASGLL

SEQ ID NO: 83548 - protein, 9 aa, Dengue virus
IAVASGLLW

SEQ ID NO: 83549 - protein, 9 aa, Dengue virus
AVASGLLWV

SEQ ID NO: 83550 - protein, 9 aa, Dengue virus
VASGLLWVA

SEQ ID NO: 83551 - protein, 9 aa, Dengue virus
ASGLLWVAE

SEQ ID NO: 83552 - protein, 9 aa, Dengue virus
SGLLWVAEI

SEQ ID NO: 83553 - protein, 9 aa, Dengue virus
GLLWVAEIQ

SEQ ID NO: 83554 - protein, 9 aa, Dengue virus
LLWVAEIQP

SEQ ID NO: 83555 - protein, 9 aa, Dengue virus
LWVAEIQPQ

SEQ ID NO: 83556 - protein, 9 aa, Dengue virus
WVAEIQPQW

SEQ ID NO: 83557 - protein, 9 aa, Dengue virus
VAEIQPQWI

SEQ ID NO: 83558 - protein, 9 aa, Dengue virus
AEIQPQWIA

SEQ ID NO: 83559 - protein, 9 aa, Dengue virus
EIQPQWIAA

SEQ ID NO: 83560 - protein, 9 aa, Dengue virus
IQPQWIAAS

SEQ ID NO: 83561 - protein, 9 aa, Dengue virus
QPQWIAASI

SEQ ID NO: 83562 - protein, 9 aa, Dengue virus
PQWIAASII

SEQ ID NO: 83563 - protein, 9 aa, Dengue virus
QWIAASIIL

SEQ ID NO: 83564 - protein, 9 aa, Dengue virus
WIAASIILE

SEQ ID NO: 83565 - protein, 9 aa, Dengue virus
IAASIILEF

SEQ ID NO: 83566 - protein, 9 aa, Dengue virus
AASIILEFF

SEQ ID NO: 83567 - protein, 9 aa, Dengue virus
ASIILEFFL

SEQ ID NO: 83568 - protein, 9 aa, Dengue virus
SIILEFFLM

SEQ ID NO: 83569 - protein, 9 aa, Dengue virus
IILEFFLMV

SEQ ID NO: 83570 - protein, 9 aa, Dengue virus
ILEFFLMVL

SEQ ID NO: 83571 - protein, 9 aa, Dengue virus
LEFFLMVLL

SEQ ID NO: 83572 - protein, 9 aa, Dengue virus
EFFLMVLLI

SEQ ID NO: 83573 - protein, 9 aa, Dengue virus
FFLMVLLIP

SEQ ID NO: 83574 - protein, 9 aa, Dengue virus
FLMVLLIPE

SEQ ID NO: 83575 - protein, 9 aa, Dengue virus
LMVLLIPEP

SEQ ID NO: 83576 - protein, 9 aa, Dengue virus
MVLLIPEPE

SEQ ID NO: 83577 - protein, 9 aa, Dengue virus
VLLIPEPEK

SEQ ID NO: 83578 - protein, 9 aa, Dengue virus
LLIPEPEKQ

SEQ ID NO: 83579 - protein, 9 aa, Dengue virus
LIPEPEKQR

SEQ ID NO: 83580 - protein, 9 aa, Dengue virus
IPEPEKQRT

SEQ ID NO: 83581 - protein, 9 aa, Dengue virus
PEPEKQRTP

SEQ ID NO: 83582 - protein, 9 aa, Dengue virus
EPEKQRTPQ

SEQ ID NO: 83583 - protein, 9 aa, Dengue virus
PEKQRTPQD

SEQ ID NO: 83584 - protein, 9 aa, Dengue virus
EKQRTPQDN

SEQ ID NO: 83585 - protein, 9 aa, Dengue virus
KQRTPQDNQ

SEQ ID NO: 83586 - protein, 9 aa, Dengue virus
QRTPQDNQL

SEQ ID NO: 83587 - protein, 9 aa, Dengue virus
RTPQDNQLI

SEQ ID NO: 83588 - protein, 9 aa, Dengue virus
TPQDNQLIY

SEQ ID NO: 83589 - protein, 9 aa, Dengue virus
PQDNQLIYV

SEQ ID NO: 83590 - protein, 9 aa, Dengue virus
QDNQLIYVI

SEQ ID NO: 83591 - protein, 9 aa, Dengue virus
DNQLIYVIL

SEQ ID NO: 83592 - protein, 9 aa, Dengue virus
NQLIYVILT

SEQ ID NO: 83593 - protein, 9 aa, Dengue virus
QLIYVILTI

SEQ ID NO: 83594 - protein, 9 aa, Dengue virus
LIYVILTIL

SEQ ID NO: 83595 - protein, 9 aa, Dengue virus
IYVILTILT

SEQ ID NO: 83596 - protein, 9 aa, Dengue virus
YVILTILTI

SEQ ID NO: 83597 - protein, 9 aa, Dengue virus
VILTILTII

SEQ ID NO: 83598 - protein, 9 aa, Dengue virus
ILTILTIIG

SEQ ID NO: 83599 - protein, 9 aa, Dengue virus
LTILTIIGL

SEQ ID NO: 83600 - protein, 9 aa, Dengue virus
ILTIIGLIA

SEQ ID NO: 83601 - protein, 9 aa, Dengue virus
LTIIGLIAA

SEQ ID NO: 83602 - protein, 9 aa, Dengue virus
TIIGLIAAN

SEQ ID NO: 83603 - protein, 9 aa, Dengue virus
IIGLIAANE

SEQ ID NO: 83604 - protein, 9 aa, Dengue virus
IGLIAANEM

SEQ ID NO: 83605 - protein, 9 aa, Dengue virus
GLIAANEMG

SEQ ID NO: 83606 - protein, 9 aa, Dengue virus
LIAANEMGL

SEQ ID NO: 83607 - protein, 9 aa, Dengue virus
IAANEMGLI

SEQ ID NO: 83608 - protein, 9 aa, Dengue virus
AANEMGLIE

SEQ ID NO: 83609 - protein, 9 aa, Dengue virus
ANEMGLIEK

SEQ ID NO: 83610 - protein, 9 aa, Dengue virus
NEMGLIEKT

SEQ ID NO: 83611 - protein, 9 aa, Dengue virus
EMGLIEKTK

SEQ ID NO: 83612 - protein, 9 aa, Dengue virus
MGLIEKTKT

SEQ ID NO: 83613 - protein, 9 aa, Dengue virus
GLIEKTKTD

SEQ ID NO: 83614 - protein, 9 aa, Dengue virus
LIEKTKTDF

SEQ ID NO: 83615 - protein, 9 aa, Dengue virus
IEKTKTDFG

SEQ ID NO: 83616 - protein, 9 aa, Dengue virus
EKTKTDFGF

SEQ ID NO: 83617 - protein, 9 aa, Dengue virus
KTKTDFGFY

SEQ ID NO: 83618 - protein, 9 aa, Dengue virus
TKTDFGFYQ

SEQ ID NO: 83619 - protein, 9 aa, Dengue virus
KTDFGFYQV

SEQ ID NO: 83620 - protein, 9 aa, Dengue virus
TDFGFYQVK

SEQ ID NO: 83621 - protein, 9 aa, Dengue virus
DFGFYQVKT

SEQ ID NO: 83622 - protein, 9 aa, Dengue virus
FGFYQVKTE

SEQ ID NO: 83623 - protein, 9 aa, Dengue virus
GFYQVKTET

SEQ ID NO: 83624 - protein, 9 aa, Dengue virus
FYQVKTETT

SEQ ID NO: 83625 - protein, 9 aa, Dengue virus
YQVKTETTI

SEQ ID NO: 83626 - protein, 9 aa, Dengue virus
QVKTETTIL

SEQ ID NO: 83627 - protein, 9 aa, Dengue virus
VKTETTILD

SEQ ID NO: 83628 - protein, 9 aa, Dengue virus
KTETTILDV

SEQ ID NO: 83629 - protein, 9 aa, Dengue virus
TETTILDVD

SEQ ID NO: 83630 - protein, 9 aa, Dengue virus
ETTILDVDL

SEQ ID NO: 83631 - protein, 9 aa, Dengue virus
TTILDVDLR

SEQ ID NO: 83632 - protein, 9 aa, Dengue virus
TILDVDLRP

SEQ ID NO: 83633 - protein, 9 aa, Dengue virus
ILDVDLRPA

SEQ ID NO: 83634 - protein, 9 aa, Dengue virus
LDVDLRPAS

SEQ ID NO: 83635 - protein, 9 aa, Dengue virus
DVDLRPASA

SEQ ID NO: 83636 - protein, 9 aa, Dengue virus
VDLRPASAW

SEQ ID NO: 83637 - protein, 9 aa, Dengue virus
DLRPASAWT

SEQ ID NO: 83638 - protein, 9 aa, Dengue virus
LRPASAWTL

SEQ ID NO: 83639 - protein, 9 aa, Dengue virus
RPASAWTLY

SEQ ID NO: 83640 - protein, 9 aa, Dengue virus
PASAWTLYA

SEQ ID NO: 83641 - protein, 9 aa, Dengue virus
ASAWTLYAV

SEQ ID NO: 83642 - protein, 9 aa, Dengue virus
SAWTLYAVA

SEQ ID NO: 83643 - protein, 9 aa, Dengue virus
AWTLYAVAT

SEQ ID NO: 83644 - protein, 9 aa, Dengue virus
WTLYAVATT

SEQ ID NO: 83645 - protein, 9 aa, Dengue virus
TLYAVATTI

SEQ ID NO: 83646 - protein, 9 aa, Dengue virus
LYAVATTIL

SEQ ID NO: 83647 - protein, 9 aa, Dengue virus
YAVATTILT

SEQ ID NO: 83648 - protein, 9 aa, Dengue virus
AVATTILTP

SEQ ID NO: 83649 - protein, 9 aa, Dengue virus
VATTILTPM

SEQ ID NO: 83650 - protein, 9 aa, Dengue virus
ATTILTPML

SEQ ID NO: 83651 - protein, 9 aa, Dengue virus
TTILTPMLR

SEQ ID NO: 83652 - protein, 9 aa, Dengue virus
TILTPMLRH

SEQ ID NO: 83653 - protein, 9 aa, Dengue virus
ILTPMLRHT

SEQ ID NO: 83654 - protein, 9 aa, Dengue virus
LTPMLRHTI

SEQ ID NO: 83655 - protein, 9 aa, Dengue virus
TPMLRHTIE

SEQ ID NO: 83656 - protein, 9 aa, Dengue virus
PMLRHTIEN

SEQ ID NO: 83657 - protein, 9 aa, Dengue virus
MLRHTIENT

SEQ ID NO: 83658 - protein, 9 aa, Dengue virus
LRHTIENTS

SEQ ID NO: 83659 - protein, 9 aa, Dengue virus
RHTIENTSA

SEQ ID NO: 83660 - protein, 9 aa, Dengue virus
HTIENTSAN

SEQ ID NO: 83661 - protein, 9 aa, Dengue virus
TIENTSANL

SEQ ID NO: 83662 - protein, 9 aa, Dengue virus
IENTSANLS

SEQ ID NO: 83663 - protein, 9 aa, Dengue virus
ENTSANLSL

SEQ ID NO: 83664 - protein, 9 aa, Dengue virus
NTSANLSLA

SEQ ID NO: 83665 - protein, 9 aa, Dengue virus
TSANLSLAA

SEQ ID NO: 83666 - protein, 9 aa, Dengue virus
SANLSLAAI

SEQ ID NO: 83667 - protein, 9 aa, Dengue virus
ANLSLAAIA

SEQ ID NO: 83668 - protein, 9 aa, Dengue virus
NLSLAAIAN

SEQ ID NO: 83669 - protein, 9 aa, Dengue virus
LSLAAIANQ

SEQ ID NO: 83670 - protein, 9 aa, Dengue virus
SLAAIANQA

SEQ ID NO: 83671 - protein, 9 aa, Dengue virus
LAAIANQAA

SEQ ID NO: 83672 - protein, 9 aa, Dengue virus
AAIANQAAV

SEQ ID NO: 83673 - protein, 9 aa, Dengue virus
AIANQAAVL

SEQ ID NO: 83674 - protein, 9 aa, Dengue virus
IANQAAVLM

SEQ ID NO: 83675 - protein, 9 aa, Dengue virus
ANQAAVLMG

SEQ ID NO: 83676 - protein, 9 aa, Dengue virus
NQAAVLMGL

SEQ ID NO: 83677 - protein, 9 aa, Dengue virus
QAAVLMGLG

SEQ ID NO: 83678 - protein, 9 aa, Dengue virus
AAVLMGLGK

SEQ ID NO: 83679 - protein, 9 aa, Dengue virus
AVLMGLGKG

SEQ ID NO: 83680 - protein, 9 aa, Dengue virus
VLMGLGKGW

SEQ ID NO: 83681 - protein, 9 aa, Dengue virus
LMGLGKGWP

SEQ ID NO: 83682 - protein, 9 aa, Dengue virus
MGLGKGWPL

SEQ ID NO: 83683 - protein, 9 aa, Dengue virus
GLGKGWPLH

SEQ ID NO: 83684 - protein, 9 aa, Dengue virus
LGKGWPLHR

SEQ ID NO: 83685 - protein, 9 aa, Dengue virus
GKGWPLHRM

SEQ ID NO: 83686 - protein, 9 aa, Dengue virus
KGWPLHRMD

SEQ ID NO: 83687 - protein, 9 aa, Dengue virus
GWPLHRMDL

SEQ ID NO: 83688 - protein, 9 aa, Dengue virus
WPLHRMDLG

SEQ ID NO: 83689 - protein, 9 aa, Dengue virus
PLHRMDLGV

SEQ ID NO: 83690 - protein, 9 aa, Dengue virus
LHRMDLGVP

SEQ ID NO: 83691 - protein, 9 aa, Dengue virus
HRMDLGVPL

SEQ ID NO: 83692 - protein, 9 aa, Dengue virus
RMDLGVPLL

SEQ ID NO: 83693 - protein, 9 aa, Dengue virus
MDLGVPLLA

SEQ ID NO: 83694 - protein, 9 aa, Dengue virus
DLGVPLLAM

SEQ ID NO: 83695 - protein, 9 aa, Dengue virus
LGVPLLAMG

SEQ ID NO: 83696 - protein, 9 aa, Dengue virus
GVPLLAMGC

SEQ ID NO: 83697 - protein, 9 aa, Dengue virus
VPLLAMGCY

SEQ ID NO: 83698 - protein, 9 aa, Dengue virus
PLLAMGCYS

SEQ ID NO: 83699 - protein, 9 aa, Dengue virus
LLAMGCYSQ

SEQ ID NO: 83700 - protein, 9 aa, Dengue virus
LAMGCYSQV

SEQ ID NO: 83701 - protein, 9 aa, Dengue virus
AMGCYSQVN

SEQ ID NO: 83702 - protein, 9 aa, Dengue virus
MGCYSQVNP

SEQ ID NO: 83703 - protein, 9 aa, Dengue virus
GCYSQVNPT

SEQ ID NO: 83704 - protein, 9 aa, Dengue virus
CYSQVNPTT

SEQ ID NO: 83705 - protein, 9 aa, Dengue virus
YSQVNPTTL

SEQ ID NO: 83706 - protein, 9 aa, Dengue virus
SQVNPTTLT

SEQ ID NO: 83707 - protein, 9 aa, Dengue virus
QVNPTTLTA

SEQ ID NO: 83708 - protein, 9 aa, Dengue virus
VNPTTLTAS

SEQ ID NO: 83709 - protein, 9 aa, Dengue virus
NPTTLTASL

SEQ ID NO: 83710 - protein, 9 aa, Dengue virus
PTTLTASLV

SEQ ID NO: 83711 - protein, 9 aa, Dengue virus
TTLTASLVM

SEQ ID NO: 83712 - protein, 9 aa, Dengue virus
TLTASLVML

SEQ ID NO: 83713 - protein, 9 aa, Dengue virus
LTASLVMLL

SEQ ID NO: 83714 - protein, 9 aa, Dengue virus
TASLVMLLV

SEQ ID NO: 83715 - protein, 9 aa, Dengue virus
ASLVMLLVH

SEQ ID NO: 83716 - protein, 9 aa, Dengue virus
SLVMLLVHY

SEQ ID NO: 83717 - protein, 9 aa, Dengue virus
LVMLLVHYA

SEQ ID NO: 83718 - protein, 9 aa, Dengue virus
VMLLVHYAI

SEQ ID NO: 83719 - protein, 9 aa, Dengue virus
MLLVHYAII

SEQ ID NO: 83720 - protein, 9 aa, Dengue virus
LLVHYAIIG

SEQ ID NO: 83721 - protein, 9 aa, Dengue virus
LVHYAIIGP

SEQ ID NO: 83722 - protein, 9 aa, Dengue virus
VHYAIIGPG

SEQ ID NO: 83723 - protein, 9 aa, Dengue virus
HYAIIGPGL

SEQ ID NO: 83724 - protein, 9 aa, Dengue virus
YAIIGPGLQ

SEQ ID NO: 83725 - protein, 9 aa, Dengue virus
AIIGPGLQA

SEQ ID NO: 83726 - protein, 9 aa, Dengue virus
IIGPGLQAK

SEQ ID NO: 83727 - protein, 9 aa, Dengue virus
IGPGLQAKA

SEQ ID NO: 83728 - protein, 9 aa, Dengue virus
GPGLQAKAT

SEQ ID NO: 83729 - protein, 9 aa, Dengue virus
PGLQAKATR

SEQ ID NO: 83730 - protein, 9 aa, Dengue virus
GLQAKATRE

SEQ ID NO: 83731 - protein, 9 aa, Dengue virus
LQAKATREA

SEQ ID NO: 83732 - protein, 9 aa, Dengue virus
QAKATREAQ

SEQ ID NO: 83733 - protein, 9 aa, Dengue virus
AKATREAQK

SEQ ID NO: 83734 - protein, 9 aa, Dengue virus
KATREAQKR

SEQ ID NO: 83735 - protein, 9 aa, Dengue virus
ATREAQKRT

SEQ ID NO: 83736 - protein, 9 aa, Dengue virus
TREAQKRTA

SEQ ID NO: 83737 - protein, 9 aa, Dengue virus
REAQKRTAA

SEQ ID NO: 83738 - protein, 9 aa, Dengue virus
EAQKRTAAG

SEQ ID NO: 83739 - protein, 9 aa, Dengue virus
AQKRTAAGI

SEQ ID NO: 83740 - protein, 9 aa, Dengue virus
QKRTAAGIM

SEQ ID NO: 83741 - protein, 9 aa, Dengue virus
KRTAAGIMK

SEQ ID NO: 83742 - protein, 9 aa, Dengue virus
RTAAGIMKN

SEQ ID NO: 83743 - protein, 9 aa, Dengue virus
TAAGIMKNP

SEQ ID NO: 83744 - protein, 9 aa, Dengue virus
AAGIMKNPT

SEQ ID NO: 83745 - protein, 9 aa, Dengue virus
AGIMKNPTV

SEQ ID NO: 83746 - protein, 9 aa, Dengue virus
GIMKNPTVD

SEQ ID NO: 83747 - protein, 9 aa, Dengue virus
IMKNPTVDG

SEQ ID NO: 83748 - protein, 9 aa, Dengue virus
MKNPTVDGI

SEQ ID NO: 83749 - protein, 9 aa, Dengue virus
KNPTVDGIT

SEQ ID NO: 83750 - protein, 9 aa, Dengue virus
NPTVDGITV

SEQ ID NO: 83751 - protein, 9 aa, Dengue virus
PTVDGITVI

SEQ ID NO: 83752 - protein, 9 aa, Dengue virus
TVDGITVID

SEQ ID NO: 83753 - protein, 9 aa, Dengue virus
VDGITVIDL

SEQ ID NO: 83754 - protein, 9 aa, Dengue virus
DGITVIDLE

SEQ ID NO: 83755 - protein, 9 aa, Dengue virus
GITVIDLEP

SEQ ID NO: 83756 - protein, 9 aa, Dengue virus
ITVIDLEPI

SEQ ID NO: 83757 - protein, 9 aa, Dengue virus
TVIDLEPIS

SEQ ID NO: 83758 - protein, 9 aa, Dengue virus
VIDLEPISY

SEQ ID NO: 83759 - protein, 9 aa, Dengue virus
IDLEPISYD

SEQ ID NO: 83760 - protein, 9 aa, Dengue virus
DLEPISYDP

SEQ ID NO: 83761 - protein, 9 aa, Dengue virus
LEPISYDPK

SEQ ID NO: 83762 - protein, 9 aa, Dengue virus
EPISYDPKF

SEQ ID NO: 83763 - protein, 9 aa, Dengue virus
PISYDPKFE

SEQ ID NO: 83764 - protein, 9 aa, Dengue virus
ISYDPKFEK

SEQ ID NO: 83765 - protein, 9 aa, Dengue virus
SYDPKFEKQ

SEQ ID NO: 83766 - protein, 9 aa, Dengue virus
YDPKFEKQL

SEQ ID NO: 83767 - protein, 9 aa, Dengue virus
DPKFEKQLG

SEQ ID NO: 83768 - protein, 9 aa, Dengue virus
PKFEKQLGQ

SEQ ID NO: 83769 - protein, 9 aa, Dengue virus
KFEKQLGQV

SEQ ID NO: 83770 - protein, 9 aa, Dengue virus
FEKQLGQVM

SEQ ID NO: 83771 - protein, 9 aa, Dengue virus
EKQLGQVML

SEQ ID NO: 83772 - protein, 9 aa, Dengue virus
KQLGQVMLL

SEQ ID NO: 83773 - protein, 9 aa, Dengue virus
QLGQVMLLV

SEQ ID NO: 83774 - protein, 9 aa, Dengue virus
LGQVMLLVL

SEQ ID NO: 83775 - protein, 9 aa, Dengue virus
GQVMLLVLC

SEQ ID NO: 83776 - protein, 9 aa, Dengue virus
QVMLLVLCA

SEQ ID NO: 83777 - protein, 9 aa, Dengue virus
VMLLVLCAG

SEQ ID NO: 83778 - protein, 9 aa, Dengue virus
MLLVLCAGQ

SEQ ID NO: 83779 - protein, 9 aa, Dengue virus
LLVLCAGQL

SEQ ID NO: 83780 - protein, 9 aa, Dengue virus
LVLCAGQLL

SEQ ID NO: 83781 - protein, 9 aa, Dengue virus
VLCAGQLLL

SEQ ID NO: 83782 - protein, 9 aa, Dengue virus
LCAGQLLLM

SEQ ID NO: 83783 - protein, 9 aa, Dengue virus
CAGQLLLMR

SEQ ID NO: 83784 - protein, 9 aa, Dengue virus
AGQLLLMRT

SEQ ID NO: 83785 - protein, 9 aa, Dengue virus
GQLLLMRTT

SEQ ID NO: 83786 - protein, 9 aa, Dengue virus
QLLLMRTTW

SEQ ID NO: 83787 - protein, 9 aa, Dengue virus
LLLMRTTWA

SEQ ID NO: 83788 - protein, 9 aa, Dengue virus
LLMRTTWAF

SEQ ID NO: 83789 - protein, 9 aa, Dengue virus
LMRTTWAFC

SEQ ID NO: 83790 - protein, 9 aa, Dengue virus
MRTTWAFCE

SEQ ID NO: 83791 - protein, 9 aa, Dengue virus
RTTWAFCEV

SEQ ID NO: 83792 - protein, 9 aa, Dengue virus
TTWAFCEVL

SEQ ID NO: 83793 - protein, 9 aa, Dengue virus
TWAFCEVLT

SEQ ID NO: 83794 - protein, 9 aa, Dengue virus
WAFCEVLTL

SEQ ID NO: 83795 - protein, 9 aa, Dengue virus
AFCEVLTLA

SEQ ID NO: 83796 - protein, 9 aa, Dengue virus
FCEVLTLAT

SEQ ID NO: 83797 - protein, 9 aa, Dengue virus
CEVLTLATG

SEQ ID NO: 83798 - protein, 9 aa, Dengue virus
EVLTLATGP

SEQ ID NO: 83799 - protein, 9 aa, Dengue virus
VLTLATGPI

SEQ ID NO: 83800 - protein, 9 aa, Dengue virus
LTLATGPIL

SEQ ID NO: 83801 - protein, 9 aa, Dengue virus
TLATGPILT

SEQ ID NO: 83802 - protein, 9 aa, Dengue virus
LATGPILTL

SEQ ID NO: 83803 - protein, 9 aa, Dengue virus
ATGPILTLW

SEQ ID NO: 83804 - protein, 9 aa, Dengue virus
TGPILTLWE

SEQ ID NO: 83805 - protein, 9 aa, Dengue virus
GPILTLWEG

SEQ ID NO: 83806 - protein, 9 aa, Dengue virus
PILTLWEGN

SEQ ID NO: 83807 - protein, 9 aa, Dengue virus
ILTLWEGNP

SEQ ID NO: 83808 - protein, 9 aa, Dengue virus
LTLWEGNPG

SEQ ID NO: 83809 - protein, 9 aa, Dengue virus
TLWEGNPGR

SEQ ID NO: 83810 - protein, 9 aa, Dengue virus
LWEGNPGRF

SEQ ID NO: 83811 - protein, 9 aa, Dengue virus
WEGNPGRFW

SEQ ID NO: 83812 - protein, 9 aa, Dengue virus
EGNPGRFWN

SEQ ID NO: 83813 - protein, 9 aa, Dengue virus
GNPGRFWNT

SEQ ID NO: 83814 - protein, 9 aa, Dengue virus
NPGRFWNTT

SEQ ID NO: 83815 - protein, 9 aa, Dengue virus
PGRFWNTTI

SEQ ID NO: 83816 - protein, 9 aa, Dengue virus
GRFWNTTIA

SEQ ID NO: 83817 - protein, 9 aa, Dengue virus
RFWNTTIAV

SEQ ID NO: 83818 - protein, 9 aa, Dengue virus
FWNTTIAVS

SEQ ID NO: 83819 - protein, 9 aa, Dengue virus
WNTTIAVST

SEQ ID NO: 83820 - protein, 9 aa, Dengue virus
NTTIAVSTA

SEQ ID NO: 83821 - protein, 9 aa, Dengue virus
TTIAVSTAN

SEQ ID NO: 83822 - protein, 9 aa, Dengue virus
TIAVSTANI

SEQ ID NO: 83823 - protein, 9 aa, Dengue virus
IAVSTANIF

SEQ ID NO: 83824 - protein, 9 aa, Dengue virus
AVSTANIFR

SEQ ID NO: 83825 - protein, 9 aa, Dengue virus
VSTANIFRG

SEQ ID NO: 83826 - protein, 9 aa, Dengue virus
STANIFRGS

SEQ ID NO: 83827 - protein, 9 aa, Dengue virus
TANIFRGSY

SEQ ID NO: 83828 - protein, 9 aa, Dengue virus
ANIFRGSYL

SEQ ID NO: 83829 - protein, 9 aa, Dengue virus
NIFRGSYLA

SEQ ID NO: 83830 - protein, 9 aa, Dengue virus
IFRGSYLAG

SEQ ID NO: 83831 - protein, 9 aa, Dengue virus
FRGSYLAGA

SEQ ID NO: 83832 - protein, 9 aa, Dengue virus
RGSYLAGAG

SEQ ID NO: 83833 - protein, 9 aa, Dengue virus
GSYLAGAGL

SEQ ID NO: 83834 - protein, 9 aa, Dengue virus
SYLAGAGLA

SEQ ID NO: 83835 - protein, 9 aa, Dengue virus
YLAGAGLAF

SEQ ID NO: 83836 - protein, 9 aa, Dengue virus
LAGAGLAFS

SEQ ID NO: 83837 - protein, 9 aa, Dengue virus
AGAGLAFSL

SEQ ID NO: 83838 - protein, 9 aa, Dengue virus
GAGLAFSLI

SEQ ID NO: 83839 - protein, 9 aa, Dengue virus
AGLAFSLIK

SEQ ID NO: 83840 - protein, 9 aa, Dengue virus
GLAFSLIKN

SEQ ID NO: 83841 - protein, 9 aa, Dengue virus
LAFSLIKNA

SEQ ID NO: 83842 - protein, 9 aa, Dengue virus
AFSLIKNAQ

SEQ ID NO: 83843 - protein, 9 aa, Dengue virus
FSLIKNAQT

SEQ ID NO: 83844 - protein, 9 aa, Dengue virus
SLIKNAQTP

SEQ ID NO: 83845 - protein, 9 aa, Dengue virus
LIKNAQTPR

SEQ ID NO: 83846 - protein, 9 aa, Dengue virus
IKNAQTPRR

SEQ ID NO: 83847 - protein, 9 aa, Dengue virus
KNAQTPRRG

SEQ ID NO: 83848 - protein, 9 aa, Dengue virus
NAQTPRRGT

SEQ ID NO: 83849 - protein, 9 aa, Dengue virus
AQTPRRGTG

SEQ ID NO: 83850 - protein, 9 aa, Dengue virus
QTPRRGTGT

SEQ ID NO: 83851 - protein, 9 aa, Dengue virus
TPRRGTGTT

SEQ ID NO: 83852 - protein, 9 aa, Dengue virus
PRRGTGTTG

SEQ ID NO: 83853 - protein, 9 aa, Dengue virus
RRGTGTTGE

SEQ ID NO: 83854 - protein, 9 aa, Dengue virus
RGTGTTGET

SEQ ID NO: 83855 - protein, 9 aa, Dengue virus
GTGTTGETL

SEQ ID NO: 83856 - protein, 9 aa, Dengue virus
TGTTGETLG

SEQ ID NO: 83857 - protein, 9 aa, Dengue virus
GTTGETLGE

SEQ ID NO: 83858 - protein, 9 aa, Dengue virus
TTGETLGEK

SEQ ID NO: 83859 - protein, 9 aa, Dengue virus
TGETLGEKW

SEQ ID NO: 83860 - protein, 9 aa, Dengue virus
GETLGEKWK

SEQ ID NO: 83861 - protein, 9 aa, Dengue virus
ETLGEKWKR

SEQ ID NO: 83862 - protein, 9 aa, Dengue virus
TLGEKWKRQ

SEQ ID NO: 83863 - protein, 9 aa, Dengue virus
LGEKWKRQL

SEQ ID NO: 83864 - protein, 9 aa, Dengue virus
GEKWKRQLN

SEQ ID NO: 83865 - protein, 9 aa, Dengue virus
EKWKRQLNS

SEQ ID NO: 83866 - protein, 9 aa, Dengue virus
KWKRQLNSL

SEQ ID NO: 83867 - protein, 9 aa, Dengue virus
WKRQLNSLD

SEQ ID NO: 83868 - protein, 9 aa, Dengue virus
KRQLNSLDR

SEQ ID NO: 83869 - protein, 9 aa, Dengue virus
RQLNSLDRK

SEQ ID NO: 83870 - protein, 9 aa, Dengue virus
QLNSLDRKE

SEQ ID NO: 83871 - protein, 9 aa, Dengue virus
LNSLDRKEF

SEQ ID NO: 83872 - protein, 9 aa, Dengue virus
NSLDRKEFE

SEQ ID NO: 83873 - protein, 9 aa, Dengue virus
SLDRKEFEE

SEQ ID NO: 83874 - protein, 9 aa, Dengue virus
LDRKEFEEY

SEQ ID NO: 83875 - protein, 9 aa, Dengue virus
DRKEFEEYK

SEQ ID NO: 83876 - protein, 9 aa, Dengue virus
RKEFEEYKR

SEQ ID NO: 83877 - protein, 9 aa, Dengue virus
KEFEEYKRS

SEQ ID NO: 83878 - protein, 9 aa, Dengue virus
EFEEYKRSG

SEQ ID NO: 83879 - protein, 9 aa, Dengue virus
FEEYKRSGI

SEQ ID NO: 83880 - protein, 9 aa, Dengue virus
EEYKRSGIL

SEQ ID NO: 83881 - protein, 9 aa, Dengue virus
EYKRSGILE

SEQ ID NO: 83882 - protein, 9 aa, Dengue virus
YKRSGILEV

SEQ ID NO: 83883 - protein, 9 aa, Dengue virus
KRSGILEVD

SEQ ID NO: 83884 - protein, 9 aa, Dengue virus
RSGILEVDR

SEQ ID NO: 83885 - protein, 9 aa, Dengue virus
SGILEVDRT

SEQ ID NO: 83886 - protein, 9 aa, Dengue virus
GILEVDRTE

SEQ ID NO: 83887 - protein, 9 aa, Dengue virus
ILEVDRTEA

SEQ ID NO: 83888 - protein, 9 aa, Dengue virus
LEVDRTEAK

SEQ ID NO: 83889 - protein, 9 aa, Dengue virus
EVDRTEAKS

SEQ ID NO: 83890 - protein, 9 aa, Dengue virus
VDRTEAKSA

SEQ ID NO: 83891 - protein, 9 aa, Dengue virus
DRTEAKSAL

SEQ ID NO: 83892 - protein, 9 aa, Dengue virus
RTEAKSALK

SEQ ID NO: 83893 - protein, 9 aa, Dengue virus
TEAKSALKD

SEQ ID NO: 83894 - protein, 9 aa, Dengue virus
EAKSALKDG

SEQ ID NO: 83895 - protein, 9 aa, Dengue virus
AKSALKDGS

SEQ ID NO: 83896 - protein, 9 aa, Dengue virus
KSALKDGSK

SEQ ID NO: 83897 - protein, 9 aa, Dengue virus
SALKDGSKI

SEQ ID NO: 83898 - protein, 9 aa, Dengue virus
ALKDGSKIK

SEQ ID NO: 83899 - protein, 9 aa, Dengue virus
LKDGSKIKH

SEQ ID NO: 83900 - protein, 9 aa, Dengue virus
KDGSKIKHA

SEQ ID NO: 83901 - protein, 9 aa, Dengue virus
DGSKIKHAV

SEQ ID NO: 83902 - protein, 9 aa, Dengue virus
GSKIKHAVS

SEQ ID NO: 83903 - protein, 9 aa, Dengue virus
SKIKHAVSR

SEQ ID NO: 83904 - protein, 9 aa, Dengue virus
KIKHAVSRG

SEQ ID NO: 83905 - protein, 9 aa, Dengue virus
IKHAVSRGS

SEQ ID NO: 83906 - protein, 9 aa, Dengue virus
KHAVSRGSS

SEQ ID NO: 83907 - protein, 9 aa, Dengue virus
HAVSRGSSK

SEQ ID NO: 83908 - protein, 9 aa, Dengue virus
AVSRGSSKI

SEQ ID NO: 83909 - protein, 9 aa, Dengue virus
VSRGSSKIR

SEQ ID NO: 83910 - protein, 9 aa, Dengue virus
SRGSSKIRW

SEQ ID NO: 83911 - protein, 9 aa, Dengue virus
RGSSKIRWI

SEQ ID NO: 83912 - protein, 9 aa, Dengue virus
GSSKIRWIV

SEQ ID NO: 83913 - protein, 9 aa, Dengue virus
SSKIRWIVE

SEQ ID NO: 83914 - protein, 9 aa, Dengue virus
SKIRWIVER

SEQ ID NO: 83915 - protein, 9 aa, Dengue virus
KIRWIVERG

SEQ ID NO: 83916 - protein, 9 aa, Dengue virus
IRWIVERGM

SEQ ID NO: 83917 - protein, 9 aa, Dengue virus
RWIVERGMV

SEQ ID NO: 83918 - protein, 9 aa, Dengue virus
WIVERGMVK

SEQ ID NO: 83919 - protein, 9 aa, Dengue virus
IVERGMVKP

SEQ ID NO: 83920 - protein, 9 aa, Dengue virus
VERGMVKPK

SEQ ID NO: 83921 - protein, 9 aa, Dengue virus
ERGMVKPKG

SEQ ID NO: 83922 - protein, 9 aa, Dengue virus
RGMVKPKGK

SEQ ID NO: 83923 - protein, 9 aa, Dengue virus
GMVKPKGKV

SEQ ID NO: 83924 - protein, 9 aa, Dengue virus
MVKPKGKVV

SEQ ID NO: 83925 - protein, 9 aa, Dengue virus
VKPKGKVVD

SEQ ID NO: 83926 - protein, 9 aa, Dengue virus
KPKGKVVDL

SEQ ID NO: 83927 - protein, 9 aa, Dengue virus
PKGKVVDLG

SEQ ID NO: 83928 - protein, 9 aa, Dengue virus
KGKVVDLGC

SEQ ID NO: 83929 - protein, 9 aa, Dengue virus
GKVVDLGCG

SEQ ID NO: 83930 - protein, 9 aa, Dengue virus
KVVDLGCGR

SEQ ID NO: 83931 - protein, 9 aa, Dengue virus
VVDLGCGRG

SEQ ID NO: 83932 - protein, 9 aa, Dengue virus
VDLGCGRGG

SEQ ID NO: 83933 - protein, 9 aa, Dengue virus
DLGCGRGGW

SEQ ID NO: 83934 - protein, 9 aa, Dengue virus
LGCGRGGWS

SEQ ID NO: 83935 - protein, 9 aa, Dengue virus
GCGRGGWSY

SEQ ID NO: 83936 - protein, 9 aa, Dengue virus
CGRGGWSYY

SEQ ID NO: 83937 - protein, 9 aa, Dengue virus
GRGGWSYYM

SEQ ID NO: 83938 - protein, 9 aa, Dengue virus
RGGWSYYMA

SEQ ID NO: 83939 - protein, 9 aa, Dengue virus
GGWSYYMAT

SEQ ID NO: 83940 - protein, 9 aa, Dengue virus
GWSYYMATL

SEQ ID NO: 83941 - protein, 9 aa, Dengue virus
WSYYMATLK

SEQ ID NO: 83942 - protein, 9 aa, Dengue virus
SYYMATLKN

SEQ ID NO: 83943 - protein, 9 aa, Dengue virus
YYMATLKNV

SEQ ID NO: 83944 - protein, 9 aa, Dengue virus
YMATLKNVT

SEQ ID NO: 83945 - protein, 9 aa, Dengue virus
MATLKNVTE

SEQ ID NO: 83946 - protein, 9 aa, Dengue virus
ATLKNVTEV

SEQ ID NO: 83947 - protein, 9 aa, Dengue virus
TLKNVTEVK

SEQ ID NO: 83948 - protein, 9 aa, Dengue virus
LKNVTEVKG

SEQ ID NO: 83949 - protein, 9 aa, Dengue virus
KNVTEVKGY

SEQ ID NO: 83950 - protein, 9 aa, Dengue virus
NVTEVKGYT

SEQ ID NO: 83951 - protein, 9 aa, Dengue virus
VTEVKGYTK

SEQ ID NO: 83952 - protein, 9 aa, Dengue virus
TEVKGYTKG

SEQ ID NO: 83953 - protein, 9 aa, Dengue virus
EVKGYTKGG

SEQ ID NO: 83954 - protein, 9 aa, Dengue virus
VKGYTKGGP

SEQ ID NO: 83955 - protein, 9 aa, Dengue virus
KGYTKGGPG

SEQ ID NO: 83956 - protein, 9 aa, Dengue virus
GYTKGGPGH

SEQ ID NO: 83957 - protein, 9 aa, Dengue virus
YTKGGPGHE

SEQ ID NO: 83958 - protein, 9 aa, Dengue virus
TKGGPGHEE

SEQ ID NO: 83959 - protein, 9 aa, Dengue virus
KGGPGHEEP

SEQ ID NO: 83960 - protein, 9 aa, Dengue virus
GGPGHEEPI

SEQ ID NO: 83961 - protein, 9 aa, Dengue virus
GPGHEEPIP

SEQ ID NO: 83962 - protein, 9 aa, Dengue virus
PGHEEPIPM

SEQ ID NO: 83963 - protein, 9 aa, Dengue virus
GHEEPIPMA

SEQ ID NO: 83964 - protein, 9 aa, Dengue virus
HEEPIPMAT

SEQ ID NO: 83965 - protein, 9 aa, Dengue virus
EEPIPMATY

SEQ ID NO: 83966 - protein, 9 aa, Dengue virus
EPIPMATYG

SEQ ID NO: 83967 - protein, 9 aa, Dengue virus
PIPMATYGW

SEQ ID NO: 83968 - protein, 9 aa, Dengue virus
IPMATYGWN

SEQ ID NO: 83969 - protein, 9 aa, Dengue virus
PMATYGWNL

SEQ ID NO: 83970 - protein, 9 aa, Dengue virus
MATYGWNLV

SEQ ID NO: 83971 - protein, 9 aa, Dengue virus
ATYGWNLVK

SEQ ID NO: 83972 - protein, 9 aa, Dengue virus
TYGWNLVKL

SEQ ID NO: 83973 - protein, 9 aa, Dengue virus
YGWNLVKLH

SEQ ID NO: 83974 - protein, 9 aa, Dengue virus
GWNLVKLHS

SEQ ID NO: 83975 - protein, 9 aa, Dengue virus
WNLVKLHSG

SEQ ID NO: 83976 - protein, 9 aa, Dengue virus
NLVKLHSGV

SEQ ID NO: 83977 - protein, 9 aa, Dengue virus
LVKLHSGVD

SEQ ID NO: 83978 - protein, 9 aa, Dengue virus
VKLHSGVDV

SEQ ID NO: 83979 - protein, 9 aa, Dengue virus
KLHSGVDVF

SEQ ID NO: 83980 - protein, 9 aa, Dengue virus
LHSGVDVFY

SEQ ID NO: 83981 - protein, 9 aa, Dengue virus
HSGVDVFYK

SEQ ID NO: 83982 - protein, 9 aa, Dengue virus
SGVDVFYKP

SEQ ID NO: 83983 - protein, 9 aa, Dengue virus
GVDVFYKPT

SEQ ID NO: 83984 - protein, 9 aa, Dengue virus
VDVFYKPTE

SEQ ID NO: 83985 - protein, 9 aa, Dengue virus
DVFYKPTEQ

SEQ ID NO: 83986 - protein, 9 aa, Dengue virus
VFYKPTEQV

SEQ ID NO: 83987 - protein, 9 aa, Dengue virus
FYKPTEQVD

SEQ ID NO: 83988 - protein, 9 aa, Dengue virus
YKPTEQVDT

SEQ ID NO: 83989 - protein, 9 aa, Dengue virus
KPTEQVDTL

SEQ ID NO: 83990 - protein, 9 aa, Dengue virus
PTEQVDTLL

SEQ ID NO: 83991 - protein, 9 aa, Dengue virus
TEQVDTLLC

SEQ ID NO: 83992 - protein, 9 aa, Dengue virus
EQVDTLLCD

SEQ ID NO: 83993 - protein, 9 aa, Dengue virus
QVDTLLCDI

SEQ ID NO: 83994 - protein, 9 aa, Dengue virus
VDTLLCDIG

SEQ ID NO: 83995 - protein, 9 aa, Dengue virus
DTLLCDIGE

SEQ ID NO: 83996 - protein, 9 aa, Dengue virus
TLLCDIGES

SEQ ID NO: 83997 - protein, 9 aa, Dengue virus
LLCDIGESS

SEQ ID NO: 83998 - protein, 9 aa, Dengue virus
LCDIGESSS

SEQ ID NO: 83999 - protein, 9 aa, Dengue virus
CDIGESSSN

SEQ ID NO: 84000 - protein, 9 aa, Dengue virus
DIGESSSNP

SEQ ID NO: 84001 - protein, 9 aa, Dengue virus
IGESSSNPT

SEQ ID NO: 84002 - protein, 9 aa, Dengue virus
GESSSNPTI

SEQ ID NO: 84003 - protein, 9 aa, Dengue virus
ESSSNPTIE

SEQ ID NO: 84004 - protein, 9 aa, Dengue virus
SSSNPTIEE

SEQ ID NO: 84005 - protein, 9 aa, Dengue virus
SSNPTIEEG

SEQ ID NO: 84006 - protein, 9 aa, Dengue virus
SNPTIEEGR

SEQ ID NO: 84007 - protein, 9 aa, Dengue virus
NPTIEEGRT

SEQ ID NO: 84008 - protein, 9 aa, Dengue virus
PTIEEGRTL

SEQ ID NO: 84009 - protein, 9 aa, Dengue virus
TIEEGRTLR

SEQ ID NO: 84010 - protein, 9 aa, Dengue virus
IEEGRTLRV

SEQ ID NO: 84011 - protein, 9 aa, Dengue virus
EEGRTLRVL

SEQ ID NO: 84012 - protein, 9 aa, Dengue virus
EGRTLRVLK

SEQ ID NO: 84013 - protein, 9 aa, Dengue virus
GRTLRVLKM

SEQ ID NO: 84014 - protein, 9 aa, Dengue virus
RTLRVLKMV

SEQ ID NO: 84015 - protein, 9 aa, Dengue virus
TLRVLKMVE

SEQ ID NO: 84016 - protein, 9 aa, Dengue virus
LRVLKMVEP

SEQ ID NO: 84017 - protein, 9 aa, Dengue virus
RVLKMVEPW

SEQ ID NO: 84018 - protein, 9 aa, Dengue virus
VLKMVEPWL

SEQ ID NO: 84019 - protein, 9 aa, Dengue virus
LKMVEPWLS

SEQ ID NO: 84020 - protein, 9 aa, Dengue virus
KMVEPWLSS

SEQ ID NO: 84021 - protein, 9 aa, Dengue virus
MVEPWLSSK

SEQ ID NO: 84022 - protein, 9 aa, Dengue virus
VEPWLSSKP

SEQ ID NO: 84023 - protein, 9 aa, Dengue virus
EPWLSSKPE

SEQ ID NO: 84024 - protein, 9 aa, Dengue virus
PWLSSKPEF

SEQ ID NO: 84025 - protein, 9 aa, Dengue virus
WLSSKPEFC

SEQ ID NO: 84026 - protein, 9 aa, Dengue virus
LSSKPEFCI

SEQ ID NO: 84027 - protein, 9 aa, Dengue virus
SSKPEFCIK

SEQ ID NO: 84028 - protein, 9 aa, Dengue virus
SKPEFCIKV

SEQ ID NO: 84029 - protein, 9 aa, Dengue virus
KPEFCIKVL

SEQ ID NO: 84030 - protein, 9 aa, Dengue virus
PEFCIKVLN

SEQ ID NO: 84031 - protein, 9 aa, Dengue virus
EFCIKVLNP

SEQ ID NO: 84032 - protein, 9 aa, Dengue virus
FCIKVLNPY

SEQ ID NO: 84033 - protein, 9 aa, Dengue virus
CIKVLNPYM

SEQ ID NO: 84034 - protein, 9 aa, Dengue virus
IKVLNPYMP

SEQ ID NO: 84035 - protein, 9 aa, Dengue virus
KVLNPYMPT

SEQ ID NO: 84036 - protein, 9 aa, Dengue virus
VLNPYMPTV

SEQ ID NO: 84037 - protein, 9 aa, Dengue virus
LNPYMPTVI

SEQ ID NO: 84038 - protein, 9 aa, Dengue virus
NPYMPTVIE

SEQ ID NO: 84039 - protein, 9 aa, Dengue virus
PYMPTVIEE

SEQ ID NO: 84040 - protein, 9 aa, Dengue virus
YMPTVIEEL

SEQ ID NO: 84041 - protein, 9 aa, Dengue virus
MPTVIEELE

SEQ ID NO: 84042 - protein, 9 aa, Dengue virus
PTVIEELEK

SEQ ID NO: 84043 - protein, 9 aa, Dengue virus
TVIEELEKL

SEQ ID NO: 84044 - protein, 9 aa, Dengue virus
VIEELEKLQ

SEQ ID NO: 84045 - protein, 9 aa, Dengue virus
IEELEKLQR

SEQ ID NO: 84046 - protein, 9 aa, Dengue virus
EELEKLQRK

SEQ ID NO: 84047 - protein, 9 aa, Dengue virus
ELEKLQRKH

SEQ ID NO: 84048 - protein, 9 aa, Dengue virus
LEKLQRKHG

SEQ ID NO: 84049 - protein, 9 aa, Dengue virus
EKLQRKHGG

SEQ ID NO: 84050 - protein, 9 aa, Dengue virus
KLQRKHGGN

SEQ ID NO: 84051 - protein, 9 aa, Dengue virus
LQRKHGGNL

SEQ ID NO: 84052 - protein, 9 aa, Dengue virus
QRKHGGNLV

SEQ ID NO: 84053 - protein, 9 aa, Dengue virus
RKHGGNLVR

SEQ ID NO: 84054 - protein, 9 aa, Dengue virus
KHGGNLVRC

SEQ ID NO: 84055 - protein, 9 aa, Dengue virus
HGGNLVRCP

SEQ ID NO: 84056 - protein, 9 aa, Dengue virus
GGNLVRCPL

SEQ ID NO: 84057 - protein, 9 aa, Dengue virus
GNLVRCPLS

SEQ ID NO: 84058 - protein, 9 aa, Dengue virus
NLVRCPLSR

SEQ ID NO: 84059 - protein, 9 aa, Dengue virus
LVRCPLSRN

SEQ ID NO: 84060 - protein, 9 aa, Dengue virus
VRCPLSRNS

SEQ ID NO: 84061 - protein, 9 aa, Dengue virus
RCPLSRNST

SEQ ID NO: 84062 - protein, 9 aa, Dengue virus
CPLSRNSTH

SEQ ID NO: 84063 - protein, 9 aa, Dengue virus
PLSRNSTHE

SEQ ID NO: 84064 - protein, 9 aa, Dengue virus
LSRNSTHEM

SEQ ID NO: 84065 - protein, 9 aa, Dengue virus
SRNSTHEMY

SEQ ID NO: 84066 - protein, 9 aa, Dengue virus
RNSTHEMYW

SEQ ID NO: 84067 - protein, 9 aa, Dengue virus
NSTHEMYWV

SEQ ID NO: 84068 - protein, 9 aa, Dengue virus
STHEMYWVS

SEQ ID NO: 84069 - protein, 9 aa, Dengue virus
THEMYWVSG

SEQ ID NO: 84070 - protein, 9 aa, Dengue virus
HEMYWVSGA

SEQ ID NO: 84071 - protein, 9 aa, Dengue virus
EMYWVSGAS

SEQ ID NO: 84072 - protein, 9 aa, Dengue virus
MYWVSGASG

SEQ ID NO: 84073 - protein, 9 aa, Dengue virus
YWVSGASGN

SEQ ID NO: 84074 - protein, 9 aa, Dengue virus
WVSGASGNI

SEQ ID NO: 84075 - protein, 9 aa, Dengue virus
VSGASGNIV

SEQ ID NO: 84076 - protein, 9 aa, Dengue virus
SGASGNIVS

SEQ ID NO: 84077 - protein, 9 aa, Dengue virus
GASGNIVSS

SEQ ID NO: 84078 - protein, 9 aa, Dengue virus
ASGNIVSSV

SEQ ID NO: 84079 - protein, 9 aa, Dengue virus
SGNIVSSVN

SEQ ID NO: 84080 - protein, 9 aa, Dengue virus
GNIVSSVNT

SEQ ID NO: 84081 - protein, 9 aa, Dengue virus
NIVSSVNTT

SEQ ID NO: 84082 - protein, 9 aa, Dengue virus
IVSSVNTTS

SEQ ID NO: 84083 - protein, 9 aa, Dengue virus
VSSVNTTSK

SEQ ID NO: 84084 - protein, 9 aa, Dengue virus
SSVNTTSKM

SEQ ID NO: 84085 - protein, 9 aa, Dengue virus
SVNTTSKML

SEQ ID NO: 84086 - protein, 9 aa, Dengue virus
VNTTSKMLL

SEQ ID NO: 84087 - protein, 9 aa, Dengue virus
NTTSKMLLN

SEQ ID NO: 84088 - protein, 9 aa, Dengue virus
TTSKMLLNR

SEQ ID NO: 84089 - protein, 9 aa, Dengue virus
TSKMLLNRF

SEQ ID NO: 84090 - protein, 9 aa, Dengue virus
SKMLLNRFT

SEQ ID NO: 84091 - protein, 9 aa, Dengue virus
KMLLNRFTT

SEQ ID NO: 84092 - protein, 9 aa, Dengue virus
MLLNRFTTR

SEQ ID NO: 84093 - protein, 9 aa, Dengue virus
LLNRFTTRH

SEQ ID NO: 84094 - protein, 9 aa, Dengue virus
LNRFTTRHR

SEQ ID NO: 84095 - protein, 9 aa, Dengue virus
NRFTTRHRK

SEQ ID NO: 84096 - protein, 9 aa, Dengue virus
RFTTRHRKP

SEQ ID NO: 84097 - protein, 9 aa, Dengue virus
FTTRHRKPT

SEQ ID NO: 84098 - protein, 9 aa, Dengue virus
TTRHRKPTY

SEQ ID NO: 84099 - protein, 9 aa, Dengue virus
TRHRKPTYE

SEQ ID NO: 84100 - protein, 9 aa, Dengue virus
RHRKPTYEK

SEQ ID NO: 84101 - protein, 9 aa, Dengue virus
HRKPTYEKD

SEQ ID NO: 84102 - protein, 9 aa, Dengue virus
RKPTYEKDV

SEQ ID NO: 84103 - protein, 9 aa, Dengue virus
KPTYEKDVD

SEQ ID NO: 84104 - protein, 9 aa, Dengue virus
PTYEKDVDL

SEQ ID NO: 84105 - protein, 9 aa, Dengue virus
TYEKDVDLG

SEQ ID NO: 84106 - protein, 9 aa, Dengue virus
YEKDVDLGA

SEQ ID NO: 84107 - protein, 9 aa, Dengue virus
EKDVDLGAG

SEQ ID NO: 84108 - protein, 9 aa, Dengue virus
KDVDLGAGT

SEQ ID NO: 84109 - protein, 9 aa, Dengue virus
DVDLGAGTR

SEQ ID NO: 84110 - protein, 9 aa, Dengue virus
VDLGAGTRS

SEQ ID NO: 84111 - protein, 9 aa, Dengue virus
DLGAGTRSV

SEQ ID NO: 84112 - protein, 9 aa, Dengue virus
LGAGTRSVS

SEQ ID NO: 84113 - protein, 9 aa, Dengue virus
GAGTRSVST

SEQ ID NO: 84114 - protein, 9 aa, Dengue virus
AGTRSVSTE

SEQ ID NO: 84115 - protein, 9 aa, Dengue virus
GTRSVSTET

SEQ ID NO: 84116 - protein, 9 aa, Dengue virus
TRSVSTETE

SEQ ID NO: 84117 - protein, 9 aa, Dengue virus
RSVSTETEK

SEQ ID NO: 84118 - protein, 9 aa, Dengue virus
SVSTETEKP

SEQ ID NO: 84119 - protein, 9 aa, Dengue virus
VSTETEKPD

SEQ ID NO: 84120 - protein, 9 aa, Dengue virus
STETEKPDM

SEQ ID NO: 84121 - protein, 9 aa, Dengue virus
TETEKPDMT

SEQ ID NO: 84122 - protein, 9 aa, Dengue virus
ETEKPDMTI

SEQ ID NO: 84123 - protein, 9 aa, Dengue virus
TEKPDMTII

SEQ ID NO: 84124 - protein, 9 aa, Dengue virus
EKPDMTIIG

SEQ ID NO: 84125 - protein, 9 aa, Dengue virus
KPDMTIIGR

SEQ ID NO: 84126 - protein, 9 aa, Dengue virus
PDMTIIGRR

SEQ ID NO: 84127 - protein, 9 aa, Dengue virus
DMTIIGRRL

SEQ ID NO: 84128 - protein, 9 aa, Dengue virus
MTIIGRRLQ

SEQ ID NO: 84129 - protein, 9 aa, Dengue virus
TIIGRRLQR

SEQ ID NO: 84130 - protein, 9 aa, Dengue virus
IIGRRLQRL

SEQ ID NO: 84131 - protein, 9 aa, Dengue virus
IGRRLQRLQ

SEQ ID NO: 84132 - protein, 9 aa, Dengue virus
GRRLQRLQE

SEQ ID NO: 84133 - protein, 9 aa, Dengue virus
RRLQRLQEE

SEQ ID NO: 84134 - protein, 9 aa, Dengue virus
RLQRLQEEH

SEQ ID NO: 84135 - protein, 9 aa, Dengue virus
LQRLQEEHK

SEQ ID NO: 84136 - protein, 9 aa, Dengue virus
QRLQEEHKE

SEQ ID NO: 84137 - protein, 9 aa, Dengue virus
RLQEEHKET

SEQ ID NO: 84138 - protein, 9 aa, Dengue virus
LQEEHKETW

SEQ ID NO: 84139 - protein, 9 aa, Dengue virus
QEEHKETWH

SEQ ID NO: 84140 - protein, 9 aa, Dengue virus
EEHKETWHY

SEQ ID NO: 84141 - protein, 9 aa, Dengue virus
EHKETWHYD

SEQ ID NO: 84142 - protein, 9 aa, Dengue virus
HKETWHYDQ

SEQ ID NO: 84143 - protein, 9 aa, Dengue virus
KETWHYDQE

SEQ ID NO: 84144 - protein, 9 aa, Dengue virus
ETWHYDQEN

SEQ ID NO: 84145 - protein, 9 aa, Dengue virus
TWHYDQENP

SEQ ID NO: 84146 - protein, 9 aa, Dengue virus
WHYDQENPY

SEQ ID NO: 84147 - protein, 9 aa, Dengue virus
HYDQENPYR

SEQ ID NO: 84148 - protein, 9 aa, Dengue virus
YDQENPYRT

SEQ ID NO: 84149 - protein, 9 aa, Dengue virus
DQENPYRTW

SEQ ID NO: 84150 - protein, 9 aa, Dengue virus
QENPYRTWA

SEQ ID NO: 84151 - protein, 9 aa, Dengue virus
ENPYRTWAY

SEQ ID NO: 84152 - protein, 9 aa, Dengue virus
NPYRTWAYH

SEQ ID NO: 84153 - protein, 9 aa, Dengue virus
PYRTWAYHG

SEQ ID NO: 84154 - protein, 9 aa, Dengue virus
YRTWAYHGS

SEQ ID NO: 84155 - protein, 9 aa, Dengue virus
RTWAYHGSY

SEQ ID NO: 84156 - protein, 9 aa, Dengue virus
TWAYHGSYE

SEQ ID NO: 84157 - protein, 9 aa, Dengue virus
WAYHGSYEA

SEQ ID NO: 84158 - protein, 9 aa, Dengue virus
AYHGSYEAP

SEQ ID NO: 84159 - protein, 9 aa, Dengue virus
YHGSYEAPS

SEQ ID NO: 84160 - protein, 9 aa, Dengue virus
HGSYEAPST

SEQ ID NO: 84161 - protein, 9 aa, Dengue virus
GSYEAPSTG

SEQ ID NO: 84162 - protein, 9 aa, Dengue virus
SYEAPSTGS

SEQ ID NO: 84163 - protein, 9 aa, Dengue virus
YEAPSTGSA

SEQ ID NO: 84164 - protein, 9 aa, Dengue virus
EAPSTGSAS

SEQ ID NO: 84165 - protein, 9 aa, Dengue virus
APSTGSASS

SEQ ID NO: 84166 - protein, 9 aa, Dengue virus
PSTGSASSM

SEQ ID NO: 84167 - protein, 9 aa, Dengue virus
STGSASSMV

SEQ ID NO: 84168 - protein, 9 aa, Dengue virus
TGSASSMVN

SEQ ID NO: 84169 - protein, 9 aa, Dengue virus
GSASSMVNG

SEQ ID NO: 84170 - protein, 9 aa, Dengue virus
SASSMVNGV

SEQ ID NO: 84171 - protein, 9 aa, Dengue virus
ASSMVNGVV

SEQ ID NO: 84172 - protein, 9 aa, Dengue virus
SSMVNGVVK

SEQ ID NO: 84173 - protein, 9 aa, Dengue virus
SMVNGVVKL

SEQ ID NO: 84174 - protein, 9 aa, Dengue virus
MVNGVVKLL

SEQ ID NO: 84175 - protein, 9 aa, Dengue virus
VNGVVKLLT

SEQ ID NO: 84176 - protein, 9 aa, Dengue virus
NGVVKLLTK

SEQ ID NO: 84177 - protein, 9 aa, Dengue virus
GVVKLLTKP

SEQ ID NO: 84178 - protein, 9 aa, Dengue virus
VVKLLTKPW

SEQ ID NO: 84179 - protein, 9 aa, Dengue virus
VKLLTKPWD

SEQ ID NO: 84180 - protein, 9 aa, Dengue virus
KLLTKPWDV

SEQ ID NO: 84181 - protein, 9 aa, Dengue virus
LLTKPWDVI

SEQ ID NO: 84182 - protein, 9 aa, Dengue virus
LTKPWDVIP

SEQ ID NO: 84183 - protein, 9 aa, Dengue virus
TKPWDVIPM

SEQ ID NO: 84184 - protein, 9 aa, Dengue virus
KPWDVIPMV

SEQ ID NO: 84185 - protein, 9 aa, Dengue virus
PWDVIPMVT

SEQ ID NO: 84186 - protein, 9 aa, Dengue virus
WDVIPMVTQ

SEQ ID NO: 84187 - protein, 9 aa, Dengue virus
DVIPMVTQL

SEQ ID NO: 84188 - protein, 9 aa, Dengue virus
VIPMVTQLA

SEQ ID NO: 84189 - protein, 9 aa, Dengue virus
IPMVTQLAM

SEQ ID NO: 84190 - protein, 9 aa, Dengue virus
PMVTQLAMT

SEQ ID NO: 84191 - protein, 9 aa, Dengue virus
MVTQLAMTD

SEQ ID NO: 84192 - protein, 9 aa, Dengue virus
VTQLAMTDT

SEQ ID NO: 84193 - protein, 9 aa, Dengue virus
TQLAMTDTT

SEQ ID NO: 84194 - protein, 9 aa, Dengue virus
QLAMTDTTP

SEQ ID NO: 84195 - protein, 9 aa, Dengue virus
LAMTDTTPF

SEQ ID NO: 84196 - protein, 9 aa, Dengue virus
AMTDTTPFG

SEQ ID NO: 84197 - protein, 9 aa, Dengue virus
MTDTTPFGQ

SEQ ID NO: 84198 - protein, 9 aa, Dengue virus
TDTTPFGQQ

SEQ ID NO: 84199 - protein, 9 aa, Dengue virus
DTTPFGQQR

SEQ ID NO: 84200 - protein, 9 aa, Dengue virus
TTPFGQQRV

SEQ ID NO: 84201 - protein, 9 aa, Dengue virus
TPFGQQRVF

SEQ ID NO: 84202 - protein, 9 aa, Dengue virus
PFGQQRVFK

SEQ ID NO: 84203 - protein, 9 aa, Dengue virus
FGQQRVFKE

SEQ ID NO: 84204 - protein, 9 aa, Dengue virus
GQQRVFKEK

SEQ ID NO: 84205 - protein, 9 aa, Dengue virus
QQRVFKEKV

SEQ ID NO: 84206 - protein, 9 aa, Dengue virus
QRVFKEKVD

SEQ ID NO: 84207 - protein, 9 aa, Dengue virus
RVFKEKVDT

SEQ ID NO: 84208 - protein, 9 aa, Dengue virus
VFKEKVDTR

SEQ ID NO: 84209 - protein, 9 aa, Dengue virus
FKEKVDTRT

SEQ ID NO: 84210 - protein, 9 aa, Dengue virus
KEKVDTRTP

SEQ ID NO: 84211 - protein, 9 aa, Dengue virus
EKVDTRTPQ

SEQ ID NO: 84212 - protein, 9 aa, Dengue virus
KVDTRTPQP

SEQ ID NO: 84213 - protein, 9 aa, Dengue virus
VDTRTPQPK

SEQ ID NO: 84214 - protein, 9 aa, Dengue virus
DTRTPQPKP

SEQ ID NO: 84215 - protein, 9 aa, Dengue virus
TRTPQPKPG

SEQ ID NO: 84216 - protein, 9 aa, Dengue virus
RTPQPKPGT

SEQ ID NO: 84217 - protein, 9 aa, Dengue virus
TPQPKPGTR

SEQ ID NO: 84218 - protein, 9 aa, Dengue virus
PQPKPGTRM

SEQ ID NO: 84219 - protein, 9 aa, Dengue virus
QPKPGTRMV

SEQ ID NO: 84220 - protein, 9 aa, Dengue virus
PKPGTRMVM

SEQ ID NO: 84221 - protein, 9 aa, Dengue virus
KPGTRMVMT

SEQ ID NO: 84222 - protein, 9 aa, Dengue virus
PGTRMVMTT

SEQ ID NO: 84223 - protein, 9 aa, Dengue virus
GTRMVMTTT

SEQ ID NO: 84224 - protein, 9 aa, Dengue virus
TRMVMTTTA

SEQ ID NO: 84225 - protein, 9 aa, Dengue virus
RMVMTTTAN

SEQ ID NO: 84226 - protein, 9 aa, Dengue virus
MVMTTTANW

SEQ ID NO: 84227 - protein, 9 aa, Dengue virus
VMTTTANWL

SEQ ID NO: 84228 - protein, 9 aa, Dengue virus
MTTTANWLW

SEQ ID NO: 84229 - protein, 9 aa, Dengue virus
TTTANWLWA

SEQ ID NO: 84230 - protein, 9 aa, Dengue virus
TTANWLWAL

SEQ ID NO: 84231 - protein, 9 aa, Dengue virus
TANWLWALL

SEQ ID NO: 84232 - protein, 9 aa, Dengue virus
ANWLWALLG

SEQ ID NO: 84233 - protein, 9 aa, Dengue virus
NWLWALLGK

SEQ ID NO: 84234 - protein, 9 aa, Dengue virus
WLWALLGKK

SEQ ID NO: 84235 - protein, 9 aa, Dengue virus
LWALLGKKK

SEQ ID NO: 84236 - protein, 9 aa, Dengue virus
LLGKKKNPR

SEQ ID NO: 84237 - protein, 9 aa, Dengue virus
LGKKKNPRL

SEQ ID NO: 84238 - protein, 9 aa, Dengue virus
GKKKNPRLC

SEQ ID NO: 84239 - protein, 9 aa, Dengue virus
KKKNPRLCT

SEQ ID NO: 84240 - protein, 9 aa, Dengue virus
KKNPRLCTR

SEQ ID NO: 84241 - protein, 9 aa, Dengue virus
KNPRLCTRE

SEQ ID NO: 84242 - protein, 9 aa, Dengue virus
NPRLCTREE

SEQ ID NO: 84243 - protein, 9 aa, Dengue virus
PRLCTREEF

SEQ ID NO: 84244 - protein, 9 aa, Dengue virus
RLCTREEFI

SEQ ID NO: 84245 - protein, 9 aa, Dengue virus
LCTREEFIS

SEQ ID NO: 84246 - protein, 9 aa, Dengue virus
CTREEFISK

SEQ ID NO: 84247 - protein, 9 aa, Dengue virus
TREEFISKV

SEQ ID NO: 84248 - protein, 9 aa, Dengue virus
REEFISKVR

SEQ ID NO: 84249 - protein, 9 aa, Dengue virus
EEFISKVRS

SEQ ID NO: 84250 - protein, 9 aa, Dengue virus
EFISKVRSN

SEQ ID NO: 84251 - protein, 9 aa, Dengue virus
FISKVRSNA

SEQ ID NO: 84252 - protein, 9 aa, Dengue virus
ISKVRSNAA

SEQ ID NO: 84253 - protein, 9 aa, Dengue virus
SKVRSNAAI

SEQ ID NO: 84254 - protein, 9 aa, Dengue virus
KVRSNAAIG

SEQ ID NO: 84255 - protein, 9 aa, Dengue virus
VRSNAAIGA

SEQ ID NO: 84256 - protein, 9 aa, Dengue virus
RSNAAIGAV

SEQ ID NO: 84257 - protein, 9 aa, Dengue virus
SNAAIGAVF

SEQ ID NO: 84258 - protein, 9 aa, Dengue virus
NAAIGAVFQ

SEQ ID NO: 84259 - protein, 9 aa, Dengue virus
AAIGAVFQE

SEQ ID NO: 84260 - protein, 9 aa, Dengue virus
AIGAVFQEE

SEQ ID NO: 84261 - protein, 9 aa, Dengue virus
IGAVFQEEQ

SEQ ID NO: 84262 - protein, 9 aa, Dengue virus
GAVFQEEQG

SEQ ID NO: 84263 - protein, 9 aa, Dengue virus
AVFQEEQGW

SEQ ID NO: 84264 - protein, 9 aa, Dengue virus
VFQEEQGWT

SEQ ID NO: 84265 - protein, 9 aa, Dengue virus
FQEEQGWTS

SEQ ID NO: 84266 - protein, 9 aa, Dengue virus
QEEQGWTSA

SEQ ID NO: 84267 - protein, 9 aa, Dengue virus
EEQGWTSAS

SEQ ID NO: 84268 - protein, 9 aa, Dengue virus
EQGWTSASE

SEQ ID NO: 84269 - protein, 9 aa, Dengue virus
QGWTSASEA

SEQ ID NO: 84270 - protein, 9 aa, Dengue virus
GWTSASEAV

SEQ ID NO: 84271 - protein, 9 aa, Dengue virus
WTSASEAVN

SEQ ID NO: 84272 - protein, 9 aa, Dengue virus
TSASEAVND

SEQ ID NO: 84273 - protein, 9 aa, Dengue virus
SASEAVNDS

SEQ ID NO: 84274 - protein, 9 aa, Dengue virus
ASEAVNDSR

SEQ ID NO: 84275 - protein, 9 aa, Dengue virus
SEAVNDSRF

SEQ ID NO: 84276 - protein, 9 aa, Dengue virus
EAVNDSRFW

SEQ ID NO: 84277 - protein, 9 aa, Dengue virus
AVNDSRFWE

SEQ ID NO: 84278 - protein, 9 aa, Dengue virus
VNDSRFWEL

SEQ ID NO: 84279 - protein, 9 aa, Dengue virus
NDSRFWELV

SEQ ID NO: 84280 - protein, 9 aa, Dengue virus
DSRFWELVD

SEQ ID NO: 84281 - protein, 9 aa, Dengue virus
SRFWELVDK

SEQ ID NO: 84282 - protein, 9 aa, Dengue virus
RFWELVDKE

SEQ ID NO: 84283 - protein, 9 aa, Dengue virus
FWELVDKER

SEQ ID NO: 84284 - protein, 9 aa, Dengue virus
WELVDKERA

SEQ ID NO: 84285 - protein, 9 aa, Dengue virus
ELVDKERAL

SEQ ID NO: 84286 - protein, 9 aa, Dengue virus
LVDKERALH

SEQ ID NO: 84287 - protein, 9 aa, Dengue virus
VDKERALHQ

SEQ ID NO: 84288 - protein, 9 aa, Dengue virus
DKERALHQE

SEQ ID NO: 84289 - protein, 9 aa, Dengue virus
KERALHQEG

SEQ ID NO: 84290 - protein, 9 aa, Dengue virus
ERALHQEGK

SEQ ID NO: 84291 - protein, 9 aa, Dengue virus
RALHQEGKC

SEQ ID NO: 84292 - protein, 9 aa, Dengue virus
ALHQEGKCE

SEQ ID NO: 84293 - protein, 9 aa, Dengue virus
LHQEGKCES

SEQ ID NO: 84294 - protein, 9 aa, Dengue virus
HQEGKCESC

SEQ ID NO: 84295 - protein, 9 aa, Dengue virus
QEGKCESCV

SEQ ID NO: 84296 - protein, 9 aa, Dengue virus
EGKCESCVY

SEQ ID NO: 84297 - protein, 9 aa, Dengue virus
GKCESCVYN

SEQ ID NO: 84298 - protein, 9 aa, Dengue virus
KCESCVYNM

SEQ ID NO: 84299 - protein, 9 aa, Dengue virus
CESCVYNMM

SEQ ID NO: 84300 - protein, 9 aa, Dengue virus
ESCVYNMMG

SEQ ID NO: 84301 - protein, 9 aa, Dengue virus
SCVYNMMGK

SEQ ID NO: 84302 - protein, 9 aa, Dengue virus
CVYNMMGKR

SEQ ID NO: 84303 - protein, 9 aa, Dengue virus
VYNMMGKRE

SEQ ID NO: 84304 - protein, 9 aa, Dengue virus
YNMMGKREK

SEQ ID NO: 84305 - protein, 9 aa, Dengue virus
NMMGKREKK

SEQ ID NO: 84306 - protein, 9 aa, Dengue virus
MMGKREKKL

SEQ ID NO: 84307 - protein, 9 aa, Dengue virus
MGKREKKLG

SEQ ID NO: 84308 - protein, 9 aa, Dengue virus
GKREKKLGE

SEQ ID NO: 84309 - protein, 9 aa, Dengue virus
KREKKLGEF

SEQ ID NO: 84310 - protein, 9 aa, Dengue virus
REKKLGEFG

SEQ ID NO: 84311 - protein, 9 aa, Dengue virus
EKKLGEFGR

SEQ ID NO: 84312 - protein, 9 aa, Dengue virus
KKLGEFGRA

SEQ ID NO: 84313 - protein, 9 aa, Dengue virus
KLGEFGRAK

SEQ ID NO: 84314 - protein, 9 aa, Dengue virus
LGEFGRAKG

SEQ ID NO: 84315 - protein, 9 aa, Dengue virus
GEFGRAKGS

SEQ ID NO: 84316 - protein, 9 aa, Dengue virus
EFGRAKGSR

SEQ ID NO: 84317 - protein, 9 aa, Dengue virus
FGRAKGSRA

SEQ ID NO: 84318 - protein, 9 aa, Dengue virus
GRAKGSRAI

SEQ ID NO: 84319 - protein, 9 aa, Dengue virus
RAKGSRAIW

SEQ ID NO: 84320 - protein, 9 aa, Dengue virus
AKGSRAIWY

SEQ ID NO: 84321 - protein, 9 aa, Dengue virus
KGSRAIWYM

SEQ ID NO: 84322 - protein, 9 aa, Dengue virus
GSRAIWYMW

SEQ ID NO: 84323 - protein, 9 aa, Dengue virus
SRAIWYMWL

SEQ ID NO: 84324 - protein, 9 aa, Dengue virus
RAIWYMWLG

SEQ ID NO: 84325 - protein, 9 aa, Dengue virus
AIWYMWLGA

SEQ ID NO: 84326 - protein, 9 aa, Dengue virus
IWYMWLGAR

SEQ ID NO: 84327 - protein, 9 aa, Dengue virus
WYMWLGARF

SEQ ID NO: 84328 - protein, 9 aa, Dengue virus
YMWLGARFL

SEQ ID NO: 84329 - protein, 9 aa, Dengue virus
MWLGARFLE

SEQ ID NO: 84330 - protein, 9 aa, Dengue virus
WLGARFLEF

SEQ ID NO: 84331 - protein, 9 aa, Dengue virus
LGARFLEFE

SEQ ID NO: 84332 - protein, 9 aa, Dengue virus
GARFLEFEA

SEQ ID NO: 84333 - protein, 9 aa, Dengue virus
ARFLEFEAL

SEQ ID NO: 84334 - protein, 9 aa, Dengue virus
RFLEFEALG

SEQ ID NO: 84335 - protein, 9 aa, Dengue virus
FLEFEALGF

SEQ ID NO: 84336 - protein, 9 aa, Dengue virus
LEFEALGFL

SEQ ID NO: 84337 - protein, 9 aa, Dengue virus
EFEALGFLN

SEQ ID NO: 84338 - protein, 9 aa, Dengue virus
FEALGFLNE

SEQ ID NO: 84339 - protein, 9 aa, Dengue virus
EALGFLNED

SEQ ID NO: 84340 - protein, 9 aa, Dengue virus
ALGFLNEDH

SEQ ID NO: 84341 - protein, 9 aa, Dengue virus
LGFLNEDHW

SEQ ID NO: 84342 - protein, 9 aa, Dengue virus
GFLNEDHWF

SEQ ID NO: 84343 - protein, 9 aa, Dengue virus
FLNEDHWFG

SEQ ID NO: 84344 - protein, 9 aa, Dengue virus
LNEDHWFGR

SEQ ID NO: 84345 - protein, 9 aa, Dengue virus
NEDHWFGRE

SEQ ID NO: 84346 - protein, 9 aa, Dengue virus
EDHWFGREN

SEQ ID NO: 84347 - protein, 9 aa, Dengue virus
DHWFGRENS

SEQ ID NO: 84348 - protein, 9 aa, Dengue virus
HWFGRENSW

SEQ ID NO: 84349 - protein, 9 aa, Dengue virus
WFGRENSWS

SEQ ID NO: 84350 - protein, 9 aa, Dengue virus
FGRENSWSG

SEQ ID NO: 84351 - protein, 9 aa, Dengue virus
GRENSWSGV

SEQ ID NO: 84352 - protein, 9 aa, Dengue virus
RENSWSGVE

SEQ ID NO: 84353 - protein, 9 aa, Dengue virus
ENSWSGVEG

SEQ ID NO: 84354 - protein, 9 aa, Dengue virus
NSWSGVEGE

SEQ ID NO: 84355 - protein, 9 aa, Dengue virus
SWSGVEGEG

SEQ ID NO: 84356 - protein, 9 aa, Dengue virus
WSGVEGEGL

SEQ ID NO: 84357 - protein, 9 aa, Dengue virus
SGVEGEGLH

SEQ ID NO: 84358 - protein, 9 aa, Dengue virus
GVEGEGLHR

SEQ ID NO: 84359 - protein, 9 aa, Dengue virus
VEGEGLHRL

SEQ ID NO: 84360 - protein, 9 aa, Dengue virus
EGEGLHRLG

SEQ ID NO: 84361 - protein, 9 aa, Dengue virus
GEGLHRLGY

SEQ ID NO: 84362 - protein, 9 aa, Dengue virus
EGLHRLGYI

SEQ ID NO: 84363 - protein, 9 aa, Dengue virus
GLHRLGYIL

SEQ ID NO: 84364 - protein, 9 aa, Dengue virus
LHRLGYILE

SEQ ID NO: 84365 - protein, 9 aa, Dengue virus
HRLGYILEE

SEQ ID NO: 84366 - protein, 9 aa, Dengue virus
RLGYILEEI

SEQ ID NO: 84367 - protein, 9 aa, Dengue virus
LGYILEEID

SEQ ID NO: 84368 - protein, 9 aa, Dengue virus
GYILEEIDK

SEQ ID NO: 84369 - protein, 9 aa, Dengue virus
YILEEIDKK

SEQ ID NO: 84370 - protein, 9 aa, Dengue virus
ILEEIDKKD

SEQ ID NO: 84371 - protein, 9 aa, Dengue virus
LEEIDKKDG

SEQ ID NO: 84372 - protein, 9 aa, Dengue virus
EEIDKKDGD

SEQ ID NO: 84373 - protein, 9 aa, Dengue virus
EIDKKDGDL

SEQ ID NO: 84374 - protein, 9 aa, Dengue virus
IDKKDGDLM

SEQ ID NO: 84375 - protein, 9 aa, Dengue virus
DKKDGDLMY

SEQ ID NO: 84376 - protein, 9 aa, Dengue virus
KKDGDLMYA

SEQ ID NO: 84377 - protein, 9 aa, Dengue virus
KDGDLMYAD

SEQ ID NO: 84378 - protein, 9 aa, Dengue virus
DGDLMYADD

SEQ ID NO: 84379 - protein, 9 aa, Dengue virus
GDLMYADDT

SEQ ID NO: 84380 - protein, 9 aa, Dengue virus
DLMYADDTA

SEQ ID NO: 84381 - protein, 9 aa, Dengue virus
LMYADDTAG

SEQ ID NO: 84382 - protein, 9 aa, Dengue virus
MYADDTAGW

SEQ ID NO: 84383 - protein, 9 aa, Dengue virus
YADDTAGWD

SEQ ID NO: 84384 - protein, 9 aa, Dengue virus
ADDTAGWDT

SEQ ID NO: 84385 - protein, 9 aa, Dengue virus
DDTAGWDTR

SEQ ID NO: 84386 - protein, 9 aa, Dengue virus
DTAGWDTRI

SEQ ID NO: 84387 - protein, 9 aa, Dengue virus
TAGWDTRIT

SEQ ID NO: 84388 - protein, 9 aa, Dengue virus
AGWDTRITE

SEQ ID NO: 84389 - protein, 9 aa, Dengue virus
GWDTRITED

SEQ ID NO: 84390 - protein, 9 aa, Dengue virus
WDTRITEDD

SEQ ID NO: 84391 - protein, 9 aa, Dengue virus
DTRITEDDL

SEQ ID NO: 84392 - protein, 9 aa, Dengue virus
TRITEDDLQ

SEQ ID NO: 84393 - protein, 9 aa, Dengue virus
RITEDDLQN

SEQ ID NO: 84394 - protein, 9 aa, Dengue virus
ITEDDLQNE

SEQ ID NO: 84395 - protein, 9 aa, Dengue virus
TEDDLQNEE

SEQ ID NO: 84396 - protein, 9 aa, Dengue virus
EDDLQNEEL

SEQ ID NO: 84397 - protein, 9 aa, Dengue virus
DDLQNEELI

SEQ ID NO: 84398 - protein, 9 aa, Dengue virus
DLQNEELIT

SEQ ID NO: 84399 - protein, 9 aa, Dengue virus
LQNEELITE

SEQ ID NO: 84400 - protein, 9 aa, Dengue virus
QNEELITEQ

SEQ ID NO: 84401 - protein, 9 aa, Dengue virus
NEELITEQM

SEQ ID NO: 84402 - protein, 9 aa, Dengue virus
EELITEQMA

SEQ ID NO: 84403 - protein, 9 aa, Dengue virus
ELITEQMAP

SEQ ID NO: 84404 - protein, 9 aa, Dengue virus
LITEQMAPH

SEQ ID NO: 84405 - protein, 9 aa, Dengue virus
ITEQMAPHH

SEQ ID NO: 84406 - protein, 9 aa, Dengue virus
TEQMAPHHK

SEQ ID NO: 84407 - protein, 9 aa, Dengue virus
EQMAPHHKI

SEQ ID NO: 84408 - protein, 9 aa, Dengue virus
QMAPHHKIL

SEQ ID NO: 84409 - protein, 9 aa, Dengue virus
MAPHHKILA

SEQ ID NO: 84410 - protein, 9 aa, Dengue virus
APHHKILAK

SEQ ID NO: 84411 - protein, 9 aa, Dengue virus
PHHKILAKA

SEQ ID NO: 84412 - protein, 9 aa, Dengue virus
HHKILAKAI

SEQ ID NO: 84413 - protein, 9 aa, Dengue virus
HKILAKAIF

SEQ ID NO: 84414 - protein, 9 aa, Dengue virus
KILAKAIFK

SEQ ID NO: 84415 - protein, 9 aa, Dengue virus
ILAKAIFKL

SEQ ID NO: 84416 - protein, 9 aa, Dengue virus
LAKAIFKLT

SEQ ID NO: 84417 - protein, 9 aa, Dengue virus
AKAIFKLTY

SEQ ID NO: 84418 - protein, 9 aa, Dengue virus
KAIFKLTYQ

SEQ ID NO: 84419 - protein, 9 aa, Dengue virus
AIFKLTYQN

SEQ ID NO: 84420 - protein, 9 aa, Dengue virus
IFKLTYQNK

SEQ ID NO: 84421 - protein, 9 aa, Dengue virus
FKLTYQNKV

SEQ ID NO: 84422 - protein, 9 aa, Dengue virus
KLTYQNKVV

SEQ ID NO: 84423 - protein, 9 aa, Dengue virus
LTYQNKVVK

SEQ ID NO: 84424 - protein, 9 aa, Dengue virus
TYQNKVVKV

SEQ ID NO: 84425 - protein, 9 aa, Dengue virus
YQNKVVKVL

SEQ ID NO: 84426 - protein, 9 aa, Dengue virus
QNKVVKVLR

SEQ ID NO: 84427 - protein, 9 aa, Dengue virus
NKVVKVLRP

SEQ ID NO: 84428 - protein, 9 aa, Dengue virus
KVVKVLRPT

SEQ ID NO: 84429 - protein, 9 aa, Dengue virus
VVKVLRPTP

SEQ ID NO: 84430 - protein, 9 aa, Dengue virus
VKVLRPTPR

SEQ ID NO: 84431 - protein, 9 aa, Dengue virus
KVLRPTPRG

SEQ ID NO: 84432 - protein, 9 aa, Dengue virus
VLRPTPRGA

SEQ ID NO: 84433 - protein, 9 aa, Dengue virus
LRPTPRGAV

SEQ ID NO: 84434 - protein, 9 aa, Dengue virus
RPTPRGAVM

SEQ ID NO: 84435 - protein, 9 aa, Dengue virus
PTPRGAVMD

SEQ ID NO: 84436 - protein, 9 aa, Dengue virus
TPRGAVMDI

SEQ ID NO: 84437 - protein, 9 aa, Dengue virus
PRGAVMDII

SEQ ID NO: 84438 - protein, 9 aa, Dengue virus
RGAVMDIIS

SEQ ID NO: 84439 - protein, 9 aa, Dengue virus
GAVMDIISR

SEQ ID NO: 84440 - protein, 9 aa, Dengue virus
AVMDIISRK

SEQ ID NO: 84441 - protein, 9 aa, Dengue virus
VMDIISRKD

SEQ ID NO: 84442 - protein, 9 aa, Dengue virus
MDIISRKDQ

SEQ ID NO: 84443 - protein, 9 aa, Dengue virus
DIISRKDQR

SEQ ID NO: 84444 - protein, 9 aa, Dengue virus
IISRKDQRG

SEQ ID NO: 84445 - protein, 9 aa, Dengue virus
ISRKDQRGS

SEQ ID NO: 84446 - protein, 9 aa, Dengue virus
SRKDQRGSG

SEQ ID NO: 84447 - protein, 9 aa, Dengue virus
RKDQRGSGQ

SEQ ID NO: 84448 - protein, 9 aa, Dengue virus
KDQRGSGQV

SEQ ID NO: 84449 - protein, 9 aa, Dengue virus
DQRGSGQVG

SEQ ID NO: 84450 - protein, 9 aa, Dengue virus
QRGSGQVGT

SEQ ID NO: 84451 - protein, 9 aa, Dengue virus
RGSGQVGTY

SEQ ID NO: 84452 - protein, 9 aa, Dengue virus
GSGQVGTYG

SEQ ID NO: 84453 - protein, 9 aa, Dengue virus
SGQVGTYGL

SEQ ID NO: 84454 - protein, 9 aa, Dengue virus
GQVGTYGLN

SEQ ID NO: 84455 - protein, 9 aa, Dengue virus
QVGTYGLNT

SEQ ID NO: 84456 - protein, 9 aa, Dengue virus
VGTYGLNTF

SEQ ID NO: 84457 - protein, 9 aa, Dengue virus
GTYGLNTFT

SEQ ID NO: 84458 - protein, 9 aa, Dengue virus
TYGLNTFTN

SEQ ID NO: 84459 - protein, 9 aa, Dengue virus
YGLNTFTNM

SEQ ID NO: 84460 - protein, 9 aa, Dengue virus
GLNTFTNME

SEQ ID NO: 84461 - protein, 9 aa, Dengue virus
LNTFTNMEV

SEQ ID NO: 84462 - protein, 9 aa, Dengue virus
NTFTNMEVQ

SEQ ID NO: 84463 - protein, 9 aa, Dengue virus
TFTNMEVQL

SEQ ID NO: 84464 - protein, 9 aa, Dengue virus
FTNMEVQLI

SEQ ID NO: 84465 - protein, 9 aa, Dengue virus
TNMEVQLIR

SEQ ID NO: 84466 - protein, 9 aa, Dengue virus
NMEVQLIRQ

SEQ ID NO: 84467 - protein, 9 aa, Dengue virus
MEVQLIRQM

SEQ ID NO: 84468 - protein, 9 aa, Dengue virus
EVQLIRQME

SEQ ID NO: 84469 - protein, 9 aa, Dengue virus
VQLIRQMEA

SEQ ID NO: 84470 - protein, 9 aa, Dengue virus
QLIRQMEAE

SEQ ID NO: 84471 - protein, 9 aa, Dengue virus
LIRQMEAEG

SEQ ID NO: 84472 - protein, 9 aa, Dengue virus
IRQMEAEGV

SEQ ID NO: 84473 - protein, 9 aa, Dengue virus
RQMEAEGVI

SEQ ID NO: 84474 - protein, 9 aa, Dengue virus
QMEAEGVIT

SEQ ID NO: 84475 - protein, 9 aa, Dengue virus
MEAEGVITQ

SEQ ID NO: 84476 - protein, 9 aa, Dengue virus
EAEGVITQD

SEQ ID NO: 84477 - protein, 9 aa, Dengue virus
AEGVITQDD

SEQ ID NO: 84478 - protein, 9 aa, Dengue virus
EGVITQDDM

SEQ ID NO: 84479 - protein, 9 aa, Dengue virus
GVITQDDMQ

SEQ ID NO: 84480 - protein, 9 aa, Dengue virus
VITQDDMQN

SEQ ID NO: 84481 - protein, 9 aa, Dengue virus
ITQDDMQNP

SEQ ID NO: 84482 - protein, 9 aa, Dengue virus
TQDDMQNPK

SEQ ID NO: 84483 - protein, 9 aa, Dengue virus
QDDMQNPKG

SEQ ID NO: 84484 - protein, 9 aa, Dengue virus
DDMQNPKGL

SEQ ID NO: 84485 - protein, 9 aa, Dengue virus
DMQNPKGLK

SEQ ID NO: 84486 - protein, 9 aa, Dengue virus
MQNPKGLKE

SEQ ID NO: 84487 - protein, 9 aa, Dengue virus
QNPKGLKER

SEQ ID NO: 84488 - protein, 9 aa, Dengue virus
NPKGLKERV

SEQ ID NO: 84489 - protein, 9 aa, Dengue virus
PKGLKERVE

SEQ ID NO: 84490 - protein, 9 aa, Dengue virus
KGLKERVEK

SEQ ID NO: 84491 - protein, 9 aa, Dengue virus
GLKERVEKW

SEQ ID NO: 84492 - protein, 9 aa, Dengue virus
LKERVEKWL

SEQ ID NO: 84493 - protein, 9 aa, Dengue virus
KERVEKWLR

SEQ ID NO: 84494 - protein, 9 aa, Dengue virus
ERVEKWLRE

SEQ ID NO: 84495 - protein, 9 aa, Dengue virus
RVEKWLREC

SEQ ID NO: 84496 - protein, 9 aa, Dengue virus
VEKWLRECG

SEQ ID NO: 84497 - protein, 9 aa, Dengue virus
EKWLRECGV

SEQ ID NO: 84498 - protein, 9 aa, Dengue virus
KWLRECGVD

SEQ ID NO: 84499 - protein, 9 aa, Dengue virus
WLRECGVDR

SEQ ID NO: 84500 - protein, 9 aa, Dengue virus
LRECGVDRL

SEQ ID NO: 84501 - protein, 9 aa, Dengue virus
RECGVDRLK

SEQ ID NO: 84502 - protein, 9 aa, Dengue virus
ECGVDRLKR

SEQ ID NO: 84503 - protein, 9 aa, Dengue virus
CGVDRLKRM

SEQ ID NO: 84504 - protein, 9 aa, Dengue virus
GVDRLKRMA

SEQ ID NO: 84505 - protein, 9 aa, Dengue virus
VDRLKRMAI

SEQ ID NO: 84506 - protein, 9 aa, Dengue virus
DRLKRMAIS

SEQ ID NO: 84507 - protein, 9 aa, Dengue virus
RLKRMAISG

SEQ ID NO: 84508 - protein, 9 aa, Dengue virus
LKRMAISGD

SEQ ID NO: 84509 - protein, 9 aa, Dengue virus
KRMAISGDD

SEQ ID NO: 84510 - protein, 9 aa, Dengue virus
RMAISGDDC

SEQ ID NO: 84511 - protein, 9 aa, Dengue virus
MAISGDDCV

SEQ ID NO: 84512 - protein, 9 aa, Dengue virus
AISGDDCVV

SEQ ID NO: 84513 - protein, 9 aa, Dengue virus
ISGDDCVVK

SEQ ID NO: 84514 - protein, 9 aa, Dengue virus
SGDDCVVKP

SEQ ID NO: 84515 - protein, 9 aa, Dengue virus
GDDCVVKPL

SEQ ID NO: 84516 - protein, 9 aa, Dengue virus
DDCVVKPLD

SEQ ID NO: 84517 - protein, 9 aa, Dengue virus
DCVVKPLDE

SEQ ID NO: 84518 - protein, 9 aa, Dengue virus
CVVKPLDER

SEQ ID NO: 84519 - protein, 9 aa, Dengue virus
VVKPLDERF

SEQ ID NO: 84520 - protein, 9 aa, Dengue virus
VKPLDERFG

SEQ ID NO: 84521 - protein, 9 aa, Dengue virus
KPLDERFGT

SEQ ID NO: 84522 - protein, 9 aa, Dengue virus
PLDERFGTS

SEQ ID NO: 84523 - protein, 9 aa, Dengue virus
LDERFGTSL

SEQ ID NO: 84524 - protein, 9 aa, Dengue virus
DERFGTSLL

SEQ ID NO: 84525 - protein, 9 aa, Dengue virus
ERFGTSLLF

SEQ ID NO: 84526 - protein, 9 aa, Dengue virus
RFGTSLLFL

SEQ ID NO: 84527 - protein, 9 aa, Dengue virus
FGTSLLFLN

SEQ ID NO: 84528 - protein, 9 aa, Dengue virus
GTSLLFLND

SEQ ID NO: 84529 - protein, 9 aa, Dengue virus
TSLLFLNDM

SEQ ID NO: 84530 - protein, 9 aa, Dengue virus
SLLFLNDMG

SEQ ID NO: 84531 - protein, 9 aa, Dengue virus
LLFLNDMGK

SEQ ID NO: 84532 - protein, 9 aa, Dengue virus
LFLNDMGKV

SEQ ID NO: 84533 - protein, 9 aa, Dengue virus
FLNDMGKVR

SEQ ID NO: 84534 - protein, 9 aa, Dengue virus
LNDMGKVRK

SEQ ID NO: 84535 - protein, 9 aa, Dengue virus
NDMGKVRKD

SEQ ID NO: 84536 - protein, 9 aa, Dengue virus
DMGKVRKDI

SEQ ID NO: 84537 - protein, 9 aa, Dengue virus
MGKVRKDIP

SEQ ID NO: 84538 - protein, 9 aa, Dengue virus
GKVRKDIPQ

SEQ ID NO: 84539 - protein, 9 aa, Dengue virus
KVRKDIPQW

SEQ ID NO: 84540 - protein, 9 aa, Dengue virus
VRKDIPQWE

SEQ ID NO: 84541 - protein, 9 aa, Dengue virus
RKDIPQWEP

SEQ ID NO: 84542 - protein, 9 aa, Dengue virus
KDIPQWEPS

SEQ ID NO: 84543 - protein, 9 aa, Dengue virus
DIPQWEPSK

SEQ ID NO: 84544 - protein, 9 aa, Dengue virus
IPQWEPSKG

SEQ ID NO: 84545 - protein, 9 aa, Dengue virus
PQWEPSKGW

SEQ ID NO: 84546 - protein, 9 aa, Dengue virus
QWEPSKGWK

SEQ ID NO: 84547 - protein, 9 aa, Dengue virus
WEPSKGWKN

SEQ ID NO: 84548 - protein, 9 aa, Dengue virus
EPSKGWKNW

SEQ ID NO: 84549 - protein, 9 aa, Dengue virus
PSKGWKNWQ

SEQ ID NO: 84550 - protein, 9 aa, Dengue virus
SKGWKNWQE

SEQ ID NO: 84551 - protein, 9 aa, Dengue virus
KGWKNWQEV

SEQ ID NO: 84552 - protein, 9 aa, Dengue virus
GWKNWQEVP

SEQ ID NO: 84553 - protein, 9 aa, Dengue virus
WKNWQEVPF

SEQ ID NO: 84554 - protein, 9 aa, Dengue virus
KNWQEVPFC

SEQ ID NO: 84555 - protein, 9 aa, Dengue virus
NWQEVPFCS

SEQ ID NO: 84556 - protein, 9 aa, Dengue virus
WQEVPFCSH

SEQ ID NO: 84557 - protein, 9 aa, Dengue virus
QEVPFCSHH

SEQ ID NO: 84558 - protein, 9 aa, Dengue virus
EVPFCSHHF

SEQ ID NO: 84559 - protein, 9 aa, Dengue virus
VPFCSHHFH

SEQ ID NO: 84560 - protein, 9 aa, Dengue virus
PFCSHHFHK

SEQ ID NO: 84561 - protein, 9 aa, Dengue virus
FCSHHFHKI

SEQ ID NO: 84562 - protein, 9 aa, Dengue virus
CSHHFHKIF

SEQ ID NO: 84563 - protein, 9 aa, Dengue virus
SHHFHKIFM

SEQ ID NO: 84564 - protein, 9 aa, Dengue virus
HHFHKIFMK

SEQ ID NO: 84565 - protein, 9 aa, Dengue virus
HFHKIFMKD

SEQ ID NO: 84566 - protein, 9 aa, Dengue virus
FHKIFMKDG

SEQ ID NO: 84567 - protein, 9 aa, Dengue virus
HKIFMKDGR

SEQ ID NO: 84568 - protein, 9 aa, Dengue virus
KIFMKDGRS

SEQ ID NO: 84569 - protein, 9 aa, Dengue virus
IFMKDGRSL

SEQ ID NO: 84570 - protein, 9 aa, Dengue virus
FMKDGRSLV

SEQ ID NO: 84571 - protein, 9 aa, Dengue virus
MKDGRSLVV

SEQ ID NO: 84572 - protein, 9 aa, Dengue virus
KDGRSLVVP

SEQ ID NO: 84573 - protein, 9 aa, Dengue virus
DGRSLVVPC

SEQ ID NO: 84574 - protein, 9 aa, Dengue virus
GRSLVVPCR

SEQ ID NO: 84575 - protein, 9 aa, Dengue virus
RSLVVPCRN

SEQ ID NO: 84576 - protein, 9 aa, Dengue virus
SLVVPCRNQ

SEQ ID NO: 84577 - protein, 9 aa, Dengue virus
LVVPCRNQD

SEQ ID NO: 84578 - protein, 9 aa, Dengue virus
VVPCRNQDE

SEQ ID NO: 84579 - protein, 9 aa, Dengue virus
VPCRNQDEL

SEQ ID NO: 84580 - protein, 9 aa, Dengue virus
PCRNQDELI

SEQ ID NO: 84581 - protein, 9 aa, Dengue virus
CRNQDELIG

SEQ ID NO: 84582 - protein, 9 aa, Dengue virus
RNQDELIGR

SEQ ID NO: 84583 - protein, 9 aa, Dengue virus
NQDELIGRA

SEQ ID NO: 84584 - protein, 9 aa, Dengue virus
QDELIGRAR

SEQ ID NO: 84585 - protein, 9 aa, Dengue virus
DELIGRARI

SEQ ID NO: 84586 - protein, 9 aa, Dengue virus
ELIGRARIS

SEQ ID NO: 84587 - protein, 9 aa, Dengue virus
LIGRARISQ

SEQ ID NO: 84588 - protein, 9 aa, Dengue virus
IGRARISQG

SEQ ID NO: 84589 - protein, 9 aa, Dengue virus
GRARISQGA

SEQ ID NO: 84590 - protein, 9 aa, Dengue virus
RARISQGAG

SEQ ID NO: 84591 - protein, 9 aa, Dengue virus
ARISQGAGW

SEQ ID NO: 84592 - protein, 9 aa, Dengue virus
RISQGAGWS

SEQ ID NO: 84593 - protein, 9 aa, Dengue virus
ISQGAGWSL

SEQ ID NO: 84594 - protein, 9 aa, Dengue virus
SQGAGWSLR

SEQ ID NO: 84595 - protein, 9 aa, Dengue virus
QGAGWSLRE

SEQ ID NO: 84596 - protein, 9 aa, Dengue virus
GAGWSLRET

SEQ ID NO: 84597 - protein, 9 aa, Dengue virus
AGWSLRETA

SEQ ID NO: 84598 - protein, 9 aa, Dengue virus
GWSLRETAC

SEQ ID NO: 84599 - protein, 9 aa, Dengue virus
WSLRETACL

SEQ ID NO: 84600 - protein, 9 aa, Dengue virus
SLRETACLG

SEQ ID NO: 84601 - protein, 9 aa, Dengue virus
LRETACLGK

SEQ ID NO: 84602 - protein, 9 aa, Dengue virus
RETACLGKA

SEQ ID NO: 84603 - protein, 9 aa, Dengue virus
ETACLGKAY

SEQ ID NO: 84604 - protein, 9 aa, Dengue virus
TACLGKAYA

SEQ ID NO: 84605 - protein, 9 aa, Dengue virus
ACLGKAYAQ

SEQ ID NO: 84606 - protein, 9 aa, Dengue virus
CLGKAYAQM

SEQ ID NO: 84607 - protein, 9 aa, Dengue virus
LGKAYAQMW

SEQ ID NO: 84608 - protein, 9 aa, Dengue virus
GKAYAQMWS

SEQ ID NO: 84609 - protein, 9 aa, Dengue virus
KAYAQMWSL

SEQ ID NO: 84610 - protein, 9 aa, Dengue virus
AYAQMWSLM

SEQ ID NO: 84611 - protein, 9 aa, Dengue virus
YAQMWSLMY

SEQ ID NO: 84612 - protein, 9 aa, Dengue virus
AQMWSLMYF

SEQ ID NO: 84613 - protein, 9 aa, Dengue virus
QMWSLMYFH

SEQ ID NO: 84614 - protein, 9 aa, Dengue virus
MWSLMYFHR

SEQ ID NO: 84615 - protein, 9 aa, Dengue virus
WSLMYFHRR

SEQ ID NO: 84616 - protein, 9 aa, Dengue virus
SLMYFHRRD

SEQ ID NO: 84617 - protein, 9 aa, Dengue virus
LMYFHRRDL

SEQ ID NO: 84618 - protein, 9 aa, Dengue virus
MYFHRRDLR

SEQ ID NO: 84619 - protein, 9 aa, Dengue virus
YFHRRDLRL

SEQ ID NO: 84620 - protein, 9 aa, Dengue virus
FHRRDLRLA

SEQ ID NO: 84621 - protein, 9 aa, Dengue virus
HRRDLRLAS

SEQ ID NO: 84622 - protein, 9 aa, Dengue virus
RRDLRLASM

SEQ ID NO: 84623 - protein, 9 aa, Dengue virus
RDLRLASMA

SEQ ID NO: 84624 - protein, 9 aa, Dengue virus
DLRLASMAI

SEQ ID NO: 84625 - protein, 9 aa, Dengue virus
LRLASMAIC

SEQ ID NO: 84626 - protein, 9 aa, Dengue virus
RLASMAICS

SEQ ID NO: 84627 - protein, 9 aa, Dengue virus
LASMAICSA

SEQ ID NO: 84628 - protein, 9 aa, Dengue virus
ASMAICSAV

SEQ ID NO: 84629 - protein, 9 aa, Dengue virus
SMAICSAVP

SEQ ID NO: 84630 - protein, 9 aa, Dengue virus
MAICSAVPT

SEQ ID NO: 84631 - protein, 9 aa, Dengue virus
AICSAVPTE

SEQ ID NO: 84632 - protein, 9 aa, Dengue virus
ICSAVPTEW

SEQ ID NO: 84633 - protein, 9 aa, Dengue virus
CSAVPTEWF

SEQ ID NO: 84634 - protein, 9 aa, Dengue virus
SAVPTEWFP

SEQ ID NO: 84635 - protein, 9 aa, Dengue virus
AVPTEWFPT

SEQ ID NO: 84636 - protein, 9 aa, Dengue virus
VPTEWFPTS

SEQ ID NO: 84637 - protein, 9 aa, Dengue virus
PTEWFPTSR

SEQ ID NO: 84638 - protein, 9 aa, Dengue virus
TEWFPTSRT

SEQ ID NO: 84639 - protein, 9 aa, Dengue virus
EWFPTSRTT

SEQ ID NO: 84640 - protein, 9 aa, Dengue virus
WFPTSRTTW

SEQ ID NO: 84641 - protein, 9 aa, Dengue virus
FPTSRTTWS

SEQ ID NO: 84642 - protein, 9 aa, Dengue virus
PTSRTTWSI

SEQ ID NO: 84643 - protein, 9 aa, Dengue virus
TSRTTWSIH

SEQ ID NO: 84644 - protein, 9 aa, Dengue virus
SRTTWSIHA

SEQ ID NO: 84645 - protein, 9 aa, Dengue virus
RTTWSIHAH

SEQ ID NO: 84646 - protein, 9 aa, Dengue virus
TTWSIHAHH

SEQ ID NO: 84647 - protein, 9 aa, Dengue virus
TWSIHAHHQ

SEQ ID NO: 84648 - protein, 9 aa, Dengue virus
WSIHAHHQW

SEQ ID NO: 84649 - protein, 9 aa, Dengue virus
SIHAHHQWM

SEQ ID NO: 84650 - protein, 9 aa, Dengue virus
IHAHHQWMT

SEQ ID NO: 84651 - protein, 9 aa, Dengue virus
HAHHQWMTT

SEQ ID NO: 84652 - protein, 9 aa, Dengue virus
AHHQWMTTE

SEQ ID NO: 84653 - protein, 9 aa, Dengue virus
HHQWMTTED

SEQ ID NO: 84654 - protein, 9 aa, Dengue virus
HQWMTTEDM

SEQ ID NO: 84655 - protein, 9 aa, Dengue virus
QWMTTEDML

SEQ ID NO: 84656 - protein, 9 aa, Dengue virus
WMTTEDMLK

SEQ ID NO: 84657 - protein, 9 aa, Dengue virus
MTTEDMLKV

SEQ ID NO: 84658 - protein, 9 aa, Dengue virus
TTEDMLKVW

SEQ ID NO: 84659 - protein, 9 aa, Dengue virus
TEDMLKVWN

SEQ ID NO: 84660 - protein, 9 aa, Dengue virus
EDMLKVWNR

SEQ ID NO: 84661 - protein, 9 aa, Dengue virus
DMLKVWNRV

SEQ ID NO: 84662 - protein, 9 aa, Dengue virus
MLKVWNRVW

SEQ ID NO: 84663 - protein, 9 aa, Dengue virus
LKVWNRVWI

SEQ ID NO: 84664 - protein, 9 aa, Dengue virus
KVWNRVWIE

SEQ ID NO: 84665 - protein, 9 aa, Dengue virus
VWNRVWIED

SEQ ID NO: 84666 - protein, 9 aa, Dengue virus
WNRVWIEDN

SEQ ID NO: 84667 - protein, 9 aa, Dengue virus
NRVWIEDNP

SEQ ID NO: 84668 - protein, 9 aa, Dengue virus
RVWIEDNPN

SEQ ID NO: 84669 - protein, 9 aa, Dengue virus
VWIEDNPNM

SEQ ID NO: 84670 - protein, 9 aa, Dengue virus
WIEDNPNMI

SEQ ID NO: 84671 - protein, 9 aa, Dengue virus
IEDNPNMID

SEQ ID NO: 84672 - protein, 9 aa, Dengue virus
EDNPNMIDK

SEQ ID NO: 84673 - protein, 9 aa, Dengue virus
DNPNMIDKT

SEQ ID NO: 84674 - protein, 9 aa, Dengue virus
NPNMIDKTP

SEQ ID NO: 84675 - protein, 9 aa, Dengue virus
PNMIDKTPV

SEQ ID NO: 84676 - protein, 9 aa, Dengue virus
NMIDKTPVH

SEQ ID NO: 84677 - protein, 9 aa, Dengue virus
MIDKTPVHS

SEQ ID NO: 84678 - protein, 9 aa, Dengue virus
IDKTPVHSW

SEQ ID NO: 84679 - protein, 9 aa, Dengue virus
DKTPVHSWE

SEQ ID NO: 84680 - protein, 9 aa, Dengue virus
KTPVHSWED

SEQ ID NO: 84681 - protein, 9 aa, Dengue virus
TPVHSWEDI

SEQ ID NO: 84682 - protein, 9 aa, Dengue virus
PVHSWEDIP

SEQ ID NO: 84683 - protein, 9 aa, Dengue virus
VHSWEDIPY

SEQ ID NO: 84684 - protein, 9 aa, Dengue virus
HSWEDIPYL

SEQ ID NO: 84685 - protein, 9 aa, Dengue virus
SWEDIPYLG

SEQ ID NO: 84686 - protein, 9 aa, Dengue virus
WEDIPYLGK

SEQ ID NO: 84687 - protein, 9 aa, Dengue virus
EDIPYLGKR

SEQ ID NO: 84688 - protein, 9 aa, Dengue virus
DIPYLGKRE

SEQ ID NO: 84689 - protein, 9 aa, Dengue virus
IPYLGKRED

SEQ ID NO: 84690 - protein, 9 aa, Dengue virus
PYLGKREDL

SEQ ID NO: 84691 - protein, 9 aa, Dengue virus
YLGKREDLW

SEQ ID NO: 84692 - protein, 9 aa, Dengue virus
LGKREDLWC

SEQ ID NO: 84693 - protein, 9 aa, Dengue virus
GKREDLWCG

SEQ ID NO: 84694 - protein, 9 aa, Dengue virus
KREDLWCGS

SEQ ID NO: 84695 - protein, 9 aa, Dengue virus
REDLWCGSL

SEQ ID NO: 84696 - protein, 9 aa, Dengue virus
EDLWCGSLI

SEQ ID NO: 84697 - protein, 9 aa, Dengue virus
DLWCGSLIG

SEQ ID NO: 84698 - protein, 9 aa, Dengue virus
LWCGSLIGL

SEQ ID NO: 84699 - protein, 9 aa, Dengue virus
WCGSLIGLS

SEQ ID NO: 84700 - protein, 9 aa, Dengue virus
CGSLIGLSS

SEQ ID NO: 84701 - protein, 9 aa, Dengue virus
GSLIGLSSR

SEQ ID NO: 84702 - protein, 9 aa, Dengue virus
SLIGLSSRA

SEQ ID NO: 84703 - protein, 9 aa, Dengue virus
LIGLSSRAT

SEQ ID NO: 84704 - protein, 9 aa, Dengue virus
IGLSSRATW

SEQ ID NO: 84705 - protein, 9 aa, Dengue virus
GLSSRATWA

SEQ ID NO: 84706 - protein, 9 aa, Dengue virus
LSSRATWAK

SEQ ID NO: 84707 - protein, 9 aa, Dengue virus
SSRATWAKN

SEQ ID NO: 84708 - protein, 9 aa, Dengue virus
SRATWAKNI

SEQ ID NO: 84709 - protein, 9 aa, Dengue virus
RATWAKNIH

SEQ ID NO: 84710 - protein, 9 aa, Dengue virus
ATWAKNIHT

SEQ ID NO: 84711 - protein, 9 aa, Dengue virus
TWAKNIHTA

SEQ ID NO: 84712 - protein, 9 aa, Dengue virus
WAKNIHTAI

SEQ ID NO: 84713 - protein, 9 aa, Dengue virus
AKNIHTAIT

SEQ ID NO: 84714 - protein, 9 aa, Dengue virus
KNIHTAITQ

SEQ ID NO: 84715 - protein, 9 aa, Dengue virus
NIHTAITQV

SEQ ID NO: 84716 - protein, 9 aa, Dengue virus
IHTAITQVR

SEQ ID NO: 84717 - protein, 9 aa, Dengue virus
HTAITQVRN

SEQ ID NO: 84718 - protein, 9 aa, Dengue virus
TAITQVRNL

SEQ ID NO: 84719 - protein, 9 aa, Dengue virus
AITQVRNLI

SEQ ID NO: 84720 - protein, 9 aa, Dengue virus
ITQVRNLIG

SEQ ID NO: 84721 - protein, 9 aa, Dengue virus
TQVRNLIGK

SEQ ID NO: 84722 - protein, 9 aa, Dengue virus
QVRNLIGKE

SEQ ID NO: 84723 - protein, 9 aa, Dengue virus
VRNLIGKEE

SEQ ID NO: 84724 - protein, 9 aa, Dengue virus
RNLIGKEEY

SEQ ID NO: 84725 - protein, 9 aa, Dengue virus
NLIGKEEYV

SEQ ID NO: 84726 - protein, 9 aa, Dengue virus
LIGKEEYVD

SEQ ID NO: 84727 - protein, 9 aa, Dengue virus
IGKEEYVDY

SEQ ID NO: 84728 - protein, 9 aa, Dengue virus
GKEEYVDYM

SEQ ID NO: 84729 - protein, 9 aa, Dengue virus
KEEYVDYMP

SEQ ID NO: 84730 - protein, 9 aa, Dengue virus
EEYVDYMPV

SEQ ID NO: 84731 - protein, 9 aa, Dengue virus
EYVDYMPVM

SEQ ID NO: 84732 - protein, 9 aa, Dengue virus
YVDYMPVMK

SEQ ID NO: 84733 - protein, 9 aa, Dengue virus
VDYMPVMKR

SEQ ID NO: 84734 - protein, 9 aa, Dengue virus
DYMPVMKRY

SEQ ID NO: 84735 - protein, 9 aa, Dengue virus
YMPVMKRYS

SEQ ID NO: 84736 - protein, 9 aa, Dengue virus
MPVMKRYSA

SEQ ID NO: 84737 - protein, 9 aa, Dengue virus
PVMKRYSAP

SEQ ID NO: 84738 - protein, 9 aa, Dengue virus
MKRYSAPSE

SEQ ID NO: 84739 - protein, 9 aa, Dengue virus
RYSAPSESE

SEQ ID NO: 84740 - protein, 9 aa, Dengue virus
YSAPSESEG

SEQ ID NO: 84741 - protein, 9 aa, Dengue virus
SAPSESEGV

SEQ ID NO: 84742 - protein, 9 aa, Dengue virus
APSESEGVL

SEQ ID NO: 84743 - protein, 9 aa, Dengue virus
MNQRKKVAR

SEQ ID NO: 84744 - protein, 9 aa, Dengue virus
NQRKKVARP

SEQ ID NO: 84745 - protein, 9 aa, Dengue virus
QRKKVARPP

SEQ ID NO: 84746 - protein, 9 aa, Dengue virus
RKKVARPPF

SEQ ID NO: 84747 - protein, 9 aa, Dengue virus
KKVARPPFN

SEQ ID NO: 84748 - protein, 9 aa, Dengue virus
KVARPPFNM

SEQ ID NO: 84749 - protein, 9 aa, Dengue virus
VARPPFNML

SEQ ID NO: 84750 - protein, 9 aa, Dengue virus
ARPPFNMLK

SEQ ID NO: 84751 - protein, 9 aa, Dengue virus
NTPFNMLKR

SEQ ID NO: 84752 - protein, 9 aa, Dengue virus
TPFNMLKRE

SEQ ID NO: 84753 - protein, 9 aa, Dengue virus
RERNRVSTV

SEQ ID NO: 84754 - protein, 9 aa, Dengue virus
ERNRVSTVQ

SEQ ID NO: 84755 - protein, 9 aa, Dengue virus
RNRVSTVQQ

SEQ ID NO: 84756 - protein, 9 aa, Dengue virus
NRVSTVQQL

SEQ ID NO: 84757 - protein, 9 aa, Dengue virus
RVSTVQQLT

SEQ ID NO: 84758 - protein, 9 aa, Dengue virus
VSTVQQLTK

SEQ ID NO: 84759 - protein, 9 aa, Dengue virus
STVQQLTKR

SEQ ID NO: 84760 - protein, 9 aa, Dengue virus
TVQQLTKRF

SEQ ID NO: 84761 - protein, 9 aa, Dengue virus
VQQLTKRFS

SEQ ID NO: 84762 - protein, 9 aa, Dengue virus
QGLVKRFSS

SEQ ID NO: 84763 - protein, 9 aa, Dengue virus
GLVKRFSSG

SEQ ID NO: 84764 - protein, 9 aa, Dengue virus
LVKRFSSGL

SEQ ID NO: 84765 - protein, 9 aa, Dengue virus
VKRFSSGLF

SEQ ID NO: 84766 - protein, 9 aa, Dengue virus
KRFSSGLFS

SEQ ID NO: 84767 - protein, 9 aa, Dengue virus
RFSSGLFSG

SEQ ID NO: 84768 - protein, 9 aa, Dengue virus
FSSGLFSGK

SEQ ID NO: 84769 - protein, 9 aa, Dengue virus
SSGLFSGKG

SEQ ID NO: 84770 - protein, 9 aa, Dengue virus
SGLFSGKGP

SEQ ID NO: 84771 - protein, 9 aa, Dengue virus
GMLQGRGPL

SEQ ID NO: 84772 - protein, 9 aa, Dengue virus
MLQGRGPLK

SEQ ID NO: 84773 - protein, 9 aa, Dengue virus
LQGRGPLKL

SEQ ID NO: 84774 - protein, 9 aa, Dengue virus
QGRGPLKLF

SEQ ID NO: 84775 - protein, 9 aa, Dengue virus
GRGPLKLFM

SEQ ID NO: 84776 - protein, 9 aa, Dengue virus
RGPLKLFMA

SEQ ID NO: 84777 - protein, 9 aa, Dengue virus
GPLKLFMAL

SEQ ID NO: 84778 - protein, 9 aa, Dengue virus
PLKLFMALV

SEQ ID NO: 84779 - protein, 9 aa, Dengue virus
LKLFMALVA

SEQ ID NO: 84780 - protein, 9 aa, Dengue virus
KLFMALVAF

SEQ ID NO: 84781 - protein, 9 aa, Dengue virus
LFMALVAFL

SEQ ID NO: 84782 - protein, 9 aa, Dengue virus
FMALVAFLR

SEQ ID NO: 84783 - protein, 9 aa, Dengue virus
MALVAFLRF

SEQ ID NO: 84784 - protein, 9 aa, Dengue virus
ALVAFLRFL

SEQ ID NO: 84785 - protein, 9 aa, Dengue virus
LVAFLRFLT

SEQ ID NO: 84786 - protein, 9 aa, Dengue virus
VAFLRFLTI

SEQ ID NO: 84787 - protein, 9 aa, Dengue virus
AFLRFLTIP

SEQ ID NO: 84788 - protein, 9 aa, Dengue virus
FLRFLTIPP

SEQ ID NO: 84789 - protein, 9 aa, Dengue virus
LRFLTIPPT

SEQ ID NO: 84790 - protein, 9 aa, Dengue virus
RFLTIPPTA

SEQ ID NO: 84791 - protein, 9 aa, Dengue virus
FLTIPPTAG

SEQ ID NO: 84792 - protein, 9 aa, Dengue virus
LTIPPTAGI

SEQ ID NO: 84793 - protein, 9 aa, Dengue virus
TIPPTAGIL

SEQ ID NO: 84794 - protein, 9 aa, Dengue virus
AGILKRWGT

SEQ ID NO: 84795 - protein, 9 aa, Dengue virus
GILKRWGTI

SEQ ID NO: 84796 - protein, 9 aa, Dengue virus
ILKRWGTIK

SEQ ID NO: 84797 - protein, 9 aa, Dengue virus
LKRWGTIKK

SEQ ID NO: 84798 - protein, 9 aa, Dengue virus
KRWGQLKKT

SEQ ID NO: 84799 - protein, 9 aa, Dengue virus
RWGQLKKTK

SEQ ID NO: 84800 - protein, 9 aa, Dengue virus
WGTIKKSKA

SEQ ID NO: 84801 - protein, 9 aa, Dengue virus
GTIKKSKAI

SEQ ID NO: 84802 - protein, 9 aa, Dengue virus
QLKKNKAIR

SEQ ID NO: 84803 - protein, 9 aa, Dengue virus
LKKNKAIRI

SEQ ID NO: 84804 - protein, 9 aa, Dengue virus
KKNKAIRIL

SEQ ID NO: 84805 - protein, 9 aa, Dengue virus
KNKAIKILT

SEQ ID NO: 84806 - protein, 9 aa, Dengue virus
NKAIKILTG

SEQ ID NO: 84807 - protein, 9 aa, Dengue virus
KAIKILTGF

SEQ ID NO: 84808 - protein, 9 aa, Dengue virus
AIKILTGFR

SEQ ID NO: 84809 - protein, 9 aa, Dengue virus
IKILTGFRK

SEQ ID NO: 84810 - protein, 9 aa, Dengue virus
KILTGFRKE

SEQ ID NO: 84811 - protein, 9 aa, Dengue virus
ILTGFRKEI

SEQ ID NO: 84812 - protein, 9 aa, Dengue virus
LTGFRKEIG

SEQ ID NO: 84813 - protein, 9 aa, Dengue virus
TGFRKEIGR

SEQ ID NO: 84814 - protein, 9 aa, Dengue virus
GRMLNILNR

SEQ ID NO: 84815 - protein, 9 aa, Dengue virus
RMLNILNRR

SEQ ID NO: 84816 - protein, 9 aa, Dengue virus
MLNILNRRR

SEQ ID NO: 84817 - protein, 9 aa, Dengue virus
LNILNRRRR

SEQ ID NO: 84818 - protein, 9 aa, Dengue virus
NILNRRRRS

SEQ ID NO: 84819 - protein, 9 aa, Dengue virus
ILNRRRRST

SEQ ID NO: 84820 - protein, 9 aa, Dengue virus
RKRSTMTLL

SEQ ID NO: 84821 - protein, 9 aa, Dengue virus
KRSTMTLLC

SEQ ID NO: 84822 - protein, 9 aa, Dengue virus
RSTMTLLCL

SEQ ID NO: 84823 - protein, 9 aa, Dengue virus
STMTLLCLI

SEQ ID NO: 84824 - protein, 9 aa, Dengue virus
TMTLLCLIP

SEQ ID NO: 84825 - protein, 9 aa, Dengue virus
MTLLCLIPT

SEQ ID NO: 84826 - protein, 9 aa, Dengue virus
TLLCLIPTA

SEQ ID NO: 84827 - protein, 9 aa, Dengue virus
LLCLIPTAM

SEQ ID NO: 84828 - protein, 9 aa, Dengue virus
LCLIPTAMA

SEQ ID NO: 84829 - protein, 9 aa, Dengue virus
CLIPTAMAF

SEQ ID NO: 84830 - protein, 9 aa, Dengue virus
LIPTAMAFH

SEQ ID NO: 84831 - protein, 9 aa, Dengue virus
IPTAMAFHL

SEQ ID NO: 84832 - protein, 9 aa, Dengue virus
PTAMAFHLS

SEQ ID NO: 84833 - protein, 9 aa, Dengue virus
TAMAFHLST

SEQ ID NO: 84834 - protein, 9 aa, Dengue virus
AMAFHLSTR

SEQ ID NO: 84835 - protein, 9 aa, Dengue virus
MAFSLSTRD

SEQ ID NO: 84836 - protein, 9 aa, Dengue virus
AFSLSTRDG

SEQ ID NO: 84837 - protein, 9 aa, Dengue virus
FSLSTRDGE

SEQ ID NO: 84838 - protein, 9 aa, Dengue virus
SLSTRDGEP

SEQ ID NO: 84839 - protein, 9 aa, Dengue virus
LTTRNGEPH

SEQ ID NO: 84840 - protein, 9 aa, Dengue virus
TTRNGEPHM

SEQ ID NO: 84841 - protein, 9 aa, Dengue virus
TRNGEPHMI

SEQ ID NO: 84842 - protein, 9 aa, Dengue virus
RNGEPHMIV

SEQ ID NO: 84843 - protein, 9 aa, Dengue virus
NGEPHMIVS

SEQ ID NO: 84844 - protein, 9 aa, Dengue virus
GEPHMIVSR

SEQ ID NO: 84845 - protein, 9 aa, Dengue virus
EPHMIVSRQ

SEQ ID NO: 84846 - protein, 9 aa, Dengue virus
PHMIVSRQE

SEQ ID NO: 84847 - protein, 9 aa, Dengue virus
HMIVSRQEK

SEQ ID NO: 84848 - protein, 9 aa, Dengue virus
MIVSRQEKG

SEQ ID NO: 84849 - protein, 9 aa, Dengue virus
IVSRQEKGK

SEQ ID NO: 84850 - protein, 9 aa, Dengue virus
VSRQEKGKS

SEQ ID NO: 84851 - protein, 9 aa, Dengue virus
SRQEKGKSL

SEQ ID NO: 84852 - protein, 9 aa, Dengue virus
RQEKGKSLL

SEQ ID NO: 84853 - protein, 9 aa, Dengue virus
QEKGKSLLF

SEQ ID NO: 84854 - protein, 9 aa, Dengue virus
EKGKSLLFK

SEQ ID NO: 84855 - protein, 9 aa, Dengue virus
KGKSLLFKT

SEQ ID NO: 84856 - protein, 9 aa, Dengue virus
GKSLLFKTE

SEQ ID NO: 84857 - protein, 9 aa, Dengue virus
KSLLFKTED

SEQ ID NO: 84858 - protein, 9 aa, Dengue virus
SLLFKTEDG

SEQ ID NO: 84859 - protein, 9 aa, Dengue virus
LLFKTEDGV

SEQ ID NO: 84860 - protein, 9 aa, Dengue virus
LFKTEDGVN

SEQ ID NO: 84861 - protein, 9 aa, Dengue virus
FKTEDGVNM

SEQ ID NO: 84862 - protein, 9 aa, Dengue virus
KTEDGVNMC

SEQ ID NO: 84863 - protein, 9 aa, Dengue virus
TEDGVNMCT

SEQ ID NO: 84864 - protein, 9 aa, Dengue virus
EDGVNMCTL

SEQ ID NO: 84865 - protein, 9 aa, Dengue virus
DGVNMCTLM

SEQ ID NO: 84866 - protein, 9 aa, Dengue virus
GVNMCTLMA

SEQ ID NO: 84867 - protein, 9 aa, Dengue virus
VNMCTLMAM

SEQ ID NO: 84868 - protein, 9 aa, Dengue virus
NMCTLMAMD

SEQ ID NO: 84869 - protein, 9 aa, Dengue virus
MCTLMAMDL

SEQ ID NO: 84870 - protein, 9 aa, Dengue virus
CTLMAMDLG

SEQ ID NO: 84871 - protein, 9 aa, Dengue virus
TLMAMDLGE

SEQ ID NO: 84872 - protein, 9 aa, Dengue virus
LMAMDLGEL

SEQ ID NO: 84873 - protein, 9 aa, Dengue virus
MAMDLGELC

SEQ ID NO: 84874 - protein, 9 aa, Dengue virus
AMDLGELCE

SEQ ID NO: 84875 - protein, 9 aa, Dengue virus
MDLGELCED

SEQ ID NO: 84876 - protein, 9 aa, Dengue virus
DLGELCEDT

SEQ ID NO: 84877 - protein, 9 aa, Dengue virus
LGELCEDTI

SEQ ID NO: 84878 - protein, 9 aa, Dengue virus
GELCEDTIT

SEQ ID NO: 84879 - protein, 9 aa, Dengue virus
ELCEDTITY

SEQ ID NO: 84880 - protein, 9 aa, Dengue virus
LCEDTITYK

SEQ ID NO: 84881 - protein, 9 aa, Dengue virus
CEDTVTYEC

SEQ ID NO: 84882 - protein, 9 aa, Dengue virus
EDTVTYECP

SEQ ID NO: 84883 - protein, 9 aa, Dengue virus
DTITYKCPL

SEQ ID NO: 84884 - protein, 9 aa, Dengue virus
TITYKCPLL

SEQ ID NO: 84885 - protein, 9 aa, Dengue virus
VTYKCPLLI

SEQ ID NO: 84886 - protein, 9 aa, Dengue virus
TYKCPLLIN

SEQ ID NO: 84887 - protein, 9 aa, Dengue virus
YKCPLLINT

SEQ ID NO: 84888 - protein, 9 aa, Dengue virus
KCPLLINTE

SEQ ID NO: 84889 - protein, 9 aa, Dengue virus
CPLLINTEP

SEQ ID NO: 84890 - protein, 9 aa, Dengue virus
PLLINTEPE

SEQ ID NO: 84891 - protein, 9 aa, Dengue virus
LLINTEPED

SEQ ID NO: 84892 - protein, 9 aa, Dengue virus
LINTEPEDI

SEQ ID NO: 84893 - protein, 9 aa, Dengue virus
INTEPEDID

SEQ ID NO: 84894 - protein, 9 aa, Dengue virus
QNEPEDIDC

SEQ ID NO: 84895 - protein, 9 aa, Dengue virus
NEPEDIDCW

SEQ ID NO: 84896 - protein, 9 aa, Dengue virus
EDIDCWCNS

SEQ ID NO: 84897 - protein, 9 aa, Dengue virus
DIDCWCNST

SEQ ID NO: 84898 - protein, 9 aa, Dengue virus
IDCWCNSTS

SEQ ID NO: 84899 - protein, 9 aa, Dengue virus
DCWCNLTSA

SEQ ID NO: 84900 - protein, 9 aa, Dengue virus
CWCNLTSAW

SEQ ID NO: 84901 - protein, 9 aa, Dengue virus
WCNLTSAWV

SEQ ID NO: 84902 - protein, 9 aa, Dengue virus
CNLTSAWVM

SEQ ID NO: 84903 - protein, 9 aa, Dengue virus
NLTSAWVMY

SEQ ID NO: 84904 - protein, 9 aa, Dengue virus
LTSAWVMYG

SEQ ID NO: 84905 - protein, 9 aa, Dengue virus
TSAWVMYGT

SEQ ID NO: 84906 - protein, 9 aa, Dengue virus
SAWVMYGTC

SEQ ID NO: 84907 - protein, 9 aa, Dengue virus
AWVMYGTCT

SEQ ID NO: 84908 - protein, 9 aa, Dengue virus
WVTYGTCTT

SEQ ID NO: 84909 - protein, 9 aa, Dengue virus
VMYGTCTQN

SEQ ID NO: 84910 - protein, 9 aa, Dengue virus
MYGTCTQNG

SEQ ID NO: 84911 - protein, 9 aa, Dengue virus
YGTCTQNGE

SEQ ID NO: 84912 - protein, 9 aa, Dengue virus
GTCTQNGER

SEQ ID NO: 84913 - protein, 9 aa, Dengue virus
TCTQNGERR

SEQ ID NO: 84914 - protein, 9 aa, Dengue virus
CTQNGERRR

SEQ ID NO: 84915 - protein, 9 aa, Dengue virus
TQNGERRRE

SEQ ID NO: 84916 - protein, 9 aa, Dengue virus
QNGERRREK

SEQ ID NO: 84917 - protein, 9 aa, Dengue virus
NGERRREKR

SEQ ID NO: 84918 - protein, 9 aa, Dengue virus
GEHRREKRS

SEQ ID NO: 84919 - protein, 9 aa, Dengue virus
EHRREKRSV

SEQ ID NO: 84920 - protein, 9 aa, Dengue virus
HRREKRSVA

SEQ ID NO: 84921 - protein, 9 aa, Dengue virus
REKRSVALV

SEQ ID NO: 84922 - protein, 9 aa, Dengue virus
EKRSVALVP

SEQ ID NO: 84923 - protein, 9 aa, Dengue virus
KRSVALVPH

SEQ ID NO: 84924 - protein, 9 aa, Dengue virus
RSVALVPHV

SEQ ID NO: 84925 - protein, 9 aa, Dengue virus
SVALVPHVG

SEQ ID NO: 84926 - protein, 9 aa, Dengue virus
VALVPHVGM

SEQ ID NO: 84927 - protein, 9 aa, Dengue virus
ALVPHVGMG

SEQ ID NO: 84928 - protein, 9 aa, Dengue virus
LVPHVGMGL

SEQ ID NO: 84929 - protein, 9 aa, Dengue virus
VPHVGMGLE

SEQ ID NO: 84930 - protein, 9 aa, Dengue virus
PHVGMGLET

SEQ ID NO: 84931 - protein, 9 aa, Dengue virus
HVGMGLETR

SEQ ID NO: 84932 - protein, 9 aa, Dengue virus
VGMGLETRT

SEQ ID NO: 84933 - protein, 9 aa, Dengue virus
GMGLETRTE

SEQ ID NO: 84934 - protein, 9 aa, Dengue virus
MGLETRTET

SEQ ID NO: 84935 - protein, 9 aa, Dengue virus
GLETRTETW

SEQ ID NO: 84936 - protein, 9 aa, Dengue virus
LETRTETWM

SEQ ID NO: 84937 - protein, 9 aa, Dengue virus
ETRTETWMS

SEQ ID NO: 84938 - protein, 9 aa, Dengue virus
TRTETWMSS

SEQ ID NO: 84939 - protein, 9 aa, Dengue virus
RTETWMSSE

SEQ ID NO: 84940 - protein, 9 aa, Dengue virus
TETWMSSEG

SEQ ID NO: 84941 - protein, 9 aa, Dengue virus
GAWKHAQRI

SEQ ID NO: 84942 - protein, 9 aa, Dengue virus
AWKHAQRIE

SEQ ID NO: 84943 - protein, 9 aa, Dengue virus
WKHAQRIET

SEQ ID NO: 84944 - protein, 9 aa, Dengue virus
KHAQRIETW

SEQ ID NO: 84945 - protein, 9 aa, Dengue virus
HAQRIETWI

SEQ ID NO: 84946 - protein, 9 aa, Dengue virus
AQRIETWIL

SEQ ID NO: 84947 - protein, 9 aa, Dengue virus
QRIETWILR

SEQ ID NO: 84948 - protein, 9 aa, Dengue virus
RIETWILRH

SEQ ID NO: 84949 - protein, 9 aa, Dengue virus
IETWILRHP

SEQ ID NO: 84950 - protein, 9 aa, Dengue virus
ETWILRHPG

SEQ ID NO: 84951 - protein, 9 aa, Dengue virus
TWILRHPGF

SEQ ID NO: 84952 - protein, 9 aa, Dengue virus
WILRHPGFT

SEQ ID NO: 84953 - protein, 9 aa, Dengue virus
ILRHPGFTI

SEQ ID NO: 84954 - protein, 9 aa, Dengue virus
LRHPGFTIM

SEQ ID NO: 84955 - protein, 9 aa, Dengue virus
RHPGFTIMA

SEQ ID NO: 84956 - protein, 9 aa, Dengue virus
HPGFTIMAA

SEQ ID NO: 84957 - protein, 9 aa, Dengue virus
PGFTIMAAI

SEQ ID NO: 84958 - protein, 9 aa, Dengue virus
GFTIMAAIL

SEQ ID NO: 84959 - protein, 9 aa, Dengue virus
FTIMAAILA

SEQ ID NO: 84960 - protein, 9 aa, Dengue virus
TIMAAILAY

SEQ ID NO: 84961 - protein, 9 aa, Dengue virus
IMAAILAYT

SEQ ID NO: 84962 - protein, 9 aa, Dengue virus
MAAILAYTI

SEQ ID NO: 84963 - protein, 9 aa, Dengue virus
AGFMAYMVG

SEQ ID NO: 84964 - protein, 9 aa, Dengue virus
GFMAYMVGQ

SEQ ID NO: 84965 - protein, 9 aa, Dengue virus
ILAYTIGTT

SEQ ID NO: 84966 - protein, 9 aa, Dengue virus
MAYMVGQTG

SEQ ID NO: 84967 - protein, 9 aa, Dengue virus
AYTIGTTHF

SEQ ID NO: 84968 - protein, 9 aa, Dengue virus
YTIGTTHFQ

SEQ ID NO: 84969 - protein, 9 aa, Dengue virus
TIGTTHFQR

SEQ ID NO: 84970 - protein, 9 aa, Dengue virus
VGQTGIQRT

SEQ ID NO: 84971 - protein, 9 aa, Dengue virus
GTTHFQRAL

SEQ ID NO: 84972 - protein, 9 aa, Dengue virus
TTHFQRALI

SEQ ID NO: 84973 - protein, 9 aa, Dengue virus
THFQRALIF

SEQ ID NO: 84974 - protein, 9 aa, Dengue virus
GIQRTVFFI

SEQ ID NO: 84975 - protein, 9 aa, Dengue virus
IQRTVFFIL

SEQ ID NO: 84976 - protein, 9 aa, Dengue virus
QRTVFFILM

SEQ ID NO: 84977 - protein, 9 aa, Dengue virus
RTVFFILMM

SEQ ID NO: 84978 - protein, 9 aa, Dengue virus
TVFFILMML

SEQ ID NO: 84979 - protein, 9 aa, Dengue virus
VFFILMMLV

SEQ ID NO: 84980 - protein, 9 aa, Dengue virus
FFILMMLVA

SEQ ID NO: 84981 - protein, 9 aa, Dengue virus
FILMMLVAP

SEQ ID NO: 84982 - protein, 9 aa, Dengue virus
ILMMLVAPS

SEQ ID NO: 84983 - protein, 9 aa, Dengue virus
LLTAVAPSM

SEQ ID NO: 84984 - protein, 9 aa, Dengue virus
LTAVAPSMT

SEQ ID NO: 84985 - protein, 9 aa, Dengue virus
TAVAPSMTM

SEQ ID NO: 84986 - protein, 9 aa, Dengue virus
AVAPSMTMR

SEQ ID NO: 84987 - protein, 9 aa, Dengue virus
VAPSMTMRC

SEQ ID NO: 84988 - protein, 9 aa, Dengue virus
APSMTMRCI

SEQ ID NO: 84989 - protein, 9 aa, Dengue virus
PSMTMRCIG

SEQ ID NO: 84990 - protein, 9 aa, Dengue virus
SYGMRCIGV

SEQ ID NO: 84991 - protein, 9 aa, Dengue virus
YGMRCIGVG

SEQ ID NO: 84992 - protein, 9 aa, Dengue virus
GMRCIGVGN

SEQ ID NO: 84993 - protein, 9 aa, Dengue virus
MRCIGISNR

SEQ ID NO: 84994 - protein, 9 aa, Dengue virus
RCIGISNRD

SEQ ID NO: 84995 - protein, 9 aa, Dengue virus
CIGVGNRDF

SEQ ID NO: 84996 - protein, 9 aa, Dengue virus
IGISNRDFV

SEQ ID NO: 84997 - protein, 9 aa, Dengue virus
GISNRDFVE

SEQ ID NO: 84998 - protein, 9 aa, Dengue virus
ISNRDFVEG

SEQ ID NO: 84999 - protein, 9 aa, Dengue virus
SNRDFVEGV

SEQ ID NO: 85000 - protein, 9 aa, Dengue virus
FVEGVSGGS

SEQ ID NO: 85001 - protein, 9 aa, Dengue virus
VEGVSGGSW

SEQ ID NO: 85002 - protein, 9 aa, Dengue virus
EGVSGGSWV

SEQ ID NO: 85003 - protein, 9 aa, Dengue virus
GVSGGSWVD

SEQ ID NO: 85004 - protein, 9 aa, Dengue virus
VSGGSWVDI

SEQ ID NO: 85005 - protein, 9 aa, Dengue virus
SGGSWVDIV

SEQ ID NO: 85006 - protein, 9 aa, Dengue virus
GGSWVDIVL

SEQ ID NO: 85007 - protein, 9 aa, Dengue virus
GSWVDIVLE

SEQ ID NO: 85008 - protein, 9 aa, Dengue virus
SWVDIVLEH

SEQ ID NO: 85009 - protein, 9 aa, Dengue virus
WVDIVLEHG

SEQ ID NO: 85010 - protein, 9 aa, Dengue virus
VDIVLEHGS

SEQ ID NO: 85011 - protein, 9 aa, Dengue virus
DIVLEHGSC

SEQ ID NO: 85012 - protein, 9 aa, Dengue virus
IVLEHGSCV

SEQ ID NO: 85013 - protein, 9 aa, Dengue virus
VLEHGSCVT

SEQ ID NO: 85014 - protein, 9 aa, Dengue virus
LEHGSCVTT

SEQ ID NO: 85015 - protein, 9 aa, Dengue virus
EHGSCVTTM

SEQ ID NO: 85016 - protein, 9 aa, Dengue virus
HGSCVTTMA

SEQ ID NO: 85017 - protein, 9 aa, Dengue virus
GSCVTTMAK

SEQ ID NO: 85018 - protein, 9 aa, Dengue virus
SCVTTMAKN

SEQ ID NO: 85019 - protein, 9 aa, Dengue virus
CVTTMAKNK

SEQ ID NO: 85020 - protein, 9 aa, Dengue virus
VTTMAKNKP

SEQ ID NO: 85021 - protein, 9 aa, Dengue virus
TTMAKNKPT

SEQ ID NO: 85022 - protein, 9 aa, Dengue virus
TMAKNKPTL

SEQ ID NO: 85023 - protein, 9 aa, Dengue virus
MAKNKPTLD

SEQ ID NO: 85024 - protein, 9 aa, Dengue virus
AKNKPTLDF

SEQ ID NO: 85025 - protein, 9 aa, Dengue virus
KNKPTLDFE

SEQ ID NO: 85026 - protein, 9 aa, Dengue virus
NKPTLDFEL

SEQ ID NO: 85027 - protein, 9 aa, Dengue virus
KPTLDFELI

SEQ ID NO: 85028 - protein, 9 aa, Dengue virus
PTLDFELIK

SEQ ID NO: 85029 - protein, 9 aa, Dengue virus
TLDFELIKT

SEQ ID NO: 85030 - protein, 9 aa, Dengue virus
LDFELIKTT

SEQ ID NO: 85031 - protein, 9 aa, Dengue virus
DFELIKTTA

SEQ ID NO: 85032 - protein, 9 aa, Dengue virus
FELIKTTAK

SEQ ID NO: 85033 - protein, 9 aa, Dengue virus
ELIKTTAKE

SEQ ID NO: 85034 - protein, 9 aa, Dengue virus
LIKTTAKEV

SEQ ID NO: 85035 - protein, 9 aa, Dengue virus
IKTTAKEVA

SEQ ID NO: 85036 - protein, 9 aa, Dengue virus
KTEAKQPAT

SEQ ID NO: 85037 - protein, 9 aa, Dengue virus
TEAKQPATL

SEQ ID NO: 85038 - protein, 9 aa, Dengue virus
EAKQPATLR

SEQ ID NO: 85039 - protein, 9 aa, Dengue virus
AKQPATLRK

SEQ ID NO: 85040 - protein, 9 aa, Dengue virus
KQPATLRKY

SEQ ID NO: 85041 - protein, 9 aa, Dengue virus
QPATLRKYC

SEQ ID NO: 85042 - protein, 9 aa, Dengue virus
PATLRKYCI

SEQ ID NO: 85043 - protein, 9 aa, Dengue virus
ATLRKYCIE

SEQ ID NO: 85044 - protein, 9 aa, Dengue virus
TLRKYCIEA

SEQ ID NO: 85045 - protein, 9 aa, Dengue virus
LRTYCIEAL

SEQ ID NO: 85046 - protein, 9 aa, Dengue virus
RTYCIEALI

SEQ ID NO: 85047 - protein, 9 aa, Dengue virus
TYCIEALIS

SEQ ID NO: 85048 - protein, 9 aa, Dengue virus
YCIEALISN

SEQ ID NO: 85049 - protein, 9 aa, Dengue virus
CIEALISNI

SEQ ID NO: 85050 - protein, 9 aa, Dengue virus
IEALISNIT

SEQ ID NO: 85051 - protein, 9 aa, Dengue virus
EALISNITT

SEQ ID NO: 85052 - protein, 9 aa, Dengue virus
ALISNITTA

SEQ ID NO: 85053 - protein, 9 aa, Dengue virus
LISNITTAT

SEQ ID NO: 85054 - protein, 9 aa, Dengue virus
LTNTTTESR

SEQ ID NO: 85055 - protein, 9 aa, Dengue virus
TNTTTESRC

SEQ ID NO: 85056 - protein, 9 aa, Dengue virus
NTTTESRCP

SEQ ID NO: 85057 - protein, 9 aa, Dengue virus
TTTESRCPT

SEQ ID NO: 85058 - protein, 9 aa, Dengue virus
TTESRCPTQ

SEQ ID NO: 85059 - protein, 9 aa, Dengue virus
TESRCPTQG

SEQ ID NO: 85060 - protein, 9 aa, Dengue virus
ESRCPTQGE

SEQ ID NO: 85061 - protein, 9 aa, Dengue virus
SRCPTQGEP

SEQ ID NO: 85062 - protein, 9 aa, Dengue virus
RCPTQGEPS

SEQ ID NO: 85063 - protein, 9 aa, Dengue virus
CPTQGEPSL

SEQ ID NO: 85064 - protein, 9 aa, Dengue virus
PTQGEPSLN

SEQ ID NO: 85065 - protein, 9 aa, Dengue virus
TQGEPSLNE

SEQ ID NO: 85066 - protein, 9 aa, Dengue virus
QGEPSLNEE

SEQ ID NO: 85067 - protein, 9 aa, Dengue virus
GEPSLNEEQ

SEQ ID NO: 85068 - protein, 9 aa, Dengue virus
EPSLNEEQD

SEQ ID NO: 85069 - protein, 9 aa, Dengue virus
PSLNEEQDK

SEQ ID NO: 85070 - protein, 9 aa, Dengue virus
SLNEEQDKR

SEQ ID NO: 85071 - protein, 9 aa, Dengue virus
LNEEQDKRF

SEQ ID NO: 85072 - protein, 9 aa, Dengue virus
NEEQDKRFV

SEQ ID NO: 85073 - protein, 9 aa, Dengue virus
EEQDKRFVC

SEQ ID NO: 85074 - protein, 9 aa, Dengue virus
EQDKRFVCK

SEQ ID NO: 85075 - protein, 9 aa, Dengue virus
QDKRFVCKH

SEQ ID NO: 85076 - protein, 9 aa, Dengue virus
DKRFVCKHS

SEQ ID NO: 85077 - protein, 9 aa, Dengue virus
KRFVCKHSM

SEQ ID NO: 85078 - protein, 9 aa, Dengue virus
QYICRRDMV

SEQ ID NO: 85079 - protein, 9 aa, Dengue virus
FVCKHSMVD

SEQ ID NO: 85080 - protein, 9 aa, Dengue virus
ICRRDMVDR

SEQ ID NO: 85081 - protein, 9 aa, Dengue virus
CRRDMVDRG

SEQ ID NO: 85082 - protein, 9 aa, Dengue virus
KHSMVDRGW

SEQ ID NO: 85083 - protein, 9 aa, Dengue virus
HSMVDRGWG

SEQ ID NO: 85084 - protein, 9 aa, Dengue virus
SMVDRGWGN

SEQ ID NO: 85085 - protein, 9 aa, Dengue virus
MVDRGWGNG

SEQ ID NO: 85086 - protein, 9 aa, Dengue virus
CGLFGKGGI

SEQ ID NO: 85087 - protein, 9 aa, Dengue virus
GLFGKGGIV

SEQ ID NO: 85088 - protein, 9 aa, Dengue virus
LFGKGGIVT

SEQ ID NO: 85089 - protein, 9 aa, Dengue virus
FGKGGIVTC

SEQ ID NO: 85090 - protein, 9 aa, Dengue virus
GKGGIVTCA

SEQ ID NO: 85091 - protein, 9 aa, Dengue virus
KGGIVTCAM

SEQ ID NO: 85092 - protein, 9 aa, Dengue virus
GGIVTCAMF

SEQ ID NO: 85093 - protein, 9 aa, Dengue virus
GVVTCAKFL

SEQ ID NO: 85094 - protein, 9 aa, Dengue virus
VVTCAKFLC

SEQ ID NO: 85095 - protein, 9 aa, Dengue virus
VTCAKFLCS

SEQ ID NO: 85096 - protein, 9 aa, Dengue virus
TCAKFLCSG

SEQ ID NO: 85097 - protein, 9 aa, Dengue virus
CAKFLCSGK

SEQ ID NO: 85098 - protein, 9 aa, Dengue virus
AKFLCSGKI

SEQ ID NO: 85099 - protein, 9 aa, Dengue virus
KFLCSGKIT

SEQ ID NO: 85100 - protein, 9 aa, Dengue virus
FLCSGKITG

SEQ ID NO: 85101 - protein, 9 aa, Dengue virus
LCSGKITGN

SEQ ID NO: 85102 - protein, 9 aa, Dengue virus
CKKNMEGKV

SEQ ID NO: 85103 - protein, 9 aa, Dengue virus
KKNMEGKVV

SEQ ID NO: 85104 - protein, 9 aa, Dengue virus
KNMEGKVVQ

SEQ ID NO: 85105 - protein, 9 aa, Dengue virus
NMEGKVVQP

SEQ ID NO: 85106 - protein, 9 aa, Dengue virus
MEGKVVQPE

SEQ ID NO: 85107 - protein, 9 aa, Dengue virus
EGKVVQPEN

SEQ ID NO: 85108 - protein, 9 aa, Dengue virus
GKVVQPENL

SEQ ID NO: 85109 - protein, 9 aa, Dengue virus
KVVQPENLE

SEQ ID NO: 85110 - protein, 9 aa, Dengue virus
VVQPENLEY

SEQ ID NO: 85111 - protein, 9 aa, Dengue virus
VQPENLEYT

SEQ ID NO: 85112 - protein, 9 aa, Dengue virus
QPENLEYTI

SEQ ID NO: 85113 - protein, 9 aa, Dengue virus
PENLEYTIV

SEQ ID NO: 85114 - protein, 9 aa, Dengue virus
ENLEYTIVI

SEQ ID NO: 85115 - protein, 9 aa, Dengue virus
NLEYTIVIT

SEQ ID NO: 85116 - protein, 9 aa, Dengue virus
LEYTIVITP

SEQ ID NO: 85117 - protein, 9 aa, Dengue virus
EYTIVITPH

SEQ ID NO: 85118 - protein, 9 aa, Dengue virus
YTIVITPHS

SEQ ID NO: 85119 - protein, 9 aa, Dengue virus
TIVITPHSG

SEQ ID NO: 85120 - protein, 9 aa, Dengue virus
IVITPHSGE

SEQ ID NO: 85121 - protein, 9 aa, Dengue virus
VITPHSGEE

SEQ ID NO: 85122 - protein, 9 aa, Dengue virus
ITPHSGEEH

SEQ ID NO: 85123 - protein, 9 aa, Dengue virus
TPHSGEEHA

SEQ ID NO: 85124 - protein, 9 aa, Dengue virus
PHSGEEHAV

SEQ ID NO: 85125 - protein, 9 aa, Dengue virus
HSGEEHAVG

SEQ ID NO: 85126 - protein, 9 aa, Dengue virus
SGEEHAVGN

SEQ ID NO: 85127 - protein, 9 aa, Dengue virus
GEEHAVGND

SEQ ID NO: 85128 - protein, 9 aa, Dengue virus
EEHAVGNDT

SEQ ID NO: 85129 - protein, 9 aa, Dengue virus
THAVGNDIP

SEQ ID NO: 85130 - protein, 9 aa, Dengue virus
HAVGNDTGK

SEQ ID NO: 85131 - protein, 9 aa, Dengue virus
AVGNDTGKH

SEQ ID NO: 85132 - protein, 9 aa, Dengue virus
VGNDIPNHG

SEQ ID NO: 85133 - protein, 9 aa, Dengue virus
GNDTGKHGK

SEQ ID NO: 85134 - protein, 9 aa, Dengue virus
NDIPNHGVT

SEQ ID NO: 85135 - protein, 9 aa, Dengue virus
DTSNHGVTT

SEQ ID NO: 85136 - protein, 9 aa, Dengue virus
TSNHGVTAM

SEQ ID NO: 85137 - protein, 9 aa, Dengue virus
SNHGVTAMI

SEQ ID NO: 85138 - protein, 9 aa, Dengue virus
NHGVTAMIT

SEQ ID NO: 85139 - protein, 9 aa, Dengue virus
HGVTAMITP

SEQ ID NO: 85140 - protein, 9 aa, Dengue virus
GVTAMITPR

SEQ ID NO: 85141 - protein, 9 aa, Dengue virus
VTAMITPRS

SEQ ID NO: 85142 - protein, 9 aa, Dengue virus
TAMITPRSP

SEQ ID NO: 85143 - protein, 9 aa, Dengue virus
AMITPRSPS

SEQ ID NO: 85144 - protein, 9 aa, Dengue virus
MITPRSPSV

SEQ ID NO: 85145 - protein, 9 aa, Dengue virus
ITPQSSITE

SEQ ID NO: 85146 - protein, 9 aa, Dengue virus
TPRTPSVEV

SEQ ID NO: 85147 - protein, 9 aa, Dengue virus
PRSPSVEVE

SEQ ID NO: 85148 - protein, 9 aa, Dengue virus
RSPSVEVEL

SEQ ID NO: 85149 - protein, 9 aa, Dengue virus
TPSVEVKLP

SEQ ID NO: 85150 - protein, 9 aa, Dengue virus
PSVEVELPD

SEQ ID NO: 85151 - protein, 9 aa, Dengue virus
SVEVELPDY

SEQ ID NO: 85152 - protein, 9 aa, Dengue virus
VEVELPDYG

SEQ ID NO: 85153 - protein, 9 aa, Dengue virus
EAELTGYGT

SEQ ID NO: 85154 - protein, 9 aa, Dengue virus
VELPDYGEL

SEQ ID NO: 85155 - protein, 9 aa, Dengue virus
ELTGYGTVT

SEQ ID NO: 85156 - protein, 9 aa, Dengue virus
LPDYGELSL

SEQ ID NO: 85157 - protein, 9 aa, Dengue virus
TGYGTVTME

SEQ ID NO: 85158 - protein, 9 aa, Dengue virus
DYGELSLDC

SEQ ID NO: 85159 - protein, 9 aa, Dengue virus
YGTVTMECS

SEQ ID NO: 85160 - protein, 9 aa, Dengue virus
GTVTMECSP

SEQ ID NO: 85161 - protein, 9 aa, Dengue virus
TVTMECSPR

SEQ ID NO: 85162 - protein, 9 aa, Dengue virus
LSLDCEPRS

SEQ ID NO: 85163 - protein, 9 aa, Dengue virus
SLDCEPRSG

SEQ ID NO: 85164 - protein, 9 aa, Dengue virus
MECSPRTGL

SEQ ID NO: 85165 - protein, 9 aa, Dengue virus
ECSPRTGLD

SEQ ID NO: 85166 - protein, 9 aa, Dengue virus
CSPRTGLDF

SEQ ID NO: 85167 - protein, 9 aa, Dengue virus
SPRTGLDFN

SEQ ID NO: 85168 - protein, 9 aa, Dengue virus
PRTGLDFNE

SEQ ID NO: 85169 - protein, 9 aa, Dengue virus
RTGLDFNEM

SEQ ID NO: 85170 - protein, 9 aa, Dengue virus
TGLDFNEMV

SEQ ID NO: 85171 - protein, 9 aa, Dengue virus
GLDFNEMVL

SEQ ID NO: 85172 - protein, 9 aa, Dengue virus
LDFNEMVLL

SEQ ID NO: 85173 - protein, 9 aa, Dengue virus
DFNEMILMR

SEQ ID NO: 85174 - protein, 9 aa, Dengue virus
FNEMVLLQM

SEQ ID NO: 85175 - protein, 9 aa, Dengue virus
NEMILMRMK

SEQ ID NO: 85176 - protein, 9 aa, Dengue virus
MENKAWLVH

SEQ ID NO: 85177 - protein, 9 aa, Dengue virus
KTKTWLVHK

SEQ ID NO: 85178 - protein, 9 aa, Dengue virus
TKTWLVHKQ

SEQ ID NO: 85179 - protein, 9 aa, Dengue virus
KAWLVHRQW

SEQ ID NO: 85180 - protein, 9 aa, Dengue virus
AWLVHRQWF

SEQ ID NO: 85181 - protein, 9 aa, Dengue virus
WLVHRQWFL

SEQ ID NO: 85182 - protein, 9 aa, Dengue virus
LVHRQWFLD

SEQ ID NO: 85183 - protein, 9 aa, Dengue virus
VHRQWFLDL

SEQ ID NO: 85184 - protein, 9 aa, Dengue virus
HRQWFLDLP

SEQ ID NO: 85185 - protein, 9 aa, Dengue virus
RQWFLDLPL

SEQ ID NO: 85186 - protein, 9 aa, Dengue virus
FLDLPLPWA

SEQ ID NO: 85187 - protein, 9 aa, Dengue virus
LDLPLPWTT

SEQ ID NO: 85188 - protein, 9 aa, Dengue virus
DLPLPWTTG

SEQ ID NO: 85189 - protein, 9 aa, Dengue virus
LPLPWTTGA

SEQ ID NO: 85190 - protein, 9 aa, Dengue virus
PLPWTTGAD

SEQ ID NO: 85191 - protein, 9 aa, Dengue virus
LPWTTGADT

SEQ ID NO: 85192 - protein, 9 aa, Dengue virus
PWTTGADTS

SEQ ID NO: 85193 - protein, 9 aa, Dengue virus
WTTGADTSE

SEQ ID NO: 85194 - protein, 9 aa, Dengue virus
TTGADTSEV

SEQ ID NO: 85195 - protein, 9 aa, Dengue virus
TGADTSEVH

SEQ ID NO: 85196 - protein, 9 aa, Dengue virus
GADTQGSNW

SEQ ID NO: 85197 - protein, 9 aa, Dengue virus
ADTLEVHWN

SEQ ID NO: 85198 - protein, 9 aa, Dengue virus
DTSEVHWNH

SEQ ID NO: 85199 - protein, 9 aa, Dengue virus
TSEVHWNHK

SEQ ID NO: 85200 - protein, 9 aa, Dengue virus
SEVHWNHKE

SEQ ID NO: 85201 - protein, 9 aa, Dengue virus
EVHWNHKER

SEQ ID NO: 85202 - protein, 9 aa, Dengue virus
VHWNHKERM

SEQ ID NO: 85203 - protein, 9 aa, Dengue virus
HWNHKERMV

SEQ ID NO: 85204 - protein, 9 aa, Dengue virus
WNHKERMVT

SEQ ID NO: 85205 - protein, 9 aa, Dengue virus
NHKERMVTF

SEQ ID NO: 85206 - protein, 9 aa, Dengue virus
HKERMVTFK

SEQ ID NO: 85207 - protein, 9 aa, Dengue virus
KETLVTFKN

SEQ ID NO: 85208 - protein, 9 aa, Dengue virus
ETLVTFKNP

SEQ ID NO: 85209 - protein, 9 aa, Dengue virus
TLVTFKNPH

SEQ ID NO: 85210 - protein, 9 aa, Dengue virus
LVTFKNPHA

SEQ ID NO: 85211 - protein, 9 aa, Dengue virus
VTFKNPHAK

SEQ ID NO: 85212 - protein, 9 aa, Dengue virus
TFKNPHAKK

SEQ ID NO: 85213 - protein, 9 aa, Dengue virus
FKNPHAKKQ

SEQ ID NO: 85214 - protein, 9 aa, Dengue virus
KNPHAKKQD

SEQ ID NO: 85215 - protein, 9 aa, Dengue virus
NPHAKKQDV

SEQ ID NO: 85216 - protein, 9 aa, Dengue virus
PHAKKQDVV

SEQ ID NO: 85217 - protein, 9 aa, Dengue virus
HAKKQDVVV

SEQ ID NO: 85218 - protein, 9 aa, Dengue virus
AKKQDVVVL

SEQ ID NO: 85219 - protein, 9 aa, Dengue virus
KKQDVVVLG

SEQ ID NO: 85220 - protein, 9 aa, Dengue virus
KQDVVVLGS

SEQ ID NO: 85221 - protein, 9 aa, Dengue virus
QDVVVLGSQ

SEQ ID NO: 85222 - protein, 9 aa, Dengue virus
DVVVLGSQE

SEQ ID NO: 85223 - protein, 9 aa, Dengue virus
VVVLGSQEG

SEQ ID NO: 85224 - protein, 9 aa, Dengue virus
VVLGSQEGA

SEQ ID NO: 85225 - protein, 9 aa, Dengue virus
GSQEGAMHT

SEQ ID NO: 85226 - protein, 9 aa, Dengue virus
SQEGAMHTA

SEQ ID NO: 85227 - protein, 9 aa, Dengue virus
QEGAMHTAL

SEQ ID NO: 85228 - protein, 9 aa, Dengue virus
EGAMHSALT

SEQ ID NO: 85229 - protein, 9 aa, Dengue virus
GAMHSALTG

SEQ ID NO: 85230 - protein, 9 aa, Dengue virus
AMHSALTGA

SEQ ID NO: 85231 - protein, 9 aa, Dengue virus
MHSALTGAT

SEQ ID NO: 85232 - protein, 9 aa, Dengue virus
HSALTGATE

SEQ ID NO: 85233 - protein, 9 aa, Dengue virus
SALTGATEV

SEQ ID NO: 85234 - protein, 9 aa, Dengue virus
ALTGATEVD

SEQ ID NO: 85235 - protein, 9 aa, Dengue virus
LTGATEVDS

SEQ ID NO: 85236 - protein, 9 aa, Dengue virus
TGATEVDSG

SEQ ID NO: 85237 - protein, 9 aa, Dengue virus
GATEIQMSS

SEQ ID NO: 85238 - protein, 9 aa, Dengue virus
ATEIQMSSG

SEQ ID NO: 85239 - protein, 9 aa, Dengue virus
TEIQMSSGN

SEQ ID NO: 85240 - protein, 9 aa, Dengue virus
EIQMSSGNL

SEQ ID NO: 85241 - protein, 9 aa, Dengue virus
IQMSSGNLL

SEQ ID NO: 85242 - protein, 9 aa, Dengue virus
QMSSGNLLF

SEQ ID NO: 85243 - protein, 9 aa, Dengue virus
MSSGNLLFT

SEQ ID NO: 85244 - protein, 9 aa, Dengue virus
SSGNLLFTG

SEQ ID NO: 85245 - protein, 9 aa, Dengue virus
SGNLLFTGH

SEQ ID NO: 85246 - protein, 9 aa, Dengue virus
GNLLFTGHL

SEQ ID NO: 85247 - protein, 9 aa, Dengue virus
NLLFTGHLK

SEQ ID NO: 85248 - protein, 9 aa, Dengue virus
LLFTGHLKC

SEQ ID NO: 85249 - protein, 9 aa, Dengue virus
LFTGHLKCR

SEQ ID NO: 85250 - protein, 9 aa, Dengue virus
FTGHLKCRL

SEQ ID NO: 85251 - protein, 9 aa, Dengue virus
TGHLKCRLR

SEQ ID NO: 85252 - protein, 9 aa, Dengue virus
GHLKCRLRM

SEQ ID NO: 85253 - protein, 9 aa, Dengue virus
HLKCRLRMD

SEQ ID NO: 85254 - protein, 9 aa, Dengue virus
LKCRLRMDK

SEQ ID NO: 85255 - protein, 9 aa, Dengue virus
KCRLRMDKL

SEQ ID NO: 85256 - protein, 9 aa, Dengue virus
CRLRMDKLQ

SEQ ID NO: 85257 - protein, 9 aa, Dengue virus
RLRMDKLQL

SEQ ID NO: 85258 - protein, 9 aa, Dengue virus
LRMDKLQLK

SEQ ID NO: 85259 - protein, 9 aa, Dengue virus
RMDKLQLKG

SEQ ID NO: 85260 - protein, 9 aa, Dengue virus
MDKLQLKGM

SEQ ID NO: 85261 - protein, 9 aa, Dengue virus
DKLQLKGMS

SEQ ID NO: 85262 - protein, 9 aa, Dengue virus
KLQLKGMSY

SEQ ID NO: 85263 - protein, 9 aa, Dengue virus
LQLKGMSYS

SEQ ID NO: 85264 - protein, 9 aa, Dengue virus
QLKGMSYSM

SEQ ID NO: 85265 - protein, 9 aa, Dengue virus
LKGMSYSMC

SEQ ID NO: 85266 - protein, 9 aa, Dengue virus
KGMSYSMCT

SEQ ID NO: 85267 - protein, 9 aa, Dengue virus
GMSYSMCTG

SEQ ID NO: 85268 - protein, 9 aa, Dengue virus
MSYSMCTGK

SEQ ID NO: 85269 - protein, 9 aa, Dengue virus
SYSMCTGKF

SEQ ID NO: 85270 - protein, 9 aa, Dengue virus
YSMCTGKFK

SEQ ID NO: 85271 - protein, 9 aa, Dengue virus
SMCTGKFKV

SEQ ID NO: 85272 - protein, 9 aa, Dengue virus
MCTGKFKVV

SEQ ID NO: 85273 - protein, 9 aa, Dengue virus
CTGKFKVVK

SEQ ID NO: 85274 - protein, 9 aa, Dengue virus
SGKFSIDRE

SEQ ID NO: 85275 - protein, 9 aa, Dengue virus
GKFKVVKEI

SEQ ID NO: 85276 - protein, 9 aa, Dengue virus
KFKVVKEIA

SEQ ID NO: 85277 - protein, 9 aa, Dengue virus
FKVVKEIAE

SEQ ID NO: 85278 - protein, 9 aa, Dengue virus
SIDREMAET

SEQ ID NO: 85279 - protein, 9 aa, Dengue virus
IDREMAETQ

SEQ ID NO: 85280 - protein, 9 aa, Dengue virus
DREMAETQH

SEQ ID NO: 85281 - protein, 9 aa, Dengue virus
REMAETQHG

SEQ ID NO: 85282 - protein, 9 aa, Dengue virus
EIAETQHGT

SEQ ID NO: 85283 - protein, 9 aa, Dengue virus
IAETQHGTI

SEQ ID NO: 85284 - protein, 9 aa, Dengue virus
AETQHGTIV

SEQ ID NO: 85285 - protein, 9 aa, Dengue virus
ETQHGTIVI

SEQ ID NO: 85286 - protein, 9 aa, Dengue virus
TQHGTIVIR

SEQ ID NO: 85287 - protein, 9 aa, Dengue virus
QHGTIVIRV

SEQ ID NO: 85288 - protein, 9 aa, Dengue virus
HGTIVIRVQ

SEQ ID NO: 85289 - protein, 9 aa, Dengue virus
GTIVIRVQY

SEQ ID NO: 85290 - protein, 9 aa, Dengue virus
TIVIRVQYE

SEQ ID NO: 85291 - protein, 9 aa, Dengue virus
IVIRVQYEG

SEQ ID NO: 85292 - protein, 9 aa, Dengue virus
VVKVKYEGT

SEQ ID NO: 85293 - protein, 9 aa, Dengue virus
VKVKYEGTG

SEQ ID NO: 85294 - protein, 9 aa, Dengue virus
KVKYEGTGA

SEQ ID NO: 85295 - protein, 9 aa, Dengue virus
VKYEGTGAP

SEQ ID NO: 85296 - protein, 9 aa, Dengue virus
KYEGTGAPC

SEQ ID NO: 85297 - protein, 9 aa, Dengue virus
YEGTGAPCK

SEQ ID NO: 85298 - protein, 9 aa, Dengue virus
EGTGAPCKV

SEQ ID NO: 85299 - protein, 9 aa, Dengue virus
GTGAPCKVP

SEQ ID NO: 85300 - protein, 9 aa, Dengue virus
TGAPCKVPI

SEQ ID NO: 85301 - protein, 9 aa, Dengue virus
GAPCKIPIE

SEQ ID NO: 85302 - protein, 9 aa, Dengue virus
APCKIPIEI

SEQ ID NO: 85303 - protein, 9 aa, Dengue virus
PCKIPFEIM

SEQ ID NO: 85304 - protein, 9 aa, Dengue virus
CKIPIEIRD

SEQ ID NO: 85305 - protein, 9 aa, Dengue virus
KIPFEIMDL

SEQ ID NO: 85306 - protein, 9 aa, Dengue virus
IPFEIMDLE

SEQ ID NO: 85307 - protein, 9 aa, Dengue virus
PFEIMDLEK

SEQ ID NO: 85308 - protein, 9 aa, Dengue virus
IEIRDVNKK

SEQ ID NO: 85309 - protein, 9 aa, Dengue virus
EIRDVNKKK

SEQ ID NO: 85310 - protein, 9 aa, Dengue virus
IRDVNKKKV

SEQ ID NO: 85311 - protein, 9 aa, Dengue virus
RDVNKKKVV

SEQ ID NO: 85312 - protein, 9 aa, Dengue virus
DVNKKKVVG

SEQ ID NO: 85313 - protein, 9 aa, Dengue virus
VNKKKVVGR

SEQ ID NO: 85314 - protein, 9 aa, Dengue virus
AENTNSATN

SEQ ID NO: 85315 - protein, 9 aa, Dengue virus
ENTNSATNI

SEQ ID NO: 85316 - protein, 9 aa, Dengue virus
STNSVTNIE

SEQ ID NO: 85317 - protein, 9 aa, Dengue virus
TNSATNIEL

SEQ ID NO: 85318 - protein, 9 aa, Dengue virus
NSATNIELE

SEQ ID NO: 85319 - protein, 9 aa, Dengue virus
SATNIELEP

SEQ ID NO: 85320 - protein, 9 aa, Dengue virus
ATNIELEPP

SEQ ID NO: 85321 - protein, 9 aa, Dengue virus
VNIEAEPPF

SEQ ID NO: 85322 - protein, 9 aa, Dengue virus
NIEAEPPFG

SEQ ID NO: 85323 - protein, 9 aa, Dengue virus
IEAEPPFGD

SEQ ID NO: 85324 - protein, 9 aa, Dengue virus
EAEPPFGDS

SEQ ID NO: 85325 - protein, 9 aa, Dengue virus
AEPPFGDSY

SEQ ID NO: 85326 - protein, 9 aa, Dengue virus
PPFGDSYII

SEQ ID NO: 85327 - protein, 9 aa, Dengue virus
PFGDSYIII

SEQ ID NO: 85328 - protein, 9 aa, Dengue virus
FGDSYIIIG

SEQ ID NO: 85329 - protein, 9 aa, Dengue virus
GDSYIIIGV

SEQ ID NO: 85330 - protein, 9 aa, Dengue virus
DSYIMIGVG

SEQ ID NO: 85331 - protein, 9 aa, Dengue virus
SYIVIGVGD

SEQ ID NO: 85332 - protein, 9 aa, Dengue virus
YIVIGVGDS

SEQ ID NO: 85333 - protein, 9 aa, Dengue virus
IVIGVGDSA

SEQ ID NO: 85334 - protein, 9 aa, Dengue virus
VIGVGDSAL

SEQ ID NO: 85335 - protein, 9 aa, Dengue virus
IGVGDSALT

SEQ ID NO: 85336 - protein, 9 aa, Dengue virus
GVGDSALTL

SEQ ID NO: 85337 - protein, 9 aa, Dengue virus
VGDSALTLH

SEQ ID NO: 85338 - protein, 9 aa, Dengue virus
GDSALTLHW

SEQ ID NO: 85339 - protein, 9 aa, Dengue virus
DSALTLHWF

SEQ ID NO: 85340 - protein, 9 aa, Dengue virus
GQLKLNWFK

SEQ ID NO: 85341 - protein, 9 aa, Dengue virus
QLKLNWFKK

SEQ ID NO: 85342 - protein, 9 aa, Dengue virus
LKLNWFKKG

SEQ ID NO: 85343 - protein, 9 aa, Dengue virus
KLNWFKKGS

SEQ ID NO: 85344 - protein, 9 aa, Dengue virus
LNWFKKGSS

SEQ ID NO: 85345 - protein, 9 aa, Dengue virus
NWFKKGSSI

SEQ ID NO: 85346 - protein, 9 aa, Dengue virus
WFKKGSSIG

SEQ ID NO: 85347 - protein, 9 aa, Dengue virus
FKKGSSIGQ

SEQ ID NO: 85348 - protein, 9 aa, Dengue virus
KKGSSIGQM

SEQ ID NO: 85349 - protein, 9 aa, Dengue virus
KGSSIGKML

SEQ ID NO: 85350 - protein, 9 aa, Dengue virus
GSSIGKMLE

SEQ ID NO: 85351 - protein, 9 aa, Dengue virus
SSIGKMLES

SEQ ID NO: 85352 - protein, 9 aa, Dengue virus
SIGKMLEST

SEQ ID NO: 85353 - protein, 9 aa, Dengue virus
IGKMLESTY

SEQ ID NO: 85354 - protein, 9 aa, Dengue virus
GKMLESTYR

SEQ ID NO: 85355 - protein, 9 aa, Dengue virus
QMFETTMRG

SEQ ID NO: 85356 - protein, 9 aa, Dengue virus
MLESTYRGA

SEQ ID NO: 85357 - protein, 9 aa, Dengue virus
FETTMRGAK

SEQ ID NO: 85358 - protein, 9 aa, Dengue virus
ETTMRGAKR

SEQ ID NO: 85359 - protein, 9 aa, Dengue virus
TTMRGAKRM

SEQ ID NO: 85360 - protein, 9 aa, Dengue virus
TMRGAKRMA

SEQ ID NO: 85361 - protein, 9 aa, Dengue virus
MRGAKRMAI

SEQ ID NO: 85362 - protein, 9 aa, Dengue virus
AKRMAILGD

SEQ ID NO: 85363 - protein, 9 aa, Dengue virus
KRMAILGDT

SEQ ID NO: 85364 - protein, 9 aa, Dengue virus
RMAILGDTA

SEQ ID NO: 85365 - protein, 9 aa, Dengue virus
MAILGDTAW

SEQ ID NO: 85366 - protein, 9 aa, Dengue virus
AILGDTAWD

SEQ ID NO: 85367 - protein, 9 aa, Dengue virus
ILGDTAWDF

SEQ ID NO: 85368 - protein, 9 aa, Dengue virus
LGDTAWDFG

SEQ ID NO: 85369 - protein, 9 aa, Dengue virus
GDTAWDFGS

SEQ ID NO: 85370 - protein, 9 aa, Dengue virus
DTAWDFGSL

SEQ ID NO: 85371 - protein, 9 aa, Dengue virus
TAWDFGSLG

SEQ ID NO: 85372 - protein, 9 aa, Dengue virus
AWDFGSLGG

SEQ ID NO: 85373 - protein, 9 aa, Dengue virus
WDFGSLGGV

SEQ ID NO: 85374 - protein, 9 aa, Dengue virus
DFGSVGGLL

SEQ ID NO: 85375 - protein, 9 aa, Dengue virus
FGSVGGLLT

SEQ ID NO: 85376 - protein, 9 aa, Dengue virus
GSVGGLLTS

SEQ ID NO: 85377 - protein, 9 aa, Dengue virus
SVGGLLTSL

SEQ ID NO: 85378 - protein, 9 aa, Dengue virus
VGGLLTSLG

SEQ ID NO: 85379 - protein, 9 aa, Dengue virus
GGLLTSLGK

SEQ ID NO: 85380 - protein, 9 aa, Dengue virus
GLLTSLGKA

SEQ ID NO: 85381 - protein, 9 aa, Dengue virus
LLTSLGKAV

SEQ ID NO: 85382 - protein, 9 aa, Dengue virus
LTSLGKAVH

SEQ ID NO: 85383 - protein, 9 aa, Dengue virus
TSIGKALHQ

SEQ ID NO: 85384 - protein, 9 aa, Dengue virus
SIGKALHQV

SEQ ID NO: 85385 - protein, 9 aa, Dengue virus
LGKAVHQIF

SEQ ID NO: 85386 - protein, 9 aa, Dengue virus
GKALHQVFG

SEQ ID NO: 85387 - protein, 9 aa, Dengue virus
KALHQVFGA

SEQ ID NO: 85388 - protein, 9 aa, Dengue virus
ALHQVFGAI

SEQ ID NO: 85389 - protein, 9 aa, Dengue virus
VHQIFGSVY

SEQ ID NO: 85390 - protein, 9 aa, Dengue virus
HQIFGSVYT

SEQ ID NO: 85391 - protein, 9 aa, Dengue virus
QIFGSVYTT

SEQ ID NO: 85392 - protein, 9 aa, Dengue virus
IFGSVYTTM

SEQ ID NO: 85393 - protein, 9 aa, Dengue virus
FGAIYGAAF

SEQ ID NO: 85394 - protein, 9 aa, Dengue virus
GAIYGAAFS

SEQ ID NO: 85395 - protein, 9 aa, Dengue virus
AIYGAAFSG

SEQ ID NO: 85396 - protein, 9 aa, Dengue virus
IYGAAFSGV

SEQ ID NO: 85397 - protein, 9 aa, Dengue virus
YGAAFSGVS

SEQ ID NO: 85398 - protein, 9 aa, Dengue virus
GAAFSGVSW

SEQ ID NO: 85399 - protein, 9 aa, Dengue virus
AAFSGVSWT

SEQ ID NO: 85400 - protein, 9 aa, Dengue virus
MFGGVSWMV

SEQ ID NO: 85401 - protein, 9 aa, Dengue virus
FGGVSWMVR

SEQ ID NO: 85402 - protein, 9 aa, Dengue virus
GGVSWMVRI

SEQ ID NO: 85403 - protein, 9 aa, Dengue virus
GVSWMVRIL

SEQ ID NO: 85404 - protein, 9 aa, Dengue virus
VSWMVRILI

SEQ ID NO: 85405 - protein, 9 aa, Dengue virus
SWMVRILIG

SEQ ID NO: 85406 - protein, 9 aa, Dengue virus
VRILIGFLV

SEQ ID NO: 85407 - protein, 9 aa, Dengue virus
RILIGLLVL

SEQ ID NO: 85408 - protein, 9 aa, Dengue virus
ILIGLLVLW

SEQ ID NO: 85409 - protein, 9 aa, Dengue virus
LIGLLVLWI

SEQ ID NO: 85410 - protein, 9 aa, Dengue virus
IGLLVLWIG

SEQ ID NO: 85411 - protein, 9 aa, Dengue virus
GLLVLWIGT

SEQ ID NO: 85412 - protein, 9 aa, Dengue virus
LLVLWIGTN

SEQ ID NO: 85413 - protein, 9 aa, Dengue virus
IITWIGMNS

SEQ ID NO: 85414 - protein, 9 aa, Dengue virus
ITWIGMNSR

SEQ ID NO: 85415 - protein, 9 aa, Dengue virus
TWIGMNSRN

SEQ ID NO: 85416 - protein, 9 aa, Dengue virus
WIGMNSRNT

SEQ ID NO: 85417 - protein, 9 aa, Dengue virus
IGTNSRNTP

SEQ ID NO: 85418 - protein, 9 aa, Dengue virus
GTNSRNTPM

SEQ ID NO: 85419 - protein, 9 aa, Dengue virus
MNSRNTSMA

SEQ ID NO: 85420 - protein, 9 aa, Dengue virus
NSRNTPMAM

SEQ ID NO: 85421 - protein, 9 aa, Dengue virus
SRNTSMAMS

SEQ ID NO: 85422 - protein, 9 aa, Dengue virus
RNTSMAMSC

SEQ ID NO: 85423 - protein, 9 aa, Dengue virus
NTSMAMSCI

SEQ ID NO: 85424 - protein, 9 aa, Dengue virus
TSMAMSCIA

SEQ ID NO: 85425 - protein, 9 aa, Dengue virus
SMAMSCIAV

SEQ ID NO: 85426 - protein, 9 aa, Dengue virus
MAMSCIAVG

SEQ ID NO: 85427 - protein, 9 aa, Dengue virus
AMSCIAVGG

SEQ ID NO: 85428 - protein, 9 aa, Dengue virus
MSCIAVGGI

SEQ ID NO: 85429 - protein, 9 aa, Dengue virus
SCIAVGGIT

SEQ ID NO: 85430 - protein, 9 aa, Dengue virus
TLFLGFTVH

SEQ ID NO: 85431 - protein, 9 aa, Dengue virus
LFLGFTVHA

SEQ ID NO: 85432 - protein, 9 aa, Dengue virus
FLGFTVHAD

SEQ ID NO: 85433 - protein, 9 aa, Dengue virus
LGFTVHADM

SEQ ID NO: 85434 - protein, 9 aa, Dengue virus
GFTVHADMG

SEQ ID NO: 85435 - protein, 9 aa, Dengue virus
FTVHADMGC

SEQ ID NO: 85436 - protein, 9 aa, Dengue virus
ADMGCVASW

SEQ ID NO: 85437 - protein, 9 aa, Dengue virus
SWSGKELKC

SEQ ID NO: 85438 - protein, 9 aa, Dengue virus
WSGKELKCG

SEQ ID NO: 85439 - protein, 9 aa, Dengue virus
SGKELKCGS

SEQ ID NO: 85440 - protein, 9 aa, Dengue virus
GKELKCGSG

SEQ ID NO: 85441 - protein, 9 aa, Dengue virus
KELKCGSGI

SEQ ID NO: 85442 - protein, 9 aa, Dengue virus
KCGSGIFVI

SEQ ID NO: 85443 - protein, 9 aa, Dengue virus
CGSGIFVID

SEQ ID NO: 85444 - protein, 9 aa, Dengue virus
GSGIFVIDN

SEQ ID NO: 85445 - protein, 9 aa, Dengue virus
SGIFVIDNV

SEQ ID NO: 85446 - protein, 9 aa, Dengue virus
GIFVIDNVH

SEQ ID NO: 85447 - protein, 9 aa, Dengue virus
IFVIDNVHT

SEQ ID NO: 85448 - protein, 9 aa, Dengue virus
FVIDNVHTW

SEQ ID NO: 85449 - protein, 9 aa, Dengue virus
VIDNVHTWT

SEQ ID NO: 85450 - protein, 9 aa, Dengue virus
IDNVHTWTE

SEQ ID NO: 85451 - protein, 9 aa, Dengue virus
NVHTWTEQH

SEQ ID NO: 85452 - protein, 9 aa, Dengue virus
VHTWTEQYQ

SEQ ID NO: 85453 - protein, 9 aa, Dengue virus
HTWTEQYQF

SEQ ID NO: 85454 - protein, 9 aa, Dengue virus
TWTEQYQFQ

SEQ ID NO: 85455 - protein, 9 aa, Dengue virus
WTEQYQFQP

SEQ ID NO: 85456 - protein, 9 aa, Dengue virus
TEQYQFQPE

SEQ ID NO: 85457 - protein, 9 aa, Dengue virus
EQYQFQPES

SEQ ID NO: 85458 - protein, 9 aa, Dengue virus
QYQFQPESP

SEQ ID NO: 85459 - protein, 9 aa, Dengue virus
YQFQPESPA

SEQ ID NO: 85460 - protein, 9 aa, Dengue virus
QFQPESPAR

SEQ ID NO: 85461 - protein, 9 aa, Dengue virus
FQPESPARV

SEQ ID NO: 85462 - protein, 9 aa, Dengue virus
QPESPARVA

SEQ ID NO: 85463 - protein, 9 aa, Dengue virus
PESPARVAS

SEQ ID NO: 85464 - protein, 9 aa, Dengue virus
ESPARVASA

SEQ ID NO: 85465 - protein, 9 aa, Dengue virus
SPARVASAI

SEQ ID NO: 85466 - protein, 9 aa, Dengue virus
PARVASAIL

SEQ ID NO: 85467 - protein, 9 aa, Dengue virus
ARVASAILN

SEQ ID NO: 85468 - protein, 9 aa, Dengue virus
RVASAILNA

SEQ ID NO: 85469 - protein, 9 aa, Dengue virus
VASAILNAH

SEQ ID NO: 85470 - protein, 9 aa, Dengue virus
ASAILNAHE

SEQ ID NO: 85471 - protein, 9 aa, Dengue virus
SAILNAHKE

SEQ ID NO: 85472 - protein, 9 aa, Dengue virus
AILNAHKEG

SEQ ID NO: 85473 - protein, 9 aa, Dengue virus
ILIAHKDGV

SEQ ID NO: 85474 - protein, 9 aa, Dengue virus
LNAHEDGVC

SEQ ID NO: 85475 - protein, 9 aa, Dengue virus
NAHKEGVCG

SEQ ID NO: 85476 - protein, 9 aa, Dengue virus
AHEDGVCGI

SEQ ID NO: 85477 - protein, 9 aa, Dengue virus
HKDGVCGVR

SEQ ID NO: 85478 - protein, 9 aa, Dengue virus
KDGVCGVRS

SEQ ID NO: 85479 - protein, 9 aa, Dengue virus
EGVCGIRST

SEQ ID NO: 85480 - protein, 9 aa, Dengue virus
RSTTRLENI

SEQ ID NO: 85481 - protein, 9 aa, Dengue virus
STTRLENIM

SEQ ID NO: 85482 - protein, 9 aa, Dengue virus
TTRLENIMW

SEQ ID NO: 85483 - protein, 9 aa, Dengue virus
TRLENIMWK

SEQ ID NO: 85484 - protein, 9 aa, Dengue virus
RLENIMWKQ

SEQ ID NO: 85485 - protein, 9 aa, Dengue virus
LENIMWKQI

SEQ ID NO: 85486 - protein, 9 aa, Dengue virus
ENIMWKQIT

SEQ ID NO: 85487 - protein, 9 aa, Dengue virus
NIMWKQITN

SEQ ID NO: 85488 - protein, 9 aa, Dengue virus
IMWKQITNE

SEQ ID NO: 85489 - protein, 9 aa, Dengue virus
GGHDLTVVT

SEQ ID NO: 85490 - protein, 9 aa, Dengue virus
GHDLTVVTG

SEQ ID NO: 85491 - protein, 9 aa, Dengue virus
HDLTVVTGD

SEQ ID NO: 85492 - protein, 9 aa, Dengue virus
DLTVVAGDA

SEQ ID NO: 85493 - protein, 9 aa, Dengue virus
LTVVAGDAK

SEQ ID NO: 85494 - protein, 9 aa, Dengue virus
TVVAGDAKG

SEQ ID NO: 85495 - protein, 9 aa, Dengue virus
VVAGDAKGV

SEQ ID NO: 85496 - protein, 9 aa, Dengue virus
VAGDAKGVL

SEQ ID NO: 85497 - protein, 9 aa, Dengue virus
AGDVKGVLS

SEQ ID NO: 85498 - protein, 9 aa, Dengue virus
GDVKGVLSK

SEQ ID NO: 85499 - protein, 9 aa, Dengue virus
DVKGVLSKG

SEQ ID NO: 85500 - protein, 9 aa, Dengue virus
VKGVLSKGK

SEQ ID NO: 85501 - protein, 9 aa, Dengue virus
KGVLSKGKR

SEQ ID NO: 85502 - protein, 9 aa, Dengue virus
GVLSKGKRA

SEQ ID NO: 85503 - protein, 9 aa, Dengue virus
VLSKGKRAL

SEQ ID NO: 85504 - protein, 9 aa, Dengue virus
LSKGKRALA

SEQ ID NO: 85505 - protein, 9 aa, Dengue virus
SKGKRALAP

SEQ ID NO: 85506 - protein, 9 aa, Dengue virus
KGKRALAPP

SEQ ID NO: 85507 - protein, 9 aa, Dengue virus
GKRALTPPA

SEQ ID NO: 85508 - protein, 9 aa, Dengue virus
LTPPASDLK

SEQ ID NO: 85509 - protein, 9 aa, Dengue virus
TPPASDLKY

SEQ ID NO: 85510 - protein, 9 aa, Dengue virus
PPASDLKYS

SEQ ID NO: 85511 - protein, 9 aa, Dengue virus
PASDLKYSW

SEQ ID NO: 85512 - protein, 9 aa, Dengue virus
ASDLKYSWK

SEQ ID NO: 85513 - protein, 9 aa, Dengue virus
NDLKYSWKT

SEQ ID NO: 85514 - protein, 9 aa, Dengue virus
TWGKAKIFA

SEQ ID NO: 85515 - protein, 9 aa, Dengue virus
WGKAKIFAP

SEQ ID NO: 85516 - protein, 9 aa, Dengue virus
GKAKIFAPE

SEQ ID NO: 85517 - protein, 9 aa, Dengue virus
KAKIFTPET

SEQ ID NO: 85518 - protein, 9 aa, Dengue virus
PETRNSTFL

SEQ ID NO: 85519 - protein, 9 aa, Dengue virus
KNSTFLIDG

SEQ ID NO: 85520 - protein, 9 aa, Dengue virus
NSTFLVDGP

SEQ ID NO: 85521 - protein, 9 aa, Dengue virus
STFLVDGPD

SEQ ID NO: 85522 - protein, 9 aa, Dengue virus
TFLVDGPDT

SEQ ID NO: 85523 - protein, 9 aa, Dengue virus
FLVDGPDTS

SEQ ID NO: 85524 - protein, 9 aa, Dengue virus
LVDGPDTSE

SEQ ID NO: 85525 - protein, 9 aa, Dengue virus
VDGPDTSEC

SEQ ID NO: 85526 - protein, 9 aa, Dengue virus
PNERRAWNF

SEQ ID NO: 85527 - protein, 9 aa, Dengue virus
NERRAWNSF

SEQ ID NO: 85528 - protein, 9 aa, Dengue virus
ERRAWNSFE

SEQ ID NO: 85529 - protein, 9 aa, Dengue virus
RRAWNSFEV

SEQ ID NO: 85530 - protein, 9 aa, Dengue virus
RAWNSFEVE

SEQ ID NO: 85531 - protein, 9 aa, Dengue virus
AWNSFEVED

SEQ ID NO: 85532 - protein, 9 aa, Dengue virus
WNSFEVEDY

SEQ ID NO: 85533 - protein, 9 aa, Dengue virus
NSFEVEDYG

SEQ ID NO: 85534 - protein, 9 aa, Dengue virus
SFEVEDYGF

SEQ ID NO: 85535 - protein, 9 aa, Dengue virus
FEVEDYGFG

SEQ ID NO: 85536 - protein, 9 aa, Dengue virus
YGFGMFTTS

SEQ ID NO: 85537 - protein, 9 aa, Dengue virus
GFGMFTTSI

SEQ ID NO: 85538 - protein, 9 aa, Dengue virus
FGMFTTSIW

SEQ ID NO: 85539 - protein, 9 aa, Dengue virus
GMFTTSIWM

SEQ ID NO: 85540 - protein, 9 aa, Dengue virus
MFTTSIWMK

SEQ ID NO: 85541 - protein, 9 aa, Dengue virus
FTTSIWMKF

SEQ ID NO: 85542 - protein, 9 aa, Dengue virus
TTSIWMKFR

SEQ ID NO: 85543 - protein, 9 aa, Dengue virus
TSIWMKFRE

SEQ ID NO: 85544 - protein, 9 aa, Dengue virus
SIWMKFREG

SEQ ID NO: 85545 - protein, 9 aa, Dengue virus
KFREGSSEL

SEQ ID NO: 85546 - protein, 9 aa, Dengue virus
FREGSSELC

SEQ ID NO: 85547 - protein, 9 aa, Dengue virus
KNQTWQIER

SEQ ID NO: 85548 - protein, 9 aa, Dengue virus
NQTWQIERA

SEQ ID NO: 85549 - protein, 9 aa, Dengue virus
QTWQIERAS

SEQ ID NO: 85550 - protein, 9 aa, Dengue virus
TWQIERASL

SEQ ID NO: 85551 - protein, 9 aa, Dengue virus
WQIERASLI

SEQ ID NO: 85552 - protein, 9 aa, Dengue virus
QIERASLIE

SEQ ID NO: 85553 - protein, 9 aa, Dengue virus
IERASLIEV

SEQ ID NO: 85554 - protein, 9 aa, Dengue virus
ERASLIEVK

SEQ ID NO: 85555 - protein, 9 aa, Dengue virus
RASLIEVKT

SEQ ID NO: 85556 - protein, 9 aa, Dengue virus
LESQMLIPR

SEQ ID NO: 85557 - protein, 9 aa, Dengue virus
ESQMLIPRS

SEQ ID NO: 85558 - protein, 9 aa, Dengue virus
SQMLIPRSY

SEQ ID NO: 85559 - protein, 9 aa, Dengue virus
QMLIPRSYA

SEQ ID NO: 85560 - protein, 9 aa, Dengue virus
MLIPRSYAG

SEQ ID NO: 85561 - protein, 9 aa, Dengue virus
LIPRSYAGP

SEQ ID NO: 85562 - protein, 9 aa, Dengue virus
IPRSYAGPF

SEQ ID NO: 85563 - protein, 9 aa, Dengue virus
PRSYAGPFS

SEQ ID NO: 85564 - protein, 9 aa, Dengue virus
RSYAGPFSQ

SEQ ID NO: 85565 - protein, 9 aa, Dengue virus
AYAGPFSQH

SEQ ID NO: 85566 - protein, 9 aa, Dengue virus
YAGPFSHHN

SEQ ID NO: 85567 - protein, 9 aa, Dengue virus
AGPFSHHNY

SEQ ID NO: 85568 - protein, 9 aa, Dengue virus
GPFSHHNYR

SEQ ID NO: 85569 - protein, 9 aa, Dengue virus
PFSHHNYRQ

SEQ ID NO: 85570 - protein, 9 aa, Dengue virus
FSHHNYRQG

SEQ ID NO: 85571 - protein, 9 aa, Dengue virus
SHHNYRQGY

SEQ ID NO: 85572 - protein, 9 aa, Dengue virus
HHNYRQGYA

SEQ ID NO: 85573 - protein, 9 aa, Dengue virus
YRQGYATQI

SEQ ID NO: 85574 - protein, 9 aa, Dengue virus
RQGYATQTM

SEQ ID NO: 85575 - protein, 9 aa, Dengue virus
QGYATQTMG

SEQ ID NO: 85576 - protein, 9 aa, Dengue virus
GYATQTMGP

SEQ ID NO: 85577 - protein, 9 aa, Dengue virus
YATQTMGPW

SEQ ID NO: 85578 - protein, 9 aa, Dengue virus
ATQTMGPWH

SEQ ID NO: 85579 - protein, 9 aa, Dengue virus
TQTMGPWHL

SEQ ID NO: 85580 - protein, 9 aa, Dengue virus
QTMGPWHLG

SEQ ID NO: 85581 - protein, 9 aa, Dengue virus
TMGPWHLGK

SEQ ID NO: 85582 - protein, 9 aa, Dengue virus
AGPWHLGKL

SEQ ID NO: 85583 - protein, 9 aa, Dengue virus
WHLGKLEIG

SEQ ID NO: 85584 - protein, 9 aa, Dengue virus
HLGKLEIGF

SEQ ID NO: 85585 - protein, 9 aa, Dengue virus
LGKLEMDFG

SEQ ID NO: 85586 - protein, 9 aa, Dengue virus
GKLEIGFGE

SEQ ID NO: 85587 - protein, 9 aa, Dengue virus
KLEMDFGEC

SEQ ID NO: 85588 - protein, 9 aa, Dengue virus
LEMDFGECP

SEQ ID NO: 85589 - protein, 9 aa, Dengue virus
EMDFGECPG

SEQ ID NO: 85590 - protein, 9 aa, Dengue virus
MDFGECPGT

SEQ ID NO: 85591 - protein, 9 aa, Dengue virus
GECPGTTVA

SEQ ID NO: 85592 - protein, 9 aa, Dengue virus
ECPGTTVAI

SEQ ID NO: 85593 - protein, 9 aa, Dengue virus
CPGTTVAIQ

SEQ ID NO: 85594 - protein, 9 aa, Dengue virus
PGTTVAIQE

SEQ ID NO: 85595 - protein, 9 aa, Dengue virus
GTTVTIQEN

SEQ ID NO: 85596 - protein, 9 aa, Dengue virus
TTVTIQENC

SEQ ID NO: 85597 - protein, 9 aa, Dengue virus
QENCDHRGP

SEQ ID NO: 85598 - protein, 9 aa, Dengue virus
ENCDHRGPS

SEQ ID NO: 85599 - protein, 9 aa, Dengue virus
NCDHRGPSL

SEQ ID NO: 85600 - protein, 9 aa, Dengue virus
CGHRGSSLR

SEQ ID NO: 85601 - protein, 9 aa, Dengue virus
GHRGSSLRT

SEQ ID NO: 85602 - protein, 9 aa, Dengue virus
HRGSSLRTT

SEQ ID NO: 85603 - protein, 9 aa, Dengue virus
RGSSLRTTT

SEQ ID NO: 85604 - protein, 9 aa, Dengue virus
GSSLRTTTA

SEQ ID NO: 85605 - protein, 9 aa, Dengue virus
SSLRTTTAS

SEQ ID NO: 85606 - protein, 9 aa, Dengue virus
YGMEIRPLN

SEQ ID NO: 85607 - protein, 9 aa, Dengue virus
GMEIRPLNE

SEQ ID NO: 85608 - protein, 9 aa, Dengue virus
MEIRPLNEK

SEQ ID NO: 85609 - protein, 9 aa, Dengue virus
EIRPLNEKE

SEQ ID NO: 85610 - protein, 9 aa, Dengue virus
IRPLNEKEE

SEQ ID NO: 85611 - protein, 9 aa, Dengue virus
RPLNEKEEN

SEQ ID NO: 85612 - protein, 9 aa, Dengue virus
PLNEKEENM

SEQ ID NO: 85613 - protein, 9 aa, Dengue virus
LNEKEENMV

SEQ ID NO: 85614 - protein, 9 aa, Dengue virus
NEKEENMVK

SEQ ID NO: 85615 - protein, 9 aa, Dengue virus
EREENMVKS

SEQ ID NO: 85616 - protein, 9 aa, Dengue virus
REENMVKSQ

SEQ ID NO: 85617 - protein, 9 aa, Dengue virus
EENMVKSQA

SEQ ID NO: 85618 - protein, 9 aa, Dengue virus
ENMVKSQVA

SEQ ID NO: 85619 - protein, 9 aa, Dengue virus
NMVKSQVAA

SEQ ID NO: 85620 - protein, 9 aa, Dengue virus
MVKSQVAAG

SEQ ID NO: 85621 - protein, 9 aa, Dengue virus
AGQSTSETF

SEQ ID NO: 85622 - protein, 9 aa, Dengue virus
STSETFSMG

SEQ ID NO: 85623 - protein, 9 aa, Dengue virus
SSETFSMGL

SEQ ID NO: 85624 - protein, 9 aa, Dengue virus
SETFFMGLL

SEQ ID NO: 85625 - protein, 9 aa, Dengue virus
GLLCLTLFM

SEQ ID NO: 85626 - protein, 9 aa, Dengue virus
LLCLTLFME

SEQ ID NO: 85627 - protein, 9 aa, Dengue virus
LCLTLFMEE

SEQ ID NO: 85628 - protein, 9 aa, Dengue virus
CLTLFMEEC

SEQ ID NO: 85629 - protein, 9 aa, Dengue virus
LTLFMEECL

SEQ ID NO: 85630 - protein, 9 aa, Dengue virus
TLFMEECLR

SEQ ID NO: 85631 - protein, 9 aa, Dengue virus
LFMEECLRR

SEQ ID NO: 85632 - protein, 9 aa, Dengue virus
FMEECLRRR

SEQ ID NO: 85633 - protein, 9 aa, Dengue virus
MEECLRRRV

SEQ ID NO: 85634 - protein, 9 aa, Dengue virus
EECLRRKVT

SEQ ID NO: 85635 - protein, 9 aa, Dengue virus
ECLRRKVTR

SEQ ID NO: 85636 - protein, 9 aa, Dengue virus
CLRRKVTRK

SEQ ID NO: 85637 - protein, 9 aa, Dengue virus
LRRKVTRKH

SEQ ID NO: 85638 - protein, 9 aa, Dengue virus
RRKVTRKHM

SEQ ID NO: 85639 - protein, 9 aa, Dengue virus
RKVTRKHMI

SEQ ID NO: 85640 - protein, 9 aa, Dengue virus
KVTRKHMIL

SEQ ID NO: 85641 - protein, 9 aa, Dengue virus
VTRKHMILV

SEQ ID NO: 85642 - protein, 9 aa, Dengue virus
TRKHMILVV

SEQ ID NO: 85643 - protein, 9 aa, Dengue virus
RKHMILVVV

SEQ ID NO: 85644 - protein, 9 aa, Dengue virus
KHMILVVVI

SEQ ID NO: 85645 - protein, 9 aa, Dengue virus
HMILVVVIT

SEQ ID NO: 85646 - protein, 9 aa, Dengue virus
ITFCAIILG

SEQ ID NO: 85647 - protein, 9 aa, Dengue virus
TFCAIILGG

SEQ ID NO: 85648 - protein, 9 aa, Dengue virus
FCAIILGGL

SEQ ID NO: 85649 - protein, 9 aa, Dengue virus
TWMDLLRAI

SEQ ID NO: 85650 - protein, 9 aa, Dengue virus
WMDLLRAII

SEQ ID NO: 85651 - protein, 9 aa, Dengue virus
MDLLRAIIM

SEQ ID NO: 85652 - protein, 9 aa, Dengue virus
DLLRAIIML

SEQ ID NO: 85653 - protein, 9 aa, Dengue virus
LLRAIIMLG

SEQ ID NO: 85654 - protein, 9 aa, Dengue virus
LRAIIMLGD

SEQ ID NO: 85655 - protein, 9 aa, Dengue virus
RAIIMLGDT

SEQ ID NO: 85656 - protein, 9 aa, Dengue virus
AIIMLGDTM

SEQ ID NO: 85657 - protein, 9 aa, Dengue virus
IIMLGDTML

SEQ ID NO: 85658 - protein, 9 aa, Dengue virus
IMLGDTMLS

SEQ ID NO: 85659 - protein, 9 aa, Dengue virus
MLGDTMLSR

SEQ ID NO: 85660 - protein, 9 aa, Dengue virus
LGDTMSGRM

SEQ ID NO: 85661 - protein, 9 aa, Dengue virus
GDTMSGRMG

SEQ ID NO: 85662 - protein, 9 aa, Dengue virus
DTMSGRMGG

SEQ ID NO: 85663 - protein, 9 aa, Dengue virus
TMSGRMGGQ

SEQ ID NO: 85664 - protein, 9 aa, Dengue virus
RIGGQIHLA

SEQ ID NO: 85665 - protein, 9 aa, Dengue virus
IGGQIHLAI

SEQ ID NO: 85666 - protein, 9 aa, Dengue virus
GGQIHLAIM

SEQ ID NO: 85667 - protein, 9 aa, Dengue virus
GQIHLAIMA

SEQ ID NO: 85668 - protein, 9 aa, Dengue virus
QIHLAIMAV

SEQ ID NO: 85669 - protein, 9 aa, Dengue virus
IHLAIMAVF

SEQ ID NO: 85670 - protein, 9 aa, Dengue virus
HLAIMIVFK

SEQ ID NO: 85671 - protein, 9 aa, Dengue virus
LAIMIVFKM

SEQ ID NO: 85672 - protein, 9 aa, Dengue virus
AIMIVFKMS

SEQ ID NO: 85673 - protein, 9 aa, Dengue virus
IMIVFKMSP

SEQ ID NO: 85674 - protein, 9 aa, Dengue virus
MIVFKMSPG

SEQ ID NO: 85675 - protein, 9 aa, Dengue virus
IVFKMSPGY

SEQ ID NO: 85676 - protein, 9 aa, Dengue virus
MSPGYVLGI

SEQ ID NO: 85677 - protein, 9 aa, Dengue virus
SPGYVLGIF

SEQ ID NO: 85678 - protein, 9 aa, Dengue virus
PGYVLGIFL

SEQ ID NO: 85679 - protein, 9 aa, Dengue virus
GYVLGIFLR

SEQ ID NO: 85680 - protein, 9 aa, Dengue virus
YVLGIFLRK

SEQ ID NO: 85681 - protein, 9 aa, Dengue virus
VLGIFLRKL

SEQ ID NO: 85682 - protein, 9 aa, Dengue virus
LGIFLRKLT

SEQ ID NO: 85683 - protein, 9 aa, Dengue virus
GIFLRKLTS

SEQ ID NO: 85684 - protein, 9 aa, Dengue virus
IFLRKLTSR

SEQ ID NO: 85685 - protein, 9 aa, Dengue virus
FLRRLTSRE

SEQ ID NO: 85686 - protein, 9 aa, Dengue virus
LRRLTSRET

SEQ ID NO: 85687 - protein, 9 aa, Dengue virus
RRLTSRETA

SEQ ID NO: 85688 - protein, 9 aa, Dengue virus
RLTSRETAL

SEQ ID NO: 85689 - protein, 9 aa, Dengue virus
VIGMAMTTV

SEQ ID NO: 85690 - protein, 9 aa, Dengue virus
IGMAMTTVL

SEQ ID NO: 85691 - protein, 9 aa, Dengue virus
GMAMTTVLS

SEQ ID NO: 85692 - protein, 9 aa, Dengue virus
MAMTTVLSI

SEQ ID NO: 85693 - protein, 9 aa, Dengue virus
AMTTVLSIP

SEQ ID NO: 85694 - protein, 9 aa, Dengue virus
MTTVLSIPH

SEQ ID NO: 85695 - protein, 9 aa, Dengue virus
TTVLSIPHD

SEQ ID NO: 85696 - protein, 9 aa, Dengue virus
TVLSIPHDL

SEQ ID NO: 85697 - protein, 9 aa, Dengue virus
VLSIPHDLM

SEQ ID NO: 85698 - protein, 9 aa, Dengue virus
FSIPHDLME

SEQ ID NO: 85699 - protein, 9 aa, Dengue virus
SIPHDLMEF

SEQ ID NO: 85700 - protein, 9 aa, Dengue virus
IPHDLMEFI

SEQ ID NO: 85701 - protein, 9 aa, Dengue virus
PHDLMEFID

SEQ ID NO: 85702 - protein, 9 aa, Dengue virus
HDLMEFIDG

SEQ ID NO: 85703 - protein, 9 aa, Dengue virus
DLMEFIDGI

SEQ ID NO: 85704 - protein, 9 aa, Dengue virus
LMEFIDGIS

SEQ ID NO: 85705 - protein, 9 aa, Dengue virus
MEFIDGISL

SEQ ID NO: 85706 - protein, 9 aa, Dengue virus
EFIDGISLG

SEQ ID NO: 85707 - protein, 9 aa, Dengue virus
FIDGISLGL

SEQ ID NO: 85708 - protein, 9 aa, Dengue virus
IDGLSLGLI

SEQ ID NO: 85709 - protein, 9 aa, Dengue virus
DGIALGLIL

SEQ ID NO: 85710 - protein, 9 aa, Dengue virus
GLSLGLILL

SEQ ID NO: 85711 - protein, 9 aa, Dengue virus
LSLGLILLK

SEQ ID NO: 85712 - protein, 9 aa, Dengue virus
SLGLILLKM

SEQ ID NO: 85713 - protein, 9 aa, Dengue virus
LGLILLKMV

SEQ ID NO: 85714 - protein, 9 aa, Dengue virus
GLILLKMVT

SEQ ID NO: 85715 - protein, 9 aa, Dengue virus
LILLKIVTH

SEQ ID NO: 85716 - protein, 9 aa, Dengue virus
ILLKIVTHF

SEQ ID NO: 85717 - protein, 9 aa, Dengue virus
LLKIVTHFD

SEQ ID NO: 85718 - protein, 9 aa, Dengue virus
VTHFDNTQV

SEQ ID NO: 85719 - protein, 9 aa, Dengue virus
THFDNTQVG

SEQ ID NO: 85720 - protein, 9 aa, Dengue virus
HFDNTQVGT

SEQ ID NO: 85721 - protein, 9 aa, Dengue virus
FDDTQVGTL

SEQ ID NO: 85722 - protein, 9 aa, Dengue virus
DDTQVGTLA

SEQ ID NO: 85723 - protein, 9 aa, Dengue virus
DTQVGTLAL

SEQ ID NO: 85724 - protein, 9 aa, Dengue virus
AQLGTLALS

SEQ ID NO: 85725 - protein, 9 aa, Dengue virus
QLGTLALSL

SEQ ID NO: 85726 - protein, 9 aa, Dengue virus
VGTLALALT

SEQ ID NO: 85727 - protein, 9 aa, Dengue virus
LALSLTFIK

SEQ ID NO: 85728 - protein, 9 aa, Dengue virus
ALSLTFIKS

SEQ ID NO: 85729 - protein, 9 aa, Dengue virus
LSLTFIKST

SEQ ID NO: 85730 - protein, 9 aa, Dengue virus
PLVMAWRTI

SEQ ID NO: 85731 - protein, 9 aa, Dengue virus
LIMAWRTIM

SEQ ID NO: 85732 - protein, 9 aa, Dengue virus
IMAWRTIMA

SEQ ID NO: 85733 - protein, 9 aa, Dengue virus
AWRTIMAVF

SEQ ID NO: 85734 - protein, 9 aa, Dengue virus
WRTIMAVFF

SEQ ID NO: 85735 - protein, 9 aa, Dengue virus
RTIMAVFFV

SEQ ID NO: 85736 - protein, 9 aa, Dengue virus
TIMAVFFVV

SEQ ID NO: 85737 - protein, 9 aa, Dengue virus
IMAVFFVVT

SEQ ID NO: 85738 - protein, 9 aa, Dengue virus
MAVFFVVTL

SEQ ID NO: 85739 - protein, 9 aa, Dengue virus
AVFFVVTLI

SEQ ID NO: 85740 - protein, 9 aa, Dengue virus
VFFVVTLIP

SEQ ID NO: 85741 - protein, 9 aa, Dengue virus
FFVVTLIPL

SEQ ID NO: 85742 - protein, 9 aa, Dengue virus
FAVTLIPLC

SEQ ID NO: 85743 - protein, 9 aa, Dengue virus
AVTLIPLCR

SEQ ID NO: 85744 - protein, 9 aa, Dengue virus
CLQKQSHWI

SEQ ID NO: 85745 - protein, 9 aa, Dengue virus
LQKQSHWIE

SEQ ID NO: 85746 - protein, 9 aa, Dengue virus
QKQSHWIEI

SEQ ID NO: 85747 - protein, 9 aa, Dengue virus
KQSHWIEIT

SEQ ID NO: 85748 - protein, 9 aa, Dengue virus
SHWVEITAI

SEQ ID NO: 85749 - protein, 9 aa, Dengue virus
HWVEITAII

SEQ ID NO: 85750 - protein, 9 aa, Dengue virus
WVEITAIIL

SEQ ID NO: 85751 - protein, 9 aa, Dengue virus
VEITAIILG

SEQ ID NO: 85752 - protein, 9 aa, Dengue virus
EITAIILGA

SEQ ID NO: 85753 - protein, 9 aa, Dengue virus
ITAIILGAQ

SEQ ID NO: 85754 - protein, 9 aa, Dengue virus
TAIILGAQA

SEQ ID NO: 85755 - protein, 9 aa, Dengue virus
AIILGAQAL

SEQ ID NO: 85756 - protein, 9 aa, Dengue virus
IILGAQALP

SEQ ID NO: 85757 - protein, 9 aa, Dengue virus
TLGAQALPV

SEQ ID NO: 85758 - protein, 9 aa, Dengue virus
MTLMKGASK

SEQ ID NO: 85759 - protein, 9 aa, Dengue virus
TLMKGASKR

SEQ ID NO: 85760 - protein, 9 aa, Dengue virus
LMKGASKRS

SEQ ID NO: 85761 - protein, 9 aa, Dengue virus
MKGASKRSW

SEQ ID NO: 85762 - protein, 9 aa, Dengue virus
KGASKRSWP

SEQ ID NO: 85763 - protein, 9 aa, Dengue virus
GASKRSWPL

SEQ ID NO: 85764 - protein, 9 aa, Dengue virus
ASKRSWPLN

SEQ ID NO: 85765 - protein, 9 aa, Dengue virus
SKRSWPLNE

SEQ ID NO: 85766 - protein, 9 aa, Dengue virus
KRSWPLNEG

SEQ ID NO: 85767 - protein, 9 aa, Dengue virus
SSADLSLER

SEQ ID NO: 85768 - protein, 9 aa, Dengue virus
SADLSLERA

SEQ ID NO: 85769 - protein, 9 aa, Dengue virus
ADLSLERAA

SEQ ID NO: 85770 - protein, 9 aa, Dengue virus
DLSLEKAAS

SEQ ID NO: 85771 - protein, 9 aa, Dengue virus
LSLEKAASV

SEQ ID NO: 85772 - protein, 9 aa, Dengue virus
SLEKAASVQ

SEQ ID NO: 85773 - protein, 9 aa, Dengue virus
LEKAASVQW

SEQ ID NO: 85774 - protein, 9 aa, Dengue virus
EKAASVQWD

SEQ ID NO: 85775 - protein, 9 aa, Dengue virus
KAASVQWDE

SEQ ID NO: 85776 - protein, 9 aa, Dengue virus
AASVQWDEM

SEQ ID NO: 85777 - protein, 9 aa, Dengue virus
ASVQWDEMA

SEQ ID NO: 85778 - protein, 9 aa, Dengue virus
SVQWDEMAD

SEQ ID NO: 85779 - protein, 9 aa, Dengue virus
AAITGSSPI

SEQ ID NO: 85780 - protein, 9 aa, Dengue virus
DITGSSPIV

SEQ ID NO: 85781 - protein, 9 aa, Dengue virus
ITGSSPIVE

SEQ ID NO: 85782 - protein, 9 aa, Dengue virus
TGSSPIVEV

SEQ ID NO: 85783 - protein, 9 aa, Dengue virus
GSSPIVEVK

SEQ ID NO: 85784 - protein, 9 aa, Dengue virus
SSPIVEVKQ

SEQ ID NO: 85785 - protein, 9 aa, Dengue virus
SPIVEVKQD

SEQ ID NO: 85786 - protein, 9 aa, Dengue virus
PIVEVKQDE

SEQ ID NO: 85787 - protein, 9 aa, Dengue virus
IVEVKQDED

SEQ ID NO: 85788 - protein, 9 aa, Dengue virus
VEVKQDEDG

SEQ ID NO: 85789 - protein, 9 aa, Dengue virus
DGSFSIRDI

SEQ ID NO: 85790 - protein, 9 aa, Dengue virus
GSFSIRDIE

SEQ ID NO: 85791 - protein, 9 aa, Dengue virus
SFSIRDIEE

SEQ ID NO: 85792 - protein, 9 aa, Dengue virus
FSIRDIEET

SEQ ID NO: 85793 - protein, 9 aa, Dengue virus
SIRDIEETN

SEQ ID NO: 85794 - protein, 9 aa, Dengue virus
IRDIEETNM

SEQ ID NO: 85795 - protein, 9 aa, Dengue virus
RDIEETNMI

SEQ ID NO: 85796 - protein, 9 aa, Dengue virus
DIEETNMIT

SEQ ID NO: 85797 - protein, 9 aa, Dengue virus
IEETNMITL

SEQ ID NO: 85798 - protein, 9 aa, Dengue virus
GLYPLAIPI

SEQ ID NO: 85799 - protein, 9 aa, Dengue virus
LYPLAIPIT

SEQ ID NO: 85800 - protein, 9 aa, Dengue virus
YPLAIPITM

SEQ ID NO: 85801 - protein, 9 aa, Dengue virus
PLAIPITMT

SEQ ID NO: 85802 - protein, 9 aa, Dengue virus
LAIPITMTL

SEQ ID NO: 85803 - protein, 9 aa, Dengue virus
AIPITMTLW

SEQ ID NO: 85804 - protein, 9 aa, Dengue virus
IPITMTLWY

SEQ ID NO: 85805 - protein, 9 aa, Dengue virus
PITMTLWYM

SEQ ID NO: 85806 - protein, 9 aa, Dengue virus
ITMTLWYMW

SEQ ID NO: 85807 - protein, 9 aa, Dengue virus
TMALWYIWQ

SEQ ID NO: 85808 - protein, 9 aa, Dengue virus
MALWYIWQV

SEQ ID NO: 85809 - protein, 9 aa, Dengue virus
ALWYIWQVK

SEQ ID NO: 85810 - protein, 9 aa, Dengue virus
LWYIWQVKT

SEQ ID NO: 85811 - protein, 9 aa, Dengue virus
WYIWQVKTQ

SEQ ID NO: 85812 - protein, 9 aa, Dengue virus
YIWQVKTQR

SEQ ID NO: 85813 - protein, 9 aa, Dengue virus
IWQVKTQRS

SEQ ID NO: 85814 - protein, 9 aa, Dengue virus
WQVRTQRSG

SEQ ID NO: 85815 - protein, 9 aa, Dengue virus
QVRTQRSGA

SEQ ID NO: 85816 - protein, 9 aa, Dengue virus
VRTQRSGAL

SEQ ID NO: 85817 - protein, 9 aa, Dengue virus
RTQRSGALW

SEQ ID NO: 85818 - protein, 9 aa, Dengue virus
LWDVPSPAT

SEQ ID NO: 85819 - protein, 9 aa, Dengue virus
WDVPSPAAA

SEQ ID NO: 85820 - protein, 9 aa, Dengue virus
DVPSPAATK

SEQ ID NO: 85821 - protein, 9 aa, Dengue virus
VPSPAATKK

SEQ ID NO: 85822 - protein, 9 aa, Dengue virus
PSPAATKKA

SEQ ID NO: 85823 - protein, 9 aa, Dengue virus
TKKAALSEG

SEQ ID NO: 85824 - protein, 9 aa, Dengue virus
KKAALSEGV

SEQ ID NO: 85825 - protein, 9 aa, Dengue virus
KATLSEGVY

SEQ ID NO: 85826 - protein, 9 aa, Dengue virus
ATLSEGVYR

SEQ ID NO: 85827 - protein, 9 aa, Dengue virus
TLSEGVYRI

SEQ ID NO: 85828 - protein, 9 aa, Dengue virus
LTEGVYRIM

SEQ ID NO: 85829 - protein, 9 aa, Dengue virus
TEGVYRIMQ

SEQ ID NO: 85830 - protein, 9 aa, Dengue virus
YRIMQRGLL

SEQ ID NO: 85831 - protein, 9 aa, Dengue virus
RIMQRGLLG

SEQ ID NO: 85832 - protein, 9 aa, Dengue virus
IMQRGLLGK

SEQ ID NO: 85833 - protein, 9 aa, Dengue virus
MQRGLLGKT

SEQ ID NO: 85834 - protein, 9 aa, Dengue virus
QRGLLGKTQ

SEQ ID NO: 85835 - protein, 9 aa, Dengue virus
RGLLGKTQV

SEQ ID NO: 85836 - protein, 9 aa, Dengue virus
GLLGKTQVG

SEQ ID NO: 85837 - protein, 9 aa, Dengue virus
LLGKTQVGV

SEQ ID NO: 85838 - protein, 9 aa, Dengue virus
LGKTQVGVG

SEQ ID NO: 85839 - protein, 9 aa, Dengue virus
GRTQVGVGI

SEQ ID NO: 85840 - protein, 9 aa, Dengue virus
RTQVGVGIH

SEQ ID NO: 85841 - protein, 9 aa, Dengue virus
TQVGVGIHI

SEQ ID NO: 85842 - protein, 9 aa, Dengue virus
QVGVGIHIE

SEQ ID NO: 85843 - protein, 9 aa, Dengue virus
VGVGIHIEG

SEQ ID NO: 85844 - protein, 9 aa, Dengue virus
GVGIHIEGV

SEQ ID NO: 85845 - protein, 9 aa, Dengue virus
VGIHIEGVF

SEQ ID NO: 85846 - protein, 9 aa, Dengue virus
GIHIEGVFH

SEQ ID NO: 85847 - protein, 9 aa, Dengue virus
IHIEGVFHT

SEQ ID NO: 85848 - protein, 9 aa, Dengue virus
HIEGVFHTM

SEQ ID NO: 85849 - protein, 9 aa, Dengue virus
IEGVFHTMW

SEQ ID NO: 85850 - protein, 9 aa, Dengue virus
RGSVICHES

SEQ ID NO: 85851 - protein, 9 aa, Dengue virus
GSVICHESG

SEQ ID NO: 85852 - protein, 9 aa, Dengue virus
SVICHESGR

SEQ ID NO: 85853 - protein, 9 aa, Dengue virus
VICHESGRL

SEQ ID NO: 85854 - protein, 9 aa, Dengue virus
ICHESGRLE

SEQ ID NO: 85855 - protein, 9 aa, Dengue virus
CHESGRLEP

SEQ ID NO: 85856 - protein, 9 aa, Dengue virus
HESGRLEPS

SEQ ID NO: 85857 - protein, 9 aa, Dengue virus
ESGRLEPSW

SEQ ID NO: 85858 - protein, 9 aa, Dengue virus
SGRLEPSWA

SEQ ID NO: 85859 - protein, 9 aa, Dengue virus
WRLGDKWDR

SEQ ID NO: 85860 - protein, 9 aa, Dengue virus
RLGDKWDRE

SEQ ID NO: 85861 - protein, 9 aa, Dengue virus
LGDKWDREE

SEQ ID NO: 85862 - protein, 9 aa, Dengue virus
GDKWDREED

SEQ ID NO: 85863 - protein, 9 aa, Dengue virus
DKWDREEDV

SEQ ID NO: 85864 - protein, 9 aa, Dengue virus
KWDREEDVQ

SEQ ID NO: 85865 - protein, 9 aa, Dengue virus
WDREEDVQV

SEQ ID NO: 85866 - protein, 9 aa, Dengue virus
DREEDVQVL

SEQ ID NO: 85867 - protein, 9 aa, Dengue virus
REEDVQVLA

SEQ ID NO: 85868 - protein, 9 aa, Dengue virus
EEDVQVLAV

SEQ ID NO: 85869 - protein, 9 aa, Dengue virus
EDVQVLAVE

SEQ ID NO: 85870 - protein, 9 aa, Dengue virus
DVQVLAVEP

SEQ ID NO: 85871 - protein, 9 aa, Dengue virus
VQVLAVEPG

SEQ ID NO: 85872 - protein, 9 aa, Dengue virus
QVLAVEPGK

SEQ ID NO: 85873 - protein, 9 aa, Dengue virus
VLAVEPGKN

SEQ ID NO: 85874 - protein, 9 aa, Dengue virus
LAVEPGKNP

SEQ ID NO: 85875 - protein, 9 aa, Dengue virus
AVEPGKNPK

SEQ ID NO: 85876 - protein, 9 aa, Dengue virus
VEPGKNPKH

SEQ ID NO: 85877 - protein, 9 aa, Dengue virus
TKPGLFKTI

SEQ ID NO: 85878 - protein, 9 aa, Dengue virus
KPGLFKTIT

SEQ ID NO: 85879 - protein, 9 aa, Dengue virus
PGLFKTITG

SEQ ID NO: 85880 - protein, 9 aa, Dengue virus
GLFKTITGE

SEQ ID NO: 85881 - protein, 9 aa, Dengue virus
LFKTITGEI

SEQ ID NO: 85882 - protein, 9 aa, Dengue virus
FKTITGEIG

SEQ ID NO: 85883 - protein, 9 aa, Dengue virus
KTITGEIGA

SEQ ID NO: 85884 - protein, 9 aa, Dengue virus
TITGEIGAV

SEQ ID NO: 85885 - protein, 9 aa, Dengue virus
ITGEIGAVT

SEQ ID NO: 85886 - protein, 9 aa, Dengue virus
PGTSGSPIV

SEQ ID NO: 85887 - protein, 9 aa, Dengue virus
GSSGSPIIN

SEQ ID NO: 85888 - protein, 9 aa, Dengue virus
TSGSPIINK

SEQ ID NO: 85889 - protein, 9 aa, Dengue virus
SGSPIINKK

SEQ ID NO: 85890 - protein, 9 aa, Dengue virus
GSPIINKKG

SEQ ID NO: 85891 - protein, 9 aa, Dengue virus
SPIINKKGK

SEQ ID NO: 85892 - protein, 9 aa, Dengue virus
PIINKKGKV

SEQ ID NO: 85893 - protein, 9 aa, Dengue virus
IINKKGKVI

SEQ ID NO: 85894 - protein, 9 aa, Dengue virus
INKKGKVIG

SEQ ID NO: 85895 - protein, 9 aa, Dengue virus
NKKGKVIGL

SEQ ID NO: 85896 - protein, 9 aa, Dengue virus
KKGKVIGLY

SEQ ID NO: 85897 - protein, 9 aa, Dengue virus
SAITQAERT

SEQ ID NO: 85898 - protein, 9 aa, Dengue virus
AITQAERTG

SEQ ID NO: 85899 - protein, 9 aa, Dengue virus
ITQAERTGE

SEQ ID NO: 85900 - protein, 9 aa, Dengue virus
TQAERTGEP

SEQ ID NO: 85901 - protein, 9 aa, Dengue virus
QAERTGEPD

SEQ ID NO: 85902 - protein, 9 aa, Dengue virus
AERTGEPDY

SEQ ID NO: 85903 - protein, 9 aa, Dengue virus
ERTGEPDYE

SEQ ID NO: 85904 - protein, 9 aa, Dengue virus
RTGEPDYEV

SEQ ID NO: 85905 - protein, 9 aa, Dengue virus
TGEPDYEVD

SEQ ID NO: 85906 - protein, 9 aa, Dengue virus
YQTPAVKSD

SEQ ID NO: 85907 - protein, 9 aa, Dengue virus
QTPAVKSDH

SEQ ID NO: 85908 - protein, 9 aa, Dengue virus
TPAVKAEHT

SEQ ID NO: 85909 - protein, 9 aa, Dengue virus
PAVKAEHTG

SEQ ID NO: 85910 - protein, 9 aa, Dengue virus
AVKSDHTGR

SEQ ID NO: 85911 - protein, 9 aa, Dengue virus
VKAEHTGRE

SEQ ID NO: 85912 - protein, 9 aa, Dengue virus
KSDHTGREI

SEQ ID NO: 85913 - protein, 9 aa, Dengue virus
SDHTGREIV

SEQ ID NO: 85914 - protein, 9 aa, Dengue virus
MCHATFTTK

SEQ ID NO: 85915 - protein, 9 aa, Dengue virus
CHATFTTKL

SEQ ID NO: 85916 - protein, 9 aa, Dengue virus
HATFTTKLL

SEQ ID NO: 85917 - protein, 9 aa, Dengue virus
ATFTTKLLS

SEQ ID NO: 85918 - protein, 9 aa, Dengue virus
TFTTKLLSS

SEQ ID NO: 85919 - protein, 9 aa, Dengue virus
FTTKLLSST

SEQ ID NO: 85920 - protein, 9 aa, Dengue virus
TTKLLSSTR

SEQ ID NO: 85921 - protein, 9 aa, Dengue virus
TKLLSSTRV

SEQ ID NO: 85922 - protein, 9 aa, Dengue virus
KLLSSTRVP

SEQ ID NO: 85923 - protein, 9 aa, Dengue virus
DEAHFTDPC

SEQ ID NO: 85924 - protein, 9 aa, Dengue virus
EAHFTDPCS

SEQ ID NO: 85925 - protein, 9 aa, Dengue virus
AHFTDPCSV

SEQ ID NO: 85926 - protein, 9 aa, Dengue virus
HFTDPCSVA

SEQ ID NO: 85927 - protein, 9 aa, Dengue virus
FTDPCSVAA

SEQ ID NO: 85928 - protein, 9 aa, Dengue virus
TDPCSVAAR

SEQ ID NO: 85929 - protein, 9 aa, Dengue virus
DPCSVAARG

SEQ ID NO: 85930 - protein, 9 aa, Dengue virus
PCSVAARGY

SEQ ID NO: 85931 - protein, 9 aa, Dengue virus
CSVAARGYI

SEQ ID NO: 85932 - protein, 9 aa, Dengue virus
FMTATPPGS

SEQ ID NO: 85933 - protein, 9 aa, Dengue virus
MTATPPGSI

SEQ ID NO: 85934 - protein, 9 aa, Dengue virus
TATPPGSID

SEQ ID NO: 85935 - protein, 9 aa, Dengue virus
ATPPGSIDP

SEQ ID NO: 85936 - protein, 9 aa, Dengue virus
TPPGSIDPF

SEQ ID NO: 85937 - protein, 9 aa, Dengue virus
PPGSIDPFP

SEQ ID NO: 85938 - protein, 9 aa, Dengue virus
PGSIDPFPQ

SEQ ID NO: 85939 - protein, 9 aa, Dengue virus
GSIDPFPQS

SEQ ID NO: 85940 - protein, 9 aa, Dengue virus
SIDPFPQSN

SEQ ID NO: 85941 - protein, 9 aa, Dengue virus
IDPFPQSNS

SEQ ID NO: 85942 - protein, 9 aa, Dengue virus
NCLRKSGKR

SEQ ID NO: 85943 - protein, 9 aa, Dengue virus
CLRKSGKRV

SEQ ID NO: 85944 - protein, 9 aa, Dengue virus
LRKSGKRVI

SEQ ID NO: 85945 - protein, 9 aa, Dengue virus
RKSGKRVIQ

SEQ ID NO: 85946 - protein, 9 aa, Dengue virus
KSGKRVIQL

SEQ ID NO: 85947 - protein, 9 aa, Dengue virus
SGKRVIQLS

SEQ ID NO: 85948 - protein, 9 aa, Dengue virus
GKRVIQLSR

SEQ ID NO: 85949 - protein, 9 aa, Dengue virus
KRVIQLSRK

SEQ ID NO: 85950 - protein, 9 aa, Dengue virus
RVIQLSRKT

SEQ ID NO: 85951 - protein, 9 aa, Dengue virus
RRCLKPVIS

SEQ ID NO: 85952 - protein, 9 aa, Dengue virus
RCLKPVILP

SEQ ID NO: 85953 - protein, 9 aa, Dengue virus
CLKPVILPD

SEQ ID NO: 85954 - protein, 9 aa, Dengue virus
LKPVILPDG

SEQ ID NO: 85955 - protein, 9 aa, Dengue virus
KPVILPDGP

SEQ ID NO: 85956 - protein, 9 aa, Dengue virus
PVILPDGPE

SEQ ID NO: 85957 - protein, 9 aa, Dengue virus
VILPDGPER

SEQ ID NO: 85958 - protein, 9 aa, Dengue virus
ILPDGPERV

SEQ ID NO: 85959 - protein, 9 aa, Dengue virus
LPDGPERVI

SEQ ID NO: 85960 - protein, 9 aa, Dengue virus
PDGPERVIL

SEQ ID NO: 85961 - protein, 9 aa, Dengue virus
RRGRIGRNL

SEQ ID NO: 85962 - protein, 9 aa, Dengue virus
RGRIGRNLA

SEQ ID NO: 85963 - protein, 9 aa, Dengue virus
GRIGRNLAQ

SEQ ID NO: 85964 - protein, 9 aa, Dengue virus
RIGRNLAQE

SEQ ID NO: 85965 - protein, 9 aa, Dengue virus
IGRNLAQED

SEQ ID NO: 85966 - protein, 9 aa, Dengue virus
GRNLAQEDD

SEQ ID NO: 85967 - protein, 9 aa, Dengue virus
RNLAQEDDQ

SEQ ID NO: 85968 - protein, 9 aa, Dengue virus
NLAQEDDQY

SEQ ID NO: 85969 - protein, 9 aa, Dengue virus
LAQEDDQYV

SEQ ID NO: 85970 - protein, 9 aa, Dengue virus
TQEDDQYVF

SEQ ID NO: 85971 - protein, 9 aa, Dengue virus
YVFSGDPLR

SEQ ID NO: 85972 - protein, 9 aa, Dengue virus
VFSGDPLRN

SEQ ID NO: 85973 - protein, 9 aa, Dengue virus
FSGDPLRND

SEQ ID NO: 85974 - protein, 9 aa, Dengue virus
SGDPLRNDE

SEQ ID NO: 85975 - protein, 9 aa, Dengue virus
GDPLRNDED

SEQ ID NO: 85976 - protein, 9 aa, Dengue virus
DPLRNDEDH

SEQ ID NO: 85977 - protein, 9 aa, Dengue virus
PLRNDEDHA

SEQ ID NO: 85978 - protein, 9 aa, Dengue virus
LRNDEDHAH

SEQ ID NO: 85979 - protein, 9 aa, Dengue virus
RNDEDHAHW

SEQ ID NO: 85980 - protein, 9 aa, Dengue virus
LFGPEREKN

SEQ ID NO: 85981 - protein, 9 aa, Dengue virus
FGPEREKNQ

SEQ ID NO: 85982 - protein, 9 aa, Dengue virus
GPEREKNQA

SEQ ID NO: 85983 - protein, 9 aa, Dengue virus
PEREKNQAI

SEQ ID NO: 85984 - protein, 9 aa, Dengue virus
EREKNQAID

SEQ ID NO: 85985 - protein, 9 aa, Dengue virus
REKNQAIDG

SEQ ID NO: 85986 - protein, 9 aa, Dengue virus
EKNQAIDGE

SEQ ID NO: 85987 - protein, 9 aa, Dengue virus
KNQAIDGEF

SEQ ID NO: 85988 - protein, 9 aa, Dengue virus
NQAIDGEFR

SEQ ID NO: 85989 - protein, 9 aa, Dengue virus
RKTFVELMK

SEQ ID NO: 85990 - protein, 9 aa, Dengue virus
KTFVELMKR

SEQ ID NO: 85991 - protein, 9 aa, Dengue virus
TFVELMKRG

SEQ ID NO: 85992 - protein, 9 aa, Dengue virus
FVELMKRGD

SEQ ID NO: 85993 - protein, 9 aa, Dengue virus
VELMKRGDL

SEQ ID NO: 85994 - protein, 9 aa, Dengue virus
ELMKRGDLP

SEQ ID NO: 85995 - protein, 9 aa, Dengue virus
LMKRGDLPV

SEQ ID NO: 85996 - protein, 9 aa, Dengue virus
MKRGDLPVW

SEQ ID NO: 85997 - protein, 9 aa, Dengue virus
KRGDLPVWL

SEQ ID NO: 85998 - protein, 9 aa, Dengue virus
VASAGISYE

SEQ ID NO: 85999 - protein, 9 aa, Dengue virus
ASAGISYED

SEQ ID NO: 86000 - protein, 9 aa, Dengue virus
SAGISYEDR

SEQ ID NO: 86001 - protein, 9 aa, Dengue virus
AGISYEDRE

SEQ ID NO: 86002 - protein, 9 aa, Dengue virus
GISYEDREW

SEQ ID NO: 86003 - protein, 9 aa, Dengue virus
ISYEDREWC

SEQ ID NO: 86004 - protein, 9 aa, Dengue virus
SYEDREWCF

SEQ ID NO: 86005 - protein, 9 aa, Dengue virus
YEDREWCFT

SEQ ID NO: 86006 - protein, 9 aa, Dengue virus
EDREWCFTG

SEQ ID NO: 86007 - protein, 9 aa, Dengue virus
GEKKKLRPK

SEQ ID NO: 86008 - protein, 9 aa, Dengue virus
EKKKLRPKW

SEQ ID NO: 86009 - protein, 9 aa, Dengue virus
KKKLRPKWL

SEQ ID NO: 86010 - protein, 9 aa, Dengue virus
KKLRPKWLD

SEQ ID NO: 86011 - protein, 9 aa, Dengue virus
KLRPKWLDA

SEQ ID NO: 86012 - protein, 9 aa, Dengue virus
LRPKWLDAR

SEQ ID NO: 86013 - protein, 9 aa, Dengue virus
RPKWLDARV

SEQ ID NO: 86014 - protein, 9 aa, Dengue virus
PKWLDARVY

SEQ ID NO: 86015 - protein, 9 aa, Dengue virus
KWLDARVYA

SEQ ID NO: 86016 - protein, 9 aa, Dengue virus
LDILTEIAT

SEQ ID NO: 86017 - protein, 9 aa, Dengue virus
DILTEIATL

SEQ ID NO: 86018 - protein, 9 aa, Dengue virus
ILTEIATLP

SEQ ID NO: 86019 - protein, 9 aa, Dengue virus
LTEIATLPT

SEQ ID NO: 86020 - protein, 9 aa, Dengue virus
TEIATLPTY

SEQ ID NO: 86021 - protein, 9 aa, Dengue virus
EIATLPTYL

SEQ ID NO: 86022 - protein, 9 aa, Dengue virus
IATLPTYLS

SEQ ID NO: 86023 - protein, 9 aa, Dengue virus
ATLPTYLSS

SEQ ID NO: 86024 - protein, 9 aa, Dengue virus
TLPTYLSSK

SEQ ID NO: 86025 - protein, 9 aa, Dengue virus
LPTYLSSKA

SEQ ID NO: 86026 - protein, 9 aa, Dengue virus
PTYLSSKAK

SEQ ID NO: 86027 - protein, 9 aa, Dengue virus
TYLSSKAKL

SEQ ID NO: 86028 - protein, 9 aa, Dengue virus
YLSSKAKLA

SEQ ID NO: 86029 - protein, 9 aa, Dengue virus
LSSKAKLAL

SEQ ID NO: 86030 - protein, 9 aa, Dengue virus
SSKAKLALD

SEQ ID NO: 86031 - protein, 9 aa, Dengue virus
SKAKLALDN

SEQ ID NO: 86032 - protein, 9 aa, Dengue virus
KAKLALDNI

SEQ ID NO: 86033 - protein, 9 aa, Dengue virus
IVMLHTTEK

SEQ ID NO: 86034 - protein, 9 aa, Dengue virus
VMLHTTEKG

SEQ ID NO: 86035 - protein, 9 aa, Dengue virus
MLHTTEKGG

SEQ ID NO: 86036 - protein, 9 aa, Dengue virus
LHTTEKGGR

SEQ ID NO: 86037 - protein, 9 aa, Dengue virus
HTTEKGGRA

SEQ ID NO: 86038 - protein, 9 aa, Dengue virus
TTEKGGRAY

SEQ ID NO: 86039 - protein, 9 aa, Dengue virus
TEKGGRAYQ

SEQ ID NO: 86040 - protein, 9 aa, Dengue virus
EKGGRAYQH

SEQ ID NO: 86041 - protein, 9 aa, Dengue virus
KGGRAYQHA

SEQ ID NO: 86042 - protein, 9 aa, Dengue virus
GGKAYQHAL

SEQ ID NO: 86043 - protein, 9 aa, Dengue virus
GKAYQHALN

SEQ ID NO: 86044 - protein, 9 aa, Dengue virus
KAYQHALNE

SEQ ID NO: 86045 - protein, 9 aa, Dengue virus
ESLETLMLI

SEQ ID NO: 86046 - protein, 9 aa, Dengue virus
SLETLMLIA

SEQ ID NO: 86047 - protein, 9 aa, Dengue virus
LETLMLIAL

SEQ ID NO: 86048 - protein, 9 aa, Dengue virus
ETLMLIALL

SEQ ID NO: 86049 - protein, 9 aa, Dengue virus
TLMLIALLG

SEQ ID NO: 86050 - protein, 9 aa, Dengue virus
LMLIALLGA

SEQ ID NO: 86051 - protein, 9 aa, Dengue virus
MLIALLGAM

SEQ ID NO: 86052 - protein, 9 aa, Dengue virus
LIALLGAMT

SEQ ID NO: 86053 - protein, 9 aa, Dengue virus
IALLGAMTA

SEQ ID NO: 86054 - protein, 9 aa, Dengue virus
LLGAMTAGT

SEQ ID NO: 86055 - protein, 9 aa, Dengue virus
LGAMTAGTF

SEQ ID NO: 86056 - protein, 9 aa, Dengue virus
GAMTAGTFL

SEQ ID NO: 86057 - protein, 9 aa, Dengue virus
AMTAGTFLF

SEQ ID NO: 86058 - protein, 9 aa, Dengue virus
MTAGTFLFF

SEQ ID NO: 86059 - protein, 9 aa, Dengue virus
TAGTFLFFM

SEQ ID NO: 86060 - protein, 9 aa, Dengue virus
AGTFLFFMQ

SEQ ID NO: 86061 - protein, 9 aa, Dengue virus
GTFLFFMQG

SEQ ID NO: 86062 - protein, 9 aa, Dengue virus
TFLFFMQGK

SEQ ID NO: 86063 - protein, 9 aa, Dengue virus
LFFMQGKGM

SEQ ID NO: 86064 - protein, 9 aa, Dengue virus
FFMQGKGMG

SEQ ID NO: 86065 - protein, 9 aa, Dengue virus
FMQGKGMGK

SEQ ID NO: 86066 - protein, 9 aa, Dengue virus
MQGKGMGKL

SEQ ID NO: 86067 - protein, 9 aa, Dengue virus
QGKGMGKLS

SEQ ID NO: 86068 - protein, 9 aa, Dengue virus
GKGIGKLSV

SEQ ID NO: 86069 - protein, 9 aa, Dengue virus
KGMGKLSMG

SEQ ID NO: 86070 - protein, 9 aa, Dengue virus
GIGKLSVGL

SEQ ID NO: 86071 - protein, 9 aa, Dengue virus
MGKLSMGLI

SEQ ID NO: 86072 - protein, 9 aa, Dengue virus
GKLSMGLIA

SEQ ID NO: 86073 - protein, 9 aa, Dengue virus
KLSMGLIAI

SEQ ID NO: 86074 - protein, 9 aa, Dengue virus
LSMGLIAIA

SEQ ID NO: 86075 - protein, 9 aa, Dengue virus
SMGLIAIAV

SEQ ID NO: 86076 - protein, 9 aa, Dengue virus
MGLIAIAVA

SEQ ID NO: 86077 - protein, 9 aa, Dengue virus
GLIAIAVAS

SEQ ID NO: 86078 - protein, 9 aa, Dengue virus
LIAIAVASG

SEQ ID NO: 86079 - protein, 9 aa, Dengue virus
IAIAVASGL

SEQ ID NO: 86080 - protein, 9 aa, Dengue virus
AIAVASGLL

SEQ ID NO: 86081 - protein, 9 aa, Dengue virus
IAMASGLLW

SEQ ID NO: 86082 - protein, 9 aa, Dengue virus
AMASGLLWI

SEQ ID NO: 86083 - protein, 9 aa, Dengue virus
MASGLLWIA

SEQ ID NO: 86084 - protein, 9 aa, Dengue virus
ASGLLWIAE

SEQ ID NO: 86085 - protein, 9 aa, Dengue virus
SGLLWIAEI

SEQ ID NO: 86086 - protein, 9 aa, Dengue virus
GLLWIAEIQ

SEQ ID NO: 86087 - protein, 9 aa, Dengue virus
LLWIAEIQP

SEQ ID NO: 86088 - protein, 9 aa, Dengue virus
LWIAEIQPQ

SEQ ID NO: 86089 - protein, 9 aa, Dengue virus
WIAEIQPQW

SEQ ID NO: 86090 - protein, 9 aa, Dengue virus
IAEIQPQWI

SEQ ID NO: 86091 - protein, 9 aa, Dengue virus
AELQPQWIA

SEQ ID NO: 86092 - protein, 9 aa, Dengue virus
ELQPQWIAA

SEQ ID NO: 86093 - protein, 9 aa, Dengue virus
LQPQWIAAS

SEQ ID NO: 86094 - protein, 9 aa, Dengue virus
EFFLMVLLV

SEQ ID NO: 86095 - protein, 9 aa, Dengue virus
FFLMVLLVP

SEQ ID NO: 86096 - protein, 9 aa, Dengue virus
FLMVLLVPE

SEQ ID NO: 86097 - protein, 9 aa, Dengue virus
LMVLLVPEP

SEQ ID NO: 86098 - protein, 9 aa, Dengue virus
MVLLVPEPE

SEQ ID NO: 86099 - protein, 9 aa, Dengue virus
VLLVPEPEK

SEQ ID NO: 86100 - protein, 9 aa, Dengue virus
LLVPEPEKQ

SEQ ID NO: 86101 - protein, 9 aa, Dengue virus
LVPEPEKQR

SEQ ID NO: 86102 - protein, 9 aa, Dengue virus
VPEPEKQRT

SEQ ID NO: 86103 - protein, 9 aa, Dengue virus
NQLIYVILA

SEQ ID NO: 86104 - protein, 9 aa, Dengue virus
QLIYVILAI

SEQ ID NO: 86105 - protein, 9 aa, Dengue virus
LIYVILAIL

SEQ ID NO: 86106 - protein, 9 aa, Dengue virus
IYVILAILT

SEQ ID NO: 86107 - protein, 9 aa, Dengue virus
YVILAILTI

SEQ ID NO: 86108 - protein, 9 aa, Dengue virus
VILAILTII

SEQ ID NO: 86109 - protein, 9 aa, Dengue virus
ILAILTIIG

SEQ ID NO: 86110 - protein, 9 aa, Dengue virus
LAILTIIGL

SEQ ID NO: 86111 - protein, 9 aa, Dengue virus
ILTIIGLVA

SEQ ID NO: 86112 - protein, 9 aa, Dengue virus
LTIIGLVAA

SEQ ID NO: 86113 - protein, 9 aa, Dengue virus
TIIGLVAAN

SEQ ID NO: 86114 - protein, 9 aa, Dengue virus
IIGLVAANE

SEQ ID NO: 86115 - protein, 9 aa, Dengue virus
IGLVAANEM

SEQ ID NO: 86116 - protein, 9 aa, Dengue virus
GLVAANEMG

SEQ ID NO: 86117 - protein, 9 aa, Dengue virus
LVAANEMGL

SEQ ID NO: 86118 - protein, 9 aa, Dengue virus
VAANEMGLI

SEQ ID NO: 86119 - protein, 9 aa, Dengue virus
MGLIEKTKA

SEQ ID NO: 86120 - protein, 9 aa, Dengue virus
GLIEKTKAD

SEQ ID NO: 86121 - protein, 9 aa, Dengue virus
LIEKTKADF

SEQ ID NO: 86122 - protein, 9 aa, Dengue virus
IEKTKADFG

SEQ ID NO: 86123 - protein, 9 aa, Dengue virus
EKTKADFGF

SEQ ID NO: 86124 - protein, 9 aa, Dengue virus
KTKADFGFY

SEQ ID NO: 86125 - protein, 9 aa, Dengue virus
TKADFGFYQ

SEQ ID NO: 86126 - protein, 9 aa, Dengue virus
KTDFGFYQA

SEQ ID NO: 86127 - protein, 9 aa, Dengue virus
TDFGFYQAK

SEQ ID NO: 86128 - protein, 9 aa, Dengue virus
DFGFYQAKT

SEQ ID NO: 86129 - protein, 9 aa, Dengue virus
FGFYQAKTE

SEQ ID NO: 86130 - protein, 9 aa, Dengue virus
GFYQAKTET

SEQ ID NO: 86131 - protein, 9 aa, Dengue virus
FYQAKTETT

SEQ ID NO: 86132 - protein, 9 aa, Dengue virus
YQAKTETTI

SEQ ID NO: 86133 - protein, 9 aa, Dengue virus
QAKTETTIL

SEQ ID NO: 86134 - protein, 9 aa, Dengue virus
AKTETTILD

SEQ ID NO: 86135 - protein, 9 aa, Dengue virus
KTEITILDV

SEQ ID NO: 86136 - protein, 9 aa, Dengue virus
AETTILDVD

SEQ ID NO: 86137 - protein, 9 aa, Dengue virus
TLYAVVTTI

SEQ ID NO: 86138 - protein, 9 aa, Dengue virus
LYAVVTTIL

SEQ ID NO: 86139 - protein, 9 aa, Dengue virus
YAVVTTILT

SEQ ID NO: 86140 - protein, 9 aa, Dengue virus
AVVTTILTP

SEQ ID NO: 86141 - protein, 9 aa, Dengue virus
VVTTILTPM

SEQ ID NO: 86142 - protein, 9 aa, Dengue virus
VTTILTPML

SEQ ID NO: 86143 - protein, 9 aa, Dengue virus
LSLTAIANQ

SEQ ID NO: 86144 - protein, 9 aa, Dengue virus
SLAAIANHA

SEQ ID NO: 86145 - protein, 9 aa, Dengue virus
LTAIANQAA

SEQ ID NO: 86146 - protein, 9 aa, Dengue virus
TAIANQAAV

SEQ ID NO: 86147 - protein, 9 aa, Dengue virus
GKGWPLHRV

SEQ ID NO: 86148 - protein, 9 aa, Dengue virus
KGWPLHRVD

SEQ ID NO: 86149 - protein, 9 aa, Dengue virus
GWPLHRVDL

SEQ ID NO: 86150 - protein, 9 aa, Dengue virus
WPLHRVDLG

SEQ ID NO: 86151 - protein, 9 aa, Dengue virus
PLHRVDLGV

SEQ ID NO: 86152 - protein, 9 aa, Dengue virus
LHRVDLGVP

SEQ ID NO: 86153 - protein, 9 aa, Dengue virus
HRVDLGVPL

SEQ ID NO: 86154 - protein, 9 aa, Dengue virus
RVDLGVPLL

SEQ ID NO: 86155 - protein, 9 aa, Dengue virus
VDLGVPLLA

SEQ ID NO: 86156 - protein, 9 aa, Dengue virus
SQVNPTTLI

SEQ ID NO: 86157 - protein, 9 aa, Dengue virus
QVNPTTLIA

SEQ ID NO: 86158 - protein, 9 aa, Dengue virus
VNPTTLIAS

SEQ ID NO: 86159 - protein, 9 aa, Dengue virus
NPTTLIASL

SEQ ID NO: 86160 - protein, 9 aa, Dengue virus
PTTLIASLV

SEQ ID NO: 86161 - protein, 9 aa, Dengue virus
TTLIASLVM

SEQ ID NO: 86162 - protein, 9 aa, Dengue virus
TLIASLVML

SEQ ID NO: 86163 - protein, 9 aa, Dengue virus
LTASLVMLS

SEQ ID NO: 86164 - protein, 9 aa, Dengue virus
TASLVMLSV

SEQ ID NO: 86165 - protein, 9 aa, Dengue virus
ASLVMLSVH

SEQ ID NO: 86166 - protein, 9 aa, Dengue virus
SLVMLSVHY

SEQ ID NO: 86167 - protein, 9 aa, Dengue virus
LVMLSVHYA

SEQ ID NO: 86168 - protein, 9 aa, Dengue virus
VMLSVHYAI

SEQ ID NO: 86169 - protein, 9 aa, Dengue virus
MLSVHYAII

SEQ ID NO: 86170 - protein, 9 aa, Dengue virus
LSVHYAIIG

SEQ ID NO: 86171 - protein, 9 aa, Dengue virus
SVHYAIIGP

SEQ ID NO: 86172 - protein, 9 aa, Dengue virus
QVMLLVLCV

SEQ ID NO: 86173 - protein, 9 aa, Dengue virus
VMLLVLCVG

SEQ ID NO: 86174 - protein, 9 aa, Dengue virus
MLLVLCVGQ

SEQ ID NO: 86175 - protein, 9 aa, Dengue virus
LLVLCVGQL

SEQ ID NO: 86176 - protein, 9 aa, Dengue virus
LVLCVGQLL

SEQ ID NO: 86177 - protein, 9 aa, Dengue virus
VLCVGQLLL

SEQ ID NO: 86178 - protein, 9 aa, Dengue virus
LCVGQLLLM

SEQ ID NO: 86179 - protein, 9 aa, Dengue virus
CVGQLLLMR

SEQ ID NO: 86180 - protein, 9 aa, Dengue virus
VGQLLLMRT

SEQ ID NO: 86181 - protein, 9 aa, Dengue virus
GQLFLMRTT

SEQ ID NO: 86182 - protein, 9 aa, Dengue virus
QLFLMRTTW

SEQ ID NO: 86183 - protein, 9 aa, Dengue virus
LFLMRTTWA

SEQ ID NO: 86184 - protein, 9 aa, Dengue virus
LLMRTTWAL

SEQ ID NO: 86185 - protein, 9 aa, Dengue virus
LMRTTWALC

SEQ ID NO: 86186 - protein, 9 aa, Dengue virus
MRTTWALCE

SEQ ID NO: 86187 - protein, 9 aa, Dengue virus
RTTWALCEV

SEQ ID NO: 86188 - protein, 9 aa, Dengue virus
TTWALCEVL

SEQ ID NO: 86189 - protein, 9 aa, Dengue virus
TWALCEVLT

SEQ ID NO: 86190 - protein, 9 aa, Dengue virus
WALCEVLTL

SEQ ID NO: 86191 - protein, 9 aa, Dengue virus
ALCEVLTLA

SEQ ID NO: 86192 - protein, 9 aa, Dengue virus
LCEVLTLAT

SEQ ID NO: 86193 - protein, 9 aa, Dengue virus
VLTLATGPV

SEQ ID NO: 86194 - protein, 9 aa, Dengue virus
LTLATGPIM

SEQ ID NO: 86195 - protein, 9 aa, Dengue virus
TLATGPIMT

SEQ ID NO: 86196 - protein, 9 aa, Dengue virus
LATGPIMTL

SEQ ID NO: 86197 - protein, 9 aa, Dengue virus
ATGPIMTLW

SEQ ID NO: 86198 - protein, 9 aa, Dengue virus
TGPIMTLWE

SEQ ID NO: 86199 - protein, 9 aa, Dengue virus
GPIMTLWEG

SEQ ID NO: 86200 - protein, 9 aa, Dengue virus
PIMTLWEGN

SEQ ID NO: 86201 - protein, 9 aa, Dengue virus
IMTLWEGNP

SEQ ID NO: 86202 - protein, 9 aa, Dengue virus
MTLWEGNPG

SEQ ID NO: 86203 - protein, 9 aa, Dengue virus
LAFSLIKNV

SEQ ID NO: 86204 - protein, 9 aa, Dengue virus
AFSLIKNVQ

SEQ ID NO: 86205 - protein, 9 aa, Dengue virus
FSLIKNVQT

SEQ ID NO: 86206 - protein, 9 aa, Dengue virus
SLIKNVQTP

SEQ ID NO: 86207 - protein, 9 aa, Dengue virus
LIKNVQTPR

SEQ ID NO: 86208 - protein, 9 aa, Dengue virus
IKNVQTPRR

SEQ ID NO: 86209 - protein, 9 aa, Dengue virus
KNVQTPRRG

SEQ ID NO: 86210 - protein, 9 aa, Dengue virus
NVQTPRRGT

SEQ ID NO: 86211 - protein, 9 aa, Dengue virus
VQTPRRGTG

SEQ ID NO: 86212 - protein, 9 aa, Dengue virus
QTPRRGTGI

SEQ ID NO: 86213 - protein, 9 aa, Dengue virus
APRRGTGTT

SEQ ID NO: 86214 - protein, 9 aa, Dengue virus
PRRGTGITG

SEQ ID NO: 86215 - protein, 9 aa, Dengue virus
RRGTGTIGE

SEQ ID NO: 86216 - protein, 9 aa, Dengue virus
RGTGTIGET

SEQ ID NO: 86217 - protein, 9 aa, Dengue virus
GTGTIGETL

SEQ ID NO: 86218 - protein, 9 aa, Dengue virus
TGITGETLG

SEQ ID NO: 86219 - protein, 9 aa, Dengue virus
GTIGETLGE

SEQ ID NO: 86220 - protein, 9 aa, Dengue virus
ITGETLGEK

SEQ ID NO: 86221 - protein, 9 aa, Dengue virus
RQLNSLDRR

SEQ ID NO: 86222 - protein, 9 aa, Dengue virus
QLNSLDRRE

SEQ ID NO: 86223 - protein, 9 aa, Dengue virus
LNSLDRREF

SEQ ID NO: 86224 - protein, 9 aa, Dengue virus
NSLDRREFE

SEQ ID NO: 86225 - protein, 9 aa, Dengue virus
SLDRREFEE

SEQ ID NO: 86226 - protein, 9 aa, Dengue virus
LDRREFEEY

SEQ ID NO: 86227 - protein, 9 aa, Dengue virus
DRREFEEYK

SEQ ID NO: 86228 - protein, 9 aa, Dengue virus
EEYKRSGII

SEQ ID NO: 86229 - protein, 9 aa, Dengue virus
EYKRSGIIE

SEQ ID NO: 86230 - protein, 9 aa, Dengue virus
YKRSGIIEV

SEQ ID NO: 86231 - protein, 9 aa, Dengue virus
KRSGIIEVD

SEQ ID NO: 86232 - protein, 9 aa, Dengue virus
RSGIIEVDR

SEQ ID NO: 86233 - protein, 9 aa, Dengue virus
SGIIEVDRT

SEQ ID NO: 86234 - protein, 9 aa, Dengue virus
GIIEVDRTE

SEQ ID NO: 86235 - protein, 9 aa, Dengue virus
IIEVDRTEA

SEQ ID NO: 86236 - protein, 9 aa, Dengue virus
IEVDRTEAK

SEQ ID NO: 86237 - protein, 9 aa, Dengue virus
RTEAKSALR

SEQ ID NO: 86238 - protein, 9 aa, Dengue virus
TEAKSALRD

SEQ ID NO: 86239 - protein, 9 aa, Dengue virus
EAKSALRDG

SEQ ID NO: 86240 - protein, 9 aa, Dengue virus
AKSALRDGS

SEQ ID NO: 86241 - protein, 9 aa, Dengue virus
KSALRDGSK

SEQ ID NO: 86242 - protein, 9 aa, Dengue virus
SALRDGSKI

SEQ ID NO: 86243 - protein, 9 aa, Dengue virus
ALRDGSKIK

SEQ ID NO: 86244 - protein, 9 aa, Dengue virus
LRDGSKIKH

SEQ ID NO: 86245 - protein, 9 aa, Dengue virus
RDGSKIKHA

SEQ ID NO: 86246 - protein, 9 aa, Dengue virus
DGSKTKHAV

SEQ ID NO: 86247 - protein, 9 aa, Dengue virus
GSKTKHAVS

SEQ ID NO: 86248 - protein, 9 aa, Dengue virus
SKTKHAVSR

SEQ ID NO: 86249 - protein, 9 aa, Dengue virus
KTKHAVSRG

SEQ ID NO: 86250 - protein, 9 aa, Dengue virus
TKHAVSRGS

SEQ ID NO: 86251 - protein, 9 aa, Dengue virus
KYAVSRGTS

SEQ ID NO: 86252 - protein, 9 aa, Dengue virus
YAVSRGTSK

SEQ ID NO: 86253 - protein, 9 aa, Dengue virus
AVSRGTSKI

SEQ ID NO: 86254 - protein, 9 aa, Dengue virus
VSRGTSKIR

SEQ ID NO: 86255 - protein, 9 aa, Dengue virus
SRGTSKIRW

SEQ ID NO: 86256 - protein, 9 aa, Dengue virus
RGTSKIRWI

SEQ ID NO: 86257 - protein, 9 aa, Dengue virus
GTSKIRWIV

SEQ ID NO: 86258 - protein, 9 aa, Dengue virus
TSKIRWIVE

SEQ ID NO: 86259 - protein, 9 aa, Dengue virus
RWIVERGMI

SEQ ID NO: 86260 - protein, 9 aa, Dengue virus
WIVERGMIK

SEQ ID NO: 86261 - protein, 9 aa, Dengue virus
IVERGMIKP

SEQ ID NO: 86262 - protein, 9 aa, Dengue virus
VERGMIKPK

SEQ ID NO: 86263 - protein, 9 aa, Dengue virus
ERGMIKPKG

SEQ ID NO: 86264 - protein, 9 aa, Dengue virus
RGMIKPKGK

SEQ ID NO: 86265 - protein, 9 aa, Dengue virus
GMIKPKGKV

SEQ ID NO: 86266 - protein, 9 aa, Dengue virus
MIKPKGKVV

SEQ ID NO: 86267 - protein, 9 aa, Dengue virus
IKPKGKVVD

SEQ ID NO: 86268 - protein, 9 aa, Dengue virus
KPKGKIVDL

SEQ ID NO: 86269 - protein, 9 aa, Dengue virus
PKGKVIDLG

SEQ ID NO: 86270 - protein, 9 aa, Dengue virus
KGKIVDLGC

SEQ ID NO: 86271 - protein, 9 aa, Dengue virus
GKVIDLGCG

SEQ ID NO: 86272 - protein, 9 aa, Dengue virus
KIVDLGCGR

SEQ ID NO: 86273 - protein, 9 aa, Dengue virus
VIDLGCGRG

SEQ ID NO: 86274 - protein, 9 aa, Dengue virus
TLKNVTEVR

SEQ ID NO: 86275 - protein, 9 aa, Dengue virus
LKNVTEVRG

SEQ ID NO: 86276 - protein, 9 aa, Dengue virus
KNVTEVRGF

SEQ ID NO: 86277 - protein, 9 aa, Dengue virus
NVTEVRGFT

SEQ ID NO: 86278 - protein, 9 aa, Dengue virus
VTEVRGFTK

SEQ ID NO: 86279 - protein, 9 aa, Dengue virus
TEVRGFTKG

SEQ ID NO: 86280 - protein, 9 aa, Dengue virus
EVRGFTKGG

SEQ ID NO: 86281 - protein, 9 aa, Dengue virus
VRGFTKGGP

SEQ ID NO: 86282 - protein, 9 aa, Dengue virus
RGFTKGGPG

SEQ ID NO: 86283 - protein, 9 aa, Dengue virus
GFTKGGPGH

SEQ ID NO: 86284 - protein, 9 aa, Dengue virus
FTKGGPGHE

SEQ ID NO: 86285 - protein, 9 aa, Dengue virus
HSGVDVFYR

SEQ ID NO: 86286 - protein, 9 aa, Dengue virus
SGVDVFYRP

SEQ ID NO: 86287 - protein, 9 aa, Dengue virus
GVDVFYRPT

SEQ ID NO: 86288 - protein, 9 aa, Dengue virus
VDVFYRPTE

SEQ ID NO: 86289 - protein, 9 aa, Dengue virus
DVFYRPTEQ

SEQ ID NO: 86290 - protein, 9 aa, Dengue virus
VFYRPTEQV

SEQ ID NO: 86291 - protein, 9 aa, Dengue virus
FYRPTEQVD

SEQ ID NO: 86292 - protein, 9 aa, Dengue virus
YRPTEQVDT

SEQ ID NO: 86293 - protein, 9 aa, Dengue virus
RPTEQVDTL

SEQ ID NO: 86294 - protein, 9 aa, Dengue virus
EELEKLQRR

SEQ ID NO: 86295 - protein, 9 aa, Dengue virus
ELEKLQRRH

SEQ ID NO: 86296 - protein, 9 aa, Dengue virus
LEKLQRRHG

SEQ ID NO: 86297 - protein, 9 aa, Dengue virus
EKLQRRHGG

SEQ ID NO: 86298 - protein, 9 aa, Dengue virus
KLQRRHGGS

SEQ ID NO: 86299 - protein, 9 aa, Dengue virus
LQRRHGGSL

SEQ ID NO: 86300 - protein, 9 aa, Dengue virus
QRRHGGSLV

SEQ ID NO: 86301 - protein, 9 aa, Dengue virus
RRHGGSLVR

SEQ ID NO: 86302 - protein, 9 aa, Dengue virus
RHGGSLVRC

SEQ ID NO: 86303 - protein, 9 aa, Dengue virus
HGGSLVRCP

SEQ ID NO: 86304 - protein, 9 aa, Dengue virus
GGSLVRCPL

SEQ ID NO: 86305 - protein, 9 aa, Dengue virus
GSLVRCPLS

SEQ ID NO: 86306 - protein, 9 aa, Dengue virus
SLVRCPLSR

SEQ ID NO: 86307 - protein, 9 aa, Dengue virus
LIRCPLSRN

SEQ ID NO: 86308 - protein, 9 aa, Dengue virus
IRCPLSRNS

SEQ ID NO: 86309 - protein, 9 aa, Dengue virus
HEMYWVSGV

SEQ ID NO: 86310 - protein, 9 aa, Dengue virus
EMYWVSGVS

SEQ ID NO: 86311 - protein, 9 aa, Dengue virus
MYWVSGVSG

SEQ ID NO: 86312 - protein, 9 aa, Dengue virus
YWVSGVSGN

SEQ ID NO: 86313 - protein, 9 aa, Dengue virus
WVSGVSGNI

SEQ ID NO: 86314 - protein, 9 aa, Dengue virus
VSGVSGNIV

SEQ ID NO: 86315 - protein, 9 aa, Dengue virus
SGVSGNIVS

SEQ ID NO: 86316 - protein, 9 aa, Dengue virus
GVSGNIVSS

SEQ ID NO: 86317 - protein, 9 aa, Dengue virus
VSGNIVSSV

SEQ ID NO: 86318 - protein, 9 aa, Dengue virus
NIVSSVNTI

SEQ ID NO: 86319 - protein, 9 aa, Dengue virus
IVSSVNTIS

SEQ ID NO: 86320 - protein, 9 aa, Dengue virus
VSSVNTISK

SEQ ID NO: 86321 - protein, 9 aa, Dengue virus
SSVNTISKM

SEQ ID NO: 86322 - protein, 9 aa, Dengue virus
SVNTISKML

SEQ ID NO: 86323 - protein, 9 aa, Dengue virus
VNTISKMLL

SEQ ID NO: 86324 - protein, 9 aa, Dengue virus
NTISKMLLN

SEQ ID NO: 86325 - protein, 9 aa, Dengue virus
TISKMLLNR

SEQ ID NO: 86326 - protein, 9 aa, Dengue virus
ISKMLLNRF

SEQ ID NO: 86327 - protein, 9 aa, Dengue virus
MLLNWFTTR

SEQ ID NO: 86328 - protein, 9 aa, Dengue virus
LLNWFTTRH

SEQ ID NO: 86329 - protein, 9 aa, Dengue virus
LNWFTTRHR

SEQ ID NO: 86330 - protein, 9 aa, Dengue virus
NRFTTRHRR

SEQ ID NO: 86331 - protein, 9 aa, Dengue virus
RFTTRHRRP

SEQ ID NO: 86332 - protein, 9 aa, Dengue virus
FTTRHRRPT

SEQ ID NO: 86333 - protein, 9 aa, Dengue virus
TTKHRKPTY

SEQ ID NO: 86334 - protein, 9 aa, Dengue virus
TKHRKPTYE

SEQ ID NO: 86335 - protein, 9 aa, Dengue virus
KHRKPTYEK

SEQ ID NO: 86336 - protein, 9 aa, Dengue virus
RKPTYEKDA

SEQ ID NO: 86337 - protein, 9 aa, Dengue virus
KPTYEKDAD

SEQ ID NO: 86338 - protein, 9 aa, Dengue virus
PTYEKDADL

SEQ ID NO: 86339 - protein, 9 aa, Dengue virus
TYEKDADLG

SEQ ID NO: 86340 - protein, 9 aa, Dengue virus
YEKDADLGA

SEQ ID NO: 86341 - protein, 9 aa, Dengue virus
EKDADLGAG

SEQ ID NO: 86342 - protein, 9 aa, Dengue virus
KDADLGAGT

SEQ ID NO: 86343 - protein, 9 aa, Dengue virus
DADLGAGTR

SEQ ID NO: 86344 - protein, 9 aa, Dengue virus
ADLGAGTRS

SEQ ID NO: 86345 - protein, 9 aa, Dengue virus
EPENPDMTI

SEQ ID NO: 86346 - protein, 9 aa, Dengue virus
PENPDMTII

SEQ ID NO: 86347 - protein, 9 aa, Dengue virus
ENPDMTIIG

SEQ ID NO: 86348 - protein, 9 aa, Dengue virus
NPDMTIIGR

SEQ ID NO: 86349 - protein, 9 aa, Dengue virus
IGRRLQRLR

SEQ ID NO: 86350 - protein, 9 aa, Dengue virus
GRRLQRLRE

SEQ ID NO: 86351 - protein, 9 aa, Dengue virus
RRLQRLREE

SEQ ID NO: 86352 - protein, 9 aa, Dengue virus
RLQRLREEH

SEQ ID NO: 86353 - protein, 9 aa, Dengue virus
LQRLREEHK

SEQ ID NO: 86354 - protein, 9 aa, Dengue virus
QRLREEHKE

SEQ ID NO: 86355 - protein, 9 aa, Dengue virus
RLREEHKET

SEQ ID NO: 86356 - protein, 9 aa, Dengue virus
LREEHKETW

SEQ ID NO: 86357 - protein, 9 aa, Dengue virus
REEHKETWH

SEQ ID NO: 86358 - protein, 9 aa, Dengue virus
HKETWHYDH

SEQ ID NO: 86359 - protein, 9 aa, Dengue virus
KETWHYDHE

SEQ ID NO: 86360 - protein, 9 aa, Dengue virus
ETWHYDHEN

SEQ ID NO: 86361 - protein, 9 aa, Dengue virus
TWHYDHENP

SEQ ID NO: 86362 - protein, 9 aa, Dengue virus
WHYDHENPY

SEQ ID NO: 86363 - protein, 9 aa, Dengue virus
HYDHENPYR

SEQ ID NO: 86364 - protein, 9 aa, Dengue virus
YDHENPYRT

SEQ ID NO: 86365 - protein, 9 aa, Dengue virus
DHENPYRTW

SEQ ID NO: 86366 - protein, 9 aa, Dengue virus
HENPYRTWA

SEQ ID NO: 86367 - protein, 9 aa, Dengue virus
YEAPSTGST

SEQ ID NO: 86368 - protein, 9 aa, Dengue virus
EASSTGSAS

SEQ ID NO: 86369 - protein, 9 aa, Dengue virus
ASSTGSASS

SEQ ID NO: 86370 - protein, 9 aa, Dengue virus
SSTGSASSM

SEQ ID NO: 86371 - protein, 9 aa, Dengue virus
STGSTSSMV

SEQ ID NO: 86372 - protein, 9 aa, Dengue virus
TGSTSSMVN

SEQ ID NO: 86373 - protein, 9 aa, Dengue virus
GSTSSMVNG

SEQ ID NO: 86374 - protein, 9 aa, Dengue virus
STSSMVNGV

SEQ ID NO: 86375 - protein, 9 aa, Dengue virus
ASSMINGVV

SEQ ID NO: 86376 - protein, 9 aa, Dengue virus
KLLTKPWDM

SEQ ID NO: 86377 - protein, 9 aa, Dengue virus
LLTKPWDVV

SEQ ID NO: 86378 - protein, 9 aa, Dengue virus
LTKPWDVVP

SEQ ID NO: 86379 - protein, 9 aa, Dengue virus
TKPWDVVPM

SEQ ID NO: 86380 - protein, 9 aa, Dengue virus
KPWDVVPMV

SEQ ID NO: 86381 - protein, 9 aa, Dengue virus
PWDVVPMVT

SEQ ID NO: 86382 - protein, 9 aa, Dengue virus
WDVVPMVTQ

SEQ ID NO: 86383 - protein, 9 aa, Dengue virus
DVVPMVTQL

SEQ ID NO: 86384 - protein, 9 aa, Dengue virus
VVPMVTQLA

SEQ ID NO: 86385 - protein, 9 aa, Dengue virus
VPMVTQLAM

SEQ ID NO: 86386 - protein, 9 aa, Dengue virus
DTRTPQPKL

SEQ ID NO: 86387 - protein, 9 aa, Dengue virus
TRTPQPKLG

SEQ ID NO: 86388 - protein, 9 aa, Dengue virus
RTPQPKLGT

SEQ ID NO: 86389 - protein, 9 aa, Dengue virus
TPQPKLGTR

SEQ ID NO: 86390 - protein, 9 aa, Dengue virus
PQPKPGTRV

SEQ ID NO: 86391 - protein, 9 aa, Dengue virus
QPKPGTRMI

SEQ ID NO: 86392 - protein, 9 aa, Dengue virus
PKPGTRMIM

SEQ ID NO: 86393 - protein, 9 aa, Dengue virus
KPGTRMIMT

SEQ ID NO: 86394 - protein, 9 aa, Dengue virus
PGTRMIMTT

SEQ ID NO: 86395 - protein, 9 aa, Dengue virus
GTRMIMTTT

SEQ ID NO: 86396 - protein, 9 aa, Dengue virus
TRMIMTTTA

SEQ ID NO: 86397 - protein, 9 aa, Dengue virus
RMIMTTTAN

SEQ ID NO: 86398 - protein, 9 aa, Dengue virus
MIMTTTANW

SEQ ID NO: 86399 - protein, 9 aa, Dengue virus
IMTTTANWL

SEQ ID NO: 86400 - protein, 9 aa, Dengue virus
TTTANWLWT

SEQ ID NO: 86401 - protein, 9 aa, Dengue virus
TTANWLWTL

SEQ ID NO: 86402 - protein, 9 aa, Dengue virus
TANWLWTLL

SEQ ID NO: 86403 - protein, 9 aa, Dengue virus
ANWLWTLLG

SEQ ID NO: 86404 - protein, 9 aa, Dengue virus
NWLWALLGR

SEQ ID NO: 86405 - protein, 9 aa, Dengue virus
WLWALLGRK

SEQ ID NO: 86406 - protein, 9 aa, Dengue virus
LWALLGRKK

SEQ ID NO: 86407 - protein, 9 aa, Dengue virus
LLGKKKSPR

SEQ ID NO: 86408 - protein, 9 aa, Dengue virus
LGKKKSPRL

SEQ ID NO: 86409 - protein, 9 aa, Dengue virus
GKKKSPRLC

SEQ ID NO: 86410 - protein, 9 aa, Dengue virus
KKKSPRLCT

SEQ ID NO: 86411 - protein, 9 aa, Dengue virus
KKSPRLCTR

SEQ ID NO: 86412 - protein, 9 aa, Dengue virus
KSPRLCTRE

SEQ ID NO: 86413 - protein, 9 aa, Dengue virus
SPRLCTREE

SEQ ID NO: 86414 - protein, 9 aa, Dengue virus
PRLCTKEEF

SEQ ID NO: 86415 - protein, 9 aa, Dengue virus
RLCTKEEFI

SEQ ID NO: 86416 - protein, 9 aa, Dengue virus
LCTKEEFIS

SEQ ID NO: 86417 - protein, 9 aa, Dengue virus
CTKEEFISK

SEQ ID NO: 86418 - protein, 9 aa, Dengue virus
TKEEFISKV

SEQ ID NO: 86419 - protein, 9 aa, Dengue virus
KEEFISKVR

SEQ ID NO: 86420 - protein, 9 aa, Dengue virus
WTSASEAVS

SEQ ID NO: 86421 - protein, 9 aa, Dengue virus
TSASEAVSD

SEQ ID NO: 86422 - protein, 9 aa, Dengue virus
SASEAVSDS

SEQ ID NO: 86423 - protein, 9 aa, Dengue virus
ASEAVSDSR

SEQ ID NO: 86424 - protein, 9 aa, Dengue virus
SEAVSDSRF

SEQ ID NO: 86425 - protein, 9 aa, Dengue virus
EAVSDSRFW

SEQ ID NO: 86426 - protein, 9 aa, Dengue virus
AVSDSRFWE

SEQ ID NO: 86427 - protein, 9 aa, Dengue virus
VSDSRFWEL

SEQ ID NO: 86428 - protein, 9 aa, Dengue virus
SDSRFWELV

SEQ ID NO: 86429 - protein, 9 aa, Dengue virus
WKLVDKERA

SEQ ID NO: 86430 - protein, 9 aa, Dengue virus
ELVDKERTL

SEQ ID NO: 86431 - protein, 9 aa, Dengue virus
ERTLHQEGK

SEQ ID NO: 86432 - protein, 9 aa, Dengue virus
RALHQEGRC

SEQ ID NO: 86433 - protein, 9 aa, Dengue virus
ALHQEGRCE

SEQ ID NO: 86434 - protein, 9 aa, Dengue virus
FLNEDHWFS

SEQ ID NO: 86435 - protein, 9 aa, Dengue virus
LNEDHWFSR

SEQ ID NO: 86436 - protein, 9 aa, Dengue virus
NEDHWFSRE

SEQ ID NO: 86437 - protein, 9 aa, Dengue virus
EDHWFSREN

SEQ ID NO: 86438 - protein, 9 aa, Dengue virus
DHWFSRENS

SEQ ID NO: 86439 - protein, 9 aa, Dengue virus
HWFSRENSW

SEQ ID NO: 86440 - protein, 9 aa, Dengue virus
WFSRENSWS

SEQ ID NO: 86441 - protein, 9 aa, Dengue virus
FSRENSWSG

SEQ ID NO: 86442 - protein, 9 aa, Dengue virus
SRENSWSGV

SEQ ID NO: 86443 - protein, 9 aa, Dengue virus
HRLGYILED

SEQ ID NO: 86444 - protein, 9 aa, Dengue virus
RLGYILEDI

SEQ ID NO: 86445 - protein, 9 aa, Dengue virus
LGYILEDID

SEQ ID NO: 86446 - protein, 9 aa, Dengue virus
GYILEDIDK

SEQ ID NO: 86447 - protein, 9 aa, Dengue virus
YILEDIDKK

SEQ ID NO: 86448 - protein, 9 aa, Dengue virus
ILEDIDKKD

SEQ ID NO: 86449 - protein, 9 aa, Dengue virus
LEDIDKKDG

SEQ ID NO: 86450 - protein, 9 aa, Dengue virus
EDIDKKDGD

SEQ ID NO: 86451 - protein, 9 aa, Dengue virus
DIDKKDGDL

SEQ ID NO: 86452 - protein, 9 aa, Dengue virus
IDKKDGDLI

SEQ ID NO: 86453 - protein, 9 aa, Dengue virus
DKKDGDLIY

SEQ ID NO: 86454 - protein, 9 aa, Dengue virus
KKDGDLIYA

SEQ ID NO: 86455 - protein, 9 aa, Dengue virus
KDGDLIYAD

SEQ ID NO: 86456 - protein, 9 aa, Dengue virus
DGDLIYADD

SEQ ID NO: 86457 - protein, 9 aa, Dengue virus
GDLIYADDT

SEQ ID NO: 86458 - protein, 9 aa, Dengue virus
DLIYADDTA

SEQ ID NO: 86459 - protein, 9 aa, Dengue virus
LIYADDTAG

SEQ ID NO: 86460 - protein, 9 aa, Dengue virus
IYADDTAGW

SEQ ID NO: 86461 - protein, 9 aa, Dengue virus
TRITEDDLL

SEQ ID NO: 86462 - protein, 9 aa, Dengue virus
RITEDDLLN

SEQ ID NO: 86463 - protein, 9 aa, Dengue virus
ITEDDLLNE

SEQ ID NO: 86464 - protein, 9 aa, Dengue virus
TEDDLLNEE

SEQ ID NO: 86465 - protein, 9 aa, Dengue virus
EDDLLNEEL

SEQ ID NO: 86466 - protein, 9 aa, Dengue virus
DDLLNEELI

SEQ ID NO: 86467 - protein, 9 aa, Dengue virus
DLLNEELIT

SEQ ID NO: 86468 - protein, 9 aa, Dengue virus
LLNEELITE

SEQ ID NO: 86469 - protein, 9 aa, Dengue virus
LNEELITEQ

SEQ ID NO: 86470 - protein, 9 aa, Dengue virus
LITEQMAPG

SEQ ID NO: 86471 - protein, 9 aa, Dengue virus
VTEQMAPHH

SEQ ID NO: 86472 - protein, 9 aa, Dengue virus
TEQMAPHHR

SEQ ID NO: 86473 - protein, 9 aa, Dengue virus
EQMAPHHKT

SEQ ID NO: 86474 - protein, 9 aa, Dengue virus
QMAPHHKTL

SEQ ID NO: 86475 - protein, 9 aa, Dengue virus
MAPHHKTLA

SEQ ID NO: 86476 - protein, 9 aa, Dengue virus
APHHKTLAK

SEQ ID NO: 86477 - protein, 9 aa, Dengue virus
PHHKTLAKA

SEQ ID NO: 86478 - protein, 9 aa, Dengue virus
HHKTLAKAI

SEQ ID NO: 86479 - protein, 9 aa, Dengue virus
HKTLAKAIF

SEQ ID NO: 86480 - protein, 9 aa, Dengue virus
KTLAKAIFK

SEQ ID NO: 86481 - protein, 9 aa, Dengue virus
TLAKAIFKL

SEQ ID NO: 86482 - protein, 9 aa, Dengue virus
VKVLRPTPK

SEQ ID NO: 86483 - protein, 9 aa, Dengue virus
KVLRPTPKG

SEQ ID NO: 86484 - protein, 9 aa, Dengue virus
VLRPTPKGA

SEQ ID NO: 86485 - protein, 9 aa, Dengue virus
LRPTPKGAV

SEQ ID NO: 86486 - protein, 9 aa, Dengue virus
RPTPKGAVM

SEQ ID NO: 86487 - protein, 9 aa, Dengue virus
PTPKGAVMD

SEQ ID NO: 86488 - protein, 9 aa, Dengue virus
TPKGAVMDI

SEQ ID NO: 86489 - protein, 9 aa, Dengue virus
PKGAVMDII

SEQ ID NO: 86490 - protein, 9 aa, Dengue virus
KGAVMDIIS

SEQ ID NO: 86491 - protein, 9 aa, Dengue virus
GSGQVGTYS

SEQ ID NO: 86492 - protein, 9 aa, Dengue virus
SGQVGTYSL

SEQ ID NO: 86493 - protein, 9 aa, Dengue virus
GQVGTYSLN

SEQ ID NO: 86494 - protein, 9 aa, Dengue virus
QVGTYSLNT

SEQ ID NO: 86495 - protein, 9 aa, Dengue virus
VGTYSLNTF

SEQ ID NO: 86496 - protein, 9 aa, Dengue virus
GTYSLNTFT

SEQ ID NO: 86497 - protein, 9 aa, Dengue virus
TYSLNTFTN

SEQ ID NO: 86498 - protein, 9 aa, Dengue virus
YSLNTFTNM

SEQ ID NO: 86499 - protein, 9 aa, Dengue virus
SLNTFTNME

SEQ ID NO: 86500 - protein, 9 aa, Dengue virus
MEAEGVITR

SEQ ID NO: 86501 - protein, 9 aa, Dengue virus
EAEGVITRD

SEQ ID NO: 86502 - protein, 9 aa, Dengue virus
AEGVITRDD

SEQ ID NO: 86503 - protein, 9 aa, Dengue virus
EGVITRDDM

SEQ ID NO: 86504 - protein, 9 aa, Dengue virus
GVITRDDMH

SEQ ID NO: 86505 - protein, 9 aa, Dengue virus
VITQDDMHN

SEQ ID NO: 86506 - protein, 9 aa, Dengue virus
ITRDDMHNP

SEQ ID NO: 86507 - protein, 9 aa, Dengue virus
TQDDMHNPK

SEQ ID NO: 86508 - protein, 9 aa, Dengue virus
RDDMHNPKG

SEQ ID NO: 86509 - protein, 9 aa, Dengue virus
DDMHNPKGL

SEQ ID NO: 86510 - protein, 9 aa, Dengue virus
DMHNPKGLK

SEQ ID NO: 86511 - protein, 9 aa, Dengue virus
MHNPKGLKE

SEQ ID NO: 86512 - protein, 9 aa, Dengue virus
HNPKGLKER

SEQ ID NO: 86513 - protein, 9 aa, Dengue virus
NPKGLKEKV

SEQ ID NO: 86514 - protein, 9 aa, Dengue virus
PKGLKEKVE

SEQ ID NO: 86515 - protein, 9 aa, Dengue virus
KGLKERVEN

SEQ ID NO: 86516 - protein, 9 aa, Dengue virus
GLKERVENW

SEQ ID NO: 86517 - protein, 9 aa, Dengue virus
LKERVENWL

SEQ ID NO: 86518 - protein, 9 aa, Dengue virus
KERVEKWLK

SEQ ID NO: 86519 - protein, 9 aa, Dengue virus
ERVEKWLKE

SEQ ID NO: 86520 - protein, 9 aa, Dengue virus
RVEKWLKEC

SEQ ID NO: 86521 - protein, 9 aa, Dengue virus
VEKWLKECG

SEQ ID NO: 86522 - protein, 9 aa, Dengue virus
EKWLKECGV

SEQ ID NO: 86523 - protein, 9 aa, Dengue virus
KWLKECGVD

SEQ ID NO: 86524 - protein, 9 aa, Dengue virus
WLKECGVDR

SEQ ID NO: 86525 - protein, 9 aa, Dengue virus
LKECGVDRL

SEQ ID NO: 86526 - protein, 9 aa, Dengue virus
KECGVDRLK

SEQ ID NO: 86527 - protein, 9 aa, Dengue virus
VKPLDERFS

SEQ ID NO: 86528 - protein, 9 aa, Dengue virus
KPLDERFST

SEQ ID NO: 86529 - protein, 9 aa, Dengue virus
PLDERFSTS

SEQ ID NO: 86530 - protein, 9 aa, Dengue virus
LDERFSTSL

SEQ ID NO: 86531 - protein, 9 aa, Dengue virus
DERFSTSLL

SEQ ID NO: 86532 - protein, 9 aa, Dengue virus
ERFSTSLLF

SEQ ID NO: 86533 - protein, 9 aa, Dengue virus
RFSTSLLFL

SEQ ID NO: 86534 - protein, 9 aa, Dengue virus
FSTSLLFLN

SEQ ID NO: 86535 - protein, 9 aa, Dengue virus
STSLLFLND

SEQ ID NO: 86536 - protein, 9 aa, Dengue virus
CSHHFHRIF

SEQ ID NO: 86537 - protein, 9 aa, Dengue virus
SHHFHKILM

SEQ ID NO: 86538 - protein, 9 aa, Dengue virus
HHFHKILMK

SEQ ID NO: 86539 - protein, 9 aa, Dengue virus
HFHKILMKD

SEQ ID NO: 86540 - protein, 9 aa, Dengue virus
FHRIFMKDG

SEQ ID NO: 86541 - protein, 9 aa, Dengue virus
HKILMKDGR

SEQ ID NO: 86542 - protein, 9 aa, Dengue virus
RIFMKDGRS

SEQ ID NO: 86543 - protein, 9 aa, Dengue virus
SQGAGWSLK

SEQ ID NO: 86544 - protein, 9 aa, Dengue virus
QGAGWSLKE

SEQ ID NO: 86545 - protein, 9 aa, Dengue virus
GAGWSLKET

SEQ ID NO: 86546 - protein, 9 aa, Dengue virus
AGWSLKETA

SEQ ID NO: 86547 - protein, 9 aa, Dengue virus
GWSLKETAC

SEQ ID NO: 86548 - protein, 9 aa, Dengue virus
WSLKETACL

SEQ ID NO: 86549 - protein, 9 aa, Dengue virus
SLKETACLG

SEQ ID NO: 86550 - protein, 9 aa, Dengue virus
LKETACLGK

SEQ ID NO: 86551 - protein, 9 aa, Dengue virus
KETACLGKA

SEQ ID NO: 86552 - protein, 9 aa, Dengue virus
CSAVPTEWL

SEQ ID NO: 86553 - protein, 9 aa, Dengue virus
SAVPTEWLP

SEQ ID NO: 86554 - protein, 9 aa, Dengue virus
AVPTEWLPT

SEQ ID NO: 86555 - protein, 9 aa, Dengue virus
VPVEWVPTS

SEQ ID NO: 86556 - protein, 9 aa, Dengue virus
PVEWVPTSR

SEQ ID NO: 86557 - protein, 9 aa, Dengue virus
VEWVPTSRT

SEQ ID NO: 86558 - protein, 9 aa, Dengue virus
EWVPTSRTT

SEQ ID NO: 86559 - protein, 9 aa, Dengue virus
WLPTSRTTW

SEQ ID NO: 86560 - protein, 9 aa, Dengue virus
LPTSRTTWS

SEQ ID NO: 86561 - protein, 9 aa, Dengue virus
WIEDNPNMT

SEQ ID NO: 86562 - protein, 9 aa, Dengue virus
IEDNPNMTD

SEQ ID NO: 86563 - protein, 9 aa, Dengue virus
EDNPNMTDK

SEQ ID NO: 86564 - protein, 9 aa, Dengue virus
DNPNMTDKT

SEQ ID NO: 86565 - protein, 9 aa, Dengue virus
NPNMTDKTP

SEQ ID NO: 86566 - protein, 9 aa, Dengue virus
PNMTDKTPV

SEQ ID NO: 86567 - protein, 9 aa, Dengue virus
NMTDKTPVH

SEQ ID NO: 86568 - protein, 9 aa, Dengue virus
MTDKTPVHS

SEQ ID NO: 86569 - protein, 9 aa, Dengue virus
TDKTPVHSW

SEQ ID NO: 86570 - protein, 9 aa, Dengue virus
DKTPIHSWE

SEQ ID NO: 86571 - protein, 9 aa, Dengue virus
KTPIHSWED

SEQ ID NO: 86572 - protein, 9 aa, Dengue virus
TPIHSWEDI

SEQ ID NO: 86573 - protein, 9 aa, Dengue virus
PIHSWEDIP

SEQ ID NO: 86574 - protein, 9 aa, Dengue virus
IHSWEDIPY

SEQ ID NO: 86575 - protein, 9 aa, Dengue virus
HSWEDVPYL

SEQ ID NO: 86576 - protein, 9 aa, Dengue virus
SWEDVPYLG

SEQ ID NO: 86577 - protein, 9 aa, Dengue virus
WEDVPYLGK

SEQ ID NO: 86578 - protein, 9 aa, Dengue virus
EDVPYLGKR

SEQ ID NO: 86579 - protein, 9 aa, Dengue virus
DVPYLGKRE

SEQ ID NO: 86580 - protein, 9 aa, Dengue virus
VPYLGKRED

SEQ ID NO: 86581 - protein, 9 aa, Dengue virus
RATWAKNIQ

SEQ ID NO: 86582 - protein, 9 aa, Dengue virus
ATWAKNIQT

SEQ ID NO: 86583 - protein, 9 aa, Dengue virus
TWAKNIQTA

SEQ ID NO: 86584 - protein, 9 aa, Dengue virus
WAKNIQTAI

SEQ ID NO: 86585 - protein, 9 aa, Dengue virus
AKNIHTAIA

SEQ ID NO: 86586 - protein, 9 aa, Dengue virus
KNIQTAITQ

SEQ ID NO: 86587 - protein, 9 aa, Dengue virus
NIQTAITQV

SEQ ID NO: 86588 - protein, 9 aa, Dengue virus
IHTAIAQVR

SEQ ID NO: 86589 - protein, 9 aa, Dengue virus
QTAITQVRN

SEQ ID NO: 86590 - protein, 9 aa, Dengue virus
TAIAQVRNL

SEQ ID NO: 86591 - protein, 9 aa, Dengue virus
AIAQVRNLI

SEQ ID NO: 86592 - protein, 9 aa, Dengue virus
IAQVRNLIG

SEQ ID NO: 86593 - protein, 9 aa, Dengue virus
AQVRNLIGK

SEQ ID NO: 86594 - protein, 9 aa, Dengue virus
NLIGKEEYM

SEQ ID NO: 86595 - protein, 9 aa, Dengue virus
LIGKEEYAD

SEQ ID NO: 86596 - protein, 9 aa, Dengue virus
IGKEEYADY

SEQ ID NO: 86597 - protein, 9 aa, Dengue virus
GKEEYMDYM

SEQ ID NO: 86598 - protein, 9 aa, Dengue virus
KEEYMDYMP

SEQ ID NO: 86599 - protein, 9 aa, Dengue virus
EEYVDYMPA

SEQ ID NO: 86600 - protein, 9 aa, Dengue virus
EYVDYMPAM

SEQ ID NO: 86601 - protein, 9 aa, Dengue virus
YVDYMPAMK

SEQ ID NO: 86602 - protein, 9 aa, Dengue virus
VDYMPAMKR

SEQ ID NO: 86603 - protein, 9 aa, Dengue virus
DYMPAMKRY

SEQ ID NO: 86604 - protein, 9 aa, Dengue virus
YMPAMKRYS

SEQ ID NO: 86605 - protein, 9 aa, Dengue virus
MPAMKRYSA

SEQ ID NO: 86606 - protein, 9 aa, Dengue virus
PAMKRYSAP

SEQ ID NO: 86607 - protein, 9 aa, Dengue virus
MKRYSAPFE

SEQ ID NO: 86608 - protein, 9 aa, Dengue virus
RYSAPFESE

SEQ ID NO: 86609 - protein, 9 aa, Dengue virus
YSAPFESEG

SEQ ID NO: 86610 - protein, 9 aa, Dengue virus
SAPFESEGV

SEQ ID NO: 86611 - protein, 9 aa, Dengue virus
APFESEGVL

SEQ ID NO: 86612 - protein, 9 aa, Dengue virus
NNQRKKARN

SEQ ID NO: 86613 - protein, 9 aa, Dengue virus
NQRKKARNT

SEQ ID NO: 86614 - protein, 9 aa, Dengue virus
QRKKARNTP

SEQ ID NO: 86615 - protein, 9 aa, Dengue virus
RKKARNTPF

SEQ ID NO: 86616 - protein, 9 aa, Dengue virus
KKARNTPFN

SEQ ID NO: 86617 - protein, 9 aa, Dengue virus
KARNTPFNM

SEQ ID NO: 86618 - protein, 9 aa, Dengue virus
ARNTPFNML

SEQ ID NO: 86619 - protein, 9 aa, Dengue virus
RNTPFNMLK

SEQ ID NO: 86620 - protein, 9 aa, Dengue virus
QGLVKRFSI

SEQ ID NO: 86621 - protein, 9 aa, Dengue virus
QLTKRFSLG

SEQ ID NO: 86622 - protein, 9 aa, Dengue virus
LVKRFSIGL

SEQ ID NO: 86623 - protein, 9 aa, Dengue virus
VKRFSIGLF

SEQ ID NO: 86624 - protein, 9 aa, Dengue virus
KRFSIGLFS

SEQ ID NO: 86625 - protein, 9 aa, Dengue virus
RFSLGMLQG

SEQ ID NO: 86626 - protein, 9 aa, Dengue virus
FSIGLFSGK

SEQ ID NO: 86627 - protein, 9 aa, Dengue virus
SIGLFSGKG

SEQ ID NO: 86628 - protein, 9 aa, Dengue virus
IGLFSGKGP

SEQ ID NO: 86629 - protein, 9 aa, Dengue virus
KRWGTIKKS

SEQ ID NO: 86630 - protein, 9 aa, Dengue virus
RWGTIKKSK

SEQ ID NO: 86631 - protein, 9 aa, Dengue virus
WGQLKKTKA

SEQ ID NO: 86632 - protein, 9 aa, Dengue virus
GQLKKTKAI

SEQ ID NO: 86633 - protein, 9 aa, Dengue virus
TIKKSKAIN

SEQ ID NO: 86634 - protein, 9 aa, Dengue virus
LKKTKAIKI

SEQ ID NO: 86635 - protein, 9 aa, Dengue virus
KKTKAIKIL

SEQ ID NO: 86636 - protein, 9 aa, Dengue virus
KNKAIRILI

SEQ ID NO: 86637 - protein, 9 aa, Dengue virus
NKAIRILIG

SEQ ID NO: 86638 - protein, 9 aa, Dengue virus
KAIRILIGF

SEQ ID NO: 86639 - protein, 9 aa, Dengue virus
AIRILIGFR

SEQ ID NO: 86640 - protein, 9 aa, Dengue virus
IRILIGFRK

SEQ ID NO: 86641 - protein, 9 aa, Dengue virus
RILIGFRKE

SEQ ID NO: 86642 - protein, 9 aa, Dengue virus
VLRGFRKEI

SEQ ID NO: 86643 - protein, 9 aa, Dengue virus
LRGFRKEIG

SEQ ID NO: 86644 - protein, 9 aa, Dengue virus
RGFRKEIGR

SEQ ID NO: 86645 - protein, 9 aa, Dengue virus
MLNILNGRR

SEQ ID NO: 86646 - protein, 9 aa, Dengue virus
LNILNGRRR

SEQ ID NO: 86647 - protein, 9 aa, Dengue virus
NILNRRKRS

SEQ ID NO: 86648 - protein, 9 aa, Dengue virus
ILNGRRRST

SEQ ID NO: 86649 - protein, 9 aa, Dengue virus
RRRSTMTLL

SEQ ID NO: 86650 - protein, 9 aa, Dengue virus
RRSTMTLLC

SEQ ID NO: 86651 - protein, 9 aa, Dengue virus
RSTVTLLCL

SEQ ID NO: 86652 - protein, 9 aa, Dengue virus
STVTLLCLI

SEQ ID NO: 86653 - protein, 9 aa, Dengue virus
TVTLLCLIP

SEQ ID NO: 86654 - protein, 9 aa, Dengue virus
VTLLCLIPT

SEQ ID NO: 86655 - protein, 9 aa, Dengue virus
TLLCLIPTI

SEQ ID NO: 86656 - protein, 9 aa, Dengue virus
LLCLIPTIM

SEQ ID NO: 86657 - protein, 9 aa, Dengue virus
LCLIPTIMA

SEQ ID NO: 86658 - protein, 9 aa, Dengue virus
CLIPTIMAF

SEQ ID NO: 86659 - protein, 9 aa, Dengue virus
LIPTVMAFS

SEQ ID NO: 86660 - protein, 9 aa, Dengue virus
IPTVMAFSL

SEQ ID NO: 86661 - protein, 9 aa, Dengue virus
PTVMAFSLS

SEQ ID NO: 86662 - protein, 9 aa, Dengue virus
TVMAFSLST

SEQ ID NO: 86663 - protein, 9 aa, Dengue virus
VMAFSLSTR

SEQ ID NO: 86664 - protein, 9 aa, Dengue virus
MAFHLTTRN

SEQ ID NO: 86665 - protein, 9 aa, Dengue virus
AFHLTTRNG

SEQ ID NO: 86666 - protein, 9 aa, Dengue virus
FHLTTRNGE

SEQ ID NO: 86667 - protein, 9 aa, Dengue virus
HLTTRNGEP

SEQ ID NO: 86668 - protein, 9 aa, Dengue virus
GEPLMIVGK

SEQ ID NO: 86669 - protein, 9 aa, Dengue virus
EPLMIVARH

SEQ ID NO: 86670 - protein, 9 aa, Dengue virus
PLMIVARHE

SEQ ID NO: 86671 - protein, 9 aa, Dengue virus
LMIVGKHER

SEQ ID NO: 86672 - protein, 9 aa, Dengue virus
MIVGKHERG

SEQ ID NO: 86673 - protein, 9 aa, Dengue virus
IVGKHERGR

SEQ ID NO: 86674 - protein, 9 aa, Dengue virus
VGKHERGRP

SEQ ID NO: 86675 - protein, 9 aa, Dengue virus
ARHERGRPL

SEQ ID NO: 86676 - protein, 9 aa, Dengue virus
FKTTEGINR

SEQ ID NO: 86677 - protein, 9 aa, Dengue virus
KTTEGINRC

SEQ ID NO: 86678 - protein, 9 aa, Dengue virus
TTEGINRCT

SEQ ID NO: 86679 - protein, 9 aa, Dengue virus
TEGTNKCTL

SEQ ID NO: 86680 - protein, 9 aa, Dengue virus
EGTNKCTLI

SEQ ID NO: 86681 - protein, 9 aa, Dengue virus
GINRCTLIA

SEQ ID NO: 86682 - protein, 9 aa, Dengue virus
INRCTLIAM

SEQ ID NO: 86683 - protein, 9 aa, Dengue virus
MCEDTVTYE

SEQ ID NO: 86684 - protein, 9 aa, Dengue virus
CEDTITYKC

SEQ ID NO: 86685 - protein, 9 aa, Dengue virus
EDTITYKCP

SEQ ID NO: 86686 - protein, 9 aa, Dengue virus
DTVTYECPL

SEQ ID NO: 86687 - protein, 9 aa, Dengue virus
TVTYECPLL

SEQ ID NO: 86688 - protein, 9 aa, Dengue virus
ITYKCPLLR

SEQ ID NO: 86689 - protein, 9 aa, Dengue virus
TYECPLLVN

SEQ ID NO: 86690 - protein, 9 aa, Dengue virus
YECPLLVNT

SEQ ID NO: 86691 - protein, 9 aa, Dengue virus
KCPLLRQNE

SEQ ID NO: 86692 - protein, 9 aa, Dengue virus
CPLLRQNEP

SEQ ID NO: 86693 - protein, 9 aa, Dengue virus
PLLRQNEPE

SEQ ID NO: 86694 - protein, 9 aa, Dengue virus
LLRQNEPED

SEQ ID NO: 86695 - protein, 9 aa, Dengue virus
LRQNEPEDI

SEQ ID NO: 86696 - protein, 9 aa, Dengue virus
RQNEPEDID

SEQ ID NO: 86697 - protein, 9 aa, Dengue virus
DCWCNSTST

SEQ ID NO: 86698 - protein, 9 aa, Dengue virus
CWCNSTSTW

SEQ ID NO: 86699 - protein, 9 aa, Dengue virus
WCNSTSTWV

SEQ ID NO: 86700 - protein, 9 aa, Dengue virus
CNSTSTWVT

SEQ ID NO: 86701 - protein, 9 aa, Dengue virus
NSTSTWVTY

SEQ ID NO: 86702 - protein, 9 aa, Dengue virus
STSTWVTYG

SEQ ID NO: 86703 - protein, 9 aa, Dengue virus
TSTWVTYGT

SEQ ID NO: 86704 - protein, 9 aa, Dengue virus
STWVTYGTC

SEQ ID NO: 86705 - protein, 9 aa, Dengue virus
TWVTYGTCT

SEQ ID NO: 86706 - protein, 9 aa, Dengue virus
VTYGTCTTT

SEQ ID NO: 86707 - protein, 9 aa, Dengue virus
TYGTCTTTG

SEQ ID NO: 86708 - protein, 9 aa, Dengue virus
YGTCTTTGE

SEQ ID NO: 86709 - protein, 9 aa, Dengue virus
GTCTTTGEH

SEQ ID NO: 86710 - protein, 9 aa, Dengue virus
TCTTTGEHR

SEQ ID NO: 86711 - protein, 9 aa, Dengue virus
CTTTGEHRR

SEQ ID NO: 86712 - protein, 9 aa, Dengue virus
TTTGEHRRE

SEQ ID NO: 86713 - protein, 9 aa, Dengue virus
TTGEHRREK

SEQ ID NO: 86714 - protein, 9 aa, Dengue virus
TGEHRREKR

SEQ ID NO: 86715 - protein, 9 aa, Dengue virus
LAGFMAYMV

SEQ ID NO: 86716 - protein, 9 aa, Dengue virus
AAILAYTIG

SEQ ID NO: 86717 - protein, 9 aa, Dengue virus
AILAYTIGT

SEQ ID NO: 86718 - protein, 9 aa, Dengue virus
FMAYMVGQT

SEQ ID NO: 86719 - protein, 9 aa, Dengue virus
LAYTIGTTH

SEQ ID NO: 86720 - protein, 9 aa, Dengue virus
AYMVGQTGI

SEQ ID NO: 86721 - protein, 9 aa, Dengue virus
YMVGQTGIQ

SEQ ID NO: 86722 - protein, 9 aa, Dengue virus
MVGQTGIQR

SEQ ID NO: 86723 - protein, 9 aa, Dengue virus
IGTTHFQRA

SEQ ID NO: 86724 - protein, 9 aa, Dengue virus
GQTRIQRTV

SEQ ID NO: 86725 - protein, 9 aa, Dengue virus
QTGIQRAVF

SEQ ID NO: 86726 - protein, 9 aa, Dengue virus
TGIQRAVFF

SEQ ID NO: 86727 - protein, 9 aa, Dengue virus
HFQRALIFI

SEQ ID NO: 86728 - protein, 9 aa, Dengue virus
FQRALIFIL

SEQ ID NO: 86729 - protein, 9 aa, Dengue virus
QRALIFILL

SEQ ID NO: 86730 - protein, 9 aa, Dengue virus
RALIFILLT

SEQ ID NO: 86731 - protein, 9 aa, Dengue virus
ALIFILLTA

SEQ ID NO: 86732 - protein, 9 aa, Dengue virus
LIFILLTAV

SEQ ID NO: 86733 - protein, 9 aa, Dengue virus
IFILLTAVA

SEQ ID NO: 86734 - protein, 9 aa, Dengue virus
FILLTAVAP

SEQ ID NO: 86735 - protein, 9 aa, Dengue virus
ILLTAVAPS

SEQ ID NO: 86736 - protein, 9 aa, Dengue virus
APSYGMRCI

SEQ ID NO: 86737 - protein, 9 aa, Dengue virus
PSYGMRCIG

SEQ ID NO: 86738 - protein, 9 aa, Dengue virus
SMTMRCIGI

SEQ ID NO: 86739 - protein, 9 aa, Dengue virus
MTMRCIGIS

SEQ ID NO: 86740 - protein, 9 aa, Dengue virus
TMRCIGISN

SEQ ID NO: 86741 - protein, 9 aa, Dengue virus
MRCIGVGNR

SEQ ID NO: 86742 - protein, 9 aa, Dengue virus
RCIGVGNRD

SEQ ID NO: 86743 - protein, 9 aa, Dengue virus
CIGISNRDF

SEQ ID NO: 86744 - protein, 9 aa, Dengue virus
IGVGNRDFV

SEQ ID NO: 86745 - protein, 9 aa, Dengue virus
FVEGVSGGT

SEQ ID NO: 86746 - protein, 9 aa, Dengue virus
VEGVSGGVW

SEQ ID NO: 86747 - protein, 9 aa, Dengue virus
EGVSGGTWV

SEQ ID NO: 86748 - protein, 9 aa, Dengue virus
GVSGGVWVD

SEQ ID NO: 86749 - protein, 9 aa, Dengue virus
VSGGVWVDL

SEQ ID NO: 86750 - protein, 9 aa, Dengue virus
SGGVWVDLV

SEQ ID NO: 86751 - protein, 9 aa, Dengue virus
GGVWVDLVL

SEQ ID NO: 86752 - protein, 9 aa, Dengue virus
GVWVDLVLE

SEQ ID NO: 86753 - protein, 9 aa, Dengue virus
VWVDLVLEH

SEQ ID NO: 86754 - protein, 9 aa, Dengue virus
LDFELIKTE

SEQ ID NO: 86755 - protein, 9 aa, Dengue virus
DFELIKTEA

SEQ ID NO: 86756 - protein, 9 aa, Dengue virus
FELIKTEAK

SEQ ID NO: 86757 - protein, 9 aa, Dengue virus
ELIKTEAKQ

SEQ ID NO: 86758 - protein, 9 aa, Dengue virus
LIKTEAKQP

SEQ ID NO: 86759 - protein, 9 aa, Dengue virus
IKTEAKQPA

SEQ ID NO: 86760 - protein, 9 aa, Dengue virus
LRKYCIEAK

SEQ ID NO: 86761 - protein, 9 aa, Dengue virus
RKYCIEAKL

SEQ ID NO: 86762 - protein, 9 aa, Dengue virus
KYCIEAKLT

SEQ ID NO: 86763 - protein, 9 aa, Dengue virus
YCIEAKLTN

SEQ ID NO: 86764 - protein, 9 aa, Dengue virus
CIEAKLTNT

SEQ ID NO: 86765 - protein, 9 aa, Dengue virus
IEAKLTNTT

SEQ ID NO: 86766 - protein, 9 aa, Dengue virus
EAKLTNTTT

SEQ ID NO: 86767 - protein, 9 aa, Dengue virus
AKLTNTTTE

SEQ ID NO: 86768 - protein, 9 aa, Dengue virus
KLTNTTTES

SEQ ID NO: 86769 - protein, 9 aa, Dengue virus
DQQYICRRN

SEQ ID NO: 86770 - protein, 9 aa, Dengue virus
QQYICRRDM

SEQ ID NO: 86771 - protein, 9 aa, Dengue virus
RFVCKHSMV

SEQ ID NO: 86772 - protein, 9 aa, Dengue virus
YICRRDMVD

SEQ ID NO: 86773 - protein, 9 aa, Dengue virus
VCKHSMVDR

SEQ ID NO: 86774 - protein, 9 aa, Dengue virus
CKHSMVDRG

SEQ ID NO: 86775 - protein, 9 aa, Dengue virus
RRDMVDRGW

SEQ ID NO: 86776 - protein, 9 aa, Dengue virus
RDMVDRGWG

SEQ ID NO: 86777 - protein, 9 aa, Dengue virus
DMVDRGWGN

SEQ ID NO: 86778 - protein, 9 aa, Dengue virus
GIVTCAMFT

SEQ ID NO: 86779 - protein, 9 aa, Dengue virus
IVTCAMFTC

SEQ ID NO: 86780 - protein, 9 aa, Dengue virus
VTCAMFTCK

SEQ ID NO: 86781 - protein, 9 aa, Dengue virus
TCAMFTCKK

SEQ ID NO: 86782 - protein, 9 aa, Dengue virus
CAMFTCKKN

SEQ ID NO: 86783 - protein, 9 aa, Dengue virus
AMFTCKKNM

SEQ ID NO: 86784 - protein, 9 aa, Dengue virus
MFTCKKNME

SEQ ID NO: 86785 - protein, 9 aa, Dengue virus
FTCKKNMEG

SEQ ID NO: 86786 - protein, 9 aa, Dengue virus
TCKKNMEGK

SEQ ID NO: 86787 - protein, 9 aa, Dengue virus
DTHAVGNDI

SEQ ID NO: 86788 - protein, 9 aa, Dengue virus
EHAVGNDTG

SEQ ID NO: 86789 - protein, 9 aa, Dengue virus
HAVGNDIPN

SEQ ID NO: 86790 - protein, 9 aa, Dengue virus
AVGNDIPNH

SEQ ID NO: 86791 - protein, 9 aa, Dengue virus
VGNDTGKHG

SEQ ID NO: 86792 - protein, 9 aa, Dengue virus
GNDIPNHGV

SEQ ID NO: 86793 - protein, 9 aa, Dengue virus
NDTGKHGKE

SEQ ID NO: 86794 - protein, 9 aa, Dengue virus
DTGKHGKEI

SEQ ID NO: 86795 - protein, 9 aa, Dengue virus
TSNHGVTTT

SEQ ID NO: 86796 - protein, 9 aa, Dengue virus
SNHGVTTTI

SEQ ID NO: 86797 - protein, 9 aa, Dengue virus
NHGVTTTIT

SEQ ID NO: 86798 - protein, 9 aa, Dengue virus
HGVTTTITP

SEQ ID NO: 86799 - protein, 9 aa, Dengue virus
GVTTTITPR

SEQ ID NO: 86800 - protein, 9 aa, Dengue virus
VTTTITPRS

SEQ ID NO: 86801 - protein, 9 aa, Dengue virus
TTTITPRSP

SEQ ID NO: 86802 - protein, 9 aa, Dengue virus
TTITPRSPS

SEQ ID NO: 86803 - protein, 9 aa, Dengue virus
KITPQSSIT

SEQ ID NO: 86804 - protein, 9 aa, Dengue virus
ITPRTPSVE

SEQ ID NO: 86805 - protein, 9 aa, Dengue virus
TPQSSITEA

SEQ ID NO: 86806 - protein, 9 aa, Dengue virus
PQSSITEAE

SEQ ID NO: 86807 - protein, 9 aa, Dengue virus
QSSITEAEL

SEQ ID NO: 86808 - protein, 9 aa, Dengue virus
SPSVEVELP

SEQ ID NO: 86809 - protein, 9 aa, Dengue virus
SITEAELTG

SEQ ID NO: 86810 - protein, 9 aa, Dengue virus
ITEAELTGY

SEQ ID NO: 86811 - protein, 9 aa, Dengue virus
TEAELTGYG

SEQ ID NO: 86812 - protein, 9 aa, Dengue virus
EVELPDYGE

SEQ ID NO: 86813 - protein, 9 aa, Dengue virus
AELTGYGTV

SEQ ID NO: 86814 - protein, 9 aa, Dengue virus
ELPDYGELS

SEQ ID NO: 86815 - protein, 9 aa, Dengue virus
LTGYGTVTM

SEQ ID NO: 86816 - protein, 9 aa, Dengue virus
PDYGELSLD

SEQ ID NO: 86817 - protein, 9 aa, Dengue virus
GYGTVTMEC

SEQ ID NO: 86818 - protein, 9 aa, Dengue virus
YGELSLDCE

SEQ ID NO: 86819 - protein, 9 aa, Dengue virus
GELSLDCEP

SEQ ID NO: 86820 - protein, 9 aa, Dengue virus
ELSLDCEPR

SEQ ID NO: 86821 - protein, 9 aa, Dengue virus
VTMECSPRT

SEQ ID NO: 86822 - protein, 9 aa, Dengue virus
TMECSPRTG

SEQ ID NO: 86823 - protein, 9 aa, Dengue virus
DFNEMVLLQ

SEQ ID NO: 86824 - protein, 9 aa, Dengue virus
FNEMILMRM

SEQ ID NO: 86825 - protein, 9 aa, Dengue virus
NEMILMEMK

SEQ ID NO: 86826 - protein, 9 aa, Dengue virus
MEKKTWLVH

SEQ ID NO: 86827 - protein, 9 aa, Dengue virus
ENKAWLVHR

SEQ ID NO: 86828 - protein, 9 aa, Dengue virus
NKAWLVHRQ

SEQ ID NO: 86829 - protein, 9 aa, Dengue virus
FLDLPLPWL

SEQ ID NO: 86830 - protein, 9 aa, Dengue virus
LDLPLPWAA

SEQ ID NO: 86831 - protein, 9 aa, Dengue virus
DLPLPWAAG

SEQ ID NO: 86832 - protein, 9 aa, Dengue virus
LPLPWAAGA

SEQ ID NO: 86833 - protein, 9 aa, Dengue virus
PLPWAAGAD

SEQ ID NO: 86834 - protein, 9 aa, Dengue virus
LPWAAGADT

SEQ ID NO: 86835 - protein, 9 aa, Dengue virus
PWAAGADTS

SEQ ID NO: 86836 - protein, 9 aa, Dengue virus
WAAGADTSE

SEQ ID NO: 86837 - protein, 9 aa, Dengue virus
AAGADTSEV

SEQ ID NO: 86838 - protein, 9 aa, Dengue virus
PGADTQGSN

SEQ ID NO: 86839 - protein, 9 aa, Dengue virus
GADTLEVHW

SEQ ID NO: 86840 - protein, 9 aa, Dengue virus
ADTQGSNWI

SEQ ID NO: 86841 - protein, 9 aa, Dengue virus
DTLEVHWNH

SEQ ID NO: 86842 - protein, 9 aa, Dengue virus
TLEVHWNHK

SEQ ID NO: 86843 - protein, 9 aa, Dengue virus
QGSNWIQKE

SEQ ID NO: 86844 - protein, 9 aa, Dengue virus
GSNWIQKET

SEQ ID NO: 86845 - protein, 9 aa, Dengue virus
SNWIQKETL

SEQ ID NO: 86846 - protein, 9 aa, Dengue virus
NWIQKETLV

SEQ ID NO: 86847 - protein, 9 aa, Dengue virus
WIQKETLVT

SEQ ID NO: 86848 - protein, 9 aa, Dengue virus
IQKETLVTF

SEQ ID NO: 86849 - protein, 9 aa, Dengue virus
QKETLVTFK

SEQ ID NO: 86850 - protein, 9 aa, Dengue virus
EGAMHTALT

SEQ ID NO: 86851 - protein, 9 aa, Dengue virus
GAMHTALTG

SEQ ID NO: 86852 - protein, 9 aa, Dengue virus
AMHTALTGA

SEQ ID NO: 86853 - protein, 9 aa, Dengue virus
MHTALTGAT

SEQ ID NO: 86854 - protein, 9 aa, Dengue virus
HTALTGATE

SEQ ID NO: 86855 - protein, 9 aa, Dengue virus
TALTGATEI

SEQ ID NO: 86856 - protein, 9 aa, Dengue virus
ALTGATEIQ

SEQ ID NO: 86857 - protein, 9 aa, Dengue virus
LTGATEIQM

SEQ ID NO: 86858 - protein, 9 aa, Dengue virus
TGATEIQMS

SEQ ID NO: 86859 - protein, 9 aa, Dengue virus
LKCKVRMER

SEQ ID NO: 86860 - protein, 9 aa, Dengue virus
KCKVRMERL

SEQ ID NO: 86861 - protein, 9 aa, Dengue virus
CKVRMERLR

SEQ ID NO: 86862 - protein, 9 aa, Dengue virus
KIRMEKLRI

SEQ ID NO: 86863 - protein, 9 aa, Dengue virus
IRMEKLRIK

SEQ ID NO: 86864 - protein, 9 aa, Dengue virus
MEKLRIKGI

SEQ ID NO: 86865 - protein, 9 aa, Dengue virus
ERLRIKGMS

SEQ ID NO: 86866 - protein, 9 aa, Dengue virus
KLRIKGISY

SEQ ID NO: 86867 - protein, 9 aa, Dengue virus
CSGKFSIDR

SEQ ID NO: 86868 - protein, 9 aa, Dengue virus
TGKFKVVKE

SEQ ID NO: 86869 - protein, 9 aa, Dengue virus
GKFSIDREM

SEQ ID NO: 86870 - protein, 9 aa, Dengue virus
KFSIDREMA

SEQ ID NO: 86871 - protein, 9 aa, Dengue virus
FSIDREMAE

SEQ ID NO: 86872 - protein, 9 aa, Dengue virus
KVVKEIAET

SEQ ID NO: 86873 - protein, 9 aa, Dengue virus
VVKEIAETQ

SEQ ID NO: 86874 - protein, 9 aa, Dengue virus
VKEIAETQH

SEQ ID NO: 86875 - protein, 9 aa, Dengue virus
KEIAETQHG

SEQ ID NO: 86876 - protein, 9 aa, Dengue virus
ETQHGTAVV

SEQ ID NO: 86877 - protein, 9 aa, Dengue virus
TQHGTTVIK

SEQ ID NO: 86878 - protein, 9 aa, Dengue virus
QHGTTVIKV

SEQ ID NO: 86879 - protein, 9 aa, Dengue virus
HGTTVIKVK

SEQ ID NO: 86880 - protein, 9 aa, Dengue virus
GTAVVKVKY

SEQ ID NO: 86881 - protein, 9 aa, Dengue virus
TTVIKVKYE

SEQ ID NO: 86882 - protein, 9 aa, Dengue virus
AVVKVKYEG

SEQ ID NO: 86883 - protein, 9 aa, Dengue virus
VIRVQYEGD

SEQ ID NO: 86884 - protein, 9 aa, Dengue virus
IRVQYEGDG

SEQ ID NO: 86885 - protein, 9 aa, Dengue virus
RVQYEGDGS

SEQ ID NO: 86886 - protein, 9 aa, Dengue virus
VQYEGDGSP

SEQ ID NO: 86887 - protein, 9 aa, Dengue virus
QYEGDGSPC

SEQ ID NO: 86888 - protein, 9 aa, Dengue virus
YEGDGSPCK

SEQ ID NO: 86889 - protein, 9 aa, Dengue virus
EGDGSPCKI

SEQ ID NO: 86890 - protein, 9 aa, Dengue virus
GAGAPCKIP

SEQ ID NO: 86891 - protein, 9 aa, Dengue virus
DGSPCKIPF

SEQ ID NO: 86892 - protein, 9 aa, Dengue virus
GSPCKIPFE

SEQ ID NO: 86893 - protein, 9 aa, Dengue virus
SPCKIPFEI

SEQ ID NO: 86894 - protein, 9 aa, Dengue virus
PCKIPIEIR

SEQ ID NO: 86895 - protein, 9 aa, Dengue virus
CKIPFEIMD

SEQ ID NO: 86896 - protein, 9 aa, Dengue virus
KIPIEIRDV

SEQ ID NO: 86897 - protein, 9 aa, Dengue virus
IPIEIRDVN

SEQ ID NO: 86898 - protein, 9 aa, Dengue virus
FEIMDLEKR

SEQ ID NO: 86899 - protein, 9 aa, Dengue virus
EIMDLEKRH

SEQ ID NO: 86900 - protein, 9 aa, Dengue virus
IMDLEKRHV

SEQ ID NO: 86901 - protein, 9 aa, Dengue virus
MDLEKRHVL

SEQ ID NO: 86902 - protein, 9 aa, Dengue virus
DLEKRHVLG

SEQ ID NO: 86903 - protein, 9 aa, Dengue virus
LEKRHVLGR

SEQ ID NO: 86904 - protein, 9 aa, Dengue virus
AESTNSVTN

SEQ ID NO: 86905 - protein, 9 aa, Dengue virus
ESTNSVTNI

SEQ ID NO: 86906 - protein, 9 aa, Dengue virus
NTNSATNIE

SEQ ID NO: 86907 - protein, 9 aa, Dengue virus
KDSPVNIEA

SEQ ID NO: 86908 - protein, 9 aa, Dengue virus
DSPVNIEAE

SEQ ID NO: 86909 - protein, 9 aa, Dengue virus
SPVNIEAEP

SEQ ID NO: 86910 - protein, 9 aa, Dengue virus
PVNIEAEPP

SEQ ID NO: 86911 - protein, 9 aa, Dengue virus
PPFGDSYIM

SEQ ID NO: 86912 - protein, 9 aa, Dengue virus
PFGDSYIMI

SEQ ID NO: 86913 - protein, 9 aa, Dengue virus
FGDSYIMIG

SEQ ID NO: 86914 - protein, 9 aa, Dengue virus
GDSYIMIGV

SEQ ID NO: 86915 - protein, 9 aa, Dengue virus
DSYIIIGVE

SEQ ID NO: 86916 - protein, 9 aa, Dengue virus
SYIIIGVEP

SEQ ID NO: 86917 - protein, 9 aa, Dengue virus
YIMIGVGNS

SEQ ID NO: 86918 - protein, 9 aa, Dengue virus
IIIGVEPGQ

SEQ ID NO: 86919 - protein, 9 aa, Dengue virus
MIGVGNSAL

SEQ ID NO: 86920 - protein, 9 aa, Dengue virus
IGVEPGQLK

SEQ ID NO: 86921 - protein, 9 aa, Dengue virus
GVEPGQLKL

SEQ ID NO: 86922 - protein, 9 aa, Dengue virus
VEPGQLKLN

SEQ ID NO: 86923 - protein, 9 aa, Dengue virus
EPGQLKLNW

SEQ ID NO: 86924 - protein, 9 aa, Dengue virus
PGQLKLNWF

SEQ ID NO: 86925 - protein, 9 aa, Dengue virus
KGSSIGQMF

SEQ ID NO: 86926 - protein, 9 aa, Dengue virus
GSSIGQMFE

SEQ ID NO: 86927 - protein, 9 aa, Dengue virus
SSIGQMFET

SEQ ID NO: 86928 - protein, 9 aa, Dengue virus
SIGQMFETT

SEQ ID NO: 86929 - protein, 9 aa, Dengue virus
IGQMFETTM

SEQ ID NO: 86930 - protein, 9 aa, Dengue virus
GQMFETTMR

SEQ ID NO: 86931 - protein, 9 aa, Dengue virus
KMLESTYRG

SEQ ID NO: 86932 - protein, 9 aa, Dengue virus
MFETTMRGA

SEQ ID NO: 86933 - protein, 9 aa, Dengue virus
LESTYRGAK

SEQ ID NO: 86934 - protein, 9 aa, Dengue virus
DFGSLGGVF

SEQ ID NO: 86935 - protein, 9 aa, Dengue virus
FGSLGGVFT

SEQ ID NO: 86936 - protein, 9 aa, Dengue virus
GSLGGVFTS

SEQ ID NO: 86937 - protein, 9 aa, Dengue virus
SLGGVFTSI

SEQ ID NO: 86938 - protein, 9 aa, Dengue virus
LGGVFTSIG

SEQ ID NO: 86939 - protein, 9 aa, Dengue virus
GGVFTSIGK

SEQ ID NO: 86940 - protein, 9 aa, Dengue virus
GVFTSIGKA

SEQ ID NO: 86941 - protein, 9 aa, Dengue virus
VFTSIGKAL

SEQ ID NO: 86942 - protein, 9 aa, Dengue virus
FTSIGKALH

SEQ ID NO: 86943 - protein, 9 aa, Dengue virus
SLGKAVHQI

SEQ ID NO: 86944 - protein, 9 aa, Dengue virus
IGKALHQVF

SEQ ID NO: 86945 - protein, 9 aa, Dengue virus
GKAVHQIFG

SEQ ID NO: 86946 - protein, 9 aa, Dengue virus
KAVHQIFGS

SEQ ID NO: 86947 - protein, 9 aa, Dengue virus
AVHQIFGSV

SEQ ID NO: 86948 - protein, 9 aa, Dengue virus
LHQVFGAIY

SEQ ID NO: 86949 - protein, 9 aa, Dengue virus
HQVFGAIYG

SEQ ID NO: 86950 - protein, 9 aa, Dengue virus
QVFGAIYGA

SEQ ID NO: 86951 - protein, 9 aa, Dengue virus
VFGAIYGAA

SEQ ID NO: 86952 - protein, 9 aa, Dengue virus
AFSGVSWTM

SEQ ID NO: 86953 - protein, 9 aa, Dengue virus
FSGVSWTMK

SEQ ID NO: 86954 - protein, 9 aa, Dengue virus
SGVSWTMKI

SEQ ID NO: 86955 - protein, 9 aa, Dengue virus
GVSWTMKIL

SEQ ID NO: 86956 - protein, 9 aa, Dengue virus
VSWTMKILI

SEQ ID NO: 86957 - protein, 9 aa, Dengue virus
SWTMKILIG

SEQ ID NO: 86958 - protein, 9 aa, Dengue virus
IRILIGLLV

SEQ ID NO: 86959 - protein, 9 aa, Dengue virus
KILIGVIIT

SEQ ID NO: 86960 - protein, 9 aa, Dengue virus
ILIGVIITW

SEQ ID NO: 86961 - protein, 9 aa, Dengue virus
LIGVIITWI

SEQ ID NO: 86962 - protein, 9 aa, Dengue virus
IGVIITWIG

SEQ ID NO: 86963 - protein, 9 aa, Dengue virus
GVIITWIGM

SEQ ID NO: 86964 - protein, 9 aa, Dengue virus
VIITWIGMN

SEQ ID NO: 86965 - protein, 9 aa, Dengue virus
IGMNSRNTS

SEQ ID NO: 86966 - protein, 9 aa, Dengue virus
GMNSRNTSM

SEQ ID NO: 86967 - protein, 9 aa, Dengue virus
TNSRNTPMA

SEQ ID NO: 86968 - protein, 9 aa, Dengue virus
SRNTPMAMT

SEQ ID NO: 86969 - protein, 9 aa, Dengue virus
RNTPMAMTC

SEQ ID NO: 86970 - protein, 9 aa, Dengue virus
NTPMAMTCI

SEQ ID NO: 86971 - protein, 9 aa, Dengue virus
TPMAMTCIA

SEQ ID NO: 86972 - protein, 9 aa, Dengue virus
PMAMTCIAV

SEQ ID NO: 86973 - protein, 9 aa, Dengue virus
LGFTVHADT

SEQ ID NO: 86974 - protein, 9 aa, Dengue virus
GFTVHADTG

SEQ ID NO: 86975 - protein, 9 aa, Dengue virus
FTVHADTGC

SEQ ID NO: 86976 - protein, 9 aa, Dengue virus
ADTGCAVSW

SEQ ID NO: 86977 - protein, 9 aa, Dengue virus
SWNGKELKC

SEQ ID NO: 86978 - protein, 9 aa, Dengue virus
WNGKELKCG

SEQ ID NO: 86979 - protein, 9 aa, Dengue virus
NGKELKCGS

SEQ ID NO: 86980 - protein, 9 aa, Dengue virus
KCGSGIFVA

SEQ ID NO: 86981 - protein, 9 aa, Dengue virus
CGSGIFVTD

SEQ ID NO: 86982 - protein, 9 aa, Dengue virus
GSGIFVADN

SEQ ID NO: 86983 - protein, 9 aa, Dengue virus
SGIFVADNV

SEQ ID NO: 86984 - protein, 9 aa, Dengue virus
GIFVTDNVH

SEQ ID NO: 86985 - protein, 9 aa, Dengue virus
IFVADNVHT

SEQ ID NO: 86986 - protein, 9 aa, Dengue virus
FVADNVHTW

SEQ ID NO: 86987 - protein, 9 aa, Dengue virus
VADNVHTWT

SEQ ID NO: 86988 - protein, 9 aa, Dengue virus
TDNVHTWTE

SEQ ID NO: 86989 - protein, 9 aa, Dengue virus
VHTWTEQHK

SEQ ID NO: 86990 - protein, 9 aa, Dengue virus
HTWIEQYKF

SEQ ID NO: 86991 - protein, 9 aa, Dengue virus
TWTEQHKFQ

SEQ ID NO: 86992 - protein, 9 aa, Dengue virus
WTEQHKFQP

SEQ ID NO: 86993 - protein, 9 aa, Dengue virus
TEQHKFQPE

SEQ ID NO: 86994 - protein, 9 aa, Dengue virus
SAILIAHKD

SEQ ID NO: 86995 - protein, 9 aa, Dengue virus
AILIAHKDG

SEQ ID NO: 86996 - protein, 9 aa, Dengue virus
ILNAHKEGV

SEQ ID NO: 86997 - protein, 9 aa, Dengue virus
LIAHKDGVC

SEQ ID NO: 86998 - protein, 9 aa, Dengue virus
IAHKDGVCG

SEQ ID NO: 86999 - protein, 9 aa, Dengue virus
AHKDGVCGV

SEQ ID NO: 87000 - protein, 9 aa, Dengue virus
HKEGVCGIR

SEQ ID NO: 87001 - protein, 9 aa, Dengue virus
KEGVCGIRS

SEQ ID NO: 87002 - protein, 9 aa, Dengue virus
DLTVVTGDV

SEQ ID NO: 87003 - protein, 9 aa, Dengue virus
LTVVAGDVR

SEQ ID NO: 87004 - protein, 9 aa, Dengue virus
TVVAGDVRG

SEQ ID NO: 87005 - protein, 9 aa, Dengue virus
VVAGDVRGV

SEQ ID NO: 87006 - protein, 9 aa, Dengue virus
VAGDVRGVL

SEQ ID NO: 87007 - protein, 9 aa, Dengue virus
AGDAKGVLT

SEQ ID NO: 87008 - protein, 9 aa, Dengue virus
GDAKGVLTK

SEQ ID NO: 87009 - protein, 9 aa, Dengue virus
DAKGVLTKG

SEQ ID NO: 87010 - protein, 9 aa, Dengue virus
VKGVLVKGK

SEQ ID NO: 87011 - protein, 9 aa, Dengue virus
KGVLVKGKR

SEQ ID NO: 87012 - protein, 9 aa, Dengue virus
GVLVKGKRA

SEQ ID NO: 87013 - protein, 9 aa, Dengue virus
VLVKGKRAL

SEQ ID NO: 87014 - protein, 9 aa, Dengue virus
LTKGKRALA

SEQ ID NO: 87015 - protein, 9 aa, Dengue virus
TKGKRALAP

SEQ ID NO: 87016 - protein, 9 aa, Dengue virus
KGKRVIAPP

SEQ ID NO: 87017 - protein, 9 aa, Dengue virus
GKRALAPPV

SEQ ID NO: 87018 - protein, 9 aa, Dengue virus
LTPPVNDLK

SEQ ID NO: 87019 - protein, 9 aa, Dengue virus
TPPVNDLKY

SEQ ID NO: 87020 - protein, 9 aa, Dengue virus
PPVNDLKYS

SEQ ID NO: 87021 - protein, 9 aa, Dengue virus
PVNDLKYSW

SEQ ID NO: 87022 - protein, 9 aa, Dengue virus
VNDLKYSWK

SEQ ID NO: 87023 - protein, 9 aa, Dengue virus
KAKIFAPEA

SEQ ID NO: 87024 - protein, 9 aa, Dengue virus
PEAKNSTFL

SEQ ID NO: 87025 - protein, 9 aa, Dengue virus
RNSTFLVDG

SEQ ID NO: 87026 - protein, 9 aa, Dengue virus
NERRAWNFL

SEQ ID NO: 87027 - protein, 9 aa, Dengue virus
ERRAWNFLE

SEQ ID NO: 87028 - protein, 9 aa, Dengue virus
RRAWNFLEV

SEQ ID NO: 87029 - protein, 9 aa, Dengue virus
RAWNFLEVE

SEQ ID NO: 87030 - protein, 9 aa, Dengue virus
AWNFLEVED

SEQ ID NO: 87031 - protein, 9 aa, Dengue virus
WNFLEVEDY

SEQ ID NO: 87032 - protein, 9 aa, Dengue virus
NFLEVEDYG

SEQ ID NO: 87033 - protein, 9 aa, Dengue virus
FLEVEDYGF

SEQ ID NO: 87034 - protein, 9 aa, Dengue virus
ESQMLIPKA

SEQ ID NO: 87035 - protein, 9 aa, Dengue virus
SQMLIPKAY

SEQ ID NO: 87036 - protein, 9 aa, Dengue virus
QMLIPKAYA

SEQ ID NO: 87037 - protein, 9 aa, Dengue virus
MLIPKAYAG

SEQ ID NO: 87038 - protein, 9 aa, Dengue virus
LIPKAYAGP

SEQ ID NO: 87039 - protein, 9 aa, Dengue virus
IPKAYAGPF

SEQ ID NO: 87040 - protein, 9 aa, Dengue virus
PKAYAGPFS

SEQ ID NO: 87041 - protein, 9 aa, Dengue virus
KAYAGPFSQ

SEQ ID NO: 87042 - protein, 9 aa, Dengue virus
SYAGPFSHH

SEQ ID NO: 87043 - protein, 9 aa, Dengue virus
YAGPISQHN

SEQ ID NO: 87044 - protein, 9 aa, Dengue virus
AGPISQHNY

SEQ ID NO: 87045 - protein, 9 aa, Dengue virus
GPISQHNYR

SEQ ID NO: 87046 - protein, 9 aa, Dengue virus
PISQHNYRQ

SEQ ID NO: 87047 - protein, 9 aa, Dengue virus
ISQHNYRQG

SEQ ID NO: 87048 - protein, 9 aa, Dengue virus
RQGYATQTA

SEQ ID NO: 87049 - protein, 9 aa, Dengue virus
QGYATQTAG

SEQ ID NO: 87050 - protein, 9 aa, Dengue virus
GYATQTAGP

SEQ ID NO: 87051 - protein, 9 aa, Dengue virus
YATQTAGPW

SEQ ID NO: 87052 - protein, 9 aa, Dengue virus
ATQTAGPWH

SEQ ID NO: 87053 - protein, 9 aa, Dengue virus
TQTAGPWHL

SEQ ID NO: 87054 - protein, 9 aa, Dengue virus
QTAGPWHLG

SEQ ID NO: 87055 - protein, 9 aa, Dengue virus
TAGPWHLGK

SEQ ID NO: 87056 - protein, 9 aa, Dengue virus
MGPWHLGKL

SEQ ID NO: 87057 - protein, 9 aa, Dengue virus
ECPGTTVTV

SEQ ID NO: 87058 - protein, 9 aa, Dengue virus
CPGTTVTVQ

SEQ ID NO: 87059 - protein, 9 aa, Dengue virus
PGTTVTIQD

SEQ ID NO: 87060 - protein, 9 aa, Dengue virus
GTTVAIQED

SEQ ID NO: 87061 - protein, 9 aa, Dengue virus
TTVAIQEDC

SEQ ID NO: 87062 - protein, 9 aa, Dengue virus
QEDCGHRGS

SEQ ID NO: 87063 - protein, 9 aa, Dengue virus
EDCGHRGSS

SEQ ID NO: 87064 - protein, 9 aa, Dengue virus
DCGHRGSSL

SEQ ID NO: 87065 - protein, 9 aa, Dengue virus
MEIRPLSER

SEQ ID NO: 87066 - protein, 9 aa, Dengue virus
EIRPLSERE

SEQ ID NO: 87067 - protein, 9 aa, Dengue virus
IRPLSEREE

SEQ ID NO: 87068 - protein, 9 aa, Dengue virus
RPLSEREEN

SEQ ID NO: 87069 - protein, 9 aa, Dengue virus
PLSEREENM

SEQ ID NO: 87070 - protein, 9 aa, Dengue virus
LSEREENMV

SEQ ID NO: 87071 - protein, 9 aa, Dengue virus
SEREENMVK

SEQ ID NO: 87072 - protein, 9 aa, Dengue virus
EKEENMVRS

SEQ ID NO: 87073 - protein, 9 aa, Dengue virus
KEENMVRSQ

SEQ ID NO: 87074 - protein, 9 aa, Dengue virus
EENMVRSQV

SEQ ID NO: 87075 - protein, 9 aa, Dengue virus
ENMVKSQVS

SEQ ID NO: 87076 - protein, 9 aa, Dengue virus
NMVKSQVSA

SEQ ID NO: 87077 - protein, 9 aa, Dengue virus
MVKSQVSAG

SEQ ID NO: 87078 - protein, 9 aa, Dengue virus
AGPGTSETF

SEQ ID NO: 87079 - protein, 9 aa, Dengue virus
GSSETFSMG

SEQ ID NO: 87080 - protein, 9 aa, Dengue virus
PSETFSMGL

SEQ ID NO: 87081 - protein, 9 aa, Dengue virus
GLLCLTLFI

SEQ ID NO: 87082 - protein, 9 aa, Dengue virus
LLCLTLFIE

SEQ ID NO: 87083 - protein, 9 aa, Dengue virus
LCLTLFIEE

SEQ ID NO: 87084 - protein, 9 aa, Dengue virus
CLTLFIEEC

SEQ ID NO: 87085 - protein, 9 aa, Dengue virus
LTLFIEECL

SEQ ID NO: 87086 - protein, 9 aa, Dengue virus
TLFIEECLR

SEQ ID NO: 87087 - protein, 9 aa, Dengue virus
LFIEECLRR

SEQ ID NO: 87088 - protein, 9 aa, Dengue virus
FIEECLRRK

SEQ ID NO: 87089 - protein, 9 aa, Dengue virus
IEECLRRKV

SEQ ID NO: 87090 - protein, 9 aa, Dengue virus
RKHMILVVA

SEQ ID NO: 87091 - protein, 9 aa, Dengue virus
KHMILVVVT

SEQ ID NO: 87092 - protein, 9 aa, Dengue virus
HMILVVVTT

SEQ ID NO: 87093 - protein, 9 aa, Dengue virus
TTLCAIILG

SEQ ID NO: 87094 - protein, 9 aa, Dengue virus
IMLGDTMFG

SEQ ID NO: 87095 - protein, 9 aa, Dengue virus
MLGDTMSSR

SEQ ID NO: 87096 - protein, 9 aa, Dengue virus
LGDTMLSRV

SEQ ID NO: 87097 - protein, 9 aa, Dengue virus
GDTMLSRVG

SEQ ID NO: 87098 - protein, 9 aa, Dengue virus
DTMLSRVGG

SEQ ID NO: 87099 - protein, 9 aa, Dengue virus
TMLSRVGGQ

SEQ ID NO: 87100 - protein, 9 aa, Dengue virus
RMGGQIHLA

SEQ ID NO: 87101 - protein, 9 aa, Dengue virus
MGGQIHLAI

SEQ ID NO: 87102 - protein, 9 aa, Dengue virus
GGQVHLAIM

SEQ ID NO: 87103 - protein, 9 aa, Dengue virus
GQVHLAIMA

SEQ ID NO: 87104 - protein, 9 aa, Dengue virus
QVHLAIMAV

SEQ ID NO: 87105 - protein, 9 aa, Dengue virus
VHLAIMAVF

SEQ ID NO: 87106 - protein, 9 aa, Dengue virus
YVLGVFLRR

SEQ ID NO: 87107 - protein, 9 aa, Dengue virus
VLGVFLRRL

SEQ ID NO: 87108 - protein, 9 aa, Dengue virus
LGVFLRRLT

SEQ ID NO: 87109 - protein, 9 aa, Dengue virus
GVFLRRLTS

SEQ ID NO: 87110 - protein, 9 aa, Dengue virus
VFLRRLTSR

SEQ ID NO: 87111 - protein, 9 aa, Dengue virus
IGMAMTTVF

SEQ ID NO: 87112 - protein, 9 aa, Dengue virus
GMAMTTVFS

SEQ ID NO: 87113 - protein, 9 aa, Dengue virus
MAMTTVFSI

SEQ ID NO: 87114 - protein, 9 aa, Dengue virus
AMTTVFSIP

SEQ ID NO: 87115 - protein, 9 aa, Dengue virus
MTTVFSIPH

SEQ ID NO: 87116 - protein, 9 aa, Dengue virus
TTVFSIPHD

SEQ ID NO: 87117 - protein, 9 aa, Dengue virus
TVFSIPHDL

SEQ ID NO: 87118 - protein, 9 aa, Dengue virus
VFSIPHDLM

SEQ ID NO: 87119 - protein, 9 aa, Dengue virus
LMEFIDGLS

SEQ ID NO: 87120 - protein, 9 aa, Dengue virus
MEFIDGLSL

SEQ ID NO: 87121 - protein, 9 aa, Dengue virus
ELIDGIALG

SEQ ID NO: 87122 - protein, 9 aa, Dengue virus
FIDGLSLGL

SEQ ID NO: 87123 - protein, 9 aa, Dengue virus
SLGLILLKT

SEQ ID NO: 87124 - protein, 9 aa, Dengue virus
GLILLKMVV

SEQ ID NO: 87125 - protein, 9 aa, Dengue virus
LILLKMVTH

SEQ ID NO: 87126 - protein, 9 aa, Dengue virus
ILLKMVTHF

SEQ ID NO: 87127 - protein, 9 aa, Dengue virus
LLKMVTHFD

SEQ ID NO: 87128 - protein, 9 aa, Dengue virus
VTHFDDTQV

SEQ ID NO: 87129 - protein, 9 aa, Dengue virus
THFDDTQVG

SEQ ID NO: 87130 - protein, 9 aa, Dengue virus
HFDDTQVGT

SEQ ID NO: 87131 - protein, 9 aa, Dengue virus
FDNAQLGTL

SEQ ID NO: 87132 - protein, 9 aa, Dengue virus
DNAQLGTLA

SEQ ID NO: 87133 - protein, 9 aa, Dengue virus
STQVGTLAL

SEQ ID NO: 87134 - protein, 9 aa, Dengue virus
LALSLTFIS

SEQ ID NO: 87135 - protein, 9 aa, Dengue virus
ALALTFIKS

SEQ ID NO: 87136 - protein, 9 aa, Dengue virus
LALTFIKST

SEQ ID NO: 87137 - protein, 9 aa, Dengue virus
PLIMAWRTI

SEQ ID NO: 87138 - protein, 9 aa, Dengue virus
LTMAWRTIM

SEQ ID NO: 87139 - protein, 9 aa, Dengue virus
TMAWRTIMA

SEQ ID NO: 87140 - protein, 9 aa, Dengue virus
RTIMAVLFA

SEQ ID NO: 87141 - protein, 9 aa, Dengue virus
TIMAVLFAV

SEQ ID NO: 87142 - protein, 9 aa, Dengue virus
IMAVLFAVT

SEQ ID NO: 87143 - protein, 9 aa, Dengue virus
MAVLFAVTL

SEQ ID NO: 87144 - protein, 9 aa, Dengue virus
AVLFAVTLI

SEQ ID NO: 87145 - protein, 9 aa, Dengue virus
VLFAVTLIP

SEQ ID NO: 87146 - protein, 9 aa, Dengue virus
LFAVTLIPL

SEQ ID NO: 87147 - protein, 9 aa, Dengue virus
HWVEITALT

SEQ ID NO: 87148 - protein, 9 aa, Dengue virus
WVEITALTL

SEQ ID NO: 87149 - protein, 9 aa, Dengue virus
VEITALTLG

SEQ ID NO: 87150 - protein, 9 aa, Dengue virus
EITALTLGA

SEQ ID NO: 87151 - protein, 9 aa, Dengue virus
ITALTLGAQ

SEQ ID NO: 87152 - protein, 9 aa, Dengue virus
TALTLGAQA

SEQ ID NO: 87153 - protein, 9 aa, Dengue virus
ALTLGAQAL

SEQ ID NO: 87154 - protein, 9 aa, Dengue virus
LTLGAQALP

SEQ ID NO: 87155 - protein, 9 aa, Dengue virus
DLSLERAAN

SEQ ID NO: 87156 - protein, 9 aa, Dengue virus
LSLERAANV

SEQ ID NO: 87157 - protein, 9 aa, Dengue virus
SLERAANVQ

SEQ ID NO: 87158 - protein, 9 aa, Dengue virus
LERAANVQW

SEQ ID NO: 87159 - protein, 9 aa, Dengue virus
ERAANVQWD

SEQ ID NO: 87160 - protein, 9 aa, Dengue virus
RAANVQWDE

SEQ ID NO: 87161 - protein, 9 aa, Dengue virus
AITGSSPII

SEQ ID NO: 87162 - protein, 9 aa, Dengue virus
PIIEVKQDD

SEQ ID NO: 87163 - protein, 9 aa, Dengue virus
IIEVKQDDD

SEQ ID NO: 87164 - protein, 9 aa, Dengue virus
PLAIPVTMA

SEQ ID NO: 87165 - protein, 9 aa, Dengue virus
LAIPVTMAL

SEQ ID NO: 87166 - protein, 9 aa, Dengue virus
AIPVTMALW

SEQ ID NO: 87167 - protein, 9 aa, Dengue virus
IPVTMALWY

SEQ ID NO: 87168 - protein, 9 aa, Dengue virus
PVTMALWYI

SEQ ID NO: 87169 - protein, 9 aa, Dengue virus
VTMALWYIW

SEQ ID NO: 87170 - protein, 9 aa, Dengue virus
TMALWYMWQ

SEQ ID NO: 87171 - protein, 9 aa, Dengue virus
MALWYMWQV

SEQ ID NO: 87172 - protein, 9 aa, Dengue virus
TLWYMWQVR

SEQ ID NO: 87173 - protein, 9 aa, Dengue virus
LWYMWQVRT

SEQ ID NO: 87174 - protein, 9 aa, Dengue virus
WYMWQVRTQ

SEQ ID NO: 87175 - protein, 9 aa, Dengue virus
YMWQVRTQR

SEQ ID NO: 87176 - protein, 9 aa, Dengue virus
MWQVRTQRS

SEQ ID NO: 87177 - protein, 9 aa, Dengue virus
WDVPSPATA

SEQ ID NO: 87178 - protein, 9 aa, Dengue virus
DVPSPAAAQ

SEQ ID NO: 87179 - protein, 9 aa, Dengue virus
VPSPAAAQK

SEQ ID NO: 87180 - protein, 9 aa, Dengue virus
PSPAAAQKA

SEQ ID NO: 87181 - protein, 9 aa, Dengue virus
TQKATLSEG

SEQ ID NO: 87182 - protein, 9 aa, Dengue virus
QKATLSEGV

SEQ ID NO: 87183 - protein, 9 aa, Dengue virus
KATLTEGVY

SEQ ID NO: 87184 - protein, 9 aa, Dengue virus
ATLTEGVYR

SEQ ID NO: 87185 - protein, 9 aa, Dengue virus
TLTEGVYRI

SEQ ID NO: 87186 - protein, 9 aa, Dengue virus
TQVGVGIHT

SEQ ID NO: 87187 - protein, 9 aa, Dengue virus
QVGVGVHVE

SEQ ID NO: 87188 - protein, 9 aa, Dengue virus
VGVGIHTEG

SEQ ID NO: 87189 - protein, 9 aa, Dengue virus
GVGIHTEGV

SEQ ID NO: 87190 - protein, 9 aa, Dengue virus
VGVHVEGVF

SEQ ID NO: 87191 - protein, 9 aa, Dengue virus
GVHVEGVFH

SEQ ID NO: 87192 - protein, 9 aa, Dengue virus
VHVEGVFHT

SEQ ID NO: 87193 - protein, 9 aa, Dengue virus
HVEGVFHTM

SEQ ID NO: 87194 - protein, 9 aa, Dengue virus
VEGVFHTMW

SEQ ID NO: 87195 - protein, 9 aa, Dengue virus
SSGSPIINR

SEQ ID NO: 87196 - protein, 9 aa, Dengue virus
FMTATPPGT

SEQ ID NO: 87197 - protein, 9 aa, Dengue virus
MTATPPGTT

SEQ ID NO: 87198 - protein, 9 aa, Dengue virus
TATPPGTTD

SEQ ID NO: 87199 - protein, 9 aa, Dengue virus
ATPPGTTDP

SEQ ID NO: 87200 - protein, 9 aa, Dengue virus
TPPGTTDPF

SEQ ID NO: 87201 - protein, 9 aa, Dengue virus
PPGTTDPFP

SEQ ID NO: 87202 - protein, 9 aa, Dengue virus
PGTTDPFPQ

SEQ ID NO: 87203 - protein, 9 aa, Dengue virus
GTTDPFPQS

SEQ ID NO: 87204 - protein, 9 aa, Dengue virus
TTDPFPQSN

SEQ ID NO: 87205 - protein, 9 aa, Dengue virus
RCLKPVIST

SEQ ID NO: 87206 - protein, 9 aa, Dengue virus
CLKPVISTD

SEQ ID NO: 87207 - protein, 9 aa, Dengue virus
LKPVISTDG

SEQ ID NO: 87208 - protein, 9 aa, Dengue virus
KPVISTDGP

SEQ ID NO: 87209 - protein, 9 aa, Dengue virus
PVISTDGPE

SEQ ID NO: 87210 - protein, 9 aa, Dengue virus
VISTDGPER

SEQ ID NO: 87211 - protein, 9 aa, Dengue virus
ISTDGPERV

SEQ ID NO: 87212 - protein, 9 aa, Dengue virus
STDGPERVI

SEQ ID NO: 87213 - protein, 9 aa, Dengue virus
RGRIGRNPT

SEQ ID NO: 87214 - protein, 9 aa, Dengue virus
GRIGRNPTQ

SEQ ID NO: 87215 - protein, 9 aa, Dengue virus
RIGRNPTQE

SEQ ID NO: 87216 - protein, 9 aa, Dengue virus
IGRNPTQED

SEQ ID NO: 87217 - protein, 9 aa, Dengue virus
GRNPTQEDD

SEQ ID NO: 87218 - protein, 9 aa, Dengue virus
RNPTQEDDQ

SEQ ID NO: 87219 - protein, 9 aa, Dengue virus
NPTQEDDQY

SEQ ID NO: 87220 - protein, 9 aa, Dengue virus
PTQEDDQYV

SEQ ID NO: 87221 - protein, 9 aa, Dengue virus
LTEIATLPA

SEQ ID NO: 87222 - protein, 9 aa, Dengue virus
TEIATLPAY

SEQ ID NO: 87223 - protein, 9 aa, Dengue virus
EIATLPAYL

SEQ ID NO: 87224 - protein, 9 aa, Dengue virus
IATLPAYLS

SEQ ID NO: 87225 - protein, 9 aa, Dengue virus
ATLPAYLSS

SEQ ID NO: 87226 - protein, 9 aa, Dengue virus
TLPAYLSSK

SEQ ID NO: 87227 - protein, 9 aa, Dengue virus
LPAYLSSKA

SEQ ID NO: 87228 - protein, 9 aa, Dengue virus
PAYLSSKAK

SEQ ID NO: 87229 - protein, 9 aa, Dengue virus
AYLSSKAKL

SEQ ID NO: 87230 - protein, 9 aa, Dengue virus
LHTTERGGK

SEQ ID NO: 87231 - protein, 9 aa, Dengue virus
HTTERGGKA

SEQ ID NO: 87232 - protein, 9 aa, Dengue virus
TTERGGKAY

SEQ ID NO: 87233 - protein, 9 aa, Dengue virus
TERGGKAYQ

SEQ ID NO: 87234 - protein, 9 aa, Dengue virus
ERGGKAYQH

SEQ ID NO: 87235 - protein, 9 aa, Dengue virus
RGGKAYQHA

SEQ ID NO: 87236 - protein, 9 aa, Dengue virus
GKGMGKLSM

SEQ ID NO: 87237 - protein, 9 aa, Dengue virus
KGIGKLSVG

SEQ ID NO: 87238 - protein, 9 aa, Dengue virus
GMGKLSMGL

SEQ ID NO: 87239 - protein, 9 aa, Dengue virus
IGKLSVGLI

SEQ ID NO: 87240 - protein, 9 aa, Dengue virus
GKLSVGLIA

SEQ ID NO: 87241 - protein, 9 aa, Dengue virus
KLSVGLIAI

SEQ ID NO: 87242 - protein, 9 aa, Dengue virus
LSVGLIAIA

SEQ ID NO: 87243 - protein, 9 aa, Dengue virus
SMGLITIAM

SEQ ID NO: 87244 - protein, 9 aa, Dengue virus
MGLITIAMA

SEQ ID NO: 87245 - protein, 9 aa, Dengue virus
GLITIAMAS

SEQ ID NO: 87246 - protein, 9 aa, Dengue virus
LITIAMASG

SEQ ID NO: 87247 - protein, 9 aa, Dengue virus
ITIAMASGL

SEQ ID NO: 87248 - protein, 9 aa, Dengue virus
TIAMASGLL

SEQ ID NO: 87249 - protein, 9 aa, Dengue virus
IAVASGLFW

SEQ ID NO: 87250 - protein, 9 aa, Dengue virus
AVASGLFWV

SEQ ID NO: 87251 - protein, 9 aa, Dengue virus
VASGLFWVA

SEQ ID NO: 87252 - protein, 9 aa, Dengue virus
ASGLFWVAE

SEQ ID NO: 87253 - protein, 9 aa, Dengue virus
SGLFWVAEI

SEQ ID NO: 87254 - protein, 9 aa, Dengue virus
GLFWVAEIQ

SEQ ID NO: 87255 - protein, 9 aa, Dengue virus
LFWVAEIQP

SEQ ID NO: 87256 - protein, 9 aa, Dengue virus
FWVAEIQPQ

SEQ ID NO: 87257 - protein, 9 aa, Dengue virus
WVAELQPQW

SEQ ID NO: 87258 - protein, 9 aa, Dengue virus
VAELQPQWI

SEQ ID NO: 87259 - protein, 9 aa, Dengue virus
IYVILTILA

SEQ ID NO: 87260 - protein, 9 aa, Dengue virus
YVILTILAI

SEQ ID NO: 87261 - protein, 9 aa, Dengue virus
VILALLTII

SEQ ID NO: 87262 - protein, 9 aa, Dengue virus
ILTILTIIA

SEQ ID NO: 87263 - protein, 9 aa, Dengue virus
LTILTIIAL

SEQ ID NO: 87264 - protein, 9 aa, Dengue virus
ILTIIALVA

SEQ ID NO: 87265 - protein, 9 aa, Dengue virus
LTIIALVAA

SEQ ID NO: 87266 - protein, 9 aa, Dengue virus
TIIALVAAN

SEQ ID NO: 87267 - protein, 9 aa, Dengue virus
IIALVAANE

SEQ ID NO: 87268 - protein, 9 aa, Dengue virus
IALVAANEM

SEQ ID NO: 87269 - protein, 9 aa, Dengue virus
ALVAANEMG

SEQ ID NO: 87270 - protein, 9 aa, Dengue virus
KADFGFYQV

SEQ ID NO: 87271 - protein, 9 aa, Dengue virus
TDFGFYQEK

SEQ ID NO: 87272 - protein, 9 aa, Dengue virus
DFGFYQEKT

SEQ ID NO: 87273 - protein, 9 aa, Dengue virus
FGFYQEKTE

SEQ ID NO: 87274 - protein, 9 aa, Dengue virus
GFYQEKTET

SEQ ID NO: 87275 - protein, 9 aa, Dengue virus
FYQEKTETT

SEQ ID NO: 87276 - protein, 9 aa, Dengue virus
YQEKTETTI

SEQ ID NO: 87277 - protein, 9 aa, Dengue virus
QEKTETTIL

SEQ ID NO: 87278 - protein, 9 aa, Dengue virus
EKTETTILD

SEQ ID NO: 87279 - protein, 9 aa, Dengue virus
KPETTILDV

SEQ ID NO: 87280 - protein, 9 aa, Dengue virus
PETTILDVD

SEQ ID NO: 87281 - protein, 9 aa, Dengue virus
LIASLVMLL

SEQ ID NO: 87282 - protein, 9 aa, Dengue virus
IASLVMLLV

SEQ ID NO: 87283 - protein, 9 aa, Dengue virus
ASLVMLFVH

SEQ ID NO: 87284 - protein, 9 aa, Dengue virus
SLAMLLVHY

SEQ ID NO: 87285 - protein, 9 aa, Dengue virus
LVMLFVHYA

SEQ ID NO: 87286 - protein, 9 aa, Dengue virus
AMLLVHYAI

SEQ ID NO: 87287 - protein, 9 aa, Dengue virus
LVLCAGQLF

SEQ ID NO: 87288 - protein, 9 aa, Dengue virus
VLCAGQLFL

SEQ ID NO: 87289 - protein, 9 aa, Dengue virus
LCAGQLFLM

SEQ ID NO: 87290 - protein, 9 aa, Dengue virus
CAGQLFLMR

SEQ ID NO: 87291 - protein, 9 aa, Dengue virus
AGQLFLMRT

SEQ ID NO: 87292 - protein, 9 aa, Dengue virus
FLMRTTWAF

SEQ ID NO: 87293 - protein, 9 aa, Dengue virus
VLTLSTGPA

SEQ ID NO: 87294 - protein, 9 aa, Dengue virus
LTLATGPVL

SEQ ID NO: 87295 - protein, 9 aa, Dengue virus
TLATGPVLT

SEQ ID NO: 87296 - protein, 9 aa, Dengue virus
LATGPVLTL

SEQ ID NO: 87297 - protein, 9 aa, Dengue virus
ATGPVLTLW

SEQ ID NO: 87298 - protein, 9 aa, Dengue virus
TGPVLTLWE

SEQ ID NO: 87299 - protein, 9 aa, Dengue virus
GPVLTLWEG

SEQ ID NO: 87300 - protein, 9 aa, Dengue virus
PVLTLWEGN

SEQ ID NO: 87301 - protein, 9 aa, Dengue virus
VLTLWEGNP

SEQ ID NO: 87302 - protein, 9 aa, Dengue virus
LAFSLIKNT

SEQ ID NO: 87303 - protein, 9 aa, Dengue virus
AFSLIKNTQ

SEQ ID NO: 87304 - protein, 9 aa, Dengue virus
FSLIKNTQT

SEQ ID NO: 87305 - protein, 9 aa, Dengue virus
SLIKNAQAP

SEQ ID NO: 87306 - protein, 9 aa, Dengue virus
LIKNAQAPR

SEQ ID NO: 87307 - protein, 9 aa, Dengue virus
IKNTQTPRR

SEQ ID NO: 87308 - protein, 9 aa, Dengue virus
KNAQAPRRG

SEQ ID NO: 87309 - protein, 9 aa, Dengue virus
NAQAPRRGT

SEQ ID NO: 87310 - protein, 9 aa, Dengue virus
AQAPRRGTG

SEQ ID NO: 87311 - protein, 9 aa, Dengue virus
TPRRGTGIT

SEQ ID NO: 87312 - protein, 9 aa, Dengue virus
SALKDGSKT

SEQ ID NO: 87313 - protein, 9 aa, Dengue virus
ALKDGSKTK

SEQ ID NO: 87314 - protein, 9 aa, Dengue virus
LKDGSKTKH

SEQ ID NO: 87315 - protein, 9 aa, Dengue virus
KDGSKTKHA

SEQ ID NO: 87316 - protein, 9 aa, Dengue virus
DGSKIKYAV

SEQ ID NO: 87317 - protein, 9 aa, Dengue virus
GSKIKYAVS

SEQ ID NO: 87318 - protein, 9 aa, Dengue virus
SKIKYAVSR

SEQ ID NO: 87319 - protein, 9 aa, Dengue virus
KIKYAVSRG

SEQ ID NO: 87320 - protein, 9 aa, Dengue virus
IKYAVSRGT

SEQ ID NO: 87321 - protein, 9 aa, Dengue virus
MVKPKGKVI

SEQ ID NO: 87322 - protein, 9 aa, Dengue virus
VKPKGKVID

SEQ ID NO: 87323 - protein, 9 aa, Dengue virus
ELEKLQRKY

SEQ ID NO: 87324 - protein, 9 aa, Dengue virus
LEKLQRKYG

SEQ ID NO: 87325 - protein, 9 aa, Dengue virus
EKLQRKYGG

SEQ ID NO: 87326 - protein, 9 aa, Dengue virus
KLQRKHGGS

SEQ ID NO: 87327 - protein, 9 aa, Dengue virus
LQRKHGGSL

SEQ ID NO: 87328 - protein, 9 aa, Dengue virus
QRKHGGSLV

SEQ ID NO: 87329 - protein, 9 aa, Dengue virus
RKHGGSLVR

SEQ ID NO: 87330 - protein, 9 aa, Dengue virus
KHGGSLVRC

SEQ ID NO: 87331 - protein, 9 aa, Dengue virus
HGGSLIRCP

SEQ ID NO: 87332 - protein, 9 aa, Dengue virus
GGSLIRCPL

SEQ ID NO: 87333 - protein, 9 aa, Dengue virus
GSLIRCPLS

SEQ ID NO: 87334 - protein, 9 aa, Dengue virus
SLIRCPLSR

SEQ ID NO: 87335 - protein, 9 aa, Dengue virus
TISKMLLNW

SEQ ID NO: 87336 - protein, 9 aa, Dengue virus
VSKMLLNRF

SEQ ID NO: 87337 - protein, 9 aa, Dengue virus
NWFTTRHRK

SEQ ID NO: 87338 - protein, 9 aa, Dengue virus
RFTTKHRKP

SEQ ID NO: 87339 - protein, 9 aa, Dengue virus
LLTKPWDMI

SEQ ID NO: 87340 - protein, 9 aa, Dengue virus
LTKPWDMIP

SEQ ID NO: 87341 - protein, 9 aa, Dengue virus
TKPWDMIPM

SEQ ID NO: 87342 - protein, 9 aa, Dengue virus
KPWDMIPMV

SEQ ID NO: 87343 - protein, 9 aa, Dengue virus
PWDMIPMVT

SEQ ID NO: 87344 - protein, 9 aa, Dengue virus
WDMIPMVTQ

SEQ ID NO: 87345 - protein, 9 aa, Dengue virus
DMIPMVTQL

SEQ ID NO: 87346 - protein, 9 aa, Dengue virus
MIPMVTQLA

SEQ ID NO: 87347 - protein, 9 aa, Dengue virus
TPQPKPGTQ

SEQ ID NO: 87348 - protein, 9 aa, Dengue virus
PQPKPGTQM

SEQ ID NO: 87349 - protein, 9 aa, Dengue virus
QPKPGTRVV

SEQ ID NO: 87350 - protein, 9 aa, Dengue virus
PKPGTRVVM

SEQ ID NO: 87351 - protein, 9 aa, Dengue virus
KPGTRVVMT

SEQ ID NO: 87352 - protein, 9 aa, Dengue virus
PGTRVVMTT

SEQ ID NO: 87353 - protein, 9 aa, Dengue virus
GTRVVMTTT

SEQ ID NO: 87354 - protein, 9 aa, Dengue virus
TRVVMTTTA

SEQ ID NO: 87355 - protein, 9 aa, Dengue virus
RVVMTTTAN

SEQ ID NO: 87356 - protein, 9 aa, Dengue virus
VVMTTTANW

SEQ ID NO: 87357 - protein, 9 aa, Dengue virus
NWLWTLLGK

SEQ ID NO: 87358 - protein, 9 aa, Dengue virus
WLWTLLGKK

SEQ ID NO: 87359 - protein, 9 aa, Dengue virus
LWTLLGKKK

SEQ ID NO: 87360 - protein, 9 aa, Dengue virus
LLGRKKNPR

SEQ ID NO: 87361 - protein, 9 aa, Dengue virus
LGRKKNPRL

SEQ ID NO: 87362 - protein, 9 aa, Dengue virus
GRKKNPRLC

SEQ ID NO: 87363 - protein, 9 aa, Dengue virus
RKKNPRLCT

SEQ ID NO: 87364 - protein, 9 aa, Dengue virus
KKTPRLCTR

SEQ ID NO: 87365 - protein, 9 aa, Dengue virus
KTPRLCTRE

SEQ ID NO: 87366 - protein, 9 aa, Dengue virus
TPRLCTREE

SEQ ID NO: 87367 - protein, 9 aa, Dengue virus
GYILEDIDR

SEQ ID NO: 87368 - protein, 9 aa, Dengue virus
YILEDIDRK

SEQ ID NO: 87369 - protein, 9 aa, Dengue virus
ILEDIDRKD

SEQ ID NO: 87370 - protein, 9 aa, Dengue virus
LEDIDRKDG

SEQ ID NO: 87371 - protein, 9 aa, Dengue virus
EDIDRKDGD

SEQ ID NO: 87372 - protein, 9 aa, Dengue virus
DIDRKDGDL

SEQ ID NO: 87373 - protein, 9 aa, Dengue virus
IDRKDGDLM

SEQ ID NO: 87374 - protein, 9 aa, Dengue virus
DRKDGDLMY

SEQ ID NO: 87375 - protein, 9 aa, Dengue virus
RKDGDLMYA

SEQ ID NO: 87376 - protein, 9 aa, Dengue virus
EQMAPHHRI

SEQ ID NO: 87377 - protein, 9 aa, Dengue virus
QMAPHHRIL

SEQ ID NO: 87378 - protein, 9 aa, Dengue virus
MAPHHRILA

SEQ ID NO: 87379 - protein, 9 aa, Dengue virus
APHHRILAK

SEQ ID NO: 87380 - protein, 9 aa, Dengue virus
PHHRILAKA

SEQ ID NO: 87381 - protein, 9 aa, Dengue virus
HHRILAKAI

SEQ ID NO: 87382 - protein, 9 aa, Dengue virus
HRILAKAIF

SEQ ID NO: 87383 - protein, 9 aa, Dengue virus
RILAKAIFK

SEQ ID NO: 87384 - protein, 9 aa, Dengue virus
GVITQDDMH

SEQ ID NO: 87385 - protein, 9 aa, Dengue virus
VITRDDMHN

SEQ ID NO: 87386 - protein, 9 aa, Dengue virus
ITQDDMHNP

SEQ ID NO: 87387 - protein, 9 aa, Dengue virus
TRDDMHNPK

SEQ ID NO: 87388 - protein, 9 aa, Dengue virus
QDDMHNPKG

SEQ ID NO: 87389 - protein, 9 aa, Dengue virus
QNPKGLRER

SEQ ID NO: 87390 - protein, 9 aa, Dengue virus
KGLRERVEK

SEQ ID NO: 87391 - protein, 9 aa, Dengue virus
GLRERVEKW

SEQ ID NO: 87392 - protein, 9 aa, Dengue virus
LKEKVEKWL

SEQ ID NO: 87393 - protein, 9 aa, Dengue virus
KERVENWLR

SEQ ID NO: 87394 - protein, 9 aa, Dengue virus
ERVENWLRE

SEQ ID NO: 87395 - protein, 9 aa, Dengue virus
RVENWLREC

SEQ ID NO: 87396 - protein, 9 aa, Dengue virus
VENWLRECG

SEQ ID NO: 87397 - protein, 9 aa, Dengue virus
ENWLRECGV

SEQ ID NO: 87398 - protein, 9 aa, Dengue virus
NWLRECGVD

SEQ ID NO: 87399 - protein, 9 aa, Dengue virus
VKPLDERFA

SEQ ID NO: 87400 - protein, 9 aa, Dengue virus
KPLDERFAT

SEQ ID NO: 87401 - protein, 9 aa, Dengue virus
PLDERFATS

SEQ ID NO: 87402 - protein, 9 aa, Dengue virus
LDERFATSL

SEQ ID NO: 87403 - protein, 9 aa, Dengue virus
DERFATSLL

SEQ ID NO: 87404 - protein, 9 aa, Dengue virus
ERFATSLLF

SEQ ID NO: 87405 - protein, 9 aa, Dengue virus
RFATSLLFL

SEQ ID NO: 87406 - protein, 9 aa, Dengue virus
FATSLLFLN

SEQ ID NO: 87407 - protein, 9 aa, Dengue virus
ATSLLFLND

SEQ ID NO: 87408 - protein, 9 aa, Dengue virus
PNMTDKTPI

SEQ ID NO: 87409 - protein, 9 aa, Dengue virus
NMTDKTPIH

SEQ ID NO: 87410 - protein, 9 aa, Dengue virus
MTDKTPIHS

SEQ ID NO: 87411 - protein, 9 aa, Dengue virus
TDKTPIHSW

SEQ ID NO: 87412 - protein, 9 aa, Dengue virus
TPVHSWEDV

SEQ ID NO: 87413 - protein, 9 aa, Dengue virus
PVHSWEDVP

SEQ ID NO: 87414 - protein, 9 aa, Dengue virus
VHSWEDVPY

SEQ ID NO: 87415 - protein, 9 aa, Dengue virus
AKNIQTAIT

SEQ ID NO: 87416 - protein, 9 aa, Dengue virus
KNIHTAIAQ

SEQ ID NO: 87417 - protein, 9 aa, Dengue virus
NIHTAIAQV

SEQ ID NO: 87418 - protein, 9 aa, Dengue virus
IQTAITQVR

SEQ ID NO: 87419 - protein, 9 aa, Dengue virus
HTAIAQVRN

SEQ ID NO: 87420 - protein, 9 aa, Dengue virus
EEYADYMPV

SEQ ID NO: 87421 - protein, 9 aa, Dengue virus
EYMDYMPVM

SEQ ID NO: 87422 - protein, 9 aa, Dengue virus
YVDYMPVMR

SEQ ID NO: 87423 - protein, 9 aa, Dengue virus
VDYMPVMRR

SEQ ID NO: 87424 - protein, 9 aa, Dengue virus
DYMPVMRRY

SEQ ID NO: 87425 - protein, 9 aa, Dengue virus
YMPVMRRYS

SEQ ID NO: 87426 - protein, 9 aa, Dengue virus
MPVMRRYSA

SEQ ID NO: 87427 - protein, 9 aa, Dengue virus
PVMRRYSAL

SEQ ID NO: 87428 - protein, 9 aa, Dengue virus
MRRYSALSE

SEQ ID NO: 87429 - protein, 9 aa, Dengue virus
RYSALSESE

SEQ ID NO: 87430 - protein, 9 aa, Dengue virus
YSALSESEG

SEQ ID NO: 87431 - protein, 9 aa, Dengue virus
SALSESEGV

SEQ ID NO: 87432 - protein, 9 aa, Dengue virus
ALSESEGVL

SEQ ID NO: 87433 - protein, 9 aa, Dengue virus
NKVVRPSFN

SEQ ID NO: 87434 - protein, 9 aa, Dengue virus
RVVRPPFNM

SEQ ID NO: 87435 - protein, 9 aa, Dengue virus
QQLTKRFSL

SEQ ID NO: 87436 - protein, 9 aa, Dengue virus
GLVKRFSIG

SEQ ID NO: 87437 - protein, 9 aa, Dengue virus
LTKRFSLGM

SEQ ID NO: 87438 - protein, 9 aa, Dengue virus
TKRFSLGML

SEQ ID NO: 87439 - protein, 9 aa, Dengue virus
KRFSLGMLQ

SEQ ID NO: 87440 - protein, 9 aa, Dengue virus
RFSIGLFSG

SEQ ID NO: 87441 - protein, 9 aa, Dengue virus
FSLGMLQGR

SEQ ID NO: 87442 - protein, 9 aa, Dengue virus
SLGMLQGRG

SEQ ID NO: 87443 - protein, 9 aa, Dengue virus
LGMLQGRGP

SEQ ID NO: 87444 - protein, 9 aa, Dengue virus
QLKKTKAIK

SEQ ID NO: 87445 - protein, 9 aa, Dengue virus
IKKSKAINV

SEQ ID NO: 87446 - protein, 9 aa, Dengue virus
KKSKAINVL

SEQ ID NO: 87447 - protein, 9 aa, Dengue virus
KSKAINVLR

SEQ ID NO: 87448 - protein, 9 aa, Dengue virus
SKAINVLRG

SEQ ID NO: 87449 - protein, 9 aa, Dengue virus
KAINVLRGF

SEQ ID NO: 87450 - protein, 9 aa, Dengue virus
AINVLRGFR

SEQ ID NO: 87451 - protein, 9 aa, Dengue virus
INVLRGFRK

SEQ ID NO: 87452 - protein, 9 aa, Dengue virus
NVLRGFRKE

SEQ ID NO: 87453 - protein, 9 aa, Dengue virus
MLNILNRRK

SEQ ID NO: 87454 - protein, 9 aa, Dengue virus
LNILNRRKR

SEQ ID NO: 87455 - protein, 9 aa, Dengue virus
NILNRRRRT

SEQ ID NO: 87456 - protein, 9 aa, Dengue virus
ILNRRKRST

SEQ ID NO: 87457 - protein, 9 aa, Dengue virus
RRRTAGMII

SEQ ID NO: 87458 - protein, 9 aa, Dengue virus
KRSTVTLLC

SEQ ID NO: 87459 - protein, 9 aa, Dengue virus
RTAGMIIML

SEQ ID NO: 87460 - protein, 9 aa, Dengue virus
TAGMIIMLI

SEQ ID NO: 87461 - protein, 9 aa, Dengue virus
AGMIIMLIP

SEQ ID NO: 87462 - protein, 9 aa, Dengue virus
GMIIMLIPT

SEQ ID NO: 87463 - protein, 9 aa, Dengue virus
MIIMLIPTV

SEQ ID NO: 87464 - protein, 9 aa, Dengue virus
IIMLIPTVM

SEQ ID NO: 87465 - protein, 9 aa, Dengue virus
IMLIPTVMA

SEQ ID NO: 87466 - protein, 9 aa, Dengue virus
MLIPTVMAF

SEQ ID NO: 87467 - protein, 9 aa, Dengue virus
LIPTIMAFH

SEQ ID NO: 87468 - protein, 9 aa, Dengue virus
IPTIMAFHL

SEQ ID NO: 87469 - protein, 9 aa, Dengue virus
PTIMAFHLS

SEQ ID NO: 87470 - protein, 9 aa, Dengue virus
TIMAFHLST

SEQ ID NO: 87471 - protein, 9 aa, Dengue virus
IMAFHLSTR

SEQ ID NO: 87472 - protein, 9 aa, Dengue virus
VTYECPLLV

SEQ ID NO: 87473 - protein, 9 aa, Dengue virus
TYKCPLLRQ

SEQ ID NO: 87474 - protein, 9 aa, Dengue virus
YKCPLLRQN

SEQ ID NO: 87475 - protein, 9 aa, Dengue virus
ECPLLVNTE

SEQ ID NO: 87476 - protein, 9 aa, Dengue virus
IGQTRIQRT

SEQ ID NO: 87477 - protein, 9 aa, Dengue virus
GQTGIQRAV

SEQ ID NO: 87478 - protein, 9 aa, Dengue virus
QTRIQRTVF

SEQ ID NO: 87479 - protein, 9 aa, Dengue virus
TRIQRTVFF

SEQ ID NO: 87480 - protein, 9 aa, Dengue virus
RIQRTVFFV

SEQ ID NO: 87481 - protein, 9 aa, Dengue virus
IQRTIFFVL

SEQ ID NO: 87482 - protein, 9 aa, Dengue virus
QRTIFFVLM

SEQ ID NO: 87483 - protein, 9 aa, Dengue virus
RAVFFVLMM

SEQ ID NO: 87484 - protein, 9 aa, Dengue virus
TIFFVLMML

SEQ ID NO: 87485 - protein, 9 aa, Dengue virus
QQYICRRNV

SEQ ID NO: 87486 - protein, 9 aa, Dengue virus
DIPNHGVTA

SEQ ID NO: 87487 - protein, 9 aa, Dengue virus
IPNHGVTAT

SEQ ID NO: 87488 - protein, 9 aa, Dengue virus
PNHGVTATI

SEQ ID NO: 87489 - protein, 9 aa, Dengue virus
KHGKEIKIT

SEQ ID NO: 87490 - protein, 9 aa, Dengue virus
HGKEIKITP

SEQ ID NO: 87491 - protein, 9 aa, Dengue virus
GKEIKITPQ

SEQ ID NO: 87492 - protein, 9 aa, Dengue virus
VTATITPRT

SEQ ID NO: 87493 - protein, 9 aa, Dengue virus
EIKITPQSS

SEQ ID NO: 87494 - protein, 9 aa, Dengue virus
IKITPQSSI

SEQ ID NO: 87495 - protein, 9 aa, Dengue virus
TITPRTPSV

SEQ ID NO: 87496 - protein, 9 aa, Dengue virus
PRTPSVEVK

SEQ ID NO: 87497 - protein, 9 aa, Dengue virus
RTPSVEVKL

SEQ ID NO: 87498 - protein, 9 aa, Dengue virus
SSITEAELT

SEQ ID NO: 87499 - protein, 9 aa, Dengue virus
PSVEVQLPD

SEQ ID NO: 87500 - protein, 9 aa, Dengue virus
SAEVKLPDY

SEQ ID NO: 87501 - protein, 9 aa, Dengue virus
AEVKLPDYG

SEQ ID NO: 87502 - protein, 9 aa, Dengue virus
DFNEMILME

SEQ ID NO: 87503 - protein, 9 aa, Dengue virus
FNEMILMEM

SEQ ID NO: 87504 - protein, 9 aa, Dengue virus
NEMVLLQME

SEQ ID NO: 87505 - protein, 9 aa, Dengue virus
MKTKTWLVH

SEQ ID NO: 87506 - protein, 9 aa, Dengue virus
EKKTWLVHK

SEQ ID NO: 87507 - protein, 9 aa, Dengue virus
LDLPLPWLP

SEQ ID NO: 87508 - protein, 9 aa, Dengue virus
DLPLPWLPG

SEQ ID NO: 87509 - protein, 9 aa, Dengue virus
LPLPWLPGA

SEQ ID NO: 87510 - protein, 9 aa, Dengue virus
PLPWLPGAD

SEQ ID NO: 87511 - protein, 9 aa, Dengue virus
LPWLPGADT

SEQ ID NO: 87512 - protein, 9 aa, Dengue virus
PWLPGADTQ

SEQ ID NO: 87513 - protein, 9 aa, Dengue virus
WLPGADTQG

SEQ ID NO: 87514 - protein, 9 aa, Dengue virus
LPGADTQGS

SEQ ID NO: 87515 - protein, 9 aa, Dengue virus
AGADTLEVH

SEQ ID NO: 87516 - protein, 9 aa, Dengue virus
DTQGSNWIQ

SEQ ID NO: 87517 - protein, 9 aa, Dengue virus
TQGSNWIQK

SEQ ID NO: 87518 - protein, 9 aa, Dengue virus
LEVHWNHKE

SEQ ID NO: 87519 - protein, 9 aa, Dengue virus
EGAGAPCKI

SEQ ID NO: 87520 - protein, 9 aa, Dengue virus
GDGSPCKIP

SEQ ID NO: 87521 - protein, 9 aa, Dengue virus
AGAPCKIPI

SEQ ID NO: 87522 - protein, 9 aa, Dengue virus
EIRDVNKER

SEQ ID NO: 87523 - protein, 9 aa, Dengue virus
IKDMNKEKV

SEQ ID NO: 87524 - protein, 9 aa, Dengue virus
RDVNKEKVI

SEQ ID NO: 87525 - protein, 9 aa, Dengue virus
DVNKEKVIG

SEQ ID NO: 87526 - protein, 9 aa, Dengue virus
VNKEKVIGR

SEQ ID NO: 87527 - protein, 9 aa, Dengue virus
VTEKDSPVN

SEQ ID NO: 87528 - protein, 9 aa, Dengue virus
TEKDSPVNI

SEQ ID NO: 87529 - protein, 9 aa, Dengue virus
EKDSPVNIE

SEQ ID NO: 87530 - protein, 9 aa, Dengue virus
DSYIVIGAG

SEQ ID NO: 87531 - protein, 9 aa, Dengue virus
SYIMIGVGN

SEQ ID NO: 87532 - protein, 9 aa, Dengue virus
YIIIGVEPG

SEQ ID NO: 87533 - protein, 9 aa, Dengue virus
IMIGVGNSA

SEQ ID NO: 87534 - protein, 9 aa, Dengue virus
IIGVEPGQL

SEQ ID NO: 87535 - protein, 9 aa, Dengue virus
VRILIGLLV

SEQ ID NO: 87536 - protein, 9 aa, Dengue virus
LGFTVRADM

SEQ ID NO: 87537 - protein, 9 aa, Dengue virus
GFTVQADTG

SEQ ID NO: 87538 - protein, 9 aa, Dengue virus
FTVQADVGC

SEQ ID NO: 87539 - protein, 9 aa, Dengue virus
ADMGCAVSW

SEQ ID NO: 87540 - protein, 9 aa, Dengue virus
SWNGRELKC

SEQ ID NO: 87541 - protein, 9 aa, Dengue virus
WNGRELKCG

SEQ ID NO: 87542 - protein, 9 aa, Dengue virus
NGRELKCGS

SEQ ID NO: 87543 - protein, 9 aa, Dengue virus
KCGSGIFVT

SEQ ID NO: 87544 - protein, 9 aa, Dengue virus
CGSGIFVAD

SEQ ID NO: 87545 - protein, 9 aa, Dengue virus
GSGIFVTDN

SEQ ID NO: 87546 - protein, 9 aa, Dengue virus
SGIFVTDNV

SEQ ID NO: 87547 - protein, 9 aa, Dengue virus
GIFVADNVH

SEQ ID NO: 87548 - protein, 9 aa, Dengue virus
IFVTDNVHT

SEQ ID NO: 87549 - protein, 9 aa, Dengue virus
FVTDNVHTW

SEQ ID NO: 87550 - protein, 9 aa, Dengue virus
VTDNVHTWT

SEQ ID NO: 87551 - protein, 9 aa, Dengue virus
ADNVHTWTE

SEQ ID NO: 87552 - protein, 9 aa, Dengue virus
LTVVTGDVK

SEQ ID NO: 87553 - protein, 9 aa, Dengue virus
TIVAGDVKG

SEQ ID NO: 87554 - protein, 9 aa, Dengue virus
IVAGDVKGV

SEQ ID NO: 87555 - protein, 9 aa, Dengue virus
AGDVKGVLV

SEQ ID NO: 87556 - protein, 9 aa, Dengue virus
GDVKGVLVK

SEQ ID NO: 87557 - protein, 9 aa, Dengue virus
DVKGVLVKG

SEQ ID NO: 87558 - protein, 9 aa, Dengue virus
AKGVLTKGK

SEQ ID NO: 87559 - protein, 9 aa, Dengue virus
GVLTKGKRV

SEQ ID NO: 87560 - protein, 9 aa, Dengue virus
VLTKGKRVI

SEQ ID NO: 87561 - protein, 9 aa, Dengue virus
LVKGKRALT

SEQ ID NO: 87562 - protein, 9 aa, Dengue virus
VKGKRALTP

SEQ ID NO: 87563 - protein, 9 aa, Dengue virus
GKRALAPPA

SEQ ID NO: 87564 - protein, 9 aa, Dengue virus
LAPPVNDLK

SEQ ID NO: 87565 - protein, 9 aa, Dengue virus
APPVNDLKY

SEQ ID NO: 87566 - protein, 9 aa, Dengue virus
KAKIFTPEV

SEQ ID NO: 87567 - protein, 9 aa, Dengue virus
PETKNSTFL

SEQ ID NO: 87568 - protein, 9 aa, Dengue virus
NERRAWNFF

SEQ ID NO: 87569 - protein, 9 aa, Dengue virus
ERRAWNFFE

SEQ ID NO: 87570 - protein, 9 aa, Dengue virus
RRAWNFFEV

SEQ ID NO: 87571 - protein, 9 aa, Dengue virus
RAWNFFEVE

SEQ ID NO: 87572 - protein, 9 aa, Dengue virus
AWNFFEVED

SEQ ID NO: 87573 - protein, 9 aa, Dengue virus
WNFFEVEDY

SEQ ID NO: 87574 - protein, 9 aa, Dengue virus
NFFEVEDYG

SEQ ID NO: 87575 - protein, 9 aa, Dengue virus
FFEVEDYGF

SEQ ID NO: 87576 - protein, 9 aa, Dengue virus
IPKAYAGPI

SEQ ID NO: 87577 - protein, 9 aa, Dengue virus
PKAYAGPIS

SEQ ID NO: 87578 - protein, 9 aa, Dengue virus
KSYAGPFSH

SEQ ID NO: 87579 - protein, 9 aa, Dengue virus
AYAGPISQH

SEQ ID NO: 87580 - protein, 9 aa, Dengue virus
RQGYATQIA

SEQ ID NO: 87581 - protein, 9 aa, Dengue virus
QGYATQIAG

SEQ ID NO: 87582 - protein, 9 aa, Dengue virus
GYATQIAGP

SEQ ID NO: 87583 - protein, 9 aa, Dengue virus
YATQIAGPW

SEQ ID NO: 87584 - protein, 9 aa, Dengue virus
ATQIAGPWH

SEQ ID NO: 87585 - protein, 9 aa, Dengue virus
TQIAGPWHL

SEQ ID NO: 87586 - protein, 9 aa, Dengue virus
QIAGPWHLG

SEQ ID NO: 87587 - protein, 9 aa, Dengue virus
IAGPWHLGK

SEQ ID NO: 87588 - protein, 9 aa, Dengue virus
PGTTVTVRE

SEQ ID NO: 87589 - protein, 9 aa, Dengue virus
GTTVTIQDD

SEQ ID NO: 87590 - protein, 9 aa, Dengue virus
TTVTIQDDC

SEQ ID NO: 87591 - protein, 9 aa, Dengue virus
QDDCDHRGP

SEQ ID NO: 87592 - protein, 9 aa, Dengue virus
DDCDHRGPS

SEQ ID NO: 87593 - protein, 9 aa, Dengue virus
NEKEENMVR

SEQ ID NO: 87594 - protein, 9 aa, Dengue virus
ENMVKSQAT

SEQ ID NO: 87595 - protein, 9 aa, Dengue virus
NMVKSQATA

SEQ ID NO: 87596 - protein, 9 aa, Dengue virus
MVKSQATAG

SEQ ID NO: 87597 - protein, 9 aa, Dengue virus
AGQGSSETF

SEQ ID NO: 87598 - protein, 9 aa, Dengue virus
GPSETFSMG

SEQ ID NO: 87599 - protein, 9 aa, Dengue virus
TPETFSMGL

SEQ ID NO: 87600 - protein, 9 aa, Dengue virus
KHMILVVAI

SEQ ID NO: 87601 - protein, 9 aa, Dengue virus
HMILVVAIT

SEQ ID NO: 87602 - protein, 9 aa, Dengue virus
TTFCAIILG

SEQ ID NO: 87603 - protein, 9 aa, Dengue virus
LGDTMFGRM

SEQ ID NO: 87604 - protein, 9 aa, Dengue virus
GDTMSSRMG

SEQ ID NO: 87605 - protein, 9 aa, Dengue virus
DTMSSRMGG

SEQ ID NO: 87606 - protein, 9 aa, Dengue virus
TMSSRMGGQ

SEQ ID NO: 87607 - protein, 9 aa, Dengue virus
RIGGQVHLA

SEQ ID NO: 87608 - protein, 9 aa, Dengue virus
VGGQTHLAI

SEQ ID NO: 87609 - protein, 9 aa, Dengue virus
GQTHLAIMI

SEQ ID NO: 87610 - protein, 9 aa, Dengue virus
QTHLAIMIV

SEQ ID NO: 87611 - protein, 9 aa, Dengue virus
THLAIMIVF

SEQ ID NO: 87612 - protein, 9 aa, Dengue virus
IGMAMTTTF

SEQ ID NO: 87613 - protein, 9 aa, Dengue virus
GMAMTTTFS

SEQ ID NO: 87614 - protein, 9 aa, Dengue virus
MAMTTTFSI

SEQ ID NO: 87615 - protein, 9 aa, Dengue virus
AMTTTFSIP

SEQ ID NO: 87616 - protein, 9 aa, Dengue virus
MTTTFSIPH

SEQ ID NO: 87617 - protein, 9 aa, Dengue virus
TTTFSIPHD

SEQ ID NO: 87618 - protein, 9 aa, Dengue virus
TTFSIPHDL

SEQ ID NO: 87619 - protein, 9 aa, Dengue virus
TFSIPHDLM

SEQ ID NO: 87620 - protein, 9 aa, Dengue virus
LILLKMVVH

SEQ ID NO: 87621 - protein, 9 aa, Dengue virus
ILLKMVVHF

SEQ ID NO: 87622 - protein, 9 aa, Dengue virus
LLKMVVHFD

SEQ ID NO: 87623 - protein, 9 aa, Dengue virus
VTQFDDTQV

SEQ ID NO: 87624 - protein, 9 aa, Dengue virus
THFDSTQVG

SEQ ID NO: 87625 - protein, 9 aa, Dengue virus
QFDDTQVGT

SEQ ID NO: 87626 - protein, 9 aa, Dengue virus
ALSLTFISS

SEQ ID NO: 87627 - protein, 9 aa, Dengue virus
LSLTFIKTT

SEQ ID NO: 87628 - protein, 9 aa, Dengue virus
PLTMAWRTI

SEQ ID NO: 87629 - protein, 9 aa, Dengue virus
PVTMALWYM

SEQ ID NO: 87630 - protein, 9 aa, Dengue virus
VTMALWYMW

SEQ ID NO: 87631 - protein, 9 aa, Dengue virus
ALWYMWQVK

SEQ ID NO: 87632 - protein, 9 aa, Dengue virus
DVPSPATAQ

SEQ ID NO: 87633 - protein, 9 aa, Dengue virus
VPSPATAQK

SEQ ID NO: 87634 - protein, 9 aa, Dengue virus
PSPATAQKA

SEQ ID NO: 87635 - protein, 9 aa, Dengue virus
AQKATLTEG

SEQ ID NO: 87636 - protein, 9 aa, Dengue virus
QKATLTEGV

SEQ ID NO: 87637 - protein, 9 aa, Dengue virus
MTATPPGST

SEQ ID NO: 87638 - protein, 9 aa, Dengue virus
TATPPGSTD

SEQ ID NO: 87639 - protein, 9 aa, Dengue virus
ATPPGSTDP

SEQ ID NO: 87640 - protein, 9 aa, Dengue virus
TPPGSTDPF

SEQ ID NO: 87641 - protein, 9 aa, Dengue virus
PPGSTDPFP

SEQ ID NO: 87642 - protein, 9 aa, Dengue virus
PGSTDPFPQ

SEQ ID NO: 87643 - protein, 9 aa, Dengue virus
GSTDPFPQS

SEQ ID NO: 87644 - protein, 9 aa, Dengue virus
STDPFPQSN

SEQ ID NO: 87645 - protein, 9 aa, Dengue virus
SLPTYLSSK

SEQ ID NO: 87646 - protein, 9 aa, Dengue virus
SVGLIAIAV

SEQ ID NO: 87647 - protein, 9 aa, Dengue virus
VGLIAIAVA

SEQ ID NO: 87648 - protein, 9 aa, Dengue virus
TIAVASGLF

SEQ ID NO: 87649 - protein, 9 aa, Dengue virus
AVASSLLWV

SEQ ID NO: 87650 - protein, 9 aa, Dengue virus
VASSLLWVA

SEQ ID NO: 87651 - protein, 9 aa, Dengue virus
SGLLWVAEL

SEQ ID NO: 87652 - protein, 9 aa, Dengue virus
GLLWVAELQ

SEQ ID NO: 87653 - protein, 9 aa, Dengue virus
LLWVAELQP

SEQ ID NO: 87654 - protein, 9 aa, Dengue virus
LWVAELQPQ

SEQ ID NO: 87655 - protein, 9 aa, Dengue virus
ILALLTIIS

SEQ ID NO: 87656 - protein, 9 aa, Dengue virus
LALLTIISL

SEQ ID NO: 87657 - protein, 9 aa, Dengue virus
LLTIISLIA

SEQ ID NO: 87658 - protein, 9 aa, Dengue virus
LAIIGLIAA

SEQ ID NO: 87659 - protein, 9 aa, Dengue virus
AIIGLIAAN

SEQ ID NO: 87660 - protein, 9 aa, Dengue virus
KTDFGFYQE

SEQ ID NO: 87661 - protein, 9 aa, Dengue virus
ADFGFYQVK

SEQ ID NO: 87662 - protein, 9 aa, Dengue virus
DFGFYQVKA

SEQ ID NO: 87663 - protein, 9 aa, Dengue virus
FGFYQVKAE

SEQ ID NO: 87664 - protein, 9 aa, Dengue virus
GFYQVKAET

SEQ ID NO: 87665 - protein, 9 aa, Dengue virus
FYQEKPETT

SEQ ID NO: 87666 - protein, 9 aa, Dengue virus
YQVKAETTI

SEQ ID NO: 87667 - protein, 9 aa, Dengue virus
QVKTEITIL

SEQ ID NO: 87668 - protein, 9 aa, Dengue virus
VKAETTILD

SEQ ID NO: 87669 - protein, 9 aa, Dengue virus
LTASLVMLF

SEQ ID NO: 87670 - protein, 9 aa, Dengue virus
TASLVMLFV

SEQ ID NO: 87671 - protein, 9 aa, Dengue virus
LTLATGPTL

SEQ ID NO: 87672 - protein, 9 aa, Dengue virus
TLSTGPALT

SEQ ID NO: 87673 - protein, 9 aa, Dengue virus
LATGPTLTL

SEQ ID NO: 87674 - protein, 9 aa, Dengue virus
STGPALTLW

SEQ ID NO: 87675 - protein, 9 aa, Dengue virus
TGPTLTLWE

SEQ ID NO: 87676 - protein, 9 aa, Dengue virus
GPALTLWEG

SEQ ID NO: 87677 - protein, 9 aa, Dengue virus
PALTLWEGG

SEQ ID NO: 87678 - protein, 9 aa, Dengue virus
TLTLWEGNP

SEQ ID NO: 87679 - protein, 9 aa, Dengue virus
FSLIKNAQA

SEQ ID NO: 87680 - protein, 9 aa, Dengue virus
SLIKNTQTP

SEQ ID NO: 87681 - protein, 9 aa, Dengue virus
LIKNTQTPR

SEQ ID NO: 87682 - protein, 9 aa, Dengue virus
IKNAQAPRR

SEQ ID NO: 87683 - protein, 9 aa, Dengue virus
KNTQTPRRG

SEQ ID NO: 87684 - protein, 9 aa, Dengue virus
NTQTPRRGT

SEQ ID NO: 87685 - protein, 9 aa, Dengue virus
TQTPRRGTG

SEQ ID NO: 87686 - protein, 9 aa, Dengue virus
SALRDGSKT

SEQ ID NO: 87687 - protein, 9 aa, Dengue virus
ALRDGSKTK

SEQ ID NO: 87688 - protein, 9 aa, Dengue virus
LKDGSKIKY

SEQ ID NO: 87689 - protein, 9 aa, Dengue virus
KDGSKIKYA

SEQ ID NO: 87690 - protein, 9 aa, Dengue virus
KLQRKYGGS

SEQ ID NO: 87691 - protein, 9 aa, Dengue virus
LQRKYGGNL

SEQ ID NO: 87692 - protein, 9 aa, Dengue virus
QRKHGGSLI

SEQ ID NO: 87693 - protein, 9 aa, Dengue virus
RKHGGSLIR

SEQ ID NO: 87694 - protein, 9 aa, Dengue virus
KHGGSLIRC

SEQ ID NO: 87695 - protein, 9 aa, Dengue virus
YGGNLIRCP

SEQ ID NO: 87696 - protein, 9 aa, Dengue virus
PQPKLGTRV

SEQ ID NO: 87697 - protein, 9 aa, Dengue virus
QPKPGTQMI

SEQ ID NO: 87698 - protein, 9 aa, Dengue virus
PKLGTRVVM

SEQ ID NO: 87699 - protein, 9 aa, Dengue virus
KLGTRVVMT

SEQ ID NO: 87700 - protein, 9 aa, Dengue virus
PGTQMIMTT

SEQ ID NO: 87701 - protein, 9 aa, Dengue virus
GTQMIMTTT

SEQ ID NO: 87702 - protein, 9 aa, Dengue virus
TQMIMTTTA

SEQ ID NO: 87703 - protein, 9 aa, Dengue virus
QMIMTTTAN

SEQ ID NO: 87704 - protein, 9 aa, Dengue virus
LLGKKKTPR

SEQ ID NO: 87705 - protein, 9 aa, Dengue virus
LGKKKTPRL

SEQ ID NO: 87706 - protein, 9 aa, Dengue virus
GKKKTPRLC

SEQ ID NO: 87707 - protein, 9 aa, Dengue virus
KKKTPRLCT

SEQ ID NO: 87708 - protein, 9 aa, Dengue virus
KKSPRLCTK

SEQ ID NO: 87709 - protein, 9 aa, Dengue virus
KSPRLCTKE

SEQ ID NO: 87710 - protein, 9 aa, Dengue virus
SPRLCTKEE

SEQ ID NO: 87711 - protein, 9 aa, Dengue virus
RERVEKWLK

SEQ ID NO: 87712 - protein, 9 aa, Dengue virus
YMDYMPVMK

SEQ ID NO: 87713 - protein, 9 aa, Dengue virus
ADYMPVMKR

SEQ ID NO: 87714 - protein, 9 aa, Dengue virus
PVMKRYSAH

SEQ ID NO: 87715 - protein, 9 aa, Dengue virus
MKRYSAHFE

SEQ ID NO: 87716 - protein, 9 aa, Dengue virus
RYSAHFESE

SEQ ID NO: 87717 - protein, 9 aa, Dengue virus
YSAHFESEG

SEQ ID NO: 87718 - protein, 9 aa, Dengue virus
SAHFESEGV

SEQ ID NO: 87719 - protein, 9 aa, Dengue virus
AHFESEGVL

SEQ ID NO: 87720 - protein, 9 aa, Dengue virus
KTKAIKILT

SEQ ID NO: 87721 - protein, 9 aa, Dengue virus
TKAIKILTG

SEQ ID NO: 87722 - protein, 9 aa, Dengue virus
NILNGRRRS

SEQ ID NO: 87723 - protein, 9 aa, Dengue virus
ILNRRRRTA

SEQ ID NO: 87724 - protein, 9 aa, Dengue virus
RKRSTVTLL

SEQ ID NO: 87725 - protein, 9 aa, Dengue virus
RRTAGMIIM

SEQ ID NO: 87726 - protein, 9 aa, Dengue virus
PTVMAFHLT

SEQ ID NO: 87727 - protein, 9 aa, Dengue virus
TVMAFHLTT

SEQ ID NO: 87728 - protein, 9 aa, Dengue virus
VMAFHLTTR

SEQ ID NO: 87729 - protein, 9 aa, Dengue virus
GIQRAVFFV

SEQ ID NO: 87730 - protein, 9 aa, Dengue virus
TGKHGKEIK

SEQ ID NO: 87731 - protein, 9 aa, Dengue virus
GKHGKEIKI

SEQ ID NO: 87732 - protein, 9 aa, Dengue virus
KEIKITPQS

SEQ ID NO: 87733 - protein, 9 aa, Dengue virus
TATITPRTP

SEQ ID NO: 87734 - protein, 9 aa, Dengue virus
ATITPRTPS

SEQ ID NO: 87735 - protein, 9 aa, Dengue virus
PRSPSVEVQ

SEQ ID NO: 87736 - protein, 9 aa, Dengue virus
RSPSAEVKL

SEQ ID NO: 87737 - protein, 9 aa, Dengue virus
SPSAEVKLP

SEQ ID NO: 87738 - protein, 9 aa, Dengue virus
NEMILMKME

SEQ ID NO: 87739 - protein, 9 aa, Dengue virus
PWTAGADTL

SEQ ID NO: 87740 - protein, 9 aa, Dengue virus
WTAGADTLE

SEQ ID NO: 87741 - protein, 9 aa, Dengue virus
TAGADTLEV

SEQ ID NO: 87742 - protein, 9 aa, Dengue virus
RDVNKERVV

SEQ ID NO: 87743 - protein, 9 aa, Dengue virus
DMNKEKVVG

SEQ ID NO: 87744 - protein, 9 aa, Dengue virus
VNKERVVGR

SEQ ID NO: 87745 - protein, 9 aa, Dengue virus
AEYTNSVTN

SEQ ID NO: 87746 - protein, 9 aa, Dengue virus
EYTNSVTNI

SEQ ID NO: 87747 - protein, 9 aa, Dengue virus
YTNSVTNIE

SEQ ID NO: 87748 - protein, 9 aa, Dengue virus
SYIIIGVGD

SEQ ID NO: 87749 - protein, 9 aa, Dengue virus
YIIIGVGDS

SEQ ID NO: 87750 - protein, 9 aa, Dengue virus
IVIGAGDSA

SEQ ID NO: 87751 - protein, 9 aa, Dengue virus
IIGVGDSAL

SEQ ID NO: 87752 - protein, 9 aa, Dengue virus
MKILIGVII

SEQ ID NO: 87753 - protein, 9 aa, Dengue virus
LGFTVQADV

SEQ ID NO: 87754 - protein, 9 aa, Dengue virus
GFTVQADVG

SEQ ID NO: 87755 - protein, 9 aa, Dengue virus
FTVRADMGC

SEQ ID NO: 87756 - protein, 9 aa, Dengue virus
SWTGKELKC

SEQ ID NO: 87757 - protein, 9 aa, Dengue virus
WTGKELKCG

SEQ ID NO: 87758 - protein, 9 aa, Dengue virus
TGKELKCGS

SEQ ID NO: 87759 - protein, 9 aa, Dengue virus
TGDVKGVLT

SEQ ID NO: 87760 - protein, 9 aa, Dengue virus
LTKGKRTLT

SEQ ID NO: 87761 - protein, 9 aa, Dengue virus
TKGKRTLTP

SEQ ID NO: 87762 - protein, 9 aa, Dengue virus
GKRTLTPPV

SEQ ID NO: 87763 - protein, 9 aa, Dengue virus
LAPPASDLK

SEQ ID NO: 87764 - protein, 9 aa, Dengue virus
APPASDLKY

SEQ ID NO: 87765 - protein, 9 aa, Dengue virus
PEARNNTFL

SEQ ID NO: 87766 - protein, 9 aa, Dengue virus
KAYAGPISQ

SEQ ID NO: 87767 - protein, 9 aa, Dengue virus
GTTVTVRED

SEQ ID NO: 87768 - protein, 9 aa, Dengue virus
TTVTVQEDC

SEQ ID NO: 87769 - protein, 9 aa, Dengue virus
REDCDHRGP

SEQ ID NO: 87770 - protein, 9 aa, Dengue virus
ENMVRSQVT

SEQ ID NO: 87771 - protein, 9 aa, Dengue virus
NMVRSQVTA

SEQ ID NO: 87772 - protein, 9 aa, Dengue virus
MVRSQVTAG

SEQ ID NO: 87773 - protein, 9 aa, Dengue virus
AGQGTPETF

SEQ ID NO: 87774 - protein, 9 aa, Dengue virus
GTSETFFMG

SEQ ID NO: 87775 - protein, 9 aa, Dengue virus
KHMILVVVA

SEQ ID NO: 87776 - protein, 9 aa, Dengue virus
HMILVVVAT

SEQ ID NO: 87777 - protein, 9 aa, Dengue virus
ATLCAIILG

SEQ ID NO: 87778 - protein, 9 aa, Dengue virus
RVGGQTHLA

SEQ ID NO: 87779 - protein, 9 aa, Dengue virus
IGGQVHLAI

SEQ ID NO: 87780 - protein, 9 aa, Dengue virus
VVHFDNAQL

SEQ ID NO: 87781 - protein, 9 aa, Dengue virus
VHFDNAQLG

SEQ ID NO: 87782 - protein, 9 aa, Dengue virus
HFDNAQLGT

SEQ ID NO: 87783 - protein, 9 aa, Dengue virus
GFYQEKPET

SEQ ID NO: 87784 - protein, 9 aa, Dengue virus
FYQVKTEIT

SEQ ID NO: 87785 - protein, 9 aa, Dengue virus
YQEKPETTI

SEQ ID NO: 87786 - protein, 9 aa, Dengue virus
QVKAETTIL

SEQ ID NO: 87787 - protein, 9 aa, Dengue virus
EKPETTILD

SEQ ID NO: 87788 - protein, 9 aa, Dengue virus
LRDGSKTKH

SEQ ID NO: 87789 - protein, 9 aa, Dengue virus
RDGSKTKHA

SEQ ID NO: 87790 - protein, 9 aa, Dengue virus
QRKYGGNLI

SEQ ID NO: 87791 - protein, 9 aa, Dengue virus
RKYGGNLIR

SEQ ID NO: 87792 - protein, 9 aa, Dengue virus
KYGGNLIRC

SEQ ID NO: 87793 - protein, 9 aa, Dengue virus
QPKLGTRVV

SEQ ID NO: 87794 - protein, 9 aa, Dengue virus
PKPGTQMIM

SEQ ID NO: 87795 - protein, 9 aa, Dengue virus
KPGTQMIMT

SEQ ID NO: 87796 - protein, 9 aa, Dengue virus
LGTRVVMTT

SEQ ID NO: 87797 - protein, 9 aa, Dengue virus
KKKPRLCTR

SEQ ID NO: 87798 - protein, 9 aa, Dengue virus
KNPRLCTKE

SEQ ID NO: 87799 - protein, 9 aa, Dengue virus
KPRLCTREE

SEQ ID NO: 87800 - protein, 9 aa, Dengue virus
PVMKRYSAL

SEQ ID NO: 87801 - protein, 9 aa, Dengue virus
MKRYSALSE

SEQ ID NO: 87802 - protein, 9 aa, Dengue virus
RYSAPSENE

SEQ ID NO: 87803 - protein, 9 aa, Dengue virus
YSAPSENEG

SEQ ID NO: 87804 - protein, 9 aa, Dengue virus
SAPLESEGV

SEQ ID NO: 87805 - protein, 9 aa, Dengue virus
APLESEGVL

SEQ ID NO: 87806 - protein, 10 aa, Dengue virus
MNQRKKVVRP

SEQ ID NO: 87807 - protein, 10 aa, Dengue virus
NQRKKVVRPP

SEQ ID NO: 87808 - protein, 10 aa, Dengue virus
QRKKVVRPPF

SEQ ID NO: 87809 - protein, 10 aa, Dengue virus
RKKVVRPPFN

SEQ ID NO: 87810 - protein, 10 aa, Dengue virus
KKVVRPPFNM

SEQ ID NO: 87811 - protein, 10 aa, Dengue virus
KVVRPPFNML

SEQ ID NO: 87812 - protein, 10 aa, Dengue virus
VVRPPFNMLK

SEQ ID NO: 87813 - protein, 10 aa, Dengue virus
VRPPFNMLKR

SEQ ID NO: 87814 - protein, 10 aa, Dengue virus
RPPFNMLKRE

SEQ ID NO: 87815 - protein, 10 aa, Dengue virus
PPFNMLKRER

SEQ ID NO: 87816 - protein, 10 aa, Dengue virus
PFNMLKRERN

SEQ ID NO: 87817 - protein, 10 aa, Dengue virus
FNMLKRERNR

SEQ ID NO: 87818 - protein, 10 aa, Dengue virus
NMLKRERNRV

SEQ ID NO: 87819 - protein, 10 aa, Dengue virus
MLKRERNRVS

SEQ ID NO: 87820 - protein, 10 aa, Dengue virus
LKRERNRVST

SEQ ID NO: 87821 - protein, 10 aa, Dengue virus
KRERNRVSTP

SEQ ID NO: 87822 - protein, 10 aa, Dengue virus
RERNRVSTPQ

SEQ ID NO: 87823 - protein, 10 aa, Dengue virus
ERNRVSTPQG

SEQ ID NO: 87824 - protein, 10 aa, Dengue virus
RNRVSTPQGL

SEQ ID NO: 87825 - protein, 10 aa, Dengue virus
NRVSTPQGLV

SEQ ID NO: 87826 - protein, 10 aa, Dengue virus
RVSTPQGLVK

SEQ ID NO: 87827 - protein, 10 aa, Dengue virus
VSTPQGLVKR

SEQ ID NO: 87828 - protein, 10 aa, Dengue virus
STPQGLVKRF

SEQ ID NO: 87829 - protein, 10 aa, Dengue virus
TPQGLVKRFS

SEQ ID NO: 87830 - protein, 10 aa, Dengue virus
PQGLVKRFST

SEQ ID NO: 87831 - protein, 10 aa, Dengue virus
QGLVKRFSTG

SEQ ID NO: 87832 - protein, 10 aa, Dengue virus
GLVKRFSTGL

SEQ ID NO: 87833 - protein, 10 aa, Dengue virus
LVKRFSTGLF

SEQ ID NO: 87834 - protein, 10 aa, Dengue virus
VKRFSTGLFS

SEQ ID NO: 87835 - protein, 10 aa, Dengue virus
KRFSTGLFSG

SEQ ID NO: 87836 - protein, 10 aa, Dengue virus
RFSTGLFSGK

SEQ ID NO: 87837 - protein, 10 aa, Dengue virus
FSTGLFSGKG

SEQ ID NO: 87838 - protein, 10 aa, Dengue virus
STGLFSGKGP

SEQ ID NO: 87839 - protein, 10 aa, Dengue virus
TGLFSGKGPL

SEQ ID NO: 87840 - protein, 10 aa, Dengue virus
GLFSGKGPLR

SEQ ID NO: 87841 - protein, 10 aa, Dengue virus
LFSGKGPLRM

SEQ ID NO: 87842 - protein, 10 aa, Dengue virus
FSGKGPLRMV

SEQ ID NO: 87843 - protein, 10 aa, Dengue virus
SGKGPLRMVL

SEQ ID NO: 87844 - protein, 10 aa, Dengue virus
GKGPLRMVLA

SEQ ID NO: 87845 - protein, 10 aa, Dengue virus
KGPLRMVLAF

SEQ ID NO: 87846 - protein, 10 aa, Dengue virus
GPLRMVLAFI

SEQ ID NO: 87847 - protein, 10 aa, Dengue virus
PLRMVLAFIT

SEQ ID NO: 87848 - protein, 10 aa, Dengue virus
LRMVLAFITF

SEQ ID NO: 87849 - protein, 10 aa, Dengue virus
RMVLAFITFL

SEQ ID NO: 87850 - protein, 10 aa, Dengue virus
MVLAFITFLR

SEQ ID NO: 87851 - protein, 10 aa, Dengue virus
VLAFITFLRV

SEQ ID NO: 87852 - protein, 10 aa, Dengue virus
LAFITFLRVL

SEQ ID NO: 87853 - protein, 10 aa, Dengue virus
AFITFLRVLS

SEQ ID NO: 87854 - protein, 10 aa, Dengue virus
FITFLRVLSI

SEQ ID NO: 87855 - protein, 10 aa, Dengue virus
ITFLRVLSIP

SEQ ID NO: 87856 - protein, 10 aa, Dengue virus
TFLRVLSIPP

SEQ ID NO: 87857 - protein, 10 aa, Dengue virus
FLRVLSIPPT

SEQ ID NO: 87858 - protein, 10 aa, Dengue virus
LRVLSIPPTA

SEQ ID NO: 87859 - protein, 10 aa, Dengue virus
RVLSIPPTAG

SEQ ID NO: 87860 - protein, 10 aa, Dengue virus
VLSIPPTAGI

SEQ ID NO: 87861 - protein, 10 aa, Dengue virus
LSIPPTAGIL

SEQ ID NO: 87862 - protein, 10 aa, Dengue virus
SIPPTAGILK

SEQ ID NO: 87863 - protein, 10 aa, Dengue virus
IPPTAGILKR

SEQ ID NO: 87864 - protein, 10 aa, Dengue virus
PPTAGILKRW

SEQ ID NO: 87865 - protein, 10 aa, Dengue virus
PTAGILKRWG

SEQ ID NO: 87866 - protein, 10 aa, Dengue virus
TAGILKRWGQ

SEQ ID NO: 87867 - protein, 10 aa, Dengue virus
AGILKRWGQL

SEQ ID NO: 87868 - protein, 10 aa, Dengue virus
GILKRWGQLK

SEQ ID NO: 87869 - protein, 10 aa, Dengue virus
ILKRWGQLKK

SEQ ID NO: 87870 - protein, 10 aa, Dengue virus
LKRWGQLKKN

SEQ ID NO: 87871 - protein, 10 aa, Dengue virus
KRWGQLKKNK

SEQ ID NO: 87872 - protein, 10 aa, Dengue virus
RWGQLKKNKA

SEQ ID NO: 87873 - protein, 10 aa, Dengue virus
WGQLKKNKAI

SEQ ID NO: 87874 - protein, 10 aa, Dengue virus
GQLKKNKAIK

SEQ ID NO: 87875 - protein, 10 aa, Dengue virus
QLKKNKAIKI

SEQ ID NO: 87876 - protein, 10 aa, Dengue virus
LKKNKAIKIL

SEQ ID NO: 87877 - protein, 10 aa, Dengue virus
KKNKAIKILI

SEQ ID NO: 87878 - protein, 10 aa, Dengue virus
KNKAIKILIG

SEQ ID NO: 87879 - protein, 10 aa, Dengue virus
NKAIKILIGF

SEQ ID NO: 87880 - protein, 10 aa, Dengue virus
KAIKILIGFR

SEQ ID NO: 87881 - protein, 10 aa, Dengue virus
AIKILIGFRK

SEQ ID NO: 87882 - protein, 10 aa, Dengue virus
IKILIGFRKE

SEQ ID NO: 87883 - protein, 10 aa, Dengue virus
KILIGFRKEI

SEQ ID NO: 87884 - protein, 10 aa, Dengue virus
ILIGFRKEIG

SEQ ID NO: 87885 - protein, 10 aa, Dengue virus
LIGFRKEIGR

SEQ ID NO: 87886 - protein, 10 aa, Dengue virus
IGFRKEIGRM

SEQ ID NO: 87887 - protein, 10 aa, Dengue virus
GFRKEIGRML

SEQ ID NO: 87888 - protein, 10 aa, Dengue virus
FRKEIGRMLN

SEQ ID NO: 87889 - protein, 10 aa, Dengue virus
RKEIGRMLNI

SEQ ID NO: 87890 - protein, 10 aa, Dengue virus
KEIGRMLNIL

SEQ ID NO: 87891 - protein, 10 aa, Dengue virus
EIGRMLNILN

SEQ ID NO: 87892 - protein, 10 aa, Dengue virus
IGRMLNILNG

SEQ ID NO: 87893 - protein, 10 aa, Dengue virus
GRMLNILNGR

SEQ ID NO: 87894 - protein, 10 aa, Dengue virus
RMLNILNGRK

SEQ ID NO: 87895 - protein, 10 aa, Dengue virus
MLNILNGRKR

SEQ ID NO: 87896 - protein, 10 aa, Dengue virus
LNILNGRKRS

SEQ ID NO: 87897 - protein, 10 aa, Dengue virus
NILNGRKRST

SEQ ID NO: 87898 - protein, 10 aa, Dengue virus
RKRSTITLLC

SEQ ID NO: 87899 - protein, 10 aa, Dengue virus
KRSTITLLCL

SEQ ID NO: 87900 - protein, 10 aa, Dengue virus
RSTITLLCLI

SEQ ID NO: 87901 - protein, 10 aa, Dengue virus
STITLLCLIP

SEQ ID NO: 87902 - protein, 10 aa, Dengue virus
TITLLCLIPT

SEQ ID NO: 87903 - protein, 10 aa, Dengue virus
TLLCLIPTVM

SEQ ID NO: 87904 - protein, 10 aa, Dengue virus
LLCLIPTVMA

SEQ ID NO: 87905 - protein, 10 aa, Dengue virus
LCLIPTVMAF

SEQ ID NO: 87906 - protein, 10 aa, Dengue virus
CLIPTVMAFH

SEQ ID NO: 87907 - protein, 10 aa, Dengue virus
LIPTVMAFHL

SEQ ID NO: 87908 - protein, 10 aa, Dengue virus
IPTVMAFHLS

SEQ ID NO: 87909 - protein, 10 aa, Dengue virus
PTVMAFHLST

SEQ ID NO: 87910 - protein, 10 aa, Dengue virus
TVMAFHLSTR

SEQ ID NO: 87911 - protein, 10 aa, Dengue virus
VMAFHLSTRD

SEQ ID NO: 87912 - protein, 10 aa, Dengue virus
MAFHLSTRDG

SEQ ID NO: 87913 - protein, 10 aa, Dengue virus
AFHLSTRDGE

SEQ ID NO: 87914 - protein, 10 aa, Dengue virus
FHLSTRDGEP

SEQ ID NO: 87915 - protein, 10 aa, Dengue virus
HLSTRDGEPL

SEQ ID NO: 87916 - protein, 10 aa, Dengue virus
LSTRDGEPLM

SEQ ID NO: 87917 - protein, 10 aa, Dengue virus
STRDGEPLMI

SEQ ID NO: 87918 - protein, 10 aa, Dengue virus
TRDGEPLMIV

SEQ ID NO: 87919 - protein, 10 aa, Dengue virus
RDGEPLMIVA

SEQ ID NO: 87920 - protein, 10 aa, Dengue virus
DGEPLMIVAK

SEQ ID NO: 87921 - protein, 10 aa, Dengue virus
GEPLMIVAKH

SEQ ID NO: 87922 - protein, 10 aa, Dengue virus
EPLMIVAKHE

SEQ ID NO: 87923 - protein, 10 aa, Dengue virus
PLMIVAKHER

SEQ ID NO: 87924 - protein, 10 aa, Dengue virus
LMIVAKHERG

SEQ ID NO: 87925 - protein, 10 aa, Dengue virus
MIVAKHERGR

SEQ ID NO: 87926 - protein, 10 aa, Dengue virus
IVAKHERGRP

SEQ ID NO: 87927 - protein, 10 aa, Dengue virus
VAKHERGRPL

SEQ ID NO: 87928 - protein, 10 aa, Dengue virus
AKHERGRPLL

SEQ ID NO: 87929 - protein, 10 aa, Dengue virus
KHERGRPLLF

SEQ ID NO: 87930 - protein, 10 aa, Dengue virus
HERGRPLLFK

SEQ ID NO: 87931 - protein, 10 aa, Dengue virus
ERGRPLLFKT

SEQ ID NO: 87932 - protein, 10 aa, Dengue virus
RGRPLLFKTT

SEQ ID NO: 87933 - protein, 10 aa, Dengue virus
GRPLLFKTTE

SEQ ID NO: 87934 - protein, 10 aa, Dengue virus
RPLLFKTTEG

SEQ ID NO: 87935 - protein, 10 aa, Dengue virus
PLLFKTTEGI

SEQ ID NO: 87936 - protein, 10 aa, Dengue virus
LLFKTTEGIN

SEQ ID NO: 87937 - protein, 10 aa, Dengue virus
LFKTTEGINK

SEQ ID NO: 87938 - protein, 10 aa, Dengue virus
FKTTEGINKC

SEQ ID NO: 87939 - protein, 10 aa, Dengue virus
KTTEGINKCT

SEQ ID NO: 87940 - protein, 10 aa, Dengue virus
TTEGINKCTL

SEQ ID NO: 87941 - protein, 10 aa, Dengue virus
TEGINKCTLI

SEQ ID NO: 87942 - protein, 10 aa, Dengue virus
EGINKCTLIA

SEQ ID NO: 87943 - protein, 10 aa, Dengue virus
GINKCTLIAM

SEQ ID NO: 87944 - protein, 10 aa, Dengue virus
INKCTLIAMD

SEQ ID NO: 87945 - protein, 10 aa, Dengue virus
NKCTLIAMDL

SEQ ID NO: 87946 - protein, 10 aa, Dengue virus
KCTLIAMDLG

SEQ ID NO: 87947 - protein, 10 aa, Dengue virus
CTLIAMDLGE

SEQ ID NO: 87948 - protein, 10 aa, Dengue virus
TLIAMDLGEM

SEQ ID NO: 87949 - protein, 10 aa, Dengue virus
LIAMDLGEMC

SEQ ID NO: 87950 - protein, 10 aa, Dengue virus
IAMDLGEMCE

SEQ ID NO: 87951 - protein, 10 aa, Dengue virus
AMDLGEMCED

SEQ ID NO: 87952 - protein, 10 aa, Dengue virus
MDLGEMCEDT

SEQ ID NO: 87953 - protein, 10 aa, Dengue virus
DLGEMCEDTV

SEQ ID NO: 87954 - protein, 10 aa, Dengue virus
LGEMCEDTVT

SEQ ID NO: 87955 - protein, 10 aa, Dengue virus
GEMCEDTVTY

SEQ ID NO: 87956 - protein, 10 aa, Dengue virus
EMCEDTVTYK

SEQ ID NO: 87957 - protein, 10 aa, Dengue virus
MCEDTVTYKC

SEQ ID NO: 87958 - protein, 10 aa, Dengue virus
CEDTVTYKCP

SEQ ID NO: 87959 - protein, 10 aa, Dengue virus
EDTVTYKCPL

SEQ ID NO: 87960 - protein, 10 aa, Dengue virus
DTVTYKCPLL

SEQ ID NO: 87961 - protein, 10 aa, Dengue virus
TVTYKCPLLV

SEQ ID NO: 87962 - protein, 10 aa, Dengue virus
VTYKCPLLVN

SEQ ID NO: 87963 - protein, 10 aa, Dengue virus
TYKCPLLVNT

SEQ ID NO: 87964 - protein, 10 aa, Dengue virus
YKCPLLVNTE

SEQ ID NO: 87965 - protein, 10 aa, Dengue virus
KCPLLVNTEP

SEQ ID NO: 87966 - protein, 10 aa, Dengue virus
CPLLVNTEPE

SEQ ID NO: 87967 - protein, 10 aa, Dengue virus
PLLVNTEPED

SEQ ID NO: 87968 - protein, 10 aa, Dengue virus
LLVNTEPEDI

SEQ ID NO: 87969 - protein, 10 aa, Dengue virus
LVNTEPEDID

SEQ ID NO: 87970 - protein, 10 aa, Dengue virus
VNTEPEDIDC

SEQ ID NO: 87971 - protein, 10 aa, Dengue virus
NTEPEDIDCW

SEQ ID NO: 87972 - protein, 10 aa, Dengue virus
TEPEDIDCWC

SEQ ID NO: 87973 - protein, 10 aa, Dengue virus
EPEDIDCWCN

SEQ ID NO: 87974 - protein, 10 aa, Dengue virus
PEDIDCWCNL

SEQ ID NO: 87975 - protein, 10 aa, Dengue virus
EDIDCWCNLT

SEQ ID NO: 87976 - protein, 10 aa, Dengue virus
DIDCWCNLTS

SEQ ID NO: 87977 - protein, 10 aa, Dengue virus
IDCWCNLTST

SEQ ID NO: 87978 - protein, 10 aa, Dengue virus
DCWCNLTSTW

SEQ ID NO: 87979 - protein, 10 aa, Dengue virus
CWCNLTSTWV

SEQ ID NO: 87980 - protein, 10 aa, Dengue virus
WCNLTSTWVM

SEQ ID NO: 87981 - protein, 10 aa, Dengue virus
CNLTSTWVMY

SEQ ID NO: 87982 - protein, 10 aa, Dengue virus
NLTSTWVMYG

SEQ ID NO: 87983 - protein, 10 aa, Dengue virus
LTSTWVMYGT

SEQ ID NO: 87984 - protein, 10 aa, Dengue virus
TSTWVMYGTC

SEQ ID NO: 87985 - protein, 10 aa, Dengue virus
STWVMYGTCT

SEQ ID NO: 87986 - protein, 10 aa, Dengue virus
TWVMYGTCTQ

SEQ ID NO: 87987 - protein, 10 aa, Dengue virus
WVMYGTCTQS

SEQ ID NO: 87988 - protein, 10 aa, Dengue virus
VMYGTCTQSG

SEQ ID NO: 87989 - protein, 10 aa, Dengue virus
MYGTCTQSGE

SEQ ID NO: 87990 - protein, 10 aa, Dengue virus
YGTCTQSGER

SEQ ID NO: 87991 - protein, 10 aa, Dengue virus
GTCTQSGERR

SEQ ID NO: 87992 - protein, 10 aa, Dengue virus
TCTQSGERRR

SEQ ID NO: 87993 - protein, 10 aa, Dengue virus
CTQSGERRRE

SEQ ID NO: 87994 - protein, 10 aa, Dengue virus
TQSGERRREK

SEQ ID NO: 87995 - protein, 10 aa, Dengue virus
QSGERRREKR

SEQ ID NO: 87996 - protein, 10 aa, Dengue virus
SGERRREKRS

SEQ ID NO: 87997 - protein, 10 aa, Dengue virus
GERRREKRSV

SEQ ID NO: 87998 - protein, 10 aa, Dengue virus
ERRREKRSVA

SEQ ID NO: 87999 - protein, 10 aa, Dengue virus
RRREKRSVAL

SEQ ID NO: 88000 - protein, 10 aa, Dengue virus
RREKRSVALT

SEQ ID NO: 88001 - protein, 10 aa, Dengue virus
REKRSVALTP

SEQ ID NO: 88002 - protein, 10 aa, Dengue virus
EKRSVALTPH

SEQ ID NO: 88003 - protein, 10 aa, Dengue virus
KRSVALTPHS

SEQ ID NO: 88004 - protein, 10 aa, Dengue virus
RSVALTPHSG

SEQ ID NO: 88005 - protein, 10 aa, Dengue virus
SVALTPHSGM

SEQ ID NO: 88006 - protein, 10 aa, Dengue virus
VALTPHSGMG

SEQ ID NO: 88007 - protein, 10 aa, Dengue virus
ALTPHSGMGL

SEQ ID NO: 88008 - protein, 10 aa, Dengue virus
LTPHSGMGLE

SEQ ID NO: 88009 - protein, 10 aa, Dengue virus
TPHSGMGLET

SEQ ID NO: 88010 - protein, 10 aa, Dengue virus
PHSGMGLETR

SEQ ID NO: 88011 - protein, 10 aa, Dengue virus
HSGMGLETRA

SEQ ID NO: 88012 - protein, 10 aa, Dengue virus
SGMGLETRAE

SEQ ID NO: 88013 - protein, 10 aa, Dengue virus
GMGLETRAET

SEQ ID NO: 88014 - protein, 10 aa, Dengue virus
MGLETRAETW

SEQ ID NO: 88015 - protein, 10 aa, Dengue virus
GLETRAETWM

SEQ ID NO: 88016 - protein, 10 aa, Dengue virus
LETRAETWMS

SEQ ID NO: 88017 - protein, 10 aa, Dengue virus
ETRAETWMSS

SEQ ID NO: 88018 - protein, 10 aa, Dengue virus
TRAETWMSSE

SEQ ID NO: 88019 - protein, 10 aa, Dengue virus
RAETWMSSEG

SEQ ID NO: 88020 - protein, 10 aa, Dengue virus
AETWMSSEGA

SEQ ID NO: 88021 - protein, 10 aa, Dengue virus
ETWMSSEGAW

SEQ ID NO: 88022 - protein, 10 aa, Dengue virus
TWMSSEGAWK

SEQ ID NO: 88023 - protein, 10 aa, Dengue virus
WMSSEGAWKH

SEQ ID NO: 88024 - protein, 10 aa, Dengue virus
MSSEGAWKHA

SEQ ID NO: 88025 - protein, 10 aa, Dengue virus
SSEGAWKHAQ

SEQ ID NO: 88026 - protein, 10 aa, Dengue virus
SEGAWKHAQR

SEQ ID NO: 88027 - protein, 10 aa, Dengue virus
EGAWKHAQRV

SEQ ID NO: 88028 - protein, 10 aa, Dengue virus
GAWKHAQRVE

SEQ ID NO: 88029 - protein, 10 aa, Dengue virus
AWKHAQRVES

SEQ ID NO: 88030 - protein, 10 aa, Dengue virus
WKHAQRVESW

SEQ ID NO: 88031 - protein, 10 aa, Dengue virus
KHAQRVESWI

SEQ ID NO: 88032 - protein, 10 aa, Dengue virus
HAQRVESWIL

SEQ ID NO: 88033 - protein, 10 aa, Dengue virus
AQRVESWILR

SEQ ID NO: 88034 - protein, 10 aa, Dengue virus
QRVESWILRN

SEQ ID NO: 88035 - protein, 10 aa, Dengue virus
RVESWILRNP

SEQ ID NO: 88036 - protein, 10 aa, Dengue virus
VESWILRNPG

SEQ ID NO: 88037 - protein, 10 aa, Dengue virus
ESWILRNPGF

SEQ ID NO: 88038 - protein, 10 aa, Dengue virus
SWILRNPGFA

SEQ ID NO: 88039 - protein, 10 aa, Dengue virus
WILRNPGFAL

SEQ ID NO: 88040 - protein, 10 aa, Dengue virus
ILRNPGFALL

SEQ ID NO: 88041 - protein, 10 aa, Dengue virus
LRNPGFALLA

SEQ ID NO: 88042 - protein, 10 aa, Dengue virus
RNPGFALLAG

SEQ ID NO: 88043 - protein, 10 aa, Dengue virus
NPGFALLAGF

SEQ ID NO: 88044 - protein, 10 aa, Dengue virus
PGFALLAGFM

SEQ ID NO: 88045 - protein, 10 aa, Dengue virus
GFALLAGFMA

SEQ ID NO: 88046 - protein, 10 aa, Dengue virus
FALLAGFMAY

SEQ ID NO: 88047 - protein, 10 aa, Dengue virus
ALLAGFMAYM

SEQ ID NO: 88048 - protein, 10 aa, Dengue virus
LLAGFMAYMI

SEQ ID NO: 88049 - protein, 10 aa, Dengue virus
LAGFMAYMIG

SEQ ID NO: 88050 - protein, 10 aa, Dengue virus
AGFMAYMIGQ

SEQ ID NO: 88051 - protein, 10 aa, Dengue virus
GFMAYMIGQT

SEQ ID NO: 88052 - protein, 10 aa, Dengue virus
FMAYMIGQTG

SEQ ID NO: 88053 - protein, 10 aa, Dengue virus
MAYMIGQTGI

SEQ ID NO: 88054 - protein, 10 aa, Dengue virus
AYMIGQTGIQ

SEQ ID NO: 88055 - protein, 10 aa, Dengue virus
YMIGQTGIQR

SEQ ID NO: 88056 - protein, 10 aa, Dengue virus
MIGQTGIQRT

SEQ ID NO: 88057 - protein, 10 aa, Dengue virus
IGQTGIQRTV

SEQ ID NO: 88058 - protein, 10 aa, Dengue virus
GQTGIQRTVF

SEQ ID NO: 88059 - protein, 10 aa, Dengue virus
QTGIQRTVFF

SEQ ID NO: 88060 - protein, 10 aa, Dengue virus
TGIQRTVFFV

SEQ ID NO: 88061 - protein, 10 aa, Dengue virus
GIQRTVFFVL

SEQ ID NO: 88062 - protein, 10 aa, Dengue virus
IQRTVFFVLM

SEQ ID NO: 88063 - protein, 10 aa, Dengue virus
QRTVFFVLMM

SEQ ID NO: 88064 - protein, 10 aa, Dengue virus
RTVFFVLMML

SEQ ID NO: 88065 - protein, 10 aa, Dengue virus
TVFFVLMMLV

SEQ ID NO: 88066 - protein, 10 aa, Dengue virus
VFFVLMMLVA

SEQ ID NO: 88067 - protein, 10 aa, Dengue virus
FFVLMMLVAP

SEQ ID NO: 88068 - protein, 10 aa, Dengue virus
FVLMMLVAPS

SEQ ID NO: 88069 - protein, 10 aa, Dengue virus
VLMMLVAPSY

SEQ ID NO: 88070 - protein, 10 aa, Dengue virus
LMMLVAPSYG

SEQ ID NO: 88071 - protein, 10 aa, Dengue virus
MMLVAPSYGM

SEQ ID NO: 88072 - protein, 10 aa, Dengue virus
MLVAPSYGMR

SEQ ID NO: 88073 - protein, 10 aa, Dengue virus
LVAPSYGMRC

SEQ ID NO: 88074 - protein, 10 aa, Dengue virus
VAPSYGMRCV

SEQ ID NO: 88075 - protein, 10 aa, Dengue virus
APSYGMRCVG

SEQ ID NO: 88076 - protein, 10 aa, Dengue virus
PSYGMRCVGV

SEQ ID NO: 88077 - protein, 10 aa, Dengue virus
SYGMRCVGVG

SEQ ID NO: 88078 - protein, 10 aa, Dengue virus
YGMRCVGVGN

SEQ ID NO: 88079 - protein, 10 aa, Dengue virus
GMRCVGVGNR

SEQ ID NO: 88080 - protein, 10 aa, Dengue virus
MRCVGVGNRD

SEQ ID NO: 88081 - protein, 10 aa, Dengue virus
RCVGVGNRDF

SEQ ID NO: 88082 - protein, 10 aa, Dengue virus
CVGVGNRDFV

SEQ ID NO: 88083 - protein, 10 aa, Dengue virus
VGVGNRDFVE

SEQ ID NO: 88084 - protein, 10 aa, Dengue virus
GVGNRDFVEG

SEQ ID NO: 88085 - protein, 10 aa, Dengue virus
VGNRDFVEGV

SEQ ID NO: 88086 - protein, 10 aa, Dengue virus
GNRDFVEGVS

SEQ ID NO: 88087 - protein, 10 aa, Dengue virus
NRDFVEGVSG

SEQ ID NO: 88088 - protein, 10 aa, Dengue virus
RDFVEGVSGG

SEQ ID NO: 88089 - protein, 10 aa, Dengue virus
DFVEGVSGGA

SEQ ID NO: 88090 - protein, 10 aa, Dengue virus
FVEGVSGGAW

SEQ ID NO: 88091 - protein, 10 aa, Dengue virus
VEGVSGGAWV

SEQ ID NO: 88092 - protein, 10 aa, Dengue virus
EGVSGGAWVD

SEQ ID NO: 88093 - protein, 10 aa, Dengue virus
GVSGGAWVDL

SEQ ID NO: 88094 - protein, 10 aa, Dengue virus
VSGGAWVDLV

SEQ ID NO: 88095 - protein, 10 aa, Dengue virus
SGGAWVDLVL

SEQ ID NO: 88096 - protein, 10 aa, Dengue virus
GGAWVDLVLE

SEQ ID NO: 88097 - protein, 10 aa, Dengue virus
GAWVDLVLEH

SEQ ID NO: 88098 - protein, 10 aa, Dengue virus
AWVDLVLEHG

SEQ ID NO: 88099 - protein, 10 aa, Dengue virus
WVDLVLEHGG

SEQ ID NO: 88100 - protein, 10 aa, Dengue virus
VDLVLEHGGC

SEQ ID NO: 88101 - protein, 10 aa, Dengue virus
DLVLEHGGCV

SEQ ID NO: 88102 - protein, 10 aa, Dengue virus
LVLEHGGCVT

SEQ ID NO: 88103 - protein, 10 aa, Dengue virus
VLEHGGCVTT

SEQ ID NO: 88104 - protein, 10 aa, Dengue virus
LEHGGCVTTM

SEQ ID NO: 88105 - protein, 10 aa, Dengue virus
EHGGCVTTMA

SEQ ID NO: 88106 - protein, 10 aa, Dengue virus
HGGCVTTMAQ

SEQ ID NO: 88107 - protein, 10 aa, Dengue virus
GGCVTTMAQG

SEQ ID NO: 88108 - protein, 10 aa, Dengue virus
GCVTTMAQGK

SEQ ID NO: 88109 - protein, 10 aa, Dengue virus
CVTTMAQGKP

SEQ ID NO: 88110 - protein, 10 aa, Dengue virus
VTTMAQGKPT

SEQ ID NO: 88111 - protein, 10 aa, Dengue virus
TTMAQGKPTL

SEQ ID NO: 88112 - protein, 10 aa, Dengue virus
TMAQGKPTLD

SEQ ID NO: 88113 - protein, 10 aa, Dengue virus
MAQGKPTLDF

SEQ ID NO: 88114 - protein, 10 aa, Dengue virus
AQGKPTLDFE

SEQ ID NO: 88115 - protein, 10 aa, Dengue virus
QGKPTLDFEL

SEQ ID NO: 88116 - protein, 10 aa, Dengue virus
GKPTLDFELT

SEQ ID NO: 88117 - protein, 10 aa, Dengue virus
KPTLDFELTK

SEQ ID NO: 88118 - protein, 10 aa, Dengue virus
PTLDFELTKT

SEQ ID NO: 88119 - protein, 10 aa, Dengue virus
TLDFELTKTT

SEQ ID NO: 88120 - protein, 10 aa, Dengue virus
LDFELTKTTA

SEQ ID NO: 88121 - protein, 10 aa, Dengue virus
DFELTKTTAK

SEQ ID NO: 88122 - protein, 10 aa, Dengue virus
FELTKTTAKE

SEQ ID NO: 88123 - protein, 10 aa, Dengue virus
ELTKTTAKEV

SEQ ID NO: 88124 - protein, 10 aa, Dengue virus
LTKTTAKEVA

SEQ ID NO: 88125 - protein, 10 aa, Dengue virus
TKTTAKEVAL

SEQ ID NO: 88126 - protein, 10 aa, Dengue virus
KTTAKEVALL

SEQ ID NO: 88127 - protein, 10 aa, Dengue virus
TTAKEVALLR

SEQ ID NO: 88128 - protein, 10 aa, Dengue virus
TAKEVALLRT

SEQ ID NO: 88129 - protein, 10 aa, Dengue virus
AKEVALLRTY

SEQ ID NO: 88130 - protein, 10 aa, Dengue virus
KEVALLRTYC

SEQ ID NO: 88131 - protein, 10 aa, Dengue virus
EVALLRTYCI

SEQ ID NO: 88132 - protein, 10 aa, Dengue virus
VALLRTYCIE

SEQ ID NO: 88133 - protein, 10 aa, Dengue virus
ALLRTYCIEA

SEQ ID NO: 88134 - protein, 10 aa, Dengue virus
LLRTYCIEAS

SEQ ID NO: 88135 - protein, 10 aa, Dengue virus
LRTYCIEASI

SEQ ID NO: 88136 - protein, 10 aa, Dengue virus
RTYCIEASIS

SEQ ID NO: 88137 - protein, 10 aa, Dengue virus
TYCIEASISN

SEQ ID NO: 88138 - protein, 10 aa, Dengue virus
YCIEASISNI

SEQ ID NO: 88139 - protein, 10 aa, Dengue virus
CIEASISNIT

SEQ ID NO: 88140 - protein, 10 aa, Dengue virus
IEASISNITT

SEQ ID NO: 88141 - protein, 10 aa, Dengue virus
EASISNITTA

SEQ ID NO: 88142 - protein, 10 aa, Dengue virus
ASISNITTAT

SEQ ID NO: 88143 - protein, 10 aa, Dengue virus
SISNITTATR

SEQ ID NO: 88144 - protein, 10 aa, Dengue virus
ISNITTATRC

SEQ ID NO: 88145 - protein, 10 aa, Dengue virus
SNITTATRCP

SEQ ID NO: 88146 - protein, 10 aa, Dengue virus
NITTATRCPT

SEQ ID NO: 88147 - protein, 10 aa, Dengue virus
ITTATRCPTQ

SEQ ID NO: 88148 - protein, 10 aa, Dengue virus
TTATRCPTQG

SEQ ID NO: 88149 - protein, 10 aa, Dengue virus
TATRCPTQGE

SEQ ID NO: 88150 - protein, 10 aa, Dengue virus
ATRCPTQGEP

SEQ ID NO: 88151 - protein, 10 aa, Dengue virus
TRCPTQGEPY

SEQ ID NO: 88152 - protein, 10 aa, Dengue virus
RCPTQGEPYL

SEQ ID NO: 88153 - protein, 10 aa, Dengue virus
CPTQGEPYLK

SEQ ID NO: 88154 - protein, 10 aa, Dengue virus
PTQGEPYLKE

SEQ ID NO: 88155 - protein, 10 aa, Dengue virus
TQGEPYLKEE

SEQ ID NO: 88156 - protein, 10 aa, Dengue virus
QGEPYLKEEQ

SEQ ID NO: 88157 - protein, 10 aa, Dengue virus
GEPYLKEEQD

SEQ ID NO: 88158 - protein, 10 aa, Dengue virus
EPYLKEEQDQ

SEQ ID NO: 88159 - protein, 10 aa, Dengue virus
PYLKEEQDQQ

SEQ ID NO: 88160 - protein, 10 aa, Dengue virus
YLKEEQDQQY

SEQ ID NO: 88161 - protein, 10 aa, Dengue virus
LKEEQDQQYI

SEQ ID NO: 88162 - protein, 10 aa, Dengue virus
KEEQDQQYIC

SEQ ID NO: 88163 - protein, 10 aa, Dengue virus
EEQDQQYICR

SEQ ID NO: 88164 - protein, 10 aa, Dengue virus
EQDQQYICRR

SEQ ID NO: 88165 - protein, 10 aa, Dengue virus
QDQQYICRRD

SEQ ID NO: 88166 - protein, 10 aa, Dengue virus
DQQYICRRDV

SEQ ID NO: 88167 - protein, 10 aa, Dengue virus
QQYICRRDVV

SEQ ID NO: 88168 - protein, 10 aa, Dengue virus
QYICRRDVVD

SEQ ID NO: 88169 - protein, 10 aa, Dengue virus
YICRRDVVDR

SEQ ID NO: 88170 - protein, 10 aa, Dengue virus
ICRRDVVDRG

SEQ ID NO: 88171 - protein, 10 aa, Dengue virus
CRRDVVDRGW

SEQ ID NO: 88172 - protein, 10 aa, Dengue virus
RRDVVDRGWG

SEQ ID NO: 88173 - protein, 10 aa, Dengue virus
RDVVDRGWGN

SEQ ID NO: 88174 - protein, 10 aa, Dengue virus
DVVDRGWGNG

SEQ ID NO: 88175 - protein, 10 aa, Dengue virus
VVDRGWGNGC

SEQ ID NO: 88176 - protein, 10 aa, Dengue virus
VDRGWGNGCG

SEQ ID NO: 88177 - protein, 10 aa, Dengue virus
DRGWGNGCGL

SEQ ID NO: 88178 - protein, 10 aa, Dengue virus
RGWGNGCGLF

SEQ ID NO: 88179 - protein, 10 aa, Dengue virus
GWGNGCGLFG

SEQ ID NO: 88180 - protein, 10 aa, Dengue virus
WGNGCGLFGK

SEQ ID NO: 88181 - protein, 10 aa, Dengue virus
GNGCGLFGKG

SEQ ID NO: 88182 - protein, 10 aa, Dengue virus
NGCGLFGKGG

SEQ ID NO: 88183 - protein, 10 aa, Dengue virus
GCGLFGKGGV

SEQ ID NO: 88184 - protein, 10 aa, Dengue virus
CGLFGKGGVV

SEQ ID NO: 88185 - protein, 10 aa, Dengue virus
GLFGKGGVVT

SEQ ID NO: 88186 - protein, 10 aa, Dengue virus
LFGKGGVVTC

SEQ ID NO: 88187 - protein, 10 aa, Dengue virus
FGKGGVVTCA

SEQ ID NO: 88188 - protein, 10 aa, Dengue virus
GKGGVVTCAK

SEQ ID NO: 88189 - protein, 10 aa, Dengue virus
KGGVVTCAKF

SEQ ID NO: 88190 - protein, 10 aa, Dengue virus
GGVVTCAKFS

SEQ ID NO: 88191 - protein, 10 aa, Dengue virus
GVVTCAKFSC

SEQ ID NO: 88192 - protein, 10 aa, Dengue virus
VVTCAKFSCS

SEQ ID NO: 88193 - protein, 10 aa, Dengue virus
VTCAKFSCSG

SEQ ID NO: 88194 - protein, 10 aa, Dengue virus
TCAKFSCSGK

SEQ ID NO: 88195 - protein, 10 aa, Dengue virus
CAKFSCSGKI

SEQ ID NO: 88196 - protein, 10 aa, Dengue virus
AKFSCSGKIT

SEQ ID NO: 88197 - protein, 10 aa, Dengue virus
KFSCSGKITG

SEQ ID NO: 88198 - protein, 10 aa, Dengue virus
FSCSGKITGN

SEQ ID NO: 88199 - protein, 10 aa, Dengue virus
SCSGKITGNL

SEQ ID NO: 88200 - protein, 10 aa, Dengue virus
CSGKITGNLV

SEQ ID NO: 88201 - protein, 10 aa, Dengue virus
SGKITGNLVQ

SEQ ID NO: 88202 - protein, 10 aa, Dengue virus
GKITGNLVQI

SEQ ID NO: 88203 - protein, 10 aa, Dengue virus
KITGNLVQIE

SEQ ID NO: 88204 - protein, 10 aa, Dengue virus
ITGNLVQIEN

SEQ ID NO: 88205 - protein, 10 aa, Dengue virus
TGNLVQIENL

SEQ ID NO: 88206 - protein, 10 aa, Dengue virus
GNLVQIENLE

SEQ ID NO: 88207 - protein, 10 aa, Dengue virus
NLVQIENLEY

SEQ ID NO: 88208 - protein, 10 aa, Dengue virus
LVQIENLEYT

SEQ ID NO: 88209 - protein, 10 aa, Dengue virus
VQIENLEYTV

SEQ ID NO: 88210 - protein, 10 aa, Dengue virus
QIENLEYTVV

SEQ ID NO: 88211 - protein, 10 aa, Dengue virus
IENLEYTVVV

SEQ ID NO: 88212 - protein, 10 aa, Dengue virus
ENLEYTVVVT

SEQ ID NO: 88213 - protein, 10 aa, Dengue virus
NLEYTVVVTV

SEQ ID NO: 88214 - protein, 10 aa, Dengue virus
LEYTVVVTVH

SEQ ID NO: 88215 - protein, 10 aa, Dengue virus
EYTVVVTVHN

SEQ ID NO: 88216 - protein, 10 aa, Dengue virus
YTVVVTVHNG

SEQ ID NO: 88217 - protein, 10 aa, Dengue virus
TVVVTVHNGD

SEQ ID NO: 88218 - protein, 10 aa, Dengue virus
VVVTVHNGDT

SEQ ID NO: 88219 - protein, 10 aa, Dengue virus
VVTVHNGDTH

SEQ ID NO: 88220 - protein, 10 aa, Dengue virus
VTVHNGDTHA

SEQ ID NO: 88221 - protein, 10 aa, Dengue virus
TVHNGDTHAV

SEQ ID NO: 88222 - protein, 10 aa, Dengue virus
VHNGDTHAVG

SEQ ID NO: 88223 - protein, 10 aa, Dengue virus
HNGDTHAVGN

SEQ ID NO: 88224 - protein, 10 aa, Dengue virus
NGDTHAVGND

SEQ ID NO: 88225 - protein, 10 aa, Dengue virus
GDTHAVGNDT

SEQ ID NO: 88226 - protein, 10 aa, Dengue virus
DTHAVGNDTS

SEQ ID NO: 88227 - protein, 10 aa, Dengue virus
THAVGNDTSN

SEQ ID NO: 88228 - protein, 10 aa, Dengue virus
HAVGNDTSNH

SEQ ID NO: 88229 - protein, 10 aa, Dengue virus
AVGNDTSNHG

SEQ ID NO: 88230 - protein, 10 aa, Dengue virus
VGNDTSNHGV

SEQ ID NO: 88231 - protein, 10 aa, Dengue virus
GNDTSNHGVT

SEQ ID NO: 88232 - protein, 10 aa, Dengue virus
NDTSNHGVTA

SEQ ID NO: 88233 - protein, 10 aa, Dengue virus
DTSNHGVTAT

SEQ ID NO: 88234 - protein, 10 aa, Dengue virus
TSNHGVTATI

SEQ ID NO: 88235 - protein, 10 aa, Dengue virus
SNHGVTATIT

SEQ ID NO: 88236 - protein, 10 aa, Dengue virus
NHGVTATITP

SEQ ID NO: 88237 - protein, 10 aa, Dengue virus
HGVTATITPR

SEQ ID NO: 88238 - protein, 10 aa, Dengue virus
GVTATITPRS

SEQ ID NO: 88239 - protein, 10 aa, Dengue virus
VTATITPRSP

SEQ ID NO: 88240 - protein, 10 aa, Dengue virus
TATITPRSPS

SEQ ID NO: 88241 - protein, 10 aa, Dengue virus
ATITPRSPSV

SEQ ID NO: 88242 - protein, 10 aa, Dengue virus
TITPRSPSVE

SEQ ID NO: 88243 - protein, 10 aa, Dengue virus
ITPRSPSVEV

SEQ ID NO: 88244 - protein, 10 aa, Dengue virus
TPRSPSVEVK

SEQ ID NO: 88245 - protein, 10 aa, Dengue virus
PRSPSVEVKL

SEQ ID NO: 88246 - protein, 10 aa, Dengue virus
RSPSVEVKLP

SEQ ID NO: 88247 - protein, 10 aa, Dengue virus
SPSVEVKLPD

SEQ ID NO: 88248 - protein, 10 aa, Dengue virus
PSVEVKLPDY

SEQ ID NO: 88249 - protein, 10 aa, Dengue virus
SVEVKLPDYG

SEQ ID NO: 88250 - protein, 10 aa, Dengue virus
VEVKLPDYGE

SEQ ID NO: 88251 - protein, 10 aa, Dengue virus
EVKLPDYGEL

SEQ ID NO: 88252 - protein, 10 aa, Dengue virus
VKLPDYGELT

SEQ ID NO: 88253 - protein, 10 aa, Dengue virus
KLPDYGELTL

SEQ ID NO: 88254 - protein, 10 aa, Dengue virus
LPDYGELTLD

SEQ ID NO: 88255 - protein, 10 aa, Dengue virus
PDYGELTLDC

SEQ ID NO: 88256 - protein, 10 aa, Dengue virus
DYGELTLDCE

SEQ ID NO: 88257 - protein, 10 aa, Dengue virus
YGELTLDCEP

SEQ ID NO: 88258 - protein, 10 aa, Dengue virus
GELTLDCEPR

SEQ ID NO: 88259 - protein, 10 aa, Dengue virus
ELTLDCEPRS

SEQ ID NO: 88260 - protein, 10 aa, Dengue virus
LTLDCEPRSG

SEQ ID NO: 88261 - protein, 10 aa, Dengue virus
TLDCEPRSGI

SEQ ID NO: 88262 - protein, 10 aa, Dengue virus
LDCEPRSGID

SEQ ID NO: 88263 - protein, 10 aa, Dengue virus
DCEPRSGIDF

SEQ ID NO: 88264 - protein, 10 aa, Dengue virus
CEPRSGIDFN

SEQ ID NO: 88265 - protein, 10 aa, Dengue virus
EPRSGIDFNE

SEQ ID NO: 88266 - protein, 10 aa, Dengue virus
PRSGIDFNEM

SEQ ID NO: 88267 - protein, 10 aa, Dengue virus
RSGIDFNEMI

SEQ ID NO: 88268 - protein, 10 aa, Dengue virus
SGIDFNEMIL

SEQ ID NO: 88269 - protein, 10 aa, Dengue virus
GIDFNEMILM

SEQ ID NO: 88270 - protein, 10 aa, Dengue virus
IDFNEMILMK

SEQ ID NO: 88271 - protein, 10 aa, Dengue virus
DFNEMILMKM

SEQ ID NO: 88272 - protein, 10 aa, Dengue virus
FNEMILMKMK

SEQ ID NO: 88273 - protein, 10 aa, Dengue virus
MKKKTWLVHK

SEQ ID NO: 88274 - protein, 10 aa, Dengue virus
KKKTWLVHKQ

SEQ ID NO: 88275 - protein, 10 aa, Dengue virus
KKTWLVHKQW

SEQ ID NO: 88276 - protein, 10 aa, Dengue virus
KTWLVHKQWF

SEQ ID NO: 88277 - protein, 10 aa, Dengue virus
TWLVHKQWFL

SEQ ID NO: 88278 - protein, 10 aa, Dengue virus
WLVHKQWFLD

SEQ ID NO: 88279 - protein, 10 aa, Dengue virus
LVHKQWFLDL

SEQ ID NO: 88280 - protein, 10 aa, Dengue virus
VHKQWFLDLP

SEQ ID NO: 88281 - protein, 10 aa, Dengue virus
HKQWFLDLPL

SEQ ID NO: 88282 - protein, 10 aa, Dengue virus
KQWFLDLPLP

SEQ ID NO: 88283 - protein, 10 aa, Dengue virus
QWFLDLPLPW

SEQ ID NO: 88284 - protein, 10 aa, Dengue virus
WFLDLPLPWT

SEQ ID NO: 88285 - protein, 10 aa, Dengue virus
FLDLPLPWTA

SEQ ID NO: 88286 - protein, 10 aa, Dengue virus
LDLPLPWTAG

SEQ ID NO: 88287 - protein, 10 aa, Dengue virus
DLPLPWTAGA

SEQ ID NO: 88288 - protein, 10 aa, Dengue virus
LPLPWTAGAD

SEQ ID NO: 88289 - protein, 10 aa, Dengue virus
PLPWTAGADT

SEQ ID NO: 88290 - protein, 10 aa, Dengue virus
LPWTAGADTS

SEQ ID NO: 88291 - protein, 10 aa, Dengue virus
PWTAGADTSE

SEQ ID NO: 88292 - protein, 10 aa, Dengue virus
WTAGADTSEV

SEQ ID NO: 88293 - protein, 10 aa, Dengue virus
TAGADTSEVH

SEQ ID NO: 88294 - protein, 10 aa, Dengue virus
AGADTSEVHW

SEQ ID NO: 88295 - protein, 10 aa, Dengue virus
GADTSEVHWN

SEQ ID NO: 88296 - protein, 10 aa, Dengue virus
ADTSEVHWNY

SEQ ID NO: 88297 - protein, 10 aa, Dengue virus
DTSEVHWNYK

SEQ ID NO: 88298 - protein, 10 aa, Dengue virus
TSEVHWNYKE

SEQ ID NO: 88299 - protein, 10 aa, Dengue virus
SEVHWNYKER

SEQ ID NO: 88300 - protein, 10 aa, Dengue virus
EVHWNYKERM

SEQ ID NO: 88301 - protein, 10 aa, Dengue virus
VHWNYKERMV

SEQ ID NO: 88302 - protein, 10 aa, Dengue virus
HWNYKERMVT

SEQ ID NO: 88303 - protein, 10 aa, Dengue virus
WNYKERMVTF

SEQ ID NO: 88304 - protein, 10 aa, Dengue virus
NYKERMVTFK

SEQ ID NO: 88305 - protein, 10 aa, Dengue virus
YKERMVTFKV

SEQ ID NO: 88306 - protein, 10 aa, Dengue virus
KERMVTFKVP

SEQ ID NO: 88307 - protein, 10 aa, Dengue virus
ERMVTFKVPH

SEQ ID NO: 88308 - protein, 10 aa, Dengue virus
RMVTFKVPHA

SEQ ID NO: 88309 - protein, 10 aa, Dengue virus
MVTFKVPHAK

SEQ ID NO: 88310 - protein, 10 aa, Dengue virus
VTFKVPHAKR

SEQ ID NO: 88311 - protein, 10 aa, Dengue virus
TFKVPHAKRQ

SEQ ID NO: 88312 - protein, 10 aa, Dengue virus
FKVPHAKRQD

SEQ ID NO: 88313 - protein, 10 aa, Dengue virus
KVPHAKRQDV

SEQ ID NO: 88314 - protein, 10 aa, Dengue virus
VPHAKRQDVT

SEQ ID NO: 88315 - protein, 10 aa, Dengue virus
PHAKRQDVTV

SEQ ID NO: 88316 - protein, 10 aa, Dengue virus
HAKRQDVTVL

SEQ ID NO: 88317 - protein, 10 aa, Dengue virus
AKRQDVTVLG

SEQ ID NO: 88318 - protein, 10 aa, Dengue virus
KRQDVTVLGS

SEQ ID NO: 88319 - protein, 10 aa, Dengue virus
RQDVTVLGSQ

SEQ ID NO: 88320 - protein, 10 aa, Dengue virus
QDVTVLGSQE

SEQ ID NO: 88321 - protein, 10 aa, Dengue virus
DVTVLGSQEG

SEQ ID NO: 88322 - protein, 10 aa, Dengue virus
VTVLGSQEGA

SEQ ID NO: 88323 - protein, 10 aa, Dengue virus
TVLGSQEGAM

SEQ ID NO: 88324 - protein, 10 aa, Dengue virus
VLGSQEGAMH

SEQ ID NO: 88325 - protein, 10 aa, Dengue virus
LGSQEGAMHS

SEQ ID NO: 88326 - protein, 10 aa, Dengue virus
GSQEGAMHSA

SEQ ID NO: 88327 - protein, 10 aa, Dengue virus
SQEGAMHSAL

SEQ ID NO: 88328 - protein, 10 aa, Dengue virus
QEGAMHSALA

SEQ ID NO: 88329 - protein, 10 aa, Dengue virus
EGAMHSALAG

SEQ ID NO: 88330 - protein, 10 aa, Dengue virus
GAMHSALAGA

SEQ ID NO: 88331 - protein, 10 aa, Dengue virus
AMHSALAGAT

SEQ ID NO: 88332 - protein, 10 aa, Dengue virus
MHSALAGATE

SEQ ID NO: 88333 - protein, 10 aa, Dengue virus
HSALAGATEV

SEQ ID NO: 88334 - protein, 10 aa, Dengue virus
SALAGATEVD

SEQ ID NO: 88335 - protein, 10 aa, Dengue virus
ALAGATEVDS

SEQ ID NO: 88336 - protein, 10 aa, Dengue virus
LAGATEVDSG

SEQ ID NO: 88337 - protein, 10 aa, Dengue virus
AGATEVDSGD

SEQ ID NO: 88338 - protein, 10 aa, Dengue virus
GATEVDSGDG

SEQ ID NO: 88339 - protein, 10 aa, Dengue virus
ATEVDSGDGN

SEQ ID NO: 88340 - protein, 10 aa, Dengue virus
TEVDSGDGNH

SEQ ID NO: 88341 - protein, 10 aa, Dengue virus
EVDSGDGNHM

SEQ ID NO: 88342 - protein, 10 aa, Dengue virus
VDSGDGNHMF

SEQ ID NO: 88343 - protein, 10 aa, Dengue virus
DSGDGNHMFA

SEQ ID NO: 88344 - protein, 10 aa, Dengue virus
SGDGNHMFAG

SEQ ID NO: 88345 - protein, 10 aa, Dengue virus
GDGNHMFAGH

SEQ ID NO: 88346 - protein, 10 aa, Dengue virus
DGNHMFAGHL

SEQ ID NO: 88347 - protein, 10 aa, Dengue virus
GNHMFAGHLK

SEQ ID NO: 88348 - protein, 10 aa, Dengue virus
NHMFAGHLKC

SEQ ID NO: 88349 - protein, 10 aa, Dengue virus
HMFAGHLKCK

SEQ ID NO: 88350 - protein, 10 aa, Dengue virus
MFAGHLKCKV

SEQ ID NO: 88351 - protein, 10 aa, Dengue virus
FAGHLKCKVR

SEQ ID NO: 88352 - protein, 10 aa, Dengue virus
AGHLKCKVRM

SEQ ID NO: 88353 - protein, 10 aa, Dengue virus
GHLKCKVRME

SEQ ID NO: 88354 - protein, 10 aa, Dengue virus
HLKCKVRMEK

SEQ ID NO: 88355 - protein, 10 aa, Dengue virus
LKCKVRMEKL

SEQ ID NO: 88356 - protein, 10 aa, Dengue virus
KCKVRMEKLR

SEQ ID NO: 88357 - protein, 10 aa, Dengue virus
CKVRMEKLRI

SEQ ID NO: 88358 - protein, 10 aa, Dengue virus
KVRMEKLRIK

SEQ ID NO: 88359 - protein, 10 aa, Dengue virus
VRMEKLRIKG

SEQ ID NO: 88360 - protein, 10 aa, Dengue virus
RMEKLRIKGM

SEQ ID NO: 88361 - protein, 10 aa, Dengue virus
MEKLRIKGMS

SEQ ID NO: 88362 - protein, 10 aa, Dengue virus
EKLRIKGMSY

SEQ ID NO: 88363 - protein, 10 aa, Dengue virus
KLRIKGMSYT

SEQ ID NO: 88364 - protein, 10 aa, Dengue virus
LRIKGMSYTM

SEQ ID NO: 88365 - protein, 10 aa, Dengue virus
RIKGMSYTMC

SEQ ID NO: 88366 - protein, 10 aa, Dengue virus
IKGMSYTMCS

SEQ ID NO: 88367 - protein, 10 aa, Dengue virus
KGMSYTMCSG

SEQ ID NO: 88368 - protein, 10 aa, Dengue virus
GMSYTMCSGK

SEQ ID NO: 88369 - protein, 10 aa, Dengue virus
MSYTMCSGKF

SEQ ID NO: 88370 - protein, 10 aa, Dengue virus
SYTMCSGKFS

SEQ ID NO: 88371 - protein, 10 aa, Dengue virus
YTMCSGKFSI

SEQ ID NO: 88372 - protein, 10 aa, Dengue virus
TMCSGKFSID

SEQ ID NO: 88373 - protein, 10 aa, Dengue virus
MCSGKFSIDK

SEQ ID NO: 88374 - protein, 10 aa, Dengue virus
CSGKFSIDKE

SEQ ID NO: 88375 - protein, 10 aa, Dengue virus
SGKFSIDKEM

SEQ ID NO: 88376 - protein, 10 aa, Dengue virus
GKFSIDKEMA

SEQ ID NO: 88377 - protein, 10 aa, Dengue virus
KFSIDKEMAE

SEQ ID NO: 88378 - protein, 10 aa, Dengue virus
FSIDKEMAET

SEQ ID NO: 88379 - protein, 10 aa, Dengue virus
SIDKEMAETQ

SEQ ID NO: 88380 - protein, 10 aa, Dengue virus
IDKEMAETQH

SEQ ID NO: 88381 - protein, 10 aa, Dengue virus
DKEMAETQHG

SEQ ID NO: 88382 - protein, 10 aa, Dengue virus
KEMAETQHGT

SEQ ID NO: 88383 - protein, 10 aa, Dengue virus
EMAETQHGTT

SEQ ID NO: 88384 - protein, 10 aa, Dengue virus
MAETQHGTTV

SEQ ID NO: 88385 - protein, 10 aa, Dengue virus
AETQHGTTVV

SEQ ID NO: 88386 - protein, 10 aa, Dengue virus
ETQHGTTVVK

SEQ ID NO: 88387 - protein, 10 aa, Dengue virus
TQHGTTVVKV

SEQ ID NO: 88388 - protein, 10 aa, Dengue virus
QHGTTVVKVK

SEQ ID NO: 88389 - protein, 10 aa, Dengue virus
HGTTVVKVKY

SEQ ID NO: 88390 - protein, 10 aa, Dengue virus
GTTVVKVKYE

SEQ ID NO: 88391 - protein, 10 aa, Dengue virus
TTVVKVKYEG

SEQ ID NO: 88392 - protein, 10 aa, Dengue virus
TVVKVKYEGA

SEQ ID NO: 88393 - protein, 10 aa, Dengue virus
VVKVKYEGAG

SEQ ID NO: 88394 - protein, 10 aa, Dengue virus
VKVKYEGAGA

SEQ ID NO: 88395 - protein, 10 aa, Dengue virus
KVKYEGAGAP

SEQ ID NO: 88396 - protein, 10 aa, Dengue virus
VKYEGAGAPC

SEQ ID NO: 88397 - protein, 10 aa, Dengue virus
KYEGAGAPCK

SEQ ID NO: 88398 - protein, 10 aa, Dengue virus
YEGAGAPCKV

SEQ ID NO: 88399 - protein, 10 aa, Dengue virus
EGAGAPCKVP

SEQ ID NO: 88400 - protein, 10 aa, Dengue virus
GAGAPCKVPI

SEQ ID NO: 88401 - protein, 10 aa, Dengue virus
AGAPCKVPIE

SEQ ID NO: 88402 - protein, 10 aa, Dengue virus
GAPCKVPIEI

SEQ ID NO: 88403 - protein, 10 aa, Dengue virus
APCKVPIEIR

SEQ ID NO: 88404 - protein, 10 aa, Dengue virus
PCKVPIEIRD

SEQ ID NO: 88405 - protein, 10 aa, Dengue virus
CKVPIEIRDV

SEQ ID NO: 88406 - protein, 10 aa, Dengue virus
KVPIEIRDVN

SEQ ID NO: 88407 - protein, 10 aa, Dengue virus
VPIEIRDVNK

SEQ ID NO: 88408 - protein, 10 aa, Dengue virus
PIEIRDVNKE

SEQ ID NO: 88409 - protein, 10 aa, Dengue virus
IEIRDVNKEK

SEQ ID NO: 88410 - protein, 10 aa, Dengue virus
EIRDVNKEKV

SEQ ID NO: 88411 - protein, 10 aa, Dengue virus
IRDVNKEKVV

SEQ ID NO: 88412 - protein, 10 aa, Dengue virus
RDVNKEKVVG

SEQ ID NO: 88413 - protein, 10 aa, Dengue virus
DVNKEKVVGR

SEQ ID NO: 88414 - protein, 10 aa, Dengue virus
AENTNSVTNI

SEQ ID NO: 88415 - protein, 10 aa, Dengue virus
ENTNSVTNIE

SEQ ID NO: 88416 - protein, 10 aa, Dengue virus
NTNSVTNIEL

SEQ ID NO: 88417 - protein, 10 aa, Dengue virus
TNSVTNIELE

SEQ ID NO: 88418 - protein, 10 aa, Dengue virus
NSVTNIELEP

SEQ ID NO: 88419 - protein, 10 aa, Dengue virus
SVTNIELEPP

SEQ ID NO: 88420 - protein, 10 aa, Dengue virus
VTNIELEPPF

SEQ ID NO: 88421 - protein, 10 aa, Dengue virus
TNIELEPPFG

SEQ ID NO: 88422 - protein, 10 aa, Dengue virus
NIELEPPFGD

SEQ ID NO: 88423 - protein, 10 aa, Dengue virus
IELEPPFGDS

SEQ ID NO: 88424 - protein, 10 aa, Dengue virus
ELEPPFGDSY

SEQ ID NO: 88425 - protein, 10 aa, Dengue virus
LEPPFGDSYI

SEQ ID NO: 88426 - protein, 10 aa, Dengue virus
EPPFGDSYIV

SEQ ID NO: 88427 - protein, 10 aa, Dengue virus
PPFGDSYIVI

SEQ ID NO: 88428 - protein, 10 aa, Dengue virus
PFGDSYIVIG

SEQ ID NO: 88429 - protein, 10 aa, Dengue virus
FGDSYIVIGV

SEQ ID NO: 88430 - protein, 10 aa, Dengue virus
GDSYIVIGVG

SEQ ID NO: 88431 - protein, 10 aa, Dengue virus
DSYIVIGVGN

SEQ ID NO: 88432 - protein, 10 aa, Dengue virus
SYIVIGVGNS

SEQ ID NO: 88433 - protein, 10 aa, Dengue virus
YIVIGVGNSA

SEQ ID NO: 88434 - protein, 10 aa, Dengue virus
IVIGVGNSAL

SEQ ID NO: 88435 - protein, 10 aa, Dengue virus
VIGVGNSALT

SEQ ID NO: 88436 - protein, 10 aa, Dengue virus
IGVGNSALTL

SEQ ID NO: 88437 - protein, 10 aa, Dengue virus
GVGNSALTLH

SEQ ID NO: 88438 - protein, 10 aa, Dengue virus
VGNSALTLHW

SEQ ID NO: 88439 - protein, 10 aa, Dengue virus
GNSALTLHWF

SEQ ID NO: 88440 - protein, 10 aa, Dengue virus
NSALTLHWFR

SEQ ID NO: 88441 - protein, 10 aa, Dengue virus
SALTLHWFRK

SEQ ID NO: 88442 - protein, 10 aa, Dengue virus
ALTLHWFRKG

SEQ ID NO: 88443 - protein, 10 aa, Dengue virus
LTLHWFRKGS

SEQ ID NO: 88444 - protein, 10 aa, Dengue virus
TLHWFRKGSS

SEQ ID NO: 88445 - protein, 10 aa, Dengue virus
LHWFRKGSSI

SEQ ID NO: 88446 - protein, 10 aa, Dengue virus
HWFRKGSSIG

SEQ ID NO: 88447 - protein, 10 aa, Dengue virus
WFRKGSSIGK

SEQ ID NO: 88448 - protein, 10 aa, Dengue virus
FRKGSSIGKM

SEQ ID NO: 88449 - protein, 10 aa, Dengue virus
RKGSSIGKMF

SEQ ID NO: 88450 - protein, 10 aa, Dengue virus
KGSSIGKMFE

SEQ ID NO: 88451 - protein, 10 aa, Dengue virus
GSSIGKMFES

SEQ ID NO: 88452 - protein, 10 aa, Dengue virus
SSIGKMFEST

SEQ ID NO: 88453 - protein, 10 aa, Dengue virus
SIGKMFESTY

SEQ ID NO: 88454 - protein, 10 aa, Dengue virus
IGKMFESTYR

SEQ ID NO: 88455 - protein, 10 aa, Dengue virus
GKMFESTYRG

SEQ ID NO: 88456 - protein, 10 aa, Dengue virus
KMFESTYRGA

SEQ ID NO: 88457 - protein, 10 aa, Dengue virus
MFESTYRGAK

SEQ ID NO: 88458 - protein, 10 aa, Dengue virus
FESTYRGAKR

SEQ ID NO: 88459 - protein, 10 aa, Dengue virus
ESTYRGAKRM

SEQ ID NO: 88460 - protein, 10 aa, Dengue virus
STYRGAKRMA

SEQ ID NO: 88461 - protein, 10 aa, Dengue virus
TYRGAKRMAI

SEQ ID NO: 88462 - protein, 10 aa, Dengue virus
YRGAKRMAIL

SEQ ID NO: 88463 - protein, 10 aa, Dengue virus
RGAKRMAILG

SEQ ID NO: 88464 - protein, 10 aa, Dengue virus
GAKRMAILGE

SEQ ID NO: 88465 - protein, 10 aa, Dengue virus
AKRMAILGET

SEQ ID NO: 88466 - protein, 10 aa, Dengue virus
KRMAILGETA

SEQ ID NO: 88467 - protein, 10 aa, Dengue virus
RMAILGETAW

SEQ ID NO: 88468 - protein, 10 aa, Dengue virus
MAILGETAWD

SEQ ID NO: 88469 - protein, 10 aa, Dengue virus
AILGETAWDF

SEQ ID NO: 88470 - protein, 10 aa, Dengue virus
ILGETAWDFG

SEQ ID NO: 88471 - protein, 10 aa, Dengue virus
LGETAWDFGS

SEQ ID NO: 88472 - protein, 10 aa, Dengue virus
GETAWDFGSV

SEQ ID NO: 88473 - protein, 10 aa, Dengue virus
ETAWDFGSVG

SEQ ID NO: 88474 - protein, 10 aa, Dengue virus
TAWDFGSVGG

SEQ ID NO: 88475 - protein, 10 aa, Dengue virus
AWDFGSVGGL

SEQ ID NO: 88476 - protein, 10 aa, Dengue virus
WDFGSVGGLF

SEQ ID NO: 88477 - protein, 10 aa, Dengue virus
DFGSVGGLFT

SEQ ID NO: 88478 - protein, 10 aa, Dengue virus
FGSVGGLFTS

SEQ ID NO: 88479 - protein, 10 aa, Dengue virus
GSVGGLFTSL

SEQ ID NO: 88480 - protein, 10 aa, Dengue virus
SVGGLFTSLG

SEQ ID NO: 88481 - protein, 10 aa, Dengue virus
VGGLFTSLGK

SEQ ID NO: 88482 - protein, 10 aa, Dengue virus
GGLFTSLGKA

SEQ ID NO: 88483 - protein, 10 aa, Dengue virus
GLFTSLGKAV

SEQ ID NO: 88484 - protein, 10 aa, Dengue virus
LFTSLGKAVH

SEQ ID NO: 88485 - protein, 10 aa, Dengue virus
FTSLGKAVHQ

SEQ ID NO: 88486 - protein, 10 aa, Dengue virus
TSLGKAVHQV

SEQ ID NO: 88487 - protein, 10 aa, Dengue virus
SLGKAVHQVF

SEQ ID NO: 88488 - protein, 10 aa, Dengue virus
LGKAVHQVFG

SEQ ID NO: 88489 - protein, 10 aa, Dengue virus
GKAVHQVFGS

SEQ ID NO: 88490 - protein, 10 aa, Dengue virus
KAVHQVFGSV

SEQ ID NO: 88491 - protein, 10 aa, Dengue virus
AVHQVFGSVY

SEQ ID NO: 88492 - protein, 10 aa, Dengue virus
VHQVFGSVYT

SEQ ID NO: 88493 - protein, 10 aa, Dengue virus
HQVFGSVYTT

SEQ ID NO: 88494 - protein, 10 aa, Dengue virus
QVFGSVYTTM

SEQ ID NO: 88495 - protein, 10 aa, Dengue virus
VFGSVYTTMF

SEQ ID NO: 88496 - protein, 10 aa, Dengue virus
FGSVYTTMFG

SEQ ID NO: 88497 - protein, 10 aa, Dengue virus
GSVYTTMFGG

SEQ ID NO: 88498 - protein, 10 aa, Dengue virus
SVYTTMFGGV

SEQ ID NO: 88499 - protein, 10 aa, Dengue virus
VYTTMFGGVS

SEQ ID NO: 88500 - protein, 10 aa, Dengue virus
YTTMFGGVSW

SEQ ID NO: 88501 - protein, 10 aa, Dengue virus
TTMFGGVSWM

SEQ ID NO: 88502 - protein, 10 aa, Dengue virus
TMFGGVSWMI

SEQ ID NO: 88503 - protein, 10 aa, Dengue virus
MFGGVSWMIR

SEQ ID NO: 88504 - protein, 10 aa, Dengue virus
FGGVSWMIRI

SEQ ID NO: 88505 - protein, 10 aa, Dengue virus
GGVSWMIRIL

SEQ ID NO: 88506 - protein, 10 aa, Dengue virus
GVSWMIRILI

SEQ ID NO: 88507 - protein, 10 aa, Dengue virus
VSWMIRILIG

SEQ ID NO: 88508 - protein, 10 aa, Dengue virus
IRILIGFLVL

SEQ ID NO: 88509 - protein, 10 aa, Dengue virus
RILIGFLVLW

SEQ ID NO: 88510 - protein, 10 aa, Dengue virus
ILIGFLVLWI

SEQ ID NO: 88511 - protein, 10 aa, Dengue virus
LIGFLVLWIG

SEQ ID NO: 88512 - protein, 10 aa, Dengue virus
IGFLVLWIGT

SEQ ID NO: 88513 - protein, 10 aa, Dengue virus
GFLVLWIGTN

SEQ ID NO: 88514 - protein, 10 aa, Dengue virus
FLVLWIGTNS

SEQ ID NO: 88515 - protein, 10 aa, Dengue virus
LVLWIGTNSR

SEQ ID NO: 88516 - protein, 10 aa, Dengue virus
VLWIGTNSRN

SEQ ID NO: 88517 - protein, 10 aa, Dengue virus
LWIGTNSRNT

SEQ ID NO: 88518 - protein, 10 aa, Dengue virus
WIGTNSRNTS

SEQ ID NO: 88519 - protein, 10 aa, Dengue virus
IGTNSRNTSM

SEQ ID NO: 88520 - protein, 10 aa, Dengue virus
GTNSRNTSMA

SEQ ID NO: 88521 - protein, 10 aa, Dengue virus
TNSRNTSMAM

SEQ ID NO: 88522 - protein, 10 aa, Dengue virus
NSRNTSMAMT

SEQ ID NO: 88523 - protein, 10 aa, Dengue virus
SRNTSMAMTC

SEQ ID NO: 88524 - protein, 10 aa, Dengue virus
RNTSMAMTCI

SEQ ID NO: 88525 - protein, 10 aa, Dengue virus
NTSMAMTCIA

SEQ ID NO: 88526 - protein, 10 aa, Dengue virus
TSMAMTCIAV

SEQ ID NO: 88527 - protein, 10 aa, Dengue virus
SMAMTCIAVG

SEQ ID NO: 88528 - protein, 10 aa, Dengue virus
MAMTCIAVGG

SEQ ID NO: 88529 - protein, 10 aa, Dengue virus
AMTCIAVGGI

SEQ ID NO: 88530 - protein, 10 aa, Dengue virus
MTCIAVGGIT

SEQ ID NO: 88531 - protein, 10 aa, Dengue virus
TCIAVGGITL

SEQ ID NO: 88532 - protein, 10 aa, Dengue virus
CIAVGGITLF

SEQ ID NO: 88533 - protein, 10 aa, Dengue virus
IAVGGITLFL

SEQ ID NO: 88534 - protein, 10 aa, Dengue virus
AVGGITLFLG

SEQ ID NO: 88535 - protein, 10 aa, Dengue virus
VGGITLFLGF

SEQ ID NO: 88536 - protein, 10 aa, Dengue virus
GGITLFLGFT

SEQ ID NO: 88537 - protein, 10 aa, Dengue virus
GITLFLGFTV

SEQ ID NO: 88538 - protein, 10 aa, Dengue virus
ITLFLGFTVQ

SEQ ID NO: 88539 - protein, 10 aa, Dengue virus
TLFLGFTVQA

SEQ ID NO: 88540 - protein, 10 aa, Dengue virus
LFLGFTVQAD

SEQ ID NO: 88541 - protein, 10 aa, Dengue virus
FLGFTVQADM

SEQ ID NO: 88542 - protein, 10 aa, Dengue virus
LGFTVQADMG

SEQ ID NO: 88543 - protein, 10 aa, Dengue virus
GFTVQADMGC

SEQ ID NO: 88544 - protein, 10 aa, Dengue virus
SWSGRELKCG

SEQ ID NO: 88545 - protein, 10 aa, Dengue virus
WSGRELKCGS

SEQ ID NO: 88546 - protein, 10 aa, Dengue virus
SGRELKCGSG

SEQ ID NO: 88547 - protein, 10 aa, Dengue virus
GRELKCGSGI

SEQ ID NO: 88548 - protein, 10 aa, Dengue virus
RELKCGSGIF

SEQ ID NO: 88549 - protein, 10 aa, Dengue virus
ELKCGSGIFV

SEQ ID NO: 88550 - protein, 10 aa, Dengue virus
LKCGSGIFVV

SEQ ID NO: 88551 - protein, 10 aa, Dengue virus
KCGSGIFVVD

SEQ ID NO: 88552 - protein, 10 aa, Dengue virus
CGSGIFVVDN

SEQ ID NO: 88553 - protein, 10 aa, Dengue virus
GSGIFVVDNV

SEQ ID NO: 88554 - protein, 10 aa, Dengue virus
SGIFVVDNVH

SEQ ID NO: 88555 - protein, 10 aa, Dengue virus
GIFVVDNVHT

SEQ ID NO: 88556 - protein, 10 aa, Dengue virus
IFVVDNVHTW

SEQ ID NO: 88557 - protein, 10 aa, Dengue virus
FVVDNVHTWT

SEQ ID NO: 88558 - protein, 10 aa, Dengue virus
VVDNVHTWTE

SEQ ID NO: 88559 - protein, 10 aa, Dengue virus
VDNVHTWTEQ

SEQ ID NO: 88560 - protein, 10 aa, Dengue virus
DNVHTWTEQY

SEQ ID NO: 88561 - protein, 10 aa, Dengue virus
NVHTWTEQYK

SEQ ID NO: 88562 - protein, 10 aa, Dengue virus
VHTWTEQYKF

SEQ ID NO: 88563 - protein, 10 aa, Dengue virus
HTWTEQYKFQ

SEQ ID NO: 88564 - protein, 10 aa, Dengue virus
TWTEQYKFQP

SEQ ID NO: 88565 - protein, 10 aa, Dengue virus
WTEQYKFQPE

SEQ ID NO: 88566 - protein, 10 aa, Dengue virus
TEQYKFQPES

SEQ ID NO: 88567 - protein, 10 aa, Dengue virus
EQYKFQPESP

SEQ ID NO: 88568 - protein, 10 aa, Dengue virus
QYKFQPESPA

SEQ ID NO: 88569 - protein, 10 aa, Dengue virus
YKFQPESPAR

SEQ ID NO: 88570 - protein, 10 aa, Dengue virus
KFQPESPARL

SEQ ID NO: 88571 - protein, 10 aa, Dengue virus
FQPESPARLA

SEQ ID NO: 88572 - protein, 10 aa, Dengue virus
QPESPARLAS

SEQ ID NO: 88573 - protein, 10 aa, Dengue virus
PESPARLASA

SEQ ID NO: 88574 - protein, 10 aa, Dengue virus
ESPARLASAI

SEQ ID NO: 88575 - protein, 10 aa, Dengue virus
SPARLASAIL

SEQ ID NO: 88576 - protein, 10 aa, Dengue virus
PARLASAILN

SEQ ID NO: 88577 - protein, 10 aa, Dengue virus
ARLASAILNA

SEQ ID NO: 88578 - protein, 10 aa, Dengue virus
RLASAILNAH

SEQ ID NO: 88579 - protein, 10 aa, Dengue virus
LASAILNAHK

SEQ ID NO: 88580 - protein, 10 aa, Dengue virus
ASAILNAHKD

SEQ ID NO: 88581 - protein, 10 aa, Dengue virus
SAILNAHKDG

SEQ ID NO: 88582 - protein, 10 aa, Dengue virus
AILNAHKDGV

SEQ ID NO: 88583 - protein, 10 aa, Dengue virus
ILNAHKDGVC

SEQ ID NO: 88584 - protein, 10 aa, Dengue virus
LNAHKDGVCG

SEQ ID NO: 88585 - protein, 10 aa, Dengue virus
NAHKDGVCGI

SEQ ID NO: 88586 - protein, 10 aa, Dengue virus
AHKDGVCGIR

SEQ ID NO: 88587 - protein, 10 aa, Dengue virus
HKDGVCGIRS

SEQ ID NO: 88588 - protein, 10 aa, Dengue virus
KDGVCGIRST

SEQ ID NO: 88589 - protein, 10 aa, Dengue virus
DGVCGIRSTT

SEQ ID NO: 88590 - protein, 10 aa, Dengue virus
GVCGIRSTTR

SEQ ID NO: 88591 - protein, 10 aa, Dengue virus
VCGIRSTTRL

SEQ ID NO: 88592 - protein, 10 aa, Dengue virus
CGIRSTTRLE

SEQ ID NO: 88593 - protein, 10 aa, Dengue virus
GIRSTTRLEN

SEQ ID NO: 88594 - protein, 10 aa, Dengue virus
IRSTTRLENV

SEQ ID NO: 88595 - protein, 10 aa, Dengue virus
RSTTRLENVM

SEQ ID NO: 88596 - protein, 10 aa, Dengue virus
STTRLENVMW

SEQ ID NO: 88597 - protein, 10 aa, Dengue virus
TTRLENVMWK

SEQ ID NO: 88598 - protein, 10 aa, Dengue virus
TRLENVMWKQ

SEQ ID NO: 88599 - protein, 10 aa, Dengue virus
RLENVMWKQI

SEQ ID NO: 88600 - protein, 10 aa, Dengue virus
LENVMWKQIT

SEQ ID NO: 88601 - protein, 10 aa, Dengue virus
ENVMWKQITN

SEQ ID NO: 88602 - protein, 10 aa, Dengue virus
NVMWKQITNE

SEQ ID NO: 88603 - protein, 10 aa, Dengue virus
VMWKQITNEL

SEQ ID NO: 88604 - protein, 10 aa, Dengue virus
MWKQITNELN

SEQ ID NO: 88605 - protein, 10 aa, Dengue virus
WKQITNELNY

SEQ ID NO: 88606 - protein, 10 aa, Dengue virus
KQITNELNYV

SEQ ID NO: 88607 - protein, 10 aa, Dengue virus
QITNELNYVL

SEQ ID NO: 88608 - protein, 10 aa, Dengue virus
ITNELNYVLW

SEQ ID NO: 88609 - protein, 10 aa, Dengue virus
TNELNYVLWE

SEQ ID NO: 88610 - protein, 10 aa, Dengue virus
NELNYVLWEG

SEQ ID NO: 88611 - protein, 10 aa, Dengue virus
ELNYVLWEGG

SEQ ID NO: 88612 - protein, 10 aa, Dengue virus
LNYVLWEGGH

SEQ ID NO: 88613 - protein, 10 aa, Dengue virus
NYVLWEGGHD

SEQ ID NO: 88614 - protein, 10 aa, Dengue virus
YVLWEGGHDL

SEQ ID NO: 88615 - protein, 10 aa, Dengue virus
VLWEGGHDLT

SEQ ID NO: 88616 - protein, 10 aa, Dengue virus
LWEGGHDLTV

SEQ ID NO: 88617 - protein, 10 aa, Dengue virus
WEGGHDLTVV

SEQ ID NO: 88618 - protein, 10 aa, Dengue virus
EGGHDLTVVA

SEQ ID NO: 88619 - protein, 10 aa, Dengue virus
GGHDLTVVAG

SEQ ID NO: 88620 - protein, 10 aa, Dengue virus
GHDLTVVAGD

SEQ ID NO: 88621 - protein, 10 aa, Dengue virus
HDLTVVAGDV

SEQ ID NO: 88622 - protein, 10 aa, Dengue virus
DLTVVAGDVK

SEQ ID NO: 88623 - protein, 10 aa, Dengue virus
LTVVAGDVKG

SEQ ID NO: 88624 - protein, 10 aa, Dengue virus
TVVAGDVKGV

SEQ ID NO: 88625 - protein, 10 aa, Dengue virus
VVAGDVKGVL

SEQ ID NO: 88626 - protein, 10 aa, Dengue virus
VAGDVKGVLT

SEQ ID NO: 88627 - protein, 10 aa, Dengue virus
AGDVKGVLTK

SEQ ID NO: 88628 - protein, 10 aa, Dengue virus
GDVKGVLTKG

SEQ ID NO: 88629 - protein, 10 aa, Dengue virus
DVKGVLTKGK

SEQ ID NO: 88630 - protein, 10 aa, Dengue virus
VKGVLTKGKR

SEQ ID NO: 88631 - protein, 10 aa, Dengue virus
KGVLTKGKRA

SEQ ID NO: 88632 - protein, 10 aa, Dengue virus
GVLTKGKRAL

SEQ ID NO: 88633 - protein, 10 aa, Dengue virus
VLTKGKRALT

SEQ ID NO: 88634 - protein, 10 aa, Dengue virus
LTKGKRALTP

SEQ ID NO: 88635 - protein, 10 aa, Dengue virus
TKGKRALTPP

SEQ ID NO: 88636 - protein, 10 aa, Dengue virus
KGKRALTPPV

SEQ ID NO: 88637 - protein, 10 aa, Dengue virus
LTPPVSDLKY

SEQ ID NO: 88638 - protein, 10 aa, Dengue virus
TPPVSDLKYS

SEQ ID NO: 88639 - protein, 10 aa, Dengue virus
PPVSDLKYSW

SEQ ID NO: 88640 - protein, 10 aa, Dengue virus
PVSDLKYSWK

SEQ ID NO: 88641 - protein, 10 aa, Dengue virus
VSDLKYSWKT

SEQ ID NO: 88642 - protein, 10 aa, Dengue virus
SDLKYSWKTW

SEQ ID NO: 88643 - protein, 10 aa, Dengue virus
DLKYSWKTWG

SEQ ID NO: 88644 - protein, 10 aa, Dengue virus
LKYSWKTWGK

SEQ ID NO: 88645 - protein, 10 aa, Dengue virus
KYSWKTWGKA

SEQ ID NO: 88646 - protein, 10 aa, Dengue virus
YSWKTWGKAK

SEQ ID NO: 88647 - protein, 10 aa, Dengue virus
SWKTWGKAKI

SEQ ID NO: 88648 - protein, 10 aa, Dengue virus
WKTWGKAKIF

SEQ ID NO: 88649 - protein, 10 aa, Dengue virus
KTWGKAKIFT

SEQ ID NO: 88650 - protein, 10 aa, Dengue virus
TWGKAKIFTP

SEQ ID NO: 88651 - protein, 10 aa, Dengue virus
WGKAKIFTPE

SEQ ID NO: 88652 - protein, 10 aa, Dengue virus
GKAKIFTPEA

SEQ ID NO: 88653 - protein, 10 aa, Dengue virus
RNSTFLIDGP

SEQ ID NO: 88654 - protein, 10 aa, Dengue virus
NSTFLIDGPD

SEQ ID NO: 88655 - protein, 10 aa, Dengue virus
STFLIDGPDT

SEQ ID NO: 88656 - protein, 10 aa, Dengue virus
TFLIDGPDTS

SEQ ID NO: 88657 - protein, 10 aa, Dengue virus
FLIDGPDTSE

SEQ ID NO: 88658 - protein, 10 aa, Dengue virus
LIDGPDTSEC

SEQ ID NO: 88659 - protein, 10 aa, Dengue virus
IDGPDTSECP

SEQ ID NO: 88660 - protein, 10 aa, Dengue virus
DGPDTSECPN

SEQ ID NO: 88661 - protein, 10 aa, Dengue virus
GPDTSECPNE

SEQ ID NO: 88662 - protein, 10 aa, Dengue virus
PDTSECPNER

SEQ ID NO: 88663 - protein, 10 aa, Dengue virus
DTSECPNERR

SEQ ID NO: 88664 - protein, 10 aa, Dengue virus
TSECPNERRA

SEQ ID NO: 88665 - protein, 10 aa, Dengue virus
SECPNERRAW

SEQ ID NO: 88666 - protein, 10 aa, Dengue virus
ECPNERRAWN

SEQ ID NO: 88667 - protein, 10 aa, Dengue virus
CPNERRAWNS

SEQ ID NO: 88668 - protein, 10 aa, Dengue virus
PNERRAWNSL

SEQ ID NO: 88669 - protein, 10 aa, Dengue virus
NERRAWNSLE

SEQ ID NO: 88670 - protein, 10 aa, Dengue virus
ERRAWNSLEV

SEQ ID NO: 88671 - protein, 10 aa, Dengue virus
RRAWNSLEVE

SEQ ID NO: 88672 - protein, 10 aa, Dengue virus
RAWNSLEVED

SEQ ID NO: 88673 - protein, 10 aa, Dengue virus
AWNSLEVEDY

SEQ ID NO: 88674 - protein, 10 aa, Dengue virus
WNSLEVEDYG

SEQ ID NO: 88675 - protein, 10 aa, Dengue virus
NSLEVEDYGF

SEQ ID NO: 88676 - protein, 10 aa, Dengue virus
SLEVEDYGFG

SEQ ID NO: 88677 - protein, 10 aa, Dengue virus
LEVEDYGFGM

SEQ ID NO: 88678 - protein, 10 aa, Dengue virus
EVEDYGFGMF

SEQ ID NO: 88679 - protein, 10 aa, Dengue virus
VEDYGFGMFT

SEQ ID NO: 88680 - protein, 10 aa, Dengue virus
EDYGFGMFTT

SEQ ID NO: 88681 - protein, 10 aa, Dengue virus
DYGFGMFTTN

SEQ ID NO: 88682 - protein, 10 aa, Dengue virus
YGFGMFTTNI

SEQ ID NO: 88683 - protein, 10 aa, Dengue virus
GFGMFTTNIW

SEQ ID NO: 88684 - protein, 10 aa, Dengue virus
FGMFTTNIWM

SEQ ID NO: 88685 - protein, 10 aa, Dengue virus
GMFTTNIWMK

SEQ ID NO: 88686 - protein, 10 aa, Dengue virus
MFTTNIWMKF

SEQ ID NO: 88687 - protein, 10 aa, Dengue virus
FTTNIWMKFR

SEQ ID NO: 88688 - protein, 10 aa, Dengue virus
TTNIWMKFRE

SEQ ID NO: 88689 - protein, 10 aa, Dengue virus
TNIWMKFREG

SEQ ID NO: 88690 - protein, 10 aa, Dengue virus
NIWMKFREGS

SEQ ID NO: 88691 - protein, 10 aa, Dengue virus
IWMKFREGSS

SEQ ID NO: 88692 - protein, 10 aa, Dengue virus
WMKFREGSSE

SEQ ID NO: 88693 - protein, 10 aa, Dengue virus
MKFREGSSEV

SEQ ID NO: 88694 - protein, 10 aa, Dengue virus
KFREGSSEVC

SEQ ID NO: 88695 - protein, 10 aa, Dengue virus
FREGSSEVCD

SEQ ID NO: 88696 - protein, 10 aa, Dengue virus
REGSSEVCDH

SEQ ID NO: 88697 - protein, 10 aa, Dengue virus
EGSSEVCDHR

SEQ ID NO: 88698 - protein, 10 aa, Dengue virus
GSSEVCDHRL

SEQ ID NO: 88699 - protein, 10 aa, Dengue virus
SSEVCDHRLM

SEQ ID NO: 88700 - protein, 10 aa, Dengue virus
SEVCDHRLMS

SEQ ID NO: 88701 - protein, 10 aa, Dengue virus
EVCDHRLMSA

SEQ ID NO: 88702 - protein, 10 aa, Dengue virus
VCDHRLMSAA

SEQ ID NO: 88703 - protein, 10 aa, Dengue virus
CDHRLMSAAI

SEQ ID NO: 88704 - protein, 10 aa, Dengue virus
DHRLMSAAIK

SEQ ID NO: 88705 - protein, 10 aa, Dengue virus
HRLMSAAIKD

SEQ ID NO: 88706 - protein, 10 aa, Dengue virus
RLMSAAIKDQ

SEQ ID NO: 88707 - protein, 10 aa, Dengue virus
LMSAAIKDQK

SEQ ID NO: 88708 - protein, 10 aa, Dengue virus
MSAAIKDQKA

SEQ ID NO: 88709 - protein, 10 aa, Dengue virus
SAAIKDQKAV

SEQ ID NO: 88710 - protein, 10 aa, Dengue virus
AAIKDQKAVH

SEQ ID NO: 88711 - protein, 10 aa, Dengue virus
AIKDQKAVHA

SEQ ID NO: 88712 - protein, 10 aa, Dengue virus
IKDQKAVHAD

SEQ ID NO: 88713 - protein, 10 aa, Dengue virus
KDQKAVHADM

SEQ ID NO: 88714 - protein, 10 aa, Dengue virus
DQKAVHADMG

SEQ ID NO: 88715 - protein, 10 aa, Dengue virus
QKAVHADMGY

SEQ ID NO: 88716 - protein, 10 aa, Dengue virus
KAVHADMGYW

SEQ ID NO: 88717 - protein, 10 aa, Dengue virus
AVHADMGYWI

SEQ ID NO: 88718 - protein, 10 aa, Dengue virus
VHADMGYWIE

SEQ ID NO: 88719 - protein, 10 aa, Dengue virus
HADMGYWIES

SEQ ID NO: 88720 - protein, 10 aa, Dengue virus
ADMGYWIESS

SEQ ID NO: 88721 - protein, 10 aa, Dengue virus
DMGYWIESSK

SEQ ID NO: 88722 - protein, 10 aa, Dengue virus
MGYWIESSKN

SEQ ID NO: 88723 - protein, 10 aa, Dengue virus
GYWIESSKNQ

SEQ ID NO: 88724 - protein, 10 aa, Dengue virus
YWIESSKNQT

SEQ ID NO: 88725 - protein, 10 aa, Dengue virus
WIESSKNQTW

SEQ ID NO: 88726 - protein, 10 aa, Dengue virus
IESSKNQTWQ

SEQ ID NO: 88727 - protein, 10 aa, Dengue virus
ESSKNQTWQI

SEQ ID NO: 88728 - protein, 10 aa, Dengue virus
SSKNQTWQIE

SEQ ID NO: 88729 - protein, 10 aa, Dengue virus
SKNQTWQIEK

SEQ ID NO: 88730 - protein, 10 aa, Dengue virus
KNQTWQIEKA

SEQ ID NO: 88731 - protein, 10 aa, Dengue virus
NQTWQIEKAS

SEQ ID NO: 88732 - protein, 10 aa, Dengue virus
QTWQIEKASL

SEQ ID NO: 88733 - protein, 10 aa, Dengue virus
TWQIEKASLI

SEQ ID NO: 88734 - protein, 10 aa, Dengue virus
WQIEKASLIE

SEQ ID NO: 88735 - protein, 10 aa, Dengue virus
QIEKASLIEV

SEQ ID NO: 88736 - protein, 10 aa, Dengue virus
IEKASLIEVK

SEQ ID NO: 88737 - protein, 10 aa, Dengue virus
EKASLIEVKT

SEQ ID NO: 88738 - protein, 10 aa, Dengue virus
KASLIEVKTC

SEQ ID NO: 88739 - protein, 10 aa, Dengue virus
ASLIEVKTCL

SEQ ID NO: 88740 - protein, 10 aa, Dengue virus
SLIEVKTCLW

SEQ ID NO: 88741 - protein, 10 aa, Dengue virus
LIEVKTCLWP

SEQ ID NO: 88742 - protein, 10 aa, Dengue virus
IEVKTCLWPK

SEQ ID NO: 88743 - protein, 10 aa, Dengue virus
EVKTCLWPKT

SEQ ID NO: 88744 - protein, 10 aa, Dengue virus
VKTCLWPKTH

SEQ ID NO: 88745 - protein, 10 aa, Dengue virus
KTCLWPKTHT

SEQ ID NO: 88746 - protein, 10 aa, Dengue virus
TCLWPKTHTL

SEQ ID NO: 88747 - protein, 10 aa, Dengue virus
CLWPKTHTLW

SEQ ID NO: 88748 - protein, 10 aa, Dengue virus
LWPKTHTLWS

SEQ ID NO: 88749 - protein, 10 aa, Dengue virus
WPKTHTLWSN

SEQ ID NO: 88750 - protein, 10 aa, Dengue virus
PKTHTLWSNG

SEQ ID NO: 88751 - protein, 10 aa, Dengue virus
KTHTLWSNGV

SEQ ID NO: 88752 - protein, 10 aa, Dengue virus
THTLWSNGVL

SEQ ID NO: 88753 - protein, 10 aa, Dengue virus
HTLWSNGVLE

SEQ ID NO: 88754 - protein, 10 aa, Dengue virus
TLWSNGVLES

SEQ ID NO: 88755 - protein, 10 aa, Dengue virus
LWSNGVLESQ

SEQ ID NO: 88756 - protein, 10 aa, Dengue virus
WSNGVLESQM

SEQ ID NO: 88757 - protein, 10 aa, Dengue virus
SNGVLESQML

SEQ ID NO: 88758 - protein, 10 aa, Dengue virus
NGVLESQMLI

SEQ ID NO: 88759 - protein, 10 aa, Dengue virus
GVLESQMLIP

SEQ ID NO: 88760 - protein, 10 aa, Dengue virus
VLESQMLIPK

SEQ ID NO: 88761 - protein, 10 aa, Dengue virus
LESQMLIPKS

SEQ ID NO: 88762 - protein, 10 aa, Dengue virus
ESQMLIPKSY

SEQ ID NO: 88763 - protein, 10 aa, Dengue virus
SQMLIPKSYA

SEQ ID NO: 88764 - protein, 10 aa, Dengue virus
QMLIPKSYAG

SEQ ID NO: 88765 - protein, 10 aa, Dengue virus
MLIPKSYAGP

SEQ ID NO: 88766 - protein, 10 aa, Dengue virus
LIPKSYAGPF

SEQ ID NO: 88767 - protein, 10 aa, Dengue virus
IPKSYAGPFS

SEQ ID NO: 88768 - protein, 10 aa, Dengue virus
PKSYAGPFSQ

SEQ ID NO: 88769 - protein, 10 aa, Dengue virus
KSYAGPFSQH

SEQ ID NO: 88770 - protein, 10 aa, Dengue virus
SYAGPFSQHN

SEQ ID NO: 88771 - protein, 10 aa, Dengue virus
YAGPFSQHNY

SEQ ID NO: 88772 - protein, 10 aa, Dengue virus
AGPFSQHNYR

SEQ ID NO: 88773 - protein, 10 aa, Dengue virus
GPFSQHNYRQ

SEQ ID NO: 88774 - protein, 10 aa, Dengue virus
PFSQHNYRQG

SEQ ID NO: 88775 - protein, 10 aa, Dengue virus
FSQHNYRQGY

SEQ ID NO: 88776 - protein, 10 aa, Dengue virus
SQHNYRQGYA

SEQ ID NO: 88777 - protein, 10 aa, Dengue virus
QHNYRQGYAT

SEQ ID NO: 88778 - protein, 10 aa, Dengue virus
HNYRQGYATQ

SEQ ID NO: 88779 - protein, 10 aa, Dengue virus
NYRQGYATQT

SEQ ID NO: 88780 - protein, 10 aa, Dengue virus
YRQGYATQTV

SEQ ID NO: 88781 - protein, 10 aa, Dengue virus
RQGYATQTVG

SEQ ID NO: 88782 - protein, 10 aa, Dengue virus
QGYATQTVGP

SEQ ID NO: 88783 - protein, 10 aa, Dengue virus
GYATQTVGPW

SEQ ID NO: 88784 - protein, 10 aa, Dengue virus
YATQTVGPWH

SEQ ID NO: 88785 - protein, 10 aa, Dengue virus
ATQTVGPWHL

SEQ ID NO: 88786 - protein, 10 aa, Dengue virus
TQTVGPWHLG

SEQ ID NO: 88787 - protein, 10 aa, Dengue virus
QTVGPWHLGK

SEQ ID NO: 88788 - protein, 10 aa, Dengue virus
TVGPWHLGKL

SEQ ID NO: 88789 - protein, 10 aa, Dengue virus
VGPWHLGKLE

SEQ ID NO: 88790 - protein, 10 aa, Dengue virus
GPWHLGKLEI

SEQ ID NO: 88791 - protein, 10 aa, Dengue virus
PWHLGKLEID

SEQ ID NO: 88792 - protein, 10 aa, Dengue virus
WHLGKLEIDF

SEQ ID NO: 88793 - protein, 10 aa, Dengue virus
HLGKLEIDFG

SEQ ID NO: 88794 - protein, 10 aa, Dengue virus
LGKLEIDFGE

SEQ ID NO: 88795 - protein, 10 aa, Dengue virus
GKLEIDFGEC

SEQ ID NO: 88796 - protein, 10 aa, Dengue virus
KLEIDFGECP

SEQ ID NO: 88797 - protein, 10 aa, Dengue virus
LEIDFGECPG

SEQ ID NO: 88798 - protein, 10 aa, Dengue virus
EIDFGECPGT

SEQ ID NO: 88799 - protein, 10 aa, Dengue virus
IDFGECPGTT

SEQ ID NO: 88800 - protein, 10 aa, Dengue virus
DFGECPGTTV

SEQ ID NO: 88801 - protein, 10 aa, Dengue virus
FGECPGTTVT

SEQ ID NO: 88802 - protein, 10 aa, Dengue virus
GECPGTTVTI

SEQ ID NO: 88803 - protein, 10 aa, Dengue virus
ECPGTTVTIQ

SEQ ID NO: 88804 - protein, 10 aa, Dengue virus
CPGTTVTIQE

SEQ ID NO: 88805 - protein, 10 aa, Dengue virus
PGTTVTIQED

SEQ ID NO: 88806 - protein, 10 aa, Dengue virus
GTTVTIQEDC

SEQ ID NO: 88807 - protein, 10 aa, Dengue virus
QEDCDHRGPS

SEQ ID NO: 88808 - protein, 10 aa, Dengue virus
EDCDHRGPSL

SEQ ID NO: 88809 - protein, 10 aa, Dengue virus
DCDHRGPSLR

SEQ ID NO: 88810 - protein, 10 aa, Dengue virus
CDHRGPSLRT

SEQ ID NO: 88811 - protein, 10 aa, Dengue virus
DHRGPSLRTT

SEQ ID NO: 88812 - protein, 10 aa, Dengue virus
HRGPSLRTTT

SEQ ID NO: 88813 - protein, 10 aa, Dengue virus
RGPSLRTTTA

SEQ ID NO: 88814 - protein, 10 aa, Dengue virus
GPSLRTTTAS

SEQ ID NO: 88815 - protein, 10 aa, Dengue virus
PSLRTTTASG

SEQ ID NO: 88816 - protein, 10 aa, Dengue virus
SLRTTTASGK

SEQ ID NO: 88817 - protein, 10 aa, Dengue virus
LRTTTASGKL

SEQ ID NO: 88818 - protein, 10 aa, Dengue virus
RTTTASGKLV

SEQ ID NO: 88819 - protein, 10 aa, Dengue virus
TTTASGKLVT

SEQ ID NO: 88820 - protein, 10 aa, Dengue virus
TTASGKLVTQ

SEQ ID NO: 88821 - protein, 10 aa, Dengue virus
TASGKLVTQW

SEQ ID NO: 88822 - protein, 10 aa, Dengue virus
ASGKLVTQWC

SEQ ID NO: 88823 - protein, 10 aa, Dengue virus
SGKLVTQWCC

SEQ ID NO: 88824 - protein, 10 aa, Dengue virus
GKLVTQWCCR

SEQ ID NO: 88825 - protein, 10 aa, Dengue virus
KLVTQWCCRS

SEQ ID NO: 88826 - protein, 10 aa, Dengue virus
LVTQWCCRSC

SEQ ID NO: 88827 - protein, 10 aa, Dengue virus
VTQWCCRSCT

SEQ ID NO: 88828 - protein, 10 aa, Dengue virus
TQWCCRSCTM

SEQ ID NO: 88829 - protein, 10 aa, Dengue virus
QWCCRSCTMP

SEQ ID NO: 88830 - protein, 10 aa, Dengue virus
WCCRSCTMPP

SEQ ID NO: 88831 - protein, 10 aa, Dengue virus
CCRSCTMPPL

SEQ ID NO: 88832 - protein, 10 aa, Dengue virus
CRSCTMPPLR

SEQ ID NO: 88833 - protein, 10 aa, Dengue virus
RSCTMPPLRF

SEQ ID NO: 88834 - protein, 10 aa, Dengue virus
SCTMPPLRFL

SEQ ID NO: 88835 - protein, 10 aa, Dengue virus
CTMPPLRFLG

SEQ ID NO: 88836 - protein, 10 aa, Dengue virus
TMPPLRFLGE

SEQ ID NO: 88837 - protein, 10 aa, Dengue virus
MPPLRFLGED

SEQ ID NO: 88838 - protein, 10 aa, Dengue virus
PPLRFLGEDG

SEQ ID NO: 88839 - protein, 10 aa, Dengue virus
PLRFLGEDGC

SEQ ID NO: 88840 - protein, 10 aa, Dengue virus
LRFLGEDGCW

SEQ ID NO: 88841 - protein, 10 aa, Dengue virus
RFLGEDGCWY

SEQ ID NO: 88842 - protein, 10 aa, Dengue virus
FLGEDGCWYG

SEQ ID NO: 88843 - protein, 10 aa, Dengue virus
LGEDGCWYGM

SEQ ID NO: 88844 - protein, 10 aa, Dengue virus
GEDGCWYGME

SEQ ID NO: 88845 - protein, 10 aa, Dengue virus
EDGCWYGMEI

SEQ ID NO: 88846 - protein, 10 aa, Dengue virus
DGCWYGMEIR

SEQ ID NO: 88847 - protein, 10 aa, Dengue virus
GCWYGMEIRP

SEQ ID NO: 88848 - protein, 10 aa, Dengue virus
CWYGMEIRPL

SEQ ID NO: 88849 - protein, 10 aa, Dengue virus
WYGMEIRPLS

SEQ ID NO: 88850 - protein, 10 aa, Dengue virus
YGMEIRPLSE

SEQ ID NO: 88851 - protein, 10 aa, Dengue virus
GMEIRPLSEK

SEQ ID NO: 88852 - protein, 10 aa, Dengue virus
MEIRPLSEKE

SEQ ID NO: 88853 - protein, 10 aa, Dengue virus
EIRPLSEKEE

SEQ ID NO: 88854 - protein, 10 aa, Dengue virus
IRPLSEKEEN

SEQ ID NO: 88855 - protein, 10 aa, Dengue virus
RPLSEKEENM

SEQ ID NO: 88856 - protein, 10 aa, Dengue virus
PLSEKEENMV

SEQ ID NO: 88857 - protein, 10 aa, Dengue virus
LSEKEENMVK

SEQ ID NO: 88858 - protein, 10 aa, Dengue virus
SEKEENMVKS

SEQ ID NO: 88859 - protein, 10 aa, Dengue virus
EKEENMVKSQ

SEQ ID NO: 88860 - protein, 10 aa, Dengue virus
KEENMVKSQV

SEQ ID NO: 88861 - protein, 10 aa, Dengue virus
EENMVKSQVT

SEQ ID NO: 88862 - protein, 10 aa, Dengue virus
ENMVKSQVTA

SEQ ID NO: 88863 - protein, 10 aa, Dengue virus
NMVKSQVTAG

SEQ ID NO: 88864 - protein, 10 aa, Dengue virus
GTSETFSMGL

SEQ ID NO: 88865 - protein, 10 aa, Dengue virus
TSETFSMGLL

SEQ ID NO: 88866 - protein, 10 aa, Dengue virus
SETFSMGLLC

SEQ ID NO: 88867 - protein, 10 aa, Dengue virus
ETFSMGLLCL

SEQ ID NO: 88868 - protein, 10 aa, Dengue virus
TFSMGLLCLT

SEQ ID NO: 88869 - protein, 10 aa, Dengue virus
FSMGLLCLTL

SEQ ID NO: 88870 - protein, 10 aa, Dengue virus
SMGLLCLTLF

SEQ ID NO: 88871 - protein, 10 aa, Dengue virus
MGLLCLTLFV

SEQ ID NO: 88872 - protein, 10 aa, Dengue virus
GLLCLTLFVE

SEQ ID NO: 88873 - protein, 10 aa, Dengue virus
LLCLTLFVEE

SEQ ID NO: 88874 - protein, 10 aa, Dengue virus
LCLTLFVEEC

SEQ ID NO: 88875 - protein, 10 aa, Dengue virus
CLTLFVEECL

SEQ ID NO: 88876 - protein, 10 aa, Dengue virus
LTLFVEECLR

SEQ ID NO: 88877 - protein, 10 aa, Dengue virus
TLFVEECLRR

SEQ ID NO: 88878 - protein, 10 aa, Dengue virus
LFVEECLRRR

SEQ ID NO: 88879 - protein, 10 aa, Dengue virus
FVEECLRRRV

SEQ ID NO: 88880 - protein, 10 aa, Dengue virus
VEECLRRRVT

SEQ ID NO: 88881 - protein, 10 aa, Dengue virus
EECLRRRVTR

SEQ ID NO: 88882 - protein, 10 aa, Dengue virus
ECLRRRVTRK

SEQ ID NO: 88883 - protein, 10 aa, Dengue virus
CLRRRVTRKH

SEQ ID NO: 88884 - protein, 10 aa, Dengue virus
LRRRVTRKHM

SEQ ID NO: 88885 - protein, 10 aa, Dengue virus
RRRVTRKHMI

SEQ ID NO: 88886 - protein, 10 aa, Dengue virus
RRVTRKHMIL

SEQ ID NO: 88887 - protein, 10 aa, Dengue virus
RVTRKHMILA

SEQ ID NO: 88888 - protein, 10 aa, Dengue virus
VTRKHMILAV

SEQ ID NO: 88889 - protein, 10 aa, Dengue virus
TRKHMILAVV

SEQ ID NO: 88890 - protein, 10 aa, Dengue virus
RKHMILAVVI

SEQ ID NO: 88891 - protein, 10 aa, Dengue virus
KHMILAVVIT

SEQ ID NO: 88892 - protein, 10 aa, Dengue virus
ITLCAIILGG

SEQ ID NO: 88893 - protein, 10 aa, Dengue virus
TLCAIILGGL

SEQ ID NO: 88894 - protein, 10 aa, Dengue virus
LCAIILGGLT

SEQ ID NO: 88895 - protein, 10 aa, Dengue virus
CAIILGGLTW

SEQ ID NO: 88896 - protein, 10 aa, Dengue virus
AIILGGLTWM

SEQ ID NO: 88897 - protein, 10 aa, Dengue virus
IILGGLTWMD

SEQ ID NO: 88898 - protein, 10 aa, Dengue virus
ILGGLTWMDL

SEQ ID NO: 88899 - protein, 10 aa, Dengue virus
LGGLTWMDLL

SEQ ID NO: 88900 - protein, 10 aa, Dengue virus
GGLTWMDLLR

SEQ ID NO: 88901 - protein, 10 aa, Dengue virus
GLTWMDLLRA

SEQ ID NO: 88902 - protein, 10 aa, Dengue virus
LTWMDLLRAL

SEQ ID NO: 88903 - protein, 10 aa, Dengue virus
TWMDLLRALI

SEQ ID NO: 88904 - protein, 10 aa, Dengue virus
WMDLLRALIM

SEQ ID NO: 88905 - protein, 10 aa, Dengue virus
MDLLRALIML

SEQ ID NO: 88906 - protein, 10 aa, Dengue virus
DLLRALIMLG

SEQ ID NO: 88907 - protein, 10 aa, Dengue virus
LLRALIMLGD

SEQ ID NO: 88908 - protein, 10 aa, Dengue virus
LRALIMLGDT

SEQ ID NO: 88909 - protein, 10 aa, Dengue virus
RALIMLGDTM

SEQ ID NO: 88910 - protein, 10 aa, Dengue virus
ALIMLGDTMS

SEQ ID NO: 88911 - protein, 10 aa, Dengue virus
LIMLGDTMSG

SEQ ID NO: 88912 - protein, 10 aa, Dengue virus
IMLGDTMSGR

SEQ ID NO: 88913 - protein, 10 aa, Dengue virus
MLGDTMSGRI

SEQ ID NO: 88914 - protein, 10 aa, Dengue virus
LGDTMSGRIG

SEQ ID NO: 88915 - protein, 10 aa, Dengue virus
GDTMSGRIGG

SEQ ID NO: 88916 - protein, 10 aa, Dengue virus
DTMSGRIGGQ

SEQ ID NO: 88917 - protein, 10 aa, Dengue virus
RIGGQTHLAI

SEQ ID NO: 88918 - protein, 10 aa, Dengue virus
IGGQTHLAIM

SEQ ID NO: 88919 - protein, 10 aa, Dengue virus
GGQTHLAIMA

SEQ ID NO: 88920 - protein, 10 aa, Dengue virus
GQTHLAIMAV

SEQ ID NO: 88921 - protein, 10 aa, Dengue virus
QTHLAIMAVF

SEQ ID NO: 88922 - protein, 10 aa, Dengue virus
THLAIMAVFK

SEQ ID NO: 88923 - protein, 10 aa, Dengue virus
HLAIMAVFKM

SEQ ID NO: 88924 - protein, 10 aa, Dengue virus
LAIMAVFKMS

SEQ ID NO: 88925 - protein, 10 aa, Dengue virus
AIMAVFKMSP

SEQ ID NO: 88926 - protein, 10 aa, Dengue virus
IMAVFKMSPG

SEQ ID NO: 88927 - protein, 10 aa, Dengue virus
MAVFKMSPGY

SEQ ID NO: 88928 - protein, 10 aa, Dengue virus
AVFKMSPGYV

SEQ ID NO: 88929 - protein, 10 aa, Dengue virus
VFKMSPGYVL

SEQ ID NO: 88930 - protein, 10 aa, Dengue virus
FKMSPGYVLG

SEQ ID NO: 88931 - protein, 10 aa, Dengue virus
KMSPGYVLGV

SEQ ID NO: 88932 - protein, 10 aa, Dengue virus
MSPGYVLGVF

SEQ ID NO: 88933 - protein, 10 aa, Dengue virus
SPGYVLGVFL

SEQ ID NO: 88934 - protein, 10 aa, Dengue virus
PGYVLGVFLR

SEQ ID NO: 88935 - protein, 10 aa, Dengue virus
GYVLGVFLRK

SEQ ID NO: 88936 - protein, 10 aa, Dengue virus
YVLGVFLRKL

SEQ ID NO: 88937 - protein, 10 aa, Dengue virus
VLGVFLRKLT

SEQ ID NO: 88938 - protein, 10 aa, Dengue virus
LGVFLRKLTS

SEQ ID NO: 88939 - protein, 10 aa, Dengue virus
GVFLRKLTSR

SEQ ID NO: 88940 - protein, 10 aa, Dengue virus
VFLRKLTSRE

SEQ ID NO: 88941 - protein, 10 aa, Dengue virus
FLRKLTSRET

SEQ ID NO: 88942 - protein, 10 aa, Dengue virus
LRKLTSRETA

SEQ ID NO: 88943 - protein, 10 aa, Dengue virus
RKLTSRETAL

SEQ ID NO: 88944 - protein, 10 aa, Dengue virus
KLTSRETALM

SEQ ID NO: 88945 - protein, 10 aa, Dengue virus
LTSRETALMV

SEQ ID NO: 88946 - protein, 10 aa, Dengue virus
TSRETALMVI

SEQ ID NO: 88947 - protein, 10 aa, Dengue virus
SRETALMVIG

SEQ ID NO: 88948 - protein, 10 aa, Dengue virus
RETALMVIGM

SEQ ID NO: 88949 - protein, 10 aa, Dengue virus
ETALMVIGMA

SEQ ID NO: 88950 - protein, 10 aa, Dengue virus
TALMVIGMAM

SEQ ID NO: 88951 - protein, 10 aa, Dengue virus
ALMVIGMAMT

SEQ ID NO: 88952 - protein, 10 aa, Dengue virus
LMVIGMAMTT

SEQ ID NO: 88953 - protein, 10 aa, Dengue virus
MVIGMAMTTT

SEQ ID NO: 88954 - protein, 10 aa, Dengue virus
VIGMAMTTTL

SEQ ID NO: 88955 - protein, 10 aa, Dengue virus
IGMAMTTTLS

SEQ ID NO: 88956 - protein, 10 aa, Dengue virus
GMAMTTTLSI

SEQ ID NO: 88957 - protein, 10 aa, Dengue virus
MAMTTTLSIP

SEQ ID NO: 88958 - protein, 10 aa, Dengue virus
AMTTTLSIPH

SEQ ID NO: 88959 - protein, 10 aa, Dengue virus
MTTTLSIPHD

SEQ ID NO: 88960 - protein, 10 aa, Dengue virus
TTTLSIPHDL

SEQ ID NO: 88961 - protein, 10 aa, Dengue virus
TTLSIPHDLM

SEQ ID NO: 88962 - protein, 10 aa, Dengue virus
TLSIPHDLME

SEQ ID NO: 88963 - protein, 10 aa, Dengue virus
LSIPHDLMEL

SEQ ID NO: 88964 - protein, 10 aa, Dengue virus
SIPHDLMELI

SEQ ID NO: 88965 - protein, 10 aa, Dengue virus
IPHDLMELID

SEQ ID NO: 88966 - protein, 10 aa, Dengue virus
PHDLMELIDG

SEQ ID NO: 88967 - protein, 10 aa, Dengue virus
HDLMELIDGI

SEQ ID NO: 88968 - protein, 10 aa, Dengue virus
DLMELIDGIS

SEQ ID NO: 88969 - protein, 10 aa, Dengue virus
LMELIDGISL

SEQ ID NO: 88970 - protein, 10 aa, Dengue virus
MELIDGISLG

SEQ ID NO: 88971 - protein, 10 aa, Dengue virus
ELIDGISLGL

SEQ ID NO: 88972 - protein, 10 aa, Dengue virus
LIDGISLGLI

SEQ ID NO: 88973 - protein, 10 aa, Dengue virus
IDGISLGLIL

SEQ ID NO: 88974 - protein, 10 aa, Dengue virus
DGISLGLILL

SEQ ID NO: 88975 - protein, 10 aa, Dengue virus
GISLGLILLK

SEQ ID NO: 88976 - protein, 10 aa, Dengue virus
ISLGLILLKI

SEQ ID NO: 88977 - protein, 10 aa, Dengue virus
SLGLILLKIV

SEQ ID NO: 88978 - protein, 10 aa, Dengue virus
LGLILLKIVT

SEQ ID NO: 88979 - protein, 10 aa, Dengue virus
GLILLKIVTQ

SEQ ID NO: 88980 - protein, 10 aa, Dengue virus
LILLKIVTQF

SEQ ID NO: 88981 - protein, 10 aa, Dengue virus
ILLKIVTQFD

SEQ ID NO: 88982 - protein, 10 aa, Dengue virus
VTQFDNTQVG

SEQ ID NO: 88983 - protein, 10 aa, Dengue virus
TQFDNTQVGT

SEQ ID NO: 88984 - protein, 10 aa, Dengue virus
QFDNTQVGTL

SEQ ID NO: 88985 - protein, 10 aa, Dengue virus
FDNTQVGTLA

SEQ ID NO: 88986 - protein, 10 aa, Dengue virus
DNTQVGTLAL

SEQ ID NO: 88987 - protein, 10 aa, Dengue virus
NTQVGTLALS

SEQ ID NO: 88988 - protein, 10 aa, Dengue virus
TQVGTLALSL

SEQ ID NO: 88989 - protein, 10 aa, Dengue virus
QVGTLALSLT

SEQ ID NO: 88990 - protein, 10 aa, Dengue virus
VGTLALSLTF

SEQ ID NO: 88991 - protein, 10 aa, Dengue virus
GTLALSLTFI

SEQ ID NO: 88992 - protein, 10 aa, Dengue virus
TLALSLTFIR

SEQ ID NO: 88993 - protein, 10 aa, Dengue virus
LALSLTFIRS

SEQ ID NO: 88994 - protein, 10 aa, Dengue virus
ALSLTFIRST

SEQ ID NO: 88995 - protein, 10 aa, Dengue virus
SLVMAWRTIM

SEQ ID NO: 88996 - protein, 10 aa, Dengue virus
LVMAWRTIMA

SEQ ID NO: 88997 - protein, 10 aa, Dengue virus
VMAWRTIMAV

SEQ ID NO: 88998 - protein, 10 aa, Dengue virus
MAWRTIMAVL

SEQ ID NO: 88999 - protein, 10 aa, Dengue virus
AWRTIMAVLF

SEQ ID NO: 89000 - protein, 10 aa, Dengue virus
WRTIMAVLFV

SEQ ID NO: 89001 - protein, 10 aa, Dengue virus
RTIMAVLFVV

SEQ ID NO: 89002 - protein, 10 aa, Dengue virus
TIMAVLFVVT

SEQ ID NO: 89003 - protein, 10 aa, Dengue virus
IMAVLFVVTL

SEQ ID NO: 89004 - protein, 10 aa, Dengue virus
MAVLFVVTLI

SEQ ID NO: 89005 - protein, 10 aa, Dengue virus
AVLFVVTLIP

SEQ ID NO: 89006 - protein, 10 aa, Dengue virus
VLFVVTLIPL

SEQ ID NO: 89007 - protein, 10 aa, Dengue virus
LFVVTLIPLC

SEQ ID NO: 89008 - protein, 10 aa, Dengue virus
FVVTLIPLCR

SEQ ID NO: 89009 - protein, 10 aa, Dengue virus
VVTLIPLCRT

SEQ ID NO: 89010 - protein, 10 aa, Dengue virus
VTLIPLCRTS

SEQ ID NO: 89011 - protein, 10 aa, Dengue virus
TLIPLCRTSC

SEQ ID NO: 89012 - protein, 10 aa, Dengue virus
LIPLCRTSCL

SEQ ID NO: 89013 - protein, 10 aa, Dengue virus
IPLCRTSCLQ

SEQ ID NO: 89014 - protein, 10 aa, Dengue virus
PLCRTSCLQK

SEQ ID NO: 89015 - protein, 10 aa, Dengue virus
LCRTSCLQKQ

SEQ ID NO: 89016 - protein, 10 aa, Dengue virus
CRTSCLQKQS

SEQ ID NO: 89017 - protein, 10 aa, Dengue virus
RTSCLQKQSH

SEQ ID NO: 89018 - protein, 10 aa, Dengue virus
TSCLQKQSHW

SEQ ID NO: 89019 - protein, 10 aa, Dengue virus
SCLQKQSHWV

SEQ ID NO: 89020 - protein, 10 aa, Dengue virus
CLQKQSHWVE

SEQ ID NO: 89021 - protein, 10 aa, Dengue virus
LQKQSHWVEI

SEQ ID NO: 89022 - protein, 10 aa, Dengue virus
QKQSHWVEIT

SEQ ID NO: 89023 - protein, 10 aa, Dengue virus
KQSHWVEITA

SEQ ID NO: 89024 - protein, 10 aa, Dengue virus
QSHWVEITAL

SEQ ID NO: 89025 - protein, 10 aa, Dengue virus
SHWVEITALI

SEQ ID NO: 89026 - protein, 10 aa, Dengue virus
HWVEITALIL

SEQ ID NO: 89027 - protein, 10 aa, Dengue virus
WVEITALILG

SEQ ID NO: 89028 - protein, 10 aa, Dengue virus
VEITALILGA

SEQ ID NO: 89029 - protein, 10 aa, Dengue virus
EITALILGAQ

SEQ ID NO: 89030 - protein, 10 aa, Dengue virus
ITALILGAQA

SEQ ID NO: 89031 - protein, 10 aa, Dengue virus
TALILGAQAL

SEQ ID NO: 89032 - protein, 10 aa, Dengue virus
ALILGAQALP

SEQ ID NO: 89033 - protein, 10 aa, Dengue virus
LILGAQALPV

SEQ ID NO: 89034 - protein, 10 aa, Dengue virus
ILGAQALPVY

SEQ ID NO: 89035 - protein, 10 aa, Dengue virus
LGAQALPVYL

SEQ ID NO: 89036 - protein, 10 aa, Dengue virus
GAQALPVYLM

SEQ ID NO: 89037 - protein, 10 aa, Dengue virus
AQALPVYLMT

SEQ ID NO: 89038 - protein, 10 aa, Dengue virus
QALPVYLMTL

SEQ ID NO: 89039 - protein, 10 aa, Dengue virus
ALPVYLMTLM

SEQ ID NO: 89040 - protein, 10 aa, Dengue virus
LPVYLMTLMK

SEQ ID NO: 89041 - protein, 10 aa, Dengue virus
PVYLMTLMKG

SEQ ID NO: 89042 - protein, 10 aa, Dengue virus
VYLMTLMKGA

SEQ ID NO: 89043 - protein, 10 aa, Dengue virus
YLMTLMKGAS

SEQ ID NO: 89044 - protein, 10 aa, Dengue virus
LMTLMKGASR

SEQ ID NO: 89045 - protein, 10 aa, Dengue virus
MTLMKGASRR

SEQ ID NO: 89046 - protein, 10 aa, Dengue virus
TLMKGASRRS

SEQ ID NO: 89047 - protein, 10 aa, Dengue virus
LMKGASRRSW

SEQ ID NO: 89048 - protein, 10 aa, Dengue virus
MKGASRRSWP

SEQ ID NO: 89049 - protein, 10 aa, Dengue virus
KGASRRSWPL

SEQ ID NO: 89050 - protein, 10 aa, Dengue virus
GASRRSWPLN

SEQ ID NO: 89051 - protein, 10 aa, Dengue virus
ASRRSWPLNE

SEQ ID NO: 89052 - protein, 10 aa, Dengue virus
SRRSWPLNEG

SEQ ID NO: 89053 - protein, 10 aa, Dengue virus
RRSWPLNEGI

SEQ ID NO: 89054 - protein, 10 aa, Dengue virus
RSWPLNEGIM

SEQ ID NO: 89055 - protein, 10 aa, Dengue virus
SWPLNEGIMA

SEQ ID NO: 89056 - protein, 10 aa, Dengue virus
WPLNEGIMAV

SEQ ID NO: 89057 - protein, 10 aa, Dengue virus
PLNEGIMAVG

SEQ ID NO: 89058 - protein, 10 aa, Dengue virus
LNEGIMAVGL

SEQ ID NO: 89059 - protein, 10 aa, Dengue virus
NEGIMAVGLV

SEQ ID NO: 89060 - protein, 10 aa, Dengue virus
EGIMAVGLVS

SEQ ID NO: 89061 - protein, 10 aa, Dengue virus
GIMAVGLVSL

SEQ ID NO: 89062 - protein, 10 aa, Dengue virus
IMAVGLVSLL

SEQ ID NO: 89063 - protein, 10 aa, Dengue virus
MAVGLVSLLG

SEQ ID NO: 89064 - protein, 10 aa, Dengue virus
AVGLVSLLGS

SEQ ID NO: 89065 - protein, 10 aa, Dengue virus
VGLVSLLGSA

SEQ ID NO: 89066 - protein, 10 aa, Dengue virus
GLVSLLGSAL

SEQ ID NO: 89067 - protein, 10 aa, Dengue virus
LVSLLGSALL

SEQ ID NO: 89068 - protein, 10 aa, Dengue virus
VSLLGSALLK

SEQ ID NO: 89069 - protein, 10 aa, Dengue virus
SLLGSALLKN

SEQ ID NO: 89070 - protein, 10 aa, Dengue virus
LLGSALLKND

SEQ ID NO: 89071 - protein, 10 aa, Dengue virus
LGSALLKNDV

SEQ ID NO: 89072 - protein, 10 aa, Dengue virus
GSALLKNDVP

SEQ ID NO: 89073 - protein, 10 aa, Dengue virus
SALLKNDVPL

SEQ ID NO: 89074 - protein, 10 aa, Dengue virus
ALLKNDVPLA

SEQ ID NO: 89075 - protein, 10 aa, Dengue virus
LLKNDVPLAG

SEQ ID NO: 89076 - protein, 10 aa, Dengue virus
LKNDVPLAGP

SEQ ID NO: 89077 - protein, 10 aa, Dengue virus
KNDVPLAGPM

SEQ ID NO: 89078 - protein, 10 aa, Dengue virus
NDVPLAGPMV

SEQ ID NO: 89079 - protein, 10 aa, Dengue virus
DVPLAGPMVA

SEQ ID NO: 89080 - protein, 10 aa, Dengue virus
VPLAGPMVAG

SEQ ID NO: 89081 - protein, 10 aa, Dengue virus
PLAGPMVAGG

SEQ ID NO: 89082 - protein, 10 aa, Dengue virus
LAGPMVAGGL

SEQ ID NO: 89083 - protein, 10 aa, Dengue virus
AGPMVAGGLL

SEQ ID NO: 89084 - protein, 10 aa, Dengue virus
GPMVAGGLLL

SEQ ID NO: 89085 - protein, 10 aa, Dengue virus
PMVAGGLLLA

SEQ ID NO: 89086 - protein, 10 aa, Dengue virus
MVAGGLLLAA

SEQ ID NO: 89087 - protein, 10 aa, Dengue virus
VAGGLLLAAY

SEQ ID NO: 89088 - protein, 10 aa, Dengue virus
AGGLLLAAYV

SEQ ID NO: 89089 - protein, 10 aa, Dengue virus
GGLLLAAYVM

SEQ ID NO: 89090 - protein, 10 aa, Dengue virus
GLLLAAYVMS

SEQ ID NO: 89091 - protein, 10 aa, Dengue virus
LLLAAYVMSG

SEQ ID NO: 89092 - protein, 10 aa, Dengue virus
LLAAYVMSGS

SEQ ID NO: 89093 - protein, 10 aa, Dengue virus
LAAYVMSGSS

SEQ ID NO: 89094 - protein, 10 aa, Dengue virus
AAYVMSGSSA

SEQ ID NO: 89095 - protein, 10 aa, Dengue virus
AYVMSGSSAD

SEQ ID NO: 89096 - protein, 10 aa, Dengue virus
YVMSGSSADL

SEQ ID NO: 89097 - protein, 10 aa, Dengue virus
VMSGSSADLS

SEQ ID NO: 89098 - protein, 10 aa, Dengue virus
MSGSSADLSL

SEQ ID NO: 89099 - protein, 10 aa, Dengue virus
SGSSADLSLE

SEQ ID NO: 89100 - protein, 10 aa, Dengue virus
GSSADLSLEK

SEQ ID NO: 89101 - protein, 10 aa, Dengue virus
SSADLSLEKA

SEQ ID NO: 89102 - protein, 10 aa, Dengue virus
SADLSLEKAA

SEQ ID NO: 89103 - protein, 10 aa, Dengue virus
ADLSLEKAAN

SEQ ID NO: 89104 - protein, 10 aa, Dengue virus
DLSLEKAANV

SEQ ID NO: 89105 - protein, 10 aa, Dengue virus
LSLEKAANVQ

SEQ ID NO: 89106 - protein, 10 aa, Dengue virus
SLEKAANVQW

SEQ ID NO: 89107 - protein, 10 aa, Dengue virus
LEKAANVQWD

SEQ ID NO: 89108 - protein, 10 aa, Dengue virus
EKAANVQWDE

SEQ ID NO: 89109 - protein, 10 aa, Dengue virus
KAANVQWDEM

SEQ ID NO: 89110 - protein, 10 aa, Dengue virus
AANVQWDEMA

SEQ ID NO: 89111 - protein, 10 aa, Dengue virus
ANVQWDEMAD

SEQ ID NO: 89112 - protein, 10 aa, Dengue virus
NVQWDEMADI

SEQ ID NO: 89113 - protein, 10 aa, Dengue virus
VQWDEMADIT

SEQ ID NO: 89114 - protein, 10 aa, Dengue virus
QWDEMADITG

SEQ ID NO: 89115 - protein, 10 aa, Dengue virus
WDEMADITGS

SEQ ID NO: 89116 - protein, 10 aa, Dengue virus
DEMADITGSS

SEQ ID NO: 89117 - protein, 10 aa, Dengue virus
EMADITGSSP

SEQ ID NO: 89118 - protein, 10 aa, Dengue virus
MADITGSSPI

SEQ ID NO: 89119 - protein, 10 aa, Dengue virus
ADITGSSPII

SEQ ID NO: 89120 - protein, 10 aa, Dengue virus
DITGSSPIIE

SEQ ID NO: 89121 - protein, 10 aa, Dengue virus
ITGSSPIIEV

SEQ ID NO: 89122 - protein, 10 aa, Dengue virus
TGSSPIIEVK

SEQ ID NO: 89123 - protein, 10 aa, Dengue virus
GSSPIIEVKQ

SEQ ID NO: 89124 - protein, 10 aa, Dengue virus
SSPIIEVKQD

SEQ ID NO: 89125 - protein, 10 aa, Dengue virus
SPIIEVKQDE

SEQ ID NO: 89126 - protein, 10 aa, Dengue virus
PIIEVKQDED

SEQ ID NO: 89127 - protein, 10 aa, Dengue virus
IIEVKQDEDG

SEQ ID NO: 89128 - protein, 10 aa, Dengue virus
IEVKQDEDGS

SEQ ID NO: 89129 - protein, 10 aa, Dengue virus
EVKQDEDGSF

SEQ ID NO: 89130 - protein, 10 aa, Dengue virus
VKQDEDGSFS

SEQ ID NO: 89131 - protein, 10 aa, Dengue virus
KQDEDGSFSI

SEQ ID NO: 89132 - protein, 10 aa, Dengue virus
QDEDGSFSIR

SEQ ID NO: 89133 - protein, 10 aa, Dengue virus
DEDGSFSIRD

SEQ ID NO: 89134 - protein, 10 aa, Dengue virus
EDGSFSIRDV

SEQ ID NO: 89135 - protein, 10 aa, Dengue virus
DGSFSIRDVE

SEQ ID NO: 89136 - protein, 10 aa, Dengue virus
GSFSIRDVEE

SEQ ID NO: 89137 - protein, 10 aa, Dengue virus
SFSIRDVEET

SEQ ID NO: 89138 - protein, 10 aa, Dengue virus
FSIRDVEETN

SEQ ID NO: 89139 - protein, 10 aa, Dengue virus
SIRDVEETNM

SEQ ID NO: 89140 - protein, 10 aa, Dengue virus
IRDVEETNMI

SEQ ID NO: 89141 - protein, 10 aa, Dengue virus
RDVEETNMIT

SEQ ID NO: 89142 - protein, 10 aa, Dengue virus
DVEETNMITL

SEQ ID NO: 89143 - protein, 10 aa, Dengue virus
VEETNMITLL

SEQ ID NO: 89144 - protein, 10 aa, Dengue virus
EETNMITLLV

SEQ ID NO: 89145 - protein, 10 aa, Dengue virus
ETNMITLLVK

SEQ ID NO: 89146 - protein, 10 aa, Dengue virus
TNMITLLVKL

SEQ ID NO: 89147 - protein, 10 aa, Dengue virus
NMITLLVKLA

SEQ ID NO: 89148 - protein, 10 aa, Dengue virus
MITLLVKLAL

SEQ ID NO: 89149 - protein, 10 aa, Dengue virus
ITLLVKLALI

SEQ ID NO: 89150 - protein, 10 aa, Dengue virus
TLLVKLALIT

SEQ ID NO: 89151 - protein, 10 aa, Dengue virus
LLVKLALITV

SEQ ID NO: 89152 - protein, 10 aa, Dengue virus
LVKLALITVS

SEQ ID NO: 89153 - protein, 10 aa, Dengue virus
VKLALITVSG

SEQ ID NO: 89154 - protein, 10 aa, Dengue virus
KLALITVSGL

SEQ ID NO: 89155 - protein, 10 aa, Dengue virus
LALITVSGLY

SEQ ID NO: 89156 - protein, 10 aa, Dengue virus
ALITVSGLYP

SEQ ID NO: 89157 - protein, 10 aa, Dengue virus
LITVSGLYPL

SEQ ID NO: 89158 - protein, 10 aa, Dengue virus
ITVSGLYPLA

SEQ ID NO: 89159 - protein, 10 aa, Dengue virus
TVSGLYPLAI

SEQ ID NO: 89160 - protein, 10 aa, Dengue virus
VSGLYPLAIP

SEQ ID NO: 89161 - protein, 10 aa, Dengue virus
SGLYPLAIPV

SEQ ID NO: 89162 - protein, 10 aa, Dengue virus
GLYPLAIPVT

SEQ ID NO: 89163 - protein, 10 aa, Dengue virus
LYPLAIPVTM

SEQ ID NO: 89164 - protein, 10 aa, Dengue virus
YPLAIPVTMT

SEQ ID NO: 89165 - protein, 10 aa, Dengue virus
PLAIPVTMTL

SEQ ID NO: 89166 - protein, 10 aa, Dengue virus
LAIPVTMTLW

SEQ ID NO: 89167 - protein, 10 aa, Dengue virus
AIPVTMTLWY

SEQ ID NO: 89168 - protein, 10 aa, Dengue virus
IPVTMTLWYM

SEQ ID NO: 89169 - protein, 10 aa, Dengue virus
PVTMTLWYMW

SEQ ID NO: 89170 - protein, 10 aa, Dengue virus
VTMTLWYMWQ

SEQ ID NO: 89171 - protein, 10 aa, Dengue virus
TMTLWYMWQV

SEQ ID NO: 89172 - protein, 10 aa, Dengue virus
MTLWYMWQVK

SEQ ID NO: 89173 - protein, 10 aa, Dengue virus
TLWYMWQVKT

SEQ ID NO: 89174 - protein, 10 aa, Dengue virus
LWYMWQVKTQ

SEQ ID NO: 89175 - protein, 10 aa, Dengue virus
WYMWQVKTQR

SEQ ID NO: 89176 - protein, 10 aa, Dengue virus
YMWQVKTQRS

SEQ ID NO: 89177 - protein, 10 aa, Dengue virus
MWQVKTQRSG

SEQ ID NO: 89178 - protein, 10 aa, Dengue virus
WQVKTQRSGA

SEQ ID NO: 89179 - protein, 10 aa, Dengue virus
QVKTQRSGAL

SEQ ID NO: 89180 - protein, 10 aa, Dengue virus
VKTQRSGALW

SEQ ID NO: 89181 - protein, 10 aa, Dengue virus
KTQRSGALWD

SEQ ID NO: 89182 - protein, 10 aa, Dengue virus
TQRSGALWDV

SEQ ID NO: 89183 - protein, 10 aa, Dengue virus
QRSGALWDVP

SEQ ID NO: 89184 - protein, 10 aa, Dengue virus
RSGALWDVPS

SEQ ID NO: 89185 - protein, 10 aa, Dengue virus
SGALWDVPSP

SEQ ID NO: 89186 - protein, 10 aa, Dengue virus
GALWDVPSPA

SEQ ID NO: 89187 - protein, 10 aa, Dengue virus
ALWDVPSPAA

SEQ ID NO: 89188 - protein, 10 aa, Dengue virus
LWDVPSPAAT

SEQ ID NO: 89189 - protein, 10 aa, Dengue virus
WDVPSPAATQ

SEQ ID NO: 89190 - protein, 10 aa, Dengue virus
DVPSPAATQK

SEQ ID NO: 89191 - protein, 10 aa, Dengue virus
VPSPAATQKA

SEQ ID NO: 89192 - protein, 10 aa, Dengue virus
TQKAALSEGV

SEQ ID NO: 89193 - protein, 10 aa, Dengue virus
QKAALSEGVY

SEQ ID NO: 89194 - protein, 10 aa, Dengue virus
KAALSEGVYR

SEQ ID NO: 89195 - protein, 10 aa, Dengue virus
AALSEGVYRI

SEQ ID NO: 89196 - protein, 10 aa, Dengue virus
ALSEGVYRIM

SEQ ID NO: 89197 - protein, 10 aa, Dengue virus
LSEGVYRIMQ

SEQ ID NO: 89198 - protein, 10 aa, Dengue virus
SEGVYRIMQR

SEQ ID NO: 89199 - protein, 10 aa, Dengue virus
EGVYRIMQRG

SEQ ID NO: 89200 - protein, 10 aa, Dengue virus
GVYRIMQRGL

SEQ ID NO: 89201 - protein, 10 aa, Dengue virus
VYRIMQRGLF

SEQ ID NO: 89202 - protein, 10 aa, Dengue virus
YRIMQRGLFG

SEQ ID NO: 89203 - protein, 10 aa, Dengue virus
RIMQRGLFGK

SEQ ID NO: 89204 - protein, 10 aa, Dengue virus
IMQRGLFGKT

SEQ ID NO: 89205 - protein, 10 aa, Dengue virus
MQRGLFGKTQ

SEQ ID NO: 89206 - protein, 10 aa, Dengue virus
QRGLFGKTQV

SEQ ID NO: 89207 - protein, 10 aa, Dengue virus
RGLFGKTQVG

SEQ ID NO: 89208 - protein, 10 aa, Dengue virus
GLFGKTQVGV

SEQ ID NO: 89209 - protein, 10 aa, Dengue virus
LFGKTQVGVG

SEQ ID NO: 89210 - protein, 10 aa, Dengue virus
FGKTQVGVGI

SEQ ID NO: 89211 - protein, 10 aa, Dengue virus
GKTQVGVGIH

SEQ ID NO: 89212 - protein, 10 aa, Dengue virus
KTQVGVGIHM

SEQ ID NO: 89213 - protein, 10 aa, Dengue virus
TQVGVGIHME

SEQ ID NO: 89214 - protein, 10 aa, Dengue virus
QVGVGIHMEG

SEQ ID NO: 89215 - protein, 10 aa, Dengue virus
VGVGIHMEGV

SEQ ID NO: 89216 - protein, 10 aa, Dengue virus
GVGIHMEGVF

SEQ ID NO: 89217 - protein, 10 aa, Dengue virus
VGIHMEGVFH

SEQ ID NO: 89218 - protein, 10 aa, Dengue virus
GIHMEGVFHT

SEQ ID NO: 89219 - protein, 10 aa, Dengue virus
IHMEGVFHTM

SEQ ID NO: 89220 - protein, 10 aa, Dengue virus
HMEGVFHTMW

SEQ ID NO: 89221 - protein, 10 aa, Dengue virus
MEGVFHTMWH

SEQ ID NO: 89222 - protein, 10 aa, Dengue virus
EGVFHTMWHV

SEQ ID NO: 89223 - protein, 10 aa, Dengue virus
GVFHTMWHVT

SEQ ID NO: 89224 - protein, 10 aa, Dengue virus
VFHTMWHVTR

SEQ ID NO: 89225 - protein, 10 aa, Dengue virus
FHTMWHVTRG

SEQ ID NO: 89226 - protein, 10 aa, Dengue virus
HTMWHVTRGS

SEQ ID NO: 89227 - protein, 10 aa, Dengue virus
TMWHVTRGSV

SEQ ID NO: 89228 - protein, 10 aa, Dengue virus
MWHVTRGSVI

SEQ ID NO: 89229 - protein, 10 aa, Dengue virus
WHVTRGSVIC

SEQ ID NO: 89230 - protein, 10 aa, Dengue virus
HVTRGSVICH

SEQ ID NO: 89231 - protein, 10 aa, Dengue virus
VTRGSVICHE

SEQ ID NO: 89232 - protein, 10 aa, Dengue virus
TRGSVICHET

SEQ ID NO: 89233 - protein, 10 aa, Dengue virus
RGSVICHETG

SEQ ID NO: 89234 - protein, 10 aa, Dengue virus
GSVICHETGR

SEQ ID NO: 89235 - protein, 10 aa, Dengue virus
SVICHETGRL

SEQ ID NO: 89236 - protein, 10 aa, Dengue virus
VICHETGRLE

SEQ ID NO: 89237 - protein, 10 aa, Dengue virus
ICHETGRLEP

SEQ ID NO: 89238 - protein, 10 aa, Dengue virus
CHETGRLEPS

SEQ ID NO: 89239 - protein, 10 aa, Dengue virus
HETGRLEPSW

SEQ ID NO: 89240 - protein, 10 aa, Dengue virus
ETGRLEPSWA

SEQ ID NO: 89241 - protein, 10 aa, Dengue virus
TGRLEPSWAD

SEQ ID NO: 89242 - protein, 10 aa, Dengue virus
GRLEPSWADV

SEQ ID NO: 89243 - protein, 10 aa, Dengue virus
RLEPSWADVR

SEQ ID NO: 89244 - protein, 10 aa, Dengue virus
LEPSWADVRN

SEQ ID NO: 89245 - protein, 10 aa, Dengue virus
EPSWADVRND

SEQ ID NO: 89246 - protein, 10 aa, Dengue virus
PSWADVRNDM

SEQ ID NO: 89247 - protein, 10 aa, Dengue virus
SWADVRNDMI

SEQ ID NO: 89248 - protein, 10 aa, Dengue virus
WADVRNDMIS

SEQ ID NO: 89249 - protein, 10 aa, Dengue virus
ADVRNDMISY

SEQ ID NO: 89250 - protein, 10 aa, Dengue virus
DVRNDMISYG

SEQ ID NO: 89251 - protein, 10 aa, Dengue virus
VRNDMISYGG

SEQ ID NO: 89252 - protein, 10 aa, Dengue virus
RNDMISYGGG

SEQ ID NO: 89253 - protein, 10 aa, Dengue virus
NDMISYGGGW

SEQ ID NO: 89254 - protein, 10 aa, Dengue virus
DMISYGGGWR

SEQ ID NO: 89255 - protein, 10 aa, Dengue virus
MISYGGGWRL

SEQ ID NO: 89256 - protein, 10 aa, Dengue virus
ISYGGGWRLG

SEQ ID NO: 89257 - protein, 10 aa, Dengue virus
SYGGGWRLGD

SEQ ID NO: 89258 - protein, 10 aa, Dengue virus
YGGGWRLGDK

SEQ ID NO: 89259 - protein, 10 aa, Dengue virus
GGGWRLGDKW

SEQ ID NO: 89260 - protein, 10 aa, Dengue virus
GGWRLGDKWD

SEQ ID NO: 89261 - protein, 10 aa, Dengue virus
GWRLGDKWDK

SEQ ID NO: 89262 - protein, 10 aa, Dengue virus
WRLGDKWDKE

SEQ ID NO: 89263 - protein, 10 aa, Dengue virus
RLGDKWDKEE

SEQ ID NO: 89264 - protein, 10 aa, Dengue virus
LGDKWDKEED

SEQ ID NO: 89265 - protein, 10 aa, Dengue virus
GDKWDKEEDV

SEQ ID NO: 89266 - protein, 10 aa, Dengue virus
DKWDKEEDVQ

SEQ ID NO: 89267 - protein, 10 aa, Dengue virus
KWDKEEDVQV

SEQ ID NO: 89268 - protein, 10 aa, Dengue virus
WDKEEDVQVL

SEQ ID NO: 89269 - protein, 10 aa, Dengue virus
DKEEDVQVLA

SEQ ID NO: 89270 - protein, 10 aa, Dengue virus
KEEDVQVLAI

SEQ ID NO: 89271 - protein, 10 aa, Dengue virus
EEDVQVLAIE

SEQ ID NO: 89272 - protein, 10 aa, Dengue virus
EDVQVLAIEP

SEQ ID NO: 89273 - protein, 10 aa, Dengue virus
DVQVLAIEPG

SEQ ID NO: 89274 - protein, 10 aa, Dengue virus
VQVLAIEPGK

SEQ ID NO: 89275 - protein, 10 aa, Dengue virus
QVLAIEPGKN

SEQ ID NO: 89276 - protein, 10 aa, Dengue virus
VLAIEPGKNP

SEQ ID NO: 89277 - protein, 10 aa, Dengue virus
LAIEPGKNPK

SEQ ID NO: 89278 - protein, 10 aa, Dengue virus
AIEPGKNPKH

SEQ ID NO: 89279 - protein, 10 aa, Dengue virus
IEPGKNPKHV

SEQ ID NO: 89280 - protein, 10 aa, Dengue virus
EPGKNPKHVQ

SEQ ID NO: 89281 - protein, 10 aa, Dengue virus
PGKNPKHVQT

SEQ ID NO: 89282 - protein, 10 aa, Dengue virus
GKNPKHVQTK

SEQ ID NO: 89283 - protein, 10 aa, Dengue virus
KNPKHVQTKP

SEQ ID NO: 89284 - protein, 10 aa, Dengue virus
NPKHVQTKPG

SEQ ID NO: 89285 - protein, 10 aa, Dengue virus
PKHVQTKPGL

SEQ ID NO: 89286 - protein, 10 aa, Dengue virus
KHVQTKPGLF

SEQ ID NO: 89287 - protein, 10 aa, Dengue virus
HVQTKPGLFK

SEQ ID NO: 89288 - protein, 10 aa, Dengue virus
VQTKPGLFKT

SEQ ID NO: 89289 - protein, 10 aa, Dengue virus
QTKPGLFKTL

SEQ ID NO: 89290 - protein, 10 aa, Dengue virus
TKPGLFKTLT

SEQ ID NO: 89291 - protein, 10 aa, Dengue virus
KPGLFKTLTG

SEQ ID NO: 89292 - protein, 10 aa, Dengue virus
PGLFKTLTGE

SEQ ID NO: 89293 - protein, 10 aa, Dengue virus
GLFKTLTGEI

SEQ ID NO: 89294 - protein, 10 aa, Dengue virus
LFKTLTGEIG

SEQ ID NO: 89295 - protein, 10 aa, Dengue virus
FKTLTGEIGA

SEQ ID NO: 89296 - protein, 10 aa, Dengue virus
KTLTGEIGAV

SEQ ID NO: 89297 - protein, 10 aa, Dengue virus
TLTGEIGAVT

SEQ ID NO: 89298 - protein, 10 aa, Dengue virus
LTGEIGAVTL

SEQ ID NO: 89299 - protein, 10 aa, Dengue virus
TGEIGAVTLD

SEQ ID NO: 89300 - protein, 10 aa, Dengue virus
GEIGAVTLDF

SEQ ID NO: 89301 - protein, 10 aa, Dengue virus
EIGAVTLDFK

SEQ ID NO: 89302 - protein, 10 aa, Dengue virus
IGAVTLDFKP

SEQ ID NO: 89303 - protein, 10 aa, Dengue virus
GAVTLDFKPG

SEQ ID NO: 89304 - protein, 10 aa, Dengue virus
AVTLDFKPGT

SEQ ID NO: 89305 - protein, 10 aa, Dengue virus
VTLDFKPGTS

SEQ ID NO: 89306 - protein, 10 aa, Dengue virus
TLDFKPGTSG

SEQ ID NO: 89307 - protein, 10 aa, Dengue virus
LDFKPGTSGS

SEQ ID NO: 89308 - protein, 10 aa, Dengue virus
DFKPGTSGSP

SEQ ID NO: 89309 - protein, 10 aa, Dengue virus
FKPGTSGSPI

SEQ ID NO: 89310 - protein, 10 aa, Dengue virus
KPGTSGSPII

SEQ ID NO: 89311 - protein, 10 aa, Dengue virus
PGTSGSPIIN

SEQ ID NO: 89312 - protein, 10 aa, Dengue virus
GTSGSPIINR

SEQ ID NO: 89313 - protein, 10 aa, Dengue virus
TSGSPIINRK

SEQ ID NO: 89314 - protein, 10 aa, Dengue virus
SGSPIINRKG

SEQ ID NO: 89315 - protein, 10 aa, Dengue virus
GSPIINRKGK

SEQ ID NO: 89316 - protein, 10 aa, Dengue virus
SPIINRKGKV

SEQ ID NO: 89317 - protein, 10 aa, Dengue virus
PIINRKGKVI

SEQ ID NO: 89318 - protein, 10 aa, Dengue virus
IINRKGKVIG

SEQ ID NO: 89319 - protein, 10 aa, Dengue virus
INRKGKVIGL

SEQ ID NO: 89320 - protein, 10 aa, Dengue virus
NRKGKVIGLY

SEQ ID NO: 89321 - protein, 10 aa, Dengue virus
RKGKVIGLYG

SEQ ID NO: 89322 - protein, 10 aa, Dengue virus
KGKVIGLYGN

SEQ ID NO: 89323 - protein, 10 aa, Dengue virus
GKVIGLYGNG

SEQ ID NO: 89324 - protein, 10 aa, Dengue virus
KVIGLYGNGV

SEQ ID NO: 89325 - protein, 10 aa, Dengue virus
VIGLYGNGVV

SEQ ID NO: 89326 - protein, 10 aa, Dengue virus
IGLYGNGVVT

SEQ ID NO: 89327 - protein, 10 aa, Dengue virus
GLYGNGVVTK

SEQ ID NO: 89328 - protein, 10 aa, Dengue virus
LYGNGVVTKS

SEQ ID NO: 89329 - protein, 10 aa, Dengue virus
YGNGVVTKSG

SEQ ID NO: 89330 - protein, 10 aa, Dengue virus
GNGVVTKSGD

SEQ ID NO: 89331 - protein, 10 aa, Dengue virus
NGVVTKSGDY

SEQ ID NO: 89332 - protein, 10 aa, Dengue virus
GVVTKSGDYV

SEQ ID NO: 89333 - protein, 10 aa, Dengue virus
VVTKSGDYVS

SEQ ID NO: 89334 - protein, 10 aa, Dengue virus
VTKSGDYVSA

SEQ ID NO: 89335 - protein, 10 aa, Dengue virus
TKSGDYVSAI

SEQ ID NO: 89336 - protein, 10 aa, Dengue virus
KSGDYVSAIT

SEQ ID NO: 89337 - protein, 10 aa, Dengue virus
SGDYVSAITQ

SEQ ID NO: 89338 - protein, 10 aa, Dengue virus
GDYVSAITQA

SEQ ID NO: 89339 - protein, 10 aa, Dengue virus
DYVSAITQAE

SEQ ID NO: 89340 - protein, 10 aa, Dengue virus
YVSAITQAER

SEQ ID NO: 89341 - protein, 10 aa, Dengue virus
VSAITQAERI

SEQ ID NO: 89342 - protein, 10 aa, Dengue virus
SAITQAERIG

SEQ ID NO: 89343 - protein, 10 aa, Dengue virus
AITQAERIGE

SEQ ID NO: 89344 - protein, 10 aa, Dengue virus
ITQAERIGEP

SEQ ID NO: 89345 - protein, 10 aa, Dengue virus
TQAERIGEPD

SEQ ID NO: 89346 - protein, 10 aa, Dengue virus
QAERIGEPDY

SEQ ID NO: 89347 - protein, 10 aa, Dengue virus
AERIGEPDYE

SEQ ID NO: 89348 - protein, 10 aa, Dengue virus
ERIGEPDYEV

SEQ ID NO: 89349 - protein, 10 aa, Dengue virus
RIGEPDYEVD

SEQ ID NO: 89350 - protein, 10 aa, Dengue virus
IGEPDYEVDE

SEQ ID NO: 89351 - protein, 10 aa, Dengue virus
GEPDYEVDED

SEQ ID NO: 89352 - protein, 10 aa, Dengue virus
EPDYEVDEDI

SEQ ID NO: 89353 - protein, 10 aa, Dengue virus
PDYEVDEDIF

SEQ ID NO: 89354 - protein, 10 aa, Dengue virus
DYEVDEDIFR

SEQ ID NO: 89355 - protein, 10 aa, Dengue virus
YEVDEDIFRK

SEQ ID NO: 89356 - protein, 10 aa, Dengue virus
EVDEDIFRKK

SEQ ID NO: 89357 - protein, 10 aa, Dengue virus
VDEDIFRKKR

SEQ ID NO: 89358 - protein, 10 aa, Dengue virus
DEDIFRKKRL

SEQ ID NO: 89359 - protein, 10 aa, Dengue virus
EDIFRKKRLT

SEQ ID NO: 89360 - protein, 10 aa, Dengue virus
DIFRKKRLTI

SEQ ID NO: 89361 - protein, 10 aa, Dengue virus
IFRKKRLTIM

SEQ ID NO: 89362 - protein, 10 aa, Dengue virus
FRKKRLTIMD

SEQ ID NO: 89363 - protein, 10 aa, Dengue virus
RKKRLTIMDL

SEQ ID NO: 89364 - protein, 10 aa, Dengue virus
KKRLTIMDLH

SEQ ID NO: 89365 - protein, 10 aa, Dengue virus
KRLTIMDLHP

SEQ ID NO: 89366 - protein, 10 aa, Dengue virus
RLTIMDLHPG

SEQ ID NO: 89367 - protein, 10 aa, Dengue virus
LTIMDLHPGA

SEQ ID NO: 89368 - protein, 10 aa, Dengue virus
TIMDLHPGAG

SEQ ID NO: 89369 - protein, 10 aa, Dengue virus
IMDLHPGAGK

SEQ ID NO: 89370 - protein, 10 aa, Dengue virus
MDLHPGAGKT

SEQ ID NO: 89371 - protein, 10 aa, Dengue virus
DLHPGAGKTK

SEQ ID NO: 89372 - protein, 10 aa, Dengue virus
LHPGAGKTKR

SEQ ID NO: 89373 - protein, 10 aa, Dengue virus
HPGAGKTKRI

SEQ ID NO: 89374 - protein, 10 aa, Dengue virus
PGAGKTKRIL

SEQ ID NO: 89375 - protein, 10 aa, Dengue virus
GAGKTKRILP

SEQ ID NO: 89376 - protein, 10 aa, Dengue virus
AGKTKRILPS

SEQ ID NO: 89377 - protein, 10 aa, Dengue virus
GKTKRILPSI

SEQ ID NO: 89378 - protein, 10 aa, Dengue virus
KTKRILPSIV

SEQ ID NO: 89379 - protein, 10 aa, Dengue virus
TKRILPSIVR

SEQ ID NO: 89380 - protein, 10 aa, Dengue virus
KRILPSIVRE

SEQ ID NO: 89381 - protein, 10 aa, Dengue virus
RILPSIVREA

SEQ ID NO: 89382 - protein, 10 aa, Dengue virus
ILPSIVREAL

SEQ ID NO: 89383 - protein, 10 aa, Dengue virus
LPSIVREALK

SEQ ID NO: 89384 - protein, 10 aa, Dengue virus
PSIVREALKR

SEQ ID NO: 89385 - protein, 10 aa, Dengue virus
SIVREALKRR

SEQ ID NO: 89386 - protein, 10 aa, Dengue virus
IVREALKRRL

SEQ ID NO: 89387 - protein, 10 aa, Dengue virus
VREALKRRLR

SEQ ID NO: 89388 - protein, 10 aa, Dengue virus
REALKRRLRT

SEQ ID NO: 89389 - protein, 10 aa, Dengue virus
EALKRRLRTL

SEQ ID NO: 89390 - protein, 10 aa, Dengue virus
ALKRRLRTLI

SEQ ID NO: 89391 - protein, 10 aa, Dengue virus
LKRRLRTLIL

SEQ ID NO: 89392 - protein, 10 aa, Dengue virus
KRRLRTLILA

SEQ ID NO: 89393 - protein, 10 aa, Dengue virus
RRLRTLILAP

SEQ ID NO: 89394 - protein, 10 aa, Dengue virus
RLRTLILAPT

SEQ ID NO: 89395 - protein, 10 aa, Dengue virus
LRTLILAPTR

SEQ ID NO: 89396 - protein, 10 aa, Dengue virus
RTLILAPTRV

SEQ ID NO: 89397 - protein, 10 aa, Dengue virus
TLILAPTRVV

SEQ ID NO: 89398 - protein, 10 aa, Dengue virus
LILAPTRVVA

SEQ ID NO: 89399 - protein, 10 aa, Dengue virus
ILAPTRVVAA

SEQ ID NO: 89400 - protein, 10 aa, Dengue virus
LAPTRVVAAE

SEQ ID NO: 89401 - protein, 10 aa, Dengue virus
APTRVVAAEM

SEQ ID NO: 89402 - protein, 10 aa, Dengue virus
PTRVVAAEME

SEQ ID NO: 89403 - protein, 10 aa, Dengue virus
TRVVAAEMEE

SEQ ID NO: 89404 - protein, 10 aa, Dengue virus
RVVAAEMEEA

SEQ ID NO: 89405 - protein, 10 aa, Dengue virus
VVAAEMEEAL

SEQ ID NO: 89406 - protein, 10 aa, Dengue virus
VAAEMEEALR

SEQ ID NO: 89407 - protein, 10 aa, Dengue virus
AAEMEEALRG

SEQ ID NO: 89408 - protein, 10 aa, Dengue virus
AEMEEALRGL

SEQ ID NO: 89409 - protein, 10 aa, Dengue virus
EMEEALRGLP

SEQ ID NO: 89410 - protein, 10 aa, Dengue virus
MEEALRGLPI

SEQ ID NO: 89411 - protein, 10 aa, Dengue virus
EEALRGLPIR

SEQ ID NO: 89412 - protein, 10 aa, Dengue virus
EALRGLPIRY

SEQ ID NO: 89413 - protein, 10 aa, Dengue virus
ALRGLPIRYQ

SEQ ID NO: 89414 - protein, 10 aa, Dengue virus
LRGLPIRYQT

SEQ ID NO: 89415 - protein, 10 aa, Dengue virus
RGLPIRYQTP

SEQ ID NO: 89416 - protein, 10 aa, Dengue virus
GLPIRYQTPA

SEQ ID NO: 89417 - protein, 10 aa, Dengue virus
LPIRYQTPAV

SEQ ID NO: 89418 - protein, 10 aa, Dengue virus
PIRYQTPAVK

SEQ ID NO: 89419 - protein, 10 aa, Dengue virus
IRYQTPAVKS

SEQ ID NO: 89420 - protein, 10 aa, Dengue virus
RYQTPAVKSE

SEQ ID NO: 89421 - protein, 10 aa, Dengue virus
YQTPAVKSEH

SEQ ID NO: 89422 - protein, 10 aa, Dengue virus
QTPAVKSEHT

SEQ ID NO: 89423 - protein, 10 aa, Dengue virus
TPAVKSEHTG

SEQ ID NO: 89424 - protein, 10 aa, Dengue virus
PAVKSEHTGR

SEQ ID NO: 89425 - protein, 10 aa, Dengue virus
AVKSEHTGRE

SEQ ID NO: 89426 - protein, 10 aa, Dengue virus
VKSEHTGREI

SEQ ID NO: 89427 - protein, 10 aa, Dengue virus
KSEHTGREIV

SEQ ID NO: 89428 - protein, 10 aa, Dengue virus
SEHTGREIVD

SEQ ID NO: 89429 - protein, 10 aa, Dengue virus
EHTGREIVDL

SEQ ID NO: 89430 - protein, 10 aa, Dengue virus
HTGREIVDLM

SEQ ID NO: 89431 - protein, 10 aa, Dengue virus
TGREIVDLMC

SEQ ID NO: 89432 - protein, 10 aa, Dengue virus
GREIVDLMCH

SEQ ID NO: 89433 - protein, 10 aa, Dengue virus
REIVDLMCHA

SEQ ID NO: 89434 - protein, 10 aa, Dengue virus
EIVDLMCHAT

SEQ ID NO: 89435 - protein, 10 aa, Dengue virus
IVDLMCHATF

SEQ ID NO: 89436 - protein, 10 aa, Dengue virus
VDLMCHATFT

SEQ ID NO: 89437 - protein, 10 aa, Dengue virus
DLMCHATFTT

SEQ ID NO: 89438 - protein, 10 aa, Dengue virus
LMCHATFTTR

SEQ ID NO: 89439 - protein, 10 aa, Dengue virus
MCHATFTTRL

SEQ ID NO: 89440 - protein, 10 aa, Dengue virus
CHATFTTRLL

SEQ ID NO: 89441 - protein, 10 aa, Dengue virus
HATFTTRLLS

SEQ ID NO: 89442 - protein, 10 aa, Dengue virus
ATFTTRLLSS

SEQ ID NO: 89443 - protein, 10 aa, Dengue virus
TFTTRLLSST

SEQ ID NO: 89444 - protein, 10 aa, Dengue virus
FTTRLLSSTR

SEQ ID NO: 89445 - protein, 10 aa, Dengue virus
TTRLLSSTRV

SEQ ID NO: 89446 - protein, 10 aa, Dengue virus
TRLLSSTRVP

SEQ ID NO: 89447 - protein, 10 aa, Dengue virus
RLLSSTRVPN

SEQ ID NO: 89448 - protein, 10 aa, Dengue virus
LLSSTRVPNY

SEQ ID NO: 89449 - protein, 10 aa, Dengue virus
LSSTRVPNYN

SEQ ID NO: 89450 - protein, 10 aa, Dengue virus
SSTRVPNYNL

SEQ ID NO: 89451 - protein, 10 aa, Dengue virus
STRVPNYNLI

SEQ ID NO: 89452 - protein, 10 aa, Dengue virus
TRVPNYNLIV

SEQ ID NO: 89453 - protein, 10 aa, Dengue virus
RVPNYNLIVM

SEQ ID NO: 89454 - protein, 10 aa, Dengue virus
VPNYNLIVMD

SEQ ID NO: 89455 - protein, 10 aa, Dengue virus
PNYNLIVMDE

SEQ ID NO: 89456 - protein, 10 aa, Dengue virus
NYNLIVMDEA

SEQ ID NO: 89457 - protein, 10 aa, Dengue virus
YNLIVMDEAH

SEQ ID NO: 89458 - protein, 10 aa, Dengue virus
NLIVMDEAHF

SEQ ID NO: 89459 - protein, 10 aa, Dengue virus
LIVMDEAHFT

SEQ ID NO: 89460 - protein, 10 aa, Dengue virus
IVMDEAHFTD

SEQ ID NO: 89461 - protein, 10 aa, Dengue virus
VMDEAHFTDP

SEQ ID NO: 89462 - protein, 10 aa, Dengue virus
MDEAHFTDPS

SEQ ID NO: 89463 - protein, 10 aa, Dengue virus
DEAHFTDPSS

SEQ ID NO: 89464 - protein, 10 aa, Dengue virus
EAHFTDPSSV

SEQ ID NO: 89465 - protein, 10 aa, Dengue virus
AHFTDPSSVA

SEQ ID NO: 89466 - protein, 10 aa, Dengue virus
HFTDPSSVAA

SEQ ID NO: 89467 - protein, 10 aa, Dengue virus
FTDPSSVAAR

SEQ ID NO: 89468 - protein, 10 aa, Dengue virus
TDPSSVAARG

SEQ ID NO: 89469 - protein, 10 aa, Dengue virus
DPSSVAARGY

SEQ ID NO: 89470 - protein, 10 aa, Dengue virus
PSSVAARGYI

SEQ ID NO: 89471 - protein, 10 aa, Dengue virus
SSVAARGYIS

SEQ ID NO: 89472 - protein, 10 aa, Dengue virus
SVAARGYIST

SEQ ID NO: 89473 - protein, 10 aa, Dengue virus
VAARGYISTR

SEQ ID NO: 89474 - protein, 10 aa, Dengue virus
AARGYISTRV

SEQ ID NO: 89475 - protein, 10 aa, Dengue virus
ARGYISTRVE

SEQ ID NO: 89476 - protein, 10 aa, Dengue virus
RGYISTRVEM

SEQ ID NO: 89477 - protein, 10 aa, Dengue virus
GYISTRVEMG

SEQ ID NO: 89478 - protein, 10 aa, Dengue virus
YISTRVEMGE

SEQ ID NO: 89479 - protein, 10 aa, Dengue virus
ISTRVEMGEA

SEQ ID NO: 89480 - protein, 10 aa, Dengue virus
STRVEMGEAA

SEQ ID NO: 89481 - protein, 10 aa, Dengue virus
TRVEMGEAAA

SEQ ID NO: 89482 - protein, 10 aa, Dengue virus
RVEMGEAAAI

SEQ ID NO: 89483 - protein, 10 aa, Dengue virus
VEMGEAAAIF

SEQ ID NO: 89484 - protein, 10 aa, Dengue virus
EMGEAAAIFM

SEQ ID NO: 89485 - protein, 10 aa, Dengue virus
MGEAAAIFMT

SEQ ID NO: 89486 - protein, 10 aa, Dengue virus
GEAAAIFMTA

SEQ ID NO: 89487 - protein, 10 aa, Dengue virus
EAAAIFMTAT

SEQ ID NO: 89488 - protein, 10 aa, Dengue virus
AAAIFMTATP

SEQ ID NO: 89489 - protein, 10 aa, Dengue virus
AAIFMTATPP

SEQ ID NO: 89490 - protein, 10 aa, Dengue virus
AIFMTATPPG

SEQ ID NO: 89491 - protein, 10 aa, Dengue virus
IFMTATPPGA

SEQ ID NO: 89492 - protein, 10 aa, Dengue virus
FMTATPPGAT

SEQ ID NO: 89493 - protein, 10 aa, Dengue virus
MTATPPGATD

SEQ ID NO: 89494 - protein, 10 aa, Dengue virus
TATPPGATDP

SEQ ID NO: 89495 - protein, 10 aa, Dengue virus
ATPPGATDPF

SEQ ID NO: 89496 - protein, 10 aa, Dengue virus
TPPGATDPFP

SEQ ID NO: 89497 - protein, 10 aa, Dengue virus
PPGATDPFPQ

SEQ ID NO: 89498 - protein, 10 aa, Dengue virus
PGATDPFPQS

SEQ ID NO: 89499 - protein, 10 aa, Dengue virus
GATDPFPQSN

SEQ ID NO: 89500 - protein, 10 aa, Dengue virus
ATDPFPQSNS

SEQ ID NO: 89501 - protein, 10 aa, Dengue virus
TDPFPQSNSP

SEQ ID NO: 89502 - protein, 10 aa, Dengue virus
DPFPQSNSPI

SEQ ID NO: 89503 - protein, 10 aa, Dengue virus
PFPQSNSPIE

SEQ ID NO: 89504 - protein, 10 aa, Dengue virus
FPQSNSPIED

SEQ ID NO: 89505 - protein, 10 aa, Dengue virus
PQSNSPIEDI

SEQ ID NO: 89506 - protein, 10 aa, Dengue virus
QSNSPIEDIE

SEQ ID NO: 89507 - protein, 10 aa, Dengue virus
SNSPIEDIER

SEQ ID NO: 89508 - protein, 10 aa, Dengue virus
NSPIEDIERE

SEQ ID NO: 89509 - protein, 10 aa, Dengue virus
SPIEDIEREI

SEQ ID NO: 89510 - protein, 10 aa, Dengue virus
PIEDIEREIP

SEQ ID NO: 89511 - protein, 10 aa, Dengue virus
IEDIEREIPE

SEQ ID NO: 89512 - protein, 10 aa, Dengue virus
EDIEREIPER

SEQ ID NO: 89513 - protein, 10 aa, Dengue virus
DIEREIPERS

SEQ ID NO: 89514 - protein, 10 aa, Dengue virus
IEREIPERSW

SEQ ID NO: 89515 - protein, 10 aa, Dengue virus
EREIPERSWN

SEQ ID NO: 89516 - protein, 10 aa, Dengue virus
REIPERSWNT

SEQ ID NO: 89517 - protein, 10 aa, Dengue virus
EIPERSWNTG

SEQ ID NO: 89518 - protein, 10 aa, Dengue virus
IPERSWNTGF

SEQ ID NO: 89519 - protein, 10 aa, Dengue virus
PERSWNTGFD

SEQ ID NO: 89520 - protein, 10 aa, Dengue virus
ERSWNTGFDW

SEQ ID NO: 89521 - protein, 10 aa, Dengue virus
RSWNTGFDWI

SEQ ID NO: 89522 - protein, 10 aa, Dengue virus
SWNTGFDWIT

SEQ ID NO: 89523 - protein, 10 aa, Dengue virus
WNTGFDWITD

SEQ ID NO: 89524 - protein, 10 aa, Dengue virus
NTGFDWITDY

SEQ ID NO: 89525 - protein, 10 aa, Dengue virus
TGFDWITDYQ

SEQ ID NO: 89526 - protein, 10 aa, Dengue virus
GFDWITDYQG

SEQ ID NO: 89527 - protein, 10 aa, Dengue virus
FDWITDYQGK

SEQ ID NO: 89528 - protein, 10 aa, Dengue virus
DWITDYQGKT

SEQ ID NO: 89529 - protein, 10 aa, Dengue virus
WITDYQGKTV

SEQ ID NO: 89530 - protein, 10 aa, Dengue virus
ITDYQGKTVW

SEQ ID NO: 89531 - protein, 10 aa, Dengue virus
TDYQGKTVWF

SEQ ID NO: 89532 - protein, 10 aa, Dengue virus
DYQGKTVWFV

SEQ ID NO: 89533 - protein, 10 aa, Dengue virus
YQGKTVWFVP

SEQ ID NO: 89534 - protein, 10 aa, Dengue virus
QGKTVWFVPS

SEQ ID NO: 89535 - protein, 10 aa, Dengue virus
GKTVWFVPSI

SEQ ID NO: 89536 - protein, 10 aa, Dengue virus
KTVWFVPSIK

SEQ ID NO: 89537 - protein, 10 aa, Dengue virus
TVWFVPSIKA

SEQ ID NO: 89538 - protein, 10 aa, Dengue virus
VWFVPSIKAG

SEQ ID NO: 89539 - protein, 10 aa, Dengue virus
WFVPSIKAGN

SEQ ID NO: 89540 - protein, 10 aa, Dengue virus
FVPSIKAGND

SEQ ID NO: 89541 - protein, 10 aa, Dengue virus
VPSIKAGNDI

SEQ ID NO: 89542 - protein, 10 aa, Dengue virus
PSIKAGNDIA

SEQ ID NO: 89543 - protein, 10 aa, Dengue virus
SIKAGNDIAN

SEQ ID NO: 89544 - protein, 10 aa, Dengue virus
IKAGNDIANC

SEQ ID NO: 89545 - protein, 10 aa, Dengue virus
KAGNDIANCL

SEQ ID NO: 89546 - protein, 10 aa, Dengue virus
AGNDIANCLR

SEQ ID NO: 89547 - protein, 10 aa, Dengue virus
GNDIANCLRK

SEQ ID NO: 89548 - protein, 10 aa, Dengue virus
NDIANCLRKS

SEQ ID NO: 89549 - protein, 10 aa, Dengue virus
DIANCLRKSG

SEQ ID NO: 89550 - protein, 10 aa, Dengue virus
IANCLRKSGK

SEQ ID NO: 89551 - protein, 10 aa, Dengue virus
ANCLRKSGKK

SEQ ID NO: 89552 - protein, 10 aa, Dengue virus
NCLRKSGKKV

SEQ ID NO: 89553 - protein, 10 aa, Dengue virus
CLRKSGKKVI

SEQ ID NO: 89554 - protein, 10 aa, Dengue virus
LRKSGKKVIQ

SEQ ID NO: 89555 - protein, 10 aa, Dengue virus
RKSGKKVIQL

SEQ ID NO: 89556 - protein, 10 aa, Dengue virus
KSGKKVIQLS

SEQ ID NO: 89557 - protein, 10 aa, Dengue virus
SGKKVIQLSR

SEQ ID NO: 89558 - protein, 10 aa, Dengue virus
GKKVIQLSRK

SEQ ID NO: 89559 - protein, 10 aa, Dengue virus
KKVIQLSRKT

SEQ ID NO: 89560 - protein, 10 aa, Dengue virus
KVIQLSRKTF

SEQ ID NO: 89561 - protein, 10 aa, Dengue virus
VIQLSRKTFD

SEQ ID NO: 89562 - protein, 10 aa, Dengue virus
IQLSRKTFDT

SEQ ID NO: 89563 - protein, 10 aa, Dengue virus
QLSRKTFDTE

SEQ ID NO: 89564 - protein, 10 aa, Dengue virus
LSRKTFDTEY

SEQ ID NO: 89565 - protein, 10 aa, Dengue virus
SRKTFDTEYP

SEQ ID NO: 89566 - protein, 10 aa, Dengue virus
RKTFDTEYPK

SEQ ID NO: 89567 - protein, 10 aa, Dengue virus
KTFDTEYPKT

SEQ ID NO: 89568 - protein, 10 aa, Dengue virus
TFDTEYPKTK

SEQ ID NO: 89569 - protein, 10 aa, Dengue virus
FDTEYPKTKL

SEQ ID NO: 89570 - protein, 10 aa, Dengue virus
DTEYPKTKLT

SEQ ID NO: 89571 - protein, 10 aa, Dengue virus
TEYPKTKLTD

SEQ ID NO: 89572 - protein, 10 aa, Dengue virus
EYPKTKLTDW

SEQ ID NO: 89573 - protein, 10 aa, Dengue virus
YPKTKLTDWD

SEQ ID NO: 89574 - protein, 10 aa, Dengue virus
PKTKLTDWDF

SEQ ID NO: 89575 - protein, 10 aa, Dengue virus
KTKLTDWDFV

SEQ ID NO: 89576 - protein, 10 aa, Dengue virus
TKLTDWDFVV

SEQ ID NO: 89577 - protein, 10 aa, Dengue virus
KLTDWDFVVT

SEQ ID NO: 89578 - protein, 10 aa, Dengue virus
LTDWDFVVTT

SEQ ID NO: 89579 - protein, 10 aa, Dengue virus
TDWDFVVTTD

SEQ ID NO: 89580 - protein, 10 aa, Dengue virus
DWDFVVTTDI

SEQ ID NO: 89581 - protein, 10 aa, Dengue virus
WDFVVTTDIS

SEQ ID NO: 89582 - protein, 10 aa, Dengue virus
DFVVTTDISE

SEQ ID NO: 89583 - protein, 10 aa, Dengue virus
FVVTTDISEM

SEQ ID NO: 89584 - protein, 10 aa, Dengue virus
VVTTDISEMG

SEQ ID NO: 89585 - protein, 10 aa, Dengue virus
VTTDISEMGA

SEQ ID NO: 89586 - protein, 10 aa, Dengue virus
TTDISEMGAN

SEQ ID NO: 89587 - protein, 10 aa, Dengue virus
TDISEMGANF

SEQ ID NO: 89588 - protein, 10 aa, Dengue virus
DISEMGANFR

SEQ ID NO: 89589 - protein, 10 aa, Dengue virus
ISEMGANFRA

SEQ ID NO: 89590 - protein, 10 aa, Dengue virus
SEMGANFRAG

SEQ ID NO: 89591 - protein, 10 aa, Dengue virus
EMGANFRAGR

SEQ ID NO: 89592 - protein, 10 aa, Dengue virus
MGANFRAGRV

SEQ ID NO: 89593 - protein, 10 aa, Dengue virus
GANFRAGRVI

SEQ ID NO: 89594 - protein, 10 aa, Dengue virus
ANFRAGRVID

SEQ ID NO: 89595 - protein, 10 aa, Dengue virus
NFRAGRVIDP

SEQ ID NO: 89596 - protein, 10 aa, Dengue virus
FRAGRVIDPR

SEQ ID NO: 89597 - protein, 10 aa, Dengue virus
RAGRVIDPRR

SEQ ID NO: 89598 - protein, 10 aa, Dengue virus
AGRVIDPRRC

SEQ ID NO: 89599 - protein, 10 aa, Dengue virus
GRVIDPRRCL

SEQ ID NO: 89600 - protein, 10 aa, Dengue virus
RVIDPRRCLK

SEQ ID NO: 89601 - protein, 10 aa, Dengue virus
VIDPRRCLKP

SEQ ID NO: 89602 - protein, 10 aa, Dengue virus
IDPRRCLKPV

SEQ ID NO: 89603 - protein, 10 aa, Dengue virus
DPRRCLKPVI

SEQ ID NO: 89604 - protein, 10 aa, Dengue virus
PRRCLKPVIL

SEQ ID NO: 89605 - protein, 10 aa, Dengue virus
RRCLKPVILT

SEQ ID NO: 89606 - protein, 10 aa, Dengue virus
RCLKPVILTD

SEQ ID NO: 89607 - protein, 10 aa, Dengue virus
CLKPVILTDG

SEQ ID NO: 89608 - protein, 10 aa, Dengue virus
LKPVILTDGP

SEQ ID NO: 89609 - protein, 10 aa, Dengue virus
KPVILTDGPE

SEQ ID NO: 89610 - protein, 10 aa, Dengue virus
PVILTDGPER

SEQ ID NO: 89611 - protein, 10 aa, Dengue virus
VILTDGPERV

SEQ ID NO: 89612 - protein, 10 aa, Dengue virus
ILTDGPERVI

SEQ ID NO: 89613 - protein, 10 aa, Dengue virus
LTDGPERVIL

SEQ ID NO: 89614 - protein, 10 aa, Dengue virus
TDGPERVILA

SEQ ID NO: 89615 - protein, 10 aa, Dengue virus
DGPERVILAG

SEQ ID NO: 89616 - protein, 10 aa, Dengue virus
GPERVILAGP

SEQ ID NO: 89617 - protein, 10 aa, Dengue virus
PERVILAGPI

SEQ ID NO: 89618 - protein, 10 aa, Dengue virus
ERVILAGPIP

SEQ ID NO: 89619 - protein, 10 aa, Dengue virus
RVILAGPIPV

SEQ ID NO: 89620 - protein, 10 aa, Dengue virus
VILAGPIPVT

SEQ ID NO: 89621 - protein, 10 aa, Dengue virus
ILAGPIPVTP

SEQ ID NO: 89622 - protein, 10 aa, Dengue virus
LAGPIPVTPA

SEQ ID NO: 89623 - protein, 10 aa, Dengue virus
AGPIPVTPAS

SEQ ID NO: 89624 - protein, 10 aa, Dengue virus
GPIPVTPASA

SEQ ID NO: 89625 - protein, 10 aa, Dengue virus
PIPVTPASAA

SEQ ID NO: 89626 - protein, 10 aa, Dengue virus
IPVTPASAAQ

SEQ ID NO: 89627 - protein, 10 aa, Dengue virus
PVTPASAAQR

SEQ ID NO: 89628 - protein, 10 aa, Dengue virus
VTPASAAQRR

SEQ ID NO: 89629 - protein, 10 aa, Dengue virus
TPASAAQRRG

SEQ ID NO: 89630 - protein, 10 aa, Dengue virus
PASAAQRRGR

SEQ ID NO: 89631 - protein, 10 aa, Dengue virus
ASAAQRRGRI

SEQ ID NO: 89632 - protein, 10 aa, Dengue virus
SAAQRRGRIG

SEQ ID NO: 89633 - protein, 10 aa, Dengue virus
AAQRRGRIGR

SEQ ID NO: 89634 - protein, 10 aa, Dengue virus
AQRRGRIGRN

SEQ ID NO: 89635 - protein, 10 aa, Dengue virus
QRRGRIGRNP

SEQ ID NO: 89636 - protein, 10 aa, Dengue virus
RRGRIGRNPA

SEQ ID NO: 89637 - protein, 10 aa, Dengue virus
RGRIGRNPAQ

SEQ ID NO: 89638 - protein, 10 aa, Dengue virus
GRIGRNPAQE

SEQ ID NO: 89639 - protein, 10 aa, Dengue virus
RIGRNPAQED

SEQ ID NO: 89640 - protein, 10 aa, Dengue virus
IGRNPAQEDD

SEQ ID NO: 89641 - protein, 10 aa, Dengue virus
GRNPAQEDDQ

SEQ ID NO: 89642 - protein, 10 aa, Dengue virus
RNPAQEDDQY

SEQ ID NO: 89643 - protein, 10 aa, Dengue virus
NPAQEDDQYV

SEQ ID NO: 89644 - protein, 10 aa, Dengue virus
PAQEDDQYVF

SEQ ID NO: 89645 - protein, 10 aa, Dengue virus
AQEDDQYVFS

SEQ ID NO: 89646 - protein, 10 aa, Dengue virus
QEDDQYVFSG

SEQ ID NO: 89647 - protein, 10 aa, Dengue virus
EDDQYVFSGD

SEQ ID NO: 89648 - protein, 10 aa, Dengue virus
DDQYVFSGDP

SEQ ID NO: 89649 - protein, 10 aa, Dengue virus
DQYVFSGDPL

SEQ ID NO: 89650 - protein, 10 aa, Dengue virus
QYVFSGDPLK

SEQ ID NO: 89651 - protein, 10 aa, Dengue virus
YVFSGDPLKN

SEQ ID NO: 89652 - protein, 10 aa, Dengue virus
VFSGDPLKND

SEQ ID NO: 89653 - protein, 10 aa, Dengue virus
FSGDPLKNDE

SEQ ID NO: 89654 - protein, 10 aa, Dengue virus
SGDPLKNDED

SEQ ID NO: 89655 - protein, 10 aa, Dengue virus
GDPLKNDEDH

SEQ ID NO: 89656 - protein, 10 aa, Dengue virus
DPLKNDEDHA

SEQ ID NO: 89657 - protein, 10 aa, Dengue virus
PLKNDEDHAH

SEQ ID NO: 89658 - protein, 10 aa, Dengue virus
LKNDEDHAHW

SEQ ID NO: 89659 - protein, 10 aa, Dengue virus
KNDEDHAHWT

SEQ ID NO: 89660 - protein, 10 aa, Dengue virus
NDEDHAHWTE

SEQ ID NO: 89661 - protein, 10 aa, Dengue virus
DEDHAHWTEA

SEQ ID NO: 89662 - protein, 10 aa, Dengue virus
EDHAHWTEAK

SEQ ID NO: 89663 - protein, 10 aa, Dengue virus
DHAHWTEAKM

SEQ ID NO: 89664 - protein, 10 aa, Dengue virus
HAHWTEAKML

SEQ ID NO: 89665 - protein, 10 aa, Dengue virus
AHWTEAKMLL

SEQ ID NO: 89666 - protein, 10 aa, Dengue virus
HWTEAKMLLD

SEQ ID NO: 89667 - protein, 10 aa, Dengue virus
WTEAKMLLDN

SEQ ID NO: 89668 - protein, 10 aa, Dengue virus
TEAKMLLDNI

SEQ ID NO: 89669 - protein, 10 aa, Dengue virus
EAKMLLDNIY

SEQ ID NO: 89670 - protein, 10 aa, Dengue virus
AKMLLDNIYT

SEQ ID NO: 89671 - protein, 10 aa, Dengue virus
KMLLDNIYTP

SEQ ID NO: 89672 - protein, 10 aa, Dengue virus
MLLDNIYTPE

SEQ ID NO: 89673 - protein, 10 aa, Dengue virus
LLDNIYTPEG

SEQ ID NO: 89674 - protein, 10 aa, Dengue virus
LDNIYTPEGI

SEQ ID NO: 89675 - protein, 10 aa, Dengue virus
DNIYTPEGII

SEQ ID NO: 89676 - protein, 10 aa, Dengue virus
NIYTPEGIIP

SEQ ID NO: 89677 - protein, 10 aa, Dengue virus
IYTPEGIIPT

SEQ ID NO: 89678 - protein, 10 aa, Dengue virus
YTPEGIIPTL

SEQ ID NO: 89679 - protein, 10 aa, Dengue virus
TPEGIIPTLF

SEQ ID NO: 89680 - protein, 10 aa, Dengue virus
PEGIIPTLFG

SEQ ID NO: 89681 - protein, 10 aa, Dengue virus
EGIIPTLFGP

SEQ ID NO: 89682 - protein, 10 aa, Dengue virus
GIIPTLFGPE

SEQ ID NO: 89683 - protein, 10 aa, Dengue virus
IIPTLFGPER

SEQ ID NO: 89684 - protein, 10 aa, Dengue virus
IPTLFGPERE

SEQ ID NO: 89685 - protein, 10 aa, Dengue virus
PTLFGPEREK

SEQ ID NO: 89686 - protein, 10 aa, Dengue virus
TLFGPEREKT

SEQ ID NO: 89687 - protein, 10 aa, Dengue virus
LFGPEREKTQ

SEQ ID NO: 89688 - protein, 10 aa, Dengue virus
FGPEREKTQA

SEQ ID NO: 89689 - protein, 10 aa, Dengue virus
GPEREKTQAI

SEQ ID NO: 89690 - protein, 10 aa, Dengue virus
PEREKTQAID

SEQ ID NO: 89691 - protein, 10 aa, Dengue virus
EREKTQAIDG

SEQ ID NO: 89692 - protein, 10 aa, Dengue virus
REKTQAIDGE

SEQ ID NO: 89693 - protein, 10 aa, Dengue virus
EKTQAIDGEF

SEQ ID NO: 89694 - protein, 10 aa, Dengue virus
KTQAIDGEFR

SEQ ID NO: 89695 - protein, 10 aa, Dengue virus
TQAIDGEFRL

SEQ ID NO: 89696 - protein, 10 aa, Dengue virus
QAIDGEFRLR

SEQ ID NO: 89697 - protein, 10 aa, Dengue virus
AIDGEFRLRG

SEQ ID NO: 89698 - protein, 10 aa, Dengue virus
IDGEFRLRGE

SEQ ID NO: 89699 - protein, 10 aa, Dengue virus
DGEFRLRGEQ

SEQ ID NO: 89700 - protein, 10 aa, Dengue virus
GEFRLRGEQR

SEQ ID NO: 89701 - protein, 10 aa, Dengue virus
EFRLRGEQRK

SEQ ID NO: 89702 - protein, 10 aa, Dengue virus
FRLRGEQRKT

SEQ ID NO: 89703 - protein, 10 aa, Dengue virus
RLRGEQRKTF

SEQ ID NO: 89704 - protein, 10 aa, Dengue virus
LRGEQRKTFV

SEQ ID NO: 89705 - protein, 10 aa, Dengue virus
RGEQRKTFVE

SEQ ID NO: 89706 - protein, 10 aa, Dengue virus
GEQRKTFVEL

SEQ ID NO: 89707 - protein, 10 aa, Dengue virus
EQRKTFVELM

SEQ ID NO: 89708 - protein, 10 aa, Dengue virus
QRKTFVELMR

SEQ ID NO: 89709 - protein, 10 aa, Dengue virus
RKTFVELMRR

SEQ ID NO: 89710 - protein, 10 aa, Dengue virus
KTFVELMRRG

SEQ ID NO: 89711 - protein, 10 aa, Dengue virus
TFVELMRRGD

SEQ ID NO: 89712 - protein, 10 aa, Dengue virus
FVELMRRGDL

SEQ ID NO: 89713 - protein, 10 aa, Dengue virus
VELMRRGDLP

SEQ ID NO: 89714 - protein, 10 aa, Dengue virus
ELMRRGDLPV

SEQ ID NO: 89715 - protein, 10 aa, Dengue virus
LMRRGDLPVW

SEQ ID NO: 89716 - protein, 10 aa, Dengue virus
MRRGDLPVWL

SEQ ID NO: 89717 - protein, 10 aa, Dengue virus
RRGDLPVWLS

SEQ ID NO: 89718 - protein, 10 aa, Dengue virus
RGDLPVWLSY

SEQ ID NO: 89719 - protein, 10 aa, Dengue virus
GDLPVWLSYK

SEQ ID NO: 89720 - protein, 10 aa, Dengue virus
DLPVWLSYKV

SEQ ID NO: 89721 - protein, 10 aa, Dengue virus
LPVWLSYKVA

SEQ ID NO: 89722 - protein, 10 aa, Dengue virus
PVWLSYKVAS

SEQ ID NO: 89723 - protein, 10 aa, Dengue virus
VWLSYKVASA

SEQ ID NO: 89724 - protein, 10 aa, Dengue virus
WLSYKVASAG

SEQ ID NO: 89725 - protein, 10 aa, Dengue virus
LSYKVASAGI

SEQ ID NO: 89726 - protein, 10 aa, Dengue virus
SYKVASAGIS

SEQ ID NO: 89727 - protein, 10 aa, Dengue virus
YKVASAGISY

SEQ ID NO: 89728 - protein, 10 aa, Dengue virus
KVASAGISYK

SEQ ID NO: 89729 - protein, 10 aa, Dengue virus
VASAGISYKD

SEQ ID NO: 89730 - protein, 10 aa, Dengue virus
ASAGISYKDR

SEQ ID NO: 89731 - protein, 10 aa, Dengue virus
SAGISYKDRE

SEQ ID NO: 89732 - protein, 10 aa, Dengue virus
AGISYKDREW

SEQ ID NO: 89733 - protein, 10 aa, Dengue virus
GISYKDREWC

SEQ ID NO: 89734 - protein, 10 aa, Dengue virus
ISYKDREWCF

SEQ ID NO: 89735 - protein, 10 aa, Dengue virus
SYKDREWCFT

SEQ ID NO: 89736 - protein, 10 aa, Dengue virus
YKDREWCFTG

SEQ ID NO: 89737 - protein, 10 aa, Dengue virus
KDREWCFTGE

SEQ ID NO: 89738 - protein, 10 aa, Dengue virus
DREWCFTGER

SEQ ID NO: 89739 - protein, 10 aa, Dengue virus
REWCFTGERN

SEQ ID NO: 89740 - protein, 10 aa, Dengue virus
EWCFTGERNN

SEQ ID NO: 89741 - protein, 10 aa, Dengue virus
WCFTGERNNQ

SEQ ID NO: 89742 - protein, 10 aa, Dengue virus
CFTGERNNQI

SEQ ID NO: 89743 - protein, 10 aa, Dengue virus
FTGERNNQIL

SEQ ID NO: 89744 - protein, 10 aa, Dengue virus
TGERNNQILE

SEQ ID NO: 89745 - protein, 10 aa, Dengue virus
GERNNQILEE

SEQ ID NO: 89746 - protein, 10 aa, Dengue virus
ERNNQILEEN

SEQ ID NO: 89747 - protein, 10 aa, Dengue virus
RNNQILEENM

SEQ ID NO: 89748 - protein, 10 aa, Dengue virus
NNQILEENME

SEQ ID NO: 89749 - protein, 10 aa, Dengue virus
NQILEENMEV

SEQ ID NO: 89750 - protein, 10 aa, Dengue virus
QILEENMEVE

SEQ ID NO: 89751 - protein, 10 aa, Dengue virus
ILEENMEVEI

SEQ ID NO: 89752 - protein, 10 aa, Dengue virus
LEENMEVEIW

SEQ ID NO: 89753 - protein, 10 aa, Dengue virus
EENMEVEIWT

SEQ ID NO: 89754 - protein, 10 aa, Dengue virus
ENMEVEIWTR

SEQ ID NO: 89755 - protein, 10 aa, Dengue virus
NMEVEIWTRE

SEQ ID NO: 89756 - protein, 10 aa, Dengue virus
MEVEIWTREG

SEQ ID NO: 89757 - protein, 10 aa, Dengue virus
EVEIWTREGE

SEQ ID NO: 89758 - protein, 10 aa, Dengue virus
VEIWTREGEK

SEQ ID NO: 89759 - protein, 10 aa, Dengue virus
EIWTREGEKK

SEQ ID NO: 89760 - protein, 10 aa, Dengue virus
IWTREGEKKK

SEQ ID NO: 89761 - protein, 10 aa, Dengue virus
WTREGEKKKL

SEQ ID NO: 89762 - protein, 10 aa, Dengue virus
TREGEKKKLR

SEQ ID NO: 89763 - protein, 10 aa, Dengue virus
REGEKKKLRP

SEQ ID NO: 89764 - protein, 10 aa, Dengue virus
EGEKKKLRPR

SEQ ID NO: 89765 - protein, 10 aa, Dengue virus
GEKKKLRPRW

SEQ ID NO: 89766 - protein, 10 aa, Dengue virus
EKKKLRPRWL

SEQ ID NO: 89767 - protein, 10 aa, Dengue virus
KKKLRPRWLD

SEQ ID NO: 89768 - protein, 10 aa, Dengue virus
KKLRPRWLDA

SEQ ID NO: 89769 - protein, 10 aa, Dengue virus
KLRPRWLDAR

SEQ ID NO: 89770 - protein, 10 aa, Dengue virus
LRPRWLDARV

SEQ ID NO: 89771 - protein, 10 aa, Dengue virus
RPRWLDARVY

SEQ ID NO: 89772 - protein, 10 aa, Dengue virus
PRWLDARVYA

SEQ ID NO: 89773 - protein, 10 aa, Dengue virus
RWLDARVYAD

SEQ ID NO: 89774 - protein, 10 aa, Dengue virus
WLDARVYADP

SEQ ID NO: 89775 - protein, 10 aa, Dengue virus
LDARVYADPM

SEQ ID NO: 89776 - protein, 10 aa, Dengue virus
DARVYADPMA

SEQ ID NO: 89777 - protein, 10 aa, Dengue virus
ARVYADPMAL

SEQ ID NO: 89778 - protein, 10 aa, Dengue virus
RVYADPMALK

SEQ ID NO: 89779 - protein, 10 aa, Dengue virus
VYADPMALKD

SEQ ID NO: 89780 - protein, 10 aa, Dengue virus
YADPMALKDF

SEQ ID NO: 89781 - protein, 10 aa, Dengue virus
ADPMALKDFK

SEQ ID NO: 89782 - protein, 10 aa, Dengue virus
DPMALKDFKE

SEQ ID NO: 89783 - protein, 10 aa, Dengue virus
PMALKDFKEF

SEQ ID NO: 89784 - protein, 10 aa, Dengue virus
MALKDFKEFA

SEQ ID NO: 89785 - protein, 10 aa, Dengue virus
ALKDFKEFAS

SEQ ID NO: 89786 - protein, 10 aa, Dengue virus
LKDFKEFASG

SEQ ID NO: 89787 - protein, 10 aa, Dengue virus
KDFKEFASGR

SEQ ID NO: 89788 - protein, 10 aa, Dengue virus
DFKEFASGRK

SEQ ID NO: 89789 - protein, 10 aa, Dengue virus
FKEFASGRKS

SEQ ID NO: 89790 - protein, 10 aa, Dengue virus
KEFASGRKSI

SEQ ID NO: 89791 - protein, 10 aa, Dengue virus
EFASGRKSIT

SEQ ID NO: 89792 - protein, 10 aa, Dengue virus
FASGRKSITL

SEQ ID NO: 89793 - protein, 10 aa, Dengue virus
ASGRKSITLD

SEQ ID NO: 89794 - protein, 10 aa, Dengue virus
SGRKSITLDI

SEQ ID NO: 89795 - protein, 10 aa, Dengue virus
GRKSITLDIL

SEQ ID NO: 89796 - protein, 10 aa, Dengue virus
RKSITLDILT

SEQ ID NO: 89797 - protein, 10 aa, Dengue virus
KSITLDILTE

SEQ ID NO: 89798 - protein, 10 aa, Dengue virus
SITLDILTEI

SEQ ID NO: 89799 - protein, 10 aa, Dengue virus
ITLDILTEIA

SEQ ID NO: 89800 - protein, 10 aa, Dengue virus
TLDILTEIAS

SEQ ID NO: 89801 - protein, 10 aa, Dengue virus
LDILTEIASL

SEQ ID NO: 89802 - protein, 10 aa, Dengue virus
DILTEIASLP

SEQ ID NO: 89803 - protein, 10 aa, Dengue virus
ILTEIASLPT

SEQ ID NO: 89804 - protein, 10 aa, Dengue virus
LTEIASLPTY

SEQ ID NO: 89805 - protein, 10 aa, Dengue virus
TEIASLPTYL

SEQ ID NO: 89806 - protein, 10 aa, Dengue virus
EIASLPTYLS

SEQ ID NO: 89807 - protein, 10 aa, Dengue virus
IASLPTYLSS

SEQ ID NO: 89808 - protein, 10 aa, Dengue virus
ASLPTYLSSR

SEQ ID NO: 89809 - protein, 10 aa, Dengue virus
SLPTYLSSRA

SEQ ID NO: 89810 - protein, 10 aa, Dengue virus
LPTYLSSRAK

SEQ ID NO: 89811 - protein, 10 aa, Dengue virus
PTYLSSRAKL

SEQ ID NO: 89812 - protein, 10 aa, Dengue virus
TYLSSRAKLA

SEQ ID NO: 89813 - protein, 10 aa, Dengue virus
YLSSRAKLAL

SEQ ID NO: 89814 - protein, 10 aa, Dengue virus
LSSRAKLALD

SEQ ID NO: 89815 - protein, 10 aa, Dengue virus
SSRAKLALDN

SEQ ID NO: 89816 - protein, 10 aa, Dengue virus
SRAKLALDNI

SEQ ID NO: 89817 - protein, 10 aa, Dengue virus
RAKLALDNIV

SEQ ID NO: 89818 - protein, 10 aa, Dengue virus
AKLALDNIVM

SEQ ID NO: 89819 - protein, 10 aa, Dengue virus
KLALDNIVML

SEQ ID NO: 89820 - protein, 10 aa, Dengue virus
LALDNIVMLH

SEQ ID NO: 89821 - protein, 10 aa, Dengue virus
ALDNIVMLHT

SEQ ID NO: 89822 - protein, 10 aa, Dengue virus
LDNIVMLHTT

SEQ ID NO: 89823 - protein, 10 aa, Dengue virus
DNIVMLHTTE

SEQ ID NO: 89824 - protein, 10 aa, Dengue virus
NIVMLHTTER

SEQ ID NO: 89825 - protein, 10 aa, Dengue virus
IVMLHTTERG

SEQ ID NO: 89826 - protein, 10 aa, Dengue virus
VMLHTTERGG

SEQ ID NO: 89827 - protein, 10 aa, Dengue virus
MLHTTERGGR

SEQ ID NO: 89828 - protein, 10 aa, Dengue virus
LHTTERGGRA

SEQ ID NO: 89829 - protein, 10 aa, Dengue virus
HTTERGGRAY

SEQ ID NO: 89830 - protein, 10 aa, Dengue virus
TTERGGRAYQ

SEQ ID NO: 89831 - protein, 10 aa, Dengue virus
TERGGRAYQH

SEQ ID NO: 89832 - protein, 10 aa, Dengue virus
ERGGRAYQHA

SEQ ID NO: 89833 - protein, 10 aa, Dengue virus
RGGRAYQHAL

SEQ ID NO: 89834 - protein, 10 aa, Dengue virus
GGRAYQHALN

SEQ ID NO: 89835 - protein, 10 aa, Dengue virus
GRAYQHALNE

SEQ ID NO: 89836 - protein, 10 aa, Dengue virus
RAYQHALNEL

SEQ ID NO: 89837 - protein, 10 aa, Dengue virus
AYQHALNELP

SEQ ID NO: 89838 - protein, 10 aa, Dengue virus
YQHALNELPE

SEQ ID NO: 89839 - protein, 10 aa, Dengue virus
QHALNELPES

SEQ ID NO: 89840 - protein, 10 aa, Dengue virus
HALNELPESL

SEQ ID NO: 89841 - protein, 10 aa, Dengue virus
ALNELPESLE

SEQ ID NO: 89842 - protein, 10 aa, Dengue virus
LNELPESLET

SEQ ID NO: 89843 - protein, 10 aa, Dengue virus
NELPESLETL

SEQ ID NO: 89844 - protein, 10 aa, Dengue virus
ELPESLETLM

SEQ ID NO: 89845 - protein, 10 aa, Dengue virus
LPESLETLML

SEQ ID NO: 89846 - protein, 10 aa, Dengue virus
PESLETLMLV

SEQ ID NO: 89847 - protein, 10 aa, Dengue virus
ESLETLMLVA

SEQ ID NO: 89848 - protein, 10 aa, Dengue virus
SLETLMLVAL

SEQ ID NO: 89849 - protein, 10 aa, Dengue virus
LETLMLVALL

SEQ ID NO: 89850 - protein, 10 aa, Dengue virus
ETLMLVALLG

SEQ ID NO: 89851 - protein, 10 aa, Dengue virus
TLMLVALLGA

SEQ ID NO: 89852 - protein, 10 aa, Dengue virus
LMLVALLGAM

SEQ ID NO: 89853 - protein, 10 aa, Dengue virus
MLVALLGAMT

SEQ ID NO: 89854 - protein, 10 aa, Dengue virus
LVALLGAMTA

SEQ ID NO: 89855 - protein, 10 aa, Dengue virus
VALLGAMTAG

SEQ ID NO: 89856 - protein, 10 aa, Dengue virus
ALLGAMTAGI

SEQ ID NO: 89857 - protein, 10 aa, Dengue virus
LLGAMTAGIF

SEQ ID NO: 89858 - protein, 10 aa, Dengue virus
LGAMTAGIFL

SEQ ID NO: 89859 - protein, 10 aa, Dengue virus
GAMTAGIFLF

SEQ ID NO: 89860 - protein, 10 aa, Dengue virus
AMTAGIFLFF

SEQ ID NO: 89861 - protein, 10 aa, Dengue virus
MTAGIFLFFM

SEQ ID NO: 89862 - protein, 10 aa, Dengue virus
TAGIFLFFMQ

SEQ ID NO: 89863 - protein, 10 aa, Dengue virus
AGIFLFFMQG

SEQ ID NO: 89864 - protein, 10 aa, Dengue virus
GIFLFFMQGK

SEQ ID NO: 89865 - protein, 10 aa, Dengue virus
IFLFFMQGKG

SEQ ID NO: 89866 - protein, 10 aa, Dengue virus
FLFFMQGKGI

SEQ ID NO: 89867 - protein, 10 aa, Dengue virus
LFFMQGKGIG

SEQ ID NO: 89868 - protein, 10 aa, Dengue virus
FFMQGKGIGK

SEQ ID NO: 89869 - protein, 10 aa, Dengue virus
FMQGKGIGKL

SEQ ID NO: 89870 - protein, 10 aa, Dengue virus
MQGKGIGKLS

SEQ ID NO: 89871 - protein, 10 aa, Dengue virus
QGKGIGKLSM

SEQ ID NO: 89872 - protein, 10 aa, Dengue virus
GKGIGKLSMG

SEQ ID NO: 89873 - protein, 10 aa, Dengue virus
KGIGKLSMGL

SEQ ID NO: 89874 - protein, 10 aa, Dengue virus
GIGKLSMGLI

SEQ ID NO: 89875 - protein, 10 aa, Dengue virus
IGKLSMGLIT

SEQ ID NO: 89876 - protein, 10 aa, Dengue virus
GKLSMGLITI

SEQ ID NO: 89877 - protein, 10 aa, Dengue virus
KLSMGLITIA

SEQ ID NO: 89878 - protein, 10 aa, Dengue virus
LSMGLITIAV

SEQ ID NO: 89879 - protein, 10 aa, Dengue virus
SMGLITIAVA

SEQ ID NO: 89880 - protein, 10 aa, Dengue virus
MGLITIAVAS

SEQ ID NO: 89881 - protein, 10 aa, Dengue virus
GLITIAVASG

SEQ ID NO: 89882 - protein, 10 aa, Dengue virus
LITIAVASGL

SEQ ID NO: 89883 - protein, 10 aa, Dengue virus
ITIAVASGLL

SEQ ID NO: 89884 - protein, 10 aa, Dengue virus
TIAVASGLLW

SEQ ID NO: 89885 - protein, 10 aa, Dengue virus
IAVASGLLWV

SEQ ID NO: 89886 - protein, 10 aa, Dengue virus
AVASGLLWVA

SEQ ID NO: 89887 - protein, 10 aa, Dengue virus
VASGLLWVAE

SEQ ID NO: 89888 - protein, 10 aa, Dengue virus
ASGLLWVAEI

SEQ ID NO: 89889 - protein, 10 aa, Dengue virus
SGLLWVAEIQ

SEQ ID NO: 89890 - protein, 10 aa, Dengue virus
GLLWVAEIQP

SEQ ID NO: 89891 - protein, 10 aa, Dengue virus
LLWVAEIQPQ

SEQ ID NO: 89892 - protein, 10 aa, Dengue virus
LWVAEIQPQW

SEQ ID NO: 89893 - protein, 10 aa, Dengue virus
WVAEIQPQWI

SEQ ID NO: 89894 - protein, 10 aa, Dengue virus
VAEIQPQWIA

SEQ ID NO: 89895 - protein, 10 aa, Dengue virus
AEIQPQWIAA

SEQ ID NO: 89896 - protein, 10 aa, Dengue virus
EIQPQWIAAS

SEQ ID NO: 89897 - protein, 10 aa, Dengue virus
IQPQWIAASI

SEQ ID NO: 89898 - protein, 10 aa, Dengue virus
QPQWIAASII

SEQ ID NO: 89899 - protein, 10 aa, Dengue virus
PQWIAASIIL

SEQ ID NO: 89900 - protein, 10 aa, Dengue virus
QWIAASIILE

SEQ ID NO: 89901 - protein, 10 aa, Dengue virus
WIAASIILEF

SEQ ID NO: 89902 - protein, 10 aa, Dengue virus
IAASIILEFF

SEQ ID NO: 89903 - protein, 10 aa, Dengue virus
AASIILEFFL

SEQ ID NO: 89904 - protein, 10 aa, Dengue virus
ASIILEFFLM

SEQ ID NO: 89905 - protein, 10 aa, Dengue virus
SIILEFFLMV

SEQ ID NO: 89906 - protein, 10 aa, Dengue virus
IILEFFLMVL

SEQ ID NO: 89907 - protein, 10 aa, Dengue virus
ILEFFLMVLL

SEQ ID NO: 89908 - protein, 10 aa, Dengue virus
LEFFLMVLLI

SEQ ID NO: 89909 - protein, 10 aa, Dengue virus
EFFLMVLLIP

SEQ ID NO: 89910 - protein, 10 aa, Dengue virus
FFLMVLLIPE

SEQ ID NO: 89911 - protein, 10 aa, Dengue virus
FLMVLLIPEP

SEQ ID NO: 89912 - protein, 10 aa, Dengue virus
LMVLLIPEPE

SEQ ID NO: 89913 - protein, 10 aa, Dengue virus
MVLLIPEPEK

SEQ ID NO: 89914 - protein, 10 aa, Dengue virus
VLLIPEPEKQ

SEQ ID NO: 89915 - protein, 10 aa, Dengue virus
LLIPEPEKQR

SEQ ID NO: 89916 - protein, 10 aa, Dengue virus
LIPEPEKQRT

SEQ ID NO: 89917 - protein, 10 aa, Dengue virus
IPEPEKQRTP

SEQ ID NO: 89918 - protein, 10 aa, Dengue virus
PEPEKQRTPQ

SEQ ID NO: 89919 - protein, 10 aa, Dengue virus
EPEKQRTPQD

SEQ ID NO: 89920 - protein, 10 aa, Dengue virus
PEKQRTPQDN

SEQ ID NO: 89921 - protein, 10 aa, Dengue virus
EKQRTPQDNQ

SEQ ID NO: 89922 - protein, 10 aa, Dengue virus
KQRTPQDNQL

SEQ ID NO: 89923 - protein, 10 aa, Dengue virus
QRTPQDNQLI

SEQ ID NO: 89924 - protein, 10 aa, Dengue virus
RTPQDNQLIY

SEQ ID NO: 89925 - protein, 10 aa, Dengue virus
TPQDNQLIYV

SEQ ID NO: 89926 - protein, 10 aa, Dengue virus
PQDNQLIYVI

SEQ ID NO: 89927 - protein, 10 aa, Dengue virus
QDNQLIYVIL

SEQ ID NO: 89928 - protein, 10 aa, Dengue virus
DNQLIYVILT

SEQ ID NO: 89929 - protein, 10 aa, Dengue virus
NQLIYVILTI

SEQ ID NO: 89930 - protein, 10 aa, Dengue virus
QLIYVILTIL

SEQ ID NO: 89931 - protein, 10 aa, Dengue virus
LIYVILTILT

SEQ ID NO: 89932 - protein, 10 aa, Dengue virus
IYVILTILTI

SEQ ID NO: 89933 - protein, 10 aa, Dengue virus
YVILTILTII

SEQ ID NO: 89934 - protein, 10 aa, Dengue virus
VILTILTIIG

SEQ ID NO: 89935 - protein, 10 aa, Dengue virus
ILTILTIIGL

SEQ ID NO: 89936 - protein, 10 aa, Dengue virus
ILTIIGLIAA

SEQ ID NO: 89937 - protein, 10 aa, Dengue virus
LTIIGLIAAN

SEQ ID NO: 89938 - protein, 10 aa, Dengue virus
TIIGLIAANE

SEQ ID NO: 89939 - protein, 10 aa, Dengue virus
IIGLIAANEM

SEQ ID NO: 89940 - protein, 10 aa, Dengue virus
IGLIAANEMG

SEQ ID NO: 89941 - protein, 10 aa, Dengue virus
GLIAANEMGL

SEQ ID NO: 89942 - protein, 10 aa, Dengue virus
LIAANEMGLI

SEQ ID NO: 89943 - protein, 10 aa, Dengue virus
IAANEMGLIE

SEQ ID NO: 89944 - protein, 10 aa, Dengue virus
AANEMGLIEK

SEQ ID NO: 89945 - protein, 10 aa, Dengue virus
ANEMGLIEKT

SEQ ID NO: 89946 - protein, 10 aa, Dengue virus
NEMGLIEKTK

SEQ ID NO: 89947 - protein, 10 aa, Dengue virus
EMGLIEKTKT

SEQ ID NO: 89948 - protein, 10 aa, Dengue virus
MGLIEKTKTD

SEQ ID NO: 89949 - protein, 10 aa, Dengue virus
GLIEKTKTDF

SEQ ID NO: 89950 - protein, 10 aa, Dengue virus
LIEKTKTDFG

SEQ ID NO: 89951 - protein, 10 aa, Dengue virus
IEKTKTDFGF

SEQ ID NO: 89952 - protein, 10 aa, Dengue virus
EKTKTDFGFY

SEQ ID NO: 89953 - protein, 10 aa, Dengue virus
KTKTDFGFYQ

SEQ ID NO: 89954 - protein, 10 aa, Dengue virus
TKTDFGFYQV

SEQ ID NO: 89955 - protein, 10 aa, Dengue virus
KTDFGFYQVK

SEQ ID NO: 89956 - protein, 10 aa, Dengue virus
TDFGFYQVKT

SEQ ID NO: 89957 - protein, 10 aa, Dengue virus
DFGFYQVKTE

SEQ ID NO: 89958 - protein, 10 aa, Dengue virus
FGFYQVKTET

SEQ ID NO: 89959 - protein, 10 aa, Dengue virus
GFYQVKTETT

SEQ ID NO: 89960 - protein, 10 aa, Dengue virus
FYQVKTETTI

SEQ ID NO: 89961 - protein, 10 aa, Dengue virus
YQVKTETTIL

SEQ ID NO: 89962 - protein, 10 aa, Dengue virus
QVKTETTILD

SEQ ID NO: 89963 - protein, 10 aa, Dengue virus
VKTETTILDV

SEQ ID NO: 89964 - protein, 10 aa, Dengue virus
KTETTILDVD

SEQ ID NO: 89965 - protein, 10 aa, Dengue virus
TETTILDVDL

SEQ ID NO: 89966 - protein, 10 aa, Dengue virus
ETTILDVDLR

SEQ ID NO: 89967 - protein, 10 aa, Dengue virus
TTILDVDLRP

SEQ ID NO: 89968 - protein, 10 aa, Dengue virus
TILDVDLRPA

SEQ ID NO: 89969 - protein, 10 aa, Dengue virus
ILDVDLRPAS

SEQ ID NO: 89970 - protein, 10 aa, Dengue virus
LDVDLRPASA

SEQ ID NO: 89971 - protein, 10 aa, Dengue virus
DVDLRPASAW

SEQ ID NO: 89972 - protein, 10 aa, Dengue virus
VDLRPASAWT

SEQ ID NO: 89973 - protein, 10 aa, Dengue virus
DLRPASAWTL

SEQ ID NO: 89974 - protein, 10 aa, Dengue virus
LRPASAWTLY

SEQ ID NO: 89975 - protein, 10 aa, Dengue virus
RPASAWTLYA

SEQ ID NO: 89976 - protein, 10 aa, Dengue virus
PASAWTLYAV

SEQ ID NO: 89977 - protein, 10 aa, Dengue virus
ASAWTLYAVA

SEQ ID NO: 89978 - protein, 10 aa, Dengue virus
SAWTLYAVAT

SEQ ID NO: 89979 - protein, 10 aa, Dengue virus
AWTLYAVATT

SEQ ID NO: 89980 - protein, 10 aa, Dengue virus
WTLYAVATTI

SEQ ID NO: 89981 - protein, 10 aa, Dengue virus
TLYAVATTIL

SEQ ID NO: 89982 - protein, 10 aa, Dengue virus
LYAVATTILT

SEQ ID NO: 89983 - protein, 10 aa, Dengue virus
YAVATTILTP

SEQ ID NO: 89984 - protein, 10 aa, Dengue virus
AVATTILTPM

SEQ ID NO: 89985 - protein, 10 aa, Dengue virus
VATTILTPML

SEQ ID NO: 89986 - protein, 10 aa, Dengue virus
ATTILTPMLR

SEQ ID NO: 89987 - protein, 10 aa, Dengue virus
TTILTPMLRH

SEQ ID NO: 89988 - protein, 10 aa, Dengue virus
TILTPMLRHT

SEQ ID NO: 89989 - protein, 10 aa, Dengue virus
ILTPMLRHTI

SEQ ID NO: 89990 - protein, 10 aa, Dengue virus
LTPMLRHTIE

SEQ ID NO: 89991 - protein, 10 aa, Dengue virus
TPMLRHTIEN

SEQ ID NO: 89992 - protein, 10 aa, Dengue virus
PMLRHTIENT

SEQ ID NO: 89993 - protein, 10 aa, Dengue virus
MLRHTIENTS

SEQ ID NO: 89994 - protein, 10 aa, Dengue virus
LRHTIENTSA

SEQ ID NO: 89995 - protein, 10 aa, Dengue virus
RHTIENTSAN

SEQ ID NO: 89996 - protein, 10 aa, Dengue virus
HTIENTSANL

SEQ ID NO: 89997 - protein, 10 aa, Dengue virus
TIENTSANLS

SEQ ID NO: 89998 - protein, 10 aa, Dengue virus
IENTSANLSL

SEQ ID NO: 89999 - protein, 10 aa, Dengue virus
ENTSANLSLA

SEQ ID NO: 90000 - protein, 10 aa, Dengue virus
NTSANLSLAA

SEQ ID NO: 90001 - protein, 10 aa, Dengue virus
TSANLSLAAI

SEQ ID NO: 90002 - protein, 10 aa, Dengue virus
SANLSLAAIA

SEQ ID NO: 90003 - protein, 10 aa, Dengue virus
ANLSLAAIAN

SEQ ID NO: 90004 - protein, 10 aa, Dengue virus
NLSLAAIANQ

SEQ ID NO: 90005 - protein, 10 aa, Dengue virus
LSLAAIANQA

SEQ ID NO: 90006 - protein, 10 aa, Dengue virus
SLAAIANQAA

SEQ ID NO: 90007 - protein, 10 aa, Dengue virus
LAAIANQAAV

SEQ ID NO: 90008 - protein, 10 aa, Dengue virus
AAIANQAAVL

SEQ ID NO: 90009 - protein, 10 aa, Dengue virus
AIANQAAVLM

SEQ ID NO: 90010 - protein, 10 aa, Dengue virus
IANQAAVLMG

SEQ ID NO: 90011 - protein, 10 aa, Dengue virus
ANQAAVLMGL

SEQ ID NO: 90012 - protein, 10 aa, Dengue virus
NQAAVLMGLG

SEQ ID NO: 90013 - protein, 10 aa, Dengue virus
QAAVLMGLGK

SEQ ID NO: 90014 - protein, 10 aa, Dengue virus
AAVLMGLGKG

SEQ ID NO: 90015 - protein, 10 aa, Dengue virus
AVLMGLGKGW

SEQ ID NO: 90016 - protein, 10 aa, Dengue virus
VLMGLGKGWP

SEQ ID NO: 90017 - protein, 10 aa, Dengue virus
LMGLGKGWPL

SEQ ID NO: 90018 - protein, 10 aa, Dengue virus
MGLGKGWPLH

SEQ ID NO: 90019 - protein, 10 aa, Dengue virus
GLGKGWPLHR

SEQ ID NO: 90020 - protein, 10 aa, Dengue virus
LGKGWPLHRM

SEQ ID NO: 90021 - protein, 10 aa, Dengue virus
GKGWPLHRMD

SEQ ID NO: 90022 - protein, 10 aa, Dengue virus
KGWPLHRMDL

SEQ ID NO: 90023 - protein, 10 aa, Dengue virus
GWPLHRMDLG

SEQ ID NO: 90024 - protein, 10 aa, Dengue virus
WPLHRMDLGV

SEQ ID NO: 90025 - protein, 10 aa, Dengue virus
PLHRMDLGVP

SEQ ID NO: 90026 - protein, 10 aa, Dengue virus
LHRMDLGVPL

SEQ ID NO: 90027 - protein, 10 aa, Dengue virus
HRMDLGVPLL

SEQ ID NO: 90028 - protein, 10 aa, Dengue virus
RMDLGVPLLA

SEQ ID NO: 90029 - protein, 10 aa, Dengue virus
MDLGVPLLAM

SEQ ID NO: 90030 - protein, 10 aa, Dengue virus
DLGVPLLAMG

SEQ ID NO: 90031 - protein, 10 aa, Dengue virus
LGVPLLAMGC

SEQ ID NO: 90032 - protein, 10 aa, Dengue virus
GVPLLAMGCY

SEQ ID NO: 90033 - protein, 10 aa, Dengue virus
VPLLAMGCYS

SEQ ID NO: 90034 - protein, 10 aa, Dengue virus
PLLAMGCYSQ

SEQ ID NO: 90035 - protein, 10 aa, Dengue virus
LLAMGCYSQV

SEQ ID NO: 90036 - protein, 10 aa, Dengue virus
LAMGCYSQVN

SEQ ID NO: 90037 - protein, 10 aa, Dengue virus
AMGCYSQVNP

SEQ ID NO: 90038 - protein, 10 aa, Dengue virus
MGCYSQVNPT

SEQ ID NO: 90039 - protein, 10 aa, Dengue virus
GCYSQVNPTT

SEQ ID NO: 90040 - protein, 10 aa, Dengue virus
CYSQVNPTTL

SEQ ID NO: 90041 - protein, 10 aa, Dengue virus
YSQVNPTTLT

SEQ ID NO: 90042 - protein, 10 aa, Dengue virus
SQVNPTTLTA

SEQ ID NO: 90043 - protein, 10 aa, Dengue virus
QVNPTTLTAS

SEQ ID NO: 90044 - protein, 10 aa, Dengue virus
VNPTTLTASL

SEQ ID NO: 90045 - protein, 10 aa, Dengue virus
NPTTLTASLV

SEQ ID NO: 90046 - protein, 10 aa, Dengue virus
PTTLTASLVM

SEQ ID NO: 90047 - protein, 10 aa, Dengue virus
TTLTASLVML

SEQ ID NO: 90048 - protein, 10 aa, Dengue virus
TLTASLVMLL

SEQ ID NO: 90049 - protein, 10 aa, Dengue virus
LTASLVMLLV

SEQ ID NO: 90050 - protein, 10 aa, Dengue virus
TASLVMLLVH

SEQ ID NO: 90051 - protein, 10 aa, Dengue virus
ASLVMLLVHY

SEQ ID NO: 90052 - protein, 10 aa, Dengue virus
SLVMLLVHYA

SEQ ID NO: 90053 - protein, 10 aa, Dengue virus
LVMLLVHYAI

SEQ ID NO: 90054 - protein, 10 aa, Dengue virus
VMLLVHYAII

SEQ ID NO: 90055 - protein, 10 aa, Dengue virus
MLLVHYAIIG

SEQ ID NO: 90056 - protein, 10 aa, Dengue virus
LLVHYAIIGP

SEQ ID NO: 90057 - protein, 10 aa, Dengue virus
LVHYAIIGPG

SEQ ID NO: 90058 - protein, 10 aa, Dengue virus
VHYAIIGPGL

SEQ ID NO: 90059 - protein, 10 aa, Dengue virus
HYAIIGPGLQ

SEQ ID NO: 90060 - protein, 10 aa, Dengue virus
YAIIGPGLQA

SEQ ID NO: 90061 - protein, 10 aa, Dengue virus
AIIGPGLQAK

SEQ ID NO: 90062 - protein, 10 aa, Dengue virus
IIGPGLQAKA

SEQ ID NO: 90063 - protein, 10 aa, Dengue virus
IGPGLQAKAT

SEQ ID NO: 90064 - protein, 10 aa, Dengue virus
GPGLQAKATR

SEQ ID NO: 90065 - protein, 10 aa, Dengue virus
PGLQAKATRE

SEQ ID NO: 90066 - protein, 10 aa, Dengue virus
GLQAKATREA

SEQ ID NO: 90067 - protein, 10 aa, Dengue virus
LQAKATREAQ

SEQ ID NO: 90068 - protein, 10 aa, Dengue virus
QAKATREAQK

SEQ ID NO: 90069 - protein, 10 aa, Dengue virus
AKATREAQKR

SEQ ID NO: 90070 - protein, 10 aa, Dengue virus
KATREAQKRT

SEQ ID NO: 90071 - protein, 10 aa, Dengue virus
ATREAQKRTA

SEQ ID NO: 90072 - protein, 10 aa, Dengue virus
TREAQKRTAA

SEQ ID NO: 90073 - protein, 10 aa, Dengue virus
REAQKRTAAG

SEQ ID NO: 90074 - protein, 10 aa, Dengue virus
EAQKRTAAGI

SEQ ID NO: 90075 - protein, 10 aa, Dengue virus
AQKRTAAGIM

SEQ ID NO: 90076 - protein, 10 aa, Dengue virus
QKRTAAGIMK

SEQ ID NO: 90077 - protein, 10 aa, Dengue virus
KRTAAGIMKN

SEQ ID NO: 90078 - protein, 10 aa, Dengue virus
RTAAGIMKNP

SEQ ID NO: 90079 - protein, 10 aa, Dengue virus
TAAGIMKNPT

SEQ ID NO: 90080 - protein, 10 aa, Dengue virus
AAGIMKNPTV

SEQ ID NO: 90081 - protein, 10 aa, Dengue virus
AGIMKNPTVD

SEQ ID NO: 90082 - protein, 10 aa, Dengue virus
GIMKNPTVDG

SEQ ID NO: 90083 - protein, 10 aa, Dengue virus
IMKNPTVDGI

SEQ ID NO: 90084 - protein, 10 aa, Dengue virus
MKNPTVDGIT

SEQ ID NO: 90085 - protein, 10 aa, Dengue virus
KNPTVDGITV

SEQ ID NO: 90086 - protein, 10 aa, Dengue virus
NPTVDGITVI

SEQ ID NO: 90087 - protein, 10 aa, Dengue virus
PTVDGITVID

SEQ ID NO: 90088 - protein, 10 aa, Dengue virus
TVDGITVIDL

SEQ ID NO: 90089 - protein, 10 aa, Dengue virus
VDGITVIDLE

SEQ ID NO: 90090 - protein, 10 aa, Dengue virus
DGITVIDLEP

SEQ ID NO: 90091 - protein, 10 aa, Dengue virus
GITVIDLEPI

SEQ ID NO: 90092 - protein, 10 aa, Dengue virus
ITVIDLEPIS

SEQ ID NO: 90093 - protein, 10 aa, Dengue virus
TVIDLEPISY

SEQ ID NO: 90094 - protein, 10 aa, Dengue virus
VIDLEPISYD

SEQ ID NO: 90095 - protein, 10 aa, Dengue virus
IDLEPISYDP

SEQ ID NO: 90096 - protein, 10 aa, Dengue virus
DLEPISYDPK

SEQ ID NO: 90097 - protein, 10 aa, Dengue virus
LEPISYDPKF

SEQ ID NO: 90098 - protein, 10 aa, Dengue virus
EPISYDPKFE

SEQ ID NO: 90099 - protein, 10 aa, Dengue virus
PISYDPKFEK

SEQ ID NO: 90100 - protein, 10 aa, Dengue virus
ISYDPKFEKQ

SEQ ID NO: 90101 - protein, 10 aa, Dengue virus
SYDPKFEKQL

SEQ ID NO: 90102 - protein, 10 aa, Dengue virus
YDPKFEKQLG

SEQ ID NO: 90103 - protein, 10 aa, Dengue virus
DPKFEKQLGQ

SEQ ID NO: 90104 - protein, 10 aa, Dengue virus
PKFEKQLGQV

SEQ ID NO: 90105 - protein, 10 aa, Dengue virus
KFEKQLGQVM

SEQ ID NO: 90106 - protein, 10 aa, Dengue virus
FEKQLGQVML

SEQ ID NO: 90107 - protein, 10 aa, Dengue virus
EKQLGQVMLL

SEQ ID NO: 90108 - protein, 10 aa, Dengue virus
KQLGQVMLLV

SEQ ID NO: 90109 - protein, 10 aa, Dengue virus
QLGQVMLLVL

SEQ ID NO: 90110 - protein, 10 aa, Dengue virus
LGQVMLLVLC

SEQ ID NO: 90111 - protein, 10 aa, Dengue virus
GQVMLLVLCA

SEQ ID NO: 90112 - protein, 10 aa, Dengue virus
QVMLLVLCAG

SEQ ID NO: 90113 - protein, 10 aa, Dengue virus
VMLLVLCAGQ

SEQ ID NO: 90114 - protein, 10 aa, Dengue virus
MLLVLCAGQL

SEQ ID NO: 90115 - protein, 10 aa, Dengue virus
LLVLCAGQLL

SEQ ID NO: 90116 - protein, 10 aa, Dengue virus
LVLCAGQLLL

SEQ ID NO: 90117 - protein, 10 aa, Dengue virus
VLCAGQLLLM

SEQ ID NO: 90118 - protein, 10 aa, Dengue virus
LCAGQLLLMR

SEQ ID NO: 90119 - protein, 10 aa, Dengue virus
CAGQLLLMRT

SEQ ID NO: 90120 - protein, 10 aa, Dengue virus
AGQLLLMRTT

SEQ ID NO: 90121 - protein, 10 aa, Dengue virus
GQLLLMRTTW

SEQ ID NO: 90122 - protein, 10 aa, Dengue virus
QLLLMRTTWA

SEQ ID NO: 90123 - protein, 10 aa, Dengue virus
LLLMRTTWAF

SEQ ID NO: 90124 - protein, 10 aa, Dengue virus
LLMRTTWAFC

SEQ ID NO: 90125 - protein, 10 aa, Dengue virus
LMRTTWAFCE

SEQ ID NO: 90126 - protein, 10 aa, Dengue virus
MRTTWAFCEV

SEQ ID NO: 90127 - protein, 10 aa, Dengue virus
RTTWAFCEVL

SEQ ID NO: 90128 - protein, 10 aa, Dengue virus
TTWAFCEVLT

SEQ ID NO: 90129 - protein, 10 aa, Dengue virus
TWAFCEVLTL

SEQ ID NO: 90130 - protein, 10 aa, Dengue virus
WAFCEVLTLA

SEQ ID NO: 90131 - protein, 10 aa, Dengue virus
AFCEVLTLAT

SEQ ID NO: 90132 - protein, 10 aa, Dengue virus
FCEVLTLATG

SEQ ID NO: 90133 - protein, 10 aa, Dengue virus
CEVLTLATGP

SEQ ID NO: 90134 - protein, 10 aa, Dengue virus
EVLTLATGPI

SEQ ID NO: 90135 - protein, 10 aa, Dengue virus
VLTLATGPIL

SEQ ID NO: 90136 - protein, 10 aa, Dengue virus
LTLATGPILT

SEQ ID NO: 90137 - protein, 10 aa, Dengue virus
TLATGPILTL

SEQ ID NO: 90138 - protein, 10 aa, Dengue virus
LATGPILTLW

SEQ ID NO: 90139 - protein, 10 aa, Dengue virus
ATGPILTLWE

SEQ ID NO: 90140 - protein, 10 aa, Dengue virus
TGPILTLWEG

SEQ ID NO: 90141 - protein, 10 aa, Dengue virus
GPILTLWEGN

SEQ ID NO: 90142 - protein, 10 aa, Dengue virus
PILTLWEGNP

SEQ ID NO: 90143 - protein, 10 aa, Dengue virus
ILTLWEGNPG

SEQ ID NO: 90144 - protein, 10 aa, Dengue virus
LTLWEGNPGR

SEQ ID NO: 90145 - protein, 10 aa, Dengue virus
TLWEGNPGRF

SEQ ID NO: 90146 - protein, 10 aa, Dengue virus
LWEGNPGRFW

SEQ ID NO: 90147 - protein, 10 aa, Dengue virus
WEGNPGRFWN

SEQ ID NO: 90148 - protein, 10 aa, Dengue virus
EGNPGRFWNT

SEQ ID NO: 90149 - protein, 10 aa, Dengue virus
GNPGRFWNTT

SEQ ID NO: 90150 - protein, 10 aa, Dengue virus
NPGRFWNTTI

SEQ ID NO: 90151 - protein, 10 aa, Dengue virus
PGRFWNTTIA

SEQ ID NO: 90152 - protein, 10 aa, Dengue virus
GRFWNTTIAV

SEQ ID NO: 90153 - protein, 10 aa, Dengue virus
RFWNTTIAVS

SEQ ID NO: 90154 - protein, 10 aa, Dengue virus
FWNTTIAVST

SEQ ID NO: 90155 - protein, 10 aa, Dengue virus
WNTTIAVSTA

SEQ ID NO: 90156 - protein, 10 aa, Dengue virus
NTTIAVSTAN

SEQ ID NO: 90157 - protein, 10 aa, Dengue virus
TTIAVSTANI

SEQ ID NO: 90158 - protein, 10 aa, Dengue virus
TIAVSTANIF

SEQ ID NO: 90159 - protein, 10 aa, Dengue virus
IAVSTANIFR

SEQ ID NO: 90160 - protein, 10 aa, Dengue virus
AVSTANIFRG

SEQ ID NO: 90161 - protein, 10 aa, Dengue virus
VSTANIFRGS

SEQ ID NO: 90162 - protein, 10 aa, Dengue virus
STANIFRGSY

SEQ ID NO: 90163 - protein, 10 aa, Dengue virus
TANIFRGSYL

SEQ ID NO: 90164 - protein, 10 aa, Dengue virus
ANIFRGSYLA

SEQ ID NO: 90165 - protein, 10 aa, Dengue virus
NIFRGSYLAG

SEQ ID NO: 90166 - protein, 10 aa, Dengue virus
IFRGSYLAGA

SEQ ID NO: 90167 - protein, 10 aa, Dengue virus
FRGSYLAGAG

SEQ ID NO: 90168 - protein, 10 aa, Dengue virus
RGSYLAGAGL

SEQ ID NO: 90169 - protein, 10 aa, Dengue virus
GSYLAGAGLA

SEQ ID NO: 90170 - protein, 10 aa, Dengue virus
SYLAGAGLAF

SEQ ID NO: 90171 - protein, 10 aa, Dengue virus
YLAGAGLAFS

SEQ ID NO: 90172 - protein, 10 aa, Dengue virus
LAGAGLAFSL

SEQ ID NO: 90173 - protein, 10 aa, Dengue virus
AGAGLAFSLI

SEQ ID NO: 90174 - protein, 10 aa, Dengue virus
GAGLAFSLIK

SEQ ID NO: 90175 - protein, 10 aa, Dengue virus
AGLAFSLIKN

SEQ ID NO: 90176 - protein, 10 aa, Dengue virus
GLAFSLIKNA

SEQ ID NO: 90177 - protein, 10 aa, Dengue virus
LAFSLIKNAQ

SEQ ID NO: 90178 - protein, 10 aa, Dengue virus
AFSLIKNAQT

SEQ ID NO: 90179 - protein, 10 aa, Dengue virus
FSLIKNAQTP

SEQ ID NO: 90180 - protein, 10 aa, Dengue virus
SLIKNAQTPR

SEQ ID NO: 90181 - protein, 10 aa, Dengue virus
LIKNAQTPRR

SEQ ID NO: 90182 - protein, 10 aa, Dengue virus
IKNAQTPRRG

SEQ ID NO: 90183 - protein, 10 aa, Dengue virus
KNAQTPRRGT

SEQ ID NO: 90184 - protein, 10 aa, Dengue virus
NAQTPRRGTG

SEQ ID NO: 90185 - protein, 10 aa, Dengue virus
AQTPRRGTGT

SEQ ID NO: 90186 - protein, 10 aa, Dengue virus
QTPRRGTGTT

SEQ ID NO: 90187 - protein, 10 aa, Dengue virus
TPRRGTGTTG

SEQ ID NO: 90188 - protein, 10 aa, Dengue virus
PRRGTGTTGE

SEQ ID NO: 90189 - protein, 10 aa, Dengue virus
RRGTGTTGET

SEQ ID NO: 90190 - protein, 10 aa, Dengue virus
RGTGTTGETL

SEQ ID NO: 90191 - protein, 10 aa, Dengue virus
GTGTTGETLG

SEQ ID NO: 90192 - protein, 10 aa, Dengue virus
TGTTGETLGE

SEQ ID NO: 90193 - protein, 10 aa, Dengue virus
GTTGETLGEK

SEQ ID NO: 90194 - protein, 10 aa, Dengue virus
TTGETLGEKW

SEQ ID NO: 90195 - protein, 10 aa, Dengue virus
TGETLGEKWK

SEQ ID NO: 90196 - protein, 10 aa, Dengue virus
GETLGEKWKR

SEQ ID NO: 90197 - protein, 10 aa, Dengue virus
ETLGEKWKRQ

SEQ ID NO: 90198 - protein, 10 aa, Dengue virus
TLGEKWKRQL

SEQ ID NO: 90199 - protein, 10 aa, Dengue virus
LGEKWKRQLN

SEQ ID NO: 90200 - protein, 10 aa, Dengue virus
GEKWKRQLNS

SEQ ID NO: 90201 - protein, 10 aa, Dengue virus
EKWKRQLNSL

SEQ ID NO: 90202 - protein, 10 aa, Dengue virus
KWKRQLNSLD

SEQ ID NO: 90203 - protein, 10 aa, Dengue virus
WKRQLNSLDR

SEQ ID NO: 90204 - protein, 10 aa, Dengue virus
KRQLNSLDRK

SEQ ID NO: 90205 - protein, 10 aa, Dengue virus
RQLNSLDRKE

SEQ ID NO: 90206 - protein, 10 aa, Dengue virus
QLNSLDRKEF

SEQ ID NO: 90207 - protein, 10 aa, Dengue virus
LNSLDRKEFE

SEQ ID NO: 90208 - protein, 10 aa, Dengue virus
NSLDRKEFEE

SEQ ID NO: 90209 - protein, 10 aa, Dengue virus
SLDRKEFEEY

SEQ ID NO: 90210 - protein, 10 aa, Dengue virus
LDRKEFEEYK

SEQ ID NO: 90211 - protein, 10 aa, Dengue virus
DRKEFEEYKR

SEQ ID NO: 90212 - protein, 10 aa, Dengue virus
RKEFEEYKRS

SEQ ID NO: 90213 - protein, 10 aa, Dengue virus
KEFEEYKRSG

SEQ ID NO: 90214 - protein, 10 aa, Dengue virus
EFEEYKRSGI

SEQ ID NO: 90215 - protein, 10 aa, Dengue virus
FEEYKRSGIL

SEQ ID NO: 90216 - protein, 10 aa, Dengue virus
EEYKRSGILE

SEQ ID NO: 90217 - protein, 10 aa, Dengue virus
EYKRSGILEV

SEQ ID NO: 90218 - protein, 10 aa, Dengue virus
YKRSGILEVD

SEQ ID NO: 90219 - protein, 10 aa, Dengue virus
KRSGILEVDR

SEQ ID NO: 90220 - protein, 10 aa, Dengue virus
RSGILEVDRT

SEQ ID NO: 90221 - protein, 10 aa, Dengue virus
SGILEVDRTE

SEQ ID NO: 90222 - protein, 10 aa, Dengue virus
GILEVDRTEA

SEQ ID NO: 90223 - protein, 10 aa, Dengue virus
ILEVDRTEAK

SEQ ID NO: 90224 - protein, 10 aa, Dengue virus
LEVDRTEAKS

SEQ ID NO: 90225 - protein, 10 aa, Dengue virus
EVDRTEAKSA

SEQ ID NO: 90226 - protein, 10 aa, Dengue virus
VDRTEAKSAL

SEQ ID NO: 90227 - protein, 10 aa, Dengue virus
DRTEAKSALK

SEQ ID NO: 90228 - protein, 10 aa, Dengue virus
RTEAKSALKD

SEQ ID NO: 90229 - protein, 10 aa, Dengue virus
TEAKSALKDG

SEQ ID NO: 90230 - protein, 10 aa, Dengue virus
EAKSALKDGS

SEQ ID NO: 90231 - protein, 10 aa, Dengue virus
AKSALKDGSK

SEQ ID NO: 90232 - protein, 10 aa, Dengue virus
KSALKDGSKI

SEQ ID NO: 90233 - protein, 10 aa, Dengue virus
SALKDGSKIK

SEQ ID NO: 90234 - protein, 10 aa, Dengue virus
ALKDGSKIKH

SEQ ID NO: 90235 - protein, 10 aa, Dengue virus
LKDGSKIKHA

SEQ ID NO: 90236 - protein, 10 aa, Dengue virus
KDGSKIKHAV

SEQ ID NO: 90237 - protein, 10 aa, Dengue virus
DGSKIKHAVS

SEQ ID NO: 90238 - protein, 10 aa, Dengue virus
GSKIKHAVSR

SEQ ID NO: 90239 - protein, 10 aa, Dengue virus
SKIKHAVSRG

SEQ ID NO: 90240 - protein, 10 aa, Dengue virus
KIKHAVSRGS

SEQ ID NO: 90241 - protein, 10 aa, Dengue virus
IKHAVSRGSS

SEQ ID NO: 90242 - protein, 10 aa, Dengue virus
KHAVSRGSSK

SEQ ID NO: 90243 - protein, 10 aa, Dengue virus
HAVSRGSSKI

SEQ ID NO: 90244 - protein, 10 aa, Dengue virus
AVSRGSSKIR

SEQ ID NO: 90245 - protein, 10 aa, Dengue virus
VSRGSSKIRW

SEQ ID NO: 90246 - protein, 10 aa, Dengue virus
SRGSSKIRWI

SEQ ID NO: 90247 - protein, 10 aa, Dengue virus
RGSSKIRWIV

SEQ ID NO: 90248 - protein, 10 aa, Dengue virus
GSSKIRWIVE

SEQ ID NO: 90249 - protein, 10 aa, Dengue virus
SSKIRWIVER

SEQ ID NO: 90250 - protein, 10 aa, Dengue virus
SKIRWIVERG

SEQ ID NO: 90251 - protein, 10 aa, Dengue virus
KIRWIVERGM

SEQ ID NO: 90252 - protein, 10 aa, Dengue virus
IRWIVERGMV

SEQ ID NO: 90253 - protein, 10 aa, Dengue virus
RWIVERGMVK

SEQ ID NO: 90254 - protein, 10 aa, Dengue virus
WIVERGMVKP

SEQ ID NO: 90255 - protein, 10 aa, Dengue virus
IVERGMVKPK

SEQ ID NO: 90256 - protein, 10 aa, Dengue virus
VERGMVKPKG

SEQ ID NO: 90257 - protein, 10 aa, Dengue virus
ERGMVKPKGK

SEQ ID NO: 90258 - protein, 10 aa, Dengue virus
RGMVKPKGKV

SEQ ID NO: 90259 - protein, 10 aa, Dengue virus
GMVKPKGKVV

SEQ ID NO: 90260 - protein, 10 aa, Dengue virus
MVKPKGKVVD

SEQ ID NO: 90261 - protein, 10 aa, Dengue virus
VKPKGKVVDL

SEQ ID NO: 90262 - protein, 10 aa, Dengue virus
KPKGKVVDLG

SEQ ID NO: 90263 - protein, 10 aa, Dengue virus
PKGKVVDLGC

SEQ ID NO: 90264 - protein, 10 aa, Dengue virus
KGKVVDLGCG

SEQ ID NO: 90265 - protein, 10 aa, Dengue virus
GKVVDLGCGR

SEQ ID NO: 90266 - protein, 10 aa, Dengue virus
KVVDLGCGRG

SEQ ID NO: 90267 - protein, 10 aa, Dengue virus
VVDLGCGRGG

SEQ ID NO: 90268 - protein, 10 aa, Dengue virus
VDLGCGRGGW

SEQ ID NO: 90269 - protein, 10 aa, Dengue virus
DLGCGRGGWS

SEQ ID NO: 90270 - protein, 10 aa, Dengue virus
LGCGRGGWSY

SEQ ID NO: 90271 - protein, 10 aa, Dengue virus
GCGRGGWSYY

SEQ ID NO: 90272 - protein, 10 aa, Dengue virus
CGRGGWSYYM

SEQ ID NO: 90273 - protein, 10 aa, Dengue virus
GRGGWSYYMA

SEQ ID NO: 90274 - protein, 10 aa, Dengue virus
RGGWSYYMAT

SEQ ID NO: 90275 - protein, 10 aa, Dengue virus
GGWSYYMATL

SEQ ID NO: 90276 - protein, 10 aa, Dengue virus
GWSYYMATLK

SEQ ID NO: 90277 - protein, 10 aa, Dengue virus
WSYYMATLKN

SEQ ID NO: 90278 - protein, 10 aa, Dengue virus
SYYMATLKNV

SEQ ID NO: 90279 - protein, 10 aa, Dengue virus
YYMATLKNVT

SEQ ID NO: 90280 - protein, 10 aa, Dengue virus
YMATLKNVTE

SEQ ID NO: 90281 - protein, 10 aa, Dengue virus
MATLKNVTEV

SEQ ID NO: 90282 - protein, 10 aa, Dengue virus
ATLKNVTEVK

SEQ ID NO: 90283 - protein, 10 aa, Dengue virus
TLKNVTEVKG

SEQ ID NO: 90284 - protein, 10 aa, Dengue virus
LKNVTEVKGY

SEQ ID NO: 90285 - protein, 10 aa, Dengue virus
KNVTEVKGYT

SEQ ID NO: 90286 - protein, 10 aa, Dengue virus
NVTEVKGYTK

SEQ ID NO: 90287 - protein, 10 aa, Dengue virus
VTEVKGYTKG

SEQ ID NO: 90288 - protein, 10 aa, Dengue virus
TEVKGYTKGG

SEQ ID NO: 90289 - protein, 10 aa, Dengue virus
EVKGYTKGGP

SEQ ID NO: 90290 - protein, 10 aa, Dengue virus
VKGYTKGGPG

SEQ ID NO: 90291 - protein, 10 aa, Dengue virus
KGYTKGGPGH

SEQ ID NO: 90292 - protein, 10 aa, Dengue virus
GYTKGGPGHE

SEQ ID NO: 90293 - protein, 10 aa, Dengue virus
YTKGGPGHEE

SEQ ID NO: 90294 - protein, 10 aa, Dengue virus
TKGGPGHEEP

SEQ ID NO: 90295 - protein, 10 aa, Dengue virus
KGGPGHEEPI

SEQ ID NO: 90296 - protein, 10 aa, Dengue virus
GGPGHEEPIP

SEQ ID NO: 90297 - protein, 10 aa, Dengue virus
GPGHEEPIPM

SEQ ID NO: 90298 - protein, 10 aa, Dengue virus
PGHEEPIPMA

SEQ ID NO: 90299 - protein, 10 aa, Dengue virus
GHEEPIPMAT

SEQ ID NO: 90300 - protein, 10 aa, Dengue virus
HEEPIPMATY

SEQ ID NO: 90301 - protein, 10 aa, Dengue virus
EEPIPMATYG

SEQ ID NO: 90302 - protein, 10 aa, Dengue virus
EPIPMATYGW

SEQ ID NO: 90303 - protein, 10 aa, Dengue virus
PIPMATYGWN

SEQ ID NO: 90304 - protein, 10 aa, Dengue virus
IPMATYGWNL

SEQ ID NO: 90305 - protein, 10 aa, Dengue virus
PMATYGWNLV

SEQ ID NO: 90306 - protein, 10 aa, Dengue virus
MATYGWNLVK

SEQ ID NO: 90307 - protein, 10 aa, Dengue virus
ATYGWNLVKL

SEQ ID NO: 90308 - protein, 10 aa, Dengue virus
TYGWNLVKLH

SEQ ID NO: 90309 - protein, 10 aa, Dengue virus
YGWNLVKLHS

SEQ ID NO: 90310 - protein, 10 aa, Dengue virus
GWNLVKLHSG

SEQ ID NO: 90311 - protein, 10 aa, Dengue virus
WNLVKLHSGV

SEQ ID NO: 90312 - protein, 10 aa, Dengue virus
NLVKLHSGVD

SEQ ID NO: 90313 - protein, 10 aa, Dengue virus
LVKLHSGVDV

SEQ ID NO: 90314 - protein, 10 aa, Dengue virus
VKLHSGVDVF

SEQ ID NO: 90315 - protein, 10 aa, Dengue virus
KLHSGVDVFY

SEQ ID NO: 90316 - protein, 10 aa, Dengue virus
LHSGVDVFYK

SEQ ID NO: 90317 - protein, 10 aa, Dengue virus
HSGVDVFYKP

SEQ ID NO: 90318 - protein, 10 aa, Dengue virus
SGVDVFYKPT

SEQ ID NO: 90319 - protein, 10 aa, Dengue virus
GVDVFYKPTE

SEQ ID NO: 90320 - protein, 10 aa, Dengue virus
VDVFYKPTEQ

SEQ ID NO: 90321 - protein, 10 aa, Dengue virus
DVFYKPTEQV

SEQ ID NO: 90322 - protein, 10 aa, Dengue virus
VFYKPTEQVD

SEQ ID NO: 90323 - protein, 10 aa, Dengue virus
FYKPTEQVDT

SEQ ID NO: 90324 - protein, 10 aa, Dengue virus
YKPTEQVDTL

SEQ ID NO: 90325 - protein, 10 aa, Dengue virus
KPTEQVDTLL

SEQ ID NO: 90326 - protein, 10 aa, Dengue virus
PTEQVDTLLC

SEQ ID NO: 90327 - protein, 10 aa, Dengue virus
TEQVDTLLCD

SEQ ID NO: 90328 - protein, 10 aa, Dengue virus
EQVDTLLCDI

SEQ ID NO: 90329 - protein, 10 aa, Dengue virus
QVDTLLCDIG

SEQ ID NO: 90330 - protein, 10 aa, Dengue virus
VDTLLCDIGE

SEQ ID NO: 90331 - protein, 10 aa, Dengue virus
DTLLCDIGES

SEQ ID NO: 90332 - protein, 10 aa, Dengue virus
TLLCDIGESS

SEQ ID NO: 90333 - protein, 10 aa, Dengue virus
LLCDIGESSS

SEQ ID NO: 90334 - protein, 10 aa, Dengue virus
LCDIGESSSN

SEQ ID NO: 90335 - protein, 10 aa, Dengue virus
CDIGESSSNP

SEQ ID NO: 90336 - protein, 10 aa, Dengue virus
DIGESSSNPT

SEQ ID NO: 90337 - protein, 10 aa, Dengue virus
IGESSSNPTI

SEQ ID NO: 90338 - protein, 10 aa, Dengue virus
GESSSNPTIE

SEQ ID NO: 90339 - protein, 10 aa, Dengue virus
ESSSNPTIEE

SEQ ID NO: 90340 - protein, 10 aa, Dengue virus
SSSNPTIEEG

SEQ ID NO: 90341 - protein, 10 aa, Dengue virus
SSNPTIEEGR

SEQ ID NO: 90342 - protein, 10 aa, Dengue virus
SNPTIEEGRT

SEQ ID NO: 90343 - protein, 10 aa, Dengue virus
NPTIEEGRTL

SEQ ID NO: 90344 - protein, 10 aa, Dengue virus
PTIEEGRTLR

SEQ ID NO: 90345 - protein, 10 aa, Dengue virus
TIEEGRTLRV

SEQ ID NO: 90346 - protein, 10 aa, Dengue virus
IEEGRTLRVL

SEQ ID NO: 90347 - protein, 10 aa, Dengue virus
EEGRTLRVLK

SEQ ID NO: 90348 - protein, 10 aa, Dengue virus
EGRTLRVLKM

SEQ ID NO: 90349 - protein, 10 aa, Dengue virus
GRTLRVLKMV

SEQ ID NO: 90350 - protein, 10 aa, Dengue virus
RTLRVLKMVE

SEQ ID NO: 90351 - protein, 10 aa, Dengue virus
TLRVLKMVEP

SEQ ID NO: 90352 - protein, 10 aa, Dengue virus
LRVLKMVEPW

SEQ ID NO: 90353 - protein, 10 aa, Dengue virus
RVLKMVEPWL

SEQ ID NO: 90354 - protein, 10 aa, Dengue virus
VLKMVEPWLS

SEQ ID NO: 90355 - protein, 10 aa, Dengue virus
LKMVEPWLSS

SEQ ID NO: 90356 - protein, 10 aa, Dengue virus
KMVEPWLSSK

SEQ ID NO: 90357 - protein, 10 aa, Dengue virus
MVEPWLSSKP

SEQ ID NO: 90358 - protein, 10 aa, Dengue virus
VEPWLSSKPE

SEQ ID NO: 90359 - protein, 10 aa, Dengue virus
EPWLSSKPEF

SEQ ID NO: 90360 - protein, 10 aa, Dengue virus
PWLSSKPEFC

SEQ ID NO: 90361 - protein, 10 aa, Dengue virus
WLSSKPEFCI

SEQ ID NO: 90362 - protein, 10 aa, Dengue virus
LSSKPEFCIK

SEQ ID NO: 90363 - protein, 10 aa, Dengue virus
SSKPEFCIKV

SEQ ID NO: 90364 - protein, 10 aa, Dengue virus
SKPEFCIKVL

SEQ ID NO: 90365 - protein, 10 aa, Dengue virus
KPEFCIKVLN

SEQ ID NO: 90366 - protein, 10 aa, Dengue virus
PEFCIKVLNP

SEQ ID NO: 90367 - protein, 10 aa, Dengue virus
EFCIKVLNPY

SEQ ID NO: 90368 - protein, 10 aa, Dengue virus
FCIKVLNPYM

SEQ ID NO: 90369 - protein, 10 aa, Dengue virus
CIKVLNPYMP

SEQ ID NO: 90370 - protein, 10 aa, Dengue virus
IKVLNPYMPT

SEQ ID NO: 90371 - protein, 10 aa, Dengue virus
KVLNPYMPTV

SEQ ID NO: 90372 - protein, 10 aa, Dengue virus
VLNPYMPTVI

SEQ ID NO: 90373 - protein, 10 aa, Dengue virus
LNPYMPTVIE

SEQ ID NO: 90374 - protein, 10 aa, Dengue virus
NPYMPTVIEE

SEQ ID NO: 90375 - protein, 10 aa, Dengue virus
PYMPTVIEEL

SEQ ID NO: 90376 - protein, 10 aa, Dengue virus
YMPTVIEELE

SEQ ID NO: 90377 - protein, 10 aa, Dengue virus
MPTVIEELEK

SEQ ID NO: 90378 - protein, 10 aa, Dengue virus
PTVIEELEKL

SEQ ID NO: 90379 - protein, 10 aa, Dengue virus
TVIEELEKLQ

SEQ ID NO: 90380 - protein, 10 aa, Dengue virus
VIEELEKLQR

SEQ ID NO: 90381 - protein, 10 aa, Dengue virus
IEELEKLQRK

SEQ ID NO: 90382 - protein, 10 aa, Dengue virus
EELEKLQRKH

SEQ ID NO: 90383 - protein, 10 aa, Dengue virus
ELEKLQRKHG

SEQ ID NO: 90384 - protein, 10 aa, Dengue virus
LEKLQRKHGG

SEQ ID NO: 90385 - protein, 10 aa, Dengue virus
EKLQRKHGGN

SEQ ID NO: 90386 - protein, 10 aa, Dengue virus
KLQRKHGGNL

SEQ ID NO: 90387 - protein, 10 aa, Dengue virus
LQRKHGGNLV

SEQ ID NO: 90388 - protein, 10 aa, Dengue virus
QRKHGGNLVR

SEQ ID NO: 90389 - protein, 10 aa, Dengue virus
RKHGGNLVRC

SEQ ID NO: 90390 - protein, 10 aa, Dengue virus
KHGGNLVRCP

SEQ ID NO: 90391 - protein, 10 aa, Dengue virus
HGGNLVRCPL

SEQ ID NO: 90392 - protein, 10 aa, Dengue virus
GGNLVRCPLS

SEQ ID NO: 90393 - protein, 10 aa, Dengue virus
GNLVRCPLSR

SEQ ID NO: 90394 - protein, 10 aa, Dengue virus
NLVRCPLSRN

SEQ ID NO: 90395 - protein, 10 aa, Dengue virus
LVRCPLSRNS

SEQ ID NO: 90396 - protein, 10 aa, Dengue virus
VRCPLSRNST

SEQ ID NO: 90397 - protein, 10 aa, Dengue virus
RCPLSRNSTH

SEQ ID NO: 90398 - protein, 10 aa, Dengue virus
CPLSRNSTHE

SEQ ID NO: 90399 - protein, 10 aa, Dengue virus
PLSRNSTHEM

SEQ ID NO: 90400 - protein, 10 aa, Dengue virus
LSRNSTHEMY

SEQ ID NO: 90401 - protein, 10 aa, Dengue virus
SRNSTHEMYW

SEQ ID NO: 90402 - protein, 10 aa, Dengue virus
RNSTHEMYWV

SEQ ID NO: 90403 - protein, 10 aa, Dengue virus
NSTHEMYWVS

SEQ ID NO: 90404 - protein, 10 aa, Dengue virus
STHEMYWVSG

SEQ ID NO: 90405 - protein, 10 aa, Dengue virus
THEMYWVSGA

SEQ ID NO: 90406 - protein, 10 aa, Dengue virus
HEMYWVSGAS

SEQ ID NO: 90407 - protein, 10 aa, Dengue virus
EMYWVSGASG

SEQ ID NO: 90408 - protein, 10 aa, Dengue virus
MYWVSGASGN

SEQ ID NO: 90409 - protein, 10 aa, Dengue virus
YWVSGASGNI

SEQ ID NO: 90410 - protein, 10 aa, Dengue virus
WVSGASGNIV

SEQ ID NO: 90411 - protein, 10 aa, Dengue virus
VSGASGNIVS

SEQ ID NO: 90412 - protein, 10 aa, Dengue virus
SGASGNIVSS

SEQ ID NO: 90413 - protein, 10 aa, Dengue virus
GASGNIVSSV

SEQ ID NO: 90414 - protein, 10 aa, Dengue virus
ASGNIVSSVN

SEQ ID NO: 90415 - protein, 10 aa, Dengue virus
SGNIVSSVNT

SEQ ID NO: 90416 - protein, 10 aa, Dengue virus
GNIVSSVNTT

SEQ ID NO: 90417 - protein, 10 aa, Dengue virus
NIVSSVNTTS

SEQ ID NO: 90418 - protein, 10 aa, Dengue virus
IVSSVNTTSK

SEQ ID NO: 90419 - protein, 10 aa, Dengue virus
VSSVNTTSKM

SEQ ID NO: 90420 - protein, 10 aa, Dengue virus
SSVNTTSKML

SEQ ID NO: 90421 - protein, 10 aa, Dengue virus
SVNTTSKMLL

SEQ ID NO: 90422 - protein, 10 aa, Dengue virus
VNTTSKMLLN

SEQ ID NO: 90423 - protein, 10 aa, Dengue virus
NTTSKMLLNR

SEQ ID NO: 90424 - protein, 10 aa, Dengue virus
TTSKMLLNRF

SEQ ID NO: 90425 - protein, 10 aa, Dengue virus
TSKMLLNRFT

SEQ ID NO: 90426 - protein, 10 aa, Dengue virus
SKMLLNRFTT

SEQ ID NO: 90427 - protein, 10 aa, Dengue virus
KMLLNRFTTR

SEQ ID NO: 90428 - protein, 10 aa, Dengue virus
MLLNRFTTRH

SEQ ID NO: 90429 - protein, 10 aa, Dengue virus
LLNRFTTRHR

SEQ ID NO: 90430 - protein, 10 aa, Dengue virus
LNRFTTRHRK

SEQ ID NO: 90431 - protein, 10 aa, Dengue virus
NRFTTRHRKP

SEQ ID NO: 90432 - protein, 10 aa, Dengue virus
RFTTRHRKPT

SEQ ID NO: 90433 - protein, 10 aa, Dengue virus
FTTRHRKPTY

SEQ ID NO: 90434 - protein, 10 aa, Dengue virus
TTRHRKPTYE

SEQ ID NO: 90435 - protein, 10 aa, Dengue virus
TRHRKPTYEK

SEQ ID NO: 90436 - protein, 10 aa, Dengue virus
RHRKPTYEKD

SEQ ID NO: 90437 - protein, 10 aa, Dengue virus
HRKPTYEKDV

SEQ ID NO: 90438 - protein, 10 aa, Dengue virus
RKPTYEKDVD

SEQ ID NO: 90439 - protein, 10 aa, Dengue virus
KPTYEKDVDL

SEQ ID NO: 90440 - protein, 10 aa, Dengue virus
PTYEKDVDLG

SEQ ID NO: 90441 - protein, 10 aa, Dengue virus
TYEKDVDLGA

SEQ ID NO: 90442 - protein, 10 aa, Dengue virus
YEKDVDLGAG

SEQ ID NO: 90443 - protein, 10 aa, Dengue virus
EKDVDLGAGT

SEQ ID NO: 90444 - protein, 10 aa, Dengue virus
KDVDLGAGTR

SEQ ID NO: 90445 - protein, 10 aa, Dengue virus
DVDLGAGTRS

SEQ ID NO: 90446 - protein, 10 aa, Dengue virus
VDLGAGTRSV

SEQ ID NO: 90447 - protein, 10 aa, Dengue virus
DLGAGTRSVS

SEQ ID NO: 90448 - protein, 10 aa, Dengue virus
LGAGTRSVST

SEQ ID NO: 90449 - protein, 10 aa, Dengue virus
GAGTRSVSTE

SEQ ID NO: 90450 - protein, 10 aa, Dengue virus
AGTRSVSTET

SEQ ID NO: 90451 - protein, 10 aa, Dengue virus
GTRSVSTETE

SEQ ID NO: 90452 - protein, 10 aa, Dengue virus
TRSVSTETEK

SEQ ID NO: 90453 - protein, 10 aa, Dengue virus
RSVSTETEKP

SEQ ID NO: 90454 - protein, 10 aa, Dengue virus
SVSTETEKPD

SEQ ID NO: 90455 - protein, 10 aa, Dengue virus
VSTETEKPDM

SEQ ID NO: 90456 - protein, 10 aa, Dengue virus
STETEKPDMT

SEQ ID NO: 90457 - protein, 10 aa, Dengue virus
TETEKPDMTI

SEQ ID NO: 90458 - protein, 10 aa, Dengue virus
ETEKPDMTII

SEQ ID NO: 90459 - protein, 10 aa, Dengue virus
TEKPDMTIIG

SEQ ID NO: 90460 - protein, 10 aa, Dengue virus
EKPDMTIIGR

SEQ ID NO: 90461 - protein, 10 aa, Dengue virus
KPDMTIIGRR

SEQ ID NO: 90462 - protein, 10 aa, Dengue virus
PDMTIIGRRL

SEQ ID NO: 90463 - protein, 10 aa, Dengue virus
DMTIIGRRLQ

SEQ ID NO: 90464 - protein, 10 aa, Dengue virus
MTIIGRRLQR

SEQ ID NO: 90465 - protein, 10 aa, Dengue virus
TIIGRRLQRL

SEQ ID NO: 90466 - protein, 10 aa, Dengue virus
IIGRRLQRLQ

SEQ ID NO: 90467 - protein, 10 aa, Dengue virus
IGRRLQRLQE

SEQ ID NO: 90468 - protein, 10 aa, Dengue virus
GRRLQRLQEE

SEQ ID NO: 90469 - protein, 10 aa, Dengue virus
RRLQRLQEEH

SEQ ID NO: 90470 - protein, 10 aa, Dengue virus
RLQRLQEEHK

SEQ ID NO: 90471 - protein, 10 aa, Dengue virus
LQRLQEEHKE

SEQ ID NO: 90472 - protein, 10 aa, Dengue virus
QRLQEEHKET

SEQ ID NO: 90473 - protein, 10 aa, Dengue virus
RLQEEHKETW

SEQ ID NO: 90474 - protein, 10 aa, Dengue virus
LQEEHKETWH

SEQ ID NO: 90475 - protein, 10 aa, Dengue virus
QEEHKETWHY

SEQ ID NO: 90476 - protein, 10 aa, Dengue virus
EEHKETWHYD

SEQ ID NO: 90477 - protein, 10 aa, Dengue virus
EHKETWHYDQ

SEQ ID NO: 90478 - protein, 10 aa, Dengue virus
HKETWHYDQE

SEQ ID NO: 90479 - protein, 10 aa, Dengue virus
KETWHYDQEN

SEQ ID NO: 90480 - protein, 10 aa, Dengue virus
ETWHYDQENP

SEQ ID NO: 90481 - protein, 10 aa, Dengue virus
TWHYDQENPY

SEQ ID NO: 90482 - protein, 10 aa, Dengue virus
WHYDQENPYR

SEQ ID NO: 90483 - protein, 10 aa, Dengue virus
HYDQENPYRT

SEQ ID NO: 90484 - protein, 10 aa, Dengue virus
YDQENPYRTW

SEQ ID NO: 90485 - protein, 10 aa, Dengue virus
DQENPYRTWA

SEQ ID NO: 90486 - protein, 10 aa, Dengue virus
QENPYRTWAY

SEQ ID NO: 90487 - protein, 10 aa, Dengue virus
ENPYRTWAYH

SEQ ID NO: 90488 - protein, 10 aa, Dengue virus
NPYRTWAYHG

SEQ ID NO: 90489 - protein, 10 aa, Dengue virus
PYRTWAYHGS

SEQ ID NO: 90490 - protein, 10 aa, Dengue virus
YRTWAYHGSY

SEQ ID NO: 90491 - protein, 10 aa, Dengue virus
RTWAYHGSYE

SEQ ID NO: 90492 - protein, 10 aa, Dengue virus
TWAYHGSYEA

SEQ ID NO: 90493 - protein, 10 aa, Dengue virus
WAYHGSYEAP

SEQ ID NO: 90494 - protein, 10 aa, Dengue virus
AYHGSYEAPS

SEQ ID NO: 90495 - protein, 10 aa, Dengue virus
YHGSYEAPST

SEQ ID NO: 90496 - protein, 10 aa, Dengue virus
HGSYEAPSTG

SEQ ID NO: 90497 - protein, 10 aa, Dengue virus
GSYEAPSTGS

SEQ ID NO: 90498 - protein, 10 aa, Dengue virus
SYEAPSTGSA

SEQ ID NO: 90499 - protein, 10 aa, Dengue virus
YEAPSTGSAS

SEQ ID NO: 90500 - protein, 10 aa, Dengue virus
EAPSTGSASS

SEQ ID NO: 90501 - protein, 10 aa, Dengue virus
APSTGSASSM

SEQ ID NO: 90502 - protein, 10 aa, Dengue virus
PSTGSASSMV

SEQ ID NO: 90503 - protein, 10 aa, Dengue virus
STGSASSMVN

SEQ ID NO: 90504 - protein, 10 aa, Dengue virus
TGSASSMVNG

SEQ ID NO: 90505 - protein, 10 aa, Dengue virus
GSASSMVNGV

SEQ ID NO: 90506 - protein, 10 aa, Dengue virus
SASSMVNGVV

SEQ ID NO: 90507 - protein, 10 aa, Dengue virus
ASSMVNGVVK

SEQ ID NO: 90508 - protein, 10 aa, Dengue virus
SSMVNGVVKL

SEQ ID NO: 90509 - protein, 10 aa, Dengue virus
SMVNGVVKLL

SEQ ID NO: 90510 - protein, 10 aa, Dengue virus
MVNGVVKLLT

SEQ ID NO: 90511 - protein, 10 aa, Dengue virus
VNGVVKLLTK

SEQ ID NO: 90512 - protein, 10 aa, Dengue virus
NGVVKLLTKP

SEQ ID NO: 90513 - protein, 10 aa, Dengue virus
GVVKLLTKPW

SEQ ID NO: 90514 - protein, 10 aa, Dengue virus
VVKLLTKPWD

SEQ ID NO: 90515 - protein, 10 aa, Dengue virus
VKLLTKPWDV

SEQ ID NO: 90516 - protein, 10 aa, Dengue virus
KLLTKPWDVI

SEQ ID NO: 90517 - protein, 10 aa, Dengue virus
LLTKPWDVIP

SEQ ID NO: 90518 - protein, 10 aa, Dengue virus
LTKPWDVIPM

SEQ ID NO: 90519 - protein, 10 aa, Dengue virus
TKPWDVIPMV

SEQ ID NO: 90520 - protein, 10 aa, Dengue virus
KPWDVIPMVT

SEQ ID NO: 90521 - protein, 10 aa, Dengue virus
PWDVIPMVTQ

SEQ ID NO: 90522 - protein, 10 aa, Dengue virus
WDVIPMVTQL

SEQ ID NO: 90523 - protein, 10 aa, Dengue virus
DVIPMVTQLA

SEQ ID NO: 90524 - protein, 10 aa, Dengue virus
VIPMVTQLAM

SEQ ID NO: 90525 - protein, 10 aa, Dengue virus
IPMVTQLAMT

SEQ ID NO: 90526 - protein, 10 aa, Dengue virus
PMVTQLAMTD

SEQ ID NO: 90527 - protein, 10 aa, Dengue virus
MVTQLAMTDT

SEQ ID NO: 90528 - protein, 10 aa, Dengue virus
VTQLAMTDTT

SEQ ID NO: 90529 - protein, 10 aa, Dengue virus
TQLAMTDTTP

SEQ ID NO: 90530 - protein, 10 aa, Dengue virus
QLAMTDTTPF

SEQ ID NO: 90531 - protein, 10 aa, Dengue virus
LAMTDTTPFG

SEQ ID NO: 90532 - protein, 10 aa, Dengue virus
AMTDTTPFGQ

SEQ ID NO: 90533 - protein, 10 aa, Dengue virus
MTDTTPFGQQ

SEQ ID NO: 90534 - protein, 10 aa, Dengue virus
TDTTPFGQQR

SEQ ID NO: 90535 - protein, 10 aa, Dengue virus
DTTPFGQQRV

SEQ ID NO: 90536 - protein, 10 aa, Dengue virus
TTPFGQQRVF

SEQ ID NO: 90537 - protein, 10 aa, Dengue virus
TPFGQQRVFK

SEQ ID NO: 90538 - protein, 10 aa, Dengue virus
PFGQQRVFKE

SEQ ID NO: 90539 - protein, 10 aa, Dengue virus
FGQQRVFKEK

SEQ ID NO: 90540 - protein, 10 aa, Dengue virus
GQQRVFKEKV

SEQ ID NO: 90541 - protein, 10 aa, Dengue virus
QQRVFKEKVD

SEQ ID NO: 90542 - protein, 10 aa, Dengue virus
QRVFKEKVDT

SEQ ID NO: 90543 - protein, 10 aa, Dengue virus
RVFKEKVDTR

SEQ ID NO: 90544 - protein, 10 aa, Dengue virus
VFKEKVDTRT

SEQ ID NO: 90545 - protein, 10 aa, Dengue virus
FKEKVDTRTP

SEQ ID NO: 90546 - protein, 10 aa, Dengue virus
KEKVDTRTPQ

SEQ ID NO: 90547 - protein, 10 aa, Dengue virus
EKVDTRTPQP

SEQ ID NO: 90548 - protein, 10 aa, Dengue virus
KVDTRTPQPK

SEQ ID NO: 90549 - protein, 10 aa, Dengue virus
VDTRTPQPKP

SEQ ID NO: 90550 - protein, 10 aa, Dengue virus
DTRTPQPKPG

SEQ ID NO: 90551 - protein, 10 aa, Dengue virus
TRTPQPKPGT

SEQ ID NO: 90552 - protein, 10 aa, Dengue virus
RTPQPKPGTR

SEQ ID NO: 90553 - protein, 10 aa, Dengue virus
TPQPKPGTRM

SEQ ID NO: 90554 - protein, 10 aa, Dengue virus
PQPKPGTRMV

SEQ ID NO: 90555 - protein, 10 aa, Dengue virus
QPKPGTRMVM

SEQ ID NO: 90556 - protein, 10 aa, Dengue virus
PKPGTRMVMT

SEQ ID NO: 90557 - protein, 10 aa, Dengue virus
KPGTRMVMTT

SEQ ID NO: 90558 - protein, 10 aa, Dengue virus
PGTRMVMTTT

SEQ ID NO: 90559 - protein, 10 aa, Dengue virus
GTRMVMTTTA

SEQ ID NO: 90560 - protein, 10 aa, Dengue virus
TRMVMTTTAN

SEQ ID NO: 90561 - protein, 10 aa, Dengue virus
RMVMTTTANW

SEQ ID NO: 90562 - protein, 10 aa, Dengue virus
MVMTTTANWL

SEQ ID NO: 90563 - protein, 10 aa, Dengue virus
VMTTTANWLW

SEQ ID NO: 90564 - protein, 10 aa, Dengue virus
MTTTANWLWA

SEQ ID NO: 90565 - protein, 10 aa, Dengue virus
TTTANWLWAL

SEQ ID NO: 90566 - protein, 10 aa, Dengue virus
TTANWLWALL

SEQ ID NO: 90567 - protein, 10 aa, Dengue virus
TANWLWALLG

SEQ ID NO: 90568 - protein, 10 aa, Dengue virus
ANWLWALLGK

SEQ ID NO: 90569 - protein, 10 aa, Dengue virus
NWLWALLGKK

SEQ ID NO: 90570 - protein, 10 aa, Dengue virus
WLWALLGKKK

SEQ ID NO: 90571 - protein, 10 aa, Dengue virus
LLGKKKNPRL

SEQ ID NO: 90572 - protein, 10 aa, Dengue virus
LGKKKNPRLC

SEQ ID NO: 90573 - protein, 10 aa, Dengue virus
GKKKNPRLCT

SEQ ID NO: 90574 - protein, 10 aa, Dengue virus
KKNPRLCTRE

SEQ ID NO: 90575 - protein, 10 aa, Dengue virus
KNPRLCTREE

SEQ ID NO: 90576 - protein, 10 aa, Dengue virus
NPRLCTREEF

SEQ ID NO: 90577 - protein, 10 aa, Dengue virus
PRLCTREEFI

SEQ ID NO: 90578 - protein, 10 aa, Dengue virus
RLCTREEFIS

SEQ ID NO: 90579 - protein, 10 aa, Dengue virus
LCTREEFISK

SEQ ID NO: 90580 - protein, 10 aa, Dengue virus
CTREEFISKV

SEQ ID NO: 90581 - protein, 10 aa, Dengue virus
TREEFISKVR

SEQ ID NO: 90582 - protein, 10 aa, Dengue virus
REEFISKVRS

SEQ ID NO: 90583 - protein, 10 aa, Dengue virus
EEFISKVRSN

SEQ ID NO: 90584 - protein, 10 aa, Dengue virus
EFISKVRSNA

SEQ ID NO: 90585 - protein, 10 aa, Dengue virus
FISKVRSNAA

SEQ ID NO: 90586 - protein, 10 aa, Dengue virus
ISKVRSNAAI

SEQ ID NO: 90587 - protein, 10 aa, Dengue virus
SKVRSNAAIG

SEQ ID NO: 90588 - protein, 10 aa, Dengue virus
KVRSNAAIGA

SEQ ID NO: 90589 - protein, 10 aa, Dengue virus
VRSNAAIGAV

SEQ ID NO: 90590 - protein, 10 aa, Dengue virus
RSNAAIGAVF

SEQ ID NO: 90591 - protein, 10 aa, Dengue virus
SNAAIGAVFQ

SEQ ID NO: 90592 - protein, 10 aa, Dengue virus
NAAIGAVFQE

SEQ ID NO: 90593 - protein, 10 aa, Dengue virus
AAIGAVFQEE

SEQ ID NO: 90594 - protein, 10 aa, Dengue virus
AIGAVFQEEQ

SEQ ID NO: 90595 - protein, 10 aa, Dengue virus
IGAVFQEEQG

SEQ ID NO: 90596 - protein, 10 aa, Dengue virus
GAVFQEEQGW

SEQ ID NO: 90597 - protein, 10 aa, Dengue virus
AVFQEEQGWT

SEQ ID NO: 90598 - protein, 10 aa, Dengue virus
VFQEEQGWTS

SEQ ID NO: 90599 - protein, 10 aa, Dengue virus
FQEEQGWTSA

SEQ ID NO: 90600 - protein, 10 aa, Dengue virus
QEEQGWTSAS

SEQ ID NO: 90601 - protein, 10 aa, Dengue virus
EEQGWTSASE

SEQ ID NO: 90602 - protein, 10 aa, Dengue virus
EQGWTSASEA

SEQ ID NO: 90603 - protein, 10 aa, Dengue virus
QGWTSASEAV

SEQ ID NO: 90604 - protein, 10 aa, Dengue virus
GWTSASEAVN

SEQ ID NO: 90605 - protein, 10 aa, Dengue virus
WTSASEAVND

SEQ ID NO: 90606 - protein, 10 aa, Dengue virus
TSASEAVNDS

SEQ ID NO: 90607 - protein, 10 aa, Dengue virus
SASEAVNDSR

SEQ ID NO: 90608 - protein, 10 aa, Dengue virus
ASEAVNDSRF

SEQ ID NO: 90609 - protein, 10 aa, Dengue virus
SEAVNDSRFW

SEQ ID NO: 90610 - protein, 10 aa, Dengue virus
EAVNDSRFWE

SEQ ID NO: 90611 - protein, 10 aa, Dengue virus
AVNDSRFWEL

SEQ ID NO: 90612 - protein, 10 aa, Dengue virus
VNDSRFWELV

SEQ ID NO: 90613 - protein, 10 aa, Dengue virus
NDSRFWELVD

SEQ ID NO: 90614 - protein, 10 aa, Dengue virus
DSRFWELVDK

SEQ ID NO: 90615 - protein, 10 aa, Dengue virus
SRFWELVDKE

SEQ ID NO: 90616 - protein, 10 aa, Dengue virus
RFWELVDKER

SEQ ID NO: 90617 - protein, 10 aa, Dengue virus
FWELVDKERA

SEQ ID NO: 90618 - protein, 10 aa, Dengue virus
WELVDKERAL

SEQ ID NO: 90619 - protein, 10 aa, Dengue virus
ELVDKERALH

SEQ ID NO: 90620 - protein, 10 aa, Dengue virus
LVDKERALHQ

SEQ ID NO: 90621 - protein, 10 aa, Dengue virus
VDKERALHQE

SEQ ID NO: 90622 - protein, 10 aa, Dengue virus
DKERALHQEG

SEQ ID NO: 90623 - protein, 10 aa, Dengue virus
KERALHQEGK

SEQ ID NO: 90624 - protein, 10 aa, Dengue virus
ERALHQEGKC

SEQ ID NO: 90625 - protein, 10 aa, Dengue virus
RALHQEGKCE

SEQ ID NO: 90626 - protein, 10 aa, Dengue virus
ALHQEGKCES

SEQ ID NO: 90627 - protein, 10 aa, Dengue virus
LHQEGKCESC

SEQ ID NO: 90628 - protein, 10 aa, Dengue virus
HQEGKCESCV

SEQ ID NO: 90629 - protein, 10 aa, Dengue virus
QEGKCESCVY

SEQ ID NO: 90630 - protein, 10 aa, Dengue virus
EGKCESCVYN

SEQ ID NO: 90631 - protein, 10 aa, Dengue virus
GKCESCVYNM

SEQ ID NO: 90632 - protein, 10 aa, Dengue virus
KCESCVYNMM

SEQ ID NO: 90633 - protein, 10 aa, Dengue virus
CESCVYNMMG

SEQ ID NO: 90634 - protein, 10 aa, Dengue virus
ESCVYNMMGK

SEQ ID NO: 90635 - protein, 10 aa, Dengue virus
SCVYNMMGKR

SEQ ID NO: 90636 - protein, 10 aa, Dengue virus
CVYNMMGKRE

SEQ ID NO: 90637 - protein, 10 aa, Dengue virus
VYNMMGKREK

SEQ ID NO: 90638 - protein, 10 aa, Dengue virus
YNMMGKREKK

SEQ ID NO: 90639 - protein, 10 aa, Dengue virus
NMMGKREKKL

SEQ ID NO: 90640 - protein, 10 aa, Dengue virus
MMGKREKKLG

SEQ ID NO: 90641 - protein, 10 aa, Dengue virus
MGKREKKLGE

SEQ ID NO: 90642 - protein, 10 aa, Dengue virus
GKREKKLGEF

SEQ ID NO: 90643 - protein, 10 aa, Dengue virus
KREKKLGEFG

SEQ ID NO: 90644 - protein, 10 aa, Dengue virus
REKKLGEFGR

SEQ ID NO: 90645 - protein, 10 aa, Dengue virus
EKKLGEFGRA

SEQ ID NO: 90646 - protein, 10 aa, Dengue virus
KKLGEFGRAK

SEQ ID NO: 90647 - protein, 10 aa, Dengue virus
KLGEFGRAKG

SEQ ID NO: 90648 - protein, 10 aa, Dengue virus
LGEFGRAKGS

SEQ ID NO: 90649 - protein, 10 aa, Dengue virus
GEFGRAKGSR

SEQ ID NO: 90650 - protein, 10 aa, Dengue virus
EFGRAKGSRA

SEQ ID NO: 90651 - protein, 10 aa, Dengue virus
FGRAKGSRAI

SEQ ID NO: 90652 - protein, 10 aa, Dengue virus
GRAKGSRAIW

SEQ ID NO: 90653 - protein, 10 aa, Dengue virus
RAKGSRAIWY

SEQ ID NO: 90654 - protein, 10 aa, Dengue virus
AKGSRAIWYM

SEQ ID NO: 90655 - protein, 10 aa, Dengue virus
KGSRAIWYMW

SEQ ID NO: 90656 - protein, 10 aa, Dengue virus
GSRAIWYMWL

SEQ ID NO: 90657 - protein, 10 aa, Dengue virus
SRAIWYMWLG

SEQ ID NO: 90658 - protein, 10 aa, Dengue virus
RAIWYMWLGA

SEQ ID NO: 90659 - protein, 10 aa, Dengue virus
AIWYMWLGAR

SEQ ID NO: 90660 - protein, 10 aa, Dengue virus
IWYMWLGARF

SEQ ID NO: 90661 - protein, 10 aa, Dengue virus
WYMWLGARFL

SEQ ID NO: 90662 - protein, 10 aa, Dengue virus
YMWLGARFLE

SEQ ID NO: 90663 - protein, 10 aa, Dengue virus
MWLGARFLEF

SEQ ID NO: 90664 - protein, 10 aa, Dengue virus
WLGARFLEFE

SEQ ID NO: 90665 - protein, 10 aa, Dengue virus
LGARFLEFEA

SEQ ID NO: 90666 - protein, 10 aa, Dengue virus
GARFLEFEAL

SEQ ID NO: 90667 - protein, 10 aa, Dengue virus
ARFLEFEALG

SEQ ID NO: 90668 - protein, 10 aa, Dengue virus
RFLEFEALGF

SEQ ID NO: 90669 - protein, 10 aa, Dengue virus
FLEFEALGFL

SEQ ID NO: 90670 - protein, 10 aa, Dengue virus
LEFEALGFLN

SEQ ID NO: 90671 - protein, 10 aa, Dengue virus
EFEALGFLNE

SEQ ID NO: 90672 - protein, 10 aa, Dengue virus
FEALGFLNED

SEQ ID NO: 90673 - protein, 10 aa, Dengue virus
EALGFLNEDH

SEQ ID NO: 90674 - protein, 10 aa, Dengue virus
ALGFLNEDHW

SEQ ID NO: 90675 - protein, 10 aa, Dengue virus
LGFLNEDHWF

SEQ ID NO: 90676 - protein, 10 aa, Dengue virus
GFLNEDHWFG

SEQ ID NO: 90677 - protein, 10 aa, Dengue virus
FLNEDHWFGR

SEQ ID NO: 90678 - protein, 10 aa, Dengue virus
LNEDHWFGRE

SEQ ID NO: 90679 - protein, 10 aa, Dengue virus
NEDHWFGREN

SEQ ID NO: 90680 - protein, 10 aa, Dengue virus
EDHWFGRENS

SEQ ID NO: 90681 - protein, 10 aa, Dengue virus
DHWFGRENSW

SEQ ID NO: 90682 - protein, 10 aa, Dengue virus
HWFGRENSWS

SEQ ID NO: 90683 - protein, 10 aa, Dengue virus
WFGRENSWSG

SEQ ID NO: 90684 - protein, 10 aa, Dengue virus
FGRENSWSGV

SEQ ID NO: 90685 - protein, 10 aa, Dengue virus
GRENSWSGVE

SEQ ID NO: 90686 - protein, 10 aa, Dengue virus
RENSWSGVEG

SEQ ID NO: 90687 - protein, 10 aa, Dengue virus
ENSWSGVEGE

SEQ ID NO: 90688 - protein, 10 aa, Dengue virus
NSWSGVEGEG

SEQ ID NO: 90689 - protein, 10 aa, Dengue virus
SWSGVEGEGL

SEQ ID NO: 90690 - protein, 10 aa, Dengue virus
WSGVEGEGLH

SEQ ID NO: 90691 - protein, 10 aa, Dengue virus
SGVEGEGLHR

SEQ ID NO: 90692 - protein, 10 aa, Dengue virus
GVEGEGLHRL

SEQ ID NO: 90693 - protein, 10 aa, Dengue virus
VEGEGLHRLG

SEQ ID NO: 90694 - protein, 10 aa, Dengue virus
EGEGLHRLGY

SEQ ID NO: 90695 - protein, 10 aa, Dengue virus
GEGLHRLGYI

SEQ ID NO: 90696 - protein, 10 aa, Dengue virus
EGLHRLGYIL

SEQ ID NO: 90697 - protein, 10 aa, Dengue virus
GLHRLGYILE

SEQ ID NO: 90698 - protein, 10 aa, Dengue virus
LHRLGYILEE

SEQ ID NO: 90699 - protein, 10 aa, Dengue virus
HRLGYILEEI

SEQ ID NO: 90700 - protein, 10 aa, Dengue virus
RLGYILEEID

SEQ ID NO: 90701 - protein, 10 aa, Dengue virus
LGYILEEIDK

SEQ ID NO: 90702 - protein, 10 aa, Dengue virus
GYILEEIDKK

SEQ ID NO: 90703 - protein, 10 aa, Dengue virus
YILEEIDKKD

SEQ ID NO: 90704 - protein, 10 aa, Dengue virus
ILEEIDKKDG

SEQ ID NO: 90705 - protein, 10 aa, Dengue virus
LEEIDKKDGD

SEQ ID NO: 90706 - protein, 10 aa, Dengue virus
EEIDKKDGDL

SEQ ID NO: 90707 - protein, 10 aa, Dengue virus
EIDKKDGDLM

SEQ ID NO: 90708 - protein, 10 aa, Dengue virus
IDKKDGDLMY

SEQ ID NO: 90709 - protein, 10 aa, Dengue virus
DKKDGDLMYA

SEQ ID NO: 90710 - protein, 10 aa, Dengue virus
KKDGDLMYAD

SEQ ID NO: 90711 - protein, 10 aa, Dengue virus
KDGDLMYADD

SEQ ID NO: 90712 - protein, 10 aa, Dengue virus
DGDLMYADDT

SEQ ID NO: 90713 - protein, 10 aa, Dengue virus
GDLMYADDTA

SEQ ID NO: 90714 - protein, 10 aa, Dengue virus
DLMYADDTAG

SEQ ID NO: 90715 - protein, 10 aa, Dengue virus
LMYADDTAGW

SEQ ID NO: 90716 - protein, 10 aa, Dengue virus
MYADDTAGWD

SEQ ID NO: 90717 - protein, 10 aa, Dengue virus
YADDTAGWDT

SEQ ID NO: 90718 - protein, 10 aa, Dengue virus
ADDTAGWDTR

SEQ ID NO: 90719 - protein, 10 aa, Dengue virus
DDTAGWDTRI

SEQ ID NO: 90720 - protein, 10 aa, Dengue virus
DTAGWDTRIT

SEQ ID NO: 90721 - protein, 10 aa, Dengue virus
TAGWDTRITE

SEQ ID NO: 90722 - protein, 10 aa, Dengue virus
AGWDTRITED

SEQ ID NO: 90723 - protein, 10 aa, Dengue virus
GWDTRITEDD

SEQ ID NO: 90724 - protein, 10 aa, Dengue virus
WDTRITEDDL

SEQ ID NO: 90725 - protein, 10 aa, Dengue virus
DTRITEDDLQ

SEQ ID NO: 90726 - protein, 10 aa, Dengue virus
TRITEDDLQN

SEQ ID NO: 90727 - protein, 10 aa, Dengue virus
RITEDDLQNE

SEQ ID NO: 90728 - protein, 10 aa, Dengue virus
ITEDDLQNEE

SEQ ID NO: 90729 - protein, 10 aa, Dengue virus
TEDDLQNEEL

SEQ ID NO: 90730 - protein, 10 aa, Dengue virus
EDDLQNEELI

SEQ ID NO: 90731 - protein, 10 aa, Dengue virus
DDLQNEELIT

SEQ ID NO: 90732 - protein, 10 aa, Dengue virus
DLQNEELITE

SEQ ID NO: 90733 - protein, 10 aa, Dengue virus
LQNEELITEQ

SEQ ID NO: 90734 - protein, 10 aa, Dengue virus
QNEELITEQM

SEQ ID NO: 90735 - protein, 10 aa, Dengue virus
NEELITEQMA

SEQ ID NO: 90736 - protein, 10 aa, Dengue virus
EELITEQMAP

SEQ ID NO: 90737 - protein, 10 aa, Dengue virus
ELITEQMAPH

SEQ ID NO: 90738 - protein, 10 aa, Dengue virus
LITEQMAPHH

SEQ ID NO: 90739 - protein, 10 aa, Dengue virus
ITEQMAPHHK

SEQ ID NO: 90740 - protein, 10 aa, Dengue virus
TEQMAPHHKI

SEQ ID NO: 90741 - protein, 10 aa, Dengue virus
EQMAPHHKIL

SEQ ID NO: 90742 - protein, 10 aa, Dengue virus
QMAPHHKILA

SEQ ID NO: 90743 - protein, 10 aa, Dengue virus
MAPHHKILAK

SEQ ID NO: 90744 - protein, 10 aa, Dengue virus
APHHKILAKA

SEQ ID NO: 90745 - protein, 10 aa, Dengue virus
PHHKILAKAI

SEQ ID NO: 90746 - protein, 10 aa, Dengue virus
HHKILAKAIF

SEQ ID NO: 90747 - protein, 10 aa, Dengue virus
HKILAKAIFK

SEQ ID NO: 90748 - protein, 10 aa, Dengue virus
KILAKAIFKL

SEQ ID NO: 90749 - protein, 10 aa, Dengue virus
ILAKAIFKLT

SEQ ID NO: 90750 - protein, 10 aa, Dengue virus
LAKAIFKLTY

SEQ ID NO: 90751 - protein, 10 aa, Dengue virus
AKAIFKLTYQ

SEQ ID NO: 90752 - protein, 10 aa, Dengue virus
KAIFKLTYQN

SEQ ID NO: 90753 - protein, 10 aa, Dengue virus
AIFKLTYQNK

SEQ ID NO: 90754 - protein, 10 aa, Dengue virus
IFKLTYQNKV

SEQ ID NO: 90755 - protein, 10 aa, Dengue virus
FKLTYQNKVV

SEQ ID NO: 90756 - protein, 10 aa, Dengue virus
KLTYQNKVVK

SEQ ID NO: 90757 - protein, 10 aa, Dengue virus
LTYQNKVVKV

SEQ ID NO: 90758 - protein, 10 aa, Dengue virus
TYQNKVVKVL

SEQ ID NO: 90759 - protein, 10 aa, Dengue virus
YQNKVVKVLR

SEQ ID NO: 90760 - protein, 10 aa, Dengue virus
QNKVVKVLRP

SEQ ID NO: 90761 - protein, 10 aa, Dengue virus
NKVVKVLRPT

SEQ ID NO: 90762 - protein, 10 aa, Dengue virus
KVVKVLRPTP

SEQ ID NO: 90763 - protein, 10 aa, Dengue virus
VVKVLRPTPR

SEQ ID NO: 90764 - protein, 10 aa, Dengue virus
VKVLRPTPRG

SEQ ID NO: 90765 - protein, 10 aa, Dengue virus
KVLRPTPRGA

SEQ ID NO: 90766 - protein, 10 aa, Dengue virus
VLRPTPRGAV

SEQ ID NO: 90767 - protein, 10 aa, Dengue virus
LRPTPRGAVM

SEQ ID NO: 90768 - protein, 10 aa, Dengue virus
RPTPRGAVMD

SEQ ID NO: 90769 - protein, 10 aa, Dengue virus
PTPRGAVMDI

SEQ ID NO: 90770 - protein, 10 aa, Dengue virus
TPRGAVMDII

SEQ ID NO: 90771 - protein, 10 aa, Dengue virus
PRGAVMDIIS

SEQ ID NO: 90772 - protein, 10 aa, Dengue virus
RGAVMDIISR

SEQ ID NO: 90773 - protein, 10 aa, Dengue virus
GAVMDIISRK

SEQ ID NO: 90774 - protein, 10 aa, Dengue virus
AVMDIISRKD

SEQ ID NO: 90775 - protein, 10 aa, Dengue virus
VMDIISRKDQ

SEQ ID NO: 90776 - protein, 10 aa, Dengue virus
MDIISRKDQR

SEQ ID NO: 90777 - protein, 10 aa, Dengue virus
DIISRKDQRG

SEQ ID NO: 90778 - protein, 10 aa, Dengue virus
IISRKDQRGS

SEQ ID NO: 90779 - protein, 10 aa, Dengue virus
ISRKDQRGSG

SEQ ID NO: 90780 - protein, 10 aa, Dengue virus
SRKDQRGSGQ

SEQ ID NO: 90781 - protein, 10 aa, Dengue virus
RKDQRGSGQV

SEQ ID NO: 90782 - protein, 10 aa, Dengue virus
KDQRGSGQVG

SEQ ID NO: 90783 - protein, 10 aa, Dengue virus
DQRGSGQVGT

SEQ ID NO: 90784 - protein, 10 aa, Dengue virus
QRGSGQVGTY

SEQ ID NO: 90785 - protein, 10 aa, Dengue virus
RGSGQVGTYG

SEQ ID NO: 90786 - protein, 10 aa, Dengue virus
GSGQVGTYGL

SEQ ID NO: 90787 - protein, 10 aa, Dengue virus
SGQVGTYGLN

SEQ ID NO: 90788 - protein, 10 aa, Dengue virus
GQVGTYGLNT

SEQ ID NO: 90789 - protein, 10 aa, Dengue virus
QVGTYGLNTF

SEQ ID NO: 90790 - protein, 10 aa, Dengue virus
VGTYGLNTFT

SEQ ID NO: 90791 - protein, 10 aa, Dengue virus
GTYGLNTFTN

SEQ ID NO: 90792 - protein, 10 aa, Dengue virus
TYGLNTFTNM

SEQ ID NO: 90793 - protein, 10 aa, Dengue virus
YGLNTFTNME

SEQ ID NO: 90794 - protein, 10 aa, Dengue virus
GLNTFTNMEV

SEQ ID NO: 90795 - protein, 10 aa, Dengue virus
LNTFTNMEVQ

SEQ ID NO: 90796 - protein, 10 aa, Dengue virus
NTFTNMEVQL

SEQ ID NO: 90797 - protein, 10 aa, Dengue virus
TFTNMEVQLI

SEQ ID NO: 90798 - protein, 10 aa, Dengue virus
FTNMEVQLIR

SEQ ID NO: 90799 - protein, 10 aa, Dengue virus
TNMEVQLIRQ

SEQ ID NO: 90800 - protein, 10 aa, Dengue virus
NMEVQLIRQM

SEQ ID NO: 90801 - protein, 10 aa, Dengue virus
MEVQLIRQME

SEQ ID NO: 90802 - protein, 10 aa, Dengue virus
EVQLIRQMEA

SEQ ID NO: 90803 - protein, 10 aa, Dengue virus
VQLIRQMEAE

SEQ ID NO: 90804 - protein, 10 aa, Dengue virus
QLIRQMEAEG

SEQ ID NO: 90805 - protein, 10 aa, Dengue virus
LIRQMEAEGV

SEQ ID NO: 90806 - protein, 10 aa, Dengue virus
IRQMEAEGVI

SEQ ID NO: 90807 - protein, 10 aa, Dengue virus
RQMEAEGVIT

SEQ ID NO: 90808 - protein, 10 aa, Dengue virus
QMEAEGVITQ

SEQ ID NO: 90809 - protein, 10 aa, Dengue virus
MEAEGVITQD

SEQ ID NO: 90810 - protein, 10 aa, Dengue virus
EAEGVITQDD

SEQ ID NO: 90811 - protein, 10 aa, Dengue virus
AEGVITQDDM

SEQ ID NO: 90812 - protein, 10 aa, Dengue virus
EGVITQDDMQ

SEQ ID NO: 90813 - protein, 10 aa, Dengue virus
GVITQDDMQN

SEQ ID NO: 90814 - protein, 10 aa, Dengue virus
VITQDDMQNP

SEQ ID NO: 90815 - protein, 10 aa, Dengue virus
ITQDDMQNPK

SEQ ID NO: 90816 - protein, 10 aa, Dengue virus
TQDDMQNPKG

SEQ ID NO: 90817 - protein, 10 aa, Dengue virus
QDDMQNPKGL

SEQ ID NO: 90818 - protein, 10 aa, Dengue virus
DDMQNPKGLK

SEQ ID NO: 90819 - protein, 10 aa, Dengue virus
DMQNPKGLKE

SEQ ID NO: 90820 - protein, 10 aa, Dengue virus
MQNPKGLKER

SEQ ID NO: 90821 - protein, 10 aa, Dengue virus
QNPKGLKERV

SEQ ID NO: 90822 - protein, 10 aa, Dengue virus
NPKGLKERVE

SEQ ID NO: 90823 - protein, 10 aa, Dengue virus
PKGLKERVEK

SEQ ID NO: 90824 - protein, 10 aa, Dengue virus
KGLKERVEKW

SEQ ID NO: 90825 - protein, 10 aa, Dengue virus
GLKERVEKWL

SEQ ID NO: 90826 - protein, 10 aa, Dengue virus
LKERVEKWLR

SEQ ID NO: 90827 - protein, 10 aa, Dengue virus
KERVEKWLRE

SEQ ID NO: 90828 - protein, 10 aa, Dengue virus
ERVEKWLREC

SEQ ID NO: 90829 - protein, 10 aa, Dengue virus
RVEKWLRECG

SEQ ID NO: 90830 - protein, 10 aa, Dengue virus
VEKWLRECGV

SEQ ID NO: 90831 - protein, 10 aa, Dengue virus
EKWLRECGVD

SEQ ID NO: 90832 - protein, 10 aa, Dengue virus
KWLRECGVDR

SEQ ID NO: 90833 - protein, 10 aa, Dengue virus
WLRECGVDRL

SEQ ID NO: 90834 - protein, 10 aa, Dengue virus
LRECGVDRLK

SEQ ID NO: 90835 - protein, 10 aa, Dengue virus
RECGVDRLKR

SEQ ID NO: 90836 - protein, 10 aa, Dengue virus
ECGVDRLKRM

SEQ ID NO: 90837 - protein, 10 aa, Dengue virus
CGVDRLKRMA

SEQ ID NO: 90838 - protein, 10 aa, Dengue virus
GVDRLKRMAI

SEQ ID NO: 90839 - protein, 10 aa, Dengue virus
VDRLKRMAIS

SEQ ID NO: 90840 - protein, 10 aa, Dengue virus
DRLKRMAISG

SEQ ID NO: 90841 - protein, 10 aa, Dengue virus
RLKRMAISGD

SEQ ID NO: 90842 - protein, 10 aa, Dengue virus
LKRMAISGDD

SEQ ID NO: 90843 - protein, 10 aa, Dengue virus
KRMAISGDDC

SEQ ID NO: 90844 - protein, 10 aa, Dengue virus
RMAISGDDCV

SEQ ID NO: 90845 - protein, 10 aa, Dengue virus
MAISGDDCVV

SEQ ID NO: 90846 - protein, 10 aa, Dengue virus
AISGDDCVVK

SEQ ID NO: 90847 - protein, 10 aa, Dengue virus
ISGDDCVVKP

SEQ ID NO: 90848 - protein, 10 aa, Dengue virus
SGDDCVVKPL

SEQ ID NO: 90849 - protein, 10 aa, Dengue virus
GDDCVVKPLD

SEQ ID NO: 90850 - protein, 10 aa, Dengue virus
DDCVVKPLDE

SEQ ID NO: 90851 - protein, 10 aa, Dengue virus
DCVVKPLDER

SEQ ID NO: 90852 - protein, 10 aa, Dengue virus
CVVKPLDERF

SEQ ID NO: 90853 - protein, 10 aa, Dengue virus
VVKPLDERFG

SEQ ID NO: 90854 - protein, 10 aa, Dengue virus
VKPLDERFGT

SEQ ID NO: 90855 - protein, 10 aa, Dengue virus
KPLDERFGTS

SEQ ID NO: 90856 - protein, 10 aa, Dengue virus
PLDERFGTSL

SEQ ID NO: 90857 - protein, 10 aa, Dengue virus
LDERFGTSLL

SEQ ID NO: 90858 - protein, 10 aa, Dengue virus
DERFGTSLLF

SEQ ID NO: 90859 - protein, 10 aa, Dengue virus
ERFGTSLLFL

SEQ ID NO: 90860 - protein, 10 aa, Dengue virus
RFGTSLLFLN

SEQ ID NO: 90861 - protein, 10 aa, Dengue virus
FGTSLLFLND

SEQ ID NO: 90862 - protein, 10 aa, Dengue virus
GTSLLFLNDM

SEQ ID NO: 90863 - protein, 10 aa, Dengue virus
TSLLFLNDMG

SEQ ID NO: 90864 - protein, 10 aa, Dengue virus
SLLFLNDMGK

SEQ ID NO: 90865 - protein, 10 aa, Dengue virus
LLFLNDMGKV

SEQ ID NO: 90866 - protein, 10 aa, Dengue virus
LFLNDMGKVR

SEQ ID NO: 90867 - protein, 10 aa, Dengue virus
FLNDMGKVRK

SEQ ID NO: 90868 - protein, 10 aa, Dengue virus
LNDMGKVRKD

SEQ ID NO: 90869 - protein, 10 aa, Dengue virus
NDMGKVRKDI

SEQ ID NO: 90870 - protein, 10 aa, Dengue virus
DMGKVRKDIP

SEQ ID NO: 90871 - protein, 10 aa, Dengue virus
MGKVRKDIPQ

SEQ ID NO: 90872 - protein, 10 aa, Dengue virus
GKVRKDIPQW

SEQ ID NO: 90873 - protein, 10 aa, Dengue virus
KVRKDIPQWE

SEQ ID NO: 90874 - protein, 10 aa, Dengue virus
VRKDIPQWEP

SEQ ID NO: 90875 - protein, 10 aa, Dengue virus
RKDIPQWEPS

SEQ ID NO: 90876 - protein, 10 aa, Dengue virus
KDIPQWEPSK

SEQ ID NO: 90877 - protein, 10 aa, Dengue virus
DIPQWEPSKG

SEQ ID NO: 90878 - protein, 10 aa, Dengue virus
IPQWEPSKGW

SEQ ID NO: 90879 - protein, 10 aa, Dengue virus
PQWEPSKGWK

SEQ ID NO: 90880 - protein, 10 aa, Dengue virus
QWEPSKGWKN

SEQ ID NO: 90881 - protein, 10 aa, Dengue virus
WEPSKGWKNW

SEQ ID NO: 90882 - protein, 10 aa, Dengue virus
EPSKGWKNWQ

SEQ ID NO: 90883 - protein, 10 aa, Dengue virus
PSKGWKNWQE

SEQ ID NO: 90884 - protein, 10 aa, Dengue virus
SKGWKNWQEV

SEQ ID NO: 90885 - protein, 10 aa, Dengue virus
KGWKNWQEVP

SEQ ID NO: 90886 - protein, 10 aa, Dengue virus
GWKNWQEVPF

SEQ ID NO: 90887 - protein, 10 aa, Dengue virus
WKNWQEVPFC

SEQ ID NO: 90888 - protein, 10 aa, Dengue virus
KNWQEVPFCS

SEQ ID NO: 90889 - protein, 10 aa, Dengue virus
NWQEVPFCSH

SEQ ID NO: 90890 - protein, 10 aa, Dengue virus
WQEVPFCSHH

SEQ ID NO: 90891 - protein, 10 aa, Dengue virus
QEVPFCSHHF

SEQ ID NO: 90892 - protein, 10 aa, Dengue virus
EVPFCSHHFH

SEQ ID NO: 90893 - protein, 10 aa, Dengue virus
VPFCSHHFHK

SEQ ID NO: 90894 - protein, 10 aa, Dengue virus
PFCSHHFHKI

SEQ ID NO: 90895 - protein, 10 aa, Dengue virus
FCSHHFHKIF

SEQ ID NO: 90896 - protein, 10 aa, Dengue virus
CSHHFHKIFM

SEQ ID NO: 90897 - protein, 10 aa, Dengue virus
SHHFHKIFMK

SEQ ID NO: 90898 - protein, 10 aa, Dengue virus
HHFHKIFMKD

SEQ ID NO: 90899 - protein, 10 aa, Dengue virus
HFHKIFMKDG

SEQ ID NO: 90900 - protein, 10 aa, Dengue virus
FHKIFMKDGR

SEQ ID NO: 90901 - protein, 10 aa, Dengue virus
HKIFMKDGRS

SEQ ID NO: 90902 - protein, 10 aa, Dengue virus
KIFMKDGRSL

SEQ ID NO: 90903 - protein, 10 aa, Dengue virus
IFMKDGRSLV

SEQ ID NO: 90904 - protein, 10 aa, Dengue virus
FMKDGRSLVV

SEQ ID NO: 90905 - protein, 10 aa, Dengue virus
MKDGRSLVVP

SEQ ID NO: 90906 - protein, 10 aa, Dengue virus
KDGRSLVVPC

SEQ ID NO: 90907 - protein, 10 aa, Dengue virus
DGRSLVVPCR

SEQ ID NO: 90908 - protein, 10 aa, Dengue virus
GRSLVVPCRN

SEQ ID NO: 90909 - protein, 10 aa, Dengue virus
RSLVVPCRNQ

SEQ ID NO: 90910 - protein, 10 aa, Dengue virus
SLVVPCRNQD

SEQ ID NO: 90911 - protein, 10 aa, Dengue virus
LVVPCRNQDE

SEQ ID NO: 90912 - protein, 10 aa, Dengue virus
VVPCRNQDEL

SEQ ID NO: 90913 - protein, 10 aa, Dengue virus
VPCRNQDELI

SEQ ID NO: 90914 - protein, 10 aa, Dengue virus
PCRNQDELIG

SEQ ID NO: 90915 - protein, 10 aa, Dengue virus
CRNQDELIGR

SEQ ID NO: 90916 - protein, 10 aa, Dengue virus
RNQDELIGRA

SEQ ID NO: 90917 - protein, 10 aa, Dengue virus
NQDELIGRAR

SEQ ID NO: 90918 - protein, 10 aa, Dengue virus
QDELIGRARI

SEQ ID NO: 90919 - protein, 10 aa, Dengue virus
DELIGRARIS

SEQ ID NO: 90920 - protein, 10 aa, Dengue virus
ELIGRARISQ

SEQ ID NO: 90921 - protein, 10 aa, Dengue virus
LIGRARISQG

SEQ ID NO: 90922 - protein, 10 aa, Dengue virus
IGRARISQGA

SEQ ID NO: 90923 - protein, 10 aa, Dengue virus
GRARISQGAG

SEQ ID NO: 90924 - protein, 10 aa, Dengue virus
RARISQGAGW

SEQ ID NO: 90925 - protein, 10 aa, Dengue virus
ARISQGAGWS

SEQ ID NO: 90926 - protein, 10 aa, Dengue virus
RISQGAGWSL

SEQ ID NO: 90927 - protein, 10 aa, Dengue virus
ISQGAGWSLR

SEQ ID NO: 90928 - protein, 10 aa, Dengue virus
SQGAGWSLRE

SEQ ID NO: 90929 - protein, 10 aa, Dengue virus
QGAGWSLRET

SEQ ID NO: 90930 - protein, 10 aa, Dengue virus
GAGWSLRETA

SEQ ID NO: 90931 - protein, 10 aa, Dengue virus
AGWSLRETAC

SEQ ID NO: 90932 - protein, 10 aa, Dengue virus
GWSLRETACL

SEQ ID NO: 90933 - protein, 10 aa, Dengue virus
WSLRETACLG

SEQ ID NO: 90934 - protein, 10 aa, Dengue virus
SLRETACLGK

SEQ ID NO: 90935 - protein, 10 aa, Dengue virus
LRETACLGKA

SEQ ID NO: 90936 - protein, 10 aa, Dengue virus
RETACLGKAY

SEQ ID NO: 90937 - protein, 10 aa, Dengue virus
ETACLGKAYA

SEQ ID NO: 90938 - protein, 10 aa, Dengue virus
TACLGKAYAQ

SEQ ID NO: 90939 - protein, 10 aa, Dengue virus
ACLGKAYAQM

SEQ ID NO: 90940 - protein, 10 aa, Dengue virus
CLGKAYAQMW

SEQ ID NO: 90941 - protein, 10 aa, Dengue virus
LGKAYAQMWS

SEQ ID NO: 90942 - protein, 10 aa, Dengue virus
GKAYAQMWSL

SEQ ID NO: 90943 - protein, 10 aa, Dengue virus
KAYAQMWSLM

SEQ ID NO: 90944 - protein, 10 aa, Dengue virus
AYAQMWSLMY

SEQ ID NO: 90945 - protein, 10 aa, Dengue virus
YAQMWSLMYF

SEQ ID NO: 90946 - protein, 10 aa, Dengue virus
AQMWSLMYFH

SEQ ID NO: 90947 - protein, 10 aa, Dengue virus
QMWSLMYFHR

SEQ ID NO: 90948 - protein, 10 aa, Dengue virus
MWSLMYFHRR

SEQ ID NO: 90949 - protein, 10 aa, Dengue virus
WSLMYFHRRD

SEQ ID NO: 90950 - protein, 10 aa, Dengue virus
SLMYFHRRDL

SEQ ID NO: 90951 - protein, 10 aa, Dengue virus
LMYFHRRDLR

SEQ ID NO: 90952 - protein, 10 aa, Dengue virus
MYFHRRDLRL

SEQ ID NO: 90953 - protein, 10 aa, Dengue virus
YFHRRDLRLA

SEQ ID NO: 90954 - protein, 10 aa, Dengue virus
FHRRDLRLAS

SEQ ID NO: 90955 - protein, 10 aa, Dengue virus
HRRDLRLASM

SEQ ID NO: 90956 - protein, 10 aa, Dengue virus
RRDLRLASMA

SEQ ID NO: 90957 - protein, 10 aa, Dengue virus
RDLRLASMAI

SEQ ID NO: 90958 - protein, 10 aa, Dengue virus
DLRLASMAIC

SEQ ID NO: 90959 - protein, 10 aa, Dengue virus
LRLASMAICS

SEQ ID NO: 90960 - protein, 10 aa, Dengue virus
RLASMAICSA

SEQ ID NO: 90961 - protein, 10 aa, Dengue virus
LASMAICSAV

SEQ ID NO: 90962 - protein, 10 aa, Dengue virus
ASMAICSAVP

SEQ ID NO: 90963 - protein, 10 aa, Dengue virus
SMAICSAVPT

SEQ ID NO: 90964 - protein, 10 aa, Dengue virus
MAICSAVPTE

SEQ ID NO: 90965 - protein, 10 aa, Dengue virus
AICSAVPTEW

SEQ ID NO: 90966 - protein, 10 aa, Dengue virus
ICSAVPTEWF

SEQ ID NO: 90967 - protein, 10 aa, Dengue virus
CSAVPTEWFP

SEQ ID NO: 90968 - protein, 10 aa, Dengue virus
SAVPTEWFPT

SEQ ID NO: 90969 - protein, 10 aa, Dengue virus
AVPTEWFPTS

SEQ ID NO: 90970 - protein, 10 aa, Dengue virus
VPTEWFPTSR

SEQ ID NO: 90971 - protein, 10 aa, Dengue virus
PTEWFPTSRT

SEQ ID NO: 90972 - protein, 10 aa, Dengue virus
TEWFPTSRTT

SEQ ID NO: 90973 - protein, 10 aa, Dengue virus
EWFPTSRTTW

SEQ ID NO: 90974 - protein, 10 aa, Dengue virus
WFPTSRTTWS

SEQ ID NO: 90975 - protein, 10 aa, Dengue virus
FPTSRTTWSI

SEQ ID NO: 90976 - protein, 10 aa, Dengue virus
PTSRTTWSIH

SEQ ID NO: 90977 - protein, 10 aa, Dengue virus
TSRTTWSIHA

SEQ ID NO: 90978 - protein, 10 aa, Dengue virus
SRTTWSIHAH

SEQ ID NO: 90979 - protein, 10 aa, Dengue virus
RTTWSIHAHH

SEQ ID NO: 90980 - protein, 10 aa, Dengue virus
TTWSIHAHHQ

SEQ ID NO: 90981 - protein, 10 aa, Dengue virus
TWSIHAHHQW

SEQ ID NO: 90982 - protein, 10 aa, Dengue virus
WSIHAHHQWM

SEQ ID NO: 90983 - protein, 10 aa, Dengue virus
SIHAHHQWMT

SEQ ID NO: 90984 - protein, 10 aa, Dengue virus
IHAHHQWMTT

SEQ ID NO: 90985 - protein, 10 aa, Dengue virus
HAHHQWMTTE

SEQ ID NO: 90986 - protein, 10 aa, Dengue virus
AHHQWMTTED

SEQ ID NO: 90987 - protein, 10 aa, Dengue virus
HHQWMTTEDM

SEQ ID NO: 90988 - protein, 10 aa, Dengue virus
HQWMTTEDML

SEQ ID NO: 90989 - protein, 10 aa, Dengue virus
QWMTTEDMLK

SEQ ID NO: 90990 - protein, 10 aa, Dengue virus
WMTTEDMLKV

SEQ ID NO: 90991 - protein, 10 aa, Dengue virus
MTTEDMLKVW

SEQ ID NO: 90992 - protein, 10 aa, Dengue virus
TTEDMLKVWN

SEQ ID NO: 90993 - protein, 10 aa, Dengue virus
TEDMLKVWNR

SEQ ID NO: 90994 - protein, 10 aa, Dengue virus
EDMLKVWNRV

SEQ ID NO: 90995 - protein, 10 aa, Dengue virus
DMLKVWNRVW

SEQ ID NO: 90996 - protein, 10 aa, Dengue virus
MLKVWNRVWI

SEQ ID NO: 90997 - protein, 10 aa, Dengue virus
LKVWNRVWIE

SEQ ID NO: 90998 - protein, 10 aa, Dengue virus
KVWNRVWIED

SEQ ID NO: 90999 - protein, 10 aa, Dengue virus
VWNRVWIEDN

SEQ ID NO: 91000 - protein, 10 aa, Dengue virus
WNRVWIEDNP

SEQ ID NO: 91001 - protein, 10 aa, Dengue virus
NRVWIEDNPN

SEQ ID NO: 91002 - protein, 10 aa, Dengue virus
RVWIEDNPNM

SEQ ID NO: 91003 - protein, 10 aa, Dengue virus
VWIEDNPNMI

SEQ ID NO: 91004 - protein, 10 aa, Dengue virus
WIEDNPNMID

SEQ ID NO: 91005 - protein, 10 aa, Dengue virus
IEDNPNMIDK

SEQ ID NO: 91006 - protein, 10 aa, Dengue virus
EDNPNMIDKT

SEQ ID NO: 91007 - protein, 10 aa, Dengue virus
DNPNMIDKTP

SEQ ID NO: 91008 - protein, 10 aa, Dengue virus
NPNMIDKTPV

SEQ ID NO: 91009 - protein, 10 aa, Dengue virus
PNMIDKTPVH

SEQ ID NO: 91010 - protein, 10 aa, Dengue virus
NMIDKTPVHS

SEQ ID NO: 91011 - protein, 10 aa, Dengue virus
MIDKTPVHSW

SEQ ID NO: 91012 - protein, 10 aa, Dengue virus
IDKTPVHSWE

SEQ ID NO: 91013 - protein, 10 aa, Dengue virus
DKTPVHSWED

SEQ ID NO: 91014 - protein, 10 aa, Dengue virus
KTPVHSWEDI

SEQ ID NO: 91015 - protein, 10 aa, Dengue virus
TPVHSWEDIP

SEQ ID NO: 91016 - protein, 10 aa, Dengue virus
PVHSWEDIPY

SEQ ID NO: 91017 - protein, 10 aa, Dengue virus
VHSWEDIPYL

SEQ ID NO: 91018 - protein, 10 aa, Dengue virus
HSWEDIPYLG

SEQ ID NO: 91019 - protein, 10 aa, Dengue virus
SWEDIPYLGK

SEQ ID NO: 91020 - protein, 10 aa, Dengue virus
WEDIPYLGKR

SEQ ID NO: 91021 - protein, 10 aa, Dengue virus
EDIPYLGKRE

SEQ ID NO: 91022 - protein, 10 aa, Dengue virus
DIPYLGKRED

SEQ ID NO: 91023 - protein, 10 aa, Dengue virus
IPYLGKREDL

SEQ ID NO: 91024 - protein, 10 aa, Dengue virus
PYLGKREDLW

SEQ ID NO: 91025 - protein, 10 aa, Dengue virus
YLGKREDLWC

SEQ ID NO: 91026 - protein, 10 aa, Dengue virus
LGKREDLWCG

SEQ ID NO: 91027 - protein, 10 aa, Dengue virus
GKREDLWCGS

SEQ ID NO: 91028 - protein, 10 aa, Dengue virus
KREDLWCGSL

SEQ ID NO: 91029 - protein, 10 aa, Dengue virus
REDLWCGSLI

SEQ ID NO: 91030 - protein, 10 aa, Dengue virus
EDLWCGSLIG

SEQ ID NO: 91031 - protein, 10 aa, Dengue virus
DLWCGSLIGL

SEQ ID NO: 91032 - protein, 10 aa, Dengue virus
LWCGSLIGLS

SEQ ID NO: 91033 - protein, 10 aa, Dengue virus
WCGSLIGLSS

SEQ ID NO: 91034 - protein, 10 aa, Dengue virus
CGSLIGLSSR

SEQ ID NO: 91035 - protein, 10 aa, Dengue virus
GSLIGLSSRA

SEQ ID NO: 91036 - protein, 10 aa, Dengue virus
SLIGLSSRAT

SEQ ID NO: 91037 - protein, 10 aa, Dengue virus
LIGLSSRATW

SEQ ID NO: 91038 - protein, 10 aa, Dengue virus
IGLSSRATWA

SEQ ID NO: 91039 - protein, 10 aa, Dengue virus
GLSSRATWAK

SEQ ID NO: 91040 - protein, 10 aa, Dengue virus
LSSRATWAKN

SEQ ID NO: 91041 - protein, 10 aa, Dengue virus
SSRATWAKNI

SEQ ID NO: 91042 - protein, 10 aa, Dengue virus
SRATWAKNIH

SEQ ID NO: 91043 - protein, 10 aa, Dengue virus
RATWAKNIHT

SEQ ID NO: 91044 - protein, 10 aa, Dengue virus
ATWAKNIHTA

SEQ ID NO: 91045 - protein, 10 aa, Dengue virus
TWAKNIHTAI

SEQ ID NO: 91046 - protein, 10 aa, Dengue virus
WAKNIHTAIT

SEQ ID NO: 91047 - protein, 10 aa, Dengue virus
AKNIHTAITQ

SEQ ID NO: 91048 - protein, 10 aa, Dengue virus
KNIHTAITQV

SEQ ID NO: 91049 - protein, 10 aa, Dengue virus
NIHTAITQVR

SEQ ID NO: 91050 - protein, 10 aa, Dengue virus
IHTAITQVRN

SEQ ID NO: 91051 - protein, 10 aa, Dengue virus
HTAITQVRNL

SEQ ID NO: 91052 - protein, 10 aa, Dengue virus
TAITQVRNLI

SEQ ID NO: 91053 - protein, 10 aa, Dengue virus
AITQVRNLIG

SEQ ID NO: 91054 - protein, 10 aa, Dengue virus
ITQVRNLIGK

SEQ ID NO: 91055 - protein, 10 aa, Dengue virus
TQVRNLIGKE

SEQ ID NO: 91056 - protein, 10 aa, Dengue virus
QVRNLIGKEE

SEQ ID NO: 91057 - protein, 10 aa, Dengue virus
VRNLIGKEEY

SEQ ID NO: 91058 - protein, 10 aa, Dengue virus
RNLIGKEEYV

SEQ ID NO: 91059 - protein, 10 aa, Dengue virus
NLIGKEEYVD

SEQ ID NO: 91060 - protein, 10 aa, Dengue virus
LIGKEEYVDY

SEQ ID NO: 91061 - protein, 10 aa, Dengue virus
IGKEEYVDYM

SEQ ID NO: 91062 - protein, 10 aa, Dengue virus
GKEEYVDYMP

SEQ ID NO: 91063 - protein, 10 aa, Dengue virus
KEEYVDYMPV

SEQ ID NO: 91064 - protein, 10 aa, Dengue virus
EEYVDYMPVM

SEQ ID NO: 91065 - protein, 10 aa, Dengue virus
EYVDYMPVMK

SEQ ID NO: 91066 - protein, 10 aa, Dengue virus
YVDYMPVMKR

SEQ ID NO: 91067 - protein, 10 aa, Dengue virus
VDYMPVMKRY

SEQ ID NO: 91068 - protein, 10 aa, Dengue virus
DYMPVMKRYS

SEQ ID NO: 91069 - protein, 10 aa, Dengue virus
YMPVMKRYSA

SEQ ID NO: 91070 - protein, 10 aa, Dengue virus
MPVMKRYSAP

SEQ ID NO: 91071 - protein, 10 aa, Dengue virus
RYSAPSESEG

SEQ ID NO: 91072 - protein, 10 aa, Dengue virus
YSAPSESEGV

SEQ ID NO: 91073 - protein, 10 aa, Dengue virus
SAPSESEGVL

SEQ ID NO: 91074 - protein, 10 aa, Dengue virus
MNQRKKVARP

SEQ ID NO: 91075 - protein, 10 aa, Dengue virus
NQRKKVARPP

SEQ ID NO: 91076 - protein, 10 aa, Dengue virus
QRKKVARPPF

SEQ ID NO: 91077 - protein, 10 aa, Dengue virus
RKKVARPPFN

SEQ ID NO: 91078 - protein, 10 aa, Dengue virus
KKVARPPFNM

SEQ ID NO: 91079 - protein, 10 aa, Dengue virus
KVARPPFNML

SEQ ID NO: 91080 - protein, 10 aa, Dengue virus
VARPPFNMLK

SEQ ID NO: 91081 - protein, 10 aa, Dengue virus
ARPPFNMLKR

SEQ ID NO: 91082 - protein, 10 aa, Dengue virus
NTPFNMLKRE

SEQ ID NO: 91083 - protein, 10 aa, Dengue virus
TPFNMLKRER

SEQ ID NO: 91084 - protein, 10 aa, Dengue virus
KRERNRVSTV

SEQ ID NO: 91085 - protein, 10 aa, Dengue virus
RERNRVSTVQ

SEQ ID NO: 91086 - protein, 10 aa, Dengue virus
ERNRVSTVQQ

SEQ ID NO: 91087 - protein, 10 aa, Dengue virus
RNRVSTVQQL

SEQ ID NO: 91088 - protein, 10 aa, Dengue virus
NRVSTVQQLT

SEQ ID NO: 91089 - protein, 10 aa, Dengue virus
RVSTVQQLTK

SEQ ID NO: 91090 - protein, 10 aa, Dengue virus
VSTVQQLTKR

SEQ ID NO: 91091 - protein, 10 aa, Dengue virus
STVQQLTKRF

SEQ ID NO: 91092 - protein, 10 aa, Dengue virus
TVQQLTKRFS

SEQ ID NO: 91093 - protein, 10 aa, Dengue virus
PQGLVKRFSS

SEQ ID NO: 91094 - protein, 10 aa, Dengue virus
QGLVKRFSSG

SEQ ID NO: 91095 - protein, 10 aa, Dengue virus
GLVKRFSSGL

SEQ ID NO: 91096 - protein, 10 aa, Dengue virus
LVKRFSSGLF

SEQ ID NO: 91097 - protein, 10 aa, Dengue virus
VKRFSSGLFS

SEQ ID NO: 91098 - protein, 10 aa, Dengue virus
KRFSSGLFSG

SEQ ID NO: 91099 - protein, 10 aa, Dengue virus
RFSSGLFSGK

SEQ ID NO: 91100 - protein, 10 aa, Dengue virus
FSSGLFSGKG

SEQ ID NO: 91101 - protein, 10 aa, Dengue virus
SSGLFSGKGP

SEQ ID NO: 91102 - protein, 10 aa, Dengue virus
SGLFSGKGPL

SEQ ID NO: 91103 - protein, 10 aa, Dengue virus
GMLQGRGPLK

SEQ ID NO: 91104 - protein, 10 aa, Dengue virus
MLQGRGPLKL

SEQ ID NO: 91105 - protein, 10 aa, Dengue virus
LQGRGPLKLF

SEQ ID NO: 91106 - protein, 10 aa, Dengue virus
QGRGPLKLFM

SEQ ID NO: 91107 - protein, 10 aa, Dengue virus
GRGPLKLFMA

SEQ ID NO: 91108 - protein, 10 aa, Dengue virus
RGPLKLFMAL

SEQ ID NO: 91109 - protein, 10 aa, Dengue virus
GPLKLFMALV

SEQ ID NO: 91110 - protein, 10 aa, Dengue virus
PLKLFMALVA

SEQ ID NO: 91111 - protein, 10 aa, Dengue virus
LKLFMALVAF

SEQ ID NO: 91112 - protein, 10 aa, Dengue virus
KLFMALVAFL

SEQ ID NO: 91113 - protein, 10 aa, Dengue virus
LFMALVAFLR

SEQ ID NO: 91114 - protein, 10 aa, Dengue virus
FMALVAFLRF

SEQ ID NO: 91115 - protein, 10 aa, Dengue virus
MALVAFLRFL

SEQ ID NO: 91116 - protein, 10 aa, Dengue virus
ALVAFLRFLT

SEQ ID NO: 91117 - protein, 10 aa, Dengue virus
LVAFLRFLTI

SEQ ID NO: 91118 - protein, 10 aa, Dengue virus
VAFLRFLTIP

SEQ ID NO: 91119 - protein, 10 aa, Dengue virus
AFLRFLTIPP

SEQ ID NO: 91120 - protein, 10 aa, Dengue virus
FLRFLTIPPT

SEQ ID NO: 91121 - protein, 10 aa, Dengue virus
LRFLTIPPTA

SEQ ID NO: 91122 - protein, 10 aa, Dengue virus
RFLTIPPTAG

SEQ ID NO: 91123 - protein, 10 aa, Dengue virus
FLTIPPTAGI

SEQ ID NO: 91124 - protein, 10 aa, Dengue virus
LTIPPTAGIL

SEQ ID NO: 91125 - protein, 10 aa, Dengue virus
TIPPTAGILK

SEQ ID NO: 91126 - protein, 10 aa, Dengue virus
TAGILKRWGT

SEQ ID NO: 91127 - protein, 10 aa, Dengue virus
AGILKRWGTI

SEQ ID NO: 91128 - protein, 10 aa, Dengue virus
GILKRWGTIK

SEQ ID NO: 91129 - protein, 10 aa, Dengue virus
ILKRWGTIKK

SEQ ID NO: 91130 - protein, 10 aa, Dengue virus
LKRWGTIKKS

SEQ ID NO: 91131 - protein, 10 aa, Dengue virus
KRWGTIKKSK

SEQ ID NO: 91132 - protein, 10 aa, Dengue virus
RWGTIKKSKA

SEQ ID NO: 91133 - protein, 10 aa, Dengue virus
WGQLKKTKAI

SEQ ID NO: 91134 - protein, 10 aa, Dengue virus
GQLKKNKAIR

SEQ ID NO: 91135 - protein, 10 aa, Dengue virus
QLKKNKAIRI

SEQ ID NO: 91136 - protein, 10 aa, Dengue virus
LKKNKAIRIL

SEQ ID NO: 91137 - protein, 10 aa, Dengue virus
KKNKAIKILT

SEQ ID NO: 91138 - protein, 10 aa, Dengue virus
KNKAIKILTG

SEQ ID NO: 91139 - protein, 10 aa, Dengue virus
NKAIKILTGF

SEQ ID NO: 91140 - protein, 10 aa, Dengue virus
KAIKILTGFR

SEQ ID NO: 91141 - protein, 10 aa, Dengue virus
AIKILTGFRK

SEQ ID NO: 91142 - protein, 10 aa, Dengue virus
IKILTGFRKE

SEQ ID NO: 91143 - protein, 10 aa, Dengue virus
KILTGFRKEI

SEQ ID NO: 91144 - protein, 10 aa, Dengue virus
ILTGFRKEIG

SEQ ID NO: 91145 - protein, 10 aa, Dengue virus
LTGFRKEIGR

SEQ ID NO: 91146 - protein, 10 aa, Dengue virus
TGFRKEIGRM

SEQ ID NO: 91147 - protein, 10 aa, Dengue virus
IGRMLNILNR

SEQ ID NO: 91148 - protein, 10 aa, Dengue virus
GRMLNILNRR

SEQ ID NO: 91149 - protein, 10 aa, Dengue virus
RMLNILNRRR

SEQ ID NO: 91150 - protein, 10 aa, Dengue virus
MLNILNRRRR

SEQ ID NO: 91151 - protein, 10 aa, Dengue virus
LNILNRRRRS

SEQ ID NO: 91152 - protein, 10 aa, Dengue virus
NILNRRRRST

SEQ ID NO: 91153 - protein, 10 aa, Dengue virus
RKRSTMTLLC

SEQ ID NO: 91154 - protein, 10 aa, Dengue virus
KRSTMTLLCL

SEQ ID NO: 91155 - protein, 10 aa, Dengue virus
RSTMTLLCLI

SEQ ID NO: 91156 - protein, 10 aa, Dengue virus
STMTLLCLIP

SEQ ID NO: 91157 - protein, 10 aa, Dengue virus
TMTLLCLIPT

SEQ ID NO: 91158 - protein, 10 aa, Dengue virus
TLLCLIPTAM

SEQ ID NO: 91159 - protein, 10 aa, Dengue virus
LLCLIPTAMA

SEQ ID NO: 91160 - protein, 10 aa, Dengue virus
LCLIPTAMAF

SEQ ID NO: 91161 - protein, 10 aa, Dengue virus
CLIPTAMAFH

SEQ ID NO: 91162 - protein, 10 aa, Dengue virus
LIPTAMAFHL

SEQ ID NO: 91163 - protein, 10 aa, Dengue virus
IPTAMAFHLS

SEQ ID NO: 91164 - protein, 10 aa, Dengue virus
PTAMAFHLST

SEQ ID NO: 91165 - protein, 10 aa, Dengue virus
TAMAFHLSTR

SEQ ID NO: 91166 - protein, 10 aa, Dengue virus
AMAFHLSTRD

SEQ ID NO: 91167 - protein, 10 aa, Dengue virus
MAFSLSTRDG

SEQ ID NO: 91168 - protein, 10 aa, Dengue virus
AFSLSTRDGE

SEQ ID NO: 91169 - protein, 10 aa, Dengue virus
FSLSTRDGEP

SEQ ID NO: 91170 - protein, 10 aa, Dengue virus
SLSTRDGEPL

SEQ ID NO: 91171 - protein, 10 aa, Dengue virus
LTTRNGEPHM

SEQ ID NO: 91172 - protein, 10 aa, Dengue virus
TTRNGEPHMI

SEQ ID NO: 91173 - protein, 10 aa, Dengue virus
TRNGEPHMIV

SEQ ID NO: 91174 - protein, 10 aa, Dengue virus
RNGEPHMIVS

SEQ ID NO: 91175 - protein, 10 aa, Dengue virus
NGEPHMIVSR

SEQ ID NO: 91176 - protein, 10 aa, Dengue virus
GEPHMIVSRQ

SEQ ID NO: 91177 - protein, 10 aa, Dengue virus
EPHMIVSRQE

SEQ ID NO: 91178 - protein, 10 aa, Dengue virus
PHMIVSRQEK

SEQ ID NO: 91179 - protein, 10 aa, Dengue virus
HMIVSRQEKG

SEQ ID NO: 91180 - protein, 10 aa, Dengue virus
MIVSRQEKGK

SEQ ID NO: 91181 - protein, 10 aa, Dengue virus
IVSRQEKGKS

SEQ ID NO: 91182 - protein, 10 aa, Dengue virus
VSRQEKGKSL

SEQ ID NO: 91183 - protein, 10 aa, Dengue virus
SRQEKGKSLL

SEQ ID NO: 91184 - protein, 10 aa, Dengue virus
RQEKGKSLLF

SEQ ID NO: 91185 - protein, 10 aa, Dengue virus
QEKGKSLLFK

SEQ ID NO: 91186 - protein, 10 aa, Dengue virus
EKGKSLLFKT

SEQ ID NO: 91187 - protein, 10 aa, Dengue virus
KGKSLLFKTE

SEQ ID NO: 91188 - protein, 10 aa, Dengue virus
GKSLLFKTED

SEQ ID NO: 91189 - protein, 10 aa, Dengue virus
KSLLFKTEDG

SEQ ID NO: 91190 - protein, 10 aa, Dengue virus
SLLFKTEDGV

SEQ ID NO: 91191 - protein, 10 aa, Dengue virus
LLFKTEDGVN

SEQ ID NO: 91192 - protein, 10 aa, Dengue virus
LFKTEDGVNM

SEQ ID NO: 91193 - protein, 10 aa, Dengue virus
FKTEDGVNMC

SEQ ID NO: 91194 - protein, 10 aa, Dengue virus
KTEDGVNMCT

SEQ ID NO: 91195 - protein, 10 aa, Dengue virus
TEDGVNMCTL

SEQ ID NO: 91196 - protein, 10 aa, Dengue virus
EDGVNMCTLM

SEQ ID NO: 91197 - protein, 10 aa, Dengue virus
DGVNMCTLMA

SEQ ID NO: 91198 - protein, 10 aa, Dengue virus
GVNMCTLMAM

SEQ ID NO: 91199 - protein, 10 aa, Dengue virus
VNMCTLMAMD

SEQ ID NO: 91200 - protein, 10 aa, Dengue virus
NMCTLMAMDL

SEQ ID NO: 91201 - protein, 10 aa, Dengue virus
MCTLMAMDLG

SEQ ID NO: 91202 - protein, 10 aa, Dengue virus
CTLMAMDLGE

SEQ ID NO: 91203 - protein, 10 aa, Dengue virus
TLMAMDLGEL

SEQ ID NO: 91204 - protein, 10 aa, Dengue virus
LMAMDLGELC

SEQ ID NO: 91205 - protein, 10 aa, Dengue virus
MAMDLGELCE

SEQ ID NO: 91206 - protein, 10 aa, Dengue virus
AMDLGELCED

SEQ ID NO: 91207 - protein, 10 aa, Dengue virus
MDLGELCEDT

SEQ ID NO: 91208 - protein, 10 aa, Dengue virus
DLGELCEDTI

SEQ ID NO: 91209 - protein, 10 aa, Dengue virus
LGELCEDTIT

SEQ ID NO: 91210 - protein, 10 aa, Dengue virus
GELCEDTITY

SEQ ID NO: 91211 - protein, 10 aa, Dengue virus
ELCEDTITYK

SEQ ID NO: 91212 - protein, 10 aa, Dengue virus
LCEDTITYKC

SEQ ID NO: 91213 - protein, 10 aa, Dengue virus
CEDTVTYECP

SEQ ID NO: 91214 - protein, 10 aa, Dengue virus
EDTITYKCPL

SEQ ID NO: 91215 - protein, 10 aa, Dengue virus
DTITYKCPLL

SEQ ID NO: 91216 - protein, 10 aa, Dengue virus
TVTYKCPLLI

SEQ ID NO: 91217 - protein, 10 aa, Dengue virus
VTYKCPLLIN

SEQ ID NO: 91218 - protein, 10 aa, Dengue virus
TYKCPLLINT

SEQ ID NO: 91219 - protein, 10 aa, Dengue virus
YKCPLLINTE

SEQ ID NO: 91220 - protein, 10 aa, Dengue virus
KCPLLINTEP

SEQ ID NO: 91221 - protein, 10 aa, Dengue virus
CPLLINTEPE

SEQ ID NO: 91222 - protein, 10 aa, Dengue virus
PLLINTEPED

SEQ ID NO: 91223 - protein, 10 aa, Dengue virus
LLINTEPEDI

SEQ ID NO: 91224 - protein, 10 aa, Dengue virus
LINTEPEDID

SEQ ID NO: 91225 - protein, 10 aa, Dengue virus
INTEPEDIDC

SEQ ID NO: 91226 - protein, 10 aa, Dengue virus
QNEPEDIDCW

SEQ ID NO: 91227 - protein, 10 aa, Dengue virus
NEPEDIDCWC

SEQ ID NO: 91228 - protein, 10 aa, Dengue virus
PEDIDCWCNS

SEQ ID NO: 91229 - protein, 10 aa, Dengue virus
EDIDCWCNST

SEQ ID NO: 91230 - protein, 10 aa, Dengue virus
DIDCWCNSTS

SEQ ID NO: 91231 - protein, 10 aa, Dengue virus
IDCWCNLTSA

SEQ ID NO: 91232 - protein, 10 aa, Dengue virus
DCWCNLTSAW

SEQ ID NO: 91233 - protein, 10 aa, Dengue virus
CWCNLTSAWV

SEQ ID NO: 91234 - protein, 10 aa, Dengue virus
WCNLTSAWVM

SEQ ID NO: 91235 - protein, 10 aa, Dengue virus
CNLTSAWVMY

SEQ ID NO: 91236 - protein, 10 aa, Dengue virus
NLTSAWVMYG

SEQ ID NO: 91237 - protein, 10 aa, Dengue virus
LTSAWVMYGT

SEQ ID NO: 91238 - protein, 10 aa, Dengue virus
TSAWVMYGTC

SEQ ID NO: 91239 - protein, 10 aa, Dengue virus
SAWVMYGTCT

SEQ ID NO: 91240 - protein, 10 aa, Dengue virus
AWVMYGTCTQ

SEQ ID NO: 91241 - protein, 10 aa, Dengue virus
WVMYGTCTQN

SEQ ID NO: 91242 - protein, 10 aa, Dengue virus
VMYGTCTQNG

SEQ ID NO: 91243 - protein, 10 aa, Dengue virus
MYGTCTQNGE

SEQ ID NO: 91244 - protein, 10 aa, Dengue virus
YGTCTQNGER

SEQ ID NO: 91245 - protein, 10 aa, Dengue virus
GTCTQNGERR

SEQ ID NO: 91246 - protein, 10 aa, Dengue virus
TCTQNGERRR

SEQ ID NO: 91247 - protein, 10 aa, Dengue virus
CTQNGERRRE

SEQ ID NO: 91248 - protein, 10 aa, Dengue virus
TQNGERRREK

SEQ ID NO: 91249 - protein, 10 aa, Dengue virus
QNGERRREKR

SEQ ID NO: 91250 - protein, 10 aa, Dengue virus
NGERRREKRS

SEQ ID NO: 91251 - protein, 10 aa, Dengue virus
GEHRREKRSV

SEQ ID NO: 91252 - protein, 10 aa, Dengue virus
EHRREKRSVA

SEQ ID NO: 91253 - protein, 10 aa, Dengue virus
HRREKRSVAL

SEQ ID NO: 91254 - protein, 10 aa, Dengue virus
RREKRSVALV

SEQ ID NO: 91255 - protein, 10 aa, Dengue virus
REKRSVALVP

SEQ ID NO: 91256 - protein, 10 aa, Dengue virus
EKRSVALVPH

SEQ ID NO: 91257 - protein, 10 aa, Dengue virus
KRSVALVPHV

SEQ ID NO: 91258 - protein, 10 aa, Dengue virus
RSVALVPHVG

SEQ ID NO: 91259 - protein, 10 aa, Dengue virus
SVALVPHVGM

SEQ ID NO: 91260 - protein, 10 aa, Dengue virus
VALVPHVGMG

SEQ ID NO: 91261 - protein, 10 aa, Dengue virus
ALVPHVGMGL

SEQ ID NO: 91262 - protein, 10 aa, Dengue virus
LVPHVGMGLE

SEQ ID NO: 91263 - protein, 10 aa, Dengue virus
VPHVGMGLET

SEQ ID NO: 91264 - protein, 10 aa, Dengue virus
PHVGMGLETR

SEQ ID NO: 91265 - protein, 10 aa, Dengue virus
HVGMGLETRT

SEQ ID NO: 91266 - protein, 10 aa, Dengue virus
VGMGLETRTE

SEQ ID NO: 91267 - protein, 10 aa, Dengue virus
GMGLETRTET

SEQ ID NO: 91268 - protein, 10 aa, Dengue virus
MGLETRTETW

SEQ ID NO: 91269 - protein, 10 aa, Dengue virus
GLETRTETWM

SEQ ID NO: 91270 - protein, 10 aa, Dengue virus
LETRTETWMS

SEQ ID NO: 91271 - protein, 10 aa, Dengue virus
ETRTETWMSS

SEQ ID NO: 91272 - protein, 10 aa, Dengue virus
TRTETWMSSE

SEQ ID NO: 91273 - protein, 10 aa, Dengue virus
RTETWMSSEG

SEQ ID NO: 91274 - protein, 10 aa, Dengue virus
TETWMSSEGA

SEQ ID NO: 91275 - protein, 10 aa, Dengue virus
EGAWKHAQRI

SEQ ID NO: 91276 - protein, 10 aa, Dengue virus
GAWKHAQRIE

SEQ ID NO: 91277 - protein, 10 aa, Dengue virus
AWKHAQRIET

SEQ ID NO: 91278 - protein, 10 aa, Dengue virus
WKHAQRIETW

SEQ ID NO: 91279 - protein, 10 aa, Dengue virus
KHAQRIETWI

SEQ ID NO: 91280 - protein, 10 aa, Dengue virus
HAQRIETWIL

SEQ ID NO: 91281 - protein, 10 aa, Dengue virus
AQRIETWILR

SEQ ID NO: 91282 - protein, 10 aa, Dengue virus
QRIETWILRH

SEQ ID NO: 91283 - protein, 10 aa, Dengue virus
RIETWILRHP

SEQ ID NO: 91284 - protein, 10 aa, Dengue virus
IETWILRHPG

SEQ ID NO: 91285 - protein, 10 aa, Dengue virus
ETWILRHPGF

SEQ ID NO: 91286 - protein, 10 aa, Dengue virus
TWILRHPGFT

SEQ ID NO: 91287 - protein, 10 aa, Dengue virus
WILRHPGFTI

SEQ ID NO: 91288 - protein, 10 aa, Dengue virus
ILRHPGFTIM

SEQ ID NO: 91289 - protein, 10 aa, Dengue virus
LRHPGFTIMA

SEQ ID NO: 91290 - protein, 10 aa, Dengue virus
RHPGFTIMAA

SEQ ID NO: 91291 - protein, 10 aa, Dengue virus
HPGFTIMAAI

SEQ ID NO: 91292 - protein, 10 aa, Dengue virus
PGFTIMAAIL

SEQ ID NO: 91293 - protein, 10 aa, Dengue virus
GFTIMAAILA

SEQ ID NO: 91294 - protein, 10 aa, Dengue virus
FTIMAAILAY

SEQ ID NO: 91295 - protein, 10 aa, Dengue virus
TIMAAILAYT

SEQ ID NO: 91296 - protein, 10 aa, Dengue virus
IMAAILAYTI

SEQ ID NO: 91297 - protein, 10 aa, Dengue virus
LAGFMAYMVG

SEQ ID NO: 91298 - protein, 10 aa, Dengue virus
AGFMAYMVGQ

SEQ ID NO: 91299 - protein, 10 aa, Dengue virus
GFMAYMVGQT

SEQ ID NO: 91300 - protein, 10 aa, Dengue virus
ILAYTIGTTH

SEQ ID NO: 91301 - protein, 10 aa, Dengue virus
MAYMVGQTGI

SEQ ID NO: 91302 - protein, 10 aa, Dengue virus
AYMVGQTGIQ

SEQ ID NO: 91303 - protein, 10 aa, Dengue virus
YTIGTTHFQR

SEQ ID NO: 91304 - protein, 10 aa, Dengue virus
TIGTTHFQRA

SEQ ID NO: 91305 - protein, 10 aa, Dengue virus
IGTTHFQRAL

SEQ ID NO: 91306 - protein, 10 aa, Dengue virus
GTTHFQRALI

SEQ ID NO: 91307 - protein, 10 aa, Dengue virus
TTHFQRALIF

SEQ ID NO: 91308 - protein, 10 aa, Dengue virus
TGIQRTVFFI

SEQ ID NO: 91309 - protein, 10 aa, Dengue virus
GIQRTVFFIL

SEQ ID NO: 91310 - protein, 10 aa, Dengue virus
IQRTVFFILM

SEQ ID NO: 91311 - protein, 10 aa, Dengue virus
QRTVFFILMM

SEQ ID NO: 91312 - protein, 10 aa, Dengue virus
RTVFFILMML

SEQ ID NO: 91313 - protein, 10 aa, Dengue virus
TVFFILMMLV

SEQ ID NO: 91314 - protein, 10 aa, Dengue virus
VFFILMMLVA

SEQ ID NO: 91315 - protein, 10 aa, Dengue virus
FFILMMLVAP

SEQ ID NO: 91316 - protein, 10 aa, Dengue virus
FILMMLVAPS

SEQ ID NO: 91317 - protein, 10 aa, Dengue virus
ILMMLVAPSY

SEQ ID NO: 91318 - protein, 10 aa, Dengue virus
LLTAVAPSMT

SEQ ID NO: 91319 - protein, 10 aa, Dengue virus
LTAVAPSMTM

SEQ ID NO: 91320 - protein, 10 aa, Dengue virus
TAVAPSMTMR

SEQ ID NO: 91321 - protein, 10 aa, Dengue virus
AVAPSMTMRC

SEQ ID NO: 91322 - protein, 10 aa, Dengue virus
VAPSMTMRCI

SEQ ID NO: 91323 - protein, 10 aa, Dengue virus
APSYGMRCIG

SEQ ID NO: 91324 - protein, 10 aa, Dengue virus
PSYGMRCIGV

SEQ ID NO: 91325 - protein, 10 aa, Dengue virus
SMTMRCIGIS

SEQ ID NO: 91326 - protein, 10 aa, Dengue virus
MTMRCIGISN

SEQ ID NO: 91327 - protein, 10 aa, Dengue virus
GMRCIGVGNR

SEQ ID NO: 91328 - protein, 10 aa, Dengue virus
MRCIGISNRD

SEQ ID NO: 91329 - protein, 10 aa, Dengue virus
RCIGISNRDF

SEQ ID NO: 91330 - protein, 10 aa, Dengue virus
CIGVGNRDFV

SEQ ID NO: 91331 - protein, 10 aa, Dengue virus
IGVGNRDFVE

SEQ ID NO: 91332 - protein, 10 aa, Dengue virus
GISNRDFVEG

SEQ ID NO: 91333 - protein, 10 aa, Dengue virus
ISNRDFVEGV

SEQ ID NO: 91334 - protein, 10 aa, Dengue virus
SNRDFVEGVS

SEQ ID NO: 91335 - protein, 10 aa, Dengue virus
DFVEGVSGGS

SEQ ID NO: 91336 - protein, 10 aa, Dengue virus
FVEGVSGGSW

SEQ ID NO: 91337 - protein, 10 aa, Dengue virus
VEGVSGGSWV

SEQ ID NO: 91338 - protein, 10 aa, Dengue virus
EGVSGGSWVD

SEQ ID NO: 91339 - protein, 10 aa, Dengue virus
GVSGGSWVDI

SEQ ID NO: 91340 - protein, 10 aa, Dengue virus
VSGGSWVDIV

SEQ ID NO: 91341 - protein, 10 aa, Dengue virus
SGGSWVDIVL

SEQ ID NO: 91342 - protein, 10 aa, Dengue virus
GGSWVDIVLE

SEQ ID NO: 91343 - protein, 10 aa, Dengue virus
GSWVDIVLEH

SEQ ID NO: 91344 - protein, 10 aa, Dengue virus
SWVDIVLEHG

SEQ ID NO: 91345 - protein, 10 aa, Dengue virus
WVDIVLEHGS

SEQ ID NO: 91346 - protein, 10 aa, Dengue virus
VDIVLEHGSC

SEQ ID NO: 91347 - protein, 10 aa, Dengue virus
DIVLEHGSCV

SEQ ID NO: 91348 - protein, 10 aa, Dengue virus
IVLEHGSCVT

SEQ ID NO: 91349 - protein, 10 aa, Dengue virus
VLEHGSCVTT

SEQ ID NO: 91350 - protein, 10 aa, Dengue virus
LEHGSCVTTM

SEQ ID NO: 91351 - protein, 10 aa, Dengue virus
EHGSCVTTMA

SEQ ID NO: 91352 - protein, 10 aa, Dengue virus
HGSCVTTMAK

SEQ ID NO: 91353 - protein, 10 aa, Dengue virus
GSCVTTMAKN

SEQ ID NO: 91354 - protein, 10 aa, Dengue virus
SCVTTMAKNK

SEQ ID NO: 91355 - protein, 10 aa, Dengue virus
CVTTMAKNKP

SEQ ID NO: 91356 - protein, 10 aa, Dengue virus
VTTMAKNKPT

SEQ ID NO: 91357 - protein, 10 aa, Dengue virus
TTMAKNKPTL

SEQ ID NO: 91358 - protein, 10 aa, Dengue virus
TMAKNKPTLD

SEQ ID NO: 91359 - protein, 10 aa, Dengue virus
MAKNKPTLDF

SEQ ID NO: 91360 - protein, 10 aa, Dengue virus
AKNKPTLDFE

SEQ ID NO: 91361 - protein, 10 aa, Dengue virus
KNKPTLDFEL

SEQ ID NO: 91362 - protein, 10 aa, Dengue virus
GKPTLDFELI

SEQ ID NO: 91363 - protein, 10 aa, Dengue virus
KPTLDFELIK

SEQ ID NO: 91364 - protein, 10 aa, Dengue virus
PTLDFELIKT

SEQ ID NO: 91365 - protein, 10 aa, Dengue virus
TLDFELIKTT

SEQ ID NO: 91366 - protein, 10 aa, Dengue virus
LDFELIKTTA

SEQ ID NO: 91367 - protein, 10 aa, Dengue virus
DFELIKTTAK

SEQ ID NO: 91368 - protein, 10 aa, Dengue virus
FELIKTTAKE

SEQ ID NO: 91369 - protein, 10 aa, Dengue virus
ELIKTTAKEV

SEQ ID NO: 91370 - protein, 10 aa, Dengue virus
LIKTTAKEVA

SEQ ID NO: 91371 - protein, 10 aa, Dengue virus
IKTTAKEVAL

SEQ ID NO: 91372 - protein, 10 aa, Dengue virus
KTEAKQPATL

SEQ ID NO: 91373 - protein, 10 aa, Dengue virus
TEAKQPATLR

SEQ ID NO: 91374 - protein, 10 aa, Dengue virus
EAKQPATLRK

SEQ ID NO: 91375 - protein, 10 aa, Dengue virus
AKQPATLRKY

SEQ ID NO: 91376 - protein, 10 aa, Dengue virus
KQPATLRKYC

SEQ ID NO: 91377 - protein, 10 aa, Dengue virus
QPATLRKYCI

SEQ ID NO: 91378 - protein, 10 aa, Dengue virus
PATLRKYCIE

SEQ ID NO: 91379 - protein, 10 aa, Dengue virus
ATLRKYCIEA

SEQ ID NO: 91380 - protein, 10 aa, Dengue virus
LLRTYCIEAL

SEQ ID NO: 91381 - protein, 10 aa, Dengue virus
LRTYCIEALI

SEQ ID NO: 91382 - protein, 10 aa, Dengue virus
RTYCIEALIS

SEQ ID NO: 91383 - protein, 10 aa, Dengue virus
TYCIEALISN

SEQ ID NO: 91384 - protein, 10 aa, Dengue virus
YCIEALISNI

SEQ ID NO: 91385 - protein, 10 aa, Dengue virus
CIEALISNIT

SEQ ID NO: 91386 - protein, 10 aa, Dengue virus
IEALISNITT

SEQ ID NO: 91387 - protein, 10 aa, Dengue virus
EALISNITTA

SEQ ID NO: 91388 - protein, 10 aa, Dengue virus
ALISNITTAT

SEQ ID NO: 91389 - protein, 10 aa, Dengue virus
LISNITTATR

SEQ ID NO: 91390 - protein, 10 aa, Dengue virus
LTNTTTESRC

SEQ ID NO: 91391 - protein, 10 aa, Dengue virus
TNTTTESRCP

SEQ ID NO: 91392 - protein, 10 aa, Dengue virus
NTTTESRCPT

SEQ ID NO: 91393 - protein, 10 aa, Dengue virus
TTTESRCPTQ

SEQ ID NO: 91394 - protein, 10 aa, Dengue virus
TTESRCPTQG

SEQ ID NO: 91395 - protein, 10 aa, Dengue virus
TESRCPTQGE

SEQ ID NO: 91396 - protein, 10 aa, Dengue virus
ESRCPTQGEP

SEQ ID NO: 91397 - protein, 10 aa, Dengue virus
SRCPTQGEPS

SEQ ID NO: 91398 - protein, 10 aa, Dengue virus
RCPTQGEPSL

SEQ ID NO: 91399 - protein, 10 aa, Dengue virus
CPTQGEPSLN

SEQ ID NO: 91400 - protein, 10 aa, Dengue virus
PTQGEPSLNE

SEQ ID NO: 91401 - protein, 10 aa, Dengue virus
TQGEPSLNEE

SEQ ID NO: 91402 - protein, 10 aa, Dengue virus
QGEPSLNEEQ

SEQ ID NO: 91403 - protein, 10 aa, Dengue virus
GEPSLNEEQD

SEQ ID NO: 91404 - protein, 10 aa, Dengue virus
EPSLNEEQDK

SEQ ID NO: 91405 - protein, 10 aa, Dengue virus
PSLNEEQDKR

SEQ ID NO: 91406 - protein, 10 aa, Dengue virus
SLNEEQDKRF

SEQ ID NO: 91407 - protein, 10 aa, Dengue virus
LNEEQDKRFV

SEQ ID NO: 91408 - protein, 10 aa, Dengue virus
NEEQDKRFVC

SEQ ID NO: 91409 - protein, 10 aa, Dengue virus
EEQDKRFVCK

SEQ ID NO: 91410 - protein, 10 aa, Dengue virus
EQDKRFVCKH

SEQ ID NO: 91411 - protein, 10 aa, Dengue virus
QDKRFVCKHS

SEQ ID NO: 91412 - protein, 10 aa, Dengue virus
DKRFVCKHSM

SEQ ID NO: 91413 - protein, 10 aa, Dengue virus
QQYICRRDMV

SEQ ID NO: 91414 - protein, 10 aa, Dengue virus
RFVCKHSMVD

SEQ ID NO: 91415 - protein, 10 aa, Dengue virus
YICRRDMVDR

SEQ ID NO: 91416 - protein, 10 aa, Dengue virus
ICRRDMVDRG

SEQ ID NO: 91417 - protein, 10 aa, Dengue virus
CKHSMVDRGW

SEQ ID NO: 91418 - protein, 10 aa, Dengue virus
KHSMVDRGWG

SEQ ID NO: 91419 - protein, 10 aa, Dengue virus
HSMVDRGWGN

SEQ ID NO: 91420 - protein, 10 aa, Dengue virus
SMVDRGWGNG

SEQ ID NO: 91421 - protein, 10 aa, Dengue virus
MVDRGWGNGC

SEQ ID NO: 91422 - protein, 10 aa, Dengue virus
GCGLFGKGGI

SEQ ID NO: 91423 - protein, 10 aa, Dengue virus
CGLFGKGGIV

SEQ ID NO: 91424 - protein, 10 aa, Dengue virus
GLFGKGGIVT

SEQ ID NO: 91425 - protein, 10 aa, Dengue virus
LFGKGGIVTC

SEQ ID NO: 91426 - protein, 10 aa, Dengue virus
FGKGGIVTCA

SEQ ID NO: 91427 - protein, 10 aa, Dengue virus
GKGGIVTCAM

SEQ ID NO: 91428 - protein, 10 aa, Dengue virus
KGGIVTCAMF

SEQ ID NO: 91429 - protein, 10 aa, Dengue virus
GGVVTCAKFL

SEQ ID NO: 91430 - protein, 10 aa, Dengue virus
GVVTCAKFLC

SEQ ID NO: 91431 - protein, 10 aa, Dengue virus
VVTCAKFLCS

SEQ ID NO: 91432 - protein, 10 aa, Dengue virus
VTCAKFLCSG

SEQ ID NO: 91433 - protein, 10 aa, Dengue virus
TCAKFLCSGK

SEQ ID NO: 91434 - protein, 10 aa, Dengue virus
CAKFLCSGKI

SEQ ID NO: 91435 - protein, 10 aa, Dengue virus
AKFLCSGKIT

SEQ ID NO: 91436 - protein, 10 aa, Dengue virus
KFLCSGKITG

SEQ ID NO: 91437 - protein, 10 aa, Dengue virus
FLCSGKITGN

SEQ ID NO: 91438 - protein, 10 aa, Dengue virus
LCSGKITGNL

SEQ ID NO: 91439 - protein, 10 aa, Dengue virus
CKKNMEGKVV

SEQ ID NO: 91440 - protein, 10 aa, Dengue virus
KKNMEGKVVQ

SEQ ID NO: 91441 - protein, 10 aa, Dengue virus
KNMEGKVVQP

SEQ ID NO: 91442 - protein, 10 aa, Dengue virus
NMEGKVVQPE

SEQ ID NO: 91443 - protein, 10 aa, Dengue virus
MEGKVVQPEN

SEQ ID NO: 91444 - protein, 10 aa, Dengue virus
EGKVVQPENL

SEQ ID NO: 91445 - protein, 10 aa, Dengue virus
GKVVQPENLE

SEQ ID NO: 91446 - protein, 10 aa, Dengue virus
KVVQPENLEY

SEQ ID NO: 91447 - protein, 10 aa, Dengue virus
VVQPENLEYT

SEQ ID NO: 91448 - protein, 10 aa, Dengue virus
VQPENLEYTI

SEQ ID NO: 91449 - protein, 10 aa, Dengue virus
QPENLEYTIV

SEQ ID NO: 91450 - protein, 10 aa, Dengue virus
PENLEYTIVI

SEQ ID NO: 91451 - protein, 10 aa, Dengue virus
ENLEYTIVIT

SEQ ID NO: 91452 - protein, 10 aa, Dengue virus
NLEYTIVITP

SEQ ID NO: 91453 - protein, 10 aa, Dengue virus
LEYTIVITPH

SEQ ID NO: 91454 - protein, 10 aa, Dengue virus
EYTIVITPHS

SEQ ID NO: 91455 - protein, 10 aa, Dengue virus
YTIVITPHSG

SEQ ID NO: 91456 - protein, 10 aa, Dengue virus
TIVITPHSGE

SEQ ID NO: 91457 - protein, 10 aa, Dengue virus
IVITPHSGEE

SEQ ID NO: 91458 - protein, 10 aa, Dengue virus
VITPHSGEEH

SEQ ID NO: 91459 - protein, 10 aa, Dengue virus
ITPHSGEEHA

SEQ ID NO: 91460 - protein, 10 aa, Dengue virus
TPHSGEEHAV

SEQ ID NO: 91461 - protein, 10 aa, Dengue virus
PHSGEEHAVG

SEQ ID NO: 91462 - protein, 10 aa, Dengue virus
HSGEEHAVGN

SEQ ID NO: 91463 - protein, 10 aa, Dengue virus
SGEEHAVGND

SEQ ID NO: 91464 - protein, 10 aa, Dengue virus
GDTHAVGNDI

SEQ ID NO: 91465 - protein, 10 aa, Dengue virus
EEHAVGNDTG

SEQ ID NO: 91466 - protein, 10 aa, Dengue virus
EHAVGNDTGK

SEQ ID NO: 91467 - protein, 10 aa, Dengue virus
HAVGNDIPNH

SEQ ID NO: 91468 - protein, 10 aa, Dengue virus
AVGNDTGKHG

SEQ ID NO: 91469 - protein, 10 aa, Dengue virus
VGNDIPNHGV

SEQ ID NO: 91470 - protein, 10 aa, Dengue virus
GNDTGKHGKE

SEQ ID NO: 91471 - protein, 10 aa, Dengue virus
NDTGKHGKEI

SEQ ID NO: 91472 - protein, 10 aa, Dengue virus
DTSNHGVTAM

SEQ ID NO: 91473 - protein, 10 aa, Dengue virus
TSNHGVTAMI

SEQ ID NO: 91474 - protein, 10 aa, Dengue virus
SNHGVTAMIT

SEQ ID NO: 91475 - protein, 10 aa, Dengue virus
NHGVTAMITP

SEQ ID NO: 91476 - protein, 10 aa, Dengue virus
HGVTAMITPR

SEQ ID NO: 91477 - protein, 10 aa, Dengue virus
GVTAMITPRS

SEQ ID NO: 91478 - protein, 10 aa, Dengue virus
VTAMITPRSP

SEQ ID NO: 91479 - protein, 10 aa, Dengue virus
TAMITPRSPS

SEQ ID NO: 91480 - protein, 10 aa, Dengue virus
AMITPRSPSV

SEQ ID NO: 91481 - protein, 10 aa, Dengue virus
MITPRSPSVE

SEQ ID NO: 91482 - protein, 10 aa, Dengue virus
ITPRTPSVEV

SEQ ID NO: 91483 - protein, 10 aa, Dengue virus
TPQSSITEAE

SEQ ID NO: 91484 - protein, 10 aa, Dengue virus
PRTPSVEVKL

SEQ ID NO: 91485 - protein, 10 aa, Dengue virus
RTPSVEVKLP

SEQ ID NO: 91486 - protein, 10 aa, Dengue virus
TPSVEVKLPD

SEQ ID NO: 91487 - protein, 10 aa, Dengue virus
PSVEVELPDY

SEQ ID NO: 91488 - protein, 10 aa, Dengue virus
ITEAELTGYG

SEQ ID NO: 91489 - protein, 10 aa, Dengue virus
VEVELPDYGE

SEQ ID NO: 91490 - protein, 10 aa, Dengue virus
EVELPDYGEL

SEQ ID NO: 91491 - protein, 10 aa, Dengue virus
AELTGYGTVT

SEQ ID NO: 91492 - protein, 10 aa, Dengue virus
ELTGYGTVTM

SEQ ID NO: 91493 - protein, 10 aa, Dengue virus
LTGYGTVTME

SEQ ID NO: 91494 - protein, 10 aa, Dengue virus
TGYGTVTMEC

SEQ ID NO: 91495 - protein, 10 aa, Dengue virus
DYGELSLDCE

SEQ ID NO: 91496 - protein, 10 aa, Dengue virus
YGTVTMECSP

SEQ ID NO: 91497 - protein, 10 aa, Dengue virus
GTVTMECSPR

SEQ ID NO: 91498 - protein, 10 aa, Dengue virus
ELSLDCEPRS

SEQ ID NO: 91499 - protein, 10 aa, Dengue virus
LSLDCEPRSG

SEQ ID NO: 91500 - protein, 10 aa, Dengue virus
SLDCEPRSGI

SEQ ID NO: 91501 - protein, 10 aa, Dengue virus
MECSPRTGLD

SEQ ID NO: 91502 - protein, 10 aa, Dengue virus
ECSPRTGLDF

SEQ ID NO: 91503 - protein, 10 aa, Dengue virus
CSPRTGLDFN

SEQ ID NO: 91504 - protein, 10 aa, Dengue virus
SPRTGLDFNE

SEQ ID NO: 91505 - protein, 10 aa, Dengue virus
PRTGLDFNEM

SEQ ID NO: 91506 - protein, 10 aa, Dengue virus
RTGLDFNEMV

SEQ ID NO: 91507 - protein, 10 aa, Dengue virus
TGLDFNEMVL

SEQ ID NO: 91508 - protein, 10 aa, Dengue virus
GLDFNEMVLL

SEQ ID NO: 91509 - protein, 10 aa, Dengue virus
IDFNEMILME

SEQ ID NO: 91510 - protein, 10 aa, Dengue virus
DFNEMILMEM

SEQ ID NO: 91511 - protein, 10 aa, Dengue virus
FNEMILMEMK

SEQ ID NO: 91512 - protein, 10 aa, Dengue virus
MEKKTWLVHK

SEQ ID NO: 91513 - protein, 10 aa, Dengue virus
EKKTWLVHKQ

SEQ ID NO: 91514 - protein, 10 aa, Dengue virus
NKAWLVHRQW

SEQ ID NO: 91515 - protein, 10 aa, Dengue virus
KAWLVHRQWF

SEQ ID NO: 91516 - protein, 10 aa, Dengue virus
AWLVHRQWFL

SEQ ID NO: 91517 - protein, 10 aa, Dengue virus
WLVHRQWFLD

SEQ ID NO: 91518 - protein, 10 aa, Dengue virus
LVHRQWFLDL

SEQ ID NO: 91519 - protein, 10 aa, Dengue virus
VHRQWFLDLP

SEQ ID NO: 91520 - protein, 10 aa, Dengue virus
HRQWFLDLPL

SEQ ID NO: 91521 - protein, 10 aa, Dengue virus
RQWFLDLPLP

SEQ ID NO: 91522 - protein, 10 aa, Dengue virus
WFLDLPLPWA

SEQ ID NO: 91523 - protein, 10 aa, Dengue virus
FLDLPLPWTT

SEQ ID NO: 91524 - protein, 10 aa, Dengue virus
LDLPLPWTTG

SEQ ID NO: 91525 - protein, 10 aa, Dengue virus
DLPLPWTTGA

SEQ ID NO: 91526 - protein, 10 aa, Dengue virus
LPLPWTTGAD

SEQ ID NO: 91527 - protein, 10 aa, Dengue virus
PLPWTTGADT

SEQ ID NO: 91528 - protein, 10 aa, Dengue virus
LPWTTGADTS

SEQ ID NO: 91529 - protein, 10 aa, Dengue virus
PWTTGADTSE

SEQ ID NO: 91530 - protein, 10 aa, Dengue virus
WTTGADTSEV

SEQ ID NO: 91531 - protein, 10 aa, Dengue virus
TTGADTSEVH

SEQ ID NO: 91532 - protein, 10 aa, Dengue virus
TGADTSEVHW

SEQ ID NO: 91533 - protein, 10 aa, Dengue virus
GADTQGSNWI

SEQ ID NO: 91534 - protein, 10 aa, Dengue virus
ADTSEVHWNH

SEQ ID NO: 91535 - protein, 10 aa, Dengue virus
DTSEVHWNHK

SEQ ID NO: 91536 - protein, 10 aa, Dengue virus
TSEVHWNHKE

SEQ ID NO: 91537 - protein, 10 aa, Dengue virus
SEVHWNHKER

SEQ ID NO: 91538 - protein, 10 aa, Dengue virus
EVHWNHKERM

SEQ ID NO: 91539 - protein, 10 aa, Dengue virus
VHWNHKERMV

SEQ ID NO: 91540 - protein, 10 aa, Dengue virus
HWNHKERMVT

SEQ ID NO: 91541 - protein, 10 aa, Dengue virus
WNHKERMVTF

SEQ ID NO: 91542 - protein, 10 aa, Dengue virus
NHKERMVTFK

SEQ ID NO: 91543 - protein, 10 aa, Dengue virus
HKERMVTFKV

SEQ ID NO: 91544 - protein, 10 aa, Dengue virus
KETLVTFKNP

SEQ ID NO: 91545 - protein, 10 aa, Dengue virus
ETLVTFKNPH

SEQ ID NO: 91546 - protein, 10 aa, Dengue virus
TLVTFKNPHA

SEQ ID NO: 91547 - protein, 10 aa, Dengue virus
LVTFKNPHAK

SEQ ID NO: 91548 - protein, 10 aa, Dengue virus
VTFKNPHAKK

SEQ ID NO: 91549 - protein, 10 aa, Dengue virus
TFKNPHAKKQ

SEQ ID NO: 91550 - protein, 10 aa, Dengue virus
FKNPHAKKQD

SEQ ID NO: 91551 - protein, 10 aa, Dengue virus
KNPHAKKQDV

SEQ ID NO: 91552 - protein, 10 aa, Dengue virus
NPHAKKQDVV

SEQ ID NO: 91553 - protein, 10 aa, Dengue virus
PHAKKQDVVV

SEQ ID NO: 91554 - protein, 10 aa, Dengue virus
HAKKQDVVVL

SEQ ID NO: 91555 - protein, 10 aa, Dengue virus
AKKQDVVVLG

SEQ ID NO: 91556 - protein, 10 aa, Dengue virus
KKQDVVVLGS

SEQ ID NO: 91557 - protein, 10 aa, Dengue virus
KQDVVVLGSQ

SEQ ID NO: 91558 - protein, 10 aa, Dengue virus
QDVVVLGSQE

SEQ ID NO: 91559 - protein, 10 aa, Dengue virus
DVVVLGSQEG

SEQ ID NO: 91560 - protein, 10 aa, Dengue virus
VVVLGSQEGA

SEQ ID NO: 91561 - protein, 10 aa, Dengue virus
VVLGSQEGAM

SEQ ID NO: 91562 - protein, 10 aa, Dengue virus
LGSQEGAMHT

SEQ ID NO: 91563 - protein, 10 aa, Dengue virus
GSQEGAMHTA

SEQ ID NO: 91564 - protein, 10 aa, Dengue virus
SQEGAMHTAL

SEQ ID NO: 91565 - protein, 10 aa, Dengue virus
QEGAMHSALT

SEQ ID NO: 91566 - protein, 10 aa, Dengue virus
EGAMHSALTG

SEQ ID NO: 91567 - protein, 10 aa, Dengue virus
GAMHSALTGA

SEQ ID NO: 91568 - protein, 10 aa, Dengue virus
AMHSALTGAT

SEQ ID NO: 91569 - protein, 10 aa, Dengue virus
MHSALTGATE

SEQ ID NO: 91570 - protein, 10 aa, Dengue virus
HSALTGATEV

SEQ ID NO: 91571 - protein, 10 aa, Dengue virus
SALTGATEVD

SEQ ID NO: 91572 - protein, 10 aa, Dengue virus
ALTGATEVDS

SEQ ID NO: 91573 - protein, 10 aa, Dengue virus
LTGATEVDSG

SEQ ID NO: 91574 - protein, 10 aa, Dengue virus
TGATEVDSGD

SEQ ID NO: 91575 - protein, 10 aa, Dengue virus
GATEIQMSSG

SEQ ID NO: 91576 - protein, 10 aa, Dengue virus
ATEIQMSSGN

SEQ ID NO: 91577 - protein, 10 aa, Dengue virus
TEIQMSSGNL

SEQ ID NO: 91578 - protein, 10 aa, Dengue virus
EIQMSSGNLL

SEQ ID NO: 91579 - protein, 10 aa, Dengue virus
IQMSSGNLLF

SEQ ID NO: 91580 - protein, 10 aa, Dengue virus
QMSSGNLLFT

SEQ ID NO: 91581 - protein, 10 aa, Dengue virus
MSSGNLLFTG

SEQ ID NO: 91582 - protein, 10 aa, Dengue virus
SSGNLLFTGH

SEQ ID NO: 91583 - protein, 10 aa, Dengue virus
SGNLLFTGHL

SEQ ID NO: 91584 - protein, 10 aa, Dengue virus
GNLLFTGHLK

SEQ ID NO: 91585 - protein, 10 aa, Dengue virus
NLLFTGHLKC

SEQ ID NO: 91586 - protein, 10 aa, Dengue virus
LLFTGHLKCR

SEQ ID NO: 91587 - protein, 10 aa, Dengue virus
LFTGHLKCRL

SEQ ID NO: 91588 - protein, 10 aa, Dengue virus
FTGHLKCRLR

SEQ ID NO: 91589 - protein, 10 aa, Dengue virus
TGHLKCRLRM

SEQ ID NO: 91590 - protein, 10 aa, Dengue virus
GHLKCRLRMD

SEQ ID NO: 91591 - protein, 10 aa, Dengue virus
HLKCRLRMDK

SEQ ID NO: 91592 - protein, 10 aa, Dengue virus
LKCRLRMDKL

SEQ ID NO: 91593 - protein, 10 aa, Dengue virus
KCRLRMDKLQ

SEQ ID NO: 91594 - protein, 10 aa, Dengue virus
CRLRMDKLQL

SEQ ID NO: 91595 - protein, 10 aa, Dengue virus
RLRMDKLQLK

SEQ ID NO: 91596 - protein, 10 aa, Dengue virus
LRMDKLQLKG

SEQ ID NO: 91597 - protein, 10 aa, Dengue virus
RMDKLQLKGM

SEQ ID NO: 91598 - protein, 10 aa, Dengue virus
MDKLQLKGMS

SEQ ID NO: 91599 - protein, 10 aa, Dengue virus
DKLQLKGMSY

SEQ ID NO: 91600 - protein, 10 aa, Dengue virus
KLQLKGMSYS

SEQ ID NO: 91601 - protein, 10 aa, Dengue virus
LQLKGMSYSM

SEQ ID NO: 91602 - protein, 10 aa, Dengue virus
QLKGMSYSMC

SEQ ID NO: 91603 - protein, 10 aa, Dengue virus
LKGMSYSMCT

SEQ ID NO: 91604 - protein, 10 aa, Dengue virus
KGMSYSMCTG

SEQ ID NO: 91605 - protein, 10 aa, Dengue virus
GMSYSMCTGK

SEQ ID NO: 91606 - protein, 10 aa, Dengue virus
MSYSMCTGKF

SEQ ID NO: 91607 - protein, 10 aa, Dengue virus
SYSMCTGKFK

SEQ ID NO: 91608 - protein, 10 aa, Dengue virus
YSMCTGKFKV

SEQ ID NO: 91609 - protein, 10 aa, Dengue virus
SMCTGKFKVV

SEQ ID NO: 91610 - protein, 10 aa, Dengue virus
MCSGKFSIDR

SEQ ID NO: 91611 - protein, 10 aa, Dengue virus
CSGKFSIDRE

SEQ ID NO: 91612 - protein, 10 aa, Dengue virus
TGKFKVVKEI

SEQ ID NO: 91613 - protein, 10 aa, Dengue virus
GKFSIDREMA

SEQ ID NO: 91614 - protein, 10 aa, Dengue virus
KFKVVKEIAE

SEQ ID NO: 91615 - protein, 10 aa, Dengue virus
FKVVKEIAET

SEQ ID NO: 91616 - protein, 10 aa, Dengue virus
KVVKEIAETQ

SEQ ID NO: 91617 - protein, 10 aa, Dengue virus
IDREMAETQH

SEQ ID NO: 91618 - protein, 10 aa, Dengue virus
DREMAETQHG

SEQ ID NO: 91619 - protein, 10 aa, Dengue virus
KEIAETQHGT

SEQ ID NO: 91620 - protein, 10 aa, Dengue virus
EIAETQHGTI

SEQ ID NO: 91621 - protein, 10 aa, Dengue virus
IAETQHGTIV

SEQ ID NO: 91622 - protein, 10 aa, Dengue virus
AETQHGTIVI

SEQ ID NO: 91623 - protein, 10 aa, Dengue virus
ETQHGTIVIR

SEQ ID NO: 91624 - protein, 10 aa, Dengue virus
TQHGTIVIRV

SEQ ID NO: 91625 - protein, 10 aa, Dengue virus
QHGTIVIRVQ

SEQ ID NO: 91626 - protein, 10 aa, Dengue virus
HGTIVIRVQY

SEQ ID NO: 91627 - protein, 10 aa, Dengue virus
GTIVIRVQYE

SEQ ID NO: 91628 - protein, 10 aa, Dengue virus
TIVIRVQYEG

SEQ ID NO: 91629 - protein, 10 aa, Dengue virus
TVVKVKYEGT

SEQ ID NO: 91630 - protein, 10 aa, Dengue virus
VVKVKYEGTG

SEQ ID NO: 91631 - protein, 10 aa, Dengue virus
VKVKYEGTGA

SEQ ID NO: 91632 - protein, 10 aa, Dengue virus
KVKYEGTGAP

SEQ ID NO: 91633 - protein, 10 aa, Dengue virus
VKYEGTGAPC

SEQ ID NO: 91634 - protein, 10 aa, Dengue virus
KYEGTGAPCK

SEQ ID NO: 91635 - protein, 10 aa, Dengue virus
YEGTGAPCKV

SEQ ID NO: 91636 - protein, 10 aa, Dengue virus
EGTGAPCKVP

SEQ ID NO: 91637 - protein, 10 aa, Dengue virus
GTGAPCKVPI

SEQ ID NO: 91638 - protein, 10 aa, Dengue virus
TGAPCKVPIE

SEQ ID NO: 91639 - protein, 10 aa, Dengue virus
GAPCKIPIEI

SEQ ID NO: 91640 - protein, 10 aa, Dengue virus
SPCKIPFEIM

SEQ ID NO: 91641 - protein, 10 aa, Dengue virus
PCKIPIEIRD

SEQ ID NO: 91642 - protein, 10 aa, Dengue virus
CKIPFEIMDL

SEQ ID NO: 91643 - protein, 10 aa, Dengue virus
KIPFEIMDLE

SEQ ID NO: 91644 - protein, 10 aa, Dengue virus
IPIEIRDVNK

SEQ ID NO: 91645 - protein, 10 aa, Dengue virus
PIEIRDVNKK

SEQ ID NO: 91646 - protein, 10 aa, Dengue virus
IEIRDVNKKK

SEQ ID NO: 91647 - protein, 10 aa, Dengue virus
EIRDVNKKKV

SEQ ID NO: 91648 - protein, 10 aa, Dengue virus
IRDVNKKKVV

SEQ ID NO: 91649 - protein, 10 aa, Dengue virus
RDVNKKKVVG

SEQ ID NO: 91650 - protein, 10 aa, Dengue virus
DVNKKKVVGR

SEQ ID NO: 91651 - protein, 10 aa, Dengue virus
AESTNSVTNI

SEQ ID NO: 91652 - protein, 10 aa, Dengue virus
ESTNSVTNIE

SEQ ID NO: 91653 - protein, 10 aa, Dengue virus
NTNSATNIEL

SEQ ID NO: 91654 - protein, 10 aa, Dengue virus
TNSATNIELE

SEQ ID NO: 91655 - protein, 10 aa, Dengue virus
NSATNIELEP

SEQ ID NO: 91656 - protein, 10 aa, Dengue virus
SATNIELEPP

SEQ ID NO: 91657 - protein, 10 aa, Dengue virus
ATNIELEPPF

SEQ ID NO: 91658 - protein, 10 aa, Dengue virus
VNIEAEPPFG

SEQ ID NO: 91659 - protein, 10 aa, Dengue virus
NIEAEPPFGD

SEQ ID NO: 91660 - protein, 10 aa, Dengue virus
IEAEPPFGDS

SEQ ID NO: 91661 - protein, 10 aa, Dengue virus
EAEPPFGDSY

SEQ ID NO: 91662 - protein, 10 aa, Dengue virus
AEPPFGDSYI

SEQ ID NO: 91663 - protein, 10 aa, Dengue virus
EPPFGDSYII

SEQ ID NO: 91664 - protein, 10 aa, Dengue virus
PPFGDSYIII

SEQ ID NO: 91665 - protein, 10 aa, Dengue virus
PFGDSYIIIG

SEQ ID NO: 91666 - protein, 10 aa, Dengue virus
FGDSYIIIGV

SEQ ID NO: 91667 - protein, 10 aa, Dengue virus
GDSYIMIGVG

SEQ ID NO: 91668 - protein, 10 aa, Dengue virus
DSYIVIGVGD

SEQ ID NO: 91669 - protein, 10 aa, Dengue virus
SYIVIGVGDS

SEQ ID NO: 91670 - protein, 10 aa, Dengue virus
YIVIGVGDSA

SEQ ID NO: 91671 - protein, 10 aa, Dengue virus
IVIGVGDSAL

SEQ ID NO: 91672 - protein, 10 aa, Dengue virus
VIGVGDSALT

SEQ ID NO: 91673 - protein, 10 aa, Dengue virus
IGVGDSALTL

SEQ ID NO: 91674 - protein, 10 aa, Dengue virus
GVGDSALTLH

SEQ ID NO: 91675 - protein, 10 aa, Dengue virus
VGDSALTLHW

SEQ ID NO: 91676 - protein, 10 aa, Dengue virus
GDSALTLHWF

SEQ ID NO: 91677 - protein, 10 aa, Dengue virus
DSALTLHWFR

SEQ ID NO: 91678 - protein, 10 aa, Dengue virus
GQLKLNWFKK

SEQ ID NO: 91679 - protein, 10 aa, Dengue virus
QLKLNWFKKG

SEQ ID NO: 91680 - protein, 10 aa, Dengue virus
LKLNWFKKGS

SEQ ID NO: 91681 - protein, 10 aa, Dengue virus
KLNWFKKGSS

SEQ ID NO: 91682 - protein, 10 aa, Dengue virus
LNWFKKGSSI

SEQ ID NO: 91683 - protein, 10 aa, Dengue virus
NWFKKGSSIG

SEQ ID NO: 91684 - protein, 10 aa, Dengue virus
WFKKGSSIGQ

SEQ ID NO: 91685 - protein, 10 aa, Dengue virus
FKKGSSIGQM

SEQ ID NO: 91686 - protein, 10 aa, Dengue virus
KKGSSIGQMF

SEQ ID NO: 91687 - protein, 10 aa, Dengue virus
KGSSIGKMLE

SEQ ID NO: 91688 - protein, 10 aa, Dengue virus
GSSIGKMLES

SEQ ID NO: 91689 - protein, 10 aa, Dengue virus
SSIGKMLEST

SEQ ID NO: 91690 - protein, 10 aa, Dengue virus
SIGKMLESTY

SEQ ID NO: 91691 - protein, 10 aa, Dengue virus
IGKMLESTYR

SEQ ID NO: 91692 - protein, 10 aa, Dengue virus
GKMLESTYRG

SEQ ID NO: 91693 - protein, 10 aa, Dengue virus
QMFETTMRGA

SEQ ID NO: 91694 - protein, 10 aa, Dengue virus
MLESTYRGAK

SEQ ID NO: 91695 - protein, 10 aa, Dengue virus
FETTMRGAKR

SEQ ID NO: 91696 - protein, 10 aa, Dengue virus
ETTMRGAKRM

SEQ ID NO: 91697 - protein, 10 aa, Dengue virus
TTMRGAKRMA

SEQ ID NO: 91698 - protein, 10 aa, Dengue virus
TMRGAKRMAI

SEQ ID NO: 91699 - protein, 10 aa, Dengue virus
MRGAKRMAIL

SEQ ID NO: 91700 - protein, 10 aa, Dengue virus
GAKRMAILGD

SEQ ID NO: 91701 - protein, 10 aa, Dengue virus
AKRMAILGDT

SEQ ID NO: 91702 - protein, 10 aa, Dengue virus
KRMAILGDTA

SEQ ID NO: 91703 - protein, 10 aa, Dengue virus
RMAILGDTAW

SEQ ID NO: 91704 - protein, 10 aa, Dengue virus
MAILGDTAWD

SEQ ID NO: 91705 - protein, 10 aa, Dengue virus
AILGDTAWDF

SEQ ID NO: 91706 - protein, 10 aa, Dengue virus
ILGDTAWDFG

SEQ ID NO: 91707 - protein, 10 aa, Dengue virus
LGDTAWDFGS

SEQ ID NO: 91708 - protein, 10 aa, Dengue virus
GDTAWDFGSL

SEQ ID NO: 91709 - protein, 10 aa, Dengue virus
DTAWDFGSLG

SEQ ID NO: 91710 - protein, 10 aa, Dengue virus
TAWDFGSLGG

SEQ ID NO: 91711 - protein, 10 aa, Dengue virus
AWDFGSLGGV

SEQ ID NO: 91712 - protein, 10 aa, Dengue virus
WDFGSVGGLL

SEQ ID NO: 91713 - protein, 10 aa, Dengue virus
DFGSVGGLLT

SEQ ID NO: 91714 - protein, 10 aa, Dengue virus
FGSVGGLLTS

SEQ ID NO: 91715 - protein, 10 aa, Dengue virus
GSVGGLLTSL

SEQ ID NO: 91716 - protein, 10 aa, Dengue virus
SVGGLLTSLG

SEQ ID NO: 91717 - protein, 10 aa, Dengue virus
VGGLLTSLGK

SEQ ID NO: 91718 - protein, 10 aa, Dengue virus
GGLLTSLGKA

SEQ ID NO: 91719 - protein, 10 aa, Dengue virus
GLLTSLGKAV

SEQ ID NO: 91720 - protein, 10 aa, Dengue virus
LLTSLGKAVH

SEQ ID NO: 91721 - protein, 10 aa, Dengue virus
LTSLGKAVHQ

SEQ ID NO: 91722 - protein, 10 aa, Dengue virus
TSIGKALHQV

SEQ ID NO: 91723 - protein, 10 aa, Dengue virus
SLGKAVHQIF

SEQ ID NO: 91724 - protein, 10 aa, Dengue virus
LGKAVHQIFG

SEQ ID NO: 91725 - protein, 10 aa, Dengue virus
GKAVHQIFGS

SEQ ID NO: 91726 - protein, 10 aa, Dengue virus
KALHQVFGAI

SEQ ID NO: 91727 - protein, 10 aa, Dengue virus
AVHQIFGSVY

SEQ ID NO: 91728 - protein, 10 aa, Dengue virus
VHQIFGSVYT

SEQ ID NO: 91729 - protein, 10 aa, Dengue virus
HQVFGAIYGA

SEQ ID NO: 91730 - protein, 10 aa, Dengue virus
QVFGAIYGAA

SEQ ID NO: 91731 - protein, 10 aa, Dengue virus
VFGAIYGAAF

SEQ ID NO: 91732 - protein, 10 aa, Dengue virus
FGAIYGAAFS

SEQ ID NO: 91733 - protein, 10 aa, Dengue virus
GAIYGAAFSG

SEQ ID NO: 91734 - protein, 10 aa, Dengue virus
AIYGAAFSGV

SEQ ID NO: 91735 - protein, 10 aa, Dengue virus
IYGAAFSGVS

SEQ ID NO: 91736 - protein, 10 aa, Dengue virus
YGAAFSGVSW

SEQ ID NO: 91737 - protein, 10 aa, Dengue virus
GAAFSGVSWT

SEQ ID NO: 91738 - protein, 10 aa, Dengue virus
TMFGGVSWMV

SEQ ID NO: 91739 - protein, 10 aa, Dengue virus
MFGGVSWMVR

SEQ ID NO: 91740 - protein, 10 aa, Dengue virus
FGGVSWMVRI

SEQ ID NO: 91741 - protein, 10 aa, Dengue virus
GGVSWMVRIL

SEQ ID NO: 91742 - protein, 10 aa, Dengue virus
GVSWMVRILI

SEQ ID NO: 91743 - protein, 10 aa, Dengue virus
VSWMVRILIG

SEQ ID NO: 91744 - protein, 10 aa, Dengue virus
VRILIGFLVL

SEQ ID NO: 91745 - protein, 10 aa, Dengue virus
RILIGLLVLW

SEQ ID NO: 91746 - protein, 10 aa, Dengue virus
ILIGLLVLWI

SEQ ID NO: 91747 - protein, 10 aa, Dengue virus
LIGLLVLWIG

SEQ ID NO: 91748 - protein, 10 aa, Dengue virus
IGLLVLWIGT

SEQ ID NO: 91749 - protein, 10 aa, Dengue virus
GLLVLWIGTN

SEQ ID NO: 91750 - protein, 10 aa, Dengue virus
LLVLWIGTNS

SEQ ID NO: 91751 - protein, 10 aa, Dengue virus
IITWIGMNSR

SEQ ID NO: 91752 - protein, 10 aa, Dengue virus
ITWIGMNSRN

SEQ ID NO: 91753 - protein, 10 aa, Dengue virus
TWIGMNSRNT

SEQ ID NO: 91754 - protein, 10 aa, Dengue virus
WIGMNSRNTS

SEQ ID NO: 91755 - protein, 10 aa, Dengue virus
IGTNSRNTPM

SEQ ID NO: 91756 - protein, 10 aa, Dengue virus
GMNSRNTSMA

SEQ ID NO: 91757 - protein, 10 aa, Dengue virus
TNSRNTPMAM

SEQ ID NO: 91758 - protein, 10 aa, Dengue virus
NSRNTSMAMS

SEQ ID NO: 91759 - protein, 10 aa, Dengue virus
SRNTSMAMSC

SEQ ID NO: 91760 - protein, 10 aa, Dengue virus
RNTSMAMSCI

SEQ ID NO: 91761 - protein, 10 aa, Dengue virus
NTSMAMSCIA

SEQ ID NO: 91762 - protein, 10 aa, Dengue virus
TSMAMSCIAV

SEQ ID NO: 91763 - protein, 10 aa, Dengue virus
SMAMSCIAVG

SEQ ID NO: 91764 - protein, 10 aa, Dengue virus
MAMSCIAVGG

SEQ ID NO: 91765 - protein, 10 aa, Dengue virus
AMSCIAVGGI

SEQ ID NO: 91766 - protein, 10 aa, Dengue virus
MSCIAVGGIT

SEQ ID NO: 91767 - protein, 10 aa, Dengue virus
SCIAVGGITL

SEQ ID NO: 91768 - protein, 10 aa, Dengue virus
ITLFLGFTVH

SEQ ID NO: 91769 - protein, 10 aa, Dengue virus
TLFLGFTVHA

SEQ ID NO: 91770 - protein, 10 aa, Dengue virus
LFLGFTVHAD

SEQ ID NO: 91771 - protein, 10 aa, Dengue virus
FLGFTVHADM

SEQ ID NO: 91772 - protein, 10 aa, Dengue virus
LGFTVHADMG

SEQ ID NO: 91773 - protein, 10 aa, Dengue virus
GFTVHADMGC

SEQ ID NO: 91774 - protein, 10 aa, Dengue virus
SWSGKELKCG

SEQ ID NO: 91775 - protein, 10 aa, Dengue virus
WSGKELKCGS

SEQ ID NO: 91776 - protein, 10 aa, Dengue virus
SGKELKCGSG

SEQ ID NO: 91777 - protein, 10 aa, Dengue virus
GKELKCGSGI

SEQ ID NO: 91778 - protein, 10 aa, Dengue virus
KELKCGSGIF

SEQ ID NO: 91779 - protein, 10 aa, Dengue virus
LKCGSGIFVI

SEQ ID NO: 91780 - protein, 10 aa, Dengue virus
KCGSGIFVID

SEQ ID NO: 91781 - protein, 10 aa, Dengue virus
CGSGIFVIDN

SEQ ID NO: 91782 - protein, 10 aa, Dengue virus
GSGIFVIDNV

SEQ ID NO: 91783 - protein, 10 aa, Dengue virus
SGIFVIDNVH

SEQ ID NO: 91784 - protein, 10 aa, Dengue virus
GIFVIDNVHT

SEQ ID NO: 91785 - protein, 10 aa, Dengue virus
IFVIDNVHTW

SEQ ID NO: 91786 - protein, 10 aa, Dengue virus
FVIDNVHTWT

SEQ ID NO: 91787 - protein, 10 aa, Dengue virus
VIDNVHTWTE

SEQ ID NO: 91788 - protein, 10 aa, Dengue virus
IDNVHTWTEQ

SEQ ID NO: 91789 - protein, 10 aa, Dengue virus
DNVHTWTEQH

SEQ ID NO: 91790 - protein, 10 aa, Dengue virus
NVHTWTEQYQ

SEQ ID NO: 91791 - protein, 10 aa, Dengue virus
VHTWTEQYQF

SEQ ID NO: 91792 - protein, 10 aa, Dengue virus
HTWTEQYQFQ

SEQ ID NO: 91793 - protein, 10 aa, Dengue virus
TWTEQYQFQP

SEQ ID NO: 91794 - protein, 10 aa, Dengue virus
WTEQYQFQPE

SEQ ID NO: 91795 - protein, 10 aa, Dengue virus
TEQYQFQPES

SEQ ID NO: 91796 - protein, 10 aa, Dengue virus
EQYQFQPESP

SEQ ID NO: 91797 - protein, 10 aa, Dengue virus
QYQFQPESPA

SEQ ID NO: 91798 - protein, 10 aa, Dengue virus
YQFQPESPAR

SEQ ID NO: 91799 - protein, 10 aa, Dengue virus
KFQPESPARV

SEQ ID NO: 91800 - protein, 10 aa, Dengue virus
FQPESPARVA

SEQ ID NO: 91801 - protein, 10 aa, Dengue virus
QPESPARVAS

SEQ ID NO: 91802 - protein, 10 aa, Dengue virus
PESPARVASA

SEQ ID NO: 91803 - protein, 10 aa, Dengue virus
ESPARVASAI

SEQ ID NO: 91804 - protein, 10 aa, Dengue virus
SPARVASAIL

SEQ ID NO: 91805 - protein, 10 aa, Dengue virus
PARVASAILN

SEQ ID NO: 91806 - protein, 10 aa, Dengue virus
ARVASAILNA

SEQ ID NO: 91807 - protein, 10 aa, Dengue virus
RVASAILNAH

SEQ ID NO: 91808 - protein, 10 aa, Dengue virus
VASAILNAHK

SEQ ID NO: 91809 - protein, 10 aa, Dengue virus
ASAILNAHKE

SEQ ID NO: 91810 - protein, 10 aa, Dengue virus
SAILIAHKDG

SEQ ID NO: 91811 - protein, 10 aa, Dengue virus
AILIAHKDGV

SEQ ID NO: 91812 - protein, 10 aa, Dengue virus
ILIAHKDGVC

SEQ ID NO: 91813 - protein, 10 aa, Dengue virus
LIAHKDGVCG

SEQ ID NO: 91814 - protein, 10 aa, Dengue virus
IAHKDGVCGI

SEQ ID NO: 91815 - protein, 10 aa, Dengue virus
AHEDGVCGIR

SEQ ID NO: 91816 - protein, 10 aa, Dengue virus
HKDGVCGVRS

SEQ ID NO: 91817 - protein, 10 aa, Dengue virus
KEGVCGIRST

SEQ ID NO: 91818 - protein, 10 aa, Dengue virus
DGVCGVRSTT

SEQ ID NO: 91819 - protein, 10 aa, Dengue virus
IRSTTRLENI

SEQ ID NO: 91820 - protein, 10 aa, Dengue virus
RSTTRLENIM

SEQ ID NO: 91821 - protein, 10 aa, Dengue virus
STTRLENIMW

SEQ ID NO: 91822 - protein, 10 aa, Dengue virus
TTRLENIMWK

SEQ ID NO: 91823 - protein, 10 aa, Dengue virus
TRLENIMWKQ

SEQ ID NO: 91824 - protein, 10 aa, Dengue virus
RLENIMWKQI

SEQ ID NO: 91825 - protein, 10 aa, Dengue virus
LENIMWKQIT

SEQ ID NO: 91826 - protein, 10 aa, Dengue virus
ENIMWKQITN

SEQ ID NO: 91827 - protein, 10 aa, Dengue virus
NIMWKQITNE

SEQ ID NO: 91828 - protein, 10 aa, Dengue virus
IMWKQITNEL

SEQ ID NO: 91829 - protein, 10 aa, Dengue virus
EGGHDLTIVA

SEQ ID NO: 91830 - protein, 10 aa, Dengue virus
GGHDLTVVTG

SEQ ID NO: 91831 - protein, 10 aa, Dengue virus
GHDLTIVAGD

SEQ ID NO: 91832 - protein, 10 aa, Dengue virus
HDLTVVAGDA

SEQ ID NO: 91833 - protein, 10 aa, Dengue virus
DLTVVAGDAK

SEQ ID NO: 91834 - protein, 10 aa, Dengue virus
LTVVAGDAKG

SEQ ID NO: 91835 - protein, 10 aa, Dengue virus
TVVAGDAKGV

SEQ ID NO: 91836 - protein, 10 aa, Dengue virus
VVAGDAKGVL

SEQ ID NO: 91837 - protein, 10 aa, Dengue virus
VAGDVKGVLS

SEQ ID NO: 91838 - protein, 10 aa, Dengue virus
AGDVKGVLSK

SEQ ID NO: 91839 - protein, 10 aa, Dengue virus
GDVKGVLSKG

SEQ ID NO: 91840 - protein, 10 aa, Dengue virus
DVKGVLSKGK

SEQ ID NO: 91841 - protein, 10 aa, Dengue virus
VKGVLSKGKR

SEQ ID NO: 91842 - protein, 10 aa, Dengue virus
KGVLSKGKRA

SEQ ID NO: 91843 - protein, 10 aa, Dengue virus
GVLSKGKRAL

SEQ ID NO: 91844 - protein, 10 aa, Dengue virus
VLSKGKRALA

SEQ ID NO: 91845 - protein, 10 aa, Dengue virus
LSKGKRALAP

SEQ ID NO: 91846 - protein, 10 aa, Dengue virus
SKGKRALAPP

SEQ ID NO: 91847 - protein, 10 aa, Dengue virus
KGKRALTPPA

SEQ ID NO: 91848 - protein, 10 aa, Dengue virus
LTPPASDLKY

SEQ ID NO: 91849 - protein, 10 aa, Dengue virus
TPPASDLKYS

SEQ ID NO: 91850 - protein, 10 aa, Dengue virus
PPASDLKYSW

SEQ ID NO: 91851 - protein, 10 aa, Dengue virus
PASDLKYSWK

SEQ ID NO: 91852 - protein, 10 aa, Dengue virus
ASDLKYSWKT

SEQ ID NO: 91853 - protein, 10 aa, Dengue virus
NDLKYSWKTW

SEQ ID NO: 91854 - protein, 10 aa, Dengue virus
KTWGKAKIFA

SEQ ID NO: 91855 - protein, 10 aa, Dengue virus
TWGKARIFTP

SEQ ID NO: 91856 - protein, 10 aa, Dengue virus
WGKAKIFAPE

SEQ ID NO: 91857 - protein, 10 aa, Dengue virus
GKAKIFTPET

SEQ ID NO: 91858 - protein, 10 aa, Dengue virus
KNSTFLIDGP

SEQ ID NO: 91859 - protein, 10 aa, Dengue virus
NSTFLVDGPD

SEQ ID NO: 91860 - protein, 10 aa, Dengue virus
STFLVDGPDT

SEQ ID NO: 91861 - protein, 10 aa, Dengue virus
TFLVDGPDTS

SEQ ID NO: 91862 - protein, 10 aa, Dengue virus
FLVDGPDTSE

SEQ ID NO: 91863 - protein, 10 aa, Dengue virus
LVDGPDTSEC

SEQ ID NO: 91864 - protein, 10 aa, Dengue virus
VDGPDTSECP

SEQ ID NO: 91865 - protein, 10 aa, Dengue virus
CPNERRAWNF

SEQ ID NO: 91866 - protein, 10 aa, Dengue virus
PNERRAWNSF

SEQ ID NO: 91867 - protein, 10 aa, Dengue virus
NERRAWNSFE

SEQ ID NO: 91868 - protein, 10 aa, Dengue virus
ERRAWNSFEV

SEQ ID NO: 91869 - protein, 10 aa, Dengue virus
RRAWNSFEVE

SEQ ID NO: 91870 - protein, 10 aa, Dengue virus
RAWNSFEVED

SEQ ID NO: 91871 - protein, 10 aa, Dengue virus
AWNSFEVEDY

SEQ ID NO: 91872 - protein, 10 aa, Dengue virus
WNSFEVEDYG

SEQ ID NO: 91873 - protein, 10 aa, Dengue virus
NSFEVEDYGF

SEQ ID NO: 91874 - protein, 10 aa, Dengue virus
SFEVEDYGFG

SEQ ID NO: 91875 - protein, 10 aa, Dengue virus
FEVEDYGFGM

SEQ ID NO: 91876 - protein, 10 aa, Dengue virus
DYGFGMFTTS

SEQ ID NO: 91877 - protein, 10 aa, Dengue virus
YGFGMFTTSI

SEQ ID NO: 91878 - protein, 10 aa, Dengue virus
GFGMFTTSIW

SEQ ID NO: 91879 - protein, 10 aa, Dengue virus
FGMFTTSIWM

SEQ ID NO: 91880 - protein, 10 aa, Dengue virus
GMFTTSIWMK

SEQ ID NO: 91881 - protein, 10 aa, Dengue virus
MFTTSIWMKF

SEQ ID NO: 91882 - protein, 10 aa, Dengue virus
FTTSIWMKFR

SEQ ID NO: 91883 - protein, 10 aa, Dengue virus
TTSIWMKFRE

SEQ ID NO: 91884 - protein, 10 aa, Dengue virus
TSIWMKFREG

SEQ ID NO: 91885 - protein, 10 aa, Dengue virus
SIWMKFREGS

SEQ ID NO: 91886 - protein, 10 aa, Dengue virus
MKFREGSSEL

SEQ ID NO: 91887 - protein, 10 aa, Dengue virus
KFREGSSELC

SEQ ID NO: 91888 - protein, 10 aa, Dengue virus
FREGSSELCD

SEQ ID NO: 91889 - protein, 10 aa, Dengue virus
SKNQTWQIER

SEQ ID NO: 91890 - protein, 10 aa, Dengue virus
KNQTWQIERA

SEQ ID NO: 91891 - protein, 10 aa, Dengue virus
NQTWQIERAS

SEQ ID NO: 91892 - protein, 10 aa, Dengue virus
QTWQIERASL

SEQ ID NO: 91893 - protein, 10 aa, Dengue virus
TWQIERASLI

SEQ ID NO: 91894 - protein, 10 aa, Dengue virus
WQIERASLIE

SEQ ID NO: 91895 - protein, 10 aa, Dengue virus
QIERASLIEV

SEQ ID NO: 91896 - protein, 10 aa, Dengue virus
IERASLIEVK

SEQ ID NO: 91897 - protein, 10 aa, Dengue virus
ERASLIEVKT

SEQ ID NO: 91898 - protein, 10 aa, Dengue virus
RASLIEVKTC

SEQ ID NO: 91899 - protein, 10 aa, Dengue virus
VLESQMLIPR

SEQ ID NO: 91900 - protein, 10 aa, Dengue virus
LESQMLIPRS

SEQ ID NO: 91901 - protein, 10 aa, Dengue virus
ESQMLIPRSY

SEQ ID NO: 91902 - protein, 10 aa, Dengue virus
SQMLIPRSYA

SEQ ID NO: 91903 - protein, 10 aa, Dengue virus
QMLIPRSYAG

SEQ ID NO: 91904 - protein, 10 aa, Dengue virus
MLIPRSYAGP

SEQ ID NO: 91905 - protein, 10 aa, Dengue virus
LIPRSYAGPF

SEQ ID NO: 91906 - protein, 10 aa, Dengue virus
IPRSYAGPFS

SEQ ID NO: 91907 - protein, 10 aa, Dengue virus
PRSYAGPFSQ

SEQ ID NO: 91908 - protein, 10 aa, Dengue virus
RSYAGPFSQH

SEQ ID NO: 91909 - protein, 10 aa, Dengue virus
AYAGPFSQHN

SEQ ID NO: 91910 - protein, 10 aa, Dengue virus
YAGPFSHHNY

SEQ ID NO: 91911 - protein, 10 aa, Dengue virus
AGPFSHHNYR

SEQ ID NO: 91912 - protein, 10 aa, Dengue virus
GPFSHHNYRQ

SEQ ID NO: 91913 - protein, 10 aa, Dengue virus
PFSHHNYRQG

SEQ ID NO: 91914 - protein, 10 aa, Dengue virus
FSHHNYRQGY

SEQ ID NO: 91915 - protein, 10 aa, Dengue virus
SHHNYRQGYA

SEQ ID NO: 91916 - protein, 10 aa, Dengue virus
HHNYRQGYAT

SEQ ID NO: 91917 - protein, 10 aa, Dengue virus
NYRQGYATQI

SEQ ID NO: 91918 - protein, 10 aa, Dengue virus
YRQGYATQTM

SEQ ID NO: 91919 - protein, 10 aa, Dengue virus
RQGYATQTMG

SEQ ID NO: 91920 - protein, 10 aa, Dengue virus
QGYATQTMGP

SEQ ID NO: 91921 - protein, 10 aa, Dengue virus
GYATQTMGPW

SEQ ID NO: 91922 - protein, 10 aa, Dengue virus
YATQTMGPWH

SEQ ID NO: 91923 - protein, 10 aa, Dengue virus
ATQTMGPWHL

SEQ ID NO: 91924 - protein, 10 aa, Dengue virus
TQTMGPWHLG

SEQ ID NO: 91925 - protein, 10 aa, Dengue virus
QTMGPWHLGK

SEQ ID NO: 91926 - protein, 10 aa, Dengue virus
TMGPWHLGKL

SEQ ID NO: 91927 - protein, 10 aa, Dengue virus
AGPWHLGKLE

SEQ ID NO: 91928 - protein, 10 aa, Dengue virus
PWHLGKLEIG

SEQ ID NO: 91929 - protein, 10 aa, Dengue virus
WHLGKLEMDF

SEQ ID NO: 91930 - protein, 10 aa, Dengue virus
HLGKLEMDFG

SEQ ID NO: 91931 - protein, 10 aa, Dengue virus
LGKLEIGFGE

SEQ ID NO: 91932 - protein, 10 aa, Dengue virus
GKLEIGFGEC

SEQ ID NO: 91933 - protein, 10 aa, Dengue virus
KLEIGFGECP

SEQ ID NO: 91934 - protein, 10 aa, Dengue virus
LEMDFGECPG

SEQ ID NO: 91935 - protein, 10 aa, Dengue virus
EMDFGECPGT

SEQ ID NO: 91936 - protein, 10 aa, Dengue virus
MDFGECPGTT

SEQ ID NO: 91937 - protein, 10 aa, Dengue virus
FGECPGTTVA

SEQ ID NO: 91938 - protein, 10 aa, Dengue virus
GECPGTTVAI

SEQ ID NO: 91939 - protein, 10 aa, Dengue virus
ECPGTTVAIQ

SEQ ID NO: 91940 - protein, 10 aa, Dengue virus
CPGTTVAIQE

SEQ ID NO: 91941 - protein, 10 aa, Dengue virus
PGTTVTIQEN

SEQ ID NO: 91942 - protein, 10 aa, Dengue virus
GTTVTIQENC

SEQ ID NO: 91943 - protein, 10 aa, Dengue virus
QENCDHRGPS

SEQ ID NO: 91944 - protein, 10 aa, Dengue virus
ENCDHRGPSL

SEQ ID NO: 91945 - protein, 10 aa, Dengue virus
NCDHRGPSLR

SEQ ID NO: 91946 - protein, 10 aa, Dengue virus
CGHRGSSLRT

SEQ ID NO: 91947 - protein, 10 aa, Dengue virus
GHRGSSLRTT

SEQ ID NO: 91948 - protein, 10 aa, Dengue virus
HRGSSLRTTT

SEQ ID NO: 91949 - protein, 10 aa, Dengue virus
RGSSLRTTTA

SEQ ID NO: 91950 - protein, 10 aa, Dengue virus
GSSLRTTTAS

SEQ ID NO: 91951 - protein, 10 aa, Dengue virus
SSLRTTTASG

SEQ ID NO: 91952 - protein, 10 aa, Dengue virus
WYGMEIRPLN

SEQ ID NO: 91953 - protein, 10 aa, Dengue virus
YGMEIRPLNE

SEQ ID NO: 91954 - protein, 10 aa, Dengue virus
GMEIRPLNEK

SEQ ID NO: 91955 - protein, 10 aa, Dengue virus
MEIRPLNEKE

SEQ ID NO: 91956 - protein, 10 aa, Dengue virus
EIRPLNEKEE

SEQ ID NO: 91957 - protein, 10 aa, Dengue virus
IRPLNEKEEN

SEQ ID NO: 91958 - protein, 10 aa, Dengue virus
RPLNEKEENM

SEQ ID NO: 91959 - protein, 10 aa, Dengue virus
PLNEKEENMV

SEQ ID NO: 91960 - protein, 10 aa, Dengue virus
LNEKEENMVK

SEQ ID NO: 91961 - protein, 10 aa, Dengue virus
NEKEENMVKS

SEQ ID NO: 91962 - protein, 10 aa, Dengue virus
EREENMVKSQ

SEQ ID NO: 91963 - protein, 10 aa, Dengue virus
REENMVKSQV

SEQ ID NO: 91964 - protein, 10 aa, Dengue virus
EENMVKSQVA

SEQ ID NO: 91965 - protein, 10 aa, Dengue virus
ENMVKSQVAA

SEQ ID NO: 91966 - protein, 10 aa, Dengue virus
NMVKSQVAAG

SEQ ID NO: 91967 - protein, 10 aa, Dengue virus
STSETFSMGL

SEQ ID NO: 91968 - protein, 10 aa, Dengue virus
SSETFSMGLL

SEQ ID NO: 91969 - protein, 10 aa, Dengue virus
PETFSMGLLC

SEQ ID NO: 91970 - protein, 10 aa, Dengue virus
MGLLCLTLFM

SEQ ID NO: 91971 - protein, 10 aa, Dengue virus
GLLCLTLFME

SEQ ID NO: 91972 - protein, 10 aa, Dengue virus
LLCLTLFMEE

SEQ ID NO: 91973 - protein, 10 aa, Dengue virus
LCLTLFMEEC

SEQ ID NO: 91974 - protein, 10 aa, Dengue virus
CLTLFMEECL

SEQ ID NO: 91975 - protein, 10 aa, Dengue virus
LTLFMEECLR

SEQ ID NO: 91976 - protein, 10 aa, Dengue virus
TLFMEECLRR

SEQ ID NO: 91977 - protein, 10 aa, Dengue virus
LFMEECLRRR

SEQ ID NO: 91978 - protein, 10 aa, Dengue virus
FMEECLRRRV

SEQ ID NO: 91979 - protein, 10 aa, Dengue virus
MEECLRRRVT

SEQ ID NO: 91980 - protein, 10 aa, Dengue virus
EECLRRKVTR

SEQ ID NO: 91981 - protein, 10 aa, Dengue virus
ECLRRKVTRK

SEQ ID NO: 91982 - protein, 10 aa, Dengue virus
CLRRKVTRKH

SEQ ID NO: 91983 - protein, 10 aa, Dengue virus
LRRKVTRKHM

SEQ ID NO: 91984 - protein, 10 aa, Dengue virus
RRKVTRKHMI

SEQ ID NO: 91985 - protein, 10 aa, Dengue virus
RKVTRKHMIL

SEQ ID NO: 91986 - protein, 10 aa, Dengue virus
RVTRKHMILV

SEQ ID NO: 91987 - protein, 10 aa, Dengue virus
VTRKHMILVV

SEQ ID NO: 91988 - protein, 10 aa, Dengue virus
TRKHMILVVV

SEQ ID NO: 91989 - protein, 10 aa, Dengue virus
RKHMILVVVI

SEQ ID NO: 91990 - protein, 10 aa, Dengue virus
KHMILVVVIT

SEQ ID NO: 91991 - protein, 10 aa, Dengue virus
ITFCAIILGG

SEQ ID NO: 91992 - protein, 10 aa, Dengue virus
TFCAIILGGL

SEQ ID NO: 91993 - protein, 10 aa, Dengue virus
FCAIILGGLT

SEQ ID NO: 91994 - protein, 10 aa, Dengue virus
LTWMDLLRAI

SEQ ID NO: 91995 - protein, 10 aa, Dengue virus
TWMDLLRAII

SEQ ID NO: 91996 - protein, 10 aa, Dengue virus
WMDLLRAIIM

SEQ ID NO: 91997 - protein, 10 aa, Dengue virus
MDLLRAIIML

SEQ ID NO: 91998 - protein, 10 aa, Dengue virus
DLLRAIIMLG

SEQ ID NO: 91999 - protein, 10 aa, Dengue virus
LLRAIIMLGD

SEQ ID NO: 92000 - protein, 10 aa, Dengue virus
LRAIIMLGDT

SEQ ID NO: 92001 - protein, 10 aa, Dengue virus
RAIIMLGDTM

SEQ ID NO: 92002 - protein, 10 aa, Dengue virus
AIIMLGDTML

SEQ ID NO: 92003 - protein, 10 aa, Dengue virus
IIMLGDTMLS

SEQ ID NO: 92004 - protein, 10 aa, Dengue virus
IMLGDTMLSR

SEQ ID NO: 92005 - protein, 10 aa, Dengue virus
MLGDTMSGRM

SEQ ID NO: 92006 - protein, 10 aa, Dengue virus
LGDTMSGRMG

SEQ ID NO: 92007 - protein, 10 aa, Dengue virus
GDTMSGRMGG

SEQ ID NO: 92008 - protein, 10 aa, Dengue virus
DTMSGRMGGQ

SEQ ID NO: 92009 - protein, 10 aa, Dengue virus
RIGGQIHLAI

SEQ ID NO: 92010 - protein, 10 aa, Dengue virus
IGGQIHLAIM

SEQ ID NO: 92011 - protein, 10 aa, Dengue virus
GGQIHLAIMA

SEQ ID NO: 92012 - protein, 10 aa, Dengue virus
GQIHLAIMAV

SEQ ID NO: 92013 - protein, 10 aa, Dengue virus
QIHLAIMAVF

SEQ ID NO: 92014 - protein, 10 aa, Dengue virus
IHLAIMAVFK

SEQ ID NO: 92015 - protein, 10 aa, Dengue virus
HLAIMIVFKM

SEQ ID NO: 92016 - protein, 10 aa, Dengue virus
LAIMIVFKMS

SEQ ID NO: 92017 - protein, 10 aa, Dengue virus
AIMIVFKMSP

SEQ ID NO: 92018 - protein, 10 aa, Dengue virus
IMIVFKMSPG

SEQ ID NO: 92019 - protein, 10 aa, Dengue virus
MIVFKMSPGY

SEQ ID NO: 92020 - protein, 10 aa, Dengue virus
IVFKMSPGYV

SEQ ID NO: 92021 - protein, 10 aa, Dengue virus
KMSPGYVLGI

SEQ ID NO: 92022 - protein, 10 aa, Dengue virus
MSPGYVLGIF

SEQ ID NO: 92023 - protein, 10 aa, Dengue virus
SPGYVLGIFL

SEQ ID NO: 92024 - protein, 10 aa, Dengue virus
PGYVLGIFLR

SEQ ID NO: 92025 - protein, 10 aa, Dengue virus
GYVLGIFLRK

SEQ ID NO: 92026 - protein, 10 aa, Dengue virus
YVLGIFLRKL

SEQ ID NO: 92027 - protein, 10 aa, Dengue virus
VLGIFLRKLT

SEQ ID NO: 92028 - protein, 10 aa, Dengue virus
LGIFLRKLTS

SEQ ID NO: 92029 - protein, 10 aa, Dengue virus
GIFLRKLTSR

SEQ ID NO: 92030 - protein, 10 aa, Dengue virus
IFLRKLTSRE

SEQ ID NO: 92031 - protein, 10 aa, Dengue virus
FLRRLTSRET

SEQ ID NO: 92032 - protein, 10 aa, Dengue virus
LRRLTSRETA

SEQ ID NO: 92033 - protein, 10 aa, Dengue virus
RRLTSRETAL

SEQ ID NO: 92034 - protein, 10 aa, Dengue virus
RLTSRETALM

SEQ ID NO: 92035 - protein, 10 aa, Dengue virus
MVIGMAMTTV

SEQ ID NO: 92036 - protein, 10 aa, Dengue virus
VIGMAMTTVL

SEQ ID NO: 92037 - protein, 10 aa, Dengue virus
IGMAMTTVLS

SEQ ID NO: 92038 - protein, 10 aa, Dengue virus
GMAMTTVLSI

SEQ ID NO: 92039 - protein, 10 aa, Dengue virus
MAMTTVLSIP

SEQ ID NO: 92040 - protein, 10 aa, Dengue virus
AMTTVLSIPH

SEQ ID NO: 92041 - protein, 10 aa, Dengue virus
MTTVLSIPHD

SEQ ID NO: 92042 - protein, 10 aa, Dengue virus
TTVLSIPHDL

SEQ ID NO: 92043 - protein, 10 aa, Dengue virus
TVLSIPHDLM

SEQ ID NO: 92044 - protein, 10 aa, Dengue virus
VLSIPHDLME

SEQ ID NO: 92045 - protein, 10 aa, Dengue virus
FSIPHDLMEL

SEQ ID NO: 92046 - protein, 10 aa, Dengue virus
SIPHDLMEFI

SEQ ID NO: 92047 - protein, 10 aa, Dengue virus
IPHDLMEFID

SEQ ID NO: 92048 - protein, 10 aa, Dengue virus
PHDLMEFIDG

SEQ ID NO: 92049 - protein, 10 aa, Dengue virus
HDLMEFIDGI

SEQ ID NO: 92050 - protein, 10 aa, Dengue virus
DLMEFIDGIS

SEQ ID NO: 92051 - protein, 10 aa, Dengue virus
LMEFIDGISL

SEQ ID NO: 92052 - protein, 10 aa, Dengue virus
MEFIDGISLG

SEQ ID NO: 92053 - protein, 10 aa, Dengue virus
EFIDGISLGL

SEQ ID NO: 92054 - protein, 10 aa, Dengue virus
FIDGISLGLI

SEQ ID NO: 92055 - protein, 10 aa, Dengue virus
IDGLSLGLIL

SEQ ID NO: 92056 - protein, 10 aa, Dengue virus
DGLSLGLILL

SEQ ID NO: 92057 - protein, 10 aa, Dengue virus
GIALGLILLK

SEQ ID NO: 92058 - protein, 10 aa, Dengue virus
ISLGLILLKM

SEQ ID NO: 92059 - protein, 10 aa, Dengue virus
SLGLILLKMV

SEQ ID NO: 92060 - protein, 10 aa, Dengue virus
LGLILLKMVT

SEQ ID NO: 92061 - protein, 10 aa, Dengue virus
GLILLKIVTH

SEQ ID NO: 92062 - protein, 10 aa, Dengue virus
LILLKIVTHF

SEQ ID NO: 92063 - protein, 10 aa, Dengue virus
ILLKIVTHFD

SEQ ID NO: 92064 - protein, 10 aa, Dengue virus
VTHFDNTQVG

SEQ ID NO: 92065 - protein, 10 aa, Dengue virus
THFDNTQVGT

SEQ ID NO: 92066 - protein, 10 aa, Dengue virus
HFDNTQVGTL

SEQ ID NO: 92067 - protein, 10 aa, Dengue virus
FDDTQVGTLA

SEQ ID NO: 92068 - protein, 10 aa, Dengue virus
DDTQVGTLAL

SEQ ID NO: 92069 - protein, 10 aa, Dengue virus
DTQVGTLALS

SEQ ID NO: 92070 - protein, 10 aa, Dengue virus
AQLGTLALSL

SEQ ID NO: 92071 - protein, 10 aa, Dengue virus
QLGTLALSLT

SEQ ID NO: 92072 - protein, 10 aa, Dengue virus
VGTLALALTF

SEQ ID NO: 92073 - protein, 10 aa, Dengue virus
TLALSLTFIK

SEQ ID NO: 92074 - protein, 10 aa, Dengue virus
LALSLTFIKS

SEQ ID NO: 92075 - protein, 10 aa, Dengue virus
ALSLTFIKST

SEQ ID NO: 92076 - protein, 10 aa, Dengue virus
PLVMAWRTIM

SEQ ID NO: 92077 - protein, 10 aa, Dengue virus
LIMAWRTIMA

SEQ ID NO: 92078 - protein, 10 aa, Dengue virus
IMAWRTIMAV

SEQ ID NO: 92079 - protein, 10 aa, Dengue virus
MAWRTIMAVF

SEQ ID NO: 92080 - protein, 10 aa, Dengue virus
AWRTIMAVFF

SEQ ID NO: 92081 - protein, 10 aa, Dengue virus
WRTIMAVFFV

SEQ ID NO: 92082 - protein, 10 aa, Dengue virus
RTIMAVFFVV

SEQ ID NO: 92083 - protein, 10 aa, Dengue virus
TIMAVFFVVT

SEQ ID NO: 92084 - protein, 10 aa, Dengue virus
IMAVFFVVTL

SEQ ID NO: 92085 - protein, 10 aa, Dengue virus
MAVFFVVTLI

SEQ ID NO: 92086 - protein, 10 aa, Dengue virus
AVFFVVTLIP

SEQ ID NO: 92087 - protein, 10 aa, Dengue virus
VFFVVTLIPL

SEQ ID NO: 92088 - protein, 10 aa, Dengue virus
FFVVTLIPLC

SEQ ID NO: 92089 - protein, 10 aa, Dengue virus
FAVTLIPLCR

SEQ ID NO: 92090 - protein, 10 aa, Dengue virus
AVTLIPLCRT

SEQ ID NO: 92091 - protein, 10 aa, Dengue virus
SCLQKQSHWI

SEQ ID NO: 92092 - protein, 10 aa, Dengue virus
CLQNQSHWVE

SEQ ID NO: 92093 - protein, 10 aa, Dengue virus
LQNQSHWVEI

SEQ ID NO: 92094 - protein, 10 aa, Dengue virus
QNQSHWVEIT

SEQ ID NO: 92095 - protein, 10 aa, Dengue virus
KQSHWIEITA

SEQ ID NO: 92096 - protein, 10 aa, Dengue virus
QSHWVEITAI

SEQ ID NO: 92097 - protein, 10 aa, Dengue virus
SHWVEITAII

SEQ ID NO: 92098 - protein, 10 aa, Dengue virus
HWVEITAIIL

SEQ ID NO: 92099 - protein, 10 aa, Dengue virus
WVEITAIILG

SEQ ID NO: 92100 - protein, 10 aa, Dengue virus
VEITAIILGA

SEQ ID NO: 92101 - protein, 10 aa, Dengue virus
EITAIILGAQ

SEQ ID NO: 92102 - protein, 10 aa, Dengue virus
ITAIILGAQA

SEQ ID NO: 92103 - protein, 10 aa, Dengue virus
TAIILGAQAL

SEQ ID NO: 92104 - protein, 10 aa, Dengue virus
AIILGAQALP

SEQ ID NO: 92105 - protein, 10 aa, Dengue virus
IILGAQALPV

SEQ ID NO: 92106 - protein, 10 aa, Dengue virus
TLGAQALPVY

SEQ ID NO: 92107 - protein, 10 aa, Dengue virus
LMTLMKGASK

SEQ ID NO: 92108 - protein, 10 aa, Dengue virus
MTLMKGASKR

SEQ ID NO: 92109 - protein, 10 aa, Dengue virus
TLMKGASKRS

SEQ ID NO: 92110 - protein, 10 aa, Dengue virus
LMKGASKRSW

SEQ ID NO: 92111 - protein, 10 aa, Dengue virus
MKGASKRSWP

SEQ ID NO: 92112 - protein, 10 aa, Dengue virus
KGASKRSWPL

SEQ ID NO: 92113 - protein, 10 aa, Dengue virus
GASKRSWPLN

SEQ ID NO: 92114 - protein, 10 aa, Dengue virus
ASKRSWPLNE

SEQ ID NO: 92115 - protein, 10 aa, Dengue virus
SKRSWPLNEG

SEQ ID NO: 92116 - protein, 10 aa, Dengue virus
KRSWPLNEGI

SEQ ID NO: 92117 - protein, 10 aa, Dengue virus
GSSADLSLER

SEQ ID NO: 92118 - protein, 10 aa, Dengue virus
SSADLSLERA

SEQ ID NO: 92119 - protein, 10 aa, Dengue virus
SADLSLERAA

SEQ ID NO: 92120 - protein, 10 aa, Dengue virus
ADLSLEKAAS

SEQ ID NO: 92121 - protein, 10 aa, Dengue virus
DLSLEKAASV

SEQ ID NO: 92122 - protein, 10 aa, Dengue virus
LSLEKAASVQ

SEQ ID NO: 92123 - protein, 10 aa, Dengue virus
SLEKAASVQW

SEQ ID NO: 92124 - protein, 10 aa, Dengue virus
LEKAASVQWD

SEQ ID NO: 92125 - protein, 10 aa, Dengue virus
EKAASVQWDE

SEQ ID NO: 92126 - protein, 10 aa, Dengue virus
KAASVQWDEM

SEQ ID NO: 92127 - protein, 10 aa, Dengue virus
AASVQWDEMA

SEQ ID NO: 92128 - protein, 10 aa, Dengue virus
ASVQWDEMAD

SEQ ID NO: 92129 - protein, 10 aa, Dengue virus
SVQWDEMADI

SEQ ID NO: 92130 - protein, 10 aa, Dengue virus
MADITGSSPV

SEQ ID NO: 92131 - protein, 10 aa, Dengue virus
ADITGSSPIV

SEQ ID NO: 92132 - protein, 10 aa, Dengue virus
DITGSSPIVE

SEQ ID NO: 92133 - protein, 10 aa, Dengue virus
ITGSSPIVEV

SEQ ID NO: 92134 - protein, 10 aa, Dengue virus
TGSSPIVEVK

SEQ ID NO: 92135 - protein, 10 aa, Dengue virus
GSSPIVEVKQ

SEQ ID NO: 92136 - protein, 10 aa, Dengue virus
SSPIVEVKQD

SEQ ID NO: 92137 - protein, 10 aa, Dengue virus
SPIVEVKQDE

SEQ ID NO: 92138 - protein, 10 aa, Dengue virus
PIVEVKQDED

SEQ ID NO: 92139 - protein, 10 aa, Dengue virus
IVEVKQDEDG

SEQ ID NO: 92140 - protein, 10 aa, Dengue virus
VEVKQDEDGS

SEQ ID NO: 92141 - protein, 10 aa, Dengue virus
EDGSFSIRDI

SEQ ID NO: 92142 - protein, 10 aa, Dengue virus
DGSFSIRDIE

SEQ ID NO: 92143 - protein, 10 aa, Dengue virus
GSFSIRDIEE

SEQ ID NO: 92144 - protein, 10 aa, Dengue virus
SFSIRDIEET

SEQ ID NO: 92145 - protein, 10 aa, Dengue virus
FSIRDIEETN

SEQ ID NO: 92146 - protein, 10 aa, Dengue virus
SIRDIEETNM

SEQ ID NO: 92147 - protein, 10 aa, Dengue virus
IRDIEETNMI

SEQ ID NO: 92148 - protein, 10 aa, Dengue virus
RDIEETNMIT

SEQ ID NO: 92149 - protein, 10 aa, Dengue virus
DIEETNMITL

SEQ ID NO: 92150 - protein, 10 aa, Dengue virus
IEETNMITLL

SEQ ID NO: 92151 - protein, 10 aa, Dengue virus
SGLYPLAIPI

SEQ ID NO: 92152 - protein, 10 aa, Dengue virus
GLYPLAIPIT

SEQ ID NO: 92153 - protein, 10 aa, Dengue virus
LYPLAIPITM

SEQ ID NO: 92154 - protein, 10 aa, Dengue virus
YPLAIPITMT

SEQ ID NO: 92155 - protein, 10 aa, Dengue virus
PLAIPITMTL

SEQ ID NO: 92156 - protein, 10 aa, Dengue virus
LAIPITMTLW

SEQ ID NO: 92157 - protein, 10 aa, Dengue virus
AIPITMTLWY

SEQ ID NO: 92158 - protein, 10 aa, Dengue virus
IPITMTLWYM

SEQ ID NO: 92159 - protein, 10 aa, Dengue virus
PITMTLWYMW

SEQ ID NO: 92160 - protein, 10 aa, Dengue virus
ITMTLWYMWQ

SEQ ID NO: 92161 - protein, 10 aa, Dengue virus
TMALWYIWQV

SEQ ID NO: 92162 - protein, 10 aa, Dengue virus
MALWYIWQVK

SEQ ID NO: 92163 - protein, 10 aa, Dengue virus
ALWYIWQVKT

SEQ ID NO: 92164 - protein, 10 aa, Dengue virus
LWYIWQVKTQ

SEQ ID NO: 92165 - protein, 10 aa, Dengue virus
WYIWQVKTQR

SEQ ID NO: 92166 - protein, 10 aa, Dengue virus
YIWQVKTQRS

SEQ ID NO: 92167 - protein, 10 aa, Dengue virus
IWQVKTQRSG

SEQ ID NO: 92168 - protein, 10 aa, Dengue virus
WQVRTQRSGA

SEQ ID NO: 92169 - protein, 10 aa, Dengue virus
QVRTQRSGAL

SEQ ID NO: 92170 - protein, 10 aa, Dengue virus
VRTQRSGALW

SEQ ID NO: 92171 - protein, 10 aa, Dengue virus
RTQRSGALWD

SEQ ID NO: 92172 - protein, 10 aa, Dengue virus
ALWDVPSPAT

SEQ ID NO: 92173 - protein, 10 aa, Dengue virus
LWDVPSPAAA

SEQ ID NO: 92174 - protein, 10 aa, Dengue virus
WDVPSPAATK

SEQ ID NO: 92175 - protein, 10 aa, Dengue virus
DVPSPAATKK

SEQ ID NO: 92176 - protein, 10 aa, Dengue virus
VPSPAATKKA

SEQ ID NO: 92177 - protein, 10 aa, Dengue virus
TKKAALSEGV

SEQ ID NO: 92178 - protein, 10 aa, Dengue virus
KKAALSEGVY

SEQ ID NO: 92179 - protein, 10 aa, Dengue virus
KATLSEGVYR

SEQ ID NO: 92180 - protein, 10 aa, Dengue virus
ATLSEGVYRI

SEQ ID NO: 92181 - protein, 10 aa, Dengue virus
TLSEGVYRIM

SEQ ID NO: 92182 - protein, 10 aa, Dengue virus
LTEGVYRIMQ

SEQ ID NO: 92183 - protein, 10 aa, Dengue virus
TEGVYRIMQR

SEQ ID NO: 92184 - protein, 10 aa, Dengue virus
VYRIMQRGLL

SEQ ID NO: 92185 - protein, 10 aa, Dengue virus
YRIMQRGLLG

SEQ ID NO: 92186 - protein, 10 aa, Dengue virus
RIMQRGLLGK

SEQ ID NO: 92187 - protein, 10 aa, Dengue virus
IMQRGLLGKT

SEQ ID NO: 92188 - protein, 10 aa, Dengue virus
MQRGLLGKTQ

SEQ ID NO: 92189 - protein, 10 aa, Dengue virus
QRGLLGKTQV

SEQ ID NO: 92190 - protein, 10 aa, Dengue virus
RGLLGKTQVG

SEQ ID NO: 92191 - protein, 10 aa, Dengue virus
GLLGKTQVGV

SEQ ID NO: 92192 - protein, 10 aa, Dengue virus
LLGKTQVGVG

SEQ ID NO: 92193 - protein, 10 aa, Dengue virus
LGKTQVGVGI

SEQ ID NO: 92194 - protein, 10 aa, Dengue virus
GKTQVGVGVH

SEQ ID NO: 92195 - protein, 10 aa, Dengue virus
KTQVGVGIHI

SEQ ID NO: 92196 - protein, 10 aa, Dengue virus
TQVGVGIHIE

SEQ ID NO: 92197 - protein, 10 aa, Dengue virus
QVGVGIHIEG

SEQ ID NO: 92198 - protein, 10 aa, Dengue virus
VGVGIHIEGV

SEQ ID NO: 92199 - protein, 10 aa, Dengue virus
GVGIHIEGVF

SEQ ID NO: 92200 - protein, 10 aa, Dengue virus
VGIHIEGVFH

SEQ ID NO: 92201 - protein, 10 aa, Dengue virus
GIHIEGVFHT

SEQ ID NO: 92202 - protein, 10 aa, Dengue virus
IHIEGVFHTM

SEQ ID NO: 92203 - protein, 10 aa, Dengue virus
HIEGVFHTMW

SEQ ID NO: 92204 - protein, 10 aa, Dengue virus
IEGVFHTMWH

SEQ ID NO: 92205 - protein, 10 aa, Dengue virus
TRGSVICHES

SEQ ID NO: 92206 - protein, 10 aa, Dengue virus
RGSVICHESG

SEQ ID NO: 92207 - protein, 10 aa, Dengue virus
GSVICHESGR

SEQ ID NO: 92208 - protein, 10 aa, Dengue virus
SVICHESGRL

SEQ ID NO: 92209 - protein, 10 aa, Dengue virus
VICHESGRLE

SEQ ID NO: 92210 - protein, 10 aa, Dengue virus
ICHESGRLEP

SEQ ID NO: 92211 - protein, 10 aa, Dengue virus
CHESGRLEPS

SEQ ID NO: 92212 - protein, 10 aa, Dengue virus
HESGRLEPSW

SEQ ID NO: 92213 - protein, 10 aa, Dengue virus
ESGRLEPSWA

SEQ ID NO: 92214 - protein, 10 aa, Dengue virus
SGRLEPSWAD

SEQ ID NO: 92215 - protein, 10 aa, Dengue virus
GWRLGDKWDR

SEQ ID NO: 92216 - protein, 10 aa, Dengue virus
WRLGDKWDRE

SEQ ID NO: 92217 - protein, 10 aa, Dengue virus
RLGDKWDREE

SEQ ID NO: 92218 - protein, 10 aa, Dengue virus
LGDKWDREED

SEQ ID NO: 92219 - protein, 10 aa, Dengue virus
GDKWDREEDV

SEQ ID NO: 92220 - protein, 10 aa, Dengue virus
DKWDREEDVQ

SEQ ID NO: 92221 - protein, 10 aa, Dengue virus
KWDREEDVQV

SEQ ID NO: 92222 - protein, 10 aa, Dengue virus
WDREEDVQVL

SEQ ID NO: 92223 - protein, 10 aa, Dengue virus
DREEDVQVLA

SEQ ID NO: 92224 - protein, 10 aa, Dengue virus
REEDVQVLAI

SEQ ID NO: 92225 - protein, 10 aa, Dengue virus
EEDVQVLAVE

SEQ ID NO: 92226 - protein, 10 aa, Dengue virus
EDVQVLAVEP

SEQ ID NO: 92227 - protein, 10 aa, Dengue virus
DVQVLAVEPG

SEQ ID NO: 92228 - protein, 10 aa, Dengue virus
VQVLAVEPGK

SEQ ID NO: 92229 - protein, 10 aa, Dengue virus
QVLAVEPGKN

SEQ ID NO: 92230 - protein, 10 aa, Dengue virus
VLAVEPGKNP

SEQ ID NO: 92231 - protein, 10 aa, Dengue virus
LAVEPGKNPK

SEQ ID NO: 92232 - protein, 10 aa, Dengue virus
AVEPGKNPKH

SEQ ID NO: 92233 - protein, 10 aa, Dengue virus
VEPGKNPKHV

SEQ ID NO: 92234 - protein, 10 aa, Dengue virus
QTKPGLFKTI

SEQ ID NO: 92235 - protein, 10 aa, Dengue virus
TKPGLFKTIT

SEQ ID NO: 92236 - protein, 10 aa, Dengue virus
KPGLFKTITG

SEQ ID NO: 92237 - protein, 10 aa, Dengue virus
PGLFKTITGE

SEQ ID NO: 92238 - protein, 10 aa, Dengue virus
GLFKTITGEI

SEQ ID NO: 92239 - protein, 10 aa, Dengue virus
LFKTITGEIG

SEQ ID NO: 92240 - protein, 10 aa, Dengue virus
FKTITGEIGA

SEQ ID NO: 92241 - protein, 10 aa, Dengue virus
KTITGEIGAV

SEQ ID NO: 92242 - protein, 10 aa, Dengue virus
TITGEIGAVT

SEQ ID NO: 92243 - protein, 10 aa, Dengue virus
ITGEIGAVTL

SEQ ID NO: 92244 - protein, 10 aa, Dengue virus
KPGTSGSPIV

SEQ ID NO: 92245 - protein, 10 aa, Dengue virus
PGTSGSPIVN

SEQ ID NO: 92246 - protein, 10 aa, Dengue virus
GTSGSPIINK

SEQ ID NO: 92247 - protein, 10 aa, Dengue virus
TSGSPIINKK

SEQ ID NO: 92248 - protein, 10 aa, Dengue virus
SGSPIINKKG

SEQ ID NO: 92249 - protein, 10 aa, Dengue virus
GSPIINKKGK

SEQ ID NO: 92250 - protein, 10 aa, Dengue virus
SPIINKKGKV

SEQ ID NO: 92251 - protein, 10 aa, Dengue virus
PIINKKGKVI

SEQ ID NO: 92252 - protein, 10 aa, Dengue virus
IINKKGKVIG

SEQ ID NO: 92253 - protein, 10 aa, Dengue virus
INKKGKVIGL

SEQ ID NO: 92254 - protein, 10 aa, Dengue virus
NKKGKVIGLY

SEQ ID NO: 92255 - protein, 10 aa, Dengue virus
KKGKVIGLYG

SEQ ID NO: 92256 - protein, 10 aa, Dengue virus
VSAITQAERT

SEQ ID NO: 92257 - protein, 10 aa, Dengue virus
SAITQAERTG

SEQ ID NO: 92258 - protein, 10 aa, Dengue virus
AITQAERTGE

SEQ ID NO: 92259 - protein, 10 aa, Dengue virus
ITQAERTGEP

SEQ ID NO: 92260 - protein, 10 aa, Dengue virus
TQAERTGEPD

SEQ ID NO: 92261 - protein, 10 aa, Dengue virus
QAERTGEPDY

SEQ ID NO: 92262 - protein, 10 aa, Dengue virus
AERTGEPDYE

SEQ ID NO: 92263 - protein, 10 aa, Dengue virus
ERTGEPDYEV

SEQ ID NO: 92264 - protein, 10 aa, Dengue virus
RTGEPDYEVD

SEQ ID NO: 92265 - protein, 10 aa, Dengue virus
TGEPDYEVDE

SEQ ID NO: 92266 - protein, 10 aa, Dengue virus
IRYQTPAVKA

SEQ ID NO: 92267 - protein, 10 aa, Dengue virus
RYQTPAVKAE

SEQ ID NO: 92268 - protein, 10 aa, Dengue virus
YQTPAVKAEH

SEQ ID NO: 92269 - protein, 10 aa, Dengue virus
QTPAVKAEHT

SEQ ID NO: 92270 - protein, 10 aa, Dengue virus
TPAVKSDHTG

SEQ ID NO: 92271 - protein, 10 aa, Dengue virus
PAVKAEHTGR

SEQ ID NO: 92272 - protein, 10 aa, Dengue virus
AVKAEHTGRE

SEQ ID NO: 92273 - protein, 10 aa, Dengue virus
VKSDHTGREI

SEQ ID NO: 92274 - protein, 10 aa, Dengue virus
KSDHTGREIV

SEQ ID NO: 92275 - protein, 10 aa, Dengue virus
AEHTGREIVD

SEQ ID NO: 92276 - protein, 10 aa, Dengue virus
LMCHATFTTK

SEQ ID NO: 92277 - protein, 10 aa, Dengue virus
MCHATFTTKL

SEQ ID NO: 92278 - protein, 10 aa, Dengue virus
CHATFTTKLL

SEQ ID NO: 92279 - protein, 10 aa, Dengue virus
HATFTTKLLS

SEQ ID NO: 92280 - protein, 10 aa, Dengue virus
ATFTTKLLSS

SEQ ID NO: 92281 - protein, 10 aa, Dengue virus
TFTTKLLSST

SEQ ID NO: 92282 - protein, 10 aa, Dengue virus
FTTKLLSSTR

SEQ ID NO: 92283 - protein, 10 aa, Dengue virus
TTKLLSSTRV

SEQ ID NO: 92284 - protein, 10 aa, Dengue virus
TKLLSSTRVP

SEQ ID NO: 92285 - protein, 10 aa, Dengue virus
KLLSSTRVPN

SEQ ID NO: 92286 - protein, 10 aa, Dengue virus
MDEAHFTDPC

SEQ ID NO: 92287 - protein, 10 aa, Dengue virus
DEAHFTDPCS

SEQ ID NO: 92288 - protein, 10 aa, Dengue virus
EAHFTDPCSV

SEQ ID NO: 92289 - protein, 10 aa, Dengue virus
AHFTDPCSVA

SEQ ID NO: 92290 - protein, 10 aa, Dengue virus
HFTDPCSVAA

SEQ ID NO: 92291 - protein, 10 aa, Dengue virus
FTDPCSVAAR

SEQ ID NO: 92292 - protein, 10 aa, Dengue virus
TDPCSVAARG

SEQ ID NO: 92293 - protein, 10 aa, Dengue virus
DPCSVAARGY

SEQ ID NO: 92294 - protein, 10 aa, Dengue virus
PCSVAARGYI

SEQ ID NO: 92295 - protein, 10 aa, Dengue virus
CSVAARGYIS

SEQ ID NO: 92296 - protein, 10 aa, Dengue virus
IFMTATPPGS

SEQ ID NO: 92297 - protein, 10 aa, Dengue virus
FMTATPPGSI

SEQ ID NO: 92298 - protein, 10 aa, Dengue virus
MTATPPGSID

SEQ ID NO: 92299 - protein, 10 aa, Dengue virus
TATPPGSIDP

SEQ ID NO: 92300 - protein, 10 aa, Dengue virus
ATPPGSIDPF

SEQ ID NO: 92301 - protein, 10 aa, Dengue virus
TPPGSIDPFP

SEQ ID NO: 92302 - protein, 10 aa, Dengue virus
PPGSIDPFPQ

SEQ ID NO: 92303 - protein, 10 aa, Dengue virus
PGSIDPFPQS

SEQ ID NO: 92304 - protein, 10 aa, Dengue virus
GSIDPFPQSN

SEQ ID NO: 92305 - protein, 10 aa, Dengue virus
SIDPFPQSNS

SEQ ID NO: 92306 - protein, 10 aa, Dengue virus
IDPFPQSNSP

SEQ ID NO: 92307 - protein, 10 aa, Dengue virus
ANCLRKSGKR

SEQ ID NO: 92308 - protein, 10 aa, Dengue virus
NCLRKSGKRV

SEQ ID NO: 92309 - protein, 10 aa, Dengue virus
CLRKSGKRVI

SEQ ID NO: 92310 - protein, 10 aa, Dengue virus
LRKSGKRVIQ

SEQ ID NO: 92311 - protein, 10 aa, Dengue virus
RKSGKRVIQL

SEQ ID NO: 92312 - protein, 10 aa, Dengue virus
KSGKRVIQLS

SEQ ID NO: 92313 - protein, 10 aa, Dengue virus
SGKRVIQLSR

SEQ ID NO: 92314 - protein, 10 aa, Dengue virus
GKRVIQLSRK

SEQ ID NO: 92315 - protein, 10 aa, Dengue virus
KRVIQLSRKT

SEQ ID NO: 92316 - protein, 10 aa, Dengue virus
RVIQLSRKTF

SEQ ID NO: 92317 - protein, 10 aa, Dengue virus
PRRCLKPVIS

SEQ ID NO: 92318 - protein, 10 aa, Dengue virus
RRCLKPVILP

SEQ ID NO: 92319 - protein, 10 aa, Dengue virus
RCLKPVILPD

SEQ ID NO: 92320 - protein, 10 aa, Dengue virus
CLKPVILPDG

SEQ ID NO: 92321 - protein, 10 aa, Dengue virus
LKPVILPDGP

SEQ ID NO: 92322 - protein, 10 aa, Dengue virus
KPVILPDGPE

SEQ ID NO: 92323 - protein, 10 aa, Dengue virus
PVILPDGPER

SEQ ID NO: 92324 - protein, 10 aa, Dengue virus
VILPDGPERV

SEQ ID NO: 92325 - protein, 10 aa, Dengue virus
ILPDGPERVI

SEQ ID NO: 92326 - protein, 10 aa, Dengue virus
LPDGPERVIL

SEQ ID NO: 92327 - protein, 10 aa, Dengue virus
PDGPERVILA

SEQ ID NO: 92328 - protein, 10 aa, Dengue virus
QRRGRIGRNL

SEQ ID NO: 92329 - protein, 10 aa, Dengue virus
RRGRIGRNLA

SEQ ID NO: 92330 - protein, 10 aa, Dengue virus
RGRIGRNLAQ

SEQ ID NO: 92331 - protein, 10 aa, Dengue virus
GRIGRNLAQE

SEQ ID NO: 92332 - protein, 10 aa, Dengue virus
RIGRNLAQED

SEQ ID NO: 92333 - protein, 10 aa, Dengue virus
IGRNLAQEDD

SEQ ID NO: 92334 - protein, 10 aa, Dengue virus
GRNLAQEDDQ

SEQ ID NO: 92335 - protein, 10 aa, Dengue virus
RNLAQEDDQY

SEQ ID NO: 92336 - protein, 10 aa, Dengue virus
NLAQEDDQYV

SEQ ID NO: 92337 - protein, 10 aa, Dengue virus
LAQEDDQYVF

SEQ ID NO: 92338 - protein, 10 aa, Dengue virus
TQEDDQYVFS

SEQ ID NO: 92339 - protein, 10 aa, Dengue virus
QYVFSGDPLR

SEQ ID NO: 92340 - protein, 10 aa, Dengue virus
YVFSGDPLRN

SEQ ID NO: 92341 - protein, 10 aa, Dengue virus
VFSGDPLRND

SEQ ID NO: 92342 - protein, 10 aa, Dengue virus
FSGDPLRNDE

SEQ ID NO: 92343 - protein, 10 aa, Dengue virus
SGDPLRNDED

SEQ ID NO: 92344 - protein, 10 aa, Dengue virus
GDPLRNDEDH

SEQ ID NO: 92345 - protein, 10 aa, Dengue virus
DPLRNDEDHA

SEQ ID NO: 92346 - protein, 10 aa, Dengue virus
PLRNDEDHAH

SEQ ID NO: 92347 - protein, 10 aa, Dengue virus
LRNDEDHAHW

SEQ ID NO: 92348 - protein, 10 aa, Dengue virus
RNDEDHAHWT

SEQ ID NO: 92349 - protein, 10 aa, Dengue virus
TLFGPEREKN

SEQ ID NO: 92350 - protein, 10 aa, Dengue virus
LFGPEREKNQ

SEQ ID NO: 92351 - protein, 10 aa, Dengue virus
FGPEREKNQA

SEQ ID NO: 92352 - protein, 10 aa, Dengue virus
GPEREKNQAI

SEQ ID NO: 92353 - protein, 10 aa, Dengue virus
PEREKNQAID

SEQ ID NO: 92354 - protein, 10 aa, Dengue virus
EREKNQAIDG

SEQ ID NO: 92355 - protein, 10 aa, Dengue virus
REKNQAIDGE

SEQ ID NO: 92356 - protein, 10 aa, Dengue virus
EKNQAIDGEF

SEQ ID NO: 92357 - protein, 10 aa, Dengue virus
KNQAIDGEFR

SEQ ID NO: 92358 - protein, 10 aa, Dengue virus
NQAIDGEFRL

SEQ ID NO: 92359 - protein, 10 aa, Dengue virus
QRKTFVELMK

SEQ ID NO: 92360 - protein, 10 aa, Dengue virus
RKTFVELMKR

SEQ ID NO: 92361 - protein, 10 aa, Dengue virus
KTFVELMKRG

SEQ ID NO: 92362 - protein, 10 aa, Dengue virus
TFVELMKRGD

SEQ ID NO: 92363 - protein, 10 aa, Dengue virus
FVELMKRGDL

SEQ ID NO: 92364 - protein, 10 aa, Dengue virus
VELMKRGDLP

SEQ ID NO: 92365 - protein, 10 aa, Dengue virus
ELMKRGDLPV

SEQ ID NO: 92366 - protein, 10 aa, Dengue virus
LMKRGDLPVW

SEQ ID NO: 92367 - protein, 10 aa, Dengue virus
MKRGDLPVWL

SEQ ID NO: 92368 - protein, 10 aa, Dengue virus
KRGDLPVWLS

SEQ ID NO: 92369 - protein, 10 aa, Dengue virus
KVASAGISYE

SEQ ID NO: 92370 - protein, 10 aa, Dengue virus
VASAGISYED

SEQ ID NO: 92371 - protein, 10 aa, Dengue virus
ASAGISYEDR

SEQ ID NO: 92372 - protein, 10 aa, Dengue virus
SAGISYEDRE

SEQ ID NO: 92373 - protein, 10 aa, Dengue virus
AGISYEDREW

SEQ ID NO: 92374 - protein, 10 aa, Dengue virus
GISYEDREWC

SEQ ID NO: 92375 - protein, 10 aa, Dengue virus
ISYEDREWCF

SEQ ID NO: 92376 - protein, 10 aa, Dengue virus
SYEDREWCFT

SEQ ID NO: 92377 - protein, 10 aa, Dengue virus
YEDREWCFTG

SEQ ID NO: 92378 - protein, 10 aa, Dengue virus
EDREWCFTGE

SEQ ID NO: 92379 - protein, 10 aa, Dengue virus
EGEKKKLRPK

SEQ ID NO: 92380 - protein, 10 aa, Dengue virus
GEKKKLRPKW

SEQ ID NO: 92381 - protein, 10 aa, Dengue virus
EKKKLRPKWL

SEQ ID NO: 92382 - protein, 10 aa, Dengue virus
KKKLRPKWLD

SEQ ID NO: 92383 - protein, 10 aa, Dengue virus
KKLRPKWLDA

SEQ ID NO: 92384 - protein, 10 aa, Dengue virus
KLRPKWLDAR

SEQ ID NO: 92385 - protein, 10 aa, Dengue virus
LRPKWLDARV

SEQ ID NO: 92386 - protein, 10 aa, Dengue virus
RPKWLDARVY

SEQ ID NO: 92387 - protein, 10 aa, Dengue virus
PKWLDARVYA

SEQ ID NO: 92388 - protein, 10 aa, Dengue virus
KWLDARVYAD

SEQ ID NO: 92389 - protein, 10 aa, Dengue virus
TLDILTEIAT

SEQ ID NO: 92390 - protein, 10 aa, Dengue virus
LDILTEIATL

SEQ ID NO: 92391 - protein, 10 aa, Dengue virus
DILTEIATLP

SEQ ID NO: 92392 - protein, 10 aa, Dengue virus
ILTEIATLPT

SEQ ID NO: 92393 - protein, 10 aa, Dengue virus
LTEIATLPTY

SEQ ID NO: 92394 - protein, 10 aa, Dengue virus
TEIATLPTYL

SEQ ID NO: 92395 - protein, 10 aa, Dengue virus
EIATLPTYLS

SEQ ID NO: 92396 - protein, 10 aa, Dengue virus
IATLPTYLSS

SEQ ID NO: 92397 - protein, 10 aa, Dengue virus
ATLPTYLSSK

SEQ ID NO: 92398 - protein, 10 aa, Dengue virus
TLPTYLSSKA

SEQ ID NO: 92399 - protein, 10 aa, Dengue virus
LPTYLSSKAK

SEQ ID NO: 92400 - protein, 10 aa, Dengue virus
PTYLSSKAKL

SEQ ID NO: 92401 - protein, 10 aa, Dengue virus
TYLSSKAKLA

SEQ ID NO: 92402 - protein, 10 aa, Dengue virus
YLSSKAKLAL

SEQ ID NO: 92403 - protein, 10 aa, Dengue virus
LSSKAKLALD

SEQ ID NO: 92404 - protein, 10 aa, Dengue virus
SSKAKLALDN

SEQ ID NO: 92405 - protein, 10 aa, Dengue virus
SKAKLALDNI

SEQ ID NO: 92406 - protein, 10 aa, Dengue virus
KAKLALDNIV

SEQ ID NO: 92407 - protein, 10 aa, Dengue virus
NIVMLHTTEK

SEQ ID NO: 92408 - protein, 10 aa, Dengue virus
IVMLHTTEKG

SEQ ID NO: 92409 - protein, 10 aa, Dengue virus
VMLHTTEKGG

SEQ ID NO: 92410 - protein, 10 aa, Dengue virus
MLHTTEKGGR

SEQ ID NO: 92411 - protein, 10 aa, Dengue virus
LHTTEKGGRA

SEQ ID NO: 92412 - protein, 10 aa, Dengue virus
HTTEKGGRAY

SEQ ID NO: 92413 - protein, 10 aa, Dengue virus
TTEKGGRAYQ

SEQ ID NO: 92414 - protein, 10 aa, Dengue virus
TEKGGRAYQH

SEQ ID NO: 92415 - protein, 10 aa, Dengue virus
EKGGRAYQHA

SEQ ID NO: 92416 - protein, 10 aa, Dengue virus
KGGRAYQHAL

SEQ ID NO: 92417 - protein, 10 aa, Dengue virus
GGKAYQHALN

SEQ ID NO: 92418 - protein, 10 aa, Dengue virus
GKAYQHALNE

SEQ ID NO: 92419 - protein, 10 aa, Dengue virus
KAYQHALNEL

SEQ ID NO: 92420 - protein, 10 aa, Dengue virus
PESLETLMLI

SEQ ID NO: 92421 - protein, 10 aa, Dengue virus
ESLETLMLIA

SEQ ID NO: 92422 - protein, 10 aa, Dengue virus
SLETLMLIAL

SEQ ID NO: 92423 - protein, 10 aa, Dengue virus
LETLMLIALL

SEQ ID NO: 92424 - protein, 10 aa, Dengue virus
ETLMLIALLG

SEQ ID NO: 92425 - protein, 10 aa, Dengue virus
TLMLIALLGA

SEQ ID NO: 92426 - protein, 10 aa, Dengue virus
LMLIALLGAM

SEQ ID NO: 92427 - protein, 10 aa, Dengue virus
MLIALLGAMT

SEQ ID NO: 92428 - protein, 10 aa, Dengue virus
LIALLGAMTA

SEQ ID NO: 92429 - protein, 10 aa, Dengue virus
IALLGAMTAG

SEQ ID NO: 92430 - protein, 10 aa, Dengue virus
ALLGAMTAGT

SEQ ID NO: 92431 - protein, 10 aa, Dengue virus
LLGAMTAGTF

SEQ ID NO: 92432 - protein, 10 aa, Dengue virus
LGAMTAGTFL

SEQ ID NO: 92433 - protein, 10 aa, Dengue virus
GAMTAGTFLF

SEQ ID NO: 92434 - protein, 10 aa, Dengue virus
AMTAGTFLFF

SEQ ID NO: 92435 - protein, 10 aa, Dengue virus
MTAGTFLFFM

SEQ ID NO: 92436 - protein, 10 aa, Dengue virus
TAGTFLFFMQ

SEQ ID NO: 92437 - protein, 10 aa, Dengue virus
AGTFLFFMQG

SEQ ID NO: 92438 - protein, 10 aa, Dengue virus
GTFLFFMQGK

SEQ ID NO: 92439 - protein, 10 aa, Dengue virus
TFLFFMQGKG

SEQ ID NO: 92440 - protein, 10 aa, Dengue virus
FLFFMQGKGM

SEQ ID NO: 92441 - protein, 10 aa, Dengue virus
LFFMQGKGMG

SEQ ID NO: 92442 - protein, 10 aa, Dengue virus
FFMQGKGMGK

SEQ ID NO: 92443 - protein, 10 aa, Dengue virus
FMQGKGMGKL

SEQ ID NO: 92444 - protein, 10 aa, Dengue virus
MQGKGMGKLS

SEQ ID NO: 92445 - protein, 10 aa, Dengue virus
QGKGIGKLSV

SEQ ID NO: 92446 - protein, 10 aa, Dengue virus
GKGIGKLSVG

SEQ ID NO: 92447 - protein, 10 aa, Dengue virus
KGIGKLSVGL

SEQ ID NO: 92448 - protein, 10 aa, Dengue virus
GMGKLSMGLI

SEQ ID NO: 92449 - protein, 10 aa, Dengue virus
IGKLSMGLIA

SEQ ID NO: 92450 - protein, 10 aa, Dengue virus
GKLSMGLIAI

SEQ ID NO: 92451 - protein, 10 aa, Dengue virus
KLSMGLIAIA

SEQ ID NO: 92452 - protein, 10 aa, Dengue virus
LSMGLIAIAV

SEQ ID NO: 92453 - protein, 10 aa, Dengue virus
SMGLIAIAVA

SEQ ID NO: 92454 - protein, 10 aa, Dengue virus
MGLIAIAVAS

SEQ ID NO: 92455 - protein, 10 aa, Dengue virus
GLIAIAVASG

SEQ ID NO: 92456 - protein, 10 aa, Dengue virus
LIAIAVASGL

SEQ ID NO: 92457 - protein, 10 aa, Dengue virus
IAIAVASGLL

SEQ ID NO: 92458 - protein, 10 aa, Dengue virus
AIAVASGLLW

SEQ ID NO: 92459 - protein, 10 aa, Dengue virus
IAMASGLLWI

SEQ ID NO: 92460 - protein, 10 aa, Dengue virus
AMASGLLWIA

SEQ ID NO: 92461 - protein, 10 aa, Dengue virus
MASGLLWIAE

SEQ ID NO: 92462 - protein, 10 aa, Dengue virus
ASGLLWIAEI

SEQ ID NO: 92463 - protein, 10 aa, Dengue virus
SGLLWIAEIQ

SEQ ID NO: 92464 - protein, 10 aa, Dengue virus
GLLWIAEIQP

SEQ ID NO: 92465 - protein, 10 aa, Dengue virus
LLWIAEIQPQ

SEQ ID NO: 92466 - protein, 10 aa, Dengue virus
LWIAEIQPQW

SEQ ID NO: 92467 - protein, 10 aa, Dengue virus
WIAEIQPQWI

SEQ ID NO: 92468 - protein, 10 aa, Dengue virus
IAEIQPQWIA

SEQ ID NO: 92469 - protein, 10 aa, Dengue virus
AELQPQWIAA

SEQ ID NO: 92470 - protein, 10 aa, Dengue virus
ELQPQWIAAS

SEQ ID NO: 92471 - protein, 10 aa, Dengue virus
LQPQWIAASI

SEQ ID NO: 92472 - protein, 10 aa, Dengue virus
LEFFLMVLLV

SEQ ID NO: 92473 - protein, 10 aa, Dengue virus
EFFLMVLLVP

SEQ ID NO: 92474 - protein, 10 aa, Dengue virus
FFLMVLLVPE

SEQ ID NO: 92475 - protein, 10 aa, Dengue virus
FLMVLLVPEP

SEQ ID NO: 92476 - protein, 10 aa, Dengue virus
LMVLLVPEPE

SEQ ID NO: 92477 - protein, 10 aa, Dengue virus
MVLLVPEPEK

SEQ ID NO: 92478 - protein, 10 aa, Dengue virus
VLLVPEPEKQ

SEQ ID NO: 92479 - protein, 10 aa, Dengue virus
LLVPEPEKQR

SEQ ID NO: 92480 - protein, 10 aa, Dengue virus
LVPEPEKQRT

SEQ ID NO: 92481 - protein, 10 aa, Dengue virus
VPEPEKQRTP

SEQ ID NO: 92482 - protein, 10 aa, Dengue virus
DNQLIYVILA

SEQ ID NO: 92483 - protein, 10 aa, Dengue virus
NQLIYVILAI

SEQ ID NO: 92484 - protein, 10 aa, Dengue virus
QLIYVILAIL

SEQ ID NO: 92485 - protein, 10 aa, Dengue virus
LIYVILAILT

SEQ ID NO: 92486 - protein, 10 aa, Dengue virus
IYVILAILTI

SEQ ID NO: 92487 - protein, 10 aa, Dengue virus
YVILAILTII

SEQ ID NO: 92488 - protein, 10 aa, Dengue virus
VILAILTIIG

SEQ ID NO: 92489 - protein, 10 aa, Dengue virus
ILAILTIIGL

SEQ ID NO: 92490 - protein, 10 aa, Dengue virus
ILTIIGLVAA

SEQ ID NO: 92491 - protein, 10 aa, Dengue virus
LTIIGLVAAN

SEQ ID NO: 92492 - protein, 10 aa, Dengue virus
TIIGLVAANE

SEQ ID NO: 92493 - protein, 10 aa, Dengue virus
IIGLVAANEM

SEQ ID NO: 92494 - protein, 10 aa, Dengue virus
IGLVAANEMG

SEQ ID NO: 92495 - protein, 10 aa, Dengue virus
GLVAANEMGL

SEQ ID NO: 92496 - protein, 10 aa, Dengue virus
LVAANEMGLI

SEQ ID NO: 92497 - protein, 10 aa, Dengue virus
VAANEMGLIE

SEQ ID NO: 92498 - protein, 10 aa, Dengue virus
EMGLIEKTKA

SEQ ID NO: 92499 - protein, 10 aa, Dengue virus
MGLIEKTKAD

SEQ ID NO: 92500 - protein, 10 aa, Dengue virus
GLIEKTKADF

SEQ ID NO: 92501 - protein, 10 aa, Dengue virus
LIEKTKADFG

SEQ ID NO: 92502 - protein, 10 aa, Dengue virus
IEKTKADFGF

SEQ ID NO: 92503 - protein, 10 aa, Dengue virus
EKTKADFGFY

SEQ ID NO: 92504 - protein, 10 aa, Dengue virus
KTKADFGFYQ

SEQ ID NO: 92505 - protein, 10 aa, Dengue virus
TKTDFGFYQA

SEQ ID NO: 92506 - protein, 10 aa, Dengue virus
KTDFGFYQAK

SEQ ID NO: 92507 - protein, 10 aa, Dengue virus
TDFGFYQAKT

SEQ ID NO: 92508 - protein, 10 aa, Dengue virus
DFGFYQAKTE

SEQ ID NO: 92509 - protein, 10 aa, Dengue virus
FGFYQAKTET

SEQ ID NO: 92510 - protein, 10 aa, Dengue virus
GFYQAKTETT

SEQ ID NO: 92511 - protein, 10 aa, Dengue virus
FYQAKTETTI

SEQ ID NO: 92512 - protein, 10 aa, Dengue virus
YQAKTETTIL

SEQ ID NO: 92513 - protein, 10 aa, Dengue virus
QAKTETTILD

SEQ ID NO: 92514 - protein, 10 aa, Dengue virus
AKTETTILDV

SEQ ID NO: 92515 - protein, 10 aa, Dengue virus
KPETTILDVD

SEQ ID NO: 92516 - protein, 10 aa, Dengue virus
PETTILDVDL

SEQ ID NO: 92517 - protein, 10 aa, Dengue virus
WTLYAVVTTI

SEQ ID NO: 92518 - protein, 10 aa, Dengue virus
TLYAVVTTIL

SEQ ID NO: 92519 - protein, 10 aa, Dengue virus
LYAVVTTILT

SEQ ID NO: 92520 - protein, 10 aa, Dengue virus
YAVVTTILTP

SEQ ID NO: 92521 - protein, 10 aa, Dengue virus
AVVTTILTPM

SEQ ID NO: 92522 - protein, 10 aa, Dengue virus
VVTTILTPML

SEQ ID NO: 92523 - protein, 10 aa, Dengue virus
VTTILTPMLR

SEQ ID NO: 92524 - protein, 10 aa, Dengue virus
NLSLTAIANQ

SEQ ID NO: 92525 - protein, 10 aa, Dengue virus
LSLTAIANQA

SEQ ID NO: 92526 - protein, 10 aa, Dengue virus
SLTAIANQAA

SEQ ID NO: 92527 - protein, 10 aa, Dengue virus
LTAIANQAAV

SEQ ID NO: 92528 - protein, 10 aa, Dengue virus
AAIANHAAVL

SEQ ID NO: 92529 - protein, 10 aa, Dengue virus
LGKGWPLHRV

SEQ ID NO: 92530 - protein, 10 aa, Dengue virus
GKGWPLHRVD

SEQ ID NO: 92531 - protein, 10 aa, Dengue virus
KGWPLHRVDL

SEQ ID NO: 92532 - protein, 10 aa, Dengue virus
GWPLHRVDLG

SEQ ID NO: 92533 - protein, 10 aa, Dengue virus
WPLHRVDLGV

SEQ ID NO: 92534 - protein, 10 aa, Dengue virus
PLHRVDLGVP

SEQ ID NO: 92535 - protein, 10 aa, Dengue virus
LHRVDLGVPL

SEQ ID NO: 92536 - protein, 10 aa, Dengue virus
HRVDLGVPLL

SEQ ID NO: 92537 - protein, 10 aa, Dengue virus
RVDLGVPLLA

SEQ ID NO: 92538 - protein, 10 aa, Dengue virus
VDLGVPLLAM

SEQ ID NO: 92539 - protein, 10 aa, Dengue virus
YSQVNPTTLI

SEQ ID NO: 92540 - protein, 10 aa, Dengue virus
SQVNPTTLIA

SEQ ID NO: 92541 - protein, 10 aa, Dengue virus
QVNPTTLIAS

SEQ ID NO: 92542 - protein, 10 aa, Dengue virus
VNPTTLIASL

SEQ ID NO: 92543 - protein, 10 aa, Dengue virus
NPTTLIASLV

SEQ ID NO: 92544 - protein, 10 aa, Dengue virus
PTTLIASLVM

SEQ ID NO: 92545 - protein, 10 aa, Dengue virus
TTLIASLVML

SEQ ID NO: 92546 - protein, 10 aa, Dengue virus
TLTASLVMLS

SEQ ID NO: 92547 - protein, 10 aa, Dengue virus
LTASLVMLSV

SEQ ID NO: 92548 - protein, 10 aa, Dengue virus
TASLVMLSVH

SEQ ID NO: 92549 - protein, 10 aa, Dengue virus
ASLVMLSVHY

SEQ ID NO: 92550 - protein, 10 aa, Dengue virus
SLVMLSVHYA

SEQ ID NO: 92551 - protein, 10 aa, Dengue virus
LVMLSVHYAI

SEQ ID NO: 92552 - protein, 10 aa, Dengue virus
VMLSVHYAII

SEQ ID NO: 92553 - protein, 10 aa, Dengue virus
MLSVHYAIIG

SEQ ID NO: 92554 - protein, 10 aa, Dengue virus
LSVHYAIIGP

SEQ ID NO: 92555 - protein, 10 aa, Dengue virus
SVHYAIIGPG

SEQ ID NO: 92556 - protein, 10 aa, Dengue virus
GQVMLLVLCV

SEQ ID NO: 92557 - protein, 10 aa, Dengue virus
QVMLLVLCVG

SEQ ID NO: 92558 - protein, 10 aa, Dengue virus
VMLLVLCVGQ

SEQ ID NO: 92559 - protein, 10 aa, Dengue virus
MLLVLCVGQL

SEQ ID NO: 92560 - protein, 10 aa, Dengue virus
LLVLCVGQLL

SEQ ID NO: 92561 - protein, 10 aa, Dengue virus
LVLCVGQLLL

SEQ ID NO: 92562 - protein, 10 aa, Dengue virus
VLCVGQLLLM

SEQ ID NO: 92563 - protein, 10 aa, Dengue virus
LCVGQLLLMR

SEQ ID NO: 92564 - protein, 10 aa, Dengue virus
CVGQLLLMRT

SEQ ID NO: 92565 - protein, 10 aa, Dengue virus
VGQLLLMRTT

SEQ ID NO: 92566 - protein, 10 aa, Dengue virus
GQLFLMRTTW

SEQ ID NO: 92567 - protein, 10 aa, Dengue virus
QLFLMRTTWA

SEQ ID NO: 92568 - protein, 10 aa, Dengue virus
LLLMRTTWAL

SEQ ID NO: 92569 - protein, 10 aa, Dengue virus
LLMRTTWALC

SEQ ID NO: 92570 - protein, 10 aa, Dengue virus
LMRTTWALCE

SEQ ID NO: 92571 - protein, 10 aa, Dengue virus
MRTTWALCEV

SEQ ID NO: 92572 - protein, 10 aa, Dengue virus
RTTWALCEVL

SEQ ID NO: 92573 - protein, 10 aa, Dengue virus
TTWALCEVLT

SEQ ID NO: 92574 - protein, 10 aa, Dengue virus
TWALCEVLTL

SEQ ID NO: 92575 - protein, 10 aa, Dengue virus
WALCEVLTLA

SEQ ID NO: 92576 - protein, 10 aa, Dengue virus
ALCEVLTLAT

SEQ ID NO: 92577 - protein, 10 aa, Dengue virus
LCEVLTLATG

SEQ ID NO: 92578 - protein, 10 aa, Dengue virus
EVLTLATGPV

SEQ ID NO: 92579 - protein, 10 aa, Dengue virus
VLTLATGPIM

SEQ ID NO: 92580 - protein, 10 aa, Dengue virus
LTLATGPIMT

SEQ ID NO: 92581 - protein, 10 aa, Dengue virus
TLATGPIMTL

SEQ ID NO: 92582 - protein, 10 aa, Dengue virus
LATGPIMTLW

SEQ ID NO: 92583 - protein, 10 aa, Dengue virus
ATGPIMTLWE

SEQ ID NO: 92584 - protein, 10 aa, Dengue virus
TGPIMTLWEG

SEQ ID NO: 92585 - protein, 10 aa, Dengue virus
GPIMTLWEGN

SEQ ID NO: 92586 - protein, 10 aa, Dengue virus
PIMTLWEGNP

SEQ ID NO: 92587 - protein, 10 aa, Dengue virus
IMTLWEGNPG

SEQ ID NO: 92588 - protein, 10 aa, Dengue virus
MTLWEGNPGR

SEQ ID NO: 92589 - protein, 10 aa, Dengue virus
GLAFSLIKNV

SEQ ID NO: 92590 - protein, 10 aa, Dengue virus
LAFSLIKNVQ

SEQ ID NO: 92591 - protein, 10 aa, Dengue virus
AFSLIKNVQT

SEQ ID NO: 92592 - protein, 10 aa, Dengue virus
FSLIKNVQTP

SEQ ID NO: 92593 - protein, 10 aa, Dengue virus
SLIKNVQTPR

SEQ ID NO: 92594 - protein, 10 aa, Dengue virus
LIKNVQTPRR

SEQ ID NO: 92595 - protein, 10 aa, Dengue virus
IKNVQTPRRG

SEQ ID NO: 92596 - protein, 10 aa, Dengue virus
KNVQTPRRGT

SEQ ID NO: 92597 - protein, 10 aa, Dengue virus
NVQTPRRGTG

SEQ ID NO: 92598 - protein, 10 aa, Dengue virus
VQTPRRGTGT

SEQ ID NO: 92599 - protein, 10 aa, Dengue virus
QTPRRGTGIT

SEQ ID NO: 92600 - protein, 10 aa, Dengue virus
TPRRGTGTIG

SEQ ID NO: 92601 - protein, 10 aa, Dengue virus
PRRGTGITGE

SEQ ID NO: 92602 - protein, 10 aa, Dengue virus
RRGTGTIGET

SEQ ID NO: 92603 - protein, 10 aa, Dengue virus
RGTGITGETL

SEQ ID NO: 92604 - protein, 10 aa, Dengue virus
GTGTIGETLG

SEQ ID NO: 92605 - protein, 10 aa, Dengue virus
TGTIGETLGE

SEQ ID NO: 92606 - protein, 10 aa, Dengue virus
GITGETLGEK

SEQ ID NO: 92607 - protein, 10 aa, Dengue virus
ITGETLGEKW

SEQ ID NO: 92608 - protein, 10 aa, Dengue virus
KRQLNSLDRR

SEQ ID NO: 92609 - protein, 10 aa, Dengue virus
RQLNSLDRRE

SEQ ID NO: 92610 - protein, 10 aa, Dengue virus
QLNSLDRREF

SEQ ID NO: 92611 - protein, 10 aa, Dengue virus
LNSLDRREFE

SEQ ID NO: 92612 - protein, 10 aa, Dengue virus
NSLDRREFEE

SEQ ID NO: 92613 - protein, 10 aa, Dengue virus
SLDRREFEEY

SEQ ID NO: 92614 - protein, 10 aa, Dengue virus
LDRREFEEYK

SEQ ID NO: 92615 - protein, 10 aa, Dengue virus
DRREFEEYKR

SEQ ID NO: 92616 - protein, 10 aa, Dengue virus
FEEYKRSGII

SEQ ID NO: 92617 - protein, 10 aa, Dengue virus
EEYKRSGIIE

SEQ ID NO: 92618 - protein, 10 aa, Dengue virus
EYKRSGIIEV

SEQ ID NO: 92619 - protein, 10 aa, Dengue virus
YKRSGIIEVD

SEQ ID NO: 92620 - protein, 10 aa, Dengue virus
KRSGIIEVDR

SEQ ID NO: 92621 - protein, 10 aa, Dengue virus
RSGIIEVDRT

SEQ ID NO: 92622 - protein, 10 aa, Dengue virus
SGIIEVDRTE

SEQ ID NO: 92623 - protein, 10 aa, Dengue virus
GIIEVDRTEA

SEQ ID NO: 92624 - protein, 10 aa, Dengue virus
IIEVDRTEAK

SEQ ID NO: 92625 - protein, 10 aa, Dengue virus
IEVDRTEAKS

SEQ ID NO: 92626 - protein, 10 aa, Dengue virus
DRTEAKSALR

SEQ ID NO: 92627 - protein, 10 aa, Dengue virus
RTEAKSALRD

SEQ ID NO: 92628 - protein, 10 aa, Dengue virus
TEAKSALRDG

SEQ ID NO: 92629 - protein, 10 aa, Dengue virus
EAKSALRDGS

SEQ ID NO: 92630 - protein, 10 aa, Dengue virus
AKSALRDGSK

SEQ ID NO: 92631 - protein, 10 aa, Dengue virus
KSALRDGSKI

SEQ ID NO: 92632 - protein, 10 aa, Dengue virus
SALRDGSKIK

SEQ ID NO: 92633 - protein, 10 aa, Dengue virus
ALRDGSKIKH

SEQ ID NO: 92634 - protein, 10 aa, Dengue virus
LRDGSKIKHA

SEQ ID NO: 92635 - protein, 10 aa, Dengue virus
RDGSKIKHAV

SEQ ID NO: 92636 - protein, 10 aa, Dengue virus
DGSKTKHAVS

SEQ ID NO: 92637 - protein, 10 aa, Dengue virus
GSKTKHAVSR

SEQ ID NO: 92638 - protein, 10 aa, Dengue virus
SKTKHAVSRG

SEQ ID NO: 92639 - protein, 10 aa, Dengue virus
KTKHAVSRGS

SEQ ID NO: 92640 - protein, 10 aa, Dengue virus
TKHAVSRGSS

SEQ ID NO: 92641 - protein, 10 aa, Dengue virus
KYAVSRGTSK

SEQ ID NO: 92642 - protein, 10 aa, Dengue virus
YAVSRGTSKI

SEQ ID NO: 92643 - protein, 10 aa, Dengue virus
AVSRGTSKIR

SEQ ID NO: 92644 - protein, 10 aa, Dengue virus
VSRGTSKIRW

SEQ ID NO: 92645 - protein, 10 aa, Dengue virus
SRGTSKIRWI

SEQ ID NO: 92646 - protein, 10 aa, Dengue virus
RGTSKIRWIV

SEQ ID NO: 92647 - protein, 10 aa, Dengue virus
GTSKIRWIVE

SEQ ID NO: 92648 - protein, 10 aa, Dengue virus
TSKIRWIVER

SEQ ID NO: 92649 - protein, 10 aa, Dengue virus
IRWIVERGMI

SEQ ID NO: 92650 - protein, 10 aa, Dengue virus
RWIVERGMIK

SEQ ID NO: 92651 - protein, 10 aa, Dengue virus
WIVERGMIKP

SEQ ID NO: 92652 - protein, 10 aa, Dengue virus
IVERGMIKPK

SEQ ID NO: 92653 - protein, 10 aa, Dengue virus
VERGMIKPKG

SEQ ID NO: 92654 - protein, 10 aa, Dengue virus
ERGMIKPKGK

SEQ ID NO: 92655 - protein, 10 aa, Dengue virus
RGMIKPKGKV

SEQ ID NO: 92656 - protein, 10 aa, Dengue virus
GMIKPKGKVV

SEQ ID NO: 92657 - protein, 10 aa, Dengue virus
MIKPKGKVVD

SEQ ID NO: 92658 - protein, 10 aa, Dengue virus
IKPKGKVVDL

SEQ ID NO: 92659 - protein, 10 aa, Dengue virus
KPKGKIVDLG

SEQ ID NO: 92660 - protein, 10 aa, Dengue virus
PKGKVIDLGC

SEQ ID NO: 92661 - protein, 10 aa, Dengue virus
KGKVIDLGCG

SEQ ID NO: 92662 - protein, 10 aa, Dengue virus
GKVIDLGCGR

SEQ ID NO: 92663 - protein, 10 aa, Dengue virus
KIVDLGCGRG

SEQ ID NO: 92664 - protein, 10 aa, Dengue virus
IVDLGCGRGG

SEQ ID NO: 92665 - protein, 10 aa, Dengue virus
ATLKNVTEVR

SEQ ID NO: 92666 - protein, 10 aa, Dengue virus
TLKNVTEVRG

SEQ ID NO: 92667 - protein, 10 aa, Dengue virus
LKNVTEVRGF

SEQ ID NO: 92668 - protein, 10 aa, Dengue virus
KNVTEVRGFT

SEQ ID NO: 92669 - protein, 10 aa, Dengue virus
NVTEVRGFTK

SEQ ID NO: 92670 - protein, 10 aa, Dengue virus
VTEVRGFTKG

SEQ ID NO: 92671 - protein, 10 aa, Dengue virus
TEVRGFTKGG

SEQ ID NO: 92672 - protein, 10 aa, Dengue virus
EVRGFTKGGP

SEQ ID NO: 92673 - protein, 10 aa, Dengue virus
VRGFTKGGPG

SEQ ID NO: 92674 - protein, 10 aa, Dengue virus
RGFTKGGPGH

SEQ ID NO: 92675 - protein, 10 aa, Dengue virus
GFTKGGPGHE

SEQ ID NO: 92676 - protein, 10 aa, Dengue virus
FTKGGPGHEE

SEQ ID NO: 92677 - protein, 10 aa, Dengue virus
LHSGVDVFYR

SEQ ID NO: 92678 - protein, 10 aa, Dengue virus
HSGVDVFYRP

SEQ ID NO: 92679 - protein, 10 aa, Dengue virus
SGVDVFYRPT

SEQ ID NO: 92680 - protein, 10 aa, Dengue virus
GVDVFYRPTE

SEQ ID NO: 92681 - protein, 10 aa, Dengue virus
VDVFYRPTEQ

SEQ ID NO: 92682 - protein, 10 aa, Dengue virus
DVFYRPTEQV

SEQ ID NO: 92683 - protein, 10 aa, Dengue virus
VFYRPTEQVD

SEQ ID NO: 92684 - protein, 10 aa, Dengue virus
FYRPTEQVDT

SEQ ID NO: 92685 - protein, 10 aa, Dengue virus
YRPTEQVDTL

SEQ ID NO: 92686 - protein, 10 aa, Dengue virus
RPTEQVDTLL

SEQ ID NO: 92687 - protein, 10 aa, Dengue virus
IEELEKLQRR

SEQ ID NO: 92688 - protein, 10 aa, Dengue virus
EELEKLQRRH

SEQ ID NO: 92689 - protein, 10 aa, Dengue virus
ELEKLQRRHG

SEQ ID NO: 92690 - protein, 10 aa, Dengue virus
LEKLQRRHGG

SEQ ID NO: 92691 - protein, 10 aa, Dengue virus
EKLQRRHGGS

SEQ ID NO: 92692 - protein, 10 aa, Dengue virus
KLQRRHGGSL

SEQ ID NO: 92693 - protein, 10 aa, Dengue virus
LQRRHGGSLV

SEQ ID NO: 92694 - protein, 10 aa, Dengue virus
QRRHGGSLVR

SEQ ID NO: 92695 - protein, 10 aa, Dengue virus
RRHGGSLVRC

SEQ ID NO: 92696 - protein, 10 aa, Dengue virus
RHGGSLVRCP

SEQ ID NO: 92697 - protein, 10 aa, Dengue virus
HGGSLVRCPL

SEQ ID NO: 92698 - protein, 10 aa, Dengue virus
GGSLVRCPLS

SEQ ID NO: 92699 - protein, 10 aa, Dengue virus
GSLVRCPLSR

SEQ ID NO: 92700 - protein, 10 aa, Dengue virus
SLVRCPLSRN

SEQ ID NO: 92701 - protein, 10 aa, Dengue virus
LIRCPLSRNS

SEQ ID NO: 92702 - protein, 10 aa, Dengue virus
IRCPLSRNST

SEQ ID NO: 92703 - protein, 10 aa, Dengue virus
THEMYWVSGV

SEQ ID NO: 92704 - protein, 10 aa, Dengue virus
HEMYWVSGVS

SEQ ID NO: 92705 - protein, 10 aa, Dengue virus
EMYWVSGVSG

SEQ ID NO: 92706 - protein, 10 aa, Dengue virus
MYWVSGVSGN

SEQ ID NO: 92707 - protein, 10 aa, Dengue virus
YWVSGVSGNI

SEQ ID NO: 92708 - protein, 10 aa, Dengue virus
WVSGVSGNIV

SEQ ID NO: 92709 - protein, 10 aa, Dengue virus
VSGVSGNIVS

SEQ ID NO: 92710 - protein, 10 aa, Dengue virus
SGVSGNIVSS

SEQ ID NO: 92711 - protein, 10 aa, Dengue virus
GVSGNIVSSV

SEQ ID NO: 92712 - protein, 10 aa, Dengue virus
VSGNIVSSVN

SEQ ID NO: 92713 - protein, 10 aa, Dengue virus
GNIVSSVNTI

SEQ ID NO: 92714 - protein, 10 aa, Dengue virus
NIVSSVNTIS

SEQ ID NO: 92715 - protein, 10 aa, Dengue virus
IVSSVNTISK

SEQ ID NO: 92716 - protein, 10 aa, Dengue virus
VSSVNTISKM

SEQ ID NO: 92717 - protein, 10 aa, Dengue virus
SSVNTISKML

SEQ ID NO: 92718 - protein, 10 aa, Dengue virus
SVNTISKMLL

SEQ ID NO: 92719 - protein, 10 aa, Dengue virus
VNTISKMLLN

SEQ ID NO: 92720 - protein, 10 aa, Dengue virus
NTISKMLLNR

SEQ ID NO: 92721 - protein, 10 aa, Dengue virus
TISKMLLNRF

SEQ ID NO: 92722 - protein, 10 aa, Dengue virus
ISKMLLNRFT

SEQ ID NO: 92723 - protein, 10 aa, Dengue virus
KMLLNWFTTR

SEQ ID NO: 92724 - protein, 10 aa, Dengue virus
MLLNWFTTRH

SEQ ID NO: 92725 - protein, 10 aa, Dengue virus
LLNRFTTKHR

SEQ ID NO: 92726 - protein, 10 aa, Dengue virus
LNRFTTKHRK

SEQ ID NO: 92727 - protein, 10 aa, Dengue virus
NRFTTKHRKP

SEQ ID NO: 92728 - protein, 10 aa, Dengue virus
RFTTRHRRPT

SEQ ID NO: 92729 - protein, 10 aa, Dengue virus
FTTRHRRPTY

SEQ ID NO: 92730 - protein, 10 aa, Dengue virus
TTKHRKPTYE

SEQ ID NO: 92731 - protein, 10 aa, Dengue virus
TKHRKPTYEK

SEQ ID NO: 92732 - protein, 10 aa, Dengue virus
RHRRPTYEKD

SEQ ID NO: 92733 - protein, 10 aa, Dengue virus
HRKPTYEKDA

SEQ ID NO: 92734 - protein, 10 aa, Dengue virus
RKPTYEKDAD

SEQ ID NO: 92735 - protein, 10 aa, Dengue virus
KPTYEKDADL

SEQ ID NO: 92736 - protein, 10 aa, Dengue virus
PTYEKDADLG

SEQ ID NO: 92737 - protein, 10 aa, Dengue virus
TYEKDADLGA

SEQ ID NO: 92738 - protein, 10 aa, Dengue virus
YEKDADLGAG

SEQ ID NO: 92739 - protein, 10 aa, Dengue virus
EKDADLGAGT

SEQ ID NO: 92740 - protein, 10 aa, Dengue virus
KDADLGAGTR

SEQ ID NO: 92741 - protein, 10 aa, Dengue virus
DADLGAGTRS

SEQ ID NO: 92742 - protein, 10 aa, Dengue virus
ADLGAGTRSV

SEQ ID NO: 92743 - protein, 10 aa, Dengue virus
TETEKPDMTV

SEQ ID NO: 92744 - protein, 10 aa, Dengue virus
ETEKPDMTVI

SEQ ID NO: 92745 - protein, 10 aa, Dengue virus
PENPDMTIIG

SEQ ID NO: 92746 - protein, 10 aa, Dengue virus
EKPDMTVIGR

SEQ ID NO: 92747 - protein, 10 aa, Dengue virus
KPDMTVIGRR

SEQ ID NO: 92748 - protein, 10 aa, Dengue virus
IIGRRLQRLR

SEQ ID NO: 92749 - protein, 10 aa, Dengue virus
IGRRLQRLRE

SEQ ID NO: 92750 - protein, 10 aa, Dengue virus
GRRLQRLREE

SEQ ID NO: 92751 - protein, 10 aa, Dengue virus
RRLQRLREEH

SEQ ID NO: 92752 - protein, 10 aa, Dengue virus
RLQRLREEHK

SEQ ID NO: 92753 - protein, 10 aa, Dengue virus
LQRLREEHKE

SEQ ID NO: 92754 - protein, 10 aa, Dengue virus
QRLREEHKET

SEQ ID NO: 92755 - protein, 10 aa, Dengue virus
RLREEHKETW

SEQ ID NO: 92756 - protein, 10 aa, Dengue virus
LREEHKETWH

SEQ ID NO: 92757 - protein, 10 aa, Dengue virus
REEHKETWHY

SEQ ID NO: 92758 - protein, 10 aa, Dengue virus
EHKETWHYDH

SEQ ID NO: 92759 - protein, 10 aa, Dengue virus
HKETWHYDHE

SEQ ID NO: 92760 - protein, 10 aa, Dengue virus
KETWHYDHEN

SEQ ID NO: 92761 - protein, 10 aa, Dengue virus
ETWHYDHENP

SEQ ID NO: 92762 - protein, 10 aa, Dengue virus
TWHYDHENPY

SEQ ID NO: 92763 - protein, 10 aa, Dengue virus
WHYDHENPYR

SEQ ID NO: 92764 - protein, 10 aa, Dengue virus
HYDHENPYRT

SEQ ID NO: 92765 - protein, 10 aa, Dengue virus
YDHENPYRTW

SEQ ID NO: 92766 - protein, 10 aa, Dengue virus
DHENPYRTWA

SEQ ID NO: 92767 - protein, 10 aa, Dengue virus
HENPYRTWAY

SEQ ID NO: 92768 - protein, 10 aa, Dengue virus
SYEASSTGSA

SEQ ID NO: 92769 - protein, 10 aa, Dengue virus
YEASSTGSAS

SEQ ID NO: 92770 - protein, 10 aa, Dengue virus
EAPSTGSTSS

SEQ ID NO: 92771 - protein, 10 aa, Dengue virus
APSTGSTSSM

SEQ ID NO: 92772 - protein, 10 aa, Dengue virus
PSTGSTSSMV

SEQ ID NO: 92773 - protein, 10 aa, Dengue virus
STGSTSSMVN

SEQ ID NO: 92774 - protein, 10 aa, Dengue virus
TGSASSMING

SEQ ID NO: 92775 - protein, 10 aa, Dengue virus
GSTSSMVNGV

SEQ ID NO: 92776 - protein, 10 aa, Dengue virus
SASSMINGVV

SEQ ID NO: 92777 - protein, 10 aa, Dengue virus
ASSMINGVVK

SEQ ID NO: 92778 - protein, 10 aa, Dengue virus
VKLLTKPWDM

SEQ ID NO: 92779 - protein, 10 aa, Dengue virus
KLLTKPWDVV

SEQ ID NO: 92780 - protein, 10 aa, Dengue virus
LLTKPWDVVP

SEQ ID NO: 92781 - protein, 10 aa, Dengue virus
LTKPWDVVPM

SEQ ID NO: 92782 - protein, 10 aa, Dengue virus
TKPWDVVPMV

SEQ ID NO: 92783 - protein, 10 aa, Dengue virus
KPWDVVPMVT

SEQ ID NO: 92784 - protein, 10 aa, Dengue virus
PWDVVPMVTQ

SEQ ID NO: 92785 - protein, 10 aa, Dengue virus
WDVVPMVTQL

SEQ ID NO: 92786 - protein, 10 aa, Dengue virus
DVVPMVTQLA

SEQ ID NO: 92787 - protein, 10 aa, Dengue virus
VVPMVTQLAM

SEQ ID NO: 92788 - protein, 10 aa, Dengue virus
VPMVTQLAMT

SEQ ID NO: 92789 - protein, 10 aa, Dengue virus
VDTRTPQPKL

SEQ ID NO: 92790 - protein, 10 aa, Dengue virus
DTRTPQPKLG

SEQ ID NO: 92791 - protein, 10 aa, Dengue virus
TRTPQPKLGT

SEQ ID NO: 92792 - protein, 10 aa, Dengue virus
RTPQPKLGTR

SEQ ID NO: 92793 - protein, 10 aa, Dengue virus
TPQPKPGTRV

SEQ ID NO: 92794 - protein, 10 aa, Dengue virus
PQPKPGTRMI

SEQ ID NO: 92795 - protein, 10 aa, Dengue virus
QPKPGTRMIM

SEQ ID NO: 92796 - protein, 10 aa, Dengue virus
PKPGTRMIMT

SEQ ID NO: 92797 - protein, 10 aa, Dengue virus
KPGTRMIMTT

SEQ ID NO: 92798 - protein, 10 aa, Dengue virus
PGTRMIMTTT

SEQ ID NO: 92799 - protein, 10 aa, Dengue virus
GTRMIMTTTA

SEQ ID NO: 92800 - protein, 10 aa, Dengue virus
TRMIMTTTAN

SEQ ID NO: 92801 - protein, 10 aa, Dengue virus
RMIMTTTANW

SEQ ID NO: 92802 - protein, 10 aa, Dengue virus
MIMTTTANWL

SEQ ID NO: 92803 - protein, 10 aa, Dengue virus
IMTTTANWLW

SEQ ID NO: 92804 - protein, 10 aa, Dengue virus
MTTTANWLWT

SEQ ID NO: 92805 - protein, 10 aa, Dengue virus
TTTANWLWTL

SEQ ID NO: 92806 - protein, 10 aa, Dengue virus
TTANWLWTLL

SEQ ID NO: 92807 - protein, 10 aa, Dengue virus
TANWLWTLLG

SEQ ID NO: 92808 - protein, 10 aa, Dengue virus
ANWLWALLGR

SEQ ID NO: 92809 - protein, 10 aa, Dengue virus
NWLWALLGRK

SEQ ID NO: 92810 - protein, 10 aa, Dengue virus
WLWALLGRKK

SEQ ID NO: 92811 - protein, 10 aa, Dengue virus
LLGKKKSPRL

SEQ ID NO: 92812 - protein, 10 aa, Dengue virus
LGKKKSPRLC

SEQ ID NO: 92813 - protein, 10 aa, Dengue virus
GKKKSPRLCT

SEQ ID NO: 92814 - protein, 10 aa, Dengue virus
KKSPRLCTRE

SEQ ID NO: 92815 - protein, 10 aa, Dengue virus
KSPRLCTREE

SEQ ID NO: 92816 - protein, 10 aa, Dengue virus
SPRLCTREEF

SEQ ID NO: 92817 - protein, 10 aa, Dengue virus
PRLCTKEEFI

SEQ ID NO: 92818 - protein, 10 aa, Dengue virus
RLCTKEEFIS

SEQ ID NO: 92819 - protein, 10 aa, Dengue virus
LCTKEEFISK

SEQ ID NO: 92820 - protein, 10 aa, Dengue virus
CTKEEFISKV

SEQ ID NO: 92821 - protein, 10 aa, Dengue virus
TKEEFISKVR

SEQ ID NO: 92822 - protein, 10 aa, Dengue virus
KEEFISKVRS

SEQ ID NO: 92823 - protein, 10 aa, Dengue virus
GWTSASEAVS

SEQ ID NO: 92824 - protein, 10 aa, Dengue virus
WTSASEAVSD

SEQ ID NO: 92825 - protein, 10 aa, Dengue virus
TSASEAVSDS

SEQ ID NO: 92826 - protein, 10 aa, Dengue virus
SASEAVSDSR

SEQ ID NO: 92827 - protein, 10 aa, Dengue virus
ASEAVSDSRF

SEQ ID NO: 92828 - protein, 10 aa, Dengue virus
SEAVSDSRFW

SEQ ID NO: 92829 - protein, 10 aa, Dengue virus
EAVSDSRFWE

SEQ ID NO: 92830 - protein, 10 aa, Dengue virus
AVSDSRFWEL

SEQ ID NO: 92831 - protein, 10 aa, Dengue virus
VSDSRFWELV

SEQ ID NO: 92832 - protein, 10 aa, Dengue virus
SDSRFWELVD

SEQ ID NO: 92833 - protein, 10 aa, Dengue virus
FWELVDKERT

SEQ ID NO: 92834 - protein, 10 aa, Dengue virus
WKLVDKERAL

SEQ ID NO: 92835 - protein, 10 aa, Dengue virus
KLVDKERALH

SEQ ID NO: 92836 - protein, 10 aa, Dengue virus
KERALHQEGR

SEQ ID NO: 92837 - protein, 10 aa, Dengue virus
ERTLHQEGKC

SEQ ID NO: 92838 - protein, 10 aa, Dengue virus
RALHQEGRCE

SEQ ID NO: 92839 - protein, 10 aa, Dengue virus
TLHQEGKCES

SEQ ID NO: 92840 - protein, 10 aa, Dengue virus
GFLNEDHWFS

SEQ ID NO: 92841 - protein, 10 aa, Dengue virus
FLNEDHWFSR

SEQ ID NO: 92842 - protein, 10 aa, Dengue virus
LNEDHWFSRE

SEQ ID NO: 92843 - protein, 10 aa, Dengue virus
NEDHWFSREN

SEQ ID NO: 92844 - protein, 10 aa, Dengue virus
EDHWFSRENS

SEQ ID NO: 92845 - protein, 10 aa, Dengue virus
DHWFSRENSW

SEQ ID NO: 92846 - protein, 10 aa, Dengue virus
HWFSRENSWS

SEQ ID NO: 92847 - protein, 10 aa, Dengue virus
WFSRENSWSG

SEQ ID NO: 92848 - protein, 10 aa, Dengue virus
FSRENSWSGV

SEQ ID NO: 92849 - protein, 10 aa, Dengue virus
SRENSWSGVE

SEQ ID NO: 92850 - protein, 10 aa, Dengue virus
LHRLGYILED

SEQ ID NO: 92851 - protein, 10 aa, Dengue virus
HRLGYILEDI

SEQ ID NO: 92852 - protein, 10 aa, Dengue virus
RLGYILEDID

SEQ ID NO: 92853 - protein, 10 aa, Dengue virus
LGYILEDIDK

SEQ ID NO: 92854 - protein, 10 aa, Dengue virus
GYILEDIDKK

SEQ ID NO: 92855 - protein, 10 aa, Dengue virus
YILEDIDKKD

SEQ ID NO: 92856 - protein, 10 aa, Dengue virus
ILEDIDKKDG

SEQ ID NO: 92857 - protein, 10 aa, Dengue virus
LEDIDKKDGD

SEQ ID NO: 92858 - protein, 10 aa, Dengue virus
EDIDKKDGDL

SEQ ID NO: 92859 - protein, 10 aa, Dengue virus
DIDKKDGDLI

SEQ ID NO: 92860 - protein, 10 aa, Dengue virus
IDKKDGDLIY

SEQ ID NO: 92861 - protein, 10 aa, Dengue virus
DKKDGDLIYA

SEQ ID NO: 92862 - protein, 10 aa, Dengue virus
KKDGDLIYAD

SEQ ID NO: 92863 - protein, 10 aa, Dengue virus
KDGDLIYADD

SEQ ID NO: 92864 - protein, 10 aa, Dengue virus
DGDLIYADDT

SEQ ID NO: 92865 - protein, 10 aa, Dengue virus
GDLIYADDTA

SEQ ID NO: 92866 - protein, 10 aa, Dengue virus
DLIYADDTAG

SEQ ID NO: 92867 - protein, 10 aa, Dengue virus
LIYADDTAGW

SEQ ID NO: 92868 - protein, 10 aa, Dengue virus
IYADDTAGWD

SEQ ID NO: 92869 - protein, 10 aa, Dengue virus
DTRITEDDLL

SEQ ID NO: 92870 - protein, 10 aa, Dengue virus
TRITEDDLLN

SEQ ID NO: 92871 - protein, 10 aa, Dengue virus
RITEDDLLNE

SEQ ID NO: 92872 - protein, 10 aa, Dengue virus
ITEDDLLNEE

SEQ ID NO: 92873 - protein, 10 aa, Dengue virus
TEDDLLNEEL

SEQ ID NO: 92874 - protein, 10 aa, Dengue virus
EDDLLNEELI

SEQ ID NO: 92875 - protein, 10 aa, Dengue virus
DDLLNEELIT

SEQ ID NO: 92876 - protein, 10 aa, Dengue virus
DLLNEELITE

SEQ ID NO: 92877 - protein, 10 aa, Dengue virus
LLNEELITEQ

SEQ ID NO: 92878 - protein, 10 aa, Dengue virus
LNEELITEQM

SEQ ID NO: 92879 - protein, 10 aa, Dengue virus
ELITEQMAPG

SEQ ID NO: 92880 - protein, 10 aa, Dengue virus
LVTEQMAPHH

SEQ ID NO: 92881 - protein, 10 aa, Dengue virus
ITEQMAPHHR

SEQ ID NO: 92882 - protein, 10 aa, Dengue virus
TEQMAPHHKT

SEQ ID NO: 92883 - protein, 10 aa, Dengue virus
EQMAPHHKTL

SEQ ID NO: 92884 - protein, 10 aa, Dengue virus
QMAPHHKTLA

SEQ ID NO: 92885 - protein, 10 aa, Dengue virus
MAPHHKTLAK

SEQ ID NO: 92886 - protein, 10 aa, Dengue virus
APHHKTLAKA

SEQ ID NO: 92887 - protein, 10 aa, Dengue virus
PHHKTLAKAI

SEQ ID NO: 92888 - protein, 10 aa, Dengue virus
HHKTLAKAIF

SEQ ID NO: 92889 - protein, 10 aa, Dengue virus
HKTLAKAIFK

SEQ ID NO: 92890 - protein, 10 aa, Dengue virus
KTLAKAIFKL

SEQ ID NO: 92891 - protein, 10 aa, Dengue virus
TLAKAIFKLT

SEQ ID NO: 92892 - protein, 10 aa, Dengue virus
VVKVLRPTPK

SEQ ID NO: 92893 - protein, 10 aa, Dengue virus
VKVLRPTPKG

SEQ ID NO: 92894 - protein, 10 aa, Dengue virus
KVLRPTPKGA

SEQ ID NO: 92895 - protein, 10 aa, Dengue virus
VLRPTPKGAV

SEQ ID NO: 92896 - protein, 10 aa, Dengue virus
LRPTPKGAVM

SEQ ID NO: 92897 - protein, 10 aa, Dengue virus
RPTPKGAVMD

SEQ ID NO: 92898 - protein, 10 aa, Dengue virus
PTPKGAVMDI

SEQ ID NO: 92899 - protein, 10 aa, Dengue virus
TPKGAVMDII

SEQ ID NO: 92900 - protein, 10 aa, Dengue virus
PKGAVMDIIS

SEQ ID NO: 92901 - protein, 10 aa, Dengue virus
KGAVMDIISR

SEQ ID NO: 92902 - protein, 10 aa, Dengue virus
RGSGQVGTYS

SEQ ID NO: 92903 - protein, 10 aa, Dengue virus
GSGQVGTYSL

SEQ ID NO: 92904 - protein, 10 aa, Dengue virus
SGQVGTYSLN

SEQ ID NO: 92905 - protein, 10 aa, Dengue virus
GQVGTYSLNT

SEQ ID NO: 92906 - protein, 10 aa, Dengue virus
QVGTYSLNTF

SEQ ID NO: 92907 - protein, 10 aa, Dengue virus
VGTYSLNTFT

SEQ ID NO: 92908 - protein, 10 aa, Dengue virus
GTYSLNTFTN

SEQ ID NO: 92909 - protein, 10 aa, Dengue virus
TYSLNTFTNM

SEQ ID NO: 92910 - protein, 10 aa, Dengue virus
YSLNTFTNME

SEQ ID NO: 92911 - protein, 10 aa, Dengue virus
SLNTFTNMEV

SEQ ID NO: 92912 - protein, 10 aa, Dengue virus
QMEAEGVITR

SEQ ID NO: 92913 - protein, 10 aa, Dengue virus
MEAEGVITRD

SEQ ID NO: 92914 - protein, 10 aa, Dengue virus
EAEGVITRDD

SEQ ID NO: 92915 - protein, 10 aa, Dengue virus
AEGVITRDDM

SEQ ID NO: 92916 - protein, 10 aa, Dengue virus
EGVITRDDMH

SEQ ID NO: 92917 - protein, 10 aa, Dengue virus
GVITQDDMHN

SEQ ID NO: 92918 - protein, 10 aa, Dengue virus
VITQDDMHNP

SEQ ID NO: 92919 - protein, 10 aa, Dengue virus
ITRDDMHNPK

SEQ ID NO: 92920 - protein, 10 aa, Dengue virus
TRDDMHNPKG

SEQ ID NO: 92921 - protein, 10 aa, Dengue virus
QDDMHNPKGL

SEQ ID NO: 92922 - protein, 10 aa, Dengue virus
DDMHNPKGLK

SEQ ID NO: 92923 - protein, 10 aa, Dengue virus
DMHNPKGLKE

SEQ ID NO: 92924 - protein, 10 aa, Dengue virus
MHNPKGLKER

SEQ ID NO: 92925 - protein, 10 aa, Dengue virus
HNPKGLKERV

SEQ ID NO: 92926 - protein, 10 aa, Dengue virus
NPKGLRERVE

SEQ ID NO: 92927 - protein, 10 aa, Dengue virus
PKGLKERVEN

SEQ ID NO: 92928 - protein, 10 aa, Dengue virus
KGLKERVENW

SEQ ID NO: 92929 - protein, 10 aa, Dengue virus
GLKERVENWL

SEQ ID NO: 92930 - protein, 10 aa, Dengue virus
LKERVEKWLK

SEQ ID NO: 92931 - protein, 10 aa, Dengue virus
KERVEKWLKE

SEQ ID NO: 92932 - protein, 10 aa, Dengue virus
ERVEKWLKEC

SEQ ID NO: 92933 - protein, 10 aa, Dengue virus
RVEKWLKECG

SEQ ID NO: 92934 - protein, 10 aa, Dengue virus
VEKWLKECGV

SEQ ID NO: 92935 - protein, 10 aa, Dengue virus
EKWLKECGVD

SEQ ID NO: 92936 - protein, 10 aa, Dengue virus
KWLKECGVDR

SEQ ID NO: 92937 - protein, 10 aa, Dengue virus
WLKECGVDRL

SEQ ID NO: 92938 - protein, 10 aa, Dengue virus
LKECGVDRLK

SEQ ID NO: 92939 - protein, 10 aa, Dengue virus
KECGVDRLKR

SEQ ID NO: 92940 - protein, 10 aa, Dengue virus
VVKPLDERFS

SEQ ID NO: 92941 - protein, 10 aa, Dengue virus
VKPLDERFST

SEQ ID NO: 92942 - protein, 10 aa, Dengue virus
KPLDERFSTS

SEQ ID NO: 92943 - protein, 10 aa, Dengue virus
PLDERFSTSL

SEQ ID NO: 92944 - protein, 10 aa, Dengue virus
LDERFSTSLL

SEQ ID NO: 92945 - protein, 10 aa, Dengue virus
DERFSTSLLF

SEQ ID NO: 92946 - protein, 10 aa, Dengue virus
ERFSTSLLFL

SEQ ID NO: 92947 - protein, 10 aa, Dengue virus
RFSTSLLFLN

SEQ ID NO: 92948 - protein, 10 aa, Dengue virus
FSTSLLFLND

SEQ ID NO: 92949 - protein, 10 aa, Dengue virus
STSLLFLNDM

SEQ ID NO: 92950 - protein, 10 aa, Dengue virus
FCSHHFHRIF

SEQ ID NO: 92951 - protein, 10 aa, Dengue virus
CSHHFHKILM

SEQ ID NO: 92952 - protein, 10 aa, Dengue virus
SHHFHKILMK

SEQ ID NO: 92953 - protein, 10 aa, Dengue virus
HHFHRIFMKD

SEQ ID NO: 92954 - protein, 10 aa, Dengue virus
HFHKILMKDG

SEQ ID NO: 92955 - protein, 10 aa, Dengue virus
FHRIFMKDGR

SEQ ID NO: 92956 - protein, 10 aa, Dengue virus
HKILMKDGRS

SEQ ID NO: 92957 - protein, 10 aa, Dengue virus
RIFMKDGRSL

SEQ ID NO: 92958 - protein, 10 aa, Dengue virus
ISQGAGWSLK

SEQ ID NO: 92959 - protein, 10 aa, Dengue virus
SQGAGWSLKE

SEQ ID NO: 92960 - protein, 10 aa, Dengue virus
QGAGWSLKET

SEQ ID NO: 92961 - protein, 10 aa, Dengue virus
GAGWSLKETA

SEQ ID NO: 92962 - protein, 10 aa, Dengue virus
AGWSLKETAC

SEQ ID NO: 92963 - protein, 10 aa, Dengue virus
GWSLKETACL

SEQ ID NO: 92964 - protein, 10 aa, Dengue virus
WSLKETACLG

SEQ ID NO: 92965 - protein, 10 aa, Dengue virus
SLKETACLGK

SEQ ID NO: 92966 - protein, 10 aa, Dengue virus
LKETACLGKA

SEQ ID NO: 92967 - protein, 10 aa, Dengue virus
KETACLGKAY

SEQ ID NO: 92968 - protein, 10 aa, Dengue virus
ICSAVPVEWV

SEQ ID NO: 92969 - protein, 10 aa, Dengue virus
CSAVPTEWLP

SEQ ID NO: 92970 - protein, 10 aa, Dengue virus
SAVPTEWLPT

SEQ ID NO: 92971 - protein, 10 aa, Dengue virus
AVPVEWVPTS

SEQ ID NO: 92972 - protein, 10 aa, Dengue virus
VPTEWLPTSR

SEQ ID NO: 92973 - protein, 10 aa, Dengue virus
PTEWLPTSRT

SEQ ID NO: 92974 - protein, 10 aa, Dengue virus
TEWLPTSRTT

SEQ ID NO: 92975 - protein, 10 aa, Dengue virus
EWLPTSRTTW

SEQ ID NO: 92976 - protein, 10 aa, Dengue virus
WVPTSRTTWS

SEQ ID NO: 92977 - protein, 10 aa, Dengue virus
LPTSRTTWSI

SEQ ID NO: 92978 - protein, 10 aa, Dengue virus
VWIEDNPNMT

SEQ ID NO: 92979 - protein, 10 aa, Dengue virus
WIEDNPNMTD

SEQ ID NO: 92980 - protein, 10 aa, Dengue virus
IEDNPNMTDK

SEQ ID NO: 92981 - protein, 10 aa, Dengue virus
EDNPNMTDKT

SEQ ID NO: 92982 - protein, 10 aa, Dengue virus
DNPNMTDKTP

SEQ ID NO: 92983 - protein, 10 aa, Dengue virus
NPNMTDKTPV

SEQ ID NO: 92984 - protein, 10 aa, Dengue virus
PNMTDKTPVH

SEQ ID NO: 92985 - protein, 10 aa, Dengue virus
NMTDKTPVHS

SEQ ID NO: 92986 - protein, 10 aa, Dengue virus
MTDKTPVHSW

SEQ ID NO: 92987 - protein, 10 aa, Dengue virus
TDKTPVHSWE

SEQ ID NO: 92988 - protein, 10 aa, Dengue virus
DKTPIHSWED

SEQ ID NO: 92989 - protein, 10 aa, Dengue virus
KTPIHSWEDI

SEQ ID NO: 92990 - protein, 10 aa, Dengue virus
TPIHSWEDIP

SEQ ID NO: 92991 - protein, 10 aa, Dengue virus
PIHSWEDIPY

SEQ ID NO: 92992 - protein, 10 aa, Dengue virus
IHSWEDIPYL

SEQ ID NO: 92993 - protein, 10 aa, Dengue virus
HSWEDVPYLG

SEQ ID NO: 92994 - protein, 10 aa, Dengue virus
SWEDVPYLGK

SEQ ID NO: 92995 - protein, 10 aa, Dengue virus
WEDVPYLGKR

SEQ ID NO: 92996 - protein, 10 aa, Dengue virus
EDVPYLGKRE

SEQ ID NO: 92997 - protein, 10 aa, Dengue virus
DVPYLGKRED

SEQ ID NO: 92998 - protein, 10 aa, Dengue virus
VPYLGKREDL

SEQ ID NO: 92999 - protein, 10 aa, Dengue virus
SRATWAKNIQ

SEQ ID NO: 93000 - protein, 10 aa, Dengue virus
RATWAKNIQT

SEQ ID NO: 93001 - protein, 10 aa, Dengue virus
ATWAKNIQTA

SEQ ID NO: 93002 - protein, 10 aa, Dengue virus
TWAKNIQTAI

SEQ ID NO: 93003 - protein, 10 aa, Dengue virus
WAKNIHTAIA

SEQ ID NO: 93004 - protein, 10 aa, Dengue virus
AKNIQTAITQ

SEQ ID NO: 93005 - protein, 10 aa, Dengue virus
KNIQTAITQV

SEQ ID NO: 93006 - protein, 10 aa, Dengue virus
NIHTAIAQVR

SEQ ID NO: 93007 - protein, 10 aa, Dengue virus
IHTAIAQVRN

SEQ ID NO: 93008 - protein, 10 aa, Dengue virus
QTAITQVRNL

SEQ ID NO: 93009 - protein, 10 aa, Dengue virus
TAIAQVRNLI

SEQ ID NO: 93010 - protein, 10 aa, Dengue virus
AIAQVRNLIG

SEQ ID NO: 93011 - protein, 10 aa, Dengue virus
IAQVRNLIGK

SEQ ID NO: 93012 - protein, 10 aa, Dengue virus
AQVRNLIGKE

SEQ ID NO: 93013 - protein, 10 aa, Dengue virus
RNLIGKEEYA

SEQ ID NO: 93014 - protein, 10 aa, Dengue virus
NLIGKEEYMD

SEQ ID NO: 93015 - protein, 10 aa, Dengue virus
LIGKEEYADY

SEQ ID NO: 93016 - protein, 10 aa, Dengue virus
IGKEEYADYM

SEQ ID NO: 93017 - protein, 10 aa, Dengue virus
GKEEYADYMP

SEQ ID NO: 93018 - protein, 10 aa, Dengue virus
KEEYVDYMPA

SEQ ID NO: 93019 - protein, 10 aa, Dengue virus
EEYVDYMPAM

SEQ ID NO: 93020 - protein, 10 aa, Dengue virus
EYVDYMPAMK

SEQ ID NO: 93021 - protein, 10 aa, Dengue virus
YVDYMPAMKR

SEQ ID NO: 93022 - protein, 10 aa, Dengue virus
VDYMPAMKRY

SEQ ID NO: 93023 - protein, 10 aa, Dengue virus
DYMPAMKRYS

SEQ ID NO: 93024 - protein, 10 aa, Dengue virus
YMPAMKRYSA

SEQ ID NO: 93025 - protein, 10 aa, Dengue virus
MPAMKRYSAP

SEQ ID NO: 93026 - protein, 10 aa, Dengue virus
RYSAPFESEG

SEQ ID NO: 93027 - protein, 10 aa, Dengue virus
YSAPFESEGV

SEQ ID NO: 93028 - protein, 10 aa, Dengue virus
SAPFESEGVL

SEQ ID NO: 93029 - protein, 10 aa, Dengue virus
NNQRKKARNT

SEQ ID NO: 93030 - protein, 10 aa, Dengue virus
NQRKKARNTP

SEQ ID NO: 93031 - protein, 10 aa, Dengue virus
QRKKARNTPF

SEQ ID NO: 93032 - protein, 10 aa, Dengue virus
RKKARNTPFN

SEQ ID NO: 93033 - protein, 10 aa, Dengue virus
KKARNTPFNM

SEQ ID NO: 93034 - protein, 10 aa, Dengue virus
KARNTPFNML

SEQ ID NO: 93035 - protein, 10 aa, Dengue virus
ARNTPFNMLK

SEQ ID NO: 93036 - protein, 10 aa, Dengue virus
RNTPFNMLKR

SEQ ID NO: 93037 - protein, 10 aa, Dengue virus
VQQLTKRFSL

SEQ ID NO: 93038 - protein, 10 aa, Dengue virus
QGLVKRFSIG

SEQ ID NO: 93039 - protein, 10 aa, Dengue virus
QLTKRFSLGM

SEQ ID NO: 93040 - protein, 10 aa, Dengue virus
LVKRFSIGLF

SEQ ID NO: 93041 - protein, 10 aa, Dengue virus
VKRFSIGLFS

SEQ ID NO: 93042 - protein, 10 aa, Dengue virus
KRFSIGLFSG

SEQ ID NO: 93043 - protein, 10 aa, Dengue virus
RFSIGLFSGK

SEQ ID NO: 93044 - protein, 10 aa, Dengue virus
FSIGLFSGKG

SEQ ID NO: 93045 - protein, 10 aa, Dengue virus
SLGMLQGRGP

SEQ ID NO: 93046 - protein, 10 aa, Dengue virus
LGMLQGRGPL

SEQ ID NO: 93047 - protein, 10 aa, Dengue virus
LKRWGQLKKT

SEQ ID NO: 93048 - protein, 10 aa, Dengue virus
KRWGQLKKTK

SEQ ID NO: 93049 - protein, 10 aa, Dengue virus
RWGQLKKTKA

SEQ ID NO: 93050 - protein, 10 aa, Dengue virus
WGTIKKSKAI

SEQ ID NO: 93051 - protein, 10 aa, Dengue virus
GQLKKTKAIK

SEQ ID NO: 93052 - protein, 10 aa, Dengue virus
QLKKTKAIKI

SEQ ID NO: 93053 - protein, 10 aa, Dengue virus
IKKSKAINVL

SEQ ID NO: 93054 - protein, 10 aa, Dengue virus
KKNKAIRILI

SEQ ID NO: 93055 - protein, 10 aa, Dengue virus
KNKAIRILIG

SEQ ID NO: 93056 - protein, 10 aa, Dengue virus
NKAIRILIGF

SEQ ID NO: 93057 - protein, 10 aa, Dengue virus
KAIRILIGFR

SEQ ID NO: 93058 - protein, 10 aa, Dengue virus
AIRILIGFRK

SEQ ID NO: 93059 - protein, 10 aa, Dengue virus
IRILIGFRKE

SEQ ID NO: 93060 - protein, 10 aa, Dengue virus
RILIGFRKEI

SEQ ID NO: 93061 - protein, 10 aa, Dengue virus
VLRGFRKEIG

SEQ ID NO: 93062 - protein, 10 aa, Dengue virus
LRGFRKEIGR

SEQ ID NO: 93063 - protein, 10 aa, Dengue virus
RGFRKEIGRM

SEQ ID NO: 93064 - protein, 10 aa, Dengue virus
RMLNILNGRR

SEQ ID NO: 93065 - protein, 10 aa, Dengue virus
MLNILNRRKR

SEQ ID NO: 93066 - protein, 10 aa, Dengue virus
LNILNGRRRS

SEQ ID NO: 93067 - protein, 10 aa, Dengue virus
NILNGRRRST

SEQ ID NO: 93068 - protein, 10 aa, Dengue virus
RRRSTMTLLC

SEQ ID NO: 93069 - protein, 10 aa, Dengue virus
RRSTMTLLCL

SEQ ID NO: 93070 - protein, 10 aa, Dengue virus
RSTVTLLCLI

SEQ ID NO: 93071 - protein, 10 aa, Dengue virus
STVTLLCLIP

SEQ ID NO: 93072 - protein, 10 aa, Dengue virus
TVTLLCLIPT

SEQ ID NO: 93073 - protein, 10 aa, Dengue virus
TLLCLIPTIM

SEQ ID NO: 93074 - protein, 10 aa, Dengue virus
LLCLIPTIMA

SEQ ID NO: 93075 - protein, 10 aa, Dengue virus
LCLIPTIMAF

SEQ ID NO: 93076 - protein, 10 aa, Dengue virus
CLIPTVMAFS

SEQ ID NO: 93077 - protein, 10 aa, Dengue virus
LIPTVMAFSL

SEQ ID NO: 93078 - protein, 10 aa, Dengue virus
IPTVMAFSLS

SEQ ID NO: 93079 - protein, 10 aa, Dengue virus
PTVMAFSLST

SEQ ID NO: 93080 - protein, 10 aa, Dengue virus
TVMAFSLSTR

SEQ ID NO: 93081 - protein, 10 aa, Dengue virus
VMAFSLSTRD

SEQ ID NO: 93082 - protein, 10 aa, Dengue virus
MAFHLTTRNG

SEQ ID NO: 93083 - protein, 10 aa, Dengue virus
AFHLTTRNGE

SEQ ID NO: 93084 - protein, 10 aa, Dengue virus
FHLTTRNGEP

SEQ ID NO: 93085 - protein, 10 aa, Dengue virus
HLTTRNGEPH

SEQ ID NO: 93086 - protein, 10 aa, Dengue virus
DGEPLMIVAR

SEQ ID NO: 93087 - protein, 10 aa, Dengue virus
GEPLMIVGKH

SEQ ID NO: 93088 - protein, 10 aa, Dengue virus
EPLMIVGKHE

SEQ ID NO: 93089 - protein, 10 aa, Dengue virus
PLMIVARHER

SEQ ID NO: 93090 - protein, 10 aa, Dengue virus
LMIVARHERG

SEQ ID NO: 93091 - protein, 10 aa, Dengue virus
MIVARHERGR

SEQ ID NO: 93092 - protein, 10 aa, Dengue virus
IVGKHERGRP

SEQ ID NO: 93093 - protein, 10 aa, Dengue virus
VGKHERGRPL

SEQ ID NO: 93094 - protein, 10 aa, Dengue virus
GKHERGRPLL

SEQ ID NO: 93095 - protein, 10 aa, Dengue virus
LFKTTEGTNK

SEQ ID NO: 93096 - protein, 10 aa, Dengue virus
FKTTEGTNKC

SEQ ID NO: 93097 - protein, 10 aa, Dengue virus
KTTEGINRCT

SEQ ID NO: 93098 - protein, 10 aa, Dengue virus
TTEGTNKCTL

SEQ ID NO: 93099 - protein, 10 aa, Dengue virus
TEGINRCTLI

SEQ ID NO: 93100 - protein, 10 aa, Dengue virus
EGTNKCTLIA

SEQ ID NO: 93101 - protein, 10 aa, Dengue virus
GINRCTLIAM

SEQ ID NO: 93102 - protein, 10 aa, Dengue virus
INRCTLIAMD

SEQ ID NO: 93103 - protein, 10 aa, Dengue virus
EMCEDTVTYE

SEQ ID NO: 93104 - protein, 10 aa, Dengue virus
MCEDTVTYEC

SEQ ID NO: 93105 - protein, 10 aa, Dengue virus
CEDTITYKCP

SEQ ID NO: 93106 - protein, 10 aa, Dengue virus
EDTVTYECPL

SEQ ID NO: 93107 - protein, 10 aa, Dengue virus
DTVTYECPLL

SEQ ID NO: 93108 - protein, 10 aa, Dengue virus
TITYKCPLLR

SEQ ID NO: 93109 - protein, 10 aa, Dengue virus
VTYECPLLVN

SEQ ID NO: 93110 - protein, 10 aa, Dengue virus
TYECPLLVNT

SEQ ID NO: 93111 - protein, 10 aa, Dengue virus
YKCPLLRQNE

SEQ ID NO: 93112 - protein, 10 aa, Dengue virus
ECPLLVNTEP

SEQ ID NO: 93113 - protein, 10 aa, Dengue virus
CPLLRQNEPE

SEQ ID NO: 93114 - protein, 10 aa, Dengue virus
PLLRQNEPED

SEQ ID NO: 93115 - protein, 10 aa, Dengue virus
LLRQNEPEDI

SEQ ID NO: 93116 - protein, 10 aa, Dengue virus
LRQNEPEDID

SEQ ID NO: 93117 - protein, 10 aa, Dengue virus
RQNEPEDIDC

SEQ ID NO: 93118 - protein, 10 aa, Dengue virus
IDCWCNSTST

SEQ ID NO: 93119 - protein, 10 aa, Dengue virus
DCWCNSTSTW

SEQ ID NO: 93120 - protein, 10 aa, Dengue virus
CWCNSTSTWV

SEQ ID NO: 93121 - protein, 10 aa, Dengue virus
WCNSTSTWVT

SEQ ID NO: 93122 - protein, 10 aa, Dengue virus
CNSTSTWVTY

SEQ ID NO: 93123 - protein, 10 aa, Dengue virus
NSTSTWVTYG

SEQ ID NO: 93124 - protein, 10 aa, Dengue virus
STSTWVTYGT

SEQ ID NO: 93125 - protein, 10 aa, Dengue virus
TSTWVTYGTC

SEQ ID NO: 93126 - protein, 10 aa, Dengue virus
STWVTYGTCT

SEQ ID NO: 93127 - protein, 10 aa, Dengue virus
TWVTYGTCTT

SEQ ID NO: 93128 - protein, 10 aa, Dengue virus
WVTYGTCTTT

SEQ ID NO: 93129 - protein, 10 aa, Dengue virus
VTYGTCTTTG

SEQ ID NO: 93130 - protein, 10 aa, Dengue virus
TYGTCTTTGE

SEQ ID NO: 93131 - protein, 10 aa, Dengue virus
YGTCTTTGEH

SEQ ID NO: 93132 - protein, 10 aa, Dengue virus
GTCTTTGEHR

SEQ ID NO: 93133 - protein, 10 aa, Dengue virus
TCTTTGEHRR

SEQ ID NO: 93134 - protein, 10 aa, Dengue virus
CTTTGEHRRE

SEQ ID NO: 93135 - protein, 10 aa, Dengue virus
TTTGEHRREK

SEQ ID NO: 93136 - protein, 10 aa, Dengue virus
TTGEHRREKR

SEQ ID NO: 93137 - protein, 10 aa, Dengue virus
TGEHRREKRS

SEQ ID NO: 93138 - protein, 10 aa, Dengue virus
LLAGFMAYMV

SEQ ID NO: 93139 - protein, 10 aa, Dengue virus
MAAILAYTIG

SEQ ID NO: 93140 - protein, 10 aa, Dengue virus
AAILAYTIGT

SEQ ID NO: 93141 - protein, 10 aa, Dengue virus
AILAYTIGTT

SEQ ID NO: 93142 - protein, 10 aa, Dengue virus
FMAYMVGQTG

SEQ ID NO: 93143 - protein, 10 aa, Dengue virus
LAYTIGTTHF

SEQ ID NO: 93144 - protein, 10 aa, Dengue virus
AYTIGTTHFQ

SEQ ID NO: 93145 - protein, 10 aa, Dengue virus
YMVGQTGIQR

SEQ ID NO: 93146 - protein, 10 aa, Dengue virus
MVGQTGIQRT

SEQ ID NO: 93147 - protein, 10 aa, Dengue virus
VGQTGIQRTV

SEQ ID NO: 93148 - protein, 10 aa, Dengue virus
GQTGIQRTIF

SEQ ID NO: 93149 - protein, 10 aa, Dengue virus
QTGIQRAVFF

SEQ ID NO: 93150 - protein, 10 aa, Dengue virus
THFQRALIFI

SEQ ID NO: 93151 - protein, 10 aa, Dengue virus
HFQRALIFIL

SEQ ID NO: 93152 - protein, 10 aa, Dengue virus
FQRALIFILL

SEQ ID NO: 93153 - protein, 10 aa, Dengue virus
QRALIFILLT

SEQ ID NO: 93154 - protein, 10 aa, Dengue virus
RALIFILLTA

SEQ ID NO: 93155 - protein, 10 aa, Dengue virus
ALIFILLTAV

SEQ ID NO: 93156 - protein, 10 aa, Dengue virus
LIFILLTAVA

SEQ ID NO: 93157 - protein, 10 aa, Dengue virus
IFILLTAVAP

SEQ ID NO: 93158 - protein, 10 aa, Dengue virus
FILLTAVAPS

SEQ ID NO: 93159 - protein, 10 aa, Dengue virus
ILLTAVAPSM

SEQ ID NO: 93160 - protein, 10 aa, Dengue virus
VAPSYGMRCI

SEQ ID NO: 93161 - protein, 10 aa, Dengue virus
APSMTMRCIG

SEQ ID NO: 93162 - protein, 10 aa, Dengue virus
PSMTMRCIGI

SEQ ID NO: 93163 - protein, 10 aa, Dengue virus
SYGMRCIGVG

SEQ ID NO: 93164 - protein, 10 aa, Dengue virus
YGMRCIGVGN

SEQ ID NO: 93165 - protein, 10 aa, Dengue virus
TMRCIGISNR

SEQ ID NO: 93166 - protein, 10 aa, Dengue virus
MRCIGVGNRD

SEQ ID NO: 93167 - protein, 10 aa, Dengue virus
RCIGVGNRDF

SEQ ID NO: 93168 - protein, 10 aa, Dengue virus
CIGISNRDFV

SEQ ID NO: 93169 - protein, 10 aa, Dengue virus
IGISNRDFVE

SEQ ID NO: 93170 - protein, 10 aa, Dengue virus
DFVEGVSGGV

SEQ ID NO: 93171 - protein, 10 aa, Dengue virus
FVEGVSGGVW

SEQ ID NO: 93172 - protein, 10 aa, Dengue virus
VEGVSGGTWV

SEQ ID NO: 93173 - protein, 10 aa, Dengue virus
EGVSGGTWVD

SEQ ID NO: 93174 - protein, 10 aa, Dengue virus
GVSGGTWVDL

SEQ ID NO: 93175 - protein, 10 aa, Dengue virus
VSGGTWVDLV

SEQ ID NO: 93176 - protein, 10 aa, Dengue virus
SGGVWVDLVL

SEQ ID NO: 93177 - protein, 10 aa, Dengue virus
GGVWVDLVLE

SEQ ID NO: 93178 - protein, 10 aa, Dengue virus
GVWVDLVLEH

SEQ ID NO: 93179 - protein, 10 aa, Dengue virus
VWVDLVLEHG

SEQ ID NO: 93180 - protein, 10 aa, Dengue virus
NKPTLDFELI

SEQ ID NO: 93181 - protein, 10 aa, Dengue virus
TLDFELIKTE

SEQ ID NO: 93182 - protein, 10 aa, Dengue virus
LDFELIKTEA

SEQ ID NO: 93183 - protein, 10 aa, Dengue virus
DFELIKTEAK

SEQ ID NO: 93184 - protein, 10 aa, Dengue virus
FELIKTEAKQ

SEQ ID NO: 93185 - protein, 10 aa, Dengue virus
ELIKTEAKQP

SEQ ID NO: 93186 - protein, 10 aa, Dengue virus
LIKTEAKQPA

SEQ ID NO: 93187 - protein, 10 aa, Dengue virus
IKTEAKQPAT

SEQ ID NO: 93188 - protein, 10 aa, Dengue virus
TLRKYCIEAK

SEQ ID NO: 93189 - protein, 10 aa, Dengue virus
LRKYCIEAKL

SEQ ID NO: 93190 - protein, 10 aa, Dengue virus
RKYCIEAKLT

SEQ ID NO: 93191 - protein, 10 aa, Dengue virus
KYCIEAKLTN

SEQ ID NO: 93192 - protein, 10 aa, Dengue virus
YCIEAKLTNT

SEQ ID NO: 93193 - protein, 10 aa, Dengue virus
CIEAKLTNTT

SEQ ID NO: 93194 - protein, 10 aa, Dengue virus
IEAKLTNTTT

SEQ ID NO: 93195 - protein, 10 aa, Dengue virus
EAKLTNTTTE

SEQ ID NO: 93196 - protein, 10 aa, Dengue virus
AKLTNTTTES

SEQ ID NO: 93197 - protein, 10 aa, Dengue virus
KLTNTTTESR

SEQ ID NO: 93198 - protein, 10 aa, Dengue virus
QDRQYICRRD

SEQ ID NO: 93199 - protein, 10 aa, Dengue virus
DQQYICRRDM

SEQ ID NO: 93200 - protein, 10 aa, Dengue virus
KRFVCKHSMV

SEQ ID NO: 93201 - protein, 10 aa, Dengue virus
QYICRRDMVD

SEQ ID NO: 93202 - protein, 10 aa, Dengue virus
FVCKHSMVDR

SEQ ID NO: 93203 - protein, 10 aa, Dengue virus
VCKHSMVDRG

SEQ ID NO: 93204 - protein, 10 aa, Dengue virus
CRRDMVDRGW

SEQ ID NO: 93205 - protein, 10 aa, Dengue virus
RRDMVDRGWG

SEQ ID NO: 93206 - protein, 10 aa, Dengue virus
RDMVDRGWGN

SEQ ID NO: 93207 - protein, 10 aa, Dengue virus
DMVDRGWGNG

SEQ ID NO: 93208 - protein, 10 aa, Dengue virus
GGIVTCAMFT

SEQ ID NO: 93209 - protein, 10 aa, Dengue virus
GIVTCAMFTC

SEQ ID NO: 93210 - protein, 10 aa, Dengue virus
IVTCAMFTCK

SEQ ID NO: 93211 - protein, 10 aa, Dengue virus
VTCAMFTCKK

SEQ ID NO: 93212 - protein, 10 aa, Dengue virus
TCAMFTCKKN

SEQ ID NO: 93213 - protein, 10 aa, Dengue virus
CAMFTCKKNM

SEQ ID NO: 93214 - protein, 10 aa, Dengue virus
AMFTCKKNME

SEQ ID NO: 93215 - protein, 10 aa, Dengue virus
MFTCKKNMEG

SEQ ID NO: 93216 - protein, 10 aa, Dengue virus
FTCKKNMEGK

SEQ ID NO: 93217 - protein, 10 aa, Dengue virus
TCKKNMEGKV

SEQ ID NO: 93218 - protein, 10 aa, Dengue virus
GEEHAVGNDT

SEQ ID NO: 93219 - protein, 10 aa, Dengue virus
DTHAVGNDIP

SEQ ID NO: 93220 - protein, 10 aa, Dengue virus
THAVGNDIPN

SEQ ID NO: 93221 - protein, 10 aa, Dengue virus
HAVGNDTGKH

SEQ ID NO: 93222 - protein, 10 aa, Dengue virus
AVGNDIPNHG

SEQ ID NO: 93223 - protein, 10 aa, Dengue virus
VGNDTGKHGK

SEQ ID NO: 93224 - protein, 10 aa, Dengue virus
GNDIPNHGVT

SEQ ID NO: 93225 - protein, 10 aa, Dengue virus
NDIPNHGVTA

SEQ ID NO: 93226 - protein, 10 aa, Dengue virus
DTSNHGVTTT

SEQ ID NO: 93227 - protein, 10 aa, Dengue virus
TSNHGVTTTI

SEQ ID NO: 93228 - protein, 10 aa, Dengue virus
SNHGVTTTIT

SEQ ID NO: 93229 - protein, 10 aa, Dengue virus
NHGVTTTITP

SEQ ID NO: 93230 - protein, 10 aa, Dengue virus
HGVTTTITPR

SEQ ID NO: 93231 - protein, 10 aa, Dengue virus
GVTTTITPRS

SEQ ID NO: 93232 - protein, 10 aa, Dengue virus
VTTTITPRSP

SEQ ID NO: 93233 - protein, 10 aa, Dengue virus
TTTITPRSPS

SEQ ID NO: 93234 - protein, 10 aa, Dengue virus
TTITPRSPSV

SEQ ID NO: 93235 - protein, 10 aa, Dengue virus
KITPQSSITE

SEQ ID NO: 93236 - protein, 10 aa, Dengue virus
ITPQSSITEA

SEQ ID NO: 93237 - protein, 10 aa, Dengue virus
TPRSPSVEVE

SEQ ID NO: 93238 - protein, 10 aa, Dengue virus
PQSSITEAEL

SEQ ID NO: 93239 - protein, 10 aa, Dengue virus
RSPSVEVELP

SEQ ID NO: 93240 - protein, 10 aa, Dengue virus
SPSVEVELPD

SEQ ID NO: 93241 - protein, 10 aa, Dengue virus
SITEAELTGY

SEQ ID NO: 93242 - protein, 10 aa, Dengue virus
SVEVELPDYG

SEQ ID NO: 93243 - protein, 10 aa, Dengue virus
TEAELTGYGT

SEQ ID NO: 93244 - protein, 10 aa, Dengue virus
EAELTGYGTV

SEQ ID NO: 93245 - protein, 10 aa, Dengue virus
VELPDYGELS

SEQ ID NO: 93246 - protein, 10 aa, Dengue virus
ELPDYGELSL

SEQ ID NO: 93247 - protein, 10 aa, Dengue virus
LPDYGELSLD

SEQ ID NO: 93248 - protein, 10 aa, Dengue virus
PDYGELSLDC

SEQ ID NO: 93249 - protein, 10 aa, Dengue virus
GYGTVTMECS

SEQ ID NO: 93250 - protein, 10 aa, Dengue virus
YGELSLDCEP

SEQ ID NO: 93251 - protein, 10 aa, Dengue virus
GELSLDCEPR

SEQ ID NO: 93252 - protein, 10 aa, Dengue virus
TVTMECSPRT

SEQ ID NO: 93253 - protein, 10 aa, Dengue virus
VTMECSPRTG

SEQ ID NO: 93254 - protein, 10 aa, Dengue virus
TMECSPRTGL

SEQ ID NO: 93255 - protein, 10 aa, Dengue virus
IDFNEMILMR

SEQ ID NO: 93256 - protein, 10 aa, Dengue virus
DFNEMVLLQM

SEQ ID NO: 93257 - protein, 10 aa, Dengue virus
FNEMILMKME

SEQ ID NO: 93258 - protein, 10 aa, Dengue virus
MENKAWLVHR

SEQ ID NO: 93259 - protein, 10 aa, Dengue virus
KTKTWLVHKQ

SEQ ID NO: 93260 - protein, 10 aa, Dengue virus
TKTWLVHKQW

SEQ ID NO: 93261 - protein, 10 aa, Dengue virus
WFLDLPLPWL

SEQ ID NO: 93262 - protein, 10 aa, Dengue virus
FLDLPLPWAA

SEQ ID NO: 93263 - protein, 10 aa, Dengue virus
LDLPLPWAAG

SEQ ID NO: 93264 - protein, 10 aa, Dengue virus
DLPLPWAAGA

SEQ ID NO: 93265 - protein, 10 aa, Dengue virus
LPLPWAAGAD

SEQ ID NO: 93266 - protein, 10 aa, Dengue virus
PLPWAAGADT

SEQ ID NO: 93267 - protein, 10 aa, Dengue virus
LPWAAGADTS

SEQ ID NO: 93268 - protein, 10 aa, Dengue virus
PWAAGADTSE

SEQ ID NO: 93269 - protein, 10 aa, Dengue virus
WAAGADTSEV

SEQ ID NO: 93270 - protein, 10 aa, Dengue virus
AAGADTSEVH

SEQ ID NO: 93271 - protein, 10 aa, Dengue virus
PGADTQGSNW

SEQ ID NO: 93272 - protein, 10 aa, Dengue virus
GADTLEVHWN

SEQ ID NO: 93273 - protein, 10 aa, Dengue virus
ADTLEVHWNH

SEQ ID NO: 93274 - protein, 10 aa, Dengue virus
DTLEVHWNHK

SEQ ID NO: 93275 - protein, 10 aa, Dengue virus
TQGSNWIQKE

SEQ ID NO: 93276 - protein, 10 aa, Dengue virus
QGSNWIQKET

SEQ ID NO: 93277 - protein, 10 aa, Dengue virus
GSNWIQKETL

SEQ ID NO: 93278 - protein, 10 aa, Dengue virus
SNWIQKETLV

SEQ ID NO: 93279 - protein, 10 aa, Dengue virus
NWIQKETLVT

SEQ ID NO: 93280 - protein, 10 aa, Dengue virus
WIQKETLVTF

SEQ ID NO: 93281 - protein, 10 aa, Dengue virus
IQKETLVTFK

SEQ ID NO: 93282 - protein, 10 aa, Dengue virus
QKETLVTFKN

SEQ ID NO: 93283 - protein, 10 aa, Dengue virus
QEGAMHTALT

SEQ ID NO: 93284 - protein, 10 aa, Dengue virus
EGAMHTALTG

SEQ ID NO: 93285 - protein, 10 aa, Dengue virus
GAMHTALTGA

SEQ ID NO: 93286 - protein, 10 aa, Dengue virus
AMHTALTGAT

SEQ ID NO: 93287 - protein, 10 aa, Dengue virus
MHTALTGATE

SEQ ID NO: 93288 - protein, 10 aa, Dengue virus
HTALTGATEI

SEQ ID NO: 93289 - protein, 10 aa, Dengue virus
TALTGATEIQ

SEQ ID NO: 93290 - protein, 10 aa, Dengue virus
ALTGATEIQM

SEQ ID NO: 93291 - protein, 10 aa, Dengue virus
LTGATEIQMS

SEQ ID NO: 93292 - protein, 10 aa, Dengue virus
TGATEIQMSS

SEQ ID NO: 93293 - protein, 10 aa, Dengue virus
HLKCKIRMEK

SEQ ID NO: 93294 - protein, 10 aa, Dengue virus
LKCKVRMERL

SEQ ID NO: 93295 - protein, 10 aa, Dengue virus
KCKIRMEKLR

SEQ ID NO: 93296 - protein, 10 aa, Dengue virus
CKIRMEKLRI

SEQ ID NO: 93297 - protein, 10 aa, Dengue virus
KIRMEKLRIK

SEQ ID NO: 93298 - protein, 10 aa, Dengue virus
IRMEKLRIKG

SEQ ID NO: 93299 - protein, 10 aa, Dengue virus
RMERLRIKGM

SEQ ID NO: 93300 - protein, 10 aa, Dengue virus
MEKLRIKGIS

SEQ ID NO: 93301 - protein, 10 aa, Dengue virus
EKLRIKGISY

SEQ ID NO: 93302 - protein, 10 aa, Dengue virus
RLRIKGMSYT

SEQ ID NO: 93303 - protein, 10 aa, Dengue virus
MCTGKFKVVK

SEQ ID NO: 93304 - protein, 10 aa, Dengue virus
CTGKFKVVKE

SEQ ID NO: 93305 - protein, 10 aa, Dengue virus
SGKFSIDREM

SEQ ID NO: 93306 - protein, 10 aa, Dengue virus
GKFKVVKEIA

SEQ ID NO: 93307 - protein, 10 aa, Dengue virus
KFSIDREMAE

SEQ ID NO: 93308 - protein, 10 aa, Dengue virus
FSIDREMAET

SEQ ID NO: 93309 - protein, 10 aa, Dengue virus
SIDREMAETQ

SEQ ID NO: 93310 - protein, 10 aa, Dengue virus
VVKEIAETQH

SEQ ID NO: 93311 - protein, 10 aa, Dengue virus
VKEIAETQHG

SEQ ID NO: 93312 - protein, 10 aa, Dengue virus
REMAETQHGT

SEQ ID NO: 93313 - protein, 10 aa, Dengue virus
AETQHGTTVI

SEQ ID NO: 93314 - protein, 10 aa, Dengue virus
ETQHGTTVIK

SEQ ID NO: 93315 - protein, 10 aa, Dengue virus
TQHGTAVVKV

SEQ ID NO: 93316 - protein, 10 aa, Dengue virus
QHGTAVVKVK

SEQ ID NO: 93317 - protein, 10 aa, Dengue virus
HGTTVIKVKY

SEQ ID NO: 93318 - protein, 10 aa, Dengue virus
GTAVVKVKYE

SEQ ID NO: 93319 - protein, 10 aa, Dengue virus
TTVIKVKYEG

SEQ ID NO: 93320 - protein, 10 aa, Dengue virus
IVIRVQYEGD

SEQ ID NO: 93321 - protein, 10 aa, Dengue virus
VIRVQYEGDG

SEQ ID NO: 93322 - protein, 10 aa, Dengue virus
IRVQYEGDGS

SEQ ID NO: 93323 - protein, 10 aa, Dengue virus
RVQYEGDGSP

SEQ ID NO: 93324 - protein, 10 aa, Dengue virus
VQYEGDGSPC

SEQ ID NO: 93325 - protein, 10 aa, Dengue virus
QYEGDGSPCK

SEQ ID NO: 93326 - protein, 10 aa, Dengue virus
YEGAGAPCKI

SEQ ID NO: 93327 - protein, 10 aa, Dengue virus
EGDGSPCKIP

SEQ ID NO: 93328 - protein, 10 aa, Dengue virus
GAGAPCKIPI

SEQ ID NO: 93329 - protein, 10 aa, Dengue virus
DGSPCKIPFE

SEQ ID NO: 93330 - protein, 10 aa, Dengue virus
GSPCKIPFEI

SEQ ID NO: 93331 - protein, 10 aa, Dengue virus
APCKIPIEIR

SEQ ID NO: 93332 - protein, 10 aa, Dengue virus
PCKIPFEIMD

SEQ ID NO: 93333 - protein, 10 aa, Dengue virus
CKIPIEIRDV

SEQ ID NO: 93334 - protein, 10 aa, Dengue virus
KIPIEIRDVN

SEQ ID NO: 93335 - protein, 10 aa, Dengue virus
IPFEIMDLEK

SEQ ID NO: 93336 - protein, 10 aa, Dengue virus
PFEIMDLEKR

SEQ ID NO: 93337 - protein, 10 aa, Dengue virus
FEIMDLEKRH

SEQ ID NO: 93338 - protein, 10 aa, Dengue virus
EIMDLEKRHV

SEQ ID NO: 93339 - protein, 10 aa, Dengue virus
IRDVNKEKVI

SEQ ID NO: 93340 - protein, 10 aa, Dengue virus
RDVNKEKVIG

SEQ ID NO: 93341 - protein, 10 aa, Dengue virus
DVNKEKVIGR

SEQ ID NO: 93342 - protein, 10 aa, Dengue virus
AENTNSATNI

SEQ ID NO: 93343 - protein, 10 aa, Dengue virus
ENTNSATNIE

SEQ ID NO: 93344 - protein, 10 aa, Dengue virus
STNSVTNIEL

SEQ ID NO: 93345 - protein, 10 aa, Dengue virus
KDSPVNIEAE

SEQ ID NO: 93346 - protein, 10 aa, Dengue virus
DSPVNIEAEP

SEQ ID NO: 93347 - protein, 10 aa, Dengue virus
SPVNIEAEPP

SEQ ID NO: 93348 - protein, 10 aa, Dengue virus
PVNIEAEPPF

SEQ ID NO: 93349 - protein, 10 aa, Dengue virus
EPPFGDSYIM

SEQ ID NO: 93350 - protein, 10 aa, Dengue virus
PPFGDSYIMI

SEQ ID NO: 93351 - protein, 10 aa, Dengue virus
PFGDSYIMIG

SEQ ID NO: 93352 - protein, 10 aa, Dengue virus
FGDSYIMIGV

SEQ ID NO: 93353 - protein, 10 aa, Dengue virus
GDSYIIIGVE

SEQ ID NO: 93354 - protein, 10 aa, Dengue virus
DSYIIIGVEP

SEQ ID NO: 93355 - protein, 10 aa, Dengue virus
SYIIIGVEPG

SEQ ID NO: 93356 - protein, 10 aa, Dengue virus
YIMIGVGNSA

SEQ ID NO: 93357 - protein, 10 aa, Dengue virus
IMIGVGNSAL

SEQ ID NO: 93358 - protein, 10 aa, Dengue virus
MIGVGNSALT

SEQ ID NO: 93359 - protein, 10 aa, Dengue virus
IGVEPGQLKL

SEQ ID NO: 93360 - protein, 10 aa, Dengue virus
GVEPGQLKLN

SEQ ID NO: 93361 - protein, 10 aa, Dengue virus
VEPGQLKLNW

SEQ ID NO: 93362 - protein, 10 aa, Dengue virus
EPGQLKLNWF

SEQ ID NO: 93363 - protein, 10 aa, Dengue virus
PGQLKLNWFK

SEQ ID NO: 93364 - protein, 10 aa, Dengue virus
RKGSSIGKML

SEQ ID NO: 93365 - protein, 10 aa, Dengue virus
KGSSIGQMFE

SEQ ID NO: 93366 - protein, 10 aa, Dengue virus
GSSIGQMFET

SEQ ID NO: 93367 - protein, 10 aa, Dengue virus
SSIGQMFETT

SEQ ID NO: 93368 - protein, 10 aa, Dengue virus
SIGQMFETTM

SEQ ID NO: 93369 - protein, 10 aa, Dengue virus
IGQMFETTMR

SEQ ID NO: 93370 - protein, 10 aa, Dengue virus
GQMFETTMRG

SEQ ID NO: 93371 - protein, 10 aa, Dengue virus
KMLESTYRGA

SEQ ID NO: 93372 - protein, 10 aa, Dengue virus
MFETTMRGAK

SEQ ID NO: 93373 - protein, 10 aa, Dengue virus
LESTYRGAKR

SEQ ID NO: 93374 - protein, 10 aa, Dengue virus
WDFGSLGGVF

SEQ ID NO: 93375 - protein, 10 aa, Dengue virus
DFGSLGGVFT

SEQ ID NO: 93376 - protein, 10 aa, Dengue virus
FGSLGGVFTS

SEQ ID NO: 93377 - protein, 10 aa, Dengue virus
GSLGGVFTSI

SEQ ID NO: 93378 - protein, 10 aa, Dengue virus
SLGGVFTSIG

SEQ ID NO: 93379 - protein, 10 aa, Dengue virus
LGGVFTSIGK

SEQ ID NO: 93380 - protein, 10 aa, Dengue virus
GGVFTSIGKA

SEQ ID NO: 93381 - protein, 10 aa, Dengue virus
GVFTSIGKAL

SEQ ID NO: 93382 - protein, 10 aa, Dengue virus
VFTSIGKALH

SEQ ID NO: 93383 - protein, 10 aa, Dengue virus
FTSIGKALHQ

SEQ ID NO: 93384 - protein, 10 aa, Dengue virus
TSLGKAVHQI

SEQ ID NO: 93385 - protein, 10 aa, Dengue virus
SIGKALHQVF

SEQ ID NO: 93386 - protein, 10 aa, Dengue virus
IGKALHQVFG

SEQ ID NO: 93387 - protein, 10 aa, Dengue virus
GKALHQVFGA

SEQ ID NO: 93388 - protein, 10 aa, Dengue virus
KAVHQIFGSV

SEQ ID NO: 93389 - protein, 10 aa, Dengue virus
ALHQVFGAIY

SEQ ID NO: 93390 - protein, 10 aa, Dengue virus
LHQVFGAIYG

SEQ ID NO: 93391 - protein, 10 aa, Dengue virus
HQIFGSVYTT

SEQ ID NO: 93392 - protein, 10 aa, Dengue virus
QIFGSVYTTM

SEQ ID NO: 93393 - protein, 10 aa, Dengue virus
IFGSVYTTMF

SEQ ID NO: 93394 - protein, 10 aa, Dengue virus
AAFSGVSWTM

SEQ ID NO: 93395 - protein, 10 aa, Dengue virus
AFSGVSWTMK

SEQ ID NO: 93396 - protein, 10 aa, Dengue virus
FSGVSWTMKI

SEQ ID NO: 93397 - protein, 10 aa, Dengue virus
SGVSWTMKIL

SEQ ID NO: 93398 - protein, 10 aa, Dengue virus
GVSWTMKILI

SEQ ID NO: 93399 - protein, 10 aa, Dengue virus
VSWTMKILIG

SEQ ID NO: 93400 - protein, 10 aa, Dengue virus
IRILIGLLVL

SEQ ID NO: 93401 - protein, 10 aa, Dengue virus
KILIGVIITW

SEQ ID NO: 93402 - protein, 10 aa, Dengue virus
ILIGVIITWI

SEQ ID NO: 93403 - protein, 10 aa, Dengue virus
LIGVIITWIG

SEQ ID NO: 93404 - protein, 10 aa, Dengue virus
IGVIITWIGM

SEQ ID NO: 93405 - protein, 10 aa, Dengue virus
GVIITWIGMN

SEQ ID NO: 93406 - protein, 10 aa, Dengue virus
VIITWIGMNS

SEQ ID NO: 93407 - protein, 10 aa, Dengue virus
WIGTNSRNTP

SEQ ID NO: 93408 - protein, 10 aa, Dengue virus
IGMNSRNTSM

SEQ ID NO: 93409 - protein, 10 aa, Dengue virus
GTNSRNTPMA

SEQ ID NO: 93410 - protein, 10 aa, Dengue virus
MNSRNTSMAM

SEQ ID NO: 93411 - protein, 10 aa, Dengue virus
NSRNTPMAMT

SEQ ID NO: 93412 - protein, 10 aa, Dengue virus
SRNTPMAMTC

SEQ ID NO: 93413 - protein, 10 aa, Dengue virus
RNTPMAMTCI

SEQ ID NO: 93414 - protein, 10 aa, Dengue virus
NTPMAMTCIA

SEQ ID NO: 93415 - protein, 10 aa, Dengue virus
TPMAMTCIAV

SEQ ID NO: 93416 - protein, 10 aa, Dengue virus
PMAMTCIAVG

SEQ ID NO: 93417 - protein, 10 aa, Dengue virus
FLGFTVHADT

SEQ ID NO: 93418 - protein, 10 aa, Dengue virus
LGFTVHADTG

SEQ ID NO: 93419 - protein, 10 aa, Dengue virus
GFTVHADTGC

SEQ ID NO: 93420 - protein, 10 aa, Dengue virus
SWNGKELKCG

SEQ ID NO: 93421 - protein, 10 aa, Dengue virus
WNGKELKCGS

SEQ ID NO: 93422 - protein, 10 aa, Dengue virus
NGKELKCGSG

SEQ ID NO: 93423 - protein, 10 aa, Dengue virus
LKCGSGIFVA

SEQ ID NO: 93424 - protein, 10 aa, Dengue virus
KCGSGIFVAD

SEQ ID NO: 93425 - protein, 10 aa, Dengue virus
CGSGIFVADN

SEQ ID NO: 93426 - protein, 10 aa, Dengue virus
GSGIFVADNV

SEQ ID NO: 93427 - protein, 10 aa, Dengue virus
SGIFVTDNVH

SEQ ID NO: 93428 - protein, 10 aa, Dengue virus
GIFVADNVHT

SEQ ID NO: 93429 - protein, 10 aa, Dengue virus
IFVTDNVHTW

SEQ ID NO: 93430 - protein, 10 aa, Dengue virus
FVADNVHTWT

SEQ ID NO: 93431 - protein, 10 aa, Dengue virus
VADNVHTWTE

SEQ ID NO: 93432 - protein, 10 aa, Dengue virus
TDNVHTWTEQ

SEQ ID NO: 93433 - protein, 10 aa, Dengue virus
NVHTWTEQHK

SEQ ID NO: 93434 - protein, 10 aa, Dengue virus
VHTWTEQHKF

SEQ ID NO: 93435 - protein, 10 aa, Dengue virus
HTWIEQYKFQ

SEQ ID NO: 93436 - protein, 10 aa, Dengue virus
TWIEQYKFQP

SEQ ID NO: 93437 - protein, 10 aa, Dengue virus
WIEQYKFQPE

SEQ ID NO: 93438 - protein, 10 aa, Dengue virus
TEQHKFQPES

SEQ ID NO: 93439 - protein, 10 aa, Dengue virus
QFQPESPARL

SEQ ID NO: 93440 - protein, 10 aa, Dengue virus
LASAILIAHK

SEQ ID NO: 93441 - protein, 10 aa, Dengue virus
ASAILNAHED

SEQ ID NO: 93442 - protein, 10 aa, Dengue virus
SAILNAHEDG

SEQ ID NO: 93443 - protein, 10 aa, Dengue virus
AILNAHKEGV

SEQ ID NO: 93444 - protein, 10 aa, Dengue virus
ILNAHKEGVC

SEQ ID NO: 93445 - protein, 10 aa, Dengue virus
LNAHKEGVCG

SEQ ID NO: 93446 - protein, 10 aa, Dengue virus
NAHKEGVCGI

SEQ ID NO: 93447 - protein, 10 aa, Dengue virus
AHKDGVCGVR

SEQ ID NO: 93448 - protein, 10 aa, Dengue virus
HEDGVCGIRS

SEQ ID NO: 93449 - protein, 10 aa, Dengue virus
KDGVCGVRST

SEQ ID NO: 93450 - protein, 10 aa, Dengue virus
HDLTIVAGDV

SEQ ID NO: 93451 - protein, 10 aa, Dengue virus
DLTIVAGDVK

SEQ ID NO: 93452 - protein, 10 aa, Dengue virus
LTVVAGDVRG

SEQ ID NO: 93453 - protein, 10 aa, Dengue virus
TIVAGDVKGV

SEQ ID NO: 93454 - protein, 10 aa, Dengue virus
VVAGDVRGVL

SEQ ID NO: 93455 - protein, 10 aa, Dengue virus
VAGDAKGVLT

SEQ ID NO: 93456 - protein, 10 aa, Dengue virus
AGDAKGVLTK

SEQ ID NO: 93457 - protein, 10 aa, Dengue virus
GDVKGVLVKG

SEQ ID NO: 93458 - protein, 10 aa, Dengue virus
DVKGVLVKGK

SEQ ID NO: 93459 - protein, 10 aa, Dengue virus
AKGVLTKGKR

SEQ ID NO: 93460 - protein, 10 aa, Dengue virus
KGVLVKGKRA

SEQ ID NO: 93461 - protein, 10 aa, Dengue virus
GVLVKGKRAL

SEQ ID NO: 93462 - protein, 10 aa, Dengue virus
VLVKGKRALT

SEQ ID NO: 93463 - protein, 10 aa, Dengue virus
LVKGKRALTP

SEQ ID NO: 93464 - protein, 10 aa, Dengue virus
VKGKRALTPP

SEQ ID NO: 93465 - protein, 10 aa, Dengue virus
KGKRALAPPV

SEQ ID NO: 93466 - protein, 10 aa, Dengue virus
LTPPVNDLKY

SEQ ID NO: 93467 - protein, 10 aa, Dengue virus
TPPVNDLKYS

SEQ ID NO: 93468 - protein, 10 aa, Dengue virus
PPVNDLKYSW

SEQ ID NO: 93469 - protein, 10 aa, Dengue virus
PVNDLKYSWK

SEQ ID NO: 93470 - protein, 10 aa, Dengue virus
VNDLKYSWKT

SEQ ID NO: 93471 - protein, 10 aa, Dengue virus
GKARIFTPEA

SEQ ID NO: 93472 - protein, 10 aa, Dengue virus
RNSTFLVDGP

SEQ ID NO: 93473 - protein, 10 aa, Dengue virus
PNERRAWNFL

SEQ ID NO: 93474 - protein, 10 aa, Dengue virus
NERRAWNFLE

SEQ ID NO: 93475 - protein, 10 aa, Dengue virus
ERRAWNFLEV

SEQ ID NO: 93476 - protein, 10 aa, Dengue virus
RRAWNFLEVE

SEQ ID NO: 93477 - protein, 10 aa, Dengue virus
RAWNFLEVED

SEQ ID NO: 93478 - protein, 10 aa, Dengue virus
AWNFLEVEDY

SEQ ID NO: 93479 - protein, 10 aa, Dengue virus
WNFLEVEDYG

SEQ ID NO: 93480 - protein, 10 aa, Dengue virus
NFLEVEDYGF

SEQ ID NO: 93481 - protein, 10 aa, Dengue virus
FLEVEDYGFG

SEQ ID NO: 93482 - protein, 10 aa, Dengue virus
LESQMLIPKA

SEQ ID NO: 93483 - protein, 10 aa, Dengue virus
ESQMLIPKAY

SEQ ID NO: 93484 - protein, 10 aa, Dengue virus
SQMLIPKAYA

SEQ ID NO: 93485 - protein, 10 aa, Dengue virus
QMLIPKAYAG

SEQ ID NO: 93486 - protein, 10 aa, Dengue virus
MLIPKAYAGP

SEQ ID NO: 93487 - protein, 10 aa, Dengue virus
LIPKAYAGPF

SEQ ID NO: 93488 - protein, 10 aa, Dengue virus
IPKAYAGPFS

SEQ ID NO: 93489 - protein, 10 aa, Dengue virus
PKAYAGPFSQ

SEQ ID NO: 93490 - protein, 10 aa, Dengue virus
KAYAGPFSQH

SEQ ID NO: 93491 - protein, 10 aa, Dengue virus
SYAGPFSHHN

SEQ ID NO: 93492 - protein, 10 aa, Dengue virus
YAGPISQHNY

SEQ ID NO: 93493 - protein, 10 aa, Dengue virus
AGPISQHNYR

SEQ ID NO: 93494 - protein, 10 aa, Dengue virus
GPISQHNYRQ

SEQ ID NO: 93495 - protein, 10 aa, Dengue virus
PISQHNYRQG

SEQ ID NO: 93496 - protein, 10 aa, Dengue virus
ISQHNYRQGY

SEQ ID NO: 93497 - protein, 10 aa, Dengue virus
YRQGYATQTA

SEQ ID NO: 93498 - protein, 10 aa, Dengue virus
RQGYATQTAG

SEQ ID NO: 93499 - protein, 10 aa, Dengue virus
QGYATQTAGP

SEQ ID NO: 93500 - protein, 10 aa, Dengue virus
GYATQTAGPW

SEQ ID NO: 93501 - protein, 10 aa, Dengue virus
YATQTAGPWH

SEQ ID NO: 93502 - protein, 10 aa, Dengue virus
ATQTAGPWHL

SEQ ID NO: 93503 - protein, 10 aa, Dengue virus
TQTAGPWHLG

SEQ ID NO: 93504 - protein, 10 aa, Dengue virus
QTAGPWHLGK

SEQ ID NO: 93505 - protein, 10 aa, Dengue virus
TAGPWHLGKL

SEQ ID NO: 93506 - protein, 10 aa, Dengue virus
MGPWHLGKLE

SEQ ID NO: 93507 - protein, 10 aa, Dengue virus
GECPGTTVTV

SEQ ID NO: 93508 - protein, 10 aa, Dengue virus
ECPGTTVTVR

SEQ ID NO: 93509 - protein, 10 aa, Dengue virus
CPGTTVTIQD

SEQ ID NO: 93510 - protein, 10 aa, Dengue virus
PGTTVAIQED

SEQ ID NO: 93511 - protein, 10 aa, Dengue virus
GTTVAIQEDC

SEQ ID NO: 93512 - protein, 10 aa, Dengue virus
QDDCDHRGPS

SEQ ID NO: 93513 - protein, 10 aa, Dengue virus
DDCDHRGPSL

SEQ ID NO: 93514 - protein, 10 aa, Dengue virus
DCGHRGSSLR

SEQ ID NO: 93515 - protein, 10 aa, Dengue virus
GMEIRPLSER

SEQ ID NO: 93516 - protein, 10 aa, Dengue virus
MEIRPLSERE

SEQ ID NO: 93517 - protein, 10 aa, Dengue virus
EIRPLSEREE

SEQ ID NO: 93518 - protein, 10 aa, Dengue virus
IRPLSEREEN

SEQ ID NO: 93519 - protein, 10 aa, Dengue virus
RPLSEREENM

SEQ ID NO: 93520 - protein, 10 aa, Dengue virus
PLSEREENMV

SEQ ID NO: 93521 - protein, 10 aa, Dengue virus
LSEREENMVK

SEQ ID NO: 93522 - protein, 10 aa, Dengue virus
SEREENMVKS

SEQ ID NO: 93523 - protein, 10 aa, Dengue virus
EKEENMVRSQ

SEQ ID NO: 93524 - protein, 10 aa, Dengue virus
KEENMVKSQA

SEQ ID NO: 93525 - protein, 10 aa, Dengue virus
EENMVKSQVS

SEQ ID NO: 93526 - protein, 10 aa, Dengue virus
ENMVKSQVSA

SEQ ID NO: 93527 - protein, 10 aa, Dengue virus
NMVKSQVSAG

SEQ ID NO: 93528 - protein, 10 aa, Dengue virus
GSSETFSMGL

SEQ ID NO: 93529 - protein, 10 aa, Dengue virus
PSETFSMGLL

SEQ ID NO: 93530 - protein, 10 aa, Dengue virus
MGLLCLTLFI

SEQ ID NO: 93531 - protein, 10 aa, Dengue virus
GLLCLTLFIE

SEQ ID NO: 93532 - protein, 10 aa, Dengue virus
LLCLTLFIEE

SEQ ID NO: 93533 - protein, 10 aa, Dengue virus
LCLTLFIEEC

SEQ ID NO: 93534 - protein, 10 aa, Dengue virus
CLTLFIEECL

SEQ ID NO: 93535 - protein, 10 aa, Dengue virus
LTLFIEECLR

SEQ ID NO: 93536 - protein, 10 aa, Dengue virus
TLFIEECLRR

SEQ ID NO: 93537 - protein, 10 aa, Dengue virus
LFIEECLRRK

SEQ ID NO: 93538 - protein, 10 aa, Dengue virus
FIEECLRRKV

SEQ ID NO: 93539 - protein, 10 aa, Dengue virus
IEECLRRKVT

SEQ ID NO: 93540 - protein, 10 aa, Dengue virus
KVTRKHMILV

SEQ ID NO: 93541 - protein, 10 aa, Dengue virus
TRKHMILVVA

SEQ ID NO: 93542 - protein, 10 aa, Dengue virus
RKHMILVVVT

SEQ ID NO: 93543 - protein, 10 aa, Dengue virus
KHMILVVVTT

SEQ ID NO: 93544 - protein, 10 aa, Dengue virus
TTLCAIILGG

SEQ ID NO: 93545 - protein, 10 aa, Dengue virus
IIMLGDTMFG

SEQ ID NO: 93546 - protein, 10 aa, Dengue virus
IMLGDTMFGR

SEQ ID NO: 93547 - protein, 10 aa, Dengue virus
MLGDTMLSRV

SEQ ID NO: 93548 - protein, 10 aa, Dengue virus
LGDTMLSRVG

SEQ ID NO: 93549 - protein, 10 aa, Dengue virus
GDTMLSRVGG

SEQ ID NO: 93550 - protein, 10 aa, Dengue virus
DTMLSRVGGQ

SEQ ID NO: 93551 - protein, 10 aa, Dengue virus
RMGGQIHLAI

SEQ ID NO: 93552 - protein, 10 aa, Dengue virus
MGGQIHLAIM

SEQ ID NO: 93553 - protein, 10 aa, Dengue virus
GGQVHLAIMA

SEQ ID NO: 93554 - protein, 10 aa, Dengue virus
GQVHLAIMAV

SEQ ID NO: 93555 - protein, 10 aa, Dengue virus
QVHLAIMAVF

SEQ ID NO: 93556 - protein, 10 aa, Dengue virus
VHLAIMAVFK

SEQ ID NO: 93557 - protein, 10 aa, Dengue virus
GYVLGVFLRR

SEQ ID NO: 93558 - protein, 10 aa, Dengue virus
YVLGVFLRRL

SEQ ID NO: 93559 - protein, 10 aa, Dengue virus
VLGVFLRRLT

SEQ ID NO: 93560 - protein, 10 aa, Dengue virus
LGVFLRRLTS

SEQ ID NO: 93561 - protein, 10 aa, Dengue virus
GVFLRRLTSR

SEQ ID NO: 93562 - protein, 10 aa, Dengue virus
VFLRRLTSRE

SEQ ID NO: 93563 - protein, 10 aa, Dengue virus
VIGMAMTTVF

SEQ ID NO: 93564 - protein, 10 aa, Dengue virus
IGMAMTTVFS

SEQ ID NO: 93565 - protein, 10 aa, Dengue virus
GMAMTTVFSI

SEQ ID NO: 93566 - protein, 10 aa, Dengue virus
MAMTTVFSIP

SEQ ID NO: 93567 - protein, 10 aa, Dengue virus
AMTTVFSIPH

SEQ ID NO: 93568 - protein, 10 aa, Dengue virus
MTTVFSIPHD

SEQ ID NO: 93569 - protein, 10 aa, Dengue virus
TTVFSIPHDL

SEQ ID NO: 93570 - protein, 10 aa, Dengue virus
TVFSIPHDLM

SEQ ID NO: 93571 - protein, 10 aa, Dengue virus
VFSIPHDLME

SEQ ID NO: 93572 - protein, 10 aa, Dengue virus
LSIPHDLMEF

SEQ ID NO: 93573 - protein, 10 aa, Dengue virus
DLMEFIDGLS

SEQ ID NO: 93574 - protein, 10 aa, Dengue virus
LMELIDGIAL

SEQ ID NO: 93575 - protein, 10 aa, Dengue virus
MEFIDGLSLG

SEQ ID NO: 93576 - protein, 10 aa, Dengue virus
EFIDGLSLGL

SEQ ID NO: 93577 - protein, 10 aa, Dengue virus
FIDGLSLGLI

SEQ ID NO: 93578 - protein, 10 aa, Dengue virus
ISLGLILLKT

SEQ ID NO: 93579 - protein, 10 aa, Dengue virus
SLGLILLKTV

SEQ ID NO: 93580 - protein, 10 aa, Dengue virus
LGLILLKTVT

SEQ ID NO: 93581 - protein, 10 aa, Dengue virus
GLILLKMVTH

SEQ ID NO: 93582 - protein, 10 aa, Dengue virus
LILLKMVTHF

SEQ ID NO: 93583 - protein, 10 aa, Dengue virus
ILLKMVTHFD

SEQ ID NO: 93584 - protein, 10 aa, Dengue virus
VTHFDDTQVG

SEQ ID NO: 93585 - protein, 10 aa, Dengue virus
THFDDTQVGT

SEQ ID NO: 93586 - protein, 10 aa, Dengue virus
HFDDTQVGTL

SEQ ID NO: 93587 - protein, 10 aa, Dengue virus
FDNAQLGTLA

SEQ ID NO: 93588 - protein, 10 aa, Dengue virus
DNAQLGTLAL

SEQ ID NO: 93589 - protein, 10 aa, Dengue virus
NTQVGTLALA

SEQ ID NO: 93590 - protein, 10 aa, Dengue virus
TLALALTFIK

SEQ ID NO: 93591 - protein, 10 aa, Dengue virus
LALALTFIKS

SEQ ID NO: 93592 - protein, 10 aa, Dengue virus
ALSLTFIKTT

SEQ ID NO: 93593 - protein, 10 aa, Dengue virus
PLIMAWRTIM

SEQ ID NO: 93594 - protein, 10 aa, Dengue virus
LTMAWRTIMA

SEQ ID NO: 93595 - protein, 10 aa, Dengue virus
TMAWRTIMAV

SEQ ID NO: 93596 - protein, 10 aa, Dengue virus
WRTIMAVLFA

SEQ ID NO: 93597 - protein, 10 aa, Dengue virus
RTIMAVLFAV

SEQ ID NO: 93598 - protein, 10 aa, Dengue virus
TIMAVLFAVT

SEQ ID NO: 93599 - protein, 10 aa, Dengue virus
IMAVLFAVTL

SEQ ID NO: 93600 - protein, 10 aa, Dengue virus
MAVLFAVTLI

SEQ ID NO: 93601 - protein, 10 aa, Dengue virus
AVLFAVTLIP

SEQ ID NO: 93602 - protein, 10 aa, Dengue virus
VLFAVTLIPL

SEQ ID NO: 93603 - protein, 10 aa, Dengue virus
LFAVTLIPLC

SEQ ID NO: 93604 - protein, 10 aa, Dengue virus
SHWVEITALT

SEQ ID NO: 93605 - protein, 10 aa, Dengue virus
HWVEITALTL

SEQ ID NO: 93606 - protein, 10 aa, Dengue virus
WVEITALTLG

SEQ ID NO: 93607 - protein, 10 aa, Dengue virus
VEITALTLGA

SEQ ID NO: 93608 - protein, 10 aa, Dengue virus
EITALTLGAQ

SEQ ID NO: 93609 - protein, 10 aa, Dengue virus
ITALTLGAQA

SEQ ID NO: 93610 - protein, 10 aa, Dengue virus
TALTLGAQAL

SEQ ID NO: 93611 - protein, 10 aa, Dengue virus
ALTLGAQALP

SEQ ID NO: 93612 - protein, 10 aa, Dengue virus
LTLGAQALPV

SEQ ID NO: 93613 - protein, 10 aa, Dengue virus
ADLSLERAAN

SEQ ID NO: 93614 - protein, 10 aa, Dengue virus
DLSLERAANV

SEQ ID NO: 93615 - protein, 10 aa, Dengue virus
LSLERAANVQ

SEQ ID NO: 93616 - protein, 10 aa, Dengue virus
SLERAANVQW

SEQ ID NO: 93617 - protein, 10 aa, Dengue virus
LERAANVQWD

SEQ ID NO: 93618 - protein, 10 aa, Dengue virus
ERAANVQWDE

SEQ ID NO: 93619 - protein, 10 aa, Dengue virus
RAANVQWDEM

SEQ ID NO: 93620 - protein, 10 aa, Dengue virus
AAITGSSPII

SEQ ID NO: 93621 - protein, 10 aa, Dengue virus
AITGSSPIIE

SEQ ID NO: 93622 - protein, 10 aa, Dengue virus
SPIIEVKQDD

SEQ ID NO: 93623 - protein, 10 aa, Dengue virus
PIIEVKQDDD

SEQ ID NO: 93624 - protein, 10 aa, Dengue virus
IIEVKQDDDG

SEQ ID NO: 93625 - protein, 10 aa, Dengue virus
YPLAIPVTMA

SEQ ID NO: 93626 - protein, 10 aa, Dengue virus
PLAIPVTMAL

SEQ ID NO: 93627 - protein, 10 aa, Dengue virus
LAIPVTMALW

SEQ ID NO: 93628 - protein, 10 aa, Dengue virus
AIPVTMALWY

SEQ ID NO: 93629 - protein, 10 aa, Dengue virus
IPVTMALWYI

SEQ ID NO: 93630 - protein, 10 aa, Dengue virus
PVTMALWYIW

SEQ ID NO: 93631 - protein, 10 aa, Dengue virus
VTMALWYIWQ

SEQ ID NO: 93632 - protein, 10 aa, Dengue virus
TMALWYMWQV

SEQ ID NO: 93633 - protein, 10 aa, Dengue virus
MTLWYMWQVR

SEQ ID NO: 93634 - protein, 10 aa, Dengue virus
TLWYMWQVRT

SEQ ID NO: 93635 - protein, 10 aa, Dengue virus
LWYMWQVRTQ

SEQ ID NO: 93636 - protein, 10 aa, Dengue virus
WYMWQVRTQR

SEQ ID NO: 93637 - protein, 10 aa, Dengue virus
YMWQVRTQRS

SEQ ID NO: 93638 - protein, 10 aa, Dengue virus
MWQVRTQRSG

SEQ ID NO: 93639 - protein, 10 aa, Dengue virus
LWDVPSPATA

SEQ ID NO: 93640 - protein, 10 aa, Dengue virus
WDVPSPAAAQ

SEQ ID NO: 93641 - protein, 10 aa, Dengue virus
DVPSPAAAQK

SEQ ID NO: 93642 - protein, 10 aa, Dengue virus
VPSPAAAQKA

SEQ ID NO: 93643 - protein, 10 aa, Dengue virus
TQKATLSEGV

SEQ ID NO: 93644 - protein, 10 aa, Dengue virus
QKATLSEGVY

SEQ ID NO: 93645 - protein, 10 aa, Dengue virus
KATLTEGVYR

SEQ ID NO: 93646 - protein, 10 aa, Dengue virus
ATLTEGVYRI

SEQ ID NO: 93647 - protein, 10 aa, Dengue virus
TLTEGVYRIM

SEQ ID NO: 93648 - protein, 10 aa, Dengue virus
LGKTQVGVGV

SEQ ID NO: 93649 - protein, 10 aa, Dengue virus
KTQVGVGVHV

SEQ ID NO: 93650 - protein, 10 aa, Dengue virus
TQVGVGVHVE

SEQ ID NO: 93651 - protein, 10 aa, Dengue virus
QVGVGVHVEG

SEQ ID NO: 93652 - protein, 10 aa, Dengue virus
VGVGIHTEGV

SEQ ID NO: 93653 - protein, 10 aa, Dengue virus
GVGIHTEGVF

SEQ ID NO: 93654 - protein, 10 aa, Dengue virus
VGIHTEGVFH

SEQ ID NO: 93655 - protein, 10 aa, Dengue virus
GVHVEGVFHT

SEQ ID NO: 93656 - protein, 10 aa, Dengue virus
VHVEGVFHTM

SEQ ID NO: 93657 - protein, 10 aa, Dengue virus
HTEGVFHTMW

SEQ ID NO: 93658 - protein, 10 aa, Dengue virus
TEGVFHTMWH

SEQ ID NO: 93659 - protein, 10 aa, Dengue virus
KEEDVQVLAV

SEQ ID NO: 93660 - protein, 10 aa, Dengue virus
GTSGSPIVNR

SEQ ID NO: 93661 - protein, 10 aa, Dengue virus
SSGSPIINRK

SEQ ID NO: 93662 - protein, 10 aa, Dengue virus
IFMTATPPGT

SEQ ID NO: 93663 - protein, 10 aa, Dengue virus
FMTATPPGTT

SEQ ID NO: 93664 - protein, 10 aa, Dengue virus
MTATPPGTTD

SEQ ID NO: 93665 - protein, 10 aa, Dengue virus
TATPPGTTDP

SEQ ID NO: 93666 - protein, 10 aa, Dengue virus
ATPPGTTDPF

SEQ ID NO: 93667 - protein, 10 aa, Dengue virus
TPPGTTDPFP

SEQ ID NO: 93668 - protein, 10 aa, Dengue virus
PPGTTDPFPQ

SEQ ID NO: 93669 - protein, 10 aa, Dengue virus
PGTTDPFPQS

SEQ ID NO: 93670 - protein, 10 aa, Dengue virus
GTTDPFPQSN

SEQ ID NO: 93671 - protein, 10 aa, Dengue virus
TTDPFPQSNS

SEQ ID NO: 93672 - protein, 10 aa, Dengue virus
RRCLKPVIST

SEQ ID NO: 93673 - protein, 10 aa, Dengue virus
RCLKPVISTD

SEQ ID NO: 93674 - protein, 10 aa, Dengue virus
CLKPVISTDG

SEQ ID NO: 93675 - protein, 10 aa, Dengue virus
LKPVISTDGP

SEQ ID NO: 93676 - protein, 10 aa, Dengue virus
KPVISTDGPE

SEQ ID NO: 93677 - protein, 10 aa, Dengue virus
PVISTDGPER

SEQ ID NO: 93678 - protein, 10 aa, Dengue virus
VISTDGPERV

SEQ ID NO: 93679 - protein, 10 aa, Dengue virus
ISTDGPERVI

SEQ ID NO: 93680 - protein, 10 aa, Dengue virus
STDGPERVIL

SEQ ID NO: 93681 - protein, 10 aa, Dengue virus
RRGRIGRNPT

SEQ ID NO: 93682 - protein, 10 aa, Dengue virus
RGRIGRNPTQ

SEQ ID NO: 93683 - protein, 10 aa, Dengue virus
GRIGRNPTQE

SEQ ID NO: 93684 - protein, 10 aa, Dengue virus
RIGRNPTQED

SEQ ID NO: 93685 - protein, 10 aa, Dengue virus
IGRNPTQEDD

SEQ ID NO: 93686 - protein, 10 aa, Dengue virus
GRNPTQEDDQ

SEQ ID NO: 93687 - protein, 10 aa, Dengue virus
RNPTQEDDQY

SEQ ID NO: 93688 - protein, 10 aa, Dengue virus
NPTQEDDQYV

SEQ ID NO: 93689 - protein, 10 aa, Dengue virus
PTQEDDQYVF

SEQ ID NO: 93690 - protein, 10 aa, Dengue virus
ILTEIATLPA

SEQ ID NO: 93691 - protein, 10 aa, Dengue virus
LTEIATLPAY

SEQ ID NO: 93692 - protein, 10 aa, Dengue virus
TEIATLPAYL

SEQ ID NO: 93693 - protein, 10 aa, Dengue virus
EIATLPAYLS

SEQ ID NO: 93694 - protein, 10 aa, Dengue virus
IATLPAYLSS

SEQ ID NO: 93695 - protein, 10 aa, Dengue virus
ATLPAYLSSK

SEQ ID NO: 93696 - protein, 10 aa, Dengue virus
TLPAYLSSKA

SEQ ID NO: 93697 - protein, 10 aa, Dengue virus
LPAYLSSKAK

SEQ ID NO: 93698 - protein, 10 aa, Dengue virus
PAYLSSKAKL

SEQ ID NO: 93699 - protein, 10 aa, Dengue virus
AYLSSKAKLA

SEQ ID NO: 93700 - protein, 10 aa, Dengue virus
MLHTTERGGK

SEQ ID NO: 93701 - protein, 10 aa, Dengue virus
LHTTERGGKA

SEQ ID NO: 93702 - protein, 10 aa, Dengue virus
HTTERGGKAY

SEQ ID NO: 93703 - protein, 10 aa, Dengue virus
TTERGGKAYQ

SEQ ID NO: 93704 - protein, 10 aa, Dengue virus
TERGGKAYQH

SEQ ID NO: 93705 - protein, 10 aa, Dengue virus
ERGGKAYQHA

SEQ ID NO: 93706 - protein, 10 aa, Dengue virus
RGGKAYQHAL

SEQ ID NO: 93707 - protein, 10 aa, Dengue virus
QGKGMGKLSM

SEQ ID NO: 93708 - protein, 10 aa, Dengue virus
GKGMGKLSMG

SEQ ID NO: 93709 - protein, 10 aa, Dengue virus
KGMGKLSMGL

SEQ ID NO: 93710 - protein, 10 aa, Dengue virus
GIGKLSVGLI

SEQ ID NO: 93711 - protein, 10 aa, Dengue virus
IGKLSVGLIA

SEQ ID NO: 93712 - protein, 10 aa, Dengue virus
GKLSVGLIAI

SEQ ID NO: 93713 - protein, 10 aa, Dengue virus
KLSVGLIAIA

SEQ ID NO: 93714 - protein, 10 aa, Dengue virus
LSMGLITIAM

SEQ ID NO: 93715 - protein, 10 aa, Dengue virus
SMGLITIAMA

SEQ ID NO: 93716 - protein, 10 aa, Dengue virus
MGLITIAMAS

SEQ ID NO: 93717 - protein, 10 aa, Dengue virus
GLITIAMASG

SEQ ID NO: 93718 - protein, 10 aa, Dengue virus
LITIAMASGL

SEQ ID NO: 93719 - protein, 10 aa, Dengue virus
ITIAMASGLL

SEQ ID NO: 93720 - protein, 10 aa, Dengue virus
TIAMASGLLW

SEQ ID NO: 93721 - protein, 10 aa, Dengue virus
IAVASGLFWV

SEQ ID NO: 93722 - protein, 10 aa, Dengue virus
AVASGLFWVA

SEQ ID NO: 93723 - protein, 10 aa, Dengue virus
VASGLFWVAE

SEQ ID NO: 93724 - protein, 10 aa, Dengue virus
ASGLFWVAEI

SEQ ID NO: 93725 - protein, 10 aa, Dengue virus
SGLFWVAEIQ

SEQ ID NO: 93726 - protein, 10 aa, Dengue virus
GLFWVAEIQP

SEQ ID NO: 93727 - protein, 10 aa, Dengue virus
LFWVAEIQPQ

SEQ ID NO: 93728 - protein, 10 aa, Dengue virus
FWVAEIQPQW

SEQ ID NO: 93729 - protein, 10 aa, Dengue virus
WVAELQPQWI

SEQ ID NO: 93730 - protein, 10 aa, Dengue virus
VAELQPQWIA

SEQ ID NO: 93731 - protein, 10 aa, Dengue virus
LIYVILTILA

SEQ ID NO: 93732 - protein, 10 aa, Dengue virus
IYVILALLTI

SEQ ID NO: 93733 - protein, 10 aa, Dengue virus
YVILALLTII

SEQ ID NO: 93734 - protein, 10 aa, Dengue virus
VILTILTIIA

SEQ ID NO: 93735 - protein, 10 aa, Dengue virus
ILTILTIIAL

SEQ ID NO: 93736 - protein, 10 aa, Dengue virus
ILTIIALVAA

SEQ ID NO: 93737 - protein, 10 aa, Dengue virus
LTIIALVAAN

SEQ ID NO: 93738 - protein, 10 aa, Dengue virus
TIIALVAANE

SEQ ID NO: 93739 - protein, 10 aa, Dengue virus
IIALVAANEM

SEQ ID NO: 93740 - protein, 10 aa, Dengue virus
IALVAANEMG

SEQ ID NO: 93741 - protein, 10 aa, Dengue virus
ALVAANEMGL

SEQ ID NO: 93742 - protein, 10 aa, Dengue virus
TKADFGFYQV

SEQ ID NO: 93743 - protein, 10 aa, Dengue virus
KTDFGFYQEK

SEQ ID NO: 93744 - protein, 10 aa, Dengue virus
ADFGFYQVKT

SEQ ID NO: 93745 - protein, 10 aa, Dengue virus
DFGFYQEKTE

SEQ ID NO: 93746 - protein, 10 aa, Dengue virus
FGFYQEKTET

SEQ ID NO: 93747 - protein, 10 aa, Dengue virus
GFYQEKTETT

SEQ ID NO: 93748 - protein, 10 aa, Dengue virus
FYQEKTETTI

SEQ ID NO: 93749 - protein, 10 aa, Dengue virus
YQEKTETTIL

SEQ ID NO: 93750 - protein, 10 aa, Dengue virus
QEKTETTILD

SEQ ID NO: 93751 - protein, 10 aa, Dengue virus
EKTETTILDV

SEQ ID NO: 93752 - protein, 10 aa, Dengue virus
KTEITILDVD

SEQ ID NO: 93753 - protein, 10 aa, Dengue virus
TEITILDVDL

SEQ ID NO: 93754 - protein, 10 aa, Dengue virus
TLIASLVMLL

SEQ ID NO: 93755 - protein, 10 aa, Dengue virus
LIASLVMLLV

SEQ ID NO: 93756 - protein, 10 aa, Dengue virus
IASLVMLLVH

SEQ ID NO: 93757 - protein, 10 aa, Dengue virus
ASLVMLFVHY

SEQ ID NO: 93758 - protein, 10 aa, Dengue virus
SLVMLFVHYA

SEQ ID NO: 93759 - protein, 10 aa, Dengue virus
LAMLLVHYAI

SEQ ID NO: 93760 - protein, 10 aa, Dengue virus
VMLFVHYAII

SEQ ID NO: 93761 - protein, 10 aa, Dengue virus
LLVLCAGQLF

SEQ ID NO: 93762 - protein, 10 aa, Dengue virus
LVLCAGQLFL

SEQ ID NO: 93763 - protein, 10 aa, Dengue virus
VLCAGQLFLM

SEQ ID NO: 93764 - protein, 10 aa, Dengue virus
LCAGQLFLMR

SEQ ID NO: 93765 - protein, 10 aa, Dengue virus
CAGQLFLMRT

SEQ ID NO: 93766 - protein, 10 aa, Dengue virus
AGQLFLMRTT

SEQ ID NO: 93767 - protein, 10 aa, Dengue virus
LFLMRTTWAF

SEQ ID NO: 93768 - protein, 10 aa, Dengue virus
FLMRTTWAFC

SEQ ID NO: 93769 - protein, 10 aa, Dengue virus
EVLTLATGPT

SEQ ID NO: 93770 - protein, 10 aa, Dengue virus
VLTLATGPVL

SEQ ID NO: 93771 - protein, 10 aa, Dengue virus
LTLATGPVLT

SEQ ID NO: 93772 - protein, 10 aa, Dengue virus
TLATGPVLTL

SEQ ID NO: 93773 - protein, 10 aa, Dengue virus
LATGPVLTLW

SEQ ID NO: 93774 - protein, 10 aa, Dengue virus
ATGPVLTLWE

SEQ ID NO: 93775 - protein, 10 aa, Dengue virus
TGPVLTLWEG

SEQ ID NO: 93776 - protein, 10 aa, Dengue virus
GPVLTLWEGN

SEQ ID NO: 93777 - protein, 10 aa, Dengue virus
PVLTLWEGNP

SEQ ID NO: 93778 - protein, 10 aa, Dengue virus
VLTLWEGNPG

SEQ ID NO: 93779 - protein, 10 aa, Dengue virus
GLAFSLIKNT

SEQ ID NO: 93780 - protein, 10 aa, Dengue virus
LAFSLIKNTQ

SEQ ID NO: 93781 - protein, 10 aa, Dengue virus
AFSLIKNAQA

SEQ ID NO: 93782 - protein, 10 aa, Dengue virus
FSLIKNAQAP

SEQ ID NO: 93783 - protein, 10 aa, Dengue virus
SLIKNAQAPR

SEQ ID NO: 93784 - protein, 10 aa, Dengue virus
LIKNAQAPRR

SEQ ID NO: 93785 - protein, 10 aa, Dengue virus
IKNTQTPRRG

SEQ ID NO: 93786 - protein, 10 aa, Dengue virus
KNAQAPRRGT

SEQ ID NO: 93787 - protein, 10 aa, Dengue virus
NTQTPRRGTG

SEQ ID NO: 93788 - protein, 10 aa, Dengue virus
TQTPRRGTGI

SEQ ID NO: 93789 - protein, 10 aa, Dengue virus
QAPRRGTGTT

SEQ ID NO: 93790 - protein, 10 aa, Dengue virus
TPRRGTGITG

SEQ ID NO: 93791 - protein, 10 aa, Dengue virus
KSALKDGSKT

SEQ ID NO: 93792 - protein, 10 aa, Dengue virus
SALKDGSKTK

SEQ ID NO: 93793 - protein, 10 aa, Dengue virus
ALKDGSKTKH

SEQ ID NO: 93794 - protein, 10 aa, Dengue virus
LKDGSKTKHA

SEQ ID NO: 93795 - protein, 10 aa, Dengue virus
KDGSKTKHAV

SEQ ID NO: 93796 - protein, 10 aa, Dengue virus
DGSKIKYAVS

SEQ ID NO: 93797 - protein, 10 aa, Dengue virus
GSKIKYAVSR

SEQ ID NO: 93798 - protein, 10 aa, Dengue virus
SKIKYAVSRG

SEQ ID NO: 93799 - protein, 10 aa, Dengue virus
KIKYAVSRGT

SEQ ID NO: 93800 - protein, 10 aa, Dengue virus
IKYAVSRGTS

SEQ ID NO: 93801 - protein, 10 aa, Dengue virus
GMVKPKGKIV

SEQ ID NO: 93802 - protein, 10 aa, Dengue virus
MVKPKGKVID

SEQ ID NO: 93803 - protein, 10 aa, Dengue virus
VKPKGKVIDL

SEQ ID NO: 93804 - protein, 10 aa, Dengue virus
EELEKLQRKY

SEQ ID NO: 93805 - protein, 10 aa, Dengue virus
ELEKLQRKYG

SEQ ID NO: 93806 - protein, 10 aa, Dengue virus
LEKLQRKYGG

SEQ ID NO: 93807 - protein, 10 aa, Dengue virus
EKLQRKHGGS

SEQ ID NO: 93808 - protein, 10 aa, Dengue virus
KLQRKHGGSL

SEQ ID NO: 93809 - protein, 10 aa, Dengue virus
LQRKHGGSLV

SEQ ID NO: 93810 - protein, 10 aa, Dengue virus
QRKHGGSLVR

SEQ ID NO: 93811 - protein, 10 aa, Dengue virus
RKHGGSLVRC

SEQ ID NO: 93812 - protein, 10 aa, Dengue virus
KHGGSLVRCP

SEQ ID NO: 93813 - protein, 10 aa, Dengue virus
HGGSLIRCPL

SEQ ID NO: 93814 - protein, 10 aa, Dengue virus
GGSLIRCPLS

SEQ ID NO: 93815 - protein, 10 aa, Dengue virus
GSLIRCPLSR

SEQ ID NO: 93816 - protein, 10 aa, Dengue virus
SLIRCPLSRN

SEQ ID NO: 93817 - protein, 10 aa, Dengue virus
NTISKMLLNW

SEQ ID NO: 93818 - protein, 10 aa, Dengue virus
TISKMLLNWF

SEQ ID NO: 93819 - protein, 10 aa, Dengue virus
VSKMLLNRFT

SEQ ID NO: 93820 - protein, 10 aa, Dengue virus
LNRFTTRHRR

SEQ ID NO: 93821 - protein, 10 aa, Dengue virus
NRFTTRHRRP

SEQ ID NO: 93822 - protein, 10 aa, Dengue virus
RFTTKHRKPT

SEQ ID NO: 93823 - protein, 10 aa, Dengue virus
SSTGSASSMV

SEQ ID NO: 93824 - protein, 10 aa, Dengue virus
KLLTKPWDMI

SEQ ID NO: 93825 - protein, 10 aa, Dengue virus
LLTKPWDMIP

SEQ ID NO: 93826 - protein, 10 aa, Dengue virus
LTKPWDMIPM

SEQ ID NO: 93827 - protein, 10 aa, Dengue virus
TKPWDMIPMV

SEQ ID NO: 93828 - protein, 10 aa, Dengue virus
KPWDMIPMVT

SEQ ID NO: 93829 - protein, 10 aa, Dengue virus
PWDMIPMVTQ

SEQ ID NO: 93830 - protein, 10 aa, Dengue virus
WDMIPMVTQL

SEQ ID NO: 93831 - protein, 10 aa, Dengue virus
DMIPMVTQLA

SEQ ID NO: 93832 - protein, 10 aa, Dengue virus
MIPMVTQLAM

SEQ ID NO: 93833 - protein, 10 aa, Dengue virus
RTPQPKPGTQ

SEQ ID NO: 93834 - protein, 10 aa, Dengue virus
TPQPKLGTRV

SEQ ID NO: 93835 - protein, 10 aa, Dengue virus
PQPKPGTRVV

SEQ ID NO: 93836 - protein, 10 aa, Dengue virus
QPKPGTRVVM

SEQ ID NO: 93837 - protein, 10 aa, Dengue virus
PKPGTRVVMT

SEQ ID NO: 93838 - protein, 10 aa, Dengue virus
KPGTRVVMTT

SEQ ID NO: 93839 - protein, 10 aa, Dengue virus
PGTRVVMTTT

SEQ ID NO: 93840 - protein, 10 aa, Dengue virus
GTRVVMTTTA

SEQ ID NO: 93841 - protein, 10 aa, Dengue virus
TRVVMTTTAN

SEQ ID NO: 93842 - protein, 10 aa, Dengue virus
RVVMTTTANW

SEQ ID NO: 93843 - protein, 10 aa, Dengue virus
VVMTTTANWL

SEQ ID NO: 93844 - protein, 10 aa, Dengue virus
ANWLWTLLGK

SEQ ID NO: 93845 - protein, 10 aa, Dengue virus
NWLWTLLGKK

SEQ ID NO: 93846 - protein, 10 aa, Dengue virus
WLWTLLGKKK

SEQ ID NO: 93847 - protein, 10 aa, Dengue virus
LLGRKKNPRL

SEQ ID NO: 93848 - protein, 10 aa, Dengue virus
LGRKKNPRLC

SEQ ID NO: 93849 - protein, 10 aa, Dengue virus
GRKKNPRLCT

SEQ ID NO: 93850 - protein, 10 aa, Dengue virus
KKTPRLCTRE

SEQ ID NO: 93851 - protein, 10 aa, Dengue virus
KTPRLCTREE

SEQ ID NO: 93852 - protein, 10 aa, Dengue virus
SPRLCTKEEF

SEQ ID NO: 93853 - protein, 10 aa, Dengue virus
LGYILEDIDR

SEQ ID NO: 93854 - protein, 10 aa, Dengue virus
GYILEDIDRK

SEQ ID NO: 93855 - protein, 10 aa, Dengue virus
YILEDIDRKD

SEQ ID NO: 93856 - protein, 10 aa, Dengue virus
ILEDIDRKDG

SEQ ID NO: 93857 - protein, 10 aa, Dengue virus
LEDIDRKDGD

SEQ ID NO: 93858 - protein, 10 aa, Dengue virus
EDIDRKDGDL

SEQ ID NO: 93859 - protein, 10 aa, Dengue virus
DIDRKDGDLM

SEQ ID NO: 93860 - protein, 10 aa, Dengue virus
IDRKDGDLMY

SEQ ID NO: 93861 - protein, 10 aa, Dengue virus
DRKDGDLMYA

SEQ ID NO: 93862 - protein, 10 aa, Dengue virus
RKDGDLMYAD

SEQ ID NO: 93863 - protein, 10 aa, Dengue virus
ITEQMAPGHK

SEQ ID NO: 93864 - protein, 10 aa, Dengue virus
TEQMAPHHRI

SEQ ID NO: 93865 - protein, 10 aa, Dengue virus
EQMAPHHRIL

SEQ ID NO: 93866 - protein, 10 aa, Dengue virus
QMAPHHRILA

SEQ ID NO: 93867 - protein, 10 aa, Dengue virus
MAPHHRILAK

SEQ ID NO: 93868 - protein, 10 aa, Dengue virus
APHHRILAKA

SEQ ID NO: 93869 - protein, 10 aa, Dengue virus
PHHRILAKAI

SEQ ID NO: 93870 - protein, 10 aa, Dengue virus
HHRILAKAIF

SEQ ID NO: 93871 - protein, 10 aa, Dengue virus
HRILAKAIFK

SEQ ID NO: 93872 - protein, 10 aa, Dengue virus
RILAKAIFKL

SEQ ID NO: 93873 - protein, 10 aa, Dengue virus
EGVITQDDMH

SEQ ID NO: 93874 - protein, 10 aa, Dengue virus
GVITRDDMHN

SEQ ID NO: 93875 - protein, 10 aa, Dengue virus
VITRDDMHNP

SEQ ID NO: 93876 - protein, 10 aa, Dengue virus
ITQDDMHNPK

SEQ ID NO: 93877 - protein, 10 aa, Dengue virus
TQDDMHNPKG

SEQ ID NO: 93878 - protein, 10 aa, Dengue virus
RDDMHNPKGL

SEQ ID NO: 93879 - protein, 10 aa, Dengue virus
MQNPKGLKEK

SEQ ID NO: 93880 - protein, 10 aa, Dengue virus
QNPKGLRERV

SEQ ID NO: 93881 - protein, 10 aa, Dengue virus
PKGLRERVEK

SEQ ID NO: 93882 - protein, 10 aa, Dengue virus
KGLRERVEKW

SEQ ID NO: 93883 - protein, 10 aa, Dengue virus
GLRERVEKWL

SEQ ID NO: 93884 - protein, 10 aa, Dengue virus
LKERVENWLR

SEQ ID NO: 93885 - protein, 10 aa, Dengue virus
KERVENWLRE

SEQ ID NO: 93886 - protein, 10 aa, Dengue virus
ERVENWLREC

SEQ ID NO: 93887 - protein, 10 aa, Dengue virus
RVENWLRECG

SEQ ID NO: 93888 - protein, 10 aa, Dengue virus
VENWLRECGV

SEQ ID NO: 93889 - protein, 10 aa, Dengue virus
ENWLRECGVD

SEQ ID NO: 93890 - protein, 10 aa, Dengue virus
NWLRECGVDR

SEQ ID NO: 93891 - protein, 10 aa, Dengue virus
VVKPLDERFA

SEQ ID NO: 93892 - protein, 10 aa, Dengue virus
VKPLDERFAT

SEQ ID NO: 93893 - protein, 10 aa, Dengue virus
KPLDERFATS

SEQ ID NO: 93894 - protein, 10 aa, Dengue virus
PLDERFATSL

SEQ ID NO: 93895 - protein, 10 aa, Dengue virus
LDERFATSLL

SEQ ID NO: 93896 - protein, 10 aa, Dengue virus
DERFATSLLF

SEQ ID NO: 93897 - protein, 10 aa, Dengue virus
ERFATSLLFL

SEQ ID NO: 93898 - protein, 10 aa, Dengue virus
RFATSLLFLN

SEQ ID NO: 93899 - protein, 10 aa, Dengue virus
FATSLLFLND

SEQ ID NO: 93900 - protein, 10 aa, Dengue virus
ATSLLFLNDM

SEQ ID NO: 93901 - protein, 10 aa, Dengue virus
NPNMTDKTPI

SEQ ID NO: 93902 - protein, 10 aa, Dengue virus
PNMTDKTPIH

SEQ ID NO: 93903 - protein, 10 aa, Dengue virus
NMTDKTPIHS

SEQ ID NO: 93904 - protein, 10 aa, Dengue virus
MTDKTPIHSW

SEQ ID NO: 93905 - protein, 10 aa, Dengue virus
TDKTPIHSWE

SEQ ID NO: 93906 - protein, 10 aa, Dengue virus
KTPVHSWEDV

SEQ ID NO: 93907 - protein, 10 aa, Dengue virus
TPVHSWEDVP

SEQ ID NO: 93908 - protein, 10 aa, Dengue virus
PVHSWEDVPY

SEQ ID NO: 93909 - protein, 10 aa, Dengue virus
VHSWEDVPYL

SEQ ID NO: 93910 - protein, 10 aa, Dengue virus
WAKNIQTAIT

SEQ ID NO: 93911 - protein, 10 aa, Dengue virus
AKNIHTAIAQ

SEQ ID NO: 93912 - protein, 10 aa, Dengue virus
KNIHTAIAQV

SEQ ID NO: 93913 - protein, 10 aa, Dengue virus
NIQTAITQVR

SEQ ID NO: 93914 - protein, 10 aa, Dengue virus
IQTAITQVRN

SEQ ID NO: 93915 - protein, 10 aa, Dengue virus
HTAIAQVRNL

SEQ ID NO: 93916 - protein, 10 aa, Dengue virus
KEEYMDYMPV

SEQ ID NO: 93917 - protein, 10 aa, Dengue virus
EEYADYMPVM

SEQ ID NO: 93918 - protein, 10 aa, Dengue virus
EYVDYMPVMR

SEQ ID NO: 93919 - protein, 10 aa, Dengue virus
YVDYMPVMRR

SEQ ID NO: 93920 - protein, 10 aa, Dengue virus
VDYMPVMRRY

SEQ ID NO: 93921 - protein, 10 aa, Dengue virus
DYMPVMRRYS

SEQ ID NO: 93922 - protein, 10 aa, Dengue virus
YMPVMRRYSA

SEQ ID NO: 93923 - protein, 10 aa, Dengue virus
MPVMRRYSAL

SEQ ID NO: 93924 - protein, 10 aa, Dengue virus
RYSALSESEG

SEQ ID NO: 93925 - protein, 10 aa, Dengue virus
YSALSESEGV

SEQ ID NO: 93926 - protein, 10 aa, Dengue virus
SALSESEGVL

SEQ ID NO: 93927 - protein, 10 aa, Dengue virus
NKVVRPSFNM

SEQ ID NO: 93928 - protein, 10 aa, Dengue virus
RVVRPPFNML

SEQ ID NO: 93929 - protein, 10 aa, Dengue virus
PQGLVKRFSI

SEQ ID NO: 93930 - protein, 10 aa, Dengue virus
QQLTKRFSLG

SEQ ID NO: 93931 - protein, 10 aa, Dengue virus
GLVKRFSIGL

SEQ ID NO: 93932 - protein, 10 aa, Dengue virus
LTKRFSLGML

SEQ ID NO: 93933 - protein, 10 aa, Dengue virus
TKRFSLGMLQ

SEQ ID NO: 93934 - protein, 10 aa, Dengue virus
KRFSLGMLQG

SEQ ID NO: 93935 - protein, 10 aa, Dengue virus
RFSLGMLQGR

SEQ ID NO: 93936 - protein, 10 aa, Dengue virus
FSLGMLQGRG

SEQ ID NO: 93937 - protein, 10 aa, Dengue virus
SIGLFSGKGP

SEQ ID NO: 93938 - protein, 10 aa, Dengue virus
IGLFSGKGPL

SEQ ID NO: 93939 - protein, 10 aa, Dengue virus
GTIKKSKAIN

SEQ ID NO: 93940 - protein, 10 aa, Dengue virus
TIKKSKAINV

SEQ ID NO: 93941 - protein, 10 aa, Dengue virus
LKKTKAIKIL

SEQ ID NO: 93942 - protein, 10 aa, Dengue virus
KKSKAINVLR

SEQ ID NO: 93943 - protein, 10 aa, Dengue virus
KSKAINVLRG

SEQ ID NO: 93944 - protein, 10 aa, Dengue virus
SKAINVLRGF

SEQ ID NO: 93945 - protein, 10 aa, Dengue virus
KAINVLRGFR

SEQ ID NO: 93946 - protein, 10 aa, Dengue virus
AINVLRGFRK

SEQ ID NO: 93947 - protein, 10 aa, Dengue virus
INVLRGFRKE

SEQ ID NO: 93948 - protein, 10 aa, Dengue virus
NVLRGFRKEI

SEQ ID NO: 93949 - protein, 10 aa, Dengue virus
RMLNILNRRK

SEQ ID NO: 93950 - protein, 10 aa, Dengue virus
MLNILNGRRR

SEQ ID NO: 93951 - protein, 10 aa, Dengue virus
LNILNRRRRT

SEQ ID NO: 93952 - protein, 10 aa, Dengue virus
NILNRRRRTA

SEQ ID NO: 93953 - protein, 10 aa, Dengue virus
RRRTAGMIIM

SEQ ID NO: 93954 - protein, 10 aa, Dengue virus
RRTAGMIIML

SEQ ID NO: 93955 - protein, 10 aa, Dengue virus
RTAGMIIMLI

SEQ ID NO: 93956 - protein, 10 aa, Dengue virus
TAGMIIMLIP

SEQ ID NO: 93957 - protein, 10 aa, Dengue virus
AGMIIMLIPT

SEQ ID NO: 93958 - protein, 10 aa, Dengue virus
MIIMLIPTVM

SEQ ID NO: 93959 - protein, 10 aa, Dengue virus
IIMLIPTVMA

SEQ ID NO: 93960 - protein, 10 aa, Dengue virus
IMLIPTVMAF

SEQ ID NO: 93961 - protein, 10 aa, Dengue virus
CLIPTIMAFH

SEQ ID NO: 93962 - protein, 10 aa, Dengue virus
LIPTIMAFHL

SEQ ID NO: 93963 - protein, 10 aa, Dengue virus
IPTIMAFHLS

SEQ ID NO: 93964 - protein, 10 aa, Dengue virus
PTIMAFHLST

SEQ ID NO: 93965 - protein, 10 aa, Dengue virus
TIMAFHLSTR

SEQ ID NO: 93966 - protein, 10 aa, Dengue virus
IMAFHLSTRD

SEQ ID NO: 93967 - protein, 10 aa, Dengue virus
TVTYECPLLV

SEQ ID NO: 93968 - protein, 10 aa, Dengue virus
ITYKCPLLRQ

SEQ ID NO: 93969 - protein, 10 aa, Dengue virus
TYKCPLLRQN

SEQ ID NO: 93970 - protein, 10 aa, Dengue virus
YECPLLVNTE

SEQ ID NO: 93971 - protein, 10 aa, Dengue virus
KCPLLRQNEP

SEQ ID NO: 93972 - protein, 10 aa, Dengue virus
MIGQTRIQRT

SEQ ID NO: 93973 - protein, 10 aa, Dengue virus
IGQTGIQRAV

SEQ ID NO: 93974 - protein, 10 aa, Dengue virus
GQTGIQRAVF

SEQ ID NO: 93975 - protein, 10 aa, Dengue virus
QTGIQRTIFF

SEQ ID NO: 93976 - protein, 10 aa, Dengue virus
TGIQRTIFFV

SEQ ID NO: 93977 - protein, 10 aa, Dengue virus
GIQRTIFFVL

SEQ ID NO: 93978 - protein, 10 aa, Dengue virus
IQRTIFFVLM

SEQ ID NO: 93979 - protein, 10 aa, Dengue virus
QRAVFFVLMM

SEQ ID NO: 93980 - protein, 10 aa, Dengue virus
RTIFFVLMML

SEQ ID NO: 93981 - protein, 10 aa, Dengue virus
TIFFVLMMLV

SEQ ID NO: 93982 - protein, 10 aa, Dengue virus
DRQYICRRDV

SEQ ID NO: 93983 - protein, 10 aa, Dengue virus
QQYICRRNVV

SEQ ID NO: 93984 - protein, 10 aa, Dengue virus
NDTSNHGVTT

SEQ ID NO: 93985 - protein, 10 aa, Dengue virus
DIPNHGVTAT

SEQ ID NO: 93986 - protein, 10 aa, Dengue virus
IPNHGVTATI

SEQ ID NO: 93987 - protein, 10 aa, Dengue virus
GKHGKEIKIT

SEQ ID NO: 93988 - protein, 10 aa, Dengue virus
KHGKEIKITP

SEQ ID NO: 93989 - protein, 10 aa, Dengue virus
HGKEIKITPQ

SEQ ID NO: 93990 - protein, 10 aa, Dengue virus
GVTATITPRT

SEQ ID NO: 93991 - protein, 10 aa, Dengue virus
KEIKITPQSS

SEQ ID NO: 93992 - protein, 10 aa, Dengue virus
TATITPRTPS

SEQ ID NO: 93993 - protein, 10 aa, Dengue virus
ATITPRTPSV

SEQ ID NO: 93994 - protein, 10 aa, Dengue virus
TITPRTPSVE

SEQ ID NO: 93995 - protein, 10 aa, Dengue virus
TPRTPSVEVK

SEQ ID NO: 93996 - protein, 10 aa, Dengue virus
PRSPSVEVEL

SEQ ID NO: 93997 - protein, 10 aa, Dengue virus
QSSITEAELT

SEQ ID NO: 93998 - protein, 10 aa, Dengue virus
SSITEAELTG

SEQ ID NO: 93999 - protein, 10 aa, Dengue virus
PSAEVKLPDY

SEQ ID NO: 94000 - protein, 10 aa, Dengue virus
SVEVQLPDYG

SEQ ID NO: 94001 - protein, 10 aa, Dengue virus
VEVQLPDYGE

SEQ ID NO: 94002 - protein, 10 aa, Dengue virus
LDFNEMVLLQ

SEQ ID NO: 94003 - protein, 10 aa, Dengue virus
DFNEMILMRM

SEQ ID NO: 94004 - protein, 10 aa, Dengue virus
FNEMILMRMK

SEQ ID NO: 94005 - protein, 10 aa, Dengue virus
MKTKTWLVHK

SEQ ID NO: 94006 - protein, 10 aa, Dengue virus
ENKAWLVHRQ

SEQ ID NO: 94007 - protein, 10 aa, Dengue virus
FLDLPLPWLP

SEQ ID NO: 94008 - protein, 10 aa, Dengue virus
LDLPLPWLPG

SEQ ID NO: 94009 - protein, 10 aa, Dengue virus
DLPLPWLPGA

SEQ ID NO: 94010 - protein, 10 aa, Dengue virus
LPLPWLPGAD

SEQ ID NO: 94011 - protein, 10 aa, Dengue virus
PLPWLPGADT

SEQ ID NO: 94012 - protein, 10 aa, Dengue virus
LPWTAGADTL

SEQ ID NO: 94013 - protein, 10 aa, Dengue virus
PWLPGADTQG

SEQ ID NO: 94014 - protein, 10 aa, Dengue virus
WTAGADTLEV

SEQ ID NO: 94015 - protein, 10 aa, Dengue virus
LPGADTQGSN

SEQ ID NO: 94016 - protein, 10 aa, Dengue virus
AGADTLEVHW

SEQ ID NO: 94017 - protein, 10 aa, Dengue virus
ADTQGSNWIQ

SEQ ID NO: 94018 - protein, 10 aa, Dengue virus
DTQGSNWIQK

SEQ ID NO: 94019 - protein, 10 aa, Dengue virus
TLEVHWNHKE

SEQ ID NO: 94020 - protein, 10 aa, Dengue virus
LEVHWNHKER

SEQ ID NO: 94021 - protein, 10 aa, Dengue virus
TVIKVKYEGA

SEQ ID NO: 94022 - protein, 10 aa, Dengue virus
YEGDGSPCKI

SEQ ID NO: 94023 - protein, 10 aa, Dengue virus
EGAGAPCKIP

SEQ ID NO: 94024 - protein, 10 aa, Dengue virus
GDGSPCKIPF

SEQ ID NO: 94025 - protein, 10 aa, Dengue virus
AGAPCKIPIE

SEQ ID NO: 94026 - protein, 10 aa, Dengue virus
IEIRDVNKER

SEQ ID NO: 94027 - protein, 10 aa, Dengue virus
EIRDVNKERV

SEQ ID NO: 94028 - protein, 10 aa, Dengue virus
IMDLEKRHVL

SEQ ID NO: 94029 - protein, 10 aa, Dengue virus
MDLEKRHVLG

SEQ ID NO: 94030 - protein, 10 aa, Dengue virus
DLEKRHVLGR

SEQ ID NO: 94031 - protein, 10 aa, Dengue virus
VTEKDSPVNI

SEQ ID NO: 94032 - protein, 10 aa, Dengue virus
TEKDSPVNIE

SEQ ID NO: 94033 - protein, 10 aa, Dengue virus
YTNSVTNIEL

SEQ ID NO: 94034 - protein, 10 aa, Dengue virus
GDSYIIIGVG

SEQ ID NO: 94035 - protein, 10 aa, Dengue virus
DSYIMIGVGN

SEQ ID NO: 94036 - protein, 10 aa, Dengue virus
SYIMIGVGNS

SEQ ID NO: 94037 - protein, 10 aa, Dengue virus
YIIIGVEPGQ

SEQ ID NO: 94038 - protein, 10 aa, Dengue virus
IIIGVEPGQL

SEQ ID NO: 94039 - protein, 10 aa, Dengue virus
IIGVEPGQLK

SEQ ID NO: 94040 - protein, 10 aa, Dengue virus
VRILIGLLVL

SEQ ID NO: 94041 - protein, 10 aa, Dengue virus
FLGFTVRADM

SEQ ID NO: 94042 - protein, 10 aa, Dengue virus
LGFTVQADVG

SEQ ID NO: 94043 - protein, 10 aa, Dengue virus
GFTVQADTGC

SEQ ID NO: 94044 - protein, 10 aa, Dengue virus
SWNGRELKCG

SEQ ID NO: 94045 - protein, 10 aa, Dengue virus
WNGRELKCGS

SEQ ID NO: 94046 - protein, 10 aa, Dengue virus
NGRELKCGSG

SEQ ID NO: 94047 - protein, 10 aa, Dengue virus
LKCGSGIFVT

SEQ ID NO: 94048 - protein, 10 aa, Dengue virus
KCGSGIFVTD

SEQ ID NO: 94049 - protein, 10 aa, Dengue virus
CGSGIFVTDN

SEQ ID NO: 94050 - protein, 10 aa, Dengue virus
GSGIFVTDNV

SEQ ID NO: 94051 - protein, 10 aa, Dengue virus
SGIFVADNVH

SEQ ID NO: 94052 - protein, 10 aa, Dengue virus
GIFVTDNVHT

SEQ ID NO: 94053 - protein, 10 aa, Dengue virus
IFVADNVHTW

SEQ ID NO: 94054 - protein, 10 aa, Dengue virus
FVTDNVHTWT

SEQ ID NO: 94055 - protein, 10 aa, Dengue virus
VTDNVHTWTE

SEQ ID NO: 94056 - protein, 10 aa, Dengue virus
ADNVHTWTEQ

SEQ ID NO: 94057 - protein, 10 aa, Dengue virus
NAHKDGVCGV

SEQ ID NO: 94058 - protein, 10 aa, Dengue virus
DLTVVTGDVK

SEQ ID NO: 94059 - protein, 10 aa, Dengue virus
LTIVAGDVKG

SEQ ID NO: 94060 - protein, 10 aa, Dengue virus
TVVTGDVKGV

SEQ ID NO: 94061 - protein, 10 aa, Dengue virus
IVAGDVKGVL

SEQ ID NO: 94062 - protein, 10 aa, Dengue virus
VAGDVKGVLV

SEQ ID NO: 94063 - protein, 10 aa, Dengue virus
AGDVKGVLVK

SEQ ID NO: 94064 - protein, 10 aa, Dengue virus
GDAKGVLTKG

SEQ ID NO: 94065 - protein, 10 aa, Dengue virus
DAKGVLTKGK

SEQ ID NO: 94066 - protein, 10 aa, Dengue virus
VKGVLVKGKR

SEQ ID NO: 94067 - protein, 10 aa, Dengue virus
RGVLTKGKRA

SEQ ID NO: 94068 - protein, 10 aa, Dengue virus
GVLTKGKRTL

SEQ ID NO: 94069 - protein, 10 aa, Dengue virus
VLTKGKRALA

SEQ ID NO: 94070 - protein, 10 aa, Dengue virus
LTKGKRALAP

SEQ ID NO: 94071 - protein, 10 aa, Dengue virus
TKGKRALAPP

SEQ ID NO: 94072 - protein, 10 aa, Dengue virus
KGKRALAPPA

SEQ ID NO: 94073 - protein, 10 aa, Dengue virus
LAPPVNDLKY

SEQ ID NO: 94074 - protein, 10 aa, Dengue virus
APPVNDLKYS

SEQ ID NO: 94075 - protein, 10 aa, Dengue virus
GKAKIFTPEV

SEQ ID NO: 94076 - protein, 10 aa, Dengue virus
PNERRAWNFF

SEQ ID NO: 94077 - protein, 10 aa, Dengue virus
NERRAWNFFE

SEQ ID NO: 94078 - protein, 10 aa, Dengue virus
ERRAWNFFEV

SEQ ID NO: 94079 - protein, 10 aa, Dengue virus
RRAWNFFEVE

SEQ ID NO: 94080 - protein, 10 aa, Dengue virus
RAWNFFEVED

SEQ ID NO: 94081 - protein, 10 aa, Dengue virus
AWNFFEVEDY

SEQ ID NO: 94082 - protein, 10 aa, Dengue virus
WNFFEVEDYG

SEQ ID NO: 94083 - protein, 10 aa, Dengue virus
NFFEVEDYGF

SEQ ID NO: 94084 - protein, 10 aa, Dengue virus
FFEVEDYGFG

SEQ ID NO: 94085 - protein, 10 aa, Dengue virus
LIPKAYAGPI

SEQ ID NO: 94086 - protein, 10 aa, Dengue virus
IPKAYAGPIS

SEQ ID NO: 94087 - protein, 10 aa, Dengue virus
PKSYAGPFSH

SEQ ID NO: 94088 - protein, 10 aa, Dengue virus
KSYAGPFSHH

SEQ ID NO: 94089 - protein, 10 aa, Dengue virus
AYAGPISQHN

SEQ ID NO: 94090 - protein, 10 aa, Dengue virus
YRQGYATQIA

SEQ ID NO: 94091 - protein, 10 aa, Dengue virus
RQGYATQIAG

SEQ ID NO: 94092 - protein, 10 aa, Dengue virus
QGYATQIAGP

SEQ ID NO: 94093 - protein, 10 aa, Dengue virus
GYATQIAGPW

SEQ ID NO: 94094 - protein, 10 aa, Dengue virus
YATQIAGPWH

SEQ ID NO: 94095 - protein, 10 aa, Dengue virus
ATQIAGPWHL

SEQ ID NO: 94096 - protein, 10 aa, Dengue virus
TQIAGPWHLG

SEQ ID NO: 94097 - protein, 10 aa, Dengue virus
QIAGPWHLGK

SEQ ID NO: 94098 - protein, 10 aa, Dengue virus
IAGPWHLGKL

SEQ ID NO: 94099 - protein, 10 aa, Dengue virus
CPGTTVTVRE

SEQ ID NO: 94100 - protein, 10 aa, Dengue virus
PGTTVTIQDD

SEQ ID NO: 94101 - protein, 10 aa, Dengue virus
GTTVTIQDDC

SEQ ID NO: 94102 - protein, 10 aa, Dengue virus
QEDCGHRGSS

SEQ ID NO: 94103 - protein, 10 aa, Dengue virus
EDCGHRGSSL

SEQ ID NO: 94104 - protein, 10 aa, Dengue virus
LNEKEENMVR

SEQ ID NO: 94105 - protein, 10 aa, Dengue virus
NEKEENMVRS

SEQ ID NO: 94106 - protein, 10 aa, Dengue virus
KEENMVRSQV

SEQ ID NO: 94107 - protein, 10 aa, Dengue virus
EENMVRSQVT

SEQ ID NO: 94108 - protein, 10 aa, Dengue virus
ENMVKSQATA

SEQ ID NO: 94109 - protein, 10 aa, Dengue virus
NMVKSQATAG

SEQ ID NO: 94110 - protein, 10 aa, Dengue virus
GTPETFSMGL

SEQ ID NO: 94111 - protein, 10 aa, Dengue virus
TPETFSMGLL

SEQ ID NO: 94112 - protein, 10 aa, Dengue virus
RKHMILVVAI

SEQ ID NO: 94113 - protein, 10 aa, Dengue virus
KHMILVVAIT

SEQ ID NO: 94114 - protein, 10 aa, Dengue virus
TTFCAIILGG

SEQ ID NO: 94115 - protein, 10 aa, Dengue virus
MLGDTMSSRM

SEQ ID NO: 94116 - protein, 10 aa, Dengue virus
LGDTMFGRMG

SEQ ID NO: 94117 - protein, 10 aa, Dengue virus
GDTMSSRMGG

SEQ ID NO: 94118 - protein, 10 aa, Dengue virus
DTMFGRMGGQ

SEQ ID NO: 94119 - protein, 10 aa, Dengue virus
RVGGQTHLAI

SEQ ID NO: 94120 - protein, 10 aa, Dengue virus
VGGQTHLAIM

SEQ ID NO: 94121 - protein, 10 aa, Dengue virus
GGQTHLAIMI

SEQ ID NO: 94122 - protein, 10 aa, Dengue virus
GQTHLAIMIV

SEQ ID NO: 94123 - protein, 10 aa, Dengue virus
QTHLAIMIVF

SEQ ID NO: 94124 - protein, 10 aa, Dengue virus
THLAIMIVFK

SEQ ID NO: 94125 - protein, 10 aa, Dengue virus
VIGMAMTTTF

SEQ ID NO: 94126 - protein, 10 aa, Dengue virus
IGMAMTTTFS

SEQ ID NO: 94127 - protein, 10 aa, Dengue virus
GMAMTTTFSI

SEQ ID NO: 94128 - protein, 10 aa, Dengue virus
MAMTTTFSIP

SEQ ID NO: 94129 - protein, 10 aa, Dengue virus
AMTTTFSIPH

SEQ ID NO: 94130 - protein, 10 aa, Dengue virus
MTTTFSIPHD

SEQ ID NO: 94131 - protein, 10 aa, Dengue virus
TTTFSIPHDL

SEQ ID NO: 94132 - protein, 10 aa, Dengue virus
TTFSIPHDLM

SEQ ID NO: 94133 - protein, 10 aa, Dengue virus
TFSIPHDLME

SEQ ID NO: 94134 - protein, 10 aa, Dengue virus
IALGLILLKM

SEQ ID NO: 94135 - protein, 10 aa, Dengue virus
GLILLKMVVH

SEQ ID NO: 94136 - protein, 10 aa, Dengue virus
LILLKMVVHF

SEQ ID NO: 94137 - protein, 10 aa, Dengue virus
ILLKTVTQFD

SEQ ID NO: 94138 - protein, 10 aa, Dengue virus
VVHFDNAQLG

SEQ ID NO: 94139 - protein, 10 aa, Dengue virus
VHFDNAQLGT

SEQ ID NO: 94140 - protein, 10 aa, Dengue virus
HFDNAQLGTL

SEQ ID NO: 94141 - protein, 10 aa, Dengue virus
NAQLGTLALS

SEQ ID NO: 94142 - protein, 10 aa, Dengue virus
LALSLTFISS

SEQ ID NO: 94143 - protein, 10 aa, Dengue virus
ALALTFIKST

SEQ ID NO: 94144 - protein, 10 aa, Dengue virus
PLTMAWRTIM

SEQ ID NO: 94145 - protein, 10 aa, Dengue virus
IPVTMALWYM

SEQ ID NO: 94146 - protein, 10 aa, Dengue virus
PVTMALWYMW

SEQ ID NO: 94147 - protein, 10 aa, Dengue virus
VTMALWYMWQ

SEQ ID NO: 94148 - protein, 10 aa, Dengue virus
MALWYMWQVK

SEQ ID NO: 94149 - protein, 10 aa, Dengue virus
ALWYMWQVKT

SEQ ID NO: 94150 - protein, 10 aa, Dengue virus
WDVPSPATAQ

SEQ ID NO: 94151 - protein, 10 aa, Dengue virus
DVPSPATAQK

SEQ ID NO: 94152 - protein, 10 aa, Dengue virus
VPSPATAQKA

SEQ ID NO: 94153 - protein, 10 aa, Dengue virus
AQKATLTEGV

SEQ ID NO: 94154 - protein, 10 aa, Dengue virus
QKATLTEGVY

SEQ ID NO: 94155 - protein, 10 aa, Dengue virus
KTQVGVGIHT

SEQ ID NO: 94156 - protein, 10 aa, Dengue virus
FMTATPPGST

SEQ ID NO: 94157 - protein, 10 aa, Dengue virus
MTATPPGSTD

SEQ ID NO: 94158 - protein, 10 aa, Dengue virus
TATPPGSTDP

SEQ ID NO: 94159 - protein, 10 aa, Dengue virus
ATPPGSTDPF

SEQ ID NO: 94160 - protein, 10 aa, Dengue virus
TPPGSTDPFP

SEQ ID NO: 94161 - protein, 10 aa, Dengue virus
PPGSTDPFPQ

SEQ ID NO: 94162 - protein, 10 aa, Dengue virus
PGSTDPFPQS

SEQ ID NO: 94163 - protein, 10 aa, Dengue virus
GSTDPFPQSN

SEQ ID NO: 94164 - protein, 10 aa, Dengue virus
STDPFPQSNS

SEQ ID NO: 94165 - protein, 10 aa, Dengue virus
ASLPAYLSSR

SEQ ID NO: 94166 - protein, 10 aa, Dengue virus
SLPAYLSSRA

SEQ ID NO: 94167 - protein, 10 aa, Dengue virus
MGKLSMGLIT

SEQ ID NO: 94168 - protein, 10 aa, Dengue virus
LSVGLIAIAV

SEQ ID NO: 94169 - protein, 10 aa, Dengue virus
SVGLIAIAVA

SEQ ID NO: 94170 - protein, 10 aa, Dengue virus
VGLIAIAVAS

SEQ ID NO: 94171 - protein, 10 aa, Dengue virus
ITIAVASGLF

SEQ ID NO: 94172 - protein, 10 aa, Dengue virus
TIAVASGLFW

SEQ ID NO: 94173 - protein, 10 aa, Dengue virus
IAVASGLLWI

SEQ ID NO: 94174 - protein, 10 aa, Dengue virus
AVASGLLWIA

SEQ ID NO: 94175 - protein, 10 aa, Dengue virus
VASGLLWIAE

SEQ ID NO: 94176 - protein, 10 aa, Dengue virus
ASGLLWVAEL

SEQ ID NO: 94177 - protein, 10 aa, Dengue virus
SGLLWVAELQ

SEQ ID NO: 94178 - protein, 10 aa, Dengue virus
GLLWVAELQP

SEQ ID NO: 94179 - protein, 10 aa, Dengue virus
LLWVAELQPQ

SEQ ID NO: 94180 - protein, 10 aa, Dengue virus
LWVAELQPQW

SEQ ID NO: 94181 - protein, 10 aa, Dengue virus
VILALLTIIS

SEQ ID NO: 94182 - protein, 10 aa, Dengue virus
ILALLTIISL

SEQ ID NO: 94183 - protein, 10 aa, Dengue virus
ILAIIGLIAA

SEQ ID NO: 94184 - protein, 10 aa, Dengue virus
LTIISLIAAN

SEQ ID NO: 94185 - protein, 10 aa, Dengue virus
AIIGLIAANE

SEQ ID NO: 94186 - protein, 10 aa, Dengue virus
TKTDFGFYQE

SEQ ID NO: 94187 - protein, 10 aa, Dengue virus
KADFGFYQVK

SEQ ID NO: 94188 - protein, 10 aa, Dengue virus
TDFGFYQEKT

SEQ ID NO: 94189 - protein, 10 aa, Dengue virus
DFGFYQVKAE

SEQ ID NO: 94190 - protein, 10 aa, Dengue virus
FGFYQVKTEI

SEQ ID NO: 94191 - protein, 10 aa, Dengue virus
GFYQVKTEIT

SEQ ID NO: 94192 - protein, 10 aa, Dengue virus
FYQVKAETTI

SEQ ID NO: 94193 - protein, 10 aa, Dengue virus
YQVKAETTIL

SEQ ID NO: 94194 - protein, 10 aa, Dengue virus
QVKTEITILD

SEQ ID NO: 94195 - protein, 10 aa, Dengue virus
EKPETTILDV

SEQ ID NO: 94196 - protein, 10 aa, Dengue virus
TLTASLVMLF

SEQ ID NO: 94197 - protein, 10 aa, Dengue virus
LTASLAMLLV

SEQ ID NO: 94198 - protein, 10 aa, Dengue virus
TASLVMLFVH

SEQ ID NO: 94199 - protein, 10 aa, Dengue virus
VLTLSTGPAL

SEQ ID NO: 94200 - protein, 10 aa, Dengue virus
LTLATGPTLT

SEQ ID NO: 94201 - protein, 10 aa, Dengue virus
TLATGPTLTL

SEQ ID NO: 94202 - protein, 10 aa, Dengue virus
LATGPTLTLW

SEQ ID NO: 94203 - protein, 10 aa, Dengue virus
STGPALTLWE

SEQ ID NO: 94204 - protein, 10 aa, Dengue virus
TGPALTLWEG

SEQ ID NO: 94205 - protein, 10 aa, Dengue virus
GPTLTLWEGN

SEQ ID NO: 94206 - protein, 10 aa, Dengue virus
PTLTLWEGNP

SEQ ID NO: 94207 - protein, 10 aa, Dengue virus
ALTLWEGGPG

SEQ ID NO: 94208 - protein, 10 aa, Dengue virus
AFSLIKNTQT

SEQ ID NO: 94209 - protein, 10 aa, Dengue virus
FSLIKNTQTP

SEQ ID NO: 94210 - protein, 10 aa, Dengue virus
SLIKNTQTPR

SEQ ID NO: 94211 - protein, 10 aa, Dengue virus
LIKNTQTPRR

SEQ ID NO: 94212 - protein, 10 aa, Dengue virus
IKNAQAPRRG

SEQ ID NO: 94213 - protein, 10 aa, Dengue virus
KNTQTPRRGT

SEQ ID NO: 94214 - protein, 10 aa, Dengue virus
NAQAPRRGTG

SEQ ID NO: 94215 - protein, 10 aa, Dengue virus
AQAPRRGTGT

SEQ ID NO: 94216 - protein, 10 aa, Dengue virus
KSALRDGSKT

SEQ ID NO: 94217 - protein, 10 aa, Dengue virus
SALRDGSKTK

SEQ ID NO: 94218 - protein, 10 aa, Dengue virus
ALKDGSKIKY

SEQ ID NO: 94219 - protein, 10 aa, Dengue virus
LKDGSKIKYA

SEQ ID NO: 94220 - protein, 10 aa, Dengue virus
KDGSKIKYAV

SEQ ID NO: 94221 - protein, 10 aa, Dengue virus
EKLQRKYGGS

SEQ ID NO: 94222 - protein, 10 aa, Dengue virus
KLQRKYGGSL

SEQ ID NO: 94223 - protein, 10 aa, Dengue virus
LQRKHGGSLI

SEQ ID NO: 94224 - protein, 10 aa, Dengue virus
QRKHGGSLIR

SEQ ID NO: 94225 - protein, 10 aa, Dengue virus
RKHGGSLIRC

SEQ ID NO: 94226 - protein, 10 aa, Dengue virus
KHGGSLIRCP

SEQ ID NO: 94227 - protein, 10 aa, Dengue virus
YGGNLIRCPL

SEQ ID NO: 94228 - protein, 10 aa, Dengue virus
TPQPKPGTQM

SEQ ID NO: 94229 - protein, 10 aa, Dengue virus
PQPKPGTQMI

SEQ ID NO: 94230 - protein, 10 aa, Dengue virus
QPKPGTQMIM

SEQ ID NO: 94231 - protein, 10 aa, Dengue virus
PKLGTRVVMT

SEQ ID NO: 94232 - protein, 10 aa, Dengue virus
KLGTRVVMTT

SEQ ID NO: 94233 - protein, 10 aa, Dengue virus
PGTQMIMTTT

SEQ ID NO: 94234 - protein, 10 aa, Dengue virus
GTQMIMTTTA

SEQ ID NO: 94235 - protein, 10 aa, Dengue virus
TQMIMTTTAN

SEQ ID NO: 94236 - protein, 10 aa, Dengue virus
QMIMTTTANW

SEQ ID NO: 94237 - protein, 10 aa, Dengue virus
LLGKKKTPRL

SEQ ID NO: 94238 - protein, 10 aa, Dengue virus
LGKKKTPRLC

SEQ ID NO: 94239 - protein, 10 aa, Dengue virus
GKKKTPRLCT

SEQ ID NO: 94240 - protein, 10 aa, Dengue virus
KKSPRLCTKE

SEQ ID NO: 94241 - protein, 10 aa, Dengue virus
KSPRLCTKEE

SEQ ID NO: 94242 - protein, 10 aa, Dengue virus
TPRLCTREEF

SEQ ID NO: 94243 - protein, 10 aa, Dengue virus
DIDKKDGDLM

SEQ ID NO: 94244 - protein, 10 aa, Dengue virus
LRERVEKWLK

SEQ ID NO: 94245 - protein, 10 aa, Dengue virus
KEKVEKWLKE

SEQ ID NO: 94246 - protein, 10 aa, Dengue virus
EYMDYMPVMK

SEQ ID NO: 94247 - protein, 10 aa, Dengue virus
YMDYMPVMKR

SEQ ID NO: 94248 - protein, 10 aa, Dengue virus
ADYMPVMKRY

SEQ ID NO: 94249 - protein, 10 aa, Dengue virus
MPVMKRYSAH

SEQ ID NO: 94250 - protein, 10 aa, Dengue virus
RYSAHFESEG

SEQ ID NO: 94251 - protein, 10 aa, Dengue virus
YSAHFESEGV

SEQ ID NO: 94252 - protein, 10 aa, Dengue virus
SAHFESEGVL

SEQ ID NO: 94253 - protein, 10 aa, Dengue virus
KKTKAIKILT

SEQ ID NO: 94254 - protein, 10 aa, Dengue virus
KTKAIKILTG

SEQ ID NO: 94255 - protein, 10 aa, Dengue virus
TKAIKILTGF

SEQ ID NO: 94256 - protein, 10 aa, Dengue virus
LNILNRRKRS

SEQ ID NO: 94257 - protein, 10 aa, Dengue virus
NILNRRKRST

SEQ ID NO: 94258 - protein, 10 aa, Dengue virus
RKRSTVTLLC

SEQ ID NO: 94259 - protein, 10 aa, Dengue virus
KRSTVTLLCL

SEQ ID NO: 94260 - protein, 10 aa, Dengue virus
MLIPTVMAFH

SEQ ID NO: 94261 - protein, 10 aa, Dengue virus
IPTVMAFHLT

SEQ ID NO: 94262 - protein, 10 aa, Dengue virus
PTVMAFHLTT

SEQ ID NO: 94263 - protein, 10 aa, Dengue virus
TVMAFHLTTR

SEQ ID NO: 94264 - protein, 10 aa, Dengue virus
VMAFHLTTRN

SEQ ID NO: 94265 - protein, 10 aa, Dengue virus
IGQTGIQRTI

SEQ ID NO: 94266 - protein, 10 aa, Dengue virus
TRIQRTVFFV

SEQ ID NO: 94267 - protein, 10 aa, Dengue virus
GIQRAVFFVL

SEQ ID NO: 94268 - protein, 10 aa, Dengue virus
DTGKHGKEIK

SEQ ID NO: 94269 - protein, 10 aa, Dengue virus
TGKHGKEIKI

SEQ ID NO: 94270 - protein, 10 aa, Dengue virus
PNHGVTATIT

SEQ ID NO: 94271 - protein, 10 aa, Dengue virus
GKEIKITPQS

SEQ ID NO: 94272 - protein, 10 aa, Dengue virus
VTATITPRTP

SEQ ID NO: 94273 - protein, 10 aa, Dengue virus
EIKITPQSSI

SEQ ID NO: 94274 - protein, 10 aa, Dengue virus
IKITPQSSIT

SEQ ID NO: 94275 - protein, 10 aa, Dengue virus
TPRSPSAEVK

SEQ ID NO: 94276 - protein, 10 aa, Dengue virus
PRSPSVEVQL

SEQ ID NO: 94277 - protein, 10 aa, Dengue virus
RSPSVEVQLP

SEQ ID NO: 94278 - protein, 10 aa, Dengue virus
SPSAEVKLPD

SEQ ID NO: 94279 - protein, 10 aa, Dengue virus
FNEMVLLQME

SEQ ID NO: 94280 - protein, 10 aa, Dengue virus
LPWLPGADTQ

SEQ ID NO: 94281 - protein, 10 aa, Dengue virus
PWTAGADTLE

SEQ ID NO: 94282 - protein, 10 aa, Dengue virus
WLPGADTQGS

SEQ ID NO: 94283 - protein, 10 aa, Dengue virus
TAGADTLEVH

SEQ ID NO: 94284 - protein, 10 aa, Dengue virus
IKDMNKEKVV

SEQ ID NO: 94285 - protein, 10 aa, Dengue virus
KDMNKEKVVG

SEQ ID NO: 94286 - protein, 10 aa, Dengue virus
DVNKERVVGR

SEQ ID NO: 94287 - protein, 10 aa, Dengue virus
AEYTNSVTNI

SEQ ID NO: 94288 - protein, 10 aa, Dengue virus
EYTNSVTNIE

SEQ ID NO: 94289 - protein, 10 aa, Dengue virus
EKDSPVNIEA

SEQ ID NO: 94290 - protein, 10 aa, Dengue virus
DSYIVIGAGD

SEQ ID NO: 94291 - protein, 10 aa, Dengue virus
SYIIIGVGDS

SEQ ID NO: 94292 - protein, 10 aa, Dengue virus
YIVIGAGDSA

SEQ ID NO: 94293 - protein, 10 aa, Dengue virus
IIIGVGDSAL

SEQ ID NO: 94294 - protein, 10 aa, Dengue virus
IIGVGDSALT

SEQ ID NO: 94295 - protein, 10 aa, Dengue virus
MKILIGVIIT

SEQ ID NO: 94296 - protein, 10 aa, Dengue virus
FLGFTVQADT

SEQ ID NO: 94297 - protein, 10 aa, Dengue virus
LGFTVQADTG

SEQ ID NO: 94298 - protein, 10 aa, Dengue virus
GFTVRADMGC

SEQ ID NO: 94299 - protein, 10 aa, Dengue virus
SWTGKELKCG

SEQ ID NO: 94300 - protein, 10 aa, Dengue virus
WTGKELKCGS

SEQ ID NO: 94301 - protein, 10 aa, Dengue virus
TGKELKCGSG

SEQ ID NO: 94302 - protein, 10 aa, Dengue virus
VTGDVKGVLT

SEQ ID NO: 94303 - protein, 10 aa, Dengue virus
TGDVKGVLTK

SEQ ID NO: 94304 - protein, 10 aa, Dengue virus
KGVLTKGKRT

SEQ ID NO: 94305 - protein, 10 aa, Dengue virus
VLTKGKRTLT

SEQ ID NO: 94306 - protein, 10 aa, Dengue virus
LTKGKRVIAP

SEQ ID NO: 94307 - protein, 10 aa, Dengue virus
TKGKRVIAPP

SEQ ID NO: 94308 - protein, 10 aa, Dengue virus
KGKRTLTPPV

SEQ ID NO: 94309 - protein, 10 aa, Dengue virus
LAPPASDLKY

SEQ ID NO: 94310 - protein, 10 aa, Dengue virus
APPASDLKYS

SEQ ID NO: 94311 - protein, 10 aa, Dengue virus
PKAYAGPISQ

SEQ ID NO: 94312 - protein, 10 aa, Dengue virus
KAYAGPISQH

SEQ ID NO: 94313 - protein, 10 aa, Dengue virus
PGTTVTVQED

SEQ ID NO: 94314 - protein, 10 aa, Dengue virus
GTTVTVREDC

SEQ ID NO: 94315 - protein, 10 aa, Dengue virus
REDCDHRGPS

SEQ ID NO: 94316 - protein, 10 aa, Dengue virus
EENMVKSQAT

SEQ ID NO: 94317 - protein, 10 aa, Dengue virus
ENMVRSQVTA

SEQ ID NO: 94318 - protein, 10 aa, Dengue virus
NMVRSQVTAG

SEQ ID NO: 94319 - protein, 10 aa, Dengue virus
GPSETFSMGL

SEQ ID NO: 94320 - protein, 10 aa, Dengue virus
RKHMILVVVA

SEQ ID NO: 94321 - protein, 10 aa, Dengue virus
KHMILVVVAT

SEQ ID NO: 94322 - protein, 10 aa, Dengue virus
ATLCAIILGG

SEQ ID NO: 94323 - protein, 10 aa, Dengue virus
RIGGQVHLAI

SEQ ID NO: 94324 - protein, 10 aa, Dengue virus
IGGQVHLAIM

SEQ ID NO: 94325 - protein, 10 aa, Dengue virus
VTHFDSTQVG

SEQ ID NO: 94326 - protein, 10 aa, Dengue virus
THFDSTQVGT

SEQ ID NO: 94327 - protein, 10 aa, Dengue virus
HFDSTQVGTL

SEQ ID NO: 94328 - protein, 10 aa, Dengue virus
TDFGFYQVKA

SEQ ID NO: 94329 - protein, 10 aa, Dengue virus
FGFYQVKAET

SEQ ID NO: 94330 - protein, 10 aa, Dengue virus
GFYQVKAETT

SEQ ID NO: 94331 - protein, 10 aa, Dengue virus
FYQEKPETTI

SEQ ID NO: 94332 - protein, 10 aa, Dengue virus
YQVKTEITIL

SEQ ID NO: 94333 - protein, 10 aa, Dengue virus
QVKAETTILD

SEQ ID NO: 94334 - protein, 10 aa, Dengue virus
VKAETTILDV

SEQ ID NO: 94335 - protein, 10 aa, Dengue virus
ALRDGSKTKH

SEQ ID NO: 94336 - protein, 10 aa, Dengue virus
LRDGSKTKHA

SEQ ID NO: 94337 - protein, 10 aa, Dengue virus
RDGSKTKHAV

SEQ ID NO: 94338 - protein, 10 aa, Dengue virus
LQRKYGGNLI

SEQ ID NO: 94339 - protein, 10 aa, Dengue virus
QRKYGGSLVR

SEQ ID NO: 94340 - protein, 10 aa, Dengue virus
RKYGGNLIRC

SEQ ID NO: 94341 - protein, 10 aa, Dengue virus
KYGGNLIRCP

SEQ ID NO: 94342 - protein, 10 aa, Dengue virus
PQPKLGTRVV

SEQ ID NO: 94343 - protein, 10 aa, Dengue virus
QPKLGTRVVM

SEQ ID NO: 94344 - protein, 10 aa, Dengue virus
PKPGTQMIMT

SEQ ID NO: 94345 - protein, 10 aa, Dengue virus
KPGTQMIMTT

SEQ ID NO: 94346 - protein, 10 aa, Dengue virus
LGTRVVMTTT

SEQ ID NO: 94347 - protein, 10 aa, Dengue virus
KKKPRLCTRE

SEQ ID NO: 94348 - protein, 10 aa, Dengue virus
KKPRLCTREE

SEQ ID NO: 94349 - protein, 10 aa, Dengue virus
NPRLCTKEEF

SEQ ID NO: 94350 - protein, 10 aa, Dengue virus
MPAMKRYSAH

SEQ ID NO: 94351 - protein, 10 aa, Dengue virus
RYSAPLESEG

SEQ ID NO: 94352 - protein, 10 aa, Dengue virus
YSAPLESEGV

SEQ ID NO: 94353 - protein, 10 aa, Dengue virus
SAPSENEGVL

SEQ ID NO: 94354 - protein, 11 aa, Dengue virus
MNQRKKVVRPP

SEQ ID NO: 94355 - protein, 11 aa, Dengue virus
NQRKKVVRPPF

SEQ ID NO: 94356 - protein, 11 aa, Dengue virus
QRKKVVRPPFN

SEQ ID NO: 94357 - protein, 11 aa, Dengue virus
RKKVVRPPFNM

SEQ ID NO: 94358 - protein, 11 aa, Dengue virus
KKVVRPPFNML

SEQ ID NO: 94359 - protein, 11 aa, Dengue virus
KVVRPPFNMLK

SEQ ID NO: 94360 - protein, 11 aa, Dengue virus
VVRPPFNMLKR

SEQ ID NO: 94361 - protein, 11 aa, Dengue virus
VRPPFNMLKRE

SEQ ID NO: 94362 - protein, 11 aa, Dengue virus
RPPFNMLKRER

SEQ ID NO: 94363 - protein, 11 aa, Dengue virus
PPFNMLKRERN

SEQ ID NO: 94364 - protein, 11 aa, Dengue virus
PFNMLKRERNR

SEQ ID NO: 94365 - protein, 11 aa, Dengue virus
FNMLKRERNRV

SEQ ID NO: 94366 - protein, 11 aa, Dengue virus
NMLKRERNRVS

SEQ ID NO: 94367 - protein, 11 aa, Dengue virus
MLKRERNRVST

SEQ ID NO: 94368 - protein, 11 aa, Dengue virus
LKRERNRVSTP

SEQ ID NO: 94369 - protein, 11 aa, Dengue virus
KRERNRVSTPQ

SEQ ID NO: 94370 - protein, 11 aa, Dengue virus
RERNRVSTPQG

SEQ ID NO: 94371 - protein, 11 aa, Dengue virus
ERNRVSTPQGL

SEQ ID NO: 94372 - protein, 11 aa, Dengue virus
RNRVSTPQGLV

SEQ ID NO: 94373 - protein, 11 aa, Dengue virus
NRVSTPQGLVK

SEQ ID NO: 94374 - protein, 11 aa, Dengue virus
RVSTPQGLVKR

SEQ ID NO: 94375 - protein, 11 aa, Dengue virus
VSTPQGLVKRF

SEQ ID NO: 94376 - protein, 11 aa, Dengue virus
STPQGLVKRFS

SEQ ID NO: 94377 - protein, 11 aa, Dengue virus
TPQGLVKRFST

SEQ ID NO: 94378 - protein, 11 aa, Dengue virus
PQGLVKRFSTG

SEQ ID NO: 94379 - protein, 11 aa, Dengue virus
QGLVKRFSTGL

SEQ ID NO: 94380 - protein, 11 aa, Dengue virus
GLVKRFSTGLF

SEQ ID NO: 94381 - protein, 11 aa, Dengue virus
LVKRFSTGLFS

SEQ ID NO: 94382 - protein, 11 aa, Dengue virus
VKRFSTGLFSG

SEQ ID NO: 94383 - protein, 11 aa, Dengue virus
KRFSTGLFSGK

SEQ ID NO: 94384 - protein, 11 aa, Dengue virus
RFSTGLFSGKG

SEQ ID NO: 94385 - protein, 11 aa, Dengue virus
FSTGLFSGKGP

SEQ ID NO: 94386 - protein, 11 aa, Dengue virus
STGLFSGKGPL

SEQ ID NO: 94387 - protein, 11 aa, Dengue virus
TGLFSGKGPLR

SEQ ID NO: 94388 - protein, 11 aa, Dengue virus
GLFSGKGPLRM

SEQ ID NO: 94389 - protein, 11 aa, Dengue virus
LFSGKGPLRMV

SEQ ID NO: 94390 - protein, 11 aa, Dengue virus
FSGKGPLRMVL

SEQ ID NO: 94391 - protein, 11 aa, Dengue virus
SGKGPLRMVLA

SEQ ID NO: 94392 - protein, 11 aa, Dengue virus
GKGPLRMVLAF

SEQ ID NO: 94393 - protein, 11 aa, Dengue virus
KGPLRMVLAFI

SEQ ID NO: 94394 - protein, 11 aa, Dengue virus
GPLRMVLAFIT

SEQ ID NO: 94395 - protein, 11 aa, Dengue virus
PLRMVLAFITF

SEQ ID NO: 94396 - protein, 11 aa, Dengue virus
LRMVLAFITFL

SEQ ID NO: 94397 - protein, 11 aa, Dengue virus
RMVLAFITFLR

SEQ ID NO: 94398 - protein, 11 aa, Dengue virus
MVLAFITFLRV

SEQ ID NO: 94399 - protein, 11 aa, Dengue virus
VLAFITFLRVL

SEQ ID NO: 94400 - protein, 11 aa, Dengue virus
LAFITFLRVLS

SEQ ID NO: 94401 - protein, 11 aa, Dengue virus
AFITFLRVLSI

SEQ ID NO: 94402 - protein, 11 aa, Dengue virus
FITFLRVLSIP

SEQ ID NO: 94403 - protein, 11 aa, Dengue virus
ITFLRVLSIPP

SEQ ID NO: 94404 - protein, 11 aa, Dengue virus
TFLRVLSIPPT

SEQ ID NO: 94405 - protein, 11 aa, Dengue virus
FLRVLSIPPTA

SEQ ID NO: 94406 - protein, 11 aa, Dengue virus
LRVLSIPPTAG

SEQ ID NO: 94407 - protein, 11 aa, Dengue virus
RVLSIPPTAGI

SEQ ID NO: 94408 - protein, 11 aa, Dengue virus
VLSIPPTAGIL

SEQ ID NO: 94409 - protein, 11 aa, Dengue virus
LSIPPTAGILK

SEQ ID NO: 94410 - protein, 11 aa, Dengue virus
SIPPTAGILKR

SEQ ID NO: 94411 - protein, 11 aa, Dengue virus
IPPTAGILKRW

SEQ ID NO: 94412 - protein, 11 aa, Dengue virus
PPTAGILKRWG

SEQ ID NO: 94413 - protein, 11 aa, Dengue virus
PTAGILKRWGQ

SEQ ID NO: 94414 - protein, 11 aa, Dengue virus
TAGILKRWGQL

SEQ ID NO: 94415 - protein, 11 aa, Dengue virus
AGILKRWGQLK

SEQ ID NO: 94416 - protein, 11 aa, Dengue virus
GILKRWGQLKK

SEQ ID NO: 94417 - protein, 11 aa, Dengue virus
ILKRWGQLKKN

SEQ ID NO: 94418 - protein, 11 aa, Dengue virus
LKRWGQLKKNK

SEQ ID NO: 94419 - protein, 11 aa, Dengue virus
KRWGQLKKNKA

SEQ ID NO: 94420 - protein, 11 aa, Dengue virus
RWGQLKKNKAI

SEQ ID NO: 94421 - protein, 11 aa, Dengue virus
WGQLKKNKAIK

SEQ ID NO: 94422 - protein, 11 aa, Dengue virus
GQLKKNKAIKI

SEQ ID NO: 94423 - protein, 11 aa, Dengue virus
QLKKNKAIKIL

SEQ ID NO: 94424 - protein, 11 aa, Dengue virus
LKKNKAIKILI

SEQ ID NO: 94425 - protein, 11 aa, Dengue virus
KKNKAIKILIG

SEQ ID NO: 94426 - protein, 11 aa, Dengue virus
KNKAIKILIGF

SEQ ID NO: 94427 - protein, 11 aa, Dengue virus
NKAIKILIGFR

SEQ ID NO: 94428 - protein, 11 aa, Dengue virus
KAIKILIGFRK

SEQ ID NO: 94429 - protein, 11 aa, Dengue virus
AIKILIGFRKE

SEQ ID NO: 94430 - protein, 11 aa, Dengue virus
IKILIGFRKEI

SEQ ID NO: 94431 - protein, 11 aa, Dengue virus
KILIGFRKEIG

SEQ ID NO: 94432 - protein, 11 aa, Dengue virus
ILIGFRKEIGR

SEQ ID NO: 94433 - protein, 11 aa, Dengue virus
LIGFRKEIGRM

SEQ ID NO: 94434 - protein, 11 aa, Dengue virus
IGFRKEIGRML

SEQ ID NO: 94435 - protein, 11 aa, Dengue virus
GFRKEIGRMLN

SEQ ID NO: 94436 - protein, 11 aa, Dengue virus
FRKEIGRMLNI

SEQ ID NO: 94437 - protein, 11 aa, Dengue virus
RKEIGRMLNIL

SEQ ID NO: 94438 - protein, 11 aa, Dengue virus
KEIGRMLNILN

SEQ ID NO: 94439 - protein, 11 aa, Dengue virus
EIGRMLNILNG

SEQ ID NO: 94440 - protein, 11 aa, Dengue virus
IGRMLNILNGR

SEQ ID NO: 94441 - protein, 11 aa, Dengue virus
GRMLNILNGRK

SEQ ID NO: 94442 - protein, 11 aa, Dengue virus
RMLNILNGRKR

SEQ ID NO: 94443 - protein, 11 aa, Dengue virus
MLNILNGRKRS

SEQ ID NO: 94444 - protein, 11 aa, Dengue virus
LNILNGRKRST

SEQ ID NO: 94445 - protein, 11 aa, Dengue virus
RKRSTITLLCL

SEQ ID NO: 94446 - protein, 11 aa, Dengue virus
KRSTITLLCLI

SEQ ID NO: 94447 - protein, 11 aa, Dengue virus
RSTITLLCLIP

SEQ ID NO: 94448 - protein, 11 aa, Dengue virus
STITLLCLIPT

SEQ ID NO: 94449 - protein, 11 aa, Dengue virus
TLLCLIPTVMA

SEQ ID NO: 94450 - protein, 11 aa, Dengue virus
LLCLIPTVMAF

SEQ ID NO: 94451 - protein, 11 aa, Dengue virus
LCLIPTVMAFH

SEQ ID NO: 94452 - protein, 11 aa, Dengue virus
CLIPTVMAFHL

SEQ ID NO: 94453 - protein, 11 aa, Dengue virus
LIPTVMAFHLS

SEQ ID NO: 94454 - protein, 11 aa, Dengue virus
IPTVMAFHLST

SEQ ID NO: 94455 - protein, 11 aa, Dengue virus
PTVMAFHLSTR

SEQ ID NO: 94456 - protein, 11 aa, Dengue virus
TVMAFHLSTRD

SEQ ID NO: 94457 - protein, 11 aa, Dengue virus
VMAFHLSTRDG

SEQ ID NO: 94458 - protein, 11 aa, Dengue virus
MAFHLSTRDGE

SEQ ID NO: 94459 - protein, 11 aa, Dengue virus
AFHLSTRDGEP

SEQ ID NO: 94460 - protein, 11 aa, Dengue virus
FHLSTRDGEPL

SEQ ID NO: 94461 - protein, 11 aa, Dengue virus
HLSTRDGEPLM

SEQ ID NO: 94462 - protein, 11 aa, Dengue virus
LSTRDGEPLMI

SEQ ID NO: 94463 - protein, 11 aa, Dengue virus
STRDGEPLMIV

SEQ ID NO: 94464 - protein, 11 aa, Dengue virus
TRDGEPLMIVA

SEQ ID NO: 94465 - protein, 11 aa, Dengue virus
RDGEPLMIVAK

SEQ ID NO: 94466 - protein, 11 aa, Dengue virus
DGEPLMIVAKH

SEQ ID NO: 94467 - protein, 11 aa, Dengue virus
GEPLMIVAKHE

SEQ ID NO: 94468 - protein, 11 aa, Dengue virus
EPLMIVAKHER

SEQ ID NO: 94469 - protein, 11 aa, Dengue virus
PLMIVAKHERG

SEQ ID NO: 94470 - protein, 11 aa, Dengue virus
LMIVAKHERGR

SEQ ID NO: 94471 - protein, 11 aa, Dengue virus
MIVAKHERGRP

SEQ ID NO: 94472 - protein, 11 aa, Dengue virus
IVAKHERGRPL

SEQ ID NO: 94473 - protein, 11 aa, Dengue virus
VAKHERGRPLL

SEQ ID NO: 94474 - protein, 11 aa, Dengue virus
AKHERGRPLLF

SEQ ID NO: 94475 - protein, 11 aa, Dengue virus
KHERGRPLLFK

SEQ ID NO: 94476 - protein, 11 aa, Dengue virus
HERGRPLLFKT

SEQ ID NO: 94477 - protein, 11 aa, Dengue virus
ERGRPLLFKTT

SEQ ID NO: 94478 - protein, 11 aa, Dengue virus
RGRPLLFKTTE

SEQ ID NO: 94479 - protein, 11 aa, Dengue virus
GRPLLFKTTEG

SEQ ID NO: 94480 - protein, 11 aa, Dengue virus
RPLLFKTTEGI

SEQ ID NO: 94481 - protein, 11 aa, Dengue virus
PLLFKTTEGIN

SEQ ID NO: 94482 - protein, 11 aa, Dengue virus
LLFKTTEGINK

SEQ ID NO: 94483 - protein, 11 aa, Dengue virus
LFKTTEGINKC

SEQ ID NO: 94484 - protein, 11 aa, Dengue virus
FKTTEGINKCT

SEQ ID NO: 94485 - protein, 11 aa, Dengue virus
KTTEGINKCTL

SEQ ID NO: 94486 - protein, 11 aa, Dengue virus
TTEGINKCTLI

SEQ ID NO: 94487 - protein, 11 aa, Dengue virus
TEGINKCTLIA

SEQ ID NO: 94488 - protein, 11 aa, Dengue virus
EGINKCTLIAM

SEQ ID NO: 94489 - protein, 11 aa, Dengue virus
GINKCTLIAMD

SEQ ID NO: 94490 - protein, 11 aa, Dengue virus
INKCTLIAMDL

SEQ ID NO: 94491 - protein, 11 aa, Dengue virus
NKCTLIAMDLG

SEQ ID NO: 94492 - protein, 11 aa, Dengue virus
KCTLIAMDLGE

SEQ ID NO: 94493 - protein, 11 aa, Dengue virus
CTLIAMDLGEM

SEQ ID NO: 94494 - protein, 11 aa, Dengue virus
TLIAMDLGEMC

SEQ ID NO: 94495 - protein, 11 aa, Dengue virus
LIAMDLGEMCE

SEQ ID NO: 94496 - protein, 11 aa, Dengue virus
IAMDLGEMCED

SEQ ID NO: 94497 - protein, 11 aa, Dengue virus
AMDLGEMCEDT

SEQ ID NO: 94498 - protein, 11 aa, Dengue virus
MDLGEMCEDTV

SEQ ID NO: 94499 - protein, 11 aa, Dengue virus
DLGEMCEDTVT

SEQ ID NO: 94500 - protein, 11 aa, Dengue virus
LGEMCEDTVTY

SEQ ID NO: 94501 - protein, 11 aa, Dengue virus
GEMCEDTVTYK

SEQ ID NO: 94502 - protein, 11 aa, Dengue virus
EMCEDTVTYKC

SEQ ID NO: 94503 - protein, 11 aa, Dengue virus
MCEDTVTYKCP

SEQ ID NO: 94504 - protein, 11 aa, Dengue virus
CEDTVTYKCPL

SEQ ID NO: 94505 - protein, 11 aa, Dengue virus
EDTVTYKCPLL

SEQ ID NO: 94506 - protein, 11 aa, Dengue virus
DTVTYKCPLLV

SEQ ID NO: 94507 - protein, 11 aa, Dengue virus
TVTYKCPLLVN

SEQ ID NO: 94508 - protein, 11 aa, Dengue virus
VTYKCPLLVNT

SEQ ID NO: 94509 - protein, 11 aa, Dengue virus
TYKCPLLVNTE

SEQ ID NO: 94510 - protein, 11 aa, Dengue virus
YKCPLLVNTEP

SEQ ID NO: 94511 - protein, 11 aa, Dengue virus
KCPLLVNTEPE

SEQ ID NO: 94512 - protein, 11 aa, Dengue virus
CPLLVNTEPED

SEQ ID NO: 94513 - protein, 11 aa, Dengue virus
PLLVNTEPEDI

SEQ ID NO: 94514 - protein, 11 aa, Dengue virus
LLVNTEPEDID

SEQ ID NO: 94515 - protein, 11 aa, Dengue virus
LVNTEPEDIDC

SEQ ID NO: 94516 - protein, 11 aa, Dengue virus
VNTEPEDIDCW

SEQ ID NO: 94517 - protein, 11 aa, Dengue virus
NTEPEDIDCWC

SEQ ID NO: 94518 - protein, 11 aa, Dengue virus
TEPEDIDCWCN

SEQ ID NO: 94519 - protein, 11 aa, Dengue virus
EPEDIDCWCNL

SEQ ID NO: 94520 - protein, 11 aa, Dengue virus
PEDIDCWCNLT

SEQ ID NO: 94521 - protein, 11 aa, Dengue virus
EDIDCWCNLTS

SEQ ID NO: 94522 - protein, 11 aa, Dengue virus
DIDCWCNLTST

SEQ ID NO: 94523 - protein, 11 aa, Dengue virus
IDCWCNLTSTW

SEQ ID NO: 94524 - protein, 11 aa, Dengue virus
DCWCNLTSTWV

SEQ ID NO: 94525 - protein, 11 aa, Dengue virus
CWCNLTSTWVM

SEQ ID NO: 94526 - protein, 11 aa, Dengue virus
WCNLTSTWVMY

SEQ ID NO: 94527 - protein, 11 aa, Dengue virus
CNLTSTWVMYG

SEQ ID NO: 94528 - protein, 11 aa, Dengue virus
NLTSTWVMYGT

SEQ ID NO: 94529 - protein, 11 aa, Dengue virus
LTSTWVMYGTC

SEQ ID NO: 94530 - protein, 11 aa, Dengue virus
TSTWVMYGTCT

SEQ ID NO: 94531 - protein, 11 aa, Dengue virus
STWVMYGTCTQ

SEQ ID NO: 94532 - protein, 11 aa, Dengue virus
TWVMYGTCTQS

SEQ ID NO: 94533 - protein, 11 aa, Dengue virus
WVMYGTCTQSG

SEQ ID NO: 94534 - protein, 11 aa, Dengue virus
VMYGTCTQSGE

SEQ ID NO: 94535 - protein, 11 aa, Dengue virus
MYGTCTQSGER

SEQ ID NO: 94536 - protein, 11 aa, Dengue virus
YGTCTQSGERR

SEQ ID NO: 94537 - protein, 11 aa, Dengue virus
GTCTQSGERRR

SEQ ID NO: 94538 - protein, 11 aa, Dengue virus
TCTQSGERRRE

SEQ ID NO: 94539 - protein, 11 aa, Dengue virus
CTQSGERRREK

SEQ ID NO: 94540 - protein, 11 aa, Dengue virus
TQSGERRREKR

SEQ ID NO: 94541 - protein, 11 aa, Dengue virus
QSGERRREKRS

SEQ ID NO: 94542 - protein, 11 aa, Dengue virus
SGERRREKRSV

SEQ ID NO: 94543 - protein, 11 aa, Dengue virus
GERRREKRSVA

SEQ ID NO: 94544 - protein, 11 aa, Dengue virus
ERRREKRSVAL

SEQ ID NO: 94545 - protein, 11 aa, Dengue virus
RRREKRSVALT

SEQ ID NO: 94546 - protein, 11 aa, Dengue virus
RREKRSVALTP

SEQ ID NO: 94547 - protein, 11 aa, Dengue virus
REKRSVALTPH

SEQ ID NO: 94548 - protein, 11 aa, Dengue virus
EKRSVALTPHS

SEQ ID NO: 94549 - protein, 11 aa, Dengue virus
KRSVALTPHSG

SEQ ID NO: 94550 - protein, 11 aa, Dengue virus
RSVALTPHSGM

SEQ ID NO: 94551 - protein, 11 aa, Dengue virus
SVALTPHSGMG

SEQ ID NO: 94552 - protein, 11 aa, Dengue virus
VALTPHSGMGL

SEQ ID NO: 94553 - protein, 11 aa, Dengue virus
ALTPHSGMGLE

SEQ ID NO: 94554 - protein, 11 aa, Dengue virus
LTPHSGMGLET

SEQ ID NO: 94555 - protein, 11 aa, Dengue virus
TPHSGMGLETR

SEQ ID NO: 94556 - protein, 11 aa, Dengue virus
PHSGMGLETRA

SEQ ID NO: 94557 - protein, 11 aa, Dengue virus
HSGMGLETRAE

SEQ ID NO: 94558 - protein, 11 aa, Dengue virus
SGMGLETRAET

SEQ ID NO: 94559 - protein, 11 aa, Dengue virus
GMGLETRAETW

SEQ ID NO: 94560 - protein, 11 aa, Dengue virus
MGLETRAETWM

SEQ ID NO: 94561 - protein, 11 aa, Dengue virus
GLETRAETWMS

SEQ ID NO: 94562 - protein, 11 aa, Dengue virus
LETRAETWMSS

SEQ ID NO: 94563 - protein, 11 aa, Dengue virus
ETRAETWMSSE

SEQ ID NO: 94564 - protein, 11 aa, Dengue virus
TRAETWMSSEG

SEQ ID NO: 94565 - protein, 11 aa, Dengue virus
RAETWMSSEGA

SEQ ID NO: 94566 - protein, 11 aa, Dengue virus
AETWMSSEGAW

SEQ ID NO: 94567 - protein, 11 aa, Dengue virus
ETWMSSEGAWK

SEQ ID NO: 94568 - protein, 11 aa, Dengue virus
TWMSSEGAWKH

SEQ ID NO: 94569 - protein, 11 aa, Dengue virus
WMSSEGAWKHA

SEQ ID NO: 94570 - protein, 11 aa, Dengue virus
MSSEGAWKHAQ

SEQ ID NO: 94571 - protein, 11 aa, Dengue virus
SSEGAWKHAQR

SEQ ID NO: 94572 - protein, 11 aa, Dengue virus
SEGAWKHAQRV

SEQ ID NO: 94573 - protein, 11 aa, Dengue virus
EGAWKHAQRVE

SEQ ID NO: 94574 - protein, 11 aa, Dengue virus
GAWKHAQRVES

SEQ ID NO: 94575 - protein, 11 aa, Dengue virus
AWKHAQRVESW

SEQ ID NO: 94576 - protein, 11 aa, Dengue virus
WKHAQRVESWI

SEQ ID NO: 94577 - protein, 11 aa, Dengue virus
KHAQRVESWIL

SEQ ID NO: 94578 - protein, 11 aa, Dengue virus
HAQRVESWILR

SEQ ID NO: 94579 - protein, 11 aa, Dengue virus
AQRVESWILRN

SEQ ID NO: 94580 - protein, 11 aa, Dengue virus
QRVESWILRNP

SEQ ID NO: 94581 - protein, 11 aa, Dengue virus
RVESWILRNPG

SEQ ID NO: 94582 - protein, 11 aa, Dengue virus
VESWILRNPGF

SEQ ID NO: 94583 - protein, 11 aa, Dengue virus
ESWILRNPGFA

SEQ ID NO: 94584 - protein, 11 aa, Dengue virus
SWILRNPGFAL

SEQ ID NO: 94585 - protein, 11 aa, Dengue virus
WILRNPGFALL

SEQ ID NO: 94586 - protein, 11 aa, Dengue virus
ILRNPGFALLA

SEQ ID NO: 94587 - protein, 11 aa, Dengue virus
LRNPGFALLAG

SEQ ID NO: 94588 - protein, 11 aa, Dengue virus
RNPGFALLAGF

SEQ ID NO: 94589 - protein, 11 aa, Dengue virus
NPGFALLAGFM

SEQ ID NO: 94590 - protein, 11 aa, Dengue virus
PGFALLAGFMA

SEQ ID NO: 94591 - protein, 11 aa, Dengue virus
GFALLAGFMAY

SEQ ID NO: 94592 - protein, 11 aa, Dengue virus
FALLAGFMAYM

SEQ ID NO: 94593 - protein, 11 aa, Dengue virus
ALLAGFMAYMI

SEQ ID NO: 94594 - protein, 11 aa, Dengue virus
LLAGFMAYMIG

SEQ ID NO: 94595 - protein, 11 aa, Dengue virus
LAGFMAYMIGQ

SEQ ID NO: 94596 - protein, 11 aa, Dengue virus
AGFMAYMIGQT

SEQ ID NO: 94597 - protein, 11 aa, Dengue virus
GFMAYMIGQTG

SEQ ID NO: 94598 - protein, 11 aa, Dengue virus
FMAYMIGQTGI

SEQ ID NO: 94599 - protein, 11 aa, Dengue virus
MAYMIGQTGIQ

SEQ ID NO: 94600 - protein, 11 aa, Dengue virus
AYMIGQTGIQR

SEQ ID NO: 94601 - protein, 11 aa, Dengue virus
YMIGQTGIQRT

SEQ ID NO: 94602 - protein, 11 aa, Dengue virus
MIGQTGIQRTV

SEQ ID NO: 94603 - protein, 11 aa, Dengue virus
IGQTGIQRTVF

SEQ ID NO: 94604 - protein, 11 aa, Dengue virus
GQTGIQRTVFF

SEQ ID NO: 94605 - protein, 11 aa, Dengue virus
QTGIQRTVFFV

SEQ ID NO: 94606 - protein, 11 aa, Dengue virus
TGIQRTVFFVL

SEQ ID NO: 94607 - protein, 11 aa, Dengue virus
GIQRTVFFVLM

SEQ ID NO: 94608 - protein, 11 aa, Dengue virus
IQRTVFFVLMM

SEQ ID NO: 94609 - protein, 11 aa, Dengue virus
QRTVFFVLMML

SEQ ID NO: 94610 - protein, 11 aa, Dengue virus
RTVFFVLMMLV

SEQ ID NO: 94611 - protein, 11 aa, Dengue virus
TVFFVLMMLVA

SEQ ID NO: 94612 - protein, 11 aa, Dengue virus
VFFVLMMLVAP

SEQ ID NO: 94613 - protein, 11 aa, Dengue virus
FFVLMMLVAPS

SEQ ID NO: 94614 - protein, 11 aa, Dengue virus
FVLMMLVAPSY

SEQ ID NO: 94615 - protein, 11 aa, Dengue virus
VLMMLVAPSYG

SEQ ID NO: 94616 - protein, 11 aa, Dengue virus
LMMLVAPSYGM

SEQ ID NO: 94617 - protein, 11 aa, Dengue virus
MMLVAPSYGMR

SEQ ID NO: 94618 - protein, 11 aa, Dengue virus
MLVAPSYGMRC

SEQ ID NO: 94619 - protein, 11 aa, Dengue virus
LVAPSYGMRCV

SEQ ID NO: 94620 - protein, 11 aa, Dengue virus
VAPSYGMRCVG

SEQ ID NO: 94621 - protein, 11 aa, Dengue virus
APSYGMRCVGV

SEQ ID NO: 94622 - protein, 11 aa, Dengue virus
PSYGMRCVGVG

SEQ ID NO: 94623 - protein, 11 aa, Dengue virus
SYGMRCVGVGN

SEQ ID NO: 94624 - protein, 11 aa, Dengue virus
YGMRCVGVGNR

SEQ ID NO: 94625 - protein, 11 aa, Dengue virus
GMRCVGVGNRD

SEQ ID NO: 94626 - protein, 11 aa, Dengue virus
MRCVGVGNRDF

SEQ ID NO: 94627 - protein, 11 aa, Dengue virus
RCVGVGNRDFV

SEQ ID NO: 94628 - protein, 11 aa, Dengue virus
CVGVGNRDFVE

SEQ ID NO: 94629 - protein, 11 aa, Dengue virus
VGVGNRDFVEG

SEQ ID NO: 94630 - protein, 11 aa, Dengue virus
GVGNRDFVEGV

SEQ ID NO: 94631 - protein, 11 aa, Dengue virus
VGNRDFVEGVS

SEQ ID NO: 94632 - protein, 11 aa, Dengue virus
GNRDFVEGVSG

SEQ ID NO: 94633 - protein, 11 aa, Dengue virus
NRDFVEGVSGG

SEQ ID NO: 94634 - protein, 11 aa, Dengue virus
RDFVEGVSGGA

SEQ ID NO: 94635 - protein, 11 aa, Dengue virus
DFVEGVSGGAW

SEQ ID NO: 94636 - protein, 11 aa, Dengue virus
FVEGVSGGAWV

SEQ ID NO: 94637 - protein, 11 aa, Dengue virus
VEGVSGGAWVD

SEQ ID NO: 94638 - protein, 11 aa, Dengue virus
EGVSGGAWVDL

SEQ ID NO: 94639 - protein, 11 aa, Dengue virus
GVSGGAWVDLV

SEQ ID NO: 94640 - protein, 11 aa, Dengue virus
VSGGAWVDLVL

SEQ ID NO: 94641 - protein, 11 aa, Dengue virus
SGGAWVDLVLE

SEQ ID NO: 94642 - protein, 11 aa, Dengue virus
GGAWVDLVLEH

SEQ ID NO: 94643 - protein, 11 aa, Dengue virus
GAWVDLVLEHG

SEQ ID NO: 94644 - protein, 11 aa, Dengue virus
AWVDLVLEHGG

SEQ ID NO: 94645 - protein, 11 aa, Dengue virus
WVDLVLEHGGC

SEQ ID NO: 94646 - protein, 11 aa, Dengue virus
VDLVLEHGGCV

SEQ ID NO: 94647 - protein, 11 aa, Dengue virus
DLVLEHGGCVT

SEQ ID NO: 94648 - protein, 11 aa, Dengue virus
LVLEHGGCVTT

SEQ ID NO: 94649 - protein, 11 aa, Dengue virus
VLEHGGCVTTM

SEQ ID NO: 94650 - protein, 11 aa, Dengue virus
LEHGGCVTTMA

SEQ ID NO: 94651 - protein, 11 aa, Dengue virus
EHGGCVTTMAQ

SEQ ID NO: 94652 - protein, 11 aa, Dengue virus
HGGCVTTMAQG

SEQ ID NO: 94653 - protein, 11 aa, Dengue virus
GGCVTTMAQGK

SEQ ID NO: 94654 - protein, 11 aa, Dengue virus
GCVTTMAQGKP

SEQ ID NO: 94655 - protein, 11 aa, Dengue virus
CVTTMAQGKPT

SEQ ID NO: 94656 - protein, 11 aa, Dengue virus
VTTMAQGKPTL

SEQ ID NO: 94657 - protein, 11 aa, Dengue virus
TTMAQGKPTLD

SEQ ID NO: 94658 - protein, 11 aa, Dengue virus
TMAQGKPTLDF

SEQ ID NO: 94659 - protein, 11 aa, Dengue virus
MAQGKPTLDFE

SEQ ID NO: 94660 - protein, 11 aa, Dengue virus
AQGKPTLDFEL

SEQ ID NO: 94661 - protein, 11 aa, Dengue virus
QGKPTLDFELT

SEQ ID NO: 94662 - protein, 11 aa, Dengue virus
GKPTLDFELTK

SEQ ID NO: 94663 - protein, 11 aa, Dengue virus
KPTLDFELTKT

SEQ ID NO: 94664 - protein, 11 aa, Dengue virus
PTLDFELTKTT

SEQ ID NO: 94665 - protein, 11 aa, Dengue virus
TLDFELTKTTA

SEQ ID NO: 94666 - protein, 11 aa, Dengue virus
LDFELTKTTAK

SEQ ID NO: 94667 - protein, 11 aa, Dengue virus
DFELTKTTAKE

SEQ ID NO: 94668 - protein, 11 aa, Dengue virus
FELTKTTAKEV

SEQ ID NO: 94669 - protein, 11 aa, Dengue virus
ELTKTTAKEVA

SEQ ID NO: 94670 - protein, 11 aa, Dengue virus
LTKTTAKEVAL

SEQ ID NO: 94671 - protein, 11 aa, Dengue virus
TKTTAKEVALL

SEQ ID NO: 94672 - protein, 11 aa, Dengue virus
KTTAKEVALLR

SEQ ID NO: 94673 - protein, 11 aa, Dengue virus
TTAKEVALLRT

SEQ ID NO: 94674 - protein, 11 aa, Dengue virus
TAKEVALLRTY

SEQ ID NO: 94675 - protein, 11 aa, Dengue virus
AKEVALLRTYC

SEQ ID NO: 94676 - protein, 11 aa, Dengue virus
KEVALLRTYCI

SEQ ID NO: 94677 - protein, 11 aa, Dengue virus
EVALLRTYCIE

SEQ ID NO: 94678 - protein, 11 aa, Dengue virus
VALLRTYCIEA

SEQ ID NO: 94679 - protein, 11 aa, Dengue virus
ALLRTYCIEAS

SEQ ID NO: 94680 - protein, 11 aa, Dengue virus
LLRTYCIEASI

SEQ ID NO: 94681 - protein, 11 aa, Dengue virus
LRTYCIEASIS

SEQ ID NO: 94682 - protein, 11 aa, Dengue virus
RTYCIEASISN

SEQ ID NO: 94683 - protein, 11 aa, Dengue virus
TYCIEASISNI

SEQ ID NO: 94684 - protein, 11 aa, Dengue virus
YCIEASISNIT

SEQ ID NO: 94685 - protein, 11 aa, Dengue virus
CIEASISNITT

SEQ ID NO: 94686 - protein, 11 aa, Dengue virus
IEASISNITTA

SEQ ID NO: 94687 - protein, 11 aa, Dengue virus
EASISNITTAT

SEQ ID NO: 94688 - protein, 11 aa, Dengue virus
ASISNITTATR

SEQ ID NO: 94689 - protein, 11 aa, Dengue virus
SISNITTATRC

SEQ ID NO: 94690 - protein, 11 aa, Dengue virus
ISNITTATRCP

SEQ ID NO: 94691 - protein, 11 aa, Dengue virus
SNITTATRCPT

SEQ ID NO: 94692 - protein, 11 aa, Dengue virus
NITTATRCPTQ

SEQ ID NO: 94693 - protein, 11 aa, Dengue virus
ITTATRCPTQG

SEQ ID NO: 94694 - protein, 11 aa, Dengue virus
TTATRCPTQGE

SEQ ID NO: 94695 - protein, 11 aa, Dengue virus
TATRCPTQGEP

SEQ ID NO: 94696 - protein, 11 aa, Dengue virus
ATRCPTQGEPY

SEQ ID NO: 94697 - protein, 11 aa, Dengue virus
TRCPTQGEPYL

SEQ ID NO: 94698 - protein, 11 aa, Dengue virus
RCPTQGEPYLK

SEQ ID NO: 94699 - protein, 11 aa, Dengue virus
CPTQGEPYLKE

SEQ ID NO: 94700 - protein, 11 aa, Dengue virus
PTQGEPYLKEE

SEQ ID NO: 94701 - protein, 11 aa, Dengue virus
TQGEPYLKEEQ

SEQ ID NO: 94702 - protein, 11 aa, Dengue virus
QGEPYLKEEQD

SEQ ID NO: 94703 - protein, 11 aa, Dengue virus
GEPYLKEEQDQ

SEQ ID NO: 94704 - protein, 11 aa, Dengue virus
EPYLKEEQDQQ

SEQ ID NO: 94705 - protein, 11 aa, Dengue virus
PYLKEEQDQQY

SEQ ID NO: 94706 - protein, 11 aa, Dengue virus
YLKEEQDQQYI

SEQ ID NO: 94707 - protein, 11 aa, Dengue virus
LKEEQDQQYIC

SEQ ID NO: 94708 - protein, 11 aa, Dengue virus
KEEQDQQYICR

SEQ ID NO: 94709 - protein, 11 aa, Dengue virus
EEQDQQYICRR

SEQ ID NO: 94710 - protein, 11 aa, Dengue virus
EQDQQYICRRD

SEQ ID NO: 94711 - protein, 11 aa, Dengue virus
QDQQYICRRDV

SEQ ID NO: 94712 - protein, 11 aa, Dengue virus
DQQYICRRDVV

SEQ ID NO: 94713 - protein, 11 aa, Dengue virus
QQYICRRDVVD

SEQ ID NO: 94714 - protein, 11 aa, Dengue virus
QYICRRDVVDR

SEQ ID NO: 94715 - protein, 11 aa, Dengue virus
YICRRDVVDRG

SEQ ID NO: 94716 - protein, 11 aa, Dengue virus
ICRRDVVDRGW

SEQ ID NO: 94717 - protein, 11 aa, Dengue virus
CRRDVVDRGWG

SEQ ID NO: 94718 - protein, 11 aa, Dengue virus
RRDVVDRGWGN

SEQ ID NO: 94719 - protein, 11 aa, Dengue virus
RDVVDRGWGNG

SEQ ID NO: 94720 - protein, 11 aa, Dengue virus
DVVDRGWGNGC

SEQ ID NO: 94721 - protein, 11 aa, Dengue virus
VVDRGWGNGCG

SEQ ID NO: 94722 - protein, 11 aa, Dengue virus
VDRGWGNGCGL

SEQ ID NO: 94723 - protein, 11 aa, Dengue virus
DRGWGNGCGLF

SEQ ID NO: 94724 - protein, 11 aa, Dengue virus
RGWGNGCGLFG

SEQ ID NO: 94725 - protein, 11 aa, Dengue virus
GWGNGCGLFGK

SEQ ID NO: 94726 - protein, 11 aa, Dengue virus
WGNGCGLFGKG

SEQ ID NO: 94727 - protein, 11 aa, Dengue virus
GNGCGLFGKGG

SEQ ID NO: 94728 - protein, 11 aa, Dengue virus
NGCGLFGKGGV

SEQ ID NO: 94729 - protein, 11 aa, Dengue virus
GCGLFGKGGVV

SEQ ID NO: 94730 - protein, 11 aa, Dengue virus
CGLFGKGGVVT

SEQ ID NO: 94731 - protein, 11 aa, Dengue virus
GLFGKGGVVTC

SEQ ID NO: 94732 - protein, 11 aa, Dengue virus
LFGKGGVVTCA

SEQ ID NO: 94733 - protein, 11 aa, Dengue virus
FGKGGVVTCAK

SEQ ID NO: 94734 - protein, 11 aa, Dengue virus
GKGGVVTCAKF

SEQ ID NO: 94735 - protein, 11 aa, Dengue virus
KGGVVTCAKFS

SEQ ID NO: 94736 - protein, 11 aa, Dengue virus
GGVVTCAKFSC

SEQ ID NO: 94737 - protein, 11 aa, Dengue virus
GVVTCAKFSCS

SEQ ID NO: 94738 - protein, 11 aa, Dengue virus
VVTCAKFSCSG

SEQ ID NO: 94739 - protein, 11 aa, Dengue virus
VTCAKFSCSGK

SEQ ID NO: 94740 - protein, 11 aa, Dengue virus
TCAKFSCSGKI

SEQ ID NO: 94741 - protein, 11 aa, Dengue virus
CAKFSCSGKIT

SEQ ID NO: 94742 - protein, 11 aa, Dengue virus
AKFSCSGKITG

SEQ ID NO: 94743 - protein, 11 aa, Dengue virus
KFSCSGKITGN

SEQ ID NO: 94744 - protein, 11 aa, Dengue virus
FSCSGKITGNL

SEQ ID NO: 94745 - protein, 11 aa, Dengue virus
SCSGKITGNLV

SEQ ID NO: 94746 - protein, 11 aa, Dengue virus
CSGKITGNLVQ

SEQ ID NO: 94747 - protein, 11 aa, Dengue virus
SGKITGNLVQI

SEQ ID NO: 94748 - protein, 11 aa, Dengue virus
GKITGNLVQIE

SEQ ID NO: 94749 - protein, 11 aa, Dengue virus
KITGNLVQIEN

SEQ ID NO: 94750 - protein, 11 aa, Dengue virus
ITGNLVQIENL

SEQ ID NO: 94751 - protein, 11 aa, Dengue virus
TGNLVQIENLE

SEQ ID NO: 94752 - protein, 11 aa, Dengue virus
GNLVQIENLEY

SEQ ID NO: 94753 - protein, 11 aa, Dengue virus
NLVQIENLEYT

SEQ ID NO: 94754 - protein, 11 aa, Dengue virus
LVQIENLEYTV

SEQ ID NO: 94755 - protein, 11 aa, Dengue virus
VQIENLEYTVV

SEQ ID NO: 94756 - protein, 11 aa, Dengue virus
QIENLEYTVVV

SEQ ID NO: 94757 - protein, 11 aa, Dengue virus
IENLEYTVVVT

SEQ ID NO: 94758 - protein, 11 aa, Dengue virus
ENLEYTVVVTV

SEQ ID NO: 94759 - protein, 11 aa, Dengue virus
NLEYTVVVTVH

SEQ ID NO: 94760 - protein, 11 aa, Dengue virus
LEYTVVVTVHN

SEQ ID NO: 94761 - protein, 11 aa, Dengue virus
EYTVVVTVHNG

SEQ ID NO: 94762 - protein, 11 aa, Dengue virus
YTVVVTVHNGD

SEQ ID NO: 94763 - protein, 11 aa, Dengue virus
TVVVTVHNGDT

SEQ ID NO: 94764 - protein, 11 aa, Dengue virus
VVVTVHNGDTH

SEQ ID NO: 94765 - protein, 11 aa, Dengue virus
VVTVHNGDTHA

SEQ ID NO: 94766 - protein, 11 aa, Dengue virus
VTVHNGDTHAV

SEQ ID NO: 94767 - protein, 11 aa, Dengue virus
TVHNGDTHAVG

SEQ ID NO: 94768 - protein, 11 aa, Dengue virus
VHNGDTHAVGN

SEQ ID NO: 94769 - protein, 11 aa, Dengue virus
HNGDTHAVGND

SEQ ID NO: 94770 - protein, 11 aa, Dengue virus
NGDTHAVGNDT

SEQ ID NO: 94771 - protein, 11 aa, Dengue virus
GDTHAVGNDTS

SEQ ID NO: 94772 - protein, 11 aa, Dengue virus
DTHAVGNDTSN

SEQ ID NO: 94773 - protein, 11 aa, Dengue virus
THAVGNDTSNH

SEQ ID NO: 94774 - protein, 11 aa, Dengue virus
HAVGNDTSNHG

SEQ ID NO: 94775 - protein, 11 aa, Dengue virus
AVGNDTSNHGV

SEQ ID NO: 94776 - protein, 11 aa, Dengue virus
VGNDTSNHGVT

SEQ ID NO: 94777 - protein, 11 aa, Dengue virus
GNDTSNHGVTA

SEQ ID NO: 94778 - protein, 11 aa, Dengue virus
NDTSNHGVTAT

SEQ ID NO: 94779 - protein, 11 aa, Dengue virus
DTSNHGVTATI

SEQ ID NO: 94780 - protein, 11 aa, Dengue virus
TSNHGVTATIT

SEQ ID NO: 94781 - protein, 11 aa, Dengue virus
SNHGVTATITP

SEQ ID NO: 94782 - protein, 11 aa, Dengue virus
NHGVTATITPR

SEQ ID NO: 94783 - protein, 11 aa, Dengue virus
HGVTATITPRS

SEQ ID NO: 94784 - protein, 11 aa, Dengue virus
GVTATITPRSP

SEQ ID NO: 94785 - protein, 11 aa, Dengue virus
VTATITPRSPS

SEQ ID NO: 94786 - protein, 11 aa, Dengue virus
TATITPRSPSV

SEQ ID NO: 94787 - protein, 11 aa, Dengue virus
ATITPRSPSVE

SEQ ID NO: 94788 - protein, 11 aa, Dengue virus
TITPRSPSVEV

SEQ ID NO: 94789 - protein, 11 aa, Dengue virus
ITPRSPSVEVK

SEQ ID NO: 94790 - protein, 11 aa, Dengue virus
TPRSPSVEVKL

SEQ ID NO: 94791 - protein, 11 aa, Dengue virus
PRSPSVEVKLP

SEQ ID NO: 94792 - protein, 11 aa, Dengue virus
RSPSVEVKLPD

SEQ ID NO: 94793 - protein, 11 aa, Dengue virus
SPSVEVKLPDY

SEQ ID NO: 94794 - protein, 11 aa, Dengue virus
PSVEVKLPDYG

SEQ ID NO: 94795 - protein, 11 aa, Dengue virus
SVEVKLPDYGE

SEQ ID NO: 94796 - protein, 11 aa, Dengue virus
VEVKLPDYGEL

SEQ ID NO: 94797 - protein, 11 aa, Dengue virus
EVKLPDYGELT

SEQ ID NO: 94798 - protein, 11 aa, Dengue virus
VKLPDYGELTL

SEQ ID NO: 94799 - protein, 11 aa, Dengue virus
KLPDYGELTLD

SEQ ID NO: 94800 - protein, 11 aa, Dengue virus
LPDYGELTLDC

SEQ ID NO: 94801 - protein, 11 aa, Dengue virus
PDYGELTLDCE

SEQ ID NO: 94802 - protein, 11 aa, Dengue virus
DYGELTLDCEP

SEQ ID NO: 94803 - protein, 11 aa, Dengue virus
YGELTLDCEPR

SEQ ID NO: 94804 - protein, 11 aa, Dengue virus
GELTLDCEPRS

SEQ ID NO: 94805 - protein, 11 aa, Dengue virus
ELTLDCEPRSG

SEQ ID NO: 94806 - protein, 11 aa, Dengue virus
LTLDCEPRSGI

SEQ ID NO: 94807 - protein, 11 aa, Dengue virus
TLDCEPRSGID

SEQ ID NO: 94808 - protein, 11 aa, Dengue virus
LDCEPRSGIDF

SEQ ID NO: 94809 - protein, 11 aa, Dengue virus
DCEPRSGIDFN

SEQ ID NO: 94810 - protein, 11 aa, Dengue virus
CEPRSGIDFNE

SEQ ID NO: 94811 - protein, 11 aa, Dengue virus
EPRSGIDFNEM

SEQ ID NO: 94812 - protein, 11 aa, Dengue virus
PRSGIDFNEMI

SEQ ID NO: 94813 - protein, 11 aa, Dengue virus
RSGIDFNEMIL

SEQ ID NO: 94814 - protein, 11 aa, Dengue virus
SGIDFNEMILM

SEQ ID NO: 94815 - protein, 11 aa, Dengue virus
GIDFNEMILMK

SEQ ID NO: 94816 - protein, 11 aa, Dengue virus
IDFNEMILMKM

SEQ ID NO: 94817 - protein, 11 aa, Dengue virus
DFNEMILMKMK

SEQ ID NO: 94818 - protein, 11 aa, Dengue virus
MKKKTWLVHKQ

SEQ ID NO: 94819 - protein, 11 aa, Dengue virus
KKKTWLVHKQW

SEQ ID NO: 94820 - protein, 11 aa, Dengue virus
KKTWLVHKQWF

SEQ ID NO: 94821 - protein, 11 aa, Dengue virus
KTWLVHKQWFL

SEQ ID NO: 94822 - protein, 11 aa, Dengue virus
TWLVHKQWFLD

SEQ ID NO: 94823 - protein, 11 aa, Dengue virus
WLVHKQWFLDL

SEQ ID NO: 94824 - protein, 11 aa, Dengue virus
LVHKQWFLDLP

SEQ ID NO: 94825 - protein, 11 aa, Dengue virus
VHKQWFLDLPL

SEQ ID NO: 94826 - protein, 11 aa, Dengue virus
HKQWFLDLPLP

SEQ ID NO: 94827 - protein, 11 aa, Dengue virus
KQWFLDLPLPW

SEQ ID NO: 94828 - protein, 11 aa, Dengue virus
QWFLDLPLPWT

SEQ ID NO: 94829 - protein, 11 aa, Dengue virus
WFLDLPLPWTA

SEQ ID NO: 94830 - protein, 11 aa, Dengue virus
FLDLPLPWTAG

SEQ ID NO: 94831 - protein, 11 aa, Dengue virus
LDLPLPWTAGA

SEQ ID NO: 94832 - protein, 11 aa, Dengue virus
DLPLPWTAGAD

SEQ ID NO: 94833 - protein, 11 aa, Dengue virus
LPLPWTAGADT

SEQ ID NO: 94834 - protein, 11 aa, Dengue virus
PLPWTAGADTS

SEQ ID NO: 94835 - protein, 11 aa, Dengue virus
LPWTAGADTSE

SEQ ID NO: 94836 - protein, 11 aa, Dengue virus
PWTAGADTSEV

SEQ ID NO: 94837 - protein, 11 aa, Dengue virus
WTAGADTSEVH

SEQ ID NO: 94838 - protein, 11 aa, Dengue virus
TAGADTSEVHW

SEQ ID NO: 94839 - protein, 11 aa, Dengue virus
AGADTSEVHWN

SEQ ID NO: 94840 - protein, 11 aa, Dengue virus
GADTSEVHWNY

SEQ ID NO: 94841 - protein, 11 aa, Dengue virus
ADTSEVHWNYK

SEQ ID NO: 94842 - protein, 11 aa, Dengue virus
DTSEVHWNYKE

SEQ ID NO: 94843 - protein, 11 aa, Dengue virus
TSEVHWNYKER

SEQ ID NO: 94844 - protein, 11 aa, Dengue virus
SEVHWNYKERM

SEQ ID NO: 94845 - protein, 11 aa, Dengue virus
EVHWNYKERMV

SEQ ID NO: 94846 - protein, 11 aa, Dengue virus
VHWNYKERMVT

SEQ ID NO: 94847 - protein, 11 aa, Dengue virus
HWNYKERMVTF

SEQ ID NO: 94848 - protein, 11 aa, Dengue virus
WNYKERMVTFK

SEQ ID NO: 94849 - protein, 11 aa, Dengue virus
NYKERMVTFKV

SEQ ID NO: 94850 - protein, 11 aa, Dengue virus
YKERMVTFKVP

SEQ ID NO: 94851 - protein, 11 aa, Dengue virus
KERMVTFKVPH

SEQ ID NO: 94852 - protein, 11 aa, Dengue virus
ERMVTFKVPHA

SEQ ID NO: 94853 - protein, 11 aa, Dengue virus
RMVTFKVPHAK

SEQ ID NO: 94854 - protein, 11 aa, Dengue virus
MVTFKVPHAKR

SEQ ID NO: 94855 - protein, 11 aa, Dengue virus
VTFKVPHAKRQ

SEQ ID NO: 94856 - protein, 11 aa, Dengue virus
TFKVPHAKRQD

SEQ ID NO: 94857 - protein, 11 aa, Dengue virus
FKVPHAKRQDV

SEQ ID NO: 94858 - protein, 11 aa, Dengue virus
KVPHAKRQDVT

SEQ ID NO: 94859 - protein, 11 aa, Dengue virus
VPHAKRQDVTV

SEQ ID NO: 94860 - protein, 11 aa, Dengue virus
PHAKRQDVTVL

SEQ ID NO: 94861 - protein, 11 aa, Dengue virus
HAKRQDVTVLG

SEQ ID NO: 94862 - protein, 11 aa, Dengue virus
AKRQDVTVLGS

SEQ ID NO: 94863 - protein, 11 aa, Dengue virus
KRQDVTVLGSQ

SEQ ID NO: 94864 - protein, 11 aa, Dengue virus
RQDVTVLGSQE

SEQ ID NO: 94865 - protein, 11 aa, Dengue virus
QDVTVLGSQEG

SEQ ID NO: 94866 - protein, 11 aa, Dengue virus
DVTVLGSQEGA

SEQ ID NO: 94867 - protein, 11 aa, Dengue virus
VTVLGSQEGAM

SEQ ID NO: 94868 - protein, 11 aa, Dengue virus
TVLGSQEGAMH

SEQ ID NO: 94869 - protein, 11 aa, Dengue virus
VLGSQEGAMHS

SEQ ID NO: 94870 - protein, 11 aa, Dengue virus
LGSQEGAMHSA

SEQ ID NO: 94871 - protein, 11 aa, Dengue virus
GSQEGAMHSAL

SEQ ID NO: 94872 - protein, 11 aa, Dengue virus
SQEGAMHSALA

SEQ ID NO: 94873 - protein, 11 aa, Dengue virus
QEGAMHSALAG

SEQ ID NO: 94874 - protein, 11 aa, Dengue virus
EGAMHSALAGA

SEQ ID NO: 94875 - protein, 11 aa, Dengue virus
GAMHSALAGAT

SEQ ID NO: 94876 - protein, 11 aa, Dengue virus
AMHSALAGATE

SEQ ID NO: 94877 - protein, 11 aa, Dengue virus
MHSALAGATEV

SEQ ID NO: 94878 - protein, 11 aa, Dengue virus
HSALAGATEVD

SEQ ID NO: 94879 - protein, 11 aa, Dengue virus
SALAGATEVDS

SEQ ID NO: 94880 - protein, 11 aa, Dengue virus
ALAGATEVDSG

SEQ ID NO: 94881 - protein, 11 aa, Dengue virus
LAGATEVDSGD

SEQ ID NO: 94882 - protein, 11 aa, Dengue virus
AGATEVDSGDG

SEQ ID NO: 94883 - protein, 11 aa, Dengue virus
GATEVDSGDGN

SEQ ID NO: 94884 - protein, 11 aa, Dengue virus
ATEVDSGDGNH

SEQ ID NO: 94885 - protein, 11 aa, Dengue virus
TEVDSGDGNHM

SEQ ID NO: 94886 - protein, 11 aa, Dengue virus
EVDSGDGNHMF

SEQ ID NO: 94887 - protein, 11 aa, Dengue virus
VDSGDGNHMFA

SEQ ID NO: 94888 - protein, 11 aa, Dengue virus
DSGDGNHMFAG

SEQ ID NO: 94889 - protein, 11 aa, Dengue virus
SGDGNHMFAGH

SEQ ID NO: 94890 - protein, 11 aa, Dengue virus
GDGNHMFAGHL

SEQ ID NO: 94891 - protein, 11 aa, Dengue virus
DGNHMFAGHLK

SEQ ID NO: 94892 - protein, 11 aa, Dengue virus
GNHMFAGHLKC

SEQ ID NO: 94893 - protein, 11 aa, Dengue virus
NHMFAGHLKCK

SEQ ID NO: 94894 - protein, 11 aa, Dengue virus
HMFAGHLKCKV

SEQ ID NO: 94895 - protein, 11 aa, Dengue virus
MFAGHLKCKVR

SEQ ID NO: 94896 - protein, 11 aa, Dengue virus
FAGHLKCKVRM

SEQ ID NO: 94897 - protein, 11 aa, Dengue virus
AGHLKCKVRME

SEQ ID NO: 94898 - protein, 11 aa, Dengue virus
GHLKCKVRMEK

SEQ ID NO: 94899 - protein, 11 aa, Dengue virus
HLKCKVRMEKL

SEQ ID NO: 94900 - protein, 11 aa, Dengue virus
LKCKVRMEKLR

SEQ ID NO: 94901 - protein, 11 aa, Dengue virus
KCKVRMEKLRI

SEQ ID NO: 94902 - protein, 11 aa, Dengue virus
CKVRMEKLRIK

SEQ ID NO: 94903 - protein, 11 aa, Dengue virus
KVRMEKLRIKG

SEQ ID NO: 94904 - protein, 11 aa, Dengue virus
VRMEKLRIKGM

SEQ ID NO: 94905 - protein, 11 aa, Dengue virus
RMEKLRIKGMS

SEQ ID NO: 94906 - protein, 11 aa, Dengue virus
MEKLRIKGMSY

SEQ ID NO: 94907 - protein, 11 aa, Dengue virus
EKLRIKGMSYT

SEQ ID NO: 94908 - protein, 11 aa, Dengue virus
KLRIKGMSYTM

SEQ ID NO: 94909 - protein, 11 aa, Dengue virus
LRIKGMSYTMC

SEQ ID NO: 94910 - protein, 11 aa, Dengue virus
RIKGMSYTMCS

SEQ ID NO: 94911 - protein, 11 aa, Dengue virus
IKGMSYTMCSG

SEQ ID NO: 94912 - protein, 11 aa, Dengue virus
KGMSYTMCSGK

SEQ ID NO: 94913 - protein, 11 aa, Dengue virus
GMSYTMCSGKF

SEQ ID NO: 94914 - protein, 11 aa, Dengue virus
MSYTMCSGKFS

SEQ ID NO: 94915 - protein, 11 aa, Dengue virus
SYTMCSGKFSI

SEQ ID NO: 94916 - protein, 11 aa, Dengue virus
YTMCSGKFSID

SEQ ID NO: 94917 - protein, 11 aa, Dengue virus
TMCSGKFSIDK

SEQ ID NO: 94918 - protein, 11 aa, Dengue virus
MCSGKFSIDKE

SEQ ID NO: 94919 - protein, 11 aa, Dengue virus
CSGKFSIDKEM

SEQ ID NO: 94920 - protein, 11 aa, Dengue virus
SGKFSIDKEMA

SEQ ID NO: 94921 - protein, 11 aa, Dengue virus
GKFSIDKEMAE

SEQ ID NO: 94922 - protein, 11 aa, Dengue virus
KFSIDKEMAET

SEQ ID NO: 94923 - protein, 11 aa, Dengue virus
FSIDKEMAETQ

SEQ ID NO: 94924 - protein, 11 aa, Dengue virus
SIDKEMAETQH

SEQ ID NO: 94925 - protein, 11 aa, Dengue virus
IDKEMAETQHG

SEQ ID NO: 94926 - protein, 11 aa, Dengue virus
DKEMAETQHGT

SEQ ID NO: 94927 - protein, 11 aa, Dengue virus
KEMAETQHGTT

SEQ ID NO: 94928 - protein, 11 aa, Dengue virus
EMAETQHGTTV

SEQ ID NO: 94929 - protein, 11 aa, Dengue virus
MAETQHGTTVV

SEQ ID NO: 94930 - protein, 11 aa, Dengue virus
AETQHGTTVVK

SEQ ID NO: 94931 - protein, 11 aa, Dengue virus
ETQHGTTVVKV

SEQ ID NO: 94932 - protein, 11 aa, Dengue virus
TQHGTTVVKVK

SEQ ID NO: 94933 - protein, 11 aa, Dengue virus
QHGTTVVKVKY

SEQ ID NO: 94934 - protein, 11 aa, Dengue virus
HGTTVVKVKYE

SEQ ID NO: 94935 - protein, 11 aa, Dengue virus
GTTVVKVKYEG

SEQ ID NO: 94936 - protein, 11 aa, Dengue virus
TTVVKVKYEGA

SEQ ID NO: 94937 - protein, 11 aa, Dengue virus
TVVKVKYEGAG

SEQ ID NO: 94938 - protein, 11 aa, Dengue virus
VVKVKYEGAGA

SEQ ID NO: 94939 - protein, 11 aa, Dengue virus
VKVKYEGAGAP

SEQ ID NO: 94940 - protein, 11 aa, Dengue virus
KVKYEGAGAPC

SEQ ID NO: 94941 - protein, 11 aa, Dengue virus
VKYEGAGAPCK

SEQ ID NO: 94942 - protein, 11 aa, Dengue virus
KYEGAGAPCKV

SEQ ID NO: 94943 - protein, 11 aa, Dengue virus
YEGAGAPCKVP

SEQ ID NO: 94944 - protein, 11 aa, Dengue virus
EGAGAPCKVPI

SEQ ID NO: 94945 - protein, 11 aa, Dengue virus
GAGAPCKVPIE

SEQ ID NO: 94946 - protein, 11 aa, Dengue virus
AGAPCKVPIEI

SEQ ID NO: 94947 - protein, 11 aa, Dengue virus
GAPCKVPIEIR

SEQ ID NO: 94948 - protein, 11 aa, Dengue virus
APCKVPIEIRD

SEQ ID NO: 94949 - protein, 11 aa, Dengue virus
PCKVPIEIRDV

SEQ ID NO: 94950 - protein, 11 aa, Dengue virus
CKVPIEIRDVN

SEQ ID NO: 94951 - protein, 11 aa, Dengue virus
KVPIEIRDVNK

SEQ ID NO: 94952 - protein, 11 aa, Dengue virus
VPIEIRDVNKE

SEQ ID NO: 94953 - protein, 11 aa, Dengue virus
PIEIRDVNKEK

SEQ ID NO: 94954 - protein, 11 aa, Dengue virus
IEIRDVNKEKV

SEQ ID NO: 94955 - protein, 11 aa, Dengue virus
EIRDVNKEKVV

SEQ ID NO: 94956 - protein, 11 aa, Dengue virus
IRDVNKEKVVG

SEQ ID NO: 94957 - protein, 11 aa, Dengue virus
RDVNKEKVVGR

SEQ ID NO: 94958 - protein, 11 aa, Dengue virus
AENTNSVTNIE

SEQ ID NO: 94959 - protein, 11 aa, Dengue virus
ENTNSVTNIEL

SEQ ID NO: 94960 - protein, 11 aa, Dengue virus
NTNSVTNIELE

SEQ ID NO: 94961 - protein, 11 aa, Dengue virus
TNSVTNIELEP

SEQ ID NO: 94962 - protein, 11 aa, Dengue virus
NSVTNIELEPP

SEQ ID NO: 94963 - protein, 11 aa, Dengue virus
SVTNIELEPPF

SEQ ID NO: 94964 - protein, 11 aa, Dengue virus
VTNIELEPPFG

SEQ ID NO: 94965 - protein, 11 aa, Dengue virus
TNIELEPPFGD

SEQ ID NO: 94966 - protein, 11 aa, Dengue virus
NIELEPPFGDS

SEQ ID NO: 94967 - protein, 11 aa, Dengue virus
IELEPPFGDSY

SEQ ID NO: 94968 - protein, 11 aa, Dengue virus
ELEPPFGDSYI

SEQ ID NO: 94969 - protein, 11 aa, Dengue virus
LEPPFGDSYIV

SEQ ID NO: 94970 - protein, 11 aa, Dengue virus
EPPFGDSYIVI

SEQ ID NO: 94971 - protein, 11 aa, Dengue virus
PPFGDSYIVIG

SEQ ID NO: 94972 - protein, 11 aa, Dengue virus
PFGDSYIVIGV

SEQ ID NO: 94973 - protein, 11 aa, Dengue virus
FGDSYIVIGVG

SEQ ID NO: 94974 - protein, 11 aa, Dengue virus
GDSYIVIGVGN

SEQ ID NO: 94975 - protein, 11 aa, Dengue virus
DSYIVIGVGNS

SEQ ID NO: 94976 - protein, 11 aa, Dengue virus
SYIVIGVGNSA

SEQ ID NO: 94977 - protein, 11 aa, Dengue virus
YIVIGVGNSAL

SEQ ID NO: 94978 - protein, 11 aa, Dengue virus
IVIGVGNSALT

SEQ ID NO: 94979 - protein, 11 aa, Dengue virus
VIGVGNSALTL

SEQ ID NO: 94980 - protein, 11 aa, Dengue virus
IGVGNSALTLH

SEQ ID NO: 94981 - protein, 11 aa, Dengue virus
GVGNSALTLHW

SEQ ID NO: 94982 - protein, 11 aa, Dengue virus
VGNSALTLHWF

SEQ ID NO: 94983 - protein, 11 aa, Dengue virus
GNSALTLHWFR

SEQ ID NO: 94984 - protein, 11 aa, Dengue virus
NSALTLHWFRK

SEQ ID NO: 94985 - protein, 11 aa, Dengue virus
SALTLHWFRKG

SEQ ID NO: 94986 - protein, 11 aa, Dengue virus
ALTLHWFRKGS

SEQ ID NO: 94987 - protein, 11 aa, Dengue virus
LTLHWFRKGSS

SEQ ID NO: 94988 - protein, 11 aa, Dengue virus
TLHWFRKGSSI

SEQ ID NO: 94989 - protein, 11 aa, Dengue virus
LHWFRKGSSIG

SEQ ID NO: 94990 - protein, 11 aa, Dengue virus
HWFRKGSSIGK

SEQ ID NO: 94991 - protein, 11 aa, Dengue virus
WFRKGSSIGKM

SEQ ID NO: 94992 - protein, 11 aa, Dengue virus
FRKGSSIGKMF

SEQ ID NO: 94993 - protein, 11 aa, Dengue virus
RKGSSIGKMFE

SEQ ID NO: 94994 - protein, 11 aa, Dengue virus
KGSSIGKMFES

SEQ ID NO: 94995 - protein, 11 aa, Dengue virus
GSSIGKMFEST

SEQ ID NO: 94996 - protein, 11 aa, Dengue virus
SSIGKMFESTY

SEQ ID NO: 94997 - protein, 11 aa, Dengue virus
SIGKMFESTYR

SEQ ID NO: 94998 - protein, 11 aa, Dengue virus
IGKMFESTYRG

SEQ ID NO: 94999 - protein, 11 aa, Dengue virus
GKMFESTYRGA

SEQ ID NO: 95000 - protein, 11 aa, Dengue virus
KMFESTYRGAK

SEQ ID NO: 95001 - protein, 11 aa, Dengue virus
MFESTYRGAKR

SEQ ID NO: 95002 - protein, 11 aa, Dengue virus
FESTYRGAKRM

SEQ ID NO: 95003 - protein, 11 aa, Dengue virus
ESTYRGAKRMA

SEQ ID NO: 95004 - protein, 11 aa, Dengue virus
STYRGAKRMAI

SEQ ID NO: 95005 - protein, 11 aa, Dengue virus
TYRGAKRMAIL

SEQ ID NO: 95006 - protein, 11 aa, Dengue virus
YRGAKRMAILG

SEQ ID NO: 95007 - protein, 11 aa, Dengue virus
RGAKRMAILGE

SEQ ID NO: 95008 - protein, 11 aa, Dengue virus
GAKRMAILGET

SEQ ID NO: 95009 - protein, 11 aa, Dengue virus
AKRMAILGETA

SEQ ID NO: 95010 - protein, 11 aa, Dengue virus
KRMAILGETAW

SEQ ID NO: 95011 - protein, 11 aa, Dengue virus
RMAILGETAWD

SEQ ID NO: 95012 - protein, 11 aa, Dengue virus
MAILGETAWDF

SEQ ID NO: 95013 - protein, 11 aa, Dengue virus
AILGETAWDFG

SEQ ID NO: 95014 - protein, 11 aa, Dengue virus
ILGETAWDFGS

SEQ ID NO: 95015 - protein, 11 aa, Dengue virus
LGETAWDFGSV

SEQ ID NO: 95016 - protein, 11 aa, Dengue virus
GETAWDFGSVG

SEQ ID NO: 95017 - protein, 11 aa, Dengue virus
ETAWDFGSVGG

SEQ ID NO: 95018 - protein, 11 aa, Dengue virus
TAWDFGSVGGL

SEQ ID NO: 95019 - protein, 11 aa, Dengue virus
AWDFGSVGGLF

SEQ ID NO: 95020 - protein, 11 aa, Dengue virus
WDFGSVGGLFT

SEQ ID NO: 95021 - protein, 11 aa, Dengue virus
DFGSVGGLFTS

SEQ ID NO: 95022 - protein, 11 aa, Dengue virus
FGSVGGLFTSL

SEQ ID NO: 95023 - protein, 11 aa, Dengue virus
GSVGGLFTSLG

SEQ ID NO: 95024 - protein, 11 aa, Dengue virus
SVGGLFTSLGK

SEQ ID NO: 95025 - protein, 11 aa, Dengue virus
VGGLFTSLGKA

SEQ ID NO: 95026 - protein, 11 aa, Dengue virus
GGLFTSLGKAV

SEQ ID NO: 95027 - protein, 11 aa, Dengue virus
GLFTSLGKAVH

SEQ ID NO: 95028 - protein, 11 aa, Dengue virus
LFTSLGKAVHQ

SEQ ID NO: 95029 - protein, 11 aa, Dengue virus
FTSLGKAVHQV

SEQ ID NO: 95030 - protein, 11 aa, Dengue virus
TSLGKAVHQVF

SEQ ID NO: 95031 - protein, 11 aa, Dengue virus
SLGKAVHQVFG

SEQ ID NO: 95032 - protein, 11 aa, Dengue virus
LGKAVHQVFGS

SEQ ID NO: 95033 - protein, 11 aa, Dengue virus
GKAVHQVFGSV

SEQ ID NO: 95034 - protein, 11 aa, Dengue virus
KAVHQVFGSVY

SEQ ID NO: 95035 - protein, 11 aa, Dengue virus
AVHQVFGSVYT

SEQ ID NO: 95036 - protein, 11 aa, Dengue virus
VHQVFGSVYTT

SEQ ID NO: 95037 - protein, 11 aa, Dengue virus
HQVFGSVYTTM

SEQ ID NO: 95038 - protein, 11 aa, Dengue virus
QVFGSVYTTMF

SEQ ID NO: 95039 - protein, 11 aa, Dengue virus
VFGSVYTTMFG

SEQ ID NO: 95040 - protein, 11 aa, Dengue virus
FGSVYTTMFGG

SEQ ID NO: 95041 - protein, 11 aa, Dengue virus
GSVYTTMFGGV

SEQ ID NO: 95042 - protein, 11 aa, Dengue virus
SVYTTMFGGVS

SEQ ID NO: 95043 - protein, 11 aa, Dengue virus
VYTTMFGGVSW

SEQ ID NO: 95044 - protein, 11 aa, Dengue virus
YTTMFGGVSWM

SEQ ID NO: 95045 - protein, 11 aa, Dengue virus
TTMFGGVSWMI

SEQ ID NO: 95046 - protein, 11 aa, Dengue virus
TMFGGVSWMIR

SEQ ID NO: 95047 - protein, 11 aa, Dengue virus
MFGGVSWMIRI

SEQ ID NO: 95048 - protein, 11 aa, Dengue virus
FGGVSWMIRIL

SEQ ID NO: 95049 - protein, 11 aa, Dengue virus
GGVSWMIRILI

SEQ ID NO: 95050 - protein, 11 aa, Dengue virus
GVSWMIRILIG

SEQ ID NO: 95051 - protein, 11 aa, Dengue virus
IRILIGFLVLW

SEQ ID NO: 95052 - protein, 11 aa, Dengue virus
RILIGFLVLWI

SEQ ID NO: 95053 - protein, 11 aa, Dengue virus
ILIGFLVLWIG

SEQ ID NO: 95054 - protein, 11 aa, Dengue virus
LIGFLVLWIGT

SEQ ID NO: 95055 - protein, 11 aa, Dengue virus
IGFLVLWIGTN

SEQ ID NO: 95056 - protein, 11 aa, Dengue virus
GFLVLWIGTNS

SEQ ID NO: 95057 - protein, 11 aa, Dengue virus
FLVLWIGTNSR

SEQ ID NO: 95058 - protein, 11 aa, Dengue virus
LVLWIGTNSRN

SEQ ID NO: 95059 - protein, 11 aa, Dengue virus
VLWIGTNSRNT

SEQ ID NO: 95060 - protein, 11 aa, Dengue virus
LWIGTNSRNTS

SEQ ID NO: 95061 - protein, 11 aa, Dengue virus
WIGTNSRNTSM

SEQ ID NO: 95062 - protein, 11 aa, Dengue virus
IGTNSRNTSMA

SEQ ID NO: 95063 - protein, 11 aa, Dengue virus
GTNSRNTSMAM

SEQ ID NO: 95064 - protein, 11 aa, Dengue virus
TNSRNTSMAMT

SEQ ID NO: 95065 - protein, 11 aa, Dengue virus
NSRNTSMAMTC

SEQ ID NO: 95066 - protein, 11 aa, Dengue virus
SRNTSMAMTCI

SEQ ID NO: 95067 - protein, 11 aa, Dengue virus
RNTSMAMTCIA

SEQ ID NO: 95068 - protein, 11 aa, Dengue virus
NTSMAMTCIAV

SEQ ID NO: 95069 - protein, 11 aa, Dengue virus
TSMAMTCIAVG

SEQ ID NO: 95070 - protein, 11 aa, Dengue virus
SMAMTCIAVGG

SEQ ID NO: 95071 - protein, 11 aa, Dengue virus
MAMTCIAVGGI

SEQ ID NO: 95072 - protein, 11 aa, Dengue virus
AMTCIAVGGIT

SEQ ID NO: 95073 - protein, 11 aa, Dengue virus
MTCIAVGGITL

SEQ ID NO: 95074 - protein, 11 aa, Dengue virus
TCIAVGGITLF

SEQ ID NO: 95075 - protein, 11 aa, Dengue virus
CIAVGGITLFL

SEQ ID NO: 95076 - protein, 11 aa, Dengue virus
IAVGGITLFLG

SEQ ID NO: 95077 - protein, 11 aa, Dengue virus
AVGGITLFLGF

SEQ ID NO: 95078 - protein, 11 aa, Dengue virus
VGGITLFLGFT

SEQ ID NO: 95079 - protein, 11 aa, Dengue virus
GGITLFLGFTV

SEQ ID NO: 95080 - protein, 11 aa, Dengue virus
GITLFLGFTVQ

SEQ ID NO: 95081 - protein, 11 aa, Dengue virus
ITLFLGFTVQA

SEQ ID NO: 95082 - protein, 11 aa, Dengue virus
TLFLGFTVQAD

SEQ ID NO: 95083 - protein, 11 aa, Dengue virus
LFLGFTVQADM

SEQ ID NO: 95084 - protein, 11 aa, Dengue virus
FLGFTVQADMG

SEQ ID NO: 95085 - protein, 11 aa, Dengue virus
LGFTVQADMGC

SEQ ID NO: 95086 - protein, 11 aa, Dengue virus
SWSGRELKCGS

SEQ ID NO: 95087 - protein, 11 aa, Dengue virus
WSGRELKCGSG

SEQ ID NO: 95088 - protein, 11 aa, Dengue virus
SGRELKCGSGI

SEQ ID NO: 95089 - protein, 11 aa, Dengue virus
GRELKCGSGIF

SEQ ID NO: 95090 - protein, 11 aa, Dengue virus
RELKCGSGIFV

SEQ ID NO: 95091 - protein, 11 aa, Dengue virus
ELKCGSGIFVV

SEQ ID NO: 95092 - protein, 11 aa, Dengue virus
LKCGSGIFVVD

SEQ ID NO: 95093 - protein, 11 aa, Dengue virus
KCGSGIFVVDN

SEQ ID NO: 95094 - protein, 11 aa, Dengue virus
CGSGIFVVDNV

SEQ ID NO: 95095 - protein, 11 aa, Dengue virus
GSGIFVVDNVH

SEQ ID NO: 95096 - protein, 11 aa, Dengue virus
SGIFVVDNVHT

SEQ ID NO: 95097 - protein, 11 aa, Dengue virus
GIFVVDNVHTW

SEQ ID NO: 95098 - protein, 11 aa, Dengue virus
IFVVDNVHTWT

SEQ ID NO: 95099 - protein, 11 aa, Dengue virus
FVVDNVHTWTE

SEQ ID NO: 95100 - protein, 11 aa, Dengue virus
VVDNVHTWTEQ

SEQ ID NO: 95101 - protein, 11 aa, Dengue virus
VDNVHTWTEQY

SEQ ID NO: 95102 - protein, 11 aa, Dengue virus
DNVHTWTEQYK

SEQ ID NO: 95103 - protein, 11 aa, Dengue virus
NVHTWTEQYKF

SEQ ID NO: 95104 - protein, 11 aa, Dengue virus
VHTWTEQYKFQ

SEQ ID NO: 95105 - protein, 11 aa, Dengue virus
HTWTEQYKFQP

SEQ ID NO: 95106 - protein, 11 aa, Dengue virus
TWTEQYKFQPE

SEQ ID NO: 95107 - protein, 11 aa, Dengue virus
WTEQYKFQPES

SEQ ID NO: 95108 - protein, 11 aa, Dengue virus
TEQYKFQPESP

SEQ ID NO: 95109 - protein, 11 aa, Dengue virus
EQYKFQPESPA

SEQ ID NO: 95110 - protein, 11 aa, Dengue virus
QYKFQPESPAR

SEQ ID NO: 95111 - protein, 11 aa, Dengue virus
YKFQPESPARL

SEQ ID NO: 95112 - protein, 11 aa, Dengue virus
KFQPESPARLA

SEQ ID NO: 95113 - protein, 11 aa, Dengue virus
FQPESPARLAS

SEQ ID NO: 95114 - protein, 11 aa, Dengue virus
QPESPARLASA

SEQ ID NO: 95115 - protein, 11 aa, Dengue virus
PESPARLASAI

SEQ ID NO: 95116 - protein, 11 aa, Dengue virus
ESPARLASAIL

SEQ ID NO: 95117 - protein, 11 aa, Dengue virus
SPARLASAILN

SEQ ID NO: 95118 - protein, 11 aa, Dengue virus
PARLASAILNA

SEQ ID NO: 95119 - protein, 11 aa, Dengue virus
ARLASAILNAH

SEQ ID NO: 95120 - protein, 11 aa, Dengue virus
RLASAILNAHK

SEQ ID NO: 95121 - protein, 11 aa, Dengue virus
LASAILNAHKD

SEQ ID NO: 95122 - protein, 11 aa, Dengue virus
ASAILNAHKDG

SEQ ID NO: 95123 - protein, 11 aa, Dengue virus
SAILNAHKDGV

SEQ ID NO: 95124 - protein, 11 aa, Dengue virus
AILNAHKDGVC

SEQ ID NO: 95125 - protein, 11 aa, Dengue virus
ILNAHKDGVCG

SEQ ID NO: 95126 - protein, 11 aa, Dengue virus
LNAHKDGVCGI

SEQ ID NO: 95127 - protein, 11 aa, Dengue virus
NAHKDGVCGIR

SEQ ID NO: 95128 - protein, 11 aa, Dengue virus
AHKDGVCGIRS

SEQ ID NO: 95129 - protein, 11 aa, Dengue virus
HKDGVCGIRST

SEQ ID NO: 95130 - protein, 11 aa, Dengue virus
KDGVCGIRSTT

SEQ ID NO: 95131 - protein, 11 aa, Dengue virus
DGVCGIRSTTR

SEQ ID NO: 95132 - protein, 11 aa, Dengue virus
GVCGIRSTTRL

SEQ ID NO: 95133 - protein, 11 aa, Dengue virus
VCGIRSTTRLE

SEQ ID NO: 95134 - protein, 11 aa, Dengue virus
CGIRSTTRLEN

SEQ ID NO: 95135 - protein, 11 aa, Dengue virus
GIRSTTRLENV

SEQ ID NO: 95136 - protein, 11 aa, Dengue virus
IRSTTRLENVM

SEQ ID NO: 95137 - protein, 11 aa, Dengue virus
RSTTRLENVMW

SEQ ID NO: 95138 - protein, 11 aa, Dengue virus
STTRLENVMWK

SEQ ID NO: 95139 - protein, 11 aa, Dengue virus
TTRLENVMWKQ

SEQ ID NO: 95140 - protein, 11 aa, Dengue virus
TRLENVMWKQI

SEQ ID NO: 95141 - protein, 11 aa, Dengue virus
RLENVMWKQIT

SEQ ID NO: 95142 - protein, 11 aa, Dengue virus
LENVMWKQITN

SEQ ID NO: 95143 - protein, 11 aa, Dengue virus
ENVMWKQITNE

SEQ ID NO: 95144 - protein, 11 aa, Dengue virus
NVMWKQITNEL

SEQ ID NO: 95145 - protein, 11 aa, Dengue virus
VMWKQITNELN

SEQ ID NO: 95146 - protein, 11 aa, Dengue virus
MWKQITNELNY

SEQ ID NO: 95147 - protein, 11 aa, Dengue virus
WKQITNELNYV

SEQ ID NO: 95148 - protein, 11 aa, Dengue virus
KQITNELNYVL

SEQ ID NO: 95149 - protein, 11 aa, Dengue virus
QITNELNYVLW

SEQ ID NO: 95150 - protein, 11 aa, Dengue virus
ITNELNYVLWE

SEQ ID NO: 95151 - protein, 11 aa, Dengue virus
TNELNYVLWEG

SEQ ID NO: 95152 - protein, 11 aa, Dengue virus
NELNYVLWEGG

SEQ ID NO: 95153 - protein, 11 aa, Dengue virus
ELNYVLWEGGH

SEQ ID NO: 95154 - protein, 11 aa, Dengue virus
LNYVLWEGGHD

SEQ ID NO: 95155 - protein, 11 aa, Dengue virus
NYVLWEGGHDL

SEQ ID NO: 95156 - protein, 11 aa, Dengue virus
YVLWEGGHDLT

SEQ ID NO: 95157 - protein, 11 aa, Dengue virus
VLWEGGHDLTV

SEQ ID NO: 95158 - protein, 11 aa, Dengue virus
LWEGGHDLTVV

SEQ ID NO: 95159 - protein, 11 aa, Dengue virus
WEGGHDLTVVA

SEQ ID NO: 95160 - protein, 11 aa, Dengue virus
EGGHDLTVVAG

SEQ ID NO: 95161 - protein, 11 aa, Dengue virus
GGHDLTVVAGD

SEQ ID NO: 95162 - protein, 11 aa, Dengue virus
GHDLTVVAGDV

SEQ ID NO: 95163 - protein, 11 aa, Dengue virus
HDLTVVAGDVK

SEQ ID NO: 95164 - protein, 11 aa, Dengue virus
DLTVVAGDVKG

SEQ ID NO: 95165 - protein, 11 aa, Dengue virus
LTVVAGDVKGV

SEQ ID NO: 95166 - protein, 11 aa, Dengue virus
TVVAGDVKGVL

SEQ ID NO: 95167 - protein, 11 aa, Dengue virus
VAGDVKGVLTK

SEQ ID NO: 95168 - protein, 11 aa, Dengue virus
AGDVKGVLTKG

SEQ ID NO: 95169 - protein, 11 aa, Dengue virus
GDVKGVLTKGK

SEQ ID NO: 95170 - protein, 11 aa, Dengue virus
DVKGVLTKGKR

SEQ ID NO: 95171 - protein, 11 aa, Dengue virus
KGVLTKGKRAL

SEQ ID NO: 95172 - protein, 11 aa, Dengue virus
GVLTKGKRALT

SEQ ID NO: 95173 - protein, 11 aa, Dengue virus
VLTKGKRALTP

SEQ ID NO: 95174 - protein, 11 aa, Dengue virus
LTKGKRALTPP

SEQ ID NO: 95175 - protein, 11 aa, Dengue virus
LTPPVSDLKYS

SEQ ID NO: 95176 - protein, 11 aa, Dengue virus
TPPVSDLKYSW

SEQ ID NO: 95177 - protein, 11 aa, Dengue virus
PPVSDLKYSWK

SEQ ID NO: 95178 - protein, 11 aa, Dengue virus
PVSDLKYSWKT

SEQ ID NO: 95179 - protein, 11 aa, Dengue virus
VSDLKYSWKTW

SEQ ID NO: 95180 - protein, 11 aa, Dengue virus
SDLKYSWKTWG

SEQ ID NO: 95181 - protein, 11 aa, Dengue virus
DLKYSWKTWGK

SEQ ID NO: 95182 - protein, 11 aa, Dengue virus
LKYSWKTWGKA

SEQ ID NO: 95183 - protein, 11 aa, Dengue virus
KYSWKTWGKAK

SEQ ID NO: 95184 - protein, 11 aa, Dengue virus
YSWKTWGKAKI

SEQ ID NO: 95185 - protein, 11 aa, Dengue virus
SWKTWGKAKIF

SEQ ID NO: 95186 - protein, 11 aa, Dengue virus
WKTWGKAKIFT

SEQ ID NO: 95187 - protein, 11 aa, Dengue virus
KTWGKAKIFTP

SEQ ID NO: 95188 - protein, 11 aa, Dengue virus
TWGKAKIFTPE

SEQ ID NO: 95189 - protein, 11 aa, Dengue virus
WGKAKIFTPEA

SEQ ID NO: 95190 - protein, 11 aa, Dengue virus
RNSTFLIDGPD

SEQ ID NO: 95191 - protein, 11 aa, Dengue virus
NSTFLIDGPDT

SEQ ID NO: 95192 - protein, 11 aa, Dengue virus
STFLIDGPDTS

SEQ ID NO: 95193 - protein, 11 aa, Dengue virus
TFLIDGPDTSE

SEQ ID NO: 95194 - protein, 11 aa, Dengue virus
FLIDGPDTSEC

SEQ ID NO: 95195 - protein, 11 aa, Dengue virus
LIDGPDTSECP

SEQ ID NO: 95196 - protein, 11 aa, Dengue virus
IDGPDTSECPN

SEQ ID NO: 95197 - protein, 11 aa, Dengue virus
DGPDTSECPNE

SEQ ID NO: 95198 - protein, 11 aa, Dengue virus
GPDTSECPNER

SEQ ID NO: 95199 - protein, 11 aa, Dengue virus
PDTSECPNERR

SEQ ID NO: 95200 - protein, 11 aa, Dengue virus
DTSECPNERRA

SEQ ID NO: 95201 - protein, 11 aa, Dengue virus
TSECPNERRAW

SEQ ID NO: 95202 - protein, 11 aa, Dengue virus
SECPNERRAWN

SEQ ID NO: 95203 - protein, 11 aa, Dengue virus
ECPNERRAWNS

SEQ ID NO: 95204 - protein, 11 aa, Dengue virus
CPNERRAWNSL

SEQ ID NO: 95205 - protein, 11 aa, Dengue virus
PNERRAWNSLE

SEQ ID NO: 95206 - protein, 11 aa, Dengue virus
NERRAWNSLEV

SEQ ID NO: 95207 - protein, 11 aa, Dengue virus
ERRAWNSLEVE

SEQ ID NO: 95208 - protein, 11 aa, Dengue virus
RRAWNSLEVED

SEQ ID NO: 95209 - protein, 11 aa, Dengue virus
RAWNSLEVEDY

SEQ ID NO: 95210 - protein, 11 aa, Dengue virus
AWNSLEVEDYG

SEQ ID NO: 95211 - protein, 11 aa, Dengue virus
WNSLEVEDYGF

SEQ ID NO: 95212 - protein, 11 aa, Dengue virus
NSLEVEDYGFG

SEQ ID NO: 95213 - protein, 11 aa, Dengue virus
SLEVEDYGFGM

SEQ ID NO: 95214 - protein, 11 aa, Dengue virus
LEVEDYGFGMF

SEQ ID NO: 95215 - protein, 11 aa, Dengue virus
EVEDYGFGMFT

SEQ ID NO: 95216 - protein, 11 aa, Dengue virus
VEDYGFGMFTT

SEQ ID NO: 95217 - protein, 11 aa, Dengue virus
EDYGFGMFTTN

SEQ ID NO: 95218 - protein, 11 aa, Dengue virus
DYGFGMFTTNI

SEQ ID NO: 95219 - protein, 11 aa, Dengue virus
YGFGMFTTNIW

SEQ ID NO: 95220 - protein, 11 aa, Dengue virus
GFGMFTTNIWM

SEQ ID NO: 95221 - protein, 11 aa, Dengue virus
FGMFTTNIWMK

SEQ ID NO: 95222 - protein, 11 aa, Dengue virus
GMFTTNIWMKF

SEQ ID NO: 95223 - protein, 11 aa, Dengue virus
MFTTNIWMKFR

SEQ ID NO: 95224 - protein, 11 aa, Dengue virus
FTTNIWMKFRE

SEQ ID NO: 95225 - protein, 11 aa, Dengue virus
TTNIWMKFREG

SEQ ID NO: 95226 - protein, 11 aa, Dengue virus
TNIWMKFREGS

SEQ ID NO: 95227 - protein, 11 aa, Dengue virus
NIWMKFREGSS

SEQ ID NO: 95228 - protein, 11 aa, Dengue virus
IWMKFREGSSE

SEQ ID NO: 95229 - protein, 11 aa, Dengue virus
WMKFREGSSEV

SEQ ID NO: 95230 - protein, 11 aa, Dengue virus
MKFREGSSEVC

SEQ ID NO: 95231 - protein, 11 aa, Dengue virus
KFREGSSEVCD

SEQ ID NO: 95232 - protein, 11 aa, Dengue virus
FREGSSEVCDH

SEQ ID NO: 95233 - protein, 11 aa, Dengue virus
REGSSEVCDHR

SEQ ID NO: 95234 - protein, 11 aa, Dengue virus
EGSSEVCDHRL

SEQ ID NO: 95235 - protein, 11 aa, Dengue virus
GSSEVCDHRLM

SEQ ID NO: 95236 - protein, 11 aa, Dengue virus
SSEVCDHRLMS

SEQ ID NO: 95237 - protein, 11 aa, Dengue virus
SEVCDHRLMSA

SEQ ID NO: 95238 - protein, 11 aa, Dengue virus
EVCDHRLMSAA

SEQ ID NO: 95239 - protein, 11 aa, Dengue virus
VCDHRLMSAAI

SEQ ID NO: 95240 - protein, 11 aa, Dengue virus
CDHRLMSAAIK

SEQ ID NO: 95241 - protein, 11 aa, Dengue virus
DHRLMSAAIKD

SEQ ID NO: 95242 - protein, 11 aa, Dengue virus
HRLMSAAIKDQ

SEQ ID NO: 95243 - protein, 11 aa, Dengue virus
RLMSAAIKDQK

SEQ ID NO: 95244 - protein, 11 aa, Dengue virus
LMSAAIKDQKA

SEQ ID NO: 95245 - protein, 11 aa, Dengue virus
MSAAIKDQKAV

SEQ ID NO: 95246 - protein, 11 aa, Dengue virus
SAAIKDQKAVH

SEQ ID NO: 95247 - protein, 11 aa, Dengue virus
AAIKDQKAVHA

SEQ ID NO: 95248 - protein, 11 aa, Dengue virus
AIKDQKAVHAD

SEQ ID NO: 95249 - protein, 11 aa, Dengue virus
IKDQKAVHADM

SEQ ID NO: 95250 - protein, 11 aa, Dengue virus
KDQKAVHADMG

SEQ ID NO: 95251 - protein, 11 aa, Dengue virus
DQKAVHADMGY

SEQ ID NO: 95252 - protein, 11 aa, Dengue virus
QKAVHADMGYW

SEQ ID NO: 95253 - protein, 11 aa, Dengue virus
KAVHADMGYWI

SEQ ID NO: 95254 - protein, 11 aa, Dengue virus
AVHADMGYWIE

SEQ ID NO: 95255 - protein, 11 aa, Dengue virus
VHADMGYWIES

SEQ ID NO: 95256 - protein, 11 aa, Dengue virus
HADMGYWIESS

SEQ ID NO: 95257 - protein, 11 aa, Dengue virus
ADMGYWIESSK

SEQ ID NO: 95258 - protein, 11 aa, Dengue virus
DMGYWIESSKN

SEQ ID NO: 95259 - protein, 11 aa, Dengue virus
MGYWIESSKNQ

SEQ ID NO: 95260 - protein, 11 aa, Dengue virus
GYWIESSKNQT

SEQ ID NO: 95261 - protein, 11 aa, Dengue virus
YWIESSKNQTW

SEQ ID NO: 95262 - protein, 11 aa, Dengue virus
WIESSKNQTWQ

SEQ ID NO: 95263 - protein, 11 aa, Dengue virus
IESSKNQTWQI

SEQ ID NO: 95264 - protein, 11 aa, Dengue virus
ESSKNQTWQIE

SEQ ID NO: 95265 - protein, 11 aa, Dengue virus
SSKNQTWQIEK

SEQ ID NO: 95266 - protein, 11 aa, Dengue virus
SKNQTWQIEKA

SEQ ID NO: 95267 - protein, 11 aa, Dengue virus
KNQTWQIEKAS

SEQ ID NO: 95268 - protein, 11 aa, Dengue virus
NQTWQIEKASL

SEQ ID NO: 95269 - protein, 11 aa, Dengue virus
QTWQIEKASLI

SEQ ID NO: 95270 - protein, 11 aa, Dengue virus
TWQIEKASLIE

SEQ ID NO: 95271 - protein, 11 aa, Dengue virus
WQIEKASLIEV

SEQ ID NO: 95272 - protein, 11 aa, Dengue virus
QIEKASLIEVK

SEQ ID NO: 95273 - protein, 11 aa, Dengue virus
IEKASLIEVKT

SEQ ID NO: 95274 - protein, 11 aa, Dengue virus
EKASLIEVKTC

SEQ ID NO: 95275 - protein, 11 aa, Dengue virus
KASLIEVKTCL

SEQ ID NO: 95276 - protein, 11 aa, Dengue virus
ASLIEVKTCLW

SEQ ID NO: 95277 - protein, 11 aa, Dengue virus
SLIEVKTCLWP

SEQ ID NO: 95278 - protein, 11 aa, Dengue virus
LIEVKTCLWPK

SEQ ID NO: 95279 - protein, 11 aa, Dengue virus
IEVKTCLWPKT

SEQ ID NO: 95280 - protein, 11 aa, Dengue virus
EVKTCLWPKTH

SEQ ID NO: 95281 - protein, 11 aa, Dengue virus
VKTCLWPKTHT

SEQ ID NO: 95282 - protein, 11 aa, Dengue virus
KTCLWPKTHTL

SEQ ID NO: 95283 - protein, 11 aa, Dengue virus
TCLWPKTHTLW

SEQ ID NO: 95284 - protein, 11 aa, Dengue virus
CLWPKTHTLWS

SEQ ID NO: 95285 - protein, 11 aa, Dengue virus
LWPKTHTLWSN

SEQ ID NO: 95286 - protein, 11 aa, Dengue virus
WPKTHTLWSNG

SEQ ID NO: 95287 - protein, 11 aa, Dengue virus
PKTHTLWSNGV

SEQ ID NO: 95288 - protein, 11 aa, Dengue virus
KTHTLWSNGVL

SEQ ID NO: 95289 - protein, 11 aa, Dengue virus
THTLWSNGVLE

SEQ ID NO: 95290 - protein, 11 aa, Dengue virus
HTLWSNGVLES

SEQ ID NO: 95291 - protein, 11 aa, Dengue virus
TLWSNGVLESQ

SEQ ID NO: 95292 - protein, 11 aa, Dengue virus
LWSNGVLESQM

SEQ ID NO: 95293 - protein, 11 aa, Dengue virus
WSNGVLESQML

SEQ ID NO: 95294 - protein, 11 aa, Dengue virus
SNGVLESQMLI

SEQ ID NO: 95295 - protein, 11 aa, Dengue virus
NGVLESQMLIP

SEQ ID NO: 95296 - protein, 11 aa, Dengue virus
GVLESQMLIPK

SEQ ID NO: 95297 - protein, 11 aa, Dengue virus
VLESQMLIPKS

SEQ ID NO: 95298 - protein, 11 aa, Dengue virus
LESQMLIPKSY

SEQ ID NO: 95299 - protein, 11 aa, Dengue virus
ESQMLIPKSYA

SEQ ID NO: 95300 - protein, 11 aa, Dengue virus
SQMLIPKSYAG

SEQ ID NO: 95301 - protein, 11 aa, Dengue virus
QMLIPKSYAGP

SEQ ID NO: 95302 - protein, 11 aa, Dengue virus
MLIPKSYAGPF

SEQ ID NO: 95303 - protein, 11 aa, Dengue virus
LIPKSYAGPFS

SEQ ID NO: 95304 - protein, 11 aa, Dengue virus
IPKSYAGPFSQ

SEQ ID NO: 95305 - protein, 11 aa, Dengue virus
PKSYAGPFSQH

SEQ ID NO: 95306 - protein, 11 aa, Dengue virus
KSYAGPFSQHN

SEQ ID NO: 95307 - protein, 11 aa, Dengue virus
SYAGPFSQHNY

SEQ ID NO: 95308 - protein, 11 aa, Dengue virus
YAGPFSQHNYR

SEQ ID NO: 95309 - protein, 11 aa, Dengue virus
AGPFSQHNYRQ

SEQ ID NO: 95310 - protein, 11 aa, Dengue virus
GPFSQHNYRQG

SEQ ID NO: 95311 - protein, 11 aa, Dengue virus
PFSQHNYRQGY

SEQ ID NO: 95312 - protein, 11 aa, Dengue virus
FSQHNYRQGYA

SEQ ID NO: 95313 - protein, 11 aa, Dengue virus
SQHNYRQGYAT

SEQ ID NO: 95314 - protein, 11 aa, Dengue virus
QHNYRQGYATQ

SEQ ID NO: 95315 - protein, 11 aa, Dengue virus
HNYRQGYATQT

SEQ ID NO: 95316 - protein, 11 aa, Dengue virus
NYRQGYATQTV

SEQ ID NO: 95317 - protein, 11 aa, Dengue virus
YRQGYATQTVG

SEQ ID NO: 95318 - protein, 11 aa, Dengue virus
RQGYATQTVGP

SEQ ID NO: 95319 - protein, 11 aa, Dengue virus
QGYATQTVGPW

SEQ ID NO: 95320 - protein, 11 aa, Dengue virus
GYATQTVGPWH

SEQ ID NO: 95321 - protein, 11 aa, Dengue virus
YATQTVGPWHL

SEQ ID NO: 95322 - protein, 11 aa, Dengue virus
ATQTVGPWHLG

SEQ ID NO: 95323 - protein, 11 aa, Dengue virus
TQTVGPWHLGK

SEQ ID NO: 95324 - protein, 11 aa, Dengue virus
QTVGPWHLGKL

SEQ ID NO: 95325 - protein, 11 aa, Dengue virus
TVGPWHLGKLE

SEQ ID NO: 95326 - protein, 11 aa, Dengue virus
VGPWHLGKLEI

SEQ ID NO: 95327 - protein, 11 aa, Dengue virus
GPWHLGKLEID

SEQ ID NO: 95328 - protein, 11 aa, Dengue virus
PWHLGKLEIDF

SEQ ID NO: 95329 - protein, 11 aa, Dengue virus
WHLGKLEIDFG

SEQ ID NO: 95330 - protein, 11 aa, Dengue virus
HLGKLEIDFGE

SEQ ID NO: 95331 - protein, 11 aa, Dengue virus
LGKLEIDFGEC

SEQ ID NO: 95332 - protein, 11 aa, Dengue virus
GKLEIDFGECP

SEQ ID NO: 95333 - protein, 11 aa, Dengue virus
KLEIDFGECPG

SEQ ID NO: 95334 - protein, 11 aa, Dengue virus
LEIDFGECPGT

SEQ ID NO: 95335 - protein, 11 aa, Dengue virus
EIDFGECPGTT

SEQ ID NO: 95336 - protein, 11 aa, Dengue virus
IDFGECPGTTV

SEQ ID NO: 95337 - protein, 11 aa, Dengue virus
DFGECPGTTVT

SEQ ID NO: 95338 - protein, 11 aa, Dengue virus
FGECPGTTVTI

SEQ ID NO: 95339 - protein, 11 aa, Dengue virus
GECPGTTVTIQ

SEQ ID NO: 95340 - protein, 11 aa, Dengue virus
ECPGTTVTIQE

SEQ ID NO: 95341 - protein, 11 aa, Dengue virus
CPGTTVTIQED

SEQ ID NO: 95342 - protein, 11 aa, Dengue virus
PGTTVTIQEDC

SEQ ID NO: 95343 - protein, 11 aa, Dengue virus
QEDCDHRGPSL

SEQ ID NO: 95344 - protein, 11 aa, Dengue virus
EDCDHRGPSLR

SEQ ID NO: 95345 - protein, 11 aa, Dengue virus
DCDHRGPSLRT

SEQ ID NO: 95346 - protein, 11 aa, Dengue virus
CDHRGPSLRTT

SEQ ID NO: 95347 - protein, 11 aa, Dengue virus
DHRGPSLRTTT

SEQ ID NO: 95348 - protein, 11 aa, Dengue virus
HRGPSLRTTTA

SEQ ID NO: 95349 - protein, 11 aa, Dengue virus
RGPSLRTTTAS

SEQ ID NO: 95350 - protein, 11 aa, Dengue virus
GPSLRTTTASG

SEQ ID NO: 95351 - protein, 11 aa, Dengue virus
PSLRTTTASGK

SEQ ID NO: 95352 - protein, 11 aa, Dengue virus
SLRTTTASGKL

SEQ ID NO: 95353 - protein, 11 aa, Dengue virus
LRTTTASGKLV

SEQ ID NO: 95354 - protein, 11 aa, Dengue virus
RTTTASGKLVT

SEQ ID NO: 95355 - protein, 11 aa, Dengue virus
TTTASGKLVTQ

SEQ ID NO: 95356 - protein, 11 aa, Dengue virus
TTASGKLVTQW

SEQ ID NO: 95357 - protein, 11 aa, Dengue virus
TASGKLVTQWC

SEQ ID NO: 95358 - protein, 11 aa, Dengue virus
ASGKLVTQWCC

SEQ ID NO: 95359 - protein, 11 aa, Dengue virus
SGKLVTQWCCR

SEQ ID NO: 95360 - protein, 11 aa, Dengue virus
GKLVTQWCCRS

SEQ ID NO: 95361 - protein, 11 aa, Dengue virus
KLVTQWCCRSC

SEQ ID NO: 95362 - protein, 11 aa, Dengue virus
LVTQWCCRSCT

SEQ ID NO: 95363 - protein, 11 aa, Dengue virus
VTQWCCRSCTM

SEQ ID NO: 95364 - protein, 11 aa, Dengue virus
TQWCCRSCTMP

SEQ ID NO: 95365 - protein, 11 aa, Dengue virus
QWCCRSCTMPP

SEQ ID NO: 95366 - protein, 11 aa, Dengue virus
WCCRSCTMPPL

SEQ ID NO: 95367 - protein, 11 aa, Dengue virus
CCRSCTMPPLR

SEQ ID NO: 95368 - protein, 11 aa, Dengue virus
CRSCTMPPLRF

SEQ ID NO: 95369 - protein, 11 aa, Dengue virus
RSCTMPPLRFL

SEQ ID NO: 95370 - protein, 11 aa, Dengue virus
SCTMPPLRFLG

SEQ ID NO: 95371 - protein, 11 aa, Dengue virus
CTMPPLRFLGE

SEQ ID NO: 95372 - protein, 11 aa, Dengue virus
TMPPLRFLGED

SEQ ID NO: 95373 - protein, 11 aa, Dengue virus
MPPLRFLGEDG

SEQ ID NO: 95374 - protein, 11 aa, Dengue virus
PPLRFLGEDGC

SEQ ID NO: 95375 - protein, 11 aa, Dengue virus
PLRFLGEDGCW

SEQ ID NO: 95376 - protein, 11 aa, Dengue virus
LRFLGEDGCWY

SEQ ID NO: 95377 - protein, 11 aa, Dengue virus
RFLGEDGCWYG

SEQ ID NO: 95378 - protein, 11 aa, Dengue virus
FLGEDGCWYGM

SEQ ID NO: 95379 - protein, 11 aa, Dengue virus
LGEDGCWYGME

SEQ ID NO: 95380 - protein, 11 aa, Dengue virus
GEDGCWYGMEI

SEQ ID NO: 95381 - protein, 11 aa, Dengue virus
EDGCWYGMEIR

SEQ ID NO: 95382 - protein, 11 aa, Dengue virus
DGCWYGMEIRP

SEQ ID NO: 95383 - protein, 11 aa, Dengue virus
GCWYGMEIRPL

SEQ ID NO: 95384 - protein, 11 aa, Dengue virus
CWYGMEIRPLS

SEQ ID NO: 95385 - protein, 11 aa, Dengue virus
WYGMEIRPLSE

SEQ ID NO: 95386 - protein, 11 aa, Dengue virus
YGMEIRPLSEK

SEQ ID NO: 95387 - protein, 11 aa, Dengue virus
GMEIRPLSEKE

SEQ ID NO: 95388 - protein, 11 aa, Dengue virus
MEIRPLSEKEE

SEQ ID NO: 95389 - protein, 11 aa, Dengue virus
EIRPLSEKEEN

SEQ ID NO: 95390 - protein, 11 aa, Dengue virus
IRPLSEKEENM

SEQ ID NO: 95391 - protein, 11 aa, Dengue virus
RPLSEKEENMV

SEQ ID NO: 95392 - protein, 11 aa, Dengue virus
PLSEKEENMVK

SEQ ID NO: 95393 - protein, 11 aa, Dengue virus
LSEKEENMVKS

SEQ ID NO: 95394 - protein, 11 aa, Dengue virus
SEKEENMVKSQ

SEQ ID NO: 95395 - protein, 11 aa, Dengue virus
EKEENMVKSQV

SEQ ID NO: 95396 - protein, 11 aa, Dengue virus
EENMVKSQVTA

SEQ ID NO: 95397 - protein, 11 aa, Dengue virus
ENMVKSQVTAG

SEQ ID NO: 95398 - protein, 11 aa, Dengue virus
GTSETFSMGLL

SEQ ID NO: 95399 - protein, 11 aa, Dengue virus
TSETFSMGLLC

SEQ ID NO: 95400 - protein, 11 aa, Dengue virus
SETFSMGLLCL

SEQ ID NO: 95401 - protein, 11 aa, Dengue virus
ETFSMGLLCLT

SEQ ID NO: 95402 - protein, 11 aa, Dengue virus
TFSMGLLCLTL

SEQ ID NO: 95403 - protein, 11 aa, Dengue virus
FSMGLLCLTLF

SEQ ID NO: 95404 - protein, 11 aa, Dengue virus
SMGLLCLTLFV

SEQ ID NO: 95405 - protein, 11 aa, Dengue virus
MGLLCLTLFVE

SEQ ID NO: 95406 - protein, 11 aa, Dengue virus
GLLCLTLFVEE

SEQ ID NO: 95407 - protein, 11 aa, Dengue virus
LLCLTLFVEEC

SEQ ID NO: 95408 - protein, 11 aa, Dengue virus
LCLTLFVEECL

SEQ ID NO: 95409 - protein, 11 aa, Dengue virus
CLTLFVEECLR

SEQ ID NO: 95410 - protein, 11 aa, Dengue virus
LTLFVEECLRR

SEQ ID NO: 95411 - protein, 11 aa, Dengue virus
TLFVEECLRRR

SEQ ID NO: 95412 - protein, 11 aa, Dengue virus
LFVEECLRRRV

SEQ ID NO: 95413 - protein, 11 aa, Dengue virus
FVEECLRRRVT

SEQ ID NO: 95414 - protein, 11 aa, Dengue virus
VEECLRRRVTR

SEQ ID NO: 95415 - protein, 11 aa, Dengue virus
EECLRRRVTRK

SEQ ID NO: 95416 - protein, 11 aa, Dengue virus
ECLRRRVTRKH

SEQ ID NO: 95417 - protein, 11 aa, Dengue virus
CLRRRVTRKHM

SEQ ID NO: 95418 - protein, 11 aa, Dengue virus
LRRRVTRKHMI

SEQ ID NO: 95419 - protein, 11 aa, Dengue virus
RRRVTRKHMIL

SEQ ID NO: 95420 - protein, 11 aa, Dengue virus
RRVTRKHMILA

SEQ ID NO: 95421 - protein, 11 aa, Dengue virus
RVTRKHMILAV

SEQ ID NO: 95422 - protein, 11 aa, Dengue virus
VTRKHMILAVV

SEQ ID NO: 95423 - protein, 11 aa, Dengue virus
TRKHMILAVVI

SEQ ID NO: 95424 - protein, 11 aa, Dengue virus
RKHMILAVVIT

SEQ ID NO: 95425 - protein, 11 aa, Dengue virus
ITLCAIILGGL

SEQ ID NO: 95426 - protein, 11 aa, Dengue virus
TLCAIILGGLT

SEQ ID NO: 95427 - protein, 11 aa, Dengue virus
LCAIILGGLTW

SEQ ID NO: 95428 - protein, 11 aa, Dengue virus
CAIILGGLTWM

SEQ ID NO: 95429 - protein, 11 aa, Dengue virus
AIILGGLTWMD

SEQ ID NO: 95430 - protein, 11 aa, Dengue virus
IILGGLTWMDL

SEQ ID NO: 95431 - protein, 11 aa, Dengue virus
ILGGLTWMDLL

SEQ ID NO: 95432 - protein, 11 aa, Dengue virus
LGGLTWMDLLR

SEQ ID NO: 95433 - protein, 11 aa, Dengue virus
GGLTWMDLLRA

SEQ ID NO: 95434 - protein, 11 aa, Dengue virus
GLTWMDLLRAL

SEQ ID NO: 95435 - protein, 11 aa, Dengue virus
LTWMDLLRALI

SEQ ID NO: 95436 - protein, 11 aa, Dengue virus
TWMDLLRALIM

SEQ ID NO: 95437 - protein, 11 aa, Dengue virus
WMDLLRALIML

SEQ ID NO: 95438 - protein, 11 aa, Dengue virus
MDLLRALIMLG

SEQ ID NO: 95439 - protein, 11 aa, Dengue virus
DLLRALIMLGD

SEQ ID NO: 95440 - protein, 11 aa, Dengue virus
LLRALIMLGDT

SEQ ID NO: 95441 - protein, 11 aa, Dengue virus
LRALIMLGDTM

SEQ ID NO: 95442 - protein, 11 aa, Dengue virus
RALIMLGDTMS

SEQ ID NO: 95443 - protein, 11 aa, Dengue virus
ALIMLGDTMSG

SEQ ID NO: 95444 - protein, 11 aa, Dengue virus
LIMLGDTMSGR

SEQ ID NO: 95445 - protein, 11 aa, Dengue virus
IMLGDTMSGRI

SEQ ID NO: 95446 - protein, 11 aa, Dengue virus
MLGDTMSGRIG

SEQ ID NO: 95447 - protein, 11 aa, Dengue virus
LGDTMSGRIGG

SEQ ID NO: 95448 - protein, 11 aa, Dengue virus
GDTMSGRIGGQ

SEQ ID NO: 95449 - protein, 11 aa, Dengue virus
RIGGQTHLAIM

SEQ ID NO: 95450 - protein, 11 aa, Dengue virus
GGQTHLAIMAV

SEQ ID NO: 95451 - protein, 11 aa, Dengue virus
GQTHLAIMAVF

SEQ ID NO: 95452 - protein, 11 aa, Dengue virus
QTHLAIMAVFK

SEQ ID NO: 95453 - protein, 11 aa, Dengue virus
THLAIMAVFKM

SEQ ID NO: 95454 - protein, 11 aa, Dengue virus
HLAIMAVFKMS

SEQ ID NO: 95455 - protein, 11 aa, Dengue virus
LAIMAVFKMSP

SEQ ID NO: 95456 - protein, 11 aa, Dengue virus
AIMAVFKMSPG

SEQ ID NO: 95457 - protein, 11 aa, Dengue virus
IMAVFKMSPGY

SEQ ID NO: 95458 - protein, 11 aa, Dengue virus
MAVFKMSPGYV

SEQ ID NO: 95459 - protein, 11 aa, Dengue virus
AVFKMSPGYVL

SEQ ID NO: 95460 - protein, 11 aa, Dengue virus
VFKMSPGYVLG

SEQ ID NO: 95461 - protein, 11 aa, Dengue virus
FKMSPGYVLGV

SEQ ID NO: 95462 - protein, 11 aa, Dengue virus
KMSPGYVLGVF

SEQ ID NO: 95463 - protein, 11 aa, Dengue virus
MSPGYVLGVFL

SEQ ID NO: 95464 - protein, 11 aa, Dengue virus
SPGYVLGVFLR

SEQ ID NO: 95465 - protein, 11 aa, Dengue virus
PGYVLGVFLRK

SEQ ID NO: 95466 - protein, 11 aa, Dengue virus
GYVLGVFLRKL

SEQ ID NO: 95467 - protein, 11 aa, Dengue virus
YVLGVFLRKLT

SEQ ID NO: 95468 - protein, 11 aa, Dengue virus
VLGVFLRKLTS

SEQ ID NO: 95469 - protein, 11 aa, Dengue virus
LGVFLRKLTSR

SEQ ID NO: 95470 - protein, 11 aa, Dengue virus
GVFLRKLTSRE

SEQ ID NO: 95471 - protein, 11 aa, Dengue virus
VFLRKLTSRET

SEQ ID NO: 95472 - protein, 11 aa, Dengue virus
FLRKLTSRETA

SEQ ID NO: 95473 - protein, 11 aa, Dengue virus
LRKLTSRETAL

SEQ ID NO: 95474 - protein, 11 aa, Dengue virus
RKLTSRETALM

SEQ ID NO: 95475 - protein, 11 aa, Dengue virus
KLTSRETALMV

SEQ ID NO: 95476 - protein, 11 aa, Dengue virus
LTSRETALMVI

SEQ ID NO: 95477 - protein, 11 aa, Dengue virus
TSRETALMVIG

SEQ ID NO: 95478 - protein, 11 aa, Dengue virus
SRETALMVIGM

SEQ ID NO: 95479 - protein, 11 aa, Dengue virus
RETALMVIGMA

SEQ ID NO: 95480 - protein, 11 aa, Dengue virus
ETALMVIGMAM

SEQ ID NO: 95481 - protein, 11 aa, Dengue virus
TALMVIGMAMT

SEQ ID NO: 95482 - protein, 11 aa, Dengue virus
ALMVIGMAMTT

SEQ ID NO: 95483 - protein, 11 aa, Dengue virus
LMVIGMAMTTT

SEQ ID NO: 95484 - protein, 11 aa, Dengue virus
MVIGMAMTTTL

SEQ ID NO: 95485 - protein, 11 aa, Dengue virus
VIGMAMTTTLS

SEQ ID NO: 95486 - protein, 11 aa, Dengue virus
IGMAMTTTLSI

SEQ ID NO: 95487 - protein, 11 aa, Dengue virus
GMAMTTTLSIP

SEQ ID NO: 95488 - protein, 11 aa, Dengue virus
MAMTTTLSIPH

SEQ ID NO: 95489 - protein, 11 aa, Dengue virus
AMTTTLSIPHD

SEQ ID NO: 95490 - protein, 11 aa, Dengue virus
MTTTLSIPHDL

SEQ ID NO: 95491 - protein, 11 aa, Dengue virus
TTTLSIPHDLM

SEQ ID NO: 95492 - protein, 11 aa, Dengue virus
TTLSIPHDLME

SEQ ID NO: 95493 - protein, 11 aa, Dengue virus
TLSIPHDLMEL

SEQ ID NO: 95494 - protein, 11 aa, Dengue virus
LSIPHDLMELI

SEQ ID NO: 95495 - protein, 11 aa, Dengue virus
SIPHDLMELID

SEQ ID NO: 95496 - protein, 11 aa, Dengue virus
IPHDLMELIDG

SEQ ID NO: 95497 - protein, 11 aa, Dengue virus
PHDLMELIDGI

SEQ ID NO: 95498 - protein, 11 aa, Dengue virus
HDLMELIDGIS

SEQ ID NO: 95499 - protein, 11 aa, Dengue virus
DLMELIDGISL

SEQ ID NO: 95500 - protein, 11 aa, Dengue virus
LMELIDGISLG

SEQ ID NO: 95501 - protein, 11 aa, Dengue virus
MELIDGISLGL

SEQ ID NO: 95502 - protein, 11 aa, Dengue virus
ELIDGISLGLI

SEQ ID NO: 95503 - protein, 11 aa, Dengue virus
LIDGISLGLIL

SEQ ID NO: 95504 - protein, 11 aa, Dengue virus
IDGISLGLILL

SEQ ID NO: 95505 - protein, 11 aa, Dengue virus
DGISLGLILLK

SEQ ID NO: 95506 - protein, 11 aa, Dengue virus
GISLGLILLKI

SEQ ID NO: 95507 - protein, 11 aa, Dengue virus
ISLGLILLKIV

SEQ ID NO: 95508 - protein, 11 aa, Dengue virus
SLGLILLKIVT

SEQ ID NO: 95509 - protein, 11 aa, Dengue virus
LGLILLKIVTQ

SEQ ID NO: 95510 - protein, 11 aa, Dengue virus
GLILLKIVTQF

SEQ ID NO: 95511 - protein, 11 aa, Dengue virus
LILLKIVTQFD

SEQ ID NO: 95512 - protein, 11 aa, Dengue virus
VTQFDNTQVGT

SEQ ID NO: 95513 - protein, 11 aa, Dengue virus
TQFDNTQVGTL

SEQ ID NO: 95514 - protein, 11 aa, Dengue virus
QFDNTQVGTLA

SEQ ID NO: 95515 - protein, 11 aa, Dengue virus
FDNTQVGTLAL

SEQ ID NO: 95516 - protein, 11 aa, Dengue virus
DNTQVGTLALS

SEQ ID NO: 95517 - protein, 11 aa, Dengue virus
NTQVGTLALSL

SEQ ID NO: 95518 - protein, 11 aa, Dengue virus
TQVGTLALSLT

SEQ ID NO: 95519 - protein, 11 aa, Dengue virus
QVGTLALSLTF

SEQ ID NO: 95520 - protein, 11 aa, Dengue virus
VGTLALSLTFI

SEQ ID NO: 95521 - protein, 11 aa, Dengue virus
GTLALSLTFIR

SEQ ID NO: 95522 - protein, 11 aa, Dengue virus
TLALSLTFIRS

SEQ ID NO: 95523 - protein, 11 aa, Dengue virus
LALSLTFIRST

SEQ ID NO: 95524 - protein, 11 aa, Dengue virus
SLVMAWRTIMA

SEQ ID NO: 95525 - protein, 11 aa, Dengue virus
LVMAWRTIMAV

SEQ ID NO: 95526 - protein, 11 aa, Dengue virus
VMAWRTIMAVL

SEQ ID NO: 95527 - protein, 11 aa, Dengue virus
MAWRTIMAVLF

SEQ ID NO: 95528 - protein, 11 aa, Dengue virus
AWRTIMAVLFV

SEQ ID NO: 95529 - protein, 11 aa, Dengue virus
WRTIMAVLFVV

SEQ ID NO: 95530 - protein, 11 aa, Dengue virus
RTIMAVLFVVT

SEQ ID NO: 95531 - protein, 11 aa, Dengue virus
TIMAVLFVVTL

SEQ ID NO: 95532 - protein, 11 aa, Dengue virus
IMAVLFVVTLI

SEQ ID NO: 95533 - protein, 11 aa, Dengue virus
MAVLFVVTLIP

SEQ ID NO: 95534 - protein, 11 aa, Dengue virus
AVLFVVTLIPL

SEQ ID NO: 95535 - protein, 11 aa, Dengue virus
VLFVVTLIPLC

SEQ ID NO: 95536 - protein, 11 aa, Dengue virus
LFVVTLIPLCR

SEQ ID NO: 95537 - protein, 11 aa, Dengue virus
FVVTLIPLCRT

SEQ ID NO: 95538 - protein, 11 aa, Dengue virus
VVTLIPLCRTS

SEQ ID NO: 95539 - protein, 11 aa, Dengue virus
VTLIPLCRTSC

SEQ ID NO: 95540 - protein, 11 aa, Dengue virus
TLIPLCRTSCL

SEQ ID NO: 95541 - protein, 11 aa, Dengue virus
LIPLCRTSCLQ

SEQ ID NO: 95542 - protein, 11 aa, Dengue virus
IPLCRTSCLQK

SEQ ID NO: 95543 - protein, 11 aa, Dengue virus
PLCRTSCLQKQ

SEQ ID NO: 95544 - protein, 11 aa, Dengue virus
LCRTSCLQKQS

SEQ ID NO: 95545 - protein, 11 aa, Dengue virus
CRTSCLQKQSH

SEQ ID NO: 95546 - protein, 11 aa, Dengue virus
RTSCLQKQSHW

SEQ ID NO: 95547 - protein, 11 aa, Dengue virus
TSCLQKQSHWV

SEQ ID NO: 95548 - protein, 11 aa, Dengue virus
SCLQKQSHWVE

SEQ ID NO: 95549 - protein, 11 aa, Dengue virus
CLQKQSHWVEI

SEQ ID NO: 95550 - protein, 11 aa, Dengue virus
LQKQSHWVEIT

SEQ ID NO: 95551 - protein, 11 aa, Dengue virus
QKQSHWVEITA

SEQ ID NO: 95552 - protein, 11 aa, Dengue virus
KQSHWVEITAL

SEQ ID NO: 95553 - protein, 11 aa, Dengue virus
QSHWVEITALI

SEQ ID NO: 95554 - protein, 11 aa, Dengue virus
SHWVEITALIL

SEQ ID NO: 95555 - protein, 11 aa, Dengue virus
HWVEITALILG

SEQ ID NO: 95556 - protein, 11 aa, Dengue virus
WVEITALILGA

SEQ ID NO: 95557 - protein, 11 aa, Dengue virus
VEITALILGAQ

SEQ ID NO: 95558 - protein, 11 aa, Dengue virus
EITALILGAQA

SEQ ID NO: 95559 - protein, 11 aa, Dengue virus
ITALILGAQAL

SEQ ID NO: 95560 - protein, 11 aa, Dengue virus
TALILGAQALP

SEQ ID NO: 95561 - protein, 11 aa, Dengue virus
ALILGAQALPV

SEQ ID NO: 95562 - protein, 11 aa, Dengue virus
LILGAQALPVY

SEQ ID NO: 95563 - protein, 11 aa, Dengue virus
ILGAQALPVYL

SEQ ID NO: 95564 - protein, 11 aa, Dengue virus
LGAQALPVYLM

SEQ ID NO: 95565 - protein, 11 aa, Dengue virus
GAQALPVYLMT

SEQ ID NO: 95566 - protein, 11 aa, Dengue virus
AQALPVYLMTL

SEQ ID NO: 95567 - protein, 11 aa, Dengue virus
QALPVYLMTLM

SEQ ID NO: 95568 - protein, 11 aa, Dengue virus
ALPVYLMTLMK

SEQ ID NO: 95569 - protein, 11 aa, Dengue virus
LPVYLMTLMKG

SEQ ID NO: 95570 - protein, 11 aa, Dengue virus
PVYLMTLMKGA

SEQ ID NO: 95571 - protein, 11 aa, Dengue virus
VYLMTLMKGAS

SEQ ID NO: 95572 - protein, 11 aa, Dengue virus
YLMTLMKGASR

SEQ ID NO: 95573 - protein, 11 aa, Dengue virus
LMTLMKGASRR

SEQ ID NO: 95574 - protein, 11 aa, Dengue virus
MTLMKGASRRS

SEQ ID NO: 95575 - protein, 11 aa, Dengue virus
TLMKGASRRSW

SEQ ID NO: 95576 - protein, 11 aa, Dengue virus
LMKGASRRSWP

SEQ ID NO: 95577 - protein, 11 aa, Dengue virus
MKGASRRSWPL

SEQ ID NO: 95578 - protein, 11 aa, Dengue virus
KGASRRSWPLN

SEQ ID NO: 95579 - protein, 11 aa, Dengue virus
GASRRSWPLNE

SEQ ID NO: 95580 - protein, 11 aa, Dengue virus
ASRRSWPLNEG

SEQ ID NO: 95581 - protein, 11 aa, Dengue virus
SRRSWPLNEGI

SEQ ID NO: 95582 - protein, 11 aa, Dengue virus
RRSWPLNEGIM

SEQ ID NO: 95583 - protein, 11 aa, Dengue virus
RSWPLNEGIMA

SEQ ID NO: 95584 - protein, 11 aa, Dengue virus
SWPLNEGIMAV

SEQ ID NO: 95585 - protein, 11 aa, Dengue virus
WPLNEGIMAVG

SEQ ID NO: 95586 - protein, 11 aa, Dengue virus
PLNEGIMAVGL

SEQ ID NO: 95587 - protein, 11 aa, Dengue virus
LNEGIMAVGLV

SEQ ID NO: 95588 - protein, 11 aa, Dengue virus
NEGIMAVGLVS

SEQ ID NO: 95589 - protein, 11 aa, Dengue virus
EGIMAVGLVSL

SEQ ID NO: 95590 - protein, 11 aa, Dengue virus
GIMAVGLVSLL

SEQ ID NO: 95591 - protein, 11 aa, Dengue virus
IMAVGLVSLLG

SEQ ID NO: 95592 - protein, 11 aa, Dengue virus
MAVGLVSLLGS

SEQ ID NO: 95593 - protein, 11 aa, Dengue virus
AVGLVSLLGSA

SEQ ID NO: 95594 - protein, 11 aa, Dengue virus
VGLVSLLGSAL

SEQ ID NO: 95595 - protein, 11 aa, Dengue virus
GLVSLLGSALL

SEQ ID NO: 95596 - protein, 11 aa, Dengue virus
LVSLLGSALLK

SEQ ID NO: 95597 - protein, 11 aa, Dengue virus
VSLLGSALLKN

SEQ ID NO: 95598 - protein, 11 aa, Dengue virus
SLLGSALLKND

SEQ ID NO: 95599 - protein, 11 aa, Dengue virus
LLGSALLKNDV

SEQ ID NO: 95600 - protein, 11 aa, Dengue virus
LGSALLKNDVP

SEQ ID NO: 95601 - protein, 11 aa, Dengue virus
GSALLKNDVPL

SEQ ID NO: 95602 - protein, 11 aa, Dengue virus
SALLKNDVPLA

SEQ ID NO: 95603 - protein, 11 aa, Dengue virus
ALLKNDVPLAG

SEQ ID NO: 95604 - protein, 11 aa, Dengue virus
LLKNDVPLAGP

SEQ ID NO: 95605 - protein, 11 aa, Dengue virus
LKNDVPLAGPM

SEQ ID NO: 95606 - protein, 11 aa, Dengue virus
KNDVPLAGPMV

SEQ ID NO: 95607 - protein, 11 aa, Dengue virus
NDVPLAGPMVA

SEQ ID NO: 95608 - protein, 11 aa, Dengue virus
DVPLAGPMVAG

SEQ ID NO: 95609 - protein, 11 aa, Dengue virus
VPLAGPMVAGG

SEQ ID NO: 95610 - protein, 11 aa, Dengue virus
PLAGPMVAGGL

SEQ ID NO: 95611 - protein, 11 aa, Dengue virus
LAGPMVAGGLL

SEQ ID NO: 95612 - protein, 11 aa, Dengue virus
AGPMVAGGLLL

SEQ ID NO: 95613 - protein, 11 aa, Dengue virus
GPMVAGGLLLA

SEQ ID NO: 95614 - protein, 11 aa, Dengue virus
PMVAGGLLLAA

SEQ ID NO: 95615 - protein, 11 aa, Dengue virus
MVAGGLLLAAY

SEQ ID NO: 95616 - protein, 11 aa, Dengue virus
VAGGLLLAAYV

SEQ ID NO: 95617 - protein, 11 aa, Dengue virus
AGGLLLAAYVM

SEQ ID NO: 95618 - protein, 11 aa, Dengue virus
GGLLLAAYVMS

SEQ ID NO: 95619 - protein, 11 aa, Dengue virus
GLLLAAYVMSG

SEQ ID NO: 95620 - protein, 11 aa, Dengue virus
LLLAAYVMSGS

SEQ ID NO: 95621 - protein, 11 aa, Dengue virus
LLAAYVMSGSS

SEQ ID NO: 95622 - protein, 11 aa, Dengue virus
LAAYVMSGSSA

SEQ ID NO: 95623 - protein, 11 aa, Dengue virus
AAYVMSGSSAD

SEQ ID NO: 95624 - protein, 11 aa, Dengue virus
AYVMSGSSADL

SEQ ID NO: 95625 - protein, 11 aa, Dengue virus
YVMSGSSADLS

SEQ ID NO: 95626 - protein, 11 aa, Dengue virus
VMSGSSADLSL

SEQ ID NO: 95627 - protein, 11 aa, Dengue virus
MSGSSADLSLE

SEQ ID NO: 95628 - protein, 11 aa, Dengue virus
SGSSADLSLEK

SEQ ID NO: 95629 - protein, 11 aa, Dengue virus
GSSADLSLEKA

SEQ ID NO: 95630 - protein, 11 aa, Dengue virus
SSADLSLEKAA

SEQ ID NO: 95631 - protein, 11 aa, Dengue virus
SADLSLEKAAN

SEQ ID NO: 95632 - protein, 11 aa, Dengue virus
ADLSLEKAANV

SEQ ID NO: 95633 - protein, 11 aa, Dengue virus
DLSLEKAANVQ

SEQ ID NO: 95634 - protein, 11 aa, Dengue virus
LSLEKAANVQW

SEQ ID NO: 95635 - protein, 11 aa, Dengue virus
SLEKAANVQWD

SEQ ID NO: 95636 - protein, 11 aa, Dengue virus
LEKAANVQWDE

SEQ ID NO: 95637 - protein, 11 aa, Dengue virus
EKAANVQWDEM

SEQ ID NO: 95638 - protein, 11 aa, Dengue virus
KAANVQWDEMA

SEQ ID NO: 95639 - protein, 11 aa, Dengue virus
AANVQWDEMAD

SEQ ID NO: 95640 - protein, 11 aa, Dengue virus
ANVQWDEMADI

SEQ ID NO: 95641 - protein, 11 aa, Dengue virus
NVQWDEMADIT

SEQ ID NO: 95642 - protein, 11 aa, Dengue virus
VQWDEMADITG

SEQ ID NO: 95643 - protein, 11 aa, Dengue virus
QWDEMADITGS

SEQ ID NO: 95644 - protein, 11 aa, Dengue virus
WDEMADITGSS

SEQ ID NO: 95645 - protein, 11 aa, Dengue virus
DEMADITGSSP

SEQ ID NO: 95646 - protein, 11 aa, Dengue virus
EMADITGSSPI

SEQ ID NO: 95647 - protein, 11 aa, Dengue virus
MADITGSSPII

SEQ ID NO: 95648 - protein, 11 aa, Dengue virus
ADITGSSPIIE

SEQ ID NO: 95649 - protein, 11 aa, Dengue virus
DITGSSPIIEV

SEQ ID NO: 95650 - protein, 11 aa, Dengue virus
ITGSSPIIEVK

SEQ ID NO: 95651 - protein, 11 aa, Dengue virus
TGSSPIIEVKQ

SEQ ID NO: 95652 - protein, 11 aa, Dengue virus
GSSPIIEVKQD

SEQ ID NO: 95653 - protein, 11 aa, Dengue virus
SSPIIEVKQDE

SEQ ID NO: 95654 - protein, 11 aa, Dengue virus
SPIIEVKQDED

SEQ ID NO: 95655 - protein, 11 aa, Dengue virus
PIIEVKQDEDG

SEQ ID NO: 95656 - protein, 11 aa, Dengue virus
IIEVKQDEDGS

SEQ ID NO: 95657 - protein, 11 aa, Dengue virus
IEVKQDEDGSF

SEQ ID NO: 95658 - protein, 11 aa, Dengue virus
EVKQDEDGSFS

SEQ ID NO: 95659 - protein, 11 aa, Dengue virus
VKQDEDGSFSI

SEQ ID NO: 95660 - protein, 11 aa, Dengue virus
KQDEDGSFSIR

SEQ ID NO: 95661 - protein, 11 aa, Dengue virus
QDEDGSFSIRD

SEQ ID NO: 95662 - protein, 11 aa, Dengue virus
DEDGSFSIRDV

SEQ ID NO: 95663 - protein, 11 aa, Dengue virus
EDGSFSIRDVE

SEQ ID NO: 95664 - protein, 11 aa, Dengue virus
DGSFSIRDVEE

SEQ ID NO: 95665 - protein, 11 aa, Dengue virus
GSFSIRDVEET

SEQ ID NO: 95666 - protein, 11 aa, Dengue virus
SFSIRDVEETN

SEQ ID NO: 95667 - protein, 11 aa, Dengue virus
FSIRDVEETNM

SEQ ID NO: 95668 - protein, 11 aa, Dengue virus
SIRDVEETNMI

SEQ ID NO: 95669 - protein, 11 aa, Dengue virus
IRDVEETNMIT

SEQ ID NO: 95670 - protein, 11 aa, Dengue virus
RDVEETNMITL

SEQ ID NO: 95671 - protein, 11 aa, Dengue virus
DVEETNMITLL

SEQ ID NO: 95672 - protein, 11 aa, Dengue virus
VEETNMITLLV

SEQ ID NO: 95673 - protein, 11 aa, Dengue virus
EETNMITLLVK

SEQ ID NO: 95674 - protein, 11 aa, Dengue virus
ETNMITLLVKL

SEQ ID NO: 95675 - protein, 11 aa, Dengue virus
TNMITLLVKLA

SEQ ID NO: 95676 - protein, 11 aa, Dengue virus
NMITLLVKLAL

SEQ ID NO: 95677 - protein, 11 aa, Dengue virus
MITLLVKLALI

SEQ ID NO: 95678 - protein, 11 aa, Dengue virus
ITLLVKLALIT

SEQ ID NO: 95679 - protein, 11 aa, Dengue virus
TLLVKLALITV

SEQ ID NO: 95680 - protein, 11 aa, Dengue virus
LLVKLALITVS

SEQ ID NO: 95681 - protein, 11 aa, Dengue virus
LVKLALITVSG

SEQ ID NO: 95682 - protein, 11 aa, Dengue virus
VKLALITVSGL

SEQ ID NO: 95683 - protein, 11 aa, Dengue virus
KLALITVSGLY

SEQ ID NO: 95684 - protein, 11 aa, Dengue virus
LALITVSGLYP

SEQ ID NO: 95685 - protein, 11 aa, Dengue virus
ALITVSGLYPL

SEQ ID NO: 95686 - protein, 11 aa, Dengue virus
LITVSGLYPLA

SEQ ID NO: 95687 - protein, 11 aa, Dengue virus
ITVSGLYPLAI

SEQ ID NO: 95688 - protein, 11 aa, Dengue virus
TVSGLYPLAIP

SEQ ID NO: 95689 - protein, 11 aa, Dengue virus
VSGLYPLAIPV

SEQ ID NO: 95690 - protein, 11 aa, Dengue virus
SGLYPLAIPVT

SEQ ID NO: 95691 - protein, 11 aa, Dengue virus
GLYPLAIPVTM

SEQ ID NO: 95692 - protein, 11 aa, Dengue virus
LYPLAIPVTMT

SEQ ID NO: 95693 - protein, 11 aa, Dengue virus
YPLAIPVTMTL

SEQ ID NO: 95694 - protein, 11 aa, Dengue virus
PLAIPVTMTLW

SEQ ID NO: 95695 - protein, 11 aa, Dengue virus
LAIPVTMTLWY

SEQ ID NO: 95696 - protein, 11 aa, Dengue virus
AIPVTMTLWYM

SEQ ID NO: 95697 - protein, 11 aa, Dengue virus
IPVTMTLWYMW

SEQ ID NO: 95698 - protein, 11 aa, Dengue virus
PVTMTLWYMWQ

SEQ ID NO: 95699 - protein, 11 aa, Dengue virus
VTMTLWYMWQV

SEQ ID NO: 95700 - protein, 11 aa, Dengue virus
TMTLWYMWQVK

SEQ ID NO: 95701 - protein, 11 aa, Dengue virus
MTLWYMWQVKT

SEQ ID NO: 95702 - protein, 11 aa, Dengue virus
TLWYMWQVKTQ

SEQ ID NO: 95703 - protein, 11 aa, Dengue virus
LWYMWQVKTQR

SEQ ID NO: 95704 - protein, 11 aa, Dengue virus
WYMWQVKTQRS

SEQ ID NO: 95705 - protein, 11 aa, Dengue virus
YMWQVKTQRSG

SEQ ID NO: 95706 - protein, 11 aa, Dengue virus
MWQVKTQRSGA

SEQ ID NO: 95707 - protein, 11 aa, Dengue virus
WQVKTQRSGAL

SEQ ID NO: 95708 - protein, 11 aa, Dengue virus
QVKTQRSGALW

SEQ ID NO: 95709 - protein, 11 aa, Dengue virus
VKTQRSGALWD

SEQ ID NO: 95710 - protein, 11 aa, Dengue virus
KTQRSGALWDV

SEQ ID NO: 95711 - protein, 11 aa, Dengue virus
TQRSGALWDVP

SEQ ID NO: 95712 - protein, 11 aa, Dengue virus
QRSGALWDVPS

SEQ ID NO: 95713 - protein, 11 aa, Dengue virus
RSGALWDVPSP

SEQ ID NO: 95714 - protein, 11 aa, Dengue virus
SGALWDVPSPA

SEQ ID NO: 95715 - protein, 11 aa, Dengue virus
GALWDVPSPAA

SEQ ID NO: 95716 - protein, 11 aa, Dengue virus
ALWDVPSPAAT

SEQ ID NO: 95717 - protein, 11 aa, Dengue virus
LWDVPSPAATQ

SEQ ID NO: 95718 - protein, 11 aa, Dengue virus
WDVPSPAATQK

SEQ ID NO: 95719 - protein, 11 aa, Dengue virus
DVPSPAATQKA

SEQ ID NO: 95720 - protein, 11 aa, Dengue virus
TQKAALSEGVY

SEQ ID NO: 95721 - protein, 11 aa, Dengue virus
QKAALSEGVYR

SEQ ID NO: 95722 - protein, 11 aa, Dengue virus
KAALSEGVYRI

SEQ ID NO: 95723 - protein, 11 aa, Dengue virus
AALSEGVYRIM

SEQ ID NO: 95724 - protein, 11 aa, Dengue virus
ALSEGVYRIMQ

SEQ ID NO: 95725 - protein, 11 aa, Dengue virus
LSEGVYRIMQR

SEQ ID NO: 95726 - protein, 11 aa, Dengue virus
SEGVYRIMQRG

SEQ ID NO: 95727 - protein, 11 aa, Dengue virus
EGVYRIMQRGL

SEQ ID NO: 95728 - protein, 11 aa, Dengue virus
GVYRIMQRGLF

SEQ ID NO: 95729 - protein, 11 aa, Dengue virus
VYRIMQRGLFG

SEQ ID NO: 95730 - protein, 11 aa, Dengue virus
YRIMQRGLFGK

SEQ ID NO: 95731 - protein, 11 aa, Dengue virus
RIMQRGLFGKT

SEQ ID NO: 95732 - protein, 11 aa, Dengue virus
IMQRGLFGKTQ

SEQ ID NO: 95733 - protein, 11 aa, Dengue virus
MQRGLFGKTQV

SEQ ID NO: 95734 - protein, 11 aa, Dengue virus
QRGLFGKTQVG

SEQ ID NO: 95735 - protein, 11 aa, Dengue virus
RGLFGKTQVGV

SEQ ID NO: 95736 - protein, 11 aa, Dengue virus
GLFGKTQVGVG

SEQ ID NO: 95737 - protein, 11 aa, Dengue virus
LFGKTQVGVGI

SEQ ID NO: 95738 - protein, 11 aa, Dengue virus
FGKTQVGVGIH

SEQ ID NO: 95739 - protein, 11 aa, Dengue virus
GKTQVGVGIHM

SEQ ID NO: 95740 - protein, 11 aa, Dengue virus
KTQVGVGIHME

SEQ ID NO: 95741 - protein, 11 aa, Dengue virus
TQVGVGIHMEG

SEQ ID NO: 95742 - protein, 11 aa, Dengue virus
QVGVGIHMEGV

SEQ ID NO: 95743 - protein, 11 aa, Dengue virus
VGVGIHMEGVF

SEQ ID NO: 95744 - protein, 11 aa, Dengue virus
GVGIHMEGVFH

SEQ ID NO: 95745 - protein, 11 aa, Dengue virus
VGIHMEGVFHT

SEQ ID NO: 95746 - protein, 11 aa, Dengue virus
GIHMEGVFHTM

SEQ ID NO: 95747 - protein, 11 aa, Dengue virus
IHMEGVFHTMW

SEQ ID NO: 95748 - protein, 11 aa, Dengue virus
HMEGVFHTMWH

SEQ ID NO: 95749 - protein, 11 aa, Dengue virus
MEGVFHTMWHV

SEQ ID NO: 95750 - protein, 11 aa, Dengue virus
EGVFHTMWHVT

SEQ ID NO: 95751 - protein, 11 aa, Dengue virus
GVFHTMWHVTR

SEQ ID NO: 95752 - protein, 11 aa, Dengue virus
VFHTMWHVTRG

SEQ ID NO: 95753 - protein, 11 aa, Dengue virus
FHTMWHVTRGS

SEQ ID NO: 95754 - protein, 11 aa, Dengue virus
HTMWHVTRGSV

SEQ ID NO: 95755 - protein, 11 aa, Dengue virus
TMWHVTRGSVI

SEQ ID NO: 95756 - protein, 11 aa, Dengue virus
MWHVTRGSVIC

SEQ ID NO: 95757 - protein, 11 aa, Dengue virus
WHVTRGSVICH

SEQ ID NO: 95758 - protein, 11 aa, Dengue virus
HVTRGSVICHE

SEQ ID NO: 95759 - protein, 11 aa, Dengue virus
VTRGSVICHET

SEQ ID NO: 95760 - protein, 11 aa, Dengue virus
TRGSVICHETG

SEQ ID NO: 95761 - protein, 11 aa, Dengue virus
RGSVICHETGR

SEQ ID NO: 95762 - protein, 11 aa, Dengue virus
GSVICHETGRL

SEQ ID NO: 95763 - protein, 11 aa, Dengue virus
SVICHETGRLE

SEQ ID NO: 95764 - protein, 11 aa, Dengue virus
VICHETGRLEP

SEQ ID NO: 95765 - protein, 11 aa, Dengue virus
ICHETGRLEPS

SEQ ID NO: 95766 - protein, 11 aa, Dengue virus
CHETGRLEPSW

SEQ ID NO: 95767 - protein, 11 aa, Dengue virus
HETGRLEPSWA

SEQ ID NO: 95768 - protein, 11 aa, Dengue virus
ETGRLEPSWAD

SEQ ID NO: 95769 - protein, 11 aa, Dengue virus
TGRLEPSWADV

SEQ ID NO: 95770 - protein, 11 aa, Dengue virus
GRLEPSWADVR

SEQ ID NO: 95771 - protein, 11 aa, Dengue virus
RLEPSWADVRN

SEQ ID NO: 95772 - protein, 11 aa, Dengue virus
LEPSWADVRND

SEQ ID NO: 95773 - protein, 11 aa, Dengue virus
EPSWADVRNDM

SEQ ID NO: 95774 - protein, 11 aa, Dengue virus
PSWADVRNDMI

SEQ ID NO: 95775 - protein, 11 aa, Dengue virus
SWADVRNDMIS

SEQ ID NO: 95776 - protein, 11 aa, Dengue virus
WADVRNDMISY

SEQ ID NO: 95777 - protein, 11 aa, Dengue virus
ADVRNDMISYG

SEQ ID NO: 95778 - protein, 11 aa, Dengue virus
DVRNDMISYGG

SEQ ID NO: 95779 - protein, 11 aa, Dengue virus
VRNDMISYGGG

SEQ ID NO: 95780 - protein, 11 aa, Dengue virus
RNDMISYGGGW

SEQ ID NO: 95781 - protein, 11 aa, Dengue virus
NDMISYGGGWR

SEQ ID NO: 95782 - protein, 11 aa, Dengue virus
DMISYGGGWRL

SEQ ID NO: 95783 - protein, 11 aa, Dengue virus
MISYGGGWRLG

SEQ ID NO: 95784 - protein, 11 aa, Dengue virus
ISYGGGWRLGD

SEQ ID NO: 95785 - protein, 11 aa, Dengue virus
SYGGGWRLGDK

SEQ ID NO: 95786 - protein, 11 aa, Dengue virus
YGGGWRLGDKW

SEQ ID NO: 95787 - protein, 11 aa, Dengue virus
GGGWRLGDKWD

SEQ ID NO: 95788 - protein, 11 aa, Dengue virus
GGWRLGDKWDK

SEQ ID NO: 95789 - protein, 11 aa, Dengue virus
GWRLGDKWDKE

SEQ ID NO: 95790 - protein, 11 aa, Dengue virus
WRLGDKWDKEE

SEQ ID NO: 95791 - protein, 11 aa, Dengue virus
RLGDKWDKEED

SEQ ID NO: 95792 - protein, 11 aa, Dengue virus
LGDKWDKEEDV

SEQ ID NO: 95793 - protein, 11 aa, Dengue virus
GDKWDKEEDVQ

SEQ ID NO: 95794 - protein, 11 aa, Dengue virus
DKWDKEEDVQV

SEQ ID NO: 95795 - protein, 11 aa, Dengue virus
KWDKEEDVQVL

SEQ ID NO: 95796 - protein, 11 aa, Dengue virus
WDKEEDVQVLA

SEQ ID NO: 95797 - protein, 11 aa, Dengue virus
DKEEDVQVLAI

SEQ ID NO: 95798 - protein, 11 aa, Dengue virus
KEEDVQVLAIE

SEQ ID NO: 95799 - protein, 11 aa, Dengue virus
EEDVQVLAIEP

SEQ ID NO: 95800 - protein, 11 aa, Dengue virus
EDVQVLAIEPG

SEQ ID NO: 95801 - protein, 11 aa, Dengue virus
DVQVLAIEPGK

SEQ ID NO: 95802 - protein, 11 aa, Dengue virus
VQVLAIEPGKN

SEQ ID NO: 95803 - protein, 11 aa, Dengue virus
QVLAIEPGKNP

SEQ ID NO: 95804 - protein, 11 aa, Dengue virus
VLAIEPGKNPK

SEQ ID NO: 95805 - protein, 11 aa, Dengue virus
LAIEPGKNPKH

SEQ ID NO: 95806 - protein, 11 aa, Dengue virus
AIEPGKNPKHV

SEQ ID NO: 95807 - protein, 11 aa, Dengue virus
IEPGKNPKHVQ

SEQ ID NO: 95808 - protein, 11 aa, Dengue virus
EPGKNPKHVQT

SEQ ID NO: 95809 - protein, 11 aa, Dengue virus
PGKNPKHVQTK

SEQ ID NO: 95810 - protein, 11 aa, Dengue virus
GKNPKHVQTKP

SEQ ID NO: 95811 - protein, 11 aa, Dengue virus
KNPKHVQTKPG

SEQ ID NO: 95812 - protein, 11 aa, Dengue virus
NPKHVQTKPGL

SEQ ID NO: 95813 - protein, 11 aa, Dengue virus
PKHVQTKPGLF

SEQ ID NO: 95814 - protein, 11 aa, Dengue virus
KHVQTKPGLFK

SEQ ID NO: 95815 - protein, 11 aa, Dengue virus
HVQTKPGLFKT

SEQ ID NO: 95816 - protein, 11 aa, Dengue virus
VQTKPGLFKTL

SEQ ID NO: 95817 - protein, 11 aa, Dengue virus
QTKPGLFKTLT

SEQ ID NO: 95818 - protein, 11 aa, Dengue virus
TKPGLFKTLTG

SEQ ID NO: 95819 - protein, 11 aa, Dengue virus
KPGLFKTLTGE

SEQ ID NO: 95820 - protein, 11 aa, Dengue virus
PGLFKTLTGEI

SEQ ID NO: 95821 - protein, 11 aa, Dengue virus
GLFKTLTGEIG

SEQ ID NO: 95822 - protein, 11 aa, Dengue virus
LFKTLTGEIGA

SEQ ID NO: 95823 - protein, 11 aa, Dengue virus
FKTLTGEIGAV

SEQ ID NO: 95824 - protein, 11 aa, Dengue virus
KTLTGEIGAVT

SEQ ID NO: 95825 - protein, 11 aa, Dengue virus
TLTGEIGAVTL

SEQ ID NO: 95826 - protein, 11 aa, Dengue virus
LTGEIGAVTLD

SEQ ID NO: 95827 - protein, 11 aa, Dengue virus
TGEIGAVTLDF

SEQ ID NO: 95828 - protein, 11 aa, Dengue virus
GEIGAVTLDFK

SEQ ID NO: 95829 - protein, 11 aa, Dengue virus
EIGAVTLDFKP

SEQ ID NO: 95830 - protein, 11 aa, Dengue virus
IGAVTLDFKPG

SEQ ID NO: 95831 - protein, 11 aa, Dengue virus
GAVTLDFKPGT

SEQ ID NO: 95832 - protein, 11 aa, Dengue virus
AVTLDFKPGTS

SEQ ID NO: 95833 - protein, 11 aa, Dengue virus
VTLDFKPGTSG

SEQ ID NO: 95834 - protein, 11 aa, Dengue virus
TLDFKPGTSGS

SEQ ID NO: 95835 - protein, 11 aa, Dengue virus
LDFKPGTSGSP

SEQ ID NO: 95836 - protein, 11 aa, Dengue virus
DFKPGTSGSPI

SEQ ID NO: 95837 - protein, 11 aa, Dengue virus
FKPGTSGSPII

SEQ ID NO: 95838 - protein, 11 aa, Dengue virus
KPGTSGSPIIN

SEQ ID NO: 95839 - protein, 11 aa, Dengue virus
PGTSGSPIINR

SEQ ID NO: 95840 - protein, 11 aa, Dengue virus
GTSGSPIINRK

SEQ ID NO: 95841 - protein, 11 aa, Dengue virus
TSGSPIINRKG

SEQ ID NO: 95842 - protein, 11 aa, Dengue virus
SGSPIINRKGK

SEQ ID NO: 95843 - protein, 11 aa, Dengue virus
GSPIINRKGKV

SEQ ID NO: 95844 - protein, 11 aa, Dengue virus
SPIINRKGKVI

SEQ ID NO: 95845 - protein, 11 aa, Dengue virus
PIINRKGKVIG

SEQ ID NO: 95846 - protein, 11 aa, Dengue virus
IINRKGKVIGL

SEQ ID NO: 95847 - protein, 11 aa, Dengue virus
INRKGKVIGLY

SEQ ID NO: 95848 - protein, 11 aa, Dengue virus
NRKGKVIGLYG

SEQ ID NO: 95849 - protein, 11 aa, Dengue virus
RKGKVIGLYGN

SEQ ID NO: 95850 - protein, 11 aa, Dengue virus
KGKVIGLYGNG

SEQ ID NO: 95851 - protein, 11 aa, Dengue virus
GKVIGLYGNGV

SEQ ID NO: 95852 - protein, 11 aa, Dengue virus
KVIGLYGNGVV

SEQ ID NO: 95853 - protein, 11 aa, Dengue virus
VIGLYGNGVVT

SEQ ID NO: 95854 - protein, 11 aa, Dengue virus
IGLYGNGVVTK

SEQ ID NO: 95855 - protein, 11 aa, Dengue virus
GLYGNGVVTKS

SEQ ID NO: 95856 - protein, 11 aa, Dengue virus
LYGNGVVTKSG

SEQ ID NO: 95857 - protein, 11 aa, Dengue virus
YGNGVVTKSGD

SEQ ID NO: 95858 - protein, 11 aa, Dengue virus
GNGVVTKSGDY

SEQ ID NO: 95859 - protein, 11 aa, Dengue virus
NGVVTKSGDYV

SEQ ID NO: 95860 - protein, 11 aa, Dengue virus
GVVTKSGDYVS

SEQ ID NO: 95861 - protein, 11 aa, Dengue virus
VVTKSGDYVSA

SEQ ID NO: 95862 - protein, 11 aa, Dengue virus
VTKSGDYVSAI

SEQ ID NO: 95863 - protein, 11 aa, Dengue virus
TKSGDYVSAIT

SEQ ID NO: 95864 - protein, 11 aa, Dengue virus
KSGDYVSAITQ

SEQ ID NO: 95865 - protein, 11 aa, Dengue virus
SGDYVSAITQA

SEQ ID NO: 95866 - protein, 11 aa, Dengue virus
GDYVSAITQAE

SEQ ID NO: 95867 - protein, 11 aa, Dengue virus
DYVSAITQAER

SEQ ID NO: 95868 - protein, 11 aa, Dengue virus
YVSAITQAERI

SEQ ID NO: 95869 - protein, 11 aa, Dengue virus
VSAITQAERIG

SEQ ID NO: 95870 - protein, 11 aa, Dengue virus
SAITQAERIGE

SEQ ID NO: 95871 - protein, 11 aa, Dengue virus
AITQAERIGEP

SEQ ID NO: 95872 - protein, 11 aa, Dengue virus
ITQAERIGEPD

SEQ ID NO: 95873 - protein, 11 aa, Dengue virus
TQAERIGEPDY

SEQ ID NO: 95874 - protein, 11 aa, Dengue virus
QAERIGEPDYE

SEQ ID NO: 95875 - protein, 11 aa, Dengue virus
AERIGEPDYEV

SEQ ID NO: 95876 - protein, 11 aa, Dengue virus
ERIGEPDYEVD

SEQ ID NO: 95877 - protein, 11 aa, Dengue virus
RIGEPDYEVDE

SEQ ID NO: 95878 - protein, 11 aa, Dengue virus
IGEPDYEVDED

SEQ ID NO: 95879 - protein, 11 aa, Dengue virus
GEPDYEVDEDI

SEQ ID NO: 95880 - protein, 11 aa, Dengue virus
EPDYEVDEDIF

SEQ ID NO: 95881 - protein, 11 aa, Dengue virus
PDYEVDEDIFR

SEQ ID NO: 95882 - protein, 11 aa, Dengue virus
DYEVDEDIFRK

SEQ ID NO: 95883 - protein, 11 aa, Dengue virus
YEVDEDIFRKK

SEQ ID NO: 95884 - protein, 11 aa, Dengue virus
EVDEDIFRKKR

SEQ ID NO: 95885 - protein, 11 aa, Dengue virus
VDEDIFRKKRL

SEQ ID NO: 95886 - protein, 11 aa, Dengue virus
DEDIFRKKRLT

SEQ ID NO: 95887 - protein, 11 aa, Dengue virus
EDIFRKKRLTI

SEQ ID NO: 95888 - protein, 11 aa, Dengue virus
DIFRKKRLTIM

SEQ ID NO: 95889 - protein, 11 aa, Dengue virus
IFRKKRLTIMD

SEQ ID NO: 95890 - protein, 11 aa, Dengue virus
FRKKRLTIMDL

SEQ ID NO: 95891 - protein, 11 aa, Dengue virus
RKKRLTIMDLH

SEQ ID NO: 95892 - protein, 11 aa, Dengue virus
KKRLTIMDLHP

SEQ ID NO: 95893 - protein, 11 aa, Dengue virus
KRLTIMDLHPG

SEQ ID NO: 95894 - protein, 11 aa, Dengue virus
RLTIMDLHPGA

SEQ ID NO: 95895 - protein, 11 aa, Dengue virus
LTIMDLHPGAG

SEQ ID NO: 95896 - protein, 11 aa, Dengue virus
TIMDLHPGAGK

SEQ ID NO: 95897 - protein, 11 aa, Dengue virus
IMDLHPGAGKT

SEQ ID NO: 95898 - protein, 11 aa, Dengue virus
MDLHPGAGKTK

SEQ ID NO: 95899 - protein, 11 aa, Dengue virus
DLHPGAGKTKR

SEQ ID NO: 95900 - protein, 11 aa, Dengue virus
LHPGAGKTKRI

SEQ ID NO: 95901 - protein, 11 aa, Dengue virus
HPGAGKTKRIL

SEQ ID NO: 95902 - protein, 11 aa, Dengue virus
PGAGKTKRILP

SEQ ID NO: 95903 - protein, 11 aa, Dengue virus
GAGKTKRILPS

SEQ ID NO: 95904 - protein, 11 aa, Dengue virus
AGKTKRILPSI

SEQ ID NO: 95905 - protein, 11 aa, Dengue virus
GKTKRILPSIV

SEQ ID NO: 95906 - protein, 11 aa, Dengue virus
KTKRILPSIVR

SEQ ID NO: 95907 - protein, 11 aa, Dengue virus
TKRILPSIVRE

SEQ ID NO: 95908 - protein, 11 aa, Dengue virus
KRILPSIVREA

SEQ ID NO: 95909 - protein, 11 aa, Dengue virus
RILPSIVREAL

SEQ ID NO: 95910 - protein, 11 aa, Dengue virus
ILPSIVREALK

SEQ ID NO: 95911 - protein, 11 aa, Dengue virus
LPSIVREALKR

SEQ ID NO: 95912 - protein, 11 aa, Dengue virus
PSIVREALKRR

SEQ ID NO: 95913 - protein, 11 aa, Dengue virus
SIVREALKRRL

SEQ ID NO: 95914 - protein, 11 aa, Dengue virus
IVREALKRRLR

SEQ ID NO: 95915 - protein, 11 aa, Dengue virus
VREALKRRLRT

SEQ ID NO: 95916 - protein, 11 aa, Dengue virus
REALKRRLRTL

SEQ ID NO: 95917 - protein, 11 aa, Dengue virus
EALKRRLRTLI

SEQ ID NO: 95918 - protein, 11 aa, Dengue virus
ALKRRLRTLIL

SEQ ID NO: 95919 - protein, 11 aa, Dengue virus
LKRRLRTLILA

SEQ ID NO: 95920 - protein, 11 aa, Dengue virus
KRRLRTLILAP

SEQ ID NO: 95921 - protein, 11 aa, Dengue virus
RRLRTLILAPT

SEQ ID NO: 95922 - protein, 11 aa, Dengue virus
RLRTLILAPTR

SEQ ID NO: 95923 - protein, 11 aa, Dengue virus
LRTLILAPTRV

SEQ ID NO: 95924 - protein, 11 aa, Dengue virus
RTLILAPTRVV

SEQ ID NO: 95925 - protein, 11 aa, Dengue virus
TLILAPTRVVA

SEQ ID NO: 95926 - protein, 11 aa, Dengue virus
LILAPTRVVAA

SEQ ID NO: 95927 - protein, 11 aa, Dengue virus
ILAPTRVVAAE

SEQ ID NO: 95928 - protein, 11 aa, Dengue virus
LAPTRVVAAEM

SEQ ID NO: 95929 - protein, 11 aa, Dengue virus
APTRVVAAEME

SEQ ID NO: 95930 - protein, 11 aa, Dengue virus
PTRVVAAEMEE

SEQ ID NO: 95931 - protein, 11 aa, Dengue virus
TRVVAAEMEEA

SEQ ID NO: 95932 - protein, 11 aa, Dengue virus
RVVAAEMEEAL

SEQ ID NO: 95933 - protein, 11 aa, Dengue virus
VVAAEMEEALR

SEQ ID NO: 95934 - protein, 11 aa, Dengue virus
VAAEMEEALRG

SEQ ID NO: 95935 - protein, 11 aa, Dengue virus
AAEMEEALRGL

SEQ ID NO: 95936 - protein, 11 aa, Dengue virus
AEMEEALRGLP

SEQ ID NO: 95937 - protein, 11 aa, Dengue virus
EMEEALRGLPI

SEQ ID NO: 95938 - protein, 11 aa, Dengue virus
MEEALRGLPIR

SEQ ID NO: 95939 - protein, 11 aa, Dengue virus
EEALRGLPIRY

SEQ ID NO: 95940 - protein, 11 aa, Dengue virus
EALRGLPIRYQ

SEQ ID NO: 95941 - protein, 11 aa, Dengue virus
ALRGLPIRYQT

SEQ ID NO: 95942 - protein, 11 aa, Dengue virus
LRGLPIRYQTP

SEQ ID NO: 95943 - protein, 11 aa, Dengue virus
RGLPIRYQTPA

SEQ ID NO: 95944 - protein, 11 aa, Dengue virus
GLPIRYQTPAV

SEQ ID NO: 95945 - protein, 11 aa, Dengue virus
LPIRYQTPAVK

SEQ ID NO: 95946 - protein, 11 aa, Dengue virus
PIRYQTPAVKS

SEQ ID NO: 95947 - protein, 11 aa, Dengue virus
IRYQTPAVKSE

SEQ ID NO: 95948 - protein, 11 aa, Dengue virus
RYQTPAVKSEH

SEQ ID NO: 95949 - protein, 11 aa, Dengue virus
YQTPAVKSEHT

SEQ ID NO: 95950 - protein, 11 aa, Dengue virus
QTPAVKSEHTG

SEQ ID NO: 95951 - protein, 11 aa, Dengue virus
TPAVKSEHTGR

SEQ ID NO: 95952 - protein, 11 aa, Dengue virus
PAVKSEHTGRE

SEQ ID NO: 95953 - protein, 11 aa, Dengue virus
AVKSEHTGREI

SEQ ID NO: 95954 - protein, 11 aa, Dengue virus
VKSEHTGREIV

SEQ ID NO: 95955 - protein, 11 aa, Dengue virus
KSEHTGREIVD

SEQ ID NO: 95956 - protein, 11 aa, Dengue virus
SEHTGREIVDL

SEQ ID NO: 95957 - protein, 11 aa, Dengue virus
EHTGREIVDLM

SEQ ID NO: 95958 - protein, 11 aa, Dengue virus
HTGREIVDLMC

SEQ ID NO: 95959 - protein, 11 aa, Dengue virus
TGREIVDLMCH

SEQ ID NO: 95960 - protein, 11 aa, Dengue virus
GREIVDLMCHA

SEQ ID NO: 95961 - protein, 11 aa, Dengue virus
REIVDLMCHAT

SEQ ID NO: 95962 - protein, 11 aa, Dengue virus
EIVDLMCHATF

SEQ ID NO: 95963 - protein, 11 aa, Dengue virus
IVDLMCHATFT

SEQ ID NO: 95964 - protein, 11 aa, Dengue virus
VDLMCHATFTT

SEQ ID NO: 95965 - protein, 11 aa, Dengue virus
DLMCHATFTTR

SEQ ID NO: 95966 - protein, 11 aa, Dengue virus
LMCHATFTTRL

SEQ ID NO: 95967 - protein, 11 aa, Dengue virus
MCHATFTTRLL

SEQ ID NO: 95968 - protein, 11 aa, Dengue virus
CHATFTTRLLS

SEQ ID NO: 95969 - protein, 11 aa, Dengue virus
HATFTTRLLSS

SEQ ID NO: 95970 - protein, 11 aa, Dengue virus
ATFTTRLLSST

SEQ ID NO: 95971 - protein, 11 aa, Dengue virus
TFTTRLLSSTR

SEQ ID NO: 95972 - protein, 11 aa, Dengue virus
FTTRLLSSTRV

SEQ ID NO: 95973 - protein, 11 aa, Dengue virus
TTRLLSSTRVP

SEQ ID NO: 95974 - protein, 11 aa, Dengue virus
TRLLSSTRVPN

SEQ ID NO: 95975 - protein, 11 aa, Dengue virus
RLLSSTRVPNY

SEQ ID NO: 95976 - protein, 11 aa, Dengue virus
LLSSTRVPNYN

SEQ ID NO: 95977 - protein, 11 aa, Dengue virus
LSSTRVPNYNL

SEQ ID NO: 95978 - protein, 11 aa, Dengue virus
SSTRVPNYNLI

SEQ ID NO: 95979 - protein, 11 aa, Dengue virus
STRVPNYNLIV

SEQ ID NO: 95980 - protein, 11 aa, Dengue virus
TRVPNYNLIVM

SEQ ID NO: 95981 - protein, 11 aa, Dengue virus
RVPNYNLIVMD

SEQ ID NO: 95982 - protein, 11 aa, Dengue virus
VPNYNLIVMDE

SEQ ID NO: 95983 - protein, 11 aa, Dengue virus
PNYNLIVMDEA

SEQ ID NO: 95984 - protein, 11 aa, Dengue virus
NYNLIVMDEAH

SEQ ID NO: 95985 - protein, 11 aa, Dengue virus
YNLIVMDEAHF

SEQ ID NO: 95986 - protein, 11 aa, Dengue virus
NLIVMDEAHFT

SEQ ID NO: 95987 - protein, 11 aa, Dengue virus
LIVMDEAHFTD

SEQ ID NO: 95988 - protein, 11 aa, Dengue virus
IVMDEAHFTDP

SEQ ID NO: 95989 - protein, 11 aa, Dengue virus
VMDEAHFTDPS

SEQ ID NO: 95990 - protein, 11 aa, Dengue virus
MDEAHFTDPSS

SEQ ID NO: 95991 - protein, 11 aa, Dengue virus
DEAHFTDPSSV

SEQ ID NO: 95992 - protein, 11 aa, Dengue virus
EAHFTDPSSVA

SEQ ID NO: 95993 - protein, 11 aa, Dengue virus
AHFTDPSSVAA

SEQ ID NO: 95994 - protein, 11 aa, Dengue virus
HFTDPSSVAAR

SEQ ID NO: 95995 - protein, 11 aa, Dengue virus
FTDPSSVAARG

SEQ ID NO: 95996 - protein, 11 aa, Dengue virus
TDPSSVAARGY

SEQ ID NO: 95997 - protein, 11 aa, Dengue virus
DPSSVAARGYI

SEQ ID NO: 95998 - protein, 11 aa, Dengue virus
PSSVAARGYIS

SEQ ID NO: 95999 - protein, 11 aa, Dengue virus
SSVAARGYIST

SEQ ID NO: 96000 - protein, 11 aa, Dengue virus
SVAARGYISTR

SEQ ID NO: 96001 - protein, 11 aa, Dengue virus
VAARGYISTRV

SEQ ID NO: 96002 - protein, 11 aa, Dengue virus
AARGYISTRVE

SEQ ID NO: 96003 - protein, 11 aa, Dengue virus
ARGYISTRVEM

SEQ ID NO: 96004 - protein, 11 aa, Dengue virus
RGYISTRVEMG

SEQ ID NO: 96005 - protein, 11 aa, Dengue virus
GYISTRVEMGE

SEQ ID NO: 96006 - protein, 11 aa, Dengue virus
YISTRVEMGEA

SEQ ID NO: 96007 - protein, 11 aa, Dengue virus
ISTRVEMGEAA

SEQ ID NO: 96008 - protein, 11 aa, Dengue virus
STRVEMGEAAA

SEQ ID NO: 96009 - protein, 11 aa, Dengue virus
TRVEMGEAAAI

SEQ ID NO: 96010 - protein, 11 aa, Dengue virus
RVEMGEAAAIF

SEQ ID NO: 96011 - protein, 11 aa, Dengue virus
VEMGEAAAIFM

SEQ ID NO: 96012 - protein, 11 aa, Dengue virus
EMGEAAAIFMT

SEQ ID NO: 96013 - protein, 11 aa, Dengue virus
MGEAAAIFMTA

SEQ ID NO: 96014 - protein, 11 aa, Dengue virus
GEAAAIFMTAT

SEQ ID NO: 96015 - protein, 11 aa, Dengue virus
EAAAIFMTATP

SEQ ID NO: 96016 - protein, 11 aa, Dengue virus
AAAIFMTATPP

SEQ ID NO: 96017 - protein, 11 aa, Dengue virus
AAIFMTATPPG

SEQ ID NO: 96018 - protein, 11 aa, Dengue virus
AIFMTATPPGA

SEQ ID NO: 96019 - protein, 11 aa, Dengue virus
IFMTATPPGAT

SEQ ID NO: 96020 - protein, 11 aa, Dengue virus
FMTATPPGATD

SEQ ID NO: 96021 - protein, 11 aa, Dengue virus
MTATPPGATDP

SEQ ID NO: 96022 - protein, 11 aa, Dengue virus
TATPPGATDPF

SEQ ID NO: 96023 - protein, 11 aa, Dengue virus
ATPPGATDPFP

SEQ ID NO: 96024 - protein, 11 aa, Dengue virus
TPPGATDPFPQ

SEQ ID NO: 96025 - protein, 11 aa, Dengue virus
PPGATDPFPQS

SEQ ID NO: 96026 - protein, 11 aa, Dengue virus
PGATDPFPQSN

SEQ ID NO: 96027 - protein, 11 aa, Dengue virus
GATDPFPQSNS

SEQ ID NO: 96028 - protein, 11 aa, Dengue virus
ATDPFPQSNSP

SEQ ID NO: 96029 - protein, 11 aa, Dengue virus
TDPFPQSNSPI

SEQ ID NO: 96030 - protein, 11 aa, Dengue virus
DPFPQSNSPIE

SEQ ID NO: 96031 - protein, 11 aa, Dengue virus
PFPQSNSPIED

SEQ ID NO: 96032 - protein, 11 aa, Dengue virus
FPQSNSPIEDI

SEQ ID NO: 96033 - protein, 11 aa, Dengue virus
PQSNSPIEDIE

SEQ ID NO: 96034 - protein, 11 aa, Dengue virus
QSNSPIEDIER

SEQ ID NO: 96035 - protein, 11 aa, Dengue virus
SNSPIEDIERE

SEQ ID NO: 96036 - protein, 11 aa, Dengue virus
NSPIEDIEREI

SEQ ID NO: 96037 - protein, 11 aa, Dengue virus
SPIEDIEREIP

SEQ ID NO: 96038 - protein, 11 aa, Dengue virus
PIEDIEREIPE

SEQ ID NO: 96039 - protein, 11 aa, Dengue virus
IEDIEREIPER

SEQ ID NO: 96040 - protein, 11 aa, Dengue virus
EDIEREIPERS

SEQ ID NO: 96041 - protein, 11 aa, Dengue virus
DIEREIPERSW

SEQ ID NO: 96042 - protein, 11 aa, Dengue virus
IEREIPERSWN

SEQ ID NO: 96043 - protein, 11 aa, Dengue virus
EREIPERSWNT

SEQ ID NO: 96044 - protein, 11 aa, Dengue virus
REIPERSWNTG

SEQ ID NO: 96045 - protein, 11 aa, Dengue virus
EIPERSWNTGF

SEQ ID NO: 96046 - protein, 11 aa, Dengue virus
IPERSWNTGFD

SEQ ID NO: 96047 - protein, 11 aa, Dengue virus
PERSWNTGFDW

SEQ ID NO: 96048 - protein, 11 aa, Dengue virus
ERSWNTGFDWI

SEQ ID NO: 96049 - protein, 11 aa, Dengue virus
RSWNTGFDWIT

SEQ ID NO: 96050 - protein, 11 aa, Dengue virus
SWNTGFDWITD

SEQ ID NO: 96051 - protein, 11 aa, Dengue virus
WNTGFDWITDY

SEQ ID NO: 96052 - protein, 11 aa, Dengue virus
NTGFDWITDYQ

SEQ ID NO: 96053 - protein, 11 aa, Dengue virus
TGFDWITDYQG

SEQ ID NO: 96054 - protein, 11 aa, Dengue virus
GFDWITDYQGK

SEQ ID NO: 96055 - protein, 11 aa, Dengue virus
FDWITDYQGKT

SEQ ID NO: 96056 - protein, 11 aa, Dengue virus
DWITDYQGKTV

SEQ ID NO: 96057 - protein, 11 aa, Dengue virus
WITDYQGKTVW

SEQ ID NO: 96058 - protein, 11 aa, Dengue virus
ITDYQGKTVWF

SEQ ID NO: 96059 - protein, 11 aa, Dengue virus
TDYQGKTVWFV

SEQ ID NO: 96060 - protein, 11 aa, Dengue virus
DYQGKTVWFVP

SEQ ID NO: 96061 - protein, 11 aa, Dengue virus
YQGKTVWFVPS

SEQ ID NO: 96062 - protein, 11 aa, Dengue virus
QGKTVWFVPSI

SEQ ID NO: 96063 - protein, 11 aa, Dengue virus
GKTVWFVPSIK

SEQ ID NO: 96064 - protein, 11 aa, Dengue virus
KTVWFVPSIKA

SEQ ID NO: 96065 - protein, 11 aa, Dengue virus
TVWFVPSIKAG

SEQ ID NO: 96066 - protein, 11 aa, Dengue virus
VWFVPSIKAGN

SEQ ID NO: 96067 - protein, 11 aa, Dengue virus
WFVPSIKAGND

SEQ ID NO: 96068 - protein, 11 aa, Dengue virus
FVPSIKAGNDI

SEQ ID NO: 96069 - protein, 11 aa, Dengue virus
VPSIKAGNDIA

SEQ ID NO: 96070 - protein, 11 aa, Dengue virus
PSIKAGNDIAN

SEQ ID NO: 96071 - protein, 11 aa, Dengue virus
SIKAGNDIANC

SEQ ID NO: 96072 - protein, 11 aa, Dengue virus
IKAGNDIANCL

SEQ ID NO: 96073 - protein, 11 aa, Dengue virus
KAGNDIANCLR

SEQ ID NO: 96074 - protein, 11 aa, Dengue virus
AGNDIANCLRK

SEQ ID NO: 96075 - protein, 11 aa, Dengue virus
GNDIANCLRKS

SEQ ID NO: 96076 - protein, 11 aa, Dengue virus
NDIANCLRKSG

SEQ ID NO: 96077 - protein, 11 aa, Dengue virus
DIANCLRKSGK

SEQ ID NO: 96078 - protein, 11 aa, Dengue virus
IANCLRKSGKK

SEQ ID NO: 96079 - protein, 11 aa, Dengue virus
ANCLRKSGKKV

SEQ ID NO: 96080 - protein, 11 aa, Dengue virus
NCLRKSGKKVI

SEQ ID NO: 96081 - protein, 11 aa, Dengue virus
CLRKSGKKVIQ

SEQ ID NO: 96082 - protein, 11 aa, Dengue virus
LRKSGKKVIQL

SEQ ID NO: 96083 - protein, 11 aa, Dengue virus
RKSGKKVIQLS

SEQ ID NO: 96084 - protein, 11 aa, Dengue virus
KSGKKVIQLSR

SEQ ID NO: 96085 - protein, 11 aa, Dengue virus
SGKKVIQLSRK

SEQ ID NO: 96086 - protein, 11 aa, Dengue virus
GKKVIQLSRKT

SEQ ID NO: 96087 - protein, 11 aa, Dengue virus
KKVIQLSRKTF

SEQ ID NO: 96088 - protein, 11 aa, Dengue virus
KVIQLSRKTFD

SEQ ID NO: 96089 - protein, 11 aa, Dengue virus
VIQLSRKTFDT

SEQ ID NO: 96090 - protein, 11 aa, Dengue virus
IQLSRKTFDTE

SEQ ID NO: 96091 - protein, 11 aa, Dengue virus
QLSRKTFDTEY

SEQ ID NO: 96092 - protein, 11 aa, Dengue virus
LSRKTFDTEYP

SEQ ID NO: 96093 - protein, 11 aa, Dengue virus
SRKTFDTEYPK

SEQ ID NO: 96094 - protein, 11 aa, Dengue virus
RKTFDTEYPKT

SEQ ID NO: 96095 - protein, 11 aa, Dengue virus
KTFDTEYPKTK

SEQ ID NO: 96096 - protein, 11 aa, Dengue virus
TFDTEYPKTKL

SEQ ID NO: 96097 - protein, 11 aa, Dengue virus
FDTEYPKTKLT

SEQ ID NO: 96098 - protein, 11 aa, Dengue virus
DTEYPKTKLTD

SEQ ID NO: 96099 - protein, 11 aa, Dengue virus
TEYPKTKLTDW

SEQ ID NO: 96100 - protein, 11 aa, Dengue virus
EYPKTKLTDWD

SEQ ID NO: 96101 - protein, 11 aa, Dengue virus
YPKTKLTDWDF

SEQ ID NO: 96102 - protein, 11 aa, Dengue virus
PKTKLTDWDFV

SEQ ID NO: 96103 - protein, 11 aa, Dengue virus
KTKLTDWDFVV

SEQ ID NO: 96104 - protein, 11 aa, Dengue virus
TKLTDWDFVVT

SEQ ID NO: 96105 - protein, 11 aa, Dengue virus
KLTDWDFVVTT

SEQ ID NO: 96106 - protein, 11 aa, Dengue virus
LTDWDFVVTTD

SEQ ID NO: 96107 - protein, 11 aa, Dengue virus
TDWDFVVTTDI

SEQ ID NO: 96108 - protein, 11 aa, Dengue virus
DWDFVVTTDIS

SEQ ID NO: 96109 - protein, 11 aa, Dengue virus
WDFVVTTDISE

SEQ ID NO: 96110 - protein, 11 aa, Dengue virus
DFVVTTDISEM

SEQ ID NO: 96111 - protein, 11 aa, Dengue virus
FVVTTDISEMG

SEQ ID NO: 96112 - protein, 11 aa, Dengue virus
VVTTDISEMGA

SEQ ID NO: 96113 - protein, 11 aa, Dengue virus
VTTDISEMGAN

SEQ ID NO: 96114 - protein, 11 aa, Dengue virus
TTDISEMGANF

SEQ ID NO: 96115 - protein, 11 aa, Dengue virus
TDISEMGANFR

SEQ ID NO: 96116 - protein, 11 aa, Dengue virus
DISEMGANFRA

SEQ ID NO: 96117 - protein, 11 aa, Dengue virus
ISEMGANFRAG

SEQ ID NO: 96118 - protein, 11 aa, Dengue virus
SEMGANFRAGR

SEQ ID NO: 96119 - protein, 11 aa, Dengue virus
EMGANFRAGRV

SEQ ID NO: 96120 - protein, 11 aa, Dengue virus
MGANFRAGRVI

SEQ ID NO: 96121 - protein, 11 aa, Dengue virus
GANFRAGRVID

SEQ ID NO: 96122 - protein, 11 aa, Dengue virus
ANFRAGRVIDP

SEQ ID NO: 96123 - protein, 11 aa, Dengue virus
NFRAGRVIDPR

SEQ ID NO: 96124 - protein, 11 aa, Dengue virus
FRAGRVIDPRR

SEQ ID NO: 96125 - protein, 11 aa, Dengue virus
RAGRVIDPRRC

SEQ ID NO: 96126 - protein, 11 aa, Dengue virus
AGRVIDPRRCL

SEQ ID NO: 96127 - protein, 11 aa, Dengue virus
GRVIDPRRCLK

SEQ ID NO: 96128 - protein, 11 aa, Dengue virus
RVIDPRRCLKP

SEQ ID NO: 96129 - protein, 11 aa, Dengue virus
VIDPRRCLKPV

SEQ ID NO: 96130 - protein, 11 aa, Dengue virus
IDPRRCLKPVI

SEQ ID NO: 96131 - protein, 11 aa, Dengue virus
DPRRCLKPVIL

SEQ ID NO: 96132 - protein, 11 aa, Dengue virus
PRRCLKPVILT

SEQ ID NO: 96133 - protein, 11 aa, Dengue virus
RRCLKPVILTD

SEQ ID NO: 96134 - protein, 11 aa, Dengue virus
RCLKPVILTDG

SEQ ID NO: 96135 - protein, 11 aa, Dengue virus
CLKPVILTDGP

SEQ ID NO: 96136 - protein, 11 aa, Dengue virus
LKPVILTDGPE

SEQ ID NO: 96137 - protein, 11 aa, Dengue virus
KPVILTDGPER

SEQ ID NO: 96138 - protein, 11 aa, Dengue virus
PVILTDGPERV

SEQ ID NO: 96139 - protein, 11 aa, Dengue virus
VILTDGPERVI

SEQ ID NO: 96140 - protein, 11 aa, Dengue virus
ILTDGPERVIL

SEQ ID NO: 96141 - protein, 11 aa, Dengue virus
LTDGPERVILA

SEQ ID NO: 96142 - protein, 11 aa, Dengue virus
TDGPERVILAG

SEQ ID NO: 96143 - protein, 11 aa, Dengue virus
DGPERVILAGP

SEQ ID NO: 96144 - protein, 11 aa, Dengue virus
GPERVILAGPI

SEQ ID NO: 96145 - protein, 11 aa, Dengue virus
PERVILAGPIP

SEQ ID NO: 96146 - protein, 11 aa, Dengue virus
ERVILAGPIPV

SEQ ID NO: 96147 - protein, 11 aa, Dengue virus
RVILAGPIPVT

SEQ ID NO: 96148 - protein, 11 aa, Dengue virus
VILAGPIPVTP

SEQ ID NO: 96149 - protein, 11 aa, Dengue virus
ILAGPIPVTPA

SEQ ID NO: 96150 - protein, 11 aa, Dengue virus
LAGPIPVTPAS

SEQ ID NO: 96151 - protein, 11 aa, Dengue virus
AGPIPVTPASA

SEQ ID NO: 96152 - protein, 11 aa, Dengue virus
GPIPVTPASAA

SEQ ID NO: 96153 - protein, 11 aa, Dengue virus
PIPVTPASAAQ

SEQ ID NO: 96154 - protein, 11 aa, Dengue virus
IPVTPASAAQR

SEQ ID NO: 96155 - protein, 11 aa, Dengue virus
PVTPASAAQRR

SEQ ID NO: 96156 - protein, 11 aa, Dengue virus
VTPASAAQRRG

SEQ ID NO: 96157 - protein, 11 aa, Dengue virus
TPASAAQRRGR

SEQ ID NO: 96158 - protein, 11 aa, Dengue virus
PASAAQRRGRI

SEQ ID NO: 96159 - protein, 11 aa, Dengue virus
ASAAQRRGRIG

SEQ ID NO: 96160 - protein, 11 aa, Dengue virus
SAAQRRGRIGR

SEQ ID NO: 96161 - protein, 11 aa, Dengue virus
AAQRRGRIGRN

SEQ ID NO: 96162 - protein, 11 aa, Dengue virus
AQRRGRIGRNP

SEQ ID NO: 96163 - protein, 11 aa, Dengue virus
QRRGRIGRNPA

SEQ ID NO: 96164 - protein, 11 aa, Dengue virus
RRGRIGRNPAQ

SEQ ID NO: 96165 - protein, 11 aa, Dengue virus
RGRIGRNPAQE

SEQ ID NO: 96166 - protein, 11 aa, Dengue virus
GRIGRNPAQED

SEQ ID NO: 96167 - protein, 11 aa, Dengue virus
RIGRNPAQEDD

SEQ ID NO: 96168 - protein, 11 aa, Dengue virus
IGRNPAQEDDQ

SEQ ID NO: 96169 - protein, 11 aa, Dengue virus
GRNPAQEDDQY

SEQ ID NO: 96170 - protein, 11 aa, Dengue virus
RNPAQEDDQYV

SEQ ID NO: 96171 - protein, 11 aa, Dengue virus
NPAQEDDQYVF

SEQ ID NO: 96172 - protein, 11 aa, Dengue virus
PAQEDDQYVFS

SEQ ID NO: 96173 - protein, 11 aa, Dengue virus
AQEDDQYVFSG

SEQ ID NO: 96174 - protein, 11 aa, Dengue virus
QEDDQYVFSGD

SEQ ID NO: 96175 - protein, 11 aa, Dengue virus
EDDQYVFSGDP

SEQ ID NO: 96176 - protein, 11 aa, Dengue virus
DDQYVFSGDPL

SEQ ID NO: 96177 - protein, 11 aa, Dengue virus
DQYVFSGDPLK

SEQ ID NO: 96178 - protein, 11 aa, Dengue virus
QYVFSGDPLKN

SEQ ID NO: 96179 - protein, 11 aa, Dengue virus
YVFSGDPLKND

SEQ ID NO: 96180 - protein, 11 aa, Dengue virus
VFSGDPLKNDE

SEQ ID NO: 96181 - protein, 11 aa, Dengue virus
FSGDPLKNDED

SEQ ID NO: 96182 - protein, 11 aa, Dengue virus
SGDPLKNDEDH

SEQ ID NO: 96183 - protein, 11 aa, Dengue virus
GDPLKNDEDHA

SEQ ID NO: 96184 - protein, 11 aa, Dengue virus
DPLKNDEDHAH

SEQ ID NO: 96185 - protein, 11 aa, Dengue virus
PLKNDEDHAHW

SEQ ID NO: 96186 - protein, 11 aa, Dengue virus
LKNDEDHAHWT

SEQ ID NO: 96187 - protein, 11 aa, Dengue virus
KNDEDHAHWTE

SEQ ID NO: 96188 - protein, 11 aa, Dengue virus
NDEDHAHWTEA

SEQ ID NO: 96189 - protein, 11 aa, Dengue virus
DEDHAHWTEAK

SEQ ID NO: 96190 - protein, 11 aa, Dengue virus
EDHAHWTEAKM

SEQ ID NO: 96191 - protein, 11 aa, Dengue virus
DHAHWTEAKML

SEQ ID NO: 96192 - protein, 11 aa, Dengue virus
HAHWTEAKMLL

SEQ ID NO: 96193 - protein, 11 aa, Dengue virus
AHWTEAKMLLD

SEQ ID NO: 96194 - protein, 11 aa, Dengue virus
HWTEAKMLLDN

SEQ ID NO: 96195 - protein, 11 aa, Dengue virus
WTEAKMLLDNI

SEQ ID NO: 96196 - protein, 11 aa, Dengue virus
TEAKMLLDNIY

SEQ ID NO: 96197 - protein, 11 aa, Dengue virus
EAKMLLDNIYT

SEQ ID NO: 96198 - protein, 11 aa, Dengue virus
AKMLLDNIYTP

SEQ ID NO: 96199 - protein, 11 aa, Dengue virus
KMLLDNIYTPE

SEQ ID NO: 96200 - protein, 11 aa, Dengue virus
MLLDNIYTPEG

SEQ ID NO: 96201 - protein, 11 aa, Dengue virus
LLDNIYTPEGI

SEQ ID NO: 96202 - protein, 11 aa, Dengue virus
LDNIYTPEGII

SEQ ID NO: 96203 - protein, 11 aa, Dengue virus
DNIYTPEGIIP

SEQ ID NO: 96204 - protein, 11 aa, Dengue virus
NIYTPEGIIPT

SEQ ID NO: 96205 - protein, 11 aa, Dengue virus
IYTPEGIIPTL

SEQ ID NO: 96206 - protein, 11 aa, Dengue virus
YTPEGIIPTLF

SEQ ID NO: 96207 - protein, 11 aa, Dengue virus
TPEGIIPTLFG

SEQ ID NO: 96208 - protein, 11 aa, Dengue virus
PEGIIPTLFGP

SEQ ID NO: 96209 - protein, 11 aa, Dengue virus
EGIIPTLFGPE

SEQ ID NO: 96210 - protein, 11 aa, Dengue virus
GIIPTLFGPER

SEQ ID NO: 96211 - protein, 11 aa, Dengue virus
IIPTLFGPERE

SEQ ID NO: 96212 - protein, 11 aa, Dengue virus
IPTLFGPEREK

SEQ ID NO: 96213 - protein, 11 aa, Dengue virus
PTLFGPEREKT

SEQ ID NO: 96214 - protein, 11 aa, Dengue virus
TLFGPEREKTQ

SEQ ID NO: 96215 - protein, 11 aa, Dengue virus
LFGPEREKTQA

SEQ ID NO: 96216 - protein, 11 aa, Dengue virus
FGPEREKTQAI

SEQ ID NO: 96217 - protein, 11 aa, Dengue virus
GPEREKTQAID

SEQ ID NO: 96218 - protein, 11 aa, Dengue virus
PEREKTQAIDG

SEQ ID NO: 96219 - protein, 11 aa, Dengue virus
EREKTQAIDGE

SEQ ID NO: 96220 - protein, 11 aa, Dengue virus
REKTQAIDGEF

SEQ ID NO: 96221 - protein, 11 aa, Dengue virus
EKTQAIDGEFR

SEQ ID NO: 96222 - protein, 11 aa, Dengue virus
KTQAIDGEFRL

SEQ ID NO: 96223 - protein, 11 aa, Dengue virus
TQAIDGEFRLR

SEQ ID NO: 96224 - protein, 11 aa, Dengue virus
QAIDGEFRLRG

SEQ ID NO: 96225 - protein, 11 aa, Dengue virus
AIDGEFRLRGE

SEQ ID NO: 96226 - protein, 11 aa, Dengue virus
IDGEFRLRGEQ

SEQ ID NO: 96227 - protein, 11 aa, Dengue virus
DGEFRLRGEQR

SEQ ID NO: 96228 - protein, 11 aa, Dengue virus
GEFRLRGEQRK

SEQ ID NO: 96229 - protein, 11 aa, Dengue virus
EFRLRGEQRKT

SEQ ID NO: 96230 - protein, 11 aa, Dengue virus
FRLRGEQRKTF

SEQ ID NO: 96231 - protein, 11 aa, Dengue virus
RLRGEQRKTFV

SEQ ID NO: 96232 - protein, 11 aa, Dengue virus
LRGEQRKTFVE

SEQ ID NO: 96233 - protein, 11 aa, Dengue virus
RGEQRKTFVEL

SEQ ID NO: 96234 - protein, 11 aa, Dengue virus
GEQRKTFVELM

SEQ ID NO: 96235 - protein, 11 aa, Dengue virus
EQRKTFVELMR

SEQ ID NO: 96236 - protein, 11 aa, Dengue virus
QRKTFVELMRR

SEQ ID NO: 96237 - protein, 11 aa, Dengue virus
RKTFVELMRRG

SEQ ID NO: 96238 - protein, 11 aa, Dengue virus
KTFVELMRRGD

SEQ ID NO: 96239 - protein, 11 aa, Dengue virus
TFVELMRRGDL

SEQ ID NO: 96240 - protein, 11 aa, Dengue virus
FVELMRRGDLP

SEQ ID NO: 96241 - protein, 11 aa, Dengue virus
VELMRRGDLPV

SEQ ID NO: 96242 - protein, 11 aa, Dengue virus
ELMRRGDLPVW

SEQ ID NO: 96243 - protein, 11 aa, Dengue virus
LMRRGDLPVWL

SEQ ID NO: 96244 - protein, 11 aa, Dengue virus
MRRGDLPVWLS

SEQ ID NO: 96245 - protein, 11 aa, Dengue virus
RRGDLPVWLSY

SEQ ID NO: 96246 - protein, 11 aa, Dengue virus
RGDLPVWLSYK

SEQ ID NO: 96247 - protein, 11 aa, Dengue virus
GDLPVWLSYKV

SEQ ID NO: 96248 - protein, 11 aa, Dengue virus
DLPVWLSYKVA

SEQ ID NO: 96249 - protein, 11 aa, Dengue virus
LPVWLSYKVAS

SEQ ID NO: 96250 - protein, 11 aa, Dengue virus
PVWLSYKVASA

SEQ ID NO: 96251 - protein, 11 aa, Dengue virus
VWLSYKVASAG

SEQ ID NO: 96252 - protein, 11 aa, Dengue virus
WLSYKVASAGI

SEQ ID NO: 96253 - protein, 11 aa, Dengue virus
LSYKVASAGIS

SEQ ID NO: 96254 - protein, 11 aa, Dengue virus
SYKVASAGISY

SEQ ID NO: 96255 - protein, 11 aa, Dengue virus
YKVASAGISYK

SEQ ID NO: 96256 - protein, 11 aa, Dengue virus
KVASAGISYKD

SEQ ID NO: 96257 - protein, 11 aa, Dengue virus
VASAGISYKDR

SEQ ID NO: 96258 - protein, 11 aa, Dengue virus
ASAGISYKDRE

SEQ ID NO: 96259 - protein, 11 aa, Dengue virus
SAGISYKDREW

SEQ ID NO: 96260 - protein, 11 aa, Dengue virus
AGISYKDREWC

SEQ ID NO: 96261 - protein, 11 aa, Dengue virus
GISYKDREWCF

SEQ ID NO: 96262 - protein, 11 aa, Dengue virus
ISYKDREWCFT

SEQ ID NO: 96263 - protein, 11 aa, Dengue virus
SYKDREWCFTG

SEQ ID NO: 96264 - protein, 11 aa, Dengue virus
YKDREWCFTGE

SEQ ID NO: 96265 - protein, 11 aa, Dengue virus
KDREWCFTGER

SEQ ID NO: 96266 - protein, 11 aa, Dengue virus
DREWCFTGERN

SEQ ID NO: 96267 - protein, 11 aa, Dengue virus
REWCFTGERNN

SEQ ID NO: 96268 - protein, 11 aa, Dengue virus
EWCFTGERNNQ

SEQ ID NO: 96269 - protein, 11 aa, Dengue virus
WCFTGERNNQI

SEQ ID NO: 96270 - protein, 11 aa, Dengue virus
CFTGERNNQIL

SEQ ID NO: 96271 - protein, 11 aa, Dengue virus
FTGERNNQILE

SEQ ID NO: 96272 - protein, 11 aa, Dengue virus
TGERNNQILEE

SEQ ID NO: 96273 - protein, 11 aa, Dengue virus
GERNNQILEEN

SEQ ID NO: 96274 - protein, 11 aa, Dengue virus
ERNNQILEENM

SEQ ID NO: 96275 - protein, 11 aa, Dengue virus
RNNQILEENME

SEQ ID NO: 96276 - protein, 11 aa, Dengue virus
NNQILEENMEV

SEQ ID NO: 96277 - protein, 11 aa, Dengue virus
NQILEENMEVE

SEQ ID NO: 96278 - protein, 11 aa, Dengue virus
QILEENMEVEI

SEQ ID NO: 96279 - protein, 11 aa, Dengue virus
ILEENMEVEIW

SEQ ID NO: 96280 - protein, 11 aa, Dengue virus
LEENMEVEIWT

SEQ ID NO: 96281 - protein, 11 aa, Dengue virus
EENMEVEIWTR

SEQ ID NO: 96282 - protein, 11 aa, Dengue virus
ENMEVEIWTRE

SEQ ID NO: 96283 - protein, 11 aa, Dengue virus
NMEVEIWTREG

SEQ ID NO: 96284 - protein, 11 aa, Dengue virus
MEVEIWTREGE

SEQ ID NO: 96285 - protein, 11 aa, Dengue virus
EVEIWTREGEK

SEQ ID NO: 96286 - protein, 11 aa, Dengue virus
VEIWTREGEKK

SEQ ID NO: 96287 - protein, 11 aa, Dengue virus
EIWTREGEKKK

SEQ ID NO: 96288 - protein, 11 aa, Dengue virus
IWTREGEKKKL

SEQ ID NO: 96289 - protein, 11 aa, Dengue virus
WTREGEKKKLR

SEQ ID NO: 96290 - protein, 11 aa, Dengue virus
TREGEKKKLRP

SEQ ID NO: 96291 - protein, 11 aa, Dengue virus
REGEKKKLRPR

SEQ ID NO: 96292 - protein, 11 aa, Dengue virus
EGEKKKLRPRW

SEQ ID NO: 96293 - protein, 11 aa, Dengue virus
GEKKKLRPRWL

SEQ ID NO: 96294 - protein, 11 aa, Dengue virus
EKKKLRPRWLD

SEQ ID NO: 96295 - protein, 11 aa, Dengue virus
KKKLRPRWLDA

SEQ ID NO: 96296 - protein, 11 aa, Dengue virus
KKLRPRWLDAR

SEQ ID NO: 96297 - protein, 11 aa, Dengue virus
KLRPRWLDARV

SEQ ID NO: 96298 - protein, 11 aa, Dengue virus
LRPRWLDARVY

SEQ ID NO: 96299 - protein, 11 aa, Dengue virus
RPRWLDARVYA

SEQ ID NO: 96300 - protein, 11 aa, Dengue virus
PRWLDARVYAD

SEQ ID NO: 96301 - protein, 11 aa, Dengue virus
RWLDARVYADP

SEQ ID NO: 96302 - protein, 11 aa, Dengue virus
WLDARVYADPM

SEQ ID NO: 96303 - protein, 11 aa, Dengue virus
LDARVYADPMA

SEQ ID NO: 96304 - protein, 11 aa, Dengue virus
DARVYADPMAL

SEQ ID NO: 96305 - protein, 11 aa, Dengue virus
ARVYADPMALK

SEQ ID NO: 96306 - protein, 11 aa, Dengue virus
RVYADPMALKD

SEQ ID NO: 96307 - protein, 11 aa, Dengue virus
VYADPMALKDF

SEQ ID NO: 96308 - protein, 11 aa, Dengue virus
YADPMALKDFK

SEQ ID NO: 96309 - protein, 11 aa, Dengue virus
ADPMALKDFKE

SEQ ID NO: 96310 - protein, 11 aa, Dengue virus
DPMALKDFKEF

SEQ ID NO: 96311 - protein, 11 aa, Dengue virus
PMALKDFKEFA

SEQ ID NO: 96312 - protein, 11 aa, Dengue virus
MALKDFKEFAS

SEQ ID NO: 96313 - protein, 11 aa, Dengue virus
ALKDFKEFASG

SEQ ID NO: 96314 - protein, 11 aa, Dengue virus
LKDFKEFASGR

SEQ ID NO: 96315 - protein, 11 aa, Dengue virus
KDFKEFASGRK

SEQ ID NO: 96316 - protein, 11 aa, Dengue virus
DFKEFASGRKS

SEQ ID NO: 96317 - protein, 11 aa, Dengue virus
FKEFASGRKSI

SEQ ID NO: 96318 - protein, 11 aa, Dengue virus
KEFASGRKSIT

SEQ ID NO: 96319 - protein, 11 aa, Dengue virus
EFASGRKSITL

SEQ ID NO: 96320 - protein, 11 aa, Dengue virus
FASGRKSITLD

SEQ ID NO: 96321 - protein, 11 aa, Dengue virus
ASGRKSITLDI

SEQ ID NO: 96322 - protein, 11 aa, Dengue virus
SGRKSITLDIL

SEQ ID NO: 96323 - protein, 11 aa, Dengue virus
GRKSITLDILT

SEQ ID NO: 96324 - protein, 11 aa, Dengue virus
RKSITLDILTE

SEQ ID NO: 96325 - protein, 11 aa, Dengue virus
KSITLDILTEI

SEQ ID NO: 96326 - protein, 11 aa, Dengue virus
SITLDILTEIA

SEQ ID NO: 96327 - protein, 11 aa, Dengue virus
ITLDILTEIAS

SEQ ID NO: 96328 - protein, 11 aa, Dengue virus
TLDILTEIASL

SEQ ID NO: 96329 - protein, 11 aa, Dengue virus
LDILTEIASLP

SEQ ID NO: 96330 - protein, 11 aa, Dengue virus
DILTEIASLPT

SEQ ID NO: 96331 - protein, 11 aa, Dengue virus
ILTEIASLPTY

SEQ ID NO: 96332 - protein, 11 aa, Dengue virus
LTEIASLPTYL

SEQ ID NO: 96333 - protein, 11 aa, Dengue virus
TEIASLPTYLS

SEQ ID NO: 96334 - protein, 11 aa, Dengue virus
EIASLPTYLSS

SEQ ID NO: 96335 - protein, 11 aa, Dengue virus
IASLPTYLSSR

SEQ ID NO: 96336 - protein, 11 aa, Dengue virus
ASLPTYLSSRA

SEQ ID NO: 96337 - protein, 11 aa, Dengue virus
SLPTYLSSRAK

SEQ ID NO: 96338 - protein, 11 aa, Dengue virus
LPTYLSSRAKL

SEQ ID NO: 96339 - protein, 11 aa, Dengue virus
PTYLSSRAKLA

SEQ ID NO: 96340 - protein, 11 aa, Dengue virus
TYLSSRAKLAL

SEQ ID NO: 96341 - protein, 11 aa, Dengue virus
YLSSRAKLALD

SEQ ID NO: 96342 - protein, 11 aa, Dengue virus
LSSRAKLALDN

SEQ ID NO: 96343 - protein, 11 aa, Dengue virus
SSRAKLALDNI

SEQ ID NO: 96344 - protein, 11 aa, Dengue virus
SRAKLALDNIV

SEQ ID NO: 96345 - protein, 11 aa, Dengue virus
RAKLALDNIVM

SEQ ID NO: 96346 - protein, 11 aa, Dengue virus
AKLALDNIVML

SEQ ID NO: 96347 - protein, 11 aa, Dengue virus
KLALDNIVMLH

SEQ ID NO: 96348 - protein, 11 aa, Dengue virus
LALDNIVMLHT

SEQ ID NO: 96349 - protein, 11 aa, Dengue virus
ALDNIVMLHTT

SEQ ID NO: 96350 - protein, 11 aa, Dengue virus
LDNIVMLHTTE

SEQ ID NO: 96351 - protein, 11 aa, Dengue virus
DNIVMLHTTER

SEQ ID NO: 96352 - protein, 11 aa, Dengue virus
NIVMLHTTERG

SEQ ID NO: 96353 - protein, 11 aa, Dengue virus
IVMLHTTERGG

SEQ ID NO: 96354 - protein, 11 aa, Dengue virus
VMLHTTERGGR

SEQ ID NO: 96355 - protein, 11 aa, Dengue virus
MLHTTERGGRA

SEQ ID NO: 96356 - protein, 11 aa, Dengue virus
LHTTERGGRAY

SEQ ID NO: 96357 - protein, 11 aa, Dengue virus
HTTERGGRAYQ

SEQ ID NO: 96358 - protein, 11 aa, Dengue virus
TTERGGRAYQH

SEQ ID NO: 96359 - protein, 11 aa, Dengue virus
TERGGRAYQHA

SEQ ID NO: 96360 - protein, 11 aa, Dengue virus
ERGGRAYQHAL

SEQ ID NO: 96361 - protein, 11 aa, Dengue virus
RGGRAYQHALN

SEQ ID NO: 96362 - protein, 11 aa, Dengue virus
GGRAYQHALNE

SEQ ID NO: 96363 - protein, 11 aa, Dengue virus
GRAYQHALNEL

SEQ ID NO: 96364 - protein, 11 aa, Dengue virus
RAYQHALNELP

SEQ ID NO: 96365 - protein, 11 aa, Dengue virus
AYQHALNELPE

SEQ ID NO: 96366 - protein, 11 aa, Dengue virus
YQHALNELPES

SEQ ID NO: 96367 - protein, 11 aa, Dengue virus
QHALNELPESL

SEQ ID NO: 96368 - protein, 11 aa, Dengue virus
HALNELPESLE

SEQ ID NO: 96369 - protein, 11 aa, Dengue virus
ALNELPESLET

SEQ ID NO: 96370 - protein, 11 aa, Dengue virus
LNELPESLETL

SEQ ID NO: 96371 - protein, 11 aa, Dengue virus
NELPESLETLM

SEQ ID NO: 96372 - protein, 11 aa, Dengue virus
ELPESLETLML

SEQ ID NO: 96373 - protein, 11 aa, Dengue virus
LPESLETLMLV

SEQ ID NO: 96374 - protein, 11 aa, Dengue virus
PESLETLMLVA

SEQ ID NO: 96375 - protein, 11 aa, Dengue virus
ESLETLMLVAL

SEQ ID NO: 96376 - protein, 11 aa, Dengue virus
SLETLMLVALL

SEQ ID NO: 96377 - protein, 11 aa, Dengue virus
LETLMLVALLG

SEQ ID NO: 96378 - protein, 11 aa, Dengue virus
ETLMLVALLGA

SEQ ID NO: 96379 - protein, 11 aa, Dengue virus
TLMLVALLGAM

SEQ ID NO: 96380 - protein, 11 aa, Dengue virus
LMLVALLGAMT

SEQ ID NO: 96381 - protein, 11 aa, Dengue virus
MLVALLGAMTA

SEQ ID NO: 96382 - protein, 11 aa, Dengue virus
LVALLGAMTAG

SEQ ID NO: 96383 - protein, 11 aa, Dengue virus
VALLGAMTAGI

SEQ ID NO: 96384 - protein, 11 aa, Dengue virus
ALLGAMTAGIF

SEQ ID NO: 96385 - protein, 11 aa, Dengue virus
LLGAMTAGIFL

SEQ ID NO: 96386 - protein, 11 aa, Dengue virus
LGAMTAGIFLF

SEQ ID NO: 96387 - protein, 11 aa, Dengue virus
GAMTAGIFLFF

SEQ ID NO: 96388 - protein, 11 aa, Dengue virus
AMTAGIFLFFM

SEQ ID NO: 96389 - protein, 11 aa, Dengue virus
MTAGIFLFFMQ

SEQ ID NO: 96390 - protein, 11 aa, Dengue virus
TAGIFLFFMQG

SEQ ID NO: 96391 - protein, 11 aa, Dengue virus
AGIFLFFMQGK

SEQ ID NO: 96392 - protein, 11 aa, Dengue virus
GIFLFFMQGKG

SEQ ID NO: 96393 - protein, 11 aa, Dengue virus
IFLFFMQGKGI

SEQ ID NO: 96394 - protein, 11 aa, Dengue virus
FLFFMQGKGIG

SEQ ID NO: 96395 - protein, 11 aa, Dengue virus
LFFMQGKGIGK

SEQ ID NO: 96396 - protein, 11 aa, Dengue virus
FFMQGKGIGKL

SEQ ID NO: 96397 - protein, 11 aa, Dengue virus
FMQGKGIGKLS

SEQ ID NO: 96398 - protein, 11 aa, Dengue virus
MQGKGIGKLSM

SEQ ID NO: 96399 - protein, 11 aa, Dengue virus
QGKGIGKLSMG

SEQ ID NO: 96400 - protein, 11 aa, Dengue virus
GKGIGKLSMGL

SEQ ID NO: 96401 - protein, 11 aa, Dengue virus
KGIGKLSMGLI

SEQ ID NO: 96402 - protein, 11 aa, Dengue virus
GIGKLSMGLIT

SEQ ID NO: 96403 - protein, 11 aa, Dengue virus
IGKLSMGLITI

SEQ ID NO: 96404 - protein, 11 aa, Dengue virus
GKLSMGLITIA

SEQ ID NO: 96405 - protein, 11 aa, Dengue virus
KLSMGLITIAV

SEQ ID NO: 96406 - protein, 11 aa, Dengue virus
LSMGLITIAVA

SEQ ID NO: 96407 - protein, 11 aa, Dengue virus
SMGLITIAVAS

SEQ ID NO: 96408 - protein, 11 aa, Dengue virus
MGLITIAVASG

SEQ ID NO: 96409 - protein, 11 aa, Dengue virus
GLITIAVASGL

SEQ ID NO: 96410 - protein, 11 aa, Dengue virus
LITIAVASGLL

SEQ ID NO: 96411 - protein, 11 aa, Dengue virus
ITIAVASGLLW

SEQ ID NO: 96412 - protein, 11 aa, Dengue virus
TIAVASGLLWV

SEQ ID NO: 96413 - protein, 11 aa, Dengue virus
IAVASGLLWVA

SEQ ID NO: 96414 - protein, 11 aa, Dengue virus
AVASGLLWVAE

SEQ ID NO: 96415 - protein, 11 aa, Dengue virus
VASGLLWVAEI

SEQ ID NO: 96416 - protein, 11 aa, Dengue virus
ASGLLWVAEIQ

SEQ ID NO: 96417 - protein, 11 aa, Dengue virus
SGLLWVAEIQP

SEQ ID NO: 96418 - protein, 11 aa, Dengue virus
GLLWVAEIQPQ

SEQ ID NO: 96419 - protein, 11 aa, Dengue virus
LLWVAEIQPQW

SEQ ID NO: 96420 - protein, 11 aa, Dengue virus
LWVAEIQPQWI

SEQ ID NO: 96421 - protein, 11 aa, Dengue virus
WVAEIQPQWIA

SEQ ID NO: 96422 - protein, 11 aa, Dengue virus
VAEIQPQWIAA

SEQ ID NO: 96423 - protein, 11 aa, Dengue virus
AEIQPQWIAAS

SEQ ID NO: 96424 - protein, 11 aa, Dengue virus
EIQPQWIAASI

SEQ ID NO: 96425 - protein, 11 aa, Dengue virus
IQPQWIAASII

SEQ ID NO: 96426 - protein, 11 aa, Dengue virus
QPQWIAASIIL

SEQ ID NO: 96427 - protein, 11 aa, Dengue virus
PQWIAASIILE

SEQ ID NO: 96428 - protein, 11 aa, Dengue virus
QWIAASIILEF

SEQ ID NO: 96429 - protein, 11 aa, Dengue virus
WIAASIILEFF

SEQ ID NO: 96430 - protein, 11 aa, Dengue virus
IAASIILEFFL

SEQ ID NO: 96431 - protein, 11 aa, Dengue virus
AASIILEFFLM

SEQ ID NO: 96432 - protein, 11 aa, Dengue virus
ASIILEFFLMV

SEQ ID NO: 96433 - protein, 11 aa, Dengue virus
SIILEFFLMVL

SEQ ID NO: 96434 - protein, 11 aa, Dengue virus
IILEFFLMVLL

SEQ ID NO: 96435 - protein, 11 aa, Dengue virus
ILEFFLMVLLI

SEQ ID NO: 96436 - protein, 11 aa, Dengue virus
LEFFLMVLLIP

SEQ ID NO: 96437 - protein, 11 aa, Dengue virus
EFFLMVLLIPE

SEQ ID NO: 96438 - protein, 11 aa, Dengue virus
FFLMVLLIPEP

SEQ ID NO: 96439 - protein, 11 aa, Dengue virus
FLMVLLIPEPE

SEQ ID NO: 96440 - protein, 11 aa, Dengue virus
LMVLLIPEPEK

SEQ ID NO: 96441 - protein, 11 aa, Dengue virus
MVLLIPEPEKQ

SEQ ID NO: 96442 - protein, 11 aa, Dengue virus
VLLIPEPEKQR

SEQ ID NO: 96443 - protein, 11 aa, Dengue virus
LLIPEPEKQRT

SEQ ID NO: 96444 - protein, 11 aa, Dengue virus
LIPEPEKQRTP

SEQ ID NO: 96445 - protein, 11 aa, Dengue virus
IPEPEKQRTPQ

SEQ ID NO: 96446 - protein, 11 aa, Dengue virus
PEPEKQRTPQD

SEQ ID NO: 96447 - protein, 11 aa, Dengue virus
EPEKQRTPQDN

SEQ ID NO: 96448 - protein, 11 aa, Dengue virus
PEKQRTPQDNQ

SEQ ID NO: 96449 - protein, 11 aa, Dengue virus
EKQRTPQDNQL

SEQ ID NO: 96450 - protein, 11 aa, Dengue virus
KQRTPQDNQLI

SEQ ID NO: 96451 - protein, 11 aa, Dengue virus
QRTPQDNQLIY

SEQ ID NO: 96452 - protein, 11 aa, Dengue virus
RTPQDNQLIYV

SEQ ID NO: 96453 - protein, 11 aa, Dengue virus
TPQDNQLIYVI

SEQ ID NO: 96454 - protein, 11 aa, Dengue virus
PQDNQLIYVIL

SEQ ID NO: 96455 - protein, 11 aa, Dengue virus
QDNQLIYVILT

SEQ ID NO: 96456 - protein, 11 aa, Dengue virus
DNQLIYVILTI

SEQ ID NO: 96457 - protein, 11 aa, Dengue virus
NQLIYVILTIL

SEQ ID NO: 96458 - protein, 11 aa, Dengue virus
QLIYVILTILT

SEQ ID NO: 96459 - protein, 11 aa, Dengue virus
LIYVILTILTI

SEQ ID NO: 96460 - protein, 11 aa, Dengue virus
IYVILTILTII

SEQ ID NO: 96461 - protein, 11 aa, Dengue virus
YVILTILTIIG

SEQ ID NO: 96462 - protein, 11 aa, Dengue virus
VILTILTIIGL

SEQ ID NO: 96463 - protein, 11 aa, Dengue virus
ILTIIGLIAAN

SEQ ID NO: 96464 - protein, 11 aa, Dengue virus
LTIIGLIAANE

SEQ ID NO: 96465 - protein, 11 aa, Dengue virus
TIIGLIAANEM

SEQ ID NO: 96466 - protein, 11 aa, Dengue virus
IIGLIAANEMG

SEQ ID NO: 96467 - protein, 11 aa, Dengue virus
IGLIAANEMGL

SEQ ID NO: 96468 - protein, 11 aa, Dengue virus
GLIAANEMGLI

SEQ ID NO: 96469 - protein, 11 aa, Dengue virus
LIAANEMGLIE

SEQ ID NO: 96470 - protein, 11 aa, Dengue virus
IAANEMGLIEK

SEQ ID NO: 96471 - protein, 11 aa, Dengue virus
AANEMGLIEKT

SEQ ID NO: 96472 - protein, 11 aa, Dengue virus
ANEMGLIEKTK

SEQ ID NO: 96473 - protein, 11 aa, Dengue virus
NEMGLIEKTKT

SEQ ID NO: 96474 - protein, 11 aa, Dengue virus
EMGLIEKTKTD

SEQ ID NO: 96475 - protein, 11 aa, Dengue virus
MGLIEKTKTDF

SEQ ID NO: 96476 - protein, 11 aa, Dengue virus
GLIEKTKTDFG

SEQ ID NO: 96477 - protein, 11 aa, Dengue virus
LIEKTKTDFGF

SEQ ID NO: 96478 - protein, 11 aa, Dengue virus
IEKTKTDFGFY

SEQ ID NO: 96479 - protein, 11 aa, Dengue virus
EKTKTDFGFYQ

SEQ ID NO: 96480 - protein, 11 aa, Dengue virus
KTKTDFGFYQV

SEQ ID NO: 96481 - protein, 11 aa, Dengue virus
TKTDFGFYQVK

SEQ ID NO: 96482 - protein, 11 aa, Dengue virus
KTDFGFYQVKT

SEQ ID NO: 96483 - protein, 11 aa, Dengue virus
TDFGFYQVKTE

SEQ ID NO: 96484 - protein, 11 aa, Dengue virus
DFGFYQVKTET

SEQ ID NO: 96485 - protein, 11 aa, Dengue virus
FGFYQVKTETT

SEQ ID NO: 96486 - protein, 11 aa, Dengue virus
GFYQVKTETTI

SEQ ID NO: 96487 - protein, 11 aa, Dengue virus
FYQVKTETTIL

SEQ ID NO: 96488 - protein, 11 aa, Dengue virus
YQVKTETTILD

SEQ ID NO: 96489 - protein, 11 aa, Dengue virus
QVKTETTILDV

SEQ ID NO: 96490 - protein, 11 aa, Dengue virus
VKTETTILDVD

SEQ ID NO: 96491 - protein, 11 aa, Dengue virus
KTETTILDVDL

SEQ ID NO: 96492 - protein, 11 aa, Dengue virus
TETTILDVDLR

SEQ ID NO: 96493 - protein, 11 aa, Dengue virus
ETTILDVDLRP

SEQ ID NO: 96494 - protein, 11 aa, Dengue virus
TTILDVDLRPA

SEQ ID NO: 96495 - protein, 11 aa, Dengue virus
TILDVDLRPAS

SEQ ID NO: 96496 - protein, 11 aa, Dengue virus
ILDVDLRPASA

SEQ ID NO: 96497 - protein, 11 aa, Dengue virus
LDVDLRPASAW

SEQ ID NO: 96498 - protein, 11 aa, Dengue virus
DVDLRPASAWT

SEQ ID NO: 96499 - protein, 11 aa, Dengue virus
VDLRPASAWTL

SEQ ID NO: 96500 - protein, 11 aa, Dengue virus
DLRPASAWTLY

SEQ ID NO: 96501 - protein, 11 aa, Dengue virus
LRPASAWTLYA

SEQ ID NO: 96502 - protein, 11 aa, Dengue virus
RPASAWTLYAV

SEQ ID NO: 96503 - protein, 11 aa, Dengue virus
PASAWTLYAVA

SEQ ID NO: 96504 - protein, 11 aa, Dengue virus
ASAWTLYAVAT

SEQ ID NO: 96505 - protein, 11 aa, Dengue virus
SAWTLYAVATT

SEQ ID NO: 96506 - protein, 11 aa, Dengue virus
AWTLYAVATTI

SEQ ID NO: 96507 - protein, 11 aa, Dengue virus
WTLYAVATTIL

SEQ ID NO: 96508 - protein, 11 aa, Dengue virus
TLYAVATTILT

SEQ ID NO: 96509 - protein, 11 aa, Dengue virus
LYAVATTILTP

SEQ ID NO: 96510 - protein, 11 aa, Dengue virus
YAVATTILTPM

SEQ ID NO: 96511 - protein, 11 aa, Dengue virus
AVATTILTPML

SEQ ID NO: 96512 - protein, 11 aa, Dengue virus
VATTILTPMLR

SEQ ID NO: 96513 - protein, 11 aa, Dengue virus
ATTILTPMLRH

SEQ ID NO: 96514 - protein, 11 aa, Dengue virus
TTILTPMLRHT

SEQ ID NO: 96515 - protein, 11 aa, Dengue virus
TILTPMLRHTI

SEQ ID NO: 96516 - protein, 11 aa, Dengue virus
ILTPMLRHTIE

SEQ ID NO: 96517 - protein, 11 aa, Dengue virus
LTPMLRHTIEN

SEQ ID NO: 96518 - protein, 11 aa, Dengue virus
TPMLRHTIENT

SEQ ID NO: 96519 - protein, 11 aa, Dengue virus
PMLRHTIENTS

SEQ ID NO: 96520 - protein, 11 aa, Dengue virus
MLRHTIENTSA

SEQ ID NO: 96521 - protein, 11 aa, Dengue virus
LRHTIENTSAN

SEQ ID NO: 96522 - protein, 11 aa, Dengue virus
RHTIENTSANL

SEQ ID NO: 96523 - protein, 11 aa, Dengue virus
HTIENTSANLS

SEQ ID NO: 96524 - protein, 11 aa, Dengue virus
TIENTSANLSL

SEQ ID NO: 96525 - protein, 11 aa, Dengue virus
IENTSANLSLA

SEQ ID NO: 96526 - protein, 11 aa, Dengue virus
ENTSANLSLAA

SEQ ID NO: 96527 - protein, 11 aa, Dengue virus
NTSANLSLAAI

SEQ ID NO: 96528 - protein, 11 aa, Dengue virus
TSANLSLAAIA

SEQ ID NO: 96529 - protein, 11 aa, Dengue virus
SANLSLAAIAN

SEQ ID NO: 96530 - protein, 11 aa, Dengue virus
ANLSLAAIANQ

SEQ ID NO: 96531 - protein, 11 aa, Dengue virus
NLSLAAIANQA

SEQ ID NO: 96532 - protein, 11 aa, Dengue virus
LSLAAIANQAA

SEQ ID NO: 96533 - protein, 11 aa, Dengue virus
SLAAIANQAAV

SEQ ID NO: 96534 - protein, 11 aa, Dengue virus
LAAIANQAAVL

SEQ ID NO: 96535 - protein, 11 aa, Dengue virus
AAIANQAAVLM

SEQ ID NO: 96536 - protein, 11 aa, Dengue virus
AIANQAAVLMG

SEQ ID NO: 96537 - protein, 11 aa, Dengue virus
IANQAAVLMGL

SEQ ID NO: 96538 - protein, 11 aa, Dengue virus
ANQAAVLMGLG

SEQ ID NO: 96539 - protein, 11 aa, Dengue virus
NQAAVLMGLGK

SEQ ID NO: 96540 - protein, 11 aa, Dengue virus
QAAVLMGLGKG

SEQ ID NO: 96541 - protein, 11 aa, Dengue virus
AAVLMGLGKGW

SEQ ID NO: 96542 - protein, 11 aa, Dengue virus
AVLMGLGKGWP

SEQ ID NO: 96543 - protein, 11 aa, Dengue virus
VLMGLGKGWPL

SEQ ID NO: 96544 - protein, 11 aa, Dengue virus
LMGLGKGWPLH

SEQ ID NO: 96545 - protein, 11 aa, Dengue virus
MGLGKGWPLHR

SEQ ID NO: 96546 - protein, 11 aa, Dengue virus
GLGKGWPLHRM

SEQ ID NO: 96547 - protein, 11 aa, Dengue virus
LGKGWPLHRMD

SEQ ID NO: 96548 - protein, 11 aa, Dengue virus
GKGWPLHRMDL

SEQ ID NO: 96549 - protein, 11 aa, Dengue virus
KGWPLHRMDLG

SEQ ID NO: 96550 - protein, 11 aa, Dengue virus
GWPLHRMDLGV

SEQ ID NO: 96551 - protein, 11 aa, Dengue virus
WPLHRMDLGVP

SEQ ID NO: 96552 - protein, 11 aa, Dengue virus
PLHRMDLGVPL

SEQ ID NO: 96553 - protein, 11 aa, Dengue virus
LHRMDLGVPLL

SEQ ID NO: 96554 - protein, 11 aa, Dengue virus
HRMDLGVPLLA

SEQ ID NO: 96555 - protein, 11 aa, Dengue virus
RMDLGVPLLAM

SEQ ID NO: 96556 - protein, 11 aa, Dengue virus
MDLGVPLLAMG

SEQ ID NO: 96557 - protein, 11 aa, Dengue virus
DLGVPLLAMGC

SEQ ID NO: 96558 - protein, 11 aa, Dengue virus
LGVPLLAMGCY

SEQ ID NO: 96559 - protein, 11 aa, Dengue virus
GVPLLAMGCYS

SEQ ID NO: 96560 - protein, 11 aa, Dengue virus
VPLLAMGCYSQ

SEQ ID NO: 96561 - protein, 11 aa, Dengue virus
PLLAMGCYSQV

SEQ ID NO: 96562 - protein, 11 aa, Dengue virus
LLAMGCYSQVN

SEQ ID NO: 96563 - protein, 11 aa, Dengue virus
LAMGCYSQVNP

SEQ ID NO: 96564 - protein, 11 aa, Dengue virus
AMGCYSQVNPT

SEQ ID NO: 96565 - protein, 11 aa, Dengue virus
MGCYSQVNPTT

SEQ ID NO: 96566 - protein, 11 aa, Dengue virus
GCYSQVNPTTL

SEQ ID NO: 96567 - protein, 11 aa, Dengue virus
CYSQVNPTTLT

SEQ ID NO: 96568 - protein, 11 aa, Dengue virus
YSQVNPTTLTA

SEQ ID NO: 96569 - protein, 11 aa, Dengue virus
SQVNPTTLTAS

SEQ ID NO: 96570 - protein, 11 aa, Dengue virus
QVNPTTLTASL

SEQ ID NO: 96571 - protein, 11 aa, Dengue virus
VNPTTLTASLV

SEQ ID NO: 96572 - protein, 11 aa, Dengue virus
NPTTLTASLVM

SEQ ID NO: 96573 - protein, 11 aa, Dengue virus
PTTLTASLVML

SEQ ID NO: 96574 - protein, 11 aa, Dengue virus
TTLTASLVMLL

SEQ ID NO: 96575 - protein, 11 aa, Dengue virus
TLTASLVMLLV

SEQ ID NO: 96576 - protein, 11 aa, Dengue virus
LTASLVMLLVH

SEQ ID NO: 96577 - protein, 11 aa, Dengue virus
TASLVMLLVHY

SEQ ID NO: 96578 - protein, 11 aa, Dengue virus
ASLVMLLVHYA

SEQ ID NO: 96579 - protein, 11 aa, Dengue virus
SLVMLLVHYAI

SEQ ID NO: 96580 - protein, 11 aa, Dengue virus
LVMLLVHYAII

SEQ ID NO: 96581 - protein, 11 aa, Dengue virus
VMLLVHYAIIG

SEQ ID NO: 96582 - protein, 11 aa, Dengue virus
MLLVHYAIIGP

SEQ ID NO: 96583 - protein, 11 aa, Dengue virus
LLVHYAIIGPG

SEQ ID NO: 96584 - protein, 11 aa, Dengue virus
LVHYAIIGPGL

SEQ ID NO: 96585 - protein, 11 aa, Dengue virus
VHYAIIGPGLQ

SEQ ID NO: 96586 - protein, 11 aa, Dengue virus
HYAIIGPGLQA

SEQ ID NO: 96587 - protein, 11 aa, Dengue virus
YAIIGPGLQAK

SEQ ID NO: 96588 - protein, 11 aa, Dengue virus
AIIGPGLQAKA

SEQ ID NO: 96589 - protein, 11 aa, Dengue virus
IIGPGLQAKAT

SEQ ID NO: 96590 - protein, 11 aa, Dengue virus
IGPGLQAKATR

SEQ ID NO: 96591 - protein, 11 aa, Dengue virus
GPGLQAKATRE

SEQ ID NO: 96592 - protein, 11 aa, Dengue virus
PGLQAKATREA

SEQ ID NO: 96593 - protein, 11 aa, Dengue virus
GLQAKATREAQ

SEQ ID NO: 96594 - protein, 11 aa, Dengue virus
LQAKATREAQK

SEQ ID NO: 96595 - protein, 11 aa, Dengue virus
QAKATREAQKR

SEQ ID NO: 96596 - protein, 11 aa, Dengue virus
AKATREAQKRT

SEQ ID NO: 96597 - protein, 11 aa, Dengue virus
KATREAQKRTA

SEQ ID NO: 96598 - protein, 11 aa, Dengue virus
ATREAQKRTAA

SEQ ID NO: 96599 - protein, 11 aa, Dengue virus
TREAQKRTAAG

SEQ ID NO: 96600 - protein, 11 aa, Dengue virus
REAQKRTAAGI

SEQ ID NO: 96601 - protein, 11 aa, Dengue virus
EAQKRTAAGIM

SEQ ID NO: 96602 - protein, 11 aa, Dengue virus
AQKRTAAGIMK

SEQ ID NO: 96603 - protein, 11 aa, Dengue virus
QKRTAAGIMKN

SEQ ID NO: 96604 - protein, 11 aa, Dengue virus
KRTAAGIMKNP

SEQ ID NO: 96605 - protein, 11 aa, Dengue virus
RTAAGIMKNPT

SEQ ID NO: 96606 - protein, 11 aa, Dengue virus
TAAGIMKNPTV

SEQ ID NO: 96607 - protein, 11 aa, Dengue virus
AAGIMKNPTVD

SEQ ID NO: 96608 - protein, 11 aa, Dengue virus
AGIMKNPTVDG

SEQ ID NO: 96609 - protein, 11 aa, Dengue virus
GIMKNPTVDGI

SEQ ID NO: 96610 - protein, 11 aa, Dengue virus
IMKNPTVDGIT

SEQ ID NO: 96611 - protein, 11 aa, Dengue virus
MKNPTVDGITV

SEQ ID NO: 96612 - protein, 11 aa, Dengue virus
KNPTVDGITVI

SEQ ID NO: 96613 - protein, 11 aa, Dengue virus
NPTVDGITVID

SEQ ID NO: 96614 - protein, 11 aa, Dengue virus
PTVDGITVIDL

SEQ ID NO: 96615 - protein, 11 aa, Dengue virus
TVDGITVIDLE

SEQ ID NO: 96616 - protein, 11 aa, Dengue virus
VDGITVIDLEP

SEQ ID NO: 96617 - protein, 11 aa, Dengue virus
DGITVIDLEPI

SEQ ID NO: 96618 - protein, 11 aa, Dengue virus
GITVIDLEPIS

SEQ ID NO: 96619 - protein, 11 aa, Dengue virus
ITVIDLEPISY

SEQ ID NO: 96620 - protein, 11 aa, Dengue virus
TVIDLEPISYD

SEQ ID NO: 96621 - protein, 11 aa, Dengue virus
VIDLEPISYDP

SEQ ID NO: 96622 - protein, 11 aa, Dengue virus
IDLEPISYDPK

SEQ ID NO: 96623 - protein, 11 aa, Dengue virus
DLEPISYDPKF

SEQ ID NO: 96624 - protein, 11 aa, Dengue virus
LEPISYDPKFE

SEQ ID NO: 96625 - protein, 11 aa, Dengue virus
EPISYDPKFEK

SEQ ID NO: 96626 - protein, 11 aa, Dengue virus
PISYDPKFEKQ

SEQ ID NO: 96627 - protein, 11 aa, Dengue virus
ISYDPKFEKQL

SEQ ID NO: 96628 - protein, 11 aa, Dengue virus
SYDPKFEKQLG

SEQ ID NO: 96629 - protein, 11 aa, Dengue virus
YDPKFEKQLGQ

SEQ ID NO: 96630 - protein, 11 aa, Dengue virus
DPKFEKQLGQV

SEQ ID NO: 96631 - protein, 11 aa, Dengue virus
PKFEKQLGQVM

SEQ ID NO: 96632 - protein, 11 aa, Dengue virus
KFEKQLGQVML

SEQ ID NO: 96633 - protein, 11 aa, Dengue virus
FEKQLGQVMLL

SEQ ID NO: 96634 - protein, 11 aa, Dengue virus
EKQLGQVMLLV

SEQ ID NO: 96635 - protein, 11 aa, Dengue virus
KQLGQVMLLVL

SEQ ID NO: 96636 - protein, 11 aa, Dengue virus
QLGQVMLLVLC

SEQ ID NO: 96637 - protein, 11 aa, Dengue virus
LGQVMLLVLCA

SEQ ID NO: 96638 - protein, 11 aa, Dengue virus
GQVMLLVLCAG

SEQ ID NO: 96639 - protein, 11 aa, Dengue virus
QVMLLVLCAGQ

SEQ ID NO: 96640 - protein, 11 aa, Dengue virus
VMLLVLCAGQL

SEQ ID NO: 96641 - protein, 11 aa, Dengue virus
MLLVLCAGQLL

SEQ ID NO: 96642 - protein, 11 aa, Dengue virus
LLVLCAGQLLL

SEQ ID NO: 96643 - protein, 11 aa, Dengue virus
LVLCAGQLLLM

SEQ ID NO: 96644 - protein, 11 aa, Dengue virus
VLCAGQLLLMR

SEQ ID NO: 96645 - protein, 11 aa, Dengue virus
LCAGQLLLMRT

SEQ ID NO: 96646 - protein, 11 aa, Dengue virus
CAGQLLLMRTT

SEQ ID NO: 96647 - protein, 11 aa, Dengue virus
AGQLLLMRTTW

SEQ ID NO: 96648 - protein, 11 aa, Dengue virus
GQLLLMRTTWA

SEQ ID NO: 96649 - protein, 11 aa, Dengue virus
QLLLMRTTWAF

SEQ ID NO: 96650 - protein, 11 aa, Dengue virus
LLLMRTTWAFC

SEQ ID NO: 96651 - protein, 11 aa, Dengue virus
LLMRTTWAFCE

SEQ ID NO: 96652 - protein, 11 aa, Dengue virus
LMRTTWAFCEV

SEQ ID NO: 96653 - protein, 11 aa, Dengue virus
MRTTWAFCEVL

SEQ ID NO: 96654 - protein, 11 aa, Dengue virus
RTTWAFCEVLT

SEQ ID NO: 96655 - protein, 11 aa, Dengue virus
TTWAFCEVLTL

SEQ ID NO: 96656 - protein, 11 aa, Dengue virus
TWAFCEVLTLA

SEQ ID NO: 96657 - protein, 11 aa, Dengue virus
WAFCEVLTLAT

SEQ ID NO: 96658 - protein, 11 aa, Dengue virus
AFCEVLTLATG

SEQ ID NO: 96659 - protein, 11 aa, Dengue virus
FCEVLTLATGP

SEQ ID NO: 96660 - protein, 11 aa, Dengue virus
CEVLTLATGPI

SEQ ID NO: 96661 - protein, 11 aa, Dengue virus
EVLTLATGPIL

SEQ ID NO: 96662 - protein, 11 aa, Dengue virus
VLTLATGPILT

SEQ ID NO: 96663 - protein, 11 aa, Dengue virus
LTLATGPILTL

SEQ ID NO: 96664 - protein, 11 aa, Dengue virus
TLATGPILTLW

SEQ ID NO: 96665 - protein, 11 aa, Dengue virus
LATGPILTLWE

SEQ ID NO: 96666 - protein, 11 aa, Dengue virus
ATGPILTLWEG

SEQ ID NO: 96667 - protein, 11 aa, Dengue virus
TGPILTLWEGN

SEQ ID NO: 96668 - protein, 11 aa, Dengue virus
GPILTLWEGNP

SEQ ID NO: 96669 - protein, 11 aa, Dengue virus
PILTLWEGNPG

SEQ ID NO: 96670 - protein, 11 aa, Dengue virus
ILTLWEGNPGR

SEQ ID NO: 96671 - protein, 11 aa, Dengue virus
LTLWEGNPGRF

SEQ ID NO: 96672 - protein, 11 aa, Dengue virus
TLWEGNPGRFW

SEQ ID NO: 96673 - protein, 11 aa, Dengue virus
LWEGNPGRFWN

SEQ ID NO: 96674 - protein, 11 aa, Dengue virus
WEGNPGRFWNT

SEQ ID NO: 96675 - protein, 11 aa, Dengue virus
EGNPGRFWNTT

SEQ ID NO: 96676 - protein, 11 aa, Dengue virus
GNPGRFWNTTI

SEQ ID NO: 96677 - protein, 11 aa, Dengue virus
NPGRFWNTTIA

SEQ ID NO: 96678 - protein, 11 aa, Dengue virus
PGRFWNTTIAV

SEQ ID NO: 96679 - protein, 11 aa, Dengue virus
GRFWNTTIAVS

SEQ ID NO: 96680 - protein, 11 aa, Dengue virus
RFWNTTIAVST

SEQ ID NO: 96681 - protein, 11 aa, Dengue virus
FWNTTIAVSTA

SEQ ID NO: 96682 - protein, 11 aa, Dengue virus
WNTTIAVSTAN

SEQ ID NO: 96683 - protein, 11 aa, Dengue virus
NTTIAVSTANI

SEQ ID NO: 96684 - protein, 11 aa, Dengue virus
TTIAVSTANIF

SEQ ID NO: 96685 - protein, 11 aa, Dengue virus
TIAVSTANIFR

SEQ ID NO: 96686 - protein, 11 aa, Dengue virus
IAVSTANIFRG

SEQ ID NO: 96687 - protein, 11 aa, Dengue virus
AVSTANIFRGS

SEQ ID NO: 96688 - protein, 11 aa, Dengue virus
VSTANIFRGSY

SEQ ID NO: 96689 - protein, 11 aa, Dengue virus
STANIFRGSYL

SEQ ID NO: 96690 - protein, 11 aa, Dengue virus
TANIFRGSYLA

SEQ ID NO: 96691 - protein, 11 aa, Dengue virus
ANIFRGSYLAG

SEQ ID NO: 96692 - protein, 11 aa, Dengue virus
NIFRGSYLAGA

SEQ ID NO: 96693 - protein, 11 aa, Dengue virus
IFRGSYLAGAG

SEQ ID NO: 96694 - protein, 11 aa, Dengue virus
FRGSYLAGAGL

SEQ ID NO: 96695 - protein, 11 aa, Dengue virus
RGSYLAGAGLA

SEQ ID NO: 96696 - protein, 11 aa, Dengue virus
GSYLAGAGLAF

SEQ ID NO: 96697 - protein, 11 aa, Dengue virus
SYLAGAGLAFS

SEQ ID NO: 96698 - protein, 11 aa, Dengue virus
YLAGAGLAFSL

SEQ ID NO: 96699 - protein, 11 aa, Dengue virus
LAGAGLAFSLI

SEQ ID NO: 96700 - protein, 11 aa, Dengue virus
AGAGLAFSLIK

SEQ ID NO: 96701 - protein, 11 aa, Dengue virus
GAGLAFSLIKN

SEQ ID NO: 96702 - protein, 11 aa, Dengue virus
AGLAFSLIKNA

SEQ ID NO: 96703 - protein, 11 aa, Dengue virus
GLAFSLIKNAQ

SEQ ID NO: 96704 - protein, 11 aa, Dengue virus
LAFSLIKNAQT

SEQ ID NO: 96705 - protein, 11 aa, Dengue virus
AFSLIKNAQTP

SEQ ID NO: 96706 - protein, 11 aa, Dengue virus
FSLIKNAQTPR

SEQ ID NO: 96707 - protein, 11 aa, Dengue virus
SLIKNAQTPRR

SEQ ID NO: 96708 - protein, 11 aa, Dengue virus
LIKNAQTPRRG

SEQ ID NO: 96709 - protein, 11 aa, Dengue virus
IKNAQTPRRGT

SEQ ID NO: 96710 - protein, 11 aa, Dengue virus
KNAQTPRRGTG

SEQ ID NO: 96711 - protein, 11 aa, Dengue virus
NAQTPRRGTGT

SEQ ID NO: 96712 - protein, 11 aa, Dengue virus
AQTPRRGTGTT

SEQ ID NO: 96713 - protein, 11 aa, Dengue virus
QTPRRGTGTTG

SEQ ID NO: 96714 - protein, 11 aa, Dengue virus
TPRRGTGTTGE

SEQ ID NO: 96715 - protein, 11 aa, Dengue virus
PRRGTGTTGET

SEQ ID NO: 96716 - protein, 11 aa, Dengue virus
RRGTGTTGETL

SEQ ID NO: 96717 - protein, 11 aa, Dengue virus
RGTGTTGETLG

SEQ ID NO: 96718 - protein, 11 aa, Dengue virus
GTGTTGETLGE

SEQ ID NO: 96719 - protein, 11 aa, Dengue virus
TGTTGETLGEK

SEQ ID NO: 96720 - protein, 11 aa, Dengue virus
GTTGETLGEKW

SEQ ID NO: 96721 - protein, 11 aa, Dengue virus
TTGETLGEKWK

SEQ ID NO: 96722 - protein, 11 aa, Dengue virus
TGETLGEKWKR

SEQ ID NO: 96723 - protein, 11 aa, Dengue virus
GETLGEKWKRQ

SEQ ID NO: 96724 - protein, 11 aa, Dengue virus
ETLGEKWKRQL

SEQ ID NO: 96725 - protein, 11 aa, Dengue virus
TLGEKWKRQLN

SEQ ID NO: 96726 - protein, 11 aa, Dengue virus
LGEKWKRQLNS

SEQ ID NO: 96727 - protein, 11 aa, Dengue virus
GEKWKRQLNSL

SEQ ID NO: 96728 - protein, 11 aa, Dengue virus
EKWKRQLNSLD

SEQ ID NO: 96729 - protein, 11 aa, Dengue virus
KWKRQLNSLDR

SEQ ID NO: 96730 - protein, 11 aa, Dengue virus
WKRQLNSLDRK

SEQ ID NO: 96731 - protein, 11 aa, Dengue virus
KRQLNSLDRKE

SEQ ID NO: 96732 - protein, 11 aa, Dengue virus
RQLNSLDRKEF

SEQ ID NO: 96733 - protein, 11 aa, Dengue virus
QLNSLDRKEFE

SEQ ID NO: 96734 - protein, 11 aa, Dengue virus
LNSLDRKEFEE

SEQ ID NO: 96735 - protein, 11 aa, Dengue virus
NSLDRKEFEEY

SEQ ID NO: 96736 - protein, 11 aa, Dengue virus
SLDRKEFEEYK

SEQ ID NO: 96737 - protein, 11 aa, Dengue virus
LDRKEFEEYKR

SEQ ID NO: 96738 - protein, 11 aa, Dengue virus
DRKEFEEYKRS

SEQ ID NO: 96739 - protein, 11 aa, Dengue virus
RKEFEEYKRSG

SEQ ID NO: 96740 - protein, 11 aa, Dengue virus
KEFEEYKRSGI

SEQ ID NO: 96741 - protein, 11 aa, Dengue virus
EFEEYKRSGIL

SEQ ID NO: 96742 - protein, 11 aa, Dengue virus
FEEYKRSGILE

SEQ ID NO: 96743 - protein, 11 aa, Dengue virus
EEYKRSGILEV

SEQ ID NO: 96744 - protein, 11 aa, Dengue virus
EYKRSGILEVD

SEQ ID NO: 96745 - protein, 11 aa, Dengue virus
YKRSGILEVDR

SEQ ID NO: 96746 - protein, 11 aa, Dengue virus
KRSGILEVDRT

SEQ ID NO: 96747 - protein, 11 aa, Dengue virus
RSGILEVDRTE

SEQ ID NO: 96748 - protein, 11 aa, Dengue virus
SGILEVDRTEA

SEQ ID NO: 96749 - protein, 11 aa, Dengue virus
GILEVDRTEAK

SEQ ID NO: 96750 - protein, 11 aa, Dengue virus
ILEVDRTEAKS

SEQ ID NO: 96751 - protein, 11 aa, Dengue virus
LEVDRTEAKSA

SEQ ID NO: 96752 - protein, 11 aa, Dengue virus
EVDRTEAKSAL

SEQ ID NO: 96753 - protein, 11 aa, Dengue virus
VDRTEAKSALK

SEQ ID NO: 96754 - protein, 11 aa, Dengue virus
DRTEAKSALKD

SEQ ID NO: 96755 - protein, 11 aa, Dengue virus
RTEAKSALKDG

SEQ ID NO: 96756 - protein, 11 aa, Dengue virus
TEAKSALKDGS

SEQ ID NO: 96757 - protein, 11 aa, Dengue virus
EAKSALKDGSK

SEQ ID NO: 96758 - protein, 11 aa, Dengue virus
AKSALKDGSKI

SEQ ID NO: 96759 - protein, 11 aa, Dengue virus
KSALKDGSKIK

SEQ ID NO: 96760 - protein, 11 aa, Dengue virus
SALKDGSKIKH

SEQ ID NO: 96761 - protein, 11 aa, Dengue virus
ALKDGSKIKHA

SEQ ID NO: 96762 - protein, 11 aa, Dengue virus
LKDGSKIKHAV

SEQ ID NO: 96763 - protein, 11 aa, Dengue virus
KDGSKIKHAVS

SEQ ID NO: 96764 - protein, 11 aa, Dengue virus
DGSKIKHAVSR

SEQ ID NO: 96765 - protein, 11 aa, Dengue virus
GSKIKHAVSRG

SEQ ID NO: 96766 - protein, 11 aa, Dengue virus
SKIKHAVSRGS

SEQ ID NO: 96767 - protein, 11 aa, Dengue virus
KIKHAVSRGSS

SEQ ID NO: 96768 - protein, 11 aa, Dengue virus
IKHAVSRGSSK

SEQ ID NO: 96769 - protein, 11 aa, Dengue virus
KHAVSRGSSKI

SEQ ID NO: 96770 - protein, 11 aa, Dengue virus
HAVSRGSSKIR

SEQ ID NO: 96771 - protein, 11 aa, Dengue virus
AVSRGSSKIRW

SEQ ID NO: 96772 - protein, 11 aa, Dengue virus
VSRGSSKIRWI

SEQ ID NO: 96773 - protein, 11 aa, Dengue virus
SRGSSKIRWIV

SEQ ID NO: 96774 - protein, 11 aa, Dengue virus
RGSSKIRWIVE

SEQ ID NO: 96775 - protein, 11 aa, Dengue virus
GSSKIRWIVER

SEQ ID NO: 96776 - protein, 11 aa, Dengue virus
SSKIRWIVERG

SEQ ID NO: 96777 - protein, 11 aa, Dengue virus
SKIRWIVERGM

SEQ ID NO: 96778 - protein, 11 aa, Dengue virus
KIRWIVERGMV

SEQ ID NO: 96779 - protein, 11 aa, Dengue virus
IRWIVERGMVK

SEQ ID NO: 96780 - protein, 11 aa, Dengue virus
RWIVERGMVKP

SEQ ID NO: 96781 - protein, 11 aa, Dengue virus
WIVERGMVKPK

SEQ ID NO: 96782 - protein, 11 aa, Dengue virus
IVERGMVKPKG

SEQ ID NO: 96783 - protein, 11 aa, Dengue virus
VERGMVKPKGK

SEQ ID NO: 96784 - protein, 11 aa, Dengue virus
ERGMVKPKGKV

SEQ ID NO: 96785 - protein, 11 aa, Dengue virus
RGMVKPKGKVV

SEQ ID NO: 96786 - protein, 11 aa, Dengue virus
GMVKPKGKVVD

SEQ ID NO: 96787 - protein, 11 aa, Dengue virus
MVKPKGKVVDL

SEQ ID NO: 96788 - protein, 11 aa, Dengue virus
VKPKGKVVDLG

SEQ ID NO: 96789 - protein, 11 aa, Dengue virus
KPKGKVVDLGC

SEQ ID NO: 96790 - protein, 11 aa, Dengue virus
PKGKVVDLGCG

SEQ ID NO: 96791 - protein, 11 aa, Dengue virus
KGKVVDLGCGR

SEQ ID NO: 96792 - protein, 11 aa, Dengue virus
GKVVDLGCGRG

SEQ ID NO: 96793 - protein, 11 aa, Dengue virus
KVVDLGCGRGG

SEQ ID NO: 96794 - protein, 11 aa, Dengue virus
VVDLGCGRGGW

SEQ ID NO: 96795 - protein, 11 aa, Dengue virus
VDLGCGRGGWS

SEQ ID NO: 96796 - protein, 11 aa, Dengue virus
DLGCGRGGWSY

SEQ ID NO: 96797 - protein, 11 aa, Dengue virus
LGCGRGGWSYY

SEQ ID NO: 96798 - protein, 11 aa, Dengue virus
GCGRGGWSYYM

SEQ ID NO: 96799 - protein, 11 aa, Dengue virus
CGRGGWSYYMA

SEQ ID NO: 96800 - protein, 11 aa, Dengue virus
GRGGWSYYMAT

SEQ ID NO: 96801 - protein, 11 aa, Dengue virus
RGGWSYYMATL

SEQ ID NO: 96802 - protein, 11 aa, Dengue virus
GGWSYYMATLK

SEQ ID NO: 96803 - protein, 11 aa, Dengue virus
GWSYYMATLKN

SEQ ID NO: 96804 - protein, 11 aa, Dengue virus
WSYYMATLKNV

SEQ ID NO: 96805 - protein, 11 aa, Dengue virus
SYYMATLKNVT

SEQ ID NO: 96806 - protein, 11 aa, Dengue virus
YYMATLKNVTE

SEQ ID NO: 96807 - protein, 11 aa, Dengue virus
YMATLKNVTEV

SEQ ID NO: 96808 - protein, 11 aa, Dengue virus
MATLKNVTEVK

SEQ ID NO: 96809 - protein, 11 aa, Dengue virus
ATLKNVTEVKG

SEQ ID NO: 96810 - protein, 11 aa, Dengue virus
TLKNVTEVKGY

SEQ ID NO: 96811 - protein, 11 aa, Dengue virus
LKNVTEVKGYT

SEQ ID NO: 96812 - protein, 11 aa, Dengue virus
KNVTEVKGYTK

SEQ ID NO: 96813 - protein, 11 aa, Dengue virus
NVTEVKGYTKG

SEQ ID NO: 96814 - protein, 11 aa, Dengue virus
VTEVKGYTKGG

SEQ ID NO: 96815 - protein, 11 aa, Dengue virus
TEVKGYTKGGP

SEQ ID NO: 96816 - protein, 11 aa, Dengue virus
EVKGYTKGGPG

SEQ ID NO: 96817 - protein, 11 aa, Dengue virus
VKGYTKGGPGH

SEQ ID NO: 96818 - protein, 11 aa, Dengue virus
KGYTKGGPGHE

SEQ ID NO: 96819 - protein, 11 aa, Dengue virus
GYTKGGPGHEE

SEQ ID NO: 96820 - protein, 11 aa, Dengue virus
YTKGGPGHEEP

SEQ ID NO: 96821 - protein, 11 aa, Dengue virus
TKGGPGHEEPI

SEQ ID NO: 96822 - protein, 11 aa, Dengue virus
KGGPGHEEPIP

SEQ ID NO: 96823 - protein, 11 aa, Dengue virus
GGPGHEEPIPM

SEQ ID NO: 96824 - protein, 11 aa, Dengue virus
GPGHEEPIPMA

SEQ ID NO: 96825 - protein, 11 aa, Dengue virus
PGHEEPIPMAT

SEQ ID NO: 96826 - protein, 11 aa, Dengue virus
GHEEPIPMATY

SEQ ID NO: 96827 - protein, 11 aa, Dengue virus
HEEPIPMATYG

SEQ ID NO: 96828 - protein, 11 aa, Dengue virus
EEPIPMATYGW

SEQ ID NO: 96829 - protein, 11 aa, Dengue virus
EPIPMATYGWN

SEQ ID NO: 96830 - protein, 11 aa, Dengue virus
PIPMATYGWNL

SEQ ID NO: 96831 - protein, 11 aa, Dengue virus
IPMATYGWNLV

SEQ ID NO: 96832 - protein, 11 aa, Dengue virus
PMATYGWNLVK

SEQ ID NO: 96833 - protein, 11 aa, Dengue virus
MATYGWNLVKL

SEQ ID NO: 96834 - protein, 11 aa, Dengue virus
ATYGWNLVKLH

SEQ ID NO: 96835 - protein, 11 aa, Dengue virus
TYGWNLVKLHS

SEQ ID NO: 96836 - protein, 11 aa, Dengue virus
YGWNLVKLHSG

SEQ ID NO: 96837 - protein, 11 aa, Dengue virus
GWNLVKLHSGV

SEQ ID NO: 96838 - protein, 11 aa, Dengue virus
WNLVKLHSGVD

SEQ ID NO: 96839 - protein, 11 aa, Dengue virus
NLVKLHSGVDV

SEQ ID NO: 96840 - protein, 11 aa, Dengue virus
LVKLHSGVDVF

SEQ ID NO: 96841 - protein, 11 aa, Dengue virus
VKLHSGVDVFY

SEQ ID NO: 96842 - protein, 11 aa, Dengue virus
KLHSGVDVFYK

SEQ ID NO: 96843 - protein, 11 aa, Dengue virus
LHSGVDVFYKP

SEQ ID NO: 96844 - protein, 11 aa, Dengue virus
HSGVDVFYKPT

SEQ ID NO: 96845 - protein, 11 aa, Dengue virus
SGVDVFYKPTE

SEQ ID NO: 96846 - protein, 11 aa, Dengue virus
GVDVFYKPTEQ

SEQ ID NO: 96847 - protein, 11 aa, Dengue virus
VDVFYKPTEQV

SEQ ID NO: 96848 - protein, 11 aa, Dengue virus
DVFYKPTEQVD

SEQ ID NO: 96849 - protein, 11 aa, Dengue virus
VFYKPTEQVDT

SEQ ID NO: 96850 - protein, 11 aa, Dengue virus
FYKPTEQVDTL

SEQ ID NO: 96851 - protein, 11 aa, Dengue virus
YKPTEQVDTLL

SEQ ID NO: 96852 - protein, 11 aa, Dengue virus
KPTEQVDTLLC

SEQ ID NO: 96853 - protein, 11 aa, Dengue virus
PTEQVDTLLCD

SEQ ID NO: 96854 - protein, 11 aa, Dengue virus
TEQVDTLLCDI

SEQ ID NO: 96855 - protein, 11 aa, Dengue virus
EQVDTLLCDIG

SEQ ID NO: 96856 - protein, 11 aa, Dengue virus
QVDTLLCDIGE

SEQ ID NO: 96857 - protein, 11 aa, Dengue virus
VDTLLCDIGES

SEQ ID NO: 96858 - protein, 11 aa, Dengue virus
DTLLCDIGESS

SEQ ID NO: 96859 - protein, 11 aa, Dengue virus
TLLCDIGESSS

SEQ ID NO: 96860 - protein, 11 aa, Dengue virus
LLCDIGESSSN

SEQ ID NO: 96861 - protein, 11 aa, Dengue virus
LCDIGESSSNP

SEQ ID NO: 96862 - protein, 11 aa, Dengue virus
CDIGESSSNPT

SEQ ID NO: 96863 - protein, 11 aa, Dengue virus
DIGESSSNPTI

SEQ ID NO: 96864 - protein, 11 aa, Dengue virus
IGESSSNPTIE

SEQ ID NO: 96865 - protein, 11 aa, Dengue virus
GESSSNPTIEE

SEQ ID NO: 96866 - protein, 11 aa, Dengue virus
ESSSNPTIEEG

SEQ ID NO: 96867 - protein, 11 aa, Dengue virus
SSSNPTIEEGR

SEQ ID NO: 96868 - protein, 11 aa, Dengue virus
SSNPTIEEGRT

SEQ ID NO: 96869 - protein, 11 aa, Dengue virus
SNPTIEEGRTL

SEQ ID NO: 96870 - protein, 11 aa, Dengue virus
NPTIEEGRTLR

SEQ ID NO: 96871 - protein, 11 aa, Dengue virus
PTIEEGRTLRV

SEQ ID NO: 96872 - protein, 11 aa, Dengue virus
TIEEGRTLRVL

SEQ ID NO: 96873 - protein, 11 aa, Dengue virus
IEEGRTLRVLK

SEQ ID NO: 96874 - protein, 11 aa, Dengue virus
EEGRTLRVLKM

SEQ ID NO: 96875 - protein, 11 aa, Dengue virus
EGRTLRVLKMV

SEQ ID NO: 96876 - protein, 11 aa, Dengue virus
GRTLRVLKMVE

SEQ ID NO: 96877 - protein, 11 aa, Dengue virus
RTLRVLKMVEP

SEQ ID NO: 96878 - protein, 11 aa, Dengue virus
TLRVLKMVEPW

SEQ ID NO: 96879 - protein, 11 aa, Dengue virus
LRVLKMVEPWL

SEQ ID NO: 96880 - protein, 11 aa, Dengue virus
RVLKMVEPWLS

SEQ ID NO: 96881 - protein, 11 aa, Dengue virus
VLKMVEPWLSS

SEQ ID NO: 96882 - protein, 11 aa, Dengue virus
LKMVEPWLSSK

SEQ ID NO: 96883 - protein, 11 aa, Dengue virus
KMVEPWLSSKP

SEQ ID NO: 96884 - protein, 11 aa, Dengue virus
MVEPWLSSKPE

SEQ ID NO: 96885 - protein, 11 aa, Dengue virus
VEPWLSSKPEF

SEQ ID NO: 96886 - protein, 11 aa, Dengue virus
EPWLSSKPEFC

SEQ ID NO: 96887 - protein, 11 aa, Dengue virus
PWLSSKPEFCI

SEQ ID NO: 96888 - protein, 11 aa, Dengue virus
WLSSKPEFCIK

SEQ ID NO: 96889 - protein, 11 aa, Dengue virus
LSSKPEFCIKV

SEQ ID NO: 96890 - protein, 11 aa, Dengue virus
SSKPEFCIKVL

SEQ ID NO: 96891 - protein, 11 aa, Dengue virus
SKPEFCIKVLN

SEQ ID NO: 96892 - protein, 11 aa, Dengue virus
KPEFCIKVLNP

SEQ ID NO: 96893 - protein, 11 aa, Dengue virus
PEFCIKVLNPY

SEQ ID NO: 96894 - protein, 11 aa, Dengue virus
EFCIKVLNPYM

SEQ ID NO: 96895 - protein, 11 aa, Dengue virus
FCIKVLNPYMP

SEQ ID NO: 96896 - protein, 11 aa, Dengue virus
CIKVLNPYMPT

SEQ ID NO: 96897 - protein, 11 aa, Dengue virus
IKVLNPYMPTV

SEQ ID NO: 96898 - protein, 11 aa, Dengue virus
KVLNPYMPTVI

SEQ ID NO: 96899 - protein, 11 aa, Dengue virus
VLNPYMPTVIE

SEQ ID NO: 96900 - protein, 11 aa, Dengue virus
LNPYMPTVIEE

SEQ ID NO: 96901 - protein, 11 aa, Dengue virus
NPYMPTVIEEL

SEQ ID NO: 96902 - protein, 11 aa, Dengue virus
PYMPTVIEELE

SEQ ID NO: 96903 - protein, 11 aa, Dengue virus
YMPTVIEELEK

SEQ ID NO: 96904 - protein, 11 aa, Dengue virus
MPTVIEELEKL

SEQ ID NO: 96905 - protein, 11 aa, Dengue virus
PTVIEELEKLQ

SEQ ID NO: 96906 - protein, 11 aa, Dengue virus
TVIEELEKLQR

SEQ ID NO: 96907 - protein, 11 aa, Dengue virus
VIEELEKLQRK

SEQ ID NO: 96908 - protein, 11 aa, Dengue virus
IEELEKLQRKH

SEQ ID NO: 96909 - protein, 11 aa, Dengue virus
EELEKLQRKHG

SEQ ID NO: 96910 - protein, 11 aa, Dengue virus
ELEKLQRKHGG

SEQ ID NO: 96911 - protein, 11 aa, Dengue virus
LEKLQRKHGGN

SEQ ID NO: 96912 - protein, 11 aa, Dengue virus
EKLQRKHGGNL

SEQ ID NO: 96913 - protein, 11 aa, Dengue virus
KLQRKHGGNLV

SEQ ID NO: 96914 - protein, 11 aa, Dengue virus
LQRKHGGNLVR

SEQ ID NO: 96915 - protein, 11 aa, Dengue virus
QRKHGGNLVRC

SEQ ID NO: 96916 - protein, 11 aa, Dengue virus
RKHGGNLVRCP

SEQ ID NO: 96917 - protein, 11 aa, Dengue virus
KHGGNLVRCPL

SEQ ID NO: 96918 - protein, 11 aa, Dengue virus
HGGNLVRCPLS

SEQ ID NO: 96919 - protein, 11 aa, Dengue virus
GGNLVRCPLSR

SEQ ID NO: 96920 - protein, 11 aa, Dengue virus
GNLVRCPLSRN

SEQ ID NO: 96921 - protein, 11 aa, Dengue virus
NLVRCPLSRNS

SEQ ID NO: 96922 - protein, 11 aa, Dengue virus
LVRCPLSRNST

SEQ ID NO: 96923 - protein, 11 aa, Dengue virus
VRCPLSRNSTH

SEQ ID NO: 96924 - protein, 11 aa, Dengue virus
RCPLSRNSTHE

SEQ ID NO: 96925 - protein, 11 aa, Dengue virus
CPLSRNSTHEM

SEQ ID NO: 96926 - protein, 11 aa, Dengue virus
PLSRNSTHEMY

SEQ ID NO: 96927 - protein, 11 aa, Dengue virus
LSRNSTHEMYW

SEQ ID NO: 96928 - protein, 11 aa, Dengue virus
SRNSTHEMYWV

SEQ ID NO: 96929 - protein, 11 aa, Dengue virus
RNSTHEMYWVS

SEQ ID NO: 96930 - protein, 11 aa, Dengue virus
NSTHEMYWVSG

SEQ ID NO: 96931 - protein, 11 aa, Dengue virus
STHEMYWVSGA

SEQ ID NO: 96932 - protein, 11 aa, Dengue virus
THEMYWVSGAS

SEQ ID NO: 96933 - protein, 11 aa, Dengue virus
HEMYWVSGASG

SEQ ID NO: 96934 - protein, 11 aa, Dengue virus
EMYWVSGASGN

SEQ ID NO: 96935 - protein, 11 aa, Dengue virus
MYWVSGASGNI

SEQ ID NO: 96936 - protein, 11 aa, Dengue virus
YWVSGASGNIV

SEQ ID NO: 96937 - protein, 11 aa, Dengue virus
WVSGASGNIVS

SEQ ID NO: 96938 - protein, 11 aa, Dengue virus
VSGASGNIVSS

SEQ ID NO: 96939 - protein, 11 aa, Dengue virus
SGASGNIVSSV

SEQ ID NO: 96940 - protein, 11 aa, Dengue virus
GASGNIVSSVN

SEQ ID NO: 96941 - protein, 11 aa, Dengue virus
ASGNIVSSVNT

SEQ ID NO: 96942 - protein, 11 aa, Dengue virus
SGNIVSSVNTT

SEQ ID NO: 96943 - protein, 11 aa, Dengue virus
GNIVSSVNTTS

SEQ ID NO: 96944 - protein, 11 aa, Dengue virus
NIVSSVNTTSK

SEQ ID NO: 96945 - protein, 11 aa, Dengue virus
IVSSVNTTSKM

SEQ ID NO: 96946 - protein, 11 aa, Dengue virus
VSSVNTTSKML

SEQ ID NO: 96947 - protein, 11 aa, Dengue virus
SSVNTTSKMLL

SEQ ID NO: 96948 - protein, 11 aa, Dengue virus
SVNTTSKMLLN

SEQ ID NO: 96949 - protein, 11 aa, Dengue virus
VNTTSKMLLNR

SEQ ID NO: 96950 - protein, 11 aa, Dengue virus
NTTSKMLLNRF

SEQ ID NO: 96951 - protein, 11 aa, Dengue virus
TTSKMLLNRFT

SEQ ID NO: 96952 - protein, 11 aa, Dengue virus
TSKMLLNRFTT

SEQ ID NO: 96953 - protein, 11 aa, Dengue virus
SKMLLNRFTTR

SEQ ID NO: 96954 - protein, 11 aa, Dengue virus
KMLLNRFTTRH

SEQ ID NO: 96955 - protein, 11 aa, Dengue virus
MLLNRFTTRHR

SEQ ID NO: 96956 - protein, 11 aa, Dengue virus
LLNRFTTRHRK

SEQ ID NO: 96957 - protein, 11 aa, Dengue virus
LNRFTTRHRKP

SEQ ID NO: 96958 - protein, 11 aa, Dengue virus
NRFTTRHRKPT

SEQ ID NO: 96959 - protein, 11 aa, Dengue virus
RFTTRHRKPTY

SEQ ID NO: 96960 - protein, 11 aa, Dengue virus
FTTRHRKPTYE

SEQ ID NO: 96961 - protein, 11 aa, Dengue virus
TTRHRKPTYEK

SEQ ID NO: 96962 - protein, 11 aa, Dengue virus
TRHRKPTYEKD

SEQ ID NO: 96963 - protein, 11 aa, Dengue virus
RHRKPTYEKDV

SEQ ID NO: 96964 - protein, 11 aa, Dengue virus
HRKPTYEKDVD

SEQ ID NO: 96965 - protein, 11 aa, Dengue virus
RKPTYEKDVDL

SEQ ID NO: 96966 - protein, 11 aa, Dengue virus
KPTYEKDVDLG

SEQ ID NO: 96967 - protein, 11 aa, Dengue virus
PTYEKDVDLGA

SEQ ID NO: 96968 - protein, 11 aa, Dengue virus
TYEKDVDLGAG

SEQ ID NO: 96969 - protein, 11 aa, Dengue virus
YEKDVDLGAGT

SEQ ID NO: 96970 - protein, 11 aa, Dengue virus
EKDVDLGAGTR

SEQ ID NO: 96971 - protein, 11 aa, Dengue virus
KDVDLGAGTRS

SEQ ID NO: 96972 - protein, 11 aa, Dengue virus
DVDLGAGTRSV

SEQ ID NO: 96973 - protein, 11 aa, Dengue virus
VDLGAGTRSVS

SEQ ID NO: 96974 - protein, 11 aa, Dengue virus
DLGAGTRSVST

SEQ ID NO: 96975 - protein, 11 aa, Dengue virus
LGAGTRSVSTE

SEQ ID NO: 96976 - protein, 11 aa, Dengue virus
GAGTRSVSTET

SEQ ID NO: 96977 - protein, 11 aa, Dengue virus
AGTRSVSTETE

SEQ ID NO: 96978 - protein, 11 aa, Dengue virus
GTRSVSTETEK

SEQ ID NO: 96979 - protein, 11 aa, Dengue virus
TRSVSTETEKP

SEQ ID NO: 96980 - protein, 11 aa, Dengue virus
RSVSTETEKPD

SEQ ID NO: 96981 - protein, 11 aa, Dengue virus
SVSTETEKPDM

SEQ ID NO: 96982 - protein, 11 aa, Dengue virus
VSTETEKPDMT

SEQ ID NO: 96983 - protein, 11 aa, Dengue virus
STETEKPDMTI

SEQ ID NO: 96984 - protein, 11 aa, Dengue virus
TETEKPDMTII

SEQ ID NO: 96985 - protein, 11 aa, Dengue virus
ETEKPDMTIIG

SEQ ID NO: 96986 - protein, 11 aa, Dengue virus
TEKPDMTIIGR

SEQ ID NO: 96987 - protein, 11 aa, Dengue virus
EKPDMTIIGRR

SEQ ID NO: 96988 - protein, 11 aa, Dengue virus
KPDMTIIGRRL

SEQ ID NO: 96989 - protein, 11 aa, Dengue virus
PDMTIIGRRLQ

SEQ ID NO: 96990 - protein, 11 aa, Dengue virus
DMTIIGRRLQR

SEQ ID NO: 96991 - protein, 11 aa, Dengue virus
MTIIGRRLQRL

SEQ ID NO: 96992 - protein, 11 aa, Dengue virus
TIIGRRLQRLQ

SEQ ID NO: 96993 - protein, 11 aa, Dengue virus
IIGRRLQRLQE

SEQ ID NO: 96994 - protein, 11 aa, Dengue virus
IGRRLQRLQEE

SEQ ID NO: 96995 - protein, 11 aa, Dengue virus
GRRLQRLQEEH

SEQ ID NO: 96996 - protein, 11 aa, Dengue virus
RRLQRLQEEHK

SEQ ID NO: 96997 - protein, 11 aa, Dengue virus
RLQRLQEEHKE

SEQ ID NO: 96998 - protein, 11 aa, Dengue virus
LQRLQEEHKET

SEQ ID NO: 96999 - protein, 11 aa, Dengue virus
QRLQEEHKETW

SEQ ID NO: 97000 - protein, 11 aa, Dengue virus
RLQEEHKETWH

SEQ ID NO: 97001 - protein, 11 aa, Dengue virus
LQEEHKETWHY

SEQ ID NO: 97002 - protein, 11 aa, Dengue virus
QEEHKETWHYD

SEQ ID NO: 97003 - protein, 11 aa, Dengue virus
EEHKETWHYDQ

SEQ ID NO: 97004 - protein, 11 aa, Dengue virus
EHKETWHYDQE

SEQ ID NO: 97005 - protein, 11 aa, Dengue virus
HKETWHYDQEN

SEQ ID NO: 97006 - protein, 11 aa, Dengue virus
KETWHYDQENP

SEQ ID NO: 97007 - protein, 11 aa, Dengue virus
ETWHYDQENPY

SEQ ID NO: 97008 - protein, 11 aa, Dengue virus
TWHYDQENPYR

SEQ ID NO: 97009 - protein, 11 aa, Dengue virus
WHYDQENPYRT

SEQ ID NO: 97010 - protein, 11 aa, Dengue virus
HYDQENPYRTW

SEQ ID NO: 97011 - protein, 11 aa, Dengue virus
YDQENPYRTWA

SEQ ID NO: 97012 - protein, 11 aa, Dengue virus
DQENPYRTWAY

SEQ ID NO: 97013 - protein, 11 aa, Dengue virus
QENPYRTWAYH

SEQ ID NO: 97014 - protein, 11 aa, Dengue virus
ENPYRTWAYHG

SEQ ID NO: 97015 - protein, 11 aa, Dengue virus
NPYRTWAYHGS

SEQ ID NO: 97016 - protein, 11 aa, Dengue virus
PYRTWAYHGSY

SEQ ID NO: 97017 - protein, 11 aa, Dengue virus
YRTWAYHGSYE

SEQ ID NO: 97018 - protein, 11 aa, Dengue virus
RTWAYHGSYEA

SEQ ID NO: 97019 - protein, 11 aa, Dengue virus
TWAYHGSYEAP

SEQ ID NO: 97020 - protein, 11 aa, Dengue virus
WAYHGSYEAPS

SEQ ID NO: 97021 - protein, 11 aa, Dengue virus
AYHGSYEAPST

SEQ ID NO: 97022 - protein, 11 aa, Dengue virus
YHGSYEAPSTG

SEQ ID NO: 97023 - protein, 11 aa, Dengue virus
HGSYEAPSTGS

SEQ ID NO: 97024 - protein, 11 aa, Dengue virus
GSYEAPSTGSA

SEQ ID NO: 97025 - protein, 11 aa, Dengue virus
SYEAPSTGSAS

SEQ ID NO: 97026 - protein, 11 aa, Dengue virus
YEAPSTGSASS

SEQ ID NO: 97027 - protein, 11 aa, Dengue virus
EAPSTGSASSM

SEQ ID NO: 97028 - protein, 11 aa, Dengue virus
APSTGSASSMV

SEQ ID NO: 97029 - protein, 11 aa, Dengue virus
PSTGSASSMVN

SEQ ID NO: 97030 - protein, 11 aa, Dengue virus
STGSASSMVNG

SEQ ID NO: 97031 - protein, 11 aa, Dengue virus
TGSASSMVNGV

SEQ ID NO: 97032 - protein, 11 aa, Dengue virus
GSASSMVNGVV

SEQ ID NO: 97033 - protein, 11 aa, Dengue virus
SASSMVNGVVK

SEQ ID NO: 97034 - protein, 11 aa, Dengue virus
ASSMVNGVVKL

SEQ ID NO: 97035 - protein, 11 aa, Dengue virus
SSMVNGVVKLL

SEQ ID NO: 97036 - protein, 11 aa, Dengue virus
SMVNGVVKLLT

SEQ ID NO: 97037 - protein, 11 aa, Dengue virus
MVNGVVKLLTK

SEQ ID NO: 97038 - protein, 11 aa, Dengue virus
VNGVVKLLTKP

SEQ ID NO: 97039 - protein, 11 aa, Dengue virus
NGVVKLLTKPW

SEQ ID NO: 97040 - protein, 11 aa, Dengue virus
GVVKLLTKPWD

SEQ ID NO: 97041 - protein, 11 aa, Dengue virus
VVKLLTKPWDV

SEQ ID NO: 97042 - protein, 11 aa, Dengue virus
VKLLTKPWDVI

SEQ ID NO: 97043 - protein, 11 aa, Dengue virus
KLLTKPWDVIP

SEQ ID NO: 97044 - protein, 11 aa, Dengue virus
LLTKPWDVIPM

SEQ ID NO: 97045 - protein, 11 aa, Dengue virus
LTKPWDVIPMV

SEQ ID NO: 97046 - protein, 11 aa, Dengue virus
TKPWDVIPMVT

SEQ ID NO: 97047 - protein, 11 aa, Dengue virus
KPWDVIPMVTQ

SEQ ID NO: 97048 - protein, 11 aa, Dengue virus
PWDVIPMVTQL

SEQ ID NO: 97049 - protein, 11 aa, Dengue virus
WDVIPMVTQLA

SEQ ID NO: 97050 - protein, 11 aa, Dengue virus
DVIPMVTQLAM

SEQ ID NO: 97051 - protein, 11 aa, Dengue virus
VIPMVTQLAMT

SEQ ID NO: 97052 - protein, 11 aa, Dengue virus
IPMVTQLAMTD

SEQ ID NO: 97053 - protein, 11 aa, Dengue virus
PMVTQLAMTDT

SEQ ID NO: 97054 - protein, 11 aa, Dengue virus
MVTQLAMTDTT

SEQ ID NO: 97055 - protein, 11 aa, Dengue virus
VTQLAMTDTTP

SEQ ID NO: 97056 - protein, 11 aa, Dengue virus
TQLAMTDTTPF

SEQ ID NO: 97057 - protein, 11 aa, Dengue virus
QLAMTDTTPFG

SEQ ID NO: 97058 - protein, 11 aa, Dengue virus
LAMTDTTPFGQ

SEQ ID NO: 97059 - protein, 11 aa, Dengue virus
AMTDTTPFGQQ

SEQ ID NO: 97060 - protein, 11 aa, Dengue virus
MTDTTPFGQQR

SEQ ID NO: 97061 - protein, 11 aa, Dengue virus
TDTTPFGQQRV

SEQ ID NO: 97062 - protein, 11 aa, Dengue virus
DTTPFGQQRVF

SEQ ID NO: 97063 - protein, 11 aa, Dengue virus
TTPFGQQRVFK

SEQ ID NO: 97064 - protein, 11 aa, Dengue virus
TPFGQQRVFKE

SEQ ID NO: 97065 - protein, 11 aa, Dengue virus
PFGQQRVFKEK

SEQ ID NO: 97066 - protein, 11 aa, Dengue virus
FGQQRVFKEKV

SEQ ID NO: 97067 - protein, 11 aa, Dengue virus
GQQRVFKEKVD

SEQ ID NO: 97068 - protein, 11 aa, Dengue virus
QQRVFKEKVDT

SEQ ID NO: 97069 - protein, 11 aa, Dengue virus
QRVFKEKVDTR

SEQ ID NO: 97070 - protein, 11 aa, Dengue virus
RVFKEKVDTRT

SEQ ID NO: 97071 - protein, 11 aa, Dengue virus
VFKEKVDTRTP

SEQ ID NO: 97072 - protein, 11 aa, Dengue virus
FKEKVDTRTPQ

SEQ ID NO: 97073 - protein, 11 aa, Dengue virus
KEKVDTRTPQP

SEQ ID NO: 97074 - protein, 11 aa, Dengue virus
EKVDTRTPQPK

SEQ ID NO: 97075 - protein, 11 aa, Dengue virus
KVDTRTPQPKP

SEQ ID NO: 97076 - protein, 11 aa, Dengue virus
VDTRTPQPKPG

SEQ ID NO: 97077 - protein, 11 aa, Dengue virus
DTRTPQPKPGT

SEQ ID NO: 97078 - protein, 11 aa, Dengue virus
TRTPQPKPGTR

SEQ ID NO: 97079 - protein, 11 aa, Dengue virus
RTPQPKPGTRM

SEQ ID NO: 97080 - protein, 11 aa, Dengue virus
TPQPKPGTRMV

SEQ ID NO: 97081 - protein, 11 aa, Dengue virus
PQPKPGTRMVM

SEQ ID NO: 97082 - protein, 11 aa, Dengue virus
QPKPGTRMVMT

SEQ ID NO: 97083 - protein, 11 aa, Dengue virus
PKPGTRMVMTT

SEQ ID NO: 97084 - protein, 11 aa, Dengue virus
KPGTRMVMTTT

SEQ ID NO: 97085 - protein, 11 aa, Dengue virus
PGTRMVMTTTA

SEQ ID NO: 97086 - protein, 11 aa, Dengue virus
GTRMVMTTTAN

SEQ ID NO: 97087 - protein, 11 aa, Dengue virus
TRMVMTTTANW

SEQ ID NO: 97088 - protein, 11 aa, Dengue virus
RMVMTTTANWL

SEQ ID NO: 97089 - protein, 11 aa, Dengue virus
MVMTTTANWLW

SEQ ID NO: 97090 - protein, 11 aa, Dengue virus
VMTTTANWLWA

SEQ ID NO: 97091 - protein, 11 aa, Dengue virus
MTTTANWLWAL

SEQ ID NO: 97092 - protein, 11 aa, Dengue virus
TTTANWLWALL

SEQ ID NO: 97093 - protein, 11 aa, Dengue virus
TTANWLWALLG

SEQ ID NO: 97094 - protein, 11 aa, Dengue virus
TANWLWALLGK

SEQ ID NO: 97095 - protein, 11 aa, Dengue virus
ANWLWALLGKK

SEQ ID NO: 97096 - protein, 11 aa, Dengue virus
NWLWALLGKKK

SEQ ID NO: 97097 - protein, 11 aa, Dengue virus
LLGKKKNPRLC

SEQ ID NO: 97098 - protein, 11 aa, Dengue virus
LGKKKNPRLCT

SEQ ID NO: 97099 - protein, 11 aa, Dengue virus
KKNPRLCTREE

SEQ ID NO: 97100 - protein, 11 aa, Dengue virus
KNPRLCTREEF

SEQ ID NO: 97101 - protein, 11 aa, Dengue virus
NPRLCTREEFI

SEQ ID NO: 97102 - protein, 11 aa, Dengue virus
PRLCTREEFIS

SEQ ID NO: 97103 - protein, 11 aa, Dengue virus
RLCTREEFISK

SEQ ID NO: 97104 - protein, 11 aa, Dengue virus
LCTREEFISKV

SEQ ID NO: 97105 - protein, 11 aa, Dengue virus
CTREEFISKVR

SEQ ID NO: 97106 - protein, 11 aa, Dengue virus
TREEFISKVRS

SEQ ID NO: 97107 - protein, 11 aa, Dengue virus
REEFISKVRSN

SEQ ID NO: 97108 - protein, 11 aa, Dengue virus
EEFISKVRSNA

SEQ ID NO: 97109 - protein, 11 aa, Dengue virus
EFISKVRSNAA

SEQ ID NO: 97110 - protein, 11 aa, Dengue virus
FISKVRSNAAI

SEQ ID NO: 97111 - protein, 11 aa, Dengue virus
ISKVRSNAAIG

SEQ ID NO: 97112 - protein, 11 aa, Dengue virus
SKVRSNAAIGA

SEQ ID NO: 97113 - protein, 11 aa, Dengue virus
KVRSNAAIGAV

SEQ ID NO: 97114 - protein, 11 aa, Dengue virus
VRSNAAIGAVF

SEQ ID NO: 97115 - protein, 11 aa, Dengue virus
RSNAAIGAVFQ

SEQ ID NO: 97116 - protein, 11 aa, Dengue virus
SNAAIGAVFQE

SEQ ID NO: 97117 - protein, 11 aa, Dengue virus
NAAIGAVFQEE

SEQ ID NO: 97118 - protein, 11 aa, Dengue virus
AAIGAVFQEEQ

SEQ ID NO: 97119 - protein, 11 aa, Dengue virus
AIGAVFQEEQG

SEQ ID NO: 97120 - protein, 11 aa, Dengue virus
IGAVFQEEQGW

SEQ ID NO: 97121 - protein, 11 aa, Dengue virus
GAVFQEEQGWT

SEQ ID NO: 97122 - protein, 11 aa, Dengue virus
AVFQEEQGWTS

SEQ ID NO: 97123 - protein, 11 aa, Dengue virus
VFQEEQGWTSA

SEQ ID NO: 97124 - protein, 11 aa, Dengue virus
FQEEQGWTSAS

SEQ ID NO: 97125 - protein, 11 aa, Dengue virus
QEEQGWTSASE

SEQ ID NO: 97126 - protein, 11 aa, Dengue virus
EEQGWTSASEA

SEQ ID NO: 97127 - protein, 11 aa, Dengue virus
EQGWTSASEAV

SEQ ID NO: 97128 - protein, 11 aa, Dengue virus
QGWTSASEAVN

SEQ ID NO: 97129 - protein, 11 aa, Dengue virus
GWTSASEAVND

SEQ ID NO: 97130 - protein, 11 aa, Dengue virus
WTSASEAVNDS

SEQ ID NO: 97131 - protein, 11 aa, Dengue virus
TSASEAVNDSR

SEQ ID NO: 97132 - protein, 11 aa, Dengue virus
SASEAVNDSRF

SEQ ID NO: 97133 - protein, 11 aa, Dengue virus
ASEAVNDSRFW

SEQ ID NO: 97134 - protein, 11 aa, Dengue virus
SEAVNDSRFWE

SEQ ID NO: 97135 - protein, 11 aa, Dengue virus
EAVNDSRFWEL

SEQ ID NO: 97136 - protein, 11 aa, Dengue virus
AVNDSRFWELV

SEQ ID NO: 97137 - protein, 11 aa, Dengue virus
VNDSRFWELVD

SEQ ID NO: 97138 - protein, 11 aa, Dengue virus
NDSRFWELVDK

SEQ ID NO: 97139 - protein, 11 aa, Dengue virus
DSRFWELVDKE

SEQ ID NO: 97140 - protein, 11 aa, Dengue virus
SRFWELVDKER

SEQ ID NO: 97141 - protein, 11 aa, Dengue virus
RFWELVDKERA

SEQ ID NO: 97142 - protein, 11 aa, Dengue virus
FWELVDKERAL

SEQ ID NO: 97143 - protein, 11 aa, Dengue virus
WELVDKERALH

SEQ ID NO: 97144 - protein, 11 aa, Dengue virus
ELVDKERALHQ

SEQ ID NO: 97145 - protein, 11 aa, Dengue virus
LVDKERALHQE

SEQ ID NO: 97146 - protein, 11 aa, Dengue virus
VDKERALHQEG

SEQ ID NO: 97147 - protein, 11 aa, Dengue virus
DKERALHQEGK

SEQ ID NO: 97148 - protein, 11 aa, Dengue virus
KERALHQEGKC

SEQ ID NO: 97149 - protein, 11 aa, Dengue virus
ERALHQEGKCE

SEQ ID NO: 97150 - protein, 11 aa, Dengue virus
RALHQEGKCES

SEQ ID NO: 97151 - protein, 11 aa, Dengue virus
ALHQEGKCESC

SEQ ID NO: 97152 - protein, 11 aa, Dengue virus
LHQEGKCESCV

SEQ ID NO: 97153 - protein, 11 aa, Dengue virus
HQEGKCESCVY

SEQ ID NO: 97154 - protein, 11 aa, Dengue virus
QEGKCESCVYN

SEQ ID NO: 97155 - protein, 11 aa, Dengue virus
EGKCESCVYNM

SEQ ID NO: 97156 - protein, 11 aa, Dengue virus
GKCESCVYNMM

SEQ ID NO: 97157 - protein, 11 aa, Dengue virus
KCESCVYNMMG

SEQ ID NO: 97158 - protein, 11 aa, Dengue virus
CESCVYNMMGK

SEQ ID NO: 97159 - protein, 11 aa, Dengue virus
ESCVYNMMGKR

SEQ ID NO: 97160 - protein, 11 aa, Dengue virus
SCVYNMMGKRE

SEQ ID NO: 97161 - protein, 11 aa, Dengue virus
CVYNMMGKREK

SEQ ID NO: 97162 - protein, 11 aa, Dengue virus
VYNMMGKREKK

SEQ ID NO: 97163 - protein, 11 aa, Dengue virus
YNMMGKREKKL

SEQ ID NO: 97164 - protein, 11 aa, Dengue virus
NMMGKREKKLG

SEQ ID NO: 97165 - protein, 11 aa, Dengue virus
MMGKREKKLGE

SEQ ID NO: 97166 - protein, 11 aa, Dengue virus
MGKREKKLGEF

SEQ ID NO: 97167 - protein, 11 aa, Dengue virus
GKREKKLGEFG

SEQ ID NO: 97168 - protein, 11 aa, Dengue virus
KREKKLGEFGR

SEQ ID NO: 97169 - protein, 11 aa, Dengue virus
REKKLGEFGRA

SEQ ID NO: 97170 - protein, 11 aa, Dengue virus
EKKLGEFGRAK

SEQ ID NO: 97171 - protein, 11 aa, Dengue virus
KKLGEFGRAKG

SEQ ID NO: 97172 - protein, 11 aa, Dengue virus
KLGEFGRAKGS

SEQ ID NO: 97173 - protein, 11 aa, Dengue virus
LGEFGRAKGSR

SEQ ID NO: 97174 - protein, 11 aa, Dengue virus
GEFGRAKGSRA

SEQ ID NO: 97175 - protein, 11 aa, Dengue virus
EFGRAKGSRAI

SEQ ID NO: 97176 - protein, 11 aa, Dengue virus
FGRAKGSRAIW

SEQ ID NO: 97177 - protein, 11 aa, Dengue virus
GRAKGSRAIWY

SEQ ID NO: 97178 - protein, 11 aa, Dengue virus
RAKGSRAIWYM

SEQ ID NO: 97179 - protein, 11 aa, Dengue virus
AKGSRAIWYMW

SEQ ID NO: 97180 - protein, 11 aa, Dengue virus
KGSRAIWYMWL

SEQ ID NO: 97181 - protein, 11 aa, Dengue virus
GSRAIWYMWLG

SEQ ID NO: 97182 - protein, 11 aa, Dengue virus
SRAIWYMWLGA

SEQ ID NO: 97183 - protein, 11 aa, Dengue virus
RAIWYMWLGAR

SEQ ID NO: 97184 - protein, 11 aa, Dengue virus
AIWYMWLGARF

SEQ ID NO: 97185 - protein, 11 aa, Dengue virus
IWYMWLGARFL

SEQ ID NO: 97186 - protein, 11 aa, Dengue virus
WYMWLGARFLE

SEQ ID NO: 97187 - protein, 11 aa, Dengue virus
YMWLGARFLEF

SEQ ID NO: 97188 - protein, 11 aa, Dengue virus
MWLGARFLEFE

SEQ ID NO: 97189 - protein, 11 aa, Dengue virus
WLGARFLEFEA

SEQ ID NO: 97190 - protein, 11 aa, Dengue virus
LGARFLEFEAL

SEQ ID NO: 97191 - protein, 11 aa, Dengue virus
GARFLEFEALG

SEQ ID NO: 97192 - protein, 11 aa, Dengue virus
ARFLEFEALGF

SEQ ID NO: 97193 - protein, 11 aa, Dengue virus
RFLEFEALGFL

SEQ ID NO: 97194 - protein, 11 aa, Dengue virus
FLEFEALGFLN

SEQ ID NO: 97195 - protein, 11 aa, Dengue virus
LEFEALGFLNE

SEQ ID NO: 97196 - protein, 11 aa, Dengue virus
EFEALGFLNED

SEQ ID NO: 97197 - protein, 11 aa, Dengue virus
FEALGFLNEDH

SEQ ID NO: 97198 - protein, 11 aa, Dengue virus
EALGFLNEDHW

SEQ ID NO: 97199 - protein, 11 aa, Dengue virus
ALGFLNEDHWF

SEQ ID NO: 97200 - protein, 11 aa, Dengue virus
LGFLNEDHWFG

SEQ ID NO: 97201 - protein, 11 aa, Dengue virus
GFLNEDHWFGR

SEQ ID NO: 97202 - protein, 11 aa, Dengue virus
FLNEDHWFGRE

SEQ ID NO: 97203 - protein, 11 aa, Dengue virus
LNEDHWFGREN

SEQ ID NO: 97204 - protein, 11 aa, Dengue virus
NEDHWFGRENS

SEQ ID NO: 97205 - protein, 11 aa, Dengue virus
EDHWFGRENSW

SEQ ID NO: 97206 - protein, 11 aa, Dengue virus
DHWFGRENSWS

SEQ ID NO: 97207 - protein, 11 aa, Dengue virus
HWFGRENSWSG

SEQ ID NO: 97208 - protein, 11 aa, Dengue virus
WFGRENSWSGV

SEQ ID NO: 97209 - protein, 11 aa, Dengue virus
FGRENSWSGVE

SEQ ID NO: 97210 - protein, 11 aa, Dengue virus
GRENSWSGVEG

SEQ ID NO: 97211 - protein, 11 aa, Dengue virus
RENSWSGVEGE

SEQ ID NO: 97212 - protein, 11 aa, Dengue virus
ENSWSGVEGEG

SEQ ID NO: 97213 - protein, 11 aa, Dengue virus
NSWSGVEGEGL

SEQ ID NO: 97214 - protein, 11 aa, Dengue virus
SWSGVEGEGLH

SEQ ID NO: 97215 - protein, 11 aa, Dengue virus
WSGVEGEGLHR

SEQ ID NO: 97216 - protein, 11 aa, Dengue virus
SGVEGEGLHRL

SEQ ID NO: 97217 - protein, 11 aa, Dengue virus
GVEGEGLHRLG

SEQ ID NO: 97218 - protein, 11 aa, Dengue virus
VEGEGLHRLGY

SEQ ID NO: 97219 - protein, 11 aa, Dengue virus
EGEGLHRLGYI

SEQ ID NO: 97220 - protein, 11 aa, Dengue virus
GEGLHRLGYIL

SEQ ID NO: 97221 - protein, 11 aa, Dengue virus
EGLHRLGYILE

SEQ ID NO: 97222 - protein, 11 aa, Dengue virus
GLHRLGYILEE

SEQ ID NO: 97223 - protein, 11 aa, Dengue virus
LHRLGYILEEI

SEQ ID NO: 97224 - protein, 11 aa, Dengue virus
HRLGYILEEID

SEQ ID NO: 97225 - protein, 11 aa, Dengue virus
RLGYILEEIDK

SEQ ID NO: 97226 - protein, 11 aa, Dengue virus
LGYILEEIDKK

SEQ ID NO: 97227 - protein, 11 aa, Dengue virus
GYILEEIDKKD

SEQ ID NO: 97228 - protein, 11 aa, Dengue virus
YILEEIDKKDG

SEQ ID NO: 97229 - protein, 11 aa, Dengue virus
ILEEIDKKDGD

SEQ ID NO: 97230 - protein, 11 aa, Dengue virus
LEEIDKKDGDL

SEQ ID NO: 97231 - protein, 11 aa, Dengue virus
EEIDKKDGDLM

SEQ ID NO: 97232 - protein, 11 aa, Dengue virus
EIDKKDGDLMY

SEQ ID NO: 97233 - protein, 11 aa, Dengue virus
IDKKDGDLMYA

SEQ ID NO: 97234 - protein, 11 aa, Dengue virus
DKKDGDLMYAD

SEQ ID NO: 97235 - protein, 11 aa, Dengue virus
KKDGDLMYADD

SEQ ID NO: 97236 - protein, 11 aa, Dengue virus
KDGDLMYADDT

SEQ ID NO: 97237 - protein, 11 aa, Dengue virus
DGDLMYADDTA

SEQ ID NO: 97238 - protein, 11 aa, Dengue virus
GDLMYADDTAG

SEQ ID NO: 97239 - protein, 11 aa, Dengue virus
DLMYADDTAGW

SEQ ID NO: 97240 - protein, 11 aa, Dengue virus
LMYADDTAGWD

SEQ ID NO: 97241 - protein, 11 aa, Dengue virus
MYADDTAGWDT

SEQ ID NO: 97242 - protein, 11 aa, Dengue virus
YADDTAGWDTR

SEQ ID NO: 97243 - protein, 11 aa, Dengue virus
ADDTAGWDTRI

SEQ ID NO: 97244 - protein, 11 aa, Dengue virus
DDTAGWDTRIT

SEQ ID NO: 97245 - protein, 11 aa, Dengue virus
DTAGWDTRITE

SEQ ID NO: 97246 - protein, 11 aa, Dengue virus
TAGWDTRITED

SEQ ID NO: 97247 - protein, 11 aa, Dengue virus
AGWDTRITEDD

SEQ ID NO: 97248 - protein, 11 aa, Dengue virus
GWDTRITEDDL

SEQ ID NO: 97249 - protein, 11 aa, Dengue virus
WDTRITEDDLQ

SEQ ID NO: 97250 - protein, 11 aa, Dengue virus
DTRITEDDLQN

SEQ ID NO: 97251 - protein, 11 aa, Dengue virus
TRITEDDLQNE

SEQ ID NO: 97252 - protein, 11 aa, Dengue virus
RITEDDLQNEE

SEQ ID NO: 97253 - protein, 11 aa, Dengue virus
ITEDDLQNEEL

SEQ ID NO: 97254 - protein, 11 aa, Dengue virus
TEDDLQNEELI

SEQ ID NO: 97255 - protein, 11 aa, Dengue virus
EDDLQNEELIT

SEQ ID NO: 97256 - protein, 11 aa, Dengue virus
DDLQNEELITE

SEQ ID NO: 97257 - protein, 11 aa, Dengue virus
DLQNEELITEQ

SEQ ID NO: 97258 - protein, 11 aa, Dengue virus
LQNEELITEQM

SEQ ID NO: 97259 - protein, 11 aa, Dengue virus
QNEELITEQMA

SEQ ID NO: 97260 - protein, 11 aa, Dengue virus
NEELITEQMAP

SEQ ID NO: 97261 - protein, 11 aa, Dengue virus
EELITEQMAPH

SEQ ID NO: 97262 - protein, 11 aa, Dengue virus
ELITEQMAPHH

SEQ ID NO: 97263 - protein, 11 aa, Dengue virus
LITEQMAPHHK

SEQ ID NO: 97264 - protein, 11 aa, Dengue virus
ITEQMAPHHKI

SEQ ID NO: 97265 - protein, 11 aa, Dengue virus
TEQMAPHHKIL

SEQ ID NO: 97266 - protein, 11 aa, Dengue virus
EQMAPHHKILA

SEQ ID NO: 97267 - protein, 11 aa, Dengue virus
QMAPHHKILAK

SEQ ID NO: 97268 - protein, 11 aa, Dengue virus
MAPHHKILAKA

SEQ ID NO: 97269 - protein, 11 aa, Dengue virus
APHHKILAKAI

SEQ ID NO: 97270 - protein, 11 aa, Dengue virus
PHHKILAKAIF

SEQ ID NO: 97271 - protein, 11 aa, Dengue virus
HHKILAKAIFK

SEQ ID NO: 97272 - protein, 11 aa, Dengue virus
HKILAKAIFKL

SEQ ID NO: 97273 - protein, 11 aa, Dengue virus
KILAKAIFKLT

SEQ ID NO: 97274 - protein, 11 aa, Dengue virus
ILAKAIFKLTY

SEQ ID NO: 97275 - protein, 11 aa, Dengue virus
LAKAIFKLTYQ

SEQ ID NO: 97276 - protein, 11 aa, Dengue virus
AKAIFKLTYQN

SEQ ID NO: 97277 - protein, 11 aa, Dengue virus
KAIFKLTYQNK

SEQ ID NO: 97278 - protein, 11 aa, Dengue virus
AIFKLTYQNKV

SEQ ID NO: 97279 - protein, 11 aa, Dengue virus
IFKLTYQNKVV

SEQ ID NO: 97280 - protein, 11 aa, Dengue virus
FKLTYQNKVVK

SEQ ID NO: 97281 - protein, 11 aa, Dengue virus
KLTYQNKVVKV

SEQ ID NO: 97282 - protein, 11 aa, Dengue virus
LTYQNKVVKVL

SEQ ID NO: 97283 - protein, 11 aa, Dengue virus
TYQNKVVKVLR

SEQ ID NO: 97284 - protein, 11 aa, Dengue virus
YQNKVVKVLRP

SEQ ID NO: 97285 - protein, 11 aa, Dengue virus
QNKVVKVLRPT

SEQ ID NO: 97286 - protein, 11 aa, Dengue virus
NKVVKVLRPTP

SEQ ID NO: 97287 - protein, 11 aa, Dengue virus
KVVKVLRPTPR

SEQ ID NO: 97288 - protein, 11 aa, Dengue virus
VVKVLRPTPRG

SEQ ID NO: 97289 - protein, 11 aa, Dengue virus
VKVLRPTPRGA

SEQ ID NO: 97290 - protein, 11 aa, Dengue virus
KVLRPTPRGAV

SEQ ID NO: 97291 - protein, 11 aa, Dengue virus
VLRPTPRGAVM

SEQ ID NO: 97292 - protein, 11 aa, Dengue virus
LRPTPRGAVMD

SEQ ID NO: 97293 - protein, 11 aa, Dengue virus
RPTPRGAVMDI

SEQ ID NO: 97294 - protein, 11 aa, Dengue virus
PTPRGAVMDII

SEQ ID NO: 97295 - protein, 11 aa, Dengue virus
TPRGAVMDIIS

SEQ ID NO: 97296 - protein, 11 aa, Dengue virus
PRGAVMDIISR

SEQ ID NO: 97297 - protein, 11 aa, Dengue virus
RGAVMDIISRK

SEQ ID NO: 97298 - protein, 11 aa, Dengue virus
GAVMDIISRKD

SEQ ID NO: 97299 - protein, 11 aa, Dengue virus
AVMDIISRKDQ

SEQ ID NO: 97300 - protein, 11 aa, Dengue virus
VMDIISRKDQR

SEQ ID NO: 97301 - protein, 11 aa, Dengue virus
MDIISRKDQRG

SEQ ID NO: 97302 - protein, 11 aa, Dengue virus
DIISRKDQRGS

SEQ ID NO: 97303 - protein, 11 aa, Dengue virus
IISRKDQRGSG

SEQ ID NO: 97304 - protein, 11 aa, Dengue virus
ISRKDQRGSGQ

SEQ ID NO: 97305 - protein, 11 aa, Dengue virus
SRKDQRGSGQV

SEQ ID NO: 97306 - protein, 11 aa, Dengue virus
RKDQRGSGQVG

SEQ ID NO: 97307 - protein, 11 aa, Dengue virus
KDQRGSGQVGT

SEQ ID NO: 97308 - protein, 11 aa, Dengue virus
DQRGSGQVGTY

SEQ ID NO: 97309 - protein, 11 aa, Dengue virus
QRGSGQVGTYG

SEQ ID NO: 97310 - protein, 11 aa, Dengue virus
RGSGQVGTYGL

SEQ ID NO: 97311 - protein, 11 aa, Dengue virus
GSGQVGTYGLN

SEQ ID NO: 97312 - protein, 11 aa, Dengue virus
SGQVGTYGLNT

SEQ ID NO: 97313 - protein, 11 aa, Dengue virus
GQVGTYGLNTF

SEQ ID NO: 97314 - protein, 11 aa, Dengue virus
QVGTYGLNTFT

SEQ ID NO: 97315 - protein, 11 aa, Dengue virus
VGTYGLNTFTN

SEQ ID NO: 97316 - protein, 11 aa, Dengue virus
GTYGLNTFTNM

SEQ ID NO: 97317 - protein, 11 aa, Dengue virus
TYGLNTFTNME

SEQ ID NO: 97318 - protein, 11 aa, Dengue virus
YGLNTFTNMEV

SEQ ID NO: 97319 - protein, 11 aa, Dengue virus
GLNTFTNMEVQ

SEQ ID NO: 97320 - protein, 11 aa, Dengue virus
LNTFTNMEVQL

SEQ ID NO: 97321 - protein, 11 aa, Dengue virus
NTFTNMEVQLI

SEQ ID NO: 97322 - protein, 11 aa, Dengue virus
TFTNMEVQLIR

SEQ ID NO: 97323 - protein, 11 aa, Dengue virus
FTNMEVQLIRQ

SEQ ID NO: 97324 - protein, 11 aa, Dengue virus
TNMEVQLIRQM

SEQ ID NO: 97325 - protein, 11 aa, Dengue virus
NMEVQLIRQME

SEQ ID NO: 97326 - protein, 11 aa, Dengue virus
MEVQLIRQMEA

SEQ ID NO: 97327 - protein, 11 aa, Dengue virus
EVQLIRQMEAE

SEQ ID NO: 97328 - protein, 11 aa, Dengue virus
VQLIRQMEAEG

SEQ ID NO: 97329 - protein, 11 aa, Dengue virus
QLIRQMEAEGV

SEQ ID NO: 97330 - protein, 11 aa, Dengue virus
LIRQMEAEGVI

SEQ ID NO: 97331 - protein, 11 aa, Dengue virus
IRQMEAEGVIT

SEQ ID NO: 97332 - protein, 11 aa, Dengue virus
RQMEAEGVITQ

SEQ ID NO: 97333 - protein, 11 aa, Dengue virus
QMEAEGVITQD

SEQ ID NO: 97334 - protein, 11 aa, Dengue virus
MEAEGVITQDD

SEQ ID NO: 97335 - protein, 11 aa, Dengue virus
EAEGVITQDDM

SEQ ID NO: 97336 - protein, 11 aa, Dengue virus
AEGVITQDDMQ

SEQ ID NO: 97337 - protein, 11 aa, Dengue virus
EGVITQDDMQN

SEQ ID NO: 97338 - protein, 11 aa, Dengue virus
GVITQDDMQNP

SEQ ID NO: 97339 - protein, 11 aa, Dengue virus
VITQDDMQNPK

SEQ ID NO: 97340 - protein, 11 aa, Dengue virus
ITQDDMQNPKG

SEQ ID NO: 97341 - protein, 11 aa, Dengue virus
TQDDMQNPKGL

SEQ ID NO: 97342 - protein, 11 aa, Dengue virus
QDDMQNPKGLK

SEQ ID NO: 97343 - protein, 11 aa, Dengue virus
DDMQNPKGLKE

SEQ ID NO: 97344 - protein, 11 aa, Dengue virus
DMQNPKGLKER

SEQ ID NO: 97345 - protein, 11 aa, Dengue virus
MQNPKGLKERV

SEQ ID NO: 97346 - protein, 11 aa, Dengue virus
QNPKGLKERVE

SEQ ID NO: 97347 - protein, 11 aa, Dengue virus
NPKGLKERVEK

SEQ ID NO: 97348 - protein, 11 aa, Dengue virus
PKGLKERVEKW

SEQ ID NO: 97349 - protein, 11 aa, Dengue virus
KGLKERVEKWL

SEQ ID NO: 97350 - protein, 11 aa, Dengue virus
GLKERVEKWLR

SEQ ID NO: 97351 - protein, 11 aa, Dengue virus
LKERVEKWLRE

SEQ ID NO: 97352 - protein, 11 aa, Dengue virus
KERVEKWLREC

SEQ ID NO: 97353 - protein, 11 aa, Dengue virus
ERVEKWLRECG

SEQ ID NO: 97354 - protein, 11 aa, Dengue virus
RVEKWLRECGV

SEQ ID NO: 97355 - protein, 11 aa, Dengue virus
VEKWLRECGVD

SEQ ID NO: 97356 - protein, 11 aa, Dengue virus
EKWLRECGVDR

SEQ ID NO: 97357 - protein, 11 aa, Dengue virus
KWLRECGVDRL

SEQ ID NO: 97358 - protein, 11 aa, Dengue virus
WLRECGVDRLK

SEQ ID NO: 97359 - protein, 11 aa, Dengue virus
LRECGVDRLKR

SEQ ID NO: 97360 - protein, 11 aa, Dengue virus
RECGVDRLKRM

SEQ ID NO: 97361 - protein, 11 aa, Dengue virus
ECGVDRLKRMA

SEQ ID NO: 97362 - protein, 11 aa, Dengue virus
CGVDRLKRMAI

SEQ ID NO: 97363 - protein, 11 aa, Dengue virus
GVDRLKRMAIS

SEQ ID NO: 97364 - protein, 11 aa, Dengue virus
VDRLKRMAISG

SEQ ID NO: 97365 - protein, 11 aa, Dengue virus
DRLKRMAISGD

SEQ ID NO: 97366 - protein, 11 aa, Dengue virus
RLKRMAISGDD

SEQ ID NO: 97367 - protein, 11 aa, Dengue virus
LKRMAISGDDC

SEQ ID NO: 97368 - protein, 11 aa, Dengue virus
KRMAISGDDCV

SEQ ID NO: 97369 - protein, 11 aa, Dengue virus
RMAISGDDCVV

SEQ ID NO: 97370 - protein, 11 aa, Dengue virus
MAISGDDCVVK

SEQ ID NO: 97371 - protein, 11 aa, Dengue virus
AISGDDCVVKP

SEQ ID NO: 97372 - protein, 11 aa, Dengue virus
ISGDDCVVKPL

SEQ ID NO: 97373 - protein, 11 aa, Dengue virus
SGDDCVVKPLD

SEQ ID NO: 97374 - protein, 11 aa, Dengue virus
GDDCVVKPLDE

SEQ ID NO: 97375 - protein, 11 aa, Dengue virus
DDCVVKPLDER

SEQ ID NO: 97376 - protein, 11 aa, Dengue virus
DCVVKPLDERF

SEQ ID NO: 97377 - protein, 11 aa, Dengue virus
CVVKPLDERFG

SEQ ID NO: 97378 - protein, 11 aa, Dengue virus
VVKPLDERFGT

SEQ ID NO: 97379 - protein, 11 aa, Dengue virus
VKPLDERFGTS

SEQ ID NO: 97380 - protein, 11 aa, Dengue virus
KPLDERFGTSL

SEQ ID NO: 97381 - protein, 11 aa, Dengue virus
PLDERFGTSLL

SEQ ID NO: 97382 - protein, 11 aa, Dengue virus
LDERFGTSLLF

SEQ ID NO: 97383 - protein, 11 aa, Dengue virus
DERFGTSLLFL

SEQ ID NO: 97384 - protein, 11 aa, Dengue virus
ERFGTSLLFLN

SEQ ID NO: 97385 - protein, 11 aa, Dengue virus
RFGTSLLFLND

SEQ ID NO: 97386 - protein, 11 aa, Dengue virus
FGTSLLFLNDM

SEQ ID NO: 97387 - protein, 11 aa, Dengue virus
GTSLLFLNDMG

SEQ ID NO: 97388 - protein, 11 aa, Dengue virus
TSLLFLNDMGK

SEQ ID NO: 97389 - protein, 11 aa, Dengue virus
SLLFLNDMGKV

SEQ ID NO: 97390 - protein, 11 aa, Dengue virus
LLFLNDMGKVR

SEQ ID NO: 97391 - protein, 11 aa, Dengue virus
LFLNDMGKVRK

SEQ ID NO: 97392 - protein, 11 aa, Dengue virus
FLNDMGKVRKD

SEQ ID NO: 97393 - protein, 11 aa, Dengue virus
LNDMGKVRKDI

SEQ ID NO: 97394 - protein, 11 aa, Dengue virus
NDMGKVRKDIP

SEQ ID NO: 97395 - protein, 11 aa, Dengue virus
DMGKVRKDIPQ

SEQ ID NO: 97396 - protein, 11 aa, Dengue virus
MGKVRKDIPQW

SEQ ID NO: 97397 - protein, 11 aa, Dengue virus
GKVRKDIPQWE

SEQ ID NO: 97398 - protein, 11 aa, Dengue virus
KVRKDIPQWEP

SEQ ID NO: 97399 - protein, 11 aa, Dengue virus
VRKDIPQWEPS

SEQ ID NO: 97400 - protein, 11 aa, Dengue virus
RKDIPQWEPSK

SEQ ID NO: 97401 - protein, 11 aa, Dengue virus
KDIPQWEPSKG

SEQ ID NO: 97402 - protein, 11 aa, Dengue virus
DIPQWEPSKGW

SEQ ID NO: 97403 - protein, 11 aa, Dengue virus
IPQWEPSKGWK

SEQ ID NO: 97404 - protein, 11 aa, Dengue virus
PQWEPSKGWKN

SEQ ID NO: 97405 - protein, 11 aa, Dengue virus
QWEPSKGWKNW

SEQ ID NO: 97406 - protein, 11 aa, Dengue virus
WEPSKGWKNWQ

SEQ ID NO: 97407 - protein, 11 aa, Dengue virus
EPSKGWKNWQE

SEQ ID NO: 97408 - protein, 11 aa, Dengue virus
PSKGWKNWQEV

SEQ ID NO: 97409 - protein, 11 aa, Dengue virus
SKGWKNWQEVP

SEQ ID NO: 97410 - protein, 11 aa, Dengue virus
KGWKNWQEVPF

SEQ ID NO: 97411 - protein, 11 aa, Dengue virus
GWKNWQEVPFC

SEQ ID NO: 97412 - protein, 11 aa, Dengue virus
WKNWQEVPFCS

SEQ ID NO: 97413 - protein, 11 aa, Dengue virus
KNWQEVPFCSH

SEQ ID NO: 97414 - protein, 11 aa, Dengue virus
NWQEVPFCSHH

SEQ ID NO: 97415 - protein, 11 aa, Dengue virus
WQEVPFCSHHF

SEQ ID NO: 97416 - protein, 11 aa, Dengue virus
QEVPFCSHHFH

SEQ ID NO: 97417 - protein, 11 aa, Dengue virus
EVPFCSHHFHK

SEQ ID NO: 97418 - protein, 11 aa, Dengue virus
VPFCSHHFHKI

SEQ ID NO: 97419 - protein, 11 aa, Dengue virus
PFCSHHFHKIF

SEQ ID NO: 97420 - protein, 11 aa, Dengue virus
FCSHHFHKIFM

SEQ ID NO: 97421 - protein, 11 aa, Dengue virus
CSHHFHKIFMK

SEQ ID NO: 97422 - protein, 11 aa, Dengue virus
SHHFHKIFMKD

SEQ ID NO: 97423 - protein, 11 aa, Dengue virus
HHFHKIFMKDG

SEQ ID NO: 97424 - protein, 11 aa, Dengue virus
HFHKIFMKDGR

SEQ ID NO: 97425 - protein, 11 aa, Dengue virus
FHKIFMKDGRS

SEQ ID NO: 97426 - protein, 11 aa, Dengue virus
HKIFMKDGRSL

SEQ ID NO: 97427 - protein, 11 aa, Dengue virus
KIFMKDGRSLV

SEQ ID NO: 97428 - protein, 11 aa, Dengue virus
IFMKDGRSLVV

SEQ ID NO: 97429 - protein, 11 aa, Dengue virus
FMKDGRSLVVP

SEQ ID NO: 97430 - protein, 11 aa, Dengue virus
MKDGRSLVVPC

SEQ ID NO: 97431 - protein, 11 aa, Dengue virus
KDGRSLVVPCR

SEQ ID NO: 97432 - protein, 11 aa, Dengue virus
DGRSLVVPCRN

SEQ ID NO: 97433 - protein, 11 aa, Dengue virus
GRSLVVPCRNQ

SEQ ID NO: 97434 - protein, 11 aa, Dengue virus
RSLVVPCRNQD

SEQ ID NO: 97435 - protein, 11 aa, Dengue virus
SLVVPCRNQDE

SEQ ID NO: 97436 - protein, 11 aa, Dengue virus
LVVPCRNQDEL

SEQ ID NO: 97437 - protein, 11 aa, Dengue virus
VVPCRNQDELI

SEQ ID NO: 97438 - protein, 11 aa, Dengue virus
VPCRNQDELIG

SEQ ID NO: 97439 - protein, 11 aa, Dengue virus
PCRNQDELIGR

SEQ ID NO: 97440 - protein, 11 aa, Dengue virus
CRNQDELIGRA

SEQ ID NO: 97441 - protein, 11 aa, Dengue virus
RNQDELIGRAR

SEQ ID NO: 97442 - protein, 11 aa, Dengue virus
NQDELIGRARI

SEQ ID NO: 97443 - protein, 11 aa, Dengue virus
QDELIGRARIS

SEQ ID NO: 97444 - protein, 11 aa, Dengue virus
DELIGRARISQ

SEQ ID NO: 97445 - protein, 11 aa, Dengue virus
ELIGRARISQG

SEQ ID NO: 97446 - protein, 11 aa, Dengue virus
LIGRARISQGA

SEQ ID NO: 97447 - protein, 11 aa, Dengue virus
IGRARISQGAG

SEQ ID NO: 97448 - protein, 11 aa, Dengue virus
GRARISQGAGW

SEQ ID NO: 97449 - protein, 11 aa, Dengue virus
RARISQGAGWS

SEQ ID NO: 97450 - protein, 11 aa, Dengue virus
ARISQGAGWSL

SEQ ID NO: 97451 - protein, 11 aa, Dengue virus
RISQGAGWSLR

SEQ ID NO: 97452 - protein, 11 aa, Dengue virus
ISQGAGWSLRE

SEQ ID NO: 97453 - protein, 11 aa, Dengue virus
SQGAGWSLRET

SEQ ID NO: 97454 - protein, 11 aa, Dengue virus
QGAGWSLRETA

SEQ ID NO: 97455 - protein, 11 aa, Dengue virus
GAGWSLRETAC

SEQ ID NO: 97456 - protein, 11 aa, Dengue virus
AGWSLRETACL

SEQ ID NO: 97457 - protein, 11 aa, Dengue virus
GWSLRETACLG

SEQ ID NO: 97458 - protein, 11 aa, Dengue virus
WSLRETACLGK

SEQ ID NO: 97459 - protein, 11 aa, Dengue virus
SLRETACLGKA

SEQ ID NO: 97460 - protein, 11 aa, Dengue virus
LRETACLGKAY

SEQ ID NO: 97461 - protein, 11 aa, Dengue virus
RETACLGKAYA

SEQ ID NO: 97462 - protein, 11 aa, Dengue virus
ETACLGKAYAQ

SEQ ID NO: 97463 - protein, 11 aa, Dengue virus
TACLGKAYAQM

SEQ ID NO: 97464 - protein, 11 aa, Dengue virus
ACLGKAYAQMW

SEQ ID NO: 97465 - protein, 11 aa, Dengue virus
CLGKAYAQMWS

SEQ ID NO: 97466 - protein, 11 aa, Dengue virus
LGKAYAQMWSL

SEQ ID NO: 97467 - protein, 11 aa, Dengue virus
GKAYAQMWSLM

SEQ ID NO: 97468 - protein, 11 aa, Dengue virus
KAYAQMWSLMY

SEQ ID NO: 97469 - protein, 11 aa, Dengue virus
AYAQMWSLMYF

SEQ ID NO: 97470 - protein, 11 aa, Dengue virus
YAQMWSLMYFH

SEQ ID NO: 97471 - protein, 11 aa, Dengue virus
AQMWSLMYFHR

SEQ ID NO: 97472 - protein, 11 aa, Dengue virus
QMWSLMYFHRR

SEQ ID NO: 97473 - protein, 11 aa, Dengue virus
MWSLMYFHRRD

SEQ ID NO: 97474 - protein, 11 aa, Dengue virus
WSLMYFHRRDL

SEQ ID NO: 97475 - protein, 11 aa, Dengue virus
SLMYFHRRDLR

SEQ ID NO: 97476 - protein, 11 aa, Dengue virus
LMYFHRRDLRL

SEQ ID NO: 97477 - protein, 11 aa, Dengue virus
MYFHRRDLRLA

SEQ ID NO: 97478 - protein, 11 aa, Dengue virus
YFHRRDLRLAS

SEQ ID NO: 97479 - protein, 11 aa, Dengue virus
FHRRDLRLASM

SEQ ID NO: 97480 - protein, 11 aa, Dengue virus
HRRDLRLASMA

SEQ ID NO: 97481 - protein, 11 aa, Dengue virus
RRDLRLASMAI

SEQ ID NO: 97482 - protein, 11 aa, Dengue virus
RDLRLASMAIC

SEQ ID NO: 97483 - protein, 11 aa, Dengue virus
DLRLASMAICS

SEQ ID NO: 97484 - protein, 11 aa, Dengue virus
LRLASMAICSA

SEQ ID NO: 97485 - protein, 11 aa, Dengue virus
RLASMAICSAV

SEQ ID NO: 97486 - protein, 11 aa, Dengue virus
LASMAICSAVP

SEQ ID NO: 97487 - protein, 11 aa, Dengue virus
ASMAICSAVPT

SEQ ID NO: 97488 - protein, 11 aa, Dengue virus
SMAICSAVPTE

SEQ ID NO: 97489 - protein, 11 aa, Dengue virus
MAICSAVPTEW

SEQ ID NO: 97490 - protein, 11 aa, Dengue virus
AICSAVPTEWF

SEQ ID NO: 97491 - protein, 11 aa, Dengue virus
ICSAVPTEWFP

SEQ ID NO: 97492 - protein, 11 aa, Dengue virus
CSAVPTEWFPT

SEQ ID NO: 97493 - protein, 11 aa, Dengue virus
SAVPTEWFPTS

SEQ ID NO: 97494 - protein, 11 aa, Dengue virus
AVPTEWFPTSR

SEQ ID NO: 97495 - protein, 11 aa, Dengue virus
VPTEWFPTSRT

SEQ ID NO: 97496 - protein, 11 aa, Dengue virus
PTEWFPTSRTT

SEQ ID NO: 97497 - protein, 11 aa, Dengue virus
TEWFPTSRTTW

SEQ ID NO: 97498 - protein, 11 aa, Dengue virus
EWFPTSRTTWS

SEQ ID NO: 97499 - protein, 11 aa, Dengue virus
WFPTSRTTWSI

SEQ ID NO: 97500 - protein, 11 aa, Dengue virus
FPTSRTTWSIH

SEQ ID NO: 97501 - protein, 11 aa, Dengue virus
PTSRTTWSIHA

SEQ ID NO: 97502 - protein, 11 aa, Dengue virus
TSRTTWSIHAH

SEQ ID NO: 97503 - protein, 11 aa, Dengue virus
SRTTWSIHAHH

SEQ ID NO: 97504 - protein, 11 aa, Dengue virus
RTTWSIHAHHQ

SEQ ID NO: 97505 - protein, 11 aa, Dengue virus
TTWSIHAHHQW

SEQ ID NO: 97506 - protein, 11 aa, Dengue virus
TWSIHAHHQWM

SEQ ID NO: 97507 - protein, 11 aa, Dengue virus
WSIHAHHQWMT

SEQ ID NO: 97508 - protein, 11 aa, Dengue virus
SIHAHHQWMTT

SEQ ID NO: 97509 - protein, 11 aa, Dengue virus
IHAHHQWMTTE

SEQ ID NO: 97510 - protein, 11 aa, Dengue virus
HAHHQWMTTED

SEQ ID NO: 97511 - protein, 11 aa, Dengue virus
AHHQWMTTEDM

SEQ ID NO: 97512 - protein, 11 aa, Dengue virus
HHQWMTTEDML

SEQ ID NO: 97513 - protein, 11 aa, Dengue virus
HQWMTTEDMLK

SEQ ID NO: 97514 - protein, 11 aa, Dengue virus
QWMTTEDMLKV

SEQ ID NO: 97515 - protein, 11 aa, Dengue virus
WMTTEDMLKVW

SEQ ID NO: 97516 - protein, 11 aa, Dengue virus
MTTEDMLKVWN

SEQ ID NO: 97517 - protein, 11 aa, Dengue virus
TTEDMLKVWNR

SEQ ID NO: 97518 - protein, 11 aa, Dengue virus
TEDMLKVWNRV

SEQ ID NO: 97519 - protein, 11 aa, Dengue virus
EDMLKVWNRVW

SEQ ID NO: 97520 - protein, 11 aa, Dengue virus
DMLKVWNRVWI

SEQ ID NO: 97521 - protein, 11 aa, Dengue virus
MLKVWNRVWIE

SEQ ID NO: 97522 - protein, 11 aa, Dengue virus
LKVWNRVWIED

SEQ ID NO: 97523 - protein, 11 aa, Dengue virus
KVWNRVWIEDN

SEQ ID NO: 97524 - protein, 11 aa, Dengue virus
VWNRVWIEDNP

SEQ ID NO: 97525 - protein, 11 aa, Dengue virus
WNRVWIEDNPN

SEQ ID NO: 97526 - protein, 11 aa, Dengue virus
NRVWIEDNPNM

SEQ ID NO: 97527 - protein, 11 aa, Dengue virus
RVWIEDNPNMI

SEQ ID NO: 97528 - protein, 11 aa, Dengue virus
VWIEDNPNMID

SEQ ID NO: 97529 - protein, 11 aa, Dengue virus
WIEDNPNMIDK

SEQ ID NO: 97530 - protein, 11 aa, Dengue virus
IEDNPNMIDKT

SEQ ID NO: 97531 - protein, 11 aa, Dengue virus
EDNPNMIDKTP

SEQ ID NO: 97532 - protein, 11 aa, Dengue virus
DNPNMIDKTPV

SEQ ID NO: 97533 - protein, 11 aa, Dengue virus
NPNMIDKTPVH

SEQ ID NO: 97534 - protein, 11 aa, Dengue virus
PNMIDKTPVHS

SEQ ID NO: 97535 - protein, 11 aa, Dengue virus
NMIDKTPVHSW

SEQ ID NO: 97536 - protein, 11 aa, Dengue virus
MIDKTPVHSWE

SEQ ID NO: 97537 - protein, 11 aa, Dengue virus
IDKTPVHSWED

SEQ ID NO: 97538 - protein, 11 aa, Dengue virus
DKTPVHSWEDI

SEQ ID NO: 97539 - protein, 11 aa, Dengue virus
KTPVHSWEDIP

SEQ ID NO: 97540 - protein, 11 aa, Dengue virus
TPVHSWEDIPY

SEQ ID NO: 97541 - protein, 11 aa, Dengue virus
PVHSWEDIPYL

SEQ ID NO: 97542 - protein, 11 aa, Dengue virus
VHSWEDIPYLG

SEQ ID NO: 97543 - protein, 11 aa, Dengue virus
HSWEDIPYLGK

SEQ ID NO: 97544 - protein, 11 aa, Dengue virus
SWEDIPYLGKR

SEQ ID NO: 97545 - protein, 11 aa, Dengue virus
WEDIPYLGKRE

SEQ ID NO: 97546 - protein, 11 aa, Dengue virus
EDIPYLGKRED

SEQ ID NO: 97547 - protein, 11 aa, Dengue virus
DIPYLGKREDL

SEQ ID NO: 97548 - protein, 11 aa, Dengue virus
IPYLGKREDLW

SEQ ID NO: 97549 - protein, 11 aa, Dengue virus
PYLGKREDLWC

SEQ ID NO: 97550 - protein, 11 aa, Dengue virus
YLGKREDLWCG

SEQ ID NO: 97551 - protein, 11 aa, Dengue virus
LGKREDLWCGS

SEQ ID NO: 97552 - protein, 11 aa, Dengue virus
GKREDLWCGSL

SEQ ID NO: 97553 - protein, 11 aa, Dengue virus
KREDLWCGSLI

SEQ ID NO: 97554 - protein, 11 aa, Dengue virus
REDLWCGSLIG

SEQ ID NO: 97555 - protein, 11 aa, Dengue virus
EDLWCGSLIGL

SEQ ID NO: 97556 - protein, 11 aa, Dengue virus
DLWCGSLIGLS

SEQ ID NO: 97557 - protein, 11 aa, Dengue virus
LWCGSLIGLSS

SEQ ID NO: 97558 - protein, 11 aa, Dengue virus
WCGSLIGLSSR

SEQ ID NO: 97559 - protein, 11 aa, Dengue virus
CGSLIGLSSRA

SEQ ID NO: 97560 - protein, 11 aa, Dengue virus
GSLIGLSSRAT

SEQ ID NO: 97561 - protein, 11 aa, Dengue virus
SLIGLSSRATW

SEQ ID NO: 97562 - protein, 11 aa, Dengue virus
LIGLSSRATWA

SEQ ID NO: 97563 - protein, 11 aa, Dengue virus
IGLSSRATWAK

SEQ ID NO: 97564 - protein, 11 aa, Dengue virus
GLSSRATWAKN

SEQ ID NO: 97565 - protein, 11 aa, Dengue virus
LSSRATWAKNI

SEQ ID NO: 97566 - protein, 11 aa, Dengue virus
SSRATWAKNIH

SEQ ID NO: 97567 - protein, 11 aa, Dengue virus
SRATWAKNIHT

SEQ ID NO: 97568 - protein, 11 aa, Dengue virus
RATWAKNIHTA

SEQ ID NO: 97569 - protein, 11 aa, Dengue virus
ATWAKNIHTAI

SEQ ID NO: 97570 - protein, 11 aa, Dengue virus
TWAKNIHTAIT

SEQ ID NO: 97571 - protein, 11 aa, Dengue virus
WAKNIHTAITQ

SEQ ID NO: 97572 - protein, 11 aa, Dengue virus
AKNIHTAITQV

SEQ ID NO: 97573 - protein, 11 aa, Dengue virus
KNIHTAITQVR

SEQ ID NO: 97574 - protein, 11 aa, Dengue virus
NIHTAITQVRN

SEQ ID NO: 97575 - protein, 11 aa, Dengue virus
IHTAITQVRNL

SEQ ID NO: 97576 - protein, 11 aa, Dengue virus
HTAITQVRNLI

SEQ ID NO: 97577 - protein, 11 aa, Dengue virus
TAITQVRNLIG

SEQ ID NO: 97578 - protein, 11 aa, Dengue virus
AITQVRNLIGK

SEQ ID NO: 97579 - protein, 11 aa, Dengue virus
ITQVRNLIGKE

SEQ ID NO: 97580 - protein, 11 aa, Dengue virus
TQVRNLIGKEE

SEQ ID NO: 97581 - protein, 11 aa, Dengue virus
QVRNLIGKEEY

SEQ ID NO: 97582 - protein, 11 aa, Dengue virus
VRNLIGKEEYV

SEQ ID NO: 97583 - protein, 11 aa, Dengue virus
RNLIGKEEYVD

SEQ ID NO: 97584 - protein, 11 aa, Dengue virus
NLIGKEEYVDY

SEQ ID NO: 97585 - protein, 11 aa, Dengue virus
LIGKEEYVDYM

SEQ ID NO: 97586 - protein, 11 aa, Dengue virus
IGKEEYVDYMP

SEQ ID NO: 97587 - protein, 11 aa, Dengue virus
GKEEYVDYMPV

SEQ ID NO: 97588 - protein, 11 aa, Dengue virus
KEEYVDYMPVM

SEQ ID NO: 97589 - protein, 11 aa, Dengue virus
EEYVDYMPVMK

SEQ ID NO: 97590 - protein, 11 aa, Dengue virus
EYVDYMPVMKR

SEQ ID NO: 97591 - protein, 11 aa, Dengue virus
YVDYMPVMKRY

SEQ ID NO: 97592 - protein, 11 aa, Dengue virus
VDYMPVMKRYS

SEQ ID NO: 97593 - protein, 11 aa, Dengue virus
DYMPVMKRYSA

SEQ ID NO: 97594 - protein, 11 aa, Dengue virus
YMPVMKRYSAP

SEQ ID NO: 97595 - protein, 11 aa, Dengue virus
RYSAPSESEGV

SEQ ID NO: 97596 - protein, 11 aa, Dengue virus
YSAPSESEGVL

SEQ ID NO: 97597 - protein, 11 aa, Dengue virus
MNQRKKVARPP

SEQ ID NO: 97598 - protein, 11 aa, Dengue virus
NQRKKVARPPF

SEQ ID NO: 97599 - protein, 11 aa, Dengue virus
QRKKVARPPFN

SEQ ID NO: 97600 - protein, 11 aa, Dengue virus
RKKVARPPFNM

SEQ ID NO: 97601 - protein, 11 aa, Dengue virus
KKVARPPFNML

SEQ ID NO: 97602 - protein, 11 aa, Dengue virus
KVARPPFNMLK

SEQ ID NO: 97603 - protein, 11 aa, Dengue virus
VARPPFNMLKR

SEQ ID NO: 97604 - protein, 11 aa, Dengue virus
ARPPFNMLKRE

SEQ ID NO: 97605 - protein, 11 aa, Dengue virus
NTPFNMLKRER

SEQ ID NO: 97606 - protein, 11 aa, Dengue virus
TPFNMLKRERN

SEQ ID NO: 97607 - protein, 11 aa, Dengue virus
LKRERNRVSTV

SEQ ID NO: 97608 - protein, 11 aa, Dengue virus
KRERNRVSTVQ

SEQ ID NO: 97609 - protein, 11 aa, Dengue virus
RERNRVSTVQQ

SEQ ID NO: 97610 - protein, 11 aa, Dengue virus
ERNRVSTVQQL

SEQ ID NO: 97611 - protein, 11 aa, Dengue virus
RNRVSTVQQLT

SEQ ID NO: 97612 - protein, 11 aa, Dengue virus
NRVSTVQQLTK

SEQ ID NO: 97613 - protein, 11 aa, Dengue virus
RVSTVQQLTKR

SEQ ID NO: 97614 - protein, 11 aa, Dengue virus
VSTVQQLTKRF

SEQ ID NO: 97615 - protein, 11 aa, Dengue virus
STVQQLTKRFS

SEQ ID NO: 97616 - protein, 11 aa, Dengue virus
TPQGLVKRFSS

SEQ ID NO: 97617 - protein, 11 aa, Dengue virus
PQGLVKRFSSG

SEQ ID NO: 97618 - protein, 11 aa, Dengue virus
QGLVKRFSSGL

SEQ ID NO: 97619 - protein, 11 aa, Dengue virus
GLVKRFSSGLF

SEQ ID NO: 97620 - protein, 11 aa, Dengue virus
LVKRFSSGLFS

SEQ ID NO: 97621 - protein, 11 aa, Dengue virus
VKRFSSGLFSG

SEQ ID NO: 97622 - protein, 11 aa, Dengue virus
KRFSSGLFSGK

SEQ ID NO: 97623 - protein, 11 aa, Dengue virus
RFSSGLFSGKG

SEQ ID NO: 97624 - protein, 11 aa, Dengue virus
FSSGLFSGKGP

SEQ ID NO: 97625 - protein, 11 aa, Dengue virus
SSGLFSGKGPL

SEQ ID NO: 97626 - protein, 11 aa, Dengue virus
SGLFSGKGPLR

SEQ ID NO: 97627 - protein, 11 aa, Dengue virus
GMLQGRGPLKL

SEQ ID NO: 97628 - protein, 11 aa, Dengue virus
MLQGRGPLKLF

SEQ ID NO: 97629 - protein, 11 aa, Dengue virus
LQGRGPLKLFM

SEQ ID NO: 97630 - protein, 11 aa, Dengue virus
QGRGPLKLFMA

SEQ ID NO: 97631 - protein, 11 aa, Dengue virus
GRGPLKLFMAL

SEQ ID NO: 97632 - protein, 11 aa, Dengue virus
RGPLKLFMALV

SEQ ID NO: 97633 - protein, 11 aa, Dengue virus
GPLKLFMALVA

SEQ ID NO: 97634 - protein, 11 aa, Dengue virus
PLKLFMALVAF

SEQ ID NO: 97635 - protein, 11 aa, Dengue virus
LKLFMALVAFL

SEQ ID NO: 97636 - protein, 11 aa, Dengue virus
KLFMALVAFLR

SEQ ID NO: 97637 - protein, 11 aa, Dengue virus
LFMALVAFLRF

SEQ ID NO: 97638 - protein, 11 aa, Dengue virus
FMALVAFLRFL

SEQ ID NO: 97639 - protein, 11 aa, Dengue virus
MALVAFLRFLT

SEQ ID NO: 97640 - protein, 11 aa, Dengue virus
ALVAFLRFLTI

SEQ ID NO: 97641 - protein, 11 aa, Dengue virus
LVAFLRFLTIP

SEQ ID NO: 97642 - protein, 11 aa, Dengue virus
VAFLRFLTIPP

SEQ ID NO: 97643 - protein, 11 aa, Dengue virus
AFLRFLTIPPT

SEQ ID NO: 97644 - protein, 11 aa, Dengue virus
FLRFLTIPPTA

SEQ ID NO: 97645 - protein, 11 aa, Dengue virus
LRFLTIPPTAG

SEQ ID NO: 97646 - protein, 11 aa, Dengue virus
RFLTIPPTAGI

SEQ ID NO: 97647 - protein, 11 aa, Dengue virus
FLTIPPTAGIL

SEQ ID NO: 97648 - protein, 11 aa, Dengue virus
LTIPPTAGILK

SEQ ID NO: 97649 - protein, 11 aa, Dengue virus
TIPPTAGILKR

SEQ ID NO: 97650 - protein, 11 aa, Dengue virus
PTAGILKRWGT

SEQ ID NO: 97651 - protein, 11 aa, Dengue virus
TAGILKRWGTI

SEQ ID NO: 97652 - protein, 11 aa, Dengue virus
AGILKRWGTIK

SEQ ID NO: 97653 - protein, 11 aa, Dengue virus
GILKRWGTIKK

SEQ ID NO: 97654 - protein, 11 aa, Dengue virus
ILKRWGQLKKT

SEQ ID NO: 97655 - protein, 11 aa, Dengue virus
LKRWGTIKKSK

SEQ ID NO: 97656 - protein, 11 aa, Dengue virus
KRWGTIKKSKA

SEQ ID NO: 97657 - protein, 11 aa, Dengue virus
RWGQLKKTKAI

SEQ ID NO: 97658 - protein, 11 aa, Dengue virus
WGQLKKNKAIR

SEQ ID NO: 97659 - protein, 11 aa, Dengue virus
GQLKKNKAIRI

SEQ ID NO: 97660 - protein, 11 aa, Dengue virus
QLKKNKAIRIL

SEQ ID NO: 97661 - protein, 11 aa, Dengue virus
LKKNKAIKILT

SEQ ID NO: 97662 - protein, 11 aa, Dengue virus
KKNKAIKILTG

SEQ ID NO: 97663 - protein, 11 aa, Dengue virus
KNKAIKILTGF

SEQ ID NO: 97664 - protein, 11 aa, Dengue virus
NKAIKILTGFR

SEQ ID NO: 97665 - protein, 11 aa, Dengue virus
KAIKILTGFRK

SEQ ID NO: 97666 - protein, 11 aa, Dengue virus
AIKILTGFRKE

SEQ ID NO: 97667 - protein, 11 aa, Dengue virus
IKILTGFRKEI

SEQ ID NO: 97668 - protein, 11 aa, Dengue virus
KILTGFRKEIG

SEQ ID NO: 97669 - protein, 11 aa, Dengue virus
ILTGFRKEIGR

SEQ ID NO: 97670 - protein, 11 aa, Dengue virus
LTGFRKEIGRM

SEQ ID NO: 97671 - protein, 11 aa, Dengue virus
TGFRKEIGRML

SEQ ID NO: 97672 - protein, 11 aa, Dengue virus
EIGRMLNILNR

SEQ ID NO: 97673 - protein, 11 aa, Dengue virus
IGRMLNILNRR

SEQ ID NO: 97674 - protein, 11 aa, Dengue virus
GRMLNILNRRR

SEQ ID NO: 97675 - protein, 11 aa, Dengue virus
RMLNILNRRRR

SEQ ID NO: 97676 - protein, 11 aa, Dengue virus
MLNILNRRRRS

SEQ ID NO: 97677 - protein, 11 aa, Dengue virus
LNILNRRRRST

SEQ ID NO: 97678 - protein, 11 aa, Dengue virus
RKRSTMTLLCL

SEQ ID NO: 97679 - protein, 11 aa, Dengue virus
KRSTMTLLCLI

SEQ ID NO: 97680 - protein, 11 aa, Dengue virus
RSTMTLLCLIP

SEQ ID NO: 97681 - protein, 11 aa, Dengue virus
STMTLLCLIPT

SEQ ID NO: 97682 - protein, 11 aa, Dengue virus
TLLCLIPTAMA

SEQ ID NO: 97683 - protein, 11 aa, Dengue virus
LLCLIPTAMAF

SEQ ID NO: 97684 - protein, 11 aa, Dengue virus
LCLIPTAMAFH

SEQ ID NO: 97685 - protein, 11 aa, Dengue virus
CLIPTAMAFHL

SEQ ID NO: 97686 - protein, 11 aa, Dengue virus
LIPTAMAFHLS

SEQ ID NO: 97687 - protein, 11 aa, Dengue virus
IPTAMAFHLST

SEQ ID NO: 97688 - protein, 11 aa, Dengue virus
PTAMAFHLSTR

SEQ ID NO: 97689 - protein, 11 aa, Dengue virus
TAMAFHLSTRD

SEQ ID NO: 97690 - protein, 11 aa, Dengue virus
AMAFHLSTRDG

SEQ ID NO: 97691 - protein, 11 aa, Dengue virus
MAFSLSTRDGE

SEQ ID NO: 97692 - protein, 11 aa, Dengue virus
AFSLSTRDGEP

SEQ ID NO: 97693 - protein, 11 aa, Dengue virus
FSLSTRDGEPL

SEQ ID NO: 97694 - protein, 11 aa, Dengue virus
SLSTRDGEPLM

SEQ ID NO: 97695 - protein, 11 aa, Dengue virus
LTTRNGEPHMI

SEQ ID NO: 97696 - protein, 11 aa, Dengue virus
TTRNGEPHMIV

SEQ ID NO: 97697 - protein, 11 aa, Dengue virus
TRNGEPHMIVS

SEQ ID NO: 97698 - protein, 11 aa, Dengue virus
RNGEPHMIVSR

SEQ ID NO: 97699 - protein, 11 aa, Dengue virus
NGEPHMIVSRQ

SEQ ID NO: 97700 - protein, 11 aa, Dengue virus
GEPHMIVSRQE

SEQ ID NO: 97701 - protein, 11 aa, Dengue virus
EPHMIVSRQEK

SEQ ID NO: 97702 - protein, 11 aa, Dengue virus
PHMIVSRQEKG

SEQ ID NO: 97703 - protein, 11 aa, Dengue virus
HMIVSRQEKGK

SEQ ID NO: 97704 - protein, 11 aa, Dengue virus
MIVSRQEKGKS

SEQ ID NO: 97705 - protein, 11 aa, Dengue virus
IVSRQEKGKSL

SEQ ID NO: 97706 - protein, 11 aa, Dengue virus
VSRQEKGKSLL

SEQ ID NO: 97707 - protein, 11 aa, Dengue virus
SRQEKGKSLLF

SEQ ID NO: 97708 - protein, 11 aa, Dengue virus
RQEKGKSLLFK

SEQ ID NO: 97709 - protein, 11 aa, Dengue virus
QEKGKSLLFKT

SEQ ID NO: 97710 - protein, 11 aa, Dengue virus
EKGKSLLFKTE

SEQ ID NO: 97711 - protein, 11 aa, Dengue virus
KGKSLLFKTED

SEQ ID NO: 97712 - protein, 11 aa, Dengue virus
GKSLLFKTEDG

SEQ ID NO: 97713 - protein, 11 aa, Dengue virus
KSLLFKTEDGV

SEQ ID NO: 97714 - protein, 11 aa, Dengue virus
SLLFKTEDGVN

SEQ ID NO: 97715 - protein, 11 aa, Dengue virus
LLFKTEDGVNM

SEQ ID NO: 97716 - protein, 11 aa, Dengue virus
LFKTEDGVNMC

SEQ ID NO: 97717 - protein, 11 aa, Dengue virus
FKTEDGVNMCT

SEQ ID NO: 97718 - protein, 11 aa, Dengue virus
KTEDGVNMCTL

SEQ ID NO: 97719 - protein, 11 aa, Dengue virus
TEDGVNMCTLM

SEQ ID NO: 97720 - protein, 11 aa, Dengue virus
EDGVNMCTLMA

SEQ ID NO: 97721 - protein, 11 aa, Dengue virus
DGVNMCTLMAM

SEQ ID NO: 97722 - protein, 11 aa, Dengue virus
GVNMCTLMAMD

SEQ ID NO: 97723 - protein, 11 aa, Dengue virus
VNMCTLMAMDL

SEQ ID NO: 97724 - protein, 11 aa, Dengue virus
NMCTLMAMDLG

SEQ ID NO: 97725 - protein, 11 aa, Dengue virus
MCTLMAMDLGE

SEQ ID NO: 97726 - protein, 11 aa, Dengue virus
CTLMAMDLGEL

SEQ ID NO: 97727 - protein, 11 aa, Dengue virus
TLMAMDLGELC

SEQ ID NO: 97728 - protein, 11 aa, Dengue virus
LMAMDLGELCE

SEQ ID NO: 97729 - protein, 11 aa, Dengue virus
MAMDLGELCED

SEQ ID NO: 97730 - protein, 11 aa, Dengue virus
AMDLGELCEDT

SEQ ID NO: 97731 - protein, 11 aa, Dengue virus
MDLGELCEDTI

SEQ ID NO: 97732 - protein, 11 aa, Dengue virus
DLGELCEDTIT

SEQ ID NO: 97733 - protein, 11 aa, Dengue virus
LGELCEDTITY

SEQ ID NO: 97734 - protein, 11 aa, Dengue virus
GELCEDTITYK

SEQ ID NO: 97735 - protein, 11 aa, Dengue virus
EMCEDTVTYEC

SEQ ID NO: 97736 - protein, 11 aa, Dengue virus
LCEDTITYKCP

SEQ ID NO: 97737 - protein, 11 aa, Dengue virus
CEDTITYKCPL

SEQ ID NO: 97738 - protein, 11 aa, Dengue virus
EDTITYKCPLL

SEQ ID NO: 97739 - protein, 11 aa, Dengue virus
DTVTYKCPLLI

SEQ ID NO: 97740 - protein, 11 aa, Dengue virus
TVTYKCPLLIN

SEQ ID NO: 97741 - protein, 11 aa, Dengue virus
VTYKCPLLINT

SEQ ID NO: 97742 - protein, 11 aa, Dengue virus
TYKCPLLINTE

SEQ ID NO: 97743 - protein, 11 aa, Dengue virus
YKCPLLINTEP

SEQ ID NO: 97744 - protein, 11 aa, Dengue virus
KCPLLINTEPE

SEQ ID NO: 97745 - protein, 11 aa, Dengue virus
CPLLINTEPED

SEQ ID NO: 97746 - protein, 11 aa, Dengue virus
PLLINTEPEDI

SEQ ID NO: 97747 - protein, 11 aa, Dengue virus
LLINTEPEDID

SEQ ID NO: 97748 - protein, 11 aa, Dengue virus
LINTEPEDIDC

SEQ ID NO: 97749 - protein, 11 aa, Dengue virus
INTEPEDIDCW

SEQ ID NO: 97750 - protein, 11 aa, Dengue virus
QNEPEDIDCWC

SEQ ID NO: 97751 - protein, 11 aa, Dengue virus
NEPEDIDCWCN

SEQ ID NO: 97752 - protein, 11 aa, Dengue virus
EPEDIDCWCNS

SEQ ID NO: 97753 - protein, 11 aa, Dengue virus
PEDIDCWCNST

SEQ ID NO: 97754 - protein, 11 aa, Dengue virus
EDIDCWCNSTS

SEQ ID NO: 97755 - protein, 11 aa, Dengue virus
DIDCWCNLTSA

SEQ ID NO: 97756 - protein, 11 aa, Dengue virus
IDCWCNLTSAW

SEQ ID NO: 97757 - protein, 11 aa, Dengue virus
DCWCNLTSAWV

SEQ ID NO: 97758 - protein, 11 aa, Dengue virus
CWCNLTSAWVM

SEQ ID NO: 97759 - protein, 11 aa, Dengue virus
WCNLTSAWVMY

SEQ ID NO: 97760 - protein, 11 aa, Dengue virus
CNLTSAWVMYG

SEQ ID NO: 97761 - protein, 11 aa, Dengue virus
NLTSAWVMYGT

SEQ ID NO: 97762 - protein, 11 aa, Dengue virus
LTSAWVMYGTC

SEQ ID NO: 97763 - protein, 11 aa, Dengue virus
TSAWVMYGTCT

SEQ ID NO: 97764 - protein, 11 aa, Dengue virus
SAWVMYGTCTQ

SEQ ID NO: 97765 - protein, 11 aa, Dengue virus
AWVMYGTCTQS

SEQ ID NO: 97766 - protein, 11 aa, Dengue virus
WVMYGTCTQNG

SEQ ID NO: 97767 - protein, 11 aa, Dengue virus
VMYGTCTQNGE

SEQ ID NO: 97768 - protein, 11 aa, Dengue virus
MYGTCTQNGER

SEQ ID NO: 97769 - protein, 11 aa, Dengue virus
YGTCTQNGERR

SEQ ID NO: 97770 - protein, 11 aa, Dengue virus
GTCTQNGERRR

SEQ ID NO: 97771 - protein, 11 aa, Dengue virus
TCTQNGERRRE

SEQ ID NO: 97772 - protein, 11 aa, Dengue virus
CTQNGERRREK

SEQ ID NO: 97773 - protein, 11 aa, Dengue virus
TQNGERRREKR

SEQ ID NO: 97774 - protein, 11 aa, Dengue virus
QNGERRREKRS

SEQ ID NO: 97775 - protein, 11 aa, Dengue virus
NGERRREKRSV

SEQ ID NO: 97776 - protein, 11 aa, Dengue virus
GEHRREKRSVA

SEQ ID NO: 97777 - protein, 11 aa, Dengue virus
EHRREKRSVAL

SEQ ID NO: 97778 - protein, 11 aa, Dengue virus
HRREKRSVALV

SEQ ID NO: 97779 - protein, 11 aa, Dengue virus
RREKRSVALVP

SEQ ID NO: 97780 - protein, 11 aa, Dengue virus
REKRSVALVPH

SEQ ID NO: 97781 - protein, 11 aa, Dengue virus
EKRSVALVPHV

SEQ ID NO: 97782 - protein, 11 aa, Dengue virus
KRSVALVPHVG

SEQ ID NO: 97783 - protein, 11 aa, Dengue virus
RSVALVPHVGM

SEQ ID NO: 97784 - protein, 11 aa, Dengue virus
SVALVPHVGMG

SEQ ID NO: 97785 - protein, 11 aa, Dengue virus
VALVPHVGMGL

SEQ ID NO: 97786 - protein, 11 aa, Dengue virus
ALVPHVGMGLE

SEQ ID NO: 97787 - protein, 11 aa, Dengue virus
LVPHVGMGLET

SEQ ID NO: 97788 - protein, 11 aa, Dengue virus
VPHVGMGLETR

SEQ ID NO: 97789 - protein, 11 aa, Dengue virus
PHVGMGLETRT

SEQ ID NO: 97790 - protein, 11 aa, Dengue virus
HVGMGLETRTE

SEQ ID NO: 97791 - protein, 11 aa, Dengue virus
VGMGLETRTET

SEQ ID NO: 97792 - protein, 11 aa, Dengue virus
GMGLETRTETW

SEQ ID NO: 97793 - protein, 11 aa, Dengue virus
MGLETRTETWM

SEQ ID NO: 97794 - protein, 11 aa, Dengue virus
GLETRTETWMS

SEQ ID NO: 97795 - protein, 11 aa, Dengue virus
LETRTETWMSS

SEQ ID NO: 97796 - protein, 11 aa, Dengue virus
ETRTETWMSSE

SEQ ID NO: 97797 - protein, 11 aa, Dengue virus
TRTETWMSSEG

SEQ ID NO: 97798 - protein, 11 aa, Dengue virus
RTETWMSSEGA

SEQ ID NO: 97799 - protein, 11 aa, Dengue virus
TETWMSSEGAW

SEQ ID NO: 97800 - protein, 11 aa, Dengue virus
SEGAWKHAQRI

SEQ ID NO: 97801 - protein, 11 aa, Dengue virus
EGAWKHAQRIE

SEQ ID NO: 97802 - protein, 11 aa, Dengue virus
GAWKHAQRIET

SEQ ID NO: 97803 - protein, 11 aa, Dengue virus
AWKHAQRIETW

SEQ ID NO: 97804 - protein, 11 aa, Dengue virus
WKHAQRIETWI

SEQ ID NO: 97805 - protein, 11 aa, Dengue virus
KHAQRIETWIL

SEQ ID NO: 97806 - protein, 11 aa, Dengue virus
HAQRIETWILR

SEQ ID NO: 97807 - protein, 11 aa, Dengue virus
AQRIETWILRH

SEQ ID NO: 97808 - protein, 11 aa, Dengue virus
QRIETWILRHP

SEQ ID NO: 97809 - protein, 11 aa, Dengue virus
RIETWILRHPG

SEQ ID NO: 97810 - protein, 11 aa, Dengue virus
IETWILRHPGF

SEQ ID NO: 97811 - protein, 11 aa, Dengue virus
ETWILRHPGFT

SEQ ID NO: 97812 - protein, 11 aa, Dengue virus
TWILRHPGFTI

SEQ ID NO: 97813 - protein, 11 aa, Dengue virus
WILRHPGFTIM

SEQ ID NO: 97814 - protein, 11 aa, Dengue virus
ILRHPGFTIMA

SEQ ID NO: 97815 - protein, 11 aa, Dengue virus
LRHPGFTIMAA

SEQ ID NO: 97816 - protein, 11 aa, Dengue virus
RHPGFTIMAAI

SEQ ID NO: 97817 - protein, 11 aa, Dengue virus
HPGFTIMAAIL

SEQ ID NO: 97818 - protein, 11 aa, Dengue virus
PGFTIMAAILA

SEQ ID NO: 97819 - protein, 11 aa, Dengue virus
GFTIMAAILAY

SEQ ID NO: 97820 - protein, 11 aa, Dengue virus
FTIMAAILAYT

SEQ ID NO: 97821 - protein, 11 aa, Dengue virus
TIMAAILAYTI

SEQ ID NO: 97822 - protein, 11 aa, Dengue virus
IMAAILAYTIG

SEQ ID NO: 97823 - protein, 11 aa, Dengue virus
LAGFMAYMVGQ

SEQ ID NO: 97824 - protein, 11 aa, Dengue virus
AGFMAYMVGQT

SEQ ID NO: 97825 - protein, 11 aa, Dengue virus
GFMAYMVGQTG

SEQ ID NO: 97826 - protein, 11 aa, Dengue virus
FMAYMVGQTGI

SEQ ID NO: 97827 - protein, 11 aa, Dengue virus
LAYTIGTTHFQ

SEQ ID NO: 97828 - protein, 11 aa, Dengue virus
AYMVGQTGIQR

SEQ ID NO: 97829 - protein, 11 aa, Dengue virus
YTIGTTHFQRA

SEQ ID NO: 97830 - protein, 11 aa, Dengue virus
MVGQTGIQRTV

SEQ ID NO: 97831 - protein, 11 aa, Dengue virus
IGTTHFQRALI

SEQ ID NO: 97832 - protein, 11 aa, Dengue virus
GTTHFQRALIF

SEQ ID NO: 97833 - protein, 11 aa, Dengue virus
QTGIQRTVFFI

SEQ ID NO: 97834 - protein, 11 aa, Dengue virus
TGIQRTVFFIL

SEQ ID NO: 97835 - protein, 11 aa, Dengue virus
GIQRTVFFILM

SEQ ID NO: 97836 - protein, 11 aa, Dengue virus
IQRTVFFILMM

SEQ ID NO: 97837 - protein, 11 aa, Dengue virus
QRTVFFILMML

SEQ ID NO: 97838 - protein, 11 aa, Dengue virus
RTVFFILMMLV

SEQ ID NO: 97839 - protein, 11 aa, Dengue virus
TVFFILMMLVA

SEQ ID NO: 97840 - protein, 11 aa, Dengue virus
VFFILMMLVAP

SEQ ID NO: 97841 - protein, 11 aa, Dengue virus
FFILMMLVAPS

SEQ ID NO: 97842 - protein, 11 aa, Dengue virus
FILMMLVAPSY

SEQ ID NO: 97843 - protein, 11 aa, Dengue virus
ILMMLVAPSYG

SEQ ID NO: 97844 - protein, 11 aa, Dengue virus
LLTAVAPSMTM

SEQ ID NO: 97845 - protein, 11 aa, Dengue virus
LTAVAPSMTMR

SEQ ID NO: 97846 - protein, 11 aa, Dengue virus
TAVAPSMTMRC

SEQ ID NO: 97847 - protein, 11 aa, Dengue virus
LVAPSYGMRCI

SEQ ID NO: 97848 - protein, 11 aa, Dengue virus
VAPSMTMRCIG

SEQ ID NO: 97849 - protein, 11 aa, Dengue virus
APSYGMRCIGV

SEQ ID NO: 97850 - protein, 11 aa, Dengue virus
PSMTMRCIGIS

SEQ ID NO: 97851 - protein, 11 aa, Dengue virus
SMTMRCIGISN

SEQ ID NO: 97852 - protein, 11 aa, Dengue virus
YGMRCIGVGNR

SEQ ID NO: 97853 - protein, 11 aa, Dengue virus
GMRCIGVGNRD

SEQ ID NO: 97854 - protein, 11 aa, Dengue virus
MRCIGISNRDF

SEQ ID NO: 97855 - protein, 11 aa, Dengue virus
RCIGISNRDFV

SEQ ID NO: 97856 - protein, 11 aa, Dengue virus
CIGVGNRDFVE

SEQ ID NO: 97857 - protein, 11 aa, Dengue virus
IGISNRDFVEG

SEQ ID NO: 97858 - protein, 11 aa, Dengue virus
GISNRDFVEGV

SEQ ID NO: 97859 - protein, 11 aa, Dengue virus
ISNRDFVEGVS

SEQ ID NO: 97860 - protein, 11 aa, Dengue virus
SNRDFVEGVSG

SEQ ID NO: 97861 - protein, 11 aa, Dengue virus
RDFVEGVSGGS

SEQ ID NO: 97862 - protein, 11 aa, Dengue virus
DFVEGVSGGSW

SEQ ID NO: 97863 - protein, 11 aa, Dengue virus
FVEGVSGGSWV

SEQ ID NO: 97864 - protein, 11 aa, Dengue virus
VEGVSGGSWVD

SEQ ID NO: 97865 - protein, 11 aa, Dengue virus
EGVSGGSWVDI

SEQ ID NO: 97866 - protein, 11 aa, Dengue virus
GVSGGSWVDIV

SEQ ID NO: 97867 - protein, 11 aa, Dengue virus
VSGGSWVDIVL

SEQ ID NO: 97868 - protein, 11 aa, Dengue virus
SGGSWVDIVLE

SEQ ID NO: 97869 - protein, 11 aa, Dengue virus
GGSWVDIVLEH

SEQ ID NO: 97870 - protein, 11 aa, Dengue virus
GSWVDIVLEHG

SEQ ID NO: 97871 - protein, 11 aa, Dengue virus
SWVDIVLEHGS

SEQ ID NO: 97872 - protein, 11 aa, Dengue virus
WVDIVLEHGSC

SEQ ID NO: 97873 - protein, 11 aa, Dengue virus
VDIVLEHGSCV

SEQ ID NO: 97874 - protein, 11 aa, Dengue virus
DIVLEHGSCVT

SEQ ID NO: 97875 - protein, 11 aa, Dengue virus
IVLEHGSCVTT

SEQ ID NO: 97876 - protein, 11 aa, Dengue virus
VLEHGSCVTTM

SEQ ID NO: 97877 - protein, 11 aa, Dengue virus
LEHGSCVTTMA

SEQ ID NO: 97878 - protein, 11 aa, Dengue virus
EHGSCVTTMAK

SEQ ID NO: 97879 - protein, 11 aa, Dengue virus
HGSCVTTMAKN

SEQ ID NO: 97880 - protein, 11 aa, Dengue virus
GSCVTTMAKNK

SEQ ID NO: 97881 - protein, 11 aa, Dengue virus
SCVTTMAKNKP

SEQ ID NO: 97882 - protein, 11 aa, Dengue virus
CVTTMAKNKPT

SEQ ID NO: 97883 - protein, 11 aa, Dengue virus
VTTMAKNKPTL

SEQ ID NO: 97884 - protein, 11 aa, Dengue virus
TTMAKNKPTLD

SEQ ID NO: 97885 - protein, 11 aa, Dengue virus
TMAKNKPTLDF

SEQ ID NO: 97886 - protein, 11 aa, Dengue virus
MAKNKPTLDFE

SEQ ID NO: 97887 - protein, 11 aa, Dengue virus
AKNKPTLDFEL

SEQ ID NO: 97888 - protein, 11 aa, Dengue virus
QGKPTLDFELI

SEQ ID NO: 97889 - protein, 11 aa, Dengue virus
GKPTLDFELIK

SEQ ID NO: 97890 - protein, 11 aa, Dengue virus
KPTLDFELIKT

SEQ ID NO: 97891 - protein, 11 aa, Dengue virus
PTLDFELIKTT

SEQ ID NO: 97892 - protein, 11 aa, Dengue virus
TLDFELIKTTA

SEQ ID NO: 97893 - protein, 11 aa, Dengue virus
LDFELIKTTAK

SEQ ID NO: 97894 - protein, 11 aa, Dengue virus
DFELIKTTAKE

SEQ ID NO: 97895 - protein, 11 aa, Dengue virus
FELIKTTAKEV

SEQ ID NO: 97896 - protein, 11 aa, Dengue virus
ELIKTTAKEVA

SEQ ID NO: 97897 - protein, 11 aa, Dengue virus
LIKTTAKEVAL

SEQ ID NO: 97898 - protein, 11 aa, Dengue virus
IKTTAKEVALL

SEQ ID NO: 97899 - protein, 11 aa, Dengue virus
KTEAKQPATLR

SEQ ID NO: 97900 - protein, 11 aa, Dengue virus
TEAKQPATLRK

SEQ ID NO: 97901 - protein, 11 aa, Dengue virus
EAKQPATLRKY

SEQ ID NO: 97902 - protein, 11 aa, Dengue virus
AKQPATLRKYC

SEQ ID NO: 97903 - protein, 11 aa, Dengue virus
KQPATLRKYCI

SEQ ID NO: 97904 - protein, 11 aa, Dengue virus
QPATLRKYCIE

SEQ ID NO: 97905 - protein, 11 aa, Dengue virus
PATLRKYCIEA

SEQ ID NO: 97906 - protein, 11 aa, Dengue virus
ALLRTYCIEAL

SEQ ID NO: 97907 - protein, 11 aa, Dengue virus
LLRTYCIEALI

SEQ ID NO: 97908 - protein, 11 aa, Dengue virus
LRTYCIEALIS

SEQ ID NO: 97909 - protein, 11 aa, Dengue virus
RTYCIEALISN

SEQ ID NO: 97910 - protein, 11 aa, Dengue virus
TYCIEALISNI

SEQ ID NO: 97911 - protein, 11 aa, Dengue virus
YCIEALISNIT

SEQ ID NO: 97912 - protein, 11 aa, Dengue virus
CIEALISNITT

SEQ ID NO: 97913 - protein, 11 aa, Dengue virus
IEALISNITTA

SEQ ID NO: 97914 - protein, 11 aa, Dengue virus
EALISNITTAT

SEQ ID NO: 97915 - protein, 11 aa, Dengue virus
ALISNITTATR

SEQ ID NO: 97916 - protein, 11 aa, Dengue virus
LISNITTATRC

SEQ ID NO: 97917 - protein, 11 aa, Dengue virus
LTNTTTESRCP

SEQ ID NO: 97918 - protein, 11 aa, Dengue virus
TNTTTESRCPT

SEQ ID NO: 97919 - protein, 11 aa, Dengue virus
NTTTESRCPTQ

SEQ ID NO: 97920 - protein, 11 aa, Dengue virus
TTTESRCPTQG

SEQ ID NO: 97921 - protein, 11 aa, Dengue virus
TTESRCPTQGE

SEQ ID NO: 97922 - protein, 11 aa, Dengue virus
TESRCPTQGEP

SEQ ID NO: 97923 - protein, 11 aa, Dengue virus
ESRCPTQGEPS

SEQ ID NO: 97924 - protein, 11 aa, Dengue virus
SRCPTQGEPSL

SEQ ID NO: 97925 - protein, 11 aa, Dengue virus
RCPTQGEPSLN

SEQ ID NO: 97926 - protein, 11 aa, Dengue virus
CPTQGEPSLNE

SEQ ID NO: 97927 - protein, 11 aa, Dengue virus
PTQGEPSLNEE

SEQ ID NO: 97928 - protein, 11 aa, Dengue virus
TQGEPSLNEEQ

SEQ ID NO: 97929 - protein, 11 aa, Dengue virus
QGEPSLNEEQD

SEQ ID NO: 97930 - protein, 11 aa, Dengue virus
GEPSLNEEQDK

SEQ ID NO: 97931 - protein, 11 aa, Dengue virus
EPSLNEEQDKR

SEQ ID NO: 97932 - protein, 11 aa, Dengue virus
PSLNEEQDKRF

SEQ ID NO: 97933 - protein, 11 aa, Dengue virus
SLNEEQDKRFV

SEQ ID NO: 97934 - protein, 11 aa, Dengue virus
LNEEQDKRFVC

SEQ ID NO: 97935 - protein, 11 aa, Dengue virus
NEEQDKRFVCK

SEQ ID NO: 97936 - protein, 11 aa, Dengue virus
EEQDKRFVCKH

SEQ ID NO: 97937 - protein, 11 aa, Dengue virus
EQDKRFVCKHS

SEQ ID NO: 97938 - protein, 11 aa, Dengue virus
QDKRFVCKHSM

SEQ ID NO: 97939 - protein, 11 aa, Dengue virus
DQQYICRRDMV

SEQ ID NO: 97940 - protein, 11 aa, Dengue virus
KRFVCKHSMVD

SEQ ID NO: 97941 - protein, 11 aa, Dengue virus
RFVCKHSMVDR

SEQ ID NO: 97942 - protein, 11 aa, Dengue virus
YICRRDMVDRG

SEQ ID NO: 97943 - protein, 11 aa, Dengue virus
VCKHSMVDRGW

SEQ ID NO: 97944 - protein, 11 aa, Dengue virus
CKHSMVDRGWG

SEQ ID NO: 97945 - protein, 11 aa, Dengue virus
KHSMVDRGWGN

SEQ ID NO: 97946 - protein, 11 aa, Dengue virus
HSMVDRGWGNG

SEQ ID NO: 97947 - protein, 11 aa, Dengue virus
SMVDRGWGNGC

SEQ ID NO: 97948 - protein, 11 aa, Dengue virus
MVDRGWGNGCG

SEQ ID NO: 97949 - protein, 11 aa, Dengue virus
NGCGLFGKGGI

SEQ ID NO: 97950 - protein, 11 aa, Dengue virus
GCGLFGKGGIV

SEQ ID NO: 97951 - protein, 11 aa, Dengue virus
CGLFGKGGIVT

SEQ ID NO: 97952 - protein, 11 aa, Dengue virus
GLFGKGGIVTC

SEQ ID NO: 97953 - protein, 11 aa, Dengue virus
LFGKGGIVTCA

SEQ ID NO: 97954 - protein, 11 aa, Dengue virus
FGKGGIVTCAM

SEQ ID NO: 97955 - protein, 11 aa, Dengue virus
GKGGIVTCAMF

SEQ ID NO: 97956 - protein, 11 aa, Dengue virus
KGGVVTCAKFL

SEQ ID NO: 97957 - protein, 11 aa, Dengue virus
GGVVTCAKFLC

SEQ ID NO: 97958 - protein, 11 aa, Dengue virus
GVVTCAKFLCS

SEQ ID NO: 97959 - protein, 11 aa, Dengue virus
VVTCAKFLCSG

SEQ ID NO: 97960 - protein, 11 aa, Dengue virus
VTCAKFLCSGK

SEQ ID NO: 97961 - protein, 11 aa, Dengue virus
TCAKFLCSGKI

SEQ ID NO: 97962 - protein, 11 aa, Dengue virus
CAKFLCSGKIT

SEQ ID NO: 97963 - protein, 11 aa, Dengue virus
AKFLCSGKITG

SEQ ID NO: 97964 - protein, 11 aa, Dengue virus
KFLCSGKITGN

SEQ ID NO: 97965 - protein, 11 aa, Dengue virus
FLCSGKITGNL

SEQ ID NO: 97966 - protein, 11 aa, Dengue virus
LCSGKITGNLV

SEQ ID NO: 97967 - protein, 11 aa, Dengue virus
CKKNMEGKVVQ

SEQ ID NO: 97968 - protein, 11 aa, Dengue virus
KKNMEGKVVQP

SEQ ID NO: 97969 - protein, 11 aa, Dengue virus
KNMEGKVVQPE

SEQ ID NO: 97970 - protein, 11 aa, Dengue virus
NMEGKVVQPEN

SEQ ID NO: 97971 - protein, 11 aa, Dengue virus
MEGKVVQPENL

SEQ ID NO: 97972 - protein, 11 aa, Dengue virus
EGKVVQPENLE

SEQ ID NO: 97973 - protein, 11 aa, Dengue virus
GKVVQPENLEY

SEQ ID NO: 97974 - protein, 11 aa, Dengue virus
KVVQPENLEYT

SEQ ID NO: 97975 - protein, 11 aa, Dengue virus
VVQPENLEYTI

SEQ ID NO: 97976 - protein, 11 aa, Dengue virus
VQPENLEYTIV

SEQ ID NO: 97977 - protein, 11 aa, Dengue virus
QPENLEYTIVI

SEQ ID NO: 97978 - protein, 11 aa, Dengue virus
PENLEYTIVIT

SEQ ID NO: 97979 - protein, 11 aa, Dengue virus
ENLEYTIVITP

SEQ ID NO: 97980 - protein, 11 aa, Dengue virus
NLEYTIVITPH

SEQ ID NO: 97981 - protein, 11 aa, Dengue virus
LEYTIVITPHS

SEQ ID NO: 97982 - protein, 11 aa, Dengue virus
EYTIVITPHSG

SEQ ID NO: 97983 - protein, 11 aa, Dengue virus
YTIVITPHSGE

SEQ ID NO: 97984 - protein, 11 aa, Dengue virus
TIVITPHSGEE

SEQ ID NO: 97985 - protein, 11 aa, Dengue virus
IVITPHSGEEH

SEQ ID NO: 97986 - protein, 11 aa, Dengue virus
VITPHSGEEHA

SEQ ID NO: 97987 - protein, 11 aa, Dengue virus
ITPHSGEEHAV

SEQ ID NO: 97988 - protein, 11 aa, Dengue virus
TPHSGEEHAVG

SEQ ID NO: 97989 - protein, 11 aa, Dengue virus
PHSGEEHAVGN

SEQ ID NO: 97990 - protein, 11 aa, Dengue virus
HSGEEHAVGND

SEQ ID NO: 97991 - protein, 11 aa, Dengue virus
NGDTHAVGNDI

SEQ ID NO: 97992 - protein, 11 aa, Dengue virus
GDTHAVGNDIP

SEQ ID NO: 97993 - protein, 11 aa, Dengue virus
DTHAVGNDIPN

SEQ ID NO: 97994 - protein, 11 aa, Dengue virus
EHAVGNDTGKH

SEQ ID NO: 97995 - protein, 11 aa, Dengue virus
HAVGNDTGKHG

SEQ ID NO: 97996 - protein, 11 aa, Dengue virus
AVGNDIPNHGV

SEQ ID NO: 97997 - protein, 11 aa, Dengue virus
VGNDTGKHGKE

SEQ ID NO: 97998 - protein, 11 aa, Dengue virus
GNDTSNHGVTT

SEQ ID NO: 97999 - protein, 11 aa, Dengue virus
NDTSNHGVTAM

SEQ ID NO: 98000 - protein, 11 aa, Dengue virus
DTSNHGVTAMI

SEQ ID NO: 98001 - protein, 11 aa, Dengue virus
TSNHGVTAMIT

SEQ ID NO: 98002 - protein, 11 aa, Dengue virus
SNHGVTAMITP

SEQ ID NO: 98003 - protein, 11 aa, Dengue virus
NHGVTAMITPR

SEQ ID NO: 98004 - protein, 11 aa, Dengue virus
HGVTAMITPRS

SEQ ID NO: 98005 - protein, 11 aa, Dengue virus
GVTAMITPRSP

SEQ ID NO: 98006 - protein, 11 aa, Dengue virus
VTAMITPRSPS

SEQ ID NO: 98007 - protein, 11 aa, Dengue virus
TAMITPRSPSV

SEQ ID NO: 98008 - protein, 11 aa, Dengue virus
AMITPRSPSVE

SEQ ID NO: 98009 - protein, 11 aa, Dengue virus
MITPRSPSVEV

SEQ ID NO: 98010 - protein, 11 aa, Dengue virus
ITPRSPSVEVE

SEQ ID NO: 98011 - protein, 11 aa, Dengue virus
TPRSPSVEVEL

SEQ ID NO: 98012 - protein, 11 aa, Dengue virus
PQSSITEAELT

SEQ ID NO: 98013 - protein, 11 aa, Dengue virus
RTPSVEVKLPD

SEQ ID NO: 98014 - protein, 11 aa, Dengue virus
TPSVEVKLPDY

SEQ ID NO: 98015 - protein, 11 aa, Dengue virus
SITEAELTGYG

SEQ ID NO: 98016 - protein, 11 aa, Dengue virus
SVEVELPDYGE

SEQ ID NO: 98017 - protein, 11 aa, Dengue virus
TEAELTGYGTV

SEQ ID NO: 98018 - protein, 11 aa, Dengue virus
EAELTGYGTVT

SEQ ID NO: 98019 - protein, 11 aa, Dengue virus
VELPDYGELSL

SEQ ID NO: 98020 - protein, 11 aa, Dengue virus
ELTGYGTVTME

SEQ ID NO: 98021 - protein, 11 aa, Dengue virus
LPDYGELSLDC

SEQ ID NO: 98022 - protein, 11 aa, Dengue virus
PDYGELSLDCE

SEQ ID NO: 98023 - protein, 11 aa, Dengue virus
GYGTVTMECSP

SEQ ID NO: 98024 - protein, 11 aa, Dengue virus
YGTVTMECSPR

SEQ ID NO: 98025 - protein, 11 aa, Dengue virus
GTVTMECSPRT

SEQ ID NO: 98026 - protein, 11 aa, Dengue virus
ELSLDCEPRSG

SEQ ID NO: 98027 - protein, 11 aa, Dengue virus
VTMECSPRTGL

SEQ ID NO: 98028 - protein, 11 aa, Dengue virus
SLDCEPRSGID

SEQ ID NO: 98029 - protein, 11 aa, Dengue virus
MECSPRTGLDF

SEQ ID NO: 98030 - protein, 11 aa, Dengue virus
ECSPRTGLDFN

SEQ ID NO: 98031 - protein, 11 aa, Dengue virus
CSPRTGLDFNE

SEQ ID NO: 98032 - protein, 11 aa, Dengue virus
SPRTGLDFNEM

SEQ ID NO: 98033 - protein, 11 aa, Dengue virus
PRTGLDFNEMV

SEQ ID NO: 98034 - protein, 11 aa, Dengue virus
RTGLDFNEMVL

SEQ ID NO: 98035 - protein, 11 aa, Dengue virus
TGLDFNEMVLL

SEQ ID NO: 98036 - protein, 11 aa, Dengue virus
GIDFNEMILME

SEQ ID NO: 98037 - protein, 11 aa, Dengue virus
LDFNEMVLLQM

SEQ ID NO: 98038 - protein, 11 aa, Dengue virus
DFNEMILMEMK

SEQ ID NO: 98039 - protein, 11 aa, Dengue virus
MENKAWLVHRQ

SEQ ID NO: 98040 - protein, 11 aa, Dengue virus
KTKTWLVHKQW

SEQ ID NO: 98041 - protein, 11 aa, Dengue virus
NKAWLVHRQWF

SEQ ID NO: 98042 - protein, 11 aa, Dengue virus
KAWLVHRQWFL

SEQ ID NO: 98043 - protein, 11 aa, Dengue virus
AWLVHRQWFLD

SEQ ID NO: 98044 - protein, 11 aa, Dengue virus
WLVHRQWFLDL

SEQ ID NO: 98045 - protein, 11 aa, Dengue virus
LVHRQWFLDLP

SEQ ID NO: 98046 - protein, 11 aa, Dengue virus
VHRQWFLDLPL

SEQ ID NO: 98047 - protein, 11 aa, Dengue virus
HRQWFLDLPLP

SEQ ID NO: 98048 - protein, 11 aa, Dengue virus
RQWFLDLPLPW

SEQ ID NO: 98049 - protein, 11 aa, Dengue virus
QWFLDLPLPWA

SEQ ID NO: 98050 - protein, 11 aa, Dengue virus
WFLDLPLPWTT

SEQ ID NO: 98051 - protein, 11 aa, Dengue virus
FLDLPLPWTTG

SEQ ID NO: 98052 - protein, 11 aa, Dengue virus
LDLPLPWTTGA

SEQ ID NO: 98053 - protein, 11 aa, Dengue virus
DLPLPWTTGAD

SEQ ID NO: 98054 - protein, 11 aa, Dengue virus
LPLPWTTGADT

SEQ ID NO: 98055 - protein, 11 aa, Dengue virus
PLPWTTGADTS

SEQ ID NO: 98056 - protein, 11 aa, Dengue virus
LPWTTGADTSE

SEQ ID NO: 98057 - protein, 11 aa, Dengue virus
PWTTGADTSEV

SEQ ID NO: 98058 - protein, 11 aa, Dengue virus
WTTGADTSEVH

SEQ ID NO: 98059 - protein, 11 aa, Dengue virus
TTGADTSEVHW

SEQ ID NO: 98060 - protein, 11 aa, Dengue virus
TGADTSEVHWN

SEQ ID NO: 98061 - protein, 11 aa, Dengue virus
GADTSEVHWNH

SEQ ID NO: 98062 - protein, 11 aa, Dengue virus
ADTSEVHWNHK

SEQ ID NO: 98063 - protein, 11 aa, Dengue virus
DTSEVHWNHKE

SEQ ID NO: 98064 - protein, 11 aa, Dengue virus
TSEVHWNHKER

SEQ ID NO: 98065 - protein, 11 aa, Dengue virus
SEVHWNHKERM

SEQ ID NO: 98066 - protein, 11 aa, Dengue virus
EVHWNHKERMV

SEQ ID NO: 98067 - protein, 11 aa, Dengue virus
VHWNHKERMVT

SEQ ID NO: 98068 - protein, 11 aa, Dengue virus
HWNHKERMVTF

SEQ ID NO: 98069 - protein, 11 aa, Dengue virus
WNHKERMVTFK

SEQ ID NO: 98070 - protein, 11 aa, Dengue virus
NHKERMVTFKV

SEQ ID NO: 98071 - protein, 11 aa, Dengue virus
HKERMVTFKVP

SEQ ID NO: 98072 - protein, 11 aa, Dengue virus
KETLVTFKNPH

SEQ ID NO: 98073 - protein, 11 aa, Dengue virus
ETLVTFKNPHA

SEQ ID NO: 98074 - protein, 11 aa, Dengue virus
TLVTFKNPHAK

SEQ ID NO: 98075 - protein, 11 aa, Dengue virus
LVTFKNPHAKK

SEQ ID NO: 98076 - protein, 11 aa, Dengue virus
VTFKNPHAKKQ

SEQ ID NO: 98077 - protein, 11 aa, Dengue virus
TFKNPHAKKQD

SEQ ID NO: 98078 - protein, 11 aa, Dengue virus
FKNPHAKKQDV

SEQ ID NO: 98079 - protein, 11 aa, Dengue virus
KNPHAKKQDVV

SEQ ID NO: 98080 - protein, 11 aa, Dengue virus
NPHAKKQDVVV

SEQ ID NO: 98081 - protein, 11 aa, Dengue virus
PHAKKQDVVVL

SEQ ID NO: 98082 - protein, 11 aa, Dengue virus
HAKKQDVVVLG

SEQ ID NO: 98083 - protein, 11 aa, Dengue virus
AKKQDVVVLGS

SEQ ID NO: 98084 - protein, 11 aa, Dengue virus
KKQDVVVLGSQ

SEQ ID NO: 98085 - protein, 11 aa, Dengue virus
KQDVVVLGSQE

SEQ ID NO: 98086 - protein, 11 aa, Dengue virus
QDVVVLGSQEG

SEQ ID NO: 98087 - protein, 11 aa, Dengue virus
DVVVLGSQEGA

SEQ ID NO: 98088 - protein, 11 aa, Dengue virus
VVVLGSQEGAM

SEQ ID NO: 98089 - protein, 11 aa, Dengue virus
VVLGSQEGAMH

SEQ ID NO: 98090 - protein, 11 aa, Dengue virus
VLGSQEGAMHT

SEQ ID NO: 98091 - protein, 11 aa, Dengue virus
LGSQEGAMHTA

SEQ ID NO: 98092 - protein, 11 aa, Dengue virus
GSQEGAMHTAL

SEQ ID NO: 98093 - protein, 11 aa, Dengue virus
SQEGAMHSALT

SEQ ID NO: 98094 - protein, 11 aa, Dengue virus
QEGAMHSALTG

SEQ ID NO: 98095 - protein, 11 aa, Dengue virus
EGAMHSALTGA

SEQ ID NO: 98096 - protein, 11 aa, Dengue virus
GAMHSALTGAT

SEQ ID NO: 98097 - protein, 11 aa, Dengue virus
AMHSALTGATE

SEQ ID NO: 98098 - protein, 11 aa, Dengue virus
MHSALTGATEV

SEQ ID NO: 98099 - protein, 11 aa, Dengue virus
HSALTGATEVD

SEQ ID NO: 98100 - protein, 11 aa, Dengue virus
SALTGATEVDS

SEQ ID NO: 98101 - protein, 11 aa, Dengue virus
ALTGATEVDSG

SEQ ID NO: 98102 - protein, 11 aa, Dengue virus
LTGATEVDSGD

SEQ ID NO: 98103 - protein, 11 aa, Dengue virus
TGATEVDSGDG

SEQ ID NO: 98104 - protein, 11 aa, Dengue virus
GATEIQMSSGN

SEQ ID NO: 98105 - protein, 11 aa, Dengue virus
ATEIQMSSGNL

SEQ ID NO: 98106 - protein, 11 aa, Dengue virus
TEIQMSSGNLL

SEQ ID NO: 98107 - protein, 11 aa, Dengue virus
EIQMSSGNLLF

SEQ ID NO: 98108 - protein, 11 aa, Dengue virus
IQMSSGNLLFT

SEQ ID NO: 98109 - protein, 11 aa, Dengue virus
QMSSGNLLFTG

SEQ ID NO: 98110 - protein, 11 aa, Dengue virus
MSSGNLLFTGH

SEQ ID NO: 98111 - protein, 11 aa, Dengue virus
SSGNLLFTGHL

SEQ ID NO: 98112 - protein, 11 aa, Dengue virus
SGNLLFTGHLK

SEQ ID NO: 98113 - protein, 11 aa, Dengue virus
GNLLFTGHLKC

SEQ ID NO: 98114 - protein, 11 aa, Dengue virus
NLLFTGHLKCR

SEQ ID NO: 98115 - protein, 11 aa, Dengue virus
LLFTGHLKCRL

SEQ ID NO: 98116 - protein, 11 aa, Dengue virus
LFTGHLKCRLR

SEQ ID NO: 98117 - protein, 11 aa, Dengue virus
FTGHLKCRLRM

SEQ ID NO: 98118 - protein, 11 aa, Dengue virus
TGHLKCRLRMD

SEQ ID NO: 98119 - protein, 11 aa, Dengue virus
GHLKCRLRMDK

SEQ ID NO: 98120 - protein, 11 aa, Dengue virus
HLKCRLRMDKL

SEQ ID NO: 98121 - protein, 11 aa, Dengue virus
LKCRLRMDKLQ

SEQ ID NO: 98122 - protein, 11 aa, Dengue virus
KCRLRMDKLQL

SEQ ID NO: 98123 - protein, 11 aa, Dengue virus
CRLRMDKLQLK

SEQ ID NO: 98124 - protein, 11 aa, Dengue virus
RLRMDKLQLKG

SEQ ID NO: 98125 - protein, 11 aa, Dengue virus
LRMDKLQLKGM

SEQ ID NO: 98126 - protein, 11 aa, Dengue virus
RMDKLQLKGMS

SEQ ID NO: 98127 - protein, 11 aa, Dengue virus
MDKLQLKGMSY

SEQ ID NO: 98128 - protein, 11 aa, Dengue virus
DKLQLKGMSYS

SEQ ID NO: 98129 - protein, 11 aa, Dengue virus
KLQLKGMSYSM

SEQ ID NO: 98130 - protein, 11 aa, Dengue virus
LQLKGMSYSMC

SEQ ID NO: 98131 - protein, 11 aa, Dengue virus
QLKGMSYSMCT

SEQ ID NO: 98132 - protein, 11 aa, Dengue virus
LKGMSYSMCTG

SEQ ID NO: 98133 - protein, 11 aa, Dengue virus
KGMSYSMCTGK

SEQ ID NO: 98134 - protein, 11 aa, Dengue virus
GMSYSMCTGKF

SEQ ID NO: 98135 - protein, 11 aa, Dengue virus
MSYSMCTGKFK

SEQ ID NO: 98136 - protein, 11 aa, Dengue virus
SYSMCTGKFKV

SEQ ID NO: 98137 - protein, 11 aa, Dengue virus
YSMCTGKFKVV

SEQ ID NO: 98138 - protein, 11 aa, Dengue virus
TMCSGKFSIDR

SEQ ID NO: 98139 - protein, 11 aa, Dengue virus
MCTGKFKVVKE

SEQ ID NO: 98140 - protein, 11 aa, Dengue virus
CTGKFKVVKEI

SEQ ID NO: 98141 - protein, 11 aa, Dengue virus
TGKFKVVKEIA

SEQ ID NO: 98142 - protein, 11 aa, Dengue virus
GKFSIDREMAE

SEQ ID NO: 98143 - protein, 11 aa, Dengue virus
KFSIDREMAET

SEQ ID NO: 98144 - protein, 11 aa, Dengue virus
FKVVKEIAETQ

SEQ ID NO: 98145 - protein, 11 aa, Dengue virus
KVVKEIAETQH

SEQ ID NO: 98146 - protein, 11 aa, Dengue virus
IDREMAETQHG

SEQ ID NO: 98147 - protein, 11 aa, Dengue virus
VKEIAETQHGT

SEQ ID NO: 98148 - protein, 11 aa, Dengue virus
KEIAETQHGTI

SEQ ID NO: 98149 - protein, 11 aa, Dengue virus
EIAETQHGTIV

SEQ ID NO: 98150 - protein, 11 aa, Dengue virus
IAETQHGTIVI

SEQ ID NO: 98151 - protein, 11 aa, Dengue virus
AETQHGTIVIR

SEQ ID NO: 98152 - protein, 11 aa, Dengue virus
ETQHGTIVIRV

SEQ ID NO: 98153 - protein, 11 aa, Dengue virus
TQHGTIVIRVQ

SEQ ID NO: 98154 - protein, 11 aa, Dengue virus
QHGTIVIRVQY

SEQ ID NO: 98155 - protein, 11 aa, Dengue virus
HGTIVIRVQYE

SEQ ID NO: 98156 - protein, 11 aa, Dengue virus
GTIVIRVQYEG

SEQ ID NO: 98157 - protein, 11 aa, Dengue virus
TTVVKVKYEGT

SEQ ID NO: 98158 - protein, 11 aa, Dengue virus
TVVKVKYEGTG

SEQ ID NO: 98159 - protein, 11 aa, Dengue virus
VVKVKYEGTGA

SEQ ID NO: 98160 - protein, 11 aa, Dengue virus
VKVKYEGTGAP

SEQ ID NO: 98161 - protein, 11 aa, Dengue virus
KVKYEGTGAPC

SEQ ID NO: 98162 - protein, 11 aa, Dengue virus
VKYEGTGAPCK

SEQ ID NO: 98163 - protein, 11 aa, Dengue virus
KYEGTGAPCKV

SEQ ID NO: 98164 - protein, 11 aa, Dengue virus
YEGTGAPCKVP

SEQ ID NO: 98165 - protein, 11 aa, Dengue virus
EGTGAPCKVPI

SEQ ID NO: 98166 - protein, 11 aa, Dengue virus
GTGAPCKVPIE

SEQ ID NO: 98167 - protein, 11 aa, Dengue virus
TGAPCKVPIEI

SEQ ID NO: 98168 - protein, 11 aa, Dengue virus
GAPCKIPIEIR

SEQ ID NO: 98169 - protein, 11 aa, Dengue virus
APCKIPIEIRD

SEQ ID NO: 98170 - protein, 11 aa, Dengue virus
PCKIPFEIMDL

SEQ ID NO: 98171 - protein, 11 aa, Dengue virus
CKIPFEIMDLE

SEQ ID NO: 98172 - protein, 11 aa, Dengue virus
KIPFEIMDLEK

SEQ ID NO: 98173 - protein, 11 aa, Dengue virus
VPIEIRDVNKK

SEQ ID NO: 98174 - protein, 11 aa, Dengue virus
PIEIRDVNKKK

SEQ ID NO: 98175 - protein, 11 aa, Dengue virus
IEIRDVNKKKV

SEQ ID NO: 98176 - protein, 11 aa, Dengue virus
EIRDVNKKKVV

SEQ ID NO: 98177 - protein, 11 aa, Dengue virus
IRDVNKKKVVG

SEQ ID NO: 98178 - protein, 11 aa, Dengue virus
RDVNKKKVVGR

SEQ ID NO: 98179 - protein, 11 aa, Dengue virus
AENTNSATNIE

SEQ ID NO: 98180 - protein, 11 aa, Dengue virus
ESTNSVTNIEL

SEQ ID NO: 98181 - protein, 11 aa, Dengue virus
NTNSATNIELE

SEQ ID NO: 98182 - protein, 11 aa, Dengue virus
TNSATNIELEP

SEQ ID NO: 98183 - protein, 11 aa, Dengue virus
NSATNIELEPP

SEQ ID NO: 98184 - protein, 11 aa, Dengue virus
SATNIELEPPF

SEQ ID NO: 98185 - protein, 11 aa, Dengue virus
ATNIELEPPFG

SEQ ID NO: 98186 - protein, 11 aa, Dengue virus
VNIEAEPPFGD

SEQ ID NO: 98187 - protein, 11 aa, Dengue virus
NIEAEPPFGDS

SEQ ID NO: 98188 - protein, 11 aa, Dengue virus
IEAEPPFGDSY

SEQ ID NO: 98189 - protein, 11 aa, Dengue virus
EAEPPFGDSYI

SEQ ID NO: 98190 - protein, 11 aa, Dengue virus
AEPPFGDSYII

SEQ ID NO: 98191 - protein, 11 aa, Dengue virus
EPPFGDSYIII

SEQ ID NO: 98192 - protein, 11 aa, Dengue virus
PPFGDSYIIIG

SEQ ID NO: 98193 - protein, 11 aa, Dengue virus
PFGDSYIIIGV

SEQ ID NO: 98194 - protein, 11 aa, Dengue virus
FGDSYIMIGVG

SEQ ID NO: 98195 - protein, 11 aa, Dengue virus
GDSYIVIGVGD

SEQ ID NO: 98196 - protein, 11 aa, Dengue virus
DSYIVIGVGDS

SEQ ID NO: 98197 - protein, 11 aa, Dengue virus
SYIVIGVGDSA

SEQ ID NO: 98198 - protein, 11 aa, Dengue virus
YIVIGVGDSAL

SEQ ID NO: 98199 - protein, 11 aa, Dengue virus
IVIGVGDSALT

SEQ ID NO: 98200 - protein, 11 aa, Dengue virus
VIGVGDSALTL

SEQ ID NO: 98201 - protein, 11 aa, Dengue virus
IGVGDSALTLH

SEQ ID NO: 98202 - protein, 11 aa, Dengue virus
GVGDSALTLHW

SEQ ID NO: 98203 - protein, 11 aa, Dengue virus
VGDSALTLHWF

SEQ ID NO: 98204 - protein, 11 aa, Dengue virus
GDSALTLHWFR

SEQ ID NO: 98205 - protein, 11 aa, Dengue virus
DSALTLHWFRK

SEQ ID NO: 98206 - protein, 11 aa, Dengue virus
GQLKLNWFKKG

SEQ ID NO: 98207 - protein, 11 aa, Dengue virus
QLKLNWFKKGS

SEQ ID NO: 98208 - protein, 11 aa, Dengue virus
LKLNWFKKGSS

SEQ ID NO: 98209 - protein, 11 aa, Dengue virus
KLNWFKKGSSI

SEQ ID NO: 98210 - protein, 11 aa, Dengue virus
LNWFKKGSSIG

SEQ ID NO: 98211 - protein, 11 aa, Dengue virus
NWFKKGSSIGQ

SEQ ID NO: 98212 - protein, 11 aa, Dengue virus
WFKKGSSIGQM

SEQ ID NO: 98213 - protein, 11 aa, Dengue virus
FKKGSSIGQMF

SEQ ID NO: 98214 - protein, 11 aa, Dengue virus
RKGSSIGKMLE

SEQ ID NO: 98215 - protein, 11 aa, Dengue virus
KGSSIGKMLES

SEQ ID NO: 98216 - protein, 11 aa, Dengue virus
GSSIGQMFETT

SEQ ID NO: 98217 - protein, 11 aa, Dengue virus
SSIGKMLESTY

SEQ ID NO: 98218 - protein, 11 aa, Dengue virus
SIGKMLESTYR

SEQ ID NO: 98219 - protein, 11 aa, Dengue virus
IGQMFETTMRG

SEQ ID NO: 98220 - protein, 11 aa, Dengue virus
GQMFETTMRGA

SEQ ID NO: 98221 - protein, 11 aa, Dengue virus
QMFETTMRGAK

SEQ ID NO: 98222 - protein, 11 aa, Dengue virus
MLESTYRGAKR

SEQ ID NO: 98223 - protein, 11 aa, Dengue virus
FETTMRGAKRM

SEQ ID NO: 98224 - protein, 11 aa, Dengue virus
ETTMRGAKRMA

SEQ ID NO: 98225 - protein, 11 aa, Dengue virus
TTMRGAKRMAI

SEQ ID NO: 98226 - protein, 11 aa, Dengue virus
TMRGAKRMAIL

SEQ ID NO: 98227 - protein, 11 aa, Dengue virus
MRGAKRMAILG

SEQ ID NO: 98228 - protein, 11 aa, Dengue virus
RGAKRMAILGD

SEQ ID NO: 98229 - protein, 11 aa, Dengue virus
GAKRMAILGDT

SEQ ID NO: 98230 - protein, 11 aa, Dengue virus
AKRMAILGDTA

SEQ ID NO: 98231 - protein, 11 aa, Dengue virus
KRMAILGDTAW

SEQ ID NO: 98232 - protein, 11 aa, Dengue virus
RMAILGDTAWD

SEQ ID NO: 98233 - protein, 11 aa, Dengue virus
MAILGDTAWDF

SEQ ID NO: 98234 - protein, 11 aa, Dengue virus
AILGDTAWDFG

SEQ ID NO: 98235 - protein, 11 aa, Dengue virus
ILGDTAWDFGS

SEQ ID NO: 98236 - protein, 11 aa, Dengue virus
LGDTAWDFGSL

SEQ ID NO: 98237 - protein, 11 aa, Dengue virus
GDTAWDFGSLG

SEQ ID NO: 98238 - protein, 11 aa, Dengue virus
DTAWDFGSLGG

SEQ ID NO: 98239 - protein, 11 aa, Dengue virus
TAWDFGSLGGV

SEQ ID NO: 98240 - protein, 11 aa, Dengue virus
AWDFGSVGGLL

SEQ ID NO: 98241 - protein, 11 aa, Dengue virus
WDFGSVGGLLT

SEQ ID NO: 98242 - protein, 11 aa, Dengue virus
DFGSVGGLLTS

SEQ ID NO: 98243 - protein, 11 aa, Dengue virus
FGSVGGLLTSL

SEQ ID NO: 98244 - protein, 11 aa, Dengue virus
GSVGGLLTSLG

SEQ ID NO: 98245 - protein, 11 aa, Dengue virus
SVGGLLTSLGK

SEQ ID NO: 98246 - protein, 11 aa, Dengue virus
VGGLLTSLGKA

SEQ ID NO: 98247 - protein, 11 aa, Dengue virus
GGLLTSLGKAV

SEQ ID NO: 98248 - protein, 11 aa, Dengue virus
GLLTSLGKAVH

SEQ ID NO: 98249 - protein, 11 aa, Dengue virus
LLTSLGKAVHQ

SEQ ID NO: 98250 - protein, 11 aa, Dengue virus
LTSLGKAVHQV

SEQ ID NO: 98251 - protein, 11 aa, Dengue virus
TSLGKAVHQIF

SEQ ID NO: 98252 - protein, 11 aa, Dengue virus
SLGKAVHQIFG

SEQ ID NO: 98253 - protein, 11 aa, Dengue virus
IGKALHQVFGA

SEQ ID NO: 98254 - protein, 11 aa, Dengue virus
GKALHQVFGAI

SEQ ID NO: 98255 - protein, 11 aa, Dengue virus
KALHQVFGAIY

SEQ ID NO: 98256 - protein, 11 aa, Dengue virus
AVHQIFGSVYT

SEQ ID NO: 98257 - protein, 11 aa, Dengue virus
VHQIFGSVYTT

SEQ ID NO: 98258 - protein, 11 aa, Dengue virus
HQIFGSVYTTM

SEQ ID NO: 98259 - protein, 11 aa, Dengue virus
QVFGAIYGAAF

SEQ ID NO: 98260 - protein, 11 aa, Dengue virus
VFGAIYGAAFS

SEQ ID NO: 98261 - protein, 11 aa, Dengue virus
FGAIYGAAFSG

SEQ ID NO: 98262 - protein, 11 aa, Dengue virus
GAIYGAAFSGV

SEQ ID NO: 98263 - protein, 11 aa, Dengue virus
AIYGAAFSGVS

SEQ ID NO: 98264 - protein, 11 aa, Dengue virus
IYGAAFSGVSW

SEQ ID NO: 98265 - protein, 11 aa, Dengue virus
YGAAFSGVSWT

SEQ ID NO: 98266 - protein, 11 aa, Dengue virus
TTMFGGVSWMV

SEQ ID NO: 98267 - protein, 11 aa, Dengue virus
TMFGGVSWMVR

SEQ ID NO: 98268 - protein, 11 aa, Dengue virus
MFGGVSWMVRI

SEQ ID NO: 98269 - protein, 11 aa, Dengue virus
FGGVSWMVRIL

SEQ ID NO: 98270 - protein, 11 aa, Dengue virus
GGVSWMVRILI

SEQ ID NO: 98271 - protein, 11 aa, Dengue virus
GVSWMVRILIG

SEQ ID NO: 98272 - protein, 11 aa, Dengue virus
VRILIGFLVLW

SEQ ID NO: 98273 - protein, 11 aa, Dengue virus
RILIGLLVLWI

SEQ ID NO: 98274 - protein, 11 aa, Dengue virus
ILIGLLVLWIG

SEQ ID NO: 98275 - protein, 11 aa, Dengue virus
LIGLLVLWIGT

SEQ ID NO: 98276 - protein, 11 aa, Dengue virus
IGLLVLWIGTN

SEQ ID NO: 98277 - protein, 11 aa, Dengue virus
GLLVLWIGTNS

SEQ ID NO: 98278 - protein, 11 aa, Dengue virus
LLVLWIGTNSR

SEQ ID NO: 98279 - protein, 11 aa, Dengue virus
IITWIGMNSRN

SEQ ID NO: 98280 - protein, 11 aa, Dengue virus
ITWIGMNSRNT

SEQ ID NO: 98281 - protein, 11 aa, Dengue virus
TWIGMNSRNTS

SEQ ID NO: 98282 - protein, 11 aa, Dengue virus
WIGTNSRNTPM

SEQ ID NO: 98283 - protein, 11 aa, Dengue virus
IGTNSRNTPMA

SEQ ID NO: 98284 - protein, 11 aa, Dengue virus
GMNSRNTSMAM

SEQ ID NO: 98285 - protein, 11 aa, Dengue virus
TNSRNTSMAMS

SEQ ID NO: 98286 - protein, 11 aa, Dengue virus
NSRNTSMAMSC

SEQ ID NO: 98287 - protein, 11 aa, Dengue virus
SRNTSMAMSCI

SEQ ID NO: 98288 - protein, 11 aa, Dengue virus
RNTSMAMSCIA

SEQ ID NO: 98289 - protein, 11 aa, Dengue virus
NTSMAMSCIAV

SEQ ID NO: 98290 - protein, 11 aa, Dengue virus
TSMAMSCIAVG

SEQ ID NO: 98291 - protein, 11 aa, Dengue virus
SMAMSCIAVGG

SEQ ID NO: 98292 - protein, 11 aa, Dengue virus
MAMSCIAVGGI

SEQ ID NO: 98293 - protein, 11 aa, Dengue virus
AMSCIAVGGIT

SEQ ID NO: 98294 - protein, 11 aa, Dengue virus
MSCIAVGGITL

SEQ ID NO: 98295 - protein, 11 aa, Dengue virus
SCIAVGGITLF

SEQ ID NO: 98296 - protein, 11 aa, Dengue virus
GITLFLGFTVH

SEQ ID NO: 98297 - protein, 11 aa, Dengue virus
ITLFLGFTVHA

SEQ ID NO: 98298 - protein, 11 aa, Dengue virus
TLFLGFTVHAD

SEQ ID NO: 98299 - protein, 11 aa, Dengue virus
LFLGFTVHADM

SEQ ID NO: 98300 - protein, 11 aa, Dengue virus
FLGFTVHADMG

SEQ ID NO: 98301 - protein, 11 aa, Dengue virus
LGFTVHADMGC

SEQ ID NO: 98302 - protein, 11 aa, Dengue virus
SWSGKELKCGS

SEQ ID NO: 98303 - protein, 11 aa, Dengue virus
WSGKELKCGSG

SEQ ID NO: 98304 - protein, 11 aa, Dengue virus
SGKELKCGSGI

SEQ ID NO: 98305 - protein, 11 aa, Dengue virus
GKELKCGSGIF

SEQ ID NO: 98306 - protein, 11 aa, Dengue virus
KELKCGSGIFV

SEQ ID NO: 98307 - protein, 11 aa, Dengue virus
ELKCGSGIFVI

SEQ ID NO: 98308 - protein, 11 aa, Dengue virus
LKCGSGIFVID

SEQ ID NO: 98309 - protein, 11 aa, Dengue virus
KCGSGIFVIDN

SEQ ID NO: 98310 - protein, 11 aa, Dengue virus
CGSGIFVIDNV

SEQ ID NO: 98311 - protein, 11 aa, Dengue virus
GSGIFVIDNVH

SEQ ID NO: 98312 - protein, 11 aa, Dengue virus
SGIFVIDNVHT

SEQ ID NO: 98313 - protein, 11 aa, Dengue virus
GIFVIDNVHTW

SEQ ID NO: 98314 - protein, 11 aa, Dengue virus
IFVIDNVHTWT

SEQ ID NO: 98315 - protein, 11 aa, Dengue virus
FVIDNVHTWTE

SEQ ID NO: 98316 - protein, 11 aa, Dengue virus
VIDNVHTWTEQ

SEQ ID NO: 98317 - protein, 11 aa, Dengue virus
IDNVHTWTEQY

SEQ ID NO: 98318 - protein, 11 aa, Dengue virus
DNVHTWTEQYQ

SEQ ID NO: 98319 - protein, 11 aa, Dengue virus
NVHTWTEQYQF

SEQ ID NO: 98320 - protein, 11 aa, Dengue virus
VHTWTEQYQFQ

SEQ ID NO: 98321 - protein, 11 aa, Dengue virus
HTWTEQYQFQP

SEQ ID NO: 98322 - protein, 11 aa, Dengue virus
TWTEQYQFQPE

SEQ ID NO: 98323 - protein, 11 aa, Dengue virus
WTEQYQFQPES

SEQ ID NO: 98324 - protein, 11 aa, Dengue virus
TEQYQFQPESP

SEQ ID NO: 98325 - protein, 11 aa, Dengue virus
EQYQFQPESPA

SEQ ID NO: 98326 - protein, 11 aa, Dengue virus
QYQFQPESPAR

SEQ ID NO: 98327 - protein, 11 aa, Dengue virus
YQFQPESPARL

SEQ ID NO: 98328 - protein, 11 aa, Dengue virus
QFQPESPARLA

SEQ ID NO: 98329 - protein, 11 aa, Dengue virus
FQPESPARVAS

SEQ ID NO: 98330 - protein, 11 aa, Dengue virus
QPESPARVASA

SEQ ID NO: 98331 - protein, 11 aa, Dengue virus
PESPARVASAI

SEQ ID NO: 98332 - protein, 11 aa, Dengue virus
ESPARVASAIL

SEQ ID NO: 98333 - protein, 11 aa, Dengue virus
SPARVASAILN

SEQ ID NO: 98334 - protein, 11 aa, Dengue virus
PARVASAILNA

SEQ ID NO: 98335 - protein, 11 aa, Dengue virus
ARVASAILNAH

SEQ ID NO: 98336 - protein, 11 aa, Dengue virus
RVASAILNAHK

SEQ ID NO: 98337 - protein, 11 aa, Dengue virus
VASAILNAHKD

SEQ ID NO: 98338 - protein, 11 aa, Dengue virus
ASAILIAHKDG

SEQ ID NO: 98339 - protein, 11 aa, Dengue virus
SAILIAHKDGV

SEQ ID NO: 98340 - protein, 11 aa, Dengue virus
AILNAHKEGVC

SEQ ID NO: 98341 - protein, 11 aa, Dengue virus
ILNAHKEGVCG

SEQ ID NO: 98342 - protein, 11 aa, Dengue virus
LIAHKDGVCGI

SEQ ID NO: 98343 - protein, 11 aa, Dengue virus
NAHKEGVCGIR

SEQ ID NO: 98344 - protein, 11 aa, Dengue virus
AHEDGVCGIRS

SEQ ID NO: 98345 - protein, 11 aa, Dengue virus
HKDGVCGVRST

SEQ ID NO: 98346 - protein, 11 aa, Dengue virus
KEGVCGIRSTT

SEQ ID NO: 98347 - protein, 11 aa, Dengue virus
EGVCGIRSTTR

SEQ ID NO: 98348 - protein, 11 aa, Dengue virus
GIRSTTRLENI

SEQ ID NO: 98349 - protein, 11 aa, Dengue virus
IRSTTRLENIM

SEQ ID NO: 98350 - protein, 11 aa, Dengue virus
RSTTRLENIMW

SEQ ID NO: 98351 - protein, 11 aa, Dengue virus
STTRLENIMWK

SEQ ID NO: 98352 - protein, 11 aa, Dengue virus
TTRLENIMWKQ

SEQ ID NO: 98353 - protein, 11 aa, Dengue virus
TRLENIMWKQI

SEQ ID NO: 98354 - protein, 11 aa, Dengue virus
RLENIMWKQIT

SEQ ID NO: 98355 - protein, 11 aa, Dengue virus
LENIMWKQITN

SEQ ID NO: 98356 - protein, 11 aa, Dengue virus
ENIMWKQITNE

SEQ ID NO: 98357 - protein, 11 aa, Dengue virus
NIMWKQITNEL

SEQ ID NO: 98358 - protein, 11 aa, Dengue virus
IMWKQITNELN

SEQ ID NO: 98359 - protein, 11 aa, Dengue virus
ALWEGGHDLTV

SEQ ID NO: 98360 - protein, 11 aa, Dengue virus
WEGGHDLTVVT

SEQ ID NO: 98361 - protein, 11 aa, Dengue virus
EGGHDLTIVAG

SEQ ID NO: 98362 - protein, 11 aa, Dengue virus
GGHDLTIVAGD

SEQ ID NO: 98363 - protein, 11 aa, Dengue virus
GHDLTVVAGDA

SEQ ID NO: 98364 - protein, 11 aa, Dengue virus
HDLTVVAGDAK

SEQ ID NO: 98365 - protein, 11 aa, Dengue virus
DLTVVAGDAKG

SEQ ID NO: 98366 - protein, 11 aa, Dengue virus
LTVVAGDAKGV

SEQ ID NO: 98367 - protein, 11 aa, Dengue virus
TVVAGDAKGVL

SEQ ID NO: 98368 - protein, 11 aa, Dengue virus
VAGDVKGVLSK

SEQ ID NO: 98369 - protein, 11 aa, Dengue virus
AGDVKGVLSKG

SEQ ID NO: 98370 - protein, 11 aa, Dengue virus
GDVKGVLSKGK

SEQ ID NO: 98371 - protein, 11 aa, Dengue virus
DVKGVLSKGKR

SEQ ID NO: 98372 - protein, 11 aa, Dengue virus
KGVLSKGKRAL

SEQ ID NO: 98373 - protein, 11 aa, Dengue virus
GVLSKGKRALA

SEQ ID NO: 98374 - protein, 11 aa, Dengue virus
VLSKGKRALAP

SEQ ID NO: 98375 - protein, 11 aa, Dengue virus
LSKGKRALAPP

SEQ ID NO: 98376 - protein, 11 aa, Dengue virus
LTPPASDLKYS

SEQ ID NO: 98377 - protein, 11 aa, Dengue virus
TPPASDLKYSW

SEQ ID NO: 98378 - protein, 11 aa, Dengue virus
PPASDLKYSWK

SEQ ID NO: 98379 - protein, 11 aa, Dengue virus
PASDLKYSWKT

SEQ ID NO: 98380 - protein, 11 aa, Dengue virus
ASDLKYSWKTW

SEQ ID NO: 98381 - protein, 11 aa, Dengue virus
NDLKYSWKTWG

SEQ ID NO: 98382 - protein, 11 aa, Dengue virus
WKTWGKARIFT

SEQ ID NO: 98383 - protein, 11 aa, Dengue virus
KTWGKAKIFAP

SEQ ID NO: 98384 - protein, 11 aa, Dengue virus
TWGKARIFTPE

SEQ ID NO: 98385 - protein, 11 aa, Dengue virus
WGKAKIFTPET

SEQ ID NO: 98386 - protein, 11 aa, Dengue virus
KNSTFLIDGPD

SEQ ID NO: 98387 - protein, 11 aa, Dengue virus
NSTFLVDGPDT

SEQ ID NO: 98388 - protein, 11 aa, Dengue virus
STFLVDGPDTS

SEQ ID NO: 98389 - protein, 11 aa, Dengue virus
TFLVDGPDTSE

SEQ ID NO: 98390 - protein, 11 aa, Dengue virus
FLVDGPDTSEC

SEQ ID NO: 98391 - protein, 11 aa, Dengue virus
LVDGPDTSECP

SEQ ID NO: 98392 - protein, 11 aa, Dengue virus
VDGPDTSECPN

SEQ ID NO: 98393 - protein, 11 aa, Dengue virus
ECPNERRAWNF

SEQ ID NO: 98394 - protein, 11 aa, Dengue virus
CPNERRAWNSF

SEQ ID NO: 98395 - protein, 11 aa, Dengue virus
PNERRAWNSFE

SEQ ID NO: 98396 - protein, 11 aa, Dengue virus
NERRAWNSFEV

SEQ ID NO: 98397 - protein, 11 aa, Dengue virus
ERRAWNSFEVE

SEQ ID NO: 98398 - protein, 11 aa, Dengue virus
RRAWNSFEVED

SEQ ID NO: 98399 - protein, 11 aa, Dengue virus
RAWNSFEVEDY

SEQ ID NO: 98400 - protein, 11 aa, Dengue virus
AWNSFEVEDYG

SEQ ID NO: 98401 - protein, 11 aa, Dengue virus
WNSFEVEDYGF

SEQ ID NO: 98402 - protein, 11 aa, Dengue virus
NSFEVEDYGFG

SEQ ID NO: 98403 - protein, 11 aa, Dengue virus
SFEVEDYGFGM

SEQ ID NO: 98404 - protein, 11 aa, Dengue virus
FEVEDYGFGMF

SEQ ID NO: 98405 - protein, 11 aa, Dengue virus
EDYGFGMFTTS

SEQ ID NO: 98406 - protein, 11 aa, Dengue virus
DYGFGMFTTSI

SEQ ID NO: 98407 - protein, 11 aa, Dengue virus
YGFGMFTTSIW

SEQ ID NO: 98408 - protein, 11 aa, Dengue virus
GFGMFTTSIWM

SEQ ID NO: 98409 - protein, 11 aa, Dengue virus
FGMFTTSIWMK

SEQ ID NO: 98410 - protein, 11 aa, Dengue virus
GMFTTSIWMKF

SEQ ID NO: 98411 - protein, 11 aa, Dengue virus
MFTTSIWMKFR

SEQ ID NO: 98412 - protein, 11 aa, Dengue virus
FTTSIWMKFRE

SEQ ID NO: 98413 - protein, 11 aa, Dengue virus
TTSIWMKFREG

SEQ ID NO: 98414 - protein, 11 aa, Dengue virus
TSIWMKFREGS

SEQ ID NO: 98415 - protein, 11 aa, Dengue virus
SIWMKFREGSS

SEQ ID NO: 98416 - protein, 11 aa, Dengue virus
WMKLREGSSEV

SEQ ID NO: 98417 - protein, 11 aa, Dengue virus
MKFREGSSELC

SEQ ID NO: 98418 - protein, 11 aa, Dengue virus
KLREGSSEVCD

SEQ ID NO: 98419 - protein, 11 aa, Dengue virus
LREGSSEVCDH

SEQ ID NO: 98420 - protein, 11 aa, Dengue virus
LCDHRLMSAAI

SEQ ID NO: 98421 - protein, 11 aa, Dengue virus
KAVHADMGYWL

SEQ ID NO: 98422 - protein, 11 aa, Dengue virus
SSKNQTWQIER

SEQ ID NO: 98423 - protein, 11 aa, Dengue virus
SKNQTWQIERA

SEQ ID NO: 98424 - protein, 11 aa, Dengue virus
KNQTWQIERAS

SEQ ID NO: 98425 - protein, 11 aa, Dengue virus
NQTWQIERASL

SEQ ID NO: 98426 - protein, 11 aa, Dengue virus
QTWQIERASLI

SEQ ID NO: 98427 - protein, 11 aa, Dengue virus
TWQIERASLIE

SEQ ID NO: 98428 - protein, 11 aa, Dengue virus
WQIERASLIEV

SEQ ID NO: 98429 - protein, 11 aa, Dengue virus
QIERASLIEVK

SEQ ID NO: 98430 - protein, 11 aa, Dengue virus
IERASLIEVKT

SEQ ID NO: 98431 - protein, 11 aa, Dengue virus
ERASLIEVKTC

SEQ ID NO: 98432 - protein, 11 aa, Dengue virus
RASLIEVKTCL

SEQ ID NO: 98433 - protein, 11 aa, Dengue virus
GVLESQMLIPR

SEQ ID NO: 98434 - protein, 11 aa, Dengue virus
VLESQMLIPRS

SEQ ID NO: 98435 - protein, 11 aa, Dengue virus
LESQMLIPRSY

SEQ ID NO: 98436 - protein, 11 aa, Dengue virus
ESQMLIPRSYA

SEQ ID NO: 98437 - protein, 11 aa, Dengue virus
SQMLIPRSYAG

SEQ ID NO: 98438 - protein, 11 aa, Dengue virus
QMLIPRSYAGP

SEQ ID NO: 98439 - protein, 11 aa, Dengue virus
MLIPRSYAGPF

SEQ ID NO: 98440 - protein, 11 aa, Dengue virus
LIPRSYAGPFS

SEQ ID NO: 98441 - protein, 11 aa, Dengue virus
IPRSYAGPFSQ

SEQ ID NO: 98442 - protein, 11 aa, Dengue virus
PRSYAGPFSQH

SEQ ID NO: 98443 - protein, 11 aa, Dengue virus
RSYAGPFSQHN

SEQ ID NO: 98444 - protein, 11 aa, Dengue virus
AYAGPFSQHNY

SEQ ID NO: 98445 - protein, 11 aa, Dengue virus
YAGPFSHHNYR

SEQ ID NO: 98446 - protein, 11 aa, Dengue virus
AGPFSHHNYRQ

SEQ ID NO: 98447 - protein, 11 aa, Dengue virus
GPFSHHNYRQG

SEQ ID NO: 98448 - protein, 11 aa, Dengue virus
PFSHHNYRQGY

SEQ ID NO: 98449 - protein, 11 aa, Dengue virus
FSHHNYRQGYA

SEQ ID NO: 98450 - protein, 11 aa, Dengue virus
SHHNYRQGYAT

SEQ ID NO: 98451 - protein, 11 aa, Dengue virus
HHNYRQGYATQ

SEQ ID NO: 98452 - protein, 11 aa, Dengue virus
HNYRQGYATQI

SEQ ID NO: 98453 - protein, 11 aa, Dengue virus
NYRQGYATQTM

SEQ ID NO: 98454 - protein, 11 aa, Dengue virus
YRQGYATQTMG

SEQ ID NO: 98455 - protein, 11 aa, Dengue virus
RQGYATQTMGP

SEQ ID NO: 98456 - protein, 11 aa, Dengue virus
QGYATQTMGPW

SEQ ID NO: 98457 - protein, 11 aa, Dengue virus
GYATQTMGPWH

SEQ ID NO: 98458 - protein, 11 aa, Dengue virus
YATQTMGPWHL

SEQ ID NO: 98459 - protein, 11 aa, Dengue virus
ATQTMGPWHLG

SEQ ID NO: 98460 - protein, 11 aa, Dengue virus
TQTMGPWHLGK

SEQ ID NO: 98461 - protein, 11 aa, Dengue virus
QTMGPWHLGKL

SEQ ID NO: 98462 - protein, 11 aa, Dengue virus
TMGPWHLGKLE

SEQ ID NO: 98463 - protein, 11 aa, Dengue virus
AGPWHLGKLEI

SEQ ID NO: 98464 - protein, 11 aa, Dengue virus
GPWHLGKLEIG

SEQ ID NO: 98465 - protein, 11 aa, Dengue virus
PWHLGKLEMDF

SEQ ID NO: 98466 - protein, 11 aa, Dengue virus
WHLGKLEIGFG

SEQ ID NO: 98467 - protein, 11 aa, Dengue virus
HLGKLEMDFGE

SEQ ID NO: 98468 - protein, 11 aa, Dengue virus
LGKLEIGFGEC

SEQ ID NO: 98469 - protein, 11 aa, Dengue virus
GKLEMDFGECP

SEQ ID NO: 98470 - protein, 11 aa, Dengue virus
KLEIGFGECPG

SEQ ID NO: 98471 - protein, 11 aa, Dengue virus
LEMDFGECPGT

SEQ ID NO: 98472 - protein, 11 aa, Dengue virus
EMDFGECPGTT

SEQ ID NO: 98473 - protein, 11 aa, Dengue virus
MDFGECPGTTV

SEQ ID NO: 98474 - protein, 11 aa, Dengue virus
DFGECPGTTVA

SEQ ID NO: 98475 - protein, 11 aa, Dengue virus
FGECPGTTVAI

SEQ ID NO: 98476 - protein, 11 aa, Dengue virus
GECPGTTVAIQ

SEQ ID NO: 98477 - protein, 11 aa, Dengue virus
ECPGTTVAIQE

SEQ ID NO: 98478 - protein, 11 aa, Dengue virus
CPGTTVTIQEN

SEQ ID NO: 98479 - protein, 11 aa, Dengue virus
PGTTVTIQENC

SEQ ID NO: 98480 - protein, 11 aa, Dengue virus
QENCDHRGPSL

SEQ ID NO: 98481 - protein, 11 aa, Dengue virus
ENCDHRGPSLR

SEQ ID NO: 98482 - protein, 11 aa, Dengue virus
NCDHRGPSLRT

SEQ ID NO: 98483 - protein, 11 aa, Dengue virus
CGHRGSSLRTT

SEQ ID NO: 98484 - protein, 11 aa, Dengue virus
GHRGSSLRTTT

SEQ ID NO: 98485 - protein, 11 aa, Dengue virus
HRGSSLRTTTA

SEQ ID NO: 98486 - protein, 11 aa, Dengue virus
RGSSLRTTTAS

SEQ ID NO: 98487 - protein, 11 aa, Dengue virus
GSSLRTTTASG

SEQ ID NO: 98488 - protein, 11 aa, Dengue virus
SSLRTTTASGK

SEQ ID NO: 98489 - protein, 11 aa, Dengue virus
CWYGMEIRPLN

SEQ ID NO: 98490 - protein, 11 aa, Dengue virus
WYGMEIRPLNE

SEQ ID NO: 98491 - protein, 11 aa, Dengue virus
YGMEIRPLNEK

SEQ ID NO: 98492 - protein, 11 aa, Dengue virus
GMEIRPLNEKE

SEQ ID NO: 98493 - protein, 11 aa, Dengue virus
MEIRPLNEKEE

SEQ ID NO: 98494 - protein, 11 aa, Dengue virus
EIRPLNEKEEN

SEQ ID NO: 98495 - protein, 11 aa, Dengue virus
IRPLNEKEENM

SEQ ID NO: 98496 - protein, 11 aa, Dengue virus
RPLNEKEENMV

SEQ ID NO: 98497 - protein, 11 aa, Dengue virus
PLNEKEENMVK

SEQ ID NO: 98498 - protein, 11 aa, Dengue virus
LNEKEENMVKS

SEQ ID NO: 98499 - protein, 11 aa, Dengue virus
NEKEENMVKSQ

SEQ ID NO: 98500 - protein, 11 aa, Dengue virus
EREENMVKSQV

SEQ ID NO: 98501 - protein, 11 aa, Dengue virus
EENMVKSQVAA

SEQ ID NO: 98502 - protein, 11 aa, Dengue virus
ENMVKSQVAAG

SEQ ID NO: 98503 - protein, 11 aa, Dengue virus
STSETFSMGLL

SEQ ID NO: 98504 - protein, 11 aa, Dengue virus
SSETFSMGLLC

SEQ ID NO: 98505 - protein, 11 aa, Dengue virus
PETFSMGLLCL

SEQ ID NO: 98506 - protein, 11 aa, Dengue virus
SMGLLCLTLFM

SEQ ID NO: 98507 - protein, 11 aa, Dengue virus
MGLLCLTLFME

SEQ ID NO: 98508 - protein, 11 aa, Dengue virus
GLLCLTLFMEE

SEQ ID NO: 98509 - protein, 11 aa, Dengue virus
LLCLTLFMEEC

SEQ ID NO: 98510 - protein, 11 aa, Dengue virus
LCLTLFMEECL

SEQ ID NO: 98511 - protein, 11 aa, Dengue virus
CLTLFMEECLR

SEQ ID NO: 98512 - protein, 11 aa, Dengue virus
LTLFMEECLRR

SEQ ID NO: 98513 - protein, 11 aa, Dengue virus
TLFMEECLRRR

SEQ ID NO: 98514 - protein, 11 aa, Dengue virus
LFMEECLRRRV

SEQ ID NO: 98515 - protein, 11 aa, Dengue virus
FMEECLRRRVT

SEQ ID NO: 98516 - protein, 11 aa, Dengue virus
MEECLRRRVTR

SEQ ID NO: 98517 - protein, 11 aa, Dengue virus
EECLRRKVTRK

SEQ ID NO: 98518 - protein, 11 aa, Dengue virus
ECLRRKVTRKH

SEQ ID NO: 98519 - protein, 11 aa, Dengue virus
CLRRKVTRKHM

SEQ ID NO: 98520 - protein, 11 aa, Dengue virus
LRRKVTRKHMI

SEQ ID NO: 98521 - protein, 11 aa, Dengue virus
RRKVTRKHMIL

SEQ ID NO: 98522 - protein, 11 aa, Dengue virus
RRVTRKHMILV

SEQ ID NO: 98523 - protein, 11 aa, Dengue virus
RVTRKHMILVV

SEQ ID NO: 98524 - protein, 11 aa, Dengue virus
VTRKHMILVVV

SEQ ID NO: 98525 - protein, 11 aa, Dengue virus
TRKHMILVVVI

SEQ ID NO: 98526 - protein, 11 aa, Dengue virus
RKHMILVVVIT

SEQ ID NO: 98527 - protein, 11 aa, Dengue virus
ITFCAIILGGL

SEQ ID NO: 98528 - protein, 11 aa, Dengue virus
TFCAIILGGLT

SEQ ID NO: 98529 - protein, 11 aa, Dengue virus
FCAIILGGLTW

SEQ ID NO: 98530 - protein, 11 aa, Dengue virus
GLTWMDLLRAI

SEQ ID NO: 98531 - protein, 11 aa, Dengue virus
LTWMDLLRAII

SEQ ID NO: 98532 - protein, 11 aa, Dengue virus
TWMDLLRAIIM

SEQ ID NO: 98533 - protein, 11 aa, Dengue virus
WMDLLRAIIML

SEQ ID NO: 98534 - protein, 11 aa, Dengue virus
MDLLRAIIMLG

SEQ ID NO: 98535 - protein, 11 aa, Dengue virus
DLLRAIIMLGD

SEQ ID NO: 98536 - protein, 11 aa, Dengue virus
LLRAIIMLGDT

SEQ ID NO: 98537 - protein, 11 aa, Dengue virus
LRAIIMLGDTM

SEQ ID NO: 98538 - protein, 11 aa, Dengue virus
RAIIMLGDTML

SEQ ID NO: 98539 - protein, 11 aa, Dengue virus
AIIMLGDTMLS

SEQ ID NO: 98540 - protein, 11 aa, Dengue virus
IIMLGDTMLSR

SEQ ID NO: 98541 - protein, 11 aa, Dengue virus
IMLGDTMSGRM

SEQ ID NO: 98542 - protein, 11 aa, Dengue virus
MLGDTMSGRMG

SEQ ID NO: 98543 - protein, 11 aa, Dengue virus
LGDTMSGRMGG

SEQ ID NO: 98544 - protein, 11 aa, Dengue virus
GDTMSGRMGGQ

SEQ ID NO: 98545 - protein, 11 aa, Dengue virus
RIGGQIHLAIM

SEQ ID NO: 98546 - protein, 11 aa, Dengue virus
GGQIHLAIMAV

SEQ ID NO: 98547 - protein, 11 aa, Dengue virus
GQIHLAIMAVF

SEQ ID NO: 98548 - protein, 11 aa, Dengue virus
QIHLAIMAVFK

SEQ ID NO: 98549 - protein, 11 aa, Dengue virus
IHLAIMAVFKM

SEQ ID NO: 98550 - protein, 11 aa, Dengue virus
HLAIMIVFKMS

SEQ ID NO: 98551 - protein, 11 aa, Dengue virus
LAIMIVFKMSP

SEQ ID NO: 98552 - protein, 11 aa, Dengue virus
AIMIVFKMSPG

SEQ ID NO: 98553 - protein, 11 aa, Dengue virus
IMIVFKMSPGY

SEQ ID NO: 98554 - protein, 11 aa, Dengue virus
MIVFKMSPGYV

SEQ ID NO: 98555 - protein, 11 aa, Dengue virus
IVFKMSPGYVL

SEQ ID NO: 98556 - protein, 11 aa, Dengue virus
FKMSPGYVLGI

SEQ ID NO: 98557 - protein, 11 aa, Dengue virus
KMSPGYVLGIF

SEQ ID NO: 98558 - protein, 11 aa, Dengue virus
MSPGYVLGIFL

SEQ ID NO: 98559 - protein, 11 aa, Dengue virus
SPGYVLGIFLR

SEQ ID NO: 98560 - protein, 11 aa, Dengue virus
PGYVLGIFLRK

SEQ ID NO: 98561 - protein, 11 aa, Dengue virus
GYVLGIFLRKL

SEQ ID NO: 98562 - protein, 11 aa, Dengue virus
YVLGIFLRKLT

SEQ ID NO: 98563 - protein, 11 aa, Dengue virus
VLGIFLRKLTS

SEQ ID NO: 98564 - protein, 11 aa, Dengue virus
LGIFLRKLTSR

SEQ ID NO: 98565 - protein, 11 aa, Dengue virus
GIFLRKLTSRE

SEQ ID NO: 98566 - protein, 11 aa, Dengue virus
IFLRKLTSRET

SEQ ID NO: 98567 - protein, 11 aa, Dengue virus
FLRRLTSRETA

SEQ ID NO: 98568 - protein, 11 aa, Dengue virus
LRRLTSRETAL

SEQ ID NO: 98569 - protein, 11 aa, Dengue virus
RRLTSRETALM

SEQ ID NO: 98570 - protein, 11 aa, Dengue virus
RLTSRETALMV

SEQ ID NO: 98571 - protein, 11 aa, Dengue virus
LMVIGMAMTTV

SEQ ID NO: 98572 - protein, 11 aa, Dengue virus
MVIGMAMTTVL

SEQ ID NO: 98573 - protein, 11 aa, Dengue virus
VIGMAMTTVLS

SEQ ID NO: 98574 - protein, 11 aa, Dengue virus
IGMAMTTVLSI

SEQ ID NO: 98575 - protein, 11 aa, Dengue virus
GMAMTTVLSIP

SEQ ID NO: 98576 - protein, 11 aa, Dengue virus
MAMTTVLSIPH

SEQ ID NO: 98577 - protein, 11 aa, Dengue virus
AMTTVLSIPHD

SEQ ID NO: 98578 - protein, 11 aa, Dengue virus
MTTVLSIPHDL

SEQ ID NO: 98579 - protein, 11 aa, Dengue virus
TTVLSIPHDLM

SEQ ID NO: 98580 - protein, 11 aa, Dengue virus
TVLSIPHDLME

SEQ ID NO: 98581 - protein, 11 aa, Dengue virus
VLSIPHDLMEL

SEQ ID NO: 98582 - protein, 11 aa, Dengue virus
FSIPHDLMELI

SEQ ID NO: 98583 - protein, 11 aa, Dengue virus
SIPHDLMEFID

SEQ ID NO: 98584 - protein, 11 aa, Dengue virus
IPHDLMEFIDG

SEQ ID NO: 98585 - protein, 11 aa, Dengue virus
PHDLMEFIDGI

SEQ ID NO: 98586 - protein, 11 aa, Dengue virus
HDLMEFIDGIS

SEQ ID NO: 98587 - protein, 11 aa, Dengue virus
DLMEFIDGISL

SEQ ID NO: 98588 - protein, 11 aa, Dengue virus
LMEFIDGISLG

SEQ ID NO: 98589 - protein, 11 aa, Dengue virus
MEFIDGISLGL

SEQ ID NO: 98590 - protein, 11 aa, Dengue virus
EFIDGISLGLI

SEQ ID NO: 98591 - protein, 11 aa, Dengue virus
FIDGISLGLIL

SEQ ID NO: 98592 - protein, 11 aa, Dengue virus
IDGIALGLILL

SEQ ID NO: 98593 - protein, 11 aa, Dengue virus
DGLSLGLILLK

SEQ ID NO: 98594 - protein, 11 aa, Dengue virus
GISLGLILLKM

SEQ ID NO: 98595 - protein, 11 aa, Dengue virus
ISLGLILLKMV

SEQ ID NO: 98596 - protein, 11 aa, Dengue virus
SLGLILLKMVT

SEQ ID NO: 98597 - protein, 11 aa, Dengue virus
LGLILLKIVTH

SEQ ID NO: 98598 - protein, 11 aa, Dengue virus
GLILLKIVTHF

SEQ ID NO: 98599 - protein, 11 aa, Dengue virus
LILLKIVTHFD

SEQ ID NO: 98600 - protein, 11 aa, Dengue virus
VTHFDNTQVGT

SEQ ID NO: 98601 - protein, 11 aa, Dengue virus
THFDNTQVGTL

SEQ ID NO: 98602 - protein, 11 aa, Dengue virus
HFDNTQVGTLA

SEQ ID NO: 98603 - protein, 11 aa, Dengue virus
FDDTQVGTLAL

SEQ ID NO: 98604 - protein, 11 aa, Dengue virus
DDTQVGTLALS

SEQ ID NO: 98605 - protein, 11 aa, Dengue virus
DTQVGTLALSL

SEQ ID NO: 98606 - protein, 11 aa, Dengue virus
TQVGTLALALT

SEQ ID NO: 98607 - protein, 11 aa, Dengue virus
QVGTLALALTF

SEQ ID NO: 98608 - protein, 11 aa, Dengue virus
LGTLALSLTFI

SEQ ID NO: 98609 - protein, 11 aa, Dengue virus
GTLALSLTFIK

SEQ ID NO: 98610 - protein, 11 aa, Dengue virus
TLALSLTFIKS

SEQ ID NO: 98611 - protein, 11 aa, Dengue virus
LALSLTFIKST

SEQ ID NO: 98612 - protein, 11 aa, Dengue virus
PLVMAWRTIMA

SEQ ID NO: 98613 - protein, 11 aa, Dengue virus
LIMAWRTIMAV

SEQ ID NO: 98614 - protein, 11 aa, Dengue virus
VMAWRTIMAVF

SEQ ID NO: 98615 - protein, 11 aa, Dengue virus
MAWRTIMAVFF

SEQ ID NO: 98616 - protein, 11 aa, Dengue virus
AWRTIMAVFFV

SEQ ID NO: 98617 - protein, 11 aa, Dengue virus
WRTIMAVFFVV

SEQ ID NO: 98618 - protein, 11 aa, Dengue virus
RTIMAVFFVVT

SEQ ID NO: 98619 - protein, 11 aa, Dengue virus
TIMAVFFVVTL

SEQ ID NO: 98620 - protein, 11 aa, Dengue virus
IMAVFFVVTLI

SEQ ID NO: 98621 - protein, 11 aa, Dengue virus
MAVFFVVTLIP

SEQ ID NO: 98622 - protein, 11 aa, Dengue virus
AVFFVVTLIPL

SEQ ID NO: 98623 - protein, 11 aa, Dengue virus
VFFVVTLIPLC

SEQ ID NO: 98624 - protein, 11 aa, Dengue virus
FFVVTLIPLCR

SEQ ID NO: 98625 - protein, 11 aa, Dengue virus
FAVTLIPLCRT

SEQ ID NO: 98626 - protein, 11 aa, Dengue virus
AVTLIPLCRTS

SEQ ID NO: 98627 - protein, 11 aa, Dengue virus
TSCLQKQSHWI

SEQ ID NO: 98628 - protein, 11 aa, Dengue virus
SCLQNQSHWVE

SEQ ID NO: 98629 - protein, 11 aa, Dengue virus
CLQNQSHWVEI

SEQ ID NO: 98630 - protein, 11 aa, Dengue virus
LQKQSHWIEIT

SEQ ID NO: 98631 - protein, 11 aa, Dengue virus
QNQSHWVEITA

SEQ ID NO: 98632 - protein, 11 aa, Dengue virus
KQSHWVEITAI

SEQ ID NO: 98633 - protein, 11 aa, Dengue virus
QSHWVEITAII

SEQ ID NO: 98634 - protein, 11 aa, Dengue virus
SHWVEITAIIL

SEQ ID NO: 98635 - protein, 11 aa, Dengue virus
HWVEITAIILG

SEQ ID NO: 98636 - protein, 11 aa, Dengue virus
WVEITAIILGA

SEQ ID NO: 98637 - protein, 11 aa, Dengue virus
VEITAIILGAQ

SEQ ID NO: 98638 - protein, 11 aa, Dengue virus
EITAIILGAQA

SEQ ID NO: 98639 - protein, 11 aa, Dengue virus
ITAIILGAQAL

SEQ ID NO: 98640 - protein, 11 aa, Dengue virus
TAIILGAQALP

SEQ ID NO: 98641 - protein, 11 aa, Dengue virus
AIILGAQALPV

SEQ ID NO: 98642 - protein, 11 aa, Dengue virus
IILGAQALPVY

SEQ ID NO: 98643 - protein, 11 aa, Dengue virus
TLGAQALPVYL

SEQ ID NO: 98644 - protein, 11 aa, Dengue virus
YLMTLMKGASK

SEQ ID NO: 98645 - protein, 11 aa, Dengue virus
LMTLMKGASKR

SEQ ID NO: 98646 - protein, 11 aa, Dengue virus
MTLMKGASKRS

SEQ ID NO: 98647 - protein, 11 aa, Dengue virus
TLMKGASKRSW

SEQ ID NO: 98648 - protein, 11 aa, Dengue virus
LMKGASKRSWP

SEQ ID NO: 98649 - protein, 11 aa, Dengue virus
MKGASKRSWPL

SEQ ID NO: 98650 - protein, 11 aa, Dengue virus
KGASKRSWPLN

SEQ ID NO: 98651 - protein, 11 aa, Dengue virus
GASKRSWPLNE

SEQ ID NO: 98652 - protein, 11 aa, Dengue virus
ASKRSWPLNEG

SEQ ID NO: 98653 - protein, 11 aa, Dengue virus
SKRSWPLNEGI

SEQ ID NO: 98654 - protein, 11 aa, Dengue virus
KRSWPLNEGIM

SEQ ID NO: 98655 - protein, 11 aa, Dengue virus
SGSSADLSLER

SEQ ID NO: 98656 - protein, 11 aa, Dengue virus
GSSADLSLERA

SEQ ID NO: 98657 - protein, 11 aa, Dengue virus
SSADLSLERAA

SEQ ID NO: 98658 - protein, 11 aa, Dengue virus
SADLSLEKAAS

SEQ ID NO: 98659 - protein, 11 aa, Dengue virus
ADLSLEKAASV

SEQ ID NO: 98660 - protein, 11 aa, Dengue virus
DLSLEKAASVQ

SEQ ID NO: 98661 - protein, 11 aa, Dengue virus
LSLEKAASVQW

SEQ ID NO: 98662 - protein, 11 aa, Dengue virus
SLEKAASVQWD

SEQ ID NO: 98663 - protein, 11 aa, Dengue virus
LEKAASVQWDE

SEQ ID NO: 98664 - protein, 11 aa, Dengue virus
EKAASVQWDEM

SEQ ID NO: 98665 - protein, 11 aa, Dengue virus
KAASVQWDEMA

SEQ ID NO: 98666 - protein, 11 aa, Dengue virus
AASVQWDEMAD

SEQ ID NO: 98667 - protein, 11 aa, Dengue virus
ASVQWDEMADI

SEQ ID NO: 98668 - protein, 11 aa, Dengue virus
SVQWDEMADIT

SEQ ID NO: 98669 - protein, 11 aa, Dengue virus
EMAAITGSSPI

SEQ ID NO: 98670 - protein, 11 aa, Dengue virus
MADITGSSPIV

SEQ ID NO: 98671 - protein, 11 aa, Dengue virus
ADITGSSPIVE

SEQ ID NO: 98672 - protein, 11 aa, Dengue virus
DITGSSPIVEV

SEQ ID NO: 98673 - protein, 11 aa, Dengue virus
ITGSSPIVEVK

SEQ ID NO: 98674 - protein, 11 aa, Dengue virus
TGSSPIVEVKQ

SEQ ID NO: 98675 - protein, 11 aa, Dengue virus
GSSPIVEVKQD

SEQ ID NO: 98676 - protein, 11 aa, Dengue virus
SSPIVEVKQDE

SEQ ID NO: 98677 - protein, 11 aa, Dengue virus
SPIVEVKQDED

SEQ ID NO: 98678 - protein, 11 aa, Dengue virus
PIVEVKQDEDG

SEQ ID NO: 98679 - protein, 11 aa, Dengue virus
IVEVKQDEDGS

SEQ ID NO: 98680 - protein, 11 aa, Dengue virus
VEVKQDEDGSF

SEQ ID NO: 98681 - protein, 11 aa, Dengue virus
DEDGSFSIRDI

SEQ ID NO: 98682 - protein, 11 aa, Dengue virus
EDGSFSIRDIE

SEQ ID NO: 98683 - protein, 11 aa, Dengue virus
DGSFSIRDIEE

SEQ ID NO: 98684 - protein, 11 aa, Dengue virus
GSFSIRDIEET

SEQ ID NO: 98685 - protein, 11 aa, Dengue virus
SFSIRDIEETN

SEQ ID NO: 98686 - protein, 11 aa, Dengue virus
FSIRDIEETNM

SEQ ID NO: 98687 - protein, 11 aa, Dengue virus
SIRDIEETNMI

SEQ ID NO: 98688 - protein, 11 aa, Dengue virus
IRDIEETNMIT

SEQ ID NO: 98689 - protein, 11 aa, Dengue virus
RDIEETNMITL

SEQ ID NO: 98690 - protein, 11 aa, Dengue virus
DIEETNMITLL

SEQ ID NO: 98691 - protein, 11 aa, Dengue virus
IEETNMITLLV

SEQ ID NO: 98692 - protein, 11 aa, Dengue virus
VSGLYPLAIPI

SEQ ID NO: 98693 - protein, 11 aa, Dengue virus
SGLYPLAIPIT

SEQ ID NO: 98694 - protein, 11 aa, Dengue virus
GLYPLAIPITM

SEQ ID NO: 98695 - protein, 11 aa, Dengue virus
LYPLAIPITMT

SEQ ID NO: 98696 - protein, 11 aa, Dengue virus
YPLAIPITMTL

SEQ ID NO: 98697 - protein, 11 aa, Dengue virus
PLAIPITMTLW

SEQ ID NO: 98698 - protein, 11 aa, Dengue virus
LAIPITMTLWY

SEQ ID NO: 98699 - protein, 11 aa, Dengue virus
AIPITMTLWYM

SEQ ID NO: 98700 - protein, 11 aa, Dengue virus
IPITMTLWYMW

SEQ ID NO: 98701 - protein, 11 aa, Dengue virus
PITMTLWYMWQ

SEQ ID NO: 98702 - protein, 11 aa, Dengue virus
ITMTLWYMWQV

SEQ ID NO: 98703 - protein, 11 aa, Dengue virus
TMALWYIWQVK

SEQ ID NO: 98704 - protein, 11 aa, Dengue virus
MALWYIWQVKT

SEQ ID NO: 98705 - protein, 11 aa, Dengue virus
ALWYIWQVKTQ

SEQ ID NO: 98706 - protein, 11 aa, Dengue virus
LWYIWQVKTQR

SEQ ID NO: 98707 - protein, 11 aa, Dengue virus
WYIWQVKTQRS

SEQ ID NO: 98708 - protein, 11 aa, Dengue virus
YIWQVKTQRSG

SEQ ID NO: 98709 - protein, 11 aa, Dengue virus
IWQVKTQRSGA

SEQ ID NO: 98710 - protein, 11 aa, Dengue virus
WQVRTQRSGAL

SEQ ID NO: 98711 - protein, 11 aa, Dengue virus
QVRTQRSGALW

SEQ ID NO: 98712 - protein, 11 aa, Dengue virus
VRTQRSGALWD

SEQ ID NO: 98713 - protein, 11 aa, Dengue virus
RTQRSGALWDV

SEQ ID NO: 98714 - protein, 11 aa, Dengue virus
GALWDVPSPAT

SEQ ID NO: 98715 - protein, 11 aa, Dengue virus
ALWDVPSPAAA

SEQ ID NO: 98716 - protein, 11 aa, Dengue virus
LWDVPSPAATK

SEQ ID NO: 98717 - protein, 11 aa, Dengue virus
WDVPSPAATKK

SEQ ID NO: 98718 - protein, 11 aa, Dengue virus
DVPSPAATKKA

SEQ ID NO: 98719 - protein, 11 aa, Dengue virus
TKKAALSEGVY

SEQ ID NO: 98720 - protein, 11 aa, Dengue virus
KKAALSEGVYR

SEQ ID NO: 98721 - protein, 11 aa, Dengue virus
KATLSEGVYRI

SEQ ID NO: 98722 - protein, 11 aa, Dengue virus
ATLSEGVYRIM

SEQ ID NO: 98723 - protein, 11 aa, Dengue virus
TLSEGVYRIMQ

SEQ ID NO: 98724 - protein, 11 aa, Dengue virus
LTEGVYRIMQR

SEQ ID NO: 98725 - protein, 11 aa, Dengue virus
TEGVYRIMQRG

SEQ ID NO: 98726 - protein, 11 aa, Dengue virus
GVYRIMQRGLL

SEQ ID NO: 98727 - protein, 11 aa, Dengue virus
VYRIMQRGLLG

SEQ ID NO: 98728 - protein, 11 aa, Dengue virus
YRIMQRGLLGK

SEQ ID NO: 98729 - protein, 11 aa, Dengue virus
RIMQRGLLGKT

SEQ ID NO: 98730 - protein, 11 aa, Dengue virus
IMQRGLLGKTQ

SEQ ID NO: 98731 - protein, 11 aa, Dengue virus
MQRGLLGKTQV

SEQ ID NO: 98732 - protein, 11 aa, Dengue virus
QRGLLGKTQVG

SEQ ID NO: 98733 - protein, 11 aa, Dengue virus
RGLLGKTQVGV

SEQ ID NO: 98734 - protein, 11 aa, Dengue virus
GLLGKTQVGVG

SEQ ID NO: 98735 - protein, 11 aa, Dengue virus
LLGKTQVGVGI

SEQ ID NO: 98736 - protein, 11 aa, Dengue virus
LGKTQVGVGIH

SEQ ID NO: 98737 - protein, 11 aa, Dengue virus
GKTQVGVGIHI

SEQ ID NO: 98738 - protein, 11 aa, Dengue virus
KTQVGVGIHIE

SEQ ID NO: 98739 - protein, 11 aa, Dengue virus
TQVGVGIHIEG

SEQ ID NO: 98740 - protein, 11 aa, Dengue virus
QVGVGIHIEGV

SEQ ID NO: 98741 - protein, 11 aa, Dengue virus
VGVGIHIEGVF

SEQ ID NO: 98742 - protein, 11 aa, Dengue virus
GVGIHIEGVFH

SEQ ID NO: 98743 - protein, 11 aa, Dengue virus
VGIHIEGVFHT

SEQ ID NO: 98744 - protein, 11 aa, Dengue virus
GIHIEGVFHTM

SEQ ID NO: 98745 - protein, 11 aa, Dengue virus
IHIEGVFHTMW

SEQ ID NO: 98746 - protein, 11 aa, Dengue virus
HIEGVFHTMWH

SEQ ID NO: 98747 - protein, 11 aa, Dengue virus
IEGVFHTMWHV

SEQ ID NO: 98748 - protein, 11 aa, Dengue virus
VTRGSVICHES

SEQ ID NO: 98749 - protein, 11 aa, Dengue virus
TRGSVICHESG

SEQ ID NO: 98750 - protein, 11 aa, Dengue virus
RGSVICHESGR

SEQ ID NO: 98751 - protein, 11 aa, Dengue virus
GSVICHESGRL

SEQ ID NO: 98752 - protein, 11 aa, Dengue virus
SVICHESGRLE

SEQ ID NO: 98753 - protein, 11 aa, Dengue virus
VICHESGRLEP

SEQ ID NO: 98754 - protein, 11 aa, Dengue virus
ICHESGRLEPS

SEQ ID NO: 98755 - protein, 11 aa, Dengue virus
CHESGRLEPSW

SEQ ID NO: 98756 - protein, 11 aa, Dengue virus
HESGRLEPSWA

SEQ ID NO: 98757 - protein, 11 aa, Dengue virus
ESGRLEPSWAD

SEQ ID NO: 98758 - protein, 11 aa, Dengue virus
SGRLEPSWADV

SEQ ID NO: 98759 - protein, 11 aa, Dengue virus
GGWRLGDKWDR

SEQ ID NO: 98760 - protein, 11 aa, Dengue virus
GWRLGDKWDRE

SEQ ID NO: 98761 - protein, 11 aa, Dengue virus
WRLGDKWDREE

SEQ ID NO: 98762 - protein, 11 aa, Dengue virus
RLGDKWDREED

SEQ ID NO: 98763 - protein, 11 aa, Dengue virus
LGDKWDREEDV

SEQ ID NO: 98764 - protein, 11 aa, Dengue virus
GDKWDREEDVQ

SEQ ID NO: 98765 - protein, 11 aa, Dengue virus
DKWDREEDVQV

SEQ ID NO: 98766 - protein, 11 aa, Dengue virus
KWDREEDVQVL

SEQ ID NO: 98767 - protein, 11 aa, Dengue virus
WDREEDVQVLA

SEQ ID NO: 98768 - protein, 11 aa, Dengue virus
DREEDVQVLAI

SEQ ID NO: 98769 - protein, 11 aa, Dengue virus
REEDVQVLAIE

SEQ ID NO: 98770 - protein, 11 aa, Dengue virus
EEDVQVLAVEP

SEQ ID NO: 98771 - protein, 11 aa, Dengue virus
EDVQVLAVEPG

SEQ ID NO: 98772 - protein, 11 aa, Dengue virus
DVQVLAVEPGK

SEQ ID NO: 98773 - protein, 11 aa, Dengue virus
VQVLAVEPGKN

SEQ ID NO: 98774 - protein, 11 aa, Dengue virus
QVLAVEPGKNP

SEQ ID NO: 98775 - protein, 11 aa, Dengue virus
VLAVEPGKNPK

SEQ ID NO: 98776 - protein, 11 aa, Dengue virus
LAVEPGKNPKH

SEQ ID NO: 98777 - protein, 11 aa, Dengue virus
AVEPGKNPKHV

SEQ ID NO: 98778 - protein, 11 aa, Dengue virus
VEPGKNPKHVQ

SEQ ID NO: 98779 - protein, 11 aa, Dengue virus
VQTKPGLFKTI

SEQ ID NO: 98780 - protein, 11 aa, Dengue virus
QTKPGLFKTIT

SEQ ID NO: 98781 - protein, 11 aa, Dengue virus
TKPGLFKTITG

SEQ ID NO: 98782 - protein, 11 aa, Dengue virus
KPGLFKTITGE

SEQ ID NO: 98783 - protein, 11 aa, Dengue virus
PGLFKTITGEI

SEQ ID NO: 98784 - protein, 11 aa, Dengue virus
GLFKTITGEIG

SEQ ID NO: 98785 - protein, 11 aa, Dengue virus
LFKTITGEIGA

SEQ ID NO: 98786 - protein, 11 aa, Dengue virus
FKTITGEIGAV

SEQ ID NO: 98787 - protein, 11 aa, Dengue virus
KTITGEIGAVT

SEQ ID NO: 98788 - protein, 11 aa, Dengue virus
TITGEIGAVTL

SEQ ID NO: 98789 - protein, 11 aa, Dengue virus
ITGEIGAVTLD

SEQ ID NO: 98790 - protein, 11 aa, Dengue virus
FKPGTSGSPIV

SEQ ID NO: 98791 - protein, 11 aa, Dengue virus
KPGTSGSPIVN

SEQ ID NO: 98792 - protein, 11 aa, Dengue virus
PGTSGSPIINK

SEQ ID NO: 98793 - protein, 11 aa, Dengue virus
GTSGSPIINKK

SEQ ID NO: 98794 - protein, 11 aa, Dengue virus
TSGSPIINKKG

SEQ ID NO: 98795 - protein, 11 aa, Dengue virus
SGSPIINKKGK

SEQ ID NO: 98796 - protein, 11 aa, Dengue virus
GSPIINKKGKV

SEQ ID NO: 98797 - protein, 11 aa, Dengue virus
SPIINKKGKVI

SEQ ID NO: 98798 - protein, 11 aa, Dengue virus
PIINKKGKVIG

SEQ ID NO: 98799 - protein, 11 aa, Dengue virus
IINKKGKVIGL

SEQ ID NO: 98800 - protein, 11 aa, Dengue virus
INKKGKVIGLY

SEQ ID NO: 98801 - protein, 11 aa, Dengue virus
NKKGKVIGLYG

SEQ ID NO: 98802 - protein, 11 aa, Dengue virus
KKGKVIGLYGN

SEQ ID NO: 98803 - protein, 11 aa, Dengue virus
YVSAITQAERT

SEQ ID NO: 98804 - protein, 11 aa, Dengue virus
VSAITQAERTG

SEQ ID NO: 98805 - protein, 11 aa, Dengue virus
SAITQAERTGE

SEQ ID NO: 98806 - protein, 11 aa, Dengue virus
AITQAERTGEP

SEQ ID NO: 98807 - protein, 11 aa, Dengue virus
ITQAERTGEPD

SEQ ID NO: 98808 - protein, 11 aa, Dengue virus
TQAERTGEPDY

SEQ ID NO: 98809 - protein, 11 aa, Dengue virus
QAERTGEPDYE

SEQ ID NO: 98810 - protein, 11 aa, Dengue virus
AERTGEPDYEV

SEQ ID NO: 98811 - protein, 11 aa, Dengue virus
ERTGEPDYEVD

SEQ ID NO: 98812 - protein, 11 aa, Dengue virus
RTGEPDYEVDE

SEQ ID NO: 98813 - protein, 11 aa, Dengue virus
TGEPDYEVDED

SEQ ID NO: 98814 - protein, 11 aa, Dengue virus
PIRYQTPAVKA

SEQ ID NO: 98815 - protein, 11 aa, Dengue virus
IRYQTPAVKSD

SEQ ID NO: 98816 - protein, 11 aa, Dengue virus
RYQTPAVKAEH

SEQ ID NO: 98817 - protein, 11 aa, Dengue virus
YQTPAVKSDHT

SEQ ID NO: 98818 - protein, 11 aa, Dengue virus
QTPAVKAEHTG

SEQ ID NO: 98819 - protein, 11 aa, Dengue virus
TPAVKAEHTGR

SEQ ID NO: 98820 - protein, 11 aa, Dengue virus
PAVKSDHTGRE

SEQ ID NO: 98821 - protein, 11 aa, Dengue virus
AVKAEHTGREI

SEQ ID NO: 98822 - protein, 11 aa, Dengue virus
VKAEHTGREIV

SEQ ID NO: 98823 - protein, 11 aa, Dengue virus
KSDHTGREIVD

SEQ ID NO: 98824 - protein, 11 aa, Dengue virus
SDHTGREIVDL

SEQ ID NO: 98825 - protein, 11 aa, Dengue virus
DLMCHATFTTK

SEQ ID NO: 98826 - protein, 11 aa, Dengue virus
LMCHATFTTKL

SEQ ID NO: 98827 - protein, 11 aa, Dengue virus
MCHATFTTKLL

SEQ ID NO: 98828 - protein, 11 aa, Dengue virus
CHATFTTKLLS

SEQ ID NO: 98829 - protein, 11 aa, Dengue virus
HATFTTKLLSS

SEQ ID NO: 98830 - protein, 11 aa, Dengue virus
ATFTTKLLSST

SEQ ID NO: 98831 - protein, 11 aa, Dengue virus
TFTTKLLSSTR

SEQ ID NO: 98832 - protein, 11 aa, Dengue virus
FTTKLLSSTRV

SEQ ID NO: 98833 - protein, 11 aa, Dengue virus
TTKLLSSTRVP

SEQ ID NO: 98834 - protein, 11 aa, Dengue virus
TKLLSSTRVPN

SEQ ID NO: 98835 - protein, 11 aa, Dengue virus
KLLSSTRVPNY

SEQ ID NO: 98836 - protein, 11 aa, Dengue virus
VMDEAHFTDPC

SEQ ID NO: 98837 - protein, 11 aa, Dengue virus
MDEAHFTDPCS

SEQ ID NO: 98838 - protein, 11 aa, Dengue virus
DEAHFTDPCSV

SEQ ID NO: 98839 - protein, 11 aa, Dengue virus
EAHFTDPCSVA

SEQ ID NO: 98840 - protein, 11 aa, Dengue virus
AHFTDPCSVAA

SEQ ID NO: 98841 - protein, 11 aa, Dengue virus
HFTDPCSVAAR

SEQ ID NO: 98842 - protein, 11 aa, Dengue virus
FTDPCSVAARG

SEQ ID NO: 98843 - protein, 11 aa, Dengue virus
TDPCSVAARGY

SEQ ID NO: 98844 - protein, 11 aa, Dengue virus
DPCSVAARGYI

SEQ ID NO: 98845 - protein, 11 aa, Dengue virus
PCSVAARGYIS

SEQ ID NO: 98846 - protein, 11 aa, Dengue virus
CSVAARGYIST

SEQ ID NO: 98847 - protein, 11 aa, Dengue virus
AIFMTATPPGS

SEQ ID NO: 98848 - protein, 11 aa, Dengue virus
IFMTATPPGSI

SEQ ID NO: 98849 - protein, 11 aa, Dengue virus
FMTATPPGSID

SEQ ID NO: 98850 - protein, 11 aa, Dengue virus
MTATPPGSIDP

SEQ ID NO: 98851 - protein, 11 aa, Dengue virus
TATPPGSIDPF

SEQ ID NO: 98852 - protein, 11 aa, Dengue virus
ATPPGSIDPFP

SEQ ID NO: 98853 - protein, 11 aa, Dengue virus
TPPGSIDPFPQ

SEQ ID NO: 98854 - protein, 11 aa, Dengue virus
PPGSIDPFPQS

SEQ ID NO: 98855 - protein, 11 aa, Dengue virus
PGSIDPFPQSN

SEQ ID NO: 98856 - protein, 11 aa, Dengue virus
GSIDPFPQSNS

SEQ ID NO: 98857 - protein, 11 aa, Dengue virus
SIDPFPQSNSP

SEQ ID NO: 98858 - protein, 11 aa, Dengue virus
IDPFPQSNSPI

SEQ ID NO: 98859 - protein, 11 aa, Dengue virus
IANCLRKSGKR

SEQ ID NO: 98860 - protein, 11 aa, Dengue virus
ANCLRKSGKRV

SEQ ID NO: 98861 - protein, 11 aa, Dengue virus
NCLRKSGKRVI

SEQ ID NO: 98862 - protein, 11 aa, Dengue virus
CLRKSGKRVIQ

SEQ ID NO: 98863 - protein, 11 aa, Dengue virus
LRKSGKRVIQL

SEQ ID NO: 98864 - protein, 11 aa, Dengue virus
RKSGKRVIQLS

SEQ ID NO: 98865 - protein, 11 aa, Dengue virus
KSGKRVIQLSR

SEQ ID NO: 98866 - protein, 11 aa, Dengue virus
SGKRVIQLSRK

SEQ ID NO: 98867 - protein, 11 aa, Dengue virus
GKRVIQLSRKT

SEQ ID NO: 98868 - protein, 11 aa, Dengue virus
KRVIQLSRKTF

SEQ ID NO: 98869 - protein, 11 aa, Dengue virus
RVIQLSRKTFD

SEQ ID NO: 98870 - protein, 11 aa, Dengue virus
DPRRCLKPVIS

SEQ ID NO: 98871 - protein, 11 aa, Dengue virus
PRRCLKPVILP

SEQ ID NO: 98872 - protein, 11 aa, Dengue virus
RRCLKPVILPD

SEQ ID NO: 98873 - protein, 11 aa, Dengue virus
RCLKPVILPDG

SEQ ID NO: 98874 - protein, 11 aa, Dengue virus
CLKPVILPDGP

SEQ ID NO: 98875 - protein, 11 aa, Dengue virus
LKPVILPDGPE

SEQ ID NO: 98876 - protein, 11 aa, Dengue virus
KPVILPDGPER

SEQ ID NO: 98877 - protein, 11 aa, Dengue virus
PVILPDGPERV

SEQ ID NO: 98878 - protein, 11 aa, Dengue virus
VILPDGPERVI

SEQ ID NO: 98879 - protein, 11 aa, Dengue virus
ILPDGPERVIL

SEQ ID NO: 98880 - protein, 11 aa, Dengue virus
LPDGPERVILA

SEQ ID NO: 98881 - protein, 11 aa, Dengue virus
PDGPERVILAG

SEQ ID NO: 98882 - protein, 11 aa, Dengue virus
AQRRGRIGRNL

SEQ ID NO: 98883 - protein, 11 aa, Dengue virus
QRRGRIGRNLA

SEQ ID NO: 98884 - protein, 11 aa, Dengue virus
RRGRIGRNLAQ

SEQ ID NO: 98885 - protein, 11 aa, Dengue virus
RGRIGRNLAQE

SEQ ID NO: 98886 - protein, 11 aa, Dengue virus
GRIGRNLAQED

SEQ ID NO: 98887 - protein, 11 aa, Dengue virus
RIGRNLAQEDD

SEQ ID NO: 98888 - protein, 11 aa, Dengue virus
IGRNLAQEDDQ

SEQ ID NO: 98889 - protein, 11 aa, Dengue virus
GRNLAQEDDQY

SEQ ID NO: 98890 - protein, 11 aa, Dengue virus
RNLAQEDDQYV

SEQ ID NO: 98891 - protein, 11 aa, Dengue virus
NLAQEDDQYVF

SEQ ID NO: 98892 - protein, 11 aa, Dengue virus
LAQEDDQYVFS

SEQ ID NO: 98893 - protein, 11 aa, Dengue virus
TQEDDQYVFSG

SEQ ID NO: 98894 - protein, 11 aa, Dengue virus
DQYVFSGDPLR

SEQ ID NO: 98895 - protein, 11 aa, Dengue virus
QYVFSGDPLRN

SEQ ID NO: 98896 - protein, 11 aa, Dengue virus
YVFSGDPLRND

SEQ ID NO: 98897 - protein, 11 aa, Dengue virus
VFSGDPLRNDE

SEQ ID NO: 98898 - protein, 11 aa, Dengue virus
FSGDPLRNDED

SEQ ID NO: 98899 - protein, 11 aa, Dengue virus
SGDPLRNDEDH

SEQ ID NO: 98900 - protein, 11 aa, Dengue virus
GDPLRNDEDHA

SEQ ID NO: 98901 - protein, 11 aa, Dengue virus
DPLRNDEDHAH

SEQ ID NO: 98902 - protein, 11 aa, Dengue virus
PLRNDEDHAHW

SEQ ID NO: 98903 - protein, 11 aa, Dengue virus
LRNDEDHAHWT

SEQ ID NO: 98904 - protein, 11 aa, Dengue virus
RNDEDHAHWTE

SEQ ID NO: 98905 - protein, 11 aa, Dengue virus
PTLFGPEREKN

SEQ ID NO: 98906 - protein, 11 aa, Dengue virus
TLFGPEREKNQ

SEQ ID NO: 98907 - protein, 11 aa, Dengue virus
LFGPEREKNQA

SEQ ID NO: 98908 - protein, 11 aa, Dengue virus
FGPEREKNQAI

SEQ ID NO: 98909 - protein, 11 aa, Dengue virus
GPEREKNQAID

SEQ ID NO: 98910 - protein, 11 aa, Dengue virus
PEREKNQAIDG

SEQ ID NO: 98911 - protein, 11 aa, Dengue virus
EREKNQAIDGE

SEQ ID NO: 98912 - protein, 11 aa, Dengue virus
REKNQAIDGEF

SEQ ID NO: 98913 - protein, 11 aa, Dengue virus
EKNQAIDGEFR

SEQ ID NO: 98914 - protein, 11 aa, Dengue virus
KNQAIDGEFRL

SEQ ID NO: 98915 - protein, 11 aa, Dengue virus
NQAIDGEFRLR

SEQ ID NO: 98916 - protein, 11 aa, Dengue virus
EQRKTFVELMK

SEQ ID NO: 98917 - protein, 11 aa, Dengue virus
QRKTFVELMKR

SEQ ID NO: 98918 - protein, 11 aa, Dengue virus
RKTFVELMKRG

SEQ ID NO: 98919 - protein, 11 aa, Dengue virus
KTFVELMKRGD

SEQ ID NO: 98920 - protein, 11 aa, Dengue virus
TFVELMKRGDL

SEQ ID NO: 98921 - protein, 11 aa, Dengue virus
FVELMKRGDLP

SEQ ID NO: 98922 - protein, 11 aa, Dengue virus
VELMKRGDLPV

SEQ ID NO: 98923 - protein, 11 aa, Dengue virus
ELMKRGDLPVW

SEQ ID NO: 98924 - protein, 11 aa, Dengue virus
LMKRGDLPVWL

SEQ ID NO: 98925 - protein, 11 aa, Dengue virus
MKRGDLPVWLS

SEQ ID NO: 98926 - protein, 11 aa, Dengue virus
KRGDLPVWLSY

SEQ ID NO: 98927 - protein, 11 aa, Dengue virus
YKVASAGISYE

SEQ ID NO: 98928 - protein, 11 aa, Dengue virus
KVASAGISYED

SEQ ID NO: 98929 - protein, 11 aa, Dengue virus
VASAGISYEDR

SEQ ID NO: 98930 - protein, 11 aa, Dengue virus
ASAGISYEDRE

SEQ ID NO: 98931 - protein, 11 aa, Dengue virus
SAGISYEDREW

SEQ ID NO: 98932 - protein, 11 aa, Dengue virus
AGISYEDREWC

SEQ ID NO: 98933 - protein, 11 aa, Dengue virus
GISYEDREWCF

SEQ ID NO: 98934 - protein, 11 aa, Dengue virus
ISYEDREWCFT

SEQ ID NO: 98935 - protein, 11 aa, Dengue virus
SYEDREWCFTG

SEQ ID NO: 98936 - protein, 11 aa, Dengue virus
YEDREWCFTGE

SEQ ID NO: 98937 - protein, 11 aa, Dengue virus
EDREWCFTGER

SEQ ID NO: 98938 - protein, 11 aa, Dengue virus
REGEKKKLRPK

SEQ ID NO: 98939 - protein, 11 aa, Dengue virus
EGEKKKLRPKW

SEQ ID NO: 98940 - protein, 11 aa, Dengue virus
GEKKKLRPKWL

SEQ ID NO: 98941 - protein, 11 aa, Dengue virus
EKKKLRPKWLD

SEQ ID NO: 98942 - protein, 11 aa, Dengue virus
KKKLRPKWLDA

SEQ ID NO: 98943 - protein, 11 aa, Dengue virus
KKLRPKWLDAR

SEQ ID NO: 98944 - protein, 11 aa, Dengue virus
KLRPKWLDARV

SEQ ID NO: 98945 - protein, 11 aa, Dengue virus
LRPKWLDARVY

SEQ ID NO: 98946 - protein, 11 aa, Dengue virus
RPKWLDARVYA

SEQ ID NO: 98947 - protein, 11 aa, Dengue virus
PKWLDARVYAD

SEQ ID NO: 98948 - protein, 11 aa, Dengue virus
KWLDARVYADP

SEQ ID NO: 98949 - protein, 11 aa, Dengue virus
ITLDILTEIAT

SEQ ID NO: 98950 - protein, 11 aa, Dengue virus
TLDILTEIATL

SEQ ID NO: 98951 - protein, 11 aa, Dengue virus
LDILTEIATLP

SEQ ID NO: 98952 - protein, 11 aa, Dengue virus
DILTEIATLPT

SEQ ID NO: 98953 - protein, 11 aa, Dengue virus
ILTEIATLPTY

SEQ ID NO: 98954 - protein, 11 aa, Dengue virus
LTEIATLPTYL

SEQ ID NO: 98955 - protein, 11 aa, Dengue virus
TEIATLPTYLS

SEQ ID NO: 98956 - protein, 11 aa, Dengue virus
EIATLPTYLSS

SEQ ID NO: 98957 - protein, 11 aa, Dengue virus
IATLPTYLSSK

SEQ ID NO: 98958 - protein, 11 aa, Dengue virus
ATLPTYLSSKA

SEQ ID NO: 98959 - protein, 11 aa, Dengue virus
TLPTYLSSKAK

SEQ ID NO: 98960 - protein, 11 aa, Dengue virus
LPTYLSSKAKL

SEQ ID NO: 98961 - protein, 11 aa, Dengue virus
PTYLSSKAKLA

SEQ ID NO: 98962 - protein, 11 aa, Dengue virus
TYLSSKAKLAL

SEQ ID NO: 98963 - protein, 11 aa, Dengue virus
YLSSKAKLALD

SEQ ID NO: 98964 - protein, 11 aa, Dengue virus
LSSKAKLALDN

SEQ ID NO: 98965 - protein, 11 aa, Dengue virus
SSKAKLALDNI

SEQ ID NO: 98966 - protein, 11 aa, Dengue virus
SKAKLALDNIV

SEQ ID NO: 98967 - protein, 11 aa, Dengue virus
KAKLALDNIVM

SEQ ID NO: 98968 - protein, 11 aa, Dengue virus
DNIVMLHTTEK

SEQ ID NO: 98969 - protein, 11 aa, Dengue virus
NIVMLHTTEKG

SEQ ID NO: 98970 - protein, 11 aa, Dengue virus
IVMLHTTEKGG

SEQ ID NO: 98971 - protein, 11 aa, Dengue virus
VMLHTTEKGGR

SEQ ID NO: 98972 - protein, 11 aa, Dengue virus
MLHTTEKGGRA

SEQ ID NO: 98973 - protein, 11 aa, Dengue virus
LHTTEKGGRAY

SEQ ID NO: 98974 - protein, 11 aa, Dengue virus
HTTEKGGRAYQ

SEQ ID NO: 98975 - protein, 11 aa, Dengue virus
TTEKGGRAYQH

SEQ ID NO: 98976 - protein, 11 aa, Dengue virus
TEKGGRAYQHA

SEQ ID NO: 98977 - protein, 11 aa, Dengue virus
EKGGRAYQHAL

SEQ ID NO: 98978 - protein, 11 aa, Dengue virus
KGGRAYQHALN

SEQ ID NO: 98979 - protein, 11 aa, Dengue virus
GGKAYQHALNE

SEQ ID NO: 98980 - protein, 11 aa, Dengue virus
GKAYQHALNEL

SEQ ID NO: 98981 - protein, 11 aa, Dengue virus
KAYQHALNELP

SEQ ID NO: 98982 - protein, 11 aa, Dengue virus
LPESLETLMLI

SEQ ID NO: 98983 - protein, 11 aa, Dengue virus
PESLETLMLIA

SEQ ID NO: 98984 - protein, 11 aa, Dengue virus
ESLETLMLIAL

SEQ ID NO: 98985 - protein, 11 aa, Dengue virus
SLETLMLIALL

SEQ ID NO: 98986 - protein, 11 aa, Dengue virus
LETLMLIALLG

SEQ ID NO: 98987 - protein, 11 aa, Dengue virus
ETLMLIALLGA

SEQ ID NO: 98988 - protein, 11 aa, Dengue virus
TLMLIALLGAM

SEQ ID NO: 98989 - protein, 11 aa, Dengue virus
LMLIALLGAMT

SEQ ID NO: 98990 - protein, 11 aa, Dengue virus
MLIALLGAMTA

SEQ ID NO: 98991 - protein, 11 aa, Dengue virus
LIALLGAMTAG

SEQ ID NO: 98992 - protein, 11 aa, Dengue virus
VALLGAMTAGT

SEQ ID NO: 98993 - protein, 11 aa, Dengue virus
ALLGAMTAGTF

SEQ ID NO: 98994 - protein, 11 aa, Dengue virus
LLGAMTAGTFL

SEQ ID NO: 98995 - protein, 11 aa, Dengue virus
LGAMTAGTFLF

SEQ ID NO: 98996 - protein, 11 aa, Dengue virus
GAMTAGTFLFF

SEQ ID NO: 98997 - protein, 11 aa, Dengue virus
AMTAGTFLFFM

SEQ ID NO: 98998 - protein, 11 aa, Dengue virus
MTAGTFLFFMQ

SEQ ID NO: 98999 - protein, 11 aa, Dengue virus
TAGTFLFFMQG

SEQ ID NO: 99000 - protein, 11 aa, Dengue virus
AGTFLFFMQGK

SEQ ID NO: 99001 - protein, 11 aa, Dengue virus
GTFLFFMQGKG

SEQ ID NO: 99002 - protein, 11 aa, Dengue virus
TFLFFMQGKGI

SEQ ID NO: 99003 - protein, 11 aa, Dengue virus
FLFFMQGKGMG

SEQ ID NO: 99004 - protein, 11 aa, Dengue virus
LFFMQGKGMGK

SEQ ID NO: 99005 - protein, 11 aa, Dengue virus
FFMQGKGMGKL

SEQ ID NO: 99006 - protein, 11 aa, Dengue virus
FMQGKGMGKLS

SEQ ID NO: 99007 - protein, 11 aa, Dengue virus
MQGKGIGKLSV

SEQ ID NO: 99008 - protein, 11 aa, Dengue virus
QGKGMGKLSMG

SEQ ID NO: 99009 - protein, 11 aa, Dengue virus
GKGIGKLSVGL

SEQ ID NO: 99010 - protein, 11 aa, Dengue virus
KGMGKLSMGLI

SEQ ID NO: 99011 - protein, 11 aa, Dengue virus
GIGKLSMGLIA

SEQ ID NO: 99012 - protein, 11 aa, Dengue virus
IGKLSMGLIAI

SEQ ID NO: 99013 - protein, 11 aa, Dengue virus
GKLSMGLIAIA

SEQ ID NO: 99014 - protein, 11 aa, Dengue virus
KLSMGLIAIAV

SEQ ID NO: 99015 - protein, 11 aa, Dengue virus
LSMGLIAIAVA

SEQ ID NO: 99016 - protein, 11 aa, Dengue virus
SMGLIAIAVAS

SEQ ID NO: 99017 - protein, 11 aa, Dengue virus
MGLIAIAVASG

SEQ ID NO: 99018 - protein, 11 aa, Dengue virus
GLIAIAVASGL

SEQ ID NO: 99019 - protein, 11 aa, Dengue virus
LIAIAVASGLL

SEQ ID NO: 99020 - protein, 11 aa, Dengue virus
IAIAVASGLLW

SEQ ID NO: 99021 - protein, 11 aa, Dengue virus
AIAVASGLLWV

SEQ ID NO: 99022 - protein, 11 aa, Dengue virus
IAMASGLLWIA

SEQ ID NO: 99023 - protein, 11 aa, Dengue virus
AMASGLLWIAE

SEQ ID NO: 99024 - protein, 11 aa, Dengue virus
MASGLLWIAEI

SEQ ID NO: 99025 - protein, 11 aa, Dengue virus
ASGLLWIAEIQ

SEQ ID NO: 99026 - protein, 11 aa, Dengue virus
SGLLWIAEIQP

SEQ ID NO: 99027 - protein, 11 aa, Dengue virus
GLLWIAEIQPQ

SEQ ID NO: 99028 - protein, 11 aa, Dengue virus
LLWIAEIQPQW

SEQ ID NO: 99029 - protein, 11 aa, Dengue virus
LWIAEIQPQWI

SEQ ID NO: 99030 - protein, 11 aa, Dengue virus
WIAEIQPQWIA

SEQ ID NO: 99031 - protein, 11 aa, Dengue virus
IAEIQPQWIAA

SEQ ID NO: 99032 - protein, 11 aa, Dengue virus
AELQPQWIAAS

SEQ ID NO: 99033 - protein, 11 aa, Dengue virus
ELQPQWIAASI

SEQ ID NO: 99034 - protein, 11 aa, Dengue virus
LQPQWIAASII

SEQ ID NO: 99035 - protein, 11 aa, Dengue virus
ILEFFLMVLLV

SEQ ID NO: 99036 - protein, 11 aa, Dengue virus
LEFFLMVLLVP

SEQ ID NO: 99037 - protein, 11 aa, Dengue virus
EFFLMVLLVPE

SEQ ID NO: 99038 - protein, 11 aa, Dengue virus
FFLMVLLVPEP

SEQ ID NO: 99039 - protein, 11 aa, Dengue virus
FLMVLLVPEPE

SEQ ID NO: 99040 - protein, 11 aa, Dengue virus
LMVLLVPEPEK

SEQ ID NO: 99041 - protein, 11 aa, Dengue virus
MVLLVPEPEKQ

SEQ ID NO: 99042 - protein, 11 aa, Dengue virus
VLLVPEPEKQR

SEQ ID NO: 99043 - protein, 11 aa, Dengue virus
LLVPEPEKQRT

SEQ ID NO: 99044 - protein, 11 aa, Dengue virus
LVPEPEKQRTP

SEQ ID NO: 99045 - protein, 11 aa, Dengue virus
VPEPEKQRTPQ

SEQ ID NO: 99046 - protein, 11 aa, Dengue virus
QDNQLIYVILA

SEQ ID NO: 99047 - protein, 11 aa, Dengue virus
DNQLIYVILAI

SEQ ID NO: 99048 - protein, 11 aa, Dengue virus
NQLIYVILAIL

SEQ ID NO: 99049 - protein, 11 aa, Dengue virus
QLIYVILAILT

SEQ ID NO: 99050 - protein, 11 aa, Dengue virus
LIYVILAILTI

SEQ ID NO: 99051 - protein, 11 aa, Dengue virus
IYVILAILTII

SEQ ID NO: 99052 - protein, 11 aa, Dengue virus
YVILAILTIIG

SEQ ID NO: 99053 - protein, 11 aa, Dengue virus
VILAILTIIGL

SEQ ID NO: 99054 - protein, 11 aa, Dengue virus
ILTIIGLVAAN

SEQ ID NO: 99055 - protein, 11 aa, Dengue virus
LTIIGLVAANE

SEQ ID NO: 99056 - protein, 11 aa, Dengue virus
TIIGLVAANEM

SEQ ID NO: 99057 - protein, 11 aa, Dengue virus
IIGLVAANEMG

SEQ ID NO: 99058 - protein, 11 aa, Dengue virus
IGLVAANEMGL

SEQ ID NO: 99059 - protein, 11 aa, Dengue virus
GLVAANEMGLI

SEQ ID NO: 99060 - protein, 11 aa, Dengue virus
LVAANEMGLIE

SEQ ID NO: 99061 - protein, 11 aa, Dengue virus
VAANEMGLIEK

SEQ ID NO: 99062 - protein, 11 aa, Dengue virus
NEMGLIEKTKA

SEQ ID NO: 99063 - protein, 11 aa, Dengue virus
EMGLIEKTKAD

SEQ ID NO: 99064 - protein, 11 aa, Dengue virus
MGLIEKTKADF

SEQ ID NO: 99065 - protein, 11 aa, Dengue virus
GLIEKTKADFG

SEQ ID NO: 99066 - protein, 11 aa, Dengue virus
LIEKTKADFGF

SEQ ID NO: 99067 - protein, 11 aa, Dengue virus
IEKTKADFGFY

SEQ ID NO: 99068 - protein, 11 aa, Dengue virus
EKTKADFGFYQ

SEQ ID NO: 99069 - protein, 11 aa, Dengue virus
KTKTDFGFYQA

SEQ ID NO: 99070 - protein, 11 aa, Dengue virus
TKTDFGFYQAK

SEQ ID NO: 99071 - protein, 11 aa, Dengue virus
KTDFGFYQAKT

SEQ ID NO: 99072 - protein, 11 aa, Dengue virus
TDFGFYQAKTE

SEQ ID NO: 99073 - protein, 11 aa, Dengue virus
DFGFYQAKTET

SEQ ID NO: 99074 - protein, 11 aa, Dengue virus
FGFYQAKTETT

SEQ ID NO: 99075 - protein, 11 aa, Dengue virus
GFYQAKTETTI

SEQ ID NO: 99076 - protein, 11 aa, Dengue virus
FYQAKTETTIL

SEQ ID NO: 99077 - protein, 11 aa, Dengue virus
YQAKTETTILD

SEQ ID NO: 99078 - protein, 11 aa, Dengue virus
QAKTETTILDV

SEQ ID NO: 99079 - protein, 11 aa, Dengue virus
AKTETTILDVD

SEQ ID NO: 99080 - protein, 11 aa, Dengue virus
KTEITILDVDL

SEQ ID NO: 99081 - protein, 11 aa, Dengue virus
TEITILDVDLR

SEQ ID NO: 99082 - protein, 11 aa, Dengue virus
AWTLYAVVTTI

SEQ ID NO: 99083 - protein, 11 aa, Dengue virus
WTLYAVVTTIL

SEQ ID NO: 99084 - protein, 11 aa, Dengue virus
TLYAVVTTILT

SEQ ID NO: 99085 - protein, 11 aa, Dengue virus
LYAVVTTILTP

SEQ ID NO: 99086 - protein, 11 aa, Dengue virus
YAVVTTILTPM

SEQ ID NO: 99087 - protein, 11 aa, Dengue virus
AVVTTILTPML

SEQ ID NO: 99088 - protein, 11 aa, Dengue virus
VVTTILTPMLR

SEQ ID NO: 99089 - protein, 11 aa, Dengue virus
VTTILTPMLRH

SEQ ID NO: 99090 - protein, 11 aa, Dengue virus
ANLSLTAIANQ

SEQ ID NO: 99091 - protein, 11 aa, Dengue virus
NLSLAAIANHA

SEQ ID NO: 99092 - protein, 11 aa, Dengue virus
LSLTAIANQAA

SEQ ID NO: 99093 - protein, 11 aa, Dengue virus
SLAAIANHAAV

SEQ ID NO: 99094 - protein, 11 aa, Dengue virus
LAAIANHAAVL

SEQ ID NO: 99095 - protein, 11 aa, Dengue virus
TAIANQAAVLM

SEQ ID NO: 99096 - protein, 11 aa, Dengue virus
GLGKGWPLHRV

SEQ ID NO: 99097 - protein, 11 aa, Dengue virus
LGKGWPLHRVD

SEQ ID NO: 99098 - protein, 11 aa, Dengue virus
GKGWPLHRVDL

SEQ ID NO: 99099 - protein, 11 aa, Dengue virus
KGWPLHRVDLG

SEQ ID NO: 99100 - protein, 11 aa, Dengue virus
GWPLHRVDLGV

SEQ ID NO: 99101 - protein, 11 aa, Dengue virus
WPLHRVDLGVP

SEQ ID NO: 99102 - protein, 11 aa, Dengue virus
PLHRVDLGVPL

SEQ ID NO: 99103 - protein, 11 aa, Dengue virus
LHRVDLGVPLL

SEQ ID NO: 99104 - protein, 11 aa, Dengue virus
HRVDLGVPLLA

SEQ ID NO: 99105 - protein, 11 aa, Dengue virus
RVDLGVPLLAM

SEQ ID NO: 99106 - protein, 11 aa, Dengue virus
VDLGVPLLAMG

SEQ ID NO: 99107 - protein, 11 aa, Dengue virus
CYSQVNPTTLI

SEQ ID NO: 99108 - protein, 11 aa, Dengue virus
YSQVNPTTLIA

SEQ ID NO: 99109 - protein, 11 aa, Dengue virus
SQVNPTTLIAS

SEQ ID NO: 99110 - protein, 11 aa, Dengue virus
QVNPTTLIASL

SEQ ID NO: 99111 - protein, 11 aa, Dengue virus
VNPTTLIASLV

SEQ ID NO: 99112 - protein, 11 aa, Dengue virus
NPTTLIASLVM

SEQ ID NO: 99113 - protein, 11 aa, Dengue virus
PTTLIASLVML

SEQ ID NO: 99114 - protein, 11 aa, Dengue virus
TTLTASLVMLS

SEQ ID NO: 99115 - protein, 11 aa, Dengue virus
TLTASLVMLSV

SEQ ID NO: 99116 - protein, 11 aa, Dengue virus
LTASLVMLSVH

SEQ ID NO: 99117 - protein, 11 aa, Dengue virus
TASLVMLSVHY

SEQ ID NO: 99118 - protein, 11 aa, Dengue virus
ASLVMLSVHYA

SEQ ID NO: 99119 - protein, 11 aa, Dengue virus
SLVMLSVHYAI

SEQ ID NO: 99120 - protein, 11 aa, Dengue virus
LVMLSVHYAII

SEQ ID NO: 99121 - protein, 11 aa, Dengue virus
VMLSVHYAIIG

SEQ ID NO: 99122 - protein, 11 aa, Dengue virus
MLSVHYAIIGP

SEQ ID NO: 99123 - protein, 11 aa, Dengue virus
LSVHYAIIGPG

SEQ ID NO: 99124 - protein, 11 aa, Dengue virus
SVHYAIIGPGL

SEQ ID NO: 99125 - protein, 11 aa, Dengue virus
LGQVMLLVLCV

SEQ ID NO: 99126 - protein, 11 aa, Dengue virus
GQVMLLVLCVG

SEQ ID NO: 99127 - protein, 11 aa, Dengue virus
QVMLLVLCVGQ

SEQ ID NO: 99128 - protein, 11 aa, Dengue virus
VMLLVLCVGQL

SEQ ID NO: 99129 - protein, 11 aa, Dengue virus
MLLVLCVGQLL

SEQ ID NO: 99130 - protein, 11 aa, Dengue virus
LLVLCVGQLLL

SEQ ID NO: 99131 - protein, 11 aa, Dengue virus
LVLCVGQLLLM

SEQ ID NO: 99132 - protein, 11 aa, Dengue virus
VLCVGQLLLMR

SEQ ID NO: 99133 - protein, 11 aa, Dengue virus
LCVGQLLLMRT

SEQ ID NO: 99134 - protein, 11 aa, Dengue virus
CVGQLLLMRTT

SEQ ID NO: 99135 - protein, 11 aa, Dengue virus
VGQLLLMRTTW

SEQ ID NO: 99136 - protein, 11 aa, Dengue virus
GQLFLMRTTWA

SEQ ID NO: 99137 - protein, 11 aa, Dengue virus
QLLLMRTTWAL

SEQ ID NO: 99138 - protein, 11 aa, Dengue virus
LLLMRTTWALC

SEQ ID NO: 99139 - protein, 11 aa, Dengue virus
LLMRTTWALCE

SEQ ID NO: 99140 - protein, 11 aa, Dengue virus
LMRTTWALCEV

SEQ ID NO: 99141 - protein, 11 aa, Dengue virus
MRTTWALCEVL

SEQ ID NO: 99142 - protein, 11 aa, Dengue virus
RTTWALCEVLT

SEQ ID NO: 99143 - protein, 11 aa, Dengue virus
TTWALCEVLTL

SEQ ID NO: 99144 - protein, 11 aa, Dengue virus
TWALCEVLTLA

SEQ ID NO: 99145 - protein, 11 aa, Dengue virus
WALCEVLTLAT

SEQ ID NO: 99146 - protein, 11 aa, Dengue virus
ALCEVLTLATG

SEQ ID NO: 99147 - protein, 11 aa, Dengue virus
LCEVLTLATGP

SEQ ID NO: 99148 - protein, 11 aa, Dengue virus
CEVLTLATGPV

SEQ ID NO: 99149 - protein, 11 aa, Dengue virus
EVLTLATGPIM

SEQ ID NO: 99150 - protein, 11 aa, Dengue virus
VLTLATGPIMT

SEQ ID NO: 99151 - protein, 11 aa, Dengue virus
LTLATGPIMTL

SEQ ID NO: 99152 - protein, 11 aa, Dengue virus
TLATGPIMTLW

SEQ ID NO: 99153 - protein, 11 aa, Dengue virus
LATGPIMTLWE

SEQ ID NO: 99154 - protein, 11 aa, Dengue virus
ATGPIMTLWEG

SEQ ID NO: 99155 - protein, 11 aa, Dengue virus
TGPIMTLWEGN

SEQ ID NO: 99156 - protein, 11 aa, Dengue virus
GPIMTLWEGNP

SEQ ID NO: 99157 - protein, 11 aa, Dengue virus
PIMTLWEGNPG

SEQ ID NO: 99158 - protein, 11 aa, Dengue virus
IMTLWEGNPGR

SEQ ID NO: 99159 - protein, 11 aa, Dengue virus
MTLWEGNPGRF

SEQ ID NO: 99160 - protein, 11 aa, Dengue virus
AGLAFSLIKNV

SEQ ID NO: 99161 - protein, 11 aa, Dengue virus
GLAFSLIKNVQ

SEQ ID NO: 99162 - protein, 11 aa, Dengue virus
LAFSLIKNVQT

SEQ ID NO: 99163 - protein, 11 aa, Dengue virus
AFSLIKNVQTP

SEQ ID NO: 99164 - protein, 11 aa, Dengue virus
FSLIKNVQTPR

SEQ ID NO: 99165 - protein, 11 aa, Dengue virus
SLIKNVQTPRR

SEQ ID NO: 99166 - protein, 11 aa, Dengue virus
LIKNVQTPRRG

SEQ ID NO: 99167 - protein, 11 aa, Dengue virus
IKNVQTPRRGT

SEQ ID NO: 99168 - protein, 11 aa, Dengue virus
KNVQTPRRGTG

SEQ ID NO: 99169 - protein, 11 aa, Dengue virus
NVQTPRRGTGT

SEQ ID NO: 99170 - protein, 11 aa, Dengue virus
VQTPRRGTGTT

SEQ ID NO: 99171 - protein, 11 aa, Dengue virus
QTPRRGTGITG

SEQ ID NO: 99172 - protein, 11 aa, Dengue virus
TPRRGTGTIGE

SEQ ID NO: 99173 - protein, 11 aa, Dengue virus
PRRGTGITGET

SEQ ID NO: 99174 - protein, 11 aa, Dengue virus
RRGTGTIGETL

SEQ ID NO: 99175 - protein, 11 aa, Dengue virus
RGTGTIGETLG

SEQ ID NO: 99176 - protein, 11 aa, Dengue virus
GTGITGETLGE

SEQ ID NO: 99177 - protein, 11 aa, Dengue virus
TGTIGETLGEK

SEQ ID NO: 99178 - protein, 11 aa, Dengue virus
GITGETLGEKW

SEQ ID NO: 99179 - protein, 11 aa, Dengue virus
ITGETLGEKWK

SEQ ID NO: 99180 - protein, 11 aa, Dengue virus
WKRQLNSLDRR

SEQ ID NO: 99181 - protein, 11 aa, Dengue virus
KRQLNSLDRRE

SEQ ID NO: 99182 - protein, 11 aa, Dengue virus
RQLNSLDRREF

SEQ ID NO: 99183 - protein, 11 aa, Dengue virus
QLNSLDRREFE

SEQ ID NO: 99184 - protein, 11 aa, Dengue virus
LNSLDRREFEE

SEQ ID NO: 99185 - protein, 11 aa, Dengue virus
NSLDRREFEEY

SEQ ID NO: 99186 - protein, 11 aa, Dengue virus
SLDRREFEEYK

SEQ ID NO: 99187 - protein, 11 aa, Dengue virus
LDRREFEEYKR

SEQ ID NO: 99188 - protein, 11 aa, Dengue virus
DRREFEEYKRS

SEQ ID NO: 99189 - protein, 11 aa, Dengue virus
EFEEYKRSGII

SEQ ID NO: 99190 - protein, 11 aa, Dengue virus
FEEYKRSGIIE

SEQ ID NO: 99191 - protein, 11 aa, Dengue virus
EEYKRSGIIEV

SEQ ID NO: 99192 - protein, 11 aa, Dengue virus
EYKRSGIIEVD

SEQ ID NO: 99193 - protein, 11 aa, Dengue virus
YKRSGIIEVDR

SEQ ID NO: 99194 - protein, 11 aa, Dengue virus
KRSGIIEVDRT

SEQ ID NO: 99195 - protein, 11 aa, Dengue virus
RSGIIEVDRTE

SEQ ID NO: 99196 - protein, 11 aa, Dengue virus
SGIIEVDRTEA

SEQ ID NO: 99197 - protein, 11 aa, Dengue virus
GIIEVDRTEAK

SEQ ID NO: 99198 - protein, 11 aa, Dengue virus
IIEVDRTEAKS

SEQ ID NO: 99199 - protein, 11 aa, Dengue virus
IEVDRTEAKSA

SEQ ID NO: 99200 - protein, 11 aa, Dengue virus
VDRTEAKSALR

SEQ ID NO: 99201 - protein, 11 aa, Dengue virus
DRTEAKSALRD

SEQ ID NO: 99202 - protein, 11 aa, Dengue virus
RTEAKSALRDG

SEQ ID NO: 99203 - protein, 11 aa, Dengue virus
TEAKSALRDGS

SEQ ID NO: 99204 - protein, 11 aa, Dengue virus
EAKSALRDGSK

SEQ ID NO: 99205 - protein, 11 aa, Dengue virus
AKSALRDGSKI

SEQ ID NO: 99206 - protein, 11 aa, Dengue virus
KSALRDGSKIK

SEQ ID NO: 99207 - protein, 11 aa, Dengue virus
SALRDGSKIKH

SEQ ID NO: 99208 - protein, 11 aa, Dengue virus
ALRDGSKIKHA

SEQ ID NO: 99209 - protein, 11 aa, Dengue virus
LRDGSKIKHAV

SEQ ID NO: 99210 - protein, 11 aa, Dengue virus
RDGSKIKHAVS

SEQ ID NO: 99211 - protein, 11 aa, Dengue virus
DGSKTKHAVSR

SEQ ID NO: 99212 - protein, 11 aa, Dengue virus
GSKTKHAVSRG

SEQ ID NO: 99213 - protein, 11 aa, Dengue virus
SKTKHAVSRGS

SEQ ID NO: 99214 - protein, 11 aa, Dengue virus
KTKHAVSRGSS

SEQ ID NO: 99215 - protein, 11 aa, Dengue virus
TKHAVSRGSSK

SEQ ID NO: 99216 - protein, 11 aa, Dengue virus
KYAVSRGTSKI

SEQ ID NO: 99217 - protein, 11 aa, Dengue virus
YAVSRGTSKIR

SEQ ID NO: 99218 - protein, 11 aa, Dengue virus
AVSRGTSKIRW

SEQ ID NO: 99219 - protein, 11 aa, Dengue virus
VSRGTSKIRWI

SEQ ID NO: 99220 - protein, 11 aa, Dengue virus
SRGTSKIRWIV

SEQ ID NO: 99221 - protein, 11 aa, Dengue virus
RGTSKIRWIVE

SEQ ID NO: 99222 - protein, 11 aa, Dengue virus
GTSKIRWIVER

SEQ ID NO: 99223 - protein, 11 aa, Dengue virus
TSKIRWIVERG

SEQ ID NO: 99224 - protein, 11 aa, Dengue virus
KIRWIVERGMI

SEQ ID NO: 99225 - protein, 11 aa, Dengue virus
IRWIVERGMIK

SEQ ID NO: 99226 - protein, 11 aa, Dengue virus
RWIVERGMIKP

SEQ ID NO: 99227 - protein, 11 aa, Dengue virus
WIVERGMIKPK

SEQ ID NO: 99228 - protein, 11 aa, Dengue virus
IVERGMIKPKG

SEQ ID NO: 99229 - protein, 11 aa, Dengue virus
VERGMIKPKGK

SEQ ID NO: 99230 - protein, 11 aa, Dengue virus
ERGMIKPKGKV

SEQ ID NO: 99231 - protein, 11 aa, Dengue virus
RGMIKPKGKVV

SEQ ID NO: 99232 - protein, 11 aa, Dengue virus
GMIKPKGKVVD

SEQ ID NO: 99233 - protein, 11 aa, Dengue virus
MIKPKGKVVDL

SEQ ID NO: 99234 - protein, 11 aa, Dengue virus
IKPKGKVVDLG

SEQ ID NO: 99235 - protein, 11 aa, Dengue virus
KPKGKIVDLGC

SEQ ID NO: 99236 - protein, 11 aa, Dengue virus
PKGKVIDLGCG

SEQ ID NO: 99237 - protein, 11 aa, Dengue virus
KGKIVDLGCGR

SEQ ID NO: 99238 - protein, 11 aa, Dengue virus
GKIVDLGCGRG

SEQ ID NO: 99239 - protein, 11 aa, Dengue virus
KVIDLGCGRGG

SEQ ID NO: 99240 - protein, 11 aa, Dengue virus
VIDLGCGRGGW

SEQ ID NO: 99241 - protein, 11 aa, Dengue virus
MATLKNVTEVR

SEQ ID NO: 99242 - protein, 11 aa, Dengue virus
ATLKNVTEVRG

SEQ ID NO: 99243 - protein, 11 aa, Dengue virus
TLKNVTEVRGF

SEQ ID NO: 99244 - protein, 11 aa, Dengue virus
LKNVTEVRGFT

SEQ ID NO: 99245 - protein, 11 aa, Dengue virus
KNVTEVRGFTK

SEQ ID NO: 99246 - protein, 11 aa, Dengue virus
NVTEVRGFTKG

SEQ ID NO: 99247 - protein, 11 aa, Dengue virus
VTEVRGFTKGG

SEQ ID NO: 99248 - protein, 11 aa, Dengue virus
TEVRGFTKGGP

SEQ ID NO: 99249 - protein, 11 aa, Dengue virus
EVRGFTKGGPG

SEQ ID NO: 99250 - protein, 11 aa, Dengue virus
VRGFTKGGPGH

SEQ ID NO: 99251 - protein, 11 aa, Dengue virus
RGFTKGGPGHE

SEQ ID NO: 99252 - protein, 11 aa, Dengue virus
GFTKGGPGHEE

SEQ ID NO: 99253 - protein, 11 aa, Dengue virus
FTKGGPGHEEP

SEQ ID NO: 99254 - protein, 11 aa, Dengue virus
KLHSGVDVFYR

SEQ ID NO: 99255 - protein, 11 aa, Dengue virus
LHSGVDVFYRP

SEQ ID NO: 99256 - protein, 11 aa, Dengue virus
HSGVDVFYRPT

SEQ ID NO: 99257 - protein, 11 aa, Dengue virus
SGVDVFYRPTE

SEQ ID NO: 99258 - protein, 11 aa, Dengue virus
GVDVFYRPTEQ

SEQ ID NO: 99259 - protein, 11 aa, Dengue virus
VDVFYRPTEQV

SEQ ID NO: 99260 - protein, 11 aa, Dengue virus
DVFYRPTEQVD

SEQ ID NO: 99261 - protein, 11 aa, Dengue virus
VFYRPTEQVDT

SEQ ID NO: 99262 - protein, 11 aa, Dengue virus
FYRPTEQVDTL

SEQ ID NO: 99263 - protein, 11 aa, Dengue virus
YRPTEQVDTLL

SEQ ID NO: 99264 - protein, 11 aa, Dengue virus
RPTEQVDTLLC

SEQ ID NO: 99265 - protein, 11 aa, Dengue virus
VIEELEKLQRR

SEQ ID NO: 99266 - protein, 11 aa, Dengue virus
IEELEKLQRRH

SEQ ID NO: 99267 - protein, 11 aa, Dengue virus
EELEKLQRRHG

SEQ ID NO: 99268 - protein, 11 aa, Dengue virus
ELEKLQRRHGG

SEQ ID NO: 99269 - protein, 11 aa, Dengue virus
LEKLQRRHGGS

SEQ ID NO: 99270 - protein, 11 aa, Dengue virus
EKLQRRHGGSL

SEQ ID NO: 99271 - protein, 11 aa, Dengue virus
KLQRRHGGSLV

SEQ ID NO: 99272 - protein, 11 aa, Dengue virus
LQRRHGGSLVR

SEQ ID NO: 99273 - protein, 11 aa, Dengue virus
QRRHGGSLVRC

SEQ ID NO: 99274 - protein, 11 aa, Dengue virus
RRHGGSLVRCP

SEQ ID NO: 99275 - protein, 11 aa, Dengue virus
RHGGSLVRCPL

SEQ ID NO: 99276 - protein, 11 aa, Dengue virus
HGGSLVRCPLS

SEQ ID NO: 99277 - protein, 11 aa, Dengue virus
GGSLVRCPLSR

SEQ ID NO: 99278 - protein, 11 aa, Dengue virus
GSLVRCPLSRN

SEQ ID NO: 99279 - protein, 11 aa, Dengue virus
SLVRCPLSRNS

SEQ ID NO: 99280 - protein, 11 aa, Dengue virus
LIRCPLSRNST

SEQ ID NO: 99281 - protein, 11 aa, Dengue virus
IRCPLSRNSTH

SEQ ID NO: 99282 - protein, 11 aa, Dengue virus
STHEMYWVSGV

SEQ ID NO: 99283 - protein, 11 aa, Dengue virus
THEMYWVSGVS

SEQ ID NO: 99284 - protein, 11 aa, Dengue virus
HEMYWVSGVSG

SEQ ID NO: 99285 - protein, 11 aa, Dengue virus
EMYWVSGVSGN

SEQ ID NO: 99286 - protein, 11 aa, Dengue virus
MYWVSGVSGNI

SEQ ID NO: 99287 - protein, 11 aa, Dengue virus
YWVSGVSGNIV

SEQ ID NO: 99288 - protein, 11 aa, Dengue virus
WVSGVSGNIVS

SEQ ID NO: 99289 - protein, 11 aa, Dengue virus
VSGVSGNIVSS

SEQ ID NO: 99290 - protein, 11 aa, Dengue virus
SGVSGNIVSSV

SEQ ID NO: 99291 - protein, 11 aa, Dengue virus
GVSGNIVSSVN

SEQ ID NO: 99292 - protein, 11 aa, Dengue virus
VSGNIVSSVNT

SEQ ID NO: 99293 - protein, 11 aa, Dengue virus
SGNIVSSVNTI

SEQ ID NO: 99294 - protein, 11 aa, Dengue virus
GNIVSSVNTIS

SEQ ID NO: 99295 - protein, 11 aa, Dengue virus
NIVSSVNTISK

SEQ ID NO: 99296 - protein, 11 aa, Dengue virus
IVSSVNTISKM

SEQ ID NO: 99297 - protein, 11 aa, Dengue virus
VSSVNTISKML

SEQ ID NO: 99298 - protein, 11 aa, Dengue virus
SSVNTISKMLL

SEQ ID NO: 99299 - protein, 11 aa, Dengue virus
SVNTISKMLLN

SEQ ID NO: 99300 - protein, 11 aa, Dengue virus
VNTISKMLLNR

SEQ ID NO: 99301 - protein, 11 aa, Dengue virus
NTISKMLLNRF

SEQ ID NO: 99302 - protein, 11 aa, Dengue virus
TISKMLLNRFT

SEQ ID NO: 99303 - protein, 11 aa, Dengue virus
ISKMLLNRFTT

SEQ ID NO: 99304 - protein, 11 aa, Dengue virus
SKMLLNWFTTR

SEQ ID NO: 99305 - protein, 11 aa, Dengue virus
KMLLNWFTTRH

SEQ ID NO: 99306 - protein, 11 aa, Dengue virus
MLLNWFTTRHR

SEQ ID NO: 99307 - protein, 11 aa, Dengue virus
LLNRFTTKHRK

SEQ ID NO: 99308 - protein, 11 aa, Dengue virus
LNWFTTRHRKP

SEQ ID NO: 99309 - protein, 11 aa, Dengue virus
NRFTTRHRRPT

SEQ ID NO: 99310 - protein, 11 aa, Dengue virus
RFTTRHRRPTY

SEQ ID NO: 99311 - protein, 11 aa, Dengue virus
FTTRHRRPTYE

SEQ ID NO: 99312 - protein, 11 aa, Dengue virus
TTKHRKPTYEK

SEQ ID NO: 99313 - protein, 11 aa, Dengue virus
TKHRKPTYEKD

SEQ ID NO: 99314 - protein, 11 aa, Dengue virus
RHRKPTYEKDA

SEQ ID NO: 99315 - protein, 11 aa, Dengue virus
HRKPTYEKDAD

SEQ ID NO: 99316 - protein, 11 aa, Dengue virus
RKPTYEKDADL

SEQ ID NO: 99317 - protein, 11 aa, Dengue virus
KPTYEKDADLG

SEQ ID NO: 99318 - protein, 11 aa, Dengue virus
PTYEKDADLGA

SEQ ID NO: 99319 - protein, 11 aa, Dengue virus
TYEKDADLGAG

SEQ ID NO: 99320 - protein, 11 aa, Dengue virus
YEKDADLGAGT

SEQ ID NO: 99321 - protein, 11 aa, Dengue virus
EKDADLGAGTR

SEQ ID NO: 99322 - protein, 11 aa, Dengue virus
KDADLGAGTRS

SEQ ID NO: 99323 - protein, 11 aa, Dengue virus
DADLGAGTRSV

SEQ ID NO: 99324 - protein, 11 aa, Dengue virus
ADLGAGTRSVS

SEQ ID NO: 99325 - protein, 11 aa, Dengue virus
STEPENPDMTI

SEQ ID NO: 99326 - protein, 11 aa, Dengue virus
TEPENPDMTII

SEQ ID NO: 99327 - protein, 11 aa, Dengue virus
ETEKPDMTVIG

SEQ ID NO: 99328 - protein, 11 aa, Dengue virus
PENPDMTIIGR

SEQ ID NO: 99329 - protein, 11 aa, Dengue virus
EKPDMTVIGRR

SEQ ID NO: 99330 - protein, 11 aa, Dengue virus
KPDMTVIGRRL

SEQ ID NO: 99331 - protein, 11 aa, Dengue virus
TIIGRRLQRLR

SEQ ID NO: 99332 - protein, 11 aa, Dengue virus
IIGRRLQRLRE

SEQ ID NO: 99333 - protein, 11 aa, Dengue virus
IGRRLQRLREE

SEQ ID NO: 99334 - protein, 11 aa, Dengue virus
GRRLQRLREEH

SEQ ID NO: 99335 - protein, 11 aa, Dengue virus
RRLQRLREEHK

SEQ ID NO: 99336 - protein, 11 aa, Dengue virus
RLQRLREEHKE

SEQ ID NO: 99337 - protein, 11 aa, Dengue virus
LQRLREEHKET

SEQ ID NO: 99338 - protein, 11 aa, Dengue virus
QRLREEHKETW

SEQ ID NO: 99339 - protein, 11 aa, Dengue virus
RLREEHKETWH

SEQ ID NO: 99340 - protein, 11 aa, Dengue virus
LREEHKETWHY

SEQ ID NO: 99341 - protein, 11 aa, Dengue virus
REEHKETWHYD

SEQ ID NO: 99342 - protein, 11 aa, Dengue virus
EEHKETWHYDH

SEQ ID NO: 99343 - protein, 11 aa, Dengue virus
EHKETWHYDHE

SEQ ID NO: 99344 - protein, 11 aa, Dengue virus
HKETWHYDHEN

SEQ ID NO: 99345 - protein, 11 aa, Dengue virus
KETWHYDHENP

SEQ ID NO: 99346 - protein, 11 aa, Dengue virus
ETWHYDHENPY

SEQ ID NO: 99347 - protein, 11 aa, Dengue virus
TWHYDHENPYR

SEQ ID NO: 99348 - protein, 11 aa, Dengue virus
WHYDHENPYRT

SEQ ID NO: 99349 - protein, 11 aa, Dengue virus
HYDHENPYRTW

SEQ ID NO: 99350 - protein, 11 aa, Dengue virus
YDHENPYRTWA

SEQ ID NO: 99351 - protein, 11 aa, Dengue virus
DHENPYRTWAY

SEQ ID NO: 99352 - protein, 11 aa, Dengue virus
HENPYRTWAYH

SEQ ID NO: 99353 - protein, 11 aa, Dengue virus
GSYEAPSTGST

SEQ ID NO: 99354 - protein, 11 aa, Dengue virus
SYEAPSTGSTS

SEQ ID NO: 99355 - protein, 11 aa, Dengue virus
YEASSTGSASS

SEQ ID NO: 99356 - protein, 11 aa, Dengue virus
EAPSTGSTSSM

SEQ ID NO: 99357 - protein, 11 aa, Dengue virus
APSTGSASSMI

SEQ ID NO: 99358 - protein, 11 aa, Dengue virus
SSTGSASSMVN

SEQ ID NO: 99359 - protein, 11 aa, Dengue virus
STGSTSSMVNG

SEQ ID NO: 99360 - protein, 11 aa, Dengue virus
TGSASSMINGV

SEQ ID NO: 99361 - protein, 11 aa, Dengue virus
GSASSMINGVV

SEQ ID NO: 99362 - protein, 11 aa, Dengue virus
STSSMVNGVVK

SEQ ID NO: 99363 - protein, 11 aa, Dengue virus
TSSMVNGVVKL

SEQ ID NO: 99364 - protein, 11 aa, Dengue virus
VVKLLTKPWDM

SEQ ID NO: 99365 - protein, 11 aa, Dengue virus
VKLLTKPWDVV

SEQ ID NO: 99366 - protein, 11 aa, Dengue virus
KLLTKPWDVVP

SEQ ID NO: 99367 - protein, 11 aa, Dengue virus
LLTKPWDVVPM

SEQ ID NO: 99368 - protein, 11 aa, Dengue virus
LTKPWDVVPMV

SEQ ID NO: 99369 - protein, 11 aa, Dengue virus
TKPWDVVPMVT

SEQ ID NO: 99370 - protein, 11 aa, Dengue virus
KPWDVVPMVTQ

SEQ ID NO: 99371 - protein, 11 aa, Dengue virus
PWDVVPMVTQL

SEQ ID NO: 99372 - protein, 11 aa, Dengue virus
WDVVPMVTQLA

SEQ ID NO: 99373 - protein, 11 aa, Dengue virus
DVVPMVTQLAM

SEQ ID NO: 99374 - protein, 11 aa, Dengue virus
VVPMVTQLAMT

SEQ ID NO: 99375 - protein, 11 aa, Dengue virus
VPMVTQLAMTD

SEQ ID NO: 99376 - protein, 11 aa, Dengue virus
KVDTRTPQPKL

SEQ ID NO: 99377 - protein, 11 aa, Dengue virus
VDTRTPQPKLG

SEQ ID NO: 99378 - protein, 11 aa, Dengue virus
DTRTPQPKLGT

SEQ ID NO: 99379 - protein, 11 aa, Dengue virus
TRTPQPKLGTR

SEQ ID NO: 99380 - protein, 11 aa, Dengue virus
RTPQPKPGTRV

SEQ ID NO: 99381 - protein, 11 aa, Dengue virus
TPQPKPGTRMI

SEQ ID NO: 99382 - protein, 11 aa, Dengue virus
PQPKPGTRMIM

SEQ ID NO: 99383 - protein, 11 aa, Dengue virus
QPKPGTRMIMT

SEQ ID NO: 99384 - protein, 11 aa, Dengue virus
PKPGTRMIMTT

SEQ ID NO: 99385 - protein, 11 aa, Dengue virus
KPGTRMIMTTT

SEQ ID NO: 99386 - protein, 11 aa, Dengue virus
PGTRMIMTTTA

SEQ ID NO: 99387 - protein, 11 aa, Dengue virus
GTRMIMTTTAN

SEQ ID NO: 99388 - protein, 11 aa, Dengue virus
TRMIMTTTANW

SEQ ID NO: 99389 - protein, 11 aa, Dengue virus
RMIMTTTANWL

SEQ ID NO: 99390 - protein, 11 aa, Dengue virus
MIMTTTANWLW

SEQ ID NO: 99391 - protein, 11 aa, Dengue virus
IMTTTANWLWA

SEQ ID NO: 99392 - protein, 11 aa, Dengue virus
MTTTANWLWTL

SEQ ID NO: 99393 - protein, 11 aa, Dengue virus
TTTANWLWTLL

SEQ ID NO: 99394 - protein, 11 aa, Dengue virus
TTANWLWTLLG

SEQ ID NO: 99395 - protein, 11 aa, Dengue virus
TANWLWALLGR

SEQ ID NO: 99396 - protein, 11 aa, Dengue virus
ANWLWALLGRK

SEQ ID NO: 99397 - protein, 11 aa, Dengue virus
NWLWALLGRKK

SEQ ID NO: 99398 - protein, 11 aa, Dengue virus
LLGKKKSPRLC

SEQ ID NO: 99399 - protein, 11 aa, Dengue virus
LGKKKSPRLCT

SEQ ID NO: 99400 - protein, 11 aa, Dengue virus
KKSPRLCTREE

SEQ ID NO: 99401 - protein, 11 aa, Dengue virus
KSPRLCTREEF

SEQ ID NO: 99402 - protein, 11 aa, Dengue virus
SPRLCTREEFI

SEQ ID NO: 99403 - protein, 11 aa, Dengue virus
PRLCTKEEFIS

SEQ ID NO: 99404 - protein, 11 aa, Dengue virus
RLCTKEEFISK

SEQ ID NO: 99405 - protein, 11 aa, Dengue virus
LCTKEEFISKV

SEQ ID NO: 99406 - protein, 11 aa, Dengue virus
CTKEEFISKVR

SEQ ID NO: 99407 - protein, 11 aa, Dengue virus
TKEEFISKVRS

SEQ ID NO: 99408 - protein, 11 aa, Dengue virus
KEEFISKVRSN

SEQ ID NO: 99409 - protein, 11 aa, Dengue virus
QGWTSASEAVS

SEQ ID NO: 99410 - protein, 11 aa, Dengue virus
GWTSASEAVSD

SEQ ID NO: 99411 - protein, 11 aa, Dengue virus
WTSASEAVSDS

SEQ ID NO: 99412 - protein, 11 aa, Dengue virus
TSASEAVSDSR

SEQ ID NO: 99413 - protein, 11 aa, Dengue virus
SASEAVSDSRF

SEQ ID NO: 99414 - protein, 11 aa, Dengue virus
ASEAVSDSRFW

SEQ ID NO: 99415 - protein, 11 aa, Dengue virus
SEAVSDSRFWE

SEQ ID NO: 99416 - protein, 11 aa, Dengue virus
EAVSDSRFWEL

SEQ ID NO: 99417 - protein, 11 aa, Dengue virus
AVSDSRFWELV

SEQ ID NO: 99418 - protein, 11 aa, Dengue virus
VSDSRFWELVD

SEQ ID NO: 99419 - protein, 11 aa, Dengue virus
SDSRFWELVDK

SEQ ID NO: 99420 - protein, 11 aa, Dengue virus
RFWELVDKERT

SEQ ID NO: 99421 - protein, 11 aa, Dengue virus
FWKLVDKERAL

SEQ ID NO: 99422 - protein, 11 aa, Dengue virus
WKLVDKERALH

SEQ ID NO: 99423 - protein, 11 aa, Dengue virus
ELVDKERTLHQ

SEQ ID NO: 99424 - protein, 11 aa, Dengue virus
DKERALHQEGR

SEQ ID NO: 99425 - protein, 11 aa, Dengue virus
KERALHQEGRC

SEQ ID NO: 99426 - protein, 11 aa, Dengue virus
ERALHQEGRCE

SEQ ID NO: 99427 - protein, 11 aa, Dengue virus
RTLHQEGKCES

SEQ ID NO: 99428 - protein, 11 aa, Dengue virus
ALHQEGRCESC

SEQ ID NO: 99429 - protein, 11 aa, Dengue virus
LGFLNEDHWFS

SEQ ID NO: 99430 - protein, 11 aa, Dengue virus
GFLNEDHWFSR

SEQ ID NO: 99431 - protein, 11 aa, Dengue virus
FLNEDHWFSRE

SEQ ID NO: 99432 - protein, 11 aa, Dengue virus
LNEDHWFSREN

SEQ ID NO: 99433 - protein, 11 aa, Dengue virus
NEDHWFSRENS

SEQ ID NO: 99434 - protein, 11 aa, Dengue virus
EDHWFSRENSW

SEQ ID NO: 99435 - protein, 11 aa, Dengue virus
DHWFSRENSWS

SEQ ID NO: 99436 - protein, 11 aa, Dengue virus
HWFSRENSWSG

SEQ ID NO: 99437 - protein, 11 aa, Dengue virus
WFSRENSWSGV

SEQ ID NO: 99438 - protein, 11 aa, Dengue virus
FSRENSWSGVE

SEQ ID NO: 99439 - protein, 11 aa, Dengue virus
SRENSWSGVEG

SEQ ID NO: 99440 - protein, 11 aa, Dengue virus
GLHRLGYILED

SEQ ID NO: 99441 - protein, 11 aa, Dengue virus
LHRLGYILEDI

SEQ ID NO: 99442 - protein, 11 aa, Dengue virus
HRLGYILEDID

SEQ ID NO: 99443 - protein, 11 aa, Dengue virus
RLGYILEDIDK

SEQ ID NO: 99444 - protein, 11 aa, Dengue virus
LGYILEDIDKK

SEQ ID NO: 99445 - protein, 11 aa, Dengue virus
GYILEDIDKKD

SEQ ID NO: 99446 - protein, 11 aa, Dengue virus
YILEDIDKKDG

SEQ ID NO: 99447 - protein, 11 aa, Dengue virus
ILEDIDKKDGD

SEQ ID NO: 99448 - protein, 11 aa, Dengue virus
LEDIDKKDGDL

SEQ ID NO: 99449 - protein, 11 aa, Dengue virus
EDIDKKDGDLI

SEQ ID NO: 99450 - protein, 11 aa, Dengue virus
DIDKKDGDLIY

SEQ ID NO: 99451 - protein, 11 aa, Dengue virus
IDKKDGDLIYA

SEQ ID NO: 99452 - protein, 11 aa, Dengue virus
DKKDGDLIYAD

SEQ ID NO: 99453 - protein, 11 aa, Dengue virus
KKDGDLIYADD

SEQ ID NO: 99454 - protein, 11 aa, Dengue virus
KDGDLIYADDT

SEQ ID NO: 99455 - protein, 11 aa, Dengue virus
DGDLIYADDTA

SEQ ID NO: 99456 - protein, 11 aa, Dengue virus
GDLIYADDTAG

SEQ ID NO: 99457 - protein, 11 aa, Dengue virus
DLIYADDTAGW

SEQ ID NO: 99458 - protein, 11 aa, Dengue virus
LIYADDTAGWD

SEQ ID NO: 99459 - protein, 11 aa, Dengue virus
IYADDTAGWDT

SEQ ID NO: 99460 - protein, 11 aa, Dengue virus
WDTRITEDDLL

SEQ ID NO: 99461 - protein, 11 aa, Dengue virus
DTRITEDDLLN

SEQ ID NO: 99462 - protein, 11 aa, Dengue virus
TRITEDDLLNE

SEQ ID NO: 99463 - protein, 11 aa, Dengue virus
RITEDDLLNEE

SEQ ID NO: 99464 - protein, 11 aa, Dengue virus
ITEDDLLNEEL

SEQ ID NO: 99465 - protein, 11 aa, Dengue virus
TEDDLLNEELI

SEQ ID NO: 99466 - protein, 11 aa, Dengue virus
EDDLLNEELIT

SEQ ID NO: 99467 - protein, 11 aa, Dengue virus
DDLLNEELITE

SEQ ID NO: 99468 - protein, 11 aa, Dengue virus
DLLNEELITEQ

SEQ ID NO: 99469 - protein, 11 aa, Dengue virus
LLNEELITEQM

SEQ ID NO: 99470 - protein, 11 aa, Dengue virus
LNEELITEQMA

SEQ ID NO: 99471 - protein, 11 aa, Dengue virus
EELITEQMAPG

SEQ ID NO: 99472 - protein, 11 aa, Dengue virus
ELVTEQMAPHH

SEQ ID NO: 99473 - protein, 11 aa, Dengue virus
LITEQMAPHHR

SEQ ID NO: 99474 - protein, 11 aa, Dengue virus
ITEQMAPHHKT

SEQ ID NO: 99475 - protein, 11 aa, Dengue virus
TEQMAPHHKTL

SEQ ID NO: 99476 - protein, 11 aa, Dengue virus
EQMAPHHKTLA

SEQ ID NO: 99477 - protein, 11 aa, Dengue virus
QMAPHHKTLAK

SEQ ID NO: 99478 - protein, 11 aa, Dengue virus
MAPHHKTLAKA

SEQ ID NO: 99479 - protein, 11 aa, Dengue virus
APHHKTLAKAI

SEQ ID NO: 99480 - protein, 11 aa, Dengue virus
PHHKTLAKAIF

SEQ ID NO: 99481 - protein, 11 aa, Dengue virus
HHKTLAKAIFK

SEQ ID NO: 99482 - protein, 11 aa, Dengue virus
HKTLAKAIFKL

SEQ ID NO: 99483 - protein, 11 aa, Dengue virus
KTLAKAIFKLT

SEQ ID NO: 99484 - protein, 11 aa, Dengue virus
TLAKAIFKLTY

SEQ ID NO: 99485 - protein, 11 aa, Dengue virus
KVVKVLRPTPK

SEQ ID NO: 99486 - protein, 11 aa, Dengue virus
VVKVLRPTPKG

SEQ ID NO: 99487 - protein, 11 aa, Dengue virus
VKVLRPTPKGA

SEQ ID NO: 99488 - protein, 11 aa, Dengue virus
KVLRPTPKGAV

SEQ ID NO: 99489 - protein, 11 aa, Dengue virus
VLRPTPKGAVM

SEQ ID NO: 99490 - protein, 11 aa, Dengue virus
LRPTPKGAVMD

SEQ ID NO: 99491 - protein, 11 aa, Dengue virus
RPTPKGAVMDI

SEQ ID NO: 99492 - protein, 11 aa, Dengue virus
PTPKGAVMDII

SEQ ID NO: 99493 - protein, 11 aa, Dengue virus
TPKGAVMDIIS

SEQ ID NO: 99494 - protein, 11 aa, Dengue virus
PKGAVMDIISR

SEQ ID NO: 99495 - protein, 11 aa, Dengue virus
KGAVMDIISRK

SEQ ID NO: 99496 - protein, 11 aa, Dengue virus
QRGSGQVGTYS

SEQ ID NO: 99497 - protein, 11 aa, Dengue virus
RGSGQVGTYSL

SEQ ID NO: 99498 - protein, 11 aa, Dengue virus
GSGQVGTYSLN

SEQ ID NO: 99499 - protein, 11 aa, Dengue virus
SGQVGTYSLNT

SEQ ID NO: 99500 - protein, 11 aa, Dengue virus
GQVGTYSLNTF

SEQ ID NO: 99501 - protein, 11 aa, Dengue virus
QVGTYSLNTFT

SEQ ID NO: 99502 - protein, 11 aa, Dengue virus
VGTYSLNTFTN

SEQ ID NO: 99503 - protein, 11 aa, Dengue virus
GTYSLNTFTNM

SEQ ID NO: 99504 - protein, 11 aa, Dengue virus
TYSLNTFTNME

SEQ ID NO: 99505 - protein, 11 aa, Dengue virus
YSLNTFTNMEV

SEQ ID NO: 99506 - protein, 11 aa, Dengue virus
SLNTFTNMEVQ

SEQ ID NO: 99507 - protein, 11 aa, Dengue virus
RQMEAEGVITR

SEQ ID NO: 99508 - protein, 11 aa, Dengue virus
QMEAEGVITRD

SEQ ID NO: 99509 - protein, 11 aa, Dengue virus
MEAEGVITRDD

SEQ ID NO: 99510 - protein, 11 aa, Dengue virus
EAEGVITRDDM

SEQ ID NO: 99511 - protein, 11 aa, Dengue virus
AEGVITRDDMH

SEQ ID NO: 99512 - protein, 11 aa, Dengue virus
EGVITRDDMHN

SEQ ID NO: 99513 - protein, 11 aa, Dengue virus
GVITQDDMHNP

SEQ ID NO: 99514 - protein, 11 aa, Dengue virus
VITRDDMHNPK

SEQ ID NO: 99515 - protein, 11 aa, Dengue virus
ITRDDMHNPKG

SEQ ID NO: 99516 - protein, 11 aa, Dengue virus
TQDDMHNPKGL

SEQ ID NO: 99517 - protein, 11 aa, Dengue virus
QDDMHNPKGLK

SEQ ID NO: 99518 - protein, 11 aa, Dengue virus
DDMHNPKGLKE

SEQ ID NO: 99519 - protein, 11 aa, Dengue virus
DMHNPKGLKER

SEQ ID NO: 99520 - protein, 11 aa, Dengue virus
MHNPKGLKERV

SEQ ID NO: 99521 - protein, 11 aa, Dengue virus
HNPKGLKERVE

SEQ ID NO: 99522 - protein, 11 aa, Dengue virus
NPKGLKERVEN

SEQ ID NO: 99523 - protein, 11 aa, Dengue virus
PKGLKERVENW

SEQ ID NO: 99524 - protein, 11 aa, Dengue virus
KGLKERVENWL

SEQ ID NO: 99525 - protein, 11 aa, Dengue virus
GLKERVEKWLK

SEQ ID NO: 99526 - protein, 11 aa, Dengue virus
LKERVEKWLKE

SEQ ID NO: 99527 - protein, 11 aa, Dengue virus
KERVEKWLKEC

SEQ ID NO: 99528 - protein, 11 aa, Dengue virus
ERVEKWLKECG

SEQ ID NO: 99529 - protein, 11 aa, Dengue virus
RVEKWLKECGV

SEQ ID NO: 99530 - protein, 11 aa, Dengue virus
VEKWLKECGVD

SEQ ID NO: 99531 - protein, 11 aa, Dengue virus
EKWLKECGVDR

SEQ ID NO: 99532 - protein, 11 aa, Dengue virus
KWLKECGVDRL

SEQ ID NO: 99533 - protein, 11 aa, Dengue virus
WLKECGVDRLK

SEQ ID NO: 99534 - protein, 11 aa, Dengue virus
LKECGVDRLKR

SEQ ID NO: 99535 - protein, 11 aa, Dengue virus
KECGVDRLKRM

SEQ ID NO: 99536 - protein, 11 aa, Dengue virus
CVVKPLDERFS

SEQ ID NO: 99537 - protein, 11 aa, Dengue virus
VVKPLDERFST

SEQ ID NO: 99538 - protein, 11 aa, Dengue virus
VKPLDERFSTS

SEQ ID NO: 99539 - protein, 11 aa, Dengue virus
KPLDERFSTSL

SEQ ID NO: 99540 - protein, 11 aa, Dengue virus
PLDERFSTSLL

SEQ ID NO: 99541 - protein, 11 aa, Dengue virus
LDERFSTSLLF

SEQ ID NO: 99542 - protein, 11 aa, Dengue virus
DERFSTSLLFL

SEQ ID NO: 99543 - protein, 11 aa, Dengue virus
ERFSTSLLFLN

SEQ ID NO: 99544 - protein, 11 aa, Dengue virus
RFSTSLLFLND

SEQ ID NO: 99545 - protein, 11 aa, Dengue virus
FSTSLLFLNDM

SEQ ID NO: 99546 - protein, 11 aa, Dengue virus
STSLLFLNDMG

SEQ ID NO: 99547 - protein, 11 aa, Dengue virus
PFCSHHFHKIL

SEQ ID NO: 99548 - protein, 11 aa, Dengue virus
FCSHHFHKILM

SEQ ID NO: 99549 - protein, 11 aa, Dengue virus
CSHHFHRIFMK

SEQ ID NO: 99550 - protein, 11 aa, Dengue virus
SHHFHRIFMKD

SEQ ID NO: 99551 - protein, 11 aa, Dengue virus
HHFHRIFMKDG

SEQ ID NO: 99552 - protein, 11 aa, Dengue virus
HFHRIFMKDGR

SEQ ID NO: 99553 - protein, 11 aa, Dengue virus
FHKILMKDGRS

SEQ ID NO: 99554 - protein, 11 aa, Dengue virus
HKILMKDGRSL

SEQ ID NO: 99555 - protein, 11 aa, Dengue virus
RIFMKDGRSLV

SEQ ID NO: 99556 - protein, 11 aa, Dengue virus
RISQGAGWSLK

SEQ ID NO: 99557 - protein, 11 aa, Dengue virus
ISQGAGWSLKE

SEQ ID NO: 99558 - protein, 11 aa, Dengue virus
SQGAGWSLKET

SEQ ID NO: 99559 - protein, 11 aa, Dengue virus
QGAGWSLKETA

SEQ ID NO: 99560 - protein, 11 aa, Dengue virus
GAGWSLKETAC

SEQ ID NO: 99561 - protein, 11 aa, Dengue virus
AGWSLKETACL

SEQ ID NO: 99562 - protein, 11 aa, Dengue virus
GWSLKETACLG

SEQ ID NO: 99563 - protein, 11 aa, Dengue virus
WSLKETACLGK

SEQ ID NO: 99564 - protein, 11 aa, Dengue virus
SLKETACLGKA

SEQ ID NO: 99565 - protein, 11 aa, Dengue virus
LKETACLGKAY

SEQ ID NO: 99566 - protein, 11 aa, Dengue virus
KETACLGKAYA

SEQ ID NO: 99567 - protein, 11 aa, Dengue virus
AICSAVPTEWL

SEQ ID NO: 99568 - protein, 11 aa, Dengue virus
ICSAVPTEWLP

SEQ ID NO: 99569 - protein, 11 aa, Dengue virus
CSAVPTEWLPT

SEQ ID NO: 99570 - protein, 11 aa, Dengue virus
SAVPTEWLPTS

SEQ ID NO: 99571 - protein, 11 aa, Dengue virus
AVPTEWLPTSR

SEQ ID NO: 99572 - protein, 11 aa, Dengue virus
VPTEWLPTSRT

SEQ ID NO: 99573 - protein, 11 aa, Dengue virus
PVEWVPTSRTT

SEQ ID NO: 99574 - protein, 11 aa, Dengue virus
TEWLPTSRTTW

SEQ ID NO: 99575 - protein, 11 aa, Dengue virus
EWLPTSRTTWS

SEQ ID NO: 99576 - protein, 11 aa, Dengue virus
WVPTSRTTWSI

SEQ ID NO: 99577 - protein, 11 aa, Dengue virus
LPTSRTTWSIH

SEQ ID NO: 99578 - protein, 11 aa, Dengue virus
RVWIEDNPNMT

SEQ ID NO: 99579 - protein, 11 aa, Dengue virus
VWIEDNPNMTD

SEQ ID NO: 99580 - protein, 11 aa, Dengue virus
WIEDNPNMTDK

SEQ ID NO: 99581 - protein, 11 aa, Dengue virus
IEDNPNMTDKT

SEQ ID NO: 99582 - protein, 11 aa, Dengue virus
EDNPNMTDKTP

SEQ ID NO: 99583 - protein, 11 aa, Dengue virus
DNPNMTDKTPV

SEQ ID NO: 99584 - protein, 11 aa, Dengue virus
NPNMTDKTPVH

SEQ ID NO: 99585 - protein, 11 aa, Dengue virus
PNMTDKTPVHS

SEQ ID NO: 99586 - protein, 11 aa, Dengue virus
NMTDKTPVHSW

SEQ ID NO: 99587 - protein, 11 aa, Dengue virus
MTDKTPVHSWE

SEQ ID NO: 99588 - protein, 11 aa, Dengue virus
TDKTPVHSWED

SEQ ID NO: 99589 - protein, 11 aa, Dengue virus
DKTPIHSWEDI

SEQ ID NO: 99590 - protein, 11 aa, Dengue virus
KTPIHSWEDIP

SEQ ID NO: 99591 - protein, 11 aa, Dengue virus
TPIHSWEDIPY

SEQ ID NO: 99592 - protein, 11 aa, Dengue virus
PIHSWEDIPYL

SEQ ID NO: 99593 - protein, 11 aa, Dengue virus
IHSWEDIPYLG

SEQ ID NO: 99594 - protein, 11 aa, Dengue virus
HSWEDVPYLGK

SEQ ID NO: 99595 - protein, 11 aa, Dengue virus
SWEDVPYLGKR

SEQ ID NO: 99596 - protein, 11 aa, Dengue virus
WEDVPYLGKRE

SEQ ID NO: 99597 - protein, 11 aa, Dengue virus
EDVPYLGKRED

SEQ ID NO: 99598 - protein, 11 aa, Dengue virus
DVPYLGKREDL

SEQ ID NO: 99599 - protein, 11 aa, Dengue virus
VPYLGKREDLW

SEQ ID NO: 99600 - protein, 11 aa, Dengue virus
TSRATWAKNIQ

SEQ ID NO: 99601 - protein, 11 aa, Dengue virus
SRATWAKNIQT

SEQ ID NO: 99602 - protein, 11 aa, Dengue virus
RATWAKNIQTA

SEQ ID NO: 99603 - protein, 11 aa, Dengue virus
ATWAKNIQTAI

SEQ ID NO: 99604 - protein, 11 aa, Dengue virus
TWAKNIQTAIT

SEQ ID NO: 99605 - protein, 11 aa, Dengue virus
WAKNIHTAIAQ

SEQ ID NO: 99606 - protein, 11 aa, Dengue virus
AKNIQTAITQV

SEQ ID NO: 99607 - protein, 11 aa, Dengue virus
KNIHTAIAQVR

SEQ ID NO: 99608 - protein, 11 aa, Dengue virus
NIHTAIAQVRN

SEQ ID NO: 99609 - protein, 11 aa, Dengue virus
IQTAITQVRNL

SEQ ID NO: 99610 - protein, 11 aa, Dengue virus
QTAITQVRNLI

SEQ ID NO: 99611 - protein, 11 aa, Dengue virus
TAIAQVRNLIG

SEQ ID NO: 99612 - protein, 11 aa, Dengue virus
AIAQVRNLIGK

SEQ ID NO: 99613 - protein, 11 aa, Dengue virus
IAQVRNLIGKE

SEQ ID NO: 99614 - protein, 11 aa, Dengue virus
AQVRNLIGKEE

SEQ ID NO: 99615 - protein, 11 aa, Dengue virus
VRNLIGKEEYA

SEQ ID NO: 99616 - protein, 11 aa, Dengue virus
RNLIGKEEYMD

SEQ ID NO: 99617 - protein, 11 aa, Dengue virus
NLIGKEEYADY

SEQ ID NO: 99618 - protein, 11 aa, Dengue virus
LIGKEEYMDYM

SEQ ID NO: 99619 - protein, 11 aa, Dengue virus
IGKEEYADYMP

SEQ ID NO: 99620 - protein, 11 aa, Dengue virus
GKEEYVDYMPA

SEQ ID NO: 99621 - protein, 11 aa, Dengue virus
KEEYVDYMPAM

SEQ ID NO: 99622 - protein, 11 aa, Dengue virus
EEYVDYMPAMK

SEQ ID NO: 99623 - protein, 11 aa, Dengue virus
EYVDYMPAMKR

SEQ ID NO: 99624 - protein, 11 aa, Dengue virus
YVDYMPAMKRY

SEQ ID NO: 99625 - protein, 11 aa, Dengue virus
VDYMPAMKRYS

SEQ ID NO: 99626 - protein, 11 aa, Dengue virus
DYMPAMKRYSA

SEQ ID NO: 99627 - protein, 11 aa, Dengue virus
YMPAMKRYSAP

SEQ ID NO: 99628 - protein, 11 aa, Dengue virus
RYSAPFESEGV

SEQ ID NO: 99629 - protein, 11 aa, Dengue virus
YSAPFESEGVL

SEQ ID NO: 99630 - protein, 11 aa, Dengue virus
NNQRKKARNTP

SEQ ID NO: 99631 - protein, 11 aa, Dengue virus
NQRKKARNTPF

SEQ ID NO: 99632 - protein, 11 aa, Dengue virus
QRKKARNTPFN

SEQ ID NO: 99633 - protein, 11 aa, Dengue virus
RKKARNTPFNM

SEQ ID NO: 99634 - protein, 11 aa, Dengue virus
KKARNTPFNML

SEQ ID NO: 99635 - protein, 11 aa, Dengue virus
KARNTPFNMLK

SEQ ID NO: 99636 - protein, 11 aa, Dengue virus
ARNTPFNMLKR

SEQ ID NO: 99637 - protein, 11 aa, Dengue virus
RNTPFNMLKRE

SEQ ID NO: 99638 - protein, 11 aa, Dengue virus
TPQGLVKRFSI

SEQ ID NO: 99639 - protein, 11 aa, Dengue virus
PQGLVKRFSIG

SEQ ID NO: 99640 - protein, 11 aa, Dengue virus
QGLVKRFSIGL

SEQ ID NO: 99641 - protein, 11 aa, Dengue virus
QLTKRFSLGML

SEQ ID NO: 99642 - protein, 11 aa, Dengue virus
LTKRFSLGMLQ

SEQ ID NO: 99643 - protein, 11 aa, Dengue virus
TKRFSLGMLQG

SEQ ID NO: 99644 - protein, 11 aa, Dengue virus
KRFSLGMLQGR

SEQ ID NO: 99645 - protein, 11 aa, Dengue virus
RFSLGMLQGRG

SEQ ID NO: 99646 - protein, 11 aa, Dengue virus
FSLGMLQGRGP

SEQ ID NO: 99647 - protein, 11 aa, Dengue virus
SLGMLQGRGPL

SEQ ID NO: 99648 - protein, 11 aa, Dengue virus
LGMLQGRGPLK

SEQ ID NO: 99649 - protein, 11 aa, Dengue virus
ILKRWGTIKKS

SEQ ID NO: 99650 - protein, 11 aa, Dengue virus
LKRWGQLKKTK

SEQ ID NO: 99651 - protein, 11 aa, Dengue virus
KRWGQLKKTKA

SEQ ID NO: 99652 - protein, 11 aa, Dengue virus
RWGTIKKSKAI

SEQ ID NO: 99653 - protein, 11 aa, Dengue virus
WGQLKKTKAIK

SEQ ID NO: 99654 - protein, 11 aa, Dengue virus
GTIKKSKAINV

SEQ ID NO: 99655 - protein, 11 aa, Dengue virus
TIKKSKAINVL

SEQ ID NO: 99656 - protein, 11 aa, Dengue virus
LKKNKAIRILI

SEQ ID NO: 99657 - protein, 11 aa, Dengue virus
KKNKAIRILIG

SEQ ID NO: 99658 - protein, 11 aa, Dengue virus
KNKAIRILIGF

SEQ ID NO: 99659 - protein, 11 aa, Dengue virus
NKAIRILIGFR

SEQ ID NO: 99660 - protein, 11 aa, Dengue virus
KAIRILIGFRK

SEQ ID NO: 99661 - protein, 11 aa, Dengue virus
AIRILIGFRKE

SEQ ID NO: 99662 - protein, 11 aa, Dengue virus
IRILIGFRKEI

SEQ ID NO: 99663 - protein, 11 aa, Dengue virus
RILIGFRKEIG

SEQ ID NO: 99664 - protein, 11 aa, Dengue virus
VLRGFRKEIGR

SEQ ID NO: 99665 - protein, 11 aa, Dengue virus
LRGFRKEIGRM

SEQ ID NO: 99666 - protein, 11 aa, Dengue virus
RGFRKEIGRML

SEQ ID NO: 99667 - protein, 11 aa, Dengue virus
GRMLNILNRRK

SEQ ID NO: 99668 - protein, 11 aa, Dengue virus
RMLNILNRRKR

SEQ ID NO: 99669 - protein, 11 aa, Dengue virus
MLNILNRRRRT

SEQ ID NO: 99670 - protein, 11 aa, Dengue virus
LNILNGRRRST

SEQ ID NO: 99671 - protein, 11 aa, Dengue virus
RRRSTMTLLCL

SEQ ID NO: 99672 - protein, 11 aa, Dengue virus
RRSTMTLLCLI

SEQ ID NO: 99673 - protein, 11 aa, Dengue virus
RSTVTLLCLIP

SEQ ID NO: 99674 - protein, 11 aa, Dengue virus
STVTLLCLIPT

SEQ ID NO: 99675 - protein, 11 aa, Dengue virus
TLLCLIPTIMA

SEQ ID NO: 99676 - protein, 11 aa, Dengue virus
LLCLIPTIMAF

SEQ ID NO: 99677 - protein, 11 aa, Dengue virus
LCLIPTVMAFS

SEQ ID NO: 99678 - protein, 11 aa, Dengue virus
CLIPTVMAFSL

SEQ ID NO: 99679 - protein, 11 aa, Dengue virus
LIPTVMAFSLS

SEQ ID NO: 99680 - protein, 11 aa, Dengue virus
IPTVMAFSLST

SEQ ID NO: 99681 - protein, 11 aa, Dengue virus
PTVMAFSLSTR

SEQ ID NO: 99682 - protein, 11 aa, Dengue virus
TVMAFSLSTRD

SEQ ID NO: 99683 - protein, 11 aa, Dengue virus
VMAFSLSTRDG

SEQ ID NO: 99684 - protein, 11 aa, Dengue virus
MAFHLTTRNGE

SEQ ID NO: 99685 - protein, 11 aa, Dengue virus
AFHLTTRNGEP

SEQ ID NO: 99686 - protein, 11 aa, Dengue virus
FHLTTRNGEPH

SEQ ID NO: 99687 - protein, 11 aa, Dengue virus
HLTTRNGEPHM

SEQ ID NO: 99688 - protein, 11 aa, Dengue virus
TRDGEPLMIVG

SEQ ID NO: 99689 - protein, 11 aa, Dengue virus
RDGEPLMIVAR

SEQ ID NO: 99690 - protein, 11 aa, Dengue virus
DGEPLMIVGKH

SEQ ID NO: 99691 - protein, 11 aa, Dengue virus
GEPLMIVGKHE

SEQ ID NO: 99692 - protein, 11 aa, Dengue virus
EPLMIVARHER

SEQ ID NO: 99693 - protein, 11 aa, Dengue virus
PLMIVGKHERG

SEQ ID NO: 99694 - protein, 11 aa, Dengue virus
LMIVARHERGR

SEQ ID NO: 99695 - protein, 11 aa, Dengue virus
MIVGKHERGRP

SEQ ID NO: 99696 - protein, 11 aa, Dengue virus
IVARHERGRPL

SEQ ID NO: 99697 - protein, 11 aa, Dengue virus
VGKHERGRPLL

SEQ ID NO: 99698 - protein, 11 aa, Dengue virus
ARHERGRPLLF

SEQ ID NO: 99699 - protein, 11 aa, Dengue virus
LLFKTTEGTNK

SEQ ID NO: 99700 - protein, 11 aa, Dengue virus
LFKTTEGINRC

SEQ ID NO: 99701 - protein, 11 aa, Dengue virus
FKTTEGTNKCT

SEQ ID NO: 99702 - protein, 11 aa, Dengue virus
KTTEGTNKCTL

SEQ ID NO: 99703 - protein, 11 aa, Dengue virus
TTEGINRCTLI

SEQ ID NO: 99704 - protein, 11 aa, Dengue virus
TEGTNKCTLIA

SEQ ID NO: 99705 - protein, 11 aa, Dengue virus
EGINRCTLIAM

SEQ ID NO: 99706 - protein, 11 aa, Dengue virus
GINRCTLIAMD

SEQ ID NO: 99707 - protein, 11 aa, Dengue virus
INRCTLIAMDV

SEQ ID NO: 99708 - protein, 11 aa, Dengue virus
GEMCEDTVTYE

SEQ ID NO: 99709 - protein, 11 aa, Dengue virus
ELCEDTITYKC

SEQ ID NO: 99710 - protein, 11 aa, Dengue virus
MCEDTVTYECP

SEQ ID NO: 99711 - protein, 11 aa, Dengue virus
CEDTVTYECPL

SEQ ID NO: 99712 - protein, 11 aa, Dengue virus
EDTVTYECPLL

SEQ ID NO: 99713 - protein, 11 aa, Dengue virus
DTITYKCPLLR

SEQ ID NO: 99714 - protein, 11 aa, Dengue virus
TITYKCPLLRQ

SEQ ID NO: 99715 - protein, 11 aa, Dengue virus
ITYKCPLLRQN

SEQ ID NO: 99716 - protein, 11 aa, Dengue virus
TYECPLLVNTE

SEQ ID NO: 99717 - protein, 11 aa, Dengue virus
YECPLLVNTEP

SEQ ID NO: 99718 - protein, 11 aa, Dengue virus
KCPLLRQNEPE

SEQ ID NO: 99719 - protein, 11 aa, Dengue virus
CPLLRQNEPED

SEQ ID NO: 99720 - protein, 11 aa, Dengue virus
PLLRQNEPEDI

SEQ ID NO: 99721 - protein, 11 aa, Dengue virus
LLRQNEPEDID

SEQ ID NO: 99722 - protein, 11 aa, Dengue virus
LRQNEPEDIDC

SEQ ID NO: 99723 - protein, 11 aa, Dengue virus
RQNEPEDIDCW

SEQ ID NO: 99724 - protein, 11 aa, Dengue virus
DIDCWCNSTST

SEQ ID NO: 99725 - protein, 11 aa, Dengue virus
IDCWCNSTSTW

SEQ ID NO: 99726 - protein, 11 aa, Dengue virus
DCWCNSTSTWV

SEQ ID NO: 99727 - protein, 11 aa, Dengue virus
CWCNSTSTWVT

SEQ ID NO: 99728 - protein, 11 aa, Dengue virus
WCNSTSTWVTY

SEQ ID NO: 99729 - protein, 11 aa, Dengue virus
CNSTSTWVTYG

SEQ ID NO: 99730 - protein, 11 aa, Dengue virus
NSTSTWVTYGT

SEQ ID NO: 99731 - protein, 11 aa, Dengue virus
STSTWVTYGTC

SEQ ID NO: 99732 - protein, 11 aa, Dengue virus
TSTWVTYGTCT

SEQ ID NO: 99733 - protein, 11 aa, Dengue virus
STWVTYGTCTT

SEQ ID NO: 99734 - protein, 11 aa, Dengue virus
TWVMYGTCTQN

SEQ ID NO: 99735 - protein, 11 aa, Dengue virus
WVTYGTCTTTG

SEQ ID NO: 99736 - protein, 11 aa, Dengue virus
VTYGTCTTTGE

SEQ ID NO: 99737 - protein, 11 aa, Dengue virus
TYGTCTTTGEH

SEQ ID NO: 99738 - protein, 11 aa, Dengue virus
YGTCTTTGEHR

SEQ ID NO: 99739 - protein, 11 aa, Dengue virus
GTCTTTGEHRR

SEQ ID NO: 99740 - protein, 11 aa, Dengue virus
TCTTTGEHRRE

SEQ ID NO: 99741 - protein, 11 aa, Dengue virus
CTTTGEHRREK

SEQ ID NO: 99742 - protein, 11 aa, Dengue virus
TTTGEHRREKR

SEQ ID NO: 99743 - protein, 11 aa, Dengue virus
TTGEHRREKRS

SEQ ID NO: 99744 - protein, 11 aa, Dengue virus
TGEHRREKRSV

SEQ ID NO: 99745 - protein, 11 aa, Dengue virus
ALLAGFMAYMV

SEQ ID NO: 99746 - protein, 11 aa, Dengue virus
LLAGFMAYMVG

SEQ ID NO: 99747 - protein, 11 aa, Dengue virus
MAAILAYTIGT

SEQ ID NO: 99748 - protein, 11 aa, Dengue virus
AAILAYTIGTT

SEQ ID NO: 99749 - protein, 11 aa, Dengue virus
AILAYTIGTTH

SEQ ID NO: 99750 - protein, 11 aa, Dengue virus
ILAYTIGTTHF

SEQ ID NO: 99751 - protein, 11 aa, Dengue virus
MAYMVGQTGIQ

SEQ ID NO: 99752 - protein, 11 aa, Dengue virus
AYTIGTTHFQR

SEQ ID NO: 99753 - protein, 11 aa, Dengue virus
YMVGQTGIQRT

SEQ ID NO: 99754 - protein, 11 aa, Dengue virus
TIGTTHFQRAL

SEQ ID NO: 99755 - protein, 11 aa, Dengue virus
VGQTGIQRTVF

SEQ ID NO: 99756 - protein, 11 aa, Dengue virus
GQTGIQRAVFF

SEQ ID NO: 99757 - protein, 11 aa, Dengue virus
TTHFQRALIFI

SEQ ID NO: 99758 - protein, 11 aa, Dengue virus
THFQRALIFIL

SEQ ID NO: 99759 - protein, 11 aa, Dengue virus
HFQRALIFILL

SEQ ID NO: 99760 - protein, 11 aa, Dengue virus
FQRALIFILLT

SEQ ID NO: 99761 - protein, 11 aa, Dengue virus
QRALIFILLTA

SEQ ID NO: 99762 - protein, 11 aa, Dengue virus
RALIFILLTAV

SEQ ID NO: 99763 - protein, 11 aa, Dengue virus
ALIFILLTAVA

SEQ ID NO: 99764 - protein, 11 aa, Dengue virus
LIFILLTAVAP

SEQ ID NO: 99765 - protein, 11 aa, Dengue virus
IFILLTAVAPS

SEQ ID NO: 99766 - protein, 11 aa, Dengue virus
FILLTAVAPSM

SEQ ID NO: 99767 - protein, 11 aa, Dengue virus
ILLTAVAPSMT

SEQ ID NO: 99768 - protein, 11 aa, Dengue virus
AVAPSMTMRCI

SEQ ID NO: 99769 - protein, 11 aa, Dengue virus
VAPSYGMRCIG

SEQ ID NO: 99770 - protein, 11 aa, Dengue virus
APSMTMRCIGI

SEQ ID NO: 99771 - protein, 11 aa, Dengue virus
PSYGMRCIGVG

SEQ ID NO: 99772 - protein, 11 aa, Dengue virus
SYGMRCIGVGN

SEQ ID NO: 99773 - protein, 11 aa, Dengue virus
MTMRCIGISNR

SEQ ID NO: 99774 - protein, 11 aa, Dengue virus
TMRCIGISNRD

SEQ ID NO: 99775 - protein, 11 aa, Dengue virus
MRCIGVGNRDF

SEQ ID NO: 99776 - protein, 11 aa, Dengue virus
RCIGVGNRDFV

SEQ ID NO: 99777 - protein, 11 aa, Dengue virus
CIGISNRDFVE

SEQ ID NO: 99778 - protein, 11 aa, Dengue virus
IGVGNRDFVEG

SEQ ID NO: 99779 - protein, 11 aa, Dengue virus
RDFVEGVSGGV

SEQ ID NO: 99780 - protein, 11 aa, Dengue virus
DFVEGVSGGTW

SEQ ID NO: 99781 - protein, 11 aa, Dengue virus
FVEGVSGGTWV

SEQ ID NO: 99782 - protein, 11 aa, Dengue virus
VEGVSGGVWVD

SEQ ID NO: 99783 - protein, 11 aa, Dengue virus
EGVSGGTWVDL

SEQ ID NO: 99784 - protein, 11 aa, Dengue virus
GVSGGTWVDLV

SEQ ID NO: 99785 - protein, 11 aa, Dengue virus
VSGGTWVDLVL

SEQ ID NO: 99786 - protein, 11 aa, Dengue virus
SGGTWVDLVLE

SEQ ID NO: 99787 - protein, 11 aa, Dengue virus
GGTWVDLVLEH

SEQ ID NO: 99788 - protein, 11 aa, Dengue virus
GTWVDLVLEHG

SEQ ID NO: 99789 - protein, 11 aa, Dengue virus
TWVDLVLEHGG

SEQ ID NO: 99790 - protein, 11 aa, Dengue virus
KNKPTLDFELI

SEQ ID NO: 99791 - protein, 11 aa, Dengue virus
NKPTLDFELIK

SEQ ID NO: 99792 - protein, 11 aa, Dengue virus
PTLDFELIKTE

SEQ ID NO: 99793 - protein, 11 aa, Dengue virus
TLDFELIKTEA

SEQ ID NO: 99794 - protein, 11 aa, Dengue virus
LDFELIKTEAK

SEQ ID NO: 99795 - protein, 11 aa, Dengue virus
DFELIKTEAKQ

SEQ ID NO: 99796 - protein, 11 aa, Dengue virus
FELIKTEAKQP

SEQ ID NO: 99797 - protein, 11 aa, Dengue virus
ELIKTEAKQPA

SEQ ID NO: 99798 - protein, 11 aa, Dengue virus
LIKTEAKQPAT

SEQ ID NO: 99799 - protein, 11 aa, Dengue virus
IKTEAKQPATL

SEQ ID NO: 99800 - protein, 11 aa, Dengue virus
ATLRKYCIEAK

SEQ ID NO: 99801 - protein, 11 aa, Dengue virus
TLRKYCIEAKL

SEQ ID NO: 99802 - protein, 11 aa, Dengue virus
LRKYCIEAKLT

SEQ ID NO: 99803 - protein, 11 aa, Dengue virus
RKYCIEAKLTN

SEQ ID NO: 99804 - protein, 11 aa, Dengue virus
KYCIEAKLTNT

SEQ ID NO: 99805 - protein, 11 aa, Dengue virus
YCIEAKLTNTT

SEQ ID NO: 99806 - protein, 11 aa, Dengue virus
CIEAKLTNTTT

SEQ ID NO: 99807 - protein, 11 aa, Dengue virus
IEAKLTNTTTE

SEQ ID NO: 99808 - protein, 11 aa, Dengue virus
EAKLTNTTTES

SEQ ID NO: 99809 - protein, 11 aa, Dengue virus
AKLTNTTTESR

SEQ ID NO: 99810 - protein, 11 aa, Dengue virus
KLTNTTTESRC

SEQ ID NO: 99811 - protein, 11 aa, Dengue virus
EQDQQYICRRN

SEQ ID NO: 99812 - protein, 11 aa, Dengue virus
QDQQYICRRDM

SEQ ID NO: 99813 - protein, 11 aa, Dengue virus
DKRFVCKHSMV

SEQ ID NO: 99814 - protein, 11 aa, Dengue virus
QQYICRRDMVD

SEQ ID NO: 99815 - protein, 11 aa, Dengue virus
QYICRRDMVDR

SEQ ID NO: 99816 - protein, 11 aa, Dengue virus
FVCKHSMVDRG

SEQ ID NO: 99817 - protein, 11 aa, Dengue virus
ICRRDMVDRGW

SEQ ID NO: 99818 - protein, 11 aa, Dengue virus
CRRDMVDRGWG

SEQ ID NO: 99819 - protein, 11 aa, Dengue virus
RRDMVDRGWGN

SEQ ID NO: 99820 - protein, 11 aa, Dengue virus
RDMVDRGWGNG

SEQ ID NO: 99821 - protein, 11 aa, Dengue virus
DMVDRGWGNGC

SEQ ID NO: 99822 - protein, 11 aa, Dengue virus
KGGIVTCAMFT

SEQ ID NO: 99823 - protein, 11 aa, Dengue virus
GGIVTCAMFTC

SEQ ID NO: 99824 - protein, 11 aa, Dengue virus
GIVTCAMFTCK

SEQ ID NO: 99825 - protein, 11 aa, Dengue virus
IVTCAMFTCKK

SEQ ID NO: 99826 - protein, 11 aa, Dengue virus
VTCAMFTCKKN

SEQ ID NO: 99827 - protein, 11 aa, Dengue virus
TCAMFTCKKNM

SEQ ID NO: 99828 - protein, 11 aa, Dengue virus
CAMFTCKKNME

SEQ ID NO: 99829 - protein, 11 aa, Dengue virus
AMFTCKKNMEG

SEQ ID NO: 99830 - protein, 11 aa, Dengue virus
MFTCKKNMEGK

SEQ ID NO: 99831 - protein, 11 aa, Dengue virus
FTCKKNMEGKV

SEQ ID NO: 99832 - protein, 11 aa, Dengue virus
TCKKNMEGKVV

SEQ ID NO: 99833 - protein, 11 aa, Dengue virus
SGEEHAVGNDT

SEQ ID NO: 99834 - protein, 11 aa, Dengue virus
GEEHAVGNDTG

SEQ ID NO: 99835 - protein, 11 aa, Dengue virus
EEHAVGNDTGK

SEQ ID NO: 99836 - protein, 11 aa, Dengue virus
THAVGNDIPNH

SEQ ID NO: 99837 - protein, 11 aa, Dengue virus
HAVGNDIPNHG

SEQ ID NO: 99838 - protein, 11 aa, Dengue virus
AVGNDTGKHGK

SEQ ID NO: 99839 - protein, 11 aa, Dengue virus
VGNDIPNHGVT

SEQ ID NO: 99840 - protein, 11 aa, Dengue virus
GNDTGKHGKEI

SEQ ID NO: 99841 - protein, 11 aa, Dengue virus
NDTGKHGKEIK

SEQ ID NO: 99842 - protein, 11 aa, Dengue virus
DTGKHGKEIKI

SEQ ID NO: 99843 - protein, 11 aa, Dengue virus
TSNHGVTTTIT

SEQ ID NO: 99844 - protein, 11 aa, Dengue virus
SNHGVTTTITP

SEQ ID NO: 99845 - protein, 11 aa, Dengue virus
NHGVTTTITPR

SEQ ID NO: 99846 - protein, 11 aa, Dengue virus
HGVTTTITPRS

SEQ ID NO: 99847 - protein, 11 aa, Dengue virus
GVTTTITPRSP

SEQ ID NO: 99848 - protein, 11 aa, Dengue virus
VTTTITPRSPS

SEQ ID NO: 99849 - protein, 11 aa, Dengue virus
TTTITPRSPSV

SEQ ID NO: 99850 - protein, 11 aa, Dengue virus
TTITPRSPSVE

SEQ ID NO: 99851 - protein, 11 aa, Dengue virus
TITPRTPSVEV

SEQ ID NO: 99852 - protein, 11 aa, Dengue virus
ITPRTPSVEVK

SEQ ID NO: 99853 - protein, 11 aa, Dengue virus
TPRTPSVEVKL

SEQ ID NO: 99854 - protein, 11 aa, Dengue virus
PRSPSVEVELP

SEQ ID NO: 99855 - protein, 11 aa, Dengue virus
QSSITEAELTG

SEQ ID NO: 99856 - protein, 11 aa, Dengue virus
SSITEAELTGY

SEQ ID NO: 99857 - protein, 11 aa, Dengue virus
PSVEVELPDYG

SEQ ID NO: 99858 - protein, 11 aa, Dengue virus
ITEAELTGYGT

SEQ ID NO: 99859 - protein, 11 aa, Dengue virus
VEVELPDYGEL

SEQ ID NO: 99860 - protein, 11 aa, Dengue virus
EVELPDYGELS

SEQ ID NO: 99861 - protein, 11 aa, Dengue virus
AELTGYGTVTM

SEQ ID NO: 99862 - protein, 11 aa, Dengue virus
ELPDYGELSLD

SEQ ID NO: 99863 - protein, 11 aa, Dengue virus
LTGYGTVTMEC

SEQ ID NO: 99864 - protein, 11 aa, Dengue virus
TGYGTVTMECS

SEQ ID NO: 99865 - protein, 11 aa, Dengue virus
DYGELSLDCEP

SEQ ID NO: 99866 - protein, 11 aa, Dengue virus
YGELSLDCEPR

SEQ ID NO: 99867 - protein, 11 aa, Dengue virus
GELSLDCEPRS

SEQ ID NO: 99868 - protein, 11 aa, Dengue virus
TVTMECSPRTG

SEQ ID NO: 99869 - protein, 11 aa, Dengue virus
LSLDCEPRSGI

SEQ ID NO: 99870 - protein, 11 aa, Dengue virus
TMECSPRTGLD

SEQ ID NO: 99871 - protein, 11 aa, Dengue virus
GIDFNEMILMR

SEQ ID NO: 99872 - protein, 11 aa, Dengue virus
IDFNEMILMRM

SEQ ID NO: 99873 - protein, 11 aa, Dengue virus
DFNEMILMKME

SEQ ID NO: 99874 - protein, 11 aa, Dengue virus
MKTKTWLVHKQ

SEQ ID NO: 99875 - protein, 11 aa, Dengue virus
EKKTWLVHKQW

SEQ ID NO: 99876 - protein, 11 aa, Dengue virus
TKTWLVHKQWF

SEQ ID NO: 99877 - protein, 11 aa, Dengue virus
QWFLDLPLPWL

SEQ ID NO: 99878 - protein, 11 aa, Dengue virus
WFLDLPLPWAA

SEQ ID NO: 99879 - protein, 11 aa, Dengue virus
FLDLPLPWAAG

SEQ ID NO: 99880 - protein, 11 aa, Dengue virus
LDLPLPWAAGA

SEQ ID NO: 99881 - protein, 11 aa, Dengue virus
DLPLPWAAGAD

SEQ ID NO: 99882 - protein, 11 aa, Dengue virus
LPLPWAAGADT

SEQ ID NO: 99883 - protein, 11 aa, Dengue virus
PLPWAAGADTS

SEQ ID NO: 99884 - protein, 11 aa, Dengue virus
LPWAAGADTSE

SEQ ID NO: 99885 - protein, 11 aa, Dengue virus
PWAAGADTSEV

SEQ ID NO: 99886 - protein, 11 aa, Dengue virus
WAAGADTSEVH

SEQ ID NO: 99887 - protein, 11 aa, Dengue virus
AAGADTSEVHW

SEQ ID NO: 99888 - protein, 11 aa, Dengue virus
PGADTQGSNWI

SEQ ID NO: 99889 - protein, 11 aa, Dengue virus
GADTQGSNWIQ

SEQ ID NO: 99890 - protein, 11 aa, Dengue virus
ADTQGSNWIQK

SEQ ID NO: 99891 - protein, 11 aa, Dengue virus
DTQGSNWIQKE

SEQ ID NO: 99892 - protein, 11 aa, Dengue virus
TQGSNWIQKET

SEQ ID NO: 99893 - protein, 11 aa, Dengue virus
LEVHWNHKERM

SEQ ID NO: 99894 - protein, 11 aa, Dengue virus
GSNWIQKETLV

SEQ ID NO: 99895 - protein, 11 aa, Dengue virus
SNWIQKETLVT

SEQ ID NO: 99896 - protein, 11 aa, Dengue virus
NWIQKETLVTF

SEQ ID NO: 99897 - protein, 11 aa, Dengue virus
WIQKETLVTFK

SEQ ID NO: 99898 - protein, 11 aa, Dengue virus
IQKETLVTFKN

SEQ ID NO: 99899 - protein, 11 aa, Dengue virus
QKETLVTFKNP

SEQ ID NO: 99900 - protein, 11 aa, Dengue virus
SQEGAMHTALT

SEQ ID NO: 99901 - protein, 11 aa, Dengue virus
QEGAMHTALTG

SEQ ID NO: 99902 - protein, 11 aa, Dengue virus
EGAMHTALTGA

SEQ ID NO: 99903 - protein, 11 aa, Dengue virus
GAMHTALTGAT

SEQ ID NO: 99904 - protein, 11 aa, Dengue virus
AMHTALTGATE

SEQ ID NO: 99905 - protein, 11 aa, Dengue virus
MHTALTGATEI

SEQ ID NO: 99906 - protein, 11 aa, Dengue virus
HTALTGATEIQ

SEQ ID NO: 99907 - protein, 11 aa, Dengue virus
TALTGATEIQM

SEQ ID NO: 99908 - protein, 11 aa, Dengue virus
ALTGATEIQMS

SEQ ID NO: 99909 - protein, 11 aa, Dengue virus
LTGATEIQMSS

SEQ ID NO: 99910 - protein, 11 aa, Dengue virus
TGATEIQMSSG

SEQ ID NO: 99911 - protein, 11 aa, Dengue virus
GHLKCKVRMER

SEQ ID NO: 99912 - protein, 11 aa, Dengue virus
HLKCKIRMEKL

SEQ ID NO: 99913 - protein, 11 aa, Dengue virus
LKCKIRMEKLR

SEQ ID NO: 99914 - protein, 11 aa, Dengue virus
KCKIRMEKLRI

SEQ ID NO: 99915 - protein, 11 aa, Dengue virus
CKIRMEKLRIK

SEQ ID NO: 99916 - protein, 11 aa, Dengue virus
KIRMEKLRIKG

SEQ ID NO: 99917 - protein, 11 aa, Dengue virus
VRMEKLRIKGI

SEQ ID NO: 99918 - protein, 11 aa, Dengue virus
RMERLRIKGMS

SEQ ID NO: 99919 - protein, 11 aa, Dengue virus
MERLRIKGMSY

SEQ ID NO: 99920 - protein, 11 aa, Dengue virus
ERLRIKGMSYT

SEQ ID NO: 99921 - protein, 11 aa, Dengue virus
KLRIKGISYTM

SEQ ID NO: 99922 - protein, 11 aa, Dengue virus
SMCTGKFKVVK

SEQ ID NO: 99923 - protein, 11 aa, Dengue virus
MCSGKFSIDRE

SEQ ID NO: 99924 - protein, 11 aa, Dengue virus
CSGKFSIDREM

SEQ ID NO: 99925 - protein, 11 aa, Dengue virus
SGKFSIDREMA

SEQ ID NO: 99926 - protein, 11 aa, Dengue virus
GKFKVVKEIAE

SEQ ID NO: 99927 - protein, 11 aa, Dengue virus
KFKVVKEIAET

SEQ ID NO: 99928 - protein, 11 aa, Dengue virus
FSIDREMAETQ

SEQ ID NO: 99929 - protein, 11 aa, Dengue virus
SIDREMAETQH

SEQ ID NO: 99930 - protein, 11 aa, Dengue virus
VVKEIAETQHG

SEQ ID NO: 99931 - protein, 11 aa, Dengue virus
DREMAETQHGT

SEQ ID NO: 99932 - protein, 11 aa, Dengue virus
REMAETQHGTT

SEQ ID NO: 99933 - protein, 11 aa, Dengue virus
MAETQHGTTVI

SEQ ID NO: 99934 - protein, 11 aa, Dengue virus
AETQHGTAVVK

SEQ ID NO: 99935 - protein, 11 aa, Dengue virus
ETQHGTAVVKV

SEQ ID NO: 99936 - protein, 11 aa, Dengue virus
TQHGTTVIKVK

SEQ ID NO: 99937 - protein, 11 aa, Dengue virus
QHGTAVVKVKY

SEQ ID NO: 99938 - protein, 11 aa, Dengue virus
HGTTVIKVKYE

SEQ ID NO: 99939 - protein, 11 aa, Dengue virus
GTTVIKVKYEG

SEQ ID NO: 99940 - protein, 11 aa, Dengue virus
TIVIRVQYEGD

SEQ ID NO: 99941 - protein, 11 aa, Dengue virus
IVIRVQYEGDG

SEQ ID NO: 99942 - protein, 11 aa, Dengue virus
VIRVQYEGDGS

SEQ ID NO: 99943 - protein, 11 aa, Dengue virus
IRVQYEGDGSP

SEQ ID NO: 99944 - protein, 11 aa, Dengue virus
RVQYEGDGSPC

SEQ ID NO: 99945 - protein, 11 aa, Dengue virus
VQYEGDGSPCK

SEQ ID NO: 99946 - protein, 11 aa, Dengue virus
KYEGAGAPCKI

SEQ ID NO: 99947 - protein, 11 aa, Dengue virus
YEGAGAPCKIP

SEQ ID NO: 99948 - protein, 11 aa, Dengue virus
EGDGSPCKIPF

SEQ ID NO: 99949 - protein, 11 aa, Dengue virus
GDGSPCKIPFE

SEQ ID NO: 99950 - protein, 11 aa, Dengue virus
AGAPCKIPIEI

SEQ ID NO: 99951 - protein, 11 aa, Dengue virus
GSPCKIPFEIM

SEQ ID NO: 99952 - protein, 11 aa, Dengue virus
SPCKIPFEIMD

SEQ ID NO: 99953 - protein, 11 aa, Dengue virus
PCKIPIEIRDV

SEQ ID NO: 99954 - protein, 11 aa, Dengue virus
CKIPIEIRDVN

SEQ ID NO: 99955 - protein, 11 aa, Dengue virus
KIPIEIRDVNK

SEQ ID NO: 99956 - protein, 11 aa, Dengue virus
IPIEIRDVNKE

SEQ ID NO: 99957 - protein, 11 aa, Dengue virus
PFEIMDLEKRH

SEQ ID NO: 99958 - protein, 11 aa, Dengue virus
FEIMDLEKRHV

SEQ ID NO: 99959 - protein, 11 aa, Dengue virus
EIRDVNKEKVI

SEQ ID NO: 99960 - protein, 11 aa, Dengue virus
IMDLEKRHVLG

SEQ ID NO: 99961 - protein, 11 aa, Dengue virus
MDLEKRHVLGR

SEQ ID NO: 99962 - protein, 11 aa, Dengue virus
AESTNSVTNIE

SEQ ID NO: 99963 - protein, 11 aa, Dengue virus
ENTNSATNIEL

SEQ ID NO: 99964 - protein, 11 aa, Dengue virus
STNSVTNIELE

SEQ ID NO: 99965 - protein, 11 aa, Dengue virus
KDSPVNIEAEP

SEQ ID NO: 99966 - protein, 11 aa, Dengue virus
DSPVNIEAEPP

SEQ ID NO: 99967 - protein, 11 aa, Dengue virus
SPVNIEAEPPF

SEQ ID NO: 99968 - protein, 11 aa, Dengue virus
PVNIEAEPPFG

SEQ ID NO: 99969 - protein, 11 aa, Dengue virus
LEPPFGDSYIM

SEQ ID NO: 99970 - protein, 11 aa, Dengue virus
EPPFGDSYIMI

SEQ ID NO: 99971 - protein, 11 aa, Dengue virus
PPFGDSYIMIG

SEQ ID NO: 99972 - protein, 11 aa, Dengue virus
PFGDSYIMIGV

SEQ ID NO: 99973 - protein, 11 aa, Dengue virus
FGDSYIIIGVE

SEQ ID NO: 99974 - protein, 11 aa, Dengue virus
GDSYIIIGVEP

SEQ ID NO: 99975 - protein, 11 aa, Dengue virus
DSYIMIGVGNS

SEQ ID NO: 99976 - protein, 11 aa, Dengue virus
SYIMIGVGNSA

SEQ ID NO: 99977 - protein, 11 aa, Dengue virus
YIIIGVEPGQL

SEQ ID NO: 99978 - protein, 11 aa, Dengue virus
IIIGVEPGQLK

SEQ ID NO: 99979 - protein, 11 aa, Dengue virus
IIGVEPGQLKL

SEQ ID NO: 99980 - protein, 11 aa, Dengue virus
IGVEPGQLKLN

SEQ ID NO: 99981 - protein, 11 aa, Dengue virus
GVEPGQLKLNW

SEQ ID NO: 99982 - protein, 11 aa, Dengue virus
VEPGQLKLNWF

SEQ ID NO: 99983 - protein, 11 aa, Dengue virus
EPGQLKLNWFK

SEQ ID NO: 99984 - protein, 11 aa, Dengue virus
PGQLKLNWFKK

SEQ ID NO: 99985 - protein, 11 aa, Dengue virus
FRKGSSIGKML

SEQ ID NO: 99986 - protein, 11 aa, Dengue virus
KKGSSIGQMFE

SEQ ID NO: 99987 - protein, 11 aa, Dengue virus
KGSSIGQMFET

SEQ ID NO: 99988 - protein, 11 aa, Dengue virus
GSSIGKMLEST

SEQ ID NO: 99989 - protein, 11 aa, Dengue virus
SSIGQMFETTM

SEQ ID NO: 99990 - protein, 11 aa, Dengue virus
SIGQMFETTMR

SEQ ID NO: 99991 - protein, 11 aa, Dengue virus
IGKMLESTYRG

SEQ ID NO: 99992 - protein, 11 aa, Dengue virus
GKMLESTYRGA

SEQ ID NO: 99993 - protein, 11 aa, Dengue virus
KMLESTYRGAK

SEQ ID NO: 99994 - protein, 11 aa, Dengue virus
MFETTMRGAKR

SEQ ID NO: 99995 - protein, 11 aa, Dengue virus
LESTYRGAKRM

SEQ ID NO: 99996 - protein, 11 aa, Dengue virus
AWDFGSLGGVF

SEQ ID NO: 99997 - protein, 11 aa, Dengue virus
WDFGSLGGVFT

SEQ ID NO: 99998 - protein, 11 aa, Dengue virus
DFGSLGGVFTS

SEQ ID NO: 99999 - protein, 11 aa, Dengue virus
FGSLGGVFTSI

SEQ ID NO: 100000 - protein, 11 aa, Dengue virus
GSLGGVFTSIG

SEQ ID NO: 100001 - protein, 11 aa, Dengue virus
SLGGVFTSIGK

SEQ ID NO: 100002 - protein, 11 aa, Dengue virus
LGGVFTSIGKA

SEQ ID NO: 100003 - protein, 11 aa, Dengue virus
GGVFTSIGKAL

SEQ ID NO: 100004 - protein, 11 aa, Dengue virus
GVFTSIGKALH

SEQ ID NO: 100005 - protein, 11 aa, Dengue virus
VFTSIGKALHQ

SEQ ID NO: 100006 - protein, 11 aa, Dengue virus
FTSIGKALHQV

SEQ ID NO: 100007 - protein, 11 aa, Dengue virus
TSIGKALHQVF

SEQ ID NO: 100008 - protein, 11 aa, Dengue virus
SIGKALHQVFG

SEQ ID NO: 100009 - protein, 11 aa, Dengue virus
LGKAVHQIFGS

SEQ ID NO: 100010 - protein, 11 aa, Dengue virus
GKAVHQIFGSV

SEQ ID NO: 100011 - protein, 11 aa, Dengue virus
KAVHQIFGSVY

SEQ ID NO: 100012 - protein, 11 aa, Dengue virus
ALHQVFGAIYG

SEQ ID NO: 100013 - protein, 11 aa, Dengue virus
LHQVFGAIYGA

SEQ ID NO: 100014 - protein, 11 aa, Dengue virus
HQVFGAIYGAA

SEQ ID NO: 100015 - protein, 11 aa, Dengue virus
QIFGSVYTTMF

SEQ ID NO: 100016 - protein, 11 aa, Dengue virus
IFGSVYTTMFG

SEQ ID NO: 100017 - protein, 11 aa, Dengue virus
GAAFSGVSWTM

SEQ ID NO: 100018 - protein, 11 aa, Dengue virus
AAFSGVSWTMK

SEQ ID NO: 100019 - protein, 11 aa, Dengue virus
AFSGVSWTMKI

SEQ ID NO: 100020 - protein, 11 aa, Dengue virus
FSGVSWTMKIL

SEQ ID NO: 100021 - protein, 11 aa, Dengue virus
SGVSWTMKILI

SEQ ID NO: 100022 - protein, 11 aa, Dengue virus
GVSWTMKILIG

SEQ ID NO: 100023 - protein, 11 aa, Dengue virus
VRILIGLLVLW

SEQ ID NO: 100024 - protein, 11 aa, Dengue virus
KILIGVIITWI

SEQ ID NO: 100025 - protein, 11 aa, Dengue virus
ILIGVIITWIG

SEQ ID NO: 100026 - protein, 11 aa, Dengue virus
LIGVIITWIGM

SEQ ID NO: 100027 - protein, 11 aa, Dengue virus
IGVIITWIGMN

SEQ ID NO: 100028 - protein, 11 aa, Dengue virus
GVIITWIGMNS

SEQ ID NO: 100029 - protein, 11 aa, Dengue virus
VIITWIGMNSR

SEQ ID NO: 100030 - protein, 11 aa, Dengue virus
LWIGTNSRNTP

SEQ ID NO: 100031 - protein, 11 aa, Dengue virus
WIGMNSRNTSM

SEQ ID NO: 100032 - protein, 11 aa, Dengue virus
IGMNSRNTSMA

SEQ ID NO: 100033 - protein, 11 aa, Dengue virus
GTNSRNTPMAM

SEQ ID NO: 100034 - protein, 11 aa, Dengue virus
TNSRNTPMAMT

SEQ ID NO: 100035 - protein, 11 aa, Dengue virus
NSRNTPMAMTC

SEQ ID NO: 100036 - protein, 11 aa, Dengue virus
SRNTPMAMTCI

SEQ ID NO: 100037 - protein, 11 aa, Dengue virus
RNTPMAMTCIA

SEQ ID NO: 100038 - protein, 11 aa, Dengue virus
NTPMAMTCIAV

SEQ ID NO: 100039 - protein, 11 aa, Dengue virus
TPMAMTCIAVG

SEQ ID NO: 100040 - protein, 11 aa, Dengue virus
PMAMTCIAVGG

SEQ ID NO: 100041 - protein, 11 aa, Dengue virus
LFLGFTVHADT

SEQ ID NO: 100042 - protein, 11 aa, Dengue virus
FLGFTVHADTG

SEQ ID NO: 100043 - protein, 11 aa, Dengue virus
LGFTVHADTGC

SEQ ID NO: 100044 - protein, 11 aa, Dengue virus
SWNGKELKCGS

SEQ ID NO: 100045 - protein, 11 aa, Dengue virus
WNGKELKCGSG

SEQ ID NO: 100046 - protein, 11 aa, Dengue virus
NGKELKCGSGI

SEQ ID NO: 100047 - protein, 11 aa, Dengue virus
ELKCGSGIFVA

SEQ ID NO: 100048 - protein, 11 aa, Dengue virus
LKCGSGIFVAD

SEQ ID NO: 100049 - protein, 11 aa, Dengue virus
KCGSGIFVADN

SEQ ID NO: 100050 - protein, 11 aa, Dengue virus
CGSGIFVADNV

SEQ ID NO: 100051 - protein, 11 aa, Dengue virus
GSGIFVADNVH

SEQ ID NO: 100052 - protein, 11 aa, Dengue virus
SGIFVADNVHT

SEQ ID NO: 100053 - protein, 11 aa, Dengue virus
GIFVADNVHTW

SEQ ID NO: 100054 - protein, 11 aa, Dengue virus
IFVTDNVHTWT

SEQ ID NO: 100055 - protein, 11 aa, Dengue virus
FVTDNVHTWTE

SEQ ID NO: 100056 - protein, 11 aa, Dengue virus
VTDNVHTWTEQ

SEQ ID NO: 100057 - protein, 11 aa, Dengue virus
TDNVHTWTEQY

SEQ ID NO: 100058 - protein, 11 aa, Dengue virus
DNVHTWIEQYK

SEQ ID NO: 100059 - protein, 11 aa, Dengue virus
NVHTWTEQHKF

SEQ ID NO: 100060 - protein, 11 aa, Dengue virus
VHTWIEQYKFQ

SEQ ID NO: 100061 - protein, 11 aa, Dengue virus
HTWIEQYKFQP

SEQ ID NO: 100062 - protein, 11 aa, Dengue virus
TWIEQYKFQPE

SEQ ID NO: 100063 - protein, 11 aa, Dengue virus
WIEQYKFQPES

SEQ ID NO: 100064 - protein, 11 aa, Dengue virus
IEQYKFQPESP

SEQ ID NO: 100065 - protein, 11 aa, Dengue virus
YKFQPESPARV

SEQ ID NO: 100066 - protein, 11 aa, Dengue virus
KFQPESPARVA

SEQ ID NO: 100067 - protein, 11 aa, Dengue virus
RLASAILIAHK

SEQ ID NO: 100068 - protein, 11 aa, Dengue virus
LASAILNAHKE

SEQ ID NO: 100069 - protein, 11 aa, Dengue virus
ASAILNAHKEG

SEQ ID NO: 100070 - protein, 11 aa, Dengue virus
SAILNAHEDGV

SEQ ID NO: 100071 - protein, 11 aa, Dengue virus
AILNAHEDGVC

SEQ ID NO: 100072 - protein, 11 aa, Dengue virus
ILIAHKDGVCG

SEQ ID NO: 100073 - protein, 11 aa, Dengue virus
LNAHKDGVCGV

SEQ ID NO: 100074 - protein, 11 aa, Dengue virus
NAHEDGVCGIR

SEQ ID NO: 100075 - protein, 11 aa, Dengue virus
AHKEGVCGIRS

SEQ ID NO: 100076 - protein, 11 aa, Dengue virus
HEDGVCGIRST

SEQ ID NO: 100077 - protein, 11 aa, Dengue virus
EDGVCGIRSTT

SEQ ID NO: 100078 - protein, 11 aa, Dengue virus
GHDLTVVTGDV

SEQ ID NO: 100079 - protein, 11 aa, Dengue virus
HDLTVVAGDVR

SEQ ID NO: 100080 - protein, 11 aa, Dengue virus
DLTIVAGDVKG

SEQ ID NO: 100081 - protein, 11 aa, Dengue virus
LTVVTGDVKGV

SEQ ID NO: 100082 - protein, 11 aa, Dengue virus
TIVAGDVKGVL

SEQ ID NO: 100083 - protein, 11 aa, Dengue virus
VAGDVKGVLVK

SEQ ID NO: 100084 - protein, 11 aa, Dengue virus
AGDAKGVLTKG

SEQ ID NO: 100085 - protein, 11 aa, Dengue virus
GDVKGVLVKGK

SEQ ID NO: 100086 - protein, 11 aa, Dengue virus
DAKGVLTKGKR

SEQ ID NO: 100087 - protein, 11 aa, Dengue virus
KGVLVKGKRAL

SEQ ID NO: 100088 - protein, 11 aa, Dengue virus
GVLVKGKRALT

SEQ ID NO: 100089 - protein, 11 aa, Dengue virus
VLTKGKRALAP

SEQ ID NO: 100090 - protein, 11 aa, Dengue virus
LVKGKRALTPP

SEQ ID NO: 100091 - protein, 11 aa, Dengue virus
LTPPVNDLKYS

SEQ ID NO: 100092 - protein, 11 aa, Dengue virus
TPPVNDLKYSW

SEQ ID NO: 100093 - protein, 11 aa, Dengue virus
PPVNDLKYSWK

SEQ ID NO: 100094 - protein, 11 aa, Dengue virus
PVNDLKYSWKT

SEQ ID NO: 100095 - protein, 11 aa, Dengue virus
VNDLKYSWKTW

SEQ ID NO: 100096 - protein, 11 aa, Dengue virus
WGKARIFTPEA

SEQ ID NO: 100097 - protein, 11 aa, Dengue virus
RNSTFLVDGPD

SEQ ID NO: 100098 - protein, 11 aa, Dengue virus
CPNERRAWNFL

SEQ ID NO: 100099 - protein, 11 aa, Dengue virus
PNERRAWNFLE

SEQ ID NO: 100100 - protein, 11 aa, Dengue virus
NERRAWNFLEV

SEQ ID NO: 100101 - protein, 11 aa, Dengue virus
ERRAWNFLEVE

SEQ ID NO: 100102 - protein, 11 aa, Dengue virus
RRAWNFLEVED

SEQ ID NO: 100103 - protein, 11 aa, Dengue virus
RAWNFLEVEDY

SEQ ID NO: 100104 - protein, 11 aa, Dengue virus
AWNFLEVEDYG

SEQ ID NO: 100105 - protein, 11 aa, Dengue virus
WNFLEVEDYGF

SEQ ID NO: 100106 - protein, 11 aa, Dengue virus
NFLEVEDYGFG

SEQ ID NO: 100107 - protein, 11 aa, Dengue virus
FLEVEDYGFGM

SEQ ID NO: 100108 - protein, 11 aa, Dengue virus
VLESQMLIPKA

SEQ ID NO: 100109 - protein, 11 aa, Dengue virus
LESQMLIPKAY

SEQ ID NO: 100110 - protein, 11 aa, Dengue virus
ESQMLIPKAYA

SEQ ID NO: 100111 - protein, 11 aa, Dengue virus
SQMLIPKAYAG

SEQ ID NO: 100112 - protein, 11 aa, Dengue virus
QMLIPKAYAGP

SEQ ID NO: 100113 - protein, 11 aa, Dengue virus
MLIPKAYAGPF

SEQ ID NO: 100114 - protein, 11 aa, Dengue virus
LIPKAYAGPFS

SEQ ID NO: 100115 - protein, 11 aa, Dengue virus
IPKAYAGPFSQ

SEQ ID NO: 100116 - protein, 11 aa, Dengue virus
PKAYAGPFSQH

SEQ ID NO: 100117 - protein, 11 aa, Dengue virus
KAYAGPFSQHN

SEQ ID NO: 100118 - protein, 11 aa, Dengue virus
SYAGPFSHHNY

SEQ ID NO: 100119 - protein, 11 aa, Dengue virus
YAGPISQHNYR

SEQ ID NO: 100120 - protein, 11 aa, Dengue virus
AGPISQHNYRQ

SEQ ID NO: 100121 - protein, 11 aa, Dengue virus
GPISQHNYRQG

SEQ ID NO: 100122 - protein, 11 aa, Dengue virus
PISQHNYRQGY

SEQ ID NO: 100123 - protein, 11 aa, Dengue virus
ISQHNYRQGYA

SEQ ID NO: 100124 - protein, 11 aa, Dengue virus
NYRQGYATQTA

SEQ ID NO: 100125 - protein, 11 aa, Dengue virus
YRQGYATQTAG

SEQ ID NO: 100126 - protein, 11 aa, Dengue virus
RQGYATQTAGP

SEQ ID NO: 100127 - protein, 11 aa, Dengue virus
QGYATQTAGPW

SEQ ID NO: 100128 - protein, 11 aa, Dengue virus
GYATQTAGPWH

SEQ ID NO: 100129 - protein, 11 aa, Dengue virus
YATQTAGPWHL

SEQ ID NO: 100130 - protein, 11 aa, Dengue virus
ATQTAGPWHLG

SEQ ID NO: 100131 - protein, 11 aa, Dengue virus
TQTAGPWHLGK

SEQ ID NO: 100132 - protein, 11 aa, Dengue virus
QTAGPWHLGKL

SEQ ID NO: 100133 - protein, 11 aa, Dengue virus
TAGPWHLGKLE

SEQ ID NO: 100134 - protein, 11 aa, Dengue virus
MGPWHLGKLEI

SEQ ID NO: 100135 - protein, 11 aa, Dengue virus
FGECPGTTVTV

SEQ ID NO: 100136 - protein, 11 aa, Dengue virus
GECPGTTVTVR

SEQ ID NO: 100137 - protein, 11 aa, Dengue virus
ECPGTTVTIQD

SEQ ID NO: 100138 - protein, 11 aa, Dengue virus
CPGTTVAIQED

SEQ ID NO: 100139 - protein, 11 aa, Dengue virus
PGTTVAIQEDC

SEQ ID NO: 100140 - protein, 11 aa, Dengue virus
QDDCDHRGPSL

SEQ ID NO: 100141 - protein, 11 aa, Dengue virus
DDCDHRGPSLR

SEQ ID NO: 100142 - protein, 11 aa, Dengue virus
DCGHRGSSLRT

SEQ ID NO: 100143 - protein, 11 aa, Dengue virus
YGMEIRPLSER

SEQ ID NO: 100144 - protein, 11 aa, Dengue virus
GMEIRPLSERE

SEQ ID NO: 100145 - protein, 11 aa, Dengue virus
MEIRPLSEREE

SEQ ID NO: 100146 - protein, 11 aa, Dengue virus
EIRPLSEREEN

SEQ ID NO: 100147 - protein, 11 aa, Dengue virus
IRPLSEREENM

SEQ ID NO: 100148 - protein, 11 aa, Dengue virus
RPLSEREENMV

SEQ ID NO: 100149 - protein, 11 aa, Dengue virus
PLSEREENMVK

SEQ ID NO: 100150 - protein, 11 aa, Dengue virus
LSEREENMVKS

SEQ ID NO: 100151 - protein, 11 aa, Dengue virus
SEREENMVKSQ

SEQ ID NO: 100152 - protein, 11 aa, Dengue virus
EKEENMVRSQV

SEQ ID NO: 100153 - protein, 11 aa, Dengue virus
EENMVKSQVSA

SEQ ID NO: 100154 - protein, 11 aa, Dengue virus
ENMVKSQVSAG

SEQ ID NO: 100155 - protein, 11 aa, Dengue virus
GSSETFSMGLL

SEQ ID NO: 100156 - protein, 11 aa, Dengue virus
TSETFFMGLLC

SEQ ID NO: 100157 - protein, 11 aa, Dengue virus
SMGLLCLTLFI

SEQ ID NO: 100158 - protein, 11 aa, Dengue virus
MGLLCLTLFIE

SEQ ID NO: 100159 - protein, 11 aa, Dengue virus
GLLCLTLFIEE

SEQ ID NO: 100160 - protein, 11 aa, Dengue virus
LLCLTLFIEEC

SEQ ID NO: 100161 - protein, 11 aa, Dengue virus
LCLTLFIEECL

SEQ ID NO: 100162 - protein, 11 aa, Dengue virus
CLTLFIEECLR

SEQ ID NO: 100163 - protein, 11 aa, Dengue virus
LTLFIEECLRR

SEQ ID NO: 100164 - protein, 11 aa, Dengue virus
TLFIEECLRRK

SEQ ID NO: 100165 - protein, 11 aa, Dengue virus
LFIEECLRRKV

SEQ ID NO: 100166 - protein, 11 aa, Dengue virus
FIEECLRRKVT

SEQ ID NO: 100167 - protein, 11 aa, Dengue virus
IEECLRRKVTR

SEQ ID NO: 100168 - protein, 11 aa, Dengue virus
RKVTRKHMILV

SEQ ID NO: 100169 - protein, 11 aa, Dengue virus
KVTRKHMILVV

SEQ ID NO: 100170 - protein, 11 aa, Dengue virus
VTRKHMILVVA

SEQ ID NO: 100171 - protein, 11 aa, Dengue virus
TRKHMILVVVT

SEQ ID NO: 100172 - protein, 11 aa, Dengue virus
RKHMILVVVTT

SEQ ID NO: 100173 - protein, 11 aa, Dengue virus
TTLCAIILGGL

SEQ ID NO: 100174 - protein, 11 aa, Dengue virus
ALIMLGDTMSS

SEQ ID NO: 100175 - protein, 11 aa, Dengue virus
IIMLGDTMFGR

SEQ ID NO: 100176 - protein, 11 aa, Dengue virus
IMLGDTMLSRV

SEQ ID NO: 100177 - protein, 11 aa, Dengue virus
MLGDTMLSRVG

SEQ ID NO: 100178 - protein, 11 aa, Dengue virus
LGDTMLSRVGG

SEQ ID NO: 100179 - protein, 11 aa, Dengue virus
GDTMLSRVGGQ

SEQ ID NO: 100180 - protein, 11 aa, Dengue virus
RMGGQIHLAIM

SEQ ID NO: 100181 - protein, 11 aa, Dengue virus
GGQVHLAIMAV

SEQ ID NO: 100182 - protein, 11 aa, Dengue virus
GQVHLAIMAVF

SEQ ID NO: 100183 - protein, 11 aa, Dengue virus
QVHLAIMAVFK

SEQ ID NO: 100184 - protein, 11 aa, Dengue virus
VHLAIMAVFKM

SEQ ID NO: 100185 - protein, 11 aa, Dengue virus
PGYVLGVFLRR

SEQ ID NO: 100186 - protein, 11 aa, Dengue virus
GYVLGVFLRRL

SEQ ID NO: 100187 - protein, 11 aa, Dengue virus
YVLGVFLRRLT

SEQ ID NO: 100188 - protein, 11 aa, Dengue virus
VLGVFLRRLTS

SEQ ID NO: 100189 - protein, 11 aa, Dengue virus
LGVFLRRLTSR

SEQ ID NO: 100190 - protein, 11 aa, Dengue virus
GVFLRRLTSRE

SEQ ID NO: 100191 - protein, 11 aa, Dengue virus
VFLRRLTSRET

SEQ ID NO: 100192 - protein, 11 aa, Dengue virus
MVIGMAMTTVF

SEQ ID NO: 100193 - protein, 11 aa, Dengue virus
VIGMAMTTVFS

SEQ ID NO: 100194 - protein, 11 aa, Dengue virus
IGMAMTTVFSI

SEQ ID NO: 100195 - protein, 11 aa, Dengue virus
GMAMTTVFSIP

SEQ ID NO: 100196 - protein, 11 aa, Dengue virus
MAMTTVFSIPH

SEQ ID NO: 100197 - protein, 11 aa, Dengue virus
AMTTVFSIPHD

SEQ ID NO: 100198 - protein, 11 aa, Dengue virus
MTTVFSIPHDL

SEQ ID NO: 100199 - protein, 11 aa, Dengue virus
TTVFSIPHDLM

SEQ ID NO: 100200 - protein, 11 aa, Dengue virus
TVFSIPHDLME

SEQ ID NO: 100201 - protein, 11 aa, Dengue virus
VFSIPHDLMEL

SEQ ID NO: 100202 - protein, 11 aa, Dengue virus
LSIPHDLMEFI

SEQ ID NO: 100203 - protein, 11 aa, Dengue virus
HDLMELIDGIA

SEQ ID NO: 100204 - protein, 11 aa, Dengue virus
DLMELIDGIAL

SEQ ID NO: 100205 - protein, 11 aa, Dengue virus
LMEFIDGLSLG

SEQ ID NO: 100206 - protein, 11 aa, Dengue virus
MELIDGIALGL

SEQ ID NO: 100207 - protein, 11 aa, Dengue virus
EFIDGLSLGLI

SEQ ID NO: 100208 - protein, 11 aa, Dengue virus
FIDGLSLGLIL

SEQ ID NO: 100209 - protein, 11 aa, Dengue virus
GLSLGLILLKM

SEQ ID NO: 100210 - protein, 11 aa, Dengue virus
LSLGLILLKMV

SEQ ID NO: 100211 - protein, 11 aa, Dengue virus
ALGLILLKMVV

SEQ ID NO: 100212 - protein, 11 aa, Dengue virus
LGLILLKMVTH

SEQ ID NO: 100213 - protein, 11 aa, Dengue virus
GLILLKMVTHF

SEQ ID NO: 100214 - protein, 11 aa, Dengue virus
LILLKMVTHFD

SEQ ID NO: 100215 - protein, 11 aa, Dengue virus
VTHFDDTQVGT

SEQ ID NO: 100216 - protein, 11 aa, Dengue virus
THFDDTQVGTL

SEQ ID NO: 100217 - protein, 11 aa, Dengue virus
HFDDTQVGTLA

SEQ ID NO: 100218 - protein, 11 aa, Dengue virus
FDNAQLGTLAL

SEQ ID NO: 100219 - protein, 11 aa, Dengue virus
DSTQVGTLALS

SEQ ID NO: 100220 - protein, 11 aa, Dengue virus
NTQVGTLALAL

SEQ ID NO: 100221 - protein, 11 aa, Dengue virus
GTLALSLTFIS

SEQ ID NO: 100222 - protein, 11 aa, Dengue virus
TLALSLTFIKT

SEQ ID NO: 100223 - protein, 11 aa, Dengue virus
LALALTFIKST

SEQ ID NO: 100224 - protein, 11 aa, Dengue virus
PLIMAWRTIMA

SEQ ID NO: 100225 - protein, 11 aa, Dengue virus
LTMAWRTIMAV

SEQ ID NO: 100226 - protein, 11 aa, Dengue virus
TMAWRTIMAVL

SEQ ID NO: 100227 - protein, 11 aa, Dengue virus
AWRTIMAVLFA

SEQ ID NO: 100228 - protein, 11 aa, Dengue virus
WRTIMAVLFAV

SEQ ID NO: 100229 - protein, 11 aa, Dengue virus
RTIMAVLFAVT

SEQ ID NO: 100230 - protein, 11 aa, Dengue virus
TIMAVLFAVTL

SEQ ID NO: 100231 - protein, 11 aa, Dengue virus
IMAVLFAVTLI

SEQ ID NO: 100232 - protein, 11 aa, Dengue virus
MAVLFAVTLIP

SEQ ID NO: 100233 - protein, 11 aa, Dengue virus
AVLFAVTLIPL

SEQ ID NO: 100234 - protein, 11 aa, Dengue virus
VLFAVTLIPLC

SEQ ID NO: 100235 - protein, 11 aa, Dengue virus
LFAVTLIPLCR

SEQ ID NO: 100236 - protein, 11 aa, Dengue virus
NQSHWVEITAL

SEQ ID NO: 100237 - protein, 11 aa, Dengue virus
QSHWVEITALT

SEQ ID NO: 100238 - protein, 11 aa, Dengue virus
SHWVEITALTL

SEQ ID NO: 100239 - protein, 11 aa, Dengue virus
HWVEITALTLG

SEQ ID NO: 100240 - protein, 11 aa, Dengue virus
WVEITALTLGA

SEQ ID NO: 100241 - protein, 11 aa, Dengue virus
VEITALTLGAQ

SEQ ID NO: 100242 - protein, 11 aa, Dengue virus
EITALTLGAQA

SEQ ID NO: 100243 - protein, 11 aa, Dengue virus
ITALTLGAQAL

SEQ ID NO: 100244 - protein, 11 aa, Dengue virus
TALTLGAQALP

SEQ ID NO: 100245 - protein, 11 aa, Dengue virus
ALTLGAQALPV

SEQ ID NO: 100246 - protein, 11 aa, Dengue virus
LTLGAQALPVY

SEQ ID NO: 100247 - protein, 11 aa, Dengue virus
SADLSLERAAN

SEQ ID NO: 100248 - protein, 11 aa, Dengue virus
ADLSLERAANV

SEQ ID NO: 100249 - protein, 11 aa, Dengue virus
DLSLERAANVQ

SEQ ID NO: 100250 - protein, 11 aa, Dengue virus
LSLERAANVQW

SEQ ID NO: 100251 - protein, 11 aa, Dengue virus
SLERAANVQWD

SEQ ID NO: 100252 - protein, 11 aa, Dengue virus
LERAANVQWDE

SEQ ID NO: 100253 - protein, 11 aa, Dengue virus
ERAANVQWDEM

SEQ ID NO: 100254 - protein, 11 aa, Dengue virus
RAANVQWDEMA

SEQ ID NO: 100255 - protein, 11 aa, Dengue virus
MAAITGSSPII

SEQ ID NO: 100256 - protein, 11 aa, Dengue virus
ADITGSSPVIE

SEQ ID NO: 100257 - protein, 11 aa, Dengue virus
DITGSSPVIEV

SEQ ID NO: 100258 - protein, 11 aa, Dengue virus
SSPIIEVKQDD

SEQ ID NO: 100259 - protein, 11 aa, Dengue virus
SPVIEVKQDED

SEQ ID NO: 100260 - protein, 11 aa, Dengue virus
PVIEVKQDEDG

SEQ ID NO: 100261 - protein, 11 aa, Dengue virus
VIEVKQDEDGS

SEQ ID NO: 100262 - protein, 11 aa, Dengue virus
LYPLAIPVTMA

SEQ ID NO: 100263 - protein, 11 aa, Dengue virus
YPLAIPVTMAL

SEQ ID NO: 100264 - protein, 11 aa, Dengue virus
PLAIPVTMALW

SEQ ID NO: 100265 - protein, 11 aa, Dengue virus
LAIPVTMALWY

SEQ ID NO: 100266 - protein, 11 aa, Dengue virus
AIPVTMALWYI

SEQ ID NO: 100267 - protein, 11 aa, Dengue virus
IPVTMALWYIW

SEQ ID NO: 100268 - protein, 11 aa, Dengue virus
PVTMALWYIWQ

SEQ ID NO: 100269 - protein, 11 aa, Dengue virus
VTMALWYIWQV

SEQ ID NO: 100270 - protein, 11 aa, Dengue virus
TMALWYMWQVK

SEQ ID NO: 100271 - protein, 11 aa, Dengue virus
MTLWYMWQVRT

SEQ ID NO: 100272 - protein, 11 aa, Dengue virus
ALWYMWQVKTQ

SEQ ID NO: 100273 - protein, 11 aa, Dengue virus
LWYMWQVRTQR

SEQ ID NO: 100274 - protein, 11 aa, Dengue virus
WYMWQVRTQRS

SEQ ID NO: 100275 - protein, 11 aa, Dengue virus
YMWQVRTQRSG

SEQ ID NO: 100276 - protein, 11 aa, Dengue virus
MWQVRTQRSGA

SEQ ID NO: 100277 - protein, 11 aa, Dengue virus
ALWDVPSPATA

SEQ ID NO: 100278 - protein, 11 aa, Dengue virus
LWDVPSPAAAQ

SEQ ID NO: 100279 - protein, 11 aa, Dengue virus
WDVPSPAAAQK

SEQ ID NO: 100280 - protein, 11 aa, Dengue virus
DVPSPAAAQKA

SEQ ID NO: 100281 - protein, 11 aa, Dengue virus
TQKATLSEGVY

SEQ ID NO: 100282 - protein, 11 aa, Dengue virus
QKATLSEGVYR

SEQ ID NO: 100283 - protein, 11 aa, Dengue virus
KATLTEGVYRI

SEQ ID NO: 100284 - protein, 11 aa, Dengue virus
ATLTEGVYRIM

SEQ ID NO: 100285 - protein, 11 aa, Dengue virus
TLTEGVYRIMQ

SEQ ID NO: 100286 - protein, 11 aa, Dengue virus
LLGRTQVGVGI

SEQ ID NO: 100287 - protein, 11 aa, Dengue virus
LGKTQVGVGVH

SEQ ID NO: 100288 - protein, 11 aa, Dengue virus
GRTQVGVGIHM

SEQ ID NO: 100289 - protein, 11 aa, Dengue virus
RTQVGVGIHME

SEQ ID NO: 100290 - protein, 11 aa, Dengue virus
TQVGVGVHVEG

SEQ ID NO: 100291 - protein, 11 aa, Dengue virus
QVGVGVHVEGV

SEQ ID NO: 100292 - protein, 11 aa, Dengue virus
VGVGVHVEGVF

SEQ ID NO: 100293 - protein, 11 aa, Dengue virus
GVGVHVEGVFH

SEQ ID NO: 100294 - protein, 11 aa, Dengue virus
VGIHTEGVFHT

SEQ ID NO: 100295 - protein, 11 aa, Dengue virus
GVHVEGVFHTM

SEQ ID NO: 100296 - protein, 11 aa, Dengue virus
VHVEGVFHTMW

SEQ ID NO: 100297 - protein, 11 aa, Dengue virus
HTEGVFHTMWH

SEQ ID NO: 100298 - protein, 11 aa, Dengue virus
VEGVFHTMWHV

SEQ ID NO: 100299 - protein, 11 aa, Dengue virus
DKEEDVQVLAV

SEQ ID NO: 100300 - protein, 11 aa, Dengue virus
KEEDVQVLAVE

SEQ ID NO: 100301 - protein, 11 aa, Dengue virus
PGTSGSPIVNR

SEQ ID NO: 100302 - protein, 11 aa, Dengue virus
GSSGSPIINRK

SEQ ID NO: 100303 - protein, 11 aa, Dengue virus
TSGSPIVNRKG

SEQ ID NO: 100304 - protein, 11 aa, Dengue virus
IRYQTPAVKAE

SEQ ID NO: 100305 - protein, 11 aa, Dengue virus
AIFMTATPPGT

SEQ ID NO: 100306 - protein, 11 aa, Dengue virus
IFMTATPPGTT

SEQ ID NO: 100307 - protein, 11 aa, Dengue virus
FMTATPPGTTD

SEQ ID NO: 100308 - protein, 11 aa, Dengue virus
MTATPPGTTDP

SEQ ID NO: 100309 - protein, 11 aa, Dengue virus
TATPPGTTDPF

SEQ ID NO: 100310 - protein, 11 aa, Dengue virus
ATPPGTTDPFP

SEQ ID NO: 100311 - protein, 11 aa, Dengue virus
TPPGTTDPFPQ

SEQ ID NO: 100312 - protein, 11 aa, Dengue virus
PPGTTDPFPQS

SEQ ID NO: 100313 - protein, 11 aa, Dengue virus
PGTTDPFPQSN

SEQ ID NO: 100314 - protein, 11 aa, Dengue virus
GTTDPFPQSNS

SEQ ID NO: 100315 - protein, 11 aa, Dengue virus
TTDPFPQSNSP

SEQ ID NO: 100316 - protein, 11 aa, Dengue virus
PRRCLKPVIST

SEQ ID NO: 100317 - protein, 11 aa, Dengue virus
RRCLKPVISTD

SEQ ID NO: 100318 - protein, 11 aa, Dengue virus
RCLKPVISTDG

SEQ ID NO: 100319 - protein, 11 aa, Dengue virus
CLKPVISTDGP

SEQ ID NO: 100320 - protein, 11 aa, Dengue virus
LKPVISTDGPE

SEQ ID NO: 100321 - protein, 11 aa, Dengue virus
KPVISTDGPER

SEQ ID NO: 100322 - protein, 11 aa, Dengue virus
PVISTDGPERV

SEQ ID NO: 100323 - protein, 11 aa, Dengue virus
VISTDGPERVI

SEQ ID NO: 100324 - protein, 11 aa, Dengue virus
ISTDGPERVIL

SEQ ID NO: 100325 - protein, 11 aa, Dengue virus
STDGPERVILA

SEQ ID NO: 100326 - protein, 11 aa, Dengue virus
QRRGRIGRNPT

SEQ ID NO: 100327 - protein, 11 aa, Dengue virus
RRGRIGRNPTQ

SEQ ID NO: 100328 - protein, 11 aa, Dengue virus
RGRIGRNPTQE

SEQ ID NO: 100329 - protein, 11 aa, Dengue virus
GRIGRNPTQED

SEQ ID NO: 100330 - protein, 11 aa, Dengue virus
RIGRNPTQEDD

SEQ ID NO: 100331 - protein, 11 aa, Dengue virus
IGRNPTQEDDQ

SEQ ID NO: 100332 - protein, 11 aa, Dengue virus
GRNPTQEDDQY

SEQ ID NO: 100333 - protein, 11 aa, Dengue virus
RNPTQEDDQYV

SEQ ID NO: 100334 - protein, 11 aa, Dengue virus
NPTQEDDQYVF

SEQ ID NO: 100335 - protein, 11 aa, Dengue virus
PTQEDDQYVFS

SEQ ID NO: 100336 - protein, 11 aa, Dengue virus
DILTEIATLPA

SEQ ID NO: 100337 - protein, 11 aa, Dengue virus
ILTEIATLPAY

SEQ ID NO: 100338 - protein, 11 aa, Dengue virus
LTEIATLPAYL

SEQ ID NO: 100339 - protein, 11 aa, Dengue virus
TEIATLPAYLS

SEQ ID NO: 100340 - protein, 11 aa, Dengue virus
EIATLPAYLSS

SEQ ID NO: 100341 - protein, 11 aa, Dengue virus
IATLPAYLSSK

SEQ ID NO: 100342 - protein, 11 aa, Dengue virus
ATLPAYLSSKA

SEQ ID NO: 100343 - protein, 11 aa, Dengue virus
TLPAYLSSKAK

SEQ ID NO: 100344 - protein, 11 aa, Dengue virus
LPAYLSSKAKL

SEQ ID NO: 100345 - protein, 11 aa, Dengue virus
PAYLSSKAKLA

SEQ ID NO: 100346 - protein, 11 aa, Dengue virus
AYLSSKAKLAL

SEQ ID NO: 100347 - protein, 11 aa, Dengue virus
VMLHTTERGGK

SEQ ID NO: 100348 - protein, 11 aa, Dengue virus
MLHTTERGGKA

SEQ ID NO: 100349 - protein, 11 aa, Dengue virus
LHTTERGGKAY

SEQ ID NO: 100350 - protein, 11 aa, Dengue virus
HTTERGGKAYQ

SEQ ID NO: 100351 - protein, 11 aa, Dengue virus
TTERGGKAYQH

SEQ ID NO: 100352 - protein, 11 aa, Dengue virus
TERGGKAYQHA

SEQ ID NO: 100353 - protein, 11 aa, Dengue virus
ERGGKAYQHAL

SEQ ID NO: 100354 - protein, 11 aa, Dengue virus
RGGKAYQHALN

SEQ ID NO: 100355 - protein, 11 aa, Dengue virus
IALLGAMTAGI

SEQ ID NO: 100356 - protein, 11 aa, Dengue virus
IFLFFMQGKGM

SEQ ID NO: 100357 - protein, 11 aa, Dengue virus
MQGKGMGKLSM

SEQ ID NO: 100358 - protein, 11 aa, Dengue virus
QGKGIGKLSVG

SEQ ID NO: 100359 - protein, 11 aa, Dengue virus
GKGMGKLSMGL

SEQ ID NO: 100360 - protein, 11 aa, Dengue virus
KGIGKLSVGLI

SEQ ID NO: 100361 - protein, 11 aa, Dengue virus
GIGKLSVGLIA

SEQ ID NO: 100362 - protein, 11 aa, Dengue virus
IGKLSVGLIAI

SEQ ID NO: 100363 - protein, 11 aa, Dengue virus
GKLSVGLIAIA

SEQ ID NO: 100364 - protein, 11 aa, Dengue virus
KLSMGLITIAM

SEQ ID NO: 100365 - protein, 11 aa, Dengue virus
LSMGLITIAMA

SEQ ID NO: 100366 - protein, 11 aa, Dengue virus
SMGLITIAMAS

SEQ ID NO: 100367 - protein, 11 aa, Dengue virus
MGLITIAMASG

SEQ ID NO: 100368 - protein, 11 aa, Dengue virus
GLITIAMASGL

SEQ ID NO: 100369 - protein, 11 aa, Dengue virus
LITIAMASGLL

SEQ ID NO: 100370 - protein, 11 aa, Dengue virus
ITIAMASGLLW

SEQ ID NO: 100371 - protein, 11 aa, Dengue virus
TIAMASGLLWI

SEQ ID NO: 100372 - protein, 11 aa, Dengue virus
IAVASGLFWVA

SEQ ID NO: 100373 - protein, 11 aa, Dengue virus
AVASGLFWVAE

SEQ ID NO: 100374 - protein, 11 aa, Dengue virus
VASGLFWVAEI

SEQ ID NO: 100375 - protein, 11 aa, Dengue virus
ASGLFWVAEIQ

SEQ ID NO: 100376 - protein, 11 aa, Dengue virus
SGLFWVAEIQP

SEQ ID NO: 100377 - protein, 11 aa, Dengue virus
GLFWVAEIQPQ

SEQ ID NO: 100378 - protein, 11 aa, Dengue virus
LFWVAEIQPQW

SEQ ID NO: 100379 - protein, 11 aa, Dengue virus
FWVAEIQPQWI

SEQ ID NO: 100380 - protein, 11 aa, Dengue virus
WVAELQPQWIA

SEQ ID NO: 100381 - protein, 11 aa, Dengue virus
VAELQPQWIAA

SEQ ID NO: 100382 - protein, 11 aa, Dengue virus
QLIYVILALLT

SEQ ID NO: 100383 - protein, 11 aa, Dengue virus
LIYVILTILAI

SEQ ID NO: 100384 - protein, 11 aa, Dengue virus
IYVILTILAII

SEQ ID NO: 100385 - protein, 11 aa, Dengue virus
YVILTILTIIA

SEQ ID NO: 100386 - protein, 11 aa, Dengue virus
VILTILTIIAL

SEQ ID NO: 100387 - protein, 11 aa, Dengue virus
ILTIIALVAAN

SEQ ID NO: 100388 - protein, 11 aa, Dengue virus
LTIIALVAANE

SEQ ID NO: 100389 - protein, 11 aa, Dengue virus
TIIALVAANEM

SEQ ID NO: 100390 - protein, 11 aa, Dengue virus
IIALVAANEMG

SEQ ID NO: 100391 - protein, 11 aa, Dengue virus
IALVAANEMGL

SEQ ID NO: 100392 - protein, 11 aa, Dengue virus
ALVAANEMGLI

SEQ ID NO: 100393 - protein, 11 aa, Dengue virus
KTKTDFGFYQE

SEQ ID NO: 100394 - protein, 11 aa, Dengue virus
TKADFGFYQVK

SEQ ID NO: 100395 - protein, 11 aa, Dengue virus
KADFGFYQVKT

SEQ ID NO: 100396 - protein, 11 aa, Dengue virus
ADFGFYQVKTE

SEQ ID NO: 100397 - protein, 11 aa, Dengue virus
DFGFYQEKTET

SEQ ID NO: 100398 - protein, 11 aa, Dengue virus
FGFYQEKTETT

SEQ ID NO: 100399 - protein, 11 aa, Dengue virus
GFYQEKTETTI

SEQ ID NO: 100400 - protein, 11 aa, Dengue virus
FYQEKTETTIL

SEQ ID NO: 100401 - protein, 11 aa, Dengue virus
YQEKTETTILD

SEQ ID NO: 100402 - protein, 11 aa, Dengue virus
QEKTETTILDV

SEQ ID NO: 100403 - protein, 11 aa, Dengue virus
EKTETTILDVD

SEQ ID NO: 100404 - protein, 11 aa, Dengue virus
KPETTILDVDL

SEQ ID NO: 100405 - protein, 11 aa, Dengue virus
PETTILDVDLR

SEQ ID NO: 100406 - protein, 11 aa, Dengue virus
TTLIASLVMLL

SEQ ID NO: 100407 - protein, 11 aa, Dengue virus
TLIASLVMLLV

SEQ ID NO: 100408 - protein, 11 aa, Dengue virus
LIASLVMLLVH

SEQ ID NO: 100409 - protein, 11 aa, Dengue virus
IASLVMLLVHY

SEQ ID NO: 100410 - protein, 11 aa, Dengue virus
ASLAMLLVHYA

SEQ ID NO: 100411 - protein, 11 aa, Dengue virus
SLAMLLVHYAI

SEQ ID NO: 100412 - protein, 11 aa, Dengue virus
LAMLLVHYAII

SEQ ID NO: 100413 - protein, 11 aa, Dengue virus
VMLFVHYAIIG

SEQ ID NO: 100414 - protein, 11 aa, Dengue virus
MLLVLCAGQLF

SEQ ID NO: 100415 - protein, 11 aa, Dengue virus
LLVLCAGQLFL

SEQ ID NO: 100416 - protein, 11 aa, Dengue virus
LVLCAGQLFLM

SEQ ID NO: 100417 - protein, 11 aa, Dengue virus
VLCAGQLFLMR

SEQ ID NO: 100418 - protein, 11 aa, Dengue virus
LCAGQLFLMRT

SEQ ID NO: 100419 - protein, 11 aa, Dengue virus
CAGQLFLMRTT

SEQ ID NO: 100420 - protein, 11 aa, Dengue virus
AGQLFLMRTTW

SEQ ID NO: 100421 - protein, 11 aa, Dengue virus
QLFLMRTTWAF

SEQ ID NO: 100422 - protein, 11 aa, Dengue virus
LFLMRTTWAFC

SEQ ID NO: 100423 - protein, 11 aa, Dengue virus
FLMRTTWAFCE

SEQ ID NO: 100424 - protein, 11 aa, Dengue virus
CEVLTLSTGPA

SEQ ID NO: 100425 - protein, 11 aa, Dengue virus
EVLTLATGPVL

SEQ ID NO: 100426 - protein, 11 aa, Dengue virus
VLTLATGPVLT

SEQ ID NO: 100427 - protein, 11 aa, Dengue virus
LTLATGPVLTL

SEQ ID NO: 100428 - protein, 11 aa, Dengue virus
TLATGPVLTLW

SEQ ID NO: 100429 - protein, 11 aa, Dengue virus
LATGPVLTLWE

SEQ ID NO: 100430 - protein, 11 aa, Dengue virus
ATGPVLTLWEG

SEQ ID NO: 100431 - protein, 11 aa, Dengue virus
TGPVLTLWEGN

SEQ ID NO: 100432 - protein, 11 aa, Dengue virus
GPVLTLWEGNP

SEQ ID NO: 100433 - protein, 11 aa, Dengue virus
PVLTLWEGNPG

SEQ ID NO: 100434 - protein, 11 aa, Dengue virus
VLTLWEGNPGR

SEQ ID NO: 100435 - protein, 11 aa, Dengue virus
AGLAFSLIKNT

SEQ ID NO: 100436 - protein, 11 aa, Dengue virus
GLAFSLIKNTQ

SEQ ID NO: 100437 - protein, 11 aa, Dengue virus
LAFSLIKNTQT

SEQ ID NO: 100438 - protein, 11 aa, Dengue virus
AFSLIKNAQAP

SEQ ID NO: 100439 - protein, 11 aa, Dengue virus
FSLIKNTQTPR

SEQ ID NO: 100440 - protein, 11 aa, Dengue virus
SLIKNTQTPRR

SEQ ID NO: 100441 - protein, 11 aa, Dengue virus
LIKNTQTPRRG

SEQ ID NO: 100442 - protein, 11 aa, Dengue virus
IKNTQTPRRGT

SEQ ID NO: 100443 - protein, 11 aa, Dengue virus
KNTQTPRRGTG

SEQ ID NO: 100444 - protein, 11 aa, Dengue virus
NAQAPRRGTGT

SEQ ID NO: 100445 - protein, 11 aa, Dengue virus
AQAPRRGTGTT

SEQ ID NO: 100446 - protein, 11 aa, Dengue virus
QTPRRGTGTIG

SEQ ID NO: 100447 - protein, 11 aa, Dengue virus
APRRGTGTTGE

SEQ ID NO: 100448 - protein, 11 aa, Dengue virus
AKSALKDGSKT

SEQ ID NO: 100449 - protein, 11 aa, Dengue virus
KSALKDGSKTK

SEQ ID NO: 100450 - protein, 11 aa, Dengue virus
SALKDGSKTKH

SEQ ID NO: 100451 - protein, 11 aa, Dengue virus
ALKDGSKTKHA

SEQ ID NO: 100452 - protein, 11 aa, Dengue virus
LKDGSKTKHAV

SEQ ID NO: 100453 - protein, 11 aa, Dengue virus
KDGSKTKHAVS

SEQ ID NO: 100454 - protein, 11 aa, Dengue virus
DGSKIKYAVSR

SEQ ID NO: 100455 - protein, 11 aa, Dengue virus
GSKIKYAVSRG

SEQ ID NO: 100456 - protein, 11 aa, Dengue virus
SKIKYAVSRGT

SEQ ID NO: 100457 - protein, 11 aa, Dengue virus
KIKYAVSRGTS

SEQ ID NO: 100458 - protein, 11 aa, Dengue virus
IKYAVSRGTSK

SEQ ID NO: 100459 - protein, 11 aa, Dengue virus
RGMVKPKGKVI

SEQ ID NO: 100460 - protein, 11 aa, Dengue virus
GMVKPKGKVID

SEQ ID NO: 100461 - protein, 11 aa, Dengue virus
MVKPKGKIVDL

SEQ ID NO: 100462 - protein, 11 aa, Dengue virus
VKPKGKIVDLG

SEQ ID NO: 100463 - protein, 11 aa, Dengue virus
IEELEKLQRKY

SEQ ID NO: 100464 - protein, 11 aa, Dengue virus
EELEKLQRKYG

SEQ ID NO: 100465 - protein, 11 aa, Dengue virus
ELEKLQRKYGG

SEQ ID NO: 100466 - protein, 11 aa, Dengue virus
LEKLQRKHGGS

SEQ ID NO: 100467 - protein, 11 aa, Dengue virus
EKLQRKHGGSL

SEQ ID NO: 100468 - protein, 11 aa, Dengue virus
KLQRKHGGSLV

SEQ ID NO: 100469 - protein, 11 aa, Dengue virus
LQRKHGGSLVR

SEQ ID NO: 100470 - protein, 11 aa, Dengue virus
QRKHGGSLVRC

SEQ ID NO: 100471 - protein, 11 aa, Dengue virus
RKHGGSLVRCP

SEQ ID NO: 100472 - protein, 11 aa, Dengue virus
KHGGSLVRCPL

SEQ ID NO: 100473 - protein, 11 aa, Dengue virus
HGGSLIRCPLS

SEQ ID NO: 100474 - protein, 11 aa, Dengue virus
GGSLIRCPLSR

SEQ ID NO: 100475 - protein, 11 aa, Dengue virus
GSLIRCPLSRN

SEQ ID NO: 100476 - protein, 11 aa, Dengue virus
SLIRCPLSRNS

SEQ ID NO: 100477 - protein, 11 aa, Dengue virus
TGNIVSSVNTI

SEQ ID NO: 100478 - protein, 11 aa, Dengue virus
VNTVSKMLLNR

SEQ ID NO: 100479 - protein, 11 aa, Dengue virus
NTISKMLLNWF

SEQ ID NO: 100480 - protein, 11 aa, Dengue virus
TISKMLLNWFT

SEQ ID NO: 100481 - protein, 11 aa, Dengue virus
VSKMLLNRFTT

SEQ ID NO: 100482 - protein, 11 aa, Dengue virus
LLNWFTTRHRK

SEQ ID NO: 100483 - protein, 11 aa, Dengue virus
LNRFTTKHRKP

SEQ ID NO: 100484 - protein, 11 aa, Dengue virus
NRFTTKHRKPT

SEQ ID NO: 100485 - protein, 11 aa, Dengue virus
RFTTKHRKPTY

SEQ ID NO: 100486 - protein, 11 aa, Dengue virus
RHRRPTYEKDV

SEQ ID NO: 100487 - protein, 11 aa, Dengue virus
ASSTGSASSMV

SEQ ID NO: 100488 - protein, 11 aa, Dengue virus
PSTGSTSSMVN

SEQ ID NO: 100489 - protein, 11 aa, Dengue virus
VKLLTKPWDMI

SEQ ID NO: 100490 - protein, 11 aa, Dengue virus
KLLTKPWDMIP

SEQ ID NO: 100491 - protein, 11 aa, Dengue virus
LLTKPWDMIPM

SEQ ID NO: 100492 - protein, 11 aa, Dengue virus
LTKPWDMIPMV

SEQ ID NO: 100493 - protein, 11 aa, Dengue virus
TKPWDMIPMVT

SEQ ID NO: 100494 - protein, 11 aa, Dengue virus
KPWDMIPMVTQ

SEQ ID NO: 100495 - protein, 11 aa, Dengue virus
PWDMIPMVTQL

SEQ ID NO: 100496 - protein, 11 aa, Dengue virus
WDMIPMVTQLA

SEQ ID NO: 100497 - protein, 11 aa, Dengue virus
DMIPMVTQLAM

SEQ ID NO: 100498 - protein, 11 aa, Dengue virus
MIPMVTQLAMT

SEQ ID NO: 100499 - protein, 11 aa, Dengue virus
TRTPQPKPGTQ

SEQ ID NO: 100500 - protein, 11 aa, Dengue virus
RTPQPKLGTRV

SEQ ID NO: 100501 - protein, 11 aa, Dengue virus
TPQPKPGTRVV

SEQ ID NO: 100502 - protein, 11 aa, Dengue virus
PQPKPGTRVVM

SEQ ID NO: 100503 - protein, 11 aa, Dengue virus
QPKPGTRVVMT

SEQ ID NO: 100504 - protein, 11 aa, Dengue virus
PKPGTRVVMTT

SEQ ID NO: 100505 - protein, 11 aa, Dengue virus
KPGTRVVMTTT

SEQ ID NO: 100506 - protein, 11 aa, Dengue virus
PGTRVVMTTTA

SEQ ID NO: 100507 - protein, 11 aa, Dengue virus
GTRVVMTTTAN

SEQ ID NO: 100508 - protein, 11 aa, Dengue virus
TRVVMTTTANW

SEQ ID NO: 100509 - protein, 11 aa, Dengue virus
RVVMTTTANWL

SEQ ID NO: 100510 - protein, 11 aa, Dengue virus
VVMTTTANWLW

SEQ ID NO: 100511 - protein, 11 aa, Dengue virus
VMTTTANWLWT

SEQ ID NO: 100512 - protein, 11 aa, Dengue virus
TANWLWTLLGK

SEQ ID NO: 100513 - protein, 11 aa, Dengue virus
ANWLWTLLGKK

SEQ ID NO: 100514 - protein, 11 aa, Dengue virus
NWLWTLLGKKK

SEQ ID NO: 100515 - protein, 11 aa, Dengue virus
LLGRKKNPRLC

SEQ ID NO: 100516 - protein, 11 aa, Dengue virus
LGRKKNPRLCT

SEQ ID NO: 100517 - protein, 11 aa, Dengue virus
KKTPRLCTREE

SEQ ID NO: 100518 - protein, 11 aa, Dengue virus
KTPRLCTREEF

SEQ ID NO: 100519 - protein, 11 aa, Dengue virus
TPRLCTREEFI

SEQ ID NO: 100520 - protein, 11 aa, Dengue virus
RLGYILEDIDR

SEQ ID NO: 100521 - protein, 11 aa, Dengue virus
LGYILEDIDRK

SEQ ID NO: 100522 - protein, 11 aa, Dengue virus
GYILEDIDRKD

SEQ ID NO: 100523 - protein, 11 aa, Dengue virus
YILEDIDRKDG

SEQ ID NO: 100524 - protein, 11 aa, Dengue virus
ILEDIDRKDGD

SEQ ID NO: 100525 - protein, 11 aa, Dengue virus
LEDIDRKDGDL

SEQ ID NO: 100526 - protein, 11 aa, Dengue virus
EDIDRKDGDLM

SEQ ID NO: 100527 - protein, 11 aa, Dengue virus
DIDRKDGDLMY

SEQ ID NO: 100528 - protein, 11 aa, Dengue virus
IDRKDGDLMYA

SEQ ID NO: 100529 - protein, 11 aa, Dengue virus
DRKDGDLMYAD

SEQ ID NO: 100530 - protein, 11 aa, Dengue virus
RKDGDLMYADD

SEQ ID NO: 100531 - protein, 11 aa, Dengue virus
LVTEQMAPHHK

SEQ ID NO: 100532 - protein, 11 aa, Dengue virus
ITEQMAPHHRI

SEQ ID NO: 100533 - protein, 11 aa, Dengue virus
TEQMAPHHRIL

SEQ ID NO: 100534 - protein, 11 aa, Dengue virus
EQMAPHHRILA

SEQ ID NO: 100535 - protein, 11 aa, Dengue virus
QMAPHHRILAK

SEQ ID NO: 100536 - protein, 11 aa, Dengue virus
MAPHHRILAKA

SEQ ID NO: 100537 - protein, 11 aa, Dengue virus
APHHRILAKAI

SEQ ID NO: 100538 - protein, 11 aa, Dengue virus
PHHRILAKAIF

SEQ ID NO: 100539 - protein, 11 aa, Dengue virus
HHRILAKAIFK

SEQ ID NO: 100540 - protein, 11 aa, Dengue virus
HRILAKAIFKL

SEQ ID NO: 100541 - protein, 11 aa, Dengue virus
RILAKAIFKLT

SEQ ID NO: 100542 - protein, 11 aa, Dengue virus
AEGVITQDDMH

SEQ ID NO: 100543 - protein, 11 aa, Dengue virus
EGVITQDDMHN

SEQ ID NO: 100544 - protein, 11 aa, Dengue virus
GVITRDDMHNP

SEQ ID NO: 100545 - protein, 11 aa, Dengue virus
VITQDDMHNPK

SEQ ID NO: 100546 - protein, 11 aa, Dengue virus
ITQDDMHNPKG

SEQ ID NO: 100547 - protein, 11 aa, Dengue virus
TRDDMHNPKGL

SEQ ID NO: 100548 - protein, 11 aa, Dengue virus
RDDMHNPKGLK

SEQ ID NO: 100549 - protein, 11 aa, Dengue virus
DMQNPKGLKEK

SEQ ID NO: 100550 - protein, 11 aa, Dengue virus
MQNPKGLRERV

SEQ ID NO: 100551 - protein, 11 aa, Dengue virus
QNPKGLRERVE

SEQ ID NO: 100552 - protein, 11 aa, Dengue virus
NPKGLKEKVEK

SEQ ID NO: 100553 - protein, 11 aa, Dengue virus
PKGLRERVEKW

SEQ ID NO: 100554 - protein, 11 aa, Dengue virus
KGLRERVEKWL

SEQ ID NO: 100555 - protein, 11 aa, Dengue virus
GLKERVENWLR

SEQ ID NO: 100556 - protein, 11 aa, Dengue virus
LKERVENWLRE

SEQ ID NO: 100557 - protein, 11 aa, Dengue virus
KERVENWLREC

SEQ ID NO: 100558 - protein, 11 aa, Dengue virus
ERVENWLRECG

SEQ ID NO: 100559 - protein, 11 aa, Dengue virus
RVENWLRECGV

SEQ ID NO: 100560 - protein, 11 aa, Dengue virus
VENWLRECGVD

SEQ ID NO: 100561 - protein, 11 aa, Dengue virus
ENWLRECGVDR

SEQ ID NO: 100562 - protein, 11 aa, Dengue virus
NWLRECGVDRL

SEQ ID NO: 100563 - protein, 11 aa, Dengue virus
CVVKPLDERFA

SEQ ID NO: 100564 - protein, 11 aa, Dengue virus
VVKPLDERFAT

SEQ ID NO: 100565 - protein, 11 aa, Dengue virus
VKPLDERFATS

SEQ ID NO: 100566 - protein, 11 aa, Dengue virus
KPLDERFATSL

SEQ ID NO: 100567 - protein, 11 aa, Dengue virus
PLDERFATSLL

SEQ ID NO: 100568 - protein, 11 aa, Dengue virus
LDERFATSLLF

SEQ ID NO: 100569 - protein, 11 aa, Dengue virus
DERFATSLLFL

SEQ ID NO: 100570 - protein, 11 aa, Dengue virus
ERFATSLLFLN

SEQ ID NO: 100571 - protein, 11 aa, Dengue virus
RFATSLLFLND

SEQ ID NO: 100572 - protein, 11 aa, Dengue virus
FATSLLFLNDM

SEQ ID NO: 100573 - protein, 11 aa, Dengue virus
ATSLLFLNDMG

SEQ ID NO: 100574 - protein, 11 aa, Dengue virus
DNPNMTDKTPI

SEQ ID NO: 100575 - protein, 11 aa, Dengue virus
NPNMTDKTPIH

SEQ ID NO: 100576 - protein, 11 aa, Dengue virus
PNMTDKTPIHS

SEQ ID NO: 100577 - protein, 11 aa, Dengue virus
NMTDKTPIHSW

SEQ ID NO: 100578 - protein, 11 aa, Dengue virus
MTDKTPIHSWE

SEQ ID NO: 100579 - protein, 11 aa, Dengue virus
TDKTPIHSWED

SEQ ID NO: 100580 - protein, 11 aa, Dengue virus
DKTPVHSWEDV

SEQ ID NO: 100581 - protein, 11 aa, Dengue virus
KTPVHSWEDVP

SEQ ID NO: 100582 - protein, 11 aa, Dengue virus
TPVHSWEDVPY

SEQ ID NO: 100583 - protein, 11 aa, Dengue virus
PVHSWEDVPYL

SEQ ID NO: 100584 - protein, 11 aa, Dengue virus
VHSWEDVPYLG

SEQ ID NO: 100585 - protein, 11 aa, Dengue virus
TWAKNIHTAIA

SEQ ID NO: 100586 - protein, 11 aa, Dengue virus
WAKNIQTAITQ

SEQ ID NO: 100587 - protein, 11 aa, Dengue virus
AKNIHTAIAQV

SEQ ID NO: 100588 - protein, 11 aa, Dengue virus
KNIQTAITQVR

SEQ ID NO: 100589 - protein, 11 aa, Dengue virus
NIQTAITQVRN

SEQ ID NO: 100590 - protein, 11 aa, Dengue virus
IHTAIAQVRNL

SEQ ID NO: 100591 - protein, 11 aa, Dengue virus
HTAIAQVRNLI

SEQ ID NO: 100592 - protein, 11 aa, Dengue virus
GKEEYADYMPV

SEQ ID NO: 100593 - protein, 11 aa, Dengue virus
KEEYMDYMPVM

SEQ ID NO: 100594 - protein, 11 aa, Dengue virus
EEYVDYMPVMR

SEQ ID NO: 100595 - protein, 11 aa, Dengue virus
EYVDYMPVMRR

SEQ ID NO: 100596 - protein, 11 aa, Dengue virus
YVDYMPVMRRY

SEQ ID NO: 100597 - protein, 11 aa, Dengue virus
VDYMPVMRRYS

SEQ ID NO: 100598 - protein, 11 aa, Dengue virus
DYMPVMRRYSA

SEQ ID NO: 100599 - protein, 11 aa, Dengue virus
YMPVMRRYSAL

SEQ ID NO: 100600 - protein, 11 aa, Dengue virus
RYSALSESEGV

SEQ ID NO: 100601 - protein, 11 aa, Dengue virus
YSALSESEGVL

SEQ ID NO: 100602 - protein, 11 aa, Dengue virus
NKVVRPSFNML

SEQ ID NO: 100603 - protein, 11 aa, Dengue virus
KVVRPSFNMLK

SEQ ID NO: 100604 - protein, 11 aa, Dengue virus
TVQQLTKRFSL

SEQ ID NO: 100605 - protein, 11 aa, Dengue virus
VQQLTKRFSLG

SEQ ID NO: 100606 - protein, 11 aa, Dengue virus
QQLTKRFSLGM

SEQ ID NO: 100607 - protein, 11 aa, Dengue virus
GLVKRFSIGLF

SEQ ID NO: 100608 - protein, 11 aa, Dengue virus
LVKRFSIGLFS

SEQ ID NO: 100609 - protein, 11 aa, Dengue virus
VKRFSIGLFSG

SEQ ID NO: 100610 - protein, 11 aa, Dengue virus
KRFSIGLFSGK

SEQ ID NO: 100611 - protein, 11 aa, Dengue virus
RFSIGLFSGKG

SEQ ID NO: 100612 - protein, 11 aa, Dengue virus
FSIGLFSGKGP

SEQ ID NO: 100613 - protein, 11 aa, Dengue virus
SIGLFSGKGPL

SEQ ID NO: 100614 - protein, 11 aa, Dengue virus
IGLFSGKGPLR

SEQ ID NO: 100615 - protein, 11 aa, Dengue virus
WGTIKKSKAIN

SEQ ID NO: 100616 - protein, 11 aa, Dengue virus
GQLKKTKAIKI

SEQ ID NO: 100617 - protein, 11 aa, Dengue virus
QLKKTKAIKIL

SEQ ID NO: 100618 - protein, 11 aa, Dengue virus
LKKTKAIKILT

SEQ ID NO: 100619 - protein, 11 aa, Dengue virus
KKSKAINVLRG

SEQ ID NO: 100620 - protein, 11 aa, Dengue virus
KTKAIKILTGF

SEQ ID NO: 100621 - protein, 11 aa, Dengue virus
TKAIKILTGFR

SEQ ID NO: 100622 - protein, 11 aa, Dengue virus
KAINVLRGFRK

SEQ ID NO: 100623 - protein, 11 aa, Dengue virus
AINVLRGFRKE

SEQ ID NO: 100624 - protein, 11 aa, Dengue virus
INVLRGFRKEI

SEQ ID NO: 100625 - protein, 11 aa, Dengue virus
NVLRGFRKEIG

SEQ ID NO: 100626 - protein, 11 aa, Dengue virus
GRMLNILNGRR

SEQ ID NO: 100627 - protein, 11 aa, Dengue virus
RMLNILNGRRR

SEQ ID NO: 100628 - protein, 11 aa, Dengue virus
MLNILNGRRRS

SEQ ID NO: 100629 - protein, 11 aa, Dengue virus
LNILNRRKRST

SEQ ID NO: 100630 - protein, 11 aa, Dengue virus
RRRTAGMIIML

SEQ ID NO: 100631 - protein, 11 aa, Dengue virus
RRTAGMIIMLI

SEQ ID NO: 100632 - protein, 11 aa, Dengue virus
RTAGMIIMLIP

SEQ ID NO: 100633 - protein, 11 aa, Dengue virus
TAGMIIMLIPT

SEQ ID NO: 100634 - protein, 11 aa, Dengue virus
MIIMLIPTVMA

SEQ ID NO: 100635 - protein, 11 aa, Dengue virus
IIMLIPTVMAF

SEQ ID NO: 100636 - protein, 11 aa, Dengue virus
LCLIPTIMAFH

SEQ ID NO: 100637 - protein, 11 aa, Dengue virus
CLIPTIMAFHL

SEQ ID NO: 100638 - protein, 11 aa, Dengue virus
LIPTIMAFHLS

SEQ ID NO: 100639 - protein, 11 aa, Dengue virus
IPTIMAFHLST

SEQ ID NO: 100640 - protein, 11 aa, Dengue virus
PTIMAFHLSTR

SEQ ID NO: 100641 - protein, 11 aa, Dengue virus
TIMAFHLSTRD

SEQ ID NO: 100642 - protein, 11 aa, Dengue virus
IMAFHLSTRDG

SEQ ID NO: 100643 - protein, 11 aa, Dengue virus
DTVTYECPLLV

SEQ ID NO: 100644 - protein, 11 aa, Dengue virus
TVTYECPLLVN

SEQ ID NO: 100645 - protein, 11 aa, Dengue virus
VTYECPLLVNT

SEQ ID NO: 100646 - protein, 11 aa, Dengue virus
TYKCPLLRQNE

SEQ ID NO: 100647 - protein, 11 aa, Dengue virus
YKCPLLRQNEP

SEQ ID NO: 100648 - protein, 11 aa, Dengue virus
ECPLLVNTEPE

SEQ ID NO: 100649 - protein, 11 aa, Dengue virus
STWVTYGTCTQ

SEQ ID NO: 100650 - protein, 11 aa, Dengue virus
TWVTYGTCTTT

SEQ ID NO: 100651 - protein, 11 aa, Dengue virus
YMIGQTGIQRA

SEQ ID NO: 100652 - protein, 11 aa, Dengue virus
MIGQTGIQRAV

SEQ ID NO: 100653 - protein, 11 aa, Dengue virus
IGQTGIQRTIF

SEQ ID NO: 100654 - protein, 11 aa, Dengue virus
GQTGIQRTIFF

SEQ ID NO: 100655 - protein, 11 aa, Dengue virus
QTGIQRAVFFV

SEQ ID NO: 100656 - protein, 11 aa, Dengue virus
TGIQRAVFFVL

SEQ ID NO: 100657 - protein, 11 aa, Dengue virus
GIQRAVFFVLM

SEQ ID NO: 100658 - protein, 11 aa, Dengue virus
IQRAVFFVLMM

SEQ ID NO: 100659 - protein, 11 aa, Dengue virus
QRAVFFVLMML

SEQ ID NO: 100660 - protein, 11 aa, Dengue virus
RTIFFVLMMLV

SEQ ID NO: 100661 - protein, 11 aa, Dengue virus
TIFFVLMMLVA

SEQ ID NO: 100662 - protein, 11 aa, Dengue virus
QDQQYICRRNV

SEQ ID NO: 100663 - protein, 11 aa, Dengue virus
DRQYICRRDVV

SEQ ID NO: 100664 - protein, 11 aa, Dengue virus
RQYICRRDVVD

SEQ ID NO: 100665 - protein, 11 aa, Dengue virus
GNDIPNHGVTA

SEQ ID NO: 100666 - protein, 11 aa, Dengue virus
NDTSNHGVTTT

SEQ ID NO: 100667 - protein, 11 aa, Dengue virus
DIPNHGVTATI

SEQ ID NO: 100668 - protein, 11 aa, Dengue virus
TGKHGKEIKIT

SEQ ID NO: 100669 - protein, 11 aa, Dengue virus
GKHGKEIKITP

SEQ ID NO: 100670 - protein, 11 aa, Dengue virus
KHGKEIKITPQ

SEQ ID NO: 100671 - protein, 11 aa, Dengue virus
HGKEIKITPQS

SEQ ID NO: 100672 - protein, 11 aa, Dengue virus
GKEIKITPQSS

SEQ ID NO: 100673 - protein, 11 aa, Dengue virus
VTATITPRTPS

SEQ ID NO: 100674 - protein, 11 aa, Dengue virus
TATITPRTPSV

SEQ ID NO: 100675 - protein, 11 aa, Dengue virus
IKITPQSSITE

SEQ ID NO: 100676 - protein, 11 aa, Dengue virus
KITPQSSITEA

SEQ ID NO: 100677 - protein, 11 aa, Dengue virus
ITPQSSITEAE

SEQ ID NO: 100678 - protein, 11 aa, Dengue virus
TPQSSITEAEL

SEQ ID NO: 100679 - protein, 11 aa, Dengue virus
PRTPSVEVKLP

SEQ ID NO: 100680 - protein, 11 aa, Dengue virus
RSPSVEVELPD

SEQ ID NO: 100681 - protein, 11 aa, Dengue virus
SPSVEVELPDY

SEQ ID NO: 100682 - protein, 11 aa, Dengue virus
PSVEVQLPDYG

SEQ ID NO: 100683 - protein, 11 aa, Dengue virus
SAEVKLPDYGE

SEQ ID NO: 100684 - protein, 11 aa, Dengue virus
VEVQLPDYGEL

SEQ ID NO: 100685 - protein, 11 aa, Dengue virus
GLDFNEMVLLQ

SEQ ID NO: 100686 - protein, 11 aa, Dengue virus
IDFNEMILMEM

SEQ ID NO: 100687 - protein, 11 aa, Dengue virus
DFNEMILMRMK

SEQ ID NO: 100688 - protein, 11 aa, Dengue virus
MEKKTWLVHKQ

SEQ ID NO: 100689 - protein, 11 aa, Dengue virus
ENKAWLVHRQW

SEQ ID NO: 100690 - protein, 11 aa, Dengue virus
WFLDLPLPWLP

SEQ ID NO: 100691 - protein, 11 aa, Dengue virus
FLDLPLPWLPG

SEQ ID NO: 100692 - protein, 11 aa, Dengue virus
LDLPLPWLPGA

SEQ ID NO: 100693 - protein, 11 aa, Dengue virus
DLPLPWLPGAD

SEQ ID NO: 100694 - protein, 11 aa, Dengue virus
LPLPWLPGADT

SEQ ID NO: 100695 - protein, 11 aa, Dengue virus
PLPWTAGADTL

SEQ ID NO: 100696 - protein, 11 aa, Dengue virus
LPWLPGADTQG

SEQ ID NO: 100697 - protein, 11 aa, Dengue virus
PWTAGADTLEV

SEQ ID NO: 100698 - protein, 11 aa, Dengue virus
WTAGADTLEVH

SEQ ID NO: 100699 - protein, 11 aa, Dengue virus
LPGADTQGSNW

SEQ ID NO: 100700 - protein, 11 aa, Dengue virus
AGADTLEVHWN

SEQ ID NO: 100701 - protein, 11 aa, Dengue virus
GADTLEVHWNH

SEQ ID NO: 100702 - protein, 11 aa, Dengue virus
ADTLEVHWNHK

SEQ ID NO: 100703 - protein, 11 aa, Dengue virus
DTLEVHWNHKE

SEQ ID NO: 100704 - protein, 11 aa, Dengue virus
TLEVHWNHKER

SEQ ID NO: 100705 - protein, 11 aa, Dengue virus
QGSNWIQKETL

SEQ ID NO: 100706 - protein, 11 aa, Dengue virus
IRMEKLRIKGM

SEQ ID NO: 100707 - protein, 11 aa, Dengue virus
TAVVKVKYEGA

SEQ ID NO: 100708 - protein, 11 aa, Dengue virus
AVVKVKYEGAG

SEQ ID NO: 100709 - protein, 11 aa, Dengue virus
QYEGDGSPCKI

SEQ ID NO: 100710 - protein, 11 aa, Dengue virus
YEGDGSPCKIP

SEQ ID NO: 100711 - protein, 11 aa, Dengue virus
EGAGAPCKIPI

SEQ ID NO: 100712 - protein, 11 aa, Dengue virus
GAGAPCKIPIE

SEQ ID NO: 100713 - protein, 11 aa, Dengue virus
DGSPCKIPFEI

SEQ ID NO: 100714 - protein, 11 aa, Dengue virus
IPFEIMDLEKR

SEQ ID NO: 100715 - protein, 11 aa, Dengue virus
PIEIKDMNKEK

SEQ ID NO: 100716 - protein, 11 aa, Dengue virus
IEIKDMNKEKV

SEQ ID NO: 100717 - protein, 11 aa, Dengue virus
EIMDLEKRHVL

SEQ ID NO: 100718 - protein, 11 aa, Dengue virus
IRDVNKEKVIG

SEQ ID NO: 100719 - protein, 11 aa, Dengue virus
RDVNKEKVIGR

SEQ ID NO: 100720 - protein, 11 aa, Dengue virus
VTEKDSPVNIE

SEQ ID NO: 100721 - protein, 11 aa, Dengue virus
TEKDSPVNIEA

SEQ ID NO: 100722 - protein, 11 aa, Dengue virus
YTNSVTNIELE

SEQ ID NO: 100723 - protein, 11 aa, Dengue virus
FGDSYIVIGAG

SEQ ID NO: 100724 - protein, 11 aa, Dengue virus
GDSYIMIGVGN

SEQ ID NO: 100725 - protein, 11 aa, Dengue virus
DSYIIIGVEPG

SEQ ID NO: 100726 - protein, 11 aa, Dengue virus
SYIIIGVEPGQ

SEQ ID NO: 100727 - protein, 11 aa, Dengue virus
YIMIGVGNSAL

SEQ ID NO: 100728 - protein, 11 aa, Dengue virus
IMIGVGNSALT

SEQ ID NO: 100729 - protein, 11 aa, Dengue virus
MIGVGNSALTL

SEQ ID NO: 100730 - protein, 11 aa, Dengue virus
FTSLGKAVHQI

SEQ ID NO: 100731 - protein, 11 aa, Dengue virus
IRILIGLLVLW

SEQ ID NO: 100732 - protein, 11 aa, Dengue virus
MNSRNTSMAMT

SEQ ID NO: 100733 - protein, 11 aa, Dengue virus
LFLGFTVQADV

SEQ ID NO: 100734 - protein, 11 aa, Dengue virus
FLGFTVQADVG

SEQ ID NO: 100735 - protein, 11 aa, Dengue virus
LGFTVQADVGC

SEQ ID NO: 100736 - protein, 11 aa, Dengue virus
SWNGRELKCGS

SEQ ID NO: 100737 - protein, 11 aa, Dengue virus
WNGRELKCGSG

SEQ ID NO: 100738 - protein, 11 aa, Dengue virus
NGRELKCGSGI

SEQ ID NO: 100739 - protein, 11 aa, Dengue virus
ELKCGSGIFVT

SEQ ID NO: 100740 - protein, 11 aa, Dengue virus
LKCGSGIFVTD

SEQ ID NO: 100741 - protein, 11 aa, Dengue virus
KCGSGIFVTDN

SEQ ID NO: 100742 - protein, 11 aa, Dengue virus
CGSGIFVTDNV

SEQ ID NO: 100743 - protein, 11 aa, Dengue virus
GSGIFVTDNVH

SEQ ID NO: 100744 - protein, 11 aa, Dengue virus
SGIFVTDNVHT

SEQ ID NO: 100745 - protein, 11 aa, Dengue virus
GIFVTDNVHTW

SEQ ID NO: 100746 - protein, 11 aa, Dengue virus
IFVADNVHTWT

SEQ ID NO: 100747 - protein, 11 aa, Dengue virus
FVADNVHTWTE

SEQ ID NO: 100748 - protein, 11 aa, Dengue virus
VADNVHTWTEQ

SEQ ID NO: 100749 - protein, 11 aa, Dengue virus
ADNVHTWTEQY

SEQ ID NO: 100750 - protein, 11 aa, Dengue virus
LASAILNAHED

SEQ ID NO: 100751 - protein, 11 aa, Dengue virus
LNAHEDGVCGI

SEQ ID NO: 100752 - protein, 11 aa, Dengue virus
NAHKDGVCGVR

SEQ ID NO: 100753 - protein, 11 aa, Dengue virus
HDLTVVTGDVK

SEQ ID NO: 100754 - protein, 11 aa, Dengue virus
DLTVVAGDVRG

SEQ ID NO: 100755 - protein, 11 aa, Dengue virus
LTVVAGDVRGV

SEQ ID NO: 100756 - protein, 11 aa, Dengue virus
TVVTGDVKGVL

SEQ ID NO: 100757 - protein, 11 aa, Dengue virus
VAGDAKGVLTK

SEQ ID NO: 100758 - protein, 11 aa, Dengue virus
AGDVKGVLVKG

SEQ ID NO: 100759 - protein, 11 aa, Dengue virus
GDAKGVLTKGK

SEQ ID NO: 100760 - protein, 11 aa, Dengue virus
DVKGVLVKGKR

SEQ ID NO: 100761 - protein, 11 aa, Dengue virus
KGVLTKGKRTL

SEQ ID NO: 100762 - protein, 11 aa, Dengue virus
GVLTKGKRALA

SEQ ID NO: 100763 - protein, 11 aa, Dengue virus
VLVKGKRALTP

SEQ ID NO: 100764 - protein, 11 aa, Dengue virus
LTKGKRALAPP

SEQ ID NO: 100765 - protein, 11 aa, Dengue virus
LAPPVNDLKYS

SEQ ID NO: 100766 - protein, 11 aa, Dengue virus
APPVNDLKYSW

SEQ ID NO: 100767 - protein, 11 aa, Dengue virus
WGKAKIFTPEV

SEQ ID NO: 100768 - protein, 11 aa, Dengue virus
CPNERRAWNFF

SEQ ID NO: 100769 - protein, 11 aa, Dengue virus
PNERRAWNFFE

SEQ ID NO: 100770 - protein, 11 aa, Dengue virus
NERRAWNFFEV

SEQ ID NO: 100771 - protein, 11 aa, Dengue virus
ERRAWNFFEVE

SEQ ID NO: 100772 - protein, 11 aa, Dengue virus
RRAWNFFEVED

SEQ ID NO: 100773 - protein, 11 aa, Dengue virus
RAWNFFEVEDY

SEQ ID NO: 100774 - protein, 11 aa, Dengue virus
AWNFFEVEDYG

SEQ ID NO: 100775 - protein, 11 aa, Dengue virus
WNFFEVEDYGF

SEQ ID NO: 100776 - protein, 11 aa, Dengue virus
NFFEVEDYGFG

SEQ ID NO: 100777 - protein, 11 aa, Dengue virus
FFEVEDYGFGM

SEQ ID NO: 100778 - protein, 11 aa, Dengue virus
MLIPKAYAGPI

SEQ ID NO: 100779 - protein, 11 aa, Dengue virus
LIPKAYAGPIS

SEQ ID NO: 100780 - protein, 11 aa, Dengue virus
IPKSYAGPFSH

SEQ ID NO: 100781 - protein, 11 aa, Dengue virus
PKSYAGPFSHH

SEQ ID NO: 100782 - protein, 11 aa, Dengue virus
KSYAGPFSHHN

SEQ ID NO: 100783 - protein, 11 aa, Dengue virus
AYAGPISQHNY

SEQ ID NO: 100784 - protein, 11 aa, Dengue virus
NYRQGYATQIA

SEQ ID NO: 100785 - protein, 11 aa, Dengue virus
YRQGYATQIAG

SEQ ID NO: 100786 - protein, 11 aa, Dengue virus
RQGYATQIAGP

SEQ ID NO: 100787 - protein, 11 aa, Dengue virus
QGYATQIAGPW

SEQ ID NO: 100788 - protein, 11 aa, Dengue virus
GYATQIAGPWH

SEQ ID NO: 100789 - protein, 11 aa, Dengue virus
YATQIAGPWHL

SEQ ID NO: 100790 - protein, 11 aa, Dengue virus
ATQIAGPWHLG

SEQ ID NO: 100791 - protein, 11 aa, Dengue virus
TQIAGPWHLGK

SEQ ID NO: 100792 - protein, 11 aa, Dengue virus
QIAGPWHLGKL

SEQ ID NO: 100793 - protein, 11 aa, Dengue virus
IAGPWHLGKLE

SEQ ID NO: 100794 - protein, 11 aa, Dengue virus
ECPGTTVTVRE

SEQ ID NO: 100795 - protein, 11 aa, Dengue virus
CPGTTVTIQDD

SEQ ID NO: 100796 - protein, 11 aa, Dengue virus
PGTTVTIQDDC

SEQ ID NO: 100797 - protein, 11 aa, Dengue virus
QEDCGHRGSSL

SEQ ID NO: 100798 - protein, 11 aa, Dengue virus
EDCGHRGSSLR

SEQ ID NO: 100799 - protein, 11 aa, Dengue virus
PLNEKEENMVR

SEQ ID NO: 100800 - protein, 11 aa, Dengue virus
LNEKEENMVRS

SEQ ID NO: 100801 - protein, 11 aa, Dengue virus
NEKEENMVRSQ

SEQ ID NO: 100802 - protein, 11 aa, Dengue virus
EKEENMVKSQA

SEQ ID NO: 100803 - protein, 11 aa, Dengue virus
EENMVKSQATA

SEQ ID NO: 100804 - protein, 11 aa, Dengue virus
ENMVRSQVTAG

SEQ ID NO: 100805 - protein, 11 aa, Dengue virus
GTSETFFMGLL

SEQ ID NO: 100806 - protein, 11 aa, Dengue virus
PSETFSMGLLC

SEQ ID NO: 100807 - protein, 11 aa, Dengue virus
TRKHMILVVVA

SEQ ID NO: 100808 - protein, 11 aa, Dengue virus
RKHMILVVVAT

SEQ ID NO: 100809 - protein, 11 aa, Dengue virus
TTFCAIILGGL

SEQ ID NO: 100810 - protein, 11 aa, Dengue virus
IMLGDTMFGRM

SEQ ID NO: 100811 - protein, 11 aa, Dengue virus
MLGDTMFGRMG

SEQ ID NO: 100812 - protein, 11 aa, Dengue virus
LGDTMFGRMGG

SEQ ID NO: 100813 - protein, 11 aa, Dengue virus
GDTMFGRMGGQ

SEQ ID NO: 100814 - protein, 11 aa, Dengue virus
RIGGQVHLAIM

SEQ ID NO: 100815 - protein, 11 aa, Dengue virus
GGQTHLAIMIV

SEQ ID NO: 100816 - protein, 11 aa, Dengue virus
GQTHLAIMIVF

SEQ ID NO: 100817 - protein, 11 aa, Dengue virus
QTHLAIMIVFK

SEQ ID NO: 100818 - protein, 11 aa, Dengue virus
THLAIMIVFKM

SEQ ID NO: 100819 - protein, 11 aa, Dengue virus
MVIGMAMTTTF

SEQ ID NO: 100820 - protein, 11 aa, Dengue virus
VIGMAMTTTFS

SEQ ID NO: 100821 - protein, 11 aa, Dengue virus
IGMAMTTTFSI

SEQ ID NO: 100822 - protein, 11 aa, Dengue virus
GMAMTTTFSIP

SEQ ID NO: 100823 - protein, 11 aa, Dengue virus
MAMTTTFSIPH

SEQ ID NO: 100824 - protein, 11 aa, Dengue virus
AMTTTFSIPHD

SEQ ID NO: 100825 - protein, 11 aa, Dengue virus
MTTTFSIPHDL

SEQ ID NO: 100826 - protein, 11 aa, Dengue virus
TTTFSIPHDLM

SEQ ID NO: 100827 - protein, 11 aa, Dengue virus
TTFSIPHDLME

SEQ ID NO: 100828 - protein, 11 aa, Dengue virus
VLSIPHDLMEF

SEQ ID NO: 100829 - protein, 11 aa, Dengue virus
GIALGLILLKM

SEQ ID NO: 100830 - protein, 11 aa, Dengue virus
IALGLILLKMV

SEQ ID NO: 100831 - protein, 11 aa, Dengue virus
LGLILLKTVTQ

SEQ ID NO: 100832 - protein, 11 aa, Dengue virus
GLILLKMVVHF

SEQ ID NO: 100833 - protein, 11 aa, Dengue virus
LILLKTVTQFD

SEQ ID NO: 100834 - protein, 11 aa, Dengue virus
VVHFDNAQLGT

SEQ ID NO: 100835 - protein, 11 aa, Dengue virus
VHFDNAQLGTL

SEQ ID NO: 100836 - protein, 11 aa, Dengue virus
QFDDTQVGTLA

SEQ ID NO: 100837 - protein, 11 aa, Dengue virus
DNTQVGTLALA

SEQ ID NO: 100838 - protein, 11 aa, Dengue virus
STQVGTLALSL

SEQ ID NO: 100839 - protein, 11 aa, Dengue virus
TLALSLTFISS

SEQ ID NO: 100840 - protein, 11 aa, Dengue virus
LALSLTFISST

SEQ ID NO: 100841 - protein, 11 aa, Dengue virus
PLTMAWRTIMA

SEQ ID NO: 100842 - protein, 11 aa, Dengue virus
IMAWRTIMAVF

SEQ ID NO: 100843 - protein, 11 aa, Dengue virus
AIPVTMALWYM

SEQ ID NO: 100844 - protein, 11 aa, Dengue virus
IPVTMALWYMW

SEQ ID NO: 100845 - protein, 11 aa, Dengue virus
PVTMALWYMWQ

SEQ ID NO: 100846 - protein, 11 aa, Dengue virus
VTMALWYMWQV

SEQ ID NO: 100847 - protein, 11 aa, Dengue virus
TMTLWYMWQVR

SEQ ID NO: 100848 - protein, 11 aa, Dengue virus
MALWYMWQVKT

SEQ ID NO: 100849 - protein, 11 aa, Dengue virus
TLWYMWQVRTQ

SEQ ID NO: 100850 - protein, 11 aa, Dengue virus
LWDVPSPATAQ

SEQ ID NO: 100851 - protein, 11 aa, Dengue virus
WDVPSPATAQK

SEQ ID NO: 100852 - protein, 11 aa, Dengue virus
DVPSPATAQKA

SEQ ID NO: 100853 - protein, 11 aa, Dengue virus
AQKATLTEGVY

SEQ ID NO: 100854 - protein, 11 aa, Dengue virus
QKATLTEGVYR

SEQ ID NO: 100855 - protein, 11 aa, Dengue virus
GKTQVGVGVHV

SEQ ID NO: 100856 - protein, 11 aa, Dengue virus
KTQVGVGIHTE

SEQ ID NO: 100857 - protein, 11 aa, Dengue virus
IFMTATPPGST

SEQ ID NO: 100858 - protein, 11 aa, Dengue virus
FMTATPPGSTD

SEQ ID NO: 100859 - protein, 11 aa, Dengue virus
MTATPPGSTDP

SEQ ID NO: 100860 - protein, 11 aa, Dengue virus
TATPPGSTDPF

SEQ ID NO: 100861 - protein, 11 aa, Dengue virus
ATPPGSTDPFP

SEQ ID NO: 100862 - protein, 11 aa, Dengue virus
TPPGSTDPFPQ

SEQ ID NO: 100863 - protein, 11 aa, Dengue virus
PPGSTDPFPQS

SEQ ID NO: 100864 - protein, 11 aa, Dengue virus
PGSTDPFPQSN

SEQ ID NO: 100865 - protein, 11 aa, Dengue virus
GSTDPFPQSNS

SEQ ID NO: 100866 - protein, 11 aa, Dengue virus
STDPFPQSNSP

SEQ ID NO: 100867 - protein, 11 aa, Dengue virus
IASLPTYLSSK

SEQ ID NO: 100868 - protein, 11 aa, Dengue virus
ASLPTYLSSKA

SEQ ID NO: 100869 - protein, 11 aa, Dengue virus
SLPTYLSSKAK

SEQ ID NO: 100870 - protein, 11 aa, Dengue virus
GMGKLSMGLIT

SEQ ID NO: 100871 - protein, 11 aa, Dengue virus
MGKLSMGLITI

SEQ ID NO: 100872 - protein, 11 aa, Dengue virus
KLSVGLIAIAV

SEQ ID NO: 100873 - protein, 11 aa, Dengue virus
LSVGLIAIAVA

SEQ ID NO: 100874 - protein, 11 aa, Dengue virus
SVGLIAIAVAS

SEQ ID NO: 100875 - protein, 11 aa, Dengue virus
VGLIAIAVASG

SEQ ID NO: 100876 - protein, 11 aa, Dengue virus
LITIAVASGLF

SEQ ID NO: 100877 - protein, 11 aa, Dengue virus
ITIAVASGLFW

SEQ ID NO: 100878 - protein, 11 aa, Dengue virus
TIAVASGLFWV

SEQ ID NO: 100879 - protein, 11 aa, Dengue virus
IAVASSLLWVA

SEQ ID NO: 100880 - protein, 11 aa, Dengue virus
AVASSLLWVAE

SEQ ID NO: 100881 - protein, 11 aa, Dengue virus
VASGLLWVAEL

SEQ ID NO: 100882 - protein, 11 aa, Dengue virus
ASGLLWVAELQ

SEQ ID NO: 100883 - protein, 11 aa, Dengue virus
SGLLWVAELQP

SEQ ID NO: 100884 - protein, 11 aa, Dengue virus
GLLWVAELQPQ

SEQ ID NO: 100885 - protein, 11 aa, Dengue virus
LLWVAELQPQW

SEQ ID NO: 100886 - protein, 11 aa, Dengue virus
LWVAELQPQWI

SEQ ID NO: 100887 - protein, 11 aa, Dengue virus
YVILTILAIIG

SEQ ID NO: 100888 - protein, 11 aa, Dengue virus
VILALLTIISL

SEQ ID NO: 100889 - protein, 11 aa, Dengue virus
ILAIIGLIAAN

SEQ ID NO: 100890 - protein, 11 aa, Dengue virus
LTIISLIAANE

SEQ ID NO: 100891 - protein, 11 aa, Dengue virus
AIIGLIAANEM

SEQ ID NO: 100892 - protein, 11 aa, Dengue virus
KTKADFGFYQV

SEQ ID NO: 100893 - protein, 11 aa, Dengue virus
TKTDFGFYQEK

SEQ ID NO: 100894 - protein, 11 aa, Dengue virus
KTDFGFYQEKT

SEQ ID NO: 100895 - protein, 11 aa, Dengue virus
TDFGFYQEKTE

SEQ ID NO: 100896 - protein, 11 aa, Dengue virus
DFGFYQVKAET

SEQ ID NO: 100897 - protein, 11 aa, Dengue virus
FGFYQVKTEIT

SEQ ID NO: 100898 - protein, 11 aa, Dengue virus
GFYQVKAETTI

SEQ ID NO: 100899 - protein, 11 aa, Dengue virus
FYQVKAETTIL

SEQ ID NO: 100900 - protein, 11 aa, Dengue virus
YQEKPETTILD

SEQ ID NO: 100901 - protein, 11 aa, Dengue virus
QEKPETTILDV

SEQ ID NO: 100902 - protein, 11 aa, Dengue virus
EKPETTILDVD

SEQ ID NO: 100903 - protein, 11 aa, Dengue virus
TTLTASLVMLF

SEQ ID NO: 100904 - protein, 11 aa, Dengue virus
TLTASLAMLLV

SEQ ID NO: 100905 - protein, 11 aa, Dengue virus
LTASLAMLLVH

SEQ ID NO: 100906 - protein, 11 aa, Dengue virus
TASLAMLLVHY

SEQ ID NO: 100907 - protein, 11 aa, Dengue virus
EVLTLSTGPAL

SEQ ID NO: 100908 - protein, 11 aa, Dengue virus
VLTLSTGPALT

SEQ ID NO: 100909 - protein, 11 aa, Dengue virus
LTLSTGPALTL

SEQ ID NO: 100910 - protein, 11 aa, Dengue virus
TLSTGPALTLW

SEQ ID NO: 100911 - protein, 11 aa, Dengue virus
LATGPTLTLWE

SEQ ID NO: 100912 - protein, 11 aa, Dengue virus
STGPALTLWEG

SEQ ID NO: 100913 - protein, 11 aa, Dengue virus
TGPALTLWEGG

SEQ ID NO: 100914 - protein, 11 aa, Dengue virus
GPTLTLWEGNP

SEQ ID NO: 100915 - protein, 11 aa, Dengue virus
PALTLWEGGPG

SEQ ID NO: 100916 - protein, 11 aa, Dengue virus
ALTLWEGGPGR

SEQ ID NO: 100917 - protein, 11 aa, Dengue virus
LAFSLIKNAQA

SEQ ID NO: 100918 - protein, 11 aa, Dengue virus
AFSLIKNTQTP

SEQ ID NO: 100919 - protein, 11 aa, Dengue virus
FSLIKNAQAPR

SEQ ID NO: 100920 - protein, 11 aa, Dengue virus
SLIKNAQAPRR

SEQ ID NO: 100921 - protein, 11 aa, Dengue virus
LIKNAQAPRRG

SEQ ID NO: 100922 - protein, 11 aa, Dengue virus
IKNAQAPRRGT

SEQ ID NO: 100923 - protein, 11 aa, Dengue virus
KNAQAPRRGTG

SEQ ID NO: 100924 - protein, 11 aa, Dengue virus
NTQTPRRGTGI

SEQ ID NO: 100925 - protein, 11 aa, Dengue virus
TQTPRRGTGIT

SEQ ID NO: 100926 - protein, 11 aa, Dengue virus
AKSALRDGSKT

SEQ ID NO: 100927 - protein, 11 aa, Dengue virus
KSALRDGSKTK

SEQ ID NO: 100928 - protein, 11 aa, Dengue virus
SALKDGSKIKY

SEQ ID NO: 100929 - protein, 11 aa, Dengue virus
ALKDGSKIKYA

SEQ ID NO: 100930 - protein, 11 aa, Dengue virus
LKDGSKIKYAV

SEQ ID NO: 100931 - protein, 11 aa, Dengue virus
KDGSKIKYAVS

SEQ ID NO: 100932 - protein, 11 aa, Dengue virus
LEKLQRKYGGS

SEQ ID NO: 100933 - protein, 11 aa, Dengue virus
EKLQRKYGGSL

SEQ ID NO: 100934 - protein, 11 aa, Dengue virus
KLQRKHGGSLI

SEQ ID NO: 100935 - protein, 11 aa, Dengue virus
LQRKHGGSLIR

SEQ ID NO: 100936 - protein, 11 aa, Dengue virus
QRKHGGSLIRC

SEQ ID NO: 100937 - protein, 11 aa, Dengue virus
RKHGGSLIRCP

SEQ ID NO: 100938 - protein, 11 aa, Dengue virus
KHGGSLIRCPL

SEQ ID NO: 100939 - protein, 11 aa, Dengue virus
YGGSLVRCPLS

SEQ ID NO: 100940 - protein, 11 aa, Dengue virus
RTPQPKPGTQM

SEQ ID NO: 100941 - protein, 11 aa, Dengue virus
TPQPKPGTQMI

SEQ ID NO: 100942 - protein, 11 aa, Dengue virus
PQPKPGTQMIM

SEQ ID NO: 100943 - protein, 11 aa, Dengue virus
QPKLGTRVVMT

SEQ ID NO: 100944 - protein, 11 aa, Dengue virus
PKPGTQMIMTT

SEQ ID NO: 100945 - protein, 11 aa, Dengue virus
KLGTRVVMTTT

SEQ ID NO: 100946 - protein, 11 aa, Dengue virus
PGTQMIMTTTA

SEQ ID NO: 100947 - protein, 11 aa, Dengue virus
GTQMIMTTTAN

SEQ ID NO: 100948 - protein, 11 aa, Dengue virus
TQMIMTTTANW

SEQ ID NO: 100949 - protein, 11 aa, Dengue virus
QMIMTTTANWL

SEQ ID NO: 100950 - protein, 11 aa, Dengue virus
LLGKKKTPRLC

SEQ ID NO: 100951 - protein, 11 aa, Dengue virus
LGKKKTPRLCT

SEQ ID NO: 100952 - protein, 11 aa, Dengue virus
KKSPRLCTKEE

SEQ ID NO: 100953 - protein, 11 aa, Dengue virus
KSPRLCTKEEF

SEQ ID NO: 100954 - protein, 11 aa, Dengue virus
SPRLCTKEEFI

SEQ ID NO: 100955 - protein, 11 aa, Dengue virus
EDIDKKDGDLM

SEQ ID NO: 100956 - protein, 11 aa, Dengue virus
DIDKKDGDLMY

SEQ ID NO: 100957 - protein, 11 aa, Dengue virus
ITEQMAPGHKI

SEQ ID NO: 100958 - protein, 11 aa, Dengue virus
GLKEKVEKWLK

SEQ ID NO: 100959 - protein, 11 aa, Dengue virus
LKEKVEKWLKE

SEQ ID NO: 100960 - protein, 11 aa, Dengue virus
KEKVEKWLKEC

SEQ ID NO: 100961 - protein, 11 aa, Dengue virus
EEYADYMPVMK

SEQ ID NO: 100962 - protein, 11 aa, Dengue virus
EYADYMPVMKR

SEQ ID NO: 100963 - protein, 11 aa, Dengue virus
YADYMPVMKRY

SEQ ID NO: 100964 - protein, 11 aa, Dengue virus
ADYMPVMKRYS

SEQ ID NO: 100965 - protein, 11 aa, Dengue virus
YMPVMKRYSAL

SEQ ID NO: 100966 - protein, 11 aa, Dengue virus
RYSAHFESEGV

SEQ ID NO: 100967 - protein, 11 aa, Dengue virus
YSAHFESEGVL

SEQ ID NO: 100968 - protein, 11 aa, Dengue virus
IKKSKAINVLR

SEQ ID NO: 100969 - protein, 11 aa, Dengue virus
KKTKAIKILTG

SEQ ID NO: 100970 - protein, 11 aa, Dengue virus
KSKAINVLRGF

SEQ ID NO: 100971 - protein, 11 aa, Dengue virus
SKAINVLRGFR

SEQ ID NO: 100972 - protein, 11 aa, Dengue virus
MLNILNRRKRS

SEQ ID NO: 100973 - protein, 11 aa, Dengue virus
LNILNRRRRTA

SEQ ID NO: 100974 - protein, 11 aa, Dengue virus
RKRSTVTLLCL

SEQ ID NO: 100975 - protein, 11 aa, Dengue virus
KRSTVTLLCLI

SEQ ID NO: 100976 - protein, 11 aa, Dengue virus
IMLIPTVMAFH

SEQ ID NO: 100977 - protein, 11 aa, Dengue virus
MLIPTVMAFHL

SEQ ID NO: 100978 - protein, 11 aa, Dengue virus
LIPTVMAFHLT

SEQ ID NO: 100979 - protein, 11 aa, Dengue virus
IPTVMAFHLTT

SEQ ID NO: 100980 - protein, 11 aa, Dengue virus
PTVMAFHLTTR

SEQ ID NO: 100981 - protein, 11 aa, Dengue virus
TVMAFHLTTRN

SEQ ID NO: 100982 - protein, 11 aa, Dengue virus
VMAFHLTTRNG

SEQ ID NO: 100983 - protein, 11 aa, Dengue virus
MIGQTGIQRTI

SEQ ID NO: 100984 - protein, 11 aa, Dengue virus
IGQTRIQRTVF

SEQ ID NO: 100985 - protein, 11 aa, Dengue virus
QTRIQRTVFFV

SEQ ID NO: 100986 - protein, 11 aa, Dengue virus
TRIQRTVFFVL

SEQ ID NO: 100987 - protein, 11 aa, Dengue virus
RIQRTVFFVLM

SEQ ID NO: 100988 - protein, 11 aa, Dengue virus
NDIPNHGVTAT

SEQ ID NO: 100989 - protein, 11 aa, Dengue virus
DTSNHGVTTTI

SEQ ID NO: 100990 - protein, 11 aa, Dengue virus
IPNHGVTATIT

SEQ ID NO: 100991 - protein, 11 aa, Dengue virus
PNHGVTATITP

SEQ ID NO: 100992 - protein, 11 aa, Dengue virus
HGVTATITPRT

SEQ ID NO: 100993 - protein, 11 aa, Dengue virus
GVTATITPRTP

SEQ ID NO: 100994 - protein, 11 aa, Dengue virus
KEIKITPQSSI

SEQ ID NO: 100995 - protein, 11 aa, Dengue virus
EIKITPQSSIT

SEQ ID NO: 100996 - protein, 11 aa, Dengue virus
ATITPRTPSVE

SEQ ID NO: 100997 - protein, 11 aa, Dengue virus
ITPRSPSVEVQ

SEQ ID NO: 100998 - protein, 11 aa, Dengue virus
TPRSPSAEVKL

SEQ ID NO: 100999 - protein, 11 aa, Dengue virus
PRSPSVEVQLP

SEQ ID NO: 101000 - protein, 11 aa, Dengue virus
RSPSAEVKLPD

SEQ ID NO: 101001 - protein, 11 aa, Dengue virus
SPSAEVKLPDY

SEQ ID NO: 101002 - protein, 11 aa, Dengue virus
DFNEMVLLQME

SEQ ID NO: 101003 - protein, 11 aa, Dengue virus
PLPWLPGADTQ

SEQ ID NO: 101004 - protein, 11 aa, Dengue virus
LPWTAGADTLE

SEQ ID NO: 101005 - protein, 11 aa, Dengue virus
PWLPGADTQGS

SEQ ID NO: 101006 - protein, 11 aa, Dengue virus
WLPGADTQGSN

SEQ ID NO: 101007 - protein, 11 aa, Dengue virus
TAGADTLEVHW

SEQ ID NO: 101008 - protein, 11 aa, Dengue virus
EIKDMNKEKVV

SEQ ID NO: 101009 - protein, 11 aa, Dengue virus
IKDMNKEKVVG

SEQ ID NO: 101010 - protein, 11 aa, Dengue virus
KDMNKEKVVGR

SEQ ID NO: 101011 - protein, 11 aa, Dengue virus
AEYTNSVTNIE

SEQ ID NO: 101012 - protein, 11 aa, Dengue virus
EYTNSVTNIEL

SEQ ID NO: 101013 - protein, 11 aa, Dengue virus
EKDSPVNIEAE

SEQ ID NO: 101014 - protein, 11 aa, Dengue virus
GDSYIVIGAGD

SEQ ID NO: 101015 - protein, 11 aa, Dengue virus
DSYIIIGVGDS

SEQ ID NO: 101016 - protein, 11 aa, Dengue virus
SYIIIGVGDSA

SEQ ID NO: 101017 - protein, 11 aa, Dengue virus
YIVIGAGDSAL

SEQ ID NO: 101018 - protein, 11 aa, Dengue virus
IVIGAGDSALT

SEQ ID NO: 101019 - protein, 11 aa, Dengue virus
VIGAGDSALTL

SEQ ID NO: 101020 - protein, 11 aa, Dengue virus
MKILIGVIITW

SEQ ID NO: 101021 - protein, 11 aa, Dengue virus
LFLGFTVQADT

SEQ ID NO: 101022 - protein, 11 aa, Dengue virus
FLGFTVQADTG

SEQ ID NO: 101023 - protein, 11 aa, Dengue virus
LGFTVRADMGC

SEQ ID NO: 101024 - protein, 11 aa, Dengue virus
SWTGKELKCGS

SEQ ID NO: 101025 - protein, 11 aa, Dengue virus
WTGKELKCGSG

SEQ ID NO: 101026 - protein, 11 aa, Dengue virus
TGKELKCGSGI

SEQ ID NO: 101027 - protein, 11 aa, Dengue virus
IDNVHTWTEQH

SEQ ID NO: 101028 - protein, 11 aa, Dengue virus
VTGDVKGVLTK

SEQ ID NO: 101029 - protein, 11 aa, Dengue virus
AGDVRGVLTKG

SEQ ID NO: 101030 - protein, 11 aa, Dengue virus
KGVLTKGKRVI

SEQ ID NO: 101031 - protein, 11 aa, Dengue virus
GVLTKGKRVIA

SEQ ID NO: 101032 - protein, 11 aa, Dengue virus
VLTKGKRVIAP

SEQ ID NO: 101033 - protein, 11 aa, Dengue virus
LTKGKRTLTPP

SEQ ID NO: 101034 - protein, 11 aa, Dengue virus
LAPPASDLKYS

SEQ ID NO: 101035 - protein, 11 aa, Dengue virus
APPASDLKYSW

SEQ ID NO: 101036 - protein, 11 aa, Dengue virus
IPKAYAGPISQ

SEQ ID NO: 101037 - protein, 11 aa, Dengue virus
PKAYAGPISQH

SEQ ID NO: 101038 - protein, 11 aa, Dengue virus
KAYAGPISQHN

SEQ ID NO: 101039 - protein, 11 aa, Dengue virus
CPGTTVTVRED

SEQ ID NO: 101040 - protein, 11 aa, Dengue virus
PGTTVTVREDC

SEQ ID NO: 101041 - protein, 11 aa, Dengue virus
REDCDHRGPSL

SEQ ID NO: 101042 - protein, 11 aa, Dengue virus
EENMVRSQVTA

SEQ ID NO: 101043 - protein, 11 aa, Dengue virus
ENMVKSQATAG

SEQ ID NO: 101044 - protein, 11 aa, Dengue virus
GTPETFSMGLL

SEQ ID NO: 101045 - protein, 11 aa, Dengue virus
TRKHMILVVAI

SEQ ID NO: 101046 - protein, 11 aa, Dengue virus
RKHMILVVAIT

SEQ ID NO: 101047 - protein, 11 aa, Dengue virus
ATLCAIILGGL

SEQ ID NO: 101048 - protein, 11 aa, Dengue virus
RVGGQTHLAIM

SEQ ID NO: 101049 - protein, 11 aa, Dengue virus
TFSIPHDLMEL

SEQ ID NO: 101050 - protein, 11 aa, Dengue virus
VTQFDDTQVGT

SEQ ID NO: 101051 - protein, 11 aa, Dengue virus
TQFDDTQVGTL

SEQ ID NO: 101052 - protein, 11 aa, Dengue virus
HFDSTQVGTLA

SEQ ID NO: 101053 - protein, 11 aa, Dengue virus
AIAVASSLLWV

SEQ ID NO: 101054 - protein, 11 aa, Dengue virus
VASGLLWIAEI

SEQ ID NO: 101055 - protein, 11 aa, Dengue virus
KTDFGFYQVKA

SEQ ID NO: 101056 - protein, 11 aa, Dengue virus
TDFGFYQEKPE

SEQ ID NO: 101057 - protein, 11 aa, Dengue virus
DFGFYQEKPET

SEQ ID NO: 101058 - protein, 11 aa, Dengue virus
FGFYQVKAETT

SEQ ID NO: 101059 - protein, 11 aa, Dengue virus
GFYQVKTEITI

SEQ ID NO: 101060 - protein, 11 aa, Dengue virus
FYQEKPETTIL

SEQ ID NO: 101061 - protein, 11 aa, Dengue virus
YQVKTEITILD

SEQ ID NO: 101062 - protein, 11 aa, Dengue virus
QVKTEITILDV

SEQ ID NO: 101063 - protein, 11 aa, Dengue virus
VKTEITILDVD

SEQ ID NO: 101064 - protein, 11 aa, Dengue virus
AQTPRRGTGTI

SEQ ID NO: 101065 - protein, 11 aa, Dengue virus
SALRDGSKTKH

SEQ ID NO: 101066 - protein, 11 aa, Dengue virus
ALRDGSKTKHA

SEQ ID NO: 101067 - protein, 11 aa, Dengue virus
LRDGSKTKHAV

SEQ ID NO: 101068 - protein, 11 aa, Dengue virus
RDGSKTKHAVS

SEQ ID NO: 101069 - protein, 11 aa, Dengue virus
KLQRKYGGSLV

SEQ ID NO: 101070 - protein, 11 aa, Dengue virus
LQRKYGGSLVR

SEQ ID NO: 101071 - protein, 11 aa, Dengue virus
QRKYGGNLIRC

SEQ ID NO: 101072 - protein, 11 aa, Dengue virus
RKYGGSLVRCP

SEQ ID NO: 101073 - protein, 11 aa, Dengue virus
KYGGSLVRCPL

SEQ ID NO: 101074 - protein, 11 aa, Dengue virus
TPQPKLGTRVV

SEQ ID NO: 101075 - protein, 11 aa, Dengue virus
PQPKLGTRVVM

SEQ ID NO: 101076 - protein, 11 aa, Dengue virus
QPKPGTQMIMT

SEQ ID NO: 101077 - protein, 11 aa, Dengue virus
PKLGTRVVMTT

SEQ ID NO: 101078 - protein, 11 aa, Dengue virus
KPGTQMIMTTT

SEQ ID NO: 101079 - protein, 11 aa, Dengue virus
LGTRVVMTTTA

SEQ ID NO: 101080 - protein, 11 aa, Dengue virus
KKKPRLCTREE

SEQ ID NO: 101081 - protein, 11 aa, Dengue virus
KKPRLCTREEF

SEQ ID NO: 101082 - protein, 11 aa, Dengue virus
KPRLCTREEFI

SEQ ID NO: 101083 - protein, 11 aa, Dengue virus
YMPAMKRYSAH

SEQ ID NO: 101084 - protein, 11 aa, Dengue virus
RYSAPLESEGV

SEQ ID NO: 101085 - protein, 11 aa, Dengue virus
YSAPSENEGVL

SEQ ID NO: 101086 - protein, 8 aa, Dengue virus
MNNQRKKT

SEQ ID NO: 101087 - protein, 8 aa, Dengue virus
PSFNMLKR

SEQ ID NO: 101088 - protein, 8 aa, Dengue virus
SFNMLKRA

SEQ ID NO: 101089 - protein, 8 aa, Dengue virus
FNMLKRAR

SEQ ID NO: 101090 - protein, 8 aa, Dengue virus
NMLKRARN

SEQ ID NO: 101091 - protein, 8 aa, Dengue virus
MLKRARNR

SEQ ID NO: 101092 - protein, 8 aa, Dengue virus
LKRARNRV

SEQ ID NO: 101093 - protein, 8 aa, Dengue virus
KRARNRVS

SEQ ID NO: 101094 - protein, 8 aa, Dengue virus
RARNRVST

SEQ ID NO: 101095 - protein, 8 aa, Dengue virus
RNRVSTVS

SEQ ID NO: 101096 - protein, 8 aa, Dengue virus
NRVSTVSQ

SEQ ID NO: 101097 - protein, 8 aa, Dengue virus
RVSTVSQL

SEQ ID NO: 101098 - protein, 8 aa, Dengue virus
VSTVSQLA

SEQ ID NO: 101099 - protein, 8 aa, Dengue virus
STVSQLAK

SEQ ID NO: 101100 - protein, 8 aa, Dengue virus
TVSQLAKR

SEQ ID NO: 101101 - protein, 8 aa, Dengue virus
VSQLAKRF

SEQ ID NO: 101102 - protein, 8 aa, Dengue virus
SQLAKRFS

SEQ ID NO: 101103 - protein, 8 aa, Dengue virus
QLAKRFSK

SEQ ID NO: 101104 - protein, 8 aa, Dengue virus
LAKRFSKG

SEQ ID NO: 101105 - protein, 8 aa, Dengue virus
AKRFSKGL

SEQ ID NO: 101106 - protein, 8 aa, Dengue virus
KRFSKGLL

SEQ ID NO: 101107 - protein, 8 aa, Dengue virus
RFSKGLLS

SEQ ID NO: 101108 - protein, 8 aa, Dengue virus
FSKGLLSG

SEQ ID NO: 101109 - protein, 8 aa, Dengue virus
SKGLLSGQ

SEQ ID NO: 101110 - protein, 8 aa, Dengue virus
KGLLSGQG

SEQ ID NO: 101111 - protein, 8 aa, Dengue virus
GLLSGQGP

SEQ ID NO: 101112 - protein, 8 aa, Dengue virus
LLSGQGPM

SEQ ID NO: 101113 - protein, 8 aa, Dengue virus
LSGQGPMK

SEQ ID NO: 101114 - protein, 8 aa, Dengue virus
GQGPMKLV

SEQ ID NO: 101115 - protein, 8 aa, Dengue virus
QGPMKLVM

SEQ ID NO: 101116 - protein, 8 aa, Dengue virus
GPMKLVMA

SEQ ID NO: 101117 - protein, 8 aa, Dengue virus
PMKLVMAF

SEQ ID NO: 101118 - protein, 8 aa, Dengue virus
KLVMAFIA

SEQ ID NO: 101119 - protein, 8 aa, Dengue virus
LVMAFIAF

SEQ ID NO: 101120 - protein, 8 aa, Dengue virus
VMAFIAFL

SEQ ID NO: 101121 - protein, 8 aa, Dengue virus
MAFIAFLR

SEQ ID NO: 101122 - protein, 8 aa, Dengue virus
AFIAFLRF

SEQ ID NO: 101123 - protein, 8 aa, Dengue virus
FIAFLRFL

SEQ ID NO: 101124 - protein, 8 aa, Dengue virus
IAFLRFLA

SEQ ID NO: 101125 - protein, 8 aa, Dengue virus
AFLRFLAI

SEQ ID NO: 101126 - protein, 8 aa, Dengue virus
FLRFLAIP

SEQ ID NO: 101127 - protein, 8 aa, Dengue virus
LRFLAIPP

SEQ ID NO: 101128 - protein, 8 aa, Dengue virus
RFLAIPPT

SEQ ID NO: 101129 - protein, 8 aa, Dengue virus
FLAIPPTA

SEQ ID NO: 101130 - protein, 8 aa, Dengue virus
LAIPPTAG

SEQ ID NO: 101131 - protein, 8 aa, Dengue virus
AIPPTAGI

SEQ ID NO: 101132 - protein, 8 aa, Dengue virus
IPPTAGIL

SEQ ID NO: 101133 - protein, 8 aa, Dengue virus
PPTAGILA

SEQ ID NO: 101134 - protein, 8 aa, Dengue virus
PTAGILAR

SEQ ID NO: 101135 - protein, 8 aa, Dengue virus
TAGILARW

SEQ ID NO: 101136 - protein, 8 aa, Dengue virus
AGILARWG

SEQ ID NO: 101137 - protein, 8 aa, Dengue virus
GFKKEISN

SEQ ID NO: 101138 - protein, 8 aa, Dengue virus
FKKEISNM

SEQ ID NO: 101139 - protein, 8 aa, Dengue virus
KKEISNML

SEQ ID NO: 101140 - protein, 8 aa, Dengue virus
AFHLTTRG

SEQ ID NO: 101141 - protein, 8 aa, Dengue virus
FHLTTRGG

SEQ ID NO: 101142 - protein, 8 aa, Dengue virus
HLTTRGGE

SEQ ID NO: 101143 - protein, 8 aa, Dengue virus
LTTRGGEP

SEQ ID NO: 101144 - protein, 8 aa, Dengue virus
TTRGGEPH

SEQ ID NO: 101145 - protein, 8 aa, Dengue virus
TRGGEPHM

SEQ ID NO: 101146 - protein, 8 aa, Dengue virus
RGGEPHMI

SEQ ID NO: 101147 - protein, 8 aa, Dengue virus
GGEPHMIV

SEQ ID NO: 101148 - protein, 8 aa, Dengue virus
QERGKSLL

SEQ ID NO: 101149 - protein, 8 aa, Dengue virus
ERGKSLLF

SEQ ID NO: 101150 - protein, 8 aa, Dengue virus
RGKSLLFK

SEQ ID NO: 101151 - protein, 8 aa, Dengue virus
GKSLLFKT

SEQ ID NO: 101152 - protein, 8 aa, Dengue virus
KSLLFKTS

SEQ ID NO: 101153 - protein, 8 aa, Dengue virus
NMCTLIAM

SEQ ID NO: 101154 - protein, 8 aa, Dengue virus
MCTLIAMD

SEQ ID NO: 101155 - protein, 8 aa, Dengue virus
CTLIAMDL

SEQ ID NO: 101156 - protein, 8 aa, Dengue virus
TLIAMDLG

SEQ ID NO: 101157 - protein, 8 aa, Dengue virus
LIAMDLGE

SEQ ID NO: 101158 - protein, 8 aa, Dengue virus
IAMDLGEL

SEQ ID NO: 101159 - protein, 8 aa, Dengue virus
AMDLGELC

SEQ ID NO: 101160 - protein, 8 aa, Dengue virus
MDLGELCE

SEQ ID NO: 101161 - protein, 8 aa, Dengue virus
DLGELCED

SEQ ID NO: 101162 - protein, 8 aa, Dengue virus
LGELCEDT

SEQ ID NO: 101163 - protein, 8 aa, Dengue virus
DTMTYKCP

SEQ ID NO: 101164 - protein, 8 aa, Dengue virus
EPEDIDCW

SEQ ID NO: 101165 - protein, 8 aa, Dengue virus
PEDIDCWC

SEQ ID NO: 101166 - protein, 8 aa, Dengue virus
EDIDCWCN

SEQ ID NO: 101167 - protein, 8 aa, Dengue virus
DVDCWCNA

SEQ ID NO: 101168 - protein, 8 aa, Dengue virus
VDCWCNAT

SEQ ID NO: 101169 - protein, 8 aa, Dengue virus
DCWCNATD

SEQ ID NO: 101170 - protein, 8 aa, Dengue virus
CWCNATDT

SEQ ID NO: 101171 - protein, 8 aa, Dengue virus
WCNATDTW

SEQ ID NO: 101172 - protein, 8 aa, Dengue virus
TSTWVTYG

SEQ ID NO: 101173 - protein, 8 aa, Dengue virus
STWVTYGT

SEQ ID NO: 101174 - protein, 8 aa, Dengue virus
TWVTYGTC

SEQ ID NO: 101175 - protein, 8 aa, Dengue virus
WVTYGTCS

SEQ ID NO: 101176 - protein, 8 aa, Dengue virus
GEHRRDKR

SEQ ID NO: 101177 - protein, 8 aa, Dengue virus
EHRRDKRS

SEQ ID NO: 101178 - protein, 8 aa, Dengue virus
HRRDKRSV

SEQ ID NO: 101179 - protein, 8 aa, Dengue virus
RRDKRSVA

SEQ ID NO: 101180 - protein, 8 aa, Dengue virus
RDKRSVAL

SEQ ID NO: 101181 - protein, 8 aa, Dengue virus
DKRSVALA

SEQ ID NO: 101182 - protein, 8 aa, Dengue virus
KRSVALAP

SEQ ID NO: 101183 - protein, 8 aa, Dengue virus
RSVALAPH

SEQ ID NO: 101184 - protein, 8 aa, Dengue virus
SVALAPHV

SEQ ID NO: 101185 - protein, 8 aa, Dengue virus
VALAPHVG

SEQ ID NO: 101186 - protein, 8 aa, Dengue virus
ALAPHVGL

SEQ ID NO: 101187 - protein, 8 aa, Dengue virus
LAPHVGLG

SEQ ID NO: 101188 - protein, 8 aa, Dengue virus
APHVGLGL

SEQ ID NO: 101189 - protein, 8 aa, Dengue virus
PHVGLGLE

SEQ ID NO: 101190 - protein, 8 aa, Dengue virus
HVGLGLET

SEQ ID NO: 101191 - protein, 8 aa, Dengue virus
VGLGLETR

SEQ ID NO: 101192 - protein, 8 aa, Dengue virus
GLETRTET

SEQ ID NO: 101193 - protein, 8 aa, Dengue virus
LETRTETW

SEQ ID NO: 101194 - protein, 8 aa, Dengue virus
ETRTETWM

SEQ ID NO: 101195 - protein, 8 aa, Dengue virus
TRTETWMS

SEQ ID NO: 101196 - protein, 8 aa, Dengue virus
RTETWMSS

SEQ ID NO: 101197 - protein, 8 aa, Dengue virus
TETWMSSE

SEQ ID NO: 101198 - protein, 8 aa, Dengue virus
ETWMSSEG

SEQ ID NO: 101199 - protein, 8 aa, Dengue virus
TWMSSEGA

SEQ ID NO: 101200 - protein, 8 aa, Dengue virus
WMSSEGAW

SEQ ID NO: 101201 - protein, 8 aa, Dengue virus
MSSEGAWK

SEQ ID NO: 101202 - protein, 8 aa, Dengue virus
SSEGAWKQ

SEQ ID NO: 101203 - protein, 8 aa, Dengue virus
SEGAWKQI

SEQ ID NO: 101204 - protein, 8 aa, Dengue virus
EGAWKQIQ

SEQ ID NO: 101205 - protein, 8 aa, Dengue virus
VETWALRH

SEQ ID NO: 101206 - protein, 8 aa, Dengue virus
ETWALRHP

SEQ ID NO: 101207 - protein, 8 aa, Dengue virus
TWALRHPG

SEQ ID NO: 101208 - protein, 8 aa, Dengue virus
WALRHPGF

SEQ ID NO: 101209 - protein, 8 aa, Dengue virus
ALRHPGFT

SEQ ID NO: 101210 - protein, 8 aa, Dengue virus
VTPSMAMR

SEQ ID NO: 101211 - protein, 8 aa, Dengue virus
TPSMAMRC

SEQ ID NO: 101212 - protein, 8 aa, Dengue virus
PSMAMRCV

SEQ ID NO: 101213 - protein, 8 aa, Dengue virus
SMAMRCVG

SEQ ID NO: 101214 - protein, 8 aa, Dengue virus
MRCVGIGS

SEQ ID NO: 101215 - protein, 8 aa, Dengue virus
RCVGIGSR

SEQ ID NO: 101216 - protein, 8 aa, Dengue virus
CVGIGSRD

SEQ ID NO: 101217 - protein, 8 aa, Dengue virus
VGIGSRDF

SEQ ID NO: 101218 - protein, 8 aa, Dengue virus
GIGSRDFV

SEQ ID NO: 101219 - protein, 8 aa, Dengue virus
IGSRDFVE

SEQ ID NO: 101220 - protein, 8 aa, Dengue virus
GNRDFVEG

SEQ ID NO: 101221 - protein, 8 aa, Dengue virus
NRDFVEGV

SEQ ID NO: 101222 - protein, 8 aa, Dengue virus
RDFVEGLS

SEQ ID NO: 101223 - protein, 8 aa, Dengue virus
DFVEGLSG

SEQ ID NO: 101224 - protein, 8 aa, Dengue virus
FVEGLSGA

SEQ ID NO: 101225 - protein, 8 aa, Dengue virus
VEGLSGAT

SEQ ID NO: 101226 - protein, 8 aa, Dengue virus
EGLSGATW

SEQ ID NO: 101227 - protein, 8 aa, Dengue virus
GLSGATWV

SEQ ID NO: 101228 - protein, 8 aa, Dengue virus
LSGATWVD

SEQ ID NO: 101229 - protein, 8 aa, Dengue virus
SGATWVDV

SEQ ID NO: 101230 - protein, 8 aa, Dengue virus
GATWVDVV

SEQ ID NO: 101231 - protein, 8 aa, Dengue virus
ATWVDVVL

SEQ ID NO: 101232 - protein, 8 aa, Dengue virus
TWVDVVLE

SEQ ID NO: 101233 - protein, 8 aa, Dengue virus
WVDVVLEH

SEQ ID NO: 101234 - protein, 8 aa, Dengue virus
VDVVLEHG

SEQ ID NO: 101235 - protein, 8 aa, Dengue virus
DVVLEHGS

SEQ ID NO: 101236 - protein, 8 aa, Dengue virus
VVLEHGSC

SEQ ID NO: 101237 - protein, 8 aa, Dengue virus
VLEHGSCV

SEQ ID NO: 101238 - protein, 8 aa, Dengue virus
LEHGSCVT

SEQ ID NO: 101239 - protein, 8 aa, Dengue virus
EHGSCVTT

SEQ ID NO: 101240 - protein, 8 aa, Dengue virus
HGSCVTTM

SEQ ID NO: 101241 - protein, 8 aa, Dengue virus
GSCVTTMA

SEQ ID NO: 101242 - protein, 8 aa, Dengue virus
SCVTTMAK

SEQ ID NO: 101243 - protein, 8 aa, Dengue virus
CVTTMAKN

SEQ ID NO: 101244 - protein, 8 aa, Dengue virus
VTTMAKNK

SEQ ID NO: 101245 - protein, 8 aa, Dengue virus
TTMAKNKP

SEQ ID NO: 101246 - protein, 8 aa, Dengue virus
TMAKNKPT

SEQ ID NO: 101247 - protein, 8 aa, Dengue virus
MAKNKPTL

SEQ ID NO: 101248 - protein, 8 aa, Dengue virus
AKNKPTLD

SEQ ID NO: 101249 - protein, 8 aa, Dengue virus
KDKPTLDI

SEQ ID NO: 101250 - protein, 8 aa, Dengue virus
DKPTLDIE

SEQ ID NO: 101251 - protein, 8 aa, Dengue virus
KPTLDIEL

SEQ ID NO: 101252 - protein, 8 aa, Dengue virus
PTLDIELL

SEQ ID NO: 101253 - protein, 8 aa, Dengue virus
TLDIELLK

SEQ ID NO: 101254 - protein, 8 aa, Dengue virus
LDIELLKT

SEQ ID NO: 101255 - protein, 8 aa, Dengue virus
DIELLKTE

SEQ ID NO: 101256 - protein, 8 aa, Dengue virus
IELLKTEV

SEQ ID NO: 101257 - protein, 8 aa, Dengue virus
ELLKTEVT

SEQ ID NO: 101258 - protein, 8 aa, Dengue virus
LRKLCIEA

SEQ ID NO: 101259 - protein, 8 aa, Dengue virus
CIEAKISN

SEQ ID NO: 101260 - protein, 8 aa, Dengue virus
TTDSRCPT

SEQ ID NO: 101261 - protein, 8 aa, Dengue virus
TDSRCPTQ

SEQ ID NO: 101262 - protein, 8 aa, Dengue virus
DSRCPTQG

SEQ ID NO: 101263 - protein, 8 aa, Dengue virus
SRCPTQGE

SEQ ID NO: 101264 - protein, 8 aa, Dengue virus
RCPTQGEA

SEQ ID NO: 101265 - protein, 8 aa, Dengue virus
CRRTFVDR

SEQ ID NO: 101266 - protein, 8 aa, Dengue virus
RRTFVDRG

SEQ ID NO: 101267 - protein, 8 aa, Dengue virus
RTFVDRGW

SEQ ID NO: 101268 - protein, 8 aa, Dengue virus
TFVDRGWG

SEQ ID NO: 101269 - protein, 8 aa, Dengue virus
FVDRGWGN

SEQ ID NO: 101270 - protein, 8 aa, Dengue virus
VDRGWGNG

SEQ ID NO: 101271 - protein, 8 aa, Dengue virus
DRGWGNGC

SEQ ID NO: 101272 - protein, 8 aa, Dengue virus
RGWGNGCG

SEQ ID NO: 101273 - protein, 8 aa, Dengue virus
GWGNGCGL

SEQ ID NO: 101274 - protein, 8 aa, Dengue virus
WGNGCGLF

SEQ ID NO: 101275 - protein, 8 aa, Dengue virus
GNGCGLFG

SEQ ID NO: 101276 - protein, 8 aa, Dengue virus
NGCGLFGK

SEQ ID NO: 101277 - protein, 8 aa, Dengue virus
GCGLFGKG

SEQ ID NO: 101278 - protein, 8 aa, Dengue virus
CGLFGKGS

SEQ ID NO: 101279 - protein, 8 aa, Dengue virus
GLFGKGSL

SEQ ID NO: 101280 - protein, 8 aa, Dengue virus
LFGKGSLI

SEQ ID NO: 101281 - protein, 8 aa, Dengue virus
FGKGSLIT

SEQ ID NO: 101282 - protein, 8 aa, Dengue virus
GKGSLITC

SEQ ID NO: 101283 - protein, 8 aa, Dengue virus
KGSLITCA

SEQ ID NO: 101284 - protein, 8 aa, Dengue virus
GSLITCAK

SEQ ID NO: 101285 - protein, 8 aa, Dengue virus
SLITCAKF

SEQ ID NO: 101286 - protein, 8 aa, Dengue virus
VQYENLKY

SEQ ID NO: 101287 - protein, 8 aa, Dengue virus
ENLKYSVI

SEQ ID NO: 101288 - protein, 8 aa, Dengue virus
IVTVHTGD

SEQ ID NO: 101289 - protein, 8 aa, Dengue virus
VTVHTGDQ

SEQ ID NO: 101290 - protein, 8 aa, Dengue virus
TVHTGDQH

SEQ ID NO: 101291 - protein, 8 aa, Dengue virus
VHTGDQHQ

SEQ ID NO: 101292 - protein, 8 aa, Dengue virus
HTGDQHQV

SEQ ID NO: 101293 - protein, 8 aa, Dengue virus
TGDQHQVG

SEQ ID NO: 101294 - protein, 8 aa, Dengue virus
GDQHQVGN

SEQ ID NO: 101295 - protein, 8 aa, Dengue virus
DQHQVGNE

SEQ ID NO: 101296 - protein, 8 aa, Dengue virus
LTLDCSPR

SEQ ID NO: 101297 - protein, 8 aa, Dengue virus
TLDCSPRT

SEQ ID NO: 101298 - protein, 8 aa, Dengue virus
LDCSPRTG

SEQ ID NO: 101299 - protein, 8 aa, Dengue virus
ECSPRTGL

SEQ ID NO: 101300 - protein, 8 aa, Dengue virus
CSPRTGLD

SEQ ID NO: 101301 - protein, 8 aa, Dengue virus
SPRTGLDF

SEQ ID NO: 101302 - protein, 8 aa, Dengue virus
PRTGLDFN

SEQ ID NO: 101303 - protein, 8 aa, Dengue virus
RTGLDFNE

SEQ ID NO: 101304 - protein, 8 aa, Dengue virus
TGLDFNEM

SEQ ID NO: 101305 - protein, 8 aa, Dengue virus
GLDFNEMV

SEQ ID NO: 101306 - protein, 8 aa, Dengue virus
LDFNEMVL

SEQ ID NO: 101307 - protein, 8 aa, Dengue virus
DFNEMVLL

SEQ ID NO: 101308 - protein, 8 aa, Dengue virus
FNEMVLLT

SEQ ID NO: 101309 - protein, 8 aa, Dengue virus
NEMVLLTM

SEQ ID NO: 101310 - protein, 8 aa, Dengue virus
EMVLLTMK

SEQ ID NO: 101311 - protein, 8 aa, Dengue virus
KSWLVHKQ

SEQ ID NO: 101312 - protein, 8 aa, Dengue virus
SWLVHKQW

SEQ ID NO: 101313 - protein, 8 aa, Dengue virus
WLVHKQWF

SEQ ID NO: 101314 - protein, 8 aa, Dengue virus
LVHKQWFL

SEQ ID NO: 101315 - protein, 8 aa, Dengue virus
VHKQWFLD

SEQ ID NO: 101316 - protein, 8 aa, Dengue virus
HKQWFLDL

SEQ ID NO: 101317 - protein, 8 aa, Dengue virus
KQWFLDLP

SEQ ID NO: 101318 - protein, 8 aa, Dengue virus
QWFLDLPL

SEQ ID NO: 101319 - protein, 8 aa, Dengue virus
WFLDLPLP

SEQ ID NO: 101320 - protein, 8 aa, Dengue virus
FLDLPLPW

SEQ ID NO: 101321 - protein, 8 aa, Dengue virus
LDLPLPWT

SEQ ID NO: 101322 - protein, 8 aa, Dengue virus
DLPLPWTS

SEQ ID NO: 101323 - protein, 8 aa, Dengue virus
LPLPWTSG

SEQ ID NO: 101324 - protein, 8 aa, Dengue virus
PLPWTSGA

SEQ ID NO: 101325 - protein, 8 aa, Dengue virus
QDLLVTFK

SEQ ID NO: 101326 - protein, 8 aa, Dengue virus
DLLVTFKT

SEQ ID NO: 101327 - protein, 8 aa, Dengue virus
LLVTFKTA

SEQ ID NO: 101328 - protein, 8 aa, Dengue virus
LVTFKTAH

SEQ ID NO: 101329 - protein, 8 aa, Dengue virus
VTFKTAHA

SEQ ID NO: 101330 - protein, 8 aa, Dengue virus
TFKTAHAK

SEQ ID NO: 101331 - protein, 8 aa, Dengue virus
FKTAHAKK

SEQ ID NO: 101332 - protein, 8 aa, Dengue virus
KTAHAKKQ

SEQ ID NO: 101333 - protein, 8 aa, Dengue virus
TAHAKKQE

SEQ ID NO: 101334 - protein, 8 aa, Dengue virus
AHAKKQEV

SEQ ID NO: 101335 - protein, 8 aa, Dengue virus
HAKKQEVV

SEQ ID NO: 101336 - protein, 8 aa, Dengue virus
AKKQEVVV

SEQ ID NO: 101337 - protein, 8 aa, Dengue virus
KKQEVVVL

SEQ ID NO: 101338 - protein, 8 aa, Dengue virus
KQEVVVLG

SEQ ID NO: 101339 - protein, 8 aa, Dengue virus
QEVVVLGS

SEQ ID NO: 101340 - protein, 8 aa, Dengue virus
EVVVLGSQ

SEQ ID NO: 101341 - protein, 8 aa, Dengue virus
VVVLGSQE

SEQ ID NO: 101342 - protein, 8 aa, Dengue virus
VVLGSQEG

SEQ ID NO: 101343 - protein, 8 aa, Dengue virus
VLGSQEGA

SEQ ID NO: 101344 - protein, 8 aa, Dengue virus
LGSQEGAM

SEQ ID NO: 101345 - protein, 8 aa, Dengue virus
GSQEGAMH

SEQ ID NO: 101346 - protein, 8 aa, Dengue virus
SQEGAMHT

SEQ ID NO: 101347 - protein, 8 aa, Dengue virus
QEGAMHTA

SEQ ID NO: 101348 - protein, 8 aa, Dengue virus
EGAMHTAL

SEQ ID NO: 101349 - protein, 8 aa, Dengue virus
GAMHTALT

SEQ ID NO: 101350 - protein, 8 aa, Dengue virus
AMHTALTG

SEQ ID NO: 101351 - protein, 8 aa, Dengue virus
MHTALTGA

SEQ ID NO: 101352 - protein, 8 aa, Dengue virus
HTALTGAT

SEQ ID NO: 101353 - protein, 8 aa, Dengue virus
TALTGATE

SEQ ID NO: 101354 - protein, 8 aa, Dengue virus
ALTGATEI

SEQ ID NO: 101355 - protein, 8 aa, Dengue virus
LTGATEIQ

SEQ ID NO: 101356 - protein, 8 aa, Dengue virus
TGATEIQT

SEQ ID NO: 101357 - protein, 8 aa, Dengue virus
GATEIQTS

SEQ ID NO: 101358 - protein, 8 aa, Dengue virus
ATEIQTSG

SEQ ID NO: 101359 - protein, 8 aa, Dengue virus
EIQTSGTT

SEQ ID NO: 101360 - protein, 8 aa, Dengue virus
GTTTIFAG

SEQ ID NO: 101361 - protein, 8 aa, Dengue virus
TTTIFAGH

SEQ ID NO: 101362 - protein, 8 aa, Dengue virus
TTIFAGHL

SEQ ID NO: 101363 - protein, 8 aa, Dengue virus
TIFAGHLK

SEQ ID NO: 101364 - protein, 8 aa, Dengue virus
IFAGHLKC

SEQ ID NO: 101365 - protein, 8 aa, Dengue virus
FAGHLKCR

SEQ ID NO: 101366 - protein, 8 aa, Dengue virus
AGHLKCRL

SEQ ID NO: 101367 - protein, 8 aa, Dengue virus
GHLKCRLK

SEQ ID NO: 101368 - protein, 8 aa, Dengue virus
HLKCRLKM

SEQ ID NO: 101369 - protein, 8 aa, Dengue virus
LKCRLKMD

SEQ ID NO: 101370 - protein, 8 aa, Dengue virus
KCRLKMDK

SEQ ID NO: 101371 - protein, 8 aa, Dengue virus
CRLKMDKL

SEQ ID NO: 101372 - protein, 8 aa, Dengue virus
RLKMDKLT

SEQ ID NO: 101373 - protein, 8 aa, Dengue virus
LKMDKLTL

SEQ ID NO: 101374 - protein, 8 aa, Dengue virus
KMDKLTLK

SEQ ID NO: 101375 - protein, 8 aa, Dengue virus
MDKLTLKG

SEQ ID NO: 101376 - protein, 8 aa, Dengue virus
EKEVAETQ

SEQ ID NO: 101377 - protein, 8 aa, Dengue virus
KEVAETQH

SEQ ID NO: 101378 - protein, 8 aa, Dengue virus
EVAETQHG

SEQ ID NO: 101379 - protein, 8 aa, Dengue virus
VAETQHGT

SEQ ID NO: 101380 - protein, 8 aa, Dengue virus
AETQHGTV

SEQ ID NO: 101381 - protein, 8 aa, Dengue virus
ETQHGTVL

SEQ ID NO: 101382 - protein, 8 aa, Dengue virus
TQHGTVLV

SEQ ID NO: 101383 - protein, 8 aa, Dengue virus
QHGTVLVQ

SEQ ID NO: 101384 - protein, 8 aa, Dengue virus
PVNIEAEP

SEQ ID NO: 101385 - protein, 8 aa, Dengue virus
VNIEAEPP

SEQ ID NO: 101386 - protein, 8 aa, Dengue virus
NIEAEPPF

SEQ ID NO: 101387 - protein, 8 aa, Dengue virus
IEAEPPFG

SEQ ID NO: 101388 - protein, 8 aa, Dengue virus
EAEPPFGE

SEQ ID NO: 101389 - protein, 8 aa, Dengue virus
AEPPFGES

SEQ ID NO: 101390 - protein, 8 aa, Dengue virus
EPPFGESY

SEQ ID NO: 101391 - protein, 8 aa, Dengue virus
PPFGESYI

SEQ ID NO: 101392 - protein, 8 aa, Dengue virus
WFKKGSSI

SEQ ID NO: 101393 - protein, 8 aa, Dengue virus
FKKGSSIG

SEQ ID NO: 101394 - protein, 8 aa, Dengue virus
KKGSSIGK

SEQ ID NO: 101395 - protein, 8 aa, Dengue virus
KGSSIGKM

SEQ ID NO: 101396 - protein, 8 aa, Dengue virus
GSSIGKMF

SEQ ID NO: 101397 - protein, 8 aa, Dengue virus
SSIGKMFE

SEQ ID NO: 101398 - protein, 8 aa, Dengue virus
SIGKMFEA

SEQ ID NO: 101399 - protein, 8 aa, Dengue virus
IGKMFEAT

SEQ ID NO: 101400 - protein, 8 aa, Dengue virus
GKMFEATA

SEQ ID NO: 101401 - protein, 8 aa, Dengue virus
KMFEATAR

SEQ ID NO: 101402 - protein, 8 aa, Dengue virus
MFEATARG

SEQ ID NO: 101403 - protein, 8 aa, Dengue virus
FEATARGA

SEQ ID NO: 101404 - protein, 8 aa, Dengue virus
EATARGAR

SEQ ID NO: 101405 - protein, 8 aa, Dengue virus
ATARGARR

SEQ ID NO: 101406 - protein, 8 aa, Dengue virus
TARGARRM

SEQ ID NO: 101407 - protein, 8 aa, Dengue virus
ARGARRMA

SEQ ID NO: 101408 - protein, 8 aa, Dengue virus
RGARRMAI

SEQ ID NO: 101409 - protein, 8 aa, Dengue virus
GARRMAIL

SEQ ID NO: 101410 - protein, 8 aa, Dengue virus
ARRMAILG

SEQ ID NO: 101411 - protein, 8 aa, Dengue virus
RRMAILGD

SEQ ID NO: 101412 - protein, 8 aa, Dengue virus
RMAILGDT

SEQ ID NO: 101413 - protein, 8 aa, Dengue virus
MAILGDTA

SEQ ID NO: 101414 - protein, 8 aa, Dengue virus
AILGDTAW

SEQ ID NO: 101415 - protein, 8 aa, Dengue virus
ILGDTAWD

SEQ ID NO: 101416 - protein, 8 aa, Dengue virus
LGDTAWDF

SEQ ID NO: 101417 - protein, 8 aa, Dengue virus
GDTAWDFG

SEQ ID NO: 101418 - protein, 8 aa, Dengue virus
DTAWDFGS

SEQ ID NO: 101419 - protein, 8 aa, Dengue virus
TAWDFGSI

SEQ ID NO: 101420 - protein, 8 aa, Dengue virus
AWDFGSIG

SEQ ID NO: 101421 - protein, 8 aa, Dengue virus
WDFGSIGG

SEQ ID NO: 101422 - protein, 8 aa, Dengue virus
DFGSIGGV

SEQ ID NO: 101423 - protein, 8 aa, Dengue virus
FGTAYGVL

SEQ ID NO: 101424 - protein, 8 aa, Dengue virus
GTAYGVLF

SEQ ID NO: 101425 - protein, 8 aa, Dengue virus
AYGVLFSG

SEQ ID NO: 101426 - protein, 8 aa, Dengue virus
YGVLFSGV

SEQ ID NO: 101427 - protein, 8 aa, Dengue virus
GVLFSGVS

SEQ ID NO: 101428 - protein, 8 aa, Dengue virus
VLFSGVSW

SEQ ID NO: 101429 - protein, 8 aa, Dengue virus
FSGVSWTM

SEQ ID NO: 101430 - protein, 8 aa, Dengue virus
SGVSWTMK

SEQ ID NO: 101431 - protein, 8 aa, Dengue virus
GVSWTMKI

SEQ ID NO: 101432 - protein, 8 aa, Dengue virus
LLTWLGLN

SEQ ID NO: 101433 - protein, 8 aa, Dengue virus
LTWLGLNS

SEQ ID NO: 101434 - protein, 8 aa, Dengue virus
TWLGLNSR

SEQ ID NO: 101435 - protein, 8 aa, Dengue virus
WLGLNSRS

SEQ ID NO: 101436 - protein, 8 aa, Dengue virus
LGLNSRST

SEQ ID NO: 101437 - protein, 8 aa, Dengue virus
GLNSRSTS

SEQ ID NO: 101438 - protein, 8 aa, Dengue virus
NSRSTSLS

SEQ ID NO: 101439 - protein, 8 aa, Dengue virus
TLYLGVMV

SEQ ID NO: 101440 - protein, 8 aa, Dengue virus
LYLGVMVQ

SEQ ID NO: 101441 - protein, 8 aa, Dengue virus
YLGVMVQA

SEQ ID NO: 101442 - protein, 8 aa, Dengue virus
LGVMVQAD

SEQ ID NO: 101443 - protein, 8 aa, Dengue virus
VQADSGCV

SEQ ID NO: 101444 - protein, 8 aa, Dengue virus
GRELKCGS

SEQ ID NO: 101445 - protein, 8 aa, Dengue virus
KELKCGSG

SEQ ID NO: 101446 - protein, 8 aa, Dengue virus
ELKCGSGI

SEQ ID NO: 101447 - protein, 8 aa, Dengue virus
LKCGSGIF

SEQ ID NO: 101448 - protein, 8 aa, Dengue virus
KCGSGIFV

SEQ ID NO: 101449 - protein, 8 aa, Dengue virus
CGSGIFVT

SEQ ID NO: 101450 - protein, 8 aa, Dengue virus
GSGIFVTN

SEQ ID NO: 101451 - protein, 8 aa, Dengue virus
SGIFVTNE

SEQ ID NO: 101452 - protein, 8 aa, Dengue virus
GIFVTNEV

SEQ ID NO: 101453 - protein, 8 aa, Dengue virus
IFVTNEVH

SEQ ID NO: 101454 - protein, 8 aa, Dengue virus
FVTNEVHT

SEQ ID NO: 101455 - protein, 8 aa, Dengue virus
VTNEVHTW

SEQ ID NO: 101456 - protein, 8 aa, Dengue virus
TNEVHTWT

SEQ ID NO: 101457 - protein, 8 aa, Dengue virus
NEVHTWTE

SEQ ID NO: 101458 - protein, 8 aa, Dengue virus
EVHTWTEQ

SEQ ID NO: 101459 - protein, 8 aa, Dengue virus
VHTWTEQY

SEQ ID NO: 101460 - protein, 8 aa, Dengue virus
HTWTEQYK

SEQ ID NO: 101461 - protein, 8 aa, Dengue virus
TWTEQYKF

SEQ ID NO: 101462 - protein, 8 aa, Dengue virus
WTEQYKFQ

SEQ ID NO: 101463 - protein, 8 aa, Dengue virus
TEQYKFQA

SEQ ID NO: 101464 - protein, 8 aa, Dengue virus
EQYKFQAD

SEQ ID NO: 101465 - protein, 8 aa, Dengue virus
QYKFQADS

SEQ ID NO: 101466 - protein, 8 aa, Dengue virus
YKFQADSP

SEQ ID NO: 101467 - protein, 8 aa, Dengue virus
KFQADSPK

SEQ ID NO: 101468 - protein, 8 aa, Dengue virus
FQADSPKR

SEQ ID NO: 101469 - protein, 8 aa, Dengue virus
QADSPKRL

SEQ ID NO: 101470 - protein, 8 aa, Dengue virus
ADSPKRLS

SEQ ID NO: 101471 - protein, 8 aa, Dengue virus
DSPKRLSA

SEQ ID NO: 101472 - protein, 8 aa, Dengue virus
SPKRLSAA

SEQ ID NO: 101473 - protein, 8 aa, Dengue virus
PKRLSAAI

SEQ ID NO: 101474 - protein, 8 aa, Dengue virus
KRLSAAIG

SEQ ID NO: 101475 - protein, 8 aa, Dengue virus
RLSAAIGK

SEQ ID NO: 101476 - protein, 8 aa, Dengue virus
LSAAIGKA

SEQ ID NO: 101477 - protein, 8 aa, Dengue virus
SAAIGKAW

SEQ ID NO: 101478 - protein, 8 aa, Dengue virus
EEGVCGIR

SEQ ID NO: 101479 - protein, 8 aa, Dengue virus
EGVCGIRS

SEQ ID NO: 101480 - protein, 8 aa, Dengue virus
GVCGIRSA

SEQ ID NO: 101481 - protein, 8 aa, Dengue virus
VCGIRSAT

SEQ ID NO: 101482 - protein, 8 aa, Dengue virus
CGIRSATR

SEQ ID NO: 101483 - protein, 8 aa, Dengue virus
GIRSATRL

SEQ ID NO: 101484 - protein, 8 aa, Dengue virus
IRSATRLE

SEQ ID NO: 101485 - protein, 8 aa, Dengue virus
RSATRLEN

SEQ ID NO: 101486 - protein, 8 aa, Dengue virus
SATRLENI

SEQ ID NO: 101487 - protein, 8 aa, Dengue virus
ATRLENIM

SEQ ID NO: 101488 - protein, 8 aa, Dengue virus
TRLENIMW

SEQ ID NO: 101489 - protein, 8 aa, Dengue virus
RLENIMWK

SEQ ID NO: 101490 - protein, 8 aa, Dengue virus
LENIMWKQ

SEQ ID NO: 101491 - protein, 8 aa, Dengue virus
ENIMWKQI

SEQ ID NO: 101492 - protein, 8 aa, Dengue virus
SNELNHIL

SEQ ID NO: 101493 - protein, 8 aa, Dengue virus
ELNHILLE

SEQ ID NO: 101494 - protein, 8 aa, Dengue virus
LNHILLEN

SEQ ID NO: 101495 - protein, 8 aa, Dengue virus
KYSWKTWG

SEQ ID NO: 101496 - protein, 8 aa, Dengue virus
YSWKTWGK

SEQ ID NO: 101497 - protein, 8 aa, Dengue virus
SWKTWGKA

SEQ ID NO: 101498 - protein, 8 aa, Dengue virus
WKTWGKAK

SEQ ID NO: 101499 - protein, 8 aa, Dengue virus
TFIIDGPN

SEQ ID NO: 101500 - protein, 8 aa, Dengue virus
FIIDGPNT

SEQ ID NO: 101501 - protein, 8 aa, Dengue virus
RAWNIWEV

SEQ ID NO: 101502 - protein, 8 aa, Dengue virus
AWNIWEVE

SEQ ID NO: 101503 - protein, 8 aa, Dengue virus
WNIWEVED

SEQ ID NO: 101504 - protein, 8 aa, Dengue virus
NIWEVEDY

SEQ ID NO: 101505 - protein, 8 aa, Dengue virus
IWEVEDYG

SEQ ID NO: 101506 - protein, 8 aa, Dengue virus
WEVEDYGF

SEQ ID NO: 101507 - protein, 8 aa, Dengue virus
EVEDYGFG

SEQ ID NO: 101508 - protein, 8 aa, Dengue virus
VEDYGFGV

SEQ ID NO: 101509 - protein, 8 aa, Dengue virus
EDYGFGVF

SEQ ID NO: 101510 - protein, 8 aa, Dengue virus
DYGFGVFT

SEQ ID NO: 101511 - protein, 8 aa, Dengue virus
YGFGVFTT

SEQ ID NO: 101512 - protein, 8 aa, Dengue virus
GFGVFTTN

SEQ ID NO: 101513 - protein, 8 aa, Dengue virus
FGVFTTNI

SEQ ID NO: 101514 - protein, 8 aa, Dengue virus
GVFTTNIW

SEQ ID NO: 101515 - protein, 8 aa, Dengue virus
VFTTNIWL

SEQ ID NO: 101516 - protein, 8 aa, Dengue virus
FTTNIWLK

SEQ ID NO: 101517 - protein, 8 aa, Dengue virus
TTNIWLKL

SEQ ID NO: 101518 - protein, 8 aa, Dengue virus
TNIWLKLR

SEQ ID NO: 101519 - protein, 8 aa, Dengue virus
CDHRLMSA

SEQ ID NO: 101520 - protein, 8 aa, Dengue virus
DHRLMSAA

SEQ ID NO: 101521 - protein, 8 aa, Dengue virus
HRLMSAAI

SEQ ID NO: 101522 - protein, 8 aa, Dengue virus
RLMSAAIK

SEQ ID NO: 101523 - protein, 8 aa, Dengue virus
LMSAAIKD

SEQ ID NO: 101524 - protein, 8 aa, Dengue virus
KDSKAVHA

SEQ ID NO: 101525 - protein, 8 aa, Dengue virus
DSKAVHAD

SEQ ID NO: 101526 - protein, 8 aa, Dengue virus
SKAVHADM

SEQ ID NO: 101527 - protein, 8 aa, Dengue virus
RAVHADMG

SEQ ID NO: 101528 - protein, 8 aa, Dengue virus
AVHADMGY

SEQ ID NO: 101529 - protein, 8 aa, Dengue virus
VHADMGYW

SEQ ID NO: 101530 - protein, 8 aa, Dengue virus
HADMGYWI

SEQ ID NO: 101531 - protein, 8 aa, Dengue virus
ADMGYWIE

SEQ ID NO: 101532 - protein, 8 aa, Dengue virus
DMGYWIES

SEQ ID NO: 101533 - protein, 8 aa, Dengue virus
MGYWIESE

SEQ ID NO: 101534 - protein, 8 aa, Dengue virus
GYWIESEK

SEQ ID NO: 101535 - protein, 8 aa, Dengue virus
YWIESEKN

SEQ ID NO: 101536 - protein, 8 aa, Dengue virus
ESEKNETW

SEQ ID NO: 101537 - protein, 8 aa, Dengue virus
SEKNETWK

SEQ ID NO: 101538 - protein, 8 aa, Dengue virus
KNETWKLA

SEQ ID NO: 101539 - protein, 8 aa, Dengue virus
RASFIEVK

SEQ ID NO: 101540 - protein, 8 aa, Dengue virus
ASFIEVKT

SEQ ID NO: 101541 - protein, 8 aa, Dengue virus
SFIEVKTC

SEQ ID NO: 101542 - protein, 8 aa, Dengue virus
WPKSHTLW

SEQ ID NO: 101543 - protein, 8 aa, Dengue virus
PKSHTLWS

SEQ ID NO: 101544 - protein, 8 aa, Dengue virus
KSHTLWSN

SEQ ID NO: 101545 - protein, 8 aa, Dengue virus
SHTLWSNG

SEQ ID NO: 101546 - protein, 8 aa, Dengue virus
HTLWSNGV

SEQ ID NO: 101547 - protein, 8 aa, Dengue virus
TLWSNGVL

SEQ ID NO: 101548 - protein, 8 aa, Dengue virus
LWSNGVLE

SEQ ID NO: 101549 - protein, 8 aa, Dengue virus
WSNGVLES

SEQ ID NO: 101550 - protein, 8 aa, Dengue virus
SNGVLESE

SEQ ID NO: 101551 - protein, 8 aa, Dengue virus
NGVLESEM

SEQ ID NO: 101552 - protein, 8 aa, Dengue virus
GVLESEMI

SEQ ID NO: 101553 - protein, 8 aa, Dengue virus
VLESEMII

SEQ ID NO: 101554 - protein, 8 aa, Dengue virus
LESEMIIP

SEQ ID NO: 101555 - protein, 8 aa, Dengue virus
ESEMIIPK

SEQ ID NO: 101556 - protein, 8 aa, Dengue virus
GGPISQHN

SEQ ID NO: 101557 - protein, 8 aa, Dengue virus
SQHNYRPG

SEQ ID NO: 101558 - protein, 8 aa, Dengue virus
QHNYRPGY

SEQ ID NO: 101559 - protein, 8 aa, Dengue virus
TQTAGPWH

SEQ ID NO: 101560 - protein, 8 aa, Dengue virus
QTAGPWHL

SEQ ID NO: 101561 - protein, 8 aa, Dengue virus
TAGPWHLG

SEQ ID NO: 101562 - protein, 8 aa, Dengue virus
AGPWHLGK

SEQ ID NO: 101563 - protein, 8 aa, Dengue virus
GPWHLGKL

SEQ ID NO: 101564 - protein, 8 aa, Dengue virus
PWHLGKLE

SEQ ID NO: 101565 - protein, 8 aa, Dengue virus
WHLGKLEL

SEQ ID NO: 101566 - protein, 8 aa, Dengue virus
HLGKLELD

SEQ ID NO: 101567 - protein, 8 aa, Dengue virus
LGKLELDF

SEQ ID NO: 101568 - protein, 8 aa, Dengue virus
CEGTTVVV

SEQ ID NO: 101569 - protein, 8 aa, Dengue virus
CGNRGPSL

SEQ ID NO: 101570 - protein, 8 aa, Dengue virus
GNRGPSLR

SEQ ID NO: 101571 - protein, 8 aa, Dengue virus
NRGPSLRT

SEQ ID NO: 101572 - protein, 8 aa, Dengue virus
RGPSLRTT

SEQ ID NO: 101573 - protein, 8 aa, Dengue virus
GPSLRTTT

SEQ ID NO: 101574 - protein, 8 aa, Dengue virus
PSLRTTTV

SEQ ID NO: 101575 - protein, 8 aa, Dengue virus
SLRTTTVT

SEQ ID NO: 101576 - protein, 8 aa, Dengue virus
LRTTTVTG

SEQ ID NO: 101577 - protein, 8 aa, Dengue virus
RTTTVTGK

SEQ ID NO: 101578 - protein, 8 aa, Dengue virus
TTTVTGKI

SEQ ID NO: 101579 - protein, 8 aa, Dengue virus
TTVTGKII

SEQ ID NO: 101580 - protein, 8 aa, Dengue virus
TVTGKIIH

SEQ ID NO: 101581 - protein, 8 aa, Dengue virus
VTGKIIHE

SEQ ID NO: 101582 - protein, 8 aa, Dengue virus
TGKIIHEW

SEQ ID NO: 101583 - protein, 8 aa, Dengue virus
GKIIHEWC

SEQ ID NO: 101584 - protein, 8 aa, Dengue virus
KIIHEWCC

SEQ ID NO: 101585 - protein, 8 aa, Dengue virus
IIHEWCCR

SEQ ID NO: 101586 - protein, 8 aa, Dengue virus
IHEWCCRS

SEQ ID NO: 101587 - protein, 8 aa, Dengue virus
HEWCCRSC

SEQ ID NO: 101588 - protein, 8 aa, Dengue virus
EWCCRSCT

SEQ ID NO: 101589 - protein, 8 aa, Dengue virus
WCCRSCTL

SEQ ID NO: 101590 - protein, 8 aa, Dengue virus
CCRSCTLP

SEQ ID NO: 101591 - protein, 8 aa, Dengue virus
CRSCTLPP

SEQ ID NO: 101592 - protein, 8 aa, Dengue virus
RSCTLPPL

SEQ ID NO: 101593 - protein, 8 aa, Dengue virus
SCTLPPLR

SEQ ID NO: 101594 - protein, 8 aa, Dengue virus
CTLPPLRY

SEQ ID NO: 101595 - protein, 8 aa, Dengue virus
TLPPLRYR

SEQ ID NO: 101596 - protein, 8 aa, Dengue virus
LPPLRYRG

SEQ ID NO: 101597 - protein, 8 aa, Dengue virus
PPLRYRGE

SEQ ID NO: 101598 - protein, 8 aa, Dengue virus
PLRYRGED

SEQ ID NO: 101599 - protein, 8 aa, Dengue virus
LRYRGEDG

SEQ ID NO: 101600 - protein, 8 aa, Dengue virus
RYRGEDGC

SEQ ID NO: 101601 - protein, 8 aa, Dengue virus
YRGEDGCW

SEQ ID NO: 101602 - protein, 8 aa, Dengue virus
RGEDGCWY

SEQ ID NO: 101603 - protein, 8 aa, Dengue virus
GEDGCWYG

SEQ ID NO: 101604 - protein, 8 aa, Dengue virus
EDGCWYGM

SEQ ID NO: 101605 - protein, 8 aa, Dengue virus
DGCWYGME

SEQ ID NO: 101606 - protein, 8 aa, Dengue virus
GCWYGMEI

SEQ ID NO: 101607 - protein, 8 aa, Dengue virus
CWYGMEIR

SEQ ID NO: 101608 - protein, 8 aa, Dengue virus
WYGMEIRP

SEQ ID NO: 101609 - protein, 8 aa, Dengue virus
YGMEIRPV

SEQ ID NO: 101610 - protein, 8 aa, Dengue virus
KEKEENLV

SEQ ID NO: 101611 - protein, 8 aa, Dengue virus
KEENLVKS

SEQ ID NO: 101612 - protein, 8 aa, Dengue virus
IEEVMRSR

SEQ ID NO: 101613 - protein, 8 aa, Dengue virus
EEVMRSRW

SEQ ID NO: 101614 - protein, 8 aa, Dengue virus
EVMRSRWS

SEQ ID NO: 101615 - protein, 8 aa, Dengue virus
MGMGTTYL

SEQ ID NO: 101616 - protein, 8 aa, Dengue virus
GMGVTYLA

SEQ ID NO: 101617 - protein, 8 aa, Dengue virus
MGVTYLAL

SEQ ID NO: 101618 - protein, 8 aa, Dengue virus
TYLALMAT

SEQ ID NO: 101619 - protein, 8 aa, Dengue virus
YLALMATF

SEQ ID NO: 101620 - protein, 8 aa, Dengue virus
LFRRLTSR

SEQ ID NO: 101621 - protein, 8 aa, Dengue virus
FRRLTSRE

SEQ ID NO: 101622 - protein, 8 aa, Dengue virus
RRLTSREV

SEQ ID NO: 101623 - protein, 8 aa, Dengue virus
RLTSREVL

SEQ ID NO: 101624 - protein, 8 aa, Dengue virus
LTSREVLL

SEQ ID NO: 101625 - protein, 8 aa, Dengue virus
TSREVLLL

SEQ ID NO: 101626 - protein, 8 aa, Dengue virus
SREVLLLT

SEQ ID NO: 101627 - protein, 8 aa, Dengue virus
EELGDGLA

SEQ ID NO: 101628 - protein, 8 aa, Dengue virus
ELGDGLAM

SEQ ID NO: 101629 - protein, 8 aa, Dengue virus
LGDGLAMG

SEQ ID NO: 101630 - protein, 8 aa, Dengue virus
GDGLAMGI

SEQ ID NO: 101631 - protein, 8 aa, Dengue virus
DGLAMGIM

SEQ ID NO: 101632 - protein, 8 aa, Dengue virus
RRSWPLNE

SEQ ID NO: 101633 - protein, 8 aa, Dengue virus
RSWPLNEG

SEQ ID NO: 101634 - protein, 8 aa, Dengue virus
SWPLNEGI

SEQ ID NO: 101635 - protein, 8 aa, Dengue virus
WPLNEGIM

SEQ ID NO: 101636 - protein, 8 aa, Dengue virus
PLNEGIMA

SEQ ID NO: 101637 - protein, 8 aa, Dengue virus
LNEGIMAV

SEQ ID NO: 101638 - protein, 8 aa, Dengue virus
NEGIMAVG

SEQ ID NO: 101639 - protein, 8 aa, Dengue virus
GIVSILLS

SEQ ID NO: 101640 - protein, 8 aa, Dengue virus
IVSILLSS

SEQ ID NO: 101641 - protein, 8 aa, Dengue virus
VSILASSL

SEQ ID NO: 101642 - protein, 8 aa, Dengue virus
SILASSLL

SEQ ID NO: 101643 - protein, 8 aa, Dengue virus
ILLSSLLK

SEQ ID NO: 101644 - protein, 8 aa, Dengue virus
LLSSLLKN

SEQ ID NO: 101645 - protein, 8 aa, Dengue virus
LSSLLKND

SEQ ID NO: 101646 - protein, 8 aa, Dengue virus
SSLLKNDV

SEQ ID NO: 101647 - protein, 8 aa, Dengue virus
SLLKNDVP

SEQ ID NO: 101648 - protein, 8 aa, Dengue virus
LLKNDVPL

SEQ ID NO: 101649 - protein, 8 aa, Dengue virus
LKNDVPLA

SEQ ID NO: 101650 - protein, 8 aa, Dengue virus
KNDVPLAG

SEQ ID NO: 101651 - protein, 8 aa, Dengue virus
NDVPLAGP

SEQ ID NO: 101652 - protein, 8 aa, Dengue virus
DVPLAGPL

SEQ ID NO: 101653 - protein, 8 aa, Dengue virus
VPLAGPLI

SEQ ID NO: 101654 - protein, 8 aa, Dengue virus
PLAGPLIA

SEQ ID NO: 101655 - protein, 8 aa, Dengue virus
LAGPLIAG

SEQ ID NO: 101656 - protein, 8 aa, Dengue virus
AGPLIAGG

SEQ ID NO: 101657 - protein, 8 aa, Dengue virus
GPLVAGGL

SEQ ID NO: 101658 - protein, 8 aa, Dengue virus
PLVAGGLL

SEQ ID NO: 101659 - protein, 8 aa, Dengue virus
LIAGGMLI

SEQ ID NO: 101660 - protein, 8 aa, Dengue virus
IAGGMLIA

SEQ ID NO: 101661 - protein, 8 aa, Dengue virus
AGGMLIAC

SEQ ID NO: 101662 - protein, 8 aa, Dengue virus
GGMLIACY

SEQ ID NO: 101663 - protein, 8 aa, Dengue virus
GMLIACYV

SEQ ID NO: 101664 - protein, 8 aa, Dengue virus
MLIACYVI

SEQ ID NO: 101665 - protein, 8 aa, Dengue virus
LIACYVIS

SEQ ID NO: 101666 - protein, 8 aa, Dengue virus
IACYVISG

SEQ ID NO: 101667 - protein, 8 aa, Dengue virus
ACYVISGS

SEQ ID NO: 101668 - protein, 8 aa, Dengue virus
CYVISGSS

SEQ ID NO: 101669 - protein, 8 aa, Dengue virus
YVISGSSA

SEQ ID NO: 101670 - protein, 8 aa, Dengue virus
VISGSSAD

SEQ ID NO: 101671 - protein, 8 aa, Dengue virus
ISGSSADL

SEQ ID NO: 101672 - protein, 8 aa, Dengue virus
SGSSADLS

SEQ ID NO: 101673 - protein, 8 aa, Dengue virus
GSSADLSL

SEQ ID NO: 101674 - protein, 8 aa, Dengue virus
SSADLSLE

SEQ ID NO: 101675 - protein, 8 aa, Dengue virus
SADLSLEK

SEQ ID NO: 101676 - protein, 8 aa, Dengue virus
ADLSLEKA

SEQ ID NO: 101677 - protein, 8 aa, Dengue virus
EAEHSGAS

SEQ ID NO: 101678 - protein, 8 aa, Dengue virus
AEHSGASH

SEQ ID NO: 101679 - protein, 8 aa, Dengue virus
EHSGASHN

SEQ ID NO: 101680 - protein, 8 aa, Dengue virus
HSGASHNI

SEQ ID NO: 101681 - protein, 8 aa, Dengue virus
SGASHNIL

SEQ ID NO: 101682 - protein, 8 aa, Dengue virus
QDDGTMKI

SEQ ID NO: 101683 - protein, 8 aa, Dengue virus
DDGTMKIK

SEQ ID NO: 101684 - protein, 8 aa, Dengue virus
DGTMKIKD

SEQ ID NO: 101685 - protein, 8 aa, Dengue virus
GTMKIKDE

SEQ ID NO: 101686 - protein, 8 aa, Dengue virus
TMKIKDEE

SEQ ID NO: 101687 - protein, 8 aa, Dengue virus
MKIKDEER

SEQ ID NO: 101688 - protein, 8 aa, Dengue virus
KIKDEERD

SEQ ID NO: 101689 - protein, 8 aa, Dengue virus
IKDEERDD

SEQ ID NO: 101690 - protein, 8 aa, Dengue virus
TLTILLKA

SEQ ID NO: 101691 - protein, 8 aa, Dengue virus
LTILLKAT

SEQ ID NO: 101692 - protein, 8 aa, Dengue virus
TILLKATL

SEQ ID NO: 101693 - protein, 8 aa, Dengue virus
ILLKATLL

SEQ ID NO: 101694 - protein, 8 aa, Dengue virus
LLKATLLA

SEQ ID NO: 101695 - protein, 8 aa, Dengue virus
LKATLLAV

SEQ ID NO: 101696 - protein, 8 aa, Dengue virus
KATLLAVS

SEQ ID NO: 101697 - protein, 8 aa, Dengue virus
ATLLAVSG

SEQ ID NO: 101698 - protein, 8 aa, Dengue virus
KKQRSGVL

SEQ ID NO: 101699 - protein, 8 aa, Dengue virus
KQRSGVLW

SEQ ID NO: 101700 - protein, 8 aa, Dengue virus
QRSGVLWD

SEQ ID NO: 101701 - protein, 8 aa, Dengue virus
RSGVLWDT

SEQ ID NO: 101702 - protein, 8 aa, Dengue virus
SGVLWDTP

SEQ ID NO: 101703 - protein, 8 aa, Dengue virus
GVLWDVPS

SEQ ID NO: 101704 - protein, 8 aa, Dengue virus
VLWDVPSP

SEQ ID NO: 101705 - protein, 8 aa, Dengue virus
LWDVPSPP

SEQ ID NO: 101706 - protein, 8 aa, Dengue virus
WDTPSPPE

SEQ ID NO: 101707 - protein, 8 aa, Dengue virus
AVLDDGIY

SEQ ID NO: 101708 - protein, 8 aa, Dengue virus
VLDDGIYR

SEQ ID NO: 101709 - protein, 8 aa, Dengue virus
LDDGIYRI

SEQ ID NO: 101710 - protein, 8 aa, Dengue virus
DDGIYRIM

SEQ ID NO: 101711 - protein, 8 aa, Dengue virus
DGIYRIMQ

SEQ ID NO: 101712 - protein, 8 aa, Dengue virus
YRIMQRGL

SEQ ID NO: 101713 - protein, 8 aa, Dengue virus
LGRSQVGV

SEQ ID NO: 101714 - protein, 8 aa, Dengue virus
GRSQVGVG

SEQ ID NO: 101715 - protein, 8 aa, Dengue virus
RSQVGVGV

SEQ ID NO: 101716 - protein, 8 aa, Dengue virus
SQVGVGVF

SEQ ID NO: 101717 - protein, 8 aa, Dengue virus
QVGVGVFQ

SEQ ID NO: 101718 - protein, 8 aa, Dengue virus
VGVGVFQE

SEQ ID NO: 101719 - protein, 8 aa, Dengue virus
ENVFHTMW

SEQ ID NO: 101720 - protein, 8 aa, Dengue virus
GVFHTMWH

SEQ ID NO: 101721 - protein, 8 aa, Dengue virus
VFHTMWHV

SEQ ID NO: 101722 - protein, 8 aa, Dengue virus
FHTMWHVT

SEQ ID NO: 101723 - protein, 8 aa, Dengue virus
HTMWHVTR

SEQ ID NO: 101724 - protein, 8 aa, Dengue virus
TMWHVTRG

SEQ ID NO: 101725 - protein, 8 aa, Dengue virus
MWHVTRGA

SEQ ID NO: 101726 - protein, 8 aa, Dengue virus
WHVTRGAV

SEQ ID NO: 101727 - protein, 8 aa, Dengue virus
HVTRGAVL

SEQ ID NO: 101728 - protein, 8 aa, Dengue virus
VTRGAVLM

SEQ ID NO: 101729 - protein, 8 aa, Dengue virus
TRGAVLMY

SEQ ID NO: 101730 - protein, 8 aa, Dengue virus
QGKRLEPS

SEQ ID NO: 101731 - protein, 8 aa, Dengue virus
GKRLEPSW

SEQ ID NO: 101732 - protein, 8 aa, Dengue virus
KRLEPSWA

SEQ ID NO: 101733 - protein, 8 aa, Dengue virus
RLEPSWAS

SEQ ID NO: 101734 - protein, 8 aa, Dengue virus
LEPSWASV

SEQ ID NO: 101735 - protein, 8 aa, Dengue virus
EPSWASVK

SEQ ID NO: 101736 - protein, 8 aa, Dengue virus
PSWASVKK

SEQ ID NO: 101737 - protein, 8 aa, Dengue virus
SWASVKKD

SEQ ID NO: 101738 - protein, 8 aa, Dengue virus
WASVKKDL

SEQ ID NO: 101739 - protein, 8 aa, Dengue virus
ASVKKDLI

SEQ ID NO: 101740 - protein, 8 aa, Dengue virus
SVKKDLIS

SEQ ID NO: 101741 - protein, 8 aa, Dengue virus
VKKDLISY

SEQ ID NO: 101742 - protein, 8 aa, Dengue virus
KKDLISYG

SEQ ID NO: 101743 - protein, 8 aa, Dengue virus
KDLISYGG

SEQ ID NO: 101744 - protein, 8 aa, Dengue virus
DLISYGGG

SEQ ID NO: 101745 - protein, 8 aa, Dengue virus
LISYGGGW

SEQ ID NO: 101746 - protein, 8 aa, Dengue virus
ISYGGGWR

SEQ ID NO: 101747 - protein, 8 aa, Dengue virus
SYGGGWRL

SEQ ID NO: 101748 - protein, 8 aa, Dengue virus
WNTGEEVQ

SEQ ID NO: 101749 - protein, 8 aa, Dengue virus
NTGEEVQV

SEQ ID NO: 101750 - protein, 8 aa, Dengue virus
TGEEVQVI

SEQ ID NO: 101751 - protein, 8 aa, Dengue virus
GEEVQVIA

SEQ ID NO: 101752 - protein, 8 aa, Dengue virus
EEVQVIAV

SEQ ID NO: 101753 - protein, 8 aa, Dengue virus
EVQVIAVE

SEQ ID NO: 101754 - protein, 8 aa, Dengue virus
VQVIAVEP

SEQ ID NO: 101755 - protein, 8 aa, Dengue virus
QVIAVEPG

SEQ ID NO: 101756 - protein, 8 aa, Dengue virus
VIAVEPGK

SEQ ID NO: 101757 - protein, 8 aa, Dengue virus
IAVEPGKN

SEQ ID NO: 101758 - protein, 8 aa, Dengue virus
AVEPGKNP

SEQ ID NO: 101759 - protein, 8 aa, Dengue virus
VEPGKNPK

SEQ ID NO: 101760 - protein, 8 aa, Dengue virus
EPGKNPKN

SEQ ID NO: 101761 - protein, 8 aa, Dengue virus
PGKNPKNV

SEQ ID NO: 101762 - protein, 8 aa, Dengue virus
GKNPKNVQ

SEQ ID NO: 101763 - protein, 8 aa, Dengue virus
KNPKNVQT

SEQ ID NO: 101764 - protein, 8 aa, Dengue virus
EGEVGAIA

SEQ ID NO: 101765 - protein, 8 aa, Dengue virus
GEVGAIAL

SEQ ID NO: 101766 - protein, 8 aa, Dengue virus
EVGAIALD

SEQ ID NO: 101767 - protein, 8 aa, Dengue virus
VGAIALDF

SEQ ID NO: 101768 - protein, 8 aa, Dengue virus
GAIALDFK

SEQ ID NO: 101769 - protein, 8 aa, Dengue virus
AIALDFKP

SEQ ID NO: 101770 - protein, 8 aa, Dengue virus
IALDFKPG

SEQ ID NO: 101771 - protein, 8 aa, Dengue virus
ALDFKPGT

SEQ ID NO: 101772 - protein, 8 aa, Dengue virus
LDFKPGTS

SEQ ID NO: 101773 - protein, 8 aa, Dengue virus
DFKPGTSG

SEQ ID NO: 101774 - protein, 8 aa, Dengue virus
FKPGTSGS

SEQ ID NO: 101775 - protein, 8 aa, Dengue virus
KPGTSGSP

SEQ ID NO: 101776 - protein, 8 aa, Dengue virus
PGTSGSPI

SEQ ID NO: 101777 - protein, 8 aa, Dengue virus
GTSGSPIV

SEQ ID NO: 101778 - protein, 8 aa, Dengue virus
TSGSPIVN

SEQ ID NO: 101779 - protein, 8 aa, Dengue virus
SGSPIVNR

SEQ ID NO: 101780 - protein, 8 aa, Dengue virus
EGKIVGLY

SEQ ID NO: 101781 - protein, 8 aa, Dengue virus
GKVVGLYG

SEQ ID NO: 101782 - protein, 8 aa, Dengue virus
KVVGLYGN

SEQ ID NO: 101783 - protein, 8 aa, Dengue virus
VVGLYGNG

SEQ ID NO: 101784 - protein, 8 aa, Dengue virus
VGLYGNGV

SEQ ID NO: 101785 - protein, 8 aa, Dengue virus
GLYGNGVV

SEQ ID NO: 101786 - protein, 8 aa, Dengue virus
LYGNGVVT

SEQ ID NO: 101787 - protein, 8 aa, Dengue virus
YGNGVVTT

SEQ ID NO: 101788 - protein, 8 aa, Dengue virus
GNGVVTTS

SEQ ID NO: 101789 - protein, 8 aa, Dengue virus
NGVVTTSG

SEQ ID NO: 101790 - protein, 8 aa, Dengue virus
GVVTTSGT

SEQ ID NO: 101791 - protein, 8 aa, Dengue virus
VVTTSGTY

SEQ ID NO: 101792 - protein, 8 aa, Dengue virus
VTTSGTYV

SEQ ID NO: 101793 - protein, 8 aa, Dengue virus
TTSGTYVS

SEQ ID NO: 101794 - protein, 8 aa, Dengue virus
SGTYVSAI

SEQ ID NO: 101795 - protein, 8 aa, Dengue virus
GTYVSAIA

SEQ ID NO: 101796 - protein, 8 aa, Dengue virus
TYVSAIAQ

SEQ ID NO: 101797 - protein, 8 aa, Dengue virus
YVSAIAQA

SEQ ID NO: 101798 - protein, 8 aa, Dengue virus
VFRKRNLT

SEQ ID NO: 101799 - protein, 8 aa, Dengue virus
FRKRNLTI

SEQ ID NO: 101800 - protein, 8 aa, Dengue virus
RKRNLTIM

SEQ ID NO: 101801 - protein, 8 aa, Dengue virus
KRNLTIMD

SEQ ID NO: 101802 - protein, 8 aa, Dengue virus
RNLTIMDL

SEQ ID NO: 101803 - protein, 8 aa, Dengue virus
NLTIMDLH

SEQ ID NO: 101804 - protein, 8 aa, Dengue virus
LTIMDLHP

SEQ ID NO: 101805 - protein, 8 aa, Dengue virus
TIMDLHPG

SEQ ID NO: 101806 - protein, 8 aa, Dengue virus
IMDLHPGS

SEQ ID NO: 101807 - protein, 8 aa, Dengue virus
MDLHPGSG

SEQ ID NO: 101808 - protein, 8 aa, Dengue virus
DLHPGSGK

SEQ ID NO: 101809 - protein, 8 aa, Dengue virus
LHPGSGKT

SEQ ID NO: 101810 - protein, 8 aa, Dengue virus
HPGSGKTR

SEQ ID NO: 101811 - protein, 8 aa, Dengue virus
PGSGKTRR

SEQ ID NO: 101812 - protein, 8 aa, Dengue virus
GSGKTRRY

SEQ ID NO: 101813 - protein, 8 aa, Dengue virus
SGKTRRYL

SEQ ID NO: 101814 - protein, 8 aa, Dengue virus
GKTRRYLP

SEQ ID NO: 101815 - protein, 8 aa, Dengue virus
KTRRYLPA

SEQ ID NO: 101816 - protein, 8 aa, Dengue virus
TRRYLPAI

SEQ ID NO: 101817 - protein, 8 aa, Dengue virus
RYLPAIVR

SEQ ID NO: 101818 - protein, 8 aa, Dengue virus
YLPAIVRE

SEQ ID NO: 101819 - protein, 8 aa, Dengue virus
LPAIVREA

SEQ ID NO: 101820 - protein, 8 aa, Dengue virus
PAIVREAI

SEQ ID NO: 101821 - protein, 8 aa, Dengue virus
AIVREAIK

SEQ ID NO: 101822 - protein, 8 aa, Dengue virus
IVREAIKR

SEQ ID NO: 101823 - protein, 8 aa, Dengue virus
REAIKRKL

SEQ ID NO: 101824 - protein, 8 aa, Dengue virus
EAIKRKLR

SEQ ID NO: 101825 - protein, 8 aa, Dengue virus
AIKRKLRT

SEQ ID NO: 101826 - protein, 8 aa, Dengue virus
IKRKLRTL

SEQ ID NO: 101827 - protein, 8 aa, Dengue virus
KRKLRTLI

SEQ ID NO: 101828 - protein, 8 aa, Dengue virus
RKLRTLIL

SEQ ID NO: 101829 - protein, 8 aa, Dengue virus
KLRTLILA

SEQ ID NO: 101830 - protein, 8 aa, Dengue virus
LRTLILAP

SEQ ID NO: 101831 - protein, 8 aa, Dengue virus
RTLILAPT

SEQ ID NO: 101832 - protein, 8 aa, Dengue virus
TLILAPTR

SEQ ID NO: 101833 - protein, 8 aa, Dengue virus
LILAPTRV

SEQ ID NO: 101834 - protein, 8 aa, Dengue virus
ILAPTRVV

SEQ ID NO: 101835 - protein, 8 aa, Dengue virus
LAPTRVVA

SEQ ID NO: 101836 - protein, 8 aa, Dengue virus
APTRVVAA

SEQ ID NO: 101837 - protein, 8 aa, Dengue virus
PTRVVAAE

SEQ ID NO: 101838 - protein, 8 aa, Dengue virus
TRVVAAEM

SEQ ID NO: 101839 - protein, 8 aa, Dengue virus
RVVAAEME

SEQ ID NO: 101840 - protein, 8 aa, Dengue virus
VVAAEMEE

SEQ ID NO: 101841 - protein, 8 aa, Dengue virus
VAAEMEEA

SEQ ID NO: 101842 - protein, 8 aa, Dengue virus
AAEMEEAL

SEQ ID NO: 101843 - protein, 8 aa, Dengue virus
SEMAEALK

SEQ ID NO: 101844 - protein, 8 aa, Dengue virus
EMAEALKG

SEQ ID NO: 101845 - protein, 8 aa, Dengue virus
MAEALKGM

SEQ ID NO: 101846 - protein, 8 aa, Dengue virus
AEALKGMP

SEQ ID NO: 101847 - protein, 8 aa, Dengue virus
EALKGMPI

SEQ ID NO: 101848 - protein, 8 aa, Dengue virus
ALKGMPIR

SEQ ID NO: 101849 - protein, 8 aa, Dengue virus
LKGMPIRY

SEQ ID NO: 101850 - protein, 8 aa, Dengue virus
KGMPIRYQ

SEQ ID NO: 101851 - protein, 8 aa, Dengue virus
GLPIRYQT

SEQ ID NO: 101852 - protein, 8 aa, Dengue virus
MPIRYQTT

SEQ ID NO: 101853 - protein, 8 aa, Dengue virus
PIRYQTTA

SEQ ID NO: 101854 - protein, 8 aa, Dengue virus
IRYQTTAV

SEQ ID NO: 101855 - protein, 8 aa, Dengue virus
KSEHTGKE

SEQ ID NO: 101856 - protein, 8 aa, Dengue virus
SEHTGKEI

SEQ ID NO: 101857 - protein, 8 aa, Dengue virus
EHTGREIV

SEQ ID NO: 101858 - protein, 8 aa, Dengue virus
HTGREIVD

SEQ ID NO: 101859 - protein, 8 aa, Dengue virus
TGREIVDL

SEQ ID NO: 101860 - protein, 8 aa, Dengue virus
GREIVDLM

SEQ ID NO: 101861 - protein, 8 aa, Dengue virus
REIVDLMC

SEQ ID NO: 101862 - protein, 8 aa, Dengue virus
EIVDLMCH

SEQ ID NO: 101863 - protein, 8 aa, Dengue virus
IVDLMCHA

SEQ ID NO: 101864 - protein, 8 aa, Dengue virus
VDLMCHAT

SEQ ID NO: 101865 - protein, 8 aa, Dengue virus
DLMCHATF

SEQ ID NO: 101866 - protein, 8 aa, Dengue virus
LMCHATFT

SEQ ID NO: 101867 - protein, 8 aa, Dengue virus
MCHATFTM

SEQ ID NO: 101868 - protein, 8 aa, Dengue virus
CHATFTMR

SEQ ID NO: 101869 - protein, 8 aa, Dengue virus
HATFTMRL

SEQ ID NO: 101870 - protein, 8 aa, Dengue virus
ATFTMRLL

SEQ ID NO: 101871 - protein, 8 aa, Dengue virus
TFTMRLLS

SEQ ID NO: 101872 - protein, 8 aa, Dengue virus
FTMRLLSP

SEQ ID NO: 101873 - protein, 8 aa, Dengue virus
TMRLLSPV

SEQ ID NO: 101874 - protein, 8 aa, Dengue virus
MRLLSPVR

SEQ ID NO: 101875 - protein, 8 aa, Dengue virus
RLLSPVRV

SEQ ID NO: 101876 - protein, 8 aa, Dengue virus
LLSPVRVP

SEQ ID NO: 101877 - protein, 8 aa, Dengue virus
LSPVRVPN

SEQ ID NO: 101878 - protein, 8 aa, Dengue virus
SPVRVPNY

SEQ ID NO: 101879 - protein, 8 aa, Dengue virus
PVRVPNYN

SEQ ID NO: 101880 - protein, 8 aa, Dengue virus
VRVPNYNL

SEQ ID NO: 101881 - protein, 8 aa, Dengue virus
RVPNYNLI

SEQ ID NO: 101882 - protein, 8 aa, Dengue virus
VPNYNLII

SEQ ID NO: 101883 - protein, 8 aa, Dengue virus
PNYNLIIM

SEQ ID NO: 101884 - protein, 8 aa, Dengue virus
NYNLIIMD

SEQ ID NO: 101885 - protein, 8 aa, Dengue virus
YNLIIMDE

SEQ ID NO: 101886 - protein, 8 aa, Dengue virus
NLIIMDEA

SEQ ID NO: 101887 - protein, 8 aa, Dengue virus
LIIMDEAH

SEQ ID NO: 101888 - protein, 8 aa, Dengue virus
IIMDEAHF

SEQ ID NO: 101889 - protein, 8 aa, Dengue virus
IMDEAHFT

SEQ ID NO: 101890 - protein, 8 aa, Dengue virus
MDEAHFTD

SEQ ID NO: 101891 - protein, 8 aa, Dengue virus
DEAHFTDP

SEQ ID NO: 101892 - protein, 8 aa, Dengue virus
EAHFTDPA

SEQ ID NO: 101893 - protein, 8 aa, Dengue virus
AHFTDPAS

SEQ ID NO: 101894 - protein, 8 aa, Dengue virus
HFTDPASI

SEQ ID NO: 101895 - protein, 8 aa, Dengue virus
FTDPASIA

SEQ ID NO: 101896 - protein, 8 aa, Dengue virus
TDPASIAA

SEQ ID NO: 101897 - protein, 8 aa, Dengue virus
DPASIAAR

SEQ ID NO: 101898 - protein, 8 aa, Dengue virus
PASIAARG

SEQ ID NO: 101899 - protein, 8 aa, Dengue virus
ASIAARGY

SEQ ID NO: 101900 - protein, 8 aa, Dengue virus
SIAARGYI

SEQ ID NO: 101901 - protein, 8 aa, Dengue virus
IAARGYIS

SEQ ID NO: 101902 - protein, 8 aa, Dengue virus
AARGYIST

SEQ ID NO: 101903 - protein, 8 aa, Dengue virus
ARGYISTR

SEQ ID NO: 101904 - protein, 8 aa, Dengue virus
RGYISTRV

SEQ ID NO: 101905 - protein, 8 aa, Dengue virus
GYISTRVG

SEQ ID NO: 101906 - protein, 8 aa, Dengue virus
YISTRVGM

SEQ ID NO: 101907 - protein, 8 aa, Dengue virus
ISTRVGMG

SEQ ID NO: 101908 - protein, 8 aa, Dengue virus
STRVGMGE

SEQ ID NO: 101909 - protein, 8 aa, Dengue virus
TRVGMGEA

SEQ ID NO: 101910 - protein, 8 aa, Dengue virus
RVGMGEAA

SEQ ID NO: 101911 - protein, 8 aa, Dengue virus
VGMGEAAA

SEQ ID NO: 101912 - protein, 8 aa, Dengue virus
GMGEAAAI

SEQ ID NO: 101913 - protein, 8 aa, Dengue virus
MGEAAAIF

SEQ ID NO: 101914 - protein, 8 aa, Dengue virus
GEAAAIFM

SEQ ID NO: 101915 - protein, 8 aa, Dengue virus
EAAAIFMT

SEQ ID NO: 101916 - protein, 8 aa, Dengue virus
AAAIFMTA

SEQ ID NO: 101917 - protein, 8 aa, Dengue virus
AAIFMTAT

SEQ ID NO: 101918 - protein, 8 aa, Dengue virus
AIFMTATP

SEQ ID NO: 101919 - protein, 8 aa, Dengue virus
IFMTATPP

SEQ ID NO: 101920 - protein, 8 aa, Dengue virus
FMTATPPG

SEQ ID NO: 101921 - protein, 8 aa, Dengue virus
MTATPPGS

SEQ ID NO: 101922 - protein, 8 aa, Dengue virus
EAFPQSNA

SEQ ID NO: 101923 - protein, 8 aa, Dengue virus
AFPQSNAV

SEQ ID NO: 101924 - protein, 8 aa, Dengue virus
FPQSNAPI

SEQ ID NO: 101925 - protein, 8 aa, Dengue virus
IQDEERDI

SEQ ID NO: 101926 - protein, 8 aa, Dengue virus
QDEERDIP

SEQ ID NO: 101927 - protein, 8 aa, Dengue virus
DEERDIPE

SEQ ID NO: 101928 - protein, 8 aa, Dengue virus
EERDIPER

SEQ ID NO: 101929 - protein, 8 aa, Dengue virus
ERDIPERS

SEQ ID NO: 101930 - protein, 8 aa, Dengue virus
RDIPERSW

SEQ ID NO: 101931 - protein, 8 aa, Dengue virus
DIPERSWN

SEQ ID NO: 101932 - protein, 8 aa, Dengue virus
IPERSWNS

SEQ ID NO: 101933 - protein, 8 aa, Dengue virus
PERSWNSG

SEQ ID NO: 101934 - protein, 8 aa, Dengue virus
ERSWNSGY

SEQ ID NO: 101935 - protein, 8 aa, Dengue virus
FPGKTVWF

SEQ ID NO: 101936 - protein, 8 aa, Dengue virus
PGKTVWFV

SEQ ID NO: 101937 - protein, 8 aa, Dengue virus
GKTVWFVP

SEQ ID NO: 101938 - protein, 8 aa, Dengue virus
KTVWFVPS

SEQ ID NO: 101939 - protein, 8 aa, Dengue virus
TVWFVPSI

SEQ ID NO: 101940 - protein, 8 aa, Dengue virus
VWFVPSIK

SEQ ID NO: 101941 - protein, 8 aa, Dengue virus
WFVPSIKA

SEQ ID NO: 101942 - protein, 8 aa, Dengue virus
FVPSIKAG

SEQ ID NO: 101943 - protein, 8 aa, Dengue virus
VPSIKAGN

SEQ ID NO: 101944 - protein, 8 aa, Dengue virus
PSIKAGND

SEQ ID NO: 101945 - protein, 8 aa, Dengue virus
SIKAGNDI

SEQ ID NO: 101946 - protein, 8 aa, Dengue virus
IKAGNDIA

SEQ ID NO: 101947 - protein, 8 aa, Dengue virus
KSGNDIAN

SEQ ID NO: 101948 - protein, 8 aa, Dengue virus
SGNDIANC

SEQ ID NO: 101949 - protein, 8 aa, Dengue virus
GNDIANCL

SEQ ID NO: 101950 - protein, 8 aa, Dengue virus
NDIANCLR

SEQ ID NO: 101951 - protein, 8 aa, Dengue virus
DIANCLRK

SEQ ID NO: 101952 - protein, 8 aa, Dengue virus
IANCLRKN

SEQ ID NO: 101953 - protein, 8 aa, Dengue virus
ANCLRKNG

SEQ ID NO: 101954 - protein, 8 aa, Dengue virus
NCLRKNGK

SEQ ID NO: 101955 - protein, 8 aa, Dengue virus
CLRKNGKK

SEQ ID NO: 101956 - protein, 8 aa, Dengue virus
LRKNGKKV

SEQ ID NO: 101957 - protein, 8 aa, Dengue virus
RKNGKKVI

SEQ ID NO: 101958 - protein, 8 aa, Dengue virus
KNGKKVIQ

SEQ ID NO: 101959 - protein, 8 aa, Dengue virus
NGKKVIQL

SEQ ID NO: 101960 - protein, 8 aa, Dengue virus
GKKVIQLS

SEQ ID NO: 101961 - protein, 8 aa, Dengue virus
KKVIQLSR

SEQ ID NO: 101962 - protein, 8 aa, Dengue virus
KVIQLSRK

SEQ ID NO: 101963 - protein, 8 aa, Dengue virus
VIQLSRKT

SEQ ID NO: 101964 - protein, 8 aa, Dengue virus
IQLSRKTF

SEQ ID NO: 101965 - protein, 8 aa, Dengue virus
QLSRKTFD

SEQ ID NO: 101966 - protein, 8 aa, Dengue virus
LSRKTFDT

SEQ ID NO: 101967 - protein, 8 aa, Dengue virus
SRKTFDTE

SEQ ID NO: 101968 - protein, 8 aa, Dengue virus
RKTFDTEY

SEQ ID NO: 101969 - protein, 8 aa, Dengue virus
KTFDTEYQ

SEQ ID NO: 101970 - protein, 8 aa, Dengue virus
TFDTEYQK

SEQ ID NO: 101971 - protein, 8 aa, Dengue virus
FDTEYQKT

SEQ ID NO: 101972 - protein, 8 aa, Dengue virus
NNDWDYVV

SEQ ID NO: 101973 - protein, 8 aa, Dengue virus
NDWDFVVT

SEQ ID NO: 101974 - protein, 8 aa, Dengue virus
DWDFVVTT

SEQ ID NO: 101975 - protein, 8 aa, Dengue virus
WDFVVTTD

SEQ ID NO: 101976 - protein, 8 aa, Dengue virus
DFVVTTDI

SEQ ID NO: 101977 - protein, 8 aa, Dengue virus
FVVTTDIS

SEQ ID NO: 101978 - protein, 8 aa, Dengue virus
VVTTDISE

SEQ ID NO: 101979 - protein, 8 aa, Dengue virus
VTTDISEM

SEQ ID NO: 101980 - protein, 8 aa, Dengue virus
TTDISEMG

SEQ ID NO: 101981 - protein, 8 aa, Dengue virus
TDISEMGA

SEQ ID NO: 101982 - protein, 8 aa, Dengue virus
DISEMGAN

SEQ ID NO: 101983 - protein, 8 aa, Dengue virus
ISEMGANF

SEQ ID NO: 101984 - protein, 8 aa, Dengue virus
SEMGANFR

SEQ ID NO: 101985 - protein, 8 aa, Dengue virus
EMGANFRA

SEQ ID NO: 101986 - protein, 8 aa, Dengue virus
MGANFRAD

SEQ ID NO: 101987 - protein, 8 aa, Dengue virus
GANFRADR

SEQ ID NO: 101988 - protein, 8 aa, Dengue virus
ANFRADRV

SEQ ID NO: 101989 - protein, 8 aa, Dengue virus
NFRADRVI

SEQ ID NO: 101990 - protein, 8 aa, Dengue virus
FRADRVID

SEQ ID NO: 101991 - protein, 8 aa, Dengue virus
RADRVIDP

SEQ ID NO: 101992 - protein, 8 aa, Dengue virus
ADRVIDPR

SEQ ID NO: 101993 - protein, 8 aa, Dengue virus
DRVIDPRR

SEQ ID NO: 101994 - protein, 8 aa, Dengue virus
RVIDPRRC

SEQ ID NO: 101995 - protein, 8 aa, Dengue virus
VIDPRRCL

SEQ ID NO: 101996 - protein, 8 aa, Dengue virus
IDPRRCLK

SEQ ID NO: 101997 - protein, 8 aa, Dengue virus
DPRRCLKP

SEQ ID NO: 101998 - protein, 8 aa, Dengue virus
PRRCLKPV

SEQ ID NO: 101999 - protein, 8 aa, Dengue virus
RRCLKPVI

SEQ ID NO: 102000 - protein, 8 aa, Dengue virus
RCLKPVIL

SEQ ID NO: 102001 - protein, 8 aa, Dengue virus
CLKPVILK

SEQ ID NO: 102002 - protein, 8 aa, Dengue virus
LKPVILKD

SEQ ID NO: 102003 - protein, 8 aa, Dengue virus
KPVILTDG

SEQ ID NO: 102004 - protein, 8 aa, Dengue virus
PVILKDGP

SEQ ID NO: 102005 - protein, 8 aa, Dengue virus
VILKDGPE

SEQ ID NO: 102006 - protein, 8 aa, Dengue virus
ILKDGPER

SEQ ID NO: 102007 - protein, 8 aa, Dengue virus
LKDGPERV

SEQ ID NO: 102008 - protein, 8 aa, Dengue virus
KDGPERVI

SEQ ID NO: 102009 - protein, 8 aa, Dengue virus
DGPERVIL

SEQ ID NO: 102010 - protein, 8 aa, Dengue virus
GPERVILA

SEQ ID NO: 102011 - protein, 8 aa, Dengue virus
PERVILAG

SEQ ID NO: 102012 - protein, 8 aa, Dengue virus
ERVILAGP

SEQ ID NO: 102013 - protein, 8 aa, Dengue virus
RVILAGPM

SEQ ID NO: 102014 - protein, 8 aa, Dengue virus
VILAGPMP

SEQ ID NO: 102015 - protein, 8 aa, Dengue virus
ILAGPMPV

SEQ ID NO: 102016 - protein, 8 aa, Dengue virus
LAGPMPVT

SEQ ID NO: 102017 - protein, 8 aa, Dengue virus
AGPMPVTV

SEQ ID NO: 102018 - protein, 8 aa, Dengue virus
GPMPVTVA

SEQ ID NO: 102019 - protein, 8 aa, Dengue virus
PMPVTVAS

SEQ ID NO: 102020 - protein, 8 aa, Dengue virus
MPVTVASA

SEQ ID NO: 102021 - protein, 8 aa, Dengue virus
PVTVASAA

SEQ ID NO: 102022 - protein, 8 aa, Dengue virus
VTVASAAQ

SEQ ID NO: 102023 - protein, 8 aa, Dengue virus
TVASAAQR

SEQ ID NO: 102024 - protein, 8 aa, Dengue virus
VASAAQRR

SEQ ID NO: 102025 - protein, 8 aa, Dengue virus
ASAAQRRG

SEQ ID NO: 102026 - protein, 8 aa, Dengue virus
SAAQRRGR

SEQ ID NO: 102027 - protein, 8 aa, Dengue virus
AAQRRGRI

SEQ ID NO: 102028 - protein, 8 aa, Dengue virus
AQRRGRIG

SEQ ID NO: 102029 - protein, 8 aa, Dengue virus
QRRGRIGR

SEQ ID NO: 102030 - protein, 8 aa, Dengue virus
RRGRIGRN

SEQ ID NO: 102031 - protein, 8 aa, Dengue virus
RGRIGRNP

SEQ ID NO: 102032 - protein, 8 aa, Dengue virus
KEGDQYIY

SEQ ID NO: 102033 - protein, 8 aa, Dengue virus
EGDQYIYM

SEQ ID NO: 102034 - protein, 8 aa, Dengue virus
GDQYIYMG

SEQ ID NO: 102035 - protein, 8 aa, Dengue virus
DQYIYMGQ

SEQ ID NO: 102036 - protein, 8 aa, Dengue virus
QYIYMGQP

SEQ ID NO: 102037 - protein, 8 aa, Dengue virus
YIYMGQPL

SEQ ID NO: 102038 - protein, 8 aa, Dengue virus
YMGQPLNN

SEQ ID NO: 102039 - protein, 8 aa, Dengue virus
MGQPLNND

SEQ ID NO: 102040 - protein, 8 aa, Dengue virus
GQPLNNDE

SEQ ID NO: 102041 - protein, 8 aa, Dengue virus
QPLNNDED

SEQ ID NO: 102042 - protein, 8 aa, Dengue virus
PLNNDEDH

SEQ ID NO: 102043 - protein, 8 aa, Dengue virus
LNNDEDHA

SEQ ID NO: 102044 - protein, 8 aa, Dengue virus
NNDEDHAH

SEQ ID NO: 102045 - protein, 8 aa, Dengue virus
NDEDHAHW

SEQ ID NO: 102046 - protein, 8 aa, Dengue virus
DEDHAHWT

SEQ ID NO: 102047 - protein, 8 aa, Dengue virus
EDHAHWTE

SEQ ID NO: 102048 - protein, 8 aa, Dengue virus
DHAHWTEA

SEQ ID NO: 102049 - protein, 8 aa, Dengue virus
HAHWTEAK

SEQ ID NO: 102050 - protein, 8 aa, Dengue virus
AHWTEAKM

SEQ ID NO: 102051 - protein, 8 aa, Dengue virus
HWTEAKML

SEQ ID NO: 102052 - protein, 8 aa, Dengue virus
WTEAKMLL

SEQ ID NO: 102053 - protein, 8 aa, Dengue virus
TEAKMLLD

SEQ ID NO: 102054 - protein, 8 aa, Dengue virus
EAKMLLDN

SEQ ID NO: 102055 - protein, 8 aa, Dengue virus
AKMLLDNI

SEQ ID NO: 102056 - protein, 8 aa, Dengue virus
KMLLDNIN

SEQ ID NO: 102057 - protein, 8 aa, Dengue virus
MLLDNINT

SEQ ID NO: 102058 - protein, 8 aa, Dengue virus
LLDNINTP

SEQ ID NO: 102059 - protein, 8 aa, Dengue virus
LDNINTPE

SEQ ID NO: 102060 - protein, 8 aa, Dengue virus
DNINTPEG

SEQ ID NO: 102061 - protein, 8 aa, Dengue virus
NINTPEGI

SEQ ID NO: 102062 - protein, 8 aa, Dengue virus
INTPEGII

SEQ ID NO: 102063 - protein, 8 aa, Dengue virus
NTPEGIIP

SEQ ID NO: 102064 - protein, 8 aa, Dengue virus
TPEGIIPA

SEQ ID NO: 102065 - protein, 8 aa, Dengue virus
PEGIIPAL

SEQ ID NO: 102066 - protein, 8 aa, Dengue virus
EGIIPALF

SEQ ID NO: 102067 - protein, 8 aa, Dengue virus
GIIPALFE

SEQ ID NO: 102068 - protein, 8 aa, Dengue virus
IIPALFEP

SEQ ID NO: 102069 - protein, 8 aa, Dengue virus
IPALFEPE

SEQ ID NO: 102070 - protein, 8 aa, Dengue virus
PALFEPER

SEQ ID NO: 102071 - protein, 8 aa, Dengue virus
ALFEPERE

SEQ ID NO: 102072 - protein, 8 aa, Dengue virus
LFEPEREK

SEQ ID NO: 102073 - protein, 8 aa, Dengue virus
FEPEREKS

SEQ ID NO: 102074 - protein, 8 aa, Dengue virus
EPEREKSA

SEQ ID NO: 102075 - protein, 8 aa, Dengue virus
PEREKSAA

SEQ ID NO: 102076 - protein, 8 aa, Dengue virus
EREKSAAI

SEQ ID NO: 102077 - protein, 8 aa, Dengue virus
REKSAAID

SEQ ID NO: 102078 - protein, 8 aa, Dengue virus
EKSAAIDG

SEQ ID NO: 102079 - protein, 8 aa, Dengue virus
KSAAIDGE

SEQ ID NO: 102080 - protein, 8 aa, Dengue virus
SAAIDGEY

SEQ ID NO: 102081 - protein, 8 aa, Dengue virus
AAIDGEYR

SEQ ID NO: 102082 - protein, 8 aa, Dengue virus
AIDGEYRL

SEQ ID NO: 102083 - protein, 8 aa, Dengue virus
IDGEYRLR

SEQ ID NO: 102084 - protein, 8 aa, Dengue virus
DGEYRLRG

SEQ ID NO: 102085 - protein, 8 aa, Dengue virus
GEYRLRGE

SEQ ID NO: 102086 - protein, 8 aa, Dengue virus
EYRLRGEA

SEQ ID NO: 102087 - protein, 8 aa, Dengue virus
YRLRGEAR

SEQ ID NO: 102088 - protein, 8 aa, Dengue virus
RLRGEARK

SEQ ID NO: 102089 - protein, 8 aa, Dengue virus
LRGEARKT

SEQ ID NO: 102090 - protein, 8 aa, Dengue virus
RGEARKTF

SEQ ID NO: 102091 - protein, 8 aa, Dengue virus
GEARKTFV

SEQ ID NO: 102092 - protein, 8 aa, Dengue virus
EARKTFVE

SEQ ID NO: 102093 - protein, 8 aa, Dengue virus
ARKTFVEL

SEQ ID NO: 102094 - protein, 8 aa, Dengue virus
RKTFVELM

SEQ ID NO: 102095 - protein, 8 aa, Dengue virus
KTFVELMR

SEQ ID NO: 102096 - protein, 8 aa, Dengue virus
TFVELMRR

SEQ ID NO: 102097 - protein, 8 aa, Dengue virus
FVELMRRG

SEQ ID NO: 102098 - protein, 8 aa, Dengue virus
VELMRRGD

SEQ ID NO: 102099 - protein, 8 aa, Dengue virus
ELMRRGDL

SEQ ID NO: 102100 - protein, 8 aa, Dengue virus
LMRRGDLP

SEQ ID NO: 102101 - protein, 8 aa, Dengue virus
MRRGDLPV

SEQ ID NO: 102102 - protein, 8 aa, Dengue virus
RRGDLPVW

SEQ ID NO: 102103 - protein, 8 aa, Dengue virus
RGDLPVWL

SEQ ID NO: 102104 - protein, 8 aa, Dengue virus
GDLPVWLA

SEQ ID NO: 102105 - protein, 8 aa, Dengue virus
DLPVWLSY

SEQ ID NO: 102106 - protein, 8 aa, Dengue virus
LPVWLSYK

SEQ ID NO: 102107 - protein, 8 aa, Dengue virus
PVWLSYKV

SEQ ID NO: 102108 - protein, 8 aa, Dengue virus
VWLSYKVA

SEQ ID NO: 102109 - protein, 8 aa, Dengue virus
WLSYKVAS

SEQ ID NO: 102110 - protein, 8 aa, Dengue virus
VASEGFQY

SEQ ID NO: 102111 - protein, 8 aa, Dengue virus
EGFQYSDR

SEQ ID NO: 102112 - protein, 8 aa, Dengue virus
YSDRRWCF

SEQ ID NO: 102113 - protein, 8 aa, Dengue virus
SDRRWCFD

SEQ ID NO: 102114 - protein, 8 aa, Dengue virus
DRRWCFDG

SEQ ID NO: 102115 - protein, 8 aa, Dengue virus
RNNQVLEE

SEQ ID NO: 102116 - protein, 8 aa, Dengue virus
NNQILEEN

SEQ ID NO: 102117 - protein, 8 aa, Dengue virus
NQVLEENM

SEQ ID NO: 102118 - protein, 8 aa, Dengue virus
QVLEENMD

SEQ ID NO: 102119 - protein, 8 aa, Dengue virus
VLEENMDV

SEQ ID NO: 102120 - protein, 8 aa, Dengue virus
LEENMDVE

SEQ ID NO: 102121 - protein, 8 aa, Dengue virus
EENMDVEI

SEQ ID NO: 102122 - protein, 8 aa, Dengue virus
ENMDVEIW

SEQ ID NO: 102123 - protein, 8 aa, Dengue virus
NMDVEIWT

SEQ ID NO: 102124 - protein, 8 aa, Dengue virus
MDVEIWTK

SEQ ID NO: 102125 - protein, 8 aa, Dengue virus
DVEIWTKE

SEQ ID NO: 102126 - protein, 8 aa, Dengue virus
VEIWTKEG

SEQ ID NO: 102127 - protein, 8 aa, Dengue virus
ERKKLRPR

SEQ ID NO: 102128 - protein, 8 aa, Dengue virus
RKKLRPRW

SEQ ID NO: 102129 - protein, 8 aa, Dengue virus
KKLRPRWL

SEQ ID NO: 102130 - protein, 8 aa, Dengue virus
KLRPRWLD

SEQ ID NO: 102131 - protein, 8 aa, Dengue virus
LRPRWLDA

SEQ ID NO: 102132 - protein, 8 aa, Dengue virus
RPRWLDAR

SEQ ID NO: 102133 - protein, 8 aa, Dengue virus
PRWLDART

SEQ ID NO: 102134 - protein, 8 aa, Dengue virus
RWLDARTY

SEQ ID NO: 102135 - protein, 8 aa, Dengue virus
WLDARTYS

SEQ ID NO: 102136 - protein, 8 aa, Dengue virus
LDARTYSD

SEQ ID NO: 102137 - protein, 8 aa, Dengue virus
DARTYSDP

SEQ ID NO: 102138 - protein, 8 aa, Dengue virus
ARTYSDPL

SEQ ID NO: 102139 - protein, 8 aa, Dengue virus
RTYSDPLA

SEQ ID NO: 102140 - protein, 8 aa, Dengue virus
TYSDPLAL

SEQ ID NO: 102141 - protein, 8 aa, Dengue virus
YSDPLALK

SEQ ID NO: 102142 - protein, 8 aa, Dengue virus
SDPLALKE

SEQ ID NO: 102143 - protein, 8 aa, Dengue virus
DPLALKEF

SEQ ID NO: 102144 - protein, 8 aa, Dengue virus
PLALKEFK

SEQ ID NO: 102145 - protein, 8 aa, Dengue virus
LALREFKE

SEQ ID NO: 102146 - protein, 8 aa, Dengue virus
ALREFKEF

SEQ ID NO: 102147 - protein, 8 aa, Dengue virus
LREFKEFA

SEQ ID NO: 102148 - protein, 8 aa, Dengue virus
REFKEFAA

SEQ ID NO: 102149 - protein, 8 aa, Dengue virus
EFKEFAAG

SEQ ID NO: 102150 - protein, 8 aa, Dengue virus
FKEFAAGR

SEQ ID NO: 102151 - protein, 8 aa, Dengue virus
KEFAAGRR

SEQ ID NO: 102152 - protein, 8 aa, Dengue virus
EFAAGRRS

SEQ ID NO: 102153 - protein, 8 aa, Dengue virus
FAAGRRSV

SEQ ID NO: 102154 - protein, 8 aa, Dengue virus
AAGRRSVS

SEQ ID NO: 102155 - protein, 8 aa, Dengue virus
AGRRSVSG

SEQ ID NO: 102156 - protein, 8 aa, Dengue virus
GDLILEIG

SEQ ID NO: 102157 - protein, 8 aa, Dengue virus
DLILEIGK

SEQ ID NO: 102158 - protein, 8 aa, Dengue virus
LILEIGKL

SEQ ID NO: 102159 - protein, 8 aa, Dengue virus
ILEIGKLP

SEQ ID NO: 102160 - protein, 8 aa, Dengue virus
LEIGKLPQ

SEQ ID NO: 102161 - protein, 8 aa, Dengue virus
EIGKLPQH

SEQ ID NO: 102162 - protein, 8 aa, Dengue virus
IGKLPQHL

SEQ ID NO: 102163 - protein, 8 aa, Dengue virus
GKLPQHLT

SEQ ID NO: 102164 - protein, 8 aa, Dengue virus
QNALDNLV

SEQ ID NO: 102165 - protein, 8 aa, Dengue virus
NALDNLVM

SEQ ID NO: 102166 - protein, 8 aa, Dengue virus
ALDNLVML

SEQ ID NO: 102167 - protein, 8 aa, Dengue virus
LDNLVMLH

SEQ ID NO: 102168 - protein, 8 aa, Dengue virus
DNLVMLHN

SEQ ID NO: 102169 - protein, 8 aa, Dengue virus
NLVMLHNS

SEQ ID NO: 102170 - protein, 8 aa, Dengue virus
LVMLHNSE

SEQ ID NO: 102171 - protein, 8 aa, Dengue virus
AYRHAMEE

SEQ ID NO: 102172 - protein, 8 aa, Dengue virus
YRHAMEEL

SEQ ID NO: 102173 - protein, 8 aa, Dengue virus
RHAMEELP

SEQ ID NO: 102174 - protein, 8 aa, Dengue virus
HAMEELPD

SEQ ID NO: 102175 - protein, 8 aa, Dengue virus
AMEELPDT

SEQ ID NO: 102176 - protein, 8 aa, Dengue virus
MEELPDTI

SEQ ID NO: 102177 - protein, 8 aa, Dengue virus
EELPDTIE

SEQ ID NO: 102178 - protein, 8 aa, Dengue virus
ELPDTIET

SEQ ID NO: 102179 - protein, 8 aa, Dengue virus
LPDTIETL

SEQ ID NO: 102180 - protein, 8 aa, Dengue virus
PDTIETLM

SEQ ID NO: 102181 - protein, 8 aa, Dengue virus
DTIETLML

SEQ ID NO: 102182 - protein, 8 aa, Dengue virus
TIETLMLL

SEQ ID NO: 102183 - protein, 8 aa, Dengue virus
IETLMLLA

SEQ ID NO: 102184 - protein, 8 aa, Dengue virus
ETLMLLAL

SEQ ID NO: 102185 - protein, 8 aa, Dengue virus
TLMLLALI

SEQ ID NO: 102186 - protein, 8 aa, Dengue virus
LMLLALIA

SEQ ID NO: 102187 - protein, 8 aa, Dengue virus
LIAVLTGG

SEQ ID NO: 102188 - protein, 8 aa, Dengue virus
LTGGVTLF

SEQ ID NO: 102189 - protein, 8 aa, Dengue virus
TGGVTLFF

SEQ ID NO: 102190 - protein, 8 aa, Dengue virus
GVTLFFLS

SEQ ID NO: 102191 - protein, 8 aa, Dengue virus
GKTSIGLL

SEQ ID NO: 102192 - protein, 8 aa, Dengue virus
KTSIGLLC

SEQ ID NO: 102193 - protein, 8 aa, Dengue virus
TSIGLLCV

SEQ ID NO: 102194 - protein, 8 aa, Dengue virus
VEPHWIAA

SEQ ID NO: 102195 - protein, 8 aa, Dengue virus
EPHWIAAS

SEQ ID NO: 102196 - protein, 8 aa, Dengue virus
PHWIAASI

SEQ ID NO: 102197 - protein, 8 aa, Dengue virus
HWIAASII

SEQ ID NO: 102198 - protein, 8 aa, Dengue virus
WIAASIIL

SEQ ID NO: 102199 - protein, 8 aa, Dengue virus
IAASIILE

SEQ ID NO: 102200 - protein, 8 aa, Dengue virus
AASIILEF

SEQ ID NO: 102201 - protein, 8 aa, Dengue virus
ASIILEFF

SEQ ID NO: 102202 - protein, 8 aa, Dengue virus
SIILEFFL

SEQ ID NO: 102203 - protein, 8 aa, Dengue virus
IILEFFLM

SEQ ID NO: 102204 - protein, 8 aa, Dengue virus
ILEFFLMV

SEQ ID NO: 102205 - protein, 8 aa, Dengue virus
LEFFLMVL

SEQ ID NO: 102206 - protein, 8 aa, Dengue virus
EFFLMVLL

SEQ ID NO: 102207 - protein, 8 aa, Dengue virus
FFLMVLLI

SEQ ID NO: 102208 - protein, 8 aa, Dengue virus
FLMVLLIP

SEQ ID NO: 102209 - protein, 8 aa, Dengue virus
LMVLLIPE

SEQ ID NO: 102210 - protein, 8 aa, Dengue virus
MVLLIPEP

SEQ ID NO: 102211 - protein, 8 aa, Dengue virus
VLLIPEPE

SEQ ID NO: 102212 - protein, 8 aa, Dengue virus
LLIPEPEK

SEQ ID NO: 102213 - protein, 8 aa, Dengue virus
LIPEPEKQ

SEQ ID NO: 102214 - protein, 8 aa, Dengue virus
IPEPEKQR

SEQ ID NO: 102215 - protein, 8 aa, Dengue virus
PEPEKQRT

SEQ ID NO: 102216 - protein, 8 aa, Dengue virus
EPEKQRTP

SEQ ID NO: 102217 - protein, 8 aa, Dengue virus
PEKQRTPQ

SEQ ID NO: 102218 - protein, 8 aa, Dengue virus
EKQRTPQD

SEQ ID NO: 102219 - protein, 8 aa, Dengue virus
KQRTPQDN

SEQ ID NO: 102220 - protein, 8 aa, Dengue virus
QRTPQDNQ

SEQ ID NO: 102221 - protein, 8 aa, Dengue virus
RTPQDNQL

SEQ ID NO: 102222 - protein, 8 aa, Dengue virus
TPQDNQLA

SEQ ID NO: 102223 - protein, 8 aa, Dengue virus
PQDNQLAY

SEQ ID NO: 102224 - protein, 8 aa, Dengue virus
QDNQLAYV

SEQ ID NO: 102225 - protein, 8 aa, Dengue virus
DNQLAYVV

SEQ ID NO: 102226 - protein, 8 aa, Dengue virus
NQLAYVVI

SEQ ID NO: 102227 - protein, 8 aa, Dengue virus
QLAYVVIG

SEQ ID NO: 102228 - protein, 8 aa, Dengue virus
LAYVVIGL

SEQ ID NO: 102229 - protein, 8 aa, Dengue virus
AYVVIGLL

SEQ ID NO: 102230 - protein, 8 aa, Dengue virus
YVVIGLLF

SEQ ID NO: 102231 - protein, 8 aa, Dengue virus
VAANEMGL

SEQ ID NO: 102232 - protein, 8 aa, Dengue virus
AANEMGLL

SEQ ID NO: 102233 - protein, 8 aa, Dengue virus
ANEMGLLE

SEQ ID NO: 102234 - protein, 8 aa, Dengue virus
NEMGLLET

SEQ ID NO: 102235 - protein, 8 aa, Dengue virus
EMGLLETT

SEQ ID NO: 102236 - protein, 8 aa, Dengue virus
MGLLETTK

SEQ ID NO: 102237 - protein, 8 aa, Dengue virus
GLLETTKK

SEQ ID NO: 102238 - protein, 8 aa, Dengue virus
LLETTKKD

SEQ ID NO: 102239 - protein, 8 aa, Dengue virus
LETTKKDL

SEQ ID NO: 102240 - protein, 8 aa, Dengue virus
ETTKKDLG

SEQ ID NO: 102241 - protein, 8 aa, Dengue virus
LDVDLHPA

SEQ ID NO: 102242 - protein, 8 aa, Dengue virus
DVDLHPAS

SEQ ID NO: 102243 - protein, 8 aa, Dengue virus
VDLHPASA

SEQ ID NO: 102244 - protein, 8 aa, Dengue virus
DLHPASAW

SEQ ID NO: 102245 - protein, 8 aa, Dengue virus
LHPASAWT

SEQ ID NO: 102246 - protein, 8 aa, Dengue virus
HPASAWTL

SEQ ID NO: 102247 - protein, 8 aa, Dengue virus
PASAWTLY

SEQ ID NO: 102248 - protein, 8 aa, Dengue virus
ASAWTLYA

SEQ ID NO: 102249 - protein, 8 aa, Dengue virus
SAWTLYAV

SEQ ID NO: 102250 - protein, 8 aa, Dengue virus
AWTLYAVA

SEQ ID NO: 102251 - protein, 8 aa, Dengue virus
WTLYAVAT

SEQ ID NO: 102252 - protein, 8 aa, Dengue virus
TLYAVATT

SEQ ID NO: 102253 - protein, 8 aa, Dengue virus
LYAVATTI

SEQ ID NO: 102254 - protein, 8 aa, Dengue virus
YAVATTII

SEQ ID NO: 102255 - protein, 8 aa, Dengue virus
AVATTIIT

SEQ ID NO: 102256 - protein, 8 aa, Dengue virus
VATTIITP

SEQ ID NO: 102257 - protein, 8 aa, Dengue virus
ATTIITPM

SEQ ID NO: 102258 - protein, 8 aa, Dengue virus
ITPMMRHT

SEQ ID NO: 102259 - protein, 8 aa, Dengue virus
TPMMRHTI

SEQ ID NO: 102260 - protein, 8 aa, Dengue virus
PMMRHTIE

SEQ ID NO: 102261 - protein, 8 aa, Dengue virus
MMRHTIEN

SEQ ID NO: 102262 - protein, 8 aa, Dengue virus
MRHTIENT

SEQ ID NO: 102263 - protein, 8 aa, Dengue virus
RHTIENTT

SEQ ID NO: 102264 - protein, 8 aa, Dengue virus
HTIENTTA

SEQ ID NO: 102265 - protein, 8 aa, Dengue virus
TIENTTAN

SEQ ID NO: 102266 - protein, 8 aa, Dengue virus
IENTTANI

SEQ ID NO: 102267 - protein, 8 aa, Dengue virus
ENTTANIS

SEQ ID NO: 102268 - protein, 8 aa, Dengue virus
NTTANISL

SEQ ID NO: 102269 - protein, 8 aa, Dengue virus
TTANISLT

SEQ ID NO: 102270 - protein, 8 aa, Dengue virus
TANISLTA

SEQ ID NO: 102271 - protein, 8 aa, Dengue virus
ANISLTAI

SEQ ID NO: 102272 - protein, 8 aa, Dengue virus
NISLTAIA

SEQ ID NO: 102273 - protein, 8 aa, Dengue virus
ISLTAIAN

SEQ ID NO: 102274 - protein, 8 aa, Dengue virus
SLTAIANQ

SEQ ID NO: 102275 - protein, 8 aa, Dengue virus
LTAIANQA

SEQ ID NO: 102276 - protein, 8 aa, Dengue virus
TAIANQAA

SEQ ID NO: 102277 - protein, 8 aa, Dengue virus
AIANQAAI

SEQ ID NO: 102278 - protein, 8 aa, Dengue virus
IANQAAIL

SEQ ID NO: 102279 - protein, 8 aa, Dengue virus
ANQAAILM

SEQ ID NO: 102280 - protein, 8 aa, Dengue virus
NQAAILMG

SEQ ID NO: 102281 - protein, 8 aa, Dengue virus
QAAILMGL

SEQ ID NO: 102282 - protein, 8 aa, Dengue virus
AAILMGLD

SEQ ID NO: 102283 - protein, 8 aa, Dengue virus
AILMGLDK

SEQ ID NO: 102284 - protein, 8 aa, Dengue virus
ILMGLDKG

SEQ ID NO: 102285 - protein, 8 aa, Dengue virus
LMGLDKGW

SEQ ID NO: 102286 - protein, 8 aa, Dengue virus
MGLDKGWP

SEQ ID NO: 102287 - protein, 8 aa, Dengue virus
GLDKGWPI

SEQ ID NO: 102288 - protein, 8 aa, Dengue virus
LDKGWPIS

SEQ ID NO: 102289 - protein, 8 aa, Dengue virus
DKGWPISK

SEQ ID NO: 102290 - protein, 8 aa, Dengue virus
KGWPISKM

SEQ ID NO: 102291 - protein, 8 aa, Dengue virus
GWPISKMD

SEQ ID NO: 102292 - protein, 8 aa, Dengue virus
WPISKMDI

SEQ ID NO: 102293 - protein, 8 aa, Dengue virus
PISKMDIG

SEQ ID NO: 102294 - protein, 8 aa, Dengue virus
ISKMDIGV

SEQ ID NO: 102295 - protein, 8 aa, Dengue virus
SKMDIGVP

SEQ ID NO: 102296 - protein, 8 aa, Dengue virus
KMDIGVPL

SEQ ID NO: 102297 - protein, 8 aa, Dengue virus
MDIGVPLL

SEQ ID NO: 102298 - protein, 8 aa, Dengue virus
DIGVPLLA

SEQ ID NO: 102299 - protein, 8 aa, Dengue virus
IGVPLLAL

SEQ ID NO: 102300 - protein, 8 aa, Dengue virus
GVPLLALG

SEQ ID NO: 102301 - protein, 8 aa, Dengue virus
VPLLALGC

SEQ ID NO: 102302 - protein, 8 aa, Dengue virus
PLLALGCY

SEQ ID NO: 102303 - protein, 8 aa, Dengue virus
LLALGCYS

SEQ ID NO: 102304 - protein, 8 aa, Dengue virus
LALGCYSQ

SEQ ID NO: 102305 - protein, 8 aa, Dengue virus
ALGCYSQV

SEQ ID NO: 102306 - protein, 8 aa, Dengue virus
LGCYSQVN

SEQ ID NO: 102307 - protein, 8 aa, Dengue virus
GCYSQVNP

SEQ ID NO: 102308 - protein, 8 aa, Dengue virus
CYSQVNPL

SEQ ID NO: 102309 - protein, 8 aa, Dengue virus
YSQVNPLT

SEQ ID NO: 102310 - protein, 8 aa, Dengue virus
SQVNPLTL

SEQ ID NO: 102311 - protein, 8 aa, Dengue virus
QVNPLTLT

SEQ ID NO: 102312 - protein, 8 aa, Dengue virus
VNPLTLTA

SEQ ID NO: 102313 - protein, 8 aa, Dengue virus
NPLTLTAA

SEQ ID NO: 102314 - protein, 8 aa, Dengue virus
PLTLTAAV

SEQ ID NO: 102315 - protein, 8 aa, Dengue virus
LVAHYAII

SEQ ID NO: 102316 - protein, 8 aa, Dengue virus
VAHYAIIG

SEQ ID NO: 102317 - protein, 8 aa, Dengue virus
AHYAIIGP

SEQ ID NO: 102318 - protein, 8 aa, Dengue virus
HYAIIGPG

SEQ ID NO: 102319 - protein, 8 aa, Dengue virus
YAIIGPGL

SEQ ID NO: 102320 - protein, 8 aa, Dengue virus
AIIGPGLQ

SEQ ID NO: 102321 - protein, 8 aa, Dengue virus
IIGPGLQA

SEQ ID NO: 102322 - protein, 8 aa, Dengue virus
IGPGLQAK

SEQ ID NO: 102323 - protein, 8 aa, Dengue virus
GPGLQAKA

SEQ ID NO: 102324 - protein, 8 aa, Dengue virus
PGLQAKAT

SEQ ID NO: 102325 - protein, 8 aa, Dengue virus
GLQAKATR

SEQ ID NO: 102326 - protein, 8 aa, Dengue virus
LQAKATRE

SEQ ID NO: 102327 - protein, 8 aa, Dengue virus
QAKATREA

SEQ ID NO: 102328 - protein, 8 aa, Dengue virus
AKATREAQ

SEQ ID NO: 102329 - protein, 8 aa, Dengue virus
KATREAQK

SEQ ID NO: 102330 - protein, 8 aa, Dengue virus
ATREAQKR

SEQ ID NO: 102331 - protein, 8 aa, Dengue virus
TREAQKRT

SEQ ID NO: 102332 - protein, 8 aa, Dengue virus
REAQKRTA

SEQ ID NO: 102333 - protein, 8 aa, Dengue virus
EAQKRTAA

SEQ ID NO: 102334 - protein, 8 aa, Dengue virus
AQKRTAAG

SEQ ID NO: 102335 - protein, 8 aa, Dengue virus
QKRTAAGI

SEQ ID NO: 102336 - protein, 8 aa, Dengue virus
KRTAAGIM

SEQ ID NO: 102337 - protein, 8 aa, Dengue virus
RTAAGIMK

SEQ ID NO: 102338 - protein, 8 aa, Dengue virus
TAAGIMKN

SEQ ID NO: 102339 - protein, 8 aa, Dengue virus
AAGIMKNP

SEQ ID NO: 102340 - protein, 8 aa, Dengue virus
AGIMKNPT

SEQ ID NO: 102341 - protein, 8 aa, Dengue virus
GIMKNPTV

SEQ ID NO: 102342 - protein, 8 aa, Dengue virus
IMKNPTVD

SEQ ID NO: 102343 - protein, 8 aa, Dengue virus
MKNPTVDG

SEQ ID NO: 102344 - protein, 8 aa, Dengue virus
KNPTVDGI

SEQ ID NO: 102345 - protein, 8 aa, Dengue virus
NPTVDGIV

SEQ ID NO: 102346 - protein, 8 aa, Dengue virus
PTVDGIVA

SEQ ID NO: 102347 - protein, 8 aa, Dengue virus
TVDGIVAI

SEQ ID NO: 102348 - protein, 8 aa, Dengue virus
DGIVAIDL

SEQ ID NO: 102349 - protein, 8 aa, Dengue virus
VAIDLDPV

SEQ ID NO: 102350 - protein, 8 aa, Dengue virus
AIDLDPVV

SEQ ID NO: 102351 - protein, 8 aa, Dengue virus
IDLDPVVY

SEQ ID NO: 102352 - protein, 8 aa, Dengue virus
DLDPVVYD

SEQ ID NO: 102353 - protein, 8 aa, Dengue virus
PVVYDAKF

SEQ ID NO: 102354 - protein, 8 aa, Dengue virus
VVYDAKFE

SEQ ID NO: 102355 - protein, 8 aa, Dengue virus
VYDAKFEK

SEQ ID NO: 102356 - protein, 8 aa, Dengue virus
YDAKFEKQ

SEQ ID NO: 102357 - protein, 8 aa, Dengue virus
DAKFEKQL

SEQ ID NO: 102358 - protein, 8 aa, Dengue virus
AKFEKQLG

SEQ ID NO: 102359 - protein, 8 aa, Dengue virus
KFEKQLGQ

SEQ ID NO: 102360 - protein, 8 aa, Dengue virus
FEKQLGQV

SEQ ID NO: 102361 - protein, 8 aa, Dengue virus
EKQLGQVM

SEQ ID NO: 102362 - protein, 8 aa, Dengue virus
KQLGQVML

SEQ ID NO: 102363 - protein, 8 aa, Dengue virus
QLGQVMLL

SEQ ID NO: 102364 - protein, 8 aa, Dengue virus
LGQIMLLI

SEQ ID NO: 102365 - protein, 8 aa, Dengue virus
GQIMLLIL

SEQ ID NO: 102366 - protein, 8 aa, Dengue virus
QIMLLILC

SEQ ID NO: 102367 - protein, 8 aa, Dengue virus
IMLLILCT

SEQ ID NO: 102368 - protein, 8 aa, Dengue virus
LCTSQILL

SEQ ID NO: 102369 - protein, 8 aa, Dengue virus
CTSQILLM

SEQ ID NO: 102370 - protein, 8 aa, Dengue virus
TSQILLMR

SEQ ID NO: 102371 - protein, 8 aa, Dengue virus
SQILLMRT

SEQ ID NO: 102372 - protein, 8 aa, Dengue virus
QILLMRTT

SEQ ID NO: 102373 - protein, 8 aa, Dengue virus
ILLMRTTW

SEQ ID NO: 102374 - protein, 8 aa, Dengue virus
LLMRTTWA

SEQ ID NO: 102375 - protein, 8 aa, Dengue virus
LMRTTWAL

SEQ ID NO: 102376 - protein, 8 aa, Dengue virus
MRTTWALC

SEQ ID NO: 102377 - protein, 8 aa, Dengue virus
RTTWALCE

SEQ ID NO: 102378 - protein, 8 aa, Dengue virus
TTWALCES

SEQ ID NO: 102379 - protein, 8 aa, Dengue virus
TWALCESI

SEQ ID NO: 102380 - protein, 8 aa, Dengue virus
WALCEALT

SEQ ID NO: 102381 - protein, 8 aa, Dengue virus
ALCEALTL

SEQ ID NO: 102382 - protein, 8 aa, Dengue virus
LCEALTLA

SEQ ID NO: 102383 - protein, 8 aa, Dengue virus
CEALTLAT

SEQ ID NO: 102384 - protein, 8 aa, Dengue virus
EALTLATG

SEQ ID NO: 102385 - protein, 8 aa, Dengue virus
ALTLATGP

SEQ ID NO: 102386 - protein, 8 aa, Dengue virus
LTLATGPI

SEQ ID NO: 102387 - protein, 8 aa, Dengue virus
TLATGPLT

SEQ ID NO: 102388 - protein, 8 aa, Dengue virus
LATGPLTT

SEQ ID NO: 102389 - protein, 8 aa, Dengue virus
ATGPLTTL

SEQ ID NO: 102390 - protein, 8 aa, Dengue virus
TGPLTTLW

SEQ ID NO: 102391 - protein, 8 aa, Dengue virus
GPLTTLWE

SEQ ID NO: 102392 - protein, 8 aa, Dengue virus
PLTTLWEG

SEQ ID NO: 102393 - protein, 8 aa, Dengue virus
LTTLWEGS

SEQ ID NO: 102394 - protein, 8 aa, Dengue virus
TTLWEGSP

SEQ ID NO: 102395 - protein, 8 aa, Dengue virus
TLWEGSPG

SEQ ID NO: 102396 - protein, 8 aa, Dengue virus
LWEGSPGK

SEQ ID NO: 102397 - protein, 8 aa, Dengue virus
WEGSPGKF

SEQ ID NO: 102398 - protein, 8 aa, Dengue virus
EGSPGKFW

SEQ ID NO: 102399 - protein, 8 aa, Dengue virus
GSPGKFWN

SEQ ID NO: 102400 - protein, 8 aa, Dengue virus
SPGKFWNT

SEQ ID NO: 102401 - protein, 8 aa, Dengue virus
PGKFWNTT

SEQ ID NO: 102402 - protein, 8 aa, Dengue virus
GKFWNTTI

SEQ ID NO: 102403 - protein, 8 aa, Dengue virus
KFWNTTIA

SEQ ID NO: 102404 - protein, 8 aa, Dengue virus
FWNTTIAV

SEQ ID NO: 102405 - protein, 8 aa, Dengue virus
WNTTIAVS

SEQ ID NO: 102406 - protein, 8 aa, Dengue virus
NTTIAVSM

SEQ ID NO: 102407 - protein, 8 aa, Dengue virus
TTIAVSMA

SEQ ID NO: 102408 - protein, 8 aa, Dengue virus
TIAVSMAN

SEQ ID NO: 102409 - protein, 8 aa, Dengue virus
IAVSMANI

SEQ ID NO: 102410 - protein, 8 aa, Dengue virus
AVSMANIF

SEQ ID NO: 102411 - protein, 8 aa, Dengue virus
VSMANIFR

SEQ ID NO: 102412 - protein, 8 aa, Dengue virus
SMANIFRG

SEQ ID NO: 102413 - protein, 8 aa, Dengue virus
MANIFRGS

SEQ ID NO: 102414 - protein, 8 aa, Dengue virus
ANIFRGSY

SEQ ID NO: 102415 - protein, 8 aa, Dengue virus
NIFRGSYL

SEQ ID NO: 102416 - protein, 8 aa, Dengue virus
IFRGSYLA

SEQ ID NO: 102417 - protein, 8 aa, Dengue virus
FRGSYLAG

SEQ ID NO: 102418 - protein, 8 aa, Dengue virus
RGSYLAGA

SEQ ID NO: 102419 - protein, 8 aa, Dengue virus
GSYLAGAG

SEQ ID NO: 102420 - protein, 8 aa, Dengue virus
SYLAGAGL

SEQ ID NO: 102421 - protein, 8 aa, Dengue virus
YLAGAGLA

SEQ ID NO: 102422 - protein, 8 aa, Dengue virus
LAGAGLAF

SEQ ID NO: 102423 - protein, 8 aa, Dengue virus
AGAGLAFS

SEQ ID NO: 102424 - protein, 8 aa, Dengue virus
GAGLAFSL

SEQ ID NO: 102425 - protein, 8 aa, Dengue virus
AGLAFSLM

SEQ ID NO: 102426 - protein, 8 aa, Dengue virus
GLAFSLMK

SEQ ID NO: 102427 - protein, 8 aa, Dengue virus
LAFSLMKS

SEQ ID NO: 102428 - protein, 8 aa, Dengue virus
AFSLMKSL

SEQ ID NO: 102429 - protein, 8 aa, Dengue virus
QGETLGEK

SEQ ID NO: 102430 - protein, 8 aa, Dengue virus
GETLGEKW

SEQ ID NO: 102431 - protein, 8 aa, Dengue virus
ETLGEKWK

SEQ ID NO: 102432 - protein, 8 aa, Dengue virus
TLGEKWKR

SEQ ID NO: 102433 - protein, 8 aa, Dengue virus
LGEKWKRQ

SEQ ID NO: 102434 - protein, 8 aa, Dengue virus
GEKWKRQL

SEQ ID NO: 102435 - protein, 8 aa, Dengue virus
EKWKRQLN

SEQ ID NO: 102436 - protein, 8 aa, Dengue virus
SGIMEVDR

SEQ ID NO: 102437 - protein, 8 aa, Dengue virus
EVDRSEAK

SEQ ID NO: 102438 - protein, 8 aa, Dengue virus
VDRSEAKE

SEQ ID NO: 102439 - protein, 8 aa, Dengue virus
DRSEAKEG

SEQ ID NO: 102440 - protein, 8 aa, Dengue virus
RSEAKEGL

SEQ ID NO: 102441 - protein, 8 aa, Dengue virus
EAKEGLKR

SEQ ID NO: 102442 - protein, 8 aa, Dengue virus
AKEGLKRG

SEQ ID NO: 102443 - protein, 8 aa, Dengue virus
KEGLKRGE

SEQ ID NO: 102444 - protein, 8 aa, Dengue virus
EGLKRGET

SEQ ID NO: 102445 - protein, 8 aa, Dengue virus
TKHAVSRG

SEQ ID NO: 102446 - protein, 8 aa, Dengue virus
HHAVSRGS

SEQ ID NO: 102447 - protein, 8 aa, Dengue virus
HAVSRGSA

SEQ ID NO: 102448 - protein, 8 aa, Dengue virus
AVSRGSAK

SEQ ID NO: 102449 - protein, 8 aa, Dengue virus
VSRGSAKL

SEQ ID NO: 102450 - protein, 8 aa, Dengue virus
SRGTAKLR

SEQ ID NO: 102451 - protein, 8 aa, Dengue virus
RGTAKLRW

SEQ ID NO: 102452 - protein, 8 aa, Dengue virus
GTAKLRWF

SEQ ID NO: 102453 - protein, 8 aa, Dengue virus
TAKLRWFV

SEQ ID NO: 102454 - protein, 8 aa, Dengue virus
AKLRWFVE

SEQ ID NO: 102455 - protein, 8 aa, Dengue virus
KLRWFVER

SEQ ID NO: 102456 - protein, 8 aa, Dengue virus
LRWFVERN

SEQ ID NO: 102457 - protein, 8 aa, Dengue virus
RWFVERNL

SEQ ID NO: 102458 - protein, 8 aa, Dengue virus
WFVERNMV

SEQ ID NO: 102459 - protein, 8 aa, Dengue virus
PEGKVIDL

SEQ ID NO: 102460 - protein, 8 aa, Dengue virus
EGKVIDLG

SEQ ID NO: 102461 - protein, 8 aa, Dengue virus
GKVIDLGC

SEQ ID NO: 102462 - protein, 8 aa, Dengue virus
KVIDLGCG

SEQ ID NO: 102463 - protein, 8 aa, Dengue virus
VIDLGCGR

SEQ ID NO: 102464 - protein, 8 aa, Dengue virus
IDLGCGRG

SEQ ID NO: 102465 - protein, 8 aa, Dengue virus
DLGCGRGG

SEQ ID NO: 102466 - protein, 8 aa, Dengue virus
LGCGRGGW

SEQ ID NO: 102467 - protein, 8 aa, Dengue virus
GCGRGGWS

SEQ ID NO: 102468 - protein, 8 aa, Dengue virus
CGRGGWSY

SEQ ID NO: 102469 - protein, 8 aa, Dengue virus
GRGGWSYY

SEQ ID NO: 102470 - protein, 8 aa, Dengue virus
RGGWSYYC

SEQ ID NO: 102471 - protein, 8 aa, Dengue virus
GGWSYYCA

SEQ ID NO: 102472 - protein, 8 aa, Dengue virus
GWSYYCAG

SEQ ID NO: 102473 - protein, 8 aa, Dengue virus
WSYYCAGL

SEQ ID NO: 102474 - protein, 8 aa, Dengue virus
SYYCAGLK

SEQ ID NO: 102475 - protein, 8 aa, Dengue virus
YYCAGLKK

SEQ ID NO: 102476 - protein, 8 aa, Dengue virus
YCAGLKKV

SEQ ID NO: 102477 - protein, 8 aa, Dengue virus
CAGLKKVT

SEQ ID NO: 102478 - protein, 8 aa, Dengue virus
AGLKKVTE

SEQ ID NO: 102479 - protein, 8 aa, Dengue virus
GLKKVTEV

SEQ ID NO: 102480 - protein, 8 aa, Dengue virus
VTEVKGYT

SEQ ID NO: 102481 - protein, 8 aa, Dengue virus
TEVKGYTK

SEQ ID NO: 102482 - protein, 8 aa, Dengue virus
EVKGYTKG

SEQ ID NO: 102483 - protein, 8 aa, Dengue virus
VKGYTKGG

SEQ ID NO: 102484 - protein, 8 aa, Dengue virus
KGYTKGGP

SEQ ID NO: 102485 - protein, 8 aa, Dengue virus
GYTKGGPG

SEQ ID NO: 102486 - protein, 8 aa, Dengue virus
YTKGGPGH

SEQ ID NO: 102487 - protein, 8 aa, Dengue virus
TKGGPGHE

SEQ ID NO: 102488 - protein, 8 aa, Dengue virus
KGGPGHEE

SEQ ID NO: 102489 - protein, 8 aa, Dengue virus
GGPGHEEP

SEQ ID NO: 102490 - protein, 8 aa, Dengue virus
GPGHEEPI

SEQ ID NO: 102491 - protein, 8 aa, Dengue virus
PGHEEPIP

SEQ ID NO: 102492 - protein, 8 aa, Dengue virus
GHEEPIPM

SEQ ID NO: 102493 - protein, 8 aa, Dengue virus
HEEPIPMA

SEQ ID NO: 102494 - protein, 8 aa, Dengue virus
EEPIPMAT

SEQ ID NO: 102495 - protein, 8 aa, Dengue virus
EPIPMATY

SEQ ID NO: 102496 - protein, 8 aa, Dengue virus
PIPMATYG

SEQ ID NO: 102497 - protein, 8 aa, Dengue virus
IPMATYGW

SEQ ID NO: 102498 - protein, 8 aa, Dengue virus
PMSTYGWN

SEQ ID NO: 102499 - protein, 8 aa, Dengue virus
MATYGWNL

SEQ ID NO: 102500 - protein, 8 aa, Dengue virus
ATYGWNLV

SEQ ID NO: 102501 - protein, 8 aa, Dengue virus
TYGWNLVK

SEQ ID NO: 102502 - protein, 8 aa, Dengue virus
YGWNLVKL

SEQ ID NO: 102503 - protein, 8 aa, Dengue virus
GWNLVKLH

SEQ ID NO: 102504 - protein, 8 aa, Dengue virus
WNLVKLHS

SEQ ID NO: 102505 - protein, 8 aa, Dengue virus
NLVKLHSG

SEQ ID NO: 102506 - protein, 8 aa, Dengue virus
LHSGKDVF

SEQ ID NO: 102507 - protein, 8 aa, Dengue virus
HSGKDVFF

SEQ ID NO: 102508 - protein, 8 aa, Dengue virus
PPEKCDTL

SEQ ID NO: 102509 - protein, 8 aa, Dengue virus
PEKCDTLL

SEQ ID NO: 102510 - protein, 8 aa, Dengue virus
EKCDTLLC

SEQ ID NO: 102511 - protein, 8 aa, Dengue virus
KCDTLLCD

SEQ ID NO: 102512 - protein, 8 aa, Dengue virus
CDTLLCDI

SEQ ID NO: 102513 - protein, 8 aa, Dengue virus
DTLLCDIG

SEQ ID NO: 102514 - protein, 8 aa, Dengue virus
TLLCDIGE

SEQ ID NO: 102515 - protein, 8 aa, Dengue virus
LLCDIGES

SEQ ID NO: 102516 - protein, 8 aa, Dengue virus
LCDIGESS

SEQ ID NO: 102517 - protein, 8 aa, Dengue virus
CDIGESSP

SEQ ID NO: 102518 - protein, 8 aa, Dengue virus
DIGESSPN

SEQ ID NO: 102519 - protein, 8 aa, Dengue virus
IGESSPNP

SEQ ID NO: 102520 - protein, 8 aa, Dengue virus
GESSPNPT

SEQ ID NO: 102521 - protein, 8 aa, Dengue virus
ESSPNPTI

SEQ ID NO: 102522 - protein, 8 aa, Dengue virus
SSPNPTIE

SEQ ID NO: 102523 - protein, 8 aa, Dengue virus
SPNPTIEE

SEQ ID NO: 102524 - protein, 8 aa, Dengue virus
PNPTIEEG

SEQ ID NO: 102525 - protein, 8 aa, Dengue virus
NPTIEEGR

SEQ ID NO: 102526 - protein, 8 aa, Dengue virus
PTIEEGRT

SEQ ID NO: 102527 - protein, 8 aa, Dengue virus
TIEEGRTL

SEQ ID NO: 102528 - protein, 8 aa, Dengue virus
IEEGRTLR

SEQ ID NO: 102529 - protein, 8 aa, Dengue virus
EEGRTLRV

SEQ ID NO: 102530 - protein, 8 aa, Dengue virus
EGRTLRVL

SEQ ID NO: 102531 - protein, 8 aa, Dengue virus
GRTLRVLK

SEQ ID NO: 102532 - protein, 8 aa, Dengue virus
RTLRVLKM

SEQ ID NO: 102533 - protein, 8 aa, Dengue virus
TLRVLKMV

SEQ ID NO: 102534 - protein, 8 aa, Dengue virus
LRVLKMVE

SEQ ID NO: 102535 - protein, 8 aa, Dengue virus
RVLKMVEP

SEQ ID NO: 102536 - protein, 8 aa, Dengue virus
VLKMVEPW

SEQ ID NO: 102537 - protein, 8 aa, Dengue virus
LKMVEPWL

SEQ ID NO: 102538 - protein, 8 aa, Dengue virus
KMVEPWLR

SEQ ID NO: 102539 - protein, 8 aa, Dengue virus
QFCIKVLN

SEQ ID NO: 102540 - protein, 8 aa, Dengue virus
FCIKVLNP

SEQ ID NO: 102541 - protein, 8 aa, Dengue virus
CIKVLNPY

SEQ ID NO: 102542 - protein, 8 aa, Dengue virus
IKVLNPYM

SEQ ID NO: 102543 - protein, 8 aa, Dengue virus
KVLNPYMP

SEQ ID NO: 102544 - protein, 8 aa, Dengue virus
ILNPYMPS

SEQ ID NO: 102545 - protein, 8 aa, Dengue virus
LNPYMPSV

SEQ ID NO: 102546 - protein, 8 aa, Dengue virus
NPYMPSVV

SEQ ID NO: 102547 - protein, 8 aa, Dengue virus
PYMPSVVE

SEQ ID NO: 102548 - protein, 8 aa, Dengue virus
HGGMLVRN

SEQ ID NO: 102549 - protein, 8 aa, Dengue virus
GGMLVRNP

SEQ ID NO: 102550 - protein, 8 aa, Dengue virus
GMLVRNPL

SEQ ID NO: 102551 - protein, 8 aa, Dengue virus
MLVRNPLS

SEQ ID NO: 102552 - protein, 8 aa, Dengue virus
LVRNPLSR

SEQ ID NO: 102553 - protein, 8 aa, Dengue virus
VRNPLSRN

SEQ ID NO: 102554 - protein, 8 aa, Dengue virus
RNPLSRNS

SEQ ID NO: 102555 - protein, 8 aa, Dengue virus
NPLSRNST

SEQ ID NO: 102556 - protein, 8 aa, Dengue virus
PLSRNSTH

SEQ ID NO: 102557 - protein, 8 aa, Dengue virus
LSRNSTHE

SEQ ID NO: 102558 - protein, 8 aa, Dengue virus
SRNSTHEM

SEQ ID NO: 102559 - protein, 8 aa, Dengue virus
RNSTHEMY

SEQ ID NO: 102560 - protein, 8 aa, Dengue virus
NSTHEMYW

SEQ ID NO: 102561 - protein, 8 aa, Dengue virus
STHEMYWV

SEQ ID NO: 102562 - protein, 8 aa, Dengue virus
THEMYWVS

SEQ ID NO: 102563 - protein, 8 aa, Dengue virus
HEMYWVSC

SEQ ID NO: 102564 - protein, 8 aa, Dengue virus
EMYWVSCG

SEQ ID NO: 102565 - protein, 8 aa, Dengue virus
MYWVSCGT

SEQ ID NO: 102566 - protein, 8 aa, Dengue virus
YWVSCGTG

SEQ ID NO: 102567 - protein, 8 aa, Dengue virus
WVSCGTGN

SEQ ID NO: 102568 - protein, 8 aa, Dengue virus
VSCGTGNI

SEQ ID NO: 102569 - protein, 8 aa, Dengue virus
SCGTGNIV

SEQ ID NO: 102570 - protein, 8 aa, Dengue virus
GTGNIVSA

SEQ ID NO: 102571 - protein, 8 aa, Dengue virus
TGNIVSAV

SEQ ID NO: 102572 - protein, 8 aa, Dengue virus
GNIVSSVN

SEQ ID NO: 102573 - protein, 8 aa, Dengue virus
NIVSAVNM

SEQ ID NO: 102574 - protein, 8 aa, Dengue virus
IVSAVNMT

SEQ ID NO: 102575 - protein, 8 aa, Dengue virus
VSAVNMTS

SEQ ID NO: 102576 - protein, 8 aa, Dengue virus
SAVNMTSR

SEQ ID NO: 102577 - protein, 8 aa, Dengue virus
AVNMTSRM

SEQ ID NO: 102578 - protein, 8 aa, Dengue virus
VNMTSRML

SEQ ID NO: 102579 - protein, 8 aa, Dengue virus
NMTSRMLL

SEQ ID NO: 102580 - protein, 8 aa, Dengue virus
MTSRMLLN

SEQ ID NO: 102581 - protein, 8 aa, Dengue virus
TSRMLLNR

SEQ ID NO: 102582 - protein, 8 aa, Dengue virus
SRMLLNRF

SEQ ID NO: 102583 - protein, 8 aa, Dengue virus
RMLLNRFT

SEQ ID NO: 102584 - protein, 8 aa, Dengue virus
MLLNRFTM

SEQ ID NO: 102585 - protein, 8 aa, Dengue virus
LLNRFTMA

SEQ ID NO: 102586 - protein, 8 aa, Dengue virus
PTYERDVD

SEQ ID NO: 102587 - protein, 8 aa, Dengue virus
TYERDVDL

SEQ ID NO: 102588 - protein, 8 aa, Dengue virus
YERDVDLG

SEQ ID NO: 102589 - protein, 8 aa, Dengue virus
ERDVDLGA

SEQ ID NO: 102590 - protein, 8 aa, Dengue virus
RDVDLGAG

SEQ ID NO: 102591 - protein, 8 aa, Dengue virus
DVDLGAGT

SEQ ID NO: 102592 - protein, 8 aa, Dengue virus
VDLGAGTR

SEQ ID NO: 102593 - protein, 8 aa, Dengue virus
DLGAGTRH

SEQ ID NO: 102594 - protein, 8 aa, Dengue virus
LGAGTRHV

SEQ ID NO: 102595 - protein, 8 aa, Dengue virus
GAGTRHVA

SEQ ID NO: 102596 - protein, 8 aa, Dengue virus
AGTRHVAV

SEQ ID NO: 102597 - protein, 8 aa, Dengue virus
GTRHVAVE

SEQ ID NO: 102598 - protein, 8 aa, Dengue virus
ANLDIIGQ

SEQ ID NO: 102599 - protein, 8 aa, Dengue virus
NLDIIGQR

SEQ ID NO: 102600 - protein, 8 aa, Dengue virus
LDIIGQRI

SEQ ID NO: 102601 - protein, 8 aa, Dengue virus
DIIGQRIE

SEQ ID NO: 102602 - protein, 8 aa, Dengue virus
IIGQRIEN

SEQ ID NO: 102603 - protein, 8 aa, Dengue virus
IGQRIENI

SEQ ID NO: 102604 - protein, 8 aa, Dengue virus
GQRIENIK

SEQ ID NO: 102605 - protein, 8 aa, Dengue virus
STWHYDED

SEQ ID NO: 102606 - protein, 8 aa, Dengue virus
TWHYDEDN

SEQ ID NO: 102607 - protein, 8 aa, Dengue virus
WHYDEDNP

SEQ ID NO: 102608 - protein, 8 aa, Dengue virus
HYDEDNPY

SEQ ID NO: 102609 - protein, 8 aa, Dengue virus
YDEDNPYK

SEQ ID NO: 102610 - protein, 8 aa, Dengue virus
DEDNPYKT

SEQ ID NO: 102611 - protein, 8 aa, Dengue virus
EDNPYKTW

SEQ ID NO: 102612 - protein, 8 aa, Dengue virus
DNPYKTWA

SEQ ID NO: 102613 - protein, 8 aa, Dengue virus
NPYKTWAY

SEQ ID NO: 102614 - protein, 8 aa, Dengue virus
PYKTWAYH

SEQ ID NO: 102615 - protein, 8 aa, Dengue virus
YKTWAYHG

SEQ ID NO: 102616 - protein, 8 aa, Dengue virus
KTWAYHGS

SEQ ID NO: 102617 - protein, 8 aa, Dengue virus
TWAYHGSY

SEQ ID NO: 102618 - protein, 8 aa, Dengue virus
WAYHGSYE

SEQ ID NO: 102619 - protein, 8 aa, Dengue virus
AYHGSYEV

SEQ ID NO: 102620 - protein, 8 aa, Dengue virus
YHGSYEVK

SEQ ID NO: 102621 - protein, 8 aa, Dengue virus
HGSYEVKP

SEQ ID NO: 102622 - protein, 8 aa, Dengue virus
GSYEVKPS

SEQ ID NO: 102623 - protein, 8 aa, Dengue virus
SYEVKPSG

SEQ ID NO: 102624 - protein, 8 aa, Dengue virus
YEVKPSGS

SEQ ID NO: 102625 - protein, 8 aa, Dengue virus
EVKPSGSA

SEQ ID NO: 102626 - protein, 8 aa, Dengue virus
VKPSGSAS

SEQ ID NO: 102627 - protein, 8 aa, Dengue virus
KPSGSASS

SEQ ID NO: 102628 - protein, 8 aa, Dengue virus
PSGSASSM

SEQ ID NO: 102629 - protein, 8 aa, Dengue virus
SGSASSMV

SEQ ID NO: 102630 - protein, 8 aa, Dengue virus
GSASSMVN

SEQ ID NO: 102631 - protein, 8 aa, Dengue virus
SASSMVNG

SEQ ID NO: 102632 - protein, 8 aa, Dengue virus
ASSMVNGV

SEQ ID NO: 102633 - protein, 8 aa, Dengue virus
SSMVNGVV

SEQ ID NO: 102634 - protein, 8 aa, Dengue virus
SMVNGVVR

SEQ ID NO: 102635 - protein, 8 aa, Dengue virus
MVNGVVRL

SEQ ID NO: 102636 - protein, 8 aa, Dengue virus
VNGVVRLL

SEQ ID NO: 102637 - protein, 8 aa, Dengue virus
NGVVKLLT

SEQ ID NO: 102638 - protein, 8 aa, Dengue virus
GVVKLLTK

SEQ ID NO: 102639 - protein, 8 aa, Dengue virus
VVKLLTKP

SEQ ID NO: 102640 - protein, 8 aa, Dengue virus
VKLLTKPW

SEQ ID NO: 102641 - protein, 8 aa, Dengue virus
KLLTKPWD

SEQ ID NO: 102642 - protein, 8 aa, Dengue virus
LLTKPWDV

SEQ ID NO: 102643 - protein, 8 aa, Dengue virus
LTKPWDVI

SEQ ID NO: 102644 - protein, 8 aa, Dengue virus
TKPWDVIP

SEQ ID NO: 102645 - protein, 8 aa, Dengue virus
KPWDVIPM

SEQ ID NO: 102646 - protein, 8 aa, Dengue virus
PWDVIPMV

SEQ ID NO: 102647 - protein, 8 aa, Dengue virus
WDVIPMVT

SEQ ID NO: 102648 - protein, 8 aa, Dengue virus
DVIPMVTQ

SEQ ID NO: 102649 - protein, 8 aa, Dengue virus
PMVTQIAM

SEQ ID NO: 102650 - protein, 8 aa, Dengue virus
MVTQIAMT

SEQ ID NO: 102651 - protein, 8 aa, Dengue virus
VTQMAMTD

SEQ ID NO: 102652 - protein, 8 aa, Dengue virus
TQMAMTDT

SEQ ID NO: 102653 - protein, 8 aa, Dengue virus
QMAMTDTT

SEQ ID NO: 102654 - protein, 8 aa, Dengue virus
MAMTDTTP

SEQ ID NO: 102655 - protein, 8 aa, Dengue virus
AMTDTTPF

SEQ ID NO: 102656 - protein, 8 aa, Dengue virus
MTDTTPFG

SEQ ID NO: 102657 - protein, 8 aa, Dengue virus
TDTTPFGQ

SEQ ID NO: 102658 - protein, 8 aa, Dengue virus
DTTPFGQQ

SEQ ID NO: 102659 - protein, 8 aa, Dengue virus
TTPFGQQR

SEQ ID NO: 102660 - protein, 8 aa, Dengue virus
TPFGQQRV

SEQ ID NO: 102661 - protein, 8 aa, Dengue virus
PFGQQRVF

SEQ ID NO: 102662 - protein, 8 aa, Dengue virus
FGQQRVFK

SEQ ID NO: 102663 - protein, 8 aa, Dengue virus
GQQRVFKE

SEQ ID NO: 102664 - protein, 8 aa, Dengue virus
QQRVFKEK

SEQ ID NO: 102665 - protein, 8 aa, Dengue virus
QRVFKEKV

SEQ ID NO: 102666 - protein, 8 aa, Dengue virus
RVFKEKVD

SEQ ID NO: 102667 - protein, 8 aa, Dengue virus
VFKEKVDT

SEQ ID NO: 102668 - protein, 8 aa, Dengue virus
FKEKVDTR

SEQ ID NO: 102669 - protein, 8 aa, Dengue virus
KEKVDTRT

SEQ ID NO: 102670 - protein, 8 aa, Dengue virus
EKVDTRTP

SEQ ID NO: 102671 - protein, 8 aa, Dengue virus
KVDTRTPK

SEQ ID NO: 102672 - protein, 8 aa, Dengue virus
PRICTREE

SEQ ID NO: 102673 - protein, 8 aa, Dengue virus
RICTREEF

SEQ ID NO: 102674 - protein, 8 aa, Dengue virus
CTREEFTR

SEQ ID NO: 102675 - protein, 8 aa, Dengue virus
TREEFTRK

SEQ ID NO: 102676 - protein, 8 aa, Dengue virus
REEFTRKV

SEQ ID NO: 102677 - protein, 8 aa, Dengue virus
EEFTRKVR

SEQ ID NO: 102678 - protein, 8 aa, Dengue virus
RKVRSNAA

SEQ ID NO: 102679 - protein, 8 aa, Dengue virus
KVRSNAAI

SEQ ID NO: 102680 - protein, 8 aa, Dengue virus
VRSNAAIG

SEQ ID NO: 102681 - protein, 8 aa, Dengue virus
RSNAAIGA

SEQ ID NO: 102682 - protein, 8 aa, Dengue virus
SNAAIGAV

SEQ ID NO: 102683 - protein, 8 aa, Dengue virus
NAAIGAVF

SEQ ID NO: 102684 - protein, 8 aa, Dengue virus
AAIGAVFV

SEQ ID NO: 102685 - protein, 8 aa, Dengue virus
AIGAVFVD

SEQ ID NO: 102686 - protein, 8 aa, Dengue virus
IGAVFVDE

SEQ ID NO: 102687 - protein, 8 aa, Dengue virus
GAVFVDEN

SEQ ID NO: 102688 - protein, 8 aa, Dengue virus
AVFVDENQ

SEQ ID NO: 102689 - protein, 8 aa, Dengue virus
VFVDENQW

SEQ ID NO: 102690 - protein, 8 aa, Dengue virus
FVDENQWN

SEQ ID NO: 102691 - protein, 8 aa, Dengue virus
VDENQWNS

SEQ ID NO: 102692 - protein, 8 aa, Dengue virus
DENQWNSA

SEQ ID NO: 102693 - protein, 8 aa, Dengue virus
ENQWNSAK

SEQ ID NO: 102694 - protein, 8 aa, Dengue virus
NQWNSAKE

SEQ ID NO: 102695 - protein, 8 aa, Dengue virus
QWNSAKEA

SEQ ID NO: 102696 - protein, 8 aa, Dengue virus
WNSAKEAV

SEQ ID NO: 102697 - protein, 8 aa, Dengue virus
NSAKEAVE

SEQ ID NO: 102698 - protein, 8 aa, Dengue virus
SAKEAVED

SEQ ID NO: 102699 - protein, 8 aa, Dengue virus
ERELHKQG

SEQ ID NO: 102700 - protein, 8 aa, Dengue virus
RELHKQGK

SEQ ID NO: 102701 - protein, 8 aa, Dengue virus
ELHKQGKC

SEQ ID NO: 102702 - protein, 8 aa, Dengue virus
LHKQGKCA

SEQ ID NO: 102703 - protein, 8 aa, Dengue virus
HKQGKCAT

SEQ ID NO: 102704 - protein, 8 aa, Dengue virus
KQGKCATC

SEQ ID NO: 102705 - protein, 8 aa, Dengue virus
QGKCATCV

SEQ ID NO: 102706 - protein, 8 aa, Dengue virus
GKCATCVY

SEQ ID NO: 102707 - protein, 8 aa, Dengue virus
KCATCVYN

SEQ ID NO: 102708 - protein, 8 aa, Dengue virus
CATCVYNM

SEQ ID NO: 102709 - protein, 8 aa, Dengue virus
ATCVYNMM

SEQ ID NO: 102710 - protein, 8 aa, Dengue virus
TCVYNMMG

SEQ ID NO: 102711 - protein, 8 aa, Dengue virus
CVYNMMGK

SEQ ID NO: 102712 - protein, 8 aa, Dengue virus
VYNMMGKR

SEQ ID NO: 102713 - protein, 8 aa, Dengue virus
YNMMGKRE

SEQ ID NO: 102714 - protein, 8 aa, Dengue virus
NMMGKREK

SEQ ID NO: 102715 - protein, 8 aa, Dengue virus
MMGKREKK

SEQ ID NO: 102716 - protein, 8 aa, Dengue virus
MGKREKKL

SEQ ID NO: 102717 - protein, 8 aa, Dengue virus
GKREKKLG

SEQ ID NO: 102718 - protein, 8 aa, Dengue virus
KREKKLGE

SEQ ID NO: 102719 - protein, 8 aa, Dengue virus
REKKLGEF

SEQ ID NO: 102720 - protein, 8 aa, Dengue virus
EKKLGEFG

SEQ ID NO: 102721 - protein, 8 aa, Dengue virus
KKLGEFGK

SEQ ID NO: 102722 - protein, 8 aa, Dengue virus
KLGEFGKA

SEQ ID NO: 102723 - protein, 8 aa, Dengue virus
LGEFGKAK

SEQ ID NO: 102724 - protein, 8 aa, Dengue virus
GEFGKAKG

SEQ ID NO: 102725 - protein, 8 aa, Dengue virus
EFGKAKGS

SEQ ID NO: 102726 - protein, 8 aa, Dengue virus
FGKAKGSR

SEQ ID NO: 102727 - protein, 8 aa, Dengue virus
GKAKGSRA

SEQ ID NO: 102728 - protein, 8 aa, Dengue virus
KAKGSRAI

SEQ ID NO: 102729 - protein, 8 aa, Dengue virus
AKGSRAIW

SEQ ID NO: 102730 - protein, 8 aa, Dengue virus
KGSRAIWY

SEQ ID NO: 102731 - protein, 8 aa, Dengue virus
GSRAIWYM

SEQ ID NO: 102732 - protein, 8 aa, Dengue virus
SRAIWYMW

SEQ ID NO: 102733 - protein, 8 aa, Dengue virus
RAIWYMWL

SEQ ID NO: 102734 - protein, 8 aa, Dengue virus
AIWYMWLG

SEQ ID NO: 102735 - protein, 8 aa, Dengue virus
IWYMWLGA

SEQ ID NO: 102736 - protein, 8 aa, Dengue virus
WYMWLGAR

SEQ ID NO: 102737 - protein, 8 aa, Dengue virus
YMWLGARF

SEQ ID NO: 102738 - protein, 8 aa, Dengue virus
MWLGARFL

SEQ ID NO: 102739 - protein, 8 aa, Dengue virus
WLGARFLE

SEQ ID NO: 102740 - protein, 8 aa, Dengue virus
LGARFLEF

SEQ ID NO: 102741 - protein, 8 aa, Dengue virus
GARFLEFE

SEQ ID NO: 102742 - protein, 8 aa, Dengue virus
ARFLEFEA

SEQ ID NO: 102743 - protein, 8 aa, Dengue virus
RFLEFEAL

SEQ ID NO: 102744 - protein, 8 aa, Dengue virus
FLEFEALG

SEQ ID NO: 102745 - protein, 8 aa, Dengue virus
LEFEALGF

SEQ ID NO: 102746 - protein, 8 aa, Dengue virus
EFEALGFL

SEQ ID NO: 102747 - protein, 8 aa, Dengue virus
FEALGFLN

SEQ ID NO: 102748 - protein, 8 aa, Dengue virus
EALGFLNE

SEQ ID NO: 102749 - protein, 8 aa, Dengue virus
ALGFLNED

SEQ ID NO: 102750 - protein, 8 aa, Dengue virus
LGFLNEDH

SEQ ID NO: 102751 - protein, 8 aa, Dengue virus
GFLNEDHW

SEQ ID NO: 102752 - protein, 8 aa, Dengue virus
FLNEDHWF

SEQ ID NO: 102753 - protein, 8 aa, Dengue virus
LNEDHWFS

SEQ ID NO: 102754 - protein, 8 aa, Dengue virus
NEDHWFSR

SEQ ID NO: 102755 - protein, 8 aa, Dengue virus
EDHWFSRE

SEQ ID NO: 102756 - protein, 8 aa, Dengue virus
DHWFSREN

SEQ ID NO: 102757 - protein, 8 aa, Dengue virus
HWFSRENS

SEQ ID NO: 102758 - protein, 8 aa, Dengue virus
WFSRENSL

SEQ ID NO: 102759 - protein, 8 aa, Dengue virus
FSRENSLS

SEQ ID NO: 102760 - protein, 8 aa, Dengue virus
SRENSLSG

SEQ ID NO: 102761 - protein, 8 aa, Dengue virus
RENSLSGV

SEQ ID NO: 102762 - protein, 8 aa, Dengue virus
ENSLSGVE

SEQ ID NO: 102763 - protein, 8 aa, Dengue virus
NSLSGVEG

SEQ ID NO: 102764 - protein, 8 aa, Dengue virus
SLSGVEGE

SEQ ID NO: 102765 - protein, 8 aa, Dengue virus
LSGVEGEG

SEQ ID NO: 102766 - protein, 8 aa, Dengue virus
SGVEGEGL

SEQ ID NO: 102767 - protein, 8 aa, Dengue virus
GVEGEGLH

SEQ ID NO: 102768 - protein, 8 aa, Dengue virus
VEGEGLHK

SEQ ID NO: 102769 - protein, 8 aa, Dengue virus
EGEGLHKL

SEQ ID NO: 102770 - protein, 8 aa, Dengue virus
GEGLHKLG

SEQ ID NO: 102771 - protein, 8 aa, Dengue virus
EGLHKLGY

SEQ ID NO: 102772 - protein, 8 aa, Dengue virus
GLHKLGYI

SEQ ID NO: 102773 - protein, 8 aa, Dengue virus
LHKLGYIL

SEQ ID NO: 102774 - protein, 8 aa, Dengue virus
HKLGYILR

SEQ ID NO: 102775 - protein, 8 aa, Dengue virus
KLGYILRD

SEQ ID NO: 102776 - protein, 8 aa, Dengue virus
LGYILRDI

SEQ ID NO: 102777 - protein, 8 aa, Dengue virus
GGAMYADD

SEQ ID NO: 102778 - protein, 8 aa, Dengue virus
GAMYADDT

SEQ ID NO: 102779 - protein, 8 aa, Dengue virus
AMYADDTA

SEQ ID NO: 102780 - protein, 8 aa, Dengue virus
MYADDTAG

SEQ ID NO: 102781 - protein, 8 aa, Dengue virus
YADDTAGW

SEQ ID NO: 102782 - protein, 8 aa, Dengue virus
ADDTAGWD

SEQ ID NO: 102783 - protein, 8 aa, Dengue virus
DDTAGWDT

SEQ ID NO: 102784 - protein, 8 aa, Dengue virus
DTAGWDTR

SEQ ID NO: 102785 - protein, 8 aa, Dengue virus
TAGWDTRI

SEQ ID NO: 102786 - protein, 8 aa, Dengue virus
AGWDTRIT

SEQ ID NO: 102787 - protein, 8 aa, Dengue virus
GWDTRITE

SEQ ID NO: 102788 - protein, 8 aa, Dengue virus
WDTRITED

SEQ ID NO: 102789 - protein, 8 aa, Dengue virus
DTRITEDD

SEQ ID NO: 102790 - protein, 8 aa, Dengue virus
TRITEDDL

SEQ ID NO: 102791 - protein, 8 aa, Dengue virus
AIFKLTYQ

SEQ ID NO: 102792 - protein, 8 aa, Dengue virus
IFKLTYQN

SEQ ID NO: 102793 - protein, 8 aa, Dengue virus
FKLTYQNK

SEQ ID NO: 102794 - protein, 8 aa, Dengue virus
KLTYQNKV

SEQ ID NO: 102795 - protein, 8 aa, Dengue virus
LTYQNKVV

SEQ ID NO: 102796 - protein, 8 aa, Dengue virus
TYQNKVVR

SEQ ID NO: 102797 - protein, 8 aa, Dengue virus
YQNKVVRV

SEQ ID NO: 102798 - protein, 8 aa, Dengue virus
QNKVVRVQ

SEQ ID NO: 102799 - protein, 8 aa, Dengue virus
NKVVRVQR

SEQ ID NO: 102800 - protein, 8 aa, Dengue virus
KVVRVQRP

SEQ ID NO: 102801 - protein, 8 aa, Dengue virus
VVRVQRPA

SEQ ID NO: 102802 - protein, 8 aa, Dengue virus
VRVQRPAK

SEQ ID NO: 102803 - protein, 8 aa, Dengue virus
GTVMDIIS

SEQ ID NO: 102804 - protein, 8 aa, Dengue virus
TVMDIISR

SEQ ID NO: 102805 - protein, 8 aa, Dengue virus
VMDVISRR

SEQ ID NO: 102806 - protein, 8 aa, Dengue virus
MDVISRRD

SEQ ID NO: 102807 - protein, 8 aa, Dengue virus
DVISRRDQ

SEQ ID NO: 102808 - protein, 8 aa, Dengue virus
VISRRDQR

SEQ ID NO: 102809 - protein, 8 aa, Dengue virus
ISRRDQRG

SEQ ID NO: 102810 - protein, 8 aa, Dengue virus
SRRDQRGS

SEQ ID NO: 102811 - protein, 8 aa, Dengue virus
RRDQRGSG

SEQ ID NO: 102812 - protein, 8 aa, Dengue virus
RDQRGSGQ

SEQ ID NO: 102813 - protein, 8 aa, Dengue virus
DQRGSGQV

SEQ ID NO: 102814 - protein, 8 aa, Dengue virus
QRGSGQVG

SEQ ID NO: 102815 - protein, 8 aa, Dengue virus
RGSGQVGT

SEQ ID NO: 102816 - protein, 8 aa, Dengue virus
GSGQVGTY

SEQ ID NO: 102817 - protein, 8 aa, Dengue virus
SGQVGTYG

SEQ ID NO: 102818 - protein, 8 aa, Dengue virus
GQVGTYGL

SEQ ID NO: 102819 - protein, 8 aa, Dengue virus
QVGTYGLN

SEQ ID NO: 102820 - protein, 8 aa, Dengue virus
VGTYGLNT

SEQ ID NO: 102821 - protein, 8 aa, Dengue virus
FTNMEAQL

SEQ ID NO: 102822 - protein, 8 aa, Dengue virus
TNMEAQLI

SEQ ID NO: 102823 - protein, 8 aa, Dengue virus
NMEAQLIR

SEQ ID NO: 102824 - protein, 8 aa, Dengue virus
MEAQLIRQ

SEQ ID NO: 102825 - protein, 8 aa, Dengue virus
EAQLIRQM

SEQ ID NO: 102826 - protein, 8 aa, Dengue virus
AQLIRQME

SEQ ID NO: 102827 - protein, 8 aa, Dengue virus
QLIRQMES

SEQ ID NO: 102828 - protein, 8 aa, Dengue virus
LIRQMESE

SEQ ID NO: 102829 - protein, 8 aa, Dengue virus
IRQMESEG

SEQ ID NO: 102830 - protein, 8 aa, Dengue virus
RQMESEGI

SEQ ID NO: 102831 - protein, 8 aa, Dengue virus
ERLKRMAI

SEQ ID NO: 102832 - protein, 8 aa, Dengue virus
RLKRMAIS

SEQ ID NO: 102833 - protein, 8 aa, Dengue virus
LKRMAISG

SEQ ID NO: 102834 - protein, 8 aa, Dengue virus
KRMAISGD

SEQ ID NO: 102835 - protein, 8 aa, Dengue virus
RMAISGDD

SEQ ID NO: 102836 - protein, 8 aa, Dengue virus
MAISGDDC

SEQ ID NO: 102837 - protein, 8 aa, Dengue virus
AISGDDCV

SEQ ID NO: 102838 - protein, 8 aa, Dengue virus
ISGDDCVV

SEQ ID NO: 102839 - protein, 8 aa, Dengue virus
SGDDCVVK

SEQ ID NO: 102840 - protein, 8 aa, Dengue virus
GDDCVVKP

SEQ ID NO: 102841 - protein, 8 aa, Dengue virus
DDCVVKPI
